United States Patent 7,888,497 (BIOINFORMATICALLY DETECTABLE GROUP OF NOVEL REGULATORY OLIGONUCLEOTIDES AND USES THEREOF) - sequence listing, part 157

SEQ ID NO: 6659421 - DNA, 21 bp, Homo sapiens
atagtatgtgacttttctgat

SEQ ID NO: 6659422 - DNA, 14 bp, Homo sapiens
atagtattcatttt

SEQ ID NO: 6659423 - DNA, 19 bp, Homo sapiens
atagtattccaatcactgt

SEQ ID NO: 6659424 - DNA, 16 bp, Homo sapiens
atagtattcttcttcc

SEQ ID NO: 6659425 - DNA, 15 bp, Homo sapiens
atagtattgaaagtg

SEQ ID NO: 6659426 - DNA, 20 bp, Homo sapiens
atagtattgctgaactctta

SEQ ID NO: 6659427 - DNA, 13 bp, Homo sapiens
atagtatttaatt

SEQ ID NO: 6659428 - DNA, 19 bp, Homo sapiens
atagtatttaattgtttca

SEQ ID NO: 6659429 - DNA, 19 bp, Homo sapiens
atagtatttctcctttgca

SEQ ID NO: 6659430 - DNA, 13 bp, Homo sapiens
atagtatttgaaa

SEQ ID NO: 6659431 - DNA, 16 bp, Homo sapiens
atagtatttttatcca

SEQ ID NO: 6659432 - DNA, 19 bp, Homo sapiens
atagtcaaaccataaactt

SEQ ID NO: 6659433 - DNA, 14 bp, Homo sapiens
atagtcaagacgaa

SEQ ID NO: 6659434 - DNA, 21 bp, Homo sapiens
atagtcaagacgaacatgtag

SEQ ID NO: 6659435 - DNA, 14 bp, Homo sapiens
atagtcacaaaaat

SEQ ID NO: 6659436 - DNA, 18 bp, Homo sapiens
atagtcacaaaaatggtg

SEQ ID NO: 6659437 - DNA, 21 bp, Homo sapiens
atagtcacaaaaatggtggtt

SEQ ID NO: 6659438 - DNA, 14 bp, Homo sapiens
atagtcacaagagc

SEQ ID NO: 6659439 - DNA, 15 bp, Homo sapiens
atagtcacctgctgg

SEQ ID NO: 6659440 - DNA, 23 bp, Homo sapiens
atagtcaccttttaaatcctgtt

SEQ ID NO: 6659441 - DNA, 17 bp, Homo sapiens
atagtcatatgtgaaga

SEQ ID NO: 6659442 - DNA, 22 bp, Homo sapiens
atagtcattctgcctgccctga

SEQ ID NO: 6659443 - DNA, 16 bp, Homo sapiens
atagtccaatatttgg

SEQ ID NO: 6659444 - DNA, 17 bp, Homo sapiens
atagtccaatatttggc

SEQ ID NO: 6659445 - DNA, 12 bp, Homo sapiens
atagtcccagca

SEQ ID NO: 6659446 - DNA, 21 bp, Homo sapiens
atagtccccatcagcaccatg

SEQ ID NO: 6659447 - DNA, 13 bp, Homo sapiens
atagtcgggcata

SEQ ID NO: 6659448 - DNA, 21 bp, Homo sapiens
atagtcgtgaatcttgttcaa

SEQ ID NO: 6659449 - DNA, 21 bp, Homo sapiens
atagtctaagactatatatat

SEQ ID NO: 6659450 - DNA, 15 bp, Homo sapiens
atagtctcaaatcaa

SEQ ID NO: 6659451 - DNA, 20 bp, Homo sapiens
atagtctcattgccaaggca

SEQ ID NO: 6659452 - DNA, 23 bp, Homo sapiens
atagtctctacctatagaaatgt

SEQ ID NO: 6659453 - DNA, 14 bp, Homo sapiens
atagtctctttaaa

SEQ ID NO: 6659454 - DNA, 20 bp, Homo sapiens
atagtctgattttaatgaaa

SEQ ID NO: 6659455 - DNA, 13 bp, Homo sapiens
atagtctgtgtga

SEQ ID NO: 6659456 - DNA, 18 bp, Homo sapiens
atagtcttagtaatagca

SEQ ID NO: 6659457 - DNA, 21 bp, Homo sapiens
atagtcttcagtttcattttc

SEQ ID NO: 6659458 - DNA, 17 bp, Homo sapiens
atagtcttttgcatgtc

SEQ ID NO: 6659459 - DNA, 20 bp, Homo sapiens
atagtgacaagtgaagaaca

SEQ ID NO: 6659460 - DNA, 23 bp, Homo sapiens
atagtgactagcactagacatgt

SEQ ID NO: 6659461 - DNA, 18 bp, Homo sapiens
atagtgactatgaacttc

SEQ ID NO: 6659462 - DNA, 18 bp, Homo sapiens
atagtgacttttcaagta

SEQ ID NO: 6659463 - DNA, 14 bp, Homo sapiens
atagtgagacactg

SEQ ID NO: 6659464 - DNA, 19 bp, Homo sapiens
atagtgagagaggaggcct

SEQ ID NO: 6659465 - DNA, 16 bp, Homo sapiens
atagtgagttgcatgt

SEQ ID NO: 6659466 - DNA, 22 bp, Homo sapiens
atagtgatttccttaatgaaaa

SEQ ID NO: 6659467 - DNA, 19 bp, Homo sapiens
atagtgcaaaactgtgtca

SEQ ID NO: 6659468 - DNA, 15 bp, Homo sapiens
atagtgcaactgttt

SEQ ID NO: 6659469 - DNA, 18 bp, Homo sapiens
atagtgcaatatattttg

SEQ ID NO: 6659470 - DNA, 17 bp, Homo sapiens
atagtgcacaaaatgaa

SEQ ID NO: 6659471 - DNA, 22 bp, Homo sapiens
atagtgcctaaaattgtatgaa

SEQ ID NO: 6659472 - DNA, 19 bp, Homo sapiens
atagtgcctaaagtgctgc

SEQ ID NO: 6659473 - DNA, 12 bp, Homo sapiens
atagtgcctcag

SEQ ID NO: 6659474 - DNA, 14 bp, Homo sapiens
atagtgcctcagcg

SEQ ID NO: 6659475 - DNA, 20 bp, Homo sapiens
atagtgcctcagcgctgccc

SEQ ID NO: 6659476 - DNA, 13 bp, Homo sapiens
atagtgcctctgc

SEQ ID NO: 6659477 - DNA, 21 bp, Homo sapiens
atagtgctaacatgaagacct

SEQ ID NO: 6659478 - DNA, 23 bp, Homo sapiens
atagtgctacctgcacctctgga

SEQ ID NO: 6659479 - DNA, 15 bp, Homo sapiens
atagtgctatatata

SEQ ID NO: 6659480 - DNA, 20 bp, Homo sapiens
atagtgctatatatataaat

SEQ ID NO: 6659481 - DNA, 20 bp, Homo sapiens
atagtgctgggatggagggg

SEQ ID NO: 6659482 - DNA, 22 bp, Homo sapiens
atagtgctgggatggaggggag

SEQ ID NO: 6659483 - DNA, 14 bp, Homo sapiens
atagtgcttgctgg

SEQ ID NO: 6659484 - DNA, 15 bp, Homo sapiens
atagtggaaaaacac

SEQ ID NO: 6659485 - DNA, 15 bp, Homo sapiens
atagtggaacatttt

SEQ ID NO: 6659486 - DNA, 19 bp, Homo sapiens
atagtggaccacttggaaa

SEQ ID NO: 6659487 - DNA, 23 bp, Homo sapiens
atagtggatggacagatggacca

SEQ ID NO: 6659488 - DNA, 17 bp, Homo sapiens
atagtggcataccaaat

SEQ ID NO: 6659489 - DNA, 16 bp, Homo sapiens
atagtgggaccacata

SEQ ID NO: 6659490 - DNA, 22 bp, Homo sapiens
atagtgggccctccgacagccc

SEQ ID NO: 6659491 - DNA, 17 bp, Homo sapiens
atagtggttcttggaaa

SEQ ID NO: 6659492 - DNA, 14 bp, Homo sapiens
atagtgtaaaataa

SEQ ID NO: 6659493 - DNA, 16 bp, Homo sapiens
atagtgtaaacaaata

SEQ ID NO: 6659494 - DNA, 18 bp, Homo sapiens
atagtgtaaacaaataat

SEQ ID NO: 6659495 - DNA, 14 bp, Homo sapiens
atagtgtaagaact

SEQ ID NO: 6659496 - DNA, 13 bp, Homo sapiens
atagtgtaataat

SEQ ID NO: 6659497 - DNA, 17 bp, Homo sapiens
atagtgtaggctttact

SEQ ID NO: 6659498 - DNA, 20 bp, Homo sapiens
atagtgtaggctttacttag

SEQ ID NO: 6659499 - DNA, 19 bp, Homo sapiens
atagtgtataccacctgta

SEQ ID NO: 6659500 - DNA, 23 bp, Homo sapiens
atagtgtataccacctgtacata

SEQ ID NO: 6659501 - DNA, 20 bp, Homo sapiens
atagtgtcctatgcaataaa

SEQ ID NO: 6659502 - DNA, 12 bp, Homo sapiens
atagtgtctttg

SEQ ID NO: 6659503 - DNA, 14 bp, Homo sapiens
atagtgtgaaatat

SEQ ID NO: 6659504 - DNA, 12 bp, Homo sapiens
atagtgtgattt

SEQ ID NO: 6659505 - DNA, 13 bp, Homo sapiens
atagtgtgatttt

SEQ ID NO: 6659506 - DNA, 19 bp, Homo sapiens
atagtgtgctcggacacag

SEQ ID NO: 6659507 - DNA, 23 bp, Homo sapiens
atagtgtggaaattaagaagaaa

SEQ ID NO: 6659508 - DNA, 15 bp, Homo sapiens
atagtgtgttctgat

SEQ ID NO: 6659509 - DNA, 17 bp, Homo sapiens
atagtgtgttctgatta

SEQ ID NO: 6659510 - DNA, 21 bp, Homo sapiens
atagtgtgttctgattagaaa

SEQ ID NO: 6659511 - DNA, 16 bp, Homo sapiens
atagtgttaatcaatt

SEQ ID NO: 6659512 - DNA, 18 bp, Homo sapiens
atagtgttaatcaattta

SEQ ID NO: 6659513 - DNA, 17 bp, Homo sapiens
atagtgttattgagaga

SEQ ID NO: 6659514 - DNA, 17 bp, Homo sapiens
atagtgttcacaaactg

SEQ ID NO: 6659515 - DNA, 20 bp, Homo sapiens
atagtgttcacaaactgtga

SEQ ID NO: 6659516 - DNA, 21 bp, Homo sapiens
atagtgttcacaaactgtgaa

SEQ ID NO: 6659517 - DNA, 22 bp, Homo sapiens
atagtgttctgcaaaaatattt

SEQ ID NO: 6659518 - DNA, 18 bp, Homo sapiens
atagtgttctgctcctgc

SEQ ID NO: 6659519 - DNA, 19 bp, Homo sapiens
atagtgttctgctcctgct

SEQ ID NO: 6659520 - DNA, 20 bp, Homo sapiens
atagtgttctgctcctgctt

SEQ ID NO: 6659521 - DNA, 23 bp, Homo sapiens
atagtgttctgctcctgcttttc

SEQ ID NO: 6659522 - DNA, 16 bp, Homo sapiens
atagtgtttaactggc

SEQ ID NO: 6659523 - DNA, 20 bp, Homo sapiens
atagttaaaaattaaatatt

SEQ ID NO: 6659524 - DNA, 19 bp, Homo sapiens
atagttaaaagactgcagc

SEQ ID NO: 6659525 - DNA, 13 bp, Homo sapiens
atagttaaactga

SEQ ID NO: 6659526 - DNA, 16 bp, Homo sapiens
atagttaaactgagag

SEQ ID NO: 6659527 - DNA, 14 bp, Homo sapiens
atagttaagcaaat

SEQ ID NO: 6659528 - DNA, 18 bp, Homo sapiens
atagttaagcaaatttca

SEQ ID NO: 6659529 - DNA, 15 bp, Homo sapiens
atagttaatattttg

SEQ ID NO: 6659530 - DNA, 21 bp, Homo sapiens
atagttaatgaaggtgtgcta

SEQ ID NO: 6659531 - DNA, 15 bp, Homo sapiens
atagttacatttatg

SEQ ID NO: 6659532 - DNA, 20 bp, Homo sapiens
atagttactccagtgccaac

SEQ ID NO: 6659533 - DNA, 15 bp, Homo sapiens
atagttactgtaaaa

SEQ ID NO: 6659534 - DNA, 12 bp, Homo sapiens
atagttactgtg

SEQ ID NO: 6659535 - DNA, 16 bp, Homo sapiens
atagttactgtgtaaa

SEQ ID NO: 6659536 - DNA, 17 bp, Homo sapiens
atagttactgtgtaatt

SEQ ID NO: 6659537 - DNA, 18 bp, Homo sapiens
atagttactgtgtaatta

SEQ ID NO: 6659538 - DNA, 20 bp, Homo sapiens
atagttactgtgtaattagt

SEQ ID NO: 6659539 - DNA, 15 bp, Homo sapiens
atagttagaacctgg

SEQ ID NO: 6659540 - DNA, 14 bp, Homo sapiens
atagttagattcca

SEQ ID NO: 6659541 - DNA, 14 bp, Homo sapiens
atagttagccctca

SEQ ID NO: 6659542 - DNA, 15 bp, Homo sapiens
atagttatacatcaa

SEQ ID NO: 6659543 - DNA, 20 bp, Homo sapiens
atagttatacatcttcatta

SEQ ID NO: 6659544 - DNA, 15 bp, Homo sapiens
atagttatatagata

SEQ ID NO: 6659545 - DNA, 15 bp, Homo sapiens
atagttatatgtaca

SEQ ID NO: 6659546 - DNA, 15 bp, Homo sapiens
atagttatgtaaata

SEQ ID NO: 6659547 - DNA, 17 bp, Homo sapiens
atagttatgtaaataat

SEQ ID NO: 6659548 - DNA, 17 bp, Homo sapiens
atagttattattgctgt

SEQ ID NO: 6659549 - DNA, 13 bp, Homo sapiens
atagttattctat

SEQ ID NO: 6659550 - DNA, 14 bp, Homo sapiens
atagttcaggattt

SEQ ID NO: 6659551 - DNA, 15 bp, Homo sapiens
atagttcagtagaat

SEQ ID NO: 6659552 - DNA, 12 bp, Homo sapiens
atagttccattc

SEQ ID NO: 6659553 - DNA, 16 bp, Homo sapiens
atagttcctaagaagc

SEQ ID NO: 6659554 - DNA, 23 bp, Homo sapiens
atagttcctaagaagcttctaat

SEQ ID NO: 6659555 - DNA, 15 bp, Homo sapiens
atagttcctgctaaa

SEQ ID NO: 6659556 - DNA, 17 bp, Homo sapiens
atagttccttgccttaa

SEQ ID NO: 6659557 - DNA, 23 bp, Homo sapiens
atagttccttgccttaataaata

SEQ ID NO: 6659558 - DNA, 14 bp, Homo sapiens
atagttctagacat

SEQ ID NO: 6659559 - DNA, 23 bp, Homo sapiens
atagttctagacatggaggttct

SEQ ID NO: 6659560 - DNA, 14 bp, Homo sapiens
atagttctatttct

SEQ ID NO: 6659561 - DNA, 16 bp, Homo sapiens
atagttctatttctat

SEQ ID NO: 6659562 - DNA, 19 bp, Homo sapiens
atagttctgtaataaaact

SEQ ID NO: 6659563 - DNA, 16 bp, Homo sapiens
atagttctgttaaata

SEQ ID NO: 6659564 - DNA, 19 bp, Homo sapiens
atagttctgttaaatattt

SEQ ID NO: 6659565 - DNA, 12 bp, Homo sapiens
atagttgaaagt

SEQ ID NO: 6659566 - DNA, 15 bp, Homo sapiens
atagttgaaagtaaa

SEQ ID NO: 6659567 - DNA, 16 bp, Homo sapiens
atagttgaacaagatt

SEQ ID NO: 6659568 - DNA, 12 bp, Homo sapiens
atagttgaatta

SEQ ID NO: 6659569 - DNA, 21 bp, Homo sapiens
atagttgaattagtgagtata

SEQ ID NO: 6659570 - DNA, 20 bp, Homo sapiens
atagttgagccagcagacat

SEQ ID NO: 6659571 - DNA, 13 bp, Homo sapiens
atagttgagcccc

SEQ ID NO: 6659572 - DNA, 21 bp, Homo sapiens
atagttgcagcccaaggacag

SEQ ID NO: 6659573 - DNA, 18 bp, Homo sapiens
atagttgccttttcttcc

SEQ ID NO: 6659574 - DNA, 19 bp, Homo sapiens
atagttgctccgcctctgc

SEQ ID NO: 6659575 - DNA, 20 bp, Homo sapiens
atagttgctcttctacacta

SEQ ID NO: 6659576 - DNA, 20 bp, Homo sapiens
atagttgctgtccccttcca

SEQ ID NO: 6659577 - DNA, 15 bp, Homo sapiens
atagttgcttttgaa

SEQ ID NO: 6659578 - DNA, 21 bp, Homo sapiens
atagttgcttttgaaggaata

SEQ ID NO: 6659579 - DNA, 20 bp, Homo sapiens
atagttggaaatatttgcgt

SEQ ID NO: 6659580 - DNA, 15 bp, Homo sapiens
atagttgtaaagata

SEQ ID NO: 6659581 - DNA, 23 bp, Homo sapiens
atagttgtaaagatattgtatct

SEQ ID NO: 6659582 - DNA, 14 bp, Homo sapiens
atagttgtattttg

SEQ ID NO: 6659583 - DNA, 15 bp, Homo sapiens
atagttgtcagaata

SEQ ID NO: 6659584 - DNA, 19 bp, Homo sapiens
atagttgtccatattttca

SEQ ID NO: 6659585 - DNA, 17 bp, Homo sapiens
atagttgtggacattta

SEQ ID NO: 6659586 - DNA, 17 bp, Homo sapiens
atagtttaaaaatattc

SEQ ID NO: 6659587 - DNA, 21 bp, Homo sapiens
atagtttaaaaatctgccacc

SEQ ID NO: 6659588 - DNA, 15 bp, Homo sapiens
atagtttaaagggag

SEQ ID NO: 6659589 - DNA, 13 bp, Homo sapiens
atagtttacacac

SEQ ID NO: 6659590 - DNA, 17 bp, Homo sapiens
atagtttacctgaataa

SEQ ID NO: 6659591 - DNA, 22 bp, Homo sapiens
atagtttactattttacttcta

SEQ ID NO: 6659592 - DNA, 14 bp, Homo sapiens
atagtttaggaaaa

SEQ ID NO: 6659593 - DNA, 15 bp, Homo sapiens
atagtttaggaaaat

SEQ ID NO: 6659594 - DNA, 20 bp, Homo sapiens
atagtttatcttatactcct

SEQ ID NO: 6659595 - DNA, 14 bp, Homo sapiens
atagtttattgaca

SEQ ID NO: 6659596 - DNA, 13 bp, Homo sapiens
atagtttatttct

SEQ ID NO: 6659597 - DNA, 22 bp, Homo sapiens
atagtttatttctgtgaaagaa

SEQ ID NO: 6659598 - DNA, 13 bp, Homo sapiens
atagtttctaaac

SEQ ID NO: 6659599 - DNA, 13 bp, Homo sapiens
atagtttctgagg

SEQ ID NO: 6659600 - DNA, 19 bp, Homo sapiens
atagtttctttattttgtg

SEQ ID NO: 6659601 - DNA, 23 bp, Homo sapiens
atagtttggatatgtaaaacatt

SEQ ID NO: 6659602 - DNA, 20 bp, Homo sapiens
atagtttgggcttcagccta

SEQ ID NO: 6659603 - DNA, 22 bp, Homo sapiens
atagtttgggcttcagcctagt

SEQ ID NO: 6659604 - DNA, 20 bp, Homo sapiens
atagtttgggggaacttgta

SEQ ID NO: 6659605 - DNA, 15 bp, Homo sapiens
atagtttgtacatgc

SEQ ID NO: 6659606 - DNA, 17 bp, Homo sapiens
atagtttgtctatttta

SEQ ID NO: 6659607 - DNA, 17 bp, Homo sapiens
atagttttaaactcatt

SEQ ID NO: 6659608 - DNA, 15 bp, Homo sapiens
atagttttactttta

SEQ ID NO: 6659609 - DNA, 22 bp, Homo sapiens
atagttttacttttaaactgtg

SEQ ID NO: 6659610 - DNA, 23 bp, Homo sapiens
atagttttacttttaaactgtgt

SEQ ID NO: 6659611 - DNA, 17 bp, Homo sapiens
atagttttataaaactc

SEQ ID NO: 6659612 - DNA, 16 bp, Homo sapiens
atagttttatttatat

SEQ ID NO: 6659613 - DNA, 20 bp, Homo sapiens
atagttttcgataaaggata

SEQ ID NO: 6659614 - DNA, 16 bp, Homo sapiens
atagttttctaaatgt

SEQ ID NO: 6659615 - DNA, 17 bp, Homo sapiens
atagttttctaaatgtt

SEQ ID NO: 6659616 - DNA, 21 bp, Homo sapiens
atagttttctaaatgtttctt

SEQ ID NO: 6659617 - DNA, 12 bp, Homo sapiens
atagttttctcc

SEQ ID NO: 6659618 - DNA, 20 bp, Homo sapiens
atagttttcttcctttgaaa

SEQ ID NO: 6659619 - DNA, 22 bp, Homo sapiens
atagttttgatgactggcattt

SEQ ID NO: 6659620 - DNA, 21 bp, Homo sapiens
atagttttgctttgttgaata

SEQ ID NO: 6659621 - DNA, 23 bp, Homo sapiens
atagttttgtaagtaacaatatg

SEQ ID NO: 6659622 - DNA, 23 bp, Homo sapiens
atagttttttctttcccatgtat

SEQ ID NO: 6659623 - DNA, 21 bp, Homo sapiens
atataaaaaaattgtaaatgt

SEQ ID NO: 6659624 - DNA, 14 bp, Homo sapiens
atataaaaaacttt

SEQ ID NO: 6659625 - DNA, 13 bp, Homo sapiens
atataaaaaatat

SEQ ID NO: 6659626 - DNA, 14 bp, Homo sapiens
atataaaaaatata

SEQ ID NO: 6659627 - DNA, 16 bp, Homo sapiens
atataaaaaatatatg

SEQ ID NO: 6659628 - DNA, 20 bp, Homo sapiens
atataaaaaatatatgtaat

SEQ ID NO: 6659629 - DNA, 14 bp, Homo sapiens
atataaaaaatgtt

SEQ ID NO: 6659630 - DNA, 13 bp, Homo sapiens
atataaaaacaaa

SEQ ID NO: 6659631 - DNA, 14 bp, Homo sapiens
atataaaaacaaca

SEQ ID NO: 6659632 - DNA, 20 bp, Homo sapiens
atataaaaacaacaaatact

SEQ ID NO: 6659633 - DNA, 13 bp, Homo sapiens
atataaaaacaat

SEQ ID NO: 6659634 - DNA, 18 bp, Homo sapiens
atataaaaacagattctg

SEQ ID NO: 6659635 - DNA, 21 bp, Homo sapiens
atataaaaacagattctgatt

SEQ ID NO: 6659636 - DNA, 14 bp, Homo sapiens
atataaaaacattt

SEQ ID NO: 6659637 - DNA, 17 bp, Homo sapiens
atataaaaacatttgta

SEQ ID NO: 6659638 - DNA, 18 bp, Homo sapiens
atataaaaacatttgtaa

SEQ ID NO: 6659639 - DNA, 23 bp, Homo sapiens
atataaaaaccccaaactgttga

SEQ ID NO: 6659640 - DNA, 20 bp, Homo sapiens
atataaaaagaaaagataaa

SEQ ID NO: 6659641 - DNA, 14 bp, Homo sapiens
atataaaaagcagc

SEQ ID NO: 6659642 - DNA, 18 bp, Homo sapiens
atataaaaagcagcagag

SEQ ID NO: 6659643 - DNA, 20 bp, Homo sapiens
atataaaaataattaaaaca

SEQ ID NO: 6659644 - DNA, 14 bp, Homo sapiens
atataaaaatatat

SEQ ID NO: 6659645 - DNA, 21 bp, Homo sapiens
atataaaaatatatgttgaat

SEQ ID NO: 6659646 - DNA, 15 bp, Homo sapiens
atataaaacagtcat

SEQ ID NO: 6659647 - DNA, 16 bp, Homo sapiens
atataaaacagtcatg

SEQ ID NO: 6659648 - DNA, 16 bp, Homo sapiens
atataaaactgaaata

SEQ ID NO: 6659649 - DNA, 22 bp, Homo sapiens
atataaaactgtacttcactgt

SEQ ID NO: 6659650 - DNA, 13 bp, Homo sapiens
atataaaacttaa

SEQ ID NO: 6659651 - DNA, 23 bp, Homo sapiens
atataaaagaaatatatctgtga

SEQ ID NO: 6659652 - DNA, 16 bp, Homo sapiens
atataaaagactgacc

SEQ ID NO: 6659653 - DNA, 15 bp, Homo sapiens
atataaaagatatat

SEQ ID NO: 6659654 - DNA, 21 bp, Homo sapiens
atataaaaggcaaatgtgtac

SEQ ID NO: 6659655 - DNA, 23 bp, Homo sapiens
atataaaaggcaaatgtgtacat

SEQ ID NO: 6659656 - DNA, 19 bp, Homo sapiens
atataaaagtctgagttct

SEQ ID NO: 6659657 - DNA, 21 bp, Homo sapiens
atataaaagttgcgtttaagt

SEQ ID NO: 6659658 - DNA, 11 bp, Homo sapiens
atataaaataa

SEQ ID NO: 6659659 - DNA, 12 bp, Homo sapiens
atataaaataaa

SEQ ID NO: 6659660 - DNA, 18 bp, Homo sapiens
atataaaataaaaagtca

SEQ ID NO: 6659661 - DNA, 20 bp, Homo sapiens
atataaaataaatatactaa

SEQ ID NO: 6659662 - DNA, 12 bp, Homo sapiens
atataaaataac

SEQ ID NO: 6659663 - DNA, 12 bp, Homo sapiens
atataaaataat

SEQ ID NO: 6659664 - DNA, 21 bp, Homo sapiens
atataaaatacacgtgtatat

SEQ ID NO: 6659665 - DNA, 15 bp, Homo sapiens
atataaaatacataa

SEQ ID NO: 6659666 - DNA, 13 bp, Homo sapiens
atataaaatatat

SEQ ID NO: 6659667 - DNA, 18 bp, Homo sapiens
atataaaatatatttatg

SEQ ID NO: 6659668 - DNA, 19 bp, Homo sapiens
atataaaatatatttatga

SEQ ID NO: 6659669 - DNA, 17 bp, Homo sapiens
atataaaatatctatat

SEQ ID NO: 6659670 - DNA, 14 bp, Homo sapiens
atataaaatatgaa

SEQ ID NO: 6659671 - DNA, 12 bp, Homo sapiens
atataaaatgcc

SEQ ID NO: 6659672 - DNA, 19 bp, Homo sapiens
atataaaatgtattcaagc

SEQ ID NO: 6659673 - DNA, 13 bp, Homo sapiens
atataaaatgtgg

SEQ ID NO: 6659674 - DNA, 15 bp, Homo sapiens
atataaaatgtttca

SEQ ID NO: 6659675 - DNA, 13 bp, Homo sapiens
atataaaatttca

SEQ ID NO: 6659676 - DNA, 22 bp, Homo sapiens
atataaaatttcagggaaaaca

SEQ ID NO: 6659677 - DNA, 15 bp, Homo sapiens
atataaaatttctgg

SEQ ID NO: 6659678 - DNA, 13 bp, Homo sapiens
atataaacactat

SEQ ID NO: 6659679 - DNA, 15 bp, Homo sapiens
atataaacactatat

SEQ ID NO: 6659680 - DNA, 23 bp, Homo sapiens
atataaacatatttttatacttt

SEQ ID NO: 6659681 - DNA, 15 bp, Homo sapiens
atataaacattttat

SEQ ID NO: 6659682 - DNA, 14 bp, Homo sapiens
atataaacctaaaa

SEQ ID NO: 6659683 - DNA, 20 bp, Homo sapiens
atataaacctaaaaaagata

SEQ ID NO: 6659684 - DNA, 21 bp, Homo sapiens
atataaacctaaaaaagatat

SEQ ID NO: 6659685 - DNA, 18 bp, Homo sapiens
atataaacgatatatgta

SEQ ID NO: 6659686 - DNA, 12 bp, Homo sapiens
atataaactgta

SEQ ID NO: 6659687 - DNA, 13 bp, Homo sapiens
atataaactgtga

SEQ ID NO: 6659688 - DNA, 14 bp, Homo sapiens
atataaactgtgag

SEQ ID NO: 6659689 - DNA, 15 bp, Homo sapiens
atataaacttaaaat

SEQ ID NO: 6659690 - DNA, 13 bp, Homo sapiens
atataaacttgtg

SEQ ID NO: 6659691 - DNA, 23 bp, Homo sapiens
atataaacttgtgtatgatccaa

SEQ ID NO: 6659692 - DNA, 20 bp, Homo sapiens
atataaagaaaatcaatgaa

SEQ ID NO: 6659693 - DNA, 13 bp, Homo sapiens
atataaagaatat

SEQ ID NO: 6659694 - DNA, 13 bp, Homo sapiens
atataaagaatga

SEQ ID NO: 6659695 - DNA, 20 bp, Homo sapiens
atataaagacaacaaaagaa

SEQ ID NO: 6659696 - DNA, 18 bp, Homo sapiens
atataaagcttaataaaa

SEQ ID NO: 6659697 - DNA, 13 bp, Homo sapiens
atataaaggaaaa

SEQ ID NO: 6659698 - DNA, 20 bp, Homo sapiens
atataaaggaccctgtttct

SEQ ID NO: 6659699 - DNA, 16 bp, Homo sapiens
atataaaggttatgaa

SEQ ID NO: 6659700 - DNA, 22 bp, Homo sapiens
atataaagttttatatattata

SEQ ID NO: 6659701 - DNA, 22 bp, Homo sapiens
atataaagtttttttatttctt

SEQ ID NO: 6659702 - DNA, 17 bp, Homo sapiens
atataaataaatatata

SEQ ID NO: 6659703 - DNA, 12 bp, Homo sapiens
atataaataagc

SEQ ID NO: 6659704 - DNA, 13 bp, Homo sapiens
atataaataagct

SEQ ID NO: 6659705 - DNA, 15 bp, Homo sapiens
atataaatactgaca

SEQ ID NO: 6659706 - DNA, 21 bp, Homo sapiens
atataaatactgacaatgtat

SEQ ID NO: 6659707 - DNA, 23 bp, Homo sapiens
atataaatagatgatttcaatag

SEQ ID NO: 6659708 - DNA, 20 bp, Homo sapiens
atataaatagctgaaaacta

SEQ ID NO: 6659709 - DNA, 15 bp, Homo sapiens
atataaatatatata

SEQ ID NO: 6659710 - DNA, 21 bp, Homo sapiens
atataaatatatataaatata

SEQ ID NO: 6659711 - DNA, 19 bp, Homo sapiens
atataaatatcacaaagtt

SEQ ID NO: 6659712 - DNA, 10 bp, Homo sapiens
atataaatca

SEQ ID NO: 6659713 - DNA, 19 bp, Homo sapiens
atataaatcaatcttatta

SEQ ID NO: 6659714 - DNA, 20 bp, Homo sapiens
atataaatcacagatttcca

SEQ ID NO: 6659715 - DNA, 13 bp, Homo sapiens
atataaatcttac

SEQ ID NO: 6659716 - DNA, 13 bp, Homo sapiens
atataaatgaagt

SEQ ID NO: 6659717 - DNA, 14 bp, Homo sapiens
atataaatgaagta

SEQ ID NO: 6659718 - DNA, 16 bp, Homo sapiens
atataaatgaagtatt

SEQ ID NO: 6659719 - DNA, 14 bp, Homo sapiens
atataaatgaatga

SEQ ID NO: 6659720 - DNA, 15 bp, Homo sapiens
atataaatgaatgaa

SEQ ID NO: 6659721 - DNA, 20 bp, Homo sapiens
atataaatgacattattaaa

SEQ ID NO: 6659722 - DNA, 17 bp, Homo sapiens
atataaatgcaaataac

SEQ ID NO: 6659723 - DNA, 18 bp, Homo sapiens
atataaatgcaaataaca

SEQ ID NO: 6659724 - DNA, 22 bp, Homo sapiens
atataaatgcaatattaatgcc

SEQ ID NO: 6659725 - DNA, 15 bp, Homo sapiens
atataaatgcatgat

SEQ ID NO: 6659726 - DNA, 16 bp, Homo sapiens
atataaatggaatcac

SEQ ID NO: 6659727 - DNA, 23 bp, Homo sapiens
atataaatggctggtttttagaa

SEQ ID NO: 6659728 - DNA, 12 bp, Homo sapiens
atataaatggga

SEQ ID NO: 6659729 - DNA, 21 bp, Homo sapiens
atataaatgggaacatttatt

SEQ ID NO: 6659730 - DNA, 17 bp, Homo sapiens
atataaatgtactacat

SEQ ID NO: 6659731 - DNA, 18 bp, Homo sapiens
atataaatgtataaatat

SEQ ID NO: 6659732 - DNA, 14 bp, Homo sapiens
atataaatgtggag

SEQ ID NO: 6659733 - DNA, 12 bp, Homo sapiens
atataaatgtgt

SEQ ID NO: 6659734 - DNA, 14 bp, Homo sapiens
atataaatgtgtgt

SEQ ID NO: 6659735 - DNA, 21 bp, Homo sapiens
atataaatgtttatattgttt

SEQ ID NO: 6659736 - DNA, 18 bp, Homo sapiens
atataaattaatacataa

SEQ ID NO: 6659737 - DNA, 14 bp, Homo sapiens
atataaattatctg

SEQ ID NO: 6659738 - DNA, 17 bp, Homo sapiens
atataaattattacttt

SEQ ID NO: 6659739 - DNA, 12 bp, Homo sapiens
atataaattgta

SEQ ID NO: 6659740 - DNA, 15 bp, Homo sapiens
atataaatttaagca

SEQ ID NO: 6659741 - DNA, 16 bp, Homo sapiens
atataacaacactaat

SEQ ID NO: 6659742 - DNA, 15 bp, Homo sapiens
atataacaaccttta

SEQ ID NO: 6659743 - DNA, 12 bp, Homo sapiens
atataacacagt

SEQ ID NO: 6659744 - DNA, 13 bp, Homo sapiens
atataacacagtt

SEQ ID NO: 6659745 - DNA, 14 bp, Homo sapiens
atataacacatttt

SEQ ID NO: 6659746 - DNA, 22 bp, Homo sapiens
atataacacttaggactagaag

SEQ ID NO: 6659747 - DNA, 15 bp, Homo sapiens
atataacagatacat

SEQ ID NO: 6659748 - DNA, 16 bp, Homo sapiens
atataacagatacatt

SEQ ID NO: 6659749 - DNA, 16 bp, Homo sapiens
atataacatatatgga

SEQ ID NO: 6659750 - DNA, 15 bp, Homo sapiens
atataacatgaaagt

SEQ ID NO: 6659751 - DNA, 18 bp, Homo sapiens
atataacatgaaatgata

SEQ ID NO: 6659752 - DNA, 20 bp, Homo sapiens
atataacatgaaatgataga

SEQ ID NO: 6659753 - DNA, 17 bp, Homo sapiens
atataaccaatgtttaa

SEQ ID NO: 6659754 - DNA, 16 bp, Homo sapiens
atataaccacatttct

SEQ ID NO: 6659755 - DNA, 15 bp, Homo sapiens
atataaccattacat

SEQ ID NO: 6659756 - DNA, 23 bp, Homo sapiens
atataaccctaacacacacagaa

SEQ ID NO: 6659757 - DNA, 13 bp, Homo sapiens
atataactaacaa

SEQ ID NO: 6659758 - DNA, 16 bp, Homo sapiens
atataactacattaaa

SEQ ID NO: 6659759 - DNA, 22 bp, Homo sapiens
atataactacattaaaagcttt

SEQ ID NO: 6659760 - DNA, 21 bp, Homo sapiens
atataactatgtggctgaaaa

SEQ ID NO: 6659761 - DNA, 14 bp, Homo sapiens
atataactctttga

SEQ ID NO: 6659762 - DNA, 17 bp, Homo sapiens
atataactgtatttgaa

SEQ ID NO: 6659763 - DNA, 13 bp, Homo sapiens
atataactgtctt

SEQ ID NO: 6659764 - DNA, 15 bp, Homo sapiens
atataactgtcttgt

SEQ ID NO: 6659765 - DNA, 16 bp, Homo sapiens
atataactgtgatgaa

SEQ ID NO: 6659766 - DNA, 22 bp, Homo sapiens
atataactgtgatgaaatatga

SEQ ID NO: 6659767 - DNA, 23 bp, Homo sapiens
atataactgtgatgaaatatgaa

SEQ ID NO: 6659768 - DNA, 14 bp, Homo sapiens
atataactttagaa

SEQ ID NO: 6659769 - DNA, 11 bp, Homo sapiens
atataagaaaa

SEQ ID NO: 6659770 - DNA, 17 bp, Homo sapiens
atataagaacttgatat

SEQ ID NO: 6659771 - DNA, 18 bp, Homo sapiens
atataagaaggaaaaatt

SEQ ID NO: 6659772 - DNA, 18 bp, Homo sapiens
atataagaatgagcctgt

SEQ ID NO: 6659773 - DNA, 13 bp, Homo sapiens
atataagacaagt

SEQ ID NO: 6659774 - DNA, 12 bp, Homo sapiens
atataagacatt

SEQ ID NO: 6659775 - DNA, 13 bp, Homo sapiens
atataagacatta

SEQ ID NO: 6659776 - DNA, 16 bp, Homo sapiens
atataagactattcca

SEQ ID NO: 6659777 - DNA, 19 bp, Homo sapiens
atataagactgctgcagtc

SEQ ID NO: 6659778 - DNA, 18 bp, Homo sapiens
atataagagaagtctcat

SEQ ID NO: 6659779 - DNA, 16 bp, Homo sapiens
atataagcaagacagt

SEQ ID NO: 6659780 - DNA, 18 bp, Homo sapiens
atataagcccttaataat

SEQ ID NO: 6659781 - DNA, 19 bp, Homo sapiens
atataagcttaaaataagt

SEQ ID NO: 6659782 - DNA, 20 bp, Homo sapiens
atataagcttaaaataagtg

SEQ ID NO: 6659783 - DNA, 21 bp, Homo sapiens
atataagcttaaaataagtga

SEQ ID NO: 6659784 - DNA, 12 bp, Homo sapiens
atataagctttt

SEQ ID NO: 6659785 - DNA, 23 bp, Homo sapiens
atataaggaaagcaataaatgaa

SEQ ID NO: 6659786 - DNA, 17 bp, Homo sapiens
atataaggcattctgta

SEQ ID NO: 6659787 - DNA, 22 bp, Homo sapiens
atataagggaagtagttatcat

SEQ ID NO: 6659788 - DNA, 13 bp, Homo sapiens
atataaggttttt

SEQ ID NO: 6659789 - DNA, 19 bp, Homo sapiens
atataagtattctaaattt

SEQ ID NO: 6659790 - DNA, 22 bp, Homo sapiens
atataagtctatactaatgctt

SEQ ID NO: 6659791 - DNA, 13 bp, Homo sapiens
atataagtgctgt

SEQ ID NO: 6659792 - DNA, 17 bp, Homo sapiens
atataagtgctgtataa

SEQ ID NO: 6659793 - DNA, 14 bp, Homo sapiens
atataagtgtacat

SEQ ID NO: 6659794 - DNA, 15 bp, Homo sapiens
atataagtgtacata

SEQ ID NO: 6659795 - DNA, 14 bp, Homo sapiens
atataagttaaaga

SEQ ID NO: 6659796 - DNA, 21 bp, Homo sapiens
atataagttaaagagacaaat

SEQ ID NO: 6659797 - DNA, 22 bp, Homo sapiens
atataataaaatgtgttgaaac

SEQ ID NO: 6659798 - DNA, 13 bp, Homo sapiens
atataataaagaa

SEQ ID NO: 6659799 - DNA, 14 bp, Homo sapiens
atataataaagaag

SEQ ID NO: 6659800 - DNA, 12 bp, Homo sapiens
atataataaagt

SEQ ID NO: 6659801 - DNA, 17 bp, Homo sapiens
atataataaagtattcc

SEQ ID NO: 6659802 - DNA, 14 bp, Homo sapiens
atataataaatggg

SEQ ID NO: 6659803 - DNA, 17 bp, Homo sapiens
atataataatgtccttt

SEQ ID NO: 6659804 - DNA, 14 bp, Homo sapiens
atataataattact

SEQ ID NO: 6659805 - DNA, 20 bp, Homo sapiens
atataataattacttaatgt

SEQ ID NO: 6659806 - DNA, 21 bp, Homo sapiens
atataatacacaaaatcaaat

SEQ ID NO: 6659807 - DNA, 22 bp, Homo sapiens
atataatactaaagtgtctatt

SEQ ID NO: 6659808 - DNA, 21 bp, Homo sapiens
atataatagattgagttatta

SEQ ID NO: 6659809 - DNA, 17 bp, Homo sapiens
atataatatatttgtgt

SEQ ID NO: 6659810 - DNA, 20 bp, Homo sapiens
atataatatatttgtgtatt

SEQ ID NO: 6659811 - DNA, 17 bp, Homo sapiens
atataatatctaaagtt

SEQ ID NO: 6659812 - DNA, 14 bp, Homo sapiens
atataatatgtata

SEQ ID NO: 6659813 - DNA, 20 bp, Homo sapiens
atataatattcagccagctt

SEQ ID NO: 6659814 - DNA, 20 bp, Homo sapiens
atataatatttgaagcagct

SEQ ID NO: 6659815 - DNA, 16 bp, Homo sapiens
atataatcatgctcat

SEQ ID NO: 6659816 - DNA, 23 bp, Homo sapiens
atataatcttggcttcttaaaaa

SEQ ID NO: 6659817 - DNA, 19 bp, Homo sapiens
atataatgaataaatcatt

SEQ ID NO: 6659818 - DNA, 19 bp, Homo sapiens
atataatgatcagcaaaaa

SEQ ID NO: 6659819 - DNA, 22 bp, Homo sapiens
atataatggaagagaaatctca

SEQ ID NO: 6659820 - DNA, 16 bp, Homo sapiens
atataatggtttactg

SEQ ID NO: 6659821 - DNA, 20 bp, Homo sapiens
atataatggtttactgctgt

SEQ ID NO: 6659822 - DNA, 22 bp, Homo sapiens
atataatggtttactgctgtca

SEQ ID NO: 6659823 - DNA, 18 bp, Homo sapiens
atataatggtttcaaaga

SEQ ID NO: 6659824 - DNA, 16 bp, Homo sapiens
atataatgtattttct

SEQ ID NO: 6659825 - DNA, 15 bp, Homo sapiens
atataattacttaat

SEQ ID NO: 6659826 - DNA, 17 bp, Homo sapiens
atataattacttaatgt

SEQ ID NO: 6659827 - DNA, 14 bp, Homo sapiens
atataattatatgt

SEQ ID NO: 6659828 - DNA, 15 bp, Homo sapiens
atataattatatgtt

SEQ ID NO: 6659829 - DNA, 16 bp, Homo sapiens
atataattctgaaatg

SEQ ID NO: 6659830 - DNA, 14 bp, Homo sapiens
atataattctggag

SEQ ID NO: 6659831 - DNA, 12 bp, Homo sapiens
atataattctta

SEQ ID NO: 6659832 - DNA, 21 bp, Homo sapiens
atataattgtactgtgttttt

SEQ ID NO: 6659833 - DNA, 18 bp, Homo sapiens
atataattgttttatctg

SEQ ID NO: 6659834 - DNA, 16 bp, Homo sapiens
atataatttaaacgtg

SEQ ID NO: 6659835 - DNA, 13 bp, Homo sapiens
atataatttaaag

SEQ ID NO: 6659836 - DNA, 22 bp, Homo sapiens
atataatttaaagaaacactaa

SEQ ID NO: 6659837 - DNA, 19 bp, Homo sapiens
atataatttaacagaagtt

SEQ ID NO: 6659838 - DNA, 13 bp, Homo sapiens
atataatttaatg

SEQ ID NO: 6659839 - DNA, 17 bp, Homo sapiens
atataatttaatgtaaa

SEQ ID NO: 6659840 - DNA, 23 bp, Homo sapiens
atataatttaatgtaaataaaac

SEQ ID NO: 6659841 - DNA, 16 bp, Homo sapiens
atataatttataagca

SEQ ID NO: 6659842 - DNA, 18 bp, Homo sapiens
atataatttataagcatt

SEQ ID NO: 6659843 - DNA, 13 bp, Homo sapiens
atataatttcctc

SEQ ID NO: 6659844 - DNA, 15 bp, Homo sapiens
atataatttcctcac

SEQ ID NO: 6659845 - DNA, 19 bp, Homo sapiens
atataatttgagtgtatat

SEQ ID NO: 6659846 - DNA, 23 bp, Homo sapiens
atataatttgccagacagagatc

SEQ ID NO: 6659847 - DNA, 11 bp, Homo sapiens
atataatttta

SEQ ID NO: 6659848 - DNA, 12 bp, Homo sapiens
atataattttat

SEQ ID NO: 6659849 - DNA, 14 bp, Homo sapiens
atatacaaacatgt

SEQ ID NO: 6659850 - DNA, 15 bp, Homo sapiens
atatacaaacatgtg

SEQ ID NO: 6659851 - DNA, 14 bp, Homo sapiens
atatacaaataaac

SEQ ID NO: 6659852 - DNA, 14 bp, Homo sapiens
atatacaaatatat

SEQ ID NO: 6659853 - DNA, 21 bp, Homo sapiens
atatacaacctgcttgggtgg

SEQ ID NO: 6659854 - DNA, 21 bp, Homo sapiens
atatacaactgtaaagcaaat

SEQ ID NO: 6659855 - DNA, 21 bp, Homo sapiens
atatacaactttggaatttga

SEQ ID NO: 6659856 - DNA, 22 bp, Homo sapiens
atatacaactttggaatttgaa

SEQ ID NO: 6659857 - DNA, 18 bp, Homo sapiens
atatacaagcaagcaaaa

SEQ ID NO: 6659858 - DNA, 19 bp, Homo sapiens
atatacaagtaaattctgt

SEQ ID NO: 6659859 - DNA, 20 bp, Homo sapiens
atatacaagtaaattctgtt

SEQ ID NO: 6659860 - DNA, 16 bp, Homo sapiens
atatacaataacataa

SEQ ID NO: 6659861 - DNA, 13 bp, Homo sapiens
atatacaataatg

SEQ ID NO: 6659862 - DNA, 16 bp, Homo sapiens
atatacaataatggaa

SEQ ID NO: 6659863 - DNA, 20 bp, Homo sapiens
atatacaataatggaaaaaa

SEQ ID NO: 6659864 - DNA, 14 bp, Homo sapiens
atatacaataatgt

SEQ ID NO: 6659865 - DNA, 16 bp, Homo sapiens
atatacacatacatac

SEQ ID NO: 6659866 - DNA, 18 bp, Homo sapiens
atatacacatagttctgt

SEQ ID NO: 6659867 - DNA, 18 bp, Homo sapiens
atatacacatggatgcac

SEQ ID NO: 6659868 - DNA, 19 bp, Homo sapiens
atatacacattttgtaaat

SEQ ID NO: 6659869 - DNA, 17 bp, Homo sapiens
atatacacgaatagaca

SEQ ID NO: 6659870 - DNA, 20 bp, Homo sapiens
atatacacgaatagacatca

SEQ ID NO: 6659871 - DNA, 17 bp, Homo sapiens
atatacagatgaaaatt

SEQ ID NO: 6659872 - DNA, 21 bp, Homo sapiens
atatacagatgaaaatttgag

SEQ ID NO: 6659873 - DNA, 22 bp, Homo sapiens
atatacagatgaaaatttgaga

SEQ ID NO: 6659874 - DNA, 19 bp, Homo sapiens
atatacagattcctgttgt

SEQ ID NO: 6659875 - DNA, 16 bp, Homo sapiens
atatacagtaacttta

SEQ ID NO: 6659876 - DNA, 13 bp, Homo sapiens
atatacagttatt

SEQ ID NO: 6659877 - DNA, 15 bp, Homo sapiens
atatacagttatttt

SEQ ID NO: 6659878 - DNA, 14 bp, Homo sapiens
atatacagtttgac

SEQ ID NO: 6659879 - DNA, 20 bp, Homo sapiens
atatacatacgcaattgtat

SEQ ID NO: 6659880 - DNA, 23 bp, Homo sapiens
atatacatacgcaattgtatata

SEQ ID NO: 6659881 - DNA, 15 bp, Homo sapiens
atatacatacttaca

SEQ ID NO: 6659882 - DNA, 13 bp, Homo sapiens
atatacatatata

SEQ ID NO: 6659883 - DNA, 15 bp, Homo sapiens
atatacatatatata

SEQ ID NO: 6659884 - DNA, 22 bp, Homo sapiens
atatacatatgagaatatacct

SEQ ID NO: 6659885 - DNA, 14 bp, Homo sapiens
atatacatatgtag

SEQ ID NO: 6659886 - DNA, 20 bp, Homo sapiens
atatacatattataaataaa

SEQ ID NO: 6659887 - DNA, 21 bp, Homo sapiens
atatacatattataaataaat

SEQ ID NO: 6659888 - DNA, 17 bp, Homo sapiens
atatacatattcaaagt

SEQ ID NO: 6659889 - DNA, 16 bp, Homo sapiens
atatacatattgtata

SEQ ID NO: 6659890 - DNA, 13 bp, Homo sapiens
atatacatcatac

SEQ ID NO: 6659891 - DNA, 16 bp, Homo sapiens
atatacatctgtgtat

SEQ ID NO: 6659892 - DNA, 16 bp, Homo sapiens
atatacatgaagaata

SEQ ID NO: 6659893 - DNA, 19 bp, Homo sapiens
atatacatgaagaatagaa

SEQ ID NO: 6659894 - DNA, 21 bp, Homo sapiens
atatacatgggtgaattatgt

SEQ ID NO: 6659895 - DNA, 14 bp, Homo sapiens
atatacatgtatag

SEQ ID NO: 6659896 - DNA, 14 bp, Homo sapiens
atatacatgtgtgt

SEQ ID NO: 6659897 - DNA, 15 bp, Homo sapiens
atatacatgtgtgta

SEQ ID NO: 6659898 - DNA, 17 bp, Homo sapiens
atatacatgtgtgtata

SEQ ID NO: 6659899 - DNA, 18 bp, Homo sapiens
atatacatgtttatgtaa

SEQ ID NO: 6659900 - DNA, 16 bp, Homo sapiens
atatacattagacaca

SEQ ID NO: 6659901 - DNA, 19 bp, Homo sapiens
atatacattagacacacat

SEQ ID NO: 6659902 - DNA, 22 bp, Homo sapiens
atatacattagacacacatata

SEQ ID NO: 6659903 - DNA, 15 bp, Homo sapiens
atatacattgtgtga

SEQ ID NO: 6659904 - DNA, 15 bp, Homo sapiens
atatacattttctaa

SEQ ID NO: 6659905 - DNA, 17 bp, Homo sapiens
atatacattttctaaat

SEQ ID NO: 6659906 - DNA, 12 bp, Homo sapiens
atatacattttt

SEQ ID NO: 6659907 - DNA, 19 bp, Homo sapiens
atataccaaattaaaaaaa

SEQ ID NO: 6659908 - DNA, 16 bp, Homo sapiens
atataccccaaattgt

SEQ ID NO: 6659909 - DNA, 17 bp, Homo sapiens
atataccccaaattgtg

SEQ ID NO: 6659910 - DNA, 17 bp, Homo sapiens
atatacccccccatgca

SEQ ID NO: 6659911 - DNA, 19 bp, Homo sapiens
atatacctggcttttactt

SEQ ID NO: 6659912 - DNA, 22 bp, Homo sapiens
atatacctggcttttactttat

SEQ ID NO: 6659913 - DNA, 14 bp, Homo sapiens
atataccttattta

SEQ ID NO: 6659914 - DNA, 22 bp, Homo sapiens
atataccttttgttaccacaga

SEQ ID NO: 6659915 - DNA, 18 bp, Homo sapiens
atatacgaaaagccagct

SEQ ID NO: 6659916 - DNA, 20 bp, Homo sapiens
atatacgtgaaaattatttg

SEQ ID NO: 6659917 - DNA, 22 bp, Homo sapiens
atatactaaaccaactctaata

SEQ ID NO: 6659918 - DNA, 16 bp, Homo sapiens
atatactaaccatttc

SEQ ID NO: 6659919 - DNA, 15 bp, Homo sapiens
atatactaataaaaa

SEQ ID NO: 6659920 - DNA, 13 bp, Homo sapiens
atatactatacaa

SEQ ID NO: 6659921 - DNA, 14 bp, Homo sapiens
atatactatatgaa

SEQ ID NO: 6659922 - DNA, 19 bp, Homo sapiens
atatactcactttctagat

SEQ ID NO: 6659923 - DNA, 13 bp, Homo sapiens
atatactcattag

SEQ ID NO: 6659924 - DNA, 16 bp, Homo sapiens
atatactcatttggat

SEQ ID NO: 6659925 - DNA, 22 bp, Homo sapiens
atatactctagatgaagtttta

SEQ ID NO: 6659926 - DNA, 15 bp, Homo sapiens
atatactgattttga

SEQ ID NO: 6659927 - DNA, 15 bp, Homo sapiens
atatactgctattta

SEQ ID NO: 6659928 - DNA, 17 bp, Homo sapiens
atatactgctatttaca

SEQ ID NO: 6659929 - DNA, 13 bp, Homo sapiens
atatactggaagt

SEQ ID NO: 6659930 - DNA, 18 bp, Homo sapiens
atatactgggttcttgtt

SEQ ID NO: 6659931 - DNA, 21 bp, Homo sapiens
atatactgggttcttgtttta

SEQ ID NO: 6659932 - DNA, 11 bp, Homo sapiens
atatactgtaa

SEQ ID NO: 6659933 - DNA, 12 bp, Homo sapiens
atatactgtaaa

SEQ ID NO: 6659934 - DNA, 21 bp, Homo sapiens
atatactgtatcctgaaaggc

SEQ ID NO: 6659935 - DNA, 22 bp, Homo sapiens
atatactgtatcctgaaaggca

SEQ ID NO: 6659936 - DNA, 17 bp, Homo sapiens
atatacttaagaataca

SEQ ID NO: 6659937 - DNA, 19 bp, Homo sapiens
atatacttaagaatacaca

SEQ ID NO: 6659938 - DNA, 16 bp, Homo sapiens
atatacttgactctaa

SEQ ID NO: 6659939 - DNA, 20 bp, Homo sapiens
atatacttgcaagataattt

SEQ ID NO: 6659940 - DNA, 22 bp, Homo sapiens
atatacttgtggttttcaaatt

SEQ ID NO: 6659941 - DNA, 21 bp, Homo sapiens
atatacttgtttttgtaaaga

SEQ ID NO: 6659942 - DNA, 17 bp, Homo sapiens
atatactttgccactgc

SEQ ID NO: 6659943 - DNA, 16 bp, Homo sapiens
atatacttttaaatta

SEQ ID NO: 6659944 - DNA, 21 bp, Homo sapiens
atatacttttacattaaagaa

SEQ ID NO: 6659945 - DNA, 19 bp, Homo sapiens
atatagaaaacaaaggagc

SEQ ID NO: 6659946 - DNA, 19 bp, Homo sapiens
atatagaaaactaatctaa

SEQ ID NO: 6659947 - DNA, 12 bp, Homo sapiens
atatagaattgc

SEQ ID NO: 6659948 - DNA, 21 bp, Homo sapiens
atatagaattgtagactgatg

SEQ ID NO: 6659949 - DNA, 21 bp, Homo sapiens
atatagaatttcctgtaatat

SEQ ID NO: 6659950 - DNA, 18 bp, Homo sapiens
atatagacacacatacat

SEQ ID NO: 6659951 - DNA, 16 bp, Homo sapiens
atatagacctatgata

SEQ ID NO: 6659952 - DNA, 20 bp, Homo sapiens
atatagacctatgataaata

SEQ ID NO: 6659953 - DNA, 22 bp, Homo sapiens
atatagactatataatcagatt

SEQ ID NO: 6659954 - DNA, 16 bp, Homo sapiens
atatagactgtacatt

SEQ ID NO: 6659955 - DNA, 13 bp, Homo sapiens
atatagagaaagt

SEQ ID NO: 6659956 - DNA, 14 bp, Homo sapiens
atatagagaataag

SEQ ID NO: 6659957 - DNA, 21 bp, Homo sapiens
atatagagactgtgttcatgt

SEQ ID NO: 6659958 - DNA, 17 bp, Homo sapiens
atatagagatgcattca

SEQ ID NO: 6659959 - DNA, 17 bp, Homo sapiens
atatagagattgtacat

SEQ ID NO: 6659960 - DNA, 18 bp, Homo sapiens
atatagagtcattgtaat

SEQ ID NO: 6659961 - DNA, 13 bp, Homo sapiens
atatagatgtctg

SEQ ID NO: 6659962 - DNA, 15 bp, Homo sapiens
atatagatgtctgtg

SEQ ID NO: 6659963 - DNA, 18 bp, Homo sapiens
atatagatgtctgtgtat

SEQ ID NO: 6659964 - DNA, 21 bp, Homo sapiens
atatagatgtctgtgtataca

SEQ ID NO: 6659965 - DNA, 16 bp, Homo sapiens
atatagattagaaaaa

SEQ ID NO: 6659966 - DNA, 15 bp, Homo sapiens
atatagattataact

SEQ ID NO: 6659967 - DNA, 15 bp, Homo sapiens
atatagattttatta

SEQ ID NO: 6659968 - DNA, 19 bp, Homo sapiens
atatagattttattatgtt

SEQ ID NO: 6659969 - DNA, 19 bp, Homo sapiens
atatagcaaaacttttaaa

SEQ ID NO: 6659970 - DNA, 18 bp, Homo sapiens
atatagcacttttgaaga

SEQ ID NO: 6659971 - DNA, 19 bp, Homo sapiens
atatagcagcaaaaatata

SEQ ID NO: 6659972 - DNA, 15 bp, Homo sapiens
atatagcatctttca

SEQ ID NO: 6659973 - DNA, 20 bp, Homo sapiens
atatagcattaataaaactg

SEQ ID NO: 6659974 - DNA, 21 bp, Homo sapiens
atatagcattaataaaactgt

SEQ ID NO: 6659975 - DNA, 16 bp, Homo sapiens
atatagcctgcctcag

SEQ ID NO: 6659976 - DNA, 12 bp, Homo sapiens
atatagccttta

SEQ ID NO: 6659977 - DNA, 22 bp, Homo sapiens
atatagctacaaatgaaaacaa

SEQ ID NO: 6659978 - DNA, 21 bp, Homo sapiens
atatagctatttttatggaat

SEQ ID NO: 6659979 - DNA, 16 bp, Homo sapiens
atatagctggcaagaa

SEQ ID NO: 6659980 - DNA, 19 bp, Homo sapiens
atatagctggcaagaatgg

SEQ ID NO: 6659981 - DNA, 15 bp, Homo sapiens
atatagctgtacaaa

SEQ ID NO: 6659982 - DNA, 20 bp, Homo sapiens
atatagctgtacaaatataa

SEQ ID NO: 6659983 - DNA, 20 bp, Homo sapiens
atatagcttttggtgtttga

SEQ ID NO: 6659984 - DNA, 19 bp, Homo sapiens
atataggaaaatacattgt

SEQ ID NO: 6659985 - DNA, 20 bp, Homo sapiens
atataggaaactaagcattg

SEQ ID NO: 6659986 - DNA, 23 bp, Homo sapiens
atataggataagaaataagaata

SEQ ID NO: 6659987 - DNA, 20 bp, Homo sapiens
atataggatattgctaattg

SEQ ID NO: 6659988 - DNA, 20 bp, Homo sapiens
atataggggcaaaaatttga

SEQ ID NO: 6659989 - DNA, 21 bp, Homo sapiens
atataggtctcttctcccaga

SEQ ID NO: 6659990 - DNA, 22 bp, Homo sapiens
atataggtctcttctcccagaa

SEQ ID NO: 6659991 - DNA, 19 bp, Homo sapiens
atataggtttctattcttg

SEQ ID NO: 6659992 - DNA, 14 bp, Homo sapiens
atataggttttgtt

SEQ ID NO: 6659993 - DNA, 23 bp, Homo sapiens
atataggttttgtttgctatctt

SEQ ID NO: 6659994 - DNA, 19 bp, Homo sapiens
atatagtaggggttgaaga

SEQ ID NO: 6659995 - DNA, 21 bp, Homo sapiens
atatagtaggggttgaagaaa

SEQ ID NO: 6659996 - DNA, 18 bp, Homo sapiens
atatagtatatttatact

SEQ ID NO: 6659997 - DNA, 16 bp, Homo sapiens
atatagtccagacact

SEQ ID NO: 6659998 - DNA, 16 bp, Homo sapiens
atatagtctacagttg

SEQ ID NO: 6659999 - DNA, 14 bp, Homo sapiens
atatagtgttgtgt

SEQ ID NO: 6660000 - DNA, 18 bp, Homo sapiens
atatagtgttgtgttaca

SEQ ID NO: 6660001 - DNA, 14 bp, Homo sapiens
atatagttaaactg

SEQ ID NO: 6660002 - DNA, 16 bp, Homo sapiens
atatagttaaactgag

SEQ ID NO: 6660003 - DNA, 22 bp, Homo sapiens
atatagttcctaagaagcttct

SEQ ID NO: 6660004 - DNA, 12 bp, Homo sapiens
atatagttcctt

SEQ ID NO: 6660005 - DNA, 19 bp, Homo sapiens
atatagttccttgccttaa

SEQ ID NO: 6660006 - DNA, 20 bp, Homo sapiens
atatagttgaaagtaaaaaa

SEQ ID NO: 6660007 - DNA, 23 bp, Homo sapiens
atatagttgaacaagatttccct

SEQ ID NO: 6660008 - DNA, 18 bp, Homo sapiens
atatagttgaggccgagg

SEQ ID NO: 6660009 - DNA, 22 bp, Homo sapiens
atatagttgtctttctttgctg

SEQ ID NO: 6660010 - DNA, 24 bp, Homo sapiens
atatagtttgtggtaaaaagatta

SEQ ID NO: 6660011 - DNA, 16 bp, Homo sapiens
atatagttttactttt

SEQ ID NO: 6660012 - DNA, 18 bp, Homo sapiens
atatagttttttctttcc

SEQ ID NO: 6660013 - DNA, 21 bp, Homo sapiens
atatataaaaagaaaagataa

SEQ ID NO: 6660014 - DNA, 15 bp, Homo sapiens
atatataaaaatata

SEQ ID NO: 6660015 - DNA, 21 bp, Homo sapiens
atatataaaacaaaacaaaca

SEQ ID NO: 6660016 - DNA, 16 bp, Homo sapiens
atatataaaagaaata

SEQ ID NO: 6660017 - DNA, 21 bp, Homo sapiens
atatataaaagaaatatatct

SEQ ID NO: 6660018 - DNA, 23 bp, Homo sapiens
atatataaaagtctgagttctct

SEQ ID NO: 6660019 - DNA, 12 bp, Homo sapiens
atatataaaata

SEQ ID NO: 6660020 - DNA, 14 bp, Homo sapiens
atatataaaataaa

SEQ ID NO: 6660021 - DNA, 15 bp, Homo sapiens
atatataaaataaat

SEQ ID NO: 6660022 - DNA, 18 bp, Homo sapiens
atatataaaataaatata

SEQ ID NO: 6660023 - DNA, 15 bp, Homo sapiens
atatataaaatacac

SEQ ID NO: 6660024 - DNA, 21 bp, Homo sapiens
atatataaaatacacgtgtat

SEQ ID NO: 6660025 - DNA, 14 bp, Homo sapiens
atatataaaatatt

SEQ ID NO: 6660026 - DNA, 23 bp, Homo sapiens
atatataaacaaacaaacaaaaa

SEQ ID NO: 6660027 - DNA, 13 bp, Homo sapiens
atatataaacact

SEQ ID NO: 6660028 - DNA, 22 bp, Homo sapiens
atatataaacactccacagtgt

SEQ ID NO: 6660029 - DNA, 21 bp, Homo sapiens
atatataaacctaaaaaagat

SEQ ID NO: 6660030 - DNA, 20 bp, Homo sapiens
atatataaagacaacaaaag

SEQ ID NO: 6660031 - DNA, 18 bp, Homo sapiens
atatataaagatatatag

SEQ ID NO: 6660032 - DNA, 10 bp, Homo sapiens
atatataaat

SEQ ID NO: 6660033 - DNA, 12 bp, Homo sapiens
atatataaataa

SEQ ID NO: 6660034 - DNA, 13 bp, Homo sapiens
atatataaataat

SEQ ID NO: 6660035 - DNA, 14 bp, Homo sapiens
atatataaatatat

SEQ ID NO: 6660036 - DNA, 17 bp, Homo sapiens
atatataaatatatatt

SEQ ID NO: 6660037 - DNA, 12 bp, Homo sapiens
atatataaatgt

SEQ ID NO: 6660038 - DNA, 18 bp, Homo sapiens
atatataaattattactt

SEQ ID NO: 6660039 - DNA, 17 bp, Homo sapiens
atatataacagatacat

SEQ ID NO: 6660040 - DNA, 16 bp, Homo sapiens
atatataactatttta

SEQ ID NO: 6660041 - DNA, 17 bp, Homo sapiens
atatataagaaagacat

SEQ ID NO: 6660042 - DNA, 15 bp, Homo sapiens
atatataagtgtaca

SEQ ID NO: 6660043 - DNA, 21 bp, Homo sapiens
atatataagtttacaccttta

SEQ ID NO: 6660044 - DNA, 15 bp, Homo sapiens
atatataataaatac

SEQ ID NO: 6660045 - DNA, 16 bp, Homo sapiens
atatataataaatggg

SEQ ID NO: 6660046 - DNA, 15 bp, Homo sapiens
atatataatatacta

SEQ ID NO: 6660047 - DNA, 17 bp, Homo sapiens
atatataatatactaaa

SEQ ID NO: 6660048 - DNA, 16 bp, Homo sapiens
atatataatatgtata

SEQ ID NO: 6660049 - DNA, 17 bp, Homo sapiens
atatataatcaaatgat

SEQ ID NO: 6660050 - DNA, 21 bp, Homo sapiens
atatataatggtaatagaata

SEQ ID NO: 6660051 - DNA, 15 bp, Homo sapiens
atatataatgtatat

SEQ ID NO: 6660052 - DNA, 15 bp, Homo sapiens
atatataattctgta

SEQ ID NO: 6660053 - DNA, 16 bp, Homo sapiens
atatataatttcctca

SEQ ID NO: 6660054 - DNA, 14 bp, Homo sapiens
atatatacacacac

SEQ ID NO: 6660055 - DNA, 15 bp, Homo sapiens
atatatacacataca

SEQ ID NO: 6660056 - DNA, 17 bp, Homo sapiens
atatatacacatacata

SEQ ID NO: 6660057 - DNA, 21 bp, Homo sapiens
atatatacacatagttctgta

SEQ ID NO: 6660058 - DNA, 23 bp, Homo sapiens
atatatacacattagaaatattc

SEQ ID NO: 6660059 - DNA, 21 bp, Homo sapiens
atatatacagtaactttatgt

SEQ ID NO: 6660060 - DNA, 12 bp, Homo sapiens
atatatacatac

SEQ ID NO: 6660061 - DNA, 18 bp, Homo sapiens
atatatacatacacttgt

SEQ ID NO: 6660062 - DNA, 16 bp, Homo sapiens
atatatacatagaaac

SEQ ID NO: 6660063 - DNA, 22 bp, Homo sapiens
atatatacatagcatgacattt

SEQ ID NO: 6660064 - DNA, 12 bp, Homo sapiens
atatatacatgt

SEQ ID NO: 6660065 - DNA, 14 bp, Homo sapiens
atatatacatgtat

SEQ ID NO: 6660066 - DNA, 17 bp, Homo sapiens
atatatacatgtatagt

SEQ ID NO: 6660067 - DNA, 19 bp, Homo sapiens
atatatacatgtatagtga

SEQ ID NO: 6660068 - DNA, 17 bp, Homo sapiens
atatatacattagacac

SEQ ID NO: 6660069 - DNA, 13 bp, Homo sapiens
atatatacatttt

SEQ ID NO: 6660070 - DNA, 15 bp, Homo sapiens
atatatacatttttt

SEQ ID NO: 6660071 - DNA, 15 bp, Homo sapiens
atatataccccccca

SEQ ID NO: 6660072 - DNA, 13 bp, Homo sapiens
atatatactacat

SEQ ID NO: 6660073 - DNA, 16 bp, Homo sapiens
atatatactacatgag

SEQ ID NO: 6660074 - DNA, 12 bp, Homo sapiens
atatatacttgt

SEQ ID NO: 6660075 - DNA, 20 bp, Homo sapiens
atatatagatatatatccat

SEQ ID NO: 6660076 - DNA, 16 bp, Homo sapiens
atatatagatatgtat

SEQ ID NO: 6660077 - DNA, 17 bp, Homo sapiens
atatataggctaaagat

SEQ ID NO: 6660078 - DNA, 20 bp, Homo sapiens
atatataggctattttctaa

SEQ ID NO: 6660079 - DNA, 18 bp, Homo sapiens
atatatagggagcacttt

SEQ ID NO: 6660080 - DNA, 17 bp, Homo sapiens
atatatagtccagacac

SEQ ID NO: 6660081 - DNA, 16 bp, Homo sapiens
atatatagtgaaaaat

SEQ ID NO: 6660082 - DNA, 14 bp, Homo sapiens
atatatagtgctat

SEQ ID NO: 6660083 - DNA, 16 bp, Homo sapiens
atatatataaaataca

SEQ ID NO: 6660084 - DNA, 12 bp, Homo sapiens
atatatataaag

SEQ ID NO: 6660085 - DNA, 12 bp, Homo sapiens
atatatataaat

SEQ ID NO: 6660086 - DNA, 15 bp, Homo sapiens
atatatataaatgta

SEQ ID NO: 6660087 - DNA, 16 bp, Homo sapiens
atatatataaatgtat

SEQ ID NO: 6660088 - DNA, 15 bp, Homo sapiens
atatatataatatat

SEQ ID NO: 6660089 - DNA, 13 bp, Homo sapiens
atatatatacaca

SEQ ID NO: 6660090 - DNA, 14 bp, Homo sapiens
atatatatacacat

SEQ ID NO: 6660091 - DNA, 16 bp, Homo sapiens
atatatatacacatac

SEQ ID NO: 6660092 - DNA, 13 bp, Homo sapiens
atatatatacata

SEQ ID NO: 6660093 - DNA, 15 bp, Homo sapiens
atatatataggttct

SEQ ID NO: 6660094 - DNA, 13 bp, Homo sapiens
atatatatatagt

SEQ ID NO: 6660095 - DNA, 12 bp, Homo sapiens
atatatatatat

SEQ ID NO: 6660096 - DNA, 15 bp, Homo sapiens
atatatatatataaa

SEQ ID NO: 6660097 - DNA, 15 bp, Homo sapiens
atatatatatataca

SEQ ID NO: 6660098 - DNA, 15 bp, Homo sapiens
atatatatatatgca

SEQ ID NO: 6660099 - DNA, 14 bp, Homo sapiens
atatatatatcagt

SEQ ID NO: 6660100 - DNA, 16 bp, Homo sapiens
atatatatatcagttt

SEQ ID NO: 6660101 - DNA, 13 bp, Homo sapiens
atatatatatgta

SEQ ID NO: 6660102 - DNA, 15 bp, Homo sapiens
atatatatatgtaca

SEQ ID NO: 6660103 - DNA, 12 bp, Homo sapiens
atatatatattt

SEQ ID NO: 6660104 - DNA, 15 bp, Homo sapiens
atatatatcagtttg

SEQ ID NO: 6660105 - DNA, 14 bp, Homo sapiens
atatatatcctatt

SEQ ID NO: 6660106 - DNA, 14 bp, Homo sapiens
atatatatcctctg

SEQ ID NO: 6660107 - DNA, 21 bp, Homo sapiens
atatatatctatctatttgag

SEQ ID NO: 6660108 - DNA, 14 bp, Homo sapiens
atatatatctgata

SEQ ID NO: 6660109 - DNA, 21 bp, Homo sapiens
atatatatctgctgtccagac

SEQ ID NO: 6660110 - DNA, 14 bp, Homo sapiens
atatatatgaataa

SEQ ID NO: 6660111 - DNA, 20 bp, Homo sapiens
atatatatgatgaaattctt

SEQ ID NO: 6660112 - DNA, 19 bp, Homo sapiens
atatatatgcctttttcct

SEQ ID NO: 6660113 - DNA, 20 bp, Homo sapiens
atatatatgcctttttccta

SEQ ID NO: 6660114 - DNA, 15 bp, Homo sapiens
atatatatggaataa

SEQ ID NO: 6660115 - DNA, 20 bp, Homo sapiens
atatatatgtacagttatct

SEQ ID NO: 6660116 - DNA, 15 bp, Homo sapiens
atatatatgtataat

SEQ ID NO: 6660117 - DNA, 14 bp, Homo sapiens
atatatatgtcaat

SEQ ID NO: 6660118 - DNA, 22 bp, Homo sapiens
atatatatgtgcagtattttat

SEQ ID NO: 6660119 - DNA, 13 bp, Homo sapiens
atatatatgtgtg

SEQ ID NO: 6660120 - DNA, 20 bp, Homo sapiens
atatatatgtgtgtgtatat

SEQ ID NO: 6660121 - DNA, 14 bp, Homo sapiens
atatatattaagtg

SEQ ID NO: 6660122 - DNA, 14 bp, Homo sapiens
atatatattatact

SEQ ID NO: 6660123 - DNA, 15 bp, Homo sapiens
atatatattatctta

SEQ ID NO: 6660124 - DNA, 18 bp, Homo sapiens
atatatattattctcatt

SEQ ID NO: 6660125 - DNA, 22 bp, Homo sapiens
atatatattattctcatttagt

SEQ ID NO: 6660126 - DNA, 14 bp, Homo sapiens
atatatattgcata

SEQ ID NO: 6660127 - DNA, 14 bp, Homo sapiens
atatatatttatca

SEQ ID NO: 6660128 - DNA, 13 bp, Homo sapiens
atatatatttcca

SEQ ID NO: 6660129 - DNA, 14 bp, Homo sapiens
atatatatttccaa

SEQ ID NO: 6660130 - DNA, 18 bp, Homo sapiens
atatatatttccaaatat

SEQ ID NO: 6660131 - DNA, 23 bp, Homo sapiens
atatatatttgattgtaaaaaca

SEQ ID NO: 6660132 - DNA, 13 bp, Homo sapiens
atatatatttgta

SEQ ID NO: 6660133 - DNA, 20 bp, Homo sapiens
atatatatttgtaacattgt

SEQ ID NO: 6660134 - DNA, 17 bp, Homo sapiens
atatatatttttaaaat

SEQ ID NO: 6660135 - DNA, 15 bp, Homo sapiens
atatatatttttaat

SEQ ID NO: 6660136 - DNA, 17 bp, Homo sapiens
atatatatttttcaaat

SEQ ID NO: 6660137 - DNA, 12 bp, Homo sapiens
atatatcaaatc

SEQ ID NO: 6660138 - DNA, 15 bp, Homo sapiens
atatatcaagaagtc

SEQ ID NO: 6660139 - DNA, 20 bp, Homo sapiens
atatatcaggtaaaatattt

SEQ ID NO: 6660140 - DNA, 14 bp, Homo sapiens
atatatcataaagt

SEQ ID NO: 6660141 - DNA, 13 bp, Homo sapiens
atatatcatagta

SEQ ID NO: 6660142 - DNA, 13 bp, Homo sapiens
atatatcatattg

SEQ ID NO: 6660143 - DNA, 20 bp, Homo sapiens
atatatcattatctttgctg

SEQ ID NO: 6660144 - DNA, 19 bp, Homo sapiens
atatatccccactactcaa

SEQ ID NO: 6660145 - DNA, 16 bp, Homo sapiens
atatatccctgataaa

SEQ ID NO: 6660146 - DNA, 20 bp, Homo sapiens
atatatccctgataaatatt

SEQ ID NO: 6660147 - DNA, 15 bp, Homo sapiens
atatatcctatttga

SEQ ID NO: 6660148 - DNA, 13 bp, Homo sapiens
atatatcctgtgt

SEQ ID NO: 6660149 - DNA, 15 bp, Homo sapiens
atatatcctgtgtac

SEQ ID NO: 6660150 - DNA, 23 bp, Homo sapiens
atatatccttttcttctatgtag

SEQ ID NO: 6660151 - DNA, 17 bp, Homo sapiens
atatatctaaatttaga

SEQ ID NO: 6660152 - DNA, 15 bp, Homo sapiens
atatatctacacata

SEQ ID NO: 6660153 - DNA, 16 bp, Homo sapiens
atatatctagaactat

SEQ ID NO: 6660154 - DNA, 14 bp, Homo sapiens
atatatctatctta

SEQ ID NO: 6660155 - DNA, 17 bp, Homo sapiens
atatatctctatttgag

SEQ ID NO: 6660156 - DNA, 18 bp, Homo sapiens
atatatctgaaaactgga

SEQ ID NO: 6660157 - DNA, 20 bp, Homo sapiens
atatatctgataaaattgtg

SEQ ID NO: 6660158 - DNA, 18 bp, Homo sapiens
atatatctgtaaagataa

SEQ ID NO: 6660159 - DNA, 19 bp, Homo sapiens
atatatctgtaaagataat

SEQ ID NO: 6660160 - DNA, 16 bp, Homo sapiens
atatatctgtaacact

SEQ ID NO: 6660161 - DNA, 17 bp, Homo sapiens
atatatctgtaacacta

SEQ ID NO: 6660162 - DNA, 20 bp, Homo sapiens
atatatctgttggagaaaga

SEQ ID NO: 6660163 - DNA, 19 bp, Homo sapiens
atatatcttataaagtgga

SEQ ID NO: 6660164 - DNA, 19 bp, Homo sapiens
atatatcttataactgttt

SEQ ID NO: 6660165 - DNA, 20 bp, Homo sapiens
atatatcttatgttaaagga

SEQ ID NO: 6660166 - DNA, 14 bp, Homo sapiens
atatatctttatac

SEQ ID NO: 6660167 - DNA, 15 bp, Homo sapiens
atatatctttatact

SEQ ID NO: 6660168 - DNA, 13 bp, Homo sapiens
atatatctttgta

SEQ ID NO: 6660169 - DNA, 19 bp, Homo sapiens
atatatgaaaactaagttc

SEQ ID NO: 6660170 - DNA, 16 bp, Homo sapiens
atatatgaaaactata

SEQ ID NO: 6660171 - DNA, 19 bp, Homo sapiens
atatatgaagacaataatt

SEQ ID NO: 6660172 - DNA, 17 bp, Homo sapiens
atatatgaagtaagttc

SEQ ID NO: 6660173 - DNA, 17 bp, Homo sapiens
atatatgaatattacat

SEQ ID NO: 6660174 - DNA, 16 bp, Homo sapiens
atatatgatatataaa

SEQ ID NO: 6660175 - DNA, 22 bp, Homo sapiens
atatatgatcattgaaatactt

SEQ ID NO: 6660176 - DNA, 21 bp, Homo sapiens
atatatgattgtttgcacaga

SEQ ID NO: 6660177 - DNA, 17 bp, Homo sapiens
atatatgatttgcatgt

SEQ ID NO: 6660178 - DNA, 15 bp, Homo sapiens
atatatgcacacata

SEQ ID NO: 6660179 - DNA, 16 bp, Homo sapiens
atatatgcacacatat

SEQ ID NO: 6660180 - DNA, 19 bp, Homo sapiens
atatatgcactatgtatat

SEQ ID NO: 6660181 - DNA, 20 bp, Homo sapiens
atatatgcacttaatttgtt

SEQ ID NO: 6660182 - DNA, 20 bp, Homo sapiens
atatatgcatatatatatgt

SEQ ID NO: 6660183 - DNA, 14 bp, Homo sapiens
atatatgccttttt

SEQ ID NO: 6660184 - DNA, 13 bp, Homo sapiens
atatatgctactt

SEQ ID NO: 6660185 - DNA, 18 bp, Homo sapiens
atatatgctcaaccagaa

SEQ ID NO: 6660186 - DNA, 12 bp, Homo sapiens
atatatgctgta

SEQ ID NO: 6660187 - DNA, 22 bp, Homo sapiens
atatatgcttttttgcaataag

SEQ ID NO: 6660188 - DNA, 19 bp, Homo sapiens
atatatggaaggttcctgt

SEQ ID NO: 6660189 - DNA, 17 bp, Homo sapiens
atatatggaataagtgt

SEQ ID NO: 6660190 - DNA, 22 bp, Homo sapiens
atatatggaataagtgtacata

SEQ ID NO: 6660191 - DNA, 16 bp, Homo sapiens
atatatggacctagct

SEQ ID NO: 6660192 - DNA, 17 bp, Homo sapiens
atatatggatcagagga

SEQ ID NO: 6660193 - DNA, 17 bp, Homo sapiens
atatatggatgtgtgtg

SEQ ID NO: 6660194 - DNA, 16 bp, Homo sapiens
atatatggcatttgca

SEQ ID NO: 6660195 - DNA, 18 bp, Homo sapiens
atatatgggggaaaatta

SEQ ID NO: 6660196 - DNA, 16 bp, Homo sapiens
atatatggtctaatgt

SEQ ID NO: 6660197 - DNA, 12 bp, Homo sapiens
atatatgtaaat

SEQ ID NO: 6660198 - DNA, 13 bp, Homo sapiens
atatatgtaaata

SEQ ID NO: 6660199 - DNA, 18 bp, Homo sapiens
atatatgtaaatatacag

SEQ ID NO: 6660200 - DNA, 13 bp, Homo sapiens
atatatgtaatat

SEQ ID NO: 6660201 - DNA, 18 bp, Homo sapiens
atatatgtagagaaagat

SEQ ID NO: 6660202 - DNA, 20 bp, Homo sapiens
atatatgtataatatatatc

SEQ ID NO: 6660203 - DNA, 12 bp, Homo sapiens
atatatgtatat

SEQ ID NO: 6660204 - DNA, 19 bp, Homo sapiens
atatatgtatatatatgca

SEQ ID NO: 6660205 - DNA, 21 bp, Homo sapiens
atatatgtatatgtatatcta

SEQ ID NO: 6660206 - DNA, 12 bp, Homo sapiens
atatatgtatgt

SEQ ID NO: 6660207 - DNA, 19 bp, Homo sapiens
atatatgtattatttataa

SEQ ID NO: 6660208 - DNA, 12 bp, Homo sapiens
atatatgtattt

SEQ ID NO: 6660209 - DNA, 15 bp, Homo sapiens
atatatgtatttcta

SEQ ID NO: 6660210 - DNA, 12 bp, Homo sapiens
atatatgtgaac

SEQ ID NO: 6660211 - DNA, 18 bp, Homo sapiens
atatatgtgaacatttat

SEQ ID NO: 6660212 - DNA, 14 bp, Homo sapiens
atatatgtgatgat

SEQ ID NO: 6660213 - DNA, 16 bp, Homo sapiens
atatatgtgcagtatt

SEQ ID NO: 6660214 - DNA, 19 bp, Homo sapiens
atatatgtgtatatataca

SEQ ID NO: 6660215 - DNA, 21 bp, Homo sapiens
atatatgtgtatatatacata

SEQ ID NO: 6660216 - DNA, 13 bp, Homo sapiens
atatatgtgtatg

SEQ ID NO: 6660217 - DNA, 14 bp, Homo sapiens
atatatgtgtgtgt

SEQ ID NO: 6660218 - DNA, 22 bp, Homo sapiens
atatatgtgtgtgtatataaat

SEQ ID NO: 6660219 - DNA, 23 bp, Homo sapiens
atatatgtgtttttcacatttgc

SEQ ID NO: 6660220 - DNA, 14 bp, Homo sapiens
atatatgtttacct

SEQ ID NO: 6660221 - DNA, 22 bp, Homo sapiens
atatatgttttaagaggcaggg

SEQ ID NO: 6660222 - DNA, 17 bp, Homo sapiens
atatatgtttttgaagg

SEQ ID NO: 6660223 - DNA, 16 bp, Homo sapiens
atatattaaaaatata

SEQ ID NO: 6660224 - DNA, 17 bp, Homo sapiens
atatattaaaacaataa

SEQ ID NO: 6660225 - DNA, 24 bp, Homo sapiens
atatattaaaacaataatgcaatt

SEQ ID NO: 6660226 - DNA, 22 bp, Homo sapiens
atatattaaaatgtaggaagaa

SEQ ID NO: 6660227 - DNA, 16 bp, Homo sapiens
atatattaaaattcca

SEQ ID NO: 6660228 - DNA, 17 bp, Homo sapiens
atatattacaagggata

SEQ ID NO: 6660229 - DNA, 19 bp, Homo sapiens
atatattaccccttcatgt

SEQ ID NO: 6660230 - DNA, 13 bp, Homo sapiens
atatattataagt

SEQ ID NO: 6660231 - DNA, 17 bp, Homo sapiens
atatattatacttgtaa

SEQ ID NO: 6660232 - DNA, 19 bp, Homo sapiens
atatattatacttgtaatt

SEQ ID NO: 6660233 - DNA, 11 bp, Homo sapiens
atatattatat

SEQ ID NO: 6660234 - DNA, 16 bp, Homo sapiens
atatattatatacata

SEQ ID NO: 6660235 - DNA, 15 bp, Homo sapiens
atatattatatatat

SEQ ID NO: 6660236 - DNA, 15 bp, Homo sapiens
atatattatgaaaat

SEQ ID NO: 6660237 - DNA, 21 bp, Homo sapiens
atatattatgtcttattttat

SEQ ID NO: 6660238 - DNA, 15 bp, Homo sapiens
atatattattctcat

SEQ ID NO: 6660239 - DNA, 21 bp, Homo sapiens
atatattattctcatttagtg

SEQ ID NO: 6660240 - DNA, 14 bp, Homo sapiens
atatattattgtaa

SEQ ID NO: 6660241 - DNA, 17 bp, Homo sapiens
atatattattgtaagtt

SEQ ID NO: 6660242 - DNA, 15 bp, Homo sapiens
atatattcaccaatg

SEQ ID NO: 6660243 - DNA, 16 bp, Homo sapiens
atatattcatacctgt

SEQ ID NO: 6660244 - DNA, 16 bp, Homo sapiens
atatattcatatacaa

SEQ ID NO: 6660245 - DNA, 22 bp, Homo sapiens
atatattccttactagaaatat

SEQ ID NO: 6660246 - DNA, 23 bp, Homo sapiens
atatattcgggcaggactgttgt

SEQ ID NO: 6660247 - DNA, 19 bp, Homo sapiens
atatattctacacatatat

SEQ ID NO: 6660248 - DNA, 13 bp, Homo sapiens
atatattctctaa

SEQ ID NO: 6660249 - DNA, 14 bp, Homo sapiens
atatattctctaat

SEQ ID NO: 6660250 - DNA, 18 bp, Homo sapiens
atatattctctaataaaa

SEQ ID NO: 6660251 - DNA, 16 bp, Homo sapiens
atatattctctttggt

SEQ ID NO: 6660252 - DNA, 14 bp, Homo sapiens
atatattcttataa

SEQ ID NO: 6660253 - DNA, 12 bp, Homo sapiens
atatattctttc

SEQ ID NO: 6660254 - DNA, 13 bp, Homo sapiens
atatattctttcc

SEQ ID NO: 6660255 - DNA, 13 bp, Homo sapiens
atatattgaactt

SEQ ID NO: 6660256 - DNA, 22 bp, Homo sapiens
atatattgaacttttgtactga

SEQ ID NO: 6660257 - DNA, 22 bp, Homo sapiens
atatattgaagtaagttcatca

SEQ ID NO: 6660258 - DNA, 18 bp, Homo sapiens
atatattgaatattttat

SEQ ID NO: 6660259 - DNA, 14 bp, Homo sapiens
atatattgaattaa

SEQ ID NO: 6660260 - DNA, 19 bp, Homo sapiens
atatattgcttatctgaaa

SEQ ID NO: 6660261 - DNA, 20 bp, Homo sapiens
atatattggcactgctaaaa

SEQ ID NO: 6660262 - DNA, 14 bp, Homo sapiens
atatattgtaaaga

SEQ ID NO: 6660263 - DNA, 14 bp, Homo sapiens
atatattgtacaaa

SEQ ID NO: 6660264 - DNA, 18 bp, Homo sapiens
atatattgttgacaactg

SEQ ID NO: 6660265 - DNA, 18 bp, Homo sapiens
atatatttaaaagtgtca

SEQ ID NO: 6660266 - DNA, 18 bp, Homo sapiens
atatatttaaaatatatt

SEQ ID NO: 6660267 - DNA, 17 bp, Homo sapiens
atatatttaaaattcat

SEQ ID NO: 6660268 - DNA, 17 bp, Homo sapiens
atatatttaacaatgac

SEQ ID NO: 6660269 - DNA, 18 bp, Homo sapiens
atatatttaacaatgaca

SEQ ID NO: 6660270 - DNA, 15 bp, Homo sapiens
atatatttaacatgt

SEQ ID NO: 6660271 - DNA, 21 bp, Homo sapiens
atatatttaactatttagaga

SEQ ID NO: 6660272 - DNA, 13 bp, Homo sapiens
atatatttaagcc

SEQ ID NO: 6660273 - DNA, 18 bp, Homo sapiens
atatatttaatatattga

SEQ ID NO: 6660274 - DNA, 20 bp, Homo sapiens
atatatttaatatattgaat

SEQ ID NO: 6660275 - DNA, 17 bp, Homo sapiens
atatatttaatatgtca

SEQ ID NO: 6660276 - DNA, 13 bp, Homo sapiens
atatatttaatga

SEQ ID NO: 6660277 - DNA, 17 bp, Homo sapiens
atatatttactaaaaga

SEQ ID NO: 6660278 - DNA, 10 bp, Homo sapiens
atatatttat

SEQ ID NO: 6660279 - DNA, 18 bp, Homo sapiens
atatatttataaatatgt

SEQ ID NO: 6660280 - DNA, 13 bp, Homo sapiens
atatatttataac

SEQ ID NO: 6660281 - DNA, 21 bp, Homo sapiens
atatatttataactcatcata

SEQ ID NO: 6660282 - DNA, 21 bp, Homo sapiens
atatatttatatactttttca

SEQ ID NO: 6660283 - DNA, 21 bp, Homo sapiens
atatatttattgagtacctac

SEQ ID NO: 6660284 - DNA, 14 bp, Homo sapiens
atatatttatttaa

SEQ ID NO: 6660285 - DNA, 22 bp, Homo sapiens
atatatttcacttttgttctgc

SEQ ID NO: 6660286 - DNA, 14 bp, Homo sapiens
atatatttcagata

SEQ ID NO: 6660287 - DNA, 15 bp, Homo sapiens
atatatttccaaata

SEQ ID NO: 6660288 - DNA, 18 bp, Homo sapiens
atatatttccaaatattc

SEQ ID NO: 6660289 - DNA, 20 bp, Homo sapiens
atatatttccaaatattcta

SEQ ID NO: 6660290 - DNA, 14 bp, Homo sapiens
atatatttctttgt

SEQ ID NO: 6660291 - DNA, 13 bp, Homo sapiens
atatatttgaaag

SEQ ID NO: 6660292 - DNA, 14 bp, Homo sapiens
atatatttgaaaga

SEQ ID NO: 6660293 - DNA, 18 bp, Homo sapiens
atatatttgaatatcatt

SEQ ID NO: 6660294 - DNA, 23 bp, Homo sapiens
atatatttgcagataattctgga

SEQ ID NO: 6660295 - DNA, 15 bp, Homo sapiens
atatatttgcataat

SEQ ID NO: 6660296 - DNA, 13 bp, Homo sapiens
atatatttgtcac

SEQ ID NO: 6660297 - DNA, 17 bp, Homo sapiens
atatatttgtcattttc

SEQ ID NO: 6660298 - DNA, 21 bp, Homo sapiens
atatatttgtttcatttctgc

SEQ ID NO: 6660299 - DNA, 12 bp, Homo sapiens
atatattttaaa

SEQ ID NO: 6660300 - DNA, 17 bp, Homo sapiens
atatattttaaatgtgg

SEQ ID NO: 6660301 - DNA, 21 bp, Homo sapiens
atatattttaaggttgcacac

SEQ ID NO: 6660302 - DNA, 19 bp, Homo sapiens
atatattttacatctggga

SEQ ID NO: 6660303 - DNA, 12 bp, Homo sapiens
atatattttata

SEQ ID NO: 6660304 - DNA, 13 bp, Homo sapiens
atatattttatat

SEQ ID NO: 6660305 - DNA, 15 bp, Homo sapiens
atatattttatatgt

SEQ ID NO: 6660306 - DNA, 18 bp, Homo sapiens
atatattttatttttaga

SEQ ID NO: 6660307 - DNA, 20 bp, Homo sapiens
atatattttcatcctataag

SEQ ID NO: 6660308 - DNA, 16 bp, Homo sapiens
atatattttctttcta

SEQ ID NO: 6660309 - DNA, 20 bp, Homo sapiens
atatattttctttctagttt

SEQ ID NO: 6660310 - DNA, 18 bp, Homo sapiens
atatattttgaaaggaga

SEQ ID NO: 6660311 - DNA, 19 bp, Homo sapiens
atatattttgaaatattga

SEQ ID NO: 6660312 - DNA, 17 bp, Homo sapiens
atatattttgtatgcaa

SEQ ID NO: 6660313 - DNA, 19 bp, Homo sapiens
atatattttgtatgcaagc

SEQ ID NO: 6660314 - DNA, 22 bp, Homo sapiens
atatattttgtatgcaagcagt

SEQ ID NO: 6660315 - DNA, 19 bp, Homo sapiens
atatattttgtgtgaaatt

SEQ ID NO: 6660316 - DNA, 20 bp, Homo sapiens
atatattttgttgttcctct

SEQ ID NO: 6660317 - DNA, 21 bp, Homo sapiens
atatattttgttgttcctcta

SEQ ID NO: 6660318 - DNA, 13 bp, Homo sapiens
atatatttttaag

SEQ ID NO: 6660319 - DNA, 14 bp, Homo sapiens
atatatttttaaga

SEQ ID NO: 6660320 - DNA, 20 bp, Homo sapiens
atatatttttaatggaaagt

SEQ ID NO: 6660321 - DNA, 17 bp, Homo sapiens
atatatttttactgctt

SEQ ID NO: 6660322 - DNA, 21 bp, Homo sapiens
atatatttttactgctttctg

SEQ ID NO: 6660323 - DNA, 14 bp, Homo sapiens
atatatttttatat

SEQ ID NO: 6660324 - DNA, 19 bp, Homo sapiens
atatatttttatatgtgga

SEQ ID NO: 6660325 - DNA, 15 bp, Homo sapiens
atatatttttatatt

SEQ ID NO: 6660326 - DNA, 16 bp, Homo sapiens
atatatttttcaaata

SEQ ID NO: 6660327 - DNA, 18 bp, Homo sapiens
atatatttttcaaataga

SEQ ID NO: 6660328 - DNA, 19 bp, Homo sapiens
atatatttttcaaatagat

SEQ ID NO: 6660329 - DNA, 20 bp, Homo sapiens
atatatttttcaaatagatt

SEQ ID NO: 6660330 - DNA, 16 bp, Homo sapiens
atatatttttcaacca

SEQ ID NO: 6660331 - DNA, 17 bp, Homo sapiens
atatatttttcaaccag

SEQ ID NO: 6660332 - DNA, 20 bp, Homo sapiens
atatatttttcaaccagcat

SEQ ID NO: 6660333 - DNA, 14 bp, Homo sapiens
atatatttttcaca

SEQ ID NO: 6660334 - DNA, 21 bp, Homo sapiens
atatatttttcacagtttttc

SEQ ID NO: 6660335 - DNA, 17 bp, Homo sapiens
atatatttttccctgtt

SEQ ID NO: 6660336 - DNA, 13 bp, Homo sapiens
atatatttttcta

SEQ ID NO: 6660337 - DNA, 20 bp, Homo sapiens
atatatttttggttgtcaat

SEQ ID NO: 6660338 - DNA, 14 bp, Homo sapiens
atatatttttgtga

SEQ ID NO: 6660339 - DNA, 19 bp, Homo sapiens
atatattttttaatttgat

SEQ ID NO: 6660340 - DNA, 17 bp, Homo sapiens
atatcaaaaaaccttta

SEQ ID NO: 6660341 - DNA, 14 bp, Homo sapiens
atatcaaaaagact

SEQ ID NO: 6660342 - DNA, 14 bp, Homo sapiens
atatcaaaagacac

SEQ ID NO: 6660343 - DNA, 17 bp, Homo sapiens
atatcaaaagacacagg

SEQ ID NO: 6660344 - DNA, 13 bp, Homo sapiens
atatcaaaaggaa

SEQ ID NO: 6660345 - DNA, 16 bp, Homo sapiens
atatcaaacattaaaa

SEQ ID NO: 6660346 - DNA, 19 bp, Homo sapiens
atatcaaagcattttataa

SEQ ID NO: 6660347 - DNA, 21 bp, Homo sapiens
atatcaaagtcattaaagaca

SEQ ID NO: 6660348 - DNA, 21 bp, Homo sapiens
atatcaaataaaatatcataa

SEQ ID NO: 6660349 - DNA, 23 bp, Homo sapiens
atatcaaataaaatatcataaag

SEQ ID NO: 6660350 - DNA, 16 bp, Homo sapiens
atatcaaatccaggac

SEQ ID NO: 6660351 - DNA, 17 bp, Homo sapiens
atatcaaatccaggact

SEQ ID NO: 6660352 - DNA, 23 bp, Homo sapiens
atatcaaatccaggactttgtta

SEQ ID NO: 6660353 - DNA, 20 bp, Homo sapiens
atatcaaattaattgtgtga

SEQ ID NO: 6660354 - DNA, 16 bp, Homo sapiens
atatcaacaacaagtt

SEQ ID NO: 6660355 - DNA, 17 bp, Homo sapiens
atatcaacagcttccct

SEQ ID NO: 6660356 - DNA, 13 bp, Homo sapiens
atatcaacttatt

SEQ ID NO: 6660357 - DNA, 22 bp, Homo sapiens
atatcaagaagtcagagaaaac

SEQ ID NO: 6660358 - DNA, 19 bp, Homo sapiens
atatcaagaatagttgtca

SEQ ID NO: 6660359 - DNA, 14 bp, Homo sapiens
atatcaagagacat

SEQ ID NO: 6660360 - DNA, 14 bp, Homo sapiens
atatcaaggaaaac

SEQ ID NO: 6660361 - DNA, 18 bp, Homo sapiens
atatcaaggagctcttct

SEQ ID NO: 6660362 - DNA, 14 bp, Homo sapiens
atatcaaggatgtt

SEQ ID NO: 6660363 - DNA, 17 bp, Homo sapiens
atatcaaggatgttctg

SEQ ID NO: 6660364 - DNA, 20 bp, Homo sapiens
atatcaagtactacattttc

SEQ ID NO: 6660365 - DNA, 13 bp, Homo sapiens
atatcaatatggt

SEQ ID NO: 6660366 - DNA, 14 bp, Homo sapiens
atatcaatcacatt

SEQ ID NO: 6660367 - DNA, 14 bp, Homo sapiens
atatcaatgcccaa

SEQ ID NO: 6660368 - DNA, 16 bp, Homo sapiens
atatcaattcaacaca

SEQ ID NO: 6660369 - DNA, 22 bp, Homo sapiens
atatcacaagagtccccagact

SEQ ID NO: 6660370 - DNA, 13 bp, Homo sapiens
atatcacacaata

SEQ ID NO: 6660371 - DNA, 17 bp, Homo sapiens
atatcacacaatatagt

SEQ ID NO: 6660372 - DNA, 22 bp, Homo sapiens
atatcacagagccactcttcaa

SEQ ID NO: 6660373 - DNA, 22 bp, Homo sapiens
atatcaccaaaaacctattcca

SEQ ID NO: 6660374 - DNA, 21 bp, Homo sapiens
atatcacccagacataaagga

SEQ ID NO: 6660375 - DNA, 16 bp, Homo sapiens
atatcacccttccctg

SEQ ID NO: 6660376 - DNA, 17 bp, Homo sapiens
atatcacccttccctgc

SEQ ID NO: 6660377 - DNA, 11 bp, Homo sapiens
atatcacctct

SEQ ID NO: 6660378 - DNA, 12 bp, Homo sapiens
atatcacctctc

SEQ ID NO: 6660379 - DNA, 17 bp, Homo sapiens
atatcacctctcttcag

SEQ ID NO: 6660380 - DNA, 19 bp, Homo sapiens
atatcacctctcttcttag

SEQ ID NO: 6660381 - DNA, 15 bp, Homo sapiens
atatcacctgaatta

SEQ ID NO: 6660382 - DNA, 18 bp, Homo sapiens
atatcacctgaattatta

SEQ ID NO: 6660383 - DNA, 17 bp, Homo sapiens
atatcactaaaagcatg

SEQ ID NO: 6660384 - DNA, 15 bp, Homo sapiens
atatcactaaataaa

SEQ ID NO: 6660385 - DNA, 23 bp, Homo sapiens
atatcactaaataaacacgattt

SEQ ID NO: 6660386 - DNA, 15 bp, Homo sapiens
atatcactaagagct

SEQ ID NO: 6660387 - DNA, 15 bp, Homo sapiens
atatcactcattaat

SEQ ID NO: 6660388 - DNA, 13 bp, Homo sapiens
atatcactttgta

SEQ ID NO: 6660389 - DNA, 13 bp, Homo sapiens
atatcagaaaagt

SEQ ID NO: 6660390 - DNA, 14 bp, Homo sapiens
atatcagaaaagta

SEQ ID NO: 6660391 - DNA, 15 bp, Homo sapiens
atatcagaaaagtag

SEQ ID NO: 6660392 - DNA, 17 bp, Homo sapiens
atatcagaaaagtagaa

SEQ ID NO: 6660393 - DNA, 19 bp, Homo sapiens
atatcagacaagcactatt

SEQ ID NO: 6660394 - DNA, 18 bp, Homo sapiens
atatcagacctctgatcc

SEQ ID NO: 6660395 - DNA, 21 bp, Homo sapiens
atatcagagctcttaatgttg

SEQ ID NO: 6660396 - DNA, 15 bp, Homo sapiens
atatcagagctggga

SEQ ID NO: 6660397 - DNA, 17 bp, Homo sapiens
atatcagcactggattg

SEQ ID NO: 6660398 - DNA, 22 bp, Homo sapiens
atatcagcactggattgtagaa

SEQ ID NO: 6660399 - DNA, 12 bp, Homo sapiens
atatcagcctga

SEQ ID NO: 6660400 - DNA, 21 bp, Homo sapiens
atatcagcctgagtctcctgt

SEQ ID NO: 6660401 - DNA, 15 bp, Homo sapiens
atatcagctactgta

SEQ ID NO: 6660402 - DNA, 22 bp, Homo sapiens
atatcagctctaaagcagagat

SEQ ID NO: 6660403 - DNA, 20 bp, Homo sapiens
atatcagctttgataattgt

SEQ ID NO: 6660404 - DNA, 20 bp, Homo sapiens
atatcaggaaatatctgtga

SEQ ID NO: 6660405 - DNA, 14 bp, Homo sapiens
atatcaggagggga

SEQ ID NO: 6660406 - DNA, 17 bp, Homo sapiens
atatcaggctattattt

SEQ ID NO: 6660407 - DNA, 22 bp, Homo sapiens
atatcaggctattatttattgt

SEQ ID NO: 6660408 - DNA, 21 bp, Homo sapiens
atatcagggcctgagtgacct

SEQ ID NO: 6660409 - DNA, 18 bp, Homo sapiens
atatcaggtaaaatattt

SEQ ID NO: 6660410 - DNA, 23 bp, Homo sapiens
atatcagtaacccccttaaattt

SEQ ID NO: 6660411 - DNA, 15 bp, Homo sapiens
atatcagtattctga

SEQ ID NO: 6660412 - DNA, 16 bp, Homo sapiens
atatcagtgacagttg

SEQ ID NO: 6660413 - DNA, 21 bp, Homo sapiens
atatcagttacagtggcagta

SEQ ID NO: 6660414 - DNA, 18 bp, Homo sapiens
atatcagttactcagccc

SEQ ID NO: 6660415 - DNA, 12 bp, Homo sapiens
atatcagtttga

SEQ ID NO: 6660416 - DNA, 13 bp, Homo sapiens
atatcagtttgct

SEQ ID NO: 6660417 - DNA, 21 bp, Homo sapiens
atatcataaaggatatttcaa

SEQ ID NO: 6660418 - DNA, 13 bp, Homo sapiens
atatcataaagta

SEQ ID NO: 6660419 - DNA, 13 bp, Homo sapiens
atatcataactat

SEQ ID NO: 6660420 - DNA, 21 bp, Homo sapiens
atatcataatgggggtaaagt

SEQ ID NO: 6660421 - DNA, 13 bp, Homo sapiens
atatcatacagtt

SEQ ID NO: 6660422 - DNA, 15 bp, Homo sapiens
atatcatacagtttt

SEQ ID NO: 6660423 - DNA, 19 bp, Homo sapiens
atatcatacagttttcatt

SEQ ID NO: 6660424 - DNA, 21 bp, Homo sapiens
atatcataggtacaatctttc

SEQ ID NO: 6660425 - DNA, 16 bp, Homo sapiens
atatcatagtataaat

SEQ ID NO: 6660426 - DNA, 15 bp, Homo sapiens
atatcatatataaaa

SEQ ID NO: 6660427 - DNA, 12 bp, Homo sapiens
atatcatatttc

SEQ ID NO: 6660428 - DNA, 14 bp, Homo sapiens
atatcatatttctg

SEQ ID NO: 6660429 - DNA, 17 bp, Homo sapiens
atatcatatttctgtgg

SEQ ID NO: 6660430 - DNA, 21 bp, Homo sapiens
atatcatcaatgtgacattta

SEQ ID NO: 6660431 - DNA, 23 bp, Homo sapiens
atatcatcaatgtgacatttaca

SEQ ID NO: 6660432 - DNA, 20 bp, Homo sapiens
atatcatccccaaatgtgtc

SEQ ID NO: 6660433 - DNA, 21 bp, Homo sapiens
atatcatccccaaatgtgtct

SEQ ID NO: 6660434 - DNA, 22 bp, Homo sapiens
atatcatctcaattttttcaaa

SEQ ID NO: 6660435 - DNA, 18 bp, Homo sapiens
atatcatctgtcattata

SEQ ID NO: 6660436 - DNA, 14 bp, Homo sapiens
atatcatgaaacac

SEQ ID NO: 6660437 - DNA, 18 bp, Homo sapiens
atatcatgaaacacttct

SEQ ID NO: 6660438 - DNA, 15 bp, Homo sapiens
atatcatgaaagaat

SEQ ID NO: 6660439 - DNA, 16 bp, Homo sapiens
atatcatgaagccttg

SEQ ID NO: 6660440 - DNA, 16 bp, Homo sapiens
atatcatgaatgtgag

SEQ ID NO: 6660441 - DNA, 14 bp, Homo sapiens
atatcatggtaatg

SEQ ID NO: 6660442 - DNA, 18 bp, Homo sapiens
atatcatggtaatgacag

SEQ ID NO: 6660443 - DNA, 13 bp, Homo sapiens
atatcatgtaaag

SEQ ID NO: 6660444 - DNA, 21 bp, Homo sapiens
atatcatgtaaagaaatgtct

SEQ ID NO: 6660445 - DNA, 15 bp, Homo sapiens
atatcatgtgtagat

SEQ ID NO: 6660446 - DNA, 22 bp, Homo sapiens
atatcatgtgtagatattatgt

SEQ ID NO: 6660447 - DNA, 23 bp, Homo sapiens
atatcatgtgtagatattatgta

SEQ ID NO: 6660448 - DNA, 22 bp, Homo sapiens
atatcatgttaaattagaatga

SEQ ID NO: 6660449 - DNA, 14 bp, Homo sapiens
atatcattaaacaa

SEQ ID NO: 6660450 - DNA, 22 bp, Homo sapiens
atatcattactaacttcttcca

SEQ ID NO: 6660451 - DNA, 18 bp, Homo sapiens
atatcattatagcatgta

SEQ ID NO: 6660452 - DNA, 13 bp, Homo sapiens
atatcattctaaa

SEQ ID NO: 6660453 - DNA, 17 bp, Homo sapiens
atatcattctaaagata

SEQ ID NO: 6660454 - DNA, 19 bp, Homo sapiens
atatcattctgtgattaaa

SEQ ID NO: 6660455 - DNA, 21 bp, Homo sapiens
atatcattctttgtatcttaa

SEQ ID NO: 6660456 - DNA, 17 bp, Homo sapiens
atatcattgattttata

SEQ ID NO: 6660457 - DNA, 23 bp, Homo sapiens
atatcatttattttttacattat

SEQ ID NO: 6660458 - DNA, 22 bp, Homo sapiens
atatcatttcactgtctaggct

SEQ ID NO: 6660459 - DNA, 18 bp, Homo sapiens
atatcatttcataaaaat

SEQ ID NO: 6660460 - DNA, 14 bp, Homo sapiens
atatcatttgtgaa

SEQ ID NO: 6660461 - DNA, 17 bp, Homo sapiens
atatcattttaaaaact

SEQ ID NO: 6660462 - DNA, 20 bp, Homo sapiens
atatcattttaaaaacttta

SEQ ID NO: 6660463 - DNA, 13 bp, Homo sapiens
atatccaaaattc

SEQ ID NO: 6660464 - DNA, 16 bp, Homo sapiens
atatccaaagactgta

SEQ ID NO: 6660465 - DNA, 18 bp, Homo sapiens
atatccaaagactgtact

SEQ ID NO: 6660466 - DNA, 15 bp, Homo sapiens
atatccaagtaccaa

SEQ ID NO: 6660467 - DNA, 16 bp, Homo sapiens
atatccaagtttgaat

SEQ ID NO: 6660468 - DNA, 18 bp, Homo sapiens
atatccaattttaaaatg

SEQ ID NO: 6660469 - DNA, 16 bp, Homo sapiens
atatccacaaatgcta

SEQ ID NO: 6660470 - DNA, 17 bp, Homo sapiens
atatccacataaatgct

SEQ ID NO: 6660471 - DNA, 18 bp, Homo sapiens
atatccacataaatgctc

SEQ ID NO: 6660472 - DNA, 21 bp, Homo sapiens
atatccacataaatgctcctt

SEQ ID NO: 6660473 - DNA, 16 bp, Homo sapiens
atatccaccacctccc

SEQ ID NO: 6660474 - DNA, 14 bp, Homo sapiens
atatccacccagca

SEQ ID NO: 6660475 - DNA, 13 bp, Homo sapiens
atatccagaaata

SEQ ID NO: 6660476 - DNA, 15 bp, Homo sapiens
atatccagaagggga

SEQ ID NO: 6660477 - DNA, 16 bp, Homo sapiens
atatccagtcaaagac

SEQ ID NO: 6660478 - DNA, 16 bp, Homo sapiens
atatccagttcctgct

SEQ ID NO: 6660479 - DNA, 18 bp, Homo sapiens
atatccagttcctgctct

SEQ ID NO: 6660480 - DNA, 22 bp, Homo sapiens
atatccagttcctgctctctgc

SEQ ID NO: 6660481 - DNA, 20 bp, Homo sapiens
atatccataaaattggatta

SEQ ID NO: 6660482 - DNA, 16 bp, Homo sapiens
atatccataacctcta

SEQ ID NO: 6660483 - DNA, 20 bp, Homo sapiens
atatccatgagctgcactga

SEQ ID NO: 6660484 - DNA, 18 bp, Homo sapiens
atatccatgatcacacag

SEQ ID NO: 6660485 - DNA, 12 bp, Homo sapiens
atatccatgtac

SEQ ID NO: 6660486 - DNA, 18 bp, Homo sapiens
atatccattctttctgat

SEQ ID NO: 6660487 - DNA, 18 bp, Homo sapiens
atatccatttatcttttg

SEQ ID NO: 6660488 - DNA, 20 bp, Homo sapiens
atatcccaaactgtgatgaa

SEQ ID NO: 6660489 - DNA, 16 bp, Homo sapiens
atatcccaacattctg

SEQ ID NO: 6660490 - DNA, 16 bp, Homo sapiens
atatcccaagtgcact

SEQ ID NO: 6660491 - DNA, 13 bp, Homo sapiens
atatcccagagaa

SEQ ID NO: 6660492 - DNA, 23 bp, Homo sapiens
atatcccatatatttaatatgtc

SEQ ID NO: 6660493 - DNA, 17 bp, Homo sapiens
atatcccgtgaaagttt

SEQ ID NO: 6660494 - DNA, 15 bp, Homo sapiens
atatccctacatgta

SEQ ID NO: 6660495 - DNA, 17 bp, Homo sapiens
atatccctatgtcccag

SEQ ID NO: 6660496 - DNA, 16 bp, Homo sapiens
atatccctgcccagcc

SEQ ID NO: 6660497 - DNA, 16 bp, Homo sapiens
atatcccttaatgaaa

SEQ ID NO: 6660498 - DNA, 21 bp, Homo sapiens
atatcccttggacattttatg

SEQ ID NO: 6660499 - DNA, 19 bp, Homo sapiens
atatccgggtgctcaataa

SEQ ID NO: 6660500 - DNA, 13 bp, Homo sapiens
atatcctaaacat

SEQ ID NO: 6660501 - DNA, 22 bp, Homo sapiens
atatcctaaacatcattcattt

SEQ ID NO: 6660502 - DNA, 16 bp, Homo sapiens
atatcctacttctcca

SEQ ID NO: 6660503 - DNA, 17 bp, Homo sapiens
atatcctctccccctcc

SEQ ID NO: 6660504 - DNA, 22 bp, Homo sapiens
atatcctctccccctcctccag

SEQ ID NO: 6660505 - DNA, 14 bp, Homo sapiens
atatcctgaataac

SEQ ID NO: 6660506 - DNA, 11 bp, Homo sapiens
atatcctgcct

SEQ ID NO: 6660507 - DNA, 12 bp, Homo sapiens
atatcctgcctc

SEQ ID NO: 6660508 - DNA, 14 bp, Homo sapiens
atatcctgctcaca

SEQ ID NO: 6660509 - DNA, 13 bp, Homo sapiens
atatcctgtgtac

SEQ ID NO: 6660510 - DNA, 23 bp, Homo sapiens
atatcctgtgtacctcactgtcc

SEQ ID NO: 6660511 - DNA, 14 bp, Homo sapiens
atatcctgtttgta

SEQ ID NO: 6660512 - DNA, 16 bp, Homo sapiens
atatcctgtttgtatt

SEQ ID NO: 6660513 - DNA, 18 bp, Homo sapiens
atatccttatcagagcta

SEQ ID NO: 6660514 - DNA, 15 bp, Homo sapiens
atatcctttctaaca

SEQ ID NO: 6660515 - DNA, 15 bp, Homo sapiens
atatccttttagaag

SEQ ID NO: 6660516 - DNA, 15 bp, Homo sapiens
atatcgctgacttca

SEQ ID NO: 6660517 - DNA, 20 bp, Homo sapiens
atatcggaggtggtggagga

SEQ ID NO: 6660518 - DNA, 17 bp, Homo sapiens
atatcggtgctatgtgt

SEQ ID NO: 6660519 - DNA, 16 bp, Homo sapiens
atatcgtacctgtccc

SEQ ID NO: 6660520 - DNA, 20 bp, Homo sapiens
atatctaaagttatatttca

SEQ ID NO: 6660521 - DNA, 21 bp, Homo sapiens
atatctaaagttatatttcag

SEQ ID NO: 6660522 - DNA, 18 bp, Homo sapiens
atatctaaattgaataat

SEQ ID NO: 6660523 - DNA, 13 bp, Homo sapiens
atatctaactttg

SEQ ID NO: 6660524 - DNA, 16 bp, Homo sapiens
atatctaactttgtaa

SEQ ID NO: 6660525 - DNA, 12 bp, Homo sapiens
atatctaagact

SEQ ID NO: 6660526 - DNA, 15 bp, Homo sapiens
atatctaagttcaca

SEQ ID NO: 6660527 - DNA, 14 bp, Homo sapiens
atatctaatatata

SEQ ID NO: 6660528 - DNA, 18 bp, Homo sapiens
atatctaatatatatgaa

SEQ ID NO: 6660529 - DNA, 16 bp, Homo sapiens
atatctaatttaccat

SEQ ID NO: 6660530 - DNA, 16 bp, Homo sapiens
atatctaatttataca

SEQ ID NO: 6660531 - DNA, 18 bp, Homo sapiens
atatctaatttatacaaa

SEQ ID NO: 6660532 - DNA, 17 bp, Homo sapiens
atatctacacatacaga

SEQ ID NO: 6660533 - DNA, 23 bp, Homo sapiens
atatctacacatacagaaagaag

SEQ ID NO: 6660534 - DNA, 14 bp, Homo sapiens
atatctacagatag

SEQ ID NO: 6660535 - DNA, 21 bp, Homo sapiens
atatctaccccagactagatg

SEQ ID NO: 6660536 - DNA, 21 bp, Homo sapiens
atatctacctgccctctctca

SEQ ID NO: 6660537 - DNA, 13 bp, Homo sapiens
atatctagaacta

SEQ ID NO: 6660538 - DNA, 14 bp, Homo sapiens
atatctagtatgaa

SEQ ID NO: 6660539 - DNA, 13 bp, Homo sapiens
atatctagtgaca

SEQ ID NO: 6660540 - DNA, 17 bp, Homo sapiens
atatctagtgacagagg

SEQ ID NO: 6660541 - DNA, 16 bp, Homo sapiens
atatctagtgctaaac

SEQ ID NO: 6660542 - DNA, 13 bp, Homo sapiens
atatctataaaat

SEQ ID NO: 6660543 - DNA, 17 bp, Homo sapiens
atatctataaacactgt

SEQ ID NO: 6660544 - DNA, 22 bp, Homo sapiens
atatctatagtagacacactat

SEQ ID NO: 6660545 - DNA, 17 bp, Homo sapiens
atatctatatataattc

SEQ ID NO: 6660546 - DNA, 19 bp, Homo sapiens
atatctatatatataattt

SEQ ID NO: 6660547 - DNA, 16 bp, Homo sapiens
atatctatatatgtat

SEQ ID NO: 6660548 - DNA, 21 bp, Homo sapiens
atatctatatatgtatctaca

SEQ ID NO: 6660549 - DNA, 15 bp, Homo sapiens
atatctatatcatat

SEQ ID NO: 6660550 - DNA, 16 bp, Homo sapiens
atatctatatcatatt

SEQ ID NO: 6660551 - DNA, 18 bp, Homo sapiens
atatctatatctctaaac

SEQ ID NO: 6660552 - DNA, 22 bp, Homo sapiens
atatctatattctaaagagcta

SEQ ID NO: 6660553 - DNA, 22 bp, Homo sapiens
atatctatattttacataaatt

SEQ ID NO: 6660554 - DNA, 13 bp, Homo sapiens
atatctatctatt

SEQ ID NO: 6660555 - DNA, 18 bp, Homo sapiens
atatctatctatttgagg

SEQ ID NO: 6660556 - DNA, 13 bp, Homo sapiens
atatctattaata

SEQ ID NO: 6660557 - DNA, 23 bp, Homo sapiens
atatctattattataaaaataat

SEQ ID NO: 6660558 - DNA, 19 bp, Homo sapiens
atatctatttatctgtctg

SEQ ID NO: 6660559 - DNA, 20 bp, Homo sapiens
atatctatttatctgtctga

SEQ ID NO: 6660560 - DNA, 15 bp, Homo sapiens
atatctatttgaata

SEQ ID NO: 6660561 - DNA, 20 bp, Homo sapiens
atatctatttgaataaatta

SEQ ID NO: 6660562 - DNA, 16 bp, Homo sapiens
atatctcaacagaatt

SEQ ID NO: 6660563 - DNA, 15 bp, Homo sapiens
atatctcaatctgca

SEQ ID NO: 6660564 - DNA, 17 bp, Homo sapiens
atatctcaatctgcagc

SEQ ID NO: 6660565 - DNA, 23 bp, Homo sapiens
atatctcaatgaaccataaattc

SEQ ID NO: 6660566 - DNA, 13 bp, Homo sapiens
atatctcagaggc

SEQ ID NO: 6660567 - DNA, 12 bp, Homo sapiens
atatctcatctg

SEQ ID NO: 6660568 - DNA, 19 bp, Homo sapiens
atatctcccccactccact

SEQ ID NO: 6660569 - DNA, 20 bp, Homo sapiens
atatctcccccactccacta

SEQ ID NO: 6660570 - DNA, 21 bp, Homo sapiens
atatctccgtcaactcatatt

SEQ ID NO: 6660571 - DNA, 19 bp, Homo sapiens
atatctcctttaatgacat

SEQ ID NO: 6660572 - DNA, 17 bp, Homo sapiens
atatctcctttgtattc

SEQ ID NO: 6660573 - DNA, 17 bp, Homo sapiens
atatctctaaactgctg

SEQ ID NO: 6660574 - DNA, 22 bp, Homo sapiens
atatctctagtccctgtgttct

SEQ ID NO: 6660575 - DNA, 22 bp, Homo sapiens
atatctctatttaattttgaca

SEQ ID NO: 6660576 - DNA, 13 bp, Homo sapiens
atatctctatttg

SEQ ID NO: 6660577 - DNA, 14 bp, Homo sapiens
atatctctatttga

SEQ ID NO: 6660578 - DNA, 13 bp, Homo sapiens
atatctctccctt

SEQ ID NO: 6660579 - DNA, 16 bp, Homo sapiens
atatctctcccttctt

SEQ ID NO: 6660580 - DNA, 22 bp, Homo sapiens
atatctctgccaacatgaggac

SEQ ID NO: 6660581 - DNA, 23 bp, Homo sapiens
atatctctgccaacatgaggaca

SEQ ID NO: 6660582 - DNA, 11 bp, Homo sapiens
atatctcttgg

SEQ ID NO: 6660583 - DNA, 15 bp, Homo sapiens
atatctcttggaaaa

SEQ ID NO: 6660584 - DNA, 16 bp, Homo sapiens
atatctcttggaaaat

SEQ ID NO: 6660585 - DNA, 20 bp, Homo sapiens
atatctcttggaaaataaga

SEQ ID NO: 6660586 - DNA, 21 bp, Homo sapiens
atatctcttggaaaataagac

SEQ ID NO: 6660587 - DNA, 16 bp, Homo sapiens
atatctgaaaatgtat

SEQ ID NO: 6660588 - DNA, 22 bp, Homo sapiens
atatctgaaaatgtatgtgtaa

SEQ ID NO: 6660589 - DNA, 15 bp, Homo sapiens
atatctgaaatgtga

SEQ ID NO: 6660590 - DNA, 22 bp, Homo sapiens
atatctgaacacatactagaaa

SEQ ID NO: 6660591 - DNA, 20 bp, Homo sapiens
atatctgaagagtatccttc

SEQ ID NO: 6660592 - DNA, 15 bp, Homo sapiens
atatctgaagccctc

SEQ ID NO: 6660593 - DNA, 14 bp, Homo sapiens
atatctgagagacc

SEQ ID NO: 6660594 - DNA, 15 bp, Homo sapiens
atatctgagagacct

SEQ ID NO: 6660595 - DNA, 20 bp, Homo sapiens
atatctgaggaattctgtat

SEQ ID NO: 6660596 - DNA, 14 bp, Homo sapiens
atatctgataaaat

SEQ ID NO: 6660597 - DNA, 18 bp, Homo sapiens
atatctgataaaattgtg

SEQ ID NO: 6660598 - DNA, 20 bp, Homo sapiens
atatctgataaaattgtgat

SEQ ID NO: 6660599 - DNA, 12 bp, Homo sapiens
atatctgcaaaa

SEQ ID NO: 6660600 - DNA, 13 bp, Homo sapiens
atatctgcatgtg

SEQ ID NO: 6660601 - DNA, 23 bp, Homo sapiens
atatctgcctttattgtgtttgt

SEQ ID NO: 6660602 - DNA, 15 bp, Homo sapiens
atatctgctgtatgt

SEQ ID NO: 6660603 - DNA, 13 bp, Homo sapiens
atatctgcttcag

SEQ ID NO: 6660604 - DNA, 16 bp, Homo sapiens
atatctgcttcagtgg

SEQ ID NO: 6660605 - DNA, 15 bp, Homo sapiens
atatctggacaagcc

SEQ ID NO: 6660606 - DNA, 19 bp, Homo sapiens
atatctgggttaagtgttt

SEQ ID NO: 6660607 - DNA, 19 bp, Homo sapiens
atatctggtatatgtcatt

SEQ ID NO: 6660608 - DNA, 21 bp, Homo sapiens
atatctggtatatgtcattat

SEQ ID NO: 6660609 - DNA, 18 bp, Homo sapiens
atatctggttatatcatt

SEQ ID NO: 6660610 - DNA, 21 bp, Homo sapiens
atatctggttatatcattctg

SEQ ID NO: 6660611 - DNA, 17 bp, Homo sapiens
atatctgtaaatttaac

SEQ ID NO: 6660612 - DNA, 21 bp, Homo sapiens
atatctgtaaatttaactgca

SEQ ID NO: 6660613 - DNA, 11 bp, Homo sapiens
atatctgtaac

SEQ ID NO: 6660614 - DNA, 20 bp, Homo sapiens
atatctgtaacactattaca

SEQ ID NO: 6660615 - DNA, 12 bp, Homo sapiens
atatctgtaatg

SEQ ID NO: 6660616 - DNA, 13 bp, Homo sapiens
atatctgtaatga

SEQ ID NO: 6660617 - DNA, 16 bp, Homo sapiens
atatctgtaatggtac

SEQ ID NO: 6660618 - DNA, 24 bp, Homo sapiens
atatctgtatttaattttgacact

SEQ ID NO: 6660619 - DNA, 17 bp, Homo sapiens
atatctgtgaaatatca

SEQ ID NO: 6660620 - DNA, 23 bp, Homo sapiens
atatctgtgcaatggaatataaa

SEQ ID NO: 6660621 - DNA, 15 bp, Homo sapiens
atatctgtgtgccct

SEQ ID NO: 6660622 - DNA, 16 bp, Homo sapiens
atatctgttattcaaa

SEQ ID NO: 6660623 - DNA, 15 bp, Homo sapiens
atatctgtttgtata

SEQ ID NO: 6660624 - DNA, 19 bp, Homo sapiens
atatctgtttgtatatttg

SEQ ID NO: 6660625 - DNA, 22 bp, Homo sapiens
atatctgtttgtatatttgcaa

SEQ ID NO: 6660626 - DNA, 17 bp, Homo sapiens
atatcttaagagtgcta

SEQ ID NO: 6660627 - DNA, 22 bp, Homo sapiens
atatcttaattctttgttctgt

SEQ ID NO: 6660628 - DNA, 20 bp, Homo sapiens
atatcttacaaaatacacat

SEQ ID NO: 6660629 - DNA, 17 bp, Homo sapiens
atatcttataactgttt

SEQ ID NO: 6660630 - DNA, 16 bp, Homo sapiens
atatcttatatataat

SEQ ID NO: 6660631 - DNA, 12 bp, Homo sapiens
atatcttcacaa

SEQ ID NO: 6660632 - DNA, 14 bp, Homo sapiens
atatcttcaccctg

SEQ ID NO: 6660633 - DNA, 19 bp, Homo sapiens
atatcttcagtttaatgca

SEQ ID NO: 6660634 - DNA, 22 bp, Homo sapiens
atatcttcagtttaatgcaaga

SEQ ID NO: 6660635 - DNA, 21 bp, Homo sapiens
atatcttcccatttaacattg

SEQ ID NO: 6660636 - DNA, 23 bp, Homo sapiens
atatcttcccatttaacattgtt

SEQ ID NO: 6660637 - DNA, 13 bp, Homo sapiens
atatcttcctttg

SEQ ID NO: 6660638 - DNA, 14 bp, Homo sapiens
atatcttcctttgg

SEQ ID NO: 6660639 - DNA, 20 bp, Homo sapiens
atatcttctatatctgaaga

SEQ ID NO: 6660640 - DNA, 19 bp, Homo sapiens
atatcttctgatttgtccc

SEQ ID NO: 6660641 - DNA, 13 bp, Homo sapiens
atatcttcttata

SEQ ID NO: 6660642 - DNA, 14 bp, Homo sapiens
atatcttgaagaat

SEQ ID NO: 6660643 - DNA, 17 bp, Homo sapiens
atatcttgaagaatatt

SEQ ID NO: 6660644 - DNA, 17 bp, Homo sapiens
atatcttgcgaatccaa

SEQ ID NO: 6660645 - DNA, 22 bp, Homo sapiens
atatcttggcaggtaggaatat

SEQ ID NO: 6660646 - DNA, 15 bp, Homo sapiens
atatcttgtatggtt

SEQ ID NO: 6660647 - DNA, 13 bp, Homo sapiens
atatcttgttatt

SEQ ID NO: 6660648 - DNA, 14 bp, Homo sapiens
atatcttgttatta

SEQ ID NO: 6660649 - DNA, 15 bp, Homo sapiens
atatcttgttattaa

SEQ ID NO: 6660650 - DNA, 16 bp, Homo sapiens
atatcttgtttacaat

SEQ ID NO: 6660651 - DNA, 18 bp, Homo sapiens
atatcttgtttacaataa

SEQ ID NO: 6660652 - DNA, 14 bp, Homo sapiens
atatctttaataag

SEQ ID NO: 6660653 - DNA, 20 bp, Homo sapiens
atatctttatacttaaacag

SEQ ID NO: 6660654 - DNA, 13 bp, Homo sapiens
atatctttatctt

SEQ ID NO: 6660655 - DNA, 22 bp, Homo sapiens
atatctttatgcaaaaacatat

SEQ ID NO: 6660656 - DNA, 22 bp, Homo sapiens
atatctttattcaccttttctt

SEQ ID NO: 6660657 - DNA, 24 bp, Homo sapiens
atatctttattcaccttttcttca

SEQ ID NO: 6660658 - DNA, 13 bp, Homo sapiens
atatctttctcat

SEQ ID NO: 6660659 - DNA, 14 bp, Homo sapiens
atatctttctctta

SEQ ID NO: 6660660 - DNA, 20 bp, Homo sapiens
atatctttctcttacctgtt

SEQ ID NO: 6660661 - DNA, 12 bp, Homo sapiens
atatctttctgc

SEQ ID NO: 6660662 - DNA, 12 bp, Homo sapiens
atatctttgcat

SEQ ID NO: 6660663 - DNA, 19 bp, Homo sapiens
atatctttgtaaattattt

SEQ ID NO: 6660664 - DNA, 12 bp, Homo sapiens
atatcttttatg

SEQ ID NO: 6660665 - DNA, 19 bp, Homo sapiens
atatcttttatgtttgaat

SEQ ID NO: 6660666 - DNA, 22 bp, Homo sapiens
atatcttttctttagagaactg

SEQ ID NO: 6660667 - DNA, 14 bp, Homo sapiens
atatcttttgacct

SEQ ID NO: 6660668 - DNA, 16 bp, Homo sapiens
atatcttttggttatt

SEQ ID NO: 6660669 - DNA, 19 bp, Homo sapiens
atatcttttgtaagacatt

SEQ ID NO: 6660670 - DNA, 22 bp, Homo sapiens
atatctttttattgatgtgcaa

SEQ ID NO: 6660671 - DNA, 17 bp, Homo sapiens
atatgaaaaatatgata

SEQ ID NO: 6660672 - DNA, 17 bp, Homo sapiens
atatgaaaaatgtaaat

SEQ ID NO: 6660673 - DNA, 13 bp, Homo sapiens
atatgaaaacaag

SEQ ID NO: 6660674 - DNA, 13 bp, Homo sapiens
atatgaaaacact

SEQ ID NO: 6660675 - DNA, 16 bp, Homo sapiens
atatgaaaactaagtt

SEQ ID NO: 6660676 - DNA, 13 bp, Homo sapiens
atatgaaaactat

SEQ ID NO: 6660677 - DNA, 15 bp, Homo sapiens
atatgaaaactatac

SEQ ID NO: 6660678 - DNA, 20 bp, Homo sapiens
atatgaaactctacatttaa

SEQ ID NO: 6660679 - DNA, 21 bp, Homo sapiens
atatgaaactctacatttaaa

SEQ ID NO: 6660680 - DNA, 17 bp, Homo sapiens
atatgaaagagaaaatg

SEQ ID NO: 6660681 - DNA, 19 bp, Homo sapiens
atatgaaagagaaaatgct

SEQ ID NO: 6660682 - DNA, 20 bp, Homo sapiens
atatgaaagtcttattaaaa

SEQ ID NO: 6660683 - DNA, 14 bp, Homo sapiens
atatgaaataagta

SEQ ID NO: 6660684 - DNA, 17 bp, Homo sapiens
atatgaaatataaatta

SEQ ID NO: 6660685 - DNA, 19 bp, Homo sapiens
atatgaaatataaattatc

SEQ ID NO: 6660686 - DNA, 21 bp, Homo sapiens
atatgaaattccagcaataag

SEQ ID NO: 6660687 - DNA, 22 bp, Homo sapiens
atatgaacagggcccaggcctg

SEQ ID NO: 6660688 - DNA, 19 bp, Homo sapiens
atatgaacatacaaatgca

SEQ ID NO: 6660689 - DNA, 19 bp, Homo sapiens
atatgaacatattgttgaa

SEQ ID NO: 6660690 - DNA, 19 bp, Homo sapiens
atatgaaccctttgtttct

SEQ ID NO: 6660691 - DNA, 18 bp, Homo sapiens
atatgaacgcacaacatg

SEQ ID NO: 6660692 - DNA, 14 bp, Homo sapiens
atatgaactgcagg

SEQ ID NO: 6660693 - DNA, 17 bp, Homo sapiens
atatgaacttaacatgc

SEQ ID NO: 6660694 - DNA, 14 bp, Homo sapiens
atatgaagagtttt

SEQ ID NO: 6660695 - DNA, 21 bp, Homo sapiens
atatgaagcaagctgtgttac

SEQ ID NO: 6660696 - DNA, 13 bp, Homo sapiens
atatgaagccttt

SEQ ID NO: 6660697 - DNA, 14 bp, Homo sapiens
atatgaagcctttg

SEQ ID NO: 6660698 - DNA, 15 bp, Homo sapiens
atatgaagctcttga

SEQ ID NO: 6660699 - DNA, 19 bp, Homo sapiens
atatgaaggaaatgaacca

SEQ ID NO: 6660700 - DNA, 17 bp, Homo sapiens
atatgaaggactattaa

SEQ ID NO: 6660701 - DNA, 13 bp, Homo sapiens
atatgaaggagag

SEQ ID NO: 6660702 - DNA, 19 bp, Homo sapiens
atatgaaggtttgagagca

SEQ ID NO: 6660703 - DNA, 21 bp, Homo sapiens
atatgaagtaagttctgaaaa

SEQ ID NO: 6660704 - DNA, 23 bp, Homo sapiens
atatgaatattacatgtaaagct

SEQ ID NO: 6660705 - DNA, 19 bp, Homo sapiens
atatgaatgcttgtaatag

SEQ ID NO: 6660706 - DNA, 21 bp, Homo sapiens
atatgaatttaaatataattc

SEQ ID NO: 6660707 - DNA, 23 bp, Homo sapiens
atatgacaatcctgaagaaacca

SEQ ID NO: 6660708 - DNA, 21 bp, Homo sapiens
atatgacaatttcaaaatgca

SEQ ID NO: 6660709 - DNA, 17 bp, Homo sapiens
atatgacacaaaggtgg

SEQ ID NO: 6660710 - DNA, 21 bp, Homo sapiens
atatgacacagcttgtgaatg

SEQ ID NO: 6660711 - DNA, 15 bp, Homo sapiens
atatgacagctgtcc

SEQ ID NO: 6660712 - DNA, 14 bp, Homo sapiens
atatgacatgccac

SEQ ID NO: 6660713 - DNA, 17 bp, Homo sapiens
atatgacatgccaccct

SEQ ID NO: 6660714 - DNA, 19 bp, Homo sapiens
atatgacattcatgcctgg

SEQ ID NO: 6660715 - DNA, 16 bp, Homo sapiens
atatgaccagaagcct

SEQ ID NO: 6660716 - DNA, 16 bp, Homo sapiens
atatgacccacactgc

SEQ ID NO: 6660717 - DNA, 18 bp, Homo sapiens
atatgacccacactgcca

SEQ ID NO: 6660718 - DNA, 22 bp, Homo sapiens
atatgacctaaatccattttct

SEQ ID NO: 6660719 - DNA, 23 bp, Homo sapiens
atatgaccttaaggaaaagtaag

SEQ ID NO: 6660720 - DNA, 16 bp, Homo sapiens
atatgacggaagaaca

SEQ ID NO: 6660721 - DNA, 18 bp, Homo sapiens
atatgacggaagaacata

SEQ ID NO: 6660722 - DNA, 13 bp, Homo sapiens
atatgactcacat

SEQ ID NO: 6660723 - DNA, 18 bp, Homo sapiens
atatgactcctttctcta

SEQ ID NO: 6660724 - DNA, 22 bp, Homo sapiens
atatgactgtttttcggacagt

SEQ ID NO: 6660725 - DNA, 22 bp, Homo sapiens
atatgacttcctagggatctga

SEQ ID NO: 6660726 - DNA, 14 bp, Homo sapiens
atatgacttcttgt

SEQ ID NO: 6660727 - DNA, 18 bp, Homo sapiens
atatgacttcttgttcat

SEQ ID NO: 6660728 - DNA, 22 bp, Homo sapiens
atatgagaaataagaaactttt

SEQ ID NO: 6660729 - DNA, 14 bp, Homo sapiens
atatgagaaataca

SEQ ID NO: 6660730 - DNA, 17 bp, Homo sapiens
atatgagaaatacagaa

SEQ ID NO: 6660731 - DNA, 18 bp, Homo sapiens
atatgagaaatacagaag

SEQ ID NO: 6660732 - DNA, 19 bp, Homo sapiens
atatgagaaatataaaaat

SEQ ID NO: 6660733 - DNA, 14 bp, Homo sapiens
atatgagaagatcc

SEQ ID NO: 6660734 - DNA, 21 bp, Homo sapiens
atatgagaagatcctgtcaca

SEQ ID NO: 6660735 - DNA, 14 bp, Homo sapiens
atatgagaatgtat

SEQ ID NO: 6660736 - DNA, 14 bp, Homo sapiens
atatgagactatta

SEQ ID NO: 6660737 - DNA, 13 bp, Homo sapiens
atatgagactttc

SEQ ID NO: 6660738 - DNA, 18 bp, Homo sapiens
atatgagagaactattgt

SEQ ID NO: 6660739 - DNA, 17 bp, Homo sapiens
atatgagcatgctccct

SEQ ID NO: 6660740 - DNA, 21 bp, Homo sapiens
atatgagcttccttctgtgaa

SEQ ID NO: 6660741 - DNA, 23 bp, Homo sapiens
atatgaggatgcagagtcagcag

SEQ ID NO: 6660742 - DNA, 16 bp, Homo sapiens
atatgaggggacccag

SEQ ID NO: 6660743 - DNA, 19 bp, Homo sapiens
atatgaggggactgcatgc

SEQ ID NO: 6660744 - DNA, 21 bp, Homo sapiens
atatgaggggcagtggacagt

SEQ ID NO: 6660745 - DNA, 15 bp, Homo sapiens
atatgagtacaaatg

SEQ ID NO: 6660746 - DNA, 20 bp, Homo sapiens
atatgagtatacaatatata

SEQ ID NO: 6660747 - DNA, 20 bp, Homo sapiens
atatgagtgtggaagccgga

SEQ ID NO: 6660748 - DNA, 17 bp, Homo sapiens
atatgagtttcatagct

SEQ ID NO: 6660749 - DNA, 21 bp, Homo sapiens
atatgagtttcatagctaaga

SEQ ID NO: 6660750 - DNA, 18 bp, Homo sapiens
atatgataaagagggatg

SEQ ID NO: 6660751 - DNA, 18 bp, Homo sapiens
atatgatatatagttaca

SEQ ID NO: 6660752 - DNA, 16 bp, Homo sapiens
atatgatatatatgta

SEQ ID NO: 6660753 - DNA, 14 bp, Homo sapiens
atatgatattcttt

SEQ ID NO: 6660754 - DNA, 20 bp, Homo sapiens
atatgatattctttaaacaa

SEQ ID NO: 6660755 - DNA, 15 bp, Homo sapiens
atatgatcaaatact

SEQ ID NO: 6660756 - DNA, 13 bp, Homo sapiens
atatgatcctgaa

SEQ ID NO: 6660757 - DNA, 14 bp, Homo sapiens
atatgatcctgaaa

SEQ ID NO: 6660758 - DNA, 17 bp, Homo sapiens
atatgatcctgaaaaaa

SEQ ID NO: 6660759 - DNA, 15 bp, Homo sapiens
atatgatctgtctgt

SEQ ID NO: 6660760 - DNA, 13 bp, Homo sapiens
atatgatgagcag

SEQ ID NO: 6660761 - DNA, 20 bp, Homo sapiens
atatgatgtttaaaagcata

SEQ ID NO: 6660762 - DNA, 11 bp, Homo sapiens
atatgattaaa

SEQ ID NO: 6660763 - DNA, 17 bp, Homo sapiens
atatgattaaaaatatc

SEQ ID NO: 6660764 - DNA, 15 bp, Homo sapiens
atatgattaaagaaa

SEQ ID NO: 6660765 - DNA, 21 bp, Homo sapiens
atatgattagtaaagaaatga

SEQ ID NO: 6660766 - DNA, 14 bp, Homo sapiens
atatgattatacaa

SEQ ID NO: 6660767 - DNA, 12 bp, Homo sapiens
atatgattcaaa

SEQ ID NO: 6660768 - DNA, 13 bp, Homo sapiens
atatgattcaaat

SEQ ID NO: 6660769 - DNA, 13 bp, Homo sapiens
atatgattctagt

SEQ ID NO: 6660770 - DNA, 20 bp, Homo sapiens
atatgattctagtacataat

SEQ ID NO: 6660771 - DNA, 16 bp, Homo sapiens
atatgattctctgtgg

SEQ ID NO: 6660772 - DNA, 16 bp, Homo sapiens
atatgattgaaaagaa

SEQ ID NO: 6660773 - DNA, 15 bp, Homo sapiens
atatgattggcaata

SEQ ID NO: 6660774 - DNA, 14 bp, Homo sapiens
atatgattggttca

SEQ ID NO: 6660775 - DNA, 19 bp, Homo sapiens
atatgattgtaacatattt

SEQ ID NO: 6660776 - DNA, 14 bp, Homo sapiens
atatgattgtttct

SEQ ID NO: 6660777 - DNA, 13 bp, Homo sapiens
atatgatttaaaa

SEQ ID NO: 6660778 - DNA, 20 bp, Homo sapiens
atatgatttaaatcagccgt

SEQ ID NO: 6660779 - DNA, 17 bp, Homo sapiens
atatgatttcactagaa

SEQ ID NO: 6660780 - DNA, 23 bp, Homo sapiens
atatgatttcactagaaaagctg

SEQ ID NO: 6660781 - DNA, 16 bp, Homo sapiens
atatgatttcttgctt

SEQ ID NO: 6660782 - DNA, 18 bp, Homo sapiens
atatgatttcttgctttg

SEQ ID NO: 6660783 - DNA, 15 bp, Homo sapiens
atatgatttgcattt

SEQ ID NO: 6660784 - DNA, 18 bp, Homo sapiens
atatgattttttaaaaga

SEQ ID NO: 6660785 - DNA, 19 bp, Homo sapiens
atatgattttttaaaagaa

SEQ ID NO: 6660786 - DNA, 23 bp, Homo sapiens
atatgcaaacagccctaaataaa

SEQ ID NO: 6660787 - DNA, 21 bp, Homo sapiens
atatgcaaacataacaaaatc

SEQ ID NO: 6660788 - DNA, 16 bp, Homo sapiens
atatgcaaagcactga

SEQ ID NO: 6660789 - DNA, 23 bp, Homo sapiens
atatgcaaagcactgacttctaa

SEQ ID NO: 6660790 - DNA, 13 bp, Homo sapiens
atatgcaagcagc

SEQ ID NO: 6660791 - DNA, 22 bp, Homo sapiens
atatgcaatcactgaaaactat

SEQ ID NO: 6660792 - DNA, 15 bp, Homo sapiens
atatgcacaatagca

SEQ ID NO: 6660793 - DNA, 19 bp, Homo sapiens
atatgcacacacagatgca

SEQ ID NO: 6660794 - DNA, 19 bp, Homo sapiens
atatgcacacagtgctttc

SEQ ID NO: 6660795 - DNA, 13 bp, Homo sapiens
atatgcacacatt

SEQ ID NO: 6660796 - DNA, 15 bp, Homo sapiens
atatgcacacatttt

SEQ ID NO: 6660797 - DNA, 17 bp, Homo sapiens
atatgcacccctggaac

SEQ ID NO: 6660798 - DNA, 11 bp, Homo sapiens
atatgcacttt

SEQ ID NO: 6660799 - DNA, 16 bp, Homo sapiens
atatgcagaatctctg

SEQ ID NO: 6660800 - DNA, 17 bp, Homo sapiens
atatgcagccatatatg

SEQ ID NO: 6660801 - DNA, 23 bp, Homo sapiens
atatgcagtctctttattttact

SEQ ID NO: 6660802 - DNA, 15 bp, Homo sapiens
atatgcatatatata

SEQ ID NO: 6660803 - DNA, 18 bp, Homo sapiens
atatgcatatatatatgt

SEQ ID NO: 6660804 - DNA, 17 bp, Homo sapiens
atatgcatatatatgta

SEQ ID NO: 6660805 - DNA, 16 bp, Homo sapiens
atatgcatctttgaga

SEQ ID NO: 6660806 - DNA, 21 bp, Homo sapiens
atatgcatgtagcatataaat

SEQ ID NO: 6660807 - DNA, 15 bp, Homo sapiens
atatgcatttttaat

SEQ ID NO: 6660808 - DNA, 19 bp, Homo sapiens
atatgccactaacttctaa

SEQ ID NO: 6660809 - DNA, 14 bp, Homo sapiens
atatgccagcttgg

SEQ ID NO: 6660810 - DNA, 21 bp, Homo sapiens
atatgccccttcttgggcccc

SEQ ID NO: 6660811 - DNA, 21 bp, Homo sapiens
atatgccctcaagtaaaagaa

SEQ ID NO: 6660812 - DNA, 14 bp, Homo sapiens
atatgcctacagcc

SEQ ID NO: 6660813 - DNA, 19 bp, Homo sapiens
atatgcctctcctttgtat

SEQ ID NO: 6660814 - DNA, 14 bp, Homo sapiens
atatgcctgctctt

SEQ ID NO: 6660815 - DNA, 15 bp, Homo sapiens
atatgcctgctcttt

SEQ ID NO: 6660816 - DNA, 16 bp, Homo sapiens
atatgccttaatttag

SEQ ID NO: 6660817 - DNA, 17 bp, Homo sapiens
atatgccttaatttaga

SEQ ID NO: 6660818 - DNA, 19 bp, Homo sapiens
atatgccttaatttagaaa

SEQ ID NO: 6660819 - DNA, 23 bp, Homo sapiens
atatgccttggaggaaatgtgct

SEQ ID NO: 6660820 - DNA, 14 bp, Homo sapiens
atatgccttgtata

SEQ ID NO: 6660821 - DNA, 20 bp, Homo sapiens
atatgctaattaaataatac

SEQ ID NO: 6660822 - DNA, 22 bp, Homo sapiens
atatgctaattaaataatacaa

SEQ ID NO: 6660823 - DNA, 14 bp, Homo sapiens
atatgctaatttgg

SEQ ID NO: 6660824 - DNA, 15 bp, Homo sapiens
atatgctacacatat

SEQ ID NO: 6660825 - DNA, 23 bp, Homo sapiens
atatgctacagtactatgtaaat

SEQ ID NO: 6660826 - DNA, 14 bp, Homo sapiens
atatgctatttcta

SEQ ID NO: 6660827 - DNA, 15 bp, Homo sapiens
atatgctatttctat

SEQ ID NO: 6660828 - DNA, 22 bp, Homo sapiens
atatgctccaggatctttgact

SEQ ID NO: 6660829 - DNA, 17 bp, Homo sapiens
atatgctctgcatgtta

SEQ ID NO: 6660830 - DNA, 16 bp, Homo sapiens
atatgctctgctttta

SEQ ID NO: 6660831 - DNA, 18 bp, Homo sapiens
atatgctcttttgtttgg

SEQ ID NO: 6660832 - DNA, 17 bp, Homo sapiens
atatgctgaattgaaca

SEQ ID NO: 6660833 - DNA, 15 bp, Homo sapiens
atatgctgatctttt

SEQ ID NO: 6660834 - DNA, 12 bp, Homo sapiens
atatgctgcatt

SEQ ID NO: 6660835 - DNA, 18 bp, Homo sapiens
atatgctgccaaattttg

SEQ ID NO: 6660836 - DNA, 22 bp, Homo sapiens
atatgctgccaaattttggcca

SEQ ID NO: 6660837 - DNA, 19 bp, Homo sapiens
atatgctgtatttctttgt

SEQ ID NO: 6660838 - DNA, 20 bp, Homo sapiens
atatgctgtatttctttgta

SEQ ID NO: 6660839 - DNA, 19 bp, Homo sapiens
atatgcttaaaataagcag

SEQ ID NO: 6660840 - DNA, 14 bp, Homo sapiens
atatgcttatacac

SEQ ID NO: 6660841 - DNA, 16 bp, Homo sapiens
atatgcttatacactt

SEQ ID NO: 6660842 - DNA, 19 bp, Homo sapiens
atatgcttatacacttaca

SEQ ID NO: 6660843 - DNA, 18 bp, Homo sapiens
atatgcttcaaactaaca

SEQ ID NO: 6660844 - DNA, 21 bp, Homo sapiens
atatgcttccagaatggggct

SEQ ID NO: 6660845 - DNA, 20 bp, Homo sapiens
atatgcttctgttttataat

SEQ ID NO: 6660846 - DNA, 16 bp, Homo sapiens
atatggaaaaaatgta

SEQ ID NO: 6660847 - DNA, 14 bp, Homo sapiens
atatggaaatatag

SEQ ID NO: 6660848 - DNA, 15 bp, Homo sapiens
atatggaaatatata

SEQ ID NO: 6660849 - DNA, 16 bp, Homo sapiens
atatggaaatcctgtt

SEQ ID NO: 6660850 - DNA, 19 bp, Homo sapiens
atatggaaatcctgttact

SEQ ID NO: 6660851 - DNA, 23 bp, Homo sapiens
atatggaaatcttttacattttt

SEQ ID NO: 6660852 - DNA, 20 bp, Homo sapiens
atatggaacatatgcacagg

SEQ ID NO: 6660853 - DNA, 13 bp, Homo sapiens
atatggaaccttc

SEQ ID NO: 6660854 - DNA, 20 bp, Homo sapiens
atatggaaccttccctccaa

SEQ ID NO: 6660855 - DNA, 18 bp, Homo sapiens
atatggaacttctaatat

SEQ ID NO: 6660856 - DNA, 18 bp, Homo sapiens
atatggaagtaaaggcat

SEQ ID NO: 6660857 - DNA, 14 bp, Homo sapiens
atatggaataagtg

SEQ ID NO: 6660858 - DNA, 15 bp, Homo sapiens
atatggaattttgca

SEQ ID NO: 6660859 - DNA, 19 bp, Homo sapiens
atatggaattttgcaaaga

SEQ ID NO: 6660860 - DNA, 15 bp, Homo sapiens
atatggacaaatgga

SEQ ID NO: 6660861 - DNA, 15 bp, Homo sapiens
atatggacaagaggt

SEQ ID NO: 6660862 - DNA, 13 bp, Homo sapiens
atatggacactgt

SEQ ID NO: 6660863 - DNA, 22 bp, Homo sapiens
atatggacagctttattttaaa

SEQ ID NO: 6660864 - DNA, 13 bp, Homo sapiens
atatggacagtta

SEQ ID NO: 6660865 - DNA, 19 bp, Homo sapiens
atatggacatatcatctgt

SEQ ID NO: 6660866 - DNA, 15 bp, Homo sapiens
atatggactcagcct

SEQ ID NO: 6660867 - DNA, 15 bp, Homo sapiens
atatggagaacatgt

SEQ ID NO: 6660868 - DNA, 20 bp, Homo sapiens
atatggagcatttttcagag

SEQ ID NO: 6660869 - DNA, 22 bp, Homo sapiens
atatggagcatttttcagagtt

SEQ ID NO: 6660870 - DNA, 11 bp, Homo sapiens
atatggagccc

SEQ ID NO: 6660871 - DNA, 15 bp, Homo sapiens
atatggaggattctt

SEQ ID NO: 6660872 - DNA, 22 bp, Homo sapiens
atatggaggattctttccccag

SEQ ID NO: 6660873 - DNA, 21 bp, Homo sapiens
atatggaggttcaatgagatg

SEQ ID NO: 6660874 - DNA, 12 bp, Homo sapiens
atatggatattt

SEQ ID NO: 6660875 - DNA, 23 bp, Homo sapiens
atatggatatttttaatttatga

SEQ ID NO: 6660876 - DNA, 17 bp, Homo sapiens
atatggatcagagcatt

SEQ ID NO: 6660877 - DNA, 22 bp, Homo sapiens
atatggcaacgttcatgttcat

SEQ ID NO: 6660878 - DNA, 15 bp, Homo sapiens
atatggcaagaaagc

SEQ ID NO: 6660879 - DNA, 17 bp, Homo sapiens
atatggcaatagcattg

SEQ ID NO: 6660880 - DNA, 15 bp, Homo sapiens
atatggcagaagaca

SEQ ID NO: 6660881 - DNA, 13 bp, Homo sapiens
atatggcaggact

SEQ ID NO: 6660882 - DNA, 20 bp, Homo sapiens
atatggcaggactcctggca

SEQ ID NO: 6660883 - DNA, 14 bp, Homo sapiens
atatggcaggagct

SEQ ID NO: 6660884 - DNA, 18 bp, Homo sapiens
atatggcaggagctactg

SEQ ID NO: 6660885 - DNA, 17 bp, Homo sapiens
atatggcatatttatat

SEQ ID NO: 6660886 - DNA, 15 bp, Homo sapiens
atatggcccagcctt

SEQ ID NO: 6660887 - DNA, 21 bp, Homo sapiens
atatggcctgacaatatgaat

SEQ ID NO: 6660888 - DNA, 15 bp, Homo sapiens
atatggcggcctgca

SEQ ID NO: 6660889 - DNA, 19 bp, Homo sapiens
atatggcggcctgcagtgg

SEQ ID NO: 6660890 - DNA, 17 bp, Homo sapiens
atatggctagttttcaa

SEQ ID NO: 6660891 - DNA, 12 bp, Homo sapiens
atatggctgccc

SEQ ID NO: 6660892 - DNA, 14 bp, Homo sapiens
atatggctgcccag

SEQ ID NO: 6660893 - DNA, 21 bp, Homo sapiens
atatgggaatgtctaacttaa

SEQ ID NO: 6660894 - DNA, 17 bp, Homo sapiens
atatgggacatttttga

SEQ ID NO: 6660895 - DNA, 16 bp, Homo sapiens
atatgggcgggcagtc

SEQ ID NO: 6660896 - DNA, 19 bp, Homo sapiens
atatggggatggtagtttt

SEQ ID NO: 6660897 - DNA, 17 bp, Homo sapiens
atatgggggaaaattat

SEQ ID NO: 6660898 - DNA, 19 bp, Homo sapiens
atatgggggaaaattattt

SEQ ID NO: 6660899 - DNA, 22 bp, Homo sapiens
atatggggtattggacatagat

SEQ ID NO: 6660900 - DNA, 23 bp, Homo sapiens
atatgggttagatgttgccatgt

SEQ ID NO: 6660901 - DNA, 22 bp, Homo sapiens
atatgggttgcatttggtcaag

SEQ ID NO: 6660902 - DNA, 19 bp, Homo sapiens
atatggtactaaggagaat

SEQ ID NO: 6660903 - DNA, 14 bp, Homo sapiens
atatggtatatata

SEQ ID NO: 6660904 - DNA, 14 bp, Homo sapiens
atatggtctaatgt

SEQ ID NO: 6660905 - DNA, 13 bp, Homo sapiens
atatggtgaaggg

SEQ ID NO: 6660906 - DNA, 15 bp, Homo sapiens
atatggtgcaaaaat

SEQ ID NO: 6660907 - DNA, 18 bp, Homo sapiens
atatggtgcaaaaatgag

SEQ ID NO: 6660908 - DNA, 17 bp, Homo sapiens
atatggtggccctgggg

SEQ ID NO: 6660909 - DNA, 18 bp, Homo sapiens
atatggttggagagccct

SEQ ID NO: 6660910 - DNA, 20 bp, Homo sapiens
atatggttggagagccctgg

SEQ ID NO: 6660911 - DNA, 15 bp, Homo sapiens
atatgtaaaacattt

SEQ ID NO: 6660912 - DNA, 13 bp, Homo sapiens
atatgtaaaataa

SEQ ID NO: 6660913 - DNA, 20 bp, Homo sapiens
atatgtaaaataaaattatg

SEQ ID NO: 6660914 - DNA, 20 bp, Homo sapiens
atatgtaaacataagtgtac

SEQ ID NO: 6660915 - DNA, 14 bp, Homo sapiens
atatgtaaatatac

SEQ ID NO: 6660916 - DNA, 11 bp, Homo sapiens
atatgtaaatg

SEQ ID NO: 6660917 - DNA, 18 bp, Homo sapiens
atatgtaaatgtgttagc

SEQ ID NO: 6660918 - DNA, 15 bp, Homo sapiens
atatgtaaattacaa

SEQ ID NO: 6660919 - DNA, 21 bp, Homo sapiens
atatgtaaattataagtaact

SEQ ID NO: 6660920 - DNA, 14 bp, Homo sapiens
atatgtaacagttt

SEQ ID NO: 6660921 - DNA, 20 bp, Homo sapiens
atatgtaacatcaagccatc

SEQ ID NO: 6660922 - DNA, 13 bp, Homo sapiens
atatgtaacatgt

SEQ ID NO: 6660923 - DNA, 21 bp, Homo sapiens
atatgtaacatgtctaaagtt

SEQ ID NO: 6660924 - DNA, 18 bp, Homo sapiens
atatgtaacttcagatgt

SEQ ID NO: 6660925 - DNA, 23 bp, Homo sapiens
atatgtaacttcagatgtttcca

SEQ ID NO: 6660926 - DNA, 17 bp, Homo sapiens
atatgtaagaacacatt

SEQ ID NO: 6660927 - DNA, 14 bp, Homo sapiens
atatgtaagggaaa

SEQ ID NO: 6660928 - DNA, 20 bp, Homo sapiens
atatgtaatacttaaataaa

SEQ ID NO: 6660929 - DNA, 22 bp, Homo sapiens
atatgtaatacttaaataaaca

SEQ ID NO: 6660930 - DNA, 21 bp, Homo sapiens
atatgtaatataaatttaagc

SEQ ID NO: 6660931 - DNA, 22 bp, Homo sapiens
atatgtaatataaatttaagca

SEQ ID NO: 6660932 - DNA, 13 bp, Homo sapiens
atatgtaatatat

SEQ ID NO: 6660933 - DNA, 15 bp, Homo sapiens
atatgtaatatatac

SEQ ID NO: 6660934 - DNA, 16 bp, Homo sapiens
atatgtaatatataca

SEQ ID NO: 6660935 - DNA, 17 bp, Homo sapiens
atatgtaattaacatat

SEQ ID NO: 6660936 - DNA, 14 bp, Homo sapiens
atatgtaattcttt

SEQ ID NO: 6660937 - DNA, 18 bp, Homo sapiens
atatgtaattctttccat

SEQ ID NO: 6660938 - DNA, 13 bp, Homo sapiens
atatgtaatttca

SEQ ID NO: 6660939 - DNA, 14 bp, Homo sapiens
atatgtaatttcaa

SEQ ID NO: 6660940 - DNA, 21 bp, Homo sapiens
atatgtaatttcaaaatacat

SEQ ID NO: 6660941 - DNA, 13 bp, Homo sapiens
atatgtacaaata

SEQ ID NO: 6660942 - DNA, 15 bp, Homo sapiens
atatgtacagctctc

SEQ ID NO: 6660943 - DNA, 14 bp, Homo sapiens
atatgtacagttat

SEQ ID NO: 6660944 - DNA, 14 bp, Homo sapiens
atatgtacataaat

SEQ ID NO: 6660945 - DNA, 15 bp, Homo sapiens
atatgtacataaatt

SEQ ID NO: 6660946 - DNA, 12 bp, Homo sapiens
atatgtacattt

SEQ ID NO: 6660947 - DNA, 11 bp, Homo sapiens
atatgtaccaa

SEQ ID NO: 6660948 - DNA, 19 bp, Homo sapiens
atatgtaccatgtacatga

SEQ ID NO: 6660949 - DNA, 23 bp, Homo sapiens
atatgtactaagaatgtccttat

SEQ ID NO: 6660950 - DNA, 13 bp, Homo sapiens
atatgtactgtat

SEQ ID NO: 6660951 - DNA, 13 bp, Homo sapiens
atatgtactgttt

SEQ ID NO: 6660952 - DNA, 21 bp, Homo sapiens
atatgtacttgtcaaagaagg

SEQ ID NO: 6660953 - DNA, 17 bp, Homo sapiens
atatgtacttttccatt

SEQ ID NO: 6660954 - DNA, 17 bp, Homo sapiens
atatgtagactatatac

SEQ ID NO: 6660955 - DNA, 18 bp, Homo sapiens
atatgtagactatataca

SEQ ID NO: 6660956 - DNA, 23 bp, Homo sapiens
atatgtagactatatacatgtgt

SEQ ID NO: 6660957 - DNA, 13 bp, Homo sapiens
atatgtagagaaa

SEQ ID NO: 6660958 - DNA, 23 bp, Homo sapiens
atatgtagatattgttttctgta

SEQ ID NO: 6660959 - DNA, 20 bp, Homo sapiens
atatgtagatgtatgcacac

SEQ ID NO: 6660960 - DNA, 17 bp, Homo sapiens
atatgtagcagaaaggc

SEQ ID NO: 6660961 - DNA, 13 bp, Homo sapiens
atatgtagcatta

SEQ ID NO: 6660962 - DNA, 14 bp, Homo sapiens
atatgtagcattaa

SEQ ID NO: 6660963 - DNA, 20 bp, Homo sapiens
atatgtagcattaaatataa

SEQ ID NO: 6660964 - DNA, 13 bp, Homo sapiens
atatgtagccctc

SEQ ID NO: 6660965 - DNA, 17 bp, Homo sapiens
atatgtaggtgtctgca

SEQ ID NO: 6660966 - DNA, 15 bp, Homo sapiens
atatgtagtatctat

SEQ ID NO: 6660967 - DNA, 20 bp, Homo sapiens
atatgtataatatatatcta

SEQ ID NO: 6660968 - DNA, 15 bp, Homo sapiens
atatgtatacacaaa

SEQ ID NO: 6660969 - DNA, 19 bp, Homo sapiens
atatgtatacgcacgcacc

SEQ ID NO: 6660970 - DNA, 13 bp, Homo sapiens
atatgtatatata

SEQ ID NO: 6660971 - DNA, 16 bp, Homo sapiens
atatgtatatatacat

SEQ ID NO: 6660972 - DNA, 21 bp, Homo sapiens
atatgtatatatatatatgca

SEQ ID NO: 6660973 - DNA, 14 bp, Homo sapiens
atatgtatatctat

SEQ ID NO: 6660974 - DNA, 23 bp, Homo sapiens
atatgtatatctgtgtaagacac

SEQ ID NO: 6660975 - DNA, 14 bp, Homo sapiens
atatgtatatcttt

SEQ ID NO: 6660976 - DNA, 17 bp, Homo sapiens
atatgtatatgtatata

SEQ ID NO: 6660977 - DNA, 12 bp, Homo sapiens
atatgtatcata

SEQ ID NO: 6660978 - DNA, 19 bp, Homo sapiens
atatgtatccagtacattt

SEQ ID NO: 6660979 - DNA, 15 bp, Homo sapiens
atatgtatctaaatg

SEQ ID NO: 6660980 - DNA, 22 bp, Homo sapiens
atatgtatctaaatgaaaagag

SEQ ID NO: 6660981 - DNA, 18 bp, Homo sapiens
atatgtatctacaataca

SEQ ID NO: 6660982 - DNA, 15 bp, Homo sapiens
atatgtatgtaaaaa

SEQ ID NO: 6660983 - DNA, 19 bp, Homo sapiens
atatgtatgtgtgagtgta

SEQ ID NO: 6660984 - DNA, 15 bp, Homo sapiens
atatgtatgtgttta

SEQ ID NO: 6660985 - DNA, 19 bp, Homo sapiens
atatgtatgtgtttagaat

SEQ ID NO: 6660986 - DNA, 16 bp, Homo sapiens
atatgtattaaatcaa

SEQ ID NO: 6660987 - DNA, 21 bp, Homo sapiens
atatgtattaagccaaacatg

SEQ ID NO: 6660988 - DNA, 22 bp, Homo sapiens
atatgtattaagccaaacatga

SEQ ID NO: 6660989 - DNA, 16 bp, Homo sapiens
atatgtattaatactt

SEQ ID NO: 6660990 - DNA, 16 bp, Homo sapiens
atatgtattaatattc

SEQ ID NO: 6660991 - DNA, 18 bp, Homo sapiens
atatgtattacctctggc

SEQ ID NO: 6660992 - DNA, 22 bp, Homo sapiens
atatgtattatttataattcct

SEQ ID NO: 6660993 - DNA, 14 bp, Homo sapiens
atatgtattctttt

SEQ ID NO: 6660994 - DNA, 18 bp, Homo sapiens
atatgtattcttttctca

SEQ ID NO: 6660995 - DNA, 23 bp, Homo sapiens
atatgtatttaagatgtacattt

SEQ ID NO: 6660996 - DNA, 13 bp, Homo sapiens
atatgtattttat

SEQ ID NO: 6660997 - DNA, 19 bp, Homo sapiens
atatgtattttatgtatgt

SEQ ID NO: 6660998 - DNA, 14 bp, Homo sapiens
atatgtcagggcgt

SEQ ID NO: 6660999 - DNA, 18 bp, Homo sapiens
atatgtcagtcactaaaa

SEQ ID NO: 6661000 - DNA, 18 bp, Homo sapiens
atatgtcagtgctgatgt

SEQ ID NO: 6661001 - DNA, 18 bp, Homo sapiens
atatgtccactgttctgt

SEQ ID NO: 6661002 - DNA, 18 bp, Homo sapiens
atatgtccagaagagtca

SEQ ID NO: 6661003 - DNA, 23 bp, Homo sapiens
atatgtccagaagagtcaaagta

SEQ ID NO: 6661004 - DNA, 23 bp, Homo sapiens
atatgtccccccctaactttctt

SEQ ID NO: 6661005 - DNA, 18 bp, Homo sapiens
atatgtccttgggttgct

SEQ ID NO: 6661006 - DNA, 17 bp, Homo sapiens
atatgtctagataaaag

SEQ ID NO: 6661007 - DNA, 13 bp, Homo sapiens
atatgtctatata

SEQ ID NO: 6661008 - DNA, 20 bp, Homo sapiens
atatgtctcgctagtgatgt

SEQ ID NO: 6661009 - DNA, 13 bp, Homo sapiens
atatgtctctttg

SEQ ID NO: 6661010 - DNA, 15 bp, Homo sapiens
atatgtctgataatg

SEQ ID NO: 6661011 - DNA, 21 bp, Homo sapiens
atatgtctgcaggtttctcct

SEQ ID NO: 6661012 - DNA, 16 bp, Homo sapiens
atatgtctgctccttt

SEQ ID NO: 6661013 - DNA, 16 bp, Homo sapiens
atatgtctgcttctgt

SEQ ID NO: 6661014 - DNA, 20 bp, Homo sapiens
atatgtcttactactttaaa

SEQ ID NO: 6661015 - DNA, 22 bp, Homo sapiens
atatgtcttgcaaagcctttaa

SEQ ID NO: 6661016 - DNA, 14 bp, Homo sapiens
atatgtgaaaaaaa

SEQ ID NO: 6661017 - DNA, 13 bp, Homo sapiens
atatgtgaagttt

SEQ ID NO: 6661018 - DNA, 14 bp, Homo sapiens
atatgtgaagtttt

SEQ ID NO: 6661019 - DNA, 15 bp, Homo sapiens
atatgtgaagttttc

SEQ ID NO: 6661020 - DNA, 22 bp, Homo sapiens
atatgtgaagttttccttgcta

SEQ ID NO: 6661021 - DNA, 20 bp, Homo sapiens
atatgtgagaacttttcata

SEQ ID NO: 6661022 - DNA, 21 bp, Homo sapiens
atatgtgagattttttattgc

SEQ ID NO: 6661023 - DNA, 20 bp, Homo sapiens
atatgtgagtgccttttgca

SEQ ID NO: 6661024 - DNA, 15 bp, Homo sapiens
atatgtgatctgtct

SEQ ID NO: 6661025 - DNA, 20 bp, Homo sapiens
atatgtgatctgtcttgtaa

SEQ ID NO: 6661026 - DNA, 21 bp, Homo sapiens
atatgtgatctgtcttgtaat

SEQ ID NO: 6661027 - DNA, 14 bp, Homo sapiens
atatgtgattttca

SEQ ID NO: 6661028 - DNA, 16 bp, Homo sapiens
atatgtgattttcaaa

SEQ ID NO: 6661029 - DNA, 14 bp, Homo sapiens
atatgtgcagtctt

SEQ ID NO: 6661030 - DNA, 19 bp, Homo sapiens
atatgtgccaatcaatagc

SEQ ID NO: 6661031 - DNA, 14 bp, Homo sapiens
atatgtgccttaag

SEQ ID NO: 6661032 - DNA, 16 bp, Homo sapiens
atatgtgccttaagtt

SEQ ID NO: 6661033 - DNA, 17 bp, Homo sapiens
atatgtgctatggagag

SEQ ID NO: 6661034 - DNA, 15 bp, Homo sapiens
atatgtgcttctcag

SEQ ID NO: 6661035 - DNA, 17 bp, Homo sapiens
atatgtgcttgtgtgta

SEQ ID NO: 6661036 - DNA, 18 bp, Homo sapiens
atatgtgcttgtgtgtat

SEQ ID NO: 6661037 - DNA, 20 bp, Homo sapiens
atatgtgcttgtgtgtatgt

SEQ ID NO: 6661038 - DNA, 21 bp, Homo sapiens
atatgtgcttgtgtgtatgtc

SEQ ID NO: 6661039 - DNA, 19 bp, Homo sapiens
atatgtggtccatctctga

SEQ ID NO: 6661040 - DNA, 23 bp, Homo sapiens
atatgtggtccatctctgaaaac

SEQ ID NO: 6661041 - DNA, 19 bp, Homo sapiens
atatgtgtaaatgttatga

SEQ ID NO: 6661042 - DNA, 20 bp, Homo sapiens
atatgtgtaaatgttatgac

SEQ ID NO: 6661043 - DNA, 20 bp, Homo sapiens
atatgtgtaatatcatttca

SEQ ID NO: 6661044 - DNA, 22 bp, Homo sapiens
atatgtgtaatatcatttcata

SEQ ID NO: 6661045 - DNA, 16 bp, Homo sapiens
atatgtgtatacatac

SEQ ID NO: 6661046 - DNA, 20 bp, Homo sapiens
atatgtgtatacatacatgt

SEQ ID NO: 6661047 - DNA, 12 bp, Homo sapiens
atatgtgtatgt

SEQ ID NO: 6661048 - DNA, 22 bp, Homo sapiens
atatgtgtatgtacgtttgtat

SEQ ID NO: 6661049 - DNA, 13 bp, Homo sapiens
atatgtgtgtgtg

SEQ ID NO: 6661050 - DNA, 14 bp, Homo sapiens
atatgtgtgtgtgt

SEQ ID NO: 6661051 - DNA, 15 bp, Homo sapiens
atatgtgtgtgtttg

SEQ ID NO: 6661052 - DNA, 14 bp, Homo sapiens
atatgtgttgaaaa

SEQ ID NO: 6661053 - DNA, 17 bp, Homo sapiens
atatgttaaagcttatt

SEQ ID NO: 6661054 - DNA, 21 bp, Homo sapiens
atatgttaataaactgcaaat

SEQ ID NO: 6661055 - DNA, 16 bp, Homo sapiens
atatgttaatttgtgt

SEQ ID NO: 6661056 - DNA, 22 bp, Homo sapiens
atatgttagaatcaaatactca

SEQ ID NO: 6661057 - DNA, 18 bp, Homo sapiens
atatgttaggaatactct

SEQ ID NO: 6661058 - DNA, 23 bp, Homo sapiens
atatgttatggcttattgtgtga

SEQ ID NO: 6661059 - DNA, 16 bp, Homo sapiens
atatgttcacatcttg

SEQ ID NO: 6661060 - DNA, 14 bp, Homo sapiens
atatgttcactgtc

SEQ ID NO: 6661061 - DNA, 22 bp, Homo sapiens
atatgttctgcaagaattaaaa

SEQ ID NO: 6661062 - DNA, 18 bp, Homo sapiens
atatgttctttaaaaata

SEQ ID NO: 6661063 - DNA, 17 bp, Homo sapiens
atatgttgaatactttt

SEQ ID NO: 6661064 - DNA, 17 bp, Homo sapiens
atatgttgagtgttcat

SEQ ID NO: 6661065 - DNA, 20 bp, Homo sapiens
atatgttgctataataaaga

SEQ ID NO: 6661066 - DNA, 13 bp, Homo sapiens
atatgttgctgaa

SEQ ID NO: 6661067 - DNA, 20 bp, Homo sapiens
atatgttggggtttttttaa

SEQ ID NO: 6661068 - DNA, 23 bp, Homo sapiens
atatgttggggtttttttaagat

SEQ ID NO: 6661069 - DNA, 17 bp, Homo sapiens
atatgttggtttaatta

SEQ ID NO: 6661070 - DNA, 16 bp, Homo sapiens
atatgttgtaatattt

SEQ ID NO: 6661071 - DNA, 21 bp, Homo sapiens
atatgttgtaatatttcttca

SEQ ID NO: 6661072 - DNA, 13 bp, Homo sapiens
atatgtttacaca

SEQ ID NO: 6661073 - DNA, 24 bp, Homo sapiens
atatgtttaccttttaattaatga

SEQ ID NO: 6661074 - DNA, 15 bp, Homo sapiens
atatgtttatatact

SEQ ID NO: 6661075 - DNA, 16 bp, Homo sapiens
atatgtttattcaaaa

SEQ ID NO: 6661076 - DNA, 17 bp, Homo sapiens
atatgtttattcaaaat

SEQ ID NO: 6661077 - DNA, 17 bp, Homo sapiens
atatgtttcaaactttg

SEQ ID NO: 6661078 - DNA, 21 bp, Homo sapiens
atatgtttccccatctctgtc

SEQ ID NO: 6661079 - DNA, 20 bp, Homo sapiens
atatgtttccttgtttatca

SEQ ID NO: 6661080 - DNA, 17 bp, Homo sapiens
atatgttttaaatatag

SEQ ID NO: 6661081 - DNA, 22 bp, Homo sapiens
atatgttttaaatatagaattt

SEQ ID NO: 6661082 - DNA, 18 bp, Homo sapiens
atatgttttaagaggcag

SEQ ID NO: 6661083 - DNA, 15 bp, Homo sapiens
atatgttttatttca

SEQ ID NO: 6661084 - DNA, 12 bp, Homo sapiens
atatgttttgag

SEQ ID NO: 6661085 - DNA, 13 bp, Homo sapiens
atatgttttgaga

SEQ ID NO: 6661086 - DNA, 15 bp, Homo sapiens
atatgttttgagaaa

SEQ ID NO: 6661087 - DNA, 17 bp, Homo sapiens
atatgtttttaaaggtg

SEQ ID NO: 6661088 - DNA, 17 bp, Homo sapiens
atatgttttttagatca

SEQ ID NO: 6661089 - DNA, 18 bp, Homo sapiens
atattaaaaaaagacata

SEQ ID NO: 6661090 - DNA, 15 bp, Homo sapiens
atattaaaaagaagt

SEQ ID NO: 6661091 - DNA, 13 bp, Homo sapiens
atattaaaaatat

SEQ ID NO: 6661092 - DNA, 15 bp, Homo sapiens
atattaaaaatataa

SEQ ID NO: 6661093 - DNA, 18 bp, Homo sapiens
atattaaaaatatacaag

SEQ ID NO: 6661094 - DNA, 23 bp, Homo sapiens
atattaaaaatatggaacttcta

SEQ ID NO: 6661095 - DNA, 14 bp, Homo sapiens
atattaaaaatggt

SEQ ID NO: 6661096 - DNA, 19 bp, Homo sapiens
atattaaaaatggtaaaat

SEQ ID NO: 6661097 - DNA, 20 bp, Homo sapiens
atattaaaaatggtaaaatt

SEQ ID NO: 6661098 - DNA, 23 bp, Homo sapiens
atattaaaaatggtaaaattgca

SEQ ID NO: 6661099 - DNA, 14 bp, Homo sapiens
atattaaaaattgg

SEQ ID NO: 6661100 - DNA, 17 bp, Homo sapiens
atattaaaacacaaagt

SEQ ID NO: 6661101 - DNA, 15 bp, Homo sapiens
atattaaaagtcaca

SEQ ID NO: 6661102 - DNA, 23 bp, Homo sapiens
atattaaaagtcacaatgttctt

SEQ ID NO: 6661103 - DNA, 11 bp, Homo sapiens
atattaaaata

SEQ ID NO: 6661104 - DNA, 15 bp, Homo sapiens
atattaaaatagcat

SEQ ID NO: 6661105 - DNA, 20 bp, Homo sapiens
atattaaaatagcatactgt

SEQ ID NO: 6661106 - DNA, 22 bp, Homo sapiens
atattaaaatagcatactgtgt

SEQ ID NO: 6661107 - DNA, 12 bp, Homo sapiens
atattaaaatca

SEQ ID NO: 6661108 - DNA, 18 bp, Homo sapiens
atattaaaatctgatgta

SEQ ID NO: 6661109 - DNA, 13 bp, Homo sapiens
atattaaaatgtc

SEQ ID NO: 6661110 - DNA, 17 bp, Homo sapiens
atattaaaattacagat

SEQ ID NO: 6661111 - DNA, 18 bp, Homo sapiens
atattaaacaaagtttca

SEQ ID NO: 6661112 - DNA, 20 bp, Homo sapiens
atattaaacaaagtttcaga

SEQ ID NO: 6661113 - DNA, 19 bp, Homo sapiens
atattaaaccataagatgg

SEQ ID NO: 6661114 - DNA, 15 bp, Homo sapiens
atattaaacgtgtaa

SEQ ID NO: 6661115 - DNA, 14 bp, Homo sapiens
atattaaacttctg

SEQ ID NO: 6661116 - DNA, 15 bp, Homo sapiens
atattaaagaaaaac

SEQ ID NO: 6661117 - DNA, 15 bp, Homo sapiens
atattaaagaaagtc

SEQ ID NO: 6661118 - DNA, 16 bp, Homo sapiens
atattaaagaaagtca

SEQ ID NO: 6661119 - DNA, 18 bp, Homo sapiens
atattaaagaaagtcata

SEQ ID NO: 6661120 - DNA, 13 bp, Homo sapiens
atattaaagaagt

SEQ ID NO: 6661121 - DNA, 21 bp, Homo sapiens
atattaaagactaactaaaat

SEQ ID NO: 6661122 - DNA, 12 bp, Homo sapiens
atattaaagatt

SEQ ID NO: 6661123 - DNA, 21 bp, Homo sapiens
atattaaagattctctttaaa

SEQ ID NO: 6661124 - DNA, 14 bp, Homo sapiens
atattaaagccatg

SEQ ID NO: 6661125 - DNA, 21 bp, Homo sapiens
atattaaagctcttcatttct

SEQ ID NO: 6661126 - DNA, 20 bp, Homo sapiens
atattaaaggtgaaaattgt

SEQ ID NO: 6661127 - DNA, 18 bp, Homo sapiens
atattaaagtctgagaaa

SEQ ID NO: 6661128 - DNA, 13 bp, Homo sapiens
atattaaagtgtt

SEQ ID NO: 6661129 - DNA, 15 bp, Homo sapiens
atattaaagtgttat

SEQ ID NO: 6661130 - DNA, 16 bp, Homo sapiens
atattaaataacatgt

SEQ ID NO: 6661131 - DNA, 17 bp, Homo sapiens
atattaaataacatgtt

SEQ ID NO: 6661132 - DNA, 23 bp, Homo sapiens
atattaaatatgttagcaaagag

SEQ ID NO: 6661133 - DNA, 13 bp, Homo sapiens
atattaaatctgc

SEQ ID NO: 6661134 - DNA, 22 bp, Homo sapiens
atattaaatgagggtttctgat

SEQ ID NO: 6661135 - DNA, 16 bp, Homo sapiens
atattaaatgttgctt

SEQ ID NO: 6661136 - DNA, 19 bp, Homo sapiens
atattaaattctcaaagtt

SEQ ID NO: 6661137 - DNA, 16 bp, Homo sapiens
atattaaatttcaaat

SEQ ID NO: 6661138 - DNA, 13 bp, Homo sapiens
atattaacatatt

SEQ ID NO: 6661139 - DNA, 14 bp, Homo sapiens
atattaacatgctt

SEQ ID NO: 6661140 - DNA, 15 bp, Homo sapiens
atattaacattcttt

SEQ ID NO: 6661141 - DNA, 15 bp, Homo sapiens
atattaactacagaa

SEQ ID NO: 6661142 - DNA, 15 bp, Homo sapiens
atattaactactgta

SEQ ID NO: 6661143 - DNA, 15 bp, Homo sapiens
atattaacttttaat

SEQ ID NO: 6661144 - DNA, 16 bp, Homo sapiens
atattaagaaaaatat

SEQ ID NO: 6661145 - DNA, 15 bp, Homo sapiens
atattaagaaaatat

SEQ ID NO: 6661146 - DNA, 21 bp, Homo sapiens
atattaagaaaatattctaac

SEQ ID NO: 6661147 - DNA, 16 bp, Homo sapiens
atattaagaaacaatt

SEQ ID NO: 6661148 - DNA, 22 bp, Homo sapiens
atattaagaaagactatctaaa

SEQ ID NO: 6661149 - DNA, 16 bp, Homo sapiens
atattaagaactgctg

SEQ ID NO: 6661150 - DNA, 13 bp, Homo sapiens
atattaagaatga

SEQ ID NO: 6661151 - DNA, 16 bp, Homo sapiens
atattaagagctattt

SEQ ID NO: 6661152 - DNA, 12 bp, Homo sapiens
atattaagcact

SEQ ID NO: 6661153 - DNA, 13 bp, Homo sapiens
atattaagcactt

SEQ ID NO: 6661154 - DNA, 20 bp, Homo sapiens
atattaagcatgacagaaaa

SEQ ID NO: 6661155 - DNA, 13 bp, Homo sapiens
atattaagctaaa

SEQ ID NO: 6661156 - DNA, 20 bp, Homo sapiens
atattaaggggatcagaagt

SEQ ID NO: 6661157 - DNA, 12 bp, Homo sapiens
atattaatacag

SEQ ID NO: 6661158 - DNA, 19 bp, Homo sapiens
atattaatagtaatttgta

SEQ ID NO: 6661159 - DNA, 19 bp, Homo sapiens
atattaatatatatctgct

SEQ ID NO: 6661160 - DNA, 13 bp, Homo sapiens
atattaatcaaaa

SEQ ID NO: 6661161 - DNA, 21 bp, Homo sapiens
atattaatcaccttctttgta

SEQ ID NO: 6661162 - DNA, 22 bp, Homo sapiens
atattaatcaccttctttgtaa

SEQ ID NO: 6661163 - DNA, 16 bp, Homo sapiens
atattaatgcccagac

SEQ ID NO: 6661164 - DNA, 23 bp, Homo sapiens
atattaattagcaggttgggcta

SEQ ID NO: 6661165 - DNA, 20 bp, Homo sapiens
atattaatttatcagattgc

SEQ ID NO: 6661166 - DNA, 21 bp, Homo sapiens
atattacaacatttatgtgag

SEQ ID NO: 6661167 - DNA, 13 bp, Homo sapiens
atattacaatatt

SEQ ID NO: 6661168 - DNA, 13 bp, Homo sapiens
atattacaatgat

SEQ ID NO: 6661169 - DNA, 16 bp, Homo sapiens
atattacaatgatcac

SEQ ID NO: 6661170 - DNA, 19 bp, Homo sapiens
atattacattgcattcaaa

SEQ ID NO: 6661171 - DNA, 21 bp, Homo sapiens
atattacattgcattcaaaat

SEQ ID NO: 6661172 - DNA, 15 bp, Homo sapiens
atattacatttcatt

SEQ ID NO: 6661173 - DNA, 17 bp, Homo sapiens
atattacatttcattta

SEQ ID NO: 6661174 - DNA, 18 bp, Homo sapiens
atattacatttcatttat

SEQ ID NO: 6661175 - DNA, 19 bp, Homo sapiens
atattaccatcttaatctt

SEQ ID NO: 6661176 - DNA, 16 bp, Homo sapiens
atattacccaatggaa

SEQ ID NO: 6661177 - DNA, 17 bp, Homo sapiens
atattacccaatggaaa

SEQ ID NO: 6661178 - DNA, 17 bp, Homo sapiens
atattacctaatgaaag

SEQ ID NO: 6661179 - DNA, 15 bp, Homo sapiens
atattacctcaaatt

SEQ ID NO: 6661180 - DNA, 19 bp, Homo sapiens
atattacctctcttggaaa

SEQ ID NO: 6661181 - DNA, 17 bp, Homo sapiens
atattacggtttgcccc

SEQ ID NO: 6661182 - DNA, 19 bp, Homo sapiens
atattacgttgtttcttat

SEQ ID NO: 6661183 - DNA, 20 bp, Homo sapiens
atattacgttgtttcttata

SEQ ID NO: 6661184 - DNA, 23 bp, Homo sapiens
atattactctagtttattctaat

SEQ ID NO: 6661185 - DNA, 14 bp, Homo sapiens
atattactctatga

SEQ ID NO: 6661186 - DNA, 23 bp, Homo sapiens
atattactctcattctttgaaca

SEQ ID NO: 6661187 - DNA, 21 bp, Homo sapiens
atattactctgcctgtcaagt

SEQ ID NO: 6661188 - DNA, 23 bp, Homo sapiens
atattactctgcctgtcaagttt

SEQ ID NO: 6661189 - DNA, 17 bp, Homo sapiens
atattactgacatttct

SEQ ID NO: 6661190 - DNA, 20 bp, Homo sapiens
atattactggataaattgta

SEQ ID NO: 6661191 - DNA, 21 bp, Homo sapiens
atattactgtacatgggacta

SEQ ID NO: 6661192 - DNA, 13 bp, Homo sapiens
atattactgtctt

SEQ ID NO: 6661193 - DNA, 14 bp, Homo sapiens
atattactgtcttt

SEQ ID NO: 6661194 - DNA, 15 bp, Homo sapiens
atattactgttgcat

SEQ ID NO: 6661195 - DNA, 20 bp, Homo sapiens
atattactgtttatttctgt

SEQ ID NO: 6661196 - DNA, 14 bp, Homo sapiens
atattactttatca

SEQ ID NO: 6661197 - DNA, 16 bp, Homo sapiens
atattactttatcact

SEQ ID NO: 6661198 - DNA, 17 bp, Homo sapiens
atattactttatcactt

SEQ ID NO: 6661199 - DNA, 18 bp, Homo sapiens
atattactttatcacttt

SEQ ID NO: 6661200 - DNA, 13 bp, Homo sapiens
atattactttgtc

SEQ ID NO: 6661201 - DNA, 15 bp, Homo sapiens
atattacttttgtaa

SEQ ID NO: 6661202 - DNA, 17 bp, Homo sapiens
atattacttttgtaaat

SEQ ID NO: 6661203 - DNA, 16 bp, Homo sapiens
atattagaaaactttg

SEQ ID NO: 6661204 - DNA, 17 bp, Homo sapiens
atattagaaaactttgt

SEQ ID NO: 6661205 - DNA, 18 bp, Homo sapiens
atattagaaaactttgtt

SEQ ID NO: 6661206 - DNA, 18 bp, Homo sapiens
atattagaagtgttaact

SEQ ID NO: 6661207 - DNA, 16 bp, Homo sapiens
atattagacttctgtt

SEQ ID NO: 6661208 - DNA, 20 bp, Homo sapiens
atattagacttctgttttca

SEQ ID NO: 6661209 - DNA, 14 bp, Homo sapiens
atattagatgcccg

SEQ ID NO: 6661210 - DNA, 22 bp, Homo sapiens
atattagatgctctgagaaatt

SEQ ID NO: 6661211 - DNA, 16 bp, Homo sapiens
atattagatgtgattt

SEQ ID NO: 6661212 - DNA, 17 bp, Homo sapiens
atattagatgtgattta

SEQ ID NO: 6661213 - DNA, 18 bp, Homo sapiens
atattagatgtgatttaa

SEQ ID NO: 6661214 - DNA, 17 bp, Homo sapiens
atattagcaaagaagct

SEQ ID NO: 6661215 - DNA, 13 bp, Homo sapiens
atattagccaaag

SEQ ID NO: 6661216 - DNA, 21 bp, Homo sapiens
atattagctttactgtttgtt

SEQ ID NO: 6661217 - DNA, 22 bp, Homo sapiens
atattaggcatgttcagggatg

SEQ ID NO: 6661218 - DNA, 23 bp, Homo sapiens
atattaggcatgttcagggatgc

SEQ ID NO: 6661219 - DNA, 15 bp, Homo sapiens
atattagtgaagatg

SEQ ID NO: 6661220 - DNA, 16 bp, Homo sapiens
atattagtgattctga

SEQ ID NO: 6661221 - DNA, 21 bp, Homo sapiens
atattagtgattctgatttca

SEQ ID NO: 6661222 - DNA, 22 bp, Homo sapiens
atattagtttgatttaatatct

SEQ ID NO: 6661223 - DNA, 13 bp, Homo sapiens
atattataaaaat

SEQ ID NO: 6661224 - DNA, 20 bp, Homo sapiens
atattataaaggataaagaa

SEQ ID NO: 6661225 - DNA, 15 bp, Homo sapiens
atattataaatatat

SEQ ID NO: 6661226 - DNA, 17 bp, Homo sapiens
atattataacttaaaaa

SEQ ID NO: 6661227 - DNA, 12 bp, Homo sapiens
atattataagat

SEQ ID NO: 6661228 - DNA, 17 bp, Homo sapiens
atattataagggagagc

SEQ ID NO: 6661229 - DNA, 20 bp, Homo sapiens
atattataagttgaccttta

SEQ ID NO: 6661230 - DNA, 14 bp, Homo sapiens
atattataataatg

SEQ ID NO: 6661231 - DNA, 20 bp, Homo sapiens
atattataataatgttctct

SEQ ID NO: 6661232 - DNA, 14 bp, Homo sapiens
atattataattgga

SEQ ID NO: 6661233 - DNA, 22 bp, Homo sapiens
atattataatttttttcaatat

SEQ ID NO: 6661234 - DNA, 21 bp, Homo sapiens
atattataccagatgaacatt

SEQ ID NO: 6661235 - DNA, 20 bp, Homo sapiens
atattatactaagaaaagat

SEQ ID NO: 6661236 - DNA, 20 bp, Homo sapiens
atattatactgacagaggct

SEQ ID NO: 6661237 - DNA, 16 bp, Homo sapiens
atattatacttgtaat

SEQ ID NO: 6661238 - DNA, 19 bp, Homo sapiens
atattatacttgtaattat

SEQ ID NO: 6661239 - DNA, 11 bp, Homo sapiens
atattatagaa

SEQ ID NO: 6661240 - DNA, 13 bp, Homo sapiens
atattatataagg

SEQ ID NO: 6661241 - DNA, 13 bp, Homo sapiens
atattatatacat

SEQ ID NO: 6661242 - DNA, 14 bp, Homo sapiens
atattatatacata

SEQ ID NO: 6661243 - DNA, 11 bp, Homo sapiens
atattatatat

SEQ ID NO: 6661244 - DNA, 12 bp, Homo sapiens
atattatatata

SEQ ID NO: 6661245 - DNA, 15 bp, Homo sapiens
atattatatatagaa

SEQ ID NO: 6661246 - DNA, 16 bp, Homo sapiens
atattatatatagaaa

SEQ ID NO: 6661247 - DNA, 19 bp, Homo sapiens
atattatatatagaaaaga

SEQ ID NO: 6661248 - DNA, 17 bp, Homo sapiens
atattatatatatctat

SEQ ID NO: 6661249 - DNA, 13 bp, Homo sapiens
atattatatcaga

SEQ ID NO: 6661250 - DNA, 18 bp, Homo sapiens
atattatatggaaatata

SEQ ID NO: 6661251 - DNA, 15 bp, Homo sapiens
atattatatggcagg

SEQ ID NO: 6661252 - DNA, 17 bp, Homo sapiens
atattatatgtatgtat

SEQ ID NO: 6661253 - DNA, 15 bp, Homo sapiens
atattatattaaaca

SEQ ID NO: 6661254 - DNA, 22 bp, Homo sapiens
atattatattgtatttaaccca

SEQ ID NO: 6661255 - DNA, 16 bp, Homo sapiens
atattatatttggatg

SEQ ID NO: 6661256 - DNA, 18 bp, Homo sapiens
atattatattttttctat

SEQ ID NO: 6661257 - DNA, 19 bp, Homo sapiens
atattatcttatactgaaa

SEQ ID NO: 6661258 - DNA, 15 bp, Homo sapiens
atattatgaaaatta

SEQ ID NO: 6661259 - DNA, 16 bp, Homo sapiens
atattatgaaaattaa

SEQ ID NO: 6661260 - DNA, 18 bp, Homo sapiens
atattatgaaatttcact

SEQ ID NO: 6661261 - DNA, 23 bp, Homo sapiens
atattatgaagcttttatgtgaa

SEQ ID NO: 6661262 - DNA, 15 bp, Homo sapiens
atattatgagatgct

SEQ ID NO: 6661263 - DNA, 15 bp, Homo sapiens
atattatgcaaattc

SEQ ID NO: 6661264 - DNA, 18 bp, Homo sapiens
atattatgcctgaatgac

SEQ ID NO: 6661265 - DNA, 19 bp, Homo sapiens
atattatgcctgaatgact

SEQ ID NO: 6661266 - DNA, 15 bp, Homo sapiens
atattatggtgtaat

SEQ ID NO: 6661267 - DNA, 22 bp, Homo sapiens
atattatgtagtccgttaacac

SEQ ID NO: 6661268 - DNA, 14 bp, Homo sapiens
atattatgtataaa

SEQ ID NO: 6661269 - DNA, 22 bp, Homo sapiens
atattatgtataaaatgtaaca

SEQ ID NO: 6661270 - DNA, 14 bp, Homo sapiens
atattatgtataga

SEQ ID NO: 6661271 - DNA, 15 bp, Homo sapiens
atattatgtatagaa

SEQ ID NO: 6661272 - DNA, 20 bp, Homo sapiens
atattatgtatagaaaataa

SEQ ID NO: 6661273 - DNA, 13 bp, Homo sapiens
atattatgtcttc

SEQ ID NO: 6661274 - DNA, 14 bp, Homo sapiens
atattatgtcttct

SEQ ID NO: 6661275 - DNA, 13 bp, Homo sapiens
atattatgtgaag

SEQ ID NO: 6661276 - DNA, 22 bp, Homo sapiens
atattatgtggcttttatttca

SEQ ID NO: 6661277 - DNA, 17 bp, Homo sapiens
atattatgtgtttccat

SEQ ID NO: 6661278 - DNA, 19 bp, Homo sapiens
atattattagttttgattt

SEQ ID NO: 6661279 - DNA, 21 bp, Homo sapiens
atattattataatcttataat

SEQ ID NO: 6661280 - DNA, 16 bp, Homo sapiens
atattattatatatat

SEQ ID NO: 6661281 - DNA, 16 bp, Homo sapiens
atattattattaattt

SEQ ID NO: 6661282 - DNA, 19 bp, Homo sapiens
atattattcaagtgcctct

SEQ ID NO: 6661283 - DNA, 19 bp, Homo sapiens
atattattccaaagttatt

SEQ ID NO: 6661284 - DNA, 21 bp, Homo sapiens
atattattccgtattacattt

SEQ ID NO: 6661285 - DNA, 22 bp, Homo sapiens
atattattccgtattacatttt

SEQ ID NO: 6661286 - DNA, 19 bp, Homo sapiens
atattattgctatatttgc

SEQ ID NO: 6661287 - DNA, 18 bp, Homo sapiens
atattattgtaagttgta

SEQ ID NO: 6661288 - DNA, 23 bp, Homo sapiens
atattattgtctgttttccttct

SEQ ID NO: 6661289 - DNA, 16 bp, Homo sapiens
atattatttaaatgtt

SEQ ID NO: 6661290 - DNA, 17 bp, Homo sapiens
atattatttcctttatt

SEQ ID NO: 6661291 - DNA, 14 bp, Homo sapiens
atattatttctagg

SEQ ID NO: 6661292 - DNA, 22 bp, Homo sapiens
atattatttctaggaagaattt

SEQ ID NO: 6661293 - DNA, 17 bp, Homo sapiens
atattatttcttctctt

SEQ ID NO: 6661294 - DNA, 13 bp, Homo sapiens
atattatttgata

SEQ ID NO: 6661295 - DNA, 18 bp, Homo sapiens
atattatttggcagtttg

SEQ ID NO: 6661296 - DNA, 19 bp, Homo sapiens
atattatttggcagtttgg

SEQ ID NO: 6661297 - DNA, 13 bp, Homo sapiens
atattatttgtct

SEQ ID NO: 6661298 - DNA, 17 bp, Homo sapiens
atattatttgtcttaaa

SEQ ID NO: 6661299 - DNA, 22 bp, Homo sapiens
atattattttagtgtgtaaaat

SEQ ID NO: 6661300 - DNA, 15 bp, Homo sapiens
atattattttatgtt

SEQ ID NO: 6661301 - DNA, 16 bp, Homo sapiens
atattattttctgtaa

SEQ ID NO: 6661302 - DNA, 16 bp, Homo sapiens
atattcaaaaattata

SEQ ID NO: 6661303 - DNA, 17 bp, Homo sapiens
atattcaaacacacagt

SEQ ID NO: 6661304 - DNA, 16 bp, Homo sapiens
atattcaaagtatata

SEQ ID NO: 6661305 - DNA, 13 bp, Homo sapiens
atattcaaatcag

SEQ ID NO: 6661306 - DNA, 19 bp, Homo sapiens
atattcaaatcagcaagct

SEQ ID NO: 6661307 - DNA, 20 bp, Homo sapiens
atattcaacacactgcctta

SEQ ID NO: 6661308 - DNA, 12 bp, Homo sapiens
atattcaaccat

SEQ ID NO: 6661309 - DNA, 17 bp, Homo sapiens
atattcaaccatggact

SEQ ID NO: 6661310 - DNA, 12 bp, Homo sapiens
atattcaagtaa

SEQ ID NO: 6661311 - DNA, 15 bp, Homo sapiens
atattcaagtaacac

SEQ ID NO: 6661312 - DNA, 18 bp, Homo sapiens
atattcaagtaacacttt

SEQ ID NO: 6661313 - DNA, 15 bp, Homo sapiens
atattcaataaagct

SEQ ID NO: 6661314 - DNA, 20 bp, Homo sapiens
atattcaataaagctgctga

SEQ ID NO: 6661315 - DNA, 21 bp, Homo sapiens
atattcaatgcatttaaaata

SEQ ID NO: 6661316 - DNA, 22 bp, Homo sapiens
atattcacacctcacgctctgg

SEQ ID NO: 6661317 - DNA, 16 bp, Homo sapiens
atattcacacttgaac

SEQ ID NO: 6661318 - DNA, 15 bp, Homo sapiens
atattcacatgttct

SEQ ID NO: 6661319 - DNA, 15 bp, Homo sapiens
atattcactctccat

SEQ ID NO: 6661320 - DNA, 20 bp, Homo sapiens
atattcactggttttacaca

SEQ ID NO: 6661321 - DNA, 17 bp, Homo sapiens
atattcagaattatgat

SEQ ID NO: 6661322 - DNA, 16 bp, Homo sapiens
atattcagacaaaatg

SEQ ID NO: 6661323 - DNA, 14 bp, Homo sapiens
atattcagagaata

SEQ ID NO: 6661324 - DNA, 14 bp, Homo sapiens
atattcagagatgt

SEQ ID NO: 6661325 - DNA, 16 bp, Homo sapiens
atattcagatgtatgt

SEQ ID NO: 6661326 - DNA, 20 bp, Homo sapiens
atattcagccagcttaaacc

SEQ ID NO: 6661327 - DNA, 20 bp, Homo sapiens
atattcagtgaaaagatttt

SEQ ID NO: 6661328 - DNA, 23 bp, Homo sapiens
atattcagtgctgtggcctgggc

SEQ ID NO: 6661329 - DNA, 12 bp, Homo sapiens
atattcataaag

SEQ ID NO: 6661330 - DNA, 23 bp, Homo sapiens
atattcataatatataaaagaaa

SEQ ID NO: 6661331 - DNA, 14 bp, Homo sapiens
atattcatacctgt

SEQ ID NO: 6661332 - DNA, 17 bp, Homo sapiens
atattcatacctgttgt

SEQ ID NO: 6661333 - DNA, 14 bp, Homo sapiens
atattcatattgga

SEQ ID NO: 6661334 - DNA, 20 bp, Homo sapiens
atattcatcaaataaacctt

SEQ ID NO: 6661335 - DNA, 17 bp, Homo sapiens
atattcatgaagagttg

SEQ ID NO: 6661336 - DNA, 21 bp, Homo sapiens
atattcatgctgcctgccatg

SEQ ID NO: 6661337 - DNA, 17 bp, Homo sapiens
atattcatgcttgccat

SEQ ID NO: 6661338 - DNA, 23 bp, Homo sapiens
atattcatgcttgccatctgttc

SEQ ID NO: 6661339 - DNA, 15 bp, Homo sapiens
atattcatgtaataa

SEQ ID NO: 6661340 - DNA, 16 bp, Homo sapiens
atattcatgtaataaa

SEQ ID NO: 6661341 - DNA, 17 bp, Homo sapiens
atattcatgtaataaat

SEQ ID NO: 6661342 - DNA, 17 bp, Homo sapiens
atattcattctttataa

SEQ ID NO: 6661343 - DNA, 22 bp, Homo sapiens
atattcattctttataaaccat

SEQ ID NO: 6661344 - DNA, 18 bp, Homo sapiens
atattcattggcagctca

SEQ ID NO: 6661345 - DNA, 19 bp, Homo sapiens
atattcattggttaacaat

SEQ ID NO: 6661346 - DNA, 21 bp, Homo sapiens
atattcatttaaaacattgca

SEQ ID NO: 6661347 - DNA, 13 bp, Homo sapiens
atattcatttcaa

SEQ ID NO: 6661348 - DNA, 17 bp, Homo sapiens
atattccaaaataaaag

SEQ ID NO: 6661349 - DNA, 13 bp, Homo sapiens
atattccaaggaa

SEQ ID NO: 6661350 - DNA, 19 bp, Homo sapiens
atattccaaggaaaattga

SEQ ID NO: 6661351 - DNA, 20 bp, Homo sapiens
atattccaaggaaaattgaa

SEQ ID NO: 6661352 - DNA, 15 bp, Homo sapiens
atattccagatcttt

SEQ ID NO: 6661353 - DNA, 17 bp, Homo sapiens
atattccagatctttca

SEQ ID NO: 6661354 - DNA, 17 bp, Homo sapiens
atattccatagtatatt

SEQ ID NO: 6661355 - DNA, 16 bp, Homo sapiens
atattccatgaatgta

SEQ ID NO: 6661356 - DNA, 19 bp, Homo sapiens
atattccatgaatgtatca

SEQ ID NO: 6661357 - DNA, 15 bp, Homo sapiens
atattccatttacat

SEQ ID NO: 6661358 - DNA, 17 bp, Homo sapiens
atattccatttacataa

SEQ ID NO: 6661359 - DNA, 14 bp, Homo sapiens
atattcccatggta

SEQ ID NO: 6661360 - DNA, 15 bp, Homo sapiens
atattcccattttat

SEQ ID NO: 6661361 - DNA, 19 bp, Homo sapiens
atattccccatttcctgta

SEQ ID NO: 6661362 - DNA, 17 bp, Homo sapiens
atattccctagaaactt

SEQ ID NO: 6661363 - DNA, 21 bp, Homo sapiens
atattcctaacttacccagat

SEQ ID NO: 6661364 - DNA, 23 bp, Homo sapiens
atattcctacaaagaaaaaagaa

SEQ ID NO: 6661365 - DNA, 17 bp, Homo sapiens
atattcctattgtgcaa

SEQ ID NO: 6661366 - DNA, 22 bp, Homo sapiens
atattcctattgtgcaatgtaa

SEQ ID NO: 6661367 - DNA, 14 bp, Homo sapiens
atattcctccaaat

SEQ ID NO: 6661368 - DNA, 13 bp, Homo sapiens
atattcctccagc

SEQ ID NO: 6661369 - DNA, 17 bp, Homo sapiens
atattcctgaatgaaat

SEQ ID NO: 6661370 - DNA, 21 bp, Homo sapiens
atattcctgcagcctggaggc

SEQ ID NO: 6661371 - DNA, 20 bp, Homo sapiens
atattcctggacttacaaaa

SEQ ID NO: 6661372 - DNA, 19 bp, Homo sapiens
atattccttactagaaata

SEQ ID NO: 6661373 - DNA, 19 bp, Homo sapiens
atattcctttctatcattt

SEQ ID NO: 6661374 - DNA, 20 bp, Homo sapiens
atattcctttctatcatttt

SEQ ID NO: 6661375 - DNA, 12 bp, Homo sapiens
atattcctttta

SEQ ID NO: 6661376 - DNA, 22 bp, Homo sapiens
atattccttttaaagaagcttt

SEQ ID NO: 6661377 - DNA, 17 bp, Homo sapiens
atattcctttttaactt

SEQ ID NO: 6661378 - DNA, 14 bp, Homo sapiens
atattcctttttct

SEQ ID NO: 6661379 - DNA, 22 bp, Homo sapiens
atattctaaaatataacacagt

SEQ ID NO: 6661380 - DNA, 18 bp, Homo sapiens
atattctaacatttgata

SEQ ID NO: 6661381 - DNA, 18 bp, Homo sapiens
atattctaagaaatatct

SEQ ID NO: 6661382 - DNA, 23 bp, Homo sapiens
atattctaagaaatatctgtgaa

SEQ ID NO: 6661383 - DNA, 21 bp, Homo sapiens
atattctacacatatatgtat

SEQ ID NO: 6661384 - DNA, 22 bp, Homo sapiens
atattctacacatatatgtata

SEQ ID NO: 6661385 - DNA, 19 bp, Homo sapiens
atattctacacatgtaaaa

SEQ ID NO: 6661386 - DNA, 12 bp, Homo sapiens
atattctagaac

SEQ ID NO: 6661387 - DNA, 21 bp, Homo sapiens
atattctagtaataaagactc

SEQ ID NO: 6661388 - DNA, 21 bp, Homo sapiens
atattctagtgtaacactgca

SEQ ID NO: 6661389 - DNA, 18 bp, Homo sapiens
atattctatacacaccct

SEQ ID NO: 6661390 - DNA, 18 bp, Homo sapiens
atattctatatgaattta

SEQ ID NO: 6661391 - DNA, 20 bp, Homo sapiens
atattctatatgaatttaaa

SEQ ID NO: 6661392 - DNA, 22 bp, Homo sapiens
atattctattacattttcagtg

SEQ ID NO: 6661393 - DNA, 15 bp, Homo sapiens
atattctattgtatt

SEQ ID NO: 6661394 - DNA, 13 bp, Homo sapiens
atattctatttta

SEQ ID NO: 6661395 - DNA, 15 bp, Homo sapiens
atattctatttttat

SEQ ID NO: 6661396 - DNA, 22 bp, Homo sapiens
atattctcacagctccaagaat

SEQ ID NO: 6661397 - DNA, 18 bp, Homo sapiens
atattctcagcagagtgc

SEQ ID NO: 6661398 - DNA, 16 bp, Homo sapiens
atattctcatggcttt

SEQ ID NO: 6661399 - DNA, 17 bp, Homo sapiens
atattctcattatttca

SEQ ID NO: 6661400 - DNA, 13 bp, Homo sapiens
atattctccccac

SEQ ID NO: 6661401 - DNA, 17 bp, Homo sapiens
atattctctaagatata

SEQ ID NO: 6661402 - DNA, 12 bp, Homo sapiens
atattctctgta

SEQ ID NO: 6661403 - DNA, 16 bp, Homo sapiens
atattctctgtacata

SEQ ID NO: 6661404 - DNA, 19 bp, Homo sapiens
atattctctgtacatatta

SEQ ID NO: 6661405 - DNA, 21 bp, Homo sapiens
atattctcttgtctggctgca

SEQ ID NO: 6661406 - DNA, 20 bp, Homo sapiens
atattctgaaaggaaataca

SEQ ID NO: 6661407 - DNA, 22 bp, Homo sapiens
atattctgaaaggaaatacact

SEQ ID NO: 6661408 - DNA, 17 bp, Homo sapiens
atattctgataatgtat

SEQ ID NO: 6661409 - DNA, 20 bp, Homo sapiens
atattctggaaaaaaaatat

SEQ ID NO: 6661410 - DNA, 23 bp, Homo sapiens
atattctggaaaaaaaatatata

SEQ ID NO: 6661411 - DNA, 17 bp, Homo sapiens
atattctgtacattttt

SEQ ID NO: 6661412 - DNA, 14 bp, Homo sapiens
atattctgttgctt

SEQ ID NO: 6661413 - DNA, 15 bp, Homo sapiens
atattctgttgcttt

SEQ ID NO: 6661414 - DNA, 18 bp, Homo sapiens
atattctgttgctttaca

SEQ ID NO: 6661415 - DNA, 20 bp, Homo sapiens
atattctgttttgttaatat

SEQ ID NO: 6661416 - DNA, 23 bp, Homo sapiens
atattcttatgtatgtgaaagtt

SEQ ID NO: 6661417 - DNA, 15 bp, Homo sapiens
atattcttattggaa

SEQ ID NO: 6661418 - DNA, 22 bp, Homo sapiens
atattcttcctggggcccaaat

SEQ ID NO: 6661419 - DNA, 18 bp, Homo sapiens
atattcttgctttcacaa

SEQ ID NO: 6661420 - DNA, 15 bp, Homo sapiens
atattcttgtccaca

SEQ ID NO: 6661421 - DNA, 22 bp, Homo sapiens
atattcttgtccacattctact

SEQ ID NO: 6661422 - DNA, 14 bp, Homo sapiens
atattctttattct

SEQ ID NO: 6661423 - DNA, 15 bp, Homo sapiens
atattctttcaaagg

SEQ ID NO: 6661424 - DNA, 15 bp, Homo sapiens
atattctttcaataa

SEQ ID NO: 6661425 - DNA, 17 bp, Homo sapiens
atattctttctcataaa

SEQ ID NO: 6661426 - DNA, 20 bp, Homo sapiens
atattctttctcataaaact

SEQ ID NO: 6661427 - DNA, 19 bp, Homo sapiens
atattcttttgatcacatt

SEQ ID NO: 6661428 - DNA, 13 bp, Homo sapiens
atattcttttgtt

SEQ ID NO: 6661429 - DNA, 14 bp, Homo sapiens
atattcttttgtta

SEQ ID NO: 6661430 - DNA, 17 bp, Homo sapiens
atattcttttgtttcca

SEQ ID NO: 6661431 - DNA, 16 bp, Homo sapiens
atattgaaaaaataga

SEQ ID NO: 6661432 - DNA, 15 bp, Homo sapiens
atattgaaaagaaaa

SEQ ID NO: 6661433 - DNA, 19 bp, Homo sapiens
atattgaaaagcacagagg

SEQ ID NO: 6661434 - DNA, 17 bp, Homo sapiens
atattgaaaatgtcact

SEQ ID NO: 6661435 - DNA, 14 bp, Homo sapiens
atattgaaaattga

SEQ ID NO: 6661436 - DNA, 16 bp, Homo sapiens
atattgaaaattgaaa

SEQ ID NO: 6661437 - DNA, 21 bp, Homo sapiens
atattgaaaattgaaaagtac

SEQ ID NO: 6661438 - DNA, 16 bp, Homo sapiens
atattgaaagttgctt

SEQ ID NO: 6661439 - DNA, 12 bp, Homo sapiens
atattgaacttt

SEQ ID NO: 6661440 - DNA, 17 bp, Homo sapiens
atattgaagacaatttg

SEQ ID NO: 6661441 - DNA, 18 bp, Homo sapiens
atattgaaggagaaaata

SEQ ID NO: 6661442 - DNA, 21 bp, Homo sapiens
atattgaatataatatatttg

SEQ ID NO: 6661443 - DNA, 23 bp, Homo sapiens
atattgaatgccttatttttgaa

SEQ ID NO: 6661444 - DNA, 13 bp, Homo sapiens
atattgaatgtta

SEQ ID NO: 6661445 - DNA, 13 bp, Homo sapiens
atattgaattttt

SEQ ID NO: 6661446 - DNA, 18 bp, Homo sapiens
atattgacaagtgtcttt

SEQ ID NO: 6661447 - DNA, 17 bp, Homo sapiens
atattgacactgtccct

SEQ ID NO: 6661448 - DNA, 16 bp, Homo sapiens
atattgacatttgtag

SEQ ID NO: 6661449 - DNA, 20 bp, Homo sapiens
atattgacatttgtagttga

SEQ ID NO: 6661450 - DNA, 18 bp, Homo sapiens
atattgaccatgtgatta

SEQ ID NO: 6661451 - DNA, 20 bp, Homo sapiens
atattgacccaaatgtgtaa

SEQ ID NO: 6661452 - DNA, 18 bp, Homo sapiens
atattgactcaaaccata

SEQ ID NO: 6661453 - DNA, 12 bp, Homo sapiens
atattgacttct

SEQ ID NO: 6661454 - DNA, 14 bp, Homo sapiens
atattgacttgtat

SEQ ID NO: 6661455 - DNA, 15 bp, Homo sapiens
atattgacttgtata

SEQ ID NO: 6661456 - DNA, 11 bp, Homo sapiens
atattgagaat

SEQ ID NO: 6661457 - DNA, 14 bp, Homo sapiens
atattgagcaatat

SEQ ID NO: 6661458 - DNA, 14 bp, Homo sapiens
atattgagcagaat

SEQ ID NO: 6661459 - DNA, 21 bp, Homo sapiens
atattgaggagcactgaaagt

SEQ ID NO: 6661460 - DNA, 16 bp, Homo sapiens
atattgaggctgcagc

SEQ ID NO: 6661461 - DNA, 16 bp, Homo sapiens
atattgaggctttgtg

SEQ ID NO: 6661462 - DNA, 12 bp, Homo sapiens
atattgataaat

SEQ ID NO: 6661463 - DNA, 19 bp, Homo sapiens
atattgataagatctttta

SEQ ID NO: 6661464 - DNA, 22 bp, Homo sapiens
atattgataataaaattcattc

SEQ ID NO: 6661465 - DNA, 18 bp, Homo sapiens
atattgatattgaaggaa

SEQ ID NO: 6661466 - DNA, 15 bp, Homo sapiens
atattgatccagaaa

SEQ ID NO: 6661467 - DNA, 14 bp, Homo sapiens
atattgatctgtat

SEQ ID NO: 6661468 - DNA, 18 bp, Homo sapiens
atattgatctttttatca

SEQ ID NO: 6661469 - DNA, 21 bp, Homo sapiens
atattgatctttttatcatga

SEQ ID NO: 6661470 - DNA, 20 bp, Homo sapiens
atattgatggagatagtggt

SEQ ID NO: 6661471 - DNA, 14 bp, Homo sapiens
atattgatgtaact

SEQ ID NO: 6661472 - DNA, 18 bp, Homo sapiens
atattgatgtaactgtgt

SEQ ID NO: 6661473 - DNA, 20 bp, Homo sapiens
atattgatgtcagtatttca

SEQ ID NO: 6661474 - DNA, 23 bp, Homo sapiens
atattgatgtcagtatttcaact

SEQ ID NO: 6661475 - DNA, 13 bp, Homo sapiens
atattgatgtgtg

SEQ ID NO: 6661476 - DNA, 17 bp, Homo sapiens
atattgatttaaaattg

SEQ ID NO: 6661477 - DNA, 13 bp, Homo sapiens
atattgatttatt

SEQ ID NO: 6661478 - DNA, 15 bp, Homo sapiens
atattgatttattaa

SEQ ID NO: 6661479 - DNA, 22 bp, Homo sapiens
atattgatttccgttaaaatac

SEQ ID NO: 6661480 - DNA, 14 bp, Homo sapiens
atattgatttctgc

SEQ ID NO: 6661481 - DNA, 20 bp, Homo sapiens
atattgcacatgtcttaatg

SEQ ID NO: 6661482 - DNA, 15 bp, Homo sapiens
atattgcagattgaa

SEQ ID NO: 6661483 - DNA, 20 bp, Homo sapiens
atattgcaggagacattttc

SEQ ID NO: 6661484 - DNA, 20 bp, Homo sapiens
atattgcagtgtgaatgctg

SEQ ID NO: 6661485 - DNA, 17 bp, Homo sapiens
atattgcatttctgtat

SEQ ID NO: 6661486 - DNA, 16 bp, Homo sapiens
atattgccaatgctac

SEQ ID NO: 6661487 - DNA, 23 bp, Homo sapiens
atattgccagtatataagctgtt

SEQ ID NO: 6661488 - DNA, 17 bp, Homo sapiens
atattgcccaggctggt

SEQ ID NO: 6661489 - DNA, 11 bp, Homo sapiens
atattgccttg

SEQ ID NO: 6661490 - DNA, 16 bp, Homo sapiens
atattgctaaaagcat

SEQ ID NO: 6661491 - DNA, 20 bp, Homo sapiens
atattgctaaaagcatgtat

SEQ ID NO: 6661492 - DNA, 19 bp, Homo sapiens
atattgctactataatcaa

SEQ ID NO: 6661493 - DNA, 22 bp, Homo sapiens
atattgctactataatcaaatg

SEQ ID NO: 6661494 - DNA, 20 bp, Homo sapiens
atattgctctatatgtaata

SEQ ID NO: 6661495 - DNA, 12 bp, Homo sapiens
atattgctctta

SEQ ID NO: 6661496 - DNA, 23 bp, Homo sapiens
atattgctcttaaaaatcttggt

SEQ ID NO: 6661497 - DNA, 17 bp, Homo sapiens
atattgctgtatagctc

SEQ ID NO: 6661498 - DNA, 15 bp, Homo sapiens
atattgctgtgtctt

SEQ ID NO: 6661499 - DNA, 23 bp, Homo sapiens
atattgctgtgtcttcattttca

SEQ ID NO: 6661500 - DNA, 18 bp, Homo sapiens
atattgcttagtaagtat

SEQ ID NO: 6661501 - DNA, 17 bp, Homo sapiens
atattgcttatgtctct

SEQ ID NO: 6661502 - DNA, 16 bp, Homo sapiens
atattgcttctccctt

SEQ ID NO: 6661503 - DNA, 14 bp, Homo sapiens
atattgcttggact

SEQ ID NO: 6661504 - DNA, 15 bp, Homo sapiens
atattgcttggacta

SEQ ID NO: 6661505 - DNA, 22 bp, Homo sapiens
atattgcttggactacctataa

SEQ ID NO: 6661506 - DNA, 14 bp, Homo sapiens
atattggaaacata

SEQ ID NO: 6661507 - DNA, 15 bp, Homo sapiens
atattggaagagaga

SEQ ID NO: 6661508 - DNA, 22 bp, Homo sapiens
atattggattgcgcctttgtat

SEQ ID NO: 6661509 - DNA, 16 bp, Homo sapiens
atattgggaaggaaat

SEQ ID NO: 6661510 - DNA, 20 bp, Homo sapiens
atattgggaaggaaatatat

SEQ ID NO: 6661511 - DNA, 15 bp, Homo sapiens
atattgggctcagag

SEQ ID NO: 6661512 - DNA, 18 bp, Homo sapiens
atattgggctcagagagt

SEQ ID NO: 6661513 - DNA, 20 bp, Homo sapiens
atattgggtgtagatttctg

SEQ ID NO: 6661514 - DNA, 21 bp, Homo sapiens
atattggtaattaaaagactc

SEQ ID NO: 6661515 - DNA, 21 bp, Homo sapiens
atattggtatatccttttctg

SEQ ID NO: 6661516 - DNA, 20 bp, Homo sapiens
atattggtattaaagaatgc

SEQ ID NO: 6661517 - DNA, 15 bp, Homo sapiens
atattggtattcact

SEQ ID NO: 6661518 - DNA, 21 bp, Homo sapiens
atattggtgcgtttttacagt

SEQ ID NO: 6661519 - DNA, 22 bp, Homo sapiens
atattggtgcgtttttacagtt

SEQ ID NO: 6661520 - DNA, 16 bp, Homo sapiens
atattggtgtactgta

SEQ ID NO: 6661521 - DNA, 20 bp, Homo sapiens
atattggtgtactgtaatgt

SEQ ID NO: 6661522 - DNA, 15 bp, Homo sapiens
atattggttcttccc

SEQ ID NO: 6661523 - DNA, 20 bp, Homo sapiens
atattggttgggatgacttg

SEQ ID NO: 6661524 - DNA, 15 bp, Homo sapiens
atattggtttgcaca

SEQ ID NO: 6661525 - DNA, 15 bp, Homo sapiens
atattggttttatga

SEQ ID NO: 6661526 - DNA, 19 bp, Homo sapiens
atattggttttatgatgac

SEQ ID NO: 6661527 - DNA, 12 bp, Homo sapiens
atattgtaaata

SEQ ID NO: 6661528 - DNA, 14 bp, Homo sapiens
atattgtaaatact

SEQ ID NO: 6661529 - DNA, 16 bp, Homo sapiens
atattgtaaatactgg

SEQ ID NO: 6661530 - DNA, 14 bp, Homo sapiens
atattgtaaatgct

SEQ ID NO: 6661531 - DNA, 12 bp, Homo sapiens
atattgtaagaa

SEQ ID NO: 6661532 - DNA, 14 bp, Homo sapiens
atattgtaagaaat

SEQ ID NO: 6661533 - DNA, 14 bp, Homo sapiens
atattgtaagtcag

SEQ ID NO: 6661534 - DNA, 16 bp, Homo sapiens
atattgtaatatgaca

SEQ ID NO: 6661535 - DNA, 19 bp, Homo sapiens
atattgtaatctatgttta

SEQ ID NO: 6661536 - DNA, 15 bp, Homo sapiens
atattgtacaaatgt

SEQ ID NO: 6661537 - DNA, 21 bp, Homo sapiens
atattgtacaaatgtaagcaa

SEQ ID NO: 6661538 - DNA, 12 bp, Homo sapiens
atattgtacagt

SEQ ID NO: 6661539 - DNA, 14 bp, Homo sapiens
atattgtacagttt

SEQ ID NO: 6661540 - DNA, 15 bp, Homo sapiens
atattgtagcagtta

SEQ ID NO: 6661541 - DNA, 12 bp, Homo sapiens
atattgtatgta

SEQ ID NO: 6661542 - DNA, 15 bp, Homo sapiens
atattgtattatcat

SEQ ID NO: 6661543 - DNA, 16 bp, Homo sapiens
atattgtattatcata

SEQ ID NO: 6661544 - DNA, 19 bp, Homo sapiens
atattgtattatcatatat

SEQ ID NO: 6661545 - DNA, 17 bp, Homo sapiens
atattgtattgctgctg

SEQ ID NO: 6661546 - DNA, 12 bp, Homo sapiens
atattgtatttt

SEQ ID NO: 6661547 - DNA, 15 bp, Homo sapiens
atattgtattttaga

SEQ ID NO: 6661548 - DNA, 22 bp, Homo sapiens
atattgtattttagatatattc

SEQ ID NO: 6661549 - DNA, 22 bp, Homo sapiens
atattgtcacctagcagatatg

SEQ ID NO: 6661550 - DNA, 21 bp, Homo sapiens
atattgtcatgtttattctaa

SEQ ID NO: 6661551 - DNA, 14 bp, Homo sapiens
atattgtgattctg

SEQ ID NO: 6661552 - DNA, 17 bp, Homo sapiens
atattgtgattctgcct

SEQ ID NO: 6661553 - DNA, 12 bp, Homo sapiens
atattgtgccaa

SEQ ID NO: 6661554 - DNA, 18 bp, Homo sapiens
atattgtgccaatatgta

SEQ ID NO: 6661555 - DNA, 20 bp, Homo sapiens
atattgtgccaatatgtatt

SEQ ID NO: 6661556 - DNA, 21 bp, Homo sapiens
atattgtgccaatatgtattg

SEQ ID NO: 6661557 - DNA, 17 bp, Homo sapiens
atattgtgcttactcaa

SEQ ID NO: 6661558 - DNA, 19 bp, Homo sapiens
atattgtgggtgttaattt

SEQ ID NO: 6661559 - DNA, 21 bp, Homo sapiens
atattgtgggtgttaattttt

SEQ ID NO: 6661560 - DNA, 17 bp, Homo sapiens
atattgtgtaaatatta

SEQ ID NO: 6661561 - DNA, 21 bp, Homo sapiens
atattgtgtaatttaagtgac

SEQ ID NO: 6661562 - DNA, 20 bp, Homo sapiens
atattgtgttgactttataa

SEQ ID NO: 6661563 - DNA, 17 bp, Homo sapiens
atattgtgttgtgaatg

SEQ ID NO: 6661564 - DNA, 13 bp, Homo sapiens
atattgtgtttgt

SEQ ID NO: 6661565 - DNA, 21 bp, Homo sapiens
atattgtgtttgtgtatttac

SEQ ID NO: 6661566 - DNA, 14 bp, Homo sapiens
atattgtgttttaa

SEQ ID NO: 6661567 - DNA, 17 bp, Homo sapiens
atattgtgttttaacac

SEQ ID NO: 6661568 - DNA, 20 bp, Homo sapiens
atattgtgttttaacaccaa

SEQ ID NO: 6661569 - DNA, 14 bp, Homo sapiens
atattgttactaga

SEQ ID NO: 6661570 - DNA, 13 bp, Homo sapiens
atattgttgacaa

SEQ ID NO: 6661571 - DNA, 15 bp, Homo sapiens
atattgttgacaact

SEQ ID NO: 6661572 - DNA, 21 bp, Homo sapiens
atattgttgacaactgtgact

SEQ ID NO: 6661573 - DNA, 16 bp, Homo sapiens
atattgttgcattgct

SEQ ID NO: 6661574 - DNA, 12 bp, Homo sapiens
atattgtttaaa

SEQ ID NO: 6661575 - DNA, 23 bp, Homo sapiens
atattgtttaatcagttctgtgt

SEQ ID NO: 6661576 - DNA, 14 bp, Homo sapiens
atattgtttctgca

SEQ ID NO: 6661577 - DNA, 18 bp, Homo sapiens
atattgtttctttatcac

SEQ ID NO: 6661578 - DNA, 15 bp, Homo sapiens
atattgtttgctgtt

SEQ ID NO: 6661579 - DNA, 16 bp, Homo sapiens
atattgtttgctgttg

SEQ ID NO: 6661580 - DNA, 19 bp, Homo sapiens
atattgtttggtaaatgtt

SEQ ID NO: 6661581 - DNA, 17 bp, Homo sapiens
atattgttttataaatg

SEQ ID NO: 6661582 - DNA, 20 bp, Homo sapiens
atattgttttctcctttctg

SEQ ID NO: 6661583 - DNA, 17 bp, Homo sapiens
atattgtttttctttct

SEQ ID NO: 6661584 - DNA, 22 bp, Homo sapiens
atattgtttttttatttggcat

SEQ ID NO: 6661585 - DNA, 22 bp, Homo sapiens
atatttaaaaaattaaaaatga

SEQ ID NO: 6661586 - DNA, 17 bp, Homo sapiens
atatttaaaaaattatg

SEQ ID NO: 6661587 - DNA, 13 bp, Homo sapiens
atatttaaaaata

SEQ ID NO: 6661588 - DNA, 16 bp, Homo sapiens
atatttaaaaatgtct

SEQ ID NO: 6661589 - DNA, 18 bp, Homo sapiens
atatttaaaaattgtttc

SEQ ID NO: 6661590 - DNA, 19 bp, Homo sapiens
atatttaaaaattgtttct

SEQ ID NO: 6661591 - DNA, 20 bp, Homo sapiens
atatttaaaaattgtttctt

SEQ ID NO: 6661592 - DNA, 14 bp, Homo sapiens
atatttaaaacttt

SEQ ID NO: 6661593 - DNA, 13 bp, Homo sapiens
atatttaaaatag

SEQ ID NO: 6661594 - DNA, 15 bp, Homo sapiens
atatttaaaattcat

SEQ ID NO: 6661595 - DNA, 14 bp, Homo sapiens
atatttaaacagca

SEQ ID NO: 6661596 - DNA, 16 bp, Homo sapiens
atatttaaagccaaat

SEQ ID NO: 6661597 - DNA, 19 bp, Homo sapiens
atatttaaagggaaattga

SEQ ID NO: 6661598 - DNA, 19 bp, Homo sapiens
atatttaaatgtaaagaca

SEQ ID NO: 6661599 - DNA, 17 bp, Homo sapiens
atatttaacaatgacaa

SEQ ID NO: 6661600 - DNA, 19 bp, Homo sapiens
atatttaacattatttata

SEQ ID NO: 6661601 - DNA, 18 bp, Homo sapiens
atatttaacctatttcca

SEQ ID NO: 6661602 - DNA, 19 bp, Homo sapiens
atatttaacctatttccac

SEQ ID NO: 6661603 - DNA, 15 bp, Homo sapiens
atatttaacttctag

SEQ ID NO: 6661604 - DNA, 21 bp, Homo sapiens
atatttaacttctagttgctc

SEQ ID NO: 6661605 - DNA, 15 bp, Homo sapiens
atatttaagaaaagc

SEQ ID NO: 6661606 - DNA, 18 bp, Homo sapiens
atatttaagaaaagcact

SEQ ID NO: 6661607 - DNA, 23 bp, Homo sapiens
atatttaagaaaagcacttttgt

SEQ ID NO: 6661608 - DNA, 14 bp, Homo sapiens
atatttaagaaaat

SEQ ID NO: 6661609 - DNA, 16 bp, Homo sapiens
atatttaagaaaatac

SEQ ID NO: 6661610 - DNA, 18 bp, Homo sapiens
atatttaagaaaatacaa

SEQ ID NO: 6661611 - DNA, 18 bp, Homo sapiens
atatttaagcaacatctt

SEQ ID NO: 6661612 - DNA, 20 bp, Homo sapiens
atatttaagccttataaacc

SEQ ID NO: 6661613 - DNA, 19 bp, Homo sapiens
atatttaagccttttgtgt

SEQ ID NO: 6661614 - DNA, 19 bp, Homo sapiens
atatttaaggatagtgtga

SEQ ID NO: 6661615 - DNA, 15 bp, Homo sapiens
atatttaagtatata

SEQ ID NO: 6661616 - DNA, 20 bp, Homo sapiens
atatttaagtatatagtata

SEQ ID NO: 6661617 - DNA, 15 bp, Homo sapiens
atatttaagtattca

SEQ ID NO: 6661618 - DNA, 17 bp, Homo sapiens
atatttaatacctttgg

SEQ ID NO: 6661619 - DNA, 17 bp, Homo sapiens
atatttaatatattgaa

SEQ ID NO: 6661620 - DNA, 14 bp, Homo sapiens
atatttaatatgtc

SEQ ID NO: 6661621 - DNA, 19 bp, Homo sapiens
atatttaatgcattaaacc

SEQ ID NO: 6661622 - DNA, 15 bp, Homo sapiens
atatttaatgttgaa

SEQ ID NO: 6661623 - DNA, 20 bp, Homo sapiens
atatttaatgttgaacaaaa

SEQ ID NO: 6661624 - DNA, 22 bp, Homo sapiens
atatttaatgttgaacaaaata

SEQ ID NO: 6661625 - DNA, 13 bp, Homo sapiens
atatttaatgttt

SEQ ID NO: 6661626 - DNA, 15 bp, Homo sapiens
atatttaatgtttta

SEQ ID NO: 6661627 - DNA, 20 bp, Homo sapiens
atatttaatgttttaaatgt

SEQ ID NO: 6661628 - DNA, 13 bp, Homo sapiens
atatttaattgtg

SEQ ID NO: 6661629 - DNA, 14 bp, Homo sapiens
atatttaatttgaa

SEQ ID NO: 6661630 - DNA, 15 bp, Homo sapiens
atatttacatatgaa

SEQ ID NO: 6661631 - DNA, 16 bp, Homo sapiens
atatttacatatgaaa

SEQ ID NO: 6661632 - DNA, 19 bp, Homo sapiens
atatttacatatgaaattt

SEQ ID NO: 6661633 - DNA, 14 bp, Homo sapiens
atatttacattttg

SEQ ID NO: 6661634 - DNA, 13 bp, Homo sapiens
atatttaccaaag

SEQ ID NO: 6661635 - DNA, 21 bp, Homo sapiens
atatttacctgtatttaagat

SEQ ID NO: 6661636 - DNA, 13 bp, Homo sapiens
atatttacctttt

SEQ ID NO: 6661637 - DNA, 14 bp, Homo sapiens
atatttacgtatga

SEQ ID NO: 6661638 - DNA, 23 bp, Homo sapiens
atatttactaagccacaagaaat

SEQ ID NO: 6661639 - DNA, 14 bp, Homo sapiens
atatttactctata

SEQ ID NO: 6661640 - DNA, 19 bp, Homo sapiens
atatttactctttgcaaac

SEQ ID NO: 6661641 - DNA, 16 bp, Homo sapiens
atatttactgctcttt

SEQ ID NO: 6661642 - DNA, 15 bp, Homo sapiens
atatttactgttaga

SEQ ID NO: 6661643 - DNA, 15 bp, Homo sapiens
atatttactgtttat

SEQ ID NO: 6661644 - DNA, 17 bp, Homo sapiens
atatttactgtttataa

SEQ ID NO: 6661645 - DNA, 13 bp, Homo sapiens
atatttactttaa

SEQ ID NO: 6661646 - DNA, 15 bp, Homo sapiens
atatttagaaaattt

SEQ ID NO: 6661647 - DNA, 15 bp, Homo sapiens
atatttagcaaataa

SEQ ID NO: 6661648 - DNA, 14 bp, Homo sapiens
atatttagctccaa

SEQ ID NO: 6661649 - DNA, 20 bp, Homo sapiens
atatttagctctgtggaatt

SEQ ID NO: 6661650 - DNA, 15 bp, Homo sapiens
atatttagctgtttt

SEQ ID NO: 6661651 - DNA, 16 bp, Homo sapiens
atatttaggaaattca

SEQ ID NO: 6661652 - DNA, 18 bp, Homo sapiens
atatttaggatttgtgtt

SEQ ID NO: 6661653 - DNA, 18 bp, Homo sapiens
atatttagtaacttctgt

SEQ ID NO: 6661654 - DNA, 16 bp, Homo sapiens
atatttataaaaataa

SEQ ID NO: 6661655 - DNA, 13 bp, Homo sapiens
atatttataaatg

SEQ ID NO: 6661656 - DNA, 17 bp, Homo sapiens
atatttataaatgagca

SEQ ID NO: 6661657 - DNA, 11 bp, Homo sapiens
atatttataac

SEQ ID NO: 6661658 - DNA, 13 bp, Homo sapiens
atatttataactc

SEQ ID NO: 6661659 - DNA, 21 bp, Homo sapiens
atatttataactcatcataaa

SEQ ID NO: 6661660 - DNA, 23 bp, Homo sapiens
atatttataactcatcataaaat

SEQ ID NO: 6661661 - DNA, 13 bp, Homo sapiens
atatttataatta

SEQ ID NO: 6661662 - DNA, 15 bp, Homo sapiens
atatttataattaaa

SEQ ID NO: 6661663 - DNA, 22 bp, Homo sapiens
atatttataattaaagaaaatt

SEQ ID NO: 6661664 - DNA, 15 bp, Homo sapiens
atatttatatattta

SEQ ID NO: 6661665 - DNA, 12 bp, Homo sapiens
atatttatattg

SEQ ID NO: 6661666 - DNA, 20 bp, Homo sapiens
atatttatattgtatattct

SEQ ID NO: 6661667 - DNA, 20 bp, Homo sapiens
atatttatccaaaatgtgta

SEQ ID NO: 6661668 - DNA, 14 bp, Homo sapiens
atatttatccacta

SEQ ID NO: 6661669 - DNA, 14 bp, Homo sapiens
atatttatgaagaa

SEQ ID NO: 6661670 - DNA, 15 bp, Homo sapiens
atatttatgaagaaa

SEQ ID NO: 6661671 - DNA, 21 bp, Homo sapiens
atatttatgaagaaaatactt

SEQ ID NO: 6661672 - DNA, 22 bp, Homo sapiens
atatttatgactttcacatttg

SEQ ID NO: 6661673 - DNA, 18 bp, Homo sapiens
atatttatgcttaaaata

SEQ ID NO: 6661674 - DNA, 19 bp, Homo sapiens
atatttatgcttaaaatat

SEQ ID NO: 6661675 - DNA, 19 bp, Homo sapiens
atatttatgttgttgaact

SEQ ID NO: 6661676 - DNA, 18 bp, Homo sapiens
atatttattaaataaaat

SEQ ID NO: 6661677 - DNA, 22 bp, Homo sapiens
atatttattaaataaaatcaat

SEQ ID NO: 6661678 - DNA, 22 bp, Homo sapiens
atatttattactgtaagaaaat

SEQ ID NO: 6661679 - DNA, 14 bp, Homo sapiens
atatttattatgag

SEQ ID NO: 6661680 - DNA, 23 bp, Homo sapiens
atatttattcattatttgtcaaa

SEQ ID NO: 6661681 - DNA, 13 bp, Homo sapiens
atatttattgact

SEQ ID NO: 6661682 - DNA, 15 bp, Homo sapiens
atatttattgagtgc

SEQ ID NO: 6661683 - DNA, 13 bp, Homo sapiens
atatttattgatt

SEQ ID NO: 6661684 - DNA, 21 bp, Homo sapiens
atatttattgcattgctggta

SEQ ID NO: 6661685 - DNA, 13 bp, Homo sapiens
atatttattggat

SEQ ID NO: 6661686 - DNA, 19 bp, Homo sapiens
atatttattgtgcattaaa

SEQ ID NO: 6661687 - DNA, 22 bp, Homo sapiens
atatttatttaaacaaatgtgt

SEQ ID NO: 6661688 - DNA, 13 bp, Homo sapiens
atatttatttatg

SEQ ID NO: 6661689 - DNA, 14 bp, Homo sapiens
atatttatttatgt

SEQ ID NO: 6661690 - DNA, 15 bp, Homo sapiens
atatttatttatgta

SEQ ID NO: 6661691 - DNA, 17 bp, Homo sapiens
atatttatttatttatt

SEQ ID NO: 6661692 - DNA, 17 bp, Homo sapiens
atatttatttcctgcta

SEQ ID NO: 6661693 - DNA, 17 bp, Homo sapiens
atatttattttaataat

SEQ ID NO: 6661694 - DNA, 21 bp, Homo sapiens
atatttattttctttctgtaa

SEQ ID NO: 6661695 - DNA, 23 bp, Homo sapiens
atatttatttttacctgcttttt

SEQ ID NO: 6661696 - DNA, 18 bp, Homo sapiens
atatttatttttttaagc

SEQ ID NO: 6661697 - DNA, 13 bp, Homo sapiens
atatttcaaatga

SEQ ID NO: 6661698 - DNA, 13 bp, Homo sapiens
atatttcaagaca

SEQ ID NO: 6661699 - DNA, 20 bp, Homo sapiens
atatttcaagctcatgtcat

SEQ ID NO: 6661700 - DNA, 17 bp, Homo sapiens
atatttcaagtacactg

SEQ ID NO: 6661701 - DNA, 15 bp, Homo sapiens
atatttcaagtgcct

SEQ ID NO: 6661702 - DNA, 21 bp, Homo sapiens
atatttcaataaatgatatat

SEQ ID NO: 6661703 - DNA, 15 bp, Homo sapiens
atatttcacttttgt

SEQ ID NO: 6661704 - DNA, 21 bp, Homo sapiens
atatttcacttttgttctgct

SEQ ID NO: 6661705 - DNA, 14 bp, Homo sapiens
atatttcagatatc

SEQ ID NO: 6661706 - DNA, 18 bp, Homo sapiens
atatttcagatgtaatgt

SEQ ID NO: 6661707 - DNA, 21 bp, Homo sapiens
atatttcagatgtaatgtttt

SEQ ID NO: 6661708 - DNA, 20 bp, Homo sapiens
atatttcaggttcttcagaa

SEQ ID NO: 6661709 - DNA, 22 bp, Homo sapiens
atatttcagtgatttttagtaa

SEQ ID NO: 6661710 - DNA, 15 bp, Homo sapiens
atatttcagtggaat

SEQ ID NO: 6661711 - DNA, 13 bp, Homo sapiens
atatttcataaat

SEQ ID NO: 6661712 - DNA, 10 bp, Homo sapiens
atatttcatt

SEQ ID NO: 6661713 - DNA, 15 bp, Homo sapiens
atatttcattgaata

SEQ ID NO: 6661714 - DNA, 13 bp, Homo sapiens
atatttcatttta

SEQ ID NO: 6661715 - DNA, 15 bp, Homo sapiens
atatttcattttaac

SEQ ID NO: 6661716 - DNA, 13 bp, Homo sapiens
atatttccaagaa

SEQ ID NO: 6661717 - DNA, 17 bp, Homo sapiens
atatttccaatgtgaaa

SEQ ID NO: 6661718 - DNA, 21 bp, Homo sapiens
atatttccatatggattttct

SEQ ID NO: 6661719 - DNA, 21 bp, Homo sapiens
atatttcccatgatttcatgt

SEQ ID NO: 6661720 - DNA, 19 bp, Homo sapiens
atatttccctaaaatacat

SEQ ID NO: 6661721 - DNA, 20 bp, Homo sapiens
atatttccctaaaatacatt

SEQ ID NO: 6661722 - DNA, 21 bp, Homo sapiens
atatttccctgaaggaaccaa

SEQ ID NO: 6661723 - DNA, 10 bp, Homo sapiens
atatttccta

SEQ ID NO: 6661724 - DNA, 17 bp, Homo sapiens
atatttcctaaggcatg

SEQ ID NO: 6661725 - DNA, 23 bp, Homo sapiens
atatttcctaaggcatgtggcct

SEQ ID NO: 6661726 - DNA, 21 bp, Homo sapiens
atatttcctataccatttccg

SEQ ID NO: 6661727 - DNA, 22 bp, Homo sapiens
atatttcctataccatttccgt

SEQ ID NO: 6661728 - DNA, 23 bp, Homo sapiens
atatttcctataccatttccgta

SEQ ID NO: 6661729 - DNA, 15 bp, Homo sapiens
atatttcctgtattg

SEQ ID NO: 6661730 - DNA, 23 bp, Homo sapiens
atatttccttcaccacctcatgt

SEQ ID NO: 6661731 - DNA, 18 bp, Homo sapiens
atatttcctttatgtgaa

SEQ ID NO: 6661732 - DNA, 21 bp, Homo sapiens
atatttccttttgtaaagtaa

SEQ ID NO: 6661733 - DNA, 19 bp, Homo sapiens
atatttcgaccctggggcg

SEQ ID NO: 6661734 - DNA, 21 bp, Homo sapiens
atatttctacagagaaaatga

SEQ ID NO: 6661735 - DNA, 16 bp, Homo sapiens
atatttctatgtaaat

SEQ ID NO: 6661736 - DNA, 21 bp, Homo sapiens
atatttctcataatgtgaaat

SEQ ID NO: 6661737 - DNA, 13 bp, Homo sapiens
atatttctcatct

SEQ ID NO: 6661738 - DNA, 18 bp, Homo sapiens
atatttctgtatatttgt

SEQ ID NO: 6661739 - DNA, 20 bp, Homo sapiens
atatttctgtatatttgtca

SEQ ID NO: 6661740 - DNA, 12 bp, Homo sapiens
atatttctgttg

SEQ ID NO: 6661741 - DNA, 12 bp, Homo sapiens
atatttcttaag

SEQ ID NO: 6661742 - DNA, 13 bp, Homo sapiens
atatttcttaagt

SEQ ID NO: 6661743 - DNA, 12 bp, Homo sapiens
atatttcttcaa

SEQ ID NO: 6661744 - DNA, 18 bp, Homo sapiens
atatttcttcaaatatct

SEQ ID NO: 6661745 - DNA, 19 bp, Homo sapiens
atatttcttcaagtgagtg

SEQ ID NO: 6661746 - DNA, 23 bp, Homo sapiens
atatttcttcaagtgagtggcat

SEQ ID NO: 6661747 - DNA, 19 bp, Homo sapiens
atatttctttttagattgt

SEQ ID NO: 6661748 - DNA, 12 bp, Homo sapiens
atatttgaaaaa

SEQ ID NO: 6661749 - DNA, 22 bp, Homo sapiens
atatttgaaaaaattaaaatct

SEQ ID NO: 6661750 - DNA, 23 bp, Homo sapiens
atatttgaaactgctaattacac

SEQ ID NO: 6661751 - DNA, 14 bp, Homo sapiens
atatttgaaagaag

SEQ ID NO: 6661752 - DNA, 15 bp, Homo sapiens
atatttgaaagaagt

SEQ ID NO: 6661753 - DNA, 15 bp, Homo sapiens
atatttgaaatagta

SEQ ID NO: 6661754 - DNA, 14 bp, Homo sapiens
atatttgaaatatt

SEQ ID NO: 6661755 - DNA, 22 bp, Homo sapiens
atatttgaagcagctctgcctt

SEQ ID NO: 6661756 - DNA, 14 bp, Homo sapiens
atatttgaagggtc

SEQ ID NO: 6661757 - DNA, 17 bp, Homo sapiens
atatttgaatatcatta

SEQ ID NO: 6661758 - DNA, 16 bp, Homo sapiens
atatttgaatgaaaac

SEQ ID NO: 6661759 - DNA, 12 bp, Homo sapiens
atatttgaattg

SEQ ID NO: 6661760 - DNA, 17 bp, Homo sapiens
atatttgaattgacagg

SEQ ID NO: 6661761 - DNA, 17 bp, Homo sapiens
atatttgaattggcctg

SEQ ID NO: 6661762 - DNA, 19 bp, Homo sapiens
atatttgacattcttcact

SEQ ID NO: 6661763 - DNA, 16 bp, Homo sapiens
atatttgactctttca

SEQ ID NO: 6661764 - DNA, 20 bp, Homo sapiens
atatttgactctttcaaaga

SEQ ID NO: 6661765 - DNA, 21 bp, Homo sapiens
atatttgactctttcaaagaa

SEQ ID NO: 6661766 - DNA, 16 bp, Homo sapiens
atatttgacttgcatg

SEQ ID NO: 6661767 - DNA, 20 bp, Homo sapiens
atatttgacttgcatgaaga

SEQ ID NO: 6661768 - DNA, 14 bp, Homo sapiens
atatttgagaataa

SEQ ID NO: 6661769 - DNA, 23 bp, Homo sapiens
atatttgagacggggtctccctg

SEQ ID NO: 6661770 - DNA, 17 bp, Homo sapiens
atatttgagttgtgatt

SEQ ID NO: 6661771 - DNA, 21 bp, Homo sapiens
atatttgagtttctttcagat

SEQ ID NO: 6661772 - DNA, 17 bp, Homo sapiens
atatttgatatttggtt

SEQ ID NO: 6661773 - DNA, 13 bp, Homo sapiens
atatttgatgtag

SEQ ID NO: 6661774 - DNA, 21 bp, Homo sapiens
atatttgattgtaaaaacaaa

SEQ ID NO: 6661775 - DNA, 15 bp, Homo sapiens
atatttgcaataaaa

SEQ ID NO: 6661776 - DNA, 13 bp, Homo sapiens
atatttgcacatg

SEQ ID NO: 6661777 - DNA, 17 bp, Homo sapiens
atatttgcacttatgta

SEQ ID NO: 6661778 - DNA, 22 bp, Homo sapiens
atatttgcacttatgtacttga

SEQ ID NO: 6661779 - DNA, 20 bp, Homo sapiens
atatttgcataatatgcata

SEQ ID NO: 6661780 - DNA, 11 bp, Homo sapiens
atatttgcatt

SEQ ID NO: 6661781 - DNA, 15 bp, Homo sapiens
atatttgccaataaa

SEQ ID NO: 6661782 - DNA, 16 bp, Homo sapiens
atatttgccaataaag

SEQ ID NO: 6661783 - DNA, 18 bp, Homo sapiens
atatttgcgtaaatggtt

SEQ ID NO: 6661784 - DNA, 11 bp, Homo sapiens
atatttgctgc

SEQ ID NO: 6661785 - DNA, 18 bp, Homo sapiens
atatttgctgcaaagaga

SEQ ID NO: 6661786 - DNA, 15 bp, Homo sapiens
atatttgctgtgaag

SEQ ID NO: 6661787 - DNA, 23 bp, Homo sapiens
atatttgctgtgaagggagaaag

SEQ ID NO: 6661788 - DNA, 18 bp, Homo sapiens
atatttgcttatttatat

SEQ ID NO: 6661789 - DNA, 15 bp, Homo sapiens
atatttgctttatac

SEQ ID NO: 6661790 - DNA, 18 bp, Homo sapiens
atatttgctttatactga

SEQ ID NO: 6661791 - DNA, 14 bp, Homo sapiens
atatttggaaagag

SEQ ID NO: 6661792 - DNA, 16 bp, Homo sapiens
atatttggaaagagac

SEQ ID NO: 6661793 - DNA, 21 bp, Homo sapiens
atatttggcttaaatatagtt

SEQ ID NO: 6661794 - DNA, 18 bp, Homo sapiens
atatttggcttatattct

SEQ ID NO: 6661795 - DNA, 17 bp, Homo sapiens
atatttggttatttaat

SEQ ID NO: 6661796 - DNA, 21 bp, Homo sapiens
atatttggtttctagatcact

SEQ ID NO: 6661797 - DNA, 19 bp, Homo sapiens
atatttggttttcctgtat

SEQ ID NO: 6661798 - DNA, 17 bp, Homo sapiens
atatttgtaaaagctaa

SEQ ID NO: 6661799 - DNA, 13 bp, Homo sapiens
atatttgtaaaat

SEQ ID NO: 6661800 - DNA, 15 bp, Homo sapiens
atatttgtaaaatga

SEQ ID NO: 6661801 - DNA, 16 bp, Homo sapiens
atatttgtaaaatgac

SEQ ID NO: 6661802 - DNA, 17 bp, Homo sapiens
atatttgtaaaatgaca

SEQ ID NO: 6661803 - DNA, 15 bp, Homo sapiens
atatttgtaaagcta

SEQ ID NO: 6661804 - DNA, 16 bp, Homo sapiens
atatttgtaacattgt

SEQ ID NO: 6661805 - DNA, 20 bp, Homo sapiens
atatttgtaactttgcatgt

SEQ ID NO: 6661806 - DNA, 22 bp, Homo sapiens
atatttgtaactttgcatgttc

SEQ ID NO: 6661807 - DNA, 15 bp, Homo sapiens
atatttgtaaggctt

SEQ ID NO: 6661808 - DNA, 13 bp, Homo sapiens
atatttgtacaaa

SEQ ID NO: 6661809 - DNA, 14 bp, Homo sapiens
atatttgtacaaaa

SEQ ID NO: 6661810 - DNA, 22 bp, Homo sapiens
atatttgtactgtttaatgttc

SEQ ID NO: 6661811 - DNA, 18 bp, Homo sapiens
atatttgtagctagaata

SEQ ID NO: 6661812 - DNA, 19 bp, Homo sapiens
atatttgtagctagaatat

SEQ ID NO: 6661813 - DNA, 19 bp, Homo sapiens
atatttgtaggtatactat

SEQ ID NO: 6661814 - DNA, 13 bp, Homo sapiens
atatttgtatgat

SEQ ID NO: 6661815 - DNA, 21 bp, Homo sapiens
atatttgtcaacagatttaaa

SEQ ID NO: 6661816 - DNA, 15 bp, Homo sapiens
atatttgtcatgaca

SEQ ID NO: 6661817 - DNA, 16 bp, Homo sapiens
atatttgtctgtgtgc

SEQ ID NO: 6661818 - DNA, 19 bp, Homo sapiens
atatttgtctgtgtgctac

SEQ ID NO: 6661819 - DNA, 16 bp, Homo sapiens
atatttgtcttccgat

SEQ ID NO: 6661820 - DNA, 17 bp, Homo sapiens
atatttgtcttccgatc

SEQ ID NO: 6661821 - DNA, 21 bp, Homo sapiens
atatttgtgaatataatttta

SEQ ID NO: 6661822 - DNA, 22 bp, Homo sapiens
atatttgtgatagcactttcta

SEQ ID NO: 6661823 - DNA, 14 bp, Homo sapiens
atatttgtgcattt

SEQ ID NO: 6661824 - DNA, 14 bp, Homo sapiens
atatttgtgccgta

SEQ ID NO: 6661825 - DNA, 21 bp, Homo sapiens
atatttgtgccgtaattatgt

SEQ ID NO: 6661826 - DNA, 22 bp, Homo sapiens
atatttgtgccgtaattatgta

SEQ ID NO: 6661827 - DNA, 16 bp, Homo sapiens
atatttgtgctttgaa

SEQ ID NO: 6661828 - DNA, 22 bp, Homo sapiens
atatttgtggtttaactttgtg

SEQ ID NO: 6661829 - DNA, 11 bp, Homo sapiens
atatttgtgta

SEQ ID NO: 6661830 - DNA, 15 bp, Homo sapiens
atatttgtgtatgtg

SEQ ID NO: 6661831 - DNA, 21 bp, Homo sapiens
atatttgttaaatatttacat

SEQ ID NO: 6661832 - DNA, 13 bp, Homo sapiens
atatttgttactt

SEQ ID NO: 6661833 - DNA, 23 bp, Homo sapiens
atatttgttactttacttttgct

SEQ ID NO: 6661834 - DNA, 19 bp, Homo sapiens
atatttgttatgataaaag

SEQ ID NO: 6661835 - DNA, 23 bp, Homo sapiens
atatttgttatgataaaaggaag

SEQ ID NO: 6661836 - DNA, 21 bp, Homo sapiens
atatttgtttgggtggtttgt

SEQ ID NO: 6661837 - DNA, 18 bp, Homo sapiens
atattttaaaaaatcaaa

SEQ ID NO: 6661838 - DNA, 20 bp, Homo sapiens
atattttaaaagagaaaaac

SEQ ID NO: 6661839 - DNA, 14 bp, Homo sapiens
atattttaaaatga

SEQ ID NO: 6661840 - DNA, 16 bp, Homo sapiens
atattttaaaatgaga

SEQ ID NO: 6661841 - DNA, 17 bp, Homo sapiens
atattttaaaatttgtt

SEQ ID NO: 6661842 - DNA, 15 bp, Homo sapiens
atattttaaattctc

SEQ ID NO: 6661843 - DNA, 16 bp, Homo sapiens
atattttaacctgcat

SEQ ID NO: 6661844 - DNA, 13 bp, Homo sapiens
atattttaacttt

SEQ ID NO: 6661845 - DNA, 13 bp, Homo sapiens
atattttaagaaa

SEQ ID NO: 6661846 - DNA, 14 bp, Homo sapiens
atattttaagaaag

SEQ ID NO: 6661847 - DNA, 16 bp, Homo sapiens
atattttaagaaagag

SEQ ID NO: 6661848 - DNA, 13 bp, Homo sapiens
atattttaataga

SEQ ID NO: 6661849 - DNA, 15 bp, Homo sapiens
atattttaatttcaa

SEQ ID NO: 6661850 - DNA, 16 bp, Homo sapiens
atattttaatttcaag

SEQ ID NO: 6661851 - DNA, 14 bp, Homo sapiens
atattttacataca

SEQ ID NO: 6661852 - DNA, 12 bp, Homo sapiens
atattttacatc

SEQ ID NO: 6661853 - DNA, 23 bp, Homo sapiens
atattttacattcttggaaagtc

SEQ ID NO: 6661854 - DNA, 12 bp, Homo sapiens
atattttacttg

SEQ ID NO: 6661855 - DNA, 17 bp, Homo sapiens
atattttacttttacag

SEQ ID NO: 6661856 - DNA, 15 bp, Homo sapiens
atattttatactgca

SEQ ID NO: 6661857 - DNA, 16 bp, Homo sapiens
atattttatactgcac

SEQ ID NO: 6661858 - DNA, 20 bp, Homo sapiens
atattttatatgttcatatt

SEQ ID NO: 6661859 - DNA, 17 bp, Homo sapiens
atattttatattaaaat

SEQ ID NO: 6661860 - DNA, 19 bp, Homo sapiens
atattttatcaaggaagtc

SEQ ID NO: 6661861 - DNA, 17 bp, Homo sapiens
atattttatcctgtatt

SEQ ID NO: 6661862 - DNA, 14 bp, Homo sapiens
atattttatctcaa

SEQ ID NO: 6661863 - DNA, 15 bp, Homo sapiens
atattttatgaacat

SEQ ID NO: 6661864 - DNA, 15 bp, Homo sapiens
atattttatgtgaga

SEQ ID NO: 6661865 - DNA, 16 bp, Homo sapiens
atattttattactgtt

SEQ ID NO: 6661866 - DNA, 15 bp, Homo sapiens
atattttattatata

SEQ ID NO: 6661867 - DNA, 12 bp, Homo sapiens
atattttattca

SEQ ID NO: 6661868 - DNA, 16 bp, Homo sapiens
atattttattcaaggt

SEQ ID NO: 6661869 - DNA, 20 bp, Homo sapiens
atattttatttcaatgtaat

SEQ ID NO: 6661870 - DNA, 13 bp, Homo sapiens
atattttatttct

SEQ ID NO: 6661871 - DNA, 16 bp, Homo sapiens
atattttatttctgat

SEQ ID NO: 6661872 - DNA, 20 bp, Homo sapiens
atattttattttcatacttt

SEQ ID NO: 6661873 - DNA, 20 bp, Homo sapiens
atattttatttttagaattt

SEQ ID NO: 6661874 - DNA, 15 bp, Homo sapiens
atattttatttttca

SEQ ID NO: 6661875 - DNA, 15 bp, Homo sapiens
atattttcaaagaga

SEQ ID NO: 6661876 - DNA, 24 bp, Homo sapiens
atattttcaaattgtatctagtgc

SEQ ID NO: 6661877 - DNA, 20 bp, Homo sapiens
atattttcaacgcagccctg

SEQ ID NO: 6661878 - DNA, 18 bp, Homo sapiens
atattttcaagtttttca

SEQ ID NO: 6661879 - DNA, 20 bp, Homo sapiens
atattttcaagtttttcata

SEQ ID NO: 6661880 - DNA, 16 bp, Homo sapiens
atattttcaattcaaa

SEQ ID NO: 6661881 - DNA, 14 bp, Homo sapiens
atattttcagcaaa

SEQ ID NO: 6661882 - DNA, 23 bp, Homo sapiens
atattttcatgacttttccatgt

SEQ ID NO: 6661883 - DNA, 18 bp, Homo sapiens
atattttcattaaaagct

SEQ ID NO: 6661884 - DNA, 16 bp, Homo sapiens
atattttccatgaaaa

SEQ ID NO: 6661885 - DNA, 21 bp, Homo sapiens
atattttccctctcttgcctt

SEQ ID NO: 6661886 - DNA, 20 bp, Homo sapiens
atattttccgtcacttaaat

SEQ ID NO: 6661887 - DNA, 22 bp, Homo sapiens
atattttcctcccagttctaca

SEQ ID NO: 6661888 - DNA, 13 bp, Homo sapiens
atattttcctcct

SEQ ID NO: 6661889 - DNA, 14 bp, Homo sapiens
atattttcctctta

SEQ ID NO: 6661890 - DNA, 21 bp, Homo sapiens
atattttcctttatgtgatgt

SEQ ID NO: 6661891 - DNA, 22 bp, Homo sapiens
atattttctatatttgtaactt

SEQ ID NO: 6661892 - DNA, 19 bp, Homo sapiens
atattttctctaggaaata

SEQ ID NO: 6661893 - DNA, 19 bp, Homo sapiens
atattttctgtatttaatt

SEQ ID NO: 6661894 - DNA, 19 bp, Homo sapiens
atattttctgtgtgttcct

SEQ ID NO: 6661895 - DNA, 12 bp, Homo sapiens
atattttcttaa

SEQ ID NO: 6661896 - DNA, 14 bp, Homo sapiens
atattttctttcta

SEQ ID NO: 6661897 - DNA, 12 bp, Homo sapiens
atattttgaaag

SEQ ID NO: 6661898 - DNA, 22 bp, Homo sapiens
atattttgacccaagtggatat

SEQ ID NO: 6661899 - DNA, 18 bp, Homo sapiens
atattttgagaaactgct

SEQ ID NO: 6661900 - DNA, 23 bp, Homo sapiens
atattttgataataaattgaaat

SEQ ID NO: 6661901 - DNA, 18 bp, Homo sapiens
atattttgataataatat

SEQ ID NO: 6661902 - DNA, 18 bp, Homo sapiens
atattttgatgcagataa

SEQ ID NO: 6661903 - DNA, 19 bp, Homo sapiens
atattttgattattgtatt

SEQ ID NO: 6661904 - DNA, 16 bp, Homo sapiens
atattttgattttaca

SEQ ID NO: 6661905 - DNA, 23 bp, Homo sapiens
atattttgcaagctctggaattg

SEQ ID NO: 6661906 - DNA, 20 bp, Homo sapiens
atattttgccactgcctttc

SEQ ID NO: 6661907 - DNA, 14 bp, Homo sapiens
atattttgctaact

SEQ ID NO: 6661908 - DNA, 14 bp, Homo sapiens
atattttggaaact

SEQ ID NO: 6661909 - DNA, 17 bp, Homo sapiens
atattttggaaactgct

SEQ ID NO: 6661910 - DNA, 21 bp, Homo sapiens
atattttggctcaaataaaat

SEQ ID NO: 6661911 - DNA, 14 bp, Homo sapiens
atattttgtaatat

SEQ ID NO: 6661912 - DNA, 21 bp, Homo sapiens
atattttgtagttaatataaa

SEQ ID NO: 6661913 - DNA, 22 bp, Homo sapiens
atattttgtagttaatataaat

SEQ ID NO: 6661914 - DNA, 20 bp, Homo sapiens
atattttgtatattatgttt

SEQ ID NO: 6661915 - DNA, 21 bp, Homo sapiens
atattttgtatattatgttta

SEQ ID NO: 6661916 - DNA, 22 bp, Homo sapiens
atattttgtatgcaagcagttt

SEQ ID NO: 6661917 - DNA, 22 bp, Homo sapiens
atattttgtattgttaatatct

SEQ ID NO: 6661918 - DNA, 21 bp, Homo sapiens
atattttgtcatatcaaataa

SEQ ID NO: 6661919 - DNA, 13 bp, Homo sapiens
atattttgttacc

SEQ ID NO: 6661920 - DNA, 15 bp, Homo sapiens
atattttgttacctt

SEQ ID NO: 6661921 - DNA, 13 bp, Homo sapiens
atattttgtttct

SEQ ID NO: 6661922 - DNA, 18 bp, Homo sapiens
atattttgtttctttaaa

SEQ ID NO: 6661923 - DNA, 19 bp, Homo sapiens
atatttttaaaaaatgaaa

SEQ ID NO: 6661924 - DNA, 23 bp, Homo sapiens
atatttttaaaagtatacatgtc

SEQ ID NO: 6661925 - DNA, 14 bp, Homo sapiens
atatttttaaagaa

SEQ ID NO: 6661926 - DNA, 17 bp, Homo sapiens
atatttttaaattttgt

SEQ ID NO: 6661927 - DNA, 12 bp, Homo sapiens
atatttttaaca

SEQ ID NO: 6661928 - DNA, 14 bp, Homo sapiens
atatttttaagata

SEQ ID NO: 6661929 - DNA, 16 bp, Homo sapiens
atatttttaagataat

SEQ ID NO: 6661930 - DNA, 20 bp, Homo sapiens
atatttttaagataataata

SEQ ID NO: 6661931 - DNA, 15 bp, Homo sapiens
atatttttaataaaa

SEQ ID NO: 6661932 - DNA, 11 bp, Homo sapiens
atatttttaca

SEQ ID NO: 6661933 - DNA, 19 bp, Homo sapiens
atatttttagactatttct

SEQ ID NO: 6661934 - DNA, 16 bp, Homo sapiens
atatttttagactcat

SEQ ID NO: 6661935 - DNA, 19 bp, Homo sapiens
atatttttatacaagtaat

SEQ ID NO: 6661936 - DNA, 16 bp, Homo sapiens
atatttttatataata

SEQ ID NO: 6661937 - DNA, 16 bp, Homo sapiens
atatttttatatttag

SEQ ID NO: 6661938 - DNA, 18 bp, Homo sapiens
atatttttatatttcctt

SEQ ID NO: 6661939 - DNA, 20 bp, Homo sapiens
atatttttatatttccttta

SEQ ID NO: 6661940 - DNA, 21 bp, Homo sapiens
atatttttatatttcctttat

SEQ ID NO: 6661941 - DNA, 15 bp, Homo sapiens
atatttttatctata

SEQ ID NO: 6661942 - DNA, 16 bp, Homo sapiens
atatttttatctatat

SEQ ID NO: 6661943 - DNA, 14 bp, Homo sapiens
atatttttatcttt

SEQ ID NO: 6661944 - DNA, 14 bp, Homo sapiens
atatttttatgtga

SEQ ID NO: 6661945 - DNA, 16 bp, Homo sapiens
atatttttatgtgaag

SEQ ID NO: 6661946 - DNA, 13 bp, Homo sapiens
atatttttattca

SEQ ID NO: 6661947 - DNA, 16 bp, Homo sapiens
atatttttattcaaac

SEQ ID NO: 6661948 - DNA, 21 bp, Homo sapiens
atatttttattcaaactacct

SEQ ID NO: 6661949 - DNA, 13 bp, Homo sapiens
atatttttcaaaa

SEQ ID NO: 6661950 - DNA, 16 bp, Homo sapiens
atatttttcaaaatca

SEQ ID NO: 6661951 - DNA, 17 bp, Homo sapiens
atatttttcaaaatcaa

SEQ ID NO: 6661952 - DNA, 14 bp, Homo sapiens
atatttttcaaata

SEQ ID NO: 6661953 - DNA, 13 bp, Homo sapiens
atatttttcaacc

SEQ ID NO: 6661954 - DNA, 15 bp, Homo sapiens
atatttttcaaccag

SEQ ID NO: 6661955 - DNA, 17 bp, Homo sapiens
atatttttcacatatct

SEQ ID NO: 6661956 - DNA, 18 bp, Homo sapiens
atatttttcacatatcta

SEQ ID NO: 6661957 - DNA, 21 bp, Homo sapiens
atatttttcatgattttgaaa

SEQ ID NO: 6661958 - DNA, 15 bp, Homo sapiens
atatttttcccagga

SEQ ID NO: 6661959 - DNA, 22 bp, Homo sapiens
atatttttccctgtttgcctat

SEQ ID NO: 6661960 - DNA, 14 bp, Homo sapiens
atatttttctaaag

SEQ ID NO: 6661961 - DNA, 13 bp, Homo sapiens
atatttttctgag

SEQ ID NO: 6661962 - DNA, 14 bp, Homo sapiens
atatttttctgtgt

SEQ ID NO: 6661963 - DNA, 13 bp, Homo sapiens
atatttttcttaa

SEQ ID NO: 6661964 - DNA, 15 bp, Homo sapiens
atatttttcttaaaa

SEQ ID NO: 6661965 - DNA, 19 bp, Homo sapiens
atatttttcttaaaaagta

SEQ ID NO: 6661966 - DNA, 19 bp, Homo sapiens
atatttttgctaggagccc

SEQ ID NO: 6661967 - DNA, 22 bp, Homo sapiens
atatttttggaaccagtaagta

SEQ ID NO: 6661968 - DNA, 10 bp, Homo sapiens
atatttttgt

SEQ ID NO: 6661969 - DNA, 14 bp, Homo sapiens
atatttttgtacat

SEQ ID NO: 6661970 - DNA, 15 bp, Homo sapiens
atatttttgtacata

SEQ ID NO: 6661971 - DNA, 23 bp, Homo sapiens
atatttttgtacgttatatattg

SEQ ID NO: 6661972 - DNA, 13 bp, Homo sapiens
atatttttgtact

SEQ ID NO: 6661973 - DNA, 14 bp, Homo sapiens
atatttttgtactt

SEQ ID NO: 6661974 - DNA, 16 bp, Homo sapiens
atatttttgtacttga

SEQ ID NO: 6661975 - DNA, 21 bp, Homo sapiens
atatttttgtcatgaactgta

SEQ ID NO: 6661976 - DNA, 20 bp, Homo sapiens
atatttttgtctgcagctgt

SEQ ID NO: 6661977 - DNA, 13 bp, Homo sapiens
atatttttgtgaa

SEQ ID NO: 6661978 - DNA, 15 bp, Homo sapiens
atatttttgtttgtt

SEQ ID NO: 6661979 - DNA, 16 bp, Homo sapiens
atatttttgtttgttt

SEQ ID NO: 6661980 - DNA, 20 bp, Homo sapiens
atatttttgtttgttttgtg

SEQ ID NO: 6661981 - DNA, 23 bp, Homo sapiens
atattttttaaaaaacacttgaa

SEQ ID NO: 6661982 - DNA, 15 bp, Homo sapiens
atattttttaaaata

SEQ ID NO: 6661983 - DNA, 15 bp, Homo sapiens
atattttttaaagtc

SEQ ID NO: 6661984 - DNA, 21 bp, Homo sapiens
atattttttaatgtattccct

SEQ ID NO: 6661985 - DNA, 13 bp, Homo sapiens
atattttttacaa

SEQ ID NO: 6661986 - DNA, 16 bp, Homo sapiens
atattttttatcataa

SEQ ID NO: 6661987 - DNA, 13 bp, Homo sapiens
atattttttatga

SEQ ID NO: 6661988 - DNA, 18 bp, Homo sapiens
atattttttcagaaatat

SEQ ID NO: 6661989 - DNA, 14 bp, Homo sapiens
atattttttctgta

SEQ ID NO: 6661990 - DNA, 17 bp, Homo sapiens
atattttttgaaggttt

SEQ ID NO: 6661991 - DNA, 22 bp, Homo sapiens
atattttttgatggaaaaagaa

SEQ ID NO: 6661992 - DNA, 13 bp, Homo sapiens
atattttttgctc

SEQ ID NO: 6661993 - DNA, 22 bp, Homo sapiens
atatttttttaacctaatatca

SEQ ID NO: 6661994 - DNA, 14 bp, Homo sapiens
atatttttttaact

SEQ ID NO: 6661995 - DNA, 17 bp, Homo sapiens
atatttttttaacttta

SEQ ID NO: 6661996 - DNA, 17 bp, Homo sapiens
atatttttttaagtctt

SEQ ID NO: 6661997 - DNA, 21 bp, Homo sapiens
atatttttttcaactgccaat

SEQ ID NO: 6661998 - DNA, 15 bp, Homo sapiens
atatttttttcctta

SEQ ID NO: 6661999 - DNA, 17 bp, Homo sapiens
atatttttttccttaca

SEQ ID NO: 6662000 - DNA, 18 bp, Homo sapiens
atatttttttccttacat

SEQ ID NO: 6662001 - DNA, 22 bp, Homo sapiens
atatttttttcctttgcattca

SEQ ID NO: 6662002 - DNA, 16 bp, Homo sapiens
atatttttttctaaga

SEQ ID NO: 6662003 - DNA, 14 bp, Homo sapiens
atatttttttctag

SEQ ID NO: 6662004 - DNA, 17 bp, Homo sapiens
atatttttttctagcta

SEQ ID NO: 6662005 - DNA, 14 bp, Homo sapiens
atatttttttctga

SEQ ID NO: 6662006 - DNA, 16 bp, Homo sapiens
atatttttttctgaaa

SEQ ID NO: 6662007 - DNA, 15 bp, Homo sapiens
atatttttttctgta

SEQ ID NO: 6662008 - DNA, 17 bp, Homo sapiens
atatttttttctgtaaa

SEQ ID NO: 6662009 - DNA, 20 bp, Homo sapiens
atatttttttctttctttgt

SEQ ID NO: 6662010 - DNA, 19 bp, Homo sapiens
atatttttttctttttaaa

SEQ ID NO: 6662011 - DNA, 22 bp, Homo sapiens
atatttttttctttttaaaata

SEQ ID NO: 6662012 - DNA, 22 bp, Homo sapiens
atatttttttttggatgaaggt

SEQ ID NO: 6662013 - DNA, 13 bp, Homo sapiens
atcaaaaaacaag

SEQ ID NO: 6662014 - DNA, 14 bp, Homo sapiens
atcaaaaaacagaa

SEQ ID NO: 6662015 - DNA, 18 bp, Homo sapiens
atcaaaaaacagaaaaac

SEQ ID NO: 6662016 - DNA, 19 bp, Homo sapiens
atcaaaaaaggcagttacc

SEQ ID NO: 6662017 - DNA, 19 bp, Homo sapiens
atcaaaaaatgtttttcaa

SEQ ID NO: 6662018 - DNA, 16 bp, Homo sapiens
atcaaaaaggcttata

SEQ ID NO: 6662019 - DNA, 23 bp, Homo sapiens
atcaaaaaggcttataaaacaga

SEQ ID NO: 6662020 - DNA, 17 bp, Homo sapiens
atcaaaaataaactagt

SEQ ID NO: 6662021 - DNA, 20 bp, Homo sapiens
atcaaaacacactactacct

SEQ ID NO: 6662022 - DNA, 17 bp, Homo sapiens
atcaaaacatatcaatt

SEQ ID NO: 6662023 - DNA, 17 bp, Homo sapiens
atcaaaacctgcgcagt

SEQ ID NO: 6662024 - DNA, 17 bp, Homo sapiens
atcaaaacctgtgccag

SEQ ID NO: 6662025 - DNA, 20 bp, Homo sapiens
atcaaaaccttccttccctg

SEQ ID NO: 6662026 - DNA, 19 bp, Homo sapiens
atcaaaactcacaagtgct

SEQ ID NO: 6662027 - DNA, 20 bp, Homo sapiens
atcaaaactctatcaaatgt

SEQ ID NO: 6662028 - DNA, 14 bp, Homo sapiens
atcaaaagaaagaa

SEQ ID NO: 6662029 - DNA, 22 bp, Homo sapiens
atcaaaagaagcctagaaaaga

SEQ ID NO: 6662030 - DNA, 13 bp, Homo sapiens
atcaaaagacaat

SEQ ID NO: 6662031 - DNA, 16 bp, Homo sapiens
atcaaaagacaattct

SEQ ID NO: 6662032 - DNA, 17 bp, Homo sapiens
atcaaaagacaattctt

SEQ ID NO: 6662033 - DNA, 19 bp, Homo sapiens
atcaaaagattaacaacac

SEQ ID NO: 6662034 - DNA, 19 bp, Homo sapiens
atcaaaagctgcttgacta

SEQ ID NO: 6662035 - DNA, 14 bp, Homo sapiens
atcaaaataaaaag

SEQ ID NO: 6662036 - DNA, 20 bp, Homo sapiens
atcaaaataggatttcttaa

SEQ ID NO: 6662037 - DNA, 21 bp, Homo sapiens
atcaaaataggatttcttaaa

SEQ ID NO: 6662038 - DNA, 22 bp, Homo sapiens
atcaaaatcactatctttctga

SEQ ID NO: 6662039 - DNA, 17 bp, Homo sapiens
atcaaaatcatggatct

SEQ ID NO: 6662040 - DNA, 16 bp, Homo sapiens
atcaaaatctctccac

SEQ ID NO: 6662041 - DNA, 21 bp, Homo sapiens
atcaaaatctgtagagcaggg

SEQ ID NO: 6662042 - DNA, 13 bp, Homo sapiens
atcaaaatgcttt

SEQ ID NO: 6662043 - DNA, 16 bp, Homo sapiens
atcaaacaaatcattt

SEQ ID NO: 6662044 - DNA, 11 bp, Homo sapiens
atcaaacaacc

SEQ ID NO: 6662045 - DNA, 19 bp, Homo sapiens
atcaaacacaacacaagaa

SEQ ID NO: 6662046 - DNA, 15 bp, Homo sapiens
atcaaacattttgaa

SEQ ID NO: 6662047 - DNA, 16 bp, Homo sapiens
atcaaacattttgaaa

SEQ ID NO: 6662048 - DNA, 17 bp, Homo sapiens
atcaaaccaaagagtat

SEQ ID NO: 6662049 - DNA, 22 bp, Homo sapiens
atcaaaccaaagagtattcagt

SEQ ID NO: 6662050 - DNA, 22 bp, Homo sapiens
atcaaacccggcggtcccctcc

SEQ ID NO: 6662051 - DNA, 18 bp, Homo sapiens
atcaaaccctagccttgc

SEQ ID NO: 6662052 - DNA, 15 bp, Homo sapiens
atcaaactgaagcca

SEQ ID NO: 6662053 - DNA, 17 bp, Homo sapiens
atcaaactgaagccaga

SEQ ID NO: 6662054 - DNA, 20 bp, Homo sapiens
atcaaactttcagctttttt

SEQ ID NO: 6662055 - DNA, 16 bp, Homo sapiens
atcaaagaaaaacaat

SEQ ID NO: 6662056 - DNA, 14 bp, Homo sapiens
atcaaagaaaacat

SEQ ID NO: 6662057 - DNA, 23 bp, Homo sapiens
atcaaagaaaagacttttgttga

SEQ ID NO: 6662058 - DNA, 14 bp, Homo sapiens
atcaaagaattaca

SEQ ID NO: 6662059 - DNA, 16 bp, Homo sapiens
atcaaagaattacagt

SEQ ID NO: 6662060 - DNA, 17 bp, Homo sapiens
atcaaagaattacagta

SEQ ID NO: 6662061 - DNA, 18 bp, Homo sapiens
atcaaagaattacagtac

SEQ ID NO: 6662062 - DNA, 16 bp, Homo sapiens
atcaaagacacacagg

SEQ ID NO: 6662063 - DNA, 15 bp, Homo sapiens
atcaaagacatttca

SEQ ID NO: 6662064 - DNA, 18 bp, Homo sapiens
atcaaagactccgagaag

SEQ ID NO: 6662065 - DNA, 15 bp, Homo sapiens
atcaaagagaagatg

SEQ ID NO: 6662066 - DNA, 15 bp, Homo sapiens
atcaaagagcacttg

SEQ ID NO: 6662067 - DNA, 19 bp, Homo sapiens
atcaaagaggttttaaaaa

SEQ ID NO: 6662068 - DNA, 12 bp, Homo sapiens
atcaaagatgaa

SEQ ID NO: 6662069 - DNA, 15 bp, Homo sapiens
atcaaagattgaaca

SEQ ID NO: 6662070 - DNA, 14 bp, Homo sapiens
atcaaagcaagggc

SEQ ID NO: 6662071 - DNA, 15 bp, Homo sapiens
atcaaagcaagggct

SEQ ID NO: 6662072 - DNA, 15 bp, Homo sapiens
atcaaagcaatgcat

SEQ ID NO: 6662073 - DNA, 16 bp, Homo sapiens
atcaaagcaatgcatt

SEQ ID NO: 6662074 - DNA, 17 bp, Homo sapiens
atcaaagcaatgcattt

SEQ ID NO: 6662075 - DNA, 17 bp, Homo sapiens
atcaaagcatagatgtt

SEQ ID NO: 6662076 - DNA, 14 bp, Homo sapiens
atcaaagccacact

SEQ ID NO: 6662077 - DNA, 11 bp, Homo sapiens
atcaaagccct

SEQ ID NO: 6662078 - DNA, 12 bp, Homo sapiens
atcaaagccctc

SEQ ID NO: 6662079 - DNA, 19 bp, Homo sapiens
atcaaagccggcctgagaa

SEQ ID NO: 6662080 - DNA, 23 bp, Homo sapiens
atcaaagccggcctgagaaacac

SEQ ID NO: 6662081 - DNA, 13 bp, Homo sapiens
atcaaagcctggc

SEQ ID NO: 6662082 - DNA, 10 bp, Homo sapiens
atcaaagcta

SEQ ID NO: 6662083 - DNA, 13 bp, Homo sapiens
atcaaagctacct

SEQ ID NO: 6662084 - DNA, 14 bp, Homo sapiens
atcaaagctacctt

SEQ ID NO: 6662085 - DNA, 20 bp, Homo sapiens
atcaaagctaggaaaggcag

SEQ ID NO: 6662086 - DNA, 21 bp, Homo sapiens
atcaaaggaaaatagtaatgt

SEQ ID NO: 6662087 - DNA, 16 bp, Homo sapiens
atcaaaggaatataag

SEQ ID NO: 6662088 - DNA, 12 bp, Homo sapiens
atcaaaggacac

SEQ ID NO: 6662089 - DNA, 21 bp, Homo sapiens
atcaaaggcagaaaggagatc

SEQ ID NO: 6662090 - DNA, 22 bp, Homo sapiens
atcaaagtcattaaagacagga

SEQ ID NO: 6662091 - DNA, 11 bp, Homo sapiens
atcaaagtgct

SEQ ID NO: 6662092 - DNA, 19 bp, Homo sapiens
atcaaagtggtaaatactg

SEQ ID NO: 6662093 - DNA, 14 bp, Homo sapiens
atcaaagtgtttaa

SEQ ID NO: 6662094 - DNA, 15 bp, Homo sapiens
atcaaagttctgctt

SEQ ID NO: 6662095 - DNA, 19 bp, Homo sapiens
atcaaataaaaattctaga

SEQ ID NO: 6662096 - DNA, 21 bp, Homo sapiens
atcaaataaaatatcataaag

SEQ ID NO: 6662097 - DNA, 15 bp, Homo sapiens
atcaaataaagagag

SEQ ID NO: 6662098 - DNA, 17 bp, Homo sapiens
atcaaataaagagagaa

SEQ ID NO: 6662099 - DNA, 14 bp, Homo sapiens
atcaaataaatttc

SEQ ID NO: 6662100 - DNA, 17 bp, Homo sapiens
atcaaataaatttctgg

SEQ ID NO: 6662101 - DNA, 17 bp, Homo sapiens
atcaaataagtatttat

SEQ ID NO: 6662102 - DNA, 18 bp, Homo sapiens
atcaaataagtatttata

SEQ ID NO: 6662103 - DNA, 15 bp, Homo sapiens
atcaaataatattca

SEQ ID NO: 6662104 - DNA, 14 bp, Homo sapiens
atcaaatacattta

SEQ ID NO: 6662105 - DNA, 15 bp, Homo sapiens
atcaaatactcattt

SEQ ID NO: 6662106 - DNA, 13 bp, Homo sapiens
atcaaatacttta

SEQ ID NO: 6662107 - DNA, 14 bp, Homo sapiens
atcaaatactttaa

SEQ ID NO: 6662108 - DNA, 15 bp, Homo sapiens
atcaaatactttaaa

SEQ ID NO: 6662109 - DNA, 21 bp, Homo sapiens
atcaaatactttaaaggaaaa

SEQ ID NO: 6662110 - DNA, 14 bp, Homo sapiens
atcaaatatagaaa

SEQ ID NO: 6662111 - DNA, 17 bp, Homo sapiens
atcaaatatattattta

SEQ ID NO: 6662112 - DNA, 22 bp, Homo sapiens
atcaaatatattcagcctggct

SEQ ID NO: 6662113 - DNA, 17 bp, Homo sapiens
atcaaatatgcaaagca

SEQ ID NO: 6662114 - DNA, 13 bp, Homo sapiens
atcaaatattaga

SEQ ID NO: 6662115 - DNA, 18 bp, Homo sapiens
atcaaatattagatgtga

SEQ ID NO: 6662116 - DNA, 12 bp, Homo sapiens
atcaaatcaact

SEQ ID NO: 6662117 - DNA, 23 bp, Homo sapiens
atcaaatcattcaaaactttcag

SEQ ID NO: 6662118 - DNA, 14 bp, Homo sapiens
atcaaatctcctgc

SEQ ID NO: 6662119 - DNA, 17 bp, Homo sapiens
atcaaatctcctgctga

SEQ ID NO: 6662120 - DNA, 17 bp, Homo sapiens
atcaaatctgtatatgt

SEQ ID NO: 6662121 - DNA, 23 bp, Homo sapiens
atcaaatgaatgattaaattatg

SEQ ID NO: 6662122 - DNA, 14 bp, Homo sapiens
atcaaatgatttca

SEQ ID NO: 6662123 - DNA, 16 bp, Homo sapiens
atcaaatgatttcata

SEQ ID NO: 6662124 - DNA, 21 bp, Homo sapiens
atcaaatgccttcatgaatct

SEQ ID NO: 6662125 - DNA, 17 bp, Homo sapiens
atcaaatggtatctttt

SEQ ID NO: 6662126 - DNA, 13 bp, Homo sapiens
atcaaatgtaaat

SEQ ID NO: 6662127 - DNA, 15 bp, Homo sapiens
atcaaatgtatgtat

SEQ ID NO: 6662128 - DNA, 16 bp, Homo sapiens
atcaaatgttacagtt

SEQ ID NO: 6662129 - DNA, 13 bp, Homo sapiens
atcaaatgtttaa

SEQ ID NO: 6662130 - DNA, 16 bp, Homo sapiens
atcaaatgtttaatca

SEQ ID NO: 6662131 - DNA, 16 bp, Homo sapiens
atcaaattaattgtgt

SEQ ID NO: 6662132 - DNA, 14 bp, Homo sapiens
atcaaattcaataa

SEQ ID NO: 6662133 - DNA, 17 bp, Homo sapiens
atcaaattctgtctggg

SEQ ID NO: 6662134 - DNA, 20 bp, Homo sapiens
atcaaatttcacgtcgtctt

SEQ ID NO: 6662135 - DNA, 17 bp, Homo sapiens
atcaaatttgccaccac

SEQ ID NO: 6662136 - DNA, 22 bp, Homo sapiens
atcaaatttgccatgacatttc

SEQ ID NO: 6662137 - DNA, 23 bp, Homo sapiens
atcaaatttgccatgacatttca

SEQ ID NO: 6662138 - DNA, 15 bp, Homo sapiens
atcaaatttttctgg

SEQ ID NO: 6662139 - DNA, 15 bp, Homo sapiens
atcaacaaagaaata

SEQ ID NO: 6662140 - DNA, 15 bp, Homo sapiens
atcaacaagatttcc

SEQ ID NO: 6662141 - DNA, 16 bp, Homo sapiens
atcaacaagatttcca

SEQ ID NO: 6662142 - DNA, 17 bp, Homo sapiens
atcaacaataaaatttt

SEQ ID NO: 6662143 - DNA, 17 bp, Homo sapiens
atcaacaatgattttct

SEQ ID NO: 6662144 - DNA, 16 bp, Homo sapiens
atcaacacacatttta

SEQ ID NO: 6662145 - DNA, 22 bp, Homo sapiens
atcaacaccaccgagctctgtg

SEQ ID NO: 6662146 - DNA, 19 bp, Homo sapiens
atcaacactgcagcatttt

SEQ ID NO: 6662147 - DNA, 15 bp, Homo sapiens
atcaacacttttctc

SEQ ID NO: 6662148 - DNA, 18 bp, Homo sapiens
atcaacagacctaagaaa

SEQ ID NO: 6662149 - DNA, 21 bp, Homo sapiens
atcaacaggagggcagcccgt

SEQ ID NO: 6662150 - DNA, 15 bp, Homo sapiens
atcaacatctcttga

SEQ ID NO: 6662151 - DNA, 17 bp, Homo sapiens
atcaacatgttattcaa

SEQ ID NO: 6662152 - DNA, 15 bp, Homo sapiens
atcaacattcttgtg

SEQ ID NO: 6662153 - DNA, 13 bp, Homo sapiens
atcaaccaaagtt

SEQ ID NO: 6662154 - DNA, 23 bp, Homo sapiens
atcaaccacctatttttgacatg

SEQ ID NO: 6662155 - DNA, 14 bp, Homo sapiens
atcaaccaggcaga

SEQ ID NO: 6662156 - DNA, 16 bp, Homo sapiens
atcaaccccagactca

SEQ ID NO: 6662157 - DNA, 21 bp, Homo sapiens
atcaaccccccgactgtgctg

SEQ ID NO: 6662158 - DNA, 22 bp, Homo sapiens
atcaaccccttcgctcctgtgt

SEQ ID NO: 6662159 - DNA, 20 bp, Homo sapiens
atcaaccctgcaatcacttt

SEQ ID NO: 6662160 - DNA, 16 bp, Homo sapiens
atcaacctatcaaagc

SEQ ID NO: 6662161 - DNA, 14 bp, Homo sapiens
atcaactaaaacat

SEQ ID NO: 6662162 - DNA, 12 bp, Homo sapiens
atcaactaaagt

SEQ ID NO: 6662163 - DNA, 15 bp, Homo sapiens
atcaactagtatttg

SEQ ID NO: 6662164 - DNA, 14 bp, Homo sapiens
atcaactcaagaat

SEQ ID NO: 6662165 - DNA, 14 bp, Homo sapiens
atcaactctgaaag

SEQ ID NO: 6662166 - DNA, 11 bp, Homo sapiens
atcaactgaat

SEQ ID NO: 6662167 - DNA, 14 bp, Homo sapiens
atcaactgaatgag

SEQ ID NO: 6662168 - DNA, 17 bp, Homo sapiens
atcaactgtcaaatatg

SEQ ID NO: 6662169 - DNA, 15 bp, Homo sapiens
atcaacttaaaagtc

SEQ ID NO: 6662170 - DNA, 20 bp, Homo sapiens
atcaacttaattctgttaca

SEQ ID NO: 6662171 - DNA, 17 bp, Homo sapiens
atcaacttcgctagaaa

SEQ ID NO: 6662172 - DNA, 15 bp, Homo sapiens
atcaactttactgta

SEQ ID NO: 6662173 - DNA, 14 bp, Homo sapiens
atcaactttatgta

SEQ ID NO: 6662174 - DNA, 22 bp, Homo sapiens
atcaacttttgaaatttaaaaa

SEQ ID NO: 6662175 - DNA, 13 bp, Homo sapiens
atcaactttttat

SEQ ID NO: 6662176 - DNA, 16 bp, Homo sapiens
atcaactttttattgc

SEQ ID NO: 6662177 - DNA, 16 bp, Homo sapiens
atcaagaaaaaaaggg

SEQ ID NO: 6662178 - DNA, 15 bp, Homo sapiens
atcaagaaagtgttg

SEQ ID NO: 6662179 - DNA, 12 bp, Homo sapiens
atcaagaaattg

SEQ ID NO: 6662180 - DNA, 17 bp, Homo sapiens
atcaagaagactttagg

SEQ ID NO: 6662181 - DNA, 22 bp, Homo sapiens
atcaagaagggctgcatgatgt

SEQ ID NO: 6662182 - DNA, 24 bp, Homo sapiens
atcaagaatagttgtcagaatatg

SEQ ID NO: 6662183 - DNA, 19 bp, Homo sapiens
atcaagaatattcaaatgt

SEQ ID NO: 6662184 - DNA, 23 bp, Homo sapiens
atcaagaatcttttgtgaaatta

SEQ ID NO: 6662185 - DNA, 23 bp, Homo sapiens
atcaagaatggggatcacagaga

SEQ ID NO: 6662186 - DNA, 13 bp, Homo sapiens
atcaagacatagc

SEQ ID NO: 6662187 - DNA, 19 bp, Homo sapiens
atcaagactatctacaaaa

SEQ ID NO: 6662188 - DNA, 18 bp, Homo sapiens
atcaagagaatcaacaga

SEQ ID NO: 6662189 - DNA, 23 bp, Homo sapiens
atcaagagacactcccccctcca

SEQ ID NO: 6662190 - DNA, 16 bp, Homo sapiens
atcaagagctgccctc

SEQ ID NO: 6662191 - DNA, 16 bp, Homo sapiens
atcaagagtctctcca

SEQ ID NO: 6662192 - DNA, 18 bp, Homo sapiens
atcaagagtctctccagc

SEQ ID NO: 6662193 - DNA, 19 bp, Homo sapiens
atcaagagtctctccagcc

SEQ ID NO: 6662194 - DNA, 22 bp, Homo sapiens
atcaagagtgagtgaacaacta

SEQ ID NO: 6662195 - DNA, 15 bp, Homo sapiens
atcaagataaaggac

SEQ ID NO: 6662196 - DNA, 17 bp, Homo sapiens
atcaagataaaggacag

SEQ ID NO: 6662197 - DNA, 18 bp, Homo sapiens
atcaagataaaggacagt

SEQ ID NO: 6662198 - DNA, 13 bp, Homo sapiens
atcaagatatatg

SEQ ID NO: 6662199 - DNA, 22 bp, Homo sapiens
atcaagatgagagaactggagg

SEQ ID NO: 6662200 - DNA, 21 bp, Homo sapiens
atcaagatgggtgattatgaa

SEQ ID NO: 6662201 - DNA, 16 bp, Homo sapiens
atcaagcaacattctt

SEQ ID NO: 6662202 - DNA, 19 bp, Homo sapiens
atcaagcacactgtatgtt

SEQ ID NO: 6662203 - DNA, 15 bp, Homo sapiens
atcaagcacttccca

SEQ ID NO: 6662204 - DNA, 14 bp, Homo sapiens
atcaagcagaaaac

SEQ ID NO: 6662205 - DNA, 18 bp, Homo sapiens
atcaagcaggaattatgt

SEQ ID NO: 6662206 - DNA, 18 bp, Homo sapiens
atcaagcaggttagagaa

SEQ ID NO: 6662207 - DNA, 20 bp, Homo sapiens
atcaagcatgcaataatgtg

SEQ ID NO: 6662208 - DNA, 23 bp, Homo sapiens
atcaagcatggaacaaagcatgt

SEQ ID NO: 6662209 - DNA, 21 bp, Homo sapiens
atcaagccatgtataaatgtg

SEQ ID NO: 6662210 - DNA, 13 bp, Homo sapiens
atcaagcccctgt

SEQ ID NO: 6662211 - DNA, 14 bp, Homo sapiens
atcaagcctgcctc

SEQ ID NO: 6662212 - DNA, 15 bp, Homo sapiens
atcaagcctgcctca

SEQ ID NO: 6662213 - DNA, 22 bp, Homo sapiens
atcaagcctttatggctgctgg

SEQ ID NO: 6662214 - DNA, 11 bp, Homo sapiens
atcaagctgtg

SEQ ID NO: 6662215 - DNA, 19 bp, Homo sapiens
atcaagcttgtgtacttga

SEQ ID NO: 6662216 - DNA, 16 bp, Homo sapiens
atcaagcttttctgta

SEQ ID NO: 6662217 - DNA, 17 bp, Homo sapiens
atcaaggaaaactgtga

SEQ ID NO: 6662218 - DNA, 22 bp, Homo sapiens
atcaaggaaaggctcatttaaa

SEQ ID NO: 6662219 - DNA, 22 bp, Homo sapiens
atcaaggaagaaatggttcaga

SEQ ID NO: 6662220 - DNA, 17 bp, Homo sapiens
atcaaggaagtcttcaa

SEQ ID NO: 6662221 - DNA, 15 bp, Homo sapiens
atcaaggaatcctga

SEQ ID NO: 6662222 - DNA, 21 bp, Homo sapiens
atcaaggactctggtttctca

SEQ ID NO: 6662223 - DNA, 15 bp, Homo sapiens
atcaaggagcccaga

SEQ ID NO: 6662224 - DNA, 19 bp, Homo sapiens
atcaaggagtgaagtaatt

SEQ ID NO: 6662225 - DNA, 14 bp, Homo sapiens
atcaaggctgcctg

SEQ ID NO: 6662226 - DNA, 17 bp, Homo sapiens
atcaaggctgcctggag

SEQ ID NO: 6662227 - DNA, 16 bp, Homo sapiens
atcaagggaagaacta

SEQ ID NO: 6662228 - DNA, 23 bp, Homo sapiens
atcaagggaatgtaactgctgaa

SEQ ID NO: 6662229 - DNA, 19 bp, Homo sapiens
atcaaggggttcccactgg

SEQ ID NO: 6662230 - DNA, 16 bp, Homo sapiens
atcaagggtacactgc

SEQ ID NO: 6662231 - DNA, 16 bp, Homo sapiens
atcaaggtagaacaaa

SEQ ID NO: 6662232 - DNA, 15 bp, Homo sapiens
atcaaggtcgttttt

SEQ ID NO: 6662233 - DNA, 12 bp, Homo sapiens
atcaaggtgctc

SEQ ID NO: 6662234 - DNA, 14 bp, Homo sapiens
atcaagtaatacaa

SEQ ID NO: 6662235 - DNA, 18 bp, Homo sapiens
atcaagtacctatattga

SEQ ID NO: 6662236 - DNA, 16 bp, Homo sapiens
atcaagtatagaaaat

SEQ ID NO: 6662237 - DNA, 21 bp, Homo sapiens
atcaagtatagaaaatcttca

SEQ ID NO: 6662238 - DNA, 20 bp, Homo sapiens
atcaagtatttgggaagtga

SEQ ID NO: 6662239 - DNA, 16 bp, Homo sapiens
atcaagtcccgaggca

SEQ ID NO: 6662240 - DNA, 16 bp, Homo sapiens
atcaagtcctttgtga

SEQ ID NO: 6662241 - DNA, 17 bp, Homo sapiens
atcaagtcctttgtgaa

SEQ ID NO: 6662242 - DNA, 19 bp, Homo sapiens
atcaagtcctttgtgaata

SEQ ID NO: 6662243 - DNA, 11 bp, Homo sapiens
atcaagtgtaa

SEQ ID NO: 6662244 - DNA, 19 bp, Homo sapiens
atcaagtgtaattagcttt

SEQ ID NO: 6662245 - DNA, 23 bp, Homo sapiens
atcaagtgttctaaaatgaaata

SEQ ID NO: 6662246 - DNA, 23 bp, Homo sapiens
atcaagttggcttctaatcaaag

SEQ ID NO: 6662247 - DNA, 20 bp, Homo sapiens
atcaagttgtaacttatatt

SEQ ID NO: 6662248 - DNA, 23 bp, Homo sapiens
atcaagttgtaacttatattgaa

SEQ ID NO: 6662249 - DNA, 20 bp, Homo sapiens
atcaagttgttgactgtgat

SEQ ID NO: 6662250 - DNA, 21 bp, Homo sapiens
atcaagttgttgactgtgatt

SEQ ID NO: 6662251 - DNA, 18 bp, Homo sapiens
atcaagtttccaagcaaa

SEQ ID NO: 6662252 - DNA, 21 bp, Homo sapiens
atcaagtttccaagcaaatgt

SEQ ID NO: 6662253 - DNA, 19 bp, Homo sapiens
atcaagtttgaccagtgca

SEQ ID NO: 6662254 - DNA, 11 bp, Homo sapiens
atcaagtttta

SEQ ID NO: 6662255 - DNA, 13 bp, Homo sapiens
atcaagttttaag

SEQ ID NO: 6662256 - DNA, 19 bp, Homo sapiens
atcaataaaaaacaaatat

SEQ ID NO: 6662257 - DNA, 21 bp, Homo sapiens
atcaataaaaaacaaatatat

SEQ ID NO: 6662258 - DNA, 18 bp, Homo sapiens
atcaataaaaaattatga

SEQ ID NO: 6662259 - DNA, 15 bp, Homo sapiens
atcaataaaaatctt

SEQ ID NO: 6662260 - DNA, 15 bp, Homo sapiens
atcaataaaatgtga

SEQ ID NO: 6662261 - DNA, 17 bp, Homo sapiens
atcaataaaatgtgatt

SEQ ID NO: 6662262 - DNA, 12 bp, Homo sapiens
atcaataaaatt

SEQ ID NO: 6662263 - DNA, 14 bp, Homo sapiens
atcaataaaattct

SEQ ID NO: 6662264 - DNA, 15 bp, Homo sapiens
atcaataaaattctg

SEQ ID NO: 6662265 - DNA, 20 bp, Homo sapiens
atcaataaaggacaggctgg

SEQ ID NO: 6662266 - DNA, 16 bp, Homo sapiens
atcaataaatacttta

SEQ ID NO: 6662267 - DNA, 18 bp, Homo sapiens
atcaataaatagatgagt

SEQ ID NO: 6662268 - DNA, 13 bp, Homo sapiens
atcaataaatgct

SEQ ID NO: 6662269 - DNA, 20 bp, Homo sapiens
atcaataatatattttctgt

SEQ ID NO: 6662270 - DNA, 21 bp, Homo sapiens
atcaataatatattttctgtt

SEQ ID NO: 6662271 - DNA, 11 bp, Homo sapiens
atcaatacaca

SEQ ID NO: 6662272 - DNA, 17 bp, Homo sapiens
atcaatacactagttgt

SEQ ID NO: 6662273 - DNA, 17 bp, Homo sapiens
atcaatacagacaaggt

SEQ ID NO: 6662274 - DNA, 15 bp, Homo sapiens
atcaatacccttggc

SEQ ID NO: 6662275 - DNA, 18 bp, Homo sapiens
atcaatacttttgtgtat

SEQ ID NO: 6662276 - DNA, 23 bp, Homo sapiens
atcaatacttttgtgtattctgt

SEQ ID NO: 6662277 - DNA, 19 bp, Homo sapiens
atcaatagaaagtcatctt

SEQ ID NO: 6662278 - DNA, 18 bp, Homo sapiens
atcaataggcaaaagtgt

SEQ ID NO: 6662279 - DNA, 18 bp, Homo sapiens
atcaatagtgcaactgtt

SEQ ID NO: 6662280 - DNA, 22 bp, Homo sapiens
atcaatagtgcaactgttttga

SEQ ID NO: 6662281 - DNA, 23 bp, Homo sapiens
atcaatagtgtcctatgcaataa

SEQ ID NO: 6662282 - DNA, 14 bp, Homo sapiens
atcaatagttgaat

SEQ ID NO: 6662283 - DNA, 17 bp, Homo sapiens
atcaatagttgaattag

SEQ ID NO: 6662284 - DNA, 16 bp, Homo sapiens
atcaatatcccaacat

SEQ ID NO: 6662285 - DNA, 17 bp, Homo sapiens
atcaatatcccaacatt

SEQ ID NO: 6662286 - DNA, 21 bp, Homo sapiens
atcaatatcccaacattctgc

SEQ ID NO: 6662287 - DNA, 18 bp, Homo sapiens
atcaatattgtcattcct

SEQ ID NO: 6662288 - DNA, 20 bp, Homo sapiens
atcaatattgtcattcctgt

SEQ ID NO: 6662289 - DNA, 13 bp, Homo sapiens
atcaatcaatggt

SEQ ID NO: 6662290 - DNA, 20 bp, Homo sapiens
atcaatcacagcttgtattt

SEQ ID NO: 6662291 - DNA, 16 bp, Homo sapiens
atcaatcagaaggtat

SEQ ID NO: 6662292 - DNA, 22 bp, Homo sapiens
atcaatcatctgtgtgaaaatg

SEQ ID NO: 6662293 - DNA, 13 bp, Homo sapiens
atcaatcatgccc

SEQ ID NO: 6662294 - DNA, 21 bp, Homo sapiens
atcaatcatgccctgccttgt

SEQ ID NO: 6662295 - DNA, 23 bp, Homo sapiens
atcaatcctgattcctctctaag

SEQ ID NO: 6662296 - DNA, 13 bp, Homo sapiens
atcaatcctgccc

SEQ ID NO: 6662297 - DNA, 20 bp, Homo sapiens
atcaatcctgcccccagcca

SEQ ID NO: 6662298 - DNA, 20 bp, Homo sapiens
atcaatctgcagtttgtgaa

SEQ ID NO: 6662299 - DNA, 21 bp, Homo sapiens
atcaatctggcttctgcatta

SEQ ID NO: 6662300 - DNA, 21 bp, Homo sapiens
atcaatctgtaaaactaagaa

SEQ ID NO: 6662301 - DNA, 16 bp, Homo sapiens
atcaatcttgcatgta

SEQ ID NO: 6662302 - DNA, 17 bp, Homo sapiens
atcaatcttgcatgtaa

SEQ ID NO: 6662303 - DNA, 18 bp, Homo sapiens
atcaatcttgcatgtaac

SEQ ID NO: 6662304 - DNA, 14 bp, Homo sapiens
atcaatcttgttac

SEQ ID NO: 6662305 - DNA, 21 bp, Homo sapiens
atcaatgaagattaacactga

SEQ ID NO: 6662306 - DNA, 14 bp, Homo sapiens
atcaatgagtaaca

SEQ ID NO: 6662307 - DNA, 14 bp, Homo sapiens
atcaatgagtgtga

SEQ ID NO: 6662308 - DNA, 16 bp, Homo sapiens
atcaatgagttcttct

SEQ ID NO: 6662309 - DNA, 15 bp, Homo sapiens
atcaatgataaattt

SEQ ID NO: 6662310 - DNA, 22 bp, Homo sapiens
atcaatgcaagagtgattgcag

SEQ ID NO: 6662311 - DNA, 22 bp, Homo sapiens
atcaatggcgcagtgcctctgg

SEQ ID NO: 6662312 - DNA, 15 bp, Homo sapiens
atcaatggtgcaaaa

SEQ ID NO: 6662313 - DNA, 23 bp, Homo sapiens
atcaatggtgcaaaaaaaaactt

SEQ ID NO: 6662314 - DNA, 16 bp, Homo sapiens
atcaatggttcaagtc

SEQ ID NO: 6662315 - DNA, 22 bp, Homo sapiens
atcaatgtatatgaagctcttg

SEQ ID NO: 6662316 - DNA, 15 bp, Homo sapiens
atcaatgtgacattt

SEQ ID NO: 6662317 - DNA, 16 bp, Homo sapiens
atcaatgtgacattta

SEQ ID NO: 6662318 - DNA, 17 bp, Homo sapiens
atcaatgtgtctttcta

SEQ ID NO: 6662319 - DNA, 22 bp, Homo sapiens
atcaatgtgtctttctaagaaa

SEQ ID NO: 6662320 - DNA, 22 bp, Homo sapiens
atcaatgttcacgcaacttgaa

SEQ ID NO: 6662321 - DNA, 23 bp, Homo sapiens
atcaatgttcacgcaacttgaaa

SEQ ID NO: 6662322 - DNA, 18 bp, Homo sapiens
atcaatgttcattgtaat

SEQ ID NO: 6662323 - DNA, 19 bp, Homo sapiens
atcaatgtttcttctaggt

SEQ ID NO: 6662324 - DNA, 21 bp, Homo sapiens
atcaattaacatcgtgggtca

SEQ ID NO: 6662325 - DNA, 20 bp, Homo sapiens
atcaattaactgagtagctc

SEQ ID NO: 6662326 - DNA, 14 bp, Homo sapiens
atcaattaattctt

SEQ ID NO: 6662327 - DNA, 17 bp, Homo sapiens
atcaattaattcttaat

SEQ ID NO: 6662328 - DNA, 17 bp, Homo sapiens
atcaattagatctaaac

SEQ ID NO: 6662329 - DNA, 18 bp, Homo sapiens
atcaattagatctaaaca

SEQ ID NO: 6662330 - DNA, 16 bp, Homo sapiens
atcaattattacattt

SEQ ID NO: 6662331 - DNA, 14 bp, Homo sapiens
atcaattcattgtg

SEQ ID NO: 6662332 - DNA, 15 bp, Homo sapiens
atcaattcattgtgt

SEQ ID NO: 6662333 - DNA, 14 bp, Homo sapiens
atcaattccctctc

SEQ ID NO: 6662334 - DNA, 18 bp, Homo sapiens
atcaattcttaaatttct

SEQ ID NO: 6662335 - DNA, 18 bp, Homo sapiens
atcaattcttgagaccca

SEQ ID NO: 6662336 - DNA, 16 bp, Homo sapiens
atcaattggaaatcaa

SEQ ID NO: 6662337 - DNA, 19 bp, Homo sapiens
atcaatttaaaaagcaaaa

SEQ ID NO: 6662338 - DNA, 21 bp, Homo sapiens
atcaatttaaacccattttag

SEQ ID NO: 6662339 - DNA, 14 bp, Homo sapiens
atcaatttaaagga

SEQ ID NO: 6662340 - DNA, 14 bp, Homo sapiens
atcaatttaaatgt

SEQ ID NO: 6662341 - DNA, 18 bp, Homo sapiens
atcaatttaaatgtttac

SEQ ID NO: 6662342 - DNA, 17 bp, Homo sapiens
atcaatttaagtgttgg

SEQ ID NO: 6662343 - DNA, 14 bp, Homo sapiens
atcaatttcccaga

SEQ ID NO: 6662344 - DNA, 15 bp, Homo sapiens
atcaatttcccagaa

SEQ ID NO: 6662345 - DNA, 12 bp, Homo sapiens
atcaatttctaa

SEQ ID NO: 6662346 - DNA, 14 bp, Homo sapiens
atcaatttctcaat

SEQ ID NO: 6662347 - DNA, 14 bp, Homo sapiens
atcaatttctccca

SEQ ID NO: 6662348 - DNA, 19 bp, Homo sapiens
atcaatttgtaattttagt

SEQ ID NO: 6662349 - DNA, 19 bp, Homo sapiens
atcaatttgtcattttgaa

SEQ ID NO: 6662350 - DNA, 14 bp, Homo sapiens
atcaattttaacat

SEQ ID NO: 6662351 - DNA, 15 bp, Homo sapiens
atcaattttcacttg

SEQ ID NO: 6662352 - DNA, 20 bp, Homo sapiens
atcaattttcacttgcttaa

SEQ ID NO: 6662353 - DNA, 16 bp, Homo sapiens
atcaatttttatacat

SEQ ID NO: 6662354 - DNA, 17 bp, Homo sapiens
atcaatttttatacata

SEQ ID NO: 6662355 - DNA, 23 bp, Homo sapiens
atcaatttttatacatatcagaa

SEQ ID NO: 6662356 - DNA, 14 bp, Homo sapiens
atcaatttttccca

SEQ ID NO: 6662357 - DNA, 17 bp, Homo sapiens
atcaatttttcccagta

SEQ ID NO: 6662358 - DNA, 21 bp, Homo sapiens
atcaatttttcccagtatttt

SEQ ID NO: 6662359 - DNA, 14 bp, Homo sapiens
atcaattttttaaa

SEQ ID NO: 6662360 - DNA, 13 bp, Homo sapiens
atcacaaaaattt

SEQ ID NO: 6662361 - DNA, 14 bp, Homo sapiens
atcacaaaagctgt

SEQ ID NO: 6662362 - DNA, 15 bp, Homo sapiens
atcacaaaagctgtg

SEQ ID NO: 6662363 - DNA, 21 bp, Homo sapiens
atcacaaaagctgtgtctctg

SEQ ID NO: 6662364 - DNA, 21 bp, Homo sapiens
atcacaaaagtatattcaaaa

SEQ ID NO: 6662365 - DNA, 21 bp, Homo sapiens
atcacaaacatatgtatcttt

SEQ ID NO: 6662366 - DNA, 12 bp, Homo sapiens
atcacaaactta

SEQ ID NO: 6662367 - DNA, 14 bp, Homo sapiens
atcacaaatgactt

SEQ ID NO: 6662368 - DNA, 15 bp, Homo sapiens
atcacaaatgacttt

SEQ ID NO: 6662369 - DNA, 19 bp, Homo sapiens
atcacaaatgactttatta

SEQ ID NO: 6662370 - DNA, 16 bp, Homo sapiens
atcacaacaagaaatt

SEQ ID NO: 6662371 - DNA, 18 bp, Homo sapiens
atcacaacgtgcattgtg

SEQ ID NO: 6662372 - DNA, 21 bp, Homo sapiens
atcacaacgtgcattgtgctt

SEQ ID NO: 6662373 - DNA, 12 bp, Homo sapiens
atcacaactttt

SEQ ID NO: 6662374 - DNA, 16 bp, Homo sapiens
atcacaacttttctgc

SEQ ID NO: 6662375 - DNA, 16 bp, Homo sapiens
atcacaagcaataatt

SEQ ID NO: 6662376 - DNA, 14 bp, Homo sapiens
atcacaataaagag

SEQ ID NO: 6662377 - DNA, 16 bp, Homo sapiens
atcacaatacagataa

SEQ ID NO: 6662378 - DNA, 15 bp, Homo sapiens
atcacaatattcagt

SEQ ID NO: 6662379 - DNA, 16 bp, Homo sapiens
atcacaatattcagtg

SEQ ID NO: 6662380 - DNA, 19 bp, Homo sapiens
atcacaatattcagtggtg

SEQ ID NO: 6662381 - DNA, 17 bp, Homo sapiens
atcacaatgtactatat

SEQ ID NO: 6662382 - DNA, 18 bp, Homo sapiens
atcacaatgtactatatg

SEQ ID NO: 6662383 - DNA, 15 bp, Homo sapiens
atcacaatttttaat

SEQ ID NO: 6662384 - DNA, 16 bp, Homo sapiens
atcacaatttttaatg

SEQ ID NO: 6662385 - DNA, 13 bp, Homo sapiens
atcacacaaagca

SEQ ID NO: 6662386 - DNA, 22 bp, Homo sapiens
atcacacaagatttgactgtaa

SEQ ID NO: 6662387 - DNA, 16 bp, Homo sapiens
atcacacaatatagtt

SEQ ID NO: 6662388 - DNA, 12 bp, Homo sapiens
atcacacacatg

SEQ ID NO: 6662389 - DNA, 20 bp, Homo sapiens
atcacacacattgctgtgaa

SEQ ID NO: 6662390 - DNA, 15 bp, Homo sapiens
atcacacagccactt

SEQ ID NO: 6662391 - DNA, 15 bp, Homo sapiens
atcacacagtgttag

SEQ ID NO: 6662392 - DNA, 16 bp, Homo sapiens
atcacaccactgtact

SEQ ID NO: 6662393 - DNA, 17 bp, Homo sapiens
atcacacctcagtggga

SEQ ID NO: 6662394 - DNA, 14 bp, Homo sapiens
atcacacctctggg

SEQ ID NO: 6662395 - DNA, 17 bp, Homo sapiens
atcacactgaataagag

SEQ ID NO: 6662396 - DNA, 18 bp, Homo sapiens
atcacacttatattttat

SEQ ID NO: 6662397 - DNA, 19 bp, Homo sapiens
atcacacttatattttatg

SEQ ID NO: 6662398 - DNA, 14 bp, Homo sapiens
atcacacttctgtg

SEQ ID NO: 6662399 - DNA, 18 bp, Homo sapiens
atcacacttctgtgagac

SEQ ID NO: 6662400 - DNA, 13 bp, Homo sapiens
atcacacttgcaa

SEQ ID NO: 6662401 - DNA, 16 bp, Homo sapiens
atcacagaaaatttaa

SEQ ID NO: 6662402 - DNA, 21 bp, Homo sapiens
atcacagactctgctagtgaa

SEQ ID NO: 6662403 - DNA, 14 bp, Homo sapiens
atcacagagcagca

SEQ ID NO: 6662404 - DNA, 15 bp, Homo sapiens
atcacagagcagcaa

SEQ ID NO: 6662405 - DNA, 21 bp, Homo sapiens
atcacagagccactcttcaag

SEQ ID NO: 6662406 - DNA, 15 bp, Homo sapiens
atcacagaggcttct

SEQ ID NO: 6662407 - DNA, 23 bp, Homo sapiens
atcacagatgcatatagacacac

SEQ ID NO: 6662408 - DNA, 22 bp, Homo sapiens
atcacagatgggtattaaactt

SEQ ID NO: 6662409 - DNA, 19 bp, Homo sapiens
atcacagcaatatttaaca

SEQ ID NO: 6662410 - DNA, 12 bp, Homo sapiens
atcacagcaccc

SEQ ID NO: 6662411 - DNA, 19 bp, Homo sapiens
atcacagcagaatgaagac

SEQ ID NO: 6662412 - DNA, 14 bp, Homo sapiens
atcacagcagcctc

SEQ ID NO: 6662413 - DNA, 22 bp, Homo sapiens
atcacagcagggccttctgcct

SEQ ID NO: 6662414 - DNA, 14 bp, Homo sapiens
atcacagccagccc

SEQ ID NO: 6662415 - DNA, 18 bp, Homo sapiens
atcacagccagcccagct

SEQ ID NO: 6662416 - DNA, 13 bp, Homo sapiens
atcacagcccagc

SEQ ID NO: 6662417 - DNA, 14 bp, Homo sapiens
atcacagccccacc

SEQ ID NO: 6662418 - DNA, 15 bp, Homo sapiens
atcacagccccaccc

SEQ ID NO: 6662419 - DNA, 18 bp, Homo sapiens
atcacagccccacccttg

SEQ ID NO: 6662420 - DNA, 15 bp, Homo sapiens
atcacagcctcaccc

SEQ ID NO: 6662421 - DNA, 22 bp, Homo sapiens
atcacagcctcacccctgcccc

SEQ ID NO: 6662422 - DNA, 23 bp, Homo sapiens
atcacagcctcacccctgcccct

SEQ ID NO: 6662423 - DNA, 17 bp, Homo sapiens
atcacagcctccagggc

SEQ ID NO: 6662424 - DNA, 18 bp, Homo sapiens
atcacagcgtttcaggaa

SEQ ID NO: 6662425 - DNA, 22 bp, Homo sapiens
atcacagctcaagcattctgtt

SEQ ID NO: 6662426 - DNA, 14 bp, Homo sapiens
atcacagctcacgg

SEQ ID NO: 6662427 - DNA, 20 bp, Homo sapiens
atcacagctcacggcagcct

SEQ ID NO: 6662428 - DNA, 14 bp, Homo sapiens
atcacagcttcagc

SEQ ID NO: 6662429 - DNA, 18 bp, Homo sapiens
atcacagcttcagccagg

SEQ ID NO: 6662430 - DNA, 22 bp, Homo sapiens
atcacagcttcagccaggagct

SEQ ID NO: 6662431 - DNA, 18 bp, Homo sapiens
atcacagcttgttttgga

SEQ ID NO: 6662432 - DNA, 22 bp, Homo sapiens
atcacaggatgccagcccctgc

SEQ ID NO: 6662433 - DNA, 23 bp, Homo sapiens
atcacaggatgccagcccctgcc

SEQ ID NO: 6662434 - DNA, 15 bp, Homo sapiens
atcacaggctctgca

SEQ ID NO: 6662435 - DNA, 21 bp, Homo sapiens
atcacaggctctgcatacaca

SEQ ID NO: 6662436 - DNA, 13 bp, Homo sapiens
atcacaggctggg

SEQ ID NO: 6662437 - DNA, 12 bp, Homo sapiens
atcacagggaat

SEQ ID NO: 6662438 - DNA, 13 bp, Homo sapiens
atcacagggaatg

SEQ ID NO: 6662439 - DNA, 15 bp, Homo sapiens
atcacagggcctcag

SEQ ID NO: 6662440 - DNA, 15 bp, Homo sapiens
atcacaggggcgggg

SEQ ID NO: 6662441 - DNA, 20 bp, Homo sapiens
atcacaggggcggggcagga

SEQ ID NO: 6662442 - DNA, 24 bp, Homo sapiens
atcacagggtgagggccacctcca

SEQ ID NO: 6662443 - DNA, 17 bp, Homo sapiens
atcacagggtgggcctc

SEQ ID NO: 6662444 - DNA, 18 bp, Homo sapiens
atcacagggttgggccca

SEQ ID NO: 6662445 - DNA, 20 bp, Homo sapiens
atcacagggttgggcccaga

SEQ ID NO: 6662446 - DNA, 16 bp, Homo sapiens
atcacagtattatctg

SEQ ID NO: 6662447 - DNA, 22 bp, Homo sapiens
atcacagtattatctgtgttaa

SEQ ID NO: 6662448 - DNA, 15 bp, Homo sapiens
atcacagtctaattt

SEQ ID NO: 6662449 - DNA, 14 bp, Homo sapiens
atcacagtctcagt

SEQ ID NO: 6662450 - DNA, 23 bp, Homo sapiens
atcacagtgactttacaggaggt

SEQ ID NO: 6662451 - DNA, 20 bp, Homo sapiens
atcacagtggcgagaggaga

SEQ ID NO: 6662452 - DNA, 22 bp, Homo sapiens
atcacagtggcgagaggagagg

SEQ ID NO: 6662453 - DNA, 15 bp, Homo sapiens
atcacagtgggaaga

SEQ ID NO: 6662454 - DNA, 23 bp, Homo sapiens
atcacagtgttatgtagtattgt

SEQ ID NO: 6662455 - DNA, 20 bp, Homo sapiens
atcacagtgtttttattgct

SEQ ID NO: 6662456 - DNA, 18 bp, Homo sapiens
atcacagttgtgttcctg

SEQ ID NO: 6662457 - DNA, 15 bp, Homo sapiens
atcacagttttggtt

SEQ ID NO: 6662458 - DNA, 15 bp, Homo sapiens
atcacataaagaaat

SEQ ID NO: 6662459 - DNA, 15 bp, Homo sapiens
atcacatacaatttg

SEQ ID NO: 6662460 - DNA, 19 bp, Homo sapiens
atcacatacaatttgcact

SEQ ID NO: 6662461 - DNA, 17 bp, Homo sapiens
atcacatagtattatgt

SEQ ID NO: 6662462 - DNA, 13 bp, Homo sapiens
atcacatcacctt

SEQ ID NO: 6662463 - DNA, 14 bp, Homo sapiens
atcacatcaccttt

SEQ ID NO: 6662464 - DNA, 12 bp, Homo sapiens
atcacatcctgg

SEQ ID NO: 6662465 - DNA, 20 bp, Homo sapiens
atcacatctaaagctttatc

SEQ ID NO: 6662466 - DNA, 18 bp, Homo sapiens
atcacatctgcacactct

SEQ ID NO: 6662467 - DNA, 19 bp, Homo sapiens
atcacatctgcacactctc

SEQ ID NO: 6662468 - DNA, 22 bp, Homo sapiens
atcacatgaaggagacagcagc

SEQ ID NO: 6662469 - DNA, 16 bp, Homo sapiens
atcacatgcccctctt

SEQ ID NO: 6662470 - DNA, 11 bp, Homo sapiens
atcacatgtat

SEQ ID NO: 6662471 - DNA, 21 bp, Homo sapiens
atcacatgtcagccactgtga

SEQ ID NO: 6662472 - DNA, 21 bp, Homo sapiens
atcacattaatctcaaagaga

SEQ ID NO: 6662473 - DNA, 19 bp, Homo sapiens
atcacattaggggaaccat

SEQ ID NO: 6662474 - DNA, 22 bp, Homo sapiens
atcacattatttgcatgttacc

SEQ ID NO: 6662475 - DNA, 23 bp, Homo sapiens
atcacattcccatggtggcctca

SEQ ID NO: 6662476 - DNA, 16 bp, Homo sapiens
atcacattcttcaaag

SEQ ID NO: 6662477 - DNA, 19 bp, Homo sapiens
atcacattttaagtgcttc

SEQ ID NO: 6662478 - DNA, 21 bp, Homo sapiens
atcacatttttttatgctctt

SEQ ID NO: 6662479 - DNA, 18 bp, Homo sapiens
atcaccaacgtctgtgcc

SEQ ID NO: 6662480 - DNA, 15 bp, Homo sapiens
atcaccaattaaaaa

SEQ ID NO: 6662481 - DNA, 18 bp, Homo sapiens
atcaccaattaaaaacct

SEQ ID NO: 6662482 - DNA, 21 bp, Homo sapiens
atcaccaccgcctctggccgc

SEQ ID NO: 6662483 - DNA, 16 bp, Homo sapiens
atcaccagaataaacc

SEQ ID NO: 6662484 - DNA, 13 bp, Homo sapiens
atcaccagacagg

SEQ ID NO: 6662485 - DNA, 21 bp, Homo sapiens
atcaccagcccggcctgctcc

SEQ ID NO: 6662486 - DNA, 22 bp, Homo sapiens
atcaccagtcctagctcttaca

SEQ ID NO: 6662487 - DNA, 20 bp, Homo sapiens
atcaccagtgcatccttcat

SEQ ID NO: 6662488 - DNA, 18 bp, Homo sapiens
atcaccagtgccacgtca

SEQ ID NO: 6662489 - DNA, 17 bp, Homo sapiens
atcaccataacctctgg

SEQ ID NO: 6662490 - DNA, 15 bp, Homo sapiens
atcaccatgatttaa

SEQ ID NO: 6662491 - DNA, 21 bp, Homo sapiens
atcaccatgtaacaaccagag

SEQ ID NO: 6662492 - DNA, 15 bp, Homo sapiens
atcaccatgtaagca

SEQ ID NO: 6662493 - DNA, 13 bp, Homo sapiens
atcaccatttctt

SEQ ID NO: 6662494 - DNA, 16 bp, Homo sapiens
atcacccaacgctcca

SEQ ID NO: 6662495 - DNA, 18 bp, Homo sapiens
atcacccaatcccagttc

SEQ ID NO: 6662496 - DNA, 21 bp, Homo sapiens
atcacccacaaccctctggaa

SEQ ID NO: 6662497 - DNA, 15 bp, Homo sapiens
atcacccagacataa

SEQ ID NO: 6662498 - DNA, 23 bp, Homo sapiens
atcacccaggcctgattcactgg

SEQ ID NO: 6662499 - DNA, 12 bp, Homo sapiens
atcacccaggct

SEQ ID NO: 6662500 - DNA, 13 bp, Homo sapiens
atcacccaggctg

SEQ ID NO: 6662501 - DNA, 14 bp, Homo sapiens
atcacccagtcctg

SEQ ID NO: 6662502 - DNA, 18 bp, Homo sapiens
atcacccagtcctggcca

SEQ ID NO: 6662503 - DNA, 16 bp, Homo sapiens
atcacccagttgtgct

SEQ ID NO: 6662504 - DNA, 18 bp, Homo sapiens
atcaccccaacctctcct

SEQ ID NO: 6662505 - DNA, 21 bp, Homo sapiens
atcaccccagaggccttgtca

SEQ ID NO: 6662506 - DNA, 18 bp, Homo sapiens
atcaccccagcccccaca

SEQ ID NO: 6662507 - DNA, 22 bp, Homo sapiens
atcaccccctccctacacacac

SEQ ID NO: 6662508 - DNA, 17 bp, Homo sapiens
atcacccctctgcccct

SEQ ID NO: 6662509 - DNA, 19 bp, Homo sapiens
atcacccctctgcccctgc

SEQ ID NO: 6662510 - DNA, 13 bp, Homo sapiens
atcaccctcaccc

SEQ ID NO: 6662511 - DNA, 19 bp, Homo sapiens
atcacccttaccatgtgcc

SEQ ID NO: 6662512 - DNA, 19 bp, Homo sapiens
atcacccttccgacaggag

SEQ ID NO: 6662513 - DNA, 23 bp, Homo sapiens
atcaccctttccggcacactgcc

SEQ ID NO: 6662514 - DNA, 14 bp, Homo sapiens
atcaccctttgcct

SEQ ID NO: 6662515 - DNA, 14 bp, Homo sapiens
atcaccgaaaacgt

SEQ ID NO: 6662516 - DNA, 19 bp, Homo sapiens
atcaccgatgcaaacattg

SEQ ID NO: 6662517 - DNA, 16 bp, Homo sapiens
atcaccgattcttcct

SEQ ID NO: 6662518 - DNA, 20 bp, Homo sapiens
atcaccgattcttccttgcc

SEQ ID NO: 6662519 - DNA, 18 bp, Homo sapiens
atcaccgctgggtggttt

SEQ ID NO: 6662520 - DNA, 22 bp, Homo sapiens
atcaccgggaacgcccccgccc

SEQ ID NO: 6662521 - DNA, 21 bp, Homo sapiens
atcaccgtcattgatggagcc

SEQ ID NO: 6662522 - DNA, 17 bp, Homo sapiens
atcaccgtcccgcacag

SEQ ID NO: 6662523 - DNA, 20 bp, Homo sapiens
atcaccgtgggctccctgac

SEQ ID NO: 6662524 - DNA, 22 bp, Homo sapiens
atcaccgtgggctccctgactg

SEQ ID NO: 6662525 - DNA, 12 bp, Homo sapiens
atcacctaaaat

SEQ ID NO: 6662526 - DNA, 16 bp, Homo sapiens
atcacctaagcacttc

SEQ ID NO: 6662527 - DNA, 17 bp, Homo sapiens
atcacctaattaatttc

SEQ ID NO: 6662528 - DNA, 16 bp, Homo sapiens
atcacctagctgaatg

SEQ ID NO: 6662529 - DNA, 21 bp, Homo sapiens
atcacctagctgaatgttttt

SEQ ID NO: 6662530 - DNA, 16 bp, Homo sapiens
atcacctcagatggca

SEQ ID NO: 6662531 - DNA, 19 bp, Homo sapiens
atcacctcagatggcagct

SEQ ID NO: 6662532 - DNA, 12 bp, Homo sapiens
atcacctcaggc

SEQ ID NO: 6662533 - DNA, 14 bp, Homo sapiens
atcacctcccacca

SEQ ID NO: 6662534 - DNA, 12 bp, Homo sapiens
atcacctcccct

SEQ ID NO: 6662535 - DNA, 15 bp, Homo sapiens
atcacctcccctcct

SEQ ID NO: 6662536 - DNA, 21 bp, Homo sapiens
atcacctctaatagaggcagt

SEQ ID NO: 6662537 - DNA, 22 bp, Homo sapiens
atcacctctctgtagtttatgg

SEQ ID NO: 6662538 - DNA, 15 bp, Homo sapiens
atcacctctcttcag

SEQ ID NO: 6662539 - DNA, 18 bp, Homo sapiens
atcacctctcttcttagt

SEQ ID NO: 6662540 - DNA, 13 bp, Homo sapiens
atcacctcttggg

SEQ ID NO: 6662541 - DNA, 20 bp, Homo sapiens
atcacctgaaacactggacc

SEQ ID NO: 6662542 - DNA, 22 bp, Homo sapiens
atcacctgaaacactggacctg

SEQ ID NO: 6662543 - DNA, 13 bp, Homo sapiens
atcacctgaggtc

SEQ ID NO: 6662544 - DNA, 17 bp, Homo sapiens
atcacctgaggtcagga

SEQ ID NO: 6662545 - DNA, 15 bp, Homo sapiens
atcacctgcatcaca

SEQ ID NO: 6662546 - DNA, 19 bp, Homo sapiens
atcacctgcatcacagccc

SEQ ID NO: 6662547 - DNA, 22 bp, Homo sapiens
atcacctgcgcagggccctctg

SEQ ID NO: 6662548 - DNA, 11 bp, Homo sapiens
atcacctgtca

SEQ ID NO: 6662549 - DNA, 23 bp, Homo sapiens
atcaccttaagaaagtgtctctg

SEQ ID NO: 6662550 - DNA, 18 bp, Homo sapiens
atcaccttaggcagggaa

SEQ ID NO: 6662551 - DNA, 14 bp, Homo sapiens
atcaccttctttgt

SEQ ID NO: 6662552 - DNA, 15 bp, Homo sapiens
atcaccttctttgta

SEQ ID NO: 6662553 - DNA, 15 bp, Homo sapiens
atcaccttttctaaa

SEQ ID NO: 6662554 - DNA, 21 bp, Homo sapiens
atcacctttttgacttttcca

SEQ ID NO: 6662555 - DNA, 17 bp, Homo sapiens
atcacgacgctgcagag

SEQ ID NO: 6662556 - DNA, 18 bp, Homo sapiens
atcacgatgtaaattatt

SEQ ID NO: 6662557 - DNA, 13 bp, Homo sapiens
atcacgatttcat

SEQ ID NO: 6662558 - DNA, 16 bp, Homo sapiens
atcacgatttcatcct

SEQ ID NO: 6662559 - DNA, 14 bp, Homo sapiens
atcacgatttgcag

SEQ ID NO: 6662560 - DNA, 13 bp, Homo sapiens
atcacgccactgc

SEQ ID NO: 6662561 - DNA, 15 bp, Homo sapiens
atcacgccactgcac

SEQ ID NO: 6662562 - DNA, 21 bp, Homo sapiens
atcacgccattgtactccagc

SEQ ID NO: 6662563 - DNA, 22 bp, Homo sapiens
atcacgccattgtactccagcc

SEQ ID NO: 6662564 - DNA, 12 bp, Homo sapiens
atcacgctcccc

SEQ ID NO: 6662565 - DNA, 15 bp, Homo sapiens
atcacgctccccgcc

SEQ ID NO: 6662566 - DNA, 23 bp, Homo sapiens
atcacgctccccgcctgttcccc

SEQ ID NO: 6662567 - DNA, 14 bp, Homo sapiens
atcacggcatgttt

SEQ ID NO: 6662568 - DNA, 20 bp, Homo sapiens
atcacgggcccgctcaacct

SEQ ID NO: 6662569 - DNA, 18 bp, Homo sapiens
atcacgggcggtcctgca

SEQ ID NO: 6662570 - DNA, 19 bp, Homo sapiens
atcacgggcggtcctgcac

SEQ ID NO: 6662571 - DNA, 20 bp, Homo sapiens
atcacgggcggtcctgcaca

SEQ ID NO: 6662572 - DNA, 21 bp, Homo sapiens
atcacgtctgacaaatgtgta

SEQ ID NO: 6662573 - DNA, 13 bp, Homo sapiens
atcacgtgtactg

SEQ ID NO: 6662574 - DNA, 17 bp, Homo sapiens
atcacgttagaggaaaa

SEQ ID NO: 6662575 - DNA, 13 bp, Homo sapiens
atcacgttgctgg

SEQ ID NO: 6662576 - DNA, 20 bp, Homo sapiens
atcactaaaagaaaatctat

SEQ ID NO: 6662577 - DNA, 22 bp, Homo sapiens
atcactaaaagcatgaattgga

SEQ ID NO: 6662578 - DNA, 13 bp, Homo sapiens
atcactaaacttt

SEQ ID NO: 6662579 - DNA, 15 bp, Homo sapiens
atcactaaactttat

SEQ ID NO: 6662580 - DNA, 13 bp, Homo sapiens
atcactaacatta

SEQ ID NO: 6662581 - DNA, 18 bp, Homo sapiens
atcactaacattatattg

SEQ ID NO: 6662582 - DNA, 12 bp, Homo sapiens
atcactaagaaa

SEQ ID NO: 6662583 - DNA, 15 bp, Homo sapiens
atcactaagaaagaa

SEQ ID NO: 6662584 - DNA, 20 bp, Homo sapiens
atcactaatactaattcatt

SEQ ID NO: 6662585 - DNA, 14 bp, Homo sapiens
atcactaatttctt

SEQ ID NO: 6662586 - DNA, 17 bp, Homo sapiens
atcactacaaaaagaag

SEQ ID NO: 6662587 - DNA, 19 bp, Homo sapiens
atcactacctttatagctc

SEQ ID NO: 6662588 - DNA, 13 bp, Homo sapiens
atcactactgcag

SEQ ID NO: 6662589 - DNA, 17 bp, Homo sapiens
atcactagagtgctctg

SEQ ID NO: 6662590 - DNA, 18 bp, Homo sapiens
atcactaggtaacttatt

SEQ ID NO: 6662591 - DNA, 21 bp, Homo sapiens
atcactattcagaagacacag

SEQ ID NO: 6662592 - DNA, 22 bp, Homo sapiens
atcactattcagaagacacaga

SEQ ID NO: 6662593 - DNA, 23 bp, Homo sapiens
atcactattcagaagacacagag

SEQ ID NO: 6662594 - DNA, 12 bp, Homo sapiens
atcactattctt

SEQ ID NO: 6662595 - DNA, 21 bp, Homo sapiens
atcactattcttaagcacttt

SEQ ID NO: 6662596 - DNA, 23 bp, Homo sapiens
atcactattcttaagcactttga

SEQ ID NO: 6662597 - DNA, 20 bp, Homo sapiens
atcactcactcactccccac

SEQ ID NO: 6662598 - DNA, 23 bp, Homo sapiens
atcactcagcccctacccctgcc

SEQ ID NO: 6662599 - DNA, 13 bp, Homo sapiens
atcactcattaat

SEQ ID NO: 6662600 - DNA, 15 bp, Homo sapiens
atcactcattaatta

SEQ ID NO: 6662601 - DNA, 16 bp, Homo sapiens
atcactcattaattaa

SEQ ID NO: 6662602 - DNA, 13 bp, Homo sapiens
atcactcccagca

SEQ ID NO: 6662603 - DNA, 15 bp, Homo sapiens
atcactcccagcact

SEQ ID NO: 6662604 - DNA, 18 bp, Homo sapiens
atcactcccagcactccc

SEQ ID NO: 6662605 - DNA, 20 bp, Homo sapiens
atcactccccaaggaagagc

SEQ ID NO: 6662606 - DNA, 13 bp, Homo sapiens
atcactcccctcc

SEQ ID NO: 6662607 - DNA, 14 bp, Homo sapiens
atcactccctggat

SEQ ID NO: 6662608 - DNA, 12 bp, Homo sapiens
atcactcctgga

SEQ ID NO: 6662609 - DNA, 15 bp, Homo sapiens
atcactctaatataa

SEQ ID NO: 6662610 - DNA, 16 bp, Homo sapiens
atcactctctgctggc

SEQ ID NO: 6662611 - DNA, 17 bp, Homo sapiens
atcactctctgctggca

SEQ ID NO: 6662612 - DNA, 21 bp, Homo sapiens
atcactctgtgtctgagtggc

SEQ ID NO: 6662613 - DNA, 23 bp, Homo sapiens
atcactctgttcattcctccagg

SEQ ID NO: 6662614 - DNA, 17 bp, Homo sapiens
atcactcttgtggatgt

SEQ ID NO: 6662615 - DNA, 24 bp, Homo sapiens
atcactgaaacaaaaattgtcttt

SEQ ID NO: 6662616 - DNA, 14 bp, Homo sapiens
atcactgaaatccc

SEQ ID NO: 6662617 - DNA, 17 bp, Homo sapiens
atcactgaacttttcaa

SEQ ID NO: 6662618 - DNA, 22 bp, Homo sapiens
atcactgaattaagccatcagg

SEQ ID NO: 6662619 - DNA, 15 bp, Homo sapiens
atcactgaatttata

SEQ ID NO: 6662620 - DNA, 20 bp, Homo sapiens
atcactgaatttataaagta

SEQ ID NO: 6662621 - DNA, 13 bp, Homo sapiens
atcactgactctg

SEQ ID NO: 6662622 - DNA, 21 bp, Homo sapiens
atcactgagaagatggcactg

SEQ ID NO: 6662623 - DNA, 16 bp, Homo sapiens
atcactgagccatcat

SEQ ID NO: 6662624 - DNA, 16 bp, Homo sapiens
atcactgagttttcca

SEQ ID NO: 6662625 - DNA, 17 bp, Homo sapiens
atcactgagttttccat

SEQ ID NO: 6662626 - DNA, 15 bp, Homo sapiens
atcactgattccctc

SEQ ID NO: 6662627 - DNA, 20 bp, Homo sapiens
atcactgattccctctccca

SEQ ID NO: 6662628 - DNA, 20 bp, Homo sapiens
atcactgattgggtgccatg

SEQ ID NO: 6662629 - DNA, 16 bp, Homo sapiens
atcactgcacctcttt

SEQ ID NO: 6662630 - DNA, 22 bp, Homo sapiens
atcactgcattattctctttta

SEQ ID NO: 6662631 - DNA, 23 bp, Homo sapiens
atcactgcattcattctgagccc

SEQ ID NO: 6662632 - DNA, 11 bp, Homo sapiens
atcactgccaa

SEQ ID NO: 6662633 - DNA, 19 bp, Homo sapiens
atcactgccctttttgaaa

SEQ ID NO: 6662634 - DNA, 21 bp, Homo sapiens
atcactgccctttttgaaatc

SEQ ID NO: 6662635 - DNA, 22 bp, Homo sapiens
atcactgccctttttgaaatca

SEQ ID NO: 6662636 - DNA, 19 bp, Homo sapiens
atcactgccttcgtttata

SEQ ID NO: 6662637 - DNA, 15 bp, Homo sapiens
atcactgccttggcc

SEQ ID NO: 6662638 - DNA, 16 bp, Homo sapiens
atcactgctcacactg

SEQ ID NO: 6662639 - DNA, 14 bp, Homo sapiens
atcactgctccagg

SEQ ID NO: 6662640 - DNA, 15 bp, Homo sapiens
atcactgctgaagat

SEQ ID NO: 6662641 - DNA, 18 bp, Homo sapiens
atcactgctgtccctcct

SEQ ID NO: 6662642 - DNA, 21 bp, Homo sapiens
atcactgcttgatgaagcaag

SEQ ID NO: 6662643 - DNA, 17 bp, Homo sapiens
atcactggactgcatgg

SEQ ID NO: 6662644 - DNA, 17 bp, Homo sapiens
atcactggagcaccagg

SEQ ID NO: 6662645 - DNA, 19 bp, Homo sapiens
atcactggagcaccaggca

SEQ ID NO: 6662646 - DNA, 23 bp, Homo sapiens
atcactggagcaccaggcacgaa

SEQ ID NO: 6662647 - DNA, 16 bp, Homo sapiens
atcactggagcccagg

SEQ ID NO: 6662648 - DNA, 13 bp, Homo sapiens
atcactggatgaa

SEQ ID NO: 6662649 - DNA, 16 bp, Homo sapiens
atcactggcaatgaaa

SEQ ID NO: 6662650 - DNA, 23 bp, Homo sapiens
atcactggcaatgaaaaattctc

SEQ ID NO: 6662651 - DNA, 16 bp, Homo sapiens
atcactggcatggtgg

SEQ ID NO: 6662652 - DNA, 16 bp, Homo sapiens
atcactggctggcctg

SEQ ID NO: 6662653 - DNA, 19 bp, Homo sapiens
atcactggctggcctgagc

SEQ ID NO: 6662654 - DNA, 21 bp, Homo sapiens
atcactggctggcctgagcaa

SEQ ID NO: 6662655 - DNA, 16 bp, Homo sapiens
atcactgggcccagag

SEQ ID NO: 6662656 - DNA, 23 bp, Homo sapiens
atcactgggcccagaggagagga

SEQ ID NO: 6662657 - DNA, 21 bp, Homo sapiens
atcactggggtcacttgggaa

SEQ ID NO: 6662658 - DNA, 15 bp, Homo sapiens
atcactgtaaagaca

SEQ ID NO: 6662659 - DNA, 20 bp, Homo sapiens
atcactgtcaatatttttat

SEQ ID NO: 6662660 - DNA, 22 bp, Homo sapiens
atcactgtctagctgtttcaaa

SEQ ID NO: 6662661 - DNA, 12 bp, Homo sapiens
atcactgtgaaa

SEQ ID NO: 6662662 - DNA, 14 bp, Homo sapiens
atcactgtgaaatt

SEQ ID NO: 6662663 - DNA, 19 bp, Homo sapiens
atcactgtgaaatttcatg

SEQ ID NO: 6662664 - DNA, 22 bp, Homo sapiens
atcactgtgaaatttcatgatt

SEQ ID NO: 6662665 - DNA, 22 bp, Homo sapiens
atcactgtgcagttgctgttta

SEQ ID NO: 6662666 - DNA, 17 bp, Homo sapiens
atcactgtgctcagcca

SEQ ID NO: 6662667 - DNA, 23 bp, Homo sapiens
atcactgtgcttaatttaaatag

SEQ ID NO: 6662668 - DNA, 16 bp, Homo sapiens
atcactgttcatgctg

SEQ ID NO: 6662669 - DNA, 12 bp, Homo sapiens
atcactgttgag

SEQ ID NO: 6662670 - DNA, 21 bp, Homo sapiens
atcactgttgagttctgattg

SEQ ID NO: 6662671 - DNA, 17 bp, Homo sapiens
atcactgtttaaagctt

SEQ ID NO: 6662672 - DNA, 14 bp, Homo sapiens
atcactgtttagat

SEQ ID NO: 6662673 - DNA, 17 bp, Homo sapiens
atcactgtttagatttg

SEQ ID NO: 6662674 - DNA, 18 bp, Homo sapiens
atcactgtttagatttgc

SEQ ID NO: 6662675 - DNA, 22 bp, Homo sapiens
atcactgtttagatttgccata

SEQ ID NO: 6662676 - DNA, 12 bp, Homo sapiens
atcacttaaaac

SEQ ID NO: 6662677 - DNA, 19 bp, Homo sapiens
atcacttaaaggcacaaat

SEQ ID NO: 6662678 - DNA, 15 bp, Homo sapiens
atcacttacattttt

SEQ ID NO: 6662679 - DNA, 19 bp, Homo sapiens
atcacttcagatctctaat

SEQ ID NO: 6662680 - DNA, 17 bp, Homo sapiens
atcacttcatgttttgt

SEQ ID NO: 6662681 - DNA, 14 bp, Homo sapiens
atcacttctccccg

SEQ ID NO: 6662682 - DNA, 16 bp, Homo sapiens
atcacttctccccgca

SEQ ID NO: 6662683 - DNA, 18 bp, Homo sapiens
atcacttctgagaactca

SEQ ID NO: 6662684 - DNA, 15 bp, Homo sapiens
atcacttcttccact

SEQ ID NO: 6662685 - DNA, 17 bp, Homo sapiens
atcacttgaatcctagg

SEQ ID NO: 6662686 - DNA, 19 bp, Homo sapiens
atcacttgagacaaatcta

SEQ ID NO: 6662687 - DNA, 20 bp, Homo sapiens
atcacttgaggccaggactt

SEQ ID NO: 6662688 - DNA, 14 bp, Homo sapiens
atccccctctgtct

SEQ ID NO: 6662689 - DNA, 19 bp, Homo sapiens
atccccctctgtctgccct

SEQ ID NO: 6662690 - DNA, 20 bp, Homo sapiens
atccccctctgtctgccctc

SEQ ID NO: 6662691 - DNA, 15 bp, Homo sapiens
atccccctgccctcg

SEQ ID NO: 6662692 - DNA, 13 bp, Homo sapiens
atccccctgtgga

SEQ ID NO: 6662693 - DNA, 15 bp, Homo sapiens
atcccccttaaagaa

SEQ ID NO: 6662694 - DNA, 24 bp, Homo sapiens
atcccccttaaagaaaattgcatg

SEQ ID NO: 6662695 - DNA, 17 bp, Homo sapiens
atcccccttagaatgtt

SEQ ID NO: 6662696 - DNA, 21 bp, Homo sapiens
atcccccttcttcctcccctc

SEQ ID NO: 6662697 - DNA, 17 bp, Homo sapiens
atccccgacagtggctc

SEQ ID NO: 6662698 - DNA, 16 bp, Homo sapiens
atccccgaccccccta

SEQ ID NO: 6662699 - DNA, 16 bp, Homo sapiens
atccccgagggcgggg

SEQ ID NO: 6662700 - DNA, 18 bp, Homo sapiens
atccccgcagtgtgcact

SEQ ID NO: 6662701 - DNA, 22 bp, Homo sapiens
atccccgcttccccttgccacg

SEQ ID NO: 6662702 - DNA, 13 bp, Homo sapiens
atccccgtctctg

SEQ ID NO: 6662703 - DNA, 19 bp, Homo sapiens
atccccgtctctgccctgg

SEQ ID NO: 6662704 - DNA, 16 bp, Homo sapiens
atcccctagaaatcct

SEQ ID NO: 6662705 - DNA, 20 bp, Homo sapiens
atcccctagaaatcctggga

SEQ ID NO: 6662706 - DNA, 13 bp, Homo sapiens
atcccctcagcct

SEQ ID NO: 6662707 - DNA, 13 bp, Homo sapiens
atcccctcaggac

SEQ ID NO: 6662708 - DNA, 15 bp, Homo sapiens
atcccctccctgcct

SEQ ID NO: 6662709 - DNA, 20 bp, Homo sapiens
atcccctccctgcctgctcc

SEQ ID NO: 6662710 - DNA, 21 bp, Homo sapiens
atcccctccctgcctgctcct

SEQ ID NO: 6662711 - DNA, 17 bp, Homo sapiens
atcccctcgtcctgtcc

SEQ ID NO: 6662712 - DNA, 19 bp, Homo sapiens
atcccctcgtcctgtccca

SEQ ID NO: 6662713 - DNA, 17 bp, Homo sapiens
atcccctctcaggagag

SEQ ID NO: 6662714 - DNA, 21 bp, Homo sapiens
atcccctctctgtggctccaa

SEQ ID NO: 6662715 - DNA, 20 bp, Homo sapiens
atcccctctgtctacaaata

SEQ ID NO: 6662716 - DNA, 12 bp, Homo sapiens
atcccctgcctc

SEQ ID NO: 6662717 - DNA, 23 bp, Homo sapiens
atcccctgcctctatccctggcc

SEQ ID NO: 6662718 - DNA, 19 bp, Homo sapiens
atcccctgcggtcaggctg

SEQ ID NO: 6662719 - DNA, 18 bp, Homo sapiens
atcccctggactgggagg

SEQ ID NO: 6662720 - DNA, 18 bp, Homo sapiens
atcccctgtcccctgggg

SEQ ID NO: 6662721 - DNA, 21 bp, Homo sapiens
atcccctgtcccctggggctg

SEQ ID NO: 6662722 - DNA, 18 bp, Homo sapiens
atccccttagaggacctg

SEQ ID NO: 6662723 - DNA, 23 bp, Homo sapiens
atccccttccagctccctcccct

SEQ ID NO: 6662724 - DNA, 21 bp, Homo sapiens
atccccttcccccatccctac

SEQ ID NO: 6662725 - DNA, 22 bp, Homo sapiens
atcccctttattaattcattaa

SEQ ID NO: 6662726 - DNA, 19 bp, Homo sapiens
atcccctttcctccccacc

SEQ ID NO: 6662727 - DNA, 18 bp, Homo sapiens
atcccctttggttttact

SEQ ID NO: 6662728 - DNA, 21 bp, Homo sapiens
atcccgaagaatggagaggaa

SEQ ID NO: 6662729 - DNA, 17 bp, Homo sapiens
atcccgaagccatcact

SEQ ID NO: 6662730 - DNA, 20 bp, Homo sapiens
atcccgaagccatcacttct

SEQ ID NO: 6662731 - DNA, 23 bp, Homo sapiens
atcccgatacctcagccctggcc

SEQ ID NO: 6662732 - DNA, 15 bp, Homo sapiens
atcccgattcaccct

SEQ ID NO: 6662733 - DNA, 20 bp, Homo sapiens
atcccgattcaccctgtcca

SEQ ID NO: 6662734 - DNA, 14 bp, Homo sapiens
atcccgccttctcc

SEQ ID NO: 6662735 - DNA, 15 bp, Homo sapiens
atcccgctcctgctg

SEQ ID NO: 6662736 - DNA, 14 bp, Homo sapiens
atcccgcttagcct

SEQ ID NO: 6662737 - DNA, 17 bp, Homo sapiens
atcccgcttagcctgcc

SEQ ID NO: 6662738 - DNA, 19 bp, Homo sapiens
atcccgcttagcctgcctc

SEQ ID NO: 6662739 - DNA, 22 bp, Homo sapiens
atcccgcttagcctgcctcacc

SEQ ID NO: 6662740 - DNA, 17 bp, Homo sapiens
atcccggccggccctgg

SEQ ID NO: 6662741 - DNA, 23 bp, Homo sapiens
atcccggccggccctggcttgga

SEQ ID NO: 6662742 - DNA, 14 bp, Homo sapiens
atcccggcctcttc

SEQ ID NO: 6662743 - DNA, 16 bp, Homo sapiens
atcccggcctcttcca

SEQ ID NO: 6662744 - DNA, 20 bp, Homo sapiens
atcccggctgaccctgtgcc

SEQ ID NO: 6662745 - DNA, 15 bp, Homo sapiens
atcccggctgccctt

SEQ ID NO: 6662746 - DNA, 22 bp, Homo sapiens
atcccgggcctcagtgccccat

SEQ ID NO: 6662747 - DNA, 14 bp, Homo sapiens
atcccggggccatg

SEQ ID NO: 6662748 - DNA, 18 bp, Homo sapiens
atcccgggttcaagagat

SEQ ID NO: 6662749 - DNA, 22 bp, Homo sapiens
atcccgggtttggctgagcctg

SEQ ID NO: 6662750 - DNA, 16 bp, Homo sapiens
atcccggtttcagaag

SEQ ID NO: 6662751 - DNA, 17 bp, Homo sapiens
atcccggtttcagaagc

SEQ ID NO: 6662752 - DNA, 22 bp, Homo sapiens
atcccgtaagaccaccttccct

SEQ ID NO: 6662753 - DNA, 14 bp, Homo sapiens
atcccgtcttccag

SEQ ID NO: 6662754 - DNA, 20 bp, Homo sapiens
atcccgtgcccctttccttc

SEQ ID NO: 6662755 - DNA, 16 bp, Homo sapiens
atcccgtgttctcctt

SEQ ID NO: 6662756 - DNA, 17 bp, Homo sapiens
atcccgtttccctccag

SEQ ID NO: 6662757 - DNA, 16 bp, Homo sapiens
atcccgttttccccat

SEQ ID NO: 6662758 - DNA, 9 bp, Homo sapiens
atccctaac

SEQ ID NO: 6662759 - DNA, 15 bp, Homo sapiens
atccctaacatcatg

SEQ ID NO: 6662760 - DNA, 18 bp, Homo sapiens
atccctaatgtgtgccat

SEQ ID NO: 6662761 - DNA, 16 bp, Homo sapiens
atccctaattcttcat

SEQ ID NO: 6662762 - DNA, 15 bp, Homo sapiens
atccctacatgtatt

SEQ ID NO: 6662763 - DNA, 18 bp, Homo sapiens
atccctacatgtattgca

SEQ ID NO: 6662764 - DNA, 16 bp, Homo sapiens
atccctaccactgtgg

SEQ ID NO: 6662765 - DNA, 14 bp, Homo sapiens
atccctacccccta

SEQ ID NO: 6662766 - DNA, 21 bp, Homo sapiens
atccctagactttaggctttc

SEQ ID NO: 6662767 - DNA, 22 bp, Homo sapiens
atccctaggtcttgggagctct

SEQ ID NO: 6662768 - DNA, 20 bp, Homo sapiens
atccctatagaccactgggt

SEQ ID NO: 6662769 - DNA, 19 bp, Homo sapiens
atccctatgtcccagcccc

SEQ ID NO: 6662770 - DNA, 20 bp, Homo sapiens
atccctatgtcccagcccct

SEQ ID NO: 6662771 - DNA, 21 bp, Homo sapiens
atccctatgtcccagcccctg

SEQ ID NO: 6662772 - DNA, 17 bp, Homo sapiens
atccctatgtttgtctc

SEQ ID NO: 6662773 - DNA, 16 bp, Homo sapiens
atccctcaattgaatg

SEQ ID NO: 6662774 - DNA, 21 bp, Homo sapiens
atccctcacacatccagacat

SEQ ID NO: 6662775 - DNA, 21 bp, Homo sapiens
atccctcatcctcatacccac

SEQ ID NO: 6662776 - DNA, 17 bp, Homo sapiens
atccctcatttcattat

SEQ ID NO: 6662777 - DNA, 18 bp, Homo sapiens
atccctcccccccatgca

SEQ ID NO: 6662778 - DNA, 16 bp, Homo sapiens
atccctcccctcagcc

SEQ ID NO: 6662779 - DNA, 18 bp, Homo sapiens
atccctcccctcagcctc

SEQ ID NO: 6662780 - DNA, 19 bp, Homo sapiens
atccctccccttgccacat

SEQ ID NO: 6662781 - DNA, 20 bp, Homo sapiens
atccctccccttgccacatc

SEQ ID NO: 6662782 - DNA, 18 bp, Homo sapiens
atccctccctccacctcc

SEQ ID NO: 6662783 - DNA, 22 bp, Homo sapiens
atccctccctcccgtccttccc

SEQ ID NO: 6662784 - DNA, 13 bp, Homo sapiens
atccctccctgcc

SEQ ID NO: 6662785 - DNA, 15 bp, Homo sapiens
atccctccttaagag

SEQ ID NO: 6662786 - DNA, 22 bp, Homo sapiens
atccctcgggaagcagccagct

SEQ ID NO: 6662787 - DNA, 23 bp, Homo sapiens
atccctctaatgagactgaccat

SEQ ID NO: 6662788 - DNA, 22 bp, Homo sapiens
atccctctacagagcttccctg

SEQ ID NO: 6662789 - DNA, 13 bp, Homo sapiens
atccctctccact

SEQ ID NO: 6662790 - DNA, 14 bp, Homo sapiens
atccctctccactc

SEQ ID NO: 6662791 - DNA, 21 bp, Homo sapiens
atccctctccactcttctctc

SEQ ID NO: 6662792 - DNA, 23 bp, Homo sapiens
atccctctccactcttctctcct

SEQ ID NO: 6662793 - DNA, 24 bp, Homo sapiens
atccctctccactcttctctcctt

SEQ ID NO: 6662794 - DNA, 19 bp, Homo sapiens
atccctctcccccaggccc

SEQ ID NO: 6662795 - DNA, 14 bp, Homo sapiens
atccctctcctctg

SEQ ID NO: 6662796 - DNA, 19 bp, Homo sapiens
atccctctcctctgccctc

SEQ ID NO: 6662797 - DNA, 12 bp, Homo sapiens
atccctctcttc

SEQ ID NO: 6662798 - DNA, 20 bp, Homo sapiens
atccctctcttccccttccc

SEQ ID NO: 6662799 - DNA, 21 bp, Homo sapiens
atccctctgggggctctggcc

SEQ ID NO: 6662800 - DNA, 22 bp, Homo sapiens
atccctcttcctccaaagcctg

SEQ ID NO: 6662801 - DNA, 18 bp, Homo sapiens
atccctgaaacattgcat

SEQ ID NO: 6662802 - DNA, 19 bp, Homo sapiens
atccctgaacccctggcca

SEQ ID NO: 6662803 - DNA, 15 bp, Homo sapiens
atccctgaggactga

SEQ ID NO: 6662804 - DNA, 22 bp, Homo sapiens
atccctgaggactgatttcaga

SEQ ID NO: 6662805 - DNA, 16 bp, Homo sapiens
atccctgcacataaac

SEQ ID NO: 6662806 - DNA, 16 bp, Homo sapiens
atccctgcagaggaaa

SEQ ID NO: 6662807 - DNA, 16 bp, Homo sapiens
atccctgccaaaaagt

SEQ ID NO: 6662808 - DNA, 14 bp, Homo sapiens
atccctgccaagaa

SEQ ID NO: 6662809 - DNA, 15 bp, Homo sapiens
atccctgccactggg

SEQ ID NO: 6662810 - DNA, 17 bp, Homo sapiens
atccctgccactgggct

SEQ ID NO: 6662811 - DNA, 23 bp, Homo sapiens
atccctgccactgggctctggac

SEQ ID NO: 6662812 - DNA, 13 bp, Homo sapiens
atccctgcccagc

SEQ ID NO: 6662813 - DNA, 14 bp, Homo sapiens
atccctgcccagcc

SEQ ID NO: 6662814 - DNA, 18 bp, Homo sapiens
atccctgcccttctcaag

SEQ ID NO: 6662815 - DNA, 15 bp, Homo sapiens
atccctgcctcaggc

SEQ ID NO: 6662816 - DNA, 15 bp, Homo sapiens
atccctgcctggagg

SEQ ID NO: 6662817 - DNA, 16 bp, Homo sapiens
atccctgcctggaggc

SEQ ID NO: 6662818 - DNA, 12 bp, Homo sapiens
atccctgctctg

SEQ ID NO: 6662819 - DNA, 15 bp, Homo sapiens
atccctgctctggtc

SEQ ID NO: 6662820 - DNA, 17 bp, Homo sapiens
atccctggacttctggg

SEQ ID NO: 6662821 - DNA, 17 bp, Homo sapiens
atccctggagcaggagc

SEQ ID NO: 6662822 - DNA, 22 bp, Homo sapiens
atccctggagcaggagccccgc

SEQ ID NO: 6662823 - DNA, 11 bp, Homo sapiens
atccctggccc

SEQ ID NO: 6662824 - DNA, 21 bp, Homo sapiens
atccctggcttccccttcaga

SEQ ID NO: 6662825 - DNA, 14 bp, Homo sapiens
atccctgggcaagt

SEQ ID NO: 6662826 - DNA, 17 bp, Homo sapiens
atccctgggcattgctt

SEQ ID NO: 6662827 - DNA, 13 bp, Homo sapiens
atccctgggcctg

SEQ ID NO: 6662828 - DNA, 14 bp, Homo sapiens
atccctgggcctgc

SEQ ID NO: 6662829 - DNA, 16 bp, Homo sapiens
atccctgggcctgctg

SEQ ID NO: 6662830 - DNA, 17 bp, Homo sapiens
atccctgggcctgctgc

SEQ ID NO: 6662831 - DNA, 18 bp, Homo sapiens
atccctgggcctgctgct

SEQ ID NO: 6662832 - DNA, 20 bp, Homo sapiens
atccctgggcctgctgctga

SEQ ID NO: 6662833 - DNA, 12 bp, Homo sapiens
atccctgtgagg

SEQ ID NO: 6662834 - DNA, 18 bp, Homo sapiens
atccctgtgttgtctcta

SEQ ID NO: 6662835 - DNA, 12 bp, Homo sapiens
atccctgttcat

SEQ ID NO: 6662836 - DNA, 13 bp, Homo sapiens
atccctgttcatt

SEQ ID NO: 6662837 - DNA, 14 bp, Homo sapiens
atccctgtttaata

SEQ ID NO: 6662838 - DNA, 15 bp, Homo sapiens
atccctgtttaatat

SEQ ID NO: 6662839 - DNA, 16 bp, Homo sapiens
atccctgtttaatatt

SEQ ID NO: 6662840 - DNA, 17 bp, Homo sapiens
atccctgtttaatattt

SEQ ID NO: 6662841 - DNA, 20 bp, Homo sapiens
atccctgtttaatatttaaa

SEQ ID NO: 6662842 - DNA, 15 bp, Homo sapiens
atcccttaagaagtt

SEQ ID NO: 6662843 - DNA, 21 bp, Homo sapiens
atcccttaagaatgagtttct

SEQ ID NO: 6662844 - DNA, 21 bp, Homo sapiens
atcccttaatatcctaaacat

SEQ ID NO: 6662845 - DNA, 15 bp, Homo sapiens
atcccttaatctatg

SEQ ID NO: 6662846 - DNA, 22 bp, Homo sapiens
atcccttactttaaccctttct

SEQ ID NO: 6662847 - DNA, 18 bp, Homo sapiens
atcccttatccaaaatgc

SEQ ID NO: 6662848 - DNA, 14 bp, Homo sapiens
atcccttcatatca

SEQ ID NO: 6662849 - DNA, 17 bp, Homo sapiens
atcccttcctccccagt

SEQ ID NO: 6662850 - DNA, 15 bp, Homo sapiens
atcccttcctcctct

SEQ ID NO: 6662851 - DNA, 21 bp, Homo sapiens
atcccttcctcctctcctgga

SEQ ID NO: 6662852 - DNA, 14 bp, Homo sapiens
atcccttcctggaa

SEQ ID NO: 6662853 - DNA, 21 bp, Homo sapiens
atcccttcctggaaacagcat

SEQ ID NO: 6662854 - DNA, 15 bp, Homo sapiens
atcccttcctgtctg

SEQ ID NO: 6662855 - DNA, 19 bp, Homo sapiens
atcccttccttttagccta

SEQ ID NO: 6662856 - DNA, 23 bp, Homo sapiens
atcccttctaggcatctcctctc

SEQ ID NO: 6662857 - DNA, 17 bp, Homo sapiens
atcccttctcacagcac

SEQ ID NO: 6662858 - DNA, 14 bp, Homo sapiens
atcccttctcagaa

SEQ ID NO: 6662859 - DNA, 17 bp, Homo sapiens
atcccttctcctgccct

SEQ ID NO: 6662860 - DNA, 13 bp, Homo sapiens
atcccttctcttc

SEQ ID NO: 6662861 - DNA, 14 bp, Homo sapiens
atcccttctcttcc

SEQ ID NO: 6662862 - DNA, 17 bp, Homo sapiens
atcccttctcttccagg

SEQ ID NO: 6662863 - DNA, 22 bp, Homo sapiens
atcccttctcttccaggcagcc

SEQ ID NO: 6662864 - DNA, 17 bp, Homo sapiens
atcccttggacatttta

SEQ ID NO: 6662865 - DNA, 21 bp, Homo sapiens
atcccttggacattttatgtc

SEQ ID NO: 6662866 - DNA, 18 bp, Homo sapiens
atcccttggcccctctct

SEQ ID NO: 6662867 - DNA, 13 bp, Homo sapiens
atccctttattac

SEQ ID NO: 6662868 - DNA, 17 bp, Homo sapiens
atccctttcctggtttc

SEQ ID NO: 6662869 - DNA, 18 bp, Homo sapiens
atccctttctaagcagga

SEQ ID NO: 6662870 - DNA, 23 bp, Homo sapiens
atccctttctctcttgtccaatg

SEQ ID NO: 6662871 - DNA, 17 bp, Homo sapiens
atccctttctcttctga

SEQ ID NO: 6662872 - DNA, 13 bp, Homo sapiens
atccctttgcaac

SEQ ID NO: 6662873 - DNA, 22 bp, Homo sapiens
atccctttgtctgtcaatcaca

SEQ ID NO: 6662874 - DNA, 23 bp, Homo sapiens
atcccttttcctgtcagtgtttt

SEQ ID NO: 6662875 - DNA, 21 bp, Homo sapiens
atcccttttcctttctggccc

SEQ ID NO: 6662876 - DNA, 13 bp, Homo sapiens
atccgaagggaat

SEQ ID NO: 6662877 - DNA, 15 bp, Homo sapiens
atccgaagggaatta

SEQ ID NO: 6662878 - DNA, 16 bp, Homo sapiens
atccgactctaagctg

SEQ ID NO: 6662879 - DNA, 19 bp, Homo sapiens
atccgactctaagctgtgt

SEQ ID NO: 6662880 - DNA, 13 bp, Homo sapiens
atccgagcgacgg

SEQ ID NO: 6662881 - DNA, 18 bp, Homo sapiens
atccgagggcccctctcc

SEQ ID NO: 6662882 - DNA, 20 bp, Homo sapiens
atccgcaacccatgccctgg

SEQ ID NO: 6662883 - DNA, 22 bp, Homo sapiens
atccgcatccagccgtgctgag

SEQ ID NO: 6662884 - DNA, 12 bp, Homo sapiens
atccgcatgtgt

SEQ ID NO: 6662885 - DNA, 13 bp, Homo sapiens
atccgcatgtgtc

SEQ ID NO: 6662886 - DNA, 15 bp, Homo sapiens
atccgccagggccca

SEQ ID NO: 6662887 - DNA, 16 bp, Homo sapiens
atccgccagtgtttct

SEQ ID NO: 6662888 - DNA, 19 bp, Homo sapiens
atccgcccacctcagcctc

SEQ ID NO: 6662889 - DNA, 20 bp, Homo sapiens
atccgcccacctcagcctcc

SEQ ID NO: 6662890 - DNA, 20 bp, Homo sapiens
atccgcccgcctctgcctcc

SEQ ID NO: 6662891 - DNA, 12 bp, Homo sapiens
atccgccctggg

SEQ ID NO: 6662892 - DNA, 19 bp, Homo sapiens
atccgccctgggctctggg

SEQ ID NO: 6662893 - DNA, 19 bp, Homo sapiens
atccgcctacctcagcctc

SEQ ID NO: 6662894 - DNA, 14 bp, Homo sapiens
atccgcctctgagc

SEQ ID NO: 6662895 - DNA, 21 bp, Homo sapiens
atccgcctctgagccaggagc

SEQ ID NO: 6662896 - DNA, 13 bp, Homo sapiens
atccgcctgcctc

SEQ ID NO: 6662897 - DNA, 14 bp, Homo sapiens
atccgcctgcctct

SEQ ID NO: 6662898 - DNA, 18 bp, Homo sapiens
atccgcctgcctctgcct

SEQ ID NO: 6662899 - DNA, 15 bp, Homo sapiens
atccgcctggcccgg

SEQ ID NO: 6662900 - DNA, 18 bp, Homo sapiens
atccgccttttgtataca

SEQ ID NO: 6662901 - DNA, 15 bp, Homo sapiens
atccgcgtgtgcctg

SEQ ID NO: 6662902 - DNA, 12 bp, Homo sapiens
atccgctctctt

SEQ ID NO: 6662903 - DNA, 14 bp, Homo sapiens
atccgctctcttcc

SEQ ID NO: 6662904 - DNA, 20 bp, Homo sapiens
atccgctctcttcctgcccc

SEQ ID NO: 6662905 - DNA, 12 bp, Homo sapiens
atccgctgccac

SEQ ID NO: 6662906 - DNA, 13 bp, Homo sapiens
atccgctgccacc

SEQ ID NO: 6662907 - DNA, 23 bp, Homo sapiens
atccgctggccgggggaggtggg

SEQ ID NO: 6662908 - DNA, 15 bp, Homo sapiens
atccgcttctcctgc

SEQ ID NO: 6662909 - DNA, 21 bp, Homo sapiens
atccgcttctcctgcagtgga

SEQ ID NO: 6662910 - DNA, 16 bp, Homo sapiens
atccggaacagccaaa

SEQ ID NO: 6662911 - DNA, 22 bp, Homo sapiens
atccggaacagccaaagaaact

SEQ ID NO: 6662912 - DNA, 14 bp, Homo sapiens
atccggagaagctg

SEQ ID NO: 6662913 - DNA, 15 bp, Homo sapiens
atccggcagcctgga

SEQ ID NO: 6662914 - DNA, 20 bp, Homo sapiens
atccggcccccagagcgccc

SEQ ID NO: 6662915 - DNA, 21 bp, Homo sapiens
atccggctgctcctccagccc

SEQ ID NO: 6662916 - DNA, 14 bp, Homo sapiens
atccgggacgcttc

SEQ ID NO: 6662917 - DNA, 19 bp, Homo sapiens
atccgggacgcttccagac

SEQ ID NO: 6662918 - DNA, 23 bp, Homo sapiens
atccggtttagtcatccaacaag

SEQ ID NO: 6662919 - DNA, 12 bp, Homo sapiens
atccggtttctt

SEQ ID NO: 6662920 - DNA, 20 bp, Homo sapiens
atccggttttagttgagtct

SEQ ID NO: 6662921 - DNA, 18 bp, Homo sapiens
atccgtaggacaagtttt

SEQ ID NO: 6662922 - DNA, 16 bp, Homo sapiens
atccgtcattgctgct

SEQ ID NO: 6662923 - DNA, 17 bp, Homo sapiens
atccgtcattgctgctg

SEQ ID NO: 6662924 - DNA, 15 bp, Homo sapiens
atccgtcccacatca

SEQ ID NO: 6662925 - DNA, 13 bp, Homo sapiens
atccgtcctgggc

SEQ ID NO: 6662926 - DNA, 14 bp, Homo sapiens
atccgtcctgggcg

SEQ ID NO: 6662927 - DNA, 21 bp, Homo sapiens
atccgtctttggcctcctcca

SEQ ID NO: 6662928 - DNA, 16 bp, Homo sapiens
atccgtgaattgcttt

SEQ ID NO: 6662929 - DNA, 22 bp, Homo sapiens
atccgtgagcagtgtgtctcct

SEQ ID NO: 6662930 - DNA, 13 bp, Homo sapiens
atccgtgttgcag

SEQ ID NO: 6662931 - DNA, 23 bp, Homo sapiens
atccgttcccttctgccacctgc

SEQ ID NO: 6662932 - DNA, 14 bp, Homo sapiens
atccgttttttaag

SEQ ID NO: 6662933 - DNA, 14 bp, Homo sapiens
atcctaaaacaaat

SEQ ID NO: 6662934 - DNA, 14 bp, Homo sapiens
atcctaaactctct

SEQ ID NO: 6662935 - DNA, 16 bp, Homo sapiens
atcctaaagaacaaag

SEQ ID NO: 6662936 - DNA, 18 bp, Homo sapiens
atcctaaagaacaaagta

SEQ ID NO: 6662937 - DNA, 14 bp, Homo sapiens
atcctaactgagaa

SEQ ID NO: 6662938 - DNA, 14 bp, Homo sapiens
atcctaagaaatat

SEQ ID NO: 6662939 - DNA, 16 bp, Homo sapiens
atcctaagaaatatgt

SEQ ID NO: 6662940 - DNA, 19 bp, Homo sapiens
atcctaagaaatatgtgag

SEQ ID NO: 6662941 - DNA, 20 bp, Homo sapiens
atcctaagaaatatgtgaga

SEQ ID NO: 6662942 - DNA, 21 bp, Homo sapiens
atcctaagaaatatgtgagat

SEQ ID NO: 6662943 - DNA, 13 bp, Homo sapiens
atcctaagaattt

SEQ ID NO: 6662944 - DNA, 20 bp, Homo sapiens
atcctaagacacaaatgcat

SEQ ID NO: 6662945 - DNA, 21 bp, Homo sapiens
atcctaagctattcagtaata

SEQ ID NO: 6662946 - DNA, 22 bp, Homo sapiens
atcctaagggaagataaagatg

SEQ ID NO: 6662947 - DNA, 18 bp, Homo sapiens
atcctaagggtcgaaagc

SEQ ID NO: 6662948 - DNA, 23 bp, Homo sapiens
atcctaaggttcttgctttctct

SEQ ID NO: 6662949 - DNA, 19 bp, Homo sapiens
atcctaatcatccaatgct

SEQ ID NO: 6662950 - DNA, 17 bp, Homo sapiens
atcctaattgtccacat

SEQ ID NO: 6662951 - DNA, 19 bp, Homo sapiens
atcctaatttctcctccct

SEQ ID NO: 6662952 - DNA, 18 bp, Homo sapiens
atcctacaagacacagtg

SEQ ID NO: 6662953 - DNA, 16 bp, Homo sapiens
atcctacaatatttta

SEQ ID NO: 6662954 - DNA, 18 bp, Homo sapiens
atcctacaatattttatt

SEQ ID NO: 6662955 - DNA, 14 bp, Homo sapiens
atcctacagtacaa

SEQ ID NO: 6662956 - DNA, 13 bp, Homo sapiens
atcctacagtgaa

SEQ ID NO: 6662957 - DNA, 14 bp, Homo sapiens
atcctacagtgaaa

SEQ ID NO: 6662958 - DNA, 21 bp, Homo sapiens
atcctacagtgaaatgagcag

SEQ ID NO: 6662959 - DNA, 12 bp, Homo sapiens
atcctaccaaag

SEQ ID NO: 6662960 - DNA, 16 bp, Homo sapiens
atcctaccaatgcatg

SEQ ID NO: 6662961 - DNA, 17 bp, Homo sapiens
atcctaccaatgcatgc

SEQ ID NO: 6662962 - DNA, 21 bp, Homo sapiens
atcctaccacaatgcagtgcc

SEQ ID NO: 6662963 - DNA, 22 bp, Homo sapiens
atcctaccacaatgcagtgcct

SEQ ID NO: 6662964 - DNA, 21 bp, Homo sapiens
atcctaccccaattccttgta

SEQ ID NO: 6662965 - DNA, 17 bp, Homo sapiens
atcctaccttttgataa

SEQ ID NO: 6662966 - DNA, 21 bp, Homo sapiens
atcctacgagtaattgcattt

SEQ ID NO: 6662967 - DNA, 24 bp, Homo sapiens
atcctacgagtaattgcatttgct

SEQ ID NO: 6662968 - DNA, 21 bp, Homo sapiens
atcctactaagaagtttaagt

SEQ ID NO: 6662969 - DNA, 17 bp, Homo sapiens
atcctactaataaacca

SEQ ID NO: 6662970 - DNA, 16 bp, Homo sapiens
atcctagaaccaagct

SEQ ID NO: 6662971 - DNA, 21 bp, Homo sapiens
atcctagaaccaagcttcaga

SEQ ID NO: 6662972 - DNA, 13 bp, Homo sapiens
atcctagacttga

SEQ ID NO: 6662973 - DNA, 15 bp, Homo sapiens
atcctagacttgaaa

SEQ ID NO: 6662974 - DNA, 21 bp, Homo sapiens
atcctagagatttggtgtaca

SEQ ID NO: 6662975 - DNA, 18 bp, Homo sapiens
atcctagaggtagagaaa

SEQ ID NO: 6662976 - DNA, 19 bp, Homo sapiens
atcctagaggtagagaaac

SEQ ID NO: 6662977 - DNA, 17 bp, Homo sapiens
atcctagattatatcaa

SEQ ID NO: 6662978 - DNA, 16 bp, Homo sapiens
atcctagcacatgctt

SEQ ID NO: 6662979 - DNA, 19 bp, Homo sapiens
atcctagcaggagagaggc

SEQ ID NO: 6662980 - DNA, 16 bp, Homo sapiens
atcctagccccgagac

SEQ ID NO: 6662981 - DNA, 21 bp, Homo sapiens
atcctagccttatcctctgat

SEQ ID NO: 6662982 - DNA, 23 bp, Homo sapiens
atcctagccttatcctctgatct

SEQ ID NO: 6662983 - DNA, 14 bp, Homo sapiens
atcctagctgtgtg

SEQ ID NO: 6662984 - DNA, 15 bp, Homo sapiens
atcctagctgtgtgc

SEQ ID NO: 6662985 - DNA, 19 bp, Homo sapiens
atcctagctgtgtgcagtc

SEQ ID NO: 6662986 - DNA, 22 bp, Homo sapiens
atcctaggcatctgctgtaata

SEQ ID NO: 6662987 - DNA, 21 bp, Homo sapiens
atcctaggcatttgctgaata

SEQ ID NO: 6662988 - DNA, 18 bp, Homo sapiens
atcctaggcttaaatgca

SEQ ID NO: 6662989 - DNA, 13 bp, Homo sapiens
atcctagggcctg

SEQ ID NO: 6662990 - DNA, 15 bp, Homo sapiens
atcctaggtgctgga

SEQ ID NO: 6662991 - DNA, 16 bp, Homo sapiens
atcctagtcttcacaa

SEQ ID NO: 6662992 - DNA, 13 bp, Homo sapiens
atcctagtgcttt

SEQ ID NO: 6662993 - DNA, 13 bp, Homo sapiens
atcctagtgggca

SEQ ID NO: 6662994 - DNA, 16 bp, Homo sapiens
atcctataaagaaacg

SEQ ID NO: 6662995 - DNA, 13 bp, Homo sapiens
atcctataaatgt

SEQ ID NO: 6662996 - DNA, 21 bp, Homo sapiens
atcctataagatgacaatgtt

SEQ ID NO: 6662997 - DNA, 13 bp, Homo sapiens
atcctatatagaa

SEQ ID NO: 6662998 - DNA, 20 bp, Homo sapiens
atcctatatagaatgctgca

SEQ ID NO: 6662999 - DNA, 18 bp, Homo sapiens
atcctatatctgtttgta

SEQ ID NO: 6663000 - DNA, 21 bp, Homo sapiens
atcctatctctccaaccagat

SEQ ID NO: 6663001 - DNA, 21 bp, Homo sapiens
atcctatctggggagctcctg

SEQ ID NO: 6663002 - DNA, 16 bp, Homo sapiens
atcctatgtgatttta

SEQ ID NO: 6663003 - DNA, 23 bp, Homo sapiens
atcctatgtgattttaactctgt

SEQ ID NO: 6663004 - DNA, 21 bp, Homo sapiens
atcctattaaaacacagcttt

SEQ ID NO: 6663005 - DNA, 18 bp, Homo sapiens
atcctattacttttcatc

SEQ ID NO: 6663006 - DNA, 22 bp, Homo sapiens
atcctatttaaagacctgacag

SEQ ID NO: 6663007 - DNA, 22 bp, Homo sapiens
atcctatttttgtagatctcca

SEQ ID NO: 6663008 - DNA, 16 bp, Homo sapiens
atcctcaaacacacaa

SEQ ID NO: 6663009 - DNA, 16 bp, Homo sapiens
atcctcaaacactgca

SEQ ID NO: 6663010 - DNA, 18 bp, Homo sapiens
atcctcaaacatggaaga

SEQ ID NO: 6663011 - DNA, 15 bp, Homo sapiens
atcctcaaagaaagt

SEQ ID NO: 6663012 - DNA, 18 bp, Homo sapiens
atcctcaaagaaagtgta

SEQ ID NO: 6663013 - DNA, 19 bp, Homo sapiens
atcctcaaagaaagtgtat

SEQ ID NO: 6663014 - DNA, 17 bp, Homo sapiens
atcctcaacactattgt

SEQ ID NO: 6663015 - DNA, 18 bp, Homo sapiens
atcctcaagttgtgtgct

SEQ ID NO: 6663016 - DNA, 16 bp, Homo sapiens
atcctcacaggagcag

SEQ ID NO: 6663017 - DNA, 23 bp, Homo sapiens
atcctcacaggagcagacagaga

SEQ ID NO: 6663018 - DNA, 20 bp, Homo sapiens
atcctcactgggctcactgc

SEQ ID NO: 6663019 - DNA, 22 bp, Homo sapiens
atcctcagaaagtgcagcatgg

SEQ ID NO: 6663020 - DNA, 19 bp, Homo sapiens
atcctcagaggctgagccc

SEQ ID NO: 6663021 - DNA, 12 bp, Homo sapiens
atcctcagcaag

SEQ ID NO: 6663022 - DNA, 19 bp, Homo sapiens
atcctcagccccagggccc

SEQ ID NO: 6663023 - DNA, 22 bp, Homo sapiens
atcctcagccccagggccctgc

SEQ ID NO: 6663024 - DNA, 20 bp, Homo sapiens
atcctcagccgagaaattgg

SEQ ID NO: 6663025 - DNA, 22 bp, Homo sapiens
atcctcaggtagtactgggaat

SEQ ID NO: 6663026 - DNA, 19 bp, Homo sapiens
atcctcagtgcaaaatgtc

SEQ ID NO: 6663027 - DNA, 22 bp, Homo sapiens
atcctcagtgcaaaatgtcttg

SEQ ID NO: 6663028 - DNA, 23 bp, Homo sapiens
atcctcagtgcaaaatgtcttgt

SEQ ID NO: 6663029 - DNA, 14 bp, Homo sapiens
atcctcagttcctg

SEQ ID NO: 6663030 - DNA, 17 bp, Homo sapiens
atcctcagttctcaaat

SEQ ID NO: 6663031 - DNA, 18 bp, Homo sapiens
atcctcatacccaccccc

SEQ ID NO: 6663032 - DNA, 16 bp, Homo sapiens
atcctcatccctgact

SEQ ID NO: 6663033 - DNA, 23 bp, Homo sapiens
atcctcatcgggctttgtccctc

SEQ ID NO: 6663034 - DNA, 13 bp, Homo sapiens
atcctcatctctc

SEQ ID NO: 6663035 - DNA, 14 bp, Homo sapiens
atcctcattcacta

SEQ ID NO: 6663036 - DNA, 19 bp, Homo sapiens
atcctccaaccaggctcct

SEQ ID NO: 6663037 - DNA, 23 bp, Homo sapiens
atcctccaacttcatttgatgct

SEQ ID NO: 6663038 - DNA, 16 bp, Homo sapiens
atcctccaatgtctaa

SEQ ID NO: 6663039 - DNA, 18 bp, Homo sapiens
atcctccaattccacagt

SEQ ID NO: 6663040 - DNA, 13 bp, Homo sapiens
atcctccacagag

SEQ ID NO: 6663041 - DNA, 20 bp, Homo sapiens
atcctccacatcctgtgtca

SEQ ID NO: 6663042 - DNA, 19 bp, Homo sapiens
atcctccacgttctgctca

SEQ ID NO: 6663043 - DNA, 11 bp, Homo sapiens
atcctccagca

SEQ ID NO: 6663044 - DNA, 15 bp, Homo sapiens
atcctccagcaggga

SEQ ID NO: 6663045 - DNA, 14 bp, Homo sapiens
atcctccagccctg

SEQ ID NO: 6663046 - DNA, 11 bp, Homo sapiens
atcctccagct

SEQ ID NO: 6663047 - DNA, 13 bp, Homo sapiens
atcctccagcttc

SEQ ID NO: 6663048 - DNA, 13 bp, Homo sapiens
atcctccagggct

SEQ ID NO: 6663049 - DNA, 22 bp, Homo sapiens
atcctccagggggcctgcaggc

SEQ ID NO: 6663050 - DNA, 19 bp, Homo sapiens
atcctccaggtgcacaagc

SEQ ID NO: 6663051 - DNA, 14 bp, Homo sapiens
atcctccaggtttt

SEQ ID NO: 6663052 - DNA, 16 bp, Homo sapiens
atcctccaggtttttc

SEQ ID NO: 6663053 - DNA, 19 bp, Homo sapiens
atcctccaggtttttcaat

SEQ ID NO: 6663054 - DNA, 21 bp, Homo sapiens
atcctccagtaccttgcttct

SEQ ID NO: 6663055 - DNA, 22 bp, Homo sapiens
atcctccatgggggctcagcca

SEQ ID NO: 6663056 - DNA, 17 bp, Homo sapiens
atcctcccattgcccag

SEQ ID NO: 6663057 - DNA, 20 bp, Homo sapiens
atcctcccattgcccagtga

SEQ ID NO: 6663058 - DNA, 18 bp, Homo sapiens
atcctccccaccagagct

SEQ ID NO: 6663059 - DNA, 20 bp, Homo sapiens
atcctccccaccagagctgc

SEQ ID NO: 6663060 - DNA, 21 bp, Homo sapiens
atcctccccaccagagctgcc

SEQ ID NO: 6663061 - DNA, 18 bp, Homo sapiens
atcctccccgctctgccg

SEQ ID NO: 6663062 - DNA, 16 bp, Homo sapiens
atcctcccctggactc

SEQ ID NO: 6663063 - DNA, 13 bp, Homo sapiens
atcctccccttcc

SEQ ID NO: 6663064 - DNA, 18 bp, Homo sapiens
atcctccccttccctgca

SEQ ID NO: 6663065 - DNA, 19 bp, Homo sapiens
atcctcccggctccctcct

SEQ ID NO: 6663066 - DNA, 15 bp, Homo sapiens
atcctccctatcaag

SEQ ID NO: 6663067 - DNA, 14 bp, Homo sapiens
atcctccctccccc

SEQ ID NO: 6663068 - DNA, 12 bp, Homo sapiens
atcctccctgcc

SEQ ID NO: 6663069 - DNA, 11 bp, Homo sapiens
atcctccctgt

SEQ ID NO: 6663070 - DNA, 16 bp, Homo sapiens
atcctccctgtaactt

SEQ ID NO: 6663071 - DNA, 17 bp, Homo sapiens
atcctcccttcccagga

SEQ ID NO: 6663072 - DNA, 16 bp, Homo sapiens
atcctcccttgcccca

SEQ ID NO: 6663073 - DNA, 21 bp, Homo sapiens
atcctccgcggaggcccctga

SEQ ID NO: 6663074 - DNA, 22 bp, Homo sapiens
atcctccgcggaggcccctgag

SEQ ID NO: 6663075 - DNA, 19 bp, Homo sapiens
atcctcctaaagacctcca

SEQ ID NO: 6663076 - DNA, 22 bp, Homo sapiens
atcctcctacctcagcctcctg

SEQ ID NO: 6663077 - DNA, 20 bp, Homo sapiens
atcctcctacctccaaagct

SEQ ID NO: 6663078 - DNA, 11 bp, Homo sapiens
atcctcctcag

SEQ ID NO: 6663079 - DNA, 23 bp, Homo sapiens
atcctcctcagcccccaggccag

SEQ ID NO: 6663080 - DNA, 11 bp, Homo sapiens
atcctcctcat

SEQ ID NO: 6663081 - DNA, 15 bp, Homo sapiens
atcctcctccccagc

SEQ ID NO: 6663082 - DNA, 23 bp, Homo sapiens
atcctcctccccagctcttctct

SEQ ID NO: 6663083 - DNA, 14 bp, Homo sapiens
atcctcctcctcat

SEQ ID NO: 6663084 - DNA, 16 bp, Homo sapiens
atcctcctcctcattc

SEQ ID NO: 6663085 - DNA, 22 bp, Homo sapiens
atcctcctcctcattcagacca

SEQ ID NO: 6663086 - DNA, 22 bp, Homo sapiens
atcctcctcctggactcccctc

SEQ ID NO: 6663087 - DNA, 13 bp, Homo sapiens
atcctcctccttc

SEQ ID NO: 6663088 - DNA, 17 bp, Homo sapiens
atcctcctccttcctag

SEQ ID NO: 6663089 - DNA, 12 bp, Homo sapiens
atcctcctctcc

SEQ ID NO: 6663090 - DNA, 18 bp, Homo sapiens
atcctcctctccatgcaa

SEQ ID NO: 6663091 - DNA, 20 bp, Homo sapiens
atcctcctctccatgcaagt

SEQ ID NO: 6663092 - DNA, 12 bp, Homo sapiens
atcctcctgagt

SEQ ID NO: 6663093 - DNA, 17 bp, Homo sapiens
atcctcctgcccagctc

SEQ ID NO: 6663094 - DNA, 20 bp, Homo sapiens
atcctcctgcccagctcctc

SEQ ID NO: 6663095 - DNA, 21 bp, Homo sapiens
atcctcctgcccagctcctca

SEQ ID NO: 6663096 - DNA, 22 bp, Homo sapiens
atcctcctgcccagctcctcac

SEQ ID NO: 6663097 - DNA, 18 bp, Homo sapiens
atcctcctgcccccaccc

SEQ ID NO: 6663098 - DNA, 19 bp, Homo sapiens
atcctcctgcccccacccc

SEQ ID NO: 6663099 - DNA, 15 bp, Homo sapiens
atcctcctgcctcag

SEQ ID NO: 6663100 - DNA, 17 bp, Homo sapiens
atcctcctggacccagc

SEQ ID NO: 6663101 - DNA, 20 bp, Homo sapiens
atcctcctggacccagcagg

SEQ ID NO: 6663102 - DNA, 14 bp, Homo sapiens
atcctcctgttctg

SEQ ID NO: 6663103 - DNA, 17 bp, Homo sapiens
atcctccttccaggccc

SEQ ID NO: 6663104 - DNA, 21 bp, Homo sapiens
atcctccttctcctgttccat

SEQ ID NO: 6663105 - DNA, 16 bp, Homo sapiens
atcctcgctcccggga

SEQ ID NO: 6663106 - DNA, 22 bp, Homo sapiens
atcctctacggttatttcctgc

SEQ ID NO: 6663107 - DNA, 16 bp, Homo sapiens
atcctctactgtgcat

SEQ ID NO: 6663108 - DNA, 23 bp, Homo sapiens
atcctctataattagttatgaca

SEQ ID NO: 6663109 - DNA, 13 bp, Homo sapiens
atcctctatgtgg

SEQ ID NO: 6663110 - DNA, 14 bp, Homo sapiens
atcctctattttgt

SEQ ID NO: 6663111 - DNA, 15 bp, Homo sapiens
atcctctccactcca

SEQ ID NO: 6663112 - DNA, 15 bp, Homo sapiens
atcctctcctttctt

SEQ ID NO: 6663113 - DNA, 15 bp, Homo sapiens
atcctctcctttgaa

SEQ ID NO: 6663114 - DNA, 23 bp, Homo sapiens
atcctctcgccaagccatcacag

SEQ ID NO: 6663115 - DNA, 17 bp, Homo sapiens
atcctctcgttcagttt

SEQ ID NO: 6663116 - DNA, 10 bp, Homo sapiens
atcctctctc

SEQ ID NO: 6663117 - DNA, 18 bp, Homo sapiens
atcctctctcccctctgc

SEQ ID NO: 6663118 - DNA, 11 bp, Homo sapiens
atcctctctct

SEQ ID NO: 6663119 - DNA, 16 bp, Homo sapiens
atcctctctctcttct

SEQ ID NO: 6663120 - DNA, 17 bp, Homo sapiens
atcctctcttcctcttc

SEQ ID NO: 6663121 - DNA, 20 bp, Homo sapiens
atcctctcttcctcttcccc

SEQ ID NO: 6663122 - DNA, 21 bp, Homo sapiens
atcctctcttcttttcccatt

SEQ ID NO: 6663123 - DNA, 22 bp, Homo sapiens
atcctctgctggttcctgactg

SEQ ID NO: 6663124 - DNA, 23 bp, Homo sapiens
atcctctgcttgtcattctgcta

SEQ ID NO: 6663125 - DNA, 17 bp, Homo sapiens
atcctctggagccagcc

SEQ ID NO: 6663126 - DNA, 19 bp, Homo sapiens
atcctctggttcttcattt

SEQ ID NO: 6663127 - DNA, 20 bp, Homo sapiens
atcctctgtaaactttttgt

SEQ ID NO: 6663128 - DNA, 14 bp, Homo sapiens
atcctctgttaatg

SEQ ID NO: 6663129 - DNA, 13 bp, Homo sapiens
atcctcttcctct

SEQ ID NO: 6663130 - DNA, 14 bp, Homo sapiens
atcctcttcctctg

SEQ ID NO: 6663131 - DNA, 19 bp, Homo sapiens
atcctcttcctctgaggct

SEQ ID NO: 6663132 - DNA, 19 bp, Homo sapiens
atcctcttctcaaagctgg

SEQ ID NO: 6663133 - DNA, 20 bp, Homo sapiens
atcctcttctcaaagctggg

SEQ ID NO: 6663134 - DNA, 22 bp, Homo sapiens
atcctcttctgcttaggagaga

SEQ ID NO: 6663135 - DNA, 15 bp, Homo sapiens
atcctcttgccacat

SEQ ID NO: 6663136 - DNA, 18 bp, Homo sapiens
atcctcttgccacatctt

SEQ ID NO: 6663137 - DNA, 22 bp, Homo sapiens
atcctcttgccacatcttgaaa

SEQ ID NO: 6663138 - DNA, 16 bp, Homo sapiens
atcctcttgctatata

SEQ ID NO: 6663139 - DNA, 19 bp, Homo sapiens
atcctctttactctgggca

SEQ ID NO: 6663140 - DNA, 18 bp, Homo sapiens
atcctctttccccactga

SEQ ID NO: 6663141 - DNA, 12 bp, Homo sapiens
atcctctttgta

SEQ ID NO: 6663142 - DNA, 22 bp, Homo sapiens
atcctctttgtaatttaatgaa

SEQ ID NO: 6663143 - DNA, 18 bp, Homo sapiens
atcctcttttaatggcat

SEQ ID NO: 6663144 - DNA, 23 bp, Homo sapiens
atcctcttttaatggcatttctc

SEQ ID NO: 6663145 - DNA, 14 bp, Homo sapiens
atcctctttttcca

SEQ ID NO: 6663146 - DNA, 22 bp, Homo sapiens
atcctgaaagccagcaaagcct

SEQ ID NO: 6663147 - DNA, 19 bp, Homo sapiens
atcctgaacaagaaagagt

SEQ ID NO: 6663148 - DNA, 20 bp, Homo sapiens
atcctgaactttctccctca

SEQ ID NO: 6663149 - DNA, 13 bp, Homo sapiens
atcctgaagaaac

SEQ ID NO: 6663150 - DNA, 13 bp, Homo sapiens
atcctgaagagca

SEQ ID NO: 6663151 - DNA, 16 bp, Homo sapiens
atcctgaataaaccag

SEQ ID NO: 6663152 - DNA, 23 bp, Homo sapiens
atcctgacaagattataatattt

SEQ ID NO: 6663153 - DNA, 13 bp, Homo sapiens
atcctgacagcgc

SEQ ID NO: 6663154 - DNA, 21 bp, Homo sapiens
atcctgacagcgccatgtgtg

SEQ ID NO: 6663155 - DNA, 22 bp, Homo sapiens
atcctgacagcgccatgtgtgt

SEQ ID NO: 6663156 - DNA, 20 bp, Homo sapiens
atcctgaccaaaggaaggca

SEQ ID NO: 6663157 - DNA, 17 bp, Homo sapiens
atcctgactctgccccc

SEQ ID NO: 6663158 - DNA, 23 bp, Homo sapiens
atcctgacttctaatatcattca

SEQ ID NO: 6663159 - DNA, 20 bp, Homo sapiens
atcctgagagacctgccctc

SEQ ID NO: 6663160 - DNA, 12 bp, Homo sapiens
atcctgagccag

SEQ ID NO: 6663161 - DNA, 14 bp, Homo sapiens
atcctgagccagat

SEQ ID NO: 6663162 - DNA, 17 bp, Homo sapiens
atcctgagccagatttc

SEQ ID NO: 6663163 - DNA, 14 bp, Homo sapiens
atcctgagcccaac

SEQ ID NO: 6663164 - DNA, 22 bp, Homo sapiens
atcctgagcccaaccaggccct

SEQ ID NO: 6663165 - DNA, 23 bp, Homo sapiens
atcctgagccccgccctcttcct

SEQ ID NO: 6663166 - DNA, 19 bp, Homo sapiens
atcctgaggaccgccccaa

SEQ ID NO: 6663167 - DNA, 13 bp, Homo sapiens
atcctgaggccag

SEQ ID NO: 6663168 - DNA, 14 bp, Homo sapiens
atcctgaggccagt

SEQ ID NO: 6663169 - DNA, 11 bp, Homo sapiens
atcctgaggct

SEQ ID NO: 6663170 - DNA, 22 bp, Homo sapiens
atcctgaggctccacttggtct

SEQ ID NO: 6663171 - DNA, 13 bp, Homo sapiens
atcctgaggctga

SEQ ID NO: 6663172 - DNA, 17 bp, Homo sapiens
atcctgaggtgcctccc

SEQ ID NO: 6663173 - DNA, 19 bp, Homo sapiens
atcctgaggtgcctcccag

SEQ ID NO: 6663174 - DNA, 15 bp, Homo sapiens
atcctgagtccagaa

SEQ ID NO: 6663175 - DNA, 17 bp, Homo sapiens
atcctgcaaaggccctt

SEQ ID NO: 6663176 - DNA, 19 bp, Homo sapiens
atcctgcaagggacaggaa

SEQ ID NO: 6663177 - DNA, 13 bp, Homo sapiens
atcctgcacccca

SEQ ID NO: 6663178 - DNA, 15 bp, Homo sapiens
atcctgcaccccagc

SEQ ID NO: 6663179 - DNA, 15 bp, Homo sapiens
atcctgcaccctctg

SEQ ID NO: 6663180 - DNA, 16 bp, Homo sapiens
atcctgcaccctctgc

SEQ ID NO: 6663181 - DNA, 17 bp, Homo sapiens
atcctgcaccctctgct

SEQ ID NO: 6663182 - DNA, 16 bp, Homo sapiens
atcctgcactgactct

SEQ ID NO: 6663183 - DNA, 21 bp, Homo sapiens
atcctgcagatactttgaagt

SEQ ID NO: 6663184 - DNA, 17 bp, Homo sapiens
atcctgcagcctcctcc

SEQ ID NO: 6663185 - DNA, 20 bp, Homo sapiens
atcctgcagcctcctcctga

SEQ ID NO: 6663186 - DNA, 17 bp, Homo sapiens
atcctgcaggaaatata

SEQ ID NO: 6663187 - DNA, 16 bp, Homo sapiens
atcctgccaccctgta

SEQ ID NO: 6663188 - DNA, 14 bp, Homo sapiens
atcctgccactgtt

SEQ ID NO: 6663189 - DNA, 23 bp, Homo sapiens
atcctgccagccccacacagcta

SEQ ID NO: 6663190 - DNA, 13 bp, Homo sapiens
atcctgccaggag

SEQ ID NO: 6663191 - DNA, 15 bp, Homo sapiens
atcctgccaggagca

SEQ ID NO: 6663192 - DNA, 20 bp, Homo sapiens
atcctgccaggagcagcctc

SEQ ID NO: 6663193 - DNA, 10 bp, Homo sapiens
atcctgcccc

SEQ ID NO: 6663194 - DNA, 11 bp, Homo sapiens
atcctgccccc

SEQ ID NO: 6663195 - DNA, 13 bp, Homo sapiens
atcctgcccccaa

SEQ ID NO: 6663196 - DNA, 15 bp, Homo sapiens
atcctgcccccaagt

SEQ ID NO: 6663197 - DNA, 22 bp, Homo sapiens
atcctgccccctgaaacttatt

SEQ ID NO: 6663198 - DNA, 23 bp, Homo sapiens
atcctgccccctgaaacttattt

SEQ ID NO: 6663199 - DNA, 14 bp, Homo sapiens
atcctgcccctcca

SEQ ID NO: 6663200 - DNA, 14 bp, Homo sapiens
atcctgccctgcag

SEQ ID NO: 6663201 - DNA, 16 bp, Homo sapiens
atcctgcctgggtggg

SEQ ID NO: 6663202 - DNA, 23 bp, Homo sapiens
atcctgccttagagccaggcaca

SEQ ID NO: 6663203 - DNA, 21 bp, Homo sapiens
atcctgccttcatggaactca

SEQ ID NO: 6663204 - DNA, 19 bp, Homo sapiens
atcctgcggaaggaattca

SEQ ID NO: 6663205 - DNA, 24 bp, Homo sapiens
atcctgcggcaggactgcagagca

SEQ ID NO: 6663206 - DNA, 16 bp, Homo sapiens
atcctgcgggtggggc

SEQ ID NO: 6663207 - DNA, 13 bp, Homo sapiens
atcctgctaagtt

SEQ ID NO: 6663208 - DNA, 19 bp, Homo sapiens
atcctgctacactcatccg

SEQ ID NO: 6663209 - DNA, 16 bp, Homo sapiens
atcctgctagcacctc

SEQ ID NO: 6663210 - DNA, 20 bp, Homo sapiens
atcctgctagcaggccccct

SEQ ID NO: 6663211 - DNA, 19 bp, Homo sapiens
atcctgctagctgtagaaa

SEQ ID NO: 6663212 - DNA, 14 bp, Homo sapiens
atcctgctccagca

SEQ ID NO: 6663213 - DNA, 15 bp, Homo sapiens
atcctgctccagcag

SEQ ID NO: 6663214 - DNA, 12 bp, Homo sapiens
atcctgctcttt

SEQ ID NO: 6663215 - DNA, 20 bp, Homo sapiens
atcctgctcttttgtgatga

SEQ ID NO: 6663216 - DNA, 11 bp, Homo sapiens
atcctgctgcc

SEQ ID NO: 6663217 - DNA, 17 bp, Homo sapiens
atcctgctgccagagaa

SEQ ID NO: 6663218 - DNA, 19 bp, Homo sapiens
atcctgctgctttgggctg

SEQ ID NO: 6663219 - DNA, 23 bp, Homo sapiens
atcctgctgctttgggctgggat

SEQ ID NO: 6663220 - DNA, 23 bp, Homo sapiens
atcctgctggggccgccacggcc

SEQ ID NO: 6663221 - DNA, 16 bp, Homo sapiens
atcctgctgtggcctc

SEQ ID NO: 6663222 - DNA, 18 bp, Homo sapiens
atcctgctgtggcctcac

SEQ ID NO: 6663223 - DNA, 19 bp, Homo sapiens
atcctgctgtggcctcact

SEQ ID NO: 6663224 - DNA, 22 bp, Homo sapiens
atcctgcttcctaggccccaga

SEQ ID NO: 6663225 - DNA, 15 bp, Homo sapiens
atcctgcttcctgaa

SEQ ID NO: 6663226 - DNA, 13 bp, Homo sapiens
atcctgcttctct

SEQ ID NO: 6663227 - DNA, 19 bp, Homo sapiens
atcctgcttctcttttcct

SEQ ID NO: 6663228 - DNA, 22 bp, Homo sapiens
atcctgcttctcttttcctcgc

SEQ ID NO: 6663229 - DNA, 23 bp, Homo sapiens
atcctgcttctcttttcctcgca

SEQ ID NO: 6663230 - DNA, 12 bp, Homo sapiens
atcctgcttgat

SEQ ID NO: 6663231 - DNA, 18 bp, Homo sapiens
atcctgctttccctcccc

SEQ ID NO: 6663232 - DNA, 14 bp, Homo sapiens
atcctgctttgatt

SEQ ID NO: 6663233 - DNA, 20 bp, Homo sapiens
atcctggaaatttgtgtgct

SEQ ID NO: 6663234 - DNA, 20 bp, Homo sapiens
atcctggaacaatattttat

SEQ ID NO: 6663235 - DNA, 21 bp, Homo sapiens
atcctggaacaatattttatg

SEQ ID NO: 6663236 - DNA, 16 bp, Homo sapiens
atcctggacagctccg

SEQ ID NO: 6663237 - DNA, 22 bp, Homo sapiens
atcctggacatgaagattcttt

SEQ ID NO: 6663238 - DNA, 16 bp, Homo sapiens
atcctggagaagcctc

SEQ ID NO: 6663239 - DNA, 11 bp, Homo sapiens
atcctggagcc

SEQ ID NO: 6663240 - DNA, 14 bp, Homo sapiens
atcctggagcccct

SEQ ID NO: 6663241 - DNA, 14 bp, Homo sapiens
atcctggaggccca

SEQ ID NO: 6663242 - DNA, 20 bp, Homo sapiens
atcctggaggggtgttgtat

SEQ ID NO: 6663243 - DNA, 14 bp, Homo sapiens
atcctggaggtctt

SEQ ID NO: 6663244 - DNA, 19 bp, Homo sapiens
atcctggaggtcttttcta

SEQ ID NO: 6663245 - DNA, 21 bp, Homo sapiens
atcctggcaagaaagcttgag

SEQ ID NO: 6663246 - DNA, 20 bp, Homo sapiens
atcctggcacccggcccctg

SEQ ID NO: 6663247 - DNA, 23 bp, Homo sapiens
atcctggcacccggcccctgctg

SEQ ID NO: 6663248 - DNA, 20 bp, Homo sapiens
atcctggcagcccagagact

SEQ ID NO: 6663249 - DNA, 24 bp, Homo sapiens
atcctggcagcccagagactttgt

SEQ ID NO: 6663250 - DNA, 14 bp, Homo sapiens
atcctggcccatca

SEQ ID NO: 6663251 - DNA, 15 bp, Homo sapiens
atcctggcccctcca

SEQ ID NO: 6663252 - DNA, 22 bp, Homo sapiens
atcctggcccctccagaccctg

SEQ ID NO: 6663253 - DNA, 13 bp, Homo sapiens
atcctggccctgg

SEQ ID NO: 6663254 - DNA, 11 bp, Homo sapiens
atcctggcctc

SEQ ID NO: 6663255 - DNA, 13 bp, Homo sapiens
atcctggcctcct

SEQ ID NO: 6663256 - DNA, 14 bp, Homo sapiens
atcctggcctcctt

SEQ ID NO: 6663257 - DNA, 15 bp, Homo sapiens
atcctggcctccttt

SEQ ID NO: 6663258 - DNA, 18 bp, Homo sapiens
atcctggctctgtggctt

SEQ ID NO: 6663259 - DNA, 19 bp, Homo sapiens
atcctggctggctgtgtcc

SEQ ID NO: 6663260 - DNA, 20 bp, Homo sapiens
atcctggctgtcgagaaaca

SEQ ID NO: 6663261 - DNA, 15 bp, Homo sapiens
atcctggctttgccc

SEQ ID NO: 6663262 - DNA, 17 bp, Homo sapiens
atcctgggacctcccca

SEQ ID NO: 6663263 - DNA, 15 bp, Homo sapiens
atcctgggatgtaaa

SEQ ID NO: 6663264 - DNA, 22 bp, Homo sapiens
atcctgggcagcttgggctggc

SEQ ID NO: 6663265 - DNA, 16 bp, Homo sapiens
atcctgggcatcccca

SEQ ID NO: 6663266 - DNA, 22 bp, Homo sapiens
atcctgggcatccccagccccc

SEQ ID NO: 6663267 - DNA, 23 bp, Homo sapiens
atcctgggcatgatgggccgagc

SEQ ID NO: 6663268 - DNA, 11 bp, Homo sapiens
atcctgggccc

SEQ ID NO: 6663269 - DNA, 18 bp, Homo sapiens
atcctgggcccccagaga

SEQ ID NO: 6663270 - DNA, 19 bp, Homo sapiens
atcctgggcccccagagac

SEQ ID NO: 6663271 - DNA, 12 bp, Homo sapiens
atcctgggcctt

SEQ ID NO: 6663272 - DNA, 21 bp, Homo sapiens
atcctgggcttttgttttgct

SEQ ID NO: 6663273 - DNA, 22 bp, Homo sapiens
atcctgggcttttgttttgctt

SEQ ID NO: 6663274 - DNA, 19 bp, Homo sapiens
atcctggggcagcactccc

SEQ ID NO: 6663275 - DNA, 20 bp, Homo sapiens
atcctggggcattaaaaaaa

SEQ ID NO: 6663276 - DNA, 15 bp, Homo sapiens
atcctggggctccct

SEQ ID NO: 6663277 - DNA, 16 bp, Homo sapiens
atcctggggctccctt

SEQ ID NO: 6663278 - DNA, 20 bp, Homo sapiens
atcctgggggatacgggggt

SEQ ID NO: 6663279 - DNA, 21 bp, Homo sapiens
atcctgggggcctgggttggg

SEQ ID NO: 6663280 - DNA, 17 bp, Homo sapiens
atcctggtattgtaata

SEQ ID NO: 6663281 - DNA, 22 bp, Homo sapiens
atcctggtattgtaatattaaa

SEQ ID NO: 6663282 - DNA, 14 bp, Homo sapiens
atcctggtctgcac

SEQ ID NO: 6663283 - DNA, 14 bp, Homo sapiens
atcctggtcttttt

SEQ ID NO: 6663284 - DNA, 14 bp, Homo sapiens
atcctggtttgtaa

SEQ ID NO: 6663285 - DNA, 16 bp, Homo sapiens
atcctggtttgtaatg

SEQ ID NO: 6663286 - DNA, 22 bp, Homo sapiens
atcctgtaactacaatgatggt

SEQ ID NO: 6663287 - DNA, 21 bp, Homo sapiens
atcctgtaccaaatctgacat

SEQ ID NO: 6663288 - DNA, 15 bp, Homo sapiens
atcctgtaggctaaa

SEQ ID NO: 6663289 - DNA, 14 bp, Homo sapiens
atcctgtataagca

SEQ ID NO: 6663290 - DNA, 17 bp, Homo sapiens
atcctgtataagcactg

SEQ ID NO: 6663291 - DNA, 23 bp, Homo sapiens
atcctgtataagcactgaaaaac

SEQ ID NO: 6663292 - DNA, 16 bp, Homo sapiens
atcctgtattcagaca

SEQ ID NO: 6663293 - DNA, 16 bp, Homo sapiens
atcctgtattcttgtt

SEQ ID NO: 6663294 - DNA, 17 bp, Homo sapiens
atcctgtcatctgagaa

SEQ ID NO: 6663295 - DNA, 12 bp, Homo sapiens
atcctgtcccat

SEQ ID NO: 6663296 - DNA, 21 bp, Homo sapiens
atcctgtcccatgggctctgg

SEQ ID NO: 6663297 - DNA, 23 bp, Homo sapiens
atcctgtcccatgggctctggcc

SEQ ID NO: 6663298 - DNA, 19 bp, Homo sapiens
atcctgtctctaaaaagaa

SEQ ID NO: 6663299 - DNA, 13 bp, Homo sapiens
atcctgtctgaaa

SEQ ID NO: 6663300 - DNA, 17 bp, Homo sapiens
atcctgtctgttcatgg

SEQ ID NO: 6663301 - DNA, 23 bp, Homo sapiens
atcctgtctttaaggaaaaaaag

SEQ ID NO: 6663302 - DNA, 23 bp, Homo sapiens
atcctgtctttctgagcacactt

SEQ ID NO: 6663303 - DNA, 11 bp, Homo sapiens
atcctgtgagg

SEQ ID NO: 6663304 - DNA, 22 bp, Homo sapiens
atcctgtgagtaggctgggcct

SEQ ID NO: 6663305 - DNA, 18 bp, Homo sapiens
atcctgtgccagaggaag

SEQ ID NO: 6663306 - DNA, 23 bp, Homo sapiens
atcctgtgccagaggaaggaaaa

SEQ ID NO: 6663307 - DNA, 13 bp, Homo sapiens
atcctgtgctaca

SEQ ID NO: 6663308 - DNA, 22 bp, Homo sapiens
atcctgtgtacctcactgtcca

SEQ ID NO: 6663309 - DNA, 13 bp, Homo sapiens
atcctgtgtcccc

SEQ ID NO: 6663310 - DNA, 20 bp, Homo sapiens
atcctgtgtgattacagcat

SEQ ID NO: 6663311 - DNA, 19 bp, Homo sapiens
atcctgtgtggagagggaa

SEQ ID NO: 6663312 - DNA, 16 bp, Homo sapiens
atcctgtgtggggagg

SEQ ID NO: 6663313 - DNA, 17 bp, Homo sapiens
atcctgtgtggggaggc

SEQ ID NO: 6663314 - DNA, 13 bp, Homo sapiens
atcctgtgtgtta

SEQ ID NO: 6663315 - DNA, 21 bp, Homo sapiens
atcctgtgtgttaagctctgc

SEQ ID NO: 6663316 - DNA, 21 bp, Homo sapiens
atcctgtgtttcattacttga

SEQ ID NO: 6663317 - DNA, 22 bp, Homo sapiens
atcctgtgtttcattacttgaa

SEQ ID NO: 6663318 - DNA, 21 bp, Homo sapiens
atcctgttaaattttctctaa

SEQ ID NO: 6663319 - DNA, 17 bp, Homo sapiens
atcctgttaacactgta

SEQ ID NO: 6663320 - DNA, 21 bp, Homo sapiens
atcctgttaacactgtaatat

SEQ ID NO: 6663321 - DNA, 19 bp, Homo sapiens
atcctgttaagagataatt

SEQ ID NO: 6663322 - DNA, 18 bp, Homo sapiens
atcctgttactctgtccc

SEQ ID NO: 6663323 - DNA, 13 bp, Homo sapiens
atcctgttgaaaa

SEQ ID NO: 6663324 - DNA, 14 bp, Homo sapiens
atcctgttgaaaag

SEQ ID NO: 6663325 - DNA, 17 bp, Homo sapiens
atcctgttggctgctgc

SEQ ID NO: 6663326 - DNA, 14 bp, Homo sapiens
atcctgtttaataa

SEQ ID NO: 6663327 - DNA, 14 bp, Homo sapiens
atcctgtttataat

SEQ ID NO: 6663328 - DNA, 18 bp, Homo sapiens
atcctgtttgaagaaaaa

SEQ ID NO: 6663329 - DNA, 12 bp, Homo sapiens
atcctgtttgta

SEQ ID NO: 6663330 - DNA, 15 bp, Homo sapiens
atcctgtttgtattt

SEQ ID NO: 6663331 - DNA, 21 bp, Homo sapiens
atcctgttttacagctgcctt

SEQ ID NO: 6663332 - DNA, 15 bp, Homo sapiens
atcctgttttctctg

SEQ ID NO: 6663333 - DNA, 23 bp, Homo sapiens
atcctgtttttcctatgctctgg

SEQ ID NO: 6663334 - DNA, 16 bp, Homo sapiens
atccttaaatatgtga

SEQ ID NO: 6663335 - DNA, 15 bp, Homo sapiens
atccttaacatttct

SEQ ID NO: 6663336 - DNA, 13 bp, Homo sapiens
atccttaactgtc

SEQ ID NO: 6663337 - DNA, 18 bp, Homo sapiens
atccttaagagaagaaat

SEQ ID NO: 6663338 - DNA, 18 bp, Homo sapiens
atccttacaatgtgaata

SEQ ID NO: 6663339 - DNA, 14 bp, Homo sapiens
atccttacactccc

SEQ ID NO: 6663340 - DNA, 14 bp, Homo sapiens
atccttactttatc

SEQ ID NO: 6663341 - DNA, 20 bp, Homo sapiens
atccttactttatctgggct

SEQ ID NO: 6663342 - DNA, 23 bp, Homo sapiens
atccttagaatggcctctttgta

SEQ ID NO: 6663343 - DNA, 21 bp, Homo sapiens
atccttagaggtcctctggag

SEQ ID NO: 6663344 - DNA, 19 bp, Homo sapiens
atccttataggcctgtccc

SEQ ID NO: 6663345 - DNA, 17 bp, Homo sapiens
atccttatctataaaag

SEQ ID NO: 6663346 - DNA, 18 bp, Homo sapiens
atccttatctataaaagg

SEQ ID NO: 6663347 - DNA, 21 bp, Homo sapiens
atccttatgagactcttaaat

SEQ ID NO: 6663348 - DNA, 18 bp, Homo sapiens
atccttatgcatgaaatg

SEQ ID NO: 6663349 - DNA, 14 bp, Homo sapiens
atccttcaactctg

SEQ ID NO: 6663350 - DNA, 17 bp, Homo sapiens
atccttcaactctgtga

SEQ ID NO: 6663351 - DNA, 18 bp, Homo sapiens
atccttcaactctgtgag

SEQ ID NO: 6663352 - DNA, 19 bp, Homo sapiens
atccttcacaatttcaatg

SEQ ID NO: 6663353 - DNA, 21 bp, Homo sapiens
atccttcatttgacatttagt

SEQ ID NO: 6663354 - DNA, 19 bp, Homo sapiens
atccttccaaaaattatta

SEQ ID NO: 6663355 - DNA, 23 bp, Homo sapiens
atccttccaaaaattattataag

SEQ ID NO: 6663356 - DNA, 22 bp, Homo sapiens
atccttccaaagaattcttata

SEQ ID NO: 6663357 - DNA, 15 bp, Homo sapiens
atccttccacctcag

SEQ ID NO: 6663358 - DNA, 14 bp, Homo sapiens
atccttccagtggc

SEQ ID NO: 6663359 - DNA, 13 bp, Homo sapiens
atccttccatcca

SEQ ID NO: 6663360 - DNA, 19 bp, Homo sapiens
atccttccatcctgaggac

SEQ ID NO: 6663361 - DNA, 14 bp, Homo sapiens
atccttccatcttg

SEQ ID NO: 6663362 - DNA, 19 bp, Homo sapiens
atccttcccaagaagagag

SEQ ID NO: 6663363 - DNA, 18 bp, Homo sapiens
atccttcccaagtaagag

SEQ ID NO: 6663364 - DNA, 14 bp, Homo sapiens
atccttccccaact

SEQ ID NO: 6663365 - DNA, 18 bp, Homo sapiens
atccttcccctcttttgg

SEQ ID NO: 6663366 - DNA, 17 bp, Homo sapiens
atccttcccgcagcacc

SEQ ID NO: 6663367 - DNA, 21 bp, Homo sapiens
atccttcccgcagcaccagcc

SEQ ID NO: 6663368 - DNA, 12 bp, Homo sapiens
atccttccctgt

SEQ ID NO: 6663369 - DNA, 22 bp, Homo sapiens
atccttccctgtctgccagggc

SEQ ID NO: 6663370 - DNA, 16 bp, Homo sapiens
atccttccgccaatct

SEQ ID NO: 6663371 - DNA, 22 bp, Homo sapiens
atccttccgccaatctggccct

SEQ ID NO: 6663372 - DNA, 12 bp, Homo sapiens
atccttcctata

SEQ ID NO: 6663373 - DNA, 15 bp, Homo sapiens
atccttcctataact

SEQ ID NO: 6663374 - DNA, 22 bp, Homo sapiens
atccttcctataacttgatgca

SEQ ID NO: 6663375 - DNA, 11 bp, Homo sapiens
atccttcctcc

SEQ ID NO: 6663376 - DNA, 13 bp, Homo sapiens
atccttcctccca

SEQ ID NO: 6663377 - DNA, 11 bp, Homo sapiens
atccttccttc

SEQ ID NO: 6663378 - DNA, 16 bp, Homo sapiens
atccttccttcccacc

SEQ ID NO: 6663379 - DNA, 21 bp, Homo sapiens
atccttcggggcgatgctccc

SEQ ID NO: 6663380 - DNA, 17 bp, Homo sapiens
atccttctaaagtgctg

SEQ ID NO: 6663381 - DNA, 19 bp, Homo sapiens
atccttctaatctgctatg

SEQ ID NO: 6663382 - DNA, 13 bp, Homo sapiens
atccttctagttt

SEQ ID NO: 6663383 - DNA, 22 bp, Homo sapiens
atccttctagtttcccacaata

SEQ ID NO: 6663384 - DNA, 13 bp, Homo sapiens
atccttctgcctt

SEQ ID NO: 6663385 - DNA, 14 bp, Homo sapiens
atccttctggctgt

SEQ ID NO: 6663386 - DNA, 20 bp, Homo sapiens
atccttcttatgtttgcttt

SEQ ID NO: 6663387 - DNA, 20 bp, Homo sapiens
atccttcttggcttcctggc

SEQ ID NO: 6663388 - DNA, 14 bp, Homo sapiens
atccttctttgtaa

SEQ ID NO: 6663389 - DNA, 20 bp, Homo sapiens
atccttctttgtaatacttt

SEQ ID NO: 6663390 - DNA, 18 bp, Homo sapiens
atccttgacaccttactt

SEQ ID NO: 6663391 - DNA, 14 bp, Homo sapiens
atccttgacttttt

SEQ ID NO: 6663392 - DNA, 21 bp, Homo sapiens
atccttgagattctgaagtat

SEQ ID NO: 6663393 - DNA, 14 bp, Homo sapiens
atccttgataatat

SEQ ID NO: 6663394 - DNA, 22 bp, Homo sapiens
atccttgatgcaagtgcaacct

SEQ ID NO: 6663395 - DNA, 18 bp, Homo sapiens
atccttgcacttctgtta

SEQ ID NO: 6663396 - DNA, 14 bp, Homo sapiens
atccttgcccaggt

SEQ ID NO: 6663397 - DNA, 15 bp, Homo sapiens
atccttgcctgtcta

SEQ ID NO: 6663398 - DNA, 15 bp, Homo sapiens
atccttggagagcag

SEQ ID NO: 6663399 - DNA, 17 bp, Homo sapiens
atccttggagagcagct

SEQ ID NO: 6663400 - DNA, 18 bp, Homo sapiens
atccttggagagcagctg

SEQ ID NO: 6663401 - DNA, 20 bp, Homo sapiens
atccttggagagcagctggc

SEQ ID NO: 6663402 - DNA, 17 bp, Homo sapiens
atccttggagtcccagg

SEQ ID NO: 6663403 - DNA, 21 bp, Homo sapiens
atccttggctgaattaaaatg

SEQ ID NO: 6663404 - DNA, 17 bp, Homo sapiens
atccttggcttcaggtt

SEQ ID NO: 6663405 - DNA, 19 bp, Homo sapiens
atccttggtctttgtatct

SEQ ID NO: 6663406 - DNA, 21 bp, Homo sapiens
atccttgtctgaatgtattta

SEQ ID NO: 6663407 - DNA, 14 bp, Homo sapiens
atccttgtcttatt

SEQ ID NO: 6663408 - DNA, 15 bp, Homo sapiens
atccttgtcttttga

SEQ ID NO: 6663409 - DNA, 19 bp, Homo sapiens
atccttgtcttttgagcta

SEQ ID NO: 6663410 - DNA, 23 bp, Homo sapiens
atccttgtttcaaacacaaatgc

SEQ ID NO: 6663411 - DNA, 20 bp, Homo sapiens
atcctttacaagatggagaa

SEQ ID NO: 6663412 - DNA, 17 bp, Homo sapiens
atcctttacgtgtttaa

SEQ ID NO: 6663413 - DNA, 19 bp, Homo sapiens
atcctttatttctgataag

SEQ ID NO: 6663414 - DNA, 20 bp, Homo sapiens
atcctttattttattgaaat

SEQ ID NO: 6663415 - DNA, 21 bp, Homo sapiens
atcctttattttattgaaatg

SEQ ID NO: 6663416 - DNA, 11 bp, Homo sapiens
atcctttcaaa

SEQ ID NO: 6663417 - DNA, 18 bp, Homo sapiens
atcctttcattaggcaaa

SEQ ID NO: 6663418 - DNA, 23 bp, Homo sapiens
atcctttcattaggcaaagtaca

SEQ ID NO: 6663419 - DNA, 24 bp, Homo sapiens
atcctttcattaggcaaagtacaa

SEQ ID NO: 6663420 - DNA, 13 bp, Homo sapiens
atcctttccctct

SEQ ID NO: 6663421 - DNA, 17 bp, Homo sapiens
atcctttccctctccca

SEQ ID NO: 6663422 - DNA, 20 bp, Homo sapiens
atcctttcctcattaaatta

SEQ ID NO: 6663423 - DNA, 15 bp, Homo sapiens
atcctttcctctagc

SEQ ID NO: 6663424 - DNA, 13 bp, Homo sapiens
atcctttctaaca

SEQ ID NO: 6663425 - DNA, 15 bp, Homo sapiens
atcctttctgccgac

SEQ ID NO: 6663426 - DNA, 22 bp, Homo sapiens
atcctttgagttatagtttgct

SEQ ID NO: 6663427 - DNA, 21 bp, Homo sapiens
atcctttgcttcattccaaat

SEQ ID NO: 6663428 - DNA, 15 bp, Homo sapiens
atcctttggggcttc

SEQ ID NO: 6663429 - DNA, 19 bp, Homo sapiens
atccttttagtctgcatat

SEQ ID NO: 6663430 - DNA, 16 bp, Homo sapiens
atccttttatgttatt

SEQ ID NO: 6663431 - DNA, 19 bp, Homo sapiens
atccttttatgttatttat

SEQ ID NO: 6663432 - DNA, 18 bp, Homo sapiens
atccttttccatcccact

SEQ ID NO: 6663433 - DNA, 21 bp, Homo sapiens
atccttttccatcccactcca

SEQ ID NO: 6663434 - DNA, 14 bp, Homo sapiens
atccttttccttat

SEQ ID NO: 6663435 - DNA, 20 bp, Homo sapiens
atccttttccttatttgcct

SEQ ID NO: 6663436 - DNA, 18 bp, Homo sapiens
atccttttctattaagat

SEQ ID NO: 6663437 - DNA, 12 bp, Homo sapiens
atccttttctcc

SEQ ID NO: 6663438 - DNA, 16 bp, Homo sapiens
atccttttctgtgttt

SEQ ID NO: 6663439 - DNA, 16 bp, Homo sapiens
atccttttcttctatg

SEQ ID NO: 6663440 - DNA, 13 bp, Homo sapiens
atccttttgcctg

SEQ ID NO: 6663441 - DNA, 13 bp, Homo sapiens
atccttttgtaga

SEQ ID NO: 6663442 - DNA, 19 bp, Homo sapiens
atccttttgttttgaagct

SEQ ID NO: 6663443 - DNA, 20 bp, Homo sapiens
atccttttttattgaataac

SEQ ID NO: 6663444 - DNA, 14 bp, Homo sapiens
atccttttttcctt

SEQ ID NO: 6663445 - DNA, 15 bp, Homo sapiens
atccttttttccttt

SEQ ID NO: 6663446 - DNA, 14 bp, Homo sapiens
atccttttttctct

SEQ ID NO: 6663447 - DNA, 22 bp, Homo sapiens
atccttttttctcttctgtcca

SEQ ID NO: 6663448 - DNA, 23 bp, Homo sapiens
atccttttttctcttctgtccat

SEQ ID NO: 6663449 - DNA, 17 bp, Homo sapiens
atccttttttgtcattt

SEQ ID NO: 6663450 - DNA, 13 bp, Homo sapiens
atcgaaaaaataa

SEQ ID NO: 6663451 - DNA, 14 bp, Homo sapiens
atcgaaaaaataat

SEQ ID NO: 6663452 - DNA, 14 bp, Homo sapiens
atcgaaaagttatt

SEQ ID NO: 6663453 - DNA, 19 bp, Homo sapiens
atcgaaaagttattttgta

SEQ ID NO: 6663454 - DNA, 12 bp, Homo sapiens
atcgaaaattca

SEQ ID NO: 6663455 - DNA, 19 bp, Homo sapiens
atcgaaataacaatgttaa

SEQ ID NO: 6663456 - DNA, 20 bp, Homo sapiens
atcgaaataacaatgttaag

SEQ ID NO: 6663457 - DNA, 16 bp, Homo sapiens
atcgaacaaactgatg

SEQ ID NO: 6663458 - DNA, 18 bp, Homo sapiens
atcgaacaaactgatgcg

SEQ ID NO: 6663459 - DNA, 17 bp, Homo sapiens
atcgaacgcgtgtgtgc

SEQ ID NO: 6663460 - DNA, 21 bp, Homo sapiens
atcgaacgcgtgtgtgcctga

SEQ ID NO: 6663461 - DNA, 15 bp, Homo sapiens
atcgaagcaaaagta

SEQ ID NO: 6663462 - DNA, 19 bp, Homo sapiens
atcgaagggtttttagaga

SEQ ID NO: 6663463 - DNA, 23 bp, Homo sapiens
atcgaagggtttttagagaatgt

SEQ ID NO: 6663464 - DNA, 18 bp, Homo sapiens
atcgaagtgtttatgtaa

SEQ ID NO: 6663465 - DNA, 13 bp, Homo sapiens
atcgaatgaaatt

SEQ ID NO: 6663466 - DNA, 14 bp, Homo sapiens
atcgacccccaagg

SEQ ID NO: 6663467 - DNA, 14 bp, Homo sapiens
atcgacctgcctcg

SEQ ID NO: 6663468 - DNA, 21 bp, Homo sapiens
atcgacttcttggttttctct

SEQ ID NO: 6663469 - DNA, 12 bp, Homo sapiens
atcgactttata

SEQ ID NO: 6663470 - DNA, 14 bp, Homo sapiens
atcgactttttaaa

SEQ ID NO: 6663471 - DNA, 16 bp, Homo sapiens
atcgagaccatcctgg

SEQ ID NO: 6663472 - DNA, 17 bp, Homo sapiens
atcgagaccatcctggc

SEQ ID NO: 6663473 - DNA, 16 bp, Homo sapiens
atcgagatggagctac

SEQ ID NO: 6663474 - DNA, 18 bp, Homo sapiens
atcgagcacttctcacca

SEQ ID NO: 6663475 - DNA, 19 bp, Homo sapiens
atcgagtctacctcttcag

SEQ ID NO: 6663476 - DNA, 22 bp, Homo sapiens
atcgagtgccgcatctcacagc

SEQ ID NO: 6663477 - DNA, 15 bp, Homo sapiens
atcgatgaatgtaaa

SEQ ID NO: 6663478 - DNA, 13 bp, Homo sapiens
atcgatgcagtgc

SEQ ID NO: 6663479 - DNA, 13 bp, Homo sapiens
atcgatggcctgg

SEQ ID NO: 6663480 - DNA, 21 bp, Homo sapiens
atcgatgggggatgcttcatg

SEQ ID NO: 6663481 - DNA, 15 bp, Homo sapiens
atcgatgtgctcagc

SEQ ID NO: 6663482 - DNA, 17 bp, Homo sapiens
atcgatgttaaacgtca

SEQ ID NO: 6663483 - DNA, 20 bp, Homo sapiens
atcgattcccaagctccctt

SEQ ID NO: 6663484 - DNA, 22 bp, Homo sapiens
atcgattgtgtacttttccttt

SEQ ID NO: 6663485 - DNA, 20 bp, Homo sapiens
atcgatttttaaaaattaaa

SEQ ID NO: 6663486 - DNA, 13 bp, Homo sapiens
atcgcaacatgaa

SEQ ID NO: 6663487 - DNA, 22 bp, Homo sapiens
atcgcaccactgcactccagcc

SEQ ID NO: 6663488 - DNA, 18 bp, Homo sapiens
atcgcaccattctgactc

SEQ ID NO: 6663489 - DNA, 20 bp, Homo sapiens
atcgcactctggcagcaccg

SEQ ID NO: 6663490 - DNA, 20 bp, Homo sapiens
atcgcagcttcctgtctgtt

SEQ ID NO: 6663491 - DNA, 20 bp, Homo sapiens
atcgcatcccggctgaccct

SEQ ID NO: 6663492 - DNA, 18 bp, Homo sapiens
atcgcatccgtcctgggc

SEQ ID NO: 6663493 - DNA, 14 bp, Homo sapiens
atcgcatttcctaa

SEQ ID NO: 6663494 - DNA, 20 bp, Homo sapiens
atcgccaacttgtctctgta

SEQ ID NO: 6663495 - DNA, 16 bp, Homo sapiens
atcgccacaaactcta

SEQ ID NO: 6663496 - DNA, 20 bp, Homo sapiens
atcgccagaggtgcttcacc

SEQ ID NO: 6663497 - DNA, 23 bp, Homo sapiens
atcgccagctgatgactcaagat

SEQ ID NO: 6663498 - DNA, 11 bp, Homo sapiens
atcgccccacc

SEQ ID NO: 6663499 - DNA, 19 bp, Homo sapiens
atcgccctccacatccctg

SEQ ID NO: 6663500 - DNA, 15 bp, Homo sapiens
atcgccctcctttcc

SEQ ID NO: 6663501 - DNA, 19 bp, Homo sapiens
atcgccctcctttccctta

SEQ ID NO: 6663502 - DNA, 16 bp, Homo sapiens
atcgcctctgtctcct

SEQ ID NO: 6663503 - DNA, 21 bp, Homo sapiens
atcgccttatgagaacatggt

SEQ ID NO: 6663504 - DNA, 15 bp, Homo sapiens
atcgccttccccacc

SEQ ID NO: 6663505 - DNA, 19 bp, Homo sapiens
atcgccttgaacaaaaagt

SEQ ID NO: 6663506 - DNA, 20 bp, Homo sapiens
atcgcgccagcgacctctct

SEQ ID NO: 6663507 - DNA, 20 bp, Homo sapiens
atcgcggcggagctggcccc

SEQ ID NO: 6663508 - DNA, 15 bp, Homo sapiens
atcgctcccttggct

SEQ ID NO: 6663509 - DNA, 21 bp, Homo sapiens
atcgctcgtgtgttctatcca

SEQ ID NO: 6663510 - DNA, 15 bp, Homo sapiens
atcgctgacttcatg

SEQ ID NO: 6663511 - DNA, 13 bp, Homo sapiens
atcgctgatgcag

SEQ ID NO: 6663512 - DNA, 19 bp, Homo sapiens
atcgctgcacatggcctga

SEQ ID NO: 6663513 - DNA, 12 bp, Homo sapiens
atcgctggcccc

SEQ ID NO: 6663514 - DNA, 12 bp, Homo sapiens
atcgctgggctc

SEQ ID NO: 6663515 - DNA, 18 bp, Homo sapiens
atcgctgtattttgagtt

SEQ ID NO: 6663516 - DNA, 21 bp, Homo sapiens
atcgctgtccaagtgtttctt

SEQ ID NO: 6663517 - DNA, 23 bp, Homo sapiens
atcgctgtgtgttagttcccaac

SEQ ID NO: 6663518 - DNA, 17 bp, Homo sapiens
atcgcttcatgtaacta

SEQ ID NO: 6663519 - DNA, 21 bp, Homo sapiens
atcgcttgaacccaggtggcg

SEQ ID NO: 6663520 - DNA, 14 bp, Homo sapiens
atcgcttgagccca

SEQ ID NO: 6663521 - DNA, 17 bp, Homo sapiens
atcgcttgagcccagga

SEQ ID NO: 6663522 - DNA, 17 bp, Homo sapiens
atcgctttccttcctcc

SEQ ID NO: 6663523 - DNA, 17 bp, Homo sapiens
atcgctttgtactttgt

SEQ ID NO: 6663524 - DNA, 23 bp, Homo sapiens
atcggaacagctccttactctga

SEQ ID NO: 6663525 - DNA, 11 bp, Homo sapiens
atcggaagaac

SEQ ID NO: 6663526 - DNA, 18 bp, Homo sapiens
atcggaagcagtgccttc

SEQ ID NO: 6663527 - DNA, 20 bp, Homo sapiens
atcggacattctaatgcata

SEQ ID NO: 6663528 - DNA, 22 bp, Homo sapiens
atcggacctcagtttctgttgt

SEQ ID NO: 6663529 - DNA, 14 bp, Homo sapiens
atcggactgccaaa

SEQ ID NO: 6663530 - DNA, 17 bp, Homo sapiens
atcggaggcccatgccc

SEQ ID NO: 6663531 - DNA, 20 bp, Homo sapiens
atcggaggcttgtcagagct

SEQ ID NO: 6663532 - DNA, 18 bp, Homo sapiens
atcggaggtggtggagga

SEQ ID NO: 6663533 - DNA, 22 bp, Homo sapiens
atcggaggtggtggaggaggag

SEQ ID NO: 6663534 - DNA, 16 bp, Homo sapiens
atcggattactgaatt

SEQ ID NO: 6663535 - DNA, 21 bp, Homo sapiens
atcggcaacagggcttctctt

SEQ ID NO: 6663536 - DNA, 18 bp, Homo sapiens
atcggcagtattttctgt

SEQ ID NO: 6663537 - DNA, 21 bp, Homo sapiens
atcggccatcaagggaagaac

SEQ ID NO: 6663538 - DNA, 20 bp, Homo sapiens
atcggccctgtcccctggag

SEQ ID NO: 6663539 - DNA, 21 bp, Homo sapiens
atcggccctgtcccctggagt

SEQ ID NO: 6663540 - DNA, 24 bp, Homo sapiens
atcggcgacggagcactgcacctg

SEQ ID NO: 6663541 - DNA, 13 bp, Homo sapiens
atcggctcccgct

SEQ ID NO: 6663542 - DNA, 20 bp, Homo sapiens
atcggctggggactgctacc

SEQ ID NO: 6663543 - DNA, 15 bp, Homo sapiens
atcgggagcacccag

SEQ ID NO: 6663544 - DNA, 18 bp, Homo sapiens
atcgggagcagtgtcttc

SEQ ID NO: 6663545 - DNA, 22 bp, Homo sapiens
atcgggataacaaaatcacaag

SEQ ID NO: 6663546 - DNA, 14 bp, Homo sapiens
atcgggcccaggga

SEQ ID NO: 6663547 - DNA, 21 bp, Homo sapiens
atcggggaggttttctccccc

SEQ ID NO: 6663548 - DNA, 14 bp, Homo sapiens
atcggggccagagg

SEQ ID NO: 6663549 - DNA, 12 bp, Homo sapiens
atcgggggcctg

SEQ ID NO: 6663550 - DNA, 15 bp, Homo sapiens
atcgggggctggggc

SEQ ID NO: 6663551 - DNA, 14 bp, Homo sapiens
atcggggggtggac

SEQ ID NO: 6663552 - DNA, 19 bp, Homo sapiens
atcgggggtgagcgaagcc

SEQ ID NO: 6663553 - DNA, 20 bp, Homo sapiens
atcgggggtgagcgaagccc

SEQ ID NO: 6663554 - DNA, 16 bp, Homo sapiens
atcggggtagaaatgc

SEQ ID NO: 6663555 - DNA, 19 bp, Homo sapiens
atcgggttcagaacacttt

SEQ ID NO: 6663556 - DNA, 13 bp, Homo sapiens
atcggtcagcagg

SEQ ID NO: 6663557 - DNA, 14 bp, Homo sapiens
atcggtcctgtctc

SEQ ID NO: 6663558 - DNA, 17 bp, Homo sapiens
atcggtgctatgtgttt

SEQ ID NO: 6663559 - DNA, 15 bp, Homo sapiens
atcggttaacaaata

SEQ ID NO: 6663560 - DNA, 23 bp, Homo sapiens
atcggttaacaaataacaacttt

SEQ ID NO: 6663561 - DNA, 16 bp, Homo sapiens
atcggttgttctttcc

SEQ ID NO: 6663562 - DNA, 17 bp, Homo sapiens
atcgtaaaattaagaaa

SEQ ID NO: 6663563 - DNA, 19 bp, Homo sapiens
atcgtaaccagttttttca

SEQ ID NO: 6663564 - DNA, 18 bp, Homo sapiens
atcgtaatgtacagatgg

SEQ ID NO: 6663565 - DNA, 14 bp, Homo sapiens
atcgtagaaaattt

SEQ ID NO: 6663566 - DNA, 13 bp, Homo sapiens
atcgtagaagaga

SEQ ID NO: 6663567 - DNA, 16 bp, Homo sapiens
atcgtaggcagccacg

SEQ ID NO: 6663568 - DNA, 20 bp, Homo sapiens
atcgtaggcagccacggccc

SEQ ID NO: 6663569 - DNA, 21 bp, Homo sapiens
atcgtagtgtgtttaaataaa

SEQ ID NO: 6663570 - DNA, 22 bp, Homo sapiens
atcgtagtgtgtttaaataaac

SEQ ID NO: 6663571 - DNA, 14 bp, Homo sapiens
atcgtatagctgta

SEQ ID NO: 6663572 - DNA, 22 bp, Homo sapiens
atcgtatagctgtattgaatca

SEQ ID NO: 6663573 - DNA, 16 bp, Homo sapiens
atcgtattcaccttca

SEQ ID NO: 6663574 - DNA, 17 bp, Homo sapiens
atcgtattctaattctt

SEQ ID NO: 6663575 - DNA, 22 bp, Homo sapiens
atcgtattctaattcttcatta

SEQ ID NO: 6663576 - DNA, 23 bp, Homo sapiens
atcgtattctaattcttcattat

SEQ ID NO: 6663577 - DNA, 19 bp, Homo sapiens
atcgtcagcgacagcctgg

SEQ ID NO: 6663578 - DNA, 17 bp, Homo sapiens
atcgtcataggcttctg

SEQ ID NO: 6663579 - DNA, 14 bp, Homo sapiens
atcgtccagccctc

SEQ ID NO: 6663580 - DNA, 19 bp, Homo sapiens
atcgtccagcgaccttcct

SEQ ID NO: 6663581 - DNA, 15 bp, Homo sapiens
atcgtcccctccccc

SEQ ID NO: 6663582 - DNA, 13 bp, Homo sapiens
atcgtccttcctc

SEQ ID NO: 6663583 - DNA, 16 bp, Homo sapiens
atcgtctcatcctcct

SEQ ID NO: 6663584 - DNA, 18 bp, Homo sapiens
atcgtctcctttgacatt

SEQ ID NO: 6663585 - DNA, 17 bp, Homo sapiens
atcgtctcggcccctct

SEQ ID NO: 6663586 - DNA, 23 bp, Homo sapiens
atcgtctctccctccctttgaaa

SEQ ID NO: 6663587 - DNA, 18 bp, Homo sapiens
atcgtgaaatcctcagcc

SEQ ID NO: 6663588 - DNA, 15 bp, Homo sapiens
atcgtgaagaagcct

SEQ ID NO: 6663589 - DNA, 14 bp, Homo sapiens
atcgtgacaacact

SEQ ID NO: 6663590 - DNA, 14 bp, Homo sapiens
atcgtgacagcagc

SEQ ID NO: 6663591 - DNA, 18 bp, Homo sapiens
atcgtgacccttcagggc

SEQ ID NO: 6663592 - DNA, 20 bp, Homo sapiens
atcgtgacgctgaataaatg

SEQ ID NO: 6663593 - DNA, 16 bp, Homo sapiens
atcgtgatcactgagc

SEQ ID NO: 6663594 - DNA, 17 bp, Homo sapiens
atcgtgatcactgagcc

SEQ ID NO: 6663595 - DNA, 19 bp, Homo sapiens
atcgtgcatttgaggggcc

SEQ ID NO: 6663596 - DNA, 21 bp, Homo sapiens
atcgtgccattacactccagc

SEQ ID NO: 6663597 - DNA, 22 bp, Homo sapiens
atcgtgccattacactccagcc

SEQ ID NO: 6663598 - DNA, 16 bp, Homo sapiens
atcgtgccgtggagct

SEQ ID NO: 6663599 - DNA, 15 bp, Homo sapiens
atcgtgcctataaat

SEQ ID NO: 6663600 - DNA, 17 bp, Homo sapiens
atcgtgctaaattttca

SEQ ID NO: 6663601 - DNA, 23 bp, Homo sapiens
atcgtggaagaagggccaccctg

SEQ ID NO: 6663602 - DNA, 17 bp, Homo sapiens
atcgtgtataagctaat

SEQ ID NO: 6663603 - DNA, 21 bp, Homo sapiens
atcgtgtctgctgactgtttc

SEQ ID NO: 6663604 - DNA, 18 bp, Homo sapiens
atcgttaagcacaagaca

SEQ ID NO: 6663605 - DNA, 19 bp, Homo sapiens
atcgttatagagagcaatt

SEQ ID NO: 6663606 - DNA, 14 bp, Homo sapiens
atcgttatgtgtgt

SEQ ID NO: 6663607 - DNA, 15 bp, Homo sapiens
atcgttatgtgtgta

SEQ ID NO: 6663608 - DNA, 18 bp, Homo sapiens
atcgttatgtgtgtatat

SEQ ID NO: 6663609 - DNA, 19 bp, Homo sapiens
atcgttattataaatgtta

SEQ ID NO: 6663610 - DNA, 16 bp, Homo sapiens
atcgttccccacccct

SEQ ID NO: 6663611 - DNA, 13 bp, Homo sapiens
atcgttcgcttgt

SEQ ID NO: 6663612 - DNA, 16 bp, Homo sapiens
atcgttctaaaatcaa

SEQ ID NO: 6663613 - DNA, 14 bp, Homo sapiens
atcgttctgctggc

SEQ ID NO: 6663614 - DNA, 21 bp, Homo sapiens
atcgttgttttgctggaggga

SEQ ID NO: 6663615 - DNA, 19 bp, Homo sapiens
atcgtttaatgtttataca

SEQ ID NO: 6663616 - DNA, 16 bp, Homo sapiens
atcgtttcacatctgt

SEQ ID NO: 6663617 - DNA, 19 bp, Homo sapiens
atcgtttctcagaagtact

SEQ ID NO: 6663618 - DNA, 17 bp, Homo sapiens
atcgttttcttaaagtg

SEQ ID NO: 6663619 - DNA, 14 bp, Homo sapiens
atcgtttttgtatt

SEQ ID NO: 6663620 - DNA, 15 bp, Homo sapiens
atcgtttttgtattt

SEQ ID NO: 6663621 - DNA, 16 bp, Homo sapiens
atctaaaaaaatgttt

SEQ ID NO: 6663622 - DNA, 16 bp, Homo sapiens
atctaaaaaataactg

SEQ ID NO: 6663623 - DNA, 16 bp, Homo sapiens
atctaaaaataactgt

SEQ ID NO: 6663624 - DNA, 18 bp, Homo sapiens
atctaaaaataactgtaa

SEQ ID NO: 6663625 - DNA, 20 bp, Homo sapiens
atctaaaaataactgtaatt

SEQ ID NO: 6663626 - DNA, 19 bp, Homo sapiens
atctaaaaatagacttaaa

SEQ ID NO: 6663627 - DNA, 23 bp, Homo sapiens
atctaaaatactcaccaaaatat

SEQ ID NO: 6663628 - DNA, 14 bp, Homo sapiens
atctaaaatgcaaa

SEQ ID NO: 6663629 - DNA, 12 bp, Homo sapiens
atctaaaatgtt

SEQ ID NO: 6663630 - DNA, 11 bp, Homo sapiens
atctaaaattt

SEQ ID NO: 6663631 - DNA, 19 bp, Homo sapiens
atctaaacagttatttctg

SEQ ID NO: 6663632 - DNA, 19 bp, Homo sapiens
atctaaaccagaaggaagc

SEQ ID NO: 6663633 - DNA, 24 bp, Homo sapiens
atctaaacccagcaaaacagattc

SEQ ID NO: 6663634 - DNA, 16 bp, Homo sapiens
atctaaacgtggtcac

SEQ ID NO: 6663635 - DNA, 19 bp, Homo sapiens
atctaaacgtggtcacctt

SEQ ID NO: 6663636 - DNA, 18 bp, Homo sapiens
atctaaactttaatatgt

SEQ ID NO: 6663637 - DNA, 21 bp, Homo sapiens
atctaaagcagcaggtctaga

SEQ ID NO: 6663638 - DNA, 20 bp, Homo sapiens
atctaaagctttatctttgt

SEQ ID NO: 6663639 - DNA, 21 bp, Homo sapiens
atctaaaggatggaaaaataa

SEQ ID NO: 6663640 - DNA, 15 bp, Homo sapiens
atctaaagtgtgttg

SEQ ID NO: 6663641 - DNA, 23 bp, Homo sapiens
atctaaagtgtgttgttgcttta

SEQ ID NO: 6663642 - DNA, 12 bp, Homo sapiens
atctaaagttat

SEQ ID NO: 6663643 - DNA, 14 bp, Homo sapiens
atctaaagttatat

SEQ ID NO: 6663644 - DNA, 16 bp, Homo sapiens
atctaaagttatattt

SEQ ID NO: 6663645 - DNA, 18 bp, Homo sapiens
atctaaatagatactttt

SEQ ID NO: 6663646 - DNA, 23 bp, Homo sapiens
atctaaatagatacttttgataa

SEQ ID NO: 6663647 - DNA, 14 bp, Homo sapiens
atctaaatagtatt

SEQ ID NO: 6663648 - DNA, 15 bp, Homo sapiens
atctaaatcaccaga

SEQ ID NO: 6663649 - DNA, 18 bp, Homo sapiens
atctaaatctatttatta

SEQ ID NO: 6663650 - DNA, 14 bp, Homo sapiens
atctaaatgaatga

SEQ ID NO: 6663651 - DNA, 13 bp, Homo sapiens
atctaaatggaac

SEQ ID NO: 6663652 - DNA, 13 bp, Homo sapiens
atctaaattaaaa

SEQ ID NO: 6663653 - DNA, 16 bp, Homo sapiens
atctaaattaaaaaag

SEQ ID NO: 6663654 - DNA, 17 bp, Homo sapiens
atctaacagacaagagt

SEQ ID NO: 6663655 - DNA, 14 bp, Homo sapiens
atctaacattatta

SEQ ID NO: 6663656 - DNA, 15 bp, Homo sapiens
atctaacctcatctt

SEQ ID NO: 6663657 - DNA, 18 bp, Homo sapiens
atctaacgggcattcaca

SEQ ID NO: 6663658 - DNA, 15 bp, Homo sapiens
atctaactttccttc

SEQ ID NO: 6663659 - DNA, 16 bp, Homo sapiens
atctaactttccttcc

SEQ ID NO: 6663660 - DNA, 22 bp, Homo sapiens
atctaagaggattcaacacctt

SEQ ID NO: 6663661 - DNA, 21 bp, Homo sapiens
atctaagcccatgggacaaat

SEQ ID NO: 6663662 - DNA, 16 bp, Homo sapiens
atctaagcctttccat

SEQ ID NO: 6663663 - DNA, 17 bp, Homo sapiens
atctaagcctttccata

SEQ ID NO: 6663664 - DNA, 15 bp, Homo sapiens
atctaagctgtttgc

SEQ ID NO: 6663665 - DNA, 14 bp, Homo sapiens
atctaaggcatgct

SEQ ID NO: 6663666 - DNA, 15 bp, Homo sapiens
atctaaggcatgctc

SEQ ID NO: 6663667 - DNA, 23 bp, Homo sapiens
atctaagtatatgtgagaaatca

SEQ ID NO: 6663668 - DNA, 16 bp, Homo sapiens
atctaagttaatttaa

SEQ ID NO: 6663669 - DNA, 17 bp, Homo sapiens
atctaagttaatttaaa

SEQ ID NO: 6663670 - DNA, 18 bp, Homo sapiens
atctaagttaatttaaag

SEQ ID NO: 6663671 - DNA, 13 bp, Homo sapiens
atctaataaactt

SEQ ID NO: 6663672 - DNA, 17 bp, Homo sapiens
atctaataaactttatt

SEQ ID NO: 6663673 - DNA, 20 bp, Homo sapiens
atctaatatatatgaataaa

SEQ ID NO: 6663674 - DNA, 16 bp, Homo sapiens
atctaatatggccaca

SEQ ID NO: 6663675 - DNA, 23 bp, Homo sapiens
atctaatatgtaacaagccaccc

SEQ ID NO: 6663676 - DNA, 21 bp, Homo sapiens
atctaatcaggttgttaatgt

SEQ ID NO: 6663677 - DNA, 15 bp, Homo sapiens
atctaatctcttatt

SEQ ID NO: 6663678 - DNA, 21 bp, Homo sapiens
atctaatctcttattctaata

SEQ ID NO: 6663679 - DNA, 13 bp, Homo sapiens
atctaatctgaac

SEQ ID NO: 6663680 - DNA, 16 bp, Homo sapiens
atctaatctgaactga

SEQ ID NO: 6663681 - DNA, 17 bp, Homo sapiens
atctaatgaaaaacaaa

SEQ ID NO: 6663682 - DNA, 18 bp, Homo sapiens
atctaatgaaaaacaaaa

SEQ ID NO: 6663683 - DNA, 22 bp, Homo sapiens
atctaatgaaaaacaaaaagct

SEQ ID NO: 6663684 - DNA, 21 bp, Homo sapiens
atctaatgagttgctggaaaa

SEQ ID NO: 6663685 - DNA, 23 bp, Homo sapiens
atctaatgagttgctggaaaatc

SEQ ID NO: 6663686 - DNA, 17 bp, Homo sapiens
atctaatgcttgtttat

SEQ ID NO: 6663687 - DNA, 22 bp, Homo sapiens
atctaatgtaagaaaatttgaa

SEQ ID NO: 6663688 - DNA, 15 bp, Homo sapiens
atctaatgtgaaaat

SEQ ID NO: 6663689 - DNA, 23 bp, Homo sapiens
atctaatgttgtctttttaatgt

SEQ ID NO: 6663690 - DNA, 23 bp, Homo sapiens
atctaattatttccacttgccct

SEQ ID NO: 6663691 - DNA, 16 bp, Homo sapiens
atctaattcttatttt

SEQ ID NO: 6663692 - DNA, 21 bp, Homo sapiens
atctaattcttatttttaatt

SEQ ID NO: 6663693 - DNA, 16 bp, Homo sapiens
atctaatttaccatta

SEQ ID NO: 6663694 - DNA, 18 bp, Homo sapiens
atctaatttatacaaaat

SEQ ID NO: 6663695 - DNA, 19 bp, Homo sapiens
atctaatttatacaaaata

SEQ ID NO: 6663696 - DNA, 18 bp, Homo sapiens
atctaatttttattaatt

SEQ ID NO: 6663697 - DNA, 18 bp, Homo sapiens
atctacaaacttttataa

SEQ ID NO: 6663698 - DNA, 21 bp, Homo sapiens
atctacaaacttttataaatg

SEQ ID NO: 6663699 - DNA, 22 bp, Homo sapiens
atctacaaacttttataaatgt

SEQ ID NO: 6663700 - DNA, 13 bp, Homo sapiens
atctacaagccaa

SEQ ID NO: 6663701 - DNA, 18 bp, Homo sapiens
atctacaatcagttgact

SEQ ID NO: 6663702 - DNA, 20 bp, Homo sapiens
atctacaatcagttgacttt

SEQ ID NO: 6663703 - DNA, 14 bp, Homo sapiens
atctacacacggtg

SEQ ID NO: 6663704 - DNA, 18 bp, Homo sapiens
atctacacagcctggact

SEQ ID NO: 6663705 - DNA, 12 bp, Homo sapiens
atctacacatgt

SEQ ID NO: 6663706 - DNA, 15 bp, Homo sapiens
atctacaccaatgaa

SEQ ID NO: 6663707 - DNA, 16 bp, Homo sapiens
atctacaccaatgaaa

SEQ ID NO: 6663708 - DNA, 19 bp, Homo sapiens
atctacaccaatgaaaaca

SEQ ID NO: 6663709 - DNA, 19 bp, Homo sapiens
atctacactccagtgagac

SEQ ID NO: 6663710 - DNA, 15 bp, Homo sapiens
atctacagaactaca

SEQ ID NO: 6663711 - DNA, 16 bp, Homo sapiens
atctacagaactacat

SEQ ID NO: 6663712 - DNA, 22 bp, Homo sapiens
atctacagatagagagttgttg

SEQ ID NO: 6663713 - DNA, 17 bp, Homo sapiens
atctacagatccttttt

SEQ ID NO: 6663714 - DNA, 23 bp, Homo sapiens
atctacagatcctttttccatca

SEQ ID NO: 6663715 - DNA, 16 bp, Homo sapiens
atctacagctcacctc

SEQ ID NO: 6663716 - DNA, 22 bp, Homo sapiens
atctacaggacaaagggaggga

SEQ ID NO: 6663717 - DNA, 23 bp, Homo sapiens
atctacaggacaaagggagggag

SEQ ID NO: 6663718 - DNA, 21 bp, Homo sapiens
atctacagtaatgaaatgttt

SEQ ID NO: 6663719 - DNA, 17 bp, Homo sapiens
atctacagtacttccag

SEQ ID NO: 6663720 - DNA, 17 bp, Homo sapiens
atctacatcttttttca

SEQ ID NO: 6663721 - DNA, 19 bp, Homo sapiens
atctacattataataaaat

SEQ ID NO: 6663722 - DNA, 20 bp, Homo sapiens
atctacattataccgcagag

SEQ ID NO: 6663723 - DNA, 12 bp, Homo sapiens
atctacatttgt

SEQ ID NO: 6663724 - DNA, 13 bp, Homo sapiens
atctacatttgtt

SEQ ID NO: 6663725 - DNA, 23 bp, Homo sapiens
atctaccagtggtgctcaatgca

SEQ ID NO: 6663726 - DNA, 15 bp, Homo sapiens
atctacccaaaggat

SEQ ID NO: 6663727 - DNA, 21 bp, Homo sapiens
atctacccaagggcagaaagt

SEQ ID NO: 6663728 - DNA, 18 bp, Homo sapiens
atctacccagtcatgtac

SEQ ID NO: 6663729 - DNA, 17 bp, Homo sapiens
atctaccccagggagaa

SEQ ID NO: 6663730 - DNA, 14 bp, Homo sapiens
atctacccgtgcct

SEQ ID NO: 6663731 - DNA, 15 bp, Homo sapiens
atctacccgtgcctg

SEQ ID NO: 6663732 - DNA, 23 bp, Homo sapiens
atctacctaaaggactattatgt

SEQ ID NO: 6663733 - DNA, 21 bp, Homo sapiens
atctacctagatttaatataa

SEQ ID NO: 6663734 - DNA, 17 bp, Homo sapiens
atctacctgcaacacaa

SEQ ID NO: 6663735 - DNA, 15 bp, Homo sapiens
atctacctgctcctt

SEQ ID NO: 6663736 - DNA, 14 bp, Homo sapiens
atctacctgtggtg

SEQ ID NO: 6663737 - DNA, 18 bp, Homo sapiens
atctacctgtgtgtatgt

SEQ ID NO: 6663738 - DNA, 17 bp, Homo sapiens
atctacctgttctgtag

SEQ ID NO: 6663739 - DNA, 21 bp, Homo sapiens
atctacctgttctgtagcttt

SEQ ID NO: 6663740 - DNA, 15 bp, Homo sapiens
atctaccttctgtag

SEQ ID NO: 6663741 - DNA, 17 bp, Homo sapiens
atctaccttctgtagtt

SEQ ID NO: 6663742 - DNA, 14 bp, Homo sapiens
atctaccttttctg

SEQ ID NO: 6663743 - DNA, 19 bp, Homo sapiens
atctaccttttctggcaaa

SEQ ID NO: 6663744 - DNA, 18 bp, Homo sapiens
atctacgtctttattaca

SEQ ID NO: 6663745 - DNA, 22 bp, Homo sapiens
atctactacatcccacattagt

SEQ ID NO: 6663746 - DNA, 14 bp, Homo sapiens
atctactagaacct

SEQ ID NO: 6663747 - DNA, 18 bp, Homo sapiens
atctactcccaagtatgg

SEQ ID NO: 6663748 - DNA, 17 bp, Homo sapiens
atctactctaaagaaaa

SEQ ID NO: 6663749 - DNA, 17 bp, Homo sapiens
atctactcttaaatata

SEQ ID NO: 6663750 - DNA, 17 bp, Homo sapiens
atctactgaatgacctc

SEQ ID NO: 6663751 - DNA, 17 bp, Homo sapiens
atctactgactatattt

SEQ ID NO: 6663752 - DNA, 13 bp, Homo sapiens
atctactgcattt

SEQ ID NO: 6663753 - DNA, 18 bp, Homo sapiens
atctactgcatttaggga

SEQ ID NO: 6663754 - DNA, 23 bp, Homo sapiens
atctactggaaatgtagcactta

SEQ ID NO: 6663755 - DNA, 12 bp, Homo sapiens
atctactgtatc

SEQ ID NO: 6663756 - DNA, 13 bp, Homo sapiens
atctactgtatca

SEQ ID NO: 6663757 - DNA, 15 bp, Homo sapiens
atctacttccaaact

SEQ ID NO: 6663758 - DNA, 19 bp, Homo sapiens
atctacttccaaactaatt

SEQ ID NO: 6663759 - DNA, 13 bp, Homo sapiens
atctacttgcaca

SEQ ID NO: 6663760 - DNA, 14 bp, Homo sapiens
atctacttgcctca

SEQ ID NO: 6663761 - DNA, 13 bp, Homo sapiens
atctacttttttt

SEQ ID NO: 6663762 - DNA, 17 bp, Homo sapiens
atctagaaagaaaagac

SEQ ID NO: 6663763 - DNA, 16 bp, Homo sapiens
atctagaaagagatca

SEQ ID NO: 6663764 - DNA, 17 bp, Homo sapiens
atctagaactatcattt

SEQ ID NO: 6663765 - DNA, 15 bp, Homo sapiens
atctagaagaaatga

SEQ ID NO: 6663766 - DNA, 17 bp, Homo sapiens
atctagaagaaatgaaa

SEQ ID NO: 6663767 - DNA, 20 bp, Homo sapiens
atctagaagaaatgaaattt

SEQ ID NO: 6663768 - DNA, 22 bp, Homo sapiens
atctagaagaaatgaaatttta

SEQ ID NO: 6663769 - DNA, 21 bp, Homo sapiens
atctagaagagtctattgtct

SEQ ID NO: 6663770 - DNA, 13 bp, Homo sapiens
atctagaagatgt

SEQ ID NO: 6663771 - DNA, 14 bp, Homo sapiens
atctagaagatgtg

SEQ ID NO: 6663772 - DNA, 14 bp, Homo sapiens
atctagaattcact

SEQ ID NO: 6663773 - DNA, 23 bp, Homo sapiens
atctagaattcactgagttttgt

SEQ ID NO: 6663774 - DNA, 16 bp, Homo sapiens
atctagagcaaagcca

SEQ ID NO: 6663775 - DNA, 18 bp, Homo sapiens
atctagagcttgatgcca

SEQ ID NO: 6663776 - DNA, 20 bp, Homo sapiens
atctagaggagggggcaggc

SEQ ID NO: 6663777 - DNA, 16 bp, Homo sapiens
atctagaggcaagcct

SEQ ID NO: 6663778 - DNA, 19 bp, Homo sapiens
atctagatactgtatcatg

SEQ ID NO: 6663779 - DNA, 21 bp, Homo sapiens
atctagatctttgtgccaaac

SEQ ID NO: 6663780 - DNA, 13 bp, Homo sapiens
atctagatgtaaa

SEQ ID NO: 6663781 - DNA, 14 bp, Homo sapiens
atctagatgtaaat

SEQ ID NO: 6663782 - DNA, 17 bp, Homo sapiens
atctagatgtaaatttt

SEQ ID NO: 6663783 - DNA, 13 bp, Homo sapiens
atctagatttcta

SEQ ID NO: 6663784 - DNA, 17 bp, Homo sapiens
atctagcacagctgtga

SEQ ID NO: 6663785 - DNA, 15 bp, Homo sapiens
atctagcactcctca

SEQ ID NO: 6663786 - DNA, 16 bp, Homo sapiens
atctagcagctggcct

SEQ ID NO: 6663787 - DNA, 17 bp, Homo sapiens
atctagcagtaaaagat

SEQ ID NO: 6663788 - DNA, 16 bp, Homo sapiens
atctagccagaggctg

SEQ ID NO: 6663789 - DNA, 14 bp, Homo sapiens
atctagccaggcct

SEQ ID NO: 6663790 - DNA, 17 bp, Homo sapiens
atctagccaggcctccc

SEQ ID NO: 6663791 - DNA, 19 bp, Homo sapiens
atctagccagtgaacataa

SEQ ID NO: 6663792 - DNA, 18 bp, Homo sapiens
atctagcccaacctacat

SEQ ID NO: 6663793 - DNA, 22 bp, Homo sapiens
atctagctccataattgcaagg

SEQ ID NO: 6663794 - DNA, 14 bp, Homo sapiens
atctagcttcttca

SEQ ID NO: 6663795 - DNA, 20 bp, Homo sapiens
atctaggcatgaagagcaaa

SEQ ID NO: 6663796 - DNA, 16 bp, Homo sapiens
atctaggcatttcatt

SEQ ID NO: 6663797 - DNA, 23 bp, Homo sapiens
atctagggaatgggactgtgagg

SEQ ID NO: 6663798 - DNA, 19 bp, Homo sapiens
atctaggggagccttgatt

SEQ ID NO: 6663799 - DNA, 21 bp, Homo sapiens
atctaggtggagttgaaagag

SEQ ID NO: 6663800 - DNA, 20 bp, Homo sapiens
atctaggtgtggctgtgaag

SEQ ID NO: 6663801 - DNA, 13 bp, Homo sapiens
atctaggtttaac

SEQ ID NO: 6663802 - DNA, 22 bp, Homo sapiens
atctaggtttaactcagatcac

SEQ ID NO: 6663803 - DNA, 15 bp, Homo sapiens
atctaggtttatgac

SEQ ID NO: 6663804 - DNA, 21 bp, Homo sapiens
atctaggtttatgacagtaat

SEQ ID NO: 6663805 - DNA, 22 bp, Homo sapiens
atctagtaggtctgcacacata

SEQ ID NO: 6663806 - DNA, 12 bp, Homo sapiens
atctagtagttg

SEQ ID NO: 6663807 - DNA, 21 bp, Homo sapiens
atctagtagttgttctgaaat

SEQ ID NO: 6663808 - DNA, 18 bp, Homo sapiens
atctagtatgaaattata

SEQ ID NO: 6663809 - DNA, 17 bp, Homo sapiens
atctagtcacaaagact

SEQ ID NO: 6663810 - DNA, 18 bp, Homo sapiens
atctagtcagtatctgta

SEQ ID NO: 6663811 - DNA, 20 bp, Homo sapiens
atctagtctgaagtctggaa

SEQ ID NO: 6663812 - DNA, 15 bp, Homo sapiens
atctagtcttgacct

SEQ ID NO: 6663813 - DNA, 20 bp, Homo sapiens
atctagtcttgacctctcca

SEQ ID NO: 6663814 - DNA, 21 bp, Homo sapiens
atctagtcttgacctctccag

SEQ ID NO: 6663815 - DNA, 17 bp, Homo sapiens
atctagtgcagctgatt

SEQ ID NO: 6663816 - DNA, 18 bp, Homo sapiens
atctagtgcagctgattt

SEQ ID NO: 6663817 - DNA, 19 bp, Homo sapiens
atctagtgcagctgatttt

SEQ ID NO: 6663818 - DNA, 12 bp, Homo sapiens
atctagtgctaa

SEQ ID NO: 6663819 - DNA, 16 bp, Homo sapiens
atctagtgctaaacct

SEQ ID NO: 6663820 - DNA, 17 bp, Homo sapiens
atctagtgctaaaccta

SEQ ID NO: 6663821 - DNA, 18 bp, Homo sapiens
atctagtgctaaacctat

SEQ ID NO: 6663822 - DNA, 19 bp, Homo sapiens
atctagtgctaaacctatc

SEQ ID NO: 6663823 - DNA, 20 bp, Homo sapiens
atctagtgctaaacctatct

SEQ ID NO: 6663824 - DNA, 21 bp, Homo sapiens
atctagtgctaaacctatctg

SEQ ID NO: 6663825 - DNA, 23 bp, Homo sapiens
atctagtgctaaacctatctgta

SEQ ID NO: 6663826 - DNA, 11 bp, Homo sapiens
atctagtgttg

SEQ ID NO: 6663827 - DNA, 19 bp, Homo sapiens
atctagttaagtcgctgaa

SEQ ID NO: 6663828 - DNA, 22 bp, Homo sapiens
atctagttatttacaggaactt

SEQ ID NO: 6663829 - DNA, 17 bp, Homo sapiens
atctagttcagaaggaa

SEQ ID NO: 6663830 - DNA, 18 bp, Homo sapiens
atctagttctcttctcct

SEQ ID NO: 6663831 - DNA, 21 bp, Homo sapiens
atctagttctcttctcctgtg

SEQ ID NO: 6663832 - DNA, 22 bp, Homo sapiens
atctagtttacagaaaaatctt

SEQ ID NO: 6663833 - DNA, 17 bp, Homo sapiens
atctagttttttttgta

SEQ ID NO: 6663834 - DNA, 18 bp, Homo sapiens
atctagttttttttgtaa

SEQ ID NO: 6663835 - DNA, 12 bp, Homo sapiens
atctataaaata

SEQ ID NO: 6663836 - DNA, 14 bp, Homo sapiens
atctataaaatgag

SEQ ID NO: 6663837 - DNA, 13 bp, Homo sapiens
atctataaacact

SEQ ID NO: 6663838 - DNA, 15 bp, Homo sapiens
atctataacaaatgc

SEQ ID NO: 6663839 - DNA, 19 bp, Homo sapiens
atctataactacatattga

SEQ ID NO: 6663840 - DNA, 23 bp, Homo sapiens
atctataagtagtaaatcagaaa

SEQ ID NO: 6663841 - DNA, 11 bp, Homo sapiens
atctataatat

SEQ ID NO: 6663842 - DNA, 11 bp, Homo sapiens
atctataattt

SEQ ID NO: 6663843 - DNA, 13 bp, Homo sapiens
atctataatttac

SEQ ID NO: 6663844 - DNA, 14 bp, Homo sapiens
atctatacctgcct

SEQ ID NO: 6663845 - DNA, 22 bp, Homo sapiens
atctatacctgccttttaagtt

SEQ ID NO: 6663846 - DNA, 15 bp, Homo sapiens
atctatagaaagtgt

SEQ ID NO: 6663847 - DNA, 16 bp, Homo sapiens
atctatagaaagtgtt

SEQ ID NO: 6663848 - DNA, 23 bp, Homo sapiens
atctatagaaagtgttctgttac

SEQ ID NO: 6663849 - DNA, 22 bp, Homo sapiens
atctatagataacggctctcca

SEQ ID NO: 6663850 - DNA, 18 bp, Homo sapiens
atctatagtagtcaatta

SEQ ID NO: 6663851 - DNA, 18 bp, Homo sapiens
atctatagtatagaatga

SEQ ID NO: 6663852 - DNA, 12 bp, Homo sapiens
atctatataaaa

SEQ ID NO: 6663853 - DNA, 16 bp, Homo sapiens
atctatataaaataac

SEQ ID NO: 6663854 - DNA, 19 bp, Homo sapiens
atctatatataattctgta

SEQ ID NO: 6663855 - DNA, 14 bp, Homo sapiens
atctatatatataa

SEQ ID NO: 6663856 - DNA, 14 bp, Homo sapiens
atctatatatgtat

SEQ ID NO: 6663857 - DNA, 16 bp, Homo sapiens
atctatatatgtatct

SEQ ID NO: 6663858 - DNA, 17 bp, Homo sapiens
atctatatcatatttct

SEQ ID NO: 6663859 - DNA, 18 bp, Homo sapiens
atctatatctctaaactg

SEQ ID NO: 6663860 - DNA, 21 bp, Homo sapiens
atctatatgtacttgtcaaag

SEQ ID NO: 6663861 - DNA, 22 bp, Homo sapiens
atctatatgtacttgtcaaaga

SEQ ID NO: 6663862 - DNA, 23 bp, Homo sapiens
atctatatgtacttgtcaaagaa

SEQ ID NO: 6663863 - DNA, 15 bp, Homo sapiens
atctatattaaagtg

SEQ ID NO: 6663864 - DNA, 16 bp, Homo sapiens
atctatattctaaaga

SEQ ID NO: 6663865 - DNA, 18 bp, Homo sapiens
atctatattctatacaca

SEQ ID NO: 6663866 - DNA, 18 bp, Homo sapiens
atctatatttgtcttccg

SEQ ID NO: 6663867 - DNA, 13 bp, Homo sapiens
atctatattttgg

SEQ ID NO: 6663868 - DNA, 18 bp, Homo sapiens
atctatatttttgtgaag

SEQ ID NO: 6663869 - DNA, 13 bp, Homo sapiens
atctatcaaaatt

SEQ ID NO: 6663870 - DNA, 15 bp, Homo sapiens
atctatcaaaattac

SEQ ID NO: 6663871 - DNA, 20 bp, Homo sapiens
atctatcaatagtcaagaaa

SEQ ID NO: 6663872 - DNA, 16 bp, Homo sapiens
atctatcacctgtcat

SEQ ID NO: 6663873 - DNA, 14 bp, Homo sapiens
atctatcactgcat

SEQ ID NO: 6663874 - DNA, 15 bp, Homo sapiens
atctatcactgcatt

SEQ ID NO: 6663875 - DNA, 19 bp, Homo sapiens
atctatccacactgtcaaa

SEQ ID NO: 6663876 - DNA, 17 bp, Homo sapiens
atctatcgagtttgcaa

SEQ ID NO: 6663877 - DNA, 15 bp, Homo sapiens
atctatcggaagaac

SEQ ID NO: 6663878 - DNA, 19 bp, Homo sapiens
atctatcggaagaacatga

SEQ ID NO: 6663879 - DNA, 20 bp, Homo sapiens
atctatcggaagaacatgaa

SEQ ID NO: 6663880 - DNA, 23 bp, Homo sapiens
atctatcggaagaacatgaatct

SEQ ID NO: 6663881 - DNA, 15 bp, Homo sapiens
atctatctatttgag

SEQ ID NO: 6663882 - DNA, 19 bp, Homo sapiens
atctatctcatctatctca

SEQ ID NO: 6663883 - DNA, 19 bp, Homo sapiens
atctatctgcttatgcagt

SEQ ID NO: 6663884 - DNA, 18 bp, Homo sapiens
atctatcttatatagttt

SEQ ID NO: 6663885 - DNA, 12 bp, Homo sapiens
atctatgaaaac

SEQ ID NO: 6663886 - DNA, 16 bp, Homo sapiens
atctatgaaaaccagt

SEQ ID NO: 6663887 - DNA, 15 bp, Homo sapiens
atctatgaacctgaa

SEQ ID NO: 6663888 - DNA, 16 bp, Homo sapiens
atctatgactgtgttt

SEQ ID NO: 6663889 - DNA, 15 bp, Homo sapiens
atctatgatataacc

SEQ ID NO: 6663890 - DNA, 17 bp, Homo sapiens
atctatgatatatttat

SEQ ID NO: 6663891 - DNA, 23 bp, Homo sapiens
atctatgatgtttcttttgcaat

SEQ ID NO: 6663892 - DNA, 14 bp, Homo sapiens
atctatgcaaagca

SEQ ID NO: 6663893 - DNA, 19 bp, Homo sapiens
atctatgcaatttttaaac

SEQ ID NO: 6663894 - DNA, 20 bp, Homo sapiens
atctatgcaatttttaaact

SEQ ID NO: 6663895 - DNA, 22 bp, Homo sapiens
atctatgcaatttttaaactag

SEQ ID NO: 6663896 - DNA, 16 bp, Homo sapiens
atctatgctggtgaaa

SEQ ID NO: 6663897 - DNA, 19 bp, Homo sapiens
atctatgctggtgaaaaca

SEQ ID NO: 6663898 - DNA, 18 bp, Homo sapiens
atctatggaaatgtgaga

SEQ ID NO: 6663899 - DNA, 22 bp, Homo sapiens
atctatggccctgcaaaaatat

SEQ ID NO: 6663900 - DNA, 13 bp, Homo sapiens
atctatggcttat

SEQ ID NO: 6663901 - DNA, 18 bp, Homo sapiens
atctatggcttatttcta

SEQ ID NO: 6663902 - DNA, 19 bp, Homo sapiens
atctatggctttaaataaa

SEQ ID NO: 6663903 - DNA, 22 bp, Homo sapiens
atctatggctttaaataaatta

SEQ ID NO: 6663904 - DNA, 16 bp, Homo sapiens
atctatgggaaatcta

SEQ ID NO: 6663905 - DNA, 17 bp, Homo sapiens
atctatgggaaatctag

SEQ ID NO: 6663906 - DNA, 18 bp, Homo sapiens
atctatgggaaatctagg

SEQ ID NO: 6663907 - DNA, 23 bp, Homo sapiens
atctatgggagagtgtcaaccag

SEQ ID NO: 6663908 - DNA, 15 bp, Homo sapiens
atctatggttctaaa

SEQ ID NO: 6663909 - DNA, 17 bp, Homo sapiens
atctatggttctaaata

SEQ ID NO: 6663910 - DNA, 22 bp, Homo sapiens
atctatgtcatattttgccact

SEQ ID NO: 6663911 - DNA, 13 bp, Homo sapiens
atctatgtgcacc

SEQ ID NO: 6663912 - DNA, 19 bp, Homo sapiens
atctatgtgtttctgtaac

SEQ ID NO: 6663913 - DNA, 20 bp, Homo sapiens
atctatgtgtttctgtaaca

SEQ ID NO: 6663914 - DNA, 22 bp, Homo sapiens
atctatgtgtttctgtaacaaa

SEQ ID NO: 6663915 - DNA, 15 bp, Homo sapiens
atctatgtttataat

SEQ ID NO: 6663916 - DNA, 21 bp, Homo sapiens
atctatgtttataatactact

SEQ ID NO: 6663917 - DNA, 16 bp, Homo sapiens
atctatgtttgtgtga

SEQ ID NO: 6663918 - DNA, 17 bp, Homo sapiens
atctatgtttgtgtgat

SEQ ID NO: 6663919 - DNA, 19 bp, Homo sapiens
atctatgtttgtgtgattt

SEQ ID NO: 6663920 - DNA, 16 bp, Homo sapiens
atctattaaaattgcc

SEQ ID NO: 6663921 - DNA, 16 bp, Homo sapiens
atctattaaagtgact

SEQ ID NO: 6663922 - DNA, 17 bp, Homo sapiens
atctattaaagtgactt

SEQ ID NO: 6663923 - DNA, 22 bp, Homo sapiens
atctattaagggattagtattt

SEQ ID NO: 6663924 - DNA, 12 bp, Homo sapiens
atctattaatat

SEQ ID NO: 6663925 - DNA, 15 bp, Homo sapiens
atctattaatatatg

SEQ ID NO: 6663926 - DNA, 21 bp, Homo sapiens
atctattacttttgcaaactg

SEQ ID NO: 6663927 - DNA, 22 bp, Homo sapiens
atctattatactttatcaaaga

SEQ ID NO: 6663928 - DNA, 15 bp, Homo sapiens
atctattatttggag

SEQ ID NO: 6663929 - DNA, 15 bp, Homo sapiens
atctattcagacaag

SEQ ID NO: 6663930 - DNA, 22 bp, Homo sapiens
atctattcagacaagcaacagg

SEQ ID NO: 6663931 - DNA, 19 bp, Homo sapiens
atctattctcaaagctaaa

SEQ ID NO: 6663932 - DNA, 18 bp, Homo sapiens
atctattctgagaaaaca

SEQ ID NO: 6663933 - DNA, 17 bp, Homo sapiens
atctattgaaaatatat

SEQ ID NO: 6663934 - DNA, 23 bp, Homo sapiens
atctattgaaaatatatattata

SEQ ID NO: 6663935 - DNA, 18 bp, Homo sapiens
atctattgatagtttcat

SEQ ID NO: 6663936 - DNA, 15 bp, Homo sapiens
atctattgatttgaa

SEQ ID NO: 6663937 - DNA, 16 bp, Homo sapiens
atctattgatttgaaa

SEQ ID NO: 6663938 - DNA, 19 bp, Homo sapiens
atctattgcagagactcat

SEQ ID NO: 6663939 - DNA, 19 bp, Homo sapiens
atctattgcagatatttga

SEQ ID NO: 6663940 - DNA, 14 bp, Homo sapiens
atctattgctcatc

SEQ ID NO: 6663941 - DNA, 17 bp, Homo sapiens
atctattgggattttct

SEQ ID NO: 6663942 - DNA, 16 bp, Homo sapiens
atctattgggttcatt

SEQ ID NO: 6663943 - DNA, 19 bp, Homo sapiens
atctattgggttcattatt

SEQ ID NO: 6663944 - DNA, 15 bp, Homo sapiens
atctattgtaagata

SEQ ID NO: 6663945 - DNA, 20 bp, Homo sapiens
atctattgtaagataaaaaa

SEQ ID NO: 6663946 - DNA, 21 bp, Homo sapiens
atctattgtaagataaaaaag

SEQ ID NO: 6663947 - DNA, 22 bp, Homo sapiens
atctattgtgttggctttacaa

SEQ ID NO: 6663948 - DNA, 18 bp, Homo sapiens
atctatttaaaaaactgt

SEQ ID NO: 6663949 - DNA, 15 bp, Homo sapiens
atctatttacataaa

SEQ ID NO: 6663950 - DNA, 13 bp, Homo sapiens
atctatttattaa

SEQ ID NO: 6663951 - DNA, 23 bp, Homo sapiens
atctatttattagtcagagtttc

SEQ ID NO: 6663952 - DNA, 16 bp, Homo sapiens
atctatttgaataaat

SEQ ID NO: 6663953 - DNA, 23 bp, Homo sapiens
atctatttgcaccttaaaagaca

SEQ ID NO: 6663954 - DNA, 13 bp, Homo sapiens
atctatttggaac

SEQ ID NO: 6663955 - DNA, 20 bp, Homo sapiens
atctatttgtacaattttaa

SEQ ID NO: 6663956 - DNA, 22 bp, Homo sapiens
atctattttaccatatgtttat

SEQ ID NO: 6663957 - DNA, 12 bp, Homo sapiens
atctattttcag

SEQ ID NO: 6663958 - DNA, 18 bp, Homo sapiens
atctattttctatgtact

SEQ ID NO: 6663959 - DNA, 20 bp, Homo sapiens
atctattttctatgtactag

SEQ ID NO: 6663960 - DNA, 14 bp, Homo sapiens
atctattttctcag

SEQ ID NO: 6663961 - DNA, 12 bp, Homo sapiens
atctattttgat

SEQ ID NO: 6663962 - DNA, 20 bp, Homo sapiens
atctattttgatgcagcatt

SEQ ID NO: 6663963 - DNA, 23 bp, Homo sapiens
atctatttttggcagtctgaatt

SEQ ID NO: 6663964 - DNA, 13 bp, Homo sapiens
atctcaaaacaaa

SEQ ID NO: 6663965 - DNA, 16 bp, Homo sapiens
atctcaaaacaaaaca

SEQ ID NO: 6663966 - DNA, 15 bp, Homo sapiens
atctcaaacaattga

SEQ ID NO: 6663967 - DNA, 17 bp, Homo sapiens
atctcaaagcacaatgt

SEQ ID NO: 6663968 - DNA, 14 bp, Homo sapiens
atctcaaaggagaa

SEQ ID NO: 6663969 - DNA, 15 bp, Homo sapiens
atctcaaaggagaaa

SEQ ID NO: 6663970 - DNA, 18 bp, Homo sapiens
atctcaaatacagtagta

SEQ ID NO: 6663971 - DNA, 23 bp, Homo sapiens
atctcaaataggctattaaaaaa

SEQ ID NO: 6663972 - DNA, 13 bp, Homo sapiens
atctcaaatccac

SEQ ID NO: 6663973 - DNA, 22 bp, Homo sapiens
atctcaaatccactgacagata

SEQ ID NO: 6663974 - DNA, 17 bp, Homo sapiens
atctcaaatctgctttc

SEQ ID NO: 6663975 - DNA, 18 bp, Homo sapiens
atctcaaatctgctttca

SEQ ID NO: 6663976 - DNA, 23 bp, Homo sapiens
atctcaaatctgctttcatccag

SEQ ID NO: 6663977 - DNA, 13 bp, Homo sapiens
atctcaaatttat

SEQ ID NO: 6663978 - DNA, 14 bp, Homo sapiens
atctcaacatgtct

SEQ ID NO: 6663979 - DNA, 20 bp, Homo sapiens
atctcaagcaagtttaatca

SEQ ID NO: 6663980 - DNA, 15 bp, Homo sapiens
atctcaagccagccc

SEQ ID NO: 6663981 - DNA, 14 bp, Homo sapiens
atctcaagtatata

SEQ ID NO: 6663982 - DNA, 17 bp, Homo sapiens
atctcaagtatataaag

SEQ ID NO: 6663983 - DNA, 19 bp, Homo sapiens
atctcaagtatatgtcatt

SEQ ID NO: 6663984 - DNA, 17 bp, Homo sapiens
atctcaataaaccagtg

SEQ ID NO: 6663985 - DNA, 19 bp, Homo sapiens
atctcaataaagtgcttta

SEQ ID NO: 6663986 - DNA, 14 bp, Homo sapiens
atctcaatctgcag

SEQ ID NO: 6663987 - DNA, 15 bp, Homo sapiens
atctcaatctgcagc

SEQ ID NO: 6663988 - DNA, 16 bp, Homo sapiens
atctcaatctgcagcc

SEQ ID NO: 6663989 - DNA, 14 bp, Homo sapiens
atctcaatcttggt

SEQ ID NO: 6663990 - DNA, 22 bp, Homo sapiens
atctcaatcttggtttgtcagt

SEQ ID NO: 6663991 - DNA, 12 bp, Homo sapiens
atctcaatgcaa

SEQ ID NO: 6663992 - DNA, 14 bp, Homo sapiens
atctcaatgcaagc

SEQ ID NO: 6663993 - DNA, 22 bp, Homo sapiens
atctcaatgcaagccccaactt

SEQ ID NO: 6663994 - DNA, 17 bp, Homo sapiens
atctcaattgaaagctt

SEQ ID NO: 6663995 - DNA, 18 bp, Homo sapiens
atctcaatttaagataca

SEQ ID NO: 6663996 - DNA, 12 bp, Homo sapiens
atctcaatttta

SEQ ID NO: 6663997 - DNA, 16 bp, Homo sapiens
atctcaattttttcaa

SEQ ID NO: 6663998 - DNA, 18 bp, Homo sapiens
atctcaattttttcaaat

SEQ ID NO: 6663999 - DNA, 16 bp, Homo sapiens
atctcacacagctggg

SEQ ID NO: 6664000 - DNA, 20 bp, Homo sapiens
atctcacactcatgcattgt

SEQ ID NO: 6664001 - DNA, 18 bp, Homo sapiens
atctcacagatcttcaac

SEQ ID NO: 6664002 - DNA, 15 bp, Homo sapiens
atctcacagcacact

SEQ ID NO: 6664003 - DNA, 14 bp, Homo sapiens
atctcacaggctga

SEQ ID NO: 6664004 - DNA, 16 bp, Homo sapiens
atctcacatatacaag

SEQ ID NO: 6664005 - DNA, 13 bp, Homo sapiens
atctcaccccatc

SEQ ID NO: 6664006 - DNA, 23 bp, Homo sapiens
atctcaccccatcccacaccctg

SEQ ID NO: 6664007 - DNA, 22 bp, Homo sapiens
atctcacctaatggttgtacat

SEQ ID NO: 6664008 - DNA, 14 bp, Homo sapiens
atctcactaaaaat

SEQ ID NO: 6664009 - DNA, 12 bp, Homo sapiens
atctcactctcc

SEQ ID NO: 6664010 - DNA, 12 bp, Homo sapiens
atctcactctgc

SEQ ID NO: 6664011 - DNA, 14 bp, Homo sapiens
atctcactctgccc

SEQ ID NO: 6664012 - DNA, 12 bp, Homo sapiens
atctcactgccc

SEQ ID NO: 6664013 - DNA, 14 bp, Homo sapiens
atctcactgcccag

SEQ ID NO: 6664014 - DNA, 14 bp, Homo sapiens
atctcactgtatta

SEQ ID NO: 6664015 - DNA, 17 bp, Homo sapiens
atctcacttcagttgtg

SEQ ID NO: 6664016 - DNA, 14 bp, Homo sapiens
atctcacttcatca

SEQ ID NO: 6664017 - DNA, 19 bp, Homo sapiens
atctcacttcatcaatcaa

SEQ ID NO: 6664018 - DNA, 20 bp, Homo sapiens
atctcacttcatcaatcaaa

SEQ ID NO: 6664019 - DNA, 13 bp, Homo sapiens
atctcacttccag

SEQ ID NO: 6664020 - DNA, 14 bp, Homo sapiens
atctcacttccaga

SEQ ID NO: 6664021 - DNA, 15 bp, Homo sapiens
atctcacttcttctt

SEQ ID NO: 6664022 - DNA, 13 bp, Homo sapiens
atctcactttgcc

SEQ ID NO: 6664023 - DNA, 14 bp, Homo sapiens
atctcactttgccc

SEQ ID NO: 6664024 - DNA, 13 bp, Homo sapiens
atctcactttgta

SEQ ID NO: 6664025 - DNA, 23 bp, Homo sapiens
atctcactttgtaaataaaaaca

SEQ ID NO: 6664026 - DNA, 15 bp, Homo sapiens
atctcacttttctcc

SEQ ID NO: 6664027 - DNA, 19 bp, Homo sapiens
atctcacttttctccatga

SEQ ID NO: 6664028 - DNA, 17 bp, Homo sapiens
atctcagaaagtgcctg

SEQ ID NO: 6664029 - DNA, 20 bp, Homo sapiens
atctcagaaagtgcctgaca

SEQ ID NO: 6664030 - DNA, 22 bp, Homo sapiens
atctcagaaccttgtcccagcc

SEQ ID NO: 6664031 - DNA, 19 bp, Homo sapiens
atctcagaggctatagctg

SEQ ID NO: 6664032 - DNA, 18 bp, Homo sapiens
atctcagagtccactgtg

SEQ ID NO: 6664033 - DNA, 19 bp, Homo sapiens
atctcagagtccactgtgg

SEQ ID NO: 6664034 - DNA, 16 bp, Homo sapiens
atctcagatatttgca

SEQ ID NO: 6664035 - DNA, 19 bp, Homo sapiens
atctcagatcactgcaacc

SEQ ID NO: 6664036 - DNA, 17 bp, Homo sapiens
atctcagattctgtcta

SEQ ID NO: 6664037 - DNA, 20 bp, Homo sapiens
atctcagcaaagctacagga

SEQ ID NO: 6664038 - DNA, 18 bp, Homo sapiens
atctcagcagccagctcc

SEQ ID NO: 6664039 - DNA, 23 bp, Homo sapiens
atctcagcatcctggaaatttgt

SEQ ID NO: 6664040 - DNA, 17 bp, Homo sapiens
atctcagccatccgcag

SEQ ID NO: 6664041 - DNA, 17 bp, Homo sapiens
atctcagccctgcaact

SEQ ID NO: 6664042 - DNA, 12 bp, Homo sapiens
atctcagcctcc

SEQ ID NO: 6664043 - DNA, 22 bp, Homo sapiens
atctcagcctcccaagtagcta

SEQ ID NO: 6664044 - DNA, 20 bp, Homo sapiens
atctcagctactcaggaggc

SEQ ID NO: 6664045 - DNA, 15 bp, Homo sapiens
atctcagctcactac

SEQ ID NO: 6664046 - DNA, 18 bp, Homo sapiens
atctcagctcactgcaag

SEQ ID NO: 6664047 - DNA, 20 bp, Homo sapiens
atctcagctcactgtgacct

SEQ ID NO: 6664048 - DNA, 16 bp, Homo sapiens
atctcagctcatcttc

SEQ ID NO: 6664049 - DNA, 19 bp, Homo sapiens
atctcaggaaaatctgtga

SEQ ID NO: 6664050 - DNA, 16 bp, Homo sapiens
atctcaggacccgccc

SEQ ID NO: 6664051 - DNA, 21 bp, Homo sapiens
atctcaggagatggagggctt

SEQ ID NO: 6664052 - DNA, 12 bp, Homo sapiens
atctcaggagct

SEQ ID NO: 6664053 - DNA, 23 bp, Homo sapiens
atctcaggataaagtttgctaag

SEQ ID NO: 6664054 - DNA, 14 bp, Homo sapiens
atctcaggccacct

SEQ ID NO: 6664055 - DNA, 15 bp, Homo sapiens
atctcaggccacctg

SEQ ID NO: 6664056 - DNA, 17 bp, Homo sapiens
atctcaggccacctgcc

SEQ ID NO: 6664057 - DNA, 19 bp, Homo sapiens
atctcaggccacctgcccc

SEQ ID NO: 6664058 - DNA, 18 bp, Homo sapiens
atctcaggccagagccaa

SEQ ID NO: 6664059 - DNA, 16 bp, Homo sapiens
atctcagggaagccca

SEQ ID NO: 6664060 - DNA, 20 bp, Homo sapiens
atctcagggaagcccagctc

SEQ ID NO: 6664061 - DNA, 13 bp, Homo sapiens
atctcagggaggg

SEQ ID NO: 6664062 - DNA, 23 bp, Homo sapiens
atctcaggggccagaggaactgt

SEQ ID NO: 6664063 - DNA, 17 bp, Homo sapiens
atctcaggggctgtttg

SEQ ID NO: 6664064 - DNA, 21 bp, Homo sapiens
atctcaggggctgtttgagga

SEQ ID NO: 6664065 - DNA, 18 bp, Homo sapiens
atctcagggtccagaccc

SEQ ID NO: 6664066 - DNA, 17 bp, Homo sapiens
atctcaggtgccactcc

SEQ ID NO: 6664067 - DNA, 21 bp, Homo sapiens
atctcaggttaagtgtgagta

SEQ ID NO: 6664068 - DNA, 16 bp, Homo sapiens
atctcaggttctcctt

SEQ ID NO: 6664069 - DNA, 15 bp, Homo sapiens
atctcagtcatgcat

SEQ ID NO: 6664070 - DNA, 18 bp, Homo sapiens
atctcagtcatgcataaa

SEQ ID NO: 6664071 - DNA, 21 bp, Homo sapiens
atctcagtcatgcataaatat

SEQ ID NO: 6664072 - DNA, 16 bp, Homo sapiens
atctcagtggtgtgtg

SEQ ID NO: 6664073 - DNA, 21 bp, Homo sapiens
atctcagttgattttctggat

SEQ ID NO: 6664074 - DNA, 20 bp, Homo sapiens
atctcagttgtttgcttctt

SEQ ID NO: 6664075 - DNA, 19 bp, Homo sapiens
atctcatacaagccattta

SEQ ID NO: 6664076 - DNA, 22 bp, Homo sapiens
atctcatacacaactgttcccg

SEQ ID NO: 6664077 - DNA, 17 bp, Homo sapiens
atctcataggttgccaa

SEQ ID NO: 6664078 - DNA, 20 bp, Homo sapiens
atctcatcaggcaaattgta

SEQ ID NO: 6664079 - DNA, 13 bp, Homo sapiens
atctcatcatgtc

SEQ ID NO: 6664080 - DNA, 16 bp, Homo sapiens
atctcatcatgtctat

SEQ ID NO: 6664081 - DNA, 19 bp, Homo sapiens
atctcatcatgtctattgt

SEQ ID NO: 6664082 - DNA, 15 bp, Homo sapiens
atctcatccccccac

SEQ ID NO: 6664083 - DNA, 14 bp, Homo sapiens
atctcatccctcaa

SEQ ID NO: 6664084 - DNA, 16 bp, Homo sapiens
atctcatccctcaact

SEQ ID NO: 6664085 - DNA, 18 bp, Homo sapiens
atctcatccctcaactga

SEQ ID NO: 6664086 - DNA, 23 bp, Homo sapiens
atctcatcctattacttttcatc

SEQ ID NO: 6664087 - DNA, 15 bp, Homo sapiens
atctcatcctggcac

SEQ ID NO: 6664088 - DNA, 20 bp, Homo sapiens
atctcatctcagtgaagaat

SEQ ID NO: 6664089 - DNA, 21 bp, Homo sapiens
atctcatctgccggcccccag

SEQ ID NO: 6664090 - DNA, 21 bp, Homo sapiens
atctcatgacattatatttga

SEQ ID NO: 6664091 - DNA, 18 bp, Homo sapiens
atctcatgccagtgcctt

SEQ ID NO: 6664092 - DNA, 19 bp, Homo sapiens
atctcatgccagtgcctta

SEQ ID NO: 6664093 - DNA, 21 bp, Homo sapiens
atctcatgcccctggctggga

SEQ ID NO: 6664094 - DNA, 17 bp, Homo sapiens
atctcatggaaactggc

SEQ ID NO: 6664095 - DNA, 16 bp, Homo sapiens
atctcatgtatcatct

SEQ ID NO: 6664096 - DNA, 20 bp, Homo sapiens
atctcatgtctgtttaatac

SEQ ID NO: 6664097 - DNA, 20 bp, Homo sapiens
atctcattactgcttcattt

SEQ ID NO: 6664098 - DNA, 22 bp, Homo sapiens
atctcattcaggtgttctcttc

SEQ ID NO: 6664099 - DNA, 22 bp, Homo sapiens
atctcattgcaaaaatatttta

SEQ ID NO: 6664100 - DNA, 22 bp, Homo sapiens
atctcattgctgttttaatttg

SEQ ID NO: 6664101 - DNA, 17 bp, Homo sapiens
atctcattgcttacaag

SEQ ID NO: 6664102 - DNA, 19 bp, Homo sapiens
atctcattggacccttcca

SEQ ID NO: 6664103 - DNA, 20 bp, Homo sapiens
atctcattggacccttccat

SEQ ID NO: 6664104 - DNA, 17 bp, Homo sapiens
atctcatttaagggaaa

SEQ ID NO: 6664105 - DNA, 19 bp, Homo sapiens
atctcatttaagggaaaaa

SEQ ID NO: 6664106 - DNA, 23 bp, Homo sapiens
atctcatttaagggaaaaatata

SEQ ID NO: 6664107 - DNA, 19 bp, Homo sapiens
atctcatttaatttgttat

SEQ ID NO: 6664108 - DNA, 23 bp, Homo sapiens
atctcatttataatgtagcagct

SEQ ID NO: 6664109 - DNA, 16 bp, Homo sapiens
atctcatttctcaaca

SEQ ID NO: 6664110 - DNA, 14 bp, Homo sapiens
atctccaaaataaa

SEQ ID NO: 6664111 - DNA, 20 bp, Homo sapiens
atctccaaaataaaactttt

SEQ ID NO: 6664112 - DNA, 21 bp, Homo sapiens
atctccaaaataaaacttttt

SEQ ID NO: 6664113 - DNA, 22 bp, Homo sapiens
atctccaaagctttcctggaga

SEQ ID NO: 6664114 - DNA, 15 bp, Homo sapiens
atctccaactttatt

SEQ ID NO: 6664115 - DNA, 14 bp, Homo sapiens
atctccaagaatgc

SEQ ID NO: 6664116 - DNA, 15 bp, Homo sapiens
atctccaagaatgct

SEQ ID NO: 6664117 - DNA, 20 bp, Homo sapiens
atctccaagaatgctgaaac

SEQ ID NO: 6664118 - DNA, 18 bp, Homo sapiens
atctccaagaccagagat

SEQ ID NO: 6664119 - DNA, 23 bp, Homo sapiens
atctccaagatagcatcccatct

SEQ ID NO: 6664120 - DNA, 15 bp, Homo sapiens
atctccaagcagctt

SEQ ID NO: 6664121 - DNA, 18 bp, Homo sapiens
atctccaaggcagggacc

SEQ ID NO: 6664122 - DNA, 12 bp, Homo sapiens
atctccaagtgg

SEQ ID NO: 6664123 - DNA, 19 bp, Homo sapiens
atctccacagtcaaagaag

SEQ ID NO: 6664124 - DNA, 19 bp, Homo sapiens
atctccacccccagctgct

SEQ ID NO: 6664125 - DNA, 15 bp, Homo sapiens
atctccagcatcctg

SEQ ID NO: 6664126 - DNA, 18 bp, Homo sapiens
atctccagccaatttcaa

SEQ ID NO: 6664127 - DNA, 16 bp, Homo sapiens
atctccagcggccctg

SEQ ID NO: 6664128 - DNA, 19 bp, Homo sapiens
atctccagcttactataaa

SEQ ID NO: 6664129 - DNA, 12 bp, Homo sapiens
atctccaggatt

SEQ ID NO: 6664130 - DNA, 20 bp, Homo sapiens
atctccaggcaaaaggagtg

SEQ ID NO: 6664131 - DNA, 16 bp, Homo sapiens
atctccaggcccagcc

SEQ ID NO: 6664132 - DNA, 22 bp, Homo sapiens
atctccaggcccagcctggccc

SEQ ID NO: 6664133 - DNA, 11 bp, Homo sapiens
atctccaggga

SEQ ID NO: 6664134 - DNA, 12 bp, Homo sapiens
atctccagggaa

SEQ ID NO: 6664135 - DNA, 22 bp, Homo sapiens
atctccagggagcaagacagag

SEQ ID NO: 6664136 - DNA, 23 bp, Homo sapiens
atctccagggagcaagacagaga

SEQ ID NO: 6664137 - DNA, 16 bp, Homo sapiens
atctccagggctccaa

SEQ ID NO: 6664138 - DNA, 13 bp, Homo sapiens
atctccagtgtgc

SEQ ID NO: 6664139 - DNA, 19 bp, Homo sapiens
atctccagtgtgccagaca

SEQ ID NO: 6664140 - DNA, 16 bp, Homo sapiens
atctccataaacatga

SEQ ID NO: 6664141 - DNA, 14 bp, Homo sapiens
atctccatactttg

SEQ ID NO: 6664142 - DNA, 19 bp, Homo sapiens
atctccatcatatgcctga

SEQ ID NO: 6664143 - DNA, 14 bp, Homo sapiens
atctccatggccct

SEQ ID NO: 6664144 - DNA, 22 bp, Homo sapiens
atctccatggccctgtcccagg

SEQ ID NO: 6664145 - DNA, 18 bp, Homo sapiens
atctccatggcttcctcc

SEQ ID NO: 6664146 - DNA, 19 bp, Homo sapiens
atctccatggcttcctcct

SEQ ID NO: 6664147 - DNA, 12 bp, Homo sapiens
atctccatgtgt

SEQ ID NO: 6664148 - DNA, 15 bp, Homo sapiens
atctcccaaggctgc

SEQ ID NO: 6664149 - DNA, 13 bp, Homo sapiens
atctcccacatgc

SEQ ID NO: 6664150 - DNA, 21 bp, Homo sapiens
atctcccacatgccaggggcc

SEQ ID NO: 6664151 - DNA, 18 bp, Homo sapiens
atctcccacctagcagca

SEQ ID NO: 6664152 - DNA, 13 bp, Homo sapiens
atctcccagactt

SEQ ID NO: 6664153 - DNA, 15 bp, Homo sapiens
atctcccagacttgt

SEQ ID NO: 6664154 - DNA, 20 bp, Homo sapiens
atctcccagacttgtttcct

SEQ ID NO: 6664155 - DNA, 12 bp, Homo sapiens
atctcccaggcc

SEQ ID NO: 6664156 - DNA, 16 bp, Homo sapiens
atctcccagggctctc

SEQ ID NO: 6664157 - DNA, 17 bp, Homo sapiens
atctcccagggctctct

SEQ ID NO: 6664158 - DNA, 21 bp, Homo sapiens
atctccccaggcctccagcct

SEQ ID NO: 6664159 - DNA, 22 bp, Homo sapiens
atctccccaggcctccagcctc

SEQ ID NO: 6664160 - DNA, 16 bp, Homo sapiens
atctccccatcattgg

SEQ ID NO: 6664161 - DNA, 19 bp, Homo sapiens
atctcccccaacccacctc

SEQ ID NO: 6664162 - DNA, 15 bp, Homo sapiens
atctcccccaccctg

SEQ ID NO: 6664163 - DNA, 14 bp, Homo sapiens
atctcccccagccc

SEQ ID NO: 6664164 - DNA, 16 bp, Homo sapiens
atctcccccagcccca

SEQ ID NO: 6664165 - DNA, 18 bp, Homo sapiens
atctcccctagctcacca

SEQ ID NO: 6664166 - DNA, 16 bp, Homo sapiens
atctcccctcagctcg

SEQ ID NO: 6664167 - DNA, 13 bp, Homo sapiens
atctcccctcctc

SEQ ID NO: 6664168 - DNA, 23 bp, Homo sapiens
atctcccctcctcacagttgcca

SEQ ID NO: 6664169 - DNA, 19 bp, Homo sapiens
atctcccgaagtcctctgt

SEQ ID NO: 6664170 - DNA, 17 bp, Homo sapiens
atctccctagcccaccc

SEQ ID NO: 6664171 - DNA, 20 bp, Homo sapiens
atctccctccccagaaacag

SEQ ID NO: 6664172 - DNA, 17 bp, Homo sapiens
atctccctcctccaggt

SEQ ID NO: 6664173 - DNA, 19 bp, Homo sapiens
atctccctcctccaggtcg

SEQ ID NO: 6664174 - DNA, 13 bp, Homo sapiens
atctccctgccat

SEQ ID NO: 6664175 - DNA, 16 bp, Homo sapiens
atctccctgccatccc

SEQ ID NO: 6664176 - DNA, 23 bp, Homo sapiens
atctccctgccatccccctctca

SEQ ID NO: 6664177 - DNA, 13 bp, Homo sapiens
atctccctgcctc

SEQ ID NO: 6664178 - DNA, 13 bp, Homo sapiens
atctccctgcctg

SEQ ID NO: 6664179 - DNA, 14 bp, Homo sapiens
atctccctgcctgg

SEQ ID NO: 6664180 - DNA, 18 bp, Homo sapiens
atctccctgcctggcccc

SEQ ID NO: 6664181 - DNA, 20 bp, Homo sapiens
atctccctgcctggccccca

SEQ ID NO: 6664182 - DNA, 14 bp, Homo sapiens
atctccctgcttca

SEQ ID NO: 6664183 - DNA, 10 bp, Homo sapiens
atctccctgg

SEQ ID NO: 6664184 - DNA, 11 bp, Homo sapiens
atctccctggc

SEQ ID NO: 6664185 - DNA, 15 bp, Homo sapiens
atctccctggtgctt

SEQ ID NO: 6664186 - DNA, 12 bp, Homo sapiens
atctcccttcct

SEQ ID NO: 6664187 - DNA, 20 bp, Homo sapiens
atctcccttctcatctcccc

SEQ ID NO: 6664188 - DNA, 19 bp, Homo sapiens
atctccgcctccacactga

SEQ ID NO: 6664189 - DNA, 19 bp, Homo sapiens
atctccggctcccagcctc

SEQ ID NO: 6664190 - DNA, 22 bp, Homo sapiens
atctccggctcccagcctcagc

SEQ ID NO: 6664191 - DNA, 13 bp, Homo sapiens
atctcctaacaaa

SEQ ID NO: 6664192 - DNA, 14 bp, Homo sapiens
atctcctaactttg

SEQ ID NO: 6664193 - DNA, 19 bp, Homo sapiens
atctcctataatctgtcaa

SEQ ID NO: 6664194 - DNA, 20 bp, Homo sapiens
atctcctatttttcagaatg

SEQ ID NO: 6664195 - DNA, 19 bp, Homo sapiens
atctcctcaagtccccaag

SEQ ID NO: 6664196 - DNA, 18 bp, Homo sapiens
atctcctcaccccagtgc

SEQ ID NO: 6664197 - DNA, 20 bp, Homo sapiens
atctcctcccatggccttcc

SEQ ID NO: 6664198 - DNA, 22 bp, Homo sapiens
atctcctcccatggccttccct

SEQ ID NO: 6664199 - DNA, 22 bp, Homo sapiens
atctcctcctatttatgaaaac

SEQ ID NO: 6664200 - DNA, 20 bp, Homo sapiens
atctcctcgcaagctgggta

SEQ ID NO: 6664201 - DNA, 12 bp, Homo sapiens
atctcctgaaaa

SEQ ID NO: 6664202 - DNA, 17 bp, Homo sapiens
atctcctgaatctaaca

SEQ ID NO: 6664203 - DNA, 15 bp, Homo sapiens
atctcctgacagaag

SEQ ID NO: 6664204 - DNA, 22 bp, Homo sapiens
atctcctgaccctcccactccc

SEQ ID NO: 6664205 - DNA, 20 bp, Homo sapiens
atctcctgaggatcagaaag

SEQ ID NO: 6664206 - DNA, 22 bp, Homo sapiens
atctcctgaggatcagaaagta

SEQ ID NO: 6664207 - DNA, 18 bp, Homo sapiens
atctcctgagttgtataa

SEQ ID NO: 6664208 - DNA, 14 bp, Homo sapiens
atctcctgatttct

SEQ ID NO: 6664209 - DNA, 17 bp, Homo sapiens
atctcctgccagcccag

SEQ ID NO: 6664210 - DNA, 16 bp, Homo sapiens
atctcctgccttcctc

SEQ ID NO: 6664211 - DNA, 14 bp, Homo sapiens
atctcctgctcacc

SEQ ID NO: 6664212 - DNA, 16 bp, Homo sapiens
atctcctgctcaccac

SEQ ID NO: 6664213 - DNA, 19 bp, Homo sapiens
atctcctgctcaccacctg

SEQ ID NO: 6664214 - DNA, 21 bp, Homo sapiens
atctcctggctaagcctctgc

SEQ ID NO: 6664215 - DNA, 17 bp, Homo sapiens
atctcctggtgttctgc

SEQ ID NO: 6664216 - DNA, 19 bp, Homo sapiens
atctcctgtaattttgtag

SEQ ID NO: 6664217 - DNA, 20 bp, Homo sapiens
atctcctgtaattttgtagt

SEQ ID NO: 6664218 - DNA, 18 bp, Homo sapiens
atctcctgtgatcctttg

SEQ ID NO: 6664219 - DNA, 17 bp, Homo sapiens
atctccttacctctgga

SEQ ID NO: 6664220 - DNA, 21 bp, Homo sapiens
atctccttcaccgtggctacc

SEQ ID NO: 6664221 - DNA, 22 bp, Homo sapiens
atctccttcccacccctacaca

SEQ ID NO: 6664222 - DNA, 16 bp, Homo sapiens
atctccttcccccagc

SEQ ID NO: 6664223 - DNA, 22 bp, Homo sapiens
atctccttcccccagcccaata

SEQ ID NO: 6664224 - DNA, 19 bp, Homo sapiens
atctccttcccttctcttg

SEQ ID NO: 6664225 - DNA, 20 bp, Homo sapiens
atctccttcccttctcttgg

SEQ ID NO: 6664226 - DNA, 21 bp, Homo sapiens
atctccttcccttctcttggg

SEQ ID NO: 6664227 - DNA, 15 bp, Homo sapiens
atctccttgactgcc

SEQ ID NO: 6664228 - DNA, 19 bp, Homo sapiens
atctccttgatcatgtctt

SEQ ID NO: 6664229 - DNA, 20 bp, Homo sapiens
atctccttgtggcctatgaa

SEQ ID NO: 6664230 - DNA, 16 bp, Homo sapiens
atctcctttgaagaag

SEQ ID NO: 6664231 - DNA, 14 bp, Homo sapiens
atctcctttgcaga

SEQ ID NO: 6664232 - DNA, 14 bp, Homo sapiens
atctcctttgtcca

SEQ ID NO: 6664233 - DNA, 19 bp, Homo sapiens
atctccttttatgctcacc

SEQ ID NO: 6664234 - DNA, 22 bp, Homo sapiens
atctccttttatgctcacctga

SEQ ID NO: 6664235 - DNA, 23 bp, Homo sapiens
atctcgaatttgaagagattgct

SEQ ID NO: 6664236 - DNA, 21 bp, Homo sapiens
atctcgactcccccctggcca

SEQ ID NO: 6664237 - DNA, 17 bp, Homo sapiens
atctcgagccccctgga

SEQ ID NO: 6664238 - DNA, 18 bp, Homo sapiens
atctcgcctggaaacaga

SEQ ID NO: 6664239 - DNA, 15 bp, Homo sapiens
atctcgccttcctgc

SEQ ID NO: 6664240 - DNA, 13 bp, Homo sapiens
atctcgctagcca

SEQ ID NO: 6664241 - DNA, 18 bp, Homo sapiens
atctcggatgaccaaacc

SEQ ID NO: 6664242 - DNA, 15 bp, Homo sapiens
atctcggctcactgc

SEQ ID NO: 6664243 - DNA, 16 bp, Homo sapiens
atctcggctcagcctc

SEQ ID NO: 6664244 - DNA, 18 bp, Homo sapiens
atctcggctcagcctccc

SEQ ID NO: 6664245 - DNA, 14 bp, Homo sapiens
atctcggggctgct

SEQ ID NO: 6664246 - DNA, 24 bp, Homo sapiens
atctcggttctgcgccacttcctt

SEQ ID NO: 6664247 - DNA, 21 bp, Homo sapiens
atctcgtaatagcttctgtgt

SEQ ID NO: 6664248 - DNA, 21 bp, Homo sapiens
atctcgtgatccgcctgcctc

SEQ ID NO: 6664249 - DNA, 18 bp, Homo sapiens
atctcgtgccagggcagg

SEQ ID NO: 6664250 - DNA, 15 bp, Homo sapiens
atctcgtgggagagc

SEQ ID NO: 6664251 - DNA, 15 bp, Homo sapiens
atctcgttcccaaag

SEQ ID NO: 6664252 - DNA, 20 bp, Homo sapiens
atctcgttgaggccaaggaa

SEQ ID NO: 6664253 - DNA, 14 bp, Homo sapiens
atctcgtttagtgc

SEQ ID NO: 6664254 - DNA, 18 bp, Homo sapiens
atctctaaaataggtaaa

SEQ ID NO: 6664255 - DNA, 17 bp, Homo sapiens
atctctaaaatgctgtt

SEQ ID NO: 6664256 - DNA, 22 bp, Homo sapiens
atctctaaaatgctgttctcaa

SEQ ID NO: 6664257 - DNA, 15 bp, Homo sapiens
atctctaaaattcta

SEQ ID NO: 6664258 - DNA, 17 bp, Homo sapiens
atctctaaaattctagt

SEQ ID NO: 6664259 - DNA, 19 bp, Homo sapiens
atctctaaaattctagtct

SEQ ID NO: 6664260 - DNA, 20 bp, Homo sapiens
atctctaacagctccatact

SEQ ID NO: 6664261 - DNA, 23 bp, Homo sapiens
atctctaatgagctagtgtctta

SEQ ID NO: 6664262 - DNA, 15 bp, Homo sapiens
atctctaattggaag

SEQ ID NO: 6664263 - DNA, 15 bp, Homo sapiens
atctctaattttgga

SEQ ID NO: 6664264 - DNA, 15 bp, Homo sapiens
atctctaccccctca

SEQ ID NO: 6664265 - DNA, 19 bp, Homo sapiens
atctctaccttctccccag

SEQ ID NO: 6664266 - DNA, 22 bp, Homo sapiens
atctctaccttctccccagctc

SEQ ID NO: 6664267 - DNA, 20 bp, Homo sapiens
atctctactaccacaaggaa

SEQ ID NO: 6664268 - DNA, 14 bp, Homo sapiens
atctctactttcct

SEQ ID NO: 6664269 - DNA, 19 bp, Homo sapiens
atctctagctcagacatct

SEQ ID NO: 6664270 - DNA, 20 bp, Homo sapiens
atctctagtgtagctgccac

SEQ ID NO: 6664271 - DNA, 15 bp, Homo sapiens
atctctatttaatat

SEQ ID NO: 6664272 - DNA, 16 bp, Homo sapiens
atctctatttaatatt

SEQ ID NO: 6664273 - DNA, 19 bp, Homo sapiens
atctctatttaatatttat

SEQ ID NO: 6664274 - DNA, 19 bp, Homo sapiens
atctctcaaaacaatatta

SEQ ID NO: 6664275 - DNA, 14 bp, Homo sapiens
atctctcaaaactt

SEQ ID NO: 6664276 - DNA, 17 bp, Homo sapiens
atctctcaaaatgtgcc

SEQ ID NO: 6664277 - DNA, 12 bp, Homo sapiens
atctctcaaact

SEQ ID NO: 6664278 - DNA, 13 bp, Homo sapiens
atctctcaaactt

SEQ ID NO: 6664279 - DNA, 15 bp, Homo sapiens
atctctcaaatctgt

SEQ ID NO: 6664280 - DNA, 18 bp, Homo sapiens
atctctcaagagtgctga

SEQ ID NO: 6664281 - DNA, 20 bp, Homo sapiens
atctctcaagagtgctgaga

SEQ ID NO: 6664282 - DNA, 24 bp, Homo sapiens
atctctcaagagtgctgagaacca

SEQ ID NO: 6664283 - DNA, 17 bp, Homo sapiens
atctctcaggagcacag

SEQ ID NO: 6664284 - DNA, 18 bp, Homo sapiens
atctctcaggagcacagg

SEQ ID NO: 6664285 - DNA, 21 bp, Homo sapiens
atctctcaggagcacaggcag

SEQ ID NO: 6664286 - DNA, 17 bp, Homo sapiens
atctctcatcctccagt

SEQ ID NO: 6664287 - DNA, 20 bp, Homo sapiens
atctctccacggtagcactt

SEQ ID NO: 6664288 - DNA, 15 bp, Homo sapiens
atctctccagagagc

SEQ ID NO: 6664289 - DNA, 18 bp, Homo sapiens
atctctcccacttcctcc

SEQ ID NO: 6664290 - DNA, 22 bp, Homo sapiens
atctctcccacttcctcctacc

SEQ ID NO: 6664291 - DNA, 23 bp, Homo sapiens
atctctcccacttcctcctacct

SEQ ID NO: 6664292 - DNA, 14 bp, Homo sapiens
atctctccctcccc

SEQ ID NO: 6664293 - DNA, 15 bp, Homo sapiens
atctctcccttaccc

SEQ ID NO: 6664294 - DNA, 15 bp, Homo sapiens
atctctcctgtgtct

SEQ ID NO: 6664295 - DNA, 20 bp, Homo sapiens
atctctcggttccacgtccc

SEQ ID NO: 6664296 - DNA, 16 bp, Homo sapiens
atctctctacctccac

SEQ ID NO: 6664297 - DNA, 21 bp, Homo sapiens
atctctctactcctacctcag

SEQ ID NO: 6664298 - DNA, 23 bp, Homo sapiens
atctctctactcctacctcagcc

SEQ ID NO: 6664299 - DNA, 17 bp, Homo sapiens
atctctctactgctgga

SEQ ID NO: 6664300 - DNA, 22 bp, Homo sapiens
atctctctctgtgtctttctct

SEQ ID NO: 6664301 - DNA, 15 bp, Homo sapiens
atctctctcttgcct

SEQ ID NO: 6664302 - DNA, 19 bp, Homo sapiens
atctctctgcagctgccgg

SEQ ID NO: 6664303 - DNA, 16 bp, Homo sapiens
atctctctgccctctc

SEQ ID NO: 6664304 - DNA, 19 bp, Homo sapiens
atctctctgcctatttatt

SEQ ID NO: 6664305 - DNA, 23 bp, Homo sapiens
atctctctgcctatttattgggg

SEQ ID NO: 6664306 - DNA, 14 bp, Homo sapiens
atctctctggccct

SEQ ID NO: 6664307 - DNA, 20 bp, Homo sapiens
atctctctggcttctgaaga

SEQ ID NO: 6664308 - DNA, 13 bp, Homo sapiens
atctctctgggat

SEQ ID NO: 6664309 - DNA, 22 bp, Homo sapiens
atctctctggggccctgggcct

SEQ ID NO: 6664310 - DNA, 20 bp, Homo sapiens
atctctctgtcttttttctc

SEQ ID NO: 6664311 - DNA, 15 bp, Homo sapiens
atctctcttgtcctc

SEQ ID NO: 6664312 - DNA, 19 bp, Homo sapiens
atctctcttgtcctcttct

SEQ ID NO: 6664313 - DNA, 21 bp, Homo sapiens
atctctcttgtcctcttctgc

SEQ ID NO: 6664314 - DNA, 13 bp, Homo sapiens
atctctgaaaaca

SEQ ID NO: 6664315 - DNA, 16 bp, Homo sapiens
atctctgaagaaacaa

SEQ ID NO: 6664316 - DNA, 13 bp, Homo sapiens
atctctgaagcat

SEQ ID NO: 6664317 - DNA, 16 bp, Homo sapiens
atctctgaagcatgtt

SEQ ID NO: 6664318 - DNA, 16 bp, Homo sapiens
atctctgacctctgct

SEQ ID NO: 6664319 - DNA, 13 bp, Homo sapiens
atctctgagtgga

SEQ ID NO: 6664320 - DNA, 16 bp, Homo sapiens
atctctgagtggagga

SEQ ID NO: 6664321 - DNA, 20 bp, Homo sapiens
atctctgagtgtctctgcct

SEQ ID NO: 6664322 - DNA, 19 bp, Homo sapiens
atctctgattaaatttaat

SEQ ID NO: 6664323 - DNA, 23 bp, Homo sapiens
atctctgattccctgatttaata

SEQ ID NO: 6664324 - DNA, 10 bp, Homo sapiens
atctctgccg

SEQ ID NO: 6664325 - DNA, 18 bp, Homo sapiens
atctctgccgtctctcct

SEQ ID NO: 6664326 - DNA, 19 bp, Homo sapiens
atctctgcctagaatcttt

SEQ ID NO: 6664327 - DNA, 21 bp, Homo sapiens
atctctgcctagaatctttat

SEQ ID NO: 6664328 - DNA, 12 bp, Homo sapiens
atctctgcctct

SEQ ID NO: 6664329 - DNA, 19 bp, Homo sapiens
atctctgcctgacaaggcc

SEQ ID NO: 6664330 - DNA, 20 bp, Homo sapiens
atctctgcctgacaaggcca

SEQ ID NO: 6664331 - DNA, 21 bp, Homo sapiens
atctctgcctgacaaggccag

SEQ ID NO: 6664332 - DNA, 22 bp, Homo sapiens
atctctgcctgacaaggccagc

SEQ ID NO: 6664333 - DNA, 14 bp, Homo sapiens
atctctgcctgtca

SEQ ID NO: 6664334 - DNA, 12 bp, Homo sapiens
atctctgccttt

SEQ ID NO: 6664335 - DNA, 19 bp, Homo sapiens
atctctgctgcttctgggc

SEQ ID NO: 6664336 - DNA, 22 bp, Homo sapiens
atctctgctgcttctgggcctg

SEQ ID NO: 6664337 - DNA, 16 bp, Homo sapiens
atctctgctttggaaa

SEQ ID NO: 6664338 - DNA, 17 bp, Homo sapiens
atctctgctttggaaat

SEQ ID NO: 6664339 - DNA, 21 bp, Homo sapiens
atctctggaaggggcagccct

SEQ ID NO: 6664340 - DNA, 23 bp, Homo sapiens
atctctggaaggggcagccctga

SEQ ID NO: 6664341 - DNA, 16 bp, Homo sapiens
atctctggagccagag

SEQ ID NO: 6664342 - DNA, 15 bp, Homo sapiens
atctctggagtgtgt

SEQ ID NO: 6664343 - DNA, 20 bp, Homo sapiens
atctctggcccagaaagcct

SEQ ID NO: 6664344 - DNA, 17 bp, Homo sapiens
atctctgggctgagcct

SEQ ID NO: 6664345 - DNA, 22 bp, Homo sapiens
atctctgggctggatgagctcc

SEQ ID NO: 6664346 - DNA, 21 bp, Homo sapiens
atctctgtaattgtgtcccct

SEQ ID NO: 6664347 - DNA, 18 bp, Homo sapiens
atctctgtactttgcttg

SEQ ID NO: 6664348 - DNA, 20 bp, Homo sapiens
atctctgtagatacaggggc

SEQ ID NO: 6664349 - DNA, 14 bp, Homo sapiens
atctctgtgagaga

SEQ ID NO: 6664350 - DNA, 15 bp, Homo sapiens
atctctgtgccttcg

SEQ ID NO: 6664351 - DNA, 22 bp, Homo sapiens
atctctgtgtacccactcctca

SEQ ID NO: 6664352 - DNA, 18 bp, Homo sapiens
atctctgttctgctccca

SEQ ID NO: 6664353 - DNA, 17 bp, Homo sapiens
atctctgttgcacctga

SEQ ID NO: 6664354 - DNA, 12 bp, Homo sapiens
atctcttaaact

SEQ ID NO: 6664355 - DNA, 15 bp, Homo sapiens
atctcttaaactctc

SEQ ID NO: 6664356 - DNA, 20 bp, Homo sapiens
atctcttaagacagcatgtg

SEQ ID NO: 6664357 - DNA, 21 bp, Homo sapiens
atctcttaagacagcatgtgt

SEQ ID NO: 6664358 - DNA, 22 bp, Homo sapiens
atctcttaagacagcatgtgtt

SEQ ID NO: 6664359 - DNA, 13 bp, Homo sapiens
atctcttagctcc

SEQ ID NO: 6664360 - DNA, 22 bp, Homo sapiens
atctcttagctcccctccaacc

SEQ ID NO: 6664361 - DNA, 20 bp, Homo sapiens
atctcttatcttacgaaaaa

SEQ ID NO: 6664362 - DNA, 18 bp, Homo sapiens
atctcttattctaataaa

SEQ ID NO: 6664363 - DNA, 21 bp, Homo sapiens
atctcttcagtctctatacca

SEQ ID NO: 6664364 - DNA, 17 bp, Homo sapiens
atctcttccccagagag

SEQ ID NO: 6664365 - DNA, 22 bp, Homo sapiens
atctcttcctacccaaccactc

SEQ ID NO: 6664366 - DNA, 11 bp, Homo sapiens
atctcttcctg

SEQ ID NO: 6664367 - DNA, 12 bp, Homo sapiens
atctcttcctgt

SEQ ID NO: 6664368 - DNA, 12 bp, Homo sapiens
atctcttccttt

SEQ ID NO: 6664369 - DNA, 14 bp, Homo sapiens
atctcttcctttcc

SEQ ID NO: 6664370 - DNA, 15 bp, Homo sapiens
atctcttcctttcct

SEQ ID NO: 6664371 - DNA, 14 bp, Homo sapiens
atctcttctggtgt

SEQ ID NO: 6664372 - DNA, 16 bp, Homo sapiens
atctcttctggtgttg

SEQ ID NO: 6664373 - DNA, 13 bp, Homo sapiens
atctcttcttaat

SEQ ID NO: 6664374 - DNA, 17 bp, Homo sapiens
atctcttcttaatgtac

SEQ ID NO: 6664375 - DNA, 19 bp, Homo sapiens
atctcttcttaatgtacat

SEQ ID NO: 6664376 - DNA, 20 bp, Homo sapiens
atctcttcttaatgtacata

SEQ ID NO: 6664377 - DNA, 14 bp, Homo sapiens
atctcttcttccct

SEQ ID NO: 6664378 - DNA, 14 bp, Homo sapiens
atctcttcttttaa

SEQ ID NO: 6664379 - DNA, 20 bp, Homo sapiens
atctcttcttttggcttcca

SEQ ID NO: 6664380 - DNA, 13 bp, Homo sapiens
atctcttgaaacc

SEQ ID NO: 6664381 - DNA, 14 bp, Homo sapiens
atctcttgaaacct

SEQ ID NO: 6664382 - DNA, 18 bp, Homo sapiens
atctcttgagcctgggag

SEQ ID NO: 6664383 - DNA, 15 bp, Homo sapiens
atctcttgaggccag

SEQ ID NO: 6664384 - DNA, 17 bp, Homo sapiens
atctcttgataaaggag

SEQ ID NO: 6664385 - DNA, 15 bp, Homo sapiens
atctcttgcccttcc

SEQ ID NO: 6664386 - DNA, 18 bp, Homo sapiens
atctcttgcttgtcattg

SEQ ID NO: 6664387 - DNA, 22 bp, Homo sapiens
atctcttggaaaataagacaat

SEQ ID NO: 6664388 - DNA, 13 bp, Homo sapiens
atctcttgggtta

SEQ ID NO: 6664389 - DNA, 18 bp, Homo sapiens
atctcttgtaccagccca

SEQ ID NO: 6664390 - DNA, 17 bp, Homo sapiens
atctcttgtcatataaa

SEQ ID NO: 6664391 - DNA, 21 bp, Homo sapiens
atctcttgtcatataaacctg

SEQ ID NO: 6664392 - DNA, 17 bp, Homo sapiens
atctcttgttcgcacaa

SEQ ID NO: 6664393 - DNA, 17 bp, Homo sapiens
atctctttaaaggcaaa

SEQ ID NO: 6664394 - DNA, 11 bp, Homo sapiens
atctctttaga

SEQ ID NO: 6664395 - DNA, 19 bp, Homo sapiens
atctctttcacattgtttg

SEQ ID NO: 6664396 - DNA, 19 bp, Homo sapiens
atctctttccaccatacct

SEQ ID NO: 6664397 - DNA, 18 bp, Homo sapiens
atctctttccatcttact

SEQ ID NO: 6664398 - DNA, 15 bp, Homo sapiens
atctctttctaaaga

SEQ ID NO: 6664399 - DNA, 14 bp, Homo sapiens
atctctttctctct

SEQ ID NO: 6664400 - DNA, 18 bp, Homo sapiens
atctctttctttctcttt

SEQ ID NO: 6664401 - DNA, 19 bp, Homo sapiens
atctcttttatatttgtag

SEQ ID NO: 6664402 - DNA, 22 bp, Homo sapiens
atctctttttaaaaaactcttt

SEQ ID NO: 6664403 - DNA, 19 bp, Homo sapiens
atctctttttaagatagac

SEQ ID NO: 6664404 - DNA, 18 bp, Homo sapiens
atctgaaaaatggccatg

SEQ ID NO: 6664405 - DNA, 14 bp, Homo sapiens
atctgaaaacaatt

SEQ ID NO: 6664406 - DNA, 21 bp, Homo sapiens
atctgaaaacatctagcccaa

SEQ ID NO: 6664407 - DNA, 14 bp, Homo sapiens
atctgaaaactgga

SEQ ID NO: 6664408 - DNA, 19 bp, Homo sapiens
atctgaaaagaaatgctaa

SEQ ID NO: 6664409 - DNA, 19 bp, Homo sapiens
atctgaaaatgtatgtgta

SEQ ID NO: 6664410 - DNA, 22 bp, Homo sapiens
atctgaaaatgtatgtgtaagt

SEQ ID NO: 6664411 - DNA, 17 bp, Homo sapiens
atctgaaacacagtcat

SEQ ID NO: 6664412 - DNA, 17 bp, Homo sapiens
atctgaaaccctccttc

SEQ ID NO: 6664413 - DNA, 13 bp, Homo sapiens
atctgaaaggcac

SEQ ID NO: 6664414 - DNA, 14 bp, Homo sapiens
atctgaaaggccag

SEQ ID NO: 6664415 - DNA, 22 bp, Homo sapiens
atctgaaagttttgatacttgt

SEQ ID NO: 6664416 - DNA, 16 bp, Homo sapiens
atctgaaatgttacaa

SEQ ID NO: 6664417 - DNA, 22 bp, Homo sapiens
atctgaaattggtgggaagcaa

SEQ ID NO: 6664418 - DNA, 19 bp, Homo sapiens
atctgaacacatactagaa

SEQ ID NO: 6664419 - DNA, 13 bp, Homo sapiens
atctgaacatctg

SEQ ID NO: 6664420 - DNA, 13 bp, Homo sapiens
atctgaacattct

SEQ ID NO: 6664421 - DNA, 18 bp, Homo sapiens
atctgaaccactttgcct

SEQ ID NO: 6664422 - DNA, 21 bp, Homo sapiens
atctgaactaattcatttatt

SEQ ID NO: 6664423 - DNA, 18 bp, Homo sapiens
atctgaactcacagactg

SEQ ID NO: 6664424 - DNA, 19 bp, Homo sapiens
atctgaactgctctacttt

SEQ ID NO: 6664425 - DNA, 13 bp, Homo sapiens
atctgaactttgt

SEQ ID NO: 6664426 - DNA, 21 bp, Homo sapiens
atctgaactttgtttccagaa

SEQ ID NO: 6664427 - DNA, 21 bp, Homo sapiens
atctgaagagctattatataa

SEQ ID NO: 6664428 - DNA, 22 bp, Homo sapiens
atctgaagccacctctctgcct

SEQ ID NO: 6664429 - DNA, 23 bp, Homo sapiens
atctgaagccacctctctgcctg

SEQ ID NO: 6664430 - DNA, 15 bp, Homo sapiens
atctgaagccctccc

SEQ ID NO: 6664431 - DNA, 23 bp, Homo sapiens
atctgaagccttttcctgaggtc

SEQ ID NO: 6664432 - DNA, 15 bp, Homo sapiens
atctgaagctattga

SEQ ID NO: 6664433 - DNA, 15 bp, Homo sapiens
atctgaaggttctgg

SEQ ID NO: 6664434 - DNA, 15 bp, Homo sapiens
atctgaagtgtctaa

SEQ ID NO: 6664435 - DNA, 21 bp, Homo sapiens
atctgaagtgtctaatgcatt

SEQ ID NO: 6664436 - DNA, 21 bp, Homo sapiens
atctgaataaagtgtaacaat

SEQ ID NO: 6664437 - DNA, 14 bp, Homo sapiens
atctgaatcccggg

SEQ ID NO: 6664438 - DNA, 17 bp, Homo sapiens
atctgaattaaataaat

SEQ ID NO: 6664439 - DNA, 18 bp, Homo sapiens
atctgaattttaaaacat

SEQ ID NO: 6664440 - DNA, 15 bp, Homo sapiens
atctgaattttgcaa

SEQ ID NO: 6664441 - DNA, 21 bp, Homo sapiens
atctgaattttgcaatgtatt

SEQ ID NO: 6664442 - DNA, 14 bp, Homo sapiens
atctgacaaagtca

SEQ ID NO: 6664443 - DNA, 13 bp, Homo sapiens
atctgacacaaaa

SEQ ID NO: 6664444 - DNA, 21 bp, Homo sapiens
atctgacactaccttatcagg

SEQ ID NO: 6664445 - DNA, 22 bp, Homo sapiens
atctgacactaccttatcaggc

SEQ ID NO: 6664446 - DNA, 23 bp, Homo sapiens
atctgacagtctcaaatttttca

SEQ ID NO: 6664447 - DNA, 22 bp, Homo sapiens
atctgacagttactcttcagtt

SEQ ID NO: 6664448 - DNA, 18 bp, Homo sapiens
atctgacatgattccttc

SEQ ID NO: 6664449 - DNA, 23 bp, Homo sapiens
atctgacatgattccttcctgtt

SEQ ID NO: 6664450 - DNA, 12 bp, Homo sapiens
atctgaccacag

SEQ ID NO: 6664451 - DNA, 16 bp, Homo sapiens
atctgaccagcagcgc

SEQ ID NO: 6664452 - DNA, 12 bp, Homo sapiens
atctgaccatct

SEQ ID NO: 6664453 - DNA, 14 bp, Homo sapiens
atctgaccatctgt

SEQ ID NO: 6664454 - DNA, 17 bp, Homo sapiens
atctgaccatctgtgac

SEQ ID NO: 6664455 - DNA, 18 bp, Homo sapiens
atctgaccatctgtgact

SEQ ID NO: 6664456 - DNA, 17 bp, Homo sapiens
atctgacccactttgta

SEQ ID NO: 6664457 - DNA, 18 bp, Homo sapiens
atctgacccactttgtaa

SEQ ID NO: 6664458 - DNA, 21 bp, Homo sapiens
atctgacccagtgcccccact

SEQ ID NO: 6664459 - DNA, 21 bp, Homo sapiens
atctgaccccggggggctggg

SEQ ID NO: 6664460 - DNA, 13 bp, Homo sapiens
atctgaccctccc

SEQ ID NO: 6664461 - DNA, 15 bp, Homo sapiens
atctgaccctcccag

SEQ ID NO: 6664462 - DNA, 17 bp, Homo sapiens
atctgactgaaattaaa

SEQ ID NO: 6664463 - DNA, 12 bp, Homo sapiens
atctgactgcca

SEQ ID NO: 6664464 - DNA, 13 bp, Homo sapiens
atctgactgccaa

SEQ ID NO: 6664465 - DNA, 14 bp, Homo sapiens
atctgactgccaaa

SEQ ID NO: 6664466 - DNA, 15 bp, Homo sapiens
atctgactgccaagc

SEQ ID NO: 6664467 - DNA, 19 bp, Homo sapiens
atctgactgccaagccaga

SEQ ID NO: 6664468 - DNA, 14 bp, Homo sapiens
atctgacttctcac

SEQ ID NO: 6664469 - DNA, 11 bp, Homo sapiens
atctgactttt

SEQ ID NO: 6664470 - DNA, 18 bp, Homo sapiens
atctgactttttctgtgc

SEQ ID NO: 6664471 - DNA, 23 bp, Homo sapiens
atctgagaaacctgttgaagatt

SEQ ID NO: 6664472 - DNA, 21 bp, Homo sapiens
atctgagaccccaaactctcc

SEQ ID NO: 6664473 - DNA, 19 bp, Homo sapiens
atctgagagacctgtgtga

SEQ ID NO: 6664474 - DNA, 20 bp, Homo sapiens
atctgagagacctgtgtgaa

SEQ ID NO: 6664475 - DNA, 21 bp, Homo sapiens
atctgagagaggctaaaatgt

SEQ ID NO: 6664476 - DNA, 21 bp, Homo sapiens
atctgagatttttttgtgtat

SEQ ID NO: 6664477 - DNA, 18 bp, Homo sapiens
atctgagcaaggagttta

SEQ ID NO: 6664478 - DNA, 15 bp, Homo sapiens
atctgagcaataact

SEQ ID NO: 6664479 - DNA, 22 bp, Homo sapiens
atctgagcaggtacatttctga

SEQ ID NO: 6664480 - DNA, 18 bp, Homo sapiens
atctgagcctaaatctaa

SEQ ID NO: 6664481 - DNA, 22 bp, Homo sapiens
atctgagcctaaatctaatcag

SEQ ID NO: 6664482 - DNA, 19 bp, Homo sapiens
atctgagctcccacctccc

SEQ ID NO: 6664483 - DNA, 20 bp, Homo sapiens
atctgagctcccacctccct

SEQ ID NO: 6664484 - DNA, 21 bp, Homo sapiens
atctgagctcccacctccctt

SEQ ID NO: 6664485 - DNA, 18 bp, Homo sapiens
atctgagctgcagcctgg

SEQ ID NO: 6664486 - DNA, 12 bp, Homo sapiens
atctgagctggg

SEQ ID NO: 6664487 - DNA, 22 bp, Homo sapiens
atctgaggaaaatggaagacct

SEQ ID NO: 6664488 - DNA, 23 bp, Homo sapiens
atctgaggaatcaacagggcagc

SEQ ID NO: 6664489 - DNA, 18 bp, Homo sapiens
atctgaggaattctgtat

SEQ ID NO: 6664490 - DNA, 21 bp, Homo sapiens
atctgaggaattctgtataga

SEQ ID NO: 6664491 - DNA, 19 bp, Homo sapiens
atctgaggaggctttggta

SEQ ID NO: 6664492 - DNA, 18 bp, Homo sapiens
atctgaggatgagacagg

SEQ ID NO: 6664493 - DNA, 18 bp, Homo sapiens
atctgaggcatcctctga

SEQ ID NO: 6664494 - DNA, 20 bp, Homo sapiens
atctgaggcatcctctgact

SEQ ID NO: 6664495 - DNA, 14 bp, Homo sapiens
atctgagggaggag

SEQ ID NO: 6664496 - DNA, 23 bp, Homo sapiens
atctgagggaggaggccacctct

SEQ ID NO: 6664497 - DNA, 13 bp, Homo sapiens
atctgagggcact

SEQ ID NO: 6664498 - DNA, 20 bp, Homo sapiens
atctgagggttaatttctag

SEQ ID NO: 6664499 - DNA, 20 bp, Homo sapiens
atctgaggtcctgtgatctt

SEQ ID NO: 6664500 - DNA, 13 bp, Homo sapiens
atctgagttgcca

SEQ ID NO: 6664501 - DNA, 19 bp, Homo sapiens
atctgataaagttgagaga

SEQ ID NO: 6664502 - DNA, 15 bp, Homo sapiens
atctgataagcaaga

SEQ ID NO: 6664503 - DNA, 17 bp, Homo sapiens
atctgatacttatttac

SEQ ID NO: 6664504 - DNA, 22 bp, Homo sapiens
atctgatagaatgatgttttaa

SEQ ID NO: 6664505 - DNA, 15 bp, Homo sapiens
atctgatatcagcac

SEQ ID NO: 6664506 - DNA, 16 bp, Homo sapiens
atctgatatcagcact

SEQ ID NO: 6664507 - DNA, 20 bp, Homo sapiens
atctgatatcagtccagttt

SEQ ID NO: 6664508 - DNA, 19 bp, Homo sapiens
atctgatatgctgagaaat

SEQ ID NO: 6664509 - DNA, 22 bp, Homo sapiens
atctgatattcaaacacacagt

SEQ ID NO: 6664510 - DNA, 21 bp, Homo sapiens
atctgatcacccccctgctta

SEQ ID NO: 6664511 - DNA, 18 bp, Homo sapiens
atctgatcagaacaaatg

SEQ ID NO: 6664512 - DNA, 18 bp, Homo sapiens
atctgatcccataaagaa

SEQ ID NO: 6664513 - DNA, 20 bp, Homo sapiens
atctgatcccataaagaaag

SEQ ID NO: 6664514 - DNA, 21 bp, Homo sapiens
atctgatcgggataacaaaat

SEQ ID NO: 6664515 - DNA, 16 bp, Homo sapiens
atctgatcgttctttc

SEQ ID NO: 6664516 - DNA, 20 bp, Homo sapiens
atctgatcgttctttctagc

SEQ ID NO: 6664517 - DNA, 17 bp, Homo sapiens
atctgatctgagtgaga

SEQ ID NO: 6664518 - DNA, 16 bp, Homo sapiens
atctgatctgtaccat

SEQ ID NO: 6664519 - DNA, 12 bp, Homo sapiens
atctgatctgtg

SEQ ID NO: 6664520 - DNA, 16 bp, Homo sapiens
atctgatctgtgatta

SEQ ID NO: 6664521 - DNA, 20 bp, Homo sapiens
atctgatctttttatacaca

SEQ ID NO: 6664522 - DNA, 23 bp, Homo sapiens
atctgatctttttatacacaata

SEQ ID NO: 6664523 - DNA, 18 bp, Homo sapiens
atctgatgccttcatctg

SEQ ID NO: 6664524 - DNA, 21 bp, Homo sapiens
atctgatggccttaatttcct

SEQ ID NO: 6664525 - DNA, 17 bp, Homo sapiens
atctgatggcttctcca

SEQ ID NO: 6664526 - DNA, 16 bp, Homo sapiens
atctgatgtataatgt

SEQ ID NO: 6664527 - DNA, 17 bp, Homo sapiens
atctgattcctttaaaa

SEQ ID NO: 6664528 - DNA, 22 bp, Homo sapiens
atctgattgttgtcaggccata

SEQ ID NO: 6664529 - DNA, 14 bp, Homo sapiens
atctgatttaatgt

SEQ ID NO: 6664530 - DNA, 15 bp, Homo sapiens
atctgatttaatgtt

SEQ ID NO: 6664531 - DNA, 13 bp, Homo sapiens
atctgatttctga

SEQ ID NO: 6664532 - DNA, 19 bp, Homo sapiens
atctgatttgcatattcat

SEQ ID NO: 6664533 - DNA, 13 bp, Homo sapiens
atctgatttttaa

SEQ ID NO: 6664534 - DNA, 21 bp, Homo sapiens
atctgcaaaaggcctcttgta

SEQ ID NO: 6664535 - DNA, 16 bp, Homo sapiens
atctgcaaacaatgaa

SEQ ID NO: 6664536 - DNA, 20 bp, Homo sapiens
atctgcaaacaatgaagaat

SEQ ID NO: 6664537 - DNA, 11 bp, Homo sapiens
atctgcaaagc

SEQ ID NO: 6664538 - DNA, 16 bp, Homo sapiens
atctgcaaagcatgtt

SEQ ID NO: 6664539 - DNA, 20 bp, Homo sapiens
atctgcacacacctccgaga

SEQ ID NO: 6664540 - DNA, 14 bp, Homo sapiens
atctgcacactcca

SEQ ID NO: 6664541 - DNA, 17 bp, Homo sapiens
atctgcacactccaggc

SEQ ID NO: 6664542 - DNA, 19 bp, Homo sapiens
atctgcacactccaggcct

SEQ ID NO: 6664543 - DNA, 21 bp, Homo sapiens
atctgcacactctcttctcca

SEQ ID NO: 6664544 - DNA, 23 bp, Homo sapiens
atctgcacactctcttctccatt

SEQ ID NO: 6664545 - DNA, 12 bp, Homo sapiens
atctgcacagtc

SEQ ID NO: 6664546 - DNA, 18 bp, Homo sapiens
atctgcacagtcagaagg

SEQ ID NO: 6664547 - DNA, 19 bp, Homo sapiens
atctgcacagtcagaagga

SEQ ID NO: 6664548 - DNA, 21 bp, Homo sapiens
atctgcacataggcagtagcc

SEQ ID NO: 6664549 - DNA, 15 bp, Homo sapiens
atctgcacccccctg

SEQ ID NO: 6664550 - DNA, 18 bp, Homo sapiens
atctgcacccccctgggc

SEQ ID NO: 6664551 - DNA, 19 bp, Homo sapiens
atctgcacccccctgggct

SEQ ID NO: 6664552 - DNA, 17 bp, Homo sapiens
atctgcaccccttctct

SEQ ID NO: 6664553 - DNA, 21 bp, Homo sapiens
atctgcaccccttctctcctc

SEQ ID NO: 6664554 - DNA, 23 bp, Homo sapiens
atctgcaccccttctctcctccc

SEQ ID NO: 6664555 - DNA, 12 bp, Homo sapiens
atctgcaccctt

SEQ ID NO: 6664556 - DNA, 19 bp, Homo sapiens
atctgcacccttcttttct

SEQ ID NO: 6664557 - DNA, 18 bp, Homo sapiens
atctgcactcctgtctct

SEQ ID NO: 6664558 - DNA, 18 bp, Homo sapiens
atctgcactctaaactgc

SEQ ID NO: 6664559 - DNA, 19 bp, Homo sapiens
atctgcactgggtgtggcc

SEQ ID NO: 6664560 - DNA, 22 bp, Homo sapiens
atctgcagaacatcgatatgta

SEQ ID NO: 6664561 - DNA, 11 bp, Homo sapiens
atctgcagaag

SEQ ID NO: 6664562 - DNA, 13 bp, Homo sapiens
atctgcagaagga

SEQ ID NO: 6664563 - DNA, 18 bp, Homo sapiens
atctgcagccattcttca

SEQ ID NO: 6664564 - DNA, 20 bp, Homo sapiens
atctgcagctctttcttctt

SEQ ID NO: 6664565 - DNA, 15 bp, Homo sapiens
atctgcaggacagag

SEQ ID NO: 6664566 - DNA, 19 bp, Homo sapiens
atctgcaggcaccgggctg

SEQ ID NO: 6664567 - DNA, 20 bp, Homo sapiens
atctgcaggcaccgggctgg

SEQ ID NO: 6664568 - DNA, 20 bp, Homo sapiens
atctgcagggggtgtgtctg

SEQ ID NO: 6664569 - DNA, 16 bp, Homo sapiens
atctgcaggggtctgg

SEQ ID NO: 6664570 - DNA, 17 bp, Homo sapiens
atctgcagtgatgcaat

SEQ ID NO: 6664571 - DNA, 21 bp, Homo sapiens
atctgcagtgttctgtgaata

SEQ ID NO: 6664572 - DNA, 19 bp, Homo sapiens
atctgcatatttctgtata

SEQ ID NO: 6664573 - DNA, 20 bp, Homo sapiens
atctgcatatttctgtatat

SEQ ID NO: 6664574 - DNA, 22 bp, Homo sapiens
atctgcatatttctgtatattt

SEQ ID NO: 6664575 - DNA, 23 bp, Homo sapiens
atctgcatggggctggggtcctc

SEQ ID NO: 6664576 - DNA, 23 bp, Homo sapiens
atctgcatgtaaaatcttcagct

SEQ ID NO: 6664577 - DNA, 15 bp, Homo sapiens
atctgcatgtctact

SEQ ID NO: 6664578 - DNA, 13 bp, Homo sapiens
atctgcattatct

SEQ ID NO: 6664579 - DNA, 14 bp, Homo sapiens
atctgcatttagca

SEQ ID NO: 6664580 - DNA, 17 bp, Homo sapiens
atctgcatttagcacaa

SEQ ID NO: 6664581 - DNA, 21 bp, Homo sapiens
atctgcatttataaatgtgtg

SEQ ID NO: 6664582 - DNA, 15 bp, Homo sapiens
atctgccaaaatgta

SEQ ID NO: 6664583 - DNA, 19 bp, Homo sapiens
atctgccaatgccatgact

SEQ ID NO: 6664584 - DNA, 23 bp, Homo sapiens
atctgccaatgccatgactgctc

SEQ ID NO: 6664585 - DNA, 14 bp, Homo sapiens
atctgccacaaaaa

SEQ ID NO: 6664586 - DNA, 22 bp, Homo sapiens
atctgccacaaaaatgttcact

SEQ ID NO: 6664587 - DNA, 12 bp, Homo sapiens
atctgccacctg

SEQ ID NO: 6664588 - DNA, 14 bp, Homo sapiens
atctgccacctgca

SEQ ID NO: 6664589 - DNA, 18 bp, Homo sapiens
atctgccagacctgcatg

SEQ ID NO: 6664590 - DNA, 19 bp, Homo sapiens
atctgccatttatttcctc

SEQ ID NO: 6664591 - DNA, 12 bp, Homo sapiens
atctgcccagga

SEQ ID NO: 6664592 - DNA, 15 bp, Homo sapiens
atctgcccaggggtg

SEQ ID NO: 6664593 - DNA, 19 bp, Homo sapiens
atctgcccaggggtgcccc

SEQ ID NO: 6664594 - DNA, 12 bp, Homo sapiens
atctgcccctcc

SEQ ID NO: 6664595 - DNA, 13 bp, Homo sapiens
atctgcccgcctc

SEQ ID NO: 6664596 - DNA, 18 bp, Homo sapiens
atctgcccgcctcggtct

SEQ ID NO: 6664597 - DNA, 18 bp, Homo sapiens
atctgcccgcctgcccac

SEQ ID NO: 6664598 - DNA, 21 bp, Homo sapiens
atctgcccgcctgcccacctg

SEQ ID NO: 6664599 - DNA, 18 bp, Homo sapiens
atctgccctcagatgaaa

SEQ ID NO: 6664600 - DNA, 14 bp, Homo sapiens
atctgccctccctg

SEQ ID NO: 6664601 - DNA, 23 bp, Homo sapiens
atctgccctttgcagtgtgcagg

SEQ ID NO: 6664602 - DNA, 16 bp, Homo sapiens
atctgccgcctcagct

SEQ ID NO: 6664603 - DNA, 21 bp, Homo sapiens
atctgccgctttgtctgtcca

SEQ ID NO: 6664604 - DNA, 16 bp, Homo sapiens
atctgccggcccccag

SEQ ID NO: 6664605 - DNA, 17 bp, Homo sapiens
atctgccggcccccagg

SEQ ID NO: 6664606 - DNA, 11 bp, Homo sapiens
atctgcctaag

SEQ ID NO: 6664607 - DNA, 14 bp, Homo sapiens
atctgcctaaggac

SEQ ID NO: 6664608 - DNA, 15 bp, Homo sapiens
atctgcctaaggact

SEQ ID NO: 6664609 - DNA, 16 bp, Homo sapiens
atctgcctaaggactt

SEQ ID NO: 6664610 - DNA, 23 bp, Homo sapiens
atctgcctaaggacttctttaat

SEQ ID NO: 6664611 - DNA, 12 bp, Homo sapiens
atctgcctcccc

SEQ ID NO: 6664612 - DNA, 12 bp, Homo sapiens
atctgcctccct

SEQ ID NO: 6664613 - DNA, 22 bp, Homo sapiens
atctgcctctattcaatttaat

SEQ ID NO: 6664614 - DNA, 15 bp, Homo sapiens
atctgcctctcttgt

SEQ ID NO: 6664615 - DNA, 22 bp, Homo sapiens
atctgcctctggaaaactattg

SEQ ID NO: 6664616 - DNA, 16 bp, Homo sapiens
atctgcctgacaggct

SEQ ID NO: 6664617 - DNA, 17 bp, Homo sapiens
atctgcctgacaggctg

SEQ ID NO: 6664618 - DNA, 11 bp, Homo sapiens
atctgcctgga

SEQ ID NO: 6664619 - DNA, 13 bp, Homo sapiens
atctgcctggaaa

SEQ ID NO: 6664620 - DNA, 22 bp, Homo sapiens
atctgcctggaaagtcctccta

SEQ ID NO: 6664621 - DNA, 15 bp, Homo sapiens
atctgcctggagcct

SEQ ID NO: 6664622 - DNA, 17 bp, Homo sapiens
atctgcctggagcctgg

SEQ ID NO: 6664623 - DNA, 16 bp, Homo sapiens
atctgcctggcctggc

SEQ ID NO: 6664624 - DNA, 18 bp, Homo sapiens
atctgcctggcctggctc

SEQ ID NO: 6664625 - DNA, 14 bp, Homo sapiens
atctgcctgggcct

SEQ ID NO: 6664626 - DNA, 18 bp, Homo sapiens
atctgcctgggcctgtgc

SEQ ID NO: 6664627 - DNA, 20 bp, Homo sapiens
atctgcctgggcctgtgcag

SEQ ID NO: 6664628 - DNA, 20 bp, Homo sapiens
atctgcctgtaattaaacta

SEQ ID NO: 6664629 - DNA, 20 bp, Homo sapiens
atctgcctgtggccttgccc

SEQ ID NO: 6664630 - DNA, 18 bp, Homo sapiens
atctgccttaaaaccaaa

SEQ ID NO: 6664631 - DNA, 20 bp, Homo sapiens
atctgccttccagcccagac

SEQ ID NO: 6664632 - DNA, 16 bp, Homo sapiens
atctgcctttattgtg

SEQ ID NO: 6664633 - DNA, 22 bp, Homo sapiens
atctgcctttattgtgtttgtc

SEQ ID NO: 6664634 - DNA, 15 bp, Homo sapiens
atctgcgatcatcgt

SEQ ID NO: 6664635 - DNA, 19 bp, Homo sapiens
atctgcgggggcagtgctc

SEQ ID NO: 6664636 - DNA, 20 bp, Homo sapiens
atctgcgggggcagtgctca

SEQ ID NO: 6664637 - DNA, 22 bp, Homo sapiens
atctgcgtgacaataaaacatt

SEQ ID NO: 6664638 - DNA, 23 bp, Homo sapiens
atctgcgtgacaataaaacatta

SEQ ID NO: 6664639 - DNA, 15 bp, Homo sapiens
atctgcgtgtgtgca

SEQ ID NO: 6664640 - DNA, 20 bp, Homo sapiens
atctgctagggaatatcaat

SEQ ID NO: 6664641 - DNA, 23 bp, Homo sapiens
atctgctagtgctgtaatattgt

SEQ ID NO: 6664642 - DNA, 22 bp, Homo sapiens
atctgctataaactttacatat

SEQ ID NO: 6664643 - DNA, 19 bp, Homo sapiens
atctgctattaaccttgcc

SEQ ID NO: 6664644 - DNA, 21 bp, Homo sapiens
atctgctatttttaatttcct

SEQ ID NO: 6664645 - DNA, 14 bp, Homo sapiens
atctgctcagcagc

SEQ ID NO: 6664646 - DNA, 19 bp, Homo sapiens
atctgctcagccctggagg

SEQ ID NO: 6664647 - DNA, 22 bp, Homo sapiens
atctgctctagattcataaata

SEQ ID NO: 6664648 - DNA, 14 bp, Homo sapiens
atctgctctccttc

SEQ ID NO: 6664649 - DNA, 16 bp, Homo sapiens
atctgctctccttcct

SEQ ID NO: 6664650 - DNA, 20 bp, Homo sapiens
atctgctctccttcctggag

SEQ ID NO: 6664651 - DNA, 20 bp, Homo sapiens
atctgctgagctctgacctg

SEQ ID NO: 6664652 - DNA, 13 bp, Homo sapiens
atctgctgaggcc

SEQ ID NO: 6664653 - DNA, 21 bp, Homo sapiens
atctgctgaggcccagtgcat

SEQ ID NO: 6664654 - DNA, 14 bp, Homo sapiens
atctgctgcacata

SEQ ID NO: 6664655 - DNA, 17 bp, Homo sapiens
atctgctgcctctgaaa

SEQ ID NO: 6664656 - DNA, 14 bp, Homo sapiens
atctgctggagttt

SEQ ID NO: 6664657 - DNA, 14 bp, Homo sapiens
atctgctgggatct

SEQ ID NO: 6664658 - DNA, 17 bp, Homo sapiens
atctgctgggctggcgg

SEQ ID NO: 6664659 - DNA, 23 bp, Homo sapiens
atctgctgtaataatattttaga

SEQ ID NO: 6664660 - DNA, 17 bp, Homo sapiens
atctgctgtccagacag

SEQ ID NO: 6664661 - DNA, 23 bp, Homo sapiens
atctgctgtccagacagcctgta

SEQ ID NO: 6664662 - DNA, 21 bp, Homo sapiens
atctgctgtcttttctttgcc

SEQ ID NO: 6664663 - DNA, 12 bp, Homo sapiens
atctgctgtgtg

SEQ ID NO: 6664664 - DNA, 13 bp, Homo sapiens
atctgctgtgtgg

SEQ ID NO: 6664665 - DNA, 13 bp, Homo sapiens
atctgctgttatc

SEQ ID NO: 6664666 - DNA, 19 bp, Homo sapiens
atctgctgttcttcagtcc

SEQ ID NO: 6664667 - DNA, 14 bp, Homo sapiens
atctgctgttgcca

SEQ ID NO: 6664668 - DNA, 17 bp, Homo sapiens
atctgctgttgccatag

SEQ ID NO: 6664669 - DNA, 19 bp, Homo sapiens
atctgctgttgccatagcc

SEQ ID NO: 6664670 - DNA, 21 bp, Homo sapiens
atctgcttaggagtttaggga

SEQ ID NO: 6664671 - DNA, 14 bp, Homo sapiens
atctgcttcagtgg

SEQ ID NO: 6664672 - DNA, 17 bp, Homo sapiens
atctgcttggttggctg

SEQ ID NO: 6664673 - DNA, 21 bp, Homo sapiens
atctgcttggttggctggcag

SEQ ID NO: 6664674 - DNA, 18 bp, Homo sapiens
atctgctttctgttcatc

SEQ ID NO: 6664675 - DNA, 20 bp, Homo sapiens
atctgctttctgttcatctc

SEQ ID NO: 6664676 - DNA, 14 bp, Homo sapiens
atctgcttttatta

SEQ ID NO: 6664677 - DNA, 17 bp, Homo sapiens
atctgcttttcctctgc

SEQ ID NO: 6664678 - DNA, 12 bp, Homo sapiens
atctggaaaggg

SEQ ID NO: 6664679 - DNA, 23 bp, Homo sapiens
atctggaaataatatcatttata

SEQ ID NO: 6664680 - DNA, 11 bp, Homo sapiens
atctggaaccc

SEQ ID NO: 6664681 - DNA, 15 bp, Homo sapiens
atctggaacccagac

SEQ ID NO: 6664682 - DNA, 18 bp, Homo sapiens
atctggaacccagactca

SEQ ID NO: 6664683 - DNA, 11 bp, Homo sapiens
atctggaacct

SEQ ID NO: 6664684 - DNA, 17 bp, Homo sapiens
atctggaacctcagcct

SEQ ID NO: 6664685 - DNA, 18 bp, Homo sapiens
atctggaacctcagcctg

SEQ ID NO: 6664686 - DNA, 15 bp, Homo sapiens
atctggaagaaagcc

SEQ ID NO: 6664687 - DNA, 21 bp, Homo sapiens
atctggaagaaagccctgtgc

SEQ ID NO: 6664688 - DNA, 21 bp, Homo sapiens
atctggaagccaaaatgtagg

SEQ ID NO: 6664689 - DNA, 15 bp, Homo sapiens
atctggaagggcact

SEQ ID NO: 6664690 - DNA, 16 bp, Homo sapiens
atctggaatctgaggc

SEQ ID NO: 6664691 - DNA, 17 bp, Homo sapiens
atctggacacttcttta

SEQ ID NO: 6664692 - DNA, 14 bp, Homo sapiens
atctggacagaaca

SEQ ID NO: 6664693 - DNA, 18 bp, Homo sapiens
atctggactcctctgtcc

SEQ ID NO: 6664694 - DNA, 20 bp, Homo sapiens
atctggagaccagggagcct

SEQ ID NO: 6664695 - DNA, 14 bp, Homo sapiens
atctggagagaaca

SEQ ID NO: 6664696 - DNA, 12 bp, Homo sapiens
atctggagcctg

SEQ ID NO: 6664697 - DNA, 20 bp, Homo sapiens
atctggagctggcactgtgg

SEQ ID NO: 6664698 - DNA, 19 bp, Homo sapiens
atctggaggccttccagct

SEQ ID NO: 6664699 - DNA, 17 bp, Homo sapiens
atctggaggctcccatg

SEQ ID NO: 6664700 - DNA, 19 bp, Homo sapiens
atctggagtccctcctccc

SEQ ID NO: 6664701 - DNA, 19 bp, Homo sapiens
atctggagtgagaggcccc

SEQ ID NO: 6664702 - DNA, 21 bp, Homo sapiens
atctggatatcaaggtggaaa

SEQ ID NO: 6664703 - DNA, 22 bp, Homo sapiens
atctggatatcaaggtggaaat

SEQ ID NO: 6664704 - DNA, 17 bp, Homo sapiens
atctggatcgttatcta

SEQ ID NO: 6664705 - DNA, 20 bp, Homo sapiens
atctggatgcctcattatgt

SEQ ID NO: 6664706 - DNA, 15 bp, Homo sapiens
atctggcacactccc

SEQ ID NO: 6664707 - DNA, 16 bp, Homo sapiens
atctggcacactccct

SEQ ID NO: 6664708 - DNA, 18 bp, Homo sapiens
atctggcacgtggccagg

SEQ ID NO: 6664709 - DNA, 20 bp, Homo sapiens
atctggcacgtggccaggag

SEQ ID NO: 6664710 - DNA, 21 bp, Homo sapiens
atctggcacgtggccaggagc

SEQ ID NO: 6664711 - DNA, 14 bp, Homo sapiens
atctggcatggctc

SEQ ID NO: 6664712 - DNA, 20 bp, Homo sapiens
atctggcattctacacctgg

SEQ ID NO: 6664713 - DNA, 15 bp, Homo sapiens
atctggccacactgg

SEQ ID NO: 6664714 - DNA, 20 bp, Homo sapiens
atctggccacactgggctca

SEQ ID NO: 6664715 - DNA, 15 bp, Homo sapiens
atctggcccaggctg

SEQ ID NO: 6664716 - DNA, 16 bp, Homo sapiens
atctggcccaggctgg

SEQ ID NO: 6664717 - DNA, 17 bp, Homo sapiens
atctggcccaggctggc

SEQ ID NO: 6664718 - DNA, 19 bp, Homo sapiens
atctggcccagggtgtttg

SEQ ID NO: 6664719 - DNA, 12 bp, Homo sapiens
atctggccctgc

SEQ ID NO: 6664720 - DNA, 13 bp, Homo sapiens
atctggccctgct

SEQ ID NO: 6664721 - DNA, 16 bp, Homo sapiens
atctggccctgctgcc

SEQ ID NO: 6664722 - DNA, 18 bp, Homo sapiens
atctggcctaaaatcttg

SEQ ID NO: 6664723 - DNA, 19 bp, Homo sapiens
atctggcctaaaatcttgg

SEQ ID NO: 6664724 - DNA, 21 bp, Homo sapiens
atctggcctaaaatcttggaa

SEQ ID NO: 6664725 - DNA, 13 bp, Homo sapiens
atctggcctggcc

SEQ ID NO: 6664726 - DNA, 14 bp, Homo sapiens
atctggcctggcca

SEQ ID NO: 6664727 - DNA, 15 bp, Homo sapiens
atctggcctggcctg

SEQ ID NO: 6664728 - DNA, 19 bp, Homo sapiens
atctggcgctcccatggct

SEQ ID NO: 6664729 - DNA, 16 bp, Homo sapiens
atctggctaaggcatc

SEQ ID NO: 6664730 - DNA, 16 bp, Homo sapiens
atctggctcactgcag

SEQ ID NO: 6664731 - DNA, 14 bp, Homo sapiens
atctggctcagcat

SEQ ID NO: 6664732 - DNA, 17 bp, Homo sapiens
atctggctcctttacaa

SEQ ID NO: 6664733 - DNA, 14 bp, Homo sapiens
atctggctgcacag

SEQ ID NO: 6664734 - DNA, 22 bp, Homo sapiens
atctggctgcagttttgctatc

SEQ ID NO: 6664735 - DNA, 16 bp, Homo sapiens
atctggctgcctttgc

SEQ ID NO: 6664736 - DNA, 21 bp, Homo sapiens
atctggctggaaagcagagcc

SEQ ID NO: 6664737 - DNA, 20 bp, Homo sapiens
atctggctgtgacagcctct

SEQ ID NO: 6664738 - DNA, 16 bp, Homo sapiens
atctggcttagtgcca

SEQ ID NO: 6664739 - DNA, 16 bp, Homo sapiens
atctggcttattttaa

SEQ ID NO: 6664740 - DNA, 19 bp, Homo sapiens
atctggcttattttaatgt

SEQ ID NO: 6664741 - DNA, 15 bp, Homo sapiens
atctggcttctgcat

SEQ ID NO: 6664742 - DNA, 19 bp, Homo sapiens
atctggcttctgcattact

SEQ ID NO: 6664743 - DNA, 19 bp, Homo sapiens
atctggctttttctgccac

SEQ ID NO: 6664744 - DNA, 20 bp, Homo sapiens
atctggctttttctgccact

SEQ ID NO: 6664745 - DNA, 22 bp, Homo sapiens
atctgggaaaataccccatcat

SEQ ID NO: 6664746 - DNA, 23 bp, Homo sapiens
atctgggaagatttgaaaacaaa

SEQ ID NO: 6664747 - DNA, 21 bp, Homo sapiens
atctgggactgtgcctggctc

SEQ ID NO: 6664748 - DNA, 14 bp, Homo sapiens
atctgggactttca

SEQ ID NO: 6664749 - DNA, 20 bp, Homo sapiens
atctgggaggcagaacaggc

SEQ ID NO: 6664750 - DNA, 13 bp, Homo sapiens
atctgggagggaa

SEQ ID NO: 6664751 - DNA, 21 bp, Homo sapiens
atctgggattattctttgaaa

SEQ ID NO: 6664752 - DNA, 18 bp, Homo sapiens
atctgggcatagatgcag

SEQ ID NO: 6664753 - DNA, 17 bp, Homo sapiens
atctgggcattttcctc

SEQ ID NO: 6664754 - DNA, 21 bp, Homo sapiens
atctgggcattttcctcctct

SEQ ID NO: 6664755 - DNA, 24 bp, Homo sapiens
atctgggcattttcctcctctgcc

SEQ ID NO: 6664756 - DNA, 15 bp, Homo sapiens
atctgggccagaatt

SEQ ID NO: 6664757 - DNA, 13 bp, Homo sapiens
atctgggcctggg

SEQ ID NO: 6664758 - DNA, 21 bp, Homo sapiens
atctgggccttggcctggagc

SEQ ID NO: 6664759 - DNA, 14 bp, Homo sapiens
atctgggctggcag

SEQ ID NO: 6664760 - DNA, 21 bp, Homo sapiens
atctgggcttaataagtcact

SEQ ID NO: 6664761 - DNA, 14 bp, Homo sapiens
atctgggcttcctg

SEQ ID NO: 6664762 - DNA, 16 bp, Homo sapiens
atctgggcttcctgga

SEQ ID NO: 6664763 - DNA, 18 bp, Homo sapiens
atctgggcttcctggagc

SEQ ID NO: 6664764 - DNA, 23 bp, Homo sapiens
atctggggaaggaccaacccatg

SEQ ID NO: 6664765 - DNA, 23 bp, Homo sapiens
atctggggagagcggctggagaa

SEQ ID NO: 6664766 - DNA, 16 bp, Homo sapiens
atctggggagcaggca

SEQ ID NO: 6664767 - DNA, 21 bp, Homo sapiens
atctggggagcaggcagccag

SEQ ID NO: 6664768 - DNA, 22 bp, Homo sapiens
atctggggagcaggcagccagc

SEQ ID NO: 6664769 - DNA, 23 bp, Homo sapiens
atctggggagcaggcagccagca

SEQ ID NO: 6664770 - DNA, 15 bp, Homo sapiens
atctggggagctcct

SEQ ID NO: 6664771 - DNA, 18 bp, Homo sapiens
atctggggagctcctggc

SEQ ID NO: 6664772 - DNA, 16 bp, Homo sapiens
atctggggatgacaat

SEQ ID NO: 6664773 - DNA, 17 bp, Homo sapiens
atctggggcatgaaaaa

SEQ ID NO: 6664774 - DNA, 15 bp, Homo sapiens
atctggggggtgggg

SEQ ID NO: 6664775 - DNA, 23 bp, Homo sapiens
atctggggggtggggaggaggaa

SEQ ID NO: 6664776 - DNA, 17 bp, Homo sapiens
atctggggtggggtggg

SEQ ID NO: 6664777 - DNA, 19 bp, Homo sapiens
atctggggttggcaacagg

SEQ ID NO: 6664778 - DNA, 23 bp, Homo sapiens
atctggggttggcaacaggacag

SEQ ID NO: 6664779 - DNA, 23 bp, Homo sapiens
atctgggtaagaagaaagcaaaa

SEQ ID NO: 6664780 - DNA, 14 bp, Homo sapiens
atctgggtagctgt

SEQ ID NO: 6664781 - DNA, 18 bp, Homo sapiens
atctgggtccttgcaccc

SEQ ID NO: 6664782 - DNA, 15 bp, Homo sapiens
atctgggtctctaat

SEQ ID NO: 6664783 - DNA, 18 bp, Homo sapiens
atctgggtgcatgatctt

SEQ ID NO: 6664784 - DNA, 23 bp, Homo sapiens
atctgggtgtgtgagtgggagga

SEQ ID NO: 6664785 - DNA, 22 bp, Homo sapiens
atctgggttttagaaattctat

SEQ ID NO: 6664786 - DNA, 20 bp, Homo sapiens
atctgggttttgcctctgcc

SEQ ID NO: 6664787 - DNA, 22 bp, Homo sapiens
atctggtaccagttgaaatttt

SEQ ID NO: 6664788 - DNA, 15 bp, Homo sapiens
atctggtatctgcat

SEQ ID NO: 6664789 - DNA, 15 bp, Homo sapiens
atctggtattaaatg

SEQ ID NO: 6664790 - DNA, 15 bp, Homo sapiens
atctggtcaagttga

SEQ ID NO: 6664791 - DNA, 22 bp, Homo sapiens
atctggtcaagttgagattttt

SEQ ID NO: 6664792 - DNA, 17 bp, Homo sapiens
atctggtcccttgcagc

SEQ ID NO: 6664793 - DNA, 23 bp, Homo sapiens
atctggtcttgtttccaggagca

SEQ ID NO: 6664794 - DNA, 14 bp, Homo sapiens
atctggtgatttct

SEQ ID NO: 6664795 - DNA, 15 bp, Homo sapiens
atctggtgatttcta

SEQ ID NO: 6664796 - DNA, 17 bp, Homo sapiens
atctggtgatttctagc

SEQ ID NO: 6664797 - DNA, 13 bp, Homo sapiens
atctggtgccttt

SEQ ID NO: 6664798 - DNA, 20 bp, Homo sapiens
atctggtgcctttccacaca

SEQ ID NO: 6664799 - DNA, 17 bp, Homo sapiens
atctggtgcgtgtggcc

SEQ ID NO: 6664800 - DNA, 18 bp, Homo sapiens
atctggtggtcagcccta

SEQ ID NO: 6664801 - DNA, 16 bp, Homo sapiens
atctggttagataatg

SEQ ID NO: 6664802 - DNA, 14 bp, Homo sapiens
atctggttatatca

SEQ ID NO: 6664803 - DNA, 13 bp, Homo sapiens
atctggttttctc

SEQ ID NO: 6664804 - DNA, 21 bp, Homo sapiens
atctggttttgggtgtttttc

SEQ ID NO: 6664805 - DNA, 17 bp, Homo sapiens
atctggtttttaaaaga

SEQ ID NO: 6664806 - DNA, 14 bp, Homo sapiens
atctgtaaaaattg

SEQ ID NO: 6664807 - DNA, 15 bp, Homo sapiens
atctgtaaaaattgt

SEQ ID NO: 6664808 - DNA, 19 bp, Homo sapiens
atctgtaaaaattgttata

SEQ ID NO: 6664809 - DNA, 12 bp, Homo sapiens
atctgtaaaata

SEQ ID NO: 6664810 - DNA, 17 bp, Homo sapiens
atctgtaaaatagtctc

SEQ ID NO: 6664811 - DNA, 17 bp, Homo sapiens
atctgtaaactgtgtat

SEQ ID NO: 6664812 - DNA, 14 bp, Homo sapiens
atctgtaaactttt

SEQ ID NO: 6664813 - DNA, 13 bp, Homo sapiens
atctgtaaatatc

SEQ ID NO: 6664814 - DNA, 19 bp, Homo sapiens
atctgtaaatatcccagag

SEQ ID NO: 6664815 - DNA, 16 bp, Homo sapiens
atctgtaaatctacac

SEQ ID NO: 6664816 - DNA, 22 bp, Homo sapiens
atctgtaaatttggactgtttt

SEQ ID NO: 6664817 - DNA, 15 bp, Homo sapiens
atctgtaacactatt

SEQ ID NO: 6664818 - DNA, 22 bp, Homo sapiens
atctgtaacactattacagtat

SEQ ID NO: 6664819 - DNA, 11 bp, Homo sapiens
atctgtaacag

SEQ ID NO: 6664820 - DNA, 23 bp, Homo sapiens
atctgtaacaggtattttgtttc

SEQ ID NO: 6664821 - DNA, 19 bp, Homo sapiens
atctgtaacccttgaattt

SEQ ID NO: 6664822 - DNA, 17 bp, Homo sapiens
atctgtaagctgtttgg

SEQ ID NO: 6664823 - DNA, 15 bp, Homo sapiens
atctgtaaggaactg

SEQ ID NO: 6664824 - DNA, 19 bp, Homo sapiens
atctgtaagtaacttcaca

SEQ ID NO: 6664825 - DNA, 15 bp, Homo sapiens
atctgtaatcctagc

SEQ ID NO: 6664826 - DNA, 16 bp, Homo sapiens
atctgtaattgataat

SEQ ID NO: 6664827 - DNA, 13 bp, Homo sapiens
atctgtaatttca

SEQ ID NO: 6664828 - DNA, 15 bp, Homo sapiens
atctgtaatttcact

SEQ ID NO: 6664829 - DNA, 13 bp, Homo sapiens
atctgtacatact

SEQ ID NO: 6664830 - DNA, 19 bp, Homo sapiens
atctgtacatactttttca

SEQ ID NO: 6664831 - DNA, 11 bp, Homo sapiens
atctgtacatg

SEQ ID NO: 6664832 - DNA, 13 bp, Homo sapiens
atctgtacatgtt

SEQ ID NO: 6664833 - DNA, 20 bp, Homo sapiens
atctgtacatgttcttgtca

SEQ ID NO: 6664834 - DNA, 16 bp, Homo sapiens
atctgtacattttgtt

SEQ ID NO: 6664835 - DNA, 15 bp, Homo sapiens
atctgtacgtaagaa

SEQ ID NO: 6664836 - DNA, 21 bp, Homo sapiens
atctgtactatctagtgtcta

SEQ ID NO: 6664837 - DNA, 14 bp, Homo sapiens
atctgtactgaaag

SEQ ID NO: 6664838 - DNA, 17 bp, Homo sapiens
atctgtactgaaagcaa

SEQ ID NO: 6664839 - DNA, 16 bp, Homo sapiens
atctgtactgtaattt

SEQ ID NO: 6664840 - DNA, 18 bp, Homo sapiens
atctgtactttgtgttta

SEQ ID NO: 6664841 - DNA, 20 bp, Homo sapiens
atctgtacttttttcaaata

SEQ ID NO: 6664842 - DNA, 21 bp, Homo sapiens
atctgtacttttttcaaatat

SEQ ID NO: 6664843 - DNA, 13 bp, Homo sapiens
atctgtagaggag

SEQ ID NO: 6664844 - DNA, 23 bp, Homo sapiens
atctgtagggaattcttctgtta

SEQ ID NO: 6664845 - DNA, 18 bp, Homo sapiens
atctgtagggctggacct

SEQ ID NO: 6664846 - DNA, 16 bp, Homo sapiens
atctgtaggtcactct

SEQ ID NO: 6664847 - DNA, 21 bp, Homo sapiens
atctgtagtaatttattgtct

SEQ ID NO: 6664848 - DNA, 19 bp, Homo sapiens
atctgtagttccagctata

SEQ ID NO: 6664849 - DNA, 12 bp, Homo sapiens
atctgtataaat

SEQ ID NO: 6664850 - DNA, 17 bp, Homo sapiens
atctgtataaataagag

SEQ ID NO: 6664851 - DNA, 17 bp, Homo sapiens
atctgtataaatgtcta

SEQ ID NO: 6664852 - DNA, 17 bp, Homo sapiens
atctgtataaatgtgaa

SEQ ID NO: 6664853 - DNA, 19 bp, Homo sapiens
atctgtataagtaagaaaa

SEQ ID NO: 6664854 - DNA, 18 bp, Homo sapiens
atctgtataccctctgtt

SEQ ID NO: 6664855 - DNA, 20 bp, Homo sapiens
atctgtatatgttgtaataa

SEQ ID NO: 6664856 - DNA, 14 bp, Homo sapiens
atctgtatgattct

SEQ ID NO: 6664857 - DNA, 15 bp, Homo sapiens
atctgtatgattcta

SEQ ID NO: 6664858 - DNA, 19 bp, Homo sapiens
atctgtatgattctatgga

SEQ ID NO: 6664859 - DNA, 14 bp, Homo sapiens
atctgtatgctggt

SEQ ID NO: 6664860 - DNA, 23 bp, Homo sapiens
atctgtatgtattagtgatattt

SEQ ID NO: 6664861 - DNA, 16 bp, Homo sapiens
atctgtattggcagca

SEQ ID NO: 6664862 - DNA, 21 bp, Homo sapiens
atctgtattggcagcacagct

SEQ ID NO: 6664863 - DNA, 15 bp, Homo sapiens
atctgtatttaattt

SEQ ID NO: 6664864 - DNA, 19 bp, Homo sapiens
atctgtatttattatttga

SEQ ID NO: 6664865 - DNA, 21 bp, Homo sapiens
atctgtatttttaaattctgc

SEQ ID NO: 6664866 - DNA, 20 bp, Homo sapiens
atctgtcaaaacactgtgga

SEQ ID NO: 6664867 - DNA, 23 bp, Homo sapiens
atctgtcaagtgggatctgtcac

SEQ ID NO: 6664868 - DNA, 22 bp, Homo sapiens
atctgtcacaataaatggccag

SEQ ID NO: 6664869 - DNA, 23 bp, Homo sapiens
atctgtcacaataaatggccagt

SEQ ID NO: 6664870 - DNA, 18 bp, Homo sapiens
atctgtcacaccagccat

SEQ ID NO: 6664871 - DNA, 15 bp, Homo sapiens
atctgtcactgacct

SEQ ID NO: 6664872 - DNA, 17 bp, Homo sapiens
atctgtcagtgtttgta

SEQ ID NO: 6664873 - DNA, 15 bp, Homo sapiens
atctgtcatccatat

SEQ ID NO: 6664874 - DNA, 17 bp, Homo sapiens
atctgtcatctctctgg

SEQ ID NO: 6664875 - DNA, 15 bp, Homo sapiens
atctgtcattatatt

SEQ ID NO: 6664876 - DNA, 19 bp, Homo sapiens
atctgtcattatattctaa

SEQ ID NO: 6664877 - DNA, 21 bp, Homo sapiens
atctgtccaaaggaggctggc

SEQ ID NO: 6664878 - DNA, 12 bp, Homo sapiens
atctgtccagac

SEQ ID NO: 6664879 - DNA, 14 bp, Homo sapiens
atctgtccagacaa

SEQ ID NO: 6664880 - DNA, 14 bp, Homo sapiens
atctgtccatcctc

SEQ ID NO: 6664881 - DNA, 19 bp, Homo sapiens
atctgtccatcctcctctc

SEQ ID NO: 6664882 - DNA, 22 bp, Homo sapiens
atctgtccatcctcctctccat

SEQ ID NO: 6664883 - DNA, 15 bp, Homo sapiens
atctgtcccctctcc

SEQ ID NO: 6664884 - DNA, 17 bp, Homo sapiens
atctgtcccctctcccc

SEQ ID NO: 6664885 - DNA, 16 bp, Homo sapiens
atctgtcccttaataa

SEQ ID NO: 6664886 - DNA, 19 bp, Homo sapiens
atctgtccgacagtcaaga

SEQ ID NO: 6664887 - DNA, 21 bp, Homo sapiens
atctgtccgtggaaaatttca

SEQ ID NO: 6664888 - DNA, 18 bp, Homo sapiens
atctgtcctcaccctgtg

SEQ ID NO: 6664889 - DNA, 21 bp, Homo sapiens
atctgtcctcaccctgtggga

SEQ ID NO: 6664890 - DNA, 23 bp, Homo sapiens
atctgtcctcaccctgtgggacc

SEQ ID NO: 6664891 - DNA, 14 bp, Homo sapiens
atctgtcctcagcc

SEQ ID NO: 6664892 - DNA, 21 bp, Homo sapiens
atctgtcctcagccttgccag

SEQ ID NO: 6664893 - DNA, 13 bp, Homo sapiens
atctgtcctctgt

SEQ ID NO: 6664894 - DNA, 14 bp, Homo sapiens
atctgtcctctgta

SEQ ID NO: 6664895 - DNA, 15 bp, Homo sapiens
atctgtcgcatttca

SEQ ID NO: 6664896 - DNA, 13 bp, Homo sapiens
atctgtctaaaga

SEQ ID NO: 6664897 - DNA, 18 bp, Homo sapiens
atctgtctatattttatt

SEQ ID NO: 6664898 - DNA, 20 bp, Homo sapiens
atctgtctcccagttatgaa

SEQ ID NO: 6664899 - DNA, 19 bp, Homo sapiens
atctgtctcggctctgcat

SEQ ID NO: 6664900 - DNA, 17 bp, Homo sapiens
atctgtctgattctatg

SEQ ID NO: 6664901 - DNA, 14 bp, Homo sapiens
atctgtctgctctg

SEQ ID NO: 6664902 - DNA, 14 bp, Homo sapiens
atctgtctgctggt

SEQ ID NO: 6664903 - DNA, 15 bp, Homo sapiens
atctgtctggagggg

SEQ ID NO: 6664904 - DNA, 14 bp, Homo sapiens
atctgtctgtccta

SEQ ID NO: 6664905 - DNA, 18 bp, Homo sapiens
atctgtctgtctgtgggc

SEQ ID NO: 6664906 - DNA, 20 bp, Homo sapiens
atctgtctgtctgtgggctt

SEQ ID NO: 6664907 - DNA, 13 bp, Homo sapiens
atctgtctgtgca

SEQ ID NO: 6664908 - DNA, 18 bp, Homo sapiens
atctgtctgtgcacatgc

SEQ ID NO: 6664909 - DNA, 22 bp, Homo sapiens
atctgtctgtggcaaaagttta

SEQ ID NO: 6664910 - DNA, 14 bp, Homo sapiens
atctgtcttcagca

SEQ ID NO: 6664911 - DNA, 17 bp, Homo sapiens
atctgtcttgacttttt

SEQ ID NO: 6664912 - DNA, 17 bp, Homo sapiens
atctgtcttgccagcca

SEQ ID NO: 6664913 - DNA, 19 bp, Homo sapiens
atctgtcttgccagccaga

SEQ ID NO: 6664914 - DNA, 11 bp, Homo sapiens
atctgtcttgg

SEQ ID NO: 6664915 - DNA, 12 bp, Homo sapiens
atctgtcttgta

SEQ ID NO: 6664916 - DNA, 13 bp, Homo sapiens
atctgtcttgtaa

SEQ ID NO: 6664917 - DNA, 22 bp, Homo sapiens
atctgtcttgtaatattttgta

SEQ ID NO: 6664918 - DNA, 20 bp, Homo sapiens
atctgtctttccactctgga

SEQ ID NO: 6664919 - DNA, 21 bp, Homo sapiens
atctgtctttccactctggat

SEQ ID NO: 6664920 - DNA, 22 bp, Homo sapiens
atctgtctttgcggggcctgtc

SEQ ID NO: 6664921 - DNA, 18 bp, Homo sapiens
atctgtgaaaggaaagag

SEQ ID NO: 6664922 - DNA, 23 bp, Homo sapiens
atctgtgaaaggaaagagggagg

SEQ ID NO: 6664923 - DNA, 11 bp, Homo sapiens
atctgtgaaat

SEQ ID NO: 6664924 - DNA, 16 bp, Homo sapiens
atctgtgaaatatcat

SEQ ID NO: 6664925 - DNA, 18 bp, Homo sapiens
atctgtgaacttgaaatt

SEQ ID NO: 6664926 - DNA, 19 bp, Homo sapiens
atctgtgaacttgaaattt

SEQ ID NO: 6664927 - DNA, 20 bp, Homo sapiens
atctgtgaagcctttatcta

SEQ ID NO: 6664928 - DNA, 17 bp, Homo sapiens
atctgtgaattgagctg

SEQ ID NO: 6664929 - DNA, 16 bp, Homo sapiens
atctgtgacctgtcag

SEQ ID NO: 6664930 - DNA, 19 bp, Homo sapiens
atctgtgacctgtcagaat

SEQ ID NO: 6664931 - DNA, 20 bp, Homo sapiens
atctgtgacctgtcagaata

SEQ ID NO: 6664932 - DNA, 21 bp, Homo sapiens
atctgtgacctgtcagaataa

SEQ ID NO: 6664933 - DNA, 18 bp, Homo sapiens
atctgtgactataaagct

SEQ ID NO: 6664934 - DNA, 16 bp, Homo sapiens
atctgtgagtgaaagt

SEQ ID NO: 6664935 - DNA, 24 bp, Homo sapiens
atctgtgagtgaaagttgccatta

SEQ ID NO: 6664936 - DNA, 13 bp, Homo sapiens
atctgtgattggc

SEQ ID NO: 6664937 - DNA, 17 bp, Homo sapiens
atctgtgattggctggt

SEQ ID NO: 6664938 - DNA, 14 bp, Homo sapiens
atctgtgcaaacag

SEQ ID NO: 6664939 - DNA, 22 bp, Homo sapiens
atctgtgcaaatccttgatact

SEQ ID NO: 6664940 - DNA, 13 bp, Homo sapiens
atctgtgcaataa

SEQ ID NO: 6664941 - DNA, 12 bp, Homo sapiens
atctgtgcagga

SEQ ID NO: 6664942 - DNA, 21 bp, Homo sapiens
atctgtgcagtcatcaacaaa

SEQ ID NO: 6664943 - DNA, 18 bp, Homo sapiens
atctgtgccatacttgtt

SEQ ID NO: 6664944 - DNA, 14 bp, Homo sapiens
atctgtgcccagag

SEQ ID NO: 6664945 - DNA, 17 bp, Homo sapiens
atctgtgcccagagatg

SEQ ID NO: 6664946 - DNA, 12 bp, Homo sapiens
atctgtgcctgg

SEQ ID NO: 6664947 - DNA, 13 bp, Homo sapiens
atctgtgcctggg

SEQ ID NO: 6664948 - DNA, 23 bp, Homo sapiens
atctgtgccttttttatatcttg

SEQ ID NO: 6664949 - DNA, 16 bp, Homo sapiens
atctgtgcgtgaaaca

SEQ ID NO: 6664950 - DNA, 23 bp, Homo sapiens
atctgtgcgtgtggcgtggcccg

SEQ ID NO: 6664951 - DNA, 16 bp, Homo sapiens
atctgtgctgtttcaa

SEQ ID NO: 6664952 - DNA, 16 bp, Homo sapiens
atctgtgcttctaata

SEQ ID NO: 6664953 - DNA, 14 bp, Homo sapiens
atctgtggagctgc

SEQ ID NO: 6664954 - DNA, 15 bp, Homo sapiens
atctgtggagctgcc

SEQ ID NO: 6664955 - DNA, 16 bp, Homo sapiens
atctgtggagttcctg

SEQ ID NO: 6664956 - DNA, 19 bp, Homo sapiens
atctgtggagttcctgctc

SEQ ID NO: 6664957 - DNA, 18 bp, Homo sapiens
atctgtggcaagcaccca

SEQ ID NO: 6664958 - DNA, 16 bp, Homo sapiens
atctgtggcctggggc

SEQ ID NO: 6664959 - DNA, 23 bp, Homo sapiens
atctgtggcgatatgagagggat

SEQ ID NO: 6664960 - DNA, 19 bp, Homo sapiens
atctgtgggcatggtcaaa

SEQ ID NO: 6664961 - DNA, 13 bp, Homo sapiens
atctgtgggccca

SEQ ID NO: 6664962 - DNA, 19 bp, Homo sapiens
atctgtgggtctccatcct

SEQ ID NO: 6664963 - DNA, 16 bp, Homo sapiens
atctgtggtcttcaaa

SEQ ID NO: 6664964 - DNA, 18 bp, Homo sapiens
atctgtggttttcctcta

SEQ ID NO: 6664965 - DNA, 20 bp, Homo sapiens
atctgtgtaacctccacagt

SEQ ID NO: 6664966 - DNA, 17 bp, Homo sapiens
atctgtgtacaaagaaa

SEQ ID NO: 6664967 - DNA, 18 bp, Homo sapiens
atctgtgtacaaagaaat

SEQ ID NO: 6664968 - DNA, 20 bp, Homo sapiens
atctgtgtatattatttggc

SEQ ID NO: 6664969 - DNA, 12 bp, Homo sapiens
atctgtgtcttg

SEQ ID NO: 6664970 - DNA, 13 bp, Homo sapiens
atctgtgtcttgt

SEQ ID NO: 6664971 - DNA, 15 bp, Homo sapiens
atctgtgtcttgttt

SEQ ID NO: 6664972 - DNA, 15 bp, Homo sapiens
atctgtgtgaaactt

SEQ ID NO: 6664973 - DNA, 17 bp, Homo sapiens
atctgtgtgcatatttg

SEQ ID NO: 6664974 - DNA, 15 bp, Homo sapiens
atctgtgtgccctag

SEQ ID NO: 6664975 - DNA, 15 bp, Homo sapiens
atctgtgtggctcct

SEQ ID NO: 6664976 - DNA, 15 bp, Homo sapiens
atctgtgtgtgaatt

SEQ ID NO: 6664977 - DNA, 16 bp, Homo sapiens
atctgtgttctaactt

SEQ ID NO: 6664978 - DNA, 16 bp, Homo sapiens
atctgtgttgtctctc

SEQ ID NO: 6664979 - DNA, 22 bp, Homo sapiens
atctgttaaccaaataaaacat

SEQ ID NO: 6664980 - DNA, 16 bp, Homo sapiens
atctgttactgaaatg

SEQ ID NO: 6664981 - DNA, 17 bp, Homo sapiens
atctgttagatgctact

SEQ ID NO: 6664982 - DNA, 18 bp, Homo sapiens
atctgttagatgctacta

SEQ ID NO: 6664983 - DNA, 22 bp, Homo sapiens
atctgttatcctgctagctgta

SEQ ID NO: 6664984 - DNA, 18 bp, Homo sapiens
atctgttcaacctcagta

SEQ ID NO: 6664985 - DNA, 15 bp, Homo sapiens
atctgttcatttcta

SEQ ID NO: 6664986 - DNA, 16 bp, Homo sapiens
atctgttcatttctaa

SEQ ID NO: 6664987 - DNA, 23 bp, Homo sapiens
atctgttcccagcccctcctccc

SEQ ID NO: 6664988 - DNA, 20 bp, Homo sapiens
atctgttcccctgtcctgtg

SEQ ID NO: 6664989 - DNA, 21 bp, Homo sapiens
atctgttcccctgtcctgtga

SEQ ID NO: 6664990 - DNA, 19 bp, Homo sapiens
atctgttcccttcctctgt

SEQ ID NO: 6664991 - DNA, 23 bp, Homo sapiens
atctgttcccttcctctgtgcca

SEQ ID NO: 6664992 - DNA, 19 bp, Homo sapiens
atctgttctatgcttcctc

SEQ ID NO: 6664993 - DNA, 14 bp, Homo sapiens
atctgttctatgga

SEQ ID NO: 6664994 - DNA, 20 bp, Homo sapiens
atctgttctatggaccaaat

SEQ ID NO: 6664995 - DNA, 20 bp, Homo sapiens
atctgttctgggctctttcc

SEQ ID NO: 6664996 - DNA, 13 bp, Homo sapiens
atctgttgaaaag

SEQ ID NO: 6664997 - DNA, 20 bp, Homo sapiens
atctgttgacaatttgccat

SEQ ID NO: 6664998 - DNA, 17 bp, Homo sapiens
atctgttggagaaagaa

SEQ ID NO: 6664999 - DNA, 12 bp, Homo sapiens
atctgttgtaat

SEQ ID NO: 6665000 - DNA, 23 bp, Homo sapiens
atctgttgtaatatcagttacag

SEQ ID NO: 6665001 - DNA, 21 bp, Homo sapiens
atctgttgtgtacgtggagag

SEQ ID NO: 6665002 - DNA, 23 bp, Homo sapiens
atctgttgtgtacgtggagaggg

SEQ ID NO: 6665003 - DNA, 14 bp, Homo sapiens
atctgtttaaagca

SEQ ID NO: 6665004 - DNA, 22 bp, Homo sapiens
atctgtttaaagcatatagaga

SEQ ID NO: 6665005 - DNA, 24 bp, Homo sapiens
atctgtttaaagcatatagagatg

SEQ ID NO: 6665006 - DNA, 15 bp, Homo sapiens
atctgtttacagtgt

SEQ ID NO: 6665007 - DNA, 17 bp, Homo sapiens
atctgtttacagtgttc

SEQ ID NO: 6665008 - DNA, 14 bp, Homo sapiens
atctgtttcccagc

SEQ ID NO: 6665009 - DNA, 21 bp, Homo sapiens
atctgtttcctgttctcttgt

SEQ ID NO: 6665010 - DNA, 22 bp, Homo sapiens
atctgtttcctgttctcttgta

SEQ ID NO: 6665011 - DNA, 16 bp, Homo sapiens
atctgtttctatgtcc

SEQ ID NO: 6665012 - DNA, 17 bp, Homo sapiens
atctgtttctctgctgt

SEQ ID NO: 6665013 - DNA, 18 bp, Homo sapiens
atctgtttctctgctgtc

SEQ ID NO: 6665014 - DNA, 15 bp, Homo sapiens
atctgtttgaggaga

SEQ ID NO: 6665015 - DNA, 14 bp, Homo sapiens
atctgtttgcttct

SEQ ID NO: 6665016 - DNA, 13 bp, Homo sapiens
atctgtttgtata

SEQ ID NO: 6665017 - DNA, 14 bp, Homo sapiens
atctgtttgtatat

SEQ ID NO: 6665018 - DNA, 15 bp, Homo sapiens
atctgtttgtatatt

SEQ ID NO: 6665019 - DNA, 17 bp, Homo sapiens
atctgtttgtatatttg

SEQ ID NO: 6665020 - DNA, 19 bp, Homo sapiens
atctgtttgtatatttgca

SEQ ID NO: 6665021 - DNA, 15 bp, Homo sapiens
atctgtttgtttttt

SEQ ID NO: 6665022 - DNA, 15 bp, Homo sapiens
atctgttttacagga

SEQ ID NO: 6665023 - DNA, 18 bp, Homo sapiens
atctgttttacaggaaac

SEQ ID NO: 6665024 - DNA, 20 bp, Homo sapiens
atctgttttacaggaaacaa

SEQ ID NO: 6665025 - DNA, 17 bp, Homo sapiens
atctgttttgaaggcaa

SEQ ID NO: 6665026 - DNA, 17 bp, Homo sapiens
atctgttttggatgttg

SEQ ID NO: 6665027 - DNA, 22 bp, Homo sapiens
atctgttttgtggtttggaata

SEQ ID NO: 6665028 - DNA, 18 bp, Homo sapiens
atctgtttttaaaaatca

SEQ ID NO: 6665029 - DNA, 21 bp, Homo sapiens
atcttaaaaacaacgaaagaa

SEQ ID NO: 6665030 - DNA, 19 bp, Homo sapiens
atcttaaaaagttgttcaa

SEQ ID NO: 6665031 - DNA, 19 bp, Homo sapiens
atcttaaaagctatcttca

SEQ ID NO: 6665032 - DNA, 20 bp, Homo sapiens
atcttaaaagctatcttcat

SEQ ID NO: 6665033 - DNA, 22 bp, Homo sapiens
atcttaaaagtgtgtaaatgct

SEQ ID NO: 6665034 - DNA, 10 bp, Homo sapiens
atcttaaaat

SEQ ID NO: 6665035 - DNA, 13 bp, Homo sapiens
atcttaaaataat

SEQ ID NO: 6665036 - DNA, 22 bp, Homo sapiens
atcttaaaattggttaatgaaa

SEQ ID NO: 6665037 - DNA, 15 bp, Homo sapiens
atcttaaacaatgta

SEQ ID NO: 6665038 - DNA, 17 bp, Homo sapiens
atcttaaacaatgtata

SEQ ID NO: 6665039 - DNA, 18 bp, Homo sapiens
atcttaaacaatgtataa

SEQ ID NO: 6665040 - DNA, 22 bp, Homo sapiens
atcttaaacataataaatcaca

SEQ ID NO: 6665041 - DNA, 16 bp, Homo sapiens
atcttaaactaatacg

SEQ ID NO: 6665042 - DNA, 17 bp, Homo sapiens
atcttaaactaatacgt

SEQ ID NO: 6665043 - DNA, 23 bp, Homo sapiens
atcttaaactcttgaatatgtgc

SEQ ID NO: 6665044 - DNA, 21 bp, Homo sapiens
atcttaaagaaacagctttca

SEQ ID NO: 6665045 - DNA, 23 bp, Homo sapiens
atcttaaagaaacagctttcaag

SEQ ID NO: 6665046 - DNA, 19 bp, Homo sapiens
atcttaaagacaaattttg

SEQ ID NO: 6665047 - DNA, 19 bp, Homo sapiens
atcttaaagtttcatgtga

SEQ ID NO: 6665048 - DNA, 14 bp, Homo sapiens
atcttaaatcagaa

SEQ ID NO: 6665049 - DNA, 17 bp, Homo sapiens
atcttaaatcagaataa

SEQ ID NO: 6665050 - DNA, 18 bp, Homo sapiens
atcttaaatcagaataaa

SEQ ID NO: 6665051 - DNA, 18 bp, Homo sapiens
atcttaagagaatccaca

SEQ ID NO: 6665052 - DNA, 20 bp, Homo sapiens
atcttaagagaatccacata

SEQ ID NO: 6665053 - DNA, 22 bp, Homo sapiens
atcttaagagaatccacataaa

SEQ ID NO: 6665054 - DNA, 12 bp, Homo sapiens
atcttaagcagg

SEQ ID NO: 6665055 - DNA, 15 bp, Homo sapiens
atcttaagcagtaat

SEQ ID NO: 6665056 - DNA, 12 bp, Homo sapiens
atcttaaggtct

SEQ ID NO: 6665057 - DNA, 18 bp, Homo sapiens
atcttaaggtctaactgt

SEQ ID NO: 6665058 - DNA, 13 bp, Homo sapiens
atcttaatactgt

SEQ ID NO: 6665059 - DNA, 20 bp, Homo sapiens
atcttaatactgttattctt

SEQ ID NO: 6665060 - DNA, 20 bp, Homo sapiens
atcttaatatatacattttt

SEQ ID NO: 6665061 - DNA, 14 bp, Homo sapiens
atcttaatatattt

SEQ ID NO: 6665062 - DNA, 16 bp, Homo sapiens
atcttaatatatttga

SEQ ID NO: 6665063 - DNA, 18 bp, Homo sapiens
atcttaatcattatcctt

SEQ ID NO: 6665064 - DNA, 12 bp, Homo sapiens
atcttaatcttt

SEQ ID NO: 6665065 - DNA, 13 bp, Homo sapiens
atcttaatcttta

SEQ ID NO: 6665066 - DNA, 13 bp, Homo sapiens
atcttaatgtctg

SEQ ID NO: 6665067 - DNA, 15 bp, Homo sapiens
atcttaatgtctggt

SEQ ID NO: 6665068 - DNA, 19 bp, Homo sapiens
atcttaatgtctggtgttt

SEQ ID NO: 6665069 - DNA, 22 bp, Homo sapiens
atcttaattaagctccttcagt

SEQ ID NO: 6665070 - DNA, 19 bp, Homo sapiens
atcttaattttggttgtat

SEQ ID NO: 6665071 - DNA, 22 bp, Homo sapiens
atcttaattttggttgtattct

SEQ ID NO: 6665072 - DNA, 23 bp, Homo sapiens
atcttaattttggttgtattctt

SEQ ID NO: 6665073 - DNA, 15 bp, Homo sapiens
atcttacaaaatcct

SEQ ID NO: 6665074 - DNA, 22 bp, Homo sapiens
atcttacaacaggcttatgaat

SEQ ID NO: 6665075 - DNA, 16 bp, Homo sapiens
atcttacaactccccc

SEQ ID NO: 6665076 - DNA, 20 bp, Homo sapiens
atcttacaactcccccaccg

SEQ ID NO: 6665077 - DNA, 15 bp, Homo sapiens
atcttacaagatatt

SEQ ID NO: 6665078 - DNA, 13 bp, Homo sapiens
atcttacaagttt

SEQ ID NO: 6665079 - DNA, 18 bp, Homo sapiens
atcttacacgaagaaata

SEQ ID NO: 6665080 - DNA, 22 bp, Homo sapiens
atcttacacgaagaaatagaat

SEQ ID NO: 6665081 - DNA, 14 bp, Homo sapiens
atcttacagaaaat

SEQ ID NO: 6665082 - DNA, 12 bp, Homo sapiens
atcttacagcca

SEQ ID NO: 6665083 - DNA, 22 bp, Homo sapiens
atcttacaggtatcaggcacag

SEQ ID NO: 6665084 - DNA, 13 bp, Homo sapiens
atcttacatctgc

SEQ ID NO: 6665085 - DNA, 15 bp, Homo sapiens
atcttaccagatgct

SEQ ID NO: 6665086 - DNA, 18 bp, Homo sapiens
atcttaccaggttcactt

SEQ ID NO: 6665087 - DNA, 19 bp, Homo sapiens
atcttaccaggttcactta

SEQ ID NO: 6665088 - DNA, 22 bp, Homo sapiens
atcttacccttcaatgttaaat

SEQ ID NO: 6665089 - DNA, 16 bp, Homo sapiens
atcttacctctcatgc

SEQ ID NO: 6665090 - DNA, 18 bp, Homo sapiens
atcttacctgtaaagtct

SEQ ID NO: 6665091 - DNA, 15 bp, Homo sapiens
atcttacttggcttt

SEQ ID NO: 6665092 - DNA, 18 bp, Homo sapiens
atcttacttgtcctttga

SEQ ID NO: 6665093 - DNA, 13 bp, Homo sapiens
atcttactttgta

SEQ ID NO: 6665094 - DNA, 16 bp, Homo sapiens
atcttactttgtaaat

SEQ ID NO: 6665095 - DNA, 17 bp, Homo sapiens
atcttactttgtaaatt

SEQ ID NO: 6665096 - DNA, 19 bp, Homo sapiens
atcttactttgtaaattct

SEQ ID NO: 6665097 - DNA, 22 bp, Homo sapiens
atcttactttgtaaattctgat

SEQ ID NO: 6665098 - DNA, 12 bp, Homo sapiens
atcttagagaca

SEQ ID NO: 6665099 - DNA, 22 bp, Homo sapiens
atcttagaggcttgatgatgat

SEQ ID NO: 6665100 - DNA, 19 bp, Homo sapiens
atcttagaggggtattctt

SEQ ID NO: 6665101 - DNA, 22 bp, Homo sapiens
atcttagagtttacagtttgtg

SEQ ID NO: 6665102 - DNA, 11 bp, Homo sapiens
atcttagcatg

SEQ ID NO: 6665103 - DNA, 16 bp, Homo sapiens
atcttagctttccaca

SEQ ID NO: 6665104 - DNA, 20 bp, Homo sapiens
atcttagcttttaatagtgt

SEQ ID NO: 6665105 - DNA, 17 bp, Homo sapiens
atcttaggcacttttta

SEQ ID NO: 6665106 - DNA, 24 bp, Homo sapiens
atcttaggcactttttaacattct

SEQ ID NO: 6665107 - DNA, 17 bp, Homo sapiens
atcttaggcatgtgctg

SEQ ID NO: 6665108 - DNA, 15 bp, Homo sapiens
atcttagggaacttt

SEQ ID NO: 6665109 - DNA, 14 bp, Homo sapiens
atcttagtgtatga

SEQ ID NO: 6665110 - DNA, 18 bp, Homo sapiens
atcttagttacatttcta

SEQ ID NO: 6665111 - DNA, 23 bp, Homo sapiens
atcttagttgatgctacaaaaca

SEQ ID NO: 6665112 - DNA, 16 bp, Homo sapiens
atcttagtttactgga

SEQ ID NO: 6665113 - DNA, 23 bp, Homo sapiens
atcttagtttggattcttatgta

SEQ ID NO: 6665114 - DNA, 14 bp, Homo sapiens
atcttataattgtt

SEQ ID NO: 6665115 - DNA, 22 bp, Homo sapiens
atcttataatttaaaatatgct

SEQ ID NO: 6665116 - DNA, 14 bp, Homo sapiens
atcttatacaacag

SEQ ID NO: 6665117 - DNA, 14 bp, Homo sapiens
atcttatactgaaa

SEQ ID NO: 6665118 - DNA, 16 bp, Homo sapiens
atcttatactgaaaaa

SEQ ID NO: 6665119 - DNA, 15 bp, Homo sapiens
atcttatatgggaaa

SEQ ID NO: 6665120 - DNA, 20 bp, Homo sapiens
atcttatattggtttgcaca

SEQ ID NO: 6665121 - DNA, 20 bp, Homo sapiens
atcttatctactgactgaaa

SEQ ID NO: 6665122 - DNA, 20 bp, Homo sapiens
atcttatgcttaaaatgcca

SEQ ID NO: 6665123 - DNA, 17 bp, Homo sapiens
atcttatgttaaaggag

SEQ ID NO: 6665124 - DNA, 15 bp, Homo sapiens
atcttattaaagttt

SEQ ID NO: 6665125 - DNA, 16 bp, Homo sapiens
atcttattaaagtttc

SEQ ID NO: 6665126 - DNA, 21 bp, Homo sapiens
atcttattagggagaaaattc

SEQ ID NO: 6665127 - DNA, 22 bp, Homo sapiens
atcttattagggagaaaattca

SEQ ID NO: 6665128 - DNA, 18 bp, Homo sapiens
atcttattcctcagtgag

SEQ ID NO: 6665129 - DNA, 19 bp, Homo sapiens
atcttatttggaattgaca

SEQ ID NO: 6665130 - DNA, 16 bp, Homo sapiens
atcttattttctcaat

SEQ ID NO: 6665131 - DNA, 17 bp, Homo sapiens
atcttatttttcctgtc

SEQ ID NO: 6665132 - DNA, 21 bp, Homo sapiens
atcttatttttcctgtcctgc

SEQ ID NO: 6665133 - DNA, 15 bp, Homo sapiens
atcttatttttctaa

SEQ ID NO: 6665134 - DNA, 14 bp, Homo sapiens
atcttcaaaaatac

SEQ ID NO: 6665135 - DNA, 18 bp, Homo sapiens
atcttcaaaaatacagaa

SEQ ID NO: 6665136 - DNA, 19 bp, Homo sapiens
atcttcaaaaatacagaat

SEQ ID NO: 6665137 - DNA, 17 bp, Homo sapiens
atcttcaaaagtaatgc

SEQ ID NO: 6665138 - DNA, 22 bp, Homo sapiens
atcttcaaaagtaatgcctctg

SEQ ID NO: 6665139 - DNA, 23 bp, Homo sapiens
atcttcaaaagtaatgcctctgt

SEQ ID NO: 6665140 - DNA, 15 bp, Homo sapiens
atcttcaaagccttc

SEQ ID NO: 6665141 - DNA, 20 bp, Homo sapiens
atcttcaaagtttttactag

SEQ ID NO: 6665142 - DNA, 19 bp, Homo sapiens
atcttcaaggtgtaaaata

SEQ ID NO: 6665143 - DNA, 18 bp, Homo sapiens
atcttcaatttggatatt

SEQ ID NO: 6665144 - DNA, 23 bp, Homo sapiens
atcttcacaatatccaatgaaga

SEQ ID NO: 6665145 - DNA, 21 bp, Homo sapiens
atcttcacaatggtgctcatt

SEQ ID NO: 6665146 - DNA, 12 bp, Homo sapiens
atcttcacatag

SEQ ID NO: 6665147 - DNA, 18 bp, Homo sapiens
atcttcacctcagagtgg

SEQ ID NO: 6665148 - DNA, 15 bp, Homo sapiens
atcttcacgcctggg

SEQ ID NO: 6665149 - DNA, 17 bp, Homo sapiens
atcttcactagaagccg

SEQ ID NO: 6665150 - DNA, 22 bp, Homo sapiens
atcttcactgcaattttgtgta

SEQ ID NO: 6665151 - DNA, 23 bp, Homo sapiens
atcttcacttctaaatgcatatc

SEQ ID NO: 6665152 - DNA, 11 bp, Homo sapiens
atcttcacttt

SEQ ID NO: 6665153 - DNA, 17 bp, Homo sapiens
atcttcagaactgccct

SEQ ID NO: 6665154 - DNA, 19 bp, Homo sapiens
atcttcagaactgcccttg

SEQ ID NO: 6665155 - DNA, 22 bp, Homo sapiens
atcttcagaggtgctaaattgt

SEQ ID NO: 6665156 - DNA, 14 bp, Homo sapiens
atcttcagctccca

SEQ ID NO: 6665157 - DNA, 15 bp, Homo sapiens
atcttcagctcccat

SEQ ID NO: 6665158 - DNA, 18 bp, Homo sapiens
atcttcagctcccatagc

SEQ ID NO: 6665159 - DNA, 12 bp, Homo sapiens
atcttcagcttc

SEQ ID NO: 6665160 - DNA, 14 bp, Homo sapiens
atcttcagttgtct

SEQ ID NO: 6665161 - DNA, 19 bp, Homo sapiens
atcttcagttgtctctgat

SEQ ID NO: 6665162 - DNA, 17 bp, Homo sapiens
atcttcagtttaatgca

SEQ ID NO: 6665163 - DNA, 17 bp, Homo sapiens
atcttcagtttctgaag

SEQ ID NO: 6665164 - DNA, 14 bp, Homo sapiens
atcttcagttttat

SEQ ID NO: 6665165 - DNA, 20 bp, Homo sapiens
atcttcagttttatctttaa

SEQ ID NO: 6665166 - DNA, 21 bp, Homo sapiens
atcttcatcccaacagcccag

SEQ ID NO: 6665167 - DNA, 14 bp, Homo sapiens
atcttcatgatgtg

SEQ ID NO: 6665168 - DNA, 22 bp, Homo sapiens
atcttcatggaattcacaaagt

SEQ ID NO: 6665169 - DNA, 21 bp, Homo sapiens
atcttccaaatattagccaaa

SEQ ID NO: 6665170 - DNA, 17 bp, Homo sapiens
atcttccatatccgggt

SEQ ID NO: 6665171 - DNA, 14 bp, Homo sapiens
atcttccatatttg

SEQ ID NO: 6665172 - DNA, 16 bp, Homo sapiens
atcttccatatttgga

SEQ ID NO: 6665173 - DNA, 11 bp, Homo sapiens
atcttcccagc

SEQ ID NO: 6665174 - DNA, 22 bp, Homo sapiens
atcttcccataataaagcaatc

SEQ ID NO: 6665175 - DNA, 22 bp, Homo sapiens
atcttccctagagggttcctgt

SEQ ID NO: 6665176 - DNA, 11 bp, Homo sapiens
atcttccctgc

SEQ ID NO: 6665177 - DNA, 12 bp, Homo sapiens
atcttccctgcc

SEQ ID NO: 6665178 - DNA, 23 bp, Homo sapiens
atcttccctttcctcccttctga

SEQ ID NO: 6665179 - DNA, 21 bp, Homo sapiens
atcttcctagtgggccacccc

SEQ ID NO: 6665180 - DNA, 19 bp, Homo sapiens
atcttcctcatcagtagat

SEQ ID NO: 6665181 - DNA, 14 bp, Homo sapiens
atcttcctctgcta

SEQ ID NO: 6665182 - DNA, 23 bp, Homo sapiens
atcttcctgcctactggatgctt

SEQ ID NO: 6665183 - DNA, 13 bp, Homo sapiens
atcttcctgctga

SEQ ID NO: 6665184 - DNA, 16 bp, Homo sapiens
atcttccttgtgagga

SEQ ID NO: 6665185 - DNA, 21 bp, Homo sapiens
atcttcctttggggaagttta

SEQ ID NO: 6665186 - DNA, 23 bp, Homo sapiens
atcttcctttggggaagtttatt

SEQ ID NO: 6665187 - DNA, 14 bp, Homo sapiens
atcttcgtcctgcc

SEQ ID NO: 6665188 - DNA, 16 bp, Homo sapiens
atcttcgtcctgcccc

SEQ ID NO: 6665189 - DNA, 14 bp, Homo sapiens
atcttcgtcttcac

SEQ ID NO: 6665190 - DNA, 16 bp, Homo sapiens
atcttcgtcttcactc

SEQ ID NO: 6665191 - DNA, 22 bp, Homo sapiens
atcttcgtcttcactcttaggc

SEQ ID NO: 6665192 - DNA, 22 bp, Homo sapiens
atcttcgttagtaatctgtata

SEQ ID NO: 6665193 - DNA, 18 bp, Homo sapiens
atcttcgttcttgttagt

SEQ ID NO: 6665194 - DNA, 21 bp, Homo sapiens
atcttctaaacccaatccaaa

SEQ ID NO: 6665195 - DNA, 13 bp, Homo sapiens
atcttctactttt

SEQ ID NO: 6665196 - DNA, 18 bp, Homo sapiens
atcttctatcattccaat

SEQ ID NO: 6665197 - DNA, 19 bp, Homo sapiens
atcttctatttttatcatg

SEQ ID NO: 6665198 - DNA, 16 bp, Homo sapiens
atcttctcaagttcta

SEQ ID NO: 6665199 - DNA, 13 bp, Homo sapiens
atcttctcagctc

SEQ ID NO: 6665200 - DNA, 21 bp, Homo sapiens
atcttctcagctcccatttct

SEQ ID NO: 6665201 - DNA, 15 bp, Homo sapiens
atcttctccaggatg

SEQ ID NO: 6665202 - DNA, 15 bp, Homo sapiens
atcttctccatctgg

SEQ ID NO: 6665203 - DNA, 19 bp, Homo sapiens
atcttctccatctggcagg

SEQ ID NO: 6665204 - DNA, 21 bp, Homo sapiens
atcttctcccttgtcctgctt

SEQ ID NO: 6665205 - DNA, 22 bp, Homo sapiens
atcttctctatatttttatttc

SEQ ID NO: 6665206 - DNA, 15 bp, Homo sapiens
atcttctctcttgat

SEQ ID NO: 6665207 - DNA, 16 bp, Homo sapiens
atcttctctcttgatt

SEQ ID NO: 6665208 - DNA, 17 bp, Homo sapiens
atcttctctttttccag

SEQ ID NO: 6665209 - DNA, 18 bp, Homo sapiens
atcttctgcagacactgt

SEQ ID NO: 6665210 - DNA, 21 bp, Homo sapiens
atcttctgccttagtctcagt

SEQ ID NO: 6665211 - DNA, 23 bp, Homo sapiens
atcttctgctaaatttttgttgg

SEQ ID NO: 6665212 - DNA, 15 bp, Homo sapiens
atcttctggaatatt

SEQ ID NO: 6665213 - DNA, 18 bp, Homo sapiens
atcttctggagtctccag

SEQ ID NO: 6665214 - DNA, 12 bp, Homo sapiens
atcttctggctt

SEQ ID NO: 6665215 - DNA, 13 bp, Homo sapiens
atcttctggtgca

SEQ ID NO: 6665216 - DNA, 20 bp, Homo sapiens
atcttctggtgcatgttctt

SEQ ID NO: 6665217 - DNA, 21 bp, Homo sapiens
atcttctggtgcatgttcttt

SEQ ID NO: 6665218 - DNA, 16 bp, Homo sapiens
atcttctgtgaaatat

SEQ ID NO: 6665219 - DNA, 19 bp, Homo sapiens
atcttctgtgaaatataat

SEQ ID NO: 6665220 - DNA, 11 bp, Homo sapiens
atcttctgttt

SEQ ID NO: 6665221 - DNA, 22 bp, Homo sapiens
atcttctgtttttctcaaataa

SEQ ID NO: 6665222 - DNA, 21 bp, Homo sapiens
atcttcttaaaccaggaaaaa

SEQ ID NO: 6665223 - DNA, 20 bp, Homo sapiens
atcttcttatgcaatttcct

SEQ ID NO: 6665224 - DNA, 14 bp, Homo sapiens
atcttcttcccagt

SEQ ID NO: 6665225 - DNA, 14 bp, Homo sapiens
atcttctttataac

SEQ ID NO: 6665226 - DNA, 17 bp, Homo sapiens
atcttctttataattct

SEQ ID NO: 6665227 - DNA, 16 bp, Homo sapiens
atcttctttattattc

SEQ ID NO: 6665228 - DNA, 18 bp, Homo sapiens
atcttctttattattcct

SEQ ID NO: 6665229 - DNA, 21 bp, Homo sapiens
atcttctttattattcctagt

SEQ ID NO: 6665230 - DNA, 12 bp, Homo sapiens
atcttctttctt

SEQ ID NO: 6665231 - DNA, 15 bp, Homo sapiens
atcttctttcttcca

SEQ ID NO: 6665232 - DNA, 19 bp, Homo sapiens
atcttctttggaaataaaa

SEQ ID NO: 6665233 - DNA, 19 bp, Homo sapiens
atcttgaaaatattgaaga

SEQ ID NO: 6665234 - DNA, 15 bp, Homo sapiens
atcttgaaaatgcca

SEQ ID NO: 6665235 - DNA, 19 bp, Homo sapiens
atcttgaaagcgaaatact

SEQ ID NO: 6665236 - DNA, 12 bp, Homo sapiens
atcttgaaatta

SEQ ID NO: 6665237 - DNA, 17 bp, Homo sapiens
atcttgaagacttttct

SEQ ID NO: 6665238 - DNA, 12 bp, Homo sapiens
atcttgaaggaa

SEQ ID NO: 6665239 - DNA, 14 bp, Homo sapiens
atcttgaagggccc

SEQ ID NO: 6665240 - DNA, 16 bp, Homo sapiens
atcttgaagggcccag

SEQ ID NO: 6665241 - DNA, 11 bp, Homo sapiens
atcttgaagtc

SEQ ID NO: 6665242 - DNA, 16 bp, Homo sapiens
atcttgaagtcagcca

SEQ ID NO: 6665243 - DNA, 18 bp, Homo sapiens
atcttgaataatgtaaga

SEQ ID NO: 6665244 - DNA, 19 bp, Homo sapiens
atcttgaatactctgccct

SEQ ID NO: 6665245 - DNA, 18 bp, Homo sapiens
atcttgaatagcttatgt

SEQ ID NO: 6665246 - DNA, 14 bp, Homo sapiens
atcttgaatatttg

SEQ ID NO: 6665247 - DNA, 13 bp, Homo sapiens
atcttgaatgtgg

SEQ ID NO: 6665248 - DNA, 20 bp, Homo sapiens
atcttgaatgtggtctcagg

SEQ ID NO: 6665249 - DNA, 16 bp, Homo sapiens
atcttgaattgtaact

SEQ ID NO: 6665250 - DNA, 17 bp, Homo sapiens
atcttgaattgtaagga

SEQ ID NO: 6665251 - DNA, 18 bp, Homo sapiens
atcttgaattgtaaggaa

SEQ ID NO: 6665252 - DNA, 21 bp, Homo sapiens
atcttgacacggtgaaatcca

SEQ ID NO: 6665253 - DNA, 22 bp, Homo sapiens
atcttgacacggtgaaatccag

SEQ ID NO: 6665254 - DNA, 14 bp, Homo sapiens
atcttgacagagcc

SEQ ID NO: 6665255 - DNA, 17 bp, Homo sapiens
atcttgacattcaaggc

SEQ ID NO: 6665256 - DNA, 23 bp, Homo sapiens
atcttgaccaagcaggaagctca

SEQ ID NO: 6665257 - DNA, 23 bp, Homo sapiens
atcttgactttctgattggtgat

SEQ ID NO: 6665258 - DNA, 13 bp, Homo sapiens
atcttgagagctg

SEQ ID NO: 6665259 - DNA, 23 bp, Homo sapiens
atcttgagccacagtcactggat

SEQ ID NO: 6665260 - DNA, 22 bp, Homo sapiens
atcttgaggaataaatgccttt

SEQ ID NO: 6665261 - DNA, 16 bp, Homo sapiens
atcttgaggtggtagt

SEQ ID NO: 6665262 - DNA, 22 bp, Homo sapiens
atcttgaggtggtagtaaaaca

SEQ ID NO: 6665263 - DNA, 19 bp, Homo sapiens
atcttgagtataagaaatg

SEQ ID NO: 6665264 - DNA, 14 bp, Homo sapiens
atcttgagtgttat

SEQ ID NO: 6665265 - DNA, 15 bp, Homo sapiens
atcttgatacattca

SEQ ID NO: 6665266 - DNA, 16 bp, Homo sapiens
atcttgatacattcaa

SEQ ID NO: 6665267 - DNA, 18 bp, Homo sapiens
atcttgatagctaaataa

SEQ ID NO: 6665268 - DNA, 21 bp, Homo sapiens
atcttgatctgctcagccctg

SEQ ID NO: 6665269 - DNA, 12 bp, Homo sapiens
atcttgatcttt

SEQ ID NO: 6665270 - DNA, 13 bp, Homo sapiens
atcttgatgttta

SEQ ID NO: 6665271 - DNA, 15 bp, Homo sapiens
atcttgatgtttaga

SEQ ID NO: 6665272 - DNA, 11 bp, Homo sapiens
atcttgattaa

SEQ ID NO: 6665273 - DNA, 19 bp, Homo sapiens
atcttgattaatgtacttt

SEQ ID NO: 6665274 - DNA, 20 bp, Homo sapiens
atcttgatttcccaaaaaca

SEQ ID NO: 6665275 - DNA, 22 bp, Homo sapiens
atcttgcagaagttcttagtgt

SEQ ID NO: 6665276 - DNA, 19 bp, Homo sapiens
atcttgcagcatttactat

SEQ ID NO: 6665277 - DNA, 22 bp, Homo sapiens
atcttgcagtatcggcactgta

SEQ ID NO: 6665278 - DNA, 24 bp, Homo sapiens
atcttgcagtatcggcactgtaca

SEQ ID NO: 6665279 - DNA, 20 bp, Homo sapiens
atcttgcatggcattaattg

SEQ ID NO: 6665280 - DNA, 13 bp, Homo sapiens
atcttgcatgtaa

SEQ ID NO: 6665281 - DNA, 18 bp, Homo sapiens
atcttgcattatgcaatt

SEQ ID NO: 6665282 - DNA, 15 bp, Homo sapiens
atcttgcattcattt

SEQ ID NO: 6665283 - DNA, 12 bp, Homo sapiens
atcttgcccact

SEQ ID NO: 6665284 - DNA, 21 bp, Homo sapiens
atcttgcccctccagagacag

SEQ ID NO: 6665285 - DNA, 19 bp, Homo sapiens
atcttgcccgctcaggctg

SEQ ID NO: 6665286 - DNA, 12 bp, Homo sapiens
atcttgcctcat

SEQ ID NO: 6665287 - DNA, 15 bp, Homo sapiens
atcttgccttctggt

SEQ ID NO: 6665288 - DNA, 17 bp, Homo sapiens
atcttgctctcttttat

SEQ ID NO: 6665289 - DNA, 13 bp, Homo sapiens
atcttgctctgct

SEQ ID NO: 6665290 - DNA, 14 bp, Homo sapiens
atcttgctctgctg

SEQ ID NO: 6665291 - DNA, 16 bp, Homo sapiens
atcttgctctgctgac

SEQ ID NO: 6665292 - DNA, 16 bp, Homo sapiens
atcttgctctgtaatc

SEQ ID NO: 6665293 - DNA, 19 bp, Homo sapiens
atcttgctggcagggcctg

SEQ ID NO: 6665294 - DNA, 17 bp, Homo sapiens
atcttgcttcattgtta

SEQ ID NO: 6665295 - DNA, 15 bp, Homo sapiens
atcttgcttccctaa

SEQ ID NO: 6665296 - DNA, 16 bp, Homo sapiens
atcttgctttggagga

SEQ ID NO: 6665297 - DNA, 22 bp, Homo sapiens
atcttgctttgtgtatctcatt

SEQ ID NO: 6665298 - DNA, 16 bp, Homo sapiens
atcttggacaaatcac

SEQ ID NO: 6665299 - DNA, 22 bp, Homo sapiens
atcttggacaaatcacatattt

SEQ ID NO: 6665300 - DNA, 17 bp, Homo sapiens
atcttggagctgcttgg

SEQ ID NO: 6665301 - DNA, 21 bp, Homo sapiens
atcttggagctttttcaaaag

SEQ ID NO: 6665302 - DNA, 19 bp, Homo sapiens
atcttggcaggtaggaata

SEQ ID NO: 6665303 - DNA, 20 bp, Homo sapiens
atcttggccctcctcagctc

SEQ ID NO: 6665304 - DNA, 16 bp, Homo sapiens
atcttggcctcccaga

SEQ ID NO: 6665305 - DNA, 16 bp, Homo sapiens
atcttggctcactgca

SEQ ID NO: 6665306 - DNA, 17 bp, Homo sapiens
atcttggctgttctaga

SEQ ID NO: 6665307 - DNA, 17 bp, Homo sapiens
atcttggcttaatttaa

SEQ ID NO: 6665308 - DNA, 22 bp, Homo sapiens
atcttggcttcttaaaaactgt

SEQ ID NO: 6665309 - DNA, 13 bp, Homo sapiens
atcttgggactgg

SEQ ID NO: 6665310 - DNA, 18 bp, Homo sapiens
atcttgggactgggtttg

SEQ ID NO: 6665311 - DNA, 23 bp, Homo sapiens
atcttgggattcctcccctggaa

SEQ ID NO: 6665312 - DNA, 20 bp, Homo sapiens
atcttggggctgatgaagaa

SEQ ID NO: 6665313 - DNA, 22 bp, Homo sapiens
atcttgggtgtattctctgtaa

SEQ ID NO: 6665314 - DNA, 12 bp, Homo sapiens
atcttggtaaat

SEQ ID NO: 6665315 - DNA, 22 bp, Homo sapiens
atcttggtactactagatgtct

SEQ ID NO: 6665316 - DNA, 19 bp, Homo sapiens
atcttggtagttctgtgcc

SEQ ID NO: 6665317 - DNA, 20 bp, Homo sapiens
atcttggtcagatttgaact

SEQ ID NO: 6665318 - DNA, 23 bp, Homo sapiens
atcttggtccaggaaatgtgcac

SEQ ID NO: 6665319 - DNA, 21 bp, Homo sapiens
atcttggtcctgtcaccctgg

SEQ ID NO: 6665320 - DNA, 14 bp, Homo sapiens
atcttggtgtaact

SEQ ID NO: 6665321 - DNA, 15 bp, Homo sapiens
atcttggtgtgttaa

SEQ ID NO: 6665322 - DNA, 21 bp, Homo sapiens
atcttggtttgccttccagaa

SEQ ID NO: 6665323 - DNA, 15 bp, Homo sapiens
atcttgtaaaaatag

SEQ ID NO: 6665324 - DNA, 12 bp, Homo sapiens
atcttgtaaata

SEQ ID NO: 6665325 - DNA, 21 bp, Homo sapiens
atcttgtaaatattgttttgc

SEQ ID NO: 6665326 - DNA, 19 bp, Homo sapiens
atcttgtacaaactttgtt

SEQ ID NO: 6665327 - DNA, 14 bp, Homo sapiens
atcttgtagacact

SEQ ID NO: 6665328 - DNA, 13 bp, Homo sapiens
atcttgtcaagaa

SEQ ID NO: 6665329 - DNA, 14 bp, Homo sapiens
atcttgtcatgtgt

SEQ ID NO: 6665330 - DNA, 16 bp, Homo sapiens
atcttgtccaagttgt

SEQ ID NO: 6665331 - DNA, 15 bp, Homo sapiens
atcttgtccacagtc

SEQ ID NO: 6665332 - DNA, 20 bp, Homo sapiens
atcttgtccacagtctccca

SEQ ID NO: 6665333 - DNA, 21 bp, Homo sapiens
atcttgtccacagtctcccat

SEQ ID NO: 6665334 - DNA, 14 bp, Homo sapiens
atcttgtccccaac

SEQ ID NO: 6665335 - DNA, 13 bp, Homo sapiens
atcttgtcctgga

SEQ ID NO: 6665336 - DNA, 15 bp, Homo sapiens
atcttgtctcaatgc

SEQ ID NO: 6665337 - DNA, 20 bp, Homo sapiens
atcttgtctcaatgctcata

SEQ ID NO: 6665338 - DNA, 18 bp, Homo sapiens
atcttgtgaaaataattg

SEQ ID NO: 6665339 - DNA, 15 bp, Homo sapiens
atcttgtgaaatggc

SEQ ID NO: 6665340 - DNA, 22 bp, Homo sapiens
atcttgtgagtggataatcagg

SEQ ID NO: 6665341 - DNA, 14 bp, Homo sapiens
atcttgtgcatgca

SEQ ID NO: 6665342 - DNA, 16 bp, Homo sapiens
atcttgtgcatgcaaa

SEQ ID NO: 6665343 - DNA, 19 bp, Homo sapiens
atcttgtgctagaatactt

SEQ ID NO: 6665344 - DNA, 15 bp, Homo sapiens
atcttgtgctatgaa

SEQ ID NO: 6665345 - DNA, 23 bp, Homo sapiens
atcttgtgctatgaaacaatctt

SEQ ID NO: 6665346 - DNA, 14 bp, Homo sapiens
atcttgtgcttctt

SEQ ID NO: 6665347 - DNA, 14 bp, Homo sapiens
atcttgtggggcca

SEQ ID NO: 6665348 - DNA, 18 bp, Homo sapiens
atcttgtgtgattaactt

SEQ ID NO: 6665349 - DNA, 16 bp, Homo sapiens
atcttgtgttgtcctt

SEQ ID NO: 6665350 - DNA, 16 bp, Homo sapiens
atcttgttactgctga

SEQ ID NO: 6665351 - DNA, 20 bp, Homo sapiens
atcttgttactgctgattct

SEQ ID NO: 6665352 - DNA, 15 bp, Homo sapiens
atcttgttactgtga

SEQ ID NO: 6665353 - DNA, 17 bp, Homo sapiens
atcttgttattattgtt

SEQ ID NO: 6665354 - DNA, 21 bp, Homo sapiens
atcttgttattattgttaata

SEQ ID NO: 6665355 - DNA, 19 bp, Homo sapiens
atcttgttcaaaatgcaga

SEQ ID NO: 6665356 - DNA, 14 bp, Homo sapiens
atcttgttcaggaa

SEQ ID NO: 6665357 - DNA, 15 bp, Homo sapiens
atcttgttcaggaaa

SEQ ID NO: 6665358 - DNA, 17 bp, Homo sapiens
atcttgttcaggaaaag

SEQ ID NO: 6665359 - DNA, 15 bp, Homo sapiens
atcttgttctttgct

SEQ ID NO: 6665360 - DNA, 18 bp, Homo sapiens
atcttgttggtacctttc

SEQ ID NO: 6665361 - DNA, 14 bp, Homo sapiens
atcttgtttcattt

SEQ ID NO: 6665362 - DNA, 19 bp, Homo sapiens
atcttgtttcatttgcttg

SEQ ID NO: 6665363 - DNA, 14 bp, Homo sapiens
atcttgtttccaaa

SEQ ID NO: 6665364 - DNA, 20 bp, Homo sapiens
atcttgtttgttactgtcat

SEQ ID NO: 6665365 - DNA, 22 bp, Homo sapiens
atcttgtttgttactgtcattc

SEQ ID NO: 6665366 - DNA, 15 bp, Homo sapiens
atcttgttttaagca

SEQ ID NO: 6665367 - DNA, 18 bp, Homo sapiens
atcttgttttaagcaaat

SEQ ID NO: 6665368 - DNA, 20 bp, Homo sapiens
atctttaaaaagcagtcctc

SEQ ID NO: 6665369 - DNA, 21 bp, Homo sapiens
atctttaaaagatgcttttaa

SEQ ID NO: 6665370 - DNA, 15 bp, Homo sapiens
atctttaaaatacac

SEQ ID NO: 6665371 - DNA, 12 bp, Homo sapiens
atctttaaagac

SEQ ID NO: 6665372 - DNA, 21 bp, Homo sapiens
atctttaaagacttgatgaat

SEQ ID NO: 6665373 - DNA, 15 bp, Homo sapiens
atctttaaatacagt

SEQ ID NO: 6665374 - DNA, 12 bp, Homo sapiens
atctttaaatag

SEQ ID NO: 6665375 - DNA, 16 bp, Homo sapiens
atctttaaatgatgta

SEQ ID NO: 6665376 - DNA, 18 bp, Homo sapiens
atctttaacatagtcctg

SEQ ID NO: 6665377 - DNA, 16 bp, Homo sapiens
atctttaagaatgctt

SEQ ID NO: 6665378 - DNA, 17 bp, Homo sapiens
atctttaagcagagaag

SEQ ID NO: 6665379 - DNA, 20 bp, Homo sapiens
atctttaatcaatgtgacat

SEQ ID NO: 6665380 - DNA, 17 bp, Homo sapiens
atctttaattccttatc

SEQ ID NO: 6665381 - DNA, 14 bp, Homo sapiens
atctttaattgtat

SEQ ID NO: 6665382 - DNA, 22 bp, Homo sapiens
atctttaattttacatttccta

SEQ ID NO: 6665383 - DNA, 13 bp, Homo sapiens
atctttacatcta

SEQ ID NO: 6665384 - DNA, 18 bp, Homo sapiens
atctttaccaaaaaccat

SEQ ID NO: 6665385 - DNA, 16 bp, Homo sapiens
atctttacgtactgta

SEQ ID NO: 6665386 - DNA, 16 bp, Homo sapiens
atctttagatatttgc

SEQ ID NO: 6665387 - DNA, 14 bp, Homo sapiens
atctttagcagttt

SEQ ID NO: 6665388 - DNA, 19 bp, Homo sapiens
atctttagcagtttcctca

SEQ ID NO: 6665389 - DNA, 14 bp, Homo sapiens
atctttagcctggg

SEQ ID NO: 6665390 - DNA, 15 bp, Homo sapiens
atctttagtgctttc

SEQ ID NO: 6665391 - DNA, 16 bp, Homo sapiens
atctttagttgaattc

SEQ ID NO: 6665392 - DNA, 20 bp, Homo sapiens
atctttatactgggtttcaa

SEQ ID NO: 6665393 - DNA, 14 bp, Homo sapiens
atctttatacttaa

SEQ ID NO: 6665394 - DNA, 18 bp, Homo sapiens
atctttatacttaaacag

SEQ ID NO: 6665395 - DNA, 21 bp, Homo sapiens
atctttatagaaggaatttgt

SEQ ID NO: 6665396 - DNA, 13 bp, Homo sapiens
atctttatcatcg

SEQ ID NO: 6665397 - DNA, 22 bp, Homo sapiens
atctttatcattaaacatgaat

SEQ ID NO: 6665398 - DNA, 18 bp, Homo sapiens
atctttatcctaaaaatc

SEQ ID NO: 6665399 - DNA, 16 bp, Homo sapiens
atctttatctcctggg

SEQ ID NO: 6665400 - DNA, 18 bp, Homo sapiens
atctttatgcaaaaacat

SEQ ID NO: 6665401 - DNA, 11 bp, Homo sapiens
atctttatgct

SEQ ID NO: 6665402 - DNA, 14 bp, Homo sapiens
atctttatgctgta

SEQ ID NO: 6665403 - DNA, 18 bp, Homo sapiens
atctttatgctgtatttt

SEQ ID NO: 6665404 - DNA, 22 bp, Homo sapiens
atctttatgctgtattttaaca

SEQ ID NO: 6665405 - DNA, 15 bp, Homo sapiens
atctttattaaaaca

SEQ ID NO: 6665406 - DNA, 13 bp, Homo sapiens
atctttattgaaa

SEQ ID NO: 6665407 - DNA, 15 bp, Homo sapiens
atctttattgaaatt

SEQ ID NO: 6665408 - DNA, 19 bp, Homo sapiens
atctttattgaacttgaaa

SEQ ID NO: 6665409 - DNA, 23 bp, Homo sapiens
atctttattggcttgataaacat

SEQ ID NO: 6665410 - DNA, 18 bp, Homo sapiens
atctttattttattattc

SEQ ID NO: 6665411 - DNA, 21 bp, Homo sapiens
atctttcaacttatttctgaa

SEQ ID NO: 6665412 - DNA, 12 bp, Homo sapiens
atctttcaagtt

SEQ ID NO: 6665413 - DNA, 18 bp, Homo sapiens
atctttcaatatcattac

SEQ ID NO: 6665414 - DNA, 19 bp, Homo sapiens
atctttcaatatcattact

SEQ ID NO: 6665415 - DNA, 20 bp, Homo sapiens
atctttcacccacagaaaga

SEQ ID NO: 6665416 - DNA, 14 bp, Homo sapiens
atctttcagaaata

SEQ ID NO: 6665417 - DNA, 19 bp, Homo sapiens
atctttcagcactcagaaa

SEQ ID NO: 6665418 - DNA, 15 bp, Homo sapiens
atctttcagcctgct

SEQ ID NO: 6665419 - DNA, 13 bp, Homo sapiens
atctttcaggaaa

SEQ ID NO: 6665420 - DNA, 15 bp, Homo sapiens
atctttcatacatat

SEQ ID NO: 6665421 - DNA, 20 bp, Homo sapiens
atctttcatcaatcattgta

SEQ ID NO: 6665422 - DNA, 23 bp, Homo sapiens
atctttccaggcttccctgactt

SEQ ID NO: 6665423 - DNA, 19 bp, Homo sapiens
atctttccatctcattaca

SEQ ID NO: 6665424 - DNA, 23 bp, Homo sapiens
atctttccctcttcggtgttctt

SEQ ID NO: 6665425 - DNA, 16 bp, Homo sapiens
atctttcctcaagtat

SEQ ID NO: 6665426 - DNA, 18 bp, Homo sapiens
atctttcctttgctctgg

SEQ ID NO: 6665427 - DNA, 17 bp, Homo sapiens
atctttcgcacagcagt

SEQ ID NO: 6665428 - DNA, 18 bp, Homo sapiens
atctttcgcacagcagtt

SEQ ID NO: 6665429 - DNA, 14 bp, Homo sapiens
atctttctaaaact

SEQ ID NO: 6665430 - DNA, 19 bp, Homo sapiens
atctttctagcagcagatc

SEQ ID NO: 6665431 - DNA, 12 bp, Homo sapiens
atctttctcttc

SEQ ID NO: 6665432 - DNA, 14 bp, Homo sapiens
atctttctcttccc

SEQ ID NO: 6665433 - DNA, 15 bp, Homo sapiens
atctttctcttccca

SEQ ID NO: 6665434 - DNA, 14 bp, Homo sapiens
atctttctgcacac

SEQ ID NO: 6665435 - DNA, 12 bp, Homo sapiens
atctttctggaa

SEQ ID NO: 6665436 - DNA, 22 bp, Homo sapiens
atctttctggaattgatgttta

SEQ ID NO: 6665437 - DNA, 18 bp, Homo sapiens
atctttcttgatcaacat

SEQ ID NO: 6665438 - DNA, 20 bp, Homo sapiens
atctttctttacctgagacc

SEQ ID NO: 6665439 - DNA, 20 bp, Homo sapiens
atctttctttccaaaacatt

SEQ ID NO: 6665440 - DNA, 21 bp, Homo sapiens
atctttctttccatttacagt

SEQ ID NO: 6665441 - DNA, 21 bp, Homo sapiens
atctttctttcttagaaattt

SEQ ID NO: 6665442 - DNA, 14 bp, Homo sapiens
atctttctttcttc

SEQ ID NO: 6665443 - DNA, 15 bp, Homo sapiens
atctttctttcttcc

SEQ ID NO: 6665444 - DNA, 21 bp, Homo sapiens
atctttctttggggaaaaatt

SEQ ID NO: 6665445 - DNA, 20 bp, Homo sapiens
atctttctttttaagaaatt

SEQ ID NO: 6665446 - DNA, 17 bp, Homo sapiens
atctttgaaaactcata

SEQ ID NO: 6665447 - DNA, 12 bp, Homo sapiens
atctttgaaata

SEQ ID NO: 6665448 - DNA, 13 bp, Homo sapiens
atctttgaaataa

SEQ ID NO: 6665449 - DNA, 20 bp, Homo sapiens
atctttgaaattatgtaaat

SEQ ID NO: 6665450 - DNA, 19 bp, Homo sapiens
atctttgaatggtcttctg

SEQ ID NO: 6665451 - DNA, 17 bp, Homo sapiens
atctttgacaattctgg

SEQ ID NO: 6665452 - DNA, 17 bp, Homo sapiens
atctttgagaatattat

SEQ ID NO: 6665453 - DNA, 21 bp, Homo sapiens
atctttgagaccatccattct

SEQ ID NO: 6665454 - DNA, 12 bp, Homo sapiens
atctttgagccc

SEQ ID NO: 6665455 - DNA, 23 bp, Homo sapiens
atctttgagcccattcttctggg

SEQ ID NO: 6665456 - DNA, 14 bp, Homo sapiens
atctttgagtgtat

SEQ ID NO: 6665457 - DNA, 12 bp, Homo sapiens
atctttgatgtg

SEQ ID NO: 6665458 - DNA, 14 bp, Homo sapiens
atctttgatgtgtt

SEQ ID NO: 6665459 - DNA, 16 bp, Homo sapiens
atctttgatgtgttgt

SEQ ID NO: 6665460 - DNA, 19 bp, Homo sapiens
atctttgatgtgttgttct

SEQ ID NO: 6665461 - DNA, 16 bp, Homo sapiens
atctttgattctcctt

SEQ ID NO: 6665462 - DNA, 17 bp, Homo sapiens
atctttgattctccttc

SEQ ID NO: 6665463 - DNA, 18 bp, Homo sapiens
atctttgattctccttca

SEQ ID NO: 6665464 - DNA, 19 bp, Homo sapiens
atctttgattctccttcag

SEQ ID NO: 6665465 - DNA, 16 bp, Homo sapiens
atctttgcactccaat

SEQ ID NO: 6665466 - DNA, 16 bp, Homo sapiens
atctttgccaacatgg

SEQ ID NO: 6665467 - DNA, 17 bp, Homo sapiens
atctttgccaacatggt

SEQ ID NO: 6665468 - DNA, 23 bp, Homo sapiens
atctttgcctcaactccaggatt

SEQ ID NO: 6665469 - DNA, 13 bp, Homo sapiens
atctttgcctctc

SEQ ID NO: 6665470 - DNA, 13 bp, Homo sapiens
atctttgccttgg

SEQ ID NO: 6665471 - DNA, 14 bp, Homo sapiens
atctttgccttggg

SEQ ID NO: 6665472 - DNA, 17 bp, Homo sapiens
atctttgcgaaaagata

SEQ ID NO: 6665473 - DNA, 18 bp, Homo sapiens
atctttgcgaaaagataa

SEQ ID NO: 6665474 - DNA, 23 bp, Homo sapiens
atctttgcgaaaagataaacctg

SEQ ID NO: 6665475 - DNA, 22 bp, Homo sapiens
atctttgctactgaatgtgttt

SEQ ID NO: 6665476 - DNA, 16 bp, Homo sapiens
atctttgctgtatact

SEQ ID NO: 6665477 - DNA, 12 bp, Homo sapiens
atctttgctgtt

SEQ ID NO: 6665478 - DNA, 22 bp, Homo sapiens
atctttgggacacctcagaaaa

SEQ ID NO: 6665479 - DNA, 15 bp, Homo sapiens
atctttggggaaact

SEQ ID NO: 6665480 - DNA, 15 bp, Homo sapiens
atctttgtaccaaaa

SEQ ID NO: 6665481 - DNA, 17 bp, Homo sapiens
atctttgtaccaaaatt

SEQ ID NO: 6665482 - DNA, 19 bp, Homo sapiens
atctttgtaccaaaatttt

SEQ ID NO: 6665483 - DNA, 20 bp, Homo sapiens
atctttgtaccaaaatttta

SEQ ID NO: 6665484 - DNA, 13 bp, Homo sapiens
atctttgtcaaac

SEQ ID NO: 6665485 - DNA, 14 bp, Homo sapiens
atctttgtggccaa

SEQ ID NO: 6665486 - DNA, 16 bp, Homo sapiens
atctttgtggccaagg

SEQ ID NO: 6665487 - DNA, 18 bp, Homo sapiens
atctttgtgttgctttca

SEQ ID NO: 6665488 - DNA, 17 bp, Homo sapiens
atctttgttaaaatata

SEQ ID NO: 6665489 - DNA, 16 bp, Homo sapiens
atctttgttacttcct

SEQ ID NO: 6665490 - DNA, 16 bp, Homo sapiens
atctttgtttaaatgc

SEQ ID NO: 6665491 - DNA, 21 bp, Homo sapiens
atctttgtttaaatgccaaaa

SEQ ID NO: 6665492 - DNA, 18 bp, Homo sapiens
atctttgttttaaccagt

SEQ ID NO: 6665493 - DNA, 14 bp, Homo sapiens
atcttttaaaatca

SEQ ID NO: 6665494 - DNA, 13 bp, Homo sapiens
atcttttaaatac

SEQ ID NO: 6665495 - DNA, 19 bp, Homo sapiens
atcttttaaattgcaatat

SEQ ID NO: 6665496 - DNA, 14 bp, Homo sapiens
atcttttaatatgc

SEQ ID NO: 6665497 - DNA, 22 bp, Homo sapiens
atcttttacaactgcctcgaaa

SEQ ID NO: 6665498 - DNA, 11 bp, Homo sapiens
atcttttacat

SEQ ID NO: 6665499 - DNA, 21 bp, Homo sapiens
atcttttactcacattctgtt

SEQ ID NO: 6665500 - DNA, 14 bp, Homo sapiens
atcttttagagtaa

SEQ ID NO: 6665501 - DNA, 18 bp, Homo sapiens
atcttttagagtaaacta

SEQ ID NO: 6665502 - DNA, 19 bp, Homo sapiens
atcttttagagtaaactat

SEQ ID NO: 6665503 - DNA, 17 bp, Homo sapiens
atcttttagctagaatc

SEQ ID NO: 6665504 - DNA, 19 bp, Homo sapiens
atcttttagctagaatcca

SEQ ID NO: 6665505 - DNA, 16 bp, Homo sapiens
atcttttagtgtttac

SEQ ID NO: 6665506 - DNA, 17 bp, Homo sapiens
atcttttagtgtttact

SEQ ID NO: 6665507 - DNA, 24 bp, Homo sapiens
atcttttataatgtcttatgccta

SEQ ID NO: 6665508 - DNA, 15 bp, Homo sapiens
atcttttatgtttga

SEQ ID NO: 6665509 - DNA, 16 bp, Homo sapiens
atcttttatgtttgaa

SEQ ID NO: 6665510 - DNA, 16 bp, Homo sapiens
atcttttattttggaa

SEQ ID NO: 6665511 - DNA, 19 bp, Homo sapiens
atcttttcaaaggtacttg

SEQ ID NO: 6665512 - DNA, 20 bp, Homo sapiens
atcttttcaaggcatttgtc

SEQ ID NO: 6665513 - DNA, 16 bp, Homo sapiens
atcttttcacaaataa

SEQ ID NO: 6665514 - DNA, 17 bp, Homo sapiens
atcttttcacaaataaa

SEQ ID NO: 6665515 - DNA, 16 bp, Homo sapiens
atcttttcagccttgt

SEQ ID NO: 6665516 - DNA, 12 bp, Homo sapiens
atcttttcataa

SEQ ID NO: 6665517 - DNA, 18 bp, Homo sapiens
atcttttccacaaatatg

SEQ ID NO: 6665518 - DNA, 23 bp, Homo sapiens
atcttttcctcccattttagaaa

SEQ ID NO: 6665519 - DNA, 14 bp, Homo sapiens
atcttttccttcag

SEQ ID NO: 6665520 - DNA, 17 bp, Homo sapiens
atcttttctacagcaaa

SEQ ID NO: 6665521 - DNA, 19 bp, Homo sapiens
atcttttctagagacacat

SEQ ID NO: 6665522 - DNA, 13 bp, Homo sapiens
atcttttctattt

SEQ ID NO: 6665523 - DNA, 18 bp, Homo sapiens
atcttttctgaatcttct

SEQ ID NO: 6665524 - DNA, 15 bp, Homo sapiens
atcttttctgaggtt

SEQ ID NO: 6665525 - DNA, 13 bp, Homo sapiens
atcttttcttatt

SEQ ID NO: 6665526 - DNA, 12 bp, Homo sapiens
atcttttcttta

SEQ ID NO: 6665527 - DNA, 14 bp, Homo sapiens
atcttttgaagagc

SEQ ID NO: 6665528 - DNA, 13 bp, Homo sapiens
atcttttgaattc

SEQ ID NO: 6665529 - DNA, 16 bp, Homo sapiens
atcttttggaagtttt

SEQ ID NO: 6665530 - DNA, 23 bp, Homo sapiens
atcttttggttgccttaaaagaa

SEQ ID NO: 6665531 - DNA, 17 bp, Homo sapiens
atcttttgtatatctaa

SEQ ID NO: 6665532 - DNA, 19 bp, Homo sapiens
atcttttgtatatctaaga

SEQ ID NO: 6665533 - DNA, 22 bp, Homo sapiens
atcttttgttcccatcctcttc

SEQ ID NO: 6665534 - DNA, 16 bp, Homo sapiens
atcttttgtttccttt

SEQ ID NO: 6665535 - DNA, 23 bp, Homo sapiens
atcttttgtttccttttttccca

SEQ ID NO: 6665536 - DNA, 23 bp, Homo sapiens
atctttttaaaaactcttcagtg

SEQ ID NO: 6665537 - DNA, 18 bp, Homo sapiens
atctttttacctttcata

SEQ ID NO: 6665538 - DNA, 18 bp, Homo sapiens
atctttttatacacaata

SEQ ID NO: 6665539 - DNA, 13 bp, Homo sapiens
atctttttattca

SEQ ID NO: 6665540 - DNA, 13 bp, Homo sapiens
atctttttcctcc

SEQ ID NO: 6665541 - DNA, 15 bp, Homo sapiens
atctttttcctccct

SEQ ID NO: 6665542 - DNA, 13 bp, Homo sapiens
atctttttctaac

SEQ ID NO: 6665543 - DNA, 12 bp, Homo sapiens
atctttttctcc

SEQ ID NO: 6665544 - DNA, 16 bp, Homo sapiens
atctttttctccaccc

SEQ ID NO: 6665545 - DNA, 17 bp, Homo sapiens
atctttttctccaccca

SEQ ID NO: 6665546 - DNA, 17 bp, Homo sapiens
atctttttgaaaatgtt

SEQ ID NO: 6665547 - DNA, 14 bp, Homo sapiens
atctttttgcttct

SEQ ID NO: 6665548 - DNA, 17 bp, Homo sapiens
atcttttttaaactgta

SEQ ID NO: 6665549 - DNA, 15 bp, Homo sapiens
atcttttttagtgtt

SEQ ID NO: 6665550 - DNA, 14 bp, Homo sapiens
atcttttttcaaaa

SEQ ID NO: 6665551 - DNA, 13 bp, Homo sapiens
atcttttttccta

SEQ ID NO: 6665552 - DNA, 19 bp, Homo sapiens
atcttttttttaaaaaaac

SEQ ID NO: 6665553 - DNA, 21 bp, Homo sapiens
atgaaaaaaaaagaaatctct

SEQ ID NO: 6665554 - DNA, 14 bp, Homo sapiens
atgaaaaaaaaagg

SEQ ID NO: 6665555 - DNA, 22 bp, Homo sapiens
atgaaaaaaaaaggggggtggg

SEQ ID NO: 6665556 - DNA, 17 bp, Homo sapiens
atgaaaaaaatatattt

SEQ ID NO: 6665557 - DNA, 17 bp, Homo sapiens
atgaaaaaaatgatcta

SEQ ID NO: 6665558 - DNA, 18 bp, Homo sapiens
atgaaaaaatgttcaaat

SEQ ID NO: 6665559 - DNA, 15 bp, Homo sapiens
atgaaaaacaaacaa

SEQ ID NO: 6665560 - DNA, 19 bp, Homo sapiens
atgaaaaacacggcagctg

SEQ ID NO: 6665561 - DNA, 14 bp, Homo sapiens
atgaaaaacatccc

SEQ ID NO: 6665562 - DNA, 14 bp, Homo sapiens
atgaaaaagaagaa

SEQ ID NO: 6665563 - DNA, 12 bp, Homo sapiens
atgaaaaagaat

SEQ ID NO: 6665564 - DNA, 17 bp, Homo sapiens
atgaaaaagattatttg

SEQ ID NO: 6665565 - DNA, 15 bp, Homo sapiens
atgaaaaagcatgta

SEQ ID NO: 6665566 - DNA, 18 bp, Homo sapiens
atgaaaaagcatgtacag

SEQ ID NO: 6665567 - DNA, 21 bp, Homo sapiens
atgaaaaagcatgtacagtgt

SEQ ID NO: 6665568 - DNA, 13 bp, Homo sapiens
atgaaaaatataa

SEQ ID NO: 6665569 - DNA, 16 bp, Homo sapiens
atgaaaaatctgaatt

SEQ ID NO: 6665570 - DNA, 18 bp, Homo sapiens
atgaaaaatctgaatttc

SEQ ID NO: 6665571 - DNA, 17 bp, Homo sapiens
atgaaaaatgaaagatg

SEQ ID NO: 6665572 - DNA, 13 bp, Homo sapiens
atgaaaaatgtaa

SEQ ID NO: 6665573 - DNA, 15 bp, Homo sapiens
atgaaaaatgtaaat

SEQ ID NO: 6665574 - DNA, 17 bp, Homo sapiens
atgaaaaatgtaaatac

SEQ ID NO: 6665575 - DNA, 16 bp, Homo sapiens
atgaaaacacattttt

SEQ ID NO: 6665576 - DNA, 20 bp, Homo sapiens
atgaaaacagtgtgtaaaca

SEQ ID NO: 6665577 - DNA, 13 bp, Homo sapiens
atgaaaacatgta

SEQ ID NO: 6665578 - DNA, 13 bp, Homo sapiens
atgaaaacattga

SEQ ID NO: 6665579 - DNA, 20 bp, Homo sapiens
atgaaaacattgatgaatga

SEQ ID NO: 6665580 - DNA, 21 bp, Homo sapiens
atgaaaaccctcgatgttcat

SEQ ID NO: 6665581 - DNA, 17 bp, Homo sapiens
atgaaaaccgtaaagtg

SEQ ID NO: 6665582 - DNA, 21 bp, Homo sapiens
atgaaaaccgtaaagtgcctt

SEQ ID NO: 6665583 - DNA, 12 bp, Homo sapiens
atgaaaacctgc

SEQ ID NO: 6665584 - DNA, 14 bp, Homo sapiens
atgaaaactataca

SEQ ID NO: 6665585 - DNA, 17 bp, Homo sapiens
atgaaaactatacaaca

SEQ ID NO: 6665586 - DNA, 12 bp, Homo sapiens
atgaaaactcat

SEQ ID NO: 6665587 - DNA, 20 bp, Homo sapiens
atgaaaactcatgatcaaga

SEQ ID NO: 6665588 - DNA, 21 bp, Homo sapiens
atgaaaactcatgatcaagat

SEQ ID NO: 6665589 - DNA, 16 bp, Homo sapiens
atgaaaactctttgct

SEQ ID NO: 6665590 - DNA, 13 bp, Homo sapiens
atgaaaactgtaa

SEQ ID NO: 6665591 - DNA, 16 bp, Homo sapiens
atgaaaacttttgtaa

SEQ ID NO: 6665592 - DNA, 21 bp, Homo sapiens
atgaaaacttttgtaaattat

SEQ ID NO: 6665593 - DNA, 18 bp, Homo sapiens
atgaaaagaataaaaatt

SEQ ID NO: 6665594 - DNA, 22 bp, Homo sapiens
atgaaaagacaagaaaatcagg

SEQ ID NO: 6665595 - DNA, 17 bp, Homo sapiens
atgaaaagagaattact

SEQ ID NO: 6665596 - DNA, 14 bp, Homo sapiens
atgaaaagaggaac

SEQ ID NO: 6665597 - DNA, 17 bp, Homo sapiens
atgaaaagattcttctg

SEQ ID NO: 6665598 - DNA, 19 bp, Homo sapiens
atgaaaagattcttctgtg

SEQ ID NO: 6665599 - DNA, 17 bp, Homo sapiens
atgaaaagccatatcta

SEQ ID NO: 6665600 - DNA, 17 bp, Homo sapiens
atgaaaagctatcttaa

SEQ ID NO: 6665601 - DNA, 21 bp, Homo sapiens
atgaaaagctatcttaaaata

SEQ ID NO: 6665602 - DNA, 16 bp, Homo sapiens
atgaaaagctgctggt

SEQ ID NO: 6665603 - DNA, 11 bp, Homo sapiens
atgaaaaggat

SEQ ID NO: 6665604 - DNA, 13 bp, Homo sapiens
atgaaaagtgcat

SEQ ID NO: 6665605 - DNA, 19 bp, Homo sapiens
atgaaaagttatttatgct

SEQ ID NO: 6665606 - DNA, 13 bp, Homo sapiens
atgaaaagtttag

SEQ ID NO: 6665607 - DNA, 12 bp, Homo sapiens
atgaaaagtttt

SEQ ID NO: 6665608 - DNA, 17 bp, Homo sapiens
atgaaaataaaacacac

SEQ ID NO: 6665609 - DNA, 14 bp, Homo sapiens
atgaaaataaaata

SEQ ID NO: 6665610 - DNA, 20 bp, Homo sapiens
atgaaaataaaataaacgaa

SEQ ID NO: 6665611 - DNA, 22 bp, Homo sapiens
atgaaaataactgaatttggag

SEQ ID NO: 6665612 - DNA, 16 bp, Homo sapiens
atgaaaataattttcc

SEQ ID NO: 6665613 - DNA, 17 bp, Homo sapiens
atgaaaatacaacttaa

SEQ ID NO: 6665614 - DNA, 20 bp, Homo sapiens
atgaaaataccataggaaga

SEQ ID NO: 6665615 - DNA, 13 bp, Homo sapiens
atgaaaatattta

SEQ ID NO: 6665616 - DNA, 14 bp, Homo sapiens
atgaaaatatttaa

SEQ ID NO: 6665617 - DNA, 17 bp, Homo sapiens
atgaaaatcctaccaac

SEQ ID NO: 6665618 - DNA, 21 bp, Homo sapiens
atgaaaatcctaccaacctct

SEQ ID NO: 6665619 - DNA, 18 bp, Homo sapiens
atgaaaatccttttaacc

SEQ ID NO: 6665620 - DNA, 16 bp, Homo sapiens
atgaaaatgagcatca

SEQ ID NO: 6665621 - DNA, 13 bp, Homo sapiens
atgaaaatgagcc

SEQ ID NO: 6665622 - DNA, 20 bp, Homo sapiens
atgaaaatgagttgtgaaag

SEQ ID NO: 6665623 - DNA, 21 bp, Homo sapiens
atgaaaatgatgtagacattt

SEQ ID NO: 6665624 - DNA, 12 bp, Homo sapiens
atgaaaatggaa

SEQ ID NO: 6665625 - DNA, 19 bp, Homo sapiens
atgaaaatggctgaagaaa

SEQ ID NO: 6665626 - DNA, 20 bp, Homo sapiens
atgaaaatgtaacttttctt

SEQ ID NO: 6665627 - DNA, 12 bp, Homo sapiens
atgaaaatgtca

SEQ ID NO: 6665628 - DNA, 15 bp, Homo sapiens
atgaaaatgtcagaa

SEQ ID NO: 6665629 - DNA, 19 bp, Homo sapiens
atgaaaatgtcagaaacca

SEQ ID NO: 6665630 - DNA, 16 bp, Homo sapiens
atgaaaatgtctcagt

SEQ ID NO: 6665631 - DNA, 20 bp, Homo sapiens
atgaaaatgtctcagtattt

SEQ ID NO: 6665632 - DNA, 16 bp, Homo sapiens
atgaaaatgtcttgtg

SEQ ID NO: 6665633 - DNA, 14 bp, Homo sapiens
atgaaaattacaac

SEQ ID NO: 6665634 - DNA, 19 bp, Homo sapiens
atgaaaatttgagactatt

SEQ ID NO: 6665635 - DNA, 13 bp, Homo sapiens
atgaaaattttaa

SEQ ID NO: 6665636 - DNA, 20 bp, Homo sapiens
atgaaacaaaaaaaaaatga

SEQ ID NO: 6665637 - DNA, 14 bp, Homo sapiens
atgaaacaaatata

SEQ ID NO: 6665638 - DNA, 19 bp, Homo sapiens
atgaaacaaatatactcat

SEQ ID NO: 6665639 - DNA, 17 bp, Homo sapiens
atgaaacaacagagaca

SEQ ID NO: 6665640 - DNA, 17 bp, Homo sapiens
atgaaacaccttctctg

SEQ ID NO: 6665641 - DNA, 15 bp, Homo sapiens
atgaaacacttctca

SEQ ID NO: 6665642 - DNA, 17 bp, Homo sapiens
atgaaacacttctcatc

SEQ ID NO: 6665643 - DNA, 22 bp, Homo sapiens
atgaaacagatgataaatattt

SEQ ID NO: 6665644 - DNA, 22 bp, Homo sapiens
atgaaacatatcatggtaatga

SEQ ID NO: 6665645 - DNA, 15 bp, Homo sapiens
atgaaacatcatttc

SEQ ID NO: 6665646 - DNA, 17 bp, Homo sapiens
atgaaacattaactcta

SEQ ID NO: 6665647 - DNA, 17 bp, Homo sapiens
atgaaaccaactgttga

SEQ ID NO: 6665648 - DNA, 22 bp, Homo sapiens
atgaaaccaactgttgacatac

SEQ ID NO: 6665649 - DNA, 15 bp, Homo sapiens
atgaaacccccacac

SEQ ID NO: 6665650 - DNA, 17 bp, Homo sapiens
atgaaacccccacacac

SEQ ID NO: 6665651 - DNA, 19 bp, Homo sapiens
atgaaacccccacacacac

SEQ ID NO: 6665652 - DNA, 15 bp, Homo sapiens
atgaaaccttcctct

SEQ ID NO: 6665653 - DNA, 20 bp, Homo sapiens
atgaaactaaagcaatagaa

SEQ ID NO: 6665654 - DNA, 17 bp, Homo sapiens
atgaaactaggcttctg

SEQ ID NO: 6665655 - DNA, 21 bp, Homo sapiens
atgaaactatggctttaaact

SEQ ID NO: 6665656 - DNA, 20 bp, Homo sapiens
atgaaactcctgattttgta

SEQ ID NO: 6665657 - DNA, 16 bp, Homo sapiens
atgaaactctacattt

SEQ ID NO: 6665658 - DNA, 18 bp, Homo sapiens
atgaaactctacatttaa

SEQ ID NO: 6665659 - DNA, 20 bp, Homo sapiens
atgaaactctttcattcttc

SEQ ID NO: 6665660 - DNA, 12 bp, Homo sapiens
atgaaactgtac

SEQ ID NO: 6665661 - DNA, 17 bp, Homo sapiens
atgaaactgtacatact

SEQ ID NO: 6665662 - DNA, 18 bp, Homo sapiens
atgaaacttaagaattga

SEQ ID NO: 6665663 - DNA, 12 bp, Homo sapiens
atgaaacttctc

SEQ ID NO: 6665664 - DNA, 17 bp, Homo sapiens
atgaaacttgagcattc

SEQ ID NO: 6665665 - DNA, 13 bp, Homo sapiens
atgaaacttggat

SEQ ID NO: 6665666 - DNA, 18 bp, Homo sapiens
atgaaagaaaacttttat

SEQ ID NO: 6665667 - DNA, 18 bp, Homo sapiens
atgaaagaatatatttat

SEQ ID NO: 6665668 - DNA, 14 bp, Homo sapiens
atgaaagacaaaga

SEQ ID NO: 6665669 - DNA, 22 bp, Homo sapiens
atgaaagacaaagaaggaaaag

SEQ ID NO: 6665670 - DNA, 19 bp, Homo sapiens
atgaaagactgtacaaagt

SEQ ID NO: 6665671 - DNA, 13 bp, Homo sapiens
atgaaagagaaaa

SEQ ID NO: 6665672 - DNA, 15 bp, Homo sapiens
atgaaagagaaaata

SEQ ID NO: 6665673 - DNA, 22 bp, Homo sapiens
atgaaagagaaaatgctttctc

SEQ ID NO: 6665674 - DNA, 13 bp, Homo sapiens
atgaaagaggagg

SEQ ID NO: 6665675 - DNA, 20 bp, Homo sapiens
atgaaagatggctgtgcctc

SEQ ID NO: 6665676 - DNA, 23 bp, Homo sapiens
atgaaagatggctgtgcctctgc

SEQ ID NO: 6665677 - DNA, 13 bp, Homo sapiens
atgaaagattaaa

SEQ ID NO: 6665678 - DNA, 18 bp, Homo sapiens
atgaaagattaaacagat

SEQ ID NO: 6665679 - DNA, 21 bp, Homo sapiens
atgaaagatttttactaatat

SEQ ID NO: 6665680 - DNA, 13 bp, Homo sapiens
atgaaagcaacaa

SEQ ID NO: 6665681 - DNA, 15 bp, Homo sapiens
atgaaagcagcacac

SEQ ID NO: 6665682 - DNA, 21 bp, Homo sapiens
atgaaagcagggaatttctat

SEQ ID NO: 6665683 - DNA, 15 bp, Homo sapiens
atgaaagcagggact

SEQ ID NO: 6665684 - DNA, 16 bp, Homo sapiens
atgaaagccaaaacct

SEQ ID NO: 6665685 - DNA, 22 bp, Homo sapiens
atgaaagccctggaattttagg

SEQ ID NO: 6665686 - DNA, 17 bp, Homo sapiens
atgaaagctatgaatgt

SEQ ID NO: 6665687 - DNA, 12 bp, Homo sapiens
atgaaaggagag

SEQ ID NO: 6665688 - DNA, 14 bp, Homo sapiens
atgaaagggaaact

SEQ ID NO: 6665689 - DNA, 21 bp, Homo sapiens
atgaaagggaaagtcagcttt

SEQ ID NO: 6665690 - DNA, 14 bp, Homo sapiens
atgaaaggtaatct

SEQ ID NO: 6665691 - DNA, 14 bp, Homo sapiens
atgaaaggtactat

SEQ ID NO: 6665692 - DNA, 17 bp, Homo sapiens
atgaaaggtgccatgga

SEQ ID NO: 6665693 - DNA, 16 bp, Homo sapiens
atgaaaggtttacatt

SEQ ID NO: 6665694 - DNA, 21 bp, Homo sapiens
atgaaaggtttacattgtcaa

SEQ ID NO: 6665695 - DNA, 19 bp, Homo sapiens
atgaaagtagattcatgaa

SEQ ID NO: 6665696 - DNA, 12 bp, Homo sapiens
atgaaagtcaaa

SEQ ID NO: 6665697 - DNA, 21 bp, Homo sapiens
atgaaagtcaaatttacttta

SEQ ID NO: 6665698 - DNA, 16 bp, Homo sapiens
atgaaagtcagtttaa

SEQ ID NO: 6665699 - DNA, 18 bp, Homo sapiens
atgaaagtcttgtgacta

SEQ ID NO: 6665700 - DNA, 17 bp, Homo sapiens
atgaaagtgactttaaa

SEQ ID NO: 6665701 - DNA, 20 bp, Homo sapiens
atgaaagtgatgacatattt

SEQ ID NO: 6665702 - DNA, 14 bp, Homo sapiens
atgaaagtgcaaag

SEQ ID NO: 6665703 - DNA, 15 bp, Homo sapiens
atgaaagtgttaatt

SEQ ID NO: 6665704 - DNA, 13 bp, Homo sapiens
atgaaagttttgc

SEQ ID NO: 6665705 - DNA, 16 bp, Homo sapiens
atgaaataaaatatat

SEQ ID NO: 6665706 - DNA, 15 bp, Homo sapiens
atgaaataaaatttg

SEQ ID NO: 6665707 - DNA, 17 bp, Homo sapiens
atgaaataaaatttgaa

SEQ ID NO: 6665708 - DNA, 21 bp, Homo sapiens
atgaaataaaatttgaaactg

SEQ ID NO: 6665709 - DNA, 22 bp, Homo sapiens
atgaaataaagacccaggggga

SEQ ID NO: 6665710 - DNA, 19 bp, Homo sapiens
atgaaataaatcatgttaa

SEQ ID NO: 6665711 - DNA, 14 bp, Homo sapiens
atgaaatactgcct

SEQ ID NO: 6665712 - DNA, 22 bp, Homo sapiens
atgaaatactgtttgaggtttt

SEQ ID NO: 6665713 - DNA, 19 bp, Homo sapiens
atgaaatacttgacaacat

SEQ ID NO: 6665714 - DNA, 14 bp, Homo sapiens
atgaaatactttat

SEQ ID NO: 6665715 - DNA, 22 bp, Homo sapiens
atgaaataggagggaaaccttt

SEQ ID NO: 6665716 - DNA, 15 bp, Homo sapiens
atgaaatataaactg

SEQ ID NO: 6665717 - DNA, 18 bp, Homo sapiens
atgaaatataaactgtga

SEQ ID NO: 6665718 - DNA, 20 bp, Homo sapiens
atgaaatataaactgtgaga

SEQ ID NO: 6665719 - DNA, 13 bp, Homo sapiens
atgaaatataaat

SEQ ID NO: 6665720 - DNA, 14 bp, Homo sapiens
atgaaatataaatt

SEQ ID NO: 6665721 - DNA, 17 bp, Homo sapiens
atgaaatataaattatc

SEQ ID NO: 6665722 - DNA, 18 bp, Homo sapiens
atgaaatatatttaaaat

SEQ ID NO: 6665723 - DNA, 19 bp, Homo sapiens
atgaaatatcagactagtg

SEQ ID NO: 6665724 - DNA, 13 bp, Homo sapiens
atgaaatatgcat

SEQ ID NO: 6665725 - DNA, 13 bp, Homo sapiens
atgaaatattttg

SEQ ID NO: 6665726 - DNA, 21 bp, Homo sapiens
atgaaatcaaatgtatgtatc

SEQ ID NO: 6665727 - DNA, 16 bp, Homo sapiens
atgaaatccttttcct

SEQ ID NO: 6665728 - DNA, 20 bp, Homo sapiens
atgaaatctgctagaaagtt

SEQ ID NO: 6665729 - DNA, 15 bp, Homo sapiens
atgaaatcttcccag

SEQ ID NO: 6665730 - DNA, 14 bp, Homo sapiens
atgaaatgaacaca

SEQ ID NO: 6665731 - DNA, 13 bp, Homo sapiens
atgaaatgaatga

SEQ ID NO: 6665732 - DNA, 14 bp, Homo sapiens
atgaaatgactgtc

SEQ ID NO: 6665733 - DNA, 19 bp, Homo sapiens
atgaaatgaggagaaacag

SEQ ID NO: 6665734 - DNA, 23 bp, Homo sapiens
atgaaatgataaagacttttatg

SEQ ID NO: 6665735 - DNA, 18 bp, Homo sapiens
atgaaatgataaagatgt

SEQ ID NO: 6665736 - DNA, 14 bp, Homo sapiens
atgaaatgcactgt

SEQ ID NO: 6665737 - DNA, 15 bp, Homo sapiens
atgaaatgcattttg

SEQ ID NO: 6665738 - DNA, 17 bp, Homo sapiens
atgaaatgcattttgct

SEQ ID NO: 6665739 - DNA, 19 bp, Homo sapiens
atgaaatgcattttgctag

SEQ ID NO: 6665740 - DNA, 15 bp, Homo sapiens
atgaaatgccaagac

SEQ ID NO: 6665741 - DNA, 22 bp, Homo sapiens
atgaaatgccagacttctaaaa

SEQ ID NO: 6665742 - DNA, 14 bp, Homo sapiens
atgaaatgctatgt

SEQ ID NO: 6665743 - DNA, 11 bp, Homo sapiens
atgaaatggat

SEQ ID NO: 6665744 - DNA, 16 bp, Homo sapiens
atgaaatggttaagaa

SEQ ID NO: 6665745 - DNA, 11 bp, Homo sapiens
atgaaatgtct

SEQ ID NO: 6665746 - DNA, 22 bp, Homo sapiens
atgaaatgtgttttgtcttttt

SEQ ID NO: 6665747 - DNA, 13 bp, Homo sapiens
atgaaatgtttac

SEQ ID NO: 6665748 - DNA, 23 bp, Homo sapiens
atgaaattacttatcatccacat

SEQ ID NO: 6665749 - DNA, 19 bp, Homo sapiens
atgaaattatataagtatt

SEQ ID NO: 6665750 - DNA, 21 bp, Homo sapiens
atgaaattatataagtattct

SEQ ID NO: 6665751 - DNA, 17 bp, Homo sapiens
atgaaattcaagtgctt

SEQ ID NO: 6665752 - DNA, 23 bp, Homo sapiens
atgaaattcttatgttgaatatg

SEQ ID NO: 6665753 - DNA, 14 bp, Homo sapiens
atgaaattgaaaat

SEQ ID NO: 6665754 - DNA, 16 bp, Homo sapiens
atgaaattgacaagct

SEQ ID NO: 6665755 - DNA, 15 bp, Homo sapiens
atgaaattgagaagg

SEQ ID NO: 6665756 - DNA, 15 bp, Homo sapiens
atgaaattgtatctc

SEQ ID NO: 6665757 - DNA, 23 bp, Homo sapiens
atgaaattgtctagcagagcagg

SEQ ID NO: 6665758 - DNA, 12 bp, Homo sapiens
atgaaatttaaa

SEQ ID NO: 6665759 - DNA, 15 bp, Homo sapiens
atgaaatttaaacat

SEQ ID NO: 6665760 - DNA, 14 bp, Homo sapiens
atgaaatttaagca

SEQ ID NO: 6665761 - DNA, 15 bp, Homo sapiens
atgaaatttaagcac

SEQ ID NO: 6665762 - DNA, 17 bp, Homo sapiens
atgaaatttaattacaa

SEQ ID NO: 6665763 - DNA, 13 bp, Homo sapiens
atgaaatttgata

SEQ ID NO: 6665764 - DNA, 14 bp, Homo sapiens
atgaaatttgcaaa

SEQ ID NO: 6665765 - DNA, 15 bp, Homo sapiens
atgaaatttgcaaaa

SEQ ID NO: 6665766 - DNA, 17 bp, Homo sapiens
atgaaatttgcaaaatc

SEQ ID NO: 6665767 - DNA, 20 bp, Homo sapiens
atgaaatttgcaaaatcact

SEQ ID NO: 6665768 - DNA, 16 bp, Homo sapiens
atgaaattttaccaag

SEQ ID NO: 6665769 - DNA, 20 bp, Homo sapiens
atgaaattttccaatgtctg

SEQ ID NO: 6665770 - DNA, 14 bp, Homo sapiens
atgaaattttgcct

SEQ ID NO: 6665771 - DNA, 17 bp, Homo sapiens
atgaaatttttgtaaat

SEQ ID NO: 6665772 - DNA, 11 bp, Homo sapiens
atgaacaaaat

SEQ ID NO: 6665773 - DNA, 17 bp, Homo sapiens
atgaacaaaattatttg

SEQ ID NO: 6665774 - DNA, 13 bp, Homo sapiens
atgaacaaactat

SEQ ID NO: 6665775 - DNA, 13 bp, Homo sapiens
atgaacaaagaaa

SEQ ID NO: 6665776 - DNA, 22 bp, Homo sapiens
atgaacaaagggattctccagg

SEQ ID NO: 6665777 - DNA, 13 bp, Homo sapiens
atgaacaaatatg

SEQ ID NO: 6665778 - DNA, 12 bp, Homo sapiens
atgaacaaatgg

SEQ ID NO: 6665779 - DNA, 14 bp, Homo sapiens
atgaacaaattctt

SEQ ID NO: 6665780 - DNA, 15 bp, Homo sapiens
atgaacaaattcttt

SEQ ID NO: 6665781 - DNA, 16 bp, Homo sapiens
atgaacaaattcttta

SEQ ID NO: 6665782 - DNA, 23 bp, Homo sapiens
atgaacaaattctttagtactca

SEQ ID NO: 6665783 - DNA, 18 bp, Homo sapiens
atgaacaagagaagcatt

SEQ ID NO: 6665784 - DNA, 13 bp, Homo sapiens
atgaacaagtttt

SEQ ID NO: 6665785 - DNA, 14 bp, Homo sapiens
atgaacaagtttta

SEQ ID NO: 6665786 - DNA, 20 bp, Homo sapiens
atgaacaatgtatacaatgc

SEQ ID NO: 6665787 - DNA, 14 bp, Homo sapiens
atgaacaatgtgtg

SEQ ID NO: 6665788 - DNA, 20 bp, Homo sapiens
atgaacacaaattatgctaa

SEQ ID NO: 6665789 - DNA, 13 bp, Homo sapiens
atgaacacaattt

SEQ ID NO: 6665790 - DNA, 15 bp, Homo sapiens
atgaacacactgtgt

SEQ ID NO: 6665791 - DNA, 22 bp, Homo sapiens
atgaacacactgtgtcctggtg

SEQ ID NO: 6665792 - DNA, 12 bp, Homo sapiens
atgaacacagac

SEQ ID NO: 6665793 - DNA, 14 bp, Homo sapiens
atgaacacagacaa

SEQ ID NO: 6665794 - DNA, 20 bp, Homo sapiens
atgaacaccatacctttgct

SEQ ID NO: 6665795 - DNA, 17 bp, Homo sapiens
atgaacacccttagaaa

SEQ ID NO: 6665796 - DNA, 16 bp, Homo sapiens
atgaacagaaatattg

SEQ ID NO: 6665797 - DNA, 19 bp, Homo sapiens
atgaacagaatttatgact

SEQ ID NO: 6665798 - DNA, 16 bp, Homo sapiens
atgaacagctctgaga

SEQ ID NO: 6665799 - DNA, 12 bp, Homo sapiens
atgaacagctgt

SEQ ID NO: 6665800 - DNA, 15 bp, Homo sapiens
atgaacagctgtgtc

SEQ ID NO: 6665801 - DNA, 23 bp, Homo sapiens
atgaacaggatgtataatatgca

SEQ ID NO: 6665802 - DNA, 17 bp, Homo sapiens
atgaacatatatttttt

SEQ ID NO: 6665803 - DNA, 21 bp, Homo sapiens
atgaacatattgttgaaaggt

SEQ ID NO: 6665804 - DNA, 17 bp, Homo sapiens
atgaacatcatggactg

SEQ ID NO: 6665805 - DNA, 14 bp, Homo sapiens
atgaacatctctgt

SEQ ID NO: 6665806 - DNA, 16 bp, Homo sapiens
atgaacatctcttgaa

SEQ ID NO: 6665807 - DNA, 17 bp, Homo sapiens
atgaacatctggggact

SEQ ID NO: 6665808 - DNA, 19 bp, Homo sapiens
atgaacatgcagttcatta

SEQ ID NO: 6665809 - DNA, 15 bp, Homo sapiens
atgaacatgttcctg

SEQ ID NO: 6665810 - DNA, 20 bp, Homo sapiens
atgaacattagaaaaatagc

SEQ ID NO: 6665811 - DNA, 12 bp, Homo sapiens
atgaacattcca

SEQ ID NO: 6665812 - DNA, 19 bp, Homo sapiens
atgaacattgtactgttgc

SEQ ID NO: 6665813 - DNA, 22 bp, Homo sapiens
atgaacattgtactgttgcttt

SEQ ID NO: 6665814 - DNA, 11 bp, Homo sapiens
atgaacatttc

SEQ ID NO: 6665815 - DNA, 19 bp, Homo sapiens
atgaacattttatttttga

SEQ ID NO: 6665816 - DNA, 13 bp, Homo sapiens
atgaaccacatct

SEQ ID NO: 6665817 - DNA, 22 bp, Homo sapiens
atgaaccacatcttgctctgct

SEQ ID NO: 6665818 - DNA, 23 bp, Homo sapiens
atgaaccacatcttgctctgctg

SEQ ID NO: 6665819 - DNA, 20 bp, Homo sapiens
atgaaccagccggggcctta

SEQ ID NO: 6665820 - DNA, 16 bp, Homo sapiens
atgaaccatggcacct

SEQ ID NO: 6665821 - DNA, 14 bp, Homo sapiens
atgaacccataggg

SEQ ID NO: 6665822 - DNA, 17 bp, Homo sapiens
atgaacccctggctcct

SEQ ID NO: 6665823 - DNA, 16 bp, Homo sapiens
atgaaccctcctcctt

SEQ ID NO: 6665824 - DNA, 17 bp, Homo sapiens
atgaaccctcctccttt

SEQ ID NO: 6665825 - DNA, 21 bp, Homo sapiens
atgaaccctcctcctttttaa

SEQ ID NO: 6665826 - DNA, 21 bp, Homo sapiens
atgaaccctcttgccatcctg

SEQ ID NO: 6665827 - DNA, 17 bp, Homo sapiens
atgaaccctggcatttg

SEQ ID NO: 6665828 - DNA, 13 bp, Homo sapiens
atgaacccttcct

SEQ ID NO: 6665829 - DNA, 18 bp, Homo sapiens
atgaacccttcctgagct

SEQ ID NO: 6665830 - DNA, 17 bp, Homo sapiens
atgaaccctttgtttct

SEQ ID NO: 6665831 - DNA, 17 bp, Homo sapiens
atgaaccgctgaatatg

SEQ ID NO: 6665832 - DNA, 17 bp, Homo sapiens
atgaaccgtttacagtg

SEQ ID NO: 6665833 - DNA, 19 bp, Homo sapiens
atgaacctattttcatttg

SEQ ID NO: 6665834 - DNA, 21 bp, Homo sapiens
atgaacctattttcatttgta

SEQ ID NO: 6665835 - DNA, 23 bp, Homo sapiens
atgaacctcaagctgcatctaga

SEQ ID NO: 6665836 - DNA, 17 bp, Homo sapiens
atgaacctggagggcta

SEQ ID NO: 6665837 - DNA, 14 bp, Homo sapiens
atgaaccttctggc

SEQ ID NO: 6665838 - DNA, 17 bp, Homo sapiens
atgaaccttctggcctc

SEQ ID NO: 6665839 - DNA, 21 bp, Homo sapiens
atgaaccttctggcctcccac

SEQ ID NO: 6665840 - DNA, 13 bp, Homo sapiens
atgaaccttgcta

SEQ ID NO: 6665841 - DNA, 18 bp, Homo sapiens
atgaacgcacaacatgca

SEQ ID NO: 6665842 - DNA, 19 bp, Homo sapiens
atgaacgtggattgtattt

SEQ ID NO: 6665843 - DNA, 16 bp, Homo sapiens
atgaactaaaaagaga

SEQ ID NO: 6665844 - DNA, 20 bp, Homo sapiens
atgaactaactgccatgtag

SEQ ID NO: 6665845 - DNA, 16 bp, Homo sapiens
atgaactactgctatt

SEQ ID NO: 6665846 - DNA, 17 bp, Homo sapiens
atgaactagctatgaaa

SEQ ID NO: 6665847 - DNA, 20 bp, Homo sapiens
atgaactattccccagcagg

SEQ ID NO: 6665848 - DNA, 18 bp, Homo sapiens
atgaactcaatataaaaa

SEQ ID NO: 6665849 - DNA, 21 bp, Homo sapiens
atgaactcaatctaaattaaa

SEQ ID NO: 6665850 - DNA, 15 bp, Homo sapiens
atgaactctttcaaa

SEQ ID NO: 6665851 - DNA, 19 bp, Homo sapiens
atgaactgaagtttcacat

SEQ ID NO: 6665852 - DNA, 15 bp, Homo sapiens
atgaactgattttta

SEQ ID NO: 6665853 - DNA, 19 bp, Homo sapiens
atgaactgcatgtataaat

SEQ ID NO: 6665854 - DNA, 20 bp, Homo sapiens
atgaactgcatgtataaatg

SEQ ID NO: 6665855 - DNA, 16 bp, Homo sapiens
atgaactgcttttcct

SEQ ID NO: 6665856 - DNA, 19 bp, Homo sapiens
atgaactggaggccaggaa

SEQ ID NO: 6665857 - DNA, 18 bp, Homo sapiens
atgaactggcttgtacat

SEQ ID NO: 6665858 - DNA, 19 bp, Homo sapiens
atgaactggcttgtacatt

SEQ ID NO: 6665859 - DNA, 13 bp, Homo sapiens
atgaactgtacta

SEQ ID NO: 6665860 - DNA, 16 bp, Homo sapiens
atgaactgtatattat

SEQ ID NO: 6665861 - DNA, 13 bp, Homo sapiens
atgaactgtatta

SEQ ID NO: 6665862 - DNA, 16 bp, Homo sapiens
atgaactgtattattg

SEQ ID NO: 6665863 - DNA, 12 bp, Homo sapiens
atgaactgtccg

SEQ ID NO: 6665864 - DNA, 22 bp, Homo sapiens
atgaactgtctagatggatgaa

SEQ ID NO: 6665865 - DNA, 17 bp, Homo sapiens
atgaactgtgacaggaa

SEQ ID NO: 6665866 - DNA, 19 bp, Homo sapiens
atgaactgtggaatttatt

SEQ ID NO: 6665867 - DNA, 19 bp, Homo sapiens
atgaacttagattttacat

SEQ ID NO: 6665868 - DNA, 21 bp, Homo sapiens
atgaacttagtcattaatgtt

SEQ ID NO: 6665869 - DNA, 15 bp, Homo sapiens
atgaacttattaata

SEQ ID NO: 6665870 - DNA, 16 bp, Homo sapiens
atgaacttattctgta

SEQ ID NO: 6665871 - DNA, 17 bp, Homo sapiens
atgaacttcgcatcaaa

SEQ ID NO: 6665872 - DNA, 19 bp, Homo sapiens
atgaacttgagatctgtat

SEQ ID NO: 6665873 - DNA, 18 bp, Homo sapiens
atgaacttgaggacacat

SEQ ID NO: 6665874 - DNA, 19 bp, Homo sapiens
atgaacttgaggacacatg

SEQ ID NO: 6665875 - DNA, 23 bp, Homo sapiens
atgaactttcagcagtctaaatt

SEQ ID NO: 6665876 - DNA, 18 bp, Homo sapiens
atgaactttgtcagtgtt

SEQ ID NO: 6665877 - DNA, 17 bp, Homo sapiens
atgaactttgtcattat

SEQ ID NO: 6665878 - DNA, 21 bp, Homo sapiens
atgaagaaaaaattttaaaaa

SEQ ID NO: 6665879 - DNA, 20 bp, Homo sapiens
atgaagaaaaaggctggctg

SEQ ID NO: 6665880 - DNA, 21 bp, Homo sapiens
atgaagaaaaaggctggctga

SEQ ID NO: 6665881 - DNA, 19 bp, Homo sapiens
atgaagaaaagtgggccag

SEQ ID NO: 6665882 - DNA, 19 bp, Homo sapiens
atgaagaaaatacttaaat

SEQ ID NO: 6665883 - DNA, 20 bp, Homo sapiens
atgaagaaaatacttaaatg

SEQ ID NO: 6665884 - DNA, 23 bp, Homo sapiens
atgaagaaaatacttaaatgtta

SEQ ID NO: 6665885 - DNA, 17 bp, Homo sapiens
atgaagaaagatactaa

SEQ ID NO: 6665886 - DNA, 19 bp, Homo sapiens
atgaagaaagatactaata

SEQ ID NO: 6665887 - DNA, 19 bp, Homo sapiens
atgaagaaagggaggccca

SEQ ID NO: 6665888 - DNA, 15 bp, Homo sapiens
atgaagaaatttatg

SEQ ID NO: 6665889 - DNA, 17 bp, Homo sapiens
atgaagaacacagcatg

SEQ ID NO: 6665890 - DNA, 16 bp, Homo sapiens
atgaagaagacacctc

SEQ ID NO: 6665891 - DNA, 21 bp, Homo sapiens
atgaagaatacccaggaagac

SEQ ID NO: 6665892 - DNA, 17 bp, Homo sapiens
atgaagaatagaaacaa

SEQ ID NO: 6665893 - DNA, 21 bp, Homo sapiens
atgaagaatataccatttcaa

SEQ ID NO: 6665894 - DNA, 15 bp, Homo sapiens
atgaagaatcacgat

SEQ ID NO: 6665895 - DNA, 11 bp, Homo sapiens
atgaagaatgt

SEQ ID NO: 6665896 - DNA, 14 bp, Homo sapiens
atgaagacagaggc

SEQ ID NO: 6665897 - DNA, 21 bp, Homo sapiens
atgaagacaggacagtgcttc

SEQ ID NO: 6665898 - DNA, 12 bp, Homo sapiens
atgaagacccag

SEQ ID NO: 6665899 - DNA, 20 bp, Homo sapiens
atgaagacccagtgtaaaga

SEQ ID NO: 6665900 - DNA, 22 bp, Homo sapiens
atgaagacccagtgtaaagaat

SEQ ID NO: 6665901 - DNA, 20 bp, Homo sapiens
atgaagacctaaatgacctc

SEQ ID NO: 6665902 - DNA, 22 bp, Homo sapiens
atgaagacctaaatgacctcag

SEQ ID NO: 6665903 - DNA, 23 bp, Homo sapiens
atgaagacctaaatgacctcagc

SEQ ID NO: 6665904 - DNA, 19 bp, Homo sapiens
atgaagacctttttctgca

SEQ ID NO: 6665905 - DNA, 22 bp, Homo sapiens
atgaagacctttttctgcacta

SEQ ID NO: 6665906 - DNA, 21 bp, Homo sapiens
atgaagactgttaaatgaaac

SEQ ID NO: 6665907 - DNA, 22 bp, Homo sapiens
atgaagactgttaaatgaaacc

SEQ ID NO: 6665908 - DNA, 21 bp, Homo sapiens
atgaagacttaactggcccag

SEQ ID NO: 6665909 - DNA, 12 bp, Homo sapiens
atgaagagaaaa

SEQ ID NO: 6665910 - DNA, 18 bp, Homo sapiens
atgaagagaagcaatttt

SEQ ID NO: 6665911 - DNA, 20 bp, Homo sapiens
atgaagagaagctgagaaga

SEQ ID NO: 6665912 - DNA, 18 bp, Homo sapiens
atgaagagctagagaaat

SEQ ID NO: 6665913 - DNA, 14 bp, Homo sapiens
atgaagagtattaa

SEQ ID NO: 6665914 - DNA, 16 bp, Homo sapiens
atgaagataaatgctt

SEQ ID NO: 6665915 - DNA, 17 bp, Homo sapiens
atgaagataaatgcttt

SEQ ID NO: 6665916 - DNA, 18 bp, Homo sapiens
atgaagataaatgcttta

SEQ ID NO: 6665917 - DNA, 21 bp, Homo sapiens
atgaagataaatgctttaaat

SEQ ID NO: 6665918 - DNA, 22 bp, Homo sapiens
atgaagataaatgctttaaata

SEQ ID NO: 6665919 - DNA, 18 bp, Homo sapiens
atgaagatacacattaca

SEQ ID NO: 6665920 - DNA, 15 bp, Homo sapiens
atgaagatctttgtt

SEQ ID NO: 6665921 - DNA, 17 bp, Homo sapiens
atgaagatgttaaaatc

SEQ ID NO: 6665922 - DNA, 19 bp, Homo sapiens
atgaagattaacactgaga

SEQ ID NO: 6665923 - DNA, 20 bp, Homo sapiens
atgaagattattttttatga

SEQ ID NO: 6665924 - DNA, 19 bp, Homo sapiens
atgaagattctcctgtgct

SEQ ID NO: 6665925 - DNA, 21 bp, Homo sapiens
atgaagattggtgggattttt

SEQ ID NO: 6665926 - DNA, 23 bp, Homo sapiens
atgaagcaaacacacagactctg

SEQ ID NO: 6665927 - DNA, 15 bp, Homo sapiens
atgaagcaaacacat

SEQ ID NO: 6665928 - DNA, 22 bp, Homo sapiens
atgaagcaaatgtcatgctgcc

SEQ ID NO: 6665929 - DNA, 11 bp, Homo sapiens
atgaagcaagc

SEQ ID NO: 6665930 - DNA, 17 bp, Homo sapiens
atgaagcaagctgtgtt

SEQ ID NO: 6665931 - DNA, 20 bp, Homo sapiens
atgaagcaagctgtgttact

SEQ ID NO: 6665932 - DNA, 14 bp, Homo sapiens
atgaagcaaggaag

SEQ ID NO: 6665933 - DNA, 20 bp, Homo sapiens
atgaagcaatttatatcttt

SEQ ID NO: 6665934 - DNA, 14 bp, Homo sapiens
atgaagcagaacct

SEQ ID NO: 6665935 - DNA, 15 bp, Homo sapiens
atgaagcagaacctt

SEQ ID NO: 6665936 - DNA, 17 bp, Homo sapiens
atgaagcagaaccttct

SEQ ID NO: 6665937 - DNA, 14 bp, Homo sapiens
atgaagcagaatga

SEQ ID NO: 6665938 - DNA, 15 bp, Homo sapiens
atgaagcagaatgag

SEQ ID NO: 6665939 - DNA, 15 bp, Homo sapiens
atgaagcagaggaag

SEQ ID NO: 6665940 - DNA, 15 bp, Homo sapiens
atgaagcagatttat

SEQ ID NO: 6665941 - DNA, 12 bp, Homo sapiens
atgaagcatgta

SEQ ID NO: 6665942 - DNA, 13 bp, Homo sapiens
atgaagcatgtag

SEQ ID NO: 6665943 - DNA, 12 bp, Homo sapiens
atgaagcccaag

SEQ ID NO: 6665944 - DNA, 15 bp, Homo sapiens
atgaagcccaagtga

SEQ ID NO: 6665945 - DNA, 21 bp, Homo sapiens
atgaagccctaagtaaatcta

SEQ ID NO: 6665946 - DNA, 23 bp, Homo sapiens
atgaagccgaccttagatttagt

SEQ ID NO: 6665947 - DNA, 16 bp, Homo sapiens
atgaagcctgtgccac

SEQ ID NO: 6665948 - DNA, 18 bp, Homo sapiens
atgaagcctgtgccacct

SEQ ID NO: 6665949 - DNA, 23 bp, Homo sapiens
atgaagcctgtgccacctgcaag

SEQ ID NO: 6665950 - DNA, 17 bp, Homo sapiens
atgaagccttgctgaac

SEQ ID NO: 6665951 - DNA, 20 bp, Homo sapiens
atgaagccttttgaaaggga

SEQ ID NO: 6665952 - DNA, 15 bp, Homo sapiens
atgaagctaatgtga

SEQ ID NO: 6665953 - DNA, 19 bp, Homo sapiens
atgaagctgacaatttatg

SEQ ID NO: 6665954 - DNA, 18 bp, Homo sapiens
atgaagctgaggctgctg

SEQ ID NO: 6665955 - DNA, 12 bp, Homo sapiens
atgaagctgcca

SEQ ID NO: 6665956 - DNA, 14 bp, Homo sapiens
atgaagctgtataa

SEQ ID NO: 6665957 - DNA, 22 bp, Homo sapiens
atgaagctgtataattaattgt

SEQ ID NO: 6665958 - DNA, 23 bp, Homo sapiens
atgaagctttatacgtgtagcta

SEQ ID NO: 6665959 - DNA, 20 bp, Homo sapiens
atgaagcttttatgtgaaac

SEQ ID NO: 6665960 - DNA, 21 bp, Homo sapiens
atgaagcttttatgtgaaaca

SEQ ID NO: 6665961 - DNA, 22 bp, Homo sapiens
atgaagcttttatgtgaaacat

SEQ ID NO: 6665962 - DNA, 16 bp, Homo sapiens
atgaaggaaatgaacc

SEQ ID NO: 6665963 - DNA, 20 bp, Homo sapiens
atgaaggactattaattcca

SEQ ID NO: 6665964 - DNA, 16 bp, Homo sapiens
atgaaggagacagcag

SEQ ID NO: 6665965 - DNA, 17 bp, Homo sapiens
atgaaggagacagcagc

SEQ ID NO: 6665966 - DNA, 22 bp, Homo sapiens
atgaaggatccatctttgtata

SEQ ID NO: 6665967 - DNA, 16 bp, Homo sapiens
atgaaggcaaaaaaat

SEQ ID NO: 6665968 - DNA, 14 bp, Homo sapiens
atgaaggcacctgc

SEQ ID NO: 6665969 - DNA, 23 bp, Homo sapiens
atgaaggcacctgcccccacagc

SEQ ID NO: 6665970 - DNA, 18 bp, Homo sapiens
atgaaggcatatttccaa

SEQ ID NO: 6665971 - DNA, 23 bp, Homo sapiens
atgaaggcatatttccaataact

SEQ ID NO: 6665972 - DNA, 22 bp, Homo sapiens
atgaaggctggaaggcagcagg

SEQ ID NO: 6665973 - DNA, 17 bp, Homo sapiens
atgaagggaaaggatat

SEQ ID NO: 6665974 - DNA, 15 bp, Homo sapiens
atgaagggaaattgt

SEQ ID NO: 6665975 - DNA, 19 bp, Homo sapiens
atgaagggaaattgtttat

SEQ ID NO: 6665976 - DNA, 21 bp, Homo sapiens
atgaagggacggctgtgggac

SEQ ID NO: 6665977 - DNA, 17 bp, Homo sapiens
atgaagggagggtccct

SEQ ID NO: 6665978 - DNA, 19 bp, Homo sapiens
atgaaggggccagaccacg

SEQ ID NO: 6665979 - DNA, 21 bp, Homo sapiens
atgaaggtcatctttttcccc

SEQ ID NO: 6665980 - DNA, 23 bp, Homo sapiens
atgaaggtgtgctacagaaaata

SEQ ID NO: 6665981 - DNA, 21 bp, Homo sapiens
atgaaggttaggatttaacag

SEQ ID NO: 6665982 - DNA, 22 bp, Homo sapiens
atgaaggttaggatttaacagt

SEQ ID NO: 6665983 - DNA, 17 bp, Homo sapiens
atgaaggtttctgaaaa

SEQ ID NO: 6665984 - DNA, 13 bp, Homo sapiens
atgaagtaaagaa

SEQ ID NO: 6665985 - DNA, 22 bp, Homo sapiens
atgaagtaaagccattaaatga

SEQ ID NO: 6665986 - DNA, 14 bp, Homo sapiens
atgaagtaatatgc

SEQ ID NO: 6665987 - DNA, 21 bp, Homo sapiens
atgaagtataaacccattttg

SEQ ID NO: 6665988 - DNA, 14 bp, Homo sapiens
atgaagtatacttt

SEQ ID NO: 6665989 - DNA, 14 bp, Homo sapiens
atgaagtatataat

SEQ ID NO: 6665990 - DNA, 17 bp, Homo sapiens
atgaagtatctaaaagt

SEQ ID NO: 6665991 - DNA, 15 bp, Homo sapiens
atgaagtattaaaat

SEQ ID NO: 6665992 - DNA, 16 bp, Homo sapiens
atgaagtattacatga

SEQ ID NO: 6665993 - DNA, 20 bp, Homo sapiens
atgaagtattacatgattta

SEQ ID NO: 6665994 - DNA, 16 bp, Homo sapiens
atgaagtatttcatgt

SEQ ID NO: 6665995 - DNA, 17 bp, Homo sapiens
atgaagtatttcatgta

SEQ ID NO: 6665996 - DNA, 17 bp, Homo sapiens
atgaagtcactattttg

SEQ ID NO: 6665997 - DNA, 20 bp, Homo sapiens
atgaagtctgagggaaacca

SEQ ID NO: 6665998 - DNA, 22 bp, Homo sapiens
atgaagtctgagggaaaccaga

SEQ ID NO: 6665999 - DNA, 19 bp, Homo sapiens
atgaagtgcacaggagcca

SEQ ID NO: 6666000 - DNA, 20 bp, Homo sapiens
atgaagtgcgtgaatgtatg

SEQ ID NO: 6666001 - DNA, 16 bp, Homo sapiens
atgaagtgttttacaa

SEQ ID NO: 6666002 - DNA, 17 bp, Homo sapiens
atgaagtgttttacaat

SEQ ID NO: 6666003 - DNA, 19 bp, Homo sapiens
atgaagtgttttacaatga

SEQ ID NO: 6666004 - DNA, 20 bp, Homo sapiens
atgaagttactttcttaatg

SEQ ID NO: 6666005 - DNA, 13 bp, Homo sapiens
atgaagttgctgt

SEQ ID NO: 6666006 - DNA, 19 bp, Homo sapiens
atgaagttgctgtttattt

SEQ ID NO: 6666007 - DNA, 21 bp, Homo sapiens
atgaagttggcacatttcatg

SEQ ID NO: 6666008 - DNA, 14 bp, Homo sapiens
atgaagtttataca

SEQ ID NO: 6666009 - DNA, 15 bp, Homo sapiens
atgaagtttatacag

SEQ ID NO: 6666010 - DNA, 13 bp, Homo sapiens
atgaagtttgaat

SEQ ID NO: 6666011 - DNA, 14 bp, Homo sapiens
atgaagtttgaatg

SEQ ID NO: 6666012 - DNA, 16 bp, Homo sapiens
atgaagtttgaatgtt

SEQ ID NO: 6666013 - DNA, 19 bp, Homo sapiens
atgaagtttgaatgttaaa

SEQ ID NO: 6666014 - DNA, 14 bp, Homo sapiens
atgaagttttacat

SEQ ID NO: 6666015 - DNA, 16 bp, Homo sapiens
atgaagttttacattg

SEQ ID NO: 6666016 - DNA, 14 bp, Homo sapiens
atgaagtttttaaa

SEQ ID NO: 6666017 - DNA, 16 bp, Homo sapiens
atgaagtttttaaaaa

SEQ ID NO: 6666018 - DNA, 14 bp, Homo sapiens
atgaataaaaataa

SEQ ID NO: 6666019 - DNA, 20 bp, Homo sapiens
atgaataaaaataaagtttt

SEQ ID NO: 6666020 - DNA, 20 bp, Homo sapiens
atgaataaaacaataaatga

SEQ ID NO: 6666021 - DNA, 15 bp, Homo sapiens
atgaataaaacactc

SEQ ID NO: 6666022 - DNA, 17 bp, Homo sapiens
atgaataaaaggctgga

SEQ ID NO: 6666023 - DNA, 12 bp, Homo sapiens
atgaataaaata

SEQ ID NO: 6666024 - DNA, 22 bp, Homo sapiens
atgaataaaattgttatttcaa

SEQ ID NO: 6666025 - DNA, 23 bp, Homo sapiens
atgaataaactgaatattttgga

SEQ ID NO: 6666026 - DNA, 14 bp, Homo sapiens
atgaataaagtgca

SEQ ID NO: 6666027 - DNA, 12 bp, Homo sapiens
atgaataaatcc

SEQ ID NO: 6666028 - DNA, 22 bp, Homo sapiens
atgaataagctttctctcagaa

SEQ ID NO: 6666029 - DNA, 20 bp, Homo sapiens
atgaataatgcctttgtaac

SEQ ID NO: 6666030 - DNA, 13 bp, Homo sapiens
atgaataatggaa

SEQ ID NO: 6666031 - DNA, 14 bp, Homo sapiens
atgaataatggaaa

SEQ ID NO: 6666032 - DNA, 20 bp, Homo sapiens
atgaataatggaaaatgcca

SEQ ID NO: 6666033 - DNA, 16 bp, Homo sapiens
atgaataatttattat

SEQ ID NO: 6666034 - DNA, 17 bp, Homo sapiens
atgaatacagcagcaag

SEQ ID NO: 6666035 - DNA, 15 bp, Homo sapiens
atgaatacagcattt

SEQ ID NO: 6666036 - DNA, 17 bp, Homo sapiens
atgaatacgagcaagct

SEQ ID NO: 6666037 - DNA, 21 bp, Homo sapiens
atgaatactgtattttgtatt

SEQ ID NO: 6666038 - DNA, 16 bp, Homo sapiens
atgaatagacataaat

SEQ ID NO: 6666039 - DNA, 22 bp, Homo sapiens
atgaatagacataaattgtaat

SEQ ID NO: 6666040 - DNA, 23 bp, Homo sapiens
atgaatagacataaattgtaatt

SEQ ID NO: 6666041 - DNA, 22 bp, Homo sapiens
atgaatagactatctagaactt

SEQ ID NO: 6666042 - DNA, 13 bp, Homo sapiens
atgaatagctgtg

SEQ ID NO: 6666043 - DNA, 16 bp, Homo sapiens
atgaatagcttgtttc

SEQ ID NO: 6666044 - DNA, 21 bp, Homo sapiens
atgaatatcaagaatagttgt

SEQ ID NO: 6666045 - DNA, 12 bp, Homo sapiens
atgaatatcagg

SEQ ID NO: 6666046 - DNA, 12 bp, Homo sapiens
atgaatatcatt

SEQ ID NO: 6666047 - DNA, 18 bp, Homo sapiens
atgaatatctattaatat

SEQ ID NO: 6666048 - DNA, 19 bp, Homo sapiens
atgaatatctattaatata

SEQ ID NO: 6666049 - DNA, 17 bp, Homo sapiens
atgaatattgaagtttc

SEQ ID NO: 6666050 - DNA, 21 bp, Homo sapiens
atgaatattgatgttaacaag

SEQ ID NO: 6666051 - DNA, 12 bp, Homo sapiens
atgaatatttat

SEQ ID NO: 6666052 - DNA, 15 bp, Homo sapiens
atgaatatttcttaa

SEQ ID NO: 6666053 - DNA, 20 bp, Homo sapiens
atgaatattttcaagttttt

SEQ ID NO: 6666054 - DNA, 23 bp, Homo sapiens
atgaatattttcaagtttttcat

SEQ ID NO: 6666055 - DNA, 13 bp, Homo sapiens
atgaatattttga

SEQ ID NO: 6666056 - DNA, 14 bp, Homo sapiens
atgaatattttgat

SEQ ID NO: 6666057 - DNA, 15 bp, Homo sapiens
atgaatattttgata

SEQ ID NO: 6666058 - DNA, 22 bp, Homo sapiens
atgaatattttgataataatat

SEQ ID NO: 6666059 - DNA, 13 bp, Homo sapiens
atgaatcactgtg

SEQ ID NO: 6666060 - DNA, 14 bp, Homo sapiens
atgaatcagaacag

SEQ ID NO: 6666061 - DNA, 17 bp, Homo sapiens
atgaatccaaatgtgaa

SEQ ID NO: 6666062 - DNA, 15 bp, Homo sapiens
atgaatccaacgtgt

SEQ ID NO: 6666063 - DNA, 20 bp, Homo sapiens
atgaatccattggagaagcg

SEQ ID NO: 6666064 - DNA, 17 bp, Homo sapiens
atgaatccccgaccccc

SEQ ID NO: 6666065 - DNA, 19 bp, Homo sapiens
atgaatccccgacccccct

SEQ ID NO: 6666066 - DNA, 15 bp, Homo sapiens
atgaatcgcttctct

SEQ ID NO: 6666067 - DNA, 14 bp, Homo sapiens
atgaatctaagcag

SEQ ID NO: 6666068 - DNA, 16 bp, Homo sapiens
atgaatctaagcagca

SEQ ID NO: 6666069 - DNA, 14 bp, Homo sapiens
atgaatctacattt

SEQ ID NO: 6666070 - DNA, 15 bp, Homo sapiens
atgaatctacatttg

SEQ ID NO: 6666071 - DNA, 21 bp, Homo sapiens
atgaatctatgccaaagatca

SEQ ID NO: 6666072 - DNA, 16 bp, Homo sapiens
atgaatctattatact

SEQ ID NO: 6666073 - DNA, 16 bp, Homo sapiens
atgaatctctgcctct

SEQ ID NO: 6666074 - DNA, 18 bp, Homo sapiens
atgaatctgcacatctgt

SEQ ID NO: 6666075 - DNA, 17 bp, Homo sapiens
atgaatctgctcacttt

SEQ ID NO: 6666076 - DNA, 24 bp, Homo sapiens
atgaatctgtctcccagttatgaa

SEQ ID NO: 6666077 - DNA, 18 bp, Homo sapiens
atgaatctgtgctggcca

SEQ ID NO: 6666078 - DNA, 21 bp, Homo sapiens
atgaatcttatgcaaaacttt

SEQ ID NO: 6666079 - DNA, 14 bp, Homo sapiens
atgaatctttgact

SEQ ID NO: 6666080 - DNA, 17 bp, Homo sapiens
atgaatctttgactgaa

SEQ ID NO: 6666081 - DNA, 18 bp, Homo sapiens
atgaatctttgactgaag

SEQ ID NO: 6666082 - DNA, 12 bp, Homo sapiens
atgaatgaaaat

SEQ ID NO: 6666083 - DNA, 13 bp, Homo sapiens
atgaatgaaaata

SEQ ID NO: 6666084 - DNA, 21 bp, Homo sapiens
atgaatgaaatataaactgtg

SEQ ID NO: 6666085 - DNA, 22 bp, Homo sapiens
atgaatgaaatataaactgtga

SEQ ID NO: 6666086 - DNA, 13 bp, Homo sapiens
atgaatgaataac

SEQ ID NO: 6666087 - DNA, 14 bp, Homo sapiens
atgaatgaatgaat

SEQ ID NO: 6666088 - DNA, 15 bp, Homo sapiens
atgaatgaatgggat

SEQ ID NO: 6666089 - DNA, 23 bp, Homo sapiens
atgaatgacttccccaatatctt

SEQ ID NO: 6666090 - DNA, 18 bp, Homo sapiens
atgaatgagccaaaatga

SEQ ID NO: 6666091 - DNA, 19 bp, Homo sapiens
atgaatgaggtctgggcta

SEQ ID NO: 6666092 - DNA, 15 bp, Homo sapiens
atgaatgagtctgtt

SEQ ID NO: 6666093 - DNA, 17 bp, Homo sapiens
atgaatgagtgggctgt

SEQ ID NO: 6666094 - DNA, 20 bp, Homo sapiens
atgaatgagttttacaaatt

SEQ ID NO: 6666095 - DNA, 18 bp, Homo sapiens
atgaatgcagattacact

SEQ ID NO: 6666096 - DNA, 18 bp, Homo sapiens
atgaatgcagcactgctg

SEQ ID NO: 6666097 - DNA, 12 bp, Homo sapiens
atgaatgcattg

SEQ ID NO: 6666098 - DNA, 17 bp, Homo sapiens
atgaatgcccaggaagt

SEQ ID NO: 6666099 - DNA, 22 bp, Homo sapiens
atgaatgcccaggaagtaattt

SEQ ID NO: 6666100 - DNA, 18 bp, Homo sapiens
atgaatgcccccagctgg

SEQ ID NO: 6666101 - DNA, 20 bp, Homo sapiens
atgaatgcccccagctggcc

SEQ ID NO: 6666102 - DNA, 16 bp, Homo sapiens
atgaatgcctttcaaa

SEQ ID NO: 6666103 - DNA, 17 bp, Homo sapiens
atgaatgcctttcaaac

SEQ ID NO: 6666104 - DNA, 21 bp, Homo sapiens
atgaatgctattttttccctt

SEQ ID NO: 6666105 - DNA, 20 bp, Homo sapiens
atgaatgcttaaagaattca

SEQ ID NO: 6666106 - DNA, 23 bp, Homo sapiens
atgaatggactcaaactgccttg

SEQ ID NO: 6666107 - DNA, 23 bp, Homo sapiens
atgaatggagatttgaaggtctg

SEQ ID NO: 6666108 - DNA, 22 bp, Homo sapiens
atgaatgggaaagtatttttga

SEQ ID NO: 6666109 - DNA, 19 bp, Homo sapiens
atgaatgggatattttgaa

SEQ ID NO: 6666110 - DNA, 18 bp, Homo sapiens
atgaatgggcaaaactga

SEQ ID NO: 6666111 - DNA, 19 bp, Homo sapiens
atgaatgggcatttctaaa

SEQ ID NO: 6666112 - DNA, 12 bp, Homo sapiens
atgaatggtctg

SEQ ID NO: 6666113 - DNA, 14 bp, Homo sapiens
atgaatgtaaaaga

SEQ ID NO: 6666114 - DNA, 23 bp, Homo sapiens
atgaatgtaaaagacactggtgt

SEQ ID NO: 6666115 - DNA, 15 bp, Homo sapiens
atgaatgtaaggatg

SEQ ID NO: 6666116 - DNA, 19 bp, Homo sapiens
atgaatgtatattttgtgt

SEQ ID NO: 6666117 - DNA, 18 bp, Homo sapiens
atgaatgtatgtgcactg

SEQ ID NO: 6666118 - DNA, 19 bp, Homo sapiens
atgaatgtatgtgcactgt

SEQ ID NO: 6666119 - DNA, 17 bp, Homo sapiens
atgaatgtatttatttg

SEQ ID NO: 6666120 - DNA, 22 bp, Homo sapiens
atgaatgtcacatttgaattct

SEQ ID NO: 6666121 - DNA, 21 bp, Homo sapiens
atgaatgtcacttctggatat

SEQ ID NO: 6666122 - DNA, 16 bp, Homo sapiens
atgaatgtcagtgtga

SEQ ID NO: 6666123 - DNA, 22 bp, Homo sapiens
atgaatgtcttttttcaaactt

SEQ ID NO: 6666124 - DNA, 18 bp, Homo sapiens
atgaatgtgaagccttcc

SEQ ID NO: 6666125 - DNA, 17 bp, Homo sapiens
atgaatgtgcatttctt

SEQ ID NO: 6666126 - DNA, 15 bp, Homo sapiens
atgaatgtgctggtg

SEQ ID NO: 6666127 - DNA, 21 bp, Homo sapiens
atgaatgtgctggtgaacact

SEQ ID NO: 6666128 - DNA, 21 bp, Homo sapiens
atgaatgtgtgtggttttttt

SEQ ID NO: 6666129 - DNA, 22 bp, Homo sapiens
atgaatgtttacactctttgta

SEQ ID NO: 6666130 - DNA, 14 bp, Homo sapiens
atgaattaaatatt

SEQ ID NO: 6666131 - DNA, 17 bp, Homo sapiens
atgaattaaatattgaa

SEQ ID NO: 6666132 - DNA, 13 bp, Homo sapiens
atgaattaaattt

SEQ ID NO: 6666133 - DNA, 23 bp, Homo sapiens
atgaattaagggccagaaaaaag

SEQ ID NO: 6666134 - DNA, 15 bp, Homo sapiens
atgaattaattcaga

SEQ ID NO: 6666135 - DNA, 19 bp, Homo sapiens
atgaattacatttgtataa

SEQ ID NO: 6666136 - DNA, 22 bp, Homo sapiens
atgaattacatttgtataaaat

SEQ ID NO: 6666137 - DNA, 18 bp, Homo sapiens
atgaattactgtatataa

SEQ ID NO: 6666138 - DNA, 21 bp, Homo sapiens
atgaattactgtatataaact

SEQ ID NO: 6666139 - DNA, 23 bp, Homo sapiens
atgaattagaagaaaatggatga

SEQ ID NO: 6666140 - DNA, 17 bp, Homo sapiens
atgaattagttgcattg

SEQ ID NO: 6666141 - DNA, 23 bp, Homo sapiens
atgaattagttttatatgcttct

SEQ ID NO: 6666142 - DNA, 21 bp, Homo sapiens
atgaattattttgataaatta

SEQ ID NO: 6666143 - DNA, 17 bp, Homo sapiens
atgaattcacaaacaaa

SEQ ID NO: 6666144 - DNA, 18 bp, Homo sapiens
atgaattcacaaacaaat

SEQ ID NO: 6666145 - DNA, 22 bp, Homo sapiens
atgaattcccttttaatcaact

SEQ ID NO: 6666146 - DNA, 22 bp, Homo sapiens
atgaattcctacacatggttat

SEQ ID NO: 6666147 - DNA, 21 bp, Homo sapiens
atgaattcgatgcgtattctg

SEQ ID NO: 6666148 - DNA, 18 bp, Homo sapiens
atgaattctctctaaaaa

SEQ ID NO: 6666149 - DNA, 16 bp, Homo sapiens
atgaattctgttgtaa

SEQ ID NO: 6666150 - DNA, 19 bp, Homo sapiens
atgaattctgttgtaattt

SEQ ID NO: 6666151 - DNA, 17 bp, Homo sapiens
atgaattcttatgctta

SEQ ID NO: 6666152 - DNA, 16 bp, Homo sapiens
atgaattcttcaacag

SEQ ID NO: 6666153 - DNA, 15 bp, Homo sapiens
atgaattcttcctct

SEQ ID NO: 6666154 - DNA, 23 bp, Homo sapiens
atgaattcttcctctccttccca

SEQ ID NO: 6666155 - DNA, 20 bp, Homo sapiens
atgaattctttgtttatgca

SEQ ID NO: 6666156 - DNA, 16 bp, Homo sapiens
atgaattgaaaaacaa

SEQ ID NO: 6666157 - DNA, 14 bp, Homo sapiens
atgaattgaatgct

SEQ ID NO: 6666158 - DNA, 13 bp, Homo sapiens
atgaattgcattt

SEQ ID NO: 6666159 - DNA, 12 bp, Homo sapiens
atgaattgcctt

SEQ ID NO: 6666160 - DNA, 21 bp, Homo sapiens
atgaattgcgttggtctctgc

SEQ ID NO: 6666161 - DNA, 21 bp, Homo sapiens
atgaattgctgtctagcctta

SEQ ID NO: 6666162 - DNA, 16 bp, Homo sapiens
atgaattggaactgca

SEQ ID NO: 6666163 - DNA, 21 bp, Homo sapiens
atgaattggaactgcaatgaa

SEQ ID NO: 6666164 - DNA, 22 bp, Homo sapiens
atgaattgggaacattatcaca

SEQ ID NO: 6666165 - DNA, 14 bp, Homo sapiens
atgaattgtacaga

SEQ ID NO: 6666166 - DNA, 14 bp, Homo sapiens
atgaattgtctaaa

SEQ ID NO: 6666167 - DNA, 15 bp, Homo sapiens
atgaatttaaggcaa

SEQ ID NO: 6666168 - DNA, 15 bp, Homo sapiens
atgaatttagaaata

SEQ ID NO: 6666169 - DNA, 23 bp, Homo sapiens
atgaatttatctgaatataggaa

SEQ ID NO: 6666170 - DNA, 16 bp, Homo sapiens
atgaatttatctttac

SEQ ID NO: 6666171 - DNA, 21 bp, Homo sapiens
atgaatttattgcacattgtt

SEQ ID NO: 6666172 - DNA, 12 bp, Homo sapiens
atgaatttctac

SEQ ID NO: 6666173 - DNA, 13 bp, Homo sapiens
atgaatttctcta

SEQ ID NO: 6666174 - DNA, 15 bp, Homo sapiens
atgaatttgactggt

SEQ ID NO: 6666175 - DNA, 21 bp, Homo sapiens
atgaatttggagactctgtgg

SEQ ID NO: 6666176 - DNA, 15 bp, Homo sapiens
atgaatttggtctgc

SEQ ID NO: 6666177 - DNA, 14 bp, Homo sapiens
atgaatttgtaatg

SEQ ID NO: 6666178 - DNA, 13 bp, Homo sapiens
atgaatttgtcca

SEQ ID NO: 6666179 - DNA, 14 bp, Homo sapiens
atgaatttgtccaa

SEQ ID NO: 6666180 - DNA, 22 bp, Homo sapiens
atgaatttgtccatttaaaaat

SEQ ID NO: 6666181 - DNA, 15 bp, Homo sapiens
atgaattttaaaagc

SEQ ID NO: 6666182 - DNA, 14 bp, Homo sapiens
atgaattttaaagt

SEQ ID NO: 6666183 - DNA, 16 bp, Homo sapiens
atgaattttaaagtat

SEQ ID NO: 6666184 - DNA, 16 bp, Homo sapiens
atgaattttaaataat

SEQ ID NO: 6666185 - DNA, 17 bp, Homo sapiens
atgaattttaaataatg

SEQ ID NO: 6666186 - DNA, 13 bp, Homo sapiens
atgaattttacat

SEQ ID NO: 6666187 - DNA, 22 bp, Homo sapiens
atgaattttccacgcagttctt

SEQ ID NO: 6666188 - DNA, 17 bp, Homo sapiens
atgaattttctgcagct

SEQ ID NO: 6666189 - DNA, 18 bp, Homo sapiens
atgaattttctgcagctg

SEQ ID NO: 6666190 - DNA, 23 bp, Homo sapiens
atgaattttgtttggacttcttt

SEQ ID NO: 6666191 - DNA, 16 bp, Homo sapiens
atgaatttttatgatt

SEQ ID NO: 6666192 - DNA, 23 bp, Homo sapiens
atgaatttttttcatcttctctg

SEQ ID NO: 6666193 - DNA, 14 bp, Homo sapiens
atgacaaaaaatgt

SEQ ID NO: 6666194 - DNA, 13 bp, Homo sapiens
atgacaaaaataa

SEQ ID NO: 6666195 - DNA, 14 bp, Homo sapiens
atgacaaaaataac

SEQ ID NO: 6666196 - DNA, 19 bp, Homo sapiens
atgacaaaaataacactgt

SEQ ID NO: 6666197 - DNA, 20 bp, Homo sapiens
atgacaaaagtgacagatgt

SEQ ID NO: 6666198 - DNA, 23 bp, Homo sapiens
atgacaaaatcatctttgtgaag

SEQ ID NO: 6666199 - DNA, 15 bp, Homo sapiens
atgacaaacatgata

SEQ ID NO: 6666200 - DNA, 21 bp, Homo sapiens
atgacaaacatgatactgctg

SEQ ID NO: 6666201 - DNA, 15 bp, Homo sapiens
atgacaaatgaaaga

SEQ ID NO: 6666202 - DNA, 17 bp, Homo sapiens
atgacaaatgaaagaga

SEQ ID NO: 6666203 - DNA, 19 bp, Homo sapiens
atgacaaatgaaagagaaa

SEQ ID NO: 6666204 - DNA, 16 bp, Homo sapiens
atgacaaatgtttcta

SEQ ID NO: 6666205 - DNA, 13 bp, Homo sapiens
atgacaaattata

SEQ ID NO: 6666206 - DNA, 13 bp, Homo sapiens
atgacaacaaatt

SEQ ID NO: 6666207 - DNA, 19 bp, Homo sapiens
atgacaacaaattttggtt

SEQ ID NO: 6666208 - DNA, 17 bp, Homo sapiens
atgacaacactacacgc

SEQ ID NO: 6666209 - DNA, 19 bp, Homo sapiens
atgacaactggaatagttt

SEQ ID NO: 6666210 - DNA, 18 bp, Homo sapiens
atgacaagatgggacagc

SEQ ID NO: 6666211 - DNA, 20 bp, Homo sapiens
atgacaagcaaggtttctgg

SEQ ID NO: 6666212 - DNA, 13 bp, Homo sapiens
atgacaagcattt

SEQ ID NO: 6666213 - DNA, 16 bp, Homo sapiens
atgacaagctgtatca

SEQ ID NO: 6666214 - DNA, 21 bp, Homo sapiens
atgacaaggggagggccagga

SEQ ID NO: 6666215 - DNA, 19 bp, Homo sapiens
atgacaataactaaagcta

SEQ ID NO: 6666216 - DNA, 14 bp, Homo sapiens
atgacaatcaaagc

SEQ ID NO: 6666217 - DNA, 15 bp, Homo sapiens
atgacaatgactgtg

SEQ ID NO: 6666218 - DNA, 14 bp, Homo sapiens
atgacaatgcaatg

SEQ ID NO: 6666219 - DNA, 19 bp, Homo sapiens
atgacaatgcaatgaaaca

SEQ ID NO: 6666220 - DNA, 19 bp, Homo sapiens
atgacaattttttccactt

SEQ ID NO: 6666221 - DNA, 20 bp, Homo sapiens
atgacacaaataccagagca

SEQ ID NO: 6666222 - DNA, 18 bp, Homo sapiens
atgacacaatccctgggg

SEQ ID NO: 6666223 - DNA, 20 bp, Homo sapiens
atgacacaatccctggggct

SEQ ID NO: 6666224 - DNA, 22 bp, Homo sapiens
atgacacataaatctgtctgat

SEQ ID NO: 6666225 - DNA, 15 bp, Homo sapiens
atgacacatttaatg

SEQ ID NO: 6666226 - DNA, 21 bp, Homo sapiens
atgacaccacacttgttttct

SEQ ID NO: 6666227 - DNA, 15 bp, Homo sapiens
atgacaccatctttt

SEQ ID NO: 6666228 - DNA, 16 bp, Homo sapiens
atgacaccatctttta

SEQ ID NO: 6666229 - DNA, 20 bp, Homo sapiens
atgacaccatcttttattct

SEQ ID NO: 6666230 - DNA, 15 bp, Homo sapiens
atgacaccctggcct

SEQ ID NO: 6666231 - DNA, 17 bp, Homo sapiens
atgacacctccatttct

SEQ ID NO: 6666232 - DNA, 19 bp, Homo sapiens
atgacacggtaggccaagc

SEQ ID NO: 6666233 - DNA, 14 bp, Homo sapiens
atgacactgaaatg

SEQ ID NO: 6666234 - DNA, 21 bp, Homo sapiens
atgacactgagaacagatctc

SEQ ID NO: 6666235 - DNA, 22 bp, Homo sapiens
atgacactggaagggtccggct

SEQ ID NO: 6666236 - DNA, 16 bp, Homo sapiens
atgacactgttcagga

SEQ ID NO: 6666237 - DNA, 12 bp, Homo sapiens
atgacacttgta

SEQ ID NO: 6666238 - DNA, 17 bp, Homo sapiens
atgacacttgtacaatt

SEQ ID NO: 6666239 - DNA, 14 bp, Homo sapiens
atgacagaaaatat

SEQ ID NO: 6666240 - DNA, 20 bp, Homo sapiens
atgacagaaatatgattgat

SEQ ID NO: 6666241 - DNA, 19 bp, Homo sapiens
atgacagaaatgacaacaa

SEQ ID NO: 6666242 - DNA, 16 bp, Homo sapiens
atgacagaatatacac

SEQ ID NO: 6666243 - DNA, 13 bp, Homo sapiens
atgacagagagtt

SEQ ID NO: 6666244 - DNA, 14 bp, Homo sapiens
atgacagaggcaag

SEQ ID NO: 6666245 - DNA, 21 bp, Homo sapiens
atgacagataacctaataatt

SEQ ID NO: 6666246 - DNA, 20 bp, Homo sapiens
atgacagatatatttaagcc

SEQ ID NO: 6666247 - DNA, 23 bp, Homo sapiens
atgacagatatatttaagcctta

SEQ ID NO: 6666248 - DNA, 15 bp, Homo sapiens
atgacagatctcaat

SEQ ID NO: 6666249 - DNA, 15 bp, Homo sapiens
atgacagatggtgaa

SEQ ID NO: 6666250 - DNA, 17 bp, Homo sapiens
atgacagattctgacat

SEQ ID NO: 6666251 - DNA, 22 bp, Homo sapiens
atgacagattctgacatttata

SEQ ID NO: 6666252 - DNA, 17 bp, Homo sapiens
atgacagatttctgtaa

SEQ ID NO: 6666253 - DNA, 19 bp, Homo sapiens
atgacagcacctgagaaga

SEQ ID NO: 6666254 - DNA, 15 bp, Homo sapiens
atgacagccaccctc

SEQ ID NO: 6666255 - DNA, 15 bp, Homo sapiens
atgacagccagagcc

SEQ ID NO: 6666256 - DNA, 17 bp, Homo sapiens
atgacagccagagcctg

SEQ ID NO: 6666257 - DNA, 17 bp, Homo sapiens
atgacagccatttgtaa

SEQ ID NO: 6666258 - DNA, 21 bp, Homo sapiens
atgacagccccttaagcatgc

SEQ ID NO: 6666259 - DNA, 23 bp, Homo sapiens
atgacagctactaacctggagac

SEQ ID NO: 6666260 - DNA, 19 bp, Homo sapiens
atgacagctcttctaagga

SEQ ID NO: 6666261 - DNA, 14 bp, Homo sapiens
atgacagctggcta

SEQ ID NO: 6666262 - DNA, 15 bp, Homo sapiens
atgacagctgtccct

SEQ ID NO: 6666263 - DNA, 17 bp, Homo sapiens
atgacagctgtccctgt

SEQ ID NO: 6666264 - DNA, 18 bp, Homo sapiens
atgacaggaacccatcac

SEQ ID NO: 6666265 - DNA, 22 bp, Homo sapiens
atgacaggaacccatcactgtg

SEQ ID NO: 6666266 - DNA, 20 bp, Homo sapiens
atgacaggcatccaaggaag

SEQ ID NO: 6666267 - DNA, 24 bp, Homo sapiens
atgacaggcctgaagatattacta

SEQ ID NO: 6666268 - DNA, 21 bp, Homo sapiens
atgacaggcgcctgccatcat

SEQ ID NO: 6666269 - DNA, 15 bp, Homo sapiens
atgacaggctctcct

SEQ ID NO: 6666270 - DNA, 21 bp, Homo sapiens
atgacaggctctcctggctgt

SEQ ID NO: 6666271 - DNA, 17 bp, Homo sapiens
atgacaggctgttcagc

SEQ ID NO: 6666272 - DNA, 20 bp, Homo sapiens
atgacagtaattgtgtttac

SEQ ID NO: 6666273 - DNA, 21 bp, Homo sapiens
atgacagtaattgtgtttaca

SEQ ID NO: 6666274 - DNA, 15 bp, Homo sapiens
atgacagtagcatac

SEQ ID NO: 6666275 - DNA, 17 bp, Homo sapiens
atgacagtagcatactg

SEQ ID NO: 6666276 - DNA, 21 bp, Homo sapiens
atgacagtagcatactgatga

SEQ ID NO: 6666277 - DNA, 22 bp, Homo sapiens
atgacagtccgtcaaaacagat

SEQ ID NO: 6666278 - DNA, 11 bp, Homo sapiens
atgacagtgaa

SEQ ID NO: 6666279 - DNA, 17 bp, Homo sapiens
atgacagtgcttgcatc

SEQ ID NO: 6666280 - DNA, 20 bp, Homo sapiens
atgacagtggaagttttttt

SEQ ID NO: 6666281 - DNA, 20 bp, Homo sapiens
atgacagtggttatatttca

SEQ ID NO: 6666282 - DNA, 21 bp, Homo sapiens
atgacagtggttatatttcaa

SEQ ID NO: 6666283 - DNA, 19 bp, Homo sapiens
atgacataaaaacaacttt

SEQ ID NO: 6666284 - DNA, 23 bp, Homo sapiens
atgacatacgcttttaatgaaaa

SEQ ID NO: 6666285 - DNA, 20 bp, Homo sapiens
atgacatattttatcttgtt

SEQ ID NO: 6666286 - DNA, 12 bp, Homo sapiens
atgacatcaaaa

SEQ ID NO: 6666287 - DNA, 18 bp, Homo sapiens
atgacatcacttgtacaa

SEQ ID NO: 6666288 - DNA, 13 bp, Homo sapiens
atgacatccacat

SEQ ID NO: 6666289 - DNA, 14 bp, Homo sapiens
atgacatccacatg

SEQ ID NO: 6666290 - DNA, 19 bp, Homo sapiens
atgacatccagaaagctga

SEQ ID NO: 6666291 - DNA, 20 bp, Homo sapiens
atgacatccagaaagctgag

SEQ ID NO: 6666292 - DNA, 22 bp, Homo sapiens
atgacatctacgaagccacagg

SEQ ID NO: 6666293 - DNA, 24 bp, Homo sapiens
atgacatcttcaaagcttgaagat

SEQ ID NO: 6666294 - DNA, 14 bp, Homo sapiens
atgacatcttttta

SEQ ID NO: 6666295 - DNA, 18 bp, Homo sapiens
atgacatgaacaatgtgt

SEQ ID NO: 6666296 - DNA, 12 bp, Homo sapiens
atgacatgaatt

SEQ ID NO: 6666297 - DNA, 21 bp, Homo sapiens
atgacatgaattttagctttt

SEQ ID NO: 6666298 - DNA, 15 bp, Homo sapiens
atgacatgacctttc

SEQ ID NO: 6666299 - DNA, 22 bp, Homo sapiens
atgacatgaggaaaataatgta

SEQ ID NO: 6666300 - DNA, 18 bp, Homo sapiens
atgacatgcactgaccct

SEQ ID NO: 6666301 - DNA, 15 bp, Homo sapiens
atgacatgttatata

SEQ ID NO: 6666302 - DNA, 23 bp, Homo sapiens
atgacattaaatgcaataatttt

SEQ ID NO: 6666303 - DNA, 15 bp, Homo sapiens
atgacattatgtgga

SEQ ID NO: 6666304 - DNA, 15 bp, Homo sapiens
atgacattattaaag

SEQ ID NO: 6666305 - DNA, 14 bp, Homo sapiens
atgacattccctgc

SEQ ID NO: 6666306 - DNA, 22 bp, Homo sapiens
atgacatttatatcacatgttt

SEQ ID NO: 6666307 - DNA, 15 bp, Homo sapiens
atgacatttcatctg

SEQ ID NO: 6666308 - DNA, 22 bp, Homo sapiens
atgacatttctttgtgctttgg

SEQ ID NO: 6666309 - DNA, 19 bp, Homo sapiens
atgacatttgtcctgcaga

SEQ ID NO: 6666310 - DNA, 13 bp, Homo sapiens
atgacattttaaa

SEQ ID NO: 6666311 - DNA, 17 bp, Homo sapiens
atgacattttgccaaaa

SEQ ID NO: 6666312 - DNA, 11 bp, Homo sapiens
atgacattttt

SEQ ID NO: 6666313 - DNA, 21 bp, Homo sapiens
atgacattttttttaactact

SEQ ID NO: 6666314 - DNA, 12 bp, Homo sapiens
atgaccaaaaac

SEQ ID NO: 6666315 - DNA, 15 bp, Homo sapiens
atgaccaaaaaccaa

SEQ ID NO: 6666316 - DNA, 17 bp, Homo sapiens
atgaccaaaaaccaaaa

SEQ ID NO: 6666317 - DNA, 18 bp, Homo sapiens
atgaccaaaccagccttc

SEQ ID NO: 6666318 - DNA, 12 bp, Homo sapiens
atgaccaaagat

SEQ ID NO: 6666319 - DNA, 16 bp, Homo sapiens
atgaccaacctgtttc

SEQ ID NO: 6666320 - DNA, 20 bp, Homo sapiens
atgaccaagaaaaagaaaaa

SEQ ID NO: 6666321 - DNA, 12 bp, Homo sapiens
atgaccaagaat

SEQ ID NO: 6666322 - DNA, 20 bp, Homo sapiens
atgaccaatcctatgtcatt

SEQ ID NO: 6666323 - DNA, 20 bp, Homo sapiens
atgaccacacccgaagtcct

SEQ ID NO: 6666324 - DNA, 22 bp, Homo sapiens
atgaccacacccgaagtcctgt

SEQ ID NO: 6666325 - DNA, 20 bp, Homo sapiens
atgaccacgggcctcagttt

SEQ ID NO: 6666326 - DNA, 21 bp, Homo sapiens
atgaccacgggcctcagtttc

SEQ ID NO: 6666327 - DNA, 16 bp, Homo sapiens
atgaccactgggcctg

SEQ ID NO: 6666328 - DNA, 21 bp, Homo sapiens
atgaccactgggcctgctagt

SEQ ID NO: 6666329 - DNA, 14 bp, Homo sapiens
atgaccagaaacag

SEQ ID NO: 6666330 - DNA, 12 bp, Homo sapiens
atgaccagaagc

SEQ ID NO: 6666331 - DNA, 14 bp, Homo sapiens
atgaccagcaaata

SEQ ID NO: 6666332 - DNA, 21 bp, Homo sapiens
atgaccagcagcagctttcag

SEQ ID NO: 6666333 - DNA, 23 bp, Homo sapiens
atgaccagcagcagctttcagct

SEQ ID NO: 6666334 - DNA, 21 bp, Homo sapiens
atgaccagcaggagggaagga

SEQ ID NO: 6666335 - DNA, 13 bp, Homo sapiens
atgaccaggacta

SEQ ID NO: 6666336 - DNA, 19 bp, Homo sapiens
atgaccagggatgctgggc

SEQ ID NO: 6666337 - DNA, 13 bp, Homo sapiens
atgaccagtaaag

SEQ ID NO: 6666338 - DNA, 13 bp, Homo sapiens
atgaccagtttac

SEQ ID NO: 6666339 - DNA, 17 bp, Homo sapiens
atgaccatactgaggga

SEQ ID NO: 6666340 - DNA, 23 bp, Homo sapiens
atgaccatatttactctttctaa

SEQ ID NO: 6666341 - DNA, 22 bp, Homo sapiens
atgaccatccagtagagatttc

SEQ ID NO: 6666342 - DNA, 14 bp, Homo sapiens
atgaccatcctgtc

SEQ ID NO: 6666343 - DNA, 15 bp, Homo sapiens
atgaccatgttatat

SEQ ID NO: 6666344 - DNA, 12 bp, Homo sapiens
atgacccacccc

SEQ ID NO: 6666345 - DNA, 13 bp, Homo sapiens
atgacccacccct

SEQ ID NO: 6666346 - DNA, 14 bp, Homo sapiens
atgacccacccctg

SEQ ID NO: 6666347 - DNA, 16 bp, Homo sapiens
atgacccacccctgtg

SEQ ID NO: 6666348 - DNA, 12 bp, Homo sapiens
atgacccagacc

SEQ ID NO: 6666349 - DNA, 12 bp, Homo sapiens
atgacccaggct

SEQ ID NO: 6666350 - DNA, 16 bp, Homo sapiens
atgacccccccagctt

SEQ ID NO: 6666351 - DNA, 18 bp, Homo sapiens
atgacccctaccccctca

SEQ ID NO: 6666352 - DNA, 23 bp, Homo sapiens
atgacccctcgtccaccccccac

SEQ ID NO: 6666353 - DNA, 14 bp, Homo sapiens
atgacccctggcca

SEQ ID NO: 6666354 - DNA, 17 bp, Homo sapiens
atgacccctggccacag

SEQ ID NO: 6666355 - DNA, 20 bp, Homo sapiens
atgacccctggccacagcct

SEQ ID NO: 6666356 - DNA, 23 bp, Homo sapiens
atgacccctggccacagccttcc

SEQ ID NO: 6666357 - DNA, 18 bp, Homo sapiens
atgaccccttctctctcc

SEQ ID NO: 6666358 - DNA, 22 bp, Homo sapiens
atgacccggcccccgccctctg

SEQ ID NO: 6666359 - DNA, 16 bp, Homo sapiens
atgacccgtacacacc

SEQ ID NO: 6666360 - DNA, 15 bp, Homo sapiens
atgaccctcctgtcc

SEQ ID NO: 6666361 - DNA, 19 bp, Homo sapiens
atgaccctctgtccccagg

SEQ ID NO: 6666362 - DNA, 14 bp, Homo sapiens
atgaccctgcctct

SEQ ID NO: 6666363 - DNA, 23 bp, Homo sapiens
atgaccctgcctctcccaggcag

SEQ ID NO: 6666364 - DNA, 13 bp, Homo sapiens
atgaccctgggct

SEQ ID NO: 6666365 - DNA, 13 bp, Homo sapiens
atgaccctgtgcc

SEQ ID NO: 6666366 - DNA, 14 bp, Homo sapiens
atgaccctgtgcct

SEQ ID NO: 6666367 - DNA, 15 bp, Homo sapiens
atgaccctgtgcctg

SEQ ID NO: 6666368 - DNA, 17 bp, Homo sapiens
atgaccctgtgcctgtg

SEQ ID NO: 6666369 - DNA, 18 bp, Homo sapiens
atgacccttttgtgtcta

SEQ ID NO: 6666370 - DNA, 15 bp, Homo sapiens
atgaccgagccctgg

SEQ ID NO: 6666371 - DNA, 17 bp, Homo sapiens
atgaccgagccctggag

SEQ ID NO: 6666372 - DNA, 19 bp, Homo sapiens
atgaccgagccctggagag

SEQ ID NO: 6666373 - DNA, 14 bp, Homo sapiens
atgaccgtgtacaa

SEQ ID NO: 6666374 - DNA, 14 bp, Homo sapiens
atgacctaaatcca

SEQ ID NO: 6666375 - DNA, 21 bp, Homo sapiens
atgacctaaatccattttcta

SEQ ID NO: 6666376 - DNA, 22 bp, Homo sapiens
atgacctaattgatagcaggtg

SEQ ID NO: 6666377 - DNA, 21 bp, Homo sapiens
atgacctacagtgctgtgtac

SEQ ID NO: 6666378 - DNA, 18 bp, Homo sapiens
atgacctagttttccatg

SEQ ID NO: 6666379 - DNA, 18 bp, Homo sapiens
atgacctcaaggaagcta

SEQ ID NO: 6666380 - DNA, 22 bp, Homo sapiens
atgacctcaccatttttgttct

SEQ ID NO: 6666381 - DNA, 20 bp, Homo sapiens
atgacctcattaaccgatgc

SEQ ID NO: 6666382 - DNA, 15 bp, Homo sapiens
atgacctccagaagt

SEQ ID NO: 6666383 - DNA, 13 bp, Homo sapiens
atgacctccattt

SEQ ID NO: 6666384 - DNA, 13 bp, Homo sapiens
atgacctcccctc

SEQ ID NO: 6666385 - DNA, 18 bp, Homo sapiens
atgacctcccctccccag

SEQ ID NO: 6666386 - DNA, 18 bp, Homo sapiens
atgacctcgtactcagga

SEQ ID NO: 6666387 - DNA, 21 bp, Homo sapiens
atgacctcgtactcaggagcc

SEQ ID NO: 6666388 - DNA, 18 bp, Homo sapiens
atgacctcttcctttagg

SEQ ID NO: 6666389 - DNA, 16 bp, Homo sapiens
atgacctgaggaaagg

SEQ ID NO: 6666390 - DNA, 14 bp, Homo sapiens
atgacctggataac

SEQ ID NO: 6666391 - DNA, 21 bp, Homo sapiens
atgacctgtgaccagcactgt

SEQ ID NO: 6666392 - DNA, 20 bp, Homo sapiens
atgaccttatcagcttcctg

SEQ ID NO: 6666393 - DNA, 13 bp, Homo sapiens
atgaccttcccag

SEQ ID NO: 6666394 - DNA, 15 bp, Homo sapiens
atgaccttcccaggg

SEQ ID NO: 6666395 - DNA, 15 bp, Homo sapiens
atgacctttcaatag

SEQ ID NO: 6666396 - DNA, 19 bp, Homo sapiens
atgaccttttggcctttgt

SEQ ID NO: 6666397 - DNA, 16 bp, Homo sapiens
atgacgacaaagctgc

SEQ ID NO: 6666398 - DNA, 14 bp, Homo sapiens
atgacgcggctcaa

SEQ ID NO: 6666399 - DNA, 17 bp, Homo sapiens
atgacgctgatacataa

SEQ ID NO: 6666400 - DNA, 15 bp, Homo sapiens
atgacggccaggctc

SEQ ID NO: 6666401 - DNA, 16 bp, Homo sapiens
atgacgggatgctctt

SEQ ID NO: 6666402 - DNA, 20 bp, Homo sapiens
atgacggtattatgcttctt

SEQ ID NO: 6666403 - DNA, 21 bp, Homo sapiens
atgacggtgttaattttgcta

SEQ ID NO: 6666404 - DNA, 23 bp, Homo sapiens
atgacgtacaagtagttctgtat

SEQ ID NO: 6666405 - DNA, 14 bp, Homo sapiens
atgacgtgcacaaa

SEQ ID NO: 6666406 - DNA, 17 bp, Homo sapiens
atgacgtgcacaaacct

SEQ ID NO: 6666407 - DNA, 18 bp, Homo sapiens
atgacgtgcacaaacctt

SEQ ID NO: 6666408 - DNA, 19 bp, Homo sapiens
atgacgtgcacaaaccttc

SEQ ID NO: 6666409 - DNA, 23 bp, Homo sapiens
atgacgtgcacaaaccttctttt

SEQ ID NO: 6666410 - DNA, 15 bp, Homo sapiens
atgacgtgtgtggct

SEQ ID NO: 6666411 - DNA, 11 bp, Homo sapiens
atgactaaaga

SEQ ID NO: 6666412 - DNA, 12 bp, Homo sapiens
atgactaaagta

SEQ ID NO: 6666413 - DNA, 20 bp, Homo sapiens
atgactaaattttcttttaa

SEQ ID NO: 6666414 - DNA, 13 bp, Homo sapiens
atgactaatcctt

SEQ ID NO: 6666415 - DNA, 17 bp, Homo sapiens
atgactaatccttaata

SEQ ID NO: 6666416 - DNA, 13 bp, Homo sapiens
atgactaattagg

SEQ ID NO: 6666417 - DNA, 14 bp, Homo sapiens
atgactaattcagg

SEQ ID NO: 6666418 - DNA, 16 bp, Homo sapiens
atgactaattcttgca

SEQ ID NO: 6666419 - DNA, 18 bp, Homo sapiens
atgactacctcagaacat

SEQ ID NO: 6666420 - DNA, 18 bp, Homo sapiens
atgactagaaagtgaata

SEQ ID NO: 6666421 - DNA, 19 bp, Homo sapiens
atgactagggtcctcaggc

SEQ ID NO: 6666422 - DNA, 16 bp, Homo sapiens
atgactataaacatta

SEQ ID NO: 6666423 - DNA, 15 bp, Homo sapiens
atgactatgtaaact

SEQ ID NO: 6666424 - DNA, 16 bp, Homo sapiens
atgactatgtaaacta

SEQ ID NO: 6666425 - DNA, 13 bp, Homo sapiens
atgactatgtcca

SEQ ID NO: 6666426 - DNA, 15 bp, Homo sapiens
atgactattgtaatg

SEQ ID NO: 6666427 - DNA, 13 bp, Homo sapiens
atgactcaaagat

SEQ ID NO: 6666428 - DNA, 20 bp, Homo sapiens
atgactcaagattcccagga

SEQ ID NO: 6666429 - DNA, 21 bp, Homo sapiens
atgactcaagattcccaggag

SEQ ID NO: 6666430 - DNA, 14 bp, Homo sapiens
atgactcagaatat

SEQ ID NO: 6666431 - DNA, 17 bp, Homo sapiens
atgactcatgcctctga

SEQ ID NO: 6666432 - DNA, 12 bp, Homo sapiens
atgactccagaa

SEQ ID NO: 6666433 - DNA, 17 bp, Homo sapiens
atgactccagaatttcc

SEQ ID NO: 6666434 - DNA, 17 bp, Homo sapiens
atgactccatagacctt

SEQ ID NO: 6666435 - DNA, 16 bp, Homo sapiens
atgactcgaaactgac

SEQ ID NO: 6666436 - DNA, 22 bp, Homo sapiens
atgactcgaaactgacagtatt

SEQ ID NO: 6666437 - DNA, 24 bp, Homo sapiens
atgactctgcctaaccatgggctc

SEQ ID NO: 6666438 - DNA, 18 bp, Homo sapiens
atgactcttccctcaaat

SEQ ID NO: 6666439 - DNA, 13 bp, Homo sapiens
atgactcttctta

SEQ ID NO: 6666440 - DNA, 16 bp, Homo sapiens
atgactcttcttatca

SEQ ID NO: 6666441 - DNA, 18 bp, Homo sapiens
atgactcttgactcttgc

SEQ ID NO: 6666442 - DNA, 16 bp, Homo sapiens
atgactctttctgaag

SEQ ID NO: 6666443 - DNA, 21 bp, Homo sapiens
atgactctttctgaaggaaga

SEQ ID NO: 6666444 - DNA, 14 bp, Homo sapiens
atgactgaaagaag

SEQ ID NO: 6666445 - DNA, 15 bp, Homo sapiens
atgactgaagggaaa

SEQ ID NO: 6666446 - DNA, 16 bp, Homo sapiens
atgactgaagtaataa

SEQ ID NO: 6666447 - DNA, 18 bp, Homo sapiens
atgactgaagtaataact

SEQ ID NO: 6666448 - DNA, 18 bp, Homo sapiens
atgactgacactcagatg

SEQ ID NO: 6666449 - DNA, 20 bp, Homo sapiens
atgactgacccaaaatgtga

SEQ ID NO: 6666450 - DNA, 21 bp, Homo sapiens
atgactgagatttgtaaatct

SEQ ID NO: 6666451 - DNA, 23 bp, Homo sapiens
atgactgcacccagctccagggg

SEQ ID NO: 6666452 - DNA, 15 bp, Homo sapiens
atgactgccaagact

SEQ ID NO: 6666453 - DNA, 16 bp, Homo sapiens
atgactgccaagactg

SEQ ID NO: 6666454 - DNA, 21 bp, Homo sapiens
atgactgccccttgcttctca

SEQ ID NO: 6666455 - DNA, 17 bp, Homo sapiens
atgactgccttgcctcc

SEQ ID NO: 6666456 - DNA, 18 bp, Homo sapiens
atgactgccttgcctcct

SEQ ID NO: 6666457 - DNA, 21 bp, Homo sapiens
atgactgctcaggcctcacct

SEQ ID NO: 6666458 - DNA, 16 bp, Homo sapiens
atgactgctgtgaaat

SEQ ID NO: 6666459 - DNA, 21 bp, Homo sapiens
atgactgcttgccctaagcag

SEQ ID NO: 6666460 - DNA, 21 bp, Homo sapiens
atgactggaaacaaggaagga

SEQ ID NO: 6666461 - DNA, 17 bp, Homo sapiens
atgactggaatttttat

SEQ ID NO: 6666462 - DNA, 15 bp, Homo sapiens
atgactggcatttta

SEQ ID NO: 6666463 - DNA, 19 bp, Homo sapiens
atgactggctgtctgcctg

SEQ ID NO: 6666464 - DNA, 21 bp, Homo sapiens
atgactggctgtctgcctgta

SEQ ID NO: 6666465 - DNA, 12 bp, Homo sapiens
atgactgggcct

SEQ ID NO: 6666466 - DNA, 18 bp, Homo sapiens
atgactggggagggctgc

SEQ ID NO: 6666467 - DNA, 18 bp, Homo sapiens
atgactggggtgggaggt

SEQ ID NO: 6666468 - DNA, 20 bp, Homo sapiens
atgactggtcttccttacct

SEQ ID NO: 6666469 - DNA, 19 bp, Homo sapiens
atgactggtggtgagagac

SEQ ID NO: 6666470 - DNA, 11 bp, Homo sapiens
atgactgtaaa

SEQ ID NO: 6666471 - DNA, 16 bp, Homo sapiens
atgactgtcccattct

SEQ ID NO: 6666472 - DNA, 19 bp, Homo sapiens
atgactgtcccattctcca

SEQ ID NO: 6666473 - DNA, 17 bp, Homo sapiens
atgactgtgaactgggc

SEQ ID NO: 6666474 - DNA, 20 bp, Homo sapiens
atgactgtgaactgggcatt

SEQ ID NO: 6666475 - DNA, 18 bp, Homo sapiens
atgactgtgaccaccttc

SEQ ID NO: 6666476 - DNA, 18 bp, Homo sapiens
atgactgttgttcttata

SEQ ID NO: 6666477 - DNA, 14 bp, Homo sapiens
atgactgtttttaa

SEQ ID NO: 6666478 - DNA, 22 bp, Homo sapiens
atgactgtttttcggacagttt

SEQ ID NO: 6666479 - DNA, 17 bp, Homo sapiens
atgactgtttttgtagt

SEQ ID NO: 6666480 - DNA, 15 bp, Homo sapiens
atgactgttttttaa

SEQ ID NO: 6666481 - DNA, 18 bp, Homo sapiens
atgacttaaaattggaaa

SEQ ID NO: 6666482 - DNA, 22 bp, Homo sapiens
atgacttaagcacacttgacat

SEQ ID NO: 6666483 - DNA, 17 bp, Homo sapiens
atgacttaattttagaa

SEQ ID NO: 6666484 - DNA, 14 bp, Homo sapiens
atgacttactgtac

SEQ ID NO: 6666485 - DNA, 17 bp, Homo sapiens
atgacttactgtacatg

SEQ ID NO: 6666486 - DNA, 23 bp, Homo sapiens
atgacttagaaacaatgtttgct

SEQ ID NO: 6666487 - DNA, 20 bp, Homo sapiens
atgacttagcgtcaagacat

SEQ ID NO: 6666488 - DNA, 18 bp, Homo sapiens
atgacttattatgcataa

SEQ ID NO: 6666489 - DNA, 14 bp, Homo sapiens
atgacttatttctg

SEQ ID NO: 6666490 - DNA, 19 bp, Homo sapiens
atgacttatttctgctctg

SEQ ID NO: 6666491 - DNA, 20 bp, Homo sapiens
atgacttatttctgctctgg

SEQ ID NO: 6666492 - DNA, 16 bp, Homo sapiens
atgacttccctgctcc

SEQ ID NO: 6666493 - DNA, 17 bp, Homo sapiens
atgacttctccaggcag

SEQ ID NO: 6666494 - DNA, 17 bp, Homo sapiens
atgacttcttgttcatg

SEQ ID NO: 6666495 - DNA, 23 bp, Homo sapiens
atgacttctttactaacactggc

SEQ ID NO: 6666496 - DNA, 23 bp, Homo sapiens
atgacttgattgtacttggagta

SEQ ID NO: 6666497 - DNA, 14 bp, Homo sapiens
atgacttgctgtcc

SEQ ID NO: 6666498 - DNA, 15 bp, Homo sapiens
atgacttgctgtcca

SEQ ID NO: 6666499 - DNA, 22 bp, Homo sapiens
atgacttggtggcttttccttg

SEQ ID NO: 6666500 - DNA, 22 bp, Homo sapiens
atgactttagaataatattgtg

SEQ ID NO: 6666501 - DNA, 18 bp, Homo sapiens
atgactttattatttatt

SEQ ID NO: 6666502 - DNA, 20 bp, Homo sapiens
atgactttcagattgtatct

SEQ ID NO: 6666503 - DNA, 20 bp, Homo sapiens
atgactttctttttgtagct

SEQ ID NO: 6666504 - DNA, 21 bp, Homo sapiens
atgactttgaactgaaacttt

SEQ ID NO: 6666505 - DNA, 14 bp, Homo sapiens
atgactttgaagta

SEQ ID NO: 6666506 - DNA, 20 bp, Homo sapiens
atgacttttattgagctctt

SEQ ID NO: 6666507 - DNA, 22 bp, Homo sapiens
atgacttttccattgaccagct

SEQ ID NO: 6666508 - DNA, 16 bp, Homo sapiens
atgactttttgaatgt

SEQ ID NO: 6666509 - DNA, 13 bp, Homo sapiens
atgacttttttaa

SEQ ID NO: 6666510 - DNA, 12 bp, Homo sapiens
atgagaaaaaaa

SEQ ID NO: 6666511 - DNA, 16 bp, Homo sapiens
atgagaaaaaaacagc

SEQ ID NO: 6666512 - DNA, 18 bp, Homo sapiens
atgagaaaaaaatatata

SEQ ID NO: 6666513 - DNA, 18 bp, Homo sapiens
atgagaaaaactgttctt

SEQ ID NO: 6666514 - DNA, 16 bp, Homo sapiens
atgagaaaactgagag

SEQ ID NO: 6666515 - DNA, 14 bp, Homo sapiens
atgagaaaagaggc

SEQ ID NO: 6666516 - DNA, 14 bp, Homo sapiens
atgagaaaatggct

SEQ ID NO: 6666517 - DNA, 15 bp, Homo sapiens
atgagaaacagctca

SEQ ID NO: 6666518 - DNA, 19 bp, Homo sapiens
atgagaaacagctcagcca

SEQ ID NO: 6666519 - DNA, 22 bp, Homo sapiens
atgagaaacagctcagccagtg

SEQ ID NO: 6666520 - DNA, 21 bp, Homo sapiens
atgagaaacttaaatgttatt

SEQ ID NO: 6666521 - DNA, 15 bp, Homo sapiens
atgagaaagaaaagg

SEQ ID NO: 6666522 - DNA, 16 bp, Homo sapiens
atgagaaagaaaagga

SEQ ID NO: 6666523 - DNA, 23 bp, Homo sapiens
atgagaaagcatttcttttctct

SEQ ID NO: 6666524 - DNA, 14 bp, Homo sapiens
atgagaaagccttc

SEQ ID NO: 6666525 - DNA, 15 bp, Homo sapiens
atgagaaagccttct

SEQ ID NO: 6666526 - DNA, 11 bp, Homo sapiens
atgagaaagga

SEQ ID NO: 6666527 - DNA, 18 bp, Homo sapiens
atgagaaagggagaggaa

SEQ ID NO: 6666528 - DNA, 20 bp, Homo sapiens
atgagaaagggagaggaaga

SEQ ID NO: 6666529 - DNA, 13 bp, Homo sapiens
atgagaaatacag

SEQ ID NO: 6666530 - DNA, 16 bp, Homo sapiens
atgagaaatacagtgc

SEQ ID NO: 6666531 - DNA, 18 bp, Homo sapiens
atgagaaatacagtgctt

SEQ ID NO: 6666532 - DNA, 19 bp, Homo sapiens
atgagaaatacagtgcttt

SEQ ID NO: 6666533 - DNA, 23 bp, Homo sapiens
atgagaaatctaaaaaacgaaaa

SEQ ID NO: 6666534 - DNA, 13 bp, Homo sapiens
atgagaaatgtga

SEQ ID NO: 6666535 - DNA, 14 bp, Homo sapiens
atgagaaatgtgaa

SEQ ID NO: 6666536 - DNA, 12 bp, Homo sapiens
atgagaaattgt

SEQ ID NO: 6666537 - DNA, 19 bp, Homo sapiens
atgagaacagataaagatt

SEQ ID NO: 6666538 - DNA, 21 bp, Homo sapiens
atgagaacatgttggtattta

SEQ ID NO: 6666539 - DNA, 21 bp, Homo sapiens
atgagaagaaaaatggaaaaa

SEQ ID NO: 6666540 - DNA, 23 bp, Homo sapiens
atgagaagaaaaatggaaaaaaa

SEQ ID NO: 6666541 - DNA, 21 bp, Homo sapiens
atgagaagaaaatggaaccag

SEQ ID NO: 6666542 - DNA, 23 bp, Homo sapiens
atgagaagaaaatggaaccaggc

SEQ ID NO: 6666543 - DNA, 13 bp, Homo sapiens
atgagaagaatag

SEQ ID NO: 6666544 - DNA, 15 bp, Homo sapiens
atgagaagagggcct

SEQ ID NO: 6666545 - DNA, 16 bp, Homo sapiens
atgagaagagggcctg

SEQ ID NO: 6666546 - DNA, 19 bp, Homo sapiens
atgagaagagttttctcag

SEQ ID NO: 6666547 - DNA, 15 bp, Homo sapiens
atgagaaggcagcca

SEQ ID NO: 6666548 - DNA, 22 bp, Homo sapiens
atgagaaggttggcgtgccctg

SEQ ID NO: 6666549 - DNA, 14 bp, Homo sapiens
atgagaagtacttg

SEQ ID NO: 6666550 - DNA, 16 bp, Homo sapiens
atgagaagtactttgt

SEQ ID NO: 6666551 - DNA, 23 bp, Homo sapiens
atgagaagtactttgtgctgatc

SEQ ID NO: 6666552 - DNA, 19 bp, Homo sapiens
atgagaagttaagcagcct

SEQ ID NO: 6666553 - DNA, 22 bp, Homo sapiens
atgagaatagaaacgtaaacta

SEQ ID NO: 6666554 - DNA, 14 bp, Homo sapiens
atgagaatatacct

SEQ ID NO: 6666555 - DNA, 22 bp, Homo sapiens
atgagaatgaccctgtcaagct

SEQ ID NO: 6666556 - DNA, 17 bp, Homo sapiens
atgagaatgtcatttgc

SEQ ID NO: 6666557 - DNA, 18 bp, Homo sapiens
atgagaatgtcatttgct

SEQ ID NO: 6666558 - DNA, 19 bp, Homo sapiens
atgagaatgtcatttgcta

SEQ ID NO: 6666559 - DNA, 12 bp, Homo sapiens
atgagaatgtga

SEQ ID NO: 6666560 - DNA, 11 bp, Homo sapiens
atgagaatgtt

SEQ ID NO: 6666561 - DNA, 18 bp, Homo sapiens
atgagaattacagaaaat

SEQ ID NO: 6666562 - DNA, 14 bp, Homo sapiens
atgagaatttctaa

SEQ ID NO: 6666563 - DNA, 22 bp, Homo sapiens
atgagaatttctaaaaagatta

SEQ ID NO: 6666564 - DNA, 21 bp, Homo sapiens
atgagaatttgagtgctctga

SEQ ID NO: 6666565 - DNA, 19 bp, Homo sapiens
atgagaattttacttccat

SEQ ID NO: 6666566 - DNA, 17 bp, Homo sapiens
atgagacaacacacaca

SEQ ID NO: 6666567 - DNA, 21 bp, Homo sapiens
atgagacagggtcttgctctg

SEQ ID NO: 6666568 - DNA, 23 bp, Homo sapiens
atgagacagggtcttgctctgtc

SEQ ID NO: 6666569 - DNA, 22 bp, Homo sapiens
atgagaccagtggtctggaaac

SEQ ID NO: 6666570 - DNA, 16 bp, Homo sapiens
atgagacccagcccct

SEQ ID NO: 6666571 - DNA, 15 bp, Homo sapiens
atgagacctggaaca

SEQ ID NO: 6666572 - DNA, 15 bp, Homo sapiens
atgagacgaaatgct

SEQ ID NO: 6666573 - DNA, 18 bp, Homo sapiens
atgagactgccctgccca

SEQ ID NO: 6666574 - DNA, 21 bp, Homo sapiens
atgagacttaattttgtcttt

SEQ ID NO: 6666575 - DNA, 22 bp, Homo sapiens
atgagacttcctattaatttat

SEQ ID NO: 6666576 - DNA, 21 bp, Homo sapiens
atgagacttgagtctattttt

SEQ ID NO: 6666577 - DNA, 21 bp, Homo sapiens
atgagactttaaaagcatttt

SEQ ID NO: 6666578 - DNA, 16 bp, Homo sapiens
atgagagaaagtggga

SEQ ID NO: 6666579 - DNA, 17 bp, Homo sapiens
atgagagacacactgaa

SEQ ID NO: 6666580 - DNA, 20 bp, Homo sapiens
atgagagacacactgaagaa

SEQ ID NO: 6666581 - DNA, 23 bp, Homo sapiens
atgagagacacactgaagaagca

SEQ ID NO: 6666582 - DNA, 15 bp, Homo sapiens
atgagagagaaaaga

SEQ ID NO: 6666583 - DNA, 14 bp, Homo sapiens
atgagagagagaaa

SEQ ID NO: 6666584 - DNA, 18 bp, Homo sapiens
atgagagcaaatgcaaaa

SEQ ID NO: 6666585 - DNA, 20 bp, Homo sapiens
atgagagcaaatgcaaaaat

SEQ ID NO: 6666586 - DNA, 13 bp, Homo sapiens
atgagagcataat

SEQ ID NO: 6666587 - DNA, 18 bp, Homo sapiens
atgagagcgacacagacg

SEQ ID NO: 6666588 - DNA, 19 bp, Homo sapiens
atgagagctcagactggga

SEQ ID NO: 6666589 - DNA, 19 bp, Homo sapiens
atgagaggaaaagaaaaga

SEQ ID NO: 6666590 - DNA, 20 bp, Homo sapiens
atgagaggagaacagtagga

SEQ ID NO: 6666591 - DNA, 13 bp, Homo sapiens
atgagaggaggca

SEQ ID NO: 6666592 - DNA, 18 bp, Homo sapiens
atgagagggcagtgtttc

SEQ ID NO: 6666593 - DNA, 15 bp, Homo sapiens
atgagagtagggccc

SEQ ID NO: 6666594 - DNA, 19 bp, Homo sapiens
atgagagttccttctcact

SEQ ID NO: 6666595 - DNA, 15 bp, Homo sapiens
atgagagttttggat

SEQ ID NO: 6666596 - DNA, 17 bp, Homo sapiens
atgagagttttggatgc

SEQ ID NO: 6666597 - DNA, 14 bp, Homo sapiens
atgagatacatttg

SEQ ID NO: 6666598 - DNA, 22 bp, Homo sapiens
atgagatactttgcattgtctg

SEQ ID NO: 6666599 - DNA, 15 bp, Homo sapiens
atgagatagaagatg

SEQ ID NO: 6666600 - DNA, 21 bp, Homo sapiens
atgagatagaagatgtttgct

SEQ ID NO: 6666601 - DNA, 19 bp, Homo sapiens
atgagataggcacatgcat

SEQ ID NO: 6666602 - DNA, 19 bp, Homo sapiens
atgagatattaaaataagc

SEQ ID NO: 6666603 - DNA, 21 bp, Homo sapiens
atgagatattaaattctcaaa

SEQ ID NO: 6666604 - DNA, 19 bp, Homo sapiens
atgagatcactgaactttt

SEQ ID NO: 6666605 - DNA, 15 bp, Homo sapiens
atgagatcaggctct

SEQ ID NO: 6666606 - DNA, 20 bp, Homo sapiens
atgagatcaggctctgcctc

SEQ ID NO: 6666607 - DNA, 15 bp, Homo sapiens
atgagatcagggcct

SEQ ID NO: 6666608 - DNA, 19 bp, Homo sapiens
atgagatcagggcctgccc

SEQ ID NO: 6666609 - DNA, 19 bp, Homo sapiens
atgagatcccagagttatt

SEQ ID NO: 6666610 - DNA, 19 bp, Homo sapiens
atgagatcccgcctcttct

SEQ ID NO: 6666611 - DNA, 23 bp, Homo sapiens
atgagatctaagcctttccataa

SEQ ID NO: 6666612 - DNA, 22 bp, Homo sapiens
atgagatgaaaatatttaacga

SEQ ID NO: 6666613 - DNA, 24 bp, Homo sapiens
atgagatgatacatccaaagcaga

SEQ ID NO: 6666614 - DNA, 17 bp, Homo sapiens
atgagatggccatgctc

SEQ ID NO: 6666615 - DNA, 15 bp, Homo sapiens
atgagatgtaataca

SEQ ID NO: 6666616 - DNA, 14 bp, Homo sapiens
atgagatgtgtgga

SEQ ID NO: 6666617 - DNA, 20 bp, Homo sapiens
atgagatgttattactgttt

SEQ ID NO: 6666618 - DNA, 14 bp, Homo sapiens
atgagattgtacat

SEQ ID NO: 6666619 - DNA, 23 bp, Homo sapiens
atgagattgtacattttttactt

SEQ ID NO: 6666620 - DNA, 21 bp, Homo sapiens
atgagatttctttgaatgtat

SEQ ID NO: 6666621 - DNA, 22 bp, Homo sapiens
atgagatttctttgaatgtatt

SEQ ID NO: 6666622 - DNA, 19 bp, Homo sapiens
atgagatttgccagcacag

SEQ ID NO: 6666623 - DNA, 19 bp, Homo sapiens
atgagattttggaagaagt

SEQ ID NO: 6666624 - DNA, 20 bp, Homo sapiens
atgagatttttaaaaaatat

SEQ ID NO: 6666625 - DNA, 16 bp, Homo sapiens
atgagattttttttaa

SEQ ID NO: 6666626 - DNA, 20 bp, Homo sapiens
atgagcaaccacatttagaa

SEQ ID NO: 6666627 - DNA, 17 bp, Homo sapiens
atgagcaactcctgttc

SEQ ID NO: 6666628 - DNA, 14 bp, Homo sapiens
atgagcaagaatta

SEQ ID NO: 6666629 - DNA, 22 bp, Homo sapiens
atgagcaaggacattgccccaa

SEQ ID NO: 6666630 - DNA, 15 bp, Homo sapiens
atgagcacaaacttc

SEQ ID NO: 6666631 - DNA, 22 bp, Homo sapiens
atgagcacatctctctgccctc

SEQ ID NO: 6666632 - DNA, 15 bp, Homo sapiens
atgagcagaagctct

SEQ ID NO: 6666633 - DNA, 14 bp, Homo sapiens
atgagcagaaggaa

SEQ ID NO: 6666634 - DNA, 22 bp, Homo sapiens
atgagcagagcccggagctccg

SEQ ID NO: 6666635 - DNA, 20 bp, Homo sapiens
atgagcagcaggcgtgcctc

SEQ ID NO: 6666636 - DNA, 14 bp, Homo sapiens
atgagcaggagctt

SEQ ID NO: 6666637 - DNA, 17 bp, Homo sapiens
atgagcatgctccctca

SEQ ID NO: 6666638 - DNA, 17 bp, Homo sapiens
atgagcatggagctggc

SEQ ID NO: 6666639 - DNA, 23 bp, Homo sapiens
atgagcattggatacagcagtag

SEQ ID NO: 6666640 - DNA, 17 bp, Homo sapiens
atgagcatttagcacaa

SEQ ID NO: 6666641 - DNA, 22 bp, Homo sapiens
atgagcatttgtttgaccccag

SEQ ID NO: 6666642 - DNA, 15 bp, Homo sapiens
atgagccaaaatgac

SEQ ID NO: 6666643 - DNA, 22 bp, Homo sapiens
atgagccaagattgcgccactg

SEQ ID NO: 6666644 - DNA, 12 bp, Homo sapiens
atgagccacaga

SEQ ID NO: 6666645 - DNA, 14 bp, Homo sapiens
atgagccagacaaa

SEQ ID NO: 6666646 - DNA, 15 bp, Homo sapiens
atgagccagtgatta

SEQ ID NO: 6666647 - DNA, 23 bp, Homo sapiens
atgagccagtgattattcttgtt

SEQ ID NO: 6666648 - DNA, 19 bp, Homo sapiens
atgagccatcactagaaga

SEQ ID NO: 6666649 - DNA, 17 bp, Homo sapiens
atgagccatccccaggg

SEQ ID NO: 6666650 - DNA, 22 bp, Homo sapiens
atgagcccaacactcacttaat

SEQ ID NO: 6666651 - DNA, 11 bp, Homo sapiens
atgagccctgg

SEQ ID NO: 6666652 - DNA, 22 bp, Homo sapiens
atgagccctggctcccacctgt

SEQ ID NO: 6666653 - DNA, 15 bp, Homo sapiens
atgagccgcccaagg

SEQ ID NO: 6666654 - DNA, 18 bp, Homo sapiens
atgagccgcccaaggcct

SEQ ID NO: 6666655 - DNA, 22 bp, Homo sapiens
atgagccgcccaaggccttccc

SEQ ID NO: 6666656 - DNA, 22 bp, Homo sapiens
atgagccgggtccggcctctcc

SEQ ID NO: 6666657 - DNA, 19 bp, Homo sapiens
atgagcctacgctgaagat

SEQ ID NO: 6666658 - DNA, 17 bp, Homo sapiens
atgagcctcagcatcct

SEQ ID NO: 6666659 - DNA, 19 bp, Homo sapiens
atgagcctcagcatcctgg

SEQ ID NO: 6666660 - DNA, 16 bp, Homo sapiens
atgagcctctccttgc

SEQ ID NO: 6666661 - DNA, 17 bp, Homo sapiens
atgagcctctccttgcc

SEQ ID NO: 6666662 - DNA, 18 bp, Homo sapiens
atgagcctgcccgctgca

SEQ ID NO: 6666663 - DNA, 20 bp, Homo sapiens
atgagcctgctggaagccca

SEQ ID NO: 6666664 - DNA, 13 bp, Homo sapiens
atgagcctggcaa

SEQ ID NO: 6666665 - DNA, 20 bp, Homo sapiens
atgagcgtcactgcccacca

SEQ ID NO: 6666666 - DNA, 23 bp, Homo sapiens
atgagcgtcactgcccaccaaag

SEQ ID NO: 6666667 - DNA, 23 bp, Homo sapiens
atgagctatcctttcaaacagct

SEQ ID NO: 6666668 - DNA, 15 bp, Homo sapiens
atgagctatgtatta

SEQ ID NO: 6666669 - DNA, 20 bp, Homo sapiens
atgagctatttccattccag

SEQ ID NO: 6666670 - DNA, 16 bp, Homo sapiens
atgagctccagacccc

SEQ ID NO: 6666671 - DNA, 17 bp, Homo sapiens
atgagctccagaccccc

SEQ ID NO: 6666672 - DNA, 21 bp, Homo sapiens
atgagctccagacccccagca

SEQ ID NO: 6666673 - DNA, 10 bp, Homo sapiens
atgagctccc

SEQ ID NO: 6666674 - DNA, 20 bp, Homo sapiens
atgagctcccacaagcctga

SEQ ID NO: 6666675 - DNA, 14 bp, Homo sapiens
atgagctcctcttc

SEQ ID NO: 6666676 - DNA, 20 bp, Homo sapiens
atgagctcctgatcagaggc

SEQ ID NO: 6666677 - DNA, 12 bp, Homo sapiens
atgagctcctgc

SEQ ID NO: 6666678 - DNA, 20 bp, Homo sapiens
atgagctcctgctcattgtg

SEQ ID NO: 6666679 - DNA, 19 bp, Homo sapiens
atgagctccttaaggctct

SEQ ID NO: 6666680 - DNA, 21 bp, Homo sapiens
atgagctcgcatttgtcaatg

SEQ ID NO: 6666681 - DNA, 22 bp, Homo sapiens
atgagctctacccagggcctgc

SEQ ID NO: 6666682 - DNA, 16 bp, Homo sapiens
atgagctcttcatgtt

SEQ ID NO: 6666683 - DNA, 17 bp, Homo sapiens
atgagctgagcttagct

SEQ ID NO: 6666684 - DNA, 12 bp, Homo sapiens
atgagctgatca

SEQ ID NO: 6666685 - DNA, 17 bp, Homo sapiens
atgagctgatctgcgga

SEQ ID NO: 6666686 - DNA, 14 bp, Homo sapiens
atgagctgctgtgc

SEQ ID NO: 6666687 - DNA, 19 bp, Homo sapiens
atgagctgctgtgcccagc

SEQ ID NO: 6666688 - DNA, 21 bp, Homo sapiens
atgagctggaaggagtgagag

SEQ ID NO: 6666689 - DNA, 12 bp, Homo sapiens
atgagctggagc

SEQ ID NO: 6666690 - DNA, 11 bp, Homo sapiens
atgagctggca

SEQ ID NO: 6666691 - DNA, 15 bp, Homo sapiens
atgagctgggccctg

SEQ ID NO: 6666692 - DNA, 17 bp, Homo sapiens
atgagctgggccctggg

SEQ ID NO: 6666693 - DNA, 13 bp, Homo sapiens
atgagctgggtac

SEQ ID NO: 6666694 - DNA, 16 bp, Homo sapiens
atgagctgggtactga

SEQ ID NO: 6666695 - DNA, 14 bp, Homo sapiens
atgagcttcaatat

SEQ ID NO: 6666696 - DNA, 16 bp, Homo sapiens
atgagcttcaatataa

SEQ ID NO: 6666697 - DNA, 15 bp, Homo sapiens
atgagcttgattaaa

SEQ ID NO: 6666698 - DNA, 16 bp, Homo sapiens
atgagcttgtaaatac

SEQ ID NO: 6666699 - DNA, 22 bp, Homo sapiens
atgagctttccagttagggctg

SEQ ID NO: 6666700 - DNA, 13 bp, Homo sapiens
atgagctttctga

SEQ ID NO: 6666701 - DNA, 15 bp, Homo sapiens
atgagctttctgaac

SEQ ID NO: 6666702 - DNA, 21 bp, Homo sapiens
atgagctttctgaacagctgg

SEQ ID NO: 6666703 - DNA, 22 bp, Homo sapiens
atgagctttctgaacagctggt

SEQ ID NO: 6666704 - DNA, 21 bp, Homo sapiens
atgagctttgtctacttcaaa

SEQ ID NO: 6666705 - DNA, 22 bp, Homo sapiens
atgaggaaaaaatggtataaaa

SEQ ID NO: 6666706 - DNA, 15 bp, Homo sapiens
atgaggaaaccaaga

SEQ ID NO: 6666707 - DNA, 19 bp, Homo sapiens
atgaggaaactactgaact

SEQ ID NO: 6666708 - DNA, 22 bp, Homo sapiens
atgaggaaagcgtttctgtgta

SEQ ID NO: 6666709 - DNA, 18 bp, Homo sapiens
atgaggaacaatcacaaa

SEQ ID NO: 6666710 - DNA, 19 bp, Homo sapiens
atgaggaacctcaaactgg

SEQ ID NO: 6666711 - DNA, 16 bp, Homo sapiens
atgaggaactgtagat

SEQ ID NO: 6666712 - DNA, 19 bp, Homo sapiens
atgaggaagcaaagagtga

SEQ ID NO: 6666713 - DNA, 12 bp, Homo sapiens
atgaggagacag

SEQ ID NO: 6666714 - DNA, 18 bp, Homo sapiens
atgaggagagaaaatata

SEQ ID NO: 6666715 - DNA, 19 bp, Homo sapiens
atgaggagagaaaatatat

SEQ ID NO: 6666716 - DNA, 17 bp, Homo sapiens
atgaggagagaaggaca

SEQ ID NO: 6666717 - DNA, 14 bp, Homo sapiens
atgaggagcctctg

SEQ ID NO: 6666718 - DNA, 21 bp, Homo sapiens
atgaggaggatgtccctgggc

SEQ ID NO: 6666719 - DNA, 23 bp, Homo sapiens
atgaggaggggagcgtctgggaa

SEQ ID NO: 6666720 - DNA, 19 bp, Homo sapiens
atgaggagtaaaattcagt

SEQ ID NO: 6666721 - DNA, 19 bp, Homo sapiens
atgaggataacttccttgc

SEQ ID NO: 6666722 - DNA, 16 bp, Homo sapiens
atgaggatccagggca

SEQ ID NO: 6666723 - DNA, 23 bp, Homo sapiens
atgaggatccagggcagcaggcc

SEQ ID NO: 6666724 - DNA, 15 bp, Homo sapiens
atgaggatgtatgtg

SEQ ID NO: 6666725 - DNA, 16 bp, Homo sapiens
atgaggatgtatgtgt

SEQ ID NO: 6666726 - DNA, 18 bp, Homo sapiens
atgaggcaacctgattgt

SEQ ID NO: 6666727 - DNA, 19 bp, Homo sapiens
atgaggcaacctgattgta

SEQ ID NO: 6666728 - DNA, 18 bp, Homo sapiens
atgaggcaatgtcaggaa

SEQ ID NO: 6666729 - DNA, 13 bp, Homo sapiens
atgaggcagagga

SEQ ID NO: 6666730 - DNA, 20 bp, Homo sapiens
atgaggcagcacgtgcacaa

SEQ ID NO: 6666731 - DNA, 16 bp, Homo sapiens
atgaggcattacaaat

SEQ ID NO: 6666732 - DNA, 22 bp, Homo sapiens
atgaggcatttgtttgaactga

SEQ ID NO: 6666733 - DNA, 12 bp, Homo sapiens
atgaggcatttt

SEQ ID NO: 6666734 - DNA, 15 bp, Homo sapiens
atgaggccactggag

SEQ ID NO: 6666735 - DNA, 17 bp, Homo sapiens
atgaggccagaccatgg

SEQ ID NO: 6666736 - DNA, 16 bp, Homo sapiens
atgaggccatctcagg

SEQ ID NO: 6666737 - DNA, 17 bp, Homo sapiens
atgaggccatctcagga

SEQ ID NO: 6666738 - DNA, 20 bp, Homo sapiens
atgaggccatctcaggagat

SEQ ID NO: 6666739 - DNA, 22 bp, Homo sapiens
atgaggccatctcaggagatgg

SEQ ID NO: 6666740 - DNA, 15 bp, Homo sapiens
atgaggccgctagag

SEQ ID NO: 6666741 - DNA, 14 bp, Homo sapiens
atgaggcctttccc

SEQ ID NO: 6666742 - DNA, 16 bp, Homo sapiens
atgaggcggagctcca

SEQ ID NO: 6666743 - DNA, 19 bp, Homo sapiens
atgaggcggagctccagga

SEQ ID NO: 6666744 - DNA, 18 bp, Homo sapiens
atgaggctgagatccaga

SEQ ID NO: 6666745 - DNA, 20 bp, Homo sapiens
atgaggctggataggagagg

SEQ ID NO: 6666746 - DNA, 22 bp, Homo sapiens
atgaggctggggcggggctgga

SEQ ID NO: 6666747 - DNA, 17 bp, Homo sapiens
atgaggcttgctgagag

SEQ ID NO: 6666748 - DNA, 14 bp, Homo sapiens
atgagggacagggt

SEQ ID NO: 6666749 - DNA, 18 bp, Homo sapiens
atgagggacagggtcttt

SEQ ID NO: 6666750 - DNA, 14 bp, Homo sapiens
atgagggactggaa

SEQ ID NO: 6666751 - DNA, 20 bp, Homo sapiens
atgagggactggaaccaggg

SEQ ID NO: 6666752 - DNA, 23 bp, Homo sapiens
atgagggacttccctagaagtct

SEQ ID NO: 6666753 - DNA, 22 bp, Homo sapiens
atgagggagggggcgctcagga

SEQ ID NO: 6666754 - DNA, 16 bp, Homo sapiens
atgagggcagcagcca

SEQ ID NO: 6666755 - DNA, 19 bp, Homo sapiens
atgagggcagcagccagcc

SEQ ID NO: 6666756 - DNA, 11 bp, Homo sapiens
atgagggccac

SEQ ID NO: 6666757 - DNA, 16 bp, Homo sapiens
atgagggccaccagga

SEQ ID NO: 6666758 - DNA, 13 bp, Homo sapiens
atgagggctgagt

SEQ ID NO: 6666759 - DNA, 18 bp, Homo sapiens
atgaggggaaaacatgta

SEQ ID NO: 6666760 - DNA, 19 bp, Homo sapiens
atgaggggacattttggtg

SEQ ID NO: 6666761 - DNA, 16 bp, Homo sapiens
atgaggggactgcatg

SEQ ID NO: 6666762 - DNA, 22 bp, Homo sapiens
atgaggggccaccccgtgcccc

SEQ ID NO: 6666763 - DNA, 23 bp, Homo sapiens
atgaggggccaccccgtgcccct

SEQ ID NO: 6666764 - DNA, 21 bp, Homo sapiens
atgaggggcttcctgggtcct

SEQ ID NO: 6666765 - DNA, 18 bp, Homo sapiens
atgagggggaattcctgg

SEQ ID NO: 6666766 - DNA, 19 bp, Homo sapiens
atgagggggaattcctgga

SEQ ID NO: 6666767 - DNA, 13 bp, Homo sapiens
atgagggggtggt

SEQ ID NO: 6666768 - DNA, 11 bp, Homo sapiens
atgagggtcag

SEQ ID NO: 6666769 - DNA, 16 bp, Homo sapiens
atgagggtcagggcag

SEQ ID NO: 6666770 - DNA, 15 bp, Homo sapiens
atgagggtgtttcct

SEQ ID NO: 6666771 - DNA, 15 bp, Homo sapiens
atgagggttcatcat

SEQ ID NO: 6666772 - DNA, 22 bp, Homo sapiens
atgagggttcatcatccctccc

SEQ ID NO: 6666773 - DNA, 22 bp, Homo sapiens
atgaggtaaaagagccaagttc

SEQ ID NO: 6666774 - DNA, 22 bp, Homo sapiens
atgaggtcaccaggggaggagc

SEQ ID NO: 6666775 - DNA, 15 bp, Homo sapiens
atgaggtcagactag

SEQ ID NO: 6666776 - DNA, 22 bp, Homo sapiens
atgaggtcagagcctgcagtta

SEQ ID NO: 6666777 - DNA, 14 bp, Homo sapiens
atgaggtcaggagt

SEQ ID NO: 6666778 - DNA, 16 bp, Homo sapiens
atgaggtcataaacac

SEQ ID NO: 6666779 - DNA, 16 bp, Homo sapiens
atgaggtcccaggcag

SEQ ID NO: 6666780 - DNA, 18 bp, Homo sapiens
atgaggtcccaggcagag

SEQ ID NO: 6666781 - DNA, 20 bp, Homo sapiens
atgaggtcccaggcagagaa

SEQ ID NO: 6666782 - DNA, 19 bp, Homo sapiens
atgaggtcctcaggtcagc

SEQ ID NO: 6666783 - DNA, 17 bp, Homo sapiens
atgaggtctgaaatgga

SEQ ID NO: 6666784 - DNA, 13 bp, Homo sapiens
atgaggtctgttt

SEQ ID NO: 6666785 - DNA, 14 bp, Homo sapiens
atgaggtctgttta

SEQ ID NO: 6666786 - DNA, 22 bp, Homo sapiens
atgaggtgggaggtggaagaag

SEQ ID NO: 6666787 - DNA, 14 bp, Homo sapiens
atgaggtgggctga

SEQ ID NO: 6666788 - DNA, 15 bp, Homo sapiens
atgaggtgggctgaa

SEQ ID NO: 6666789 - DNA, 15 bp, Homo sapiens
atgaggtgttgtgca

SEQ ID NO: 6666790 - DNA, 18 bp, Homo sapiens
atgaggtgttgtgcattt

SEQ ID NO: 6666791 - DNA, 22 bp, Homo sapiens
atgaggttcaactgttgattgc

SEQ ID NO: 6666792 - DNA, 13 bp, Homo sapiens
atgaggttctgag

SEQ ID NO: 6666793 - DNA, 23 bp, Homo sapiens
atgaggttgggggaaccagcaga

SEQ ID NO: 6666794 - DNA, 14 bp, Homo sapiens
atgaggtttcttca

SEQ ID NO: 6666795 - DNA, 19 bp, Homo sapiens
atgagtaaaaactagaagg

SEQ ID NO: 6666796 - DNA, 16 bp, Homo sapiens
atgagtaaactgtttc

SEQ ID NO: 6666797 - DNA, 19 bp, Homo sapiens
atgagtaaactgtttctca

SEQ ID NO: 6666798 - DNA, 15 bp, Homo sapiens
atgagtaaaggagta

SEQ ID NO: 6666799 - DNA, 15 bp, Homo sapiens
atgagtaaataaact

SEQ ID NO: 6666800 - DNA, 16 bp, Homo sapiens
atgagtacaaatgcct

SEQ ID NO: 6666801 - DNA, 17 bp, Homo sapiens
atgagtaggatgtctct

SEQ ID NO: 6666802 - DNA, 17 bp, Homo sapiens
atgagtatacaatatat

SEQ ID NO: 6666803 - DNA, 21 bp, Homo sapiens
atgagtatacaatatataaaa

SEQ ID NO: 6666804 - DNA, 20 bp, Homo sapiens
atgagtatctttaaatataa

SEQ ID NO: 6666805 - DNA, 15 bp, Homo sapiens
atgagtatgaacttg

SEQ ID NO: 6666806 - DNA, 16 bp, Homo sapiens
atgagtatgaacttga

SEQ ID NO: 6666807 - DNA, 17 bp, Homo sapiens
atgagtatgaacttgag

SEQ ID NO: 6666808 - DNA, 13 bp, Homo sapiens
atgagtatttggt

SEQ ID NO: 6666809 - DNA, 14 bp, Homo sapiens
atgagtatttggta

SEQ ID NO: 6666810 - DNA, 14 bp, Homo sapiens
atgagtcaatcagc

SEQ ID NO: 6666811 - DNA, 18 bp, Homo sapiens
atgagtcaatcagccttt

SEQ ID NO: 6666812 - DNA, 16 bp, Homo sapiens
atgagtcaatgtgcag

SEQ ID NO: 6666813 - DNA, 14 bp, Homo sapiens
atgagtcacaaaat

SEQ ID NO: 6666814 - DNA, 18 bp, Homo sapiens
atgagtcacaaaataaag

SEQ ID NO: 6666815 - DNA, 18 bp, Homo sapiens
atgagtcactgagcatca

SEQ ID NO: 6666816 - DNA, 13 bp, Homo sapiens
atgagtcagacac

SEQ ID NO: 6666817 - DNA, 22 bp, Homo sapiens
atgagtcagtctctctctccct

SEQ ID NO: 6666818 - DNA, 16 bp, Homo sapiens
atgagtcatttgttta

SEQ ID NO: 6666819 - DNA, 22 bp, Homo sapiens
atgagtccatgtcctatgcctc

SEQ ID NO: 6666820 - DNA, 23 bp, Homo sapiens
atgagtccatgtcctatgcctca

SEQ ID NO: 6666821 - DNA, 23 bp, Homo sapiens
atgagtcccctgtttgtttctga

SEQ ID NO: 6666822 - DNA, 21 bp, Homo sapiens
atgagtccttgaaaatatttt

SEQ ID NO: 6666823 - DNA, 17 bp, Homo sapiens
atgagtctacctgagca

SEQ ID NO: 6666824 - DNA, 15 bp, Homo sapiens
atgagtctagtttca

SEQ ID NO: 6666825 - DNA, 14 bp, Homo sapiens
atgagtctccagat

SEQ ID NO: 6666826 - DNA, 16 bp, Homo sapiens
atgagtctgctttcac

SEQ ID NO: 6666827 - DNA, 21 bp, Homo sapiens
atgagtctgtaggagcaaggg

SEQ ID NO: 6666828 - DNA, 18 bp, Homo sapiens
atgagtctgtttcccaag

SEQ ID NO: 6666829 - DNA, 19 bp, Homo sapiens
atgagtctgtttcccaagc

SEQ ID NO: 6666830 - DNA, 20 bp, Homo sapiens
atgagtctgtttcccaagct

SEQ ID NO: 6666831 - DNA, 18 bp, Homo sapiens
atgagtctgtttgaaatg

SEQ ID NO: 6666832 - DNA, 13 bp, Homo sapiens
atgagtcttgtaa

SEQ ID NO: 6666833 - DNA, 21 bp, Homo sapiens
atgagtctttgagactaaatt

SEQ ID NO: 6666834 - DNA, 16 bp, Homo sapiens
atgagtgaagtattgc

SEQ ID NO: 6666835 - DNA, 19 bp, Homo sapiens
atgagtgaagtattgctga

SEQ ID NO: 6666836 - DNA, 20 bp, Homo sapiens
atgagtgaagtattgctgaa

SEQ ID NO: 6666837 - DNA, 13 bp, Homo sapiens
atgagtgagaata

SEQ ID NO: 6666838 - DNA, 17 bp, Homo sapiens
atgagtgcaagcaaagc

SEQ ID NO: 6666839 - DNA, 18 bp, Homo sapiens
atgagtgcaagcaaagca

SEQ ID NO: 6666840 - DNA, 15 bp, Homo sapiens
atgagtgcacctgcc

SEQ ID NO: 6666841 - DNA, 19 bp, Homo sapiens
atgagtgcaggtttctatt

SEQ ID NO: 6666842 - DNA, 16 bp, Homo sapiens
atgagtgcgtgctcag

SEQ ID NO: 6666843 - DNA, 14 bp, Homo sapiens
atgagtggaaatac

SEQ ID NO: 6666844 - DNA, 21 bp, Homo sapiens
atgagtggatggatggacaga

SEQ ID NO: 6666845 - DNA, 16 bp, Homo sapiens
atgagtgggaatccgg

SEQ ID NO: 6666846 - DNA, 22 bp, Homo sapiens
atgagtggtgacttaaggagaa

SEQ ID NO: 6666847 - DNA, 19 bp, Homo sapiens
atgagtgtaacaagaaagg

SEQ ID NO: 6666848 - DNA, 18 bp, Homo sapiens
atgagtgtattttttaaa

SEQ ID NO: 6666849 - DNA, 13 bp, Homo sapiens
atgagtgtgaatg

SEQ ID NO: 6666850 - DNA, 12 bp, Homo sapiens
atgagtgtgcat

SEQ ID NO: 6666851 - DNA, 14 bp, Homo sapiens
atgagtgtgccaga

SEQ ID NO: 6666852 - DNA, 20 bp, Homo sapiens
atgagtgtgggtgccagtcc

SEQ ID NO: 6666853 - DNA, 19 bp, Homo sapiens
atgagtgttaataaaattt

SEQ ID NO: 6666854 - DNA, 17 bp, Homo sapiens
atgagttaaataaaaca

SEQ ID NO: 6666855 - DNA, 17 bp, Homo sapiens
atgagttatgagttatt

SEQ ID NO: 6666856 - DNA, 15 bp, Homo sapiens
atgagttcaaatact

SEQ ID NO: 6666857 - DNA, 16 bp, Homo sapiens
atgagttcaaatactt

SEQ ID NO: 6666858 - DNA, 19 bp, Homo sapiens
atgagttcaaatacttttg

SEQ ID NO: 6666859 - DNA, 22 bp, Homo sapiens
atgagttcacatgtgccctgcc

SEQ ID NO: 6666860 - DNA, 22 bp, Homo sapiens
atgagttccctaaacaaaagca

SEQ ID NO: 6666861 - DNA, 15 bp, Homo sapiens
atgagttcttctcaa

SEQ ID NO: 6666862 - DNA, 14 bp, Homo sapiens
atgagttgaaatgt

SEQ ID NO: 6666863 - DNA, 22 bp, Homo sapiens
atgagttgaaatgttctgtcaa

SEQ ID NO: 6666864 - DNA, 16 bp, Homo sapiens
atgagttgcagttttt

SEQ ID NO: 6666865 - DNA, 16 bp, Homo sapiens
atgagttgcatttgta

SEQ ID NO: 6666866 - DNA, 17 bp, Homo sapiens
atgagttgcatttgtaa

SEQ ID NO: 6666867 - DNA, 16 bp, Homo sapiens
atgagttgctggaaaa

SEQ ID NO: 6666868 - DNA, 17 bp, Homo sapiens
atgagttgctggaaaat

SEQ ID NO: 6666869 - DNA, 21 bp, Homo sapiens
atgagttgtcacagaaattat

SEQ ID NO: 6666870 - DNA, 23 bp, Homo sapiens
atgagttgttttcagactcagac

SEQ ID NO: 6666871 - DNA, 13 bp, Homo sapiens
atgagtttaaaaa

SEQ ID NO: 6666872 - DNA, 21 bp, Homo sapiens
atgagtttaaaaaaataacat

SEQ ID NO: 6666873 - DNA, 15 bp, Homo sapiens
atgagtttatgggaa

SEQ ID NO: 6666874 - DNA, 15 bp, Homo sapiens
atgagtttcttagac

SEQ ID NO: 6666875 - DNA, 15 bp, Homo sapiens
atgagtttgccctgg

SEQ ID NO: 6666876 - DNA, 21 bp, Homo sapiens
atgagttttacaaattccttt

SEQ ID NO: 6666877 - DNA, 16 bp, Homo sapiens
atgagttttacattac

SEQ ID NO: 6666878 - DNA, 13 bp, Homo sapiens
atgagttttggga

SEQ ID NO: 6666879 - DNA, 18 bp, Homo sapiens
atgagttttgggaagtta

SEQ ID NO: 6666880 - DNA, 13 bp, Homo sapiens
atgagtttttaaa

SEQ ID NO: 6666881 - DNA, 15 bp, Homo sapiens
atgagtttttcatta

SEQ ID NO: 6666882 - DNA, 15 bp, Homo sapiens
atgataaaaaagtgt

SEQ ID NO: 6666883 - DNA, 22 bp, Homo sapiens
atgataaaaaagtgtcctataa

SEQ ID NO: 6666884 - DNA, 21 bp, Homo sapiens
atgataaaaaattttgtaatt

SEQ ID NO: 6666885 - DNA, 22 bp, Homo sapiens
atgataaaaaattttgtaattt

SEQ ID NO: 6666886 - DNA, 14 bp, Homo sapiens
atgataaaagagaa

SEQ ID NO: 6666887 - DNA, 14 bp, Homo sapiens
atgataaaaggaag

SEQ ID NO: 6666888 - DNA, 19 bp, Homo sapiens
atgataaaaggaagtagat

SEQ ID NO: 6666889 - DNA, 17 bp, Homo sapiens
atgataaaaggaatctg

SEQ ID NO: 6666890 - DNA, 14 bp, Homo sapiens
atgataaaataagt

SEQ ID NO: 6666891 - DNA, 15 bp, Homo sapiens
atgataaaataagta

SEQ ID NO: 6666892 - DNA, 16 bp, Homo sapiens
atgataaaataagtaa

SEQ ID NO: 6666893 - DNA, 19 bp, Homo sapiens
atgataaaataagtaacat

SEQ ID NO: 6666894 - DNA, 20 bp, Homo sapiens
atgataaaatcccattgtat

SEQ ID NO: 6666895 - DNA, 22 bp, Homo sapiens
atgataaaatcccattgtattt

SEQ ID NO: 6666896 - DNA, 16 bp, Homo sapiens
atgataaactcagatc

SEQ ID NO: 6666897 - DNA, 18 bp, Homo sapiens
atgataaactcagatctg

SEQ ID NO: 6666898 - DNA, 14 bp, Homo sapiens
atgataaaggaaat

SEQ ID NO: 6666899 - DNA, 22 bp, Homo sapiens
atgataaaggcttaggacttca

SEQ ID NO: 6666900 - DNA, 18 bp, Homo sapiens
atgataaagttgtaaata

SEQ ID NO: 6666901 - DNA, 12 bp, Homo sapiens
atgataaatatt

SEQ ID NO: 6666902 - DNA, 17 bp, Homo sapiens
atgataaccaagaatgt

SEQ ID NO: 6666903 - DNA, 14 bp, Homo sapiens
atgataactactga

SEQ ID NO: 6666904 - DNA, 14 bp, Homo sapiens
atgataactggaaa

SEQ ID NO: 6666905 - DNA, 14 bp, Homo sapiens
atgataagaacaga

SEQ ID NO: 6666906 - DNA, 23 bp, Homo sapiens
atgataagacattttgtttttac

SEQ ID NO: 6666907 - DNA, 12 bp, Homo sapiens
atgataagattg

SEQ ID NO: 6666908 - DNA, 16 bp, Homo sapiens
atgataataataataa

SEQ ID NO: 6666909 - DNA, 17 bp, Homo sapiens
atgataatacccacatt

SEQ ID NO: 6666910 - DNA, 19 bp, Homo sapiens
atgataatagattctcttg

SEQ ID NO: 6666911 - DNA, 15 bp, Homo sapiens
atgataatagctcac

SEQ ID NO: 6666912 - DNA, 14 bp, Homo sapiens
atgataataggtca

SEQ ID NO: 6666913 - DNA, 23 bp, Homo sapiens
atgataatcaattattacattta

SEQ ID NO: 6666914 - DNA, 18 bp, Homo sapiens
atgataatcccaccaccc

SEQ ID NO: 6666915 - DNA, 12 bp, Homo sapiens
atgataatgaac

SEQ ID NO: 6666916 - DNA, 15 bp, Homo sapiens
atgataatgaacaga

SEQ ID NO: 6666917 - DNA, 19 bp, Homo sapiens
atgataattacaatacaaa

SEQ ID NO: 6666918 - DNA, 16 bp, Homo sapiens
atgataattatttaca

SEQ ID NO: 6666919 - DNA, 12 bp, Homo sapiens
atgatacaaaga

SEQ ID NO: 6666920 - DNA, 17 bp, Homo sapiens
atgatacaagattagaa

SEQ ID NO: 6666921 - DNA, 13 bp, Homo sapiens
atgatacaatgaa

SEQ ID NO: 6666922 - DNA, 17 bp, Homo sapiens
atgatacagcagagcta

SEQ ID NO: 6666923 - DNA, 12 bp, Homo sapiens
atgatacagtca

SEQ ID NO: 6666924 - DNA, 12 bp, Homo sapiens
atgatacagtgt

SEQ ID NO: 6666925 - DNA, 15 bp, Homo sapiens
atgatacatccaaag

SEQ ID NO: 6666926 - DNA, 20 bp, Homo sapiens
atgataccacctttactgtg

SEQ ID NO: 6666927 - DNA, 15 bp, Homo sapiens
atgataccagcagca

SEQ ID NO: 6666928 - DNA, 17 bp, Homo sapiens
atgatacccaacagttt

SEQ ID NO: 6666929 - DNA, 19 bp, Homo sapiens
atgatacccaacagtttat

SEQ ID NO: 6666930 - DNA, 22 bp, Homo sapiens
atgataccctgaatttggcctg

SEQ ID NO: 6666931 - DNA, 20 bp, Homo sapiens
atgatacctattaaaggaaa

SEQ ID NO: 6666932 - DNA, 21 bp, Homo sapiens
atgatacctattaaaggaaaa

SEQ ID NO: 6666933 - DNA, 15 bp, Homo sapiens
atgatactgaattgt

SEQ ID NO: 6666934 - DNA, 21 bp, Homo sapiens
atgatactgaattgttatgta

SEQ ID NO: 6666935 - DNA, 14 bp, Homo sapiens
atgatactgacttt

SEQ ID NO: 6666936 - DNA, 14 bp, Homo sapiens
atgatactgattat

SEQ ID NO: 6666937 - DNA, 15 bp, Homo sapiens
atgatactgtagaac

SEQ ID NO: 6666938 - DNA, 19 bp, Homo sapiens
atgatactgtagaacctgt

SEQ ID NO: 6666939 - DNA, 17 bp, Homo sapiens
atgatactgtctaagaa

SEQ ID NO: 6666940 - DNA, 15 bp, Homo sapiens
atgatactgtctctc

SEQ ID NO: 6666941 - DNA, 15 bp, Homo sapiens
atgatactgtttctt

SEQ ID NO: 6666942 - DNA, 18 bp, Homo sapiens
atgatacttcgacactgt

SEQ ID NO: 6666943 - DNA, 23 bp, Homo sapiens
atgatacttcgacactgttctta

SEQ ID NO: 6666944 - DNA, 21 bp, Homo sapiens
atgatacttgaaaattaacat

SEQ ID NO: 6666945 - DNA, 14 bp, Homo sapiens
atgatagaaacaga

SEQ ID NO: 6666946 - DNA, 22 bp, Homo sapiens
atgatagaaagaataaaatgtt

SEQ ID NO: 6666947 - DNA, 23 bp, Homo sapiens
atgatagaactgtactgttttct

SEQ ID NO: 6666948 - DNA, 17 bp, Homo sapiens
atgatagacttcgaaaa

SEQ ID NO: 6666949 - DNA, 16 bp, Homo sapiens
atgatagacttgttag

SEQ ID NO: 6666950 - DNA, 17 bp, Homo sapiens
atgatagtaagaaaagt

SEQ ID NO: 6666951 - DNA, 19 bp, Homo sapiens
atgatagttaaactaccac

SEQ ID NO: 6666952 - DNA, 13 bp, Homo sapiens
atgatagttttct

SEQ ID NO: 6666953 - DNA, 12 bp, Homo sapiens
atgatataaaca

SEQ ID NO: 6666954 - DNA, 22 bp, Homo sapiens
atgatatagagtgacttggaga

SEQ ID NO: 6666955 - DNA, 15 bp, Homo sapiens
atgatataggaaaat

SEQ ID NO: 6666956 - DNA, 13 bp, Homo sapiens
atgatatataaac

SEQ ID NO: 6666957 - DNA, 14 bp, Homo sapiens
atgatatatatgta

SEQ ID NO: 6666958 - DNA, 14 bp, Homo sapiens
atgatatcattgtt

SEQ ID NO: 6666959 - DNA, 21 bp, Homo sapiens
atgatatccagtaagcacatg

SEQ ID NO: 6666960 - DNA, 13 bp, Homo sapiens
atgatatgcatgt

SEQ ID NO: 6666961 - DNA, 14 bp, Homo sapiens
atgatatgcatgta

SEQ ID NO: 6666962 - DNA, 18 bp, Homo sapiens
atgatatgcatgtagcat

SEQ ID NO: 6666963 - DNA, 19 bp, Homo sapiens
atgatatgcatgtagcata

SEQ ID NO: 6666964 - DNA, 12 bp, Homo sapiens
atgatatgcatt

SEQ ID NO: 6666965 - DNA, 23 bp, Homo sapiens
atgatatgcttgtaactaaaata

SEQ ID NO: 6666966 - DNA, 21 bp, Homo sapiens
atgatatgtaaacataattct

SEQ ID NO: 6666967 - DNA, 16 bp, Homo sapiens
atgatatgtctttaaa

SEQ ID NO: 6666968 - DNA, 12 bp, Homo sapiens
atgatatgtgct

SEQ ID NO: 6666969 - DNA, 22 bp, Homo sapiens
atgatatgtgcttgtgtgtatg

SEQ ID NO: 6666970 - DNA, 18 bp, Homo sapiens
atgatattaaaaattggc

SEQ ID NO: 6666971 - DNA, 19 bp, Homo sapiens
atgatattccccatttcct

SEQ ID NO: 6666972 - DNA, 23 bp, Homo sapiens
atgatattctcattatttcatca

SEQ ID NO: 6666973 - DNA, 21 bp, Homo sapiens
atgatattgacactgtccctc

SEQ ID NO: 6666974 - DNA, 13 bp, Homo sapiens
atgatattgcata

SEQ ID NO: 6666975 - DNA, 18 bp, Homo sapiens
atgatattgcatatgcat

SEQ ID NO: 6666976 - DNA, 17 bp, Homo sapiens
atgatattgctgaagaa

SEQ ID NO: 6666977 - DNA, 21 bp, Homo sapiens
atgatattgtttaaaattcag

SEQ ID NO: 6666978 - DNA, 15 bp, Homo sapiens
atgatatttcttgct

SEQ ID NO: 6666979 - DNA, 15 bp, Homo sapiens
atgatcaaaaataat

SEQ ID NO: 6666980 - DNA, 16 bp, Homo sapiens
atgatcaaaatgcata

SEQ ID NO: 6666981 - DNA, 14 bp, Homo sapiens
atgatcaaatgttt

SEQ ID NO: 6666982 - DNA, 20 bp, Homo sapiens
atgatcaaatgtttaatcat

SEQ ID NO: 6666983 - DNA, 15 bp, Homo sapiens
atgatcaacaattta

SEQ ID NO: 6666984 - DNA, 18 bp, Homo sapiens
atgatcaacataatggac

SEQ ID NO: 6666985 - DNA, 17 bp, Homo sapiens
atgatcaagatatatgt

SEQ ID NO: 6666986 - DNA, 17 bp, Homo sapiens
atgatcaaggaaaagat

SEQ ID NO: 6666987 - DNA, 18 bp, Homo sapiens
atgatcaccatgttagcc

SEQ ID NO: 6666988 - DNA, 21 bp, Homo sapiens
atgatcaccatgttagcctta

SEQ ID NO: 6666989 - DNA, 15 bp, Homo sapiens
atgatcacggctcac

SEQ ID NO: 6666990 - DNA, 18 bp, Homo sapiens
atgatcacggctcactgc

SEQ ID NO: 6666991 - DNA, 12 bp, Homo sapiens
atgatcactgtg

SEQ ID NO: 6666992 - DNA, 19 bp, Homo sapiens
atgatcagctgtttgtcat

SEQ ID NO: 6666993 - DNA, 20 bp, Homo sapiens
atgatcagtggacagtctgc

SEQ ID NO: 6666994 - DNA, 20 bp, Homo sapiens
atgatcagtgttgttgctct

SEQ ID NO: 6666995 - DNA, 13 bp, Homo sapiens
atgatcagttttt

SEQ ID NO: 6666996 - DNA, 17 bp, Homo sapiens
atgatcataaaagtgat

SEQ ID NO: 6666997 - DNA, 11 bp, Homo sapiens
atgatcatgaa

SEQ ID NO: 6666998 - DNA, 13 bp, Homo sapiens
atgatcatgaaac

SEQ ID NO: 6666999 - DNA, 13 bp, Homo sapiens
atgatcattgaaa

SEQ ID NO: 6667000 - DNA, 23 bp, Homo sapiens
atgatcattgaaagtaaaaaata

SEQ ID NO: 6667001 - DNA, 15 bp, Homo sapiens
atgatccaagcaaga

SEQ ID NO: 6667002 - DNA, 17 bp, Homo sapiens
atgatccaagcaagact

SEQ ID NO: 6667003 - DNA, 17 bp, Homo sapiens
atgatccagagcagagt

SEQ ID NO: 6667004 - DNA, 19 bp, Homo sapiens
atgatccagagcagagttt

SEQ ID NO: 6667005 - DNA, 20 bp, Homo sapiens
atgatccagcagattattca

SEQ ID NO: 6667006 - DNA, 22 bp, Homo sapiens
atgatccagcagattattcact

SEQ ID NO: 6667007 - DNA, 17 bp, Homo sapiens
atgatccagctgtgtgt

SEQ ID NO: 6667008 - DNA, 21 bp, Homo sapiens
atgatccatgagtttgccctg

SEQ ID NO: 6667009 - DNA, 22 bp, Homo sapiens
atgatccatgagtttgccctgg

SEQ ID NO: 6667010 - DNA, 18 bp, Homo sapiens
atgatccccacgccacag

SEQ ID NO: 6667011 - DNA, 19 bp, Homo sapiens
atgatccccacgccacagc

SEQ ID NO: 6667012 - DNA, 23 bp, Homo sapiens
atgatccccacgccacagccctt

SEQ ID NO: 6667013 - DNA, 21 bp, Homo sapiens
atgatccggatttaatttgat

SEQ ID NO: 6667014 - DNA, 16 bp, Homo sapiens
atgatcctaggcattt

SEQ ID NO: 6667015 - DNA, 12 bp, Homo sapiens
atgatcctccca

SEQ ID NO: 6667016 - DNA, 17 bp, Homo sapiens
atgatccttttttgtca

SEQ ID NO: 6667017 - DNA, 19 bp, Homo sapiens
atgatcgcccgataaagac

SEQ ID NO: 6667018 - DNA, 18 bp, Homo sapiens
atgatcgctgtattttga

SEQ ID NO: 6667019 - DNA, 22 bp, Homo sapiens
atgatcgctgtattttgagttt

SEQ ID NO: 6667020 - DNA, 15 bp, Homo sapiens
atgatcgtagacaca

SEQ ID NO: 6667021 - DNA, 14 bp, Homo sapiens
atgatcgtgcctat

SEQ ID NO: 6667022 - DNA, 17 bp, Homo sapiens
atgatctaataaacttt

SEQ ID NO: 6667023 - DNA, 16 bp, Homo sapiens
atgatctactcagaaa

SEQ ID NO: 6667024 - DNA, 15 bp, Homo sapiens
atgatctagttcctg

SEQ ID NO: 6667025 - DNA, 13 bp, Homo sapiens
atgatctattgct

SEQ ID NO: 6667026 - DNA, 17 bp, Homo sapiens
atgatctattgctcatc

SEQ ID NO: 6667027 - DNA, 15 bp, Homo sapiens
atgatctatttgtag

SEQ ID NO: 6667028 - DNA, 12 bp, Homo sapiens
atgatctccctg

SEQ ID NO: 6667029 - DNA, 16 bp, Homo sapiens
atgatctccgtatgat

SEQ ID NO: 6667030 - DNA, 18 bp, Homo sapiens
atgatctcggatgaccaa

SEQ ID NO: 6667031 - DNA, 15 bp, Homo sapiens
atgatctcggctcac

SEQ ID NO: 6667032 - DNA, 13 bp, Homo sapiens
atgatctgattga

SEQ ID NO: 6667033 - DNA, 13 bp, Homo sapiens
atgatctgtcaaa

SEQ ID NO: 6667034 - DNA, 15 bp, Homo sapiens
atgatctgtctgtgg

SEQ ID NO: 6667035 - DNA, 22 bp, Homo sapiens
atgatcttacacgaagaaatag

SEQ ID NO: 6667036 - DNA, 15 bp, Homo sapiens
atgatcttctttata

SEQ ID NO: 6667037 - DNA, 21 bp, Homo sapiens
atgatcttgagtataagaaat

SEQ ID NO: 6667038 - DNA, 14 bp, Homo sapiens
atgatcttgtgaca

SEQ ID NO: 6667039 - DNA, 15 bp, Homo sapiens
atgatcttgtgacat

SEQ ID NO: 6667040 - DNA, 16 bp, Homo sapiens
atgatctttaaaatac

SEQ ID NO: 6667041 - DNA, 18 bp, Homo sapiens
atgatgaaaaggttgcct

SEQ ID NO: 6667042 - DNA, 16 bp, Homo sapiens
atgatgaaaataataa

SEQ ID NO: 6667043 - DNA, 13 bp, Homo sapiens
atgatgaaaatat

SEQ ID NO: 6667044 - DNA, 15 bp, Homo sapiens
atgatgaaaatattt

SEQ ID NO: 6667045 - DNA, 16 bp, Homo sapiens
atgatgaaacattcat

SEQ ID NO: 6667046 - DNA, 18 bp, Homo sapiens
atgatgaaatgaggtcag

SEQ ID NO: 6667047 - DNA, 19 bp, Homo sapiens
atgatgaaattcttatgtt

SEQ ID NO: 6667048 - DNA, 15 bp, Homo sapiens
atgatgaactcacct

SEQ ID NO: 6667049 - DNA, 20 bp, Homo sapiens
atgatgaagaaatgatggaa

SEQ ID NO: 6667050 - DNA, 12 bp, Homo sapiens
atgatgaatgag

SEQ ID NO: 6667051 - DNA, 17 bp, Homo sapiens
atgatgaccaagaatta

SEQ ID NO: 6667052 - DNA, 16 bp, Homo sapiens
atgatgaccccggcct

SEQ ID NO: 6667053 - DNA, 22 bp, Homo sapiens
atgatgacgacgacaacgatga

SEQ ID NO: 6667054 - DNA, 16 bp, Homo sapiens
atgatgactcttctta

SEQ ID NO: 6667055 - DNA, 19 bp, Homo sapiens
atgatgactcttcttatca

SEQ ID NO: 6667056 - DNA, 20 bp, Homo sapiens
atgatgactcttcttatcac

SEQ ID NO: 6667057 - DNA, 19 bp, Homo sapiens
atgatgacttagtacaaag

SEQ ID NO: 6667058 - DNA, 16 bp, Homo sapiens
atgatgagaggccagc

SEQ ID NO: 6667059 - DNA, 17 bp, Homo sapiens
atgatgaggatctgaaa

SEQ ID NO: 6667060 - DNA, 15 bp, Homo sapiens
atgatgataaacact

SEQ ID NO: 6667061 - DNA, 15 bp, Homo sapiens
atgatgatctgcctc

SEQ ID NO: 6667062 - DNA, 18 bp, Homo sapiens
atgatgatctttaaaata

SEQ ID NO: 6667063 - DNA, 21 bp, Homo sapiens
atgatgatctttaaaatacac

SEQ ID NO: 6667064 - DNA, 14 bp, Homo sapiens
atgatgatgaaaac

SEQ ID NO: 6667065 - DNA, 14 bp, Homo sapiens
atgatgatgataat

SEQ ID NO: 6667066 - DNA, 16 bp, Homo sapiens
atgatgatgatgatga

SEQ ID NO: 6667067 - DNA, 16 bp, Homo sapiens
atgatgatgattttaa

SEQ ID NO: 6667068 - DNA, 15 bp, Homo sapiens
atgatgatgggaatt

SEQ ID NO: 6667069 - DNA, 20 bp, Homo sapiens
atgatgatgtggaagaactt

SEQ ID NO: 6667070 - DNA, 15 bp, Homo sapiens
atgatgatgttaacc

SEQ ID NO: 6667071 - DNA, 16 bp, Homo sapiens
atgatgattaaacacc

SEQ ID NO: 6667072 - DNA, 19 bp, Homo sapiens
atgatgattaaacacctga

SEQ ID NO: 6667073 - DNA, 20 bp, Homo sapiens
atgatgattaaacacctgac

SEQ ID NO: 6667074 - DNA, 15 bp, Homo sapiens
atgatgattcaatca

SEQ ID NO: 6667075 - DNA, 23 bp, Homo sapiens
atgatgattccttgagcatttta

SEQ ID NO: 6667076 - DNA, 14 bp, Homo sapiens
atgatgatttcaga

SEQ ID NO: 6667077 - DNA, 17 bp, Homo sapiens
atgatgcacagtatctg

SEQ ID NO: 6667078 - DNA, 20 bp, Homo sapiens
atgatgcagctgttgagaaa

SEQ ID NO: 6667079 - DNA, 14 bp, Homo sapiens
atgatgcagtctcc

SEQ ID NO: 6667080 - DNA, 14 bp, Homo sapiens
atgatgcatacagt

SEQ ID NO: 6667081 - DNA, 17 bp, Homo sapiens
atgatgcatgatgccct

SEQ ID NO: 6667082 - DNA, 19 bp, Homo sapiens
atgatgccctgctccaggg

SEQ ID NO: 6667083 - DNA, 21 bp, Homo sapiens
atgatgccgaacattaggaat

SEQ ID NO: 6667084 - DNA, 23 bp, Homo sapiens
atgatgccgctcttctgtcatcc

SEQ ID NO: 6667085 - DNA, 21 bp, Homo sapiens
atgatgctaagagtcctgggt

SEQ ID NO: 6667086 - DNA, 15 bp, Homo sapiens
atgatgctaagctga

SEQ ID NO: 6667087 - DNA, 15 bp, Homo sapiens
atgatgctagttctt

SEQ ID NO: 6667088 - DNA, 22 bp, Homo sapiens
atgatgctcaaaatctttccaa

SEQ ID NO: 6667089 - DNA, 20 bp, Homo sapiens
atgatgctgccggcacagct

SEQ ID NO: 6667090 - DNA, 14 bp, Homo sapiens
atgatgcttactac

SEQ ID NO: 6667091 - DNA, 23 bp, Homo sapiens
atgatgcttctataattttgcct

SEQ ID NO: 6667092 - DNA, 22 bp, Homo sapiens
atgatggaaacgcacttacaag

SEQ ID NO: 6667093 - DNA, 13 bp, Homo sapiens
atgatggaaagga

SEQ ID NO: 6667094 - DNA, 17 bp, Homo sapiens
atgatggaagtgttcag

SEQ ID NO: 6667095 - DNA, 17 bp, Homo sapiens
atgatggagcgcacctg

SEQ ID NO: 6667096 - DNA, 21 bp, Homo sapiens
atgatggatcaccattatatt

SEQ ID NO: 6667097 - DNA, 21 bp, Homo sapiens
atgatggatttaacagcatga

SEQ ID NO: 6667098 - DNA, 15 bp, Homo sapiens
atgatggcccattct

SEQ ID NO: 6667099 - DNA, 19 bp, Homo sapiens
atgatggcccattctactt

SEQ ID NO: 6667100 - DNA, 15 bp, Homo sapiens
atgatgggaaaatat

SEQ ID NO: 6667101 - DNA, 18 bp, Homo sapiens
atgatgggaaaatatttc

SEQ ID NO: 6667102 - DNA, 13 bp, Homo sapiens
atgatgggaggtg

SEQ ID NO: 6667103 - DNA, 11 bp, Homo sapiens
atgatgggatt

SEQ ID NO: 6667104 - DNA, 13 bp, Homo sapiens
atgatgggcctga

SEQ ID NO: 6667105 - DNA, 14 bp, Homo sapiens
atgatgggctggag

SEQ ID NO: 6667106 - DNA, 17 bp, Homo sapiens
atgatgggctggagcag

SEQ ID NO: 6667107 - DNA, 22 bp, Homo sapiens
atgatggggtcagcaggcccag

SEQ ID NO: 6667108 - DNA, 22 bp, Homo sapiens
atgatggtgttaaagctgtaca

SEQ ID NO: 6667109 - DNA, 14 bp, Homo sapiens
atgatggttcacgt

SEQ ID NO: 6667110 - DNA, 18 bp, Homo sapiens
atgatggttgcaaaagac

SEQ ID NO: 6667111 - DNA, 13 bp, Homo sapiens
atgatgtaattga

SEQ ID NO: 6667112 - DNA, 20 bp, Homo sapiens
atgatgtatataaaatgtgc

SEQ ID NO: 6667113 - DNA, 12 bp, Homo sapiens
atgatgtatatt

SEQ ID NO: 6667114 - DNA, 16 bp, Homo sapiens
atgatgtcacacaagc

SEQ ID NO: 6667115 - DNA, 19 bp, Homo sapiens
atgatgtccagaagaatat

SEQ ID NO: 6667116 - DNA, 18 bp, Homo sapiens
atgatgtcggtcttgcaa

SEQ ID NO: 6667117 - DNA, 19 bp, Homo sapiens
atgatgtcgttcattttct

SEQ ID NO: 6667118 - DNA, 17 bp, Homo sapiens
atgatgtctacagaaaa

SEQ ID NO: 6667119 - DNA, 19 bp, Homo sapiens
atgatgtctcttgtagaag

SEQ ID NO: 6667120 - DNA, 15 bp, Homo sapiens
atgatgtctgcaaag

SEQ ID NO: 6667121 - DNA, 12 bp, Homo sapiens
atgatgtgaaag

SEQ ID NO: 6667122 - DNA, 21 bp, Homo sapiens
atgatgtgaaagataaatgat

SEQ ID NO: 6667123 - DNA, 19 bp, Homo sapiens
atgatgtgatggaacacac

SEQ ID NO: 6667124 - DNA, 21 bp, Homo sapiens
atgatgtgatggaacacacac

SEQ ID NO: 6667125 - DNA, 22 bp, Homo sapiens
atgatgtgatggaacacacaca

SEQ ID NO: 6667126 - DNA, 16 bp, Homo sapiens
atgatgtgcctgggtg

SEQ ID NO: 6667127 - DNA, 13 bp, Homo sapiens
atgatgtggacat

SEQ ID NO: 6667128 - DNA, 19 bp, Homo sapiens
atgatgtgtacccaaacgt

SEQ ID NO: 6667129 - DNA, 16 bp, Homo sapiens
atgatgtgtgaaaact

SEQ ID NO: 6667130 - DNA, 17 bp, Homo sapiens
atgatgtgtgagtgtaa

SEQ ID NO: 6667131 - DNA, 15 bp, Homo sapiens
atgatgtgttgtgat

SEQ ID NO: 6667132 - DNA, 21 bp, Homo sapiens
atgatgtgtttaaactgagta

SEQ ID NO: 6667133 - DNA, 21 bp, Homo sapiens
atgatgttagaagaagaggaa

SEQ ID NO: 6667134 - DNA, 17 bp, Homo sapiens
atgatgttatacatcaa

SEQ ID NO: 6667135 - DNA, 13 bp, Homo sapiens
atgatgttatctt

SEQ ID NO: 6667136 - DNA, 17 bp, Homo sapiens
atgatgttatcttaaca

SEQ ID NO: 6667137 - DNA, 22 bp, Homo sapiens
atgatgttatcttaacactgaa

SEQ ID NO: 6667138 - DNA, 16 bp, Homo sapiens
atgatgttattttgta

SEQ ID NO: 6667139 - DNA, 15 bp, Homo sapiens
atgatgttgataatt

SEQ ID NO: 6667140 - DNA, 13 bp, Homo sapiens
atgatgttgctgt

SEQ ID NO: 6667141 - DNA, 23 bp, Homo sapiens
atgatgttggtccaaagtgcgtg

SEQ ID NO: 6667142 - DNA, 14 bp, Homo sapiens
atgatgttgtaaaa

SEQ ID NO: 6667143 - DNA, 21 bp, Homo sapiens
atgatgtttcgtgaagtatac

SEQ ID NO: 6667144 - DNA, 19 bp, Homo sapiens
atgatgtttcttttgcaat

SEQ ID NO: 6667145 - DNA, 11 bp, Homo sapiens
atgatgtttgc

SEQ ID NO: 6667146 - DNA, 21 bp, Homo sapiens
atgatgtttgcccaaaattta

SEQ ID NO: 6667147 - DNA, 15 bp, Homo sapiens
atgatgttttaaaaa

SEQ ID NO: 6667148 - DNA, 24 bp, Homo sapiens
atgatgttttccatgagtcccctg

SEQ ID NO: 6667149 - DNA, 15 bp, Homo sapiens
atgatgttttgatat

SEQ ID NO: 6667150 - DNA, 16 bp, Homo sapiens
atgatgttttgcaaag

SEQ ID NO: 6667151 - DNA, 17 bp, Homo sapiens
atgatgtttttaaaatc

SEQ ID NO: 6667152 - DNA, 18 bp, Homo sapiens
atgatgtttttaaaatct

SEQ ID NO: 6667153 - DNA, 22 bp, Homo sapiens
atgatgtttttaaaatcttatt

SEQ ID NO: 6667154 - DNA, 14 bp, Homo sapiens
atgattaaaaatat

SEQ ID NO: 6667155 - DNA, 18 bp, Homo sapiens
atgattaaacacctgaca

SEQ ID NO: 6667156 - DNA, 19 bp, Homo sapiens
atgattaaacacctgacac

SEQ ID NO: 6667157 - DNA, 21 bp, Homo sapiens
atgattaaacacctgacacat

SEQ ID NO: 6667158 - DNA, 14 bp, Homo sapiens
atgattaaagaaaa

SEQ ID NO: 6667159 - DNA, 18 bp, Homo sapiens
atgattaaataagattct

SEQ ID NO: 6667160 - DNA, 20 bp, Homo sapiens
atgattaaataagattctaa

SEQ ID NO: 6667161 - DNA, 19 bp, Homo sapiens
atgattaaattatcattgt

SEQ ID NO: 6667162 - DNA, 14 bp, Homo sapiens
atgattaatcagct

SEQ ID NO: 6667163 - DNA, 14 bp, Homo sapiens
atgattaatgtgta

SEQ ID NO: 6667164 - DNA, 19 bp, Homo sapiens
atgattaattaaatagctt

SEQ ID NO: 6667165 - DNA, 19 bp, Homo sapiens
atgattactctttgagata

SEQ ID NO: 6667166 - DNA, 14 bp, Homo sapiens
atgattactggcct

SEQ ID NO: 6667167 - DNA, 16 bp, Homo sapiens
atgattactttaaaat

SEQ ID NO: 6667168 - DNA, 23 bp, Homo sapiens
atgattagcaagttacagtgatg

SEQ ID NO: 6667169 - DNA, 21 bp, Homo sapiens
atgattagttaaaaaaagaaa

SEQ ID NO: 6667170 - DNA, 17 bp, Homo sapiens
atgattagttatgtctt

SEQ ID NO: 6667171 - DNA, 19 bp, Homo sapiens
atgattataagagagctta

SEQ ID NO: 6667172 - DNA, 15 bp, Homo sapiens
atgattataatgcta

SEQ ID NO: 6667173 - DNA, 16 bp, Homo sapiens
atgattattatttaaa

SEQ ID NO: 6667174 - DNA, 14 bp, Homo sapiens
atgattattttcaa

SEQ ID NO: 6667175 - DNA, 14 bp, Homo sapiens
atgattcaaatatc

SEQ ID NO: 6667176 - DNA, 22 bp, Homo sapiens
atgattcaaatatcaaaaggaa

SEQ ID NO: 6667177 - DNA, 16 bp, Homo sapiens
atgattcaaatgtttt

SEQ ID NO: 6667178 - DNA, 21 bp, Homo sapiens
atgattcaacaggttttcctg

SEQ ID NO: 6667179 - DNA, 16 bp, Homo sapiens
atgattcaagccattc

SEQ ID NO: 6667180 - DNA, 21 bp, Homo sapiens
atgattcaatcattttgggaa

SEQ ID NO: 6667181 - DNA, 16 bp, Homo sapiens
atgattcaatgtgaat

SEQ ID NO: 6667182 - DNA, 21 bp, Homo sapiens
atgattcaatgtgaattttaa

SEQ ID NO: 6667183 - DNA, 20 bp, Homo sapiens
atgattcaattttttaatgt

SEQ ID NO: 6667184 - DNA, 20 bp, Homo sapiens
atgattcagtgcattttcaa

SEQ ID NO: 6667185 - DNA, 20 bp, Homo sapiens
atgattcatctttcagaaat

SEQ ID NO: 6667186 - DNA, 22 bp, Homo sapiens
atgattcatgagctgggtactg

SEQ ID NO: 6667187 - DNA, 13 bp, Homo sapiens
atgattcatttta

SEQ ID NO: 6667188 - DNA, 13 bp, Homo sapiens
atgattccaaata

SEQ ID NO: 6667189 - DNA, 14 bp, Homo sapiens
atgattccaaataa

SEQ ID NO: 6667190 - DNA, 21 bp, Homo sapiens
atgattccaattactactttg

SEQ ID NO: 6667191 - DNA, 11 bp, Homo sapiens
atgattccctc

SEQ ID NO: 6667192 - DNA, 17 bp, Homo sapiens
atgattccgtgtgtgta

SEQ ID NO: 6667193 - DNA, 20 bp, Homo sapiens
atgattccgtgtgtgtactg

SEQ ID NO: 6667194 - DNA, 22 bp, Homo sapiens
atgattcctcttggcaagatgt

SEQ ID NO: 6667195 - DNA, 15 bp, Homo sapiens
atgattccttcctgt

SEQ ID NO: 6667196 - DNA, 22 bp, Homo sapiens
atgattccttgatggagatatt

SEQ ID NO: 6667197 - DNA, 19 bp, Homo sapiens
atgattcggatttgacaaa

SEQ ID NO: 6667198 - DNA, 18 bp, Homo sapiens
atgattcgtgtaattact

SEQ ID NO: 6667199 - DNA, 18 bp, Homo sapiens
atgattctatgtaatgta

SEQ ID NO: 6667200 - DNA, 18 bp, Homo sapiens
atgattctattatatatt

SEQ ID NO: 6667201 - DNA, 15 bp, Homo sapiens
atgattctcctctcc

SEQ ID NO: 6667202 - DNA, 16 bp, Homo sapiens
atgattctcctctccc

SEQ ID NO: 6667203 - DNA, 14 bp, Homo sapiens
atgattctctgagt

SEQ ID NO: 6667204 - DNA, 14 bp, Homo sapiens
atgattctctgtgg

SEQ ID NO: 6667205 - DNA, 15 bp, Homo sapiens
atgattctctgtggt

SEQ ID NO: 6667206 - DNA, 16 bp, Homo sapiens
atgattctctgtggtt

SEQ ID NO: 6667207 - DNA, 21 bp, Homo sapiens
atgattctgaacttttgtgga

SEQ ID NO: 6667208 - DNA, 12 bp, Homo sapiens
atgattctgaag

SEQ ID NO: 6667209 - DNA, 17 bp, Homo sapiens
atgattcttctaggcat

SEQ ID NO: 6667210 - DNA, 15 bp, Homo sapiens
atgattcttgtgtca

SEQ ID NO: 6667211 - DNA, 16 bp, Homo sapiens
atgattgaaaagaaga

SEQ ID NO: 6667212 - DNA, 20 bp, Homo sapiens
atgattgaaaagaagaaagt

SEQ ID NO: 6667213 - DNA, 14 bp, Homo sapiens
atgattgcactaaa

SEQ ID NO: 6667214 - DNA, 24 bp, Homo sapiens
atgattgcactaaataaactactt

SEQ ID NO: 6667215 - DNA, 19 bp, Homo sapiens
atgattgcagaattgttta

SEQ ID NO: 6667216 - DNA, 14 bp, Homo sapiens
atgattgctccaga

SEQ ID NO: 6667217 - DNA, 15 bp, Homo sapiens
atgattgctccagag

SEQ ID NO: 6667218 - DNA, 19 bp, Homo sapiens
atgattgcttgagctcagg

SEQ ID NO: 6667219 - DNA, 13 bp, Homo sapiens
atgattggattat

SEQ ID NO: 6667220 - DNA, 15 bp, Homo sapiens
atgattggattattc

SEQ ID NO: 6667221 - DNA, 18 bp, Homo sapiens
atgattggcttaaagtga

SEQ ID NO: 6667222 - DNA, 20 bp, Homo sapiens
atgattggcttaaagtgaag

SEQ ID NO: 6667223 - DNA, 22 bp, Homo sapiens
atgattggcttaaagtgaagga

SEQ ID NO: 6667224 - DNA, 23 bp, Homo sapiens
atgattggcttaaagtgaaggaa

SEQ ID NO: 6667225 - DNA, 15 bp, Homo sapiens
atgattggttcagtt

SEQ ID NO: 6667226 - DNA, 14 bp, Homo sapiens
atgattgtaaaata

SEQ ID NO: 6667227 - DNA, 18 bp, Homo sapiens
atgattgtaaaatagctt

SEQ ID NO: 6667228 - DNA, 16 bp, Homo sapiens
atgattgtaacatatt

SEQ ID NO: 6667229 - DNA, 17 bp, Homo sapiens
atgattgtaacatattt

SEQ ID NO: 6667230 - DNA, 14 bp, Homo sapiens
atgattgtatttgt

SEQ ID NO: 6667231 - DNA, 12 bp, Homo sapiens
atgattgtcttt

SEQ ID NO: 6667232 - DNA, 13 bp, Homo sapiens
atgattgtctttt

SEQ ID NO: 6667233 - DNA, 22 bp, Homo sapiens
atgattgtgcacatacttgaga

SEQ ID NO: 6667234 - DNA, 20 bp, Homo sapiens
atgattgttcttttgtttca

SEQ ID NO: 6667235 - DNA, 17 bp, Homo sapiens
atgattgtttaattgta

SEQ ID NO: 6667236 - DNA, 20 bp, Homo sapiens
atgattgtttctcaaatctt

SEQ ID NO: 6667237 - DNA, 21 bp, Homo sapiens
atgattgttttagaagttaaa

SEQ ID NO: 6667238 - DNA, 14 bp, Homo sapiens
atgatttaaaaaat

SEQ ID NO: 6667239 - DNA, 16 bp, Homo sapiens
atgatttaaaaaataa

SEQ ID NO: 6667240 - DNA, 18 bp, Homo sapiens
atgatttaaaacatgtaa

SEQ ID NO: 6667241 - DNA, 20 bp, Homo sapiens
atgatttaaatagaacttga

SEQ ID NO: 6667242 - DNA, 16 bp, Homo sapiens
atgatttaagcatttt

SEQ ID NO: 6667243 - DNA, 17 bp, Homo sapiens
atgatttaagcatttta

SEQ ID NO: 6667244 - DNA, 16 bp, Homo sapiens
atgatttaataaaata

SEQ ID NO: 6667245 - DNA, 22 bp, Homo sapiens
atgatttaataaaataattcta

SEQ ID NO: 6667246 - DNA, 17 bp, Homo sapiens
atgatttaatttgaaat

SEQ ID NO: 6667247 - DNA, 13 bp, Homo sapiens
atgatttacattt

SEQ ID NO: 6667248 - DNA, 21 bp, Homo sapiens
atgatttactcttagagatga

SEQ ID NO: 6667249 - DNA, 20 bp, Homo sapiens
atgatttataaacagacaat

SEQ ID NO: 6667250 - DNA, 14 bp, Homo sapiens
atgatttataccta

SEQ ID NO: 6667251 - DNA, 15 bp, Homo sapiens
atgatttatagtttg

SEQ ID NO: 6667252 - DNA, 20 bp, Homo sapiens
atgatttatagtttgtacat

SEQ ID NO: 6667253 - DNA, 14 bp, Homo sapiens
atgatttatatatg

SEQ ID NO: 6667254 - DNA, 22 bp, Homo sapiens
atgatttatatatggcatattt

SEQ ID NO: 6667255 - DNA, 22 bp, Homo sapiens
atgatttcaagatgttatatta

SEQ ID NO: 6667256 - DNA, 16 bp, Homo sapiens
atgatttcaatgattg

SEQ ID NO: 6667257 - DNA, 14 bp, Homo sapiens
atgatttcacaaat

SEQ ID NO: 6667258 - DNA, 18 bp, Homo sapiens
atgatttcacaaatatta

SEQ ID NO: 6667259 - DNA, 15 bp, Homo sapiens
atgatttcacagtgt

SEQ ID NO: 6667260 - DNA, 20 bp, Homo sapiens
atgatttcactagaaaagct

SEQ ID NO: 6667261 - DNA, 17 bp, Homo sapiens
atgatttcagctcactg

SEQ ID NO: 6667262 - DNA, 12 bp, Homo sapiens
atgatttcatat

SEQ ID NO: 6667263 - DNA, 21 bp, Homo sapiens
atgatttcatgctatctctgt

SEQ ID NO: 6667264 - DNA, 21 bp, Homo sapiens
atgatttcattatcacatgat

SEQ ID NO: 6667265 - DNA, 13 bp, Homo sapiens
atgatttcattca

SEQ ID NO: 6667266 - DNA, 19 bp, Homo sapiens
atgatttccttcaatgtgc

SEQ ID NO: 6667267 - DNA, 17 bp, Homo sapiens
atgatttccttgaatgt

SEQ ID NO: 6667268 - DNA, 18 bp, Homo sapiens
atgatttctagcaggcag

SEQ ID NO: 6667269 - DNA, 19 bp, Homo sapiens
atgatttctccagaaattt

SEQ ID NO: 6667270 - DNA, 14 bp, Homo sapiens
atgatttcttgctt

SEQ ID NO: 6667271 - DNA, 17 bp, Homo sapiens
atgatttcttgctttgg

SEQ ID NO: 6667272 - DNA, 12 bp, Homo sapiens
atgatttgcaac

SEQ ID NO: 6667273 - DNA, 16 bp, Homo sapiens
atgatttgcaacttta

SEQ ID NO: 6667274 - DNA, 22 bp, Homo sapiens
atgatttgcattttttaaattt

SEQ ID NO: 6667275 - DNA, 21 bp, Homo sapiens
atgatttgccgacatgtttga

SEQ ID NO: 6667276 - DNA, 14 bp, Homo sapiens
atgatttggccagg

SEQ ID NO: 6667277 - DNA, 17 bp, Homo sapiens
atgatttggccaggcct

SEQ ID NO: 6667278 - DNA, 22 bp, Homo sapiens
atgatttgggctctagaattcc

SEQ ID NO: 6667279 - DNA, 11 bp, Homo sapiens
atgatttgtaa

SEQ ID NO: 6667280 - DNA, 12 bp, Homo sapiens
atgatttgtaaa

SEQ ID NO: 6667281 - DNA, 17 bp, Homo sapiens
atgatttgtaaaggact

SEQ ID NO: 6667282 - DNA, 16 bp, Homo sapiens
atgatttgtaacattc

SEQ ID NO: 6667283 - DNA, 23 bp, Homo sapiens
atgatttgtcccagcctggggct

SEQ ID NO: 6667284 - DNA, 13 bp, Homo sapiens
atgatttgtggaa

SEQ ID NO: 6667285 - DNA, 15 bp, Homo sapiens
atgatttgttttgaa

SEQ ID NO: 6667286 - DNA, 17 bp, Homo sapiens
atgattttaacagtttt

SEQ ID NO: 6667287 - DNA, 11 bp, Homo sapiens
atgattttaca

SEQ ID NO: 6667288 - DNA, 15 bp, Homo sapiens
atgattttacagaga

SEQ ID NO: 6667289 - DNA, 14 bp, Homo sapiens
atgattttacttag

SEQ ID NO: 6667290 - DNA, 22 bp, Homo sapiens
atgattttatacatagtcacaa

SEQ ID NO: 6667291 - DNA, 18 bp, Homo sapiens
atgattttattacagaaa

SEQ ID NO: 6667292 - DNA, 20 bp, Homo sapiens
atgattttatttaaactatt

SEQ ID NO: 6667293 - DNA, 12 bp, Homo sapiens
atgattttcctc

SEQ ID NO: 6667294 - DNA, 13 bp, Homo sapiens
atgattttccttt

SEQ ID NO: 6667295 - DNA, 14 bp, Homo sapiens
atgattttcctttt

SEQ ID NO: 6667296 - DNA, 17 bp, Homo sapiens
atgattttgatgcacaa

SEQ ID NO: 6667297 - DNA, 16 bp, Homo sapiens
atgattttgcttttcc

SEQ ID NO: 6667298 - DNA, 20 bp, Homo sapiens
atgattttgtaattcttatg

SEQ ID NO: 6667299 - DNA, 23 bp, Homo sapiens
atgattttgttttcatcccattt

SEQ ID NO: 6667300 - DNA, 18 bp, Homo sapiens
atgatttttaacttttta

SEQ ID NO: 6667301 - DNA, 21 bp, Homo sapiens
atgatttttaagtacaaaaaa

SEQ ID NO: 6667302 - DNA, 13 bp, Homo sapiens
atgatttttagac

SEQ ID NO: 6667303 - DNA, 13 bp, Homo sapiens
atgatttttagat

SEQ ID NO: 6667304 - DNA, 19 bp, Homo sapiens
atgatttttctttacaaaa

SEQ ID NO: 6667305 - DNA, 16 bp, Homo sapiens
atgatttttgctattt

SEQ ID NO: 6667306 - DNA, 14 bp, Homo sapiens
atgatttttgtgta

SEQ ID NO: 6667307 - DNA, 20 bp, Homo sapiens
atgattttttaaaagaaatt

SEQ ID NO: 6667308 - DNA, 13 bp, Homo sapiens
atgattttttaag

SEQ ID NO: 6667309 - DNA, 14 bp, Homo sapiens
atgattttttaagc

SEQ ID NO: 6667310 - DNA, 22 bp, Homo sapiens
atgattttttaagcagactcag

SEQ ID NO: 6667311 - DNA, 21 bp, Homo sapiens
atgattttttaagtctatgtt

SEQ ID NO: 6667312 - DNA, 15 bp, Homo sapiens
atgattttttcatga

SEQ ID NO: 6667313 - DNA, 17 bp, Homo sapiens
atgattttttgaaagtt

SEQ ID NO: 6667314 - DNA, 23 bp, Homo sapiens
atgattttttgaaagttaacatt

SEQ ID NO: 6667315 - DNA, 17 bp, Homo sapiens
atgatttttttttcata

SEQ ID NO: 6667316 - DNA, 21 bp, Homo sapiens
atgatttttttttcatacact

SEQ ID NO: 6667317 - DNA, 18 bp, Homo sapiens
atgcaaaaaaaaaaatgt

SEQ ID NO: 6667318 - DNA, 16 bp, Homo sapiens
atgcaaaaaaaattag

SEQ ID NO: 6667319 - DNA, 13 bp, Homo sapiens
atgcaaaaaatct

SEQ ID NO: 6667320 - DNA, 17 bp, Homo sapiens
atgcaaaaaatcttaat

SEQ ID NO: 6667321 - DNA, 23 bp, Homo sapiens
atgcaaaaaatcttaatactgtt

SEQ ID NO: 6667322 - DNA, 18 bp, Homo sapiens
atgcaaaaacatatgtct

SEQ ID NO: 6667323 - DNA, 23 bp, Homo sapiens
atgcaaaaagaaatgactaatta

SEQ ID NO: 6667324 - DNA, 11 bp, Homo sapiens
atgcaaaaatc

SEQ ID NO: 6667325 - DNA, 15 bp, Homo sapiens
atgcaaaaatgaatt

SEQ ID NO: 6667326 - DNA, 21 bp, Homo sapiens
atgcaaaaccttgtgaactga

SEQ ID NO: 6667327 - DNA, 16 bp, Homo sapiens
atgcaaaagaaagcaa

SEQ ID NO: 6667328 - DNA, 18 bp, Homo sapiens
atgcaaaagcaatcatag

SEQ ID NO: 6667329 - DNA, 19 bp, Homo sapiens
atgcaaaagcaatcataga

SEQ ID NO: 6667330 - DNA, 21 bp, Homo sapiens
atgcaaaagtcagcgtgacaa

SEQ ID NO: 6667331 - DNA, 24 bp, Homo sapiens
atgcaaaagtcagcgtgacaatat

SEQ ID NO: 6667332 - DNA, 14 bp, Homo sapiens
atgcaaaataaaga

SEQ ID NO: 6667333 - DNA, 18 bp, Homo sapiens
atgcaaaataaatgtttt

SEQ ID NO: 6667334 - DNA, 21 bp, Homo sapiens
atgcaaaataatacctgtcca

SEQ ID NO: 6667335 - DNA, 12 bp, Homo sapiens
atgcaaaataga

SEQ ID NO: 6667336 - DNA, 21 bp, Homo sapiens
atgcaaaatagacatctttaa

SEQ ID NO: 6667337 - DNA, 22 bp, Homo sapiens
atgcaaaatcaggaaaggctgt

SEQ ID NO: 6667338 - DNA, 21 bp, Homo sapiens
atgcaaacaagaaacgtgtca

SEQ ID NO: 6667339 - DNA, 16 bp, Homo sapiens
atgcaaaccagcttta

SEQ ID NO: 6667340 - DNA, 16 bp, Homo sapiens
atgcaaaccaggagca

SEQ ID NO: 6667341 - DNA, 18 bp, Homo sapiens
atgcaaaccatcattgaa

SEQ ID NO: 6667342 - DNA, 18 bp, Homo sapiens
atgcaaacgttggagttt

SEQ ID NO: 6667343 - DNA, 12 bp, Homo sapiens
atgcaaactctt

SEQ ID NO: 6667344 - DNA, 23 bp, Homo sapiens
atgcaaactgtgcttctctatga

SEQ ID NO: 6667345 - DNA, 22 bp, Homo sapiens
atgcaaactttattttgtgttt

SEQ ID NO: 6667346 - DNA, 15 bp, Homo sapiens
atgcaaagaaaatca

SEQ ID NO: 6667347 - DNA, 16 bp, Homo sapiens
atgcaaagaggcaaga

SEQ ID NO: 6667348 - DNA, 19 bp, Homo sapiens
atgcaaagcactctctgca

SEQ ID NO: 6667349 - DNA, 22 bp, Homo sapiens
atgcaaagctgaagaccatgga

SEQ ID NO: 6667350 - DNA, 19 bp, Homo sapiens
atgcaaagtacaatgtgtt

SEQ ID NO: 6667351 - DNA, 20 bp, Homo sapiens
atgcaaagtataaatttgtg

SEQ ID NO: 6667352 - DNA, 23 bp, Homo sapiens
atgcaaataaaacccaatacttt

SEQ ID NO: 6667353 - DNA, 23 bp, Homo sapiens
atgcaaataaagcctgctctccc

SEQ ID NO: 6667354 - DNA, 16 bp, Homo sapiens
atgcaaatacaatcag

SEQ ID NO: 6667355 - DNA, 13 bp, Homo sapiens
atgcaaatacatt

SEQ ID NO: 6667356 - DNA, 22 bp, Homo sapiens
atgcaaatagattcagagaaat

SEQ ID NO: 6667357 - DNA, 19 bp, Homo sapiens
atgcaaatagtagacattt

SEQ ID NO: 6667358 - DNA, 16 bp, Homo sapiens
atgcaaatattgctat

SEQ ID NO: 6667359 - DNA, 11 bp, Homo sapiens
atgcaaatcct

SEQ ID NO: 6667360 - DNA, 19 bp, Homo sapiens
atgcaaatcctatgtgatt

SEQ ID NO: 6667361 - DNA, 15 bp, Homo sapiens
atgcaaatgaaggaa

SEQ ID NO: 6667362 - DNA, 12 bp, Homo sapiens
atgcaaatgaat

SEQ ID NO: 6667363 - DNA, 13 bp, Homo sapiens
atgcaaatgaatc

SEQ ID NO: 6667364 - DNA, 14 bp, Homo sapiens
atgcaaatgaatca

SEQ ID NO: 6667365 - DNA, 18 bp, Homo sapiens
atgcaaatgaatcattgt

SEQ ID NO: 6667366 - DNA, 14 bp, Homo sapiens
atgcaaatgagctc

SEQ ID NO: 6667367 - DNA, 20 bp, Homo sapiens
atgcaaatgagttcaggact

SEQ ID NO: 6667368 - DNA, 16 bp, Homo sapiens
atgcaaatgtcttcca

SEQ ID NO: 6667369 - DNA, 14 bp, Homo sapiens
atgcaaattctcaa

SEQ ID NO: 6667370 - DNA, 13 bp, Homo sapiens
atgcaaattgtga

SEQ ID NO: 6667371 - DNA, 14 bp, Homo sapiens
atgcaaattgtgaa

SEQ ID NO: 6667372 - DNA, 13 bp, Homo sapiens
atgcaacaaaaat

SEQ ID NO: 6667373 - DNA, 16 bp, Homo sapiens
atgcaacaaatattta

SEQ ID NO: 6667374 - DNA, 21 bp, Homo sapiens
atgcaacaacatgtataatat

SEQ ID NO: 6667375 - DNA, 23 bp, Homo sapiens
atgcaacatttgtgcagaaattt

SEQ ID NO: 6667376 - DNA, 14 bp, Homo sapiens
atgcaaccaaaagg

SEQ ID NO: 6667377 - DNA, 22 bp, Homo sapiens
atgcaaccaaaagggaaaaaat

SEQ ID NO: 6667378 - DNA, 17 bp, Homo sapiens
atgcaaccaagtcacac

SEQ ID NO: 6667379 - DNA, 15 bp, Homo sapiens
atgcaaccatttgaa

SEQ ID NO: 6667380 - DNA, 12 bp, Homo sapiens
atgcaacctgtg

SEQ ID NO: 6667381 - DNA, 13 bp, Homo sapiens
atgcaacctgtgc

SEQ ID NO: 6667382 - DNA, 12 bp, Homo sapiens
atgcaactccaa

SEQ ID NO: 6667383 - DNA, 20 bp, Homo sapiens
atgcaactcgccctgtttgg

SEQ ID NO: 6667384 - DNA, 17 bp, Homo sapiens
atgcaactctaactctg

SEQ ID NO: 6667385 - DNA, 16 bp, Homo sapiens
atgcaagaaaaaaact

SEQ ID NO: 6667386 - DNA, 20 bp, Homo sapiens
atgcaagaaaaaaacttact

SEQ ID NO: 6667387 - DNA, 15 bp, Homo sapiens
atgcaagaagaatat

SEQ ID NO: 6667388 - DNA, 20 bp, Homo sapiens
atgcaagacttcactgcagc

SEQ ID NO: 6667389 - DNA, 23 bp, Homo sapiens
atgcaagacttcactgcagcctt

SEQ ID NO: 6667390 - DNA, 23 bp, Homo sapiens
atgcaagagaacattttactgtt

SEQ ID NO: 6667391 - DNA, 15 bp, Homo sapiens
atgcaagagaaggag

SEQ ID NO: 6667392 - DNA, 20 bp, Homo sapiens
atgcaagagtgattgcagct

SEQ ID NO: 6667393 - DNA, 21 bp, Homo sapiens
atgcaagagtgattgcagctt

SEQ ID NO: 6667394 - DNA, 17 bp, Homo sapiens
atgcaagcagaggacca

SEQ ID NO: 6667395 - DNA, 13 bp, Homo sapiens
atgcaagcagttt

SEQ ID NO: 6667396 - DNA, 15 bp, Homo sapiens
atgcaagcagtttca

SEQ ID NO: 6667397 - DNA, 15 bp, Homo sapiens
atgcaagctcagggt

SEQ ID NO: 6667398 - DNA, 16 bp, Homo sapiens
atgcaagcttggtcaa

SEQ ID NO: 6667399 - DNA, 23 bp, Homo sapiens
atgcaagcttggtcaaacttttt

SEQ ID NO: 6667400 - DNA, 13 bp, Homo sapiens
atgcaaggaagga

SEQ ID NO: 6667401 - DNA, 14 bp, Homo sapiens
atgcaaggaaggaa

SEQ ID NO: 6667402 - DNA, 15 bp, Homo sapiens
atgcaaggaaggaaa

SEQ ID NO: 6667403 - DNA, 14 bp, Homo sapiens
atgcaaggaccagg

SEQ ID NO: 6667404 - DNA, 12 bp, Homo sapiens
atgcaaggatta

SEQ ID NO: 6667405 - DNA, 18 bp, Homo sapiens
atgcaagggactgtgtgt

SEQ ID NO: 6667406 - DNA, 14 bp, Homo sapiens
atgcaaggtcattt

SEQ ID NO: 6667407 - DNA, 24 bp, Homo sapiens
atgcaagtacaagtatataatatg

SEQ ID NO: 6667408 - DNA, 17 bp, Homo sapiens
atgcaagtagctggctg

SEQ ID NO: 6667409 - DNA, 18 bp, Homo sapiens
atgcaagtgagaaagaca

SEQ ID NO: 6667410 - DNA, 14 bp, Homo sapiens
atgcaagtgctgtt

SEQ ID NO: 6667411 - DNA, 22 bp, Homo sapiens
atgcaagtggagctgtctgtct

SEQ ID NO: 6667412 - DNA, 19 bp, Homo sapiens
atgcaagtgggagatgaaa

SEQ ID NO: 6667413 - DNA, 20 bp, Homo sapiens
atgcaagtgggagatgaaaa

SEQ ID NO: 6667414 - DNA, 21 bp, Homo sapiens
atgcaagtgggagatgaaaac

SEQ ID NO: 6667415 - DNA, 12 bp, Homo sapiens
atgcaagttatt

SEQ ID NO: 6667416 - DNA, 16 bp, Homo sapiens
atgcaataaaattatt

SEQ ID NO: 6667417 - DNA, 15 bp, Homo sapiens
atgcaataaataaca

SEQ ID NO: 6667418 - DNA, 16 bp, Homo sapiens
atgcaataaccagcat

SEQ ID NO: 6667419 - DNA, 15 bp, Homo sapiens
atgcaataactctgg

SEQ ID NO: 6667420 - DNA, 17 bp, Homo sapiens
atgcaataactctggga

SEQ ID NO: 6667421 - DNA, 12 bp, Homo sapiens
atgcaataagat

SEQ ID NO: 6667422 - DNA, 15 bp, Homo sapiens
atgcaataagattta

SEQ ID NO: 6667423 - DNA, 16 bp, Homo sapiens
atgcaataagatttag

SEQ ID NO: 6667424 - DNA, 15 bp, Homo sapiens
atgcaatataaaaat

SEQ ID NO: 6667425 - DNA, 18 bp, Homo sapiens
atgcaatatatccccact

SEQ ID NO: 6667426 - DNA, 21 bp, Homo sapiens
atgcaatatatccccactact

SEQ ID NO: 6667427 - DNA, 15 bp, Homo sapiens
atgcaatatatctaa

SEQ ID NO: 6667428 - DNA, 13 bp, Homo sapiens
atgcaatatttgt

SEQ ID NO: 6667429 - DNA, 14 bp, Homo sapiens
atgcaatatttgta

SEQ ID NO: 6667430 - DNA, 22 bp, Homo sapiens
atgcaatcagacaagtgttttg

SEQ ID NO: 6667431 - DNA, 18 bp, Homo sapiens
atgcaatcctacttctat

SEQ ID NO: 6667432 - DNA, 17 bp, Homo sapiens
atgcaatccttacaaat

SEQ ID NO: 6667433 - DNA, 18 bp, Homo sapiens
atgcaatccttacaaatg

SEQ ID NO: 6667434 - DNA, 17 bp, Homo sapiens
atgcaatccttccctgc

SEQ ID NO: 6667435 - DNA, 23 bp, Homo sapiens
atgcaatgaaaacaaaattccat

SEQ ID NO: 6667436 - DNA, 18 bp, Homo sapiens
atgcaatgaaacagatga

SEQ ID NO: 6667437 - DNA, 12 bp, Homo sapiens
atgcaatgagat

SEQ ID NO: 6667438 - DNA, 19 bp, Homo sapiens
atgcaatgataaataaagt

SEQ ID NO: 6667439 - DNA, 16 bp, Homo sapiens
atgcaatgcaattcaa

SEQ ID NO: 6667440 - DNA, 17 bp, Homo sapiens
atgcaatgcatatctgt

SEQ ID NO: 6667441 - DNA, 16 bp, Homo sapiens
atgcaatgcatctgaa

SEQ ID NO: 6667442 - DNA, 18 bp, Homo sapiens
atgcaatgcttcattatt

SEQ ID NO: 6667443 - DNA, 16 bp, Homo sapiens
atgcaatgtatggctt

SEQ ID NO: 6667444 - DNA, 21 bp, Homo sapiens
atgcaatgtcttaaataaaac

SEQ ID NO: 6667445 - DNA, 18 bp, Homo sapiens
atgcaatgtgctactgat

SEQ ID NO: 6667446 - DNA, 15 bp, Homo sapiens
atgcaattaaaacta

SEQ ID NO: 6667447 - DNA, 18 bp, Homo sapiens
atgcaattagatagaaaa

SEQ ID NO: 6667448 - DNA, 14 bp, Homo sapiens
atgcaattcaatgc

SEQ ID NO: 6667449 - DNA, 15 bp, Homo sapiens
atgcaattcaatgca

SEQ ID NO: 6667450 - DNA, 15 bp, Homo sapiens
atgcaattcagtgtt

SEQ ID NO: 6667451 - DNA, 19 bp, Homo sapiens
atgcaattggggaagaaaa

SEQ ID NO: 6667452 - DNA, 13 bp, Homo sapiens
atgcaattgttga

SEQ ID NO: 6667453 - DNA, 19 bp, Homo sapiens
atgcaatttgaagtaactt

SEQ ID NO: 6667454 - DNA, 23 bp, Homo sapiens
atgcaatttgaagtaacttattt

SEQ ID NO: 6667455 - DNA, 20 bp, Homo sapiens
atgcaattttattaaatgca

SEQ ID NO: 6667456 - DNA, 20 bp, Homo sapiens
atgcaattttgcatttgaat

SEQ ID NO: 6667457 - DNA, 14 bp, Homo sapiens
atgcaatttttaaa

SEQ ID NO: 6667458 - DNA, 16 bp, Homo sapiens
atgcacaaaaagatgc

SEQ ID NO: 6667459 - DNA, 16 bp, Homo sapiens
atgcacaaacagaggc

SEQ ID NO: 6667460 - DNA, 17 bp, Homo sapiens
atgcacaaacagaggcc

SEQ ID NO: 6667461 - DNA, 22 bp, Homo sapiens
atgcacaactagttaaaagcct

SEQ ID NO: 6667462 - DNA, 14 bp, Homo sapiens
atgcacaattccat

SEQ ID NO: 6667463 - DNA, 11 bp, Homo sapiens
atgcacaattt

SEQ ID NO: 6667464 - DNA, 22 bp, Homo sapiens
atgcacacaaaacaaccctaga

SEQ ID NO: 6667465 - DNA, 12 bp, Homo sapiens
atgcacacacac

SEQ ID NO: 6667466 - DNA, 13 bp, Homo sapiens
atgcacacacaca

SEQ ID NO: 6667467 - DNA, 14 bp, Homo sapiens
atgcacacacacac

SEQ ID NO: 6667468 - DNA, 15 bp, Homo sapiens
atgcacacacacaca

SEQ ID NO: 6667469 - DNA, 16 bp, Homo sapiens
atgcacacacctcatg

SEQ ID NO: 6667470 - DNA, 23 bp, Homo sapiens
atgcacacagcggctgcctcctg

SEQ ID NO: 6667471 - DNA, 22 bp, Homo sapiens
atgcacacaggagaaaatgcaa

SEQ ID NO: 6667472 - DNA, 11 bp, Homo sapiens
atgcacacata

SEQ ID NO: 6667473 - DNA, 14 bp, Homo sapiens
atgcacacatatat

SEQ ID NO: 6667474 - DNA, 19 bp, Homo sapiens
atgcacacattttttaaat

SEQ ID NO: 6667475 - DNA, 23 bp, Homo sapiens
atgcacaccaaaaaaatacttga

SEQ ID NO: 6667476 - DNA, 17 bp, Homo sapiens
atgcacaccaaattgct

SEQ ID NO: 6667477 - DNA, 19 bp, Homo sapiens
atgcacaccaaattgctga

SEQ ID NO: 6667478 - DNA, 22 bp, Homo sapiens
atgcacaccaaattgctgagat

SEQ ID NO: 6667479 - DNA, 21 bp, Homo sapiens
atgcacactgagaatgctaat

SEQ ID NO: 6667480 - DNA, 17 bp, Homo sapiens
atgcacagagaagctgg

SEQ ID NO: 6667481 - DNA, 18 bp, Homo sapiens
atgcacagagttgttaca

SEQ ID NO: 6667482 - DNA, 13 bp, Homo sapiens
atgcacagatata

SEQ ID NO: 6667483 - DNA, 16 bp, Homo sapiens
atgcacagatatactt

SEQ ID NO: 6667484 - DNA, 19 bp, Homo sapiens
atgcacagatatactttgt

SEQ ID NO: 6667485 - DNA, 22 bp, Homo sapiens
atgcacagatgccatggcctgt

SEQ ID NO: 6667486 - DNA, 15 bp, Homo sapiens
atgcacagctgcttg

SEQ ID NO: 6667487 - DNA, 12 bp, Homo sapiens
atgcacagtaca

SEQ ID NO: 6667488 - DNA, 14 bp, Homo sapiens
atgcacagtacaat

SEQ ID NO: 6667489 - DNA, 15 bp, Homo sapiens
atgcacagtacaata

SEQ ID NO: 6667490 - DNA, 15 bp, Homo sapiens
atgcacagtatctgc

SEQ ID NO: 6667491 - DNA, 21 bp, Homo sapiens
atgcacagtatctgctgttct

SEQ ID NO: 6667492 - DNA, 22 bp, Homo sapiens
atgcacagtatctgctgttctt

SEQ ID NO: 6667493 - DNA, 14 bp, Homo sapiens
atgcacagtatttg

SEQ ID NO: 6667494 - DNA, 12 bp, Homo sapiens
atgcacagtcat

SEQ ID NO: 6667495 - DNA, 15 bp, Homo sapiens
atgcacagtcataca

SEQ ID NO: 6667496 - DNA, 22 bp, Homo sapiens
atgcacagtgcctgatgggagt

SEQ ID NO: 6667497 - DNA, 22 bp, Homo sapiens
atgcacagttctatttgctatc

SEQ ID NO: 6667498 - DNA, 18 bp, Homo sapiens
atgcacatatggactctg

SEQ ID NO: 6667499 - DNA, 21 bp, Homo sapiens
atgcacatatggactctgcac

SEQ ID NO: 6667500 - DNA, 14 bp, Homo sapiens
atgcacatccctgg

SEQ ID NO: 6667501 - DNA, 19 bp, Homo sapiens
atgcacatgctgtctggcc

SEQ ID NO: 6667502 - DNA, 22 bp, Homo sapiens
atgcacatgtaacccaaatgtc

SEQ ID NO: 6667503 - DNA, 16 bp, Homo sapiens
atgcacatgtattctg

SEQ ID NO: 6667504 - DNA, 23 bp, Homo sapiens
atgcacatgttggaggagagagc

SEQ ID NO: 6667505 - DNA, 16 bp, Homo sapiens
atgcacattcatcctc

SEQ ID NO: 6667506 - DNA, 22 bp, Homo sapiens
atgcacattcatcctcacatgt

SEQ ID NO: 6667507 - DNA, 19 bp, Homo sapiens
atgcacattggaagctccc

SEQ ID NO: 6667508 - DNA, 21 bp, Homo sapiens
atgcacatttatatatatatg

SEQ ID NO: 6667509 - DNA, 12 bp, Homo sapiens
atgcacatttgt

SEQ ID NO: 6667510 - DNA, 21 bp, Homo sapiens
atgcacatttgtcactgaata

SEQ ID NO: 6667511 - DNA, 20 bp, Homo sapiens
atgcacatttgtgcataaat

SEQ ID NO: 6667512 - DNA, 18 bp, Homo sapiens
atgcaccaccaagccaag

SEQ ID NO: 6667513 - DNA, 21 bp, Homo sapiens
atgcaccaccaagccaaggga

SEQ ID NO: 6667514 - DNA, 14 bp, Homo sapiens
atgcaccagccctt

SEQ ID NO: 6667515 - DNA, 22 bp, Homo sapiens
atgcaccagcccttagcaggga

SEQ ID NO: 6667516 - DNA, 19 bp, Homo sapiens
atgcaccagtgccgcctgt

SEQ ID NO: 6667517 - DNA, 22 bp, Homo sapiens
atgcaccagtgccgcctgtgcc

SEQ ID NO: 6667518 - DNA, 14 bp, Homo sapiens
atgcacccatcagc

SEQ ID NO: 6667519 - DNA, 22 bp, Homo sapiens
atgcacccatcagcactctgta

SEQ ID NO: 6667520 - DNA, 14 bp, Homo sapiens
atgcacccatcagt

SEQ ID NO: 6667521 - DNA, 14 bp, Homo sapiens
atgcacccctgagc

SEQ ID NO: 6667522 - DNA, 18 bp, Homo sapiens
atgcacccctggaaccag

SEQ ID NO: 6667523 - DNA, 13 bp, Homo sapiens
atgcaccctccct

SEQ ID NO: 6667524 - DNA, 18 bp, Homo sapiens
atgcaccctccctcctgc

SEQ ID NO: 6667525 - DNA, 22 bp, Homo sapiens
atgcaccctccctcctgccgct

SEQ ID NO: 6667526 - DNA, 14 bp, Homo sapiens
atgcacctaaagaa

SEQ ID NO: 6667527 - DNA, 20 bp, Homo sapiens
atgcacctagctgtgcaaga

SEQ ID NO: 6667528 - DNA, 23 bp, Homo sapiens
atgcacctcccttccctccctga

SEQ ID NO: 6667529 - DNA, 24 bp, Homo sapiens
atgcacctgaatgttagatagtta

SEQ ID NO: 6667530 - DNA, 13 bp, Homo sapiens
atgcacctggaat

SEQ ID NO: 6667531 - DNA, 14 bp, Homo sapiens
atgcacctggaata

SEQ ID NO: 6667532 - DNA, 19 bp, Homo sapiens
atgcacctggaatatataa

SEQ ID NO: 6667533 - DNA, 19 bp, Homo sapiens
atgcaccttgtgtctgtac

SEQ ID NO: 6667534 - DNA, 18 bp, Homo sapiens
atgcacggtttctgttct

SEQ ID NO: 6667535 - DNA, 22 bp, Homo sapiens
atgcacggtttctgttctgccc

SEQ ID NO: 6667536 - DNA, 18 bp, Homo sapiens
atgcacgtggggcccact

SEQ ID NO: 6667537 - DNA, 14 bp, Homo sapiens
atgcactaagacaa

SEQ ID NO: 6667538 - DNA, 23 bp, Homo sapiens
atgcactaagacaagaacattct

SEQ ID NO: 6667539 - DNA, 20 bp, Homo sapiens
atgcactaatcaatactttg

SEQ ID NO: 6667540 - DNA, 16 bp, Homo sapiens
atgcactagccaaccc

SEQ ID NO: 6667541 - DNA, 21 bp, Homo sapiens
atgcactagccaacccaactg

SEQ ID NO: 6667542 - DNA, 18 bp, Homo sapiens
atgcactatatgtttaca

SEQ ID NO: 6667543 - DNA, 17 bp, Homo sapiens
atgcactatatttgtat

SEQ ID NO: 6667544 - DNA, 20 bp, Homo sapiens
atgcactatatttgtatata

SEQ ID NO: 6667545 - DNA, 13 bp, Homo sapiens
atgcactatgagg

SEQ ID NO: 6667546 - DNA, 13 bp, Homo sapiens
atgcactcacccc

SEQ ID NO: 6667547 - DNA, 14 bp, Homo sapiens
atgcactcagctct

SEQ ID NO: 6667548 - DNA, 15 bp, Homo sapiens
atgcactcagtgtgg

SEQ ID NO: 6667549 - DNA, 13 bp, Homo sapiens
atgcactcctgcc

SEQ ID NO: 6667550 - DNA, 19 bp, Homo sapiens
atgcactcctgccccggcc

SEQ ID NO: 6667551 - DNA, 14 bp, Homo sapiens
atgcactcgctgtg

SEQ ID NO: 6667552 - DNA, 13 bp, Homo sapiens
atgcactctctct

SEQ ID NO: 6667553 - DNA, 17 bp, Homo sapiens
atgcactctctctctgt

SEQ ID NO: 6667554 - DNA, 20 bp, Homo sapiens
atgcactctctctctgttaa

SEQ ID NO: 6667555 - DNA, 22 bp, Homo sapiens
atgcactctgggtctggccagg

SEQ ID NO: 6667556 - DNA, 20 bp, Homo sapiens
atgcactgaaaacttagcca

SEQ ID NO: 6667557 - DNA, 15 bp, Homo sapiens
atgcactgaagagct

SEQ ID NO: 6667558 - DNA, 21 bp, Homo sapiens
atgcactgaagagctcttggc

SEQ ID NO: 6667559 - DNA, 24 bp, Homo sapiens
atgcactgatgtgtgaagtgagaa

SEQ ID NO: 6667560 - DNA, 17 bp, Homo sapiens
atgcactgcaaatactt

SEQ ID NO: 6667561 - DNA, 14 bp, Homo sapiens
atgcactggcctgt

SEQ ID NO: 6667562 - DNA, 18 bp, Homo sapiens
atgcactggcctgttctg

SEQ ID NO: 6667563 - DNA, 19 bp, Homo sapiens
atgcactgtgaaggaccct

SEQ ID NO: 6667564 - DNA, 20 bp, Homo sapiens
atgcactgtgaaggaccctt

SEQ ID NO: 6667565 - DNA, 13 bp, Homo sapiens
atgcactgtggtt

SEQ ID NO: 6667566 - DNA, 15 bp, Homo sapiens
atgcacttaaagaag

SEQ ID NO: 6667567 - DNA, 19 bp, Homo sapiens
atgcacttaaagaagtatt

SEQ ID NO: 6667568 - DNA, 21 bp, Homo sapiens
atgcacttaaagaagtatttt

SEQ ID NO: 6667569 - DNA, 19 bp, Homo sapiens
atgcacttattttttaatg

SEQ ID NO: 6667570 - DNA, 20 bp, Homo sapiens
atgcacttattttttaatgt

SEQ ID NO: 6667571 - DNA, 16 bp, Homo sapiens
atgcactttaattgaa

SEQ ID NO: 6667572 - DNA, 19 bp, Homo sapiens
atgcactttaattgaagaa

SEQ ID NO: 6667573 - DNA, 16 bp, Homo sapiens
atgcactttgctttaa

SEQ ID NO: 6667574 - DNA, 19 bp, Homo sapiens
atgcactttgttctggctc

SEQ ID NO: 6667575 - DNA, 15 bp, Homo sapiens
atgcacttttagaaa

SEQ ID NO: 6667576 - DNA, 19 bp, Homo sapiens
atgcacttttgggcctttt

SEQ ID NO: 6667577 - DNA, 15 bp, Homo sapiens
atgcagaaaaagaaa

SEQ ID NO: 6667578 - DNA, 17 bp, Homo sapiens
atgcagaaaaagaaaaa

SEQ ID NO: 6667579 - DNA, 20 bp, Homo sapiens
atgcagaaaaggaagatgtt

SEQ ID NO: 6667580 - DNA, 16 bp, Homo sapiens
atgcagaaagcatccc

SEQ ID NO: 6667581 - DNA, 20 bp, Homo sapiens
atgcagaaatagacaaaaag

SEQ ID NO: 6667582 - DNA, 22 bp, Homo sapiens
atgcagaaatagacaaaaagta

SEQ ID NO: 6667583 - DNA, 22 bp, Homo sapiens
atgcagaacaggcagaaatata

SEQ ID NO: 6667584 - DNA, 17 bp, Homo sapiens
atgcagaaccacaaaca

SEQ ID NO: 6667585 - DNA, 18 bp, Homo sapiens
atgcagaacgtatttagc

SEQ ID NO: 6667586 - DNA, 13 bp, Homo sapiens
atgcagaagcaat

SEQ ID NO: 6667587 - DNA, 13 bp, Homo sapiens
atgcagaaggaag

SEQ ID NO: 6667588 - DNA, 20 bp, Homo sapiens
atgcagaaggtatttttgaa

SEQ ID NO: 6667589 - DNA, 22 bp, Homo sapiens
atgcagaaggtatttttgaagt

SEQ ID NO: 6667590 - DNA, 14 bp, Homo sapiens
atgcagaagtgcat

SEQ ID NO: 6667591 - DNA, 19 bp, Homo sapiens
atgcagaatgttgattaca

SEQ ID NO: 6667592 - DNA, 19 bp, Homo sapiens
atgcagaattgctaggtaa

SEQ ID NO: 6667593 - DNA, 21 bp, Homo sapiens
atgcagaattgctaggtaaag

SEQ ID NO: 6667594 - DNA, 18 bp, Homo sapiens
atgcagacaaagccctgt

SEQ ID NO: 6667595 - DNA, 12 bp, Homo sapiens
atgcagacacac

SEQ ID NO: 6667596 - DNA, 19 bp, Homo sapiens
atgcagacatctctggagc

SEQ ID NO: 6667597 - DNA, 14 bp, Homo sapiens
atgcagacatttac

SEQ ID NO: 6667598 - DNA, 16 bp, Homo sapiens
atgcagacatttacat

SEQ ID NO: 6667599 - DNA, 23 bp, Homo sapiens
atgcagaccccaccctgtctgca

SEQ ID NO: 6667600 - DNA, 20 bp, Homo sapiens
atgcagacctcatgcccagc

SEQ ID NO: 6667601 - DNA, 23 bp, Homo sapiens
atgcagacctcatgcccagctct

SEQ ID NO: 6667602 - DNA, 11 bp, Homo sapiens
atgcagagctt

SEQ ID NO: 6667603 - DNA, 15 bp, Homo sapiens
atgcagaggaggtga

SEQ ID NO: 6667604 - DNA, 13 bp, Homo sapiens
atgcagaggcctg

SEQ ID NO: 6667605 - DNA, 18 bp, Homo sapiens
atgcagaggcctggggga

SEQ ID NO: 6667606 - DNA, 23 bp, Homo sapiens
atgcagaggtaaaagtgtgagca

SEQ ID NO: 6667607 - DNA, 17 bp, Homo sapiens
atgcagaggtccacaac

SEQ ID NO: 6667608 - DNA, 15 bp, Homo sapiens
atgcagaggtctcca

SEQ ID NO: 6667609 - DNA, 17 bp, Homo sapiens
atgcagagtaagtatta

SEQ ID NO: 6667610 - DNA, 15 bp, Homo sapiens
atgcagataaataca

SEQ ID NO: 6667611 - DNA, 20 bp, Homo sapiens
atgcagataaatacatttat

SEQ ID NO: 6667612 - DNA, 16 bp, Homo sapiens
atgcagatctagccag

SEQ ID NO: 6667613 - DNA, 18 bp, Homo sapiens
atgcagatctagccaggc

SEQ ID NO: 6667614 - DNA, 23 bp, Homo sapiens
atgcagatggggctcccgcccgt

SEQ ID NO: 6667615 - DNA, 20 bp, Homo sapiens
atgcagattcctgggcctgt

SEQ ID NO: 6667616 - DNA, 16 bp, Homo sapiens
atgcagcaaaatgtga

SEQ ID NO: 6667617 - DNA, 17 bp, Homo sapiens
atgcagcaaatatatga

SEQ ID NO: 6667618 - DNA, 14 bp, Homo sapiens
atgcagcaacaccc

SEQ ID NO: 6667619 - DNA, 17 bp, Homo sapiens
atgcagcaacacccaag

SEQ ID NO: 6667620 - DNA, 19 bp, Homo sapiens
atgcagcaacacccaagtc

SEQ ID NO: 6667621 - DNA, 16 bp, Homo sapiens
atgcagcaaggccctg

SEQ ID NO: 6667622 - DNA, 17 bp, Homo sapiens
atgcagcaatcccactt

SEQ ID NO: 6667623 - DNA, 19 bp, Homo sapiens
atgcagcactgctgcctca

SEQ ID NO: 6667624 - DNA, 21 bp, Homo sapiens
atgcagcactgctgcctcagc

SEQ ID NO: 6667625 - DNA, 16 bp, Homo sapiens
atgcagcccaccagga

SEQ ID NO: 6667626 - DNA, 15 bp, Homo sapiens
atgcagcccatgccc

SEQ ID NO: 6667627 - DNA, 21 bp, Homo sapiens
atgcagcccatgcccacctgc

SEQ ID NO: 6667628 - DNA, 14 bp, Homo sapiens
atgcagcccatttc

SEQ ID NO: 6667629 - DNA, 20 bp, Homo sapiens
atgcagcccatttctccaga

SEQ ID NO: 6667630 - DNA, 18 bp, Homo sapiens
atgcagcccctgggccct

SEQ ID NO: 6667631 - DNA, 21 bp, Homo sapiens
atgcagcctaaggctgtatga

SEQ ID NO: 6667632 - DNA, 15 bp, Homo sapiens
atgcagcctcacagt

SEQ ID NO: 6667633 - DNA, 12 bp, Homo sapiens
atgcagcctgct

SEQ ID NO: 6667634 - DNA, 16 bp, Homo sapiens
atgcagccttggggca

SEQ ID NO: 6667635 - DNA, 20 bp, Homo sapiens
atgcagcgaaccaatatttg

SEQ ID NO: 6667636 - DNA, 22 bp, Homo sapiens
atgcagcgaaccaatatttgta

SEQ ID NO: 6667637 - DNA, 23 bp, Homo sapiens
atgcagcggtgtggaccgaggaa

SEQ ID NO: 6667638 - DNA, 16 bp, Homo sapiens
atgcagctactggaat

SEQ ID NO: 6667639 - DNA, 15 bp, Homo sapiens
atgcagctcttcctg

SEQ ID NO: 6667640 - DNA, 15 bp, Homo sapiens
atgcagctgcaccct

SEQ ID NO: 6667641 - DNA, 21 bp, Homo sapiens
atgcagctgcaccctccctcc

SEQ ID NO: 6667642 - DNA, 13 bp, Homo sapiens
atgcagctgcctg

SEQ ID NO: 6667643 - DNA, 14 bp, Homo sapiens
atgcagctgcctgg

SEQ ID NO: 6667644 - DNA, 16 bp, Homo sapiens
atgcagctgcctgggg

SEQ ID NO: 6667645 - DNA, 22 bp, Homo sapiens
atgcagctgcctggggcccaag

SEQ ID NO: 6667646 - DNA, 17 bp, Homo sapiens
atgcagctgttgagaaa

SEQ ID NO: 6667647 - DNA, 19 bp, Homo sapiens
atgcagctgttgagaaaac

SEQ ID NO: 6667648 - DNA, 15 bp, Homo sapiens
atgcagcttatacga

SEQ ID NO: 6667649 - DNA, 21 bp, Homo sapiens
atgcagcttcaggtgagccaa

SEQ ID NO: 6667650 - DNA, 12 bp, Homo sapiens
atgcagcttcat

SEQ ID NO: 6667651 - DNA, 17 bp, Homo sapiens
atgcagcttcatcaatt

SEQ ID NO: 6667652 - DNA, 17 bp, Homo sapiens
atgcagcttggagacag

SEQ ID NO: 6667653 - DNA, 22 bp, Homo sapiens
atgcagcttgtccttgctcctg

SEQ ID NO: 6667654 - DNA, 24 bp, Homo sapiens
atgcagcttgtccttgctcctgga

SEQ ID NO: 6667655 - DNA, 16 bp, Homo sapiens
atgcaggaactgaaaa

SEQ ID NO: 6667656 - DNA, 18 bp, Homo sapiens
atgcaggaagaccacatg

SEQ ID NO: 6667657 - DNA, 19 bp, Homo sapiens
atgcaggaagaggcccact

SEQ ID NO: 6667658 - DNA, 15 bp, Homo sapiens
atgcaggaaggaaaa

SEQ ID NO: 6667659 - DNA, 12 bp, Homo sapiens
atgcaggacagg

SEQ ID NO: 6667660 - DNA, 13 bp, Homo sapiens
atgcaggacagga

SEQ ID NO: 6667661 - DNA, 16 bp, Homo sapiens
atgcaggacaggaggc

SEQ ID NO: 6667662 - DNA, 14 bp, Homo sapiens
atgcaggaggtgga

SEQ ID NO: 6667663 - DNA, 16 bp, Homo sapiens
atgcaggcaacattac

SEQ ID NO: 6667664 - DNA, 19 bp, Homo sapiens
atgcaggcacctcttttaa

SEQ ID NO: 6667665 - DNA, 21 bp, Homo sapiens
atgcaggcacttattgtaaat

SEQ ID NO: 6667666 - DNA, 18 bp, Homo sapiens
atgcaggcagattaataa

SEQ ID NO: 6667667 - DNA, 19 bp, Homo sapiens
atgcaggcagattaataac

SEQ ID NO: 6667668 - DNA, 23 bp, Homo sapiens
atgcaggcagattaataacagaa

SEQ ID NO: 6667669 - DNA, 24 bp, Homo sapiens
atgcaggcatgcttctcaccgtgc

SEQ ID NO: 6667670 - DNA, 15 bp, Homo sapiens
atgcaggctcccctg

SEQ ID NO: 6667671 - DNA, 17 bp, Homo sapiens
atgcagggaagagggca

SEQ ID NO: 6667672 - DNA, 16 bp, Homo sapiens
atgcagggagcactgt

SEQ ID NO: 6667673 - DNA, 19 bp, Homo sapiens
atgcagggattgctgccac

SEQ ID NO: 6667674 - DNA, 20 bp, Homo sapiens
atgcagggattgctgccact

SEQ ID NO: 6667675 - DNA, 22 bp, Homo sapiens
atgcagggattgctgccacttt

SEQ ID NO: 6667676 - DNA, 13 bp, Homo sapiens
atgcagggcagtc

SEQ ID NO: 6667677 - DNA, 19 bp, Homo sapiens
atgcagggcctcacacggt

SEQ ID NO: 6667678 - DNA, 11 bp, Homo sapiens
atgcaggtcag

SEQ ID NO: 6667679 - DNA, 22 bp, Homo sapiens
atgcaggtctgattcccagaaa

SEQ ID NO: 6667680 - DNA, 10 bp, Homo sapiens
atgcaggtgg

SEQ ID NO: 6667681 - DNA, 20 bp, Homo sapiens
atgcaggtggatctccttga

SEQ ID NO: 6667682 - DNA, 22 bp, Homo sapiens
atgcaggttagaaataatgtca

SEQ ID NO: 6667683 - DNA, 22 bp, Homo sapiens
atgcaggtttgaccaggaaagc

SEQ ID NO: 6667684 - DNA, 15 bp, Homo sapiens
atgcaggttttctaa

SEQ ID NO: 6667685 - DNA, 16 bp, Homo sapiens
atgcagtaaattatct

SEQ ID NO: 6667686 - DNA, 14 bp, Homo sapiens
atgcagtactaaaa

SEQ ID NO: 6667687 - DNA, 18 bp, Homo sapiens
atgcagtactaacattta

SEQ ID NO: 6667688 - DNA, 19 bp, Homo sapiens
atgcagtacttttgttgta

SEQ ID NO: 6667689 - DNA, 17 bp, Homo sapiens
atgcagtagcactttgg

SEQ ID NO: 6667690 - DNA, 18 bp, Homo sapiens
atgcagtataaaatgtaa

SEQ ID NO: 6667691 - DNA, 19 bp, Homo sapiens
atgcagtataaaatgtaaa

SEQ ID NO: 6667692 - DNA, 15 bp, Homo sapiens
atgcagtatcatctg

SEQ ID NO: 6667693 - DNA, 15 bp, Homo sapiens
atgcagtatggtaca

SEQ ID NO: 6667694 - DNA, 23 bp, Homo sapiens
atgcagtatggtacatttttcaa

SEQ ID NO: 6667695 - DNA, 14 bp, Homo sapiens
atgcagtccagaat

SEQ ID NO: 6667696 - DNA, 16 bp, Homo sapiens
atgcagtccagaataa

SEQ ID NO: 6667697 - DNA, 23 bp, Homo sapiens
atgcagtccagaataagtgctgt

SEQ ID NO: 6667698 - DNA, 20 bp, Homo sapiens
atgcagtcctcatctccagc

SEQ ID NO: 6667699 - DNA, 15 bp, Homo sapiens
atgcagtctcctctt

SEQ ID NO: 6667700 - DNA, 20 bp, Homo sapiens
atgcagtctcctctttaaaa

SEQ ID NO: 6667701 - DNA, 17 bp, Homo sapiens
atgcagtctctttattt

SEQ ID NO: 6667702 - DNA, 18 bp, Homo sapiens
atgcagtctgtccaggct

SEQ ID NO: 6667703 - DNA, 19 bp, Homo sapiens
atgcagtctgtccaggctc

SEQ ID NO: 6667704 - DNA, 13 bp, Homo sapiens
atgcagtgccagg

SEQ ID NO: 6667705 - DNA, 21 bp, Homo sapiens
atgcagtgctcgctgttgctg

SEQ ID NO: 6667706 - DNA, 23 bp, Homo sapiens
atgcagtggtatgatcacggctc

SEQ ID NO: 6667707 - DNA, 18 bp, Homo sapiens
atgcagtgtgatccagtt

SEQ ID NO: 6667708 - DNA, 23 bp, Homo sapiens
atgcagttattagaacttagttt

SEQ ID NO: 6667709 - DNA, 17 bp, Homo sapiens
atgcagttcattatttt

SEQ ID NO: 6667710 - DNA, 22 bp, Homo sapiens
atgcagttctcacgaaagtatt

SEQ ID NO: 6667711 - DNA, 15 bp, Homo sapiens
atgcagttgtctctg

SEQ ID NO: 6667712 - DNA, 13 bp, Homo sapiens
atgcagtttgaaa

SEQ ID NO: 6667713 - DNA, 15 bp, Homo sapiens
atgcagtttgaaatt

SEQ ID NO: 6667714 - DNA, 17 bp, Homo sapiens
atgcagtttgaaattct

SEQ ID NO: 6667715 - DNA, 18 bp, Homo sapiens
atgcagtttgaaattctg

SEQ ID NO: 6667716 - DNA, 23 bp, Homo sapiens
atgcagtttgaaattctgaattt

SEQ ID NO: 6667717 - DNA, 14 bp, Homo sapiens
atgcagttttaaga

SEQ ID NO: 6667718 - DNA, 17 bp, Homo sapiens
atgcagttttaagaatt

SEQ ID NO: 6667719 - DNA, 22 bp, Homo sapiens
atgcagttttaatacttgtaat

SEQ ID NO: 6667720 - DNA, 16 bp, Homo sapiens
atgcagttttcaaatt

SEQ ID NO: 6667721 - DNA, 15 bp, Homo sapiens
atgcagttttcctta

SEQ ID NO: 6667722 - DNA, 17 bp, Homo sapiens
atgcataaaaaaatgat

SEQ ID NO: 6667723 - DNA, 21 bp, Homo sapiens
atgcataaaagggtcaaacct

SEQ ID NO: 6667724 - DNA, 23 bp, Homo sapiens
atgcataaaagggtcaaacctgt

SEQ ID NO: 6667725 - DNA, 12 bp, Homo sapiens
atgcataaacaa

SEQ ID NO: 6667726 - DNA, 17 bp, Homo sapiens
atgcataaacaacagta

SEQ ID NO: 6667727 - DNA, 14 bp, Homo sapiens
atgcataaatatgc

SEQ ID NO: 6667728 - DNA, 17 bp, Homo sapiens
atgcataaatatgcagt

SEQ ID NO: 6667729 - DNA, 21 bp, Homo sapiens
atgcataaatatgcagtgata

SEQ ID NO: 6667730 - DNA, 14 bp, Homo sapiens
atgcataaatcaat

SEQ ID NO: 6667731 - DNA, 14 bp, Homo sapiens
atgcataaatgcat

SEQ ID NO: 6667732 - DNA, 19 bp, Homo sapiens
atgcataataatcctgcaa

SEQ ID NO: 6667733 - DNA, 21 bp, Homo sapiens
atgcataataatcctgcaaag

SEQ ID NO: 6667734 - DNA, 23 bp, Homo sapiens
atgcataataatcctgcaaagta

SEQ ID NO: 6667735 - DNA, 16 bp, Homo sapiens
atgcataatgtcttta

SEQ ID NO: 6667736 - DNA, 13 bp, Homo sapiens
atgcatacaaatc

SEQ ID NO: 6667737 - DNA, 14 bp, Homo sapiens
atgcatacacacac

SEQ ID NO: 6667738 - DNA, 17 bp, Homo sapiens
atgcatacagttttcta

SEQ ID NO: 6667739 - DNA, 17 bp, Homo sapiens
atgcatacatacacata

SEQ ID NO: 6667740 - DNA, 23 bp, Homo sapiens
atgcatacatacacatatataca

SEQ ID NO: 6667741 - DNA, 22 bp, Homo sapiens
atgcataccacaagacatttct

SEQ ID NO: 6667742 - DNA, 14 bp, Homo sapiens
atgcataccagtaa

SEQ ID NO: 6667743 - DNA, 22 bp, Homo sapiens
atgcatacgcattaagggcctg

SEQ ID NO: 6667744 - DNA, 14 bp, Homo sapiens
atgcatacgtaaaa

SEQ ID NO: 6667745 - DNA, 20 bp, Homo sapiens
atgcatactgttgatacaaa

SEQ ID NO: 6667746 - DNA, 16 bp, Homo sapiens
atgcatacttcaaaag

SEQ ID NO: 6667747 - DNA, 22 bp, Homo sapiens
atgcatacttcaaaagtatttt

SEQ ID NO: 6667748 - DNA, 14 bp, Homo sapiens
atgcatactttatt

SEQ ID NO: 6667749 - DNA, 18 bp, Homo sapiens
atgcatagacaagtgttt

SEQ ID NO: 6667750 - DNA, 12 bp, Homo sapiens
atgcatagagca

SEQ ID NO: 6667751 - DNA, 14 bp, Homo sapiens
atgcatagagcaat

SEQ ID NO: 6667752 - DNA, 18 bp, Homo sapiens
atgcatagagccctggcc

SEQ ID NO: 6667753 - DNA, 16 bp, Homo sapiens
atgcataggcttaact

SEQ ID NO: 6667754 - DNA, 17 bp, Homo sapiens
atgcataggtttagcag

SEQ ID NO: 6667755 - DNA, 21 bp, Homo sapiens
atgcataggtttagcagtata

SEQ ID NO: 6667756 - DNA, 19 bp, Homo sapiens
atgcatataatgaataaat

SEQ ID NO: 6667757 - DNA, 21 bp, Homo sapiens
atgcatatagacacacataca

SEQ ID NO: 6667758 - DNA, 12 bp, Homo sapiens
atgcatatatat

SEQ ID NO: 6667759 - DNA, 15 bp, Homo sapiens
atgcatatatatatg

SEQ ID NO: 6667760 - DNA, 16 bp, Homo sapiens
atgcatatatatgtat

SEQ ID NO: 6667761 - DNA, 16 bp, Homo sapiens
atgcatatatgaaaac

SEQ ID NO: 6667762 - DNA, 23 bp, Homo sapiens
atgcatatgtcactagaatggat

SEQ ID NO: 6667763 - DNA, 13 bp, Homo sapiens
atgcatattactg

SEQ ID NO: 6667764 - DNA, 14 bp, Homo sapiens
atgcatattactgt

SEQ ID NO: 6667765 - DNA, 16 bp, Homo sapiens
atgcatattattttat

SEQ ID NO: 6667766 - DNA, 20 bp, Homo sapiens
atgcatattattttatgttg

SEQ ID NO: 6667767 - DNA, 18 bp, Homo sapiens
atgcatattcaacacact

SEQ ID NO: 6667768 - DNA, 17 bp, Homo sapiens
atgcatattgattctga

SEQ ID NO: 6667769 - DNA, 13 bp, Homo sapiens
atgcatatttcta

SEQ ID NO: 6667770 - DNA, 12 bp, Homo sapiens
atgcatatttgc

SEQ ID NO: 6667771 - DNA, 17 bp, Homo sapiens
atgcatatttgcaaagt

SEQ ID NO: 6667772 - DNA, 21 bp, Homo sapiens
atgcatatttgcaaagtgtat

SEQ ID NO: 6667773 - DNA, 14 bp, Homo sapiens
atgcatatttgcca

SEQ ID NO: 6667774 - DNA, 12 bp, Homo sapiens
atgcatatttgt

SEQ ID NO: 6667775 - DNA, 23 bp, Homo sapiens
atgcatcacactcaaggacagga

SEQ ID NO: 6667776 - DNA, 16 bp, Homo sapiens
atgcatcacatgatga

SEQ ID NO: 6667777 - DNA, 12 bp, Homo sapiens
atgcatcactgg

SEQ ID NO: 6667778 - DNA, 14 bp, Homo sapiens
atgcatcagaaagg

SEQ ID NO: 6667779 - DNA, 15 bp, Homo sapiens
atgcatcagaaaggg

SEQ ID NO: 6667780 - DNA, 20 bp, Homo sapiens
atgcatcagaaagggagggc

SEQ ID NO: 6667781 - DNA, 22 bp, Homo sapiens
atgcatcagataacaactgtga

SEQ ID NO: 6667782 - DNA, 19 bp, Homo sapiens
atgcatcatctcttcctca

SEQ ID NO: 6667783 - DNA, 18 bp, Homo sapiens
atgcatccattcctcagg

SEQ ID NO: 6667784 - DNA, 22 bp, Homo sapiens
atgcatccattcctcagggaca

SEQ ID NO: 6667785 - DNA, 23 bp, Homo sapiens
atgcatccattcctcagggacag

SEQ ID NO: 6667786 - DNA, 16 bp, Homo sapiens
atgcatccatttcagt

SEQ ID NO: 6667787 - DNA, 16 bp, Homo sapiens
atgcatcccacagcca

SEQ ID NO: 6667788 - DNA, 22 bp, Homo sapiens
atgcatcccaccttgccaaagc

SEQ ID NO: 6667789 - DNA, 17 bp, Homo sapiens
atgcatcgggaaagaag

SEQ ID NO: 6667790 - DNA, 19 bp, Homo sapiens
atgcatcgggaaagaagaa

SEQ ID NO: 6667791 - DNA, 23 bp, Homo sapiens
atgcatcgggaaagaagaaactc

SEQ ID NO: 6667792 - DNA, 19 bp, Homo sapiens
atgcatctccacctgctcc

SEQ ID NO: 6667793 - DNA, 12 bp, Homo sapiens
atgcatctcttt

SEQ ID NO: 6667794 - DNA, 13 bp, Homo sapiens
atgcatctcttta

SEQ ID NO: 6667795 - DNA, 14 bp, Homo sapiens
atgcatctgaaagt

SEQ ID NO: 6667796 - DNA, 19 bp, Homo sapiens
atgcatctggcccaggaat

SEQ ID NO: 6667797 - DNA, 14 bp, Homo sapiens
atgcatctggctac

SEQ ID NO: 6667798 - DNA, 18 bp, Homo sapiens
atgcatctgtggcctggg

SEQ ID NO: 6667799 - DNA, 18 bp, Homo sapiens
atgcatcttactgaaggt

SEQ ID NO: 6667800 - DNA, 14 bp, Homo sapiens
atgcatgaagcaac

SEQ ID NO: 6667801 - DNA, 18 bp, Homo sapiens
atgcatgacacttccaaa

SEQ ID NO: 6667802 - DNA, 21 bp, Homo sapiens
atgcatgagaactaaatagat

SEQ ID NO: 6667803 - DNA, 14 bp, Homo sapiens
atgcatgagcacct

SEQ ID NO: 6667804 - DNA, 18 bp, Homo sapiens
atgcatgagctattgcta

SEQ ID NO: 6667805 - DNA, 16 bp, Homo sapiens
atgcatgagctccctc

SEQ ID NO: 6667806 - DNA, 21 bp, Homo sapiens
atgcatgatccagctgtgtgt

SEQ ID NO: 6667807 - DNA, 19 bp, Homo sapiens
atgcatgatgactcttctt

SEQ ID NO: 6667808 - DNA, 21 bp, Homo sapiens
atgcatgatgactcttcttat

SEQ ID NO: 6667809 - DNA, 20 bp, Homo sapiens
atgcatgattgcagaattgt

SEQ ID NO: 6667810 - DNA, 12 bp, Homo sapiens
atgcatgatttt

SEQ ID NO: 6667811 - DNA, 18 bp, Homo sapiens
atgcatgattttatacat

SEQ ID NO: 6667812 - DNA, 21 bp, Homo sapiens
atgcatgattttatacatagt

SEQ ID NO: 6667813 - DNA, 13 bp, Homo sapiens
atgcatgccaggc

SEQ ID NO: 6667814 - DNA, 14 bp, Homo sapiens
atgcatgccctctc

SEQ ID NO: 6667815 - DNA, 17 bp, Homo sapiens
atgcatgccctctctga

SEQ ID NO: 6667816 - DNA, 21 bp, Homo sapiens
atgcatgccctctctgagtct

SEQ ID NO: 6667817 - DNA, 18 bp, Homo sapiens
atgcatgcgcaggctcat

SEQ ID NO: 6667818 - DNA, 16 bp, Homo sapiens
atgcatgctttccata

SEQ ID NO: 6667819 - DNA, 19 bp, Homo sapiens
atgcatgctttccatattt

SEQ ID NO: 6667820 - DNA, 20 bp, Homo sapiens
atgcatgctttccatatttt

SEQ ID NO: 6667821 - DNA, 20 bp, Homo sapiens
atgcatggaaacctgaaaaa

SEQ ID NO: 6667822 - DNA, 23 bp, Homo sapiens
atgcatggagggctgccctgtac

SEQ ID NO: 6667823 - DNA, 15 bp, Homo sapiens
atgcatggcctccca

SEQ ID NO: 6667824 - DNA, 20 bp, Homo sapiens
atgcatggcctcccagccac

SEQ ID NO: 6667825 - DNA, 17 bp, Homo sapiens
atgcatggctcccgagt

SEQ ID NO: 6667826 - DNA, 21 bp, Homo sapiens
atgcatggggcgggtcctagc

SEQ ID NO: 6667827 - DNA, 18 bp, Homo sapiens
atgcatggtgccccagga

SEQ ID NO: 6667828 - DNA, 13 bp, Homo sapiens
atgcatggtttca

SEQ ID NO: 6667829 - DNA, 19 bp, Homo sapiens
atgcatggtttcagcacta

SEQ ID NO: 6667830 - DNA, 14 bp, Homo sapiens
atgcatgtaaggtc

SEQ ID NO: 6667831 - DNA, 19 bp, Homo sapiens
atgcatgtagcatataaat

SEQ ID NO: 6667832 - DNA, 20 bp, Homo sapiens
atgcatgtagcatataaatg

SEQ ID NO: 6667833 - DNA, 23 bp, Homo sapiens
atgcatgtagcatataaatgttt

SEQ ID NO: 6667834 - DNA, 19 bp, Homo sapiens
atgcatgtagtagcctttc

SEQ ID NO: 6667835 - DNA, 13 bp, Homo sapiens
atgcatgtcttaa

SEQ ID NO: 6667836 - DNA, 14 bp, Homo sapiens
atgcatgtcttaaa

SEQ ID NO: 6667837 - DNA, 22 bp, Homo sapiens
atgcatgtcttaaatgctcata

SEQ ID NO: 6667838 - DNA, 13 bp, Homo sapiens
atgcatgtgaaga

SEQ ID NO: 6667839 - DNA, 24 bp, Homo sapiens
atgcatgtgattggcagcttcaaa

SEQ ID NO: 6667840 - DNA, 13 bp, Homo sapiens
atgcatgtgtgtg

SEQ ID NO: 6667841 - DNA, 16 bp, Homo sapiens
atgcatgttactgcca

SEQ ID NO: 6667842 - DNA, 16 bp, Homo sapiens
atgcatgttctcctct

SEQ ID NO: 6667843 - DNA, 13 bp, Homo sapiens
atgcatgttctgt

SEQ ID NO: 6667844 - DNA, 18 bp, Homo sapiens
atgcatgttgaccatgtc

SEQ ID NO: 6667845 - DNA, 18 bp, Homo sapiens
atgcatgttttatgtgca

SEQ ID NO: 6667846 - DNA, 15 bp, Homo sapiens
atgcattaaaagaaa

SEQ ID NO: 6667847 - DNA, 16 bp, Homo sapiens
atgcattaaaagaaaa

SEQ ID NO: 6667848 - DNA, 12 bp, Homo sapiens
atgcattaaacc

SEQ ID NO: 6667849 - DNA, 18 bp, Homo sapiens
atgcattaacttttgtaa

SEQ ID NO: 6667850 - DNA, 17 bp, Homo sapiens
atgcattacttactgtt

SEQ ID NO: 6667851 - DNA, 22 bp, Homo sapiens
atgcattcacatttagaaaagt

SEQ ID NO: 6667852 - DNA, 13 bp, Homo sapiens
atgcattcatgtt

SEQ ID NO: 6667853 - DNA, 22 bp, Homo sapiens
atgcattcccggtgcagaacag

SEQ ID NO: 6667854 - DNA, 13 bp, Homo sapiens
atgcattccctga

SEQ ID NO: 6667855 - DNA, 14 bp, Homo sapiens
atgcattctatcgt

SEQ ID NO: 6667856 - DNA, 22 bp, Homo sapiens
atgcattctatcgttattataa

SEQ ID NO: 6667857 - DNA, 14 bp, Homo sapiens
atgcattctggaga

SEQ ID NO: 6667858 - DNA, 18 bp, Homo sapiens
atgcattctggagacaga

SEQ ID NO: 6667859 - DNA, 17 bp, Homo sapiens
atgcattctttatagtg

SEQ ID NO: 6667860 - DNA, 12 bp, Homo sapiens
atgcattgagct

SEQ ID NO: 6667861 - DNA, 23 bp, Homo sapiens
atgcattgagctgcctccagcct

SEQ ID NO: 6667862 - DNA, 17 bp, Homo sapiens
atgcattgatattgtga

SEQ ID NO: 6667863 - DNA, 18 bp, Homo sapiens
atgcattgcctgtaacaa

SEQ ID NO: 6667864 - DNA, 17 bp, Homo sapiens
atgcattggcctctgta

SEQ ID NO: 6667865 - DNA, 16 bp, Homo sapiens
atgcattgtagtttaa

SEQ ID NO: 6667866 - DNA, 21 bp, Homo sapiens
atgcattgtctgcaatggtga

SEQ ID NO: 6667867 - DNA, 22 bp, Homo sapiens
atgcattgtggatatgagcttt

SEQ ID NO: 6667868 - DNA, 16 bp, Homo sapiens
atgcattgttgaggtg

SEQ ID NO: 6667869 - DNA, 17 bp, Homo sapiens
atgcattgttggctatt

SEQ ID NO: 6667870 - DNA, 18 bp, Homo sapiens
atgcattgttggctattt

SEQ ID NO: 6667871 - DNA, 19 bp, Homo sapiens
atgcattgttggctatttg

SEQ ID NO: 6667872 - DNA, 22 bp, Homo sapiens
atgcattgttggctatttgaaa

SEQ ID NO: 6667873 - DNA, 13 bp, Homo sapiens
atgcattgttgta

SEQ ID NO: 6667874 - DNA, 22 bp, Homo sapiens
atgcattgttgttctgctcaat

SEQ ID NO: 6667875 - DNA, 22 bp, Homo sapiens
atgcatttaaagtattctccat

SEQ ID NO: 6667876 - DNA, 17 bp, Homo sapiens
atgcatttaagttgtaa

SEQ ID NO: 6667877 - DNA, 13 bp, Homo sapiens
atgcatttaataa

SEQ ID NO: 6667878 - DNA, 19 bp, Homo sapiens
atgcatttaataaagatga

SEQ ID NO: 6667879 - DNA, 21 bp, Homo sapiens
atgcatttaataaagatgagt

SEQ ID NO: 6667880 - DNA, 16 bp, Homo sapiens
atgcatttagcatgag

SEQ ID NO: 6667881 - DNA, 19 bp, Homo sapiens
atgcatttagcatgagttc

SEQ ID NO: 6667882 - DNA, 22 bp, Homo sapiens
atgcatttatagatcatttcta

SEQ ID NO: 6667883 - DNA, 12 bp, Homo sapiens
atgcatttcaaa

SEQ ID NO: 6667884 - DNA, 14 bp, Homo sapiens
atgcatttcattca

SEQ ID NO: 6667885 - DNA, 16 bp, Homo sapiens
atgcatttcattcaaa

SEQ ID NO: 6667886 - DNA, 18 bp, Homo sapiens
atgcatttcattcaaatc

SEQ ID NO: 6667887 - DNA, 16 bp, Homo sapiens
atgcatttccacactg

SEQ ID NO: 6667888 - DNA, 15 bp, Homo sapiens
atgcatttctatcaa

SEQ ID NO: 6667889 - DNA, 13 bp, Homo sapiens
atgcatttgaggt

SEQ ID NO: 6667890 - DNA, 22 bp, Homo sapiens
atgcatttgggtccaggaggaa

SEQ ID NO: 6667891 - DNA, 16 bp, Homo sapiens
atgcattttaaatgtc

SEQ ID NO: 6667892 - DNA, 21 bp, Homo sapiens
atgcattttcaagatacattt

SEQ ID NO: 6667893 - DNA, 13 bp, Homo sapiens
atgcattttcttc

SEQ ID NO: 6667894 - DNA, 14 bp, Homo sapiens
atgcattttcttca

SEQ ID NO: 6667895 - DNA, 17 bp, Homo sapiens
atgcattttcttcacag

SEQ ID NO: 6667896 - DNA, 18 bp, Homo sapiens
atgcattttcttgtatga

SEQ ID NO: 6667897 - DNA, 22 bp, Homo sapiens
atgcattttgagtgtttataga

SEQ ID NO: 6667898 - DNA, 13 bp, Homo sapiens
atgcattttgcag

SEQ ID NO: 6667899 - DNA, 19 bp, Homo sapiens
atgcattttgcagcagtga

SEQ ID NO: 6667900 - DNA, 23 bp, Homo sapiens
atgcattttgtttggtattgtat

SEQ ID NO: 6667901 - DNA, 19 bp, Homo sapiens
atgccaaaaaaaaatacat

SEQ ID NO: 6667902 - DNA, 18 bp, Homo sapiens
atgccaaaaaagatgcca

SEQ ID NO: 6667903 - DNA, 21 bp, Homo sapiens
atgccaaagaatgaatttcaa

SEQ ID NO: 6667904 - DNA, 16 bp, Homo sapiens
atgccaaagatcactt

SEQ ID NO: 6667905 - DNA, 23 bp, Homo sapiens
atgccaaagatcacttgttgttt

SEQ ID NO: 6667906 - DNA, 20 bp, Homo sapiens
atgccaaagatgtttgaaaa

SEQ ID NO: 6667907 - DNA, 18 bp, Homo sapiens
atgccaaagcagacattt

SEQ ID NO: 6667908 - DNA, 18 bp, Homo sapiens
atgccaaagctagggtgg

SEQ ID NO: 6667909 - DNA, 13 bp, Homo sapiens
atgccaaagctgc

SEQ ID NO: 6667910 - DNA, 14 bp, Homo sapiens
atgccaaagctgct

SEQ ID NO: 6667911 - DNA, 13 bp, Homo sapiens
atgccaaattaaa

SEQ ID NO: 6667912 - DNA, 19 bp, Homo sapiens
atgccaaattaaaaaagat

SEQ ID NO: 6667913 - DNA, 20 bp, Homo sapiens
atgccaaattgtagttcttg

SEQ ID NO: 6667914 - DNA, 18 bp, Homo sapiens
atgccaacaagaatgcat

SEQ ID NO: 6667915 - DNA, 20 bp, Homo sapiens
atgccaacaagaatgcattg

SEQ ID NO: 6667916 - DNA, 13 bp, Homo sapiens
atgccaaccagct

SEQ ID NO: 6667917 - DNA, 18 bp, Homo sapiens
atgccaacttcccacacg

SEQ ID NO: 6667918 - DNA, 23 bp, Homo sapiens
atgccaagaagtttaaggaatat

SEQ ID NO: 6667919 - DNA, 19 bp, Homo sapiens
atgccaagactctatgctc

SEQ ID NO: 6667920 - DNA, 20 bp, Homo sapiens
atgccaagactctatgctct

SEQ ID NO: 6667921 - DNA, 21 bp, Homo sapiens
atgccaagactctatgctctg

SEQ ID NO: 6667922 - DNA, 20 bp, Homo sapiens
atgccaagagtgcacccatg

SEQ ID NO: 6667923 - DNA, 16 bp, Homo sapiens
atgccaagcactgtgc

SEQ ID NO: 6667924 - DNA, 18 bp, Homo sapiens
atgccaagcactgtgctc

SEQ ID NO: 6667925 - DNA, 19 bp, Homo sapiens
atgccaagcactgtgctca

SEQ ID NO: 6667926 - DNA, 16 bp, Homo sapiens
atgccaagcacttcag

SEQ ID NO: 6667927 - DNA, 16 bp, Homo sapiens
atgccaaggagcccct

SEQ ID NO: 6667928 - DNA, 20 bp, Homo sapiens
atgccaaggaggtcccagga

SEQ ID NO: 6667929 - DNA, 20 bp, Homo sapiens
atgccaagggggtgactgga

SEQ ID NO: 6667930 - DNA, 21 bp, Homo sapiens
atgccaagtaacaatgcatgc

SEQ ID NO: 6667931 - DNA, 22 bp, Homo sapiens
atgccaagtggacttggagctg

SEQ ID NO: 6667932 - DNA, 18 bp, Homo sapiens
atgccaataaagtgatct

SEQ ID NO: 6667933 - DNA, 16 bp, Homo sapiens
atgccaatactagtca

SEQ ID NO: 6667934 - DNA, 21 bp, Homo sapiens
atgccaatatgacacagcttg

SEQ ID NO: 6667935 - DNA, 19 bp, Homo sapiens
atgccaatcttaaagacaa

SEQ ID NO: 6667936 - DNA, 22 bp, Homo sapiens
atgccaatgagtctgtaatttt

SEQ ID NO: 6667937 - DNA, 22 bp, Homo sapiens
atgccaatgtcagcatcaagcc

SEQ ID NO: 6667938 - DNA, 13 bp, Homo sapiens
atgccaatgtcca

SEQ ID NO: 6667939 - DNA, 16 bp, Homo sapiens
atgccaatgtccaggt

SEQ ID NO: 6667940 - DNA, 17 bp, Homo sapiens
atgccaatgtccaggtc

SEQ ID NO: 6667941 - DNA, 22 bp, Homo sapiens
atgccaattagcaattgactgt

SEQ ID NO: 6667942 - DNA, 15 bp, Homo sapiens
atgccaatttcctct

SEQ ID NO: 6667943 - DNA, 18 bp, Homo sapiens
atgccaatttcctctcca

SEQ ID NO: 6667944 - DNA, 17 bp, Homo sapiens
atgccacaagacataat

SEQ ID NO: 6667945 - DNA, 15 bp, Homo sapiens
atgccacacaccttt

SEQ ID NO: 6667946 - DNA, 15 bp, Homo sapiens
atgccacacagagtg

SEQ ID NO: 6667947 - DNA, 16 bp, Homo sapiens
atgccacacagagtgg

SEQ ID NO: 6667948 - DNA, 23 bp, Homo sapiens
atgccacaccggtaccctcctcc

SEQ ID NO: 6667949 - DNA, 15 bp, Homo sapiens
atgccacacgtaaac

SEQ ID NO: 6667950 - DNA, 18 bp, Homo sapiens
atgccacacgtaaacact

SEQ ID NO: 6667951 - DNA, 14 bp, Homo sapiens
atgccacagccaag

SEQ ID NO: 6667952 - DNA, 18 bp, Homo sapiens
atgccacagccaagccca

SEQ ID NO: 6667953 - DNA, 21 bp, Homo sapiens
atgccacagccaagcccaccc

SEQ ID NO: 6667954 - DNA, 13 bp, Homo sapiens
atgccacagcccc

SEQ ID NO: 6667955 - DNA, 14 bp, Homo sapiens
atgccacagcccca

SEQ ID NO: 6667956 - DNA, 17 bp, Homo sapiens
atgccacagccccacag

SEQ ID NO: 6667957 - DNA, 13 bp, Homo sapiens
atgccacagccct

SEQ ID NO: 6667958 - DNA, 17 bp, Homo sapiens
atgccacagccctgtca

SEQ ID NO: 6667959 - DNA, 18 bp, Homo sapiens
atgccacagccctgtcag

SEQ ID NO: 6667960 - DNA, 19 bp, Homo sapiens
atgccacagccctgtcagc

SEQ ID NO: 6667961 - DNA, 15 bp, Homo sapiens
atgccacattttgct

SEQ ID NO: 6667962 - DNA, 14 bp, Homo sapiens
atgccaccaaagga

SEQ ID NO: 6667963 - DNA, 14 bp, Homo sapiens
atgccaccacccac

SEQ ID NO: 6667964 - DNA, 15 bp, Homo sapiens
atgccaccacccacc

SEQ ID NO: 6667965 - DNA, 18 bp, Homo sapiens
atgccaccacccacccca

SEQ ID NO: 6667966 - DNA, 16 bp, Homo sapiens
atgccaccaggtaaca

SEQ ID NO: 6667967 - DNA, 19 bp, Homo sapiens
atgccacccccgctggagg

SEQ ID NO: 6667968 - DNA, 14 bp, Homo sapiens
atgccaccctagcc

SEQ ID NO: 6667969 - DNA, 13 bp, Homo sapiens
atgccaccctcac

SEQ ID NO: 6667970 - DNA, 17 bp, Homo sapiens
atgccaccctcacacac

SEQ ID NO: 6667971 - DNA, 17 bp, Homo sapiens
atgccaccctctccatg

SEQ ID NO: 6667972 - DNA, 20 bp, Homo sapiens
atgccaccctgttttcagct

SEQ ID NO: 6667973 - DNA, 16 bp, Homo sapiens
atgccacctagactct

SEQ ID NO: 6667974 - DNA, 22 bp, Homo sapiens
atgccacctagactctccctgt

SEQ ID NO: 6667975 - DNA, 13 bp, Homo sapiens
atgccacctgcag

SEQ ID NO: 6667976 - DNA, 16 bp, Homo sapiens
atgccacgcctggaag

SEQ ID NO: 6667977 - DNA, 19 bp, Homo sapiens
atgccacgcctggaagggc

SEQ ID NO: 6667978 - DNA, 23 bp, Homo sapiens
atgccacgcggtacaaaggaaaa

SEQ ID NO: 6667979 - DNA, 17 bp, Homo sapiens
atgccacgggaagttta

SEQ ID NO: 6667980 - DNA, 16 bp, Homo sapiens
atgccactaggccctg

SEQ ID NO: 6667981 - DNA, 16 bp, Homo sapiens
atgccactccctaccc

SEQ ID NO: 6667982 - DNA, 14 bp, Homo sapiens
atgccactcctccc

SEQ ID NO: 6667983 - DNA, 18 bp, Homo sapiens
atgccactcctccctccg

SEQ ID NO: 6667984 - DNA, 14 bp, Homo sapiens
atgccactgcactc

SEQ ID NO: 6667985 - DNA, 20 bp, Homo sapiens
atgccactgcactccagcct

SEQ ID NO: 6667986 - DNA, 14 bp, Homo sapiens
atgccactgccagg

SEQ ID NO: 6667987 - DNA, 20 bp, Homo sapiens
atgccactgccaggcacctg

SEQ ID NO: 6667988 - DNA, 22 bp, Homo sapiens
atgccactgccaggcacctggc

SEQ ID NO: 6667989 - DNA, 14 bp, Homo sapiens
atgccactgccttc

SEQ ID NO: 6667990 - DNA, 18 bp, Homo sapiens
atgccactgccttcgctt

SEQ ID NO: 6667991 - DNA, 21 bp, Homo sapiens
atgccactgggacagctggct

SEQ ID NO: 6667992 - DNA, 16 bp, Homo sapiens
atgccacttgggaatg

SEQ ID NO: 6667993 - DNA, 23 bp, Homo sapiens
atgccagaccgcagagaggctca

SEQ ID NO: 6667994 - DNA, 21 bp, Homo sapiens
atgccagacttctaaaataaa

SEQ ID NO: 6667995 - DNA, 12 bp, Homo sapiens
atgccagagcca

SEQ ID NO: 6667996 - DNA, 24 bp, Homo sapiens
atgccagagccaacctggacttcc

SEQ ID NO: 6667997 - DNA, 17 bp, Homo sapiens
atgccagagggccagca

SEQ ID NO: 6667998 - DNA, 19 bp, Homo sapiens
atgccagagggccagcagg

SEQ ID NO: 6667999 - DNA, 12 bp, Homo sapiens
atgccagcagca

SEQ ID NO: 6668000 - DNA, 18 bp, Homo sapiens
atgccagccaagctctgc

SEQ ID NO: 6668001 - DNA, 22 bp, Homo sapiens
atgccagccaagctctgcagtc

SEQ ID NO: 6668002 - DNA, 10 bp, Homo sapiens
atgccagccc

SEQ ID NO: 6668003 - DNA, 15 bp, Homo sapiens
atgccagcccaaagc

SEQ ID NO: 6668004 - DNA, 12 bp, Homo sapiens
atgccagcccct

SEQ ID NO: 6668005 - DNA, 15 bp, Homo sapiens
atgccagcccctgcc

SEQ ID NO: 6668006 - DNA, 19 bp, Homo sapiens
atgccagcccctgcctggg

SEQ ID NO: 6668007 - DNA, 21 bp, Homo sapiens
atgccagcccctgcctgggtt

SEQ ID NO: 6668008 - DNA, 23 bp, Homo sapiens
atgccagcccttcaggaagcagg

SEQ ID NO: 6668009 - DNA, 22 bp, Homo sapiens
atgccagccgggtacctcagtt

SEQ ID NO: 6668010 - DNA, 12 bp, Homo sapiens
atgccagccttg

SEQ ID NO: 6668011 - DNA, 12 bp, Homo sapiens
atgccagctggc

SEQ ID NO: 6668012 - DNA, 13 bp, Homo sapiens
atgccagctggcc

SEQ ID NO: 6668013 - DNA, 14 bp, Homo sapiens
atgccagcttctct

SEQ ID NO: 6668014 - DNA, 20 bp, Homo sapiens
atgccagcttctctctccag

SEQ ID NO: 6668015 - DNA, 21 bp, Homo sapiens
atgccagcttctctctccagg

SEQ ID NO: 6668016 - DNA, 14 bp, Homo sapiens
atgccaggacagct

SEQ ID NO: 6668017 - DNA, 20 bp, Homo sapiens
atgccaggacagctgcaggt

SEQ ID NO: 6668018 - DNA, 20 bp, Homo sapiens
atgccaggacccgccagccc

SEQ ID NO: 6668019 - DNA, 21 bp, Homo sapiens
atgccagggccatgtcagaca

SEQ ID NO: 6668020 - DNA, 23 bp, Homo sapiens
atgccagggccatgtcagacaca

SEQ ID NO: 6668021 - DNA, 15 bp, Homo sapiens
atgccagggcccagg

SEQ ID NO: 6668022 - DNA, 21 bp, Homo sapiens
atgccagggcgcactttccac

SEQ ID NO: 6668023 - DNA, 12 bp, Homo sapiens
atgccaggtgca

SEQ ID NO: 6668024 - DNA, 17 bp, Homo sapiens
atgccaggttaggaagg

SEQ ID NO: 6668025 - DNA, 22 bp, Homo sapiens
atgccaggttaggaaggcagca

SEQ ID NO: 6668026 - DNA, 17 bp, Homo sapiens
atgccagtaacaggctc

SEQ ID NO: 6668027 - DNA, 21 bp, Homo sapiens
atgccagtgactgctgcgctg

SEQ ID NO: 6668028 - DNA, 18 bp, Homo sapiens
atgccagtgcatgccagg

SEQ ID NO: 6668029 - DNA, 20 bp, Homo sapiens
atgccataaaagccgcccag

SEQ ID NO: 6668030 - DNA, 13 bp, Homo sapiens
atgccataataca

SEQ ID NO: 6668031 - DNA, 18 bp, Homo sapiens
atgccataatcagaacac

SEQ ID NO: 6668032 - DNA, 16 bp, Homo sapiens
atgccataccttgaga

SEQ ID NO: 6668033 - DNA, 14 bp, Homo sapiens
atgccatcaataaa

SEQ ID NO: 6668034 - DNA, 15 bp, Homo sapiens
atgccatcagcccct

SEQ ID NO: 6668035 - DNA, 18 bp, Homo sapiens
atgccatcagcccctggg

SEQ ID NO: 6668036 - DNA, 14 bp, Homo sapiens
atgccatcatctcc

SEQ ID NO: 6668037 - DNA, 19 bp, Homo sapiens
atgccatccagatgtgtgc

SEQ ID NO: 6668038 - DNA, 17 bp, Homo sapiens
atgccatccattctgcc

SEQ ID NO: 6668039 - DNA, 23 bp, Homo sapiens
atgccatcctcaaacactgcagg

SEQ ID NO: 6668040 - DNA, 21 bp, Homo sapiens
atgccatcctctttctctttt

SEQ ID NO: 6668041 - DNA, 17 bp, Homo sapiens
atgccatccttccagca

SEQ ID NO: 6668042 - DNA, 19 bp, Homo sapiens
atgccatctgtgtcctggt

SEQ ID NO: 6668043 - DNA, 20 bp, Homo sapiens
atgccatgaacaaattcttt

SEQ ID NO: 6668044 - DNA, 22 bp, Homo sapiens
atgccatgactgctcaggcctc

SEQ ID NO: 6668045 - DNA, 23 bp, Homo sapiens
atgccatgactgctcaggcctca

SEQ ID NO: 6668046 - DNA, 21 bp, Homo sapiens
atgccatgatttttggtattt

SEQ ID NO: 6668047 - DNA, 18 bp, Homo sapiens
atgccatgcctatgggcc

SEQ ID NO: 6668048 - DNA, 19 bp, Homo sapiens
atgccatggacagaagaag

SEQ ID NO: 6668049 - DNA, 14 bp, Homo sapiens
atgccatgtatgtt

SEQ ID NO: 6668050 - DNA, 18 bp, Homo sapiens
atgccatgtatgttgcat

SEQ ID NO: 6668051 - DNA, 20 bp, Homo sapiens
atgccatgtatgttgcatga

SEQ ID NO: 6668052 - DNA, 21 bp, Homo sapiens
atgccatgtatgttgcatgaa

SEQ ID NO: 6668053 - DNA, 21 bp, Homo sapiens
atgccatgttaatatttgaat

SEQ ID NO: 6668054 - DNA, 22 bp, Homo sapiens
atgccatgtttagattccagga

SEQ ID NO: 6668055 - DNA, 23 bp, Homo sapiens
atgccatgtttagattccaggat

SEQ ID NO: 6668056 - DNA, 14 bp, Homo sapiens
atgccattaaaaaa

SEQ ID NO: 6668057 - DNA, 22 bp, Homo sapiens
atgccattctccagtttcagaa

SEQ ID NO: 6668058 - DNA, 21 bp, Homo sapiens
atgccattctgcctcagcctc

SEQ ID NO: 6668059 - DNA, 16 bp, Homo sapiens
atgccattgtatttct

SEQ ID NO: 6668060 - DNA, 17 bp, Homo sapiens
atgccatttaaagctta

SEQ ID NO: 6668061 - DNA, 21 bp, Homo sapiens
atgccatttaaagcttattaa

SEQ ID NO: 6668062 - DNA, 21 bp, Homo sapiens
atgccatttagaatctagaaa

SEQ ID NO: 6668063 - DNA, 22 bp, Homo sapiens
atgccatttagaatctagaaat

SEQ ID NO: 6668064 - DNA, 19 bp, Homo sapiens
atgccatttagcaataaat

SEQ ID NO: 6668065 - DNA, 20 bp, Homo sapiens
atgccatttcagtggcttcc

SEQ ID NO: 6668066 - DNA, 15 bp, Homo sapiens
atgccatttctcacg

SEQ ID NO: 6668067 - DNA, 16 bp, Homo sapiens
atgccatttcttctct

SEQ ID NO: 6668068 - DNA, 12 bp, Homo sapiens
atgccatttgtt

SEQ ID NO: 6668069 - DNA, 14 bp, Homo sapiens
atgccatttgttta

SEQ ID NO: 6668070 - DNA, 20 bp, Homo sapiens
atgcccaacagggcaaccaa

SEQ ID NO: 6668071 - DNA, 15 bp, Homo sapiens
atgcccaagggaaag

SEQ ID NO: 6668072 - DNA, 19 bp, Homo sapiens
atgcccaccccctgccctg

SEQ ID NO: 6668073 - DNA, 14 bp, Homo sapiens
atgcccacccctgc

SEQ ID NO: 6668074 - DNA, 21 bp, Homo sapiens
atgcccaccgaggagccccag

SEQ ID NO: 6668075 - DNA, 23 bp, Homo sapiens
atgcccaccgaggagccccagcc

SEQ ID NO: 6668076 - DNA, 20 bp, Homo sapiens
atgcccacgcccctccccag

SEQ ID NO: 6668077 - DNA, 17 bp, Homo sapiens
atgcccacgttctttcc

SEQ ID NO: 6668078 - DNA, 20 bp, Homo sapiens
atgcccactcccccaggagc

SEQ ID NO: 6668079 - DNA, 11 bp, Homo sapiens
atgcccactgc

SEQ ID NO: 6668080 - DNA, 16 bp, Homo sapiens
atgcccactgctggtg

SEQ ID NO: 6668081 - DNA, 19 bp, Homo sapiens
atgcccactgctggtgcca

SEQ ID NO: 6668082 - DNA, 12 bp, Homo sapiens
atgcccagaaga

SEQ ID NO: 6668083 - DNA, 18 bp, Homo sapiens
atgcccagagacccagcg

SEQ ID NO: 6668084 - DNA, 21 bp, Homo sapiens
atgcccagagggcccaggcag

SEQ ID NO: 6668085 - DNA, 22 bp, Homo sapiens
atgcccagagggcccaggcagg

SEQ ID NO: 6668086 - DNA, 17 bp, Homo sapiens
atgcccagattcccaga

SEQ ID NO: 6668087 - DNA, 18 bp, Homo sapiens
atgcccagcacaattcat

SEQ ID NO: 6668088 - DNA, 14 bp, Homo sapiens
atgcccagcagggg

SEQ ID NO: 6668089 - DNA, 12 bp, Homo sapiens
atgcccagcccc

SEQ ID NO: 6668090 - DNA, 20 bp, Homo sapiens
atgcccagcccctggtggtg

SEQ ID NO: 6668091 - DNA, 17 bp, Homo sapiens
atgcccagccccttctg

SEQ ID NO: 6668092 - DNA, 13 bp, Homo sapiens
atgcccagcctcc

SEQ ID NO: 6668093 - DNA, 14 bp, Homo sapiens
atgcccagcctcca

SEQ ID NO: 6668094 - DNA, 13 bp, Homo sapiens
atgcccagctctc

SEQ ID NO: 6668095 - DNA, 23 bp, Homo sapiens
atgcccaggatttgactcgggcc

SEQ ID NO: 6668096 - DNA, 17 bp, Homo sapiens
atgcccagggccactct

SEQ ID NO: 6668097 - DNA, 14 bp, Homo sapiens
atgcccagtaaaat

SEQ ID NO: 6668098 - DNA, 16 bp, Homo sapiens
atgcccagtgagactg

SEQ ID NO: 6668099 - DNA, 12 bp, Homo sapiens
atgcccagttca

SEQ ID NO: 6668100 - DNA, 16 bp, Homo sapiens
atgcccattcctgcct

SEQ ID NO: 6668101 - DNA, 13 bp, Homo sapiens
atgccccaaactt

SEQ ID NO: 6668102 - DNA, 14 bp, Homo sapiens
atgccccaaatata

SEQ ID NO: 6668103 - DNA, 15 bp, Homo sapiens
atgccccaaatatag

SEQ ID NO: 6668104 - DNA, 13 bp, Homo sapiens
atgccccaaggac

SEQ ID NO: 6668105 - DNA, 21 bp, Homo sapiens
atgccccacccccctcctccc

SEQ ID NO: 6668106 - DNA, 23 bp, Homo sapiens
atgccccacccccctcctccccc

SEQ ID NO: 6668107 - DNA, 18 bp, Homo sapiens
atgccccactctgctgag

SEQ ID NO: 6668108 - DNA, 21 bp, Homo sapiens
atgccccactctgctgaggcc

SEQ ID NO: 6668109 - DNA, 15 bp, Homo sapiens
atgccccagagctgt

SEQ ID NO: 6668110 - DNA, 13 bp, Homo sapiens
atgccccagctct

SEQ ID NO: 6668111 - DNA, 14 bp, Homo sapiens
atgccccaggctct

SEQ ID NO: 6668112 - DNA, 12 bp, Homo sapiens
atgccccagtcg

SEQ ID NO: 6668113 - DNA, 13 bp, Homo sapiens
atgcccccagctg

SEQ ID NO: 6668114 - DNA, 17 bp, Homo sapiens
atgcccccaggcagcca

SEQ ID NO: 6668115 - DNA, 22 bp, Homo sapiens
atgcccccgacccccgcagagg

SEQ ID NO: 6668116 - DNA, 22 bp, Homo sapiens
atgccccctaatccccttctcc

SEQ ID NO: 6668117 - DNA, 17 bp, Homo sapiens
atgccccctccaggaga

SEQ ID NO: 6668118 - DNA, 15 bp, Homo sapiens
atgccccctcccctc

SEQ ID NO: 6668119 - DNA, 21 bp, Homo sapiens
atgccccctcccttcacaggg

SEQ ID NO: 6668120 - DNA, 15 bp, Homo sapiens
atgccccctcgtgcc

SEQ ID NO: 6668121 - DNA, 10 bp, Homo sapiens
atgccccctg

SEQ ID NO: 6668122 - DNA, 16 bp, Homo sapiens
atgccccctgcttact

SEQ ID NO: 6668123 - DNA, 15 bp, Homo sapiens
atgccccggccacct

SEQ ID NO: 6668124 - DNA, 18 bp, Homo sapiens
atgccccggccacctctg

SEQ ID NO: 6668125 - DNA, 19 bp, Homo sapiens
atgccccggccacctctgc

SEQ ID NO: 6668126 - DNA, 18 bp, Homo sapiens
atgccccgtccccctctg

SEQ ID NO: 6668127 - DNA, 21 bp, Homo sapiens
atgccccgtccccctctggct

SEQ ID NO: 6668128 - DNA, 17 bp, Homo sapiens
atgcccctccccagtag

SEQ ID NO: 6668129 - DNA, 16 bp, Homo sapiens
atgcccctcccccagc

SEQ ID NO: 6668130 - DNA, 18 bp, Homo sapiens
atgcccctctgcctgggc

SEQ ID NO: 6668131 - DNA, 13 bp, Homo sapiens
atgcccctgacag

SEQ ID NO: 6668132 - DNA, 16 bp, Homo sapiens
atgcccctggctggga

SEQ ID NO: 6668133 - DNA, 20 bp, Homo sapiens
atgccccttctccccttcct

SEQ ID NO: 6668134 - DNA, 21 bp, Homo sapiens
atgccccttctccccttcctg

SEQ ID NO: 6668135 - DNA, 12 bp, Homo sapiens
atgccccttggt

SEQ ID NO: 6668136 - DNA, 15 bp, Homo sapiens
atgccccttggtcct

SEQ ID NO: 6668137 - DNA, 17 bp, Homo sapiens
atgcccgagtccgccca

SEQ ID NO: 6668138 - DNA, 22 bp, Homo sapiens
atgcccgttgtctaggagacag

SEQ ID NO: 6668139 - DNA, 20 bp, Homo sapiens
atgccctaagagtgtcactg

SEQ ID NO: 6668140 - DNA, 15 bp, Homo sapiens
atgccctacatctta

SEQ ID NO: 6668141 - DNA, 19 bp, Homo sapiens
atgccctagaccctcccca

SEQ ID NO: 6668142 - DNA, 15 bp, Homo sapiens
atgccctatgtgtat

SEQ ID NO: 6668143 - DNA, 12 bp, Homo sapiens
atgccctcagct

SEQ ID NO: 6668144 - DNA, 19 bp, Homo sapiens
atgccctccaatcctttcc

SEQ ID NO: 6668145 - DNA, 19 bp, Homo sapiens
atgccctccactccactgc

SEQ ID NO: 6668146 - DNA, 15 bp, Homo sapiens
atgccctcccaggac

SEQ ID NO: 6668147 - DNA, 18 bp, Homo sapiens
atgccctcccaggaccct

SEQ ID NO: 6668148 - DNA, 19 bp, Homo sapiens
atgccctccctgctgccag

SEQ ID NO: 6668149 - DNA, 21 bp, Homo sapiens
atgccctcccttctccctgga

SEQ ID NO: 6668150 - DNA, 23 bp, Homo sapiens
atgccctcctctcccattgtccc

SEQ ID NO: 6668151 - DNA, 10 bp, Homo sapiens
atgccctctc

SEQ ID NO: 6668152 - DNA, 22 bp, Homo sapiens
atgccctctctcgggagcccta

SEQ ID NO: 6668153 - DNA, 22 bp, Homo sapiens
atgccctctctgagtctggact

SEQ ID NO: 6668154 - DNA, 16 bp, Homo sapiens
atgccctcttctcctt

SEQ ID NO: 6668155 - DNA, 17 bp, Homo sapiens
atgccctcttctccttg

SEQ ID NO: 6668156 - DNA, 13 bp, Homo sapiens
atgccctgcagag

SEQ ID NO: 6668157 - DNA, 14 bp, Homo sapiens
atgccctgcagagc

SEQ ID NO: 6668158 - DNA, 19 bp, Homo sapiens
atgccctgccaagcctgga

SEQ ID NO: 6668159 - DNA, 20 bp, Homo sapiens
atgccctgccaagcctggag

SEQ ID NO: 6668160 - DNA, 13 bp, Homo sapiens
atgccctgccatt

SEQ ID NO: 6668161 - DNA, 15 bp, Homo sapiens
atgccctgccttgct

SEQ ID NO: 6668162 - DNA, 19 bp, Homo sapiens
atgccctgcggctctggaa

SEQ ID NO: 6668163 - DNA, 22 bp, Homo sapiens
atgccctgctagatgagaattc

SEQ ID NO: 6668164 - DNA, 14 bp, Homo sapiens
atgccctggatcca

SEQ ID NO: 6668165 - DNA, 20 bp, Homo sapiens
atgccctgggatgcctcacc

SEQ ID NO: 6668166 - DNA, 17 bp, Homo sapiens
atgccctgtccctagct

SEQ ID NO: 6668167 - DNA, 23 bp, Homo sapiens
atgccctgtccctagctcacact

SEQ ID NO: 6668168 - DNA, 12 bp, Homo sapiens
atgccctgtgca

SEQ ID NO: 6668169 - DNA, 22 bp, Homo sapiens
atgccctgttcatgctgagcaa

SEQ ID NO: 6668170 - DNA, 21 bp, Homo sapiens
atgccctgttgggggcttcag

SEQ ID NO: 6668171 - DNA, 15 bp, Homo sapiens
atgcccttaaatcat

SEQ ID NO: 6668172 - DNA, 14 bp, Homo sapiens
atgcccttaatgtg

SEQ ID NO: 6668173 - DNA, 22 bp, Homo sapiens
atgcccttacacgtgcgtgtga

SEQ ID NO: 6668174 - DNA, 11 bp, Homo sapiens
atgcccttccc

SEQ ID NO: 6668175 - DNA, 16 bp, Homo sapiens
atgcccttctccttat

SEQ ID NO: 6668176 - DNA, 15 bp, Homo sapiens
atgccgagacctcaa

SEQ ID NO: 6668177 - DNA, 16 bp, Homo sapiens
atgccgagacctcaag

SEQ ID NO: 6668178 - DNA, 19 bp, Homo sapiens
atgccgatatactctagat

SEQ ID NO: 6668179 - DNA, 15 bp, Homo sapiens
atgccgatttctgta

SEQ ID NO: 6668180 - DNA, 19 bp, Homo sapiens
atgccgatttctgtaaact

SEQ ID NO: 6668181 - DNA, 17 bp, Homo sapiens
atgccgccgcagctggt

SEQ ID NO: 6668182 - DNA, 19 bp, Homo sapiens
atgccgcctgtcaataaat

SEQ ID NO: 6668183 - DNA, 20 bp, Homo sapiens
atgccgcctgtcaataaatg

SEQ ID NO: 6668184 - DNA, 20 bp, Homo sapiens
atgccgcgggcggccaggca

SEQ ID NO: 6668185 - DNA, 21 bp, Homo sapiens
atgccgctcttctgtcatccc

SEQ ID NO: 6668186 - DNA, 15 bp, Homo sapiens
atgccgctgtctctg

SEQ ID NO: 6668187 - DNA, 21 bp, Homo sapiens
atgccgctgtgtctatgaact

SEQ ID NO: 6668188 - DNA, 14 bp, Homo sapiens
atgccggatgtgct

SEQ ID NO: 6668189 - DNA, 16 bp, Homo sapiens
atgccggatgtgcttt

SEQ ID NO: 6668190 - DNA, 22 bp, Homo sapiens
atgccgggcgccaggacagcag

SEQ ID NO: 6668191 - DNA, 20 bp, Homo sapiens
atgccggttaaattccatat

SEQ ID NO: 6668192 - DNA, 13 bp, Homo sapiens
atgccgtcctgct

SEQ ID NO: 6668193 - DNA, 20 bp, Homo sapiens
atgccgtcctgctggagtga

SEQ ID NO: 6668194 - DNA, 22 bp, Homo sapiens
atgccgtctcatatttttacaa

SEQ ID NO: 6668195 - DNA, 22 bp, Homo sapiens
atgccgttacttttcatatttg

SEQ ID NO: 6668196 - DNA, 23 bp, Homo sapiens
atgccgttctgcaccctacccag

SEQ ID NO: 6668197 - DNA, 16 bp, Homo sapiens
atgccgttctgttcca

SEQ ID NO: 6668198 - DNA, 19 bp, Homo sapiens
atgcctaaaaattcccttc

SEQ ID NO: 6668199 - DNA, 20 bp, Homo sapiens
atgcctaaagcccattgctg

SEQ ID NO: 6668200 - DNA, 13 bp, Homo sapiens
atgcctaataaac

SEQ ID NO: 6668201 - DNA, 18 bp, Homo sapiens
atgcctaatatttaggca

SEQ ID NO: 6668202 - DNA, 21 bp, Homo sapiens
atgcctaatttttttctattt

SEQ ID NO: 6668203 - DNA, 18 bp, Homo sapiens
atgcctacaaccatccct

SEQ ID NO: 6668204 - DNA, 21 bp, Homo sapiens
atgcctacaaccatccctgcc

SEQ ID NO: 6668205 - DNA, 20 bp, Homo sapiens
atgcctacattagtgagatt

SEQ ID NO: 6668206 - DNA, 16 bp, Homo sapiens
atgcctaccaatattt

SEQ ID NO: 6668207 - DNA, 22 bp, Homo sapiens
atgcctaccgggttctcctgat

SEQ ID NO: 6668208 - DNA, 23 bp, Homo sapiens
atgcctaccgggttctcctgatt

SEQ ID NO: 6668209 - DNA, 13 bp, Homo sapiens
atgcctacttttg

SEQ ID NO: 6668210 - DNA, 16 bp, Homo sapiens
atgcctacttttggcc

SEQ ID NO: 6668211 - DNA, 17 bp, Homo sapiens
atgcctacttttggcct

SEQ ID NO: 6668212 - DNA, 20 bp, Homo sapiens
atgcctagactgtgtatgtc

SEQ ID NO: 6668213 - DNA, 20 bp, Homo sapiens
atgcctagagatatttcaag

SEQ ID NO: 6668214 - DNA, 19 bp, Homo sapiens
atgcctagcacaagtacca

SEQ ID NO: 6668215 - DNA, 24 bp, Homo sapiens
atgcctagcagagtgctggcactt

SEQ ID NO: 6668216 - DNA, 18 bp, Homo sapiens
atgcctaggccagctcct

SEQ ID NO: 6668217 - DNA, 14 bp, Homo sapiens
atgcctaggtccct

SEQ ID NO: 6668218 - DNA, 17 bp, Homo sapiens
atgcctataaaatgccc

SEQ ID NO: 6668219 - DNA, 15 bp, Homo sapiens
atgcctatgggccag

SEQ ID NO: 6668220 - DNA, 16 bp, Homo sapiens
atgcctatggtggatc

SEQ ID NO: 6668221 - DNA, 19 bp, Homo sapiens
atgcctatttactggaaac

SEQ ID NO: 6668222 - DNA, 18 bp, Homo sapiens
atgcctcaagaacacctt

SEQ ID NO: 6668223 - DNA, 22 bp, Homo sapiens
atgcctcaattcacatagattt

SEQ ID NO: 6668224 - DNA, 19 bp, Homo sapiens
atgcctcaccacacccagg

SEQ ID NO: 6668225 - DNA, 15 bp, Homo sapiens
atgcctcactaattt

SEQ ID NO: 6668226 - DNA, 17 bp, Homo sapiens
atgcctcactttcttct

SEQ ID NO: 6668227 - DNA, 18 bp, Homo sapiens
atgcctcactttcttcta

SEQ ID NO: 6668228 - DNA, 11 bp, Homo sapiens
atgcctcagcc

SEQ ID NO: 6668229 - DNA, 20 bp, Homo sapiens
atgcctcagccagccctgga

SEQ ID NO: 6668230 - DNA, 13 bp, Homo sapiens
atgcctcagccct

SEQ ID NO: 6668231 - DNA, 16 bp, Homo sapiens
atgcctcagcctcctg

SEQ ID NO: 6668232 - DNA, 18 bp, Homo sapiens
atgcctcagcctctcaag

SEQ ID NO: 6668233 - DNA, 16 bp, Homo sapiens
atgcctcagtgtattt

SEQ ID NO: 6668234 - DNA, 12 bp, Homo sapiens
atgcctcagttt

SEQ ID NO: 6668235 - DNA, 18 bp, Homo sapiens
atgcctcataaattaatg

SEQ ID NO: 6668236 - DNA, 20 bp, Homo sapiens
atgcctcataaattaatgat

SEQ ID NO: 6668237 - DNA, 14 bp, Homo sapiens
atgcctccaagcca

SEQ ID NO: 6668238 - DNA, 21 bp, Homo sapiens
atgcctccaccgctgcctaag

SEQ ID NO: 6668239 - DNA, 17 bp, Homo sapiens
atgcctccagctacaaa

SEQ ID NO: 6668240 - DNA, 14 bp, Homo sapiens
atgcctccctgacc

SEQ ID NO: 6668241 - DNA, 15 bp, Homo sapiens
atgcctcctcaggag

SEQ ID NO: 6668242 - DNA, 16 bp, Homo sapiens
atgcctcctcctgccc

SEQ ID NO: 6668243 - DNA, 17 bp, Homo sapiens
atgcctcctcctgccct

SEQ ID NO: 6668244 - DNA, 14 bp, Homo sapiens
atgcctcctgccct

SEQ ID NO: 6668245 - DNA, 19 bp, Homo sapiens
atgcctcgagccatagagc

SEQ ID NO: 6668246 - DNA, 16 bp, Homo sapiens
atgcctctcctttgta

SEQ ID NO: 6668247 - DNA, 17 bp, Homo sapiens
atgcctctcctttgtat

SEQ ID NO: 6668248 - DNA, 14 bp, Homo sapiens
atgcctctctcagg

SEQ ID NO: 6668249 - DNA, 19 bp, Homo sapiens
atgcctctgaggccagcct

SEQ ID NO: 6668250 - DNA, 22 bp, Homo sapiens
atgcctctgaggccagcctggc

SEQ ID NO: 6668251 - DNA, 21 bp, Homo sapiens
atgcctctggaggcctctggc

SEQ ID NO: 6668252 - DNA, 19 bp, Homo sapiens
atgcctctgtcttctggac

SEQ ID NO: 6668253 - DNA, 22 bp, Homo sapiens
atgcctcttctacctcttccag

SEQ ID NO: 6668254 - DNA, 21 bp, Homo sapiens
atgcctgacacaggggacact

SEQ ID NO: 6668255 - DNA, 20 bp, Homo sapiens
atgcctgaccccttgctccc

SEQ ID NO: 6668256 - DNA, 16 bp, Homo sapiens
atgcctgagccccctg

SEQ ID NO: 6668257 - DNA, 18 bp, Homo sapiens
atgcctgagccccctgag

SEQ ID NO: 6668258 - DNA, 14 bp, Homo sapiens
atgcctgagggtgg

SEQ ID NO: 6668259 - DNA, 20 bp, Homo sapiens
atgcctgagtgcctggccaa

SEQ ID NO: 6668260 - DNA, 20 bp, Homo sapiens
atgcctgatgtgacgctact

SEQ ID NO: 6668261 - DNA, 21 bp, Homo sapiens
atgcctgattcggacggccaa

SEQ ID NO: 6668262 - DNA, 17 bp, Homo sapiens
atgcctgattttaaaag

SEQ ID NO: 6668263 - DNA, 17 bp, Homo sapiens
atgcctgcactgggaag

SEQ ID NO: 6668264 - DNA, 18 bp, Homo sapiens
atgcctgcccgcaccctg

SEQ ID NO: 6668265 - DNA, 16 bp, Homo sapiens
atgcctgcggagttgt

SEQ ID NO: 6668266 - DNA, 19 bp, Homo sapiens
atgcctgctctttggcctg

SEQ ID NO: 6668267 - DNA, 16 bp, Homo sapiens
atgcctgctgagagag

SEQ ID NO: 6668268 - DNA, 23 bp, Homo sapiens
atgcctgctttgaataaatgtgt

SEQ ID NO: 6668269 - DNA, 18 bp, Homo sapiens
atgcctgctttttggaaa

SEQ ID NO: 6668270 - DNA, 19 bp, Homo sapiens
atgcctgctttttggaaag

SEQ ID NO: 6668271 - DNA, 18 bp, Homo sapiens
atgcctggaagctttgtc

SEQ ID NO: 6668272 - DNA, 19 bp, Homo sapiens
atgcctggatggggctgca

SEQ ID NO: 6668273 - DNA, 20 bp, Homo sapiens
atgcctggatggggctgcac

SEQ ID NO: 6668274 - DNA, 16 bp, Homo sapiens
atgcctggcacagctt

SEQ ID NO: 6668275 - DNA, 18 bp, Homo sapiens
atgcctggcccccctcca

SEQ ID NO: 6668276 - DNA, 19 bp, Homo sapiens
atgcctggcccccctccag

SEQ ID NO: 6668277 - DNA, 18 bp, Homo sapiens
atgcctggcccctcctcc

SEQ ID NO: 6668278 - DNA, 12 bp, Homo sapiens
atgcctggcctg

SEQ ID NO: 6668279 - DNA, 19 bp, Homo sapiens
atgcctggcctgaggaccc

SEQ ID NO: 6668280 - DNA, 11 bp, Homo sapiens
atgcctgggcc

SEQ ID NO: 6668281 - DNA, 20 bp, Homo sapiens
atgcctgggcccaggcccag

SEQ ID NO: 6668282 - DNA, 12 bp, Homo sapiens
atgcctgggcct

SEQ ID NO: 6668283 - DNA, 17 bp, Homo sapiens
atgcctgggttgctgct

SEQ ID NO: 6668284 - DNA, 21 bp, Homo sapiens
atgcctggtaagtggcttttt

SEQ ID NO: 6668285 - DNA, 14 bp, Homo sapiens
atgcctggtatttt

SEQ ID NO: 6668286 - DNA, 16 bp, Homo sapiens
atgcctggtctttcct

SEQ ID NO: 6668287 - DNA, 13 bp, Homo sapiens
atgcctggtggca

SEQ ID NO: 6668288 - DNA, 14 bp, Homo sapiens
atgcctggtggcag

SEQ ID NO: 6668289 - DNA, 16 bp, Homo sapiens
atgcctggtggcagct

SEQ ID NO: 6668290 - DNA, 18 bp, Homo sapiens
atgcctggtggcagctgc

SEQ ID NO: 6668291 - DNA, 19 bp, Homo sapiens
atgcctggtggcagctgcg

SEQ ID NO: 6668292 - DNA, 18 bp, Homo sapiens
atgcctgtaatcccagaa

SEQ ID NO: 6668293 - DNA, 16 bp, Homo sapiens
atgcctgtaattcagt

SEQ ID NO: 6668294 - DNA, 18 bp, Homo sapiens
atgcctgtaattcagtgt

SEQ ID NO: 6668295 - DNA, 23 bp, Homo sapiens
atgcctgtactcgcttgtgcaga

SEQ ID NO: 6668296 - DNA, 20 bp, Homo sapiens
atgcctgtagctttcctggt

SEQ ID NO: 6668297 - DNA, 19 bp, Homo sapiens
atgcctgtagtctcagcta

SEQ ID NO: 6668298 - DNA, 20 bp, Homo sapiens
atgcctgtcagtttcatgga

SEQ ID NO: 6668299 - DNA, 18 bp, Homo sapiens
atgcctgtccagcctggg

SEQ ID NO: 6668300 - DNA, 12 bp, Homo sapiens
atgcctgtcctt

SEQ ID NO: 6668301 - DNA, 21 bp, Homo sapiens
atgcctgtctctagctgttct

SEQ ID NO: 6668302 - DNA, 21 bp, Homo sapiens
atgcctgtctctgttcagatg

SEQ ID NO: 6668303 - DNA, 19 bp, Homo sapiens
atgcctgtcttaattttct

SEQ ID NO: 6668304 - DNA, 13 bp, Homo sapiens
atgcctgtgaagc

SEQ ID NO: 6668305 - DNA, 13 bp, Homo sapiens
atgcctgtgccaa

SEQ ID NO: 6668306 - DNA, 14 bp, Homo sapiens
atgcctgtggctgc

SEQ ID NO: 6668307 - DNA, 19 bp, Homo sapiens
atgcctgttaatttataat

SEQ ID NO: 6668308 - DNA, 17 bp, Homo sapiens
atgcctgttgaaggtac

SEQ ID NO: 6668309 - DNA, 17 bp, Homo sapiens
atgcctgttgcaggcaa

SEQ ID NO: 6668310 - DNA, 18 bp, Homo sapiens
atgcctgttgcaggcaaa

SEQ ID NO: 6668311 - DNA, 22 bp, Homo sapiens
atgcctgttgcaggcaaatgta

SEQ ID NO: 6668312 - DNA, 17 bp, Homo sapiens
atgcctgttttgagacc

SEQ ID NO: 6668313 - DNA, 17 bp, Homo sapiens
atgccttaattaaagaa

SEQ ID NO: 6668314 - DNA, 14 bp, Homo sapiens
atgccttaatttag

SEQ ID NO: 6668315 - DNA, 16 bp, Homo sapiens
atgccttaatttagaa

SEQ ID NO: 6668316 - DNA, 18 bp, Homo sapiens
atgccttactttgtatga

SEQ ID NO: 6668317 - DNA, 23 bp, Homo sapiens
atgccttactttgtatgatattc

SEQ ID NO: 6668318 - DNA, 12 bp, Homo sapiens
atgccttatgta

SEQ ID NO: 6668319 - DNA, 18 bp, Homo sapiens
atgccttatgtaattatt

SEQ ID NO: 6668320 - DNA, 20 bp, Homo sapiens
atgccttatttttgaattct

SEQ ID NO: 6668321 - DNA, 21 bp, Homo sapiens
atgccttatttttgaattctt

SEQ ID NO: 6668322 - DNA, 18 bp, Homo sapiens
atgccttcactacaacat

SEQ ID NO: 6668323 - DNA, 22 bp, Homo sapiens
atgccttcatgggggtgacccc

SEQ ID NO: 6668324 - DNA, 16 bp, Homo sapiens
atgccttcccctgggc

SEQ ID NO: 6668325 - DNA, 21 bp, Homo sapiens
atgccttccgacaccactggg

SEQ ID NO: 6668326 - DNA, 23 bp, Homo sapiens
atgccttccgacaccactgggaa

SEQ ID NO: 6668327 - DNA, 21 bp, Homo sapiens
atgccttccgggccgggcgga

SEQ ID NO: 6668328 - DNA, 22 bp, Homo sapiens
atgccttcctgtctttctggcc

SEQ ID NO: 6668329 - DNA, 17 bp, Homo sapiens
atgccttctagattcac

SEQ ID NO: 6668330 - DNA, 15 bp, Homo sapiens
atgccttctatacat

SEQ ID NO: 6668331 - DNA, 15 bp, Homo sapiens
atgccttctccagac

SEQ ID NO: 6668332 - DNA, 20 bp, Homo sapiens
atgccttcttattgctttta

SEQ ID NO: 6668333 - DNA, 18 bp, Homo sapiens
atgccttgaattgtctag

SEQ ID NO: 6668334 - DNA, 19 bp, Homo sapiens
atgccttgaggtgaaatgg

SEQ ID NO: 6668335 - DNA, 22 bp, Homo sapiens
atgccttgagtctttaatccca

SEQ ID NO: 6668336 - DNA, 21 bp, Homo sapiens
atgccttgataaatatatatg

SEQ ID NO: 6668337 - DNA, 22 bp, Homo sapiens
atgccttgataaatatatatga

SEQ ID NO: 6668338 - DNA, 22 bp, Homo sapiens
atgccttgcaatggatcagcca

SEQ ID NO: 6668339 - DNA, 22 bp, Homo sapiens
atgccttggggaggacaaaact

SEQ ID NO: 6668340 - DNA, 24 bp, Homo sapiens
atgccttggtttttactgctctga

SEQ ID NO: 6668341 - DNA, 21 bp, Homo sapiens
atgcctttaaagtatgaatct

SEQ ID NO: 6668342 - DNA, 22 bp, Homo sapiens
atgcctttatttctgtatctga

SEQ ID NO: 6668343 - DNA, 12 bp, Homo sapiens
atgcctttcaaa

SEQ ID NO: 6668344 - DNA, 14 bp, Homo sapiens
atgcctttcatagt

SEQ ID NO: 6668345 - DNA, 19 bp, Homo sapiens
atgcctttctagcaattgc

SEQ ID NO: 6668346 - DNA, 22 bp, Homo sapiens
atgcctttctagtcctattcta

SEQ ID NO: 6668347 - DNA, 14 bp, Homo sapiens
atgcctttgagaca

SEQ ID NO: 6668348 - DNA, 13 bp, Homo sapiens
atgcctttgtaac

SEQ ID NO: 6668349 - DNA, 15 bp, Homo sapiens
atgcctttgtaagtt

SEQ ID NO: 6668350 - DNA, 16 bp, Homo sapiens
atgcctttgtaagtta

SEQ ID NO: 6668351 - DNA, 22 bp, Homo sapiens
atgccttttcaaatgcagcaat

SEQ ID NO: 6668352 - DNA, 22 bp, Homo sapiens
atgccttttcccaactccagaa

SEQ ID NO: 6668353 - DNA, 15 bp, Homo sapiens
atgccttttctgtga

SEQ ID NO: 6668354 - DNA, 18 bp, Homo sapiens
atgccttttgtagctgtc

SEQ ID NO: 6668355 - DNA, 20 bp, Homo sapiens
atgccttttttttttttaag

SEQ ID NO: 6668356 - DNA, 14 bp, Homo sapiens
atgcgaaaacttga

SEQ ID NO: 6668357 - DNA, 22 bp, Homo sapiens
atgcgaatgagctgggccctgg

SEQ ID NO: 6668358 - DNA, 17 bp, Homo sapiens
atgcgaatggtagtcta

SEQ ID NO: 6668359 - DNA, 20 bp, Homo sapiens
atgcgacactgggaggccag

SEQ ID NO: 6668360 - DNA, 19 bp, Homo sapiens
atgcgacttgttttgctgc

SEQ ID NO: 6668361 - DNA, 13 bp, Homo sapiens
atgcgagactctg

SEQ ID NO: 6668362 - DNA, 22 bp, Homo sapiens
atgcgagcttggccttgggccg

SEQ ID NO: 6668363 - DNA, 14 bp, Homo sapiens
atgcgaggggccag

SEQ ID NO: 6668364 - DNA, 18 bp, Homo sapiens
atgcgaggggccagcaga

SEQ ID NO: 6668365 - DNA, 16 bp, Homo sapiens
atgcgatttcttcctt

SEQ ID NO: 6668366 - DNA, 21 bp, Homo sapiens
atgcgatttcttccttgttgt

SEQ ID NO: 6668367 - DNA, 18 bp, Homo sapiens
atgcgattttattactgg

SEQ ID NO: 6668368 - DNA, 14 bp, Homo sapiens
atgcgcaaatacaa

SEQ ID NO: 6668369 - DNA, 18 bp, Homo sapiens
atgcgcaaatacaaaatg

SEQ ID NO: 6668370 - DNA, 21 bp, Homo sapiens
atgcgcaagggcaaaccattt

SEQ ID NO: 6668371 - DNA, 16 bp, Homo sapiens
atgcgcaatgtggcat

SEQ ID NO: 6668372 - DNA, 18 bp, Homo sapiens
atgcgcagatgaggggcc

SEQ ID NO: 6668373 - DNA, 20 bp, Homo sapiens
atgcgcagatgaggggccac

SEQ ID NO: 6668374 - DNA, 12 bp, Homo sapiens
atgcgcagcccc

SEQ ID NO: 6668375 - DNA, 12 bp, Homo sapiens
atgcgcaggctc

SEQ ID NO: 6668376 - DNA, 14 bp, Homo sapiens
atgcgcaggctggc

SEQ ID NO: 6668377 - DNA, 22 bp, Homo sapiens
atgcgcaggctggccctgccct

SEQ ID NO: 6668378 - DNA, 15 bp, Homo sapiens
atgcgccaataaacc

SEQ ID NO: 6668379 - DNA, 15 bp, Homo sapiens
atgcgcccgaggcag

SEQ ID NO: 6668380 - DNA, 16 bp, Homo sapiens
atgcgccctggtatgt

SEQ ID NO: 6668381 - DNA, 13 bp, Homo sapiens
atgcgccttgctg

SEQ ID NO: 6668382 - DNA, 21 bp, Homo sapiens
atgcgccttgctgatggcttg

SEQ ID NO: 6668383 - DNA, 17 bp, Homo sapiens
atgcgcgcgctctctct

SEQ ID NO: 6668384 - DNA, 22 bp, Homo sapiens
atgcgcgctgtgggcaattgtt

SEQ ID NO: 6668385 - DNA, 23 bp, Homo sapiens
atgcgctcagggccatgctgagg

SEQ ID NO: 6668386 - DNA, 13 bp, Homo sapiens
atgcgctcctggc

SEQ ID NO: 6668387 - DNA, 14 bp, Homo sapiens
atgcgctcctggct

SEQ ID NO: 6668388 - DNA, 16 bp, Homo sapiens
atgcgctcctggcttt

SEQ ID NO: 6668389 - DNA, 18 bp, Homo sapiens
atgcgctcttcaccagga

SEQ ID NO: 6668390 - DNA, 20 bp, Homo sapiens
atgcgctcttcaccaggaag

SEQ ID NO: 6668391 - DNA, 18 bp, Homo sapiens
atgcgctgctcaacctct

SEQ ID NO: 6668392 - DNA, 20 bp, Homo sapiens
atgcggagccagcaggcctc

SEQ ID NO: 6668393 - DNA, 12 bp, Homo sapiens
atgcggcccagc

SEQ ID NO: 6668394 - DNA, 15 bp, Homo sapiens
atgcggcccagcccg

SEQ ID NO: 6668395 - DNA, 16 bp, Homo sapiens
atgcggcccaggatgg

SEQ ID NO: 6668396 - DNA, 20 bp, Homo sapiens
atgcggcccaggatggcttt

SEQ ID NO: 6668397 - DNA, 15 bp, Homo sapiens
atgcggccggcctgg

SEQ ID NO: 6668398 - DNA, 14 bp, Homo sapiens
atgcggctttctct

SEQ ID NO: 6668399 - DNA, 16 bp, Homo sapiens
atgcggctttctctgc

SEQ ID NO: 6668400 - DNA, 18 bp, Homo sapiens
atgcggctttctctgcct

SEQ ID NO: 6668401 - DNA, 23 bp, Homo sapiens
atgcggctttctctgcctctggg

SEQ ID NO: 6668402 - DNA, 18 bp, Homo sapiens
atgcggggacaggctgga

SEQ ID NO: 6668403 - DNA, 16 bp, Homo sapiens
atgcggggcagagcca

SEQ ID NO: 6668404 - DNA, 18 bp, Homo sapiens
atgcggtagccagcacac

SEQ ID NO: 6668405 - DNA, 15 bp, Homo sapiens
atgcggtctagggaa

SEQ ID NO: 6668406 - DNA, 15 bp, Homo sapiens
atgcggtgggtgctg

SEQ ID NO: 6668407 - DNA, 19 bp, Homo sapiens
atgcggttaattttgaagt

SEQ ID NO: 6668408 - DNA, 17 bp, Homo sapiens
atgcgtaaatcaacttg

SEQ ID NO: 6668409 - DNA, 16 bp, Homo sapiens
atgcgtaatttaatgg

SEQ ID NO: 6668410 - DNA, 20 bp, Homo sapiens
atgcgtagcatttgctgcat

SEQ ID NO: 6668411 - DNA, 14 bp, Homo sapiens
atgcgtatatgtgc

SEQ ID NO: 6668412 - DNA, 18 bp, Homo sapiens
atgcgtatatgtgcgtct

SEQ ID NO: 6668413 - DNA, 18 bp, Homo sapiens
atgcgtatttgcatttgg

SEQ ID NO: 6668414 - DNA, 14 bp, Homo sapiens
atgcgtctctggcc

SEQ ID NO: 6668415 - DNA, 13 bp, Homo sapiens
atgcgtcttgtga

SEQ ID NO: 6668416 - DNA, 15 bp, Homo sapiens
atgcgtcttgtgaaa

SEQ ID NO: 6668417 - DNA, 16 bp, Homo sapiens
atgcgtgcccagctct

SEQ ID NO: 6668418 - DNA, 16 bp, Homo sapiens
atgcgtgccgcctgct

SEQ ID NO: 6668419 - DNA, 18 bp, Homo sapiens
atgcgtgccgcctgctcc

SEQ ID NO: 6668420 - DNA, 19 bp, Homo sapiens
atgcgtgccgcctgctcct

SEQ ID NO: 6668421 - DNA, 16 bp, Homo sapiens
atgcgtgggaggcaga

SEQ ID NO: 6668422 - DNA, 21 bp, Homo sapiens
atgcgtgggaggcagaaacct

SEQ ID NO: 6668423 - DNA, 12 bp, Homo sapiens
atgcgtgggcag

SEQ ID NO: 6668424 - DNA, 13 bp, Homo sapiens
atgcgtgggcaga

SEQ ID NO: 6668425 - DNA, 15 bp, Homo sapiens
atgcgttcgcctctg

SEQ ID NO: 6668426 - DNA, 14 bp, Homo sapiens
atgcgtttcttcca

SEQ ID NO: 6668427 - DNA, 15 bp, Homo sapiens
atgcgtttgcctcct

SEQ ID NO: 6668428 - DNA, 14 bp, Homo sapiens
atgctaaaacctga

SEQ ID NO: 6668429 - DNA, 12 bp, Homo sapiens
atgctaaactgt

SEQ ID NO: 6668430 - DNA, 14 bp, Homo sapiens
atgctaaactgtga

SEQ ID NO: 6668431 - DNA, 12 bp, Homo sapiens
atgctaaacttg

SEQ ID NO: 6668432 - DNA, 14 bp, Homo sapiens
atgctaaagaaaaa

SEQ ID NO: 6668433 - DNA, 17 bp, Homo sapiens
atgctaaagatgatgat

SEQ ID NO: 6668434 - DNA, 17 bp, Homo sapiens
atgctaaataactatat

SEQ ID NO: 6668435 - DNA, 20 bp, Homo sapiens
atgctaaatgcaaacactgt

SEQ ID NO: 6668436 - DNA, 21 bp, Homo sapiens
atgctaaatgtaagaatcatt

SEQ ID NO: 6668437 - DNA, 13 bp, Homo sapiens
atgctaaatgtgt

SEQ ID NO: 6668438 - DNA, 16 bp, Homo sapiens
atgctaaatgtgtaat

SEQ ID NO: 6668439 - DNA, 17 bp, Homo sapiens
atgctaaatgtgtaata

SEQ ID NO: 6668440 - DNA, 16 bp, Homo sapiens
atgctaacaaactgaa

SEQ ID NO: 6668441 - DNA, 15 bp, Homo sapiens
atgctaacaaagaca

SEQ ID NO: 6668442 - DNA, 23 bp, Homo sapiens
atgctaacaaagacaaaagtctg

SEQ ID NO: 6668443 - DNA, 19 bp, Homo sapiens
atgctaacagttcacttgc

SEQ ID NO: 6668444 - DNA, 23 bp, Homo sapiens
atgctaacagttcacttgcagtg

SEQ ID NO: 6668445 - DNA, 16 bp, Homo sapiens
atgctaacatctaaaa

SEQ ID NO: 6668446 - DNA, 19 bp, Homo sapiens
atgctaagaaatgctgaaa

SEQ ID NO: 6668447 - DNA, 18 bp, Homo sapiens
atgctaagagaagtagaa

SEQ ID NO: 6668448 - DNA, 21 bp, Homo sapiens
atgctaagagtcctgggtaaa

SEQ ID NO: 6668449 - DNA, 21 bp, Homo sapiens
atgctaagcaagctaacctta

SEQ ID NO: 6668450 - DNA, 12 bp, Homo sapiens
atgctaagccag

SEQ ID NO: 6668451 - DNA, 23 bp, Homo sapiens
atgctaagtccatcaccctttcc

SEQ ID NO: 6668452 - DNA, 17 bp, Homo sapiens
atgctaatattaaaagt

SEQ ID NO: 6668453 - DNA, 13 bp, Homo sapiens
atgctaatgtaat

SEQ ID NO: 6668454 - DNA, 15 bp, Homo sapiens
atgctaattaaataa

SEQ ID NO: 6668455 - DNA, 22 bp, Homo sapiens
atgctaattaaataatacaact

SEQ ID NO: 6668456 - DNA, 15 bp, Homo sapiens
atgctaattgaacat

SEQ ID NO: 6668457 - DNA, 17 bp, Homo sapiens
atgctaatttaaagaga

SEQ ID NO: 6668458 - DNA, 15 bp, Homo sapiens
atgctacagtatttt

SEQ ID NO: 6668459 - DNA, 13 bp, Homo sapiens
atgctaccaccag

SEQ ID NO: 6668460 - DNA, 15 bp, Homo sapiens
atgctaccaccagct

SEQ ID NO: 6668461 - DNA, 22 bp, Homo sapiens
atgctaccaccagctgtgtcca

SEQ ID NO: 6668462 - DNA, 16 bp, Homo sapiens
atgctacccacagcgt

SEQ ID NO: 6668463 - DNA, 14 bp, Homo sapiens
atgctaccggggac

SEQ ID NO: 6668464 - DNA, 23 bp, Homo sapiens
atgctaccttgtgacccagcact

SEQ ID NO: 6668465 - DNA, 23 bp, Homo sapiens
atgctactaaatttttataataa

SEQ ID NO: 6668466 - DNA, 23 bp, Homo sapiens
atgctactgtgttacatgttgta

SEQ ID NO: 6668467 - DNA, 13 bp, Homo sapiens
atgctacttccca

SEQ ID NO: 6668468 - DNA, 18 bp, Homo sapiens
atgctacttttacttgtt

SEQ ID NO: 6668469 - DNA, 22 bp, Homo sapiens
atgctagaaaatcgagttggca

SEQ ID NO: 6668470 - DNA, 14 bp, Homo sapiens
atgctagagaatca

SEQ ID NO: 6668471 - DNA, 15 bp, Homo sapiens
atgctagagcctctg

SEQ ID NO: 6668472 - DNA, 19 bp, Homo sapiens
atgctagagcctctgcctg

SEQ ID NO: 6668473 - DNA, 22 bp, Homo sapiens
atgctagaggcttttattagaa

SEQ ID NO: 6668474 - DNA, 15 bp, Homo sapiens
atgctagcaggctgt

SEQ ID NO: 6668475 - DNA, 23 bp, Homo sapiens
atgctagccccagagatgccagc

SEQ ID NO: 6668476 - DNA, 23 bp, Homo sapiens
atgctagcctcacgaaactggaa

SEQ ID NO: 6668477 - DNA, 17 bp, Homo sapiens
atgctagcgcgttgcct

SEQ ID NO: 6668478 - DNA, 21 bp, Homo sapiens
atgctaggatgcggaaatccc

SEQ ID NO: 6668479 - DNA, 16 bp, Homo sapiens
atgctaggcctgtagt

SEQ ID NO: 6668480 - DNA, 15 bp, Homo sapiens
atgctaggctgtctg

SEQ ID NO: 6668481 - DNA, 18 bp, Homo sapiens
atgctaggttaattccaa

SEQ ID NO: 6668482 - DNA, 18 bp, Homo sapiens
atgctagtgttgtatttc

SEQ ID NO: 6668483 - DNA, 15 bp, Homo sapiens
atgctagttcttacg

SEQ ID NO: 6668484 - DNA, 12 bp, Homo sapiens
atgctagtttat

SEQ ID NO: 6668485 - DNA, 19 bp, Homo sapiens
atgctataaattttttgaa

SEQ ID NO: 6668486 - DNA, 15 bp, Homo sapiens
atgctatcaaataac

SEQ ID NO: 6668487 - DNA, 16 bp, Homo sapiens
atgctatcagaaacag

SEQ ID NO: 6668488 - DNA, 22 bp, Homo sapiens
atgctatcagaaattcgcccca

SEQ ID NO: 6668489 - DNA, 16 bp, Homo sapiens
atgctatcctcttatt

SEQ ID NO: 6668490 - DNA, 19 bp, Homo sapiens
atgctatctcgctagccat

SEQ ID NO: 6668491 - DNA, 14 bp, Homo sapiens
atgctatgaaattg

SEQ ID NO: 6668492 - DNA, 14 bp, Homo sapiens
atgctatggaaata

SEQ ID NO: 6668493 - DNA, 17 bp, Homo sapiens
atgctatggactgcaca

SEQ ID NO: 6668494 - DNA, 18 bp, Homo sapiens
atgctatggactgcacaa

SEQ ID NO: 6668495 - DNA, 14 bp, Homo sapiens
atgctatggcattt

SEQ ID NO: 6668496 - DNA, 17 bp, Homo sapiens
atgctatggtcaggtta

SEQ ID NO: 6668497 - DNA, 17 bp, Homo sapiens
atgctatgtcatttcat

SEQ ID NO: 6668498 - DNA, 15 bp, Homo sapiens
atgctatgttctgtc

SEQ ID NO: 6668499 - DNA, 14 bp, Homo sapiens
atgctattaagaag

SEQ ID NO: 6668500 - DNA, 17 bp, Homo sapiens
atgctattaagaaggca

SEQ ID NO: 6668501 - DNA, 17 bp, Homo sapiens
atgctattgaaattact

SEQ ID NO: 6668502 - DNA, 15 bp, Homo sapiens
atgctattgacaata

SEQ ID NO: 6668503 - DNA, 14 bp, Homo sapiens
atgctatttatgca

SEQ ID NO: 6668504 - DNA, 22 bp, Homo sapiens
atgctatttatgcaagttaggg

SEQ ID NO: 6668505 - DNA, 19 bp, Homo sapiens
atgctatttcagccaatct

SEQ ID NO: 6668506 - DNA, 20 bp, Homo sapiens
atgctatttctatattttca

SEQ ID NO: 6668507 - DNA, 12 bp, Homo sapiens
atgctatttctg

SEQ ID NO: 6668508 - DNA, 17 bp, Homo sapiens
atgctatttctggcctc

SEQ ID NO: 6668509 - DNA, 22 bp, Homo sapiens
atgctatttctggcctcagcag

SEQ ID NO: 6668510 - DNA, 13 bp, Homo sapiens
atgctatttgaac

SEQ ID NO: 6668511 - DNA, 15 bp, Homo sapiens
atgctatttgaacaa

SEQ ID NO: 6668512 - DNA, 14 bp, Homo sapiens
atgctatttgcaat

SEQ ID NO: 6668513 - DNA, 15 bp, Homo sapiens
atgctattttaaaaa

SEQ ID NO: 6668514 - DNA, 22 bp, Homo sapiens
atgctattttaaaaaatatata

SEQ ID NO: 6668515 - DNA, 18 bp, Homo sapiens
atgctatttttgttttta

SEQ ID NO: 6668516 - DNA, 17 bp, Homo sapiens
atgctcaaccactgtgg

SEQ ID NO: 6668517 - DNA, 19 bp, Homo sapiens
atgctcaacccccctccca

SEQ ID NO: 6668518 - DNA, 17 bp, Homo sapiens
atgctcaagaatgtagt

SEQ ID NO: 6668519 - DNA, 18 bp, Homo sapiens
atgctcaagaatgtagtc

SEQ ID NO: 6668520 - DNA, 20 bp, Homo sapiens
atgctcaagtttttcagaaa

SEQ ID NO: 6668521 - DNA, 20 bp, Homo sapiens
atgctcaatcatgtgccaga

SEQ ID NO: 6668522 - DNA, 15 bp, Homo sapiens
atgctcaatgtgctg

SEQ ID NO: 6668523 - DNA, 16 bp, Homo sapiens
atgctcaatgtgctgt

SEQ ID NO: 6668524 - DNA, 20 bp, Homo sapiens
atgctcaatgtgctgttgat

SEQ ID NO: 6668525 - DNA, 15 bp, Homo sapiens
atgctcaatttcagc

SEQ ID NO: 6668526 - DNA, 13 bp, Homo sapiens
atgctcacctcta

SEQ ID NO: 6668527 - DNA, 15 bp, Homo sapiens
atgctcacctgacat

SEQ ID NO: 6668528 - DNA, 17 bp, Homo sapiens
atgctcactttattatc

SEQ ID NO: 6668529 - DNA, 14 bp, Homo sapiens
atgctcagaccagc

SEQ ID NO: 6668530 - DNA, 14 bp, Homo sapiens
atgctcagagcttt

SEQ ID NO: 6668531 - DNA, 11 bp, Homo sapiens
atgctcagcct

SEQ ID NO: 6668532 - DNA, 20 bp, Homo sapiens
atgctcagccttgctgctct

SEQ ID NO: 6668533 - DNA, 16 bp, Homo sapiens
atgctcagctcagcat

SEQ ID NO: 6668534 - DNA, 17 bp, Homo sapiens
atgctcagggtcactga

SEQ ID NO: 6668535 - DNA, 21 bp, Homo sapiens
atgctcaggtacagagaagga

SEQ ID NO: 6668536 - DNA, 17 bp, Homo sapiens
atgctcagtgccttttg

SEQ ID NO: 6668537 - DNA, 21 bp, Homo sapiens
atgctcagtttaaggtacact

SEQ ID NO: 6668538 - DNA, 19 bp, Homo sapiens
atgctcataaagatgttaa

SEQ ID NO: 6668539 - DNA, 20 bp, Homo sapiens
atgctcataaagatgttaaa

SEQ ID NO: 6668540 - DNA, 21 bp, Homo sapiens
atgctcatacttggacagtta

SEQ ID NO: 6668541 - DNA, 17 bp, Homo sapiens
atgctcatctgagccag

SEQ ID NO: 6668542 - DNA, 13 bp, Homo sapiens
atgctcatctgct

SEQ ID NO: 6668543 - DNA, 16 bp, Homo sapiens
atgctcatctgctggt

SEQ ID NO: 6668544 - DNA, 23 bp, Homo sapiens
atgctcatgtccctgtccccagg

SEQ ID NO: 6668545 - DNA, 16 bp, Homo sapiens
atgctcattccatgac

SEQ ID NO: 6668546 - DNA, 15 bp, Homo sapiens
atgctccaaatataa

SEQ ID NO: 6668547 - DNA, 15 bp, Homo sapiens
atgctccaaatgctg

SEQ ID NO: 6668548 - DNA, 17 bp, Homo sapiens
atgctccagccaacccc

SEQ ID NO: 6668549 - DNA, 13 bp, Homo sapiens
atgctccagctgt

SEQ ID NO: 6668550 - DNA, 14 bp, Homo sapiens
atgctccaggcgcg

SEQ ID NO: 6668551 - DNA, 17 bp, Homo sapiens
atgctccagggtcaggc

SEQ ID NO: 6668552 - DNA, 23 bp, Homo sapiens
atgctcccaaatgcagcttcagg

SEQ ID NO: 6668553 - DNA, 17 bp, Homo sapiens
atgctcccaactccctt

SEQ ID NO: 6668554 - DNA, 19 bp, Homo sapiens
atgctcccaactcccttct

SEQ ID NO: 6668555 - DNA, 22 bp, Homo sapiens
atgctcccacctgaatttgtat

SEQ ID NO: 6668556 - DNA, 19 bp, Homo sapiens
atgctcccagctgtgctgt

SEQ ID NO: 6668557 - DNA, 21 bp, Homo sapiens
atgctcccatctcctgatttc

SEQ ID NO: 6668558 - DNA, 21 bp, Homo sapiens
atgctccccacagcgtccctg

SEQ ID NO: 6668559 - DNA, 23 bp, Homo sapiens
atgctcccccatcctccccttcc

SEQ ID NO: 6668560 - DNA, 21 bp, Homo sapiens
atgctccctcagcctcagagg

SEQ ID NO: 6668561 - DNA, 18 bp, Homo sapiens
atgctccctcccctgccc

SEQ ID NO: 6668562 - DNA, 22 bp, Homo sapiens
atgctccctcccctgccctggt

SEQ ID NO: 6668563 - DNA, 17 bp, Homo sapiens
atgctccctcctctcct

SEQ ID NO: 6668564 - DNA, 21 bp, Homo sapiens
atgctccctcctctcctaccc

SEQ ID NO: 6668565 - DNA, 23 bp, Homo sapiens
atgctcccttttacattctgtgt

SEQ ID NO: 6668566 - DNA, 13 bp, Homo sapiens
atgctcctagaag

SEQ ID NO: 6668567 - DNA, 18 bp, Homo sapiens
atgctcctagaagtctta

SEQ ID NO: 6668568 - DNA, 13 bp, Homo sapiens
atgctcctagttt

SEQ ID NO: 6668569 - DNA, 14 bp, Homo sapiens
atgctcctctcttt

SEQ ID NO: 6668570 - DNA, 12 bp, Homo sapiens
atgctcctctgc

SEQ ID NO: 6668571 - DNA, 14 bp, Homo sapiens
atgctcctctgcct

SEQ ID NO: 6668572 - DNA, 18 bp, Homo sapiens
atgctcctctgcctgtgc

SEQ ID NO: 6668573 - DNA, 20 bp, Homo sapiens
atgctcctctgcctgtgccc

SEQ ID NO: 6668574 - DNA, 23 bp, Homo sapiens
atgctcctctgcctgtgcccgct

SEQ ID NO: 6668575 - DNA, 19 bp, Homo sapiens
atgctcctggcccactgca

SEQ ID NO: 6668576 - DNA, 23 bp, Homo sapiens
atgctccttgagaggagaaatgc

SEQ ID NO: 6668577 - DNA, 23 bp, Homo sapiens
atgctcgccatcaaggtccagtg

SEQ ID NO: 6668578 - DNA, 14 bp, Homo sapiens
atgctcgtgtgatt

SEQ ID NO: 6668579 - DNA, 15 bp, Homo sapiens
atgctcgtgtgattt

SEQ ID NO: 6668580 - DNA, 16 bp, Homo sapiens
atgctctagtgccttc

SEQ ID NO: 6668581 - DNA, 18 bp, Homo sapiens
atgctctcaatatataat

SEQ ID NO: 6668582 - DNA, 22 bp, Homo sapiens
atgctctcactgtttgttttta

SEQ ID NO: 6668583 - DNA, 20 bp, Homo sapiens
atgctctcatatatatttta

SEQ ID NO: 6668584 - DNA, 19 bp, Homo sapiens
atgctctccaaaccacttt

SEQ ID NO: 6668585 - DNA, 17 bp, Homo sapiens
atgctctctcacctgct

SEQ ID NO: 6668586 - DNA, 19 bp, Homo sapiens
atgctctctcacctgctcc

SEQ ID NO: 6668587 - DNA, 23 bp, Homo sapiens
atgctctctcacctgctcccagt

SEQ ID NO: 6668588 - DNA, 12 bp, Homo sapiens
atgctctctctt

SEQ ID NO: 6668589 - DNA, 19 bp, Homo sapiens
atgctctctcttcttatta

SEQ ID NO: 6668590 - DNA, 21 bp, Homo sapiens
atgctctctgaggcaaggccc

SEQ ID NO: 6668591 - DNA, 23 bp, Homo sapiens
atgctctctgaggcaaggcccag

SEQ ID NO: 6668592 - DNA, 13 bp, Homo sapiens
atgctctctgcag

SEQ ID NO: 6668593 - DNA, 12 bp, Homo sapiens
atgctctgagaa

SEQ ID NO: 6668594 - DNA, 14 bp, Homo sapiens
atgctctgagaaat

SEQ ID NO: 6668595 - DNA, 23 bp, Homo sapiens
atgctctgagtagctttacactg

SEQ ID NO: 6668596 - DNA, 14 bp, Homo sapiens
atgctctgatgcag

SEQ ID NO: 6668597 - DNA, 16 bp, Homo sapiens
atgctctgatgcagtg

SEQ ID NO: 6668598 - DNA, 19 bp, Homo sapiens
atgctctgcatgttacata

SEQ ID NO: 6668599 - DNA, 12 bp, Homo sapiens
atgctctgcccc

SEQ ID NO: 6668600 - DNA, 22 bp, Homo sapiens
atgctctggaaaacctgaggcc

SEQ ID NO: 6668601 - DNA, 12 bp, Homo sapiens
atgctctggctt

SEQ ID NO: 6668602 - DNA, 16 bp, Homo sapiens
atgctctgtccagctt

SEQ ID NO: 6668603 - DNA, 23 bp, Homo sapiens
atgctctgtgcgagggttactat

SEQ ID NO: 6668604 - DNA, 21 bp, Homo sapiens
atgctctgtggctggctcacc

SEQ ID NO: 6668605 - DNA, 23 bp, Homo sapiens
atgctcttaattgccacctctaa

SEQ ID NO: 6668606 - DNA, 16 bp, Homo sapiens
atgctcttagaaaatt

SEQ ID NO: 6668607 - DNA, 14 bp, Homo sapiens
atgctcttctgtgg

SEQ ID NO: 6668608 - DNA, 21 bp, Homo sapiens
atgctcttggggttcataggg

SEQ ID NO: 6668609 - DNA, 19 bp, Homo sapiens
atgctctttaaataataaa

SEQ ID NO: 6668610 - DNA, 16 bp, Homo sapiens
atgctctttacttcat

SEQ ID NO: 6668611 - DNA, 11 bp, Homo sapiens
atgctctttca

SEQ ID NO: 6668612 - DNA, 21 bp, Homo sapiens
atgctctttcccacccagcct

SEQ ID NO: 6668613 - DNA, 23 bp, Homo sapiens
atgctctttcccacccagcctgg

SEQ ID NO: 6668614 - DNA, 17 bp, Homo sapiens
atgctctttcccaggac

SEQ ID NO: 6668615 - DNA, 21 bp, Homo sapiens
atgctcttttttactcattga

SEQ ID NO: 6668616 - DNA, 23 bp, Homo sapiens
atgctcttttttactcattgaaa

SEQ ID NO: 6668617 - DNA, 18 bp, Homo sapiens
atgctgaaaacacagaga

SEQ ID NO: 6668618 - DNA, 15 bp, Homo sapiens
atgctgaaacaggag

SEQ ID NO: 6668619 - DNA, 15 bp, Homo sapiens
atgctgaaataaact

SEQ ID NO: 6668620 - DNA, 17 bp, Homo sapiens
atgctgaacattgcata

SEQ ID NO: 6668621 - DNA, 14 bp, Homo sapiens
atgctgaactcctt

SEQ ID NO: 6668622 - DNA, 22 bp, Homo sapiens
atgctgaagacattcaaaacgt

SEQ ID NO: 6668623 - DNA, 23 bp, Homo sapiens
atgctgaatatacagcaggtgct

SEQ ID NO: 6668624 - DNA, 18 bp, Homo sapiens
atgctgaatccacctcgg

SEQ ID NO: 6668625 - DNA, 15 bp, Homo sapiens
atgctgaatgaatcc

SEQ ID NO: 6668626 - DNA, 11 bp, Homo sapiens
atgctgaatta

SEQ ID NO: 6668627 - DNA, 13 bp, Homo sapiens
atgctgaattatt

SEQ ID NO: 6668628 - DNA, 18 bp, Homo sapiens
atgctgaattattttgtt

SEQ ID NO: 6668629 - DNA, 18 bp, Homo sapiens
atgctgacaatgctgcca

SEQ ID NO: 6668630 - DNA, 19 bp, Homo sapiens
atgctgacaatgctgccat

SEQ ID NO: 6668631 - DNA, 11 bp, Homo sapiens
atgctgacacc

SEQ ID NO: 6668632 - DNA, 14 bp, Homo sapiens
atgctgacaccagc

SEQ ID NO: 6668633 - DNA, 19 bp, Homo sapiens
atgctgacattcacctgcc

SEQ ID NO: 6668634 - DNA, 20 bp, Homo sapiens
atgctgacattcacctgccc

SEQ ID NO: 6668635 - DNA, 22 bp, Homo sapiens
atgctgacattcacctgcccca

SEQ ID NO: 6668636 - DNA, 13 bp, Homo sapiens
atgctgacccagg

SEQ ID NO: 6668637 - DNA, 13 bp, Homo sapiens
atgctgacccatg

SEQ ID NO: 6668638 - DNA, 19 bp, Homo sapiens
atgctgacccatgggcagg

SEQ ID NO: 6668639 - DNA, 15 bp, Homo sapiens
atgctgacctcacct

SEQ ID NO: 6668640 - DNA, 19 bp, Homo sapiens
atgctgacctcacctggtc

SEQ ID NO: 6668641 - DNA, 22 bp, Homo sapiens
atgctgactgatggttaaataa

SEQ ID NO: 6668642 - DNA, 19 bp, Homo sapiens
atgctgactgtactcctcc

SEQ ID NO: 6668643 - DNA, 18 bp, Homo sapiens
atgctgacttgcagagtt

SEQ ID NO: 6668644 - DNA, 11 bp, Homo sapiens
atgctgagaca

SEQ ID NO: 6668645 - DNA, 19 bp, Homo sapiens
atgctgagacatccctcat

SEQ ID NO: 6668646 - DNA, 19 bp, Homo sapiens
atgctgagctgaagaaatt

SEQ ID NO: 6668647 - DNA, 20 bp, Homo sapiens
atgctgagctgaagaaatta

SEQ ID NO: 6668648 - DNA, 23 bp, Homo sapiens
atgctgaggatataagcttttag

SEQ ID NO: 6668649 - DNA, 15 bp, Homo sapiens
atgctgaggccaccc

SEQ ID NO: 6668650 - DNA, 14 bp, Homo sapiens
atgctgaggcctcg

SEQ ID NO: 6668651 - DNA, 14 bp, Homo sapiens
atgctgaggcctgg

SEQ ID NO: 6668652 - DNA, 15 bp, Homo sapiens
atgctgaggcctggg

SEQ ID NO: 6668653 - DNA, 17 bp, Homo sapiens
atgctgaggcctgggcc

SEQ ID NO: 6668654 - DNA, 18 bp, Homo sapiens
atgctgaggcctgggccg

SEQ ID NO: 6668655 - DNA, 13 bp, Homo sapiens
atgctgagggtgt

SEQ ID NO: 6668656 - DNA, 23 bp, Homo sapiens
atgctgagggtgtttcttcctgc

SEQ ID NO: 6668657 - DNA, 15 bp, Homo sapiens
atgctgaggttttga

SEQ ID NO: 6668658 - DNA, 17 bp, Homo sapiens
atgctgaggttttgaat

SEQ ID NO: 6668659 - DNA, 18 bp, Homo sapiens
atgctgagtctcccaagg

SEQ ID NO: 6668660 - DNA, 20 bp, Homo sapiens
atgctgagtttgtgctggtg

SEQ ID NO: 6668661 - DNA, 14 bp, Homo sapiens
atgctgatcatcgc

SEQ ID NO: 6668662 - DNA, 19 bp, Homo sapiens
atgctgatcatcgccagag

SEQ ID NO: 6668663 - DNA, 21 bp, Homo sapiens
atgctgatcttttaaaatcat

SEQ ID NO: 6668664 - DNA, 18 bp, Homo sapiens
atgctgatgaatcactgt

SEQ ID NO: 6668665 - DNA, 19 bp, Homo sapiens
atgctgatgaatcactgtt

SEQ ID NO: 6668666 - DNA, 16 bp, Homo sapiens
atgctgcaaaggagaa

SEQ ID NO: 6668667 - DNA, 16 bp, Homo sapiens
atgctgcaacaaaatg

SEQ ID NO: 6668668 - DNA, 23 bp, Homo sapiens
atgctgcaagttatgaaatattt

SEQ ID NO: 6668669 - DNA, 22 bp, Homo sapiens
atgctgcacaccagttactgtt

SEQ ID NO: 6668670 - DNA, 23 bp, Homo sapiens
atgctgcatatgttacaattctc

SEQ ID NO: 6668671 - DNA, 18 bp, Homo sapiens
atgctgcatttggctgga

SEQ ID NO: 6668672 - DNA, 21 bp, Homo sapiens
atgctgcatttggctggagcc

SEQ ID NO: 6668673 - DNA, 22 bp, Homo sapiens
atgctgcatttggctggagccc

SEQ ID NO: 6668674 - DNA, 17 bp, Homo sapiens
atgctgccaatatccta

SEQ ID NO: 6668675 - DNA, 20 bp, Homo sapiens
atgctgccaatatcctaata

SEQ ID NO: 6668676 - DNA, 12 bp, Homo sapiens
atgctgccagtg

SEQ ID NO: 6668677 - DNA, 13 bp, Homo sapiens
atgctgccatgcc

SEQ ID NO: 6668678 - DNA, 17 bp, Homo sapiens
atgctgccatgcccacc

SEQ ID NO: 6668679 - DNA, 20 bp, Homo sapiens
atgctgcccaccccctgctg

SEQ ID NO: 6668680 - DNA, 22 bp, Homo sapiens
atgctgcccaccccctgctggt

SEQ ID NO: 6668681 - DNA, 22 bp, Homo sapiens
atgctgcccagggtcagtgtat

SEQ ID NO: 6668682 - DNA, 22 bp, Homo sapiens
atgctgccccgttccctgtcag

SEQ ID NO: 6668683 - DNA, 24 bp, Homo sapiens
atgctgccccgttccctgtcagag

SEQ ID NO: 6668684 - DNA, 14 bp, Homo sapiens
atgctgccctgtga

SEQ ID NO: 6668685 - DNA, 12 bp, Homo sapiens
atgctgccggca

SEQ ID NO: 6668686 - DNA, 17 bp, Homo sapiens
atgctgccggcacagct

SEQ ID NO: 6668687 - DNA, 19 bp, Homo sapiens
atgctgccggcacagctgg

SEQ ID NO: 6668688 - DNA, 17 bp, Homo sapiens
atgctgcctaggctgac

SEQ ID NO: 6668689 - DNA, 19 bp, Homo sapiens
atgctgcctaggctgacct

SEQ ID NO: 6668690 - DNA, 16 bp, Homo sapiens
atgctgcctcaggacc

SEQ ID NO: 6668691 - DNA, 20 bp, Homo sapiens
atgctgcctcattttcacag

SEQ ID NO: 6668692 - DNA, 12 bp, Homo sapiens
atgctgcctgcc

SEQ ID NO: 6668693 - DNA, 14 bp, Homo sapiens
atgctgcctgcctg

SEQ ID NO: 6668694 - DNA, 22 bp, Homo sapiens
atgctgcctgtatttgagagac

SEQ ID NO: 6668695 - DNA, 16 bp, Homo sapiens
atgctgccttaaaaga

SEQ ID NO: 6668696 - DNA, 23 bp, Homo sapiens
atgctgccttattcagggaagga

SEQ ID NO: 6668697 - DNA, 23 bp, Homo sapiens
atgctgcctttattatatttgaa

SEQ ID NO: 6668698 - DNA, 23 bp, Homo sapiens
atgctgctcatccccacctgtct

SEQ ID NO: 6668699 - DNA, 20 bp, Homo sapiens
atgctgctcccctaaagcca

SEQ ID NO: 6668700 - DNA, 22 bp, Homo sapiens
atgctgctcccctaaagccagg

SEQ ID NO: 6668701 - DNA, 11 bp, Homo sapiens
atgctgctctc

SEQ ID NO: 6668702 - DNA, 22 bp, Homo sapiens
atgctgctgagcacatctcttc

SEQ ID NO: 6668703 - DNA, 22 bp, Homo sapiens
atgctgctgcccctgcacagca

SEQ ID NO: 6668704 - DNA, 19 bp, Homo sapiens
atgctgctggaggaatcag

SEQ ID NO: 6668705 - DNA, 14 bp, Homo sapiens
atgctgctggcctc

SEQ ID NO: 6668706 - DNA, 15 bp, Homo sapiens
atgctgctggcctcc

SEQ ID NO: 6668707 - DNA, 16 bp, Homo sapiens
atgctgctggcctccc

SEQ ID NO: 6668708 - DNA, 13 bp, Homo sapiens
atgctgctgggga

SEQ ID NO: 6668709 - DNA, 15 bp, Homo sapiens
atgctgcttctcctc

SEQ ID NO: 6668710 - DNA, 20 bp, Homo sapiens
atgctgctttaattgtgaat

SEQ ID NO: 6668711 - DNA, 16 bp, Homo sapiens
atgctgctttggttaa

SEQ ID NO: 6668712 - DNA, 16 bp, Homo sapiens
atgctgcttttaaaac

SEQ ID NO: 6668713 - DNA, 19 bp, Homo sapiens
atgctgcttttatatctgt

SEQ ID NO: 6668714 - DNA, 20 bp, Homo sapiens
atgctgcttttatatctgta

SEQ ID NO: 6668715 - DNA, 21 bp, Homo sapiens
atgctgcttttcttttctaac

SEQ ID NO: 6668716 - DNA, 19 bp, Homo sapiens
atgctgctttttggcacag

SEQ ID NO: 6668717 - DNA, 12 bp, Homo sapiens
atgctggaaata

SEQ ID NO: 6668718 - DNA, 14 bp, Homo sapiens
atgctggaaataaa

SEQ ID NO: 6668719 - DNA, 18 bp, Homo sapiens
atgctggacaggtctggg

SEQ ID NO: 6668720 - DNA, 21 bp, Homo sapiens
atgctggacaggtctgggaga

SEQ ID NO: 6668721 - DNA, 12 bp, Homo sapiens
atgctggagaag

SEQ ID NO: 6668722 - DNA, 14 bp, Homo sapiens
atgctggagaagag

SEQ ID NO: 6668723 - DNA, 14 bp, Homo sapiens
atgctggagcctgt

SEQ ID NO: 6668724 - DNA, 18 bp, Homo sapiens
atgctggagcctgtgtaa

SEQ ID NO: 6668725 - DNA, 23 bp, Homo sapiens
atgctggagcctgtgtaacagct

SEQ ID NO: 6668726 - DNA, 11 bp, Homo sapiens
atgctggagcg

SEQ ID NO: 6668727 - DNA, 15 bp, Homo sapiens
atgctggaggccctc

SEQ ID NO: 6668728 - DNA, 13 bp, Homo sapiens
atgctggagggag

SEQ ID NO: 6668729 - DNA, 21 bp, Homo sapiens
atgctggagtacccagcctat

SEQ ID NO: 6668730 - DNA, 23 bp, Homo sapiens
atgctggagtacccagcctatca

SEQ ID NO: 6668731 - DNA, 16 bp, Homo sapiens
atgctggccagcaccc

SEQ ID NO: 6668732 - DNA, 22 bp, Homo sapiens
atgctggccagcaccctctcct

SEQ ID NO: 6668733 - DNA, 23 bp, Homo sapiens
atgctggccagcctggggcctgg

SEQ ID NO: 6668734 - DNA, 18 bp, Homo sapiens
atgctggcccagggccca

SEQ ID NO: 6668735 - DNA, 19 bp, Homo sapiens
atgctggcccagggcccag

SEQ ID NO: 6668736 - DNA, 22 bp, Homo sapiens
atgctggccccaaaagccttac

SEQ ID NO: 6668737 - DNA, 15 bp, Homo sapiens
atgctggcctgactg

SEQ ID NO: 6668738 - DNA, 22 bp, Homo sapiens
atgctggcctgactggttgtca

SEQ ID NO: 6668739 - DNA, 16 bp, Homo sapiens
atgctggcctgtggca

SEQ ID NO: 6668740 - DNA, 16 bp, Homo sapiens
atgctggcctgtgtga

SEQ ID NO: 6668741 - DNA, 22 bp, Homo sapiens
atgctggctcctgaagggtgct

SEQ ID NO: 6668742 - DNA, 16 bp, Homo sapiens
atgctggctgagctga

SEQ ID NO: 6668743 - DNA, 20 bp, Homo sapiens
atgctggctgagctgaacac

SEQ ID NO: 6668744 - DNA, 16 bp, Homo sapiens
atgctggctggccttg

SEQ ID NO: 6668745 - DNA, 12 bp, Homo sapiens
atgctggctggg

SEQ ID NO: 6668746 - DNA, 14 bp, Homo sapiens
atgctggctggggc

SEQ ID NO: 6668747 - DNA, 20 bp, Homo sapiens
atgctggctgttggctgggg

SEQ ID NO: 6668748 - DNA, 22 bp, Homo sapiens
atgctggctgttggctgggggc

SEQ ID NO: 6668749 - DNA, 9 bp, Homo sapiens
atgctggga

SEQ ID NO: 6668750 - DNA, 23 bp, Homo sapiens
atgctgggaagacgcctgagctc

SEQ ID NO: 6668751 - DNA, 14 bp, Homo sapiens
atgctgggaccctc

SEQ ID NO: 6668752 - DNA, 16 bp, Homo sapiens
atgctgggacccttag

SEQ ID NO: 6668753 - DNA, 15 bp, Homo sapiens
atgctgggagggctg

SEQ ID NO: 6668754 - DNA, 19 bp, Homo sapiens
atgctgggccactggggac

SEQ ID NO: 6668755 - DNA, 21 bp, Homo sapiens
atgctgggcccccagcctggc

SEQ ID NO: 6668756 - DNA, 16 bp, Homo sapiens
atgctgggctgggtgc

SEQ ID NO: 6668757 - DNA, 20 bp, Homo sapiens
atgctgggtctgaggcccct

SEQ ID NO: 6668758 - DNA, 19 bp, Homo sapiens
atgctgggtgttgcatttc

SEQ ID NO: 6668759 - DNA, 19 bp, Homo sapiens
atgctgggttctggggctg

SEQ ID NO: 6668760 - DNA, 19 bp, Homo sapiens
atgctgggttggtgcacag

SEQ ID NO: 6668761 - DNA, 19 bp, Homo sapiens
atgctgggtttatagatgt

SEQ ID NO: 6668762 - DNA, 18 bp, Homo sapiens
atgctggtagctagtgat

SEQ ID NO: 6668763 - DNA, 21 bp, Homo sapiens
atgctggtagctagtgattta

SEQ ID NO: 6668764 - DNA, 17 bp, Homo sapiens
atgctggtgagtgccac

SEQ ID NO: 6668765 - DNA, 22 bp, Homo sapiens
atgctggtggaggaagggctgg

SEQ ID NO: 6668766 - DNA, 17 bp, Homo sapiens
atgctggtggctggtga

SEQ ID NO: 6668767 - DNA, 21 bp, Homo sapiens
atgctggtggttaaggccagg

SEQ ID NO: 6668768 - DNA, 16 bp, Homo sapiens
atgctggttacctgtt

SEQ ID NO: 6668769 - DNA, 20 bp, Homo sapiens
atgctggttacctgttccat

SEQ ID NO: 6668770 - DNA, 21 bp, Homo sapiens
atgctggttttcctaaatgca

SEQ ID NO: 6668771 - DNA, 13 bp, Homo sapiens
atgctggtttttc

SEQ ID NO: 6668772 - DNA, 16 bp, Homo sapiens
atgctgtaaaagcaag

SEQ ID NO: 6668773 - DNA, 12 bp, Homo sapiens
atgctgtaaata

SEQ ID NO: 6668774 - DNA, 15 bp, Homo sapiens
atgctgtaaatattt

SEQ ID NO: 6668775 - DNA, 18 bp, Homo sapiens
atgctgtaaatatttcat

SEQ ID NO: 6668776 - DNA, 22 bp, Homo sapiens
atgctgtacatctattttggat

SEQ ID NO: 6668777 - DNA, 18 bp, Homo sapiens
atgctgtacgtactgcat

SEQ ID NO: 6668778 - DNA, 17 bp, Homo sapiens
atgctgtactaaaatat

SEQ ID NO: 6668779 - DNA, 13 bp, Homo sapiens
atgctgtagtaac

SEQ ID NO: 6668780 - DNA, 14 bp, Homo sapiens
atgctgtagtaact

SEQ ID NO: 6668781 - DNA, 19 bp, Homo sapiens
atgctgtatatcctttcta

SEQ ID NO: 6668782 - DNA, 14 bp, Homo sapiens
atgctgtatgtcat

SEQ ID NO: 6668783 - DNA, 14 bp, Homo sapiens
atgctgtatttctt

SEQ ID NO: 6668784 - DNA, 22 bp, Homo sapiens
atgctgtatttctttgtagaat

SEQ ID NO: 6668785 - DNA, 18 bp, Homo sapiens
atgctgtatttttacagc

SEQ ID NO: 6668786 - DNA, 22 bp, Homo sapiens
atgctgtcaactatgatatggt

SEQ ID NO: 6668787 - DNA, 16 bp, Homo sapiens
atgctgtcactggcag

SEQ ID NO: 6668788 - DNA, 18 bp, Homo sapiens
atgctgtcaggagatgga

SEQ ID NO: 6668789 - DNA, 23 bp, Homo sapiens
atgctgtcatggtcctttctgga

SEQ ID NO: 6668790 - DNA, 12 bp, Homo sapiens
atgctgtccctg

SEQ ID NO: 6668791 - DNA, 14 bp, Homo sapiens
atgctgtccgtgct

SEQ ID NO: 6668792 - DNA, 21 bp, Homo sapiens
atgctgtctccataatgccac

SEQ ID NO: 6668793 - DNA, 17 bp, Homo sapiens
atgctgtctggcacagc

SEQ ID NO: 6668794 - DNA, 20 bp, Homo sapiens
atgctgtctttcttgctccc

SEQ ID NO: 6668795 - DNA, 21 bp, Homo sapiens
atgctgtctttcttgctccct

SEQ ID NO: 6668796 - DNA, 13 bp, Homo sapiens
atgctgtgaaatt

SEQ ID NO: 6668797 - DNA, 12 bp, Homo sapiens
atgctgtgaata

SEQ ID NO: 6668798 - DNA, 13 bp, Homo sapiens
atgctgtgcattt

SEQ ID NO: 6668799 - DNA, 18 bp, Homo sapiens
atgctgtgcccctggcct

SEQ ID NO: 6668800 - DNA, 22 bp, Homo sapiens
atgctgtgccctaaagtgtatt

SEQ ID NO: 6668801 - DNA, 11 bp, Homo sapiens
atgctgtgcta

SEQ ID NO: 6668802 - DNA, 12 bp, Homo sapiens
atgctgtgctac

SEQ ID NO: 6668803 - DNA, 18 bp, Homo sapiens
atgctgtgctacgtgtga

SEQ ID NO: 6668804 - DNA, 15 bp, Homo sapiens
atgctgtgctctttg

SEQ ID NO: 6668805 - DNA, 21 bp, Homo sapiens
atgctgtggttcactgcactg

SEQ ID NO: 6668806 - DNA, 14 bp, Homo sapiens
atgctgtgtaagct

SEQ ID NO: 6668807 - DNA, 23 bp, Homo sapiens
atgctgtgtatatggtatatata

SEQ ID NO: 6668808 - DNA, 21 bp, Homo sapiens
atgctgtgtgcagagtataca

SEQ ID NO: 6668809 - DNA, 23 bp, Homo sapiens
atgctgtgtgcagagtatacaag

SEQ ID NO: 6668810 - DNA, 19 bp, Homo sapiens
atgctgttaacagctgtca

SEQ ID NO: 6668811 - DNA, 21 bp, Homo sapiens
atgctgttagtaaatttctgt

SEQ ID NO: 6668812 - DNA, 17 bp, Homo sapiens
atgctgttcagaaatat

SEQ ID NO: 6668813 - DNA, 17 bp, Homo sapiens
atgctgttcatgaaaga

SEQ ID NO: 6668814 - DNA, 19 bp, Homo sapiens
atgctgttcatgaaagatt

SEQ ID NO: 6668815 - DNA, 23 bp, Homo sapiens
atgctgttcgttcaaaagtggag

SEQ ID NO: 6668816 - DNA, 15 bp, Homo sapiens
atgctgttctcaatc

SEQ ID NO: 6668817 - DNA, 14 bp, Homo sapiens
atgctgttctcttt

SEQ ID NO: 6668818 - DNA, 17 bp, Homo sapiens
atgctgttctctttgct

SEQ ID NO: 6668819 - DNA, 18 bp, Homo sapiens
atgctgttctctttgctg

SEQ ID NO: 6668820 - DNA, 20 bp, Homo sapiens
atgctgttctctttgctgac

SEQ ID NO: 6668821 - DNA, 22 bp, Homo sapiens
atgctgttctctttgctgacac

SEQ ID NO: 6668822 - DNA, 11 bp, Homo sapiens
atgctgttgat

SEQ ID NO: 6668823 - DNA, 19 bp, Homo sapiens
atgctgttgattgctaaat

SEQ ID NO: 6668824 - DNA, 16 bp, Homo sapiens
atgctgttgcctcatc

SEQ ID NO: 6668825 - DNA, 18 bp, Homo sapiens
atgctgttgcctcatcta

SEQ ID NO: 6668826 - DNA, 16 bp, Homo sapiens
atgctgtttatgaatt

SEQ ID NO: 6668827 - DNA, 14 bp, Homo sapiens
atgctgtttcctag

SEQ ID NO: 6668828 - DNA, 16 bp, Homo sapiens
atgctgtttcctagct

SEQ ID NO: 6668829 - DNA, 17 bp, Homo sapiens
atgctgtttcctagcta

SEQ ID NO: 6668830 - DNA, 14 bp, Homo sapiens
atgctgtttctaag

SEQ ID NO: 6668831 - DNA, 24 bp, Homo sapiens
atgctgtttctaagaaaatgtagt

SEQ ID NO: 6668832 - DNA, 16 bp, Homo sapiens
atgctgttttaataat

SEQ ID NO: 6668833 - DNA, 14 bp, Homo sapiens
atgcttaaaaatgt

SEQ ID NO: 6668834 - DNA, 15 bp, Homo sapiens
atgcttaaaaggttg

SEQ ID NO: 6668835 - DNA, 15 bp, Homo sapiens
atgcttaaaatatgt

SEQ ID NO: 6668836 - DNA, 20 bp, Homo sapiens
atgcttaaaatatgtatgtc

SEQ ID NO: 6668837 - DNA, 21 bp, Homo sapiens
atgcttaaaatatgtatgtct

SEQ ID NO: 6668838 - DNA, 23 bp, Homo sapiens
atgcttaaaatatgtatgtctaa

SEQ ID NO: 6668839 - DNA, 18 bp, Homo sapiens
atgcttaaagaattcaaa

SEQ ID NO: 6668840 - DNA, 18 bp, Homo sapiens
atgcttaaataaaaatta

SEQ ID NO: 6668841 - DNA, 14 bp, Homo sapiens
atgcttaaatttta

SEQ ID NO: 6668842 - DNA, 22 bp, Homo sapiens
atgcttaacataaacttgtact

SEQ ID NO: 6668843 - DNA, 20 bp, Homo sapiens
atgcttaacatacccgccta

SEQ ID NO: 6668844 - DNA, 16 bp, Homo sapiens
atgcttaataaaagaa

SEQ ID NO: 6668845 - DNA, 18 bp, Homo sapiens
atgcttaataaaagaaca

SEQ ID NO: 6668846 - DNA, 19 bp, Homo sapiens
atgcttaataaacatgtca

SEQ ID NO: 6668847 - DNA, 22 bp, Homo sapiens
atgcttaataataattgaagaa

SEQ ID NO: 6668848 - DNA, 14 bp, Homo sapiens
atgcttaatttcta

SEQ ID NO: 6668849 - DNA, 21 bp, Homo sapiens
atgcttacatctggaatctga

SEQ ID NO: 6668850 - DNA, 23 bp, Homo sapiens
atgcttacatctggaatctgagg

SEQ ID NO: 6668851 - DNA, 16 bp, Homo sapiens
atgcttactaaatctt

SEQ ID NO: 6668852 - DNA, 15 bp, Homo sapiens
atgcttactttttaa

SEQ ID NO: 6668853 - DNA, 18 bp, Homo sapiens
atgcttagaattctgaga

SEQ ID NO: 6668854 - DNA, 18 bp, Homo sapiens
atgcttagcttatctttc

SEQ ID NO: 6668855 - DNA, 14 bp, Homo sapiens
atgcttagtaatgc

SEQ ID NO: 6668856 - DNA, 15 bp, Homo sapiens
atgcttagtaatgct

SEQ ID NO: 6668857 - DNA, 15 bp, Homo sapiens
atgcttagtcactgc

SEQ ID NO: 6668858 - DNA, 20 bp, Homo sapiens
atgcttatattgttcacttc

SEQ ID NO: 6668859 - DNA, 20 bp, Homo sapiens
atgcttatgttaaactctgt

SEQ ID NO: 6668860 - DNA, 14 bp, Homo sapiens
atgcttattttaaa

SEQ ID NO: 6668861 - DNA, 20 bp, Homo sapiens
atgcttcaaactaacacatt

SEQ ID NO: 6668862 - DNA, 14 bp, Homo sapiens
atgcttcagttgta

SEQ ID NO: 6668863 - DNA, 10 bp, Homo sapiens
atgcttcata

SEQ ID NO: 6668864 - DNA, 18 bp, Homo sapiens
atgcttcatgaaaatcct

SEQ ID NO: 6668865 - DNA, 12 bp, Homo sapiens
atgcttcatgtg

SEQ ID NO: 6668866 - DNA, 17 bp, Homo sapiens
atgcttcattcaatatt

SEQ ID NO: 6668867 - DNA, 23 bp, Homo sapiens
atgcttccacaggcaaaactcag

SEQ ID NO: 6668868 - DNA, 16 bp, Homo sapiens
atgcttccagaatggg

SEQ ID NO: 6668869 - DNA, 17 bp, Homo sapiens
atgcttccattaacaaa

SEQ ID NO: 6668870 - DNA, 21 bp, Homo sapiens
atgcttcccagagggagcagg

SEQ ID NO: 6668871 - DNA, 14 bp, Homo sapiens
atgcttccctgcag

SEQ ID NO: 6668872 - DNA, 15 bp, Homo sapiens
atgcttccctgcagc

SEQ ID NO: 6668873 - DNA, 16 bp, Homo sapiens
atgcttccctgcagct

SEQ ID NO: 6668874 - DNA, 17 bp, Homo sapiens
atgcttccctgcagctg

SEQ ID NO: 6668875 - DNA, 17 bp, Homo sapiens
atgcttcctagaagtta

SEQ ID NO: 6668876 - DNA, 10 bp, Homo sapiens
atgcttcctc

SEQ ID NO: 6668877 - DNA, 19 bp, Homo sapiens
atgcttctaagtaaataca

SEQ ID NO: 6668878 - DNA, 22 bp, Homo sapiens
atgcttctaagtaaatacaatt

SEQ ID NO: 6668879 - DNA, 20 bp, Homo sapiens
atgcttctagaaagcccctc

SEQ ID NO: 6668880 - DNA, 16 bp, Homo sapiens
atgcttctagagtttt

SEQ ID NO: 6668881 - DNA, 12 bp, Homo sapiens
atgcttctattt

SEQ ID NO: 6668882 - DNA, 13 bp, Homo sapiens
atgcttctcactg

SEQ ID NO: 6668883 - DNA, 16 bp, Homo sapiens
atgcttctcactgcca

SEQ ID NO: 6668884 - DNA, 20 bp, Homo sapiens
atgcttctcactgccatgcc

SEQ ID NO: 6668885 - DNA, 19 bp, Homo sapiens
atgcttctcatcttgtgaa

SEQ ID NO: 6668886 - DNA, 11 bp, Homo sapiens
atgcttctctc

SEQ ID NO: 6668887 - DNA, 14 bp, Homo sapiens
atgcttctgagagc

SEQ ID NO: 6668888 - DNA, 17 bp, Homo sapiens
atgcttctgctcacatt

SEQ ID NO: 6668889 - DNA, 21 bp, Homo sapiens
atgcttctgctcacattccct

SEQ ID NO: 6668890 - DNA, 14 bp, Homo sapiens
atgcttctgggaga

SEQ ID NO: 6668891 - DNA, 14 bp, Homo sapiens
atgcttctgtagct

SEQ ID NO: 6668892 - DNA, 17 bp, Homo sapiens
atgcttctgtagcttct

SEQ ID NO: 6668893 - DNA, 18 bp, Homo sapiens
atgcttctgtagcttcta

SEQ ID NO: 6668894 - DNA, 21 bp, Homo sapiens
atgcttctgttttataatttt

SEQ ID NO: 6668895 - DNA, 17 bp, Homo sapiens
atgcttcttcagagact

SEQ ID NO: 6668896 - DNA, 13 bp, Homo sapiens
atgcttcttctca

SEQ ID NO: 6668897 - DNA, 21 bp, Homo sapiens
atgcttcttttagtcagaaat

SEQ ID NO: 6668898 - DNA, 15 bp, Homo sapiens
atgcttgacatacct

SEQ ID NO: 6668899 - DNA, 16 bp, Homo sapiens
atgcttgatataataa

SEQ ID NO: 6668900 - DNA, 22 bp, Homo sapiens
atgcttgatggaattttttcct

SEQ ID NO: 6668901 - DNA, 21 bp, Homo sapiens
atgcttgatgttacaaggtgt

SEQ ID NO: 6668902 - DNA, 18 bp, Homo sapiens
atgcttgatgtttggcct

SEQ ID NO: 6668903 - DNA, 16 bp, Homo sapiens
atgcttgcaaaaacta

SEQ ID NO: 6668904 - DNA, 13 bp, Homo sapiens
atgcttgcatgga

SEQ ID NO: 6668905 - DNA, 15 bp, Homo sapiens
atgcttgcatggaga

SEQ ID NO: 6668906 - DNA, 20 bp, Homo sapiens
atgcttgcatggagaatggg

SEQ ID NO: 6668907 - DNA, 17 bp, Homo sapiens
atgcttgccaagaaatc

SEQ ID NO: 6668908 - DNA, 15 bp, Homo sapiens
atgcttgccatctgt

SEQ ID NO: 6668909 - DNA, 21 bp, Homo sapiens
atgcttggaatatctgctgta

SEQ ID NO: 6668910 - DNA, 17 bp, Homo sapiens
atgcttggaatgggaga

SEQ ID NO: 6668911 - DNA, 18 bp, Homo sapiens
atgcttgggaagactcct

SEQ ID NO: 6668912 - DNA, 21 bp, Homo sapiens
atgcttgggaccagaagtgtt

SEQ ID NO: 6668913 - DNA, 23 bp, Homo sapiens
atgcttgggaccagaagtgtttc

SEQ ID NO: 6668914 - DNA, 14 bp, Homo sapiens
atgcttgggccctg

SEQ ID NO: 6668915 - DNA, 16 bp, Homo sapiens
atgcttgggccctgca

SEQ ID NO: 6668916 - DNA, 13 bp, Homo sapiens
atgcttgggctga

SEQ ID NO: 6668917 - DNA, 21 bp, Homo sapiens
atgcttgtaacaagaaaacat

SEQ ID NO: 6668918 - DNA, 14 bp, Homo sapiens
atgcttgtacataa

SEQ ID NO: 6668919 - DNA, 18 bp, Homo sapiens
atgcttgtgtatatgtat

SEQ ID NO: 6668920 - DNA, 17 bp, Homo sapiens
atgcttgtttatgatat

SEQ ID NO: 6668921 - DNA, 16 bp, Homo sapiens
atgctttaagacagaa

SEQ ID NO: 6668922 - DNA, 16 bp, Homo sapiens
atgctttatgtttaaa

SEQ ID NO: 6668923 - DNA, 23 bp, Homo sapiens
atgctttatgtttaaaaacattc

SEQ ID NO: 6668924 - DNA, 15 bp, Homo sapiens
atgctttatttgtaa

SEQ ID NO: 6668925 - DNA, 18 bp, Homo sapiens
atgctttatttgtaaatt

SEQ ID NO: 6668926 - DNA, 21 bp, Homo sapiens
atgctttatttgtaaatttag

SEQ ID NO: 6668927 - DNA, 21 bp, Homo sapiens
atgctttcagattaaaattgt

SEQ ID NO: 6668928 - DNA, 15 bp, Homo sapiens
atgctttccatattt

SEQ ID NO: 6668929 - DNA, 20 bp, Homo sapiens
atgctttcccaccagcatgt

SEQ ID NO: 6668930 - DNA, 13 bp, Homo sapiens
atgctttcctccc

SEQ ID NO: 6668931 - DNA, 15 bp, Homo sapiens
atgctttccttttct

SEQ ID NO: 6668932 - DNA, 10 bp, Homo sapiens
atgctttctc

SEQ ID NO: 6668933 - DNA, 23 bp, Homo sapiens
atgctttctcatgcatagacaag

SEQ ID NO: 6668934 - DNA, 16 bp, Homo sapiens
atgctttctccttttt

SEQ ID NO: 6668935 - DNA, 16 bp, Homo sapiens
atgctttgaaacagaa

SEQ ID NO: 6668936 - DNA, 17 bp, Homo sapiens
atgctttgaacatctct

SEQ ID NO: 6668937 - DNA, 17 bp, Homo sapiens
atgctttgaatgcaaaa

SEQ ID NO: 6668938 - DNA, 21 bp, Homo sapiens
atgctttgaatgcaaaagaaa

SEQ ID NO: 6668939 - DNA, 22 bp, Homo sapiens
atgctttgaatgcaaaagaaat

SEQ ID NO: 6668940 - DNA, 20 bp, Homo sapiens
atgctttgagaccagaagaa

SEQ ID NO: 6668941 - DNA, 20 bp, Homo sapiens
atgctttgagtccacgccca

SEQ ID NO: 6668942 - DNA, 17 bp, Homo sapiens
atgctttgataaaatat

SEQ ID NO: 6668943 - DNA, 21 bp, Homo sapiens
atgctttgataaaatatttta

SEQ ID NO: 6668944 - DNA, 22 bp, Homo sapiens
atgctttgataaaatattttaa

SEQ ID NO: 6668945 - DNA, 19 bp, Homo sapiens
atgctttgcagagaactca

SEQ ID NO: 6668946 - DNA, 22 bp, Homo sapiens
atgctttgccataaccacattt

SEQ ID NO: 6668947 - DNA, 14 bp, Homo sapiens
atgctttgctctca

SEQ ID NO: 6668948 - DNA, 23 bp, Homo sapiens
atgctttggaaaaatgggtcttt

SEQ ID NO: 6668949 - DNA, 14 bp, Homo sapiens
atgctttgggaact

SEQ ID NO: 6668950 - DNA, 16 bp, Homo sapiens
atgctttgggaggcca

SEQ ID NO: 6668951 - DNA, 15 bp, Homo sapiens
atgctttgtgactat

SEQ ID NO: 6668952 - DNA, 20 bp, Homo sapiens
atgcttttaaactgattacg

SEQ ID NO: 6668953 - DNA, 17 bp, Homo sapiens
atgcttttataggcctg

SEQ ID NO: 6668954 - DNA, 16 bp, Homo sapiens
atgcttttatattcta

SEQ ID NO: 6668955 - DNA, 13 bp, Homo sapiens
atgcttttcaaac

SEQ ID NO: 6668956 - DNA, 14 bp, Homo sapiens
atgcttttctcatg

SEQ ID NO: 6668957 - DNA, 16 bp, Homo sapiens
atgcttttctcatggt

SEQ ID NO: 6668958 - DNA, 15 bp, Homo sapiens
atgcttttctctcag

SEQ ID NO: 6668959 - DNA, 17 bp, Homo sapiens
atgcttttgctaatacc

SEQ ID NO: 6668960 - DNA, 21 bp, Homo sapiens
atgcttttgctaataccaaaa

SEQ ID NO: 6668961 - DNA, 20 bp, Homo sapiens
atgcttttgctgctgcttaa

SEQ ID NO: 6668962 - DNA, 18 bp, Homo sapiens
atgcttttggaagttaaa

SEQ ID NO: 6668963 - DNA, 13 bp, Homo sapiens
atgcttttgtcta

SEQ ID NO: 6668964 - DNA, 16 bp, Homo sapiens
atgctttttctcagat

SEQ ID NO: 6668965 - DNA, 17 bp, Homo sapiens
atgctttttgagtttca

SEQ ID NO: 6668966 - DNA, 21 bp, Homo sapiens
atgctttttgagtttcatgtt

SEQ ID NO: 6668967 - DNA, 13 bp, Homo sapiens
atgcttttttgca

SEQ ID NO: 6668968 - DNA, 16 bp, Homo sapiens
atgcttttttgcaata

SEQ ID NO: 6668969 - DNA, 15 bp, Homo sapiens
atggaaaaaaaaatc

SEQ ID NO: 6668970 - DNA, 20 bp, Homo sapiens
atggaaaaaaacataaaaag

SEQ ID NO: 6668971 - DNA, 21 bp, Homo sapiens
atggaaaaaccatttgaagtg

SEQ ID NO: 6668972 - DNA, 21 bp, Homo sapiens
atggaaaaacttgtgctataa

SEQ ID NO: 6668973 - DNA, 17 bp, Homo sapiens
atggaaaaataaaactg

SEQ ID NO: 6668974 - DNA, 14 bp, Homo sapiens
atggaaaaatgcca

SEQ ID NO: 6668975 - DNA, 19 bp, Homo sapiens
atggaaaaattgacaaaaa

SEQ ID NO: 6668976 - DNA, 15 bp, Homo sapiens
atggaaaacagagta

SEQ ID NO: 6668977 - DNA, 22 bp, Homo sapiens
atggaaaacatttcaagtttac

SEQ ID NO: 6668978 - DNA, 14 bp, Homo sapiens
atggaaaacctggg

SEQ ID NO: 6668979 - DNA, 20 bp, Homo sapiens
atggaaaactgttaagggaa

SEQ ID NO: 6668980 - DNA, 15 bp, Homo sapiens
atggaaaacttagtt

SEQ ID NO: 6668981 - DNA, 22 bp, Homo sapiens
atggaaaagcaacttcatttga

SEQ ID NO: 6668982 - DNA, 20 bp, Homo sapiens
atggaaaaggaagactagag

SEQ ID NO: 6668983 - DNA, 12 bp, Homo sapiens
atggaaaataaa

SEQ ID NO: 6668984 - DNA, 15 bp, Homo sapiens
atggaaaataaacat

SEQ ID NO: 6668985 - DNA, 16 bp, Homo sapiens
atggaaaataaacatc

SEQ ID NO: 6668986 - DNA, 17 bp, Homo sapiens
atggaaaataaattata

SEQ ID NO: 6668987 - DNA, 20 bp, Homo sapiens
atggaaaatacctaattgtg

SEQ ID NO: 6668988 - DNA, 16 bp, Homo sapiens
atggaaaatatacaag

SEQ ID NO: 6668989 - DNA, 20 bp, Homo sapiens
atggaaaatgccatgaatta

SEQ ID NO: 6668990 - DNA, 22 bp, Homo sapiens
atggaaaattaattctaaactt

SEQ ID NO: 6668991 - DNA, 23 bp, Homo sapiens
atggaaacaaagtggaaggaaag

SEQ ID NO: 6668992 - DNA, 18 bp, Homo sapiens
atggaaacaatgtggagt

SEQ ID NO: 6668993 - DNA, 13 bp, Homo sapiens
atggaaacactga

SEQ ID NO: 6668994 - DNA, 17 bp, Homo sapiens
atggaaacactgatttt

SEQ ID NO: 6668995 - DNA, 18 bp, Homo sapiens
atggaaacagaagacaaa

SEQ ID NO: 6668996 - DNA, 20 bp, Homo sapiens
atggaaacagaggaccagca

SEQ ID NO: 6668997 - DNA, 15 bp, Homo sapiens
atggaaacagggcag

SEQ ID NO: 6668998 - DNA, 14 bp, Homo sapiens
atggaaacatttta

SEQ ID NO: 6668999 - DNA, 17 bp, Homo sapiens
atggaaacgcacaaccc

SEQ ID NO: 6669000 - DNA, 18 bp, Homo sapiens
atggaaacgcacttacaa

SEQ ID NO: 6669001 - DNA, 14 bp, Homo sapiens
atggaaactgaatg

SEQ ID NO: 6669002 - DNA, 20 bp, Homo sapiens
atggaaagaaaagttattgc

SEQ ID NO: 6669003 - DNA, 14 bp, Homo sapiens
atggaaagaaggaa

SEQ ID NO: 6669004 - DNA, 15 bp, Homo sapiens
atggaaagaaggaaa

SEQ ID NO: 6669005 - DNA, 15 bp, Homo sapiens
atggaaagacaaact

SEQ ID NO: 6669006 - DNA, 23 bp, Homo sapiens
atggaaagcagagttttcattaa

SEQ ID NO: 6669007 - DNA, 16 bp, Homo sapiens
atggaaagcttttcag

SEQ ID NO: 6669008 - DNA, 15 bp, Homo sapiens
atggaaaggagagga

SEQ ID NO: 6669009 - DNA, 23 bp, Homo sapiens
atggaaaggagcctaggccaggt

SEQ ID NO: 6669010 - DNA, 13 bp, Homo sapiens
atggaaaggatgg

SEQ ID NO: 6669011 - DNA, 13 bp, Homo sapiens
atggaaaggccag

SEQ ID NO: 6669012 - DNA, 20 bp, Homo sapiens
atggaaagggtgtggcttgg

SEQ ID NO: 6669013 - DNA, 18 bp, Homo sapiens
atggaaaggtcctgctgt

SEQ ID NO: 6669014 - DNA, 17 bp, Homo sapiens
atggaaaggtcctgtgg

SEQ ID NO: 6669015 - DNA, 16 bp, Homo sapiens
atggaaagtaactcat

SEQ ID NO: 6669016 - DNA, 17 bp, Homo sapiens
atggaaatacagttatt

SEQ ID NO: 6669017 - DNA, 13 bp, Homo sapiens
atggaaatacatt

SEQ ID NO: 6669018 - DNA, 20 bp, Homo sapiens
atggaaataccaggaccagt

SEQ ID NO: 6669019 - DNA, 22 bp, Homo sapiens
atggaaataccaggaccagttt

SEQ ID NO: 6669020 - DNA, 23 bp, Homo sapiens
atggaaataccaggaccagttta

SEQ ID NO: 6669021 - DNA, 22 bp, Homo sapiens
atggaaatagctacagctgtgt

SEQ ID NO: 6669022 - DNA, 16 bp, Homo sapiens
atggaaatatgttcta

SEQ ID NO: 6669023 - DNA, 20 bp, Homo sapiens
atggaaatattaagaacatt

SEQ ID NO: 6669024 - DNA, 17 bp, Homo sapiens
atggaaatattatgcaa

SEQ ID NO: 6669025 - DNA, 15 bp, Homo sapiens
atggaaatcctgtta

SEQ ID NO: 6669026 - DNA, 13 bp, Homo sapiens
atggaaatgttta

SEQ ID NO: 6669027 - DNA, 20 bp, Homo sapiens
atggaaattcccttcatctg

SEQ ID NO: 6669028 - DNA, 18 bp, Homo sapiens
atggaaattctgctcaga

SEQ ID NO: 6669029 - DNA, 16 bp, Homo sapiens
atggaacacacacaca

SEQ ID NO: 6669030 - DNA, 24 bp, Homo sapiens
atggaacacacacacacgcagaca

SEQ ID NO: 6669031 - DNA, 15 bp, Homo sapiens
atggaacacagaact

SEQ ID NO: 6669032 - DNA, 16 bp, Homo sapiens
atggaacactctgaga

SEQ ID NO: 6669033 - DNA, 17 bp, Homo sapiens
atggaacactctgagac

SEQ ID NO: 6669034 - DNA, 15 bp, Homo sapiens
atggaacagaataga

SEQ ID NO: 6669035 - DNA, 17 bp, Homo sapiens
atggaacagatttcaaa

SEQ ID NO: 6669036 - DNA, 14 bp, Homo sapiens
atggaacagccctg

SEQ ID NO: 6669037 - DNA, 15 bp, Homo sapiens
atggaacagccctgc

SEQ ID NO: 6669038 - DNA, 18 bp, Homo sapiens
atggaacagtaattactt

SEQ ID NO: 6669039 - DNA, 18 bp, Homo sapiens
atggaacatatgcacagg

SEQ ID NO: 6669040 - DNA, 18 bp, Homo sapiens
atggaaccatggaggagg

SEQ ID NO: 6669041 - DNA, 20 bp, Homo sapiens
atggaaccgcaggaagctgc

SEQ ID NO: 6669042 - DNA, 21 bp, Homo sapiens
atggaacctcctttctcttct

SEQ ID NO: 6669043 - DNA, 17 bp, Homo sapiens
atggaaccttccctcca

SEQ ID NO: 6669044 - DNA, 15 bp, Homo sapiens
atggaacgcattttg

SEQ ID NO: 6669045 - DNA, 20 bp, Homo sapiens
atggaacgcattttgggttg

SEQ ID NO: 6669046 - DNA, 20 bp, Homo sapiens
atggaacgggcatgggcctc

SEQ ID NO: 6669047 - DNA, 15 bp, Homo sapiens
atggaactactgtac

SEQ ID NO: 6669048 - DNA, 23 bp, Homo sapiens
atggaactcagctgtctgtggct

SEQ ID NO: 6669049 - DNA, 22 bp, Homo sapiens
atggaactcattcctgcctgtc

SEQ ID NO: 6669050 - DNA, 20 bp, Homo sapiens
atggaactccccagggcctc

SEQ ID NO: 6669051 - DNA, 15 bp, Homo sapiens
atggaactgtgtatt

SEQ ID NO: 6669052 - DNA, 16 bp, Homo sapiens
atggaactgtgtattt

SEQ ID NO: 6669053 - DNA, 15 bp, Homo sapiens
atggaacttaaaaca

SEQ ID NO: 6669054 - DNA, 16 bp, Homo sapiens
atggaacttaaaacat

SEQ ID NO: 6669055 - DNA, 20 bp, Homo sapiens
atggaacttaaaacatatgg

SEQ ID NO: 6669056 - DNA, 19 bp, Homo sapiens
atggaacttctaatatatt

SEQ ID NO: 6669057 - DNA, 17 bp, Homo sapiens
atggaactttatttaca

SEQ ID NO: 6669058 - DNA, 13 bp, Homo sapiens
atggaagaaagta

SEQ ID NO: 6669059 - DNA, 16 bp, Homo sapiens
atggaagaagaaagga

SEQ ID NO: 6669060 - DNA, 17 bp, Homo sapiens
atggaagaagtatattt

SEQ ID NO: 6669061 - DNA, 20 bp, Homo sapiens
atggaagaagttttaactat

SEQ ID NO: 6669062 - DNA, 19 bp, Homo sapiens
atggaagacaaaatgtttt

SEQ ID NO: 6669063 - DNA, 22 bp, Homo sapiens
atggaagacaaatacacataca

SEQ ID NO: 6669064 - DNA, 14 bp, Homo sapiens
atggaagacacatt

SEQ ID NO: 6669065 - DNA, 17 bp, Homo sapiens
atggaagacagctctta

SEQ ID NO: 6669066 - DNA, 14 bp, Homo sapiens
atggaagacctaag

SEQ ID NO: 6669067 - DNA, 16 bp, Homo sapiens
atggaagacctaaggc

SEQ ID NO: 6669068 - DNA, 20 bp, Homo sapiens
atggaagacctaaggcagac

SEQ ID NO: 6669069 - DNA, 11 bp, Homo sapiens
atggaagagaa

SEQ ID NO: 6669070 - DNA, 17 bp, Homo sapiens
atggaagagaaatctca

SEQ ID NO: 6669071 - DNA, 22 bp, Homo sapiens
atggaagatggtccgtgcccag

SEQ ID NO: 6669072 - DNA, 15 bp, Homo sapiens
atggaagattagagg

SEQ ID NO: 6669073 - DNA, 22 bp, Homo sapiens
atggaagattagaggtttgtca

SEQ ID NO: 6669074 - DNA, 16 bp, Homo sapiens
atggaagattttaaat

SEQ ID NO: 6669075 - DNA, 14 bp, Homo sapiens
atggaagcaaagac

SEQ ID NO: 6669076 - DNA, 15 bp, Homo sapiens
atggaagcaaagaca

SEQ ID NO: 6669077 - DNA, 16 bp, Homo sapiens
atggaagcaaagacaa

SEQ ID NO: 6669078 - DNA, 14 bp, Homo sapiens
atggaagcacacaa

SEQ ID NO: 6669079 - DNA, 14 bp, Homo sapiens
atggaagccaacac

SEQ ID NO: 6669080 - DNA, 21 bp, Homo sapiens
atggaagcccacttctcagat

SEQ ID NO: 6669081 - DNA, 22 bp, Homo sapiens
atggaagcctccacctgcagcc

SEQ ID NO: 6669082 - DNA, 20 bp, Homo sapiens
atggaagcctgaactgaggc

SEQ ID NO: 6669083 - DNA, 23 bp, Homo sapiens
atggaagctggcaggagacactg

SEQ ID NO: 6669084 - DNA, 22 bp, Homo sapiens
atggaagcttccagtccaatct

SEQ ID NO: 6669085 - DNA, 15 bp, Homo sapiens
atggaaggaagaaaa

SEQ ID NO: 6669086 - DNA, 16 bp, Homo sapiens
atggaaggagacttag

SEQ ID NO: 6669087 - DNA, 16 bp, Homo sapiens
atggaaggagagaggt

SEQ ID NO: 6669088 - DNA, 15 bp, Homo sapiens
atggaagggaggggt

SEQ ID NO: 6669089 - DNA, 17 bp, Homo sapiens
atggaagtaaagcctca

SEQ ID NO: 6669090 - DNA, 14 bp, Homo sapiens
atggaagtaaaggc

SEQ ID NO: 6669091 - DNA, 18 bp, Homo sapiens
atggaagtggcagtgaaa

SEQ ID NO: 6669092 - DNA, 19 bp, Homo sapiens
atggaagtgggccagtcct

SEQ ID NO: 6669093 - DNA, 22 bp, Homo sapiens
atggaagtgggccagtcctggt

SEQ ID NO: 6669094 - DNA, 15 bp, Homo sapiens
atggaataaaccatt

SEQ ID NO: 6669095 - DNA, 15 bp, Homo sapiens
atggaataacatgta

SEQ ID NO: 6669096 - DNA, 13 bp, Homo sapiens
atggaataagtgt

SEQ ID NO: 6669097 - DNA, 22 bp, Homo sapiens
atggaataagtgtacatatgta

SEQ ID NO: 6669098 - DNA, 23 bp, Homo sapiens
atggaatacagtcattccaagaa

SEQ ID NO: 6669099 - DNA, 17 bp, Homo sapiens
atggaatactcttatat

SEQ ID NO: 6669100 - DNA, 14 bp, Homo sapiens
atggaatagaaaag

SEQ ID NO: 6669101 - DNA, 22 bp, Homo sapiens
atggaatagaaaagatgagagg

SEQ ID NO: 6669102 - DNA, 23 bp, Homo sapiens
atggaatagaaaagatgagaggc

SEQ ID NO: 6669103 - DNA, 16 bp, Homo sapiens
atggaatagttctgta

SEQ ID NO: 6669104 - DNA, 17 bp, Homo sapiens
atggaatattcatttta

SEQ ID NO: 6669105 - DNA, 21 bp, Homo sapiens
atggaatatttataggccagg

SEQ ID NO: 6669106 - DNA, 24 bp, Homo sapiens
atggaatatttataggccagggca

SEQ ID NO: 6669107 - DNA, 15 bp, Homo sapiens
atggaatcacagcca

SEQ ID NO: 6669108 - DNA, 20 bp, Homo sapiens
atggaatcgatttcctccca

SEQ ID NO: 6669109 - DNA, 23 bp, Homo sapiens
atggaatcttgctgcaggccctc

SEQ ID NO: 6669110 - DNA, 14 bp, Homo sapiens
atggaatgagggtt

SEQ ID NO: 6669111 - DNA, 16 bp, Homo sapiens
atggaatgcttgaaaa

SEQ ID NO: 6669112 - DNA, 18 bp, Homo sapiens
atggaatggacatcctgt

SEQ ID NO: 6669113 - DNA, 23 bp, Homo sapiens
atggaatggcaggtgtcatatga

SEQ ID NO: 6669114 - DNA, 18 bp, Homo sapiens
atggaatgtgccacctgt

SEQ ID NO: 6669115 - DNA, 14 bp, Homo sapiens
atggaatgtgcccc

SEQ ID NO: 6669116 - DNA, 19 bp, Homo sapiens
atggaatgtgcccctggcc

SEQ ID NO: 6669117 - DNA, 23 bp, Homo sapiens
atggaattaaccatttaataaag

SEQ ID NO: 6669118 - DNA, 12 bp, Homo sapiens
atggaattactc

SEQ ID NO: 6669119 - DNA, 14 bp, Homo sapiens
atggaattattttg

SEQ ID NO: 6669120 - DNA, 16 bp, Homo sapiens
atggaattcacaaagt

SEQ ID NO: 6669121 - DNA, 17 bp, Homo sapiens
atggaattcacaaagta

SEQ ID NO: 6669122 - DNA, 20 bp, Homo sapiens
atggaattcacaaagtaatt

SEQ ID NO: 6669123 - DNA, 16 bp, Homo sapiens
atggaattcgtgttat

SEQ ID NO: 6669124 - DNA, 16 bp, Homo sapiens
atggaattgatttgca

SEQ ID NO: 6669125 - DNA, 19 bp, Homo sapiens
atggaattgatttgcattg

SEQ ID NO: 6669126 - DNA, 22 bp, Homo sapiens
atggaattgcttctgtgtagtc

SEQ ID NO: 6669127 - DNA, 20 bp, Homo sapiens
atggaattggtttaaacttt

SEQ ID NO: 6669128 - DNA, 22 bp, Homo sapiens
atggaattggtttaaactttta

SEQ ID NO: 6669129 - DNA, 16 bp, Homo sapiens
atggaatttaatttat

SEQ ID NO: 6669130 - DNA, 13 bp, Homo sapiens
atggaatttggaa

SEQ ID NO: 6669131 - DNA, 19 bp, Homo sapiens
atggaattttgcaaagatt

SEQ ID NO: 6669132 - DNA, 17 bp, Homo sapiens
atggaatttttgaatct

SEQ ID NO: 6669133 - DNA, 15 bp, Homo sapiens
atggaattttttgaa

SEQ ID NO: 6669134 - DNA, 18 bp, Homo sapiens
atggaattttttgaatat

SEQ ID NO: 6669135 - DNA, 16 bp, Homo sapiens
atggaatttttttgta

SEQ ID NO: 6669136 - DNA, 18 bp, Homo sapiens
atggaatttttttgtacg

SEQ ID NO: 6669137 - DNA, 12 bp, Homo sapiens
atggacaaagaa

SEQ ID NO: 6669138 - DNA, 16 bp, Homo sapiens
atggacaaagttctgt

SEQ ID NO: 6669139 - DNA, 15 bp, Homo sapiens
atggacaaatggact

SEQ ID NO: 6669140 - DNA, 22 bp, Homo sapiens
atggacaacttatttaaaaata

SEQ ID NO: 6669141 - DNA, 20 bp, Homo sapiens
atggacaagaggtacagggt

SEQ ID NO: 6669142 - DNA, 22 bp, Homo sapiens
atggacaagcagtgtctgtcag

SEQ ID NO: 6669143 - DNA, 15 bp, Homo sapiens
atggacaaggagctg

SEQ ID NO: 6669144 - DNA, 16 bp, Homo sapiens
atggacaatataaact

SEQ ID NO: 6669145 - DNA, 18 bp, Homo sapiens
atggacaatataaactga

SEQ ID NO: 6669146 - DNA, 22 bp, Homo sapiens
atggacaatataaactgaaaaa

SEQ ID NO: 6669147 - DNA, 18 bp, Homo sapiens
atggacaatttccaagaa

SEQ ID NO: 6669148 - DNA, 13 bp, Homo sapiens
atggacacaaatt

SEQ ID NO: 6669149 - DNA, 13 bp, Homo sapiens
atggacacagacc

SEQ ID NO: 6669150 - DNA, 13 bp, Homo sapiens
atggacaccccca

SEQ ID NO: 6669151 - DNA, 21 bp, Homo sapiens
atggacaccccttatccagga

SEQ ID NO: 6669152 - DNA, 15 bp, Homo sapiens
atggacacgagccac

SEQ ID NO: 6669153 - DNA, 15 bp, Homo sapiens
atggacactacaccc

SEQ ID NO: 6669154 - DNA, 16 bp, Homo sapiens
atggacactacaccca

SEQ ID NO: 6669155 - DNA, 18 bp, Homo sapiens
atggacactacacccagc

SEQ ID NO: 6669156 - DNA, 15 bp, Homo sapiens
atggacactccaggg

SEQ ID NO: 6669157 - DNA, 19 bp, Homo sapiens
atggacactccagtgccag

SEQ ID NO: 6669158 - DNA, 16 bp, Homo sapiens
atggacactgccaaga

SEQ ID NO: 6669159 - DNA, 22 bp, Homo sapiens
atggacactgccaagagccgac

SEQ ID NO: 6669160 - DNA, 15 bp, Homo sapiens
atggacactgcctta

SEQ ID NO: 6669161 - DNA, 20 bp, Homo sapiens
atggacagaagaaggcagca

SEQ ID NO: 6669162 - DNA, 18 bp, Homo sapiens
atggacagacacctcccc

SEQ ID NO: 6669163 - DNA, 21 bp, Homo sapiens
atggacagacacctcccccta

SEQ ID NO: 6669164 - DNA, 23 bp, Homo sapiens
atggacagacacctccccctacc

SEQ ID NO: 6669165 - DNA, 22 bp, Homo sapiens
atggacagagaactttattttg

SEQ ID NO: 6669166 - DNA, 14 bp, Homo sapiens
atggacagatggac

SEQ ID NO: 6669167 - DNA, 16 bp, Homo sapiens
atggacagatggacca

SEQ ID NO: 6669168 - DNA, 18 bp, Homo sapiens
atggacagcattgccagt

SEQ ID NO: 6669169 - DNA, 17 bp, Homo sapiens
atggacagggccagggt

SEQ ID NO: 6669170 - DNA, 19 bp, Homo sapiens
atggacagttcacaccctg

SEQ ID NO: 6669171 - DNA, 21 bp, Homo sapiens
atggacagttcacaccctgca

SEQ ID NO: 6669172 - DNA, 18 bp, Homo sapiens
atggacagtttgtttcct

SEQ ID NO: 6669173 - DNA, 22 bp, Homo sapiens
atggacagtttgtttcctgtct

SEQ ID NO: 6669174 - DNA, 16 bp, Homo sapiens
atggacatatgggttt

SEQ ID NO: 6669175 - DNA, 19 bp, Homo sapiens
atggacatcgatatgaaaa

SEQ ID NO: 6669176 - DNA, 20 bp, Homo sapiens
atggacatcgatatgaaaaa

SEQ ID NO: 6669177 - DNA, 17 bp, Homo sapiens
atggacatcttgtcatt

SEQ ID NO: 6669178 - DNA, 17 bp, Homo sapiens
atggacatgagagtagg

SEQ ID NO: 6669179 - DNA, 23 bp, Homo sapiens
atggacatgagagtagggccctg

SEQ ID NO: 6669180 - DNA, 19 bp, Homo sapiens
atggacatgagtttaaagc

SEQ ID NO: 6669181 - DNA, 14 bp, Homo sapiens
atggacatgatctt

SEQ ID NO: 6669182 - DNA, 14 bp, Homo sapiens
atggacatgggcag

SEQ ID NO: 6669183 - DNA, 13 bp, Homo sapiens
atggacatggtgg

SEQ ID NO: 6669184 - DNA, 20 bp, Homo sapiens
atggacatgtgtcccagcca

SEQ ID NO: 6669185 - DNA, 12 bp, Homo sapiens
atggacattttc

SEQ ID NO: 6669186 - DNA, 22 bp, Homo sapiens
atggacattttcttttattatc

SEQ ID NO: 6669187 - DNA, 12 bp, Homo sapiens
atggaccaaagc

SEQ ID NO: 6669188 - DNA, 19 bp, Homo sapiens
atggaccaaagccacctgc

SEQ ID NO: 6669189 - DNA, 21 bp, Homo sapiens
atggaccaaagccacctgctg

SEQ ID NO: 6669190 - DNA, 14 bp, Homo sapiens
atggaccaaatgta

SEQ ID NO: 6669191 - DNA, 19 bp, Homo sapiens
atggaccaaatgtaaaata

SEQ ID NO: 6669192 - DNA, 18 bp, Homo sapiens
atggaccaacctgctctg

SEQ ID NO: 6669193 - DNA, 16 bp, Homo sapiens
atggaccactgtttct

SEQ ID NO: 6669194 - DNA, 22 bp, Homo sapiens
atggaccactgtttcttgcttg

SEQ ID NO: 6669195 - DNA, 13 bp, Homo sapiens
atggaccactttt

SEQ ID NO: 6669196 - DNA, 13 bp, Homo sapiens
atggaccagtaga

SEQ ID NO: 6669197 - DNA, 20 bp, Homo sapiens
atggacccactacccttctc

SEQ ID NO: 6669198 - DNA, 14 bp, Homo sapiens
atggacccctccct

SEQ ID NO: 6669199 - DNA, 15 bp, Homo sapiens
atggacccctccctt

SEQ ID NO: 6669200 - DNA, 16 bp, Homo sapiens
atggaccctcgcagca

SEQ ID NO: 6669201 - DNA, 17 bp, Homo sapiens
atggaccctcgcagcag

SEQ ID NO: 6669202 - DNA, 21 bp, Homo sapiens
atggaccgggtgggcctggcc

SEQ ID NO: 6669203 - DNA, 22 bp, Homo sapiens
atggaccgggtgggcctggcct

SEQ ID NO: 6669204 - DNA, 23 bp, Homo sapiens
atggaccgggtgggcctggcctg

SEQ ID NO: 6669205 - DNA, 14 bp, Homo sapiens
atggacctaacatt

SEQ ID NO: 6669206 - DNA, 18 bp, Homo sapiens
atggacctatctgtaaga

SEQ ID NO: 6669207 - DNA, 13 bp, Homo sapiens
atggacctcagca

SEQ ID NO: 6669208 - DNA, 23 bp, Homo sapiens
atggacctgccccggacctacct

SEQ ID NO: 6669209 - DNA, 18 bp, Homo sapiens
atggacctgcctgcatag

SEQ ID NO: 6669210 - DNA, 20 bp, Homo sapiens
atggacctggtgcccctgct

SEQ ID NO: 6669211 - DNA, 20 bp, Homo sapiens
atggaccttctctccagagc

SEQ ID NO: 6669212 - DNA, 16 bp, Homo sapiens
atggacgaatatgaat

SEQ ID NO: 6669213 - DNA, 20 bp, Homo sapiens
atggacgaatatgaatgtca

SEQ ID NO: 6669214 - DNA, 23 bp, Homo sapiens
atggacgacctccagctctcagt

SEQ ID NO: 6669215 - DNA, 18 bp, Homo sapiens
atggacgcaggccctgtc

SEQ ID NO: 6669216 - DNA, 21 bp, Homo sapiens
atggacgcctggctccaggct

SEQ ID NO: 6669217 - DNA, 15 bp, Homo sapiens
atggacgctgccggg

SEQ ID NO: 6669218 - DNA, 13 bp, Homo sapiens
atggacggtgctc

SEQ ID NO: 6669219 - DNA, 17 bp, Homo sapiens
atggacggtgctccagg

SEQ ID NO: 6669220 - DNA, 20 bp, Homo sapiens
atggacggtgctccaggcag

SEQ ID NO: 6669221 - DNA, 21 bp, Homo sapiens
atggacgtcgaggaccgggca

SEQ ID NO: 6669222 - DNA, 22 bp, Homo sapiens
atggacgtgtctgcacagggtc

SEQ ID NO: 6669223 - DNA, 16 bp, Homo sapiens
atggacgtgtgtgaat

SEQ ID NO: 6669224 - DNA, 19 bp, Homo sapiens
atggacgtgttatgactcc

SEQ ID NO: 6669225 - DNA, 21 bp, Homo sapiens
atggactaaccccaacgcaca

SEQ ID NO: 6669226 - DNA, 21 bp, Homo sapiens
atggactacagtagctcacgt

SEQ ID NO: 6669227 - DNA, 22 bp, Homo sapiens
atggactatctgtctggtggcc

SEQ ID NO: 6669228 - DNA, 21 bp, Homo sapiens
atggactatgcacacttttaa

SEQ ID NO: 6669229 - DNA, 19 bp, Homo sapiens
atggactcagccttgcaaa

SEQ ID NO: 6669230 - DNA, 15 bp, Homo sapiens
atggactcagctctg

SEQ ID NO: 6669231 - DNA, 18 bp, Homo sapiens
atggactcagctctgtct

SEQ ID NO: 6669232 - DNA, 21 bp, Homo sapiens
atggactcagctctgtctgct

SEQ ID NO: 6669233 - DNA, 16 bp, Homo sapiens
atggactctacactgt

SEQ ID NO: 6669234 - DNA, 15 bp, Homo sapiens
atggactctgcacat

SEQ ID NO: 6669235 - DNA, 16 bp, Homo sapiens
atggactctgtcctga

SEQ ID NO: 6669236 - DNA, 12 bp, Homo sapiens
atggactgcaca

SEQ ID NO: 6669237 - DNA, 17 bp, Homo sapiens
atggactgcacaaaagt

SEQ ID NO: 6669238 - DNA, 19 bp, Homo sapiens
atggactgcaccttgtgaa

SEQ ID NO: 6669239 - DNA, 16 bp, Homo sapiens
atggactgtggtgact

SEQ ID NO: 6669240 - DNA, 22 bp, Homo sapiens
atggactgtggtgactttggat

SEQ ID NO: 6669241 - DNA, 17 bp, Homo sapiens
atggactgttgccacca

SEQ ID NO: 6669242 - DNA, 20 bp, Homo sapiens
atggacttaattatgctaac

SEQ ID NO: 6669243 - DNA, 19 bp, Homo sapiens
atggacttatttcttcaaa

SEQ ID NO: 6669244 - DNA, 12 bp, Homo sapiens
atggacttcaaa

SEQ ID NO: 6669245 - DNA, 14 bp, Homo sapiens
atggacttctggat

SEQ ID NO: 6669246 - DNA, 18 bp, Homo sapiens
atggacttgcttcttgtg

SEQ ID NO: 6669247 - DNA, 23 bp, Homo sapiens
atggacttgtatatttgtacaaa

SEQ ID NO: 6669248 - DNA, 18 bp, Homo sapiens
atggacttgtgattggct

SEQ ID NO: 6669249 - DNA, 13 bp, Homo sapiens
atggactttcttg

SEQ ID NO: 6669250 - DNA, 22 bp, Homo sapiens
atggactttgcacactttggcc

SEQ ID NO: 6669251 - DNA, 15 bp, Homo sapiens
atggactttggaagc

SEQ ID NO: 6669252 - DNA, 16 bp, Homo sapiens
atggacttttgggggt

SEQ ID NO: 6669253 - DNA, 19 bp, Homo sapiens
atggacttttgggggttgg

SEQ ID NO: 6669254 - DNA, 13 bp, Homo sapiens
atggagaaaatga

SEQ ID NO: 6669255 - DNA, 22 bp, Homo sapiens
atggagaaaatgaatggacaaa

SEQ ID NO: 6669256 - DNA, 22 bp, Homo sapiens
atggagaaaccttgtctctact

SEQ ID NO: 6669257 - DNA, 22 bp, Homo sapiens
atggagaaagaagtggagacag

SEQ ID NO: 6669258 - DNA, 16 bp, Homo sapiens
atggagaaagctgact

SEQ ID NO: 6669259 - DNA, 12 bp, Homo sapiens
atggagaaatga

SEQ ID NO: 6669260 - DNA, 15 bp, Homo sapiens
atggagaagctgcag

SEQ ID NO: 6669261 - DNA, 12 bp, Homo sapiens
atggagaaggaa

SEQ ID NO: 6669262 - DNA, 14 bp, Homo sapiens
atggagaaggaaaa

SEQ ID NO: 6669263 - DNA, 15 bp, Homo sapiens
atggagaaggaaaag

SEQ ID NO: 6669264 - DNA, 17 bp, Homo sapiens
atggagaatacatcttg

SEQ ID NO: 6669265 - DNA, 15 bp, Homo sapiens
atggagaatcacttt

SEQ ID NO: 6669266 - DNA, 19 bp, Homo sapiens
atggagaatgccagcccaa

SEQ ID NO: 6669267 - DNA, 17 bp, Homo sapiens
atggagacaataaacag

SEQ ID NO: 6669268 - DNA, 13 bp, Homo sapiens
atggagacaccac

SEQ ID NO: 6669269 - DNA, 14 bp, Homo sapiens
atggagacagcagt

SEQ ID NO: 6669270 - DNA, 14 bp, Homo sapiens
atggagacagcgaa

SEQ ID NO: 6669271 - DNA, 18 bp, Homo sapiens
atggagacgcatttcggt

SEQ ID NO: 6669272 - DNA, 14 bp, Homo sapiens
atggagactcctgc

SEQ ID NO: 6669273 - DNA, 20 bp, Homo sapiens
atggagactcctgccctgtt

SEQ ID NO: 6669274 - DNA, 21 bp, Homo sapiens
atggagactggtcctgtgtgc

SEQ ID NO: 6669275 - DNA, 11 bp, Homo sapiens
atggagagaat

SEQ ID NO: 6669276 - DNA, 11 bp, Homo sapiens
atggagagaga

SEQ ID NO: 6669277 - DNA, 17 bp, Homo sapiens
atggagagaggggaata

SEQ ID NO: 6669278 - DNA, 15 bp, Homo sapiens
atggagagccctggg

SEQ ID NO: 6669279 - DNA, 13 bp, Homo sapiens
atggagagctgga

SEQ ID NO: 6669280 - DNA, 23 bp, Homo sapiens
atggagagctggagcctggtgcc

SEQ ID NO: 6669281 - DNA, 12 bp, Homo sapiens
atggagaggaag

SEQ ID NO: 6669282 - DNA, 13 bp, Homo sapiens
atggagaggaaga

SEQ ID NO: 6669283 - DNA, 19 bp, Homo sapiens
atggagaggacagagcagg

SEQ ID NO: 6669284 - DNA, 14 bp, Homo sapiens
atggagaggcatgg

SEQ ID NO: 6669285 - DNA, 18 bp, Homo sapiens
atggagaggcggcctcgt

SEQ ID NO: 6669286 - DNA, 13 bp, Homo sapiens
atggagaggtttg

SEQ ID NO: 6669287 - DNA, 16 bp, Homo sapiens
atggagaggtttgtca

SEQ ID NO: 6669288 - DNA, 16 bp, Homo sapiens
atggagagtgagagca

SEQ ID NO: 6669289 - DNA, 18 bp, Homo sapiens
atggagagtggggagagg

SEQ ID NO: 6669290 - DNA, 23 bp, Homo sapiens
atggagatagccccacaggaggt

SEQ ID NO: 6669291 - DNA, 16 bp, Homo sapiens
atggagatctgaaggg

SEQ ID NO: 6669292 - DNA, 20 bp, Homo sapiens
atggagcaaaacaaagctga

SEQ ID NO: 6669293 - DNA, 16 bp, Homo sapiens
atggagcaagctcttc

SEQ ID NO: 6669294 - DNA, 22 bp, Homo sapiens
atggagcacgaggccttcagaa

SEQ ID NO: 6669295 - DNA, 11 bp, Homo sapiens
atggagcagcc

SEQ ID NO: 6669296 - DNA, 15 bp, Homo sapiens
atggagcagccccca

SEQ ID NO: 6669297 - DNA, 18 bp, Homo sapiens
atggagcagcccccaaag

SEQ ID NO: 6669298 - DNA, 23 bp, Homo sapiens
atggagcagcccccaaagagctg

SEQ ID NO: 6669299 - DNA, 18 bp, Homo sapiens
atggagcatcaagccact

SEQ ID NO: 6669300 - DNA, 18 bp, Homo sapiens
atggagcatttttcagag

SEQ ID NO: 6669301 - DNA, 15 bp, Homo sapiens
atggagccagctccc

SEQ ID NO: 6669302 - DNA, 21 bp, Homo sapiens
atggagccagctctgcattat

SEQ ID NO: 6669303 - DNA, 12 bp, Homo sapiens
atggagcccagg

SEQ ID NO: 6669304 - DNA, 13 bp, Homo sapiens
atggagcccaggc

SEQ ID NO: 6669305 - DNA, 15 bp, Homo sapiens
atggagccccacctt

SEQ ID NO: 6669306 - DNA, 12 bp, Homo sapiens
atggagccccag

SEQ ID NO: 6669307 - DNA, 15 bp, Homo sapiens
atggagccccagccc

SEQ ID NO: 6669308 - DNA, 15 bp, Homo sapiens
atggagcccccagat

SEQ ID NO: 6669309 - DNA, 20 bp, Homo sapiens
atggagcctacctctgtctg

SEQ ID NO: 6669310 - DNA, 21 bp, Homo sapiens
atggagcctacctctgtctga

SEQ ID NO: 6669311 - DNA, 12 bp, Homo sapiens
atggagcctctg

SEQ ID NO: 6669312 - DNA, 14 bp, Homo sapiens
atggagcctgctct

SEQ ID NO: 6669313 - DNA, 21 bp, Homo sapiens
atggagcctggcacaggactg

SEQ ID NO: 6669314 - DNA, 13 bp, Homo sapiens
atggagctggccg

SEQ ID NO: 6669315 - DNA, 14 bp, Homo sapiens
atggagcttgtaca

SEQ ID NO: 6669316 - DNA, 15 bp, Homo sapiens
atggagcttgtacat

SEQ ID NO: 6669317 - DNA, 23 bp, Homo sapiens
atggaggaagaacaacaaagaca

SEQ ID NO: 6669318 - DNA, 18 bp, Homo sapiens
atggaggactctcctctt

SEQ ID NO: 6669319 - DNA, 15 bp, Homo sapiens
atggaggagaaataa

SEQ ID NO: 6669320 - DNA, 22 bp, Homo sapiens
atggaggagacaggaagcctca

SEQ ID NO: 6669321 - DNA, 19 bp, Homo sapiens
atggaggagccaggcccca

SEQ ID NO: 6669322 - DNA, 21 bp, Homo sapiens
atggaggagccaggccccacc

SEQ ID NO: 6669323 - DNA, 14 bp, Homo sapiens
atggaggaggaggc

SEQ ID NO: 6669324 - DNA, 16 bp, Homo sapiens
atggaggaggaggcaa

SEQ ID NO: 6669325 - DNA, 21 bp, Homo sapiens
atggaggatggtgtcctgagg

SEQ ID NO: 6669326 - DNA, 17 bp, Homo sapiens
atggaggattctttccc

SEQ ID NO: 6669327 - DNA, 19 bp, Homo sapiens
atggaggattctttcccca

SEQ ID NO: 6669328 - DNA, 20 bp, Homo sapiens
atggaggcagagacctccaa

SEQ ID NO: 6669329 - DNA, 22 bp, Homo sapiens
atggaggcaggctccccctgcc

SEQ ID NO: 6669330 - DNA, 12 bp, Homo sapiens
atggaggccaag

SEQ ID NO: 6669331 - DNA, 11 bp, Homo sapiens
atggaggccag

SEQ ID NO: 6669332 - DNA, 13 bp, Homo sapiens
atggaggccagag

SEQ ID NO: 6669333 - DNA, 15 bp, Homo sapiens
atggaggccagagtc

SEQ ID NO: 6669334 - DNA, 20 bp, Homo sapiens
atggaggccagagtctccca

SEQ ID NO: 6669335 - DNA, 22 bp, Homo sapiens
atggaggcctcacacccagagg

SEQ ID NO: 6669336 - DNA, 15 bp, Homo sapiens
atggaggcctgtcct

SEQ ID NO: 6669337 - DNA, 15 bp, Homo sapiens
atggaggcgccttcc

SEQ ID NO: 6669338 - DNA, 21 bp, Homo sapiens
atggaggcgccttcctgggtt

SEQ ID NO: 6669339 - DNA, 15 bp, Homo sapiens
atggaggctgcagcg

SEQ ID NO: 6669340 - DNA, 19 bp, Homo sapiens
atggagggcaacattccac

SEQ ID NO: 6669341 - DNA, 14 bp, Homo sapiens
atggagggcagagt

SEQ ID NO: 6669342 - DNA, 22 bp, Homo sapiens
atggagggcagagtgggctgcc

SEQ ID NO: 6669343 - DNA, 14 bp, Homo sapiens
atggaggggagagg

SEQ ID NO: 6669344 - DNA, 17 bp, Homo sapiens
atggaggggagtgttgg

SEQ ID NO: 6669345 - DNA, 22 bp, Homo sapiens
atggaggggatgataaaggaaa

SEQ ID NO: 6669346 - DNA, 15 bp, Homo sapiens
atggaggggcagagc

SEQ ID NO: 6669347 - DNA, 19 bp, Homo sapiens
atggaggggcagagccagg

SEQ ID NO: 6669348 - DNA, 23 bp, Homo sapiens
atggagggggctggggtcacaga

SEQ ID NO: 6669349 - DNA, 22 bp, Homo sapiens
atggaggggtggtcctgactca

SEQ ID NO: 6669350 - DNA, 14 bp, Homo sapiens
atggagggtggggc

SEQ ID NO: 6669351 - DNA, 16 bp, Homo sapiens
atggagggtttagtgc

SEQ ID NO: 6669352 - DNA, 12 bp, Homo sapiens
atggaggttcta

SEQ ID NO: 6669353 - DNA, 15 bp, Homo sapiens
atggaggttctaagg

SEQ ID NO: 6669354 - DNA, 17 bp, Homo sapiens
atggaggttctaaggcc

SEQ ID NO: 6669355 - DNA, 15 bp, Homo sapiens
atggaggttctcaga

SEQ ID NO: 6669356 - DNA, 22 bp, Homo sapiens
atggagtagaggtactagaatg

SEQ ID NO: 6669357 - DNA, 15 bp, Homo sapiens
atggagtagcctgga

SEQ ID NO: 6669358 - DNA, 19 bp, Homo sapiens
atggagtagcctggactgt

SEQ ID NO: 6669359 - DNA, 22 bp, Homo sapiens
atggagtaggtaccatttgtgt

SEQ ID NO: 6669360 - DNA, 12 bp, Homo sapiens
atggagtattct

SEQ ID NO: 6669361 - DNA, 17 bp, Homo sapiens
atggagtcttgtgaaag

SEQ ID NO: 6669362 - DNA, 22 bp, Homo sapiens
atggagtgacggtcccacactg

SEQ ID NO: 6669363 - DNA, 22 bp, Homo sapiens
atggagtgagtcacctgctcca

SEQ ID NO: 6669364 - DNA, 17 bp, Homo sapiens
atggagtgcaccaaaga

SEQ ID NO: 6669365 - DNA, 18 bp, Homo sapiens
atggagtgctgttttgtt

SEQ ID NO: 6669366 - DNA, 18 bp, Homo sapiens
atggagtggcagcccagc

SEQ ID NO: 6669367 - DNA, 19 bp, Homo sapiens
atggagtgggagatcagcc

SEQ ID NO: 6669368 - DNA, 14 bp, Homo sapiens
atggagtgtgcaga

SEQ ID NO: 6669369 - DNA, 18 bp, Homo sapiens
atggagtgtgtattgttc

SEQ ID NO: 6669370 - DNA, 17 bp, Homo sapiens
atggagtgtttgaaaac

SEQ ID NO: 6669371 - DNA, 23 bp, Homo sapiens
atggagtgtttgacgaagaaaca

SEQ ID NO: 6669372 - DNA, 17 bp, Homo sapiens
atggagttaacgggtga

SEQ ID NO: 6669373 - DNA, 21 bp, Homo sapiens
atggagttaacgggtgaataa

SEQ ID NO: 6669374 - DNA, 18 bp, Homo sapiens
atggagttggagttcatt

SEQ ID NO: 6669375 - DNA, 23 bp, Homo sapiens
atggagttggagttcattcatat

SEQ ID NO: 6669376 - DNA, 14 bp, Homo sapiens
atggagtttctaag

SEQ ID NO: 6669377 - DNA, 15 bp, Homo sapiens
atggagtttctaagg

SEQ ID NO: 6669378 - DNA, 16 bp, Homo sapiens
atggagtttctaaggt

SEQ ID NO: 6669379 - DNA, 20 bp, Homo sapiens
atggataaaataatgctgca

SEQ ID NO: 6669380 - DNA, 13 bp, Homo sapiens
atggataaactga

SEQ ID NO: 6669381 - DNA, 16 bp, Homo sapiens
atggataaactgagcc

SEQ ID NO: 6669382 - DNA, 17 bp, Homo sapiens
atggataaactgagcct

SEQ ID NO: 6669383 - DNA, 18 bp, Homo sapiens
atggataacctatatgat

SEQ ID NO: 6669384 - DNA, 23 bp, Homo sapiens
atggataatctgagcaggtacat

SEQ ID NO: 6669385 - DNA, 13 bp, Homo sapiens
atggatactacat

SEQ ID NO: 6669386 - DNA, 19 bp, Homo sapiens
atggatactacatctttaa

SEQ ID NO: 6669387 - DNA, 13 bp, Homo sapiens
atggatagaaaaa

SEQ ID NO: 6669388 - DNA, 15 bp, Homo sapiens
atggatagaaaaaaa

SEQ ID NO: 6669389 - DNA, 16 bp, Homo sapiens
atggatagagaagaaa

SEQ ID NO: 6669390 - DNA, 15 bp, Homo sapiens
atggatatatttgaa

SEQ ID NO: 6669391 - DNA, 21 bp, Homo sapiens
atggatatatttgaaatagta

SEQ ID NO: 6669392 - DNA, 16 bp, Homo sapiens
atggatatcacacata

SEQ ID NO: 6669393 - DNA, 18 bp, Homo sapiens
atggatatgctgctttaa

SEQ ID NO: 6669394 - DNA, 19 bp, Homo sapiens
atggatatgtgtaaatgtt

SEQ ID NO: 6669395 - DNA, 15 bp, Homo sapiens
atggatattagatgc

SEQ ID NO: 6669396 - DNA, 22 bp, Homo sapiens
atggatatttttaatttatgat

SEQ ID NO: 6669397 - DNA, 22 bp, Homo sapiens
atggatccccagtgaaaactag

SEQ ID NO: 6669398 - DNA, 14 bp, Homo sapiens
atggatcccgaaga

SEQ ID NO: 6669399 - DNA, 18 bp, Homo sapiens
atggatccttccatcttg

SEQ ID NO: 6669400 - DNA, 14 bp, Homo sapiens
atggatctgatctg

SEQ ID NO: 6669401 - DNA, 13 bp, Homo sapiens
atggatctgattt

SEQ ID NO: 6669402 - DNA, 16 bp, Homo sapiens
atggatgaactgaaag

SEQ ID NO: 6669403 - DNA, 22 bp, Homo sapiens
atggatgaatctcccactccag

SEQ ID NO: 6669404 - DNA, 13 bp, Homo sapiens
atggatgaattat

SEQ ID NO: 6669405 - DNA, 16 bp, Homo sapiens
atggatgacaaagaaa

SEQ ID NO: 6669406 - DNA, 21 bp, Homo sapiens
atggatgagtaaactgtttct

SEQ ID NO: 6669407 - DNA, 14 bp, Homo sapiens
atggatgattaaat

SEQ ID NO: 6669408 - DNA, 15 bp, Homo sapiens
atggatgatttaagt

SEQ ID NO: 6669409 - DNA, 15 bp, Homo sapiens
atggatgcatttcaa

SEQ ID NO: 6669410 - DNA, 18 bp, Homo sapiens
atggatgcatttcaaatg

SEQ ID NO: 6669411 - DNA, 20 bp, Homo sapiens
atggatgcatttcaaatgtt

SEQ ID NO: 6669412 - DNA, 13 bp, Homo sapiens
atggatgccaata

SEQ ID NO: 6669413 - DNA, 22 bp, Homo sapiens
atggatgccaatattaaatctg

SEQ ID NO: 6669414 - DNA, 15 bp, Homo sapiens
atggatgctggggag

SEQ ID NO: 6669415 - DNA, 12 bp, Homo sapiens
atggatggaaaa

SEQ ID NO: 6669416 - DNA, 14 bp, Homo sapiens
atggatggcacaat

SEQ ID NO: 6669417 - DNA, 15 bp, Homo sapiens
atggatgtaatatag

SEQ ID NO: 6669418 - DNA, 13 bp, Homo sapiens
atggatgtaattc

SEQ ID NO: 6669419 - DNA, 12 bp, Homo sapiens
atggatgtattt

SEQ ID NO: 6669420 - DNA, 17 bp, Homo sapiens
atggatgtccccagcag

SEQ ID NO: 6669421 - DNA, 18 bp, Homo sapiens
atggatgtccccagcaga

SEQ ID NO: 6669422 - DNA, 17 bp, Homo sapiens
atggatgtggggtcccc

SEQ ID NO: 6669423 - DNA, 22 bp, Homo sapiens
atggatgtgttattcttgccct

SEQ ID NO: 6669424 - DNA, 12 bp, Homo sapiens
atggattaaaaa

SEQ ID NO: 6669425 - DNA, 14 bp, Homo sapiens
atggattaaatggc

SEQ ID NO: 6669426 - DNA, 16 bp, Homo sapiens
atggattaaatggcac

SEQ ID NO: 6669427 - DNA, 14 bp, Homo sapiens
atggattatttatg

SEQ ID NO: 6669428 - DNA, 20 bp, Homo sapiens
atggattcaattacggactc

SEQ ID NO: 6669429 - DNA, 14 bp, Homo sapiens
atggattcacttct

SEQ ID NO: 6669430 - DNA, 12 bp, Homo sapiens
atggattcagca

SEQ ID NO: 6669431 - DNA, 19 bp, Homo sapiens
atggattcagtttctaaaa

SEQ ID NO: 6669432 - DNA, 13 bp, Homo sapiens
atggattctaaaa

SEQ ID NO: 6669433 - DNA, 18 bp, Homo sapiens
atggattctaaaatgcct

SEQ ID NO: 6669434 - DNA, 16 bp, Homo sapiens
atggattctatttatt

SEQ ID NO: 6669435 - DNA, 16 bp, Homo sapiens
atggattctcagatat

SEQ ID NO: 6669436 - DNA, 17 bp, Homo sapiens
atggattctcagatatt

SEQ ID NO: 6669437 - DNA, 18 bp, Homo sapiens
atggattctcagatattt

SEQ ID NO: 6669438 - DNA, 19 bp, Homo sapiens
atggattctccactcagtt

SEQ ID NO: 6669439 - DNA, 13 bp, Homo sapiens
atggattgccaca

SEQ ID NO: 6669440 - DNA, 21 bp, Homo sapiens
atggattgccacagctcaact

SEQ ID NO: 6669441 - DNA, 15 bp, Homo sapiens
atggattggattatt

SEQ ID NO: 6669442 - DNA, 18 bp, Homo sapiens
atggattggtaagatgtc

SEQ ID NO: 6669443 - DNA, 15 bp, Homo sapiens
atggatttaacagca

SEQ ID NO: 6669444 - DNA, 23 bp, Homo sapiens
atggatttaacagcatgacaaaa

SEQ ID NO: 6669445 - DNA, 14 bp, Homo sapiens
atggatttagaaaa

SEQ ID NO: 6669446 - DNA, 14 bp, Homo sapiens
atggatttcagaag

SEQ ID NO: 6669447 - DNA, 17 bp, Homo sapiens
atggatttcagaagcct

SEQ ID NO: 6669448 - DNA, 17 bp, Homo sapiens
atggatttccagttttt

SEQ ID NO: 6669449 - DNA, 20 bp, Homo sapiens
atggatttctgtcttctcta

SEQ ID NO: 6669450 - DNA, 14 bp, Homo sapiens
atggatttgaagca

SEQ ID NO: 6669451 - DNA, 14 bp, Homo sapiens
atggatttgacaca

SEQ ID NO: 6669452 - DNA, 18 bp, Homo sapiens
atggatttgacacactca

SEQ ID NO: 6669453 - DNA, 17 bp, Homo sapiens
atggatttgatgctgtt

SEQ ID NO: 6669454 - DNA, 14 bp, Homo sapiens
atggatttgcctgt

SEQ ID NO: 6669455 - DNA, 19 bp, Homo sapiens
atggatttggactcgaaat

SEQ ID NO: 6669456 - DNA, 22 bp, Homo sapiens
atggatttggttatgatggaaa

SEQ ID NO: 6669457 - DNA, 18 bp, Homo sapiens
atggattttctattgtta

SEQ ID NO: 6669458 - DNA, 17 bp, Homo sapiens
atggattttttttttca

SEQ ID NO: 6669459 - DNA, 14 bp, Homo sapiens
atggcaaaaatggc

SEQ ID NO: 6669460 - DNA, 20 bp, Homo sapiens
atggcaaaagatccaggagt

SEQ ID NO: 6669461 - DNA, 24 bp, Homo sapiens
atggcaaagcggttgcttctggct

SEQ ID NO: 6669462 - DNA, 19 bp, Homo sapiens
atggcaaataaacagtttg

SEQ ID NO: 6669463 - DNA, 23 bp, Homo sapiens
atggcaaatcctgtcggtctcca

SEQ ID NO: 6669464 - DNA, 14 bp, Homo sapiens
atggcaacaaactg

SEQ ID NO: 6669465 - DNA, 20 bp, Homo sapiens
atggcaacaaactgcacatg

SEQ ID NO: 6669466 - DNA, 22 bp, Homo sapiens
atggcaacaaactgcacatgat

SEQ ID NO: 6669467 - DNA, 24 bp, Homo sapiens
atggcaacagatctggaacctcag

SEQ ID NO: 6669468 - DNA, 15 bp, Homo sapiens
atggcaaccattata

SEQ ID NO: 6669469 - DNA, 13 bp, Homo sapiens
atggcaagagaga

SEQ ID NO: 6669470 - DNA, 17 bp, Homo sapiens
atggcaagagatcatat

SEQ ID NO: 6669471 - DNA, 18 bp, Homo sapiens
atggcaagtctagagtct

SEQ ID NO: 6669472 - DNA, 21 bp, Homo sapiens
atggcaagtgatatcacctct

SEQ ID NO: 6669473 - DNA, 23 bp, Homo sapiens
atggcaagttttccatattttta

SEQ ID NO: 6669474 - DNA, 17 bp, Homo sapiens
atggcaagtttttggta

SEQ ID NO: 6669475 - DNA, 18 bp, Homo sapiens
atggcaatagggtagaat

SEQ ID NO: 6669476 - DNA, 14 bp, Homo sapiens
atggcaattctgga

SEQ ID NO: 6669477 - DNA, 15 bp, Homo sapiens
atggcaattttgtaa

SEQ ID NO: 6669478 - DNA, 17 bp, Homo sapiens
atggcacagaaggatct

SEQ ID NO: 6669479 - DNA, 23 bp, Homo sapiens
atggcacagcccaaagaaggaaa

SEQ ID NO: 6669480 - DNA, 20 bp, Homo sapiens
atggcacagggcatgaaatg

SEQ ID NO: 6669481 - DNA, 17 bp, Homo sapiens
atggcacatcagcacga

SEQ ID NO: 6669482 - DNA, 22 bp, Homo sapiens
atggcaccaacgggaccccctg

SEQ ID NO: 6669483 - DNA, 17 bp, Homo sapiens
atggcaccagccccctg

SEQ ID NO: 6669484 - DNA, 16 bp, Homo sapiens
atggcacccacacaga

SEQ ID NO: 6669485 - DNA, 20 bp, Homo sapiens
atggcacctcaggctgaggg

SEQ ID NO: 6669486 - DNA, 14 bp, Homo sapiens
atggcacctgtggc

SEQ ID NO: 6669487 - DNA, 21 bp, Homo sapiens
atggcaccttcagactttgct

SEQ ID NO: 6669488 - DNA, 19 bp, Homo sapiens
atggcacgatctcagctca

SEQ ID NO: 6669489 - DNA, 22 bp, Homo sapiens
atggcactaaaccacttctctg

SEQ ID NO: 6669490 - DNA, 14 bp, Homo sapiens
atggcactagtatt

SEQ ID NO: 6669491 - DNA, 16 bp, Homo sapiens
atggcactagtatttc

SEQ ID NO: 6669492 - DNA, 23 bp, Homo sapiens
atggcactccctccagcacaaac

SEQ ID NO: 6669493 - DNA, 18 bp, Homo sapiens
atggcactgtccagggcc

SEQ ID NO: 6669494 - DNA, 20 bp, Homo sapiens
atggcacttagctatcagaa

SEQ ID NO: 6669495 - DNA, 15 bp, Homo sapiens
atggcacttttgagc

SEQ ID NO: 6669496 - DNA, 19 bp, Homo sapiens
atggcacttttgagctcct

SEQ ID NO: 6669497 - DNA, 19 bp, Homo sapiens
atggcagaagacaccagag

SEQ ID NO: 6669498 - DNA, 20 bp, Homo sapiens
atggcagaagacaccagagc

SEQ ID NO: 6669499 - DNA, 21 bp, Homo sapiens
atggcagaagacaccagagca

SEQ ID NO: 6669500 - DNA, 20 bp, Homo sapiens
atggcagaagcgtctccctt

SEQ ID NO: 6669501 - DNA, 14 bp, Homo sapiens
atggcagaagggaa

SEQ ID NO: 6669502 - DNA, 21 bp, Homo sapiens
atggcagactctttaataaat

SEQ ID NO: 6669503 - DNA, 16 bp, Homo sapiens
atggcagagaagatga

SEQ ID NO: 6669504 - DNA, 15 bp, Homo sapiens
atggcagagccaggc

SEQ ID NO: 6669505 - DNA, 17 bp, Homo sapiens
atggcagagccatccac

SEQ ID NO: 6669506 - DNA, 19 bp, Homo sapiens
atggcagaggaatatcaat

SEQ ID NO: 6669507 - DNA, 22 bp, Homo sapiens
atggcagaggatagtaatgaaa

SEQ ID NO: 6669508 - DNA, 18 bp, Homo sapiens
atggcagagttgtaaata

SEQ ID NO: 6669509 - DNA, 22 bp, Homo sapiens
atggcagagtttgtgtgttgtc

SEQ ID NO: 6669510 - DNA, 14 bp, Homo sapiens
atggcagatacatt

SEQ ID NO: 6669511 - DNA, 12 bp, Homo sapiens
atggcagatgat

SEQ ID NO: 6669512 - DNA, 14 bp, Homo sapiens
atggcagatttgca

SEQ ID NO: 6669513 - DNA, 17 bp, Homo sapiens
atggcagcagaaaactt

SEQ ID NO: 6669514 - DNA, 15 bp, Homo sapiens
atggcagcagccagg

SEQ ID NO: 6669515 - DNA, 16 bp, Homo sapiens
atggcagcaggcctgt

SEQ ID NO: 6669516 - DNA, 16 bp, Homo sapiens
atggcagcctcagggc

SEQ ID NO: 6669517 - DNA, 14 bp, Homo sapiens
atggcagctgccac

SEQ ID NO: 6669518 - DNA, 12 bp, Homo sapiens
atggcagctggg

SEQ ID NO: 6669519 - DNA, 13 bp, Homo sapiens
atggcagctgggc

SEQ ID NO: 6669520 - DNA, 15 bp, Homo sapiens
atggcagctgggccc

SEQ ID NO: 6669521 - DNA, 22 bp, Homo sapiens
atggcagctgggcccacagccc

SEQ ID NO: 6669522 - DNA, 18 bp, Homo sapiens
atggcagctgtttctcat

SEQ ID NO: 6669523 - DNA, 12 bp, Homo sapiens
atggcaggaagg

SEQ ID NO: 6669524 - DNA, 12 bp, Homo sapiens
atggcaggactc

SEQ ID NO: 6669525 - DNA, 18 bp, Homo sapiens
atggcaggactcctggca

SEQ ID NO: 6669526 - DNA, 21 bp, Homo sapiens
atggcaggagaatcagcctgg

SEQ ID NO: 6669527 - DNA, 15 bp, Homo sapiens
atggcaggagagctt

SEQ ID NO: 6669528 - DNA, 20 bp, Homo sapiens
atggcaggagctactgagaa

SEQ ID NO: 6669529 - DNA, 21 bp, Homo sapiens
atggcaggagctactgagaac

SEQ ID NO: 6669530 - DNA, 14 bp, Homo sapiens
atggcaggagtctc

SEQ ID NO: 6669531 - DNA, 19 bp, Homo sapiens
atggcaggagtctctgcca

SEQ ID NO: 6669532 - DNA, 13 bp, Homo sapiens
atggcaggcctga

SEQ ID NO: 6669533 - DNA, 13 bp, Homo sapiens
atggcaggctggg

SEQ ID NO: 6669534 - DNA, 16 bp, Homo sapiens
atggcagggcctcatc

SEQ ID NO: 6669535 - DNA, 17 bp, Homo sapiens
atggcagggcctcatct

SEQ ID NO: 6669536 - DNA, 18 bp, Homo sapiens
atggcagggcctcatctc

SEQ ID NO: 6669537 - DNA, 15 bp, Homo sapiens
atggcagggggctgc

SEQ ID NO: 6669538 - DNA, 16 bp, Homo sapiens
atggcagggggctgct

SEQ ID NO: 6669539 - DNA, 17 bp, Homo sapiens
atggcagggggctgctg

SEQ ID NO: 6669540 - DNA, 17 bp, Homo sapiens
atggcagggggtggaat

SEQ ID NO: 6669541 - DNA, 24 bp, Homo sapiens
atggcagggggtggaattattact

SEQ ID NO: 6669542 - DNA, 16 bp, Homo sapiens
atggcaggtgcctgta

SEQ ID NO: 6669543 - DNA, 12 bp, Homo sapiens
atggcagtattt

SEQ ID NO: 6669544 - DNA, 16 bp, Homo sapiens
atggcagtatttcatt

SEQ ID NO: 6669545 - DNA, 14 bp, Homo sapiens
atggcagtccagcc

SEQ ID NO: 6669546 - DNA, 21 bp, Homo sapiens
atggcagtccagccagctcct

SEQ ID NO: 6669547 - DNA, 18 bp, Homo sapiens
atggcagtcctggaggca

SEQ ID NO: 6669548 - DNA, 21 bp, Homo sapiens
atggcagtgactccccagccc

SEQ ID NO: 6669549 - DNA, 15 bp, Homo sapiens
atggcagtggctgtg

SEQ ID NO: 6669550 - DNA, 15 bp, Homo sapiens
atggcagtgtctttc

SEQ ID NO: 6669551 - DNA, 19 bp, Homo sapiens
atggcagtgtggggagggc

SEQ ID NO: 6669552 - DNA, 21 bp, Homo sapiens
atggcagtgtggggagggcag

SEQ ID NO: 6669553 - DNA, 18 bp, Homo sapiens
atggcagtgttcctattt

SEQ ID NO: 6669554 - DNA, 14 bp, Homo sapiens
atggcagtttgaag

SEQ ID NO: 6669555 - DNA, 14 bp, Homo sapiens
atggcatattgata

SEQ ID NO: 6669556 - DNA, 18 bp, Homo sapiens
atggcatatttttcacat

SEQ ID NO: 6669557 - DNA, 21 bp, Homo sapiens
atggcatatttttcacatatc

SEQ ID NO: 6669558 - DNA, 18 bp, Homo sapiens
atggcatcaaccaccatg

SEQ ID NO: 6669559 - DNA, 15 bp, Homo sapiens
atggcatcacctcca

SEQ ID NO: 6669560 - DNA, 22 bp, Homo sapiens
atggcatcatccattctctctg

SEQ ID NO: 6669561 - DNA, 20 bp, Homo sapiens
atggcatccagggctgccag

SEQ ID NO: 6669562 - DNA, 21 bp, Homo sapiens
atggcatccctttttcataaa

SEQ ID NO: 6669563 - DNA, 17 bp, Homo sapiens
atggcatcctgtgaagt

SEQ ID NO: 6669564 - DNA, 16 bp, Homo sapiens
atggcatcgttgcatt

SEQ ID NO: 6669565 - DNA, 17 bp, Homo sapiens
atggcatctagccagag

SEQ ID NO: 6669566 - DNA, 16 bp, Homo sapiens
atggcatgacaaggtg

SEQ ID NO: 6669567 - DNA, 15 bp, Homo sapiens
atggcatgagaaata

SEQ ID NO: 6669568 - DNA, 18 bp, Homo sapiens
atggcatgagaaatacaa

SEQ ID NO: 6669569 - DNA, 23 bp, Homo sapiens
atggcatgattagattgcaaagc

SEQ ID NO: 6669570 - DNA, 19 bp, Homo sapiens
atggcatgatttatatatg

SEQ ID NO: 6669571 - DNA, 17 bp, Homo sapiens
atggcatgcgccaccat

SEQ ID NO: 6669572 - DNA, 15 bp, Homo sapiens
atggcatgctccttg

SEQ ID NO: 6669573 - DNA, 14 bp, Homo sapiens
atggcatggagact

SEQ ID NO: 6669574 - DNA, 17 bp, Homo sapiens
atggcatggagactctg

SEQ ID NO: 6669575 - DNA, 15 bp, Homo sapiens
atggcatggcaggag

SEQ ID NO: 6669576 - DNA, 20 bp, Homo sapiens
atggcatggtaggctacttt

SEQ ID NO: 6669577 - DNA, 19 bp, Homo sapiens
atggcatgtgaaaagtaaa

SEQ ID NO: 6669578 - DNA, 15 bp, Homo sapiens
atggcatgttttgtc

SEQ ID NO: 6669579 - DNA, 16 bp, Homo sapiens
atggcatgttttgtca

SEQ ID NO: 6669580 - DNA, 18 bp, Homo sapiens
atggcatgttttgtcatt

SEQ ID NO: 6669581 - DNA, 18 bp, Homo sapiens
atggcatttagcacagta

SEQ ID NO: 6669582 - DNA, 21 bp, Homo sapiens
atggcatttagcacagtattt

SEQ ID NO: 6669583 - DNA, 16 bp, Homo sapiens
atggcatttctcttta

SEQ ID NO: 6669584 - DNA, 21 bp, Homo sapiens
atggcatttctctttaaacta

SEQ ID NO: 6669585 - DNA, 14 bp, Homo sapiens
atggcatttgcaga

SEQ ID NO: 6669586 - DNA, 22 bp, Homo sapiens
atggcatttggtctcaggcagc

SEQ ID NO: 6669587 - DNA, 23 bp, Homo sapiens
atggcatttggtctcaggcagca

SEQ ID NO: 6669588 - DNA, 14 bp, Homo sapiens
atggccaaacccaa

SEQ ID NO: 6669589 - DNA, 15 bp, Homo sapiens
atggccaagagcatc

SEQ ID NO: 6669590 - DNA, 22 bp, Homo sapiens
atggccaaggggccagctgccc

SEQ ID NO: 6669591 - DNA, 21 bp, Homo sapiens
atggccaagggggtggacgca

SEQ ID NO: 6669592 - DNA, 15 bp, Homo sapiens
atggccaagtgtaca

SEQ ID NO: 6669593 - DNA, 16 bp, Homo sapiens
atggccacagccacct

SEQ ID NO: 6669594 - DNA, 16 bp, Homo sapiens
atggccacatcctcat

SEQ ID NO: 6669595 - DNA, 22 bp, Homo sapiens
atggccaccccgtgccacccgt

SEQ ID NO: 6669596 - DNA, 14 bp, Homo sapiens
atggccactgctct

SEQ ID NO: 6669597 - DNA, 21 bp, Homo sapiens
atggccagacgtggtggctca

SEQ ID NO: 6669598 - DNA, 18 bp, Homo sapiens
atggccagactcccttgc

SEQ ID NO: 6669599 - DNA, 13 bp, Homo sapiens
atggccagcagca

SEQ ID NO: 6669600 - DNA, 19 bp, Homo sapiens
atggccagccccttagaca

SEQ ID NO: 6669601 - DNA, 22 bp, Homo sapiens
atggccagccccttagacagag

SEQ ID NO: 6669602 - DNA, 23 bp, Homo sapiens
atggccaggaagtagcacaggct

SEQ ID NO: 6669603 - DNA, 15 bp, Homo sapiens
atggccaggagtggg

SEQ ID NO: 6669604 - DNA, 13 bp, Homo sapiens
atggccaggcctc

SEQ ID NO: 6669605 - DNA, 17 bp, Homo sapiens
atggccaggggccagga

SEQ ID NO: 6669606 - DNA, 18 bp, Homo sapiens
atggccaggggccaggag

SEQ ID NO: 6669607 - DNA, 19 bp, Homo sapiens
atggccaggggccaggagt

SEQ ID NO: 6669608 - DNA, 16 bp, Homo sapiens
atggccaggtggccac

SEQ ID NO: 6669609 - DNA, 22 bp, Homo sapiens
atggccaggtggccactccaga

SEQ ID NO: 6669610 - DNA, 17 bp, Homo sapiens
atggccagtgctgcttc

SEQ ID NO: 6669611 - DNA, 16 bp, Homo sapiens
atggccagtgtctgtc

SEQ ID NO: 6669612 - DNA, 22 bp, Homo sapiens
atggccagtgtctgtcccgggg

SEQ ID NO: 6669613 - DNA, 17 bp, Homo sapiens
atggccatagaggccca

SEQ ID NO: 6669614 - DNA, 15 bp, Homo sapiens
atggccatgcaggag

SEQ ID NO: 6669615 - DNA, 16 bp, Homo sapiens
atggcccagcaggcag

SEQ ID NO: 6669616 - DNA, 14 bp, Homo sapiens
atggcccagcctgg

SEQ ID NO: 6669617 - DNA, 15 bp, Homo sapiens
atggcccagcctgga

SEQ ID NO: 6669618 - DNA, 15 bp, Homo sapiens
atggcccatcctgtg

SEQ ID NO: 6669619 - DNA, 14 bp, Homo sapiens
atggccccaacaag

SEQ ID NO: 6669620 - DNA, 17 bp, Homo sapiens
atggccccagcacagct

SEQ ID NO: 6669621 - DNA, 12 bp, Homo sapiens
atggccccagct

SEQ ID NO: 6669622 - DNA, 14 bp, Homo sapiens
atggccccagctgg

SEQ ID NO: 6669623 - DNA, 15 bp, Homo sapiens
atggccccagctggc

SEQ ID NO: 6669624 - DNA, 16 bp, Homo sapiens
atggccccagctggct

SEQ ID NO: 6669625 - DNA, 20 bp, Homo sapiens
atggccccagctggctgggt

SEQ ID NO: 6669626 - DNA, 17 bp, Homo sapiens
atggccccagggttgaa

SEQ ID NO: 6669627 - DNA, 16 bp, Homo sapiens
atggccccatcccagt

SEQ ID NO: 6669628 - DNA, 14 bp, Homo sapiens
atggcccccaataa

SEQ ID NO: 6669629 - DNA, 16 bp, Homo sapiens
atggcccccaataaag

SEQ ID NO: 6669630 - DNA, 20 bp, Homo sapiens
atggcccccaataaaggcag

SEQ ID NO: 6669631 - DNA, 15 bp, Homo sapiens
atggcccccagaggc

SEQ ID NO: 6669632 - DNA, 23 bp, Homo sapiens
atggcccccaggggcaggactga

SEQ ID NO: 6669633 - DNA, 13 bp, Homo sapiens
atggccccccact

SEQ ID NO: 6669634 - DNA, 21 bp, Homo sapiens
atggccccgcaaggcctccag

SEQ ID NO: 6669635 - DNA, 17 bp, Homo sapiens
atggcccctccagcaca

SEQ ID NO: 6669636 - DNA, 19 bp, Homo sapiens
atggcccctccagcacaca

SEQ ID NO: 6669637 - DNA, 16 bp, Homo sapiens
atggcccctccaggaa

SEQ ID NO: 6669638 - DNA, 11 bp, Homo sapiens
atggcccctct

SEQ ID NO: 6669639 - DNA, 17 bp, Homo sapiens
atggcccggatgctgct

SEQ ID NO: 6669640 - DNA, 14 bp, Homo sapiens
atggcccggcccct

SEQ ID NO: 6669641 - DNA, 16 bp, Homo sapiens
atggcccggcccctcc

SEQ ID NO: 6669642 - DNA, 16 bp, Homo sapiens
atggccctcattcagt

SEQ ID NO: 6669643 - DNA, 22 bp, Homo sapiens
atggccctcggaggtccagctg

SEQ ID NO: 6669644 - DNA, 23 bp, Homo sapiens
atggccctcggaggtccagctgg

SEQ ID NO: 6669645 - DNA, 20 bp, Homo sapiens
atggccctgctgcccctccc

SEQ ID NO: 6669646 - DNA, 13 bp, Homo sapiens
atggccctggaca

SEQ ID NO: 6669647 - DNA, 11 bp, Homo sapiens
atggccctggg

SEQ ID NO: 6669648 - DNA, 21 bp, Homo sapiens
atggccctgtagccagcacct

SEQ ID NO: 6669649 - DNA, 14 bp, Homo sapiens
atggccctgtccca

SEQ ID NO: 6669650 - DNA, 15 bp, Homo sapiens
atggccctgtcccag

SEQ ID NO: 6669651 - DNA, 18 bp, Homo sapiens
atggcccttcccactgga

SEQ ID NO: 6669652 - DNA, 18 bp, Homo sapiens
atggcccttcctcctcca

SEQ ID NO: 6669653 - DNA, 15 bp, Homo sapiens
atggccgctgcccac

SEQ ID NO: 6669654 - DNA, 21 bp, Homo sapiens
atggccgggcgcggtggctca

SEQ ID NO: 6669655 - DNA, 15 bp, Homo sapiens
atggccgggctgctg

SEQ ID NO: 6669656 - DNA, 16 bp, Homo sapiens
atggccgggctgctgc

SEQ ID NO: 6669657 - DNA, 23 bp, Homo sapiens
atggccgttgcctctctgccagc

SEQ ID NO: 6669658 - DNA, 21 bp, Homo sapiens
atggcctatgtgcgaagcaag

SEQ ID NO: 6669659 - DNA, 13 bp, Homo sapiens
atggcctcagatg

SEQ ID NO: 6669660 - DNA, 17 bp, Homo sapiens
atggcctcagccctgct

SEQ ID NO: 6669661 - DNA, 19 bp, Homo sapiens
atggcctcagccctgctcc

SEQ ID NO: 6669662 - DNA, 21 bp, Homo sapiens
atggcctcagccctgctccct

SEQ ID NO: 6669663 - DNA, 23 bp, Homo sapiens
atggcctcagccctgctccctgc

SEQ ID NO: 6669664 - DNA, 14 bp, Homo sapiens
atggcctcagctgc

SEQ ID NO: 6669665 - DNA, 15 bp, Homo sapiens
atggcctcagctgcc

SEQ ID NO: 6669666 - DNA, 21 bp, Homo sapiens
atggcctcagctgcctcactt

SEQ ID NO: 6669667 - DNA, 17 bp, Homo sapiens
atggcctcatgtggctg

SEQ ID NO: 6669668 - DNA, 17 bp, Homo sapiens
atggcctccagaggagg

SEQ ID NO: 6669669 - DNA, 17 bp, Homo sapiens
atggcctcccagccacc

SEQ ID NO: 6669670 - DNA, 19 bp, Homo sapiens
atggcctcccagccacccg

SEQ ID NO: 6669671 - DNA, 23 bp, Homo sapiens
atggcctcgcctccccaccctcc

SEQ ID NO: 6669672 - DNA, 19 bp, Homo sapiens
atggcctctaagagtgccc

SEQ ID NO: 6669673 - DNA, 12 bp, Homo sapiens
atggcctctggg

SEQ ID NO: 6669674 - DNA, 13 bp, Homo sapiens
atggcctctgggg

SEQ ID NO: 6669675 - DNA, 15 bp, Homo sapiens
atggcctctggggca

SEQ ID NO: 6669676 - DNA, 21 bp, Homo sapiens
atggcctcttactaatgtaaa

SEQ ID NO: 6669677 - DNA, 18 bp, Homo sapiens
atggcctcttcagatctc

SEQ ID NO: 6669678 - DNA, 19 bp, Homo sapiens
atggcctcttgaagagaaa

SEQ ID NO: 6669679 - DNA, 16 bp, Homo sapiens
atggcctctttgtaga

SEQ ID NO: 6669680 - DNA, 19 bp, Homo sapiens
atggcctgacagctctgtt

SEQ ID NO: 6669681 - DNA, 21 bp, Homo sapiens
atggcctgagcatccagacct

SEQ ID NO: 6669682 - DNA, 12 bp, Homo sapiens
atggcctggagc

SEQ ID NO: 6669683 - DNA, 16 bp, Homo sapiens
atggcctggagcaggc

SEQ ID NO: 6669684 - DNA, 18 bp, Homo sapiens
atggcctggagcaggccc

SEQ ID NO: 6669685 - DNA, 20 bp, Homo sapiens
atggcctggagcaggcccaa

SEQ ID NO: 6669686 - DNA, 12 bp, Homo sapiens
atggcctggcca

SEQ ID NO: 6669687 - DNA, 18 bp, Homo sapiens
atggcctggctgcctggt

SEQ ID NO: 6669688 - DNA, 20 bp, Homo sapiens
atggcctgtccctagggctc

SEQ ID NO: 6669689 - DNA, 22 bp, Homo sapiens
atggcctgtccctagggctctc

SEQ ID NO: 6669690 - DNA, 19 bp, Homo sapiens
atggccttcccgccggagg

SEQ ID NO: 6669691 - DNA, 21 bp, Homo sapiens
atggccttcccgccggaggcc

SEQ ID NO: 6669692 - DNA, 17 bp, Homo sapiens
atggcctttccttccct

SEQ ID NO: 6669693 - DNA, 15 bp, Homo sapiens
atggcctttggaccc

SEQ ID NO: 6669694 - DNA, 22 bp, Homo sapiens
atggcctttggacccagggcct

SEQ ID NO: 6669695 - DNA, 23 bp, Homo sapiens
atggccttttgctacgtgcctcc

SEQ ID NO: 6669696 - DNA, 16 bp, Homo sapiens
atggcgaccaccaaag

SEQ ID NO: 6669697 - DNA, 19 bp, Homo sapiens
atggcgattcccattgaaa

SEQ ID NO: 6669698 - DNA, 13 bp, Homo sapiens
atggcgcaggaac

SEQ ID NO: 6669699 - DNA, 17 bp, Homo sapiens
atggcgcagtgcctctg

SEQ ID NO: 6669700 - DNA, 14 bp, Homo sapiens
atggcgccctgcct

SEQ ID NO: 6669701 - DNA, 19 bp, Homo sapiens
atggcgccctgcctcctgg

SEQ ID NO: 6669702 - DNA, 22 bp, Homo sapiens
atggcgcctgctccctccagaa

SEQ ID NO: 6669703 - DNA, 19 bp, Homo sapiens
atggcgcgggaggcaccag

SEQ ID NO: 6669704 - DNA, 17 bp, Homo sapiens
atggcggaggccatggg

SEQ ID NO: 6669705 - DNA, 17 bp, Homo sapiens
atggcggcccctcagcc

SEQ ID NO: 6669706 - DNA, 16 bp, Homo sapiens
atggcggcctgcagtg

SEQ ID NO: 6669707 - DNA, 19 bp, Homo sapiens
atggcggcctgcagtggtg

SEQ ID NO: 6669708 - DNA, 21 bp, Homo sapiens
atggcgtaagtacagagaagc

SEQ ID NO: 6669709 - DNA, 24 bp, Homo sapiens
atggcgtccgtgggttgctaactg

SEQ ID NO: 6669710 - DNA, 13 bp, Homo sapiens
atggcgtctgctc

SEQ ID NO: 6669711 - DNA, 15 bp, Homo sapiens
atggcgtctgctctg

SEQ ID NO: 6669712 - DNA, 17 bp, Homo sapiens
atggcgtctgctctggt

SEQ ID NO: 6669713 - DNA, 20 bp, Homo sapiens
atggcgtgtccctctcggaa

SEQ ID NO: 6669714 - DNA, 15 bp, Homo sapiens
atggcgttggtttgt

SEQ ID NO: 6669715 - DNA, 20 bp, Homo sapiens
atggcgttttgtctgtgttg

SEQ ID NO: 6669716 - DNA, 20 bp, Homo sapiens
atggcgtttttctcgtcccc

SEQ ID NO: 6669717 - DNA, 17 bp, Homo sapiens
atggctaagaccacaga

SEQ ID NO: 6669718 - DNA, 20 bp, Homo sapiens
atggctaagatactgctgat

SEQ ID NO: 6669719 - DNA, 17 bp, Homo sapiens
atggctaataaactgta

SEQ ID NO: 6669720 - DNA, 16 bp, Homo sapiens
atggctaattcccaga

SEQ ID NO: 6669721 - DNA, 16 bp, Homo sapiens
atggctacatctccaa

SEQ ID NO: 6669722 - DNA, 18 bp, Homo sapiens
atggctacctaaaaagat

SEQ ID NO: 6669723 - DNA, 18 bp, Homo sapiens
atggctacctcagaaaga

SEQ ID NO: 6669724 - DNA, 18 bp, Homo sapiens
atggctactttggtttct

SEQ ID NO: 6669725 - DNA, 14 bp, Homo sapiens
atggctagaattat

SEQ ID NO: 6669726 - DNA, 16 bp, Homo sapiens
atggctagtactgtat

SEQ ID NO: 6669727 - DNA, 20 bp, Homo sapiens
atggctagtatcaaaagaaa

SEQ ID NO: 6669728 - DNA, 13 bp, Homo sapiens
atggctataaata

SEQ ID NO: 6669729 - DNA, 15 bp, Homo sapiens
atggctataaatata

SEQ ID NO: 6669730 - DNA, 15 bp, Homo sapiens
atggctataggtgct

SEQ ID NO: 6669731 - DNA, 18 bp, Homo sapiens
atggctatattaggcatg

SEQ ID NO: 6669732 - DNA, 18 bp, Homo sapiens
atggctatcaaaagaaat

SEQ ID NO: 6669733 - DNA, 23 bp, Homo sapiens
atggctatgtagacataaagaag

SEQ ID NO: 6669734 - DNA, 13 bp, Homo sapiens
atggctattttat

SEQ ID NO: 6669735 - DNA, 17 bp, Homo sapiens
atggctcaagtctgcac

SEQ ID NO: 6669736 - DNA, 18 bp, Homo sapiens
atggctcactatggtgcc

SEQ ID NO: 6669737 - DNA, 19 bp, Homo sapiens
atggctcactatggtgcca

SEQ ID NO: 6669738 - DNA, 20 bp, Homo sapiens
atggctcactgcagcctcga

SEQ ID NO: 6669739 - DNA, 21 bp, Homo sapiens
atggctcagagcttgaagatt

SEQ ID NO: 6669740 - DNA, 12 bp, Homo sapiens
atggctcagagg

SEQ ID NO: 6669741 - DNA, 22 bp, Homo sapiens
atggctcagagggggactgctg

SEQ ID NO: 6669742 - DNA, 13 bp, Homo sapiens
atggctcagggtg

SEQ ID NO: 6669743 - DNA, 14 bp, Homo sapiens
atggctcagggtgg

SEQ ID NO: 6669744 - DNA, 18 bp, Homo sapiens
atggctcatgtctgaaaa

SEQ ID NO: 6669745 - DNA, 16 bp, Homo sapiens
atggctccagaaatgt

SEQ ID NO: 6669746 - DNA, 20 bp, Homo sapiens
atggctccagtctgctgccc

SEQ ID NO: 6669747 - DNA, 23 bp, Homo sapiens
atggctccagtctgctgccctcc

SEQ ID NO: 6669748 - DNA, 12 bp, Homo sapiens
atggctcccagg

SEQ ID NO: 6669749 - DNA, 21 bp, Homo sapiens
atggctcccctgaggctggca

SEQ ID NO: 6669750 - DNA, 17 bp, Homo sapiens
atggctccctgggctgg

SEQ ID NO: 6669751 - DNA, 19 bp, Homo sapiens
atggctccctgggctggca

SEQ ID NO: 6669752 - DNA, 18 bp, Homo sapiens
atggctcctgtctggctc

SEQ ID NO: 6669753 - DNA, 16 bp, Homo sapiens
atggctcgtgggctct

SEQ ID NO: 6669754 - DNA, 22 bp, Homo sapiens
atggctctaacattactgcctt

SEQ ID NO: 6669755 - DNA, 23 bp, Homo sapiens
atggctctaacattactgccttc

SEQ ID NO: 6669756 - DNA, 15 bp, Homo sapiens
atggctctatttctt

SEQ ID NO: 6669757 - DNA, 15 bp, Homo sapiens
atggctctcaagtga

SEQ ID NO: 6669758 - DNA, 17 bp, Homo sapiens
atggctctcaagtgaaa

SEQ ID NO: 6669759 - DNA, 22 bp, Homo sapiens
atggctctgcacccctctgccc

SEQ ID NO: 6669760 - DNA, 23 bp, Homo sapiens
atggctctgggcggtccagaagg

SEQ ID NO: 6669761 - DNA, 15 bp, Homo sapiens
atggctctgtgaaat

SEQ ID NO: 6669762 - DNA, 23 bp, Homo sapiens
atggctctgttatgcaagcacaa

SEQ ID NO: 6669763 - DNA, 12 bp, Homo sapiens
atggctcttcat

SEQ ID NO: 6669764 - DNA, 23 bp, Homo sapiens
atggctgaagaaacacagcatgc

SEQ ID NO: 6669765 - DNA, 17 bp, Homo sapiens
atggctgaagctggagc

SEQ ID NO: 6669766 - DNA, 14 bp, Homo sapiens
atggctgagatgga

SEQ ID NO: 6669767 - DNA, 13 bp, Homo sapiens
atggctgagcctc

SEQ ID NO: 6669768 - DNA, 21 bp, Homo sapiens
atggctgagcctcgtgtccag

SEQ ID NO: 6669769 - DNA, 14 bp, Homo sapiens
atggctgcagtcct

SEQ ID NO: 6669770 - DNA, 13 bp, Homo sapiens
atggctgcccagg

SEQ ID NO: 6669771 - DNA, 14 bp, Homo sapiens
atggctgcccagga

SEQ ID NO: 6669772 - DNA, 15 bp, Homo sapiens
atggctgcccaggag

SEQ ID NO: 6669773 - DNA, 17 bp, Homo sapiens
atggctgcccaggagac

SEQ ID NO: 6669774 - DNA, 17 bp, Homo sapiens
atggctgcccccaggaa

SEQ ID NO: 6669775 - DNA, 14 bp, Homo sapiens
atggctgcccctgc

SEQ ID NO: 6669776 - DNA, 22 bp, Homo sapiens
atggctgcccctgcgtggcctg

SEQ ID NO: 6669777 - DNA, 15 bp, Homo sapiens
atggctgctgcctgc

SEQ ID NO: 6669778 - DNA, 18 bp, Homo sapiens
atggctggacatgggtgg

SEQ ID NO: 6669779 - DNA, 22 bp, Homo sapiens
atggctggatgtgcatctggcc

SEQ ID NO: 6669780 - DNA, 23 bp, Homo sapiens
atggctggatgtgcatctggcct

SEQ ID NO: 6669781 - DNA, 14 bp, Homo sapiens
atggctggcctggt

SEQ ID NO: 6669782 - DNA, 23 bp, Homo sapiens
atggctgggaactgcagacctgt

SEQ ID NO: 6669783 - DNA, 19 bp, Homo sapiens
atggctggggggtctcagc

SEQ ID NO: 6669784 - DNA, 13 bp, Homo sapiens
atggctgggtcct

SEQ ID NO: 6669785 - DNA, 13 bp, Homo sapiens
atggctgtaaaac

SEQ ID NO: 6669786 - DNA, 14 bp, Homo sapiens
atggctgtaaacta

SEQ ID NO: 6669787 - DNA, 13 bp, Homo sapiens
atggctgtatttt

SEQ ID NO: 6669788 - DNA, 16 bp, Homo sapiens
atggctgtatttttag

SEQ ID NO: 6669789 - DNA, 16 bp, Homo sapiens
atggctgtcccctgca

SEQ ID NO: 6669790 - DNA, 20 bp, Homo sapiens
atggctgtctcaaaccaagc

SEQ ID NO: 6669791 - DNA, 12 bp, Homo sapiens
atggctgtctgc

SEQ ID NO: 6669792 - DNA, 21 bp, Homo sapiens
atggctgtctgcacagagggt

SEQ ID NO: 6669793 - DNA, 14 bp, Homo sapiens
atggctgtgaggat

SEQ ID NO: 6669794 - DNA, 18 bp, Homo sapiens
atggctgtgccccacctg

SEQ ID NO: 6669795 - DNA, 16 bp, Homo sapiens
atggctgtgcctctgc

SEQ ID NO: 6669796 - DNA, 20 bp, Homo sapiens
atggctgtgtttgcagcctg

SEQ ID NO: 6669797 - DNA, 20 bp, Homo sapiens
atggctgttatctgtcttta

SEQ ID NO: 6669798 - DNA, 17 bp, Homo sapiens
atggcttacttacaaaa

SEQ ID NO: 6669799 - DNA, 21 bp, Homo sapiens
atggcttacttacaaaagcag

SEQ ID NO: 6669800 - DNA, 24 bp, Homo sapiens
atggcttagttaagtcatccacag

SEQ ID NO: 6669801 - DNA, 16 bp, Homo sapiens
atggcttagttttcat

SEQ ID NO: 6669802 - DNA, 15 bp, Homo sapiens
atggcttataaatgt

SEQ ID NO: 6669803 - DNA, 17 bp, Homo sapiens
atggcttatccagctgg

SEQ ID NO: 6669804 - DNA, 22 bp, Homo sapiens
atggcttatttctatgacaaat

SEQ ID NO: 6669805 - DNA, 19 bp, Homo sapiens
atggcttatttgtataatg

SEQ ID NO: 6669806 - DNA, 14 bp, Homo sapiens
atggcttcaccaag

SEQ ID NO: 6669807 - DNA, 19 bp, Homo sapiens
atggcttccgtgagacaca

SEQ ID NO: 6669808 - DNA, 13 bp, Homo sapiens
atggcttcctgag

SEQ ID NO: 6669809 - DNA, 14 bp, Homo sapiens
atggcttctaacaa

SEQ ID NO: 6669810 - DNA, 15 bp, Homo sapiens
atggcttctcctttg

SEQ ID NO: 6669811 - DNA, 21 bp, Homo sapiens
atggcttctcctttggcatgt

SEQ ID NO: 6669812 - DNA, 22 bp, Homo sapiens
atggcttcttctagaatgtaaa

SEQ ID NO: 6669813 - DNA, 13 bp, Homo sapiens
atggcttgacatg

SEQ ID NO: 6669814 - DNA, 18 bp, Homo sapiens
atggcttgacatgtgcaa

SEQ ID NO: 6669815 - DNA, 20 bp, Homo sapiens
atggcttgggctggagtggg

SEQ ID NO: 6669816 - DNA, 17 bp, Homo sapiens
atggcttggggagcaga

SEQ ID NO: 6669817 - DNA, 13 bp, Homo sapiens
atggcttgtctat

SEQ ID NO: 6669818 - DNA, 20 bp, Homo sapiens
atggcttgtctatactcctt

SEQ ID NO: 6669819 - DNA, 17 bp, Homo sapiens
atggcttgttctctgga

SEQ ID NO: 6669820 - DNA, 18 bp, Homo sapiens
atggcttgttctctggaa

SEQ ID NO: 6669821 - DNA, 20 bp, Homo sapiens
atggctttaaataaattaag

SEQ ID NO: 6669822 - DNA, 19 bp, Homo sapiens
atggctttaacagtaatgt

SEQ ID NO: 6669823 - DNA, 15 bp, Homo sapiens
atggctttaattata

SEQ ID NO: 6669824 - DNA, 23 bp, Homo sapiens
atggctttatttttttgaactct

SEQ ID NO: 6669825 - DNA, 15 bp, Homo sapiens
atggctttcaaagct

SEQ ID NO: 6669826 - DNA, 17 bp, Homo sapiens
atggctttgtcttgaaa

SEQ ID NO: 6669827 - DNA, 13 bp, Homo sapiens
atggctttgtgct

SEQ ID NO: 6669828 - DNA, 20 bp, Homo sapiens
atggcttttgctttccctga

SEQ ID NO: 6669829 - DNA, 18 bp, Homo sapiens
atggcttttgtgcattat

SEQ ID NO: 6669830 - DNA, 14 bp, Homo sapiens
atggctttttttgc

SEQ ID NO: 6669831 - DNA, 17 bp, Homo sapiens
atgggaaaaagagactc

SEQ ID NO: 6669832 - DNA, 21 bp, Homo sapiens
atgggaaaacttcactccaaa

SEQ ID NO: 6669833 - DNA, 14 bp, Homo sapiens
atgggaaactgttg

SEQ ID NO: 6669834 - DNA, 16 bp, Homo sapiens
atgggaaactttccct

SEQ ID NO: 6669835 - DNA, 17 bp, Homo sapiens
atgggaaagagaaagag

SEQ ID NO: 6669836 - DNA, 17 bp, Homo sapiens
atgggaaagccacctct

SEQ ID NO: 6669837 - DNA, 22 bp, Homo sapiens
atgggaaagtatttttgaaaga

SEQ ID NO: 6669838 - DNA, 14 bp, Homo sapiens
atgggaaagtgcaa

SEQ ID NO: 6669839 - DNA, 18 bp, Homo sapiens
atgggaaataaagaaaat

SEQ ID NO: 6669840 - DNA, 19 bp, Homo sapiens
atgggaaatagcggccctg

SEQ ID NO: 6669841 - DNA, 20 bp, Homo sapiens
atgggaaatagcggccctgg

SEQ ID NO: 6669842 - DNA, 16 bp, Homo sapiens
atgggaacaaggaagg

SEQ ID NO: 6669843 - DNA, 16 bp, Homo sapiens
atgggaacaagtgtac

SEQ ID NO: 6669844 - DNA, 23 bp, Homo sapiens
atgggaacaagtgtacagaagaa

SEQ ID NO: 6669845 - DNA, 15 bp, Homo sapiens
atgggaacatttatt

SEQ ID NO: 6669846 - DNA, 23 bp, Homo sapiens
atgggaacatttattttatgaga

SEQ ID NO: 6669847 - DNA, 23 bp, Homo sapiens
atgggaacctagtactctctgct

SEQ ID NO: 6669848 - DNA, 14 bp, Homo sapiens
atgggaacctcata

SEQ ID NO: 6669849 - DNA, 13 bp, Homo sapiens
atgggaacgcagc

SEQ ID NO: 6669850 - DNA, 19 bp, Homo sapiens
atgggaagatggtagcaga

SEQ ID NO: 6669851 - DNA, 22 bp, Homo sapiens
atgggaagatggtagcagataa

SEQ ID NO: 6669852 - DNA, 15 bp, Homo sapiens
atgggaagcattagt

SEQ ID NO: 6669853 - DNA, 22 bp, Homo sapiens
atgggaagccatattcacacct

SEQ ID NO: 6669854 - DNA, 13 bp, Homo sapiens
atgggaaggaggg

SEQ ID NO: 6669855 - DNA, 14 bp, Homo sapiens
atgggaaggaggga

SEQ ID NO: 6669856 - DNA, 17 bp, Homo sapiens
atgggaaggagggaggt

SEQ ID NO: 6669857 - DNA, 21 bp, Homo sapiens
atgggaaggtgggcgggcagg

SEQ ID NO: 6669858 - DNA, 16 bp, Homo sapiens
atgggaatacaaaagg

SEQ ID NO: 6669859 - DNA, 16 bp, Homo sapiens
atgggaatgaagcttg

SEQ ID NO: 6669860 - DNA, 18 bp, Homo sapiens
atgggaatgaggtgggag

SEQ ID NO: 6669861 - DNA, 23 bp, Homo sapiens
atgggaattctttacaataaaca

SEQ ID NO: 6669862 - DNA, 14 bp, Homo sapiens
atgggaattgtgtg

SEQ ID NO: 6669863 - DNA, 15 bp, Homo sapiens
atgggaattgtgtga

SEQ ID NO: 6669864 - DNA, 14 bp, Homo sapiens
atgggaatttgtca

SEQ ID NO: 6669865 - DNA, 15 bp, Homo sapiens
atgggacagcaacaa

SEQ ID NO: 6669866 - DNA, 17 bp, Homo sapiens
atgggacagggaggcca

SEQ ID NO: 6669867 - DNA, 14 bp, Homo sapiens
atgggaccgtgccc

SEQ ID NO: 6669868 - DNA, 17 bp, Homo sapiens
atgggaccgtgccccac

SEQ ID NO: 6669869 - DNA, 12 bp, Homo sapiens
atgggacctgat

SEQ ID NO: 6669870 - DNA, 19 bp, Homo sapiens
atgggacctgtggctgtcg

SEQ ID NO: 6669871 - DNA, 22 bp, Homo sapiens
atgggactcattgtagaaagga

SEQ ID NO: 6669872 - DNA, 19 bp, Homo sapiens
atgggactgatgtcatctt

SEQ ID NO: 6669873 - DNA, 21 bp, Homo sapiens
atgggactggagtcagatgag

SEQ ID NO: 6669874 - DNA, 21 bp, Homo sapiens
atgggactggagtccctgtga

SEQ ID NO: 6669875 - DNA, 15 bp, Homo sapiens
atgggactgggaggg

SEQ ID NO: 6669876 - DNA, 17 bp, Homo sapiens
atgggactgggagggcc

SEQ ID NO: 6669877 - DNA, 22 bp, Homo sapiens
atgggactttccttccctctcc

SEQ ID NO: 6669878 - DNA, 22 bp, Homo sapiens
atgggagaaaacgccagtgtgt

SEQ ID NO: 6669879 - DNA, 15 bp, Homo sapiens
atgggagagaagaga

SEQ ID NO: 6669880 - DNA, 23 bp, Homo sapiens
atgggagaggcaataaataaatg

SEQ ID NO: 6669881 - DNA, 15 bp, Homo sapiens
atgggagagtagatg

SEQ ID NO: 6669882 - DNA, 16 bp, Homo sapiens
atgggagagtccaggc

SEQ ID NO: 6669883 - DNA, 16 bp, Homo sapiens
atgggagatggtcagt

SEQ ID NO: 6669884 - DNA, 20 bp, Homo sapiens
atgggagattaaaaccagag

SEQ ID NO: 6669885 - DNA, 12 bp, Homo sapiens
atgggagccagc

SEQ ID NO: 6669886 - DNA, 12 bp, Homo sapiens
atgggagccagg

SEQ ID NO: 6669887 - DNA, 15 bp, Homo sapiens
atgggagccaggagt

SEQ ID NO: 6669888 - DNA, 18 bp, Homo sapiens
atgggagccaggcccaga

SEQ ID NO: 6669889 - DNA, 13 bp, Homo sapiens
atgggagccccag

SEQ ID NO: 6669890 - DNA, 22 bp, Homo sapiens
atgggagccccagggtcttccc

SEQ ID NO: 6669891 - DNA, 20 bp, Homo sapiens
atgggagccgggtctgcctc

SEQ ID NO: 6669892 - DNA, 13 bp, Homo sapiens
atgggagctcatg

SEQ ID NO: 6669893 - DNA, 14 bp, Homo sapiens
atgggagctcctct

SEQ ID NO: 6669894 - DNA, 20 bp, Homo sapiens
atgggagctcctctcctgga

SEQ ID NO: 6669895 - DNA, 21 bp, Homo sapiens
atgggagctcctctcctggag

SEQ ID NO: 6669896 - DNA, 20 bp, Homo sapiens
atgggagctggttagaaatg

SEQ ID NO: 6669897 - DNA, 13 bp, Homo sapiens
atgggaggaaaga

SEQ ID NO: 6669898 - DNA, 18 bp, Homo sapiens
atgggaggaaagagagca

SEQ ID NO: 6669899 - DNA, 18 bp, Homo sapiens
atgggaggaacaaagaca

SEQ ID NO: 6669900 - DNA, 23 bp, Homo sapiens
atgggaggaaggcccaggggtgg

SEQ ID NO: 6669901 - DNA, 18 bp, Homo sapiens
atgggaggagagccactg

SEQ ID NO: 6669902 - DNA, 18 bp, Homo sapiens
atgggaggcagccgaggc

SEQ ID NO: 6669903 - DNA, 21 bp, Homo sapiens
atgggaggcctttccctaagc

SEQ ID NO: 6669904 - DNA, 23 bp, Homo sapiens
atgggaggctcacccccttctcc

SEQ ID NO: 6669905 - DNA, 13 bp, Homo sapiens
atgggaggctcct

SEQ ID NO: 6669906 - DNA, 14 bp, Homo sapiens
atgggaggctcctg

SEQ ID NO: 6669907 - DNA, 16 bp, Homo sapiens
atgggagggagggaga

SEQ ID NO: 6669908 - DNA, 15 bp, Homo sapiens
atgggagggatcagc

SEQ ID NO: 6669909 - DNA, 21 bp, Homo sapiens
atgggagggatggcccttcct

SEQ ID NO: 6669910 - DNA, 15 bp, Homo sapiens
atgggagggggctcc

SEQ ID NO: 6669911 - DNA, 22 bp, Homo sapiens
atgggagggggcttgaagccaa

SEQ ID NO: 6669912 - DNA, 23 bp, Homo sapiens
atgggagggggcttgaagccaaa

SEQ ID NO: 6669913 - DNA, 20 bp, Homo sapiens
atgggaggtatgggctgggg

SEQ ID NO: 6669914 - DNA, 15 bp, Homo sapiens
atgggaggtggaagc

SEQ ID NO: 6669915 - DNA, 15 bp, Homo sapiens
atgggagtaagagca

SEQ ID NO: 6669916 - DNA, 18 bp, Homo sapiens
atgggagtaggctccaga

SEQ ID NO: 6669917 - DNA, 21 bp, Homo sapiens
atgggagtaggctccagacag

SEQ ID NO: 6669918 - DNA, 22 bp, Homo sapiens
atgggagtaggctccagacagg

SEQ ID NO: 6669919 - DNA, 19 bp, Homo sapiens
atgggagtcagggagccct

SEQ ID NO: 6669920 - DNA, 15 bp, Homo sapiens
atgggagtctgaaat

SEQ ID NO: 6669921 - DNA, 16 bp, Homo sapiens
atgggagtctgaaatg

SEQ ID NO: 6669922 - DNA, 19 bp, Homo sapiens
atgggagtgaacatttcta

SEQ ID NO: 6669923 - DNA, 20 bp, Homo sapiens
atgggagtgggcacctcaga

SEQ ID NO: 6669924 - DNA, 20 bp, Homo sapiens
atgggatatgattggttcag

SEQ ID NO: 6669925 - DNA, 23 bp, Homo sapiens
atgggatattttgaaatgaactt

SEQ ID NO: 6669926 - DNA, 23 bp, Homo sapiens
atgggatcatttttccaggactc

SEQ ID NO: 6669927 - DNA, 20 bp, Homo sapiens
atgggatcctctccaccctc

SEQ ID NO: 6669928 - DNA, 18 bp, Homo sapiens
atgggatgattgaagaaa

SEQ ID NO: 6669929 - DNA, 17 bp, Homo sapiens
atgggatgggctttctc

SEQ ID NO: 6669930 - DNA, 23 bp, Homo sapiens
atgggatgtatgaatacagcagc

SEQ ID NO: 6669931 - DNA, 17 bp, Homo sapiens
atgggatgtatttttct

SEQ ID NO: 6669932 - DNA, 17 bp, Homo sapiens
atgggattctggacagg

SEQ ID NO: 6669933 - DNA, 22 bp, Homo sapiens
atgggattggtgggctgattta

SEQ ID NO: 6669934 - DNA, 22 bp, Homo sapiens
atgggcaaaatggctagaatta

SEQ ID NO: 6669935 - DNA, 20 bp, Homo sapiens
atgggcaaaccctggtgctt

SEQ ID NO: 6669936 - DNA, 18 bp, Homo sapiens
atgggcaacccccagcct

SEQ ID NO: 6669937 - DNA, 19 bp, Homo sapiens
atgggcaacccccagcctg

SEQ ID NO: 6669938 - DNA, 23 bp, Homo sapiens
atgggcaactcgtgacagcctct

SEQ ID NO: 6669939 - DNA, 23 bp, Homo sapiens
atgggcaactggctgaaaggtta

SEQ ID NO: 6669940 - DNA, 20 bp, Homo sapiens
atgggcaaggggccaggaag

SEQ ID NO: 6669941 - DNA, 20 bp, Homo sapiens
atgggcaatcctgggctggc

SEQ ID NO: 6669942 - DNA, 23 bp, Homo sapiens
atgggcaattctgacttctccca

SEQ ID NO: 6669943 - DNA, 20 bp, Homo sapiens
atgggcacaaagggcccaga

SEQ ID NO: 6669944 - DNA, 13 bp, Homo sapiens
atgggcacaggct

SEQ ID NO: 6669945 - DNA, 19 bp, Homo sapiens
atgggcacaggctgcccca

SEQ ID NO: 6669946 - DNA, 21 bp, Homo sapiens
atgggcacaggctgccccacc

SEQ ID NO: 6669947 - DNA, 16 bp, Homo sapiens
atgggcacatgaggag

SEQ ID NO: 6669948 - DNA, 16 bp, Homo sapiens
atgggcacctctgctg

SEQ ID NO: 6669949 - DNA, 14 bp, Homo sapiens
atgggcactggaaa

SEQ ID NO: 6669950 - DNA, 13 bp, Homo sapiens
atgggcagagcag

SEQ ID NO: 6669951 - DNA, 15 bp, Homo sapiens
atgggcagagcagag

SEQ ID NO: 6669952 - DNA, 18 bp, Homo sapiens
atgggcagcaattcacgc

SEQ ID NO: 6669953 - DNA, 20 bp, Homo sapiens
atgggcagctggggggctgt

SEQ ID NO: 6669954 - DNA, 12 bp, Homo sapiens
atgggcaggaga

SEQ ID NO: 6669955 - DNA, 17 bp, Homo sapiens
atgggcaggtggcctct

SEQ ID NO: 6669956 - DNA, 20 bp, Homo sapiens
atgggcagtgcctcctggga

SEQ ID NO: 6669957 - DNA, 16 bp, Homo sapiens
atgggcagttctccca

SEQ ID NO: 6669958 - DNA, 19 bp, Homo sapiens
atgggcagttctcccaggg

SEQ ID NO: 6669959 - DNA, 15 bp, Homo sapiens
atgggcagtttcagt

SEQ ID NO: 6669960 - DNA, 17 bp, Homo sapiens
atgggcatctatgggag

SEQ ID NO: 6669961 - DNA, 17 bp, Homo sapiens
atgggcatcttttgtat

SEQ ID NO: 6669962 - DNA, 20 bp, Homo sapiens
atgggcatcttttgtattaa

SEQ ID NO: 6669963 - DNA, 16 bp, Homo sapiens
atgggcattgcagcct

SEQ ID NO: 6669964 - DNA, 19 bp, Homo sapiens
atgggcattgcagccttgc

SEQ ID NO: 6669965 - DNA, 18 bp, Homo sapiens
atgggcattgggctgaca

SEQ ID NO: 6669966 - DNA, 21 bp, Homo sapiens
atgggcattgggctgacacct

SEQ ID NO: 6669967 - DNA, 15 bp, Homo sapiens
atgggccaagccagg

SEQ ID NO: 6669968 - DNA, 13 bp, Homo sapiens
atgggccaccgcc

SEQ ID NO: 6669969 - DNA, 18 bp, Homo sapiens
atgggccaccgccttgcc

SEQ ID NO: 6669970 - DNA, 20 bp, Homo sapiens
atgggccacggctgagcctt

SEQ ID NO: 6669971 - DNA, 23 bp, Homo sapiens
atgggccactgaaatctgtcaag

SEQ ID NO: 6669972 - DNA, 15 bp, Homo sapiens
atgggccagcccctc

SEQ ID NO: 6669973 - DNA, 20 bp, Homo sapiens
atgggccagcccctccatct

SEQ ID NO: 6669974 - DNA, 12 bp, Homo sapiens
atgggccagcct

SEQ ID NO: 6669975 - DNA, 15 bp, Homo sapiens
atgggccagcctagc

SEQ ID NO: 6669976 - DNA, 17 bp, Homo sapiens
atgggccagcctagccc

SEQ ID NO: 6669977 - DNA, 23 bp, Homo sapiens
atgggccagggtttacccagtgg

SEQ ID NO: 6669978 - DNA, 22 bp, Homo sapiens
atgggccccgccttcctgggca

SEQ ID NO: 6669979 - DNA, 12 bp, Homo sapiens
atgggcccctgg

SEQ ID NO: 6669980 - DNA, 23 bp, Homo sapiens
atgggcccgcctcggcctcccaa

SEQ ID NO: 6669981 - DNA, 18 bp, Homo sapiens
atgggcccgctgcctctt

SEQ ID NO: 6669982 - DNA, 20 bp, Homo sapiens
atgggccctatgtctcagga

SEQ ID NO: 6669983 - DNA, 12 bp, Homo sapiens
atgggccctcag

SEQ ID NO: 6669984 - DNA, 19 bp, Homo sapiens
atgggcccttggaaaaaca

SEQ ID NO: 6669985 - DNA, 16 bp, Homo sapiens
atgggccgagccacct

SEQ ID NO: 6669986 - DNA, 14 bp, Homo sapiens
atgggccggccccc

SEQ ID NO: 6669987 - DNA, 18 bp, Homo sapiens
atgggccggcccccttcc

SEQ ID NO: 6669988 - DNA, 20 bp, Homo sapiens
atgggccggcccccttcctg

SEQ ID NO: 6669989 - DNA, 17 bp, Homo sapiens
atgggccgtcccctctc

SEQ ID NO: 6669990 - DNA, 19 bp, Homo sapiens
atgggccgtcccctctccc

SEQ ID NO: 6669991 - DNA, 20 bp, Homo sapiens
atgggccgtcccctctcccc

SEQ ID NO: 6669992 - DNA, 22 bp, Homo sapiens
atgggccgtcccctctcccctt

SEQ ID NO: 6669993 - DNA, 17 bp, Homo sapiens
atgggcctcatgaataa

SEQ ID NO: 6669994 - DNA, 15 bp, Homo sapiens
atgggcctcctgtgt

SEQ ID NO: 6669995 - DNA, 16 bp, Homo sapiens
atgggcctctctgggg

SEQ ID NO: 6669996 - DNA, 21 bp, Homo sapiens
atgggcctctctgggggaggc

SEQ ID NO: 6669997 - DNA, 22 bp, Homo sapiens
atgggcctgaactcggacaagt

SEQ ID NO: 6669998 - DNA, 13 bp, Homo sapiens
atgggcctgcctg

SEQ ID NO: 6669999 - DNA, 14 bp, Homo sapiens
atgggcctgcctgc

SEQ ID NO: 6670000 - DNA, 16 bp, Homo sapiens
atgggcctgcctgcct

SEQ ID NO: 6670001 - DNA, 23 bp, Homo sapiens
atgggcctgcctgcctccacccg

SEQ ID NO: 6670002 - DNA, 19 bp, Homo sapiens
atgggcctgtatgagacag

SEQ ID NO: 6670003 - DNA, 21 bp, Homo sapiens
atgggccttgctttgggcttt

SEQ ID NO: 6670004 - DNA, 18 bp, Homo sapiens
atgggccttttagaaacc

SEQ ID NO: 6670005 - DNA, 20 bp, Homo sapiens
atgggccttttcttgaataa

SEQ ID NO: 6670006 - DNA, 21 bp, Homo sapiens
atgggcgaccagggccatctc

SEQ ID NO: 6670007 - DNA, 15 bp, Homo sapiens
atgggcgcaggccca

SEQ ID NO: 6670008 - DNA, 14 bp, Homo sapiens
atgggcgggcagtc

SEQ ID NO: 6670009 - DNA, 15 bp, Homo sapiens
atgggcgggggtggt

SEQ ID NO: 6670010 - DNA, 16 bp, Homo sapiens
atgggctaatgaagat

SEQ ID NO: 6670011 - DNA, 16 bp, Homo sapiens
atgggctcagggccag

SEQ ID NO: 6670012 - DNA, 17 bp, Homo sapiens
atgggctcagggccagg

SEQ ID NO: 6670013 - DNA, 14 bp, Homo sapiens
atgggctccccagg

SEQ ID NO: 6670014 - DNA, 17 bp, Homo sapiens
atgggctctacctctct

SEQ ID NO: 6670015 - DNA, 22 bp, Homo sapiens
atgggctctacctctctttctc

SEQ ID NO: 6670016 - DNA, 14 bp, Homo sapiens
atgggctctggccc

SEQ ID NO: 6670017 - DNA, 15 bp, Homo sapiens
atgggctcttccaac

SEQ ID NO: 6670018 - DNA, 20 bp, Homo sapiens
atgggctgagctagcctcca

SEQ ID NO: 6670019 - DNA, 12 bp, Homo sapiens
atgggctgcaga

SEQ ID NO: 6670020 - DNA, 14 bp, Homo sapiens
atgggctgcagaag

SEQ ID NO: 6670021 - DNA, 15 bp, Homo sapiens
atgggctggggcagg

SEQ ID NO: 6670022 - DNA, 19 bp, Homo sapiens
atgggctggggcaggggcc

SEQ ID NO: 6670023 - DNA, 21 bp, Homo sapiens
atgggctggggcaggggcctg

SEQ ID NO: 6670024 - DNA, 22 bp, Homo sapiens
atgggctggggcaggggcctgg

SEQ ID NO: 6670025 - DNA, 21 bp, Homo sapiens
atgggctgggggccagggctg

SEQ ID NO: 6670026 - DNA, 22 bp, Homo sapiens
atgggctgggggccagggctgg

SEQ ID NO: 6670027 - DNA, 14 bp, Homo sapiens
atgggctgggggct

SEQ ID NO: 6670028 - DNA, 18 bp, Homo sapiens
atgggctgtgattactgc

SEQ ID NO: 6670029 - DNA, 20 bp, Homo sapiens
atgggctgtgattactgcaa

SEQ ID NO: 6670030 - DNA, 21 bp, Homo sapiens
atgggctgtgattactgcaat

SEQ ID NO: 6670031 - DNA, 14 bp, Homo sapiens
atgggctgtgtcct

SEQ ID NO: 6670032 - DNA, 16 bp, Homo sapiens
atgggcttagagcagt

SEQ ID NO: 6670033 - DNA, 20 bp, Homo sapiens
atgggcttggacttcctggg

SEQ ID NO: 6670034 - DNA, 23 bp, Homo sapiens
atgggcttggacttcctggggcc

SEQ ID NO: 6670035 - DNA, 12 bp, Homo sapiens
atgggctttctc

SEQ ID NO: 6670036 - DNA, 15 bp, Homo sapiens
atgggctttctcttt

SEQ ID NO: 6670037 - DNA, 22 bp, Homo sapiens
atgggctttgtacgttccttct

SEQ ID NO: 6670038 - DNA, 22 bp, Homo sapiens
atgggcttttggggagccagaa

SEQ ID NO: 6670039 - DNA, 21 bp, Homo sapiens
atgggcttttgttctgagggg

SEQ ID NO: 6670040 - DNA, 22 bp, Homo sapiens
atggggaaactgagggcagaga

SEQ ID NO: 6670041 - DNA, 17 bp, Homo sapiens
atggggaactcccccag

SEQ ID NO: 6670042 - DNA, 18 bp, Homo sapiens
atggggaactcccccaga

SEQ ID NO: 6670043 - DNA, 20 bp, Homo sapiens
atggggaaggcagaggctgg

SEQ ID NO: 6670044 - DNA, 15 bp, Homo sapiens
atggggaagtgctcc

SEQ ID NO: 6670045 - DNA, 20 bp, Homo sapiens
atggggacatttcttcccca

SEQ ID NO: 6670046 - DNA, 14 bp, Homo sapiens
atggggacctgggg

SEQ ID NO: 6670047 - DNA, 16 bp, Homo sapiens
atggggactctccagg

SEQ ID NO: 6670048 - DNA, 16 bp, Homo sapiens
atggggagctggccta

SEQ ID NO: 6670049 - DNA, 13 bp, Homo sapiens
atggggaggagac

SEQ ID NO: 6670050 - DNA, 14 bp, Homo sapiens
atggggaggaggag

SEQ ID NO: 6670051 - DNA, 17 bp, Homo sapiens
atggggaggcaagtgtg

SEQ ID NO: 6670052 - DNA, 21 bp, Homo sapiens
atggggaggcaagtgtggggg

SEQ ID NO: 6670053 - DNA, 18 bp, Homo sapiens
atggggaggcagcagagc

SEQ ID NO: 6670054 - DNA, 17 bp, Homo sapiens
atggggaggccctgcct

SEQ ID NO: 6670055 - DNA, 11 bp, Homo sapiens
atggggagggg

SEQ ID NO: 6670056 - DNA, 12 bp, Homo sapiens
atggggagggga

SEQ ID NO: 6670057 - DNA, 16 bp, Homo sapiens
atggggaggggagaga

SEQ ID NO: 6670058 - DNA, 17 bp, Homo sapiens
atggggataaaatgact

SEQ ID NO: 6670059 - DNA, 16 bp, Homo sapiens
atggggatagtctggg

SEQ ID NO: 6670060 - DNA, 20 bp, Homo sapiens
atggggatctggggggtggg

SEQ ID NO: 6670061 - DNA, 23 bp, Homo sapiens
atggggatctggggggtggggag

SEQ ID NO: 6670062 - DNA, 12 bp, Homo sapiens
atggggatgcag

SEQ ID NO: 6670063 - DNA, 18 bp, Homo sapiens
atggggatgcttccgcct

SEQ ID NO: 6670064 - DNA, 20 bp, Homo sapiens
atggggattcaggggctttg

SEQ ID NO: 6670065 - DNA, 15 bp, Homo sapiens
atggggcaagacaga

SEQ ID NO: 6670066 - DNA, 17 bp, Homo sapiens
atggggcaagccagggc

SEQ ID NO: 6670067 - DNA, 18 bp, Homo sapiens
atggggcaagccagggcc

SEQ ID NO: 6670068 - DNA, 21 bp, Homo sapiens
atggggcaagccagggcccag

SEQ ID NO: 6670069 - DNA, 15 bp, Homo sapiens
atggggcagcctcca

SEQ ID NO: 6670070 - DNA, 16 bp, Homo sapiens
atggggcagcctccag

SEQ ID NO: 6670071 - DNA, 19 bp, Homo sapiens
atggggccagatccagcct

SEQ ID NO: 6670072 - DNA, 12 bp, Homo sapiens
atggggcctccc

SEQ ID NO: 6670073 - DNA, 19 bp, Homo sapiens
atggggcctccctccttgg

SEQ ID NO: 6670074 - DNA, 12 bp, Homo sapiens
atggggcctctg

SEQ ID NO: 6670075 - DNA, 21 bp, Homo sapiens
atggggcgatcaagtccagag

SEQ ID NO: 6670076 - DNA, 19 bp, Homo sapiens
atggggctcagatggactg

SEQ ID NO: 6670077 - DNA, 21 bp, Homo sapiens
atggggctcagatggactggg

SEQ ID NO: 6670078 - DNA, 18 bp, Homo sapiens
atggggctcccagctcct

SEQ ID NO: 6670079 - DNA, 22 bp, Homo sapiens
atggggctgaacggggagaaaa

SEQ ID NO: 6670080 - DNA, 20 bp, Homo sapiens
atggggctggcatgttttct

SEQ ID NO: 6670081 - DNA, 23 bp, Homo sapiens
atggggctggggtcctcctgtgc

SEQ ID NO: 6670082 - DNA, 11 bp, Homo sapiens
atgggggaaag

SEQ ID NO: 6670083 - DNA, 21 bp, Homo sapiens
atgggggaaagcaaagcacag

SEQ ID NO: 6670084 - DNA, 23 bp, Homo sapiens
atgggggaaagcaaagcacagag

SEQ ID NO: 6670085 - DNA, 23 bp, Homo sapiens
atgggggaagattttatgcacag

SEQ ID NO: 6670086 - DNA, 21 bp, Homo sapiens
atgggggacaggatttggcca

SEQ ID NO: 6670087 - DNA, 18 bp, Homo sapiens
atgggggaggctctgaag

SEQ ID NO: 6670088 - DNA, 19 bp, Homo sapiens
atgggggaggggggaagga

SEQ ID NO: 6670089 - DNA, 16 bp, Homo sapiens
atgggggatgtggcca

SEQ ID NO: 6670090 - DNA, 22 bp, Homo sapiens
atgggggatttcaaacttaaac

SEQ ID NO: 6670091 - DNA, 15 bp, Homo sapiens
atgggggcaagaaga

SEQ ID NO: 6670092 - DNA, 17 bp, Homo sapiens
atgggggcactgaggac

SEQ ID NO: 6670093 - DNA, 15 bp, Homo sapiens
atgggggcagtctcc

SEQ ID NO: 6670094 - DNA, 18 bp, Homo sapiens
atgggggcatctcttccc

SEQ ID NO: 6670095 - DNA, 22 bp, Homo sapiens
atgggggcatctcttccccaga

SEQ ID NO: 6670096 - DNA, 16 bp, Homo sapiens
atgggggcccaaaggg

SEQ ID NO: 6670097 - DNA, 15 bp, Homo sapiens
atgggggcctggatt

SEQ ID NO: 6670098 - DNA, 17 bp, Homo sapiens
atgggggctcctggcag

SEQ ID NO: 6670099 - DNA, 15 bp, Homo sapiens
atgggggctctgcac

SEQ ID NO: 6670100 - DNA, 14 bp, Homo sapiens
atgggggctggagg

SEQ ID NO: 6670101 - DNA, 21 bp, Homo sapiens
atgggggctttcggggagggc

SEQ ID NO: 6670102 - DNA, 20 bp, Homo sapiens
atggggggagcaccctgagg

SEQ ID NO: 6670103 - DNA, 20 bp, Homo sapiens
atggggggaggggggagggc

SEQ ID NO: 6670104 - DNA, 17 bp, Homo sapiens
atggggggcgggccagg

SEQ ID NO: 6670105 - DNA, 19 bp, Homo sapiens
atggggggctgatggctgc

SEQ ID NO: 6670106 - DNA, 14 bp, Homo sapiens
atgggggtaaagtt

SEQ ID NO: 6670107 - DNA, 17 bp, Homo sapiens
atgggggtagcagctgg

SEQ ID NO: 6670108 - DNA, 19 bp, Homo sapiens
atgggggtagcagctggac

SEQ ID NO: 6670109 - DNA, 17 bp, Homo sapiens
atgggggtgcaggcagc

SEQ ID NO: 6670110 - DNA, 22 bp, Homo sapiens
atgggggtgctgcagccaggag

SEQ ID NO: 6670111 - DNA, 21 bp, Homo sapiens
atgggggtgtgatttgtgaaa

SEQ ID NO: 6670112 - DNA, 14 bp, Homo sapiens
atgggggtttcacc

SEQ ID NO: 6670113 - DNA, 16 bp, Homo sapiens
atggggtcagcaggcc

SEQ ID NO: 6670114 - DNA, 17 bp, Homo sapiens
atggggtcagcaggccc

SEQ ID NO: 6670115 - DNA, 18 bp, Homo sapiens
atggggtcagcaggccca

SEQ ID NO: 6670116 - DNA, 19 bp, Homo sapiens
atggggtcagccccaaggg

SEQ ID NO: 6670117 - DNA, 19 bp, Homo sapiens
atggggtccaggtcaccag

SEQ ID NO: 6670118 - DNA, 17 bp, Homo sapiens
atggggtcctggccatc

SEQ ID NO: 6670119 - DNA, 16 bp, Homo sapiens
atggggtctctcacag

SEQ ID NO: 6670120 - DNA, 20 bp, Homo sapiens
atggggtctctcacagacag

SEQ ID NO: 6670121 - DNA, 16 bp, Homo sapiens
atggggtctgtaaaat

SEQ ID NO: 6670122 - DNA, 19 bp, Homo sapiens
atggggtcttgctatgttg

SEQ ID NO: 6670123 - DNA, 15 bp, Homo sapiens
atggggtggaaggca

SEQ ID NO: 6670124 - DNA, 14 bp, Homo sapiens
atggggtgggcagg

SEQ ID NO: 6670125 - DNA, 18 bp, Homo sapiens
atggggtgggcagggctg

SEQ ID NO: 6670126 - DNA, 19 bp, Homo sapiens
atggggtgggcctctggtt

SEQ ID NO: 6670127 - DNA, 14 bp, Homo sapiens
atggggttcctgct

SEQ ID NO: 6670128 - DNA, 15 bp, Homo sapiens
atggggttcctggtt

SEQ ID NO: 6670129 - DNA, 16 bp, Homo sapiens
atggggttctggaaat

SEQ ID NO: 6670130 - DNA, 24 bp, Homo sapiens
atggggttgggctctgcgtcccac

SEQ ID NO: 6670131 - DNA, 16 bp, Homo sapiens
atggggttgttgtctc

SEQ ID NO: 6670132 - DNA, 20 bp, Homo sapiens
atggggtttcagttgcgaaa

SEQ ID NO: 6670133 - DNA, 21 bp, Homo sapiens
atggggtttgggcccctcaga

SEQ ID NO: 6670134 - DNA, 15 bp, Homo sapiens
atgggtaacactgat

SEQ ID NO: 6670135 - DNA, 17 bp, Homo sapiens
atgggtaagggagggaa

SEQ ID NO: 6670136 - DNA, 23 bp, Homo sapiens
atgggtactgtctcggcagaggt

SEQ ID NO: 6670137 - DNA, 14 bp, Homo sapiens
atgggtagcttctg

SEQ ID NO: 6670138 - DNA, 15 bp, Homo sapiens
atgggtagcttctga

SEQ ID NO: 6670139 - DNA, 12 bp, Homo sapiens
atgggtagggta

SEQ ID NO: 6670140 - DNA, 16 bp, Homo sapiens
atgggtagggtaaatc

SEQ ID NO: 6670141 - DNA, 17 bp, Homo sapiens
atgggtagggtaaatca

SEQ ID NO: 6670142 - DNA, 17 bp, Homo sapiens
atgggtagtacctgtac

SEQ ID NO: 6670143 - DNA, 18 bp, Homo sapiens
atgggtatcatgcttcta

SEQ ID NO: 6670144 - DNA, 18 bp, Homo sapiens
atgggtccaagagacatg

SEQ ID NO: 6670145 - DNA, 24 bp, Homo sapiens
atgggtccagaagaccccacttca

SEQ ID NO: 6670146 - DNA, 19 bp, Homo sapiens
atgggtccaggattcctct

SEQ ID NO: 6670147 - DNA, 21 bp, Homo sapiens
atgggtccaggattcctcttt

SEQ ID NO: 6670148 - DNA, 19 bp, Homo sapiens
atgggtcccttgaaggaag

SEQ ID NO: 6670149 - DNA, 20 bp, Homo sapiens
atgggtcctagcccttccct

SEQ ID NO: 6670150 - DNA, 22 bp, Homo sapiens
atgggtcctagcccttccctga

SEQ ID NO: 6670151 - DNA, 13 bp, Homo sapiens
atgggtcctctgg

SEQ ID NO: 6670152 - DNA, 19 bp, Homo sapiens
atgggtccttgatgccaga

SEQ ID NO: 6670153 - DNA, 21 bp, Homo sapiens
atgggtccttgatgccagagg

SEQ ID NO: 6670154 - DNA, 17 bp, Homo sapiens
atgggtcgcccatgaga

SEQ ID NO: 6670155 - DNA, 15 bp, Homo sapiens
atgggtctggctaga

SEQ ID NO: 6670156 - DNA, 16 bp, Homo sapiens
atgggtgaaggctggc

SEQ ID NO: 6670157 - DNA, 14 bp, Homo sapiens
atgggtgattatga

SEQ ID NO: 6670158 - DNA, 15 bp, Homo sapiens
atgggtgattatgaa

SEQ ID NO: 6670159 - DNA, 19 bp, Homo sapiens
atgggtgattatgaaatgc

SEQ ID NO: 6670160 - DNA, 20 bp, Homo sapiens
atgggtgcaaggaaaattag

SEQ ID NO: 6670161 - DNA, 17 bp, Homo sapiens
atgggtgcccacagtgt

SEQ ID NO: 6670162 - DNA, 23 bp, Homo sapiens
atgggtgccctttcctggcagtc

SEQ ID NO: 6670163 - DNA, 13 bp, Homo sapiens
atgggtgctgaac

SEQ ID NO: 6670164 - DNA, 15 bp, Homo sapiens
atgggtgctggtcct

SEQ ID NO: 6670165 - DNA, 15 bp, Homo sapiens
atgggtgcttggagg

SEQ ID NO: 6670166 - DNA, 23 bp, Homo sapiens
atgggtgcttggaggaaggaaac

SEQ ID NO: 6670167 - DNA, 12 bp, Homo sapiens
atgggtgggagg

SEQ ID NO: 6670168 - DNA, 15 bp, Homo sapiens
atgggtgggaggaga

SEQ ID NO: 6670169 - DNA, 12 bp, Homo sapiens
atgggtgggggc

SEQ ID NO: 6670170 - DNA, 13 bp, Homo sapiens
atgggtgggggct

SEQ ID NO: 6670171 - DNA, 22 bp, Homo sapiens
atgggtggttgaatgatttccc

SEQ ID NO: 6670172 - DNA, 15 bp, Homo sapiens
atgggtgtcccctgg

SEQ ID NO: 6670173 - DNA, 19 bp, Homo sapiens
atgggtgtgtgtttgtgtg

SEQ ID NO: 6670174 - DNA, 22 bp, Homo sapiens
atgggtgttaacgtgcatgagg

SEQ ID NO: 6670175 - DNA, 22 bp, Homo sapiens
atgggtgttttgatctctgttc

SEQ ID NO: 6670176 - DNA, 18 bp, Homo sapiens
atgggtgtttttaataaa

SEQ ID NO: 6670177 - DNA, 15 bp, Homo sapiens
atgggttatgtgtat

SEQ ID NO: 6670178 - DNA, 22 bp, Homo sapiens
atgggttatttttattaaatgt

SEQ ID NO: 6670179 - DNA, 18 bp, Homo sapiens
atgggttgaacaagccac

SEQ ID NO: 6670180 - DNA, 14 bp, Homo sapiens
atgggttgcatttg

SEQ ID NO: 6670181 - DNA, 19 bp, Homo sapiens
atgggtttgaactcacact

SEQ ID NO: 6670182 - DNA, 20 bp, Homo sapiens
atgggtttggggctggcccc

SEQ ID NO: 6670183 - DNA, 19 bp, Homo sapiens
atgggttttgtaggtactt

SEQ ID NO: 6670184 - DNA, 21 bp, Homo sapiens
atgggttttgttaggggtggg

SEQ ID NO: 6670185 - DNA, 23 bp, Homo sapiens
atggtaaaagttacttattctag

SEQ ID NO: 6670186 - DNA, 15 bp, Homo sapiens
atggtaaaattgcat

SEQ ID NO: 6670187 - DNA, 16 bp, Homo sapiens
atggtaaaattgcatg

SEQ ID NO: 6670188 - DNA, 17 bp, Homo sapiens
atggtaaaattgcatgg

SEQ ID NO: 6670189 - DNA, 18 bp, Homo sapiens
atggtaaagatattattc

SEQ ID NO: 6670190 - DNA, 14 bp, Homo sapiens
atggtaaagtaaat

SEQ ID NO: 6670191 - DNA, 17 bp, Homo sapiens
atggtaaataactgtga

SEQ ID NO: 6670192 - DNA, 13 bp, Homo sapiens
atggtaacacttt

SEQ ID NO: 6670193 - DNA, 17 bp, Homo sapiens
atggtaaccagccacag

SEQ ID NO: 6670194 - DNA, 22 bp, Homo sapiens
atggtaactgcacctgggcagc

SEQ ID NO: 6670195 - DNA, 14 bp, Homo sapiens
atggtaactgcttt

SEQ ID NO: 6670196 - DNA, 15 bp, Homo sapiens
atggtaactgctttc

SEQ ID NO: 6670197 - DNA, 23 bp, Homo sapiens
atggtaactgctttctgttccaa

SEQ ID NO: 6670198 - DNA, 15 bp, Homo sapiens
atggtaacttttgta

SEQ ID NO: 6670199 - DNA, 19 bp, Homo sapiens
atggtaacttttgtagtct

SEQ ID NO: 6670200 - DNA, 14 bp, Homo sapiens
atggtaagacctct

SEQ ID NO: 6670201 - DNA, 15 bp, Homo sapiens
atggtaagagaaaag

SEQ ID NO: 6670202 - DNA, 23 bp, Homo sapiens
atggtaagtacttgagtaaatct

SEQ ID NO: 6670203 - DNA, 14 bp, Homo sapiens
atggtaagtagcag

SEQ ID NO: 6670204 - DNA, 13 bp, Homo sapiens
atggtaataagca

SEQ ID NO: 6670205 - DNA, 20 bp, Homo sapiens
atggtaataagcactgtaaa

SEQ ID NO: 6670206 - DNA, 14 bp, Homo sapiens
atggtaatagcttt

SEQ ID NO: 6670207 - DNA, 16 bp, Homo sapiens
atggtaatataacaat

SEQ ID NO: 6670208 - DNA, 21 bp, Homo sapiens
atggtaatataacaatatatg

SEQ ID NO: 6670209 - DNA, 23 bp, Homo sapiens
atggtaatcagttttgtataact

SEQ ID NO: 6670210 - DNA, 15 bp, Homo sapiens
atggtaatcatatta

SEQ ID NO: 6670211 - DNA, 23 bp, Homo sapiens
atggtaatctttacctgtataca

SEQ ID NO: 6670212 - DNA, 15 bp, Homo sapiens
atggtaatcttttct

SEQ ID NO: 6670213 - DNA, 21 bp, Homo sapiens
atggtaatgacagatgcaagt

SEQ ID NO: 6670214 - DNA, 20 bp, Homo sapiens
atggtaatttatagtttata

SEQ ID NO: 6670215 - DNA, 19 bp, Homo sapiens
atggtacatttttcaactt

SEQ ID NO: 6670216 - DNA, 17 bp, Homo sapiens
atggtaccaatcatgaa

SEQ ID NO: 6670217 - DNA, 20 bp, Homo sapiens
atggtaccaatcatgaatct

SEQ ID NO: 6670218 - DNA, 14 bp, Homo sapiens
atggtacccccttc

SEQ ID NO: 6670219 - DNA, 17 bp, Homo sapiens
atggtacccccttctgg

SEQ ID NO: 6670220 - DNA, 22 bp, Homo sapiens
atggtacctctgtctataggac

SEQ ID NO: 6670221 - DNA, 23 bp, Homo sapiens
atggtactaaggaagtcctgttt

SEQ ID NO: 6670222 - DNA, 17 bp, Homo sapiens
atggtactaaggagaat

SEQ ID NO: 6670223 - DNA, 17 bp, Homo sapiens
atggtactcccaaactg

SEQ ID NO: 6670224 - DNA, 23 bp, Homo sapiens
atggtactgtacagctggctcta

SEQ ID NO: 6670225 - DNA, 15 bp, Homo sapiens
atggtacttaggtag

SEQ ID NO: 6670226 - DNA, 17 bp, Homo sapiens
atggtacttcctctgtg

SEQ ID NO: 6670227 - DNA, 18 bp, Homo sapiens
atggtacttcctctgtga

SEQ ID NO: 6670228 - DNA, 24 bp, Homo sapiens
atggtacttcctctgtgaactgtg

SEQ ID NO: 6670229 - DNA, 23 bp, Homo sapiens
atggtagaaaatgcaccaaatag

SEQ ID NO: 6670230 - DNA, 23 bp, Homo sapiens
atggtagacgagctgtctgctgc

SEQ ID NO: 6670231 - DNA, 18 bp, Homo sapiens
atggtagcattttaaaca

SEQ ID NO: 6670232 - DNA, 23 bp, Homo sapiens
atggtagctcgccaaccgcatct

SEQ ID NO: 6670233 - DNA, 16 bp, Homo sapiens
atggtagctctgaagg

SEQ ID NO: 6670234 - DNA, 17 bp, Homo sapiens
atggtagctgaaaaaac

SEQ ID NO: 6670235 - DNA, 14 bp, Homo sapiens
atggtaggaccctc

SEQ ID NO: 6670236 - DNA, 22 bp, Homo sapiens
atggtaggaccctcgagagcct

SEQ ID NO: 6670237 - DNA, 19 bp, Homo sapiens
atggtaggctacttttcag

SEQ ID NO: 6670238 - DNA, 19 bp, Homo sapiens
atggtagggagagacacaa

SEQ ID NO: 6670239 - DNA, 12 bp, Homo sapiens
atggtagtttct

SEQ ID NO: 6670240 - DNA, 15 bp, Homo sapiens
atggtagtttctgtg

SEQ ID NO: 6670241 - DNA, 18 bp, Homo sapiens
atggtagtttctgtggtt

SEQ ID NO: 6670242 - DNA, 19 bp, Homo sapiens
atggtagtttctgtggttg

SEQ ID NO: 6670243 - DNA, 21 bp, Homo sapiens
atggtagttttacagtgtttc

SEQ ID NO: 6670244 - DNA, 18 bp, Homo sapiens
atggtagttttttcatct

SEQ ID NO: 6670245 - DNA, 11 bp, Homo sapiens
atggtataaaa

SEQ ID NO: 6670246 - DNA, 20 bp, Homo sapiens
atggtataaaaggttgccaa

SEQ ID NO: 6670247 - DNA, 17 bp, Homo sapiens
atggtataagtaacttt

SEQ ID NO: 6670248 - DNA, 12 bp, Homo sapiens
atggtataattg

SEQ ID NO: 6670249 - DNA, 17 bp, Homo sapiens
atggtataattgaaact

SEQ ID NO: 6670250 - DNA, 19 bp, Homo sapiens
atggtatactactgctttg

SEQ ID NO: 6670251 - DNA, 19 bp, Homo sapiens
atggtatatatacatatat

SEQ ID NO: 6670252 - DNA, 21 bp, Homo sapiens
atggtatcaaaattacatata

SEQ ID NO: 6670253 - DNA, 23 bp, Homo sapiens
atggtatcaataaatagaccatt

SEQ ID NO: 6670254 - DNA, 23 bp, Homo sapiens
atggtatcatatattaaaacaat

SEQ ID NO: 6670255 - DNA, 21 bp, Homo sapiens
atggtatcatttggaaatcag

SEQ ID NO: 6670256 - DNA, 15 bp, Homo sapiens
atggtatctgttact

SEQ ID NO: 6670257 - DNA, 20 bp, Homo sapiens
atggtatctgttactccaaa

SEQ ID NO: 6670258 - DNA, 23 bp, Homo sapiens
atggtatgattctattatatatt

SEQ ID NO: 6670259 - DNA, 20 bp, Homo sapiens
atggtatgcagcatacaaaa

SEQ ID NO: 6670260 - DNA, 15 bp, Homo sapiens
atggtatgctggcca

SEQ ID NO: 6670261 - DNA, 23 bp, Homo sapiens
atggtatgctggccagcaccctc

SEQ ID NO: 6670262 - DNA, 15 bp, Homo sapiens
atggtatttctttct

SEQ ID NO: 6670263 - DNA, 13 bp, Homo sapiens
atggtatttgaga

SEQ ID NO: 6670264 - DNA, 16 bp, Homo sapiens
atggtatttgagacat

SEQ ID NO: 6670265 - DNA, 19 bp, Homo sapiens
atggtattttcgtgcattt

SEQ ID NO: 6670266 - DNA, 15 bp, Homo sapiens
atggtcacacactga

SEQ ID NO: 6670267 - DNA, 19 bp, Homo sapiens
atggtcacacactgatgct

SEQ ID NO: 6670268 - DNA, 20 bp, Homo sapiens
atggtcacacactgatgctt

SEQ ID NO: 6670269 - DNA, 13 bp, Homo sapiens
atggtcacagacc

SEQ ID NO: 6670270 - DNA, 22 bp, Homo sapiens
atggtcacagtaaagagtacac

SEQ ID NO: 6670271 - DNA, 23 bp, Homo sapiens
atggtcacagtcctatgtacaga

SEQ ID NO: 6670272 - DNA, 19 bp, Homo sapiens
atggtcagcgttgcatgtc

SEQ ID NO: 6670273 - DNA, 20 bp, Homo sapiens
atggtcaggatctcatgaca

SEQ ID NO: 6670274 - DNA, 11 bp, Homo sapiens
atggtcaggcc

SEQ ID NO: 6670275 - DNA, 12 bp, Homo sapiens
atggtcaggccc

SEQ ID NO: 6670276 - DNA, 20 bp, Homo sapiens
atggtcagtgtggagagggg

SEQ ID NO: 6670277 - DNA, 12 bp, Homo sapiens
atggtcatattt

SEQ ID NO: 6670278 - DNA, 17 bp, Homo sapiens
atggtcatcaccaccct

SEQ ID NO: 6670279 - DNA, 22 bp, Homo sapiens
atggtcatcttggagggaccaa

SEQ ID NO: 6670280 - DNA, 20 bp, Homo sapiens
atggtccagaaactcctgtt

SEQ ID NO: 6670281 - DNA, 18 bp, Homo sapiens
atggtccaggagaaggcc

SEQ ID NO: 6670282 - DNA, 15 bp, Homo sapiens
atggtccatagcact

SEQ ID NO: 6670283 - DNA, 13 bp, Homo sapiens
atggtccatcact

SEQ ID NO: 6670284 - DNA, 18 bp, Homo sapiens
atggtccatttcatgtga

SEQ ID NO: 6670285 - DNA, 22 bp, Homo sapiens
atggtcccacatccctgggcct

SEQ ID NO: 6670286 - DNA, 22 bp, Homo sapiens
atggtcccaggaagcagggaga

SEQ ID NO: 6670287 - DNA, 15 bp, Homo sapiens
atggtcccatccagg

SEQ ID NO: 6670288 - DNA, 17 bp, Homo sapiens
atggtcccttcttccct

SEQ ID NO: 6670289 - DNA, 22 bp, Homo sapiens
atggtccgccacgaggagcttc

SEQ ID NO: 6670290 - DNA, 16 bp, Homo sapiens
atggtccgctttcctg

SEQ ID NO: 6670291 - DNA, 15 bp, Homo sapiens
atggtccggtgtcct

SEQ ID NO: 6670292 - DNA, 18 bp, Homo sapiens
atggtccgtgctaaggac

SEQ ID NO: 6670293 - DNA, 19 bp, Homo sapiens
atggtccgtgctaaggact

SEQ ID NO: 6670294 - DNA, 20 bp, Homo sapiens
atggtccgtgctaaggactt

SEQ ID NO: 6670295 - DNA, 19 bp, Homo sapiens
atggtcctatttttgtgaa

SEQ ID NO: 6670296 - DNA, 23 bp, Homo sapiens
atggtcctatttttgtgaagagg

SEQ ID NO: 6670297 - DNA, 16 bp, Homo sapiens
atggtcctgaatgtag

SEQ ID NO: 6670298 - DNA, 12 bp, Homo sapiens
atggtcctggct

SEQ ID NO: 6670299 - DNA, 12 bp, Homo sapiens
atggtcctgggg

SEQ ID NO: 6670300 - DNA, 20 bp, Homo sapiens
atggtcctggggctctgtgc

SEQ ID NO: 6670301 - DNA, 14 bp, Homo sapiens
atggtctaaaaata

SEQ ID NO: 6670302 - DNA, 16 bp, Homo sapiens
atggtctcagtgttaa

SEQ ID NO: 6670303 - DNA, 18 bp, Homo sapiens
atggtctccacctgtgct

SEQ ID NO: 6670304 - DNA, 18 bp, Homo sapiens
atggtctcgatctcctga

SEQ ID NO: 6670305 - DNA, 19 bp, Homo sapiens
atggtctcgatctcctgac

SEQ ID NO: 6670306 - DNA, 22 bp, Homo sapiens
atggtctctctccctctgtctt

SEQ ID NO: 6670307 - DNA, 19 bp, Homo sapiens
atggtctctgcacccagtg

SEQ ID NO: 6670308 - DNA, 23 bp, Homo sapiens
atggtctgcatcagctttttgta

SEQ ID NO: 6670309 - DNA, 19 bp, Homo sapiens
atggtctggggtaaaattg

SEQ ID NO: 6670310 - DNA, 14 bp, Homo sapiens
atggtctggtctat

SEQ ID NO: 6670311 - DNA, 16 bp, Homo sapiens
atggtctggtctatgt

SEQ ID NO: 6670312 - DNA, 16 bp, Homo sapiens
atggtcttacattgga

SEQ ID NO: 6670313 - DNA, 12 bp, Homo sapiens
atggtcttgagc

SEQ ID NO: 6670314 - DNA, 12 bp, Homo sapiens
atggtctttgct

SEQ ID NO: 6670315 - DNA, 14 bp, Homo sapiens
atggtctttgctag

SEQ ID NO: 6670316 - DNA, 15 bp, Homo sapiens
atggtctttgggcag

SEQ ID NO: 6670317 - DNA, 14 bp, Homo sapiens
atggtgaaaatgta

SEQ ID NO: 6670318 - DNA, 17 bp, Homo sapiens
atggtgaaaatgtactg

SEQ ID NO: 6670319 - DNA, 20 bp, Homo sapiens
atggtgaaaccccatctcta

SEQ ID NO: 6670320 - DNA, 21 bp, Homo sapiens
atggtgaaaccccatctctac

SEQ ID NO: 6670321 - DNA, 20 bp, Homo sapiens
atggtgaaaccccgtctcta

SEQ ID NO: 6670322 - DNA, 20 bp, Homo sapiens
atggtgaaattataactatt

SEQ ID NO: 6670323 - DNA, 18 bp, Homo sapiens
atggtgaacattttaatg

SEQ ID NO: 6670324 - DNA, 18 bp, Homo sapiens
atggtgaagacagaaacc

SEQ ID NO: 6670325 - DNA, 22 bp, Homo sapiens
atggtgaagggaagtggggagt

SEQ ID NO: 6670326 - DNA, 18 bp, Homo sapiens
atggtgaagtcacattag

SEQ ID NO: 6670327 - DNA, 19 bp, Homo sapiens
atggtgacagtctccccca

SEQ ID NO: 6670328 - DNA, 22 bp, Homo sapiens
atggtgaccaccccctgttccc

SEQ ID NO: 6670329 - DNA, 16 bp, Homo sapiens
atggtgactcctgaaa

SEQ ID NO: 6670330 - DNA, 23 bp, Homo sapiens
atggtgacttttgaaaagaggtg

SEQ ID NO: 6670331 - DNA, 15 bp, Homo sapiens
atggtgagcagcgga

SEQ ID NO: 6670332 - DNA, 13 bp, Homo sapiens
atggtgagctggg

SEQ ID NO: 6670333 - DNA, 17 bp, Homo sapiens
atggtgaggctgtcagt

SEQ ID NO: 6670334 - DNA, 16 bp, Homo sapiens
atggtgatcctctatt

SEQ ID NO: 6670335 - DNA, 14 bp, Homo sapiens
atggtgatgaaatg

SEQ ID NO: 6670336 - DNA, 17 bp, Homo sapiens
atggtgatgaaatgtaa

SEQ ID NO: 6670337 - DNA, 14 bp, Homo sapiens
atggtgatgactta

SEQ ID NO: 6670338 - DNA, 16 bp, Homo sapiens
atggtgatgcaagtca

SEQ ID NO: 6670339 - DNA, 19 bp, Homo sapiens
atggtgattttaaatgtgt

SEQ ID NO: 6670340 - DNA, 13 bp, Homo sapiens
atggtgcaaaaaa

SEQ ID NO: 6670341 - DNA, 15 bp, Homo sapiens
atggtgcaatgaatt

SEQ ID NO: 6670342 - DNA, 17 bp, Homo sapiens
atggtgcaatgaccttt

SEQ ID NO: 6670343 - DNA, 13 bp, Homo sapiens
atggtgcaatttg

SEQ ID NO: 6670344 - DNA, 21 bp, Homo sapiens
atggtgcagagaagctggact

SEQ ID NO: 6670345 - DNA, 16 bp, Homo sapiens
atggtgcagtgaagaa

SEQ ID NO: 6670346 - DNA, 18 bp, Homo sapiens
atggtgcagttgacagca

SEQ ID NO: 6670347 - DNA, 22 bp, Homo sapiens
atggtgccccaggaccagctca

SEQ ID NO: 6670348 - DNA, 19 bp, Homo sapiens
atggtgcctagtattgaca

SEQ ID NO: 6670349 - DNA, 20 bp, Homo sapiens
atggtgcctagtattgacaa

SEQ ID NO: 6670350 - DNA, 19 bp, Homo sapiens
atggtgcctatatctgaga

SEQ ID NO: 6670351 - DNA, 12 bp, Homo sapiens
atggtgcctctg

SEQ ID NO: 6670352 - DNA, 13 bp, Homo sapiens
atggtgcctctgg

SEQ ID NO: 6670353 - DNA, 15 bp, Homo sapiens
atggtgcctctggag

SEQ ID NO: 6670354 - DNA, 14 bp, Homo sapiens
atggtgcctgagag

SEQ ID NO: 6670355 - DNA, 15 bp, Homo sapiens
atggtgcctgagagg

SEQ ID NO: 6670356 - DNA, 21 bp, Homo sapiens
atggtgcctgagaggcaggca

SEQ ID NO: 6670357 - DNA, 20 bp, Homo sapiens
atggtgccttaggaatgact

SEQ ID NO: 6670358 - DNA, 22 bp, Homo sapiens
atggtgctcaccatgcttccag

SEQ ID NO: 6670359 - DNA, 14 bp, Homo sapiens
atggtgctgacctc

SEQ ID NO: 6670360 - DNA, 14 bp, Homo sapiens
atggtgctgagaag

SEQ ID NO: 6670361 - DNA, 16 bp, Homo sapiens
atggtgctgagaagct

SEQ ID NO: 6670362 - DNA, 21 bp, Homo sapiens
atggtgctgcacccctggtgt

SEQ ID NO: 6670363 - DNA, 23 bp, Homo sapiens
atggtgctgcacccctggtgtcc

SEQ ID NO: 6670364 - DNA, 13 bp, Homo sapiens
atggtgctgccca

SEQ ID NO: 6670365 - DNA, 16 bp, Homo sapiens
atggtgctgcccaggc

SEQ ID NO: 6670366 - DNA, 12 bp, Homo sapiens
atggtgctgtgt

SEQ ID NO: 6670367 - DNA, 19 bp, Homo sapiens
atggtgctgtgtgtgagcg

SEQ ID NO: 6670368 - DNA, 17 bp, Homo sapiens
atggtgcttaagttcca

SEQ ID NO: 6670369 - DNA, 19 bp, Homo sapiens
atggtgcttaagttccagc

SEQ ID NO: 6670370 - DNA, 14 bp, Homo sapiens
atggtgcttccccc

SEQ ID NO: 6670371 - DNA, 20 bp, Homo sapiens
atggtggaagaggttctcag

SEQ ID NO: 6670372 - DNA, 23 bp, Homo sapiens
atggtggaagaggttctcagcaa

SEQ ID NO: 6670373 - DNA, 17 bp, Homo sapiens
atggtggactaagcaat

SEQ ID NO: 6670374 - DNA, 20 bp, Homo sapiens
atggtggactcgcctgtaat

SEQ ID NO: 6670375 - DNA, 14 bp, Homo sapiens
atggtggagggcac

SEQ ID NO: 6670376 - DNA, 22 bp, Homo sapiens
atggtggcacgtgcctgtagtc

SEQ ID NO: 6670377 - DNA, 16 bp, Homo sapiens
atggtggccacagact

SEQ ID NO: 6670378 - DNA, 17 bp, Homo sapiens
atggtggccacagactg

SEQ ID NO: 6670379 - DNA, 15 bp, Homo sapiens
atggtggccagaaat

SEQ ID NO: 6670380 - DNA, 15 bp, Homo sapiens
atggtggccctgggg

SEQ ID NO: 6670381 - DNA, 20 bp, Homo sapiens
atggtggccctggggaagag

SEQ ID NO: 6670382 - DNA, 21 bp, Homo sapiens
atggtggcgctttctcctgtg

SEQ ID NO: 6670383 - DNA, 22 bp, Homo sapiens
atggtggcgctttctcctgtgc

SEQ ID NO: 6670384 - DNA, 20 bp, Homo sapiens
atggtggctgtgtctctccc

SEQ ID NO: 6670385 - DNA, 17 bp, Homo sapiens
atggtggcttcagctcc

SEQ ID NO: 6670386 - DNA, 18 bp, Homo sapiens
atggtgggaaccctcccc

SEQ ID NO: 6670387 - DNA, 19 bp, Homo sapiens
atggtgggaaccctcccca

SEQ ID NO: 6670388 - DNA, 16 bp, Homo sapiens
atggtgggctccagag

SEQ ID NO: 6670389 - DNA, 20 bp, Homo sapiens
atggtgggctccagagtagg

SEQ ID NO: 6670390 - DNA, 16 bp, Homo sapiens
atggtgggcttcaggg

SEQ ID NO: 6670391 - DNA, 23 bp, Homo sapiens
atggtgggcttcagggcaggtgg

SEQ ID NO: 6670392 - DNA, 19 bp, Homo sapiens
atggtggggcccccagcac

SEQ ID NO: 6670393 - DNA, 23 bp, Homo sapiens
atggtggggcccccagcaccctc

SEQ ID NO: 6670394 - DNA, 22 bp, Homo sapiens
atggtggtaaacattctctcag

SEQ ID NO: 6670395 - DNA, 22 bp, Homo sapiens
atggtggtattgtgaccactga

SEQ ID NO: 6670396 - DNA, 23 bp, Homo sapiens
atggtggtgatgtccaaaagata

SEQ ID NO: 6670397 - DNA, 23 bp, Homo sapiens
atggtggttggttgggttttttg

SEQ ID NO: 6670398 - DNA, 19 bp, Homo sapiens
atggtggttgtttcttcca

SEQ ID NO: 6670399 - DNA, 17 bp, Homo sapiens
atggtggtttcagaaag

SEQ ID NO: 6670400 - DNA, 22 bp, Homo sapiens
atggtggtttgtcatatattca

SEQ ID NO: 6670401 - DNA, 14 bp, Homo sapiens
atggtgtaataaga

SEQ ID NO: 6670402 - DNA, 18 bp, Homo sapiens
atggtgtaataagacata

SEQ ID NO: 6670403 - DNA, 18 bp, Homo sapiens
atggtgtaatgcacaatt

SEQ ID NO: 6670404 - DNA, 20 bp, Homo sapiens
atggtgtaatgcacaattta

SEQ ID NO: 6670405 - DNA, 16 bp, Homo sapiens
atggtgtagctgtcct

SEQ ID NO: 6670406 - DNA, 12 bp, Homo sapiens
atggtgtatttt

SEQ ID NO: 6670407 - DNA, 16 bp, Homo sapiens
atggtgtcataactag

SEQ ID NO: 6670408 - DNA, 23 bp, Homo sapiens
atggtgtcatctgctccttcctg

SEQ ID NO: 6670409 - DNA, 15 bp, Homo sapiens
atggtgtcatggctg

SEQ ID NO: 6670410 - DNA, 12 bp, Homo sapiens
atggtgtcattt

SEQ ID NO: 6670411 - DNA, 14 bp, Homo sapiens
atggtgtccttccc

SEQ ID NO: 6670412 - DNA, 18 bp, Homo sapiens
atggtgtctcttctttag

SEQ ID NO: 6670413 - DNA, 19 bp, Homo sapiens
atggtgtcttgatatattt

SEQ ID NO: 6670414 - DNA, 20 bp, Homo sapiens
atggtgtgccacaggctgca

SEQ ID NO: 6670415 - DNA, 23 bp, Homo sapiens
atggtgtggactgaatgggatca

SEQ ID NO: 6670416 - DNA, 15 bp, Homo sapiens
atggtgtggcctgtg

SEQ ID NO: 6670417 - DNA, 19 bp, Homo sapiens
atggtgtggtgaatgtgtg

SEQ ID NO: 6670418 - DNA, 14 bp, Homo sapiens
atggtgttaaagct

SEQ ID NO: 6670419 - DNA, 22 bp, Homo sapiens
atggtgttctcctgctgctccc

SEQ ID NO: 6670420 - DNA, 16 bp, Homo sapiens
atggtgttgagaagaa

SEQ ID NO: 6670421 - DNA, 15 bp, Homo sapiens
atggtgttgtatact

SEQ ID NO: 6670422 - DNA, 21 bp, Homo sapiens
atggtgttttcatgtaaataa

SEQ ID NO: 6670423 - DNA, 17 bp, Homo sapiens
atggtgttttgtcagac

SEQ ID NO: 6670424 - DNA, 17 bp, Homo sapiens
atggtgtttttcttgta

SEQ ID NO: 6670425 - DNA, 18 bp, Homo sapiens
atggttaaaaaggccaaa

SEQ ID NO: 6670426 - DNA, 23 bp, Homo sapiens
atggttaaaaaggccaaagataa

SEQ ID NO: 6670427 - DNA, 13 bp, Homo sapiens
atggttaaacatt

SEQ ID NO: 6670428 - DNA, 13 bp, Homo sapiens
atggttaactaat

SEQ ID NO: 6670429 - DNA, 18 bp, Homo sapiens
atggttaagagtccaaga

SEQ ID NO: 6670430 - DNA, 18 bp, Homo sapiens
atggttaataaaactgca

SEQ ID NO: 6670431 - DNA, 20 bp, Homo sapiens
atggttaatttttcctgcat

SEQ ID NO: 6670432 - DNA, 21 bp, Homo sapiens
atggttaatttttcctgcatg

SEQ ID NO: 6670433 - DNA, 17 bp, Homo sapiens
atggttacactgttaga

SEQ ID NO: 6670434 - DNA, 22 bp, Homo sapiens
atggttaccatgtctttctctc

SEQ ID NO: 6670435 - DNA, 21 bp, Homo sapiens
atggttacgttggttaaataa

SEQ ID NO: 6670436 - DNA, 13 bp, Homo sapiens
atggttactcatt

SEQ ID NO: 6670437 - DNA, 15 bp, Homo sapiens
atggttactcatttt

SEQ ID NO: 6670438 - DNA, 18 bp, Homo sapiens
atggttacttcttctctt

SEQ ID NO: 6670439 - DNA, 12 bp, Homo sapiens
atggttagctgt

SEQ ID NO: 6670440 - DNA, 21 bp, Homo sapiens
atggttagctgtcacatacaa

SEQ ID NO: 6670441 - DNA, 18 bp, Homo sapiens
atggttatgaaagaatat

SEQ ID NO: 6670442 - DNA, 16 bp, Homo sapiens
atggttatgtttttct

SEQ ID NO: 6670443 - DNA, 22 bp, Homo sapiens
atggttattcccccctacttga

SEQ ID NO: 6670444 - DNA, 16 bp, Homo sapiens
atggttcaagtattaa

SEQ ID NO: 6670445 - DNA, 15 bp, Homo sapiens
atggttccaatgaaa

SEQ ID NO: 6670446 - DNA, 16 bp, Homo sapiens
atggttccatgcctga

SEQ ID NO: 6670447 - DNA, 16 bp, Homo sapiens
atggttccccaggagg

SEQ ID NO: 6670448 - DNA, 18 bp, Homo sapiens
atggttccttccctggga

SEQ ID NO: 6670449 - DNA, 20 bp, Homo sapiens
atggttccttccctgggaag

SEQ ID NO: 6670450 - DNA, 13 bp, Homo sapiens
atggttctaaata

SEQ ID NO: 6670451 - DNA, 13 bp, Homo sapiens
atggttctcaatt

SEQ ID NO: 6670452 - DNA, 17 bp, Homo sapiens
atggttctcagatcttg

SEQ ID NO: 6670453 - DNA, 20 bp, Homo sapiens
atggttctccaagaaactga

SEQ ID NO: 6670454 - DNA, 20 bp, Homo sapiens
atggttctctcaacaagaaa

SEQ ID NO: 6670455 - DNA, 18 bp, Homo sapiens
atggttctggctgtttga

SEQ ID NO: 6670456 - DNA, 19 bp, Homo sapiens
atggttctggctgtttgag

SEQ ID NO: 6670457 - DNA, 21 bp, Homo sapiens
atggttctgtgacccatctgt

SEQ ID NO: 6670458 - DNA, 13 bp, Homo sapiens
atggttgaataca

SEQ ID NO: 6670459 - DNA, 13 bp, Homo sapiens
atggttgaatgaa

SEQ ID NO: 6670460 - DNA, 17 bp, Homo sapiens
atggttgatgatacttc

SEQ ID NO: 6670461 - DNA, 16 bp, Homo sapiens
atggttgatggaaaat

SEQ ID NO: 6670462 - DNA, 22 bp, Homo sapiens
atggttgatggaaaataaacat

SEQ ID NO: 6670463 - DNA, 23 bp, Homo sapiens
atggttgcaaagtgttgtcttat

SEQ ID NO: 6670464 - DNA, 18 bp, Homo sapiens
atggttgcgtcctttgaa

SEQ ID NO: 6670465 - DNA, 13 bp, Homo sapiens
atggttgctttga

SEQ ID NO: 6670466 - DNA, 18 bp, Homo sapiens
atggttggagagccctgg

SEQ ID NO: 6670467 - DNA, 15 bp, Homo sapiens
atggttgggacaatg

SEQ ID NO: 6670468 - DNA, 16 bp, Homo sapiens
atggttgggggaatgc

SEQ ID NO: 6670469 - DNA, 18 bp, Homo sapiens
atggttggttagtgcatg

SEQ ID NO: 6670470 - DNA, 19 bp, Homo sapiens
atggttgtatacacatgct

SEQ ID NO: 6670471 - DNA, 12 bp, Homo sapiens
atggttgtatta

SEQ ID NO: 6670472 - DNA, 16 bp, Homo sapiens
atggttgtattagatg

SEQ ID NO: 6670473 - DNA, 18 bp, Homo sapiens
atggttgtattagatgtt

SEQ ID NO: 6670474 - DNA, 17 bp, Homo sapiens
atggttgtcacctctct

SEQ ID NO: 6670475 - DNA, 23 bp, Homo sapiens
atggttgtgaaatgtaacatgaa

SEQ ID NO: 6670476 - DNA, 23 bp, Homo sapiens
atggttgtgtatgggtagcacta

SEQ ID NO: 6670477 - DNA, 17 bp, Homo sapiens
atggttgttgcatatag

SEQ ID NO: 6670478 - DNA, 14 bp, Homo sapiens
atggtttaaaagaa

SEQ ID NO: 6670479 - DNA, 19 bp, Homo sapiens
atggtttaaatatgaatga

SEQ ID NO: 6670480 - DNA, 16 bp, Homo sapiens
atggtttaacaaaatg

SEQ ID NO: 6670481 - DNA, 13 bp, Homo sapiens
atggtttactgct

SEQ ID NO: 6670482 - DNA, 16 bp, Homo sapiens
atggtttactgctgtc

SEQ ID NO: 6670483 - DNA, 18 bp, Homo sapiens
atggtttactgctgtcat

SEQ ID NO: 6670484 - DNA, 22 bp, Homo sapiens
atggtttatagccctgtgaagt

SEQ ID NO: 6670485 - DNA, 18 bp, Homo sapiens
atggtttatgcatgtata

SEQ ID NO: 6670486 - DNA, 16 bp, Homo sapiens
atggtttattcccaag

SEQ ID NO: 6670487 - DNA, 19 bp, Homo sapiens
atggtttattctttgcaaa

SEQ ID NO: 6670488 - DNA, 19 bp, Homo sapiens
atggtttattttgtattgt

SEQ ID NO: 6670489 - DNA, 21 bp, Homo sapiens
atggtttattttgtattgtgg

SEQ ID NO: 6670490 - DNA, 18 bp, Homo sapiens
atggtttcaagttattca

SEQ ID NO: 6670491 - DNA, 17 bp, Homo sapiens
atggtttccatttacta

SEQ ID NO: 6670492 - DNA, 12 bp, Homo sapiens
atggtttcctct

SEQ ID NO: 6670493 - DNA, 20 bp, Homo sapiens
atggtttctgcgtgctttat

SEQ ID NO: 6670494 - DNA, 22 bp, Homo sapiens
atggtttgaatataaacactat

SEQ ID NO: 6670495 - DNA, 22 bp, Homo sapiens
atggtttgactcccgaacatca

SEQ ID NO: 6670496 - DNA, 16 bp, Homo sapiens
atggtttgatatgtag

SEQ ID NO: 6670497 - DNA, 18 bp, Homo sapiens
atggtttgcaaggaagcc

SEQ ID NO: 6670498 - DNA, 15 bp, Homo sapiens
atggtttggaaaata

SEQ ID NO: 6670499 - DNA, 14 bp, Homo sapiens
atggttttaaactt

SEQ ID NO: 6670500 - DNA, 16 bp, Homo sapiens
atggttttaaagctaa

SEQ ID NO: 6670501 - DNA, 15 bp, Homo sapiens
atggttttacagtga

SEQ ID NO: 6670502 - DNA, 19 bp, Homo sapiens
atggttttataactatata

SEQ ID NO: 6670503 - DNA, 20 bp, Homo sapiens
atggttttattctttgagaa

SEQ ID NO: 6670504 - DNA, 14 bp, Homo sapiens
atggttttcaaaat

SEQ ID NO: 6670505 - DNA, 21 bp, Homo sapiens
atggttttcattcattggtga

SEQ ID NO: 6670506 - DNA, 20 bp, Homo sapiens
atggttttgccctccctctc

SEQ ID NO: 6670507 - DNA, 18 bp, Homo sapiens
atggttttggctctccca

SEQ ID NO: 6670508 - DNA, 17 bp, Homo sapiens
atgtaaaaaacaaaaaa

SEQ ID NO: 6670509 - DNA, 23 bp, Homo sapiens
atgtaaaaaacaaaaaaaacaac

SEQ ID NO: 6670510 - DNA, 13 bp, Homo sapiens
atgtaaaaaatac

SEQ ID NO: 6670511 - DNA, 19 bp, Homo sapiens
atgtaaaaaatacaaacat

SEQ ID NO: 6670512 - DNA, 13 bp, Homo sapiens
atgtaaaaaatat

SEQ ID NO: 6670513 - DNA, 14 bp, Homo sapiens
atgtaaaaaatatt

SEQ ID NO: 6670514 - DNA, 13 bp, Homo sapiens
atgtaaaaagaca

SEQ ID NO: 6670515 - DNA, 21 bp, Homo sapiens
atgtaaaaatccttttgaatg

SEQ ID NO: 6670516 - DNA, 14 bp, Homo sapiens
atgtaaaacaaaaa

SEQ ID NO: 6670517 - DNA, 15 bp, Homo sapiens
atgtaaaacaaaaaa

SEQ ID NO: 6670518 - DNA, 13 bp, Homo sapiens
atgtaaaacacat

SEQ ID NO: 6670519 - DNA, 23 bp, Homo sapiens
atgtaaaacacatacaaaagaat

SEQ ID NO: 6670520 - DNA, 17 bp, Homo sapiens
atgtaaaacagaaaaaa

SEQ ID NO: 6670521 - DNA, 13 bp, Homo sapiens
atgtaaaacattt

SEQ ID NO: 6670522 - DNA, 15 bp, Homo sapiens
atgtaaaacatttat

SEQ ID NO: 6670523 - DNA, 14 bp, Homo sapiens
atgtaaaacccttt

SEQ ID NO: 6670524 - DNA, 23 bp, Homo sapiens
atgtaaaagacactggtgtatct

SEQ ID NO: 6670525 - DNA, 15 bp, Homo sapiens
atgtaaaaggattat

SEQ ID NO: 6670526 - DNA, 19 bp, Homo sapiens
atgtaaaaggattattact

SEQ ID NO: 6670527 - DNA, 23 bp, Homo sapiens
atgtaaaaggattattactaatt

SEQ ID NO: 6670528 - DNA, 22 bp, Homo sapiens
atgtaaaaggccaaacctctgt

SEQ ID NO: 6670529 - DNA, 23 bp, Homo sapiens
atgtaaaaggccaaacctctgtt

SEQ ID NO: 6670530 - DNA, 21 bp, Homo sapiens
atgtaaaaggtattaaattga

SEQ ID NO: 6670531 - DNA, 20 bp, Homo sapiens
atgtaaaataaaggctctgt

SEQ ID NO: 6670532 - DNA, 13 bp, Homo sapiens
atgtaaaatatgt

SEQ ID NO: 6670533 - DNA, 20 bp, Homo sapiens
atgtaaaatatgtaaaacta

SEQ ID NO: 6670534 - DNA, 12 bp, Homo sapiens
atgtaaaatatt

SEQ ID NO: 6670535 - DNA, 16 bp, Homo sapiens
atgtaaaatattgtta

SEQ ID NO: 6670536 - DNA, 15 bp, Homo sapiens
atgtaaaatatttat

SEQ ID NO: 6670537 - DNA, 23 bp, Homo sapiens
atgtaaaatcttgtcatgtgtat

SEQ ID NO: 6670538 - DNA, 14 bp, Homo sapiens
atgtaaaatgaatt

SEQ ID NO: 6670539 - DNA, 22 bp, Homo sapiens
atgtaaaatgaattgaaaaaca

SEQ ID NO: 6670540 - DNA, 12 bp, Homo sapiens
atgtaaaatgat

SEQ ID NO: 6670541 - DNA, 21 bp, Homo sapiens
atgtaaaatgcagtccagaat

SEQ ID NO: 6670542 - DNA, 22 bp, Homo sapiens
atgtaaaatgcagtccagaata

SEQ ID NO: 6670543 - DNA, 12 bp, Homo sapiens
atgtaaaatgtt

SEQ ID NO: 6670544 - DNA, 13 bp, Homo sapiens
atgtaaaatgttt

SEQ ID NO: 6670545 - DNA, 13 bp, Homo sapiens
atgtaaaattaca

SEQ ID NO: 6670546 - DNA, 14 bp, Homo sapiens
atgtaaaattttgc

SEQ ID NO: 6670547 - DNA, 12 bp, Homo sapiens
atgtaaacaaaa

SEQ ID NO: 6670548 - DNA, 13 bp, Homo sapiens
atgtaaacaaatc

SEQ ID NO: 6670549 - DNA, 16 bp, Homo sapiens
atgtaaacaaatcttt

SEQ ID NO: 6670550 - DNA, 14 bp, Homo sapiens
atgtaaacagtgag

SEQ ID NO: 6670551 - DNA, 16 bp, Homo sapiens
atgtaaacagtgcctg

SEQ ID NO: 6670552 - DNA, 17 bp, Homo sapiens
atgtaaacagtgcctgc

SEQ ID NO: 6670553 - DNA, 22 bp, Homo sapiens
atgtaaacagtgcctgctgaat

SEQ ID NO: 6670554 - DNA, 13 bp, Homo sapiens
atgtaaacattca

SEQ ID NO: 6670555 - DNA, 21 bp, Homo sapiens
atgtaaacattcatatttgca

SEQ ID NO: 6670556 - DNA, 22 bp, Homo sapiens
atgtaaaccagaaaaaataaat

SEQ ID NO: 6670557 - DNA, 12 bp, Homo sapiens
atgtaaactctt

SEQ ID NO: 6670558 - DNA, 15 bp, Homo sapiens
atgtaaactcttcac

SEQ ID NO: 6670559 - DNA, 18 bp, Homo sapiens
atgtaaactcttcacctt

SEQ ID NO: 6670560 - DNA, 13 bp, Homo sapiens
atgtaaactttaa

SEQ ID NO: 6670561 - DNA, 23 bp, Homo sapiens
atgtaaactttcctgtactcact

SEQ ID NO: 6670562 - DNA, 17 bp, Homo sapiens
atgtaaagaaatgtctt

SEQ ID NO: 6670563 - DNA, 19 bp, Homo sapiens
atgtaaagacaaaaaacta

SEQ ID NO: 6670564 - DNA, 21 bp, Homo sapiens
atgtaaagatatttttatctt

SEQ ID NO: 6670565 - DNA, 19 bp, Homo sapiens
atgtaaagatgatttaagt

SEQ ID NO: 6670566 - DNA, 20 bp, Homo sapiens
atgtaaagccaaaaccatct

SEQ ID NO: 6670567 - DNA, 23 bp, Homo sapiens
atgtaaagccaaaaccatcttct

SEQ ID NO: 6670568 - DNA, 18 bp, Homo sapiens
atgtaaagctgttaaaat

SEQ ID NO: 6670569 - DNA, 19 bp, Homo sapiens
atgtaaagctgttaaaata

SEQ ID NO: 6670570 - DNA, 21 bp, Homo sapiens
atgtaaaggcaggtttgggaa

SEQ ID NO: 6670571 - DNA, 12 bp, Homo sapiens
atgtaaagtatg

SEQ ID NO: 6670572 - DNA, 18 bp, Homo sapiens
atgtaaagtatgtaaaca

SEQ ID NO: 6670573 - DNA, 14 bp, Homo sapiens
atgtaaagtatgtt

SEQ ID NO: 6670574 - DNA, 15 bp, Homo sapiens
atgtaaagtatgttt

SEQ ID NO: 6670575 - DNA, 16 bp, Homo sapiens
atgtaaagtgatattt

SEQ ID NO: 6670576 - DNA, 16 bp, Homo sapiens
atgtaaagtgtcagaa

SEQ ID NO: 6670577 - DNA, 13 bp, Homo sapiens
atgtaaataaact

SEQ ID NO: 6670578 - DNA, 20 bp, Homo sapiens
atgtaaataaactatttata

SEQ ID NO: 6670579 - DNA, 21 bp, Homo sapiens
atgtaaataaaggatttctag

SEQ ID NO: 6670580 - DNA, 23 bp, Homo sapiens
atgtaaataaccccattctttgc

SEQ ID NO: 6670581 - DNA, 17 bp, Homo sapiens
atgtaaataatacatta

SEQ ID NO: 6670582 - DNA, 14 bp, Homo sapiens
atgtaaataatctg

SEQ ID NO: 6670583 - DNA, 15 bp, Homo sapiens
atgtaaatacaaatt

SEQ ID NO: 6670584 - DNA, 19 bp, Homo sapiens
atgtaaatacaatttgtac

SEQ ID NO: 6670585 - DNA, 20 bp, Homo sapiens
atgtaaatacaatttgtact

SEQ ID NO: 6670586 - DNA, 19 bp, Homo sapiens
atgtaaatacatcaaaaat

SEQ ID NO: 6670587 - DNA, 16 bp, Homo sapiens
atgtaaatactcatga

SEQ ID NO: 6670588 - DNA, 13 bp, Homo sapiens
atgtaaatactgt

SEQ ID NO: 6670589 - DNA, 18 bp, Homo sapiens
atgtaaatagcttttcat

SEQ ID NO: 6670590 - DNA, 11 bp, Homo sapiens
atgtaaatata

SEQ ID NO: 6670591 - DNA, 17 bp, Homo sapiens
atgtaaatattgctgtc

SEQ ID NO: 6670592 - DNA, 22 bp, Homo sapiens
atgtaaatattgctgtctgaaa

SEQ ID NO: 6670593 - DNA, 13 bp, Homo sapiens
atgtaaatatttt

SEQ ID NO: 6670594 - DNA, 20 bp, Homo sapiens
atgtaaatattttaaagaat

SEQ ID NO: 6670595 - DNA, 21 bp, Homo sapiens
atgtaaatattttaaagaatt

SEQ ID NO: 6670596 - DNA, 11 bp, Homo sapiens
atgtaaatcct

SEQ ID NO: 6670597 - DNA, 21 bp, Homo sapiens
atgtaaatgacctaattgata

SEQ ID NO: 6670598 - DNA, 14 bp, Homo sapiens
atgtaaatgctcat

SEQ ID NO: 6670599 - DNA, 13 bp, Homo sapiens
atgtaaatgcttg

SEQ ID NO: 6670600 - DNA, 12 bp, Homo sapiens
atgtaaatgtgc

SEQ ID NO: 6670601 - DNA, 12 bp, Homo sapiens
atgtaaatgtgt

SEQ ID NO: 6670602 - DNA, 14 bp, Homo sapiens
atgtaaatgttatt

SEQ ID NO: 6670603 - DNA, 20 bp, Homo sapiens
atgtaaatgttattattctt

SEQ ID NO: 6670604 - DNA, 21 bp, Homo sapiens
atgtaaattaactcaccagat

SEQ ID NO: 6670605 - DNA, 15 bp, Homo sapiens
atgtaaattaccagt

SEQ ID NO: 6670606 - DNA, 15 bp, Homo sapiens
atgtaaattataagt

SEQ ID NO: 6670607 - DNA, 20 bp, Homo sapiens
atgtaaattattgtaaactt

SEQ ID NO: 6670608 - DNA, 21 bp, Homo sapiens
atgtaaatttataaatatatt

SEQ ID NO: 6670609 - DNA, 19 bp, Homo sapiens
atgtaaatttgtactattt

SEQ ID NO: 6670610 - DNA, 21 bp, Homo sapiens
atgtaaatttgtactatttaa

SEQ ID NO: 6670611 - DNA, 13 bp, Homo sapiens
atgtaaatttttt

SEQ ID NO: 6670612 - DNA, 16 bp, Homo sapiens
atgtaacaacaattat

SEQ ID NO: 6670613 - DNA, 14 bp, Homo sapiens
atgtaacaaccaga

SEQ ID NO: 6670614 - DNA, 23 bp, Homo sapiens
atgtaacacaggataaagttatt

SEQ ID NO: 6670615 - DNA, 18 bp, Homo sapiens
atgtaacacataaacaat

SEQ ID NO: 6670616 - DNA, 19 bp, Homo sapiens
atgtaacacataaacaatt

SEQ ID NO: 6670617 - DNA, 23 bp, Homo sapiens
atgtaacactagccgaatggtag

SEQ ID NO: 6670618 - DNA, 12 bp, Homo sapiens
atgtaacactgt

SEQ ID NO: 6670619 - DNA, 13 bp, Homo sapiens
atgtaacagaaag

SEQ ID NO: 6670620 - DNA, 14 bp, Homo sapiens
atgtaacagaaagg

SEQ ID NO: 6670621 - DNA, 13 bp, Homo sapiens
atgtaacagtctg

SEQ ID NO: 6670622 - DNA, 16 bp, Homo sapiens
atgtaacagttgtgtc

SEQ ID NO: 6670623 - DNA, 14 bp, Homo sapiens
atgtaacagtttaa

SEQ ID NO: 6670624 - DNA, 19 bp, Homo sapiens
atgtaacatcataattaca

SEQ ID NO: 6670625 - DNA, 15 bp, Homo sapiens
atgtaacatccagaa

SEQ ID NO: 6670626 - DNA, 17 bp, Homo sapiens
atgtaacatgatgttaa

SEQ ID NO: 6670627 - DNA, 23 bp, Homo sapiens
atgtaacatgatttccctccaga

SEQ ID NO: 6670628 - DNA, 16 bp, Homo sapiens
atgtaacattggtgaa

SEQ ID NO: 6670629 - DNA, 21 bp, Homo sapiens
atgtaaccaagagtattccat

SEQ ID NO: 6670630 - DNA, 11 bp, Homo sapiens
atgtaaccaat

SEQ ID NO: 6670631 - DNA, 17 bp, Homo sapiens
atgtaaccaatcctact

SEQ ID NO: 6670632 - DNA, 17 bp, Homo sapiens
atgtaacccaaatgtcc

SEQ ID NO: 6670633 - DNA, 23 bp, Homo sapiens
atgtaacctacaattcagttagg

SEQ ID NO: 6670634 - DNA, 19 bp, Homo sapiens
atgtaacctatttatcgca

SEQ ID NO: 6670635 - DNA, 17 bp, Homo sapiens
atgtaaccttaaaagca

SEQ ID NO: 6670636 - DNA, 18 bp, Homo sapiens
atgtaactaggccatttg

SEQ ID NO: 6670637 - DNA, 15 bp, Homo sapiens
atgtaactattgaat

SEQ ID NO: 6670638 - DNA, 17 bp, Homo sapiens
atgtaactattgaattg

SEQ ID NO: 6670639 - DNA, 21 bp, Homo sapiens
atgtaactcctccatccatgt

SEQ ID NO: 6670640 - DNA, 22 bp, Homo sapiens
atgtaactctatagttattgtt

SEQ ID NO: 6670641 - DNA, 19 bp, Homo sapiens
atgtaactctccagccatt

SEQ ID NO: 6670642 - DNA, 15 bp, Homo sapiens
atgtaactgagaatt

SEQ ID NO: 6670643 - DNA, 20 bp, Homo sapiens
atgtaactgagaatttgtgt

SEQ ID NO: 6670644 - DNA, 15 bp, Homo sapiens
atgtaactgcctaga

SEQ ID NO: 6670645 - DNA, 17 bp, Homo sapiens
atgtaactgcctagaaa

SEQ ID NO: 6670646 - DNA, 14 bp, Homo sapiens
atgtaactgctctt

SEQ ID NO: 6670647 - DNA, 13 bp, Homo sapiens
atgtaactgctga

SEQ ID NO: 6670648 - DNA, 22 bp, Homo sapiens
atgtaactgtccgtagtatcag

SEQ ID NO: 6670649 - DNA, 14 bp, Homo sapiens
atgtaactgttacc

SEQ ID NO: 6670650 - DNA, 22 bp, Homo sapiens
atgtaactgttaccattggaaa

SEQ ID NO: 6670651 - DNA, 18 bp, Homo sapiens
atgtaacttcagatgttt

SEQ ID NO: 6670652 - DNA, 19 bp, Homo sapiens
atgtaacttcagatgtttc

SEQ ID NO: 6670653 - DNA, 14 bp, Homo sapiens
atgtaacttcctct

SEQ ID NO: 6670654 - DNA, 16 bp, Homo sapiens
atgtaacttcctgtgg

SEQ ID NO: 6670655 - DNA, 18 bp, Homo sapiens
atgtaacttcctgtggat

SEQ ID NO: 6670656 - DNA, 12 bp, Homo sapiens
atgtaacttgca

SEQ ID NO: 6670657 - DNA, 20 bp, Homo sapiens
atgtaacttgttgcagactg

SEQ ID NO: 6670658 - DNA, 18 bp, Homo sapiens
atgtaactttttaatcat

SEQ ID NO: 6670659 - DNA, 16 bp, Homo sapiens
atgtaagaaaacaaaa

SEQ ID NO: 6670660 - DNA, 22 bp, Homo sapiens
atgtaagaacacattttaaata

SEQ ID NO: 6670661 - DNA, 13 bp, Homo sapiens
atgtaagaagccc

SEQ ID NO: 6670662 - DNA, 19 bp, Homo sapiens
atgtaagaattcagaagac

SEQ ID NO: 6670663 - DNA, 16 bp, Homo sapiens
atgtaagagctttaca

SEQ ID NO: 6670664 - DNA, 21 bp, Homo sapiens
atgtaagattatagattctaa

SEQ ID NO: 6670665 - DNA, 24 bp, Homo sapiens
atgtaagattatagattctaaaga

SEQ ID NO: 6670666 - DNA, 21 bp, Homo sapiens
atgtaagcaaaggctctgaaa

SEQ ID NO: 6670667 - DNA, 13 bp, Homo sapiens
atgtaagcatttg

SEQ ID NO: 6670668 - DNA, 17 bp, Homo sapiens
atgtaagccaagtcatg

SEQ ID NO: 6670669 - DNA, 13 bp, Homo sapiens
atgtaagctggaa

SEQ ID NO: 6670670 - DNA, 22 bp, Homo sapiens
atgtaagctgtttattttatat

SEQ ID NO: 6670671 - DNA, 14 bp, Homo sapiens
atgtaaggaattga

SEQ ID NO: 6670672 - DNA, 19 bp, Homo sapiens
atgtaaggaggtttgtata

SEQ ID NO: 6670673 - DNA, 23 bp, Homo sapiens
atgtaaggcactgtcaggaatgg

SEQ ID NO: 6670674 - DNA, 13 bp, Homo sapiens
atgtaaggcctta

SEQ ID NO: 6670675 - DNA, 23 bp, Homo sapiens
atgtaaggctgtgtaagatttgt

SEQ ID NO: 6670676 - DNA, 14 bp, Homo sapiens
atgtaagggaaact

SEQ ID NO: 6670677 - DNA, 19 bp, Homo sapiens
atgtaagggaaactgccag

SEQ ID NO: 6670678 - DNA, 21 bp, Homo sapiens
atgtaagggctttaaataaaa

SEQ ID NO: 6670679 - DNA, 11 bp, Homo sapiens
atgtaagggtc

SEQ ID NO: 6670680 - DNA, 13 bp, Homo sapiens
atgtaaggtatat

SEQ ID NO: 6670681 - DNA, 20 bp, Homo sapiens
atgtaaggttttttttgtac

SEQ ID NO: 6670682 - DNA, 21 bp, Homo sapiens
atgtaaggttttttttgtacg

SEQ ID NO: 6670683 - DNA, 22 bp, Homo sapiens
atgtaaggttttttttgtacgc

SEQ ID NO: 6670684 - DNA, 14 bp, Homo sapiens
atgtaagtgggccc

SEQ ID NO: 6670685 - DNA, 19 bp, Homo sapiens
atgtaagtgtggttttgta

SEQ ID NO: 6670686 - DNA, 13 bp, Homo sapiens
atgtaagtttaat

SEQ ID NO: 6670687 - DNA, 19 bp, Homo sapiens
atgtaataaaaagtatatg

SEQ ID NO: 6670688 - DNA, 15 bp, Homo sapiens
atgtaataaattcaa

SEQ ID NO: 6670689 - DNA, 21 bp, Homo sapiens
atgtaataactgcatgtgtct

SEQ ID NO: 6670690 - DNA, 17 bp, Homo sapiens
atgtaataactgtgaag

SEQ ID NO: 6670691 - DNA, 14 bp, Homo sapiens
atgtaataactttc

SEQ ID NO: 6670692 - DNA, 14 bp, Homo sapiens
atgtaataagcact

SEQ ID NO: 6670693 - DNA, 13 bp, Homo sapiens
atgtaataataat

SEQ ID NO: 6670694 - DNA, 19 bp, Homo sapiens
atgtaataatgtacagagg

SEQ ID NO: 6670695 - DNA, 21 bp, Homo sapiens
atgtaatactggaataatttg

SEQ ID NO: 6670696 - DNA, 17 bp, Homo sapiens
atgtaatactgtagaaa

SEQ ID NO: 6670697 - DNA, 23 bp, Homo sapiens
atgtaatactgtagaaatattgc

SEQ ID NO: 6670698 - DNA, 18 bp, Homo sapiens
atgtaatacttaaataaa

SEQ ID NO: 6670699 - DNA, 12 bp, Homo sapiens
atgtaatacttc

SEQ ID NO: 6670700 - DNA, 17 bp, Homo sapiens
atgtaatagaagcttaa

SEQ ID NO: 6670701 - DNA, 16 bp, Homo sapiens
atgtaatagtggcttt

SEQ ID NO: 6670702 - DNA, 22 bp, Homo sapiens
atgtaatagttctatccttttg

SEQ ID NO: 6670703 - DNA, 14 bp, Homo sapiens
atgtaatatataca

SEQ ID NO: 6670704 - DNA, 17 bp, Homo sapiens
atgtaatatatacatat

SEQ ID NO: 6670705 - DNA, 18 bp, Homo sapiens
atgtaatatatcctgaaa

SEQ ID NO: 6670706 - DNA, 15 bp, Homo sapiens
atgtaatcaatgttt

SEQ ID NO: 6670707 - DNA, 16 bp, Homo sapiens
atgtaatcagatgcca

SEQ ID NO: 6670708 - DNA, 18 bp, Homo sapiens
atgtaatccttttgttta

SEQ ID NO: 6670709 - DNA, 17 bp, Homo sapiens
atgtaatcggcttgaat

SEQ ID NO: 6670710 - DNA, 23 bp, Homo sapiens
atgtaatctctctgcagctgccg

SEQ ID NO: 6670711 - DNA, 13 bp, Homo sapiens
atgtaatgacact

SEQ ID NO: 6670712 - DNA, 14 bp, Homo sapiens
atgtaatgacactt

SEQ ID NO: 6670713 - DNA, 15 bp, Homo sapiens
atgtaatgcaactac

SEQ ID NO: 6670714 - DNA, 23 bp, Homo sapiens
atgtaatgcattaataaaaatca

SEQ ID NO: 6670715 - DNA, 21 bp, Homo sapiens
atgtaatgcgattttattact

SEQ ID NO: 6670716 - DNA, 21 bp, Homo sapiens
atgtaatgcttatgtgttgca

SEQ ID NO: 6670717 - DNA, 16 bp, Homo sapiens
atgtaatgcttccaat

SEQ ID NO: 6670718 - DNA, 23 bp, Homo sapiens
atgtaatggaaagggtgttggca

SEQ ID NO: 6670719 - DNA, 18 bp, Homo sapiens
atgtaatggcagttatat

SEQ ID NO: 6670720 - DNA, 14 bp, Homo sapiens
atgtaatgtcagac

SEQ ID NO: 6670721 - DNA, 22 bp, Homo sapiens
atgtaatgtgtggtggcctcag

SEQ ID NO: 6670722 - DNA, 23 bp, Homo sapiens
atgtaatgtgtggtggcctcagc

SEQ ID NO: 6670723 - DNA, 21 bp, Homo sapiens
atgtaatgttttctttgcaaa

SEQ ID NO: 6670724 - DNA, 18 bp, Homo sapiens
atgtaattaaactgttaa

SEQ ID NO: 6670725 - DNA, 19 bp, Homo sapiens
atgtaattaactgtaaact

SEQ ID NO: 6670726 - DNA, 23 bp, Homo sapiens
atgtaattaagtactatgtatca

SEQ ID NO: 6670727 - DNA, 14 bp, Homo sapiens
atgtaattataagc

SEQ ID NO: 6670728 - DNA, 21 bp, Homo sapiens
atgtaattatatatactatat

SEQ ID NO: 6670729 - DNA, 13 bp, Homo sapiens
atgtaattatcta

SEQ ID NO: 6670730 - DNA, 19 bp, Homo sapiens
atgtaattatctagtagtt

SEQ ID NO: 6670731 - DNA, 15 bp, Homo sapiens
atgtaattgaataaa

SEQ ID NO: 6670732 - DNA, 20 bp, Homo sapiens
atgtaattgtttgtctttaa

SEQ ID NO: 6670733 - DNA, 12 bp, Homo sapiens
atgtaatttaaa

SEQ ID NO: 6670734 - DNA, 20 bp, Homo sapiens
atgtaatttaaatgaaagaa

SEQ ID NO: 6670735 - DNA, 21 bp, Homo sapiens
atgtaatttagaaactgattt

SEQ ID NO: 6670736 - DNA, 22 bp, Homo sapiens
atgtaatttagggtactaaatt

SEQ ID NO: 6670737 - DNA, 15 bp, Homo sapiens
atgtaatttatgcaa

SEQ ID NO: 6670738 - DNA, 15 bp, Homo sapiens
atgtaatttctttaa

SEQ ID NO: 6670739 - DNA, 22 bp, Homo sapiens
atgtaatttgcattactctggt

SEQ ID NO: 6670740 - DNA, 18 bp, Homo sapiens
atgtaatttgtgtaataa

SEQ ID NO: 6670741 - DNA, 15 bp, Homo sapiens
atgtaatttgtttcc

SEQ ID NO: 6670742 - DNA, 12 bp, Homo sapiens
atgtaattttgt

SEQ ID NO: 6670743 - DNA, 15 bp, Homo sapiens
atgtaattttgtgta

SEQ ID NO: 6670744 - DNA, 16 bp, Homo sapiens
atgtaattttgtgtaa

SEQ ID NO: 6670745 - DNA, 23 bp, Homo sapiens
atgtaattttgtgtaagaaatac

SEQ ID NO: 6670746 - DNA, 17 bp, Homo sapiens
atgtaatttttaaagca

SEQ ID NO: 6670747 - DNA, 20 bp, Homo sapiens
atgtacaaaaaaaaaaccct

SEQ ID NO: 6670748 - DNA, 16 bp, Homo sapiens
atgtacaaaaacacaa

SEQ ID NO: 6670749 - DNA, 17 bp, Homo sapiens
atgtacaaaaacacaaa

SEQ ID NO: 6670750 - DNA, 20 bp, Homo sapiens
atgtacaaaaacacaaatac

SEQ ID NO: 6670751 - DNA, 18 bp, Homo sapiens
atgtacaaaagtaccata

SEQ ID NO: 6670752 - DNA, 14 bp, Homo sapiens
atgtacaaaatgaa

SEQ ID NO: 6670753 - DNA, 15 bp, Homo sapiens
atgtacaaaatgaat

SEQ ID NO: 6670754 - DNA, 19 bp, Homo sapiens
atgtacaaaatgaattgcc

SEQ ID NO: 6670755 - DNA, 23 bp, Homo sapiens
atgtacaaagatacttgatgcac

SEQ ID NO: 6670756 - DNA, 18 bp, Homo sapiens
atgtacaaataatattgc

SEQ ID NO: 6670757 - DNA, 21 bp, Homo sapiens
atgtacaaataatattgcctt

SEQ ID NO: 6670758 - DNA, 17 bp, Homo sapiens
atgtacaaattcttata

SEQ ID NO: 6670759 - DNA, 12 bp, Homo sapiens
atgtacaaccct

SEQ ID NO: 6670760 - DNA, 14 bp, Homo sapiens
atgtacaagatgaa

SEQ ID NO: 6670761 - DNA, 15 bp, Homo sapiens
atgtacaaggtatgt

SEQ ID NO: 6670762 - DNA, 15 bp, Homo sapiens
atgtacaagttttgt

SEQ ID NO: 6670763 - DNA, 22 bp, Homo sapiens
atgtacaataaaggatgtttat

SEQ ID NO: 6670764 - DNA, 15 bp, Homo sapiens
atgtacaatacaatg

SEQ ID NO: 6670765 - DNA, 20 bp, Homo sapiens
atgtacaatattttaagcat

SEQ ID NO: 6670766 - DNA, 21 bp, Homo sapiens
atgtacaatattttaagcatt

SEQ ID NO: 6670767 - DNA, 15 bp, Homo sapiens
atgtacaattatgtc

SEQ ID NO: 6670768 - DNA, 19 bp, Homo sapiens
atgtacaattatgtctctt

SEQ ID NO: 6670769 - DNA, 20 bp, Homo sapiens
atgtacaattatgtctcttg

SEQ ID NO: 6670770 - DNA, 22 bp, Homo sapiens
atgtacaattatgtctcttgag

SEQ ID NO: 6670771 - DNA, 20 bp, Homo sapiens
atgtacaattttatataatt

SEQ ID NO: 6670772 - DNA, 15 bp, Homo sapiens
atgtacacaggtcaa

SEQ ID NO: 6670773 - DNA, 22 bp, Homo sapiens
atgtacacagtttaaacacatc

SEQ ID NO: 6670774 - DNA, 23 bp, Homo sapiens
atgtacaccacatgctattgtct

SEQ ID NO: 6670775 - DNA, 18 bp, Homo sapiens
atgtacactttttacagc

SEQ ID NO: 6670776 - DNA, 13 bp, Homo sapiens
atgtacagacaga

SEQ ID NO: 6670777 - DNA, 18 bp, Homo sapiens
atgtacagacatatttaa

SEQ ID NO: 6670778 - DNA, 14 bp, Homo sapiens
atgtacagattctt

SEQ ID NO: 6670779 - DNA, 20 bp, Homo sapiens
atgtacagattttatttgta

SEQ ID NO: 6670780 - DNA, 17 bp, Homo sapiens
atgtacaggctgagaca

SEQ ID NO: 6670781 - DNA, 18 bp, Homo sapiens
atgtacaggctgagacac

SEQ ID NO: 6670782 - DNA, 14 bp, Homo sapiens
atgtacaggttgga

SEQ ID NO: 6670783 - DNA, 15 bp, Homo sapiens
atgtacagtattttg

SEQ ID NO: 6670784 - DNA, 14 bp, Homo sapiens
atgtacagtctgtc

SEQ ID NO: 6670785 - DNA, 16 bp, Homo sapiens
atgtacagtctgtcat

SEQ ID NO: 6670786 - DNA, 20 bp, Homo sapiens
atgtacagttgagctcaggt

SEQ ID NO: 6670787 - DNA, 14 bp, Homo sapiens
atgtacagtttatt

SEQ ID NO: 6670788 - DNA, 19 bp, Homo sapiens
atgtacagtttattgatat

SEQ ID NO: 6670789 - DNA, 13 bp, Homo sapiens
atgtacataactc

SEQ ID NO: 6670790 - DNA, 13 bp, Homo sapiens
atgtacatactga

SEQ ID NO: 6670791 - DNA, 17 bp, Homo sapiens
atgtacatagtaaagta

SEQ ID NO: 6670792 - DNA, 18 bp, Homo sapiens
atgtacatagtgctaaca

SEQ ID NO: 6670793 - DNA, 17 bp, Homo sapiens
atgtacatcagtttgtt

SEQ ID NO: 6670794 - DNA, 23 bp, Homo sapiens
atgtacatctcccctttgctaac

SEQ ID NO: 6670795 - DNA, 15 bp, Homo sapiens
atgtacatgagaagg

SEQ ID NO: 6670796 - DNA, 14 bp, Homo sapiens
atgtacatgtatta

SEQ ID NO: 6670797 - DNA, 14 bp, Homo sapiens
atgtacatgtgtag

SEQ ID NO: 6670798 - DNA, 14 bp, Homo sapiens
atgtacatgtgttg

SEQ ID NO: 6670799 - DNA, 23 bp, Homo sapiens
atgtacatgttcctttgtaattg

SEQ ID NO: 6670800 - DNA, 16 bp, Homo sapiens
atgtacattacagatt

SEQ ID NO: 6670801 - DNA, 23 bp, Homo sapiens
atgtacattacagattaaagaag

SEQ ID NO: 6670802 - DNA, 12 bp, Homo sapiens
atgtacatttaa

SEQ ID NO: 6670803 - DNA, 17 bp, Homo sapiens
atgtacatttaataata

SEQ ID NO: 6670804 - DNA, 20 bp, Homo sapiens
atgtacatttccaaatgaac

SEQ ID NO: 6670805 - DNA, 20 bp, Homo sapiens
atgtacatttccaaattcac

SEQ ID NO: 6670806 - DNA, 14 bp, Homo sapiens
atgtacatttggaa

SEQ ID NO: 6670807 - DNA, 15 bp, Homo sapiens
atgtaccagtgtact

SEQ ID NO: 6670808 - DNA, 13 bp, Homo sapiens
atgtaccatcaat

SEQ ID NO: 6670809 - DNA, 17 bp, Homo sapiens
atgtaccatgaatattt

SEQ ID NO: 6670810 - DNA, 19 bp, Homo sapiens
atgtaccatgttgcccaga

SEQ ID NO: 6670811 - DNA, 22 bp, Homo sapiens
atgtaccatttgcatggctcca

SEQ ID NO: 6670812 - DNA, 16 bp, Homo sapiens
atgtacccaccgggcc

SEQ ID NO: 6670813 - DNA, 19 bp, Homo sapiens
atgtacccagtagggtttg

SEQ ID NO: 6670814 - DNA, 15 bp, Homo sapiens
atgtaccccctttcc

SEQ ID NO: 6670815 - DNA, 18 bp, Homo sapiens
atgtaccctctgaaatac

SEQ ID NO: 6670816 - DNA, 20 bp, Homo sapiens
atgtaccgatgatactgttt

SEQ ID NO: 6670817 - DNA, 23 bp, Homo sapiens
atgtaccgatgatactgtttctt

SEQ ID NO: 6670818 - DNA, 21 bp, Homo sapiens
atgtacctaatccaaatatca

SEQ ID NO: 6670819 - DNA, 23 bp, Homo sapiens
atgtacctatgtgagtttcagaa

SEQ ID NO: 6670820 - DNA, 20 bp, Homo sapiens
atgtacctcagatctctctc

SEQ ID NO: 6670821 - DNA, 16 bp, Homo sapiens
atgtacctcccctgcc

SEQ ID NO: 6670822 - DNA, 18 bp, Homo sapiens
atgtacctcccctgcctt

SEQ ID NO: 6670823 - DNA, 15 bp, Homo sapiens
atgtacctcttttag

SEQ ID NO: 6670824 - DNA, 21 bp, Homo sapiens
atgtacctcttttagtcattt

SEQ ID NO: 6670825 - DNA, 22 bp, Homo sapiens
atgtaccttctttcactctgtc

SEQ ID NO: 6670826 - DNA, 19 bp, Homo sapiens
atgtacgaaactgtatgat

SEQ ID NO: 6670827 - DNA, 19 bp, Homo sapiens
atgtacgataggtagaatt

SEQ ID NO: 6670828 - DNA, 20 bp, Homo sapiens
atgtacgatgagaaattcaa

SEQ ID NO: 6670829 - DNA, 21 bp, Homo sapiens
atgtacgctgctgcaggacat

SEQ ID NO: 6670830 - DNA, 20 bp, Homo sapiens
atgtacgtccagcctgcccc

SEQ ID NO: 6670831 - DNA, 21 bp, Homo sapiens
atgtacgtttgtatgtgtgta

SEQ ID NO: 6670832 - DNA, 14 bp, Homo sapiens
atgtactaagaatg

SEQ ID NO: 6670833 - DNA, 23 bp, Homo sapiens
atgtactaagaatgtccttattc

SEQ ID NO: 6670834 - DNA, 15 bp, Homo sapiens
atgtactacagctat

SEQ ID NO: 6670835 - DNA, 16 bp, Homo sapiens
atgtactacagctata

SEQ ID NO: 6670836 - DNA, 20 bp, Homo sapiens
atgtactacagctatatttg

SEQ ID NO: 6670837 - DNA, 17 bp, Homo sapiens
atgtactacatttgcat

SEQ ID NO: 6670838 - DNA, 18 bp, Homo sapiens
atgtactacatttgcatg

SEQ ID NO: 6670839 - DNA, 23 bp, Homo sapiens
atgtactaccctcagtctacact

SEQ ID NO: 6670840 - DNA, 21 bp, Homo sapiens
atgtactagtactgtgtactg

SEQ ID NO: 6670841 - DNA, 15 bp, Homo sapiens
atgtactagtgttct

SEQ ID NO: 6670842 - DNA, 16 bp, Homo sapiens
atgtactatatgtata

SEQ ID NO: 6670843 - DNA, 18 bp, Homo sapiens
atgtactatatgtatatc

SEQ ID NO: 6670844 - DNA, 17 bp, Homo sapiens
atgtactatgtctgaac

SEQ ID NO: 6670845 - DNA, 20 bp, Homo sapiens
atgtactatgtctgaacata

SEQ ID NO: 6670846 - DNA, 16 bp, Homo sapiens
atgtactcacatataa

SEQ ID NO: 6670847 - DNA, 19 bp, Homo sapiens
atgtactcacatataacat

SEQ ID NO: 6670848 - DNA, 15 bp, Homo sapiens
atgtactctcctttt

SEQ ID NO: 6670849 - DNA, 20 bp, Homo sapiens
atgtactctgttgagtaaaa

SEQ ID NO: 6670850 - DNA, 17 bp, Homo sapiens
atgtactgaattcttta

SEQ ID NO: 6670851 - DNA, 22 bp, Homo sapiens
atgtactgagacaaaaaggaaa

SEQ ID NO: 6670852 - DNA, 13 bp, Homo sapiens
atgtactgagagg

SEQ ID NO: 6670853 - DNA, 16 bp, Homo sapiens
atgtactgagaggagg

SEQ ID NO: 6670854 - DNA, 18 bp, Homo sapiens
atgtactgattgagaagt

SEQ ID NO: 6670855 - DNA, 16 bp, Homo sapiens
atgtactgatttcagt

SEQ ID NO: 6670856 - DNA, 19 bp, Homo sapiens
atgtactgatttcagtaag

SEQ ID NO: 6670857 - DNA, 20 bp, Homo sapiens
atgtactggagagtggcaaa

SEQ ID NO: 6670858 - DNA, 20 bp, Homo sapiens
atgtactgtacataaattcc

SEQ ID NO: 6670859 - DNA, 13 bp, Homo sapiens
atgtactgtacta

SEQ ID NO: 6670860 - DNA, 14 bp, Homo sapiens
atgtactgtactaa

SEQ ID NO: 6670861 - DNA, 16 bp, Homo sapiens
atgtactgtactaatt

SEQ ID NO: 6670862 - DNA, 17 bp, Homo sapiens
atgtactgtacttccca

SEQ ID NO: 6670863 - DNA, 16 bp, Homo sapiens
atgtactgtagttttt

SEQ ID NO: 6670864 - DNA, 16 bp, Homo sapiens
atgtactgtataacat

SEQ ID NO: 6670865 - DNA, 19 bp, Homo sapiens
atgtactgttgaaaaagat

SEQ ID NO: 6670866 - DNA, 14 bp, Homo sapiens
atgtactgtttgct

SEQ ID NO: 6670867 - DNA, 19 bp, Homo sapiens
atgtacttaagagtggcat

SEQ ID NO: 6670868 - DNA, 16 bp, Homo sapiens
atgtacttaatccttt

SEQ ID NO: 6670869 - DNA, 16 bp, Homo sapiens
atgtacttatattaag

SEQ ID NO: 6670870 - DNA, 21 bp, Homo sapiens
atgtacttccagtatcctgaa

SEQ ID NO: 6670871 - DNA, 14 bp, Homo sapiens
atgtacttcctgtg

SEQ ID NO: 6670872 - DNA, 15 bp, Homo sapiens
atgtacttcctgtgt

SEQ ID NO: 6670873 - DNA, 20 bp, Homo sapiens
atgtacttgaaaaatgtttt

SEQ ID NO: 6670874 - DNA, 14 bp, Homo sapiens
atgtacttgaaaat

SEQ ID NO: 6670875 - DNA, 16 bp, Homo sapiens
atgtacttgtcaaaga

SEQ ID NO: 6670876 - DNA, 22 bp, Homo sapiens
atgtacttgtttgaatatttgt

SEQ ID NO: 6670877 - DNA, 18 bp, Homo sapiens
atgtacttgtttgctatg

SEQ ID NO: 6670878 - DNA, 21 bp, Homo sapiens
atgtactttatattttctata

SEQ ID NO: 6670879 - DNA, 22 bp, Homo sapiens
atgtactttatattttctatat

SEQ ID NO: 6670880 - DNA, 18 bp, Homo sapiens
atgtactttggcatcttt

SEQ ID NO: 6670881 - DNA, 22 bp, Homo sapiens
atgtactttggcatcttttgga

SEQ ID NO: 6670882 - DNA, 14 bp, Homo sapiens
atgtacttttccat

SEQ ID NO: 6670883 - DNA, 14 bp, Homo sapiens
atgtactttttagt

SEQ ID NO: 6670884 - DNA, 15 bp, Homo sapiens
atgtactttttagta

SEQ ID NO: 6670885 - DNA, 16 bp, Homo sapiens
atgtactttttattgc

SEQ ID NO: 6670886 - DNA, 23 bp, Homo sapiens
atgtagaaaagagacttctctgt

SEQ ID NO: 6670887 - DNA, 17 bp, Homo sapiens
atgtagaaacatttaga

SEQ ID NO: 6670888 - DNA, 14 bp, Homo sapiens
atgtagaaataaat

SEQ ID NO: 6670889 - DNA, 17 bp, Homo sapiens
atgtagaaataaattac

SEQ ID NO: 6670890 - DNA, 23 bp, Homo sapiens
atgtagaaattctaacttaatgt

SEQ ID NO: 6670891 - DNA, 12 bp, Homo sapiens
atgtagaactgt

SEQ ID NO: 6670892 - DNA, 15 bp, Homo sapiens
atgtagaactgttca

SEQ ID NO: 6670893 - DNA, 21 bp, Homo sapiens
atgtagaactgttcatttcca

SEQ ID NO: 6670894 - DNA, 22 bp, Homo sapiens
atgtagaactgttcatttccac

SEQ ID NO: 6670895 - DNA, 16 bp, Homo sapiens
atgtagaagaaagcaa

SEQ ID NO: 6670896 - DNA, 14 bp, Homo sapiens
atgtagaagaggga

SEQ ID NO: 6670897 - DNA, 13 bp, Homo sapiens
atgtagaagctgc

SEQ ID NO: 6670898 - DNA, 17 bp, Homo sapiens
atgtagaagtctttcag

SEQ ID NO: 6670899 - DNA, 18 bp, Homo sapiens
atgtagaagtctttcaga

SEQ ID NO: 6670900 - DNA, 17 bp, Homo sapiens
atgtagaataaatgaag

SEQ ID NO: 6670901 - DNA, 17 bp, Homo sapiens
atgtagaatattcagac

SEQ ID NO: 6670902 - DNA, 20 bp, Homo sapiens
atgtagaatattcagacaaa

SEQ ID NO: 6670903 - DNA, 14 bp, Homo sapiens
atgtagaatgattt

SEQ ID NO: 6670904 - DNA, 18 bp, Homo sapiens
atgtagacagttgggttt

SEQ ID NO: 6670905 - DNA, 18 bp, Homo sapiens
atgtagacattgtaaata

SEQ ID NO: 6670906 - DNA, 19 bp, Homo sapiens
atgtagactatatacatgt

SEQ ID NO: 6670907 - DNA, 17 bp, Homo sapiens
atgtagactgtgccaga

SEQ ID NO: 6670908 - DNA, 22 bp, Homo sapiens
atgtagactgtgccagaggcca

SEQ ID NO: 6670909 - DNA, 16 bp, Homo sapiens
atgtagagagaacagg

SEQ ID NO: 6670910 - DNA, 13 bp, Homo sapiens
atgtagaggagaa

SEQ ID NO: 6670911 - DNA, 17 bp, Homo sapiens
atgtagaggagaaactg

SEQ ID NO: 6670912 - DNA, 16 bp, Homo sapiens
atgtagaggctttatg

SEQ ID NO: 6670913 - DNA, 19 bp, Homo sapiens
atgtagaggggaaaagaga

SEQ ID NO: 6670914 - DNA, 19 bp, Homo sapiens
atgtagataacaagacctc

SEQ ID NO: 6670915 - DNA, 18 bp, Homo sapiens
atgtagatataaatataa

SEQ ID NO: 6670916 - DNA, 20 bp, Homo sapiens
atgtagatatttggcttaaa

SEQ ID NO: 6670917 - DNA, 19 bp, Homo sapiens
atgtagatcaagtgtgcat

SEQ ID NO: 6670918 - DNA, 16 bp, Homo sapiens
atgtagatgatatgtt

SEQ ID NO: 6670919 - DNA, 16 bp, Homo sapiens
atgtagattagtgatc

SEQ ID NO: 6670920 - DNA, 17 bp, Homo sapiens
atgtagatttatttcat

SEQ ID NO: 6670921 - DNA, 18 bp, Homo sapiens
atgtagcaaattccaata

SEQ ID NO: 6670922 - DNA, 20 bp, Homo sapiens
atgtagcaaattccaataca

SEQ ID NO: 6670923 - DNA, 18 bp, Homo sapiens
atgtagcaatcagatttt

SEQ ID NO: 6670924 - DNA, 12 bp, Homo sapiens
atgtagcacctt

SEQ ID NO: 6670925 - DNA, 20 bp, Homo sapiens
atgtagcaccttttctcctc

SEQ ID NO: 6670926 - DNA, 18 bp, Homo sapiens
atgtagcacttacgtaaa

SEQ ID NO: 6670927 - DNA, 14 bp, Homo sapiens
atgtagcagtgagt

SEQ ID NO: 6670928 - DNA, 14 bp, Homo sapiens
atgtagcatgcttg

SEQ ID NO: 6670929 - DNA, 19 bp, Homo sapiens
atgtagcatgcttgttgca

SEQ ID NO: 6670930 - DNA, 15 bp, Homo sapiens
atgtagccagacagt

SEQ ID NO: 6670931 - DNA, 13 bp, Homo sapiens
atgtagccagccc

SEQ ID NO: 6670932 - DNA, 19 bp, Homo sapiens
atgtagccccagtcagaag

SEQ ID NO: 6670933 - DNA, 18 bp, Homo sapiens
atgtagccccctggcctc

SEQ ID NO: 6670934 - DNA, 21 bp, Homo sapiens
atgtagccccctggcctctgt

SEQ ID NO: 6670935 - DNA, 19 bp, Homo sapiens
atgtagcccctctcctgga

SEQ ID NO: 6670936 - DNA, 16 bp, Homo sapiens
atgtagccttcacaca

SEQ ID NO: 6670937 - DNA, 20 bp, Homo sapiens
atgtagccttttatccctca

SEQ ID NO: 6670938 - DNA, 19 bp, Homo sapiens
atgtagcgctttgaatatg

SEQ ID NO: 6670939 - DNA, 21 bp, Homo sapiens
atgtagcgtgtttacatgtgt

SEQ ID NO: 6670940 - DNA, 12 bp, Homo sapiens
atgtagctcttt

SEQ ID NO: 6670941 - DNA, 21 bp, Homo sapiens
atgtagctctttgtcagggag

SEQ ID NO: 6670942 - DNA, 12 bp, Homo sapiens
atgtagctggca

SEQ ID NO: 6670943 - DNA, 17 bp, Homo sapiens
atgtagctggcaagctg

SEQ ID NO: 6670944 - DNA, 21 bp, Homo sapiens
atgtagctgtcgtacattgag

SEQ ID NO: 6670945 - DNA, 15 bp, Homo sapiens
atgtagcttccacct

SEQ ID NO: 6670946 - DNA, 18 bp, Homo sapiens
atgtagcttcttctgaaa

SEQ ID NO: 6670947 - DNA, 16 bp, Homo sapiens
atgtagcttgacaatt

SEQ ID NO: 6670948 - DNA, 22 bp, Homo sapiens
atgtagcttttatgtgatatgt

SEQ ID NO: 6670949 - DNA, 16 bp, Homo sapiens
atgtaggaaaaaaata

SEQ ID NO: 6670950 - DNA, 17 bp, Homo sapiens
atgtaggaaaaaaatag

SEQ ID NO: 6670951 - DNA, 21 bp, Homo sapiens
atgtaggaaaaaaatagtcta

SEQ ID NO: 6670952 - DNA, 22 bp, Homo sapiens
atgtaggaaagaccatttttcc

SEQ ID NO: 6670953 - DNA, 14 bp, Homo sapiens
atgtaggagctgca

SEQ ID NO: 6670954 - DNA, 13 bp, Homo sapiens
atgtaggagggac

SEQ ID NO: 6670955 - DNA, 20 bp, Homo sapiens
atgtaggatgacaggctctc

SEQ ID NO: 6670956 - DNA, 23 bp, Homo sapiens
atgtaggcccctggtctgccctg

SEQ ID NO: 6670957 - DNA, 20 bp, Homo sapiens
atgtagggcataatgatgat

SEQ ID NO: 6670958 - DNA, 16 bp, Homo sapiens
atgtaggtaagactgt

SEQ ID NO: 6670959 - DNA, 17 bp, Homo sapiens
atgtaggtgagcctggg

SEQ ID NO: 6670960 - DNA, 18 bp, Homo sapiens
atgtaggtgagcctgggc

SEQ ID NO: 6670961 - DNA, 15 bp, Homo sapiens
atgtagtaacactaa

SEQ ID NO: 6670962 - DNA, 13 bp, Homo sapiens
atgtagtaattga

SEQ ID NO: 6670963 - DNA, 23 bp, Homo sapiens
atgtagtatcaaatattagatgt

SEQ ID NO: 6670964 - DNA, 14 bp, Homo sapiens
atgtagtatctata

SEQ ID NO: 6670965 - DNA, 20 bp, Homo sapiens
atgtagtatggcctgacagc

SEQ ID NO: 6670966 - DNA, 18 bp, Homo sapiens
atgtagtattaaaagttg

SEQ ID NO: 6670967 - DNA, 18 bp, Homo sapiens
atgtagtcagttgcattc

SEQ ID NO: 6670968 - DNA, 16 bp, Homo sapiens
atgtagtcataataaa

SEQ ID NO: 6670969 - DNA, 17 bp, Homo sapiens
atgtagtcataataaat

SEQ ID NO: 6670970 - DNA, 19 bp, Homo sapiens
atgtagtccgttaacacta

SEQ ID NO: 6670971 - DNA, 17 bp, Homo sapiens
atgtagtctcacactgt

SEQ ID NO: 6670972 - DNA, 18 bp, Homo sapiens
atgtagtcttgacgaata

SEQ ID NO: 6670973 - DNA, 17 bp, Homo sapiens
atgtagtgattaaatat

SEQ ID NO: 6670974 - DNA, 20 bp, Homo sapiens
atgtagtgcatttttaaact

SEQ ID NO: 6670975 - DNA, 14 bp, Homo sapiens
atgtagtgcctctt

SEQ ID NO: 6670976 - DNA, 15 bp, Homo sapiens
atgtagtggttttag

SEQ ID NO: 6670977 - DNA, 19 bp, Homo sapiens
atgtagttaaatagctata

SEQ ID NO: 6670978 - DNA, 14 bp, Homo sapiens
atgtagttcatact

SEQ ID NO: 6670979 - DNA, 18 bp, Homo sapiens
atgtagttctgctccaga

SEQ ID NO: 6670980 - DNA, 16 bp, Homo sapiens
atgtagttctttgttc

SEQ ID NO: 6670981 - DNA, 21 bp, Homo sapiens
atgtagttgtcacactaaaat

SEQ ID NO: 6670982 - DNA, 19 bp, Homo sapiens
atgtagtttgaggaaattt

SEQ ID NO: 6670983 - DNA, 20 bp, Homo sapiens
atgtagttttaaataaagtt

SEQ ID NO: 6670984 - DNA, 17 bp, Homo sapiens
atgtagttttgtttatg

SEQ ID NO: 6670985 - DNA, 19 bp, Homo sapiens
atgtataaaaattatcaaa

SEQ ID NO: 6670986 - DNA, 21 bp, Homo sapiens
atgtataaaaattatcaaaaa

SEQ ID NO: 6670987 - DNA, 14 bp, Homo sapiens
atgtataaaatgta

SEQ ID NO: 6670988 - DNA, 15 bp, Homo sapiens
atgtataaaatgtaa

SEQ ID NO: 6670989 - DNA, 16 bp, Homo sapiens
atgtataaaatgtaac

SEQ ID NO: 6670990 - DNA, 23 bp, Homo sapiens
atgtataaacataagttgcattt

SEQ ID NO: 6670991 - DNA, 17 bp, Homo sapiens
atgtataaagattgtac

SEQ ID NO: 6670992 - DNA, 20 bp, Homo sapiens
atgtataaagattgtactta

SEQ ID NO: 6670993 - DNA, 21 bp, Homo sapiens
atgtataaagcaactgttatg

SEQ ID NO: 6670994 - DNA, 22 bp, Homo sapiens
atgtataaagcaactgttatga

SEQ ID NO: 6670995 - DNA, 12 bp, Homo sapiens
atgtataaatat

SEQ ID NO: 6670996 - DNA, 17 bp, Homo sapiens
atgtataaatatacagt

SEQ ID NO: 6670997 - DNA, 14 bp, Homo sapiens
atgtataaatgtga

SEQ ID NO: 6670998 - DNA, 13 bp, Homo sapiens
atgtataaattaa

SEQ ID NO: 6670999 - DNA, 19 bp, Homo sapiens
atgtataaattattcagaa

SEQ ID NO: 6671000 - DNA, 14 bp, Homo sapiens
atgtataaccaagt

SEQ ID NO: 6671001 - DNA, 18 bp, Homo sapiens
atgtataagtaaatatat

SEQ ID NO: 6671002 - DNA, 12 bp, Homo sapiens
atgtataataca

SEQ ID NO: 6671003 - DNA, 12 bp, Homo sapiens
atgtataatata

SEQ ID NO: 6671004 - DNA, 16 bp, Homo sapiens
atgtataatatatatc

SEQ ID NO: 6671005 - DNA, 18 bp, Homo sapiens
atgtataatatatatcta

SEQ ID NO: 6671006 - DNA, 12 bp, Homo sapiens
atgtataatgta

SEQ ID NO: 6671007 - DNA, 14 bp, Homo sapiens
atgtataatgtaat

SEQ ID NO: 6671008 - DNA, 22 bp, Homo sapiens
atgtataatgtgcagaaaatat

SEQ ID NO: 6671009 - DNA, 15 bp, Homo sapiens
atgtataattaactt

SEQ ID NO: 6671010 - DNA, 21 bp, Homo sapiens
atgtataattaacttaactga

SEQ ID NO: 6671011 - DNA, 22 bp, Homo sapiens
atgtataattaacttaactgaa

SEQ ID NO: 6671012 - DNA, 17 bp, Homo sapiens
atgtataatttgaggtg

SEQ ID NO: 6671013 - DNA, 12 bp, Homo sapiens
atgtatacacac

SEQ ID NO: 6671014 - DNA, 18 bp, Homo sapiens
atgtatacacacatatac

SEQ ID NO: 6671015 - DNA, 14 bp, Homo sapiens
atgtatacaccaag

SEQ ID NO: 6671016 - DNA, 14 bp, Homo sapiens
atgtatacatctta

SEQ ID NO: 6671017 - DNA, 15 bp, Homo sapiens
atgtatacgcacgca

SEQ ID NO: 6671018 - DNA, 17 bp, Homo sapiens
atgtatacgcacgcacc

SEQ ID NO: 6671019 - DNA, 18 bp, Homo sapiens
atgtatacgcacgcaccc

SEQ ID NO: 6671020 - DNA, 20 bp, Homo sapiens
atgtatacgcacgcacccac

SEQ ID NO: 6671021 - DNA, 19 bp, Homo sapiens
atgtatactatagtaccag

SEQ ID NO: 6671022 - DNA, 21 bp, Homo sapiens
atgtatactgccactaacctt

SEQ ID NO: 6671023 - DNA, 17 bp, Homo sapiens
atgtatacttcagtgct

SEQ ID NO: 6671024 - DNA, 23 bp, Homo sapiens
atgtatacttgaaaaatgttata

SEQ ID NO: 6671025 - DNA, 17 bp, Homo sapiens
atgtatagctttaacat

SEQ ID NO: 6671026 - DNA, 16 bp, Homo sapiens
atgtatagtaaatcac

SEQ ID NO: 6671027 - DNA, 15 bp, Homo sapiens
atgtatataaaatgt

SEQ ID NO: 6671028 - DNA, 12 bp, Homo sapiens
atgtatatacac

SEQ ID NO: 6671029 - DNA, 21 bp, Homo sapiens
atgtatatacacacatgtata

SEQ ID NO: 6671030 - DNA, 14 bp, Homo sapiens
atgtatatacacat

SEQ ID NO: 6671031 - DNA, 17 bp, Homo sapiens
atgtatatacacatata

SEQ ID NO: 6671032 - DNA, 22 bp, Homo sapiens
atgtatatactatacaacaatg

SEQ ID NO: 6671033 - DNA, 16 bp, Homo sapiens
atgtatatagatgtgc

SEQ ID NO: 6671034 - DNA, 19 bp, Homo sapiens
atgtatatatatatagtaa

SEQ ID NO: 6671035 - DNA, 14 bp, Homo sapiens
atgtatatatattc

SEQ ID NO: 6671036 - DNA, 18 bp, Homo sapiens
atgtatatatattctcag

SEQ ID NO: 6671037 - DNA, 19 bp, Homo sapiens
atgtatatatattctcagc

SEQ ID NO: 6671038 - DNA, 13 bp, Homo sapiens
atgtatatatcta

SEQ ID NO: 6671039 - DNA, 15 bp, Homo sapiens
atgtatatctatatc

SEQ ID NO: 6671040 - DNA, 19 bp, Homo sapiens
atgtatatctatatctcta

SEQ ID NO: 6671041 - DNA, 23 bp, Homo sapiens
atgtatatctgtaatatataatc

SEQ ID NO: 6671042 - DNA, 22 bp, Homo sapiens
atgtatatctgtgtaagacacg

SEQ ID NO: 6671043 - DNA, 23 bp, Homo sapiens
atgtatatctgtgtaagacacgt

SEQ ID NO: 6671044 - DNA, 14 bp, Homo sapiens
atgtatatgtatat

SEQ ID NO: 6671045 - DNA, 17 bp, Homo sapiens
atgtatattaaaaaaga

SEQ ID NO: 6671046 - DNA, 13 bp, Homo sapiens
atgtatattactg

SEQ ID NO: 6671047 - DNA, 14 bp, Homo sapiens
atgtatattactga

SEQ ID NO: 6671048 - DNA, 19 bp, Homo sapiens
atgtatattgtgttgcaaa

SEQ ID NO: 6671049 - DNA, 19 bp, Homo sapiens
atgtatatttaaaagaaag

SEQ ID NO: 6671050 - DNA, 14 bp, Homo sapiens
atgtatatttacca

SEQ ID NO: 6671051 - DNA, 18 bp, Homo sapiens
atgtatattttatataaa

SEQ ID NO: 6671052 - DNA, 13 bp, Homo sapiens
atgtatattttca

SEQ ID NO: 6671053 - DNA, 14 bp, Homo sapiens
atgtatcaaactgt

SEQ ID NO: 6671054 - DNA, 12 bp, Homo sapiens
atgtatcaatga

SEQ ID NO: 6671055 - DNA, 11 bp, Homo sapiens
atgtatcacta

SEQ ID NO: 6671056 - DNA, 14 bp, Homo sapiens
atgtatcagctctc

SEQ ID NO: 6671057 - DNA, 18 bp, Homo sapiens
atgtatcagtgtcctttc

SEQ ID NO: 6671058 - DNA, 21 bp, Homo sapiens
atgtatcagtgtcctttccag

SEQ ID NO: 6671059 - DNA, 16 bp, Homo sapiens
atgtatcatagaaatg

SEQ ID NO: 6671060 - DNA, 16 bp, Homo sapiens
atgtatcattaatgta

SEQ ID NO: 6671061 - DNA, 18 bp, Homo sapiens
atgtatcatttttgtgca

SEQ ID NO: 6671062 - DNA, 21 bp, Homo sapiens
atgtatcatttttgtgcacag

SEQ ID NO: 6671063 - DNA, 15 bp, Homo sapiens
atgtatccagtacat

SEQ ID NO: 6671064 - DNA, 20 bp, Homo sapiens
atgtatccatgggggcaggg

SEQ ID NO: 6671065 - DNA, 17 bp, Homo sapiens
atgtatcctctataatt

SEQ ID NO: 6671066 - DNA, 16 bp, Homo sapiens
atgtatcgctcctatt

SEQ ID NO: 6671067 - DNA, 20 bp, Homo sapiens
atgtatctacaatacatata

SEQ ID NO: 6671068 - DNA, 16 bp, Homo sapiens
atgtatctatttatta

SEQ ID NO: 6671069 - DNA, 14 bp, Homo sapiens
atgtatctatttgt

SEQ ID NO: 6671070 - DNA, 15 bp, Homo sapiens
atgtatctgagcagg

SEQ ID NO: 6671071 - DNA, 17 bp, Homo sapiens
atgtatctgagttgcca

SEQ ID NO: 6671072 - DNA, 16 bp, Homo sapiens
atgtatctgcatatgt

SEQ ID NO: 6671073 - DNA, 17 bp, Homo sapiens
atgtatctgcatatgtt

SEQ ID NO: 6671074 - DNA, 16 bp, Homo sapiens
atgtatctgtctactt

SEQ ID NO: 6671075 - DNA, 22 bp, Homo sapiens
atgtatctgtctactttctctt

SEQ ID NO: 6671076 - DNA, 19 bp, Homo sapiens
atgtatcttaaaggacata

SEQ ID NO: 6671077 - DNA, 22 bp, Homo sapiens
atgtatcttaaaggacataaaa

SEQ ID NO: 6671078 - DNA, 18 bp, Homo sapiens
atgtatcttatttatata

SEQ ID NO: 6671079 - DNA, 21 bp, Homo sapiens
atgtatcttatttatatatga

SEQ ID NO: 6671080 - DNA, 22 bp, Homo sapiens
atgtatcttatttatatatgaa

SEQ ID NO: 6671081 - DNA, 16 bp, Homo sapiens
atgtatctttattaaa

SEQ ID NO: 6671082 - DNA, 13 bp, Homo sapiens
atgtatgaaattg

SEQ ID NO: 6671083 - DNA, 22 bp, Homo sapiens
atgtatgaaggaatcattccag

SEQ ID NO: 6671084 - DNA, 17 bp, Homo sapiens
atgtatgaatacagcag

SEQ ID NO: 6671085 - DNA, 17 bp, Homo sapiens
atgtatgaattttgtaa

SEQ ID NO: 6671086 - DNA, 22 bp, Homo sapiens
atgtatgatctctctagctttg

SEQ ID NO: 6671087 - DNA, 14 bp, Homo sapiens
atgtatgattacat

SEQ ID NO: 6671088 - DNA, 17 bp, Homo sapiens
atgtatgcagctatctg

SEQ ID NO: 6671089 - DNA, 15 bp, Homo sapiens
atgtatgcatgttgt

SEQ ID NO: 6671090 - DNA, 19 bp, Homo sapiens
atgtatgcatgttgtctaa

SEQ ID NO: 6671091 - DNA, 15 bp, Homo sapiens
atgtatgccatgtat

SEQ ID NO: 6671092 - DNA, 13 bp, Homo sapiens
atgtatgcctgca

SEQ ID NO: 6671093 - DNA, 21 bp, Homo sapiens
atgtatgccttcgggaaaatt

SEQ ID NO: 6671094 - DNA, 13 bp, Homo sapiens
atgtatgctgttt

SEQ ID NO: 6671095 - DNA, 23 bp, Homo sapiens
atgtatgcttccagggacaagct

SEQ ID NO: 6671096 - DNA, 14 bp, Homo sapiens
atgtatggatatat

SEQ ID NO: 6671097 - DNA, 22 bp, Homo sapiens
atgtatggatatatttgaaata

SEQ ID NO: 6671098 - DNA, 20 bp, Homo sapiens
atgtatggcttttctcttgc

SEQ ID NO: 6671099 - DNA, 22 bp, Homo sapiens
atgtatggtgcaatgtgtgtat

SEQ ID NO: 6671100 - DNA, 15 bp, Homo sapiens
atgtatgtaaaaatg

SEQ ID NO: 6671101 - DNA, 16 bp, Homo sapiens
atgtatgtaaatagat

SEQ ID NO: 6671102 - DNA, 18 bp, Homo sapiens
atgtatgtacaatacaat

SEQ ID NO: 6671103 - DNA, 18 bp, Homo sapiens
atgtatgtatgagacaga

SEQ ID NO: 6671104 - DNA, 17 bp, Homo sapiens
atgtatgtgaaagtgta

SEQ ID NO: 6671105 - DNA, 16 bp, Homo sapiens
atgtatgtgcactgtc

SEQ ID NO: 6671106 - DNA, 19 bp, Homo sapiens
atgtatgtgccaattttgt

SEQ ID NO: 6671107 - DNA, 15 bp, Homo sapiens
atgtatgtggaagca

SEQ ID NO: 6671108 - DNA, 17 bp, Homo sapiens
atgtatgtgtaataaat

SEQ ID NO: 6671109 - DNA, 13 bp, Homo sapiens
atgtatgtgtagt

SEQ ID NO: 6671110 - DNA, 13 bp, Homo sapiens
atgtatgtgtata

SEQ ID NO: 6671111 - DNA, 14 bp, Homo sapiens
atgtatgtgtatat

SEQ ID NO: 6671112 - DNA, 18 bp, Homo sapiens
atgtatgtgtatatgttt

SEQ ID NO: 6671113 - DNA, 20 bp, Homo sapiens
atgtatgtgtatatgtttat

SEQ ID NO: 6671114 - DNA, 22 bp, Homo sapiens
atgtatgtgtatatgtttatac

SEQ ID NO: 6671115 - DNA, 20 bp, Homo sapiens
atgtatgtgtgaaacaatgt

SEQ ID NO: 6671116 - DNA, 19 bp, Homo sapiens
atgtatgtgtgagtgtatg

SEQ ID NO: 6671117 - DNA, 13 bp, Homo sapiens
atgtatgtgtgtg

SEQ ID NO: 6671118 - DNA, 17 bp, Homo sapiens
atgtatgtgtttagaat

SEQ ID NO: 6671119 - DNA, 20 bp, Homo sapiens
atgtatgtgtttagaattga

SEQ ID NO: 6671120 - DNA, 12 bp, Homo sapiens
atgtatgttaat

SEQ ID NO: 6671121 - DNA, 19 bp, Homo sapiens
atgtatgttcagaagaaat

SEQ ID NO: 6671122 - DNA, 13 bp, Homo sapiens
atgtatgttcttg

SEQ ID NO: 6671123 - DNA, 18 bp, Homo sapiens
atgtatgttggtttttta

SEQ ID NO: 6671124 - DNA, 13 bp, Homo sapiens
atgtatgtttaca

SEQ ID NO: 6671125 - DNA, 17 bp, Homo sapiens
atgtatgtttacatatc

SEQ ID NO: 6671126 - DNA, 12 bp, Homo sapiens
atgtatgtttct

SEQ ID NO: 6671127 - DNA, 16 bp, Homo sapiens
atgtatgtttctgcat

SEQ ID NO: 6671128 - DNA, 21 bp, Homo sapiens
atgtatgttttttactgtttg

SEQ ID NO: 6671129 - DNA, 20 bp, Homo sapiens
atgtattaaacttttcatta

SEQ ID NO: 6671130 - DNA, 12 bp, Homo sapiens
atgtattaaatt

SEQ ID NO: 6671131 - DNA, 16 bp, Homo sapiens
atgtattaaattacat

SEQ ID NO: 6671132 - DNA, 21 bp, Homo sapiens
atgtattaataaatagagcaa

SEQ ID NO: 6671133 - DNA, 12 bp, Homo sapiens
atgtattaatct

SEQ ID NO: 6671134 - DNA, 15 bp, Homo sapiens
atgtattaatctgtt

SEQ ID NO: 6671135 - DNA, 22 bp, Homo sapiens
atgtattacagtggggaatgaa

SEQ ID NO: 6671136 - DNA, 23 bp, Homo sapiens
atgtattaccagccccccacccc

SEQ ID NO: 6671137 - DNA, 21 bp, Homo sapiens
atgtattagtgatatttctct

SEQ ID NO: 6671138 - DNA, 15 bp, Homo sapiens
atgtattataacttt

SEQ ID NO: 6671139 - DNA, 18 bp, Homo sapiens
atgtattatgaaaaagat

SEQ ID NO: 6671140 - DNA, 12 bp, Homo sapiens
atgtattatgct

SEQ ID NO: 6671141 - DNA, 20 bp, Homo sapiens
atgtattatgtcctgtgaga

SEQ ID NO: 6671142 - DNA, 17 bp, Homo sapiens
atgtattattctgcagc

SEQ ID NO: 6671143 - DNA, 15 bp, Homo sapiens
atgtattatttataa

SEQ ID NO: 6671144 - DNA, 16 bp, Homo sapiens
atgtattatttataat

SEQ ID NO: 6671145 - DNA, 15 bp, Homo sapiens
atgtattatttcatt

SEQ ID NO: 6671146 - DNA, 14 bp, Homo sapiens
atgtattcaaatac

SEQ ID NO: 6671147 - DNA, 18 bp, Homo sapiens
atgtattcaagcaaacat

SEQ ID NO: 6671148 - DNA, 17 bp, Homo sapiens
atgtattcacacacccc

SEQ ID NO: 6671149 - DNA, 16 bp, Homo sapiens
atgtattcatccagag

SEQ ID NO: 6671150 - DNA, 18 bp, Homo sapiens
atgtattcatccagagtt

SEQ ID NO: 6671151 - DNA, 17 bp, Homo sapiens
atgtattcccttatctt

SEQ ID NO: 6671152 - DNA, 23 bp, Homo sapiens
atgtattcccttcctctgatttg

SEQ ID NO: 6671153 - DNA, 15 bp, Homo sapiens
atgtattcccttgta

SEQ ID NO: 6671154 - DNA, 17 bp, Homo sapiens
atgtattcccttgtatt

SEQ ID NO: 6671155 - DNA, 13 bp, Homo sapiens
atgtattcctgaa

SEQ ID NO: 6671156 - DNA, 18 bp, Homo sapiens
atgtattcctgaaaagct

SEQ ID NO: 6671157 - DNA, 19 bp, Homo sapiens
atgtattcctttaaaatat

SEQ ID NO: 6671158 - DNA, 22 bp, Homo sapiens
atgtattcctttaaaatattgt

SEQ ID NO: 6671159 - DNA, 12 bp, Homo sapiens
atgtattctgta

SEQ ID NO: 6671160 - DNA, 16 bp, Homo sapiens
atgtattctgtatccg

SEQ ID NO: 6671161 - DNA, 15 bp, Homo sapiens
atgtattctttataa

SEQ ID NO: 6671162 - DNA, 18 bp, Homo sapiens
atgtattctttctgcctt

SEQ ID NO: 6671163 - DNA, 17 bp, Homo sapiens
atgtattcttttatata

SEQ ID NO: 6671164 - DNA, 22 bp, Homo sapiens
atgtattgaagaggatattctt

SEQ ID NO: 6671165 - DNA, 14 bp, Homo sapiens
atgtattgactgta

SEQ ID NO: 6671166 - DNA, 22 bp, Homo sapiens
atgtattgattacaaataaaca

SEQ ID NO: 6671167 - DNA, 12 bp, Homo sapiens
atgtattgattc

SEQ ID NO: 6671168 - DNA, 21 bp, Homo sapiens
atgtattggcatttatttatg

SEQ ID NO: 6671169 - DNA, 15 bp, Homo sapiens
atgtattggcctgga

SEQ ID NO: 6671170 - DNA, 14 bp, Homo sapiens
atgtattgtaaaca

SEQ ID NO: 6671171 - DNA, 20 bp, Homo sapiens
atgtattgtaaacagaagga

SEQ ID NO: 6671172 - DNA, 20 bp, Homo sapiens
atgtattgtaaacatgtgtt

SEQ ID NO: 6671173 - DNA, 15 bp, Homo sapiens
atgtattgtgcaatg

SEQ ID NO: 6671174 - DNA, 22 bp, Homo sapiens
atgtattgtgcaatgtgtataa

SEQ ID NO: 6671175 - DNA, 19 bp, Homo sapiens
atgtattgtgtcttttgca

SEQ ID NO: 6671176 - DNA, 20 bp, Homo sapiens
atgtattgtgtcttttgcat

SEQ ID NO: 6671177 - DNA, 22 bp, Homo sapiens
atgtattgtgtcttttgcatga

SEQ ID NO: 6671178 - DNA, 23 bp, Homo sapiens
atgtattgtttgggatcctattg

SEQ ID NO: 6671179 - DNA, 17 bp, Homo sapiens
atgtattgttttactcc

SEQ ID NO: 6671180 - DNA, 21 bp, Homo sapiens
atgtatttaaagaacactgca

SEQ ID NO: 6671181 - DNA, 19 bp, Homo sapiens
atgtatttaaagttgtatc

SEQ ID NO: 6671182 - DNA, 22 bp, Homo sapiens
atgtatttaccaaaaattttgt

SEQ ID NO: 6671183 - DNA, 16 bp, Homo sapiens
atgtatttagctacag

SEQ ID NO: 6671184 - DNA, 21 bp, Homo sapiens
atgtatttaggactgaaaata

SEQ ID NO: 6671185 - DNA, 21 bp, Homo sapiens
atgtatttataatttaaatga

SEQ ID NO: 6671186 - DNA, 20 bp, Homo sapiens
atgtatttatatgttaattt

SEQ ID NO: 6671187 - DNA, 15 bp, Homo sapiens
atgtatttatgtgta

SEQ ID NO: 6671188 - DNA, 16 bp, Homo sapiens
atgtatttatttaaaa

SEQ ID NO: 6671189 - DNA, 16 bp, Homo sapiens
atgtatttcagggacc

SEQ ID NO: 6671190 - DNA, 21 bp, Homo sapiens
atgtatttcagggacctcagg

SEQ ID NO: 6671191 - DNA, 22 bp, Homo sapiens
atgtatttcagggacctcaggg

SEQ ID NO: 6671192 - DNA, 23 bp, Homo sapiens
atgtatttcagggacctcagggg

SEQ ID NO: 6671193 - DNA, 23 bp, Homo sapiens
atgtatttcattgctgtgtcaca

SEQ ID NO: 6671194 - DNA, 23 bp, Homo sapiens
atgtatttctttagaacaacata

SEQ ID NO: 6671195 - DNA, 18 bp, Homo sapiens
atgtatttgaaaattaca

SEQ ID NO: 6671196 - DNA, 21 bp, Homo sapiens
atgtatttgaaaattacatgt

SEQ ID NO: 6671197 - DNA, 22 bp, Homo sapiens
atgtatttgaaaattacatgtt

SEQ ID NO: 6671198 - DNA, 23 bp, Homo sapiens
atgtatttgaaaattacatgttt

SEQ ID NO: 6671199 - DNA, 14 bp, Homo sapiens
atgtatttgattta

SEQ ID NO: 6671200 - DNA, 15 bp, Homo sapiens
atgtatttgtagtgt

SEQ ID NO: 6671201 - DNA, 14 bp, Homo sapiens
atgtatttgtttgc

SEQ ID NO: 6671202 - DNA, 16 bp, Homo sapiens
atgtattttaaaataa

SEQ ID NO: 6671203 - DNA, 21 bp, Homo sapiens
atgtattttaactatttttgt

SEQ ID NO: 6671204 - DNA, 12 bp, Homo sapiens
atgtattttaca

SEQ ID NO: 6671205 - DNA, 13 bp, Homo sapiens
atgtattttacac

SEQ ID NO: 6671206 - DNA, 13 bp, Homo sapiens
atgtattttatgt

SEQ ID NO: 6671207 - DNA, 19 bp, Homo sapiens
atgtattttattattttct

SEQ ID NO: 6671208 - DNA, 15 bp, Homo sapiens
atgtattttattgta

SEQ ID NO: 6671209 - DNA, 20 bp, Homo sapiens
atgtattttattgtaacaga

SEQ ID NO: 6671210 - DNA, 23 bp, Homo sapiens
atgtattttattgtaacagacat

SEQ ID NO: 6671211 - DNA, 19 bp, Homo sapiens
atgtattttcaaatgtaaa

SEQ ID NO: 6671212 - DNA, 22 bp, Homo sapiens
atgtattttcaataaagaaaaa

SEQ ID NO: 6671213 - DNA, 19 bp, Homo sapiens
atgtattttcctaatgtga

SEQ ID NO: 6671214 - DNA, 18 bp, Homo sapiens
atgtattttgaaaacact

SEQ ID NO: 6671215 - DNA, 20 bp, Homo sapiens
atgtattttgaaaacactta

SEQ ID NO: 6671216 - DNA, 17 bp, Homo sapiens
atgtattttgaagaata

SEQ ID NO: 6671217 - DNA, 19 bp, Homo sapiens
atgtattttgaagaatatt

SEQ ID NO: 6671218 - DNA, 20 bp, Homo sapiens
atgtattttgaagaatattt

SEQ ID NO: 6671219 - DNA, 16 bp, Homo sapiens
atgtattttgacactg

SEQ ID NO: 6671220 - DNA, 21 bp, Homo sapiens
atgtattttggaagacatata

SEQ ID NO: 6671221 - DNA, 19 bp, Homo sapiens
atgtattttggttgctgat

SEQ ID NO: 6671222 - DNA, 14 bp, Homo sapiens
atgtattttgtaaa

SEQ ID NO: 6671223 - DNA, 23 bp, Homo sapiens
atgtattttgtaaactgatgttt

SEQ ID NO: 6671224 - DNA, 17 bp, Homo sapiens
atgtattttgtgagttt

SEQ ID NO: 6671225 - DNA, 16 bp, Homo sapiens
atgtatttttctatgt

SEQ ID NO: 6671226 - DNA, 18 bp, Homo sapiens
atgtatttttcttgctgt

SEQ ID NO: 6671227 - DNA, 22 bp, Homo sapiens
atgtatttttcttgctgttcag

SEQ ID NO: 6671228 - DNA, 17 bp, Homo sapiens
atgtatttttgtaccct

SEQ ID NO: 6671229 - DNA, 17 bp, Homo sapiens
atgtcaaaaatatttag

SEQ ID NO: 6671230 - DNA, 23 bp, Homo sapiens
atgtcaaaagtagaactttgtat

SEQ ID NO: 6671231 - DNA, 14 bp, Homo sapiens
atgtcaaacaaata

SEQ ID NO: 6671232 - DNA, 21 bp, Homo sapiens
atgtcaaacatgagatgtgtg

SEQ ID NO: 6671233 - DNA, 19 bp, Homo sapiens
atgtcaaagatatgttaag

SEQ ID NO: 6671234 - DNA, 22 bp, Homo sapiens
atgtcaaagtgaaagacatttc

SEQ ID NO: 6671235 - DNA, 17 bp, Homo sapiens
atgtcaaatatctcaga

SEQ ID NO: 6671236 - DNA, 15 bp, Homo sapiens
atgtcaaatggagct

SEQ ID NO: 6671237 - DNA, 21 bp, Homo sapiens
atgtcaacagccatttaggca

SEQ ID NO: 6671238 - DNA, 23 bp, Homo sapiens
atgtcaaccttgtgtgagtgtga

SEQ ID NO: 6671239 - DNA, 17 bp, Homo sapiens
atgtcaactgacctaaa

SEQ ID NO: 6671240 - DNA, 12 bp, Homo sapiens
atgtcaagaaat

SEQ ID NO: 6671241 - DNA, 23 bp, Homo sapiens
atgtcaagaacaggacatagcac

SEQ ID NO: 6671242 - DNA, 16 bp, Homo sapiens
atgtcaagattcagct

SEQ ID NO: 6671243 - DNA, 17 bp, Homo sapiens
atgtcaagattcagcta

SEQ ID NO: 6671244 - DNA, 17 bp, Homo sapiens
atgtcaaggactcctgt

SEQ ID NO: 6671245 - DNA, 23 bp, Homo sapiens
atgtcaagggcagctttgctcat

SEQ ID NO: 6671246 - DNA, 20 bp, Homo sapiens
atgtcaaggtgctgttgtca

SEQ ID NO: 6671247 - DNA, 21 bp, Homo sapiens
atgtcaaggtgctgttgtcat

SEQ ID NO: 6671248 - DNA, 17 bp, Homo sapiens
atgtcaataactttata

SEQ ID NO: 6671249 - DNA, 18 bp, Homo sapiens
atgtcaataactttatat

SEQ ID NO: 6671250 - DNA, 16 bp, Homo sapiens
atgtcaatatgagata

SEQ ID NO: 6671251 - DNA, 14 bp, Homo sapiens
atgtcaatatttga

SEQ ID NO: 6671252 - DNA, 15 bp, Homo sapiens
atgtcaatatttgag

SEQ ID NO: 6671253 - DNA, 18 bp, Homo sapiens
atgtcaatgaacaagcat

SEQ ID NO: 6671254 - DNA, 19 bp, Homo sapiens
atgtcaatttctgtgttgc

SEQ ID NO: 6671255 - DNA, 14 bp, Homo sapiens
atgtcaatttgtat

SEQ ID NO: 6671256 - DNA, 16 bp, Homo sapiens
atgtcaatttgtatat

SEQ ID NO: 6671257 - DNA, 17 bp, Homo sapiens
atgtcacaaagagctga

SEQ ID NO: 6671258 - DNA, 14 bp, Homo sapiens
atgtcacaaattga

SEQ ID NO: 6671259 - DNA, 17 bp, Homo sapiens
atgtcacacaaactgat

SEQ ID NO: 6671260 - DNA, 21 bp, Homo sapiens
atgtcacacttgtttcttgtt

SEQ ID NO: 6671261 - DNA, 23 bp, Homo sapiens
atgtcacacttgtttcttgttca

SEQ ID NO: 6671262 - DNA, 12 bp, Homo sapiens
atgtcacagcat

SEQ ID NO: 6671263 - DNA, 14 bp, Homo sapiens
atgtcacaggcagg

SEQ ID NO: 6671264 - DNA, 16 bp, Homo sapiens
atgtcacaggcaggtc

SEQ ID NO: 6671265 - DNA, 13 bp, Homo sapiens
atgtcacagggcc

SEQ ID NO: 6671266 - DNA, 19 bp, Homo sapiens
atgtcacagtccaaccaga

SEQ ID NO: 6671267 - DNA, 22 bp, Homo sapiens
atgtcacagtttgttcagtgag

SEQ ID NO: 6671268 - DNA, 23 bp, Homo sapiens
atgtcacatcctaatagaaagaa

SEQ ID NO: 6671269 - DNA, 21 bp, Homo sapiens
atgtcacatgacatccacatg

SEQ ID NO: 6671270 - DNA, 20 bp, Homo sapiens
atgtcaccgtggaccttcct

SEQ ID NO: 6671271 - DNA, 22 bp, Homo sapiens
atgtcaccgtggaccttcctgc

SEQ ID NO: 6671272 - DNA, 13 bp, Homo sapiens
atgtcacctcagc

SEQ ID NO: 6671273 - DNA, 21 bp, Homo sapiens
atgtcacctcagctgatatta

SEQ ID NO: 6671274 - DNA, 15 bp, Homo sapiens
atgtcacctggctgc

SEQ ID NO: 6671275 - DNA, 21 bp, Homo sapiens
atgtcacctggctgctaggcc

SEQ ID NO: 6671276 - DNA, 16 bp, Homo sapiens
atgtcacgaatatgga

SEQ ID NO: 6671277 - DNA, 20 bp, Homo sapiens
atgtcacggctactctatat

SEQ ID NO: 6671278 - DNA, 19 bp, Homo sapiens
atgtcacgtactgtctgat

SEQ ID NO: 6671279 - DNA, 23 bp, Homo sapiens
atgtcactaaacaagaaatctga

SEQ ID NO: 6671280 - DNA, 22 bp, Homo sapiens
atgtcactagaatggataaaat

SEQ ID NO: 6671281 - DNA, 13 bp, Homo sapiens
atgtcactatttg

SEQ ID NO: 6671282 - DNA, 17 bp, Homo sapiens
atgtcactattttcact

SEQ ID NO: 6671283 - DNA, 14 bp, Homo sapiens
atgtcactcagccc

SEQ ID NO: 6671284 - DNA, 18 bp, Homo sapiens
atgtcactcagccccttc

SEQ ID NO: 6671285 - DNA, 21 bp, Homo sapiens
atgtcactgaagtgattgaaa

SEQ ID NO: 6671286 - DNA, 11 bp, Homo sapiens
atgtcactgcc

SEQ ID NO: 6671287 - DNA, 14 bp, Homo sapiens
atgtcactgttata

SEQ ID NO: 6671288 - DNA, 20 bp, Homo sapiens
atgtcactgttataaatttt

SEQ ID NO: 6671289 - DNA, 23 bp, Homo sapiens
atgtcactgtttttattccttcc

SEQ ID NO: 6671290 - DNA, 16 bp, Homo sapiens
atgtcacttcatattt

SEQ ID NO: 6671291 - DNA, 19 bp, Homo sapiens
atgtcacttcatattttat

SEQ ID NO: 6671292 - DNA, 20 bp, Homo sapiens
atgtcactttttgaggcaaa

SEQ ID NO: 6671293 - DNA, 19 bp, Homo sapiens
atgtcagaaaaacaataag

SEQ ID NO: 6671294 - DNA, 15 bp, Homo sapiens
atgtcagacatgaaa

SEQ ID NO: 6671295 - DNA, 15 bp, Homo sapiens
atgtcagactttgct

SEQ ID NO: 6671296 - DNA, 16 bp, Homo sapiens
atgtcagagccaggct

SEQ ID NO: 6671297 - DNA, 12 bp, Homo sapiens
atgtcagagcta

SEQ ID NO: 6671298 - DNA, 22 bp, Homo sapiens
atgtcagagctatgttccctcc

SEQ ID NO: 6671299 - DNA, 17 bp, Homo sapiens
atgtcagaggaccccag

SEQ ID NO: 6671300 - DNA, 19 bp, Homo sapiens
atgtcagataagtgtaaat

SEQ ID NO: 6671301 - DNA, 21 bp, Homo sapiens
atgtcagataagtgtaaatag

SEQ ID NO: 6671302 - DNA, 23 bp, Homo sapiens
atgtcagatgtacatagagatct

SEQ ID NO: 6671303 - DNA, 16 bp, Homo sapiens
atgtcagattcctttc

SEQ ID NO: 6671304 - DNA, 16 bp, Homo sapiens
atgtcagatttctggt

SEQ ID NO: 6671305 - DNA, 19 bp, Homo sapiens
atgtcagatttctggttga

SEQ ID NO: 6671306 - DNA, 16 bp, Homo sapiens
atgtcagcaaaaagca

SEQ ID NO: 6671307 - DNA, 22 bp, Homo sapiens
atgtcagcaaaaagcaaaatca

SEQ ID NO: 6671308 - DNA, 18 bp, Homo sapiens
atgtcagcagacacacat

SEQ ID NO: 6671309 - DNA, 13 bp, Homo sapiens
atgtcagcagttg

SEQ ID NO: 6671310 - DNA, 16 bp, Homo sapiens
atgtcagcagttgctg

SEQ ID NO: 6671311 - DNA, 21 bp, Homo sapiens
atgtcagcagttgctggtaaa

SEQ ID NO: 6671312 - DNA, 19 bp, Homo sapiens
atgtcagccgagccgggcc

SEQ ID NO: 6671313 - DNA, 12 bp, Homo sapiens
atgtcagccttg

SEQ ID NO: 6671314 - DNA, 13 bp, Homo sapiens
atgtcagccttgc

SEQ ID NO: 6671315 - DNA, 14 bp, Homo sapiens
atgtcagccttgca

SEQ ID NO: 6671316 - DNA, 15 bp, Homo sapiens
atgtcagcctttgtt

SEQ ID NO: 6671317 - DNA, 20 bp, Homo sapiens
atgtcagctgctgttgaact

SEQ ID NO: 6671318 - DNA, 21 bp, Homo sapiens
atgtcagctgctgttgaactt

SEQ ID NO: 6671319 - DNA, 22 bp, Homo sapiens
atgtcagctgctgttgaacttt

SEQ ID NO: 6671320 - DNA, 16 bp, Homo sapiens
atgtcagcttatccta

SEQ ID NO: 6671321 - DNA, 16 bp, Homo sapiens
atgtcagcttcccagc

SEQ ID NO: 6671322 - DNA, 19 bp, Homo sapiens
atgtcaggaacagaaggat

SEQ ID NO: 6671323 - DNA, 12 bp, Homo sapiens
atgtcaggcctg

SEQ ID NO: 6671324 - DNA, 14 bp, Homo sapiens
atgtcagtatgtgg

SEQ ID NO: 6671325 - DNA, 16 bp, Homo sapiens
atgtcagtatgtggaa

SEQ ID NO: 6671326 - DNA, 20 bp, Homo sapiens
atgtcagtctacaggccttt

SEQ ID NO: 6671327 - DNA, 20 bp, Homo sapiens
atgtcagtgacattaaacta

SEQ ID NO: 6671328 - DNA, 15 bp, Homo sapiens
atgtcagtgctgatg

SEQ ID NO: 6671329 - DNA, 17 bp, Homo sapiens
atgtcagtgtttgggaa

SEQ ID NO: 6671330 - DNA, 17 bp, Homo sapiens
atgtcagttgttattta

SEQ ID NO: 6671331 - DNA, 17 bp, Homo sapiens
atgtcataaagaagagc

SEQ ID NO: 6671332 - DNA, 16 bp, Homo sapiens
atgtcataaatgtcac

SEQ ID NO: 6671333 - DNA, 18 bp, Homo sapiens
atgtcataaatgtcacaa

SEQ ID NO: 6671334 - DNA, 18 bp, Homo sapiens
atgtcataaattactgtt

SEQ ID NO: 6671335 - DNA, 15 bp, Homo sapiens
atgtcatacagagaa

SEQ ID NO: 6671336 - DNA, 20 bp, Homo sapiens
atgtcatacagagaagtcac

SEQ ID NO: 6671337 - DNA, 22 bp, Homo sapiens
atgtcatactctgtgtaatctc

SEQ ID NO: 6671338 - DNA, 14 bp, Homo sapiens
atgtcatagaaata

SEQ ID NO: 6671339 - DNA, 14 bp, Homo sapiens
atgtcatagccaaa

SEQ ID NO: 6671340 - DNA, 21 bp, Homo sapiens
atgtcatatcatttcactgtc

SEQ ID NO: 6671341 - DNA, 22 bp, Homo sapiens
atgtcatatcatttcactgtct

SEQ ID NO: 6671342 - DNA, 22 bp, Homo sapiens
atgtcatcactctaggttttac

SEQ ID NO: 6671343 - DNA, 14 bp, Homo sapiens
atgtcatcatacat

SEQ ID NO: 6671344 - DNA, 14 bp, Homo sapiens
atgtcatcccattg

SEQ ID NO: 6671345 - DNA, 20 bp, Homo sapiens
atgtcatccccttgtgtcag

SEQ ID NO: 6671346 - DNA, 13 bp, Homo sapiens
atgtcatcttgag

SEQ ID NO: 6671347 - DNA, 23 bp, Homo sapiens
atgtcatgaaagcacctgccctc

SEQ ID NO: 6671348 - DNA, 21 bp, Homo sapiens
atgtcatgcctcactttcttc

SEQ ID NO: 6671349 - DNA, 17 bp, Homo sapiens
atgtcatgtacttcctg

SEQ ID NO: 6671350 - DNA, 18 bp, Homo sapiens
atgtcatgtacttcctgt

SEQ ID NO: 6671351 - DNA, 13 bp, Homo sapiens
atgtcatgtctgc

SEQ ID NO: 6671352 - DNA, 13 bp, Homo sapiens
atgtcatgtcttc

SEQ ID NO: 6671353 - DNA, 21 bp, Homo sapiens
atgtcatgtcttccattaaga

SEQ ID NO: 6671354 - DNA, 21 bp, Homo sapiens
atgtcatgtgtacaaaagttt

SEQ ID NO: 6671355 - DNA, 15 bp, Homo sapiens
atgtcattaatcaat

SEQ ID NO: 6671356 - DNA, 22 bp, Homo sapiens
atgtcattatgacatttcttaa

SEQ ID NO: 6671357 - DNA, 17 bp, Homo sapiens
atgtcattatgtagaaa

SEQ ID NO: 6671358 - DNA, 18 bp, Homo sapiens
atgtcattatttattgtt

SEQ ID NO: 6671359 - DNA, 22 bp, Homo sapiens
atgtcattatttattgttaaat

SEQ ID NO: 6671360 - DNA, 15 bp, Homo sapiens
atgtcattgcccact

SEQ ID NO: 6671361 - DNA, 19 bp, Homo sapiens
atgtcattgctaaaaaata

SEQ ID NO: 6671362 - DNA, 21 bp, Homo sapiens
atgtcattgctaaaaaataaa

SEQ ID NO: 6671363 - DNA, 14 bp, Homo sapiens
atgtcattgtctac

SEQ ID NO: 6671364 - DNA, 16 bp, Homo sapiens
atgtcatttcagaagt

SEQ ID NO: 6671365 - DNA, 13 bp, Homo sapiens
atgtcatttcatg

SEQ ID NO: 6671366 - DNA, 14 bp, Homo sapiens
atgtcatttcatgt

SEQ ID NO: 6671367 - DNA, 13 bp, Homo sapiens
atgtcatttcctt

SEQ ID NO: 6671368 - DNA, 18 bp, Homo sapiens
atgtcatttctactttga

SEQ ID NO: 6671369 - DNA, 11 bp, Homo sapiens
atgtcatttgc

SEQ ID NO: 6671370 - DNA, 16 bp, Homo sapiens
atgtcatttgcacaca

SEQ ID NO: 6671371 - DNA, 15 bp, Homo sapiens
atgtcatttgctaat

SEQ ID NO: 6671372 - DNA, 15 bp, Homo sapiens
atgtcattttcagat

SEQ ID NO: 6671373 - DNA, 15 bp, Homo sapiens
atgtcatttttaatg

SEQ ID NO: 6671374 - DNA, 17 bp, Homo sapiens
atgtcatttttaatgta

SEQ ID NO: 6671375 - DNA, 18 bp, Homo sapiens
atgtcatttttaatgtat

SEQ ID NO: 6671376 - DNA, 19 bp, Homo sapiens
atgtccaaacttaacagat

SEQ ID NO: 6671377 - DNA, 19 bp, Homo sapiens
atgtccaaagaggctgccc

SEQ ID NO: 6671378 - DNA, 18 bp, Homo sapiens
atgtccaacagagtggac

SEQ ID NO: 6671379 - DNA, 17 bp, Homo sapiens
atgtccaagaagcccag

SEQ ID NO: 6671380 - DNA, 23 bp, Homo sapiens
atgtccaagaagcccaggaaagg

SEQ ID NO: 6671381 - DNA, 14 bp, Homo sapiens
atgtccaagttctt

SEQ ID NO: 6671382 - DNA, 20 bp, Homo sapiens
atgtccaagttcttcacctc

SEQ ID NO: 6671383 - DNA, 19 bp, Homo sapiens
atgtccaatggtaggaatt

SEQ ID NO: 6671384 - DNA, 23 bp, Homo sapiens
atgtccaccacttcaggggatgg

SEQ ID NO: 6671385 - DNA, 16 bp, Homo sapiens
atgtccactgtgtata

SEQ ID NO: 6671386 - DNA, 12 bp, Homo sapiens
atgtccagaaga

SEQ ID NO: 6671387 - DNA, 21 bp, Homo sapiens
atgtccagaagaatattcagg

SEQ ID NO: 6671388 - DNA, 22 bp, Homo sapiens
atgtccagaagaatattcagga

SEQ ID NO: 6671389 - DNA, 23 bp, Homo sapiens
atgtccagaagaatattcaggac

SEQ ID NO: 6671390 - DNA, 22 bp, Homo sapiens
atgtccagaagagtcaaagtag

SEQ ID NO: 6671391 - DNA, 23 bp, Homo sapiens
atgtccagaagagtcaaagtagt

SEQ ID NO: 6671392 - DNA, 20 bp, Homo sapiens
atgtccagagggactggaca

SEQ ID NO: 6671393 - DNA, 21 bp, Homo sapiens
atgtccagagggactggacag

SEQ ID NO: 6671394 - DNA, 22 bp, Homo sapiens
atgtccagcaccttgtgcctgg

SEQ ID NO: 6671395 - DNA, 22 bp, Homo sapiens
atgtccagctgctgtcaggtct

SEQ ID NO: 6671396 - DNA, 18 bp, Homo sapiens
atgtccaggtcacaggca

SEQ ID NO: 6671397 - DNA, 16 bp, Homo sapiens
atgtccagtaagatca

SEQ ID NO: 6671398 - DNA, 18 bp, Homo sapiens
atgtccagtaagatcact

SEQ ID NO: 6671399 - DNA, 20 bp, Homo sapiens
atgtccagtaagatcactgt

SEQ ID NO: 6671400 - DNA, 18 bp, Homo sapiens
atgtccagtcatcctgcc

SEQ ID NO: 6671401 - DNA, 20 bp, Homo sapiens
atgtccagtcatcctgccct

SEQ ID NO: 6671402 - DNA, 13 bp, Homo sapiens
atgtccagtgagt

SEQ ID NO: 6671403 - DNA, 16 bp, Homo sapiens
atgtccataaaagaga

SEQ ID NO: 6671404 - DNA, 18 bp, Homo sapiens
atgtccataaaagagacc

SEQ ID NO: 6671405 - DNA, 21 bp, Homo sapiens
atgtccatacactttgttgca

SEQ ID NO: 6671406 - DNA, 18 bp, Homo sapiens
atgtccatcagatgacaa

SEQ ID NO: 6671407 - DNA, 13 bp, Homo sapiens
atgtccatccctt

SEQ ID NO: 6671408 - DNA, 16 bp, Homo sapiens
atgtccatgaaaaaca

SEQ ID NO: 6671409 - DNA, 14 bp, Homo sapiens
atgtccatttacac

SEQ ID NO: 6671410 - DNA, 19 bp, Homo sapiens
atgtccatttatatcattt

SEQ ID NO: 6671411 - DNA, 12 bp, Homo sapiens
atgtcccaaata

SEQ ID NO: 6671412 - DNA, 14 bp, Homo sapiens
atgtcccaaataaa

SEQ ID NO: 6671413 - DNA, 17 bp, Homo sapiens
atgtcccaaataaattt

SEQ ID NO: 6671414 - DNA, 18 bp, Homo sapiens
atgtcccaaataaattta

SEQ ID NO: 6671415 - DNA, 20 bp, Homo sapiens
atgtcccaacttgtaaaaat

SEQ ID NO: 6671416 - DNA, 13 bp, Homo sapiens
atgtcccaagagc

SEQ ID NO: 6671417 - DNA, 14 bp, Homo sapiens
atgtcccacaggga

SEQ ID NO: 6671418 - DNA, 12 bp, Homo sapiens
atgtcccaccca

SEQ ID NO: 6671419 - DNA, 13 bp, Homo sapiens
atgtcccagaggc

SEQ ID NO: 6671420 - DNA, 21 bp, Homo sapiens
atgtcccatctgctcctccca

SEQ ID NO: 6671421 - DNA, 18 bp, Homo sapiens
atgtcccatgaccttgac

SEQ ID NO: 6671422 - DNA, 23 bp, Homo sapiens
atgtccccaaagtaccacactga

SEQ ID NO: 6671423 - DNA, 12 bp, Homo sapiens
atgtccccactc

SEQ ID NO: 6671424 - DNA, 22 bp, Homo sapiens
atgtccccattctataaattca

SEQ ID NO: 6671425 - DNA, 22 bp, Homo sapiens
atgtccccccctaactttcttg

SEQ ID NO: 6671426 - DNA, 23 bp, Homo sapiens
atgtccccctcacccccacctca

SEQ ID NO: 6671427 - DNA, 16 bp, Homo sapiens
atgtcccctgtcccac

SEQ ID NO: 6671428 - DNA, 12 bp, Homo sapiens
atgtccccttcc

SEQ ID NO: 6671429 - DNA, 19 bp, Homo sapiens
atgtccctagaaaacaatg

SEQ ID NO: 6671430 - DNA, 19 bp, Homo sapiens
atgtccctattctgccatg

SEQ ID NO: 6671431 - DNA, 11 bp, Homo sapiens
atgtccctcca

SEQ ID NO: 6671432 - DNA, 18 bp, Homo sapiens
atgtccctccaaggctgt

SEQ ID NO: 6671433 - DNA, 14 bp, Homo sapiens
atgtccctcctttt

SEQ ID NO: 6671434 - DNA, 19 bp, Homo sapiens
atgtccctgaagtcttgca

SEQ ID NO: 6671435 - DNA, 20 bp, Homo sapiens
atgtccctgggccagggtct

SEQ ID NO: 6671436 - DNA, 19 bp, Homo sapiens
atgtccctgtccccaggcc

SEQ ID NO: 6671437 - DNA, 23 bp, Homo sapiens
atgtccctgtccccaggcccagc

SEQ ID NO: 6671438 - DNA, 15 bp, Homo sapiens
atgtccctgtcccct

SEQ ID NO: 6671439 - DNA, 21 bp, Homo sapiens
atgtcccttcacatagttttt

SEQ ID NO: 6671440 - DNA, 21 bp, Homo sapiens
atgtcccttgatgcacagaga

SEQ ID NO: 6671441 - DNA, 17 bp, Homo sapiens
atgtccctttcttctcc

SEQ ID NO: 6671442 - DNA, 18 bp, Homo sapiens
atgtccctttcttctccc

SEQ ID NO: 6671443 - DNA, 20 bp, Homo sapiens
atgtccctttcttggccagt

SEQ ID NO: 6671444 - DNA, 13 bp, Homo sapiens
atgtccggcttta

SEQ ID NO: 6671445 - DNA, 23 bp, Homo sapiens
atgtcctaaagaagacattttct

SEQ ID NO: 6671446 - DNA, 17 bp, Homo sapiens
atgtcctaaggacacac

SEQ ID NO: 6671447 - DNA, 19 bp, Homo sapiens
atgtcctaaggacacacta

SEQ ID NO: 6671448 - DNA, 15 bp, Homo sapiens
atgtcctaatggtga

SEQ ID NO: 6671449 - DNA, 19 bp, Homo sapiens
atgtcctaattcttctgtc

SEQ ID NO: 6671450 - DNA, 15 bp, Homo sapiens
atgtcctatgtgtga

SEQ ID NO: 6671451 - DNA, 14 bp, Homo sapiens
atgtcctcagaggg

SEQ ID NO: 6671452 - DNA, 15 bp, Homo sapiens
atgtcctcctctgtg

SEQ ID NO: 6671453 - DNA, 17 bp, Homo sapiens
atgtcctccttgttcta

SEQ ID NO: 6671454 - DNA, 13 bp, Homo sapiens
atgtcctctctta

SEQ ID NO: 6671455 - DNA, 16 bp, Homo sapiens
atgtcctgcctattat

SEQ ID NO: 6671456 - DNA, 20 bp, Homo sapiens
atgtcctgcctattatctgt

SEQ ID NO: 6671457 - DNA, 16 bp, Homo sapiens
atgtcctgctggcttc

SEQ ID NO: 6671458 - DNA, 22 bp, Homo sapiens
atgtcctggaagtgtgtgtttc

SEQ ID NO: 6671459 - DNA, 21 bp, Homo sapiens
atgtcctgtagagagagacct

SEQ ID NO: 6671460 - DNA, 12 bp, Homo sapiens
atgtcctgtcct

SEQ ID NO: 6671461 - DNA, 14 bp, Homo sapiens
atgtcctgtcctgg

SEQ ID NO: 6671462 - DNA, 16 bp, Homo sapiens
atgtcctgtcctggtc

SEQ ID NO: 6671463 - DNA, 19 bp, Homo sapiens
atgtcctgtgagatgtgta

SEQ ID NO: 6671464 - DNA, 20 bp, Homo sapiens
atgtcctgtgtcagtttatg

SEQ ID NO: 6671465 - DNA, 16 bp, Homo sapiens
atgtccttctgagccc

SEQ ID NO: 6671466 - DNA, 15 bp, Homo sapiens
atgtccttgggttgc

SEQ ID NO: 6671467 - DNA, 16 bp, Homo sapiens
atgtcctttccctgga

SEQ ID NO: 6671468 - DNA, 15 bp, Homo sapiens
atgtcgatcaagaga

SEQ ID NO: 6671469 - DNA, 18 bp, Homo sapiens
atgtcgatcaagagaatc

SEQ ID NO: 6671470 - DNA, 15 bp, Homo sapiens
atgtcgattttcaat

SEQ ID NO: 6671471 - DNA, 14 bp, Homo sapiens
atgtcgcacaatgt

SEQ ID NO: 6671472 - DNA, 16 bp, Homo sapiens
atgtcgcacaatgttt

SEQ ID NO: 6671473 - DNA, 13 bp, Homo sapiens
atgtcgcctctgc

SEQ ID NO: 6671474 - DNA, 22 bp, Homo sapiens
atgtcgctgggtcctctgcagt

SEQ ID NO: 6671475 - DNA, 12 bp, Homo sapiens
atgtcgcttttg

SEQ ID NO: 6671476 - DNA, 13 bp, Homo sapiens
atgtcggcctcta

SEQ ID NO: 6671477 - DNA, 19 bp, Homo sapiens
atgtcggggcccctgcgtg

SEQ ID NO: 6671478 - DNA, 23 bp, Homo sapiens
atgtcgtcaaagctgaaatggac

SEQ ID NO: 6671479 - DNA, 18 bp, Homo sapiens
atgtcgtcgagctccccc

SEQ ID NO: 6671480 - DNA, 19 bp, Homo sapiens
atgtcgtgaccaactagac

SEQ ID NO: 6671481 - DNA, 20 bp, Homo sapiens
atgtcgtgaccaactagaca

SEQ ID NO: 6671482 - DNA, 19 bp, Homo sapiens
atgtcgtggacacacacag

SEQ ID NO: 6671483 - DNA, 20 bp, Homo sapiens
atgtcgtggacacacacaga

SEQ ID NO: 6671484 - DNA, 14 bp, Homo sapiens
atgtcgttcatttt

SEQ ID NO: 6671485 - DNA, 19 bp, Homo sapiens
atgtctaaaagattcttta

SEQ ID NO: 6671486 - DNA, 20 bp, Homo sapiens
atgtctaaaagattctttaa

SEQ ID NO: 6671487 - DNA, 21 bp, Homo sapiens
atgtctaacaggacttgaatt

SEQ ID NO: 6671488 - DNA, 14 bp, Homo sapiens
atgtctaacttaaa

SEQ ID NO: 6671489 - DNA, 18 bp, Homo sapiens
atgtctaacttaaatagc

SEQ ID NO: 6671490 - DNA, 20 bp, Homo sapiens
atgtctaattcatttactca

SEQ ID NO: 6671491 - DNA, 13 bp, Homo sapiens
atgtctaattgag

SEQ ID NO: 6671492 - DNA, 12 bp, Homo sapiens
atgtctacaaaa

SEQ ID NO: 6671493 - DNA, 21 bp, Homo sapiens
atgtctacaaaagcaaagtga

SEQ ID NO: 6671494 - DNA, 15 bp, Homo sapiens
atgtctacagaaaat

SEQ ID NO: 6671495 - DNA, 21 bp, Homo sapiens
atgtctacagaaaatgctggc

SEQ ID NO: 6671496 - DNA, 13 bp, Homo sapiens
atgtctactgaag

SEQ ID NO: 6671497 - DNA, 12 bp, Homo sapiens
atgtctactgct

SEQ ID NO: 6671498 - DNA, 13 bp, Homo sapiens
atgtctactgctt

SEQ ID NO: 6671499 - DNA, 16 bp, Homo sapiens
atgtctagaaagtaag

SEQ ID NO: 6671500 - DNA, 13 bp, Homo sapiens
atgtctagataac

SEQ ID NO: 6671501 - DNA, 18 bp, Homo sapiens
atgtctagattttgaaaa

SEQ ID NO: 6671502 - DNA, 22 bp, Homo sapiens
atgtctataaaccgaactgatg

SEQ ID NO: 6671503 - DNA, 21 bp, Homo sapiens
atgtctataagtatataaata

SEQ ID NO: 6671504 - DNA, 17 bp, Homo sapiens
atgtctatgatagataa

SEQ ID NO: 6671505 - DNA, 21 bp, Homo sapiens
atgtctatgattcgtgtaatt

SEQ ID NO: 6671506 - DNA, 13 bp, Homo sapiens
atgtctatgtgta

SEQ ID NO: 6671507 - DNA, 17 bp, Homo sapiens
atgtctatgtgtatata

SEQ ID NO: 6671508 - DNA, 15 bp, Homo sapiens
atgtctattattatg

SEQ ID NO: 6671509 - DNA, 13 bp, Homo sapiens
atgtctattgtcc

SEQ ID NO: 6671510 - DNA, 14 bp, Homo sapiens
atgtctattgtcca

SEQ ID NO: 6671511 - DNA, 13 bp, Homo sapiens
atgtctatttaag

SEQ ID NO: 6671512 - DNA, 14 bp, Homo sapiens
atgtctatttaagc

SEQ ID NO: 6671513 - DNA, 16 bp, Homo sapiens
atgtctattttcttga

SEQ ID NO: 6671514 - DNA, 14 bp, Homo sapiens
atgtctcaaaataa

SEQ ID NO: 6671515 - DNA, 20 bp, Homo sapiens
atgtctcaatagtaaaagat

SEQ ID NO: 6671516 - DNA, 22 bp, Homo sapiens
atgtctcaccaggaaattctgt

SEQ ID NO: 6671517 - DNA, 22 bp, Homo sapiens
atgtctcactgagcactgtttt

SEQ ID NO: 6671518 - DNA, 19 bp, Homo sapiens
atgtctcagagccttccat

SEQ ID NO: 6671519 - DNA, 17 bp, Homo sapiens
atgtctcagcctcctca

SEQ ID NO: 6671520 - DNA, 18 bp, Homo sapiens
atgtctcagcctcctcag

SEQ ID NO: 6671521 - DNA, 22 bp, Homo sapiens
atgtctcaggtccctgcagggc

SEQ ID NO: 6671522 - DNA, 13 bp, Homo sapiens
atgtctcatgtaa

SEQ ID NO: 6671523 - DNA, 20 bp, Homo sapiens
atgtctcatgtaatttgcat

SEQ ID NO: 6671524 - DNA, 13 bp, Homo sapiens
atgtctccagatt

SEQ ID NO: 6671525 - DNA, 22 bp, Homo sapiens
atgtctccagattggcacccct

SEQ ID NO: 6671526 - DNA, 20 bp, Homo sapiens
atgtctccattttcttctct

SEQ ID NO: 6671527 - DNA, 13 bp, Homo sapiens
atgtctccccagt

SEQ ID NO: 6671528 - DNA, 22 bp, Homo sapiens
atgtctccccagttccacagca

SEQ ID NO: 6671529 - DNA, 23 bp, Homo sapiens
atgtctccccagttccacagcag

SEQ ID NO: 6671530 - DNA, 16 bp, Homo sapiens
atgtctcccctgccac

SEQ ID NO: 6671531 - DNA, 20 bp, Homo sapiens
atgtctcctaagcacctgta

SEQ ID NO: 6671532 - DNA, 20 bp, Homo sapiens
atgtctcctcaagcctgtgg

SEQ ID NO: 6671533 - DNA, 22 bp, Homo sapiens
atgtctcctcaagcctgtgggc

SEQ ID NO: 6671534 - DNA, 23 bp, Homo sapiens
atgtctcctcaagcctgtgggca

SEQ ID NO: 6671535 - DNA, 17 bp, Homo sapiens
atgtctcctttgctctt

SEQ ID NO: 6671536 - DNA, 16 bp, Homo sapiens
atgtctcgtggtagga

SEQ ID NO: 6671537 - DNA, 18 bp, Homo sapiens
atgtctctaaactgcggt

SEQ ID NO: 6671538 - DNA, 16 bp, Homo sapiens
atgtctctagcagtga

SEQ ID NO: 6671539 - DNA, 16 bp, Homo sapiens
atgtctctctgccaag

SEQ ID NO: 6671540 - DNA, 11 bp, Homo sapiens
atgtctctgat

SEQ ID NO: 6671541 - DNA, 14 bp, Homo sapiens
atgtctctgcaaac

SEQ ID NO: 6671542 - DNA, 12 bp, Homo sapiens
atgtctctgcct

SEQ ID NO: 6671543 - DNA, 13 bp, Homo sapiens
atgtctctgctcc

SEQ ID NO: 6671544 - DNA, 14 bp, Homo sapiens
atgtctctgctcct

SEQ ID NO: 6671545 - DNA, 19 bp, Homo sapiens
atgtctctggggcagatcc

SEQ ID NO: 6671546 - DNA, 16 bp, Homo sapiens
atgtctcttcctctgt

SEQ ID NO: 6671547 - DNA, 15 bp, Homo sapiens
atgtctcttcctggt

SEQ ID NO: 6671548 - DNA, 18 bp, Homo sapiens
atgtctcttctaacatct

SEQ ID NO: 6671549 - DNA, 16 bp, Homo sapiens
atgtctcttctgagct

SEQ ID NO: 6671550 - DNA, 18 bp, Homo sapiens
atgtctcttgagcatcaa

SEQ ID NO: 6671551 - DNA, 21 bp, Homo sapiens
atgtctcttgagcatcaatct

SEQ ID NO: 6671552 - DNA, 23 bp, Homo sapiens
atgtctcttgagcatcaatcttg

SEQ ID NO: 6671553 - DNA, 18 bp, Homo sapiens
atgtctcttggaaatgtt

SEQ ID NO: 6671554 - DNA, 13 bp, Homo sapiens
atgtctcttgtag

SEQ ID NO: 6671555 - DNA, 15 bp, Homo sapiens
atgtctcttgtagaa

SEQ ID NO: 6671556 - DNA, 22 bp, Homo sapiens
atgtctctttggggagagctgg

SEQ ID NO: 6671557 - DNA, 23 bp, Homo sapiens
atgtctctttggggagagctggc

SEQ ID NO: 6671558 - DNA, 11 bp, Homo sapiens
atgtctgaaat

SEQ ID NO: 6671559 - DNA, 13 bp, Homo sapiens
atgtctgaacttt

SEQ ID NO: 6671560 - DNA, 18 bp, Homo sapiens
atgtctgaactttgggaa

SEQ ID NO: 6671561 - DNA, 18 bp, Homo sapiens
atgtctgaagtacaaaca

SEQ ID NO: 6671562 - DNA, 22 bp, Homo sapiens
atgtctgagagaccatctccta

SEQ ID NO: 6671563 - DNA, 23 bp, Homo sapiens
atgtctgagatacgtctgtgact

SEQ ID NO: 6671564 - DNA, 12 bp, Homo sapiens
atgtctgataat

SEQ ID NO: 6671565 - DNA, 14 bp, Homo sapiens
atgtctgataatga

SEQ ID NO: 6671566 - DNA, 15 bp, Homo sapiens
atgtctgataatgat

SEQ ID NO: 6671567 - DNA, 22 bp, Homo sapiens
atgtctgataatgatttgctct

SEQ ID NO: 6671568 - DNA, 14 bp, Homo sapiens
atgtctgcaaagga

SEQ ID NO: 6671569 - DNA, 23 bp, Homo sapiens
atgtctgcaaaggagggcctcag

SEQ ID NO: 6671570 - DNA, 14 bp, Homo sapiens
atgtctgcagctca

SEQ ID NO: 6671571 - DNA, 15 bp, Homo sapiens
atgtctgcagctcaa

SEQ ID NO: 6671572 - DNA, 19 bp, Homo sapiens
atgtctgcagtgtgccccc

SEQ ID NO: 6671573 - DNA, 20 bp, Homo sapiens
atgtctgcagtgtgcccccc

SEQ ID NO: 6671574 - DNA, 14 bp, Homo sapiens
atgtctgcatggca

SEQ ID NO: 6671575 - DNA, 19 bp, Homo sapiens
atgtctgcatggcagaagc

SEQ ID NO: 6671576 - DNA, 19 bp, Homo sapiens
atgtctgccaaaatgcaac

SEQ ID NO: 6671577 - DNA, 22 bp, Homo sapiens
atgtctgccaaaatgcaacata

SEQ ID NO: 6671578 - DNA, 15 bp, Homo sapiens
atgtctgccacacaa

SEQ ID NO: 6671579 - DNA, 14 bp, Homo sapiens
atgtctgcctggag

SEQ ID NO: 6671580 - DNA, 21 bp, Homo sapiens
atgtctgctgagttggcctgg

SEQ ID NO: 6671581 - DNA, 13 bp, Homo sapiens
atgtctgcttctg

SEQ ID NO: 6671582 - DNA, 21 bp, Homo sapiens
atgtctgcttctgtccaggac

SEQ ID NO: 6671583 - DNA, 12 bp, Homo sapiens
atgtctggagac

SEQ ID NO: 6671584 - DNA, 20 bp, Homo sapiens
atgtctggagtggtaacagc

SEQ ID NO: 6671585 - DNA, 23 bp, Homo sapiens
atgtctggagtggtaacagctct

SEQ ID NO: 6671586 - DNA, 20 bp, Homo sapiens
atgtctggcagatgagggct

SEQ ID NO: 6671587 - DNA, 20 bp, Homo sapiens
atgtctgggaaagcagagtg

SEQ ID NO: 6671588 - DNA, 18 bp, Homo sapiens
atgtctgggtcgtctttt

SEQ ID NO: 6671589 - DNA, 16 bp, Homo sapiens
atgtctggtgtttgtc

SEQ ID NO: 6671590 - DNA, 18 bp, Homo sapiens
atgtctggtgtttgtcat

SEQ ID NO: 6671591 - DNA, 17 bp, Homo sapiens
atgtctggttctcaatt

SEQ ID NO: 6671592 - DNA, 19 bp, Homo sapiens
atgtctggttctcaattcc

SEQ ID NO: 6671593 - DNA, 21 bp, Homo sapiens
atgtctggttctcaattccaa

SEQ ID NO: 6671594 - DNA, 12 bp, Homo sapiens
atgtctgtaaat

SEQ ID NO: 6671595 - DNA, 17 bp, Homo sapiens
atgtctgtagttgcttt

SEQ ID NO: 6671596 - DNA, 19 bp, Homo sapiens
atgtctgtatcactctgtg

SEQ ID NO: 6671597 - DNA, 21 bp, Homo sapiens
atgtctgtatccccagtgccc

SEQ ID NO: 6671598 - DNA, 22 bp, Homo sapiens
atgtctgtcagaagacactaat

SEQ ID NO: 6671599 - DNA, 22 bp, Homo sapiens
atgtctgtccctaaacatagtg

SEQ ID NO: 6671600 - DNA, 10 bp, Homo sapiens
atgtctgtga

SEQ ID NO: 6671601 - DNA, 19 bp, Homo sapiens
atgtctgtgaacttgatgt

SEQ ID NO: 6671602 - DNA, 18 bp, Homo sapiens
atgtctgtgccatttctc

SEQ ID NO: 6671603 - DNA, 12 bp, Homo sapiens
atgtctgtgctg

SEQ ID NO: 6671604 - DNA, 14 bp, Homo sapiens
atgtctgtggattt

SEQ ID NO: 6671605 - DNA, 10 bp, Homo sapiens
atgtctgtgt

SEQ ID NO: 6671606 - DNA, 17 bp, Homo sapiens
atgtctgtgtatgtata

SEQ ID NO: 6671607 - DNA, 16 bp, Homo sapiens
atgtctgttctaagtc

SEQ ID NO: 6671608 - DNA, 16 bp, Homo sapiens
atgtctgttctacata

SEQ ID NO: 6671609 - DNA, 16 bp, Homo sapiens
atgtctgttgatgact

SEQ ID NO: 6671610 - DNA, 17 bp, Homo sapiens
atgtctgtttaagaaaa

SEQ ID NO: 6671611 - DNA, 15 bp, Homo sapiens
atgtctgtttattaa

SEQ ID NO: 6671612 - DNA, 13 bp, Homo sapiens
atgtctgtttgct

SEQ ID NO: 6671613 - DNA, 21 bp, Homo sapiens
atgtctgttttagttggaatg

SEQ ID NO: 6671614 - DNA, 14 bp, Homo sapiens
atgtctgttttcca

SEQ ID NO: 6671615 - DNA, 21 bp, Homo sapiens
atgtcttaaataaaactattt

SEQ ID NO: 6671616 - DNA, 18 bp, Homo sapiens
atgtcttaaatgctcata

SEQ ID NO: 6671617 - DNA, 17 bp, Homo sapiens
atgtcttaacaaatcag

SEQ ID NO: 6671618 - DNA, 17 bp, Homo sapiens
atgtcttaacctcaggg

SEQ ID NO: 6671619 - DNA, 20 bp, Homo sapiens
atgtcttaatgaagtttgaa

SEQ ID NO: 6671620 - DNA, 18 bp, Homo sapiens
atgtcttactactttaaa

SEQ ID NO: 6671621 - DNA, 19 bp, Homo sapiens
atgtcttactactttaaat

SEQ ID NO: 6671622 - DNA, 15 bp, Homo sapiens
atgtcttattttatt

SEQ ID NO: 6671623 - DNA, 16 bp, Homo sapiens
atgtcttcaaggcttc

SEQ ID NO: 6671624 - DNA, 19 bp, Homo sapiens
atgtcttcaaggcttcagt

SEQ ID NO: 6671625 - DNA, 20 bp, Homo sapiens
atgtcttcataatataacaa

SEQ ID NO: 6671626 - DNA, 21 bp, Homo sapiens
atgtcttcatacctacatgta

SEQ ID NO: 6671627 - DNA, 24 bp, Homo sapiens
atgtcttcatcacttcttccactg

SEQ ID NO: 6671628 - DNA, 18 bp, Homo sapiens
atgtcttcatttcattgt

SEQ ID NO: 6671629 - DNA, 19 bp, Homo sapiens
atgtcttcatttcattgta

SEQ ID NO: 6671630 - DNA, 22 bp, Homo sapiens
atgtcttcattttttaatgtgc

SEQ ID NO: 6671631 - DNA, 24 bp, Homo sapiens
atgtcttcattttttaatgtgctc

SEQ ID NO: 6671632 - DNA, 24 bp, Homo sapiens
atgtcttccctgggctgccaccag

SEQ ID NO: 6671633 - DNA, 14 bp, Homo sapiens
atgtcttctcacaa

SEQ ID NO: 6671634 - DNA, 15 bp, Homo sapiens
atgtcttctccctgg

SEQ ID NO: 6671635 - DNA, 14 bp, Homo sapiens
atgtcttctgctgt

SEQ ID NO: 6671636 - DNA, 20 bp, Homo sapiens
atgtcttctgctgttcttca

SEQ ID NO: 6671637 - DNA, 15 bp, Homo sapiens
atgtcttcttttgtg

SEQ ID NO: 6671638 - DNA, 17 bp, Homo sapiens
atgtcttgactgttagt

SEQ ID NO: 6671639 - DNA, 18 bp, Homo sapiens
atgtcttgagatgtatta

SEQ ID NO: 6671640 - DNA, 21 bp, Homo sapiens
atgtcttgagctctattatga

SEQ ID NO: 6671641 - DNA, 16 bp, Homo sapiens
atgtcttggacactgt

SEQ ID NO: 6671642 - DNA, 19 bp, Homo sapiens
atgtcttgggtaggcggga

SEQ ID NO: 6671643 - DNA, 18 bp, Homo sapiens
atgtcttggtacttgctg

SEQ ID NO: 6671644 - DNA, 19 bp, Homo sapiens
atgtcttggtcttctactg

SEQ ID NO: 6671645 - DNA, 18 bp, Homo sapiens
atgtcttgtaagcaaaag

SEQ ID NO: 6671646 - DNA, 22 bp, Homo sapiens
atgtcttgtacatgtgtagcct

SEQ ID NO: 6671647 - DNA, 12 bp, Homo sapiens
atgtcttgtgca

SEQ ID NO: 6671648 - DNA, 14 bp, Homo sapiens
atgtcttgtgcata

SEQ ID NO: 6671649 - DNA, 20 bp, Homo sapiens
atgtcttgtgtatttctctg

SEQ ID NO: 6671650 - DNA, 18 bp, Homo sapiens
atgtcttgttcctgtgca

SEQ ID NO: 6671651 - DNA, 14 bp, Homo sapiens
atgtcttgttcttg

SEQ ID NO: 6671652 - DNA, 16 bp, Homo sapiens
atgtctttaaaatgat

SEQ ID NO: 6671653 - DNA, 22 bp, Homo sapiens
atgtctttactggacctgaaat

SEQ ID NO: 6671654 - DNA, 22 bp, Homo sapiens
atgtctttaggcagcagctttt

SEQ ID NO: 6671655 - DNA, 19 bp, Homo sapiens
atgtctttccaaattattt

SEQ ID NO: 6671656 - DNA, 22 bp, Homo sapiens
atgtctttctccaaagttatcc

SEQ ID NO: 6671657 - DNA, 17 bp, Homo sapiens
atgtctttggtcctctt

SEQ ID NO: 6671658 - DNA, 15 bp, Homo sapiens
atgtctttgtaagtc

SEQ ID NO: 6671659 - DNA, 20 bp, Homo sapiens
atgtctttgttggaaaagaa

SEQ ID NO: 6671660 - DNA, 17 bp, Homo sapiens
atgtcttttcaaaagga

SEQ ID NO: 6671661 - DNA, 16 bp, Homo sapiens
atgtctttttaagaat

SEQ ID NO: 6671662 - DNA, 19 bp, Homo sapiens
atgtctttttttctgttaa

SEQ ID NO: 6671663 - DNA, 21 bp, Homo sapiens
atgtgaaaaaaaaaagtaatt

SEQ ID NO: 6671664 - DNA, 20 bp, Homo sapiens
atgtgaaaaactaatgtgtc

SEQ ID NO: 6671665 - DNA, 20 bp, Homo sapiens
atgtgaaaaagcctaagaaa

SEQ ID NO: 6671666 - DNA, 19 bp, Homo sapiens
atgtgaaaaatctgctgtt

SEQ ID NO: 6671667 - DNA, 20 bp, Homo sapiens
atgtgaaaaattaacttttt

SEQ ID NO: 6671668 - DNA, 14 bp, Homo sapiens
atgtgaaaacctgt

SEQ ID NO: 6671669 - DNA, 22 bp, Homo sapiens
atgtgaaaagatcccaagatgg

SEQ ID NO: 6671670 - DNA, 21 bp, Homo sapiens
atgtgaaaagcacagctgtat

SEQ ID NO: 6671671 - DNA, 23 bp, Homo sapiens
atgtgaaaagcacagctgtatat

SEQ ID NO: 6671672 - DNA, 18 bp, Homo sapiens
atgtgaaaaggcaaaaag

SEQ ID NO: 6671673 - DNA, 14 bp, Homo sapiens
atgtgaaaagtatc

SEQ ID NO: 6671674 - DNA, 20 bp, Homo sapiens
atgtgaaaatatacttgact

SEQ ID NO: 6671675 - DNA, 15 bp, Homo sapiens
atgtgaaaccttttt

SEQ ID NO: 6671676 - DNA, 20 bp, Homo sapiens
atgtgaaactgagaccaagt

SEQ ID NO: 6671677 - DNA, 18 bp, Homo sapiens
atgtgaaagataaatgat

SEQ ID NO: 6671678 - DNA, 13 bp, Homo sapiens
atgtgaaagatgc

SEQ ID NO: 6671679 - DNA, 14 bp, Homo sapiens
atgtgaaaggatat

SEQ ID NO: 6671680 - DNA, 18 bp, Homo sapiens
atgtgaaaggatatgaat

SEQ ID NO: 6671681 - DNA, 20 bp, Homo sapiens
atgtgaaaggatatgaatct

SEQ ID NO: 6671682 - DNA, 17 bp, Homo sapiens
atgtgaaatcattcatt

SEQ ID NO: 6671683 - DNA, 16 bp, Homo sapiens
atgtgaaatctcagaa

SEQ ID NO: 6671684 - DNA, 13 bp, Homo sapiens
atgtgaaatgctt

SEQ ID NO: 6671685 - DNA, 14 bp, Homo sapiens
atgtgaaatgcttt

SEQ ID NO: 6671686 - DNA, 18 bp, Homo sapiens
atgtgaaatgcttttata

SEQ ID NO: 6671687 - DNA, 17 bp, Homo sapiens
atgtgaaatgtaactgt

SEQ ID NO: 6671688 - DNA, 19 bp, Homo sapiens
atgtgaaatttttccacac

SEQ ID NO: 6671689 - DNA, 22 bp, Homo sapiens
atgtgaacaactgtttgtcttt

SEQ ID NO: 6671690 - DNA, 16 bp, Homo sapiens
atgtgaacagcggctg

SEQ ID NO: 6671691 - DNA, 22 bp, Homo sapiens
atgtgaaccattaaccagatct

SEQ ID NO: 6671692 - DNA, 13 bp, Homo sapiens
atgtgaacccggg

SEQ ID NO: 6671693 - DNA, 23 bp, Homo sapiens
atgtgaactctcccctccccatc

SEQ ID NO: 6671694 - DNA, 14 bp, Homo sapiens
atgtgaacttgtag

SEQ ID NO: 6671695 - DNA, 16 bp, Homo sapiens
atgtgaacttgtagct

SEQ ID NO: 6671696 - DNA, 18 bp, Homo sapiens
atgtgaacttgtagctgt

SEQ ID NO: 6671697 - DNA, 20 bp, Homo sapiens
atgtgaacttgtagctgtaa

SEQ ID NO: 6671698 - DNA, 22 bp, Homo sapiens
atgtgaacttgtagctgtaaaa

SEQ ID NO: 6671699 - DNA, 15 bp, Homo sapiens
atgtgaactttatta

SEQ ID NO: 6671700 - DNA, 17 bp, Homo sapiens
atgtgaactttattaaa

SEQ ID NO: 6671701 - DNA, 19 bp, Homo sapiens
atgtgaactttctcagcat

SEQ ID NO: 6671702 - DNA, 21 bp, Homo sapiens
atgtgaactttctcagcatat

SEQ ID NO: 6671703 - DNA, 14 bp, Homo sapiens
atgtgaagaattta

SEQ ID NO: 6671704 - DNA, 19 bp, Homo sapiens
atgtgaagaatttagatct

SEQ ID NO: 6671705 - DNA, 23 bp, Homo sapiens
atgtgaagacagagcagatcagt

SEQ ID NO: 6671706 - DNA, 15 bp, Homo sapiens
atgtgaagaggtctg

SEQ ID NO: 6671707 - DNA, 20 bp, Homo sapiens
atgtgaagataatttgcata

SEQ ID NO: 6671708 - DNA, 12 bp, Homo sapiens
atgtgaagatat

SEQ ID NO: 6671709 - DNA, 23 bp, Homo sapiens
atgtgaagatgcattgtagttta

SEQ ID NO: 6671710 - DNA, 16 bp, Homo sapiens
atgtgaagcatgcttt

SEQ ID NO: 6671711 - DNA, 12 bp, Homo sapiens
atgtgaagccaa

SEQ ID NO: 6671712 - DNA, 12 bp, Homo sapiens
atgtgaagcctt

SEQ ID NO: 6671713 - DNA, 14 bp, Homo sapiens
atgtgaagccttcc

SEQ ID NO: 6671714 - DNA, 15 bp, Homo sapiens
atgtgaagccttccc

SEQ ID NO: 6671715 - DNA, 14 bp, Homo sapiens
atgtgaagctattt

SEQ ID NO: 6671716 - DNA, 14 bp, Homo sapiens
atgtgaaggcccaa

SEQ ID NO: 6671717 - DNA, 19 bp, Homo sapiens
atgtgaagtgttaatacta

SEQ ID NO: 6671718 - DNA, 20 bp, Homo sapiens
atgtgaagtgttaatactag

SEQ ID NO: 6671719 - DNA, 14 bp, Homo sapiens
atgtgaagttttct

SEQ ID NO: 6671720 - DNA, 21 bp, Homo sapiens
atgtgaataaaattattttgg

SEQ ID NO: 6671721 - DNA, 16 bp, Homo sapiens
atgtgaataatggcac

SEQ ID NO: 6671722 - DNA, 20 bp, Homo sapiens
atgtgaataggttatatgca

SEQ ID NO: 6671723 - DNA, 19 bp, Homo sapiens
atgtgaatatgccagtgac

SEQ ID NO: 6671724 - DNA, 17 bp, Homo sapiens
atgtgaatatggacagt

SEQ ID NO: 6671725 - DNA, 16 bp, Homo sapiens
atgtgaatatttgtaa

SEQ ID NO: 6671726 - DNA, 15 bp, Homo sapiens
atgtgaatcgcagct

SEQ ID NO: 6671727 - DNA, 12 bp, Homo sapiens
atgtgaatgaag

SEQ ID NO: 6671728 - DNA, 16 bp, Homo sapiens
atgtgaatgggaaaag

SEQ ID NO: 6671729 - DNA, 12 bp, Homo sapiens
atgtgaatgtgg

SEQ ID NO: 6671730 - DNA, 14 bp, Homo sapiens
atgtgaattactaa

SEQ ID NO: 6671731 - DNA, 14 bp, Homo sapiens
atgtgaattattga

SEQ ID NO: 6671732 - DNA, 16 bp, Homo sapiens
atgtgaattattgaca

SEQ ID NO: 6671733 - DNA, 21 bp, Homo sapiens
atgtgaattattgacactgaa

SEQ ID NO: 6671734 - DNA, 21 bp, Homo sapiens
atgtgaatttgagtttgctgt

SEQ ID NO: 6671735 - DNA, 21 bp, Homo sapiens
atgtgaatttgtttgtgacaa

SEQ ID NO: 6671736 - DNA, 15 bp, Homo sapiens
atgtgaatttttaag

SEQ ID NO: 6671737 - DNA, 17 bp, Homo sapiens
atgtgaatttttaagct

SEQ ID NO: 6671738 - DNA, 17 bp, Homo sapiens
atgtgaatttttattgt

SEQ ID NO: 6671739 - DNA, 19 bp, Homo sapiens
atgtgaatttttatttctt

SEQ ID NO: 6671740 - DNA, 13 bp, Homo sapiens
atgtgaatttttg

SEQ ID NO: 6671741 - DNA, 15 bp, Homo sapiens
atgtgacaataatat

SEQ ID NO: 6671742 - DNA, 18 bp, Homo sapiens
atgtgacaattttgtaca

SEQ ID NO: 6671743 - DNA, 20 bp, Homo sapiens
atgtgacaattttgtacaaa

SEQ ID NO: 6671744 - DNA, 15 bp, Homo sapiens
atgtgacatttgtca

SEQ ID NO: 6671745 - DNA, 18 bp, Homo sapiens
atgtgacattttacatta

SEQ ID NO: 6671746 - DNA, 14 bp, Homo sapiens
atgtgaccattctg

SEQ ID NO: 6671747 - DNA, 15 bp, Homo sapiens
atgtgaccattctgc

SEQ ID NO: 6671748 - DNA, 14 bp, Homo sapiens
atgtgacccaccag

SEQ ID NO: 6671749 - DNA, 18 bp, Homo sapiens
atgtgacccgatggcaca

SEQ ID NO: 6671750 - DNA, 24 bp, Homo sapiens
atgtgacccgatggcacatagatg

SEQ ID NO: 6671751 - DNA, 20 bp, Homo sapiens
atgtgacgctggaccttttc

SEQ ID NO: 6671752 - DNA, 19 bp, Homo sapiens
atgtgacggggtgtgtggc

SEQ ID NO: 6671753 - DNA, 21 bp, Homo sapiens
atgtgactaccgtgccagcag

SEQ ID NO: 6671754 - DNA, 17 bp, Homo sapiens
atgtgactagcgcctgg

SEQ ID NO: 6671755 - DNA, 20 bp, Homo sapiens
atgtgactagcgcctggcct

SEQ ID NO: 6671756 - DNA, 18 bp, Homo sapiens
atgtgactcagcatcacc

SEQ ID NO: 6671757 - DNA, 16 bp, Homo sapiens
atgtgactctttccaa

SEQ ID NO: 6671758 - DNA, 21 bp, Homo sapiens
atgtgactctttccaaccggc

SEQ ID NO: 6671759 - DNA, 14 bp, Homo sapiens
atgtgactgcatca

SEQ ID NO: 6671760 - DNA, 20 bp, Homo sapiens
atgtgactgcatcatatatt

SEQ ID NO: 6671761 - DNA, 14 bp, Homo sapiens
atgtgacttctccc

SEQ ID NO: 6671762 - DNA, 21 bp, Homo sapiens
atgtgacttggattcaatttt

SEQ ID NO: 6671763 - DNA, 21 bp, Homo sapiens
atgtgactttgaaaatatata

SEQ ID NO: 6671764 - DNA, 14 bp, Homo sapiens
atgtgacttttctg

SEQ ID NO: 6671765 - DNA, 19 bp, Homo sapiens
atgtgactttttttggtat

SEQ ID NO: 6671766 - DNA, 19 bp, Homo sapiens
atgtgagaaatcagaattg

SEQ ID NO: 6671767 - DNA, 13 bp, Homo sapiens
atgtgagaaatgt

SEQ ID NO: 6671768 - DNA, 18 bp, Homo sapiens
atgtgagaacttttcata

SEQ ID NO: 6671769 - DNA, 14 bp, Homo sapiens
atgtgagaagccag

SEQ ID NO: 6671770 - DNA, 15 bp, Homo sapiens
atgtgagaagccagc

SEQ ID NO: 6671771 - DNA, 14 bp, Homo sapiens
atgtgagactggtt

SEQ ID NO: 6671772 - DNA, 14 bp, Homo sapiens
atgtgagagaaagt

SEQ ID NO: 6671773 - DNA, 17 bp, Homo sapiens
atgtgagatagttttca

SEQ ID NO: 6671774 - DNA, 12 bp, Homo sapiens
atgtgagatttc

SEQ ID NO: 6671775 - DNA, 16 bp, Homo sapiens
atgtgagatttcctta

SEQ ID NO: 6671776 - DNA, 21 bp, Homo sapiens
atgtgagattttttattgcta

SEQ ID NO: 6671777 - DNA, 13 bp, Homo sapiens
atgtgagcacaat

SEQ ID NO: 6671778 - DNA, 16 bp, Homo sapiens
atgtgagcacatgcgt

SEQ ID NO: 6671779 - DNA, 18 bp, Homo sapiens
atgtgagcacatgcgtat

SEQ ID NO: 6671780 - DNA, 19 bp, Homo sapiens
atgtgagcacatgcgtata

SEQ ID NO: 6671781 - DNA, 19 bp, Homo sapiens
atgtgagcactatctttca

SEQ ID NO: 6671782 - DNA, 16 bp, Homo sapiens
atgtgagcatgaaact

SEQ ID NO: 6671783 - DNA, 17 bp, Homo sapiens
atgtgagccaccgctgc

SEQ ID NO: 6671784 - DNA, 13 bp, Homo sapiens
atgtgagccccag

SEQ ID NO: 6671785 - DNA, 14 bp, Homo sapiens
atgtgagccccagg

SEQ ID NO: 6671786 - DNA, 17 bp, Homo sapiens
atgtgagcctcgtgtca

SEQ ID NO: 6671787 - DNA, 20 bp, Homo sapiens
atgtgagcctcgtgtcatct

SEQ ID NO: 6671788 - DNA, 12 bp, Homo sapiens
atgtgagcctga

SEQ ID NO: 6671789 - DNA, 16 bp, Homo sapiens
atgtgaggaggaaaag

SEQ ID NO: 6671790 - DNA, 18 bp, Homo sapiens
atgtgaggaggaaaagga

SEQ ID NO: 6671791 - DNA, 19 bp, Homo sapiens
atgtgaggaggaaaaggaa

SEQ ID NO: 6671792 - DNA, 19 bp, Homo sapiens
atgtgaggtaattattgct

SEQ ID NO: 6671793 - DNA, 23 bp, Homo sapiens
atgtgagtacccaggatgatttc

SEQ ID NO: 6671794 - DNA, 20 bp, Homo sapiens
atgtgagtagtcttatgtaa

SEQ ID NO: 6671795 - DNA, 17 bp, Homo sapiens
atgtgagtagttactaa

SEQ ID NO: 6671796 - DNA, 12 bp, Homo sapiens
atgtgagtattt

SEQ ID NO: 6671797 - DNA, 17 bp, Homo sapiens
atgtgagtcattatgta

SEQ ID NO: 6671798 - DNA, 19 bp, Homo sapiens
atgtgagtcctgttgaaga

SEQ ID NO: 6671799 - DNA, 20 bp, Homo sapiens
atgtgagtcctgttgaagac

SEQ ID NO: 6671800 - DNA, 22 bp, Homo sapiens
atgtgagtcctgttgaagactt

SEQ ID NO: 6671801 - DNA, 22 bp, Homo sapiens
atgtgagtgaaagtacttcagg

SEQ ID NO: 6671802 - DNA, 20 bp, Homo sapiens
atgtgagtgccttttgcaga

SEQ ID NO: 6671803 - DNA, 15 bp, Homo sapiens
atgtgagtggttgaa

SEQ ID NO: 6671804 - DNA, 19 bp, Homo sapiens
atgtgagtggttgaatatg

SEQ ID NO: 6671805 - DNA, 22 bp, Homo sapiens
atgtgagtggttgaatatgatt

SEQ ID NO: 6671806 - DNA, 22 bp, Homo sapiens
atgtgagtgtgtgtttgtgctg

SEQ ID NO: 6671807 - DNA, 18 bp, Homo sapiens
atgtgagtttaatctttt

SEQ ID NO: 6671808 - DNA, 15 bp, Homo sapiens
atgtgagtttcagaa

SEQ ID NO: 6671809 - DNA, 16 bp, Homo sapiens
atgtgagtttcagaaa

SEQ ID NO: 6671810 - DNA, 19 bp, Homo sapiens
atgtgagtttcctgctata

SEQ ID NO: 6671811 - DNA, 17 bp, Homo sapiens
atgtgagtttggtctgg

SEQ ID NO: 6671812 - DNA, 17 bp, Homo sapiens
atgtgataaggaaatca

SEQ ID NO: 6671813 - DNA, 20 bp, Homo sapiens
atgtgataaggatcagaaca

SEQ ID NO: 6671814 - DNA, 17 bp, Homo sapiens
atgtgataatatattgc

SEQ ID NO: 6671815 - DNA, 15 bp, Homo sapiens
atgtgataattgtaa

SEQ ID NO: 6671816 - DNA, 16 bp, Homo sapiens
atgtgataattgtaaa

SEQ ID NO: 6671817 - DNA, 20 bp, Homo sapiens
atgtgatacattaggaagct

SEQ ID NO: 6671818 - DNA, 18 bp, Homo sapiens
atgtgatataaacagctt

SEQ ID NO: 6671819 - DNA, 13 bp, Homo sapiens
atgtgatatataa

SEQ ID NO: 6671820 - DNA, 19 bp, Homo sapiens
atgtgatatgtgtaatatc

SEQ ID NO: 6671821 - DNA, 16 bp, Homo sapiens
atgtgatatgttttaa

SEQ ID NO: 6671822 - DNA, 21 bp, Homo sapiens
atgtgatattctgttgcttta

SEQ ID NO: 6671823 - DNA, 17 bp, Homo sapiens
atgtgatattttcacat

SEQ ID NO: 6671824 - DNA, 18 bp, Homo sapiens
atgtgatcacgcctggct

SEQ ID NO: 6671825 - DNA, 15 bp, Homo sapiens
atgtgatcaggcccc

SEQ ID NO: 6671826 - DNA, 22 bp, Homo sapiens
atgtgatcaggccccacccctg

SEQ ID NO: 6671827 - DNA, 17 bp, Homo sapiens
atgtgatccttttatgt

SEQ ID NO: 6671828 - DNA, 18 bp, Homo sapiens
atgtgatccttttatgtt

SEQ ID NO: 6671829 - DNA, 18 bp, Homo sapiens
atgtgatccttttggagt

SEQ ID NO: 6671830 - DNA, 16 bp, Homo sapiens
atgtgatctgtcttgt

SEQ ID NO: 6671831 - DNA, 16 bp, Homo sapiens
atgtgatgagaggaaa

SEQ ID NO: 6671832 - DNA, 17 bp, Homo sapiens
atgtgatgagaggaaat

SEQ ID NO: 6671833 - DNA, 16 bp, Homo sapiens
atgtgatgatgtaatt

SEQ ID NO: 6671834 - DNA, 18 bp, Homo sapiens
atgtgatgccaaagatgt

SEQ ID NO: 6671835 - DNA, 22 bp, Homo sapiens
atgtgatgccaaagatgtttga

SEQ ID NO: 6671836 - DNA, 23 bp, Homo sapiens
atgtgatgccaaagatgtttgaa

SEQ ID NO: 6671837 - DNA, 14 bp, Homo sapiens
atgtgatgctggta

SEQ ID NO: 6671838 - DNA, 16 bp, Homo sapiens
atgtgatggaacacac

SEQ ID NO: 6671839 - DNA, 16 bp, Homo sapiens
atgtgatggatggcac

SEQ ID NO: 6671840 - DNA, 19 bp, Homo sapiens
atgtgatggatggcacaat

SEQ ID NO: 6671841 - DNA, 14 bp, Homo sapiens
atgtgatgtcatga

SEQ ID NO: 6671842 - DNA, 17 bp, Homo sapiens
atgtgatgttctaaggc

SEQ ID NO: 6671843 - DNA, 17 bp, Homo sapiens
atgtgattaactcttag

SEQ ID NO: 6671844 - DNA, 18 bp, Homo sapiens
atgtgattaactcttaga

SEQ ID NO: 6671845 - DNA, 14 bp, Homo sapiens
atgtgattatcatt

SEQ ID NO: 6671846 - DNA, 15 bp, Homo sapiens
atgtgattcaaaaga

SEQ ID NO: 6671847 - DNA, 21 bp, Homo sapiens
atgtgattgcctcaataaagc

SEQ ID NO: 6671848 - DNA, 22 bp, Homo sapiens
atgtgattgcctcaataaagct

SEQ ID NO: 6671849 - DNA, 15 bp, Homo sapiens
atgtgattggcagct

SEQ ID NO: 6671850 - DNA, 23 bp, Homo sapiens
atgtgattggcagcttcaaaaca

SEQ ID NO: 6671851 - DNA, 15 bp, Homo sapiens
atgtgattgtggaat

SEQ ID NO: 6671852 - DNA, 13 bp, Homo sapiens
atgtgatttaata

SEQ ID NO: 6671853 - DNA, 20 bp, Homo sapiens
atgtgatttaatagtgttaa

SEQ ID NO: 6671854 - DNA, 13 bp, Homo sapiens
atgtgatttatgc

SEQ ID NO: 6671855 - DNA, 22 bp, Homo sapiens
atgtgatttgtcttcccttctt

SEQ ID NO: 6671856 - DNA, 15 bp, Homo sapiens
atgtgattttaactc

SEQ ID NO: 6671857 - DNA, 20 bp, Homo sapiens
atgtgattttaactctgtct

SEQ ID NO: 6671858 - DNA, 11 bp, Homo sapiens
atgtgattttg

SEQ ID NO: 6671859 - DNA, 23 bp, Homo sapiens
atgtgattttgagcaaaccacat

SEQ ID NO: 6671860 - DNA, 22 bp, Homo sapiens
atgtgattttgtaggttatttt

SEQ ID NO: 6671861 - DNA, 13 bp, Homo sapiens
atgtgatttttgt

SEQ ID NO: 6671862 - DNA, 20 bp, Homo sapiens
atgtgatttttgtgaagtta

SEQ ID NO: 6671863 - DNA, 17 bp, Homo sapiens
atgtgcaaaaatttttg

SEQ ID NO: 6671864 - DNA, 15 bp, Homo sapiens
atgtgcaacctgtgg

SEQ ID NO: 6671865 - DNA, 17 bp, Homo sapiens
atgtgcaactcttgtat

SEQ ID NO: 6671866 - DNA, 17 bp, Homo sapiens
atgtgcaataatttgta

SEQ ID NO: 6671867 - DNA, 18 bp, Homo sapiens
atgtgcaataatttgtac

SEQ ID NO: 6671868 - DNA, 13 bp, Homo sapiens
atgtgcaatagaa

SEQ ID NO: 6671869 - DNA, 16 bp, Homo sapiens
atgtgcacacacacgc

SEQ ID NO: 6671870 - DNA, 15 bp, Homo sapiens
atgtgcacatgtgtc

SEQ ID NO: 6671871 - DNA, 19 bp, Homo sapiens
atgtgcacccggcctggat

SEQ ID NO: 6671872 - DNA, 18 bp, Homo sapiens
atgtgcacctatggccca

SEQ ID NO: 6671873 - DNA, 19 bp, Homo sapiens
atgtgcacctatggcccag

SEQ ID NO: 6671874 - DNA, 16 bp, Homo sapiens
atgtgcacggcagctt

SEQ ID NO: 6671875 - DNA, 22 bp, Homo sapiens
atgtgcacggcagcttgagcct

SEQ ID NO: 6671876 - DNA, 18 bp, Homo sapiens
atgtgcagaaaatattta

SEQ ID NO: 6671877 - DNA, 14 bp, Homo sapiens
atgtgcagagttga

SEQ ID NO: 6671878 - DNA, 18 bp, Homo sapiens
atgtgcagcagattggaa

SEQ ID NO: 6671879 - DNA, 15 bp, Homo sapiens
atgtgcagggatatt

SEQ ID NO: 6671880 - DNA, 19 bp, Homo sapiens
atgtgcagggatattgcct

SEQ ID NO: 6671881 - DNA, 17 bp, Homo sapiens
atgtgcaggtttgttac

SEQ ID NO: 6671882 - DNA, 19 bp, Homo sapiens
atgtgcaggtttgttacat

SEQ ID NO: 6671883 - DNA, 18 bp, Homo sapiens
atgtgcagtattttatta

SEQ ID NO: 6671884 - DNA, 15 bp, Homo sapiens
atgtgcagtgtggga

SEQ ID NO: 6671885 - DNA, 16 bp, Homo sapiens
atgtgcagtttggaat

SEQ ID NO: 6671886 - DNA, 16 bp, Homo sapiens
atgtgcatagtttctt

SEQ ID NO: 6671887 - DNA, 17 bp, Homo sapiens
atgtgcatagtttcttt

SEQ ID NO: 6671888 - DNA, 14 bp, Homo sapiens
atgtgcatataaag

SEQ ID NO: 6671889 - DNA, 15 bp, Homo sapiens
atgtgcatctggcct

SEQ ID NO: 6671890 - DNA, 14 bp, Homo sapiens
atgtgcatttaatt

SEQ ID NO: 6671891 - DNA, 21 bp, Homo sapiens
atgtgcatttcacctgtgaca

SEQ ID NO: 6671892 - DNA, 21 bp, Homo sapiens
atgtgccaaagtccatttatc

SEQ ID NO: 6671893 - DNA, 15 bp, Homo sapiens
atgtgccaaggtggg

SEQ ID NO: 6671894 - DNA, 16 bp, Homo sapiens
atgtgccaataaccaa

SEQ ID NO: 6671895 - DNA, 17 bp, Homo sapiens
atgtgccaataaccaag

SEQ ID NO: 6671896 - DNA, 16 bp, Homo sapiens
atgtgccaattttgtc

SEQ ID NO: 6671897 - DNA, 18 bp, Homo sapiens
atgtgccacagaggcccc

SEQ ID NO: 6671898 - DNA, 19 bp, Homo sapiens
atgtgccacagaggcccca

SEQ ID NO: 6671899 - DNA, 13 bp, Homo sapiens
atgtgccacctgt

SEQ ID NO: 6671900 - DNA, 21 bp, Homo sapiens
atgtgccacctgtccggccca

SEQ ID NO: 6671901 - DNA, 11 bp, Homo sapiens
atgtgccacta

SEQ ID NO: 6671902 - DNA, 23 bp, Homo sapiens
atgtgccaggaaactcttgctat

SEQ ID NO: 6671903 - DNA, 17 bp, Homo sapiens
atgtgccaggcttgcct

SEQ ID NO: 6671904 - DNA, 19 bp, Homo sapiens
atgtgccaggcttgcctgg

SEQ ID NO: 6671905 - DNA, 22 bp, Homo sapiens
atgtgccaggcttgcctgggct

SEQ ID NO: 6671906 - DNA, 20 bp, Homo sapiens
atgtgccagggcaatgatga

SEQ ID NO: 6671907 - DNA, 19 bp, Homo sapiens
atgtgccatctgtacatat

SEQ ID NO: 6671908 - DNA, 16 bp, Homo sapiens
atgtgccatgtataat

SEQ ID NO: 6671909 - DNA, 18 bp, Homo sapiens
atgtgccattttaaaaaa

SEQ ID NO: 6671910 - DNA, 17 bp, Homo sapiens
atgtgccattttaataa

SEQ ID NO: 6671911 - DNA, 14 bp, Homo sapiens
atgtgcccaaagct

SEQ ID NO: 6671912 - DNA, 16 bp, Homo sapiens
atgtgcccccaccccc

SEQ ID NO: 6671913 - DNA, 12 bp, Homo sapiens
atgtgcccctgc

SEQ ID NO: 6671914 - DNA, 14 bp, Homo sapiens
atgtgcccctgcca

SEQ ID NO: 6671915 - DNA, 15 bp, Homo sapiens
atgtgcccctggccc

SEQ ID NO: 6671916 - DNA, 15 bp, Homo sapiens
atgtgccctgccttg

SEQ ID NO: 6671917 - DNA, 22 bp, Homo sapiens
atgtgcccttttataaggaaac

SEQ ID NO: 6671918 - DNA, 14 bp, Homo sapiens
atgtgccgtctttg

SEQ ID NO: 6671919 - DNA, 23 bp, Homo sapiens
atgtgccgtctttggttcctcat

SEQ ID NO: 6671920 - DNA, 18 bp, Homo sapiens
atgtgcctaaataagtta

SEQ ID NO: 6671921 - DNA, 19 bp, Homo sapiens
atgtgcctaatggagaaga

SEQ ID NO: 6671922 - DNA, 11 bp, Homo sapiens
atgtgcctatt

SEQ ID NO: 6671923 - DNA, 14 bp, Homo sapiens
atgtgcctctgtcc

SEQ ID NO: 6671924 - DNA, 16 bp, Homo sapiens
atgtgcctctgtcctt

SEQ ID NO: 6671925 - DNA, 15 bp, Homo sapiens
atgtgcctgatccag

SEQ ID NO: 6671926 - DNA, 19 bp, Homo sapiens
atgtgcctgcaccaggaga

SEQ ID NO: 6671927 - DNA, 22 bp, Homo sapiens
atgtgcctgcaccaggagacag

SEQ ID NO: 6671928 - DNA, 21 bp, Homo sapiens
atgtgcctgtattcccagcta

SEQ ID NO: 6671929 - DNA, 21 bp, Homo sapiens
atgtgccttaagttttagtct

SEQ ID NO: 6671930 - DNA, 17 bp, Homo sapiens
atgtgccttatgttgaa

SEQ ID NO: 6671931 - DNA, 22 bp, Homo sapiens
atgtgccttctagaatacatat

SEQ ID NO: 6671932 - DNA, 20 bp, Homo sapiens
atgtgccttgattgattaga

SEQ ID NO: 6671933 - DNA, 21 bp, Homo sapiens
atgtgccttgattgattagat

SEQ ID NO: 6671934 - DNA, 24 bp, Homo sapiens
atgtgccttgattgattagataaa

SEQ ID NO: 6671935 - DNA, 11 bp, Homo sapiens
atgtgcctttc

SEQ ID NO: 6671936 - DNA, 19 bp, Homo sapiens
atgtgcctttctttgcctc

SEQ ID NO: 6671937 - DNA, 20 bp, Homo sapiens
atgtgcctttctttgcctct

SEQ ID NO: 6671938 - DNA, 22 bp, Homo sapiens
atgtgcctttttgtttttgtaa

SEQ ID NO: 6671939 - DNA, 14 bp, Homo sapiens
atgtgcgaacacag

SEQ ID NO: 6671940 - DNA, 15 bp, Homo sapiens
atgtgcgaagcaaga

SEQ ID NO: 6671941 - DNA, 20 bp, Homo sapiens
atgtgcgaagcaagaagaat

SEQ ID NO: 6671942 - DNA, 21 bp, Homo sapiens
atgtgcgaagcaagaagaatt

SEQ ID NO: 6671943 - DNA, 16 bp, Homo sapiens
atgtgcggctgaactg

SEQ ID NO: 6671944 - DNA, 20 bp, Homo sapiens
atgtgcgtctctctttctcc

SEQ ID NO: 6671945 - DNA, 16 bp, Homo sapiens
atgtgcgtgctgtctg

SEQ ID NO: 6671946 - DNA, 19 bp, Homo sapiens
atgtgcgtgctgtctgtcc

SEQ ID NO: 6671947 - DNA, 18 bp, Homo sapiens
atgtgcgtggaagtgttc

SEQ ID NO: 6671948 - DNA, 16 bp, Homo sapiens
atgtgcgtgtgcgtgt

SEQ ID NO: 6671949 - DNA, 23 bp, Homo sapiens
atgtgcgtgtgcgtgttcctttg

SEQ ID NO: 6671950 - DNA, 20 bp, Homo sapiens
atgtgcgtgtgtgcaagtgt

SEQ ID NO: 6671951 - DNA, 18 bp, Homo sapiens
atgtgctagagttaaaag

SEQ ID NO: 6671952 - DNA, 19 bp, Homo sapiens
atgtgctagtaattggaaa

SEQ ID NO: 6671953 - DNA, 21 bp, Homo sapiens
atgtgctagtaattggaaagg

SEQ ID NO: 6671954 - DNA, 18 bp, Homo sapiens
atgtgctatacacacaca

SEQ ID NO: 6671955 - DNA, 19 bp, Homo sapiens
atgtgctatacacacacac

SEQ ID NO: 6671956 - DNA, 16 bp, Homo sapiens
atgtgctatgcaaaat

SEQ ID NO: 6671957 - DNA, 15 bp, Homo sapiens
atgtgctatggagag

SEQ ID NO: 6671958 - DNA, 16 bp, Homo sapiens
atgtgctattaatatt

SEQ ID NO: 6671959 - DNA, 18 bp, Homo sapiens
atgtgctattaatatttg

SEQ ID NO: 6671960 - DNA, 19 bp, Homo sapiens
atgtgctattaatatttgt

SEQ ID NO: 6671961 - DNA, 13 bp, Homo sapiens
atgtgctcagaag

SEQ ID NO: 6671962 - DNA, 22 bp, Homo sapiens
atgtgctgatgtttacaatgat

SEQ ID NO: 6671963 - DNA, 24 bp, Homo sapiens
atgtgctgccctgttgccgagccc

SEQ ID NO: 6671964 - DNA, 18 bp, Homo sapiens
atgtgctgcgtgcctgtg

SEQ ID NO: 6671965 - DNA, 14 bp, Homo sapiens
atgtgctggagctg

SEQ ID NO: 6671966 - DNA, 18 bp, Homo sapiens
atgtgctggagctggctt

SEQ ID NO: 6671967 - DNA, 14 bp, Homo sapiens
atgtgctggagggg

SEQ ID NO: 6671968 - DNA, 17 bp, Homo sapiens
atgtgctggaggggtgg

SEQ ID NO: 6671969 - DNA, 20 bp, Homo sapiens
atgtgctggaggggtggccc

SEQ ID NO: 6671970 - DNA, 23 bp, Homo sapiens
atgtgctggaggggtggcccaga

SEQ ID NO: 6671971 - DNA, 22 bp, Homo sapiens
atgtgctgggaaatgcagaaat

SEQ ID NO: 6671972 - DNA, 17 bp, Homo sapiens
atgtgctggtgaacact

SEQ ID NO: 6671973 - DNA, 18 bp, Homo sapiens
atgtgctgtgaccattta

SEQ ID NO: 6671974 - DNA, 17 bp, Homo sapiens
atgtgctgtgtaaagtt

SEQ ID NO: 6671975 - DNA, 18 bp, Homo sapiens
atgtgctgtgtaaagtta

SEQ ID NO: 6671976 - DNA, 19 bp, Homo sapiens
atgtgctgtgtaaagttag

SEQ ID NO: 6671977 - DNA, 13 bp, Homo sapiens
atgtgctgtgtga

SEQ ID NO: 6671978 - DNA, 18 bp, Homo sapiens
atgtgctgtgtgacattg

SEQ ID NO: 6671979 - DNA, 20 bp, Homo sapiens
atgtgctgtgtgagtgagca

SEQ ID NO: 6671980 - DNA, 22 bp, Homo sapiens
atgtgctgttgattctttcaat

SEQ ID NO: 6671981 - DNA, 17 bp, Homo sapiens
atgtgcttcattgtttg

SEQ ID NO: 6671982 - DNA, 13 bp, Homo sapiens
atgtgcttctcag

SEQ ID NO: 6671983 - DNA, 13 bp, Homo sapiens
atgtgcttgaaga

SEQ ID NO: 6671984 - DNA, 21 bp, Homo sapiens
atgtgcttgtgcctacctggc

SEQ ID NO: 6671985 - DNA, 20 bp, Homo sapiens
atgtgcttgtgctcatgtgt

SEQ ID NO: 6671986 - DNA, 23 bp, Homo sapiens
atgtgcttgtgctcatgtgtgtg

SEQ ID NO: 6671987 - DNA, 18 bp, Homo sapiens
atgtgcttgtgtgtatgt

SEQ ID NO: 6671988 - DNA, 15 bp, Homo sapiens
atgtgctttcatcca

SEQ ID NO: 6671989 - DNA, 15 bp, Homo sapiens
atgtgctttgctgca

SEQ ID NO: 6671990 - DNA, 21 bp, Homo sapiens
atgtgctttgctgcacaaaca

SEQ ID NO: 6671991 - DNA, 15 bp, Homo sapiens
atgtgctttgtagct

SEQ ID NO: 6671992 - DNA, 19 bp, Homo sapiens
atgtggaaaacatcctgac

SEQ ID NO: 6671993 - DNA, 21 bp, Homo sapiens
atgtggaaaacatcctgactt

SEQ ID NO: 6671994 - DNA, 17 bp, Homo sapiens
atgtggaaaactcacag

SEQ ID NO: 6671995 - DNA, 16 bp, Homo sapiens
atgtggaaagtgaatt

SEQ ID NO: 6671996 - DNA, 15 bp, Homo sapiens
atgtggaactgctgc

SEQ ID NO: 6671997 - DNA, 16 bp, Homo sapiens
atgtggaactgctgcc

SEQ ID NO: 6671998 - DNA, 16 bp, Homo sapiens
atgtggaactgtagga

SEQ ID NO: 6671999 - DNA, 15 bp, Homo sapiens
atgtggaagaaaatg

SEQ ID NO: 6672000 - DNA, 12 bp, Homo sapiens
atgtggaagagc

SEQ ID NO: 6672001 - DNA, 17 bp, Homo sapiens
atgtggaatataaagat

SEQ ID NO: 6672002 - DNA, 18 bp, Homo sapiens
atgtggaatggattatag

SEQ ID NO: 6672003 - DNA, 20 bp, Homo sapiens
atgtggaattacataacagg

SEQ ID NO: 6672004 - DNA, 16 bp, Homo sapiens
atgtggacatgcaccc

SEQ ID NO: 6672005 - DNA, 17 bp, Homo sapiens
atgtggacatgcacccg

SEQ ID NO: 6672006 - DNA, 19 bp, Homo sapiens
atgtggacgtgcactgaca

SEQ ID NO: 6672007 - DNA, 17 bp, Homo sapiens
atgtggacttaggaagg

SEQ ID NO: 6672008 - DNA, 18 bp, Homo sapiens
atgtggacttgtatgctg

SEQ ID NO: 6672009 - DNA, 14 bp, Homo sapiens
atgtggagaaggtg

SEQ ID NO: 6672010 - DNA, 13 bp, Homo sapiens
atgtggagactga

SEQ ID NO: 6672011 - DNA, 20 bp, Homo sapiens
atgtggagactgatggccag

SEQ ID NO: 6672012 - DNA, 16 bp, Homo sapiens
atgtggagcagcagcc

SEQ ID NO: 6672013 - DNA, 12 bp, Homo sapiens
atgtggagccag

SEQ ID NO: 6672014 - DNA, 16 bp, Homo sapiens
atgtggaggaagagcc

SEQ ID NO: 6672015 - DNA, 19 bp, Homo sapiens
atgtggagtcagcctcgca

SEQ ID NO: 6672016 - DNA, 18 bp, Homo sapiens
atgtggagtctccctctg

SEQ ID NO: 6672017 - DNA, 19 bp, Homo sapiens
atgtggagtggacattcaa

SEQ ID NO: 6672018 - DNA, 20 bp, Homo sapiens
atgtggataaaactgtgtaa

SEQ ID NO: 6672019 - DNA, 21 bp, Homo sapiens
atgtggattaaaaccttaaga

SEQ ID NO: 6672020 - DNA, 15 bp, Homo sapiens
atgtggcaaaacata

SEQ ID NO: 6672021 - DNA, 19 bp, Homo sapiens
atgtggcaataaaggagaa

SEQ ID NO: 6672022 - DNA, 15 bp, Homo sapiens
atgtggcagaagtgc

SEQ ID NO: 6672023 - DNA, 14 bp, Homo sapiens
atgtggcagcccat

SEQ ID NO: 6672024 - DNA, 16 bp, Homo sapiens
atgtggcagcccatgg

SEQ ID NO: 6672025 - DNA, 22 bp, Homo sapiens
atgtggcagctggggagcagct

SEQ ID NO: 6672026 - DNA, 16 bp, Homo sapiens
atgtggcagctgtctc

SEQ ID NO: 6672027 - DNA, 20 bp, Homo sapiens
atgtggcaggggcagtggcc

SEQ ID NO: 6672028 - DNA, 23 bp, Homo sapiens
atgtggccacaactgctgtggcc

SEQ ID NO: 6672029 - DNA, 19 bp, Homo sapiens
atgtggccacttatttcac

SEQ ID NO: 6672030 - DNA, 21 bp, Homo sapiens
atgtggcccaagtcattccta

SEQ ID NO: 6672031 - DNA, 16 bp, Homo sapiens
atgtggccccaggtgc

SEQ ID NO: 6672032 - DNA, 22 bp, Homo sapiens
atgtggcccctgaacaagaatt

SEQ ID NO: 6672033 - DNA, 21 bp, Homo sapiens
atgtggccctccagtgtatga

SEQ ID NO: 6672034 - DNA, 16 bp, Homo sapiens
atgtggccctggcctg

SEQ ID NO: 6672035 - DNA, 20 bp, Homo sapiens
atgtggccctggcctgctgg

SEQ ID NO: 6672036 - DNA, 16 bp, Homo sapiens
atgtggcctaatattg

SEQ ID NO: 6672037 - DNA, 13 bp, Homo sapiens
atgtggcctgccc

SEQ ID NO: 6672038 - DNA, 14 bp, Homo sapiens
atgtggcctgccca

SEQ ID NO: 6672039 - DNA, 18 bp, Homo sapiens
atgtggcctgcccagcct

SEQ ID NO: 6672040 - DNA, 17 bp, Homo sapiens
atgtggccttgagcaag

SEQ ID NO: 6672041 - DNA, 20 bp, Homo sapiens
atgtggcctttgaattctgt

SEQ ID NO: 6672042 - DNA, 10 bp, Homo sapiens
atgtggctga

SEQ ID NO: 6672043 - DNA, 19 bp, Homo sapiens
atgtggctgaaaatgcaaa

SEQ ID NO: 6672044 - DNA, 20 bp, Homo sapiens
atgtggctgaaaatgcaaag

SEQ ID NO: 6672045 - DNA, 14 bp, Homo sapiens
atgtggctggaaga

SEQ ID NO: 6672046 - DNA, 17 bp, Homo sapiens
atgtggctgtaaaactt

SEQ ID NO: 6672047 - DNA, 18 bp, Homo sapiens
atgtggctgtaacctgct

SEQ ID NO: 6672048 - DNA, 22 bp, Homo sapiens
atgtggctgtaatgacaaaaga

SEQ ID NO: 6672049 - DNA, 16 bp, Homo sapiens
atgtggcttcttcaac

SEQ ID NO: 6672050 - DNA, 17 bp, Homo sapiens
atgtggcttcttcaact

SEQ ID NO: 6672051 - DNA, 17 bp, Homo sapiens
atgtggcttttatttca

SEQ ID NO: 6672052 - DNA, 18 bp, Homo sapiens
atgtgggaaaaaagaaat

SEQ ID NO: 6672053 - DNA, 18 bp, Homo sapiens
atgtgggaagaaacaaac

SEQ ID NO: 6672054 - DNA, 20 bp, Homo sapiens
atgtgggaagaaacaaaccc

SEQ ID NO: 6672055 - DNA, 17 bp, Homo sapiens
atgtgggaagttacctt

SEQ ID NO: 6672056 - DNA, 18 bp, Homo sapiens
atgtgggaagttaccttt

SEQ ID NO: 6672057 - DNA, 22 bp, Homo sapiens
atgtgggaatctcccagacttg

SEQ ID NO: 6672058 - DNA, 20 bp, Homo sapiens
atgtgggaattaagcaaaat

SEQ ID NO: 6672059 - DNA, 22 bp, Homo sapiens
atgtgggagctgaaccacagaa

SEQ ID NO: 6672060 - DNA, 11 bp, Homo sapiens
atgtgggaggg

SEQ ID NO: 6672061 - DNA, 17 bp, Homo sapiens
atgtgggatattgaatg

SEQ ID NO: 6672062 - DNA, 15 bp, Homo sapiens
atgtgggcacggagg

SEQ ID NO: 6672063 - DNA, 12 bp, Homo sapiens
atgtgggcagct

SEQ ID NO: 6672064 - DNA, 23 bp, Homo sapiens
atgtgggcgcccaccctgggctc

SEQ ID NO: 6672065 - DNA, 21 bp, Homo sapiens
atgtgggcgtttgtaaattct

SEQ ID NO: 6672066 - DNA, 20 bp, Homo sapiens
atgtgggctagttgggcttc

SEQ ID NO: 6672067 - DNA, 15 bp, Homo sapiens
atgtgggctcagatc

SEQ ID NO: 6672068 - DNA, 14 bp, Homo sapiens
atgtgggggcttca

SEQ ID NO: 6672069 - DNA, 18 bp, Homo sapiens
atgtgggggcttcatctc

SEQ ID NO: 6672070 - DNA, 22 bp, Homo sapiens
atgtgggggcttcatctcttta

SEQ ID NO: 6672071 - DNA, 15 bp, Homo sapiens
atgtgggtccctctc

SEQ ID NO: 6672072 - DNA, 16 bp, Homo sapiens
atgtgggtccctctct

SEQ ID NO: 6672073 - DNA, 20 bp, Homo sapiens
atgtgggtccctctcttgac

SEQ ID NO: 6672074 - DNA, 18 bp, Homo sapiens
atgtgggtgaccaggtcc

SEQ ID NO: 6672075 - DNA, 16 bp, Homo sapiens
atgtgggtggagaagg

SEQ ID NO: 6672076 - DNA, 19 bp, Homo sapiens
atgtgggtggagaagggag

SEQ ID NO: 6672077 - DNA, 20 bp, Homo sapiens
atgtgggtggagaagggagg

SEQ ID NO: 6672078 - DNA, 16 bp, Homo sapiens
atgtgggtgtcagtgt

SEQ ID NO: 6672079 - DNA, 15 bp, Homo sapiens
atgtgggttatcctc

SEQ ID NO: 6672080 - DNA, 15 bp, Homo sapiens
atgtgggttccacag

SEQ ID NO: 6672081 - DNA, 16 bp, Homo sapiens
atgtgggttgcctggt

SEQ ID NO: 6672082 - DNA, 15 bp, Homo sapiens
atgtggtaagtggag

SEQ ID NO: 6672083 - DNA, 15 bp, Homo sapiens
atgtggtcacagctg

SEQ ID NO: 6672084 - DNA, 19 bp, Homo sapiens
atgtggtcacagctgtata

SEQ ID NO: 6672085 - DNA, 17 bp, Homo sapiens
atgtggtccatctctga

SEQ ID NO: 6672086 - DNA, 18 bp, Homo sapiens
atgtggtccatctctgaa

SEQ ID NO: 6672087 - DNA, 19 bp, Homo sapiens
atgtggtcctatttaagcc

SEQ ID NO: 6672088 - DNA, 21 bp, Homo sapiens
atgtggtctgccaatctgtac

SEQ ID NO: 6672089 - DNA, 22 bp, Homo sapiens
atgtggtcttatgattttatta

SEQ ID NO: 6672090 - DNA, 13 bp, Homo sapiens
atgtggtgagaat

SEQ ID NO: 6672091 - DNA, 13 bp, Homo sapiens
atgtggtgcctga

SEQ ID NO: 6672092 - DNA, 18 bp, Homo sapiens
atgtggtggcaataaatg

SEQ ID NO: 6672093 - DNA, 22 bp, Homo sapiens
atgtggtggcacaggccccctt

SEQ ID NO: 6672094 - DNA, 15 bp, Homo sapiens
atgtggtgggacagg

SEQ ID NO: 6672095 - DNA, 21 bp, Homo sapiens
atgtggttaccgagtatctgt

SEQ ID NO: 6672096 - DNA, 20 bp, Homo sapiens
atgtggttagttaactgaat

SEQ ID NO: 6672097 - DNA, 17 bp, Homo sapiens
atgtggttatttctctg

SEQ ID NO: 6672098 - DNA, 15 bp, Homo sapiens
atgtggttcttcaaa

SEQ ID NO: 6672099 - DNA, 19 bp, Homo sapiens
atgtggtttatagagggcc

SEQ ID NO: 6672100 - DNA, 23 bp, Homo sapiens
atgtggtttggttcctctctggt

SEQ ID NO: 6672101 - DNA, 16 bp, Homo sapiens
atgtggtttgtacata

SEQ ID NO: 6672102 - DNA, 20 bp, Homo sapiens
atgtggtttttgatgccttt

SEQ ID NO: 6672103 - DNA, 16 bp, Homo sapiens
atgtggttttttgcca

SEQ ID NO: 6672104 - DNA, 15 bp, Homo sapiens
atgtgtaaaatgtga

SEQ ID NO: 6672105 - DNA, 23 bp, Homo sapiens
atgtgtaaaattggattattact

SEQ ID NO: 6672106 - DNA, 14 bp, Homo sapiens
atgtgtaaacaggt

SEQ ID NO: 6672107 - DNA, 16 bp, Homo sapiens
atgtgtaaacaggtat

SEQ ID NO: 6672108 - DNA, 20 bp, Homo sapiens
atgtgtaaatggagcttgta

SEQ ID NO: 6672109 - DNA, 17 bp, Homo sapiens
atgtgtaaatgttatga

SEQ ID NO: 6672110 - DNA, 16 bp, Homo sapiens
atgtgtaacttctaga

SEQ ID NO: 6672111 - DNA, 22 bp, Homo sapiens
atgtgtaacttttttttagtat

SEQ ID NO: 6672112 - DNA, 15 bp, Homo sapiens
atgtgtaaggtgaac

SEQ ID NO: 6672113 - DNA, 17 bp, Homo sapiens
atgtgtaataatgtaac

SEQ ID NO: 6672114 - DNA, 18 bp, Homo sapiens
atgtgtaataatgtaaca

SEQ ID NO: 6672115 - DNA, 21 bp, Homo sapiens
atgtgtaataatgtaacatga

SEQ ID NO: 6672116 - DNA, 18 bp, Homo sapiens
atgtgtaatatcatttca

SEQ ID NO: 6672117 - DNA, 19 bp, Homo sapiens
atgtgtaatatcatttcat

SEQ ID NO: 6672118 - DNA, 17 bp, Homo sapiens
atgtgtaatcaataaac

SEQ ID NO: 6672119 - DNA, 21 bp, Homo sapiens
atgtgtaatcaataaacgatt

SEQ ID NO: 6672120 - DNA, 18 bp, Homo sapiens
atgtgtaatttttctgta

SEQ ID NO: 6672121 - DNA, 20 bp, Homo sapiens
atgtgtaatttttctgtata

SEQ ID NO: 6672122 - DNA, 16 bp, Homo sapiens
atgtgtaattttttaa

SEQ ID NO: 6672123 - DNA, 18 bp, Homo sapiens
atgtgtacagaaacaact

SEQ ID NO: 6672124 - DNA, 22 bp, Homo sapiens
atgtgtacagaaacaactgcca

SEQ ID NO: 6672125 - DNA, 23 bp, Homo sapiens
atgtgtacagaaacaactgccaa

SEQ ID NO: 6672126 - DNA, 13 bp, Homo sapiens
atgtgtacatata

SEQ ID NO: 6672127 - DNA, 15 bp, Homo sapiens
atgtgtacatatatg

SEQ ID NO: 6672128 - DNA, 22 bp, Homo sapiens
atgtgtacatggcagagtttgt

SEQ ID NO: 6672129 - DNA, 15 bp, Homo sapiens
atgtgtactctaact

SEQ ID NO: 6672130 - DNA, 15 bp, Homo sapiens
atgtgtactggtcag

SEQ ID NO: 6672131 - DNA, 17 bp, Homo sapiens
atgtgtactttattgat

SEQ ID NO: 6672132 - DNA, 20 bp, Homo sapiens
atgtgtagatattatgtata

SEQ ID NO: 6672133 - DNA, 17 bp, Homo sapiens
atgtgtagcctgtgcat

SEQ ID NO: 6672134 - DNA, 17 bp, Homo sapiens
atgtgtagccttctccc

SEQ ID NO: 6672135 - DNA, 21 bp, Homo sapiens
atgtgtagctgcaaaaataat

SEQ ID NO: 6672136 - DNA, 21 bp, Homo sapiens
atgtgtaggatgtatgctgtt

SEQ ID NO: 6672137 - DNA, 17 bp, Homo sapiens
atgtgtaggtgaacagt

SEQ ID NO: 6672138 - DNA, 20 bp, Homo sapiens
atgtgtagttcatgtaaata

SEQ ID NO: 6672139 - DNA, 13 bp, Homo sapiens
atgtgtataaaaa

SEQ ID NO: 6672140 - DNA, 13 bp, Homo sapiens
atgtgtataaaca

SEQ ID NO: 6672141 - DNA, 22 bp, Homo sapiens
atgtgtataaactgctgtcaat

SEQ ID NO: 6672142 - DNA, 13 bp, Homo sapiens
atgtgtataaatt

SEQ ID NO: 6672143 - DNA, 14 bp, Homo sapiens
atgtgtataaattg

SEQ ID NO: 6672144 - DNA, 23 bp, Homo sapiens
atgtgtataattttaaagtaatt

SEQ ID NO: 6672145 - DNA, 16 bp, Homo sapiens
atgtgtatacatacat

SEQ ID NO: 6672146 - DNA, 20 bp, Homo sapiens
atgtgtatacatacatgtat

SEQ ID NO: 6672147 - DNA, 11 bp, Homo sapiens
atgtgtatata

SEQ ID NO: 6672148 - DNA, 15 bp, Homo sapiens
atgtgtatatataca

SEQ ID NO: 6672149 - DNA, 19 bp, Homo sapiens
atgtgtatatatacataca

SEQ ID NO: 6672150 - DNA, 16 bp, Homo sapiens
atgtgtatatatgtca

SEQ ID NO: 6672151 - DNA, 20 bp, Homo sapiens
atgtgtatatattatatata

SEQ ID NO: 6672152 - DNA, 23 bp, Homo sapiens
atgtgtatatgtttatacacaca

SEQ ID NO: 6672153 - DNA, 16 bp, Homo sapiens
atgtgtatattccttt

SEQ ID NO: 6672154 - DNA, 17 bp, Homo sapiens
atgtgtatattcctttt

SEQ ID NO: 6672155 - DNA, 23 bp, Homo sapiens
atgtgtatattccttttaaagaa

SEQ ID NO: 6672156 - DNA, 21 bp, Homo sapiens
atgtgtatcagtgtttatgtg

SEQ ID NO: 6672157 - DNA, 22 bp, Homo sapiens
atgtgtatccatgcattatata

SEQ ID NO: 6672158 - DNA, 18 bp, Homo sapiens
atgtgtatcggatgcttt

SEQ ID NO: 6672159 - DNA, 12 bp, Homo sapiens
atgtgtatggaa

SEQ ID NO: 6672160 - DNA, 19 bp, Homo sapiens
atgtgtatgtgagtattct

SEQ ID NO: 6672161 - DNA, 15 bp, Homo sapiens
atgtgtatgtgttta

SEQ ID NO: 6672162 - DNA, 20 bp, Homo sapiens
atgtgtattcatactgacat

SEQ ID NO: 6672163 - DNA, 18 bp, Homo sapiens
atgtgtatttcttaagaa

SEQ ID NO: 6672164 - DNA, 14 bp, Homo sapiens
atgtgtatttttgt

SEQ ID NO: 6672165 - DNA, 20 bp, Homo sapiens
atgtgtcaaagagatgagga

SEQ ID NO: 6672166 - DNA, 16 bp, Homo sapiens
atgtgtcaaatacaaa

SEQ ID NO: 6672167 - DNA, 14 bp, Homo sapiens
atgtgtcagcatgc

SEQ ID NO: 6672168 - DNA, 23 bp, Homo sapiens
atgtgtcatgaagaatgtttctg

SEQ ID NO: 6672169 - DNA, 23 bp, Homo sapiens
atgtgtcatgatttcaatgattg

SEQ ID NO: 6672170 - DNA, 15 bp, Homo sapiens
atgtgtcatgcatga

SEQ ID NO: 6672171 - DNA, 15 bp, Homo sapiens
atgtgtcatgtaata

SEQ ID NO: 6672172 - DNA, 14 bp, Homo sapiens
atgtgtccaagaca

SEQ ID NO: 6672173 - DNA, 12 bp, Homo sapiens
atgtgtcccaga

SEQ ID NO: 6672174 - DNA, 22 bp, Homo sapiens
atgtgtcccagtgaacagtttg

SEQ ID NO: 6672175 - DNA, 19 bp, Homo sapiens
atgtgtcccccccaggcct

SEQ ID NO: 6672176 - DNA, 17 bp, Homo sapiens
atgtgtcccccctgtgg

SEQ ID NO: 6672177 - DNA, 13 bp, Homo sapiens
atgtgtcccctca

SEQ ID NO: 6672178 - DNA, 20 bp, Homo sapiens
atgtgtcccgaatccacagt

SEQ ID NO: 6672179 - DNA, 17 bp, Homo sapiens
atgtgtcctcagggagc

SEQ ID NO: 6672180 - DNA, 18 bp, Homo sapiens
atgtgtcctcagggagca

SEQ ID NO: 6672181 - DNA, 12 bp, Homo sapiens
atgtgtcctcct

SEQ ID NO: 6672182 - DNA, 16 bp, Homo sapiens
atgtgtcctcctgctc

SEQ ID NO: 6672183 - DNA, 16 bp, Homo sapiens
atgtgtcctttctgaa

SEQ ID NO: 6672184 - DNA, 15 bp, Homo sapiens
atgtgtctcaggaaa

SEQ ID NO: 6672185 - DNA, 16 bp, Homo sapiens
atgtgtctcccagaac

SEQ ID NO: 6672186 - DNA, 23 bp, Homo sapiens
atgtgtctcctgtttcagaccag

SEQ ID NO: 6672187 - DNA, 22 bp, Homo sapiens
atgtgtctctgctttccttttc

SEQ ID NO: 6672188 - DNA, 18 bp, Homo sapiens
atgtgtctgcaacatgga

SEQ ID NO: 6672189 - DNA, 18 bp, Homo sapiens
atgtgtctgctaatgtaa

SEQ ID NO: 6672190 - DNA, 21 bp, Homo sapiens
atgtgtctggaagaagcagcg

SEQ ID NO: 6672191 - DNA, 14 bp, Homo sapiens
atgtgtctggccct

SEQ ID NO: 6672192 - DNA, 16 bp, Homo sapiens
atgtgtctgggagagc

SEQ ID NO: 6672193 - DNA, 21 bp, Homo sapiens
atgtgtctgggagagcctggc

SEQ ID NO: 6672194 - DNA, 22 bp, Homo sapiens
atgtgtctgggagagcctggca

SEQ ID NO: 6672195 - DNA, 15 bp, Homo sapiens
atgtgtctgtattca

SEQ ID NO: 6672196 - DNA, 21 bp, Homo sapiens
atgtgtctgtatttcatgtgg

SEQ ID NO: 6672197 - DNA, 23 bp, Homo sapiens
atgtgtctgtgttgcttcaaatt

SEQ ID NO: 6672198 - DNA, 13 bp, Homo sapiens
atgtgtcttcaat

SEQ ID NO: 6672199 - DNA, 13 bp, Homo sapiens
atgtgtctttaga

SEQ ID NO: 6672200 - DNA, 20 bp, Homo sapiens
atgtgtgaaggtcttgcctg

SEQ ID NO: 6672201 - DNA, 13 bp, Homo sapiens
atgtgtgaagtga

SEQ ID NO: 6672202 - DNA, 18 bp, Homo sapiens
atgtgtgacccttgtcat

SEQ ID NO: 6672203 - DNA, 18 bp, Homo sapiens
atgtgtgactttcaggct

SEQ ID NO: 6672204 - DNA, 23 bp, Homo sapiens
atgtgtgagataacttccttcac

SEQ ID NO: 6672205 - DNA, 19 bp, Homo sapiens
atgtgtgagcatcctgcaa

SEQ ID NO: 6672206 - DNA, 22 bp, Homo sapiens
atgtgtgaggagctgctggctt

SEQ ID NO: 6672207 - DNA, 18 bp, Homo sapiens
atgtgtgagtgtatgtat

SEQ ID NO: 6672208 - DNA, 20 bp, Homo sapiens
atgtgtgagtgtatgtatac

SEQ ID NO: 6672209 - DNA, 17 bp, Homo sapiens
atgtgtgagtgtgtgca

SEQ ID NO: 6672210 - DNA, 14 bp, Homo sapiens
atgtgtgatgctga

SEQ ID NO: 6672211 - DNA, 15 bp, Homo sapiens
atgtgtgcaggagcc

SEQ ID NO: 6672212 - DNA, 23 bp, Homo sapiens
atgtgtgcaggagcctccctgca

SEQ ID NO: 6672213 - DNA, 11 bp, Homo sapiens
atgtgtgcatg

SEQ ID NO: 6672214 - DNA, 17 bp, Homo sapiens
atgtgtgcatgtgtgta

SEQ ID NO: 6672215 - DNA, 12 bp, Homo sapiens
atgtgtgcccag

SEQ ID NO: 6672216 - DNA, 14 bp, Homo sapiens
atgtgtgcccagct

SEQ ID NO: 6672217 - DNA, 15 bp, Homo sapiens
atgtgtgcccagctt

SEQ ID NO: 6672218 - DNA, 15 bp, Homo sapiens
atgtgtgccctggac

SEQ ID NO: 6672219 - DNA, 16 bp, Homo sapiens
atgtgtgccctggact

SEQ ID NO: 6672220 - DNA, 18 bp, Homo sapiens
atgtgtgcctgtggcaga

SEQ ID NO: 6672221 - DNA, 20 bp, Homo sapiens
atgtgtgctcacaatgttct

SEQ ID NO: 6672222 - DNA, 15 bp, Homo sapiens
atgtgtgctcttatc

SEQ ID NO: 6672223 - DNA, 21 bp, Homo sapiens
atgtgtgctcttatccccagc

SEQ ID NO: 6672224 - DNA, 14 bp, Homo sapiens
atgtgtgctgtgct

SEQ ID NO: 6672225 - DNA, 17 bp, Homo sapiens
atgtgtgcttatacaat

SEQ ID NO: 6672226 - DNA, 13 bp, Homo sapiens
atgtgtgctttcc

SEQ ID NO: 6672227 - DNA, 15 bp, Homo sapiens
atgtgtgctttccca

SEQ ID NO: 6672228 - DNA, 15 bp, Homo sapiens
atgtgtggatgtgta

SEQ ID NO: 6672229 - DNA, 19 bp, Homo sapiens
atgtgtggctcattctttt

SEQ ID NO: 6672230 - DNA, 20 bp, Homo sapiens
atgtgtggctcattcttttc

SEQ ID NO: 6672231 - DNA, 14 bp, Homo sapiens
atgtgtgggaaagg

SEQ ID NO: 6672232 - DNA, 18 bp, Homo sapiens
atgtgtgggtgctgataa

SEQ ID NO: 6672233 - DNA, 16 bp, Homo sapiens
atgtgtggtggcctca

SEQ ID NO: 6672234 - DNA, 17 bp, Homo sapiens
atgtgtggtttcagttc

SEQ ID NO: 6672235 - DNA, 21 bp, Homo sapiens
atgtgtggtttcagttctgtg

SEQ ID NO: 6672236 - DNA, 20 bp, Homo sapiens
atgtgtgtagacaaatattt

SEQ ID NO: 6672237 - DNA, 15 bp, Homo sapiens
atgtgtgtagactgt

SEQ ID NO: 6672238 - DNA, 21 bp, Homo sapiens
atgtgtgtagactgtaacttt

SEQ ID NO: 6672239 - DNA, 18 bp, Homo sapiens
atgtgtgtaggttatctt

SEQ ID NO: 6672240 - DNA, 19 bp, Homo sapiens
atgtgtgtaggttatcttt

SEQ ID NO: 6672241 - DNA, 13 bp, Homo sapiens
atgtgtgtataag

SEQ ID NO: 6672242 - DNA, 23 bp, Homo sapiens
atgtgtgtataagtgcacacaga

SEQ ID NO: 6672243 - DNA, 12 bp, Homo sapiens
atgtgtgtatat

SEQ ID NO: 6672244 - DNA, 18 bp, Homo sapiens
atgtgtgtatatgtatgt

SEQ ID NO: 6672245 - DNA, 22 bp, Homo sapiens
atgtgtgtatatgtatgtgtgt

SEQ ID NO: 6672246 - DNA, 13 bp, Homo sapiens
atgtgtgtatgtg

SEQ ID NO: 6672247 - DNA, 22 bp, Homo sapiens
atgtgtgtcagcccatgtcaat

SEQ ID NO: 6672248 - DNA, 16 bp, Homo sapiens
atgtgtgtctattttg

SEQ ID NO: 6672249 - DNA, 20 bp, Homo sapiens
atgtgtgtgatgtgacattt

SEQ ID NO: 6672250 - DNA, 20 bp, Homo sapiens
atgtgtgtgccaagccctgg

SEQ ID NO: 6672251 - DNA, 20 bp, Homo sapiens
atgtgtgtggtgtgtgtgct

SEQ ID NO: 6672252 - DNA, 13 bp, Homo sapiens
atgtgtgtgtatg

SEQ ID NO: 6672253 - DNA, 19 bp, Homo sapiens
atgtgtgtgtatgctacta

SEQ ID NO: 6672254 - DNA, 17 bp, Homo sapiens
atgtgtgtgtctctatc

SEQ ID NO: 6672255 - DNA, 14 bp, Homo sapiens
atgtgtgtgtctgt

SEQ ID NO: 6672256 - DNA, 13 bp, Homo sapiens
atgtgtgtgtgta

SEQ ID NO: 6672257 - DNA, 21 bp, Homo sapiens
atgtgtgtgtgtgtgtgtaat

SEQ ID NO: 6672258 - DNA, 20 bp, Homo sapiens
atgtgtgtgtgtgtgtgtgt

SEQ ID NO: 6672259 - DNA, 22 bp, Homo sapiens
atgtgtgtgtgttgtgtgtggg

SEQ ID NO: 6672260 - DNA, 13 bp, Homo sapiens
atgtgtgttcatg

SEQ ID NO: 6672261 - DNA, 17 bp, Homo sapiens
atgtgtgttcctgcttt

SEQ ID NO: 6672262 - DNA, 23 bp, Homo sapiens
atgtgtgttcctgcttttctaat

SEQ ID NO: 6672263 - DNA, 22 bp, Homo sapiens
atgtgtgttgatactgttgcac

SEQ ID NO: 6672264 - DNA, 20 bp, Homo sapiens
atgtgtgttgtaacaaatat

SEQ ID NO: 6672265 - DNA, 16 bp, Homo sapiens
atgtgtgttgtcagcc

SEQ ID NO: 6672266 - DNA, 22 bp, Homo sapiens
atgtgtgttgtcagcctgtgct

SEQ ID NO: 6672267 - DNA, 15 bp, Homo sapiens
atgtgtgttgtgtga

SEQ ID NO: 6672268 - DNA, 13 bp, Homo sapiens
atgtgtgttgttt

SEQ ID NO: 6672269 - DNA, 17 bp, Homo sapiens
atgtgtgttgtttccat

SEQ ID NO: 6672270 - DNA, 12 bp, Homo sapiens
atgtgtgtttaa

SEQ ID NO: 6672271 - DNA, 15 bp, Homo sapiens
atgtgtgtttaaata

SEQ ID NO: 6672272 - DNA, 16 bp, Homo sapiens
atgtgtgtttaaataa

SEQ ID NO: 6672273 - DNA, 22 bp, Homo sapiens
atgtgttaatcttaatgtatat

SEQ ID NO: 6672274 - DNA, 21 bp, Homo sapiens
atgtgttatagacggtgctca

SEQ ID NO: 6672275 - DNA, 19 bp, Homo sapiens
atgtgttattacttcctca

SEQ ID NO: 6672276 - DNA, 12 bp, Homo sapiens
atgtgttccaaa

SEQ ID NO: 6672277 - DNA, 12 bp, Homo sapiens
atgtgttcctcc

SEQ ID NO: 6672278 - DNA, 20 bp, Homo sapiens
atgtgttcctccattttctt

SEQ ID NO: 6672279 - DNA, 16 bp, Homo sapiens
atgtgttcctcctgct

SEQ ID NO: 6672280 - DNA, 18 bp, Homo sapiens
atgtgttcctcctgctgt

SEQ ID NO: 6672281 - DNA, 23 bp, Homo sapiens
atgtgttcggttttgttgttccc

SEQ ID NO: 6672282 - DNA, 23 bp, Homo sapiens
atgtgttcttctttctctgtatt

SEQ ID NO: 6672283 - DNA, 23 bp, Homo sapiens
atgtgttcttttctcctttacca

SEQ ID NO: 6672284 - DNA, 14 bp, Homo sapiens
atgtgttgaaaaaa

SEQ ID NO: 6672285 - DNA, 16 bp, Homo sapiens
atgtgttgaaaaccaa

SEQ ID NO: 6672286 - DNA, 22 bp, Homo sapiens
atgtgttgaaaaccaaaatgac

SEQ ID NO: 6672287 - DNA, 14 bp, Homo sapiens
atgtgttgaaactg

SEQ ID NO: 6672288 - DNA, 20 bp, Homo sapiens
atgtgttgaccggctgccgt

SEQ ID NO: 6672289 - DNA, 23 bp, Homo sapiens
atgtgttgataattttttaatta

SEQ ID NO: 6672290 - DNA, 16 bp, Homo sapiens
atgtgttgcaaattat

SEQ ID NO: 6672291 - DNA, 20 bp, Homo sapiens
atgtgttgcaaattattcta

SEQ ID NO: 6672292 - DNA, 19 bp, Homo sapiens
atgtgttgcataaacaatc

SEQ ID NO: 6672293 - DNA, 14 bp, Homo sapiens
atgtgttgccaaag

SEQ ID NO: 6672294 - DNA, 22 bp, Homo sapiens
atgtgttggggaagggcctgcc

SEQ ID NO: 6672295 - DNA, 21 bp, Homo sapiens
atgtgtttacatttactgaaa

SEQ ID NO: 6672296 - DNA, 16 bp, Homo sapiens
atgtgtttagaattga

SEQ ID NO: 6672297 - DNA, 20 bp, Homo sapiens
atgtgtttagaattgaaggt

SEQ ID NO: 6672298 - DNA, 17 bp, Homo sapiens
atgtgtttataattgtt

SEQ ID NO: 6672299 - DNA, 21 bp, Homo sapiens
atgtgtttataattgttatac

SEQ ID NO: 6672300 - DNA, 24 bp, Homo sapiens
atgtgtttattcatccagcagtgt

SEQ ID NO: 6672301 - DNA, 21 bp, Homo sapiens
atgtgtttcaggtggaacagg

SEQ ID NO: 6672302 - DNA, 12 bp, Homo sapiens
atgtgtttccat

SEQ ID NO: 6672303 - DNA, 13 bp, Homo sapiens
atgtgtttctgac

SEQ ID NO: 6672304 - DNA, 21 bp, Homo sapiens
atgtgtttctggtatgaaaca

SEQ ID NO: 6672305 - DNA, 22 bp, Homo sapiens
atgtgtttctggtatgaaacaa

SEQ ID NO: 6672306 - DNA, 13 bp, Homo sapiens
atgtgtttctgta

SEQ ID NO: 6672307 - DNA, 15 bp, Homo sapiens
atgtgtttcttgctg

SEQ ID NO: 6672308 - DNA, 14 bp, Homo sapiens
atgtgtttgatttt

SEQ ID NO: 6672309 - DNA, 14 bp, Homo sapiens
atgtgtttgctgcc

SEQ ID NO: 6672310 - DNA, 19 bp, Homo sapiens
atgtgtttggagttaaaat

SEQ ID NO: 6672311 - DNA, 19 bp, Homo sapiens
atgtgtttgggatactgct

SEQ ID NO: 6672312 - DNA, 18 bp, Homo sapiens
atgtgtttggttctgggg

SEQ ID NO: 6672313 - DNA, 12 bp, Homo sapiens
atgtgtttgtgt

SEQ ID NO: 6672314 - DNA, 15 bp, Homo sapiens
atgtgttttcagtct

SEQ ID NO: 6672315 - DNA, 21 bp, Homo sapiens
atgtgttttcatcatttcagc

SEQ ID NO: 6672316 - DNA, 15 bp, Homo sapiens
atgtgttttctgaat

SEQ ID NO: 6672317 - DNA, 23 bp, Homo sapiens
atgtgttttgcacgtcttgctat

SEQ ID NO: 6672318 - DNA, 13 bp, Homo sapiens
atgtgtttttaaa

SEQ ID NO: 6672319 - DNA, 13 bp, Homo sapiens
atgtgtttttctc

SEQ ID NO: 6672320 - DNA, 18 bp, Homo sapiens
atgttaaaaagaaatcca

SEQ ID NO: 6672321 - DNA, 19 bp, Homo sapiens
atgttaaaaagaaatccag

SEQ ID NO: 6672322 - DNA, 15 bp, Homo sapiens
atgttaaaacataaa

SEQ ID NO: 6672323 - DNA, 21 bp, Homo sapiens
atgttaaaacataaacacatt

SEQ ID NO: 6672324 - DNA, 14 bp, Homo sapiens
atgttaaaatgtat

SEQ ID NO: 6672325 - DNA, 15 bp, Homo sapiens
atgttaaaatgtatt

SEQ ID NO: 6672326 - DNA, 16 bp, Homo sapiens
atgttaaagagaatga

SEQ ID NO: 6672327 - DNA, 21 bp, Homo sapiens
atgttaaagaggcgtcttgta

SEQ ID NO: 6672328 - DNA, 18 bp, Homo sapiens
atgttaaagatgtagcaa

SEQ ID NO: 6672329 - DNA, 18 bp, Homo sapiens
atgttaaagcatcagaga

SEQ ID NO: 6672330 - DNA, 19 bp, Homo sapiens
atgttaaagcatcagagat

SEQ ID NO: 6672331 - DNA, 12 bp, Homo sapiens
atgttaaagctt

SEQ ID NO: 6672332 - DNA, 15 bp, Homo sapiens
atgttaaagtttaag

SEQ ID NO: 6672333 - DNA, 14 bp, Homo sapiens
atgttaaataaatt

SEQ ID NO: 6672334 - DNA, 18 bp, Homo sapiens
atgttaaataaattgtat

SEQ ID NO: 6672335 - DNA, 14 bp, Homo sapiens
atgttaaatactgt

SEQ ID NO: 6672336 - DNA, 22 bp, Homo sapiens
atgttaaatactgtgcagaata

SEQ ID NO: 6672337 - DNA, 23 bp, Homo sapiens
atgttaaatactgtgcagaataa

SEQ ID NO: 6672338 - DNA, 18 bp, Homo sapiens
atgttaaatcccattcat

SEQ ID NO: 6672339 - DNA, 11 bp, Homo sapiens
atgttaaatct

SEQ ID NO: 6672340 - DNA, 13 bp, Homo sapiens
atgttaaatctac

SEQ ID NO: 6672341 - DNA, 17 bp, Homo sapiens
atgttaaatgccttggt

SEQ ID NO: 6672342 - DNA, 13 bp, Homo sapiens
atgttaaatgtta

SEQ ID NO: 6672343 - DNA, 14 bp, Homo sapiens
atgttaaatgttat

SEQ ID NO: 6672344 - DNA, 12 bp, Homo sapiens
atgttaaatttg

SEQ ID NO: 6672345 - DNA, 14 bp, Homo sapiens
atgttaaatttgta

SEQ ID NO: 6672346 - DNA, 22 bp, Homo sapiens
atgttaaatttgtaagtttcag

SEQ ID NO: 6672347 - DNA, 23 bp, Homo sapiens
atgttaaatttgtaagtttcagg

SEQ ID NO: 6672348 - DNA, 22 bp, Homo sapiens
atgttaacaacttgaattacaa

SEQ ID NO: 6672349 - DNA, 23 bp, Homo sapiens
atgttaacaatgcctattgtaat

SEQ ID NO: 6672350 - DNA, 12 bp, Homo sapiens
atgttaacacat

SEQ ID NO: 6672351 - DNA, 18 bp, Homo sapiens
atgttaacacattttgta

SEQ ID NO: 6672352 - DNA, 21 bp, Homo sapiens
atgttaacacattttgtataa

SEQ ID NO: 6672353 - DNA, 15 bp, Homo sapiens
atgttaacctaggca

SEQ ID NO: 6672354 - DNA, 17 bp, Homo sapiens
atgttaacctaggcagt

SEQ ID NO: 6672355 - DNA, 19 bp, Homo sapiens
atgttaacctaggcagtgg

SEQ ID NO: 6672356 - DNA, 22 bp, Homo sapiens
atgttaactattattaataaat

SEQ ID NO: 6672357 - DNA, 22 bp, Homo sapiens
atgttaactgagctactagaga

SEQ ID NO: 6672358 - DNA, 20 bp, Homo sapiens
atgttaactttattacaatt

SEQ ID NO: 6672359 - DNA, 21 bp, Homo sapiens
atgttaactttattacaattt

SEQ ID NO: 6672360 - DNA, 13 bp, Homo sapiens
atgttaactttca

SEQ ID NO: 6672361 - DNA, 15 bp, Homo sapiens
atgttaactttcaaa

SEQ ID NO: 6672362 - DNA, 21 bp, Homo sapiens
atgttaactttcaaatccact

SEQ ID NO: 6672363 - DNA, 15 bp, Homo sapiens
atgttaactttgtgg

SEQ ID NO: 6672364 - DNA, 22 bp, Homo sapiens
atgttaagataacttactgtat

SEQ ID NO: 6672365 - DNA, 22 bp, Homo sapiens
atgttaagcaaaggaaaccaaa

SEQ ID NO: 6672366 - DNA, 23 bp, Homo sapiens
atgttaagcagctaaattttctg

SEQ ID NO: 6672367 - DNA, 14 bp, Homo sapiens
atgttaagcattta

SEQ ID NO: 6672368 - DNA, 15 bp, Homo sapiens
atgttaagctcttta

SEQ ID NO: 6672369 - DNA, 17 bp, Homo sapiens
atgttaagctttattgt

SEQ ID NO: 6672370 - DNA, 13 bp, Homo sapiens
atgttaaggaaac

SEQ ID NO: 6672371 - DNA, 18 bp, Homo sapiens
atgttaaggaaactctta

SEQ ID NO: 6672372 - DNA, 23 bp, Homo sapiens
atgttaagtgccattactactgt

SEQ ID NO: 6672373 - DNA, 16 bp, Homo sapiens
atgttaagttacagtt

SEQ ID NO: 6672374 - DNA, 15 bp, Homo sapiens
atgttaagttacttc

SEQ ID NO: 6672375 - DNA, 14 bp, Homo sapiens
atgttaagttatat

SEQ ID NO: 6672376 - DNA, 16 bp, Homo sapiens
atgttaataaactgca

SEQ ID NO: 6672377 - DNA, 15 bp, Homo sapiens
atgttaataaaggtt

SEQ ID NO: 6672378 - DNA, 15 bp, Homo sapiens
atgttaatacatcat

SEQ ID NO: 6672379 - DNA, 19 bp, Homo sapiens
atgttaatagaaaatatat

SEQ ID NO: 6672380 - DNA, 13 bp, Homo sapiens
atgttaatatttc

SEQ ID NO: 6672381 - DNA, 13 bp, Homo sapiens
atgttaatatttt

SEQ ID NO: 6672382 - DNA, 22 bp, Homo sapiens
atgttaatattttaggtgtaaa

SEQ ID NO: 6672383 - DNA, 15 bp, Homo sapiens
atgttaatattttat

SEQ ID NO: 6672384 - DNA, 17 bp, Homo sapiens
atgttaatattttatgt

SEQ ID NO: 6672385 - DNA, 19 bp, Homo sapiens
atgttaatattttatgtgt

SEQ ID NO: 6672386 - DNA, 17 bp, Homo sapiens
atgttaatcagcccctc

SEQ ID NO: 6672387 - DNA, 15 bp, Homo sapiens
atgttaatctcccag

SEQ ID NO: 6672388 - DNA, 16 bp, Homo sapiens
atgttaattaaactga

SEQ ID NO: 6672389 - DNA, 16 bp, Homo sapiens
atgttaattaaagtaa

SEQ ID NO: 6672390 - DNA, 23 bp, Homo sapiens
atgttaattaaagtaaaattatt

SEQ ID NO: 6672391 - DNA, 19 bp, Homo sapiens
atgttaattgatagaataa

SEQ ID NO: 6672392 - DNA, 12 bp, Homo sapiens
atgttaatttat

SEQ ID NO: 6672393 - DNA, 19 bp, Homo sapiens
atgttaattttttggtaca

SEQ ID NO: 6672394 - DNA, 20 bp, Homo sapiens
atgttaattttttggtacaa

SEQ ID NO: 6672395 - DNA, 13 bp, Homo sapiens
atgttacaaaaaa

SEQ ID NO: 6672396 - DNA, 12 bp, Homo sapiens
atgttacaagtt

SEQ ID NO: 6672397 - DNA, 19 bp, Homo sapiens
atgttacaagtttgctaaa

SEQ ID NO: 6672398 - DNA, 21 bp, Homo sapiens
atgttacaagtttgctaaaag

SEQ ID NO: 6672399 - DNA, 23 bp, Homo sapiens
atgttacatagtgtaggctttac

SEQ ID NO: 6672400 - DNA, 15 bp, Homo sapiens
atgttacatctgtct

SEQ ID NO: 6672401 - DNA, 19 bp, Homo sapiens
atgttacattgtcaaagct

SEQ ID NO: 6672402 - DNA, 14 bp, Homo sapiens
atgttacattgttt

SEQ ID NO: 6672403 - DNA, 15 bp, Homo sapiens
atgttaccaaagcaa

SEQ ID NO: 6672404 - DNA, 18 bp, Homo sapiens
atgttaccagacttcaag

SEQ ID NO: 6672405 - DNA, 14 bp, Homo sapiens
atgttacctaatta

SEQ ID NO: 6672406 - DNA, 19 bp, Homo sapiens
atgttacggcatcacactt

SEQ ID NO: 6672407 - DNA, 21 bp, Homo sapiens
atgttacggcatcacacttat

SEQ ID NO: 6672408 - DNA, 21 bp, Homo sapiens
atgttactattttctacaatt

SEQ ID NO: 6672409 - DNA, 14 bp, Homo sapiens
atgttactcagtgt

SEQ ID NO: 6672410 - DNA, 22 bp, Homo sapiens
atgttactcagtgttagagaaa

SEQ ID NO: 6672411 - DNA, 20 bp, Homo sapiens
atgttactccctgttttagt

SEQ ID NO: 6672412 - DNA, 13 bp, Homo sapiens
atgttactgacca

SEQ ID NO: 6672413 - DNA, 17 bp, Homo sapiens
atgttactgactcctca

SEQ ID NO: 6672414 - DNA, 12 bp, Homo sapiens
atgttactgaga

SEQ ID NO: 6672415 - DNA, 13 bp, Homo sapiens
atgttactgagat

SEQ ID NO: 6672416 - DNA, 19 bp, Homo sapiens
atgttactgagatgtttta

SEQ ID NO: 6672417 - DNA, 22 bp, Homo sapiens
atgttactgatcatgcattgtt

SEQ ID NO: 6672418 - DNA, 23 bp, Homo sapiens
atgttactgtctgactacaacat

SEQ ID NO: 6672419 - DNA, 17 bp, Homo sapiens
atgttactgtgtgaaga

SEQ ID NO: 6672420 - DNA, 19 bp, Homo sapiens
atgttacttccccacccct

SEQ ID NO: 6672421 - DNA, 18 bp, Homo sapiens
atgttacttgagaagtgc

SEQ ID NO: 6672422 - DNA, 21 bp, Homo sapiens
atgttacttgagaagtgctta

SEQ ID NO: 6672423 - DNA, 16 bp, Homo sapiens
atgttagaagaagagg

SEQ ID NO: 6672424 - DNA, 19 bp, Homo sapiens
atgttagaattgatttcca

SEQ ID NO: 6672425 - DNA, 19 bp, Homo sapiens
atgttagacttgctccctc

SEQ ID NO: 6672426 - DNA, 18 bp, Homo sapiens
atgttagacttgtgtgca

SEQ ID NO: 6672427 - DNA, 19 bp, Homo sapiens
atgttagacttgtgtgcat

SEQ ID NO: 6672428 - DNA, 22 bp, Homo sapiens
atgttagaggttttaaagtgat

SEQ ID NO: 6672429 - DNA, 14 bp, Homo sapiens
atgttagagtaatg

SEQ ID NO: 6672430 - DNA, 15 bp, Homo sapiens
atgttagagtcattt

SEQ ID NO: 6672431 - DNA, 18 bp, Homo sapiens
atgttagagtcatttctg

SEQ ID NO: 6672432 - DNA, 15 bp, Homo sapiens
atgttagcaaagagt

SEQ ID NO: 6672433 - DNA, 16 bp, Homo sapiens
atgttagcaagatgat

SEQ ID NO: 6672434 - DNA, 18 bp, Homo sapiens
atgttagcagacccagct

SEQ ID NO: 6672435 - DNA, 15 bp, Homo sapiens
atgttaggctgggcc

SEQ ID NO: 6672436 - DNA, 20 bp, Homo sapiens
atgttaggctgggcccagag

SEQ ID NO: 6672437 - DNA, 16 bp, Homo sapiens
atgttagtaactttta

SEQ ID NO: 6672438 - DNA, 21 bp, Homo sapiens
atgttagtaatacctctaata

SEQ ID NO: 6672439 - DNA, 16 bp, Homo sapiens
atgttagtataagctt

SEQ ID NO: 6672440 - DNA, 19 bp, Homo sapiens
atgttagtattttaatcct

SEQ ID NO: 6672441 - DNA, 14 bp, Homo sapiens
atgttagtcaagga

SEQ ID NO: 6672442 - DNA, 22 bp, Homo sapiens
atgttagtcattgttatttata

SEQ ID NO: 6672443 - DNA, 15 bp, Homo sapiens
atgttagtcttaccg

SEQ ID NO: 6672444 - DNA, 13 bp, Homo sapiens
atgttagtggcat

SEQ ID NO: 6672445 - DNA, 18 bp, Homo sapiens
atgttagtggcatatttg

SEQ ID NO: 6672446 - DNA, 22 bp, Homo sapiens
atgttagtgttttaagaaatgt

SEQ ID NO: 6672447 - DNA, 23 bp, Homo sapiens
atgttagttaccttatagttact

SEQ ID NO: 6672448 - DNA, 18 bp, Homo sapiens
atgttagttagtgtagat

SEQ ID NO: 6672449 - DNA, 14 bp, Homo sapiens
atgttataaagtag

SEQ ID NO: 6672450 - DNA, 22 bp, Homo sapiens
atgttatacaaccttcatttaa

SEQ ID NO: 6672451 - DNA, 23 bp, Homo sapiens
atgttatacatcaatatgtatat

SEQ ID NO: 6672452 - DNA, 21 bp, Homo sapiens
atgttatactgaaccaggcca

SEQ ID NO: 6672453 - DNA, 22 bp, Homo sapiens
atgttatactgaaccaggccag

SEQ ID NO: 6672454 - DNA, 19 bp, Homo sapiens
atgttatattgcttcctgt

SEQ ID NO: 6672455 - DNA, 22 bp, Homo sapiens
atgttatatttaatgcattaaa

SEQ ID NO: 6672456 - DNA, 20 bp, Homo sapiens
atgttatatttttcttaaaa

SEQ ID NO: 6672457 - DNA, 13 bp, Homo sapiens
atgttatcagtat

SEQ ID NO: 6672458 - DNA, 17 bp, Homo sapiens
atgttatcggattactg

SEQ ID NO: 6672459 - DNA, 14 bp, Homo sapiens
atgttatcggctct

SEQ ID NO: 6672460 - DNA, 16 bp, Homo sapiens
atgttatcggctctat

SEQ ID NO: 6672461 - DNA, 17 bp, Homo sapiens
atgttatcttaacactg

SEQ ID NO: 6672462 - DNA, 18 bp, Homo sapiens
atgttatcttaacactga

SEQ ID NO: 6672463 - DNA, 15 bp, Homo sapiens
atgttatcttctcaa

SEQ ID NO: 6672464 - DNA, 17 bp, Homo sapiens
atgttatcttctcaagt

SEQ ID NO: 6672465 - DNA, 11 bp, Homo sapiens
atgttatgaaa

SEQ ID NO: 6672466 - DNA, 11 bp, Homo sapiens
atgttatgaac

SEQ ID NO: 6672467 - DNA, 13 bp, Homo sapiens
atgttatgaacag

SEQ ID NO: 6672468 - DNA, 18 bp, Homo sapiens
atgttatgactatgtaaa

SEQ ID NO: 6672469 - DNA, 16 bp, Homo sapiens
atgttatgataaaaaa

SEQ ID NO: 6672470 - DNA, 20 bp, Homo sapiens
atgttatgataaaaaatttt

SEQ ID NO: 6672471 - DNA, 21 bp, Homo sapiens
atgttatgataaaaaattttg

SEQ ID NO: 6672472 - DNA, 17 bp, Homo sapiens
atgttatgatattgttt

SEQ ID NO: 6672473 - DNA, 18 bp, Homo sapiens
atgttatgatattgttta

SEQ ID NO: 6672474 - DNA, 20 bp, Homo sapiens
atgttatgatattgtttaaa

SEQ ID NO: 6672475 - DNA, 22 bp, Homo sapiens
atgttatgatattgtttaaaat

SEQ ID NO: 6672476 - DNA, 19 bp, Homo sapiens
atgttatgatttgtaacat

SEQ ID NO: 6672477 - DNA, 18 bp, Homo sapiens
atgttatgcagtgaacta

SEQ ID NO: 6672478 - DNA, 18 bp, Homo sapiens
atgttatgcataaagtca

SEQ ID NO: 6672479 - DNA, 21 bp, Homo sapiens
atgttatgggatgtaaacaat

SEQ ID NO: 6672480 - DNA, 21 bp, Homo sapiens
atgttatgtaaaaggccaaac

SEQ ID NO: 6672481 - DNA, 20 bp, Homo sapiens
atgttattactgaggaaagg

SEQ ID NO: 6672482 - DNA, 15 bp, Homo sapiens
atgttattactgttt

SEQ ID NO: 6672483 - DNA, 16 bp, Homo sapiens
atgttattggaatttt

SEQ ID NO: 6672484 - DNA, 19 bp, Homo sapiens
atgttattggaattttctt

SEQ ID NO: 6672485 - DNA, 12 bp, Homo sapiens
atgttattgtgt

SEQ ID NO: 6672486 - DNA, 13 bp, Homo sapiens
atgttatttaaca

SEQ ID NO: 6672487 - DNA, 20 bp, Homo sapiens
atgttatttatatattggta

SEQ ID NO: 6672488 - DNA, 16 bp, Homo sapiens
atgttatttatgatgt

SEQ ID NO: 6672489 - DNA, 20 bp, Homo sapiens
atgttatttatgatgttatt

SEQ ID NO: 6672490 - DNA, 17 bp, Homo sapiens
atgttatttctgcaaac

SEQ ID NO: 6672491 - DNA, 18 bp, Homo sapiens
atgttatttctgcaaaca

SEQ ID NO: 6672492 - DNA, 14 bp, Homo sapiens
atgttatttggaat

SEQ ID NO: 6672493 - DNA, 15 bp, Homo sapiens
atgttattttccttc

SEQ ID NO: 6672494 - DNA, 16 bp, Homo sapiens
atgttattttccttct

SEQ ID NO: 6672495 - DNA, 18 bp, Homo sapiens
atgttattttctgttgaa

SEQ ID NO: 6672496 - DNA, 21 bp, Homo sapiens
atgttattttctgttgaagtt

SEQ ID NO: 6672497 - DNA, 21 bp, Homo sapiens
atgttattttgtacgtgttat

SEQ ID NO: 6672498 - DNA, 13 bp, Homo sapiens
atgttatttttgg

SEQ ID NO: 6672499 - DNA, 19 bp, Homo sapiens
atgttattttttaattatt

SEQ ID NO: 6672500 - DNA, 20 bp, Homo sapiens
atgttattttttaattatta

SEQ ID NO: 6672501 - DNA, 14 bp, Homo sapiens
atgttcaaattcac

SEQ ID NO: 6672502 - DNA, 18 bp, Homo sapiens
atgttcaaattcacgttc

SEQ ID NO: 6672503 - DNA, 15 bp, Homo sapiens
atgttcaatctgtgt

SEQ ID NO: 6672504 - DNA, 15 bp, Homo sapiens
atgttcacaaggtac

SEQ ID NO: 6672505 - DNA, 19 bp, Homo sapiens
atgttcacgcaacttgaaa

SEQ ID NO: 6672506 - DNA, 20 bp, Homo sapiens
atgttcagaaatgtaaatgt

SEQ ID NO: 6672507 - DNA, 17 bp, Homo sapiens
atgttcagaagaaattc

SEQ ID NO: 6672508 - DNA, 16 bp, Homo sapiens
atgttcagattattgg

SEQ ID NO: 6672509 - DNA, 17 bp, Homo sapiens
atgttcagtcacatgtg

SEQ ID NO: 6672510 - DNA, 16 bp, Homo sapiens
atgttcagtgtaattt

SEQ ID NO: 6672511 - DNA, 22 bp, Homo sapiens
atgttcagtgtaatttctttgc

SEQ ID NO: 6672512 - DNA, 16 bp, Homo sapiens
atgttcagttttcctt

SEQ ID NO: 6672513 - DNA, 13 bp, Homo sapiens
atgttcatatcta

SEQ ID NO: 6672514 - DNA, 20 bp, Homo sapiens
atgttcatatttattgatta

SEQ ID NO: 6672515 - DNA, 18 bp, Homo sapiens
atgttcatcaatgaatga

SEQ ID NO: 6672516 - DNA, 19 bp, Homo sapiens
atgttcatcccatgatgta

SEQ ID NO: 6672517 - DNA, 22 bp, Homo sapiens
atgttcatcctcattgcctcct

SEQ ID NO: 6672518 - DNA, 20 bp, Homo sapiens
atgttcatgatagtgtgatt

SEQ ID NO: 6672519 - DNA, 21 bp, Homo sapiens
atgttcatgatagtgtgattt

SEQ ID NO: 6672520 - DNA, 12 bp, Homo sapiens
atgttcattata

SEQ ID NO: 6672521 - DNA, 19 bp, Homo sapiens
atgttccaaaccctcctgg

SEQ ID NO: 6672522 - DNA, 16 bp, Homo sapiens
atgttccaaatttaga

SEQ ID NO: 6672523 - DNA, 19 bp, Homo sapiens
atgttccaataaaacttta

SEQ ID NO: 6672524 - DNA, 18 bp, Homo sapiens
atgttccaataaacagga

SEQ ID NO: 6672525 - DNA, 17 bp, Homo sapiens
atgttccacctgccaca

SEQ ID NO: 6672526 - DNA, 14 bp, Homo sapiens
atgttccactaacc

SEQ ID NO: 6672527 - DNA, 22 bp, Homo sapiens
atgttccagatggcccccagct

SEQ ID NO: 6672528 - DNA, 17 bp, Homo sapiens
atgttccagtgaggaac

SEQ ID NO: 6672529 - DNA, 19 bp, Homo sapiens
atgttccattcagtctgca

SEQ ID NO: 6672530 - DNA, 16 bp, Homo sapiens
atgttcccagcagtgg

SEQ ID NO: 6672531 - DNA, 12 bp, Homo sapiens
atgttccccagg

SEQ ID NO: 6672532 - DNA, 18 bp, Homo sapiens
atgttccccgtggctagg

SEQ ID NO: 6672533 - DNA, 19 bp, Homo sapiens
atgttccctgcaccctgga

SEQ ID NO: 6672534 - DNA, 20 bp, Homo sapiens
atgttccgttcatctgagga

SEQ ID NO: 6672535 - DNA, 16 bp, Homo sapiens
atgttcctaacaaaat

SEQ ID NO: 6672536 - DNA, 16 bp, Homo sapiens
atgttcctagtgaaag

SEQ ID NO: 6672537 - DNA, 19 bp, Homo sapiens
atgttcctgaattctattt

SEQ ID NO: 6672538 - DNA, 21 bp, Homo sapiens
atgttcctgggatgtttaatc

SEQ ID NO: 6672539 - DNA, 20 bp, Homo sapiens
atgttccttcaagatcatgt

SEQ ID NO: 6672540 - DNA, 19 bp, Homo sapiens
atgttccttccagattgtg

SEQ ID NO: 6672541 - DNA, 11 bp, Homo sapiens
atgttccttta

SEQ ID NO: 6672542 - DNA, 23 bp, Homo sapiens
atgttcctttatttaggaaacac

SEQ ID NO: 6672543 - DNA, 18 bp, Homo sapiens
atgttccttttaaagaaa

SEQ ID NO: 6672544 - DNA, 15 bp, Homo sapiens
atgttccttttgaaa

SEQ ID NO: 6672545 - DNA, 21 bp, Homo sapiens
atgttcggtttttttcctgtt

SEQ ID NO: 6672546 - DNA, 17 bp, Homo sapiens
atgttctaacctttaca

SEQ ID NO: 6672547 - DNA, 12 bp, Homo sapiens
atgttctaaggc

SEQ ID NO: 6672548 - DNA, 15 bp, Homo sapiens
atgttctaaggctct

SEQ ID NO: 6672549 - DNA, 16 bp, Homo sapiens
atgttctaaggctctg

SEQ ID NO: 6672550 - DNA, 18 bp, Homo sapiens
atgttctaaggctctgag

SEQ ID NO: 6672551 - DNA, 13 bp, Homo sapiens
atgttctaagttt

SEQ ID NO: 6672552 - DNA, 15 bp, Homo sapiens
atgttctaagtttct

SEQ ID NO: 6672553 - DNA, 21 bp, Homo sapiens
atgttctaagtttctaagatt

SEQ ID NO: 6672554 - DNA, 23 bp, Homo sapiens
atgttctaggtcagtctaacagt

SEQ ID NO: 6672555 - DNA, 14 bp, Homo sapiens
atgttctaggtttc

SEQ ID NO: 6672556 - DNA, 21 bp, Homo sapiens
atgttctagtctgctttggta

SEQ ID NO: 6672557 - DNA, 17 bp, Homo sapiens
atgttctatatgcattt

SEQ ID NO: 6672558 - DNA, 20 bp, Homo sapiens
atgttctattttttgttttg

SEQ ID NO: 6672559 - DNA, 14 bp, Homo sapiens
atgttctcagaatc

SEQ ID NO: 6672560 - DNA, 13 bp, Homo sapiens
atgttctccattt

SEQ ID NO: 6672561 - DNA, 13 bp, Homo sapiens
atgttctcctcta

SEQ ID NO: 6672562 - DNA, 18 bp, Homo sapiens
atgttctcgttttgaaac

SEQ ID NO: 6672563 - DNA, 16 bp, Homo sapiens
atgttctctatcattt

SEQ ID NO: 6672564 - DNA, 17 bp, Homo sapiens
atgttctctcttctcca

SEQ ID NO: 6672565 - DNA, 18 bp, Homo sapiens
atgttctgaatttccttt

SEQ ID NO: 6672566 - DNA, 16 bp, Homo sapiens
atgttctgacattaac

SEQ ID NO: 6672567 - DNA, 17 bp, Homo sapiens
atgttctgacattaaca

SEQ ID NO: 6672568 - DNA, 20 bp, Homo sapiens
atgttctgagctataacatt

SEQ ID NO: 6672569 - DNA, 21 bp, Homo sapiens
atgttctgagctataacattt

SEQ ID NO: 6672570 - DNA, 18 bp, Homo sapiens
atgttctgcaagaattaa

SEQ ID NO: 6672571 - DNA, 18 bp, Homo sapiens
atgttctgcccccagccc

SEQ ID NO: 6672572 - DNA, 16 bp, Homo sapiens
atgttctggacctccc

SEQ ID NO: 6672573 - DNA, 13 bp, Homo sapiens
atgttctggccct

SEQ ID NO: 6672574 - DNA, 16 bp, Homo sapiens
atgttctggctttaca

SEQ ID NO: 6672575 - DNA, 14 bp, Homo sapiens
atgttctgggacac

SEQ ID NO: 6672576 - DNA, 20 bp, Homo sapiens
atgttctggtatgcattctt

SEQ ID NO: 6672577 - DNA, 18 bp, Homo sapiens
atgttctgtcttcccaaa

SEQ ID NO: 6672578 - DNA, 13 bp, Homo sapiens
atgttctgtgtca

SEQ ID NO: 6672579 - DNA, 18 bp, Homo sapiens
atgttctgtgtcacgtga

SEQ ID NO: 6672580 - DNA, 13 bp, Homo sapiens
atgttctgttgta

SEQ ID NO: 6672581 - DNA, 13 bp, Homo sapiens
atgttctgtttgc

SEQ ID NO: 6672582 - DNA, 15 bp, Homo sapiens
atgttcttaattctt

SEQ ID NO: 6672583 - DNA, 15 bp, Homo sapiens
atgttcttatagaat

SEQ ID NO: 6672584 - DNA, 17 bp, Homo sapiens
atgttcttatagaataa

SEQ ID NO: 6672585 - DNA, 22 bp, Homo sapiens
atgttcttatagaataaaagct

SEQ ID NO: 6672586 - DNA, 15 bp, Homo sapiens
atgttcttcataagc

SEQ ID NO: 6672587 - DNA, 13 bp, Homo sapiens
atgttcttccagt

SEQ ID NO: 6672588 - DNA, 13 bp, Homo sapiens
atgttcttgaaga

SEQ ID NO: 6672589 - DNA, 22 bp, Homo sapiens
atgttcttgggtggttcctaag

SEQ ID NO: 6672590 - DNA, 17 bp, Homo sapiens
atgttcttggtgtttga

SEQ ID NO: 6672591 - DNA, 23 bp, Homo sapiens
atgttcttggtgtttgactgtaa

SEQ ID NO: 6672592 - DNA, 17 bp, Homo sapiens
atgttcttgtcataaaa

SEQ ID NO: 6672593 - DNA, 21 bp, Homo sapiens
atgttcttgtcataaaatgca

SEQ ID NO: 6672594 - DNA, 20 bp, Homo sapiens
atgttctttatatacaataa

SEQ ID NO: 6672595 - DNA, 12 bp, Homo sapiens
atgttctttctg

SEQ ID NO: 6672596 - DNA, 14 bp, Homo sapiens
atgttctttggaaa

SEQ ID NO: 6672597 - DNA, 15 bp, Homo sapiens
atgttctttgtacct

SEQ ID NO: 6672598 - DNA, 21 bp, Homo sapiens
atgttgaaaaaatttaaaagt

SEQ ID NO: 6672599 - DNA, 16 bp, Homo sapiens
atgttgaaaagtcaaa

SEQ ID NO: 6672600 - DNA, 20 bp, Homo sapiens
atgttgaaactgcttgagca

SEQ ID NO: 6672601 - DNA, 15 bp, Homo sapiens
atgttgaaatatgca

SEQ ID NO: 6672602 - DNA, 16 bp, Homo sapiens
atgttgaaatatgcat

SEQ ID NO: 6672603 - DNA, 19 bp, Homo sapiens
atgttgaaatatgcatact

SEQ ID NO: 6672604 - DNA, 19 bp, Homo sapiens
atgttgaacaaaataaatt

SEQ ID NO: 6672605 - DNA, 18 bp, Homo sapiens
atgttgaagaatacagtt

SEQ ID NO: 6672606 - DNA, 22 bp, Homo sapiens
atgttgaatgcccacaggcaaa

SEQ ID NO: 6672607 - DNA, 13 bp, Homo sapiens
atgttgaatgtat

SEQ ID NO: 6672608 - DNA, 14 bp, Homo sapiens
atgttgaatgtatt

SEQ ID NO: 6672609 - DNA, 14 bp, Homo sapiens
atgttgaatgtttg

SEQ ID NO: 6672610 - DNA, 19 bp, Homo sapiens
atgttgacatcactggcat

SEQ ID NO: 6672611 - DNA, 12 bp, Homo sapiens
atgttgacattt

SEQ ID NO: 6672612 - DNA, 15 bp, Homo sapiens
atgttgacattttct

SEQ ID NO: 6672613 - DNA, 19 bp, Homo sapiens
atgttgaccatgtctatga

SEQ ID NO: 6672614 - DNA, 14 bp, Homo sapiens
atgttgacctttga

SEQ ID NO: 6672615 - DNA, 16 bp, Homo sapiens
atgttgactgtcttga

SEQ ID NO: 6672616 - DNA, 21 bp, Homo sapiens
atgttgactttttaaaattct

SEQ ID NO: 6672617 - DNA, 22 bp, Homo sapiens
atgttgagaatcccaaatttga

SEQ ID NO: 6672618 - DNA, 18 bp, Homo sapiens
atgttgagacctcagctt

SEQ ID NO: 6672619 - DNA, 21 bp, Homo sapiens
atgttgaggggaggaggccag

SEQ ID NO: 6672620 - DNA, 12 bp, Homo sapiens
atgttgataatt

SEQ ID NO: 6672621 - DNA, 15 bp, Homo sapiens
atgttgataatttca

SEQ ID NO: 6672622 - DNA, 16 bp, Homo sapiens
atgttgataatttcag

SEQ ID NO: 6672623 - DNA, 14 bp, Homo sapiens
atgttgatcagcaa

SEQ ID NO: 6672624 - DNA, 24 bp, Homo sapiens
atgttgatccatccagcttgccag

SEQ ID NO: 6672625 - DNA, 16 bp, Homo sapiens
atgttgatctgcatat

SEQ ID NO: 6672626 - DNA, 13 bp, Homo sapiens
atgttgatgaaat

SEQ ID NO: 6672627 - DNA, 16 bp, Homo sapiens
atgttgatgaaattct

SEQ ID NO: 6672628 - DNA, 22 bp, Homo sapiens
atgttgatgcaatccttacaaa

SEQ ID NO: 6672629 - DNA, 18 bp, Homo sapiens
atgttgattacagtgcag

SEQ ID NO: 6672630 - DNA, 12 bp, Homo sapiens
atgttgatttat

SEQ ID NO: 6672631 - DNA, 12 bp, Homo sapiens
atgttgatttct

SEQ ID NO: 6672632 - DNA, 13 bp, Homo sapiens
atgttgatttcta

SEQ ID NO: 6672633 - DNA, 16 bp, Homo sapiens
atgttgatttttactg

SEQ ID NO: 6672634 - DNA, 18 bp, Homo sapiens
atgttgcacatcattcat

SEQ ID NO: 6672635 - DNA, 23 bp, Homo sapiens
atgttgcacatcattcattcact

SEQ ID NO: 6672636 - DNA, 14 bp, Homo sapiens
atgttgcatgaatc

SEQ ID NO: 6672637 - DNA, 14 bp, Homo sapiens
atgttgcatgataa

SEQ ID NO: 6672638 - DNA, 16 bp, Homo sapiens
atgttgccaaaatggt

SEQ ID NO: 6672639 - DNA, 19 bp, Homo sapiens
atgttgccacctgttaaaa

SEQ ID NO: 6672640 - DNA, 22 bp, Homo sapiens
atgttgccatcctaccgtcttt

SEQ ID NO: 6672641 - DNA, 13 bp, Homo sapiens
atgttgcccaggc

SEQ ID NO: 6672642 - DNA, 14 bp, Homo sapiens
atgttgcccaggca

SEQ ID NO: 6672643 - DNA, 20 bp, Homo sapiens
atgttgcccaggcaggtctt

SEQ ID NO: 6672644 - DNA, 12 bp, Homo sapiens
atgttgccttgg

SEQ ID NO: 6672645 - DNA, 20 bp, Homo sapiens
atgttgctagttttttgctt

SEQ ID NO: 6672646 - DNA, 17 bp, Homo sapiens
atgttgctataataaag

SEQ ID NO: 6672647 - DNA, 16 bp, Homo sapiens
atgttgctatagtgac

SEQ ID NO: 6672648 - DNA, 22 bp, Homo sapiens
atgttgctatgtgccttatgtt

SEQ ID NO: 6672649 - DNA, 19 bp, Homo sapiens
atgttgctcagtctccctt

SEQ ID NO: 6672650 - DNA, 20 bp, Homo sapiens
atgttgctcagtctcccttt

SEQ ID NO: 6672651 - DNA, 12 bp, Homo sapiens
atgttgctcttt

SEQ ID NO: 6672652 - DNA, 18 bp, Homo sapiens
atgttgctctttcacctg

SEQ ID NO: 6672653 - DNA, 15 bp, Homo sapiens
atgttgctggactgt

SEQ ID NO: 6672654 - DNA, 17 bp, Homo sapiens
atgttgctgttattata

SEQ ID NO: 6672655 - DNA, 20 bp, Homo sapiens
atgttgctgttcacagcttt

SEQ ID NO: 6672656 - DNA, 19 bp, Homo sapiens
atgttgcttctgaatcact

SEQ ID NO: 6672657 - DNA, 20 bp, Homo sapiens
atgttgcttctgaatcactg

SEQ ID NO: 6672658 - DNA, 23 bp, Homo sapiens
atgttgctttaacctgaaccttg

SEQ ID NO: 6672659 - DNA, 15 bp, Homo sapiens
atgttgcttttgaaa

SEQ ID NO: 6672660 - DNA, 14 bp, Homo sapiens
atgttggaaaacat

SEQ ID NO: 6672661 - DNA, 13 bp, Homo sapiens
atgttggactctg

SEQ ID NO: 6672662 - DNA, 20 bp, Homo sapiens
atgttggactctgagctcat

SEQ ID NO: 6672663 - DNA, 21 bp, Homo sapiens
atgttggagcagcaggcctct

SEQ ID NO: 6672664 - DNA, 19 bp, Homo sapiens
atgttggaggagagagcct

SEQ ID NO: 6672665 - DNA, 20 bp, Homo sapiens
atgttggaggagagagcctt

SEQ ID NO: 6672666 - DNA, 16 bp, Homo sapiens
atgttggataaggaat

SEQ ID NO: 6672667 - DNA, 19 bp, Homo sapiens
atgttggatagtcagctgt

SEQ ID NO: 6672668 - DNA, 21 bp, Homo sapiens
atgttggcattaacaataaag

SEQ ID NO: 6672669 - DNA, 13 bp, Homo sapiens
atgttggccaggc

SEQ ID NO: 6672670 - DNA, 19 bp, Homo sapiens
atgttggcctgtcagagct

SEQ ID NO: 6672671 - DNA, 21 bp, Homo sapiens
atgttggcctgtcagagcttg

SEQ ID NO: 6672672 - DNA, 12 bp, Homo sapiens
atgttggctggg

SEQ ID NO: 6672673 - DNA, 15 bp, Homo sapiens
atgttgggaaagtat

SEQ ID NO: 6672674 - DNA, 21 bp, Homo sapiens
atgttgggaaagtatttactt

SEQ ID NO: 6672675 - DNA, 21 bp, Homo sapiens
atgttgggatttatatctata

SEQ ID NO: 6672676 - DNA, 15 bp, Homo sapiens
atgttgggcatgatt

SEQ ID NO: 6672677 - DNA, 21 bp, Homo sapiens
atgttggggtttcctttacct

SEQ ID NO: 6672678 - DNA, 18 bp, Homo sapiens
atgttggggtttttttaa

SEQ ID NO: 6672679 - DNA, 15 bp, Homo sapiens
atgttggtcaggctg

SEQ ID NO: 6672680 - DNA, 21 bp, Homo sapiens
atgttggtcttggtcatttgc

SEQ ID NO: 6672681 - DNA, 12 bp, Homo sapiens
atgttggtgctg

SEQ ID NO: 6672682 - DNA, 15 bp, Homo sapiens
atgttggttgcactt

SEQ ID NO: 6672683 - DNA, 19 bp, Homo sapiens
atgttggttgcactttgta

SEQ ID NO: 6672684 - DNA, 14 bp, Homo sapiens
atgttggtttactt

SEQ ID NO: 6672685 - DNA, 18 bp, Homo sapiens
atgttgtaaacaggaagc

SEQ ID NO: 6672686 - DNA, 14 bp, Homo sapiens
atgttgtaaataaa

SEQ ID NO: 6672687 - DNA, 23 bp, Homo sapiens
atgttgtaataaaacttatgcta

SEQ ID NO: 6672688 - DNA, 14 bp, Homo sapiens
atgttgtaatattt

SEQ ID NO: 6672689 - DNA, 17 bp, Homo sapiens
atgttgtaatatttctt

SEQ ID NO: 6672690 - DNA, 18 bp, Homo sapiens
atgttgtaatgctgcact

SEQ ID NO: 6672691 - DNA, 16 bp, Homo sapiens
atgttgtaattttact

SEQ ID NO: 6672692 - DNA, 18 bp, Homo sapiens
atgttgtacaatcaaaac

SEQ ID NO: 6672693 - DNA, 18 bp, Homo sapiens
atgttgtagtgtccccca

SEQ ID NO: 6672694 - DNA, 15 bp, Homo sapiens
atgttgtattaactg

SEQ ID NO: 6672695 - DNA, 16 bp, Homo sapiens
atgttgtattaactgg

SEQ ID NO: 6672696 - DNA, 15 bp, Homo sapiens
atgttgtatttgtta

SEQ ID NO: 6672697 - DNA, 13 bp, Homo sapiens
atgttgtcaaaga

SEQ ID NO: 6672698 - DNA, 14 bp, Homo sapiens
atgttgtcaaggat

SEQ ID NO: 6672699 - DNA, 14 bp, Homo sapiens
atgttgtcataaca

SEQ ID NO: 6672700 - DNA, 15 bp, Homo sapiens
atgttgtcataacat

SEQ ID NO: 6672701 - DNA, 17 bp, Homo sapiens
atgttgtcataacattt

SEQ ID NO: 6672702 - DNA, 16 bp, Homo sapiens
atgttgtccaacaata

SEQ ID NO: 6672703 - DNA, 22 bp, Homo sapiens
atgttgtccaattgttgacagt

SEQ ID NO: 6672704 - DNA, 18 bp, Homo sapiens
atgttgtcctgtgtcatc

SEQ ID NO: 6672705 - DNA, 15 bp, Homo sapiens
atgttgtgaataatt

SEQ ID NO: 6672706 - DNA, 21 bp, Homo sapiens
atgttgtgattaacatcatca

SEQ ID NO: 6672707 - DNA, 13 bp, Homo sapiens
atgttgtgtgcat

SEQ ID NO: 6672708 - DNA, 21 bp, Homo sapiens
atgttgtgttggtatttactg

SEQ ID NO: 6672709 - DNA, 21 bp, Homo sapiens
atgttgtgtttctgttcacct

SEQ ID NO: 6672710 - DNA, 19 bp, Homo sapiens
atgttgtgtttggttcaat

SEQ ID NO: 6672711 - DNA, 17 bp, Homo sapiens
atgttgttaaaaacatg

SEQ ID NO: 6672712 - DNA, 15 bp, Homo sapiens
atgttgttaaacacg

SEQ ID NO: 6672713 - DNA, 13 bp, Homo sapiens
atgttgttaaatg

SEQ ID NO: 6672714 - DNA, 17 bp, Homo sapiens
atgttgttatttaaaga

SEQ ID NO: 6672715 - DNA, 19 bp, Homo sapiens
atgttgttcaaatgcattt

SEQ ID NO: 6672716 - DNA, 19 bp, Homo sapiens
atgttgttcaccagtgctt

SEQ ID NO: 6672717 - DNA, 23 bp, Homo sapiens
atgttgttgtctatttgtctctt

SEQ ID NO: 6672718 - DNA, 24 bp, Homo sapiens
atgttgttgtctatttgtctctta

SEQ ID NO: 6672719 - DNA, 16 bp, Homo sapiens
atgttgttgtgtgtat

SEQ ID NO: 6672720 - DNA, 22 bp, Homo sapiens
atgttgttgtgtgtatatgtat

SEQ ID NO: 6672721 - DNA, 16 bp, Homo sapiens
atgttgtttaacataa

SEQ ID NO: 6672722 - DNA, 16 bp, Homo sapiens
atgttgtttataataa

SEQ ID NO: 6672723 - DNA, 18 bp, Homo sapiens
atgttgtttataataaaa

SEQ ID NO: 6672724 - DNA, 18 bp, Homo sapiens
atgttgttttgtacagat

SEQ ID NO: 6672725 - DNA, 19 bp, Homo sapiens
atgttgttttgtacagatg

SEQ ID NO: 6672726 - DNA, 17 bp, Homo sapiens
atgttgttttttcatag

SEQ ID NO: 6672727 - DNA, 20 bp, Homo sapiens
atgtttaaaaagtttctaat

SEQ ID NO: 6672728 - DNA, 24 bp, Homo sapiens
atgtttaaaagcatactctatgtg

SEQ ID NO: 6672729 - DNA, 15 bp, Homo sapiens
atgtttaaaataaaa

SEQ ID NO: 6672730 - DNA, 19 bp, Homo sapiens
atgtttaaaataaaatgaa

SEQ ID NO: 6672731 - DNA, 13 bp, Homo sapiens
atgtttaaaatgg

SEQ ID NO: 6672732 - DNA, 15 bp, Homo sapiens
atgtttaaagagaag

SEQ ID NO: 6672733 - DNA, 14 bp, Homo sapiens
atgtttaaagtaat

SEQ ID NO: 6672734 - DNA, 21 bp, Homo sapiens
atgtttaaagtaattgttcca

SEQ ID NO: 6672735 - DNA, 19 bp, Homo sapiens
atgtttaaatagcctaaat

SEQ ID NO: 6672736 - DNA, 16 bp, Homo sapiens
atgtttaaatcatgta

SEQ ID NO: 6672737 - DNA, 16 bp, Homo sapiens
atgtttaacaaatcta

SEQ ID NO: 6672738 - DNA, 18 bp, Homo sapiens
atgtttaacatcattgca

SEQ ID NO: 6672739 - DNA, 20 bp, Homo sapiens
atgtttaacatcattgcata

SEQ ID NO: 6672740 - DNA, 17 bp, Homo sapiens
atgtttaacttaatcaa

SEQ ID NO: 6672741 - DNA, 19 bp, Homo sapiens
atgtttaacttaatcaatt

SEQ ID NO: 6672742 - DNA, 20 bp, Homo sapiens
atgtttaagaaatgagaaat

SEQ ID NO: 6672743 - DNA, 13 bp, Homo sapiens
atgtttaagattt

SEQ ID NO: 6672744 - DNA, 14 bp, Homo sapiens
atgtttaagcagaa

SEQ ID NO: 6672745 - DNA, 15 bp, Homo sapiens
atgtttaagtgcttg

SEQ ID NO: 6672746 - DNA, 17 bp, Homo sapiens
atgtttaataaagcttt

SEQ ID NO: 6672747 - DNA, 14 bp, Homo sapiens
atgtttaatcatat

SEQ ID NO: 6672748 - DNA, 15 bp, Homo sapiens
atgtttaatcatata

SEQ ID NO: 6672749 - DNA, 14 bp, Homo sapiens
atgtttaatctgtt

SEQ ID NO: 6672750 - DNA, 20 bp, Homo sapiens
atgtttaatgttcattttct

SEQ ID NO: 6672751 - DNA, 14 bp, Homo sapiens
atgtttaattcatt

SEQ ID NO: 6672752 - DNA, 16 bp, Homo sapiens
atgtttaattgtgata

SEQ ID NO: 6672753 - DNA, 16 bp, Homo sapiens
atgtttacaaatggac

SEQ ID NO: 6672754 - DNA, 16 bp, Homo sapiens
atgtttacactctttg

SEQ ID NO: 6672755 - DNA, 22 bp, Homo sapiens
atgtttacactctttgtaagag

SEQ ID NO: 6672756 - DNA, 15 bp, Homo sapiens
atgtttacagaggac

SEQ ID NO: 6672757 - DNA, 19 bp, Homo sapiens
atgtttacagaggacagta

SEQ ID NO: 6672758 - DNA, 20 bp, Homo sapiens
atgtttacctcactggtgca

SEQ ID NO: 6672759 - DNA, 16 bp, Homo sapiens
atgtttacctggtgct

SEQ ID NO: 6672760 - DNA, 19 bp, Homo sapiens
atgtttaccttttaattaa

SEQ ID NO: 6672761 - DNA, 14 bp, Homo sapiens
atgtttactatata

SEQ ID NO: 6672762 - DNA, 23 bp, Homo sapiens
atgtttactcattgcccccacct

SEQ ID NO: 6672763 - DNA, 16 bp, Homo sapiens
atgtttactgtaaatt

SEQ ID NO: 6672764 - DNA, 15 bp, Homo sapiens
atgtttactgtatca

SEQ ID NO: 6672765 - DNA, 17 bp, Homo sapiens
atgtttagactttaaca

SEQ ID NO: 6672766 - DNA, 21 bp, Homo sapiens
atgtttagactttaacataag

SEQ ID NO: 6672767 - DNA, 15 bp, Homo sapiens
atgtttagataaaat

SEQ ID NO: 6672768 - DNA, 18 bp, Homo sapiens
atgtttagataaaattga

SEQ ID NO: 6672769 - DNA, 19 bp, Homo sapiens
atgtttaggggcaaacatc

SEQ ID NO: 6672770 - DNA, 21 bp, Homo sapiens
atgtttaggttactaaaacag

SEQ ID NO: 6672771 - DNA, 21 bp, Homo sapiens
atgtttagtgtgctgctgttc

SEQ ID NO: 6672772 - DNA, 20 bp, Homo sapiens
atgtttagttttacatttta

SEQ ID NO: 6672773 - DNA, 15 bp, Homo sapiens
atgtttataaactga

SEQ ID NO: 6672774 - DNA, 17 bp, Homo sapiens
atgtttatacaataatt

SEQ ID NO: 6672775 - DNA, 16 bp, Homo sapiens
atgtttatacacacag

SEQ ID NO: 6672776 - DNA, 17 bp, Homo sapiens
atgtttatataaatgct

SEQ ID NO: 6672777 - DNA, 12 bp, Homo sapiens
atgtttatatca

SEQ ID NO: 6672778 - DNA, 14 bp, Homo sapiens
atgtttatctgaca

SEQ ID NO: 6672779 - DNA, 14 bp, Homo sapiens
atgtttatctgctt

SEQ ID NO: 6672780 - DNA, 14 bp, Homo sapiens
atgtttatgagcca

SEQ ID NO: 6672781 - DNA, 16 bp, Homo sapiens
atgtttatgagccaga

SEQ ID NO: 6672782 - DNA, 22 bp, Homo sapiens
atgtttatgcaaggaaggaaag

SEQ ID NO: 6672783 - DNA, 23 bp, Homo sapiens
atgtttatggaaatattaagaac

SEQ ID NO: 6672784 - DNA, 19 bp, Homo sapiens
atgtttatgtactgtaaac

SEQ ID NO: 6672785 - DNA, 15 bp, Homo sapiens
atgtttatgttctta

SEQ ID NO: 6672786 - DNA, 20 bp, Homo sapiens
atgtttattaaatgcttcat

SEQ ID NO: 6672787 - DNA, 19 bp, Homo sapiens
atgtttattacagtataat

SEQ ID NO: 6672788 - DNA, 18 bp, Homo sapiens
atgtttattcctgataat

SEQ ID NO: 6672789 - DNA, 17 bp, Homo sapiens
atgtttattccttctgt

SEQ ID NO: 6672790 - DNA, 15 bp, Homo sapiens
atgtttattctaata

SEQ ID NO: 6672791 - DNA, 14 bp, Homo sapiens
atgtttattctagt

SEQ ID NO: 6672792 - DNA, 16 bp, Homo sapiens
atgtttattcttctag

SEQ ID NO: 6672793 - DNA, 17 bp, Homo sapiens
atgtttattcttctaga

SEQ ID NO: 6672794 - DNA, 19 bp, Homo sapiens
atgtttattcttctagagt

SEQ ID NO: 6672795 - DNA, 21 bp, Homo sapiens
atgtttattcttctagagttc

SEQ ID NO: 6672796 - DNA, 21 bp, Homo sapiens
atgtttattgttttttaaaga

SEQ ID NO: 6672797 - DNA, 20 bp, Homo sapiens
atgtttatttagctctgaag

SEQ ID NO: 6672798 - DNA, 13 bp, Homo sapiens
atgtttatttcat

SEQ ID NO: 6672799 - DNA, 23 bp, Homo sapiens
atgtttatttcataaagaattgt

SEQ ID NO: 6672800 - DNA, 17 bp, Homo sapiens
atgtttcaaactttgga

SEQ ID NO: 6672801 - DNA, 16 bp, Homo sapiens
atgtttcaactgtgct

SEQ ID NO: 6672802 - DNA, 21 bp, Homo sapiens
atgtttcaagaggagccccca

SEQ ID NO: 6672803 - DNA, 21 bp, Homo sapiens
atgtttcacataaaacctcat

SEQ ID NO: 6672804 - DNA, 16 bp, Homo sapiens
atgtttcaccaaggaa

SEQ ID NO: 6672805 - DNA, 20 bp, Homo sapiens
atgtttcaccctgtccctct

SEQ ID NO: 6672806 - DNA, 20 bp, Homo sapiens
atgtttcatgaagaaaaaat

SEQ ID NO: 6672807 - DNA, 22 bp, Homo sapiens
atgtttcatgttttgtgactat

SEQ ID NO: 6672808 - DNA, 13 bp, Homo sapiens
atgtttcattatg

SEQ ID NO: 6672809 - DNA, 18 bp, Homo sapiens
atgtttcattattctttc

SEQ ID NO: 6672810 - DNA, 21 bp, Homo sapiens
atgtttcatttacctctaaat

SEQ ID NO: 6672811 - DNA, 17 bp, Homo sapiens
atgtttccagaaaatat

SEQ ID NO: 6672812 - DNA, 12 bp, Homo sapiens
atgtttccagca

SEQ ID NO: 6672813 - DNA, 19 bp, Homo sapiens
atgtttccagcagaagaca

SEQ ID NO: 6672814 - DNA, 18 bp, Homo sapiens
atgtttccagcattccca

SEQ ID NO: 6672815 - DNA, 19 bp, Homo sapiens
atgtttccagcattcccag

SEQ ID NO: 6672816 - DNA, 23 bp, Homo sapiens
atgtttccaggcatgaccctgga

SEQ ID NO: 6672817 - DNA, 15 bp, Homo sapiens
atgtttccatagttt

SEQ ID NO: 6672818 - DNA, 12 bp, Homo sapiens
atgtttccccca

SEQ ID NO: 6672819 - DNA, 16 bp, Homo sapiens
atgtttcccccactcc

SEQ ID NO: 6672820 - DNA, 13 bp, Homo sapiens
atgtttccctctc

SEQ ID NO: 6672821 - DNA, 19 bp, Homo sapiens
atgtttccctctccttcca

SEQ ID NO: 6672822 - DNA, 19 bp, Homo sapiens
atgtttcctaactgtgatt

SEQ ID NO: 6672823 - DNA, 20 bp, Homo sapiens
atgtttcctctagttctttg

SEQ ID NO: 6672824 - DNA, 23 bp, Homo sapiens
atgtttcctgtggaaatatgcaa

SEQ ID NO: 6672825 - DNA, 13 bp, Homo sapiens
atgtttccttaaa

SEQ ID NO: 6672826 - DNA, 22 bp, Homo sapiens
atgtttcgagtaaacttgaaaa

SEQ ID NO: 6672827 - DNA, 17 bp, Homo sapiens
atgtttctacacattgc

SEQ ID NO: 6672828 - DNA, 15 bp, Homo sapiens
atgtttctatttcca

SEQ ID NO: 6672829 - DNA, 18 bp, Homo sapiens
atgtttctatttccataa

SEQ ID NO: 6672830 - DNA, 17 bp, Homo sapiens
atgtttctcacattgct

SEQ ID NO: 6672831 - DNA, 15 bp, Homo sapiens
atgtttctcatttta

SEQ ID NO: 6672832 - DNA, 19 bp, Homo sapiens
atgtttctcattttaaaca

SEQ ID NO: 6672833 - DNA, 21 bp, Homo sapiens
atgtttctgcagtattctgta

SEQ ID NO: 6672834 - DNA, 22 bp, Homo sapiens
atgtttctgcagtattctgtag

SEQ ID NO: 6672835 - DNA, 20 bp, Homo sapiens
atgtttctgggtcctgaaga

SEQ ID NO: 6672836 - DNA, 23 bp, Homo sapiens
atgtttctgtgaaattctcagag

SEQ ID NO: 6672837 - DNA, 15 bp, Homo sapiens
atgtttctgtgtcat

SEQ ID NO: 6672838 - DNA, 14 bp, Homo sapiens
atgtttcttaacta

SEQ ID NO: 6672839 - DNA, 18 bp, Homo sapiens
atgtttcttcatttctct

SEQ ID NO: 6672840 - DNA, 19 bp, Homo sapiens
atgtttcttcatttctctg

SEQ ID NO: 6672841 - DNA, 15 bp, Homo sapiens
atgtttcttctaggt

SEQ ID NO: 6672842 - DNA, 15 bp, Homo sapiens
atgtttcttctccaa

SEQ ID NO: 6672843 - DNA, 22 bp, Homo sapiens
atgtttcttctttcttttaagc

SEQ ID NO: 6672844 - DNA, 18 bp, Homo sapiens
atgtttctttgtaatgaa

SEQ ID NO: 6672845 - DNA, 16 bp, Homo sapiens
atgtttcttttaaaga

SEQ ID NO: 6672846 - DNA, 19 bp, Homo sapiens
atgtttcttttgtatgtaa

SEQ ID NO: 6672847 - DNA, 15 bp, Homo sapiens
atgtttctttttctt

SEQ ID NO: 6672848 - DNA, 13 bp, Homo sapiens
atgtttgaaaata

SEQ ID NO: 6672849 - DNA, 18 bp, Homo sapiens
atgtttgaaaattagaga

SEQ ID NO: 6672850 - DNA, 13 bp, Homo sapiens
atgtttgaacaaa

SEQ ID NO: 6672851 - DNA, 16 bp, Homo sapiens
atgtttgaagttacaa

SEQ ID NO: 6672852 - DNA, 12 bp, Homo sapiens
atgtttgaatga

SEQ ID NO: 6672853 - DNA, 22 bp, Homo sapiens
atgtttgaggagcatgttttgt

SEQ ID NO: 6672854 - DNA, 15 bp, Homo sapiens
atgtttgaggttaaa

SEQ ID NO: 6672855 - DNA, 15 bp, Homo sapiens
atgtttgatagtaaa

SEQ ID NO: 6672856 - DNA, 13 bp, Homo sapiens
atgtttgatttag

SEQ ID NO: 6672857 - DNA, 19 bp, Homo sapiens
atgtttgcaactggtatat

SEQ ID NO: 6672858 - DNA, 22 bp, Homo sapiens
atgtttgcaactggtatatatt

SEQ ID NO: 6672859 - DNA, 19 bp, Homo sapiens
atgtttgcacctttctagt

SEQ ID NO: 6672860 - DNA, 13 bp, Homo sapiens
atgtttgcagggg

SEQ ID NO: 6672861 - DNA, 15 bp, Homo sapiens
atgtttgccatgagt

SEQ ID NO: 6672862 - DNA, 15 bp, Homo sapiens
atgtttgcctctgcc

SEQ ID NO: 6672863 - DNA, 15 bp, Homo sapiens
atgtttgccttctgc

SEQ ID NO: 6672864 - DNA, 15 bp, Homo sapiens
atgtttgctcagagg

SEQ ID NO: 6672865 - DNA, 22 bp, Homo sapiens
atgtttgctcagcttctccaac

SEQ ID NO: 6672866 - DNA, 12 bp, Homo sapiens
atgtttgctgat

SEQ ID NO: 6672867 - DNA, 22 bp, Homo sapiens
atgtttgctgttccacaaagca

SEQ ID NO: 6672868 - DNA, 21 bp, Homo sapiens
atgtttggaaaaaactctgaa

SEQ ID NO: 6672869 - DNA, 20 bp, Homo sapiens
atgtttggaaaccacagtca

SEQ ID NO: 6672870 - DNA, 18 bp, Homo sapiens
atgtttggaaaggttcta

SEQ ID NO: 6672871 - DNA, 17 bp, Homo sapiens
atgtttggattgatatc

SEQ ID NO: 6672872 - DNA, 15 bp, Homo sapiens
atgtttggcaagaaa

SEQ ID NO: 6672873 - DNA, 17 bp, Homo sapiens
atgtttggcatgtaaat

SEQ ID NO: 6672874 - DNA, 22 bp, Homo sapiens
atgtttggcatgtaaatgtaaa

SEQ ID NO: 6672875 - DNA, 13 bp, Homo sapiens
atgtttggctctg

SEQ ID NO: 6672876 - DNA, 16 bp, Homo sapiens
atgtttggctgaaatt

SEQ ID NO: 6672877 - DNA, 23 bp, Homo sapiens
atgtttggctgctagaacatggt

SEQ ID NO: 6672878 - DNA, 17 bp, Homo sapiens
atgtttgggggaaaaaa

SEQ ID NO: 6672879 - DNA, 22 bp, Homo sapiens
atgtttgggggaaaaaaaagaa

SEQ ID NO: 6672880 - DNA, 17 bp, Homo sapiens
atgtttgggtgggttaa

SEQ ID NO: 6672881 - DNA, 17 bp, Homo sapiens
atgtttggtaccaagaa

SEQ ID NO: 6672882 - DNA, 19 bp, Homo sapiens
atgtttggtgcatagaact

SEQ ID NO: 6672883 - DNA, 21 bp, Homo sapiens
atgtttggtgcatagaactgg

SEQ ID NO: 6672884 - DNA, 20 bp, Homo sapiens
atgtttggttgtaaatgctc

SEQ ID NO: 6672885 - DNA, 14 bp, Homo sapiens
atgtttgtaacttt

SEQ ID NO: 6672886 - DNA, 16 bp, Homo sapiens
atgtttgtaagcaatt

SEQ ID NO: 6672887 - DNA, 20 bp, Homo sapiens
atgtttgtaagcaattctaa

SEQ ID NO: 6672888 - DNA, 22 bp, Homo sapiens
atgtttgtaagcaattctaagt

SEQ ID NO: 6672889 - DNA, 14 bp, Homo sapiens
atgtttgtacaaga

SEQ ID NO: 6672890 - DNA, 18 bp, Homo sapiens
atgtttgtacaagattgt

SEQ ID NO: 6672891 - DNA, 21 bp, Homo sapiens
atgtttgtacacaacacctaa

SEQ ID NO: 6672892 - DNA, 19 bp, Homo sapiens
atgtttgtcagtaaatact

SEQ ID NO: 6672893 - DNA, 13 bp, Homo sapiens
atgtttgtcattt

SEQ ID NO: 6672894 - DNA, 22 bp, Homo sapiens
atgtttgtctcacttttcatct

SEQ ID NO: 6672895 - DNA, 19 bp, Homo sapiens
atgtttgtctgtgtgctgt

SEQ ID NO: 6672896 - DNA, 18 bp, Homo sapiens
atgtttgtgatattaaat

SEQ ID NO: 6672897 - DNA, 22 bp, Homo sapiens
atgtttgtgatattaaatttca

SEQ ID NO: 6672898 - DNA, 17 bp, Homo sapiens
atgtttgtgcagtaact

SEQ ID NO: 6672899 - DNA, 12 bp, Homo sapiens
atgtttgtgtct

SEQ ID NO: 6672900 - DNA, 13 bp, Homo sapiens
atgtttgtgtctg

SEQ ID NO: 6672901 - DNA, 20 bp, Homo sapiens
atgtttgttatttacactgg

SEQ ID NO: 6672902 - DNA, 15 bp, Homo sapiens
atgtttgtttcagtg

SEQ ID NO: 6672903 - DNA, 21 bp, Homo sapiens
atgtttgttttcaaaatactt

SEQ ID NO: 6672904 - DNA, 17 bp, Homo sapiens
atgttttaaaaaaattt

SEQ ID NO: 6672905 - DNA, 15 bp, Homo sapiens
atgttttaaagttaa

SEQ ID NO: 6672906 - DNA, 19 bp, Homo sapiens
atgttttaaagttaaaact

SEQ ID NO: 6672907 - DNA, 15 bp, Homo sapiens
atgttttaaggcttc

SEQ ID NO: 6672908 - DNA, 13 bp, Homo sapiens
atgttttaatatc

SEQ ID NO: 6672909 - DNA, 15 bp, Homo sapiens
atgttttaatatcct

SEQ ID NO: 6672910 - DNA, 16 bp, Homo sapiens
atgttttaatatccta

SEQ ID NO: 6672911 - DNA, 12 bp, Homo sapiens
atgttttaccat

SEQ ID NO: 6672912 - DNA, 15 bp, Homo sapiens
atgttttacgtgcaa

SEQ ID NO: 6672913 - DNA, 20 bp, Homo sapiens
atgttttacgtgcaaacaac

SEQ ID NO: 6672914 - DNA, 16 bp, Homo sapiens
atgttttactgtgaaa

SEQ ID NO: 6672915 - DNA, 22 bp, Homo sapiens
atgttttagagataaatattta

SEQ ID NO: 6672916 - DNA, 23 bp, Homo sapiens
atgttttagagataaatatttat

SEQ ID NO: 6672917 - DNA, 19 bp, Homo sapiens
atgttttagagttaacaat

SEQ ID NO: 6672918 - DNA, 14 bp, Homo sapiens
atgttttagcattt

SEQ ID NO: 6672919 - DNA, 17 bp, Homo sapiens
atgttttagtaaaaaag

SEQ ID NO: 6672920 - DNA, 16 bp, Homo sapiens
atgttttataattcat

SEQ ID NO: 6672921 - DNA, 14 bp, Homo sapiens
atgttttataattt

SEQ ID NO: 6672922 - DNA, 14 bp, Homo sapiens
atgttttatatcaa

SEQ ID NO: 6672923 - DNA, 18 bp, Homo sapiens
atgttttatttaaatgct

SEQ ID NO: 6672924 - DNA, 19 bp, Homo sapiens
atgttttatttaaatgctt

SEQ ID NO: 6672925 - DNA, 15 bp, Homo sapiens
atgttttatttcatt

SEQ ID NO: 6672926 - DNA, 23 bp, Homo sapiens
atgttttatttcattggttaatt

SEQ ID NO: 6672927 - DNA, 16 bp, Homo sapiens
atgttttcaaaaggta

SEQ ID NO: 6672928 - DNA, 12 bp, Homo sapiens
atgttttcagct

SEQ ID NO: 6672929 - DNA, 19 bp, Homo sapiens
atgttttcagctaggaaca

SEQ ID NO: 6672930 - DNA, 22 bp, Homo sapiens
atgttttccaatattttaataa

SEQ ID NO: 6672931 - DNA, 16 bp, Homo sapiens
atgttttccacataaa

SEQ ID NO: 6672932 - DNA, 19 bp, Homo sapiens
atgttttccagctcctcat

SEQ ID NO: 6672933 - DNA, 16 bp, Homo sapiens
atgttttccattgttt

SEQ ID NO: 6672934 - DNA, 20 bp, Homo sapiens
atgttttcgaaaatcaaatg

SEQ ID NO: 6672935 - DNA, 18 bp, Homo sapiens
atgttttctgaaaatata

SEQ ID NO: 6672936 - DNA, 16 bp, Homo sapiens
atgttttgaaatgata

SEQ ID NO: 6672937 - DNA, 14 bp, Homo sapiens
atgttttgacattt

SEQ ID NO: 6672938 - DNA, 18 bp, Homo sapiens
atgttttgataaagtagt

SEQ ID NO: 6672939 - DNA, 13 bp, Homo sapiens
atgttttgcaaac

SEQ ID NO: 6672940 - DNA, 13 bp, Homo sapiens
atgttttgcttaa

SEQ ID NO: 6672941 - DNA, 15 bp, Homo sapiens
atgttttggaattca

SEQ ID NO: 6672942 - DNA, 17 bp, Homo sapiens
atgttttggagagagca

SEQ ID NO: 6672943 - DNA, 23 bp, Homo sapiens
atgttttgggaaacactgaaatg

SEQ ID NO: 6672944 - DNA, 19 bp, Homo sapiens
atgttttgggatcaggagc

SEQ ID NO: 6672945 - DNA, 20 bp, Homo sapiens
atgttttgggatcaggagcc

SEQ ID NO: 6672946 - DNA, 22 bp, Homo sapiens
atgttttggtccacttttccag

SEQ ID NO: 6672947 - DNA, 21 bp, Homo sapiens
atgttttggtctgaaaagctg

SEQ ID NO: 6672948 - DNA, 19 bp, Homo sapiens
atgttttgtaaacatttat

SEQ ID NO: 6672949 - DNA, 12 bp, Homo sapiens
atgttttgtaca

SEQ ID NO: 6672950 - DNA, 14 bp, Homo sapiens
atgttttgtacaat

SEQ ID NO: 6672951 - DNA, 17 bp, Homo sapiens
atgttttgtacaattac

SEQ ID NO: 6672952 - DNA, 18 bp, Homo sapiens
atgttttgtataaaatct

SEQ ID NO: 6672953 - DNA, 23 bp, Homo sapiens
atgttttgtataaaatctgaatt

SEQ ID NO: 6672954 - DNA, 20 bp, Homo sapiens
atgttttgtatacaaatata

SEQ ID NO: 6672955 - DNA, 19 bp, Homo sapiens
atgttttgtatatacagtt

SEQ ID NO: 6672956 - DNA, 13 bp, Homo sapiens
atgttttgtcatt

SEQ ID NO: 6672957 - DNA, 20 bp, Homo sapiens
atgttttgtcccatttcctt

SEQ ID NO: 6672958 - DNA, 19 bp, Homo sapiens
atgttttgtgactatatag

SEQ ID NO: 6672959 - DNA, 21 bp, Homo sapiens
atgttttgtgactatatagag

SEQ ID NO: 6672960 - DNA, 13 bp, Homo sapiens
atgttttgttcaa

SEQ ID NO: 6672961 - DNA, 16 bp, Homo sapiens
atgttttgtttctgaa

SEQ ID NO: 6672962 - DNA, 16 bp, Homo sapiens
atgttttgttttgtgt

SEQ ID NO: 6672963 - DNA, 22 bp, Homo sapiens
atgtttttaaaaacctattttg

SEQ ID NO: 6672964 - DNA, 15 bp, Homo sapiens
atgtttttaaaatct

SEQ ID NO: 6672965 - DNA, 16 bp, Homo sapiens
atgtttttaaaatctt

SEQ ID NO: 6672966 - DNA, 17 bp, Homo sapiens
atgtttttaaaatctta

SEQ ID NO: 6672967 - DNA, 16 bp, Homo sapiens
atgtttttaaatatat

SEQ ID NO: 6672968 - DNA, 22 bp, Homo sapiens
atgtttttaaatgcataaaata

SEQ ID NO: 6672969 - DNA, 13 bp, Homo sapiens
atgtttttaacac

SEQ ID NO: 6672970 - DNA, 15 bp, Homo sapiens
atgtttttaacacta

SEQ ID NO: 6672971 - DNA, 13 bp, Homo sapiens
atgtttttaatgt

SEQ ID NO: 6672972 - DNA, 14 bp, Homo sapiens
atgtttttaatgta

SEQ ID NO: 6672973 - DNA, 15 bp, Homo sapiens
atgtttttaatgtat

SEQ ID NO: 6672974 - DNA, 19 bp, Homo sapiens
atgtttttacattatgcaa

SEQ ID NO: 6672975 - DNA, 13 bp, Homo sapiens
atgtttttactga

SEQ ID NO: 6672976 - DNA, 15 bp, Homo sapiens
atgtttttactttat

SEQ ID NO: 6672977 - DNA, 20 bp, Homo sapiens
atgtttttataaaaataaat

SEQ ID NO: 6672978 - DNA, 16 bp, Homo sapiens
atgtttttatttttgt

SEQ ID NO: 6672979 - DNA, 17 bp, Homo sapiens
atgtttttcagttcaaa

SEQ ID NO: 6672980 - DNA, 19 bp, Homo sapiens
atgtttttcagttcaaagt

SEQ ID NO: 6672981 - DNA, 18 bp, Homo sapiens
atgtttttcatactgaat

SEQ ID NO: 6672982 - DNA, 20 bp, Homo sapiens
atgtttttcatccattccta

SEQ ID NO: 6672983 - DNA, 14 bp, Homo sapiens
atgtttttcctttc

SEQ ID NO: 6672984 - DNA, 14 bp, Homo sapiens
atgtttttctaaag

SEQ ID NO: 6672985 - DNA, 22 bp, Homo sapiens
atgtttttctcaaaaagctgct

SEQ ID NO: 6672986 - DNA, 14 bp, Homo sapiens
atgtttttctgtat

SEQ ID NO: 6672987 - DNA, 18 bp, Homo sapiens
atgtttttctgtataaca

SEQ ID NO: 6672988 - DNA, 16 bp, Homo sapiens
atgtttttctgtgtta

SEQ ID NO: 6672989 - DNA, 23 bp, Homo sapiens
atgtttttctttatttttgttaa

SEQ ID NO: 6672990 - DNA, 15 bp, Homo sapiens
atgtttttgaaaaaa

SEQ ID NO: 6672991 - DNA, 12 bp, Homo sapiens
atgtttttgaag

SEQ ID NO: 6672992 - DNA, 14 bp, Homo sapiens
atgtttttgaaggc

SEQ ID NO: 6672993 - DNA, 15 bp, Homo sapiens
atgtttttgaaggca

SEQ ID NO: 6672994 - DNA, 13 bp, Homo sapiens
atgtttttgccaa

SEQ ID NO: 6672995 - DNA, 18 bp, Homo sapiens
atgtttttggttattggt

SEQ ID NO: 6672996 - DNA, 18 bp, Homo sapiens
atgtttttgtactctgca

SEQ ID NO: 6672997 - DNA, 17 bp, Homo sapiens
atgtttttgtgtagagt

SEQ ID NO: 6672998 - DNA, 21 bp, Homo sapiens
atgtttttgttttctttgaat

SEQ ID NO: 6672999 - DNA, 22 bp, Homo sapiens
atgttttttaaaatatttatct

SEQ ID NO: 6673000 - DNA, 22 bp, Homo sapiens
atgttttttagatcaaatactt

SEQ ID NO: 6673001 - DNA, 17 bp, Homo sapiens
atgttttttatacttca

SEQ ID NO: 6673002 - DNA, 15 bp, Homo sapiens
atgttttttatgttc

SEQ ID NO: 6673003 - DNA, 15 bp, Homo sapiens
atgttttttcatgtg

SEQ ID NO: 6673004 - DNA, 14 bp, Homo sapiens
atgttttttctgta

SEQ ID NO: 6673005 - DNA, 15 bp, Homo sapiens
atgttttttctgtaa

SEQ ID NO: 6673006 - DNA, 23 bp, Homo sapiens
atgttttttcttcaaatgtttaa

SEQ ID NO: 6673007 - DNA, 17 bp, Homo sapiens
atgttttttgtaagata

SEQ ID NO: 6673008 - DNA, 20 bp, Homo sapiens
atgttttttgtaagataaac

SEQ ID NO: 6673009 - DNA, 16 bp, Homo sapiens
atgttttttttcagca

SEQ ID NO: 6673010 - DNA, 15 bp, Homo sapiens
atgtttttttttaaa

SEQ ID NO: 6673011 - DNA, 21 bp, Homo sapiens
atgtttttttttttaagacaa

SEQ ID NO: 6673012 - DNA, 19 bp, Homo sapiens
attaaaaaaaaaaaaaaac

SEQ ID NO: 6673013 - DNA, 17 bp, Homo sapiens
attaaaaaaaaaacttc

SEQ ID NO: 6673014 - DNA, 23 bp, Homo sapiens
attaaaaaaaaaagcctgtattt

SEQ ID NO: 6673015 - DNA, 23 bp, Homo sapiens
attaaaaaaaaatactctttcaa

SEQ ID NO: 6673016 - DNA, 17 bp, Homo sapiens
attaaaaaaaaattgta

SEQ ID NO: 6673017 - DNA, 14 bp, Homo sapiens
attaaaaaaaacaa

SEQ ID NO: 6673018 - DNA, 19 bp, Homo sapiens
attaaaaaaaacaaaaaga

SEQ ID NO: 6673019 - DNA, 20 bp, Homo sapiens
attaaaaaaaacaaaaagaa

SEQ ID NO: 6673020 - DNA, 23 bp, Homo sapiens
attaaaaaaaagaagagccttgt

SEQ ID NO: 6673021 - DNA, 14 bp, Homo sapiens
attaaaaaaataat

SEQ ID NO: 6673022 - DNA, 20 bp, Homo sapiens
attaaaaaaatgtggtacat

SEQ ID NO: 6673023 - DNA, 14 bp, Homo sapiens
attaaaaaacaatt

SEQ ID NO: 6673024 - DNA, 19 bp, Homo sapiens
attaaaaaacaattaactg

SEQ ID NO: 6673025 - DNA, 22 bp, Homo sapiens
attaaaaaacttcatgtaattt

SEQ ID NO: 6673026 - DNA, 13 bp, Homo sapiens
attaaaaaagata

SEQ ID NO: 6673027 - DNA, 14 bp, Homo sapiens
attaaaaaagataa

SEQ ID NO: 6673028 - DNA, 17 bp, Homo sapiens
attaaaaaagataaaca

SEQ ID NO: 6673029 - DNA, 18 bp, Homo sapiens
attaaaaaagcatacttc

SEQ ID NO: 6673030 - DNA, 19 bp, Homo sapiens
attaaaaaagcatacttct

SEQ ID NO: 6673031 - DNA, 13 bp, Homo sapiens
attaaaaaagtct

SEQ ID NO: 6673032 - DNA, 13 bp, Homo sapiens
attaaaaacagaa

SEQ ID NO: 6673033 - DNA, 14 bp, Homo sapiens
attaaaaacatgac

SEQ ID NO: 6673034 - DNA, 20 bp, Homo sapiens
attaaaaacatttttttaag

SEQ ID NO: 6673035 - DNA, 13 bp, Homo sapiens
attaaaaaccact

SEQ ID NO: 6673036 - DNA, 20 bp, Homo sapiens
attaaaaaccactgaacatt

SEQ ID NO: 6673037 - DNA, 22 bp, Homo sapiens
attaaaaactagtagttctctt

SEQ ID NO: 6673038 - DNA, 14 bp, Homo sapiens
attaaaaactgagt

SEQ ID NO: 6673039 - DNA, 20 bp, Homo sapiens
attaaaaactgagtgactct

SEQ ID NO: 6673040 - DNA, 18 bp, Homo sapiens
attaaaaactgtgatttt

SEQ ID NO: 6673041 - DNA, 19 bp, Homo sapiens
attaaaaactgtgattttt

SEQ ID NO: 6673042 - DNA, 20 bp, Homo sapiens
attaaaaagaattcttccac

SEQ ID NO: 6673043 - DNA, 14 bp, Homo sapiens
attaaaaagacact

SEQ ID NO: 6673044 - DNA, 18 bp, Homo sapiens
attaaaaagacactttta

SEQ ID NO: 6673045 - DNA, 21 bp, Homo sapiens
attaaaaagatggttgccaag

SEQ ID NO: 6673046 - DNA, 22 bp, Homo sapiens
attaaaaagattctttttctga

SEQ ID NO: 6673047 - DNA, 23 bp, Homo sapiens
attaaaaagggagaaagaaaact

SEQ ID NO: 6673048 - DNA, 12 bp, Homo sapiens
attaaaaagtct

SEQ ID NO: 6673049 - DNA, 23 bp, Homo sapiens
attaaaaagtctgtatggcatga

SEQ ID NO: 6673050 - DNA, 15 bp, Homo sapiens
attaaaaagttaatc

SEQ ID NO: 6673051 - DNA, 17 bp, Homo sapiens
attaaaaagttaatctt

SEQ ID NO: 6673052 - DNA, 20 bp, Homo sapiens
attaaaaagttgttctttgt

SEQ ID NO: 6673053 - DNA, 17 bp, Homo sapiens
attaaaaataccttcta

SEQ ID NO: 6673054 - DNA, 23 bp, Homo sapiens
attaaaaataccttctatgtatt

SEQ ID NO: 6673055 - DNA, 15 bp, Homo sapiens
attaaaaatagatat

SEQ ID NO: 6673056 - DNA, 12 bp, Homo sapiens
attaaaaatata

SEQ ID NO: 6673057 - DNA, 14 bp, Homo sapiens
attaaaaatataaa

SEQ ID NO: 6673058 - DNA, 22 bp, Homo sapiens
attaaaaatatacaatttcttg

SEQ ID NO: 6673059 - DNA, 17 bp, Homo sapiens
attaaaaatatcaaatt

SEQ ID NO: 6673060 - DNA, 19 bp, Homo sapiens
attaaaaatattttttaaa

SEQ ID NO: 6673061 - DNA, 15 bp, Homo sapiens
attaaaaatctcaaa

SEQ ID NO: 6673062 - DNA, 19 bp, Homo sapiens
attaaaaatctcaaatttc

SEQ ID NO: 6673063 - DNA, 22 bp, Homo sapiens
attaaaaatgaaattatttata

SEQ ID NO: 6673064 - DNA, 13 bp, Homo sapiens
attaaaaatggta

SEQ ID NO: 6673065 - DNA, 14 bp, Homo sapiens
attaaaaatggtaa

SEQ ID NO: 6673066 - DNA, 17 bp, Homo sapiens
attaaaaatggtaaaat

SEQ ID NO: 6673067 - DNA, 19 bp, Homo sapiens
attaaaaatggtaaaattg

SEQ ID NO: 6673068 - DNA, 15 bp, Homo sapiens
attaaaaatgttctc

SEQ ID NO: 6673069 - DNA, 20 bp, Homo sapiens
attaaaaatgttctcaaata

SEQ ID NO: 6673070 - DNA, 13 bp, Homo sapiens
attaaaaattacc

SEQ ID NO: 6673071 - DNA, 14 bp, Homo sapiens
attaaaacaaaaca

SEQ ID NO: 6673072 - DNA, 15 bp, Homo sapiens
attaaaacaaaacaa

SEQ ID NO: 6673073 - DNA, 14 bp, Homo sapiens
attaaaacaagaga

SEQ ID NO: 6673074 - DNA, 23 bp, Homo sapiens
attaaaacaagagaccacttcct

SEQ ID NO: 6673075 - DNA, 21 bp, Homo sapiens
attaaaacaatattgtttcta

SEQ ID NO: 6673076 - DNA, 13 bp, Homo sapiens
attaaaacaatgt

SEQ ID NO: 6673077 - DNA, 16 bp, Homo sapiens
attaaaacacaaagtc

SEQ ID NO: 6673078 - DNA, 23 bp, Homo sapiens
attaaaacacaacatctttttct

SEQ ID NO: 6673079 - DNA, 15 bp, Homo sapiens
attaaaacacagctt

SEQ ID NO: 6673080 - DNA, 15 bp, Homo sapiens
attaaaacacattat

SEQ ID NO: 6673081 - DNA, 17 bp, Homo sapiens
attaaaacacattatgt

SEQ ID NO: 6673082 - DNA, 17 bp, Homo sapiens
attaaaacagaagcaaa

SEQ ID NO: 6673083 - DNA, 18 bp, Homo sapiens
attaaaacagaagcaaat

SEQ ID NO: 6673084 - DNA, 18 bp, Homo sapiens
attaaaaccacagaacag

SEQ ID NO: 6673085 - DNA, 18 bp, Homo sapiens
attaaaacgggaatcaca

SEQ ID NO: 6673086 - DNA, 19 bp, Homo sapiens
attaaaactatttagtgtt

SEQ ID NO: 6673087 - DNA, 11 bp, Homo sapiens
attaaaactca

SEQ ID NO: 6673088 - DNA, 13 bp, Homo sapiens
attaaaactcagc

SEQ ID NO: 6673089 - DNA, 14 bp, Homo sapiens
attaaaactgaatt

SEQ ID NO: 6673090 - DNA, 22 bp, Homo sapiens
attaaaactgagtccatgaaaa

SEQ ID NO: 6673091 - DNA, 14 bp, Homo sapiens
attaaaactgcttt

SEQ ID NO: 6673092 - DNA, 20 bp, Homo sapiens
attaaaacttcttaaatatc

SEQ ID NO: 6673093 - DNA, 22 bp, Homo sapiens
attaaaagaaatatacagtttg

SEQ ID NO: 6673094 - DNA, 14 bp, Homo sapiens
attaaaagactcat

SEQ ID NO: 6673095 - DNA, 15 bp, Homo sapiens
attaaaagactcatc

SEQ ID NO: 6673096 - DNA, 16 bp, Homo sapiens
attaaaagattatttg

SEQ ID NO: 6673097 - DNA, 13 bp, Homo sapiens
attaaaagcaggc

SEQ ID NO: 6673098 - DNA, 18 bp, Homo sapiens
attaaaagcccactgtgg

SEQ ID NO: 6673099 - DNA, 13 bp, Homo sapiens
attaaaagcttta

SEQ ID NO: 6673100 - DNA, 17 bp, Homo sapiens
attaaaagctttagatt

SEQ ID NO: 6673101 - DNA, 17 bp, Homo sapiens
attaaaagttgcatttg

SEQ ID NO: 6673102 - DNA, 14 bp, Homo sapiens
attaaaataaaaca

SEQ ID NO: 6673103 - DNA, 16 bp, Homo sapiens
attaaaataaaacaag

SEQ ID NO: 6673104 - DNA, 21 bp, Homo sapiens
attaaaataaaacaagcctta

SEQ ID NO: 6673105 - DNA, 22 bp, Homo sapiens
attaaaataaaacgttatctca

SEQ ID NO: 6673106 - DNA, 19 bp, Homo sapiens
attaaaataaataaatgca

SEQ ID NO: 6673107 - DNA, 22 bp, Homo sapiens
attaaaatactatgcagtatct

SEQ ID NO: 6673108 - DNA, 13 bp, Homo sapiens
attaaaatagcat

SEQ ID NO: 6673109 - DNA, 22 bp, Homo sapiens
attaaaatagcatactgtgtat

SEQ ID NO: 6673110 - DNA, 11 bp, Homo sapiens
attaaaatata

SEQ ID NO: 6673111 - DNA, 13 bp, Homo sapiens
attaaaatataat

SEQ ID NO: 6673112 - DNA, 18 bp, Homo sapiens
attaaaatatagagacag

SEQ ID NO: 6673113 - DNA, 14 bp, Homo sapiens
attaaaatatatat

SEQ ID NO: 6673114 - DNA, 18 bp, Homo sapiens
attaaaatatatataaat

SEQ ID NO: 6673115 - DNA, 20 bp, Homo sapiens
attaaaatatatataaatat

SEQ ID NO: 6673116 - DNA, 21 bp, Homo sapiens
attaaaatatatataaatata

SEQ ID NO: 6673117 - DNA, 21 bp, Homo sapiens
attaaaatatatttaatatgt

SEQ ID NO: 6673118 - DNA, 13 bp, Homo sapiens
attaaaatatgaa

SEQ ID NO: 6673119 - DNA, 22 bp, Homo sapiens
attaaaatatggctataaatat

SEQ ID NO: 6673120 - DNA, 22 bp, Homo sapiens
attaaaatattatttgatatct

SEQ ID NO: 6673121 - DNA, 17 bp, Homo sapiens
attaaaatatttcaggt

SEQ ID NO: 6673122 - DNA, 13 bp, Homo sapiens
attaaaatatttg

SEQ ID NO: 6673123 - DNA, 14 bp, Homo sapiens
attaaaatattttg

SEQ ID NO: 6673124 - DNA, 12 bp, Homo sapiens
attaaaatcaca

SEQ ID NO: 6673125 - DNA, 13 bp, Homo sapiens
attaaaatcacaa

SEQ ID NO: 6673126 - DNA, 14 bp, Homo sapiens
attaaaatcctcaa

SEQ ID NO: 6673127 - DNA, 16 bp, Homo sapiens
attaaaatcctcaatc

SEQ ID NO: 6673128 - DNA, 13 bp, Homo sapiens
attaaaatctctt

SEQ ID NO: 6673129 - DNA, 14 bp, Homo sapiens
attaaaatctcttg

SEQ ID NO: 6673130 - DNA, 23 bp, Homo sapiens
attaaaatctggcaaagttatat

SEQ ID NO: 6673131 - DNA, 15 bp, Homo sapiens
attaaaatcttaaac

SEQ ID NO: 6673132 - DNA, 20 bp, Homo sapiens
attaaaatgacaaacatgat

SEQ ID NO: 6673133 - DNA, 14 bp, Homo sapiens
attaaaatggattt

SEQ ID NO: 6673134 - DNA, 11 bp, Homo sapiens
attaaaatgta

SEQ ID NO: 6673135 - DNA, 17 bp, Homo sapiens
attaaaatgtatgcatg

SEQ ID NO: 6673136 - DNA, 15 bp, Homo sapiens
attaaaatgtgcagt

SEQ ID NO: 6673137 - DNA, 17 bp, Homo sapiens
attaaaatgtttgagca

SEQ ID NO: 6673138 - DNA, 17 bp, Homo sapiens
attaaaattgtgcataa

SEQ ID NO: 6673139 - DNA, 22 bp, Homo sapiens
attaaaattgtgcataatgctt

SEQ ID NO: 6673140 - DNA, 11 bp, Homo sapiens
attaaaattta

SEQ ID NO: 6673141 - DNA, 20 bp, Homo sapiens
attaaaatttatcttaagtt

SEQ ID NO: 6673142 - DNA, 20 bp, Homo sapiens
attaaacaaagtttcagagt

SEQ ID NO: 6673143 - DNA, 11 bp, Homo sapiens
attaaacaatt

SEQ ID NO: 6673144 - DNA, 17 bp, Homo sapiens
attaaacaatttatttt

SEQ ID NO: 6673145 - DNA, 14 bp, Homo sapiens
attaaacaattttg

SEQ ID NO: 6673146 - DNA, 12 bp, Homo sapiens
attaaacacctg

SEQ ID NO: 6673147 - DNA, 15 bp, Homo sapiens
attaaacacctgaca

SEQ ID NO: 6673148 - DNA, 19 bp, Homo sapiens
attaaacacctgacacatc

SEQ ID NO: 6673149 - DNA, 12 bp, Homo sapiens
attaaacagatg

SEQ ID NO: 6673150 - DNA, 14 bp, Homo sapiens
attaaacagatgat

SEQ ID NO: 6673151 - DNA, 21 bp, Homo sapiens
attaaacagatgatgagaatt

SEQ ID NO: 6673152 - DNA, 19 bp, Homo sapiens
attaaacagatgtgaatat

SEQ ID NO: 6673153 - DNA, 19 bp, Homo sapiens
attaaacagcaaagccata

SEQ ID NO: 6673154 - DNA, 19 bp, Homo sapiens
attaaacaggtggttcttt

SEQ ID NO: 6673155 - DNA, 16 bp, Homo sapiens
attaaacatgctgtac

SEQ ID NO: 6673156 - DNA, 12 bp, Homo sapiens
attaaacatttt

SEQ ID NO: 6673157 - DNA, 22 bp, Homo sapiens
attaaaccaatgaagaagacaa

SEQ ID NO: 6673158 - DNA, 14 bp, Homo sapiens
attaaaccaattat

SEQ ID NO: 6673159 - DNA, 15 bp, Homo sapiens
attaaaccaattata

SEQ ID NO: 6673160 - DNA, 15 bp, Homo sapiens
attaaaccacatcat

SEQ ID NO: 6673161 - DNA, 16 bp, Homo sapiens
attaaaccatctccct

SEQ ID NO: 6673162 - DNA, 16 bp, Homo sapiens
attaaacccacaagct

SEQ ID NO: 6673163 - DNA, 14 bp, Homo sapiens
attaaaccctggat

SEQ ID NO: 6673164 - DNA, 22 bp, Homo sapiens
attaaacctgtctccactgtgc

SEQ ID NO: 6673165 - DNA, 11 bp, Homo sapiens
attaaaccttt

SEQ ID NO: 6673166 - DNA, 21 bp, Homo sapiens
attaaacgaggcaatgactgt

SEQ ID NO: 6673167 - DNA, 22 bp, Homo sapiens
attaaacgaggcaatgactgtg

SEQ ID NO: 6673168 - DNA, 14 bp, Homo sapiens
attaaacgattttt

SEQ ID NO: 6673169 - DNA, 21 bp, Homo sapiens
attaaacgatttttaaaatgt

SEQ ID NO: 6673170 - DNA, 21 bp, Homo sapiens
attaaacggattattttttca

SEQ ID NO: 6673171 - DNA, 23 bp, Homo sapiens
attaaacggattattttttcaga

SEQ ID NO: 6673172 - DNA, 18 bp, Homo sapiens
attaaacgtatgcatgtg

SEQ ID NO: 6673173 - DNA, 21 bp, Homo sapiens
attaaacgtatgcatgtgaag

SEQ ID NO: 6673174 - DNA, 16 bp, Homo sapiens
attaaacgtgtaaatt

SEQ ID NO: 6673175 - DNA, 14 bp, Homo sapiens
attaaactaaaata

SEQ ID NO: 6673176 - DNA, 18 bp, Homo sapiens
attaaactaaaatacaag

SEQ ID NO: 6673177 - DNA, 12 bp, Homo sapiens
attaaactcagt

SEQ ID NO: 6673178 - DNA, 15 bp, Homo sapiens
attaaactgaagaag

SEQ ID NO: 6673179 - DNA, 16 bp, Homo sapiens
attaaactgtaaatca

SEQ ID NO: 6673180 - DNA, 17 bp, Homo sapiens
attaaactgtaaatcat

SEQ ID NO: 6673181 - DNA, 16 bp, Homo sapiens
attaaactgtatgtct

SEQ ID NO: 6673182 - DNA, 16 bp, Homo sapiens
attaaacttaatctaa

SEQ ID NO: 6673183 - DNA, 21 bp, Homo sapiens
attaaacttaatctaaatgga

SEQ ID NO: 6673184 - DNA, 12 bp, Homo sapiens
attaaacttatg

SEQ ID NO: 6673185 - DNA, 14 bp, Homo sapiens
attaaacttatgaa

SEQ ID NO: 6673186 - DNA, 14 bp, Homo sapiens
attaaacttcagca

SEQ ID NO: 6673187 - DNA, 15 bp, Homo sapiens
attaaacttcagcaa

SEQ ID NO: 6673188 - DNA, 18 bp, Homo sapiens
attaaacttcttttctct

SEQ ID NO: 6673189 - DNA, 15 bp, Homo sapiens
attaaacttttcatt

SEQ ID NO: 6673190 - DNA, 21 bp, Homo sapiens
attaaagaaaaaaatgtattt

SEQ ID NO: 6673191 - DNA, 21 bp, Homo sapiens
attaaagaaaaaccacagata

SEQ ID NO: 6673192 - DNA, 16 bp, Homo sapiens
attaaagaaaaacttt

SEQ ID NO: 6673193 - DNA, 18 bp, Homo sapiens
attaaagaaaaactttaa

SEQ ID NO: 6673194 - DNA, 19 bp, Homo sapiens
attaaagaaaaactttaaa

SEQ ID NO: 6673195 - DNA, 17 bp, Homo sapiens
attaaagaaaattaatt

SEQ ID NO: 6673196 - DNA, 16 bp, Homo sapiens
attaaagaaaattgcc

SEQ ID NO: 6673197 - DNA, 17 bp, Homo sapiens
attaaagaaaattgcca

SEQ ID NO: 6673198 - DNA, 18 bp, Homo sapiens
attaaagaaaattgccaa

SEQ ID NO: 6673199 - DNA, 19 bp, Homo sapiens
attaaagaaaattgccaaa

SEQ ID NO: 6673200 - DNA, 23 bp, Homo sapiens
attaaagaaaattgccaaaatat

SEQ ID NO: 6673201 - DNA, 15 bp, Homo sapiens
attaaagaaagtcat

SEQ ID NO: 6673202 - DNA, 19 bp, Homo sapiens
attaaagaaatttaatgtt

SEQ ID NO: 6673203 - DNA, 15 bp, Homo sapiens
attaaagaagacctg

SEQ ID NO: 6673204 - DNA, 21 bp, Homo sapiens
attaaagaagacctgagaatg

SEQ ID NO: 6673205 - DNA, 12 bp, Homo sapiens
attaaagaatat

SEQ ID NO: 6673206 - DNA, 18 bp, Homo sapiens
attaaagaatttaaaaaa

SEQ ID NO: 6673207 - DNA, 18 bp, Homo sapiens
attaaagacatttaaaat

SEQ ID NO: 6673208 - DNA, 23 bp, Homo sapiens
attaaagagattgtgcgttcaaa

SEQ ID NO: 6673209 - DNA, 17 bp, Homo sapiens
attaaagataagacttc

SEQ ID NO: 6673210 - DNA, 22 bp, Homo sapiens
attaaagatatttctttaaatt

SEQ ID NO: 6673211 - DNA, 13 bp, Homo sapiens
attaaagatgcag

SEQ ID NO: 6673212 - DNA, 14 bp, Homo sapiens
attaaagatgcagg

SEQ ID NO: 6673213 - DNA, 15 bp, Homo sapiens
attaaagatgcaggt

SEQ ID NO: 6673214 - DNA, 15 bp, Homo sapiens
attaaagatgccata

SEQ ID NO: 6673215 - DNA, 18 bp, Homo sapiens
attaaagatgccatagca

SEQ ID NO: 6673216 - DNA, 13 bp, Homo sapiens
attaaagatgtgt

SEQ ID NO: 6673217 - DNA, 15 bp, Homo sapiens
attaaagattgcttt

SEQ ID NO: 6673218 - DNA, 17 bp, Homo sapiens
attaaagattggaatgt

SEQ ID NO: 6673219 - DNA, 21 bp, Homo sapiens
attaaagatttcttttcatta

SEQ ID NO: 6673220 - DNA, 17 bp, Homo sapiens
attaaagcaacatttta

SEQ ID NO: 6673221 - DNA, 11 bp, Homo sapiens
attaaagccat

SEQ ID NO: 6673222 - DNA, 17 bp, Homo sapiens
attaaagccatgtttat

SEQ ID NO: 6673223 - DNA, 22 bp, Homo sapiens
attaaagccgccgttttcatga

SEQ ID NO: 6673224 - DNA, 17 bp, Homo sapiens
attaaagcgcaaatgaa

SEQ ID NO: 6673225 - DNA, 17 bp, Homo sapiens
attaaagctaaagtatc

SEQ ID NO: 6673226 - DNA, 17 bp, Homo sapiens
attaaagctcttcattt

SEQ ID NO: 6673227 - DNA, 20 bp, Homo sapiens
attaaagctcttcatttctg

SEQ ID NO: 6673228 - DNA, 18 bp, Homo sapiens
attaaagcttaaactgaa

SEQ ID NO: 6673229 - DNA, 22 bp, Homo sapiens
attaaagcttatttttctgtga

SEQ ID NO: 6673230 - DNA, 12 bp, Homo sapiens
attaaaggaaaa

SEQ ID NO: 6673231 - DNA, 18 bp, Homo sapiens
attaaaggaagcactctg

SEQ ID NO: 6673232 - DNA, 18 bp, Homo sapiens
attaaaggaattaaacta

SEQ ID NO: 6673233 - DNA, 17 bp, Homo sapiens
attaaaggcagcatttg

SEQ ID NO: 6673234 - DNA, 21 bp, Homo sapiens
attaaaggcagcatttgatga

SEQ ID NO: 6673235 - DNA, 19 bp, Homo sapiens
attaaaggcataaatgact

SEQ ID NO: 6673236 - DNA, 16 bp, Homo sapiens
attaaaggcttctctc

SEQ ID NO: 6673237 - DNA, 19 bp, Homo sapiens
attaaaggcttctctctca

SEQ ID NO: 6673238 - DNA, 13 bp, Homo sapiens
attaaagggcaga

SEQ ID NO: 6673239 - DNA, 17 bp, Homo sapiens
attaaaggtcctgccct

SEQ ID NO: 6673240 - DNA, 13 bp, Homo sapiens
attaaagtatgca

SEQ ID NO: 6673241 - DNA, 18 bp, Homo sapiens
attaaagtatgcaaaata

SEQ ID NO: 6673242 - DNA, 13 bp, Homo sapiens
attaaagtcagaa

SEQ ID NO: 6673243 - DNA, 16 bp, Homo sapiens
attaaagtctacactg

SEQ ID NO: 6673244 - DNA, 20 bp, Homo sapiens
attaaagtctacactgcctt

SEQ ID NO: 6673245 - DNA, 17 bp, Homo sapiens
attaaagtctattcaaa

SEQ ID NO: 6673246 - DNA, 16 bp, Homo sapiens
attaaagtctgaatca

SEQ ID NO: 6673247 - DNA, 18 bp, Homo sapiens
attaaagtgatactgaaa

SEQ ID NO: 6673248 - DNA, 17 bp, Homo sapiens
attaaagtgcactgtgt

SEQ ID NO: 6673249 - DNA, 18 bp, Homo sapiens
attaaagtgcactgtgtc

SEQ ID NO: 6673250 - DNA, 18 bp, Homo sapiens
attaaagtgctaaggttc

SEQ ID NO: 6673251 - DNA, 21 bp, Homo sapiens
attaaagtgctaaggttctaa

SEQ ID NO: 6673252 - DNA, 23 bp, Homo sapiens
attaaagtgctaaggttctaagg

SEQ ID NO: 6673253 - DNA, 14 bp, Homo sapiens
attaaagtgctgtt

SEQ ID NO: 6673254 - DNA, 19 bp, Homo sapiens
attaaagtgtccattgaca

SEQ ID NO: 6673255 - DNA, 21 bp, Homo sapiens
attaaagttctgtaaaatata

SEQ ID NO: 6673256 - DNA, 20 bp, Homo sapiens
attaaagtttcaaaaatctg

SEQ ID NO: 6673257 - DNA, 15 bp, Homo sapiens
attaaagttttcaaa

SEQ ID NO: 6673258 - DNA, 19 bp, Homo sapiens
attaaataaaatcaatttt

SEQ ID NO: 6673259 - DNA, 13 bp, Homo sapiens
attaaataaaatg

SEQ ID NO: 6673260 - DNA, 21 bp, Homo sapiens
attaaataaaatttttatgta

SEQ ID NO: 6673261 - DNA, 16 bp, Homo sapiens
attaaataaactgttt

SEQ ID NO: 6673262 - DNA, 17 bp, Homo sapiens
attaaataaactgtttt

SEQ ID NO: 6673263 - DNA, 15 bp, Homo sapiens
attaaataaatcttt

SEQ ID NO: 6673264 - DNA, 21 bp, Homo sapiens
attaaataaatgaataaatcc

SEQ ID NO: 6673265 - DNA, 15 bp, Homo sapiens
attaaataaattacc

SEQ ID NO: 6673266 - DNA, 13 bp, Homo sapiens
attaaataaattt

SEQ ID NO: 6673267 - DNA, 14 bp, Homo sapiens
attaaataaatttt

SEQ ID NO: 6673268 - DNA, 21 bp, Homo sapiens
attaaataacagtgtgtgacc

SEQ ID NO: 6673269 - DNA, 14 bp, Homo sapiens
attaaataacatgt

SEQ ID NO: 6673270 - DNA, 17 bp, Homo sapiens
attaaataagattctaa

SEQ ID NO: 6673271 - DNA, 19 bp, Homo sapiens
attaaataagattctaacg

SEQ ID NO: 6673272 - DNA, 14 bp, Homo sapiens
attaaataatacaa

SEQ ID NO: 6673273 - DNA, 16 bp, Homo sapiens
attaaataattttaca

SEQ ID NO: 6673274 - DNA, 12 bp, Homo sapiens
attaaatacata

SEQ ID NO: 6673275 - DNA, 13 bp, Homo sapiens
attaaatacatat

SEQ ID NO: 6673276 - DNA, 23 bp, Homo sapiens
attaaatacatatggatgttact

SEQ ID NO: 6673277 - DNA, 17 bp, Homo sapiens
attaaatagggaaaaaa

SEQ ID NO: 6673278 - DNA, 21 bp, Homo sapiens
attaaatataaaatacataaa

SEQ ID NO: 6673279 - DNA, 22 bp, Homo sapiens
attaaatatagattagaaaaat

SEQ ID NO: 6673280 - DNA, 17 bp, Homo sapiens
attaaatatatctagaa

SEQ ID NO: 6673281 - DNA, 21 bp, Homo sapiens
attaaatatatctttgtaaat

SEQ ID NO: 6673282 - DNA, 14 bp, Homo sapiens
attaaatatatttt

SEQ ID NO: 6673283 - DNA, 20 bp, Homo sapiens
attaaatatgttagcaaaga

SEQ ID NO: 6673284 - DNA, 17 bp, Homo sapiens
attaaatatttaacata

SEQ ID NO: 6673285 - DNA, 16 bp, Homo sapiens
attaaatatttcttaa

SEQ ID NO: 6673286 - DNA, 17 bp, Homo sapiens
attaaatcagttttgtg

SEQ ID NO: 6673287 - DNA, 19 bp, Homo sapiens
attaaatcagttttgtgta

SEQ ID NO: 6673288 - DNA, 17 bp, Homo sapiens
attaaatccaactttca

SEQ ID NO: 6673289 - DNA, 17 bp, Homo sapiens
attaaatcccaaatcct

SEQ ID NO: 6673290 - DNA, 23 bp, Homo sapiens
attaaatcccaaatcctatttaa

SEQ ID NO: 6673291 - DNA, 15 bp, Homo sapiens
attaaatcgtttaat

SEQ ID NO: 6673292 - DNA, 16 bp, Homo sapiens
attaaatcgtttaatg

SEQ ID NO: 6673293 - DNA, 19 bp, Homo sapiens
attaaatcgtttaatgttt

SEQ ID NO: 6673294 - DNA, 16 bp, Homo sapiens
attaaatctagacatt

SEQ ID NO: 6673295 - DNA, 18 bp, Homo sapiens
attaaatctatgaagtat

SEQ ID NO: 6673296 - DNA, 17 bp, Homo sapiens
attaaatctctttaaga

SEQ ID NO: 6673297 - DNA, 13 bp, Homo sapiens
attaaatctgaca

SEQ ID NO: 6673298 - DNA, 11 bp, Homo sapiens
attaaatctgt

SEQ ID NO: 6673299 - DNA, 15 bp, Homo sapiens
attaaatcttaaaca

SEQ ID NO: 6673300 - DNA, 19 bp, Homo sapiens
attaaatcttaaacaatgt

SEQ ID NO: 6673301 - DNA, 23 bp, Homo sapiens
attaaatcttaaacaatgtataa

SEQ ID NO: 6673302 - DNA, 23 bp, Homo sapiens
attaaatgaaatacttgacaaca

SEQ ID NO: 6673303 - DNA, 18 bp, Homo sapiens
attaaatgaacttatgta

SEQ ID NO: 6673304 - DNA, 15 bp, Homo sapiens
attaaatgccttgta

SEQ ID NO: 6673305 - DNA, 19 bp, Homo sapiens
attaaatggcacctgtata

SEQ ID NO: 6673306 - DNA, 21 bp, Homo sapiens
attaaatggtgatttcttgct

SEQ ID NO: 6673307 - DNA, 21 bp, Homo sapiens
attaaatgtagcttcagtcat

SEQ ID NO: 6673308 - DNA, 22 bp, Homo sapiens
attaaatgtagcttcagtcatt

SEQ ID NO: 6673309 - DNA, 14 bp, Homo sapiens
attaaatgtcttat

SEQ ID NO: 6673310 - DNA, 10 bp, Homo sapiens
attaaatgtg

SEQ ID NO: 6673311 - DNA, 16 bp, Homo sapiens
attaaatgtggaagga

SEQ ID NO: 6673312 - DNA, 22 bp, Homo sapiens
attaaatgttgcacatcattca

SEQ ID NO: 6673313 - DNA, 13 bp, Homo sapiens
attaaattaagac

SEQ ID NO: 6673314 - DNA, 13 bp, Homo sapiens
attaaattacagc

SEQ ID NO: 6673315 - DNA, 16 bp, Homo sapiens
attaaattacagcttt

SEQ ID NO: 6673316 - DNA, 18 bp, Homo sapiens
attaaattacatttgtaa

SEQ ID NO: 6673317 - DNA, 16 bp, Homo sapiens
attaaattagctattt

SEQ ID NO: 6673318 - DNA, 13 bp, Homo sapiens
attaaattaggaa

SEQ ID NO: 6673319 - DNA, 15 bp, Homo sapiens
attaaattatcattg

SEQ ID NO: 6673320 - DNA, 19 bp, Homo sapiens
attaaattatcattgtttg

SEQ ID NO: 6673321 - DNA, 16 bp, Homo sapiens
attaaattcacaaact

SEQ ID NO: 6673322 - DNA, 20 bp, Homo sapiens
attaaattctcaaagtttta

SEQ ID NO: 6673323 - DNA, 14 bp, Homo sapiens
attaaattctgagc

SEQ ID NO: 6673324 - DNA, 14 bp, Homo sapiens
attaaattcttgca

SEQ ID NO: 6673325 - DNA, 18 bp, Homo sapiens
attaaattcttgcaaagt

SEQ ID NO: 6673326 - DNA, 23 bp, Homo sapiens
attaaattgcctttgtaatatga

SEQ ID NO: 6673327 - DNA, 13 bp, Homo sapiens
attaaatttaact

SEQ ID NO: 6673328 - DNA, 17 bp, Homo sapiens
attaaatttaatatact

SEQ ID NO: 6673329 - DNA, 18 bp, Homo sapiens
attaaatttattaaatgt

SEQ ID NO: 6673330 - DNA, 20 bp, Homo sapiens
attaaatttcaaatgcagaa

SEQ ID NO: 6673331 - DNA, 21 bp, Homo sapiens
attaaatttgttgacaaaatt

SEQ ID NO: 6673332 - DNA, 18 bp, Homo sapiens
attaaattttagtacatt

SEQ ID NO: 6673333 - DNA, 15 bp, Homo sapiens
attaaattttagtca

SEQ ID NO: 6673334 - DNA, 18 bp, Homo sapiens
attaaatttttaaaatct

SEQ ID NO: 6673335 - DNA, 19 bp, Homo sapiens
attaaatttttaaaatctg

SEQ ID NO: 6673336 - DNA, 20 bp, Homo sapiens
attaaatttttaaaatctgc

SEQ ID NO: 6673337 - DNA, 14 bp, Homo sapiens
attaaatttttcct

SEQ ID NO: 6673338 - DNA, 16 bp, Homo sapiens
attaaatttttcctta

SEQ ID NO: 6673339 - DNA, 17 bp, Homo sapiens
attaaattttttgttga

SEQ ID NO: 6673340 - DNA, 18 bp, Homo sapiens
attaaattttttgttgac

SEQ ID NO: 6673341 - DNA, 15 bp, Homo sapiens
attaaatttttttgt

SEQ ID NO: 6673342 - DNA, 16 bp, Homo sapiens
attaaatttttttgta

SEQ ID NO: 6673343 - DNA, 18 bp, Homo sapiens
attaaattttttttacat

SEQ ID NO: 6673344 - DNA, 12 bp, Homo sapiens
attaacaaaagt

SEQ ID NO: 6673345 - DNA, 18 bp, Homo sapiens
attaacaaaatgtatgtc

SEQ ID NO: 6673346 - DNA, 19 bp, Homo sapiens
attaacaaagtaaaattaa

SEQ ID NO: 6673347 - DNA, 20 bp, Homo sapiens
attaacaaattatgttacat

SEQ ID NO: 6673348 - DNA, 16 bp, Homo sapiens
attaacaaattcagtg

SEQ ID NO: 6673349 - DNA, 13 bp, Homo sapiens
attaacaaattgc

SEQ ID NO: 6673350 - DNA, 14 bp, Homo sapiens
attaacaaattgca

SEQ ID NO: 6673351 - DNA, 18 bp, Homo sapiens
attaacaaattgcatttg

SEQ ID NO: 6673352 - DNA, 18 bp, Homo sapiens
attaacaaatttctttgt

SEQ ID NO: 6673353 - DNA, 17 bp, Homo sapiens
attaacaactgtgaata

SEQ ID NO: 6673354 - DNA, 14 bp, Homo sapiens
attaacaagaactc

SEQ ID NO: 6673355 - DNA, 18 bp, Homo sapiens
attaacaagaactcatta

SEQ ID NO: 6673356 - DNA, 18 bp, Homo sapiens
attaacaatgtattttaa

SEQ ID NO: 6673357 - DNA, 18 bp, Homo sapiens
attaacacagtgtttcaa

SEQ ID NO: 6673358 - DNA, 19 bp, Homo sapiens
attaacacagtgtttcaat

SEQ ID NO: 6673359 - DNA, 22 bp, Homo sapiens
attaacacccaaaagaattaaa

SEQ ID NO: 6673360 - DNA, 16 bp, Homo sapiens
attaacacgctgcctg

SEQ ID NO: 6673361 - DNA, 22 bp, Homo sapiens
attaacactaattatcacgtct

SEQ ID NO: 6673362 - DNA, 14 bp, Homo sapiens
attaacactcattt

SEQ ID NO: 6673363 - DNA, 15 bp, Homo sapiens
attaacatatgtcac

SEQ ID NO: 6673364 - DNA, 17 bp, Homo sapiens
attaacatattatttca

SEQ ID NO: 6673365 - DNA, 18 bp, Homo sapiens
attaacatattatttcat

SEQ ID NO: 6673366 - DNA, 19 bp, Homo sapiens
attaacatcaaacacggct

SEQ ID NO: 6673367 - DNA, 14 bp, Homo sapiens
attaacatgatgta

SEQ ID NO: 6673368 - DNA, 14 bp, Homo sapiens
attaacatgcaata

SEQ ID NO: 6673369 - DNA, 21 bp, Homo sapiens
attaacatgcttatgacaatg

SEQ ID NO: 6673370 - DNA, 19 bp, Homo sapiens
attaacatgttaaaccatg

SEQ ID NO: 6673371 - DNA, 22 bp, Homo sapiens
attaacattgggaaatcttata

SEQ ID NO: 6673372 - DNA, 12 bp, Homo sapiens
attaacattttt

SEQ ID NO: 6673373 - DNA, 15 bp, Homo sapiens
attaaccatagatgt

SEQ ID NO: 6673374 - DNA, 16 bp, Homo sapiens
attaaccattgctaat

SEQ ID NO: 6673375 - DNA, 15 bp, Homo sapiens
attaaccgatgcttt

SEQ ID NO: 6673376 - DNA, 16 bp, Homo sapiens
attaaccgatgcttta

SEQ ID NO: 6673377 - DNA, 14 bp, Homo sapiens
attaacctacctgt

SEQ ID NO: 6673378 - DNA, 13 bp, Homo sapiens
attaacctctcac

SEQ ID NO: 6673379 - DNA, 23 bp, Homo sapiens
attaacctgcatgcagcaacacc

SEQ ID NO: 6673380 - DNA, 16 bp, Homo sapiens
attaacctggtgctgg

SEQ ID NO: 6673381 - DNA, 19 bp, Homo sapiens
attaaccttgccttagaaa

SEQ ID NO: 6673382 - DNA, 20 bp, Homo sapiens
attaaccttgccttagaaac

SEQ ID NO: 6673383 - DNA, 15 bp, Homo sapiens
attaaccttttcaaa

SEQ ID NO: 6673384 - DNA, 18 bp, Homo sapiens
attaaccttttttgtctt

SEQ ID NO: 6673385 - DNA, 21 bp, Homo sapiens
attaaccttttttgtcttatt

SEQ ID NO: 6673386 - DNA, 17 bp, Homo sapiens
attaacgggcatgtatt

SEQ ID NO: 6673387 - DNA, 17 bp, Homo sapiens
attaactaaagaagagg

SEQ ID NO: 6673388 - DNA, 21 bp, Homo sapiens
attaactaaggaaatatttca

SEQ ID NO: 6673389 - DNA, 15 bp, Homo sapiens
attaactacagaaaa

SEQ ID NO: 6673390 - DNA, 20 bp, Homo sapiens
attaactacagaaaagacaa

SEQ ID NO: 6673391 - DNA, 17 bp, Homo sapiens
attaactacatttatga

SEQ ID NO: 6673392 - DNA, 17 bp, Homo sapiens
attaactactgaataat

SEQ ID NO: 6673393 - DNA, 20 bp, Homo sapiens
attaactaggtatgaagtat

SEQ ID NO: 6673394 - DNA, 22 bp, Homo sapiens
attaactatcttctttggactt

SEQ ID NO: 6673395 - DNA, 22 bp, Homo sapiens
attaactcactatggtttttca

SEQ ID NO: 6673396 - DNA, 14 bp, Homo sapiens
attaactccctcca

SEQ ID NO: 6673397 - DNA, 17 bp, Homo sapiens
attaactccctccacca

SEQ ID NO: 6673398 - DNA, 13 bp, Homo sapiens
attaactctgcat

SEQ ID NO: 6673399 - DNA, 20 bp, Homo sapiens
attaactctgcatagacaaa

SEQ ID NO: 6673400 - DNA, 21 bp, Homo sapiens
attaactctgcatagacaaag

SEQ ID NO: 6673401 - DNA, 23 bp, Homo sapiens
attaactctgcatagacaaaggc

SEQ ID NO: 6673402 - DNA, 23 bp, Homo sapiens
attaactctggacctctcttgtg

SEQ ID NO: 6673403 - DNA, 21 bp, Homo sapiens
attaactctgtaaaagtgtct

SEQ ID NO: 6673404 - DNA, 15 bp, Homo sapiens
attaactgaagcaaa

SEQ ID NO: 6673405 - DNA, 22 bp, Homo sapiens
attaactgacgaagaagcaact

SEQ ID NO: 6673406 - DNA, 17 bp, Homo sapiens
attaactgccaaaacaa

SEQ ID NO: 6673407 - DNA, 18 bp, Homo sapiens
attaactgggtacccaaa

SEQ ID NO: 6673408 - DNA, 22 bp, Homo sapiens
attaactgggtacccaaaacac

SEQ ID NO: 6673409 - DNA, 19 bp, Homo sapiens
attaactgtgaaatgtacg

SEQ ID NO: 6673410 - DNA, 13 bp, Homo sapiens
attaactgttgca

SEQ ID NO: 6673411 - DNA, 21 bp, Homo sapiens
attaactgttgcacttttgaa

SEQ ID NO: 6673412 - DNA, 14 bp, Homo sapiens
attaacttaactga

SEQ ID NO: 6673413 - DNA, 18 bp, Homo sapiens
attaacttacggatttat

SEQ ID NO: 6673414 - DNA, 15 bp, Homo sapiens
attaacttagcatgt

SEQ ID NO: 6673415 - DNA, 13 bp, Homo sapiens
attaacttagttt

SEQ ID NO: 6673416 - DNA, 17 bp, Homo sapiens
attaacttagtttttaa

SEQ ID NO: 6673417 - DNA, 17 bp, Homo sapiens
attaacttatttagaga

SEQ ID NO: 6673418 - DNA, 18 bp, Homo sapiens
attaacttatttagagat

SEQ ID NO: 6673419 - DNA, 18 bp, Homo sapiens
attaacttctctggaaag

SEQ ID NO: 6673420 - DNA, 21 bp, Homo sapiens
attaacttgtattttcttaat

SEQ ID NO: 6673421 - DNA, 19 bp, Homo sapiens
attaactttcaaaagcaaa

SEQ ID NO: 6673422 - DNA, 15 bp, Homo sapiens
attaacttttaatgg

SEQ ID NO: 6673423 - DNA, 17 bp, Homo sapiens
attaacttttataaact

SEQ ID NO: 6673424 - DNA, 18 bp, Homo sapiens
attaagaaaaacaataaa

SEQ ID NO: 6673425 - DNA, 17 bp, Homo sapiens
attaagaaaatattcta

SEQ ID NO: 6673426 - DNA, 16 bp, Homo sapiens
attaagaaaatcatat

SEQ ID NO: 6673427 - DNA, 21 bp, Homo sapiens
attaagaaaccccctcatgga

SEQ ID NO: 6673428 - DNA, 21 bp, Homo sapiens
attaagaaaccttgctctcct

SEQ ID NO: 6673429 - DNA, 13 bp, Homo sapiens
attaagaaagact

SEQ ID NO: 6673430 - DNA, 17 bp, Homo sapiens
attaagaaagattaaat

SEQ ID NO: 6673431 - DNA, 11 bp, Homo sapiens
attaagaaata

SEQ ID NO: 6673432 - DNA, 20 bp, Homo sapiens
attaagaacactaaaaagtc

SEQ ID NO: 6673433 - DNA, 14 bp, Homo sapiens
attaagaacatttt

SEQ ID NO: 6673434 - DNA, 13 bp, Homo sapiens
attaagaactgaa

SEQ ID NO: 6673435 - DNA, 14 bp, Homo sapiens
attaagaactgctg

SEQ ID NO: 6673436 - DNA, 14 bp, Homo sapiens
attaagaagaaaat

SEQ ID NO: 6673437 - DNA, 14 bp, Homo sapiens
attaagaagaaact

SEQ ID NO: 6673438 - DNA, 15 bp, Homo sapiens
attaagaaggcaaaa

SEQ ID NO: 6673439 - DNA, 22 bp, Homo sapiens
attaagaagtacaataagcaga

SEQ ID NO: 6673440 - DNA, 12 bp, Homo sapiens
attaagaatctc

SEQ ID NO: 6673441 - DNA, 13 bp, Homo sapiens
attaagaatctta

SEQ ID NO: 6673442 - DNA, 20 bp, Homo sapiens
attaagaatcttagataact

SEQ ID NO: 6673443 - DNA, 16 bp, Homo sapiens
attaagaatgaaatac

SEQ ID NO: 6673444 - DNA, 20 bp, Homo sapiens
attaagaatgaaatactgtt

SEQ ID NO: 6673445 - DNA, 21 bp, Homo sapiens
attaagaatgaaatactgttt

SEQ ID NO: 6673446 - DNA, 15 bp, Homo sapiens
attaagaatgatctg

SEQ ID NO: 6673447 - DNA, 23 bp, Homo sapiens
attaagaatgatctgattgaccg

SEQ ID NO: 6673448 - DNA, 18 bp, Homo sapiens
attaagaatgttctcaat

SEQ ID NO: 6673449 - DNA, 13 bp, Homo sapiens
attaagaatgttg

SEQ ID NO: 6673450 - DNA, 21 bp, Homo sapiens
attaagacaatagcacttaaa

SEQ ID NO: 6673451 - DNA, 13 bp, Homo sapiens
attaagaccaaag

SEQ ID NO: 6673452 - DNA, 19 bp, Homo sapiens
attaagactttaaaagatg

SEQ ID NO: 6673453 - DNA, 23 bp, Homo sapiens
attaagagaacaaagagtgaaat

SEQ ID NO: 6673454 - DNA, 19 bp, Homo sapiens
attaagagatacattccct

SEQ ID NO: 6673455 - DNA, 14 bp, Homo sapiens
attaagagctattt

SEQ ID NO: 6673456 - DNA, 16 bp, Homo sapiens
attaagatacaaatta

SEQ ID NO: 6673457 - DNA, 17 bp, Homo sapiens
attaagatacaaattaa

SEQ ID NO: 6673458 - DNA, 18 bp, Homo sapiens
attaagatacactcctgc

SEQ ID NO: 6673459 - DNA, 21 bp, Homo sapiens
attaagatatgggacattttt

SEQ ID NO: 6673460 - DNA, 13 bp, Homo sapiens
attaagatcctaa

SEQ ID NO: 6673461 - DNA, 20 bp, Homo sapiens
attaagatcctaaactctct

SEQ ID NO: 6673462 - DNA, 21 bp, Homo sapiens
attaagatcctaaactctcta

SEQ ID NO: 6673463 - DNA, 16 bp, Homo sapiens
attaagatctcagtgg

SEQ ID NO: 6673464 - DNA, 15 bp, Homo sapiens
attaagattataatt

SEQ ID NO: 6673465 - DNA, 20 bp, Homo sapiens
attaagattctctgcccagc

SEQ ID NO: 6673466 - DNA, 14 bp, Homo sapiens
attaagcaaatgtt

SEQ ID NO: 6673467 - DNA, 20 bp, Homo sapiens
attaagcaaccttaaagcaa

SEQ ID NO: 6673468 - DNA, 13 bp, Homo sapiens
attaagcacacac

SEQ ID NO: 6673469 - DNA, 24 bp, Homo sapiens
attaagcacacacatctggccctg

SEQ ID NO: 6673470 - DNA, 13 bp, Homo sapiens
attaagcacacta

SEQ ID NO: 6673471 - DNA, 14 bp, Homo sapiens
attaagcatatatt

SEQ ID NO: 6673472 - DNA, 14 bp, Homo sapiens
attaagcatcagaa

SEQ ID NO: 6673473 - DNA, 22 bp, Homo sapiens
attaagcatgacagaaaatatg

SEQ ID NO: 6673474 - DNA, 16 bp, Homo sapiens
attaagccaaacatga

SEQ ID NO: 6673475 - DNA, 20 bp, Homo sapiens
attaagccaggaaacatgaa

SEQ ID NO: 6673476 - DNA, 23 bp, Homo sapiens
attaagccaggaaacatgaagca

SEQ ID NO: 6673477 - DNA, 17 bp, Homo sapiens
attaagccctcttccat

SEQ ID NO: 6673478 - DNA, 16 bp, Homo sapiens
attaagcctacaacat

SEQ ID NO: 6673479 - DNA, 13 bp, Homo sapiens
attaagctaaaag

SEQ ID NO: 6673480 - DNA, 18 bp, Homo sapiens
attaagctaatggtcctg

SEQ ID NO: 6673481 - DNA, 22 bp, Homo sapiens
attaagctctcatagctcataa

SEQ ID NO: 6673482 - DNA, 20 bp, Homo sapiens
attaagcttttgtctgtagg

SEQ ID NO: 6673483 - DNA, 14 bp, Homo sapiens
attaaggacattta

SEQ ID NO: 6673484 - DNA, 17 bp, Homo sapiens
attaaggactacagaat

SEQ ID NO: 6673485 - DNA, 14 bp, Homo sapiens
attaaggatcatag

SEQ ID NO: 6673486 - DNA, 22 bp, Homo sapiens
attaaggatcatagtcgggcat

SEQ ID NO: 6673487 - DNA, 14 bp, Homo sapiens
attaaggatgtagc

SEQ ID NO: 6673488 - DNA, 21 bp, Homo sapiens
attaaggatgtagcttttcac

SEQ ID NO: 6673489 - DNA, 15 bp, Homo sapiens
attaaggattttatg

SEQ ID NO: 6673490 - DNA, 19 bp, Homo sapiens
attaaggcgtgagccactg

SEQ ID NO: 6673491 - DNA, 19 bp, Homo sapiens
attaagggccagaaaaaag

SEQ ID NO: 6673492 - DNA, 20 bp, Homo sapiens
attaaggggatcagaagtag

SEQ ID NO: 6673493 - DNA, 16 bp, Homo sapiens
attaaggtacatcatt

SEQ ID NO: 6673494 - DNA, 20 bp, Homo sapiens
attaaggtatttcgaaactg

SEQ ID NO: 6673495 - DNA, 23 bp, Homo sapiens
attaaggtatttcgaaactgcca

SEQ ID NO: 6673496 - DNA, 15 bp, Homo sapiens
attaaggtgatgtga

SEQ ID NO: 6673497 - DNA, 16 bp, Homo sapiens
attaaggtgatgtgat

SEQ ID NO: 6673498 - DNA, 17 bp, Homo sapiens
attaaggtgatgtgatt

SEQ ID NO: 6673499 - DNA, 17 bp, Homo sapiens
attaaggtgtttgaaaa

SEQ ID NO: 6673500 - DNA, 18 bp, Homo sapiens
attaaggtttgccctgcc

SEQ ID NO: 6673501 - DNA, 22 bp, Homo sapiens
attaaggtttgccctgcctgca

SEQ ID NO: 6673502 - DNA, 12 bp, Homo sapiens
attaaggttttc

SEQ ID NO: 6673503 - DNA, 16 bp, Homo sapiens
attaagtaaaaaatat

SEQ ID NO: 6673504 - DNA, 15 bp, Homo sapiens
attaagtaaactaat

SEQ ID NO: 6673505 - DNA, 14 bp, Homo sapiens
attaagtaaatgct

SEQ ID NO: 6673506 - DNA, 15 bp, Homo sapiens
attaagtaacttatt

SEQ ID NO: 6673507 - DNA, 19 bp, Homo sapiens
attaagtaagtctcaaggt

SEQ ID NO: 6673508 - DNA, 14 bp, Homo sapiens
attaagtaatcttt

SEQ ID NO: 6673509 - DNA, 16 bp, Homo sapiens
attaagtactatgtat

SEQ ID NO: 6673510 - DNA, 18 bp, Homo sapiens
attaagtactatgtatca

SEQ ID NO: 6673511 - DNA, 19 bp, Homo sapiens
attaagtactatgtatcaa

SEQ ID NO: 6673512 - DNA, 14 bp, Homo sapiens
attaagtagaacaa

SEQ ID NO: 6673513 - DNA, 18 bp, Homo sapiens
attaagtagaacaaaaaa

SEQ ID NO: 6673514 - DNA, 21 bp, Homo sapiens
attaagtagaacaaaaaaccc

SEQ ID NO: 6673515 - DNA, 14 bp, Homo sapiens
attaagtatatata

SEQ ID NO: 6673516 - DNA, 18 bp, Homo sapiens
attaagtatatttgtaaa

SEQ ID NO: 6673517 - DNA, 24 bp, Homo sapiens
attaagtatatttgtaaaagctaa

SEQ ID NO: 6673518 - DNA, 20 bp, Homo sapiens
attaagtatctgggattatt

SEQ ID NO: 6673519 - DNA, 22 bp, Homo sapiens
attaagtcagtggctttgcata

SEQ ID NO: 6673520 - DNA, 20 bp, Homo sapiens
attaagtcatcatctccaaa

SEQ ID NO: 6673521 - DNA, 19 bp, Homo sapiens
attaagtcattttgtaata

SEQ ID NO: 6673522 - DNA, 15 bp, Homo sapiens
attaagtccaaatct

SEQ ID NO: 6673523 - DNA, 21 bp, Homo sapiens
attaagtcctacttttaaaga

SEQ ID NO: 6673524 - DNA, 14 bp, Homo sapiens
attaagtgaaattt

SEQ ID NO: 6673525 - DNA, 17 bp, Homo sapiens
attaagtgactgaccat

SEQ ID NO: 6673526 - DNA, 23 bp, Homo sapiens
attaagtggggtagactgaggga

SEQ ID NO: 6673527 - DNA, 22 bp, Homo sapiens
attaagtggtagtaatttcctt

SEQ ID NO: 6673528 - DNA, 16 bp, Homo sapiens
attaagtgtgtataaa

SEQ ID NO: 6673529 - DNA, 22 bp, Homo sapiens
attaagtgtgtgtatactgtaa

SEQ ID NO: 6673530 - DNA, 23 bp, Homo sapiens
attaagtgtgtgtatactgtaat

SEQ ID NO: 6673531 - DNA, 21 bp, Homo sapiens
attaagtgttgaaaaatatct

SEQ ID NO: 6673532 - DNA, 17 bp, Homo sapiens
attaagtgttgtacaat

SEQ ID NO: 6673533 - DNA, 16 bp, Homo sapiens
attaagttattaacat

SEQ ID NO: 6673534 - DNA, 19 bp, Homo sapiens
attaagttcctatcttttg

SEQ ID NO: 6673535 - DNA, 17 bp, Homo sapiens
attaagttcgaggtggc

SEQ ID NO: 6673536 - DNA, 20 bp, Homo sapiens
attaagttctcaatgtgaaa

SEQ ID NO: 6673537 - DNA, 13 bp, Homo sapiens
attaagttcttta

SEQ ID NO: 6673538 - DNA, 19 bp, Homo sapiens
attaagttgtaaaatgtca

SEQ ID NO: 6673539 - DNA, 20 bp, Homo sapiens
attaagttgttaataaaagt

SEQ ID NO: 6673540 - DNA, 14 bp, Homo sapiens
attaagttgttgaa

SEQ ID NO: 6673541 - DNA, 22 bp, Homo sapiens
attaagttgttgaaagtaagtt

SEQ ID NO: 6673542 - DNA, 13 bp, Homo sapiens
attaagtttgaaa

SEQ ID NO: 6673543 - DNA, 16 bp, Homo sapiens
attaagttttaaataa

SEQ ID NO: 6673544 - DNA, 16 bp, Homo sapiens
attaataaaaaatgga

SEQ ID NO: 6673545 - DNA, 22 bp, Homo sapiens
attaataaaaaatggaaagaat

SEQ ID NO: 6673546 - DNA, 13 bp, Homo sapiens
attaataaaaaga

SEQ ID NO: 6673547 - DNA, 12 bp, Homo sapiens
attaataaaact

SEQ ID NO: 6673548 - DNA, 23 bp, Homo sapiens
attaataaaacttatctgagtca

SEQ ID NO: 6673549 - DNA, 21 bp, Homo sapiens
attaataaaactttatgtact

SEQ ID NO: 6673550 - DNA, 13 bp, Homo sapiens
attaataaaatat

SEQ ID NO: 6673551 - DNA, 22 bp, Homo sapiens
attaataaaatatctatttgaa

SEQ ID NO: 6673552 - DNA, 12 bp, Homo sapiens
attaataaagac

SEQ ID NO: 6673553 - DNA, 14 bp, Homo sapiens
attaataaagcatt

SEQ ID NO: 6673554 - DNA, 17 bp, Homo sapiens
attaataaagttgcttt

SEQ ID NO: 6673555 - DNA, 13 bp, Homo sapiens
attaataaatttt

SEQ ID NO: 6673556 - DNA, 14 bp, Homo sapiens
attaataacagaaa

SEQ ID NO: 6673557 - DNA, 22 bp, Homo sapiens
attaataacctgccagtcccag

SEQ ID NO: 6673558 - DNA, 14 bp, Homo sapiens
attaataactgaat

SEQ ID NO: 6673559 - DNA, 20 bp, Homo sapiens
attaataactgaataaaaaa

SEQ ID NO: 6673560 - DNA, 20 bp, Homo sapiens
attaataagatttttcaaaa

SEQ ID NO: 6673561 - DNA, 15 bp, Homo sapiens
attaataataaattc

SEQ ID NO: 6673562 - DNA, 12 bp, Homo sapiens
attaataatagc

SEQ ID NO: 6673563 - DNA, 13 bp, Homo sapiens
attaataatattt

SEQ ID NO: 6673564 - DNA, 16 bp, Homo sapiens
attaataatatttatg

SEQ ID NO: 6673565 - DNA, 20 bp, Homo sapiens
attaatacaatgatgctatt

SEQ ID NO: 6673566 - DNA, 13 bp, Homo sapiens
attaatacagagt

SEQ ID NO: 6673567 - DNA, 17 bp, Homo sapiens
attaatacataagttaa

SEQ ID NO: 6673568 - DNA, 15 bp, Homo sapiens
attaatacattctat

SEQ ID NO: 6673569 - DNA, 17 bp, Homo sapiens
attaataccaaatattt

SEQ ID NO: 6673570 - DNA, 16 bp, Homo sapiens
attaatactaaaatat

SEQ ID NO: 6673571 - DNA, 22 bp, Homo sapiens
attaatacttacggttttaaat

SEQ ID NO: 6673572 - DNA, 16 bp, Homo sapiens
attaatacttcatttg

SEQ ID NO: 6673573 - DNA, 18 bp, Homo sapiens
attaatagaacacagagt

SEQ ID NO: 6673574 - DNA, 13 bp, Homo sapiens
attaatagagttg

SEQ ID NO: 6673575 - DNA, 17 bp, Homo sapiens
attaatagcagcctttc

SEQ ID NO: 6673576 - DNA, 18 bp, Homo sapiens
attaatagcattcgaaga

SEQ ID NO: 6673577 - DNA, 19 bp, Homo sapiens
attaatagccaaagatttc

SEQ ID NO: 6673578 - DNA, 20 bp, Homo sapiens
attaatagccaaagatttca

SEQ ID NO: 6673579 - DNA, 23 bp, Homo sapiens
attaatagcttttattgtataaa

SEQ ID NO: 6673580 - DNA, 20 bp, Homo sapiens
attaataggaaagatttaat

SEQ ID NO: 6673581 - DNA, 22 bp, Homo sapiens
attaataggaaagatttaatgt

SEQ ID NO: 6673582 - DNA, 13 bp, Homo sapiens
attaatagtttta

SEQ ID NO: 6673583 - DNA, 19 bp, Homo sapiens
attaatataaaaacatttt

SEQ ID NO: 6673584 - DNA, 20 bp, Homo sapiens
attaatatatgtattattta

SEQ ID NO: 6673585 - DNA, 12 bp, Homo sapiens
attaatatatta

SEQ ID NO: 6673586 - DNA, 15 bp, Homo sapiens
attaatatatttcca

SEQ ID NO: 6673587 - DNA, 18 bp, Homo sapiens
attaatatccctacatgt

SEQ ID NO: 6673588 - DNA, 19 bp, Homo sapiens
attaatatcctgtaataaa

SEQ ID NO: 6673589 - DNA, 14 bp, Homo sapiens
attaatatctccat

SEQ ID NO: 6673590 - DNA, 17 bp, Homo sapiens
attaatatctcctggaa

SEQ ID NO: 6673591 - DNA, 13 bp, Homo sapiens
attaatatgagtt

SEQ ID NO: 6673592 - DNA, 14 bp, Homo sapiens
attaatatgtactt

SEQ ID NO: 6673593 - DNA, 19 bp, Homo sapiens
attaatatgtacttttcca

SEQ ID NO: 6673594 - DNA, 19 bp, Homo sapiens
attaatattaactacagaa

SEQ ID NO: 6673595 - DNA, 15 bp, Homo sapiens
attaatattattatg

SEQ ID NO: 6673596 - DNA, 12 bp, Homo sapiens
attaatattcat

SEQ ID NO: 6673597 - DNA, 19 bp, Homo sapiens
attaatattcccattttat

SEQ ID NO: 6673598 - DNA, 16 bp, Homo sapiens
attaatattcttttgt

SEQ ID NO: 6673599 - DNA, 17 bp, Homo sapiens
attaatattgtattgct

SEQ ID NO: 6673600 - DNA, 16 bp, Homo sapiens
attaatattgtgctta

SEQ ID NO: 6673601 - DNA, 12 bp, Homo sapiens
attaatatttaa

SEQ ID NO: 6673602 - DNA, 21 bp, Homo sapiens
attaatatttaggagtctatt

SEQ ID NO: 6673603 - DNA, 13 bp, Homo sapiens
attaatatttatg

SEQ ID NO: 6673604 - DNA, 19 bp, Homo sapiens
attaatatttatgtctctg

SEQ ID NO: 6673605 - DNA, 11 bp, Homo sapiens
attaatatttg

SEQ ID NO: 6673606 - DNA, 21 bp, Homo sapiens
attaatatttgtgctttgaaa

SEQ ID NO: 6673607 - DNA, 23 bp, Homo sapiens
attaatatttgtgctttgaaaaa

SEQ ID NO: 6673608 - DNA, 17 bp, Homo sapiens
attaatatttgtttagt

SEQ ID NO: 6673609 - DNA, 11 bp, Homo sapiens
attaatcaaag

SEQ ID NO: 6673610 - DNA, 11 bp, Homo sapiens
attaatcaaga

SEQ ID NO: 6673611 - DNA, 18 bp, Homo sapiens
attaatcaagagaaactt

SEQ ID NO: 6673612 - DNA, 18 bp, Homo sapiens
attaatcaccttctttgt

SEQ ID NO: 6673613 - DNA, 13 bp, Homo sapiens
attaatcactatt

SEQ ID NO: 6673614 - DNA, 16 bp, Homo sapiens
attaatcactattgtt

SEQ ID NO: 6673615 - DNA, 22 bp, Homo sapiens
attaatcactgtgtatatttga

SEQ ID NO: 6673616 - DNA, 20 bp, Homo sapiens
attaatcagctgttgcaggc

SEQ ID NO: 6673617 - DNA, 23 bp, Homo sapiens
attaatcagctgttgcaggcagt

SEQ ID NO: 6673618 - DNA, 16 bp, Homo sapiens
attaatcagttcatta

SEQ ID NO: 6673619 - DNA, 16 bp, Homo sapiens
attaatcataaagaaa

SEQ ID NO: 6673620 - DNA, 14 bp, Homo sapiens
attaatcatagatt

SEQ ID NO: 6673621 - DNA, 19 bp, Homo sapiens
attaatcatctataaagaa

SEQ ID NO: 6673622 - DNA, 14 bp, Homo sapiens
attaatcattccat

SEQ ID NO: 6673623 - DNA, 23 bp, Homo sapiens
attaatccaaagcttattttgta

SEQ ID NO: 6673624 - DNA, 16 bp, Homo sapiens
attaatccacaaatat

SEQ ID NO: 6673625 - DNA, 19 bp, Homo sapiens
attaatccccatcattact

SEQ ID NO: 6673626 - DNA, 13 bp, Homo sapiens
attaatctctaaa

SEQ ID NO: 6673627 - DNA, 14 bp, Homo sapiens
attaatctctaaaa

SEQ ID NO: 6673628 - DNA, 19 bp, Homo sapiens
attaatctctaaaattcta

SEQ ID NO: 6673629 - DNA, 22 bp, Homo sapiens
attaatctctaaaattctagtc

SEQ ID NO: 6673630 - DNA, 21 bp, Homo sapiens
attaatcttagtgtatgatta

SEQ ID NO: 6673631 - DNA, 22 bp, Homo sapiens
attaatcttagtgtatgattac

SEQ ID NO: 6673632 - DNA, 16 bp, Homo sapiens
attaatcttattgttt

SEQ ID NO: 6673633 - DNA, 12 bp, Homo sapiens
attaatcttgat

SEQ ID NO: 6673634 - DNA, 15 bp, Homo sapiens
attaatcttggatag

SEQ ID NO: 6673635 - DNA, 21 bp, Homo sapiens
attaatcttggatagctaata

SEQ ID NO: 6673636 - DNA, 14 bp, Homo sapiens
attaatcttttaaa

SEQ ID NO: 6673637 - DNA, 17 bp, Homo sapiens
attaatcttttaaaaat

SEQ ID NO: 6673638 - DNA, 13 bp, Homo sapiens
attaatgaaatat

SEQ ID NO: 6673639 - DNA, 17 bp, Homo sapiens
attaatgaaatatctgt

SEQ ID NO: 6673640 - DNA, 22 bp, Homo sapiens
attaatgaaatgataaagactt

SEQ ID NO: 6673641 - DNA, 23 bp, Homo sapiens
attaatgaaatgataaagacttt

SEQ ID NO: 6673642 - DNA, 14 bp, Homo sapiens
attaatgaactgtg

SEQ ID NO: 6673643 - DNA, 18 bp, Homo sapiens
attaatgaactgtgacag

SEQ ID NO: 6673644 - DNA, 16 bp, Homo sapiens
attaatgaatgcccag

SEQ ID NO: 6673645 - DNA, 16 bp, Homo sapiens
attaatgacacttgtc

SEQ ID NO: 6673646 - DNA, 15 bp, Homo sapiens
attaatgacttactt

SEQ ID NO: 6673647 - DNA, 21 bp, Homo sapiens
attaatgagaagagttttctc

SEQ ID NO: 6673648 - DNA, 12 bp, Homo sapiens
attaatgagttt

SEQ ID NO: 6673649 - DNA, 12 bp, Homo sapiens
attaatgcactt

SEQ ID NO: 6673650 - DNA, 14 bp, Homo sapiens
attaatgcactttc

SEQ ID NO: 6673651 - DNA, 15 bp, Homo sapiens
attaatgcactttct

SEQ ID NO: 6673652 - DNA, 16 bp, Homo sapiens
attaatgcactttcta

SEQ ID NO: 6673653 - DNA, 13 bp, Homo sapiens
attaatgcccaga

SEQ ID NO: 6673654 - DNA, 14 bp, Homo sapiens
attaatgcccagac

SEQ ID NO: 6673655 - DNA, 15 bp, Homo sapiens
attaatgcctgcttt

SEQ ID NO: 6673656 - DNA, 22 bp, Homo sapiens
attaatgcctgctttttggaaa

SEQ ID NO: 6673657 - DNA, 15 bp, Homo sapiens
attaatgcctttaaa

SEQ ID NO: 6673658 - DNA, 16 bp, Homo sapiens
attaatggaaaactgt

SEQ ID NO: 6673659 - DNA, 15 bp, Homo sapiens
attaatggcactgat

SEQ ID NO: 6673660 - DNA, 22 bp, Homo sapiens
attaatggcatgtaatattctg

SEQ ID NO: 6673661 - DNA, 18 bp, Homo sapiens
attaatggtttattcttt

SEQ ID NO: 6673662 - DNA, 20 bp, Homo sapiens
attaatggtttattctttgc

SEQ ID NO: 6673663 - DNA, 22 bp, Homo sapiens
attaatggtttttgttagttca

SEQ ID NO: 6673664 - DNA, 13 bp, Homo sapiens
attaatgtaataa

SEQ ID NO: 6673665 - DNA, 18 bp, Homo sapiens
attaatgtaataaagtga

SEQ ID NO: 6673666 - DNA, 20 bp, Homo sapiens
attaatgtaataaagtgaac

SEQ ID NO: 6673667 - DNA, 21 bp, Homo sapiens
attaatgtaataaagtgaact

SEQ ID NO: 6673668 - DNA, 13 bp, Homo sapiens
attaatgtacttt

SEQ ID NO: 6673669 - DNA, 14 bp, Homo sapiens
attaatgtactttt

SEQ ID NO: 6673670 - DNA, 15 bp, Homo sapiens
attaatgtacttttt

SEQ ID NO: 6673671 - DNA, 20 bp, Homo sapiens
attaatgtactttttattgc

SEQ ID NO: 6673672 - DNA, 23 bp, Homo sapiens
attaatgtagggcagaatagctg

SEQ ID NO: 6673673 - DNA, 18 bp, Homo sapiens
attaatgtcatgttgctt

SEQ ID NO: 6673674 - DNA, 20 bp, Homo sapiens
attaatgtctcactttactt

SEQ ID NO: 6673675 - DNA, 22 bp, Homo sapiens
attaatgtctcactttactttc

SEQ ID NO: 6673676 - DNA, 21 bp, Homo sapiens
attaatgtgtaaaattggatt

SEQ ID NO: 6673677 - DNA, 14 bp, Homo sapiens
attaatgtgtatta

SEQ ID NO: 6673678 - DNA, 20 bp, Homo sapiens
attaatgtgtgtctgaagac

SEQ ID NO: 6673679 - DNA, 21 bp, Homo sapiens
attaatgtgtgtctgaagact

SEQ ID NO: 6673680 - DNA, 23 bp, Homo sapiens
attaatgtttatttagctctgaa

SEQ ID NO: 6673681 - DNA, 12 bp, Homo sapiens
attaatgtttct

SEQ ID NO: 6673682 - DNA, 18 bp, Homo sapiens
attaatgtttctatctga

SEQ ID NO: 6673683 - DNA, 17 bp, Homo sapiens
attaatgtttcttaaat

SEQ ID NO: 6673684 - DNA, 21 bp, Homo sapiens
attaatgtttgtgggtatttc

SEQ ID NO: 6673685 - DNA, 17 bp, Homo sapiens
attaatgttttcaaaag

SEQ ID NO: 6673686 - DNA, 15 bp, Homo sapiens
attaatgttttcatt

SEQ ID NO: 6673687 - DNA, 17 bp, Homo sapiens
attaatgttttcattat

SEQ ID NO: 6673688 - DNA, 15 bp, Homo sapiens
attaatgttttgtac

SEQ ID NO: 6673689 - DNA, 13 bp, Homo sapiens
attaattaaagaa

SEQ ID NO: 6673690 - DNA, 17 bp, Homo sapiens
attaattaaatgaactt

SEQ ID NO: 6673691 - DNA, 14 bp, Homo sapiens
attaattaacatca

SEQ ID NO: 6673692 - DNA, 15 bp, Homo sapiens
attaattaacatcaa

SEQ ID NO: 6673693 - DNA, 15 bp, Homo sapiens
attaattaattaaca

SEQ ID NO: 6673694 - DNA, 14 bp, Homo sapiens
attaattacataca

SEQ ID NO: 6673695 - DNA, 14 bp, Homo sapiens
attaattactaatt

SEQ ID NO: 6673696 - DNA, 15 bp, Homo sapiens
attaattactgtgtg

SEQ ID NO: 6673697 - DNA, 18 bp, Homo sapiens
attaattagatcaacact

SEQ ID NO: 6673698 - DNA, 16 bp, Homo sapiens
attaattagttccagt

SEQ ID NO: 6673699 - DNA, 13 bp, Homo sapiens
attaattatctga

SEQ ID NO: 6673700 - DNA, 15 bp, Homo sapiens
attaattatgtgtag

SEQ ID NO: 6673701 - DNA, 20 bp, Homo sapiens
attaattatgtgtagttata

SEQ ID NO: 6673702 - DNA, 17 bp, Homo sapiens
attaattattttccaaa

SEQ ID NO: 6673703 - DNA, 19 bp, Homo sapiens
attaattcaatgaaatgga

SEQ ID NO: 6673704 - DNA, 20 bp, Homo sapiens
attaattcctgtttgtctac

SEQ ID NO: 6673705 - DNA, 12 bp, Homo sapiens
attaattctaaa

SEQ ID NO: 6673706 - DNA, 14 bp, Homo sapiens
attaattctaaact

SEQ ID NO: 6673707 - DNA, 13 bp, Homo sapiens
attaattctataa

SEQ ID NO: 6673708 - DNA, 14 bp, Homo sapiens
attaattctataag

SEQ ID NO: 6673709 - DNA, 16 bp, Homo sapiens
attaattctcaaataa

SEQ ID NO: 6673710 - DNA, 14 bp, Homo sapiens
attaattgaatcta

SEQ ID NO: 6673711 - DNA, 11 bp, Homo sapiens
attaattgagg

SEQ ID NO: 6673712 - DNA, 23 bp, Homo sapiens
attaattgcctgttaaatataca

SEQ ID NO: 6673713 - DNA, 13 bp, Homo sapiens
attaattgctttg

SEQ ID NO: 6673714 - DNA, 14 bp, Homo sapiens
attaattgctttga

SEQ ID NO: 6673715 - DNA, 14 bp, Homo sapiens
attaattgtgcctg

SEQ ID NO: 6673716 - DNA, 21 bp, Homo sapiens
attaattgtgctgtttgcttg

SEQ ID NO: 6673717 - DNA, 14 bp, Homo sapiens
attaattgtgtgaa

SEQ ID NO: 6673718 - DNA, 16 bp, Homo sapiens
attaattgtgtgaact

SEQ ID NO: 6673719 - DNA, 19 bp, Homo sapiens
attaattgttccttgcttt

SEQ ID NO: 6673720 - DNA, 23 bp, Homo sapiens
attaattgttccttgcttttata

SEQ ID NO: 6673721 - DNA, 17 bp, Homo sapiens
attaatttatgcagaat

SEQ ID NO: 6673722 - DNA, 17 bp, Homo sapiens
attaatttatgcagaga

SEQ ID NO: 6673723 - DNA, 12 bp, Homo sapiens
attaatttatgg

SEQ ID NO: 6673724 - DNA, 21 bp, Homo sapiens
attaatttatggtttctgcgt

SEQ ID NO: 6673725 - DNA, 19 bp, Homo sapiens
attaatttattaaatttat

SEQ ID NO: 6673726 - DNA, 14 bp, Homo sapiens
attaatttcaaaat

SEQ ID NO: 6673727 - DNA, 15 bp, Homo sapiens
attaatttcaacata

SEQ ID NO: 6673728 - DNA, 21 bp, Homo sapiens
attaatttcaatcaaccaaag

SEQ ID NO: 6673729 - DNA, 13 bp, Homo sapiens
attaatttctctc

SEQ ID NO: 6673730 - DNA, 23 bp, Homo sapiens
attaatttctgataaagttcctt

SEQ ID NO: 6673731 - DNA, 22 bp, Homo sapiens
attaatttctgccatttcatgt

SEQ ID NO: 6673732 - DNA, 15 bp, Homo sapiens
attaatttgaaacca

SEQ ID NO: 6673733 - DNA, 13 bp, Homo sapiens
attaatttgtgaa

SEQ ID NO: 6673734 - DNA, 14 bp, Homo sapiens
attaatttgtgaat

SEQ ID NO: 6673735 - DNA, 17 bp, Homo sapiens
attaatttgtgaatttg

SEQ ID NO: 6673736 - DNA, 18 bp, Homo sapiens
attaatttgttaattaaa

SEQ ID NO: 6673737 - DNA, 22 bp, Homo sapiens
attaatttgttaattaaatatt

SEQ ID NO: 6673738 - DNA, 12 bp, Homo sapiens
attaatttgttt

SEQ ID NO: 6673739 - DNA, 18 bp, Homo sapiens
attaattttcagccatgt

SEQ ID NO: 6673740 - DNA, 16 bp, Homo sapiens
attaattttgtgcatt

SEQ ID NO: 6673741 - DNA, 20 bp, Homo sapiens
attaattttgtgcattcttt

SEQ ID NO: 6673742 - DNA, 13 bp, Homo sapiens
attaatttttaat

SEQ ID NO: 6673743 - DNA, 18 bp, Homo sapiens
attaatttttaattgaaa

SEQ ID NO: 6673744 - DNA, 22 bp, Homo sapiens
attaatttttatttatttttct

SEQ ID NO: 6673745 - DNA, 16 bp, Homo sapiens
attaatttttttattg

SEQ ID NO: 6673746 - DNA, 18 bp, Homo sapiens
attaatttttttattgtt

SEQ ID NO: 6673747 - DNA, 22 bp, Homo sapiens
attaatttttttattgtttaaa

SEQ ID NO: 6673748 - DNA, 16 bp, Homo sapiens
attacaaaacctattt

SEQ ID NO: 6673749 - DNA, 17 bp, Homo sapiens
attacaaaatgaagttt

SEQ ID NO: 6673750 - DNA, 14 bp, Homo sapiens
attacaaacaataa

SEQ ID NO: 6673751 - DNA, 20 bp, Homo sapiens
attacaaacaataagaacaa

SEQ ID NO: 6673752 - DNA, 23 bp, Homo sapiens
attacaaacaataagaacaagtt

SEQ ID NO: 6673753 - DNA, 20 bp, Homo sapiens
attacaaataaacagttgtt

SEQ ID NO: 6673754 - DNA, 20 bp, Homo sapiens
attacaaatagaagcttctt

SEQ ID NO: 6673755 - DNA, 22 bp, Homo sapiens
attacaaatatatagcacatca

SEQ ID NO: 6673756 - DNA, 18 bp, Homo sapiens
attacaaatcagaagtca

SEQ ID NO: 6673757 - DNA, 19 bp, Homo sapiens
attacaaatcagaagtcat

SEQ ID NO: 6673758 - DNA, 22 bp, Homo sapiens
attacaaatcagaagtcatctt

SEQ ID NO: 6673759 - DNA, 18 bp, Homo sapiens
attacaaatgcaaatttc

SEQ ID NO: 6673760 - DNA, 21 bp, Homo sapiens
attacaaatgcaaatttctat

SEQ ID NO: 6673761 - DNA, 14 bp, Homo sapiens
attacaaattgctt

SEQ ID NO: 6673762 - DNA, 19 bp, Homo sapiens
attacaaattttcactgct

SEQ ID NO: 6673763 - DNA, 23 bp, Homo sapiens
attacaacaagcaaactgaaatt

SEQ ID NO: 6673764 - DNA, 14 bp, Homo sapiens
attacaacagcacg

SEQ ID NO: 6673765 - DNA, 12 bp, Homo sapiens
attacaacattt

SEQ ID NO: 6673766 - DNA, 13 bp, Homo sapiens
attacaacattta

SEQ ID NO: 6673767 - DNA, 15 bp, Homo sapiens
attacaacatttatg

SEQ ID NO: 6673768 - DNA, 13 bp, Homo sapiens
attacaactaaat

SEQ ID NO: 6673769 - DNA, 16 bp, Homo sapiens
attacaagtattcagt

SEQ ID NO: 6673770 - DNA, 14 bp, Homo sapiens
attacaagtatttt

SEQ ID NO: 6673771 - DNA, 16 bp, Homo sapiens
attacaagtggctccc

SEQ ID NO: 6673772 - DNA, 22 bp, Homo sapiens
attacaagtggctccccacctg

SEQ ID NO: 6673773 - DNA, 17 bp, Homo sapiens
attacaagtttcagtaa

SEQ ID NO: 6673774 - DNA, 23 bp, Homo sapiens
attacaagtttcagtaatagctg

SEQ ID NO: 6673775 - DNA, 16 bp, Homo sapiens
attacaataaatcctt

SEQ ID NO: 6673776 - DNA, 19 bp, Homo sapiens
attacaatacagtatttct

SEQ ID NO: 6673777 - DNA, 15 bp, Homo sapiens
attacaatggaaaca

SEQ ID NO: 6673778 - DNA, 18 bp, Homo sapiens
attacaatggccagccca

SEQ ID NO: 6673779 - DNA, 15 bp, Homo sapiens
attacaatttcttta

SEQ ID NO: 6673780 - DNA, 14 bp, Homo sapiens
attacaatttgtat

SEQ ID NO: 6673781 - DNA, 15 bp, Homo sapiens
attacaattttctgt

SEQ ID NO: 6673782 - DNA, 12 bp, Homo sapiens
attacaattttt

SEQ ID NO: 6673783 - DNA, 19 bp, Homo sapiens
attacacaataaagcagtc

SEQ ID NO: 6673784 - DNA, 22 bp, Homo sapiens
attacacacgtgtgatgtatgt

SEQ ID NO: 6673785 - DNA, 19 bp, Homo sapiens
attacacagttcacaaaca

SEQ ID NO: 6673786 - DNA, 22 bp, Homo sapiens
attacacagttcacaaacagta

SEQ ID NO: 6673787 - DNA, 16 bp, Homo sapiens
attacacattaaagta

SEQ ID NO: 6673788 - DNA, 20 bp, Homo sapiens
attacaccacaagtatctaa

SEQ ID NO: 6673789 - DNA, 22 bp, Homo sapiens
attacaccacaagtatctaaat

SEQ ID NO: 6673790 - DNA, 15 bp, Homo sapiens
attacacccatgcac

SEQ ID NO: 6673791 - DNA, 17 bp, Homo sapiens
attacactaaattatta

SEQ ID NO: 6673792 - DNA, 13 bp, Homo sapiens
attacactccagc

SEQ ID NO: 6673793 - DNA, 16 bp, Homo sapiens
attacactccagcctg

SEQ ID NO: 6673794 - DNA, 19 bp, Homo sapiens
attacactgtgccttttcc

SEQ ID NO: 6673795 - DNA, 15 bp, Homo sapiens
attacagaaaatttg

SEQ ID NO: 6673796 - DNA, 11 bp, Homo sapiens
attacagaaac

SEQ ID NO: 6673797 - DNA, 23 bp, Homo sapiens
attacagaaatgtttttaacact

SEQ ID NO: 6673798 - DNA, 20 bp, Homo sapiens
attacagaagaagctcctga

SEQ ID NO: 6673799 - DNA, 20 bp, Homo sapiens
attacagaagagtttcttaa

SEQ ID NO: 6673800 - DNA, 22 bp, Homo sapiens
attacagaagagtttcttaact

SEQ ID NO: 6673801 - DNA, 12 bp, Homo sapiens
attacagagagg

SEQ ID NO: 6673802 - DNA, 19 bp, Homo sapiens
attacagagatataaatga

SEQ ID NO: 6673803 - DNA, 16 bp, Homo sapiens
attacagatctgcacc

SEQ ID NO: 6673804 - DNA, 21 bp, Homo sapiens
attacagatctgcaccaccat

SEQ ID NO: 6673805 - DNA, 21 bp, Homo sapiens
attacagatgggcaaattaag

SEQ ID NO: 6673806 - DNA, 14 bp, Homo sapiens
attacagatgtgaa

SEQ ID NO: 6673807 - DNA, 16 bp, Homo sapiens
attacagattaaaaaa

SEQ ID NO: 6673808 - DNA, 17 bp, Homo sapiens
attacagattaaagaag

SEQ ID NO: 6673809 - DNA, 17 bp, Homo sapiens
attacagatttagttta

SEQ ID NO: 6673810 - DNA, 15 bp, Homo sapiens
attacagctggagaa

SEQ ID NO: 6673811 - DNA, 16 bp, Homo sapiens
attacaggaaatgcaa

SEQ ID NO: 6673812 - DNA, 21 bp, Homo sapiens
attacaggaatgaagaactgt

SEQ ID NO: 6673813 - DNA, 21 bp, Homo sapiens
attacaggagggaacatttcc

SEQ ID NO: 6673814 - DNA, 23 bp, Homo sapiens
attacaggagggaacatttccga

SEQ ID NO: 6673815 - DNA, 21 bp, Homo sapiens
attacaggattaatatattga

SEQ ID NO: 6673816 - DNA, 20 bp, Homo sapiens
attacaggcatgtgccacca

SEQ ID NO: 6673817 - DNA, 21 bp, Homo sapiens
attacaggccttttgactctt

SEQ ID NO: 6673818 - DNA, 17 bp, Homo sapiens
attacaggcgtgagcca

SEQ ID NO: 6673819 - DNA, 21 bp, Homo sapiens
attacaggcgtgagccaccaa

SEQ ID NO: 6673820 - DNA, 18 bp, Homo sapiens
attacaggcgtgagcccc

SEQ ID NO: 6673821 - DNA, 16 bp, Homo sapiens
attacaggctcctgcc

SEQ ID NO: 6673822 - DNA, 17 bp, Homo sapiens
attacagggaagaaatc

SEQ ID NO: 6673823 - DNA, 17 bp, Homo sapiens
attacaggtgtgagcca

SEQ ID NO: 6673824 - DNA, 19 bp, Homo sapiens
attacaggtgtgtgccatc

SEQ ID NO: 6673825 - DNA, 19 bp, Homo sapiens
attacaggtgtgtgggcca

SEQ ID NO: 6673826 - DNA, 21 bp, Homo sapiens
attacaggttccttttgaagc

SEQ ID NO: 6673827 - DNA, 12 bp, Homo sapiens
attacagtataa

SEQ ID NO: 6673828 - DNA, 15 bp, Homo sapiens
attacagtataatta

SEQ ID NO: 6673829 - DNA, 19 bp, Homo sapiens
attacagtggggaatgaag

SEQ ID NO: 6673830 - DNA, 15 bp, Homo sapiens
attacagtgggtgcc

SEQ ID NO: 6673831 - DNA, 20 bp, Homo sapiens
attacagtgtcctaccactc

SEQ ID NO: 6673832 - DNA, 12 bp, Homo sapiens
attacagtgttg

SEQ ID NO: 6673833 - DNA, 18 bp, Homo sapiens
attacataatctgtacaa

SEQ ID NO: 6673834 - DNA, 15 bp, Homo sapiens
attacataatgttag

SEQ ID NO: 6673835 - DNA, 22 bp, Homo sapiens
attacataattcaaagataaca

SEQ ID NO: 6673836 - DNA, 13 bp, Homo sapiens
attacatagatca

SEQ ID NO: 6673837 - DNA, 15 bp, Homo sapiens
attacatccttgtgg

SEQ ID NO: 6673838 - DNA, 19 bp, Homo sapiens
attacatctctaattttgg

SEQ ID NO: 6673839 - DNA, 14 bp, Homo sapiens
attacatctgcctt

SEQ ID NO: 6673840 - DNA, 12 bp, Homo sapiens
attacatcttta

SEQ ID NO: 6673841 - DNA, 14 bp, Homo sapiens
attacatctttatt

SEQ ID NO: 6673842 - DNA, 21 bp, Homo sapiens
attacatctttattaacctca

SEQ ID NO: 6673843 - DNA, 15 bp, Homo sapiens
attacatctttcaca

SEQ ID NO: 6673844 - DNA, 13 bp, Homo sapiens
attacatgatctt

SEQ ID NO: 6673845 - DNA, 20 bp, Homo sapiens
attacatgatttaaagacta

SEQ ID NO: 6673846 - DNA, 13 bp, Homo sapiens
attacatgcatga

SEQ ID NO: 6673847 - DNA, 19 bp, Homo sapiens
attacatgtaaaacattat

SEQ ID NO: 6673848 - DNA, 16 bp, Homo sapiens
attacatgtaaagctg

SEQ ID NO: 6673849 - DNA, 17 bp, Homo sapiens
attacatgtaaagctgt

SEQ ID NO: 6673850 - DNA, 22 bp, Homo sapiens
attacatgtaaagctgttaaaa

SEQ ID NO: 6673851 - DNA, 23 bp, Homo sapiens
attacatgtaaagctgttaaaat

SEQ ID NO: 6673852 - DNA, 15 bp, Homo sapiens
attacatgtaaatta

SEQ ID NO: 6673853 - DNA, 21 bp, Homo sapiens
attacattactgaaaacttca

SEQ ID NO: 6673854 - DNA, 21 bp, Homo sapiens
attacattagttaagatgtct

SEQ ID NO: 6673855 - DNA, 21 bp, Homo sapiens
attacattcctaactagaatt

SEQ ID NO: 6673856 - DNA, 17 bp, Homo sapiens
attacattggcacaatg

SEQ ID NO: 6673857 - DNA, 15 bp, Homo sapiens
attacatttaaatcc

SEQ ID NO: 6673858 - DNA, 18 bp, Homo sapiens
attacatttccaaatgaa

SEQ ID NO: 6673859 - DNA, 21 bp, Homo sapiens
attacatttgaactatatcct

SEQ ID NO: 6673860 - DNA, 13 bp, Homo sapiens
attacatttgtaa

SEQ ID NO: 6673861 - DNA, 14 bp, Homo sapiens
attacatttgtaat

SEQ ID NO: 6673862 - DNA, 13 bp, Homo sapiens
attacatttgtat

SEQ ID NO: 6673863 - DNA, 15 bp, Homo sapiens
attacatttgtataa

SEQ ID NO: 6673864 - DNA, 18 bp, Homo sapiens
attacatttgtataaaat

SEQ ID NO: 6673865 - DNA, 18 bp, Homo sapiens
attacattttatatgtga

SEQ ID NO: 6673866 - DNA, 18 bp, Homo sapiens
attaccaaaaaagtattt

SEQ ID NO: 6673867 - DNA, 14 bp, Homo sapiens
attaccaaaacaag

SEQ ID NO: 6673868 - DNA, 12 bp, Homo sapiens
attaccaaaata

SEQ ID NO: 6673869 - DNA, 15 bp, Homo sapiens
attaccaagagaagg

SEQ ID NO: 6673870 - DNA, 20 bp, Homo sapiens
attaccaagcgcttctttct

SEQ ID NO: 6673871 - DNA, 21 bp, Homo sapiens
attaccaagcgcttctttctg

SEQ ID NO: 6673872 - DNA, 19 bp, Homo sapiens
attaccaagttacttgaaa

SEQ ID NO: 6673873 - DNA, 19 bp, Homo sapiens
attaccaataggcaaatta

SEQ ID NO: 6673874 - DNA, 20 bp, Homo sapiens
attaccaataggcaaattaa

SEQ ID NO: 6673875 - DNA, 22 bp, Homo sapiens
attaccaataggcaaattaatc

SEQ ID NO: 6673876 - DNA, 15 bp, Homo sapiens
attaccaccatcccg

SEQ ID NO: 6673877 - DNA, 17 bp, Homo sapiens
attaccaccctttcaca

SEQ ID NO: 6673878 - DNA, 15 bp, Homo sapiens
attaccagaaaatga

SEQ ID NO: 6673879 - DNA, 17 bp, Homo sapiens
attaccagcatttacta

SEQ ID NO: 6673880 - DNA, 12 bp, Homo sapiens
attaccagggac

SEQ ID NO: 6673881 - DNA, 16 bp, Homo sapiens
attaccaggtccattt

SEQ ID NO: 6673882 - DNA, 18 bp, Homo sapiens
attaccaggtttcatttt

SEQ ID NO: 6673883 - DNA, 21 bp, Homo sapiens
attaccagtaaagtgtaacat

SEQ ID NO: 6673884 - DNA, 23 bp, Homo sapiens
attaccagtaaagtgtaacatat

SEQ ID NO: 6673885 - DNA, 13 bp, Homo sapiens
attaccagtctga

SEQ ID NO: 6673886 - DNA, 20 bp, Homo sapiens
attaccagtgactaattttg

SEQ ID NO: 6673887 - DNA, 20 bp, Homo sapiens
attaccagttttccagaaca

SEQ ID NO: 6673888 - DNA, 22 bp, Homo sapiens
attaccatagagtaatgatgta

SEQ ID NO: 6673889 - DNA, 13 bp, Homo sapiens
attaccatcttaa

SEQ ID NO: 6673890 - DNA, 16 bp, Homo sapiens
attaccatgtaaataa

SEQ ID NO: 6673891 - DNA, 17 bp, Homo sapiens
attaccatgtaaataat

SEQ ID NO: 6673892 - DNA, 14 bp, Homo sapiens
attaccatgtaatg

SEQ ID NO: 6673893 - DNA, 15 bp, Homo sapiens
attaccatgtaatgg

SEQ ID NO: 6673894 - DNA, 12 bp, Homo sapiens
attacccaaaag

SEQ ID NO: 6673895 - DNA, 14 bp, Homo sapiens
attacccaaaccca

SEQ ID NO: 6673896 - DNA, 13 bp, Homo sapiens
attacccactgtc

SEQ ID NO: 6673897 - DNA, 15 bp, Homo sapiens
attaccccatacccc

SEQ ID NO: 6673898 - DNA, 17 bp, Homo sapiens
attaccccatacccctt

SEQ ID NO: 6673899 - DNA, 18 bp, Homo sapiens
attaccccctccttcaga

SEQ ID NO: 6673900 - DNA, 19 bp, Homo sapiens
attaccccctccttcagac

SEQ ID NO: 6673901 - DNA, 21 bp, Homo sapiens
attaccccctccttcagacac

SEQ ID NO: 6673902 - DNA, 17 bp, Homo sapiens
attacccctcatttaaa

SEQ ID NO: 6673903 - DNA, 17 bp, Homo sapiens
attaccctacagacagc

SEQ ID NO: 6673904 - DNA, 19 bp, Homo sapiens
attaccctcggtcattcct

SEQ ID NO: 6673905 - DNA, 18 bp, Homo sapiens
attaccctctgcagaaca

SEQ ID NO: 6673906 - DNA, 12 bp, Homo sapiens
attacccttcct

SEQ ID NO: 6673907 - DNA, 17 bp, Homo sapiens
attaccgcgttgtaaaa

SEQ ID NO: 6673908 - DNA, 15 bp, Homo sapiens
attaccgtgtaccac

SEQ ID NO: 6673909 - DNA, 13 bp, Homo sapiens
attacctaatttt

SEQ ID NO: 6673910 - DNA, 20 bp, Homo sapiens
attacctaatttttttcctg

SEQ ID NO: 6673911 - DNA, 14 bp, Homo sapiens
attacctattaggt

SEQ ID NO: 6673912 - DNA, 20 bp, Homo sapiens
attacctccatccatccttc

SEQ ID NO: 6673913 - DNA, 22 bp, Homo sapiens
attacctccatccatccttcca

SEQ ID NO: 6673914 - DNA, 22 bp, Homo sapiens
attacctgaattttggctgtgt

SEQ ID NO: 6673915 - DNA, 19 bp, Homo sapiens
attacctgccaattgctac

SEQ ID NO: 6673916 - DNA, 12 bp, Homo sapiens
attacctggtga

SEQ ID NO: 6673917 - DNA, 22 bp, Homo sapiens
attacctggtgagtaacttaga

SEQ ID NO: 6673918 - DNA, 11 bp, Homo sapiens
attacctgtac

SEQ ID NO: 6673919 - DNA, 15 bp, Homo sapiens
attacctgtggatat

SEQ ID NO: 6673920 - DNA, 22 bp, Homo sapiens
attaccttattggatatttgat

SEQ ID NO: 6673921 - DNA, 12 bp, Homo sapiens
attaccttctcc

SEQ ID NO: 6673922 - DNA, 15 bp, Homo sapiens
attaccttctttcta

SEQ ID NO: 6673923 - DNA, 18 bp, Homo sapiens
attaccttgtctttcaaa

SEQ ID NO: 6673924 - DNA, 21 bp, Homo sapiens
attaccttgtctttcaaaaga

SEQ ID NO: 6673925 - DNA, 15 bp, Homo sapiens
attacctttaatttt

SEQ ID NO: 6673926 - DNA, 14 bp, Homo sapiens
attacctttacata

SEQ ID NO: 6673927 - DNA, 23 bp, Homo sapiens
attaccttttaccagcttttaac

SEQ ID NO: 6673928 - DNA, 19 bp, Homo sapiens
attacgatcccccaagtgt

SEQ ID NO: 6673929 - DNA, 15 bp, Homo sapiens
attacggctcctctc

SEQ ID NO: 6673930 - DNA, 14 bp, Homo sapiens
attacggtgtacag

SEQ ID NO: 6673931 - DNA, 15 bp, Homo sapiens
attacgtatgtctgg

SEQ ID NO: 6673932 - DNA, 20 bp, Homo sapiens
attacgtgagccaggtaatg

SEQ ID NO: 6673933 - DNA, 14 bp, Homo sapiens
attacgtgcattta

SEQ ID NO: 6673934 - DNA, 20 bp, Homo sapiens
attacgtgcatttaaactct

SEQ ID NO: 6673935 - DNA, 20 bp, Homo sapiens
attacgtgtatgtttcttct

SEQ ID NO: 6673936 - DNA, 18 bp, Homo sapiens
attactaaagacagaaaa

SEQ ID NO: 6673937 - DNA, 22 bp, Homo sapiens
attactaactgtggacaaaagt

SEQ ID NO: 6673938 - DNA, 15 bp, Homo sapiens
attactaacttctaa

SEQ ID NO: 6673939 - DNA, 16 bp, Homo sapiens
attactaacttctaaa

SEQ ID NO: 6673940 - DNA, 21 bp, Homo sapiens
attactaacttctaaaactgt

SEQ ID NO: 6673941 - DNA, 20 bp, Homo sapiens
attactaaggagtaatctgt

SEQ ID NO: 6673942 - DNA, 13 bp, Homo sapiens
attactaatgtac

SEQ ID NO: 6673943 - DNA, 19 bp, Homo sapiens
attactaattctatttctc

SEQ ID NO: 6673944 - DNA, 22 bp, Homo sapiens
attactaattctatttctctat

SEQ ID NO: 6673945 - DNA, 11 bp, Homo sapiens
attactaattt

SEQ ID NO: 6673946 - DNA, 20 bp, Homo sapiens
attactaattttacacatta

SEQ ID NO: 6673947 - DNA, 21 bp, Homo sapiens
attactacaaaatttgaaatt

SEQ ID NO: 6673948 - DNA, 19 bp, Homo sapiens
attactacactggtgtgtc

SEQ ID NO: 6673949 - DNA, 21 bp, Homo sapiens
attactagactgccacaagga

SEQ ID NO: 6673950 - DNA, 17 bp, Homo sapiens
attactagataaaatgt

SEQ ID NO: 6673951 - DNA, 16 bp, Homo sapiens
attactaggtgacatg

SEQ ID NO: 6673952 - DNA, 14 bp, Homo sapiens
attactagtactat

SEQ ID NO: 6673953 - DNA, 14 bp, Homo sapiens
attactagtgttta

SEQ ID NO: 6673954 - DNA, 21 bp, Homo sapiens
attactagtgtttaagtcatt

SEQ ID NO: 6673955 - DNA, 15 bp, Homo sapiens
attactattaactct

SEQ ID NO: 6673956 - DNA, 16 bp, Homo sapiens
attactattaactctg

SEQ ID NO: 6673957 - DNA, 20 bp, Homo sapiens
attactcactaaagggcttc

SEQ ID NO: 6673958 - DNA, 15 bp, Homo sapiens
attactccaaggttt

SEQ ID NO: 6673959 - DNA, 22 bp, Homo sapiens
attactcccaggatcagcagaa

SEQ ID NO: 6673960 - DNA, 15 bp, Homo sapiens
attactcccattttg

SEQ ID NO: 6673961 - DNA, 19 bp, Homo sapiens
attactcctatttttgtaa

SEQ ID NO: 6673962 - DNA, 14 bp, Homo sapiens
attactccttcagc

SEQ ID NO: 6673963 - DNA, 19 bp, Homo sapiens
attactctagtttattcta

SEQ ID NO: 6673964 - DNA, 20 bp, Homo sapiens
attactctatgatgattgct

SEQ ID NO: 6673965 - DNA, 17 bp, Homo sapiens
attactctcattctttg

SEQ ID NO: 6673966 - DNA, 15 bp, Homo sapiens
attactctgaaattg

SEQ ID NO: 6673967 - DNA, 22 bp, Homo sapiens
attactctgcctgtcaagtttt

SEQ ID NO: 6673968 - DNA, 21 bp, Homo sapiens
attactcttcctctaacattt

SEQ ID NO: 6673969 - DNA, 16 bp, Homo sapiens
attactcttgtaagat

SEQ ID NO: 6673970 - DNA, 17 bp, Homo sapiens
attactcttgtaagatt

SEQ ID NO: 6673971 - DNA, 18 bp, Homo sapiens
attactcttgtaagattt

SEQ ID NO: 6673972 - DNA, 16 bp, Homo sapiens
attactgaaaacttca

SEQ ID NO: 6673973 - DNA, 19 bp, Homo sapiens
attactgaaatttaagaaa

SEQ ID NO: 6673974 - DNA, 16 bp, Homo sapiens
attactgacatttctt

SEQ ID NO: 6673975 - DNA, 16 bp, Homo sapiens
attactgacttttctt

SEQ ID NO: 6673976 - DNA, 20 bp, Homo sapiens
attactgacttttcttttta

SEQ ID NO: 6673977 - DNA, 17 bp, Homo sapiens
attactgaggaaaggga

SEQ ID NO: 6673978 - DNA, 14 bp, Homo sapiens
attactgaggggat

SEQ ID NO: 6673979 - DNA, 19 bp, Homo sapiens
attactgaggggattctct

SEQ ID NO: 6673980 - DNA, 17 bp, Homo sapiens
attactgatgtgatatt

SEQ ID NO: 6673981 - DNA, 13 bp, Homo sapiens
attactgcaatca

SEQ ID NO: 6673982 - DNA, 19 bp, Homo sapiens
attactgcactcttaaaca

SEQ ID NO: 6673983 - DNA, 23 bp, Homo sapiens
attactgcagtacatacgtctgc

SEQ ID NO: 6673984 - DNA, 17 bp, Homo sapiens
attactgcatgcacttc

SEQ ID NO: 6673985 - DNA, 19 bp, Homo sapiens
attactgcccagatgtttt

SEQ ID NO: 6673986 - DNA, 22 bp, Homo sapiens
attactgcccagatgttttaga

SEQ ID NO: 6673987 - DNA, 17 bp, Homo sapiens
attactgctaagtattt

SEQ ID NO: 6673988 - DNA, 18 bp, Homo sapiens
attactgcttcatttttg

SEQ ID NO: 6673989 - DNA, 22 bp, Homo sapiens
attactgcttgcagtaattcaa

SEQ ID NO: 6673990 - DNA, 21 bp, Homo sapiens
attactgctttaatcagaaac

SEQ ID NO: 6673991 - DNA, 19 bp, Homo sapiens
attactggatctcttaaga

SEQ ID NO: 6673992 - DNA, 22 bp, Homo sapiens
attactggcctttttcatttat

SEQ ID NO: 6673993 - DNA, 15 bp, Homo sapiens
attactgtaagaaaa

SEQ ID NO: 6673994 - DNA, 16 bp, Homo sapiens
attactgtaagaaaat

SEQ ID NO: 6673995 - DNA, 16 bp, Homo sapiens
attactgtatgtataa

SEQ ID NO: 6673996 - DNA, 14 bp, Homo sapiens
attactgtcccctt

SEQ ID NO: 6673997 - DNA, 15 bp, Homo sapiens
attactgtctttatt

SEQ ID NO: 6673998 - DNA, 13 bp, Homo sapiens
attactgtgagaa

SEQ ID NO: 6673999 - DNA, 18 bp, Homo sapiens
attactgtgagaactgtg

SEQ ID NO: 6674000 - DNA, 22 bp, Homo sapiens
attactgtgagaactgtgaata

SEQ ID NO: 6674001 - DNA, 14 bp, Homo sapiens
attactgtgatttc

SEQ ID NO: 6674002 - DNA, 17 bp, Homo sapiens
attactgtgatttctgg

SEQ ID NO: 6674003 - DNA, 19 bp, Homo sapiens
attactgtgatttctggct

SEQ ID NO: 6674004 - DNA, 15 bp, Homo sapiens
attactgttcttatt

SEQ ID NO: 6674005 - DNA, 19 bp, Homo sapiens
attactgttgataattctt

SEQ ID NO: 6674006 - DNA, 20 bp, Homo sapiens
attactgttgataattctta

SEQ ID NO: 6674007 - DNA, 21 bp, Homo sapiens
attactgttgcatttactttt

SEQ ID NO: 6674008 - DNA, 17 bp, Homo sapiens
attactgtttaagacac

SEQ ID NO: 6674009 - DNA, 24 bp, Homo sapiens
attactgtttaattgacatactca

SEQ ID NO: 6674010 - DNA, 17 bp, Homo sapiens
attactgtttattactt

SEQ ID NO: 6674011 - DNA, 21 bp, Homo sapiens
attactgtttgaaacttttca

SEQ ID NO: 6674012 - DNA, 23 bp, Homo sapiens
attactgtttgaaacttttcaag

SEQ ID NO: 6674013 - DNA, 20 bp, Homo sapiens
attactgtttgtcttctccc

SEQ ID NO: 6674014 - DNA, 17 bp, Homo sapiens
attactgttttatgttg

SEQ ID NO: 6674015 - DNA, 22 bp, Homo sapiens
attactgttttatgttgatctg

SEQ ID NO: 6674016 - DNA, 17 bp, Homo sapiens
attacttaagatgttta

SEQ ID NO: 6674017 - DNA, 11 bp, Homo sapiens
attacttaatg

SEQ ID NO: 6674018 - DNA, 14 bp, Homo sapiens
attacttactgtta

SEQ ID NO: 6674019 - DNA, 20 bp, Homo sapiens
attacttactgttaaaactg

SEQ ID NO: 6674020 - DNA, 21 bp, Homo sapiens
attacttaggttattttgctt

SEQ ID NO: 6674021 - DNA, 15 bp, Homo sapiens
attacttatccctgc

SEQ ID NO: 6674022 - DNA, 19 bp, Homo sapiens
attacttatccctgcccat

SEQ ID NO: 6674023 - DNA, 14 bp, Homo sapiens
attacttatttaac

SEQ ID NO: 6674024 - DNA, 16 bp, Homo sapiens
attacttatttttgac

SEQ ID NO: 6674025 - DNA, 13 bp, Homo sapiens
attacttcagggc

SEQ ID NO: 6674026 - DNA, 22 bp, Homo sapiens
attacttctctataaaaaatat

SEQ ID NO: 6674027 - DNA, 12 bp, Homo sapiens
attacttctgct

SEQ ID NO: 6674028 - DNA, 18 bp, Homo sapiens
attacttgaaacccacag

SEQ ID NO: 6674029 - DNA, 16 bp, Homo sapiens
attacttgaactttcc

SEQ ID NO: 6674030 - DNA, 20 bp, Homo sapiens
attacttgcacaagcttgta

SEQ ID NO: 6674031 - DNA, 18 bp, Homo sapiens
attacttggcaaattctg

SEQ ID NO: 6674032 - DNA, 21 bp, Homo sapiens
attacttgggaaatttttaat

SEQ ID NO: 6674033 - DNA, 13 bp, Homo sapiens
attacttgtaaat

SEQ ID NO: 6674034 - DNA, 15 bp, Homo sapiens
attacttgtaaatat

SEQ ID NO: 6674035 - DNA, 21 bp, Homo sapiens
attacttgtaaatataaagac

SEQ ID NO: 6674036 - DNA, 16 bp, Homo sapiens
attacttgtgttactt

SEQ ID NO: 6674037 - DNA, 19 bp, Homo sapiens
attacttgtgttacttgcc

SEQ ID NO: 6674038 - DNA, 18 bp, Homo sapiens
attacttgttgcctataa

SEQ ID NO: 6674039 - DNA, 23 bp, Homo sapiens
attactttaaattatatgatatg

SEQ ID NO: 6674040 - DNA, 23 bp, Homo sapiens
attactttaccacccccacacct

SEQ ID NO: 6674041 - DNA, 17 bp, Homo sapiens
attactttattataaaa

SEQ ID NO: 6674042 - DNA, 13 bp, Homo sapiens
attactttcagaa

SEQ ID NO: 6674043 - DNA, 16 bp, Homo sapiens
attactttcagaatgt

SEQ ID NO: 6674044 - DNA, 17 bp, Homo sapiens
attactttctctgtagt

SEQ ID NO: 6674045 - DNA, 22 bp, Homo sapiens
attactttctctgtagttccta

SEQ ID NO: 6674046 - DNA, 14 bp, Homo sapiens
attactttctgccg

SEQ ID NO: 6674047 - DNA, 13 bp, Homo sapiens
attactttgaaca

SEQ ID NO: 6674048 - DNA, 22 bp, Homo sapiens
attactttgaacattaatgttg

SEQ ID NO: 6674049 - DNA, 21 bp, Homo sapiens
attactttggggctaatttaa

SEQ ID NO: 6674050 - DNA, 17 bp, Homo sapiens
attactttgtagatgta

SEQ ID NO: 6674051 - DNA, 17 bp, Homo sapiens
attactttgtcttttca

SEQ ID NO: 6674052 - DNA, 14 bp, Homo sapiens
attactttgtttta

SEQ ID NO: 6674053 - DNA, 19 bp, Homo sapiens
attacttttctgcaatgtt

SEQ ID NO: 6674054 - DNA, 18 bp, Homo sapiens
attacttttgcaaactgt

SEQ ID NO: 6674055 - DNA, 20 bp, Homo sapiens
attacttttgtaaatattct

SEQ ID NO: 6674056 - DNA, 19 bp, Homo sapiens
attactttttaaaatgttg

SEQ ID NO: 6674057 - DNA, 12 bp, Homo sapiens
attagaaaactt

SEQ ID NO: 6674058 - DNA, 18 bp, Homo sapiens
attagaaaactttgttag

SEQ ID NO: 6674059 - DNA, 15 bp, Homo sapiens
attagaaaaggaaat

SEQ ID NO: 6674060 - DNA, 22 bp, Homo sapiens
attagaaaaggaaataggtttt

SEQ ID NO: 6674061 - DNA, 20 bp, Homo sapiens
attagaaaaggtatgaaaat

SEQ ID NO: 6674062 - DNA, 13 bp, Homo sapiens
attagaaaatgtt

SEQ ID NO: 6674063 - DNA, 22 bp, Homo sapiens
attagaaaattttgtaaaacaa

SEQ ID NO: 6674064 - DNA, 23 bp, Homo sapiens
attagaaaattttgtaaaacaat

SEQ ID NO: 6674065 - DNA, 23 bp, Homo sapiens
attagaaacaaacaaaactctta

SEQ ID NO: 6674066 - DNA, 18 bp, Homo sapiens
attagaaacacacttttg

SEQ ID NO: 6674067 - DNA, 19 bp, Homo sapiens
attagaaacacacttttgc

SEQ ID NO: 6674068 - DNA, 18 bp, Homo sapiens
attagaaaggctaacaaa

SEQ ID NO: 6674069 - DNA, 19 bp, Homo sapiens
attagaaaggctaacaaat

SEQ ID NO: 6674070 - DNA, 15 bp, Homo sapiens
attagaaataaagca

SEQ ID NO: 6674071 - DNA, 15 bp, Homo sapiens
attagaaatatttta

SEQ ID NO: 6674072 - DNA, 11 bp, Homo sapiens
attagaaatga

SEQ ID NO: 6674073 - DNA, 15 bp, Homo sapiens
attagaaattagaaa

SEQ ID NO: 6674074 - DNA, 13 bp, Homo sapiens
attagaacaatag

SEQ ID NO: 6674075 - DNA, 14 bp, Homo sapiens
attagaacatttaa

SEQ ID NO: 6674076 - DNA, 14 bp, Homo sapiens
attagaacccttgc

SEQ ID NO: 6674077 - DNA, 10 bp, Homo sapiens
attagaactt

SEQ ID NO: 6674078 - DNA, 11 bp, Homo sapiens
attagaacttg

SEQ ID NO: 6674079 - DNA, 14 bp, Homo sapiens
attagaagaaaatg

SEQ ID NO: 6674080 - DNA, 13 bp, Homo sapiens
attagaagacatt

SEQ ID NO: 6674081 - DNA, 21 bp, Homo sapiens
attagaagatattagtcttgg

SEQ ID NO: 6674082 - DNA, 17 bp, Homo sapiens
attagaagtctttcagt

SEQ ID NO: 6674083 - DNA, 18 bp, Homo sapiens
attagaagtgttaactta

SEQ ID NO: 6674084 - DNA, 20 bp, Homo sapiens
attagaagtgttaacttagc

SEQ ID NO: 6674085 - DNA, 13 bp, Homo sapiens
attagaatagtgt

SEQ ID NO: 6674086 - DNA, 15 bp, Homo sapiens
attagaatgcagacg

SEQ ID NO: 6674087 - DNA, 13 bp, Homo sapiens
attagaatgtgat

SEQ ID NO: 6674088 - DNA, 14 bp, Homo sapiens
attagaatgtgatt

SEQ ID NO: 6674089 - DNA, 14 bp, Homo sapiens
attagaattctgta

SEQ ID NO: 6674090 - DNA, 18 bp, Homo sapiens
attagaattctgtataga

SEQ ID NO: 6674091 - DNA, 21 bp, Homo sapiens
attagaattctgtatagatta

SEQ ID NO: 6674092 - DNA, 19 bp, Homo sapiens
attagacacacatatacat

SEQ ID NO: 6674093 - DNA, 13 bp, Homo sapiens
attagacagaaca

SEQ ID NO: 6674094 - DNA, 15 bp, Homo sapiens
attagacagaacacc

SEQ ID NO: 6674095 - DNA, 16 bp, Homo sapiens
attagactcctcctcc

SEQ ID NO: 6674096 - DNA, 19 bp, Homo sapiens
attagactggacagcttgt

SEQ ID NO: 6674097 - DNA, 20 bp, Homo sapiens
attagactggacagcttgtg

SEQ ID NO: 6674098 - DNA, 20 bp, Homo sapiens
attagacttctgttttcaat

SEQ ID NO: 6674099 - DNA, 12 bp, Homo sapiens
attagacttgaa

SEQ ID NO: 6674100 - DNA, 18 bp, Homo sapiens
attagacttgaaatacgt

SEQ ID NO: 6674101 - DNA, 20 bp, Homo sapiens
attagactttagaaataaat

SEQ ID NO: 6674102 - DNA, 15 bp, Homo sapiens
attagagaaaacctt

SEQ ID NO: 6674103 - DNA, 22 bp, Homo sapiens
attagagaaaaccttaaaagta

SEQ ID NO: 6674104 - DNA, 22 bp, Homo sapiens
attagagaaatgaattataact

SEQ ID NO: 6674105 - DNA, 14 bp, Homo sapiens
attagagaacatcc

SEQ ID NO: 6674106 - DNA, 18 bp, Homo sapiens
attagagagtgttgaaac

SEQ ID NO: 6674107 - DNA, 13 bp, Homo sapiens
attagagatgttg

SEQ ID NO: 6674108 - DNA, 16 bp, Homo sapiens
attagagcacagcttc

SEQ ID NO: 6674109 - DNA, 13 bp, Homo sapiens
attagagcaggcg

SEQ ID NO: 6674110 - DNA, 16 bp, Homo sapiens
attagagcctgtaaac

SEQ ID NO: 6674111 - DNA, 17 bp, Homo sapiens
attagagctgcataatg

SEQ ID NO: 6674112 - DNA, 15 bp, Homo sapiens
attagaggaatttaa

SEQ ID NO: 6674113 - DNA, 18 bp, Homo sapiens
attagaggatgtggcagg

SEQ ID NO: 6674114 - DNA, 21 bp, Homo sapiens
attagaggatgtggcaggggc

SEQ ID NO: 6674115 - DNA, 17 bp, Homo sapiens
attagagggacagccaa

SEQ ID NO: 6674116 - DNA, 15 bp, Homo sapiens
attagaggtttgtca

SEQ ID NO: 6674117 - DNA, 12 bp, Homo sapiens
attagagtattt

SEQ ID NO: 6674118 - DNA, 18 bp, Homo sapiens
attagagtatttcccttc

SEQ ID NO: 6674119 - DNA, 15 bp, Homo sapiens
attagagtcagcctt

SEQ ID NO: 6674120 - DNA, 17 bp, Homo sapiens
attagagtgcaaaagtg

SEQ ID NO: 6674121 - DNA, 21 bp, Homo sapiens
attagagtggttattcattat

SEQ ID NO: 6674122 - DNA, 23 bp, Homo sapiens
attagagtgtctttccacggagc

SEQ ID NO: 6674123 - DNA, 14 bp, Homo sapiens
attagagttgtgat

SEQ ID NO: 6674124 - DNA, 22 bp, Homo sapiens
attagataaccatattcacaat

SEQ ID NO: 6674125 - DNA, 13 bp, Homo sapiens
attagataatatt

SEQ ID NO: 6674126 - DNA, 21 bp, Homo sapiens
attagataatcttttacattg

SEQ ID NO: 6674127 - DNA, 19 bp, Homo sapiens
attagatcaaatagttgca

SEQ ID NO: 6674128 - DNA, 14 bp, Homo sapiens
attagatcaacact

SEQ ID NO: 6674129 - DNA, 17 bp, Homo sapiens
attagatcccatattta

SEQ ID NO: 6674130 - DNA, 19 bp, Homo sapiens
attagatcttcaaacagaa

SEQ ID NO: 6674131 - DNA, 20 bp, Homo sapiens
attagatcttcaaacagaat

SEQ ID NO: 6674132 - DNA, 15 bp, Homo sapiens
attagatgactgaat

SEQ ID NO: 6674133 - DNA, 14 bp, Homo sapiens
attagatgcatgtt

SEQ ID NO: 6674134 - DNA, 20 bp, Homo sapiens
attagatgcatgttgaccat

SEQ ID NO: 6674135 - DNA, 21 bp, Homo sapiens
attagatgcatgttgaccatg

SEQ ID NO: 6674136 - DNA, 21 bp, Homo sapiens
attagatggaaaaatgtgaaa

SEQ ID NO: 6674137 - DNA, 13 bp, Homo sapiens
attagatgtcatg

SEQ ID NO: 6674138 - DNA, 20 bp, Homo sapiens
attagatgtcatgaggaaac

SEQ ID NO: 6674139 - DNA, 15 bp, Homo sapiens
attagatgtgattta

SEQ ID NO: 6674140 - DNA, 22 bp, Homo sapiens
attagatgtgatttaatagtgt

SEQ ID NO: 6674141 - DNA, 13 bp, Homo sapiens
attagatgttctc

SEQ ID NO: 6674142 - DNA, 19 bp, Homo sapiens
attagatgttctctatcat

SEQ ID NO: 6674143 - DNA, 23 bp, Homo sapiens
attagatgtttatttagaaactg

SEQ ID NO: 6674144 - DNA, 16 bp, Homo sapiens
attagatgttttacaa

SEQ ID NO: 6674145 - DNA, 18 bp, Homo sapiens
attagattatttctgtat

SEQ ID NO: 6674146 - DNA, 17 bp, Homo sapiens
attagattcctttcctg

SEQ ID NO: 6674147 - DNA, 20 bp, Homo sapiens
attagatttgtgcaaacatg

SEQ ID NO: 6674148 - DNA, 20 bp, Homo sapiens
attagattttaaaacttcat

SEQ ID NO: 6674149 - DNA, 14 bp, Homo sapiens
attagattttagaa

SEQ ID NO: 6674150 - DNA, 21 bp, Homo sapiens
attagcaaaaaaagttgtatg

SEQ ID NO: 6674151 - DNA, 22 bp, Homo sapiens
attagcaaaaaaagttgtatga

SEQ ID NO: 6674152 - DNA, 22 bp, Homo sapiens
attagcaaagcaaaaggctgag

SEQ ID NO: 6674153 - DNA, 14 bp, Homo sapiens
attagcaaggcaga

SEQ ID NO: 6674154 - DNA, 16 bp, Homo sapiens
attagcaaggcagagc

SEQ ID NO: 6674155 - DNA, 19 bp, Homo sapiens
attagcaatcattttatat

SEQ ID NO: 6674156 - DNA, 14 bp, Homo sapiens
attagcaatgaatt

SEQ ID NO: 6674157 - DNA, 14 bp, Homo sapiens
attagcagaatgga

SEQ ID NO: 6674158 - DNA, 21 bp, Homo sapiens
attagcagaatggagaaagta

SEQ ID NO: 6674159 - DNA, 19 bp, Homo sapiens
attagcagccatattgtca

SEQ ID NO: 6674160 - DNA, 21 bp, Homo sapiens
attagcagctatgtaaatgac

SEQ ID NO: 6674161 - DNA, 14 bp, Homo sapiens
attagcagttgctc

SEQ ID NO: 6674162 - DNA, 20 bp, Homo sapiens
attagcatgaaaggtaatct

SEQ ID NO: 6674163 - DNA, 14 bp, Homo sapiens
attagcatgcaagc

SEQ ID NO: 6674164 - DNA, 16 bp, Homo sapiens
attagcatgcaagctt

SEQ ID NO: 6674165 - DNA, 17 bp, Homo sapiens
attagcatgcaagcttg

SEQ ID NO: 6674166 - DNA, 15 bp, Homo sapiens
attagcatgctgctt

SEQ ID NO: 6674167 - DNA, 14 bp, Homo sapiens
attagcatggcggc

SEQ ID NO: 6674168 - DNA, 13 bp, Homo sapiens
attagcattctgt

SEQ ID NO: 6674169 - DNA, 14 bp, Homo sapiens
attagcatttagtc

SEQ ID NO: 6674170 - DNA, 20 bp, Homo sapiens
attagcatttgttttagcat

SEQ ID NO: 6674171 - DNA, 22 bp, Homo sapiens
attagccaactgtttccctgct

SEQ ID NO: 6674172 - DNA, 11 bp, Homo sapiens
attagccaggt

SEQ ID NO: 6674173 - DNA, 12 bp, Homo sapiens
attagccagtaa

SEQ ID NO: 6674174 - DNA, 17 bp, Homo sapiens
attagccagtgaaaaac

SEQ ID NO: 6674175 - DNA, 15 bp, Homo sapiens
attagccgggcatgg

SEQ ID NO: 6674176 - DNA, 21 bp, Homo sapiens
attagccgggcatggtggcag

SEQ ID NO: 6674177 - DNA, 23 bp, Homo sapiens
attagccgggcatggtggcatgt

SEQ ID NO: 6674178 - DNA, 20 bp, Homo sapiens
attagcctcgtctttcagcg

SEQ ID NO: 6674179 - DNA, 23 bp, Homo sapiens
attagcctcgtctttcagcgagc

SEQ ID NO: 6674180 - DNA, 20 bp, Homo sapiens
attagcgacaacagattgga

SEQ ID NO: 6674181 - DNA, 16 bp, Homo sapiens
attagctaattagaaa

SEQ ID NO: 6674182 - DNA, 23 bp, Homo sapiens
attagctatatttttatataata

SEQ ID NO: 6674183 - DNA, 17 bp, Homo sapiens
attagctatttctgctc

SEQ ID NO: 6674184 - DNA, 19 bp, Homo sapiens
attagctgggatatgtagt

SEQ ID NO: 6674185 - DNA, 20 bp, Homo sapiens
attagctgtaaatacatgtg

SEQ ID NO: 6674186 - DNA, 13 bp, Homo sapiens
attagcttaccca

SEQ ID NO: 6674187 - DNA, 22 bp, Homo sapiens
attagcttacccaatgggaccg

SEQ ID NO: 6674188 - DNA, 13 bp, Homo sapiens
attagctttgtgt

SEQ ID NO: 6674189 - DNA, 15 bp, Homo sapiens
attagctttgtgttt

SEQ ID NO: 6674190 - DNA, 21 bp, Homo sapiens
attagctttgtgtttggttta

SEQ ID NO: 6674191 - DNA, 21 bp, Homo sapiens
attagcttttagttttaaaac

SEQ ID NO: 6674192 - DNA, 16 bp, Homo sapiens
attagctttttcatcc

SEQ ID NO: 6674193 - DNA, 21 bp, Homo sapiens
attaggaacagagtatatatg

SEQ ID NO: 6674194 - DNA, 23 bp, Homo sapiens
attaggaacagagtatatatgta

SEQ ID NO: 6674195 - DNA, 19 bp, Homo sapiens
attaggaaccttgcaacgg

SEQ ID NO: 6674196 - DNA, 22 bp, Homo sapiens
attaggaagtgtaacagctgag

SEQ ID NO: 6674197 - DNA, 15 bp, Homo sapiens
attaggaagtgttta

SEQ ID NO: 6674198 - DNA, 23 bp, Homo sapiens
attaggaatgggataagaaggtg

SEQ ID NO: 6674199 - DNA, 16 bp, Homo sapiens
attaggaattgtttat

SEQ ID NO: 6674200 - DNA, 23 bp, Homo sapiens
attaggaattgtttatacacaac

SEQ ID NO: 6674201 - DNA, 17 bp, Homo sapiens
attaggaggctcaacaa

SEQ ID NO: 6674202 - DNA, 17 bp, Homo sapiens
attaggagtaattcttt

SEQ ID NO: 6674203 - DNA, 16 bp, Homo sapiens
attaggatctatgcaa

SEQ ID NO: 6674204 - DNA, 17 bp, Homo sapiens
attaggatctatgcaat

SEQ ID NO: 6674205 - DNA, 22 bp, Homo sapiens
attaggatctgcaaacaatgaa

SEQ ID NO: 6674206 - DNA, 21 bp, Homo sapiens
attaggcaaaaataatttatt

SEQ ID NO: 6674207 - DNA, 16 bp, Homo sapiens
attaggcaaagtacaa

SEQ ID NO: 6674208 - DNA, 21 bp, Homo sapiens
attaggcaaggctatgtgatt

SEQ ID NO: 6674209 - DNA, 14 bp, Homo sapiens
attaggcacacaga

SEQ ID NO: 6674210 - DNA, 11 bp, Homo sapiens
attaggcctgg

SEQ ID NO: 6674211 - DNA, 15 bp, Homo sapiens
attaggctgtaacta

SEQ ID NO: 6674212 - DNA, 17 bp, Homo sapiens
attaggctgtaactact

SEQ ID NO: 6674213 - DNA, 12 bp, Homo sapiens
attaggctttag

SEQ ID NO: 6674214 - DNA, 17 bp, Homo sapiens
attagggagaaaattca

SEQ ID NO: 6674215 - DNA, 15 bp, Homo sapiens
attagggagctcttg

SEQ ID NO: 6674216 - DNA, 15 bp, Homo sapiens
attagggatgcctcc

SEQ ID NO: 6674217 - DNA, 18 bp, Homo sapiens
attagggcaattggaaca

SEQ ID NO: 6674218 - DNA, 18 bp, Homo sapiens
attagggccctgtgtctg

SEQ ID NO: 6674219 - DNA, 18 bp, Homo sapiens
attaggggattcttcttt

SEQ ID NO: 6674220 - DNA, 23 bp, Homo sapiens
attaggggcaatagtagaatgga

SEQ ID NO: 6674221 - DNA, 15 bp, Homo sapiens
attaggggttgctaa

SEQ ID NO: 6674222 - DNA, 22 bp, Homo sapiens
attagggttgcctcactgtagc

SEQ ID NO: 6674223 - DNA, 14 bp, Homo sapiens
attaggtagcacag

SEQ ID NO: 6674224 - DNA, 15 bp, Homo sapiens
attaggtagcacagc

SEQ ID NO: 6674225 - DNA, 12 bp, Homo sapiens
attaggtatgtt

SEQ ID NO: 6674226 - DNA, 13 bp, Homo sapiens
attaggtcacatt

SEQ ID NO: 6674227 - DNA, 22 bp, Homo sapiens
attaggtcttaaagtagttact

SEQ ID NO: 6674228 - DNA, 15 bp, Homo sapiens
attaggtcttgctgg

SEQ ID NO: 6674229 - DNA, 16 bp, Homo sapiens
attaggtcttgctgga

SEQ ID NO: 6674230 - DNA, 17 bp, Homo sapiens
attaggtgaagggatgg

SEQ ID NO: 6674231 - DNA, 23 bp, Homo sapiens
attaggtgatcccgttttcccca

SEQ ID NO: 6674232 - DNA, 18 bp, Homo sapiens
attaggtgtgactgaatt

SEQ ID NO: 6674233 - DNA, 20 bp, Homo sapiens
attaggttaactatgtacaa

SEQ ID NO: 6674234 - DNA, 13 bp, Homo sapiens
attaggttgtgaa

SEQ ID NO: 6674235 - DNA, 16 bp, Homo sapiens
attaggtttagaatca

SEQ ID NO: 6674236 - DNA, 18 bp, Homo sapiens
attaggtttcagcagagc

SEQ ID NO: 6674237 - DNA, 15 bp, Homo sapiens
attaggttttgtaca

SEQ ID NO: 6674238 - DNA, 20 bp, Homo sapiens
attagtaaatatgtgaagaa

SEQ ID NO: 6674239 - DNA, 17 bp, Homo sapiens
attagtaaatgtctttg

SEQ ID NO: 6674240 - DNA, 20 bp, Homo sapiens
attagtaaatgtctttgtaa

SEQ ID NO: 6674241 - DNA, 17 bp, Homo sapiens
attagtaacatgtgtta

SEQ ID NO: 6674242 - DNA, 19 bp, Homo sapiens
attagtaactgttcctact

SEQ ID NO: 6674243 - DNA, 12 bp, Homo sapiens
attagtaagatc

SEQ ID NO: 6674244 - DNA, 15 bp, Homo sapiens
attagtaattgtaag

SEQ ID NO: 6674245 - DNA, 20 bp, Homo sapiens
attagtaatttatatagatg

SEQ ID NO: 6674246 - DNA, 21 bp, Homo sapiens
attagtaatttatatagatgt

SEQ ID NO: 6674247 - DNA, 19 bp, Homo sapiens
attagtacacagcaccaga

SEQ ID NO: 6674248 - DNA, 18 bp, Homo sapiens
attagtactttatagaag

SEQ ID NO: 6674249 - DNA, 14 bp, Homo sapiens
attagtagaaaata

SEQ ID NO: 6674250 - DNA, 16 bp, Homo sapiens
attagtagaaatgcca

SEQ ID NO: 6674251 - DNA, 12 bp, Homo sapiens
attagtataata

SEQ ID NO: 6674252 - DNA, 13 bp, Homo sapiens
attagtataatat

SEQ ID NO: 6674253 - DNA, 15 bp, Homo sapiens
attagtatcctgtta

SEQ ID NO: 6674254 - DNA, 21 bp, Homo sapiens
attagtatggttcaagattgt

SEQ ID NO: 6674255 - DNA, 13 bp, Homo sapiens
attagtatgtctg

SEQ ID NO: 6674256 - DNA, 14 bp, Homo sapiens
attagtatgtctgt

SEQ ID NO: 6674257 - DNA, 13 bp, Homo sapiens
attagtattcagg

SEQ ID NO: 6674258 - DNA, 18 bp, Homo sapiens
attagtattcaggcactg

SEQ ID NO: 6674259 - DNA, 13 bp, Homo sapiens
attagtattctaa

SEQ ID NO: 6674260 - DNA, 13 bp, Homo sapiens
attagtattgttg

SEQ ID NO: 6674261 - DNA, 17 bp, Homo sapiens
attagtattgttgtcct

SEQ ID NO: 6674262 - DNA, 23 bp, Homo sapiens
attagtattgttgtccttttcat

SEQ ID NO: 6674263 - DNA, 23 bp, Homo sapiens
attagtatttatttaatgttatg

SEQ ID NO: 6674264 - DNA, 23 bp, Homo sapiens
attagtcacctaaccctctgtca

SEQ ID NO: 6674265 - DNA, 23 bp, Homo sapiens
attagtccaaggcctttttcata

SEQ ID NO: 6674266 - DNA, 15 bp, Homo sapiens
attagtcctcacagc

SEQ ID NO: 6674267 - DNA, 21 bp, Homo sapiens
attagtcgttatatttgactt

SEQ ID NO: 6674268 - DNA, 18 bp, Homo sapiens
attagtgaactaagttat

SEQ ID NO: 6674269 - DNA, 22 bp, Homo sapiens
attagtgaactaagttattgtt

SEQ ID NO: 6674270 - DNA, 15 bp, Homo sapiens
attagtgaagtatgc

SEQ ID NO: 6674271 - DNA, 21 bp, Homo sapiens
attagtgagacatcagggagt

SEQ ID NO: 6674272 - DNA, 21 bp, Homo sapiens
attagtgagattaaaaatcta

SEQ ID NO: 6674273 - DNA, 16 bp, Homo sapiens
attagtgatatttctc

SEQ ID NO: 6674274 - DNA, 23 bp, Homo sapiens
attagtgatatttctctagtagt

SEQ ID NO: 6674275 - DNA, 18 bp, Homo sapiens
attagtgattctgatttc

SEQ ID NO: 6674276 - DNA, 13 bp, Homo sapiens
attagtgcaataa

SEQ ID NO: 6674277 - DNA, 22 bp, Homo sapiens
attagtgccaagtttttcagaa

SEQ ID NO: 6674278 - DNA, 22 bp, Homo sapiens
attagtgccacttaatgtatgt

SEQ ID NO: 6674279 - DNA, 18 bp, Homo sapiens
attagtgccagaatttta

SEQ ID NO: 6674280 - DNA, 22 bp, Homo sapiens
attagtgtatgctttgaatgta

SEQ ID NO: 6674281 - DNA, 16 bp, Homo sapiens
attagtgtcccccctt

SEQ ID NO: 6674282 - DNA, 23 bp, Homo sapiens
attagtgtccccccttgaagcaa

SEQ ID NO: 6674283 - DNA, 14 bp, Homo sapiens
attagtgtctccag

SEQ ID NO: 6674284 - DNA, 15 bp, Homo sapiens
attagtgttatatga

SEQ ID NO: 6674285 - DNA, 19 bp, Homo sapiens
attagtgttatatgaacat

SEQ ID NO: 6674286 - DNA, 12 bp, Homo sapiens
attagtgttttc

SEQ ID NO: 6674287 - DNA, 13 bp, Homo sapiens
attagtgttttca

SEQ ID NO: 6674288 - DNA, 19 bp, Homo sapiens
attagtgttttcattctgg

SEQ ID NO: 6674289 - DNA, 15 bp, Homo sapiens
attagttaaaacaca

SEQ ID NO: 6674290 - DNA, 18 bp, Homo sapiens
attagttacaaagttata

SEQ ID NO: 6674291 - DNA, 17 bp, Homo sapiens
attagttacttgctata

SEQ ID NO: 6674292 - DNA, 15 bp, Homo sapiens
attagttatgtcttt

SEQ ID NO: 6674293 - DNA, 18 bp, Homo sapiens
attagttatgtcttttaa

SEQ ID NO: 6674294 - DNA, 21 bp, Homo sapiens
attagttccagtttctccttg

SEQ ID NO: 6674295 - DNA, 21 bp, Homo sapiens
attagttccctgtctcttgaa

SEQ ID NO: 6674296 - DNA, 17 bp, Homo sapiens
attagttctatttctat

SEQ ID NO: 6674297 - DNA, 21 bp, Homo sapiens
attagttgaatataagaaaat

SEQ ID NO: 6674298 - DNA, 16 bp, Homo sapiens
attagttgacagtatt

SEQ ID NO: 6674299 - DNA, 19 bp, Homo sapiens
attagttgcactaactgct

SEQ ID NO: 6674300 - DNA, 13 bp, Homo sapiens
attagttgcattg

SEQ ID NO: 6674301 - DNA, 15 bp, Homo sapiens
attagttgccaatat

SEQ ID NO: 6674302 - DNA, 14 bp, Homo sapiens
attagttgctttgt

SEQ ID NO: 6674303 - DNA, 17 bp, Homo sapiens
attagttggctttcata

SEQ ID NO: 6674304 - DNA, 18 bp, Homo sapiens
attagttggctttcataa

SEQ ID NO: 6674305 - DNA, 14 bp, Homo sapiens
attagttgggatgc

SEQ ID NO: 6674306 - DNA, 23 bp, Homo sapiens
attagtttaaaatgaagcaattt

SEQ ID NO: 6674307 - DNA, 18 bp, Homo sapiens
attagtttacatcatttt

SEQ ID NO: 6674308 - DNA, 20 bp, Homo sapiens
attagtttaccacttgcctt

SEQ ID NO: 6674309 - DNA, 18 bp, Homo sapiens
attagtttatattactct

SEQ ID NO: 6674310 - DNA, 20 bp, Homo sapiens
attagtttcctttttaatat

SEQ ID NO: 6674311 - DNA, 14 bp, Homo sapiens
attagttttaaaat

SEQ ID NO: 6674312 - DNA, 15 bp, Homo sapiens
attagttttctgtat

SEQ ID NO: 6674313 - DNA, 14 bp, Homo sapiens
attagttttcttgt

SEQ ID NO: 6674314 - DNA, 18 bp, Homo sapiens
attataaaaaatgtaaca

SEQ ID NO: 6674315 - DNA, 15 bp, Homo sapiens
attataaaaaattaa

SEQ ID NO: 6674316 - DNA, 14 bp, Homo sapiens
attataaaaatatt

SEQ ID NO: 6674317 - DNA, 14 bp, Homo sapiens
attataaaaatgaa

SEQ ID NO: 6674318 - DNA, 14 bp, Homo sapiens
attataaaaccatg

SEQ ID NO: 6674319 - DNA, 11 bp, Homo sapiens
attataaaagc

SEQ ID NO: 6674320 - DNA, 14 bp, Homo sapiens
attataaaatcttt

SEQ ID NO: 6674321 - DNA, 18 bp, Homo sapiens
attataaaattaatcaca

SEQ ID NO: 6674322 - DNA, 18 bp, Homo sapiens
attataaaattattttta

SEQ ID NO: 6674323 - DNA, 22 bp, Homo sapiens
attataaaattgaaaacactaa

SEQ ID NO: 6674324 - DNA, 23 bp, Homo sapiens
attataaaattgaaaacactaac

SEQ ID NO: 6674325 - DNA, 21 bp, Homo sapiens
attataaacaacagaaacttc

SEQ ID NO: 6674326 - DNA, 18 bp, Homo sapiens
attataaacaagaatgaa

SEQ ID NO: 6674327 - DNA, 14 bp, Homo sapiens
attataaacagcag

SEQ ID NO: 6674328 - DNA, 13 bp, Homo sapiens
attataaactata

SEQ ID NO: 6674329 - DNA, 11 bp, Homo sapiens
attataaactt

SEQ ID NO: 6674330 - DNA, 18 bp, Homo sapiens
attataaaggataaagaa

SEQ ID NO: 6674331 - DNA, 19 bp, Homo sapiens
attataaagttcagatgtt

SEQ ID NO: 6674332 - DNA, 16 bp, Homo sapiens
attataaagttttcta

SEQ ID NO: 6674333 - DNA, 15 bp, Homo sapiens
attataaataaatgc

SEQ ID NO: 6674334 - DNA, 19 bp, Homo sapiens
attataaatatatataaag

SEQ ID NO: 6674335 - DNA, 20 bp, Homo sapiens
attataaatatatataaaga

SEQ ID NO: 6674336 - DNA, 19 bp, Homo sapiens
attataaatgaaatttgca

SEQ ID NO: 6674337 - DNA, 12 bp, Homo sapiens
attataaatgac

SEQ ID NO: 6674338 - DNA, 12 bp, Homo sapiens
attataaatgtt

SEQ ID NO: 6674339 - DNA, 15 bp, Homo sapiens
attataaatgttagt

SEQ ID NO: 6674340 - DNA, 16 bp, Homo sapiens
attataaatgttagtt

SEQ ID NO: 6674341 - DNA, 16 bp, Homo sapiens
attataaatgtttcat

SEQ ID NO: 6674342 - DNA, 15 bp, Homo sapiens
attataaattatgtt

SEQ ID NO: 6674343 - DNA, 16 bp, Homo sapiens
attataacaactattt

SEQ ID NO: 6674344 - DNA, 17 bp, Homo sapiens
attataacagttatatt

SEQ ID NO: 6674345 - DNA, 14 bp, Homo sapiens
attataaccttaat

SEQ ID NO: 6674346 - DNA, 14 bp, Homo sapiens
attataactagaca

SEQ ID NO: 6674347 - DNA, 19 bp, Homo sapiens
attataactattacagtgt

SEQ ID NO: 6674348 - DNA, 15 bp, Homo sapiens
attataacttaaaat

SEQ ID NO: 6674349 - DNA, 18 bp, Homo sapiens
attataacttattagcag

SEQ ID NO: 6674350 - DNA, 22 bp, Homo sapiens
attataacttgtctaaataagt

SEQ ID NO: 6674351 - DNA, 17 bp, Homo sapiens
attataagcattgaaat

SEQ ID NO: 6674352 - DNA, 18 bp, Homo sapiens
attataagccctgcataa

SEQ ID NO: 6674353 - DNA, 19 bp, Homo sapiens
attataagccctgcataat

SEQ ID NO: 6674354 - DNA, 20 bp, Homo sapiens
attataagccctgcataatg

SEQ ID NO: 6674355 - DNA, 23 bp, Homo sapiens
attataagccctgcataatgtta

SEQ ID NO: 6674356 - DNA, 18 bp, Homo sapiens
attataagctatgtcact

SEQ ID NO: 6674357 - DNA, 18 bp, Homo sapiens
attataagggcaaattgg

SEQ ID NO: 6674358 - DNA, 23 bp, Homo sapiens
attataagggcaaattggagaaa

SEQ ID NO: 6674359 - DNA, 21 bp, Homo sapiens
attataagggccctgccctgt

SEQ ID NO: 6674360 - DNA, 15 bp, Homo sapiens
attataagtaacttg

SEQ ID NO: 6674361 - DNA, 17 bp, Homo sapiens
attataagtcttacata

SEQ ID NO: 6674362 - DNA, 16 bp, Homo sapiens
attataagttctattt

SEQ ID NO: 6674363 - DNA, 17 bp, Homo sapiens
attataagttctatttt

SEQ ID NO: 6674364 - DNA, 11 bp, Homo sapiens
attataagttg

SEQ ID NO: 6674365 - DNA, 14 bp, Homo sapiens
attataagttgacc

SEQ ID NO: 6674366 - DNA, 16 bp, Homo sapiens
attataagttgacctt

SEQ ID NO: 6674367 - DNA, 17 bp, Homo sapiens
attataagttgaccttt

SEQ ID NO: 6674368 - DNA, 14 bp, Homo sapiens
attataataaaatt

SEQ ID NO: 6674369 - DNA, 15 bp, Homo sapiens
attataataaaggtc

SEQ ID NO: 6674370 - DNA, 16 bp, Homo sapiens
attataataaaggtca

SEQ ID NO: 6674371 - DNA, 17 bp, Homo sapiens
attataataaaggtcac

SEQ ID NO: 6674372 - DNA, 15 bp, Homo sapiens
attataataaatata

SEQ ID NO: 6674373 - DNA, 17 bp, Homo sapiens
attataataagcaaaaa

SEQ ID NO: 6674374 - DNA, 18 bp, Homo sapiens
attataatatgtgcctta

SEQ ID NO: 6674375 - DNA, 19 bp, Homo sapiens
attataatatgtgccttaa

SEQ ID NO: 6674376 - DNA, 18 bp, Homo sapiens
attataatcttataattg

SEQ ID NO: 6674377 - DNA, 16 bp, Homo sapiens
attataatgcatctaa

SEQ ID NO: 6674378 - DNA, 17 bp, Homo sapiens
attataatgcatctaaa

SEQ ID NO: 6674379 - DNA, 21 bp, Homo sapiens
attataatgccagaatataat

SEQ ID NO: 6674380 - DNA, 17 bp, Homo sapiens
attataatgctatttta

SEQ ID NO: 6674381 - DNA, 18 bp, Homo sapiens
attataatgtgcccaaag

SEQ ID NO: 6674382 - DNA, 20 bp, Homo sapiens
attataattgtaatggattt

SEQ ID NO: 6674383 - DNA, 13 bp, Homo sapiens
attataattgttg

SEQ ID NO: 6674384 - DNA, 19 bp, Homo sapiens
attataatttgggtgacta

SEQ ID NO: 6674385 - DNA, 22 bp, Homo sapiens
attataatttttttcaatattt

SEQ ID NO: 6674386 - DNA, 13 bp, Homo sapiens
attatacaaaaga

SEQ ID NO: 6674387 - DNA, 23 bp, Homo sapiens
attatacaaaagagcatggatgc

SEQ ID NO: 6674388 - DNA, 22 bp, Homo sapiens
attatacagaccgaactgttgt

SEQ ID NO: 6674389 - DNA, 20 bp, Homo sapiens
attatacagacctaatatca

SEQ ID NO: 6674390 - DNA, 21 bp, Homo sapiens
attatacagacctaatatcat

SEQ ID NO: 6674391 - DNA, 13 bp, Homo sapiens
attatacaggaaa

SEQ ID NO: 6674392 - DNA, 22 bp, Homo sapiens
attatacatcaattggaaatca

SEQ ID NO: 6674393 - DNA, 17 bp, Homo sapiens
attatacatgaaattca

SEQ ID NO: 6674394 - DNA, 21 bp, Homo sapiens
attatacatgtgatacatttt

SEQ ID NO: 6674395 - DNA, 18 bp, Homo sapiens
attataccaaaatgttgc

SEQ ID NO: 6674396 - DNA, 19 bp, Homo sapiens
attataccaaaatgttgct

SEQ ID NO: 6674397 - DNA, 20 bp, Homo sapiens
attataccaaaatgttgctg

SEQ ID NO: 6674398 - DNA, 13 bp, Homo sapiens
attataccaagag

SEQ ID NO: 6674399 - DNA, 22 bp, Homo sapiens
attataccaagagtatgagaaa

SEQ ID NO: 6674400 - DNA, 20 bp, Homo sapiens
attataccagatgaacattt

SEQ ID NO: 6674401 - DNA, 22 bp, Homo sapiens
attataccagatgaacatttca

SEQ ID NO: 6674402 - DNA, 19 bp, Homo sapiens
attataccatgtgtgctaa

SEQ ID NO: 6674403 - DNA, 20 bp, Homo sapiens
attataccccatgataccta

SEQ ID NO: 6674404 - DNA, 19 bp, Homo sapiens
attataccgcagagtattt

SEQ ID NO: 6674405 - DNA, 17 bp, Homo sapiens
attatactaagaaaaga

SEQ ID NO: 6674406 - DNA, 17 bp, Homo sapiens
attatactgaagctagt

SEQ ID NO: 6674407 - DNA, 16 bp, Homo sapiens
attatactgtgtgtga

SEQ ID NO: 6674408 - DNA, 16 bp, Homo sapiens
attatactgttatcca

SEQ ID NO: 6674409 - DNA, 16 bp, Homo sapiens
attatacttgtaatta

SEQ ID NO: 6674410 - DNA, 18 bp, Homo sapiens
attatacttgtaattatg

SEQ ID NO: 6674411 - DNA, 16 bp, Homo sapiens
attatactttatatct

SEQ ID NO: 6674412 - DNA, 18 bp, Homo sapiens
attatactttatcaaaga

SEQ ID NO: 6674413 - DNA, 14 bp, Homo sapiens
attatagaaaatta

SEQ ID NO: 6674414 - DNA, 15 bp, Homo sapiens
attatagaaattact

SEQ ID NO: 6674415 - DNA, 19 bp, Homo sapiens
attatagacaaaagaataa

SEQ ID NO: 6674416 - DNA, 16 bp, Homo sapiens
attatagagcagaaat

SEQ ID NO: 6674417 - DNA, 17 bp, Homo sapiens
attatagagcagaaatt

SEQ ID NO: 6674418 - DNA, 19 bp, Homo sapiens
attatagagcagaaattct

SEQ ID NO: 6674419 - DNA, 21 bp, Homo sapiens
attatagagcagaaattctgt

SEQ ID NO: 6674420 - DNA, 18 bp, Homo sapiens
attatagattctaaagat

SEQ ID NO: 6674421 - DNA, 19 bp, Homo sapiens
attatagattctaaagatt

SEQ ID NO: 6674422 - DNA, 22 bp, Homo sapiens
attatagcaatgtgattttgta

SEQ ID NO: 6674423 - DNA, 23 bp, Homo sapiens
attatagcacgaagctatgagaa

SEQ ID NO: 6674424 - DNA, 16 bp, Homo sapiens
attatagcgcctgtat

SEQ ID NO: 6674425 - DNA, 23 bp, Homo sapiens
attatagcgcctgtataagtaga

SEQ ID NO: 6674426 - DNA, 21 bp, Homo sapiens
attatagctctaatgtttgca

SEQ ID NO: 6674427 - DNA, 22 bp, Homo sapiens
attatagctctaatgtttgcat

SEQ ID NO: 6674428 - DNA, 15 bp, Homo sapiens
attatagcttttaag

SEQ ID NO: 6674429 - DNA, 17 bp, Homo sapiens
attataggagccttaat

SEQ ID NO: 6674430 - DNA, 16 bp, Homo sapiens
attataggccaaactg

SEQ ID NO: 6674431 - DNA, 21 bp, Homo sapiens
attataggtaatcaatgaata

SEQ ID NO: 6674432 - DNA, 16 bp, Homo sapiens
attatagtaaatctat

SEQ ID NO: 6674433 - DNA, 15 bp, Homo sapiens
attatagtactgctt

SEQ ID NO: 6674434 - DNA, 21 bp, Homo sapiens
attatagtactgctttactgt

SEQ ID NO: 6674435 - DNA, 15 bp, Homo sapiens
attatagtgaaacat

SEQ ID NO: 6674436 - DNA, 18 bp, Homo sapiens
attatagtgaaacatgta

SEQ ID NO: 6674437 - DNA, 21 bp, Homo sapiens
attatagttattcaaatccat

SEQ ID NO: 6674438 - DNA, 16 bp, Homo sapiens
attatataaactgtgc

SEQ ID NO: 6674439 - DNA, 11 bp, Homo sapiens
attatataaca

SEQ ID NO: 6674440 - DNA, 15 bp, Homo sapiens
attatataactcttt

SEQ ID NO: 6674441 - DNA, 20 bp, Homo sapiens
attatataagcaaaatgaaa

SEQ ID NO: 6674442 - DNA, 15 bp, Homo sapiens
attatataaggcatt

SEQ ID NO: 6674443 - DNA, 20 bp, Homo sapiens
attatatatacattagacac

SEQ ID NO: 6674444 - DNA, 15 bp, Homo sapiens
attatatatactata

SEQ ID NO: 6674445 - DNA, 14 bp, Homo sapiens
attatatatagaaa

SEQ ID NO: 6674446 - DNA, 16 bp, Homo sapiens
attatatatagaaaag

SEQ ID NO: 6674447 - DNA, 17 bp, Homo sapiens
attatatatataatata

SEQ ID NO: 6674448 - DNA, 13 bp, Homo sapiens
attatatatatat

SEQ ID NO: 6674449 - DNA, 16 bp, Homo sapiens
attatatatatctata

SEQ ID NO: 6674450 - DNA, 13 bp, Homo sapiens
attatatatcata

SEQ ID NO: 6674451 - DNA, 14 bp, Homo sapiens
attatatattgttg

SEQ ID NO: 6674452 - DNA, 14 bp, Homo sapiens
attatatatttaca

SEQ ID NO: 6674453 - DNA, 17 bp, Homo sapiens
attatatatttacagaa

SEQ ID NO: 6674454 - DNA, 16 bp, Homo sapiens
attatatatttatagc

SEQ ID NO: 6674455 - DNA, 21 bp, Homo sapiens
attatatattttgttgttcct

SEQ ID NO: 6674456 - DNA, 15 bp, Homo sapiens
attatatatttttct

SEQ ID NO: 6674457 - DNA, 16 bp, Homo sapiens
attatatcaaggtaaa

SEQ ID NO: 6674458 - DNA, 19 bp, Homo sapiens
attatatcaatttcctcat

SEQ ID NO: 6674459 - DNA, 19 bp, Homo sapiens
attatatcagcttttctga

SEQ ID NO: 6674460 - DNA, 20 bp, Homo sapiens
attatatctaatttatacaa

SEQ ID NO: 6674461 - DNA, 18 bp, Homo sapiens
attatatctgaggaattc

SEQ ID NO: 6674462 - DNA, 18 bp, Homo sapiens
attatatctgtggtcttc

SEQ ID NO: 6674463 - DNA, 13 bp, Homo sapiens
attatatctgttt

SEQ ID NO: 6674464 - DNA, 23 bp, Homo sapiens
attatatgaagtttaaattctag

SEQ ID NO: 6674465 - DNA, 14 bp, Homo sapiens
attatatgatatgc

SEQ ID NO: 6674466 - DNA, 21 bp, Homo sapiens
attatatgcctgattcatagt

SEQ ID NO: 6674467 - DNA, 18 bp, Homo sapiens
attatatgctatttctat

SEQ ID NO: 6674468 - DNA, 18 bp, Homo sapiens
attatatggaaatatata

SEQ ID NO: 6674469 - DNA, 20 bp, Homo sapiens
attatatggaaatatatatt

SEQ ID NO: 6674470 - DNA, 21 bp, Homo sapiens
attatatggaaatatatatta

SEQ ID NO: 6674471 - DNA, 17 bp, Homo sapiens
attatatggcaggagct

SEQ ID NO: 6674472 - DNA, 20 bp, Homo sapiens
attatatgggtatatattca

SEQ ID NO: 6674473 - DNA, 17 bp, Homo sapiens
attatatgttgtaagca

SEQ ID NO: 6674474 - DNA, 16 bp, Homo sapiens
attatattatgtttaa

SEQ ID NO: 6674475 - DNA, 20 bp, Homo sapiens
attatattattagttttgat

SEQ ID NO: 6674476 - DNA, 21 bp, Homo sapiens
attatattcaatgcatttaaa

SEQ ID NO: 6674477 - DNA, 23 bp, Homo sapiens
attatattcctctaaaactctca

SEQ ID NO: 6674478 - DNA, 13 bp, Homo sapiens
attatattctaat

SEQ ID NO: 6674479 - DNA, 19 bp, Homo sapiens
attatattctgtttattat

SEQ ID NO: 6674480 - DNA, 14 bp, Homo sapiens
attatattgagaca

SEQ ID NO: 6674481 - DNA, 17 bp, Homo sapiens
attatattgagacaaaa

SEQ ID NO: 6674482 - DNA, 21 bp, Homo sapiens
attatattgagacaaaaatta

SEQ ID NO: 6674483 - DNA, 14 bp, Homo sapiens
attatattgcaatg

SEQ ID NO: 6674484 - DNA, 18 bp, Homo sapiens
attatattgtatttaacc

SEQ ID NO: 6674485 - DNA, 16 bp, Homo sapiens
attatattgtccaggc

SEQ ID NO: 6674486 - DNA, 16 bp, Homo sapiens
attatatttacaaatg

SEQ ID NO: 6674487 - DNA, 21 bp, Homo sapiens
attatatttctacagagaaaa

SEQ ID NO: 6674488 - DNA, 22 bp, Homo sapiens
attatatttctattttattatg

SEQ ID NO: 6674489 - DNA, 23 bp, Homo sapiens
attatatttctattttattatga

SEQ ID NO: 6674490 - DNA, 18 bp, Homo sapiens
attatatttgaaatcgtt

SEQ ID NO: 6674491 - DNA, 21 bp, Homo sapiens
attatatttgagtttctttca

SEQ ID NO: 6674492 - DNA, 16 bp, Homo sapiens
attatatttgcattat

SEQ ID NO: 6674493 - DNA, 12 bp, Homo sapiens
attatatttgga

SEQ ID NO: 6674494 - DNA, 15 bp, Homo sapiens
attatatttggatgc

SEQ ID NO: 6674495 - DNA, 18 bp, Homo sapiens
attatatttttgtaaata

SEQ ID NO: 6674496 - DNA, 15 bp, Homo sapiens
attatattttttcta

SEQ ID NO: 6674497 - DNA, 14 bp, Homo sapiens
attatcaaaattct

SEQ ID NO: 6674498 - DNA, 15 bp, Homo sapiens
attatcaaagcattg

SEQ ID NO: 6674499 - DNA, 22 bp, Homo sapiens
attatcaagctaataaaatatc

SEQ ID NO: 6674500 - DNA, 17 bp, Homo sapiens
attatcaatatctaata

SEQ ID NO: 6674501 - DNA, 17 bp, Homo sapiens
attatcaatgaaaattt

SEQ ID NO: 6674502 - DNA, 19 bp, Homo sapiens
attatcaattaccacacca

SEQ ID NO: 6674503 - DNA, 16 bp, Homo sapiens
attatcaccaggattt

SEQ ID NO: 6674504 - DNA, 20 bp, Homo sapiens
attatcactgaaaaaatgta

SEQ ID NO: 6674505 - DNA, 12 bp, Homo sapiens
attatcagatgc

SEQ ID NO: 6674506 - DNA, 13 bp, Homo sapiens
attatcagcaaag

SEQ ID NO: 6674507 - DNA, 16 bp, Homo sapiens
attatcagtagaaaga

SEQ ID NO: 6674508 - DNA, 20 bp, Homo sapiens
attatcagtcatgaggaaag

SEQ ID NO: 6674509 - DNA, 14 bp, Homo sapiens
attatcagtgaata

SEQ ID NO: 6674510 - DNA, 19 bp, Homo sapiens
attatcagtgaatataaat

SEQ ID NO: 6674511 - DNA, 22 bp, Homo sapiens
attatcagttatattttgctgt

SEQ ID NO: 6674512 - DNA, 13 bp, Homo sapiens
attatcataagaa

SEQ ID NO: 6674513 - DNA, 14 bp, Homo sapiens
attatcataagaat

SEQ ID NO: 6674514 - DNA, 18 bp, Homo sapiens
attatcataagaattttt

SEQ ID NO: 6674515 - DNA, 14 bp, Homo sapiens
attatcatatatgc

SEQ ID NO: 6674516 - DNA, 21 bp, Homo sapiens
attatcatcctataaagaaac

SEQ ID NO: 6674517 - DNA, 14 bp, Homo sapiens
attatcatgtgtaa

SEQ ID NO: 6674518 - DNA, 16 bp, Homo sapiens
attatcatgtgtaatc

SEQ ID NO: 6674519 - DNA, 17 bp, Homo sapiens
attatcatgtgtaatca

SEQ ID NO: 6674520 - DNA, 19 bp, Homo sapiens
attatcatgtgtaatcaat

SEQ ID NO: 6674521 - DNA, 21 bp, Homo sapiens
attatcattgctcccctgata

SEQ ID NO: 6674522 - DNA, 12 bp, Homo sapiens
attatcattgtt

SEQ ID NO: 6674523 - DNA, 14 bp, Homo sapiens
attatcattgtttg

SEQ ID NO: 6674524 - DNA, 17 bp, Homo sapiens
attatcattgtttgtcc

SEQ ID NO: 6674525 - DNA, 17 bp, Homo sapiens
attatccaggtaatcca

SEQ ID NO: 6674526 - DNA, 15 bp, Homo sapiens
attatccattcccaa

SEQ ID NO: 6674527 - DNA, 16 bp, Homo sapiens
attatccattcccaag

SEQ ID NO: 6674528 - DNA, 14 bp, Homo sapiens
attatcccagctgc

SEQ ID NO: 6674529 - DNA, 13 bp, Homo sapiens
attatcccagctt

SEQ ID NO: 6674530 - DNA, 23 bp, Homo sapiens
attatccctatttttaaagtaca

SEQ ID NO: 6674531 - DNA, 12 bp, Homo sapiens
attatccctgaa

SEQ ID NO: 6674532 - DNA, 17 bp, Homo sapiens
attatcctatttcagta

SEQ ID NO: 6674533 - DNA, 18 bp, Homo sapiens
attatcctcaagttgtgt

SEQ ID NO: 6674534 - DNA, 21 bp, Homo sapiens
attatcctcaagttgtgtgct

SEQ ID NO: 6674535 - DNA, 18 bp, Homo sapiens
attatcctgtgtgattac

SEQ ID NO: 6674536 - DNA, 21 bp, Homo sapiens
attatccttcacaatttcaat

SEQ ID NO: 6674537 - DNA, 17 bp, Homo sapiens
attatcctttattttat

SEQ ID NO: 6674538 - DNA, 21 bp, Homo sapiens
attatcctttcctcattaaat

SEQ ID NO: 6674539 - DNA, 19 bp, Homo sapiens
attatcggaagcagtgcct

SEQ ID NO: 6674540 - DNA, 16 bp, Homo sapiens
attatcgggaacagtg

SEQ ID NO: 6674541 - DNA, 17 bp, Homo sapiens
attatcgggaacagtgt

SEQ ID NO: 6674542 - DNA, 22 bp, Homo sapiens
attatcgggaacagtgtttccc

SEQ ID NO: 6674543 - DNA, 15 bp, Homo sapiens
attatctaaatgaat

SEQ ID NO: 6674544 - DNA, 15 bp, Homo sapiens
attatctacccacgt

SEQ ID NO: 6674545 - DNA, 15 bp, Homo sapiens
attatctagctttct

SEQ ID NO: 6674546 - DNA, 23 bp, Homo sapiens
attatctagtaggtctgcacaca

SEQ ID NO: 6674547 - DNA, 18 bp, Homo sapiens
attatctcaaaactgcac

SEQ ID NO: 6674548 - DNA, 15 bp, Homo sapiens
attatctcaagtaaa

SEQ ID NO: 6674549 - DNA, 24 bp, Homo sapiens
attatctcaagtaaaacaaatgaa

SEQ ID NO: 6674550 - DNA, 18 bp, Homo sapiens
attatctcctttgaagaa

SEQ ID NO: 6674551 - DNA, 21 bp, Homo sapiens
attatctctttgatctacttg

SEQ ID NO: 6674552 - DNA, 13 bp, Homo sapiens
attatctgagttg

SEQ ID NO: 6674553 - DNA, 15 bp, Homo sapiens
attatctgatccttg

SEQ ID NO: 6674554 - DNA, 17 bp, Homo sapiens
attatctgattccttta

SEQ ID NO: 6674555 - DNA, 14 bp, Homo sapiens
attatctgcattta

SEQ ID NO: 6674556 - DNA, 17 bp, Homo sapiens
attatctgcatttatct

SEQ ID NO: 6674557 - DNA, 21 bp, Homo sapiens
attatctgtaaaaattgttat

SEQ ID NO: 6674558 - DNA, 20 bp, Homo sapiens
attatctgtactgaaagcaa

SEQ ID NO: 6674559 - DNA, 15 bp, Homo sapiens
attatctgttctatg

SEQ ID NO: 6674560 - DNA, 18 bp, Homo sapiens
attatcttatactgaaaa

SEQ ID NO: 6674561 - DNA, 16 bp, Homo sapiens
attatcttatcattta

SEQ ID NO: 6674562 - DNA, 17 bp, Homo sapiens
attatcttatcatttat

SEQ ID NO: 6674563 - DNA, 22 bp, Homo sapiens
attatcttatctactgactgaa

SEQ ID NO: 6674564 - DNA, 14 bp, Homo sapiens
attatcttatgaat

SEQ ID NO: 6674565 - DNA, 20 bp, Homo sapiens
attatcttcaccctcatcct

SEQ ID NO: 6674566 - DNA, 12 bp, Homo sapiens
attatcttcata

SEQ ID NO: 6674567 - DNA, 17 bp, Homo sapiens
attatcttctggtgcat

SEQ ID NO: 6674568 - DNA, 17 bp, Homo sapiens
attatcttcttaacagt

SEQ ID NO: 6674569 - DNA, 13 bp, Homo sapiens
attatcttggaaa

SEQ ID NO: 6674570 - DNA, 15 bp, Homo sapiens
attatctttaaaact

SEQ ID NO: 6674571 - DNA, 23 bp, Homo sapiens
attatctttagttgaattccaag

SEQ ID NO: 6674572 - DNA, 17 bp, Homo sapiens
attatcttttggctctg

SEQ ID NO: 6674573 - DNA, 23 bp, Homo sapiens
attatgaaaaacatcccaaactt

SEQ ID NO: 6674574 - DNA, 14 bp, Homo sapiens
attatgaaaaagat

SEQ ID NO: 6674575 - DNA, 17 bp, Homo sapiens
attatgaaaaagattat

SEQ ID NO: 6674576 - DNA, 12 bp, Homo sapiens
attatgaaaatc

SEQ ID NO: 6674577 - DNA, 22 bp, Homo sapiens
attatgaaaatgtaagttatgt

SEQ ID NO: 6674578 - DNA, 14 bp, Homo sapiens
attatgaaacttgt

SEQ ID NO: 6674579 - DNA, 21 bp, Homo sapiens
attatgaaacttgtgtaaata

SEQ ID NO: 6674580 - DNA, 18 bp, Homo sapiens
attatgaaacttttggaa

SEQ ID NO: 6674581 - DNA, 15 bp, Homo sapiens
attatgaaatatggt

SEQ ID NO: 6674582 - DNA, 11 bp, Homo sapiens
attatgaaatg

SEQ ID NO: 6674583 - DNA, 20 bp, Homo sapiens
attatgaaatttcacttcag

SEQ ID NO: 6674584 - DNA, 15 bp, Homo sapiens
attatgaagctcata

SEQ ID NO: 6674585 - DNA, 14 bp, Homo sapiens
attatgaaggacct

SEQ ID NO: 6674586 - DNA, 18 bp, Homo sapiens
attatgaataaaattgtt

SEQ ID NO: 6674587 - DNA, 17 bp, Homo sapiens
attatgaattacatttg

SEQ ID NO: 6674588 - DNA, 19 bp, Homo sapiens
attatgaattacatttgta

SEQ ID NO: 6674589 - DNA, 22 bp, Homo sapiens
attatgaattacatttgtataa

SEQ ID NO: 6674590 - DNA, 16 bp, Homo sapiens
attatgacaaatgaaa

SEQ ID NO: 6674591 - DNA, 18 bp, Homo sapiens
attatgacaaatgaaaga

SEQ ID NO: 6674592 - DNA, 20 bp, Homo sapiens
attatgacaaatgaaagaga

SEQ ID NO: 6674593 - DNA, 14 bp, Homo sapiens
attatgacatttct

SEQ ID NO: 6674594 - DNA, 19 bp, Homo sapiens
attatgacatttcttaaaa

SEQ ID NO: 6674595 - DNA, 22 bp, Homo sapiens
attatgacatttcttaaaactt

SEQ ID NO: 6674596 - DNA, 16 bp, Homo sapiens
attatgacgtgcacaa

SEQ ID NO: 6674597 - DNA, 21 bp, Homo sapiens
attatgacgtgcacaaacctt

SEQ ID NO: 6674598 - DNA, 21 bp, Homo sapiens
attatgactaaagtaccagat

SEQ ID NO: 6674599 - DNA, 14 bp, Homo sapiens
attatgactgtttt

SEQ ID NO: 6674600 - DNA, 21 bp, Homo sapiens
attatgactgttttttaaact

SEQ ID NO: 6674601 - DNA, 20 bp, Homo sapiens
attatgagaggcaatgattg

SEQ ID NO: 6674602 - DNA, 23 bp, Homo sapiens
attatgagattggttttcctgtg

SEQ ID NO: 6674603 - DNA, 15 bp, Homo sapiens
attatgagctacaac

SEQ ID NO: 6674604 - DNA, 23 bp, Homo sapiens
attatgaggaaacttggacattt

SEQ ID NO: 6674605 - DNA, 19 bp, Homo sapiens
attatgatcccttccccct

SEQ ID NO: 6674606 - DNA, 12 bp, Homo sapiens
attatgatctaa

SEQ ID NO: 6674607 - DNA, 14 bp, Homo sapiens
attatgatctaata

SEQ ID NO: 6674608 - DNA, 18 bp, Homo sapiens
attatgatctaataaact

SEQ ID NO: 6674609 - DNA, 22 bp, Homo sapiens
attatgatctaataaactttat

SEQ ID NO: 6674610 - DNA, 23 bp, Homo sapiens
attatgatgaaaacctacatatt

SEQ ID NO: 6674611 - DNA, 20 bp, Homo sapiens
attatgatttcattatcaca

SEQ ID NO: 6674612 - DNA, 22 bp, Homo sapiens
attatgatttcattatcacatg

SEQ ID NO: 6674613 - DNA, 17 bp, Homo sapiens
attatgcaaaagcagct

SEQ ID NO: 6674614 - DNA, 17 bp, Homo sapiens
attatgcaaaatttaga

SEQ ID NO: 6674615 - DNA, 14 bp, Homo sapiens
attatgcaaattcc

SEQ ID NO: 6674616 - DNA, 21 bp, Homo sapiens
attatgcaacgtttaacattg

SEQ ID NO: 6674617 - DNA, 18 bp, Homo sapiens
attatgcaattcagtgtt

SEQ ID NO: 6674618 - DNA, 16 bp, Homo sapiens
attatgcactaaatat

SEQ ID NO: 6674619 - DNA, 16 bp, Homo sapiens
attatgcagaatactt

SEQ ID NO: 6674620 - DNA, 17 bp, Homo sapiens
attatgcataactgaca

SEQ ID NO: 6674621 - DNA, 23 bp, Homo sapiens
attatgcatgaagtaatatgcac

SEQ ID NO: 6674622 - DNA, 14 bp, Homo sapiens
attatgcattctta

SEQ ID NO: 6674623 - DNA, 15 bp, Homo sapiens
attatgcattcttat

SEQ ID NO: 6674624 - DNA, 22 bp, Homo sapiens
attatgcccagtttctgcctct

SEQ ID NO: 6674625 - DNA, 19 bp, Homo sapiens
attatgccctcttctcaca

SEQ ID NO: 6674626 - DNA, 21 bp, Homo sapiens
attatgcctgagttataaata

SEQ ID NO: 6674627 - DNA, 22 bp, Homo sapiens
attatgcctgagttataaatat

SEQ ID NO: 6674628 - DNA, 11 bp, Homo sapiens
attatgctaag

SEQ ID NO: 6674629 - DNA, 13 bp, Homo sapiens
attatgctgcttt

SEQ ID NO: 6674630 - DNA, 20 bp, Homo sapiens
attatgcttccacaggcaaa

SEQ ID NO: 6674631 - DNA, 12 bp, Homo sapiens
attatgcttctt

SEQ ID NO: 6674632 - DNA, 17 bp, Homo sapiens
attatgctttgaacttt

SEQ ID NO: 6674633 - DNA, 15 bp, Homo sapiens
attatggaaaaataa

SEQ ID NO: 6674634 - DNA, 14 bp, Homo sapiens
attatggaaaacat

SEQ ID NO: 6674635 - DNA, 17 bp, Homo sapiens
attatggaagattttaa

SEQ ID NO: 6674636 - DNA, 19 bp, Homo sapiens
attatggaatatcatctgt

SEQ ID NO: 6674637 - DNA, 22 bp, Homo sapiens
attatggacatcgatatgaaaa

SEQ ID NO: 6674638 - DNA, 17 bp, Homo sapiens
attatggcatatattaa

SEQ ID NO: 6674639 - DNA, 15 bp, Homo sapiens
attatggcatttcta

SEQ ID NO: 6674640 - DNA, 17 bp, Homo sapiens
attatggcttgtgaact

SEQ ID NO: 6674641 - DNA, 20 bp, Homo sapiens
attatggcttgtgaactgct

SEQ ID NO: 6674642 - DNA, 21 bp, Homo sapiens
attatggctttgtgcttgttc

SEQ ID NO: 6674643 - DNA, 19 bp, Homo sapiens
attatgggaacaagtgtac

SEQ ID NO: 6674644 - DNA, 18 bp, Homo sapiens
attatggggctgcttttg

SEQ ID NO: 6674645 - DNA, 23 bp, Homo sapiens
attatgggtatgtgttgccaaag

SEQ ID NO: 6674646 - DNA, 15 bp, Homo sapiens
attatgggtcctgca

SEQ ID NO: 6674647 - DNA, 19 bp, Homo sapiens
attatggtagaatcatttt

SEQ ID NO: 6674648 - DNA, 16 bp, Homo sapiens
attatggtgtaatgca

SEQ ID NO: 6674649 - DNA, 17 bp, Homo sapiens
attatggtgtaatgcac

SEQ ID NO: 6674650 - DNA, 18 bp, Homo sapiens
attatggtgtaatgcaca

SEQ ID NO: 6674651 - DNA, 19 bp, Homo sapiens
attatggtgtaatgcacaa

SEQ ID NO: 6674652 - DNA, 19 bp, Homo sapiens
attatggttagctgtcaca

SEQ ID NO: 6674653 - DNA, 22 bp, Homo sapiens
attatgtaaaatgttttagcaa

SEQ ID NO: 6674654 - DNA, 14 bp, Homo sapiens
attatgtaaagttt

SEQ ID NO: 6674655 - DNA, 12 bp, Homo sapiens
attatgtaaatc

SEQ ID NO: 6674656 - DNA, 14 bp, Homo sapiens
attatgtaaatccc

SEQ ID NO: 6674657 - DNA, 12 bp, Homo sapiens
attatgtaaatt

SEQ ID NO: 6674658 - DNA, 18 bp, Homo sapiens
attatgtaatatattgta

SEQ ID NO: 6674659 - DNA, 19 bp, Homo sapiens
attatgtaatatattgtac

SEQ ID NO: 6674660 - DNA, 17 bp, Homo sapiens
attatgtaccatgaata

SEQ ID NO: 6674661 - DNA, 18 bp, Homo sapiens
attatgtaccatgaatat

SEQ ID NO: 6674662 - DNA, 12 bp, Homo sapiens
attatgtagaaa

SEQ ID NO: 6674663 - DNA, 15 bp, Homo sapiens
attatgtagaaatat

SEQ ID NO: 6674664 - DNA, 16 bp, Homo sapiens
attatgtagctctttg

SEQ ID NO: 6674665 - DNA, 14 bp, Homo sapiens
attatgtagctgaa

SEQ ID NO: 6674666 - DNA, 17 bp, Homo sapiens
attatgtataaaatgta

SEQ ID NO: 6674667 - DNA, 18 bp, Homo sapiens
attatgtataaaatgtaa

SEQ ID NO: 6674668 - DNA, 21 bp, Homo sapiens
attatgtataaaatgtaacac

SEQ ID NO: 6674669 - DNA, 16 bp, Homo sapiens
attatgtatagaaaat

SEQ ID NO: 6674670 - DNA, 22 bp, Homo sapiens
attatgtatcttagttacattt

SEQ ID NO: 6674671 - DNA, 23 bp, Homo sapiens
attatgtatcttagttacatttc

SEQ ID NO: 6674672 - DNA, 20 bp, Homo sapiens
attatgtatggatatatttg

SEQ ID NO: 6674673 - DNA, 21 bp, Homo sapiens
attatgtatggatatatttga

SEQ ID NO: 6674674 - DNA, 15 bp, Homo sapiens
attatgtatgtttac

SEQ ID NO: 6674675 - DNA, 15 bp, Homo sapiens
attatgtcaaatgga

SEQ ID NO: 6674676 - DNA, 19 bp, Homo sapiens
attatgtccactgtgtata

SEQ ID NO: 6674677 - DNA, 22 bp, Homo sapiens
attatgtcctgtgagatgtgta

SEQ ID NO: 6674678 - DNA, 16 bp, Homo sapiens
attatgtctcaaaata

SEQ ID NO: 6674679 - DNA, 21 bp, Homo sapiens
attatgtctcttgagcatcaa

SEQ ID NO: 6674680 - DNA, 16 bp, Homo sapiens
attatgtcttcttttg

SEQ ID NO: 6674681 - DNA, 17 bp, Homo sapiens
attatgtcttcttttgt

SEQ ID NO: 6674682 - DNA, 12 bp, Homo sapiens
attatgtgaaat

SEQ ID NO: 6674683 - DNA, 16 bp, Homo sapiens
attatgtgaagaattt

SEQ ID NO: 6674684 - DNA, 22 bp, Homo sapiens
attatgtgaagaatttagatct

SEQ ID NO: 6674685 - DNA, 12 bp, Homo sapiens
attatgtgacaa

SEQ ID NO: 6674686 - DNA, 17 bp, Homo sapiens
attatgtgacaaccttt

SEQ ID NO: 6674687 - DNA, 20 bp, Homo sapiens
attatgtgacaacctttgtg

SEQ ID NO: 6674688 - DNA, 21 bp, Homo sapiens
attatgtgacaacctttgtgt

SEQ ID NO: 6674689 - DNA, 22 bp, Homo sapiens
attatgtgacaacctttgtgta

SEQ ID NO: 6674690 - DNA, 19 bp, Homo sapiens
attatgtgcctaattttct

SEQ ID NO: 6674691 - DNA, 20 bp, Homo sapiens
attatgtggcttttatttca

SEQ ID NO: 6674692 - DNA, 16 bp, Homo sapiens
attatgtggttttaga

SEQ ID NO: 6674693 - DNA, 11 bp, Homo sapiens
attatgtgtgc

SEQ ID NO: 6674694 - DNA, 13 bp, Homo sapiens
attatgtgtgcat

SEQ ID NO: 6674695 - DNA, 23 bp, Homo sapiens
attatgtgttcaaggaccacatg

SEQ ID NO: 6674696 - DNA, 11 bp, Homo sapiens
attatgttaaa

SEQ ID NO: 6674697 - DNA, 12 bp, Homo sapiens
attatgttaaac

SEQ ID NO: 6674698 - DNA, 23 bp, Homo sapiens
attatgttaaactagcatatctg

SEQ ID NO: 6674699 - DNA, 17 bp, Homo sapiens
attatgttagtttaaaa

SEQ ID NO: 6674700 - DNA, 19 bp, Homo sapiens
attatgttagtttaaaagg

SEQ ID NO: 6674701 - DNA, 20 bp, Homo sapiens
attatgttatacaaggcaag

SEQ ID NO: 6674702 - DNA, 16 bp, Homo sapiens
attatgttattgaaaa

SEQ ID NO: 6674703 - DNA, 22 bp, Homo sapiens
attatgttattgaaaaaaattg

SEQ ID NO: 6674704 - DNA, 13 bp, Homo sapiens
attatgttattgg

SEQ ID NO: 6674705 - DNA, 22 bp, Homo sapiens
attatgttattggaattttctt

SEQ ID NO: 6674706 - DNA, 14 bp, Homo sapiens
attatgttcatgta

SEQ ID NO: 6674707 - DNA, 23 bp, Homo sapiens
attatgttcttagcaataaatgc

SEQ ID NO: 6674708 - DNA, 13 bp, Homo sapiens
attatgttgttca

SEQ ID NO: 6674709 - DNA, 20 bp, Homo sapiens
attatgtttatataaatgct

SEQ ID NO: 6674710 - DNA, 12 bp, Homo sapiens
attatgtttatt

SEQ ID NO: 6674711 - DNA, 20 bp, Homo sapiens
attatgtttattacaatttt

SEQ ID NO: 6674712 - DNA, 22 bp, Homo sapiens
attatgtttccgaggcactgtt

SEQ ID NO: 6674713 - DNA, 17 bp, Homo sapiens
attatgtttcttcttgt

SEQ ID NO: 6674714 - DNA, 18 bp, Homo sapiens
attatgtttgatttctct

SEQ ID NO: 6674715 - DNA, 15 bp, Homo sapiens
attattaaaaattat

SEQ ID NO: 6674716 - DNA, 13 bp, Homo sapiens
attattaaacgat

SEQ ID NO: 6674717 - DNA, 16 bp, Homo sapiens
attattaaatcagaat

SEQ ID NO: 6674718 - DNA, 22 bp, Homo sapiens
attattaaatcgtttaatgttt

SEQ ID NO: 6674719 - DNA, 23 bp, Homo sapiens
attattaaattgtaaaactccaa

SEQ ID NO: 6674720 - DNA, 18 bp, Homo sapiens
attattaactacatttat

SEQ ID NO: 6674721 - DNA, 22 bp, Homo sapiens
attattaacttgtattttctta

SEQ ID NO: 6674722 - DNA, 19 bp, Homo sapiens
attattaagtaacttattt

SEQ ID NO: 6674723 - DNA, 21 bp, Homo sapiens
attattaagtaacttatttat

SEQ ID NO: 6674724 - DNA, 18 bp, Homo sapiens
attattaataccaaatat

SEQ ID NO: 6674725 - DNA, 19 bp, Homo sapiens
attattaataccaaatatt

SEQ ID NO: 6674726 - DNA, 18 bp, Homo sapiens
attattaatcagaatatc

SEQ ID NO: 6674727 - DNA, 17 bp, Homo sapiens
attattaatcattccat

SEQ ID NO: 6674728 - DNA, 16 bp, Homo sapiens
attattaattgtcctg

SEQ ID NO: 6674729 - DNA, 12 bp, Homo sapiens
attattaatttt

SEQ ID NO: 6674730 - DNA, 17 bp, Homo sapiens
attattacaaatattgt

SEQ ID NO: 6674731 - DNA, 18 bp, Homo sapiens
attattacactgtaagaa

SEQ ID NO: 6674732 - DNA, 13 bp, Homo sapiens
attattacagtgt

SEQ ID NO: 6674733 - DNA, 23 bp, Homo sapiens
attattacatctttattaacctc

SEQ ID NO: 6674734 - DNA, 19 bp, Homo sapiens
attattaccagcatttgtc

SEQ ID NO: 6674735 - DNA, 20 bp, Homo sapiens
attattaccagcatttgtcc

SEQ ID NO: 6674736 - DNA, 21 bp, Homo sapiens
attattaccagcatttgtcct

SEQ ID NO: 6674737 - DNA, 21 bp, Homo sapiens
attattactgtttttgctatt

SEQ ID NO: 6674738 - DNA, 20 bp, Homo sapiens
attattactttatgaacaat

SEQ ID NO: 6674739 - DNA, 22 bp, Homo sapiens
attattacttttcctcttagaa

SEQ ID NO: 6674740 - DNA, 11 bp, Homo sapiens
attattagaac

SEQ ID NO: 6674741 - DNA, 23 bp, Homo sapiens
attattagaacattcacttttgt

SEQ ID NO: 6674742 - DNA, 17 bp, Homo sapiens
attattagaatcaaaca

SEQ ID NO: 6674743 - DNA, 23 bp, Homo sapiens
attattagaatccaattaatgat

SEQ ID NO: 6674744 - DNA, 14 bp, Homo sapiens
attattagagattt

SEQ ID NO: 6674745 - DNA, 16 bp, Homo sapiens
attattagagattttc

SEQ ID NO: 6674746 - DNA, 17 bp, Homo sapiens
attattagcatttgttt

SEQ ID NO: 6674747 - DNA, 23 bp, Homo sapiens
attattagcatttgttttagcat

SEQ ID NO: 6674748 - DNA, 23 bp, Homo sapiens
attattagttgaccaactatatt

SEQ ID NO: 6674749 - DNA, 13 bp, Homo sapiens
attattataaaaa

SEQ ID NO: 6674750 - DNA, 14 bp, Homo sapiens
attattatatatat

SEQ ID NO: 6674751 - DNA, 15 bp, Homo sapiens
attattatattgttt

SEQ ID NO: 6674752 - DNA, 22 bp, Homo sapiens
attattatcaggggagaaaaat

SEQ ID NO: 6674753 - DNA, 16 bp, Homo sapiens
attattatcgctttat

SEQ ID NO: 6674754 - DNA, 14 bp, Homo sapiens
attattatctttaa

SEQ ID NO: 6674755 - DNA, 20 bp, Homo sapiens
attattatgcaaaatttaga

SEQ ID NO: 6674756 - DNA, 22 bp, Homo sapiens
attattatgtttattacaattt

SEQ ID NO: 6674757 - DNA, 12 bp, Homo sapiens
attattattaaa

SEQ ID NO: 6674758 - DNA, 12 bp, Homo sapiens
attattattatt

SEQ ID NO: 6674759 - DNA, 13 bp, Homo sapiens
attattattatta

SEQ ID NO: 6674760 - DNA, 15 bp, Homo sapiens
attattattattatt

SEQ ID NO: 6674761 - DNA, 14 bp, Homo sapiens
attattattatttg

SEQ ID NO: 6674762 - DNA, 16 bp, Homo sapiens
attattattcttcata

SEQ ID NO: 6674763 - DNA, 15 bp, Homo sapiens
attattatttctgtt

SEQ ID NO: 6674764 - DNA, 14 bp, Homo sapiens
attattcaaaaaca

SEQ ID NO: 6674765 - DNA, 22 bp, Homo sapiens
attattcaaaccaatttcttcc

SEQ ID NO: 6674766 - DNA, 16 bp, Homo sapiens
attattcaaagatcct

SEQ ID NO: 6674767 - DNA, 14 bp, Homo sapiens
attattcaaagttg

SEQ ID NO: 6674768 - DNA, 13 bp, Homo sapiens
attattcaacaca

SEQ ID NO: 6674769 - DNA, 21 bp, Homo sapiens
attattcaagaatgaaaaata

SEQ ID NO: 6674770 - DNA, 17 bp, Homo sapiens
attattcaagtgcctct

SEQ ID NO: 6674771 - DNA, 18 bp, Homo sapiens
attattcaccatgtaaaa

SEQ ID NO: 6674772 - DNA, 22 bp, Homo sapiens
attattcaccatgtaaaacaaa

SEQ ID NO: 6674773 - DNA, 14 bp, Homo sapiens
attattcactagta

SEQ ID NO: 6674774 - DNA, 23 bp, Homo sapiens
attattcagaactatttaaaata

SEQ ID NO: 6674775 - DNA, 19 bp, Homo sapiens
attattcagaattatacag

SEQ ID NO: 6674776 - DNA, 15 bp, Homo sapiens
attattcaggcttta

SEQ ID NO: 6674777 - DNA, 16 bp, Homo sapiens
attattcagtgaattt

SEQ ID NO: 6674778 - DNA, 18 bp, Homo sapiens
attattcagtgaatttgt

SEQ ID NO: 6674779 - DNA, 20 bp, Homo sapiens
attattcagtgaatttgtcc

SEQ ID NO: 6674780 - DNA, 13 bp, Homo sapiens
attattcagtgtc

SEQ ID NO: 6674781 - DNA, 18 bp, Homo sapiens
attattcagttaagaaaa

SEQ ID NO: 6674782 - DNA, 22 bp, Homo sapiens
attattcatagctgtatatttg

SEQ ID NO: 6674783 - DNA, 13 bp, Homo sapiens
attattcatttaa

SEQ ID NO: 6674784 - DNA, 19 bp, Homo sapiens
attattcatttaaaatgat

SEQ ID NO: 6674785 - DNA, 12 bp, Homo sapiens
attattcatttt

SEQ ID NO: 6674786 - DNA, 17 bp, Homo sapiens
attattccctgtacaat

SEQ ID NO: 6674787 - DNA, 21 bp, Homo sapiens
attattccttcttactctcct

SEQ ID NO: 6674788 - DNA, 23 bp, Homo sapiens
attattccttcttactctcctct

SEQ ID NO: 6674789 - DNA, 18 bp, Homo sapiens
attattccttgctttcat

SEQ ID NO: 6674790 - DNA, 22 bp, Homo sapiens
attattctagtcaactgctgtt

SEQ ID NO: 6674791 - DNA, 15 bp, Homo sapiens
attattctatgtagt

SEQ ID NO: 6674792 - DNA, 18 bp, Homo sapiens
attattctcttttatctg

SEQ ID NO: 6674793 - DNA, 16 bp, Homo sapiens
attattctgattccac

SEQ ID NO: 6674794 - DNA, 17 bp, Homo sapiens
attattctgcctacgtt

SEQ ID NO: 6674795 - DNA, 15 bp, Homo sapiens
attattctgttttgc

SEQ ID NO: 6674796 - DNA, 12 bp, Homo sapiens
attattcttgag

SEQ ID NO: 6674797 - DNA, 20 bp, Homo sapiens
attattcttgttcagggaga

SEQ ID NO: 6674798 - DNA, 23 bp, Homo sapiens
attattctttgaaaacagatgac

SEQ ID NO: 6674799 - DNA, 15 bp, Homo sapiens
attattgaaaagcaa

SEQ ID NO: 6674800 - DNA, 12 bp, Homo sapiens
attattgaaatt

SEQ ID NO: 6674801 - DNA, 16 bp, Homo sapiens
attattgaagatgtga

SEQ ID NO: 6674802 - DNA, 13 bp, Homo sapiens
attattgaatgtt

SEQ ID NO: 6674803 - DNA, 16 bp, Homo sapiens
attattgaatgttata

SEQ ID NO: 6674804 - DNA, 18 bp, Homo sapiens
attattgacactgaactt

SEQ ID NO: 6674805 - DNA, 19 bp, Homo sapiens
attattgagagccctagaa

SEQ ID NO: 6674806 - DNA, 21 bp, Homo sapiens
attattgagtctgtccagata

SEQ ID NO: 6674807 - DNA, 17 bp, Homo sapiens
attattgagttctgaag

SEQ ID NO: 6674808 - DNA, 14 bp, Homo sapiens
attattgatgaaaa

SEQ ID NO: 6674809 - DNA, 17 bp, Homo sapiens
attattgatgttttcat

SEQ ID NO: 6674810 - DNA, 22 bp, Homo sapiens
attattgcccagttattcttaa

SEQ ID NO: 6674811 - DNA, 19 bp, Homo sapiens
attattgctatatttgcta

SEQ ID NO: 6674812 - DNA, 15 bp, Homo sapiens
attattgctgttgct

SEQ ID NO: 6674813 - DNA, 19 bp, Homo sapiens
attattgctgttgcttgaa

SEQ ID NO: 6674814 - DNA, 15 bp, Homo sapiens
attattgctgtttgg

SEQ ID NO: 6674815 - DNA, 19 bp, Homo sapiens
attattgcttattgcttag

SEQ ID NO: 6674816 - DNA, 18 bp, Homo sapiens
attattggctgctttgcc

SEQ ID NO: 6674817 - DNA, 20 bp, Homo sapiens
attattggctgctttgcctc

SEQ ID NO: 6674818 - DNA, 15 bp, Homo sapiens
attattggcttgcac

SEQ ID NO: 6674819 - DNA, 19 bp, Homo sapiens
attattgtaaactttttca

SEQ ID NO: 6674820 - DNA, 22 bp, Homo sapiens
attattgtaaactttttcaatg

SEQ ID NO: 6674821 - DNA, 21 bp, Homo sapiens
attattgtaagttgtacaaat

SEQ ID NO: 6674822 - DNA, 15 bp, Homo sapiens
attattgtagacatg

SEQ ID NO: 6674823 - DNA, 16 bp, Homo sapiens
attattgtagacatgc

SEQ ID NO: 6674824 - DNA, 15 bp, Homo sapiens
attattgtagagaaa

SEQ ID NO: 6674825 - DNA, 14 bp, Homo sapiens
attattgtagtttg

SEQ ID NO: 6674826 - DNA, 15 bp, Homo sapiens
attattgtagtttga

SEQ ID NO: 6674827 - DNA, 16 bp, Homo sapiens
attattgtatttattc

SEQ ID NO: 6674828 - DNA, 14 bp, Homo sapiens
attattgtctgatt

SEQ ID NO: 6674829 - DNA, 20 bp, Homo sapiens
attattgtctgttttccttc

SEQ ID NO: 6674830 - DNA, 19 bp, Homo sapiens
attattgtgatttcccgtg

SEQ ID NO: 6674831 - DNA, 18 bp, Homo sapiens
attattgttaataataat

SEQ ID NO: 6674832 - DNA, 21 bp, Homo sapiens
attattgttcccctaagtgga

SEQ ID NO: 6674833 - DNA, 11 bp, Homo sapiens
attatttaaac

SEQ ID NO: 6674834 - DNA, 12 bp, Homo sapiens
attatttaaaca

SEQ ID NO: 6674835 - DNA, 13 bp, Homo sapiens
attatttaaagca

SEQ ID NO: 6674836 - DNA, 12 bp, Homo sapiens
attatttaaata

SEQ ID NO: 6674837 - DNA, 16 bp, Homo sapiens
attatttaaataaaat

SEQ ID NO: 6674838 - DNA, 17 bp, Homo sapiens
attatttaaatgtactt

SEQ ID NO: 6674839 - DNA, 21 bp, Homo sapiens
attatttaaatgtacttatat

SEQ ID NO: 6674840 - DNA, 22 bp, Homo sapiens
attatttaaatgtttaacatca

SEQ ID NO: 6674841 - DNA, 14 bp, Homo sapiens
attatttaactctt

SEQ ID NO: 6674842 - DNA, 14 bp, Homo sapiens
attatttaagacta

SEQ ID NO: 6674843 - DNA, 12 bp, Homo sapiens
attatttaataa

SEQ ID NO: 6674844 - DNA, 15 bp, Homo sapiens
attatttaataacat

SEQ ID NO: 6674845 - DNA, 18 bp, Homo sapiens
attatttaataacattac

SEQ ID NO: 6674846 - DNA, 14 bp, Homo sapiens
attatttaataaga

SEQ ID NO: 6674847 - DNA, 14 bp, Homo sapiens
attatttaatgttt

SEQ ID NO: 6674848 - DNA, 16 bp, Homo sapiens
attatttaatttgtat

SEQ ID NO: 6674849 - DNA, 13 bp, Homo sapiens
attatttacaaaa

SEQ ID NO: 6674850 - DNA, 15 bp, Homo sapiens
attatttacatcact

SEQ ID NO: 6674851 - DNA, 17 bp, Homo sapiens
attatttagtaaaatta

SEQ ID NO: 6674852 - DNA, 21 bp, Homo sapiens
attatttagtaaaattatctg

SEQ ID NO: 6674853 - DNA, 20 bp, Homo sapiens
attatttagtcaattgttta

SEQ ID NO: 6674854 - DNA, 13 bp, Homo sapiens
attatttatatgg

SEQ ID NO: 6674855 - DNA, 22 bp, Homo sapiens
attatttatatggggaatatat

SEQ ID NO: 6674856 - DNA, 16 bp, Homo sapiens
attatttatatttcct

SEQ ID NO: 6674857 - DNA, 19 bp, Homo sapiens
attatttatgtatggtgca

SEQ ID NO: 6674858 - DNA, 20 bp, Homo sapiens
attatttattaaaaatgttc

SEQ ID NO: 6674859 - DNA, 23 bp, Homo sapiens
attatttattaaatgcccagccc

SEQ ID NO: 6674860 - DNA, 13 bp, Homo sapiens
attatttattaca

SEQ ID NO: 6674861 - DNA, 17 bp, Homo sapiens
attatttatttaataac

SEQ ID NO: 6674862 - DNA, 13 bp, Homo sapiens
attatttatttct

SEQ ID NO: 6674863 - DNA, 22 bp, Homo sapiens
attatttatttgattaggtatg

SEQ ID NO: 6674864 - DNA, 12 bp, Homo sapiens
attatttcaaaa

SEQ ID NO: 6674865 - DNA, 13 bp, Homo sapiens
attatttcaaaat

SEQ ID NO: 6674866 - DNA, 18 bp, Homo sapiens
attatttcacaaataata

SEQ ID NO: 6674867 - DNA, 16 bp, Homo sapiens
attatttcaccagcag

SEQ ID NO: 6674868 - DNA, 17 bp, Homo sapiens
attatttcaccagcagc

SEQ ID NO: 6674869 - DNA, 18 bp, Homo sapiens
attatttcaccagcagca

SEQ ID NO: 6674870 - DNA, 18 bp, Homo sapiens
attatttcactttagatg

SEQ ID NO: 6674871 - DNA, 13 bp, Homo sapiens
attatttcatcat

SEQ ID NO: 6674872 - DNA, 12 bp, Homo sapiens
attatttcgtgt

SEQ ID NO: 6674873 - DNA, 16 bp, Homo sapiens
attatttctccatccc

SEQ ID NO: 6674874 - DNA, 22 bp, Homo sapiens
attatttctggctttttgaatt

SEQ ID NO: 6674875 - DNA, 11 bp, Homo sapiens
attatttctgt

SEQ ID NO: 6674876 - DNA, 15 bp, Homo sapiens
attatttctgtcaca

SEQ ID NO: 6674877 - DNA, 12 bp, Homo sapiens
attatttcttct

SEQ ID NO: 6674878 - DNA, 14 bp, Homo sapiens
attatttgaaaaca

SEQ ID NO: 6674879 - DNA, 21 bp, Homo sapiens
attatttgagaagctgctcaa

SEQ ID NO: 6674880 - DNA, 17 bp, Homo sapiens
attatttgataacattt

SEQ ID NO: 6674881 - DNA, 15 bp, Homo sapiens
attatttgatatctg

SEQ ID NO: 6674882 - DNA, 13 bp, Homo sapiens
attatttgcatgt

SEQ ID NO: 6674883 - DNA, 15 bp, Homo sapiens
attatttgcatgtta

SEQ ID NO: 6674884 - DNA, 19 bp, Homo sapiens
attatttgcatgttatgtt

SEQ ID NO: 6674885 - DNA, 16 bp, Homo sapiens
attatttgctatggca

SEQ ID NO: 6674886 - DNA, 14 bp, Homo sapiens
attatttgcttttc

SEQ ID NO: 6674887 - DNA, 20 bp, Homo sapiens
attatttgcttttcatgtag

SEQ ID NO: 6674888 - DNA, 18 bp, Homo sapiens
attatttgggggaactgg

SEQ ID NO: 6674889 - DNA, 16 bp, Homo sapiens
attatttgtactttgt

SEQ ID NO: 6674890 - DNA, 17 bp, Homo sapiens
attatttgtcaaattgt

SEQ ID NO: 6674891 - DNA, 21 bp, Homo sapiens
attatttgtgcattttattga

SEQ ID NO: 6674892 - DNA, 15 bp, Homo sapiens
attatttgtgtaata

SEQ ID NO: 6674893 - DNA, 12 bp, Homo sapiens
attatttgtgtt

SEQ ID NO: 6674894 - DNA, 15 bp, Homo sapiens
attatttgtgtttta

SEQ ID NO: 6674895 - DNA, 22 bp, Homo sapiens
attatttgtgttttaatttaaa

SEQ ID NO: 6674896 - DNA, 13 bp, Homo sapiens
attattttaaaat

SEQ ID NO: 6674897 - DNA, 13 bp, Homo sapiens
attattttaaaca

SEQ ID NO: 6674898 - DNA, 21 bp, Homo sapiens
attattttaaacaaaatagaa

SEQ ID NO: 6674899 - DNA, 14 bp, Homo sapiens
attattttaaatta

SEQ ID NO: 6674900 - DNA, 21 bp, Homo sapiens
attattttaattttttctctt

SEQ ID NO: 6674901 - DNA, 20 bp, Homo sapiens
attattttagagttctaata

SEQ ID NO: 6674902 - DNA, 18 bp, Homo sapiens
attattttagcttcagtt

SEQ ID NO: 6674903 - DNA, 13 bp, Homo sapiens
attattttagtgt

SEQ ID NO: 6674904 - DNA, 19 bp, Homo sapiens
attattttagtgtgtaaaa

SEQ ID NO: 6674905 - DNA, 21 bp, Homo sapiens
attattttagtgtgtaaaatt

SEQ ID NO: 6674906 - DNA, 23 bp, Homo sapiens
attattttagtgtgtaaaattaa

SEQ ID NO: 6674907 - DNA, 13 bp, Homo sapiens
attattttatcac

SEQ ID NO: 6674908 - DNA, 16 bp, Homo sapiens
attattttatgtcata

SEQ ID NO: 6674909 - DNA, 13 bp, Homo sapiens
attattttcaaag

SEQ ID NO: 6674910 - DNA, 21 bp, Homo sapiens
attattttcaaaggaaaacac

SEQ ID NO: 6674911 - DNA, 18 bp, Homo sapiens
attattttcagaagctga

SEQ ID NO: 6674912 - DNA, 19 bp, Homo sapiens
attattttcattacaatgg

SEQ ID NO: 6674913 - DNA, 13 bp, Homo sapiens
attattttccaaa

SEQ ID NO: 6674914 - DNA, 14 bp, Homo sapiens
attattttccaaaa

SEQ ID NO: 6674915 - DNA, 19 bp, Homo sapiens
attattttcccatttgctg

SEQ ID NO: 6674916 - DNA, 13 bp, Homo sapiens
attattttctata

SEQ ID NO: 6674917 - DNA, 17 bp, Homo sapiens
attattttctatagctc

SEQ ID NO: 6674918 - DNA, 20 bp, Homo sapiens
attattttctatagctcttc

SEQ ID NO: 6674919 - DNA, 14 bp, Homo sapiens
attattttctccaa

SEQ ID NO: 6674920 - DNA, 14 bp, Homo sapiens
attattttctgaga

SEQ ID NO: 6674921 - DNA, 14 bp, Homo sapiens
attattttctgtaa

SEQ ID NO: 6674922 - DNA, 16 bp, Homo sapiens
attattttctgtcaga

SEQ ID NO: 6674923 - DNA, 22 bp, Homo sapiens
attattttctgtcagatgagaa

SEQ ID NO: 6674924 - DNA, 20 bp, Homo sapiens
attattttgaggtagaggaa

SEQ ID NO: 6674925 - DNA, 21 bp, Homo sapiens
attattttgaggtagaggaaa

SEQ ID NO: 6674926 - DNA, 23 bp, Homo sapiens
attattttgggaagaaaacctgt

SEQ ID NO: 6674927 - DNA, 14 bp, Homo sapiens
attattttggggtc

SEQ ID NO: 6674928 - DNA, 19 bp, Homo sapiens
attattttggggtctcttt

SEQ ID NO: 6674929 - DNA, 20 bp, Homo sapiens
attattttggtacttttatg

SEQ ID NO: 6674930 - DNA, 14 bp, Homo sapiens
attattttgtattc

SEQ ID NO: 6674931 - DNA, 22 bp, Homo sapiens
attattttgtcataaaatgcta

SEQ ID NO: 6674932 - DNA, 14 bp, Homo sapiens
attattttgtggtt

SEQ ID NO: 6674933 - DNA, 17 bp, Homo sapiens
attattttgtggttcta

SEQ ID NO: 6674934 - DNA, 13 bp, Homo sapiens
attattttgttac

SEQ ID NO: 6674935 - DNA, 15 bp, Homo sapiens
attattttgttcata

SEQ ID NO: 6674936 - DNA, 18 bp, Homo sapiens
attattttgttcatacat

SEQ ID NO: 6674937 - DNA, 17 bp, Homo sapiens
attattttgttgtgatt

SEQ ID NO: 6674938 - DNA, 19 bp, Homo sapiens
attatttttataattgtac

SEQ ID NO: 6674939 - DNA, 14 bp, Homo sapiens
attatttttataca

SEQ ID NO: 6674940 - DNA, 23 bp, Homo sapiens
attatttttatactgaatataaa

SEQ ID NO: 6674941 - DNA, 18 bp, Homo sapiens
attatttttatctgaagc

SEQ ID NO: 6674942 - DNA, 14 bp, Homo sapiens
attatttttcaatt

SEQ ID NO: 6674943 - DNA, 17 bp, Homo sapiens
attatttttcactctaa

SEQ ID NO: 6674944 - DNA, 22 bp, Homo sapiens
attatttttccactttgttctt

SEQ ID NO: 6674945 - DNA, 14 bp, Homo sapiens
attatttttctgta

SEQ ID NO: 6674946 - DNA, 21 bp, Homo sapiens
attatttttgagcaggagcag

SEQ ID NO: 6674947 - DNA, 14 bp, Homo sapiens
attatttttgtaga

SEQ ID NO: 6674948 - DNA, 18 bp, Homo sapiens
attatttttgtgtttcta

SEQ ID NO: 6674949 - DNA, 23 bp, Homo sapiens
attattttttaaagtcttctttc

SEQ ID NO: 6674950 - DNA, 15 bp, Homo sapiens
attattttttaataa

SEQ ID NO: 6674951 - DNA, 20 bp, Homo sapiens
attattttttaataaactgc

SEQ ID NO: 6674952 - DNA, 22 bp, Homo sapiens
attattttttaataagaacatt

SEQ ID NO: 6674953 - DNA, 17 bp, Homo sapiens
attattttttatttctg

SEQ ID NO: 6674954 - DNA, 15 bp, Homo sapiens
attattttttcagac

SEQ ID NO: 6674955 - DNA, 19 bp, Homo sapiens
attattttttcagaccgaa

SEQ ID NO: 6674956 - DNA, 14 bp, Homo sapiens
attattttttctat

SEQ ID NO: 6674957 - DNA, 16 bp, Homo sapiens
attattttttgttgaa

SEQ ID NO: 6674958 - DNA, 20 bp, Homo sapiens
attatttttttaaaattttg

SEQ ID NO: 6674959 - DNA, 18 bp, Homo sapiens
attatttttttaaacttc

SEQ ID NO: 6674960 - DNA, 20 bp, Homo sapiens
attcaaaaaaaaaatataag

SEQ ID NO: 6674961 - DNA, 22 bp, Homo sapiens
attcaaaaaaatcctagagatt

SEQ ID NO: 6674962 - DNA, 17 bp, Homo sapiens
attcaaaaagtgtttat

SEQ ID NO: 6674963 - DNA, 14 bp, Homo sapiens
attcaaaaatgtac

SEQ ID NO: 6674964 - DNA, 20 bp, Homo sapiens
attcaaaaattatattttga

SEQ ID NO: 6674965 - DNA, 11 bp, Homo sapiens
attcaaaacat

SEQ ID NO: 6674966 - DNA, 22 bp, Homo sapiens
attcaaaacctgcagttaacag

SEQ ID NO: 6674967 - DNA, 13 bp, Homo sapiens
attcaaaacgtga

SEQ ID NO: 6674968 - DNA, 14 bp, Homo sapiens
attcaaaactttca

SEQ ID NO: 6674969 - DNA, 22 bp, Homo sapiens
attcaaaagagagagagagatc

SEQ ID NO: 6674970 - DNA, 15 bp, Homo sapiens
attcaaaagcacaaa

SEQ ID NO: 6674971 - DNA, 20 bp, Homo sapiens
attcaaaaggtttttaaaag

SEQ ID NO: 6674972 - DNA, 12 bp, Homo sapiens
attcaaaagtaa

SEQ ID NO: 6674973 - DNA, 20 bp, Homo sapiens
attcaaaagtaagaatgcaa

SEQ ID NO: 6674974 - DNA, 16 bp, Homo sapiens
attcaaaagttgaaat

SEQ ID NO: 6674975 - DNA, 12 bp, Homo sapiens
attcaaaatagt

SEQ ID NO: 6674976 - DNA, 17 bp, Homo sapiens
attcaaaatagttctat

SEQ ID NO: 6674977 - DNA, 11 bp, Homo sapiens
attcaaaatat

SEQ ID NO: 6674978 - DNA, 12 bp, Homo sapiens
attcaaaatatt

SEQ ID NO: 6674979 - DNA, 15 bp, Homo sapiens
attcaaaatatttaa

SEQ ID NO: 6674980 - DNA, 20 bp, Homo sapiens
attcaaaatattttatcttt

SEQ ID NO: 6674981 - DNA, 13 bp, Homo sapiens
attcaaaatcttc

SEQ ID NO: 6674982 - DNA, 13 bp, Homo sapiens
attcaaaatgctc

SEQ ID NO: 6674983 - DNA, 14 bp, Homo sapiens
attcaaaatgctct

SEQ ID NO: 6674984 - DNA, 14 bp, Homo sapiens
attcaaaatggctt

SEQ ID NO: 6674985 - DNA, 15 bp, Homo sapiens
attcaaaatgtccag

SEQ ID NO: 6674986 - DNA, 19 bp, Homo sapiens
attcaaaattgacattgct

SEQ ID NO: 6674987 - DNA, 22 bp, Homo sapiens
attcaaaattgacattgcttta

SEQ ID NO: 6674988 - DNA, 15 bp, Homo sapiens
attcaaacacacagt

SEQ ID NO: 6674989 - DNA, 16 bp, Homo sapiens
attcaaacacacagta

SEQ ID NO: 6674990 - DNA, 17 bp, Homo sapiens
attcaaacacacagtat

SEQ ID NO: 6674991 - DNA, 14 bp, Homo sapiens
attcaaacagtctc

SEQ ID NO: 6674992 - DNA, 19 bp, Homo sapiens
attcaaacagtctcaggaa

SEQ ID NO: 6674993 - DNA, 15 bp, Homo sapiens
attcaaacatattct

SEQ ID NO: 6674994 - DNA, 17 bp, Homo sapiens
attcaaacatattcttt

SEQ ID NO: 6674995 - DNA, 15 bp, Homo sapiens
attcaaaccaaagct

SEQ ID NO: 6674996 - DNA, 24 bp, Homo sapiens
attcaaaccaaagctgcctgtgcc

SEQ ID NO: 6674997 - DNA, 14 bp, Homo sapiens
attcaaaccattta

SEQ ID NO: 6674998 - DNA, 15 bp, Homo sapiens
attcaaaccatttaa

SEQ ID NO: 6674999 - DNA, 17 bp, Homo sapiens
attcaaaccatttaatt

SEQ ID NO: 6675000 - DNA, 21 bp, Homo sapiens
attcaaaccatttaattcata

SEQ ID NO: 6675001 - DNA, 15 bp, Homo sapiens
attcaaacctaagtt

SEQ ID NO: 6675002 - DNA, 21 bp, Homo sapiens
attcaaactacctatattcct

SEQ ID NO: 6675003 - DNA, 18 bp, Homo sapiens
attcaaactgcactttta

SEQ ID NO: 6675004 - DNA, 13 bp, Homo sapiens
attcaaactttta

SEQ ID NO: 6675005 - DNA, 21 bp, Homo sapiens
attcaaagaaaaccctaagtg

SEQ ID NO: 6675006 - DNA, 12 bp, Homo sapiens
attcaaagatga

SEQ ID NO: 6675007 - DNA, 15 bp, Homo sapiens
attcaaagatgataa

SEQ ID NO: 6675008 - DNA, 15 bp, Homo sapiens
attcaaagatgtgat

SEQ ID NO: 6675009 - DNA, 16 bp, Homo sapiens
attcaaagcagctgta

SEQ ID NO: 6675010 - DNA, 18 bp, Homo sapiens
attcaaagcataaaactt

SEQ ID NO: 6675011 - DNA, 17 bp, Homo sapiens
attcaaagcgaacagtc

SEQ ID NO: 6675012 - DNA, 17 bp, Homo sapiens
attcaaagctctattaa

SEQ ID NO: 6675013 - DNA, 17 bp, Homo sapiens
attcaaagcttgtgaaa

SEQ ID NO: 6675014 - DNA, 22 bp, Homo sapiens
attcaaagtagttttattttaa

SEQ ID NO: 6675015 - DNA, 23 bp, Homo sapiens
attcaaagtagttttattttaat

SEQ ID NO: 6675016 - DNA, 19 bp, Homo sapiens
attcaaagtatatacagag

SEQ ID NO: 6675017 - DNA, 23 bp, Homo sapiens
attcaaagtgttgtgttcctggc

SEQ ID NO: 6675018 - DNA, 17 bp, Homo sapiens
attcaaagttgcctaaa

SEQ ID NO: 6675019 - DNA, 23 bp, Homo sapiens
attcaaataaccctgaatcagag

SEQ ID NO: 6675020 - DNA, 14 bp, Homo sapiens
attcaaataccaat

SEQ ID NO: 6675021 - DNA, 19 bp, Homo sapiens
attcaaatcagtgatctat

SEQ ID NO: 6675022 - DNA, 14 bp, Homo sapiens
attcaaatgggtga

SEQ ID NO: 6675023 - DNA, 20 bp, Homo sapiens
attcaaatgggtgatatcct

SEQ ID NO: 6675024 - DNA, 16 bp, Homo sapiens
attcaaatgtattaca

SEQ ID NO: 6675025 - DNA, 18 bp, Homo sapiens
attcaaatgtattacagt

SEQ ID NO: 6675026 - DNA, 19 bp, Homo sapiens
attcaaatgtcagttcata

SEQ ID NO: 6675027 - DNA, 21 bp, Homo sapiens
attcaaatgtcagttcataat

SEQ ID NO: 6675028 - DNA, 14 bp, Homo sapiens
attcaaatgttaca

SEQ ID NO: 6675029 - DNA, 12 bp, Homo sapiens
attcaaatttat

SEQ ID NO: 6675030 - DNA, 13 bp, Homo sapiens
attcaaatttatt

SEQ ID NO: 6675031 - DNA, 13 bp, Homo sapiens
attcaaattttat

SEQ ID NO: 6675032 - DNA, 13 bp, Homo sapiens
attcaacaaatga

SEQ ID NO: 6675033 - DNA, 16 bp, Homo sapiens
attcaacaatttcaat

SEQ ID NO: 6675034 - DNA, 22 bp, Homo sapiens
attcaacaatttcaataaaaga

SEQ ID NO: 6675035 - DNA, 13 bp, Homo sapiens
attcaacacatta

SEQ ID NO: 6675036 - DNA, 22 bp, Homo sapiens
attcaacacattacttgcacaa

SEQ ID NO: 6675037 - DNA, 23 bp, Homo sapiens
attcaacacattacttgcacaag

SEQ ID NO: 6675038 - DNA, 14 bp, Homo sapiens
attcaacacatttt

SEQ ID NO: 6675039 - DNA, 15 bp, Homo sapiens
attcaacacattttt

SEQ ID NO: 6675040 - DNA, 22 bp, Homo sapiens
attcaacactcccttcccatga

SEQ ID NO: 6675041 - DNA, 14 bp, Homo sapiens
attcaacagagagg

SEQ ID NO: 6675042 - DNA, 19 bp, Homo sapiens
attcaacagagagggagaa

SEQ ID NO: 6675043 - DNA, 21 bp, Homo sapiens
attcaacagcaagtgtgaata

SEQ ID NO: 6675044 - DNA, 18 bp, Homo sapiens
attcaacatcaaaactta

SEQ ID NO: 6675045 - DNA, 14 bp, Homo sapiens
attcaaccatggac

SEQ ID NO: 6675046 - DNA, 18 bp, Homo sapiens
attcaaccatggacttta

SEQ ID NO: 6675047 - DNA, 20 bp, Homo sapiens
attcaaccatggactttata

SEQ ID NO: 6675048 - DNA, 18 bp, Homo sapiens
attcaacctgtgtcttat

SEQ ID NO: 6675049 - DNA, 14 bp, Homo sapiens
attcaaccttacca

SEQ ID NO: 6675050 - DNA, 17 bp, Homo sapiens
attcaaccttaccaaaa

SEQ ID NO: 6675051 - DNA, 23 bp, Homo sapiens
attcaactaaaaaaaaaaaagta

SEQ ID NO: 6675052 - DNA, 14 bp, Homo sapiens
attcaactcagact

SEQ ID NO: 6675053 - DNA, 21 bp, Homo sapiens
attcaactctgtgtcccagca

SEQ ID NO: 6675054 - DNA, 16 bp, Homo sapiens
attcaactggaaatta

SEQ ID NO: 6675055 - DNA, 18 bp, Homo sapiens
attcaactggaaattaaa

SEQ ID NO: 6675056 - DNA, 21 bp, Homo sapiens
attcaactttccaaataaaag

SEQ ID NO: 6675057 - DNA, 13 bp, Homo sapiens
attcaactttgta

SEQ ID NO: 6675058 - DNA, 15 bp, Homo sapiens
attcaagaaaataaa

SEQ ID NO: 6675059 - DNA, 18 bp, Homo sapiens
attcaagaaaataaaact

SEQ ID NO: 6675060 - DNA, 17 bp, Homo sapiens
attcaagaaacagaagt

SEQ ID NO: 6675061 - DNA, 15 bp, Homo sapiens
attcaagaaagatat

SEQ ID NO: 6675062 - DNA, 18 bp, Homo sapiens
attcaagaaagatatcta

SEQ ID NO: 6675063 - DNA, 20 bp, Homo sapiens
attcaagaaagatatctatg

SEQ ID NO: 6675064 - DNA, 16 bp, Homo sapiens
attcaagaaagccagt

SEQ ID NO: 6675065 - DNA, 22 bp, Homo sapiens
attcaagacaagagctgttatg

SEQ ID NO: 6675066 - DNA, 16 bp, Homo sapiens
attcaagagcctcccc

SEQ ID NO: 6675067 - DNA, 18 bp, Homo sapiens
attcaagagcctcccctg

SEQ ID NO: 6675068 - DNA, 19 bp, Homo sapiens
attcaagagctagaaaaat

SEQ ID NO: 6675069 - DNA, 14 bp, Homo sapiens
attcaagagtgggg

SEQ ID NO: 6675070 - DNA, 15 bp, Homo sapiens
attcaagcctctaaa

SEQ ID NO: 6675071 - DNA, 19 bp, Homo sapiens
attcaagcctctaaacaga

SEQ ID NO: 6675072 - DNA, 13 bp, Homo sapiens
attcaagctattt

SEQ ID NO: 6675073 - DNA, 14 bp, Homo sapiens
attcaagctgagaa

SEQ ID NO: 6675074 - DNA, 15 bp, Homo sapiens
attcaagctgagaaa

SEQ ID NO: 6675075 - DNA, 17 bp, Homo sapiens
attcaagctgagaaaag

SEQ ID NO: 6675076 - DNA, 18 bp, Homo sapiens
attcaagctgagaaaagt

SEQ ID NO: 6675077 - DNA, 20 bp, Homo sapiens
attcaaggagaatatgataa

SEQ ID NO: 6675078 - DNA, 17 bp, Homo sapiens
attcaaggagatataaa

SEQ ID NO: 6675079 - DNA, 20 bp, Homo sapiens
attcaaggagatataaaatc

SEQ ID NO: 6675080 - DNA, 18 bp, Homo sapiens
attcaaggagcaagaaat

SEQ ID NO: 6675081 - DNA, 16 bp, Homo sapiens
attcaaggccttccaa

SEQ ID NO: 6675082 - DNA, 13 bp, Homo sapiens
attcaaggctcag

SEQ ID NO: 6675083 - DNA, 18 bp, Homo sapiens
attcaaggctcagaagga

SEQ ID NO: 6675084 - DNA, 17 bp, Homo sapiens
attcaaggcttatctct

SEQ ID NO: 6675085 - DNA, 13 bp, Homo sapiens
attcaagtaacac

SEQ ID NO: 6675086 - DNA, 20 bp, Homo sapiens
attcaagtattaggggtaat

SEQ ID NO: 6675087 - DNA, 21 bp, Homo sapiens
attcaagtctatgatgctgtt

SEQ ID NO: 6675088 - DNA, 22 bp, Homo sapiens
attcaagtgcttaaaaatactt

SEQ ID NO: 6675089 - DNA, 22 bp, Homo sapiens
attcaataaaatactattcttt

SEQ ID NO: 6675090 - DNA, 14 bp, Homo sapiens
attcaataaagtat

SEQ ID NO: 6675091 - DNA, 18 bp, Homo sapiens
attcaataaagtatttaa

SEQ ID NO: 6675092 - DNA, 20 bp, Homo sapiens
attcaataaagtatttaatt

SEQ ID NO: 6675093 - DNA, 21 bp, Homo sapiens
attcaataaagtatttaatta

SEQ ID NO: 6675094 - DNA, 22 bp, Homo sapiens
attcaataaagtatttaattag

SEQ ID NO: 6675095 - DNA, 18 bp, Homo sapiens
attcaataactattgctg

SEQ ID NO: 6675096 - DNA, 22 bp, Homo sapiens
attcaataactattgctgcttt

SEQ ID NO: 6675097 - DNA, 13 bp, Homo sapiens
attcaataagcat

SEQ ID NO: 6675098 - DNA, 22 bp, Homo sapiens
attcaatacaaacaatctctta

SEQ ID NO: 6675099 - DNA, 21 bp, Homo sapiens
attcaatagtaatataataca

SEQ ID NO: 6675100 - DNA, 15 bp, Homo sapiens
attcaatattatgaa

SEQ ID NO: 6675101 - DNA, 15 bp, Homo sapiens
attcaatattgacat

SEQ ID NO: 6675102 - DNA, 17 bp, Homo sapiens
attcaatattgacattt

SEQ ID NO: 6675103 - DNA, 19 bp, Homo sapiens
attcaatattgacatttgt

SEQ ID NO: 6675104 - DNA, 20 bp, Homo sapiens
attcaatattgacatttgta

SEQ ID NO: 6675105 - DNA, 13 bp, Homo sapiens
attcaatatttac

SEQ ID NO: 6675106 - DNA, 13 bp, Homo sapiens
attcaatcaaagc

SEQ ID NO: 6675107 - DNA, 14 bp, Homo sapiens
attcaatcaaagct

SEQ ID NO: 6675108 - DNA, 15 bp, Homo sapiens
attcaatcaaagcta

SEQ ID NO: 6675109 - DNA, 22 bp, Homo sapiens
attcaatcgactgggtttatgt

SEQ ID NO: 6675110 - DNA, 22 bp, Homo sapiens
attcaatctgtaaactgtgtat

SEQ ID NO: 6675111 - DNA, 14 bp, Homo sapiens
attcaatgaaatgg

SEQ ID NO: 6675112 - DNA, 16 bp, Homo sapiens
attcaatgaaatggat

SEQ ID NO: 6675113 - DNA, 17 bp, Homo sapiens
attcaatgcaatgaaaa

SEQ ID NO: 6675114 - DNA, 15 bp, Homo sapiens
attcaatgcaatgca

SEQ ID NO: 6675115 - DNA, 17 bp, Homo sapiens
attcaatgcaatgcaat

SEQ ID NO: 6675116 - DNA, 21 bp, Homo sapiens
attcaatgcaatgcaattcaa

SEQ ID NO: 6675117 - DNA, 21 bp, Homo sapiens
attcaatgggtaaataaatgc

SEQ ID NO: 6675118 - DNA, 12 bp, Homo sapiens
attcaatgtgaa

SEQ ID NO: 6675119 - DNA, 15 bp, Homo sapiens
attcaattaaaacca

SEQ ID NO: 6675120 - DNA, 21 bp, Homo sapiens
attcaattaaaaccattacct

SEQ ID NO: 6675121 - DNA, 12 bp, Homo sapiens
attcaattaaag

SEQ ID NO: 6675122 - DNA, 21 bp, Homo sapiens
attcaattagtggtcataaaa

SEQ ID NO: 6675123 - DNA, 24 bp, Homo sapiens
attcaattagtggtcataaaatag

SEQ ID NO: 6675124 - DNA, 18 bp, Homo sapiens
attcaattcatagaataa

SEQ ID NO: 6675125 - DNA, 16 bp, Homo sapiens
attcaattcctctggg

SEQ ID NO: 6675126 - DNA, 15 bp, Homo sapiens
attcaattctgtata

SEQ ID NO: 6675127 - DNA, 22 bp, Homo sapiens
attcaatttaattcttatttct

SEQ ID NO: 6675128 - DNA, 23 bp, Homo sapiens
attcaatttaattcttatttctg

SEQ ID NO: 6675129 - DNA, 19 bp, Homo sapiens
attcaatttattcaagaaa

SEQ ID NO: 6675130 - DNA, 15 bp, Homo sapiens
attcaatttgattct

SEQ ID NO: 6675131 - DNA, 21 bp, Homo sapiens
attcaatttgattctatgact

SEQ ID NO: 6675132 - DNA, 13 bp, Homo sapiens
attcacaaagaaa

SEQ ID NO: 6675133 - DNA, 21 bp, Homo sapiens
attcacaaagtataacaatta

SEQ ID NO: 6675134 - DNA, 14 bp, Homo sapiens
attcacaacacaat

SEQ ID NO: 6675135 - DNA, 16 bp, Homo sapiens
attcacaacacaatca

SEQ ID NO: 6675136 - DNA, 20 bp, Homo sapiens
attcacaacctcaccaaact

SEQ ID NO: 6675137 - DNA, 22 bp, Homo sapiens
attcacaacctcaccaaactag

SEQ ID NO: 6675138 - DNA, 18 bp, Homo sapiens
attcacaagacccaaaag

SEQ ID NO: 6675139 - DNA, 15 bp, Homo sapiens
attcacaagcctcct

SEQ ID NO: 6675140 - DNA, 21 bp, Homo sapiens
attcacaagcctcctgtacct

SEQ ID NO: 6675141 - DNA, 22 bp, Homo sapiens
attcacaagcctcctgtacctc

SEQ ID NO: 6675142 - DNA, 14 bp, Homo sapiens
attcacaagctgcc

SEQ ID NO: 6675143 - DNA, 20 bp, Homo sapiens
attcacaagctgcctccctg

SEQ ID NO: 6675144 - DNA, 23 bp, Homo sapiens
attcacaagttaagattcttggt

SEQ ID NO: 6675145 - DNA, 23 bp, Homo sapiens
attcacaatggaaactttaggtc

SEQ ID NO: 6675146 - DNA, 11 bp, Homo sapiens
attcacacaca

SEQ ID NO: 6675147 - DNA, 12 bp, Homo sapiens
attcacacacag

SEQ ID NO: 6675148 - DNA, 20 bp, Homo sapiens
attcacacacagcctggcct

SEQ ID NO: 6675149 - DNA, 12 bp, Homo sapiens
attcacacaccc

SEQ ID NO: 6675150 - DNA, 17 bp, Homo sapiens
attcacaccccacctgc

SEQ ID NO: 6675151 - DNA, 22 bp, Homo sapiens
attcacagaacctactgttcct

SEQ ID NO: 6675152 - DNA, 14 bp, Homo sapiens
attcacagactgat

SEQ ID NO: 6675153 - DNA, 13 bp, Homo sapiens
attcacagagcct

SEQ ID NO: 6675154 - DNA, 14 bp, Homo sapiens
attcacagagcctt

SEQ ID NO: 6675155 - DNA, 11 bp, Homo sapiens
attcacagccc

SEQ ID NO: 6675156 - DNA, 14 bp, Homo sapiens
attcacagcccaga

SEQ ID NO: 6675157 - DNA, 23 bp, Homo sapiens
attcacagcccagaaccacagat

SEQ ID NO: 6675158 - DNA, 11 bp, Homo sapiens
attcacagcct

SEQ ID NO: 6675159 - DNA, 20 bp, Homo sapiens
attcacagcctccgcggact

SEQ ID NO: 6675160 - DNA, 14 bp, Homo sapiens
attcacagcctttc

SEQ ID NO: 6675161 - DNA, 17 bp, Homo sapiens
attcacagcgcctcctg

SEQ ID NO: 6675162 - DNA, 18 bp, Homo sapiens
attcacagcgcctcctgg

SEQ ID NO: 6675163 - DNA, 22 bp, Homo sapiens
attcacagttctttgggccaga

SEQ ID NO: 6675164 - DNA, 23 bp, Homo sapiens
attcacagttctttgggccagac

SEQ ID NO: 6675165 - DNA, 21 bp, Homo sapiens
attcacataaccccttgaaac

SEQ ID NO: 6675166 - DNA, 14 bp, Homo sapiens
attcacataataaa

SEQ ID NO: 6675167 - DNA, 21 bp, Homo sapiens
attcacatatgtcttactact

SEQ ID NO: 6675168 - DNA, 16 bp, Homo sapiens
attcacatcatttggg

SEQ ID NO: 6675169 - DNA, 20 bp, Homo sapiens
attcacatctaacctcatct

SEQ ID NO: 6675170 - DNA, 16 bp, Homo sapiens
attcacatgctggctc

SEQ ID NO: 6675171 - DNA, 18 bp, Homo sapiens
attcacatgctggctcct

SEQ ID NO: 6675172 - DNA, 19 bp, Homo sapiens
attcacatgctggctcctg

SEQ ID NO: 6675173 - DNA, 16 bp, Homo sapiens
attcacatgttctaat

SEQ ID NO: 6675174 - DNA, 21 bp, Homo sapiens
attcacatgttttcaaatgga

SEQ ID NO: 6675175 - DNA, 21 bp, Homo sapiens
attcacattgaccgcaactca

SEQ ID NO: 6675176 - DNA, 21 bp, Homo sapiens
attcacatttcaagatccaaa

SEQ ID NO: 6675177 - DNA, 16 bp, Homo sapiens
attcacatttgatgta

SEQ ID NO: 6675178 - DNA, 17 bp, Homo sapiens
attcacatttgatgtac

SEQ ID NO: 6675179 - DNA, 19 bp, Homo sapiens
attcacatttgatgtacat

SEQ ID NO: 6675180 - DNA, 16 bp, Homo sapiens
attcaccaaaagttca

SEQ ID NO: 6675181 - DNA, 14 bp, Homo sapiens
attcaccaatgttg

SEQ ID NO: 6675182 - DNA, 17 bp, Homo sapiens
attcaccaatttccttt

SEQ ID NO: 6675183 - DNA, 12 bp, Homo sapiens
attcaccaccct

SEQ ID NO: 6675184 - DNA, 20 bp, Homo sapiens
attcaccagatattttgttc

SEQ ID NO: 6675185 - DNA, 14 bp, Homo sapiens
attcacccagacag

SEQ ID NO: 6675186 - DNA, 14 bp, Homo sapiens
attcacccccatcc

SEQ ID NO: 6675187 - DNA, 21 bp, Homo sapiens
attcacccccctctgctgccg

SEQ ID NO: 6675188 - DNA, 16 bp, Homo sapiens
attcaccccctttcct

SEQ ID NO: 6675189 - DNA, 21 bp, Homo sapiens
attcacccctcccacctcttt

SEQ ID NO: 6675190 - DNA, 14 bp, Homo sapiens
attcacccctgccc

SEQ ID NO: 6675191 - DNA, 15 bp, Homo sapiens
attcacccctgcccc

SEQ ID NO: 6675192 - DNA, 17 bp, Homo sapiens
attcacccgaagcgctt

SEQ ID NO: 6675193 - DNA, 15 bp, Homo sapiens
attcaccctccactt

SEQ ID NO: 6675194 - DNA, 17 bp, Homo sapiens
attcaccctccacttcc

SEQ ID NO: 6675195 - DNA, 20 bp, Homo sapiens
attcaccctccacttcccgt

SEQ ID NO: 6675196 - DNA, 17 bp, Homo sapiens
attcacctaagagattc

SEQ ID NO: 6675197 - DNA, 20 bp, Homo sapiens
attcacctatgttattttgt

SEQ ID NO: 6675198 - DNA, 15 bp, Homo sapiens
attcacctcagcctg

SEQ ID NO: 6675199 - DNA, 17 bp, Homo sapiens
attcacctcttcctctg

SEQ ID NO: 6675200 - DNA, 13 bp, Homo sapiens
attcacctgagca

SEQ ID NO: 6675201 - DNA, 19 bp, Homo sapiens
attcacctgccccaactct

SEQ ID NO: 6675202 - DNA, 19 bp, Homo sapiens
attcacctgtaaaacttta

SEQ ID NO: 6675203 - DNA, 15 bp, Homo sapiens
attcacctgtggatg

SEQ ID NO: 6675204 - DNA, 13 bp, Homo sapiens
attcaccttcagt

SEQ ID NO: 6675205 - DNA, 17 bp, Homo sapiens
attcaccttttcttcaa

SEQ ID NO: 6675206 - DNA, 22 bp, Homo sapiens
attcacctttttaataaaaata

SEQ ID NO: 6675207 - DNA, 17 bp, Homo sapiens
attcacgcatacttgga

SEQ ID NO: 6675208 - DNA, 21 bp, Homo sapiens
attcacgccattggttggaag

SEQ ID NO: 6675209 - DNA, 20 bp, Homo sapiens
attcacgccgtaattctttc

SEQ ID NO: 6675210 - DNA, 22 bp, Homo sapiens
attcacgccgtaattctttctg

SEQ ID NO: 6675211 - DNA, 14 bp, Homo sapiens
attcacgcttttgt

SEQ ID NO: 6675212 - DNA, 20 bp, Homo sapiens
attcacggagatatgaagag

SEQ ID NO: 6675213 - DNA, 17 bp, Homo sapiens
attcacgttctagtgaa

SEQ ID NO: 6675214 - DNA, 23 bp, Homo sapiens
attcacgttctagtgaaactgca

SEQ ID NO: 6675215 - DNA, 14 bp, Homo sapiens
attcacgtttttct

SEQ ID NO: 6675216 - DNA, 16 bp, Homo sapiens
attcactagaaaatga

SEQ ID NO: 6675217 - DNA, 17 bp, Homo sapiens
attcactcaagcactga

SEQ ID NO: 6675218 - DNA, 18 bp, Homo sapiens
attcactcaagcactgat

SEQ ID NO: 6675219 - DNA, 21 bp, Homo sapiens
attcactcaagcactgatatc

SEQ ID NO: 6675220 - DNA, 22 bp, Homo sapiens
attcactcactcactcattcct

SEQ ID NO: 6675221 - DNA, 12 bp, Homo sapiens
attcactccact

SEQ ID NO: 6675222 - DNA, 22 bp, Homo sapiens
attcactccagtcaacagattc

SEQ ID NO: 6675223 - DNA, 23 bp, Homo sapiens
attcactccagtcaacagattca

SEQ ID NO: 6675224 - DNA, 11 bp, Homo sapiens
attcactctcc

SEQ ID NO: 6675225 - DNA, 20 bp, Homo sapiens
attcactgaagttctcctga

SEQ ID NO: 6675226 - DNA, 17 bp, Homo sapiens
attcactgatttgacat

SEQ ID NO: 6675227 - DNA, 11 bp, Homo sapiens
attcactgctg

SEQ ID NO: 6675228 - DNA, 13 bp, Homo sapiens
attcactggcccc

SEQ ID NO: 6675229 - DNA, 19 bp, Homo sapiens
attcactggttttacacag

SEQ ID NO: 6675230 - DNA, 20 bp, Homo sapiens
attcactggttttacacaga

SEQ ID NO: 6675231 - DNA, 14 bp, Homo sapiens
attcactgtaagtt

SEQ ID NO: 6675232 - DNA, 21 bp, Homo sapiens
attcactgtataaactttttt

SEQ ID NO: 6675233 - DNA, 14 bp, Homo sapiens
attcactgtctgtt

SEQ ID NO: 6675234 - DNA, 12 bp, Homo sapiens
attcactgtgca

SEQ ID NO: 6675235 - DNA, 14 bp, Homo sapiens
attcactgtgcttc

SEQ ID NO: 6675236 - DNA, 12 bp, Homo sapiens
attcactgttga

SEQ ID NO: 6675237 - DNA, 13 bp, Homo sapiens
attcacttaagtt

SEQ ID NO: 6675238 - DNA, 18 bp, Homo sapiens
attcacttagcagaacct

SEQ ID NO: 6675239 - DNA, 16 bp, Homo sapiens
attcacttatatgttc

SEQ ID NO: 6675240 - DNA, 13 bp, Homo sapiens
attcacttcacgc

SEQ ID NO: 6675241 - DNA, 23 bp, Homo sapiens
attcacttcagtttaatgtctcc

SEQ ID NO: 6675242 - DNA, 15 bp, Homo sapiens
attcacttctatata

SEQ ID NO: 6675243 - DNA, 23 bp, Homo sapiens
attcacttctatatatacaatga

SEQ ID NO: 6675244 - DNA, 22 bp, Homo sapiens
attcacttctgcattcctgtaa

SEQ ID NO: 6675245 - DNA, 14 bp, Homo sapiens
attcacttgcattt

SEQ ID NO: 6675246 - DNA, 22 bp, Homo sapiens
attcactttaccttcagcagtt

SEQ ID NO: 6675247 - DNA, 12 bp, Homo sapiens
attcactttaga

SEQ ID NO: 6675248 - DNA, 14 bp, Homo sapiens
attcactttattat

SEQ ID NO: 6675249 - DNA, 19 bp, Homo sapiens
attcacttttgttaacagt

SEQ ID NO: 6675250 - DNA, 23 bp, Homo sapiens
attcacttttgttaacagtattt

SEQ ID NO: 6675251 - DNA, 12 bp, Homo sapiens
attcagaaaaaa

SEQ ID NO: 6675252 - DNA, 18 bp, Homo sapiens
attcagaaaacataatat

SEQ ID NO: 6675253 - DNA, 21 bp, Homo sapiens
attcagaaaacataatataag

SEQ ID NO: 6675254 - DNA, 18 bp, Homo sapiens
attcagaaaatgttctgt

SEQ ID NO: 6675255 - DNA, 20 bp, Homo sapiens
attcagaaatgactttttga

SEQ ID NO: 6675256 - DNA, 13 bp, Homo sapiens
attcagaaatgag

SEQ ID NO: 6675257 - DNA, 16 bp, Homo sapiens
attcagaaatgtggca

SEQ ID NO: 6675258 - DNA, 20 bp, Homo sapiens
attcagaaattaaaatatta

SEQ ID NO: 6675259 - DNA, 13 bp, Homo sapiens
attcagaaattgg

SEQ ID NO: 6675260 - DNA, 14 bp, Homo sapiens
attcagaacataaa

SEQ ID NO: 6675261 - DNA, 17 bp, Homo sapiens
attcagaacataaatgc

SEQ ID NO: 6675262 - DNA, 17 bp, Homo sapiens
attcagaactaaatttt

SEQ ID NO: 6675263 - DNA, 16 bp, Homo sapiens
attcagaactatttaa

SEQ ID NO: 6675264 - DNA, 18 bp, Homo sapiens
attcagaactctcagact

SEQ ID NO: 6675265 - DNA, 13 bp, Homo sapiens
attcagaacttta

SEQ ID NO: 6675266 - DNA, 14 bp, Homo sapiens
attcagaactttag

SEQ ID NO: 6675267 - DNA, 17 bp, Homo sapiens
attcagaactttagtat

SEQ ID NO: 6675268 - DNA, 18 bp, Homo sapiens
attcagaagaaaaagaag

SEQ ID NO: 6675269 - DNA, 15 bp, Homo sapiens
attcagaagcatcac

SEQ ID NO: 6675270 - DNA, 18 bp, Homo sapiens
attcagaaggatcttcat

SEQ ID NO: 6675271 - DNA, 18 bp, Homo sapiens
attcagaatcaaaccttt

SEQ ID NO: 6675272 - DNA, 13 bp, Homo sapiens
attcagacaacat

SEQ ID NO: 6675273 - DNA, 17 bp, Homo sapiens
attcagacaacattatg

SEQ ID NO: 6675274 - DNA, 13 bp, Homo sapiens
attcagacagatg

SEQ ID NO: 6675275 - DNA, 14 bp, Homo sapiens
attcagacagatga

SEQ ID NO: 6675276 - DNA, 16 bp, Homo sapiens
attcagacagctgcct

SEQ ID NO: 6675277 - DNA, 13 bp, Homo sapiens
attcagacaggca

SEQ ID NO: 6675278 - DNA, 15 bp, Homo sapiens
attcagacatctgag

SEQ ID NO: 6675279 - DNA, 18 bp, Homo sapiens
attcagactaaaaataca

SEQ ID NO: 6675280 - DNA, 20 bp, Homo sapiens
attcagactaaaaatacacc

SEQ ID NO: 6675281 - DNA, 18 bp, Homo sapiens
attcagagaaaggcaagg

SEQ ID NO: 6675282 - DNA, 20 bp, Homo sapiens
attcagagaaaggcaaggga

SEQ ID NO: 6675283 - DNA, 19 bp, Homo sapiens
attcagagactgcccttct

SEQ ID NO: 6675284 - DNA, 14 bp, Homo sapiens
attcagagatgtac

SEQ ID NO: 6675285 - DNA, 21 bp, Homo sapiens
attcagagatgtaccatgtta

SEQ ID NO: 6675286 - DNA, 22 bp, Homo sapiens
attcagaggaagacatctgtag

SEQ ID NO: 6675287 - DNA, 20 bp, Homo sapiens
attcagaggcagtgatgact

SEQ ID NO: 6675288 - DNA, 17 bp, Homo sapiens
attcagagttgatggtt

SEQ ID NO: 6675289 - DNA, 19 bp, Homo sapiens
attcagataatggtaattt

SEQ ID NO: 6675290 - DNA, 22 bp, Homo sapiens
attcagataatggtaatttagt

SEQ ID NO: 6675291 - DNA, 18 bp, Homo sapiens
attcagatatatttttca

SEQ ID NO: 6675292 - DNA, 21 bp, Homo sapiens
attcagatatatttttcacag

SEQ ID NO: 6675293 - DNA, 19 bp, Homo sapiens
attcagatcaaaatgcctt

SEQ ID NO: 6675294 - DNA, 20 bp, Homo sapiens
attcagatcaaaatgccttt

SEQ ID NO: 6675295 - DNA, 23 bp, Homo sapiens
attcagatcaaaatgcctttcag

SEQ ID NO: 6675296 - DNA, 19 bp, Homo sapiens
attcagatcactgaattta

SEQ ID NO: 6675297 - DNA, 18 bp, Homo sapiens
attcagatcgtattaatt

SEQ ID NO: 6675298 - DNA, 19 bp, Homo sapiens
attcagatcgtattaatta

SEQ ID NO: 6675299 - DNA, 20 bp, Homo sapiens
attcagatgaatagatggaa

SEQ ID NO: 6675300 - DNA, 12 bp, Homo sapiens
attcagatgtat

SEQ ID NO: 6675301 - DNA, 21 bp, Homo sapiens
attcagattaggacacagtgt

SEQ ID NO: 6675302 - DNA, 18 bp, Homo sapiens
attcagattgtcttgcaa

SEQ ID NO: 6675303 - DNA, 22 bp, Homo sapiens
attcagattgtcttgcaacttc

SEQ ID NO: 6675304 - DNA, 22 bp, Homo sapiens
attcagatttctacactttata

SEQ ID NO: 6675305 - DNA, 20 bp, Homo sapiens
attcagatttctctttgaaa

SEQ ID NO: 6675306 - DNA, 15 bp, Homo sapiens
attcagcaaatattt

SEQ ID NO: 6675307 - DNA, 15 bp, Homo sapiens
attcagcacacccca

SEQ ID NO: 6675308 - DNA, 19 bp, Homo sapiens
attcagcacaccccaaggg

SEQ ID NO: 6675309 - DNA, 20 bp, Homo sapiens
attcagcacaccccaaggga

SEQ ID NO: 6675310 - DNA, 20 bp, Homo sapiens
attcagcaccctgggtgcca

SEQ ID NO: 6675311 - DNA, 21 bp, Homo sapiens
attcagcaccctgggtgccat

SEQ ID NO: 6675312 - DNA, 14 bp, Homo sapiens
attcagcactgatt

SEQ ID NO: 6675313 - DNA, 20 bp, Homo sapiens
attcagcactgatttcacaa

SEQ ID NO: 6675314 - DNA, 19 bp, Homo sapiens
attcagcagcaaattttca

SEQ ID NO: 6675315 - DNA, 14 bp, Homo sapiens
attcagcagtgcct

SEQ ID NO: 6675316 - DNA, 21 bp, Homo sapiens
attcagcagtgtctgttcttc

SEQ ID NO: 6675317 - DNA, 12 bp, Homo sapiens
attcagcatctg

SEQ ID NO: 6675318 - DNA, 21 bp, Homo sapiens
attcagcatttgatttccatg

SEQ ID NO: 6675319 - DNA, 15 bp, Homo sapiens
attcagcctggcttc

SEQ ID NO: 6675320 - DNA, 12 bp, Homo sapiens
attcagccttat

SEQ ID NO: 6675321 - DNA, 14 bp, Homo sapiens
attcagccttcttt

SEQ ID NO: 6675322 - DNA, 16 bp, Homo sapiens
attcagccttcttttt

SEQ ID NO: 6675323 - DNA, 22 bp, Homo sapiens
attcagccttctttttctggac

SEQ ID NO: 6675324 - DNA, 16 bp, Homo sapiens
attcagccttgctgac

SEQ ID NO: 6675325 - DNA, 19 bp, Homo sapiens
attcagctagaatttctgg

SEQ ID NO: 6675326 - DNA, 21 bp, Homo sapiens
attcagctcactggtttacaa

SEQ ID NO: 6675327 - DNA, 20 bp, Homo sapiens
attcagctcattatgaaaaa

SEQ ID NO: 6675328 - DNA, 23 bp, Homo sapiens
attcagctcattatgaaaaacat

SEQ ID NO: 6675329 - DNA, 14 bp, Homo sapiens
attcagctctgatc

SEQ ID NO: 6675330 - DNA, 14 bp, Homo sapiens
attcagctctggag

SEQ ID NO: 6675331 - DNA, 21 bp, Homo sapiens
attcagctctggagaacagtg

SEQ ID NO: 6675332 - DNA, 11 bp, Homo sapiens
attcagctgcc

SEQ ID NO: 6675333 - DNA, 21 bp, Homo sapiens
attcaggaaaaggcctggggt

SEQ ID NO: 6675334 - DNA, 17 bp, Homo sapiens
attcaggaagataaaaa

SEQ ID NO: 6675335 - DNA, 22 bp, Homo sapiens
attcaggaagctcagggcctgg

SEQ ID NO: 6675336 - DNA, 14 bp, Homo sapiens
attcaggaatgggc

SEQ ID NO: 6675337 - DNA, 21 bp, Homo sapiens
attcaggaatgtgtggcctgc

SEQ ID NO: 6675338 - DNA, 20 bp, Homo sapiens
attcaggacgtccttccata

SEQ ID NO: 6675339 - DNA, 19 bp, Homo sapiens
attcaggactgctggtttg

SEQ ID NO: 6675340 - DNA, 14 bp, Homo sapiens
attcaggactggct

SEQ ID NO: 6675341 - DNA, 16 bp, Homo sapiens
attcaggactggctca

SEQ ID NO: 6675342 - DNA, 22 bp, Homo sapiens
attcaggacttaacggctccag

SEQ ID NO: 6675343 - DNA, 14 bp, Homo sapiens
attcaggcacatgt

SEQ ID NO: 6675344 - DNA, 16 bp, Homo sapiens
attcaggcagcactga

SEQ ID NO: 6675345 - DNA, 17 bp, Homo sapiens
attcaggccagcccagc

SEQ ID NO: 6675346 - DNA, 18 bp, Homo sapiens
attcaggccagcccagcc

SEQ ID NO: 6675347 - DNA, 23 bp, Homo sapiens
attcaggccagcccagccaggcc

SEQ ID NO: 6675348 - DNA, 12 bp, Homo sapiens
attcaggcctct

SEQ ID NO: 6675349 - DNA, 22 bp, Homo sapiens
attcaggcctctgaggagccca

SEQ ID NO: 6675350 - DNA, 16 bp, Homo sapiens
attcaggctactcatt

SEQ ID NO: 6675351 - DNA, 16 bp, Homo sapiens
attcaggctgcttggg

SEQ ID NO: 6675352 - DNA, 17 bp, Homo sapiens
attcagggagaatgttg

SEQ ID NO: 6675353 - DNA, 19 bp, Homo sapiens
attcagggagaatgttgtt

SEQ ID NO: 6675354 - DNA, 15 bp, Homo sapiens
attcagggctttaaa

SEQ ID NO: 6675355 - DNA, 18 bp, Homo sapiens
attcaggggaaacttgat

SEQ ID NO: 6675356 - DNA, 15 bp, Homo sapiens
attcaggggaagggc

SEQ ID NO: 6675357 - DNA, 19 bp, Homo sapiens
attcaggggctgacacttc

SEQ ID NO: 6675358 - DNA, 17 bp, Homo sapiens
attcaggggctgggggt

SEQ ID NO: 6675359 - DNA, 16 bp, Homo sapiens
attcaggggctttggg

SEQ ID NO: 6675360 - DNA, 19 bp, Homo sapiens
attcaggggctttgggccc

SEQ ID NO: 6675361 - DNA, 18 bp, Homo sapiens
attcagggtaaataggaa

SEQ ID NO: 6675362 - DNA, 14 bp, Homo sapiens
attcaggtaacact

SEQ ID NO: 6675363 - DNA, 16 bp, Homo sapiens
attcaggtaatacaaa

SEQ ID NO: 6675364 - DNA, 18 bp, Homo sapiens
attcaggtacagaaaaca

SEQ ID NO: 6675365 - DNA, 20 bp, Homo sapiens
attcaggtacagaaaacatg

SEQ ID NO: 6675366 - DNA, 23 bp, Homo sapiens
attcaggtatgttgcctttatgg

SEQ ID NO: 6675367 - DNA, 22 bp, Homo sapiens
attcaggtcccagttgctgtca

SEQ ID NO: 6675368 - DNA, 21 bp, Homo sapiens
attcaggtctgtatgtcatgg

SEQ ID NO: 6675369 - DNA, 18 bp, Homo sapiens
attcaggtgacctcctgc

SEQ ID NO: 6675370 - DNA, 21 bp, Homo sapiens
attcaggtgataactcaccat

SEQ ID NO: 6675371 - DNA, 17 bp, Homo sapiens
attcaggtgcagaggaa

SEQ ID NO: 6675372 - DNA, 17 bp, Homo sapiens
attcaggtgttctcttc

SEQ ID NO: 6675373 - DNA, 12 bp, Homo sapiens
attcaggttttt

SEQ ID NO: 6675374 - DNA, 19 bp, Homo sapiens
attcagtaaacaaattctt

SEQ ID NO: 6675375 - DNA, 14 bp, Homo sapiens
attcagtaacattt

SEQ ID NO: 6675376 - DNA, 19 bp, Homo sapiens
attcagtaacttgtttaca

SEQ ID NO: 6675377 - DNA, 13 bp, Homo sapiens
attcagtaatgca

SEQ ID NO: 6675378 - DNA, 22 bp, Homo sapiens
attcagtaatgcagtttttaaa

SEQ ID NO: 6675379 - DNA, 14 bp, Homo sapiens
attcagtactgatt

SEQ ID NO: 6675380 - DNA, 22 bp, Homo sapiens
attcagtagcattttaatagtt

SEQ ID NO: 6675381 - DNA, 12 bp, Homo sapiens
attcagtatttt

SEQ ID NO: 6675382 - DNA, 14 bp, Homo sapiens
attcagtcctgtat

SEQ ID NO: 6675383 - DNA, 22 bp, Homo sapiens
attcagtctcagctgctgaaat

SEQ ID NO: 6675384 - DNA, 21 bp, Homo sapiens
attcagtctgctctcccttgt

SEQ ID NO: 6675385 - DNA, 16 bp, Homo sapiens
attcagtcttgcctta

SEQ ID NO: 6675386 - DNA, 17 bp, Homo sapiens
attcagtcttgccttac

SEQ ID NO: 6675387 - DNA, 16 bp, Homo sapiens
attcagtgaaaaagat

SEQ ID NO: 6675388 - DNA, 14 bp, Homo sapiens
attcagtgaaaaga

SEQ ID NO: 6675389 - DNA, 13 bp, Homo sapiens
attcagtgaattt

SEQ ID NO: 6675390 - DNA, 17 bp, Homo sapiens
attcagtgatatgtaaa

SEQ ID NO: 6675391 - DNA, 18 bp, Homo sapiens
attcagtgatatgtaaat

SEQ ID NO: 6675392 - DNA, 15 bp, Homo sapiens
attcagtgattactg

SEQ ID NO: 6675393 - DNA, 17 bp, Homo sapiens
attcagtgattactgtc

SEQ ID NO: 6675394 - DNA, 22 bp, Homo sapiens
attcagtgctgtggcctgggca

SEQ ID NO: 6675395 - DNA, 15 bp, Homo sapiens
attcagtggacattt

SEQ ID NO: 6675396 - DNA, 17 bp, Homo sapiens
attcagtggacatttgt

SEQ ID NO: 6675397 - DNA, 22 bp, Homo sapiens
attcagtggacatttgttctgg

SEQ ID NO: 6675398 - DNA, 16 bp, Homo sapiens
attcagtggaggctgg

SEQ ID NO: 6675399 - DNA, 18 bp, Homo sapiens
attcagtggcaacttgtg

SEQ ID NO: 6675400 - DNA, 19 bp, Homo sapiens
attcagtggcgagaaataa

SEQ ID NO: 6675401 - DNA, 16 bp, Homo sapiens
attcagtggtgaaatc

SEQ ID NO: 6675402 - DNA, 23 bp, Homo sapiens
attcagtggtgaaatcttgtttg

SEQ ID NO: 6675403 - DNA, 17 bp, Homo sapiens
attcagttaagaaaaaa

SEQ ID NO: 6675404 - DNA, 19 bp, Homo sapiens
attcagttaggctagagac

SEQ ID NO: 6675405 - DNA, 23 bp, Homo sapiens
attcagttcccaccatctgatta

SEQ ID NO: 6675406 - DNA, 19 bp, Homo sapiens
attcagttctaggcctttc

SEQ ID NO: 6675407 - DNA, 22 bp, Homo sapiens
attcagttctaggcctttcctc

SEQ ID NO: 6675408 - DNA, 24 bp, Homo sapiens
attcagttctaggcctttcctctg

SEQ ID NO: 6675409 - DNA, 18 bp, Homo sapiens
attcagttcttacacatt

SEQ ID NO: 6675410 - DNA, 16 bp, Homo sapiens
attcagttgttagtgt

SEQ ID NO: 6675411 - DNA, 21 bp, Homo sapiens
attcagttgttagtgtgtctt

SEQ ID NO: 6675412 - DNA, 19 bp, Homo sapiens
attcagtttaagagttttc

SEQ ID NO: 6675413 - DNA, 21 bp, Homo sapiens
attcagtttaagagttttcct

SEQ ID NO: 6675414 - DNA, 18 bp, Homo sapiens
attcagttttcccacttt

SEQ ID NO: 6675415 - DNA, 20 bp, Homo sapiens
attcagtttttgtatcttgg

SEQ ID NO: 6675416 - DNA, 19 bp, Homo sapiens
attcagtttttttccagtt

SEQ ID NO: 6675417 - DNA, 16 bp, Homo sapiens
attcataaaaataacc

SEQ ID NO: 6675418 - DNA, 17 bp, Homo sapiens
attcataaagagaaaat

SEQ ID NO: 6675419 - DNA, 16 bp, Homo sapiens
attcataaagtaatga

SEQ ID NO: 6675420 - DNA, 15 bp, Homo sapiens
attcataaagttaca

SEQ ID NO: 6675421 - DNA, 19 bp, Homo sapiens
attcataaagttacagttt

SEQ ID NO: 6675422 - DNA, 23 bp, Homo sapiens
attcataacaatgtatgtgaaag

SEQ ID NO: 6675423 - DNA, 23 bp, Homo sapiens
attcataagccaatttttctgca

SEQ ID NO: 6675424 - DNA, 14 bp, Homo sapiens
attcataaggaaat

SEQ ID NO: 6675425 - DNA, 17 bp, Homo sapiens
attcataagtctttggt

SEQ ID NO: 6675426 - DNA, 12 bp, Homo sapiens
attcataataaa

SEQ ID NO: 6675427 - DNA, 19 bp, Homo sapiens
attcataatatataaaaga

SEQ ID NO: 6675428 - DNA, 19 bp, Homo sapiens
attcataatgaattataac

SEQ ID NO: 6675429 - DNA, 21 bp, Homo sapiens
attcataatgaattataacag

SEQ ID NO: 6675430 - DNA, 15 bp, Homo sapiens
attcataatgactta

SEQ ID NO: 6675431 - DNA, 15 bp, Homo sapiens
attcataatgtgaga

SEQ ID NO: 6675432 - DNA, 16 bp, Homo sapiens
attcataattaaaatt

SEQ ID NO: 6675433 - DNA, 16 bp, Homo sapiens
attcataattagaaca

SEQ ID NO: 6675434 - DNA, 22 bp, Homo sapiens
attcatacaaagtactgtcctc

SEQ ID NO: 6675435 - DNA, 21 bp, Homo sapiens
attcatacaacaaagaggatt

SEQ ID NO: 6675436 - DNA, 16 bp, Homo sapiens
attcatactaaataaa

SEQ ID NO: 6675437 - DNA, 19 bp, Homo sapiens
attcatactaaataaaaca

SEQ ID NO: 6675438 - DNA, 14 bp, Homo sapiens
attcatactcaaag

SEQ ID NO: 6675439 - DNA, 15 bp, Homo sapiens
attcatactcaaaga

SEQ ID NO: 6675440 - DNA, 16 bp, Homo sapiens
attcatactccttttg

SEQ ID NO: 6675441 - DNA, 13 bp, Homo sapiens
attcatactctgt

SEQ ID NO: 6675442 - DNA, 20 bp, Homo sapiens
attcatactctgttgcctcc

SEQ ID NO: 6675443 - DNA, 20 bp, Homo sapiens
attcatacttaaaaatttat

SEQ ID NO: 6675444 - DNA, 19 bp, Homo sapiens
attcatagcatcctgatta

SEQ ID NO: 6675445 - DNA, 19 bp, Homo sapiens
attcatagctgtatatttg

SEQ ID NO: 6675446 - DNA, 23 bp, Homo sapiens
attcatagggaaaggttttgtat

SEQ ID NO: 6675447 - DNA, 17 bp, Homo sapiens
attcatagtaacttctt

SEQ ID NO: 6675448 - DNA, 18 bp, Homo sapiens
attcatagtaacttctta

SEQ ID NO: 6675449 - DNA, 21 bp, Homo sapiens
attcatagtggattaatgcat

SEQ ID NO: 6675450 - DNA, 17 bp, Homo sapiens
attcatagttttatatc

SEQ ID NO: 6675451 - DNA, 15 bp, Homo sapiens
attcatataaaagtt

SEQ ID NO: 6675452 - DNA, 21 bp, Homo sapiens
attcatatacaaacatgtatg

SEQ ID NO: 6675453 - DNA, 16 bp, Homo sapiens
attcatatattgcatt

SEQ ID NO: 6675454 - DNA, 18 bp, Homo sapiens
attcatatattgcatttc

SEQ ID NO: 6675455 - DNA, 16 bp, Homo sapiens
attcatatctaaatag

SEQ ID NO: 6675456 - DNA, 18 bp, Homo sapiens
attcatatctaaatagta

SEQ ID NO: 6675457 - DNA, 13 bp, Homo sapiens
attcatatgcata

SEQ ID NO: 6675458 - DNA, 14 bp, Homo sapiens
attcatatgcatat

SEQ ID NO: 6675459 - DNA, 18 bp, Homo sapiens
attcatatgcatattttt

SEQ ID NO: 6675460 - DNA, 14 bp, Homo sapiens
attcatattacaat

SEQ ID NO: 6675461 - DNA, 18 bp, Homo sapiens
attcatattacaatattt

SEQ ID NO: 6675462 - DNA, 21 bp, Homo sapiens
attcatattaccagaaaatga

SEQ ID NO: 6675463 - DNA, 19 bp, Homo sapiens
attcatattctgttggaag

SEQ ID NO: 6675464 - DNA, 13 bp, Homo sapiens
attcatattgaat

SEQ ID NO: 6675465 - DNA, 14 bp, Homo sapiens
attcatattgaata

SEQ ID NO: 6675466 - DNA, 16 bp, Homo sapiens
attcatattgcatcat

SEQ ID NO: 6675467 - DNA, 18 bp, Homo sapiens
attcatatttacttctta

SEQ ID NO: 6675468 - DNA, 20 bp, Homo sapiens
attcatatttgcaataaaaa

SEQ ID NO: 6675469 - DNA, 13 bp, Homo sapiens
attcatatttgta

SEQ ID NO: 6675470 - DNA, 21 bp, Homo sapiens
attcatatttgtactttctgt

SEQ ID NO: 6675471 - DNA, 20 bp, Homo sapiens
attcatatttgtagttgcat

SEQ ID NO: 6675472 - DNA, 14 bp, Homo sapiens
attcatattttcca

SEQ ID NO: 6675473 - DNA, 16 bp, Homo sapiens
attcatattttctttc

SEQ ID NO: 6675474 - DNA, 16 bp, Homo sapiens
attcatcaaactcttt

SEQ ID NO: 6675475 - DNA, 12 bp, Homo sapiens
attcatcaaata

SEQ ID NO: 6675476 - DNA, 14 bp, Homo sapiens
attcatcaaataaa

SEQ ID NO: 6675477 - DNA, 19 bp, Homo sapiens
attcatcaaatggaagaca

SEQ ID NO: 6675478 - DNA, 15 bp, Homo sapiens
attcatcaatgaaga

SEQ ID NO: 6675479 - DNA, 12 bp, Homo sapiens
attcatcagaat

SEQ ID NO: 6675480 - DNA, 21 bp, Homo sapiens
attcatcatatgaatgttctt

SEQ ID NO: 6675481 - DNA, 14 bp, Homo sapiens
attcatccagagtt

SEQ ID NO: 6675482 - DNA, 18 bp, Homo sapiens
attcatccagttgcaata

SEQ ID NO: 6675483 - DNA, 20 bp, Homo sapiens
attcatccagttgcaataaa

SEQ ID NO: 6675484 - DNA, 16 bp, Homo sapiens
attcatcccaactgtc

SEQ ID NO: 6675485 - DNA, 13 bp, Homo sapiens
attcatcccctcc

SEQ ID NO: 6675486 - DNA, 11 bp, Homo sapiens
attcatcctca

SEQ ID NO: 6675487 - DNA, 13 bp, Homo sapiens
attcatccttcca

SEQ ID NO: 6675488 - DNA, 15 bp, Homo sapiens
attcatctaatgtat

SEQ ID NO: 6675489 - DNA, 16 bp, Homo sapiens
attcatctctcaaact

SEQ ID NO: 6675490 - DNA, 22 bp, Homo sapiens
attcatctctggttttcttgcc

SEQ ID NO: 6675491 - DNA, 13 bp, Homo sapiens
attcatctgcaat

SEQ ID NO: 6675492 - DNA, 19 bp, Homo sapiens
attcatctggaggctgcgt

SEQ ID NO: 6675493 - DNA, 22 bp, Homo sapiens
attcatctgttgacaatttgcc

SEQ ID NO: 6675494 - DNA, 18 bp, Homo sapiens
attcatcttttaatcatg

SEQ ID NO: 6675495 - DNA, 22 bp, Homo sapiens
attcatcttttaatcatgagcc

SEQ ID NO: 6675496 - DNA, 13 bp, Homo sapiens
attcatgaacttc

SEQ ID NO: 6675497 - DNA, 14 bp, Homo sapiens
attcatgaatattt

SEQ ID NO: 6675498 - DNA, 17 bp, Homo sapiens
attcatgaatattttca

SEQ ID NO: 6675499 - DNA, 15 bp, Homo sapiens
attcatgacattatg

SEQ ID NO: 6675500 - DNA, 13 bp, Homo sapiens
attcatgactatg

SEQ ID NO: 6675501 - DNA, 17 bp, Homo sapiens
attcatgagctgggtac

SEQ ID NO: 6675502 - DNA, 12 bp, Homo sapiens
attcatgatgct

SEQ ID NO: 6675503 - DNA, 15 bp, Homo sapiens
attcatgatgctagt

SEQ ID NO: 6675504 - DNA, 18 bp, Homo sapiens
attcatgcaacttgattc

SEQ ID NO: 6675505 - DNA, 21 bp, Homo sapiens
attcatgcaagagtttcttgt

SEQ ID NO: 6675506 - DNA, 20 bp, Homo sapiens
attcatgccatctgttttca

SEQ ID NO: 6675507 - DNA, 22 bp, Homo sapiens
attcatgctgcctgccatgtgt

SEQ ID NO: 6675508 - DNA, 18 bp, Homo sapiens
attcatggaccactgttt

SEQ ID NO: 6675509 - DNA, 19 bp, Homo sapiens
attcatggagtagcctgga

SEQ ID NO: 6675510 - DNA, 19 bp, Homo sapiens
attcatggctttgtatcca

SEQ ID NO: 6675511 - DNA, 15 bp, Homo sapiens
attcatggtatcttg

SEQ ID NO: 6675512 - DNA, 15 bp, Homo sapiens
attcatggttatgaa

SEQ ID NO: 6675513 - DNA, 12 bp, Homo sapiens
attcatggttca

SEQ ID NO: 6675514 - DNA, 15 bp, Homo sapiens
attcatggttcaagt

SEQ ID NO: 6675515 - DNA, 20 bp, Homo sapiens
attcatggttttaaagctaa

SEQ ID NO: 6675516 - DNA, 21 bp, Homo sapiens
attcatggttttaaagctaaa

SEQ ID NO: 6675517 - DNA, 12 bp, Homo sapiens
attcatgtaaca

SEQ ID NO: 6675518 - DNA, 17 bp, Homo sapiens
attcatgtaacagttgt

SEQ ID NO: 6675519 - DNA, 18 bp, Homo sapiens
attcatgtaacagttgtg

SEQ ID NO: 6675520 - DNA, 13 bp, Homo sapiens
attcatgtaactc

SEQ ID NO: 6675521 - DNA, 16 bp, Homo sapiens
attcatgtaactctcc

SEQ ID NO: 6675522 - DNA, 19 bp, Homo sapiens
attcatgtaactctccagc

SEQ ID NO: 6675523 - DNA, 14 bp, Homo sapiens
attcatgtaataaa

SEQ ID NO: 6675524 - DNA, 17 bp, Homo sapiens
attcatgtaataaacag

SEQ ID NO: 6675525 - DNA, 16 bp, Homo sapiens
attcatgtacagcatg

SEQ ID NO: 6675526 - DNA, 14 bp, Homo sapiens
attcatgtccagag

SEQ ID NO: 6675527 - DNA, 19 bp, Homo sapiens
attcatgtgcttgtgccta

SEQ ID NO: 6675528 - DNA, 18 bp, Homo sapiens
attcatgtgtaggaagag

SEQ ID NO: 6675529 - DNA, 19 bp, Homo sapiens
attcatgttcatgtgatta

SEQ ID NO: 6675530 - DNA, 12 bp, Homo sapiens
attcatgtttct

SEQ ID NO: 6675531 - DNA, 17 bp, Homo sapiens
attcatgttttaaaagt

SEQ ID NO: 6675532 - DNA, 21 bp, Homo sapiens
attcatgttttaaaagtttgt

SEQ ID NO: 6675533 - DNA, 14 bp, Homo sapiens
attcattaaagaaa

SEQ ID NO: 6675534 - DNA, 13 bp, Homo sapiens
attcattaatctg

SEQ ID NO: 6675535 - DNA, 15 bp, Homo sapiens
attcattagttttga

SEQ ID NO: 6675536 - DNA, 15 bp, Homo sapiens
attcattatgtcaat

SEQ ID NO: 6675537 - DNA, 12 bp, Homo sapiens
attcattatttg

SEQ ID NO: 6675538 - DNA, 15 bp, Homo sapiens
attcattcactcttc

SEQ ID NO: 6675539 - DNA, 22 bp, Homo sapiens
attcattcagatataagatttg

SEQ ID NO: 6675540 - DNA, 15 bp, Homo sapiens
attcattcagtattt

SEQ ID NO: 6675541 - DNA, 13 bp, Homo sapiens
attcattccattt

SEQ ID NO: 6675542 - DNA, 22 bp, Homo sapiens
attcattcctcacaatgaggct

SEQ ID NO: 6675543 - DNA, 12 bp, Homo sapiens
attcattctcat

SEQ ID NO: 6675544 - DNA, 20 bp, Homo sapiens
attcattctcataattccta

SEQ ID NO: 6675545 - DNA, 14 bp, Homo sapiens
attcattctgagcc

SEQ ID NO: 6675546 - DNA, 22 bp, Homo sapiens
attcattctggtctctctatta

SEQ ID NO: 6675547 - DNA, 13 bp, Homo sapiens
attcattctttat

SEQ ID NO: 6675548 - DNA, 15 bp, Homo sapiens
attcattctttttga

SEQ ID NO: 6675549 - DNA, 19 bp, Homo sapiens
attcattgtataaaaatag

SEQ ID NO: 6675550 - DNA, 13 bp, Homo sapiens
attcatttaaaat

SEQ ID NO: 6675551 - DNA, 15 bp, Homo sapiens
attcatttaaaatga

SEQ ID NO: 6675552 - DNA, 13 bp, Homo sapiens
attcatttaagaa

SEQ ID NO: 6675553 - DNA, 17 bp, Homo sapiens
attcatttaagaacaag

SEQ ID NO: 6675554 - DNA, 14 bp, Homo sapiens
attcatttaagtca

SEQ ID NO: 6675555 - DNA, 14 bp, Homo sapiens
attcatttactcac

SEQ ID NO: 6675556 - DNA, 22 bp, Homo sapiens
attcatttcaaagggagagaga

SEQ ID NO: 6675557 - DNA, 12 bp, Homo sapiens
attcatttcaca

SEQ ID NO: 6675558 - DNA, 13 bp, Homo sapiens
attcatttcacat

SEQ ID NO: 6675559 - DNA, 13 bp, Homo sapiens
attcatttcactg

SEQ ID NO: 6675560 - DNA, 15 bp, Homo sapiens
attcatttcactgta

SEQ ID NO: 6675561 - DNA, 15 bp, Homo sapiens
attcatttcacttta

SEQ ID NO: 6675562 - DNA, 13 bp, Homo sapiens
attcatttcataa

SEQ ID NO: 6675563 - DNA, 14 bp, Homo sapiens
attcatttgaataa

SEQ ID NO: 6675564 - DNA, 13 bp, Homo sapiens
attcatttggtga

SEQ ID NO: 6675565 - DNA, 14 bp, Homo sapiens
attcatttgtattg

SEQ ID NO: 6675566 - DNA, 23 bp, Homo sapiens
attcatttgtattgcttatttta

SEQ ID NO: 6675567 - DNA, 12 bp, Homo sapiens
attcatttgtgg

SEQ ID NO: 6675568 - DNA, 12 bp, Homo sapiens
attcatttgttt

SEQ ID NO: 6675569 - DNA, 18 bp, Homo sapiens
attcattttatattgaaa

SEQ ID NO: 6675570 - DNA, 20 bp, Homo sapiens
attcattttatattgaaaaa

SEQ ID NO: 6675571 - DNA, 22 bp, Homo sapiens
attcattttatattgaaaaaaa

SEQ ID NO: 6675572 - DNA, 12 bp, Homo sapiens
attcattttcct

SEQ ID NO: 6675573 - DNA, 15 bp, Homo sapiens
attcattttctagat

SEQ ID NO: 6675574 - DNA, 16 bp, Homo sapiens
attcattttctctaat

SEQ ID NO: 6675575 - DNA, 21 bp, Homo sapiens
attcattttctgacatgcatt

SEQ ID NO: 6675576 - DNA, 13 bp, Homo sapiens
attccaaaaacat

SEQ ID NO: 6675577 - DNA, 17 bp, Homo sapiens
attccaaaagggggcct

SEQ ID NO: 6675578 - DNA, 14 bp, Homo sapiens
attccaaaattcca

SEQ ID NO: 6675579 - DNA, 15 bp, Homo sapiens
attccaaaattccat

SEQ ID NO: 6675580 - DNA, 18 bp, Homo sapiens
attccaaaccaaatttta

SEQ ID NO: 6675581 - DNA, 21 bp, Homo sapiens
attccaaacttctaaatgttg

SEQ ID NO: 6675582 - DNA, 13 bp, Homo sapiens
attccaaagagtg

SEQ ID NO: 6675583 - DNA, 11 bp, Homo sapiens
attccaaagat

SEQ ID NO: 6675584 - DNA, 19 bp, Homo sapiens
attccaaagtctctaattc

SEQ ID NO: 6675585 - DNA, 20 bp, Homo sapiens
attccaaatgtcttttagaa

SEQ ID NO: 6675586 - DNA, 13 bp, Homo sapiens
attccaaattcat

SEQ ID NO: 6675587 - DNA, 23 bp, Homo sapiens
attccaacaatggggtgggccca

SEQ ID NO: 6675588 - DNA, 16 bp, Homo sapiens
attccaacactgattt

SEQ ID NO: 6675589 - DNA, 14 bp, Homo sapiens
attccaacagctca

SEQ ID NO: 6675590 - DNA, 20 bp, Homo sapiens
attccaacatttctcactga

SEQ ID NO: 6675591 - DNA, 20 bp, Homo sapiens
attccaacccaggtctgctt

SEQ ID NO: 6675592 - DNA, 16 bp, Homo sapiens
attccaaccccaactc

SEQ ID NO: 6675593 - DNA, 14 bp, Homo sapiens
attccaactcctga

SEQ ID NO: 6675594 - DNA, 19 bp, Homo sapiens
attccaactcgtatagcat

SEQ ID NO: 6675595 - DNA, 23 bp, Homo sapiens
attccaactcgtatagcatgcat

SEQ ID NO: 6675596 - DNA, 23 bp, Homo sapiens
attccaactgggcatttcaatcc

SEQ ID NO: 6675597 - DNA, 13 bp, Homo sapiens
attccaagaacta

SEQ ID NO: 6675598 - DNA, 14 bp, Homo sapiens
attccaagacagta

SEQ ID NO: 6675599 - DNA, 16 bp, Homo sapiens
attccaagactctaga

SEQ ID NO: 6675600 - DNA, 17 bp, Homo sapiens
attccaagactctagag

SEQ ID NO: 6675601 - DNA, 17 bp, Homo sapiens
attccaagattaaaagt

SEQ ID NO: 6675602 - DNA, 22 bp, Homo sapiens
attccaagattaaaagttcata

SEQ ID NO: 6675603 - DNA, 13 bp, Homo sapiens
attccaagcttcc

SEQ ID NO: 6675604 - DNA, 23 bp, Homo sapiens
attccaagcttccatagctgctg

SEQ ID NO: 6675605 - DNA, 21 bp, Homo sapiens
attccaagtcaacactcttct

SEQ ID NO: 6675606 - DNA, 22 bp, Homo sapiens
attccaagtgcatttttcttat

SEQ ID NO: 6675607 - DNA, 16 bp, Homo sapiens
attccaagtgtatttt

SEQ ID NO: 6675608 - DNA, 20 bp, Homo sapiens
attccaagtgtattttaaaa

SEQ ID NO: 6675609 - DNA, 17 bp, Homo sapiens
attccaagtgtttctgt

SEQ ID NO: 6675610 - DNA, 12 bp, Homo sapiens
attccaataaac

SEQ ID NO: 6675611 - DNA, 19 bp, Homo sapiens
attccaataaagcagagtt

SEQ ID NO: 6675612 - DNA, 12 bp, Homo sapiens
attccaatacat

SEQ ID NO: 6675613 - DNA, 20 bp, Homo sapiens
attccaatacattgaacaca

SEQ ID NO: 6675614 - DNA, 12 bp, Homo sapiens
attccaatattt

SEQ ID NO: 6675615 - DNA, 13 bp, Homo sapiens
attccaatattta

SEQ ID NO: 6675616 - DNA, 17 bp, Homo sapiens
attccaatatttataat

SEQ ID NO: 6675617 - DNA, 23 bp, Homo sapiens
attccaatgatacccaacagttt

SEQ ID NO: 6675618 - DNA, 18 bp, Homo sapiens
attccaattaaatttatt

SEQ ID NO: 6675619 - DNA, 15 bp, Homo sapiens
attccaattctaaat

SEQ ID NO: 6675620 - DNA, 20 bp, Homo sapiens
attccaatttcaaaatgtct

SEQ ID NO: 6675621 - DNA, 21 bp, Homo sapiens
attccacaaacacattataaa

SEQ ID NO: 6675622 - DNA, 9 bp, Homo sapiens
attccacac

SEQ ID NO: 6675623 - DNA, 13 bp, Homo sapiens
attccacacattt

SEQ ID NO: 6675624 - DNA, 21 bp, Homo sapiens
attccacagagttactgccac

SEQ ID NO: 6675625 - DNA, 22 bp, Homo sapiens
attccacagatatctttttcat

SEQ ID NO: 6675626 - DNA, 12 bp, Homo sapiens
attccacagctg

SEQ ID NO: 6675627 - DNA, 12 bp, Homo sapiens
attccacaggac

SEQ ID NO: 6675628 - DNA, 18 bp, Homo sapiens
attccacaggacgaatgc

SEQ ID NO: 6675629 - DNA, 23 bp, Homo sapiens
attccacaggacgaatgcatatt

SEQ ID NO: 6675630 - DNA, 12 bp, Homo sapiens
attccacaggat

SEQ ID NO: 6675631 - DNA, 20 bp, Homo sapiens
attccacagggaccagggcc

SEQ ID NO: 6675632 - DNA, 22 bp, Homo sapiens
attccacagtgcccagctaatt

SEQ ID NO: 6675633 - DNA, 16 bp, Homo sapiens
attccacatctgtttc

SEQ ID NO: 6675634 - DNA, 19 bp, Homo sapiens
attccacatctgtttcaaa

SEQ ID NO: 6675635 - DNA, 20 bp, Homo sapiens
attccaccaggattaatctc

SEQ ID NO: 6675636 - DNA, 23 bp, Homo sapiens
attccaccaggattaatctctaa

SEQ ID NO: 6675637 - DNA, 18 bp, Homo sapiens
attccaccattcacattt

SEQ ID NO: 6675638 - DNA, 17 bp, Homo sapiens
attccacccctcctcga

SEQ ID NO: 6675639 - DNA, 18 bp, Homo sapiens
attccacccctccttccc

SEQ ID NO: 6675640 - DNA, 17 bp, Homo sapiens
attccaccttaaattaa

SEQ ID NO: 6675641 - DNA, 14 bp, Homo sapiens
attccacgtgcccc

SEQ ID NO: 6675642 - DNA, 16 bp, Homo sapiens
attccactacacctgg

SEQ ID NO: 6675643 - DNA, 20 bp, Homo sapiens
attccactgaaacctctgtt

SEQ ID NO: 6675644 - DNA, 22 bp, Homo sapiens
attccactgaaacctctgttct

SEQ ID NO: 6675645 - DNA, 16 bp, Homo sapiens
attccagaacaaattg

SEQ ID NO: 6675646 - DNA, 16 bp, Homo sapiens
attccagaacgccctg

SEQ ID NO: 6675647 - DNA, 20 bp, Homo sapiens
attccagaacgccctgtgtc

SEQ ID NO: 6675648 - DNA, 21 bp, Homo sapiens
attccagaatcttgactttct

SEQ ID NO: 6675649 - DNA, 14 bp, Homo sapiens
attccagaatgctg

SEQ ID NO: 6675650 - DNA, 20 bp, Homo sapiens
attccagaatgctgtacatc

SEQ ID NO: 6675651 - DNA, 16 bp, Homo sapiens
attccagacagtcaca

SEQ ID NO: 6675652 - DNA, 14 bp, Homo sapiens
attccagacttcaa

SEQ ID NO: 6675653 - DNA, 17 bp, Homo sapiens
attccagactttctatt

SEQ ID NO: 6675654 - DNA, 18 bp, Homo sapiens
attccagagacatcagca

SEQ ID NO: 6675655 - DNA, 17 bp, Homo sapiens
attccagagcactgctc

SEQ ID NO: 6675656 - DNA, 17 bp, Homo sapiens
attccagaggactctgc

SEQ ID NO: 6675657 - DNA, 14 bp, Homo sapiens
attccagagttaaa

SEQ ID NO: 6675658 - DNA, 21 bp, Homo sapiens
attccagatctttcagaaata

SEQ ID NO: 6675659 - DNA, 20 bp, Homo sapiens
attccagcaataagaaatga

SEQ ID NO: 6675660 - DNA, 22 bp, Homo sapiens
attccagcaataagaaatgaac

SEQ ID NO: 6675661 - DNA, 13 bp, Homo sapiens
attccagcagctg

SEQ ID NO: 6675662 - DNA, 18 bp, Homo sapiens
attccagccaggcccagg

SEQ ID NO: 6675663 - DNA, 17 bp, Homo sapiens
attccagcccctctggt

SEQ ID NO: 6675664 - DNA, 14 bp, Homo sapiens
attccagctctccc

SEQ ID NO: 6675665 - DNA, 19 bp, Homo sapiens
attccagctctcccatgga

SEQ ID NO: 6675666 - DNA, 17 bp, Homo sapiens
attccagctctgccccc

SEQ ID NO: 6675667 - DNA, 13 bp, Homo sapiens
attccagctgtcc

SEQ ID NO: 6675668 - DNA, 16 bp, Homo sapiens
attccaggaaccaaaa

SEQ ID NO: 6675669 - DNA, 13 bp, Homo sapiens
attccaggagaag

SEQ ID NO: 6675670 - DNA, 15 bp, Homo sapiens
attccaggagtggga

SEQ ID NO: 6675671 - DNA, 20 bp, Homo sapiens
attccaggagtgggattatt

SEQ ID NO: 6675672 - DNA, 16 bp, Homo sapiens
attccaggctgagcca

SEQ ID NO: 6675673 - DNA, 18 bp, Homo sapiens
attccaggctgagccatg

SEQ ID NO: 6675674 - DNA, 21 bp, Homo sapiens
attccaggctgagccatgagg

SEQ ID NO: 6675675 - DNA, 18 bp, Homo sapiens
attccagggatgagccaa

SEQ ID NO: 6675676 - DNA, 19 bp, Homo sapiens
attccagggatgagccaaa

SEQ ID NO: 6675677 - DNA, 11 bp, Homo sapiens
attccagggct

SEQ ID NO: 6675678 - DNA, 13 bp, Homo sapiens
attccagggctgg

SEQ ID NO: 6675679 - DNA, 16 bp, Homo sapiens
attccaggtttaagta

SEQ ID NO: 6675680 - DNA, 14 bp, Homo sapiens
attccagtaacttt

SEQ ID NO: 6675681 - DNA, 19 bp, Homo sapiens
attccagtaacttttttgt

SEQ ID NO: 6675682 - DNA, 18 bp, Homo sapiens
attccagtacagtattct

SEQ ID NO: 6675683 - DNA, 20 bp, Homo sapiens
attccagtcaaatctgggct

SEQ ID NO: 6675684 - DNA, 13 bp, Homo sapiens
attccagtccaat

SEQ ID NO: 6675685 - DNA, 19 bp, Homo sapiens
attccagtccaattttcct

SEQ ID NO: 6675686 - DNA, 18 bp, Homo sapiens
attccagtcccctttctc

SEQ ID NO: 6675687 - DNA, 19 bp, Homo sapiens
attccagtgcagtagtgcc

SEQ ID NO: 6675688 - DNA, 22 bp, Homo sapiens
attccagtgcagtagtgccaaa

SEQ ID NO: 6675689 - DNA, 19 bp, Homo sapiens
attccagtgtattttctgt

SEQ ID NO: 6675690 - DNA, 15 bp, Homo sapiens
attccagttgcaatt

SEQ ID NO: 6675691 - DNA, 12 bp, Homo sapiens
attccagttgcg

SEQ ID NO: 6675692 - DNA, 13 bp, Homo sapiens
attccagtttagg

SEQ ID NO: 6675693 - DNA, 13 bp, Homo sapiens
attccataaatct

SEQ ID NO: 6675694 - DNA, 20 bp, Homo sapiens
attccataattccatatgct

SEQ ID NO: 6675695 - DNA, 18 bp, Homo sapiens
attccatagctcaataaa

SEQ ID NO: 6675696 - DNA, 19 bp, Homo sapiens
attccatagtatattaaaa

SEQ ID NO: 6675697 - DNA, 16 bp, Homo sapiens
attccatatatccttt

SEQ ID NO: 6675698 - DNA, 22 bp, Homo sapiens
attccatatcttgcgaatccaa

SEQ ID NO: 6675699 - DNA, 15 bp, Homo sapiens
attccatattagaaa

SEQ ID NO: 6675700 - DNA, 20 bp, Homo sapiens
attccatattagaaaacttt

SEQ ID NO: 6675701 - DNA, 18 bp, Homo sapiens
attccatattcatgtaaa

SEQ ID NO: 6675702 - DNA, 17 bp, Homo sapiens
attccatatttattcaa

SEQ ID NO: 6675703 - DNA, 14 bp, Homo sapiens
attccatcaataaa

SEQ ID NO: 6675704 - DNA, 15 bp, Homo sapiens
attccatcaataaat

SEQ ID NO: 6675705 - DNA, 17 bp, Homo sapiens
attccatcaataaatgc

SEQ ID NO: 6675706 - DNA, 23 bp, Homo sapiens
attccatcaataaatgctctatt

SEQ ID NO: 6675707 - DNA, 23 bp, Homo sapiens
attccatcaataggcaaaagtgt

SEQ ID NO: 6675708 - DNA, 16 bp, Homo sapiens
attccatcacagccag

SEQ ID NO: 6675709 - DNA, 17 bp, Homo sapiens
attccatcacagccagc

SEQ ID NO: 6675710 - DNA, 11 bp, Homo sapiens
attccatcctt

SEQ ID NO: 6675711 - DNA, 15 bp, Homo sapiens
attccatgaatcgct

SEQ ID NO: 6675712 - DNA, 21 bp, Homo sapiens
attccatgaatcgcttctctt

SEQ ID NO: 6675713 - DNA, 13 bp, Homo sapiens
attccatgaatgt

SEQ ID NO: 6675714 - DNA, 15 bp, Homo sapiens
attccatgaatgtat

SEQ ID NO: 6675715 - DNA, 15 bp, Homo sapiens
attccatgaatgttc

SEQ ID NO: 6675716 - DNA, 17 bp, Homo sapiens
attccatgacgcaggag

SEQ ID NO: 6675717 - DNA, 18 bp, Homo sapiens
attccatgactctgccta

SEQ ID NO: 6675718 - DNA, 15 bp, Homo sapiens
attccatgagctgct

SEQ ID NO: 6675719 - DNA, 12 bp, Homo sapiens
attccatgctaa

SEQ ID NO: 6675720 - DNA, 16 bp, Homo sapiens
attccatgggatgtta

SEQ ID NO: 6675721 - DNA, 21 bp, Homo sapiens
attccatgtcagataagtgta

SEQ ID NO: 6675722 - DNA, 15 bp, Homo sapiens
attccatgtccctgt

SEQ ID NO: 6675723 - DNA, 23 bp, Homo sapiens
attccatgtttggaagacccttg

SEQ ID NO: 6675724 - DNA, 23 bp, Homo sapiens
attccatgttttaaaattatata

SEQ ID NO: 6675725 - DNA, 14 bp, Homo sapiens
attccattcccttc

SEQ ID NO: 6675726 - DNA, 19 bp, Homo sapiens
attccattcccttcggcca

SEQ ID NO: 6675727 - DNA, 16 bp, Homo sapiens
attccattgtgtgagt

SEQ ID NO: 6675728 - DNA, 20 bp, Homo sapiens
attccatttatcctagaaaa

SEQ ID NO: 6675729 - DNA, 15 bp, Homo sapiens
attccatttctctcc

SEQ ID NO: 6675730 - DNA, 16 bp, Homo sapiens
attccatttctggaca

SEQ ID NO: 6675731 - DNA, 16 bp, Homo sapiens
attccatttgctgatt

SEQ ID NO: 6675732 - DNA, 14 bp, Homo sapiens
attccattttaagt

SEQ ID NO: 6675733 - DNA, 20 bp, Homo sapiens
attccattttatacaagaag

SEQ ID NO: 6675734 - DNA, 15 bp, Homo sapiens
attcccaactgctct

SEQ ID NO: 6675735 - DNA, 14 bp, Homo sapiens
attcccaagaaatg

SEQ ID NO: 6675736 - DNA, 16 bp, Homo sapiens
attcccaagaaatgct

SEQ ID NO: 6675737 - DNA, 17 bp, Homo sapiens
attcccaagatgcctga

SEQ ID NO: 6675738 - DNA, 18 bp, Homo sapiens
attcccaagatgcctgat

SEQ ID NO: 6675739 - DNA, 20 bp, Homo sapiens
attcccaagatgcctgatca

SEQ ID NO: 6675740 - DNA, 18 bp, Homo sapiens
attcccaagctctgctcc

SEQ ID NO: 6675741 - DNA, 16 bp, Homo sapiens
attcccaagggagact

SEQ ID NO: 6675742 - DNA, 17 bp, Homo sapiens
attcccaagtatgcctt

SEQ ID NO: 6675743 - DNA, 13 bp, Homo sapiens
attcccaatcttg

SEQ ID NO: 6675744 - DNA, 20 bp, Homo sapiens
attcccaattatcaaaaaac

SEQ ID NO: 6675745 - DNA, 19 bp, Homo sapiens
attcccacacctccacagt

SEQ ID NO: 6675746 - DNA, 14 bp, Homo sapiens
attcccaccaaggt

SEQ ID NO: 6675747 - DNA, 11 bp, Homo sapiens
attcccacccc

SEQ ID NO: 6675748 - DNA, 23 bp, Homo sapiens
attcccactaagctttctccttt

SEQ ID NO: 6675749 - DNA, 19 bp, Homo sapiens
attcccactcaccagccct

SEQ ID NO: 6675750 - DNA, 12 bp, Homo sapiens
attcccagagac

SEQ ID NO: 6675751 - DNA, 23 bp, Homo sapiens
attcccagagacaggaaaatcct

SEQ ID NO: 6675752 - DNA, 19 bp, Homo sapiens
attcccagagcaaaataat

SEQ ID NO: 6675753 - DNA, 13 bp, Homo sapiens
attcccagcctga

SEQ ID NO: 6675754 - DNA, 14 bp, Homo sapiens
attcccagctgtct

SEQ ID NO: 6675755 - DNA, 16 bp, Homo sapiens
attcccagctgtctgt

SEQ ID NO: 6675756 - DNA, 17 bp, Homo sapiens
attcccagctgtctgtg

SEQ ID NO: 6675757 - DNA, 13 bp, Homo sapiens
attcccaggcagg

SEQ ID NO: 6675758 - DNA, 15 bp, Homo sapiens
attcccaggccaggg

SEQ ID NO: 6675759 - DNA, 21 bp, Homo sapiens
attcccaggccagggctgggt

SEQ ID NO: 6675760 - DNA, 22 bp, Homo sapiens
attcccaggccagggctgggtc

SEQ ID NO: 6675761 - DNA, 20 bp, Homo sapiens
attcccagggaagtgctctg

SEQ ID NO: 6675762 - DNA, 19 bp, Homo sapiens
attcccagggaccttggaa

SEQ ID NO: 6675763 - DNA, 15 bp, Homo sapiens
attcccagggccgct

SEQ ID NO: 6675764 - DNA, 20 bp, Homo sapiens
attcccatcactgctgtccc

SEQ ID NO: 6675765 - DNA, 22 bp, Homo sapiens
attcccatcactgctgtccctc

SEQ ID NO: 6675766 - DNA, 16 bp, Homo sapiens
attcccatggtggcct

SEQ ID NO: 6675767 - DNA, 20 bp, Homo sapiens
attcccattttgcaaaattt

SEQ ID NO: 6675768 - DNA, 16 bp, Homo sapiens
attccccaccctcccc

SEQ ID NO: 6675769 - DNA, 22 bp, Homo sapiens
attccccaccctgaaagccctg

SEQ ID NO: 6675770 - DNA, 17 bp, Homo sapiens
attccccactcagcctt

SEQ ID NO: 6675771 - DNA, 13 bp, Homo sapiens
attccccagagtg

SEQ ID NO: 6675772 - DNA, 21 bp, Homo sapiens
attccccagcctctcttccta

SEQ ID NO: 6675773 - DNA, 16 bp, Homo sapiens
attccccaggaggcca

SEQ ID NO: 6675774 - DNA, 22 bp, Homo sapiens
attccccaggaggccagccttg

SEQ ID NO: 6675775 - DNA, 22 bp, Homo sapiens
attccccaggtggctgacccag

SEQ ID NO: 6675776 - DNA, 16 bp, Homo sapiens
attccccagtgactcc

SEQ ID NO: 6675777 - DNA, 18 bp, Homo sapiens
attccccagtgactccag

SEQ ID NO: 6675778 - DNA, 20 bp, Homo sapiens
attccccagtgactccaggg

SEQ ID NO: 6675779 - DNA, 15 bp, Homo sapiens
attccccatatttgt

SEQ ID NO: 6675780 - DNA, 21 bp, Homo sapiens
attccccatatttgtgttcag

SEQ ID NO: 6675781 - DNA, 22 bp, Homo sapiens
attccccatatttgtgttcagt

SEQ ID NO: 6675782 - DNA, 13 bp, Homo sapiens
attccccattgcc

SEQ ID NO: 6675783 - DNA, 20 bp, Homo sapiens
attccccattgcctcctcct

SEQ ID NO: 6675784 - DNA, 18 bp, Homo sapiens
attcccccaccagctgca

SEQ ID NO: 6675785 - DNA, 21 bp, Homo sapiens
attcccccaccagctgcagcc

SEQ ID NO: 6675786 - DNA, 20 bp, Homo sapiens
attcccccccctttcctaaa

SEQ ID NO: 6675787 - DNA, 15 bp, Homo sapiens
attcccccctaagct

SEQ ID NO: 6675788 - DNA, 17 bp, Homo sapiens
attcccccctacttgag

SEQ ID NO: 6675789 - DNA, 19 bp, Homo sapiens
attccccctgccctgtgcc

SEQ ID NO: 6675790 - DNA, 20 bp, Homo sapiens
attccccctgccctgtgccg

SEQ ID NO: 6675791 - DNA, 23 bp, Homo sapiens
attcccccttaaacttccaaagc

SEQ ID NO: 6675792 - DNA, 16 bp, Homo sapiens
attcccccttcctagt

SEQ ID NO: 6675793 - DNA, 20 bp, Homo sapiens
attccccggggcgtttcttt

SEQ ID NO: 6675794 - DNA, 21 bp, Homo sapiens
attcccctcccacctctcctt

SEQ ID NO: 6675795 - DNA, 22 bp, Homo sapiens
attcccctggaccacacctccg

SEQ ID NO: 6675796 - DNA, 15 bp, Homo sapiens
attcccctttgcact

SEQ ID NO: 6675797 - DNA, 20 bp, Homo sapiens
attcccctttgcactgtaat

SEQ ID NO: 6675798 - DNA, 23 bp, Homo sapiens
attccccttttttctctatgtac

SEQ ID NO: 6675799 - DNA, 17 bp, Homo sapiens
attcccgcatggttttt

SEQ ID NO: 6675800 - DNA, 23 bp, Homo sapiens
attcccggagggaaactgtgaat

SEQ ID NO: 6675801 - DNA, 18 bp, Homo sapiens
attcccgggcccttcagt

SEQ ID NO: 6675802 - DNA, 21 bp, Homo sapiens
attcccgttttgtcacttttt

SEQ ID NO: 6675803 - DNA, 19 bp, Homo sapiens
attccctaacttgtgaaga

SEQ ID NO: 6675804 - DNA, 17 bp, Homo sapiens
attccctacagcctagg

SEQ ID NO: 6675805 - DNA, 17 bp, Homo sapiens
attccctagaaacttcc

SEQ ID NO: 6675806 - DNA, 20 bp, Homo sapiens
attccctagaaacttccaaa

SEQ ID NO: 6675807 - DNA, 16 bp, Homo sapiens
attccctagcaggaac

SEQ ID NO: 6675808 - DNA, 17 bp, Homo sapiens
attccctatcaaaacat

SEQ ID NO: 6675809 - DNA, 20 bp, Homo sapiens
attccctatcaaaacatatc

SEQ ID NO: 6675810 - DNA, 23 bp, Homo sapiens
attccctattcgtagccatctcc

SEQ ID NO: 6675811 - DNA, 14 bp, Homo sapiens
attccctcagccta

SEQ ID NO: 6675812 - DNA, 13 bp, Homo sapiens
attccctcatcct

SEQ ID NO: 6675813 - DNA, 14 bp, Homo sapiens
attccctccaccca

SEQ ID NO: 6675814 - DNA, 16 bp, Homo sapiens
attccctccacccact

SEQ ID NO: 6675815 - DNA, 13 bp, Homo sapiens
attccctccccct

SEQ ID NO: 6675816 - DNA, 14 bp, Homo sapiens
attccctcctgcta

SEQ ID NO: 6675817 - DNA, 19 bp, Homo sapiens
attccctctcctgcccaga

SEQ ID NO: 6675818 - DNA, 17 bp, Homo sapiens
attccctctctcagcac

SEQ ID NO: 6675819 - DNA, 16 bp, Homo sapiens
attccctctctctgac

SEQ ID NO: 6675820 - DNA, 20 bp, Homo sapiens
attccctgcacacacatgca

SEQ ID NO: 6675821 - DNA, 20 bp, Homo sapiens
attccctgcatccaatctgc

SEQ ID NO: 6675822 - DNA, 12 bp, Homo sapiens
attccctgccca

SEQ ID NO: 6675823 - DNA, 18 bp, Homo sapiens
attccctgcccaaaccct

SEQ ID NO: 6675824 - DNA, 21 bp, Homo sapiens
attccctgcccaaacccttaa

SEQ ID NO: 6675825 - DNA, 23 bp, Homo sapiens
attccctgcccaaacccttaact

SEQ ID NO: 6675826 - DNA, 19 bp, Homo sapiens
attccctgcccccaatttc

SEQ ID NO: 6675827 - DNA, 14 bp, Homo sapiens
attccctggaattg

SEQ ID NO: 6675828 - DNA, 17 bp, Homo sapiens
attccctggaattgcca

SEQ ID NO: 6675829 - DNA, 14 bp, Homo sapiens
attccctggaccag

SEQ ID NO: 6675830 - DNA, 13 bp, Homo sapiens
attccctggagac

SEQ ID NO: 6675831 - DNA, 19 bp, Homo sapiens
attccctggcctttcatat

SEQ ID NO: 6675832 - DNA, 21 bp, Homo sapiens
attccctgtacaatatttaaa

SEQ ID NO: 6675833 - DNA, 16 bp, Homo sapiens
attcccttatctttta

SEQ ID NO: 6675834 - DNA, 20 bp, Homo sapiens
attcccttcgacagcatttt

SEQ ID NO: 6675835 - DNA, 18 bp, Homo sapiens
attcccttctctcagcct

SEQ ID NO: 6675836 - DNA, 20 bp, Homo sapiens
attcccttctctcagcctcc

SEQ ID NO: 6675837 - DNA, 12 bp, Homo sapiens
attcccttctgg

SEQ ID NO: 6675838 - DNA, 13 bp, Homo sapiens
attcccttgtatt

SEQ ID NO: 6675839 - DNA, 17 bp, Homo sapiens
attcccttgtattttgt

SEQ ID NO: 6675840 - DNA, 23 bp, Homo sapiens
attcccttttcaccttttcagga

SEQ ID NO: 6675841 - DNA, 19 bp, Homo sapiens
attcccttttgactcttcc

SEQ ID NO: 6675842 - DNA, 22 bp, Homo sapiens
attccgaaaaaaaaatgttcat

SEQ ID NO: 6675843 - DNA, 15 bp, Homo sapiens
attccgagcattcca

SEQ ID NO: 6675844 - DNA, 21 bp, Homo sapiens
attccgagtctttctcactgc

SEQ ID NO: 6675845 - DNA, 17 bp, Homo sapiens
attccggactggcagaa

SEQ ID NO: 6675846 - DNA, 18 bp, Homo sapiens
attccggaggctaaataa

SEQ ID NO: 6675847 - DNA, 22 bp, Homo sapiens
attccggccacatcattctgtg

SEQ ID NO: 6675848 - DNA, 16 bp, Homo sapiens
attccgtagccagctg

SEQ ID NO: 6675849 - DNA, 16 bp, Homo sapiens
attccgtattacattt

SEQ ID NO: 6675850 - DNA, 21 bp, Homo sapiens
attccgtattggttgggggct

SEQ ID NO: 6675851 - DNA, 13 bp, Homo sapiens
attccgttaggaa

SEQ ID NO: 6675852 - DNA, 14 bp, Homo sapiens
attccgttaggaat

SEQ ID NO: 6675853 - DNA, 19 bp, Homo sapiens
attccgttgtctgtggatg

SEQ ID NO: 6675854 - DNA, 20 bp, Homo sapiens
attccgtttacattttagac

SEQ ID NO: 6675855 - DNA, 19 bp, Homo sapiens
attcctaaaattatggaaa

SEQ ID NO: 6675856 - DNA, 20 bp, Homo sapiens
attcctaaactatctttttt

SEQ ID NO: 6675857 - DNA, 16 bp, Homo sapiens
attcctaacctgtcag

SEQ ID NO: 6675858 - DNA, 24 bp, Homo sapiens
attcctaacctgtcagaataataa

SEQ ID NO: 6675859 - DNA, 21 bp, Homo sapiens
attcctaactagaattagtat

SEQ ID NO: 6675860 - DNA, 19 bp, Homo sapiens
attcctaagcagtgcttgt

SEQ ID NO: 6675861 - DNA, 21 bp, Homo sapiens
attcctaagcagtgcttgtaa

SEQ ID NO: 6675862 - DNA, 15 bp, Homo sapiens
attcctaagccactt

SEQ ID NO: 6675863 - DNA, 22 bp, Homo sapiens
attcctaaggcccagctgccag

SEQ ID NO: 6675864 - DNA, 19 bp, Homo sapiens
attcctaaggtaatcctat

SEQ ID NO: 6675865 - DNA, 20 bp, Homo sapiens
attcctaattcctgtatgtt

SEQ ID NO: 6675866 - DNA, 18 bp, Homo sapiens
attcctacaaagatgttt

SEQ ID NO: 6675867 - DNA, 13 bp, Homo sapiens
attcctacaactt

SEQ ID NO: 6675868 - DNA, 17 bp, Homo sapiens
attcctacagcactact

SEQ ID NO: 6675869 - DNA, 14 bp, Homo sapiens
attcctacccctct

SEQ ID NO: 6675870 - DNA, 20 bp, Homo sapiens
attcctacccctcttccagc

SEQ ID NO: 6675871 - DNA, 22 bp, Homo sapiens
attcctacccctcttccagctt

SEQ ID NO: 6675872 - DNA, 18 bp, Homo sapiens
attcctactccctcttcc

SEQ ID NO: 6675873 - DNA, 19 bp, Homo sapiens
attcctacttaaacaaaaa

SEQ ID NO: 6675874 - DNA, 14 bp, Homo sapiens
attcctacttgcag

SEQ ID NO: 6675875 - DNA, 24 bp, Homo sapiens
attcctagaaactgacacatgctg

SEQ ID NO: 6675876 - DNA, 12 bp, Homo sapiens
attcctagaaat

SEQ ID NO: 6675877 - DNA, 15 bp, Homo sapiens
attcctagagagcag

SEQ ID NO: 6675878 - DNA, 21 bp, Homo sapiens
attcctagagagcagaaataa

SEQ ID NO: 6675879 - DNA, 23 bp, Homo sapiens
attcctagagggtaaatatgact

SEQ ID NO: 6675880 - DNA, 17 bp, Homo sapiens
attcctagattacatct

SEQ ID NO: 6675881 - DNA, 20 bp, Homo sapiens
attcctagcaaatttctctc

SEQ ID NO: 6675882 - DNA, 12 bp, Homo sapiens
attcctatcagt

SEQ ID NO: 6675883 - DNA, 11 bp, Homo sapiens
attcctatgaa

SEQ ID NO: 6675884 - DNA, 23 bp, Homo sapiens
attcctattgtgatttgactgtt

SEQ ID NO: 6675885 - DNA, 21 bp, Homo sapiens
attcctcacagccttggctcc

SEQ ID NO: 6675886 - DNA, 17 bp, Homo sapiens
attcctcagctgccaag

SEQ ID NO: 6675887 - DNA, 19 bp, Homo sapiens
attcctcaggaaggacatg

SEQ ID NO: 6675888 - DNA, 21 bp, Homo sapiens
attcctcagtgaggttatctt

SEQ ID NO: 6675889 - DNA, 18 bp, Homo sapiens
attcctcatcaccatcgt

SEQ ID NO: 6675890 - DNA, 21 bp, Homo sapiens
attcctcatcctcagatgctc

SEQ ID NO: 6675891 - DNA, 22 bp, Homo sapiens
attcctcatgaatgtaaatttg

SEQ ID NO: 6675892 - DNA, 19 bp, Homo sapiens
attcctcatttgttcatta

SEQ ID NO: 6675893 - DNA, 18 bp, Homo sapiens
attcctccagagacactg

SEQ ID NO: 6675894 - DNA, 18 bp, Homo sapiens
attcctccagcctcccct

SEQ ID NO: 6675895 - DNA, 20 bp, Homo sapiens
attcctccagcctcccctcc

SEQ ID NO: 6675896 - DNA, 12 bp, Homo sapiens
attcctcccagg

SEQ ID NO: 6675897 - DNA, 13 bp, Homo sapiens
attcctcccagga

SEQ ID NO: 6675898 - DNA, 17 bp, Homo sapiens
attcctcccctggaagt

SEQ ID NO: 6675899 - DNA, 16 bp, Homo sapiens
attcctccctccggcc

SEQ ID NO: 6675900 - DNA, 22 bp, Homo sapiens
attcctcctgtctcctctgtca

SEQ ID NO: 6675901 - DNA, 23 bp, Homo sapiens
attcctcctgtctcctctgtcag

SEQ ID NO: 6675902 - DNA, 15 bp, Homo sapiens
attcctccttccccc

SEQ ID NO: 6675903 - DNA, 23 bp, Homo sapiens
attcctccttccccccatctctg

SEQ ID NO: 6675904 - DNA, 21 bp, Homo sapiens
attcctcgaagttctaggaaa

SEQ ID NO: 6675905 - DNA, 23 bp, Homo sapiens
attcctcgcgacatcttctcaac

SEQ ID NO: 6675906 - DNA, 15 bp, Homo sapiens
attcctctaaaactc

SEQ ID NO: 6675907 - DNA, 17 bp, Homo sapiens
attcctctcaccccact

SEQ ID NO: 6675908 - DNA, 23 bp, Homo sapiens
attcctctcaccccactcctgtc

SEQ ID NO: 6675909 - DNA, 15 bp, Homo sapiens
attcctctcatttcc

SEQ ID NO: 6675910 - DNA, 20 bp, Homo sapiens
attcctctcatttccagctt

SEQ ID NO: 6675911 - DNA, 21 bp, Homo sapiens
attcctctcatttccagcttc

SEQ ID NO: 6675912 - DNA, 22 bp, Homo sapiens
attcctctcatttccagcttct

SEQ ID NO: 6675913 - DNA, 14 bp, Homo sapiens
attcctctgctgcc

SEQ ID NO: 6675914 - DNA, 18 bp, Homo sapiens
attcctctgctgccattt

SEQ ID NO: 6675915 - DNA, 22 bp, Homo sapiens
attcctctgggaatgttacatt

SEQ ID NO: 6675916 - DNA, 14 bp, Homo sapiens
attcctcttattgg

SEQ ID NO: 6675917 - DNA, 17 bp, Homo sapiens
attcctcttgcctctct

SEQ ID NO: 6675918 - DNA, 19 bp, Homo sapiens
attcctcttgcctctctca

SEQ ID NO: 6675919 - DNA, 15 bp, Homo sapiens
attcctctttgcttt

SEQ ID NO: 6675920 - DNA, 15 bp, Homo sapiens
attcctcttttctct

SEQ ID NO: 6675921 - DNA, 17 bp, Homo sapiens
attcctcttttctctgc

SEQ ID NO: 6675922 - DNA, 16 bp, Homo sapiens
attcctgaagaaccag

SEQ ID NO: 6675923 - DNA, 15 bp, Homo sapiens
attcctgaagccaga

SEQ ID NO: 6675924 - DNA, 16 bp, Homo sapiens
attcctgaagggaact

SEQ ID NO: 6675925 - DNA, 14 bp, Homo sapiens
attcctgaatgtaa

SEQ ID NO: 6675926 - DNA, 13 bp, Homo sapiens
attcctgaccctc

SEQ ID NO: 6675927 - DNA, 17 bp, Homo sapiens
attcctgaccctcccta

SEQ ID NO: 6675928 - DNA, 22 bp, Homo sapiens
attcctgacctccgccatccac

SEQ ID NO: 6675929 - DNA, 16 bp, Homo sapiens
attcctgagattctgg

SEQ ID NO: 6675930 - DNA, 18 bp, Homo sapiens
attcctgagattctggga

SEQ ID NO: 6675931 - DNA, 16 bp, Homo sapiens
attcctgatatgattt

SEQ ID NO: 6675932 - DNA, 16 bp, Homo sapiens
attcctgatcccatgg

SEQ ID NO: 6675933 - DNA, 21 bp, Homo sapiens
attcctgatgcttcttcagag

SEQ ID NO: 6675934 - DNA, 15 bp, Homo sapiens
attcctgcagcctgg

SEQ ID NO: 6675935 - DNA, 18 bp, Homo sapiens
attcctgccctgctgttt

SEQ ID NO: 6675936 - DNA, 11 bp, Homo sapiens
attcctgcctg

SEQ ID NO: 6675937 - DNA, 12 bp, Homo sapiens
attcctgcctgg

SEQ ID NO: 6675938 - DNA, 18 bp, Homo sapiens
attcctgcctttcttcca

SEQ ID NO: 6675939 - DNA, 15 bp, Homo sapiens
attcctgcctttgat

SEQ ID NO: 6675940 - DNA, 15 bp, Homo sapiens
attcctgctctccca

SEQ ID NO: 6675941 - DNA, 12 bp, Homo sapiens
attcctggaacc

SEQ ID NO: 6675942 - DNA, 23 bp, Homo sapiens
attcctggagaggtggctgcgcc

SEQ ID NO: 6675943 - DNA, 15 bp, Homo sapiens
attcctggagcccga

SEQ ID NO: 6675944 - DNA, 21 bp, Homo sapiens
attcctggcatgacactctag

SEQ ID NO: 6675945 - DNA, 12 bp, Homo sapiens
attcctggcccc

SEQ ID NO: 6675946 - DNA, 17 bp, Homo sapiens
attcctgggaaatattc

SEQ ID NO: 6675947 - DNA, 22 bp, Homo sapiens
attcctgggaaatattccctag

SEQ ID NO: 6675948 - DNA, 22 bp, Homo sapiens
attcctgggctcaagcagtcct

SEQ ID NO: 6675949 - DNA, 15 bp, Homo sapiens
attcctggtacccag

SEQ ID NO: 6675950 - DNA, 20 bp, Homo sapiens
attcctggtacccagccatc

SEQ ID NO: 6675951 - DNA, 22 bp, Homo sapiens
attcctggtttaattcagcaga

SEQ ID NO: 6675952 - DNA, 19 bp, Homo sapiens
attcctggtttgactcagt

SEQ ID NO: 6675953 - DNA, 23 bp, Homo sapiens
attcctggtttgactcagttcca

SEQ ID NO: 6675954 - DNA, 18 bp, Homo sapiens
attcctgtaaataagagt

SEQ ID NO: 6675955 - DNA, 18 bp, Homo sapiens
attcctgtaaatgtgaca

SEQ ID NO: 6675956 - DNA, 18 bp, Homo sapiens
attcctgtagcatcttct

SEQ ID NO: 6675957 - DNA, 23 bp, Homo sapiens
attcctgtagcatcttctggagt

SEQ ID NO: 6675958 - DNA, 13 bp, Homo sapiens
attcctgtatgtt

SEQ ID NO: 6675959 - DNA, 16 bp, Homo sapiens
attcctgtatgttgtc

SEQ ID NO: 6675960 - DNA, 17 bp, Homo sapiens
attcctgtatgttgtcc

SEQ ID NO: 6675961 - DNA, 18 bp, Homo sapiens
attcctgtatgttgtcca

SEQ ID NO: 6675962 - DNA, 13 bp, Homo sapiens
attcctgtcaaca

SEQ ID NO: 6675963 - DNA, 20 bp, Homo sapiens
attcctgttgaccttcccac

SEQ ID NO: 6675964 - DNA, 21 bp, Homo sapiens
attcctgttgctgtcttcagt

SEQ ID NO: 6675965 - DNA, 13 bp, Homo sapiens
attcctgttgtgt

SEQ ID NO: 6675966 - DNA, 14 bp, Homo sapiens
attccttacaactg

SEQ ID NO: 6675967 - DNA, 16 bp, Homo sapiens
attccttactagaaat

SEQ ID NO: 6675968 - DNA, 17 bp, Homo sapiens
attccttactagaaata

SEQ ID NO: 6675969 - DNA, 13 bp, Homo sapiens
attccttacttgc

SEQ ID NO: 6675970 - DNA, 16 bp, Homo sapiens
attccttacttgcact

SEQ ID NO: 6675971 - DNA, 19 bp, Homo sapiens
attccttagcagctcaggc

SEQ ID NO: 6675972 - DNA, 20 bp, Homo sapiens
attccttagcttagacctca

SEQ ID NO: 6675973 - DNA, 21 bp, Homo sapiens
attccttagcttagacctcag

SEQ ID NO: 6675974 - DNA, 22 bp, Homo sapiens
attccttagcttagacctcagc

SEQ ID NO: 6675975 - DNA, 18 bp, Homo sapiens
attccttatgggatcatt

SEQ ID NO: 6675976 - DNA, 18 bp, Homo sapiens
attccttcaaataaagaa

SEQ ID NO: 6675977 - DNA, 17 bp, Homo sapiens
attccttcactcatcca

SEQ ID NO: 6675978 - DNA, 22 bp, Homo sapiens
attccttcagggtgatgccagg

SEQ ID NO: 6675979 - DNA, 22 bp, Homo sapiens
attccttccatctagcagctgg

SEQ ID NO: 6675980 - DNA, 23 bp, Homo sapiens
attccttccatctagcagctggc

SEQ ID NO: 6675981 - DNA, 11 bp, Homo sapiens
attccttccca

SEQ ID NO: 6675982 - DNA, 16 bp, Homo sapiens
attccttcccagaggg

SEQ ID NO: 6675983 - DNA, 16 bp, Homo sapiens
attccttcctgttctg

SEQ ID NO: 6675984 - DNA, 20 bp, Homo sapiens
attccttcgaaaggccttca

SEQ ID NO: 6675985 - DNA, 19 bp, Homo sapiens
attccttctaagataaaaa

SEQ ID NO: 6675986 - DNA, 15 bp, Homo sapiens
attccttctacatgt

SEQ ID NO: 6675987 - DNA, 22 bp, Homo sapiens
attccttctatagctagagctt

SEQ ID NO: 6675988 - DNA, 23 bp, Homo sapiens
attccttctcccatctcttcctt

SEQ ID NO: 6675989 - DNA, 11 bp, Homo sapiens
attccttctct

SEQ ID NO: 6675990 - DNA, 14 bp, Homo sapiens
attccttctctgaa

SEQ ID NO: 6675991 - DNA, 16 bp, Homo sapiens
attccttctctgaaca

SEQ ID NO: 6675992 - DNA, 22 bp, Homo sapiens
attccttctcttttttcagaga

SEQ ID NO: 6675993 - DNA, 23 bp, Homo sapiens
attccttctgcctaacttgtaaa

SEQ ID NO: 6675994 - DNA, 12 bp, Homo sapiens
attccttctgga

SEQ ID NO: 6675995 - DNA, 22 bp, Homo sapiens
attccttcttactctcctcttc

SEQ ID NO: 6675996 - DNA, 18 bp, Homo sapiens
attccttcttgctcagtc

SEQ ID NO: 6675997 - DNA, 17 bp, Homo sapiens
attccttctttgataat

SEQ ID NO: 6675998 - DNA, 22 bp, Homo sapiens
attccttctttgataatgttaa

SEQ ID NO: 6675999 - DNA, 18 bp, Homo sapiens
attccttctttttaaaat

SEQ ID NO: 6676000 - DNA, 20 bp, Homo sapiens
attccttgagtcaggagctt

SEQ ID NO: 6676001 - DNA, 13 bp, Homo sapiens
attccttgataat

SEQ ID NO: 6676002 - DNA, 17 bp, Homo sapiens
attccttgccccacagt

SEQ ID NO: 6676003 - DNA, 15 bp, Homo sapiens
attccttgcctgtca

SEQ ID NO: 6676004 - DNA, 18 bp, Homo sapiens
attccttggagccactgg

SEQ ID NO: 6676005 - DNA, 21 bp, Homo sapiens
attccttgtcaccagcaacat

SEQ ID NO: 6676006 - DNA, 12 bp, Homo sapiens
attcctttaaaa

SEQ ID NO: 6676007 - DNA, 16 bp, Homo sapiens
attcctttaaaatata

SEQ ID NO: 6676008 - DNA, 15 bp, Homo sapiens
attcctttaaagtga

SEQ ID NO: 6676009 - DNA, 16 bp, Homo sapiens
attcctttaaattctc

SEQ ID NO: 6676010 - DNA, 18 bp, Homo sapiens
attcctttaaattctcca

SEQ ID NO: 6676011 - DNA, 20 bp, Homo sapiens
attcctttaaattctccaac

SEQ ID NO: 6676012 - DNA, 14 bp, Homo sapiens
attcctttcagagt

SEQ ID NO: 6676013 - DNA, 19 bp, Homo sapiens
attcctttccagaatgcaa

SEQ ID NO: 6676014 - DNA, 13 bp, Homo sapiens
attcctttccctt

SEQ ID NO: 6676015 - DNA, 15 bp, Homo sapiens
attcctttcccttcc

SEQ ID NO: 6676016 - DNA, 15 bp, Homo sapiens
attcctttccttttt

SEQ ID NO: 6676017 - DNA, 17 bp, Homo sapiens
attcctttctcatccca

SEQ ID NO: 6676018 - DNA, 14 bp, Homo sapiens
attcctttgcatat

SEQ ID NO: 6676019 - DNA, 21 bp, Homo sapiens
attcctttggccactgtattt

SEQ ID NO: 6676020 - DNA, 22 bp, Homo sapiens
attcctttggccactgtatttg

SEQ ID NO: 6676021 - DNA, 16 bp, Homo sapiens
attcctttgtcttcaa

SEQ ID NO: 6676022 - DNA, 15 bp, Homo sapiens
attccttttaaagaa

SEQ ID NO: 6676023 - DNA, 22 bp, Homo sapiens
attccttttaaagaagctttat

SEQ ID NO: 6676024 - DNA, 14 bp, Homo sapiens
attccttttcataa

SEQ ID NO: 6676025 - DNA, 22 bp, Homo sapiens
attccttttcataacttttctt

SEQ ID NO: 6676026 - DNA, 15 bp, Homo sapiens
attccttttcgttta

SEQ ID NO: 6676027 - DNA, 18 bp, Homo sapiens
attccttttcgtttagaa

SEQ ID NO: 6676028 - DNA, 22 bp, Homo sapiens
attccttttcgtttagaatcag

SEQ ID NO: 6676029 - DNA, 21 bp, Homo sapiens
attccttttgatggggagaaa

SEQ ID NO: 6676030 - DNA, 22 bp, Homo sapiens
attccttttgatggggagaaag

SEQ ID NO: 6676031 - DNA, 21 bp, Homo sapiens
attcctttttattccttttaa

SEQ ID NO: 6676032 - DNA, 22 bp, Homo sapiens
attcctttttattccttttaaa

SEQ ID NO: 6676033 - DNA, 15 bp, Homo sapiens
attcctttttattta

SEQ ID NO: 6676034 - DNA, 18 bp, Homo sapiens
attcctttttatttatat

SEQ ID NO: 6676035 - DNA, 15 bp, Homo sapiens
attcctttttctatg

SEQ ID NO: 6676036 - DNA, 18 bp, Homo sapiens
attcctttttcttcactt

SEQ ID NO: 6676037 - DNA, 20 bp, Homo sapiens
attcgaaacctgtgatttct

SEQ ID NO: 6676038 - DNA, 17 bp, Homo sapiens
attcgaatctctgcccc

SEQ ID NO: 6676039 - DNA, 23 bp, Homo sapiens
attcgaatggggtagaaacattg

SEQ ID NO: 6676040 - DNA, 17 bp, Homo sapiens
attcgacataccccact

SEQ ID NO: 6676041 - DNA, 16 bp, Homo sapiens
attcgacctataagaa

SEQ ID NO: 6676042 - DNA, 20 bp, Homo sapiens
attcgacctgatttacagtt

SEQ ID NO: 6676043 - DNA, 16 bp, Homo sapiens
attcgagacagaacct

SEQ ID NO: 6676044 - DNA, 14 bp, Homo sapiens
attcgagcaaacaa

SEQ ID NO: 6676045 - DNA, 20 bp, Homo sapiens
attcgagctatatttaagta

SEQ ID NO: 6676046 - DNA, 19 bp, Homo sapiens
attcgatctcattcagtat

SEQ ID NO: 6676047 - DNA, 18 bp, Homo sapiens
attcgccacacagtattt

SEQ ID NO: 6676048 - DNA, 19 bp, Homo sapiens
attcgcccaaagccagaca

SEQ ID NO: 6676049 - DNA, 21 bp, Homo sapiens
attcgcccaaagccagacagc

SEQ ID NO: 6676050 - DNA, 21 bp, Homo sapiens
attcgctactatgatttaatt

SEQ ID NO: 6676051 - DNA, 21 bp, Homo sapiens
attcgctgaaatacttaatgt

SEQ ID NO: 6676052 - DNA, 16 bp, Homo sapiens
attcgctgtacccttt

SEQ ID NO: 6676053 - DNA, 21 bp, Homo sapiens
attcgctgtaccctttaagat

SEQ ID NO: 6676054 - DNA, 22 bp, Homo sapiens
attcgctgtaccctttaagata

SEQ ID NO: 6676055 - DNA, 14 bp, Homo sapiens
attcgcttgagaaa

SEQ ID NO: 6676056 - DNA, 13 bp, Homo sapiens
attcgctttctaa

SEQ ID NO: 6676057 - DNA, 14 bp, Homo sapiens
attcggaccactag

SEQ ID NO: 6676058 - DNA, 13 bp, Homo sapiens
attcggaccctgc

SEQ ID NO: 6676059 - DNA, 16 bp, Homo sapiens
attcggactgctgtgc

SEQ ID NO: 6676060 - DNA, 22 bp, Homo sapiens
attcggccttggtgaacacaca

SEQ ID NO: 6676061 - DNA, 16 bp, Homo sapiens
attcggggcctgctgg

SEQ ID NO: 6676062 - DNA, 17 bp, Homo sapiens
attcggggcctgctgga

SEQ ID NO: 6676063 - DNA, 16 bp, Homo sapiens
attcgggggctgacct

SEQ ID NO: 6676064 - DNA, 18 bp, Homo sapiens
attcggtgtgctgccaac

SEQ ID NO: 6676065 - DNA, 18 bp, Homo sapiens
attcgtacataatactga

SEQ ID NO: 6676066 - DNA, 22 bp, Homo sapiens
attcgtacataatactgaacca

SEQ ID NO: 6676067 - DNA, 23 bp, Homo sapiens
attcgtatgatcagtactgactt

SEQ ID NO: 6676068 - DNA, 19 bp, Homo sapiens
attcgtgaaaacacatttg

SEQ ID NO: 6676069 - DNA, 22 bp, Homo sapiens
attcgtgagctggggactcagg

SEQ ID NO: 6676070 - DNA, 21 bp, Homo sapiens
attcgtgattttcaagcagca

SEQ ID NO: 6676071 - DNA, 16 bp, Homo sapiens
attcgtgtgttttttt

SEQ ID NO: 6676072 - DNA, 14 bp, Homo sapiens
attcgtgttatgaa

SEQ ID NO: 6676073 - DNA, 21 bp, Homo sapiens
attcgtgttatgaatctgtgc

SEQ ID NO: 6676074 - DNA, 22 bp, Homo sapiens
attcgttgctccagtataaatt

SEQ ID NO: 6676075 - DNA, 17 bp, Homo sapiens
attcgtttctgacatac

SEQ ID NO: 6676076 - DNA, 22 bp, Homo sapiens
attcgtttctgacataccttag

SEQ ID NO: 6676077 - DNA, 13 bp, Homo sapiens
attctaaaaaaga

SEQ ID NO: 6676078 - DNA, 15 bp, Homo sapiens
attctaaaacattct

SEQ ID NO: 6676079 - DNA, 19 bp, Homo sapiens
attctaaaacattctttaa

SEQ ID NO: 6676080 - DNA, 13 bp, Homo sapiens
attctaaaagaga

SEQ ID NO: 6676081 - DNA, 23 bp, Homo sapiens
attctaaaagtaataaattccaa

SEQ ID NO: 6676082 - DNA, 16 bp, Homo sapiens
attctaaaatataaca

SEQ ID NO: 6676083 - DNA, 14 bp, Homo sapiens
attctaaaatgatt

SEQ ID NO: 6676084 - DNA, 15 bp, Homo sapiens
attctaaacagatgt

SEQ ID NO: 6676085 - DNA, 13 bp, Homo sapiens
attctaaagagag

SEQ ID NO: 6676086 - DNA, 12 bp, Homo sapiens
attctaaagata

SEQ ID NO: 6676087 - DNA, 14 bp, Homo sapiens
attctaaagattct

SEQ ID NO: 6676088 - DNA, 17 bp, Homo sapiens
attctaaagattctata

SEQ ID NO: 6676089 - DNA, 18 bp, Homo sapiens
attctaaagattctatag

SEQ ID NO: 6676090 - DNA, 22 bp, Homo sapiens
attctaaagattctatagttct

SEQ ID NO: 6676091 - DNA, 14 bp, Homo sapiens
attctaaagctcaa

SEQ ID NO: 6676092 - DNA, 16 bp, Homo sapiens
attctaaataaaatat

SEQ ID NO: 6676093 - DNA, 20 bp, Homo sapiens
attctaaataaaatataatt

SEQ ID NO: 6676094 - DNA, 14 bp, Homo sapiens
attctaaatacatg

SEQ ID NO: 6676095 - DNA, 16 bp, Homo sapiens
attctaaatattgaca

SEQ ID NO: 6676096 - DNA, 21 bp, Homo sapiens
attctaaatccgacttgaata

SEQ ID NO: 6676097 - DNA, 17 bp, Homo sapiens
attctaaatgaatgttt

SEQ ID NO: 6676098 - DNA, 15 bp, Homo sapiens
attctaaatgctggt

SEQ ID NO: 6676099 - DNA, 12 bp, Homo sapiens
attctaaatgta

SEQ ID NO: 6676100 - DNA, 17 bp, Homo sapiens
attctaaatttttactt

SEQ ID NO: 6676101 - DNA, 23 bp, Homo sapiens
attctaacaaaaagcaattacta

SEQ ID NO: 6676102 - DNA, 13 bp, Homo sapiens
attctaacatatt

SEQ ID NO: 6676103 - DNA, 12 bp, Homo sapiens
attctaaccaga

SEQ ID NO: 6676104 - DNA, 16 bp, Homo sapiens
attctaacttattaaa

SEQ ID NO: 6676105 - DNA, 17 bp, Homo sapiens
attctaagattgtacat

SEQ ID NO: 6676106 - DNA, 18 bp, Homo sapiens
attctaagattgtacata

SEQ ID NO: 6676107 - DNA, 22 bp, Homo sapiens
attctaagccagttttcatttt

SEQ ID NO: 6676108 - DNA, 20 bp, Homo sapiens
attctaagtgagatgtttgg

SEQ ID NO: 6676109 - DNA, 22 bp, Homo sapiens
attctaagtgagatgtttggca

SEQ ID NO: 6676110 - DNA, 18 bp, Homo sapiens
attctaagttagactctt

SEQ ID NO: 6676111 - DNA, 21 bp, Homo sapiens
attctaagttagactcttccc

SEQ ID NO: 6676112 - DNA, 19 bp, Homo sapiens
attctaagttatttacttt

SEQ ID NO: 6676113 - DNA, 18 bp, Homo sapiens
attctaataaatcaatgt

SEQ ID NO: 6676114 - DNA, 22 bp, Homo sapiens
attctaataaatcaatgtgagt

SEQ ID NO: 6676115 - DNA, 19 bp, Homo sapiens
attctaataactgcttact

SEQ ID NO: 6676116 - DNA, 14 bp, Homo sapiens
attctaataagcta

SEQ ID NO: 6676117 - DNA, 18 bp, Homo sapiens
attctaatgatggcccat

SEQ ID NO: 6676118 - DNA, 23 bp, Homo sapiens
attctaatgatggcccattctac

SEQ ID NO: 6676119 - DNA, 12 bp, Homo sapiens
attctaatgcat

SEQ ID NO: 6676120 - DNA, 14 bp, Homo sapiens
attctaatgcatat

SEQ ID NO: 6676121 - DNA, 17 bp, Homo sapiens
attctaattaaaattgt

SEQ ID NO: 6676122 - DNA, 16 bp, Homo sapiens
attctaattcttcatt

SEQ ID NO: 6676123 - DNA, 21 bp, Homo sapiens
attctaattggcagattgttt

SEQ ID NO: 6676124 - DNA, 21 bp, Homo sapiens
attctaattgtcagtgatttt

SEQ ID NO: 6676125 - DNA, 19 bp, Homo sapiens
attctacaaaaaaccagga

SEQ ID NO: 6676126 - DNA, 13 bp, Homo sapiens
attctacacagag

SEQ ID NO: 6676127 - DNA, 16 bp, Homo sapiens
attctacacatgtaaa

SEQ ID NO: 6676128 - DNA, 15 bp, Homo sapiens
attctacagaataat

SEQ ID NO: 6676129 - DNA, 20 bp, Homo sapiens
attctacagaataatccagt

SEQ ID NO: 6676130 - DNA, 22 bp, Homo sapiens
attctacagcatacagagcagg

SEQ ID NO: 6676131 - DNA, 15 bp, Homo sapiens
attctacagtttctt

SEQ ID NO: 6676132 - DNA, 19 bp, Homo sapiens
attctacataatggaaaac

SEQ ID NO: 6676133 - DNA, 16 bp, Homo sapiens
attctaccctgttgca

SEQ ID NO: 6676134 - DNA, 18 bp, Homo sapiens
attctacctccttgtgtt

SEQ ID NO: 6676135 - DNA, 23 bp, Homo sapiens
attctacctggctacaattactt

SEQ ID NO: 6676136 - DNA, 16 bp, Homo sapiens
attctacgtatctgct

SEQ ID NO: 6676137 - DNA, 14 bp, Homo sapiens
attctactaaatat

SEQ ID NO: 6676138 - DNA, 16 bp, Homo sapiens
attctactaaatattt

SEQ ID NO: 6676139 - DNA, 17 bp, Homo sapiens
attctactaaatatttt

SEQ ID NO: 6676140 - DNA, 16 bp, Homo sapiens
attctactaagttatt

SEQ ID NO: 6676141 - DNA, 22 bp, Homo sapiens
attctactaagttattttatga

SEQ ID NO: 6676142 - DNA, 17 bp, Homo sapiens
attctactaatgtgatg

SEQ ID NO: 6676143 - DNA, 15 bp, Homo sapiens
attctactcttgtca

SEQ ID NO: 6676144 - DNA, 21 bp, Homo sapiens
attctactgagtccctggcaa

SEQ ID NO: 6676145 - DNA, 17 bp, Homo sapiens
attctactggcctgtaa

SEQ ID NO: 6676146 - DNA, 14 bp, Homo sapiens
attctacttcagct

SEQ ID NO: 6676147 - DNA, 16 bp, Homo sapiens
attctacttcagcttt

SEQ ID NO: 6676148 - DNA, 17 bp, Homo sapiens
attctacttcagctttg

SEQ ID NO: 6676149 - DNA, 17 bp, Homo sapiens
attctacttctctgttg

SEQ ID NO: 6676150 - DNA, 12 bp, Homo sapiens
attctacttgct

SEQ ID NO: 6676151 - DNA, 21 bp, Homo sapiens
attctacttgctctggacctg

SEQ ID NO: 6676152 - DNA, 17 bp, Homo sapiens
attctagatcctgcacc

SEQ ID NO: 6676153 - DNA, 19 bp, Homo sapiens
attctagcacatcatggca

SEQ ID NO: 6676154 - DNA, 14 bp, Homo sapiens
attctagcagggaa

SEQ ID NO: 6676155 - DNA, 18 bp, Homo sapiens
attctagctaatgtaata

SEQ ID NO: 6676156 - DNA, 15 bp, Homo sapiens
attctagctttgagc

SEQ ID NO: 6676157 - DNA, 18 bp, Homo sapiens
attctagcttttttcctc

SEQ ID NO: 6676158 - DNA, 22 bp, Homo sapiens
attctaggatgaacaatgtata

SEQ ID NO: 6676159 - DNA, 20 bp, Homo sapiens
attctaggcctcctggccca

SEQ ID NO: 6676160 - DNA, 20 bp, Homo sapiens
attctagggtttcttaaata

SEQ ID NO: 6676161 - DNA, 22 bp, Homo sapiens
attctaggtggaggttgtgcat

SEQ ID NO: 6676162 - DNA, 20 bp, Homo sapiens
attctagtacataattgatt

SEQ ID NO: 6676163 - DNA, 13 bp, Homo sapiens
attctagtatttt

SEQ ID NO: 6676164 - DNA, 14 bp, Homo sapiens
attctagtcaactg

SEQ ID NO: 6676165 - DNA, 20 bp, Homo sapiens
attctagtcaactgctgttt

SEQ ID NO: 6676166 - DNA, 21 bp, Homo sapiens
attctagtcaactgctgtttt

SEQ ID NO: 6676167 - DNA, 16 bp, Homo sapiens
attctagtctctgatt

SEQ ID NO: 6676168 - DNA, 17 bp, Homo sapiens
attctagtctctgattt

SEQ ID NO: 6676169 - DNA, 14 bp, Homo sapiens
attctagtgctgct

SEQ ID NO: 6676170 - DNA, 15 bp, Homo sapiens
attctagtgctgctg

SEQ ID NO: 6676171 - DNA, 17 bp, Homo sapiens
attctagtggctgttca

SEQ ID NO: 6676172 - DNA, 19 bp, Homo sapiens
attctagtggctgttcatg

SEQ ID NO: 6676173 - DNA, 20 bp, Homo sapiens
attctataagagacaaagtt

SEQ ID NO: 6676174 - DNA, 15 bp, Homo sapiens
attctatactgttga

SEQ ID NO: 6676175 - DNA, 13 bp, Homo sapiens
attctatagttct

SEQ ID NO: 6676176 - DNA, 14 bp, Homo sapiens
attctatatttcat

SEQ ID NO: 6676177 - DNA, 19 bp, Homo sapiens
attctatccccaatcagct

SEQ ID NO: 6676178 - DNA, 19 bp, Homo sapiens
attctatcgttattataaa

SEQ ID NO: 6676179 - DNA, 15 bp, Homo sapiens
attctatctactgat

SEQ ID NO: 6676180 - DNA, 16 bp, Homo sapiens
attctatctctcttta

SEQ ID NO: 6676181 - DNA, 20 bp, Homo sapiens
attctatgaagcccacccag

SEQ ID NO: 6676182 - DNA, 16 bp, Homo sapiens
attctatgacaataaa

SEQ ID NO: 6676183 - DNA, 20 bp, Homo sapiens
attctatgactgaagtactg

SEQ ID NO: 6676184 - DNA, 17 bp, Homo sapiens
attctatgattaaactg

SEQ ID NO: 6676185 - DNA, 16 bp, Homo sapiens
attctatgcctgtatt

SEQ ID NO: 6676186 - DNA, 17 bp, Homo sapiens
attctatgcctgtattt

SEQ ID NO: 6676187 - DNA, 16 bp, Homo sapiens
attctatgtaatgtaa

SEQ ID NO: 6676188 - DNA, 23 bp, Homo sapiens
attctatgtgtcatcaatagtgt

SEQ ID NO: 6676189 - DNA, 14 bp, Homo sapiens
attctatgttaata

SEQ ID NO: 6676190 - DNA, 21 bp, Homo sapiens
attctatgttaatattttatg

SEQ ID NO: 6676191 - DNA, 22 bp, Homo sapiens
attctatgttaatattttatgt

SEQ ID NO: 6676192 - DNA, 18 bp, Homo sapiens
attctattacattttcag

SEQ ID NO: 6676193 - DNA, 13 bp, Homo sapiens
attctattctaat

SEQ ID NO: 6676194 - DNA, 18 bp, Homo sapiens
attctattctaataactg

SEQ ID NO: 6676195 - DNA, 19 bp, Homo sapiens
attctattgccttctttga

SEQ ID NO: 6676196 - DNA, 20 bp, Homo sapiens
attctattgccttctttgaa

SEQ ID NO: 6676197 - DNA, 13 bp, Homo sapiens
attctatttaatt

SEQ ID NO: 6676198 - DNA, 14 bp, Homo sapiens
attctatttctcta

SEQ ID NO: 6676199 - DNA, 19 bp, Homo sapiens
attctatttggtttgcttt

SEQ ID NO: 6676200 - DNA, 20 bp, Homo sapiens
attctatttgtcttctcctt

SEQ ID NO: 6676201 - DNA, 13 bp, Homo sapiens
attctatttgtgt

SEQ ID NO: 6676202 - DNA, 15 bp, Homo sapiens
attctatttgtgtaa

SEQ ID NO: 6676203 - DNA, 14 bp, Homo sapiens
attctattttgctg

SEQ ID NO: 6676204 - DNA, 21 bp, Homo sapiens
attctcaaaatacgtgttcaa

SEQ ID NO: 6676205 - DNA, 15 bp, Homo sapiens
attctcaaacacagt

SEQ ID NO: 6676206 - DNA, 14 bp, Homo sapiens
attctcaaagcagg

SEQ ID NO: 6676207 - DNA, 14 bp, Homo sapiens
attctcaaagttaa

SEQ ID NO: 6676208 - DNA, 23 bp, Homo sapiens
attctcaaagttaaaagtaaaat

SEQ ID NO: 6676209 - DNA, 14 bp, Homo sapiens
attctcaaagtttt

SEQ ID NO: 6676210 - DNA, 15 bp, Homo sapiens
attctcaaagtttta

SEQ ID NO: 6676211 - DNA, 19 bp, Homo sapiens
attctcaaagttttattat

SEQ ID NO: 6676212 - DNA, 15 bp, Homo sapiens
attctcaagccctgc

SEQ ID NO: 6676213 - DNA, 23 bp, Homo sapiens
attctcaagccgcatcccagact

SEQ ID NO: 6676214 - DNA, 12 bp, Homo sapiens
attctcaagtga

SEQ ID NO: 6676215 - DNA, 19 bp, Homo sapiens
attctcaatcatgggaatt

SEQ ID NO: 6676216 - DNA, 21 bp, Homo sapiens
attctcaatcatgggaatttt

SEQ ID NO: 6676217 - DNA, 19 bp, Homo sapiens
attctcacagctccaagaa

SEQ ID NO: 6676218 - DNA, 23 bp, Homo sapiens
attctcacataagcccagttcat

SEQ ID NO: 6676219 - DNA, 17 bp, Homo sapiens
attctcacatccctcta

SEQ ID NO: 6676220 - DNA, 14 bp, Homo sapiens
attctcaccaggaa

SEQ ID NO: 6676221 - DNA, 15 bp, Homo sapiens
attctcacctgcctt

SEQ ID NO: 6676222 - DNA, 15 bp, Homo sapiens
attctcactccacca

SEQ ID NO: 6676223 - DNA, 16 bp, Homo sapiens
attctcactccaccac

SEQ ID NO: 6676224 - DNA, 16 bp, Homo sapiens
attctcactctgcttt

SEQ ID NO: 6676225 - DNA, 16 bp, Homo sapiens
attctcagaaaggcaa

SEQ ID NO: 6676226 - DNA, 18 bp, Homo sapiens
attctcagaacaccaagt

SEQ ID NO: 6676227 - DNA, 19 bp, Homo sapiens
attctcagaagtgaaaaag

SEQ ID NO: 6676228 - DNA, 14 bp, Homo sapiens
attctcagaatctc

SEQ ID NO: 6676229 - DNA, 18 bp, Homo sapiens
attctcagaatctcaaat

SEQ ID NO: 6676230 - DNA, 13 bp, Homo sapiens
attctcagaattc

SEQ ID NO: 6676231 - DNA, 16 bp, Homo sapiens
attctcagatatttat

SEQ ID NO: 6676232 - DNA, 23 bp, Homo sapiens
attctcagatatttatattttta

SEQ ID NO: 6676233 - DNA, 17 bp, Homo sapiens
attctcagcagagtgct

SEQ ID NO: 6676234 - DNA, 13 bp, Homo sapiens
attctcagggctg

SEQ ID NO: 6676235 - DNA, 18 bp, Homo sapiens
attctcagggctggagcc

SEQ ID NO: 6676236 - DNA, 22 bp, Homo sapiens
attctcagggctggagcctggg

SEQ ID NO: 6676237 - DNA, 19 bp, Homo sapiens
attctcagggtctctgctg

SEQ ID NO: 6676238 - DNA, 21 bp, Homo sapiens
attctcagggtctctgctgcc

SEQ ID NO: 6676239 - DNA, 15 bp, Homo sapiens
attctcagtaacttt

SEQ ID NO: 6676240 - DNA, 19 bp, Homo sapiens
attctcagtgccaactgtg

SEQ ID NO: 6676241 - DNA, 24 bp, Homo sapiens
attctcagtgccaactgtggctgg

SEQ ID NO: 6676242 - DNA, 20 bp, Homo sapiens
attctcataagtagcattca

SEQ ID NO: 6676243 - DNA, 20 bp, Homo sapiens
attctcataatactgaaatg

SEQ ID NO: 6676244 - DNA, 16 bp, Homo sapiens
attctcataattccta

SEQ ID NO: 6676245 - DNA, 16 bp, Homo sapiens
attctcataggagact

SEQ ID NO: 6676246 - DNA, 18 bp, Homo sapiens
attctcataggagactgc

SEQ ID NO: 6676247 - DNA, 19 bp, Homo sapiens
attctcatatgtagccctc

SEQ ID NO: 6676248 - DNA, 20 bp, Homo sapiens
attctcatctgcacccttct

SEQ ID NO: 6676249 - DNA, 22 bp, Homo sapiens
attctcatctgcacccttcttt

SEQ ID NO: 6676250 - DNA, 14 bp, Homo sapiens
attctcatgcctca

SEQ ID NO: 6676251 - DNA, 15 bp, Homo sapiens
attctcatgcctcag

SEQ ID NO: 6676252 - DNA, 16 bp, Homo sapiens
attctcatggagaagt

SEQ ID NO: 6676253 - DNA, 23 bp, Homo sapiens
attctcatgtctcagcctcctca

SEQ ID NO: 6676254 - DNA, 15 bp, Homo sapiens
attctcatgtgatcc

SEQ ID NO: 6676255 - DNA, 12 bp, Homo sapiens
attctcattaaa

SEQ ID NO: 6676256 - DNA, 17 bp, Homo sapiens
attctcattatgaagat

SEQ ID NO: 6676257 - DNA, 18 bp, Homo sapiens
attctcattatgttgata

SEQ ID NO: 6676258 - DNA, 15 bp, Homo sapiens
attctcattatttca

SEQ ID NO: 6676259 - DNA, 12 bp, Homo sapiens
attctcattctt

SEQ ID NO: 6676260 - DNA, 16 bp, Homo sapiens
attctcattgcagaat

SEQ ID NO: 6676261 - DNA, 14 bp, Homo sapiens
attctcatttagtg

SEQ ID NO: 6676262 - DNA, 17 bp, Homo sapiens
attctcatttgtcacac

SEQ ID NO: 6676263 - DNA, 17 bp, Homo sapiens
attctcattttgctttt

SEQ ID NO: 6676264 - DNA, 16 bp, Homo sapiens
attctcatttttctaa

SEQ ID NO: 6676265 - DNA, 14 bp, Homo sapiens
attctccaaatgat

SEQ ID NO: 6676266 - DNA, 17 bp, Homo sapiens
attctccacctgccagg

SEQ ID NO: 6676267 - DNA, 20 bp, Homo sapiens
attctccacctgccagggac

SEQ ID NO: 6676268 - DNA, 16 bp, Homo sapiens
attctccactttttct

SEQ ID NO: 6676269 - DNA, 18 bp, Homo sapiens
attctccactttttctta

SEQ ID NO: 6676270 - DNA, 21 bp, Homo sapiens
attctccagaaaaatcaatca

SEQ ID NO: 6676271 - DNA, 23 bp, Homo sapiens
attctccagccatcaagagactg

SEQ ID NO: 6676272 - DNA, 21 bp, Homo sapiens
attctccaggattccaaagtt

SEQ ID NO: 6676273 - DNA, 21 bp, Homo sapiens
attctccagtttcagaagcag

SEQ ID NO: 6676274 - DNA, 12 bp, Homo sapiens
attctcccagcg

SEQ ID NO: 6676275 - DNA, 21 bp, Homo sapiens
attctcccaggtaccagctgc

SEQ ID NO: 6676276 - DNA, 21 bp, Homo sapiens
attctcccagtctctgtcgtg

SEQ ID NO: 6676277 - DNA, 12 bp, Homo sapiens
attctcccctcc

SEQ ID NO: 6676278 - DNA, 19 bp, Homo sapiens
attctcccgcctcagcctc

SEQ ID NO: 6676279 - DNA, 23 bp, Homo sapiens
attctcccgcttcctggcctccc

SEQ ID NO: 6676280 - DNA, 23 bp, Homo sapiens
attctcccgggactctgcatatt

SEQ ID NO: 6676281 - DNA, 17 bp, Homo sapiens
attctcccttgattcca

SEQ ID NO: 6676282 - DNA, 18 bp, Homo sapiens
attctcctcctcctccct

SEQ ID NO: 6676283 - DNA, 23 bp, Homo sapiens
attctcctcctcctccctcctca

SEQ ID NO: 6676284 - DNA, 11 bp, Homo sapiens
attctcctctc

SEQ ID NO: 6676285 - DNA, 13 bp, Homo sapiens
attctcctctccc

SEQ ID NO: 6676286 - DNA, 12 bp, Homo sapiens
attctcctgcct

SEQ ID NO: 6676287 - DNA, 14 bp, Homo sapiens
attctcctgcctca

SEQ ID NO: 6676288 - DNA, 23 bp, Homo sapiens
attctcctgcctcagcctcccaa

SEQ ID NO: 6676289 - DNA, 23 bp, Homo sapiens
attctcctgcctcagcctcctga

SEQ ID NO: 6676290 - DNA, 11 bp, Homo sapiens
attctcctgga

SEQ ID NO: 6676291 - DNA, 13 bp, Homo sapiens
attctcctgtgct

SEQ ID NO: 6676292 - DNA, 14 bp, Homo sapiens
attctcctgtgcta

SEQ ID NO: 6676293 - DNA, 13 bp, Homo sapiens
attctccttcagc

SEQ ID NO: 6676294 - DNA, 18 bp, Homo sapiens
attctccttcagccctca

SEQ ID NO: 6676295 - DNA, 17 bp, Homo sapiens
attctccttcctgtgcc

SEQ ID NO: 6676296 - DNA, 16 bp, Homo sapiens
attctccttgtgttac

SEQ ID NO: 6676297 - DNA, 21 bp, Homo sapiens
attctccttgtgttactaagt

SEQ ID NO: 6676298 - DNA, 22 bp, Homo sapiens
attctccttgtgttactaagtt

SEQ ID NO: 6676299 - DNA, 18 bp, Homo sapiens
attctccttgttgttggt

SEQ ID NO: 6676300 - DNA, 21 bp, Homo sapiens
attctcctttttacccctcta

SEQ ID NO: 6676301 - DNA, 22 bp, Homo sapiens
attctcgccccttccctctctc

SEQ ID NO: 6676302 - DNA, 22 bp, Homo sapiens
attctctaagatgaatccaaat

SEQ ID NO: 6676303 - DNA, 21 bp, Homo sapiens
attctctaataaaattcagaa

SEQ ID NO: 6676304 - DNA, 17 bp, Homo sapiens
attctctaataagaaaa

SEQ ID NO: 6676305 - DNA, 14 bp, Homo sapiens
attctctactgcca

SEQ ID NO: 6676306 - DNA, 20 bp, Homo sapiens
attctctagacaaaatccat

SEQ ID NO: 6676307 - DNA, 18 bp, Homo sapiens
attctctagtttgattaa

SEQ ID NO: 6676308 - DNA, 19 bp, Homo sapiens
attctctagtttgattaaa

SEQ ID NO: 6676309 - DNA, 20 bp, Homo sapiens
attctctatgtacagatgat

SEQ ID NO: 6676310 - DNA, 13 bp, Homo sapiens
attctctatttat

SEQ ID NO: 6676311 - DNA, 21 bp, Homo sapiens
attctctcaagacttctccag

SEQ ID NO: 6676312 - DNA, 20 bp, Homo sapiens
attctctcacttaattttcc

SEQ ID NO: 6676313 - DNA, 17 bp, Homo sapiens
attctctcatagaacat

SEQ ID NO: 6676314 - DNA, 19 bp, Homo sapiens
attctctccaaaaatgcac

SEQ ID NO: 6676315 - DNA, 23 bp, Homo sapiens
attctctccagtgtgtgtaacag

SEQ ID NO: 6676316 - DNA, 21 bp, Homo sapiens
attctctccatttcactggct

SEQ ID NO: 6676317 - DNA, 12 bp, Homo sapiens
attctctcctaa

SEQ ID NO: 6676318 - DNA, 16 bp, Homo sapiens
attctctcctcagact

SEQ ID NO: 6676319 - DNA, 21 bp, Homo sapiens
attctctcctgtacctcttga

SEQ ID NO: 6676320 - DNA, 16 bp, Homo sapiens
attctctctcctgtcc

SEQ ID NO: 6676321 - DNA, 22 bp, Homo sapiens
attctctctgaacacacattgc

SEQ ID NO: 6676322 - DNA, 13 bp, Homo sapiens
attctctctgccc

SEQ ID NO: 6676323 - DNA, 16 bp, Homo sapiens
attctctctgctcagt

SEQ ID NO: 6676324 - DNA, 19 bp, Homo sapiens
attctctcttattgttctt

SEQ ID NO: 6676325 - DNA, 15 bp, Homo sapiens
attctctcttctctc

SEQ ID NO: 6676326 - DNA, 18 bp, Homo sapiens
attctctcttgtccttca

SEQ ID NO: 6676327 - DNA, 11 bp, Homo sapiens
attctctgagc

SEQ ID NO: 6676328 - DNA, 14 bp, Homo sapiens
attctctgcaattt

SEQ ID NO: 6676329 - DNA, 16 bp, Homo sapiens
attctctgcaatttgt

SEQ ID NO: 6676330 - DNA, 23 bp, Homo sapiens
attctctgcaatttgtttaaaga

SEQ ID NO: 6676331 - DNA, 17 bp, Homo sapiens
attctctgcaattttac

SEQ ID NO: 6676332 - DNA, 11 bp, Homo sapiens
attctctgcag

SEQ ID NO: 6676333 - DNA, 21 bp, Homo sapiens
attctctgcagcccattccca

SEQ ID NO: 6676334 - DNA, 12 bp, Homo sapiens
attctctgccca

SEQ ID NO: 6676335 - DNA, 19 bp, Homo sapiens
attctctgcccgggcccct

SEQ ID NO: 6676336 - DNA, 12 bp, Homo sapiens
attctctgcctt

SEQ ID NO: 6676337 - DNA, 20 bp, Homo sapiens
attctctggctgtaaggctc

SEQ ID NO: 6676338 - DNA, 14 bp, Homo sapiens
attctctgtaagtg

SEQ ID NO: 6676339 - DNA, 11 bp, Homo sapiens
attctctgtac

SEQ ID NO: 6676340 - DNA, 14 bp, Homo sapiens
attctctgtacata

SEQ ID NO: 6676341 - DNA, 14 bp, Homo sapiens
attctctgtccagg

SEQ ID NO: 6676342 - DNA, 18 bp, Homo sapiens
attctctgtccagggctt

SEQ ID NO: 6676343 - DNA, 18 bp, Homo sapiens
attctctgtctcatccat

SEQ ID NO: 6676344 - DNA, 10 bp, Homo sapiens
attctctgtg

SEQ ID NO: 6676345 - DNA, 16 bp, Homo sapiens
attctctgtttgcttt

SEQ ID NO: 6676346 - DNA, 21 bp, Homo sapiens
attctctgtttgcttttgaac

SEQ ID NO: 6676347 - DNA, 15 bp, Homo sapiens
attctcttaaataaa

SEQ ID NO: 6676348 - DNA, 13 bp, Homo sapiens
attctcttaccca

SEQ ID NO: 6676349 - DNA, 15 bp, Homo sapiens
attctcttatccaac

SEQ ID NO: 6676350 - DNA, 14 bp, Homo sapiens
attctcttcactcc

SEQ ID NO: 6676351 - DNA, 15 bp, Homo sapiens
attctcttcgctgtg

SEQ ID NO: 6676352 - DNA, 12 bp, Homo sapiens
attctcttctca

SEQ ID NO: 6676353 - DNA, 16 bp, Homo sapiens
attctcttcttgctat

SEQ ID NO: 6676354 - DNA, 17 bp, Homo sapiens
attctcttgaaggtgct

SEQ ID NO: 6676355 - DNA, 14 bp, Homo sapiens
attctcttgcattg

SEQ ID NO: 6676356 - DNA, 15 bp, Homo sapiens
attctcttgcattgt

SEQ ID NO: 6676357 - DNA, 15 bp, Homo sapiens
attctcttgcctcag

SEQ ID NO: 6676358 - DNA, 18 bp, Homo sapiens
attctcttgtataagatc

SEQ ID NO: 6676359 - DNA, 23 bp, Homo sapiens
attctcttgttctttggcaacaa

SEQ ID NO: 6676360 - DNA, 15 bp, Homo sapiens
attctctttaactgt

SEQ ID NO: 6676361 - DNA, 17 bp, Homo sapiens
attctctttaactgtgt

SEQ ID NO: 6676362 - DNA, 19 bp, Homo sapiens
attctctttaactgtgtga

SEQ ID NO: 6676363 - DNA, 19 bp, Homo sapiens
attctctttcaattctgtg

SEQ ID NO: 6676364 - DNA, 20 bp, Homo sapiens
attctctttctttttctgtc

SEQ ID NO: 6676365 - DNA, 22 bp, Homo sapiens
attctctttctttttctgtctc

SEQ ID NO: 6676366 - DNA, 18 bp, Homo sapiens
attctctttgataacaaa

SEQ ID NO: 6676367 - DNA, 19 bp, Homo sapiens
attctctttgataacaaaa

SEQ ID NO: 6676368 - DNA, 12 bp, Homo sapiens
attctctttggt

SEQ ID NO: 6676369 - DNA, 16 bp, Homo sapiens
attctgaaaaagacat

SEQ ID NO: 6676370 - DNA, 23 bp, Homo sapiens
attctgaaaaagacataaaacag

SEQ ID NO: 6676371 - DNA, 19 bp, Homo sapiens
attctgaaaactgaatgtc

SEQ ID NO: 6676372 - DNA, 22 bp, Homo sapiens
attctgaaaactgaatgtcaag

SEQ ID NO: 6676373 - DNA, 17 bp, Homo sapiens
attctgaaaggaaatac

SEQ ID NO: 6676374 - DNA, 15 bp, Homo sapiens
attctgaaatacttt

SEQ ID NO: 6676375 - DNA, 22 bp, Homo sapiens
attctgaaatttttttcctaag

SEQ ID NO: 6676376 - DNA, 19 bp, Homo sapiens
attctgaactaaagtgctg

SEQ ID NO: 6676377 - DNA, 22 bp, Homo sapiens
attctgaactaaagtgctgcac

SEQ ID NO: 6676378 - DNA, 15 bp, Homo sapiens
attctgaaggagccc

SEQ ID NO: 6676379 - DNA, 15 bp, Homo sapiens
attctgaaggggaaa

SEQ ID NO: 6676380 - DNA, 14 bp, Homo sapiens
attctgaagttata

SEQ ID NO: 6676381 - DNA, 20 bp, Homo sapiens
attctgaatcaccaattaaa

SEQ ID NO: 6676382 - DNA, 15 bp, Homo sapiens
attctgaatctgaaa

SEQ ID NO: 6676383 - DNA, 16 bp, Homo sapiens
attctgaatgcaattt

SEQ ID NO: 6676384 - DNA, 16 bp, Homo sapiens
attctgaatgcttcta

SEQ ID NO: 6676385 - DNA, 13 bp, Homo sapiens
attctgaatgtac

SEQ ID NO: 6676386 - DNA, 23 bp, Homo sapiens
attctgaattaattaatttggag

SEQ ID NO: 6676387 - DNA, 18 bp, Homo sapiens
attctgaatttgcaaagt

SEQ ID NO: 6676388 - DNA, 20 bp, Homo sapiens
attctgaatttgcaaagtac

SEQ ID NO: 6676389 - DNA, 23 bp, Homo sapiens
attctgaatttgtagacatactt

SEQ ID NO: 6676390 - DNA, 12 bp, Homo sapiens
attctgaatttt

SEQ ID NO: 6676391 - DNA, 21 bp, Homo sapiens
attctgacatccacatgctct

SEQ ID NO: 6676392 - DNA, 18 bp, Homo sapiens
attctgacatttatattt

SEQ ID NO: 6676393 - DNA, 16 bp, Homo sapiens
attctgacccagggcc

SEQ ID NO: 6676394 - DNA, 23 bp, Homo sapiens
attctgaccgttaaaaaattctt

SEQ ID NO: 6676395 - DNA, 14 bp, Homo sapiens
attctgaccttaaa

SEQ ID NO: 6676396 - DNA, 17 bp, Homo sapiens
attctgaccttgtgaac

SEQ ID NO: 6676397 - DNA, 22 bp, Homo sapiens
attctgaccttgtgaacatcag

SEQ ID NO: 6676398 - DNA, 20 bp, Homo sapiens
attctgactgtccaggagct

SEQ ID NO: 6676399 - DNA, 14 bp, Homo sapiens
attctgacttcctc

SEQ ID NO: 6676400 - DNA, 17 bp, Homo sapiens
attctgacttctcccat

SEQ ID NO: 6676401 - DNA, 15 bp, Homo sapiens
attctgagaaaacaa

SEQ ID NO: 6676402 - DNA, 14 bp, Homo sapiens
attctgagaccaaa

SEQ ID NO: 6676403 - DNA, 19 bp, Homo sapiens
attctgagatccagcacaa

SEQ ID NO: 6676404 - DNA, 20 bp, Homo sapiens
attctgagcaaaggccctgg

SEQ ID NO: 6676405 - DNA, 21 bp, Homo sapiens
attctgagcaaaggccctggg

SEQ ID NO: 6676406 - DNA, 22 bp, Homo sapiens
attctgagcaaaggccctgggt

SEQ ID NO: 6676407 - DNA, 21 bp, Homo sapiens
attctgagcacgggcaaagaa

SEQ ID NO: 6676408 - DNA, 16 bp, Homo sapiens
attctgagcagtgcct

SEQ ID NO: 6676409 - DNA, 17 bp, Homo sapiens
attctgaggccctgccc

SEQ ID NO: 6676410 - DNA, 13 bp, Homo sapiens
attctgaggcctg

SEQ ID NO: 6676411 - DNA, 17 bp, Homo sapiens
attctgagggaatttaa

SEQ ID NO: 6676412 - DNA, 20 bp, Homo sapiens
attctgaggtaagtgtatga

SEQ ID NO: 6676413 - DNA, 22 bp, Homo sapiens
attctgataaaaataatattaa

SEQ ID NO: 6676414 - DNA, 17 bp, Homo sapiens
attctgataatgtattg

SEQ ID NO: 6676415 - DNA, 22 bp, Homo sapiens
attctgataatttaaaatccat

SEQ ID NO: 6676416 - DNA, 16 bp, Homo sapiens
attctgatacagcctt

SEQ ID NO: 6676417 - DNA, 12 bp, Homo sapiens
attctgatacat

SEQ ID NO: 6676418 - DNA, 16 bp, Homo sapiens
attctgataggagggg

SEQ ID NO: 6676419 - DNA, 23 bp, Homo sapiens
attctgatcctcagcccctccag

SEQ ID NO: 6676420 - DNA, 10 bp, Homo sapiens
attctgatga

SEQ ID NO: 6676421 - DNA, 18 bp, Homo sapiens
attctgatgtactctaaa

SEQ ID NO: 6676422 - DNA, 23 bp, Homo sapiens
attctgatgtactctaaatactg

SEQ ID NO: 6676423 - DNA, 15 bp, Homo sapiens
attctgattacacaa

SEQ ID NO: 6676424 - DNA, 18 bp, Homo sapiens
attctgattattacaaca

SEQ ID NO: 6676425 - DNA, 22 bp, Homo sapiens
attctgattctggctttaagcc

SEQ ID NO: 6676426 - DNA, 15 bp, Homo sapiens
attctgattcttcta

SEQ ID NO: 6676427 - DNA, 20 bp, Homo sapiens
attctgattcttctaaatta

SEQ ID NO: 6676428 - DNA, 13 bp, Homo sapiens
attctgattcttt

SEQ ID NO: 6676429 - DNA, 13 bp, Homo sapiens
attctgatttcag

SEQ ID NO: 6676430 - DNA, 19 bp, Homo sapiens
attctgatttcagtttttc

SEQ ID NO: 6676431 - DNA, 23 bp, Homo sapiens
attctgatttcagtttttcattt

SEQ ID NO: 6676432 - DNA, 14 bp, Homo sapiens
attctgcaagtttc

SEQ ID NO: 6676433 - DNA, 18 bp, Homo sapiens
attctgcaagtttctgtt

SEQ ID NO: 6676434 - DNA, 15 bp, Homo sapiens
attctgcaatggcag

SEQ ID NO: 6676435 - DNA, 19 bp, Homo sapiens
attctgcaccttgccaggg

SEQ ID NO: 6676436 - DNA, 18 bp, Homo sapiens
attctgcacgctgcccag

SEQ ID NO: 6676437 - DNA, 21 bp, Homo sapiens
attctgcacgctgcccagggg

SEQ ID NO: 6676438 - DNA, 18 bp, Homo sapiens
attctgcactcagaaaat

SEQ ID NO: 6676439 - DNA, 22 bp, Homo sapiens
attctgcagcccgatgtccctg

SEQ ID NO: 6676440 - DNA, 21 bp, Homo sapiens
attctgcagctgcttttgcat

SEQ ID NO: 6676441 - DNA, 23 bp, Homo sapiens
attctgcagtaaatcttttacaa

SEQ ID NO: 6676442 - DNA, 20 bp, Homo sapiens
attctgcatcctggcttgaa

SEQ ID NO: 6676443 - DNA, 13 bp, Homo sapiens
attctgcatgccc

SEQ ID NO: 6676444 - DNA, 14 bp, Homo sapiens
attctgcatgtact

SEQ ID NO: 6676445 - DNA, 11 bp, Homo sapiens
attctgcatta

SEQ ID NO: 6676446 - DNA, 18 bp, Homo sapiens
attctgcattaataatag

SEQ ID NO: 6676447 - DNA, 15 bp, Homo sapiens
attctgcattgagaa

SEQ ID NO: 6676448 - DNA, 19 bp, Homo sapiens
attctgcattgagaaggaa

SEQ ID NO: 6676449 - DNA, 19 bp, Homo sapiens
attctgcattgctagataa

SEQ ID NO: 6676450 - DNA, 15 bp, Homo sapiens
attctgcatttagct

SEQ ID NO: 6676451 - DNA, 18 bp, Homo sapiens
attctgcatttagctgta

SEQ ID NO: 6676452 - DNA, 22 bp, Homo sapiens
attctgcatttagctgtattca

SEQ ID NO: 6676453 - DNA, 18 bp, Homo sapiens
attctgccaaagtaaaac

SEQ ID NO: 6676454 - DNA, 21 bp, Homo sapiens
attctgccataacagattatg

SEQ ID NO: 6676455 - DNA, 19 bp, Homo sapiens
attctgcccaaaaatatgg

SEQ ID NO: 6676456 - DNA, 13 bp, Homo sapiens
attctgccctgtg

SEQ ID NO: 6676457 - DNA, 22 bp, Homo sapiens
attctgccgccccctcctgaac

SEQ ID NO: 6676458 - DNA, 23 bp, Homo sapiens
attctgcctacgttctctttaaa

SEQ ID NO: 6676459 - DNA, 17 bp, Homo sapiens
attctgcctagagtgta

SEQ ID NO: 6676460 - DNA, 15 bp, Homo sapiens
attctgcctcagcct

SEQ ID NO: 6676461 - DNA, 17 bp, Homo sapiens
attctgcctcagcctcc

SEQ ID NO: 6676462 - DNA, 18 bp, Homo sapiens
attctgcctcagcctcct

SEQ ID NO: 6676463 - DNA, 19 bp, Homo sapiens
attctgcctcagcctcctg

SEQ ID NO: 6676464 - DNA, 13 bp, Homo sapiens
attctgcctctcc

SEQ ID NO: 6676465 - DNA, 16 bp, Homo sapiens
attctgcctctcctca

SEQ ID NO: 6676466 - DNA, 16 bp, Homo sapiens
attctgcctctctagg

SEQ ID NO: 6676467 - DNA, 14 bp, Homo sapiens
attctgcctctctg

SEQ ID NO: 6676468 - DNA, 17 bp, Homo sapiens
attctgcctctctggaa

SEQ ID NO: 6676469 - DNA, 20 bp, Homo sapiens
attctgcctgcccaggcccc

SEQ ID NO: 6676470 - DNA, 14 bp, Homo sapiens
attctgcctgccct

SEQ ID NO: 6676471 - DNA, 20 bp, Homo sapiens
attctgcctgcctcctccct

SEQ ID NO: 6676472 - DNA, 14 bp, Homo sapiens
attctgcctgcctg

SEQ ID NO: 6676473 - DNA, 14 bp, Homo sapiens
attctgcctgctcc

SEQ ID NO: 6676474 - DNA, 13 bp, Homo sapiens
attctgccttggt

SEQ ID NO: 6676475 - DNA, 21 bp, Homo sapiens
attctgccttggttctggcca

SEQ ID NO: 6676476 - DNA, 20 bp, Homo sapiens
attctgcctttgcagaaaca

SEQ ID NO: 6676477 - DNA, 19 bp, Homo sapiens
attctgcctttgccaggtg

SEQ ID NO: 6676478 - DNA, 22 bp, Homo sapiens
attctgcgtcatgcttgtgtta

SEQ ID NO: 6676479 - DNA, 18 bp, Homo sapiens
attctgctaatttatgaa

SEQ ID NO: 6676480 - DNA, 21 bp, Homo sapiens
attctgctaatttatgaagat

SEQ ID NO: 6676481 - DNA, 18 bp, Homo sapiens
attctgctcacatatctg

SEQ ID NO: 6676482 - DNA, 19 bp, Homo sapiens
attctgctcctgaaaaatg

SEQ ID NO: 6676483 - DNA, 20 bp, Homo sapiens
attctgctctaaataaagac

SEQ ID NO: 6676484 - DNA, 14 bp, Homo sapiens
attctgctctgccc

SEQ ID NO: 6676485 - DNA, 20 bp, Homo sapiens
attctgctctgcccatgcct

SEQ ID NO: 6676486 - DNA, 16 bp, Homo sapiens
attctgctgcccccag

SEQ ID NO: 6676487 - DNA, 12 bp, Homo sapiens
attctgctgctt

SEQ ID NO: 6676488 - DNA, 13 bp, Homo sapiens
attctgctgcttg

SEQ ID NO: 6676489 - DNA, 16 bp, Homo sapiens
attctgctggcctctg

SEQ ID NO: 6676490 - DNA, 19 bp, Homo sapiens
attctgctggcctctgcga

SEQ ID NO: 6676491 - DNA, 22 bp, Homo sapiens
attctgctttcttgccacacag

SEQ ID NO: 6676492 - DNA, 18 bp, Homo sapiens
attctggaaaaaaaatat

SEQ ID NO: 6676493 - DNA, 22 bp, Homo sapiens
attctggaaaaaaaatatatat

SEQ ID NO: 6676494 - DNA, 19 bp, Homo sapiens
attctggaaacttttgtta

SEQ ID NO: 6676495 - DNA, 18 bp, Homo sapiens
attctggaagctgattaa

SEQ ID NO: 6676496 - DNA, 18 bp, Homo sapiens
attctggacagtcagctc

SEQ ID NO: 6676497 - DNA, 22 bp, Homo sapiens
attctggacagtcagctcttca

SEQ ID NO: 6676498 - DNA, 15 bp, Homo sapiens
attctggaccagaga

SEQ ID NO: 6676499 - DNA, 16 bp, Homo sapiens
attctggacctctggg

SEQ ID NO: 6676500 - DNA, 22 bp, Homo sapiens
attctggagacagaaccagcag

SEQ ID NO: 6676501 - DNA, 19 bp, Homo sapiens
attctggaggaagaagaca

SEQ ID NO: 6676502 - DNA, 17 bp, Homo sapiens
attctggataaagccac

SEQ ID NO: 6676503 - DNA, 15 bp, Homo sapiens
attctggatctcctg

SEQ ID NO: 6676504 - DNA, 16 bp, Homo sapiens
attctggatctcctgc

SEQ ID NO: 6676505 - DNA, 19 bp, Homo sapiens
attctggatctcctgctgc

SEQ ID NO: 6676506 - DNA, 15 bp, Homo sapiens
attctggcactttaa

SEQ ID NO: 6676507 - DNA, 14 bp, Homo sapiens
attctggcaggacc

SEQ ID NO: 6676508 - DNA, 19 bp, Homo sapiens
attctggcccagccaatct

SEQ ID NO: 6676509 - DNA, 23 bp, Homo sapiens
attctggcctagtcccttccaca

SEQ ID NO: 6676510 - DNA, 14 bp, Homo sapiens
attctggctccacc

SEQ ID NO: 6676511 - DNA, 19 bp, Homo sapiens
attctggctgataaaagat

SEQ ID NO: 6676512 - DNA, 19 bp, Homo sapiens
attctggctttaagccttc

SEQ ID NO: 6676513 - DNA, 15 bp, Homo sapiens
attctgggaaaggtg

SEQ ID NO: 6676514 - DNA, 19 bp, Homo sapiens
attctgggaaaggtgctca

SEQ ID NO: 6676515 - DNA, 20 bp, Homo sapiens
attctgggaaaggtgctcaa

SEQ ID NO: 6676516 - DNA, 16 bp, Homo sapiens
attctgggaaatgttt

SEQ ID NO: 6676517 - DNA, 20 bp, Homo sapiens
attctgggaaatgttttaat

SEQ ID NO: 6676518 - DNA, 22 bp, Homo sapiens
attctgggaagcttgagcctcc

SEQ ID NO: 6676519 - DNA, 15 bp, Homo sapiens
attctgggaagggag

SEQ ID NO: 6676520 - DNA, 20 bp, Homo sapiens
attctgggaatcatgtccat

SEQ ID NO: 6676521 - DNA, 22 bp, Homo sapiens
attctgggaatgtatagtattt

SEQ ID NO: 6676522 - DNA, 18 bp, Homo sapiens
attctgggagaatgaaag

SEQ ID NO: 6676523 - DNA, 14 bp, Homo sapiens
attctgggcaaata

SEQ ID NO: 6676524 - DNA, 21 bp, Homo sapiens
attctgggctcctggaaccaa

SEQ ID NO: 6676525 - DNA, 23 bp, Homo sapiens
attctgggctcctggaaccaatc

SEQ ID NO: 6676526 - DNA, 18 bp, Homo sapiens
attctgggcttggggtgt

SEQ ID NO: 6676527 - DNA, 16 bp, Homo sapiens
attctgggtttgccca

SEQ ID NO: 6676528 - DNA, 17 bp, Homo sapiens
attctgggttttgtagc

SEQ ID NO: 6676529 - DNA, 18 bp, Homo sapiens
attctgggttttgtagca

SEQ ID NO: 6676530 - DNA, 14 bp, Homo sapiens
attctggtatacat

SEQ ID NO: 6676531 - DNA, 15 bp, Homo sapiens
attctggtatacatt

SEQ ID NO: 6676532 - DNA, 16 bp, Homo sapiens
attctggtcttcactg

SEQ ID NO: 6676533 - DNA, 15 bp, Homo sapiens
attctggttcttgaa

SEQ ID NO: 6676534 - DNA, 16 bp, Homo sapiens
attctggttcttgaaa

SEQ ID NO: 6676535 - DNA, 17 bp, Homo sapiens
attctggttgtaaatct

SEQ ID NO: 6676536 - DNA, 15 bp, Homo sapiens
attctgtaaaagaaa

SEQ ID NO: 6676537 - DNA, 12 bp, Homo sapiens
attctgtaagaa

SEQ ID NO: 6676538 - DNA, 16 bp, Homo sapiens
attctgtaattacata

SEQ ID NO: 6676539 - DNA, 18 bp, Homo sapiens
attctgtaattacatatt

SEQ ID NO: 6676540 - DNA, 16 bp, Homo sapiens
attctgtaatttgaat

SEQ ID NO: 6676541 - DNA, 14 bp, Homo sapiens
attctgtactctta

SEQ ID NO: 6676542 - DNA, 22 bp, Homo sapiens
attctgtacttccaatttataa

SEQ ID NO: 6676543 - DNA, 19 bp, Homo sapiens
attctgtagccaacttaaa

SEQ ID NO: 6676544 - DNA, 14 bp, Homo sapiens
attctgtagttgca

SEQ ID NO: 6676545 - DNA, 12 bp, Homo sapiens
attctgtataga

SEQ ID NO: 6676546 - DNA, 21 bp, Homo sapiens
attctgtatagattagaattc

SEQ ID NO: 6676547 - DNA, 20 bp, Homo sapiens
attctgtatccgtgaattgc

SEQ ID NO: 6676548 - DNA, 17 bp, Homo sapiens
attctgtcaatgaaaag

SEQ ID NO: 6676549 - DNA, 17 bp, Homo sapiens
attctgtcatagaaagt

SEQ ID NO: 6676550 - DNA, 15 bp, Homo sapiens
attctgtcatttaca

SEQ ID NO: 6676551 - DNA, 22 bp, Homo sapiens
attctgtccatgaagcatacac

SEQ ID NO: 6676552 - DNA, 12 bp, Homo sapiens
attctgtccctg

SEQ ID NO: 6676553 - DNA, 15 bp, Homo sapiens
attctgtccctgtcc

SEQ ID NO: 6676554 - DNA, 16 bp, Homo sapiens
attctgtccctgtccc

SEQ ID NO: 6676555 - DNA, 22 bp, Homo sapiens
attctgtccctgtccctgcccc

SEQ ID NO: 6676556 - DNA, 18 bp, Homo sapiens
attctgtcgccttagcat

SEQ ID NO: 6676557 - DNA, 20 bp, Homo sapiens
attctgtcgccttagcatgt

SEQ ID NO: 6676558 - DNA, 14 bp, Homo sapiens
attctgtctgggga

SEQ ID NO: 6676559 - DNA, 23 bp, Homo sapiens
attctgtcttcatcccctcagaa

SEQ ID NO: 6676560 - DNA, 14 bp, Homo sapiens
attctgtcttgaag

SEQ ID NO: 6676561 - DNA, 17 bp, Homo sapiens
attctgtctttcaaaag

SEQ ID NO: 6676562 - DNA, 20 bp, Homo sapiens
attctgtctttcaaaaggta

SEQ ID NO: 6676563 - DNA, 15 bp, Homo sapiens
attctgtgaagaatg

SEQ ID NO: 6676564 - DNA, 10 bp, Homo sapiens
attctgtgac

SEQ ID NO: 6676565 - DNA, 20 bp, Homo sapiens
attctgtgaccaaaatacct

SEQ ID NO: 6676566 - DNA, 23 bp, Homo sapiens
attctgtgcaggctgcagtggct

SEQ ID NO: 6676567 - DNA, 20 bp, Homo sapiens
attctgtgcataaaagttaa

SEQ ID NO: 6676568 - DNA, 22 bp, Homo sapiens
attctgtgcctccaggaccagg

SEQ ID NO: 6676569 - DNA, 22 bp, Homo sapiens
attctgtggctgccatcagaaa

SEQ ID NO: 6676570 - DNA, 13 bp, Homo sapiens
attctgtgggcag

SEQ ID NO: 6676571 - DNA, 17 bp, Homo sapiens
attctgtgggcagctgg

SEQ ID NO: 6676572 - DNA, 21 bp, Homo sapiens
attctgtgggcagctggctct

SEQ ID NO: 6676573 - DNA, 19 bp, Homo sapiens
attctgtggttctataata

SEQ ID NO: 6676574 - DNA, 22 bp, Homo sapiens
attctgtgtcagagcccagccc

SEQ ID NO: 6676575 - DNA, 17 bp, Homo sapiens
attctgtgtggtatatt

SEQ ID NO: 6676576 - DNA, 17 bp, Homo sapiens
attctgtgtgttttcat

SEQ ID NO: 6676577 - DNA, 23 bp, Homo sapiens
attctgtgtgttttcataataaa

SEQ ID NO: 6676578 - DNA, 11 bp, Homo sapiens
attctgtgttg

SEQ ID NO: 6676579 - DNA, 12 bp, Homo sapiens
attctgttaaaa

SEQ ID NO: 6676580 - DNA, 15 bp, Homo sapiens
attctgttaaaatct

SEQ ID NO: 6676581 - DNA, 22 bp, Homo sapiens
attctgttaaaatctattctgt

SEQ ID NO: 6676582 - DNA, 17 bp, Homo sapiens
attctgttagctgctca

SEQ ID NO: 6676583 - DNA, 19 bp, Homo sapiens
attctgttccctgggctga

SEQ ID NO: 6676584 - DNA, 17 bp, Homo sapiens
attctgttctaaaactc

SEQ ID NO: 6676585 - DNA, 13 bp, Homo sapiens
attctgttctgat

SEQ ID NO: 6676586 - DNA, 20 bp, Homo sapiens
attctgttgcatagactagt

SEQ ID NO: 6676587 - DNA, 20 bp, Homo sapiens
attctgttggagttccctca

SEQ ID NO: 6676588 - DNA, 15 bp, Homo sapiens
attctgttggccagc

SEQ ID NO: 6676589 - DNA, 21 bp, Homo sapiens
attctgttgttcagtcctctg

SEQ ID NO: 6676590 - DNA, 16 bp, Homo sapiens
attctgttgttccatt

SEQ ID NO: 6676591 - DNA, 17 bp, Homo sapiens
attctgttgttccattt

SEQ ID NO: 6676592 - DNA, 13 bp, Homo sapiens
attctgtttatta

SEQ ID NO: 6676593 - DNA, 20 bp, Homo sapiens
attctgtttattcttccaga

SEQ ID NO: 6676594 - DNA, 22 bp, Homo sapiens
attctgtttgcgtacttgtaat

SEQ ID NO: 6676595 - DNA, 19 bp, Homo sapiens
attctgttttcccccagca

SEQ ID NO: 6676596 - DNA, 19 bp, Homo sapiens
attctgttttgttaatata

SEQ ID NO: 6676597 - DNA, 19 bp, Homo sapiens
attctgtttttaaaaatta

SEQ ID NO: 6676598 - DNA, 14 bp, Homo sapiens
attcttaaaaattg

SEQ ID NO: 6676599 - DNA, 17 bp, Homo sapiens
attcttaaaaattgaat

SEQ ID NO: 6676600 - DNA, 23 bp, Homo sapiens
attcttaaaatatatttcagata

SEQ ID NO: 6676601 - DNA, 13 bp, Homo sapiens
attcttaaaatgc

SEQ ID NO: 6676602 - DNA, 17 bp, Homo sapiens
attcttaaaatgcaata

SEQ ID NO: 6676603 - DNA, 18 bp, Homo sapiens
attcttaaaatgcaatat

SEQ ID NO: 6676604 - DNA, 22 bp, Homo sapiens
attcttaaaattcaagaaaata

SEQ ID NO: 6676605 - DNA, 19 bp, Homo sapiens
attcttaaagtacttgtta

SEQ ID NO: 6676606 - DNA, 12 bp, Homo sapiens
attcttaaagtg

SEQ ID NO: 6676607 - DNA, 13 bp, Homo sapiens
attcttaaagttg

SEQ ID NO: 6676608 - DNA, 14 bp, Homo sapiens
attcttaaagttga

SEQ ID NO: 6676609 - DNA, 16 bp, Homo sapiens
attcttaaagttgaat

SEQ ID NO: 6676610 - DNA, 18 bp, Homo sapiens
attcttaaagttgaattt

SEQ ID NO: 6676611 - DNA, 17 bp, Homo sapiens
attcttaacaaactctt

SEQ ID NO: 6676612 - DNA, 20 bp, Homo sapiens
attcttaacacagccttcct

SEQ ID NO: 6676613 - DNA, 21 bp, Homo sapiens
attcttaacacagccttcctt

SEQ ID NO: 6676614 - DNA, 22 bp, Homo sapiens
attcttaacacagccttccttc

SEQ ID NO: 6676615 - DNA, 23 bp, Homo sapiens
attcttaacacagccttccttct

SEQ ID NO: 6676616 - DNA, 20 bp, Homo sapiens
attcttaagatttctcctga

SEQ ID NO: 6676617 - DNA, 20 bp, Homo sapiens
attcttaaggcaataaaact

SEQ ID NO: 6676618 - DNA, 17 bp, Homo sapiens
attcttaagtcttttgt

SEQ ID NO: 6676619 - DNA, 20 bp, Homo sapiens
attcttaatttggatctatt

SEQ ID NO: 6676620 - DNA, 21 bp, Homo sapiens
attcttaatttggatctattt

SEQ ID NO: 6676621 - DNA, 23 bp, Homo sapiens
attcttacactgcctgtatactt

SEQ ID NO: 6676622 - DNA, 16 bp, Homo sapiens
attcttacagccaagt

SEQ ID NO: 6676623 - DNA, 20 bp, Homo sapiens
attcttacatatgatccagt

SEQ ID NO: 6676624 - DNA, 17 bp, Homo sapiens
attcttaccctttcttt

SEQ ID NO: 6676625 - DNA, 19 bp, Homo sapiens
attcttaccgagaaaagga

SEQ ID NO: 6676626 - DNA, 16 bp, Homo sapiens
attcttactctggagc

SEQ ID NO: 6676627 - DNA, 16 bp, Homo sapiens
attcttactgttcttc

SEQ ID NO: 6676628 - DNA, 16 bp, Homo sapiens
attcttagtaaaatgc

SEQ ID NO: 6676629 - DNA, 15 bp, Homo sapiens
attcttagttaatct

SEQ ID NO: 6676630 - DNA, 17 bp, Homo sapiens
attcttagttaatcttt

SEQ ID NO: 6676631 - DNA, 20 bp, Homo sapiens
attcttataaatatgaagct

SEQ ID NO: 6676632 - DNA, 14 bp, Homo sapiens
attcttatatttta

SEQ ID NO: 6676633 - DNA, 15 bp, Homo sapiens
attcttatattttat

SEQ ID NO: 6676634 - DNA, 16 bp, Homo sapiens
attcttatgttccaga

SEQ ID NO: 6676635 - DNA, 14 bp, Homo sapiens
attcttatgttgaa

SEQ ID NO: 6676636 - DNA, 14 bp, Homo sapiens
attcttatttaatg

SEQ ID NO: 6676637 - DNA, 18 bp, Homo sapiens
attcttatttaatgaaag

SEQ ID NO: 6676638 - DNA, 17 bp, Homo sapiens
attcttatttcatgaaa

SEQ ID NO: 6676639 - DNA, 13 bp, Homo sapiens
attcttatttctg

SEQ ID NO: 6676640 - DNA, 14 bp, Homo sapiens
attcttatttctgt

SEQ ID NO: 6676641 - DNA, 16 bp, Homo sapiens
attcttattttttaaa

SEQ ID NO: 6676642 - DNA, 10 bp, Homo sapiens
attcttcaaa

SEQ ID NO: 6676643 - DNA, 20 bp, Homo sapiens
attcttcaagaaagaattcc

SEQ ID NO: 6676644 - DNA, 21 bp, Homo sapiens
attcttcaagagacccttcaa

SEQ ID NO: 6676645 - DNA, 15 bp, Homo sapiens
attcttcaatttgaa

SEQ ID NO: 6676646 - DNA, 15 bp, Homo sapiens
attcttcacatgtaa

SEQ ID NO: 6676647 - DNA, 17 bp, Homo sapiens
attcttcagatatactg

SEQ ID NO: 6676648 - DNA, 15 bp, Homo sapiens
attcttcagcaaaaa

SEQ ID NO: 6676649 - DNA, 20 bp, Homo sapiens
attcttcagcgtaaaatggt

SEQ ID NO: 6676650 - DNA, 13 bp, Homo sapiens
attcttcagtctg

SEQ ID NO: 6676651 - DNA, 20 bp, Homo sapiens
attcttcagttctctactcc

SEQ ID NO: 6676652 - DNA, 17 bp, Homo sapiens
attcttcagtttttcac

SEQ ID NO: 6676653 - DNA, 22 bp, Homo sapiens
attcttcatcagcatttaataa

SEQ ID NO: 6676654 - DNA, 14 bp, Homo sapiens
attcttcatgaaat

SEQ ID NO: 6676655 - DNA, 23 bp, Homo sapiens
attcttcattatagtaaatctat

SEQ ID NO: 6676656 - DNA, 15 bp, Homo sapiens
attcttcattctgta

SEQ ID NO: 6676657 - DNA, 12 bp, Homo sapiens
attcttcattta

SEQ ID NO: 6676658 - DNA, 18 bp, Homo sapiens
attcttccacctcagcct

SEQ ID NO: 6676659 - DNA, 13 bp, Homo sapiens
attcttccagaat

SEQ ID NO: 6676660 - DNA, 18 bp, Homo sapiens
attcttccagatgtgatg

SEQ ID NO: 6676661 - DNA, 20 bp, Homo sapiens
attcttccagtagttgaaca

SEQ ID NO: 6676662 - DNA, 19 bp, Homo sapiens
attcttccatcatcactgt

SEQ ID NO: 6676663 - DNA, 21 bp, Homo sapiens
attcttcccaacttgcctttg

SEQ ID NO: 6676664 - DNA, 23 bp, Homo sapiens
attcttcccaacttgcctttgaa

SEQ ID NO: 6676665 - DNA, 16 bp, Homo sapiens
attcttcccattctcc

SEQ ID NO: 6676666 - DNA, 17 bp, Homo sapiens
attcttcccattctcca

SEQ ID NO: 6676667 - DNA, 18 bp, Homo sapiens
attcttcccattctccat

SEQ ID NO: 6676668 - DNA, 15 bp, Homo sapiens
attcttccctggggg

SEQ ID NO: 6676669 - DNA, 20 bp, Homo sapiens
attcttcccttttaaacaca

SEQ ID NO: 6676670 - DNA, 22 bp, Homo sapiens
attcttcccttttaaacacatt

SEQ ID NO: 6676671 - DNA, 23 bp, Homo sapiens
attcttccgtcacatatacaaaa

SEQ ID NO: 6676672 - DNA, 17 bp, Homo sapiens
attcttcctagttttct

SEQ ID NO: 6676673 - DNA, 13 bp, Homo sapiens
attcttcctcctc

SEQ ID NO: 6676674 - DNA, 10 bp, Homo sapiens
attcttcctt

SEQ ID NO: 6676675 - DNA, 11 bp, Homo sapiens
attcttccttg

SEQ ID NO: 6676676 - DNA, 16 bp, Homo sapiens
attcttccttgccaca

SEQ ID NO: 6676677 - DNA, 12 bp, Homo sapiens
attcttcctttg

SEQ ID NO: 6676678 - DNA, 13 bp, Homo sapiens
attcttctagagt

SEQ ID NO: 6676679 - DNA, 14 bp, Homo sapiens
attcttctagagtt

SEQ ID NO: 6676680 - DNA, 21 bp, Homo sapiens
attcttctaggggtagctggt

SEQ ID NO: 6676681 - DNA, 22 bp, Homo sapiens
attcttctattaacaaattatt

SEQ ID NO: 6676682 - DNA, 20 bp, Homo sapiens
attcttctcctttgtcaaat

SEQ ID NO: 6676683 - DNA, 22 bp, Homo sapiens
attcttctcctttgtcaaatgg

SEQ ID NO: 6676684 - DNA, 23 bp, Homo sapiens
attcttctcctttgtcaaatggt

SEQ ID NO: 6676685 - DNA, 15 bp, Homo sapiens
attcttctctgttgt

SEQ ID NO: 6676686 - DNA, 16 bp, Homo sapiens
attcttctctgttgtc

SEQ ID NO: 6676687 - DNA, 15 bp, Homo sapiens
attcttctcttcctt

SEQ ID NO: 6676688 - DNA, 21 bp, Homo sapiens
attcttctcttccttttatca

SEQ ID NO: 6676689 - DNA, 21 bp, Homo sapiens
attcttctgaactcaaactga

SEQ ID NO: 6676690 - DNA, 20 bp, Homo sapiens
attcttctgaccatctagtg

SEQ ID NO: 6676691 - DNA, 13 bp, Homo sapiens
attcttctgcagt

SEQ ID NO: 6676692 - DNA, 13 bp, Homo sapiens
attcttctgtcct

SEQ ID NO: 6676693 - DNA, 11 bp, Homo sapiens
attcttcttaa

SEQ ID NO: 6676694 - DNA, 19 bp, Homo sapiens
attcttcttaaaagtttct

SEQ ID NO: 6676695 - DNA, 14 bp, Homo sapiens
attcttcttacatt

SEQ ID NO: 6676696 - DNA, 15 bp, Homo sapiens
attcttcttacatta

SEQ ID NO: 6676697 - DNA, 23 bp, Homo sapiens
attcttcttacattattaatcat

SEQ ID NO: 6676698 - DNA, 22 bp, Homo sapiens
attcttcttccaacgtggccca

SEQ ID NO: 6676699 - DNA, 19 bp, Homo sapiens
attcttcttcttttatgta

SEQ ID NO: 6676700 - DNA, 13 bp, Homo sapiens
attcttcttgaaa

SEQ ID NO: 6676701 - DNA, 21 bp, Homo sapiens
attcttcttgaaaataaaaaa

SEQ ID NO: 6676702 - DNA, 12 bp, Homo sapiens
attcttcttgct

SEQ ID NO: 6676703 - DNA, 20 bp, Homo sapiens
attcttgaaagaattttcct

SEQ ID NO: 6676704 - DNA, 18 bp, Homo sapiens
attcttgaacttgaaaaa

SEQ ID NO: 6676705 - DNA, 19 bp, Homo sapiens
attcttgaacttgaaaaaa

SEQ ID NO: 6676706 - DNA, 20 bp, Homo sapiens
attcttgaacttgaaaaaaa

SEQ ID NO: 6676707 - DNA, 18 bp, Homo sapiens
attcttgaaggaaaatga

SEQ ID NO: 6676708 - DNA, 13 bp, Homo sapiens
attcttgaataaa

SEQ ID NO: 6676709 - DNA, 21 bp, Homo sapiens
attcttgagttttgataaagt

SEQ ID NO: 6676710 - DNA, 22 bp, Homo sapiens
attcttgatcagtagtttgcat

SEQ ID NO: 6676711 - DNA, 15 bp, Homo sapiens
attcttgatctctaa

SEQ ID NO: 6676712 - DNA, 10 bp, Homo sapiens
attcttgatg

SEQ ID NO: 6676713 - DNA, 14 bp, Homo sapiens
attcttgatgaaaa

SEQ ID NO: 6676714 - DNA, 18 bp, Homo sapiens
attcttgatgaaaagctt

SEQ ID NO: 6676715 - DNA, 21 bp, Homo sapiens
attcttgatgaaaagctttgt

SEQ ID NO: 6676716 - DNA, 12 bp, Homo sapiens
attcttgatgta

SEQ ID NO: 6676717 - DNA, 17 bp, Homo sapiens
attcttgatgtaaaatc

SEQ ID NO: 6676718 - DNA, 20 bp, Homo sapiens
attcttgatgtaaaatcttg

SEQ ID NO: 6676719 - DNA, 19 bp, Homo sapiens
attcttgatttatttgctt

SEQ ID NO: 6676720 - DNA, 21 bp, Homo sapiens
attcttgatttatttgcttct

SEQ ID NO: 6676721 - DNA, 22 bp, Homo sapiens
attcttgattttcaagctttca

SEQ ID NO: 6676722 - DNA, 14 bp, Homo sapiens
attcttgcaaagta

SEQ ID NO: 6676723 - DNA, 15 bp, Homo sapiens
attcttgcaaagtat

SEQ ID NO: 6676724 - DNA, 12 bp, Homo sapiens
attcttgcactg

SEQ ID NO: 6676725 - DNA, 17 bp, Homo sapiens
attcttgccaaatataa

SEQ ID NO: 6676726 - DNA, 12 bp, Homo sapiens
attcttgctggg

SEQ ID NO: 6676727 - DNA, 16 bp, Homo sapiens
attcttgcttgaggaa

SEQ ID NO: 6676728 - DNA, 19 bp, Homo sapiens
attcttggcatctactctg

SEQ ID NO: 6676729 - DNA, 16 bp, Homo sapiens
attcttgggaaacacc

SEQ ID NO: 6676730 - DNA, 22 bp, Homo sapiens
attcttggtcaagtttttctct

SEQ ID NO: 6676731 - DNA, 13 bp, Homo sapiens
attcttggttatt

SEQ ID NO: 6676732 - DNA, 19 bp, Homo sapiens
attcttggttattctgcca

SEQ ID NO: 6676733 - DNA, 20 bp, Homo sapiens
attcttggttattctgccat

SEQ ID NO: 6676734 - DNA, 18 bp, Homo sapiens
attcttggttgaggaaac

SEQ ID NO: 6676735 - DNA, 19 bp, Homo sapiens
attcttggttgttaattta

SEQ ID NO: 6676736 - DNA, 13 bp, Homo sapiens
attcttgtacagt

SEQ ID NO: 6676737 - DNA, 12 bp, Homo sapiens
attcttgtatat

SEQ ID NO: 6676738 - DNA, 17 bp, Homo sapiens
attcttgtccacattct

SEQ ID NO: 6676739 - DNA, 19 bp, Homo sapiens
attcttgtgaatatgtaca

SEQ ID NO: 6676740 - DNA, 19 bp, Homo sapiens
attcttgtgcctcggcctc

SEQ ID NO: 6676741 - DNA, 21 bp, Homo sapiens
attcttgtgcctcggcctccc

SEQ ID NO: 6676742 - DNA, 22 bp, Homo sapiens
attcttgtgggagacagcagcc

SEQ ID NO: 6676743 - DNA, 14 bp, Homo sapiens
attcttgtggttaa

SEQ ID NO: 6676744 - DNA, 15 bp, Homo sapiens
attcttgtggttaaa

SEQ ID NO: 6676745 - DNA, 16 bp, Homo sapiens
attcttgtggttaaaa

SEQ ID NO: 6676746 - DNA, 14 bp, Homo sapiens
attcttgtttgaat

SEQ ID NO: 6676747 - DNA, 17 bp, Homo sapiens
attcttgttttacattt

SEQ ID NO: 6676748 - DNA, 18 bp, Homo sapiens
attcttgttttctttctt

SEQ ID NO: 6676749 - DNA, 21 bp, Homo sapiens
attcttgttttctttctttaa

SEQ ID NO: 6676750 - DNA, 19 bp, Homo sapiens
attctttaaacaaatatga

SEQ ID NO: 6676751 - DNA, 20 bp, Homo sapiens
attctttaaacaaatatgaa

SEQ ID NO: 6676752 - DNA, 19 bp, Homo sapiens
attctttaaatatatatta

SEQ ID NO: 6676753 - DNA, 17 bp, Homo sapiens
attctttaaatttcatc

SEQ ID NO: 6676754 - DNA, 20 bp, Homo sapiens
attctttacaaactgaagat

SEQ ID NO: 6676755 - DNA, 22 bp, Homo sapiens
attctttagagattataacaaa

SEQ ID NO: 6676756 - DNA, 23 bp, Homo sapiens
attctttagatttttaaattgga

SEQ ID NO: 6676757 - DNA, 18 bp, Homo sapiens
attctttagcttacctgg

SEQ ID NO: 6676758 - DNA, 16 bp, Homo sapiens
attctttagtactcaa

SEQ ID NO: 6676759 - DNA, 17 bp, Homo sapiens
attctttagtctacata

SEQ ID NO: 6676760 - DNA, 17 bp, Homo sapiens
attctttataaaatgta

SEQ ID NO: 6676761 - DNA, 22 bp, Homo sapiens
attctttataaaatgtataaat

SEQ ID NO: 6676762 - DNA, 21 bp, Homo sapiens
attctttataatcctctgtaa

SEQ ID NO: 6676763 - DNA, 16 bp, Homo sapiens
attctttataattgaa

SEQ ID NO: 6676764 - DNA, 23 bp, Homo sapiens
attctttatacaacagtgctaaa

SEQ ID NO: 6676765 - DNA, 14 bp, Homo sapiens
attctttatagtga

SEQ ID NO: 6676766 - DNA, 22 bp, Homo sapiens
attctttatatatggacagctt

SEQ ID NO: 6676767 - DNA, 22 bp, Homo sapiens
attctttatcccattttatcat

SEQ ID NO: 6676768 - DNA, 17 bp, Homo sapiens
attctttatcttgacat

SEQ ID NO: 6676769 - DNA, 21 bp, Homo sapiens
attctttattatttttctctc

SEQ ID NO: 6676770 - DNA, 13 bp, Homo sapiens
attctttattctt

SEQ ID NO: 6676771 - DNA, 20 bp, Homo sapiens
attctttatttatttatatt

SEQ ID NO: 6676772 - DNA, 19 bp, Homo sapiens
attctttcaactgggtttt

SEQ ID NO: 6676773 - DNA, 20 bp, Homo sapiens
attctttcaatacagatata

SEQ ID NO: 6676774 - DNA, 18 bp, Homo sapiens
attctttcaatccacagt

SEQ ID NO: 6676775 - DNA, 12 bp, Homo sapiens
attctttcactt

SEQ ID NO: 6676776 - DNA, 15 bp, Homo sapiens
attctttcacttgat

SEQ ID NO: 6676777 - DNA, 17 bp, Homo sapiens
attctttcacttgatgt

SEQ ID NO: 6676778 - DNA, 22 bp, Homo sapiens
attctttcacttgatgtttgtt

SEQ ID NO: 6676779 - DNA, 13 bp, Homo sapiens
attctttcagatt

SEQ ID NO: 6676780 - DNA, 13 bp, Homo sapiens
attctttccatga

SEQ ID NO: 6676781 - DNA, 15 bp, Homo sapiens
attctttccatgcag

SEQ ID NO: 6676782 - DNA, 16 bp, Homo sapiens
attctttcccaacacc

SEQ ID NO: 6676783 - DNA, 19 bp, Homo sapiens
attctttcccaacacctct

SEQ ID NO: 6676784 - DNA, 19 bp, Homo sapiens
attctttcccagtctgtcg

SEQ ID NO: 6676785 - DNA, 14 bp, Homo sapiens
attctttccccaga

SEQ ID NO: 6676786 - DNA, 21 bp, Homo sapiens
attctttcccctcagagctct

SEQ ID NO: 6676787 - DNA, 14 bp, Homo sapiens
attctttcctacct

SEQ ID NO: 6676788 - DNA, 12 bp, Homo sapiens
attctttccttc

SEQ ID NO: 6676789 - DNA, 13 bp, Homo sapiens
attctttctgcta

SEQ ID NO: 6676790 - DNA, 15 bp, Homo sapiens
attctttctgtctcc

SEQ ID NO: 6676791 - DNA, 23 bp, Homo sapiens
attctttctgtctcccttctctc

SEQ ID NO: 6676792 - DNA, 13 bp, Homo sapiens
attctttcttcct

SEQ ID NO: 6676793 - DNA, 15 bp, Homo sapiens
attctttcttcctcc

SEQ ID NO: 6676794 - DNA, 14 bp, Homo sapiens
attctttgaaaaca

SEQ ID NO: 6676795 - DNA, 19 bp, Homo sapiens
attctttgacctgttggga

SEQ ID NO: 6676796 - DNA, 13 bp, Homo sapiens
attctttgagaag

SEQ ID NO: 6676797 - DNA, 18 bp, Homo sapiens
attctttgatatgttgat

SEQ ID NO: 6676798 - DNA, 13 bp, Homo sapiens
attctttgatgtt

SEQ ID NO: 6676799 - DNA, 15 bp, Homo sapiens
attctttgatgttaa

SEQ ID NO: 6676800 - DNA, 17 bp, Homo sapiens
attctttgatgttaaca

SEQ ID NO: 6676801 - DNA, 18 bp, Homo sapiens
attctttgatgttaacac

SEQ ID NO: 6676802 - DNA, 19 bp, Homo sapiens
attctttgatgttaacaca

SEQ ID NO: 6676803 - DNA, 20 bp, Homo sapiens
attctttgatgttaacacat

SEQ ID NO: 6676804 - DNA, 22 bp, Homo sapiens
attctttgatgttaacacattt

SEQ ID NO: 6676805 - DNA, 17 bp, Homo sapiens
attctttgcaatactgc

SEQ ID NO: 6676806 - DNA, 19 bp, Homo sapiens
attctttgcaatactgctt

SEQ ID NO: 6676807 - DNA, 13 bp, Homo sapiens
attctttgcattc

SEQ ID NO: 6676808 - DNA, 19 bp, Homo sapiens
attctttgcttgaacacag

SEQ ID NO: 6676809 - DNA, 20 bp, Homo sapiens
attctttgcttgaacacagt

SEQ ID NO: 6676810 - DNA, 13 bp, Homo sapiens
attctttggtaat

SEQ ID NO: 6676811 - DNA, 15 bp, Homo sapiens
attctttggtaattt

SEQ ID NO: 6676812 - DNA, 17 bp, Homo sapiens
attctttggttgtgaat

SEQ ID NO: 6676813 - DNA, 14 bp, Homo sapiens
attctttgtatctt

SEQ ID NO: 6676814 - DNA, 16 bp, Homo sapiens
attctttgtatcttaa

SEQ ID NO: 6676815 - DNA, 18 bp, Homo sapiens
attctttgtatcttaaat

SEQ ID NO: 6676816 - DNA, 13 bp, Homo sapiens
attctttgttctg

SEQ ID NO: 6676817 - DNA, 13 bp, Homo sapiens
attctttgtttcc

SEQ ID NO: 6676818 - DNA, 18 bp, Homo sapiens
attctttgtttcctcttt

SEQ ID NO: 6676819 - DNA, 18 bp, Homo sapiens
attcttttaaaagacaag

SEQ ID NO: 6676820 - DNA, 23 bp, Homo sapiens
attcttttaaatgggtgaaaaat

SEQ ID NO: 6676821 - DNA, 19 bp, Homo sapiens
attcttttaaattagaaaa

SEQ ID NO: 6676822 - DNA, 17 bp, Homo sapiens
attcttttaacttcttt

SEQ ID NO: 6676823 - DNA, 13 bp, Homo sapiens
attcttttatata

SEQ ID NO: 6676824 - DNA, 16 bp, Homo sapiens
attcttttatataact

SEQ ID NO: 6676825 - DNA, 23 bp, Homo sapiens
attcttttatataactacattaa

SEQ ID NO: 6676826 - DNA, 14 bp, Homo sapiens
attcttttcaaaat

SEQ ID NO: 6676827 - DNA, 16 bp, Homo sapiens
attcttttcaaaattg

SEQ ID NO: 6676828 - DNA, 23 bp, Homo sapiens
attcttttcagcttgtttctata

SEQ ID NO: 6676829 - DNA, 17 bp, Homo sapiens
attcttttcatcaaaaa

SEQ ID NO: 6676830 - DNA, 14 bp, Homo sapiens
attcttttgaaaga

SEQ ID NO: 6676831 - DNA, 22 bp, Homo sapiens
attcttttgaaagatggtaatc

SEQ ID NO: 6676832 - DNA, 15 bp, Homo sapiens
attcttttgaattgt

SEQ ID NO: 6676833 - DNA, 16 bp, Homo sapiens
attcttttgaattgtt

SEQ ID NO: 6676834 - DNA, 21 bp, Homo sapiens
attcttttgatcacattgttt

SEQ ID NO: 6676835 - DNA, 12 bp, Homo sapiens
attcttttgcca

SEQ ID NO: 6676836 - DNA, 18 bp, Homo sapiens
attcttttggctttgaaa

SEQ ID NO: 6676837 - DNA, 17 bp, Homo sapiens
attcttttgtaatttaa

SEQ ID NO: 6676838 - DNA, 14 bp, Homo sapiens
attcttttgttatt

SEQ ID NO: 6676839 - DNA, 16 bp, Homo sapiens
attcttttgttattaa

SEQ ID NO: 6676840 - DNA, 19 bp, Homo sapiens
attcttttgttattaaaaa

SEQ ID NO: 6676841 - DNA, 17 bp, Homo sapiens
attcttttgtttccatg

SEQ ID NO: 6676842 - DNA, 14 bp, Homo sapiens
attctttttaaagt

SEQ ID NO: 6676843 - DNA, 22 bp, Homo sapiens
attctttttcttttttaaatta

SEQ ID NO: 6676844 - DNA, 16 bp, Homo sapiens
attctttttgaaatgt

SEQ ID NO: 6676845 - DNA, 15 bp, Homo sapiens
attctttttgctcta

SEQ ID NO: 6676846 - DNA, 21 bp, Homo sapiens
attctttttgctctaaaatat

SEQ ID NO: 6676847 - DNA, 15 bp, Homo sapiens
attcttttttattaa

SEQ ID NO: 6676848 - DNA, 16 bp, Homo sapiens
attcttttttattaat

SEQ ID NO: 6676849 - DNA, 17 bp, Homo sapiens
attcttttttattaatc

SEQ ID NO: 6676850 - DNA, 21 bp, Homo sapiens
attcttttttattaatcactg

SEQ ID NO: 6676851 - DNA, 17 bp, Homo sapiens
attcttttttcaatgta

SEQ ID NO: 6676852 - DNA, 19 bp, Homo sapiens
attcttttttcaatgtact

SEQ ID NO: 6676853 - DNA, 21 bp, Homo sapiens
attcttttttcaatgtactgt

SEQ ID NO: 6676854 - DNA, 18 bp, Homo sapiens
attgaaaaaaaaaatgtt

SEQ ID NO: 6676855 - DNA, 22 bp, Homo sapiens
attgaaaaaaattggcattaaa

SEQ ID NO: 6676856 - DNA, 13 bp, Homo sapiens
attgaaaaaagag

SEQ ID NO: 6676857 - DNA, 19 bp, Homo sapiens
attgaaaaaagagaaaggg

SEQ ID NO: 6676858 - DNA, 12 bp, Homo sapiens
attgaaaaaagt

SEQ ID NO: 6676859 - DNA, 17 bp, Homo sapiens
attgaaaaaagtggaaa

SEQ ID NO: 6676860 - DNA, 19 bp, Homo sapiens
attgaaaaaatagagcctg

SEQ ID NO: 6676861 - DNA, 19 bp, Homo sapiens
attgaaaaaatattgttta

SEQ ID NO: 6676862 - DNA, 15 bp, Homo sapiens
attgaaaaatttcta

SEQ ID NO: 6676863 - DNA, 16 bp, Homo sapiens
attgaaaacaaagaca

SEQ ID NO: 6676864 - DNA, 13 bp, Homo sapiens
attgaaaacacac

SEQ ID NO: 6676865 - DNA, 18 bp, Homo sapiens
attgaaaacacttagtat

SEQ ID NO: 6676866 - DNA, 14 bp, Homo sapiens
attgaaaacagata

SEQ ID NO: 6676867 - DNA, 14 bp, Homo sapiens
attgaaaacagtgt

SEQ ID NO: 6676868 - DNA, 13 bp, Homo sapiens
attgaaaacttca

SEQ ID NO: 6676869 - DNA, 18 bp, Homo sapiens
attgaaaacttttctcag

SEQ ID NO: 6676870 - DNA, 13 bp, Homo sapiens
attgaaaagaaaa

SEQ ID NO: 6676871 - DNA, 15 bp, Homo sapiens
attgaaaagaagaaa

SEQ ID NO: 6676872 - DNA, 22 bp, Homo sapiens
attgaaaagaagaaagtctatg

SEQ ID NO: 6676873 - DNA, 21 bp, Homo sapiens
attgaaaagattttaacaagt

SEQ ID NO: 6676874 - DNA, 15 bp, Homo sapiens
attgaaaaggaagat

SEQ ID NO: 6676875 - DNA, 12 bp, Homo sapiens
attgaaaaggac

SEQ ID NO: 6676876 - DNA, 19 bp, Homo sapiens
attgaaaagtttttgtttg

SEQ ID NO: 6676877 - DNA, 20 bp, Homo sapiens
attgaaaagtttttgtttgg

SEQ ID NO: 6676878 - DNA, 23 bp, Homo sapiens
attgaaaagtttttgtttggaga

SEQ ID NO: 6676879 - DNA, 21 bp, Homo sapiens
attgaaaatagtaaatgcttt

SEQ ID NO: 6676880 - DNA, 17 bp, Homo sapiens
attgaaaatatatatta

SEQ ID NO: 6676881 - DNA, 13 bp, Homo sapiens
attgaaaatcata

SEQ ID NO: 6676882 - DNA, 19 bp, Homo sapiens
attgaaaatggtattaaag

SEQ ID NO: 6676883 - DNA, 15 bp, Homo sapiens
attgaaaatgtcact

SEQ ID NO: 6676884 - DNA, 16 bp, Homo sapiens
attgaaaatgtcactg

SEQ ID NO: 6676885 - DNA, 19 bp, Homo sapiens
attgaaaatgtcactgtta

SEQ ID NO: 6676886 - DNA, 20 bp, Homo sapiens
attgaaaattaaggaaatgt

SEQ ID NO: 6676887 - DNA, 18 bp, Homo sapiens
attgaaaattgaaaagta

SEQ ID NO: 6676888 - DNA, 15 bp, Homo sapiens
attgaaacacagagt

SEQ ID NO: 6676889 - DNA, 13 bp, Homo sapiens
attgaaacatgaa

SEQ ID NO: 6676890 - DNA, 17 bp, Homo sapiens
attgaaactagttattt

SEQ ID NO: 6676891 - DNA, 14 bp, Homo sapiens
attgaaactgtatt

SEQ ID NO: 6676892 - DNA, 20 bp, Homo sapiens
attgaaactgtatttacttg

SEQ ID NO: 6676893 - DNA, 15 bp, Homo sapiens
attgaaagaaaaaaa

SEQ ID NO: 6676894 - DNA, 23 bp, Homo sapiens
attgaaagaaaaaaaaatactta

SEQ ID NO: 6676895 - DNA, 14 bp, Homo sapiens
attgaaagaatgta

SEQ ID NO: 6676896 - DNA, 20 bp, Homo sapiens
attgaaagcactatgaattt

SEQ ID NO: 6676897 - DNA, 23 bp, Homo sapiens
attgaaagccaacaactctgcct

SEQ ID NO: 6676898 - DNA, 20 bp, Homo sapiens
attgaaagcttcaaagttta

SEQ ID NO: 6676899 - DNA, 20 bp, Homo sapiens
attgaaagcttttaaaatgt

SEQ ID NO: 6676900 - DNA, 21 bp, Homo sapiens
attgaaaggacctcttctgaa

SEQ ID NO: 6676901 - DNA, 15 bp, Homo sapiens
attgaaagtaaaaaa

SEQ ID NO: 6676902 - DNA, 16 bp, Homo sapiens
attgaaagtaaaaaat

SEQ ID NO: 6676903 - DNA, 12 bp, Homo sapiens
attgaaagtatt

SEQ ID NO: 6676904 - DNA, 14 bp, Homo sapiens
attgaaagtattca

SEQ ID NO: 6676905 - DNA, 16 bp, Homo sapiens
attgaaagtattcaga

SEQ ID NO: 6676906 - DNA, 22 bp, Homo sapiens
attgaaagttgcttttattgca

SEQ ID NO: 6676907 - DNA, 22 bp, Homo sapiens
attgaaagtttttaatatttat

SEQ ID NO: 6676908 - DNA, 17 bp, Homo sapiens
attgaaataaggaggga

SEQ ID NO: 6676909 - DNA, 21 bp, Homo sapiens
attgaaatagtttccaagaaa

SEQ ID NO: 6676910 - DNA, 16 bp, Homo sapiens
attgaaatattataga

SEQ ID NO: 6676911 - DNA, 17 bp, Homo sapiens
attgaaatctaggaaaa

SEQ ID NO: 6676912 - DNA, 17 bp, Homo sapiens
attgaaatctttttgct

SEQ ID NO: 6676913 - DNA, 20 bp, Homo sapiens
attgaaatctttttgctttg

SEQ ID NO: 6676914 - DNA, 14 bp, Homo sapiens
attgaaatgctgta

SEQ ID NO: 6676915 - DNA, 22 bp, Homo sapiens
attgaaatggggcgctggacac

SEQ ID NO: 6676916 - DNA, 15 bp, Homo sapiens
attgaaattaacttt

SEQ ID NO: 6676917 - DNA, 16 bp, Homo sapiens
attgaaattaactttt

SEQ ID NO: 6676918 - DNA, 16 bp, Homo sapiens
attgaaattactgaaa

SEQ ID NO: 6676919 - DNA, 12 bp, Homo sapiens
attgaaattata

SEQ ID NO: 6676920 - DNA, 16 bp, Homo sapiens
attgaaattgtacata

SEQ ID NO: 6676921 - DNA, 20 bp, Homo sapiens
attgaaatttaaaaataaag

SEQ ID NO: 6676922 - DNA, 17 bp, Homo sapiens
attgaaatttactgtga

SEQ ID NO: 6676923 - DNA, 20 bp, Homo sapiens
attgaaatttttctctttaa

SEQ ID NO: 6676924 - DNA, 17 bp, Homo sapiens
attgaacacaggcaaag

SEQ ID NO: 6676925 - DNA, 18 bp, Homo sapiens
attgaacattttatcatt

SEQ ID NO: 6676926 - DNA, 21 bp, Homo sapiens
attgaaccaagggatcctccc

SEQ ID NO: 6676927 - DNA, 14 bp, Homo sapiens
attgaacccaggag

SEQ ID NO: 6676928 - DNA, 16 bp, Homo sapiens
attgaaccgtcaatgt

SEQ ID NO: 6676929 - DNA, 12 bp, Homo sapiens
attgaacctggt

SEQ ID NO: 6676930 - DNA, 23 bp, Homo sapiens
attgaacctttgtgccctatcac

SEQ ID NO: 6676931 - DNA, 22 bp, Homo sapiens
attgaacttccaggaaagtgtg

SEQ ID NO: 6676932 - DNA, 20 bp, Homo sapiens
attgaacttttgtactgaat

SEQ ID NO: 6676933 - DNA, 14 bp, Homo sapiens
attgaagaaacaga

SEQ ID NO: 6676934 - DNA, 15 bp, Homo sapiens
attgaagaaacagat

SEQ ID NO: 6676935 - DNA, 15 bp, Homo sapiens
attgaagaactgcac

SEQ ID NO: 6676936 - DNA, 13 bp, Homo sapiens
attgaagaagaat

SEQ ID NO: 6676937 - DNA, 15 bp, Homo sapiens
attgaagaatctgcc

SEQ ID NO: 6676938 - DNA, 17 bp, Homo sapiens
attgaagaatctgcccc

SEQ ID NO: 6676939 - DNA, 19 bp, Homo sapiens
attgaagacaatttgatac

SEQ ID NO: 6676940 - DNA, 13 bp, Homo sapiens
attgaagagaact

SEQ ID NO: 6676941 - DNA, 16 bp, Homo sapiens
attgaagagttgagga

SEQ ID NO: 6676942 - DNA, 20 bp, Homo sapiens
attgaagatgctgcctgtat

SEQ ID NO: 6676943 - DNA, 20 bp, Homo sapiens
attgaagcaactacaacttc

SEQ ID NO: 6676944 - DNA, 13 bp, Homo sapiens
attgaagcagagt

SEQ ID NO: 6676945 - DNA, 15 bp, Homo sapiens
attgaagcagagtgg

SEQ ID NO: 6676946 - DNA, 14 bp, Homo sapiens
attgaagcatgaac

SEQ ID NO: 6676947 - DNA, 18 bp, Homo sapiens
attgaagccgactctggc

SEQ ID NO: 6676948 - DNA, 22 bp, Homo sapiens
attgaagctcgtgacaagtgcc

SEQ ID NO: 6676949 - DNA, 21 bp, Homo sapiens
attgaagctttactttagaat

SEQ ID NO: 6676950 - DNA, 12 bp, Homo sapiens
attgaaggaaag

SEQ ID NO: 6676951 - DNA, 15 bp, Homo sapiens
attgaaggaaagatt

SEQ ID NO: 6676952 - DNA, 19 bp, Homo sapiens
attgaaggaagccaaattt

SEQ ID NO: 6676953 - DNA, 19 bp, Homo sapiens
attgaaggagaaaatgcat

SEQ ID NO: 6676954 - DNA, 13 bp, Homo sapiens
attgaaggcctgg

SEQ ID NO: 6676955 - DNA, 19 bp, Homo sapiens
attgaaggcttaaacccat

SEQ ID NO: 6676956 - DNA, 22 bp, Homo sapiens
attgaaggcttaattgactgaa

SEQ ID NO: 6676957 - DNA, 17 bp, Homo sapiens
attgaaggggcttctaa

SEQ ID NO: 6676958 - DNA, 19 bp, Homo sapiens
attgaaggggcttctaatg

SEQ ID NO: 6676959 - DNA, 20 bp, Homo sapiens
attgaaggggcttctaatga

SEQ ID NO: 6676960 - DNA, 21 bp, Homo sapiens
attgaaggggcttctaatgac

SEQ ID NO: 6676961 - DNA, 22 bp, Homo sapiens
attgaaggtgataagggaaaag

SEQ ID NO: 6676962 - DNA, 19 bp, Homo sapiens
attgaaggtttttgatagc

SEQ ID NO: 6676963 - DNA, 20 bp, Homo sapiens
attgaaggtttttgatagca

SEQ ID NO: 6676964 - DNA, 15 bp, Homo sapiens
attgaagtaaaatgt

SEQ ID NO: 6676965 - DNA, 15 bp, Homo sapiens
attgaagtaatgaat

SEQ ID NO: 6676966 - DNA, 18 bp, Homo sapiens
attgaagtatctgtacct

SEQ ID NO: 6676967 - DNA, 20 bp, Homo sapiens
attgaagtcaattactctat

SEQ ID NO: 6676968 - DNA, 18 bp, Homo sapiens
attgaagtcagatgtggt

SEQ ID NO: 6676969 - DNA, 20 bp, Homo sapiens
attgaagtcttcttatctaa

SEQ ID NO: 6676970 - DNA, 17 bp, Homo sapiens
attgaagtgtcttctgt

SEQ ID NO: 6676971 - DNA, 17 bp, Homo sapiens
attgaagttgtttatca

SEQ ID NO: 6676972 - DNA, 13 bp, Homo sapiens
attgaagtttcaa

SEQ ID NO: 6676973 - DNA, 19 bp, Homo sapiens
attgaataaagttgaagct

SEQ ID NO: 6676974 - DNA, 17 bp, Homo sapiens
attgaataagtattctt

SEQ ID NO: 6676975 - DNA, 19 bp, Homo sapiens
attgaataagtattcttca

SEQ ID NO: 6676976 - DNA, 14 bp, Homo sapiens
attgaatactgtct

SEQ ID NO: 6676977 - DNA, 15 bp, Homo sapiens
attgaatacttacat

SEQ ID NO: 6676978 - DNA, 16 bp, Homo sapiens
attgaatacttacatt

SEQ ID NO: 6676979 - DNA, 13 bp, Homo sapiens
attgaatactttg

SEQ ID NO: 6676980 - DNA, 14 bp, Homo sapiens
attgaatactttga

SEQ ID NO: 6676981 - DNA, 20 bp, Homo sapiens
attgaatactttgaatgtgt

SEQ ID NO: 6676982 - DNA, 19 bp, Homo sapiens
attgaataggcattaaatg

SEQ ID NO: 6676983 - DNA, 18 bp, Homo sapiens
attgaatagtttatttct

SEQ ID NO: 6676984 - DNA, 20 bp, Homo sapiens
attgaatagtttatttctgt

SEQ ID NO: 6676985 - DNA, 22 bp, Homo sapiens
attgaatagtttatttctgtga

SEQ ID NO: 6676986 - DNA, 15 bp, Homo sapiens
attgaatatatcaga

SEQ ID NO: 6676987 - DNA, 21 bp, Homo sapiens
attgaatatatcagaatctgt

SEQ ID NO: 6676988 - DNA, 13 bp, Homo sapiens
attgaatattgtg

SEQ ID NO: 6676989 - DNA, 20 bp, Homo sapiens
attgaatcatgtagtatcaa

SEQ ID NO: 6676990 - DNA, 10 bp, Homo sapiens
attgaatcta

SEQ ID NO: 6676991 - DNA, 19 bp, Homo sapiens
attgaatctacaaaagtga

SEQ ID NO: 6676992 - DNA, 18 bp, Homo sapiens
attgaatctatttaagta

SEQ ID NO: 6676993 - DNA, 20 bp, Homo sapiens
attgaatgccttatttttga

SEQ ID NO: 6676994 - DNA, 21 bp, Homo sapiens
attgaatgccttatttttgaa

SEQ ID NO: 6676995 - DNA, 21 bp, Homo sapiens
attgaatggctatgtttttaa

SEQ ID NO: 6676996 - DNA, 20 bp, Homo sapiens
attgaatgtaccttatttaa

SEQ ID NO: 6676997 - DNA, 16 bp, Homo sapiens
attgaatgtgaaacat

SEQ ID NO: 6676998 - DNA, 16 bp, Homo sapiens
attgaatgtttccaac

SEQ ID NO: 6676999 - DNA, 14 bp, Homo sapiens
attgaattaaatcc

SEQ ID NO: 6677000 - DNA, 16 bp, Homo sapiens
attgaattagaaaatt

SEQ ID NO: 6677001 - DNA, 23 bp, Homo sapiens
attgaattattgggcttaatata

SEQ ID NO: 6677002 - DNA, 22 bp, Homo sapiens
attgaattattttgttactgtc

SEQ ID NO: 6677003 - DNA, 14 bp, Homo sapiens
attgaattcattat

SEQ ID NO: 6677004 - DNA, 17 bp, Homo sapiens
attgaattcatttcact

SEQ ID NO: 6677005 - DNA, 19 bp, Homo sapiens
attgaattcgtttctgaca

SEQ ID NO: 6677006 - DNA, 24 bp, Homo sapiens
attgaattcttcacatgtaacttt

SEQ ID NO: 6677007 - DNA, 18 bp, Homo sapiens
attgaattgggggagtca

SEQ ID NO: 6677008 - DNA, 20 bp, Homo sapiens
attgaattttcaagcatctc

SEQ ID NO: 6677009 - DNA, 20 bp, Homo sapiens
attgaatttttatttttgaa

SEQ ID NO: 6677010 - DNA, 17 bp, Homo sapiens
attgaatttttcctatg

SEQ ID NO: 6677011 - DNA, 15 bp, Homo sapiens
attgacaaaatgtta

SEQ ID NO: 6677012 - DNA, 21 bp, Homo sapiens
attgacaaacccggaagatca

SEQ ID NO: 6677013 - DNA, 16 bp, Homo sapiens
attgacaacattttat

SEQ ID NO: 6677014 - DNA, 16 bp, Homo sapiens
attgacaactgaagag

SEQ ID NO: 6677015 - DNA, 22 bp, Homo sapiens
attgacaagctaggaaagagga

SEQ ID NO: 6677016 - DNA, 15 bp, Homo sapiens
attgacaagtgtctt

SEQ ID NO: 6677017 - DNA, 16 bp, Homo sapiens
attgacaataaaatat

SEQ ID NO: 6677018 - DNA, 17 bp, Homo sapiens
attgacaataaaatatt

SEQ ID NO: 6677019 - DNA, 18 bp, Homo sapiens
attgacaataaaatatta

SEQ ID NO: 6677020 - DNA, 20 bp, Homo sapiens
attgacaataaaatattatt

SEQ ID NO: 6677021 - DNA, 15 bp, Homo sapiens
attgacaatgacaaa

SEQ ID NO: 6677022 - DNA, 16 bp, Homo sapiens
attgacacacagcact

SEQ ID NO: 6677023 - DNA, 20 bp, Homo sapiens
attgacacacagcactctct

SEQ ID NO: 6677024 - DNA, 14 bp, Homo sapiens
attgacacagaaaa

SEQ ID NO: 6677025 - DNA, 17 bp, Homo sapiens
attgacaccaaaatgaa

SEQ ID NO: 6677026 - DNA, 14 bp, Homo sapiens
attgacactgaact

SEQ ID NO: 6677027 - DNA, 19 bp, Homo sapiens
attgacacttaaaaatggt

SEQ ID NO: 6677028 - DNA, 18 bp, Homo sapiens
attgacagatcaagctgt

SEQ ID NO: 6677029 - DNA, 21 bp, Homo sapiens
attgacagatcaagctgtgag

SEQ ID NO: 6677030 - DNA, 12 bp, Homo sapiens
attgacagcaat

SEQ ID NO: 6677031 - DNA, 16 bp, Homo sapiens
attgacagcaattcat

SEQ ID NO: 6677032 - DNA, 22 bp, Homo sapiens
attgacagcaattcatggttca

SEQ ID NO: 6677033 - DNA, 16 bp, Homo sapiens
attgacagcatataga

SEQ ID NO: 6677034 - DNA, 18 bp, Homo sapiens
attgacagcatatagaat

SEQ ID NO: 6677035 - DNA, 20 bp, Homo sapiens
attgacagcatatagaatat

SEQ ID NO: 6677036 - DNA, 19 bp, Homo sapiens
attgacagctttgctgctg

SEQ ID NO: 6677037 - DNA, 18 bp, Homo sapiens
attgacaggtcttttcaa

SEQ ID NO: 6677038 - DNA, 20 bp, Homo sapiens
attgacaggtcttttcaaat

SEQ ID NO: 6677039 - DNA, 16 bp, Homo sapiens
attgacagttgaacag

SEQ ID NO: 6677040 - DNA, 18 bp, Homo sapiens
attgacatcagcatcacc

SEQ ID NO: 6677041 - DNA, 17 bp, Homo sapiens
attgacattcctttgaa

SEQ ID NO: 6677042 - DNA, 17 bp, Homo sapiens
attgacattctacagtt

SEQ ID NO: 6677043 - DNA, 23 bp, Homo sapiens
attgacattctacagttgtgata

SEQ ID NO: 6677044 - DNA, 15 bp, Homo sapiens
attgacattgaaatc

SEQ ID NO: 6677045 - DNA, 10 bp, Homo sapiens
attgacattt

SEQ ID NO: 6677046 - DNA, 13 bp, Homo sapiens
attgacatttgta

SEQ ID NO: 6677047 - DNA, 17 bp, Homo sapiens
attgacatttgtagttg

SEQ ID NO: 6677048 - DNA, 14 bp, Homo sapiens
attgaccaagaact

SEQ ID NO: 6677049 - DNA, 19 bp, Homo sapiens
attgaccaagtgatgtgtt

SEQ ID NO: 6677050 - DNA, 15 bp, Homo sapiens
attgaccaccagtta

SEQ ID NO: 6677051 - DNA, 13 bp, Homo sapiens
attgaccagctct

SEQ ID NO: 6677052 - DNA, 14 bp, Homo sapiens
attgaccagctctc

SEQ ID NO: 6677053 - DNA, 15 bp, Homo sapiens
attgaccagctctct

SEQ ID NO: 6677054 - DNA, 14 bp, Homo sapiens
attgaccatctgct

SEQ ID NO: 6677055 - DNA, 18 bp, Homo sapiens
attgacccacaagaaatg

SEQ ID NO: 6677056 - DNA, 21 bp, Homo sapiens
attgaccctagccagagaata

SEQ ID NO: 6677057 - DNA, 21 bp, Homo sapiens
attgaccgacagctttccagt

SEQ ID NO: 6677058 - DNA, 20 bp, Homo sapiens
attgaccgcgactaatttca

SEQ ID NO: 6677059 - DNA, 19 bp, Homo sapiens
attgacctcagctgcacat

SEQ ID NO: 6677060 - DNA, 19 bp, Homo sapiens
attgacctgaggagacatc

SEQ ID NO: 6677061 - DNA, 15 bp, Homo sapiens
attgacctggagggg

SEQ ID NO: 6677062 - DNA, 22 bp, Homo sapiens
attgacgacctacatctgaaat

SEQ ID NO: 6677063 - DNA, 15 bp, Homo sapiens
attgacgtctagcta

SEQ ID NO: 6677064 - DNA, 15 bp, Homo sapiens
attgactaaagccat

SEQ ID NO: 6677065 - DNA, 21 bp, Homo sapiens
attgactatcaaactgaagcc

SEQ ID NO: 6677066 - DNA, 15 bp, Homo sapiens
attgactcaaaccat

SEQ ID NO: 6677067 - DNA, 22 bp, Homo sapiens
attgactcaaatctccagtatt

SEQ ID NO: 6677068 - DNA, 21 bp, Homo sapiens
attgactcctttccaatagaa

SEQ ID NO: 6677069 - DNA, 15 bp, Homo sapiens
attgactctgggtcc

SEQ ID NO: 6677070 - DNA, 20 bp, Homo sapiens
attgactctgggtccttcct

SEQ ID NO: 6677071 - DNA, 17 bp, Homo sapiens
attgactcttatttata

SEQ ID NO: 6677072 - DNA, 14 bp, Homo sapiens
attgactcttgagt

SEQ ID NO: 6677073 - DNA, 15 bp, Homo sapiens
attgactcttgagtt

SEQ ID NO: 6677074 - DNA, 12 bp, Homo sapiens
attgactcttgc

SEQ ID NO: 6677075 - DNA, 16 bp, Homo sapiens
attgactgaaattact

SEQ ID NO: 6677076 - DNA, 16 bp, Homo sapiens
attgactgaagcacag

SEQ ID NO: 6677077 - DNA, 20 bp, Homo sapiens
attgactgatgattttcctt

SEQ ID NO: 6677078 - DNA, 18 bp, Homo sapiens
attgactggttaaaaact

SEQ ID NO: 6677079 - DNA, 21 bp, Homo sapiens
attgactggtttacaggccct

SEQ ID NO: 6677080 - DNA, 22 bp, Homo sapiens
attgactggtttacaggccctg

SEQ ID NO: 6677081 - DNA, 15 bp, Homo sapiens
attgacttagatatt

SEQ ID NO: 6677082 - DNA, 20 bp, Homo sapiens
attgacttagatattaaaat

SEQ ID NO: 6677083 - DNA, 16 bp, Homo sapiens
attgacttcaagatgc

SEQ ID NO: 6677084 - DNA, 15 bp, Homo sapiens
attgacttcatttta

SEQ ID NO: 6677085 - DNA, 23 bp, Homo sapiens
attgacttcattttatatttaaa

SEQ ID NO: 6677086 - DNA, 12 bp, Homo sapiens
attgacttcctc

SEQ ID NO: 6677087 - DNA, 23 bp, Homo sapiens
attgacttcctccaatccccact

SEQ ID NO: 6677088 - DNA, 18 bp, Homo sapiens
attgacttctcttgaatt

SEQ ID NO: 6677089 - DNA, 11 bp, Homo sapiens
attgacttctt

SEQ ID NO: 6677090 - DNA, 13 bp, Homo sapiens
attgactttatgt

SEQ ID NO: 6677091 - DNA, 17 bp, Homo sapiens
attgactttatgttgta

SEQ ID NO: 6677092 - DNA, 15 bp, Homo sapiens
attgacttttataaa

SEQ ID NO: 6677093 - DNA, 18 bp, Homo sapiens
attgagaaagagcactta

SEQ ID NO: 6677094 - DNA, 22 bp, Homo sapiens
attgagaaagagcacttaagag

SEQ ID NO: 6677095 - DNA, 16 bp, Homo sapiens
attgagaactgacaaa

SEQ ID NO: 6677096 - DNA, 22 bp, Homo sapiens
attgagaactgcatatgtttcg

SEQ ID NO: 6677097 - DNA, 21 bp, Homo sapiens
attgagaagaaaaactcaatt

SEQ ID NO: 6677098 - DNA, 16 bp, Homo sapiens
attgagaaggagagaa

SEQ ID NO: 6677099 - DNA, 17 bp, Homo sapiens
attgagaataagaattt

SEQ ID NO: 6677100 - DNA, 21 bp, Homo sapiens
attgagaatagaaatttgccc

SEQ ID NO: 6677101 - DNA, 12 bp, Homo sapiens
attgagaatcag

SEQ ID NO: 6677102 - DNA, 21 bp, Homo sapiens
attgagaattcaaatcctctt

SEQ ID NO: 6677103 - DNA, 19 bp, Homo sapiens
attgagacaaaaattatct

SEQ ID NO: 6677104 - DNA, 15 bp, Homo sapiens
attgagacactgtca

SEQ ID NO: 6677105 - DNA, 17 bp, Homo sapiens
attgagaccgtgaagat

SEQ ID NO: 6677106 - DNA, 19 bp, Homo sapiens
attgagacctacaggctga

SEQ ID NO: 6677107 - DNA, 20 bp, Homo sapiens
attgagactgctagaaccaa

SEQ ID NO: 6677108 - DNA, 23 bp, Homo sapiens
attgagagagaagtcggccaggt

SEQ ID NO: 6677109 - DNA, 19 bp, Homo sapiens
attgagagagatgtgtaat

SEQ ID NO: 6677110 - DNA, 17 bp, Homo sapiens
attgagagcagcctctt

SEQ ID NO: 6677111 - DNA, 14 bp, Homo sapiens
attgagagttttgt

SEQ ID NO: 6677112 - DNA, 20 bp, Homo sapiens
attgagatactatcattaac

SEQ ID NO: 6677113 - DNA, 21 bp, Homo sapiens
attgagatgtgtttttaatgt

SEQ ID NO: 6677114 - DNA, 14 bp, Homo sapiens
attgagattttcca

SEQ ID NO: 6677115 - DNA, 20 bp, Homo sapiens
attgagcaaataaacttaca

SEQ ID NO: 6677116 - DNA, 22 bp, Homo sapiens
attgagcaaataaacttacaga

SEQ ID NO: 6677117 - DNA, 20 bp, Homo sapiens
attgagcagaattcattcat

SEQ ID NO: 6677118 - DNA, 22 bp, Homo sapiens
attgagcagttagctcatttga

SEQ ID NO: 6677119 - DNA, 19 bp, Homo sapiens
attgagcatattttcttac

SEQ ID NO: 6677120 - DNA, 14 bp, Homo sapiens
attgagcatttgaa

SEQ ID NO: 6677121 - DNA, 13 bp, Homo sapiens
attgagccattta

SEQ ID NO: 6677122 - DNA, 12 bp, Homo sapiens
attgagccttgc

SEQ ID NO: 6677123 - DNA, 20 bp, Homo sapiens
attgagctagcgatttcaga

SEQ ID NO: 6677124 - DNA, 20 bp, Homo sapiens
attgagctctctgcccttga

SEQ ID NO: 6677125 - DNA, 20 bp, Homo sapiens
attgagctgatataaattct

SEQ ID NO: 6677126 - DNA, 22 bp, Homo sapiens
attgagctgatataaattctgt

SEQ ID NO: 6677127 - DNA, 22 bp, Homo sapiens
attgagctgcctccagcctggt

SEQ ID NO: 6677128 - DNA, 15 bp, Homo sapiens
attgagctgtttcct

SEQ ID NO: 6677129 - DNA, 14 bp, Homo sapiens
attgagcttgcatg

SEQ ID NO: 6677130 - DNA, 19 bp, Homo sapiens
attgagctttgcatttatg

SEQ ID NO: 6677131 - DNA, 22 bp, Homo sapiens
attgagctttgcatttatgatt

SEQ ID NO: 6677132 - DNA, 17 bp, Homo sapiens
attgaggaaaaatatgt

SEQ ID NO: 6677133 - DNA, 22 bp, Homo sapiens
attgaggagagggactgaatag

SEQ ID NO: 6677134 - DNA, 15 bp, Homo sapiens
attgaggataaattg

SEQ ID NO: 6677135 - DNA, 20 bp, Homo sapiens
attgaggataaattgccata

SEQ ID NO: 6677136 - DNA, 21 bp, Homo sapiens
attgaggataaattgccataa

SEQ ID NO: 6677137 - DNA, 22 bp, Homo sapiens
attgaggatctctttgatcctg

SEQ ID NO: 6677138 - DNA, 21 bp, Homo sapiens
attgaggccaagaatattgca

SEQ ID NO: 6677139 - DNA, 22 bp, Homo sapiens
attgaggccaagaatattgcaa

SEQ ID NO: 6677140 - DNA, 12 bp, Homo sapiens
attgaggcctgc

SEQ ID NO: 6677141 - DNA, 19 bp, Homo sapiens
attgaggctttgtgttgta

SEQ ID NO: 6677142 - DNA, 22 bp, Homo sapiens
attgagggaaaacataatatct

SEQ ID NO: 6677143 - DNA, 14 bp, Homo sapiens
attgaggtaagttt

SEQ ID NO: 6677144 - DNA, 16 bp, Homo sapiens
attgaggtaagttttt

SEQ ID NO: 6677145 - DNA, 15 bp, Homo sapiens
attgaggtggggaat

SEQ ID NO: 6677146 - DNA, 17 bp, Homo sapiens
attgaggtttggaagag

SEQ ID NO: 6677147 - DNA, 18 bp, Homo sapiens
attgaggtttggaagagt

SEQ ID NO: 6677148 - DNA, 17 bp, Homo sapiens
attgagtaatattacat

SEQ ID NO: 6677149 - DNA, 19 bp, Homo sapiens
attgagtaatgggatttga

SEQ ID NO: 6677150 - DNA, 22 bp, Homo sapiens
attgagtaatggtgtagaacac

SEQ ID NO: 6677151 - DNA, 23 bp, Homo sapiens
attgagtacgtgctttgagaaaa

SEQ ID NO: 6677152 - DNA, 21 bp, Homo sapiens
attgagtatcctttcagtgtt

SEQ ID NO: 6677153 - DNA, 15 bp, Homo sapiens
attgagtattgttta

SEQ ID NO: 6677154 - DNA, 21 bp, Homo sapiens
attgagtattgtttaaaatgt

SEQ ID NO: 6677155 - DNA, 23 bp, Homo sapiens
attgagtattgtttaaaatgtaa

SEQ ID NO: 6677156 - DNA, 17 bp, Homo sapiens
attgagtccagctttcc

SEQ ID NO: 6677157 - DNA, 22 bp, Homo sapiens
attgagtctgtccagataagtt

SEQ ID NO: 6677158 - DNA, 15 bp, Homo sapiens
attgagtcttaactg

SEQ ID NO: 6677159 - DNA, 18 bp, Homo sapiens
attgagtcttaactgtat

SEQ ID NO: 6677160 - DNA, 20 bp, Homo sapiens
attgagtcttaactgtattt

SEQ ID NO: 6677161 - DNA, 23 bp, Homo sapiens
attgagtgcactaaacaaataag

SEQ ID NO: 6677162 - DNA, 16 bp, Homo sapiens
attgagtgctggggga

SEQ ID NO: 6677163 - DNA, 13 bp, Homo sapiens
attgagtgtacat

SEQ ID NO: 6677164 - DNA, 16 bp, Homo sapiens
attgagtgttctagtt

SEQ ID NO: 6677165 - DNA, 19 bp, Homo sapiens
attgagttaaatcagtaat

SEQ ID NO: 6677166 - DNA, 17 bp, Homo sapiens
attgagttccagttgaa

SEQ ID NO: 6677167 - DNA, 13 bp, Homo sapiens
attgagttctgaa

SEQ ID NO: 6677168 - DNA, 18 bp, Homo sapiens
attgagttctgaaggttg

SEQ ID NO: 6677169 - DNA, 17 bp, Homo sapiens
attgagttcttcctgta

SEQ ID NO: 6677170 - DNA, 20 bp, Homo sapiens
attgagttcttcctgtaatc

SEQ ID NO: 6677171 - DNA, 17 bp, Homo sapiens
attgagtttaacaataa

SEQ ID NO: 6677172 - DNA, 15 bp, Homo sapiens
attgagtttaagtct

SEQ ID NO: 6677173 - DNA, 22 bp, Homo sapiens
attgagtttaagtctctgactc

SEQ ID NO: 6677174 - DNA, 20 bp, Homo sapiens
attgagtttgtaggtaaaat

SEQ ID NO: 6677175 - DNA, 16 bp, Homo sapiens
attgagttttgagtac

SEQ ID NO: 6677176 - DNA, 15 bp, Homo sapiens
attgataaaagagtt

SEQ ID NO: 6677177 - DNA, 19 bp, Homo sapiens
attgataaccttgaaaaaa

SEQ ID NO: 6677178 - DNA, 16 bp, Homo sapiens
attgataagtaatgaa

SEQ ID NO: 6677179 - DNA, 16 bp, Homo sapiens
attgataagttcatac

SEQ ID NO: 6677180 - DNA, 22 bp, Homo sapiens
attgataagttcatacattgta

SEQ ID NO: 6677181 - DNA, 13 bp, Homo sapiens
attgataataaaa

SEQ ID NO: 6677182 - DNA, 13 bp, Homo sapiens
attgataatcttc

SEQ ID NO: 6677183 - DNA, 16 bp, Homo sapiens
attgataatcttcagg

SEQ ID NO: 6677184 - DNA, 17 bp, Homo sapiens
attgataatcttcaggt

SEQ ID NO: 6677185 - DNA, 21 bp, Homo sapiens
attgatacaacaggattttca

SEQ ID NO: 6677186 - DNA, 22 bp, Homo sapiens
attgatacaacaggattttcaa

SEQ ID NO: 6677187 - DNA, 22 bp, Homo sapiens
attgatacatttttaaatgtaa

SEQ ID NO: 6677188 - DNA, 16 bp, Homo sapiens
attgatacgtttatta

SEQ ID NO: 6677189 - DNA, 14 bp, Homo sapiens
attgatacttcagg

SEQ ID NO: 6677190 - DNA, 20 bp, Homo sapiens
attgatacttcaggtgcttt

SEQ ID NO: 6677191 - DNA, 13 bp, Homo sapiens
attgatagaataa

SEQ ID NO: 6677192 - DNA, 19 bp, Homo sapiens
attgatagtttcatttaca

SEQ ID NO: 6677193 - DNA, 17 bp, Homo sapiens
attgatatcgtgaaatc

SEQ ID NO: 6677194 - DNA, 20 bp, Homo sapiens
attgatatctccatgatgat

SEQ ID NO: 6677195 - DNA, 17 bp, Homo sapiens
attgatatgaaaaatat

SEQ ID NO: 6677196 - DNA, 17 bp, Homo sapiens
attgatatgcttataca

SEQ ID NO: 6677197 - DNA, 16 bp, Homo sapiens
attgatattctaagaa

SEQ ID NO: 6677198 - DNA, 23 bp, Homo sapiens
attgatattctaagaaatatctg

SEQ ID NO: 6677199 - DNA, 13 bp, Homo sapiens
attgatattgtga

SEQ ID NO: 6677200 - DNA, 16 bp, Homo sapiens
attgatatttgtgcat

SEQ ID NO: 6677201 - DNA, 20 bp, Homo sapiens
attgatatttttatacaagt

SEQ ID NO: 6677202 - DNA, 15 bp, Homo sapiens
attgatcaaattcat

SEQ ID NO: 6677203 - DNA, 17 bp, Homo sapiens
attgatcacacagtgtt

SEQ ID NO: 6677204 - DNA, 16 bp, Homo sapiens
attgatcacagatgtg

SEQ ID NO: 6677205 - DNA, 18 bp, Homo sapiens
attgatcattttcccccc

SEQ ID NO: 6677206 - DNA, 19 bp, Homo sapiens
attgatcattttcccccca

SEQ ID NO: 6677207 - DNA, 15 bp, Homo sapiens
attgatccacttctt

SEQ ID NO: 6677208 - DNA, 18 bp, Homo sapiens
attgatccagtcatttta

SEQ ID NO: 6677209 - DNA, 20 bp, Homo sapiens
attgatcccacatttccatg

SEQ ID NO: 6677210 - DNA, 22 bp, Homo sapiens
attgatcccttctcctgccctt

SEQ ID NO: 6677211 - DNA, 22 bp, Homo sapiens
attgatcctgcaaaatctgttg

SEQ ID NO: 6677212 - DNA, 21 bp, Homo sapiens
attgatcctttgatcccagaa

SEQ ID NO: 6677213 - DNA, 19 bp, Homo sapiens
attgatcggagcctcctct

SEQ ID NO: 6677214 - DNA, 15 bp, Homo sapiens
attgatctgtattaa

SEQ ID NO: 6677215 - DNA, 19 bp, Homo sapiens
attgatctgttttacagga

SEQ ID NO: 6677216 - DNA, 17 bp, Homo sapiens
attgatcttaaactgga

SEQ ID NO: 6677217 - DNA, 14 bp, Homo sapiens
attgatctttttat

SEQ ID NO: 6677218 - DNA, 15 bp, Homo sapiens
attgatcttttttaa

SEQ ID NO: 6677219 - DNA, 15 bp, Homo sapiens
attgatggatgtctt

SEQ ID NO: 6677220 - DNA, 16 bp, Homo sapiens
attgatggatgtcttc

SEQ ID NO: 6677221 - DNA, 14 bp, Homo sapiens
attgatgggtgggc

SEQ ID NO: 6677222 - DNA, 18 bp, Homo sapiens
attgatgggtgggctagt

SEQ ID NO: 6677223 - DNA, 22 bp, Homo sapiens
attgatgtaaggactgtaaaca

SEQ ID NO: 6677224 - DNA, 13 bp, Homo sapiens
attgatgtacaga

SEQ ID NO: 6677225 - DNA, 21 bp, Homo sapiens
attgatgtacagtctgtcatg

SEQ ID NO: 6677226 - DNA, 21 bp, Homo sapiens
attgatgtcattcagcagtca

SEQ ID NO: 6677227 - DNA, 21 bp, Homo sapiens
attgatgtggccctggctgcc

SEQ ID NO: 6677228 - DNA, 14 bp, Homo sapiens
attgatgttaagaa

SEQ ID NO: 6677229 - DNA, 12 bp, Homo sapiens
attgatgttgat

SEQ ID NO: 6677230 - DNA, 23 bp, Homo sapiens
attgatgtttacatgtctgttgt

SEQ ID NO: 6677231 - DNA, 14 bp, Homo sapiens
attgatgtttcctt

SEQ ID NO: 6677232 - DNA, 21 bp, Homo sapiens
attgatgttttacgtgcaaac

SEQ ID NO: 6677233 - DNA, 13 bp, Homo sapiens
attgattaaaagc

SEQ ID NO: 6677234 - DNA, 18 bp, Homo sapiens
attgattaagtatatcta

SEQ ID NO: 6677235 - DNA, 22 bp, Homo sapiens
attgattatgggttataatcag

SEQ ID NO: 6677236 - DNA, 22 bp, Homo sapiens
attgattattctgattccactt

SEQ ID NO: 6677237 - DNA, 22 bp, Homo sapiens
attgattcaaatgttacaaaaa

SEQ ID NO: 6677238 - DNA, 23 bp, Homo sapiens
attgattcaagggcctagatttg

SEQ ID NO: 6677239 - DNA, 16 bp, Homo sapiens
attgattcagtatctt

SEQ ID NO: 6677240 - DNA, 16 bp, Homo sapiens
attgattcagtcttct

SEQ ID NO: 6677241 - DNA, 18 bp, Homo sapiens
attgattcagtcttctgg

SEQ ID NO: 6677242 - DNA, 14 bp, Homo sapiens
attgattgaaaaaa

SEQ ID NO: 6677243 - DNA, 16 bp, Homo sapiens
attgattgatgtacag

SEQ ID NO: 6677244 - DNA, 20 bp, Homo sapiens
attgattgatgtacagaaca

SEQ ID NO: 6677245 - DNA, 13 bp, Homo sapiens
attgattgctgtg

SEQ ID NO: 6677246 - DNA, 23 bp, Homo sapiens
attgattgctgtgtccaactcca

SEQ ID NO: 6677247 - DNA, 14 bp, Homo sapiens
attgattgcttttt

SEQ ID NO: 6677248 - DNA, 21 bp, Homo sapiens
attgattggataaatgcttat

SEQ ID NO: 6677249 - DNA, 14 bp, Homo sapiens
attgattgggaaaa

SEQ ID NO: 6677250 - DNA, 19 bp, Homo sapiens
attgattgggaaaacattt

SEQ ID NO: 6677251 - DNA, 22 bp, Homo sapiens
attgattgggaaaacatttgct

SEQ ID NO: 6677252 - DNA, 19 bp, Homo sapiens
attgattgggcacatcatt

SEQ ID NO: 6677253 - DNA, 23 bp, Homo sapiens
attgattgggcacatcatttcaa

SEQ ID NO: 6677254 - DNA, 21 bp, Homo sapiens
attgatttaaaattgttctac

SEQ ID NO: 6677255 - DNA, 20 bp, Homo sapiens
attgatttaaagtgaacaca

SEQ ID NO: 6677256 - DNA, 18 bp, Homo sapiens
attgatttaacttcattt

SEQ ID NO: 6677257 - DNA, 20 bp, Homo sapiens
attgatttaacttcattttt

SEQ ID NO: 6677258 - DNA, 21 bp, Homo sapiens
attgatttaacttcatttttc

SEQ ID NO: 6677259 - DNA, 21 bp, Homo sapiens
attgatttacctttggaattg

SEQ ID NO: 6677260 - DNA, 13 bp, Homo sapiens
attgatttagtaa

SEQ ID NO: 6677261 - DNA, 13 bp, Homo sapiens
attgatttcctgt

SEQ ID NO: 6677262 - DNA, 15 bp, Homo sapiens
attgatttcctgtgt

SEQ ID NO: 6677263 - DNA, 23 bp, Homo sapiens
attgatttctacgttatgaaaac

SEQ ID NO: 6677264 - DNA, 20 bp, Homo sapiens
attgatttctgccttccttg

SEQ ID NO: 6677265 - DNA, 15 bp, Homo sapiens
attgatttcttttct

SEQ ID NO: 6677266 - DNA, 14 bp, Homo sapiens
attgatttgaagaa

SEQ ID NO: 6677267 - DNA, 17 bp, Homo sapiens
attgattttaaaaatac

SEQ ID NO: 6677268 - DNA, 15 bp, Homo sapiens
attgattttaaatat

SEQ ID NO: 6677269 - DNA, 15 bp, Homo sapiens
attgattttataatt

SEQ ID NO: 6677270 - DNA, 19 bp, Homo sapiens
attgattttccccctaatt

SEQ ID NO: 6677271 - DNA, 14 bp, Homo sapiens
attgattttctttc

SEQ ID NO: 6677272 - DNA, 13 bp, Homo sapiens
attgatttttaag

SEQ ID NO: 6677273 - DNA, 14 bp, Homo sapiens
attgatttttaaga

SEQ ID NO: 6677274 - DNA, 17 bp, Homo sapiens
attgatttttctcttca

SEQ ID NO: 6677275 - DNA, 16 bp, Homo sapiens
attgatttttcttctt

SEQ ID NO: 6677276 - DNA, 21 bp, Homo sapiens
attgatttttgtaataaaagg

SEQ ID NO: 6677277 - DNA, 23 bp, Homo sapiens
attgattttttttcttggtttct

SEQ ID NO: 6677278 - DNA, 17 bp, Homo sapiens
attgcaaaatacatgaa

SEQ ID NO: 6677279 - DNA, 17 bp, Homo sapiens
attgcaaaatagaagaa

SEQ ID NO: 6677280 - DNA, 19 bp, Homo sapiens
attgcaaaatagaagaaga

SEQ ID NO: 6677281 - DNA, 20 bp, Homo sapiens
attgcaaagggacattgaag

SEQ ID NO: 6677282 - DNA, 23 bp, Homo sapiens
attgcaaaggttccaactgtata

SEQ ID NO: 6677283 - DNA, 18 bp, Homo sapiens
attgcaaagtgcgctcat

SEQ ID NO: 6677284 - DNA, 17 bp, Homo sapiens
attgcaaatcttgaaat

SEQ ID NO: 6677285 - DNA, 13 bp, Homo sapiens
attgcaacaaaat

SEQ ID NO: 6677286 - DNA, 14 bp, Homo sapiens
attgcaacaaaata

SEQ ID NO: 6677287 - DNA, 13 bp, Homo sapiens
attgcaacaatgc

SEQ ID NO: 6677288 - DNA, 15 bp, Homo sapiens
attgcaacaatgcaa

SEQ ID NO: 6677289 - DNA, 14 bp, Homo sapiens
attgcaacagactg

SEQ ID NO: 6677290 - DNA, 18 bp, Homo sapiens
attgcaacaggctgggct

SEQ ID NO: 6677291 - DNA, 13 bp, Homo sapiens
attgcaaggaagg

SEQ ID NO: 6677292 - DNA, 16 bp, Homo sapiens
attgcaaggaaggaaa

SEQ ID NO: 6677293 - DNA, 13 bp, Homo sapiens
attgcaagggaag

SEQ ID NO: 6677294 - DNA, 18 bp, Homo sapiens
attgcaaggtcactttgc

SEQ ID NO: 6677295 - DNA, 14 bp, Homo sapiens
attgcaataaagta

SEQ ID NO: 6677296 - DNA, 17 bp, Homo sapiens
attgcaataaagtataa

SEQ ID NO: 6677297 - DNA, 20 bp, Homo sapiens
attgcaatacattgttcagg

SEQ ID NO: 6677298 - DNA, 17 bp, Homo sapiens
attgcaattttaacaca

SEQ ID NO: 6677299 - DNA, 9 bp, Homo sapiens
attgcacaa

SEQ ID NO: 6677300 - DNA, 14 bp, Homo sapiens
attgcacaaataca

SEQ ID NO: 6677301 - DNA, 15 bp, Homo sapiens
attgcacaaatacaa

SEQ ID NO: 6677302 - DNA, 11 bp, Homo sapiens
attgcacaata

SEQ ID NO: 6677303 - DNA, 13 bp, Homo sapiens
attgcacaatatt

SEQ ID NO: 6677304 - DNA, 13 bp, Homo sapiens
attgcacaatttg

SEQ ID NO: 6677305 - DNA, 16 bp, Homo sapiens
attgcacaatttgagc

SEQ ID NO: 6677306 - DNA, 18 bp, Homo sapiens
attgcacaatttgagcaa

SEQ ID NO: 6677307 - DNA, 13 bp, Homo sapiens
attgcacagaatt

SEQ ID NO: 6677308 - DNA, 15 bp, Homo sapiens
attgcacagaatttg

SEQ ID NO: 6677309 - DNA, 23 bp, Homo sapiens
attgcacagagcacacttattta

SEQ ID NO: 6677310 - DNA, 14 bp, Homo sapiens
attgcacagggaga

SEQ ID NO: 6677311 - DNA, 21 bp, Homo sapiens
attgcaccagaaatgtttatg

SEQ ID NO: 6677312 - DNA, 15 bp, Homo sapiens
attgcaccattttca

SEQ ID NO: 6677313 - DNA, 17 bp, Homo sapiens
attgcacccagcccaga

SEQ ID NO: 6677314 - DNA, 17 bp, Homo sapiens
attgcacctgcaggctt

SEQ ID NO: 6677315 - DNA, 13 bp, Homo sapiens
attgcactaaaag

SEQ ID NO: 6677316 - DNA, 16 bp, Homo sapiens
attgcactaaaagtga

SEQ ID NO: 6677317 - DNA, 19 bp, Homo sapiens
attgcactaaataaactac

SEQ ID NO: 6677318 - DNA, 19 bp, Homo sapiens
attgcactagagaaaataa

SEQ ID NO: 6677319 - DNA, 17 bp, Homo sapiens
attgcactaggaattct

SEQ ID NO: 6677320 - DNA, 18 bp, Homo sapiens
attgcactatgaaaatca

SEQ ID NO: 6677321 - DNA, 17 bp, Homo sapiens
attgcactcatcatatt

SEQ ID NO: 6677322 - DNA, 19 bp, Homo sapiens
attgcactccagcctgggc

SEQ ID NO: 6677323 - DNA, 15 bp, Homo sapiens
attgcactccagtct

SEQ ID NO: 6677324 - DNA, 13 bp, Homo sapiens
attgcactctaaa

SEQ ID NO: 6677325 - DNA, 18 bp, Homo sapiens
attgcactctagcctggc

SEQ ID NO: 6677326 - DNA, 19 bp, Homo sapiens
attgcactgaagtttttga

SEQ ID NO: 6677327 - DNA, 22 bp, Homo sapiens
attgcactgaagtttttgaaat

SEQ ID NO: 6677328 - DNA, 18 bp, Homo sapiens
attgcactgcagttattt

SEQ ID NO: 6677329 - DNA, 19 bp, Homo sapiens
attgcactgttctgattat

SEQ ID NO: 6677330 - DNA, 23 bp, Homo sapiens
attgcactgttctgattatgtaa

SEQ ID NO: 6677331 - DNA, 19 bp, Homo sapiens
attgcactttataaacact

SEQ ID NO: 6677332 - DNA, 17 bp, Homo sapiens
attgcagaaaattctgt

SEQ ID NO: 6677333 - DNA, 22 bp, Homo sapiens
attgcagaactaaactcattta

SEQ ID NO: 6677334 - DNA, 14 bp, Homo sapiens
attgcagaagaaac

SEQ ID NO: 6677335 - DNA, 15 bp, Homo sapiens
attgcagaagaaact

SEQ ID NO: 6677336 - DNA, 19 bp, Homo sapiens
attgcagaattgtttagat

SEQ ID NO: 6677337 - DNA, 21 bp, Homo sapiens
attgcagagactcatttcaca

SEQ ID NO: 6677338 - DNA, 18 bp, Homo sapiens
attgcagagtgaccagca

SEQ ID NO: 6677339 - DNA, 22 bp, Homo sapiens
attgcagatatgggactgattc

SEQ ID NO: 6677340 - DNA, 17 bp, Homo sapiens
attgcagatcccagccc

SEQ ID NO: 6677341 - DNA, 16 bp, Homo sapiens
attgcagcagttgcta

SEQ ID NO: 6677342 - DNA, 18 bp, Homo sapiens
attgcagcctaagaagaa

SEQ ID NO: 6677343 - DNA, 14 bp, Homo sapiens
attgcagctaagct

SEQ ID NO: 6677344 - DNA, 15 bp, Homo sapiens
attgcagctcactgc

SEQ ID NO: 6677345 - DNA, 19 bp, Homo sapiens
attgcagctgggagaaggg

SEQ ID NO: 6677346 - DNA, 16 bp, Homo sapiens
attgcagctttatgtt

SEQ ID NO: 6677347 - DNA, 20 bp, Homo sapiens
attgcagctttatgttcatt

SEQ ID NO: 6677348 - DNA, 20 bp, Homo sapiens
attgcaggagacattttcat

SEQ ID NO: 6677349 - DNA, 23 bp, Homo sapiens
attgcaggagtccctgccatcat

SEQ ID NO: 6677350 - DNA, 14 bp, Homo sapiens
attgcaggatggtg

SEQ ID NO: 6677351 - DNA, 15 bp, Homo sapiens
attgcaggccagtgg

SEQ ID NO: 6677352 - DNA, 19 bp, Homo sapiens
attgcaggccagtggacag

SEQ ID NO: 6677353 - DNA, 22 bp, Homo sapiens
attgcaggccagtggacagagg

SEQ ID NO: 6677354 - DNA, 14 bp, Homo sapiens
attgcagtaaagtc

SEQ ID NO: 6677355 - DNA, 16 bp, Homo sapiens
attgcagtatcagagg

SEQ ID NO: 6677356 - DNA, 17 bp, Homo sapiens
attgcagtctaaaactt

SEQ ID NO: 6677357 - DNA, 20 bp, Homo sapiens
attgcagtgtgaatgctggg

SEQ ID NO: 6677358 - DNA, 22 bp, Homo sapiens
attgcagtgtgaatgctgggcc

SEQ ID NO: 6677359 - DNA, 21 bp, Homo sapiens
attgcagttcaaatcctcacc

SEQ ID NO: 6677360 - DNA, 19 bp, Homo sapiens
attgcagtttatcattcaa

SEQ ID NO: 6677361 - DNA, 13 bp, Homo sapiens
attgcagtttcat

SEQ ID NO: 6677362 - DNA, 13 bp, Homo sapiens
attgcataaagca

SEQ ID NO: 6677363 - DNA, 21 bp, Homo sapiens
attgcatactttgtattttga

SEQ ID NO: 6677364 - DNA, 15 bp, Homo sapiens
attgcatatagattt

SEQ ID NO: 6677365 - DNA, 14 bp, Homo sapiens
attgcatcctgctg

SEQ ID NO: 6677366 - DNA, 15 bp, Homo sapiens
attgcatcctgctgg

SEQ ID NO: 6677367 - DNA, 16 bp, Homo sapiens
attgcatcctgctggg

SEQ ID NO: 6677368 - DNA, 21 bp, Homo sapiens
attgcatctaggtaattttta

SEQ ID NO: 6677369 - DNA, 22 bp, Homo sapiens
attgcatctcccagataatgtg

SEQ ID NO: 6677370 - DNA, 13 bp, Homo sapiens
attgcatctgtat

SEQ ID NO: 6677371 - DNA, 21 bp, Homo sapiens
attgcatgaaaatagctattt

SEQ ID NO: 6677372 - DNA, 19 bp, Homo sapiens
attgcatgagaagccatac

SEQ ID NO: 6677373 - DNA, 19 bp, Homo sapiens
attgcatgccgggtgcagc

SEQ ID NO: 6677374 - DNA, 23 bp, Homo sapiens
attgcatgccgggtgcagcatct

SEQ ID NO: 6677375 - DNA, 19 bp, Homo sapiens
attgcatgggttttgtagg

SEQ ID NO: 6677376 - DNA, 17 bp, Homo sapiens
attgcatggtgtgaact

SEQ ID NO: 6677377 - DNA, 18 bp, Homo sapiens
attgcatggtgtgaacta

SEQ ID NO: 6677378 - DNA, 16 bp, Homo sapiens
attgcatgtaaaatgc

SEQ ID NO: 6677379 - DNA, 18 bp, Homo sapiens
attgcatgtattgtaaac

SEQ ID NO: 6677380 - DNA, 14 bp, Homo sapiens
attgcatgtgactc

SEQ ID NO: 6677381 - DNA, 15 bp, Homo sapiens
attgcattataaaat

SEQ ID NO: 6677382 - DNA, 14 bp, Homo sapiens
attgcattctattg

SEQ ID NO: 6677383 - DNA, 21 bp, Homo sapiens
attgcattctgaatgaataaa

SEQ ID NO: 6677384 - DNA, 14 bp, Homo sapiens
attgcattgctggt

SEQ ID NO: 6677385 - DNA, 15 bp, Homo sapiens
attgcatttattgca

SEQ ID NO: 6677386 - DNA, 16 bp, Homo sapiens
attgcatttcctgaca

SEQ ID NO: 6677387 - DNA, 15 bp, Homo sapiens
attgcatttctgtat

SEQ ID NO: 6677388 - DNA, 18 bp, Homo sapiens
attgcatttctgtatttt

SEQ ID NO: 6677389 - DNA, 21 bp, Homo sapiens
attgcatttgctgttgtttct

SEQ ID NO: 6677390 - DNA, 16 bp, Homo sapiens
attgcatttgcttttg

SEQ ID NO: 6677391 - DNA, 18 bp, Homo sapiens
attgcattttttaaaaca

SEQ ID NO: 6677392 - DNA, 16 bp, Homo sapiens
attgccaaaaaggata

SEQ ID NO: 6677393 - DNA, 20 bp, Homo sapiens
attgccaaaaagtgaaataa

SEQ ID NO: 6677394 - DNA, 19 bp, Homo sapiens
attgccaaaacccagctgc

SEQ ID NO: 6677395 - DNA, 14 bp, Homo sapiens
attgccaaaatata

SEQ ID NO: 6677396 - DNA, 15 bp, Homo sapiens
attgccaaatattaa

SEQ ID NO: 6677397 - DNA, 21 bp, Homo sapiens
attgccaaatattaagaagct

SEQ ID NO: 6677398 - DNA, 20 bp, Homo sapiens
attgccaagccccccgagtg

SEQ ID NO: 6677399 - DNA, 19 bp, Homo sapiens
attgccaaggcatccccag

SEQ ID NO: 6677400 - DNA, 16 bp, Homo sapiens
attgccaagtgcctat

SEQ ID NO: 6677401 - DNA, 17 bp, Homo sapiens
attgccaatactcatgt

SEQ ID NO: 6677402 - DNA, 12 bp, Homo sapiens
attgccacagct

SEQ ID NO: 6677403 - DNA, 19 bp, Homo sapiens
attgccacagctcaactcg

SEQ ID NO: 6677404 - DNA, 21 bp, Homo sapiens
attgccacctctaacagcacc

SEQ ID NO: 6677405 - DNA, 14 bp, Homo sapiens
attgccacctctgg

SEQ ID NO: 6677406 - DNA, 20 bp, Homo sapiens
attgccacctctggccaaat

SEQ ID NO: 6677407 - DNA, 13 bp, Homo sapiens
attgccagcaaat

SEQ ID NO: 6677408 - DNA, 17 bp, Homo sapiens
attgccaggaatgtttc

SEQ ID NO: 6677409 - DNA, 19 bp, Homo sapiens
attgccaggagatggcccc

SEQ ID NO: 6677410 - DNA, 19 bp, Homo sapiens
attgccagtatataagctg

SEQ ID NO: 6677411 - DNA, 15 bp, Homo sapiens
attgccataatatga

SEQ ID NO: 6677412 - DNA, 22 bp, Homo sapiens
attgccatattaaaatctgatg

SEQ ID NO: 6677413 - DNA, 17 bp, Homo sapiens
attgccatattgcacat

SEQ ID NO: 6677414 - DNA, 18 bp, Homo sapiens
attgccatattgcacatg

SEQ ID NO: 6677415 - DNA, 15 bp, Homo sapiens
attgccatcagtgat

SEQ ID NO: 6677416 - DNA, 20 bp, Homo sapiens
attgccatcgggtgccaaat

SEQ ID NO: 6677417 - DNA, 22 bp, Homo sapiens
attgccatgaatttctaccaga

SEQ ID NO: 6677418 - DNA, 19 bp, Homo sapiens
attgccatggccctgagcc

SEQ ID NO: 6677419 - DNA, 12 bp, Homo sapiens
attgccatgtgg

SEQ ID NO: 6677420 - DNA, 18 bp, Homo sapiens
attgccattatagcgcct

SEQ ID NO: 6677421 - DNA, 13 bp, Homo sapiens
attgcccacttct

SEQ ID NO: 6677422 - DNA, 13 bp, Homo sapiens
attgcccagtgag

SEQ ID NO: 6677423 - DNA, 19 bp, Homo sapiens
attgcccagtgagccctgc

SEQ ID NO: 6677424 - DNA, 22 bp, Homo sapiens
attgcccagtgagccctgctct

SEQ ID NO: 6677425 - DNA, 15 bp, Homo sapiens
attgccccatgagac

SEQ ID NO: 6677426 - DNA, 16 bp, Homo sapiens
attgcccccacctctg

SEQ ID NO: 6677427 - DNA, 20 bp, Homo sapiens
attgcccccatggggtcctt

SEQ ID NO: 6677428 - DNA, 23 bp, Homo sapiens
attgcccccatggggtccttgga

SEQ ID NO: 6677429 - DNA, 12 bp, Homo sapiens
attgccccctct

SEQ ID NO: 6677430 - DNA, 14 bp, Homo sapiens
attgcccctctgcc

SEQ ID NO: 6677431 - DNA, 19 bp, Homo sapiens
attgcccctggctttgcct

SEQ ID NO: 6677432 - DNA, 15 bp, Homo sapiens
attgccctaattaaa

SEQ ID NO: 6677433 - DNA, 16 bp, Homo sapiens
attgccctgccaggct

SEQ ID NO: 6677434 - DNA, 11 bp, Homo sapiens
attgccctggt

SEQ ID NO: 6677435 - DNA, 20 bp, Homo sapiens
attgcctaagaataaacatt

SEQ ID NO: 6677436 - DNA, 21 bp, Homo sapiens
attgcctaagaataaacattt

SEQ ID NO: 6677437 - DNA, 16 bp, Homo sapiens
attgcctacaataaaa

SEQ ID NO: 6677438 - DNA, 21 bp, Homo sapiens
attgcctagcctataaataaa

SEQ ID NO: 6677439 - DNA, 16 bp, Homo sapiens
attgcctataatactt

SEQ ID NO: 6677440 - DNA, 19 bp, Homo sapiens
attgcctataatacttgca

SEQ ID NO: 6677441 - DNA, 22 bp, Homo sapiens
attgcctataatacttgcaact

SEQ ID NO: 6677442 - DNA, 13 bp, Homo sapiens
attgcctatttca

SEQ ID NO: 6677443 - DNA, 18 bp, Homo sapiens
attgcctatttcagtggc

SEQ ID NO: 6677444 - DNA, 20 bp, Homo sapiens
attgcctccacctctccttg

SEQ ID NO: 6677445 - DNA, 14 bp, Homo sapiens
attgcctcccaggc

SEQ ID NO: 6677446 - DNA, 14 bp, Homo sapiens
attgcctcccttcc

SEQ ID NO: 6677447 - DNA, 12 bp, Homo sapiens
attgcctcctgt

SEQ ID NO: 6677448 - DNA, 23 bp, Homo sapiens
attgcctcggctggctcccctgc

SEQ ID NO: 6677449 - DNA, 13 bp, Homo sapiens
attgcctctgaaa

SEQ ID NO: 6677450 - DNA, 20 bp, Homo sapiens
attgcctgactaaaatgttt

SEQ ID NO: 6677451 - DNA, 15 bp, Homo sapiens
attgcctgcagagag

SEQ ID NO: 6677452 - DNA, 13 bp, Homo sapiens
attgcctggactg

SEQ ID NO: 6677453 - DNA, 15 bp, Homo sapiens
attgcctgggcagtg

SEQ ID NO: 6677454 - DNA, 18 bp, Homo sapiens
attgcctgggcagtgccc

SEQ ID NO: 6677455 - DNA, 17 bp, Homo sapiens
attgcctgttctgcttc

SEQ ID NO: 6677456 - DNA, 14 bp, Homo sapiens
attgcctgtttctg

SEQ ID NO: 6677457 - DNA, 15 bp, Homo sapiens
attgcctgtttctga

SEQ ID NO: 6677458 - DNA, 17 bp, Homo sapiens
attgccttaaggccaca

SEQ ID NO: 6677459 - DNA, 19 bp, Homo sapiens
attgccttatttgtctgta

SEQ ID NO: 6677460 - DNA, 21 bp, Homo sapiens
attgccttatttgtctgtaaa

SEQ ID NO: 6677461 - DNA, 13 bp, Homo sapiens
attgccttcattt

SEQ ID NO: 6677462 - DNA, 20 bp, Homo sapiens
attgccttcattttatgata

SEQ ID NO: 6677463 - DNA, 16 bp, Homo sapiens
attgccttcgctccat

SEQ ID NO: 6677464 - DNA, 21 bp, Homo sapiens
attgccttctcaccagctgca

SEQ ID NO: 6677465 - DNA, 22 bp, Homo sapiens
attgccttctcaccagctgcaa

SEQ ID NO: 6677466 - DNA, 18 bp, Homo sapiens
attgccttctctgcccac

SEQ ID NO: 6677467 - DNA, 16 bp, Homo sapiens
attgccttctttgaag

SEQ ID NO: 6677468 - DNA, 20 bp, Homo sapiens
attgccttctttgaagaagg

SEQ ID NO: 6677469 - DNA, 18 bp, Homo sapiens
attgccttgagcttttca

SEQ ID NO: 6677470 - DNA, 16 bp, Homo sapiens
attgccttgatgtttc

SEQ ID NO: 6677471 - DNA, 17 bp, Homo sapiens
attgccttgggcctggg

SEQ ID NO: 6677472 - DNA, 12 bp, Homo sapiens
attgcctttaat

SEQ ID NO: 6677473 - DNA, 17 bp, Homo sapiens
attgcctttgaatgtta

SEQ ID NO: 6677474 - DNA, 21 bp, Homo sapiens
attgcctttgtaatatgagaa

SEQ ID NO: 6677475 - DNA, 13 bp, Homo sapiens
attgcctttgtag

SEQ ID NO: 6677476 - DNA, 17 bp, Homo sapiens
attgccttttaattttt

SEQ ID NO: 6677477 - DNA, 18 bp, Homo sapiens
attgccttttttctgtat

SEQ ID NO: 6677478 - DNA, 17 bp, Homo sapiens
attgcgagaaacagaga

SEQ ID NO: 6677479 - DNA, 15 bp, Homo sapiens
attgcgagaattttc

SEQ ID NO: 6677480 - DNA, 13 bp, Homo sapiens
attgcgagagatg

SEQ ID NO: 6677481 - DNA, 15 bp, Homo sapiens
attgcgagagatgtg

SEQ ID NO: 6677482 - DNA, 17 bp, Homo sapiens
attgcgcctaatgtgtt

SEQ ID NO: 6677483 - DNA, 15 bp, Homo sapiens
attgcgcctttgtat

SEQ ID NO: 6677484 - DNA, 17 bp, Homo sapiens
attgcgcctttgtatta

SEQ ID NO: 6677485 - DNA, 19 bp, Homo sapiens
attgcgcctttgtattata

SEQ ID NO: 6677486 - DNA, 13 bp, Homo sapiens
attgcgctcaggg

SEQ ID NO: 6677487 - DNA, 16 bp, Homo sapiens
attgcgctctcaagac

SEQ ID NO: 6677488 - DNA, 13 bp, Homo sapiens
attgcgctgctac

SEQ ID NO: 6677489 - DNA, 19 bp, Homo sapiens
attgcggacagccacggcc

SEQ ID NO: 6677490 - DNA, 15 bp, Homo sapiens
attgcggccccagga

SEQ ID NO: 6677491 - DNA, 16 bp, Homo sapiens
attgcggccccaggag

SEQ ID NO: 6677492 - DNA, 20 bp, Homo sapiens
attgcgtcttagcagtgatt

SEQ ID NO: 6677493 - DNA, 23 bp, Homo sapiens
attgctaaaaaataaataaaagc

SEQ ID NO: 6677494 - DNA, 14 bp, Homo sapiens
attgctaaaacagc

SEQ ID NO: 6677495 - DNA, 13 bp, Homo sapiens
attgctaaaagca

SEQ ID NO: 6677496 - DNA, 18 bp, Homo sapiens
attgctaaaagcatgtat

SEQ ID NO: 6677497 - DNA, 19 bp, Homo sapiens
attgctaaaagcatgtata

SEQ ID NO: 6677498 - DNA, 13 bp, Homo sapiens
attgctaaaagtg

SEQ ID NO: 6677499 - DNA, 21 bp, Homo sapiens
attgctaatcaccaaaggctc

SEQ ID NO: 6677500 - DNA, 20 bp, Homo sapiens
attgctaattgctgttgaaa

SEQ ID NO: 6677501 - DNA, 23 bp, Homo sapiens
attgctaattgctgttgaaagca

SEQ ID NO: 6677502 - DNA, 18 bp, Homo sapiens
attgctaattgtgtatat

SEQ ID NO: 6677503 - DNA, 17 bp, Homo sapiens
attgctaccgagaaggt

SEQ ID NO: 6677504 - DNA, 13 bp, Homo sapiens
attgctacctcag

SEQ ID NO: 6677505 - DNA, 22 bp, Homo sapiens
attgctacctcagtgctcctgg

SEQ ID NO: 6677506 - DNA, 20 bp, Homo sapiens
attgctactgctcagcttct

SEQ ID NO: 6677507 - DNA, 22 bp, Homo sapiens
attgctactgctcagcttcttc

SEQ ID NO: 6677508 - DNA, 22 bp, Homo sapiens
attgctactgtcctacccaccc

SEQ ID NO: 6677509 - DNA, 15 bp, Homo sapiens
attgctacttcctgc

SEQ ID NO: 6677510 - DNA, 23 bp, Homo sapiens
attgctacttcctgcctggtctc

SEQ ID NO: 6677511 - DNA, 15 bp, Homo sapiens
attgctagagctcct

SEQ ID NO: 6677512 - DNA, 23 bp, Homo sapiens
attgctagagctcctccctctca

SEQ ID NO: 6677513 - DNA, 18 bp, Homo sapiens
attgctagccagcattcc

SEQ ID NO: 6677514 - DNA, 19 bp, Homo sapiens
attgctagtactagtacta

SEQ ID NO: 6677515 - DNA, 14 bp, Homo sapiens
attgctagtagata

SEQ ID NO: 6677516 - DNA, 15 bp, Homo sapiens
attgctagtatttga

SEQ ID NO: 6677517 - DNA, 14 bp, Homo sapiens
attgctatcagcaa

SEQ ID NO: 6677518 - DNA, 23 bp, Homo sapiens
attgctatctggaggccttccag

SEQ ID NO: 6677519 - DNA, 18 bp, Homo sapiens
attgctatgttactattt

SEQ ID NO: 6677520 - DNA, 14 bp, Homo sapiens
attgctatgttctt

SEQ ID NO: 6677521 - DNA, 16 bp, Homo sapiens
attgctatttatattc

SEQ ID NO: 6677522 - DNA, 21 bp, Homo sapiens
attgctcagagaaatatgcag

SEQ ID NO: 6677523 - DNA, 12 bp, Homo sapiens
attgctcagccc

SEQ ID NO: 6677524 - DNA, 14 bp, Homo sapiens
attgctcagcccgc

SEQ ID NO: 6677525 - DNA, 15 bp, Homo sapiens
attgctcagcccgct

SEQ ID NO: 6677526 - DNA, 16 bp, Homo sapiens
attgctcagcccgctt

SEQ ID NO: 6677527 - DNA, 18 bp, Homo sapiens
attgctcagcccgcttgg

SEQ ID NO: 6677528 - DNA, 22 bp, Homo sapiens
attgctcatctcagtcctcaaa

SEQ ID NO: 6677529 - DNA, 18 bp, Homo sapiens
attgctcatgttggccaa

SEQ ID NO: 6677530 - DNA, 19 bp, Homo sapiens
attgctccattttcttgtc

SEQ ID NO: 6677531 - DNA, 20 bp, Homo sapiens
attgctccattttcttgtca

SEQ ID NO: 6677532 - DNA, 14 bp, Homo sapiens
attgctcccaggat

SEQ ID NO: 6677533 - DNA, 16 bp, Homo sapiens
attgctcccaggatct

SEQ ID NO: 6677534 - DNA, 23 bp, Homo sapiens
attgctcccatcagggaagaacc

SEQ ID NO: 6677535 - DNA, 18 bp, Homo sapiens
attgctcgcccagacacc

SEQ ID NO: 6677536 - DNA, 22 bp, Homo sapiens
attgctcgcccagacaccatgt

SEQ ID NO: 6677537 - DNA, 23 bp, Homo sapiens
attgctcgcccagacaccatgtg

SEQ ID NO: 6677538 - DNA, 20 bp, Homo sapiens
attgctctaattcttttcaa

SEQ ID NO: 6677539 - DNA, 16 bp, Homo sapiens
attgctctatgtctgc

SEQ ID NO: 6677540 - DNA, 19 bp, Homo sapiens
attgctctatgttagtata

SEQ ID NO: 6677541 - DNA, 21 bp, Homo sapiens
attgctctgccccaccttgcc

SEQ ID NO: 6677542 - DNA, 15 bp, Homo sapiens
attgctctggagcag

SEQ ID NO: 6677543 - DNA, 18 bp, Homo sapiens
attgctctgtgtatatct

SEQ ID NO: 6677544 - DNA, 19 bp, Homo sapiens
attgctctgtgtatatctc

SEQ ID NO: 6677545 - DNA, 14 bp, Homo sapiens
attgctcttaaaaa

SEQ ID NO: 6677546 - DNA, 18 bp, Homo sapiens
attgctcttaaaaatctt

SEQ ID NO: 6677547 - DNA, 16 bp, Homo sapiens
attgctgaaaatggta

SEQ ID NO: 6677548 - DNA, 18 bp, Homo sapiens
attgctgaaaatggtatt

SEQ ID NO: 6677549 - DNA, 13 bp, Homo sapiens
attgctgaaattt

SEQ ID NO: 6677550 - DNA, 22 bp, Homo sapiens
attgctgaactcttaggcacat

SEQ ID NO: 6677551 - DNA, 21 bp, Homo sapiens
attgctgaagggcattctttc

SEQ ID NO: 6677552 - DNA, 18 bp, Homo sapiens
attgctgaatcccatcag

SEQ ID NO: 6677553 - DNA, 19 bp, Homo sapiens
attgctgaatcccatcagg

SEQ ID NO: 6677554 - DNA, 12 bp, Homo sapiens
attgctgactgt

SEQ ID NO: 6677555 - DNA, 22 bp, Homo sapiens
attgctgagatgtttagtagct

SEQ ID NO: 6677556 - DNA, 14 bp, Homo sapiens
attgctgagcctct

SEQ ID NO: 6677557 - DNA, 20 bp, Homo sapiens
attgctgataccatatgaat

SEQ ID NO: 6677558 - DNA, 16 bp, Homo sapiens
attgctgatggtgcaa

SEQ ID NO: 6677559 - DNA, 14 bp, Homo sapiens
attgctgatgtagt

SEQ ID NO: 6677560 - DNA, 13 bp, Homo sapiens
attgctgatttta

SEQ ID NO: 6677561 - DNA, 16 bp, Homo sapiens
attgctgattttaaag

SEQ ID NO: 6677562 - DNA, 14 bp, Homo sapiens
attgctgcaaatgc

SEQ ID NO: 6677563 - DNA, 18 bp, Homo sapiens
attgctgcataaatttgt

SEQ ID NO: 6677564 - DNA, 19 bp, Homo sapiens
attgctgcataaatttgta

SEQ ID NO: 6677565 - DNA, 21 bp, Homo sapiens
attgctgcataaatttgtaat

SEQ ID NO: 6677566 - DNA, 21 bp, Homo sapiens
attgctgcattttaagcataa

SEQ ID NO: 6677567 - DNA, 12 bp, Homo sapiens
attgctgccaaa

SEQ ID NO: 6677568 - DNA, 13 bp, Homo sapiens
attgctgccaaaa

SEQ ID NO: 6677569 - DNA, 15 bp, Homo sapiens
attgctgccaaaacc

SEQ ID NO: 6677570 - DNA, 17 bp, Homo sapiens
attgctgccaaaaccac

SEQ ID NO: 6677571 - DNA, 16 bp, Homo sapiens
attgctgccagagaag

SEQ ID NO: 6677572 - DNA, 22 bp, Homo sapiens
attgctgccataattctaagtt

SEQ ID NO: 6677573 - DNA, 12 bp, Homo sapiens
attgctgccttt

SEQ ID NO: 6677574 - DNA, 18 bp, Homo sapiens
attgctgctccttagctg

SEQ ID NO: 6677575 - DNA, 13 bp, Homo sapiens
attgctgctgccc

SEQ ID NO: 6677576 - DNA, 12 bp, Homo sapiens
attgctgcttga

SEQ ID NO: 6677577 - DNA, 13 bp, Homo sapiens
attgctgcttgga

SEQ ID NO: 6677578 - DNA, 17 bp, Homo sapiens
attgctgcttgtacact

SEQ ID NO: 6677579 - DNA, 17 bp, Homo sapiens
attgctggaaaccaagt

SEQ ID NO: 6677580 - DNA, 12 bp, Homo sapiens
attgctggacta

SEQ ID NO: 6677581 - DNA, 14 bp, Homo sapiens
attgctggggccag

SEQ ID NO: 6677582 - DNA, 17 bp, Homo sapiens
attgctggggccaggcc

SEQ ID NO: 6677583 - DNA, 18 bp, Homo sapiens
attgctggggccaggccc

SEQ ID NO: 6677584 - DNA, 22 bp, Homo sapiens
attgctgtaaataaaaatagct

SEQ ID NO: 6677585 - DNA, 22 bp, Homo sapiens
attgctgtaccacatctgctct

SEQ ID NO: 6677586 - DNA, 20 bp, Homo sapiens
attgctgtattttagaaaat

SEQ ID NO: 6677587 - DNA, 23 bp, Homo sapiens
attgctgtcaagttcctttgggt

SEQ ID NO: 6677588 - DNA, 17 bp, Homo sapiens
attgctgtccttgggta

SEQ ID NO: 6677589 - DNA, 20 bp, Homo sapiens
attgctgtctagccttagtc

SEQ ID NO: 6677590 - DNA, 15 bp, Homo sapiens
attgctgtctgaaaa

SEQ ID NO: 6677591 - DNA, 21 bp, Homo sapiens
attgctgtctgaaaaagtgtt

SEQ ID NO: 6677592 - DNA, 13 bp, Homo sapiens
attgctgtctggt

SEQ ID NO: 6677593 - DNA, 15 bp, Homo sapiens
attgctgtctggtga

SEQ ID NO: 6677594 - DNA, 17 bp, Homo sapiens
attgctgtctggtgagg

SEQ ID NO: 6677595 - DNA, 19 bp, Homo sapiens
attgctgtgtccaactcca

SEQ ID NO: 6677596 - DNA, 20 bp, Homo sapiens
attgctgtgtccaactccag

SEQ ID NO: 6677597 - DNA, 15 bp, Homo sapiens
attgctgtgtctcct

SEQ ID NO: 6677598 - DNA, 23 bp, Homo sapiens
attgctgtgtcttcattttcatt

SEQ ID NO: 6677599 - DNA, 18 bp, Homo sapiens
attgctgttgaaagcaaa

SEQ ID NO: 6677600 - DNA, 19 bp, Homo sapiens
attgctgttgaaagcaaaa

SEQ ID NO: 6677601 - DNA, 22 bp, Homo sapiens
attgctgttgaaagcaaaaatg

SEQ ID NO: 6677602 - DNA, 17 bp, Homo sapiens
attgctgttgcttgaat

SEQ ID NO: 6677603 - DNA, 21 bp, Homo sapiens
attgctgttgtccctctgcta

SEQ ID NO: 6677604 - DNA, 19 bp, Homo sapiens
attgctgttgttgcaggga

SEQ ID NO: 6677605 - DNA, 20 bp, Homo sapiens
attgctgttttaatttgtat

SEQ ID NO: 6677606 - DNA, 17 bp, Homo sapiens
attgcttaaaagacatt

SEQ ID NO: 6677607 - DNA, 13 bp, Homo sapiens
attgcttaatccc

SEQ ID NO: 6677608 - DNA, 19 bp, Homo sapiens
attgcttaatttctgcctt

SEQ ID NO: 6677609 - DNA, 19 bp, Homo sapiens
attgcttacatttttacaa

SEQ ID NO: 6677610 - DNA, 22 bp, Homo sapiens
attgcttacatttttacaataa

SEQ ID NO: 6677611 - DNA, 16 bp, Homo sapiens
attgcttagtaaaatt

SEQ ID NO: 6677612 - DNA, 20 bp, Homo sapiens
attgcttagtgaaaatacta

SEQ ID NO: 6677613 - DNA, 18 bp, Homo sapiens
attgcttatctgaaatgc

SEQ ID NO: 6677614 - DNA, 17 bp, Homo sapiens
attgcttatttattgta

SEQ ID NO: 6677615 - DNA, 14 bp, Homo sapiens
attgcttattttat

SEQ ID NO: 6677616 - DNA, 16 bp, Homo sapiens
attgcttattttatta

SEQ ID NO: 6677617 - DNA, 16 bp, Homo sapiens
attgcttcaattaaaa

SEQ ID NO: 6677618 - DNA, 15 bp, Homo sapiens
attgcttcaatttca

SEQ ID NO: 6677619 - DNA, 20 bp, Homo sapiens
attgcttcacaacccatcta

SEQ ID NO: 6677620 - DNA, 15 bp, Homo sapiens
attgcttcctgatta

SEQ ID NO: 6677621 - DNA, 18 bp, Homo sapiens
attgcttcctgtgtaaca

SEQ ID NO: 6677622 - DNA, 22 bp, Homo sapiens
attgcttcctgtgtaacatctg

SEQ ID NO: 6677623 - DNA, 23 bp, Homo sapiens
attgcttcctgtgtaacatctgc

SEQ ID NO: 6677624 - DNA, 17 bp, Homo sapiens
attgcttctaaaacaat

SEQ ID NO: 6677625 - DNA, 20 bp, Homo sapiens
attgcttctaaaacaataaa

SEQ ID NO: 6677626 - DNA, 15 bp, Homo sapiens
attgcttctccctca

SEQ ID NO: 6677627 - DNA, 14 bp, Homo sapiens
attgcttctctaaa

SEQ ID NO: 6677628 - DNA, 22 bp, Homo sapiens
attgcttcttctcctatgtgta

SEQ ID NO: 6677629 - DNA, 23 bp, Homo sapiens
attgcttcttctcctatgtgtaa

SEQ ID NO: 6677630 - DNA, 22 bp, Homo sapiens
attgcttcttgtgaaaccacag

SEQ ID NO: 6677631 - DNA, 20 bp, Homo sapiens
attgcttgaacccaggaggt

SEQ ID NO: 6677632 - DNA, 19 bp, Homo sapiens
attgcttgaacctgtgagg

SEQ ID NO: 6677633 - DNA, 16 bp, Homo sapiens
attgcttgagcccaga

SEQ ID NO: 6677634 - DNA, 17 bp, Homo sapiens
attgcttgagcccagga

SEQ ID NO: 6677635 - DNA, 14 bp, Homo sapiens
attgcttgagctca

SEQ ID NO: 6677636 - DNA, 14 bp, Homo sapiens
attgcttgcacaaa

SEQ ID NO: 6677637 - DNA, 17 bp, Homo sapiens
attgcttggactaccta

SEQ ID NO: 6677638 - DNA, 21 bp, Homo sapiens
attgcttggactacctataaa

SEQ ID NO: 6677639 - DNA, 16 bp, Homo sapiens
attgcttgttggattt

SEQ ID NO: 6677640 - DNA, 13 bp, Homo sapiens
attgctttactgg

SEQ ID NO: 6677641 - DNA, 16 bp, Homo sapiens
attgctttactgtcaa

SEQ ID NO: 6677642 - DNA, 19 bp, Homo sapiens
attgctttatccagcagtc

SEQ ID NO: 6677643 - DNA, 15 bp, Homo sapiens
attgctttctgctct

SEQ ID NO: 6677644 - DNA, 17 bp, Homo sapiens
attgctttgaaaaagtt

SEQ ID NO: 6677645 - DNA, 12 bp, Homo sapiens
attgctttgcca

SEQ ID NO: 6677646 - DNA, 15 bp, Homo sapiens
attgctttgccaaaa

SEQ ID NO: 6677647 - DNA, 23 bp, Homo sapiens
attgctttgccaaaataccagag

SEQ ID NO: 6677648 - DNA, 19 bp, Homo sapiens
attgctttgggtaataaat

SEQ ID NO: 6677649 - DNA, 14 bp, Homo sapiens
attgctttgtgact

SEQ ID NO: 6677650 - DNA, 15 bp, Homo sapiens
attgctttgtgcctt

SEQ ID NO: 6677651 - DNA, 19 bp, Homo sapiens
attgcttttaaaattttaa

SEQ ID NO: 6677652 - DNA, 21 bp, Homo sapiens
attgcttttattacattagtt

SEQ ID NO: 6677653 - DNA, 18 bp, Homo sapiens
attgcttttattttgaaa

SEQ ID NO: 6677654 - DNA, 15 bp, Homo sapiens
attgcttttgtgcat

SEQ ID NO: 6677655 - DNA, 20 bp, Homo sapiens
attgcttttgttgtgacttt

SEQ ID NO: 6677656 - DNA, 23 bp, Homo sapiens
attgctttttcctctcattgtct

SEQ ID NO: 6677657 - DNA, 20 bp, Homo sapiens
attgctttttctaatgtggt

SEQ ID NO: 6677658 - DNA, 21 bp, Homo sapiens
attgcttttttccaaaacaaa

SEQ ID NO: 6677659 - DNA, 15 bp, Homo sapiens
attggaaaaaattag

SEQ ID NO: 6677660 - DNA, 12 bp, Homo sapiens
attggaaaaatc

SEQ ID NO: 6677661 - DNA, 15 bp, Homo sapiens
attggaaaagactaa

SEQ ID NO: 6677662 - DNA, 15 bp, Homo sapiens
attggaaaagggcac

SEQ ID NO: 6677663 - DNA, 14 bp, Homo sapiens
attggaaacaagtc

SEQ ID NO: 6677664 - DNA, 15 bp, Homo sapiens
attggaaagacagga

SEQ ID NO: 6677665 - DNA, 14 bp, Homo sapiens
attggaaagacttc

SEQ ID NO: 6677666 - DNA, 19 bp, Homo sapiens
attggaaagacttctcaaa

SEQ ID NO: 6677667 - DNA, 14 bp, Homo sapiens
attggaaatgtact

SEQ ID NO: 6677668 - DNA, 22 bp, Homo sapiens
attggaaatgtgaatcgcagct

SEQ ID NO: 6677669 - DNA, 15 bp, Homo sapiens
attggaaatttcacg

SEQ ID NO: 6677670 - DNA, 16 bp, Homo sapiens
attggaacagaatgtt

SEQ ID NO: 6677671 - DNA, 14 bp, Homo sapiens
attggaacttttct

SEQ ID NO: 6677672 - DNA, 12 bp, Homo sapiens
attggaagcagg

SEQ ID NO: 6677673 - DNA, 20 bp, Homo sapiens
attggaagctgattcccaga

SEQ ID NO: 6677674 - DNA, 19 bp, Homo sapiens
attggaaggagacacagat

SEQ ID NO: 6677675 - DNA, 23 bp, Homo sapiens
attggaaggtatttttttaaatt

SEQ ID NO: 6677676 - DNA, 15 bp, Homo sapiens
attggaataatcact

SEQ ID NO: 6677677 - DNA, 19 bp, Homo sapiens
attggaatcttcacctcag

SEQ ID NO: 6677678 - DNA, 22 bp, Homo sapiens
attggaatcttcacctcagagt

SEQ ID NO: 6677679 - DNA, 18 bp, Homo sapiens
attggaatgcagaggtct

SEQ ID NO: 6677680 - DNA, 14 bp, Homo sapiens
attggaatgccttg

SEQ ID NO: 6677681 - DNA, 21 bp, Homo sapiens
attggaatggaactactgtac

SEQ ID NO: 6677682 - DNA, 18 bp, Homo sapiens
attggaatgggcagctca

SEQ ID NO: 6677683 - DNA, 12 bp, Homo sapiens
attggaattaac

SEQ ID NO: 6677684 - DNA, 15 bp, Homo sapiens
attggaattctggat

SEQ ID NO: 6677685 - DNA, 21 bp, Homo sapiens
attggaatttctggcctccta

SEQ ID NO: 6677686 - DNA, 17 bp, Homo sapiens
attggacaaagaacctt

SEQ ID NO: 6677687 - DNA, 10 bp, Homo sapiens
attggacagc

SEQ ID NO: 6677688 - DNA, 22 bp, Homo sapiens
attggacagttttgatacaaac

SEQ ID NO: 6677689 - DNA, 20 bp, Homo sapiens
attggacggtttctagcctc

SEQ ID NO: 6677690 - DNA, 15 bp, Homo sapiens
attggactccaggcc

SEQ ID NO: 6677691 - DNA, 23 bp, Homo sapiens
attggactccaggcctgaccagg

SEQ ID NO: 6677692 - DNA, 14 bp, Homo sapiens
attggacttccatt

SEQ ID NO: 6677693 - DNA, 15 bp, Homo sapiens
attggacttccattt

SEQ ID NO: 6677694 - DNA, 14 bp, Homo sapiens
attggacttccttg

SEQ ID NO: 6677695 - DNA, 17 bp, Homo sapiens
attggagaaaagcactt

SEQ ID NO: 6677696 - DNA, 18 bp, Homo sapiens
attggagaaaagcactta

SEQ ID NO: 6677697 - DNA, 15 bp, Homo sapiens
attggagaatacttt

SEQ ID NO: 6677698 - DNA, 17 bp, Homo sapiens
attggagatagggaaag

SEQ ID NO: 6677699 - DNA, 16 bp, Homo sapiens
attggagatgcaaata

SEQ ID NO: 6677700 - DNA, 17 bp, Homo sapiens
attggagccaccatgcc

SEQ ID NO: 6677701 - DNA, 14 bp, Homo sapiens
attggagctgaaga

SEQ ID NO: 6677702 - DNA, 23 bp, Homo sapiens
attggaggaaagcaaccggtgga

SEQ ID NO: 6677703 - DNA, 19 bp, Homo sapiens
attggaggtgagatcacag

SEQ ID NO: 6677704 - DNA, 16 bp, Homo sapiens
attggataaagcagct

SEQ ID NO: 6677705 - DNA, 15 bp, Homo sapiens
attggataacaccac

SEQ ID NO: 6677706 - DNA, 20 bp, Homo sapiens
attggatacagcagtagaca

SEQ ID NO: 6677707 - DNA, 18 bp, Homo sapiens
attggataccccattaaa

SEQ ID NO: 6677708 - DNA, 21 bp, Homo sapiens
attggatattctcctcggact

SEQ ID NO: 6677709 - DNA, 11 bp, Homo sapiens
attggatattt

SEQ ID NO: 6677710 - DNA, 16 bp, Homo sapiens
attggattatcctgag

SEQ ID NO: 6677711 - DNA, 21 bp, Homo sapiens
attggattattcatttaaaat

SEQ ID NO: 6677712 - DNA, 17 bp, Homo sapiens
attggattatttaataa

SEQ ID NO: 6677713 - DNA, 22 bp, Homo sapiens
attggattctgagagctgtgca

SEQ ID NO: 6677714 - DNA, 19 bp, Homo sapiens
attggatttgctgtgacta

SEQ ID NO: 6677715 - DNA, 18 bp, Homo sapiens
attggatttgtccaaaca

SEQ ID NO: 6677716 - DNA, 19 bp, Homo sapiens
attggatttgtccaaacag

SEQ ID NO: 6677717 - DNA, 16 bp, Homo sapiens
attggatttgtctttg

SEQ ID NO: 6677718 - DNA, 17 bp, Homo sapiens
attggattttatgttga

SEQ ID NO: 6677719 - DNA, 22 bp, Homo sapiens
attggattttatgttgacattt

SEQ ID NO: 6677720 - DNA, 19 bp, Homo sapiens
attggcaaagatgtgggga

SEQ ID NO: 6677721 - DNA, 12 bp, Homo sapiens
attggcaaagtt

SEQ ID NO: 6677722 - DNA, 18 bp, Homo sapiens
attggcaagtaacttctg

SEQ ID NO: 6677723 - DNA, 19 bp, Homo sapiens
attggcaagtaacttctga

SEQ ID NO: 6677724 - DNA, 21 bp, Homo sapiens
attggcacaagctccctggtg

SEQ ID NO: 6677725 - DNA, 11 bp, Homo sapiens
attggcacagt

SEQ ID NO: 6677726 - DNA, 18 bp, Homo sapiens
attggcaccgaagcccag

SEQ ID NO: 6677727 - DNA, 16 bp, Homo sapiens
attggcagattgtttt

SEQ ID NO: 6677728 - DNA, 15 bp, Homo sapiens
attggcagcacagct

SEQ ID NO: 6677729 - DNA, 13 bp, Homo sapiens
attggcagcagat

SEQ ID NO: 6677730 - DNA, 18 bp, Homo sapiens
attggcagcaggtgctgc

SEQ ID NO: 6677731 - DNA, 17 bp, Homo sapiens
attggcagccaaggaat

SEQ ID NO: 6677732 - DNA, 21 bp, Homo sapiens
attggcagccaaggaatgtgt

SEQ ID NO: 6677733 - DNA, 22 bp, Homo sapiens
attggcagctcaaagacttcca

SEQ ID NO: 6677734 - DNA, 14 bp, Homo sapiens
attggcaggaggca

SEQ ID NO: 6677735 - DNA, 14 bp, Homo sapiens
attggcatctgctt

SEQ ID NO: 6677736 - DNA, 16 bp, Homo sapiens
attggcatctgctttt

SEQ ID NO: 6677737 - DNA, 18 bp, Homo sapiens
attggcatggttgttgca

SEQ ID NO: 6677738 - DNA, 16 bp, Homo sapiens
attggcattaaaactt

SEQ ID NO: 6677739 - DNA, 20 bp, Homo sapiens
attggcattttaagtgttta

SEQ ID NO: 6677740 - DNA, 21 bp, Homo sapiens
attggccacctgtagccatct

SEQ ID NO: 6677741 - DNA, 21 bp, Homo sapiens
attggccactggatcctgctg

SEQ ID NO: 6677742 - DNA, 13 bp, Homo sapiens
attggccactggg

SEQ ID NO: 6677743 - DNA, 22 bp, Homo sapiens
attggccctgacaaaaaggtgc

SEQ ID NO: 6677744 - DNA, 15 bp, Homo sapiens
attggccctgcccct

SEQ ID NO: 6677745 - DNA, 16 bp, Homo sapiens
attggccctgcccctc

SEQ ID NO: 6677746 - DNA, 18 bp, Homo sapiens
attggccctgcccctccc

SEQ ID NO: 6677747 - DNA, 18 bp, Homo sapiens
attggccgagctcctggg

SEQ ID NO: 6677748 - DNA, 17 bp, Homo sapiens
attggccgatgagctgg

SEQ ID NO: 6677749 - DNA, 14 bp, Homo sapiens
attggcctctgtct

SEQ ID NO: 6677750 - DNA, 12 bp, Homo sapiens
attggcctgaac

SEQ ID NO: 6677751 - DNA, 22 bp, Homo sapiens
attggcctgaacagatgtaaat

SEQ ID NO: 6677752 - DNA, 11 bp, Homo sapiens
attggcctgga

SEQ ID NO: 6677753 - DNA, 12 bp, Homo sapiens
attggcctggag

SEQ ID NO: 6677754 - DNA, 23 bp, Homo sapiens
attggcctggcaaaataaaacat

SEQ ID NO: 6677755 - DNA, 17 bp, Homo sapiens
attggcctggccagacc

SEQ ID NO: 6677756 - DNA, 20 bp, Homo sapiens
attggcctgtagagttgctg

SEQ ID NO: 6677757 - DNA, 21 bp, Homo sapiens
attggcctgtagagttgctga

SEQ ID NO: 6677758 - DNA, 18 bp, Homo sapiens
attggcctgtgtctggcc

SEQ ID NO: 6677759 - DNA, 19 bp, Homo sapiens
attggccttttacctggat

SEQ ID NO: 6677760 - DNA, 23 bp, Homo sapiens
attggcgttgtttgtggctgttg

SEQ ID NO: 6677761 - DNA, 20 bp, Homo sapiens
attggctagaatcagggtgg

SEQ ID NO: 6677762 - DNA, 17 bp, Homo sapiens
attggctagttgaatct

SEQ ID NO: 6677763 - DNA, 18 bp, Homo sapiens
attggctatttaaaactt

SEQ ID NO: 6677764 - DNA, 15 bp, Homo sapiens
attggctcacactga

SEQ ID NO: 6677765 - DNA, 17 bp, Homo sapiens
attggctcacactgaga

SEQ ID NO: 6677766 - DNA, 21 bp, Homo sapiens
attggctcacccaagcaaggc

SEQ ID NO: 6677767 - DNA, 20 bp, Homo sapiens
attggctcccaactcctccc

SEQ ID NO: 6677768 - DNA, 13 bp, Homo sapiens
attggctcctcca

SEQ ID NO: 6677769 - DNA, 21 bp, Homo sapiens
attggctcttgaactgagctt

SEQ ID NO: 6677770 - DNA, 14 bp, Homo sapiens
attggctgagagac

SEQ ID NO: 6677771 - DNA, 22 bp, Homo sapiens
attggctgcttaaactggaaag

SEQ ID NO: 6677772 - DNA, 11 bp, Homo sapiens
attggcttaaa

SEQ ID NO: 6677773 - DNA, 20 bp, Homo sapiens
attggcttaaaatgtactct

SEQ ID NO: 6677774 - DNA, 16 bp, Homo sapiens
attggcttaaagtgaa

SEQ ID NO: 6677775 - DNA, 22 bp, Homo sapiens
attggcttaaagtgaaggaaat

SEQ ID NO: 6677776 - DNA, 19 bp, Homo sapiens
attggcttactgaaagaca

SEQ ID NO: 6677777 - DNA, 20 bp, Homo sapiens
attggcttactgaaagacag

SEQ ID NO: 6677778 - DNA, 21 bp, Homo sapiens
attggcttattttttaaaata

SEQ ID NO: 6677779 - DNA, 18 bp, Homo sapiens
attggcttgcactttgtg

SEQ ID NO: 6677780 - DNA, 14 bp, Homo sapiens
attggcttgtagaa

SEQ ID NO: 6677781 - DNA, 22 bp, Homo sapiens
attggcttgtagaattgttata

SEQ ID NO: 6677782 - DNA, 17 bp, Homo sapiens
attggcttgtgtgtttc

SEQ ID NO: 6677783 - DNA, 18 bp, Homo sapiens
attggcttgtgtgtttca

SEQ ID NO: 6677784 - DNA, 22 bp, Homo sapiens
attggcttgtgtgtttcacttt

SEQ ID NO: 6677785 - DNA, 12 bp, Homo sapiens
attggcttgttt

SEQ ID NO: 6677786 - DNA, 21 bp, Homo sapiens
attggctttatcctctttaga

SEQ ID NO: 6677787 - DNA, 15 bp, Homo sapiens
attggctttcaagtg

SEQ ID NO: 6677788 - DNA, 23 bp, Homo sapiens
attggctttgggttgcaggacct

SEQ ID NO: 6677789 - DNA, 16 bp, Homo sapiens
attggcttttcatgcg

SEQ ID NO: 6677790 - DNA, 19 bp, Homo sapiens
attggctttttcagagtca

SEQ ID NO: 6677791 - DNA, 15 bp, Homo sapiens
attgggaaaacattt

SEQ ID NO: 6677792 - DNA, 20 bp, Homo sapiens
attgggaaggggacccccgc

SEQ ID NO: 6677793 - DNA, 16 bp, Homo sapiens
attgggaataaatatg

SEQ ID NO: 6677794 - DNA, 17 bp, Homo sapiens
attgggaataaatatgc

SEQ ID NO: 6677795 - DNA, 15 bp, Homo sapiens
attgggaccctccag

SEQ ID NO: 6677796 - DNA, 19 bp, Homo sapiens
attgggacgtagagcacag

SEQ ID NO: 6677797 - DNA, 20 bp, Homo sapiens
attgggagcaatctggaaaa

SEQ ID NO: 6677798 - DNA, 18 bp, Homo sapiens
attgggagcttgggaatg

SEQ ID NO: 6677799 - DNA, 13 bp, Homo sapiens
attgggagtagga

SEQ ID NO: 6677800 - DNA, 22 bp, Homo sapiens
attgggatgtgagccccagggg

SEQ ID NO: 6677801 - DNA, 17 bp, Homo sapiens
attgggcaataaaagat

SEQ ID NO: 6677802 - DNA, 22 bp, Homo sapiens
attgggcacagtccagacccaa

SEQ ID NO: 6677803 - DNA, 18 bp, Homo sapiens
attgggcacatcatttca

SEQ ID NO: 6677804 - DNA, 21 bp, Homo sapiens
attgggcacatcatttcaaga

SEQ ID NO: 6677805 - DNA, 18 bp, Homo sapiens
attgggcagaatcctggg

SEQ ID NO: 6677806 - DNA, 22 bp, Homo sapiens
attgggcagaatcctgggcccc

SEQ ID NO: 6677807 - DNA, 13 bp, Homo sapiens
attgggcaggagg

SEQ ID NO: 6677808 - DNA, 14 bp, Homo sapiens
attgggcaggagga

SEQ ID NO: 6677809 - DNA, 17 bp, Homo sapiens
attgggccaacaaggac

SEQ ID NO: 6677810 - DNA, 13 bp, Homo sapiens
attgggcccccag

SEQ ID NO: 6677811 - DNA, 15 bp, Homo sapiens
attgggcccctgcca

SEQ ID NO: 6677812 - DNA, 16 bp, Homo sapiens
attgggcccctgccag

SEQ ID NO: 6677813 - DNA, 15 bp, Homo sapiens
attgggcggggcttc

SEQ ID NO: 6677814 - DNA, 15 bp, Homo sapiens
attgggctcagagag

SEQ ID NO: 6677815 - DNA, 14 bp, Homo sapiens
attggggaagaaaa

SEQ ID NO: 6677816 - DNA, 17 bp, Homo sapiens
attggggaagaaaaaat

SEQ ID NO: 6677817 - DNA, 19 bp, Homo sapiens
attggggaattaaatagtg

SEQ ID NO: 6677818 - DNA, 20 bp, Homo sapiens
attggggaattaaatagtgt

SEQ ID NO: 6677819 - DNA, 12 bp, Homo sapiens
attggggaggga

SEQ ID NO: 6677820 - DNA, 13 bp, Homo sapiens
attggggagggag

SEQ ID NO: 6677821 - DNA, 14 bp, Homo sapiens
attggggagggaga

SEQ ID NO: 6677822 - DNA, 20 bp, Homo sapiens
attggggattcttaaagttg

SEQ ID NO: 6677823 - DNA, 15 bp, Homo sapiens
attggggctcccagc

SEQ ID NO: 6677824 - DNA, 22 bp, Homo sapiens
attggggctcccagccaggccc

SEQ ID NO: 6677825 - DNA, 21 bp, Homo sapiens
attggggggaaagagggagca

SEQ ID NO: 6677826 - DNA, 17 bp, Homo sapiens
attggggggtgggcttt

SEQ ID NO: 6677827 - DNA, 15 bp, Homo sapiens
attggggtccctcta

SEQ ID NO: 6677828 - DNA, 13 bp, Homo sapiens
attggggtgacct

SEQ ID NO: 6677829 - DNA, 19 bp, Homo sapiens
attggggtgataaggggcc

SEQ ID NO: 6677830 - DNA, 12 bp, Homo sapiens
attggggtgatg

SEQ ID NO: 6677831 - DNA, 14 bp, Homo sapiens
attggggttatttt

SEQ ID NO: 6677832 - DNA, 16 bp, Homo sapiens
attggggttggggggg

SEQ ID NO: 6677833 - DNA, 15 bp, Homo sapiens
attgggtatcaccac

SEQ ID NO: 6677834 - DNA, 18 bp, Homo sapiens
attgggtctattccagct

SEQ ID NO: 6677835 - DNA, 21 bp, Homo sapiens
attgggtctattccagctcat

SEQ ID NO: 6677836 - DNA, 13 bp, Homo sapiens
attgggtgtgccc

SEQ ID NO: 6677837 - DNA, 16 bp, Homo sapiens
attgggtgtgccctgg

SEQ ID NO: 6677838 - DNA, 19 bp, Homo sapiens
attgggtgtgccctggctc

SEQ ID NO: 6677839 - DNA, 13 bp, Homo sapiens
attgggttcatta

SEQ ID NO: 6677840 - DNA, 22 bp, Homo sapiens
attgggtttggggccatggtgg

SEQ ID NO: 6677841 - DNA, 16 bp, Homo sapiens
attgggttttatcagt

SEQ ID NO: 6677842 - DNA, 13 bp, Homo sapiens
attgggtttttat

SEQ ID NO: 6677843 - DNA, 21 bp, Homo sapiens
attggtaaaactcactgtgat

SEQ ID NO: 6677844 - DNA, 19 bp, Homo sapiens
attggtaaattctggtata

SEQ ID NO: 6677845 - DNA, 22 bp, Homo sapiens
attggtaactgcctggcctggc

SEQ ID NO: 6677846 - DNA, 17 bp, Homo sapiens
attggtaattaaaagac

SEQ ID NO: 6677847 - DNA, 18 bp, Homo sapiens
attggtaattaaaagact

SEQ ID NO: 6677848 - DNA, 23 bp, Homo sapiens
attggtaattaaaagactccaca

SEQ ID NO: 6677849 - DNA, 17 bp, Homo sapiens
attggtaggatttatat

SEQ ID NO: 6677850 - DNA, 18 bp, Homo sapiens
attggtatcaagaaagtc

SEQ ID NO: 6677851 - DNA, 18 bp, Homo sapiens
attggtattaaagaatgc

SEQ ID NO: 6677852 - DNA, 17 bp, Homo sapiens
attggtcatggtagatt

SEQ ID NO: 6677853 - DNA, 18 bp, Homo sapiens
attggtcatttagagttt

SEQ ID NO: 6677854 - DNA, 23 bp, Homo sapiens
attggtcatttagagtttcacag

SEQ ID NO: 6677855 - DNA, 23 bp, Homo sapiens
attggtccaacagtttgatgctg

SEQ ID NO: 6677856 - DNA, 20 bp, Homo sapiens
attggtccaacccagcctga

SEQ ID NO: 6677857 - DNA, 14 bp, Homo sapiens
attggtccagcttg

SEQ ID NO: 6677858 - DNA, 15 bp, Homo sapiens
attggtccagcttgc

SEQ ID NO: 6677859 - DNA, 18 bp, Homo sapiens
attggtctaatttattca

SEQ ID NO: 6677860 - DNA, 18 bp, Homo sapiens
attggtctatctactggc

SEQ ID NO: 6677861 - DNA, 17 bp, Homo sapiens
attggtctcctctcagc

SEQ ID NO: 6677862 - DNA, 15 bp, Homo sapiens
attggtctctatctc

SEQ ID NO: 6677863 - DNA, 22 bp, Homo sapiens
attggtcttaatgttgaatgta

SEQ ID NO: 6677864 - DNA, 21 bp, Homo sapiens
attggtcttgccctattataa

SEQ ID NO: 6677865 - DNA, 22 bp, Homo sapiens
attggtgacgatgggtgttgct

SEQ ID NO: 6677866 - DNA, 12 bp, Homo sapiens
attggtgactca

SEQ ID NO: 6677867 - DNA, 15 bp, Homo sapiens
attggtgactcactt

SEQ ID NO: 6677868 - DNA, 13 bp, Homo sapiens
attggtgataagt

SEQ ID NO: 6677869 - DNA, 21 bp, Homo sapiens
attggtgctatttgaagaaaa

SEQ ID NO: 6677870 - DNA, 16 bp, Homo sapiens
attggtgctttgtgtc

SEQ ID NO: 6677871 - DNA, 17 bp, Homo sapiens
attggtgctttgtgtct

SEQ ID NO: 6677872 - DNA, 13 bp, Homo sapiens
attggtggaattc

SEQ ID NO: 6677873 - DNA, 20 bp, Homo sapiens
attggtggccggtggttttg

SEQ ID NO: 6677874 - DNA, 18 bp, Homo sapiens
attggtgggattttttgt

SEQ ID NO: 6677875 - DNA, 10 bp, Homo sapiens
attggtgtac

SEQ ID NO: 6677876 - DNA, 13 bp, Homo sapiens
attggtgtatatc

SEQ ID NO: 6677877 - DNA, 13 bp, Homo sapiens
attggtgtatatt

SEQ ID NO: 6677878 - DNA, 18 bp, Homo sapiens
attggtgtgaatgctgta

SEQ ID NO: 6677879 - DNA, 22 bp, Homo sapiens
attggtgttcgtttccatcatg

SEQ ID NO: 6677880 - DNA, 15 bp, Homo sapiens
attggtgttgcagcc

SEQ ID NO: 6677881 - DNA, 20 bp, Homo sapiens
attggtgttgcagccgcaga

SEQ ID NO: 6677882 - DNA, 14 bp, Homo sapiens
attggtgttgtact

SEQ ID NO: 6677883 - DNA, 22 bp, Homo sapiens
attggtgttgtactcaatttta

SEQ ID NO: 6677884 - DNA, 19 bp, Homo sapiens
attggtgtttttttctatg

SEQ ID NO: 6677885 - DNA, 15 bp, Homo sapiens
attggttaaaatgtg

SEQ ID NO: 6677886 - DNA, 17 bp, Homo sapiens
attggttaaaatgtgat

SEQ ID NO: 6677887 - DNA, 14 bp, Homo sapiens
attggttaatgaaa

SEQ ID NO: 6677888 - DNA, 15 bp, Homo sapiens
attggttaatgaaaa

SEQ ID NO: 6677889 - DNA, 15 bp, Homo sapiens
attggttagtattta

SEQ ID NO: 6677890 - DNA, 16 bp, Homo sapiens
attggttattaaactg

SEQ ID NO: 6677891 - DNA, 19 bp, Homo sapiens
attggttattaaactgaat

SEQ ID NO: 6677892 - DNA, 16 bp, Homo sapiens
attggttcatgcctgg

SEQ ID NO: 6677893 - DNA, 18 bp, Homo sapiens
attggttcatgcctgggg

SEQ ID NO: 6677894 - DNA, 17 bp, Homo sapiens
attggttccctttgctc

SEQ ID NO: 6677895 - DNA, 18 bp, Homo sapiens
attggttccctttgctcc

SEQ ID NO: 6677896 - DNA, 15 bp, Homo sapiens
attggttctatttat

SEQ ID NO: 6677897 - DNA, 13 bp, Homo sapiens
attggttcttccc

SEQ ID NO: 6677898 - DNA, 16 bp, Homo sapiens
attggttggtgtgaag

SEQ ID NO: 6677899 - DNA, 13 bp, Homo sapiens
attggtttaaact

SEQ ID NO: 6677900 - DNA, 20 bp, Homo sapiens
attggtttaaacttttatgc

SEQ ID NO: 6677901 - DNA, 15 bp, Homo sapiens
attggtttaaagaaa

SEQ ID NO: 6677902 - DNA, 18 bp, Homo sapiens
attggtttaaagaaagtg

SEQ ID NO: 6677903 - DNA, 14 bp, Homo sapiens
attggtttctcttc

SEQ ID NO: 6677904 - DNA, 15 bp, Homo sapiens
attggtttctcttct

SEQ ID NO: 6677905 - DNA, 16 bp, Homo sapiens
attggtttctcttctc

SEQ ID NO: 6677906 - DNA, 17 bp, Homo sapiens
attggtttgagaaaggc

SEQ ID NO: 6677907 - DNA, 17 bp, Homo sapiens
attggtttgcacaagtt

SEQ ID NO: 6677908 - DNA, 22 bp, Homo sapiens
attggtttggcaagaacttgtt

SEQ ID NO: 6677909 - DNA, 23 bp, Homo sapiens
attggtttgttattcttttccag

SEQ ID NO: 6677910 - DNA, 15 bp, Homo sapiens
attggttttatgatg

SEQ ID NO: 6677911 - DNA, 18 bp, Homo sapiens
attggttttatgatgacg

SEQ ID NO: 6677912 - DNA, 22 bp, Homo sapiens
attggttttccaatcatttgac

SEQ ID NO: 6677913 - DNA, 16 bp, Homo sapiens
attggtttttactgaa

SEQ ID NO: 6677914 - DNA, 21 bp, Homo sapiens
attgtaaaaaaaaatgccttt

SEQ ID NO: 6677915 - DNA, 22 bp, Homo sapiens
attgtaaaaaaggttttctata

SEQ ID NO: 6677916 - DNA, 16 bp, Homo sapiens
attgtaaaaaattcac

SEQ ID NO: 6677917 - DNA, 20 bp, Homo sapiens
attgtaaaaaattcacataa

SEQ ID NO: 6677918 - DNA, 14 bp, Homo sapiens
attgtaaaaacaaa

SEQ ID NO: 6677919 - DNA, 16 bp, Homo sapiens
attgtaaaaataatca

SEQ ID NO: 6677920 - DNA, 15 bp, Homo sapiens
attgtaaaaatggca

SEQ ID NO: 6677921 - DNA, 17 bp, Homo sapiens
attgtaaaactgaggca

SEQ ID NO: 6677922 - DNA, 13 bp, Homo sapiens
attgtaaaagcat

SEQ ID NO: 6677923 - DNA, 19 bp, Homo sapiens
attgtaaaagcattttgta

SEQ ID NO: 6677924 - DNA, 13 bp, Homo sapiens
attgtaaaataat

SEQ ID NO: 6677925 - DNA, 15 bp, Homo sapiens
attgtaaaatagctt

SEQ ID NO: 6677926 - DNA, 20 bp, Homo sapiens
attgtaaaattatttcatga

SEQ ID NO: 6677927 - DNA, 15 bp, Homo sapiens
attgtaaaattgtat

SEQ ID NO: 6677928 - DNA, 14 bp, Homo sapiens
attgtaaacaaact

SEQ ID NO: 6677929 - DNA, 23 bp, Homo sapiens
attgtaaacaaactgtgtaactg

SEQ ID NO: 6677930 - DNA, 14 bp, Homo sapiens
attgtaaactaaag

SEQ ID NO: 6677931 - DNA, 12 bp, Homo sapiens
attgtaaactgt

SEQ ID NO: 6677932 - DNA, 13 bp, Homo sapiens
attgtaaactgta

SEQ ID NO: 6677933 - DNA, 13 bp, Homo sapiens
attgtaaagaagg

SEQ ID NO: 6677934 - DNA, 19 bp, Homo sapiens
attgtaaaggtaggtgcat

SEQ ID NO: 6677935 - DNA, 18 bp, Homo sapiens
attgtaaaggtgatgaat

SEQ ID NO: 6677936 - DNA, 12 bp, Homo sapiens
attgtaaagtaa

SEQ ID NO: 6677937 - DNA, 16 bp, Homo sapiens
attgtaaagtatgtga

SEQ ID NO: 6677938 - DNA, 19 bp, Homo sapiens
attgtaaagtatgtgagta

SEQ ID NO: 6677939 - DNA, 15 bp, Homo sapiens
attgtaaatacaagt

SEQ ID NO: 6677940 - DNA, 13 bp, Homo sapiens
attgtaaatactg

SEQ ID NO: 6677941 - DNA, 18 bp, Homo sapiens
attgtaaatactggactc

SEQ ID NO: 6677942 - DNA, 19 bp, Homo sapiens
attgtaaatactggactca

SEQ ID NO: 6677943 - DNA, 14 bp, Homo sapiens
attgtaaatagtat

SEQ ID NO: 6677944 - DNA, 16 bp, Homo sapiens
attgtaaatatgtttt

SEQ ID NO: 6677945 - DNA, 14 bp, Homo sapiens
attgtaaatattgt

SEQ ID NO: 6677946 - DNA, 20 bp, Homo sapiens
attgtaaatatttactcttt

SEQ ID NO: 6677947 - DNA, 15 bp, Homo sapiens
attgtaaatattttg

SEQ ID NO: 6677948 - DNA, 15 bp, Homo sapiens
attgtaaatctgaag

SEQ ID NO: 6677949 - DNA, 16 bp, Homo sapiens
attgtaaatgaacata

SEQ ID NO: 6677950 - DNA, 18 bp, Homo sapiens
attgtaaatgaacataat

SEQ ID NO: 6677951 - DNA, 19 bp, Homo sapiens
attgtaaatgctattatac

SEQ ID NO: 6677952 - DNA, 14 bp, Homo sapiens
attgtaaatgtgct

SEQ ID NO: 6677953 - DNA, 17 bp, Homo sapiens
attgtaaatgtgctttt

SEQ ID NO: 6677954 - DNA, 13 bp, Homo sapiens
attgtaaattatt

SEQ ID NO: 6677955 - DNA, 18 bp, Homo sapiens
attgtaaatttggattta

SEQ ID NO: 6677956 - DNA, 15 bp, Homo sapiens
attgtaaattttaga

SEQ ID NO: 6677957 - DNA, 17 bp, Homo sapiens
attgtaacagacattgt

SEQ ID NO: 6677958 - DNA, 18 bp, Homo sapiens
attgtaacagacattgtt

SEQ ID NO: 6677959 - DNA, 19 bp, Homo sapiens
attgtaacagacattgttt

SEQ ID NO: 6677960 - DNA, 14 bp, Homo sapiens
attgtaacatattt

SEQ ID NO: 6677961 - DNA, 16 bp, Homo sapiens
attgtaacgttgctgt

SEQ ID NO: 6677962 - DNA, 18 bp, Homo sapiens
attgtaacgttgctgtgg

SEQ ID NO: 6677963 - DNA, 20 bp, Homo sapiens
attgtaacgttgctgtggga

SEQ ID NO: 6677964 - DNA, 21 bp, Homo sapiens
attgtaacgttgctgtgggaa

SEQ ID NO: 6677965 - DNA, 13 bp, Homo sapiens
attgtaactgttc

SEQ ID NO: 6677966 - DNA, 15 bp, Homo sapiens
attgtaactgttctt

SEQ ID NO: 6677967 - DNA, 15 bp, Homo sapiens
attgtaacttggatg

SEQ ID NO: 6677968 - DNA, 18 bp, Homo sapiens
attgtaagcatgcacaaa

SEQ ID NO: 6677969 - DNA, 20 bp, Homo sapiens
attgtaagccagagtcaaca

SEQ ID NO: 6677970 - DNA, 17 bp, Homo sapiens
attgtaagcgtatggct

SEQ ID NO: 6677971 - DNA, 19 bp, Homo sapiens
attgtaagcgtatggcttt

SEQ ID NO: 6677972 - DNA, 17 bp, Homo sapiens
attgtaaggtctttgta

SEQ ID NO: 6677973 - DNA, 19 bp, Homo sapiens
attgtaaggtctttgtaaa

SEQ ID NO: 6677974 - DNA, 18 bp, Homo sapiens
attgtaagtgaaattaag

SEQ ID NO: 6677975 - DNA, 20 bp, Homo sapiens
attgtaagtgaagtaaaact

SEQ ID NO: 6677976 - DNA, 19 bp, Homo sapiens
attgtaagttgtacaaatg

SEQ ID NO: 6677977 - DNA, 15 bp, Homo sapiens
attgtaatacacata

SEQ ID NO: 6677978 - DNA, 15 bp, Homo sapiens
attgtaatatagaaa

SEQ ID NO: 6677979 - DNA, 14 bp, Homo sapiens
attgtaatatgaca

SEQ ID NO: 6677980 - DNA, 19 bp, Homo sapiens
attgtaatatgacagataa

SEQ ID NO: 6677981 - DNA, 13 bp, Homo sapiens
attgtaatcataa

SEQ ID NO: 6677982 - DNA, 16 bp, Homo sapiens
attgtaatctgaataa

SEQ ID NO: 6677983 - DNA, 15 bp, Homo sapiens
attgtaatctttcat

SEQ ID NO: 6677984 - DNA, 21 bp, Homo sapiens
attgtaatgaatatctgcttt

SEQ ID NO: 6677985 - DNA, 22 bp, Homo sapiens
attgtaatgccaatatgacaca

SEQ ID NO: 6677986 - DNA, 13 bp, Homo sapiens
attgtaatgtaat

SEQ ID NO: 6677987 - DNA, 14 bp, Homo sapiens
attgtaatgtaata

SEQ ID NO: 6677988 - DNA, 16 bp, Homo sapiens
attgtaatgtatactt

SEQ ID NO: 6677989 - DNA, 13 bp, Homo sapiens
attgtaatgttac

SEQ ID NO: 6677990 - DNA, 17 bp, Homo sapiens
attgtaatgttgtgaat

SEQ ID NO: 6677991 - DNA, 22 bp, Homo sapiens
attgtaatgttgtgaataatta

SEQ ID NO: 6677992 - DNA, 14 bp, Homo sapiens
attgtaattatatc

SEQ ID NO: 6677993 - DNA, 17 bp, Homo sapiens
attgtaattatatctga

SEQ ID NO: 6677994 - DNA, 18 bp, Homo sapiens
attgtaattatgtaaata

SEQ ID NO: 6677995 - DNA, 13 bp, Homo sapiens
attgtaattccaa

SEQ ID NO: 6677996 - DNA, 22 bp, Homo sapiens
attgtaattttgttcctgttta

SEQ ID NO: 6677997 - DNA, 13 bp, Homo sapiens
attgtacaaaaaa

SEQ ID NO: 6677998 - DNA, 18 bp, Homo sapiens
attgtacaaaattaagca

SEQ ID NO: 6677999 - DNA, 22 bp, Homo sapiens
attgtacaaagtattaagcata

SEQ ID NO: 6678000 - DNA, 13 bp, Homo sapiens
attgtacaacctg

SEQ ID NO: 6678001 - DNA, 21 bp, Homo sapiens
attgtacaagcagttaatcac

SEQ ID NO: 6678002 - DNA, 19 bp, Homo sapiens
attgtacactaacatattt

SEQ ID NO: 6678003 - DNA, 15 bp, Homo sapiens
attgtacactatcta

SEQ ID NO: 6678004 - DNA, 21 bp, Homo sapiens
attgtacagaatcattgctta

SEQ ID NO: 6678005 - DNA, 22 bp, Homo sapiens
attgtacagactgttttactgt

SEQ ID NO: 6678006 - DNA, 16 bp, Homo sapiens
attgtacagctgttta

SEQ ID NO: 6678007 - DNA, 17 bp, Homo sapiens
attgtacagtttgttta

SEQ ID NO: 6678008 - DNA, 18 bp, Homo sapiens
attgtacagtttgtttac

SEQ ID NO: 6678009 - DNA, 14 bp, Homo sapiens
attgtacagttttt

SEQ ID NO: 6678010 - DNA, 19 bp, Homo sapiens
attgtacatatggaaatcc

SEQ ID NO: 6678011 - DNA, 19 bp, Homo sapiens
attgtacatatttttatat

SEQ ID NO: 6678012 - DNA, 23 bp, Homo sapiens
attgtacatttatttattactgt

SEQ ID NO: 6678013 - DNA, 17 bp, Homo sapiens
attgtacccttcttgtc

SEQ ID NO: 6678014 - DNA, 20 bp, Homo sapiens
attgtacccttcttgtctct

SEQ ID NO: 6678015 - DNA, 21 bp, Homo sapiens
attgtacccttcttgtctctc

SEQ ID NO: 6678016 - DNA, 18 bp, Homo sapiens
attgtacctctcttatag

SEQ ID NO: 6678017 - DNA, 14 bp, Homo sapiens
attgtaccttttaa

SEQ ID NO: 6678018 - DNA, 17 bp, Homo sapiens
attgtacgtagccacag

SEQ ID NO: 6678019 - DNA, 18 bp, Homo sapiens
attgtactaatctgagat

SEQ ID NO: 6678020 - DNA, 18 bp, Homo sapiens
attgtactcaatggattt

SEQ ID NO: 6678021 - DNA, 22 bp, Homo sapiens
attgtactcaatggatttgatg

SEQ ID NO: 6678022 - DNA, 15 bp, Homo sapiens
attgtactccagcct

SEQ ID NO: 6678023 - DNA, 15 bp, Homo sapiens
attgtactgttcata

SEQ ID NO: 6678024 - DNA, 20 bp, Homo sapiens
attgtactgttgctttaata

SEQ ID NO: 6678025 - DNA, 16 bp, Homo sapiens
attgtactgtttttaa

SEQ ID NO: 6678026 - DNA, 14 bp, Homo sapiens
attgtacttagcca

SEQ ID NO: 6678027 - DNA, 22 bp, Homo sapiens
attgtacttagccagttcaaag

SEQ ID NO: 6678028 - DNA, 23 bp, Homo sapiens
attgtacttagccagttcaaagt

SEQ ID NO: 6678029 - DNA, 20 bp, Homo sapiens
attgtacttggagtaattgc

SEQ ID NO: 6678030 - DNA, 13 bp, Homo sapiens
attgtactttgaa

SEQ ID NO: 6678031 - DNA, 19 bp, Homo sapiens
attgtagaaacacagtttt

SEQ ID NO: 6678032 - DNA, 16 bp, Homo sapiens
attgtagaaagctaat

SEQ ID NO: 6678033 - DNA, 20 bp, Homo sapiens
attgtagaaagctaatacaa

SEQ ID NO: 6678034 - DNA, 17 bp, Homo sapiens
attgtagaattgtatat

SEQ ID NO: 6678035 - DNA, 19 bp, Homo sapiens
attgtagactgatgtttta

SEQ ID NO: 6678036 - DNA, 20 bp, Homo sapiens
attgtagagaaaaaaaaata

SEQ ID NO: 6678037 - DNA, 19 bp, Homo sapiens
attgtagagcacatttagt

SEQ ID NO: 6678038 - DNA, 15 bp, Homo sapiens
attgtagagtgccca

SEQ ID NO: 6678039 - DNA, 21 bp, Homo sapiens
attgtagagtgcccatggggt

SEQ ID NO: 6678040 - DNA, 17 bp, Homo sapiens
attgtagataatactgt

SEQ ID NO: 6678041 - DNA, 17 bp, Homo sapiens
attgtagatggaaatca

SEQ ID NO: 6678042 - DNA, 22 bp, Homo sapiens
attgtagcaataagctggacta

SEQ ID NO: 6678043 - DNA, 17 bp, Homo sapiens
attgtagcatcctggaa

SEQ ID NO: 6678044 - DNA, 18 bp, Homo sapiens
attgtagcatttcttgat

SEQ ID NO: 6678045 - DNA, 15 bp, Homo sapiens
attgtagcccagttg

SEQ ID NO: 6678046 - DNA, 20 bp, Homo sapiens
attgtagcgtctttcttttt

SEQ ID NO: 6678047 - DNA, 13 bp, Homo sapiens
attgtagtaatct

SEQ ID NO: 6678048 - DNA, 14 bp, Homo sapiens
attgtagtgcaaaa

SEQ ID NO: 6678049 - DNA, 16 bp, Homo sapiens
attgtagtgcaaaatg

SEQ ID NO: 6678050 - DNA, 18 bp, Homo sapiens
attgtagtgcaaaatggt

SEQ ID NO: 6678051 - DNA, 16 bp, Homo sapiens
attgtagttctgtgta

SEQ ID NO: 6678052 - DNA, 15 bp, Homo sapiens
attgtataaaacagt

SEQ ID NO: 6678053 - DNA, 17 bp, Homo sapiens
attgtataaaacagtgt

SEQ ID NO: 6678054 - DNA, 13 bp, Homo sapiens
attgtataaacta

SEQ ID NO: 6678055 - DNA, 17 bp, Homo sapiens
attgtataaactatcag

SEQ ID NO: 6678056 - DNA, 20 bp, Homo sapiens
attgtataaattactttgat

SEQ ID NO: 6678057 - DNA, 18 bp, Homo sapiens
attgtataagtcaagcac

SEQ ID NO: 6678058 - DNA, 19 bp, Homo sapiens
attgtataagtcaagcaca

SEQ ID NO: 6678059 - DNA, 20 bp, Homo sapiens
attgtataagtcaagcacat

SEQ ID NO: 6678060 - DNA, 14 bp, Homo sapiens
attgtataatgtga

SEQ ID NO: 6678061 - DNA, 15 bp, Homo sapiens
attgtataatgtgat

SEQ ID NO: 6678062 - DNA, 17 bp, Homo sapiens
attgtataatgtgattt

SEQ ID NO: 6678063 - DNA, 17 bp, Homo sapiens
attgtataccaatgtgt

SEQ ID NO: 6678064 - DNA, 18 bp, Homo sapiens
attgtataccaatgtgtt

SEQ ID NO: 6678065 - DNA, 21 bp, Homo sapiens
attgtatagagatatgcagaa

SEQ ID NO: 6678066 - DNA, 13 bp, Homo sapiens
attgtataggcca

SEQ ID NO: 6678067 - DNA, 17 bp, Homo sapiens
attgtataggccatctg

SEQ ID NO: 6678068 - DNA, 22 bp, Homo sapiens
attgtataggccatctgtaaat

SEQ ID NO: 6678069 - DNA, 18 bp, Homo sapiens
attgtatatatatgtgaa

SEQ ID NO: 6678070 - DNA, 19 bp, Homo sapiens
attgtatatatatgtgaac

SEQ ID NO: 6678071 - DNA, 13 bp, Homo sapiens
attgtatatatgt

SEQ ID NO: 6678072 - DNA, 22 bp, Homo sapiens
attgtatatatgtgtgtttaaa

SEQ ID NO: 6678073 - DNA, 20 bp, Homo sapiens
attgtatattacaatgatca

SEQ ID NO: 6678074 - DNA, 21 bp, Homo sapiens
attgtatattgattatagcaa

SEQ ID NO: 6678075 - DNA, 18 bp, Homo sapiens
attgtatatttttatcta

SEQ ID NO: 6678076 - DNA, 17 bp, Homo sapiens
attgtatcaatttgttt

SEQ ID NO: 6678077 - DNA, 20 bp, Homo sapiens
attgtatcagaggcctataa

SEQ ID NO: 6678078 - DNA, 17 bp, Homo sapiens
attgtatcgtatagctg

SEQ ID NO: 6678079 - DNA, 18 bp, Homo sapiens
attgtatctacattaaaa

SEQ ID NO: 6678080 - DNA, 18 bp, Homo sapiens
attgtatctagtgcagct

SEQ ID NO: 6678081 - DNA, 14 bp, Homo sapiens
attgtatctccttt

SEQ ID NO: 6678082 - DNA, 15 bp, Homo sapiens
attgtatctgaactc

SEQ ID NO: 6678083 - DNA, 21 bp, Homo sapiens
attgtatgatgtgttgtgata

SEQ ID NO: 6678084 - DNA, 15 bp, Homo sapiens
attgtattacaaatc

SEQ ID NO: 6678085 - DNA, 17 bp, Homo sapiens
attgtattaggaaaata

SEQ ID NO: 6678086 - DNA, 23 bp, Homo sapiens
attgtattaggtgtcatttccat

SEQ ID NO: 6678087 - DNA, 23 bp, Homo sapiens
attgtattatagtactgctttac

SEQ ID NO: 6678088 - DNA, 17 bp, Homo sapiens
attgtattatcatatat

SEQ ID NO: 6678089 - DNA, 14 bp, Homo sapiens
attgtattgaaaac

SEQ ID NO: 6678090 - DNA, 17 bp, Homo sapiens
attgtatttaaaacatt

SEQ ID NO: 6678091 - DNA, 18 bp, Homo sapiens
attgtatttaaaacattt

SEQ ID NO: 6678092 - DNA, 19 bp, Homo sapiens
attgtatttaaaacatttc

SEQ ID NO: 6678093 - DNA, 15 bp, Homo sapiens
attgtatttaagaca

SEQ ID NO: 6678094 - DNA, 18 bp, Homo sapiens
attgtatttaagacataa

SEQ ID NO: 6678095 - DNA, 22 bp, Homo sapiens
attgtatttaagacataaacaa

SEQ ID NO: 6678096 - DNA, 17 bp, Homo sapiens
attgtatttgtgacttt

SEQ ID NO: 6678097 - DNA, 22 bp, Homo sapiens
attgtattttagcagggtacat

SEQ ID NO: 6678098 - DNA, 14 bp, Homo sapiens
attgtattttagta

SEQ ID NO: 6678099 - DNA, 15 bp, Homo sapiens
attgtcaaagaggat

SEQ ID NO: 6678100 - DNA, 17 bp, Homo sapiens
attgtcaaagcttgccg

SEQ ID NO: 6678101 - DNA, 21 bp, Homo sapiens
attgtcaacactatataaata

SEQ ID NO: 6678102 - DNA, 21 bp, Homo sapiens
attgtcaatgctggagaaaaa

SEQ ID NO: 6678103 - DNA, 14 bp, Homo sapiens
attgtcacatcaag

SEQ ID NO: 6678104 - DNA, 22 bp, Homo sapiens
attgtcaccgcaggtgctcatg

SEQ ID NO: 6678105 - DNA, 13 bp, Homo sapiens
attgtcacctctg

SEQ ID NO: 6678106 - DNA, 16 bp, Homo sapiens
attgtcacctctgtta

SEQ ID NO: 6678107 - DNA, 18 bp, Homo sapiens
attgtcagaatgttgtgt

SEQ ID NO: 6678108 - DNA, 19 bp, Homo sapiens
attgtcagagttctgctct

SEQ ID NO: 6678109 - DNA, 23 bp, Homo sapiens
attgtcagatattttttcagaaa

SEQ ID NO: 6678110 - DNA, 20 bp, Homo sapiens
attgtcagccacctccctct

SEQ ID NO: 6678111 - DNA, 22 bp, Homo sapiens
attgtcagccatcgtcctggga

SEQ ID NO: 6678112 - DNA, 16 bp, Homo sapiens
attgtcataagtaaac

SEQ ID NO: 6678113 - DNA, 20 bp, Homo sapiens
attgtcatggggatcaattt

SEQ ID NO: 6678114 - DNA, 20 bp, Homo sapiens
attgtcatgtttattctaat

SEQ ID NO: 6678115 - DNA, 17 bp, Homo sapiens
attgtcattacaaatct

SEQ ID NO: 6678116 - DNA, 18 bp, Homo sapiens
attgtcattacaaatctt

SEQ ID NO: 6678117 - DNA, 16 bp, Homo sapiens
attgtccacaaatgtc

SEQ ID NO: 6678118 - DNA, 22 bp, Homo sapiens
attgtccacaaatgtcctcaga

SEQ ID NO: 6678119 - DNA, 23 bp, Homo sapiens
attgtccagagctgcttccccgt

SEQ ID NO: 6678120 - DNA, 23 bp, Homo sapiens
attgtccagctgggacctaatgc

SEQ ID NO: 6678121 - DNA, 13 bp, Homo sapiens
attgtccaggaaa

SEQ ID NO: 6678122 - DNA, 19 bp, Homo sapiens
attgtccaggtgaggccca

SEQ ID NO: 6678123 - DNA, 23 bp, Homo sapiens
attgtccagtttgtcttggatat

SEQ ID NO: 6678124 - DNA, 20 bp, Homo sapiens
attgtccatatcagacctct

SEQ ID NO: 6678125 - DNA, 19 bp, Homo sapiens
attgtccatgcctacagat

SEQ ID NO: 6678126 - DNA, 16 bp, Homo sapiens
attgtccccatgcaac

SEQ ID NO: 6678127 - DNA, 17 bp, Homo sapiens
attgtccctctgcccca

SEQ ID NO: 6678128 - DNA, 23 bp, Homo sapiens
attgtccctctgccccatcctcc

SEQ ID NO: 6678129 - DNA, 20 bp, Homo sapiens
attgtccggccgctttgtga

SEQ ID NO: 6678130 - DNA, 14 bp, Homo sapiens
attgtcctattagt

SEQ ID NO: 6678131 - DNA, 19 bp, Homo sapiens
attgtcctccttttcactt

SEQ ID NO: 6678132 - DNA, 20 bp, Homo sapiens
attgtcctccttttcacttt

SEQ ID NO: 6678133 - DNA, 13 bp, Homo sapiens
attgtcctgtagc

SEQ ID NO: 6678134 - DNA, 18 bp, Homo sapiens
attgtcctgtttcttcat

SEQ ID NO: 6678135 - DNA, 12 bp, Homo sapiens
attgtccttgaa

SEQ ID NO: 6678136 - DNA, 15 bp, Homo sapiens
attgtccttgaagct

SEQ ID NO: 6678137 - DNA, 22 bp, Homo sapiens
attgtccttgaagcttgtatct

SEQ ID NO: 6678138 - DNA, 17 bp, Homo sapiens
attgtccttgtgtatcc

SEQ ID NO: 6678139 - DNA, 19 bp, Homo sapiens
attgtccttttctaggaag

SEQ ID NO: 6678140 - DNA, 22 bp, Homo sapiens
attgtcgaaaagagtcttccaa

SEQ ID NO: 6678141 - DNA, 20 bp, Homo sapiens
attgtcgtttcattcatttt

SEQ ID NO: 6678142 - DNA, 18 bp, Homo sapiens
attgtctaaccaattgtg

SEQ ID NO: 6678143 - DNA, 21 bp, Homo sapiens
attgtctaatgacagataaat

SEQ ID NO: 6678144 - DNA, 18 bp, Homo sapiens
attgtctactcctagaag

SEQ ID NO: 6678145 - DNA, 19 bp, Homo sapiens
attgtctagaagcggtttc

SEQ ID NO: 6678146 - DNA, 16 bp, Homo sapiens
attgtctatatggaat

SEQ ID NO: 6678147 - DNA, 15 bp, Homo sapiens
attgtctcagtgaag

SEQ ID NO: 6678148 - DNA, 20 bp, Homo sapiens
attgtctcattgccagtggt

SEQ ID NO: 6678149 - DNA, 19 bp, Homo sapiens
attgtctccaaggtcccat

SEQ ID NO: 6678150 - DNA, 23 bp, Homo sapiens
attgtctcctatatatttctatt

SEQ ID NO: 6678151 - DNA, 15 bp, Homo sapiens
attgtctccttgagt

SEQ ID NO: 6678152 - DNA, 14 bp, Homo sapiens
attgtctcttcatg

SEQ ID NO: 6678153 - DNA, 19 bp, Homo sapiens
attgtctgattgaaacatg

SEQ ID NO: 6678154 - DNA, 22 bp, Homo sapiens
attgtctgattgaaacatgaaa

SEQ ID NO: 6678155 - DNA, 16 bp, Homo sapiens
attgtctgctgatgca

SEQ ID NO: 6678156 - DNA, 13 bp, Homo sapiens
attgtctgctgcc

SEQ ID NO: 6678157 - DNA, 19 bp, Homo sapiens
attgtctgctgcctccaag

SEQ ID NO: 6678158 - DNA, 12 bp, Homo sapiens
attgtctgtaaa

SEQ ID NO: 6678159 - DNA, 14 bp, Homo sapiens
attgtctgtctaca

SEQ ID NO: 6678160 - DNA, 19 bp, Homo sapiens
attgtctgtctacatttct

SEQ ID NO: 6678161 - DNA, 13 bp, Homo sapiens
attgtctgtctct

SEQ ID NO: 6678162 - DNA, 17 bp, Homo sapiens
attgtctgttttccttc

SEQ ID NO: 6678163 - DNA, 16 bp, Homo sapiens
attgtcttaaaaccag

SEQ ID NO: 6678164 - DNA, 21 bp, Homo sapiens
attgtcttaatggatgaaatc

SEQ ID NO: 6678165 - DNA, 14 bp, Homo sapiens
attgtcttcatgta

SEQ ID NO: 6678166 - DNA, 22 bp, Homo sapiens
attgtcttccaaccccagctgg

SEQ ID NO: 6678167 - DNA, 23 bp, Homo sapiens
attgtcttccaaccccagctggc

SEQ ID NO: 6678168 - DNA, 20 bp, Homo sapiens
attgtcttcggaaaccttgg

SEQ ID NO: 6678169 - DNA, 18 bp, Homo sapiens
attgtcttggttgccagt

SEQ ID NO: 6678170 - DNA, 14 bp, Homo sapiens
attgtcttgttctg

SEQ ID NO: 6678171 - DNA, 19 bp, Homo sapiens
attgtcttgttctgtccct

SEQ ID NO: 6678172 - DNA, 19 bp, Homo sapiens
attgtctttaaaaactgtt

SEQ ID NO: 6678173 - DNA, 14 bp, Homo sapiens
attgtctttatatg

SEQ ID NO: 6678174 - DNA, 13 bp, Homo sapiens
attgtctttatga

SEQ ID NO: 6678175 - DNA, 23 bp, Homo sapiens
attgtctttattaacaaacagga

SEQ ID NO: 6678176 - DNA, 13 bp, Homo sapiens
attgtctttgaat

SEQ ID NO: 6678177 - DNA, 19 bp, Homo sapiens
attgtctttgctgtactct

SEQ ID NO: 6678178 - DNA, 22 bp, Homo sapiens
attgtcttttagacaactagat

SEQ ID NO: 6678179 - DNA, 23 bp, Homo sapiens
attgtcttttagacaactagatt

SEQ ID NO: 6678180 - DNA, 18 bp, Homo sapiens
attgtcttttgtcatgtg

SEQ ID NO: 6678181 - DNA, 22 bp, Homo sapiens
attgtcttttttttcctttgaa

SEQ ID NO: 6678182 - DNA, 23 bp, Homo sapiens
attgtcttttttttcctttgaac

SEQ ID NO: 6678183 - DNA, 20 bp, Homo sapiens
attgtgaaatttgttaatat

SEQ ID NO: 6678184 - DNA, 18 bp, Homo sapiens
attgtgaacatttgtgat

SEQ ID NO: 6678185 - DNA, 17 bp, Homo sapiens
attgtgaaccaatgcaa

SEQ ID NO: 6678186 - DNA, 22 bp, Homo sapiens
attgtgaaccctagctgtgtca

SEQ ID NO: 6678187 - DNA, 14 bp, Homo sapiens
attgtgaactcatt

SEQ ID NO: 6678188 - DNA, 15 bp, Homo sapiens
attgtgaactcattg

SEQ ID NO: 6678189 - DNA, 14 bp, Homo sapiens
attgtgaagattga

SEQ ID NO: 6678190 - DNA, 21 bp, Homo sapiens
attgtgaagctaatgaccaac

SEQ ID NO: 6678191 - DNA, 23 bp, Homo sapiens
attgtgaatgttgtcctgtgtca

SEQ ID NO: 6678192 - DNA, 14 bp, Homo sapiens
attgtgaattgata

SEQ ID NO: 6678193 - DNA, 21 bp, Homo sapiens
attgtgacagcgatggcaggc

SEQ ID NO: 6678194 - DNA, 15 bp, Homo sapiens
attgtgaccaagtta

SEQ ID NO: 6678195 - DNA, 16 bp, Homo sapiens
attgtgaccaagttat

SEQ ID NO: 6678196 - DNA, 17 bp, Homo sapiens
attgtgaccaatacatt

SEQ ID NO: 6678197 - DNA, 19 bp, Homo sapiens
attgtgaccactgaattca

SEQ ID NO: 6678198 - DNA, 19 bp, Homo sapiens
attgtgactgtgtttgcat

SEQ ID NO: 6678199 - DNA, 17 bp, Homo sapiens
attgtgacttcactgta

SEQ ID NO: 6678200 - DNA, 18 bp, Homo sapiens
attgtgacttcactgtat

SEQ ID NO: 6678201 - DNA, 19 bp, Homo sapiens
attgtgagaattactgttt

SEQ ID NO: 6678202 - DNA, 19 bp, Homo sapiens
attgtgagatgatttgtac

SEQ ID NO: 6678203 - DNA, 20 bp, Homo sapiens
attgtgagctctggttattt

SEQ ID NO: 6678204 - DNA, 19 bp, Homo sapiens
attgtgagttttctatttc

SEQ ID NO: 6678205 - DNA, 21 bp, Homo sapiens
attgtgatctatcaatagtca

SEQ ID NO: 6678206 - DNA, 22 bp, Homo sapiens
attgtgattagacagaacacct

SEQ ID NO: 6678207 - DNA, 18 bp, Homo sapiens
attgtgattctgcctttg

SEQ ID NO: 6678208 - DNA, 16 bp, Homo sapiens
attgtgatttcccgtg

SEQ ID NO: 6678209 - DNA, 14 bp, Homo sapiens
attgtgatttgact

SEQ ID NO: 6678210 - DNA, 14 bp, Homo sapiens
attgtgcaaaatat

SEQ ID NO: 6678211 - DNA, 16 bp, Homo sapiens
attgtgcaaaatattg

SEQ ID NO: 6678212 - DNA, 15 bp, Homo sapiens
attgtgcaaatggaa

SEQ ID NO: 6678213 - DNA, 15 bp, Homo sapiens
attgtgcaatagtca

SEQ ID NO: 6678214 - DNA, 18 bp, Homo sapiens
attgtgcaatgtaaatat

SEQ ID NO: 6678215 - DNA, 15 bp, Homo sapiens
attgtgcacatttaa

SEQ ID NO: 6678216 - DNA, 20 bp, Homo sapiens
attgtgcacatttaataatc

SEQ ID NO: 6678217 - DNA, 20 bp, Homo sapiens
attgtgcagaaaagctcaga

SEQ ID NO: 6678218 - DNA, 22 bp, Homo sapiens
attgtgcagaaaagctcagagt

SEQ ID NO: 6678219 - DNA, 13 bp, Homo sapiens
attgtgcagagaa

SEQ ID NO: 6678220 - DNA, 11 bp, Homo sapiens
attgtgccaaa

SEQ ID NO: 6678221 - DNA, 15 bp, Homo sapiens
attgtgccaaagata

SEQ ID NO: 6678222 - DNA, 16 bp, Homo sapiens
attgtgccaaagatag

SEQ ID NO: 6678223 - DNA, 14 bp, Homo sapiens
attgtgccaagcct

SEQ ID NO: 6678224 - DNA, 17 bp, Homo sapiens
attgtgccaagccttct

SEQ ID NO: 6678225 - DNA, 23 bp, Homo sapiens
attgtgcccctaaagagcatcct

SEQ ID NO: 6678226 - DNA, 20 bp, Homo sapiens
attgtgcctgccaccaccat

SEQ ID NO: 6678227 - DNA, 13 bp, Homo sapiens
attgtgctagtgc

SEQ ID NO: 6678228 - DNA, 21 bp, Homo sapiens
attgtgctccaaatgtctact

SEQ ID NO: 6678229 - DNA, 23 bp, Homo sapiens
attgtgctgggtcccagcctggt

SEQ ID NO: 6678230 - DNA, 13 bp, Homo sapiens
attgtgcttaaat

SEQ ID NO: 6678231 - DNA, 17 bp, Homo sapiens
attgtgcttaaattatt

SEQ ID NO: 6678232 - DNA, 16 bp, Homo sapiens
attgtgcttaataata

SEQ ID NO: 6678233 - DNA, 20 bp, Homo sapiens
attgtgcttcacagtagagc

SEQ ID NO: 6678234 - DNA, 17 bp, Homo sapiens
attgtgcttctccccag

SEQ ID NO: 6678235 - DNA, 15 bp, Homo sapiens
attgtgctttcacca

SEQ ID NO: 6678236 - DNA, 16 bp, Homo sapiens
attgtgctttggttaa

SEQ ID NO: 6678237 - DNA, 18 bp, Homo sapiens
attgtggataacaaagat

SEQ ID NO: 6678238 - DNA, 18 bp, Homo sapiens
attgtggatcttgagctc

SEQ ID NO: 6678239 - DNA, 17 bp, Homo sapiens
attgtggatgtgttcat

SEQ ID NO: 6678240 - DNA, 16 bp, Homo sapiens
attgtggattataaaa

SEQ ID NO: 6678241 - DNA, 18 bp, Homo sapiens
attgtggattataaaaaa

SEQ ID NO: 6678242 - DNA, 12 bp, Homo sapiens
attgtggctccc

SEQ ID NO: 6678243 - DNA, 14 bp, Homo sapiens
attgtggctccctg

SEQ ID NO: 6678244 - DNA, 12 bp, Homo sapiens
attgtggctcct

SEQ ID NO: 6678245 - DNA, 22 bp, Homo sapiens
attgtggctgtcaaatccatgt

SEQ ID NO: 6678246 - DNA, 17 bp, Homo sapiens
attgtggctgtcagcag

SEQ ID NO: 6678247 - DNA, 19 bp, Homo sapiens
attgtggctgtcagcagga

SEQ ID NO: 6678248 - DNA, 19 bp, Homo sapiens
attgtgggcataaactgtt

SEQ ID NO: 6678249 - DNA, 15 bp, Homo sapiens
attgtggggagagaa

SEQ ID NO: 6678250 - DNA, 20 bp, Homo sapiens
attgtggggatgatgaaata

SEQ ID NO: 6678251 - DNA, 22 bp, Homo sapiens
attgtggggctcataaaacatg

SEQ ID NO: 6678252 - DNA, 18 bp, Homo sapiens
attgtgggggaaaaataa

SEQ ID NO: 6678253 - DNA, 22 bp, Homo sapiens
attgtggggtgcagctgggtgg

SEQ ID NO: 6678254 - DNA, 18 bp, Homo sapiens
attgtgggtaacgtgaga

SEQ ID NO: 6678255 - DNA, 16 bp, Homo sapiens
attgtgggtgttaatt

SEQ ID NO: 6678256 - DNA, 19 bp, Homo sapiens
attgtggtacaatctcaaa

SEQ ID NO: 6678257 - DNA, 16 bp, Homo sapiens
attgtggtagaaattt

SEQ ID NO: 6678258 - DNA, 18 bp, Homo sapiens
attgtggtaggcctttta

SEQ ID NO: 6678259 - DNA, 21 bp, Homo sapiens
attgtggtaggccttttaaca

SEQ ID NO: 6678260 - DNA, 14 bp, Homo sapiens
attgtggtgccaca

SEQ ID NO: 6678261 - DNA, 20 bp, Homo sapiens
attgtggtggttgagatgga

SEQ ID NO: 6678262 - DNA, 23 bp, Homo sapiens
attgtggttatttttatacagta

SEQ ID NO: 6678263 - DNA, 19 bp, Homo sapiens
attgtgtaaaaaatggaaa

SEQ ID NO: 6678264 - DNA, 15 bp, Homo sapiens
attgtgtaactgttc

SEQ ID NO: 6678265 - DNA, 17 bp, Homo sapiens
attgtgtaactgttctt

SEQ ID NO: 6678266 - DNA, 19 bp, Homo sapiens
attgtgtaagaatcactgc

SEQ ID NO: 6678267 - DNA, 22 bp, Homo sapiens
attgtgtaagtttataatgcag

SEQ ID NO: 6678268 - DNA, 17 bp, Homo sapiens
attgtgtaatttaagtg

SEQ ID NO: 6678269 - DNA, 20 bp, Homo sapiens
attgtgtacaaagtagagaa

SEQ ID NO: 6678270 - DNA, 12 bp, Homo sapiens
attgtgtacata

SEQ ID NO: 6678271 - DNA, 14 bp, Homo sapiens
attgtgtagccttt

SEQ ID NO: 6678272 - DNA, 15 bp, Homo sapiens
attgtgtagcctttt

SEQ ID NO: 6678273 - DNA, 15 bp, Homo sapiens
attgtgtatattcat

SEQ ID NO: 6678274 - DNA, 12 bp, Homo sapiens
attgtgtatctg

SEQ ID NO: 6678275 - DNA, 14 bp, Homo sapiens
attgtgtatctgtg

SEQ ID NO: 6678276 - DNA, 19 bp, Homo sapiens
attgtgtattatgttgttc

SEQ ID NO: 6678277 - DNA, 15 bp, Homo sapiens
attgtgtattgatgc

SEQ ID NO: 6678278 - DNA, 18 bp, Homo sapiens
attgtgtattgatgcaat

SEQ ID NO: 6678279 - DNA, 19 bp, Homo sapiens
attgtgtattgatgcaata

SEQ ID NO: 6678280 - DNA, 11 bp, Homo sapiens
attgtgtattt

SEQ ID NO: 6678281 - DNA, 18 bp, Homo sapiens
attgtgtcagaaacatga

SEQ ID NO: 6678282 - DNA, 17 bp, Homo sapiens
attgtgtcagactgttt

SEQ ID NO: 6678283 - DNA, 13 bp, Homo sapiens
attgtgtctcccg

SEQ ID NO: 6678284 - DNA, 15 bp, Homo sapiens
attgtgtcttttgca

SEQ ID NO: 6678285 - DNA, 19 bp, Homo sapiens
attgtgtgaaaaaagaaaa

SEQ ID NO: 6678286 - DNA, 14 bp, Homo sapiens
attgtgtgaatact

SEQ ID NO: 6678287 - DNA, 21 bp, Homo sapiens
attgtgtgaattaatttctaa

SEQ ID NO: 6678288 - DNA, 17 bp, Homo sapiens
attgtgtgatccagccc

SEQ ID NO: 6678289 - DNA, 17 bp, Homo sapiens
attgtgtgcgctgcctg

SEQ ID NO: 6678290 - DNA, 16 bp, Homo sapiens
attgtgtggagaactc

SEQ ID NO: 6678291 - DNA, 21 bp, Homo sapiens
attgtgtggagaagtgtgttc

SEQ ID NO: 6678292 - DNA, 17 bp, Homo sapiens
attgtgtggcctggtgg

SEQ ID NO: 6678293 - DNA, 22 bp, Homo sapiens
attgtgtggtttcccctttctt

SEQ ID NO: 6678294 - DNA, 18 bp, Homo sapiens
attgtgtgtcacaaagct

SEQ ID NO: 6678295 - DNA, 17 bp, Homo sapiens
attgtgtgtctggtaac

SEQ ID NO: 6678296 - DNA, 22 bp, Homo sapiens
attgtgtgtgcagacttcagga

SEQ ID NO: 6678297 - DNA, 14 bp, Homo sapiens
attgtgtgtggaat

SEQ ID NO: 6678298 - DNA, 22 bp, Homo sapiens
attgtgtgttctcacagtgaca

SEQ ID NO: 6678299 - DNA, 17 bp, Homo sapiens
attgtgttatttcactt

SEQ ID NO: 6678300 - DNA, 15 bp, Homo sapiens
attgtgttcccattt

SEQ ID NO: 6678301 - DNA, 20 bp, Homo sapiens
attgtgttcccatttcagct

SEQ ID NO: 6678302 - DNA, 17 bp, Homo sapiens
attgtgttgacattaag

SEQ ID NO: 6678303 - DNA, 22 bp, Homo sapiens
attgtgttgactttataaattt

SEQ ID NO: 6678304 - DNA, 19 bp, Homo sapiens
attgtgttgatttctttcc

SEQ ID NO: 6678305 - DNA, 18 bp, Homo sapiens
attgtgttgccttagcac

SEQ ID NO: 6678306 - DNA, 23 bp, Homo sapiens
attgtgttggctttacaaataat

SEQ ID NO: 6678307 - DNA, 20 bp, Homo sapiens
attgtgttgtgcagcattaa

SEQ ID NO: 6678308 - DNA, 19 bp, Homo sapiens
attgtgtttacattttatg

SEQ ID NO: 6678309 - DNA, 16 bp, Homo sapiens
attgtgtttatgcatt

SEQ ID NO: 6678310 - DNA, 14 bp, Homo sapiens
attgtgtttgctaa

SEQ ID NO: 6678311 - DNA, 15 bp, Homo sapiens
attgtgtttgtcatt

SEQ ID NO: 6678312 - DNA, 13 bp, Homo sapiens
attgtgtttgtgt

SEQ ID NO: 6678313 - DNA, 13 bp, Homo sapiens
attgtgttttaac

SEQ ID NO: 6678314 - DNA, 19 bp, Homo sapiens
attgttaaaaccttactta

SEQ ID NO: 6678315 - DNA, 13 bp, Homo sapiens
attgttaaaataa

SEQ ID NO: 6678316 - DNA, 15 bp, Homo sapiens
attgttaaacaaatg

SEQ ID NO: 6678317 - DNA, 17 bp, Homo sapiens
attgttaaacaaatgat

SEQ ID NO: 6678318 - DNA, 22 bp, Homo sapiens
attgttaaatacacattatcac

SEQ ID NO: 6678319 - DNA, 15 bp, Homo sapiens
attgttaaatgataa

SEQ ID NO: 6678320 - DNA, 16 bp, Homo sapiens
attgttaaattacatt

SEQ ID NO: 6678321 - DNA, 19 bp, Homo sapiens
attgttaaattacattttt

SEQ ID NO: 6678322 - DNA, 18 bp, Homo sapiens
attgttaagggcattttt

SEQ ID NO: 6678323 - DNA, 21 bp, Homo sapiens
attgttaagtctaaatatttc

SEQ ID NO: 6678324 - DNA, 18 bp, Homo sapiens
attgttaatataatttaa

SEQ ID NO: 6678325 - DNA, 21 bp, Homo sapiens
attgttaatgcctataacttt

SEQ ID NO: 6678326 - DNA, 16 bp, Homo sapiens
attgttaattgctgag

SEQ ID NO: 6678327 - DNA, 17 bp, Homo sapiens
attgttaatttttccta

SEQ ID NO: 6678328 - DNA, 19 bp, Homo sapiens
attgttacaagtgttctta

SEQ ID NO: 6678329 - DNA, 17 bp, Homo sapiens
attgttacacattaagt

SEQ ID NO: 6678330 - DNA, 20 bp, Homo sapiens
attgttacccatttgaaaga

SEQ ID NO: 6678331 - DNA, 16 bp, Homo sapiens
attgttagaaaatgac

SEQ ID NO: 6678332 - DNA, 23 bp, Homo sapiens
attgttagatggcaatagtcatt

SEQ ID NO: 6678333 - DNA, 15 bp, Homo sapiens
attgttagatgtttg

SEQ ID NO: 6678334 - DNA, 23 bp, Homo sapiens
attgttaggagtggttctcattt

SEQ ID NO: 6678335 - DNA, 21 bp, Homo sapiens
attgttaggatcaatgataaa

SEQ ID NO: 6678336 - DNA, 17 bp, Homo sapiens
attgttataaaataaca

SEQ ID NO: 6678337 - DNA, 22 bp, Homo sapiens
attgttataaaataacatgctg

SEQ ID NO: 6678338 - DNA, 18 bp, Homo sapiens
attgttataaataaaatt

SEQ ID NO: 6678339 - DNA, 21 bp, Homo sapiens
attgttatgcacttttcccca

SEQ ID NO: 6678340 - DNA, 22 bp, Homo sapiens
attgttattgtggaagatttac

SEQ ID NO: 6678341 - DNA, 12 bp, Homo sapiens
attgttatttca

SEQ ID NO: 6678342 - DNA, 17 bp, Homo sapiens
attgttattttcagtga

SEQ ID NO: 6678343 - DNA, 15 bp, Homo sapiens
attgttcaaacaata

SEQ ID NO: 6678344 - DNA, 16 bp, Homo sapiens
attgttcaaacaatat

SEQ ID NO: 6678345 - DNA, 22 bp, Homo sapiens
attgttcaaagaacccccctcc

SEQ ID NO: 6678346 - DNA, 18 bp, Homo sapiens
attgttcacctttgtagc

SEQ ID NO: 6678347 - DNA, 20 bp, Homo sapiens
attgttcacttctaaaccaa

SEQ ID NO: 6678348 - DNA, 13 bp, Homo sapiens
attgttcataata

SEQ ID NO: 6678349 - DNA, 17 bp, Homo sapiens
attgttcataatacata

SEQ ID NO: 6678350 - DNA, 12 bp, Homo sapiens
attgttccaaga

SEQ ID NO: 6678351 - DNA, 16 bp, Homo sapiens
attgttccaagacatt

SEQ ID NO: 6678352 - DNA, 16 bp, Homo sapiens
attgttccataataaa

SEQ ID NO: 6678353 - DNA, 21 bp, Homo sapiens
attgttcccagtgacacttca

SEQ ID NO: 6678354 - DNA, 19 bp, Homo sapiens
attgttccctatgaaagat

SEQ ID NO: 6678355 - DNA, 15 bp, Homo sapiens
attgttcccttcctc

SEQ ID NO: 6678356 - DNA, 16 bp, Homo sapiens
attgttcctaagttct

SEQ ID NO: 6678357 - DNA, 19 bp, Homo sapiens
attgttcctaagttcttag

SEQ ID NO: 6678358 - DNA, 12 bp, Homo sapiens
attgttcctctt

SEQ ID NO: 6678359 - DNA, 13 bp, Homo sapiens
attgttcctcttt

SEQ ID NO: 6678360 - DNA, 21 bp, Homo sapiens
attgttcctgaatacaagcct

SEQ ID NO: 6678361 - DNA, 13 bp, Homo sapiens
attgttcctgtca

SEQ ID NO: 6678362 - DNA, 21 bp, Homo sapiens
attgttccttacctttacata

SEQ ID NO: 6678363 - DNA, 21 bp, Homo sapiens
attgttcgatgcctgcatgct

SEQ ID NO: 6678364 - DNA, 18 bp, Homo sapiens
attgttctagtactgtat

SEQ ID NO: 6678365 - DNA, 15 bp, Homo sapiens
attgttctctaggaa

SEQ ID NO: 6678366 - DNA, 13 bp, Homo sapiens
attgttctgaaca

SEQ ID NO: 6678367 - DNA, 13 bp, Homo sapiens
attgttctgcttt

SEQ ID NO: 6678368 - DNA, 17 bp, Homo sapiens
attgttctgggtgattt

SEQ ID NO: 6678369 - DNA, 20 bp, Homo sapiens
attgttctgggtgatttcta

SEQ ID NO: 6678370 - DNA, 13 bp, Homo sapiens
attgttcttaaaa

SEQ ID NO: 6678371 - DNA, 16 bp, Homo sapiens
attgttcttgggagaa

SEQ ID NO: 6678372 - DNA, 20 bp, Homo sapiens
attgttcttgggagaaaatc

SEQ ID NO: 6678373 - DNA, 22 bp, Homo sapiens
attgttcttgtaaaactgtgac

SEQ ID NO: 6678374 - DNA, 17 bp, Homo sapiens
attgttcttttgtttca

SEQ ID NO: 6678375 - DNA, 18 bp, Homo sapiens
attgttcttttgtttcat

SEQ ID NO: 6678376 - DNA, 17 bp, Homo sapiens
attgttgaaaaagtttg

SEQ ID NO: 6678377 - DNA, 18 bp, Homo sapiens
attgttgaaaaagtttgt

SEQ ID NO: 6678378 - DNA, 20 bp, Homo sapiens
attgttgaaaaagtttgttt

SEQ ID NO: 6678379 - DNA, 18 bp, Homo sapiens
attgttgaatgtattctt

SEQ ID NO: 6678380 - DNA, 17 bp, Homo sapiens
attgttgacaactggtt

SEQ ID NO: 6678381 - DNA, 18 bp, Homo sapiens
attgttgacaactgtgac

SEQ ID NO: 6678382 - DNA, 18 bp, Homo sapiens
attgttgacagttctgaa

SEQ ID NO: 6678383 - DNA, 22 bp, Homo sapiens
attgttgacagttctgaagaat

SEQ ID NO: 6678384 - DNA, 16 bp, Homo sapiens
attgttgagctattgc

SEQ ID NO: 6678385 - DNA, 19 bp, Homo sapiens
attgttgagctattgctgt

SEQ ID NO: 6678386 - DNA, 13 bp, Homo sapiens
attgttgagctgt

SEQ ID NO: 6678387 - DNA, 23 bp, Homo sapiens
attgttgaggtggtctgaatgtt

SEQ ID NO: 6678388 - DNA, 14 bp, Homo sapiens
attgttgctccctg

SEQ ID NO: 6678389 - DNA, 16 bp, Homo sapiens
attgttgctgaaactt

SEQ ID NO: 6678390 - DNA, 16 bp, Homo sapiens
attgttggagtattta

SEQ ID NO: 6678391 - DNA, 17 bp, Homo sapiens
attgttggcacagaaca

SEQ ID NO: 6678392 - DNA, 12 bp, Homo sapiens
attgttggcagt

SEQ ID NO: 6678393 - DNA, 17 bp, Homo sapiens
attgttggcagtttcct

SEQ ID NO: 6678394 - DNA, 23 bp, Homo sapiens
attgttggctatttgaaatacta

SEQ ID NO: 6678395 - DNA, 15 bp, Homo sapiens
attgttgggaaagga

SEQ ID NO: 6678396 - DNA, 16 bp, Homo sapiens
attgttggtgttaatt

SEQ ID NO: 6678397 - DNA, 19 bp, Homo sapiens
attgttggtgttaattgaa

SEQ ID NO: 6678398 - DNA, 16 bp, Homo sapiens
attgttgtaaagtatt

SEQ ID NO: 6678399 - DNA, 14 bp, Homo sapiens
attgttgtatatca

SEQ ID NO: 6678400 - DNA, 20 bp, Homo sapiens
attgttgtatatcactaaaa

SEQ ID NO: 6678401 - DNA, 23 bp, Homo sapiens
attgttgtatatcactaaaagca

SEQ ID NO: 6678402 - DNA, 15 bp, Homo sapiens
attgttgtcaaatgc

SEQ ID NO: 6678403 - DNA, 15 bp, Homo sapiens
attgttgtccttttc

SEQ ID NO: 6678404 - DNA, 18 bp, Homo sapiens
attgttgtccttttcata

SEQ ID NO: 6678405 - DNA, 22 bp, Homo sapiens
attgttgtgggctttctccggg

SEQ ID NO: 6678406 - DNA, 14 bp, Homo sapiens
attgttgtgtataa

SEQ ID NO: 6678407 - DNA, 24 bp, Homo sapiens
attgttgttactttttcttgtatt

SEQ ID NO: 6678408 - DNA, 13 bp, Homo sapiens
attgttgttctgt

SEQ ID NO: 6678409 - DNA, 19 bp, Homo sapiens
attgttgttctgttaactg

SEQ ID NO: 6678410 - DNA, 13 bp, Homo sapiens
attgttgttgcca

SEQ ID NO: 6678411 - DNA, 12 bp, Homo sapiens
attgttgtttct

SEQ ID NO: 6678412 - DNA, 20 bp, Homo sapiens
attgttgtttgtatgtataa

SEQ ID NO: 6678413 - DNA, 16 bp, Homo sapiens
attgtttaaaaacagg

SEQ ID NO: 6678414 - DNA, 20 bp, Homo sapiens
attgtttaaaaacaggaaaa

SEQ ID NO: 6678415 - DNA, 14 bp, Homo sapiens
attgtttaaaaacc

SEQ ID NO: 6678416 - DNA, 17 bp, Homo sapiens
attgtttaaaatgtaat

SEQ ID NO: 6678417 - DNA, 16 bp, Homo sapiens
attgtttaaaattcag

SEQ ID NO: 6678418 - DNA, 22 bp, Homo sapiens
attgtttaagaatcatggattt

SEQ ID NO: 6678419 - DNA, 21 bp, Homo sapiens
attgtttaagtgttgtaaata

SEQ ID NO: 6678420 - DNA, 15 bp, Homo sapiens
attgtttaatctttt

SEQ ID NO: 6678421 - DNA, 12 bp, Homo sapiens
attgtttacagg

SEQ ID NO: 6678422 - DNA, 15 bp, Homo sapiens
attgtttacaggata

SEQ ID NO: 6678423 - DNA, 13 bp, Homo sapiens
attgtttagattt

SEQ ID NO: 6678424 - DNA, 16 bp, Homo sapiens
attgtttatctagatg

SEQ ID NO: 6678425 - DNA, 17 bp, Homo sapiens
attgtttatctagatgt

SEQ ID NO: 6678426 - DNA, 14 bp, Homo sapiens
attgtttattcttt

SEQ ID NO: 6678427 - DNA, 17 bp, Homo sapiens
attgtttatttatcagt

SEQ ID NO: 6678428 - DNA, 19 bp, Homo sapiens
attgtttatttatcagtga

SEQ ID NO: 6678429 - DNA, 14 bp, Homo sapiens
attgtttcagtgtt

SEQ ID NO: 6678430 - DNA, 18 bp, Homo sapiens
attgtttcatatctggtc

SEQ ID NO: 6678431 - DNA, 17 bp, Homo sapiens
attgtttccaaagtgca

SEQ ID NO: 6678432 - DNA, 22 bp, Homo sapiens
attgtttccaaagtgcatgtca

SEQ ID NO: 6678433 - DNA, 20 bp, Homo sapiens
attgtttcctcttccaaagt

SEQ ID NO: 6678434 - DNA, 13 bp, Homo sapiens
attgtttctacaa

SEQ ID NO: 6678435 - DNA, 16 bp, Homo sapiens
attgtttctagaacag

SEQ ID NO: 6678436 - DNA, 15 bp, Homo sapiens
attgtttctgtgggc

SEQ ID NO: 6678437 - DNA, 18 bp, Homo sapiens
attgtttcttgacaagct

SEQ ID NO: 6678438 - DNA, 20 bp, Homo sapiens
attgtttctttaagaaagta

SEQ ID NO: 6678439 - DNA, 13 bp, Homo sapiens
attgtttgaaaca

SEQ ID NO: 6678440 - DNA, 18 bp, Homo sapiens
attgtttgaaacaaagaa

SEQ ID NO: 6678441 - DNA, 20 bp, Homo sapiens
attgtttgatgaataaaatg

SEQ ID NO: 6678442 - DNA, 21 bp, Homo sapiens
attgtttgatgaataaaatgt

SEQ ID NO: 6678443 - DNA, 22 bp, Homo sapiens
attgtttgatgaataaaatgtt

SEQ ID NO: 6678444 - DNA, 23 bp, Homo sapiens
attgtttgatgaataaaatgttt

SEQ ID NO: 6678445 - DNA, 15 bp, Homo sapiens
attgtttgctgctat

SEQ ID NO: 6678446 - DNA, 19 bp, Homo sapiens
attgtttgcttattgttcc

SEQ ID NO: 6678447 - DNA, 21 bp, Homo sapiens
attgtttgcttattgttccaa

SEQ ID NO: 6678448 - DNA, 16 bp, Homo sapiens
attgtttggacctgca

SEQ ID NO: 6678449 - DNA, 20 bp, Homo sapiens
attgtttggcttcctcctga

SEQ ID NO: 6678450 - DNA, 18 bp, Homo sapiens
attgtttgtcctttatgt

SEQ ID NO: 6678451 - DNA, 15 bp, Homo sapiens
attgtttgttgcact

SEQ ID NO: 6678452 - DNA, 14 bp, Homo sapiens
attgttttaaaaag

SEQ ID NO: 6678453 - DNA, 18 bp, Homo sapiens
attgttttaatctgaaat

SEQ ID NO: 6678454 - DNA, 14 bp, Homo sapiens
attgttttacaata

SEQ ID NO: 6678455 - DNA, 15 bp, Homo sapiens
attgttttacaatag

SEQ ID NO: 6678456 - DNA, 18 bp, Homo sapiens
attgttttacaatagttc

SEQ ID NO: 6678457 - DNA, 18 bp, Homo sapiens
attgttttaccagctccc

SEQ ID NO: 6678458 - DNA, 23 bp, Homo sapiens
attgttttactcctttttattca

SEQ ID NO: 6678459 - DNA, 19 bp, Homo sapiens
attgttttagagactatgg

SEQ ID NO: 6678460 - DNA, 18 bp, Homo sapiens
attgttttcacttgtatt

SEQ ID NO: 6678461 - DNA, 19 bp, Homo sapiens
attgttttcagtgtacatg

SEQ ID NO: 6678462 - DNA, 12 bp, Homo sapiens
attgttttctgt

SEQ ID NO: 6678463 - DNA, 19 bp, Homo sapiens
attgttttgcaaaagtgta

SEQ ID NO: 6678464 - DNA, 18 bp, Homo sapiens
attgttttgccaacattg

SEQ ID NO: 6678465 - DNA, 15 bp, Homo sapiens
attgttttggaataa

SEQ ID NO: 6678466 - DNA, 18 bp, Homo sapiens
attgttttggtttgctac

SEQ ID NO: 6678467 - DNA, 16 bp, Homo sapiens
attgttttgttaacaa

SEQ ID NO: 6678468 - DNA, 21 bp, Homo sapiens
attgtttttataaaaacattg

SEQ ID NO: 6678469 - DNA, 15 bp, Homo sapiens
attgtttttatatat

SEQ ID NO: 6678470 - DNA, 16 bp, Homo sapiens
attgtttttatttcta

SEQ ID NO: 6678471 - DNA, 23 bp, Homo sapiens
attgttttttaaagcaagtcacc

SEQ ID NO: 6678472 - DNA, 23 bp, Homo sapiens
attgttttttatcttttctacag

SEQ ID NO: 6678473 - DNA, 14 bp, Homo sapiens
atttaaaaaaaaac

SEQ ID NO: 6678474 - DNA, 15 bp, Homo sapiens
atttaaaaaaaaaga

SEQ ID NO: 6678475 - DNA, 15 bp, Homo sapiens
atttaaaaaaaagaa

SEQ ID NO: 6678476 - DNA, 14 bp, Homo sapiens
atttaaaaaaaatc

SEQ ID NO: 6678477 - DNA, 17 bp, Homo sapiens
atttaaaaaactcctgt

SEQ ID NO: 6678478 - DNA, 15 bp, Homo sapiens
atttaaaaaactgta

SEQ ID NO: 6678479 - DNA, 17 bp, Homo sapiens
atttaaaaaactgtata

SEQ ID NO: 6678480 - DNA, 18 bp, Homo sapiens
atttaaaaaactgtataa

SEQ ID NO: 6678481 - DNA, 20 bp, Homo sapiens
atttaaaaaagaaaaaagtc

SEQ ID NO: 6678482 - DNA, 17 bp, Homo sapiens
atttaaaaaataaatat

SEQ ID NO: 6678483 - DNA, 21 bp, Homo sapiens
atttaaaaaataaatataatt

SEQ ID NO: 6678484 - DNA, 20 bp, Homo sapiens
atttaaaaaatgaatagtac

SEQ ID NO: 6678485 - DNA, 17 bp, Homo sapiens
atttaaaaaattaaaaa

SEQ ID NO: 6678486 - DNA, 18 bp, Homo sapiens
atttaaaaacaaccaaca

SEQ ID NO: 6678487 - DNA, 22 bp, Homo sapiens
atttaaaaacaggcagctcata

SEQ ID NO: 6678488 - DNA, 14 bp, Homo sapiens
atttaaaaacattt

SEQ ID NO: 6678489 - DNA, 15 bp, Homo sapiens
atttaaaaacatttt

SEQ ID NO: 6678490 - DNA, 14 bp, Homo sapiens
atttaaaaactgga

SEQ ID NO: 6678491 - DNA, 15 bp, Homo sapiens
atttaaaaactggaa

SEQ ID NO: 6678492 - DNA, 16 bp, Homo sapiens
atttaaaaactggaac

SEQ ID NO: 6678493 - DNA, 16 bp, Homo sapiens
atttaaaaagcccaac

SEQ ID NO: 6678494 - DNA, 22 bp, Homo sapiens
atttaaaaagctcactgctgat

SEQ ID NO: 6678495 - DNA, 17 bp, Homo sapiens
atttaaaaagctgacta

SEQ ID NO: 6678496 - DNA, 17 bp, Homo sapiens
atttaaaaagtgagaaa

SEQ ID NO: 6678497 - DNA, 12 bp, Homo sapiens
atttaaaaataa

SEQ ID NO: 6678498 - DNA, 17 bp, Homo sapiens
atttaaaaataaagcta

SEQ ID NO: 6678499 - DNA, 16 bp, Homo sapiens
atttaaaaataaatgt

SEQ ID NO: 6678500 - DNA, 15 bp, Homo sapiens
atttaaaaatatttc

SEQ ID NO: 6678501 - DNA, 17 bp, Homo sapiens
atttaaaaatctttcag

SEQ ID NO: 6678502 - DNA, 19 bp, Homo sapiens
atttaaaaatgagtgtgaa

SEQ ID NO: 6678503 - DNA, 20 bp, Homo sapiens
atttaaaaatgcatgataat

SEQ ID NO: 6678504 - DNA, 21 bp, Homo sapiens
atttaaaaatgccaaaactta

SEQ ID NO: 6678505 - DNA, 15 bp, Homo sapiens
atttaaaaatgtctt

SEQ ID NO: 6678506 - DNA, 21 bp, Homo sapiens
atttaaaaattaaagcagcaa

SEQ ID NO: 6678507 - DNA, 18 bp, Homo sapiens
atttaaaaattgtttctt

SEQ ID NO: 6678508 - DNA, 14 bp, Homo sapiens
atttaaaacaaaca

SEQ ID NO: 6678509 - DNA, 18 bp, Homo sapiens
atttaaaacacagtattg

SEQ ID NO: 6678510 - DNA, 24 bp, Homo sapiens
atttaaaacacagtattgtagaaa

SEQ ID NO: 6678511 - DNA, 16 bp, Homo sapiens
atttaaaacagacact

SEQ ID NO: 6678512 - DNA, 13 bp, Homo sapiens
atttaaaacaggc

SEQ ID NO: 6678513 - DNA, 14 bp, Homo sapiens
atttaaaacaggca

SEQ ID NO: 6678514 - DNA, 12 bp, Homo sapiens
atttaaaacatt

SEQ ID NO: 6678515 - DNA, 19 bp, Homo sapiens
atttaaaacatttcatgta

SEQ ID NO: 6678516 - DNA, 14 bp, Homo sapiens
atttaaaactctgg

SEQ ID NO: 6678517 - DNA, 13 bp, Homo sapiens
atttaaaactgtt

SEQ ID NO: 6678518 - DNA, 11 bp, Homo sapiens
atttaaaactt

SEQ ID NO: 6678519 - DNA, 17 bp, Homo sapiens
atttaaaagacaaacac

SEQ ID NO: 6678520 - DNA, 19 bp, Homo sapiens
atttaaaagacaaacacct

SEQ ID NO: 6678521 - DNA, 13 bp, Homo sapiens
atttaaaagatcc

SEQ ID NO: 6678522 - DNA, 13 bp, Homo sapiens
atttaaaagattc

SEQ ID NO: 6678523 - DNA, 16 bp, Homo sapiens
atttaaaagattcatt

SEQ ID NO: 6678524 - DNA, 19 bp, Homo sapiens
atttaaaagattcattttt

SEQ ID NO: 6678525 - DNA, 19 bp, Homo sapiens
atttaaaagggaagtctag

SEQ ID NO: 6678526 - DNA, 20 bp, Homo sapiens
atttaaaagtaaaatgtctt

SEQ ID NO: 6678527 - DNA, 15 bp, Homo sapiens
atttaaaagtgtcaa

SEQ ID NO: 6678528 - DNA, 17 bp, Homo sapiens
atttaaaataaacattt

SEQ ID NO: 6678529 - DNA, 13 bp, Homo sapiens
atttaaaataaat

SEQ ID NO: 6678530 - DNA, 14 bp, Homo sapiens
atttaaaataaata

SEQ ID NO: 6678531 - DNA, 18 bp, Homo sapiens
atttaaaataaataaact

SEQ ID NO: 6678532 - DNA, 14 bp, Homo sapiens
atttaaaataaatt

SEQ ID NO: 6678533 - DNA, 16 bp, Homo sapiens
atttaaaataccactg

SEQ ID NO: 6678534 - DNA, 23 bp, Homo sapiens
atttaaaataccactgtaattga

SEQ ID NO: 6678535 - DNA, 21 bp, Homo sapiens
atttaaaatagcaaaagaaga

SEQ ID NO: 6678536 - DNA, 12 bp, Homo sapiens
atttaaaatagt

SEQ ID NO: 6678537 - DNA, 13 bp, Homo sapiens
atttaaaatagtt

SEQ ID NO: 6678538 - DNA, 21 bp, Homo sapiens
atttaaaatagttccagataa

SEQ ID NO: 6678539 - DNA, 17 bp, Homo sapiens
atttaaaatagttttct

SEQ ID NO: 6678540 - DNA, 14 bp, Homo sapiens
atttaaaatatttc

SEQ ID NO: 6678541 - DNA, 14 bp, Homo sapiens
atttaaaatggact

SEQ ID NO: 6678542 - DNA, 11 bp, Homo sapiens
atttaaaatgt

SEQ ID NO: 6678543 - DNA, 18 bp, Homo sapiens
atttaaaatgttacttat

SEQ ID NO: 6678544 - DNA, 21 bp, Homo sapiens
atttaaaattaaataaatttt

SEQ ID NO: 6678545 - DNA, 17 bp, Homo sapiens
atttaaaattaatcttg

SEQ ID NO: 6678546 - DNA, 20 bp, Homo sapiens
atttaaaattaatcttgctt

SEQ ID NO: 6678547 - DNA, 16 bp, Homo sapiens
atttaaaattacgttt

SEQ ID NO: 6678548 - DNA, 11 bp, Homo sapiens
atttaaaattc

SEQ ID NO: 6678549 - DNA, 16 bp, Homo sapiens
atttaaaattccatta

SEQ ID NO: 6678550 - DNA, 21 bp, Homo sapiens
atttaaaattgctatgttact

SEQ ID NO: 6678551 - DNA, 13 bp, Homo sapiens
atttaaaattggc

SEQ ID NO: 6678552 - DNA, 14 bp, Homo sapiens
atttaaaattggca

SEQ ID NO: 6678553 - DNA, 22 bp, Homo sapiens
atttaaaatttcgttgtccaat

SEQ ID NO: 6678554 - DNA, 18 bp, Homo sapiens
atttaaacaaatgtgtaa

SEQ ID NO: 6678555 - DNA, 19 bp, Homo sapiens
atttaaacaataaatgtgc

SEQ ID NO: 6678556 - DNA, 15 bp, Homo sapiens
atttaaacacacaga

SEQ ID NO: 6678557 - DNA, 17 bp, Homo sapiens
atttaaacacattaaag

SEQ ID NO: 6678558 - DNA, 11 bp, Homo sapiens
atttaaacaga

SEQ ID NO: 6678559 - DNA, 15 bp, Homo sapiens
atttaaacagcagtg

SEQ ID NO: 6678560 - DNA, 18 bp, Homo sapiens
atttaaacaggcccagca

SEQ ID NO: 6678561 - DNA, 19 bp, Homo sapiens
atttaaacaggcccagcat

SEQ ID NO: 6678562 - DNA, 19 bp, Homo sapiens
atttaaaccagcagaaaag

SEQ ID NO: 6678563 - DNA, 20 bp, Homo sapiens
atttaaacccaatcagatgc

SEQ ID NO: 6678564 - DNA, 13 bp, Homo sapiens
atttaaacccatt

SEQ ID NO: 6678565 - DNA, 21 bp, Homo sapiens
atttaaaccgctaaaagaaac

SEQ ID NO: 6678566 - DNA, 14 bp, Homo sapiens
atttaaacctttta

SEQ ID NO: 6678567 - DNA, 12 bp, Homo sapiens
atttaaactaaa

SEQ ID NO: 6678568 - DNA, 20 bp, Homo sapiens
atttaaactataagcaagaa

SEQ ID NO: 6678569 - DNA, 17 bp, Homo sapiens
atttaaactatcttgtg

SEQ ID NO: 6678570 - DNA, 17 bp, Homo sapiens
atttaaactattcagag

SEQ ID NO: 6678571 - DNA, 12 bp, Homo sapiens
atttaaactctg

SEQ ID NO: 6678572 - DNA, 17 bp, Homo sapiens
atttaaactgtgtttta

SEQ ID NO: 6678573 - DNA, 18 bp, Homo sapiens
atttaaacttacaaactt

SEQ ID NO: 6678574 - DNA, 14 bp, Homo sapiens
atttaaactttcaa

SEQ ID NO: 6678575 - DNA, 20 bp, Homo sapiens
atttaaactttttaaaatac

SEQ ID NO: 6678576 - DNA, 22 bp, Homo sapiens
atttaaagaaaataaacaccat

SEQ ID NO: 6678577 - DNA, 13 bp, Homo sapiens
atttaaagaaagt

SEQ ID NO: 6678578 - DNA, 15 bp, Homo sapiens
atttaaagaaagtga

SEQ ID NO: 6678579 - DNA, 19 bp, Homo sapiens
atttaaagaacaccctata

SEQ ID NO: 6678580 - DNA, 19 bp, Homo sapiens
atttaaagaatgagaaaca

SEQ ID NO: 6678581 - DNA, 16 bp, Homo sapiens
atttaaagacaaagac

SEQ ID NO: 6678582 - DNA, 18 bp, Homo sapiens
atttaaagacaaagacat

SEQ ID NO: 6678583 - DNA, 23 bp, Homo sapiens
atttaaagacaaagacattattt

SEQ ID NO: 6678584 - DNA, 19 bp, Homo sapiens
atttaaagaccaataaact

SEQ ID NO: 6678585 - DNA, 13 bp, Homo sapiens
atttaaagagatt

SEQ ID NO: 6678586 - DNA, 22 bp, Homo sapiens
atttaaagataccaaatagaaa

SEQ ID NO: 6678587 - DNA, 19 bp, Homo sapiens
atttaaagcaggttcttgt

SEQ ID NO: 6678588 - DNA, 14 bp, Homo sapiens
atttaaagccaaat

SEQ ID NO: 6678589 - DNA, 16 bp, Homo sapiens
atttaaagccaaatgt

SEQ ID NO: 6678590 - DNA, 19 bp, Homo sapiens
atttaaagcttattaaaac

SEQ ID NO: 6678591 - DNA, 21 bp, Homo sapiens
atttaaaggcttaggcatgtt

SEQ ID NO: 6678592 - DNA, 18 bp, Homo sapiens
atttaaagggaaaaccct

SEQ ID NO: 6678593 - DNA, 17 bp, Homo sapiens
atttaaagggaaattga

SEQ ID NO: 6678594 - DNA, 15 bp, Homo sapiens
atttaaagggaatga

SEQ ID NO: 6678595 - DNA, 20 bp, Homo sapiens
atttaaaggggagatactct

SEQ ID NO: 6678596 - DNA, 18 bp, Homo sapiens
atttaaaggtacaatcaa

SEQ ID NO: 6678597 - DNA, 24 bp, Homo sapiens
atttaaagtatcttgcactgataa

SEQ ID NO: 6678598 - DNA, 20 bp, Homo sapiens
atttaaagtattttaatttt

SEQ ID NO: 6678599 - DNA, 21 bp, Homo sapiens
atttaaagtattttaatttta

SEQ ID NO: 6678600 - DNA, 17 bp, Homo sapiens
atttaaagttgtataaa

SEQ ID NO: 6678601 - DNA, 19 bp, Homo sapiens
atttaaagttgtataaaaa

SEQ ID NO: 6678602 - DNA, 17 bp, Homo sapiens
atttaaagttgtatctt

SEQ ID NO: 6678603 - DNA, 22 bp, Homo sapiens
atttaaagttgtttgtgccttt

SEQ ID NO: 6678604 - DNA, 17 bp, Homo sapiens
atttaaatagaacttga

SEQ ID NO: 6678605 - DNA, 14 bp, Homo sapiens
atttaaatagatga

SEQ ID NO: 6678606 - DNA, 13 bp, Homo sapiens
atttaaatataat

SEQ ID NO: 6678607 - DNA, 20 bp, Homo sapiens
atttaaatataattctgtaa

SEQ ID NO: 6678608 - DNA, 23 bp, Homo sapiens
atttaaatataattctgtaaatg

SEQ ID NO: 6678609 - DNA, 20 bp, Homo sapiens
atttaaatatctgaacattt

SEQ ID NO: 6678610 - DNA, 19 bp, Homo sapiens
atttaaatcgtactacaga

SEQ ID NO: 6678611 - DNA, 14 bp, Homo sapiens
atttaaatgcatgt

SEQ ID NO: 6678612 - DNA, 18 bp, Homo sapiens
atttaaatgcatgtctta

SEQ ID NO: 6678613 - DNA, 13 bp, Homo sapiens
atttaaatgccat

SEQ ID NO: 6678614 - DNA, 14 bp, Homo sapiens
atttaaatgctttt

SEQ ID NO: 6678615 - DNA, 21 bp, Homo sapiens
atttaaatgctttttatcgct

SEQ ID NO: 6678616 - DNA, 23 bp, Homo sapiens
atttaaatgctttttatcgctaa

SEQ ID NO: 6678617 - DNA, 14 bp, Homo sapiens
atttaaatggcttt

SEQ ID NO: 6678618 - DNA, 19 bp, Homo sapiens
atttaaatgtaaagacaaa

SEQ ID NO: 6678619 - DNA, 14 bp, Homo sapiens
atttaaatgtgaat

SEQ ID NO: 6678620 - DNA, 18 bp, Homo sapiens
atttaaatgttgaaatct

SEQ ID NO: 6678621 - DNA, 19 bp, Homo sapiens
atttaaatgttgaaatctt

SEQ ID NO: 6678622 - DNA, 12 bp, Homo sapiens
atttaaatgttt

SEQ ID NO: 6678623 - DNA, 13 bp, Homo sapiens
atttaaatgttta

SEQ ID NO: 6678624 - DNA, 21 bp, Homo sapiens
atttaaatgtttaacatcatt

SEQ ID NO: 6678625 - DNA, 21 bp, Homo sapiens
atttaaatgtttactatagac

SEQ ID NO: 6678626 - DNA, 18 bp, Homo sapiens
atttaaattctttttcaa

SEQ ID NO: 6678627 - DNA, 16 bp, Homo sapiens
atttaaattctttttt

SEQ ID NO: 6678628 - DNA, 13 bp, Homo sapiens
atttaaatttagt

SEQ ID NO: 6678629 - DNA, 21 bp, Homo sapiens
atttaaatttatgagtgttaa

SEQ ID NO: 6678630 - DNA, 19 bp, Homo sapiens
atttaaattttacccttta

SEQ ID NO: 6678631 - DNA, 20 bp, Homo sapiens
atttaacaaaaagtgcttca

SEQ ID NO: 6678632 - DNA, 18 bp, Homo sapiens
atttaacaaactaaaaat

SEQ ID NO: 6678633 - DNA, 15 bp, Homo sapiens
atttaacaatgcgaa

SEQ ID NO: 6678634 - DNA, 12 bp, Homo sapiens
atttaacagaaa

SEQ ID NO: 6678635 - DNA, 13 bp, Homo sapiens
atttaacagaaat

SEQ ID NO: 6678636 - DNA, 17 bp, Homo sapiens
atttaacagaaattgta

SEQ ID NO: 6678637 - DNA, 13 bp, Homo sapiens
atttaacagaagt

SEQ ID NO: 6678638 - DNA, 19 bp, Homo sapiens
atttaacagaagttgtgaa

SEQ ID NO: 6678639 - DNA, 20 bp, Homo sapiens
atttaacagaagttgtgaaa

SEQ ID NO: 6678640 - DNA, 17 bp, Homo sapiens
atttaacagtcatttaa

SEQ ID NO: 6678641 - DNA, 22 bp, Homo sapiens
atttaacataatggttgtgaaa

SEQ ID NO: 6678642 - DNA, 21 bp, Homo sapiens
atttaacataggttttgattt

SEQ ID NO: 6678643 - DNA, 23 bp, Homo sapiens
atttaacatcactacaaaaagaa

SEQ ID NO: 6678644 - DNA, 22 bp, Homo sapiens
atttaacatctgcagtgttctg

SEQ ID NO: 6678645 - DNA, 23 bp, Homo sapiens
atttaacatctgcagtgttctgt

SEQ ID NO: 6678646 - DNA, 15 bp, Homo sapiens
atttaacatgggagg

SEQ ID NO: 6678647 - DNA, 16 bp, Homo sapiens
atttaacattatttat

SEQ ID NO: 6678648 - DNA, 12 bp, Homo sapiens
atttaacatttt

SEQ ID NO: 6678649 - DNA, 18 bp, Homo sapiens
atttaacattttacagta

SEQ ID NO: 6678650 - DNA, 21 bp, Homo sapiens
atttaacattttacagtaaat

SEQ ID NO: 6678651 - DNA, 21 bp, Homo sapiens
atttaaccataaatcaattca

SEQ ID NO: 6678652 - DNA, 16 bp, Homo sapiens
atttaacccccctgta

SEQ ID NO: 6678653 - DNA, 18 bp, Homo sapiens
atttaacccccctgtaca

SEQ ID NO: 6678654 - DNA, 21 bp, Homo sapiens
atttaacccccctgtacacaa

SEQ ID NO: 6678655 - DNA, 22 bp, Homo sapiens
atttaaccccttggtactgaaa

SEQ ID NO: 6678656 - DNA, 18 bp, Homo sapiens
atttaacctctaaattct

SEQ ID NO: 6678657 - DNA, 14 bp, Homo sapiens
atttaacctctttt

SEQ ID NO: 6678658 - DNA, 23 bp, Homo sapiens
atttaacctctttttaaggacac

SEQ ID NO: 6678659 - DNA, 22 bp, Homo sapiens
atttaacctgttatttctatga

SEQ ID NO: 6678660 - DNA, 21 bp, Homo sapiens
atttaacgttgatgtaatgaa

SEQ ID NO: 6678661 - DNA, 19 bp, Homo sapiens
atttaactaatttaaacca

SEQ ID NO: 6678662 - DNA, 21 bp, Homo sapiens
atttaactacccttaattact

SEQ ID NO: 6678663 - DNA, 22 bp, Homo sapiens
atttaactacccttaattactt

SEQ ID NO: 6678664 - DNA, 23 bp, Homo sapiens
atttaactacccttaattactta

SEQ ID NO: 6678665 - DNA, 18 bp, Homo sapiens
atttaactccctgtaaca

SEQ ID NO: 6678666 - DNA, 22 bp, Homo sapiens
atttaactctttgaaactgtat

SEQ ID NO: 6678667 - DNA, 19 bp, Homo sapiens
atttaactgaactgtgaac

SEQ ID NO: 6678668 - DNA, 13 bp, Homo sapiens
atttaactgacta

SEQ ID NO: 6678669 - DNA, 13 bp, Homo sapiens
atttaactgactt

SEQ ID NO: 6678670 - DNA, 23 bp, Homo sapiens
atttaactgcctaaaatgttctc

SEQ ID NO: 6678671 - DNA, 20 bp, Homo sapiens
atttaactggagctccgatt

SEQ ID NO: 6678672 - DNA, 18 bp, Homo sapiens
atttaactggtgcacttt

SEQ ID NO: 6678673 - DNA, 22 bp, Homo sapiens
atttaactggtgcactttgtaa

SEQ ID NO: 6678674 - DNA, 23 bp, Homo sapiens
atttaactggtgcactttgtaaa

SEQ ID NO: 6678675 - DNA, 22 bp, Homo sapiens
atttaacttaagaaaatttaca

SEQ ID NO: 6678676 - DNA, 11 bp, Homo sapiens
atttaacttct

SEQ ID NO: 6678677 - DNA, 12 bp, Homo sapiens
atttaacttctg

SEQ ID NO: 6678678 - DNA, 17 bp, Homo sapiens
atttaacttcttcataa

SEQ ID NO: 6678679 - DNA, 17 bp, Homo sapiens
atttaacttgagcttta

SEQ ID NO: 6678680 - DNA, 21 bp, Homo sapiens
atttaacttgagggtaataaa

SEQ ID NO: 6678681 - DNA, 17 bp, Homo sapiens
atttaacttgtttccaa

SEQ ID NO: 6678682 - DNA, 23 bp, Homo sapiens
atttaacttttagtaaagtcaag

SEQ ID NO: 6678683 - DNA, 21 bp, Homo sapiens
atttaagaaaaacaaaatgtt

SEQ ID NO: 6678684 - DNA, 13 bp, Homo sapiens
atttaagaaaaca

SEQ ID NO: 6678685 - DNA, 14 bp, Homo sapiens
atttaagaaaagca

SEQ ID NO: 6678686 - DNA, 20 bp, Homo sapiens
atttaagaaaagcacttttg

SEQ ID NO: 6678687 - DNA, 17 bp, Homo sapiens
atttaagaaaatacaat

SEQ ID NO: 6678688 - DNA, 20 bp, Homo sapiens
atttaagaaaatacaataaa

SEQ ID NO: 6678689 - DNA, 15 bp, Homo sapiens
atttaagaatgacag

SEQ ID NO: 6678690 - DNA, 12 bp, Homo sapiens
atttaagaattt

SEQ ID NO: 6678691 - DNA, 16 bp, Homo sapiens
atttaagaatttacca

SEQ ID NO: 6678692 - DNA, 22 bp, Homo sapiens
atttaagaatttaccagaaata

SEQ ID NO: 6678693 - DNA, 16 bp, Homo sapiens
atttaagaatttgttt

SEQ ID NO: 6678694 - DNA, 15 bp, Homo sapiens
atttaagacataaac

SEQ ID NO: 6678695 - DNA, 22 bp, Homo sapiens
atttaagactgataattttaca

SEQ ID NO: 6678696 - DNA, 23 bp, Homo sapiens
atttaagactgataattttacaa

SEQ ID NO: 6678697 - DNA, 19 bp, Homo sapiens
atttaagagcagtccattt

SEQ ID NO: 6678698 - DNA, 13 bp, Homo sapiens
atttaagagtcct

SEQ ID NO: 6678699 - DNA, 15 bp, Homo sapiens
atttaagatacaaat

SEQ ID NO: 6678700 - DNA, 16 bp, Homo sapiens
atttaagatgtacatt

SEQ ID NO: 6678701 - DNA, 19 bp, Homo sapiens
atttaagatgtacatttaa

SEQ ID NO: 6678702 - DNA, 18 bp, Homo sapiens
atttaagcaaacgtctat

SEQ ID NO: 6678703 - DNA, 14 bp, Homo sapiens
atttaagcacaaaa

SEQ ID NO: 6678704 - DNA, 18 bp, Homo sapiens
atttaagcacaaacttta

SEQ ID NO: 6678705 - DNA, 19 bp, Homo sapiens
atttaagcagcttgaatgg

SEQ ID NO: 6678706 - DNA, 19 bp, Homo sapiens
atttaagcataatctgaaa

SEQ ID NO: 6678707 - DNA, 17 bp, Homo sapiens
atttaagcatgagtggc

SEQ ID NO: 6678708 - DNA, 15 bp, Homo sapiens
atttaagcattcaaa

SEQ ID NO: 6678709 - DNA, 12 bp, Homo sapiens
atttaagcattg

SEQ ID NO: 6678710 - DNA, 18 bp, Homo sapiens
atttaagccaataaataa

SEQ ID NO: 6678711 - DNA, 17 bp, Homo sapiens
atttaagcctaaagatt

SEQ ID NO: 6678712 - DNA, 21 bp, Homo sapiens
atttaagccttacaaagggaa

SEQ ID NO: 6678713 - DNA, 17 bp, Homo sapiens
atttaagccttataaac

SEQ ID NO: 6678714 - DNA, 20 bp, Homo sapiens
atttaagccttataaaccaa

SEQ ID NO: 6678715 - DNA, 15 bp, Homo sapiens
atttaagccttgaca

SEQ ID NO: 6678716 - DNA, 17 bp, Homo sapiens
atttaagccttttgtgt

SEQ ID NO: 6678717 - DNA, 19 bp, Homo sapiens
atttaagctgtaaattaca

SEQ ID NO: 6678718 - DNA, 19 bp, Homo sapiens
atttaagctttaaatgaca

SEQ ID NO: 6678719 - DNA, 22 bp, Homo sapiens
atttaaggagatgtaagagctt

SEQ ID NO: 6678720 - DNA, 15 bp, Homo sapiens
atttaaggatagtgt

SEQ ID NO: 6678721 - DNA, 21 bp, Homo sapiens
atttaaggatagtgtgaagat

SEQ ID NO: 6678722 - DNA, 23 bp, Homo sapiens
atttaaggatgactttttttctg

SEQ ID NO: 6678723 - DNA, 13 bp, Homo sapiens
atttaaggatgga

SEQ ID NO: 6678724 - DNA, 19 bp, Homo sapiens
atttaaggatggatggcac

SEQ ID NO: 6678725 - DNA, 23 bp, Homo sapiens
atttaaggatggatggcaccctg

SEQ ID NO: 6678726 - DNA, 13 bp, Homo sapiens
atttaagggaaaa

SEQ ID NO: 6678727 - DNA, 14 bp, Homo sapiens
atttaagggaaaaa

SEQ ID NO: 6678728 - DNA, 16 bp, Homo sapiens
atttaagggaaaaata

SEQ ID NO: 6678729 - DNA, 19 bp, Homo sapiens
atttaagggaatgtgagca

SEQ ID NO: 6678730 - DNA, 23 bp, Homo sapiens
atttaagggggaaaaagtgtcaa

SEQ ID NO: 6678731 - DNA, 12 bp, Homo sapiens
atttaaggtatt

SEQ ID NO: 6678732 - DNA, 23 bp, Homo sapiens
atttaaggtgtgcaattttctat

SEQ ID NO: 6678733 - DNA, 13 bp, Homo sapiens
atttaagtaattt

SEQ ID NO: 6678734 - DNA, 13 bp, Homo sapiens
atttaagtatata

SEQ ID NO: 6678735 - DNA, 23 bp, Homo sapiens
atttaagtatatagtatatttat

SEQ ID NO: 6678736 - DNA, 14 bp, Homo sapiens
atttaagtatggaa

SEQ ID NO: 6678737 - DNA, 21 bp, Homo sapiens
atttaagtcgggaaattctgc

SEQ ID NO: 6678738 - DNA, 21 bp, Homo sapiens
atttaagtgcgtgtgtagagt

SEQ ID NO: 6678739 - DNA, 17 bp, Homo sapiens
atttaagtggactgtat

SEQ ID NO: 6678740 - DNA, 18 bp, Homo sapiens
atttaagtgttggaaaaa

SEQ ID NO: 6678741 - DNA, 19 bp, Homo sapiens
atttaagttcatattccat

SEQ ID NO: 6678742 - DNA, 15 bp, Homo sapiens
atttaataaaaagga

SEQ ID NO: 6678743 - DNA, 18 bp, Homo sapiens
atttaataaaaaggaata

SEQ ID NO: 6678744 - DNA, 21 bp, Homo sapiens
atttaataaaataattctaaa

SEQ ID NO: 6678745 - DNA, 20 bp, Homo sapiens
atttaataaagaaatattta

SEQ ID NO: 6678746 - DNA, 22 bp, Homo sapiens
atttaataaagaaatatttacc

SEQ ID NO: 6678747 - DNA, 14 bp, Homo sapiens
atttaataaagatg

SEQ ID NO: 6678748 - DNA, 13 bp, Homo sapiens
atttaataacatt

SEQ ID NO: 6678749 - DNA, 13 bp, Homo sapiens
atttaataacttt

SEQ ID NO: 6678750 - DNA, 12 bp, Homo sapiens
atttaataagag

SEQ ID NO: 6678751 - DNA, 20 bp, Homo sapiens
atttaataagagtaaaaata

SEQ ID NO: 6678752 - DNA, 13 bp, Homo sapiens
atttaataatata

SEQ ID NO: 6678753 - DNA, 15 bp, Homo sapiens
atttaataatatact

SEQ ID NO: 6678754 - DNA, 19 bp, Homo sapiens
atttaataatatacttgtg

SEQ ID NO: 6678755 - DNA, 14 bp, Homo sapiens
atttaataatcaga

SEQ ID NO: 6678756 - DNA, 15 bp, Homo sapiens
atttaataatctgta

SEQ ID NO: 6678757 - DNA, 13 bp, Homo sapiens
atttaataattat

SEQ ID NO: 6678758 - DNA, 15 bp, Homo sapiens
atttaataattatat

SEQ ID NO: 6678759 - DNA, 18 bp, Homo sapiens
atttaataattatatgct

SEQ ID NO: 6678760 - DNA, 13 bp, Homo sapiens
atttaatacattt

SEQ ID NO: 6678761 - DNA, 18 bp, Homo sapiens
atttaatacttttgctga

SEQ ID NO: 6678762 - DNA, 20 bp, Homo sapiens
atttaatagataaagtgcct

SEQ ID NO: 6678763 - DNA, 17 bp, Homo sapiens
atttaatagcaaagaat

SEQ ID NO: 6678764 - DNA, 20 bp, Homo sapiens
atttaatagcaaagaattga

SEQ ID NO: 6678765 - DNA, 14 bp, Homo sapiens
atttaatagtgtta

SEQ ID NO: 6678766 - DNA, 21 bp, Homo sapiens
atttaatagtgttaatcaatt

SEQ ID NO: 6678767 - DNA, 14 bp, Homo sapiens
atttaatatactgc

SEQ ID NO: 6678768 - DNA, 16 bp, Homo sapiens
atttaatatactgcat

SEQ ID NO: 6678769 - DNA, 18 bp, Homo sapiens
atttaatatactgcatat

SEQ ID NO: 6678770 - DNA, 19 bp, Homo sapiens
atttaatatagctattttt

SEQ ID NO: 6678771 - DNA, 13 bp, Homo sapiens
atttaatatcaaa

SEQ ID NO: 6678772 - DNA, 20 bp, Homo sapiens
atttaatatcaaaagaaaat

SEQ ID NO: 6678773 - DNA, 16 bp, Homo sapiens
atttaatatctgagaa

SEQ ID NO: 6678774 - DNA, 22 bp, Homo sapiens
atttaatatctgagaagtgtat

SEQ ID NO: 6678775 - DNA, 15 bp, Homo sapiens
atttaatatcttcag

SEQ ID NO: 6678776 - DNA, 14 bp, Homo sapiens
atttaatatgcaaa

SEQ ID NO: 6678777 - DNA, 21 bp, Homo sapiens
atttaatatggatttgttaca

SEQ ID NO: 6678778 - DNA, 17 bp, Homo sapiens
atttaatattacagata

SEQ ID NO: 6678779 - DNA, 18 bp, Homo sapiens
atttaatattatatagga

SEQ ID NO: 6678780 - DNA, 14 bp, Homo sapiens
atttaatatttact

SEQ ID NO: 6678781 - DNA, 23 bp, Homo sapiens
atttaatatttttcaaaatcaaa

SEQ ID NO: 6678782 - DNA, 18 bp, Homo sapiens
atttaatcagtgtgacag

SEQ ID NO: 6678783 - DNA, 14 bp, Homo sapiens
atttaatcatttcc

SEQ ID NO: 6678784 - DNA, 22 bp, Homo sapiens
atttaatcatttccagcaaaat

SEQ ID NO: 6678785 - DNA, 20 bp, Homo sapiens
atttaatccagttataagaa

SEQ ID NO: 6678786 - DNA, 11 bp, Homo sapiens
atttaatcttg

SEQ ID NO: 6678787 - DNA, 14 bp, Homo sapiens
atttaatcttttat

SEQ ID NO: 6678788 - DNA, 19 bp, Homo sapiens
atttaatcttttcttattt

SEQ ID NO: 6678789 - DNA, 20 bp, Homo sapiens
atttaatgaaagactgtaca

SEQ ID NO: 6678790 - DNA, 21 bp, Homo sapiens
atttaatgagttttatcttga

SEQ ID NO: 6678791 - DNA, 16 bp, Homo sapiens
atttaatgatgcttca

SEQ ID NO: 6678792 - DNA, 13 bp, Homo sapiens
atttaatgattga

SEQ ID NO: 6678793 - DNA, 24 bp, Homo sapiens
atttaatgatttttgtgtatccag

SEQ ID NO: 6678794 - DNA, 18 bp, Homo sapiens
atttaatgcattaaacct

SEQ ID NO: 6678795 - DNA, 23 bp, Homo sapiens
atttaatgcctgcccattagaga

SEQ ID NO: 6678796 - DNA, 12 bp, Homo sapiens
atttaatgctgc

SEQ ID NO: 6678797 - DNA, 14 bp, Homo sapiens
atttaatgctgcct

SEQ ID NO: 6678798 - DNA, 14 bp, Homo sapiens
atttaatgctgtgg

SEQ ID NO: 6678799 - DNA, 23 bp, Homo sapiens
atttaatggaagtgtatttattt

SEQ ID NO: 6678800 - DNA, 15 bp, Homo sapiens
atttaatggactgtg

SEQ ID NO: 6678801 - DNA, 16 bp, Homo sapiens
atttaatggactgtga

SEQ ID NO: 6678802 - DNA, 18 bp, Homo sapiens
atttaatggactgtgaat

SEQ ID NO: 6678803 - DNA, 16 bp, Homo sapiens
atttaatggatatttc

SEQ ID NO: 6678804 - DNA, 21 bp, Homo sapiens
atttaatggccggctggaaat

SEQ ID NO: 6678805 - DNA, 17 bp, Homo sapiens
atttaatggggaggaca

SEQ ID NO: 6678806 - DNA, 17 bp, Homo sapiens
atttaatgttacagcat

SEQ ID NO: 6678807 - DNA, 19 bp, Homo sapiens
atttaatgttgaacaaaat

SEQ ID NO: 6678808 - DNA, 12 bp, Homo sapiens
atttaatgtttg

SEQ ID NO: 6678809 - DNA, 13 bp, Homo sapiens
atttaatgtttga

SEQ ID NO: 6678810 - DNA, 14 bp, Homo sapiens
atttaatgtttgat

SEQ ID NO: 6678811 - DNA, 15 bp, Homo sapiens
atttaatgtttgatt

SEQ ID NO: 6678812 - DNA, 19 bp, Homo sapiens
atttaatgtttgatttagt

SEQ ID NO: 6678813 - DNA, 16 bp, Homo sapiens
atttaatgtttgtaag

SEQ ID NO: 6678814 - DNA, 21 bp, Homo sapiens
atttaatgtttgtaagcaatt

SEQ ID NO: 6678815 - DNA, 18 bp, Homo sapiens
atttaatgttttaaatgt

SEQ ID NO: 6678816 - DNA, 20 bp, Homo sapiens
atttaatgttttaaatgtac

SEQ ID NO: 6678817 - DNA, 15 bp, Homo sapiens
atttaatgttttctg

SEQ ID NO: 6678818 - DNA, 16 bp, Homo sapiens
atttaatgttttctgc

SEQ ID NO: 6678819 - DNA, 13 bp, Homo sapiens
atttaattaaaaa

SEQ ID NO: 6678820 - DNA, 18 bp, Homo sapiens
atttaattaaagcacact

SEQ ID NO: 6678821 - DNA, 15 bp, Homo sapiens
atttaattaaatgta

SEQ ID NO: 6678822 - DNA, 19 bp, Homo sapiens
atttaattaatcatgaatg

SEQ ID NO: 6678823 - DNA, 19 bp, Homo sapiens
atttaattacttcttagta

SEQ ID NO: 6678824 - DNA, 15 bp, Homo sapiens
atttaattagtgcta

SEQ ID NO: 6678825 - DNA, 16 bp, Homo sapiens
atttaattagtgctaa

SEQ ID NO: 6678826 - DNA, 21 bp, Homo sapiens
atttaattagtgctaagtgtg

SEQ ID NO: 6678827 - DNA, 23 bp, Homo sapiens
atttaattagtgctaagtgtgaa

SEQ ID NO: 6678828 - DNA, 14 bp, Homo sapiens
atttaattataaaa

SEQ ID NO: 6678829 - DNA, 20 bp, Homo sapiens
atttaattatattatgaata

SEQ ID NO: 6678830 - DNA, 12 bp, Homo sapiens
atttaattatta

SEQ ID NO: 6678831 - DNA, 14 bp, Homo sapiens
atttaattatttgt

SEQ ID NO: 6678832 - DNA, 16 bp, Homo sapiens
atttaattcacctcag

SEQ ID NO: 6678833 - DNA, 14 bp, Homo sapiens
atttaattcataat

SEQ ID NO: 6678834 - DNA, 15 bp, Homo sapiens
atttaattcataatt

SEQ ID NO: 6678835 - DNA, 23 bp, Homo sapiens
atttaattcataattagaacaat

SEQ ID NO: 6678836 - DNA, 17 bp, Homo sapiens
atttaattcatgtttct

SEQ ID NO: 6678837 - DNA, 23 bp, Homo sapiens
atttaattcctctttttagggct

SEQ ID NO: 6678838 - DNA, 17 bp, Homo sapiens
atttaattctgaaatca

SEQ ID NO: 6678839 - DNA, 18 bp, Homo sapiens
atttaattcttcaccttt

SEQ ID NO: 6678840 - DNA, 22 bp, Homo sapiens
atttaattcttcacctttgtaa

SEQ ID NO: 6678841 - DNA, 24 bp, Homo sapiens
atttaattctttctattttcacaa

SEQ ID NO: 6678842 - DNA, 21 bp, Homo sapiens
atttaattgcaacatgaagtt

SEQ ID NO: 6678843 - DNA, 13 bp, Homo sapiens
atttaattgcttt

SEQ ID NO: 6678844 - DNA, 14 bp, Homo sapiens
atttaattgctttg

SEQ ID NO: 6678845 - DNA, 15 bp, Homo sapiens
atttaattgctttga

SEQ ID NO: 6678846 - DNA, 16 bp, Homo sapiens
atttaattgctttgaa

SEQ ID NO: 6678847 - DNA, 13 bp, Homo sapiens
atttaattgtaaa

SEQ ID NO: 6678848 - DNA, 17 bp, Homo sapiens
atttaattgtaaactgt

SEQ ID NO: 6678849 - DNA, 16 bp, Homo sapiens
atttaatttagatatt

SEQ ID NO: 6678850 - DNA, 19 bp, Homo sapiens
atttaatttataggcagat

SEQ ID NO: 6678851 - DNA, 23 bp, Homo sapiens
atttaatttataggcagatcttt

SEQ ID NO: 6678852 - DNA, 12 bp, Homo sapiens
atttaatttatg

SEQ ID NO: 6678853 - DNA, 13 bp, Homo sapiens
atttaatttatgt

SEQ ID NO: 6678854 - DNA, 14 bp, Homo sapiens
atttaatttcataa

SEQ ID NO: 6678855 - DNA, 15 bp, Homo sapiens
atttaatttcataaa

SEQ ID NO: 6678856 - DNA, 17 bp, Homo sapiens
atttaatttcataaatt

SEQ ID NO: 6678857 - DNA, 16 bp, Homo sapiens
atttaatttcatgtat

SEQ ID NO: 6678858 - DNA, 18 bp, Homo sapiens
atttaatttctaatttca

SEQ ID NO: 6678859 - DNA, 19 bp, Homo sapiens
atttaatttctaatttcaa

SEQ ID NO: 6678860 - DNA, 22 bp, Homo sapiens
atttaatttgaaggtagaatgt

SEQ ID NO: 6678861 - DNA, 17 bp, Homo sapiens
atttaatttgccaaaat

SEQ ID NO: 6678862 - DNA, 23 bp, Homo sapiens
atttaatttgtaaaacttctgct

SEQ ID NO: 6678863 - DNA, 13 bp, Homo sapiens
atttaatttgtat

SEQ ID NO: 6678864 - DNA, 18 bp, Homo sapiens
atttaatttgtatgctaa

SEQ ID NO: 6678865 - DNA, 17 bp, Homo sapiens
atttaatttgttataag

SEQ ID NO: 6678866 - DNA, 17 bp, Homo sapiens
atttaattttaatttta

SEQ ID NO: 6678867 - DNA, 16 bp, Homo sapiens
atttaattttgacact

SEQ ID NO: 6678868 - DNA, 11 bp, Homo sapiens
atttaattttt

SEQ ID NO: 6678869 - DNA, 14 bp, Homo sapiens
atttaatttttaaa

SEQ ID NO: 6678870 - DNA, 18 bp, Homo sapiens
atttaatttttaaaagac

SEQ ID NO: 6678871 - DNA, 20 bp, Homo sapiens
atttaatttttaaaagactt

SEQ ID NO: 6678872 - DNA, 17 bp, Homo sapiens
atttaatttttacatga

SEQ ID NO: 6678873 - DNA, 18 bp, Homo sapiens
atttaatttttacatgac

SEQ ID NO: 6678874 - DNA, 16 bp, Homo sapiens
atttaatttttccttt

SEQ ID NO: 6678875 - DNA, 17 bp, Homo sapiens
atttaatttttcctttt

SEQ ID NO: 6678876 - DNA, 17 bp, Homo sapiens
atttaatttttgcaatt

SEQ ID NO: 6678877 - DNA, 22 bp, Homo sapiens
atttaattttttaactgctgca

SEQ ID NO: 6678878 - DNA, 19 bp, Homo sapiens
atttacaaaaatataaaat

SEQ ID NO: 6678879 - DNA, 23 bp, Homo sapiens
atttacaaaaatataaaatatga

SEQ ID NO: 6678880 - DNA, 15 bp, Homo sapiens
atttacaaaagattt

SEQ ID NO: 6678881 - DNA, 14 bp, Homo sapiens
atttacaaaattta

SEQ ID NO: 6678882 - DNA, 15 bp, Homo sapiens
atttacaaaatttat

SEQ ID NO: 6678883 - DNA, 15 bp, Homo sapiens
atttacaaagtgtgt

SEQ ID NO: 6678884 - DNA, 18 bp, Homo sapiens
atttacaaagtgtgtatt

SEQ ID NO: 6678885 - DNA, 19 bp, Homo sapiens
atttacaaagtgtgtatta

SEQ ID NO: 6678886 - DNA, 22 bp, Homo sapiens
atttacaaatgaagtatttcat

SEQ ID NO: 6678887 - DNA, 16 bp, Homo sapiens
atttacaacttccaga

SEQ ID NO: 6678888 - DNA, 21 bp, Homo sapiens
atttacaacttccagatttga

SEQ ID NO: 6678889 - DNA, 14 bp, Homo sapiens
atttacaagaagaa

SEQ ID NO: 6678890 - DNA, 19 bp, Homo sapiens
atttacaagagaagaaagt

SEQ ID NO: 6678891 - DNA, 19 bp, Homo sapiens
atttacaagagctgttcat

SEQ ID NO: 6678892 - DNA, 18 bp, Homo sapiens
atttacaagatggactta

SEQ ID NO: 6678893 - DNA, 21 bp, Homo sapiens
atttacaagcatcatggatca

SEQ ID NO: 6678894 - DNA, 18 bp, Homo sapiens
atttacaagggaagattt

SEQ ID NO: 6678895 - DNA, 21 bp, Homo sapiens
atttacaagggaagatttatg

SEQ ID NO: 6678896 - DNA, 14 bp, Homo sapiens
atttacaataaata

SEQ ID NO: 6678897 - DNA, 17 bp, Homo sapiens
atttacaataaatattc

SEQ ID NO: 6678898 - DNA, 13 bp, Homo sapiens
atttacaatgtat

SEQ ID NO: 6678899 - DNA, 14 bp, Homo sapiens
atttacaatgtatt

SEQ ID NO: 6678900 - DNA, 14 bp, Homo sapiens
atttacaatgtgta

SEQ ID NO: 6678901 - DNA, 15 bp, Homo sapiens
atttacaatttcaaa

SEQ ID NO: 6678902 - DNA, 23 bp, Homo sapiens
atttacaatttcaaaagaacatt

SEQ ID NO: 6678903 - DNA, 13 bp, Homo sapiens
atttacacagtga

SEQ ID NO: 6678904 - DNA, 14 bp, Homo sapiens
atttacacagtgag

SEQ ID NO: 6678905 - DNA, 16 bp, Homo sapiens
atttacacatcttaaa

SEQ ID NO: 6678906 - DNA, 17 bp, Homo sapiens
atttacacatcttaaaa

SEQ ID NO: 6678907 - DNA, 18 bp, Homo sapiens
atttacactatgataaag

SEQ ID NO: 6678908 - DNA, 11 bp, Homo sapiens
atttacagaag

SEQ ID NO: 6678909 - DNA, 22 bp, Homo sapiens
atttacagacacacccagtgcg

SEQ ID NO: 6678910 - DNA, 19 bp, Homo sapiens
atttacagataacttcttt

SEQ ID NO: 6678911 - DNA, 16 bp, Homo sapiens
atttacagctgtgctc

SEQ ID NO: 6678912 - DNA, 15 bp, Homo sapiens
atttacaggaacttc

SEQ ID NO: 6678913 - DNA, 14 bp, Homo sapiens
atttacaggacttc

SEQ ID NO: 6678914 - DNA, 20 bp, Homo sapiens
atttacagtctctttcttcc

SEQ ID NO: 6678915 - DNA, 21 bp, Homo sapiens
atttacagtgaaaatgtaagc

SEQ ID NO: 6678916 - DNA, 22 bp, Homo sapiens
atttacagtgaaaatgtaagct

SEQ ID NO: 6678917 - DNA, 12 bp, Homo sapiens
atttacagtgat

SEQ ID NO: 6678918 - DNA, 22 bp, Homo sapiens
atttacatagtgcaaaactgtg

SEQ ID NO: 6678919 - DNA, 14 bp, Homo sapiens
atttacatatgaaa

SEQ ID NO: 6678920 - DNA, 15 bp, Homo sapiens
atttacatatgaaat

SEQ ID NO: 6678921 - DNA, 17 bp, Homo sapiens
atttacatcagaagttt

SEQ ID NO: 6678922 - DNA, 18 bp, Homo sapiens
atttacatcagaagtttg

SEQ ID NO: 6678923 - DNA, 21 bp, Homo sapiens
atttacatgctactaaatttt

SEQ ID NO: 6678924 - DNA, 14 bp, Homo sapiens
atttacatgtatgg

SEQ ID NO: 6678925 - DNA, 15 bp, Homo sapiens
atttacatgtatggt

SEQ ID NO: 6678926 - DNA, 19 bp, Homo sapiens
atttacatgtattatttca

SEQ ID NO: 6678927 - DNA, 23 bp, Homo sapiens
atttacattaggtattacaagta

SEQ ID NO: 6678928 - DNA, 16 bp, Homo sapiens
atttacattcaactct

SEQ ID NO: 6678929 - DNA, 22 bp, Homo sapiens
atttacatttatctattaaaat

SEQ ID NO: 6678930 - DNA, 12 bp, Homo sapiens
atttacatttta

SEQ ID NO: 6678931 - DNA, 14 bp, Homo sapiens
atttacattttata

SEQ ID NO: 6678932 - DNA, 20 bp, Homo sapiens
atttaccaacatgtatctgt

SEQ ID NO: 6678933 - DNA, 21 bp, Homo sapiens
atttaccaacatgtatctgtc

SEQ ID NO: 6678934 - DNA, 17 bp, Homo sapiens
atttaccacaaaagcaa

SEQ ID NO: 6678935 - DNA, 21 bp, Homo sapiens
atttaccacagcagctgaaca

SEQ ID NO: 6678936 - DNA, 14 bp, Homo sapiens
atttaccacttttt

SEQ ID NO: 6678937 - DNA, 19 bp, Homo sapiens
atttaccagaagtttaaat

SEQ ID NO: 6678938 - DNA, 23 bp, Homo sapiens
atttaccagcctccgtatttcag

SEQ ID NO: 6678939 - DNA, 19 bp, Homo sapiens
atttaccattattttacag

SEQ ID NO: 6678940 - DNA, 15 bp, Homo sapiens
atttaccctggtgga

SEQ ID NO: 6678941 - DNA, 21 bp, Homo sapiens
atttaccctggtggaggcttc

SEQ ID NO: 6678942 - DNA, 16 bp, Homo sapiens
atttaccctttataga

SEQ ID NO: 6678943 - DNA, 23 bp, Homo sapiens
atttacccttttcccccttccca

SEQ ID NO: 6678944 - DNA, 16 bp, Homo sapiens
atttacctcagcctgg

SEQ ID NO: 6678945 - DNA, 18 bp, Homo sapiens
atttacctcgttctgctc

SEQ ID NO: 6678946 - DNA, 15 bp, Homo sapiens
atttacctctaaatt

SEQ ID NO: 6678947 - DNA, 22 bp, Homo sapiens
atttacctctcattagaaaggc

SEQ ID NO: 6678948 - DNA, 19 bp, Homo sapiens
atttacctgcgaacttgtg

SEQ ID NO: 6678949 - DNA, 15 bp, Homo sapiens
atttacctgttgttg

SEQ ID NO: 6678950 - DNA, 15 bp, Homo sapiens
atttacctttggaat

SEQ ID NO: 6678951 - DNA, 20 bp, Homo sapiens
atttaccttttaagacattt

SEQ ID NO: 6678952 - DNA, 22 bp, Homo sapiens
atttaccttttaagacattttc

SEQ ID NO: 6678953 - DNA, 20 bp, Homo sapiens
atttaccttttctgttgtac

SEQ ID NO: 6678954 - DNA, 16 bp, Homo sapiens
atttacctttttgaaa

SEQ ID NO: 6678955 - DNA, 17 bp, Homo sapiens
atttacctttttttagt

SEQ ID NO: 6678956 - DNA, 15 bp, Homo sapiens
atttacgactgaaga

SEQ ID NO: 6678957 - DNA, 15 bp, Homo sapiens
atttacgctttgatt

SEQ ID NO: 6678958 - DNA, 15 bp, Homo sapiens
atttacgtaaaaaga

SEQ ID NO: 6678959 - DNA, 14 bp, Homo sapiens
atttactaaaagaa

SEQ ID NO: 6678960 - DNA, 19 bp, Homo sapiens
atttactaaaatggactgt

SEQ ID NO: 6678961 - DNA, 14 bp, Homo sapiens
atttactaaacata

SEQ ID NO: 6678962 - DNA, 23 bp, Homo sapiens
atttactaacagtaactgccatt

SEQ ID NO: 6678963 - DNA, 16 bp, Homo sapiens
atttactaactaaata

SEQ ID NO: 6678964 - DNA, 21 bp, Homo sapiens
atttactaagccacaagaaat

SEQ ID NO: 6678965 - DNA, 22 bp, Homo sapiens
atttactaagccacaagaaatt

SEQ ID NO: 6678966 - DNA, 15 bp, Homo sapiens
atttactacttttgc

SEQ ID NO: 6678967 - DNA, 14 bp, Homo sapiens
atttactatatata

SEQ ID NO: 6678968 - DNA, 12 bp, Homo sapiens
atttactatgta

SEQ ID NO: 6678969 - DNA, 15 bp, Homo sapiens
atttactatttcaat

SEQ ID NO: 6678970 - DNA, 20 bp, Homo sapiens
atttactcaccatatttgaa

SEQ ID NO: 6678971 - DNA, 22 bp, Homo sapiens
atttactcattcatttattcat

SEQ ID NO: 6678972 - DNA, 15 bp, Homo sapiens
atttactcctcctgc

SEQ ID NO: 6678973 - DNA, 14 bp, Homo sapiens
atttactcttagag

SEQ ID NO: 6678974 - DNA, 13 bp, Homo sapiens
atttactcttctt

SEQ ID NO: 6678975 - DNA, 16 bp, Homo sapiens
atttactcttcttcat

SEQ ID NO: 6678976 - DNA, 20 bp, Homo sapiens
atttactgactgcttataaa

SEQ ID NO: 6678977 - DNA, 21 bp, Homo sapiens
atttactgagagaaggtgaaa

SEQ ID NO: 6678978 - DNA, 21 bp, Homo sapiens
atttactgagcttctctgtga

SEQ ID NO: 6678979 - DNA, 20 bp, Homo sapiens
atttactgatgagagaatgt

SEQ ID NO: 6678980 - DNA, 18 bp, Homo sapiens
atttactgattccagcaa

SEQ ID NO: 6678981 - DNA, 14 bp, Homo sapiens
atttactgcaatgt

SEQ ID NO: 6678982 - DNA, 18 bp, Homo sapiens
atttactgcaatgtctgt

SEQ ID NO: 6678983 - DNA, 17 bp, Homo sapiens
atttactgcattcttct

SEQ ID NO: 6678984 - DNA, 21 bp, Homo sapiens
atttactgcattcttctgatc

SEQ ID NO: 6678985 - DNA, 19 bp, Homo sapiens
atttactggaaacctgtta

SEQ ID NO: 6678986 - DNA, 13 bp, Homo sapiens
atttactggccac

SEQ ID NO: 6678987 - DNA, 12 bp, Homo sapiens
atttactgtact

SEQ ID NO: 6678988 - DNA, 16 bp, Homo sapiens
atttactgtcccagga

SEQ ID NO: 6678989 - DNA, 17 bp, Homo sapiens
atttactgtgagactgt

SEQ ID NO: 6678990 - DNA, 18 bp, Homo sapiens
atttactgttagaattct

SEQ ID NO: 6678991 - DNA, 13 bp, Homo sapiens
atttacttaagac

SEQ ID NO: 6678992 - DNA, 19 bp, Homo sapiens
atttacttaagacttaatg

SEQ ID NO: 6678993 - DNA, 19 bp, Homo sapiens
atttacttaagtgttcatt

SEQ ID NO: 6678994 - DNA, 16 bp, Homo sapiens
atttacttcttataca

SEQ ID NO: 6678995 - DNA, 20 bp, Homo sapiens
atttacttgccattactcaa

SEQ ID NO: 6678996 - DNA, 21 bp, Homo sapiens
atttacttgttatgttgtaat

SEQ ID NO: 6678997 - DNA, 22 bp, Homo sapiens
atttactttaaaaagaaattaa

SEQ ID NO: 6678998 - DNA, 15 bp, Homo sapiens
atttactttgaattt

SEQ ID NO: 6678999 - DNA, 15 bp, Homo sapiens
atttactttgcattt

SEQ ID NO: 6679000 - DNA, 14 bp, Homo sapiens
atttacttttaata

SEQ ID NO: 6679001 - DNA, 17 bp, Homo sapiens
atttagaaaaaaacatg

SEQ ID NO: 6679002 - DNA, 18 bp, Homo sapiens
atttagaaaaaagtttac

SEQ ID NO: 6679003 - DNA, 20 bp, Homo sapiens
atttagaaaaagaacatgca

SEQ ID NO: 6679004 - DNA, 23 bp, Homo sapiens
atttagaaaaagaacatgcagtt

SEQ ID NO: 6679005 - DNA, 21 bp, Homo sapiens
atttagaaaatagagctttta

SEQ ID NO: 6679006 - DNA, 16 bp, Homo sapiens
atttagaaactgaaaa

SEQ ID NO: 6679007 - DNA, 22 bp, Homo sapiens
atttagaaactgaaaaatatct

SEQ ID NO: 6679008 - DNA, 22 bp, Homo sapiens
atttagaaagaagcccaatatt

SEQ ID NO: 6679009 - DNA, 13 bp, Homo sapiens
atttagaaatgtt

SEQ ID NO: 6679010 - DNA, 14 bp, Homo sapiens
atttagaaatgttt

SEQ ID NO: 6679011 - DNA, 17 bp, Homo sapiens
atttagaacctgcattt

SEQ ID NO: 6679012 - DNA, 18 bp, Homo sapiens
atttagaagaaagatgtt

SEQ ID NO: 6679013 - DNA, 17 bp, Homo sapiens
atttagaagatattatt

SEQ ID NO: 6679014 - DNA, 17 bp, Homo sapiens
atttagaagcaaagatt

SEQ ID NO: 6679015 - DNA, 20 bp, Homo sapiens
atttagaagcaaagatttca

SEQ ID NO: 6679016 - DNA, 22 bp, Homo sapiens
atttagaatatgttaatgcaaa

SEQ ID NO: 6679017 - DNA, 12 bp, Homo sapiens
atttagaatcta

SEQ ID NO: 6679018 - DNA, 20 bp, Homo sapiens
atttagaatggttgagttac

SEQ ID NO: 6679019 - DNA, 19 bp, Homo sapiens
atttagaccccatacaagt

SEQ ID NO: 6679020 - DNA, 18 bp, Homo sapiens
atttagaccctgtttcct

SEQ ID NO: 6679021 - DNA, 18 bp, Homo sapiens
atttagaccttttccctg

SEQ ID NO: 6679022 - DNA, 16 bp, Homo sapiens
atttagactgaaacta

SEQ ID NO: 6679023 - DNA, 23 bp, Homo sapiens
atttagacttggattctttccat

SEQ ID NO: 6679024 - DNA, 23 bp, Homo sapiens
atttagagatgaattaaatttaa

SEQ ID NO: 6679025 - DNA, 19 bp, Homo sapiens
atttagagctagtctttca

SEQ ID NO: 6679026 - DNA, 21 bp, Homo sapiens
atttagagcttttcagaacat

SEQ ID NO: 6679027 - DNA, 17 bp, Homo sapiens
atttagaggataaataa

SEQ ID NO: 6679028 - DNA, 19 bp, Homo sapiens
atttagaggataaataata

SEQ ID NO: 6679029 - DNA, 18 bp, Homo sapiens
atttagaggatgtggctg

SEQ ID NO: 6679030 - DNA, 18 bp, Homo sapiens
atttagagggtgaaggag

SEQ ID NO: 6679031 - DNA, 19 bp, Homo sapiens
atttagagggtgaaggaga

SEQ ID NO: 6679032 - DNA, 18 bp, Homo sapiens
atttagagtcaatttgct

SEQ ID NO: 6679033 - DNA, 14 bp, Homo sapiens
atttagagttctag

SEQ ID NO: 6679034 - DNA, 18 bp, Homo sapiens
atttagatattcatactt

SEQ ID NO: 6679035 - DNA, 20 bp, Homo sapiens
atttagatattttccatata

SEQ ID NO: 6679036 - DNA, 23 bp, Homo sapiens
atttagatattttccatatattg

SEQ ID NO: 6679037 - DNA, 12 bp, Homo sapiens
atttagatctta

SEQ ID NO: 6679038 - DNA, 13 bp, Homo sapiens
atttagcaaataa

SEQ ID NO: 6679039 - DNA, 18 bp, Homo sapiens
atttagcaaataatttcc

SEQ ID NO: 6679040 - DNA, 13 bp, Homo sapiens
atttagcaagcaa

SEQ ID NO: 6679041 - DNA, 21 bp, Homo sapiens
atttagcaagcaactaatttt

SEQ ID NO: 6679042 - DNA, 15 bp, Homo sapiens
atttagcaatgctgt

SEQ ID NO: 6679043 - DNA, 15 bp, Homo sapiens
atttagcacagtatt

SEQ ID NO: 6679044 - DNA, 21 bp, Homo sapiens
atttagcacagtatttaacat

SEQ ID NO: 6679045 - DNA, 22 bp, Homo sapiens
atttagcacagtatttaacatt

SEQ ID NO: 6679046 - DNA, 16 bp, Homo sapiens
atttagcagtattgtt

SEQ ID NO: 6679047 - DNA, 19 bp, Homo sapiens
atttagcataaatttaatg

SEQ ID NO: 6679048 - DNA, 18 bp, Homo sapiens
atttagccaataaagaaa

SEQ ID NO: 6679049 - DNA, 23 bp, Homo sapiens
atttagcccgagatctggtcttt

SEQ ID NO: 6679050 - DNA, 17 bp, Homo sapiens
atttagctaacaaaaga

SEQ ID NO: 6679051 - DNA, 21 bp, Homo sapiens
atttagctccaaaccttcaca

SEQ ID NO: 6679052 - DNA, 20 bp, Homo sapiens
atttagctgtattcatatat

SEQ ID NO: 6679053 - DNA, 15 bp, Homo sapiens
atttaggaaattcaa

SEQ ID NO: 6679054 - DNA, 20 bp, Homo sapiens
atttaggaaattcaaagcat

SEQ ID NO: 6679055 - DNA, 16 bp, Homo sapiens
atttaggaatgctcaa

SEQ ID NO: 6679056 - DNA, 17 bp, Homo sapiens
atttaggactgaaaata

SEQ ID NO: 6679057 - DNA, 17 bp, Homo sapiens
atttaggagaagccagg

SEQ ID NO: 6679058 - DNA, 23 bp, Homo sapiens
atttaggccagggtctcactgag

SEQ ID NO: 6679059 - DNA, 20 bp, Homo sapiens
atttagggagaaatgttgtt

SEQ ID NO: 6679060 - DNA, 22 bp, Homo sapiens
atttagggagcagatgactgag

SEQ ID NO: 6679061 - DNA, 18 bp, Homo sapiens
atttagggagtattctaa

SEQ ID NO: 6679062 - DNA, 17 bp, Homo sapiens
atttagggccttttctg

SEQ ID NO: 6679063 - DNA, 18 bp, Homo sapiens
atttaggtaaataaagct

SEQ ID NO: 6679064 - DNA, 14 bp, Homo sapiens
atttaggtttctga

SEQ ID NO: 6679065 - DNA, 17 bp, Homo sapiens
atttaggtttctgagtt

SEQ ID NO: 6679066 - DNA, 17 bp, Homo sapiens
atttaggtttttattag

SEQ ID NO: 6679067 - DNA, 17 bp, Homo sapiens
atttaggtttttggctg

SEQ ID NO: 6679068 - DNA, 23 bp, Homo sapiens
atttaggtttttgtttgtttcct

SEQ ID NO: 6679069 - DNA, 15 bp, Homo sapiens
atttagtaaaaataa

SEQ ID NO: 6679070 - DNA, 21 bp, Homo sapiens
atttagtaaagtttgttgaaa

SEQ ID NO: 6679071 - DNA, 14 bp, Homo sapiens
atttagtaaatgct

SEQ ID NO: 6679072 - DNA, 14 bp, Homo sapiens
atttagtaaatgtt

SEQ ID NO: 6679073 - DNA, 17 bp, Homo sapiens
atttagtacactatgtt

SEQ ID NO: 6679074 - DNA, 16 bp, Homo sapiens
atttagtaccctgcag

SEQ ID NO: 6679075 - DNA, 17 bp, Homo sapiens
atttagtaccctgcagg

SEQ ID NO: 6679076 - DNA, 21 bp, Homo sapiens
atttagtaggtgagttttcac

SEQ ID NO: 6679077 - DNA, 17 bp, Homo sapiens
atttagtagttatttgt

SEQ ID NO: 6679078 - DNA, 16 bp, Homo sapiens
atttagtattatcaaa

SEQ ID NO: 6679079 - DNA, 18 bp, Homo sapiens
atttagtattttgtttca

SEQ ID NO: 6679080 - DNA, 20 bp, Homo sapiens
atttagtcaattgtttaatg

SEQ ID NO: 6679081 - DNA, 21 bp, Homo sapiens
atttagtcacaccatcttaaa

SEQ ID NO: 6679082 - DNA, 23 bp, Homo sapiens
atttagtcccaccctatggccac

SEQ ID NO: 6679083 - DNA, 21 bp, Homo sapiens
atttagtctctttattcctag

SEQ ID NO: 6679084 - DNA, 22 bp, Homo sapiens
atttagtctctttattcctagt

SEQ ID NO: 6679085 - DNA, 20 bp, Homo sapiens
atttagtgaaagctagagat

SEQ ID NO: 6679086 - DNA, 15 bp, Homo sapiens
atttagtgaactacg

SEQ ID NO: 6679087 - DNA, 22 bp, Homo sapiens
atttagtgacaaaaataaaaag

SEQ ID NO: 6679088 - DNA, 21 bp, Homo sapiens
atttagtgagttattccttga

SEQ ID NO: 6679089 - DNA, 18 bp, Homo sapiens
atttagtgatactggctc

SEQ ID NO: 6679090 - DNA, 16 bp, Homo sapiens
atttagtgctaaacaa

SEQ ID NO: 6679091 - DNA, 15 bp, Homo sapiens
atttagtgctcagaa

SEQ ID NO: 6679092 - DNA, 14 bp, Homo sapiens
atttagtgctcagt

SEQ ID NO: 6679093 - DNA, 17 bp, Homo sapiens
atttagtgcttaacatt

SEQ ID NO: 6679094 - DNA, 18 bp, Homo sapiens
atttagtggatggaatat

SEQ ID NO: 6679095 - DNA, 20 bp, Homo sapiens
atttagtggtggtagaaatg

SEQ ID NO: 6679096 - DNA, 17 bp, Homo sapiens
atttagtgttcataaat

SEQ ID NO: 6679097 - DNA, 14 bp, Homo sapiens
atttagttatagtt

SEQ ID NO: 6679098 - DNA, 17 bp, Homo sapiens
atttagttctttgttat

SEQ ID NO: 6679099 - DNA, 18 bp, Homo sapiens
atttagttgaaaaatcta

SEQ ID NO: 6679100 - DNA, 21 bp, Homo sapiens
atttagttgattttaattact

SEQ ID NO: 6679101 - DNA, 15 bp, Homo sapiens
atttagttgtgcagt

SEQ ID NO: 6679102 - DNA, 14 bp, Homo sapiens
atttagttgtggaa

SEQ ID NO: 6679103 - DNA, 18 bp, Homo sapiens
atttagttgttgtagaga

SEQ ID NO: 6679104 - DNA, 20 bp, Homo sapiens
atttagttgttgtagagaaa

SEQ ID NO: 6679105 - DNA, 17 bp, Homo sapiens
atttagttgtttctaga

SEQ ID NO: 6679106 - DNA, 13 bp, Homo sapiens
atttagtttgtta

SEQ ID NO: 6679107 - DNA, 14 bp, Homo sapiens
atttagtttgttaa

SEQ ID NO: 6679108 - DNA, 20 bp, Homo sapiens
atttagtttgttaaagcctg

SEQ ID NO: 6679109 - DNA, 14 bp, Homo sapiens
atttagttttatgg

SEQ ID NO: 6679110 - DNA, 21 bp, Homo sapiens
atttagttttgtaacttagct

SEQ ID NO: 6679111 - DNA, 16 bp, Homo sapiens
atttataaaaaggtgt

SEQ ID NO: 6679112 - DNA, 17 bp, Homo sapiens
atttataaaaataaaaa

SEQ ID NO: 6679113 - DNA, 20 bp, Homo sapiens
atttataaaaatataaattg

SEQ ID NO: 6679114 - DNA, 14 bp, Homo sapiens
atttataaaacttt

SEQ ID NO: 6679115 - DNA, 21 bp, Homo sapiens
atttataaaattagaaagcaa

SEQ ID NO: 6679116 - DNA, 16 bp, Homo sapiens
atttataaaccagcag

SEQ ID NO: 6679117 - DNA, 23 bp, Homo sapiens
atttataaactaattttgtacgt

SEQ ID NO: 6679118 - DNA, 14 bp, Homo sapiens
atttataaactaga

SEQ ID NO: 6679119 - DNA, 19 bp, Homo sapiens
atttataaactagatctcc

SEQ ID NO: 6679120 - DNA, 18 bp, Homo sapiens
atttataaactaggtaaa

SEQ ID NO: 6679121 - DNA, 15 bp, Homo sapiens
atttataaacttttt

SEQ ID NO: 6679122 - DNA, 17 bp, Homo sapiens
atttataaagcaaatta

SEQ ID NO: 6679123 - DNA, 14 bp, Homo sapiens
atttataaatatgt

SEQ ID NO: 6679124 - DNA, 13 bp, Homo sapiens
atttataaatgaa

SEQ ID NO: 6679125 - DNA, 14 bp, Homo sapiens
atttataaatgcac

SEQ ID NO: 6679126 - DNA, 13 bp, Homo sapiens
atttataaatgct

SEQ ID NO: 6679127 - DNA, 14 bp, Homo sapiens
atttataaatgcta

SEQ ID NO: 6679128 - DNA, 21 bp, Homo sapiens
atttataacaatgttaaatgc

SEQ ID NO: 6679129 - DNA, 15 bp, Homo sapiens
atttataacagttat

SEQ ID NO: 6679130 - DNA, 16 bp, Homo sapiens
atttataacagttata

SEQ ID NO: 6679131 - DNA, 15 bp, Homo sapiens
atttataacattgta

SEQ ID NO: 6679132 - DNA, 16 bp, Homo sapiens
atttataacattgtaa

SEQ ID NO: 6679133 - DNA, 20 bp, Homo sapiens
atttataacgtgttcaatat

SEQ ID NO: 6679134 - DNA, 20 bp, Homo sapiens
atttataactaatatggttt

SEQ ID NO: 6679135 - DNA, 13 bp, Homo sapiens
atttataactcat

SEQ ID NO: 6679136 - DNA, 19 bp, Homo sapiens
atttataactcatcataaa

SEQ ID NO: 6679137 - DNA, 22 bp, Homo sapiens
atttataactcatcataaaata

SEQ ID NO: 6679138 - DNA, 20 bp, Homo sapiens
atttataagcattgccattg

SEQ ID NO: 6679139 - DNA, 18 bp, Homo sapiens
atttataatacagaatct

SEQ ID NO: 6679140 - DNA, 22 bp, Homo sapiens
atttataatcacttttttccac

SEQ ID NO: 6679141 - DNA, 23 bp, Homo sapiens
atttataatcacttttttccaca

SEQ ID NO: 6679142 - DNA, 12 bp, Homo sapiens
atttataatgta

SEQ ID NO: 6679143 - DNA, 19 bp, Homo sapiens
atttataatgtatttgaaa

SEQ ID NO: 6679144 - DNA, 20 bp, Homo sapiens
atttataatgtatttgaaaa

SEQ ID NO: 6679145 - DNA, 20 bp, Homo sapiens
atttataatgttagtagaaa

SEQ ID NO: 6679146 - DNA, 23 bp, Homo sapiens
atttataattaaagaaaattgcc

SEQ ID NO: 6679147 - DNA, 17 bp, Homo sapiens
atttataattcagtatg

SEQ ID NO: 6679148 - DNA, 19 bp, Homo sapiens
atttataattcagtatgtt

SEQ ID NO: 6679149 - DNA, 21 bp, Homo sapiens
atttataatttaaatgatatt

SEQ ID NO: 6679150 - DNA, 22 bp, Homo sapiens
atttataatttaaatgatattt

SEQ ID NO: 6679151 - DNA, 13 bp, Homo sapiens
atttatacaaaga

SEQ ID NO: 6679152 - DNA, 17 bp, Homo sapiens
atttatacaaagaaact

SEQ ID NO: 6679153 - DNA, 20 bp, Homo sapiens
atttatacaccagcaattta

SEQ ID NO: 6679154 - DNA, 15 bp, Homo sapiens
atttatacatacaga

SEQ ID NO: 6679155 - DNA, 21 bp, Homo sapiens
atttataccagttttctttat

SEQ ID NO: 6679156 - DNA, 22 bp, Homo sapiens
atttatacctcaaactatctgg

SEQ ID NO: 6679157 - DNA, 14 bp, Homo sapiens
atttatactattta

SEQ ID NO: 6679158 - DNA, 16 bp, Homo sapiens
atttatactgtagcaa

SEQ ID NO: 6679159 - DNA, 13 bp, Homo sapiens
atttatactttgc

SEQ ID NO: 6679160 - DNA, 15 bp, Homo sapiens
atttatagaaagctt

SEQ ID NO: 6679161 - DNA, 16 bp, Homo sapiens
atttatagagttcata

SEQ ID NO: 6679162 - DNA, 21 bp, Homo sapiens
atttatagagttcatagaaat

SEQ ID NO: 6679163 - DNA, 17 bp, Homo sapiens
atttatagatcatttct

SEQ ID NO: 6679164 - DNA, 18 bp, Homo sapiens
atttatagatcatttcta

SEQ ID NO: 6679165 - DNA, 15 bp, Homo sapiens
atttataggaccttc

SEQ ID NO: 6679166 - DNA, 22 bp, Homo sapiens
atttataggcagatctttaaat

SEQ ID NO: 6679167 - DNA, 23 bp, Homo sapiens
atttataggcagatctttaaata

SEQ ID NO: 6679168 - DNA, 17 bp, Homo sapiens
atttataggccagggca

SEQ ID NO: 6679169 - DNA, 18 bp, Homo sapiens
atttataggcgttttttg

SEQ ID NO: 6679170 - DNA, 13 bp, Homo sapiens
atttatagggctt

SEQ ID NO: 6679171 - DNA, 21 bp, Homo sapiens
atttatagtaatgagtttaaa

SEQ ID NO: 6679172 - DNA, 18 bp, Homo sapiens
atttatagtttatacagt

SEQ ID NO: 6679173 - DNA, 16 bp, Homo sapiens
atttatagtttgtaca

SEQ ID NO: 6679174 - DNA, 12 bp, Homo sapiens
atttatataaag

SEQ ID NO: 6679175 - DNA, 15 bp, Homo sapiens
atttatataaagtat

SEQ ID NO: 6679176 - DNA, 18 bp, Homo sapiens
atttatataaagtatttt

SEQ ID NO: 6679177 - DNA, 20 bp, Homo sapiens
atttatataaagtattttta

SEQ ID NO: 6679178 - DNA, 17 bp, Homo sapiens
atttatataactgttgt

SEQ ID NO: 6679179 - DNA, 20 bp, Homo sapiens
atttatataactgttgttga

SEQ ID NO: 6679180 - DNA, 23 bp, Homo sapiens
atttatataagcccttaataata

SEQ ID NO: 6679181 - DNA, 19 bp, Homo sapiens
atttatatacaacctgctt

SEQ ID NO: 6679182 - DNA, 20 bp, Homo sapiens
atttatatactttttcatga

SEQ ID NO: 6679183 - DNA, 12 bp, Homo sapiens
atttatatatat

SEQ ID NO: 6679184 - DNA, 17 bp, Homo sapiens
atttatatatcagttat

SEQ ID NO: 6679185 - DNA, 19 bp, Homo sapiens
atttatatatctaagttca

SEQ ID NO: 6679186 - DNA, 14 bp, Homo sapiens
atttatatatgaaa

SEQ ID NO: 6679187 - DNA, 17 bp, Homo sapiens
atttatatatgaaaact

SEQ ID NO: 6679188 - DNA, 18 bp, Homo sapiens
atttatatatgaaaacta

SEQ ID NO: 6679189 - DNA, 16 bp, Homo sapiens
atttatatatgaagta

SEQ ID NO: 6679190 - DNA, 14 bp, Homo sapiens
atttatatatggca

SEQ ID NO: 6679191 - DNA, 15 bp, Homo sapiens
atttatatatggcat

SEQ ID NO: 6679192 - DNA, 17 bp, Homo sapiens
atttatatatggcatat

SEQ ID NO: 6679193 - DNA, 16 bp, Homo sapiens
atttatatatgtatct

SEQ ID NO: 6679194 - DNA, 15 bp, Homo sapiens
atttatatatgtatt

SEQ ID NO: 6679195 - DNA, 12 bp, Homo sapiens
atttatatattt

SEQ ID NO: 6679196 - DNA, 15 bp, Homo sapiens
atttatatatttata

SEQ ID NO: 6679197 - DNA, 17 bp, Homo sapiens
atttatatatttataac

SEQ ID NO: 6679198 - DNA, 20 bp, Homo sapiens
atttatatatttataactca

SEQ ID NO: 6679199 - DNA, 13 bp, Homo sapiens
atttatatatttg

SEQ ID NO: 6679200 - DNA, 15 bp, Homo sapiens
atttatatcacatgt

SEQ ID NO: 6679201 - DNA, 16 bp, Homo sapiens
atttatatcaggtgta

SEQ ID NO: 6679202 - DNA, 21 bp, Homo sapiens
atttatatcagtttcatgaaa

SEQ ID NO: 6679203 - DNA, 13 bp, Homo sapiens
atttatatctata

SEQ ID NO: 6679204 - DNA, 17 bp, Homo sapiens
atttatatctatagtag

SEQ ID NO: 6679205 - DNA, 21 bp, Homo sapiens
atttatatctgcttctagctt

SEQ ID NO: 6679206 - DNA, 22 bp, Homo sapiens
atttatatcttatatataataa

SEQ ID NO: 6679207 - DNA, 15 bp, Homo sapiens
atttatatcttgtta

SEQ ID NO: 6679208 - DNA, 13 bp, Homo sapiens
atttatatcttta

SEQ ID NO: 6679209 - DNA, 19 bp, Homo sapiens
atttatatctttatgcaaa

SEQ ID NO: 6679210 - DNA, 11 bp, Homo sapiens
atttatatgaa

SEQ ID NO: 6679211 - DNA, 13 bp, Homo sapiens
atttatatgaagc

SEQ ID NO: 6679212 - DNA, 18 bp, Homo sapiens
atttatatgaagcaagct

SEQ ID NO: 6679213 - DNA, 20 bp, Homo sapiens
atttatatgaagcaagctgt

SEQ ID NO: 6679214 - DNA, 14 bp, Homo sapiens
atttatatgcatgc

SEQ ID NO: 6679215 - DNA, 15 bp, Homo sapiens
atttatatgcatgca

SEQ ID NO: 6679216 - DNA, 16 bp, Homo sapiens
atttatatgtacatga

SEQ ID NO: 6679217 - DNA, 13 bp, Homo sapiens
atttatatgtact

SEQ ID NO: 6679218 - DNA, 15 bp, Homo sapiens
atttatatgttatta

SEQ ID NO: 6679219 - DNA, 20 bp, Homo sapiens
atttatattaaataacatgt

SEQ ID NO: 6679220 - DNA, 21 bp, Homo sapiens
atttatattaattgagattat

SEQ ID NO: 6679221 - DNA, 13 bp, Homo sapiens
atttatattagag

SEQ ID NO: 6679222 - DNA, 16 bp, Homo sapiens
atttatattagagtgc

SEQ ID NO: 6679223 - DNA, 13 bp, Homo sapiens
atttatattgata

SEQ ID NO: 6679224 - DNA, 22 bp, Homo sapiens
atttatattgataagatctttt

SEQ ID NO: 6679225 - DNA, 22 bp, Homo sapiens
atttatattgtatattctggaa

SEQ ID NO: 6679226 - DNA, 14 bp, Homo sapiens
atttatatttaaat

SEQ ID NO: 6679227 - DNA, 17 bp, Homo sapiens
atttatatttaaattat

SEQ ID NO: 6679228 - DNA, 18 bp, Homo sapiens
atttatatttaaattata

SEQ ID NO: 6679229 - DNA, 15 bp, Homo sapiens
atttatatttagtaa

SEQ ID NO: 6679230 - DNA, 15 bp, Homo sapiens
atttatatttattga

SEQ ID NO: 6679231 - DNA, 22 bp, Homo sapiens
atttatatttattgactcttga

SEQ ID NO: 6679232 - DNA, 13 bp, Homo sapiens
atttatatttcac

SEQ ID NO: 6679233 - DNA, 23 bp, Homo sapiens
atttatatttcctgtattgcttt

SEQ ID NO: 6679234 - DNA, 16 bp, Homo sapiens
atttatatttgaaatt

SEQ ID NO: 6679235 - DNA, 12 bp, Homo sapiens
atttatatttgg

SEQ ID NO: 6679236 - DNA, 17 bp, Homo sapiens
atttatatttggaaaga

SEQ ID NO: 6679237 - DNA, 18 bp, Homo sapiens
atttatatttggaaagag

SEQ ID NO: 6679238 - DNA, 14 bp, Homo sapiens
atttatattttccc

SEQ ID NO: 6679239 - DNA, 12 bp, Homo sapiens
atttatcaaaat

SEQ ID NO: 6679240 - DNA, 13 bp, Homo sapiens
atttatcaaaatg

SEQ ID NO: 6679241 - DNA, 22 bp, Homo sapiens
atttatcaaagcatagatgttt

SEQ ID NO: 6679242 - DNA, 12 bp, Homo sapiens
atttatcaaatc

SEQ ID NO: 6679243 - DNA, 13 bp, Homo sapiens
atttatcaaatca

SEQ ID NO: 6679244 - DNA, 23 bp, Homo sapiens
atttatcaatttttcccagtatt

SEQ ID NO: 6679245 - DNA, 16 bp, Homo sapiens
atttatcacacttctg

SEQ ID NO: 6679246 - DNA, 15 bp, Homo sapiens
atttatcaggagaag

SEQ ID NO: 6679247 - DNA, 14 bp, Homo sapiens
atttatcagtgaca

SEQ ID NO: 6679248 - DNA, 16 bp, Homo sapiens
atttatcatatttaat

SEQ ID NO: 6679249 - DNA, 21 bp, Homo sapiens
atttatccaattttgatcttt

SEQ ID NO: 6679250 - DNA, 20 bp, Homo sapiens
atttatccacaggaaagtgt

SEQ ID NO: 6679251 - DNA, 22 bp, Homo sapiens
atttatccagaaaactgtgatt

SEQ ID NO: 6679252 - DNA, 21 bp, Homo sapiens
atttatccaggaattgatacg

SEQ ID NO: 6679253 - DNA, 19 bp, Homo sapiens
atttatcctagtattccta

SEQ ID NO: 6679254 - DNA, 20 bp, Homo sapiens
atttatcctgaaatttcaga

SEQ ID NO: 6679255 - DNA, 22 bp, Homo sapiens
atttatcgaaagtaaaaaagat

SEQ ID NO: 6679256 - DNA, 13 bp, Homo sapiens
atttatctaaatt

SEQ ID NO: 6679257 - DNA, 14 bp, Homo sapiens
atttatctactatt

SEQ ID NO: 6679258 - DNA, 15 bp, Homo sapiens
atttatctataattt

SEQ ID NO: 6679259 - DNA, 16 bp, Homo sapiens
atttatctattgtaag

SEQ ID NO: 6679260 - DNA, 23 bp, Homo sapiens
atttatctgaatataggaagcat

SEQ ID NO: 6679261 - DNA, 17 bp, Homo sapiens
atttatctgagcaataa

SEQ ID NO: 6679262 - DNA, 19 bp, Homo sapiens
atttatctgagtcaactcc

SEQ ID NO: 6679263 - DNA, 20 bp, Homo sapiens
atttatctgggattatggtt

SEQ ID NO: 6679264 - DNA, 20 bp, Homo sapiens
atttatctgtattttttaca

SEQ ID NO: 6679265 - DNA, 14 bp, Homo sapiens
atttatctgtgaat

SEQ ID NO: 6679266 - DNA, 18 bp, Homo sapiens
atttatcttaagttctat

SEQ ID NO: 6679267 - DNA, 13 bp, Homo sapiens
atttatcttctgt

SEQ ID NO: 6679268 - DNA, 14 bp, Homo sapiens
atttatcttctgtt

SEQ ID NO: 6679269 - DNA, 12 bp, Homo sapiens
atttatcttgaa

SEQ ID NO: 6679270 - DNA, 19 bp, Homo sapiens
atttatcttgtctctgggc

SEQ ID NO: 6679271 - DNA, 18 bp, Homo sapiens
atttatgaaaaaatatga

SEQ ID NO: 6679272 - DNA, 15 bp, Homo sapiens
atttatgaagaaaat

SEQ ID NO: 6679273 - DNA, 15 bp, Homo sapiens
atttatgaagatagt

SEQ ID NO: 6679274 - DNA, 16 bp, Homo sapiens
atttatgaagatagtt

SEQ ID NO: 6679275 - DNA, 15 bp, Homo sapiens
atttatgaagttttt

SEQ ID NO: 6679276 - DNA, 16 bp, Homo sapiens
atttatgaatgtgcat

SEQ ID NO: 6679277 - DNA, 22 bp, Homo sapiens
atttatgaatgtgcatttcttg

SEQ ID NO: 6679278 - DNA, 14 bp, Homo sapiens
atttatgaccagag

SEQ ID NO: 6679279 - DNA, 19 bp, Homo sapiens
atttatgaccagagcaaaa

SEQ ID NO: 6679280 - DNA, 18 bp, Homo sapiens
atttatgacctaagtcag

SEQ ID NO: 6679281 - DNA, 18 bp, Homo sapiens
atttatgacctcaacaaa

SEQ ID NO: 6679282 - DNA, 21 bp, Homo sapiens
atttatgacctcaacaaagaa

SEQ ID NO: 6679283 - DNA, 21 bp, Homo sapiens
atttatgactccactgtggaa

SEQ ID NO: 6679284 - DNA, 15 bp, Homo sapiens
atttatgagtttttg

SEQ ID NO: 6679285 - DNA, 16 bp, Homo sapiens
atttatgatgcagttt

SEQ ID NO: 6679286 - DNA, 14 bp, Homo sapiens
atttatgatgttat

SEQ ID NO: 6679287 - DNA, 16 bp, Homo sapiens
atttatgcaaggtatt

SEQ ID NO: 6679288 - DNA, 17 bp, Homo sapiens
atttatgcaagttaggg

SEQ ID NO: 6679289 - DNA, 19 bp, Homo sapiens
atttatgcagaaggtattt

SEQ ID NO: 6679290 - DNA, 22 bp, Homo sapiens
atttatgcagaaggtatttttg

SEQ ID NO: 6679291 - DNA, 22 bp, Homo sapiens
atttatgcagagacagctgttt

SEQ ID NO: 6679292 - DNA, 16 bp, Homo sapiens
atttatgcatattatt

SEQ ID NO: 6679293 - DNA, 15 bp, Homo sapiens
atttatgcatgagaa

SEQ ID NO: 6679294 - DNA, 22 bp, Homo sapiens
atttatgcatgagaactaaata

SEQ ID NO: 6679295 - DNA, 18 bp, Homo sapiens
atttatgcatttatgcat

SEQ ID NO: 6679296 - DNA, 13 bp, Homo sapiens
atttatgcatttc

SEQ ID NO: 6679297 - DNA, 21 bp, Homo sapiens
atttatgcgtaatttaatggg

SEQ ID NO: 6679298 - DNA, 22 bp, Homo sapiens
atttatgctataaattttttga

SEQ ID NO: 6679299 - DNA, 20 bp, Homo sapiens
atttatgcttaaaatatgta

SEQ ID NO: 6679300 - DNA, 21 bp, Homo sapiens
atttatgcttaaaatatgtat

SEQ ID NO: 6679301 - DNA, 22 bp, Homo sapiens
atttatgcttaaaatatgtatg

SEQ ID NO: 6679302 - DNA, 16 bp, Homo sapiens
atttatggaagaaaga

SEQ ID NO: 6679303 - DNA, 14 bp, Homo sapiens
atttatggaccact

SEQ ID NO: 6679304 - DNA, 12 bp, Homo sapiens
atttatggagga

SEQ ID NO: 6679305 - DNA, 18 bp, Homo sapiens
atttatggattaaaaact

SEQ ID NO: 6679306 - DNA, 20 bp, Homo sapiens
atttatggccgtatcaaatg

SEQ ID NO: 6679307 - DNA, 13 bp, Homo sapiens
atttatgggcccc

SEQ ID NO: 6679308 - DNA, 16 bp, Homo sapiens
atttatgggcccctgg

SEQ ID NO: 6679309 - DNA, 18 bp, Homo sapiens
atttatggtcaacactta

SEQ ID NO: 6679310 - DNA, 23 bp, Homo sapiens
atttatggttgttaaaaatgtca

SEQ ID NO: 6679311 - DNA, 12 bp, Homo sapiens
atttatgtaaac

SEQ ID NO: 6679312 - DNA, 23 bp, Homo sapiens
atttatgtaaactgcattagaaa

SEQ ID NO: 6679313 - DNA, 18 bp, Homo sapiens
atttatgtaatgaagtaa

SEQ ID NO: 6679314 - DNA, 21 bp, Homo sapiens
atttatgtaatgaagtaaagc

SEQ ID NO: 6679315 - DNA, 21 bp, Homo sapiens
atttatgtaatgctttatgtt

SEQ ID NO: 6679316 - DNA, 15 bp, Homo sapiens
atttatgtacaaaat

SEQ ID NO: 6679317 - DNA, 23 bp, Homo sapiens
atttatgtagacattgtaaataa

SEQ ID NO: 6679318 - DNA, 12 bp, Homo sapiens
atttatgtagat

SEQ ID NO: 6679319 - DNA, 14 bp, Homo sapiens
atttatgtagatgt

SEQ ID NO: 6679320 - DNA, 21 bp, Homo sapiens
atttatgtagatgtgcatttt

SEQ ID NO: 6679321 - DNA, 12 bp, Homo sapiens
atttatgtatct

SEQ ID NO: 6679322 - DNA, 17 bp, Homo sapiens
atttatgtattgtgcaa

SEQ ID NO: 6679323 - DNA, 17 bp, Homo sapiens
atttatgtattttgaaa

SEQ ID NO: 6679324 - DNA, 22 bp, Homo sapiens
atttatgtctatttaagcctca

SEQ ID NO: 6679325 - DNA, 15 bp, Homo sapiens
atttatgtctcatgt

SEQ ID NO: 6679326 - DNA, 18 bp, Homo sapiens
atttatgtgaaatgcttt

SEQ ID NO: 6679327 - DNA, 12 bp, Homo sapiens
atttatgtgcac

SEQ ID NO: 6679328 - DNA, 17 bp, Homo sapiens
atttatgtgctgttaga

SEQ ID NO: 6679329 - DNA, 15 bp, Homo sapiens
atttatgtgtagaat

SEQ ID NO: 6679330 - DNA, 21 bp, Homo sapiens
atttatgtgtagaatttgaaa

SEQ ID NO: 6679331 - DNA, 17 bp, Homo sapiens
atttatgtgtatatttg

SEQ ID NO: 6679332 - DNA, 20 bp, Homo sapiens
atttatgtgtatatttgtag

SEQ ID NO: 6679333 - DNA, 21 bp, Homo sapiens
atttatgtgtatatttgtaga

SEQ ID NO: 6679334 - DNA, 13 bp, Homo sapiens
atttatgtgtgag

SEQ ID NO: 6679335 - DNA, 22 bp, Homo sapiens
atttatgtgtgaggagctgctg

SEQ ID NO: 6679336 - DNA, 14 bp, Homo sapiens
atttatgttaaaag

SEQ ID NO: 6679337 - DNA, 21 bp, Homo sapiens
atttatgttatttatgatgtt

SEQ ID NO: 6679338 - DNA, 18 bp, Homo sapiens
atttatgttgtatagatt

SEQ ID NO: 6679339 - DNA, 13 bp, Homo sapiens
atttatgtttgca

SEQ ID NO: 6679340 - DNA, 19 bp, Homo sapiens
atttattaaaatgattgta

SEQ ID NO: 6679341 - DNA, 21 bp, Homo sapiens
atttattaaaatgattgtaaa

SEQ ID NO: 6679342 - DNA, 12 bp, Homo sapiens
atttattaaaga

SEQ ID NO: 6679343 - DNA, 13 bp, Homo sapiens
atttattaaagaa

SEQ ID NO: 6679344 - DNA, 22 bp, Homo sapiens
atttattaaagaaaaaaatgta

SEQ ID NO: 6679345 - DNA, 12 bp, Homo sapiens
atttattaaata

SEQ ID NO: 6679346 - DNA, 13 bp, Homo sapiens
atttattaaatgt

SEQ ID NO: 6679347 - DNA, 22 bp, Homo sapiens
atttattaaattgtgattgttt

SEQ ID NO: 6679348 - DNA, 21 bp, Homo sapiens
atttattaaatttattaaatg

SEQ ID NO: 6679349 - DNA, 23 bp, Homo sapiens
atttattaaatttattaaatgtt

SEQ ID NO: 6679350 - DNA, 13 bp, Homo sapiens
atttattaactta

SEQ ID NO: 6679351 - DNA, 14 bp, Homo sapiens
atttattaacttaa

SEQ ID NO: 6679352 - DNA, 17 bp, Homo sapiens
atttattaacttaataa

SEQ ID NO: 6679353 - DNA, 16 bp, Homo sapiens
atttattaagatggat

SEQ ID NO: 6679354 - DNA, 22 bp, Homo sapiens
atttattaagatggattctcag

SEQ ID NO: 6679355 - DNA, 21 bp, Homo sapiens
atttattaagcagtacaaatg

SEQ ID NO: 6679356 - DNA, 15 bp, Homo sapiens
atttattaatattta

SEQ ID NO: 6679357 - DNA, 17 bp, Homo sapiens
atttattaattgctttg

SEQ ID NO: 6679358 - DNA, 21 bp, Homo sapiens
atttattacaaatcagaactt

SEQ ID NO: 6679359 - DNA, 19 bp, Homo sapiens
atttattaccgataaatga

SEQ ID NO: 6679360 - DNA, 15 bp, Homo sapiens
atttattacctctga

SEQ ID NO: 6679361 - DNA, 22 bp, Homo sapiens
atttattactgtccctatctat

SEQ ID NO: 6679362 - DNA, 21 bp, Homo sapiens
atttattacttgtgcacttag

SEQ ID NO: 6679363 - DNA, 22 bp, Homo sapiens
atttattagccctgcattttca

SEQ ID NO: 6679364 - DNA, 16 bp, Homo sapiens
atttattagctgtaaa

SEQ ID NO: 6679365 - DNA, 19 bp, Homo sapiens
atttattatatatttacag

SEQ ID NO: 6679366 - DNA, 14 bp, Homo sapiens
atttattatgagac

SEQ ID NO: 6679367 - DNA, 13 bp, Homo sapiens
atttattatgtcc

SEQ ID NO: 6679368 - DNA, 16 bp, Homo sapiens
atttattattgaaatt

SEQ ID NO: 6679369 - DNA, 13 bp, Homo sapiens
atttattattgta

SEQ ID NO: 6679370 - DNA, 13 bp, Homo sapiens
atttattatttat

SEQ ID NO: 6679371 - DNA, 14 bp, Homo sapiens
atttattcactgta

SEQ ID NO: 6679372 - DNA, 18 bp, Homo sapiens
atttattcatgtgtacag

SEQ ID NO: 6679373 - DNA, 17 bp, Homo sapiens
atttattccccagtgac

SEQ ID NO: 6679374 - DNA, 18 bp, Homo sapiens
atttattccccagtgact

SEQ ID NO: 6679375 - DNA, 17 bp, Homo sapiens
atttattcccttttaaa

SEQ ID NO: 6679376 - DNA, 15 bp, Homo sapiens
atttattctcagaac

SEQ ID NO: 6679377 - DNA, 16 bp, Homo sapiens
atttattctgggaatg

SEQ ID NO: 6679378 - DNA, 18 bp, Homo sapiens
atttattctgggaatgta

SEQ ID NO: 6679379 - DNA, 22 bp, Homo sapiens
atttattctgggaatgtatagt

SEQ ID NO: 6679380 - DNA, 14 bp, Homo sapiens
atttattctttatt

SEQ ID NO: 6679381 - DNA, 13 bp, Homo sapiens
atttattgaaatg

SEQ ID NO: 6679382 - DNA, 18 bp, Homo sapiens
atttattgaagaaacaga

SEQ ID NO: 6679383 - DNA, 15 bp, Homo sapiens
atttattgaattatt

SEQ ID NO: 6679384 - DNA, 14 bp, Homo sapiens
atttattgactttg

SEQ ID NO: 6679385 - DNA, 17 bp, Homo sapiens
atttattgactttgaca

SEQ ID NO: 6679386 - DNA, 19 bp, Homo sapiens
atttattgactttgacaat

SEQ ID NO: 6679387 - DNA, 15 bp, Homo sapiens
atttattgaggaaaa

SEQ ID NO: 6679388 - DNA, 17 bp, Homo sapiens
atttattgaggaaaaat

SEQ ID NO: 6679389 - DNA, 21 bp, Homo sapiens
atttattgaggaaaaatatgt

SEQ ID NO: 6679390 - DNA, 17 bp, Homo sapiens
atttattgatgttttca

SEQ ID NO: 6679391 - DNA, 18 bp, Homo sapiens
atttattgatgttttcac

SEQ ID NO: 6679392 - DNA, 17 bp, Homo sapiens
atttattgatttcaagt

SEQ ID NO: 6679393 - DNA, 13 bp, Homo sapiens
atttattgcacaa

SEQ ID NO: 6679394 - DNA, 14 bp, Homo sapiens
atttattgcacaaa

SEQ ID NO: 6679395 - DNA, 17 bp, Homo sapiens
atttattgcacattgtt

SEQ ID NO: 6679396 - DNA, 22 bp, Homo sapiens
atttattgcagaggatgttcat

SEQ ID NO: 6679397 - DNA, 24 bp, Homo sapiens
atttattgcagaggatgttcataa

SEQ ID NO: 6679398 - DNA, 12 bp, Homo sapiens
atttattgccat

SEQ ID NO: 6679399 - DNA, 22 bp, Homo sapiens
atttattgctgtgtaacactgt

SEQ ID NO: 6679400 - DNA, 14 bp, Homo sapiens
atttattgcttgat

SEQ ID NO: 6679401 - DNA, 20 bp, Homo sapiens
atttattgcttgatactttt

SEQ ID NO: 6679402 - DNA, 14 bp, Homo sapiens
atttattgctttat

SEQ ID NO: 6679403 - DNA, 17 bp, Homo sapiens
atttattggatgataca

SEQ ID NO: 6679404 - DNA, 13 bp, Homo sapiens
atttattggcaat

SEQ ID NO: 6679405 - DNA, 14 bp, Homo sapiens
atttattggcaata

SEQ ID NO: 6679406 - DNA, 20 bp, Homo sapiens
atttattggcagccaaggaa

SEQ ID NO: 6679407 - DNA, 23 bp, Homo sapiens
atttattgggatgtgagccccag

SEQ ID NO: 6679408 - DNA, 13 bp, Homo sapiens
atttattggggtg

SEQ ID NO: 6679409 - DNA, 14 bp, Homo sapiens
atttattggttttg

SEQ ID NO: 6679410 - DNA, 19 bp, Homo sapiens
atttattgtaccaaagctg

SEQ ID NO: 6679411 - DNA, 20 bp, Homo sapiens
atttattgtatatatggata

SEQ ID NO: 6679412 - DNA, 16 bp, Homo sapiens
atttattgtattctgg

SEQ ID NO: 6679413 - DNA, 18 bp, Homo sapiens
atttattgtattttagta

SEQ ID NO: 6679414 - DNA, 14 bp, Homo sapiens
atttattgtcagtt

SEQ ID NO: 6679415 - DNA, 16 bp, Homo sapiens
atttattgtcagtttt

SEQ ID NO: 6679416 - DNA, 17 bp, Homo sapiens
atttattgtctgtctac

SEQ ID NO: 6679417 - DNA, 20 bp, Homo sapiens
atttattgtctttattttta

SEQ ID NO: 6679418 - DNA, 21 bp, Homo sapiens
atttattgttaaattacattt

SEQ ID NO: 6679419 - DNA, 16 bp, Homo sapiens
atttattgtttatgta

SEQ ID NO: 6679420 - DNA, 20 bp, Homo sapiens
atttattgtttatttatcag

SEQ ID NO: 6679421 - DNA, 21 bp, Homo sapiens
atttattgtttatttatcagt

SEQ ID NO: 6679422 - DNA, 14 bp, Homo sapiens
atttattgtttgaa

SEQ ID NO: 6679423 - DNA, 15 bp, Homo sapiens
atttattgtttgaaa

SEQ ID NO: 6679424 - DNA, 17 bp, Homo sapiens
atttattgtttgaaatg

SEQ ID NO: 6679425 - DNA, 15 bp, Homo sapiens
atttatttaaaactc

SEQ ID NO: 6679426 - DNA, 19 bp, Homo sapiens
atttatttaaaactctggt

SEQ ID NO: 6679427 - DNA, 14 bp, Homo sapiens
atttatttaaaata

SEQ ID NO: 6679428 - DNA, 21 bp, Homo sapiens
atttatttaaaatttcgttgt

SEQ ID NO: 6679429 - DNA, 14 bp, Homo sapiens
atttatttaaagca

SEQ ID NO: 6679430 - DNA, 20 bp, Homo sapiens
atttatttaataacaattgt

SEQ ID NO: 6679431 - DNA, 17 bp, Homo sapiens
atttatttaatgtgagt

SEQ ID NO: 6679432 - DNA, 15 bp, Homo sapiens
atttatttaatgtta

SEQ ID NO: 6679433 - DNA, 13 bp, Homo sapiens
atttatttaattt

SEQ ID NO: 6679434 - DNA, 18 bp, Homo sapiens
atttatttacaaatgttt

SEQ ID NO: 6679435 - DNA, 15 bp, Homo sapiens
atttatttacactct

SEQ ID NO: 6679436 - DNA, 23 bp, Homo sapiens
atttatttacagatgaatgtatt

SEQ ID NO: 6679437 - DNA, 24 bp, Homo sapiens
atttatttactgagcttctctgtg

SEQ ID NO: 6679438 - DNA, 13 bp, Homo sapiens
atttatttatatt

SEQ ID NO: 6679439 - DNA, 19 bp, Homo sapiens
atttatttatgaaaaaata

SEQ ID NO: 6679440 - DNA, 14 bp, Homo sapiens
atttatttatgcta

SEQ ID NO: 6679441 - DNA, 14 bp, Homo sapiens
atttatttatgtag

SEQ ID NO: 6679442 - DNA, 15 bp, Homo sapiens
atttatttatgtgca

SEQ ID NO: 6679443 - DNA, 13 bp, Homo sapiens
atttatttatgtt

SEQ ID NO: 6679444 - DNA, 18 bp, Homo sapiens
atttatttatgttctcaa

SEQ ID NO: 6679445 - DNA, 14 bp, Homo sapiens
atttatttattatt

SEQ ID NO: 6679446 - DNA, 14 bp, Homo sapiens
atttatttatttaa

SEQ ID NO: 6679447 - DNA, 14 bp, Homo sapiens
atttatttcatcat

SEQ ID NO: 6679448 - DNA, 18 bp, Homo sapiens
atttatttccaatgtttc

SEQ ID NO: 6679449 - DNA, 12 bp, Homo sapiens
atttatttctgt

SEQ ID NO: 6679450 - DNA, 21 bp, Homo sapiens
atttatttctttgtgataaca

SEQ ID NO: 6679451 - DNA, 14 bp, Homo sapiens
atttatttgaaaat

SEQ ID NO: 6679452 - DNA, 16 bp, Homo sapiens
atttatttgaatgatt

SEQ ID NO: 6679453 - DNA, 23 bp, Homo sapiens
atttatttggaaatattctatga

SEQ ID NO: 6679454 - DNA, 12 bp, Homo sapiens
atttatttggag

SEQ ID NO: 6679455 - DNA, 17 bp, Homo sapiens
atttattttaaacgctt

SEQ ID NO: 6679456 - DNA, 15 bp, Homo sapiens
atttattttaatgta

SEQ ID NO: 6679457 - DNA, 14 bp, Homo sapiens
atttattttacatt

SEQ ID NO: 6679458 - DNA, 16 bp, Homo sapiens
atttattttacattta

SEQ ID NO: 6679459 - DNA, 20 bp, Homo sapiens
atttattttagcaaatcagt

SEQ ID NO: 6679460 - DNA, 15 bp, Homo sapiens
atttattttataaga

SEQ ID NO: 6679461 - DNA, 17 bp, Homo sapiens
atttattttatgagaaa

SEQ ID NO: 6679462 - DNA, 22 bp, Homo sapiens
atttattttattctatgtatgt

SEQ ID NO: 6679463 - DNA, 17 bp, Homo sapiens
atttattttcctcccca

SEQ ID NO: 6679464 - DNA, 16 bp, Homo sapiens
atttattttcttttga

SEQ ID NO: 6679465 - DNA, 21 bp, Homo sapiens
atttattttgacataaagttg

SEQ ID NO: 6679466 - DNA, 15 bp, Homo sapiens
atttattttgtaatt

SEQ ID NO: 6679467 - DNA, 15 bp, Homo sapiens
atttattttgtatga

SEQ ID NO: 6679468 - DNA, 20 bp, Homo sapiens
atttattttgtatgaaatat

SEQ ID NO: 6679469 - DNA, 22 bp, Homo sapiens
atttattttgtatgaaatatat

SEQ ID NO: 6679470 - DNA, 14 bp, Homo sapiens
atttattttgtgaa

SEQ ID NO: 6679471 - DNA, 18 bp, Homo sapiens
atttattttgtgaacact

SEQ ID NO: 6679472 - DNA, 18 bp, Homo sapiens
atttatttttaatatgtt

SEQ ID NO: 6679473 - DNA, 20 bp, Homo sapiens
atttatttttacctgctttt

SEQ ID NO: 6679474 - DNA, 21 bp, Homo sapiens
atttatttttacctgcttttt

SEQ ID NO: 6679475 - DNA, 22 bp, Homo sapiens
atttatttttagccattgtcgt

SEQ ID NO: 6679476 - DNA, 15 bp, Homo sapiens
atttatttttcagtt

SEQ ID NO: 6679477 - DNA, 17 bp, Homo sapiens
atttatttttgtactgt

SEQ ID NO: 6679478 - DNA, 17 bp, Homo sapiens
atttattttttaagaaa

SEQ ID NO: 6679479 - DNA, 16 bp, Homo sapiens
atttattttttcaaaa

SEQ ID NO: 6679480 - DNA, 19 bp, Homo sapiens
atttattttttttaattgt

SEQ ID NO: 6679481 - DNA, 23 bp, Homo sapiens
atttcaaaaaaaaaaaaaaagac

SEQ ID NO: 6679482 - DNA, 19 bp, Homo sapiens
atttcaaaaaaataaaata

SEQ ID NO: 6679483 - DNA, 20 bp, Homo sapiens
atttcaaaaaaataaaataa

SEQ ID NO: 6679484 - DNA, 23 bp, Homo sapiens
atttcaaaaacatgcttttccaa

SEQ ID NO: 6679485 - DNA, 14 bp, Homo sapiens
atttcaaaaatata

SEQ ID NO: 6679486 - DNA, 16 bp, Homo sapiens
atttcaaaaatttgga

SEQ ID NO: 6679487 - DNA, 19 bp, Homo sapiens
atttcaaaaatttggaatt

SEQ ID NO: 6679488 - DNA, 20 bp, Homo sapiens
atttcaaaaatttggaattc

SEQ ID NO: 6679489 - DNA, 20 bp, Homo sapiens
atttcaaaagaacattctta

SEQ ID NO: 6679490 - DNA, 24 bp, Homo sapiens
atttcaaaagaacattcttatatt

SEQ ID NO: 6679491 - DNA, 16 bp, Homo sapiens
atttcaaaagacatgt

SEQ ID NO: 6679492 - DNA, 17 bp, Homo sapiens
atttcaaaagacatgtt

SEQ ID NO: 6679493 - DNA, 14 bp, Homo sapiens
atttcaaaaggaag

SEQ ID NO: 6679494 - DNA, 16 bp, Homo sapiens
atttcaaaatatgtgt

SEQ ID NO: 6679495 - DNA, 16 bp, Homo sapiens
atttcaaaatgataga

SEQ ID NO: 6679496 - DNA, 22 bp, Homo sapiens
atttcaaaatgatattcaatct

SEQ ID NO: 6679497 - DNA, 16 bp, Homo sapiens
atttcaaaatgctttt

SEQ ID NO: 6679498 - DNA, 21 bp, Homo sapiens
atttcaaaatgctttttatta

SEQ ID NO: 6679499 - DNA, 19 bp, Homo sapiens
atttcaaaattaatagctt

SEQ ID NO: 6679500 - DNA, 17 bp, Homo sapiens
atttcaaacatttgtca

SEQ ID NO: 6679501 - DNA, 20 bp, Homo sapiens
atttcaaacattttgtatca

SEQ ID NO: 6679502 - DNA, 17 bp, Homo sapiens
atttcaaaccagtttca

SEQ ID NO: 6679503 - DNA, 19 bp, Homo sapiens
atttcaaaccagtttcaca

SEQ ID NO: 6679504 - DNA, 16 bp, Homo sapiens
atttcaaacggcctca

SEQ ID NO: 6679505 - DNA, 20 bp, Homo sapiens
atttcaaacttaaacaaaaa

SEQ ID NO: 6679506 - DNA, 18 bp, Homo sapiens
atttcaaacttttgaaag

SEQ ID NO: 6679507 - DNA, 18 bp, Homo sapiens
atttcaaagccctgcctc

SEQ ID NO: 6679508 - DNA, 23 bp, Homo sapiens
atttcaaagccctgcctctgtgt

SEQ ID NO: 6679509 - DNA, 12 bp, Homo sapiens
atttcaaatctc

SEQ ID NO: 6679510 - DNA, 13 bp, Homo sapiens
atttcaaatgcag

SEQ ID NO: 6679511 - DNA, 11 bp, Homo sapiens
atttcaaatgg

SEQ ID NO: 6679512 - DNA, 23 bp, Homo sapiens
atttcaaattaatctttctatat

SEQ ID NO: 6679513 - DNA, 20 bp, Homo sapiens
atttcaaattgaatttgcac

SEQ ID NO: 6679514 - DNA, 15 bp, Homo sapiens
atttcaacagttatt

SEQ ID NO: 6679515 - DNA, 19 bp, Homo sapiens
atttcaacatgagtgtatt

SEQ ID NO: 6679516 - DNA, 21 bp, Homo sapiens
atttcaaccacacctaaatta

SEQ ID NO: 6679517 - DNA, 14 bp, Homo sapiens
atttcaactaatgt

SEQ ID NO: 6679518 - DNA, 16 bp, Homo sapiens
atttcaactacagtga

SEQ ID NO: 6679519 - DNA, 17 bp, Homo sapiens
atttcaactccagaagt

SEQ ID NO: 6679520 - DNA, 12 bp, Homo sapiens
atttcaactgct

SEQ ID NO: 6679521 - DNA, 14 bp, Homo sapiens
atttcaactgctgt

SEQ ID NO: 6679522 - DNA, 16 bp, Homo sapiens
atttcaactgctgtaa

SEQ ID NO: 6679523 - DNA, 21 bp, Homo sapiens
atttcaagaaaaaataaatgg

SEQ ID NO: 6679524 - DNA, 14 bp, Homo sapiens
atttcaagaatgtt

SEQ ID NO: 6679525 - DNA, 15 bp, Homo sapiens
atttcaagaatgttt

SEQ ID NO: 6679526 - DNA, 19 bp, Homo sapiens
atttcaagacagattgtga

SEQ ID NO: 6679527 - DNA, 19 bp, Homo sapiens
atttcaagatccaaatgct

SEQ ID NO: 6679528 - DNA, 16 bp, Homo sapiens
atttcaagatgttata

SEQ ID NO: 6679529 - DNA, 17 bp, Homo sapiens
atttcaagatgttatat

SEQ ID NO: 6679530 - DNA, 14 bp, Homo sapiens
atttcaagctcatg

SEQ ID NO: 6679531 - DNA, 16 bp, Homo sapiens
atttcaagctcatgtc

SEQ ID NO: 6679532 - DNA, 14 bp, Homo sapiens
atttcaagcttatt

SEQ ID NO: 6679533 - DNA, 21 bp, Homo sapiens
atttcaagcttattttggaga

SEQ ID NO: 6679534 - DNA, 22 bp, Homo sapiens
atttcaagcttattttggagag

SEQ ID NO: 6679535 - DNA, 13 bp, Homo sapiens
atttcaaggcagt

SEQ ID NO: 6679536 - DNA, 17 bp, Homo sapiens
atttcaaggccatattt

SEQ ID NO: 6679537 - DNA, 22 bp, Homo sapiens
atttcaaggccatattttaaaa

SEQ ID NO: 6679538 - DNA, 22 bp, Homo sapiens
atttcaagggttgcttctgagt

SEQ ID NO: 6679539 - DNA, 12 bp, Homo sapiens
atttcaaggttc

SEQ ID NO: 6679540 - DNA, 17 bp, Homo sapiens
atttcaagtacactgaa

SEQ ID NO: 6679541 - DNA, 16 bp, Homo sapiens
atttcaataaatcttt

SEQ ID NO: 6679542 - DNA, 19 bp, Homo sapiens
atttcaataacctttcact

SEQ ID NO: 6679543 - DNA, 16 bp, Homo sapiens
atttcaataagtgttg

SEQ ID NO: 6679544 - DNA, 18 bp, Homo sapiens
atttcaatagccccatct

SEQ ID NO: 6679545 - DNA, 22 bp, Homo sapiens
atttcaatcccacgtacttata

SEQ ID NO: 6679546 - DNA, 15 bp, Homo sapiens
atttcaatcttttaa

SEQ ID NO: 6679547 - DNA, 18 bp, Homo sapiens
atttcaatgattgtttaa

SEQ ID NO: 6679548 - DNA, 23 bp, Homo sapiens
atttcaatgattgtttaattgta

SEQ ID NO: 6679549 - DNA, 21 bp, Homo sapiens
atttcaatgcgttttgttgta

SEQ ID NO: 6679550 - DNA, 12 bp, Homo sapiens
atttcaatgctt

SEQ ID NO: 6679551 - DNA, 15 bp, Homo sapiens
atttcaatggtgttg

SEQ ID NO: 6679552 - DNA, 20 bp, Homo sapiens
atttcaatggtgttggcttc

SEQ ID NO: 6679553 - DNA, 20 bp, Homo sapiens
atttcaatgtaattaaactg

SEQ ID NO: 6679554 - DNA, 17 bp, Homo sapiens
atttcaatgtcagcctt

SEQ ID NO: 6679555 - DNA, 21 bp, Homo sapiens
atttcaatgtcagcctttgtt

SEQ ID NO: 6679556 - DNA, 14 bp, Homo sapiens
atttcaatgtgtat

SEQ ID NO: 6679557 - DNA, 14 bp, Homo sapiens
atttcaattctcaa

SEQ ID NO: 6679558 - DNA, 15 bp, Homo sapiens
atttcaattctcaaa

SEQ ID NO: 6679559 - DNA, 13 bp, Homo sapiens
atttcaattgctt

SEQ ID NO: 6679560 - DNA, 15 bp, Homo sapiens
atttcaattgtttat

SEQ ID NO: 6679561 - DNA, 13 bp, Homo sapiens
atttcaattttta

SEQ ID NO: 6679562 - DNA, 15 bp, Homo sapiens
atttcacaaatatta

SEQ ID NO: 6679563 - DNA, 13 bp, Homo sapiens
atttcacaacaga

SEQ ID NO: 6679564 - DNA, 20 bp, Homo sapiens
atttcacaacagatcaattt

SEQ ID NO: 6679565 - DNA, 19 bp, Homo sapiens
atttcacacaactgtggat

SEQ ID NO: 6679566 - DNA, 17 bp, Homo sapiens
atttcacacataagaaa

SEQ ID NO: 6679567 - DNA, 14 bp, Homo sapiens
atttcacagataat

SEQ ID NO: 6679568 - DNA, 20 bp, Homo sapiens
atttcacagataatttactt

SEQ ID NO: 6679569 - DNA, 15 bp, Homo sapiens
atttcacagcctttc

SEQ ID NO: 6679570 - DNA, 20 bp, Homo sapiens
atttcacatggactttggaa

SEQ ID NO: 6679571 - DNA, 22 bp, Homo sapiens
atttcacatggactttggaaaa

SEQ ID NO: 6679572 - DNA, 22 bp, Homo sapiens
atttcacattaatatttgctga

SEQ ID NO: 6679573 - DNA, 15 bp, Homo sapiens
atttcacattattct

SEQ ID NO: 6679574 - DNA, 17 bp, Homo sapiens
atttcacattattctgg

SEQ ID NO: 6679575 - DNA, 14 bp, Homo sapiens
atttcacattcctg

SEQ ID NO: 6679576 - DNA, 11 bp, Homo sapiens
atttcacattg

SEQ ID NO: 6679577 - DNA, 15 bp, Homo sapiens
atttcacatttttgt

SEQ ID NO: 6679578 - DNA, 19 bp, Homo sapiens
atttcacatttttgtaatg

SEQ ID NO: 6679579 - DNA, 19 bp, Homo sapiens
atttcaccatgttgccaat

SEQ ID NO: 6679580 - DNA, 15 bp, Homo sapiens
atttcacccctccct

SEQ ID NO: 6679581 - DNA, 20 bp, Homo sapiens
atttcacccctccctttctc

SEQ ID NO: 6679582 - DNA, 21 bp, Homo sapiens
atttcacccctccctttctcc

SEQ ID NO: 6679583 - DNA, 22 bp, Homo sapiens
atttcacctgtgacaaaggatg

SEQ ID NO: 6679584 - DNA, 16 bp, Homo sapiens
atttcacgattcattt

SEQ ID NO: 6679585 - DNA, 23 bp, Homo sapiens
atttcacgcttttaattctcatt

SEQ ID NO: 6679586 - DNA, 19 bp, Homo sapiens
atttcacgtcataggaagt

SEQ ID NO: 6679587 - DNA, 20 bp, Homo sapiens
atttcacgtcgtcttctgta

SEQ ID NO: 6679588 - DNA, 15 bp, Homo sapiens
atttcactaaaagtc

SEQ ID NO: 6679589 - DNA, 18 bp, Homo sapiens
atttcactaaatgtaaaa

SEQ ID NO: 6679590 - DNA, 22 bp, Homo sapiens
atttcactagagacaaatcttt

SEQ ID NO: 6679591 - DNA, 20 bp, Homo sapiens
atttcactatcttcttcaaa

SEQ ID NO: 6679592 - DNA, 21 bp, Homo sapiens
atttcactatcttcttcaaat

SEQ ID NO: 6679593 - DNA, 14 bp, Homo sapiens
atttcactattttt

SEQ ID NO: 6679594 - DNA, 22 bp, Homo sapiens
atttcactatttttatttatat

SEQ ID NO: 6679595 - DNA, 12 bp, Homo sapiens
atttcactctcc

SEQ ID NO: 6679596 - DNA, 19 bp, Homo sapiens
atttcactgtagctctaaa

SEQ ID NO: 6679597 - DNA, 24 bp, Homo sapiens
atttcactgtagctctaaaatctg

SEQ ID NO: 6679598 - DNA, 13 bp, Homo sapiens
atttcactgtctt

SEQ ID NO: 6679599 - DNA, 21 bp, Homo sapiens
atttcacttaaactttgtcac

SEQ ID NO: 6679600 - DNA, 14 bp, Homo sapiens
atttcacttaataa

SEQ ID NO: 6679601 - DNA, 17 bp, Homo sapiens
atttcacttaataatgt

SEQ ID NO: 6679602 - DNA, 16 bp, Homo sapiens
atttcacttgaaatta

SEQ ID NO: 6679603 - DNA, 23 bp, Homo sapiens
atttcacttgagtggaggtttat

SEQ ID NO: 6679604 - DNA, 19 bp, Homo sapiens
atttcacttgatgatacaa

SEQ ID NO: 6679605 - DNA, 15 bp, Homo sapiens
atttcacttttctgt

SEQ ID NO: 6679606 - DNA, 15 bp, Homo sapiens
atttcacttttgttc

SEQ ID NO: 6679607 - DNA, 18 bp, Homo sapiens
atttcagaaaatgaaaaa

SEQ ID NO: 6679608 - DNA, 21 bp, Homo sapiens
atttcagaaatacagataaat

SEQ ID NO: 6679609 - DNA, 12 bp, Homo sapiens
atttcagaagag

SEQ ID NO: 6679610 - DNA, 15 bp, Homo sapiens
atttcagaaggagaa

SEQ ID NO: 6679611 - DNA, 15 bp, Homo sapiens
atttcagaagtttaa

SEQ ID NO: 6679612 - DNA, 16 bp, Homo sapiens
atttcagaatattttg

SEQ ID NO: 6679613 - DNA, 16 bp, Homo sapiens
atttcagaattaccat

SEQ ID NO: 6679614 - DNA, 17 bp, Homo sapiens
atttcagacatatccaa

SEQ ID NO: 6679615 - DNA, 18 bp, Homo sapiens
atttcagacatatccaaa

SEQ ID NO: 6679616 - DNA, 12 bp, Homo sapiens
atttcagacatt

SEQ ID NO: 6679617 - DNA, 22 bp, Homo sapiens
atttcagagaggccttttggaa

SEQ ID NO: 6679618 - DNA, 17 bp, Homo sapiens
atttcagagctgaggct

SEQ ID NO: 6679619 - DNA, 17 bp, Homo sapiens
atttcagaggctgcagg

SEQ ID NO: 6679620 - DNA, 14 bp, Homo sapiens
atttcagagggtaa

SEQ ID NO: 6679621 - DNA, 14 bp, Homo sapiens
atttcagatgcttt

SEQ ID NO: 6679622 - DNA, 16 bp, Homo sapiens
atttcagatgctttag

SEQ ID NO: 6679623 - DNA, 13 bp, Homo sapiens
atttcagatgtaa

SEQ ID NO: 6679624 - DNA, 14 bp, Homo sapiens
atttcagatgtaat

SEQ ID NO: 6679625 - DNA, 18 bp, Homo sapiens
atttcagattcccagagc

SEQ ID NO: 6679626 - DNA, 15 bp, Homo sapiens
atttcagatttgtga

SEQ ID NO: 6679627 - DNA, 20 bp, Homo sapiens
atttcagattttaaaaaggg

SEQ ID NO: 6679628 - DNA, 20 bp, Homo sapiens
atttcagcacaataaatata

SEQ ID NO: 6679629 - DNA, 16 bp, Homo sapiens
atttcagcagctgcag

SEQ ID NO: 6679630 - DNA, 16 bp, Homo sapiens
atttcagccaaagtcc

SEQ ID NO: 6679631 - DNA, 14 bp, Homo sapiens
atttcagctgcttt

SEQ ID NO: 6679632 - DNA, 15 bp, Homo sapiens
atttcagctttggct

SEQ ID NO: 6679633 - DNA, 21 bp, Homo sapiens
atttcaggaaaatgtattgat

SEQ ID NO: 6679634 - DNA, 19 bp, Homo sapiens
atttcaggaatcagaaatc

SEQ ID NO: 6679635 - DNA, 17 bp, Homo sapiens
atttcaggaatttaatt

SEQ ID NO: 6679636 - DNA, 17 bp, Homo sapiens
atttcaggactctctcc

SEQ ID NO: 6679637 - DNA, 19 bp, Homo sapiens
atttcaggaggaatactga

SEQ ID NO: 6679638 - DNA, 22 bp, Homo sapiens
atttcaggaggaatactgaaca

SEQ ID NO: 6679639 - DNA, 12 bp, Homo sapiens
atttcaggaggt

SEQ ID NO: 6679640 - DNA, 19 bp, Homo sapiens
atttcaggatactctgtca

SEQ ID NO: 6679641 - DNA, 20 bp, Homo sapiens
atttcaggattaactaaaga

SEQ ID NO: 6679642 - DNA, 22 bp, Homo sapiens
atttcaggattaactaaagaag

SEQ ID NO: 6679643 - DNA, 18 bp, Homo sapiens
atttcaggcacatcattg

SEQ ID NO: 6679644 - DNA, 16 bp, Homo sapiens
atttcaggcattttgt

SEQ ID NO: 6679645 - DNA, 16 bp, Homo sapiens
atttcaggccctcagc

SEQ ID NO: 6679646 - DNA, 13 bp, Homo sapiens
atttcagggaaaa

SEQ ID NO: 6679647 - DNA, 17 bp, Homo sapiens
atttcagggaaattaat

SEQ ID NO: 6679648 - DNA, 16 bp, Homo sapiens
atttcagggacctcag

SEQ ID NO: 6679649 - DNA, 17 bp, Homo sapiens
atttcagggacctcagg

SEQ ID NO: 6679650 - DNA, 21 bp, Homo sapiens
atttcagggacctcaggggca

SEQ ID NO: 6679651 - DNA, 20 bp, Homo sapiens
atttcagggagaaactccaa

SEQ ID NO: 6679652 - DNA, 12 bp, Homo sapiens
atttcagggtgc

SEQ ID NO: 6679653 - DNA, 21 bp, Homo sapiens
atttcaggtcaactctgaaga

SEQ ID NO: 6679654 - DNA, 18 bp, Homo sapiens
atttcaggtgtaaccatt

SEQ ID NO: 6679655 - DNA, 23 bp, Homo sapiens
atttcaggtgtgaaagaatcagt

SEQ ID NO: 6679656 - DNA, 22 bp, Homo sapiens
atttcaggttaaattaaaccaa

SEQ ID NO: 6679657 - DNA, 17 bp, Homo sapiens
atttcaggttgtgcatt

SEQ ID NO: 6679658 - DNA, 17 bp, Homo sapiens
atttcagtagaatttta

SEQ ID NO: 6679659 - DNA, 19 bp, Homo sapiens
atttcagtagaattttagt

SEQ ID NO: 6679660 - DNA, 18 bp, Homo sapiens
atttcagtatcatctcca

SEQ ID NO: 6679661 - DNA, 13 bp, Homo sapiens
atttcagtatttt

SEQ ID NO: 6679662 - DNA, 15 bp, Homo sapiens
atttcagtattttcc

SEQ ID NO: 6679663 - DNA, 15 bp, Homo sapiens
atttcagtccagaag

SEQ ID NO: 6679664 - DNA, 19 bp, Homo sapiens
atttcagtgataatgttca

SEQ ID NO: 6679665 - DNA, 13 bp, Homo sapiens
atttcagtgccat

SEQ ID NO: 6679666 - DNA, 19 bp, Homo sapiens
atttcagtgccatacatgt

SEQ ID NO: 6679667 - DNA, 23 bp, Homo sapiens
atttcagtggaatagatgtctca

SEQ ID NO: 6679668 - DNA, 15 bp, Homo sapiens
atttcagtggcttcc

SEQ ID NO: 6679669 - DNA, 19 bp, Homo sapiens
atttcagtgtaaagtgtgt

SEQ ID NO: 6679670 - DNA, 20 bp, Homo sapiens
atttcagtgtagttaattta

SEQ ID NO: 6679671 - DNA, 21 bp, Homo sapiens
atttcagtgttacctgtgtgc

SEQ ID NO: 6679672 - DNA, 23 bp, Homo sapiens
atttcagttcagcggttgaggag

SEQ ID NO: 6679673 - DNA, 16 bp, Homo sapiens
atttcagttctaggaa

SEQ ID NO: 6679674 - DNA, 18 bp, Homo sapiens
atttcagtttgtttactt

SEQ ID NO: 6679675 - DNA, 17 bp, Homo sapiens
atttcagtttttcattt

SEQ ID NO: 6679676 - DNA, 20 bp, Homo sapiens
atttcagtttttcatttgtt

SEQ ID NO: 6679677 - DNA, 12 bp, Homo sapiens
atttcataaaaa

SEQ ID NO: 6679678 - DNA, 18 bp, Homo sapiens
atttcataaacaacttaa

SEQ ID NO: 6679679 - DNA, 12 bp, Homo sapiens
atttcataaaga

SEQ ID NO: 6679680 - DNA, 13 bp, Homo sapiens
atttcataaatta

SEQ ID NO: 6679681 - DNA, 20 bp, Homo sapiens
atttcataattcagaactaa

SEQ ID NO: 6679682 - DNA, 17 bp, Homo sapiens
atttcatacaaaactgt

SEQ ID NO: 6679683 - DNA, 14 bp, Homo sapiens
atttcatacaaatt

SEQ ID NO: 6679684 - DNA, 17 bp, Homo sapiens
atttcatacaaattttc

SEQ ID NO: 6679685 - DNA, 16 bp, Homo sapiens
atttcatactaaactg

SEQ ID NO: 6679686 - DNA, 19 bp, Homo sapiens
atttcatagccaaacagga

SEQ ID NO: 6679687 - DNA, 20 bp, Homo sapiens
atttcatagccaaacaggag

SEQ ID NO: 6679688 - DNA, 17 bp, Homo sapiens
atttcatagttcagaat

SEQ ID NO: 6679689 - DNA, 19 bp, Homo sapiens
atttcatagttcagaattt

SEQ ID NO: 6679690 - DNA, 14 bp, Homo sapiens
atttcatatactat

SEQ ID NO: 6679691 - DNA, 22 bp, Homo sapiens
atttcatatactataattgtaa

SEQ ID NO: 6679692 - DNA, 23 bp, Homo sapiens
atttcatatatctatatgtctat

SEQ ID NO: 6679693 - DNA, 17 bp, Homo sapiens
atttcatatctaacttt

SEQ ID NO: 6679694 - DNA, 20 bp, Homo sapiens
atttcatatctacagataga

SEQ ID NO: 6679695 - DNA, 22 bp, Homo sapiens
atttcatatctacagatagaga

SEQ ID NO: 6679696 - DNA, 16 bp, Homo sapiens
atttcatatgctgtat

SEQ ID NO: 6679697 - DNA, 20 bp, Homo sapiens
atttcatattattttagtgt

SEQ ID NO: 6679698 - DNA, 18 bp, Homo sapiens
atttcatcattgtttctg

SEQ ID NO: 6679699 - DNA, 17 bp, Homo sapiens
atttcatccaccaatat

SEQ ID NO: 6679700 - DNA, 14 bp, Homo sapiens
atttcatccagaag

SEQ ID NO: 6679701 - DNA, 19 bp, Homo sapiens
atttcatccagtttgttct

SEQ ID NO: 6679702 - DNA, 18 bp, Homo sapiens
atttcatccatatttctt

SEQ ID NO: 6679703 - DNA, 17 bp, Homo sapiens
atttcatccttgaatcc

SEQ ID NO: 6679704 - DNA, 20 bp, Homo sapiens
atttcatcctttcacttctt

SEQ ID NO: 6679705 - DNA, 14 bp, Homo sapiens
atttcatctaattt

SEQ ID NO: 6679706 - DNA, 17 bp, Homo sapiens
atttcatctaatttaat

SEQ ID NO: 6679707 - DNA, 15 bp, Homo sapiens
atttcatctactaca

SEQ ID NO: 6679708 - DNA, 14 bp, Homo sapiens
atttcatctcattt

SEQ ID NO: 6679709 - DNA, 15 bp, Homo sapiens
atttcatctcattta

SEQ ID NO: 6679710 - DNA, 21 bp, Homo sapiens
atttcatctcatttaagggaa

SEQ ID NO: 6679711 - DNA, 14 bp, Homo sapiens
atttcatctgctct

SEQ ID NO: 6679712 - DNA, 18 bp, Homo sapiens
atttcatctgctctcctt

SEQ ID NO: 6679713 - DNA, 22 bp, Homo sapiens
atttcatctgctgctgaaactg

SEQ ID NO: 6679714 - DNA, 23 bp, Homo sapiens
atttcatctgggtggtctgaata

SEQ ID NO: 6679715 - DNA, 13 bp, Homo sapiens
atttcatctgttc

SEQ ID NO: 6679716 - DNA, 17 bp, Homo sapiens
atttcatcttctggaat

SEQ ID NO: 6679717 - DNA, 12 bp, Homo sapiens
atttcatgaaaa

SEQ ID NO: 6679718 - DNA, 17 bp, Homo sapiens
atttcatgaaaaagctg

SEQ ID NO: 6679719 - DNA, 18 bp, Homo sapiens
atttcatgaaaaagctgc

SEQ ID NO: 6679720 - DNA, 18 bp, Homo sapiens
atttcatgaacgttatta

SEQ ID NO: 6679721 - DNA, 17 bp, Homo sapiens
atttcatgattagacaa

SEQ ID NO: 6679722 - DNA, 15 bp, Homo sapiens
atttcatgattggct

SEQ ID NO: 6679723 - DNA, 23 bp, Homo sapiens
atttcatgattggcttaaagtga

SEQ ID NO: 6679724 - DNA, 23 bp, Homo sapiens
atttcatgctatcagaaacagta

SEQ ID NO: 6679725 - DNA, 18 bp, Homo sapiens
atttcatgctatctctgt

SEQ ID NO: 6679726 - DNA, 20 bp, Homo sapiens
atttcatgctctgcaaaagg

SEQ ID NO: 6679727 - DNA, 19 bp, Homo sapiens
atttcatggattatttatg

SEQ ID NO: 6679728 - DNA, 14 bp, Homo sapiens
atttcatgtaatat

SEQ ID NO: 6679729 - DNA, 12 bp, Homo sapiens
atttcatgtact

SEQ ID NO: 6679730 - DNA, 16 bp, Homo sapiens
atttcatgtactgcat

SEQ ID NO: 6679731 - DNA, 21 bp, Homo sapiens
atttcatgtccataaaagaga

SEQ ID NO: 6679732 - DNA, 22 bp, Homo sapiens
atttcatgtcctgtgtcagttt

SEQ ID NO: 6679733 - DNA, 14 bp, Homo sapiens
atttcatgtggctg

SEQ ID NO: 6679734 - DNA, 23 bp, Homo sapiens
atttcatgttagtcttaccgaat

SEQ ID NO: 6679735 - DNA, 17 bp, Homo sapiens
atttcattagccatgca

SEQ ID NO: 6679736 - DNA, 18 bp, Homo sapiens
atttcattatgctttgaa

SEQ ID NO: 6679737 - DNA, 18 bp, Homo sapiens
atttcattatttttcaat

SEQ ID NO: 6679738 - DNA, 15 bp, Homo sapiens
atttcattcaaatca

SEQ ID NO: 6679739 - DNA, 16 bp, Homo sapiens
atttcattcaaatcag

SEQ ID NO: 6679740 - DNA, 18 bp, Homo sapiens
atttcattcaaatcagtg

SEQ ID NO: 6679741 - DNA, 21 bp, Homo sapiens
atttcattcacattaatgaga

SEQ ID NO: 6679742 - DNA, 14 bp, Homo sapiens
atttcattcatatc

SEQ ID NO: 6679743 - DNA, 16 bp, Homo sapiens
atttcattccattgcc

SEQ ID NO: 6679744 - DNA, 18 bp, Homo sapiens
atttcattccattgccta

SEQ ID NO: 6679745 - DNA, 12 bp, Homo sapiens
atttcattcgtg

SEQ ID NO: 6679746 - DNA, 13 bp, Homo sapiens
atttcattgcact

SEQ ID NO: 6679747 - DNA, 20 bp, Homo sapiens
atttcattgcactttccttt

SEQ ID NO: 6679748 - DNA, 17 bp, Homo sapiens
atttcattgctgtgtca

SEQ ID NO: 6679749 - DNA, 14 bp, Homo sapiens
atttcattggttaa

SEQ ID NO: 6679750 - DNA, 20 bp, Homo sapiens
atttcattgtctctatctga

SEQ ID NO: 6679751 - DNA, 12 bp, Homo sapiens
atttcatttagc

SEQ ID NO: 6679752 - DNA, 14 bp, Homo sapiens
atttcatttatact

SEQ ID NO: 6679753 - DNA, 22 bp, Homo sapiens
atttcatttatactgtagcaat

SEQ ID NO: 6679754 - DNA, 12 bp, Homo sapiens
atttcatttcac

SEQ ID NO: 6679755 - DNA, 20 bp, Homo sapiens
atttcattttagtattttag

SEQ ID NO: 6679756 - DNA, 23 bp, Homo sapiens
atttcattttgtaacaaatgaac

SEQ ID NO: 6679757 - DNA, 13 bp, Homo sapiens
atttccaaaatgt

SEQ ID NO: 6679758 - DNA, 14 bp, Homo sapiens
atttccaaacatcc

SEQ ID NO: 6679759 - DNA, 14 bp, Homo sapiens
atttccaaactgtt

SEQ ID NO: 6679760 - DNA, 16 bp, Homo sapiens
atttccaaagagaaaa

SEQ ID NO: 6679761 - DNA, 13 bp, Homo sapiens
atttccaaataaa

SEQ ID NO: 6679762 - DNA, 15 bp, Homo sapiens
atttccaaataaaat

SEQ ID NO: 6679763 - DNA, 14 bp, Homo sapiens
atttccaaatattc

SEQ ID NO: 6679764 - DNA, 17 bp, Homo sapiens
atttccaaatattctaa

SEQ ID NO: 6679765 - DNA, 13 bp, Homo sapiens
atttccaaatgaa

SEQ ID NO: 6679766 - DNA, 17 bp, Homo sapiens
atttccaaatgaatgac

SEQ ID NO: 6679767 - DNA, 20 bp, Homo sapiens
atttccaacaccacagacac

SEQ ID NO: 6679768 - DNA, 22 bp, Homo sapiens
atttccaacaccacagacacac

SEQ ID NO: 6679769 - DNA, 23 bp, Homo sapiens
atttccaacaccacagacacaca

SEQ ID NO: 6679770 - DNA, 13 bp, Homo sapiens
atttccaacagca

SEQ ID NO: 6679771 - DNA, 20 bp, Homo sapiens
atttccaactggcactctgt

SEQ ID NO: 6679772 - DNA, 19 bp, Homo sapiens
atttccaagtaatataatg

SEQ ID NO: 6679773 - DNA, 21 bp, Homo sapiens
atttccaataactagtgatat

SEQ ID NO: 6679774 - DNA, 14 bp, Homo sapiens
atttccaatgtgaa

SEQ ID NO: 6679775 - DNA, 14 bp, Homo sapiens
atttccaatgtttc

SEQ ID NO: 6679776 - DNA, 20 bp, Homo sapiens
atttccaccaggccgtgcct

SEQ ID NO: 6679777 - DNA, 18 bp, Homo sapiens
atttccactattttcaaa

SEQ ID NO: 6679778 - DNA, 21 bp, Homo sapiens
atttccactattttcaaagaa

SEQ ID NO: 6679779 - DNA, 16 bp, Homo sapiens
atttccactcaggtct

SEQ ID NO: 6679780 - DNA, 17 bp, Homo sapiens
atttccactgaacaaaa

SEQ ID NO: 6679781 - DNA, 22 bp, Homo sapiens
atttccactgtaattaaaacta

SEQ ID NO: 6679782 - DNA, 12 bp, Homo sapiens
atttccagagtc

SEQ ID NO: 6679783 - DNA, 20 bp, Homo sapiens
atttccagagtccggaggca

SEQ ID NO: 6679784 - DNA, 21 bp, Homo sapiens
atttccagagtccggaggcag

SEQ ID NO: 6679785 - DNA, 22 bp, Homo sapiens
atttccagagtccggaggcagc

SEQ ID NO: 6679786 - DNA, 18 bp, Homo sapiens
atttccagcaaaatatat

SEQ ID NO: 6679787 - DNA, 14 bp, Homo sapiens
atttccagccaggg

SEQ ID NO: 6679788 - DNA, 20 bp, Homo sapiens
atttccaggaaaaaataaaa

SEQ ID NO: 6679789 - DNA, 21 bp, Homo sapiens
atttccaggaaaaaataaaaa

SEQ ID NO: 6679790 - DNA, 23 bp, Homo sapiens
atttccaggaaaaaataaaaaga

SEQ ID NO: 6679791 - DNA, 12 bp, Homo sapiens
atttccaggccc

SEQ ID NO: 6679792 - DNA, 19 bp, Homo sapiens
atttccaggcccctgagga

SEQ ID NO: 6679793 - DNA, 18 bp, Homo sapiens
atttccagggcagcagcc

SEQ ID NO: 6679794 - DNA, 19 bp, Homo sapiens
atttccaggggcacacaat

SEQ ID NO: 6679795 - DNA, 13 bp, Homo sapiens
atttccagtacct

SEQ ID NO: 6679796 - DNA, 20 bp, Homo sapiens
atttccagtacctttgtcac

SEQ ID NO: 6679797 - DNA, 13 bp, Homo sapiens
atttccagtctcc

SEQ ID NO: 6679798 - DNA, 17 bp, Homo sapiens
atttccagtctccacca

SEQ ID NO: 6679799 - DNA, 14 bp, Homo sapiens
atttccagtttaag

SEQ ID NO: 6679800 - DNA, 19 bp, Homo sapiens
atttccagtttttctttac

SEQ ID NO: 6679801 - DNA, 19 bp, Homo sapiens
atttccataccattgtgga

SEQ ID NO: 6679802 - DNA, 22 bp, Homo sapiens
atttccatataaatattagaaa

SEQ ID NO: 6679803 - DNA, 17 bp, Homo sapiens
atttccatatggatttt

SEQ ID NO: 6679804 - DNA, 16 bp, Homo sapiens
atttccatattaaaat

SEQ ID NO: 6679805 - DNA, 20 bp, Homo sapiens
atttccatcttaatgttact

SEQ ID NO: 6679806 - DNA, 21 bp, Homo sapiens
atttccatggattcccctgga

SEQ ID NO: 6679807 - DNA, 17 bp, Homo sapiens
atttccatgtatgcata

SEQ ID NO: 6679808 - DNA, 21 bp, Homo sapiens
atttccattaaaggtggaaaa

SEQ ID NO: 6679809 - DNA, 15 bp, Homo sapiens
atttccattatttat

SEQ ID NO: 6679810 - DNA, 15 bp, Homo sapiens
atttccattccagaa

SEQ ID NO: 6679811 - DNA, 16 bp, Homo sapiens
atttccattccagaat

SEQ ID NO: 6679812 - DNA, 17 bp, Homo sapiens
atttccattccagaata

SEQ ID NO: 6679813 - DNA, 20 bp, Homo sapiens
atttccatttacttaagact

SEQ ID NO: 6679814 - DNA, 17 bp, Homo sapiens
atttccatttcttcctc

SEQ ID NO: 6679815 - DNA, 18 bp, Homo sapiens
atttccatttcttcctca

SEQ ID NO: 6679816 - DNA, 17 bp, Homo sapiens
atttcccaaagtcctct

SEQ ID NO: 6679817 - DNA, 24 bp, Homo sapiens
atttcccaagtcagacagatgtca

SEQ ID NO: 6679818 - DNA, 23 bp, Homo sapiens
atttcccagccctcttcttctca

SEQ ID NO: 6679819 - DNA, 21 bp, Homo sapiens
atttcccaggctgaattggga

SEQ ID NO: 6679820 - DNA, 15 bp, Homo sapiens
atttcccagggttaa

SEQ ID NO: 6679821 - DNA, 22 bp, Homo sapiens
atttcccagtaattattttctt

SEQ ID NO: 6679822 - DNA, 16 bp, Homo sapiens
atttcccagttaaaga

SEQ ID NO: 6679823 - DNA, 13 bp, Homo sapiens
atttcccatctgc

SEQ ID NO: 6679824 - DNA, 14 bp, Homo sapiens
atttcccatctgca

SEQ ID NO: 6679825 - DNA, 21 bp, Homo sapiens
atttcccatttgtgccagagg

SEQ ID NO: 6679826 - DNA, 19 bp, Homo sapiens
atttccccaacagtgtgaa

SEQ ID NO: 6679827 - DNA, 15 bp, Homo sapiens
atttccccaccccac

SEQ ID NO: 6679828 - DNA, 20 bp, Homo sapiens
atttccccactctgagtgaa

SEQ ID NO: 6679829 - DNA, 15 bp, Homo sapiens
atttccccagacctg

SEQ ID NO: 6679830 - DNA, 15 bp, Homo sapiens
atttccccagccaca

SEQ ID NO: 6679831 - DNA, 21 bp, Homo sapiens
atttccccagccacaggccaa

SEQ ID NO: 6679832 - DNA, 14 bp, Homo sapiens
atttccccagggca

SEQ ID NO: 6679833 - DNA, 21 bp, Homo sapiens
atttcccccaccccatttctc

SEQ ID NO: 6679834 - DNA, 22 bp, Homo sapiens
atttcccccttcatccatcctg

SEQ ID NO: 6679835 - DNA, 16 bp, Homo sapiens
atttcccctaatcttt

SEQ ID NO: 6679836 - DNA, 20 bp, Homo sapiens
atttcccctcccgtcttcct

SEQ ID NO: 6679837 - DNA, 23 bp, Homo sapiens
atttcccctctgcacccagaaca

SEQ ID NO: 6679838 - DNA, 18 bp, Homo sapiens
atttcccctctgtgtcct

SEQ ID NO: 6679839 - DNA, 18 bp, Homo sapiens
atttcccctcttctgcta

SEQ ID NO: 6679840 - DNA, 23 bp, Homo sapiens
atttcccctgtcagtttcccctc

SEQ ID NO: 6679841 - DNA, 19 bp, Homo sapiens
atttcccggagccatcacc

SEQ ID NO: 6679842 - DNA, 19 bp, Homo sapiens
atttcccgtggccccagcc

SEQ ID NO: 6679843 - DNA, 23 bp, Homo sapiens
atttcccgtggccccagcctggc

SEQ ID NO: 6679844 - DNA, 18 bp, Homo sapiens
atttccctaaaatacatt

SEQ ID NO: 6679845 - DNA, 17 bp, Homo sapiens
atttccctacattaaac

SEQ ID NO: 6679846 - DNA, 20 bp, Homo sapiens
atttccctccagagaaagca

SEQ ID NO: 6679847 - DNA, 19 bp, Homo sapiens
atttccctcccaagtaaat

SEQ ID NO: 6679848 - DNA, 15 bp, Homo sapiens
atttccctctgatat

SEQ ID NO: 6679849 - DNA, 15 bp, Homo sapiens
atttccctgaacaga

SEQ ID NO: 6679850 - DNA, 18 bp, Homo sapiens
atttccctgactcctcta

SEQ ID NO: 6679851 - DNA, 22 bp, Homo sapiens
atttccctgggggcatcctgct

SEQ ID NO: 6679852 - DNA, 12 bp, Homo sapiens
atttcccttctt

SEQ ID NO: 6679853 - DNA, 18 bp, Homo sapiens
atttcccttcttctgtca

SEQ ID NO: 6679854 - DNA, 23 bp, Homo sapiens
atttcccttcttgcatccttcct

SEQ ID NO: 6679855 - DNA, 21 bp, Homo sapiens
atttccctttagctgtgttat

SEQ ID NO: 6679856 - DNA, 22 bp, Homo sapiens
atttccctttagctgtgttatt

SEQ ID NO: 6679857 - DNA, 14 bp, Homo sapiens
atttccgaataaag

SEQ ID NO: 6679858 - DNA, 17 bp, Homo sapiens
atttccggtcccggctg

SEQ ID NO: 6679859 - DNA, 15 bp, Homo sapiens
atttccgttaaaata

SEQ ID NO: 6679860 - DNA, 16 bp, Homo sapiens
atttccgttaaaatac

SEQ ID NO: 6679861 - DNA, 17 bp, Homo sapiens
atttccgttaaaatacc

SEQ ID NO: 6679862 - DNA, 22 bp, Homo sapiens
atttccgttgtacatgttcctg

SEQ ID NO: 6679863 - DNA, 21 bp, Homo sapiens
atttcctaaatatattttaag

SEQ ID NO: 6679864 - DNA, 13 bp, Homo sapiens
atttcctaatatg

SEQ ID NO: 6679865 - DNA, 19 bp, Homo sapiens
atttcctacacaaatgata

SEQ ID NO: 6679866 - DNA, 22 bp, Homo sapiens
atttcctacagaaatactgctc

SEQ ID NO: 6679867 - DNA, 15 bp, Homo sapiens
atttcctatcctggt

SEQ ID NO: 6679868 - DNA, 13 bp, Homo sapiens
atttcctatctgt

SEQ ID NO: 6679869 - DNA, 14 bp, Homo sapiens
atttcctatctgta

SEQ ID NO: 6679870 - DNA, 15 bp, Homo sapiens
atttcctatgatgta

SEQ ID NO: 6679871 - DNA, 20 bp, Homo sapiens
atttcctatgatgtatactg

SEQ ID NO: 6679872 - DNA, 21 bp, Homo sapiens
atttcctatgatgtatactgc

SEQ ID NO: 6679873 - DNA, 19 bp, Homo sapiens
atttcctatttttggaaga

SEQ ID NO: 6679874 - DNA, 22 bp, Homo sapiens
atttcctcaacgttgctcccca

SEQ ID NO: 6679875 - DNA, 17 bp, Homo sapiens
atttcctcacgtgcagg

SEQ ID NO: 6679876 - DNA, 17 bp, Homo sapiens
atttcctcactgcctgg

SEQ ID NO: 6679877 - DNA, 19 bp, Homo sapiens
atttcctcagcttatctct

SEQ ID NO: 6679878 - DNA, 22 bp, Homo sapiens
atttcctcatgtgatcacaatt

SEQ ID NO: 6679879 - DNA, 14 bp, Homo sapiens
atttcctccatggt

SEQ ID NO: 6679880 - DNA, 12 bp, Homo sapiens
atttcctcctcc

SEQ ID NO: 6679881 - DNA, 23 bp, Homo sapiens
atttcctcctcccagtgccttct

SEQ ID NO: 6679882 - DNA, 13 bp, Homo sapiens
atttcctcctggc

SEQ ID NO: 6679883 - DNA, 16 bp, Homo sapiens
atttcctctaaagaaa

SEQ ID NO: 6679884 - DNA, 17 bp, Homo sapiens
atttcctctaaagaaac

SEQ ID NO: 6679885 - DNA, 18 bp, Homo sapiens
atttcctctaaagaaact

SEQ ID NO: 6679886 - DNA, 19 bp, Homo sapiens
atttcctctattgatgtac

SEQ ID NO: 6679887 - DNA, 20 bp, Homo sapiens
atttcctctccactgctgga

SEQ ID NO: 6679888 - DNA, 15 bp, Homo sapiens
atttcctctgttctt

SEQ ID NO: 6679889 - DNA, 19 bp, Homo sapiens
atttcctcttataacttct

SEQ ID NO: 6679890 - DNA, 17 bp, Homo sapiens
atttcctcttccttctc

SEQ ID NO: 6679891 - DNA, 17 bp, Homo sapiens
atttcctcttgaacgtt

SEQ ID NO: 6679892 - DNA, 16 bp, Homo sapiens
atttcctgacttgagt

SEQ ID NO: 6679893 - DNA, 22 bp, Homo sapiens
atttcctgagctaaatgcttca

SEQ ID NO: 6679894 - DNA, 19 bp, Homo sapiens
atttcctgatacattaaaa

SEQ ID NO: 6679895 - DNA, 11 bp, Homo sapiens
atttcctgatc

SEQ ID NO: 6679896 - DNA, 16 bp, Homo sapiens
atttcctgatctagca

SEQ ID NO: 6679897 - DNA, 20 bp, Homo sapiens
atttcctgcccttcctcagt

SEQ ID NO: 6679898 - DNA, 23 bp, Homo sapiens
atttcctgctacacaaaagccaa

SEQ ID NO: 6679899 - DNA, 14 bp, Homo sapiens
atttcctgctcctc

SEQ ID NO: 6679900 - DNA, 15 bp, Homo sapiens
atttcctgctttcta

SEQ ID NO: 6679901 - DNA, 15 bp, Homo sapiens
atttcctggatgttt

SEQ ID NO: 6679902 - DNA, 20 bp, Homo sapiens
atttcctgggagaaagacca

SEQ ID NO: 6679903 - DNA, 21 bp, Homo sapiens
atttcctggtgtgaaggtcct

SEQ ID NO: 6679904 - DNA, 13 bp, Homo sapiens
atttcctgtaata

SEQ ID NO: 6679905 - DNA, 20 bp, Homo sapiens
atttcctgtaatatatttat

SEQ ID NO: 6679906 - DNA, 23 bp, Homo sapiens
atttcctgtacaatcatgaacag

SEQ ID NO: 6679907 - DNA, 14 bp, Homo sapiens
atttcctgtgtctt

SEQ ID NO: 6679908 - DNA, 22 bp, Homo sapiens
atttcctgttggatttgtttaa

SEQ ID NO: 6679909 - DNA, 14 bp, Homo sapiens
atttcctgtttgaa

SEQ ID NO: 6679910 - DNA, 13 bp, Homo sapiens
atttccttaaaat

SEQ ID NO: 6679911 - DNA, 17 bp, Homo sapiens
atttccttagtgccagg

SEQ ID NO: 6679912 - DNA, 14 bp, Homo sapiens
atttccttcaggca

SEQ ID NO: 6679913 - DNA, 15 bp, Homo sapiens
atttccttcaggttt

SEQ ID NO: 6679914 - DNA, 22 bp, Homo sapiens
atttccttccaaggtcactctt

SEQ ID NO: 6679915 - DNA, 14 bp, Homo sapiens
atttccttccactg

SEQ ID NO: 6679916 - DNA, 20 bp, Homo sapiens
atttccttccactgtagcta

SEQ ID NO: 6679917 - DNA, 17 bp, Homo sapiens
atttccttccagcccat

SEQ ID NO: 6679918 - DNA, 19 bp, Homo sapiens
atttccttccagccttttt

SEQ ID NO: 6679919 - DNA, 16 bp, Homo sapiens
atttccttctgttaag

SEQ ID NO: 6679920 - DNA, 22 bp, Homo sapiens
atttccttctgttaagaaagga

SEQ ID NO: 6679921 - DNA, 23 bp, Homo sapiens
atttccttgaatgtggcttgaga

SEQ ID NO: 6679922 - DNA, 20 bp, Homo sapiens
atttccttggattttcctga

SEQ ID NO: 6679923 - DNA, 15 bp, Homo sapiens
atttccttgtgcaaa

SEQ ID NO: 6679924 - DNA, 19 bp, Homo sapiens
atttcctttaccctccaca

SEQ ID NO: 6679925 - DNA, 20 bp, Homo sapiens
atttcctttaccctccacac

SEQ ID NO: 6679926 - DNA, 13 bp, Homo sapiens
atttcctttataa

SEQ ID NO: 6679927 - DNA, 15 bp, Homo sapiens
atttcctttatactg

SEQ ID NO: 6679928 - DNA, 22 bp, Homo sapiens
atttcctttatactgtgaagtt

SEQ ID NO: 6679929 - DNA, 14 bp, Homo sapiens
atttcctttatgtg

SEQ ID NO: 6679930 - DNA, 15 bp, Homo sapiens
atttcctttatgtga

SEQ ID NO: 6679931 - DNA, 19 bp, Homo sapiens
atttcctttatgtgaattt

SEQ ID NO: 6679932 - DNA, 21 bp, Homo sapiens
atttcctttatgtgaattttt

SEQ ID NO: 6679933 - DNA, 22 bp, Homo sapiens
atttcctttattattctgtatc

SEQ ID NO: 6679934 - DNA, 18 bp, Homo sapiens
atttcctttgcgcaaact

SEQ ID NO: 6679935 - DNA, 18 bp, Homo sapiens
atttcctttggagctttt

SEQ ID NO: 6679936 - DNA, 16 bp, Homo sapiens
atttccttttcttccc

SEQ ID NO: 6679937 - DNA, 21 bp, Homo sapiens
atttcctttttctattttacc

SEQ ID NO: 6679938 - DNA, 17 bp, Homo sapiens
atttcctttttgacact

SEQ ID NO: 6679939 - DNA, 19 bp, Homo sapiens
atttccttttttgttatta

SEQ ID NO: 6679940 - DNA, 14 bp, Homo sapiens
atttcgaaactgcc

SEQ ID NO: 6679941 - DNA, 14 bp, Homo sapiens
atttcgaagatata

SEQ ID NO: 6679942 - DNA, 14 bp, Homo sapiens
atttcgaagtttgc

SEQ ID NO: 6679943 - DNA, 20 bp, Homo sapiens
atttcgaagtttgcaacctt

SEQ ID NO: 6679944 - DNA, 17 bp, Homo sapiens
atttcgaccctggggcg

SEQ ID NO: 6679945 - DNA, 14 bp, Homo sapiens
atttcgatgtacag

SEQ ID NO: 6679946 - DNA, 16 bp, Homo sapiens
atttcgccttaaactc

SEQ ID NO: 6679947 - DNA, 21 bp, Homo sapiens
atttcggaccgaaggtgacag

SEQ ID NO: 6679948 - DNA, 19 bp, Homo sapiens
atttcggattttttccaaa

SEQ ID NO: 6679949 - DNA, 14 bp, Homo sapiens
atttcggctatgtc

SEQ ID NO: 6679950 - DNA, 20 bp, Homo sapiens
atttcggttgagaatggaaa

SEQ ID NO: 6679951 - DNA, 14 bp, Homo sapiens
atttcgttccctga

SEQ ID NO: 6679952 - DNA, 14 bp, Homo sapiens
atttctaaaaaaca

SEQ ID NO: 6679953 - DNA, 14 bp, Homo sapiens
atttctaaaaagat

SEQ ID NO: 6679954 - DNA, 20 bp, Homo sapiens
atttctaaaaagattagcaa

SEQ ID NO: 6679955 - DNA, 17 bp, Homo sapiens
atttctaaaacattaat

SEQ ID NO: 6679956 - DNA, 14 bp, Homo sapiens
atttctaaaatctt

SEQ ID NO: 6679957 - DNA, 15 bp, Homo sapiens
atttctaaaatgtta

SEQ ID NO: 6679958 - DNA, 17 bp, Homo sapiens
atttctaaaatgttaaa

SEQ ID NO: 6679959 - DNA, 19 bp, Homo sapiens
atttctaaaccacaaaagt

SEQ ID NO: 6679960 - DNA, 21 bp, Homo sapiens
atttctaaaccacaaaagttg

SEQ ID NO: 6679961 - DNA, 21 bp, Homo sapiens
atttctaaagataatattact

SEQ ID NO: 6679962 - DNA, 17 bp, Homo sapiens
atttctaaatcctcact

SEQ ID NO: 6679963 - DNA, 12 bp, Homo sapiens
atttctaaatct

SEQ ID NO: 6679964 - DNA, 16 bp, Homo sapiens
atttctaaatttatat

SEQ ID NO: 6679965 - DNA, 12 bp, Homo sapiens
atttctaacagt

SEQ ID NO: 6679966 - DNA, 15 bp, Homo sapiens
atttctaacagtcct

SEQ ID NO: 6679967 - DNA, 20 bp, Homo sapiens
atttctaacagtccttgctt

SEQ ID NO: 6679968 - DNA, 21 bp, Homo sapiens
atttctaacagtccttgcttt

SEQ ID NO: 6679969 - DNA, 12 bp, Homo sapiens
atttctaacata

SEQ ID NO: 6679970 - DNA, 20 bp, Homo sapiens
atttctaactaaggacagga

SEQ ID NO: 6679971 - DNA, 21 bp, Homo sapiens
atttctaactctgatgtaaat

SEQ ID NO: 6679972 - DNA, 14 bp, Homo sapiens
atttctaagactac

SEQ ID NO: 6679973 - DNA, 21 bp, Homo sapiens
atttctaagcgcctattgttt

SEQ ID NO: 6679974 - DNA, 18 bp, Homo sapiens
atttctaagcttatttct

SEQ ID NO: 6679975 - DNA, 19 bp, Homo sapiens
atttctaagcttatttcta

SEQ ID NO: 6679976 - DNA, 22 bp, Homo sapiens
atttctaagcttatttctaact

SEQ ID NO: 6679977 - DNA, 21 bp, Homo sapiens
atttctaagtcaaacacttgt

SEQ ID NO: 6679978 - DNA, 12 bp, Homo sapiens
atttctaagtgt

SEQ ID NO: 6679979 - DNA, 13 bp, Homo sapiens
atttctaagtgtt

SEQ ID NO: 6679980 - DNA, 18 bp, Homo sapiens
atttctaagttaaatcat

SEQ ID NO: 6679981 - DNA, 18 bp, Homo sapiens
atttctaatccttttcct

SEQ ID NO: 6679982 - DNA, 19 bp, Homo sapiens
atttctaatccttttcctt

SEQ ID NO: 6679983 - DNA, 14 bp, Homo sapiens
atttctaatgttta

SEQ ID NO: 6679984 - DNA, 16 bp, Homo sapiens
atttctacactttata

SEQ ID NO: 6679985 - DNA, 16 bp, Homo sapiens
atttctacagagaaaa

SEQ ID NO: 6679986 - DNA, 14 bp, Homo sapiens
atttctaccagatg

SEQ ID NO: 6679987 - DNA, 20 bp, Homo sapiens
atttctaccagatgtgcttt

SEQ ID NO: 6679988 - DNA, 12 bp, Homo sapiens
atttctacctca

SEQ ID NO: 6679989 - DNA, 14 bp, Homo sapiens
atttctacctcagc

SEQ ID NO: 6679990 - DNA, 19 bp, Homo sapiens
atttctactatgatcagaa

SEQ ID NO: 6679991 - DNA, 16 bp, Homo sapiens
atttctactgtcaaat

SEQ ID NO: 6679992 - DNA, 18 bp, Homo sapiens
atttctactgtgactgat

SEQ ID NO: 6679993 - DNA, 21 bp, Homo sapiens
atttctactttttgcacctta

SEQ ID NO: 6679994 - DNA, 20 bp, Homo sapiens
atttctagaacaattacatg

SEQ ID NO: 6679995 - DNA, 23 bp, Homo sapiens
atttctagaacatccctgccagc

SEQ ID NO: 6679996 - DNA, 20 bp, Homo sapiens
atttctagacagtattgcca

SEQ ID NO: 6679997 - DNA, 21 bp, Homo sapiens
atttctagacagtattgccac

SEQ ID NO: 6679998 - DNA, 23 bp, Homo sapiens
atttctagacagtattgccacct

SEQ ID NO: 6679999 - DNA, 15 bp, Homo sapiens
atttctagcaggcag

SEQ ID NO: 6680000 - DNA, 18 bp, Homo sapiens
atttctagcagtatgtgt

SEQ ID NO: 6680001 - DNA, 21 bp, Homo sapiens
atttctagcagtatgtgtgct

SEQ ID NO: 6680002 - DNA, 23 bp, Homo sapiens
atttctagcagtatgtgtgctct

SEQ ID NO: 6680003 - DNA, 16 bp, Homo sapiens
atttctagcctgcact

SEQ ID NO: 6680004 - DNA, 18 bp, Homo sapiens
atttctagcttatctact

SEQ ID NO: 6680005 - DNA, 21 bp, Homo sapiens
atttctagcttatctacttcc

SEQ ID NO: 6680006 - DNA, 18 bp, Homo sapiens
atttctagctttttaatt

SEQ ID NO: 6680007 - DNA, 16 bp, Homo sapiens
atttctaggaagaatt

SEQ ID NO: 6680008 - DNA, 19 bp, Homo sapiens
atttctaggaagaatttta

SEQ ID NO: 6680009 - DNA, 20 bp, Homo sapiens
atttctaggaagaattttaa

SEQ ID NO: 6680010 - DNA, 17 bp, Homo sapiens
atttctaggactgaatt

SEQ ID NO: 6680011 - DNA, 23 bp, Homo sapiens
atttctaggactgaattatgaaa

SEQ ID NO: 6680012 - DNA, 18 bp, Homo sapiens
atttctaggcaaaattgt

SEQ ID NO: 6680013 - DNA, 22 bp, Homo sapiens
atttctaggcaaaattgtgaag

SEQ ID NO: 6680014 - DNA, 21 bp, Homo sapiens
atttctaggcaggtggagaga

SEQ ID NO: 6680015 - DNA, 19 bp, Homo sapiens
atttctaggtaggaaatgt

SEQ ID NO: 6680016 - DNA, 15 bp, Homo sapiens
atttctagtaggcag

SEQ ID NO: 6680017 - DNA, 20 bp, Homo sapiens
atttctagtaggcagcaaaa

SEQ ID NO: 6680018 - DNA, 19 bp, Homo sapiens
atttctagtatctattgtg

SEQ ID NO: 6680019 - DNA, 21 bp, Homo sapiens
atttctagtccaaaattacaa

SEQ ID NO: 6680020 - DNA, 16 bp, Homo sapiens
atttctagtcccttct

SEQ ID NO: 6680021 - DNA, 22 bp, Homo sapiens
atttctagtcccttctctcttt

SEQ ID NO: 6680022 - DNA, 15 bp, Homo sapiens
atttctagttattta

SEQ ID NO: 6680023 - DNA, 21 bp, Homo sapiens
atttctagttctttcctcccc

SEQ ID NO: 6680024 - DNA, 13 bp, Homo sapiens
atttctagttttt

SEQ ID NO: 6680025 - DNA, 14 bp, Homo sapiens
atttctataaattt

SEQ ID NO: 6680026 - DNA, 20 bp, Homo sapiens
atttctataaatttaagaaa

SEQ ID NO: 6680027 - DNA, 21 bp, Homo sapiens
atttctataaatttaagaaaa

SEQ ID NO: 6680028 - DNA, 14 bp, Homo sapiens
atttctatacagta

SEQ ID NO: 6680029 - DNA, 18 bp, Homo sapiens
atttctatactttacagg

SEQ ID NO: 6680030 - DNA, 20 bp, Homo sapiens
atttctatactttacaggaa

SEQ ID NO: 6680031 - DNA, 14 bp, Homo sapiens
atttctatagccaa

SEQ ID NO: 6680032 - DNA, 17 bp, Homo sapiens
atttctatagccaaaaa

SEQ ID NO: 6680033 - DNA, 18 bp, Homo sapiens
atttctatattttcattc

SEQ ID NO: 6680034 - DNA, 22 bp, Homo sapiens
atttctatcttgaatttcatgc

SEQ ID NO: 6680035 - DNA, 16 bp, Homo sapiens
atttctatgacaaatt

SEQ ID NO: 6680036 - DNA, 19 bp, Homo sapiens
atttctatgacaaattcaa

SEQ ID NO: 6680037 - DNA, 17 bp, Homo sapiens
atttctatgagaaaaga

SEQ ID NO: 6680038 - DNA, 20 bp, Homo sapiens
atttctatgatccttttttg

SEQ ID NO: 6680039 - DNA, 15 bp, Homo sapiens
atttctatggcatat

SEQ ID NO: 6680040 - DNA, 19 bp, Homo sapiens
atttctatggcatattgat

SEQ ID NO: 6680041 - DNA, 14 bp, Homo sapiens
atttctatggcttt

SEQ ID NO: 6680042 - DNA, 22 bp, Homo sapiens
atttctatgtaaattattgtaa

SEQ ID NO: 6680043 - DNA, 20 bp, Homo sapiens
atttctatgtatgtgccaat

SEQ ID NO: 6680044 - DNA, 12 bp, Homo sapiens
atttctatgtca

SEQ ID NO: 6680045 - DNA, 11 bp, Homo sapiens
atttctattaa

SEQ ID NO: 6680046 - DNA, 14 bp, Homo sapiens
atttctattaaagg

SEQ ID NO: 6680047 - DNA, 22 bp, Homo sapiens
atttctattattaattgcaaaa

SEQ ID NO: 6680048 - DNA, 17 bp, Homo sapiens
atttctattatttttca

SEQ ID NO: 6680049 - DNA, 20 bp, Homo sapiens
atttctattatttttcaagt

SEQ ID NO: 6680050 - DNA, 13 bp, Homo sapiens
atttctattcctt

SEQ ID NO: 6680051 - DNA, 17 bp, Homo sapiens
atttctatttatttact

SEQ ID NO: 6680052 - DNA, 15 bp, Homo sapiens
atttctatttcataa

SEQ ID NO: 6680053 - DNA, 14 bp, Homo sapiens
atttctcaaagttt

SEQ ID NO: 6680054 - DNA, 15 bp, Homo sapiens
atttctcaaagtttt

SEQ ID NO: 6680055 - DNA, 19 bp, Homo sapiens
atttctcaacaaagcacag

SEQ ID NO: 6680056 - DNA, 20 bp, Homo sapiens
atttctcaacaaagcacagt

SEQ ID NO: 6680057 - DNA, 15 bp, Homo sapiens
atttctcaatagttc

SEQ ID NO: 6680058 - DNA, 15 bp, Homo sapiens
atttctcactagtgt

SEQ ID NO: 6680059 - DNA, 22 bp, Homo sapiens
atttctcactatatatatttct

SEQ ID NO: 6680060 - DNA, 24 bp, Homo sapiens
atttctcagaagtctttcagcaag

SEQ ID NO: 6680061 - DNA, 21 bp, Homo sapiens
atttctcagcgggagtctcct

SEQ ID NO: 6680062 - DNA, 17 bp, Homo sapiens
atttctcagctgtgcct

SEQ ID NO: 6680063 - DNA, 12 bp, Homo sapiens
atttctcaggct

SEQ ID NO: 6680064 - DNA, 14 bp, Homo sapiens
atttctcagtgatt

SEQ ID NO: 6680065 - DNA, 19 bp, Homo sapiens
atttctcagtggcttctcc

SEQ ID NO: 6680066 - DNA, 18 bp, Homo sapiens
atttctcataattttgca

SEQ ID NO: 6680067 - DNA, 19 bp, Homo sapiens
atttctcataattttgcaa

SEQ ID NO: 6680068 - DNA, 20 bp, Homo sapiens
atttctcataattttgcaaa

SEQ ID NO: 6680069 - DNA, 12 bp, Homo sapiens
atttctcatgtg

SEQ ID NO: 6680070 - DNA, 13 bp, Homo sapiens
atttctcatgttg

SEQ ID NO: 6680071 - DNA, 17 bp, Homo sapiens
atttctcattgactttt

SEQ ID NO: 6680072 - DNA, 18 bp, Homo sapiens
atttctcatttagcattg

SEQ ID NO: 6680073 - DNA, 16 bp, Homo sapiens
atttctccagaaccca

SEQ ID NO: 6680074 - DNA, 18 bp, Homo sapiens
atttctccagacccagag

SEQ ID NO: 6680075 - DNA, 18 bp, Homo sapiens
atttctccagttgggact

SEQ ID NO: 6680076 - DNA, 16 bp, Homo sapiens
atttctccatcccctc

SEQ ID NO: 6680077 - DNA, 17 bp, Homo sapiens
atttctccatcccctcc

SEQ ID NO: 6680078 - DNA, 20 bp, Homo sapiens
atttctccatcctgcagata

SEQ ID NO: 6680079 - DNA, 20 bp, Homo sapiens
atttctccatgggccaccgc

SEQ ID NO: 6680080 - DNA, 13 bp, Homo sapiens
atttctccattaa

SEQ ID NO: 6680081 - DNA, 11 bp, Homo sapiens
atttctcccag

SEQ ID NO: 6680082 - DNA, 12 bp, Homo sapiens
atttctccccag

SEQ ID NO: 6680083 - DNA, 20 bp, Homo sapiens
atttctcctccatgggagaa

SEQ ID NO: 6680084 - DNA, 12 bp, Homo sapiens
atttctcctccc

SEQ ID NO: 6680085 - DNA, 17 bp, Homo sapiens
atttctcctcccttcct

SEQ ID NO: 6680086 - DNA, 15 bp, Homo sapiens
atttctcctttgata

SEQ ID NO: 6680087 - DNA, 20 bp, Homo sapiens
atttctcctttgataaaata

SEQ ID NO: 6680088 - DNA, 17 bp, Homo sapiens
atttctcctttgcaata

SEQ ID NO: 6680089 - DNA, 12 bp, Homo sapiens
atttctcctttt

SEQ ID NO: 6680090 - DNA, 18 bp, Homo sapiens
atttctcgggtgcatttg

SEQ ID NO: 6680091 - DNA, 17 bp, Homo sapiens
atttctctagaggctgg

SEQ ID NO: 6680092 - DNA, 20 bp, Homo sapiens
atttctctagaggctggcaa

SEQ ID NO: 6680093 - DNA, 22 bp, Homo sapiens
atttctctagtagttaaaaaaa

SEQ ID NO: 6680094 - DNA, 19 bp, Homo sapiens
atttctctatgtttattct

SEQ ID NO: 6680095 - DNA, 17 bp, Homo sapiens
atttctctcatctgtta

SEQ ID NO: 6680096 - DNA, 14 bp, Homo sapiens
atttctctccttaa

SEQ ID NO: 6680097 - DNA, 18 bp, Homo sapiens
atttctctgaacagaaaa

SEQ ID NO: 6680098 - DNA, 13 bp, Homo sapiens
atttctctgtgaa

SEQ ID NO: 6680099 - DNA, 15 bp, Homo sapiens
atttctctgtgaatc

SEQ ID NO: 6680100 - DNA, 16 bp, Homo sapiens
atttctctgtgaatcc

SEQ ID NO: 6680101 - DNA, 13 bp, Homo sapiens
atttctctgtgta

SEQ ID NO: 6680102 - DNA, 14 bp, Homo sapiens
atttctctgtgtat

SEQ ID NO: 6680103 - DNA, 22 bp, Homo sapiens
atttctctgtgtatttatataa

SEQ ID NO: 6680104 - DNA, 22 bp, Homo sapiens
atttctcttctcagctcttcca

SEQ ID NO: 6680105 - DNA, 12 bp, Homo sapiens
atttctcttgct

SEQ ID NO: 6680106 - DNA, 15 bp, Homo sapiens
atttctcttgggcag

SEQ ID NO: 6680107 - DNA, 20 bp, Homo sapiens
atttctcttgggcaggcaga

SEQ ID NO: 6680108 - DNA, 13 bp, Homo sapiens
atttctcttgtcc

SEQ ID NO: 6680109 - DNA, 15 bp, Homo sapiens
atttctcttgtcctt

SEQ ID NO: 6680110 - DNA, 18 bp, Homo sapiens
atttctctttttgaaaaa

SEQ ID NO: 6680111 - DNA, 16 bp, Homo sapiens
atttctgaaaaagaga

SEQ ID NO: 6680112 - DNA, 20 bp, Homo sapiens
atttctgaaatgacctcaag

SEQ ID NO: 6680113 - DNA, 11 bp, Homo sapiens
atttctgaaca

SEQ ID NO: 6680114 - DNA, 19 bp, Homo sapiens
atttctgaatctagagaac

SEQ ID NO: 6680115 - DNA, 21 bp, Homo sapiens
atttctgaattcaaagcttgt

SEQ ID NO: 6680116 - DNA, 15 bp, Homo sapiens
atttctgactcttat

SEQ ID NO: 6680117 - DNA, 23 bp, Homo sapiens
atttctgagaaggtccttaatga

SEQ ID NO: 6680118 - DNA, 18 bp, Homo sapiens
atttctgagcaaagcatc

SEQ ID NO: 6680119 - DNA, 19 bp, Homo sapiens
atttctgatgttttatttg

SEQ ID NO: 6680120 - DNA, 19 bp, Homo sapiens
atttctgcacaggtctctg

SEQ ID NO: 6680121 - DNA, 18 bp, Homo sapiens
atttctgcagatggaaag

SEQ ID NO: 6680122 - DNA, 18 bp, Homo sapiens
atttctgcatatgttgaa

SEQ ID NO: 6680123 - DNA, 23 bp, Homo sapiens
atttctgcatatgttgaatactt

SEQ ID NO: 6680124 - DNA, 17 bp, Homo sapiens
atttctgccctgagccc

SEQ ID NO: 6680125 - DNA, 21 bp, Homo sapiens
atttctgcccttgttccagct

SEQ ID NO: 6680126 - DNA, 16 bp, Homo sapiens
atttctgcctcccctt

SEQ ID NO: 6680127 - DNA, 15 bp, Homo sapiens
atttctgcctcgctc

SEQ ID NO: 6680128 - DNA, 12 bp, Homo sapiens
atttctgccttt

SEQ ID NO: 6680129 - DNA, 13 bp, Homo sapiens
atttctgcctttc

SEQ ID NO: 6680130 - DNA, 21 bp, Homo sapiens
atttctgctaaatatcaccta

SEQ ID NO: 6680131 - DNA, 14 bp, Homo sapiens
atttctgctaagtt

SEQ ID NO: 6680132 - DNA, 15 bp, Homo sapiens
atttctgctctggaa

SEQ ID NO: 6680133 - DNA, 15 bp, Homo sapiens
atttctgctcttcca

SEQ ID NO: 6680134 - DNA, 22 bp, Homo sapiens
atttctgctgaattttcacatg

SEQ ID NO: 6680135 - DNA, 16 bp, Homo sapiens
atttctgctttctttg

SEQ ID NO: 6680136 - DNA, 21 bp, Homo sapiens
atttctgcttttgcatctttg

SEQ ID NO: 6680137 - DNA, 14 bp, Homo sapiens
atttctggaagaaa

SEQ ID NO: 6680138 - DNA, 16 bp, Homo sapiens
atttctggaagaaagg

SEQ ID NO: 6680139 - DNA, 18 bp, Homo sapiens
atttctggaagattctta

SEQ ID NO: 6680140 - DNA, 17 bp, Homo sapiens
atttctggcaaatattt

SEQ ID NO: 6680141 - DNA, 18 bp, Homo sapiens
atttctggcatatgtttc

SEQ ID NO: 6680142 - DNA, 15 bp, Homo sapiens
atttctggcctccta

SEQ ID NO: 6680143 - DNA, 16 bp, Homo sapiens
atttctggcttctagt

SEQ ID NO: 6680144 - DNA, 15 bp, Homo sapiens
atttctgggatattt

SEQ ID NO: 6680145 - DNA, 19 bp, Homo sapiens
atttctgggggaggatgta

SEQ ID NO: 6680146 - DNA, 19 bp, Homo sapiens
atttctggggggagaaaaa

SEQ ID NO: 6680147 - DNA, 15 bp, Homo sapiens
atttctggttgattt

SEQ ID NO: 6680148 - DNA, 11 bp, Homo sapiens
atttctgtaaa

SEQ ID NO: 6680149 - DNA, 13 bp, Homo sapiens
atttctgtacatt

SEQ ID NO: 6680150 - DNA, 23 bp, Homo sapiens
atttctgtagaatgctgtagaat

SEQ ID NO: 6680151 - DNA, 13 bp, Homo sapiens
atttctgtatact

SEQ ID NO: 6680152 - DNA, 12 bp, Homo sapiens
atttctgtatat

SEQ ID NO: 6680153 - DNA, 21 bp, Homo sapiens
atttctgtatatagatgtctg

SEQ ID NO: 6680154 - DNA, 23 bp, Homo sapiens
atttctgtatattccctgtggaa

SEQ ID NO: 6680155 - DNA, 22 bp, Homo sapiens
atttctgtatatttgtcatgac

SEQ ID NO: 6680156 - DNA, 17 bp, Homo sapiens
atttctgtattttttgt

SEQ ID NO: 6680157 - DNA, 19 bp, Homo sapiens
atttctgtcacagtaaaaa

SEQ ID NO: 6680158 - DNA, 21 bp, Homo sapiens
atttctgtcacagtaaaaata

SEQ ID NO: 6680159 - DNA, 15 bp, Homo sapiens
atttctgtcagaatg

SEQ ID NO: 6680160 - DNA, 13 bp, Homo sapiens
atttctgtctcat

SEQ ID NO: 6680161 - DNA, 21 bp, Homo sapiens
atttctgtctcataattgtca

SEQ ID NO: 6680162 - DNA, 17 bp, Homo sapiens
atttctgtctttaagaa

SEQ ID NO: 6680163 - DNA, 14 bp, Homo sapiens
atttctgtgaaaga

SEQ ID NO: 6680164 - DNA, 17 bp, Homo sapiens
atttctgtgaagcaaaa

SEQ ID NO: 6680165 - DNA, 11 bp, Homo sapiens
atttctgtgcc

SEQ ID NO: 6680166 - DNA, 18 bp, Homo sapiens
atttctgtggaaaacaat

SEQ ID NO: 6680167 - DNA, 20 bp, Homo sapiens
atttctgtggagggttgcca

SEQ ID NO: 6680168 - DNA, 16 bp, Homo sapiens
atttctgtgggagaat

SEQ ID NO: 6680169 - DNA, 20 bp, Homo sapiens
atttctgtgtagtatttata

SEQ ID NO: 6680170 - DNA, 20 bp, Homo sapiens
atttctgtgtattttgagat

SEQ ID NO: 6680171 - DNA, 16 bp, Homo sapiens
atttctgttccttttt

SEQ ID NO: 6680172 - DNA, 14 bp, Homo sapiens
atttctgttctcat

SEQ ID NO: 6680173 - DNA, 17 bp, Homo sapiens
atttcttaaaacacatg

SEQ ID NO: 6680174 - DNA, 14 bp, Homo sapiens
atttcttaaaattc

SEQ ID NO: 6680175 - DNA, 19 bp, Homo sapiens
atttcttaaattattttat

SEQ ID NO: 6680176 - DNA, 21 bp, Homo sapiens
atttcttaatgtaacatgttt

SEQ ID NO: 6680177 - DNA, 20 bp, Homo sapiens
atttcttactaaacattttg

SEQ ID NO: 6680178 - DNA, 14 bp, Homo sapiens
atttcttactcaaa

SEQ ID NO: 6680179 - DNA, 18 bp, Homo sapiens
atttcttagagattaaac

SEQ ID NO: 6680180 - DNA, 18 bp, Homo sapiens
atttcttatcaccacagt

SEQ ID NO: 6680181 - DNA, 13 bp, Homo sapiens
atttcttatgtga

SEQ ID NO: 6680182 - DNA, 16 bp, Homo sapiens
atttcttatgtgacat

SEQ ID NO: 6680183 - DNA, 17 bp, Homo sapiens
atttcttatgtgacatt

SEQ ID NO: 6680184 - DNA, 18 bp, Homo sapiens
atttcttatgtgacatta

SEQ ID NO: 6680185 - DNA, 19 bp, Homo sapiens
atttcttatgtgacattaa

SEQ ID NO: 6680186 - DNA, 21 bp, Homo sapiens
atttcttatgtgacattaaca

SEQ ID NO: 6680187 - DNA, 17 bp, Homo sapiens
atttcttattaaccaaa

SEQ ID NO: 6680188 - DNA, 17 bp, Homo sapiens
atttcttatttgaaagt

SEQ ID NO: 6680189 - DNA, 15 bp, Homo sapiens
atttcttcaaaatgt

SEQ ID NO: 6680190 - DNA, 19 bp, Homo sapiens
atttcttcaaaatgtatat

SEQ ID NO: 6680191 - DNA, 16 bp, Homo sapiens
atttcttcaccagatt

SEQ ID NO: 6680192 - DNA, 17 bp, Homo sapiens
atttcttcagtcagaaa

SEQ ID NO: 6680193 - DNA, 23 bp, Homo sapiens
atttcttcagtcagaaaacttta

SEQ ID NO: 6680194 - DNA, 23 bp, Homo sapiens
atttcttccacaagagcccaggc

SEQ ID NO: 6680195 - DNA, 16 bp, Homo sapiens
atttcttccagtgatg

SEQ ID NO: 6680196 - DNA, 11 bp, Homo sapiens
atttcttccca

SEQ ID NO: 6680197 - DNA, 20 bp, Homo sapiens
atttcttcccagaatctctg

SEQ ID NO: 6680198 - DNA, 21 bp, Homo sapiens
atttcttcccagaatctctga

SEQ ID NO: 6680199 - DNA, 19 bp, Homo sapiens
atttcttccctgctttgca

SEQ ID NO: 6680200 - DNA, 16 bp, Homo sapiens
atttcttcctcactat

SEQ ID NO: 6680201 - DNA, 16 bp, Homo sapiens
atttcttcctcagctg

SEQ ID NO: 6680202 - DNA, 14 bp, Homo sapiens
atttcttcctctgc

SEQ ID NO: 6680203 - DNA, 15 bp, Homo sapiens
atttcttcctctgca

SEQ ID NO: 6680204 - DNA, 12 bp, Homo sapiens
atttcttccttc

SEQ ID NO: 6680205 - DNA, 14 bp, Homo sapiens
atttcttccttgtt

SEQ ID NO: 6680206 - DNA, 22 bp, Homo sapiens
atttcttccttgttgtttgctt

SEQ ID NO: 6680207 - DNA, 23 bp, Homo sapiens
atttcttccttgttgtttgcttt

SEQ ID NO: 6680208 - DNA, 17 bp, Homo sapiens
atttcttcgctgctcta

SEQ ID NO: 6680209 - DNA, 22 bp, Homo sapiens
atttcttcgctgctctagctgg

SEQ ID NO: 6680210 - DNA, 17 bp, Homo sapiens
atttcttcgtgaacata

SEQ ID NO: 6680211 - DNA, 20 bp, Homo sapiens
atttcttcgtgatgacatat

SEQ ID NO: 6680212 - DNA, 19 bp, Homo sapiens
atttcttcgttctttttaa

SEQ ID NO: 6680213 - DNA, 16 bp, Homo sapiens
atttcttctagaagat

SEQ ID NO: 6680214 - DNA, 23 bp, Homo sapiens
atttcttctagaagataacattt

SEQ ID NO: 6680215 - DNA, 19 bp, Homo sapiens
atttcttctcaaacctcca

SEQ ID NO: 6680216 - DNA, 13 bp, Homo sapiens
atttcttctctta

SEQ ID NO: 6680217 - DNA, 21 bp, Homo sapiens
atttcttctcttatcctctct

SEQ ID NO: 6680218 - DNA, 19 bp, Homo sapiens
atttcttctctttagtata

SEQ ID NO: 6680219 - DNA, 22 bp, Homo sapiens
atttcttctctttagtataatt

SEQ ID NO: 6680220 - DNA, 18 bp, Homo sapiens
atttcttctgcacaaaga

SEQ ID NO: 6680221 - DNA, 13 bp, Homo sapiens
atttcttctgtag

SEQ ID NO: 6680222 - DNA, 14 bp, Homo sapiens
atttcttcttacca

SEQ ID NO: 6680223 - DNA, 13 bp, Homo sapiens
atttcttcttaga

SEQ ID NO: 6680224 - DNA, 21 bp, Homo sapiens
atttcttcttctaagaagaca

SEQ ID NO: 6680225 - DNA, 23 bp, Homo sapiens
atttcttcttctaagaagacatt

SEQ ID NO: 6680226 - DNA, 21 bp, Homo sapiens
atttcttctttagatgccaaa

SEQ ID NO: 6680227 - DNA, 22 bp, Homo sapiens
atttcttgaaaagccttggaga

SEQ ID NO: 6680228 - DNA, 20 bp, Homo sapiens
atttcttgaagaataaattc

SEQ ID NO: 6680229 - DNA, 21 bp, Homo sapiens
atttcttgaagaataaattct

SEQ ID NO: 6680230 - DNA, 22 bp, Homo sapiens
atttcttgacttcacagcagcc

SEQ ID NO: 6680231 - DNA, 12 bp, Homo sapiens
atttcttgcaat

SEQ ID NO: 6680232 - DNA, 14 bp, Homo sapiens
atttcttgcaattt

SEQ ID NO: 6680233 - DNA, 15 bp, Homo sapiens
atttcttgcaatttg

SEQ ID NO: 6680234 - DNA, 15 bp, Homo sapiens
atttcttggcatgca

SEQ ID NO: 6680235 - DNA, 19 bp, Homo sapiens
atttcttggcattggaatt

SEQ ID NO: 6680236 - DNA, 20 bp, Homo sapiens
atttcttggtaagaagccgg

SEQ ID NO: 6680237 - DNA, 23 bp, Homo sapiens
atttcttggtattattctgtttt

SEQ ID NO: 6680238 - DNA, 18 bp, Homo sapiens
atttcttgtcaattatgt

SEQ ID NO: 6680239 - DNA, 13 bp, Homo sapiens
atttcttgtgcct

SEQ ID NO: 6680240 - DNA, 12 bp, Homo sapiens
atttctttaaaa

SEQ ID NO: 6680241 - DNA, 19 bp, Homo sapiens
atttctttaaaaaagaaat

SEQ ID NO: 6680242 - DNA, 18 bp, Homo sapiens
atttctttaaaagaatga

SEQ ID NO: 6680243 - DNA, 22 bp, Homo sapiens
atttctttagaacaacataaaa

SEQ ID NO: 6680244 - DNA, 11 bp, Homo sapiens
atttctttata

SEQ ID NO: 6680245 - DNA, 22 bp, Homo sapiens
atttctttataaaatttactgt

SEQ ID NO: 6680246 - DNA, 17 bp, Homo sapiens
atttctttatttctgtc

SEQ ID NO: 6680247 - DNA, 14 bp, Homo sapiens
atttctttccagag

SEQ ID NO: 6680248 - DNA, 20 bp, Homo sapiens
atttctttcctttaaaaata

SEQ ID NO: 6680249 - DNA, 12 bp, Homo sapiens
atttctttctaa

SEQ ID NO: 6680250 - DNA, 13 bp, Homo sapiens
atttctttctaaa

SEQ ID NO: 6680251 - DNA, 20 bp, Homo sapiens
atttctttctaaaacacatt

SEQ ID NO: 6680252 - DNA, 22 bp, Homo sapiens
atttctttctttgcaccaaaga

SEQ ID NO: 6680253 - DNA, 12 bp, Homo sapiens
atttctttgaaa

SEQ ID NO: 6680254 - DNA, 22 bp, Homo sapiens
atttctttgaaaaaaaataaat

SEQ ID NO: 6680255 - DNA, 17 bp, Homo sapiens
atttctttgaatgtatt

SEQ ID NO: 6680256 - DNA, 17 bp, Homo sapiens
atttctttgcctgttca

SEQ ID NO: 6680257 - DNA, 20 bp, Homo sapiens
atttctttgcctgttcagtt

SEQ ID NO: 6680258 - DNA, 23 bp, Homo sapiens
atttctttgcctgttcagttaca

SEQ ID NO: 6680259 - DNA, 22 bp, Homo sapiens
atttctttgctgtaagatgtct

SEQ ID NO: 6680260 - DNA, 17 bp, Homo sapiens
atttctttgtagaataa

SEQ ID NO: 6680261 - DNA, 22 bp, Homo sapiens
atttctttgtagaataaatggt

SEQ ID NO: 6680262 - DNA, 18 bp, Homo sapiens
atttctttgtctttttcc

SEQ ID NO: 6680263 - DNA, 20 bp, Homo sapiens
atttctttgtctttttccta

SEQ ID NO: 6680264 - DNA, 16 bp, Homo sapiens
atttctttgtgataac

SEQ ID NO: 6680265 - DNA, 19 bp, Homo sapiens
atttctttgtgctttggct

SEQ ID NO: 6680266 - DNA, 14 bp, Homo sapiens
atttctttgttata

SEQ ID NO: 6680267 - DNA, 22 bp, Homo sapiens
atttctttgttatcaaacttca

SEQ ID NO: 6680268 - DNA, 23 bp, Homo sapiens
atttctttgttatcaaacttcag

SEQ ID NO: 6680269 - DNA, 10 bp, Homo sapiens
atttctttta

SEQ ID NO: 6680270 - DNA, 13 bp, Homo sapiens
atttcttttaaaa

SEQ ID NO: 6680271 - DNA, 16 bp, Homo sapiens
atttcttttaaagaag

SEQ ID NO: 6680272 - DNA, 13 bp, Homo sapiens
atttcttttagaa

SEQ ID NO: 6680273 - DNA, 14 bp, Homo sapiens
atttcttttatata

SEQ ID NO: 6680274 - DNA, 16 bp, Homo sapiens
atttcttttatatata

SEQ ID NO: 6680275 - DNA, 17 bp, Homo sapiens
atttcttttatatataa

SEQ ID NO: 6680276 - DNA, 20 bp, Homo sapiens
atttcttttatatataaaat

SEQ ID NO: 6680277 - DNA, 14 bp, Homo sapiens
atttcttttattaa

SEQ ID NO: 6680278 - DNA, 24 bp, Homo sapiens
atttcttttccttcattcataggg

SEQ ID NO: 6680279 - DNA, 20 bp, Homo sapiens
atttcttttgccgttattaa

SEQ ID NO: 6680280 - DNA, 22 bp, Homo sapiens
atttcttttgtaataaactatt

SEQ ID NO: 6680281 - DNA, 20 bp, Homo sapiens
atttcttttgttgtacttta

SEQ ID NO: 6680282 - DNA, 21 bp, Homo sapiens
atttcttttgttgtactttat

SEQ ID NO: 6680283 - DNA, 22 bp, Homo sapiens
atttctttttaattattttaaa

SEQ ID NO: 6680284 - DNA, 22 bp, Homo sapiens
atttctttttcttgcaaaacaa

SEQ ID NO: 6680285 - DNA, 21 bp, Homo sapiens
atttctttttgggagagactt

SEQ ID NO: 6680286 - DNA, 21 bp, Homo sapiens
atttcttttttaaatgaagaa

SEQ ID NO: 6680287 - DNA, 22 bp, Homo sapiens
atttcttttttaaatgaagaaa

SEQ ID NO: 6680288 - DNA, 20 bp, Homo sapiens
atttctttttttaaattgta

SEQ ID NO: 6680289 - DNA, 18 bp, Homo sapiens
atttcttttttttaataa

SEQ ID NO: 6680290 - DNA, 14 bp, Homo sapiens
atttgaaaaaaact

SEQ ID NO: 6680291 - DNA, 22 bp, Homo sapiens
atttgaaaaaaacttcattctc

SEQ ID NO: 6680292 - DNA, 16 bp, Homo sapiens
atttgaaaaaaagcat

SEQ ID NO: 6680293 - DNA, 21 bp, Homo sapiens
atttgaaaaaagttactgcaa

SEQ ID NO: 6680294 - DNA, 22 bp, Homo sapiens
atttgaaaaagttccatagaaa

SEQ ID NO: 6680295 - DNA, 14 bp, Homo sapiens
atttgaaaaatata

SEQ ID NO: 6680296 - DNA, 20 bp, Homo sapiens
atttgaaaaatataaaatta

SEQ ID NO: 6680297 - DNA, 22 bp, Homo sapiens
atttgaaaacataatctgcaaa

SEQ ID NO: 6680298 - DNA, 19 bp, Homo sapiens
atttgaaaagcccacataa

SEQ ID NO: 6680299 - DNA, 18 bp, Homo sapiens
atttgaaaataattgttc

SEQ ID NO: 6680300 - DNA, 14 bp, Homo sapiens
atttgaaaattgta

SEQ ID NO: 6680301 - DNA, 16 bp, Homo sapiens
atttgaaaattttgat

SEQ ID NO: 6680302 - DNA, 17 bp, Homo sapiens
atttgaaaccaggacat

SEQ ID NO: 6680303 - DNA, 14 bp, Homo sapiens
atttgaaagaaagg

SEQ ID NO: 6680304 - DNA, 13 bp, Homo sapiens
atttgaaaggaaa

SEQ ID NO: 6680305 - DNA, 13 bp, Homo sapiens
atttgaaagtgcc

SEQ ID NO: 6680306 - DNA, 17 bp, Homo sapiens
atttgaaagtgcctttg

SEQ ID NO: 6680307 - DNA, 14 bp, Homo sapiens
atttgaaatactaa

SEQ ID NO: 6680308 - DNA, 16 bp, Homo sapiens
atttgaaatactaaaa

SEQ ID NO: 6680309 - DNA, 19 bp, Homo sapiens
atttgaaatactaaaagca

SEQ ID NO: 6680310 - DNA, 14 bp, Homo sapiens
atttgaaatagatt

SEQ ID NO: 6680311 - DNA, 14 bp, Homo sapiens
atttgaaatattga

SEQ ID NO: 6680312 - DNA, 21 bp, Homo sapiens
atttgaaatcaccttttctaa

SEQ ID NO: 6680313 - DNA, 22 bp, Homo sapiens
atttgaaatcaccttttctaaa

SEQ ID NO: 6680314 - DNA, 15 bp, Homo sapiens
atttgaaatttagct

SEQ ID NO: 6680315 - DNA, 13 bp, Homo sapiens
atttgaacactgg

SEQ ID NO: 6680316 - DNA, 22 bp, Homo sapiens
atttgaacactggctaaagata

SEQ ID NO: 6680317 - DNA, 18 bp, Homo sapiens
atttgaacacttggtgct

SEQ ID NO: 6680318 - DNA, 22 bp, Homo sapiens
atttgaacatgtggcttgaatt

SEQ ID NO: 6680319 - DNA, 20 bp, Homo sapiens
atttgaaccaaaacattccg

SEQ ID NO: 6680320 - DNA, 14 bp, Homo sapiens
atttgaaccaataa

SEQ ID NO: 6680321 - DNA, 15 bp, Homo sapiens
atttgaactgagccg

SEQ ID NO: 6680322 - DNA, 16 bp, Homo sapiens
atttgaactttggaac

SEQ ID NO: 6680323 - DNA, 20 bp, Homo sapiens
atttgaactttttattgatt

SEQ ID NO: 6680324 - DNA, 16 bp, Homo sapiens
atttgaagaacatgtg

SEQ ID NO: 6680325 - DNA, 17 bp, Homo sapiens
atttgaagacttcaaaa

SEQ ID NO: 6680326 - DNA, 16 bp, Homo sapiens
atttgaagatctgatt

SEQ ID NO: 6680327 - DNA, 17 bp, Homo sapiens
atttgaagatttaatta

SEQ ID NO: 6680328 - DNA, 17 bp, Homo sapiens
atttgaagcagctctgc

SEQ ID NO: 6680329 - DNA, 17 bp, Homo sapiens
atttgaagctcagaaag

SEQ ID NO: 6680330 - DNA, 23 bp, Homo sapiens
atttgaagctgcagtgagctgtg

SEQ ID NO: 6680331 - DNA, 14 bp, Homo sapiens
atttgaagggtctt

SEQ ID NO: 6680332 - DNA, 16 bp, Homo sapiens
atttgaagtaaaggat

SEQ ID NO: 6680333 - DNA, 17 bp, Homo sapiens
atttgaagtaacttatt

SEQ ID NO: 6680334 - DNA, 20 bp, Homo sapiens
atttgaagtggaaaaagaaa

SEQ ID NO: 6680335 - DNA, 18 bp, Homo sapiens
atttgaataaatgagaaa

SEQ ID NO: 6680336 - DNA, 13 bp, Homo sapiens
atttgaataaatt

SEQ ID NO: 6680337 - DNA, 14 bp, Homo sapiens
atttgaataaatta

SEQ ID NO: 6680338 - DNA, 17 bp, Homo sapiens
atttgaataaattatga

SEQ ID NO: 6680339 - DNA, 19 bp, Homo sapiens
atttgaataattccatgat

SEQ ID NO: 6680340 - DNA, 18 bp, Homo sapiens
atttgaatcaatgtatta

SEQ ID NO: 6680341 - DNA, 24 bp, Homo sapiens
atttgaatcagagaaaactgttga

SEQ ID NO: 6680342 - DNA, 23 bp, Homo sapiens
atttgaatcagcctacaggcctc

SEQ ID NO: 6680343 - DNA, 18 bp, Homo sapiens
atttgaatctcaatttga

SEQ ID NO: 6680344 - DNA, 18 bp, Homo sapiens
atttgaatcttgtctcaa

SEQ ID NO: 6680345 - DNA, 22 bp, Homo sapiens
atttgaatcttgtctcaatgct

SEQ ID NO: 6680346 - DNA, 16 bp, Homo sapiens
atttgaatgaaaaatt

SEQ ID NO: 6680347 - DNA, 18 bp, Homo sapiens
atttgaatgcattttgtt

SEQ ID NO: 6680348 - DNA, 15 bp, Homo sapiens
atttgaatgcttaat

SEQ ID NO: 6680349 - DNA, 17 bp, Homo sapiens
atttgaatggattaaat

SEQ ID NO: 6680350 - DNA, 22 bp, Homo sapiens
atttgaatggattaaatggcac

SEQ ID NO: 6680351 - DNA, 17 bp, Homo sapiens
atttgaatgggtccatt

SEQ ID NO: 6680352 - DNA, 20 bp, Homo sapiens
atttgaatgtatgcttcata

SEQ ID NO: 6680353 - DNA, 22 bp, Homo sapiens
atttgaatgtatgcttcataca

SEQ ID NO: 6680354 - DNA, 18 bp, Homo sapiens
atttgaatgttaagcaga

SEQ ID NO: 6680355 - DNA, 14 bp, Homo sapiens
atttgaattagtaa

SEQ ID NO: 6680356 - DNA, 18 bp, Homo sapiens
atttgaattatcagcaaa

SEQ ID NO: 6680357 - DNA, 23 bp, Homo sapiens
atttgaattatcagcaaagaaaa

SEQ ID NO: 6680358 - DNA, 14 bp, Homo sapiens
atttgaattcattt

SEQ ID NO: 6680359 - DNA, 19 bp, Homo sapiens
atttgaattcatttgctga

SEQ ID NO: 6680360 - DNA, 16 bp, Homo sapiens
atttgaattgggtccc

SEQ ID NO: 6680361 - DNA, 18 bp, Homo sapiens
atttgaattttaaatcta

SEQ ID NO: 6680362 - DNA, 14 bp, Homo sapiens
atttgaatttttac

SEQ ID NO: 6680363 - DNA, 20 bp, Homo sapiens
atttgacaaaataacatttg

SEQ ID NO: 6680364 - DNA, 21 bp, Homo sapiens
atttgacacataaaagtaatt

SEQ ID NO: 6680365 - DNA, 22 bp, Homo sapiens
atttgacacataaaagtaatta

SEQ ID NO: 6680366 - DNA, 13 bp, Homo sapiens
atttgacagacat

SEQ ID NO: 6680367 - DNA, 18 bp, Homo sapiens
atttgacaggggctcagg

SEQ ID NO: 6680368 - DNA, 17 bp, Homo sapiens
atttgacattgtcagaa

SEQ ID NO: 6680369 - DNA, 14 bp, Homo sapiens
atttgacatttagt

SEQ ID NO: 6680370 - DNA, 17 bp, Homo sapiens
atttgaccagaactttt

SEQ ID NO: 6680371 - DNA, 22 bp, Homo sapiens
atttgacctcctccctgttatt

SEQ ID NO: 6680372 - DNA, 13 bp, Homo sapiens
atttgactaattt

SEQ ID NO: 6680373 - DNA, 14 bp, Homo sapiens
atttgactaatttt

SEQ ID NO: 6680374 - DNA, 20 bp, Homo sapiens
atttgactatgaatgttatc

SEQ ID NO: 6680375 - DNA, 13 bp, Homo sapiens
atttgactattct

SEQ ID NO: 6680376 - DNA, 17 bp, Homo sapiens
atttgactattctgtat

SEQ ID NO: 6680377 - DNA, 14 bp, Homo sapiens
atttgactgaagat

SEQ ID NO: 6680378 - DNA, 15 bp, Homo sapiens
atttgacttctgagt

SEQ ID NO: 6680379 - DNA, 13 bp, Homo sapiens
atttgacttgtgg

SEQ ID NO: 6680380 - DNA, 18 bp, Homo sapiens
atttgactttctgtctgt

SEQ ID NO: 6680381 - DNA, 22 bp, Homo sapiens
atttgacttttctgtaattcag

SEQ ID NO: 6680382 - DNA, 12 bp, Homo sapiens
atttgagaaatg

SEQ ID NO: 6680383 - DNA, 15 bp, Homo sapiens
atttgagaagaaata

SEQ ID NO: 6680384 - DNA, 18 bp, Homo sapiens
atttgagaagaaatactc

SEQ ID NO: 6680385 - DNA, 23 bp, Homo sapiens
atttgagaagataatcattgctt

SEQ ID NO: 6680386 - DNA, 18 bp, Homo sapiens
atttgagaagctgctcaa

SEQ ID NO: 6680387 - DNA, 18 bp, Homo sapiens
atttgagaatacataaac

SEQ ID NO: 6680388 - DNA, 20 bp, Homo sapiens
atttgagaatacataaacaa

SEQ ID NO: 6680389 - DNA, 14 bp, Homo sapiens
atttgagaatataa

SEQ ID NO: 6680390 - DNA, 15 bp, Homo sapiens
atttgagaattattc

SEQ ID NO: 6680391 - DNA, 12 bp, Homo sapiens
atttgagacagg

SEQ ID NO: 6680392 - DNA, 14 bp, Homo sapiens
atttgagactgaaa

SEQ ID NO: 6680393 - DNA, 15 bp, Homo sapiens
atttgagactgaaat

SEQ ID NO: 6680394 - DNA, 15 bp, Homo sapiens
atttgagagaagcca

SEQ ID NO: 6680395 - DNA, 13 bp, Homo sapiens
atttgagcaattc

SEQ ID NO: 6680396 - DNA, 17 bp, Homo sapiens
atttgagcaattcattt

SEQ ID NO: 6680397 - DNA, 21 bp, Homo sapiens
atttgagcaattcatttcact

SEQ ID NO: 6680398 - DNA, 22 bp, Homo sapiens
atttgagcatgcacagctgctt

SEQ ID NO: 6680399 - DNA, 18 bp, Homo sapiens
atttgagctgcctggagg

SEQ ID NO: 6680400 - DNA, 20 bp, Homo sapiens
atttgaggaagctctccctt

SEQ ID NO: 6680401 - DNA, 21 bp, Homo sapiens
atttgaggacttgttaaagag

SEQ ID NO: 6680402 - DNA, 19 bp, Homo sapiens
atttgaggagcagcttcag

SEQ ID NO: 6680403 - DNA, 23 bp, Homo sapiens
atttgaggagcagcttcagttgt

SEQ ID NO: 6680404 - DNA, 15 bp, Homo sapiens
atttgaggagggaat

SEQ ID NO: 6680405 - DNA, 17 bp, Homo sapiens
atttgagggcccagcca

SEQ ID NO: 6680406 - DNA, 18 bp, Homo sapiens
atttgagggcccagccag

SEQ ID NO: 6680407 - DNA, 17 bp, Homo sapiens
atttgaggggaaaaaac

SEQ ID NO: 6680408 - DNA, 17 bp, Homo sapiens
atttgaggggaaaacac

SEQ ID NO: 6680409 - DNA, 22 bp, Homo sapiens
atttgaggggccaggggcaggc

SEQ ID NO: 6680410 - DNA, 22 bp, Homo sapiens
atttgaggtcaagtaagaagac

SEQ ID NO: 6680411 - DNA, 17 bp, Homo sapiens
atttgaggtcagtgttt

SEQ ID NO: 6680412 - DNA, 21 bp, Homo sapiens
atttgaggtctacattcttgg

SEQ ID NO: 6680413 - DNA, 16 bp, Homo sapiens
atttgaggtctagaga

SEQ ID NO: 6680414 - DNA, 17 bp, Homo sapiens
atttgaggtctagagag

SEQ ID NO: 6680415 - DNA, 21 bp, Homo sapiens
atttgaggtctagagagaacc

SEQ ID NO: 6680416 - DNA, 18 bp, Homo sapiens
atttgaggtctgttcttt

SEQ ID NO: 6680417 - DNA, 22 bp, Homo sapiens
atttgaggtctgttctttccaa

SEQ ID NO: 6680418 - DNA, 23 bp, Homo sapiens
atttgaggtctgttctttccaaa

SEQ ID NO: 6680419 - DNA, 13 bp, Homo sapiens
atttgagtctctt

SEQ ID NO: 6680420 - DNA, 21 bp, Homo sapiens
atttgagtctcttaatagcca

SEQ ID NO: 6680421 - DNA, 19 bp, Homo sapiens
atttgagtgttttaagata

SEQ ID NO: 6680422 - DNA, 18 bp, Homo sapiens
atttgagtttgacattta

SEQ ID NO: 6680423 - DNA, 14 bp, Homo sapiens
atttgataaacatt

SEQ ID NO: 6680424 - DNA, 15 bp, Homo sapiens
atttgataaactaaa

SEQ ID NO: 6680425 - DNA, 16 bp, Homo sapiens
atttgataaactgaat

SEQ ID NO: 6680426 - DNA, 12 bp, Homo sapiens
atttgataatga

SEQ ID NO: 6680427 - DNA, 19 bp, Homo sapiens
atttgataattttgaaatg

SEQ ID NO: 6680428 - DNA, 13 bp, Homo sapiens
atttgatacaaaa

SEQ ID NO: 6680429 - DNA, 15 bp, Homo sapiens
atttgatacaaaatg

SEQ ID NO: 6680430 - DNA, 19 bp, Homo sapiens
atttgatacataataaaaa

SEQ ID NO: 6680431 - DNA, 15 bp, Homo sapiens
atttgatacatataa

SEQ ID NO: 6680432 - DNA, 12 bp, Homo sapiens
atttgatactta

SEQ ID NO: 6680433 - DNA, 13 bp, Homo sapiens
atttgatacttat

SEQ ID NO: 6680434 - DNA, 22 bp, Homo sapiens
atttgatacttatattttcgta

SEQ ID NO: 6680435 - DNA, 17 bp, Homo sapiens
atttgatatacagacct

SEQ ID NO: 6680436 - DNA, 18 bp, Homo sapiens
atttgatatacagacctc

SEQ ID NO: 6680437 - DNA, 23 bp, Homo sapiens
atttgatatacagacctccagat

SEQ ID NO: 6680438 - DNA, 15 bp, Homo sapiens
atttgatatatgtat

SEQ ID NO: 6680439 - DNA, 16 bp, Homo sapiens
atttgatattatctac

SEQ ID NO: 6680440 - DNA, 15 bp, Homo sapiens
atttgatatttgcat

SEQ ID NO: 6680441 - DNA, 16 bp, Homo sapiens
atttgatatttgcatt

SEQ ID NO: 6680442 - DNA, 19 bp, Homo sapiens
atttgatatttgcattgag

SEQ ID NO: 6680443 - DNA, 16 bp, Homo sapiens
atttgatatttggtta

SEQ ID NO: 6680444 - DNA, 18 bp, Homo sapiens
atttgatatttggttatt

SEQ ID NO: 6680445 - DNA, 12 bp, Homo sapiens
atttgatcacag

SEQ ID NO: 6680446 - DNA, 17 bp, Homo sapiens
atttgatcccaatagaa

SEQ ID NO: 6680447 - DNA, 23 bp, Homo sapiens
atttgatcgttccagttcccact

SEQ ID NO: 6680448 - DNA, 20 bp, Homo sapiens
atttgatcttgtaaaaatag

SEQ ID NO: 6680449 - DNA, 14 bp, Homo sapiens
atttgatctttgtt

SEQ ID NO: 6680450 - DNA, 20 bp, Homo sapiens
atttgatctttgtttaaatg

SEQ ID NO: 6680451 - DNA, 11 bp, Homo sapiens
atttgatgaaa

SEQ ID NO: 6680452 - DNA, 16 bp, Homo sapiens
atttgatgctggagag

SEQ ID NO: 6680453 - DNA, 23 bp, Homo sapiens
atttgatgctgtttgacaaagtt

SEQ ID NO: 6680454 - DNA, 17 bp, Homo sapiens
atttgatgcttttctct

SEQ ID NO: 6680455 - DNA, 19 bp, Homo sapiens
atttgatgcttttctctca

SEQ ID NO: 6680456 - DNA, 19 bp, Homo sapiens
atttgatggtgaatattac

SEQ ID NO: 6680457 - DNA, 20 bp, Homo sapiens
atttgatggtgaatattaca

SEQ ID NO: 6680458 - DNA, 23 bp, Homo sapiens
atttgatggtggtattgtgacca

SEQ ID NO: 6680459 - DNA, 13 bp, Homo sapiens
atttgatgtaata

SEQ ID NO: 6680460 - DNA, 18 bp, Homo sapiens
atttgatgtaatacttct

SEQ ID NO: 6680461 - DNA, 17 bp, Homo sapiens
atttgatgtacattaca

SEQ ID NO: 6680462 - DNA, 19 bp, Homo sapiens
atttgatgtacattacaga

SEQ ID NO: 6680463 - DNA, 20 bp, Homo sapiens
atttgatgtacattacagat

SEQ ID NO: 6680464 - DNA, 15 bp, Homo sapiens
atttgatgtgacttt

SEQ ID NO: 6680465 - DNA, 20 bp, Homo sapiens
atttgatgtggtgaaaagca

SEQ ID NO: 6680466 - DNA, 18 bp, Homo sapiens
atttgattaataaaatat

SEQ ID NO: 6680467 - DNA, 22 bp, Homo sapiens
atttgattaataaaatatctat

SEQ ID NO: 6680468 - DNA, 15 bp, Homo sapiens
atttgattaggtatg

SEQ ID NO: 6680469 - DNA, 21 bp, Homo sapiens
atttgattaggtatgtttgta

SEQ ID NO: 6680470 - DNA, 20 bp, Homo sapiens
atttgattatgtatggatat

SEQ ID NO: 6680471 - DNA, 18 bp, Homo sapiens
atttgattcattttcctg

SEQ ID NO: 6680472 - DNA, 22 bp, Homo sapiens
atttgattcattttcctgttca

SEQ ID NO: 6680473 - DNA, 20 bp, Homo sapiens
atttgattcgccctcctccc

SEQ ID NO: 6680474 - DNA, 20 bp, Homo sapiens
atttgattctatgactgaag

SEQ ID NO: 6680475 - DNA, 23 bp, Homo sapiens
atttgattctgtgtgttttcata

SEQ ID NO: 6680476 - DNA, 17 bp, Homo sapiens
atttgattgctttgctg

SEQ ID NO: 6680477 - DNA, 18 bp, Homo sapiens
atttgattgctttgctgc

SEQ ID NO: 6680478 - DNA, 21 bp, Homo sapiens
atttgattgctttgctgcaca

SEQ ID NO: 6680479 - DNA, 18 bp, Homo sapiens
atttgattgggatgaatg

SEQ ID NO: 6680480 - DNA, 18 bp, Homo sapiens
atttgatttattaactta

SEQ ID NO: 6680481 - DNA, 22 bp, Homo sapiens
atttgatttattaacttaataa

SEQ ID NO: 6680482 - DNA, 14 bp, Homo sapiens
atttgatttccatc

SEQ ID NO: 6680483 - DNA, 22 bp, Homo sapiens
atttgatttcgatgtacagtct

SEQ ID NO: 6680484 - DNA, 14 bp, Homo sapiens
atttgatttctaat

SEQ ID NO: 6680485 - DNA, 20 bp, Homo sapiens
atttgatttctaattgtaag

SEQ ID NO: 6680486 - DNA, 21 bp, Homo sapiens
atttgatttctaattgtaagt

SEQ ID NO: 6680487 - DNA, 15 bp, Homo sapiens
atttgatttgtttag

SEQ ID NO: 6680488 - DNA, 19 bp, Homo sapiens
atttgatttttattattaa

SEQ ID NO: 6680489 - DNA, 22 bp, Homo sapiens
atttgatttttctaaccttgaa

SEQ ID NO: 6680490 - DNA, 18 bp, Homo sapiens
atttgatttttgtctcaa

SEQ ID NO: 6680491 - DNA, 21 bp, Homo sapiens
atttgcaaaatggaaatgtaa

SEQ ID NO: 6680492 - DNA, 22 bp, Homo sapiens
atttgcaaaatggaaatgtaat

SEQ ID NO: 6680493 - DNA, 19 bp, Homo sapiens
atttgcaaaccctttgtat

SEQ ID NO: 6680494 - DNA, 20 bp, Homo sapiens
atttgcaaaccctttgtatt

SEQ ID NO: 6680495 - DNA, 11 bp, Homo sapiens
atttgcaaagt

SEQ ID NO: 6680496 - DNA, 17 bp, Homo sapiens
atttgcaaagtactgta

SEQ ID NO: 6680497 - DNA, 18 bp, Homo sapiens
atttgcaaagtactgtaa

SEQ ID NO: 6680498 - DNA, 22 bp, Homo sapiens
atttgcaacactgccaaacatc

SEQ ID NO: 6680499 - DNA, 23 bp, Homo sapiens
atttgcaacagcaaattaatgtg

SEQ ID NO: 6680500 - DNA, 22 bp, Homo sapiens
atttgcaacaggaagacactgg

SEQ ID NO: 6680501 - DNA, 21 bp, Homo sapiens
atttgcaacaggggaggaaaa

SEQ ID NO: 6680502 - DNA, 19 bp, Homo sapiens
atttgcaactttagaaaga

SEQ ID NO: 6680503 - DNA, 23 bp, Homo sapiens
atttgcaactttagaaagaaatt

SEQ ID NO: 6680504 - DNA, 16 bp, Homo sapiens
atttgcaaggctgatt

SEQ ID NO: 6680505 - DNA, 16 bp, Homo sapiens
atttgcaataaaaaag

SEQ ID NO: 6680506 - DNA, 21 bp, Homo sapiens
atttgcaatattcctttgggc

SEQ ID NO: 6680507 - DNA, 19 bp, Homo sapiens
atttgcaattcatgtaaca

SEQ ID NO: 6680508 - DNA, 20 bp, Homo sapiens
atttgcaattcatgtaacag

SEQ ID NO: 6680509 - DNA, 19 bp, Homo sapiens
atttgcacaatatttcttt

SEQ ID NO: 6680510 - DNA, 20 bp, Homo sapiens
atttgcacacaaaacatctt

SEQ ID NO: 6680511 - DNA, 17 bp, Homo sapiens
atttgcacaggttttca

SEQ ID NO: 6680512 - DNA, 11 bp, Homo sapiens
atttgcacagt

SEQ ID NO: 6680513 - DNA, 15 bp, Homo sapiens
atttgcacattaaat

SEQ ID NO: 6680514 - DNA, 20 bp, Homo sapiens
atttgcacattaaatgactc

SEQ ID NO: 6680515 - DNA, 13 bp, Homo sapiens
atttgcaccagtt

SEQ ID NO: 6680516 - DNA, 15 bp, Homo sapiens
atttgcaccagtttt

SEQ ID NO: 6680517 - DNA, 18 bp, Homo sapiens
atttgcaccttaaaagac

SEQ ID NO: 6680518 - DNA, 12 bp, Homo sapiens
atttgcacttat

SEQ ID NO: 6680519 - DNA, 18 bp, Homo sapiens
atttgcacttatgtactt

SEQ ID NO: 6680520 - DNA, 21 bp, Homo sapiens
atttgcacttatgtacttgat

SEQ ID NO: 6680521 - DNA, 19 bp, Homo sapiens
atttgcagaagctgtgagt

SEQ ID NO: 6680522 - DNA, 23 bp, Homo sapiens
atttgcagataattctggaccag

SEQ ID NO: 6680523 - DNA, 13 bp, Homo sapiens
atttgcagctgct

SEQ ID NO: 6680524 - DNA, 18 bp, Homo sapiens
atttgcaggattcccttc

SEQ ID NO: 6680525 - DNA, 19 bp, Homo sapiens
atttgcaggattcccttct

SEQ ID NO: 6680526 - DNA, 19 bp, Homo sapiens
atttgcataatactaattt

SEQ ID NO: 6680527 - DNA, 15 bp, Homo sapiens
atttgcatacttacc

SEQ ID NO: 6680528 - DNA, 22 bp, Homo sapiens
atttgcatatcacccttccctg

SEQ ID NO: 6680529 - DNA, 22 bp, Homo sapiens
atttgcatattttgagaaactg

SEQ ID NO: 6680530 - DNA, 17 bp, Homo sapiens
atttgcatgaaagcaca

SEQ ID NO: 6680531 - DNA, 18 bp, Homo sapiens
atttgcatgattatagtt

SEQ ID NO: 6680532 - DNA, 18 bp, Homo sapiens
atttgcatggattttgga

SEQ ID NO: 6680533 - DNA, 16 bp, Homo sapiens
atttgcatgtgtaaat

SEQ ID NO: 6680534 - DNA, 12 bp, Homo sapiens
atttgcatgtta

SEQ ID NO: 6680535 - DNA, 13 bp, Homo sapiens
atttgcatgttat

SEQ ID NO: 6680536 - DNA, 15 bp, Homo sapiens
atttgcatgttatgt

SEQ ID NO: 6680537 - DNA, 22 bp, Homo sapiens
atttgcatgttatgtttaataa

SEQ ID NO: 6680538 - DNA, 13 bp, Homo sapiens
atttgcattgtgt

SEQ ID NO: 6680539 - DNA, 15 bp, Homo sapiens
atttgccaaaaacta

SEQ ID NO: 6680540 - DNA, 18 bp, Homo sapiens
atttgccaaaaattcatg

SEQ ID NO: 6680541 - DNA, 14 bp, Homo sapiens
atttgccaaaataa

SEQ ID NO: 6680542 - DNA, 15 bp, Homo sapiens
atttgccaactaatt

SEQ ID NO: 6680543 - DNA, 21 bp, Homo sapiens
atttgccaagtctcccaatat

SEQ ID NO: 6680544 - DNA, 15 bp, Homo sapiens
atttgccaataataa

SEQ ID NO: 6680545 - DNA, 19 bp, Homo sapiens
atttgccagacagagatca

SEQ ID NO: 6680546 - DNA, 16 bp, Homo sapiens
atttgccagaggacca

SEQ ID NO: 6680547 - DNA, 22 bp, Homo sapiens
atttgccagaggaccaatgctt

SEQ ID NO: 6680548 - DNA, 13 bp, Homo sapiens
atttgccagcaca

SEQ ID NO: 6680549 - DNA, 16 bp, Homo sapiens
atttgccagcacaggg

SEQ ID NO: 6680550 - DNA, 20 bp, Homo sapiens
atttgccaggggcatccaag

SEQ ID NO: 6680551 - DNA, 21 bp, Homo sapiens
atttgccagttttattttcta

SEQ ID NO: 6680552 - DNA, 13 bp, Homo sapiens
atttgccatagag

SEQ ID NO: 6680553 - DNA, 15 bp, Homo sapiens
atttgccatagagta

SEQ ID NO: 6680554 - DNA, 21 bp, Homo sapiens
atttgccatagagtacactgc

SEQ ID NO: 6680555 - DNA, 14 bp, Homo sapiens
atttgccatagcag

SEQ ID NO: 6680556 - DNA, 17 bp, Homo sapiens
atttgccatgacatttc

SEQ ID NO: 6680557 - DNA, 23 bp, Homo sapiens
atttgccatgacatttcatctgg

SEQ ID NO: 6680558 - DNA, 15 bp, Homo sapiens
atttgccatgggctt

SEQ ID NO: 6680559 - DNA, 17 bp, Homo sapiens
atttgccattcctggaa

SEQ ID NO: 6680560 - DNA, 21 bp, Homo sapiens
atttgccatttttattagaaa

SEQ ID NO: 6680561 - DNA, 19 bp, Homo sapiens
atttgcccatttacacttt

SEQ ID NO: 6680562 - DNA, 16 bp, Homo sapiens
atttgcccctggcaaa

SEQ ID NO: 6680563 - DNA, 17 bp, Homo sapiens
atttgccctaagaactt

SEQ ID NO: 6680564 - DNA, 15 bp, Homo sapiens
atttgccctcctcct

SEQ ID NO: 6680565 - DNA, 20 bp, Homo sapiens
atttgcctaattcctggcat

SEQ ID NO: 6680566 - DNA, 11 bp, Homo sapiens
atttgcctcac

SEQ ID NO: 6680567 - DNA, 14 bp, Homo sapiens
atttgcctcacctt

SEQ ID NO: 6680568 - DNA, 12 bp, Homo sapiens
atttgcctgcct

SEQ ID NO: 6680569 - DNA, 23 bp, Homo sapiens
atttgcctgcctgggcctcccaa

SEQ ID NO: 6680570 - DNA, 13 bp, Homo sapiens
atttgcctgcttc

SEQ ID NO: 6680571 - DNA, 13 bp, Homo sapiens
atttgcctgtaac

SEQ ID NO: 6680572 - DNA, 15 bp, Homo sapiens
atttgcctgtgccac

SEQ ID NO: 6680573 - DNA, 21 bp, Homo sapiens
atttgcctgtttctgcttgct

SEQ ID NO: 6680574 - DNA, 16 bp, Homo sapiens
atttgccttctccctg

SEQ ID NO: 6680575 - DNA, 14 bp, Homo sapiens
atttgccttgcaga

SEQ ID NO: 6680576 - DNA, 21 bp, Homo sapiens
atttgccttgcagaactgcca

SEQ ID NO: 6680577 - DNA, 15 bp, Homo sapiens
atttgccttgctgga

SEQ ID NO: 6680578 - DNA, 14 bp, Homo sapiens
atttgcctttaaaa

SEQ ID NO: 6680579 - DNA, 23 bp, Homo sapiens
atttgcctttaaaaaaaaaagtt

SEQ ID NO: 6680580 - DNA, 20 bp, Homo sapiens
atttgcctttctgggagcag

SEQ ID NO: 6680581 - DNA, 20 bp, Homo sapiens
atttgccttttaaattcttt

SEQ ID NO: 6680582 - DNA, 18 bp, Homo sapiens
atttgcgcacaacttaaa

SEQ ID NO: 6680583 - DNA, 23 bp, Homo sapiens
atttgcgcctcggtatctggctt

SEQ ID NO: 6680584 - DNA, 23 bp, Homo sapiens
atttgctaataccaactatttca

SEQ ID NO: 6680585 - DNA, 19 bp, Homo sapiens
atttgctaatgaattttaa

SEQ ID NO: 6680586 - DNA, 13 bp, Homo sapiens
atttgctaatttt

SEQ ID NO: 6680587 - DNA, 19 bp, Homo sapiens
atttgctaatttttattaa

SEQ ID NO: 6680588 - DNA, 23 bp, Homo sapiens
atttgctatattttaatattgtt

SEQ ID NO: 6680589 - DNA, 17 bp, Homo sapiens
atttgctatcaaaataa

SEQ ID NO: 6680590 - DNA, 11 bp, Homo sapiens
atttgctcact

SEQ ID NO: 6680591 - DNA, 14 bp, Homo sapiens
atttgctcctgggt

SEQ ID NO: 6680592 - DNA, 11 bp, Homo sapiens
atttgctctgg

SEQ ID NO: 6680593 - DNA, 21 bp, Homo sapiens
atttgctctgtggtaagagat

SEQ ID NO: 6680594 - DNA, 11 bp, Homo sapiens
atttgctcttt

SEQ ID NO: 6680595 - DNA, 23 bp, Homo sapiens
atttgctctttgacaactaaaat

SEQ ID NO: 6680596 - DNA, 15 bp, Homo sapiens
atttgctgaaaacat

SEQ ID NO: 6680597 - DNA, 16 bp, Homo sapiens
atttgctgaataacaa

SEQ ID NO: 6680598 - DNA, 17 bp, Homo sapiens
atttgctgatttctagt

SEQ ID NO: 6680599 - DNA, 19 bp, Homo sapiens
atttgctgcaaagagaaac

SEQ ID NO: 6680600 - DNA, 10 bp, Homo sapiens
atttgctgcc

SEQ ID NO: 6680601 - DNA, 16 bp, Homo sapiens
atttgctgccccagct

SEQ ID NO: 6680602 - DNA, 14 bp, Homo sapiens
atttgctgccctgg

SEQ ID NO: 6680603 - DNA, 14 bp, Homo sapiens
atttgctgctcttc

SEQ ID NO: 6680604 - DNA, 13 bp, Homo sapiens
atttgctggaaca

SEQ ID NO: 6680605 - DNA, 14 bp, Homo sapiens
atttgctggagaaa

SEQ ID NO: 6680606 - DNA, 19 bp, Homo sapiens
atttgctggagtgctggct

SEQ ID NO: 6680607 - DNA, 21 bp, Homo sapiens
atttgctggagtgctggctcc

SEQ ID NO: 6680608 - DNA, 21 bp, Homo sapiens
atttgctgtgaagggagaaag

SEQ ID NO: 6680609 - DNA, 14 bp, Homo sapiens
atttgctgtgacta

SEQ ID NO: 6680610 - DNA, 23 bp, Homo sapiens
atttgctgttcatcttgtacaaa

SEQ ID NO: 6680611 - DNA, 12 bp, Homo sapiens
atttgcttcatt

SEQ ID NO: 6680612 - DNA, 18 bp, Homo sapiens
atttgcttgtactgggac

SEQ ID NO: 6680613 - DNA, 15 bp, Homo sapiens
atttgctttggaagt

SEQ ID NO: 6680614 - DNA, 12 bp, Homo sapiens
atttgcttttga

SEQ ID NO: 6680615 - DNA, 18 bp, Homo sapiens
atttgcttttgaaaagat

SEQ ID NO: 6680616 - DNA, 18 bp, Homo sapiens
atttgctttttgtgatat

SEQ ID NO: 6680617 - DNA, 12 bp, Homo sapiens
atttggaaaata

SEQ ID NO: 6680618 - DNA, 15 bp, Homo sapiens
atttggaaactaata

SEQ ID NO: 6680619 - DNA, 20 bp, Homo sapiens
atttggaaactaataaaata

SEQ ID NO: 6680620 - DNA, 22 bp, Homo sapiens
atttggaaactaataaaatatt

SEQ ID NO: 6680621 - DNA, 17 bp, Homo sapiens
atttggaaaggaccaaa

SEQ ID NO: 6680622 - DNA, 15 bp, Homo sapiens
atttggaaagtgtgt

SEQ ID NO: 6680623 - DNA, 17 bp, Homo sapiens
atttggaaatctttaaa

SEQ ID NO: 6680624 - DNA, 14 bp, Homo sapiens
atttggaaatttag

SEQ ID NO: 6680625 - DNA, 13 bp, Homo sapiens
atttggaacagtg

SEQ ID NO: 6680626 - DNA, 17 bp, Homo sapiens
atttggaaccaaagtct

SEQ ID NO: 6680627 - DNA, 16 bp, Homo sapiens
atttggaaccttgttt

SEQ ID NO: 6680628 - DNA, 21 bp, Homo sapiens
atttggaagaaaaaaatcttc

SEQ ID NO: 6680629 - DNA, 20 bp, Homo sapiens
atttggaagagaggcacctg

SEQ ID NO: 6680630 - DNA, 19 bp, Homo sapiens
atttggaagcaacgtgtta

SEQ ID NO: 6680631 - DNA, 13 bp, Homo sapiens
atttggaaggaaa

SEQ ID NO: 6680632 - DNA, 12 bp, Homo sapiens
atttggaaggca

SEQ ID NO: 6680633 - DNA, 22 bp, Homo sapiens
atttggaataaaaattccagaa

SEQ ID NO: 6680634 - DNA, 14 bp, Homo sapiens
atttggaatacttt

SEQ ID NO: 6680635 - DNA, 14 bp, Homo sapiens
atttggaatcatat

SEQ ID NO: 6680636 - DNA, 22 bp, Homo sapiens
atttggaatgtacatactgaaa

SEQ ID NO: 6680637 - DNA, 14 bp, Homo sapiens
atttggaattagaa

SEQ ID NO: 6680638 - DNA, 19 bp, Homo sapiens
atttggaattgacattctc

SEQ ID NO: 6680639 - DNA, 17 bp, Homo sapiens
atttggaattttaagtt

SEQ ID NO: 6680640 - DNA, 21 bp, Homo sapiens
atttggacaatctgcaaaatg

SEQ ID NO: 6680641 - DNA, 18 bp, Homo sapiens
atttggaccattttcctg

SEQ ID NO: 6680642 - DNA, 14 bp, Homo sapiens
atttggactgtttt

SEQ ID NO: 6680643 - DNA, 20 bp, Homo sapiens
atttggagaaaacagccact

SEQ ID NO: 6680644 - DNA, 21 bp, Homo sapiens
atttggagacacaactatttt

SEQ ID NO: 6680645 - DNA, 15 bp, Homo sapiens
atttggagagaaata

SEQ ID NO: 6680646 - DNA, 16 bp, Homo sapiens
atttggagagaaatat

SEQ ID NO: 6680647 - DNA, 21 bp, Homo sapiens
atttggagatgtctctgtgtg

SEQ ID NO: 6680648 - DNA, 20 bp, Homo sapiens
atttggagctatcagtgctt

SEQ ID NO: 6680649 - DNA, 21 bp, Homo sapiens
atttggaggaaaaaaagcatg

SEQ ID NO: 6680650 - DNA, 19 bp, Homo sapiens
atttggagggaagctcttg

SEQ ID NO: 6680651 - DNA, 16 bp, Homo sapiens
atttggagggcctggg

SEQ ID NO: 6680652 - DNA, 22 bp, Homo sapiens
atttggagggcctgggcctggc

SEQ ID NO: 6680653 - DNA, 14 bp, Homo sapiens
atttggagtggagg

SEQ ID NO: 6680654 - DNA, 16 bp, Homo sapiens
atttggagtggaggca

SEQ ID NO: 6680655 - DNA, 16 bp, Homo sapiens
atttggagttaggtcc

SEQ ID NO: 6680656 - DNA, 18 bp, Homo sapiens
atttggataataaaaatt

SEQ ID NO: 6680657 - DNA, 20 bp, Homo sapiens
atttggataataaaaattgt

SEQ ID NO: 6680658 - DNA, 22 bp, Homo sapiens
atttggatacactctctagctt

SEQ ID NO: 6680659 - DNA, 16 bp, Homo sapiens
atttggatataaatct

SEQ ID NO: 6680660 - DNA, 17 bp, Homo sapiens
atttggatataaatctt

SEQ ID NO: 6680661 - DNA, 20 bp, Homo sapiens
atttggatctcttcttaatg

SEQ ID NO: 6680662 - DNA, 18 bp, Homo sapiens
atttggatgattgtcata

SEQ ID NO: 6680663 - DNA, 15 bp, Homo sapiens
atttggattcacagc

SEQ ID NO: 6680664 - DNA, 18 bp, Homo sapiens
atttggatttaaaagcct

SEQ ID NO: 6680665 - DNA, 23 bp, Homo sapiens
atttggatttaaaagcctgctca

SEQ ID NO: 6680666 - DNA, 14 bp, Homo sapiens
atttggatttacga

SEQ ID NO: 6680667 - DNA, 21 bp, Homo sapiens
atttggattttaaacaaaatt

SEQ ID NO: 6680668 - DNA, 17 bp, Homo sapiens
atttggcaaaacaaaat

SEQ ID NO: 6680669 - DNA, 20 bp, Homo sapiens
atttggcaaaacaaaatgta

SEQ ID NO: 6680670 - DNA, 21 bp, Homo sapiens
atttggcaaaatgtcttaaca

SEQ ID NO: 6680671 - DNA, 19 bp, Homo sapiens
atttggcaatgccatcatc

SEQ ID NO: 6680672 - DNA, 15 bp, Homo sapiens
atttggcagtttggt

SEQ ID NO: 6680673 - DNA, 18 bp, Homo sapiens
atttggcataactgtgat

SEQ ID NO: 6680674 - DNA, 16 bp, Homo sapiens
atttggcatctcctgt

SEQ ID NO: 6680675 - DNA, 17 bp, Homo sapiens
atttggcatctcctgtc

SEQ ID NO: 6680676 - DNA, 15 bp, Homo sapiens
atttggccacactgg

SEQ ID NO: 6680677 - DNA, 14 bp, Homo sapiens
atttggcccagaga

SEQ ID NO: 6680678 - DNA, 20 bp, Homo sapiens
atttggccgagtcagcacgt

SEQ ID NO: 6680679 - DNA, 16 bp, Homo sapiens
atttggccggctctgg

SEQ ID NO: 6680680 - DNA, 13 bp, Homo sapiens
atttggccttaag

SEQ ID NO: 6680681 - DNA, 21 bp, Homo sapiens
atttggccttaagaactgtgt

SEQ ID NO: 6680682 - DNA, 18 bp, Homo sapiens
atttggctcacttgcctt

SEQ ID NO: 6680683 - DNA, 18 bp, Homo sapiens
atttggctcgctgtggtt

SEQ ID NO: 6680684 - DNA, 16 bp, Homo sapiens
atttggcttcctctgc

SEQ ID NO: 6680685 - DNA, 18 bp, Homo sapiens
atttggcttcctctgctg

SEQ ID NO: 6680686 - DNA, 21 bp, Homo sapiens
atttggcttgttttattttgg

SEQ ID NO: 6680687 - DNA, 16 bp, Homo sapiens
atttggctttcacatt

SEQ ID NO: 6680688 - DNA, 15 bp, Homo sapiens
atttgggaacataaa

SEQ ID NO: 6680689 - DNA, 14 bp, Homo sapiens
atttgggaagtgaa

SEQ ID NO: 6680690 - DNA, 22 bp, Homo sapiens
atttgggaccctgctttagagc

SEQ ID NO: 6680691 - DNA, 20 bp, Homo sapiens
atttgggagaagcaaatata

SEQ ID NO: 6680692 - DNA, 16 bp, Homo sapiens
atttgggagctgaacc

SEQ ID NO: 6680693 - DNA, 17 bp, Homo sapiens
atttgggaggaggaaaa

SEQ ID NO: 6680694 - DNA, 17 bp, Homo sapiens
atttgggagggaaaagg

SEQ ID NO: 6680695 - DNA, 21 bp, Homo sapiens
atttgggcctgctccagacct

SEQ ID NO: 6680696 - DNA, 21 bp, Homo sapiens
atttgggctgaatgtatgtaa

SEQ ID NO: 6680697 - DNA, 22 bp, Homo sapiens
atttggggacagattcagtctt

SEQ ID NO: 6680698 - DNA, 16 bp, Homo sapiens
atttggggcttatttt

SEQ ID NO: 6680699 - DNA, 21 bp, Homo sapiens
atttggggcttgcatgccaaa

SEQ ID NO: 6680700 - DNA, 22 bp, Homo sapiens
atttgggggctcggggaggcag

SEQ ID NO: 6680701 - DNA, 21 bp, Homo sapiens
atttggggtagctagaggaac

SEQ ID NO: 6680702 - DNA, 12 bp, Homo sapiens
atttggggtgga

SEQ ID NO: 6680703 - DNA, 17 bp, Homo sapiens
atttggggttgcatcag

SEQ ID NO: 6680704 - DNA, 21 bp, Homo sapiens
atttggggtttgcttgtaaaa

SEQ ID NO: 6680705 - DNA, 16 bp, Homo sapiens
atttgggtccaggagg

SEQ ID NO: 6680706 - DNA, 16 bp, Homo sapiens
atttgggtggtaagag

SEQ ID NO: 6680707 - DNA, 21 bp, Homo sapiens
atttgggttatgatgtcaaac

SEQ ID NO: 6680708 - DNA, 18 bp, Homo sapiens
atttgggttgcaaagcta

SEQ ID NO: 6680709 - DNA, 20 bp, Homo sapiens
atttgggtttgttggtcaca

SEQ ID NO: 6680710 - DNA, 19 bp, Homo sapiens
atttgggtttttttgttgt

SEQ ID NO: 6680711 - DNA, 19 bp, Homo sapiens
atttggtaaaaatgctgct

SEQ ID NO: 6680712 - DNA, 14 bp, Homo sapiens
atttggtacacatg

SEQ ID NO: 6680713 - DNA, 19 bp, Homo sapiens
atttggtacacatgtgtta

SEQ ID NO: 6680714 - DNA, 12 bp, Homo sapiens
atttggtacttt

SEQ ID NO: 6680715 - DNA, 23 bp, Homo sapiens
atttggtacttttgagtgtgtgt

SEQ ID NO: 6680716 - DNA, 18 bp, Homo sapiens
atttggtaggaagcctga

SEQ ID NO: 6680717 - DNA, 20 bp, Homo sapiens
atttggtatatactttgcca

SEQ ID NO: 6680718 - DNA, 15 bp, Homo sapiens
atttggtatccttat

SEQ ID NO: 6680719 - DNA, 23 bp, Homo sapiens
atttggtcaagattttgaatgct

SEQ ID NO: 6680720 - DNA, 17 bp, Homo sapiens
atttggtcaccttcctc

SEQ ID NO: 6680721 - DNA, 20 bp, Homo sapiens
atttggtccaaaaaaaggaa

SEQ ID NO: 6680722 - DNA, 21 bp, Homo sapiens
atttggtccaaaaaaaggaaa

SEQ ID NO: 6680723 - DNA, 14 bp, Homo sapiens
atttggtcctttct

SEQ ID NO: 6680724 - DNA, 19 bp, Homo sapiens
atttggtctcactacttga

SEQ ID NO: 6680725 - DNA, 14 bp, Homo sapiens
atttggtctcaggc

SEQ ID NO: 6680726 - DNA, 23 bp, Homo sapiens
atttggtctcaggcagcaccaca

SEQ ID NO: 6680727 - DNA, 20 bp, Homo sapiens
atttggtctgccagaatact

SEQ ID NO: 6680728 - DNA, 17 bp, Homo sapiens
atttggtctgcctctga

SEQ ID NO: 6680729 - DNA, 16 bp, Homo sapiens
atttggtcttagcttt

SEQ ID NO: 6680730 - DNA, 14 bp, Homo sapiens
atttggtgaccatc

SEQ ID NO: 6680731 - DNA, 22 bp, Homo sapiens
atttggtgctcacgtgtcctta

SEQ ID NO: 6680732 - DNA, 14 bp, Homo sapiens
atttggtggctcta

SEQ ID NO: 6680733 - DNA, 22 bp, Homo sapiens
atttggtgggagttatatcagt

SEQ ID NO: 6680734 - DNA, 18 bp, Homo sapiens
atttggtgttcctggaag

SEQ ID NO: 6680735 - DNA, 21 bp, Homo sapiens
atttggttaaaggtctcccac

SEQ ID NO: 6680736 - DNA, 14 bp, Homo sapiens
atttggttaaatca

SEQ ID NO: 6680737 - DNA, 15 bp, Homo sapiens
atttggttctaatag

SEQ ID NO: 6680738 - DNA, 21 bp, Homo sapiens
atttggttgcactttagacat

SEQ ID NO: 6680739 - DNA, 23 bp, Homo sapiens
atttggttgcactttagacattt

SEQ ID NO: 6680740 - DNA, 23 bp, Homo sapiens
atttggtttagaatgctgcgctt

SEQ ID NO: 6680741 - DNA, 20 bp, Homo sapiens
atttggtttgttaattctta

SEQ ID NO: 6680742 - DNA, 18 bp, Homo sapiens
atttggttttacacagga

SEQ ID NO: 6680743 - DNA, 17 bp, Homo sapiens
atttggttttcacattg

SEQ ID NO: 6680744 - DNA, 21 bp, Homo sapiens
atttggttttcacattggaaa

SEQ ID NO: 6680745 - DNA, 14 bp, Homo sapiens
atttggtttttact

SEQ ID NO: 6680746 - DNA, 15 bp, Homo sapiens
atttgtaaaaaagat

SEQ ID NO: 6680747 - DNA, 14 bp, Homo sapiens
atttgtaaaaagta

SEQ ID NO: 6680748 - DNA, 15 bp, Homo sapiens
atttgtaaaaagtag

SEQ ID NO: 6680749 - DNA, 19 bp, Homo sapiens
atttgtaaaaataatgaat

SEQ ID NO: 6680750 - DNA, 20 bp, Homo sapiens
atttgtaaaaataatgaatg

SEQ ID NO: 6680751 - DNA, 17 bp, Homo sapiens
atttgtaaaaatactgt

SEQ ID NO: 6680752 - DNA, 22 bp, Homo sapiens
atttgtaaaaatgagacttttt

SEQ ID NO: 6680753 - DNA, 23 bp, Homo sapiens
atttgtaaaaatgagtcatttgt

SEQ ID NO: 6680754 - DNA, 17 bp, Homo sapiens
atttgtaaaacagtggt

SEQ ID NO: 6680755 - DNA, 15 bp, Homo sapiens
atttgtaaaacttct

SEQ ID NO: 6680756 - DNA, 17 bp, Homo sapiens
atttgtaaaacttctgc

SEQ ID NO: 6680757 - DNA, 18 bp, Homo sapiens
atttgtaaaacttctgct

SEQ ID NO: 6680758 - DNA, 18 bp, Homo sapiens
atttgtaaacttctgaag

SEQ ID NO: 6680759 - DNA, 23 bp, Homo sapiens
atttgtaaactttgcttctccaa

SEQ ID NO: 6680760 - DNA, 10 bp, Homo sapiens
atttgtaaag

SEQ ID NO: 6680761 - DNA, 13 bp, Homo sapiens
atttgtaaatctt

SEQ ID NO: 6680762 - DNA, 16 bp, Homo sapiens
atttgtaaatttagtg

SEQ ID NO: 6680763 - DNA, 20 bp, Homo sapiens
atttgtaaatttagtgtttt

SEQ ID NO: 6680764 - DNA, 19 bp, Homo sapiens
atttgtaacattgtaaagt

SEQ ID NO: 6680765 - DNA, 21 bp, Homo sapiens
atttgtaacattgtaaagtat

SEQ ID NO: 6680766 - DNA, 23 bp, Homo sapiens
atttgtaacattgtaaagtatgt

SEQ ID NO: 6680767 - DNA, 16 bp, Homo sapiens
atttgtaacctcagct

SEQ ID NO: 6680768 - DNA, 16 bp, Homo sapiens
atttgtaactttgcag

SEQ ID NO: 6680769 - DNA, 16 bp, Homo sapiens
atttgtaactttgcat

SEQ ID NO: 6680770 - DNA, 18 bp, Homo sapiens
atttgtaactttgcatgt

SEQ ID NO: 6680771 - DNA, 19 bp, Homo sapiens
atttgtaagcaacttgctt

SEQ ID NO: 6680772 - DNA, 22 bp, Homo sapiens
atttgtaagcaacttgcttcta

SEQ ID NO: 6680773 - DNA, 16 bp, Homo sapiens
atttgtaaggcttgtt

SEQ ID NO: 6680774 - DNA, 21 bp, Homo sapiens
atttgtaagtgtaaaaaatgt

SEQ ID NO: 6680775 - DNA, 18 bp, Homo sapiens
atttgtaagttgtgtgca

SEQ ID NO: 6680776 - DNA, 22 bp, Homo sapiens
atttgtaagtttatgtctaaag

SEQ ID NO: 6680777 - DNA, 15 bp, Homo sapiens
atttgtaagtttcag

SEQ ID NO: 6680778 - DNA, 23 bp, Homo sapiens
atttgtaataaaactatttgtat

SEQ ID NO: 6680779 - DNA, 16 bp, Homo sapiens
atttgtaatgagcacc

SEQ ID NO: 6680780 - DNA, 20 bp, Homo sapiens
atttgtaatgtcttgagctc

SEQ ID NO: 6680781 - DNA, 23 bp, Homo sapiens
atttgtaatgtcttgagctctat

SEQ ID NO: 6680782 - DNA, 22 bp, Homo sapiens
atttgtaattaaaagcaaatca

SEQ ID NO: 6680783 - DNA, 19 bp, Homo sapiens
atttgtaattgcttacatt

SEQ ID NO: 6680784 - DNA, 23 bp, Homo sapiens
atttgtaattgcttacattttta

SEQ ID NO: 6680785 - DNA, 13 bp, Homo sapiens
atttgtaatttaa

SEQ ID NO: 6680786 - DNA, 17 bp, Homo sapiens
atttgtaattttagtat

SEQ ID NO: 6680787 - DNA, 16 bp, Homo sapiens
atttgtacaaataaac

SEQ ID NO: 6680788 - DNA, 18 bp, Homo sapiens
atttgtacaaataaacct

SEQ ID NO: 6680789 - DNA, 20 bp, Homo sapiens
atttgtacaaataaacctga

SEQ ID NO: 6680790 - DNA, 22 bp, Homo sapiens
atttgtacaaataaacctgagg

SEQ ID NO: 6680791 - DNA, 16 bp, Homo sapiens
atttgtacaaatactg

SEQ ID NO: 6680792 - DNA, 12 bp, Homo sapiens
atttgtacaagg

SEQ ID NO: 6680793 - DNA, 16 bp, Homo sapiens
atttgtacaattttaa

SEQ ID NO: 6680794 - DNA, 20 bp, Homo sapiens
atttgtacaggactgtaaag

SEQ ID NO: 6680795 - DNA, 18 bp, Homo sapiens
atttgtacagttcagttc

SEQ ID NO: 6680796 - DNA, 18 bp, Homo sapiens
atttgtacatatgtaaaa

SEQ ID NO: 6680797 - DNA, 19 bp, Homo sapiens
atttgtacatatgtaaaat

SEQ ID NO: 6680798 - DNA, 21 bp, Homo sapiens
atttgtacatatgtaaaataa

SEQ ID NO: 6680799 - DNA, 21 bp, Homo sapiens
atttgtacatcttctttggaa

SEQ ID NO: 6680800 - DNA, 20 bp, Homo sapiens
atttgtaccattccttcaaa

SEQ ID NO: 6680801 - DNA, 22 bp, Homo sapiens
atttgtaccattccttcaaata

SEQ ID NO: 6680802 - DNA, 16 bp, Homo sapiens
atttgtaccatttcag

SEQ ID NO: 6680803 - DNA, 20 bp, Homo sapiens
atttgtactatttaactgac

SEQ ID NO: 6680804 - DNA, 13 bp, Homo sapiens
atttgtacttgct

SEQ ID NO: 6680805 - DNA, 14 bp, Homo sapiens
atttgtacttggaa

SEQ ID NO: 6680806 - DNA, 15 bp, Homo sapiens
atttgtacttggaag

SEQ ID NO: 6680807 - DNA, 15 bp, Homo sapiens
atttgtactttctgt

SEQ ID NO: 6680808 - DNA, 19 bp, Homo sapiens
atttgtactttctgttaaa

SEQ ID NO: 6680809 - DNA, 22 bp, Homo sapiens
atttgtactttctgttaaaatg

SEQ ID NO: 6680810 - DNA, 19 bp, Homo sapiens
atttgtacttttttcttaa

SEQ ID NO: 6680811 - DNA, 24 bp, Homo sapiens
atttgtagactcttgctcctgctt

SEQ ID NO: 6680812 - DNA, 15 bp, Homo sapiens
atttgtagacttaag

SEQ ID NO: 6680813 - DNA, 18 bp, Homo sapiens
atttgtagatatatattt

SEQ ID NO: 6680814 - DNA, 13 bp, Homo sapiens
atttgtagattag

SEQ ID NO: 6680815 - DNA, 17 bp, Homo sapiens
atttgtagcataactgt

SEQ ID NO: 6680816 - DNA, 19 bp, Homo sapiens
atttgtagccaaagaaatt

SEQ ID NO: 6680817 - DNA, 18 bp, Homo sapiens
atttgtagctagaatatc

SEQ ID NO: 6680818 - DNA, 16 bp, Homo sapiens
atttgtagggtttcta

SEQ ID NO: 6680819 - DNA, 19 bp, Homo sapiens
atttgtaggtatactatgt

SEQ ID NO: 6680820 - DNA, 22 bp, Homo sapiens
atttgtagtgttggagaagaac

SEQ ID NO: 6680821 - DNA, 15 bp, Homo sapiens
atttgtataaaataa

SEQ ID NO: 6680822 - DNA, 23 bp, Homo sapiens
atttgtataaagcattactcttt

SEQ ID NO: 6680823 - DNA, 21 bp, Homo sapiens
atttgtataacccatatctgt

SEQ ID NO: 6680824 - DNA, 21 bp, Homo sapiens
atttgtataatgggaagcctg

SEQ ID NO: 6680825 - DNA, 16 bp, Homo sapiens
atttgtatagttgctt

SEQ ID NO: 6680826 - DNA, 18 bp, Homo sapiens
atttgtatagttgcttgc

SEQ ID NO: 6680827 - DNA, 12 bp, Homo sapiens
atttgtatatat

SEQ ID NO: 6680828 - DNA, 15 bp, Homo sapiens
atttgtatatataca

SEQ ID NO: 6680829 - DNA, 17 bp, Homo sapiens
atttgtatattaaaata

SEQ ID NO: 6680830 - DNA, 22 bp, Homo sapiens
atttgtatattacacatttgta

SEQ ID NO: 6680831 - DNA, 23 bp, Homo sapiens
atttgtatattgtggatgtgttc

SEQ ID NO: 6680832 - DNA, 17 bp, Homo sapiens
atttgtatcatgtttta

SEQ ID NO: 6680833 - DNA, 14 bp, Homo sapiens
atttgtatgatatt

SEQ ID NO: 6680834 - DNA, 17 bp, Homo sapiens
atttgtatgctaaatga

SEQ ID NO: 6680835 - DNA, 13 bp, Homo sapiens
atttgtattaatg

SEQ ID NO: 6680836 - DNA, 20 bp, Homo sapiens
atttgtattaatttgtaaga

SEQ ID NO: 6680837 - DNA, 14 bp, Homo sapiens
atttgtattactag

SEQ ID NO: 6680838 - DNA, 21 bp, Homo sapiens
atttgtattatgttccaaggc

SEQ ID NO: 6680839 - DNA, 23 bp, Homo sapiens
atttgtattcccttttatttcca

SEQ ID NO: 6680840 - DNA, 24 bp, Homo sapiens
atttgtattcccttttatttccaa

SEQ ID NO: 6680841 - DNA, 13 bp, Homo sapiens
atttgtatttata

SEQ ID NO: 6680842 - DNA, 15 bp, Homo sapiens
atttgtatttatatt

SEQ ID NO: 6680843 - DNA, 21 bp, Homo sapiens
atttgtatttatattagagtg

SEQ ID NO: 6680844 - DNA, 17 bp, Homo sapiens
atttgtatttattcttt

SEQ ID NO: 6680845 - DNA, 20 bp, Homo sapiens
atttgtatttatttccagac

SEQ ID NO: 6680846 - DNA, 17 bp, Homo sapiens
atttgtatttctcttgt

SEQ ID NO: 6680847 - DNA, 16 bp, Homo sapiens
atttgtattttgtgtg

SEQ ID NO: 6680848 - DNA, 23 bp, Homo sapiens
atttgtattttgtgtgaccaact

SEQ ID NO: 6680849 - DNA, 21 bp, Homo sapiens
atttgtcacagaaatcagagg

SEQ ID NO: 6680850 - DNA, 13 bp, Homo sapiens
atttgtcactgga

SEQ ID NO: 6680851 - DNA, 20 bp, Homo sapiens
atttgtcagtatttttgccg

SEQ ID NO: 6680852 - DNA, 23 bp, Homo sapiens
atttgtcatgacagtgcttgcat

SEQ ID NO: 6680853 - DNA, 14 bp, Homo sapiens
atttgtcattttga

SEQ ID NO: 6680854 - DNA, 15 bp, Homo sapiens
atttgtcattttgaa

SEQ ID NO: 6680855 - DNA, 16 bp, Homo sapiens
atttgtcattttgaag

SEQ ID NO: 6680856 - DNA, 21 bp, Homo sapiens
atttgtcattttgaagctaat

SEQ ID NO: 6680857 - DNA, 16 bp, Homo sapiens
atttgtccaaacaggt

SEQ ID NO: 6680858 - DNA, 15 bp, Homo sapiens
atttgtccagataat

SEQ ID NO: 6680859 - DNA, 17 bp, Homo sapiens
atttgtccattgtaaat

SEQ ID NO: 6680860 - DNA, 15 bp, Homo sapiens
atttgtccatttaaa

SEQ ID NO: 6680861 - DNA, 20 bp, Homo sapiens
atttgtccatttaaaaatga

SEQ ID NO: 6680862 - DNA, 13 bp, Homo sapiens
atttgtcccaagt

SEQ ID NO: 6680863 - DNA, 11 bp, Homo sapiens
atttgtcccag

SEQ ID NO: 6680864 - DNA, 20 bp, Homo sapiens
atttgtcccagcctggggct

SEQ ID NO: 6680865 - DNA, 14 bp, Homo sapiens
atttgtcctcatgt

SEQ ID NO: 6680866 - DNA, 12 bp, Homo sapiens
atttgtcctttt

SEQ ID NO: 6680867 - DNA, 18 bp, Homo sapiens
atttgtcgatatttccat

SEQ ID NO: 6680868 - DNA, 18 bp, Homo sapiens
atttgtctacttgctcca

SEQ ID NO: 6680869 - DNA, 16 bp, Homo sapiens
atttgtctcatatatt

SEQ ID NO: 6680870 - DNA, 15 bp, Homo sapiens
atttgtctcattttg

SEQ ID NO: 6680871 - DNA, 18 bp, Homo sapiens
atttgtctcattttgtat

SEQ ID NO: 6680872 - DNA, 16 bp, Homo sapiens
atttgtctctgagccc

SEQ ID NO: 6680873 - DNA, 12 bp, Homo sapiens
atttgtctctta

SEQ ID NO: 6680874 - DNA, 21 bp, Homo sapiens
atttgtctcttacatctcctt

SEQ ID NO: 6680875 - DNA, 14 bp, Homo sapiens
atttgtctgtgtgc

SEQ ID NO: 6680876 - DNA, 17 bp, Homo sapiens
atttgtctgtgtgctac

SEQ ID NO: 6680877 - DNA, 23 bp, Homo sapiens
atttgtctgtgtgctactaacag

SEQ ID NO: 6680878 - DNA, 13 bp, Homo sapiens
atttgtcttaaaa

SEQ ID NO: 6680879 - DNA, 23 bp, Homo sapiens
atttgtcttaaaaaatgtgaaat

SEQ ID NO: 6680880 - DNA, 15 bp, Homo sapiens
atttgtcttcccttc

SEQ ID NO: 6680881 - DNA, 18 bp, Homo sapiens
atttgtcttcccttcttt

SEQ ID NO: 6680882 - DNA, 22 bp, Homo sapiens
atttgtcttcttttcaaaataa

SEQ ID NO: 6680883 - DNA, 15 bp, Homo sapiens
atttgtctttaaaca

SEQ ID NO: 6680884 - DNA, 14 bp, Homo sapiens
atttgtctttgaat

SEQ ID NO: 6680885 - DNA, 15 bp, Homo sapiens
atttgtcttttgtaa

SEQ ID NO: 6680886 - DNA, 23 bp, Homo sapiens
atttgtctttttgttgtaaaaca

SEQ ID NO: 6680887 - DNA, 16 bp, Homo sapiens
atttgtgaaagtgcca

SEQ ID NO: 6680888 - DNA, 20 bp, Homo sapiens
atttgtgaactcagccaagc

SEQ ID NO: 6680889 - DNA, 21 bp, Homo sapiens
atttgtgaactcagccaagca

SEQ ID NO: 6680890 - DNA, 13 bp, Homo sapiens
atttgtgaagaat

SEQ ID NO: 6680891 - DNA, 18 bp, Homo sapiens
atttgtgaaggtggaaat

SEQ ID NO: 6680892 - DNA, 10 bp, Homo sapiens
atttgtgaat

SEQ ID NO: 6680893 - DNA, 14 bp, Homo sapiens
atttgtgaatatat

SEQ ID NO: 6680894 - DNA, 14 bp, Homo sapiens
atttgtgacaaaaa

SEQ ID NO: 6680895 - DNA, 11 bp, Homo sapiens
atttgtgacta

SEQ ID NO: 6680896 - DNA, 16 bp, Homo sapiens
atttgtgactaattgt

SEQ ID NO: 6680897 - DNA, 13 bp, Homo sapiens
atttgtgactttt

SEQ ID NO: 6680898 - DNA, 14 bp, Homo sapiens
atttgtgacttttt

SEQ ID NO: 6680899 - DNA, 14 bp, Homo sapiens
atttgtgagactgt

SEQ ID NO: 6680900 - DNA, 15 bp, Homo sapiens
atttgtgagattcct

SEQ ID NO: 6680901 - DNA, 20 bp, Homo sapiens
atttgtgagccaaagagaaa

SEQ ID NO: 6680902 - DNA, 14 bp, Homo sapiens
atttgtgatacaat

SEQ ID NO: 6680903 - DNA, 15 bp, Homo sapiens
atttgtgatacttcc

SEQ ID NO: 6680904 - DNA, 18 bp, Homo sapiens
atttgtgatcagcattgt

SEQ ID NO: 6680905 - DNA, 23 bp, Homo sapiens
atttgtgatcagcattgtgactt

SEQ ID NO: 6680906 - DNA, 20 bp, Homo sapiens
atttgtgctagaaattttca

SEQ ID NO: 6680907 - DNA, 16 bp, Homo sapiens
atttgtgctttgaaaa

SEQ ID NO: 6680908 - DNA, 22 bp, Homo sapiens
atttgtgctttttaagaatatt

SEQ ID NO: 6680909 - DNA, 24 bp, Homo sapiens
atttgtggcccaagcctggtctcc

SEQ ID NO: 6680910 - DNA, 23 bp, Homo sapiens
atttgtgggaggagtgacatgaa

SEQ ID NO: 6680911 - DNA, 22 bp, Homo sapiens
atttgtggggagggatttgggg

SEQ ID NO: 6680912 - DNA, 21 bp, Homo sapiens
atttgtgggtttttatttcct

SEQ ID NO: 6680913 - DNA, 19 bp, Homo sapiens
atttgtggtaatctacacc

SEQ ID NO: 6680914 - DNA, 17 bp, Homo sapiens
atttgtggttgcatgtc

SEQ ID NO: 6680915 - DNA, 18 bp, Homo sapiens
atttgtggtttaactttg

SEQ ID NO: 6680916 - DNA, 19 bp, Homo sapiens
atttgtggtttaactttgt

SEQ ID NO: 6680917 - DNA, 12 bp, Homo sapiens
atttgtgtaaag

SEQ ID NO: 6680918 - DNA, 21 bp, Homo sapiens
atttgtgtaaatgagtaaaac

SEQ ID NO: 6680919 - DNA, 14 bp, Homo sapiens
atttgtgtaaattt

SEQ ID NO: 6680920 - DNA, 15 bp, Homo sapiens
atttgtgtaaatttg

SEQ ID NO: 6680921 - DNA, 12 bp, Homo sapiens
atttgtgtaact

SEQ ID NO: 6680922 - DNA, 22 bp, Homo sapiens
atttgtgtaaggactttggctt

SEQ ID NO: 6680923 - DNA, 21 bp, Homo sapiens
atttgtgtaataaagtgtttt

SEQ ID NO: 6680924 - DNA, 13 bp, Homo sapiens
atttgtgtaatag

SEQ ID NO: 6680925 - DNA, 18 bp, Homo sapiens
atttgtgtagattgtgta

SEQ ID NO: 6680926 - DNA, 17 bp, Homo sapiens
atttgtgtcacaaagaa

SEQ ID NO: 6680927 - DNA, 18 bp, Homo sapiens
atttgtgtcataccagaa

SEQ ID NO: 6680928 - DNA, 13 bp, Homo sapiens
atttgtgtctctt

SEQ ID NO: 6680929 - DNA, 17 bp, Homo sapiens
atttgtgtctgcctgcc

SEQ ID NO: 6680930 - DNA, 15 bp, Homo sapiens
atttgtgtctgtgtt

SEQ ID NO: 6680931 - DNA, 14 bp, Homo sapiens
atttgtgtgctaaa

SEQ ID NO: 6680932 - DNA, 18 bp, Homo sapiens
atttgtgtggaaatcata

SEQ ID NO: 6680933 - DNA, 15 bp, Homo sapiens
atttgtgtgtgtgca

SEQ ID NO: 6680934 - DNA, 13 bp, Homo sapiens
atttgtgtgttaa

SEQ ID NO: 6680935 - DNA, 18 bp, Homo sapiens
atttgtgtgttcactaaa

SEQ ID NO: 6680936 - DNA, 21 bp, Homo sapiens
atttgtgtgttctaatgagta

SEQ ID NO: 6680937 - DNA, 22 bp, Homo sapiens
atttgtgtgtttttagctgtga

SEQ ID NO: 6680938 - DNA, 18 bp, Homo sapiens
atttgtgttgaagaggtt

SEQ ID NO: 6680939 - DNA, 22 bp, Homo sapiens
atttgttaaaaagactgttatt

SEQ ID NO: 6680940 - DNA, 22 bp, Homo sapiens
atttgttaaaatacagttctgt

SEQ ID NO: 6680941 - DNA, 21 bp, Homo sapiens
atttgttaaaattatcaatat

SEQ ID NO: 6680942 - DNA, 16 bp, Homo sapiens
atttgttaaatattta

SEQ ID NO: 6680943 - DNA, 18 bp, Homo sapiens
atttgttaaatatttaca

SEQ ID NO: 6680944 - DNA, 17 bp, Homo sapiens
atttgttaacagagcaa

SEQ ID NO: 6680945 - DNA, 23 bp, Homo sapiens
atttgttaagaaaaactacagca

SEQ ID NO: 6680946 - DNA, 13 bp, Homo sapiens
atttgttaatata

SEQ ID NO: 6680947 - DNA, 15 bp, Homo sapiens
atttgttaatatttc

SEQ ID NO: 6680948 - DNA, 15 bp, Homo sapiens
atttgttaatgattc

SEQ ID NO: 6680949 - DNA, 22 bp, Homo sapiens
atttgttaatttcttgcaattt

SEQ ID NO: 6680950 - DNA, 22 bp, Homo sapiens
atttgttactttacttttgctg

SEQ ID NO: 6680951 - DNA, 21 bp, Homo sapiens
atttgttagttcctgtatgaa

SEQ ID NO: 6680952 - DNA, 14 bp, Homo sapiens
atttgttatatata

SEQ ID NO: 6680953 - DNA, 18 bp, Homo sapiens
atttgttatatataataa

SEQ ID NO: 6680954 - DNA, 23 bp, Homo sapiens
atttgttatatcagcagacactc

SEQ ID NO: 6680955 - DNA, 15 bp, Homo sapiens
atttgttatggcaga

SEQ ID NO: 6680956 - DNA, 17 bp, Homo sapiens
atttgttattcttaaga

SEQ ID NO: 6680957 - DNA, 18 bp, Homo sapiens
atttgttatttgtacagt

SEQ ID NO: 6680958 - DNA, 17 bp, Homo sapiens
atttgttattttcagta

SEQ ID NO: 6680959 - DNA, 19 bp, Homo sapiens
atttgttcagctcccccag

SEQ ID NO: 6680960 - DNA, 21 bp, Homo sapiens
atttgttcatagaccctctca

SEQ ID NO: 6680961 - DNA, 22 bp, Homo sapiens
atttgttcatagaccctctcaa

SEQ ID NO: 6680962 - DNA, 14 bp, Homo sapiens
atttgttcatgttt

SEQ ID NO: 6680963 - DNA, 15 bp, Homo sapiens
atttgttcattaaac

SEQ ID NO: 6680964 - DNA, 16 bp, Homo sapiens
atttgttcattaaacg

SEQ ID NO: 6680965 - DNA, 22 bp, Homo sapiens
atttgttccacccgacctctga

SEQ ID NO: 6680966 - DNA, 14 bp, Homo sapiens
atttgttcctgctt

SEQ ID NO: 6680967 - DNA, 23 bp, Homo sapiens
atttgttctgggttaacagtaaa

SEQ ID NO: 6680968 - DNA, 17 bp, Homo sapiens
atttgttcttgtattta

SEQ ID NO: 6680969 - DNA, 14 bp, Homo sapiens
atttgttctttgcc

SEQ ID NO: 6680970 - DNA, 17 bp, Homo sapiens
atttgttctttttctga

SEQ ID NO: 6680971 - DNA, 17 bp, Homo sapiens
atttgttgacagcaaaa

SEQ ID NO: 6680972 - DNA, 19 bp, Homo sapiens
atttgttgacagcaaaatg

SEQ ID NO: 6680973 - DNA, 22 bp, Homo sapiens
atttgttgagagtgtgaccaaa

SEQ ID NO: 6680974 - DNA, 16 bp, Homo sapiens
atttgttgattctctc

SEQ ID NO: 6680975 - DNA, 11 bp, Homo sapiens
atttgttgcat

SEQ ID NO: 6680976 - DNA, 16 bp, Homo sapiens
atttgttgctgctgct

SEQ ID NO: 6680977 - DNA, 13 bp, Homo sapiens
atttgttggaatg

SEQ ID NO: 6680978 - DNA, 15 bp, Homo sapiens
atttgttggaatgaa

SEQ ID NO: 6680979 - DNA, 23 bp, Homo sapiens
atttgttggtaactaatgttatt

SEQ ID NO: 6680980 - DNA, 12 bp, Homo sapiens
atttgttgtact

SEQ ID NO: 6680981 - DNA, 21 bp, Homo sapiens
atttgttgtgactggcaccca

SEQ ID NO: 6680982 - DNA, 15 bp, Homo sapiens
atttgtttaaaattc

SEQ ID NO: 6680983 - DNA, 16 bp, Homo sapiens
atttgtttaaaattct

SEQ ID NO: 6680984 - DNA, 14 bp, Homo sapiens
atttgtttaaacaa

SEQ ID NO: 6680985 - DNA, 19 bp, Homo sapiens
atttgtttaaagaataaag

SEQ ID NO: 6680986 - DNA, 14 bp, Homo sapiens
atttgtttaaagta

SEQ ID NO: 6680987 - DNA, 17 bp, Homo sapiens
atttgtttaaggttaat

SEQ ID NO: 6680988 - DNA, 16 bp, Homo sapiens
atttgtttacatgcag

SEQ ID NO: 6680989 - DNA, 20 bp, Homo sapiens
atttgtttatggtaaaaaat

SEQ ID NO: 6680990 - DNA, 17 bp, Homo sapiens
atttgtttatttgcaat

SEQ ID NO: 6680991 - DNA, 17 bp, Homo sapiens
atttgtttcatctattt

SEQ ID NO: 6680992 - DNA, 16 bp, Homo sapiens
atttgtttccagcatg

SEQ ID NO: 6680993 - DNA, 21 bp, Homo sapiens
atttgtttcccccacagtttt

SEQ ID NO: 6680994 - DNA, 23 bp, Homo sapiens
atttgtttccttttggcctcctg

SEQ ID NO: 6680995 - DNA, 20 bp, Homo sapiens
atttgtttctttctctgagg

SEQ ID NO: 6680996 - DNA, 18 bp, Homo sapiens
atttgtttgctgaaattt

SEQ ID NO: 6680997 - DNA, 23 bp, Homo sapiens
atttgtttggttatagtgcaata

SEQ ID NO: 6680998 - DNA, 22 bp, Homo sapiens
atttgtttgtagctttcctgga

SEQ ID NO: 6680999 - DNA, 12 bp, Homo sapiens
atttgtttgtat

SEQ ID NO: 6681000 - DNA, 18 bp, Homo sapiens
atttgtttgtgcttctaa

SEQ ID NO: 6681001 - DNA, 22 bp, Homo sapiens
atttgtttgtttgttttattca

SEQ ID NO: 6681002 - DNA, 17 bp, Homo sapiens
atttgtttgttttcctt

SEQ ID NO: 6681003 - DNA, 18 bp, Homo sapiens
atttgttttagaatgatg

SEQ ID NO: 6681004 - DNA, 13 bp, Homo sapiens
atttgttttagca

SEQ ID NO: 6681005 - DNA, 16 bp, Homo sapiens
atttgttttagcatta

SEQ ID NO: 6681006 - DNA, 15 bp, Homo sapiens
atttgttttcacact

SEQ ID NO: 6681007 - DNA, 19 bp, Homo sapiens
atttgttttcatttgtata

SEQ ID NO: 6681008 - DNA, 13 bp, Homo sapiens
atttgttttcccg

SEQ ID NO: 6681009 - DNA, 18 bp, Homo sapiens
atttgttttgaattttgt

SEQ ID NO: 6681010 - DNA, 18 bp, Homo sapiens
atttgttttgacggatga

SEQ ID NO: 6681011 - DNA, 16 bp, Homo sapiens
atttgttttgcttttg

SEQ ID NO: 6681012 - DNA, 21 bp, Homo sapiens
atttgttttgtgttgtttgaa

SEQ ID NO: 6681013 - DNA, 17 bp, Homo sapiens
atttgttttgtgtttca

SEQ ID NO: 6681014 - DNA, 15 bp, Homo sapiens
atttgttttgtttac

SEQ ID NO: 6681015 - DNA, 16 bp, Homo sapiens
atttgttttgtttaca

SEQ ID NO: 6681016 - DNA, 17 bp, Homo sapiens
atttgtttttaaactgt

SEQ ID NO: 6681017 - DNA, 21 bp, Homo sapiens
atttgtttttaaactgtacag

SEQ ID NO: 6681018 - DNA, 14 bp, Homo sapiens
atttgtttttctct

SEQ ID NO: 6681019 - DNA, 18 bp, Homo sapiens
attttaaaaaacactgat

SEQ ID NO: 6681020 - DNA, 20 bp, Homo sapiens
attttaaaaaagatggattt

SEQ ID NO: 6681021 - DNA, 18 bp, Homo sapiens
attttaaaaaagccttcc

SEQ ID NO: 6681022 - DNA, 12 bp, Homo sapiens
attttaaaaaat

SEQ ID NO: 6681023 - DNA, 16 bp, Homo sapiens
attttaaaaaataaca

SEQ ID NO: 6681024 - DNA, 17 bp, Homo sapiens
attttaaaaaatatata

SEQ ID NO: 6681025 - DNA, 15 bp, Homo sapiens
attttaaaaaatcaa

SEQ ID NO: 6681026 - DNA, 19 bp, Homo sapiens
attttaaaaaatgaaaata

SEQ ID NO: 6681027 - DNA, 17 bp, Homo sapiens
attttaaaaaatggtca

SEQ ID NO: 6681028 - DNA, 16 bp, Homo sapiens
attttaaaaacataga

SEQ ID NO: 6681029 - DNA, 15 bp, Homo sapiens
attttaaaaacatga

SEQ ID NO: 6681030 - DNA, 14 bp, Homo sapiens
attttaaaaacttt

SEQ ID NO: 6681031 - DNA, 15 bp, Homo sapiens
attttaaaaacttta

SEQ ID NO: 6681032 - DNA, 17 bp, Homo sapiens
attttaaaaaggaattt

SEQ ID NO: 6681033 - DNA, 14 bp, Homo sapiens
attttaaaaagggt

SEQ ID NO: 6681034 - DNA, 15 bp, Homo sapiens
attttaaaaagggta

SEQ ID NO: 6681035 - DNA, 21 bp, Homo sapiens
attttaaaaagggtaacttgt

SEQ ID NO: 6681036 - DNA, 12 bp, Homo sapiens
attttaaaaata

SEQ ID NO: 6681037 - DNA, 14 bp, Homo sapiens
attttaaaaataca

SEQ ID NO: 6681038 - DNA, 15 bp, Homo sapiens
attttaaaaatacat

SEQ ID NO: 6681039 - DNA, 17 bp, Homo sapiens
attttaaaaatacatat

SEQ ID NO: 6681040 - DNA, 18 bp, Homo sapiens
attttaaaaatacatttt

SEQ ID NO: 6681041 - DNA, 19 bp, Homo sapiens
attttaaaaatacattttt

SEQ ID NO: 6681042 - DNA, 15 bp, Homo sapiens
attttaaaaatctac

SEQ ID NO: 6681043 - DNA, 14 bp, Homo sapiens
attttaaaaatgaa

SEQ ID NO: 6681044 - DNA, 15 bp, Homo sapiens
attttaaaaatggtg

SEQ ID NO: 6681045 - DNA, 23 bp, Homo sapiens
attttaaaaatgtaaatgaattt

SEQ ID NO: 6681046 - DNA, 23 bp, Homo sapiens
attttaaaaatgttaaaatgtat

SEQ ID NO: 6681047 - DNA, 13 bp, Homo sapiens
attttaaaacatg

SEQ ID NO: 6681048 - DNA, 14 bp, Homo sapiens
attttaaaaccatg

SEQ ID NO: 6681049 - DNA, 17 bp, Homo sapiens
attttaaaaccatgcag

SEQ ID NO: 6681050 - DNA, 23 bp, Homo sapiens
attttaaaaccatgcagcttcat

SEQ ID NO: 6681051 - DNA, 17 bp, Homo sapiens
attttaaaagaatgatt

SEQ ID NO: 6681052 - DNA, 23 bp, Homo sapiens
attttaaaagaatgattatgaat

SEQ ID NO: 6681053 - DNA, 15 bp, Homo sapiens
attttaaaagtctat

SEQ ID NO: 6681054 - DNA, 19 bp, Homo sapiens
attttaaaagtctatttta

SEQ ID NO: 6681055 - DNA, 19 bp, Homo sapiens
attttaaaataaattagtt

SEQ ID NO: 6681056 - DNA, 17 bp, Homo sapiens
attttaaaatatatgaa

SEQ ID NO: 6681057 - DNA, 14 bp, Homo sapiens
attttaaaatattt

SEQ ID NO: 6681058 - DNA, 18 bp, Homo sapiens
attttaaaatatttaaac

SEQ ID NO: 6681059 - DNA, 14 bp, Homo sapiens
attttaaaatctga

SEQ ID NO: 6681060 - DNA, 21 bp, Homo sapiens
attttaaaatgaaatgcattt

SEQ ID NO: 6681061 - DNA, 15 bp, Homo sapiens
attttaaaatgaata

SEQ ID NO: 6681062 - DNA, 14 bp, Homo sapiens
attttaaaatgcaa

SEQ ID NO: 6681063 - DNA, 24 bp, Homo sapiens
attttaaaatgcaaatattgctat

SEQ ID NO: 6681064 - DNA, 19 bp, Homo sapiens
attttaaaatgtagaagaa

SEQ ID NO: 6681065 - DNA, 14 bp, Homo sapiens
attttaaaatttca

SEQ ID NO: 6681066 - DNA, 15 bp, Homo sapiens
attttaaaattttgc

SEQ ID NO: 6681067 - DNA, 20 bp, Homo sapiens
attttaaacaaaatttatgt

SEQ ID NO: 6681068 - DNA, 23 bp, Homo sapiens
attttaaacacattaggaaaagt

SEQ ID NO: 6681069 - DNA, 15 bp, Homo sapiens
attttaaacagagga

SEQ ID NO: 6681070 - DNA, 21 bp, Homo sapiens
attttaaacatatccaagttt

SEQ ID NO: 6681071 - DNA, 21 bp, Homo sapiens
attttaaacgcttcttatgta

SEQ ID NO: 6681072 - DNA, 16 bp, Homo sapiens
attttaaactagatga

SEQ ID NO: 6681073 - DNA, 20 bp, Homo sapiens
attttaaactagatgacctc

SEQ ID NO: 6681074 - DNA, 21 bp, Homo sapiens
attttaaactagatgacctca

SEQ ID NO: 6681075 - DNA, 12 bp, Homo sapiens
attttaaagaat

SEQ ID NO: 6681076 - DNA, 12 bp, Homo sapiens
attttaaagaca

SEQ ID NO: 6681077 - DNA, 22 bp, Homo sapiens
attttaaagagtgtgttataaa

SEQ ID NO: 6681078 - DNA, 18 bp, Homo sapiens
attttaaagccattctga

SEQ ID NO: 6681079 - DNA, 17 bp, Homo sapiens
attttaaagcctgaaaa

SEQ ID NO: 6681080 - DNA, 23 bp, Homo sapiens
attttaaagcctgaaaattccaa

SEQ ID NO: 6681081 - DNA, 17 bp, Homo sapiens
attttaaagtatgcatt

SEQ ID NO: 6681082 - DNA, 19 bp, Homo sapiens
attttaaagtatgcattat

SEQ ID NO: 6681083 - DNA, 13 bp, Homo sapiens
attttaaagttag

SEQ ID NO: 6681084 - DNA, 18 bp, Homo sapiens
attttaaagttagtatct

SEQ ID NO: 6681085 - DNA, 21 bp, Homo sapiens
attttaaagttagtatctttt

SEQ ID NO: 6681086 - DNA, 14 bp, Homo sapiens
attttaaataaaat

SEQ ID NO: 6681087 - DNA, 23 bp, Homo sapiens
attttaaataacctctggccctt

SEQ ID NO: 6681088 - DNA, 13 bp, Homo sapiens
attttaaataaga

SEQ ID NO: 6681089 - DNA, 14 bp, Homo sapiens
attttaaataagat

SEQ ID NO: 6681090 - DNA, 23 bp, Homo sapiens
attttaaataagatggagaataa

SEQ ID NO: 6681091 - DNA, 15 bp, Homo sapiens
attttaaataatgta

SEQ ID NO: 6681092 - DNA, 17 bp, Homo sapiens
attttaaataatgtatt

SEQ ID NO: 6681093 - DNA, 20 bp, Homo sapiens
attttaaatatccatttatc

SEQ ID NO: 6681094 - DNA, 21 bp, Homo sapiens
attttaaatctaaatctattt

SEQ ID NO: 6681095 - DNA, 12 bp, Homo sapiens
attttaaatgaa

SEQ ID NO: 6681096 - DNA, 23 bp, Homo sapiens
attttaaatgcacagttctattt

SEQ ID NO: 6681097 - DNA, 17 bp, Homo sapiens
attttaaatgctgtatg

SEQ ID NO: 6681098 - DNA, 15 bp, Homo sapiens
attttaaatgtctat

SEQ ID NO: 6681099 - DNA, 18 bp, Homo sapiens
attttaaatgtgtgagtg

SEQ ID NO: 6681100 - DNA, 14 bp, Homo sapiens
attttaaatgtttt

SEQ ID NO: 6681101 - DNA, 13 bp, Homo sapiens
attttaaattata

SEQ ID NO: 6681102 - DNA, 19 bp, Homo sapiens
attttaaattataaggact

SEQ ID NO: 6681103 - DNA, 21 bp, Homo sapiens
attttaaattataaggactgc

SEQ ID NO: 6681104 - DNA, 12 bp, Homo sapiens
attttaaatttc

SEQ ID NO: 6681105 - DNA, 18 bp, Homo sapiens
attttaaattttatgtca

SEQ ID NO: 6681106 - DNA, 19 bp, Homo sapiens
attttaacaaaagaagatt

SEQ ID NO: 6681107 - DNA, 17 bp, Homo sapiens
attttaacaacagctgg

SEQ ID NO: 6681108 - DNA, 17 bp, Homo sapiens
attttaacaactgctct

SEQ ID NO: 6681109 - DNA, 19 bp, Homo sapiens
attttaacaagaagatgaa

SEQ ID NO: 6681110 - DNA, 22 bp, Homo sapiens
attttaacaataactactgtgt

SEQ ID NO: 6681111 - DNA, 18 bp, Homo sapiens
attttaacacacataaag

SEQ ID NO: 6681112 - DNA, 21 bp, Homo sapiens
attttaacacacataaaggat

SEQ ID NO: 6681113 - DNA, 15 bp, Homo sapiens
attttaacactttgt

SEQ ID NO: 6681114 - DNA, 17 bp, Homo sapiens
attttaacactttgtat

SEQ ID NO: 6681115 - DNA, 18 bp, Homo sapiens
attttaacactttgtatt

SEQ ID NO: 6681116 - DNA, 18 bp, Homo sapiens
attttaacagacatgtat

SEQ ID NO: 6681117 - DNA, 19 bp, Homo sapiens
attttaacagacatgtata

SEQ ID NO: 6681118 - DNA, 14 bp, Homo sapiens
attttaacagtttt

SEQ ID NO: 6681119 - DNA, 16 bp, Homo sapiens
attttaacatgatttc

SEQ ID NO: 6681120 - DNA, 13 bp, Homo sapiens
attttaacatttt

SEQ ID NO: 6681121 - DNA, 16 bp, Homo sapiens
attttaacgctgccta

SEQ ID NO: 6681122 - DNA, 18 bp, Homo sapiens
attttaactaaattttaa

SEQ ID NO: 6681123 - DNA, 14 bp, Homo sapiens
attttaactctgtc

SEQ ID NO: 6681124 - DNA, 22 bp, Homo sapiens
attttaactgatttaacacttt

SEQ ID NO: 6681125 - DNA, 15 bp, Homo sapiens
attttaactggcatg

SEQ ID NO: 6681126 - DNA, 16 bp, Homo sapiens
attttaacttaaattt

SEQ ID NO: 6681127 - DNA, 18 bp, Homo sapiens
attttaacttaactgaaa

SEQ ID NO: 6681128 - DNA, 19 bp, Homo sapiens
attttaacttaactgaaat

SEQ ID NO: 6681129 - DNA, 15 bp, Homo sapiens
attttaactttatca

SEQ ID NO: 6681130 - DNA, 19 bp, Homo sapiens
attttaactttatcacatt

SEQ ID NO: 6681131 - DNA, 13 bp, Homo sapiens
attttaagaaaga

SEQ ID NO: 6681132 - DNA, 18 bp, Homo sapiens
attttaagaagaaagatt

SEQ ID NO: 6681133 - DNA, 17 bp, Homo sapiens
attttaagacgtgaatg

SEQ ID NO: 6681134 - DNA, 15 bp, Homo sapiens
attttaagattcctt

SEQ ID NO: 6681135 - DNA, 16 bp, Homo sapiens
attttaagattccttt

SEQ ID NO: 6681136 - DNA, 21 bp, Homo sapiens
attttaagcattactcttgta

SEQ ID NO: 6681137 - DNA, 20 bp, Homo sapiens
attttaagcattcttagact

SEQ ID NO: 6681138 - DNA, 20 bp, Homo sapiens
attttaagccctatcactga

SEQ ID NO: 6681139 - DNA, 18 bp, Homo sapiens
attttaagccttcatttg

SEQ ID NO: 6681140 - DNA, 22 bp, Homo sapiens
attttaagcctttgttgaactg

SEQ ID NO: 6681141 - DNA, 19 bp, Homo sapiens
attttaagctaggaaaaga

SEQ ID NO: 6681142 - DNA, 14 bp, Homo sapiens
attttaagcttgaa

SEQ ID NO: 6681143 - DNA, 16 bp, Homo sapiens
attttaaggatatgat

SEQ ID NO: 6681144 - DNA, 16 bp, Homo sapiens
attttaagggggaaaa

SEQ ID NO: 6681145 - DNA, 21 bp, Homo sapiens
attttaagggtaatattttct

SEQ ID NO: 6681146 - DNA, 15 bp, Homo sapiens
attttaaggttctca

SEQ ID NO: 6681147 - DNA, 20 bp, Homo sapiens
attttaaggttgcacacagt

SEQ ID NO: 6681148 - DNA, 20 bp, Homo sapiens
attttaagtaacgtgctcac

SEQ ID NO: 6681149 - DNA, 19 bp, Homo sapiens
attttaagtccctgtcacc

SEQ ID NO: 6681150 - DNA, 16 bp, Homo sapiens
attttaagtctacaaa

SEQ ID NO: 6681151 - DNA, 17 bp, Homo sapiens
attttaagtgctttgta

SEQ ID NO: 6681152 - DNA, 16 bp, Homo sapiens
attttaagtgtttaaa

SEQ ID NO: 6681153 - DNA, 21 bp, Homo sapiens
attttaagtgtttaaaagcaa

SEQ ID NO: 6681154 - DNA, 20 bp, Homo sapiens
attttaagtttgtagtaaaa

SEQ ID NO: 6681155 - DNA, 15 bp, Homo sapiens
attttaataaaaata

SEQ ID NO: 6681156 - DNA, 15 bp, Homo sapiens
attttaataaacact

SEQ ID NO: 6681157 - DNA, 17 bp, Homo sapiens
attttaataaacactct

SEQ ID NO: 6681158 - DNA, 21 bp, Homo sapiens
attttaataacatatctaaag

SEQ ID NO: 6681159 - DNA, 16 bp, Homo sapiens
attttaataatgtttc

SEQ ID NO: 6681160 - DNA, 21 bp, Homo sapiens
attttaatacaggacttttaa

SEQ ID NO: 6681161 - DNA, 13 bp, Homo sapiens
attttaatatata

SEQ ID NO: 6681162 - DNA, 17 bp, Homo sapiens
attttaatattaacttt

SEQ ID NO: 6681163 - DNA, 13 bp, Homo sapiens
attttaatattta

SEQ ID NO: 6681164 - DNA, 17 bp, Homo sapiens
attttaatatttatgtt

SEQ ID NO: 6681165 - DNA, 22 bp, Homo sapiens
attttaatcccctgcactaggc

SEQ ID NO: 6681166 - DNA, 13 bp, Homo sapiens
attttaatcctgt

SEQ ID NO: 6681167 - DNA, 17 bp, Homo sapiens
attttaatcctgtacca

SEQ ID NO: 6681168 - DNA, 21 bp, Homo sapiens
attttaatcctgtaccaaatc

SEQ ID NO: 6681169 - DNA, 22 bp, Homo sapiens
attttaatcctgtaccaaatct

SEQ ID NO: 6681170 - DNA, 21 bp, Homo sapiens
attttaatccttctaactaaa

SEQ ID NO: 6681171 - DNA, 19 bp, Homo sapiens
attttaatgaatattgatg

SEQ ID NO: 6681172 - DNA, 14 bp, Homo sapiens
attttaatgatatt

SEQ ID NO: 6681173 - DNA, 16 bp, Homo sapiens
attttaatgatattgg

SEQ ID NO: 6681174 - DNA, 18 bp, Homo sapiens
attttaatgatattggag

SEQ ID NO: 6681175 - DNA, 18 bp, Homo sapiens
attttaatgctgtttcta

SEQ ID NO: 6681176 - DNA, 19 bp, Homo sapiens
attttaatgctgtttctaa

SEQ ID NO: 6681177 - DNA, 19 bp, Homo sapiens
attttaatggattgttaat

SEQ ID NO: 6681178 - DNA, 15 bp, Homo sapiens
attttaatgtaaaat

SEQ ID NO: 6681179 - DNA, 16 bp, Homo sapiens
attttaatgtaattga

SEQ ID NO: 6681180 - DNA, 22 bp, Homo sapiens
attttaatgtactaatatttct

SEQ ID NO: 6681181 - DNA, 15 bp, Homo sapiens
attttaatgtatttt

SEQ ID NO: 6681182 - DNA, 12 bp, Homo sapiens
attttaatgtga

SEQ ID NO: 6681183 - DNA, 20 bp, Homo sapiens
attttaattactgctataaa

SEQ ID NO: 6681184 - DNA, 15 bp, Homo sapiens
attttaattaggtta

SEQ ID NO: 6681185 - DNA, 18 bp, Homo sapiens
attttaattaggttaact

SEQ ID NO: 6681186 - DNA, 20 bp, Homo sapiens
attttaattaggttaactat

SEQ ID NO: 6681187 - DNA, 18 bp, Homo sapiens
attttaattatcttttct

SEQ ID NO: 6681188 - DNA, 23 bp, Homo sapiens
attttaattattattcttcataa

SEQ ID NO: 6681189 - DNA, 18 bp, Homo sapiens
attttaattcaagaaatg

SEQ ID NO: 6681190 - DNA, 20 bp, Homo sapiens
attttaattcaagaaatgac

SEQ ID NO: 6681191 - DNA, 15 bp, Homo sapiens
attttaattcagttg

SEQ ID NO: 6681192 - DNA, 13 bp, Homo sapiens
attttaattctct

SEQ ID NO: 6681193 - DNA, 20 bp, Homo sapiens
attttaatttagtaaatgtt

SEQ ID NO: 6681194 - DNA, 18 bp, Homo sapiens
attttaatttatgagttt

SEQ ID NO: 6681195 - DNA, 14 bp, Homo sapiens
attttaatttcagg

SEQ ID NO: 6681196 - DNA, 15 bp, Homo sapiens
attttaatttctaca

SEQ ID NO: 6681197 - DNA, 13 bp, Homo sapiens
attttaatttctg

SEQ ID NO: 6681198 - DNA, 19 bp, Homo sapiens
attttaatttgatacaaaa

SEQ ID NO: 6681199 - DNA, 17 bp, Homo sapiens
attttaattttaaagag

SEQ ID NO: 6681200 - DNA, 18 bp, Homo sapiens
attttaattttaaccaaa

SEQ ID NO: 6681201 - DNA, 14 bp, Homo sapiens
attttaattttgtt

SEQ ID NO: 6681202 - DNA, 19 bp, Homo sapiens
attttaatttttgctttta

SEQ ID NO: 6681203 - DNA, 22 bp, Homo sapiens
attttacaaaagaggagcactt

SEQ ID NO: 6681204 - DNA, 16 bp, Homo sapiens
attttacaaaagatgt

SEQ ID NO: 6681205 - DNA, 15 bp, Homo sapiens
attttacaaatatta

SEQ ID NO: 6681206 - DNA, 21 bp, Homo sapiens
attttacaaatattaagaaaa

SEQ ID NO: 6681207 - DNA, 21 bp, Homo sapiens
attttacaagtataacagttt

SEQ ID NO: 6681208 - DNA, 12 bp, Homo sapiens
attttacaattt

SEQ ID NO: 6681209 - DNA, 15 bp, Homo sapiens
attttacacagaaac

SEQ ID NO: 6681210 - DNA, 19 bp, Homo sapiens
attttacacagaaacactg

SEQ ID NO: 6681211 - DNA, 13 bp, Homo sapiens
attttacacatta

SEQ ID NO: 6681212 - DNA, 19 bp, Homo sapiens
attttacacattagatttt

SEQ ID NO: 6681213 - DNA, 20 bp, Homo sapiens
attttacagaaacgtgttaa

SEQ ID NO: 6681214 - DNA, 18 bp, Homo sapiens
attttacagagaatctga

SEQ ID NO: 6681215 - DNA, 23 bp, Homo sapiens
attttacagctcattaaactttt

SEQ ID NO: 6681216 - DNA, 12 bp, Homo sapiens
attttacagtaa

SEQ ID NO: 6681217 - DNA, 18 bp, Homo sapiens
attttacagtaaatgtta

SEQ ID NO: 6681218 - DNA, 18 bp, Homo sapiens
attttacagtatcttcaa

SEQ ID NO: 6681219 - DNA, 19 bp, Homo sapiens
attttacagtatcttcaaa

SEQ ID NO: 6681220 - DNA, 15 bp, Homo sapiens
attttacataacgga

SEQ ID NO: 6681221 - DNA, 13 bp, Homo sapiens
attttacatgaag

SEQ ID NO: 6681222 - DNA, 14 bp, Homo sapiens
attttacatgaagt

SEQ ID NO: 6681223 - DNA, 19 bp, Homo sapiens
attttacatgaagtatttt

SEQ ID NO: 6681224 - DNA, 12 bp, Homo sapiens
attttacatgac

SEQ ID NO: 6681225 - DNA, 14 bp, Homo sapiens
attttacatttatc

SEQ ID NO: 6681226 - DNA, 12 bp, Homo sapiens
attttaccaaag

SEQ ID NO: 6681227 - DNA, 13 bp, Homo sapiens
attttaccaaagc

SEQ ID NO: 6681228 - DNA, 15 bp, Homo sapiens
attttaccaaagcat

SEQ ID NO: 6681229 - DNA, 18 bp, Homo sapiens
attttaccaaagcatcaa

SEQ ID NO: 6681230 - DNA, 22 bp, Homo sapiens
attttaccaaagcatcaataca

SEQ ID NO: 6681231 - DNA, 21 bp, Homo sapiens
attttaccaagagtaacttta

SEQ ID NO: 6681232 - DNA, 17 bp, Homo sapiens
attttaccaagttatat

SEQ ID NO: 6681233 - DNA, 20 bp, Homo sapiens
attttaccaagttatataaa

SEQ ID NO: 6681234 - DNA, 22 bp, Homo sapiens
attttaccaagttatataaaga

SEQ ID NO: 6681235 - DNA, 17 bp, Homo sapiens
attttaccactgctgtg

SEQ ID NO: 6681236 - DNA, 23 bp, Homo sapiens
attttaccatatggaatagggat

SEQ ID NO: 6681237 - DNA, 17 bp, Homo sapiens
attttacctattctgaa

SEQ ID NO: 6681238 - DNA, 22 bp, Homo sapiens
attttacctattctgaaaaaga

SEQ ID NO: 6681239 - DNA, 16 bp, Homo sapiens
attttacgttttagaa

SEQ ID NO: 6681240 - DNA, 17 bp, Homo sapiens
attttacgttttagaaa

SEQ ID NO: 6681241 - DNA, 16 bp, Homo sapiens
attttactaaaatcgt

SEQ ID NO: 6681242 - DNA, 18 bp, Homo sapiens
attttactactgtggaaa

SEQ ID NO: 6681243 - DNA, 22 bp, Homo sapiens
attttactacttgttacctttc

SEQ ID NO: 6681244 - DNA, 13 bp, Homo sapiens
attttactagaaa

SEQ ID NO: 6681245 - DNA, 19 bp, Homo sapiens
attttactcagaatagctg

SEQ ID NO: 6681246 - DNA, 19 bp, Homo sapiens
attttactgacagaaatgc

SEQ ID NO: 6681247 - DNA, 18 bp, Homo sapiens
attttactgattaacaaa

SEQ ID NO: 6681248 - DNA, 20 bp, Homo sapiens
attttactgtacagacagaa

SEQ ID NO: 6681249 - DNA, 22 bp, Homo sapiens
attttactgtacagacagaaaa

SEQ ID NO: 6681250 - DNA, 15 bp, Homo sapiens
attttactgtctatg

SEQ ID NO: 6681251 - DNA, 13 bp, Homo sapiens
attttactgtctt

SEQ ID NO: 6681252 - DNA, 20 bp, Homo sapiens
attttactgtcttaattaag

SEQ ID NO: 6681253 - DNA, 23 bp, Homo sapiens
attttactgtcttaattaagtaa

SEQ ID NO: 6681254 - DNA, 18 bp, Homo sapiens
attttacttctagagata

SEQ ID NO: 6681255 - DNA, 16 bp, Homo sapiens
attttacttggaaata

SEQ ID NO: 6681256 - DNA, 23 bp, Homo sapiens
attttacttggaaatattaaaag

SEQ ID NO: 6681257 - DNA, 15 bp, Homo sapiens
attttactttaacag

SEQ ID NO: 6681258 - DNA, 15 bp, Homo sapiens
attttactttgtgca

SEQ ID NO: 6681259 - DNA, 17 bp, Homo sapiens
attttactttttcctgg

SEQ ID NO: 6681260 - DNA, 14 bp, Homo sapiens
attttagaaagaaa

SEQ ID NO: 6681261 - DNA, 16 bp, Homo sapiens
attttagaaagaaaat

SEQ ID NO: 6681262 - DNA, 20 bp, Homo sapiens
attttagaaagaaaattata

SEQ ID NO: 6681263 - DNA, 22 bp, Homo sapiens
attttagaaagaaaattatatt

SEQ ID NO: 6681264 - DNA, 16 bp, Homo sapiens
attttagaaagctaaa

SEQ ID NO: 6681265 - DNA, 21 bp, Homo sapiens
attttagaaataataaaaaga

SEQ ID NO: 6681266 - DNA, 17 bp, Homo sapiens
attttagaaattataat

SEQ ID NO: 6681267 - DNA, 19 bp, Homo sapiens
attttagaagactctacca

SEQ ID NO: 6681268 - DNA, 13 bp, Homo sapiens
attttagaagagg

SEQ ID NO: 6681269 - DNA, 22 bp, Homo sapiens
attttagaataccccaccagca

SEQ ID NO: 6681270 - DNA, 16 bp, Homo sapiens
attttagaattaaaat

SEQ ID NO: 6681271 - DNA, 20 bp, Homo sapiens
attttagacaaatctaaggg

SEQ ID NO: 6681272 - DNA, 15 bp, Homo sapiens
attttagatatattc

SEQ ID NO: 6681273 - DNA, 18 bp, Homo sapiens
attttagatatattctct

SEQ ID NO: 6681274 - DNA, 22 bp, Homo sapiens
attttagatgtagatatttgaa

SEQ ID NO: 6681275 - DNA, 15 bp, Homo sapiens
attttagatgttatt

SEQ ID NO: 6681276 - DNA, 20 bp, Homo sapiens
attttagatgttattatgct

SEQ ID NO: 6681277 - DNA, 21 bp, Homo sapiens
attttagatgttattatgcta

SEQ ID NO: 6681278 - DNA, 14 bp, Homo sapiens
attttagatgttta

SEQ ID NO: 6681279 - DNA, 18 bp, Homo sapiens
attttagattaagctttt

SEQ ID NO: 6681280 - DNA, 21 bp, Homo sapiens
attttagattaagcttttcat

SEQ ID NO: 6681281 - DNA, 15 bp, Homo sapiens
attttagcaaatcag

SEQ ID NO: 6681282 - DNA, 19 bp, Homo sapiens
attttagcaaatcagtata

SEQ ID NO: 6681283 - DNA, 19 bp, Homo sapiens
attttagcagttctgcaaa

SEQ ID NO: 6681284 - DNA, 20 bp, Homo sapiens
attttagcagttctgcaaat

SEQ ID NO: 6681285 - DNA, 18 bp, Homo sapiens
attttagccttaaatttt

SEQ ID NO: 6681286 - DNA, 17 bp, Homo sapiens
attttagccttctctgt

SEQ ID NO: 6681287 - DNA, 15 bp, Homo sapiens
attttagctaattta

SEQ ID NO: 6681288 - DNA, 18 bp, Homo sapiens
attttagctactatatat

SEQ ID NO: 6681289 - DNA, 18 bp, Homo sapiens
attttagctcatgtatat

SEQ ID NO: 6681290 - DNA, 16 bp, Homo sapiens
attttagcttcagttg

SEQ ID NO: 6681291 - DNA, 13 bp, Homo sapiens
attttaggaaagg

SEQ ID NO: 6681292 - DNA, 16 bp, Homo sapiens
attttaggaaatgaat

SEQ ID NO: 6681293 - DNA, 14 bp, Homo sapiens
attttaggaaattt

SEQ ID NO: 6681294 - DNA, 18 bp, Homo sapiens
attttaggaacttcagag

SEQ ID NO: 6681295 - DNA, 19 bp, Homo sapiens
attttaggaacttcagaga

SEQ ID NO: 6681296 - DNA, 16 bp, Homo sapiens
attttaggagacagtc

SEQ ID NO: 6681297 - DNA, 18 bp, Homo sapiens
attttaggagctaaggct

SEQ ID NO: 6681298 - DNA, 20 bp, Homo sapiens
attttaggagctaaggctct

SEQ ID NO: 6681299 - DNA, 22 bp, Homo sapiens
attttaggagctaaggctctat

SEQ ID NO: 6681300 - DNA, 15 bp, Homo sapiens
attttaggcaagttt

SEQ ID NO: 6681301 - DNA, 17 bp, Homo sapiens
attttaggcagggattt

SEQ ID NO: 6681302 - DNA, 16 bp, Homo sapiens
attttagggctgtaga

SEQ ID NO: 6681303 - DNA, 18 bp, Homo sapiens
attttagggctgtagact

SEQ ID NO: 6681304 - DNA, 22 bp, Homo sapiens
attttagggttctaaatgcaat

SEQ ID NO: 6681305 - DNA, 14 bp, Homo sapiens
attttaggtcccag

SEQ ID NO: 6681306 - DNA, 16 bp, Homo sapiens
attttaggtgctgtta

SEQ ID NO: 6681307 - DNA, 21 bp, Homo sapiens
attttaggtgctgttatgttt

SEQ ID NO: 6681308 - DNA, 12 bp, Homo sapiens
attttagtatac

SEQ ID NO: 6681309 - DNA, 17 bp, Homo sapiens
attttagtattaactct

SEQ ID NO: 6681310 - DNA, 18 bp, Homo sapiens
attttagtattaactctg

SEQ ID NO: 6681311 - DNA, 14 bp, Homo sapiens
attttagtattcat

SEQ ID NO: 6681312 - DNA, 16 bp, Homo sapiens
attttagtattcattc

SEQ ID NO: 6681313 - DNA, 19 bp, Homo sapiens
attttagtattcattctgc

SEQ ID NO: 6681314 - DNA, 23 bp, Homo sapiens
attttagtcacacgtggtctttc

SEQ ID NO: 6681315 - DNA, 18 bp, Homo sapiens
attttagtcactaagact

SEQ ID NO: 6681316 - DNA, 20 bp, Homo sapiens
attttagtcactaagacttt

SEQ ID NO: 6681317 - DNA, 17 bp, Homo sapiens
attttagtctgtcatcc

SEQ ID NO: 6681318 - DNA, 15 bp, Homo sapiens
attttagtgactgta

SEQ ID NO: 6681319 - DNA, 23 bp, Homo sapiens
attttagtggaccctgaaatgtg

SEQ ID NO: 6681320 - DNA, 18 bp, Homo sapiens
attttagtgtatctttaa

SEQ ID NO: 6681321 - DNA, 18 bp, Homo sapiens
attttagtgtattaatca

SEQ ID NO: 6681322 - DNA, 20 bp, Homo sapiens
attttagtgtattaatcata

SEQ ID NO: 6681323 - DNA, 16 bp, Homo sapiens
attttagtgtgtaaaa

SEQ ID NO: 6681324 - DNA, 18 bp, Homo sapiens
attttagttacagctgtg

SEQ ID NO: 6681325 - DNA, 18 bp, Homo sapiens
attttagttccttctata

SEQ ID NO: 6681326 - DNA, 14 bp, Homo sapiens
attttagtttctgt

SEQ ID NO: 6681327 - DNA, 16 bp, Homo sapiens
attttagtttctgttc

SEQ ID NO: 6681328 - DNA, 23 bp, Homo sapiens
attttagtttctgttctgtggaa

SEQ ID NO: 6681329 - DNA, 14 bp, Homo sapiens
attttagttttatt

SEQ ID NO: 6681330 - DNA, 20 bp, Homo sapiens
attttagttttattttctaa

SEQ ID NO: 6681331 - DNA, 22 bp, Homo sapiens
attttagttttgtattatcaat

SEQ ID NO: 6681332 - DNA, 19 bp, Homo sapiens
attttagtttttcattaaa

SEQ ID NO: 6681333 - DNA, 14 bp, Homo sapiens
attttataaaacat

SEQ ID NO: 6681334 - DNA, 18 bp, Homo sapiens
attttataaaattaaaga

SEQ ID NO: 6681335 - DNA, 20 bp, Homo sapiens
attttataaaattaaagaaa

SEQ ID NO: 6681336 - DNA, 12 bp, Homo sapiens
attttataaagt

SEQ ID NO: 6681337 - DNA, 15 bp, Homo sapiens
attttataaatcgct

SEQ ID NO: 6681338 - DNA, 17 bp, Homo sapiens
attttataaatcgcttt

SEQ ID NO: 6681339 - DNA, 21 bp, Homo sapiens
attttataaatcgcttttgat

SEQ ID NO: 6681340 - DNA, 23 bp, Homo sapiens
attttataaatcgcttttgataa

SEQ ID NO: 6681341 - DNA, 15 bp, Homo sapiens
attttataagaaaaa

SEQ ID NO: 6681342 - DNA, 19 bp, Homo sapiens
attttataagcacagacaa

SEQ ID NO: 6681343 - DNA, 20 bp, Homo sapiens
attttataagcacagacaat

SEQ ID NO: 6681344 - DNA, 23 bp, Homo sapiens
attttataagcacagacaattct

SEQ ID NO: 6681345 - DNA, 15 bp, Homo sapiens
attttataagggcac

SEQ ID NO: 6681346 - DNA, 13 bp, Homo sapiens
attttataatcag

SEQ ID NO: 6681347 - DNA, 15 bp, Homo sapiens
attttataattggtg

SEQ ID NO: 6681348 - DNA, 21 bp, Homo sapiens
attttataattggtgctattt

SEQ ID NO: 6681349 - DNA, 19 bp, Homo sapiens
attttatacaagaagggag

SEQ ID NO: 6681350 - DNA, 12 bp, Homo sapiens
attttatacata

SEQ ID NO: 6681351 - DNA, 14 bp, Homo sapiens
attttataccaaag

SEQ ID NO: 6681352 - DNA, 15 bp, Homo sapiens
attttatactgcact

SEQ ID NO: 6681353 - DNA, 22 bp, Homo sapiens
attttatactgcactttagtgt

SEQ ID NO: 6681354 - DNA, 23 bp, Homo sapiens
attttatactgcactttagtgta

SEQ ID NO: 6681355 - DNA, 19 bp, Homo sapiens
attttatagctactaattt

SEQ ID NO: 6681356 - DNA, 18 bp, Homo sapiens
attttatagctcagttta

SEQ ID NO: 6681357 - DNA, 19 bp, Homo sapiens
attttataggggatacttg

SEQ ID NO: 6681358 - DNA, 18 bp, Homo sapiens
attttatagtgtgttgtg

SEQ ID NO: 6681359 - DNA, 18 bp, Homo sapiens
attttatataaaatccat

SEQ ID NO: 6681360 - DNA, 16 bp, Homo sapiens
attttatataaagaaa

SEQ ID NO: 6681361 - DNA, 18 bp, Homo sapiens
attttatataaagaaaat

SEQ ID NO: 6681362 - DNA, 15 bp, Homo sapiens
attttatataaagta

SEQ ID NO: 6681363 - DNA, 14 bp, Homo sapiens
attttatatacaat

SEQ ID NO: 6681364 - DNA, 18 bp, Homo sapiens
attttatatatagagaaa

SEQ ID NO: 6681365 - DNA, 21 bp, Homo sapiens
attttatatcaatttaaaaaa

SEQ ID NO: 6681366 - DNA, 15 bp, Homo sapiens
attttatatgtcaaa

SEQ ID NO: 6681367 - DNA, 16 bp, Homo sapiens
attttatatgtcaaag

SEQ ID NO: 6681368 - DNA, 19 bp, Homo sapiens
attttatatgttcatattg

SEQ ID NO: 6681369 - DNA, 19 bp, Homo sapiens
attttatattagaagtgtt

SEQ ID NO: 6681370 - DNA, 15 bp, Homo sapiens
attttatattgaaaa

SEQ ID NO: 6681371 - DNA, 16 bp, Homo sapiens
attttatattgaaaaa

SEQ ID NO: 6681372 - DNA, 22 bp, Homo sapiens
attttatattgaaaaaaataat

SEQ ID NO: 6681373 - DNA, 17 bp, Homo sapiens
attttatatttgagttg

SEQ ID NO: 6681374 - DNA, 15 bp, Homo sapiens
attttatatttttgt

SEQ ID NO: 6681375 - DNA, 20 bp, Homo sapiens
attttatatttttgtacata

SEQ ID NO: 6681376 - DNA, 14 bp, Homo sapiens
attttatcagacaa

SEQ ID NO: 6681377 - DNA, 20 bp, Homo sapiens
attttatcattaaaaattac

SEQ ID NO: 6681378 - DNA, 22 bp, Homo sapiens
attttatccctttctcttctga

SEQ ID NO: 6681379 - DNA, 12 bp, Homo sapiens
attttatcctgt

SEQ ID NO: 6681380 - DNA, 16 bp, Homo sapiens
attttatcctgtattc

SEQ ID NO: 6681381 - DNA, 20 bp, Homo sapiens
attttatctacccagtcatg

SEQ ID NO: 6681382 - DNA, 19 bp, Homo sapiens
attttatctttcgcacagc

SEQ ID NO: 6681383 - DNA, 20 bp, Homo sapiens
attttatctttgattctcct

SEQ ID NO: 6681384 - DNA, 23 bp, Homo sapiens
attttatctttgattctccttca

SEQ ID NO: 6681385 - DNA, 21 bp, Homo sapiens
attttatgaaaggtttacatt

SEQ ID NO: 6681386 - DNA, 17 bp, Homo sapiens
attttatgaacattgta

SEQ ID NO: 6681387 - DNA, 21 bp, Homo sapiens
attttatgaacattgtactgt

SEQ ID NO: 6681388 - DNA, 22 bp, Homo sapiens
attttatgaacattgtactgtt

SEQ ID NO: 6681389 - DNA, 17 bp, Homo sapiens
attttatgaatatcatt

SEQ ID NO: 6681390 - DNA, 16 bp, Homo sapiens
attttatgagaaatgt

SEQ ID NO: 6681391 - DNA, 19 bp, Homo sapiens
attttatgagagtttggaa

SEQ ID NO: 6681392 - DNA, 20 bp, Homo sapiens
attttatgatacttgaattt

SEQ ID NO: 6681393 - DNA, 14 bp, Homo sapiens
attttatgatccag

SEQ ID NO: 6681394 - DNA, 19 bp, Homo sapiens
attttatgatcttttcagt

SEQ ID NO: 6681395 - DNA, 17 bp, Homo sapiens
attttatgatttaaaaa

SEQ ID NO: 6681396 - DNA, 20 bp, Homo sapiens
attttatgatttaaaaaata

SEQ ID NO: 6681397 - DNA, 12 bp, Homo sapiens
attttatgcttt

SEQ ID NO: 6681398 - DNA, 17 bp, Homo sapiens
attttatgctttaaaca

SEQ ID NO: 6681399 - DNA, 21 bp, Homo sapiens
attttatggcacctatttctt

SEQ ID NO: 6681400 - DNA, 18 bp, Homo sapiens
attttatggtactaatga

SEQ ID NO: 6681401 - DNA, 16 bp, Homo sapiens
attttatggtgcatta

SEQ ID NO: 6681402 - DNA, 15 bp, Homo sapiens
attttatggtggaaa

SEQ ID NO: 6681403 - DNA, 16 bp, Homo sapiens
attttatggttatgtt

SEQ ID NO: 6681404 - DNA, 18 bp, Homo sapiens
attttatggttttataac

SEQ ID NO: 6681405 - DNA, 19 bp, Homo sapiens
attttatggttttataact

SEQ ID NO: 6681406 - DNA, 12 bp, Homo sapiens
attttatgtatg

SEQ ID NO: 6681407 - DNA, 15 bp, Homo sapiens
attttatgtctgtaa

SEQ ID NO: 6681408 - DNA, 21 bp, Homo sapiens
attttatgtctttcttgtaag

SEQ ID NO: 6681409 - DNA, 17 bp, Homo sapiens
attttatgtgactgctt

SEQ ID NO: 6681410 - DNA, 12 bp, Homo sapiens
attttatgtgct

SEQ ID NO: 6681411 - DNA, 13 bp, Homo sapiens
attttatgtgctt

SEQ ID NO: 6681412 - DNA, 13 bp, Homo sapiens
attttatgttata

SEQ ID NO: 6681413 - DNA, 15 bp, Homo sapiens
attttatgttatata

SEQ ID NO: 6681414 - DNA, 20 bp, Homo sapiens
attttatgttatttatagct

SEQ ID NO: 6681415 - DNA, 14 bp, Homo sapiens
attttatgttgaca

SEQ ID NO: 6681416 - DNA, 15 bp, Homo sapiens
attttatgttgacat

SEQ ID NO: 6681417 - DNA, 22 bp, Homo sapiens
attttatgttgacatttgtttg

SEQ ID NO: 6681418 - DNA, 18 bp, Homo sapiens
attttatgttgcatagaa

SEQ ID NO: 6681419 - DNA, 12 bp, Homo sapiens
attttatgttta

SEQ ID NO: 6681420 - DNA, 17 bp, Homo sapiens
attttatgtttaaaatg

SEQ ID NO: 6681421 - DNA, 15 bp, Homo sapiens
attttattaaacaca

SEQ ID NO: 6681422 - DNA, 15 bp, Homo sapiens
attttattaaatgca

SEQ ID NO: 6681423 - DNA, 22 bp, Homo sapiens
attttattaagctttttggaat

SEQ ID NO: 6681424 - DNA, 15 bp, Homo sapiens
attttattaataata

SEQ ID NO: 6681425 - DNA, 19 bp, Homo sapiens
attttattacagaaatgtt

SEQ ID NO: 6681426 - DNA, 22 bp, Homo sapiens
attttattaccttgttcctgta

SEQ ID NO: 6681427 - DNA, 19 bp, Homo sapiens
attttattactgtaataca

SEQ ID NO: 6681428 - DNA, 18 bp, Homo sapiens
attttattactgtttatt

SEQ ID NO: 6681429 - DNA, 13 bp, Homo sapiens
attttattagaca

SEQ ID NO: 6681430 - DNA, 12 bp, Homo sapiens
attttattatga

SEQ ID NO: 6681431 - DNA, 14 bp, Homo sapiens
attttattatgaag

SEQ ID NO: 6681432 - DNA, 15 bp, Homo sapiens
attttattatgaaga

SEQ ID NO: 6681433 - DNA, 16 bp, Homo sapiens
attttattatgagctt

SEQ ID NO: 6681434 - DNA, 14 bp, Homo sapiens
attttattatgcat

SEQ ID NO: 6681435 - DNA, 15 bp, Homo sapiens
attttattatgcatg

SEQ ID NO: 6681436 - DNA, 17 bp, Homo sapiens
attttattatgcatgaa

SEQ ID NO: 6681437 - DNA, 15 bp, Homo sapiens
attttattatgtaaa

SEQ ID NO: 6681438 - DNA, 17 bp, Homo sapiens
attttattatgtaaatc

SEQ ID NO: 6681439 - DNA, 18 bp, Homo sapiens
attttattatgtaaatcc

SEQ ID NO: 6681440 - DNA, 20 bp, Homo sapiens
attttattatgtaaatccca

SEQ ID NO: 6681441 - DNA, 21 bp, Homo sapiens
attttattatgtaaatcccat

SEQ ID NO: 6681442 - DNA, 14 bp, Homo sapiens
attttattcaaggt

SEQ ID NO: 6681443 - DNA, 16 bp, Homo sapiens
attttattcacatatg

SEQ ID NO: 6681444 - DNA, 19 bp, Homo sapiens
attttattctatgtatgtt

SEQ ID NO: 6681445 - DNA, 11 bp, Homo sapiens
attttattctt

SEQ ID NO: 6681446 - DNA, 17 bp, Homo sapiens
attttattcttatttca

SEQ ID NO: 6681447 - DNA, 21 bp, Homo sapiens
attttattgaatactgtctgt

SEQ ID NO: 6681448 - DNA, 14 bp, Homo sapiens
attttattgactgg

SEQ ID NO: 6681449 - DNA, 23 bp, Homo sapiens
attttattgactgggcaacactg

SEQ ID NO: 6681450 - DNA, 14 bp, Homo sapiens
attttattgtaaca

SEQ ID NO: 6681451 - DNA, 15 bp, Homo sapiens
attttattgtaacag

SEQ ID NO: 6681452 - DNA, 18 bp, Homo sapiens
attttattgtcagaattt

SEQ ID NO: 6681453 - DNA, 17 bp, Homo sapiens
attttatttaaactatt

SEQ ID NO: 6681454 - DNA, 19 bp, Homo sapiens
attttatttaaactattca

SEQ ID NO: 6681455 - DNA, 15 bp, Homo sapiens
attttatttacagct

SEQ ID NO: 6681456 - DNA, 23 bp, Homo sapiens
attttatttacagctgtgctcca

SEQ ID NO: 6681457 - DNA, 17 bp, Homo sapiens
attttatttagacaaga

SEQ ID NO: 6681458 - DNA, 16 bp, Homo sapiens
attttatttagttctt

SEQ ID NO: 6681459 - DNA, 14 bp, Homo sapiens
attttatttatagt

SEQ ID NO: 6681460 - DNA, 15 bp, Homo sapiens
attttatttatcttt

SEQ ID NO: 6681461 - DNA, 17 bp, Homo sapiens
attttatttatttaatt

SEQ ID NO: 6681462 - DNA, 14 bp, Homo sapiens
attttatttcaatg

SEQ ID NO: 6681463 - DNA, 18 bp, Homo sapiens
attttatttcaatgtaat

SEQ ID NO: 6681464 - DNA, 13 bp, Homo sapiens
attttatttccat

SEQ ID NO: 6681465 - DNA, 16 bp, Homo sapiens
attttatttctctcag

SEQ ID NO: 6681466 - DNA, 15 bp, Homo sapiens
attttatttctgatg

SEQ ID NO: 6681467 - DNA, 23 bp, Homo sapiens
attttatttctttttgattttta

SEQ ID NO: 6681468 - DNA, 14 bp, Homo sapiens
attttatttgaaaa

SEQ ID NO: 6681469 - DNA, 14 bp, Homo sapiens
attttatttgctta

SEQ ID NO: 6681470 - DNA, 22 bp, Homo sapiens
attttatttgtaattttaaaag

SEQ ID NO: 6681471 - DNA, 22 bp, Homo sapiens
attttatttgtaggggaactca

SEQ ID NO: 6681472 - DNA, 13 bp, Homo sapiens
attttatttgtat

SEQ ID NO: 6681473 - DNA, 15 bp, Homo sapiens
attttattttaaatt

SEQ ID NO: 6681474 - DNA, 15 bp, Homo sapiens
attttattttagcag

SEQ ID NO: 6681475 - DNA, 15 bp, Homo sapiens
attttattttcaagc

SEQ ID NO: 6681476 - DNA, 21 bp, Homo sapiens
attttattttgacagaagcta

SEQ ID NO: 6681477 - DNA, 15 bp, Homo sapiens
attttatttttagaa

SEQ ID NO: 6681478 - DNA, 18 bp, Homo sapiens
attttatttttagaattt

SEQ ID NO: 6681479 - DNA, 15 bp, Homo sapiens
attttatttttatta

SEQ ID NO: 6681480 - DNA, 17 bp, Homo sapiens
attttatttttgcaaaa

SEQ ID NO: 6681481 - DNA, 19 bp, Homo sapiens
attttattttttttcaaaa

SEQ ID NO: 6681482 - DNA, 18 bp, Homo sapiens
attttattttttttctgt

SEQ ID NO: 6681483 - DNA, 19 bp, Homo sapiens
attttcaaaagaaaaccca

SEQ ID NO: 6681484 - DNA, 22 bp, Homo sapiens
attttcaaaagcattaattttt

SEQ ID NO: 6681485 - DNA, 11 bp, Homo sapiens
attttcaaact

SEQ ID NO: 6681486 - DNA, 13 bp, Homo sapiens
attttcaaagact

SEQ ID NO: 6681487 - DNA, 19 bp, Homo sapiens
attttcaaagattgttggc

SEQ ID NO: 6681488 - DNA, 14 bp, Homo sapiens
attttcaaatatgt

SEQ ID NO: 6681489 - DNA, 17 bp, Homo sapiens
attttcaaatatgtaaa

SEQ ID NO: 6681490 - DNA, 18 bp, Homo sapiens
attttcaaatatgtaaac

SEQ ID NO: 6681491 - DNA, 20 bp, Homo sapiens
attttcaaatatgtaaactt

SEQ ID NO: 6681492 - DNA, 22 bp, Homo sapiens
attttcaaatccttattgttca

SEQ ID NO: 6681493 - DNA, 13 bp, Homo sapiens
attttcaacaatt

SEQ ID NO: 6681494 - DNA, 17 bp, Homo sapiens
attttcaagaaactgag

SEQ ID NO: 6681495 - DNA, 24 bp, Homo sapiens
attttcaagaataatcacgctttc

SEQ ID NO: 6681496 - DNA, 21 bp, Homo sapiens
attttcaagatacatttcatc

SEQ ID NO: 6681497 - DNA, 18 bp, Homo sapiens
attttcaagattctaaag

SEQ ID NO: 6681498 - DNA, 23 bp, Homo sapiens
attttcaagattctaaagctcaa

SEQ ID NO: 6681499 - DNA, 15 bp, Homo sapiens
attttcaagcaaata

SEQ ID NO: 6681500 - DNA, 20 bp, Homo sapiens
attttcaagcagcatcttct

SEQ ID NO: 6681501 - DNA, 15 bp, Homo sapiens
attttcaagctttca

SEQ ID NO: 6681502 - DNA, 14 bp, Homo sapiens
attttcaagctttt

SEQ ID NO: 6681503 - DNA, 17 bp, Homo sapiens
attttcaaggccctcag

SEQ ID NO: 6681504 - DNA, 20 bp, Homo sapiens
attttcaaggccctcagcat

SEQ ID NO: 6681505 - DNA, 13 bp, Homo sapiens
attttcaaggcct

SEQ ID NO: 6681506 - DNA, 16 bp, Homo sapiens
attttcaaggccttca

SEQ ID NO: 6681507 - DNA, 19 bp, Homo sapiens
attttcaagtaattgtgaa

SEQ ID NO: 6681508 - DNA, 15 bp, Homo sapiens
attttcaagttattc

SEQ ID NO: 6681509 - DNA, 19 bp, Homo sapiens
attttcaagttattcagaa

SEQ ID NO: 6681510 - DNA, 13 bp, Homo sapiens
attttcaagttta

SEQ ID NO: 6681511 - DNA, 15 bp, Homo sapiens
attttcaagtttaca

SEQ ID NO: 6681512 - DNA, 15 bp, Homo sapiens
attttcaagtttttc

SEQ ID NO: 6681513 - DNA, 22 bp, Homo sapiens
attttcaagtttttcatactgt

SEQ ID NO: 6681514 - DNA, 17 bp, Homo sapiens
attttcaataaagaaaa

SEQ ID NO: 6681515 - DNA, 19 bp, Homo sapiens
attttcaataatagactta

SEQ ID NO: 6681516 - DNA, 17 bp, Homo sapiens
attttcaatgcacatta

SEQ ID NO: 6681517 - DNA, 15 bp, Homo sapiens
attttcaattatact

SEQ ID NO: 6681518 - DNA, 16 bp, Homo sapiens
attttcaattatactg

SEQ ID NO: 6681519 - DNA, 14 bp, Homo sapiens
attttcacaaaatg

SEQ ID NO: 6681520 - DNA, 17 bp, Homo sapiens
attttcacaaaatgtct

SEQ ID NO: 6681521 - DNA, 22 bp, Homo sapiens
attttcacaaaatgtctcagtt

SEQ ID NO: 6681522 - DNA, 23 bp, Homo sapiens
attttcacaaaatgtctcagttt

SEQ ID NO: 6681523 - DNA, 20 bp, Homo sapiens
attttcacaattattaaatt

SEQ ID NO: 6681524 - DNA, 21 bp, Homo sapiens
attttcacactggtaaatgtt

SEQ ID NO: 6681525 - DNA, 18 bp, Homo sapiens
attttcacagaggaagaa

SEQ ID NO: 6681526 - DNA, 20 bp, Homo sapiens
attttcacaggtttgtttct

SEQ ID NO: 6681527 - DNA, 15 bp, Homo sapiens
attttcacattcttg

SEQ ID NO: 6681528 - DNA, 19 bp, Homo sapiens
attttcacattcttggctt

SEQ ID NO: 6681529 - DNA, 18 bp, Homo sapiens
attttcactggaagattt

SEQ ID NO: 6681530 - DNA, 16 bp, Homo sapiens
attttcacttgcttaa

SEQ ID NO: 6681531 - DNA, 16 bp, Homo sapiens
attttcactttttctg

SEQ ID NO: 6681532 - DNA, 14 bp, Homo sapiens
attttcagaaaata

SEQ ID NO: 6681533 - DNA, 21 bp, Homo sapiens
attttcagaagttaacatcaa

SEQ ID NO: 6681534 - DNA, 22 bp, Homo sapiens
attttcagaattaatgcattca

SEQ ID NO: 6681535 - DNA, 16 bp, Homo sapiens
attttcagatccttcc

SEQ ID NO: 6681536 - DNA, 19 bp, Homo sapiens
attttcagatttgcacaaa

SEQ ID NO: 6681537 - DNA, 19 bp, Homo sapiens
attttcagcatcaaacatg

SEQ ID NO: 6681538 - DNA, 21 bp, Homo sapiens
attttcagcatcaaacatgaa

SEQ ID NO: 6681539 - DNA, 22 bp, Homo sapiens
attttcagcatcaaacatgaaa

SEQ ID NO: 6681540 - DNA, 19 bp, Homo sapiens
attttcagcattaagctgt

SEQ ID NO: 6681541 - DNA, 19 bp, Homo sapiens
attttcaggtttcttaaaa

SEQ ID NO: 6681542 - DNA, 22 bp, Homo sapiens
attttcagtaatgttattttct

SEQ ID NO: 6681543 - DNA, 20 bp, Homo sapiens
attttcagtaccaaagaaac

SEQ ID NO: 6681544 - DNA, 21 bp, Homo sapiens
attttcagtagggctacaaaa

SEQ ID NO: 6681545 - DNA, 18 bp, Homo sapiens
attttcagtatactgtgt

SEQ ID NO: 6681546 - DNA, 14 bp, Homo sapiens
attttcagtatttt

SEQ ID NO: 6681547 - DNA, 12 bp, Homo sapiens
attttcagtccc

SEQ ID NO: 6681548 - DNA, 20 bp, Homo sapiens
attttcagtcccctctctct

SEQ ID NO: 6681549 - DNA, 19 bp, Homo sapiens
attttcagtcgttgtgctt

SEQ ID NO: 6681550 - DNA, 12 bp, Homo sapiens
attttcagtgat

SEQ ID NO: 6681551 - DNA, 15 bp, Homo sapiens
attttcagtgatctt

SEQ ID NO: 6681552 - DNA, 22 bp, Homo sapiens
attttcagttattatatttaca

SEQ ID NO: 6681553 - DNA, 18 bp, Homo sapiens
attttcagttctatttaa

SEQ ID NO: 6681554 - DNA, 22 bp, Homo sapiens
attttcataacttattgctgat

SEQ ID NO: 6681555 - DNA, 21 bp, Homo sapiens
attttcataagtatttcaaat

SEQ ID NO: 6681556 - DNA, 16 bp, Homo sapiens
attttcataattcatt

SEQ ID NO: 6681557 - DNA, 11 bp, Homo sapiens
attttcatagt

SEQ ID NO: 6681558 - DNA, 13 bp, Homo sapiens
attttcatagtga

SEQ ID NO: 6681559 - DNA, 18 bp, Homo sapiens
attttcatatgcttcaaa

SEQ ID NO: 6681560 - DNA, 17 bp, Homo sapiens
attttcatatttaaagc

SEQ ID NO: 6681561 - DNA, 19 bp, Homo sapiens
attttcatatttaaagcca

SEQ ID NO: 6681562 - DNA, 13 bp, Homo sapiens
attttcatctatt

SEQ ID NO: 6681563 - DNA, 19 bp, Homo sapiens
attttcatgacttttccat

SEQ ID NO: 6681564 - DNA, 13 bp, Homo sapiens
attttcatgattc

SEQ ID NO: 6681565 - DNA, 16 bp, Homo sapiens
attttcatgcacagta

SEQ ID NO: 6681566 - DNA, 19 bp, Homo sapiens
attttcatgcacagtagat

SEQ ID NO: 6681567 - DNA, 19 bp, Homo sapiens
attttcattaaaaatgaaa

SEQ ID NO: 6681568 - DNA, 19 bp, Homo sapiens
attttcattaaaaggaaaa

SEQ ID NO: 6681569 - DNA, 21 bp, Homo sapiens
attttcattaaaaggaaaaaa

SEQ ID NO: 6681570 - DNA, 16 bp, Homo sapiens
attttcattacaatgg

SEQ ID NO: 6681571 - DNA, 16 bp, Homo sapiens
attttcattagcaaaa

SEQ ID NO: 6681572 - DNA, 22 bp, Homo sapiens
attttcattagcaaaaaaagtt

SEQ ID NO: 6681573 - DNA, 15 bp, Homo sapiens
attttcattcatttt

SEQ ID NO: 6681574 - DNA, 14 bp, Homo sapiens
attttcattctgaa

SEQ ID NO: 6681575 - DNA, 16 bp, Homo sapiens
attttcattctgccaa

SEQ ID NO: 6681576 - DNA, 17 bp, Homo sapiens
attttcattctgccaaa

SEQ ID NO: 6681577 - DNA, 15 bp, Homo sapiens
attttcattgtgatt

SEQ ID NO: 6681578 - DNA, 14 bp, Homo sapiens
attttcatttaact

SEQ ID NO: 6681579 - DNA, 14 bp, Homo sapiens
attttcatttgtac

SEQ ID NO: 6681580 - DNA, 16 bp, Homo sapiens
attttcatttgtacaa

SEQ ID NO: 6681581 - DNA, 11 bp, Homo sapiens
attttcatttt

SEQ ID NO: 6681582 - DNA, 17 bp, Homo sapiens
attttcattttacagtt

SEQ ID NO: 6681583 - DNA, 14 bp, Homo sapiens
attttcattttcat

SEQ ID NO: 6681584 - DNA, 17 bp, Homo sapiens
attttccaaatgtaata

SEQ ID NO: 6681585 - DNA, 17 bp, Homo sapiens
attttccaagtaaaata

SEQ ID NO: 6681586 - DNA, 14 bp, Homo sapiens
attttccaataaaa

SEQ ID NO: 6681587 - DNA, 19 bp, Homo sapiens
attttccaattaattatca

SEQ ID NO: 6681588 - DNA, 18 bp, Homo sapiens
attttccacgcagttctt

SEQ ID NO: 6681589 - DNA, 22 bp, Homo sapiens
attttccagccttatgtgttac

SEQ ID NO: 6681590 - DNA, 15 bp, Homo sapiens
attttccaggcttct

SEQ ID NO: 6681591 - DNA, 13 bp, Homo sapiens
attttccataaat

SEQ ID NO: 6681592 - DNA, 15 bp, Homo sapiens
attttccataagcta

SEQ ID NO: 6681593 - DNA, 18 bp, Homo sapiens
attttccataagctattt

SEQ ID NO: 6681594 - DNA, 15 bp, Homo sapiens
attttccatatattg

SEQ ID NO: 6681595 - DNA, 15 bp, Homo sapiens
attttccatctaaaa

SEQ ID NO: 6681596 - DNA, 19 bp, Homo sapiens
attttccatctaaaaatat

SEQ ID NO: 6681597 - DNA, 20 bp, Homo sapiens
attttccatctaaaaatata

SEQ ID NO: 6681598 - DNA, 17 bp, Homo sapiens
attttccattaactatt

SEQ ID NO: 6681599 - DNA, 20 bp, Homo sapiens
attttcccaatagcactttc

SEQ ID NO: 6681600 - DNA, 15 bp, Homo sapiens
attttcccatcatcc

SEQ ID NO: 6681601 - DNA, 18 bp, Homo sapiens
attttcccatcatccttt

SEQ ID NO: 6681602 - DNA, 20 bp, Homo sapiens
attttcccatcatcctttgt

SEQ ID NO: 6681603 - DNA, 21 bp, Homo sapiens
attttcccccactactgcagc

SEQ ID NO: 6681604 - DNA, 15 bp, Homo sapiens
attttccccccactc

SEQ ID NO: 6681605 - DNA, 20 bp, Homo sapiens
attttcccccttttctgcat

SEQ ID NO: 6681606 - DNA, 20 bp, Homo sapiens
attttccccgaattctattt

SEQ ID NO: 6681607 - DNA, 16 bp, Homo sapiens
attttcccctgaagac

SEQ ID NO: 6681608 - DNA, 17 bp, Homo sapiens
attttcccctgaagact

SEQ ID NO: 6681609 - DNA, 21 bp, Homo sapiens
attttccctcttggtgtgatt

SEQ ID NO: 6681610 - DNA, 14 bp, Homo sapiens
attttcccttttta

SEQ ID NO: 6681611 - DNA, 21 bp, Homo sapiens
attttccgcccactcctggga

SEQ ID NO: 6681612 - DNA, 15 bp, Homo sapiens
attttcctaaggcca

SEQ ID NO: 6681613 - DNA, 16 bp, Homo sapiens
attttcctaaggccac

SEQ ID NO: 6681614 - DNA, 22 bp, Homo sapiens
attttcctaatgtgatcatatg

SEQ ID NO: 6681615 - DNA, 16 bp, Homo sapiens
attttcctagcatcag

SEQ ID NO: 6681616 - DNA, 21 bp, Homo sapiens
attttcctcaatcacactaca

SEQ ID NO: 6681617 - DNA, 15 bp, Homo sapiens
attttcctccccagc

SEQ ID NO: 6681618 - DNA, 18 bp, Homo sapiens
attttcctcctctgccta

SEQ ID NO: 6681619 - DNA, 12 bp, Homo sapiens
attttcctctgg

SEQ ID NO: 6681620 - DNA, 11 bp, Homo sapiens
attttcctctt

SEQ ID NO: 6681621 - DNA, 13 bp, Homo sapiens
attttcctgaaaa

SEQ ID NO: 6681622 - DNA, 14 bp, Homo sapiens
attttcctgaaaac

SEQ ID NO: 6681623 - DNA, 18 bp, Homo sapiens
attttcctgacatttgtt

SEQ ID NO: 6681624 - DNA, 16 bp, Homo sapiens
attttcctgccaggca

SEQ ID NO: 6681625 - DNA, 22 bp, Homo sapiens
attttcctggtgccaatttcaa

SEQ ID NO: 6681626 - DNA, 19 bp, Homo sapiens
attttcctgtcctctttca

SEQ ID NO: 6681627 - DNA, 14 bp, Homo sapiens
attttcctgtgaca

SEQ ID NO: 6681628 - DNA, 14 bp, Homo sapiens
attttcctgtgtaa

SEQ ID NO: 6681629 - DNA, 14 bp, Homo sapiens
attttcctgtgtcc

SEQ ID NO: 6681630 - DNA, 15 bp, Homo sapiens
attttcctgtttact

SEQ ID NO: 6681631 - DNA, 19 bp, Homo sapiens
attttcctgtttactgatt

SEQ ID NO: 6681632 - DNA, 22 bp, Homo sapiens
attttccttcagaatatcttaa

SEQ ID NO: 6681633 - DNA, 13 bp, Homo sapiens
attttccttctga

SEQ ID NO: 6681634 - DNA, 14 bp, Homo sapiens
attttccttctgaa

SEQ ID NO: 6681635 - DNA, 16 bp, Homo sapiens
attttccttgcttttc

SEQ ID NO: 6681636 - DNA, 17 bp, Homo sapiens
attttccttgcttttct

SEQ ID NO: 6681637 - DNA, 13 bp, Homo sapiens
attttcctttaga

SEQ ID NO: 6681638 - DNA, 17 bp, Homo sapiens
attttcctttatgtgat

SEQ ID NO: 6681639 - DNA, 17 bp, Homo sapiens
attttcctttgtcattt

SEQ ID NO: 6681640 - DNA, 21 bp, Homo sapiens
attttccttttttatacacat

SEQ ID NO: 6681641 - DNA, 16 bp, Homo sapiens
attttcggaacacatt

SEQ ID NO: 6681642 - DNA, 17 bp, Homo sapiens
attttcgggattctttg

SEQ ID NO: 6681643 - DNA, 16 bp, Homo sapiens
attttcgtatgaaaat

SEQ ID NO: 6681644 - DNA, 13 bp, Homo sapiens
attttcgtgcatt

SEQ ID NO: 6681645 - DNA, 14 bp, Homo sapiens
attttcgtgcattt

SEQ ID NO: 6681646 - DNA, 15 bp, Homo sapiens
attttcgtgcatttg

SEQ ID NO: 6681647 - DNA, 19 bp, Homo sapiens
attttctaaaagctttcat

SEQ ID NO: 6681648 - DNA, 13 bp, Homo sapiens
attttctaaactg

SEQ ID NO: 6681649 - DNA, 17 bp, Homo sapiens
attttctaaactgtttt

SEQ ID NO: 6681650 - DNA, 14 bp, Homo sapiens
attttctaaagact

SEQ ID NO: 6681651 - DNA, 15 bp, Homo sapiens
attttctaaagactt

SEQ ID NO: 6681652 - DNA, 20 bp, Homo sapiens
attttctaaataaaaatatg

SEQ ID NO: 6681653 - DNA, 22 bp, Homo sapiens
attttctaaataaaaatatgta

SEQ ID NO: 6681654 - DNA, 17 bp, Homo sapiens
attttctaagaaacatt

SEQ ID NO: 6681655 - DNA, 22 bp, Homo sapiens
attttctaagcaatttcttgct

SEQ ID NO: 6681656 - DNA, 21 bp, Homo sapiens
attttctaaggaatgcacaaa

SEQ ID NO: 6681657 - DNA, 23 bp, Homo sapiens
attttctaagtcgtgcactttct

SEQ ID NO: 6681658 - DNA, 14 bp, Homo sapiens
attttctaattaaa

SEQ ID NO: 6681659 - DNA, 15 bp, Homo sapiens
attttctacaattaa

SEQ ID NO: 6681660 - DNA, 21 bp, Homo sapiens
attttctaccactggtgtaaa

SEQ ID NO: 6681661 - DNA, 22 bp, Homo sapiens
attttctagaatactaataaaa

SEQ ID NO: 6681662 - DNA, 18 bp, Homo sapiens
attttctagactgtgaag

SEQ ID NO: 6681663 - DNA, 18 bp, Homo sapiens
attttctagatacaataa

SEQ ID NO: 6681664 - DNA, 14 bp, Homo sapiens
attttctataattt

SEQ ID NO: 6681665 - DNA, 15 bp, Homo sapiens
attttctataattta

SEQ ID NO: 6681666 - DNA, 18 bp, Homo sapiens
attttctataatttaaat

SEQ ID NO: 6681667 - DNA, 19 bp, Homo sapiens
attttctatagctcttcta

SEQ ID NO: 6681668 - DNA, 19 bp, Homo sapiens
attttctatatttgtaact

SEQ ID NO: 6681669 - DNA, 22 bp, Homo sapiens
attttctatcccccttaaagaa

SEQ ID NO: 6681670 - DNA, 17 bp, Homo sapiens
attttctatgtgttgtg

SEQ ID NO: 6681671 - DNA, 16 bp, Homo sapiens
attttctattgttact

SEQ ID NO: 6681672 - DNA, 20 bp, Homo sapiens
attttctattgttactctgg

SEQ ID NO: 6681673 - DNA, 15 bp, Homo sapiens
attttctatttaaaa

SEQ ID NO: 6681674 - DNA, 20 bp, Homo sapiens
attttctatttctctgtgta

SEQ ID NO: 6681675 - DNA, 23 bp, Homo sapiens
attttctcaaaagcatttatcat

SEQ ID NO: 6681676 - DNA, 15 bp, Homo sapiens
attttctcaatctcc

SEQ ID NO: 6681677 - DNA, 20 bp, Homo sapiens
attttctccaaataaaaatt

SEQ ID NO: 6681678 - DNA, 18 bp, Homo sapiens
attttctccacaacactg

SEQ ID NO: 6681679 - DNA, 16 bp, Homo sapiens
attttctccacttcat

SEQ ID NO: 6681680 - DNA, 14 bp, Homo sapiens
attttctccagctc

SEQ ID NO: 6681681 - DNA, 15 bp, Homo sapiens
attttctcccaggaa

SEQ ID NO: 6681682 - DNA, 17 bp, Homo sapiens
attttctcccaggaagc

SEQ ID NO: 6681683 - DNA, 18 bp, Homo sapiens
attttctccctggatttt

SEQ ID NO: 6681684 - DNA, 23 bp, Homo sapiens
attttctcccttaggaatataca

SEQ ID NO: 6681685 - DNA, 21 bp, Homo sapiens
attttctccctttatgtatct

SEQ ID NO: 6681686 - DNA, 13 bp, Homo sapiens
attttctcctgtg

SEQ ID NO: 6681687 - DNA, 13 bp, Homo sapiens
attttctccttgg

SEQ ID NO: 6681688 - DNA, 17 bp, Homo sapiens
attttctccttggtttg

SEQ ID NO: 6681689 - DNA, 16 bp, Homo sapiens
attttctctaaactgt

SEQ ID NO: 6681690 - DNA, 14 bp, Homo sapiens
attttctctcctcg

SEQ ID NO: 6681691 - DNA, 17 bp, Homo sapiens
attttctctgatacttt

SEQ ID NO: 6681692 - DNA, 15 bp, Homo sapiens
attttctctggaaat

SEQ ID NO: 6681693 - DNA, 22 bp, Homo sapiens
attttctctggcagcataattt

SEQ ID NO: 6681694 - DNA, 16 bp, Homo sapiens
attttctctgtacttt

SEQ ID NO: 6681695 - DNA, 14 bp, Homo sapiens
attttctctgtatg

SEQ ID NO: 6681696 - DNA, 23 bp, Homo sapiens
attttctctgtatgaatgtgatt

SEQ ID NO: 6681697 - DNA, 18 bp, Homo sapiens
attttctctgtgtttgtt

SEQ ID NO: 6681698 - DNA, 13 bp, Homo sapiens
attttctcttaga

SEQ ID NO: 6681699 - DNA, 14 bp, Homo sapiens
attttctcttagag

SEQ ID NO: 6681700 - DNA, 15 bp, Homo sapiens
attttctctttaaaa

SEQ ID NO: 6681701 - DNA, 21 bp, Homo sapiens
attttctctttaaaagaaagt

SEQ ID NO: 6681702 - DNA, 16 bp, Homo sapiens
attttctgaaactaat

SEQ ID NO: 6681703 - DNA, 21 bp, Homo sapiens
attttctgaaactaatgaaag

SEQ ID NO: 6681704 - DNA, 22 bp, Homo sapiens
attttctgaaactaatgaaagc

SEQ ID NO: 6681705 - DNA, 18 bp, Homo sapiens
attttctgaaagttaccc

SEQ ID NO: 6681706 - DNA, 15 bp, Homo sapiens
attttctgacatgca

SEQ ID NO: 6681707 - DNA, 16 bp, Homo sapiens
attttctgacatgcat

SEQ ID NO: 6681708 - DNA, 22 bp, Homo sapiens
attttctgaccaaaatgtgttt

SEQ ID NO: 6681709 - DNA, 17 bp, Homo sapiens
attttctgagtagcata

SEQ ID NO: 6681710 - DNA, 15 bp, Homo sapiens
attttctgcatctcc

SEQ ID NO: 6681711 - DNA, 16 bp, Homo sapiens
attttctgcatctcca

SEQ ID NO: 6681712 - DNA, 19 bp, Homo sapiens
attttctgcatctccactt

SEQ ID NO: 6681713 - DNA, 17 bp, Homo sapiens
attttctggaaaatgct

SEQ ID NO: 6681714 - DNA, 22 bp, Homo sapiens
attttctggaatacatgaaata

SEQ ID NO: 6681715 - DNA, 17 bp, Homo sapiens
attttctggtaaaaaga

SEQ ID NO: 6681716 - DNA, 21 bp, Homo sapiens
attttctggtactctgtgaaa

SEQ ID NO: 6681717 - DNA, 20 bp, Homo sapiens
attttctggtagatagaaat

SEQ ID NO: 6681718 - DNA, 15 bp, Homo sapiens
attttctggttctaa

SEQ ID NO: 6681719 - DNA, 12 bp, Homo sapiens
attttctgtaag

SEQ ID NO: 6681720 - DNA, 17 bp, Homo sapiens
attttctgtaatctttt

SEQ ID NO: 6681721 - DNA, 19 bp, Homo sapiens
attttctgtaattcttctc

SEQ ID NO: 6681722 - DNA, 12 bp, Homo sapiens
attttctgtatt

SEQ ID NO: 6681723 - DNA, 14 bp, Homo sapiens
attttctgtatttt

SEQ ID NO: 6681724 - DNA, 13 bp, Homo sapiens
attttctgtcact

SEQ ID NO: 6681725 - DNA, 16 bp, Homo sapiens
attttctgtcactgta

SEQ ID NO: 6681726 - DNA, 14 bp, Homo sapiens
attttctgtcagat

SEQ ID NO: 6681727 - DNA, 22 bp, Homo sapiens
attttctgtcagatgagaacaa

SEQ ID NO: 6681728 - DNA, 18 bp, Homo sapiens
attttctgtgcctgaata

SEQ ID NO: 6681729 - DNA, 20 bp, Homo sapiens
attttctgtgcctgaatatt

SEQ ID NO: 6681730 - DNA, 11 bp, Homo sapiens
attttctgtgt

SEQ ID NO: 6681731 - DNA, 16 bp, Homo sapiens
attttctgtgtaaaat

SEQ ID NO: 6681732 - DNA, 18 bp, Homo sapiens
attttctgtgtaaaatga

SEQ ID NO: 6681733 - DNA, 20 bp, Homo sapiens
attttctgtgtgttcctggc

SEQ ID NO: 6681734 - DNA, 18 bp, Homo sapiens
attttctgtgttgttcat

SEQ ID NO: 6681735 - DNA, 19 bp, Homo sapiens
attttctgtgttgttcata

SEQ ID NO: 6681736 - DNA, 18 bp, Homo sapiens
attttctgttcagattaa

SEQ ID NO: 6681737 - DNA, 23 bp, Homo sapiens
attttctgttcatagatattgga

SEQ ID NO: 6681738 - DNA, 13 bp, Homo sapiens
attttcttaaaac

SEQ ID NO: 6681739 - DNA, 15 bp, Homo sapiens
attttcttaaccagt

SEQ ID NO: 6681740 - DNA, 20 bp, Homo sapiens
attttcttaaggaattttgt

SEQ ID NO: 6681741 - DNA, 14 bp, Homo sapiens
attttcttaatata

SEQ ID NO: 6681742 - DNA, 20 bp, Homo sapiens
attttcttacccaatttccc

SEQ ID NO: 6681743 - DNA, 14 bp, Homo sapiens
attttcttactttt

SEQ ID NO: 6681744 - DNA, 16 bp, Homo sapiens
attttcttacttttat

SEQ ID NO: 6681745 - DNA, 19 bp, Homo sapiens
attttcttatcttctgcaa

SEQ ID NO: 6681746 - DNA, 23 bp, Homo sapiens
attttcttatgtaagtttgcata

SEQ ID NO: 6681747 - DNA, 14 bp, Homo sapiens
attttcttcagttg

SEQ ID NO: 6681748 - DNA, 17 bp, Homo sapiens
attttcttcagttggtg

SEQ ID NO: 6681749 - DNA, 17 bp, Homo sapiens
attttcttcatctttgc

SEQ ID NO: 6681750 - DNA, 21 bp, Homo sapiens
attttcttcatgcaatgacat

SEQ ID NO: 6681751 - DNA, 14 bp, Homo sapiens
attttcttcccaaa

SEQ ID NO: 6681752 - DNA, 18 bp, Homo sapiens
attttcttccttctcagc

SEQ ID NO: 6681753 - DNA, 14 bp, Homo sapiens
attttcttctcatt

SEQ ID NO: 6681754 - DNA, 18 bp, Homo sapiens
attttcttctttaatttt

SEQ ID NO: 6681755 - DNA, 20 bp, Homo sapiens
attttcttctttaatttttc

SEQ ID NO: 6681756 - DNA, 16 bp, Homo sapiens
attttcttgatgtcac

SEQ ID NO: 6681757 - DNA, 17 bp, Homo sapiens
attttcttggaattttg

SEQ ID NO: 6681758 - DNA, 18 bp, Homo sapiens
attttcttggaattttgt

SEQ ID NO: 6681759 - DNA, 19 bp, Homo sapiens
attttcttggaattttgta

SEQ ID NO: 6681760 - DNA, 22 bp, Homo sapiens
attttcttggaattttgtaaaa

SEQ ID NO: 6681761 - DNA, 12 bp, Homo sapiens
attttcttgttt

SEQ ID NO: 6681762 - DNA, 19 bp, Homo sapiens
attttctttaaaagaatgg

SEQ ID NO: 6681763 - DNA, 12 bp, Homo sapiens
attttctttaat

SEQ ID NO: 6681764 - DNA, 15 bp, Homo sapiens
attttctttaatgct

SEQ ID NO: 6681765 - DNA, 19 bp, Homo sapiens
attttctttaatgctttta

SEQ ID NO: 6681766 - DNA, 20 bp, Homo sapiens
attttctttagcttttacca

SEQ ID NO: 6681767 - DNA, 20 bp, Homo sapiens
attttctttatttgtagcca

SEQ ID NO: 6681768 - DNA, 14 bp, Homo sapiens
attttctttcaaaa

SEQ ID NO: 6681769 - DNA, 17 bp, Homo sapiens
attttctttcatacatt

SEQ ID NO: 6681770 - DNA, 21 bp, Homo sapiens
attttctttcatacattatat

SEQ ID NO: 6681771 - DNA, 11 bp, Homo sapiens
attttctttcc

SEQ ID NO: 6681772 - DNA, 19 bp, Homo sapiens
attttctttcccagaagcg

SEQ ID NO: 6681773 - DNA, 21 bp, Homo sapiens
attttctttctatgtagaact

SEQ ID NO: 6681774 - DNA, 15 bp, Homo sapiens
attttctttgaaatt

SEQ ID NO: 6681775 - DNA, 15 bp, Homo sapiens
attttctttgtttct

SEQ ID NO: 6681776 - DNA, 20 bp, Homo sapiens
attttcttttatatctgtaa

SEQ ID NO: 6681777 - DNA, 22 bp, Homo sapiens
attttcttttatatctgtaaat

SEQ ID NO: 6681778 - DNA, 15 bp, Homo sapiens
attttcttttattat

SEQ ID NO: 6681779 - DNA, 20 bp, Homo sapiens
attttcttttgaattgtttt

SEQ ID NO: 6681780 - DNA, 19 bp, Homo sapiens
attttcttttgtaaatgtt

SEQ ID NO: 6681781 - DNA, 20 bp, Homo sapiens
attttctttttaataaaaag

SEQ ID NO: 6681782 - DNA, 14 bp, Homo sapiens
attttctttttcct

SEQ ID NO: 6681783 - DNA, 23 bp, Homo sapiens
attttctttttcctttataattc

SEQ ID NO: 6681784 - DNA, 18 bp, Homo sapiens
attttctttttctgaagc

SEQ ID NO: 6681785 - DNA, 18 bp, Homo sapiens
attttctttttcttaaga

SEQ ID NO: 6681786 - DNA, 19 bp, Homo sapiens
attttctttttgtttcact

SEQ ID NO: 6681787 - DNA, 22 bp, Homo sapiens
attttctttttgtttcactgga

SEQ ID NO: 6681788 - DNA, 22 bp, Homo sapiens
attttcttttttatcttgcact

SEQ ID NO: 6681789 - DNA, 12 bp, Homo sapiens
attttgaaaaat

SEQ ID NO: 6681790 - DNA, 22 bp, Homo sapiens
attttgaaaaattacctgtata

SEQ ID NO: 6681791 - DNA, 23 bp, Homo sapiens
attttgaaaaattacctgtataa

SEQ ID NO: 6681792 - DNA, 19 bp, Homo sapiens
attttgaaaaattcctatt

SEQ ID NO: 6681793 - DNA, 15 bp, Homo sapiens
attttgaaaacactt

SEQ ID NO: 6681794 - DNA, 16 bp, Homo sapiens
attttgaaaactacat

SEQ ID NO: 6681795 - DNA, 19 bp, Homo sapiens
attttgaaaactacatttt

SEQ ID NO: 6681796 - DNA, 17 bp, Homo sapiens
attttgaaaagatgtac

SEQ ID NO: 6681797 - DNA, 14 bp, Homo sapiens
attttgaaaagctt

SEQ ID NO: 6681798 - DNA, 18 bp, Homo sapiens
attttgaaaagcttctta

SEQ ID NO: 6681799 - DNA, 20 bp, Homo sapiens
attttgaaaagcttcttaat

SEQ ID NO: 6681800 - DNA, 14 bp, Homo sapiens
attttgaaaagtaa

SEQ ID NO: 6681801 - DNA, 14 bp, Homo sapiens
attttgaaaatatg

SEQ ID NO: 6681802 - DNA, 21 bp, Homo sapiens
attttgaaaatatgtactgta

SEQ ID NO: 6681803 - DNA, 12 bp, Homo sapiens
attttgaaactt

SEQ ID NO: 6681804 - DNA, 19 bp, Homo sapiens
attttgaaaggtcagaatt

SEQ ID NO: 6681805 - DNA, 23 bp, Homo sapiens
attttgaaaggtcagaattttgt

SEQ ID NO: 6681806 - DNA, 15 bp, Homo sapiens
attttgaaagtctgt

SEQ ID NO: 6681807 - DNA, 19 bp, Homo sapiens
attttgaaagtctgtcctt

SEQ ID NO: 6681808 - DNA, 20 bp, Homo sapiens
attttgaaagtctgtccttg

SEQ ID NO: 6681809 - DNA, 20 bp, Homo sapiens
attttgaaatcatgaagata

SEQ ID NO: 6681810 - DNA, 15 bp, Homo sapiens
attttgaaatgaact

SEQ ID NO: 6681811 - DNA, 16 bp, Homo sapiens
attttgaaatgaactt

SEQ ID NO: 6681812 - DNA, 19 bp, Homo sapiens
attttgaaatgaactttgt

SEQ ID NO: 6681813 - DNA, 21 bp, Homo sapiens
attttgaaatgattcatcttt

SEQ ID NO: 6681814 - DNA, 20 bp, Homo sapiens
attttgaacaactcgaatca

SEQ ID NO: 6681815 - DNA, 20 bp, Homo sapiens
attttgaaccaaaacatata

SEQ ID NO: 6681816 - DNA, 18 bp, Homo sapiens
attttgaacgcttaagtc

SEQ ID NO: 6681817 - DNA, 13 bp, Homo sapiens
attttgaactttt

SEQ ID NO: 6681818 - DNA, 15 bp, Homo sapiens
attttgaagaaaaca

SEQ ID NO: 6681819 - DNA, 23 bp, Homo sapiens
attttgaagctaattattttaat

SEQ ID NO: 6681820 - DNA, 15 bp, Homo sapiens
attttgaaggaaaat

SEQ ID NO: 6681821 - DNA, 15 bp, Homo sapiens
attttgaagtcagag

SEQ ID NO: 6681822 - DNA, 19 bp, Homo sapiens
attttgaagtgctgtttat

SEQ ID NO: 6681823 - DNA, 14 bp, Homo sapiens
attttgaagtttac

SEQ ID NO: 6681824 - DNA, 15 bp, Homo sapiens
attttgaatcaataa

SEQ ID NO: 6681825 - DNA, 18 bp, Homo sapiens
attttgaatcaataatat

SEQ ID NO: 6681826 - DNA, 12 bp, Homo sapiens
attttgaatgta

SEQ ID NO: 6681827 - DNA, 15 bp, Homo sapiens
attttgaatgtcaca

SEQ ID NO: 6681828 - DNA, 20 bp, Homo sapiens
attttgaatgtttatgttct

SEQ ID NO: 6681829 - DNA, 13 bp, Homo sapiens
attttgacaaaaa

SEQ ID NO: 6681830 - DNA, 14 bp, Homo sapiens
attttgacaaaaat

SEQ ID NO: 6681831 - DNA, 21 bp, Homo sapiens
attttgacaaaaatgtttgta

SEQ ID NO: 6681832 - DNA, 13 bp, Homo sapiens
attttgacaacat

SEQ ID NO: 6681833 - DNA, 23 bp, Homo sapiens
attttgacaacatggcttctcct

SEQ ID NO: 6681834 - DNA, 19 bp, Homo sapiens
attttgacagaagctattt

SEQ ID NO: 6681835 - DNA, 24 bp, Homo sapiens
attttgacagttattttgataaca

SEQ ID NO: 6681836 - DNA, 21 bp, Homo sapiens
attttgacccaagtggatatt

SEQ ID NO: 6681837 - DNA, 13 bp, Homo sapiens
attttgaccttgt

SEQ ID NO: 6681838 - DNA, 18 bp, Homo sapiens
attttgactgtgatttat

SEQ ID NO: 6681839 - DNA, 13 bp, Homo sapiens
attttgagaaact

SEQ ID NO: 6681840 - DNA, 21 bp, Homo sapiens
attttgagaaactgctgcaga

SEQ ID NO: 6681841 - DNA, 22 bp, Homo sapiens
attttgagaaagtcttatttat

SEQ ID NO: 6681842 - DNA, 19 bp, Homo sapiens
attttgagaacaaagatga

SEQ ID NO: 6681843 - DNA, 22 bp, Homo sapiens
attttgagacaccaataaaagt

SEQ ID NO: 6681844 - DNA, 23 bp, Homo sapiens
attttgagacaccaataaaagtt

SEQ ID NO: 6681845 - DNA, 16 bp, Homo sapiens
attttgagaggctgag

SEQ ID NO: 6681846 - DNA, 13 bp, Homo sapiens
attttgagatgta

SEQ ID NO: 6681847 - DNA, 17 bp, Homo sapiens
attttgagctatttcct

SEQ ID NO: 6681848 - DNA, 21 bp, Homo sapiens
attttgagctgaaatgctgca

SEQ ID NO: 6681849 - DNA, 19 bp, Homo sapiens
attttgaggacatcactta

SEQ ID NO: 6681850 - DNA, 14 bp, Homo sapiens
attttgaggctttc

SEQ ID NO: 6681851 - DNA, 19 bp, Homo sapiens
attttgagggtgtaaccag

SEQ ID NO: 6681852 - DNA, 18 bp, Homo sapiens
attttgaggtagaggaaa

SEQ ID NO: 6681853 - DNA, 13 bp, Homo sapiens
attttgaggttta

SEQ ID NO: 6681854 - DNA, 19 bp, Homo sapiens
attttgaggttttgtaaaa

SEQ ID NO: 6681855 - DNA, 20 bp, Homo sapiens
attttgaggttttgtaaaac

SEQ ID NO: 6681856 - DNA, 23 bp, Homo sapiens
attttgaggttttgtaaaactgt

SEQ ID NO: 6681857 - DNA, 18 bp, Homo sapiens
attttgagtaaagctcct

SEQ ID NO: 6681858 - DNA, 21 bp, Homo sapiens
attttgagtatctcggacctt

SEQ ID NO: 6681859 - DNA, 18 bp, Homo sapiens
attttgagtattccatga

SEQ ID NO: 6681860 - DNA, 23 bp, Homo sapiens
attttgagtgactcgagggttgg

SEQ ID NO: 6681861 - DNA, 13 bp, Homo sapiens
attttgagtttca

SEQ ID NO: 6681862 - DNA, 15 bp, Homo sapiens
attttgagtttgcct

SEQ ID NO: 6681863 - DNA, 18 bp, Homo sapiens
attttgagtttgcctcag

SEQ ID NO: 6681864 - DNA, 13 bp, Homo sapiens
attttgataataa

SEQ ID NO: 6681865 - DNA, 18 bp, Homo sapiens
attttgatacaaatgttt

SEQ ID NO: 6681866 - DNA, 17 bp, Homo sapiens
attttgataccagaagg

SEQ ID NO: 6681867 - DNA, 14 bp, Homo sapiens
attttgatagtggg

SEQ ID NO: 6681868 - DNA, 20 bp, Homo sapiens
attttgatataatctttcaa

SEQ ID NO: 6681869 - DNA, 16 bp, Homo sapiens
attttgatataattgt

SEQ ID NO: 6681870 - DNA, 14 bp, Homo sapiens
attttgatcagtgt

SEQ ID NO: 6681871 - DNA, 15 bp, Homo sapiens
attttgatcagtgtt

SEQ ID NO: 6681872 - DNA, 20 bp, Homo sapiens
attttgatctcacattttta

SEQ ID NO: 6681873 - DNA, 13 bp, Homo sapiens
attttgatcttca

SEQ ID NO: 6681874 - DNA, 17 bp, Homo sapiens
attttgatgcagcattt

SEQ ID NO: 6681875 - DNA, 15 bp, Homo sapiens
attttgatgtattat

SEQ ID NO: 6681876 - DNA, 15 bp, Homo sapiens
attttgatgttttaa

SEQ ID NO: 6681877 - DNA, 17 bp, Homo sapiens
attttgatgttttaagg

SEQ ID NO: 6681878 - DNA, 21 bp, Homo sapiens
attttgattaaccttttcaaa

SEQ ID NO: 6681879 - DNA, 14 bp, Homo sapiens
attttgattttaca

SEQ ID NO: 6681880 - DNA, 23 bp, Homo sapiens
attttgatttttaatggaaagtt

SEQ ID NO: 6681881 - DNA, 20 bp, Homo sapiens
attttgcaaaaatcctattc

SEQ ID NO: 6681882 - DNA, 13 bp, Homo sapiens
attttgcaaatat

SEQ ID NO: 6681883 - DNA, 15 bp, Homo sapiens
attttgcaacttgga

SEQ ID NO: 6681884 - DNA, 10 bp, Homo sapiens
attttgcaca

SEQ ID NO: 6681885 - DNA, 23 bp, Homo sapiens
attttgcacctgcagccaagcaa

SEQ ID NO: 6681886 - DNA, 14 bp, Homo sapiens
attttgcactagaa

SEQ ID NO: 6681887 - DNA, 18 bp, Homo sapiens
attttgcagaaggaaatg

SEQ ID NO: 6681888 - DNA, 22 bp, Homo sapiens
attttgcagaggctatgggaag

SEQ ID NO: 6681889 - DNA, 12 bp, Homo sapiens
attttgcagcag

SEQ ID NO: 6681890 - DNA, 14 bp, Homo sapiens
attttgcagcagtg

SEQ ID NO: 6681891 - DNA, 15 bp, Homo sapiens
attttgcagcagtga

SEQ ID NO: 6681892 - DNA, 15 bp, Homo sapiens
attttgcagtgtgca

SEQ ID NO: 6681893 - DNA, 18 bp, Homo sapiens
attttgcatactgaaaat

SEQ ID NO: 6681894 - DNA, 18 bp, Homo sapiens
attttgcatatatgttct

SEQ ID NO: 6681895 - DNA, 16 bp, Homo sapiens
attttgcatattctct

SEQ ID NO: 6681896 - DNA, 14 bp, Homo sapiens
attttgcattcaaa

SEQ ID NO: 6681897 - DNA, 15 bp, Homo sapiens
attttgcattcaaat

SEQ ID NO: 6681898 - DNA, 16 bp, Homo sapiens
attttgcattccagaa

SEQ ID NO: 6681899 - DNA, 16 bp, Homo sapiens
attttgccatttagcg

SEQ ID NO: 6681900 - DNA, 22 bp, Homo sapiens
attttgcctaatacattaaagc

SEQ ID NO: 6681901 - DNA, 20 bp, Homo sapiens
attttgcctgttaaatcgta

SEQ ID NO: 6681902 - DNA, 16 bp, Homo sapiens
attttgcgatgtgttt

SEQ ID NO: 6681903 - DNA, 18 bp, Homo sapiens
attttgcgtcagagaaat

SEQ ID NO: 6681904 - DNA, 21 bp, Homo sapiens
attttgctaactggttaaaca

SEQ ID NO: 6681905 - DNA, 23 bp, Homo sapiens
attttgctaagtaaatctcttct

SEQ ID NO: 6681906 - DNA, 23 bp, Homo sapiens
attttgctattgtaaatatgttt

SEQ ID NO: 6681907 - DNA, 14 bp, Homo sapiens
attttgctccctct

SEQ ID NO: 6681908 - DNA, 18 bp, Homo sapiens
attttgctccctctgtta

SEQ ID NO: 6681909 - DNA, 15 bp, Homo sapiens
attttgctgatgggt

SEQ ID NO: 6681910 - DNA, 18 bp, Homo sapiens
attttgctgcttgatgat

SEQ ID NO: 6681911 - DNA, 19 bp, Homo sapiens
attttgctggagactattt

SEQ ID NO: 6681912 - DNA, 20 bp, Homo sapiens
attttgctggagactattta

SEQ ID NO: 6681913 - DNA, 21 bp, Homo sapiens
attttgctggagactatttaa

SEQ ID NO: 6681914 - DNA, 14 bp, Homo sapiens
attttgctgtatat

SEQ ID NO: 6681915 - DNA, 22 bp, Homo sapiens
attttgcttcactttgccttct

SEQ ID NO: 6681916 - DNA, 13 bp, Homo sapiens
attttgcttccca

SEQ ID NO: 6681917 - DNA, 16 bp, Homo sapiens
attttgctttaatttt

SEQ ID NO: 6681918 - DNA, 21 bp, Homo sapiens
attttgctttagagaatgcca

SEQ ID NO: 6681919 - DNA, 12 bp, Homo sapiens
attttgctttgt

SEQ ID NO: 6681920 - DNA, 18 bp, Homo sapiens
attttgctttgtgatttt

SEQ ID NO: 6681921 - DNA, 19 bp, Homo sapiens
attttggaaaaatgtcact

SEQ ID NO: 6681922 - DNA, 21 bp, Homo sapiens
attttggaaaaatgtcactga

SEQ ID NO: 6681923 - DNA, 22 bp, Homo sapiens
attttggaaaaatgtcactgaa

SEQ ID NO: 6681924 - DNA, 20 bp, Homo sapiens
attttggaaaataaattatt

SEQ ID NO: 6681925 - DNA, 19 bp, Homo sapiens
attttggaaaatgattagg

SEQ ID NO: 6681926 - DNA, 22 bp, Homo sapiens
attttggaaactcaaggaaaag

SEQ ID NO: 6681927 - DNA, 19 bp, Homo sapiens
attttggaaactgctaaat

SEQ ID NO: 6681928 - DNA, 23 bp, Homo sapiens
attttggaaactgctaaattcta

SEQ ID NO: 6681929 - DNA, 19 bp, Homo sapiens
attttggaactgtgtttca

SEQ ID NO: 6681930 - DNA, 18 bp, Homo sapiens
attttggaatatttgctt

SEQ ID NO: 6681931 - DNA, 11 bp, Homo sapiens
attttggaatt

SEQ ID NO: 6681932 - DNA, 13 bp, Homo sapiens
attttggaattgg

SEQ ID NO: 6681933 - DNA, 19 bp, Homo sapiens
attttggaattggtgtata

SEQ ID NO: 6681934 - DNA, 14 bp, Homo sapiens
attttggaatttgc

SEQ ID NO: 6681935 - DNA, 18 bp, Homo sapiens
attttggacgtgtgagga

SEQ ID NO: 6681936 - DNA, 19 bp, Homo sapiens
attttggagagataggaag

SEQ ID NO: 6681937 - DNA, 19 bp, Homo sapiens
attttggagattataataa

SEQ ID NO: 6681938 - DNA, 21 bp, Homo sapiens
attttggagattataataaat

SEQ ID NO: 6681939 - DNA, 18 bp, Homo sapiens
attttggatatattattg

SEQ ID NO: 6681940 - DNA, 21 bp, Homo sapiens
attttggatatattattgtaa

SEQ ID NO: 6681941 - DNA, 12 bp, Homo sapiens
attttggatgag

SEQ ID NO: 6681942 - DNA, 18 bp, Homo sapiens
attttggcatctgcaaag

SEQ ID NO: 6681943 - DNA, 19 bp, Homo sapiens
attttggcatctgcaaagg

SEQ ID NO: 6681944 - DNA, 21 bp, Homo sapiens
attttggcgctattacaaata

SEQ ID NO: 6681945 - DNA, 20 bp, Homo sapiens
attttggctcaccgtggatt

SEQ ID NO: 6681946 - DNA, 12 bp, Homo sapiens
attttggctcag

SEQ ID NO: 6681947 - DNA, 19 bp, Homo sapiens
attttggctttctccctgt

SEQ ID NO: 6681948 - DNA, 22 bp, Homo sapiens
attttgggaaattatctgcctt

SEQ ID NO: 6681949 - DNA, 23 bp, Homo sapiens
attttgggaaattcttgcactgt

SEQ ID NO: 6681950 - DNA, 21 bp, Homo sapiens
attttgggacaattgttttaa

SEQ ID NO: 6681951 - DNA, 22 bp, Homo sapiens
attttgggacaattgttttaat

SEQ ID NO: 6681952 - DNA, 16 bp, Homo sapiens
attttggggaactgtt

SEQ ID NO: 6681953 - DNA, 23 bp, Homo sapiens
attttggggaagggtttgaattg

SEQ ID NO: 6681954 - DNA, 19 bp, Homo sapiens
attttggggaggaaaacag

SEQ ID NO: 6681955 - DNA, 16 bp, Homo sapiens
attttggggctatatt

SEQ ID NO: 6681956 - DNA, 19 bp, Homo sapiens
attttggggggttatttat

SEQ ID NO: 6681957 - DNA, 22 bp, Homo sapiens
attttgggggtttttaatcttt

SEQ ID NO: 6681958 - DNA, 17 bp, Homo sapiens
attttggggtctctttt

SEQ ID NO: 6681959 - DNA, 21 bp, Homo sapiens
attttgggtattaatatatag

SEQ ID NO: 6681960 - DNA, 22 bp, Homo sapiens
attttgggtcaacttgacacca

SEQ ID NO: 6681961 - DNA, 18 bp, Homo sapiens
attttgggttgtttaaaa

SEQ ID NO: 6681962 - DNA, 21 bp, Homo sapiens
attttgggttgtttaaaaatt

SEQ ID NO: 6681963 - DNA, 19 bp, Homo sapiens
attttgggttttgggtctt

SEQ ID NO: 6681964 - DNA, 21 bp, Homo sapiens
attttggtaatgatgttgata

SEQ ID NO: 6681965 - DNA, 21 bp, Homo sapiens
attttggtattacactgtatt

SEQ ID NO: 6681966 - DNA, 21 bp, Homo sapiens
attttggtcatagcattcact

SEQ ID NO: 6681967 - DNA, 18 bp, Homo sapiens
attttggtccaagttgtg

SEQ ID NO: 6681968 - DNA, 10 bp, Homo sapiens
attttggtct

SEQ ID NO: 6681969 - DNA, 18 bp, Homo sapiens
attttggtgaatgtgggt

SEQ ID NO: 6681970 - DNA, 21 bp, Homo sapiens
attttggtgagaaatgggact

SEQ ID NO: 6681971 - DNA, 20 bp, Homo sapiens
attttggtgcacaaatacaa

SEQ ID NO: 6681972 - DNA, 14 bp, Homo sapiens
attttggtgtgcat

SEQ ID NO: 6681973 - DNA, 16 bp, Homo sapiens
attttggtgtgcatct

SEQ ID NO: 6681974 - DNA, 16 bp, Homo sapiens
attttggttcttctca

SEQ ID NO: 6681975 - DNA, 15 bp, Homo sapiens
attttggttgtattc

SEQ ID NO: 6681976 - DNA, 16 bp, Homo sapiens
attttggtttttctca

SEQ ID NO: 6681977 - DNA, 14 bp, Homo sapiens
attttgtaaaaaga

SEQ ID NO: 6681978 - DNA, 18 bp, Homo sapiens
attttgtaaaaagaaatt

SEQ ID NO: 6681979 - DNA, 17 bp, Homo sapiens
attttgtaaaatgtatt

SEQ ID NO: 6681980 - DNA, 21 bp, Homo sapiens
attttgtaaaatgtattatgt

SEQ ID NO: 6681981 - DNA, 13 bp, Homo sapiens
attttgtaaacta

SEQ ID NO: 6681982 - DNA, 17 bp, Homo sapiens
attttgtaaaggtgaaa

SEQ ID NO: 6681983 - DNA, 23 bp, Homo sapiens
attttgtaaataataaaatagta

SEQ ID NO: 6681984 - DNA, 13 bp, Homo sapiens
attttgtaaatct

SEQ ID NO: 6681985 - DNA, 17 bp, Homo sapiens
attttgtaacaaatgaa

SEQ ID NO: 6681986 - DNA, 18 bp, Homo sapiens
attttgtaacgaagacac

SEQ ID NO: 6681987 - DNA, 19 bp, Homo sapiens
attttgtaacgaagacaca

SEQ ID NO: 6681988 - DNA, 22 bp, Homo sapiens
attttgtaactgcctaccagtc

SEQ ID NO: 6681989 - DNA, 17 bp, Homo sapiens
attttgtaactttctct

SEQ ID NO: 6681990 - DNA, 12 bp, Homo sapiens
attttgtaagaa

SEQ ID NO: 6681991 - DNA, 16 bp, Homo sapiens
attttgtaagaaggca

SEQ ID NO: 6681992 - DNA, 12 bp, Homo sapiens
attttgtaagta

SEQ ID NO: 6681993 - DNA, 10 bp, Homo sapiens
attttgtaat

SEQ ID NO: 6681994 - DNA, 16 bp, Homo sapiens
attttgtaatgaattc

SEQ ID NO: 6681995 - DNA, 23 bp, Homo sapiens
attttgtaatgtatcaaatacat

SEQ ID NO: 6681996 - DNA, 15 bp, Homo sapiens
attttgtaattttct

SEQ ID NO: 6681997 - DNA, 22 bp, Homo sapiens
attttgtaatttttttgaaaaa

SEQ ID NO: 6681998 - DNA, 13 bp, Homo sapiens
attttgtacattt

SEQ ID NO: 6681999 - DNA, 21 bp, Homo sapiens
attttgtaccaagtaaatcca

SEQ ID NO: 6682000 - DNA, 18 bp, Homo sapiens
attttgtacgtatgaatg

SEQ ID NO: 6682001 - DNA, 21 bp, Homo sapiens
attttgtacgtgttattatta

SEQ ID NO: 6682002 - DNA, 14 bp, Homo sapiens
attttgtactttgt

SEQ ID NO: 6682003 - DNA, 15 bp, Homo sapiens
attttgtagatgtga

SEQ ID NO: 6682004 - DNA, 20 bp, Homo sapiens
attttgtataatcacagttg

SEQ ID NO: 6682005 - DNA, 20 bp, Homo sapiens
attttgtatattatgtttat

SEQ ID NO: 6682006 - DNA, 13 bp, Homo sapiens
attttgtatctgc

SEQ ID NO: 6682007 - DNA, 15 bp, Homo sapiens
attttgtatctgcag

SEQ ID NO: 6682008 - DNA, 21 bp, Homo sapiens
attttgtatctgcaggcagac

SEQ ID NO: 6682009 - DNA, 13 bp, Homo sapiens
attttgtatgcaa

SEQ ID NO: 6682010 - DNA, 17 bp, Homo sapiens
attttgtatgctgaatt

SEQ ID NO: 6682011 - DNA, 12 bp, Homo sapiens
attttgtatgga

SEQ ID NO: 6682012 - DNA, 15 bp, Homo sapiens
attttgtatgtaaat

SEQ ID NO: 6682013 - DNA, 15 bp, Homo sapiens
attttgtatgtatgt

SEQ ID NO: 6682014 - DNA, 24 bp, Homo sapiens
attttgtattacatctaatgcttc

SEQ ID NO: 6682015 - DNA, 16 bp, Homo sapiens
attttgtattattgct

SEQ ID NO: 6682016 - DNA, 19 bp, Homo sapiens
attttgtattgtttcaatt

SEQ ID NO: 6682017 - DNA, 15 bp, Homo sapiens
attttgtatttaaaa

SEQ ID NO: 6682018 - DNA, 12 bp, Homo sapiens
attttgtatttt

SEQ ID NO: 6682019 - DNA, 15 bp, Homo sapiens
attttgtattttcaa

SEQ ID NO: 6682020 - DNA, 15 bp, Homo sapiens
attttgtatttttga

SEQ ID NO: 6682021 - DNA, 17 bp, Homo sapiens
attttgtcacagctctt

SEQ ID NO: 6682022 - DNA, 16 bp, Homo sapiens
attttgtcactgctgt

SEQ ID NO: 6682023 - DNA, 19 bp, Homo sapiens
attttgtcactgctgtaaa

SEQ ID NO: 6682024 - DNA, 23 bp, Homo sapiens
attttgtccaccttttaagttaa

SEQ ID NO: 6682025 - DNA, 15 bp, Homo sapiens
attttgtcctttcat

SEQ ID NO: 6682026 - DNA, 12 bp, Homo sapiens
attttgtctaaa

SEQ ID NO: 6682027 - DNA, 20 bp, Homo sapiens
attttgtctctagttgactt

SEQ ID NO: 6682028 - DNA, 21 bp, Homo sapiens
attttgtctctctcacattaa

SEQ ID NO: 6682029 - DNA, 20 bp, Homo sapiens
attttgtctgcttagtatct

SEQ ID NO: 6682030 - DNA, 16 bp, Homo sapiens
attttgtcttaagtgt

SEQ ID NO: 6682031 - DNA, 17 bp, Homo sapiens
attttgtcttaagtgtt

SEQ ID NO: 6682032 - DNA, 19 bp, Homo sapiens
attttgtgaaacagacttg

SEQ ID NO: 6682033 - DNA, 20 bp, Homo sapiens
attttgtgaaacagacttgt

SEQ ID NO: 6682034 - DNA, 21 bp, Homo sapiens
attttgtgaaacagacttgta

SEQ ID NO: 6682035 - DNA, 22 bp, Homo sapiens
attttgtgaaacagacttgtat

SEQ ID NO: 6682036 - DNA, 13 bp, Homo sapiens
attttgtgaaatt

SEQ ID NO: 6682037 - DNA, 16 bp, Homo sapiens
attttgtgaaatttca

SEQ ID NO: 6682038 - DNA, 15 bp, Homo sapiens
attttgtgagtttgt

SEQ ID NO: 6682039 - DNA, 19 bp, Homo sapiens
attttgtgagtttgtttct

SEQ ID NO: 6682040 - DNA, 23 bp, Homo sapiens
attttgtgagtttgtttctttga

SEQ ID NO: 6682041 - DNA, 13 bp, Homo sapiens
attttgtgatgaa

SEQ ID NO: 6682042 - DNA, 19 bp, Homo sapiens
attttgtgatgaataaaat

SEQ ID NO: 6682043 - DNA, 22 bp, Homo sapiens
attttgtgatgatgctgtgaca

SEQ ID NO: 6682044 - DNA, 18 bp, Homo sapiens
attttgtgatgcaaataa

SEQ ID NO: 6682045 - DNA, 14 bp, Homo sapiens
attttgtgcaaaaa

SEQ ID NO: 6682046 - DNA, 17 bp, Homo sapiens
attttgtgcattctttg

SEQ ID NO: 6682047 - DNA, 19 bp, Homo sapiens
attttgtgcattctttggt

SEQ ID NO: 6682048 - DNA, 20 bp, Homo sapiens
attttgtgcattctttggta

SEQ ID NO: 6682049 - DNA, 22 bp, Homo sapiens
attttgtggctgatttcaaatg

SEQ ID NO: 6682050 - DNA, 21 bp, Homo sapiens
attttgtgggaatttaagagc

SEQ ID NO: 6682051 - DNA, 18 bp, Homo sapiens
attttgtggttctatttt

SEQ ID NO: 6682052 - DNA, 13 bp, Homo sapiens
attttgtgtaaaa

SEQ ID NO: 6682053 - DNA, 16 bp, Homo sapiens
attttgtgtaagaaat

SEQ ID NO: 6682054 - DNA, 17 bp, Homo sapiens
attttgtgtaagaaata

SEQ ID NO: 6682055 - DNA, 14 bp, Homo sapiens
attttgtgtacagt

SEQ ID NO: 6682056 - DNA, 17 bp, Homo sapiens
attttgtgtataatgtg

SEQ ID NO: 6682057 - DNA, 21 bp, Homo sapiens
attttgtgtataatgtgcttt

SEQ ID NO: 6682058 - DNA, 12 bp, Homo sapiens
attttgtgtcct

SEQ ID NO: 6682059 - DNA, 13 bp, Homo sapiens
attttgtgtctta

SEQ ID NO: 6682060 - DNA, 15 bp, Homo sapiens
attttgtgtcttaag

SEQ ID NO: 6682061 - DNA, 14 bp, Homo sapiens
attttgtgtgacca

SEQ ID NO: 6682062 - DNA, 18 bp, Homo sapiens
attttgtgtgaccaactg

SEQ ID NO: 6682063 - DNA, 14 bp, Homo sapiens
attttgtgtgattg

SEQ ID NO: 6682064 - DNA, 17 bp, Homo sapiens
attttgtgttgaagagc

SEQ ID NO: 6682065 - DNA, 14 bp, Homo sapiens
attttgtgttgcta

SEQ ID NO: 6682066 - DNA, 15 bp, Homo sapiens
attttgtgttgctaa

SEQ ID NO: 6682067 - DNA, 17 bp, Homo sapiens
attttgtgtttattctt

SEQ ID NO: 6682068 - DNA, 20 bp, Homo sapiens
attttgtgtttattcttgat

SEQ ID NO: 6682069 - DNA, 17 bp, Homo sapiens
attttgttagattttgc

SEQ ID NO: 6682070 - DNA, 18 bp, Homo sapiens
attttgttatagaatact

SEQ ID NO: 6682071 - DNA, 21 bp, Homo sapiens
attttgttatagttcatagtt

SEQ ID NO: 6682072 - DNA, 18 bp, Homo sapiens
attttgttcaagtttgct

SEQ ID NO: 6682073 - DNA, 18 bp, Homo sapiens
attttgttctagttttca

SEQ ID NO: 6682074 - DNA, 14 bp, Homo sapiens
attttgttctctgg

SEQ ID NO: 6682075 - DNA, 16 bp, Homo sapiens
attttgttctctggga

SEQ ID NO: 6682076 - DNA, 21 bp, Homo sapiens
attttgttctctgggagaaaa

SEQ ID NO: 6682077 - DNA, 12 bp, Homo sapiens
attttgttctga

SEQ ID NO: 6682078 - DNA, 14 bp, Homo sapiens
attttgttcttatt

SEQ ID NO: 6682079 - DNA, 20 bp, Homo sapiens
attttgttgcttttgtgaac

SEQ ID NO: 6682080 - DNA, 13 bp, Homo sapiens
attttgttgtaaa

SEQ ID NO: 6682081 - DNA, 18 bp, Homo sapiens
attttgttgtaaaaagaa

SEQ ID NO: 6682082 - DNA, 14 bp, Homo sapiens
attttgttgtgatt

SEQ ID NO: 6682083 - DNA, 23 bp, Homo sapiens
attttgttgtgattttgtacaga

SEQ ID NO: 6682084 - DNA, 15 bp, Homo sapiens
attttgttgttcctc

SEQ ID NO: 6682085 - DNA, 17 bp, Homo sapiens
attttgtttaaaaaatc

SEQ ID NO: 6682086 - DNA, 15 bp, Homo sapiens
attttgtttaaatta

SEQ ID NO: 6682087 - DNA, 12 bp, Homo sapiens
attttgtttaca

SEQ ID NO: 6682088 - DNA, 14 bp, Homo sapiens
attttgtttcaatc

SEQ ID NO: 6682089 - DNA, 19 bp, Homo sapiens
attttgtttcaatctctga

SEQ ID NO: 6682090 - DNA, 22 bp, Homo sapiens
attttgtttcagaattttgtat

SEQ ID NO: 6682091 - DNA, 13 bp, Homo sapiens
attttgtttccaa

SEQ ID NO: 6682092 - DNA, 19 bp, Homo sapiens
attttgtttccaaagctga

SEQ ID NO: 6682093 - DNA, 15 bp, Homo sapiens
attttgtttctgtac

SEQ ID NO: 6682094 - DNA, 22 bp, Homo sapiens
attttgtttggtattgtattta

SEQ ID NO: 6682095 - DNA, 16 bp, Homo sapiens
attttgtttgtaatcc

SEQ ID NO: 6682096 - DNA, 15 bp, Homo sapiens
attttgttttaaact

SEQ ID NO: 6682097 - DNA, 18 bp, Homo sapiens
attttgttttaaactgtg

SEQ ID NO: 6682098 - DNA, 17 bp, Homo sapiens
attttgttttacttttt

SEQ ID NO: 6682099 - DNA, 19 bp, Homo sapiens
attttgttttgctttttct

SEQ ID NO: 6682100 - DNA, 21 bp, Homo sapiens
attttgttttgctttttctga

SEQ ID NO: 6682101 - DNA, 22 bp, Homo sapiens
attttgttttgctttttctgac

SEQ ID NO: 6682102 - DNA, 21 bp, Homo sapiens
attttgtttttactgtatgtt

SEQ ID NO: 6682103 - DNA, 14 bp, Homo sapiens
atttttaaaaaaca

SEQ ID NO: 6682104 - DNA, 14 bp, Homo sapiens
atttttaaaaaata

SEQ ID NO: 6682105 - DNA, 15 bp, Homo sapiens
atttttaaaaaatat

SEQ ID NO: 6682106 - DNA, 19 bp, Homo sapiens
atttttaaaaaatattttc

SEQ ID NO: 6682107 - DNA, 21 bp, Homo sapiens
atttttaaaactagcaactct

SEQ ID NO: 6682108 - DNA, 19 bp, Homo sapiens
atttttaaaagaaaaaaac

SEQ ID NO: 6682109 - DNA, 13 bp, Homo sapiens
atttttaaaagcc

SEQ ID NO: 6682110 - DNA, 12 bp, Homo sapiens
atttttaaaagg

SEQ ID NO: 6682111 - DNA, 13 bp, Homo sapiens
atttttaaaataa

SEQ ID NO: 6682112 - DNA, 20 bp, Homo sapiens
atttttaaaataaaaatatt

SEQ ID NO: 6682113 - DNA, 16 bp, Homo sapiens
atttttaaaataaact

SEQ ID NO: 6682114 - DNA, 15 bp, Homo sapiens
atttttaaaatactt

SEQ ID NO: 6682115 - DNA, 18 bp, Homo sapiens
atttttaaaatatgtttt

SEQ ID NO: 6682116 - DNA, 20 bp, Homo sapiens
atttttaaaatatttaactt

SEQ ID NO: 6682117 - DNA, 17 bp, Homo sapiens
atttttaaaatatttat

SEQ ID NO: 6682118 - DNA, 14 bp, Homo sapiens
atttttaaaatctg

SEQ ID NO: 6682119 - DNA, 14 bp, Homo sapiens
atttttaaaatgaa

SEQ ID NO: 6682120 - DNA, 16 bp, Homo sapiens
atttttaaaatgtaca

SEQ ID NO: 6682121 - DNA, 21 bp, Homo sapiens
atttttaaacaggtggtgaga

SEQ ID NO: 6682122 - DNA, 12 bp, Homo sapiens
atttttaaacta

SEQ ID NO: 6682123 - DNA, 18 bp, Homo sapiens
atttttaaacttgaaata

SEQ ID NO: 6682124 - DNA, 20 bp, Homo sapiens
atttttaaagaaaagttttg

SEQ ID NO: 6682125 - DNA, 13 bp, Homo sapiens
atttttaaagaag

SEQ ID NO: 6682126 - DNA, 18 bp, Homo sapiens
atttttaaagaatgttag

SEQ ID NO: 6682127 - DNA, 17 bp, Homo sapiens
atttttaaagcaaaaaa

SEQ ID NO: 6682128 - DNA, 14 bp, Homo sapiens
atttttaaagcatg

SEQ ID NO: 6682129 - DNA, 15 bp, Homo sapiens
atttttaaagcatgg

SEQ ID NO: 6682130 - DNA, 12 bp, Homo sapiens
atttttaaaggt

SEQ ID NO: 6682131 - DNA, 20 bp, Homo sapiens
atttttaaagtactttctta

SEQ ID NO: 6682132 - DNA, 14 bp, Homo sapiens
atttttaaagtaga

SEQ ID NO: 6682133 - DNA, 18 bp, Homo sapiens
atttttaaagtttaaata

SEQ ID NO: 6682134 - DNA, 11 bp, Homo sapiens
atttttaaatc

SEQ ID NO: 6682135 - DNA, 19 bp, Homo sapiens
atttttaaatcatttcatg

SEQ ID NO: 6682136 - DNA, 14 bp, Homo sapiens
atttttaaattata

SEQ ID NO: 6682137 - DNA, 13 bp, Homo sapiens
atttttaaattct

SEQ ID NO: 6682138 - DNA, 12 bp, Homo sapiens
atttttaaattg

SEQ ID NO: 6682139 - DNA, 21 bp, Homo sapiens
atttttaaattggagaaaagc

SEQ ID NO: 6682140 - DNA, 13 bp, Homo sapiens
atttttaaattgt

SEQ ID NO: 6682141 - DNA, 14 bp, Homo sapiens
atttttaaattgtt

SEQ ID NO: 6682142 - DNA, 15 bp, Homo sapiens
atttttaaattttct

SEQ ID NO: 6682143 - DNA, 16 bp, Homo sapiens
atttttaacacttaaa

SEQ ID NO: 6682144 - DNA, 21 bp, Homo sapiens
atttttaacacttaaatttct

SEQ ID NO: 6682145 - DNA, 20 bp, Homo sapiens
atttttaacttttggaatca

SEQ ID NO: 6682146 - DNA, 24 bp, Homo sapiens
atttttaacttttggaatcatact

SEQ ID NO: 6682147 - DNA, 19 bp, Homo sapiens
atttttaagaaaggaagca

SEQ ID NO: 6682148 - DNA, 15 bp, Homo sapiens
atttttaagaaagta

SEQ ID NO: 6682149 - DNA, 19 bp, Homo sapiens
atttttaagaaagtaattt

SEQ ID NO: 6682150 - DNA, 14 bp, Homo sapiens
atttttaagaactt

SEQ ID NO: 6682151 - DNA, 17 bp, Homo sapiens
atttttaagactgtaat

SEQ ID NO: 6682152 - DNA, 20 bp, Homo sapiens
atttttaagataataatata

SEQ ID NO: 6682153 - DNA, 22 bp, Homo sapiens
atttttaagataataatatatg

SEQ ID NO: 6682154 - DNA, 21 bp, Homo sapiens
atttttaagcaaaatattatt

SEQ ID NO: 6682155 - DNA, 21 bp, Homo sapiens
atttttaagctccatgtgcat

SEQ ID NO: 6682156 - DNA, 23 bp, Homo sapiens
atttttaagctccatgtgcatat

SEQ ID NO: 6682157 - DNA, 14 bp, Homo sapiens
atttttaagtacaa

SEQ ID NO: 6682158 - DNA, 19 bp, Homo sapiens
atttttaagtacaaaaaag

SEQ ID NO: 6682159 - DNA, 21 bp, Homo sapiens
atttttaagtacaaaaaagtt

SEQ ID NO: 6682160 - DNA, 14 bp, Homo sapiens
atttttaagtggtt

SEQ ID NO: 6682161 - DNA, 20 bp, Homo sapiens
atttttaagtgtcagactat

SEQ ID NO: 6682162 - DNA, 18 bp, Homo sapiens
atttttaatatgtaagga

SEQ ID NO: 6682163 - DNA, 15 bp, Homo sapiens
atttttaatatgttg

SEQ ID NO: 6682164 - DNA, 12 bp, Homo sapiens
atttttaatcag

SEQ ID NO: 6682165 - DNA, 16 bp, Homo sapiens
atttttaatcatgaaa

SEQ ID NO: 6682166 - DNA, 13 bp, Homo sapiens
atttttaatgact

SEQ ID NO: 6682167 - DNA, 18 bp, Homo sapiens
atttttaatgacttttta

SEQ ID NO: 6682168 - DNA, 21 bp, Homo sapiens
atttttaatgcaccaatcttg

SEQ ID NO: 6682169 - DNA, 13 bp, Homo sapiens
atttttaatgtat

SEQ ID NO: 6682170 - DNA, 14 bp, Homo sapiens
atttttaatgtatc

SEQ ID NO: 6682171 - DNA, 17 bp, Homo sapiens
atttttaatgtatctat

SEQ ID NO: 6682172 - DNA, 22 bp, Homo sapiens
atttttaatgtatctatttgta

SEQ ID NO: 6682173 - DNA, 23 bp, Homo sapiens
atttttaatgtatctatttgtac

SEQ ID NO: 6682174 - DNA, 13 bp, Homo sapiens
atttttaatgttt

SEQ ID NO: 6682175 - DNA, 15 bp, Homo sapiens
atttttaattaaaaa

SEQ ID NO: 6682176 - DNA, 18 bp, Homo sapiens
atttttaattaaaaacta

SEQ ID NO: 6682177 - DNA, 18 bp, Homo sapiens
atttttaatttaacaaac

SEQ ID NO: 6682178 - DNA, 15 bp, Homo sapiens
atttttaatttatga

SEQ ID NO: 6682179 - DNA, 16 bp, Homo sapiens
atttttaattttcaca

SEQ ID NO: 6682180 - DNA, 18 bp, Homo sapiens
atttttacaaataaagat

SEQ ID NO: 6682181 - DNA, 17 bp, Homo sapiens
atttttacaaataggta

SEQ ID NO: 6682182 - DNA, 20 bp, Homo sapiens
atttttacaaataggtagag

SEQ ID NO: 6682183 - DNA, 20 bp, Homo sapiens
atttttacaagaagtttatt

SEQ ID NO: 6682184 - DNA, 16 bp, Homo sapiens
atttttacaagatcca

SEQ ID NO: 6682185 - DNA, 23 bp, Homo sapiens
atttttacaagatccatttgcct

SEQ ID NO: 6682186 - DNA, 16 bp, Homo sapiens
atttttacaagttata

SEQ ID NO: 6682187 - DNA, 17 bp, Homo sapiens
atttttacaatgtaatt

SEQ ID NO: 6682188 - DNA, 18 bp, Homo sapiens
atttttacaatgtaatta

SEQ ID NO: 6682189 - DNA, 19 bp, Homo sapiens
atttttacactattgtgaa

SEQ ID NO: 6682190 - DNA, 16 bp, Homo sapiens
atttttacattctgaa

SEQ ID NO: 6682191 - DNA, 23 bp, Homo sapiens
atttttaccaactctatactcaa

SEQ ID NO: 6682192 - DNA, 11 bp, Homo sapiens
atttttaccag

SEQ ID NO: 6682193 - DNA, 17 bp, Homo sapiens
atttttaccctaatgtc

SEQ ID NO: 6682194 - DNA, 21 bp, Homo sapiens
atttttaccctaatgtcttca

SEQ ID NO: 6682195 - DNA, 19 bp, Homo sapiens
atttttaccgtttcttccc

SEQ ID NO: 6682196 - DNA, 12 bp, Homo sapiens
atttttacctaa

SEQ ID NO: 6682197 - DNA, 16 bp, Homo sapiens
atttttacctaaagac

SEQ ID NO: 6682198 - DNA, 16 bp, Homo sapiens
atttttacctgctttt

SEQ ID NO: 6682199 - DNA, 21 bp, Homo sapiens
atttttacgtagaagctcttg

SEQ ID NO: 6682200 - DNA, 14 bp, Homo sapiens
atttttactaaagc

SEQ ID NO: 6682201 - DNA, 18 bp, Homo sapiens
atttttactaaagcagtg

SEQ ID NO: 6682202 - DNA, 19 bp, Homo sapiens
atttttactactattctgt

SEQ ID NO: 6682203 - DNA, 20 bp, Homo sapiens
atttttactattgaactgta

SEQ ID NO: 6682204 - DNA, 14 bp, Homo sapiens
atttttactcaggc

SEQ ID NO: 6682205 - DNA, 18 bp, Homo sapiens
atttttactcaggctttc

SEQ ID NO: 6682206 - DNA, 20 bp, Homo sapiens
atttttactcaggctttcta

SEQ ID NO: 6682207 - DNA, 14 bp, Homo sapiens
atttttactgccac

SEQ ID NO: 6682208 - DNA, 23 bp, Homo sapiens
atttttagaataagaatttgcat

SEQ ID NO: 6682209 - DNA, 18 bp, Homo sapiens
atttttagactatttctt

SEQ ID NO: 6682210 - DNA, 22 bp, Homo sapiens
atttttagatggttacactgtt

SEQ ID NO: 6682211 - DNA, 20 bp, Homo sapiens
atttttagccataattttgc

SEQ ID NO: 6682212 - DNA, 17 bp, Homo sapiens
atttttagccattgtcg

SEQ ID NO: 6682213 - DNA, 22 bp, Homo sapiens
atttttagcctgtgtcattgcc

SEQ ID NO: 6682214 - DNA, 16 bp, Homo sapiens
atttttagtaaccttt

SEQ ID NO: 6682215 - DNA, 14 bp, Homo sapiens
atttttagtagaga

SEQ ID NO: 6682216 - DNA, 21 bp, Homo sapiens
atttttagtagagatggggtt

SEQ ID NO: 6682217 - DNA, 23 bp, Homo sapiens
atttttagtttaaaatcttgcat

SEQ ID NO: 6682218 - DNA, 12 bp, Homo sapiens
atttttataaaa

SEQ ID NO: 6682219 - DNA, 15 bp, Homo sapiens
atttttataaattac

SEQ ID NO: 6682220 - DNA, 15 bp, Homo sapiens
atttttataatgact

SEQ ID NO: 6682221 - DNA, 17 bp, Homo sapiens
atttttataatgactgg

SEQ ID NO: 6682222 - DNA, 23 bp, Homo sapiens
atttttataattaaagatgccat

SEQ ID NO: 6682223 - DNA, 21 bp, Homo sapiens
atttttataattgtacaaaat

SEQ ID NO: 6682224 - DNA, 18 bp, Homo sapiens
atttttataattttatct

SEQ ID NO: 6682225 - DNA, 13 bp, Homo sapiens
atttttatacact

SEQ ID NO: 6682226 - DNA, 23 bp, Homo sapiens
atttttatacactgtaagctttg

SEQ ID NO: 6682227 - DNA, 22 bp, Homo sapiens
atttttatacatatcagaaaag

SEQ ID NO: 6682228 - DNA, 23 bp, Homo sapiens
atttttatacatatcagaaaagt

SEQ ID NO: 6682229 - DNA, 15 bp, Homo sapiens
atttttatactcaga

SEQ ID NO: 6682230 - DNA, 16 bp, Homo sapiens
atttttatactttatt

SEQ ID NO: 6682231 - DNA, 23 bp, Homo sapiens
atttttatataatatctaaagtt

SEQ ID NO: 6682232 - DNA, 17 bp, Homo sapiens
atttttatatcatgcaa

SEQ ID NO: 6682233 - DNA, 16 bp, Homo sapiens
atttttatatgaaata

SEQ ID NO: 6682234 - DNA, 16 bp, Homo sapiens
atttttatattctata

SEQ ID NO: 6682235 - DNA, 22 bp, Homo sapiens
atttttatattgtttttgtatt

SEQ ID NO: 6682236 - DNA, 16 bp, Homo sapiens
atttttatatttgaaa

SEQ ID NO: 6682237 - DNA, 18 bp, Homo sapiens
atttttatccaatcttgt

SEQ ID NO: 6682238 - DNA, 14 bp, Homo sapiens
atttttatctccaa

SEQ ID NO: 6682239 - DNA, 17 bp, Homo sapiens
atttttatctgaagcta

SEQ ID NO: 6682240 - DNA, 19 bp, Homo sapiens
atttttatctttcgtgata

SEQ ID NO: 6682241 - DNA, 11 bp, Homo sapiens
atttttatgat

SEQ ID NO: 6682242 - DNA, 17 bp, Homo sapiens
atttttatgatgatgaa

SEQ ID NO: 6682243 - DNA, 13 bp, Homo sapiens
atttttatgtaaa

SEQ ID NO: 6682244 - DNA, 22 bp, Homo sapiens
atttttatgtaattatatatac

SEQ ID NO: 6682245 - DNA, 13 bp, Homo sapiens
atttttatgtgaa

SEQ ID NO: 6682246 - DNA, 23 bp, Homo sapiens
atttttatgttttgaaagacaga

SEQ ID NO: 6682247 - DNA, 14 bp, Homo sapiens
atttttattaaatg

SEQ ID NO: 6682248 - DNA, 15 bp, Homo sapiens
atttttattaaatgt

SEQ ID NO: 6682249 - DNA, 12 bp, Homo sapiens
atttttattata

SEQ ID NO: 6682250 - DNA, 13 bp, Homo sapiens
atttttattatta

SEQ ID NO: 6682251 - DNA, 15 bp, Homo sapiens
atttttattatttgt

SEQ ID NO: 6682252 - DNA, 14 bp, Homo sapiens
atttttattcatgt

SEQ ID NO: 6682253 - DNA, 12 bp, Homo sapiens
atttttattgtt

SEQ ID NO: 6682254 - DNA, 13 bp, Homo sapiens
atttttatttatg

SEQ ID NO: 6682255 - DNA, 14 bp, Homo sapiens
atttttatttatga

SEQ ID NO: 6682256 - DNA, 21 bp, Homo sapiens
atttttatttcagattttgat

SEQ ID NO: 6682257 - DNA, 13 bp, Homo sapiens
atttttatttcta

SEQ ID NO: 6682258 - DNA, 18 bp, Homo sapiens
atttttatttctttttaa

SEQ ID NO: 6682259 - DNA, 14 bp, Homo sapiens
atttttatttttga

SEQ ID NO: 6682260 - DNA, 18 bp, Homo sapiens
atttttatttttgcacaa

SEQ ID NO: 6682261 - DNA, 21 bp, Homo sapiens
atttttcaaaacatacaagca

SEQ ID NO: 6682262 - DNA, 15 bp, Homo sapiens
atttttcaaaatcaa

SEQ ID NO: 6682263 - DNA, 17 bp, Homo sapiens
atttttcaaaatcgttt

SEQ ID NO: 6682264 - DNA, 21 bp, Homo sapiens
atttttcaaaattatatgtat

SEQ ID NO: 6682265 - DNA, 19 bp, Homo sapiens
atttttcaaatcattcctt

SEQ ID NO: 6682266 - DNA, 22 bp, Homo sapiens
atttttcaaccccaccctgttt

SEQ ID NO: 6682267 - DNA, 17 bp, Homo sapiens
atttttcaactttgaat

SEQ ID NO: 6682268 - DNA, 12 bp, Homo sapiens
atttttcaaggc

SEQ ID NO: 6682269 - DNA, 20 bp, Homo sapiens
atttttcaatagcacatatg

SEQ ID NO: 6682270 - DNA, 21 bp, Homo sapiens
atttttcacatatctagtatg

SEQ ID NO: 6682271 - DNA, 17 bp, Homo sapiens
atttttcactgtacatt

SEQ ID NO: 6682272 - DNA, 15 bp, Homo sapiens
atttttcacttcaaa

SEQ ID NO: 6682273 - DNA, 15 bp, Homo sapiens
atttttcagaaaaat

SEQ ID NO: 6682274 - DNA, 17 bp, Homo sapiens
atttttcagagaataga

SEQ ID NO: 6682275 - DNA, 19 bp, Homo sapiens
atttttcagagttttctaa

SEQ ID NO: 6682276 - DNA, 14 bp, Homo sapiens
atttttcagatgct

SEQ ID NO: 6682277 - DNA, 20 bp, Homo sapiens
atttttcagctctctgtata

SEQ ID NO: 6682278 - DNA, 18 bp, Homo sapiens
atttttcagttccaagaa

SEQ ID NO: 6682279 - DNA, 22 bp, Homo sapiens
atttttcagttccaagaaagat

SEQ ID NO: 6682280 - DNA, 12 bp, Homo sapiens
atttttcatatt

SEQ ID NO: 6682281 - DNA, 18 bp, Homo sapiens
atttttcatattgtgcca

SEQ ID NO: 6682282 - DNA, 19 bp, Homo sapiens
atttttcatattgtgccaa

SEQ ID NO: 6682283 - DNA, 18 bp, Homo sapiens
atttttcatctttaagaa

SEQ ID NO: 6682284 - DNA, 21 bp, Homo sapiens
atttttcattacctgtagctt

SEQ ID NO: 6682285 - DNA, 13 bp, Homo sapiens
atttttcattcat

SEQ ID NO: 6682286 - DNA, 19 bp, Homo sapiens
atttttcattgatatgaaa

SEQ ID NO: 6682287 - DNA, 23 bp, Homo sapiens
atttttccaaatgaaaaatctca

SEQ ID NO: 6682288 - DNA, 13 bp, Homo sapiens
atttttccaacta

SEQ ID NO: 6682289 - DNA, 15 bp, Homo sapiens
atttttccaggactc

SEQ ID NO: 6682290 - DNA, 15 bp, Homo sapiens
atttttccatctgtg

SEQ ID NO: 6682291 - DNA, 16 bp, Homo sapiens
atttttccatctgtgt

SEQ ID NO: 6682292 - DNA, 19 bp, Homo sapiens
atttttccatgacattttt

SEQ ID NO: 6682293 - DNA, 16 bp, Homo sapiens
atttttccatttgtat

SEQ ID NO: 6682294 - DNA, 12 bp, Homo sapiens
atttttcccagg

SEQ ID NO: 6682295 - DNA, 17 bp, Homo sapiens
atttttcccaggacagg

SEQ ID NO: 6682296 - DNA, 15 bp, Homo sapiens
atttttcccagtatt

SEQ ID NO: 6682297 - DNA, 13 bp, Homo sapiens
atttttccctccg

SEQ ID NO: 6682298 - DNA, 12 bp, Homo sapiens
atttttcctgca

SEQ ID NO: 6682299 - DNA, 14 bp, Homo sapiens
atttttcctgcatg

SEQ ID NO: 6682300 - DNA, 15 bp, Homo sapiens
atttttcctgtcctg

SEQ ID NO: 6682301 - DNA, 16 bp, Homo sapiens
atttttcctgtcctgc

SEQ ID NO: 6682302 - DNA, 22 bp, Homo sapiens
atttttcggaggccccactgat

SEQ ID NO: 6682303 - DNA, 15 bp, Homo sapiens
atttttctaaagaaa

SEQ ID NO: 6682304 - DNA, 19 bp, Homo sapiens
atttttctaaagaaatata

SEQ ID NO: 6682305 - DNA, 19 bp, Homo sapiens
atttttctaactacaaagg

SEQ ID NO: 6682306 - DNA, 22 bp, Homo sapiens
atttttctagtcagtaaacatt

SEQ ID NO: 6682307 - DNA, 19 bp, Homo sapiens
atttttctataaatcagta

SEQ ID NO: 6682308 - DNA, 21 bp, Homo sapiens
atttttctcacctagctgctc

SEQ ID NO: 6682309 - DNA, 19 bp, Homo sapiens
atttttctcagtttgtata

SEQ ID NO: 6682310 - DNA, 11 bp, Homo sapiens
atttttctcca

SEQ ID NO: 6682311 - DNA, 15 bp, Homo sapiens
atttttctcccaaga

SEQ ID NO: 6682312 - DNA, 20 bp, Homo sapiens
atttttctcccaagaaacct

SEQ ID NO: 6682313 - DNA, 14 bp, Homo sapiens
atttttctctccct

SEQ ID NO: 6682314 - DNA, 15 bp, Homo sapiens
atttttctctccctc

SEQ ID NO: 6682315 - DNA, 12 bp, Homo sapiens
atttttctctct

SEQ ID NO: 6682316 - DNA, 12 bp, Homo sapiens
atttttctcttc

SEQ ID NO: 6682317 - DNA, 15 bp, Homo sapiens
atttttctcttgtac

SEQ ID NO: 6682318 - DNA, 17 bp, Homo sapiens
atttttctcttgtacca

SEQ ID NO: 6682319 - DNA, 18 bp, Homo sapiens
atttttctcttgtaccat

SEQ ID NO: 6682320 - DNA, 15 bp, Homo sapiens
atttttctctttctc

SEQ ID NO: 6682321 - DNA, 19 bp, Homo sapiens
atttttctgaggtccttat

SEQ ID NO: 6682322 - DNA, 13 bp, Homo sapiens
atttttctgatgg

SEQ ID NO: 6682323 - DNA, 12 bp, Homo sapiens
atttttctgcac

SEQ ID NO: 6682324 - DNA, 14 bp, Homo sapiens
atttttctgcactg

SEQ ID NO: 6682325 - DNA, 16 bp, Homo sapiens
atttttctgcactgag

SEQ ID NO: 6682326 - DNA, 15 bp, Homo sapiens
atttttctgccctgg

SEQ ID NO: 6682327 - DNA, 21 bp, Homo sapiens
atttttctggaggttgataac

SEQ ID NO: 6682328 - DNA, 23 bp, Homo sapiens
atttttctgggcttttccttttg

SEQ ID NO: 6682329 - DNA, 18 bp, Homo sapiens
atttttcttaatcaagaa

SEQ ID NO: 6682330 - DNA, 21 bp, Homo sapiens
atttttcttagggaaggatac

SEQ ID NO: 6682331 - DNA, 20 bp, Homo sapiens
atttttcttatttatgtaac

SEQ ID NO: 6682332 - DNA, 15 bp, Homo sapiens
atttttcttccagga

SEQ ID NO: 6682333 - DNA, 17 bp, Homo sapiens
atttttcttcttttact

SEQ ID NO: 6682334 - DNA, 22 bp, Homo sapiens
atttttcttggatctttttgca

SEQ ID NO: 6682335 - DNA, 14 bp, Homo sapiens
atttttctttaaag

SEQ ID NO: 6682336 - DNA, 15 bp, Homo sapiens
atttttctttaactg

SEQ ID NO: 6682337 - DNA, 16 bp, Homo sapiens
atttttctttacaaaa

SEQ ID NO: 6682338 - DNA, 18 bp, Homo sapiens
atttttctttattgctta

SEQ ID NO: 6682339 - DNA, 20 bp, Homo sapiens
atttttcttttaaagatttg

SEQ ID NO: 6682340 - DNA, 20 bp, Homo sapiens
atttttcttttattcttctt

SEQ ID NO: 6682341 - DNA, 17 bp, Homo sapiens
atttttcttttcttgat

SEQ ID NO: 6682342 - DNA, 14 bp, Homo sapiens
atttttctttttaa

SEQ ID NO: 6682343 - DNA, 10 bp, Homo sapiens
atttttgaaa

SEQ ID NO: 6682344 - DNA, 18 bp, Homo sapiens
atttttgaaaaatattgc

SEQ ID NO: 6682345 - DNA, 21 bp, Homo sapiens
atttttgaaaaatattgctaa

SEQ ID NO: 6682346 - DNA, 22 bp, Homo sapiens
atttttgaaaaatattgctaaa

SEQ ID NO: 6682347 - DNA, 22 bp, Homo sapiens
atttttgaaaatcctgaataaa

SEQ ID NO: 6682348 - DNA, 20 bp, Homo sapiens
atttttgaaactgcatttgt

SEQ ID NO: 6682349 - DNA, 21 bp, Homo sapiens
atttttgaaagaattctattt

SEQ ID NO: 6682350 - DNA, 19 bp, Homo sapiens
atttttgaagcaaagaagg

SEQ ID NO: 6682351 - DNA, 21 bp, Homo sapiens
atttttgaagtaaattaaaca

SEQ ID NO: 6682352 - DNA, 17 bp, Homo sapiens
atttttgaatgtagtaa

SEQ ID NO: 6682353 - DNA, 15 bp, Homo sapiens
atttttgaatgtgat

SEQ ID NO: 6682354 - DNA, 15 bp, Homo sapiens
atttttgacactttt

SEQ ID NO: 6682355 - DNA, 18 bp, Homo sapiens
atttttgacactttttgt

SEQ ID NO: 6682356 - DNA, 18 bp, Homo sapiens
atttttgacatggaaatg

SEQ ID NO: 6682357 - DNA, 17 bp, Homo sapiens
atttttgagcaggagca

SEQ ID NO: 6682358 - DNA, 18 bp, Homo sapiens
atttttgagcccttgttt

SEQ ID NO: 6682359 - DNA, 13 bp, Homo sapiens
atttttgaggaat

SEQ ID NO: 6682360 - DNA, 20 bp, Homo sapiens
atttttgagtaaaacttgta

SEQ ID NO: 6682361 - DNA, 21 bp, Homo sapiens
atttttgataaagcctcaagg

SEQ ID NO: 6682362 - DNA, 23 bp, Homo sapiens
atttttgatacagttttcagaaa

SEQ ID NO: 6682363 - DNA, 17 bp, Homo sapiens
atttttgataccttcaa

SEQ ID NO: 6682364 - DNA, 21 bp, Homo sapiens
atttttgatactaagcattga

SEQ ID NO: 6682365 - DNA, 17 bp, Homo sapiens
atttttgatcaaatgta

SEQ ID NO: 6682366 - DNA, 19 bp, Homo sapiens
atttttgatcaaatgtaca

SEQ ID NO: 6682367 - DNA, 21 bp, Homo sapiens
atttttgatctttgagtgtat

SEQ ID NO: 6682368 - DNA, 12 bp, Homo sapiens
atttttgatgta

SEQ ID NO: 6682369 - DNA, 20 bp, Homo sapiens
atttttgattaacaatgtat

SEQ ID NO: 6682370 - DNA, 15 bp, Homo sapiens
atttttgattcagct

SEQ ID NO: 6682371 - DNA, 16 bp, Homo sapiens
atttttgattgtgttg

SEQ ID NO: 6682372 - DNA, 19 bp, Homo sapiens
atttttgcaataatgcagt

SEQ ID NO: 6682373 - DNA, 20 bp, Homo sapiens
atttttgcaataatgcagta

SEQ ID NO: 6682374 - DNA, 19 bp, Homo sapiens
atttttgcaataccaagta

SEQ ID NO: 6682375 - DNA, 14 bp, Homo sapiens
atttttgcatgttt

SEQ ID NO: 6682376 - DNA, 15 bp, Homo sapiens
atttttgcatgttta

SEQ ID NO: 6682377 - DNA, 16 bp, Homo sapiens
atttttgcatgtttaa

SEQ ID NO: 6682378 - DNA, 22 bp, Homo sapiens
atttttgccctgagtccaagag

SEQ ID NO: 6682379 - DNA, 21 bp, Homo sapiens
atttttgcctcttccagtctt

SEQ ID NO: 6682380 - DNA, 20 bp, Homo sapiens
atttttgctccaatatccat

SEQ ID NO: 6682381 - DNA, 15 bp, Homo sapiens
atttttgctgaattc

SEQ ID NO: 6682382 - DNA, 20 bp, Homo sapiens
atttttgctgaattcatcta

SEQ ID NO: 6682383 - DNA, 10 bp, Homo sapiens
atttttgctt

SEQ ID NO: 6682384 - DNA, 16 bp, Homo sapiens
atttttgcttgacttc

SEQ ID NO: 6682385 - DNA, 23 bp, Homo sapiens
atttttggaagaggactccttaa

SEQ ID NO: 6682386 - DNA, 21 bp, Homo sapiens
atttttggacttagtgcaaca

SEQ ID NO: 6682387 - DNA, 19 bp, Homo sapiens
atttttggaggtttattac

SEQ ID NO: 6682388 - DNA, 18 bp, Homo sapiens
atttttggagtttaccac

SEQ ID NO: 6682389 - DNA, 17 bp, Homo sapiens
atttttggattgacagt

SEQ ID NO: 6682390 - DNA, 19 bp, Homo sapiens
atttttggattgacagtaa

SEQ ID NO: 6682391 - DNA, 18 bp, Homo sapiens
atttttggatttctgtga

SEQ ID NO: 6682392 - DNA, 17 bp, Homo sapiens
atttttggcaaagccag

SEQ ID NO: 6682393 - DNA, 19 bp, Homo sapiens
atttttggcaaagccagaa

SEQ ID NO: 6682394 - DNA, 15 bp, Homo sapiens
atttttggcattcct

SEQ ID NO: 6682395 - DNA, 17 bp, Homo sapiens
atttttgggaggagcca

SEQ ID NO: 6682396 - DNA, 18 bp, Homo sapiens
atttttggggaaaaaagc

SEQ ID NO: 6682397 - DNA, 19 bp, Homo sapiens
atttttggggaaaaaagca

SEQ ID NO: 6682398 - DNA, 20 bp, Homo sapiens
atttttggggaaaaaagcac

SEQ ID NO: 6682399 - DNA, 22 bp, Homo sapiens
atttttggggatcatagcttgt

SEQ ID NO: 6682400 - DNA, 16 bp, Homo sapiens
atttttggggggagag

SEQ ID NO: 6682401 - DNA, 19 bp, Homo sapiens
atttttgggtttggccagg

SEQ ID NO: 6682402 - DNA, 23 bp, Homo sapiens
atttttgggtttggccagggagg

SEQ ID NO: 6682403 - DNA, 19 bp, Homo sapiens
atttttggtatttgaaaca

SEQ ID NO: 6682404 - DNA, 22 bp, Homo sapiens
atttttggtgggtgaaaggaat

SEQ ID NO: 6682405 - DNA, 15 bp, Homo sapiens
atttttggttgaata

SEQ ID NO: 6682406 - DNA, 19 bp, Homo sapiens
atttttggttgtcaatatt

SEQ ID NO: 6682407 - DNA, 13 bp, Homo sapiens
atttttgtaaaaa

SEQ ID NO: 6682408 - DNA, 18 bp, Homo sapiens
atttttgtaaagtttccg

SEQ ID NO: 6682409 - DNA, 11 bp, Homo sapiens
atttttgtaac

SEQ ID NO: 6682410 - DNA, 16 bp, Homo sapiens
atttttgtaagaaaat

SEQ ID NO: 6682411 - DNA, 12 bp, Homo sapiens
atttttgtaatg

SEQ ID NO: 6682412 - DNA, 19 bp, Homo sapiens
atttttgtaatgtgaaaag

SEQ ID NO: 6682413 - DNA, 21 bp, Homo sapiens
atttttgtacagtttgctgta

SEQ ID NO: 6682414 - DNA, 13 bp, Homo sapiens
atttttgtacatc

SEQ ID NO: 6682415 - DNA, 13 bp, Homo sapiens
atttttgtacatt

SEQ ID NO: 6682416 - DNA, 21 bp, Homo sapiens
atttttgtacattacactaaa

SEQ ID NO: 6682417 - DNA, 16 bp, Homo sapiens
atttttgtacattatg

SEQ ID NO: 6682418 - DNA, 20 bp, Homo sapiens
atttttgtacattatgttat

SEQ ID NO: 6682419 - DNA, 23 bp, Homo sapiens
atttttgtaccatattgctctta

SEQ ID NO: 6682420 - DNA, 20 bp, Homo sapiens
atttttgtacgttatatatt

SEQ ID NO: 6682421 - DNA, 13 bp, Homo sapiens
atttttgtactgt

SEQ ID NO: 6682422 - DNA, 17 bp, Homo sapiens
atttttgtactgtgctg

SEQ ID NO: 6682423 - DNA, 14 bp, Homo sapiens
atttttgtacttga

SEQ ID NO: 6682424 - DNA, 14 bp, Homo sapiens
atttttgtataaaa

SEQ ID NO: 6682425 - DNA, 18 bp, Homo sapiens
atttttgtataaaaagga

SEQ ID NO: 6682426 - DNA, 20 bp, Homo sapiens
atttttgtataaaaaggaaa

SEQ ID NO: 6682427 - DNA, 21 bp, Homo sapiens
atttttgtataaaaaggaaat

SEQ ID NO: 6682428 - DNA, 22 bp, Homo sapiens
atttttgtataaaaaggaaatt

SEQ ID NO: 6682429 - DNA, 21 bp, Homo sapiens
atttttgtatctacatctttt

SEQ ID NO: 6682430 - DNA, 16 bp, Homo sapiens
atttttgtatgccttt

SEQ ID NO: 6682431 - DNA, 18 bp, Homo sapiens
atttttgtattcaattaa

SEQ ID NO: 6682432 - DNA, 13 bp, Homo sapiens
atttttgtatttt

SEQ ID NO: 6682433 - DNA, 18 bp, Homo sapiens
atttttgtatttttagga

SEQ ID NO: 6682434 - DNA, 19 bp, Homo sapiens
atttttgtcacggaaagca

SEQ ID NO: 6682435 - DNA, 20 bp, Homo sapiens
atttttgtcagtctgagtca

SEQ ID NO: 6682436 - DNA, 21 bp, Homo sapiens
atttttgtcattgattaaatt

SEQ ID NO: 6682437 - DNA, 22 bp, Homo sapiens
atttttgtcattgattaaattg

SEQ ID NO: 6682438 - DNA, 23 bp, Homo sapiens
atttttgtccctgctcctcccaa

SEQ ID NO: 6682439 - DNA, 15 bp, Homo sapiens
atttttgtctgtcct

SEQ ID NO: 6682440 - DNA, 20 bp, Homo sapiens
atttttgtgaaatgaaaaca

SEQ ID NO: 6682441 - DNA, 13 bp, Homo sapiens
atttttgtgcaca

SEQ ID NO: 6682442 - DNA, 15 bp, Homo sapiens
atttttgtgccatta

SEQ ID NO: 6682443 - DNA, 17 bp, Homo sapiens
atttttgtgtttctaaa

SEQ ID NO: 6682444 - DNA, 16 bp, Homo sapiens
atttttgttactctct

SEQ ID NO: 6682445 - DNA, 17 bp, Homo sapiens
atttttgttagcaaaga

SEQ ID NO: 6682446 - DNA, 11 bp, Homo sapiens
atttttgttgg

SEQ ID NO: 6682447 - DNA, 22 bp, Homo sapiens
atttttgttggagccactctgt

SEQ ID NO: 6682448 - DNA, 14 bp, Homo sapiens
atttttgtttgact

SEQ ID NO: 6682449 - DNA, 14 bp, Homo sapiens
atttttgtttgttt

SEQ ID NO: 6682450 - DNA, 17 bp, Homo sapiens
atttttgtttgttttgt

SEQ ID NO: 6682451 - DNA, 17 bp, Homo sapiens
atttttgttttgaaagt

SEQ ID NO: 6682452 - DNA, 21 bp, Homo sapiens
atttttgtttttattaaaagg

SEQ ID NO: 6682453 - DNA, 22 bp, Homo sapiens
atttttgtttttgagtactgta

SEQ ID NO: 6682454 - DNA, 14 bp, Homo sapiens
attttttaaaaaag

SEQ ID NO: 6682455 - DNA, 15 bp, Homo sapiens
attttttaaaaacta

SEQ ID NO: 6682456 - DNA, 18 bp, Homo sapiens
attttttaaaaagtgttt

SEQ ID NO: 6682457 - DNA, 13 bp, Homo sapiens
attttttaaaaca

SEQ ID NO: 6682458 - DNA, 17 bp, Homo sapiens
attttttaaaacaagaa

SEQ ID NO: 6682459 - DNA, 22 bp, Homo sapiens
attttttaaaacaagccaagaa

SEQ ID NO: 6682460 - DNA, 23 bp, Homo sapiens
attttttaaaacaagccaagaaa

SEQ ID NO: 6682461 - DNA, 13 bp, Homo sapiens
attttttaaaata

SEQ ID NO: 6682462 - DNA, 14 bp, Homo sapiens
attttttaaaataa

SEQ ID NO: 6682463 - DNA, 13 bp, Homo sapiens
attttttaaagaa

SEQ ID NO: 6682464 - DNA, 16 bp, Homo sapiens
attttttaaagaatcc

SEQ ID NO: 6682465 - DNA, 22 bp, Homo sapiens
attttttaaagtcttctttcat

SEQ ID NO: 6682466 - DNA, 13 bp, Homo sapiens
attttttaaatga

SEQ ID NO: 6682467 - DNA, 19 bp, Homo sapiens
attttttaaatttacagaa

SEQ ID NO: 6682468 - DNA, 23 bp, Homo sapiens
attttttaaccccgtcaacaaat

SEQ ID NO: 6682469 - DNA, 18 bp, Homo sapiens
attttttaacttatgtat

SEQ ID NO: 6682470 - DNA, 11 bp, Homo sapiens
attttttaaga

SEQ ID NO: 6682471 - DNA, 15 bp, Homo sapiens
attttttaagagaca

SEQ ID NO: 6682472 - DNA, 12 bp, Homo sapiens
attttttaagct

SEQ ID NO: 6682473 - DNA, 21 bp, Homo sapiens
attttttaagcttcagttgct

SEQ ID NO: 6682474 - DNA, 15 bp, Homo sapiens
attttttaaggcaaa

SEQ ID NO: 6682475 - DNA, 17 bp, Homo sapiens
attttttaagtatttat

SEQ ID NO: 6682476 - DNA, 16 bp, Homo sapiens
attttttaataaactg

SEQ ID NO: 6682477 - DNA, 14 bp, Homo sapiens
attttttaatgtgc

SEQ ID NO: 6682478 - DNA, 21 bp, Homo sapiens
attttttaatttgatgaaagc

SEQ ID NO: 6682479 - DNA, 19 bp, Homo sapiens
attttttacattttacaca

SEQ ID NO: 6682480 - DNA, 20 bp, Homo sapiens
attttttacattttcctgtg

SEQ ID NO: 6682481 - DNA, 15 bp, Homo sapiens
attttttactacata

SEQ ID NO: 6682482 - DNA, 12 bp, Homo sapiens
attttttatact

SEQ ID NO: 6682483 - DNA, 13 bp, Homo sapiens
attttttatactg

SEQ ID NO: 6682484 - DNA, 18 bp, Homo sapiens
attttttatatatacagt

SEQ ID NO: 6682485 - DNA, 16 bp, Homo sapiens
attttttatcatgcat

SEQ ID NO: 6682486 - DNA, 15 bp, Homo sapiens
attttttatgatatc

SEQ ID NO: 6682487 - DNA, 21 bp, Homo sapiens
attttttatgatcaaggtgaa

SEQ ID NO: 6682488 - DNA, 16 bp, Homo sapiens
attttttatgtacaac

SEQ ID NO: 6682489 - DNA, 19 bp, Homo sapiens
attttttatgtacaaccct

SEQ ID NO: 6682490 - DNA, 20 bp, Homo sapiens
attttttatgtacaaccctg

SEQ ID NO: 6682491 - DNA, 18 bp, Homo sapiens
attttttattaatatttg

SEQ ID NO: 6682492 - DNA, 16 bp, Homo sapiens
attttttattcttgtg

SEQ ID NO: 6682493 - DNA, 13 bp, Homo sapiens
attttttattgtt

SEQ ID NO: 6682494 - DNA, 16 bp, Homo sapiens
attttttatttccaca

SEQ ID NO: 6682495 - DNA, 13 bp, Homo sapiens
attttttatttct

SEQ ID NO: 6682496 - DNA, 15 bp, Homo sapiens
attttttattttact

SEQ ID NO: 6682497 - DNA, 13 bp, Homo sapiens
attttttcagacc

SEQ ID NO: 6682498 - DNA, 13 bp, Homo sapiens
attttttcccaaa

SEQ ID NO: 6682499 - DNA, 14 bp, Homo sapiens
attttttccctcct

SEQ ID NO: 6682500 - DNA, 19 bp, Homo sapiens
attttttccctcctgacaa

SEQ ID NO: 6682501 - DNA, 18 bp, Homo sapiens
attttttcccttctcttc

SEQ ID NO: 6682502 - DNA, 14 bp, Homo sapiens
attttttcctacca

SEQ ID NO: 6682503 - DNA, 14 bp, Homo sapiens
attttttcctgaga

SEQ ID NO: 6682504 - DNA, 19 bp, Homo sapiens
attttttcctgctagtgta

SEQ ID NO: 6682505 - DNA, 20 bp, Homo sapiens
attttttccttcaaagttta

SEQ ID NO: 6682506 - DNA, 20 bp, Homo sapiens
attttttcgtgcactctgct

SEQ ID NO: 6682507 - DNA, 21 bp, Homo sapiens
attttttctaaaacattcccc

SEQ ID NO: 6682508 - DNA, 13 bp, Homo sapiens
attttttctgtac

SEQ ID NO: 6682509 - DNA, 14 bp, Homo sapiens
attttttcttttgt

SEQ ID NO: 6682510 - DNA, 20 bp, Homo sapiens
attttttcttttgtaattgt

SEQ ID NO: 6682511 - DNA, 21 bp, Homo sapiens
attttttgaaatgctgaaaat

SEQ ID NO: 6682512 - DNA, 15 bp, Homo sapiens
attttttgaactttg

SEQ ID NO: 6682513 - DNA, 12 bp, Homo sapiens
attttttgaagg

SEQ ID NO: 6682514 - DNA, 14 bp, Homo sapiens
attttttgaatatg

SEQ ID NO: 6682515 - DNA, 21 bp, Homo sapiens
attttttgacacttccattgt

SEQ ID NO: 6682516 - DNA, 23 bp, Homo sapiens
attttttgactttttttgtatgt

SEQ ID NO: 6682517 - DNA, 18 bp, Homo sapiens
attttttgaggccagtaa

SEQ ID NO: 6682518 - DNA, 18 bp, Homo sapiens
attttttgagtaattcta

SEQ ID NO: 6682519 - DNA, 15 bp, Homo sapiens
attttttgatggaaa

SEQ ID NO: 6682520 - DNA, 15 bp, Homo sapiens
attttttgcagtctt

SEQ ID NO: 6682521 - DNA, 16 bp, Homo sapiens
attttttgggccatta

SEQ ID NO: 6682522 - DNA, 17 bp, Homo sapiens
attttttgggccattac

SEQ ID NO: 6682523 - DNA, 20 bp, Homo sapiens
attttttgggccattacccc

SEQ ID NO: 6682524 - DNA, 17 bp, Homo sapiens
attttttggtacaaaaa

SEQ ID NO: 6682525 - DNA, 22 bp, Homo sapiens
attttttggtagcttgtatcaa

SEQ ID NO: 6682526 - DNA, 23 bp, Homo sapiens
attttttgtctgtgataacagag

SEQ ID NO: 6682527 - DNA, 18 bp, Homo sapiens
attttttgtctgtttatt

SEQ ID NO: 6682528 - DNA, 13 bp, Homo sapiens
attttttgtgaat

SEQ ID NO: 6682529 - DNA, 12 bp, Homo sapiens
attttttgttct

SEQ ID NO: 6682530 - DNA, 14 bp, Homo sapiens
attttttgttcttg

SEQ ID NO: 6682531 - DNA, 13 bp, Homo sapiens
attttttgtttct

SEQ ID NO: 6682532 - DNA, 17 bp, Homo sapiens
atttttttaaaattttg

SEQ ID NO: 6682533 - DNA, 18 bp, Homo sapiens
atttttttaaagatgccc

SEQ ID NO: 6682534 - DNA, 15 bp, Homo sapiens
atttttttaaagtag

SEQ ID NO: 6682535 - DNA, 16 bp, Homo sapiens
atttttttaaatttca

SEQ ID NO: 6682536 - DNA, 16 bp, Homo sapiens
atttttttaaatttgc

SEQ ID NO: 6682537 - DNA, 18 bp, Homo sapiens
atttttttaaccaaaggt

SEQ ID NO: 6682538 - DNA, 14 bp, Homo sapiens
atttttttaactgt

SEQ ID NO: 6682539 - DNA, 18 bp, Homo sapiens
atttttttaactgtgata

SEQ ID NO: 6682540 - DNA, 12 bp, Homo sapiens
atttttttaagc

SEQ ID NO: 6682541 - DNA, 19 bp, Homo sapiens
atttttttaagcaacactt

SEQ ID NO: 6682542 - DNA, 13 bp, Homo sapiens
atttttttaagct

SEQ ID NO: 6682543 - DNA, 18 bp, Homo sapiens
atttttttaatttacaaa

SEQ ID NO: 6682544 - DNA, 18 bp, Homo sapiens
atttttttaccaattcca

SEQ ID NO: 6682545 - DNA, 18 bp, Homo sapiens
atttttttactaatagac

SEQ ID NO: 6682546 - DNA, 18 bp, Homo sapiens
atttttttactaatgata

SEQ ID NO: 6682547 - DNA, 17 bp, Homo sapiens
atttttttagaaagcat

SEQ ID NO: 6682548 - DNA, 23 bp, Homo sapiens
atttttttagaaagcatttgaat

SEQ ID NO: 6682549 - DNA, 15 bp, Homo sapiens
atttttttagattga

SEQ ID NO: 6682550 - DNA, 16 bp, Homo sapiens
atttttttagttaata

SEQ ID NO: 6682551 - DNA, 14 bp, Homo sapiens
atttttttatacta

SEQ ID NO: 6682552 - DNA, 22 bp, Homo sapiens
atttttttatataagttaaaga

SEQ ID NO: 6682553 - DNA, 17 bp, Homo sapiens
atttttttatgctcttg

SEQ ID NO: 6682554 - DNA, 13 bp, Homo sapiens
atttttttattca

SEQ ID NO: 6682555 - DNA, 16 bp, Homo sapiens
atttttttattcagca

SEQ ID NO: 6682556 - DNA, 19 bp, Homo sapiens
atttttttcccaattgaga

SEQ ID NO: 6682557 - DNA, 12 bp, Homo sapiens
atttttttccta

SEQ ID NO: 6682558 - DNA, 22 bp, Homo sapiens
atttttttccttacataaacat

SEQ ID NO: 6682559 - DNA, 23 bp, Homo sapiens
atttttttctacataattgtgac

SEQ ID NO: 6682560 - DNA, 16 bp, Homo sapiens
atttttttctacctat

SEQ ID NO: 6682561 - DNA, 20 bp, Homo sapiens
atttttttctaccttgaggt

SEQ ID NO: 6682562 - DNA, 18 bp, Homo sapiens
atttttttctatgcataa

SEQ ID NO: 6682563 - DNA, 16 bp, Homo sapiens
atttttttctctctgg

SEQ ID NO: 6682564 - DNA, 15 bp, Homo sapiens
atttttttctgattg

SEQ ID NO: 6682565 - DNA, 20 bp, Homo sapiens
atttttttctttacttatct

SEQ ID NO: 6682566 - DNA, 21 bp, Homo sapiens
atttttttgaactcttctcat

SEQ ID NO: 6682567 - DNA, 19 bp, Homo sapiens
atttttttgtaaaggaaat

SEQ ID NO: 6682568 - DNA, 14 bp, Homo sapiens
atttttttgtaatt

SEQ ID NO: 6682569 - DNA, 15 bp, Homo sapiens
atttttttgtaattg

SEQ ID NO: 6682570 - DNA, 23 bp, Homo sapiens
atttttttgtagatgaaaaagca

SEQ ID NO: 6682571 - DNA, 17 bp, Homo sapiens
atttttttgtatgaaaa

SEQ ID NO: 6682572 - DNA, 13 bp, Homo sapiens
atttttttgtatt

SEQ ID NO: 6682573 - DNA, 19 bp, Homo sapiens
atttttttgtcattaaaat

SEQ ID NO: 6682574 - DNA, 14 bp, Homo sapiens
atttttttgttcca

SEQ ID NO: 6682575 - DNA, 13 bp, Homo sapiens
atttttttgttct

SEQ ID NO: 6682576 - DNA, 14 bp, Homo sapiens
atttttttgttctt

SEQ ID NO: 6682577 - DNA, 19 bp, Homo sapiens
attttttttaaaatagaaa

SEQ ID NO: 6682578 - DNA, 15 bp, Homo sapiens
attttttttaaagtt

SEQ ID NO: 6682579 - DNA, 21 bp, Homo sapiens
attttttttaaatcaaaaact

SEQ ID NO: 6682580 - DNA, 14 bp, Homo sapiens
attttttttaacat

SEQ ID NO: 6682581 - DNA, 18 bp, Homo sapiens
attttttttaacattcct

SEQ ID NO: 6682582 - DNA, 20 bp, Homo sapiens
attttttttaagttcacttt

SEQ ID NO: 6682583 - DNA, 17 bp, Homo sapiens
attttttttaatgctta

SEQ ID NO: 6682584 - DNA, 22 bp, Homo sapiens
attttttttaattgaaaagaag

SEQ ID NO: 6682585 - DNA, 17 bp, Homo sapiens
attttttttaattgtat

SEQ ID NO: 6682586 - DNA, 22 bp, Homo sapiens
attttttttaattgtatttttg

SEQ ID NO: 6682587 - DNA, 23 bp, Homo sapiens
attttttttactgtgcatacatg

SEQ ID NO: 6682588 - DNA, 18 bp, Homo sapiens
attttttttagtatttat

SEQ ID NO: 6682589 - DNA, 22 bp, Homo sapiens
attttttttatattgccttatt

SEQ ID NO: 6682590 - DNA, 20 bp, Homo sapiens
attttttttattagtattgt

SEQ ID NO: 6682591 - DNA, 15 bp, Homo sapiens
attttttttcaaaaa

SEQ ID NO: 6682592 - DNA, 19 bp, Homo sapiens
attttttttcaaaaatgct

SEQ ID NO: 6682593 - DNA, 18 bp, Homo sapiens
attttttttcaaaatgaa

SEQ ID NO: 6682594 - DNA, 20 bp, Homo sapiens
attttttttcaaaatgaaga

SEQ ID NO: 6682595 - DNA, 16 bp, Homo sapiens
attttttttcaaatgt

SEQ ID NO: 6682596 - DNA, 16 bp, Homo sapiens
attttttttcatgttt

SEQ ID NO: 6682597 - DNA, 23 bp, Homo sapiens
attttttttcccatttagaatgg

SEQ ID NO: 6682598 - DNA, 12 bp, Homo sapiens
attttttttccg

SEQ ID NO: 6682599 - DNA, 20 bp, Homo sapiens
attttttttctgaacaaaag

SEQ ID NO: 6682600 - DNA, 20 bp, Homo sapiens
attttttttctgttatataa

SEQ ID NO: 6682601 - DNA, 24 bp, Homo sapiens
attttttttcttccaacatgtgat

SEQ ID NO: 6682602 - DNA, 14 bp, Homo sapiens
attttttttcttgg

SEQ ID NO: 6682603 - DNA, 20 bp, Homo sapiens
attttttttctttgaataaa

SEQ ID NO: 6682604 - DNA, 15 bp, Homo sapiens
attttttttctttta

SEQ ID NO: 6682605 - DNA, 14 bp, Homo sapiens
attttttttggcct

SEQ ID NO: 6682606 - DNA, 15 bp, Homo sapiens
attttttttggcctg

SEQ ID NO: 6682607 - DNA, 23 bp, Homo sapiens
attttttttggcctgtttgatgt

SEQ ID NO: 6682608 - DNA, 19 bp, Homo sapiens
attttttttggttgtttgc

SEQ ID NO: 6682609 - DNA, 21 bp, Homo sapiens
attttttttggttgtttgctg

SEQ ID NO: 6682610 - DNA, 18 bp, Homo sapiens
attttttttgtattctta

SEQ ID NO: 6682611 - DNA, 21 bp, Homo sapiens
attttttttgttgtttcagtg

SEQ ID NO: 6682612 - DNA, 21 bp, Homo sapiens
atttttttttaagctctgagc

SEQ ID NO: 6682613 - DNA, 22 bp, Homo sapiens
atttttttttaattttgatata

SEQ ID NO: 6682614 - DNA, 23 bp, Homo sapiens
atttttttttagaacagaaaaca

SEQ ID NO: 6682615 - DNA, 13 bp, Homo sapiens
atttttttttcca

SEQ ID NO: 6682616 - DNA, 20 bp, Homo sapiens
atttttttttccacttttgt

SEQ ID NO: 6682617 - DNA, 17 bp, Homo sapiens
atttttttttcctagcc

SEQ ID NO: 6682618 - DNA, 18 bp, Homo sapiens
atttttttttcctggaat

SEQ ID NO: 6682619 - DNA, 22 bp, Homo sapiens
atttttttttccttcagtgcct

SEQ ID NO: 6682620 - DNA, 23 bp, Homo sapiens
atttttttttccttcagtgcctt

SEQ ID NO: 6682621 - DNA, 14 bp, Homo sapiens
atttttttttctaa

SEQ ID NO: 6682622 - DNA, 15 bp, Homo sapiens
atttttttttctaag

SEQ ID NO: 6682623 - DNA, 18 bp, Homo sapiens
atttttttttctaagaga

SEQ ID NO: 6682624 - DNA, 16 bp, Homo sapiens
atttttttttctcttt

SEQ ID NO: 6682625 - DNA, 17 bp, Homo sapiens
atttttttttctttata

SEQ ID NO: 6682626 - DNA, 18 bp, Homo sapiens
atttttttttggatgaag

SEQ ID NO: 6682627 - DNA, 15 bp, Homo sapiens
atttttttttgtaaa

SEQ ID NO: 6682628 - DNA, 19 bp, Homo sapiens
attttttttttaaattatt

SEQ ID NO: 6682629 - DNA, 17 bp, Homo sapiens
attttttttttaacttg

SEQ ID NO: 6682630 - DNA, 19 bp, Homo sapiens
attttttttttaacttgaa

SEQ ID NO: 6682631 - DNA, 20 bp, Homo sapiens
attttttttttaacttgaaa

SEQ ID NO: 6682632 - DNA, 16 bp, Homo sapiens
attttttttttcaggt

SEQ ID NO: 6682633 - DNA, 21 bp, Homo sapiens
atttttttttttaatctactg

SEQ ID NO: 6682634 - DNA, 18 bp, Homo sapiens
attttttttttttgaaaa

SEQ ID NO: 6682635 - DNA, 23 bp, Homo sapiens
attttttttttttggtccttctt

SEQ ID NO: 6682636 - DNA, 20 bp, Homo sapiens
atttttttttttttcctgtc

SEQ ID NO: 6682637 - DNA, 19 bp, Homo sapiens
atttttttttttttttcct

SEQ ID NO: 6682638 - DNA, 23 bp, Homo sapiens
caaaaaaaaaaaaaaaatccact

SEQ ID NO: 6682639 - DNA, 20 bp, Homo sapiens
caaaaaaaaaaaaaaattag

SEQ ID NO: 6682640 - DNA, 20 bp, Homo sapiens
caaaaaaaaaaaaagaagac

SEQ ID NO: 6682641 - DNA, 21 bp, Homo sapiens
caaaaaaaaaaaaagaagacc

SEQ ID NO: 6682642 - DNA, 19 bp, Homo sapiens
caaaaaaaaaaaaatgcac

SEQ ID NO: 6682643 - DNA, 15 bp, Homo sapiens
caaaaaaaaaaaagc

SEQ ID NO: 6682644 - DNA, 13 bp, Homo sapiens
caaaaaaaaaaga

SEQ ID NO: 6682645 - DNA, 19 bp, Homo sapiens
caaaaaaaaaatagagaga

SEQ ID NO: 6682646 - DNA, 15 bp, Homo sapiens
caaaaaaaaacttaa

SEQ ID NO: 6682647 - DNA, 16 bp, Homo sapiens
caaaaaaaaagtttta

SEQ ID NO: 6682648 - DNA, 17 bp, Homo sapiens
caaaaaaaaagttttat

SEQ ID NO: 6682649 - DNA, 12 bp, Homo sapiens
caaaaaaaacaa

SEQ ID NO: 6682650 - DNA, 15 bp, Homo sapiens
caaaaaaaacaacaa

SEQ ID NO: 6682651 - DNA, 15 bp, Homo sapiens
caaaaaaaagaaaga

SEQ ID NO: 6682652 - DNA, 16 bp, Homo sapiens
caaaaaaaagaaagaa

SEQ ID NO: 6682653 - DNA, 20 bp, Homo sapiens
caaaaaaaagaaagaaaaaa

SEQ ID NO: 6682654 - DNA, 14 bp, Homo sapiens
caaaaaaaagaacc

SEQ ID NO: 6682655 - DNA, 15 bp, Homo sapiens
caaaaaaaatcttta

SEQ ID NO: 6682656 - DNA, 16 bp, Homo sapiens
caaaaaaaatctttaa

SEQ ID NO: 6682657 - DNA, 13 bp, Homo sapiens
caaaaaaaattag

SEQ ID NO: 6682658 - DNA, 13 bp, Homo sapiens
caaaaaaacacta

SEQ ID NO: 6682659 - DNA, 13 bp, Homo sapiens
caaaaaaaccaca

SEQ ID NO: 6682660 - DNA, 18 bp, Homo sapiens
caaaaaaaccacaaaggc

SEQ ID NO: 6682661 - DNA, 13 bp, Homo sapiens
caaaaaaagcctc

SEQ ID NO: 6682662 - DNA, 15 bp, Homo sapiens
caaaaaaagcctcca

SEQ ID NO: 6682663 - DNA, 19 bp, Homo sapiens
caaaaaaagcctccaaggg

SEQ ID NO: 6682664 - DNA, 14 bp, Homo sapiens
caaaaaaagccttt

SEQ ID NO: 6682665 - DNA, 20 bp, Homo sapiens
caaaaaaaggaaaaataatc

SEQ ID NO: 6682666 - DNA, 22 bp, Homo sapiens
caaaaaaaggaaaaataatcaa

SEQ ID NO: 6682667 - DNA, 13 bp, Homo sapiens
caaaaaaaggaag

SEQ ID NO: 6682668 - DNA, 20 bp, Homo sapiens
caaaaaaagggaaggattta

SEQ ID NO: 6682669 - DNA, 14 bp, Homo sapiens
caaaaaaagttgta

SEQ ID NO: 6682670 - DNA, 22 bp, Homo sapiens
caaaaaaagttgtatgatctgt

SEQ ID NO: 6682671 - DNA, 20 bp, Homo sapiens
caaaaaaagtttgttacttt

SEQ ID NO: 6682672 - DNA, 13 bp, Homo sapiens
caaaaaaatactg

SEQ ID NO: 6682673 - DNA, 17 bp, Homo sapiens
caaaaaaatctgcagaa

SEQ ID NO: 6682674 - DNA, 18 bp, Homo sapiens
caaaaaaatcttccaatt

SEQ ID NO: 6682675 - DNA, 15 bp, Homo sapiens
caaaaaaatgttcat

SEQ ID NO: 6682676 - DNA, 20 bp, Homo sapiens
caaaaaaatgtttttaaaaa

SEQ ID NO: 6682677 - DNA, 21 bp, Homo sapiens
caaaaaaattaaaatggatgc

SEQ ID NO: 6682678 - DNA, 15 bp, Homo sapiens
caaaaaaatttaaaa

SEQ ID NO: 6682679 - DNA, 14 bp, Homo sapiens
caaaaaacagaaaa

SEQ ID NO: 6682680 - DNA, 15 bp, Homo sapiens
caaaaaacagaaaaa

SEQ ID NO: 6682681 - DNA, 22 bp, Homo sapiens
caaaaaacatacttacatttca

SEQ ID NO: 6682682 - DNA, 11 bp, Homo sapiens
caaaaaaccca

SEQ ID NO: 6682683 - DNA, 15 bp, Homo sapiens
caaaaaaccccagct

SEQ ID NO: 6682684 - DNA, 16 bp, Homo sapiens
caaaaaacctcactgg

SEQ ID NO: 6682685 - DNA, 20 bp, Homo sapiens
caaaaaactatcaactacaa

SEQ ID NO: 6682686 - DNA, 13 bp, Homo sapiens
caaaaaactatgt

SEQ ID NO: 6682687 - DNA, 14 bp, Homo sapiens
caaaaaactgcagt

SEQ ID NO: 6682688 - DNA, 11 bp, Homo sapiens
caaaaaagaac

SEQ ID NO: 6682689 - DNA, 21 bp, Homo sapiens
caaaaaagacttgagacaatg

SEQ ID NO: 6682690 - DNA, 12 bp, Homo sapiens
caaaaaagagaa

SEQ ID NO: 6682691 - DNA, 14 bp, Homo sapiens
caaaaaagagaaac

SEQ ID NO: 6682692 - DNA, 20 bp, Homo sapiens
caaaaaagcaaacacaagaa

SEQ ID NO: 6682693 - DNA, 13 bp, Homo sapiens
caaaaaaggaaaa

SEQ ID NO: 6682694 - DNA, 19 bp, Homo sapiens
caaaaaaggaaaagttaaa

SEQ ID NO: 6682695 - DNA, 13 bp, Homo sapiens
caaaaaaggaaat

SEQ ID NO: 6682696 - DNA, 20 bp, Homo sapiens
caaaaaaggacgtaaaattt

SEQ ID NO: 6682697 - DNA, 19 bp, Homo sapiens
caaaaaagtatttttttaa

SEQ ID NO: 6682698 - DNA, 16 bp, Homo sapiens
caaaaaagtcaacaaa

SEQ ID NO: 6682699 - DNA, 17 bp, Homo sapiens
caaaaaagtccaatttt

SEQ ID NO: 6682700 - DNA, 17 bp, Homo sapiens
caaaaaataaaataagt

SEQ ID NO: 6682701 - DNA, 14 bp, Homo sapiens
caaaaaataaattt

SEQ ID NO: 6682702 - DNA, 19 bp, Homo sapiens
caaaaaatactttttctaa

SEQ ID NO: 6682703 - DNA, 19 bp, Homo sapiens
caaaaaatatctagtaata

SEQ ID NO: 6682704 - DNA, 18 bp, Homo sapiens
caaaaaatattcatctgt

SEQ ID NO: 6682705 - DNA, 13 bp, Homo sapiens
caaaaaatcttaa

SEQ ID NO: 6682706 - DNA, 20 bp, Homo sapiens
caaaaaatgtgagctataat

SEQ ID NO: 6682707 - DNA, 15 bp, Homo sapiens
caaaaaatgtgctgt

SEQ ID NO: 6682708 - DNA, 15 bp, Homo sapiens
caaaaaattaaagca

SEQ ID NO: 6682709 - DNA, 14 bp, Homo sapiens
caaaaaattcttta

SEQ ID NO: 6682710 - DNA, 10 bp, Homo sapiens
caaaaacaaa

SEQ ID NO: 6682711 - DNA, 12 bp, Homo sapiens
caaaaacaaaaa

SEQ ID NO: 6682712 - DNA, 14 bp, Homo sapiens
caaaaacaaaaaaa

SEQ ID NO: 6682713 - DNA, 17 bp, Homo sapiens
caaaaacaaaaaaacta

SEQ ID NO: 6682714 - DNA, 14 bp, Homo sapiens
caaaaacaaaaaga

SEQ ID NO: 6682715 - DNA, 12 bp, Homo sapiens
caaaaacaaaac

SEQ ID NO: 6682716 - DNA, 18 bp, Homo sapiens
caaaaacaaaaccagctg

SEQ ID NO: 6682717 - DNA, 15 bp, Homo sapiens
caaaaacaaagaaaa

SEQ ID NO: 6682718 - DNA, 22 bp, Homo sapiens
caaaaacaaagtgcaaagctgc

SEQ ID NO: 6682719 - DNA, 23 bp, Homo sapiens
caaaaacaaagtgcaaagctgct

SEQ ID NO: 6682720 - DNA, 12 bp, Homo sapiens
caaaaacaagca

SEQ ID NO: 6682721 - DNA, 18 bp, Homo sapiens
caaaaacaataaacgaaa

SEQ ID NO: 6682722 - DNA, 13 bp, Homo sapiens
caaaaacacagca

SEQ ID NO: 6682723 - DNA, 15 bp, Homo sapiens
caaaaacacagcaag

SEQ ID NO: 6682724 - DNA, 23 bp, Homo sapiens
caaaaacacagtgtttttgtaaa

SEQ ID NO: 6682725 - DNA, 21 bp, Homo sapiens
caaaaacagcagtttgtgata

SEQ ID NO: 6682726 - DNA, 14 bp, Homo sapiens
caaaaacagcctca

SEQ ID NO: 6682727 - DNA, 13 bp, Homo sapiens
caaaaacaggcag

SEQ ID NO: 6682728 - DNA, 22 bp, Homo sapiens
caaaaacatacttcaaaaatgt

SEQ ID NO: 6682729 - DNA, 21 bp, Homo sapiens
caaaaacatatgtctgtcttt

SEQ ID NO: 6682730 - DNA, 23 bp, Homo sapiens
caaaaacatttgattaataaaat

SEQ ID NO: 6682731 - DNA, 14 bp, Homo sapiens
caaaaacatttgtt

SEQ ID NO: 6682732 - DNA, 19 bp, Homo sapiens
caaaaacatttgtttatcc

SEQ ID NO: 6682733 - DNA, 15 bp, Homo sapiens
caaaaaccaaaaaaa

SEQ ID NO: 6682734 - DNA, 19 bp, Homo sapiens
caaaaaccaaacacccaga

SEQ ID NO: 6682735 - DNA, 15 bp, Homo sapiens
caaaaaccaaatgtt

SEQ ID NO: 6682736 - DNA, 13 bp, Homo sapiens
caaaaaccaagtt

SEQ ID NO: 6682737 - DNA, 19 bp, Homo sapiens
caaaaaccaagttatctgt

SEQ ID NO: 6682738 - DNA, 18 bp, Homo sapiens
caaaaaccacagtcctca

SEQ ID NO: 6682739 - DNA, 18 bp, Homo sapiens
caaaaaccagtattgtac

SEQ ID NO: 6682740 - DNA, 19 bp, Homo sapiens
caaaaaccccagtgtttta

SEQ ID NO: 6682741 - DNA, 19 bp, Homo sapiens
caaaaaccttggcataaga

SEQ ID NO: 6682742 - DNA, 23 bp, Homo sapiens
caaaaaccttggcataagacaga

SEQ ID NO: 6682743 - DNA, 17 bp, Homo sapiens
caaaaacgaaagctggg

SEQ ID NO: 6682744 - DNA, 16 bp, Homo sapiens
caaaaacgccctcaag

SEQ ID NO: 6682745 - DNA, 21 bp, Homo sapiens
caaaaacgccctcaagaacat

SEQ ID NO: 6682746 - DNA, 14 bp, Homo sapiens
caaaaactaaaatc

SEQ ID NO: 6682747 - DNA, 19 bp, Homo sapiens
caaaaactagtaaagacat

SEQ ID NO: 6682748 - DNA, 13 bp, Homo sapiens
caaaaactattat

SEQ ID NO: 6682749 - DNA, 18 bp, Homo sapiens
caaaaactattatcacca

SEQ ID NO: 6682750 - DNA, 16 bp, Homo sapiens
caaaaactatttggga

SEQ ID NO: 6682751 - DNA, 22 bp, Homo sapiens
caaaaactgtaaaagtgtacag

SEQ ID NO: 6682752 - DNA, 16 bp, Homo sapiens
caaaaactgtactgtg

SEQ ID NO: 6682753 - DNA, 22 bp, Homo sapiens
caaaaactgtctttaaaagaga

SEQ ID NO: 6682754 - DNA, 14 bp, Homo sapiens
caaaaacttccttt

SEQ ID NO: 6682755 - DNA, 15 bp, Homo sapiens
caaaaacttccttta

SEQ ID NO: 6682756 - DNA, 16 bp, Homo sapiens
caaaaacttcctttac

SEQ ID NO: 6682757 - DNA, 19 bp, Homo sapiens
caaaaacttcctttacaga

SEQ ID NO: 6682758 - DNA, 14 bp, Homo sapiens
caaaaactttccat

SEQ ID NO: 6682759 - DNA, 23 bp, Homo sapiens
caaaaactttccatgacagtagc

SEQ ID NO: 6682760 - DNA, 24 bp, Homo sapiens
caaaaactttccatgacagtagca

SEQ ID NO: 6682761 - DNA, 18 bp, Homo sapiens
caaaaagaaaaaaagaaa

SEQ ID NO: 6682762 - DNA, 14 bp, Homo sapiens
caaaaagaaacttt

SEQ ID NO: 6682763 - DNA, 19 bp, Homo sapiens
caaaaagaaagctgtgaaa

SEQ ID NO: 6682764 - DNA, 13 bp, Homo sapiens
caaaaagaaatga

SEQ ID NO: 6682765 - DNA, 15 bp, Homo sapiens
caaaaagaaatgtca

SEQ ID NO: 6682766 - DNA, 16 bp, Homo sapiens
caaaaagaaatgtcaa

SEQ ID NO: 6682767 - DNA, 21 bp, Homo sapiens
caaaaagaacaataatgagag

SEQ ID NO: 6682768 - DNA, 23 bp, Homo sapiens
caaaaagaacaataatgagagca

SEQ ID NO: 6682769 - DNA, 14 bp, Homo sapiens
caaaaagaaccact

SEQ ID NO: 6682770 - DNA, 19 bp, Homo sapiens
caaaaagaactaaatatgc

SEQ ID NO: 6682771 - DNA, 11 bp, Homo sapiens
caaaaagaaga

SEQ ID NO: 6682772 - DNA, 13 bp, Homo sapiens
caaaaagaagagt

SEQ ID NO: 6682773 - DNA, 15 bp, Homo sapiens
caaaaagaagagttt

SEQ ID NO: 6682774 - DNA, 21 bp, Homo sapiens
caaaaagacacttgatacttg

SEQ ID NO: 6682775 - DNA, 15 bp, Homo sapiens
caaaaagaccagact

SEQ ID NO: 6682776 - DNA, 18 bp, Homo sapiens
caaaaagagacccacaat

SEQ ID NO: 6682777 - DNA, 23 bp, Homo sapiens
caaaaagataccttaaaatttga

SEQ ID NO: 6682778 - DNA, 15 bp, Homo sapiens
caaaaagatgcttta

SEQ ID NO: 6682779 - DNA, 11 bp, Homo sapiens
caaaaagcaca

SEQ ID NO: 6682780 - DNA, 13 bp, Homo sapiens
caaaaagcagaag

SEQ ID NO: 6682781 - DNA, 16 bp, Homo sapiens
caaaaagcagagtgga

SEQ ID NO: 6682782 - DNA, 23 bp, Homo sapiens
caaaaagcagagtggactgcatt

SEQ ID NO: 6682783 - DNA, 21 bp, Homo sapiens
caaaaagccaacaaaccaaga

SEQ ID NO: 6682784 - DNA, 20 bp, Homo sapiens
caaaaagccacagcagagca

SEQ ID NO: 6682785 - DNA, 12 bp, Homo sapiens
caaaaagctaac

SEQ ID NO: 6682786 - DNA, 17 bp, Homo sapiens
caaaaagctaacatctt

SEQ ID NO: 6682787 - DNA, 13 bp, Homo sapiens
caaaaagctaatg

SEQ ID NO: 6682788 - DNA, 15 bp, Homo sapiens
caaaaagctctgaaa

SEQ ID NO: 6682789 - DNA, 18 bp, Homo sapiens
caaaaagctttaaaaaat

SEQ ID NO: 6682790 - DNA, 12 bp, Homo sapiens
caaaaaggactg

SEQ ID NO: 6682791 - DNA, 24 bp, Homo sapiens
caaaaaggagccttttgctctctg

SEQ ID NO: 6682792 - DNA, 17 bp, Homo sapiens
caaaaaggatacataat

SEQ ID NO: 6682793 - DNA, 19 bp, Homo sapiens
caaaaaggcaaatattgaa

SEQ ID NO: 6682794 - DNA, 17 bp, Homo sapiens
caaaaaggtataaataa

SEQ ID NO: 6682795 - DNA, 23 bp, Homo sapiens
caaaaagtaaagtaatgcatttg

SEQ ID NO: 6682796 - DNA, 15 bp, Homo sapiens
caaaaagtgcttcat

SEQ ID NO: 6682797 - DNA, 16 bp, Homo sapiens
caaaaagtttcctttt

SEQ ID NO: 6682798 - DNA, 10 bp, Homo sapiens
caaaaataaa

SEQ ID NO: 6682799 - DNA, 19 bp, Homo sapiens
caaaaataaaaaatctgaa

SEQ ID NO: 6682800 - DNA, 12 bp, Homo sapiens
caaaaataaact

SEQ ID NO: 6682801 - DNA, 23 bp, Homo sapiens
caaaaataaactagtttccagtg

SEQ ID NO: 6682802 - DNA, 15 bp, Homo sapiens
caaaaataacactgt

SEQ ID NO: 6682803 - DNA, 23 bp, Homo sapiens
caaaaataacactgttggcactt

SEQ ID NO: 6682804 - DNA, 13 bp, Homo sapiens
caaaaatacaaaa

SEQ ID NO: 6682805 - DNA, 16 bp, Homo sapiens
caaaaatacaacacag

SEQ ID NO: 6682806 - DNA, 16 bp, Homo sapiens
caaaaatacagaattt

SEQ ID NO: 6682807 - DNA, 14 bp, Homo sapiens
caaaaatactctaa

SEQ ID NO: 6682808 - DNA, 17 bp, Homo sapiens
caaaaatactctaattc

SEQ ID NO: 6682809 - DNA, 12 bp, Homo sapiens
caaaaatagaaa

SEQ ID NO: 6682810 - DNA, 14 bp, Homo sapiens
caaaaatagaaatt

SEQ ID NO: 6682811 - DNA, 18 bp, Homo sapiens
caaaaatagaaattagat

SEQ ID NO: 6682812 - DNA, 14 bp, Homo sapiens
caaaaatagctctt

SEQ ID NO: 6682813 - DNA, 21 bp, Homo sapiens
caaaaatagtcaaaaattaaa

SEQ ID NO: 6682814 - DNA, 13 bp, Homo sapiens
caaaaatatatta

SEQ ID NO: 6682815 - DNA, 20 bp, Homo sapiens
caaaaatatattaaaaatat

SEQ ID NO: 6682816 - DNA, 22 bp, Homo sapiens
caaaaatatattaaaaatataa

SEQ ID NO: 6682817 - DNA, 17 bp, Homo sapiens
caaaaatatcccttccg

SEQ ID NO: 6682818 - DNA, 14 bp, Homo sapiens
caaaaatatttata

SEQ ID NO: 6682819 - DNA, 15 bp, Homo sapiens
caaaaatattttatg

SEQ ID NO: 6682820 - DNA, 16 bp, Homo sapiens
caaaaatattttccta

SEQ ID NO: 6682821 - DNA, 19 bp, Homo sapiens
caaaaatcaaagaacagat

SEQ ID NO: 6682822 - DNA, 22 bp, Homo sapiens
caaaaatcaaagaacagatggg

SEQ ID NO: 6682823 - DNA, 20 bp, Homo sapiens
caaaaatcaacctatcaaag

SEQ ID NO: 6682824 - DNA, 13 bp, Homo sapiens
caaaaatcatcaa

SEQ ID NO: 6682825 - DNA, 15 bp, Homo sapiens
caaaaatcatcaaag

SEQ ID NO: 6682826 - DNA, 15 bp, Homo sapiens
caaaaatccaaatat

SEQ ID NO: 6682827 - DNA, 20 bp, Homo sapiens
caaaaatccaaatattgtta

SEQ ID NO: 6682828 - DNA, 21 bp, Homo sapiens
caaaaatctgaagattgttta

SEQ ID NO: 6682829 - DNA, 16 bp, Homo sapiens
caaaaatctgcctggg

SEQ ID NO: 6682830 - DNA, 19 bp, Homo sapiens
caaaaatgaaagcatgtct

SEQ ID NO: 6682831 - DNA, 11 bp, Homo sapiens
caaaaatgaat

SEQ ID NO: 6682832 - DNA, 13 bp, Homo sapiens
caaaaatgactct

SEQ ID NO: 6682833 - DNA, 15 bp, Homo sapiens
caaaaatgctaatat

SEQ ID NO: 6682834 - DNA, 21 bp, Homo sapiens
caaaaatgctaatattaaaag

SEQ ID NO: 6682835 - DNA, 15 bp, Homo sapiens
caaaaatgggaaaaa

SEQ ID NO: 6682836 - DNA, 19 bp, Homo sapiens
caaaaatgggaaaaataaa

SEQ ID NO: 6682837 - DNA, 18 bp, Homo sapiens
caaaaatgtaaaaaacaa

SEQ ID NO: 6682838 - DNA, 22 bp, Homo sapiens
caaaaatgtacaaaataaagtt

SEQ ID NO: 6682839 - DNA, 19 bp, Homo sapiens
caaaaatgtccagccaccc

SEQ ID NO: 6682840 - DNA, 12 bp, Homo sapiens
caaaaatgttca

SEQ ID NO: 6682841 - DNA, 11 bp, Homo sapiens
caaaaatgttg

SEQ ID NO: 6682842 - DNA, 14 bp, Homo sapiens
caaaaatgttgaac

SEQ ID NO: 6682843 - DNA, 20 bp, Homo sapiens
caaaaattagccgggcgtgg

SEQ ID NO: 6682844 - DNA, 14 bp, Homo sapiens
caaaaattatatat

SEQ ID NO: 6682845 - DNA, 15 bp, Homo sapiens
caaaaattatatatt

SEQ ID NO: 6682846 - DNA, 21 bp, Homo sapiens
caaaaattatctatttgtata

SEQ ID NO: 6682847 - DNA, 22 bp, Homo sapiens
caaaaattatttttttttttgt

SEQ ID NO: 6682848 - DNA, 17 bp, Homo sapiens
caaaaattcacaagctg

SEQ ID NO: 6682849 - DNA, 20 bp, Homo sapiens
caaaaattgagagctttatt

SEQ ID NO: 6682850 - DNA, 15 bp, Homo sapiens
caaaaattgccaagt

SEQ ID NO: 6682851 - DNA, 19 bp, Homo sapiens
caaaaattgccaagtgcct

SEQ ID NO: 6682852 - DNA, 22 bp, Homo sapiens
caaaaattgcgagcctttaccc

SEQ ID NO: 6682853 - DNA, 21 bp, Homo sapiens
caaaaattgtgtttagatttt

SEQ ID NO: 6682854 - DNA, 21 bp, Homo sapiens
caaaaatttctgcttttgcat

SEQ ID NO: 6682855 - DNA, 21 bp, Homo sapiens
caaaaatttctgtaaaacagg

SEQ ID NO: 6682856 - DNA, 22 bp, Homo sapiens
caaaaatttgaaccaaaacatt

SEQ ID NO: 6682857 - DNA, 14 bp, Homo sapiens
caaaaattttgtga

SEQ ID NO: 6682858 - DNA, 17 bp, Homo sapiens
caaaaattttgtgacat

SEQ ID NO: 6682859 - DNA, 11 bp, Homo sapiens
caaaaattttt

SEQ ID NO: 6682860 - DNA, 15 bp, Homo sapiens
caaaaatttttggat

SEQ ID NO: 6682861 - DNA, 21 bp, Homo sapiens
caaaaatttttggattgacag

SEQ ID NO: 6682862 - DNA, 15 bp, Homo sapiens
caaaacaaaaaccaa

SEQ ID NO: 6682863 - DNA, 17 bp, Homo sapiens
caaaacaaaaattaggt

SEQ ID NO: 6682864 - DNA, 11 bp, Homo sapiens
caaaacaaaac

SEQ ID NO: 6682865 - DNA, 14 bp, Homo sapiens
caaaacaaaacaac

SEQ ID NO: 6682866 - DNA, 17 bp, Homo sapiens
caaaacaaaacaacaac

SEQ ID NO: 6682867 - DNA, 18 bp, Homo sapiens
caaaacaaaacaacaaca

SEQ ID NO: 6682868 - DNA, 13 bp, Homo sapiens
caaaacaaaatgt

SEQ ID NO: 6682869 - DNA, 14 bp, Homo sapiens
caaaacaaacaaac

SEQ ID NO: 6682870 - DNA, 16 bp, Homo sapiens
caaaacaaacatgcag

SEQ ID NO: 6682871 - DNA, 14 bp, Homo sapiens
caaaacaaacttcc

SEQ ID NO: 6682872 - DNA, 13 bp, Homo sapiens
caaaacaaagctg

SEQ ID NO: 6682873 - DNA, 17 bp, Homo sapiens
caaaacaaagctgattt

SEQ ID NO: 6682874 - DNA, 23 bp, Homo sapiens
caaaacaaagctgatttcccttt

SEQ ID NO: 6682875 - DNA, 12 bp, Homo sapiens
caaaacaaaggc

SEQ ID NO: 6682876 - DNA, 21 bp, Homo sapiens
caaaacaaatgccacacatca

SEQ ID NO: 6682877 - DNA, 13 bp, Homo sapiens
caaaacaaattca

SEQ ID NO: 6682878 - DNA, 14 bp, Homo sapiens
caaaacaacaaaaa

SEQ ID NO: 6682879 - DNA, 12 bp, Homo sapiens
caaaacaacagc

SEQ ID NO: 6682880 - DNA, 18 bp, Homo sapiens
caaaacaacagcaacaac

SEQ ID NO: 6682881 - DNA, 20 bp, Homo sapiens
caaaacaacagcaacaacaa

SEQ ID NO: 6682882 - DNA, 15 bp, Homo sapiens
caaaacaacattttg

SEQ ID NO: 6682883 - DNA, 17 bp, Homo sapiens
caaaacaagaaagaaac

SEQ ID NO: 6682884 - DNA, 19 bp, Homo sapiens
caaaacaagaaagaaacgt

SEQ ID NO: 6682885 - DNA, 17 bp, Homo sapiens
caaaacaatctatttaa

SEQ ID NO: 6682886 - DNA, 11 bp, Homo sapiens
caaaacaatgc

SEQ ID NO: 6682887 - DNA, 22 bp, Homo sapiens
caaaacacacgcgcgcacacac

SEQ ID NO: 6682888 - DNA, 12 bp, Homo sapiens
caaaacacacta

SEQ ID NO: 6682889 - DNA, 12 bp, Homo sapiens
caaaacacattt

SEQ ID NO: 6682890 - DNA, 15 bp, Homo sapiens
caaaacactatgtat

SEQ ID NO: 6682891 - DNA, 15 bp, Homo sapiens
caaaacactgtggaa

SEQ ID NO: 6682892 - DNA, 17 bp, Homo sapiens
caaaacacttaggaaga

SEQ ID NO: 6682893 - DNA, 19 bp, Homo sapiens
caaaacacttaggaagaaa

SEQ ID NO: 6682894 - DNA, 20 bp, Homo sapiens
caaaacacttaggaagaaat

SEQ ID NO: 6682895 - DNA, 19 bp, Homo sapiens
caaaacagagatgtgataa

SEQ ID NO: 6682896 - DNA, 18 bp, Homo sapiens
caaaacagaggcacttaa

SEQ ID NO: 6682897 - DNA, 16 bp, Homo sapiens
caaaacagattcaaag

SEQ ID NO: 6682898 - DNA, 13 bp, Homo sapiens
caaaacagattgt

SEQ ID NO: 6682899 - DNA, 18 bp, Homo sapiens
caaaacagattgtttgca

SEQ ID NO: 6682900 - DNA, 18 bp, Homo sapiens
caaaacagcgtttaagac

SEQ ID NO: 6682901 - DNA, 23 bp, Homo sapiens
caaaacagcgtttaagactgtaa

SEQ ID NO: 6682902 - DNA, 16 bp, Homo sapiens
caaaacagctttgtct

SEQ ID NO: 6682903 - DNA, 17 bp, Homo sapiens
caaaacagctttgtctc

SEQ ID NO: 6682904 - DNA, 14 bp, Homo sapiens
caaaacagttatac

SEQ ID NO: 6682905 - DNA, 16 bp, Homo sapiens
caaaacatatcaattc

SEQ ID NO: 6682906 - DNA, 17 bp, Homo sapiens
caaaacatatcaattca

SEQ ID NO: 6682907 - DNA, 18 bp, Homo sapiens
caaaacatattcaaagca

SEQ ID NO: 6682908 - DNA, 13 bp, Homo sapiens
caaaacattcatg

SEQ ID NO: 6682909 - DNA, 14 bp, Homo sapiens
caaaacattccaag

SEQ ID NO: 6682910 - DNA, 16 bp, Homo sapiens
caaaacattccaagaa

SEQ ID NO: 6682911 - DNA, 18 bp, Homo sapiens
caaaacattttgaaggaa

SEQ ID NO: 6682912 - DNA, 11 bp, Homo sapiens
caaaaccaaac

SEQ ID NO: 6682913 - DNA, 15 bp, Homo sapiens
caaaaccaaattgag

SEQ ID NO: 6682914 - DNA, 21 bp, Homo sapiens
caaaaccaagattttgaagga

SEQ ID NO: 6682915 - DNA, 17 bp, Homo sapiens
caaaaccaatgctgatg

SEQ ID NO: 6682916 - DNA, 19 bp, Homo sapiens
caaaaccacacaaggagaa

SEQ ID NO: 6682917 - DNA, 16 bp, Homo sapiens
caaaaccacagccctg

SEQ ID NO: 6682918 - DNA, 14 bp, Homo sapiens
caaaaccacatggg

SEQ ID NO: 6682919 - DNA, 15 bp, Homo sapiens
caaaaccacatgggc

SEQ ID NO: 6682920 - DNA, 18 bp, Homo sapiens
caaaaccacatgggctgg

SEQ ID NO: 6682921 - DNA, 20 bp, Homo sapiens
caaaaccacatgggctgggg

SEQ ID NO: 6682922 - DNA, 23 bp, Homo sapiens
caaaaccacatgggctgggggcc

SEQ ID NO: 6682923 - DNA, 17 bp, Homo sapiens
caaaaccaccctaacct

SEQ ID NO: 6682924 - DNA, 13 bp, Homo sapiens
caaaaccagaggg

SEQ ID NO: 6682925 - DNA, 16 bp, Homo sapiens
caaaaccagagggcag

SEQ ID NO: 6682926 - DNA, 17 bp, Homo sapiens
caaaaccatccatccct

SEQ ID NO: 6682927 - DNA, 16 bp, Homo sapiens
caaaaccattgcttca

SEQ ID NO: 6682928 - DNA, 15 bp, Homo sapiens
caaaacccagacctg

SEQ ID NO: 6682929 - DNA, 14 bp, Homo sapiens
caaaacccagctgc

SEQ ID NO: 6682930 - DNA, 13 bp, Homo sapiens
caaaacccaggac

SEQ ID NO: 6682931 - DNA, 15 bp, Homo sapiens
caaaacccaggacat

SEQ ID NO: 6682932 - DNA, 20 bp, Homo sapiens
caaaacccaggacatctcct

SEQ ID NO: 6682933 - DNA, 23 bp, Homo sapiens
caaaacccatcgtggtatgtgaa

SEQ ID NO: 6682934 - DNA, 16 bp, Homo sapiens
caaaaccccatctcta

SEQ ID NO: 6682935 - DNA, 15 bp, Homo sapiens
caaaaccccccagat

SEQ ID NO: 6682936 - DNA, 21 bp, Homo sapiens
caaaaccccccagatatcatc

SEQ ID NO: 6682937 - DNA, 23 bp, Homo sapiens
caaaacccctaagagactgcgtt

SEQ ID NO: 6682938 - DNA, 14 bp, Homo sapiens
caaaaccgccagct

SEQ ID NO: 6682939 - DNA, 19 bp, Homo sapiens
caaaacctcaaaccagtca

SEQ ID NO: 6682940 - DNA, 14 bp, Homo sapiens
caaaacctggagat

SEQ ID NO: 6682941 - DNA, 23 bp, Homo sapiens
caaaacctgtattactgaataat

SEQ ID NO: 6682942 - DNA, 20 bp, Homo sapiens
caaaacctgtgccaggctga

SEQ ID NO: 6682943 - DNA, 13 bp, Homo sapiens
caaaaccttcctt

SEQ ID NO: 6682944 - DNA, 18 bp, Homo sapiens
caaaacgagggggtcagc

SEQ ID NO: 6682945 - DNA, 15 bp, Homo sapiens
caaaacgatgaagtt

SEQ ID NO: 6682946 - DNA, 14 bp, Homo sapiens
caaaacgggtcagt

SEQ ID NO: 6682947 - DNA, 21 bp, Homo sapiens
caaaacggttttactgcagct

SEQ ID NO: 6682948 - DNA, 13 bp, Homo sapiens
caaaacgtcttat

SEQ ID NO: 6682949 - DNA, 16 bp, Homo sapiens
caaaacgtgatgtttt

SEQ ID NO: 6682950 - DNA, 22 bp, Homo sapiens
caaaacgttttatgtgaatgtg

SEQ ID NO: 6682951 - DNA, 17 bp, Homo sapiens
caaaactacttttctaa

SEQ ID NO: 6682952 - DNA, 15 bp, Homo sapiens
caaaactagaattgt

SEQ ID NO: 6682953 - DNA, 14 bp, Homo sapiens
caaaactagttctt

SEQ ID NO: 6682954 - DNA, 15 bp, Homo sapiens
caaaactatacttga

SEQ ID NO: 6682955 - DNA, 21 bp, Homo sapiens
caaaactatcctatgccttca

SEQ ID NO: 6682956 - DNA, 19 bp, Homo sapiens
caaaactatcggttcaagt

SEQ ID NO: 6682957 - DNA, 17 bp, Homo sapiens
caaaactatgacaattt

SEQ ID NO: 6682958 - DNA, 15 bp, Homo sapiens
caaaactatttttgt

SEQ ID NO: 6682959 - DNA, 16 bp, Homo sapiens
caaaactcacagagct

SEQ ID NO: 6682960 - DNA, 15 bp, Homo sapiens
caaaactcaggcaga

SEQ ID NO: 6682961 - DNA, 15 bp, Homo sapiens
caaaactccaggcag

SEQ ID NO: 6682962 - DNA, 17 bp, Homo sapiens
caaaactccaggcagga

SEQ ID NO: 6682963 - DNA, 11 bp, Homo sapiens
caaaactctac

SEQ ID NO: 6682964 - DNA, 16 bp, Homo sapiens
caaaactctcctctgc

SEQ ID NO: 6682965 - DNA, 22 bp, Homo sapiens
caaaactctcctctgctgctgg

SEQ ID NO: 6682966 - DNA, 23 bp, Homo sapiens
caaaactctcctctgctgctggc

SEQ ID NO: 6682967 - DNA, 18 bp, Homo sapiens
caaaactgcactgtcaag

SEQ ID NO: 6682968 - DNA, 18 bp, Homo sapiens
caaaactgctttgtgcat

SEQ ID NO: 6682969 - DNA, 20 bp, Homo sapiens
caaaactgctttgtgcatat

SEQ ID NO: 6682970 - DNA, 19 bp, Homo sapiens
caaaactgtaccctatgtt

SEQ ID NO: 6682971 - DNA, 13 bp, Homo sapiens
caaaactgttctt

SEQ ID NO: 6682972 - DNA, 18 bp, Homo sapiens
caaaacttaaaagtattc

SEQ ID NO: 6682973 - DNA, 13 bp, Homo sapiens
caaaacttaacat

SEQ ID NO: 6682974 - DNA, 20 bp, Homo sapiens
caaaacttaagatgggcctg

SEQ ID NO: 6682975 - DNA, 20 bp, Homo sapiens
caaaacttataatttccaaa

SEQ ID NO: 6682976 - DNA, 15 bp, Homo sapiens
caaaacttcttgtca

SEQ ID NO: 6682977 - DNA, 19 bp, Homo sapiens
caaaacttcttgtcagaca

SEQ ID NO: 6682978 - DNA, 20 bp, Homo sapiens
caaaacttcttgtcagacat

SEQ ID NO: 6682979 - DNA, 12 bp, Homo sapiens
caaaacttgaaa

SEQ ID NO: 6682980 - DNA, 12 bp, Homo sapiens
caaaactttcag

SEQ ID NO: 6682981 - DNA, 22 bp, Homo sapiens
caaaagaaaaaagcaagtacaa

SEQ ID NO: 6682982 - DNA, 12 bp, Homo sapiens
caaaagaaaaac

SEQ ID NO: 6682983 - DNA, 20 bp, Homo sapiens
caaaagaaaattgatatttt

SEQ ID NO: 6682984 - DNA, 23 bp, Homo sapiens
caaaagaaaattgatatttttat

SEQ ID NO: 6682985 - DNA, 18 bp, Homo sapiens
caaaagaaacaccagtgt

SEQ ID NO: 6682986 - DNA, 20 bp, Homo sapiens
caaaagaaacaccagtgtta

SEQ ID NO: 6682987 - DNA, 16 bp, Homo sapiens
caaaagaaaccatgac

SEQ ID NO: 6682988 - DNA, 17 bp, Homo sapiens
caaaagaaaccatgaca

SEQ ID NO: 6682989 - DNA, 23 bp, Homo sapiens
caaaagaaaccatgcaaagcaac

SEQ ID NO: 6682990 - DNA, 13 bp, Homo sapiens
caaaagaaactta

SEQ ID NO: 6682991 - DNA, 14 bp, Homo sapiens
caaaagaagaagtt

SEQ ID NO: 6682992 - DNA, 15 bp, Homo sapiens
caaaagaagaagttt

SEQ ID NO: 6682993 - DNA, 20 bp, Homo sapiens
caaaagaagaagtttcatca

SEQ ID NO: 6682994 - DNA, 16 bp, Homo sapiens
caaaagaagcccccag

SEQ ID NO: 6682995 - DNA, 20 bp, Homo sapiens
caaaagaagcccggctcctg

SEQ ID NO: 6682996 - DNA, 20 bp, Homo sapiens
caaaagaagggtaagtgctt

SEQ ID NO: 6682997 - DNA, 18 bp, Homo sapiens
caaaagaagtaaaagcaa

SEQ ID NO: 6682998 - DNA, 14 bp, Homo sapiens
caaaagaagtaaca

SEQ ID NO: 6682999 - DNA, 17 bp, Homo sapiens
caaaagaagtaacaaga

SEQ ID NO: 6683000 - DNA, 19 bp, Homo sapiens
caaaagaatggcagaaaag

SEQ ID NO: 6683001 - DNA, 15 bp, Homo sapiens
caaaagaattaaatt

SEQ ID NO: 6683002 - DNA, 12 bp, Homo sapiens
caaaagaatttt

SEQ ID NO: 6683003 - DNA, 12 bp, Homo sapiens
caaaagacaatt

SEQ ID NO: 6683004 - DNA, 13 bp, Homo sapiens
caaaagacaattc

SEQ ID NO: 6683005 - DNA, 22 bp, Homo sapiens
caaaagacaattctttatacaa

SEQ ID NO: 6683006 - DNA, 17 bp, Homo sapiens
caaaagacagacccagt

SEQ ID NO: 6683007 - DNA, 22 bp, Homo sapiens
caaaagacatcctcaaaagaaa

SEQ ID NO: 6683008 - DNA, 21 bp, Homo sapiens
caaaagacatgttgtaaatta

SEQ ID NO: 6683009 - DNA, 19 bp, Homo sapiens
caaaagacattagagaaaa

SEQ ID NO: 6683010 - DNA, 16 bp, Homo sapiens
caaaagactagtttgt

SEQ ID NO: 6683011 - DNA, 16 bp, Homo sapiens
caaaagactggtttgt

SEQ ID NO: 6683012 - DNA, 19 bp, Homo sapiens
caaaagagaaaaaaaatta

SEQ ID NO: 6683013 - DNA, 16 bp, Homo sapiens
caaaagagacagggag

SEQ ID NO: 6683014 - DNA, 13 bp, Homo sapiens
caaaagagagaat

SEQ ID NO: 6683015 - DNA, 15 bp, Homo sapiens
caaaagagatgaaag

SEQ ID NO: 6683016 - DNA, 23 bp, Homo sapiens
caaaagagcatggatgcatttca

SEQ ID NO: 6683017 - DNA, 16 bp, Homo sapiens
caaaagagccctggct

SEQ ID NO: 6683018 - DNA, 23 bp, Homo sapiens
caaaagaggcttttgggccaaaa

SEQ ID NO: 6683019 - DNA, 14 bp, Homo sapiens
caaaagagggttta

SEQ ID NO: 6683020 - DNA, 21 bp, Homo sapiens
caaaagagggtttattttcag

SEQ ID NO: 6683021 - DNA, 19 bp, Homo sapiens
caaaagaggtgtcatgctt

SEQ ID NO: 6683022 - DNA, 16 bp, Homo sapiens
caaaagaggttacttt

SEQ ID NO: 6683023 - DNA, 17 bp, Homo sapiens
caaaagaggttacttta

SEQ ID NO: 6683024 - DNA, 22 bp, Homo sapiens
caaaagaggttactttagttag

SEQ ID NO: 6683025 - DNA, 13 bp, Homo sapiens
caaaagataatat

SEQ ID NO: 6683026 - DNA, 15 bp, Homo sapiens
caaaagatacaaaag

SEQ ID NO: 6683027 - DNA, 12 bp, Homo sapiens
caaaagatatga

SEQ ID NO: 6683028 - DNA, 15 bp, Homo sapiens
caaaagatctgggga

SEQ ID NO: 6683029 - DNA, 16 bp, Homo sapiens
caaaagattaatcttt

SEQ ID NO: 6683030 - DNA, 19 bp, Homo sapiens
caaaagattaatctttaaa

SEQ ID NO: 6683031 - DNA, 19 bp, Homo sapiens
caaaagattgctgaaattt

SEQ ID NO: 6683032 - DNA, 20 bp, Homo sapiens
caaaagatttggaaagatat

SEQ ID NO: 6683033 - DNA, 14 bp, Homo sapiens
caaaagcaaaattt

SEQ ID NO: 6683034 - DNA, 17 bp, Homo sapiens
caaaagcaaaattttta

SEQ ID NO: 6683035 - DNA, 17 bp, Homo sapiens
caaaagcaaagatgcat

SEQ ID NO: 6683036 - DNA, 23 bp, Homo sapiens
caaaagcaagactgttgctcaaa

SEQ ID NO: 6683037 - DNA, 17 bp, Homo sapiens
caaaagcaatcatagag

SEQ ID NO: 6683038 - DNA, 21 bp, Homo sapiens
caaaagcacaaaccctgggga

SEQ ID NO: 6683039 - DNA, 22 bp, Homo sapiens
caaaagcacaaaccctggggac

SEQ ID NO: 6683040 - DNA, 21 bp, Homo sapiens
caaaagcacttgttccttctg

SEQ ID NO: 6683041 - DNA, 16 bp, Homo sapiens
caaaagcagcacaagg

SEQ ID NO: 6683042 - DNA, 20 bp, Homo sapiens
caaaagcagccctctgcctc

SEQ ID NO: 6683043 - DNA, 17 bp, Homo sapiens
caaaagcagctaaatgt

SEQ ID NO: 6683044 - DNA, 15 bp, Homo sapiens
caaaagcagctttta

SEQ ID NO: 6683045 - DNA, 16 bp, Homo sapiens
caaaagcaggcgacaa

SEQ ID NO: 6683046 - DNA, 18 bp, Homo sapiens
caaaagccataacttgaa

SEQ ID NO: 6683047 - DNA, 18 bp, Homo sapiens
caaaagccatgtatttca

SEQ ID NO: 6683048 - DNA, 15 bp, Homo sapiens
caaaagcccattcat

SEQ ID NO: 6683049 - DNA, 20 bp, Homo sapiens
caaaagcccattcattccat

SEQ ID NO: 6683050 - DNA, 19 bp, Homo sapiens
caaaagcctcagaaaggga

SEQ ID NO: 6683051 - DNA, 11 bp, Homo sapiens
caaaagcctct

SEQ ID NO: 6683052 - DNA, 14 bp, Homo sapiens
caaaagccttgtgt

SEQ ID NO: 6683053 - DNA, 18 bp, Homo sapiens
caaaagccttgtgtatat

SEQ ID NO: 6683054 - DNA, 22 bp, Homo sapiens
caaaagccttgtgtatatttgt

SEQ ID NO: 6683055 - DNA, 23 bp, Homo sapiens
caaaagccttgtgtatatttgta

SEQ ID NO: 6683056 - DNA, 15 bp, Homo sapiens
caaaagcgccctcac

SEQ ID NO: 6683057 - DNA, 14 bp, Homo sapiens
caaaagctatatgt

SEQ ID NO: 6683058 - DNA, 12 bp, Homo sapiens
caaaagctcagg

SEQ ID NO: 6683059 - DNA, 14 bp, Homo sapiens
caaaagctcagggc

SEQ ID NO: 6683060 - DNA, 21 bp, Homo sapiens
caaaagctcagggccctgtgc

SEQ ID NO: 6683061 - DNA, 21 bp, Homo sapiens
caaaagctgaacacatttctt

SEQ ID NO: 6683062 - DNA, 21 bp, Homo sapiens
caaaagctgaccacaaagagt

SEQ ID NO: 6683063 - DNA, 12 bp, Homo sapiens
caaaagctgctc

SEQ ID NO: 6683064 - DNA, 22 bp, Homo sapiens
caaaagctgcttgactatcaca

SEQ ID NO: 6683065 - DNA, 19 bp, Homo sapiens
caaaagctgggcaggttgg

SEQ ID NO: 6683066 - DNA, 11 bp, Homo sapiens
caaaagctgta

SEQ ID NO: 6683067 - DNA, 15 bp, Homo sapiens
caaaagctgtgtctc

SEQ ID NO: 6683068 - DNA, 17 bp, Homo sapiens
caaaagcttcaaattaa

SEQ ID NO: 6683069 - DNA, 20 bp, Homo sapiens
caaaagcttgtgtatcttga

SEQ ID NO: 6683070 - DNA, 21 bp, Homo sapiens
caaaagctttttgatgtataa

SEQ ID NO: 6683071 - DNA, 16 bp, Homo sapiens
caaaaggaaaaagctc

SEQ ID NO: 6683072 - DNA, 17 bp, Homo sapiens
caaaaggaaaaagctcc

SEQ ID NO: 6683073 - DNA, 14 bp, Homo sapiens
caaaaggaaagaaa

SEQ ID NO: 6683074 - DNA, 16 bp, Homo sapiens
caaaaggaaagctgtg

SEQ ID NO: 6683075 - DNA, 20 bp, Homo sapiens
caaaaggaaagctgtgttta

SEQ ID NO: 6683076 - DNA, 15 bp, Homo sapiens
caaaaggaacaaaaa

SEQ ID NO: 6683077 - DNA, 16 bp, Homo sapiens
caaaaggaagattctt

SEQ ID NO: 6683078 - DNA, 14 bp, Homo sapiens
caaaaggaatagat

SEQ ID NO: 6683079 - DNA, 18 bp, Homo sapiens
caaaaggagaactgtgct

SEQ ID NO: 6683080 - DNA, 19 bp, Homo sapiens
caaaaggagaactgtgctc

SEQ ID NO: 6683081 - DNA, 22 bp, Homo sapiens
caaaaggagaactgtgctctcc

SEQ ID NO: 6683082 - DNA, 20 bp, Homo sapiens
caaaaggagaagaggaacat

SEQ ID NO: 6683083 - DNA, 21 bp, Homo sapiens
caaaaggaggaatttcagtgg

SEQ ID NO: 6683084 - DNA, 24 bp, Homo sapiens
caaaaggatctttgtggccaagga

SEQ ID NO: 6683085 - DNA, 23 bp, Homo sapiens
caaaaggatggtggttattttaa

SEQ ID NO: 6683086 - DNA, 11 bp, Homo sapiens
caaaaggcagc

SEQ ID NO: 6683087 - DNA, 12 bp, Homo sapiens
caaaaggcagct

SEQ ID NO: 6683088 - DNA, 19 bp, Homo sapiens
caaaaggcagtggggctgg

SEQ ID NO: 6683089 - DNA, 21 bp, Homo sapiens
caaaaggcatttcccaccctg

SEQ ID NO: 6683090 - DNA, 17 bp, Homo sapiens
caaaaggccccttccca

SEQ ID NO: 6683091 - DNA, 19 bp, Homo sapiens
caaaaggccctctggaggg

SEQ ID NO: 6683092 - DNA, 16 bp, Homo sapiens
caaaaggcctcttgta

SEQ ID NO: 6683093 - DNA, 23 bp, Homo sapiens
caaaaggcctcttgtaaagactg

SEQ ID NO: 6683094 - DNA, 18 bp, Homo sapiens
caaaaggctccatatata

SEQ ID NO: 6683095 - DNA, 17 bp, Homo sapiens
caaaagggaaaaaataa

SEQ ID NO: 6683096 - DNA, 20 bp, Homo sapiens
caaaagggaaaaaataaaaa

SEQ ID NO: 6683097 - DNA, 16 bp, Homo sapiens
caaaagggagaacatg

SEQ ID NO: 6683098 - DNA, 13 bp, Homo sapiens
caaaagggccagg

SEQ ID NO: 6683099 - DNA, 20 bp, Homo sapiens
caaaagggggccccttgaga

SEQ ID NO: 6683100 - DNA, 18 bp, Homo sapiens
caaaagggtgtatagtgt

SEQ ID NO: 6683101 - DNA, 21 bp, Homo sapiens
caaaagggtgtatagtgttca

SEQ ID NO: 6683102 - DNA, 16 bp, Homo sapiens
caaaagggtgtctgag

SEQ ID NO: 6683103 - DNA, 22 bp, Homo sapiens
caaaagggtttaaactgattca

SEQ ID NO: 6683104 - DNA, 16 bp, Homo sapiens
caaaaggtaaatacaa

SEQ ID NO: 6683105 - DNA, 17 bp, Homo sapiens
caaaaggtaaatacaat

SEQ ID NO: 6683106 - DNA, 21 bp, Homo sapiens
caaaaggtattttaatcacca

SEQ ID NO: 6683107 - DNA, 22 bp, Homo sapiens
caaaaggtgattaaatatttaa

SEQ ID NO: 6683108 - DNA, 13 bp, Homo sapiens
caaaaggtgcctg

SEQ ID NO: 6683109 - DNA, 18 bp, Homo sapiens
caaaaggtgcctgtgagg

SEQ ID NO: 6683110 - DNA, 22 bp, Homo sapiens
caaaaggtgcctgtgaggcagg

SEQ ID NO: 6683111 - DNA, 13 bp, Homo sapiens
caaaaggtgtgcc

SEQ ID NO: 6683112 - DNA, 17 bp, Homo sapiens
caaaaggttaagccata

SEQ ID NO: 6683113 - DNA, 20 bp, Homo sapiens
caaaaggtttgagattcctg

SEQ ID NO: 6683114 - DNA, 17 bp, Homo sapiens
caaaagtaaatgggagg

SEQ ID NO: 6683115 - DNA, 15 bp, Homo sapiens
caaaagtaatcactt

SEQ ID NO: 6683116 - DNA, 15 bp, Homo sapiens
caaaagtaatgcctc

SEQ ID NO: 6683117 - DNA, 17 bp, Homo sapiens
caaaagtaatgcctctg

SEQ ID NO: 6683118 - DNA, 18 bp, Homo sapiens
caaaagtagaactttgta

SEQ ID NO: 6683119 - DNA, 20 bp, Homo sapiens
caaaagtagaactttgtata

SEQ ID NO: 6683120 - DNA, 22 bp, Homo sapiens
caaaagtatattcaaaaattat

SEQ ID NO: 6683121 - DNA, 14 bp, Homo sapiens
caaaagtattttcc

SEQ ID NO: 6683122 - DNA, 17 bp, Homo sapiens
caaaagtattttcctgt

SEQ ID NO: 6683123 - DNA, 19 bp, Homo sapiens
caaaagtattttcctgtaa

SEQ ID NO: 6683124 - DNA, 14 bp, Homo sapiens
caaaagtccctccc

SEQ ID NO: 6683125 - DNA, 21 bp, Homo sapiens
caaaagtccctccctgcctga

SEQ ID NO: 6683126 - DNA, 22 bp, Homo sapiens
caaaagtccctccctgcctgag

SEQ ID NO: 6683127 - DNA, 20 bp, Homo sapiens
caaaagtctcaatgttccat

SEQ ID NO: 6683128 - DNA, 11 bp, Homo sapiens
caaaagtctga

SEQ ID NO: 6683129 - DNA, 15 bp, Homo sapiens
caaaagtctgaggca

SEQ ID NO: 6683130 - DNA, 15 bp, Homo sapiens
caaaagtgaaccatc

SEQ ID NO: 6683131 - DNA, 16 bp, Homo sapiens
caaaagtgaaccatct

SEQ ID NO: 6683132 - DNA, 14 bp, Homo sapiens
caaaagtgaacttg

SEQ ID NO: 6683133 - DNA, 14 bp, Homo sapiens
caaaagtgacagat

SEQ ID NO: 6683134 - DNA, 20 bp, Homo sapiens
caaaagtgacagatgttatt

SEQ ID NO: 6683135 - DNA, 20 bp, Homo sapiens
caaaagtgagatgggaaggg

SEQ ID NO: 6683136 - DNA, 17 bp, Homo sapiens
caaaagtgatctgtccc

SEQ ID NO: 6683137 - DNA, 23 bp, Homo sapiens
caaaagtgcagcaggagaactct

SEQ ID NO: 6683138 - DNA, 19 bp, Homo sapiens
caaaagtgcagtagtgtca

SEQ ID NO: 6683139 - DNA, 14 bp, Homo sapiens
caaaagtgcattca

SEQ ID NO: 6683140 - DNA, 15 bp, Homo sapiens
caaaagtgcattcaa

SEQ ID NO: 6683141 - DNA, 15 bp, Homo sapiens
caaaagtgctttgga

SEQ ID NO: 6683142 - DNA, 16 bp, Homo sapiens
caaaagtggcctcttt

SEQ ID NO: 6683143 - DNA, 17 bp, Homo sapiens
caaaagtggcctctttg

SEQ ID NO: 6683144 - DNA, 20 bp, Homo sapiens
caaaagtggggctaaatgaa

SEQ ID NO: 6683145 - DNA, 21 bp, Homo sapiens
caaaagtggggctaaatgaag

SEQ ID NO: 6683146 - DNA, 11 bp, Homo sapiens
caaaagtgtca

SEQ ID NO: 6683147 - DNA, 18 bp, Homo sapiens
caaaagttacatgtttgc

SEQ ID NO: 6683148 - DNA, 19 bp, Homo sapiens
caaaagttacatgtttgca

SEQ ID NO: 6683149 - DNA, 12 bp, Homo sapiens
caaaagttatta

SEQ ID NO: 6683150 - DNA, 18 bp, Homo sapiens
caaaagttattaaaattg

SEQ ID NO: 6683151 - DNA, 14 bp, Homo sapiens
caaaagttccaaga

SEQ ID NO: 6683152 - DNA, 18 bp, Homo sapiens
caaaagttggactaaatg

SEQ ID NO: 6683153 - DNA, 16 bp, Homo sapiens
caaaagttgtttaata

SEQ ID NO: 6683154 - DNA, 14 bp, Homo sapiens
caaaagtttctctt

SEQ ID NO: 6683155 - DNA, 18 bp, Homo sapiens
caaaagtttgtttgctta

SEQ ID NO: 6683156 - DNA, 23 bp, Homo sapiens
caaaagttttaattaaaaaaaat

SEQ ID NO: 6683157 - DNA, 15 bp, Homo sapiens
caaaagttttcctga

SEQ ID NO: 6683158 - DNA, 17 bp, Homo sapiens
caaaagttttcctgaga

SEQ ID NO: 6683159 - DNA, 15 bp, Homo sapiens
caaaataaaaaccaa

SEQ ID NO: 6683160 - DNA, 18 bp, Homo sapiens
caaaataaaaagcctcag

SEQ ID NO: 6683161 - DNA, 19 bp, Homo sapiens
caaaataaaaattgaaaaa

SEQ ID NO: 6683162 - DNA, 13 bp, Homo sapiens
caaaataaaacat

SEQ ID NO: 6683163 - DNA, 14 bp, Homo sapiens
caaaataaaacata

SEQ ID NO: 6683164 - DNA, 15 bp, Homo sapiens
caaaataaaacatag

SEQ ID NO: 6683165 - DNA, 15 bp, Homo sapiens
caaaataaaaccaga

SEQ ID NO: 6683166 - DNA, 16 bp, Homo sapiens
caaaataaaacttttt

SEQ ID NO: 6683167 - DNA, 20 bp, Homo sapiens
caaaataaaactttttaaaa

SEQ ID NO: 6683168 - DNA, 20 bp, Homo sapiens
caaaataaaaggactctgga

SEQ ID NO: 6683169 - DNA, 16 bp, Homo sapiens
caaaataaaatgagtt

SEQ ID NO: 6683170 - DNA, 18 bp, Homo sapiens
caaaataaacctgttctt

SEQ ID NO: 6683171 - DNA, 12 bp, Homo sapiens
caaaataaagaa

SEQ ID NO: 6683172 - DNA, 23 bp, Homo sapiens
caaaataaagttacattgctggt

SEQ ID NO: 6683173 - DNA, 14 bp, Homo sapiens
caaaataaatgttg

SEQ ID NO: 6683174 - DNA, 21 bp, Homo sapiens
caaaataaggggcacctggga

SEQ ID NO: 6683175 - DNA, 13 bp, Homo sapiens
caaaataagtttt

SEQ ID NO: 6683176 - DNA, 17 bp, Homo sapiens
caaaataatgtcttgtt

SEQ ID NO: 6683177 - DNA, 20 bp, Homo sapiens
caaaataatgtcttgttaat

SEQ ID NO: 6683178 - DNA, 17 bp, Homo sapiens
caaaataattagctata

SEQ ID NO: 6683179 - DNA, 21 bp, Homo sapiens
caaaataattagctatatttt

SEQ ID NO: 6683180 - DNA, 11 bp, Homo sapiens
caaaataattc

SEQ ID NO: 6683181 - DNA, 13 bp, Homo sapiens
caaaataatttaa

SEQ ID NO: 6683182 - DNA, 17 bp, Homo sapiens
caaaataatttaactaa

SEQ ID NO: 6683183 - DNA, 21 bp, Homo sapiens
caaaataatttaactaattta

SEQ ID NO: 6683184 - DNA, 22 bp, Homo sapiens
caaaatacaatcctgtttataa

SEQ ID NO: 6683185 - DNA, 22 bp, Homo sapiens
caaaatacacattcttgcttgt

SEQ ID NO: 6683186 - DNA, 18 bp, Homo sapiens
caaaatacagcactttga

SEQ ID NO: 6683187 - DNA, 14 bp, Homo sapiens
caaaatacatgaag

SEQ ID NO: 6683188 - DNA, 19 bp, Homo sapiens
caaaatacatgatgatttc

SEQ ID NO: 6683189 - DNA, 22 bp, Homo sapiens
caaaatacattattcttcttta

SEQ ID NO: 6683190 - DNA, 23 bp, Homo sapiens
caaaatacattctttttgctcta

SEQ ID NO: 6683191 - DNA, 16 bp, Homo sapiens
caaaatacatttgtaa

SEQ ID NO: 6683192 - DNA, 16 bp, Homo sapiens
caaaataccaaatgcc

SEQ ID NO: 6683193 - DNA, 20 bp, Homo sapiens
caaaataccaaatgcctgtt

SEQ ID NO: 6683194 - DNA, 14 bp, Homo sapiens
caaaataccagagc

SEQ ID NO: 6683195 - DNA, 16 bp, Homo sapiens
caaaataccagagcct

SEQ ID NO: 6683196 - DNA, 17 bp, Homo sapiens
caaaatactacacatcc

SEQ ID NO: 6683197 - DNA, 16 bp, Homo sapiens
caaaatactccaaaga

SEQ ID NO: 6683198 - DNA, 17 bp, Homo sapiens
caaaatactccaaagat

SEQ ID NO: 6683199 - DNA, 14 bp, Homo sapiens
caaaatacttcttt

SEQ ID NO: 6683200 - DNA, 15 bp, Homo sapiens
caaaatactttttaa

SEQ ID NO: 6683201 - DNA, 14 bp, Homo sapiens
caaaatagaaaagt

SEQ ID NO: 6683202 - DNA, 17 bp, Homo sapiens
caaaatagaaaagttat

SEQ ID NO: 6683203 - DNA, 15 bp, Homo sapiens
caaaatagaagaaga

SEQ ID NO: 6683204 - DNA, 18 bp, Homo sapiens
caaaatagacaagttttg

SEQ ID NO: 6683205 - DNA, 16 bp, Homo sapiens
caaaatagacatcttt

SEQ ID NO: 6683206 - DNA, 15 bp, Homo sapiens
caaaatagcatttgt

SEQ ID NO: 6683207 - DNA, 20 bp, Homo sapiens
caaaatagcttattatagaa

SEQ ID NO: 6683208 - DNA, 21 bp, Homo sapiens
caaaataggatttcttaaatt

SEQ ID NO: 6683209 - DNA, 14 bp, Homo sapiens
caaaatagtattgc

SEQ ID NO: 6683210 - DNA, 18 bp, Homo sapiens
caaaatagtcatgtttct

SEQ ID NO: 6683211 - DNA, 13 bp, Homo sapiens
caaaatagttcta

SEQ ID NO: 6683212 - DNA, 17 bp, Homo sapiens
caaaatagttctatttc

SEQ ID NO: 6683213 - DNA, 20 bp, Homo sapiens
caaaatagtttaggaaaatg

SEQ ID NO: 6683214 - DNA, 21 bp, Homo sapiens
caaaatataaatcacagattt

SEQ ID NO: 6683215 - DNA, 13 bp, Homo sapiens
caaaatatataat

SEQ ID NO: 6683216 - DNA, 18 bp, Homo sapiens
caaaatatatgtttggct

SEQ ID NO: 6683217 - DNA, 19 bp, Homo sapiens
caaaatatattttcagtac

SEQ ID NO: 6683218 - DNA, 14 bp, Homo sapiens
caaaatatattttg

SEQ ID NO: 6683219 - DNA, 22 bp, Homo sapiens
caaaatatgccccttcttgggc

SEQ ID NO: 6683220 - DNA, 19 bp, Homo sapiens
caaaatatgttgatgaaaa

SEQ ID NO: 6683221 - DNA, 13 bp, Homo sapiens
caaaatattaaca

SEQ ID NO: 6683222 - DNA, 18 bp, Homo sapiens
caaaatattcttctttga

SEQ ID NO: 6683223 - DNA, 21 bp, Homo sapiens
caaaatattcttctttgatag

SEQ ID NO: 6683224 - DNA, 14 bp, Homo sapiens
caaaatatttaaaa

SEQ ID NO: 6683225 - DNA, 19 bp, Homo sapiens
caaaatatttaaaaatgtc

SEQ ID NO: 6683226 - DNA, 14 bp, Homo sapiens
caaaatatttaagt

SEQ ID NO: 6683227 - DNA, 20 bp, Homo sapiens
caaaatatttaagtgaagga

SEQ ID NO: 6683228 - DNA, 14 bp, Homo sapiens
caaaatatttaatt

SEQ ID NO: 6683229 - DNA, 21 bp, Homo sapiens
caaaatatttatttgttttgg

SEQ ID NO: 6683230 - DNA, 16 bp, Homo sapiens
caaaatatttgtacat

SEQ ID NO: 6683231 - DNA, 17 bp, Homo sapiens
caaaatatttgtacata

SEQ ID NO: 6683232 - DNA, 12 bp, Homo sapiens
caaaatattttc

SEQ ID NO: 6683233 - DNA, 16 bp, Homo sapiens
caaaatatttttaaaa

SEQ ID NO: 6683234 - DNA, 15 bp, Homo sapiens
caaaatattttttgc

SEQ ID NO: 6683235 - DNA, 17 bp, Homo sapiens
caaaatcaagcaagcct

SEQ ID NO: 6683236 - DNA, 18 bp, Homo sapiens
caaaatcaagcctgattc

SEQ ID NO: 6683237 - DNA, 17 bp, Homo sapiens
caaaatcagtgatggga

SEQ ID NO: 6683238 - DNA, 23 bp, Homo sapiens
caaaatcatgaatatttcaaaat

SEQ ID NO: 6683239 - DNA, 23 bp, Homo sapiens
caaaatcatggaatggttataaa

SEQ ID NO: 6683240 - DNA, 16 bp, Homo sapiens
caaaatcattttaatg

SEQ ID NO: 6683241 - DNA, 23 bp, Homo sapiens
caaaatcattttatatgtcaaag

SEQ ID NO: 6683242 - DNA, 22 bp, Homo sapiens
caaaatccaaaaagaaatgatg

SEQ ID NO: 6683243 - DNA, 16 bp, Homo sapiens
caaaatccaaactgct

SEQ ID NO: 6683244 - DNA, 22 bp, Homo sapiens
caaaatcctgaactttctccct

SEQ ID NO: 6683245 - DNA, 19 bp, Homo sapiens
caaaatccttccaaagaat

SEQ ID NO: 6683246 - DNA, 20 bp, Homo sapiens
caaaatccttgcttatgaca

SEQ ID NO: 6683247 - DNA, 21 bp, Homo sapiens
caaaatcgtttttaatttaaa

SEQ ID NO: 6683248 - DNA, 19 bp, Homo sapiens
caaaatctaaaatgtttta

SEQ ID NO: 6683249 - DNA, 22 bp, Homo sapiens
caaaatctaaaatgttttatga

SEQ ID NO: 6683250 - DNA, 19 bp, Homo sapiens
caaaatctcccattttgga

SEQ ID NO: 6683251 - DNA, 21 bp, Homo sapiens
caaaatctctccactttcagc

SEQ ID NO: 6683252 - DNA, 16 bp, Homo sapiens
caaaatctgattagaa

SEQ ID NO: 6683253 - DNA, 21 bp, Homo sapiens
caaaatctgtagagcagggca

SEQ ID NO: 6683254 - DNA, 16 bp, Homo sapiens
caaaatctgttctaac

SEQ ID NO: 6683255 - DNA, 16 bp, Homo sapiens
caaaatcttgatcagt

SEQ ID NO: 6683256 - DNA, 18 bp, Homo sapiens
caaaatcttgatcagtta

SEQ ID NO: 6683257 - DNA, 22 bp, Homo sapiens
caaaatcttgatcagttaagaa

SEQ ID NO: 6683258 - DNA, 19 bp, Homo sapiens
caaaatctttgtataaata

SEQ ID NO: 6683259 - DNA, 23 bp, Homo sapiens
caaaatctttgtataaataaata

SEQ ID NO: 6683260 - DNA, 15 bp, Homo sapiens
caaaatgaaaagaga

SEQ ID NO: 6683261 - DNA, 19 bp, Homo sapiens
caaaatgaaaagagaaact

SEQ ID NO: 6683262 - DNA, 12 bp, Homo sapiens
caaaatgaaaca

SEQ ID NO: 6683263 - DNA, 21 bp, Homo sapiens
caaaatgaactaactgccatg

SEQ ID NO: 6683264 - DNA, 22 bp, Homo sapiens
caaaatgaactaactgccatgt

SEQ ID NO: 6683265 - DNA, 19 bp, Homo sapiens
caaaatgaagatacacatt

SEQ ID NO: 6683266 - DNA, 15 bp, Homo sapiens
caaaatgaattttta

SEQ ID NO: 6683267 - DNA, 14 bp, Homo sapiens
caaaatgacaatga

SEQ ID NO: 6683268 - DNA, 19 bp, Homo sapiens
caaaatgacatctttttaa

SEQ ID NO: 6683269 - DNA, 11 bp, Homo sapiens
caaaatgactt

SEQ ID NO: 6683270 - DNA, 17 bp, Homo sapiens
caaaatgactttataca

SEQ ID NO: 6683271 - DNA, 19 bp, Homo sapiens
caaaatgactttatacaac

SEQ ID NO: 6683272 - DNA, 19 bp, Homo sapiens
caaaatgactttgaactga

SEQ ID NO: 6683273 - DNA, 21 bp, Homo sapiens
caaaatgagccctgtcctgcc

SEQ ID NO: 6683274 - DNA, 20 bp, Homo sapiens
caaaatgaggaatgtatatg

SEQ ID NO: 6683275 - DNA, 17 bp, Homo sapiens
caaaatgattgtctttt

SEQ ID NO: 6683276 - DNA, 20 bp, Homo sapiens
caaaatgcatacgtattgtt

SEQ ID NO: 6683277 - DNA, 12 bp, Homo sapiens
caaaatgcatgt

SEQ ID NO: 6683278 - DNA, 15 bp, Homo sapiens
caaaatgcatgtgat

SEQ ID NO: 6683279 - DNA, 20 bp, Homo sapiens
caaaatgctttttatttctg

SEQ ID NO: 6683280 - DNA, 23 bp, Homo sapiens
caaaatgctttttatttctgcat

SEQ ID NO: 6683281 - DNA, 18 bp, Homo sapiens
caaaatggaaatgtaata

SEQ ID NO: 6683282 - DNA, 16 bp, Homo sapiens
caaaatggacatggtg

SEQ ID NO: 6683283 - DNA, 16 bp, Homo sapiens
caaaatggattttagt

SEQ ID NO: 6683284 - DNA, 20 bp, Homo sapiens
caaaatgggagatcttctca

SEQ ID NO: 6683285 - DNA, 19 bp, Homo sapiens
caaaatgggaggaggaaag

SEQ ID NO: 6683286 - DNA, 21 bp, Homo sapiens
caaaatggtacagcttctgga

SEQ ID NO: 6683287 - DNA, 19 bp, Homo sapiens
caaaatggtcctatttttg

SEQ ID NO: 6683288 - DNA, 23 bp, Homo sapiens
caaaatggtcctatttttgtgaa

SEQ ID NO: 6683289 - DNA, 11 bp, Homo sapiens
caaaatgtaac

SEQ ID NO: 6683290 - DNA, 13 bp, Homo sapiens
caaaatgtaactg

SEQ ID NO: 6683291 - DNA, 16 bp, Homo sapiens
caaaatgtacttaaat

SEQ ID NO: 6683292 - DNA, 17 bp, Homo sapiens
caaaatgtagacaaagt

SEQ ID NO: 6683293 - DNA, 17 bp, Homo sapiens
caaaatgtatatattta

SEQ ID NO: 6683294 - DNA, 18 bp, Homo sapiens
caaaatgtcaatttttaa

SEQ ID NO: 6683295 - DNA, 13 bp, Homo sapiens
caaaatgtccagc

SEQ ID NO: 6683296 - DNA, 23 bp, Homo sapiens
caaaatgtctgttttagttggaa

SEQ ID NO: 6683297 - DNA, 20 bp, Homo sapiens
caaaatgtcttaatgcaaat

SEQ ID NO: 6683298 - DNA, 19 bp, Homo sapiens
caaaatgtcttgtgtattt

SEQ ID NO: 6683299 - DNA, 20 bp, Homo sapiens
caaaatgtgaactgactttt

SEQ ID NO: 6683300 - DNA, 14 bp, Homo sapiens
caaaatgtgtattt

SEQ ID NO: 6683301 - DNA, 19 bp, Homo sapiens
caaaatgtgtgcttggaaa

SEQ ID NO: 6683302 - DNA, 16 bp, Homo sapiens
caaaatgttaacaact

SEQ ID NO: 6683303 - DNA, 17 bp, Homo sapiens
caaaatgttaacaactt

SEQ ID NO: 6683304 - DNA, 21 bp, Homo sapiens
caaaatgttaataaaggtttc

SEQ ID NO: 6683305 - DNA, 22 bp, Homo sapiens
caaaatgttatcttctcaagtt

SEQ ID NO: 6683306 - DNA, 16 bp, Homo sapiens
caaaatgttatttccc

SEQ ID NO: 6683307 - DNA, 10 bp, Homo sapiens
caaaatgttc

SEQ ID NO: 6683308 - DNA, 17 bp, Homo sapiens
caaaatgttcgtattct

SEQ ID NO: 6683309 - DNA, 17 bp, Homo sapiens
caaaatgttctatttaa

SEQ ID NO: 6683310 - DNA, 11 bp, Homo sapiens
caaaatgttgg

SEQ ID NO: 6683311 - DNA, 18 bp, Homo sapiens
caaaatgttggtcatttt

SEQ ID NO: 6683312 - DNA, 16 bp, Homo sapiens
caaaatgtttattttc

SEQ ID NO: 6683313 - DNA, 16 bp, Homo sapiens
caaaattaaggtgttt

SEQ ID NO: 6683314 - DNA, 19 bp, Homo sapiens
caaaattaaggtgtttgaa

SEQ ID NO: 6683315 - DNA, 18 bp, Homo sapiens
caaaattactggacatat

SEQ ID NO: 6683316 - DNA, 15 bp, Homo sapiens
caaaattagccaggt

SEQ ID NO: 6683317 - DNA, 20 bp, Homo sapiens
caaaattagccagtaatcct

SEQ ID NO: 6683318 - DNA, 22 bp, Homo sapiens
caaaattagccagtaatcctgt

SEQ ID NO: 6683319 - DNA, 22 bp, Homo sapiens
caaaattagggagctcttgaca

SEQ ID NO: 6683320 - DNA, 17 bp, Homo sapiens
caaaattataaagcctt

SEQ ID NO: 6683321 - DNA, 16 bp, Homo sapiens
caaaattatgctgcat

SEQ ID NO: 6683322 - DNA, 17 bp, Homo sapiens
caaaattatttcagaaa

SEQ ID NO: 6683323 - DNA, 15 bp, Homo sapiens
caaaattccaaattt

SEQ ID NO: 6683324 - DNA, 12 bp, Homo sapiens
caaaattcctgt

SEQ ID NO: 6683325 - DNA, 18 bp, Homo sapiens
caaaattctagaagcaga

SEQ ID NO: 6683326 - DNA, 19 bp, Homo sapiens
caaaattctagctgtatga

SEQ ID NO: 6683327 - DNA, 19 bp, Homo sapiens
caaaattgacagctttcta

SEQ ID NO: 6683328 - DNA, 19 bp, Homo sapiens
caaaattgacattgcttta

SEQ ID NO: 6683329 - DNA, 16 bp, Homo sapiens
caaaattgatgtgttt

SEQ ID NO: 6683330 - DNA, 16 bp, Homo sapiens
caaaattgcaaatctt

SEQ ID NO: 6683331 - DNA, 19 bp, Homo sapiens
caaaattgcaatttcttag

SEQ ID NO: 6683332 - DNA, 20 bp, Homo sapiens
caaaattgcctataatactt

SEQ ID NO: 6683333 - DNA, 11 bp, Homo sapiens
caaaattgctt

SEQ ID NO: 6683334 - DNA, 16 bp, Homo sapiens
caaaattgcttctaaa

SEQ ID NO: 6683335 - DNA, 19 bp, Homo sapiens
caaaattgcttctaaaaca

SEQ ID NO: 6683336 - DNA, 17 bp, Homo sapiens
caaaattgtaagccaga

SEQ ID NO: 6683337 - DNA, 13 bp, Homo sapiens
caaaattgtttac

SEQ ID NO: 6683338 - DNA, 14 bp, Homo sapiens
caaaattgttttca

SEQ ID NO: 6683339 - DNA, 19 bp, Homo sapiens
caaaattgttttcacttgt

SEQ ID NO: 6683340 - DNA, 15 bp, Homo sapiens
caaaatttaagttaa

SEQ ID NO: 6683341 - DNA, 16 bp, Homo sapiens
caaaatttaagttaac

SEQ ID NO: 6683342 - DNA, 14 bp, Homo sapiens
caaaatttaattgt

SEQ ID NO: 6683343 - DNA, 21 bp, Homo sapiens
caaaatttaattgtgtaactg

SEQ ID NO: 6683344 - DNA, 21 bp, Homo sapiens
caaaatttagtttttgttctt

SEQ ID NO: 6683345 - DNA, 13 bp, Homo sapiens
caaaatttatatt

SEQ ID NO: 6683346 - DNA, 19 bp, Homo sapiens
caaaatttatgtcattttc

SEQ ID NO: 6683347 - DNA, 19 bp, Homo sapiens
caaaatttattttataaga

SEQ ID NO: 6683348 - DNA, 20 bp, Homo sapiens
caaaatttattttataagaa

SEQ ID NO: 6683349 - DNA, 22 bp, Homo sapiens
caaaatttattttataagaaaa

SEQ ID NO: 6683350 - DNA, 16 bp, Homo sapiens
caaaatttcacagttc

SEQ ID NO: 6683351 - DNA, 15 bp, Homo sapiens
caaaatttccagtac

SEQ ID NO: 6683352 - DNA, 20 bp, Homo sapiens
caaaatttccagtacctttg

SEQ ID NO: 6683353 - DNA, 12 bp, Homo sapiens
caaaatttgaaa

SEQ ID NO: 6683354 - DNA, 18 bp, Homo sapiens
caaaatttgaataataaa

SEQ ID NO: 6683355 - DNA, 23 bp, Homo sapiens
caaaatttgactaattttacatg

SEQ ID NO: 6683356 - DNA, 21 bp, Homo sapiens
caaaatttgatggtgaatatt

SEQ ID NO: 6683357 - DNA, 12 bp, Homo sapiens
caaaattttaaa

SEQ ID NO: 6683358 - DNA, 23 bp, Homo sapiens
caaaattttataagcaaatttca

SEQ ID NO: 6683359 - DNA, 18 bp, Homo sapiens
caaaattttattcctata

SEQ ID NO: 6683360 - DNA, 14 bp, Homo sapiens
caaaattttatttt

SEQ ID NO: 6683361 - DNA, 16 bp, Homo sapiens
caaaattttattttgt

SEQ ID NO: 6683362 - DNA, 19 bp, Homo sapiens
caaaattttattttgtgct

SEQ ID NO: 6683363 - DNA, 17 bp, Homo sapiens
caaaattttctcatttt

SEQ ID NO: 6683364 - DNA, 21 bp, Homo sapiens
caaaattttgtcccatctcta

SEQ ID NO: 6683365 - DNA, 12 bp, Homo sapiens
caaaatttttaa

SEQ ID NO: 6683366 - DNA, 18 bp, Homo sapiens
caaaatttttaaaactgc

SEQ ID NO: 6683367 - DNA, 15 bp, Homo sapiens
caaaatttttcaacc

SEQ ID NO: 6683368 - DNA, 15 bp, Homo sapiens
caaacaaaaaagaaa

SEQ ID NO: 6683369 - DNA, 21 bp, Homo sapiens
caaacaaaaaggttctcaggt

SEQ ID NO: 6683370 - DNA, 23 bp, Homo sapiens
caaacaaaaatagaatatataaa

SEQ ID NO: 6683371 - DNA, 14 bp, Homo sapiens
caaacaaaaatgac

SEQ ID NO: 6683372 - DNA, 10 bp, Homo sapiens
caaacaaaac

SEQ ID NO: 6683373 - DNA, 13 bp, Homo sapiens
caaacaaaactta

SEQ ID NO: 6683374 - DNA, 14 bp, Homo sapiens
caaacaaaacttaa

SEQ ID NO: 6683375 - DNA, 13 bp, Homo sapiens
caaacaaaagcac

SEQ ID NO: 6683376 - DNA, 21 bp, Homo sapiens
caaacaaaagctgaacacatt

SEQ ID NO: 6683377 - DNA, 14 bp, Homo sapiens
caaacaaaatgatg

SEQ ID NO: 6683378 - DNA, 18 bp, Homo sapiens
caaacaaaatttctatta

SEQ ID NO: 6683379 - DNA, 14 bp, Homo sapiens
caaacaaacaaaca

SEQ ID NO: 6683380 - DNA, 16 bp, Homo sapiens
caaacaaagccagaag

SEQ ID NO: 6683381 - DNA, 14 bp, Homo sapiens
caaacaaatatgca

SEQ ID NO: 6683382 - DNA, 13 bp, Homo sapiens
caaacaaatcatt

SEQ ID NO: 6683383 - DNA, 22 bp, Homo sapiens
caaacaaatcattttgatgtat

SEQ ID NO: 6683384 - DNA, 23 bp, Homo sapiens
caaacaaccattttttgttctgt

SEQ ID NO: 6683385 - DNA, 14 bp, Homo sapiens
caaacaacctgaat

SEQ ID NO: 6683386 - DNA, 14 bp, Homo sapiens
caaacaactcagct

SEQ ID NO: 6683387 - DNA, 15 bp, Homo sapiens
caaacaacttcagaa

SEQ ID NO: 6683388 - DNA, 13 bp, Homo sapiens
caaacaagaaacg

SEQ ID NO: 6683389 - DNA, 23 bp, Homo sapiens
caaacaagaaacgtgtcacactt

SEQ ID NO: 6683390 - DNA, 16 bp, Homo sapiens
caaacaagccccctgc

SEQ ID NO: 6683391 - DNA, 18 bp, Homo sapiens
caaacaagccccctgccc

SEQ ID NO: 6683392 - DNA, 16 bp, Homo sapiens
caaacaaggaagccaa

SEQ ID NO: 6683393 - DNA, 21 bp, Homo sapiens
caaacaaggcctgtcagctaa

SEQ ID NO: 6683394 - DNA, 21 bp, Homo sapiens
caaacaaggggctgttacata

SEQ ID NO: 6683395 - DNA, 12 bp, Homo sapiens
caaacaataaac

SEQ ID NO: 6683396 - DNA, 12 bp, Homo sapiens
caaacaataata

SEQ ID NO: 6683397 - DNA, 15 bp, Homo sapiens
caaacaatacctgaa

SEQ ID NO: 6683398 - DNA, 22 bp, Homo sapiens
caaacaatacctgaatgctctg

SEQ ID NO: 6683399 - DNA, 18 bp, Homo sapiens
caaacaatcccaatcttt

SEQ ID NO: 6683400 - DNA, 19 bp, Homo sapiens
caaacaatcccaatctttc

SEQ ID NO: 6683401 - DNA, 21 bp, Homo sapiens
caaacaatcccaatctttcta

SEQ ID NO: 6683402 - DNA, 21 bp, Homo sapiens
caaacaatggaaactgaatgc

SEQ ID NO: 6683403 - DNA, 22 bp, Homo sapiens
caaacaatggaaactgaatgct

SEQ ID NO: 6683404 - DNA, 20 bp, Homo sapiens
caaacaattcaatcaaagct

SEQ ID NO: 6683405 - DNA, 23 bp, Homo sapiens
caaacaattcaatcaaagctacc

SEQ ID NO: 6683406 - DNA, 15 bp, Homo sapiens
caaacacaaatgcag

SEQ ID NO: 6683407 - DNA, 15 bp, Homo sapiens
caaacacaacacaag

SEQ ID NO: 6683408 - DNA, 14 bp, Homo sapiens
caaacacaaggtca

SEQ ID NO: 6683409 - DNA, 21 bp, Homo sapiens
caaacacaataagagtctcct

SEQ ID NO: 6683410 - DNA, 14 bp, Homo sapiens
caaacacaattcta

SEQ ID NO: 6683411 - DNA, 12 bp, Homo sapiens
caaacacacaca

SEQ ID NO: 6683412 - DNA, 14 bp, Homo sapiens
caaacacacacact

SEQ ID NO: 6683413 - DNA, 15 bp, Homo sapiens
caaacacacagaagg

SEQ ID NO: 6683414 - DNA, 18 bp, Homo sapiens
caaacacacagactctgt

SEQ ID NO: 6683415 - DNA, 13 bp, Homo sapiens
caaacacacagta

SEQ ID NO: 6683416 - DNA, 13 bp, Homo sapiens
caaacacactgta

SEQ ID NO: 6683417 - DNA, 14 bp, Homo sapiens
caaacacactgtaa

SEQ ID NO: 6683418 - DNA, 17 bp, Homo sapiens
caaacacactgtaaata

SEQ ID NO: 6683419 - DNA, 23 bp, Homo sapiens
caaacacattaagccttccacac

SEQ ID NO: 6683420 - DNA, 16 bp, Homo sapiens
caaacaccaacataaa

SEQ ID NO: 6683421 - DNA, 13 bp, Homo sapiens
caaacaccacttt

SEQ ID NO: 6683422 - DNA, 11 bp, Homo sapiens
caaacaccagt

SEQ ID NO: 6683423 - DNA, 17 bp, Homo sapiens
caaacaccattattcca

SEQ ID NO: 6683424 - DNA, 18 bp, Homo sapiens
caaacacccaagcacaaa

SEQ ID NO: 6683425 - DNA, 22 bp, Homo sapiens
caaacacccacttatttttcaa

SEQ ID NO: 6683426 - DNA, 13 bp, Homo sapiens
caaacacccagag

SEQ ID NO: 6683427 - DNA, 14 bp, Homo sapiens
caaacacctcccag

SEQ ID NO: 6683428 - DNA, 14 bp, Homo sapiens
caaacacctgctga

SEQ ID NO: 6683429 - DNA, 15 bp, Homo sapiens
caaacacctggactt

SEQ ID NO: 6683430 - DNA, 12 bp, Homo sapiens
caaacaccttcc

SEQ ID NO: 6683431 - DNA, 14 bp, Homo sapiens
caaacaccttccag

SEQ ID NO: 6683432 - DNA, 22 bp, Homo sapiens
caaacaccttcttattatatat

SEQ ID NO: 6683433 - DNA, 17 bp, Homo sapiens
caaacacggacccatag

SEQ ID NO: 6683434 - DNA, 23 bp, Homo sapiens
caaacactccaccccctccagct

SEQ ID NO: 6683435 - DNA, 18 bp, Homo sapiens
caaacactccaccctcca

SEQ ID NO: 6683436 - DNA, 16 bp, Homo sapiens
caaacactgaatcatg

SEQ ID NO: 6683437 - DNA, 18 bp, Homo sapiens
caaacactgaggcagcct

SEQ ID NO: 6683438 - DNA, 21 bp, Homo sapiens
caaacactgaggcagccttgg

SEQ ID NO: 6683439 - DNA, 21 bp, Homo sapiens
caaacactgccatattgtgta

SEQ ID NO: 6683440 - DNA, 22 bp, Homo sapiens
caaacactgccatattgtgtaa

SEQ ID NO: 6683441 - DNA, 18 bp, Homo sapiens
caaacactgtgatgttgg

SEQ ID NO: 6683442 - DNA, 14 bp, Homo sapiens
caaacactgtgtat

SEQ ID NO: 6683443 - DNA, 22 bp, Homo sapiens
caaacacttattgtttgaaaga

SEQ ID NO: 6683444 - DNA, 15 bp, Homo sapiens
caaacacttctgctt

SEQ ID NO: 6683445 - DNA, 12 bp, Homo sapiens
caaacagaaatg

SEQ ID NO: 6683446 - DNA, 18 bp, Homo sapiens
caaacagaaatgactgtg

SEQ ID NO: 6683447 - DNA, 19 bp, Homo sapiens
caaacagaacactgtaata

SEQ ID NO: 6683448 - DNA, 15 bp, Homo sapiens
caaacagaagtgcat

SEQ ID NO: 6683449 - DNA, 17 bp, Homo sapiens
caaacagagccttcaca

SEQ ID NO: 6683450 - DNA, 12 bp, Homo sapiens
caaacagagggc

SEQ ID NO: 6683451 - DNA, 14 bp, Homo sapiens
caaacagagtatgt

SEQ ID NO: 6683452 - DNA, 19 bp, Homo sapiens
caaacagcaagagtaagca

SEQ ID NO: 6683453 - DNA, 13 bp, Homo sapiens
caaacagccacac

SEQ ID NO: 6683454 - DNA, 21 bp, Homo sapiens
caaacaggccaggctccagca

SEQ ID NO: 6683455 - DNA, 14 bp, Homo sapiens
caaacaggctgtaa

SEQ ID NO: 6683456 - DNA, 15 bp, Homo sapiens
caaacagggcctctg

SEQ ID NO: 6683457 - DNA, 19 bp, Homo sapiens
caaacagggcctctgcgga

SEQ ID NO: 6683458 - DNA, 14 bp, Homo sapiens
caaacagggtggcc

SEQ ID NO: 6683459 - DNA, 16 bp, Homo sapiens
caaacagggtggccca

SEQ ID NO: 6683460 - DNA, 21 bp, Homo sapiens
caaacaggtcgagctgtgctc

SEQ ID NO: 6683461 - DNA, 12 bp, Homo sapiens
caaacaggtgct

SEQ ID NO: 6683462 - DNA, 18 bp, Homo sapiens
caaacaggtgctggccca

SEQ ID NO: 6683463 - DNA, 20 bp, Homo sapiens
caaacaggtgctggcccagc

SEQ ID NO: 6683464 - DNA, 15 bp, Homo sapiens
caaacagtaacgtgt

SEQ ID NO: 6683465 - DNA, 21 bp, Homo sapiens
caaacagtaatctaggtgtgg

SEQ ID NO: 6683466 - DNA, 12 bp, Homo sapiens
caaacagtattt

SEQ ID NO: 6683467 - DNA, 15 bp, Homo sapiens
caaacagtatttctg

SEQ ID NO: 6683468 - DNA, 16 bp, Homo sapiens
caaacagtctcaggaa

SEQ ID NO: 6683469 - DNA, 12 bp, Homo sapiens
caaacagtgaat

SEQ ID NO: 6683470 - DNA, 15 bp, Homo sapiens
caaacagtgactgta

SEQ ID NO: 6683471 - DNA, 21 bp, Homo sapiens
caaacagtgccaaatgctggg

SEQ ID NO: 6683472 - DNA, 21 bp, Homo sapiens
caaacagttgtaccactgcta

SEQ ID NO: 6683473 - DNA, 16 bp, Homo sapiens
caaacatagacagatg

SEQ ID NO: 6683474 - DNA, 19 bp, Homo sapiens
caaacatagacagatgtgg

SEQ ID NO: 6683475 - DNA, 17 bp, Homo sapiens
caaacatatataacaat

SEQ ID NO: 6683476 - DNA, 17 bp, Homo sapiens
caaacatcaaataaatt

SEQ ID NO: 6683477 - DNA, 19 bp, Homo sapiens
caaacatcaaataaatttc

SEQ ID NO: 6683478 - DNA, 11 bp, Homo sapiens
caaacatcaca

SEQ ID NO: 6683479 - DNA, 17 bp, Homo sapiens
caaacatcactctgctg

SEQ ID NO: 6683480 - DNA, 22 bp, Homo sapiens
caaacatcagacctgtcttcca

SEQ ID NO: 6683481 - DNA, 15 bp, Homo sapiens
caaacatcattgttt

SEQ ID NO: 6683482 - DNA, 17 bp, Homo sapiens
caaacatcccccaatga

SEQ ID NO: 6683483 - DNA, 12 bp, Homo sapiens
caaacatgaaaa

SEQ ID NO: 6683484 - DNA, 14 bp, Homo sapiens
caaacatgaaaaca

SEQ ID NO: 6683485 - DNA, 16 bp, Homo sapiens
caaacatgaaaacatt

SEQ ID NO: 6683486 - DNA, 22 bp, Homo sapiens
caaacatgaaaatttttgagtt

SEQ ID NO: 6683487 - DNA, 21 bp, Homo sapiens
caaacatgaccctaaatcttg

SEQ ID NO: 6683488 - DNA, 16 bp, Homo sapiens
caaacatgagtgaata

SEQ ID NO: 6683489 - DNA, 15 bp, Homo sapiens
caaacatgcagtact

SEQ ID NO: 6683490 - DNA, 22 bp, Homo sapiens
caaacatgcagtacttttgttg

SEQ ID NO: 6683491 - DNA, 18 bp, Homo sapiens
caaacatgcttataacat

SEQ ID NO: 6683492 - DNA, 19 bp, Homo sapiens
caaacatgcttataacatt

SEQ ID NO: 6683493 - DNA, 15 bp, Homo sapiens
caaacatggagaaat

SEQ ID NO: 6683494 - DNA, 22 bp, Homo sapiens
caaacatggatacttcctgggt

SEQ ID NO: 6683495 - DNA, 21 bp, Homo sapiens
caaacatgggtggtaacaaga

SEQ ID NO: 6683496 - DNA, 22 bp, Homo sapiens
caaacatgggtggtaacaagag

SEQ ID NO: 6683497 - DNA, 16 bp, Homo sapiens
caaacatgtatgtata

SEQ ID NO: 6683498 - DNA, 13 bp, Homo sapiens
caaacatgtattt

SEQ ID NO: 6683499 - DNA, 18 bp, Homo sapiens
caaacatgtatttatgta

SEQ ID NO: 6683500 - DNA, 19 bp, Homo sapiens
caaacatgtgcaactcttg

SEQ ID NO: 6683501 - DNA, 23 bp, Homo sapiens
caaacattagtatagtctccctt

SEQ ID NO: 6683502 - DNA, 11 bp, Homo sapiens
caaacattgtg

SEQ ID NO: 6683503 - DNA, 14 bp, Homo sapiens
caaacatttcaaag

SEQ ID NO: 6683504 - DNA, 18 bp, Homo sapiens
caaacatttctttttcct

SEQ ID NO: 6683505 - DNA, 19 bp, Homo sapiens
caaacattttctcttagaa

SEQ ID NO: 6683506 - DNA, 23 bp, Homo sapiens
caaacattttctggccagtgttt

SEQ ID NO: 6683507 - DNA, 17 bp, Homo sapiens
caaaccaaagctgcctg

SEQ ID NO: 6683508 - DNA, 21 bp, Homo sapiens
caaaccaaagctgcctgtgcc

SEQ ID NO: 6683509 - DNA, 22 bp, Homo sapiens
caaaccaaagctgcctgtgcca

SEQ ID NO: 6683510 - DNA, 15 bp, Homo sapiens
caaaccaaataaaaa

SEQ ID NO: 6683511 - DNA, 17 bp, Homo sapiens
caaaccaaattttaatt

SEQ ID NO: 6683512 - DNA, 18 bp, Homo sapiens
caaaccaacaccccatat

SEQ ID NO: 6683513 - DNA, 19 bp, Homo sapiens
caaaccaacatctttgcga

SEQ ID NO: 6683514 - DNA, 15 bp, Homo sapiens
caaaccaagggtaca

SEQ ID NO: 6683515 - DNA, 19 bp, Homo sapiens
caaaccaatttcttccttc

SEQ ID NO: 6683516 - DNA, 15 bp, Homo sapiens
caaaccaatttgttc

SEQ ID NO: 6683517 - DNA, 20 bp, Homo sapiens
caaaccaatttgttctgtgc

SEQ ID NO: 6683518 - DNA, 15 bp, Homo sapiens
caaaccacaactgac

SEQ ID NO: 6683519 - DNA, 16 bp, Homo sapiens
caaaccaccagaagcc

SEQ ID NO: 6683520 - DNA, 20 bp, Homo sapiens
caaaccaccagaagcccaga

SEQ ID NO: 6683521 - DNA, 15 bp, Homo sapiens
caaaccaccaggcat

SEQ ID NO: 6683522 - DNA, 15 bp, Homo sapiens
caaaccactgtacat

SEQ ID NO: 6683523 - DNA, 23 bp, Homo sapiens
caaaccacttctccatgctgcaa

SEQ ID NO: 6683524 - DNA, 13 bp, Homo sapiens
caaaccagcctgg

SEQ ID NO: 6683525 - DNA, 14 bp, Homo sapiens
caaaccagcctggg

SEQ ID NO: 6683526 - DNA, 13 bp, Homo sapiens
caaaccaggactc

SEQ ID NO: 6683527 - DNA, 21 bp, Homo sapiens
caaaccaggggacactttgtt

SEQ ID NO: 6683528 - DNA, 20 bp, Homo sapiens
caaaccaggtcaccatcctc

SEQ ID NO: 6683529 - DNA, 14 bp, Homo sapiens
caaaccatcattga

SEQ ID NO: 6683530 - DNA, 17 bp, Homo sapiens
caaaccatcattgaaat

SEQ ID NO: 6683531 - DNA, 17 bp, Homo sapiens
caaaccatctggtgcct

SEQ ID NO: 6683532 - DNA, 21 bp, Homo sapiens
caaaccatctggtgcctttcc

SEQ ID NO: 6683533 - DNA, 22 bp, Homo sapiens
caaaccatctggtgcctttcca

SEQ ID NO: 6683534 - DNA, 16 bp, Homo sapiens
caaaccattacctgta

SEQ ID NO: 6683535 - DNA, 13 bp, Homo sapiens
caaaccattactg

SEQ ID NO: 6683536 - DNA, 14 bp, Homo sapiens
caaaccattactga

SEQ ID NO: 6683537 - DNA, 14 bp, Homo sapiens
caaaccatttaatt

SEQ ID NO: 6683538 - DNA, 20 bp, Homo sapiens
caaaccatttaattcataat

SEQ ID NO: 6683539 - DNA, 22 bp, Homo sapiens
caaaccatttcagccaaactgt

SEQ ID NO: 6683540 - DNA, 14 bp, Homo sapiens
caaaccatttccaa

SEQ ID NO: 6683541 - DNA, 15 bp, Homo sapiens
caaacccaaaggacc

SEQ ID NO: 6683542 - DNA, 17 bp, Homo sapiens
caaacccaccctttcta

SEQ ID NO: 6683543 - DNA, 22 bp, Homo sapiens
caaacccacgattttctccagc

SEQ ID NO: 6683544 - DNA, 24 bp, Homo sapiens
caaacccacgattttctccagctc

SEQ ID NO: 6683545 - DNA, 20 bp, Homo sapiens
caaacccagacaaccaaaac

SEQ ID NO: 6683546 - DNA, 15 bp, Homo sapiens
caaacccagcccctg

SEQ ID NO: 6683547 - DNA, 16 bp, Homo sapiens
caaacccagtctcctc

SEQ ID NO: 6683548 - DNA, 22 bp, Homo sapiens
caaacccagtctcctctccatt

SEQ ID NO: 6683549 - DNA, 21 bp, Homo sapiens
caaacccatgaagctggccct

SEQ ID NO: 6683550 - DNA, 13 bp, Homo sapiens
caaaccccagccc

SEQ ID NO: 6683551 - DNA, 23 bp, Homo sapiens
caaaccccctgcagcccaggcca

SEQ ID NO: 6683552 - DNA, 13 bp, Homo sapiens
caaacccctgacc

SEQ ID NO: 6683553 - DNA, 13 bp, Homo sapiens
caaaccccttccc

SEQ ID NO: 6683554 - DNA, 15 bp, Homo sapiens
caaaccctagccttg

SEQ ID NO: 6683555 - DNA, 22 bp, Homo sapiens
caaaccctggggactctgcttg

SEQ ID NO: 6683556 - DNA, 18 bp, Homo sapiens
caaaccctggtgctttcc

SEQ ID NO: 6683557 - DNA, 17 bp, Homo sapiens
caaaccctgtcaaacat

SEQ ID NO: 6683558 - DNA, 19 bp, Homo sapiens
caaaccctgttcaggctgg

SEQ ID NO: 6683559 - DNA, 23 bp, Homo sapiens
caaacccttaactgacatgggcc

SEQ ID NO: 6683560 - DNA, 19 bp, Homo sapiens
caaacccttagcagcccag

SEQ ID NO: 6683561 - DNA, 20 bp, Homo sapiens
caaacccttagcagcccagc

SEQ ID NO: 6683562 - DNA, 21 bp, Homo sapiens
caaacccttagcagcccagca

SEQ ID NO: 6683563 - DNA, 20 bp, Homo sapiens
caaacccttcaactcctggc

SEQ ID NO: 6683564 - DNA, 20 bp, Homo sapiens
caaacccttcagtgccaaaa

SEQ ID NO: 6683565 - DNA, 16 bp, Homo sapiens
caaaccctttgtatta

SEQ ID NO: 6683566 - DNA, 17 bp, Homo sapiens
caaaccgagcagggctg

SEQ ID NO: 6683567 - DNA, 13 bp, Homo sapiens
caaaccggcaggt

SEQ ID NO: 6683568 - DNA, 22 bp, Homo sapiens
caaacctactgcccacatttgg

SEQ ID NO: 6683569 - DNA, 20 bp, Homo sapiens
caaacctagccccttagccc

SEQ ID NO: 6683570 - DNA, 21 bp, Homo sapiens
caaacctagcttttaaaaaat

SEQ ID NO: 6683571 - DNA, 15 bp, Homo sapiens
caaacctcaaatata

SEQ ID NO: 6683572 - DNA, 20 bp, Homo sapiens
caaacctcacactactgtat

SEQ ID NO: 6683573 - DNA, 18 bp, Homo sapiens
caaacctcacatttgtga

SEQ ID NO: 6683574 - DNA, 13 bp, Homo sapiens
caaacctcaccaa

SEQ ID NO: 6683575 - DNA, 12 bp, Homo sapiens
caaacctcagag

SEQ ID NO: 6683576 - DNA, 15 bp, Homo sapiens
caaacctcagaggga

SEQ ID NO: 6683577 - DNA, 22 bp, Homo sapiens
caaacctcagtcatattcttat

SEQ ID NO: 6683578 - DNA, 19 bp, Homo sapiens
caaacctcatatgtgaaat

SEQ ID NO: 6683579 - DNA, 11 bp, Homo sapiens
caaacctccaa

SEQ ID NO: 6683580 - DNA, 21 bp, Homo sapiens
caaacctccaaaactcctgcc

SEQ ID NO: 6683581 - DNA, 15 bp, Homo sapiens
caaacctcctgtcag

SEQ ID NO: 6683582 - DNA, 16 bp, Homo sapiens
caaacctctcagcact

SEQ ID NO: 6683583 - DNA, 14 bp, Homo sapiens
caaacctctgttca

SEQ ID NO: 6683584 - DNA, 15 bp, Homo sapiens
caaacctctgttcag

SEQ ID NO: 6683585 - DNA, 22 bp, Homo sapiens
caaacctgcagtttttaatttg

SEQ ID NO: 6683586 - DNA, 12 bp, Homo sapiens
caaacctgcctg

SEQ ID NO: 6683587 - DNA, 14 bp, Homo sapiens
caaacctgcctggg

SEQ ID NO: 6683588 - DNA, 13 bp, Homo sapiens
caaacctggcaga

SEQ ID NO: 6683589 - DNA, 22 bp, Homo sapiens
caaacctgtagatgcagaaaaa

SEQ ID NO: 6683590 - DNA, 21 bp, Homo sapiens
caaacctgtttaaatatttca

SEQ ID NO: 6683591 - DNA, 21 bp, Homo sapiens
caaaccttaagataatggata

SEQ ID NO: 6683592 - DNA, 16 bp, Homo sapiens
caaaccttactctgag

SEQ ID NO: 6683593 - DNA, 21 bp, Homo sapiens
caaaccttatctccacaacct

SEQ ID NO: 6683594 - DNA, 12 bp, Homo sapiens
caaaccttcaca

SEQ ID NO: 6683595 - DNA, 15 bp, Homo sapiens
caaaccttcctggga

SEQ ID NO: 6683596 - DNA, 16 bp, Homo sapiens
caaaccttcctgggag

SEQ ID NO: 6683597 - DNA, 13 bp, Homo sapiens
caaaccttctttt

SEQ ID NO: 6683598 - DNA, 23 bp, Homo sapiens
caaaccttcttttcaatgcaatg

SEQ ID NO: 6683599 - DNA, 17 bp, Homo sapiens
caaaccttgaggagaag

SEQ ID NO: 6683600 - DNA, 23 bp, Homo sapiens
caaacctttagctgtgaatggct

SEQ ID NO: 6683601 - DNA, 18 bp, Homo sapiens
caaacctttattttagaa

SEQ ID NO: 6683602 - DNA, 21 bp, Homo sapiens
caaacctttcccccttagcac

SEQ ID NO: 6683603 - DNA, 22 bp, Homo sapiens
caaacctttctataattttaca

SEQ ID NO: 6683604 - DNA, 15 bp, Homo sapiens
caaacctttctggcc

SEQ ID NO: 6683605 - DNA, 14 bp, Homo sapiens
caaacctttgagta

SEQ ID NO: 6683606 - DNA, 20 bp, Homo sapiens
caaacctttttatattttat

SEQ ID NO: 6683607 - DNA, 23 bp, Homo sapiens
caaacctttttatattttatact

SEQ ID NO: 6683608 - DNA, 15 bp, Homo sapiens
caaacgaataaagat

SEQ ID NO: 6683609 - DNA, 17 bp, Homo sapiens
caaacgaataaagatag

SEQ ID NO: 6683610 - DNA, 16 bp, Homo sapiens
caaacgacagaggagc

SEQ ID NO: 6683611 - DNA, 19 bp, Homo sapiens
caaacgagactttctcctg

SEQ ID NO: 6683612 - DNA, 21 bp, Homo sapiens
caaacgagactttctcctggc

SEQ ID NO: 6683613 - DNA, 17 bp, Homo sapiens
caaacgcctagattgct

SEQ ID NO: 6683614 - DNA, 22 bp, Homo sapiens
caaacgctaaagagcccttgcc

SEQ ID NO: 6683615 - DNA, 17 bp, Homo sapiens
caaacggagcccctgaa

SEQ ID NO: 6683616 - DNA, 23 bp, Homo sapiens
caaacgggaccaatgggtttgcc

SEQ ID NO: 6683617 - DNA, 14 bp, Homo sapiens
caaacggtacacag

SEQ ID NO: 6683618 - DNA, 17 bp, Homo sapiens
caaacggtgcaacagaa

SEQ ID NO: 6683619 - DNA, 16 bp, Homo sapiens
caaacgtaatttgtta

SEQ ID NO: 6683620 - DNA, 12 bp, Homo sapiens
caaacgtcccca

SEQ ID NO: 6683621 - DNA, 13 bp, Homo sapiens
caaacgtccccag

SEQ ID NO: 6683622 - DNA, 23 bp, Homo sapiens
caaacgtctattttgtatatttg

SEQ ID NO: 6683623 - DNA, 19 bp, Homo sapiens
caaacgtgccccccagttc

SEQ ID NO: 6683624 - DNA, 23 bp, Homo sapiens
caaacgttggagtttgggctgga

SEQ ID NO: 6683625 - DNA, 23 bp, Homo sapiens
caaacgttgggcatcatggtttt

SEQ ID NO: 6683626 - DNA, 15 bp, Homo sapiens
caaacgtttgacaaa

SEQ ID NO: 6683627 - DNA, 16 bp, Homo sapiens
caaacgtttgacaaac

SEQ ID NO: 6683628 - DNA, 11 bp, Homo sapiens
caaactaaaaa

SEQ ID NO: 6683629 - DNA, 20 bp, Homo sapiens
caaactaaaaatattcctcc

SEQ ID NO: 6683630 - DNA, 16 bp, Homo sapiens
caaactaaaagacatt

SEQ ID NO: 6683631 - DNA, 16 bp, Homo sapiens
caaactaattctcaca

SEQ ID NO: 6683632 - DNA, 15 bp, Homo sapiens
caaactacctatatt

SEQ ID NO: 6683633 - DNA, 13 bp, Homo sapiens
caaactacctctg

SEQ ID NO: 6683634 - DNA, 22 bp, Homo sapiens
caaactacgcgatagtctctgt

SEQ ID NO: 6683635 - DNA, 16 bp, Homo sapiens
caaactactgtacatt

SEQ ID NO: 6683636 - DNA, 13 bp, Homo sapiens
caaactagattta

SEQ ID NO: 6683637 - DNA, 17 bp, Homo sapiens
caaactaggagatgaaa

SEQ ID NO: 6683638 - DNA, 22 bp, Homo sapiens
caaactaggagatgaaactggt

SEQ ID NO: 6683639 - DNA, 15 bp, Homo sapiens
caaactaggaggaaa

SEQ ID NO: 6683640 - DNA, 22 bp, Homo sapiens
caaactaggaggaaaagacaga

SEQ ID NO: 6683641 - DNA, 19 bp, Homo sapiens
caaactagggccaagccca

SEQ ID NO: 6683642 - DNA, 20 bp, Homo sapiens
caaactaggggacaaagcaa

SEQ ID NO: 6683643 - DNA, 18 bp, Homo sapiens
caaactatgatttatttt

SEQ ID NO: 6683644 - DNA, 19 bp, Homo sapiens
caaactatgggatccaagg

SEQ ID NO: 6683645 - DNA, 16 bp, Homo sapiens
caaactattgggaggg

SEQ ID NO: 6683646 - DNA, 17 bp, Homo sapiens
caaactatttcagtgat

SEQ ID NO: 6683647 - DNA, 18 bp, Homo sapiens
caaactcactgctcaaga

SEQ ID NO: 6683648 - DNA, 19 bp, Homo sapiens
caaactcagaaggctttgg

SEQ ID NO: 6683649 - DNA, 16 bp, Homo sapiens
caaactcagatctcat

SEQ ID NO: 6683650 - DNA, 20 bp, Homo sapiens
caaactcagttcaaaccatt

SEQ ID NO: 6683651 - DNA, 15 bp, Homo sapiens
caaactccaggctgg

SEQ ID NO: 6683652 - DNA, 16 bp, Homo sapiens
caaactcccaggacct

SEQ ID NO: 6683653 - DNA, 18 bp, Homo sapiens
caaactccccttccctgg

SEQ ID NO: 6683654 - DNA, 23 bp, Homo sapiens
caaactccccttccctggggagc

SEQ ID NO: 6683655 - DNA, 17 bp, Homo sapiens
caaactcctatttcaat

SEQ ID NO: 6683656 - DNA, 11 bp, Homo sapiens
caaactcctga

SEQ ID NO: 6683657 - DNA, 16 bp, Homo sapiens
caaactcctgacctca

SEQ ID NO: 6683658 - DNA, 13 bp, Homo sapiens
caaactcctgcct

SEQ ID NO: 6683659 - DNA, 14 bp, Homo sapiens
caaactcctgcctg

SEQ ID NO: 6683660 - DNA, 22 bp, Homo sapiens
caaactcctgggctcaagtgat

SEQ ID NO: 6683661 - DNA, 15 bp, Homo sapiens
caaactcctttctta

SEQ ID NO: 6683662 - DNA, 16 bp, Homo sapiens
caaactcctttcttat

SEQ ID NO: 6683663 - DNA, 13 bp, Homo sapiens
caaactcgtctga

SEQ ID NO: 6683664 - DNA, 21 bp, Homo sapiens
caaactcgtctgatgttttga

SEQ ID NO: 6683665 - DNA, 16 bp, Homo sapiens
caaactctactaattt

SEQ ID NO: 6683666 - DNA, 18 bp, Homo sapiens
caaactctatcggagaac

SEQ ID NO: 6683667 - DNA, 19 bp, Homo sapiens
caaactctctagtgcagga

SEQ ID NO: 6683668 - DNA, 13 bp, Homo sapiens
caaactcttcagt

SEQ ID NO: 6683669 - DNA, 14 bp, Homo sapiens
caaactcttcagtt

SEQ ID NO: 6683670 - DNA, 22 bp, Homo sapiens
caaactcttcagttaattctta

SEQ ID NO: 6683671 - DNA, 19 bp, Homo sapiens
caaactcttgacctcaggt

SEQ ID NO: 6683672 - DNA, 21 bp, Homo sapiens
caaactcttgacctcaggtga

SEQ ID NO: 6683673 - DNA, 13 bp, Homo sapiens
caaactgaaatta

SEQ ID NO: 6683674 - DNA, 15 bp, Homo sapiens
caaactgaaattagt

SEQ ID NO: 6683675 - DNA, 21 bp, Homo sapiens
caaactgaaattagtgttttc

SEQ ID NO: 6683676 - DNA, 22 bp, Homo sapiens
caaactgaaattagtgttttca

SEQ ID NO: 6683677 - DNA, 22 bp, Homo sapiens
caaactgaggaatttcacctgt

SEQ ID NO: 6683678 - DNA, 23 bp, Homo sapiens
caaactgagtaaattggaaacat

SEQ ID NO: 6683679 - DNA, 21 bp, Homo sapiens
caaactgatccatcctgtttt

SEQ ID NO: 6683680 - DNA, 15 bp, Homo sapiens
caaactgatctaaaa

SEQ ID NO: 6683681 - DNA, 21 bp, Homo sapiens
caaactgatgcgaaaacttga

SEQ ID NO: 6683682 - DNA, 19 bp, Homo sapiens
caaactgcaatagagactg

SEQ ID NO: 6683683 - DNA, 20 bp, Homo sapiens
caaactgcaatagagactgt

SEQ ID NO: 6683684 - DNA, 15 bp, Homo sapiens
caaactgcacatgat

SEQ ID NO: 6683685 - DNA, 19 bp, Homo sapiens
caaactgcacatgatttca

SEQ ID NO: 6683686 - DNA, 12 bp, Homo sapiens
caaactgcagct

SEQ ID NO: 6683687 - DNA, 18 bp, Homo sapiens
caaactgcctaagccctc

SEQ ID NO: 6683688 - DNA, 14 bp, Homo sapiens
caaactgccttctt

SEQ ID NO: 6683689 - DNA, 21 bp, Homo sapiens
caaactgcggtatacatttta

SEQ ID NO: 6683690 - DNA, 16 bp, Homo sapiens
caaactgctgcatact

SEQ ID NO: 6683691 - DNA, 21 bp, Homo sapiens
caaactgcttcccttactttg

SEQ ID NO: 6683692 - DNA, 13 bp, Homo sapiens
caaactgctttat

SEQ ID NO: 6683693 - DNA, 14 bp, Homo sapiens
caaactgctttatt

SEQ ID NO: 6683694 - DNA, 16 bp, Homo sapiens
caaactgggaacccct

SEQ ID NO: 6683695 - DNA, 19 bp, Homo sapiens
caaactgggatgaaactaa

SEQ ID NO: 6683696 - DNA, 16 bp, Homo sapiens
caaactggggcctcca

SEQ ID NO: 6683697 - DNA, 17 bp, Homo sapiens
caaactgggtcttcagc

SEQ ID NO: 6683698 - DNA, 16 bp, Homo sapiens
caaactggtattctgt

SEQ ID NO: 6683699 - DNA, 19 bp, Homo sapiens
caaactggtattctgttct

SEQ ID NO: 6683700 - DNA, 15 bp, Homo sapiens
caaactggtgcatga

SEQ ID NO: 6683701 - DNA, 16 bp, Homo sapiens
caaactggttatttaa

SEQ ID NO: 6683702 - DNA, 21 bp, Homo sapiens
caaactgtaaaaataacataa

SEQ ID NO: 6683703 - DNA, 15 bp, Homo sapiens
caaactgtgaaaata

SEQ ID NO: 6683704 - DNA, 18 bp, Homo sapiens
caaactgtgccctgcctt

SEQ ID NO: 6683705 - DNA, 15 bp, Homo sapiens
caaactgtgtaactg

SEQ ID NO: 6683706 - DNA, 23 bp, Homo sapiens
caaactgttgtctagtatacagt

SEQ ID NO: 6683707 - DNA, 15 bp, Homo sapiens
caaacttaaacaaaa

SEQ ID NO: 6683708 - DNA, 16 bp, Homo sapiens
caaacttaaacaaaaa

SEQ ID NO: 6683709 - DNA, 17 bp, Homo sapiens
caaacttaaacaaaaaa

SEQ ID NO: 6683710 - DNA, 18 bp, Homo sapiens
caaacttaacatggaaga

SEQ ID NO: 6683711 - DNA, 17 bp, Homo sapiens
caaacttaagaaacact

SEQ ID NO: 6683712 - DNA, 13 bp, Homo sapiens
caaacttactatt

SEQ ID NO: 6683713 - DNA, 23 bp, Homo sapiens
caaacttccagtgcaacactgaa

SEQ ID NO: 6683714 - DNA, 13 bp, Homo sapiens
caaacttgcttta

SEQ ID NO: 6683715 - DNA, 22 bp, Homo sapiens
caaacttggaatttgtaacctc

SEQ ID NO: 6683716 - DNA, 17 bp, Homo sapiens
caaacttggatcagata

SEQ ID NO: 6683717 - DNA, 23 bp, Homo sapiens
caaacttgtggcctcaagcaatc

SEQ ID NO: 6683718 - DNA, 16 bp, Homo sapiens
caaacttgttcattta

SEQ ID NO: 6683719 - DNA, 14 bp, Homo sapiens
caaacttgttttct

SEQ ID NO: 6683720 - DNA, 15 bp, Homo sapiens
caaactttaaaatgc

SEQ ID NO: 6683721 - DNA, 14 bp, Homo sapiens
caaactttaaattc

SEQ ID NO: 6683722 - DNA, 15 bp, Homo sapiens
caaactttaacaggt

SEQ ID NO: 6683723 - DNA, 21 bp, Homo sapiens
caaactttaggtttttttaat

SEQ ID NO: 6683724 - DNA, 22 bp, Homo sapiens
caaactttattgacaagtgatt

SEQ ID NO: 6683725 - DNA, 12 bp, Homo sapiens
caaactttgcat

SEQ ID NO: 6683726 - DNA, 20 bp, Homo sapiens
caaactttgcatctcagtat

SEQ ID NO: 6683727 - DNA, 15 bp, Homo sapiens
caaacttttatgcag

SEQ ID NO: 6683728 - DNA, 17 bp, Homo sapiens
caaacttttcaaggctt

SEQ ID NO: 6683729 - DNA, 20 bp, Homo sapiens
caaacttttcaaggcttata

SEQ ID NO: 6683730 - DNA, 14 bp, Homo sapiens
caaacttttctttc

SEQ ID NO: 6683731 - DNA, 15 bp, Homo sapiens
caaacttttgaaaga

SEQ ID NO: 6683732 - DNA, 16 bp, Homo sapiens
caaacttttgaaagat

SEQ ID NO: 6683733 - DNA, 18 bp, Homo sapiens
caaacttttgaaagatgt

SEQ ID NO: 6683734 - DNA, 19 bp, Homo sapiens
caaacttttgaaagatgta

SEQ ID NO: 6683735 - DNA, 20 bp, Homo sapiens
caaactttttccagcaaaat

SEQ ID NO: 6683736 - DNA, 15 bp, Homo sapiens
caaacttttttatat

SEQ ID NO: 6683737 - DNA, 17 bp, Homo sapiens
caaacttttttatatct

SEQ ID NO: 6683738 - DNA, 19 bp, Homo sapiens
caaacttttttatatcttt

SEQ ID NO: 6683739 - DNA, 21 bp, Homo sapiens
caaagaaaaaaaatcttataa

SEQ ID NO: 6683740 - DNA, 21 bp, Homo sapiens
caaagaaaaaaatatatttta

SEQ ID NO: 6683741 - DNA, 22 bp, Homo sapiens
caaagaaaaaaatatattttat

SEQ ID NO: 6683742 - DNA, 14 bp, Homo sapiens
caaagaaaaacaat

SEQ ID NO: 6683743 - DNA, 23 bp, Homo sapiens
caaagaaaaagtaaatcaaagat

SEQ ID NO: 6683744 - DNA, 23 bp, Homo sapiens
caaagaaaaattaattaggaatt

SEQ ID NO: 6683745 - DNA, 19 bp, Homo sapiens
caaagaaaaccctaagtgt

SEQ ID NO: 6683746 - DNA, 13 bp, Homo sapiens
caaagaaaatgtt

SEQ ID NO: 6683747 - DNA, 16 bp, Homo sapiens
caaagaaaattctcaa

SEQ ID NO: 6683748 - DNA, 17 bp, Homo sapiens
caaagaaaattctcaag

SEQ ID NO: 6683749 - DNA, 19 bp, Homo sapiens
caaagaaaattctcaagtg

SEQ ID NO: 6683750 - DNA, 15 bp, Homo sapiens
caaagaaacaaagca

SEQ ID NO: 6683751 - DNA, 23 bp, Homo sapiens
caaagaaacaagctgtgcaggca

SEQ ID NO: 6683752 - DNA, 21 bp, Homo sapiens
caaagaaacactaagctctct

SEQ ID NO: 6683753 - DNA, 17 bp, Homo sapiens
caaagaaactcagaaga

SEQ ID NO: 6683754 - DNA, 18 bp, Homo sapiens
caaagaaactcagaagag

SEQ ID NO: 6683755 - DNA, 22 bp, Homo sapiens
caaagaaacttgaagctttgta

SEQ ID NO: 6683756 - DNA, 23 bp, Homo sapiens
caaagaaactttttaataaagta

SEQ ID NO: 6683757 - DNA, 19 bp, Homo sapiens
caaagaaagaaagtttaga

SEQ ID NO: 6683758 - DNA, 14 bp, Homo sapiens
caaagaaagcactt

SEQ ID NO: 6683759 - DNA, 13 bp, Homo sapiens
caaagaaaggaga

SEQ ID NO: 6683760 - DNA, 14 bp, Homo sapiens
caaagaaagtgtat

SEQ ID NO: 6683761 - DNA, 16 bp, Homo sapiens
caaagaaagtgtattg

SEQ ID NO: 6683762 - DNA, 18 bp, Homo sapiens
caaagaaatagcaagaga

SEQ ID NO: 6683763 - DNA, 13 bp, Homo sapiens
caaagaaatccaa

SEQ ID NO: 6683764 - DNA, 15 bp, Homo sapiens
caaagaaatgaacat

SEQ ID NO: 6683765 - DNA, 18 bp, Homo sapiens
caaagaaatgaacattcc

SEQ ID NO: 6683766 - DNA, 20 bp, Homo sapiens
caaagaaatgggcctgcctg

SEQ ID NO: 6683767 - DNA, 21 bp, Homo sapiens
caaagaaatgggcctgcctgc

SEQ ID NO: 6683768 - DNA, 13 bp, Homo sapiens
caaagaaattatg

SEQ ID NO: 6683769 - DNA, 16 bp, Homo sapiens
caaagaaattcagaac

SEQ ID NO: 6683770 - DNA, 12 bp, Homo sapiens
caaagaaatttc

SEQ ID NO: 6683771 - DNA, 16 bp, Homo sapiens
caaagaacaagaaatt

SEQ ID NO: 6683772 - DNA, 17 bp, Homo sapiens
caaagaaccaaagaaga

SEQ ID NO: 6683773 - DNA, 17 bp, Homo sapiens
caaagaaccatgcagga

SEQ ID NO: 6683774 - DNA, 18 bp, Homo sapiens
caaagaaccatgcaggaa

SEQ ID NO: 6683775 - DNA, 21 bp, Homo sapiens
caaagaacccatttgccatgc

SEQ ID NO: 6683776 - DNA, 14 bp, Homo sapiens
caaagaacccccct

SEQ ID NO: 6683777 - DNA, 19 bp, Homo sapiens
caaagaacccccctcccca

SEQ ID NO: 6683778 - DNA, 21 bp, Homo sapiens
caaagaacggcatgtgaattc

SEQ ID NO: 6683779 - DNA, 19 bp, Homo sapiens
caaagaactccagagtcag

SEQ ID NO: 6683780 - DNA, 15 bp, Homo sapiens
caaagaactgcccca

SEQ ID NO: 6683781 - DNA, 22 bp, Homo sapiens
caaagaactgccccatctcctc

SEQ ID NO: 6683782 - DNA, 20 bp, Homo sapiens
caaagaacttgatttgcatg

SEQ ID NO: 6683783 - DNA, 18 bp, Homo sapiens
caaagaacttgctgctgc

SEQ ID NO: 6683784 - DNA, 16 bp, Homo sapiens
caaagaagaaagctga

SEQ ID NO: 6683785 - DNA, 20 bp, Homo sapiens
caaagaagacatgttttaga

SEQ ID NO: 6683786 - DNA, 20 bp, Homo sapiens
caaagaagatagctctctga

SEQ ID NO: 6683787 - DNA, 21 bp, Homo sapiens
caaagaagctgtcttggaagt

SEQ ID NO: 6683788 - DNA, 21 bp, Homo sapiens
caaagaagcttccacaaaatt

SEQ ID NO: 6683789 - DNA, 14 bp, Homo sapiens
caaagaaggcacag

SEQ ID NO: 6683790 - DNA, 22 bp, Homo sapiens
caaagaaggcacaggtgtaaat

SEQ ID NO: 6683791 - DNA, 23 bp, Homo sapiens
caaagaaggcacaggtgtaaata

SEQ ID NO: 6683792 - DNA, 15 bp, Homo sapiens
caaagaaggcaggga

SEQ ID NO: 6683793 - DNA, 11 bp, Homo sapiens
caaagaatatt

SEQ ID NO: 6683794 - DNA, 22 bp, Homo sapiens
caaagaatcacctaattaattt

SEQ ID NO: 6683795 - DNA, 20 bp, Homo sapiens
caaagaatccctagacttta

SEQ ID NO: 6683796 - DNA, 23 bp, Homo sapiens
caaagaatgaatttcaacgcctg

SEQ ID NO: 6683797 - DNA, 17 bp, Homo sapiens
caaagaatgcatgttct

SEQ ID NO: 6683798 - DNA, 17 bp, Homo sapiens
caaagaattccaaagca

SEQ ID NO: 6683799 - DNA, 21 bp, Homo sapiens
caaagaattcctgaagccaga

SEQ ID NO: 6683800 - DNA, 11 bp, Homo sapiens
caaagacaaaa

SEQ ID NO: 6683801 - DNA, 13 bp, Homo sapiens
caaagacaaaaga

SEQ ID NO: 6683802 - DNA, 17 bp, Homo sapiens
caaagacaaaagaaact

SEQ ID NO: 6683803 - DNA, 22 bp, Homo sapiens
caaagacaaagtgtgtaattat

SEQ ID NO: 6683804 - DNA, 17 bp, Homo sapiens
caaagacacaggaagaa

SEQ ID NO: 6683805 - DNA, 16 bp, Homo sapiens
caaagacagagcggaa

SEQ ID NO: 6683806 - DNA, 13 bp, Homo sapiens
caaagacaggcaa

SEQ ID NO: 6683807 - DNA, 19 bp, Homo sapiens
caaagacagtatttattgg

SEQ ID NO: 6683808 - DNA, 15 bp, Homo sapiens
caaagacatggaaga

SEQ ID NO: 6683809 - DNA, 18 bp, Homo sapiens
caaagacattgacagcaa

SEQ ID NO: 6683810 - DNA, 19 bp, Homo sapiens
caaagacattgacagcaat

SEQ ID NO: 6683811 - DNA, 20 bp, Homo sapiens
caaagacattgacagcaatt

SEQ ID NO: 6683812 - DNA, 14 bp, Homo sapiens
caaagaccaaaatg

SEQ ID NO: 6683813 - DNA, 17 bp, Homo sapiens
caaagaccaaaatgaaa

SEQ ID NO: 6683814 - DNA, 18 bp, Homo sapiens
caaagaccaatgtgaaga

SEQ ID NO: 6683815 - DNA, 21 bp, Homo sapiens
caaagaccaattttttgtgtg

SEQ ID NO: 6683816 - DNA, 13 bp, Homo sapiens
caaagaccacctc

SEQ ID NO: 6683817 - DNA, 14 bp, Homo sapiens
caaagaccacctcc

SEQ ID NO: 6683818 - DNA, 16 bp, Homo sapiens
caaagaccacctccaa

SEQ ID NO: 6683819 - DNA, 18 bp, Homo sapiens
caaagaccacctccaacc

SEQ ID NO: 6683820 - DNA, 19 bp, Homo sapiens
caaagaccacctccaaccc

SEQ ID NO: 6683821 - DNA, 17 bp, Homo sapiens
caaagacctacctccag

SEQ ID NO: 6683822 - DNA, 17 bp, Homo sapiens
caaagacctgcctgtgt

SEQ ID NO: 6683823 - DNA, 16 bp, Homo sapiens
caaagaccttgtgtgt

SEQ ID NO: 6683824 - DNA, 18 bp, Homo sapiens
caaagaccttgtgtgtat

SEQ ID NO: 6683825 - DNA, 17 bp, Homo sapiens
caaagacgtgtccgacc

SEQ ID NO: 6683826 - DNA, 22 bp, Homo sapiens
caaagactatttcaaaatgtcc

SEQ ID NO: 6683827 - DNA, 14 bp, Homo sapiens
caaagactcaaatt

SEQ ID NO: 6683828 - DNA, 15 bp, Homo sapiens
caaagactcaaattt

SEQ ID NO: 6683829 - DNA, 17 bp, Homo sapiens
caaagactcaaattttg

SEQ ID NO: 6683830 - DNA, 17 bp, Homo sapiens
caaagactccttgtgga

SEQ ID NO: 6683831 - DNA, 13 bp, Homo sapiens
caaagactctgag

SEQ ID NO: 6683832 - DNA, 15 bp, Homo sapiens
caaagactctggagg

SEQ ID NO: 6683833 - DNA, 21 bp, Homo sapiens
caaagactgtgaacagcttgc

SEQ ID NO: 6683834 - DNA, 22 bp, Homo sapiens
caaagactgtgaacagcttgct

SEQ ID NO: 6683835 - DNA, 19 bp, Homo sapiens
caaagacttaatcatatca

SEQ ID NO: 6683836 - DNA, 16 bp, Homo sapiens
caaagacttagtatat

SEQ ID NO: 6683837 - DNA, 20 bp, Homo sapiens
caaagacttcatttaacact

SEQ ID NO: 6683838 - DNA, 18 bp, Homo sapiens
caaagacttcctctggct

SEQ ID NO: 6683839 - DNA, 17 bp, Homo sapiens
caaagacttgttaaatg

SEQ ID NO: 6683840 - DNA, 19 bp, Homo sapiens
caaagagaaaaagaaatgc

SEQ ID NO: 6683841 - DNA, 15 bp, Homo sapiens
caaagagaaaactta

SEQ ID NO: 6683842 - DNA, 23 bp, Homo sapiens
caaagagaaaagattaaaattag

SEQ ID NO: 6683843 - DNA, 22 bp, Homo sapiens
caaagagaaagagtttgaaact

SEQ ID NO: 6683844 - DNA, 20 bp, Homo sapiens
caaagagaaatcacaggggc

SEQ ID NO: 6683845 - DNA, 13 bp, Homo sapiens
caaagagaagatg

SEQ ID NO: 6683846 - DNA, 14 bp, Homo sapiens
caaagagaagatgc

SEQ ID NO: 6683847 - DNA, 18 bp, Homo sapiens
caaagagaaggcctggtc

SEQ ID NO: 6683848 - DNA, 17 bp, Homo sapiens
caaagagaatgtatttc

SEQ ID NO: 6683849 - DNA, 18 bp, Homo sapiens
caaagagactggagcatc

SEQ ID NO: 6683850 - DNA, 16 bp, Homo sapiens
caaagagactgggcct

SEQ ID NO: 6683851 - DNA, 16 bp, Homo sapiens
caaagagagaaaataa

SEQ ID NO: 6683852 - DNA, 21 bp, Homo sapiens
caaagagagatttttttttaa

SEQ ID NO: 6683853 - DNA, 13 bp, Homo sapiens
caaagagaggtcc

SEQ ID NO: 6683854 - DNA, 20 bp, Homo sapiens
caaagagagttaaaagcagc

SEQ ID NO: 6683855 - DNA, 21 bp, Homo sapiens
caaagagagttaaaagcagca

SEQ ID NO: 6683856 - DNA, 19 bp, Homo sapiens
caaagagagttaatcaact

SEQ ID NO: 6683857 - DNA, 15 bp, Homo sapiens
caaagagatgtcctt

SEQ ID NO: 6683858 - DNA, 19 bp, Homo sapiens
caaagagattcgaatgacg

SEQ ID NO: 6683859 - DNA, 22 bp, Homo sapiens
caaagagattgtggtggtgcta

SEQ ID NO: 6683860 - DNA, 23 bp, Homo sapiens
caaagagccatgtgtcatgtaat

SEQ ID NO: 6683861 - DNA, 16 bp, Homo sapiens
caaagagcctggagaa

SEQ ID NO: 6683862 - DNA, 14 bp, Homo sapiens
caaagagccttcag

SEQ ID NO: 6683863 - DNA, 16 bp, Homo sapiens
caaagagctcccgagg

SEQ ID NO: 6683864 - DNA, 15 bp, Homo sapiens
caaagagctgtggct

SEQ ID NO: 6683865 - DNA, 22 bp, Homo sapiens
caaagaggactcgcttgtaaat

SEQ ID NO: 6683866 - DNA, 14 bp, Homo sapiens
caaagaggattaga

SEQ ID NO: 6683867 - DNA, 17 bp, Homo sapiens
caaagaggccagtactt

SEQ ID NO: 6683868 - DNA, 19 bp, Homo sapiens
caaagaggcctttaaccat

SEQ ID NO: 6683869 - DNA, 20 bp, Homo sapiens
caaagaggctgaggctggca

SEQ ID NO: 6683870 - DNA, 21 bp, Homo sapiens
caaagaggctgcccctctcac

SEQ ID NO: 6683871 - DNA, 15 bp, Homo sapiens
caaagagggatgttt

SEQ ID NO: 6683872 - DNA, 15 bp, Homo sapiens
caaagagggcttcct

SEQ ID NO: 6683873 - DNA, 15 bp, Homo sapiens
caaagagggtgaggg

SEQ ID NO: 6683874 - DNA, 18 bp, Homo sapiens
caaagagggtgagggcct

SEQ ID NO: 6683875 - DNA, 20 bp, Homo sapiens
caaagagggtgagggccttc

SEQ ID NO: 6683876 - DNA, 13 bp, Homo sapiens
caaagaggtattt

SEQ ID NO: 6683877 - DNA, 16 bp, Homo sapiens
caaagaggtatttatc

SEQ ID NO: 6683878 - DNA, 16 bp, Homo sapiens
caaagaggtgaacatt

SEQ ID NO: 6683879 - DNA, 22 bp, Homo sapiens
caaagaggtgaacattaaaata

SEQ ID NO: 6683880 - DNA, 20 bp, Homo sapiens
caaagaggtgctgctttgct

SEQ ID NO: 6683881 - DNA, 21 bp, Homo sapiens
caaagaggttttaaaaaaatc

SEQ ID NO: 6683882 - DNA, 16 bp, Homo sapiens
caaagagtctctggct

SEQ ID NO: 6683883 - DNA, 19 bp, Homo sapiens
caaagagtctctggctcag

SEQ ID NO: 6683884 - DNA, 20 bp, Homo sapiens
caaagagtctctggctcagc

SEQ ID NO: 6683885 - DNA, 23 bp, Homo sapiens
caaagagtctctggctcagctgt

SEQ ID NO: 6683886 - DNA, 14 bp, Homo sapiens
caaagagtgaaata

SEQ ID NO: 6683887 - DNA, 20 bp, Homo sapiens
caaagagtgaaatattgtaa

SEQ ID NO: 6683888 - DNA, 16 bp, Homo sapiens
caaagagtgtggaatt

SEQ ID NO: 6683889 - DNA, 16 bp, Homo sapiens
caaagagttaatatat

SEQ ID NO: 6683890 - DNA, 24 bp, Homo sapiens
caaagagttctggaaaagaactgt

SEQ ID NO: 6683891 - DNA, 18 bp, Homo sapiens
caaagagtttgatgaggc

SEQ ID NO: 6683892 - DNA, 21 bp, Homo sapiens
caaagataaaaggtttctttt

SEQ ID NO: 6683893 - DNA, 16 bp, Homo sapiens
caaagataacgcagga

SEQ ID NO: 6683894 - DNA, 21 bp, Homo sapiens
caaagataacgcaggagagag

SEQ ID NO: 6683895 - DNA, 20 bp, Homo sapiens
caaagataatctctcagctt

SEQ ID NO: 6683896 - DNA, 22 bp, Homo sapiens
caaagataatgcatatttttgc

SEQ ID NO: 6683897 - DNA, 16 bp, Homo sapiens
caaagataccattctt

SEQ ID NO: 6683898 - DNA, 14 bp, Homo sapiens
caaagatagacagg

SEQ ID NO: 6683899 - DNA, 19 bp, Homo sapiens
caaagatagacaggtcctg

SEQ ID NO: 6683900 - DNA, 16 bp, Homo sapiens
caaagatatatattca

SEQ ID NO: 6683901 - DNA, 20 bp, Homo sapiens
caaagatatgctaagcagta

SEQ ID NO: 6683902 - DNA, 12 bp, Homo sapiens
caaagatattat

SEQ ID NO: 6683903 - DNA, 18 bp, Homo sapiens
caaagatcaaaataaaaa

SEQ ID NO: 6683904 - DNA, 17 bp, Homo sapiens
caaagatcaccagccat

SEQ ID NO: 6683905 - DNA, 14 bp, Homo sapiens
caaagatctcagca

SEQ ID NO: 6683906 - DNA, 18 bp, Homo sapiens
caaagatctctagagttt

SEQ ID NO: 6683907 - DNA, 14 bp, Homo sapiens
caaagatctgctcc

SEQ ID NO: 6683908 - DNA, 15 bp, Homo sapiens
caaagatctgctcct

SEQ ID NO: 6683909 - DNA, 17 bp, Homo sapiens
caaagatgaaagctgtt

SEQ ID NO: 6683910 - DNA, 20 bp, Homo sapiens
caaagatgaaagctgtttca

SEQ ID NO: 6683911 - DNA, 13 bp, Homo sapiens
caaagatgaccat

SEQ ID NO: 6683912 - DNA, 17 bp, Homo sapiens
caaagatgacttctttt

SEQ ID NO: 6683913 - DNA, 14 bp, Homo sapiens
caaagatgataatt

SEQ ID NO: 6683914 - DNA, 15 bp, Homo sapiens
caaagatgcagccgc

SEQ ID NO: 6683915 - DNA, 14 bp, Homo sapiens
caaagatgcatttt

SEQ ID NO: 6683916 - DNA, 17 bp, Homo sapiens
caaagatgcattttgag

SEQ ID NO: 6683917 - DNA, 11 bp, Homo sapiens
caaagatgctg

SEQ ID NO: 6683918 - DNA, 20 bp, Homo sapiens
caaagatggattaaactcag

SEQ ID NO: 6683919 - DNA, 17 bp, Homo sapiens
caaagatggctcagagg

SEQ ID NO: 6683920 - DNA, 12 bp, Homo sapiens
caaagatggctt

SEQ ID NO: 6683921 - DNA, 23 bp, Homo sapiens
caaagatggtggctgtgtctctc

SEQ ID NO: 6683922 - DNA, 14 bp, Homo sapiens
caaagatgtactga

SEQ ID NO: 6683923 - DNA, 17 bp, Homo sapiens
caaagatgtactgagag

SEQ ID NO: 6683924 - DNA, 19 bp, Homo sapiens
caaagatgtactgagagga

SEQ ID NO: 6683925 - DNA, 22 bp, Homo sapiens
caaagatgtgggttctttttct

SEQ ID NO: 6683926 - DNA, 21 bp, Homo sapiens
caaagatgtgttcaggcattc

SEQ ID NO: 6683927 - DNA, 16 bp, Homo sapiens
caaagatgtttgtcag

SEQ ID NO: 6683928 - DNA, 18 bp, Homo sapiens
caaagatgtttgtcagat

SEQ ID NO: 6683929 - DNA, 15 bp, Homo sapiens
caaagattaaatgtg

SEQ ID NO: 6683930 - DNA, 17 bp, Homo sapiens
caaagattaggtcgttt

SEQ ID NO: 6683931 - DNA, 18 bp, Homo sapiens
caaagattaggtcgtttt

SEQ ID NO: 6683932 - DNA, 20 bp, Homo sapiens
caaagattaggtcgttttcc

SEQ ID NO: 6683933 - DNA, 21 bp, Homo sapiens
caaagattcaaaattgacatt

SEQ ID NO: 6683934 - DNA, 16 bp, Homo sapiens
caaagattcatgattt

SEQ ID NO: 6683935 - DNA, 21 bp, Homo sapiens
caaagatttcagtagaatttt

SEQ ID NO: 6683936 - DNA, 22 bp, Homo sapiens
caaagattttacctgggatatg

SEQ ID NO: 6683937 - DNA, 15 bp, Homo sapiens
caaagattttctaag

SEQ ID NO: 6683938 - DNA, 18 bp, Homo sapiens
caaagcaaaacagactgt

SEQ ID NO: 6683939 - DNA, 17 bp, Homo sapiens
caaagcaaaccaacaag

SEQ ID NO: 6683940 - DNA, 12 bp, Homo sapiens
caaagcaaagaa

SEQ ID NO: 6683941 - DNA, 21 bp, Homo sapiens
caaagcaaatttcattatcta

SEQ ID NO: 6683942 - DNA, 15 bp, Homo sapiens
caaagcaaatttcta

SEQ ID NO: 6683943 - DNA, 21 bp, Homo sapiens
caaagcaacccgctggagccc

SEQ ID NO: 6683944 - DNA, 23 bp, Homo sapiens
caaagcaacccgctggagcccac

SEQ ID NO: 6683945 - DNA, 16 bp, Homo sapiens
caaagcaagcacctgg

SEQ ID NO: 6683946 - DNA, 22 bp, Homo sapiens
caaagcaagcattcagaagaaa

SEQ ID NO: 6683947 - DNA, 11 bp, Homo sapiens
caaagcaaggg

SEQ ID NO: 6683948 - DNA, 14 bp, Homo sapiens
caaagcaagggctc

SEQ ID NO: 6683949 - DNA, 15 bp, Homo sapiens
caaagcaagggctcc

SEQ ID NO: 6683950 - DNA, 13 bp, Homo sapiens
caaagcacagaga

SEQ ID NO: 6683951 - DNA, 14 bp, Homo sapiens
caaagcacagtgtt

SEQ ID NO: 6683952 - DNA, 22 bp, Homo sapiens
caaagcacagtgttaaatgaaa

SEQ ID NO: 6683953 - DNA, 16 bp, Homo sapiens
caaagcacagtttgaa

SEQ ID NO: 6683954 - DNA, 21 bp, Homo sapiens
caaagcaccaaaataagaaaa

SEQ ID NO: 6683955 - DNA, 22 bp, Homo sapiens
caaagcaccaaaataagaaaag

SEQ ID NO: 6683956 - DNA, 24 bp, Homo sapiens
caaagcaccaaaataagaaaagat

SEQ ID NO: 6683957 - DNA, 19 bp, Homo sapiens
caaagcacctgaaccactg

SEQ ID NO: 6683958 - DNA, 22 bp, Homo sapiens
caaagcaccttgaatggaaggt

SEQ ID NO: 6683959 - DNA, 15 bp, Homo sapiens
caaagcactctctgc

SEQ ID NO: 6683960 - DNA, 14 bp, Homo sapiens
caaagcactggcct

SEQ ID NO: 6683961 - DNA, 22 bp, Homo sapiens
caaagcactggccttgcctcca

SEQ ID NO: 6683962 - DNA, 21 bp, Homo sapiens
caaagcactgttgagaaggag

SEQ ID NO: 6683963 - DNA, 18 bp, Homo sapiens
caaagcacttaagtgtta

SEQ ID NO: 6683964 - DNA, 21 bp, Homo sapiens
caaagcacttgcttacatcct

SEQ ID NO: 6683965 - DNA, 21 bp, Homo sapiens
caaagcacttggactcttgct

SEQ ID NO: 6683966 - DNA, 20 bp, Homo sapiens
caaagcacttttaaaaaaat

SEQ ID NO: 6683967 - DNA, 15 bp, Homo sapiens
caaagcagacagctc

SEQ ID NO: 6683968 - DNA, 16 bp, Homo sapiens
caaagcagacagctcc

SEQ ID NO: 6683969 - DNA, 19 bp, Homo sapiens
caaagcagagagtccaatt

SEQ ID NO: 6683970 - DNA, 20 bp, Homo sapiens
caaagcagagtgaaattcaa

SEQ ID NO: 6683971 - DNA, 21 bp, Homo sapiens
caaagcagagtgaaattcaat

SEQ ID NO: 6683972 - DNA, 16 bp, Homo sapiens
caaagcagattttcct

SEQ ID NO: 6683973 - DNA, 18 bp, Homo sapiens
caaagcagcaacacacat

SEQ ID NO: 6683974 - DNA, 13 bp, Homo sapiens
caaagcagcagga

SEQ ID NO: 6683975 - DNA, 19 bp, Homo sapiens
caaagcagcaggcctctgg

SEQ ID NO: 6683976 - DNA, 15 bp, Homo sapiens
caaagcaggagtgga

SEQ ID NO: 6683977 - DNA, 18 bp, Homo sapiens
caaagcaggagtggaagg

SEQ ID NO: 6683978 - DNA, 21 bp, Homo sapiens
caaagcagggaaacagggagg

SEQ ID NO: 6683979 - DNA, 20 bp, Homo sapiens
caaagcagtatataataact

SEQ ID NO: 6683980 - DNA, 17 bp, Homo sapiens
caaagcagtgcatgctg

SEQ ID NO: 6683981 - DNA, 22 bp, Homo sapiens
caaagcagtgcatgctgtccct

SEQ ID NO: 6683982 - DNA, 15 bp, Homo sapiens
caaagcagtggagcc

SEQ ID NO: 6683983 - DNA, 23 bp, Homo sapiens
caaagcagtggcttagctgccat

SEQ ID NO: 6683984 - DNA, 24 bp, Homo sapiens
caaagcagtggcttagctgccatc

SEQ ID NO: 6683985 - DNA, 22 bp, Homo sapiens
caaagcagtttttccccctagg

SEQ ID NO: 6683986 - DNA, 14 bp, Homo sapiens
caaagcataaaact

SEQ ID NO: 6683987 - DNA, 19 bp, Homo sapiens
caaagcatagatgttttgg

SEQ ID NO: 6683988 - DNA, 15 bp, Homo sapiens
caaagcatcaaataa

SEQ ID NO: 6683989 - DNA, 19 bp, Homo sapiens
caaagcatcggtcatgtgt

SEQ ID NO: 6683990 - DNA, 21 bp, Homo sapiens
caaagcatcggtcatgtgtgt

SEQ ID NO: 6683991 - DNA, 16 bp, Homo sapiens
caaagcatgctcagta

SEQ ID NO: 6683992 - DNA, 18 bp, Homo sapiens
caaagcatgctcagtatt

SEQ ID NO: 6683993 - DNA, 24 bp, Homo sapiens
caaagcatggacatttagaagaaa

SEQ ID NO: 6683994 - DNA, 14 bp, Homo sapiens
caaagcatggacta

SEQ ID NO: 6683995 - DNA, 19 bp, Homo sapiens
caaagcatgggattattag

SEQ ID NO: 6683996 - DNA, 14 bp, Homo sapiens
caaagcatgtttca

SEQ ID NO: 6683997 - DNA, 17 bp, Homo sapiens
caaagcatgttttgcat

SEQ ID NO: 6683998 - DNA, 17 bp, Homo sapiens
caaagcattgagcaaag

SEQ ID NO: 6683999 - DNA, 14 bp, Homo sapiens
caaagcatttctag

SEQ ID NO: 6684000 - DNA, 18 bp, Homo sapiens
caaagcatttctagtccc

SEQ ID NO: 6684001 - DNA, 17 bp, Homo sapiens
caaagccaaactctgcc

SEQ ID NO: 6684002 - DNA, 18 bp, Homo sapiens
caaagccaaactctgcca

SEQ ID NO: 6684003 - DNA, 20 bp, Homo sapiens
caaagccaaagctaggcctg

SEQ ID NO: 6684004 - DNA, 22 bp, Homo sapiens
caaagccaacagtcaaaacaga

SEQ ID NO: 6684005 - DNA, 16 bp, Homo sapiens
caaagccaagaaagaa

SEQ ID NO: 6684006 - DNA, 16 bp, Homo sapiens
caaagccaagacctca

SEQ ID NO: 6684007 - DNA, 18 bp, Homo sapiens
caaagccacaaggctggc

SEQ ID NO: 6684008 - DNA, 19 bp, Homo sapiens
caaagccacaaggctggcc

SEQ ID NO: 6684009 - DNA, 15 bp, Homo sapiens
caaagccacctgctg

SEQ ID NO: 6684010 - DNA, 16 bp, Homo sapiens
caaagccactggaagg

SEQ ID NO: 6684011 - DNA, 18 bp, Homo sapiens
caaagccactggaaggag

SEQ ID NO: 6684012 - DNA, 19 bp, Homo sapiens
caaagccactggaaggagc

SEQ ID NO: 6684013 - DNA, 12 bp, Homo sapiens
caaagccagaac

SEQ ID NO: 6684014 - DNA, 14 bp, Homo sapiens
caaagccagacagc

SEQ ID NO: 6684015 - DNA, 14 bp, Homo sapiens
caaagccagaggag

SEQ ID NO: 6684016 - DNA, 23 bp, Homo sapiens
caaagccagcgtcctcctctgtg

SEQ ID NO: 6684017 - DNA, 15 bp, Homo sapiens
caaagccagggtctc

SEQ ID NO: 6684018 - DNA, 14 bp, Homo sapiens
caaagccaggtccc

SEQ ID NO: 6684019 - DNA, 17 bp, Homo sapiens
caaagccaggtccctct

SEQ ID NO: 6684020 - DNA, 18 bp, Homo sapiens
caaagccaggtccctctc

SEQ ID NO: 6684021 - DNA, 19 bp, Homo sapiens
caaagccaggtccctctca

SEQ ID NO: 6684022 - DNA, 16 bp, Homo sapiens
caaagccagtgaaatg

SEQ ID NO: 6684023 - DNA, 23 bp, Homo sapiens
caaagccagtgaaatgtgaagga

SEQ ID NO: 6684024 - DNA, 17 bp, Homo sapiens
caaagccatatggacac

SEQ ID NO: 6684025 - DNA, 19 bp, Homo sapiens
caaagccatattctaaatt

SEQ ID NO: 6684026 - DNA, 15 bp, Homo sapiens
caaagccattctttt

SEQ ID NO: 6684027 - DNA, 20 bp, Homo sapiens
caaagcccaaactcctttct

SEQ ID NO: 6684028 - DNA, 22 bp, Homo sapiens
caaagcccaaactcctttctta

SEQ ID NO: 6684029 - DNA, 19 bp, Homo sapiens
caaagcccaaagtggtata

SEQ ID NO: 6684030 - DNA, 14 bp, Homo sapiens
caaagcccaaggga

SEQ ID NO: 6684031 - DNA, 16 bp, Homo sapiens
caaagcccagcccggc

SEQ ID NO: 6684032 - DNA, 19 bp, Homo sapiens
caaagcccagcccggctga

SEQ ID NO: 6684033 - DNA, 23 bp, Homo sapiens
caaagcccagctctttgttcagt

SEQ ID NO: 6684034 - DNA, 14 bp, Homo sapiens
caaagcccatgccc

SEQ ID NO: 6684035 - DNA, 15 bp, Homo sapiens
caaagccccatgctg

SEQ ID NO: 6684036 - DNA, 16 bp, Homo sapiens
caaagccccatgctgg

SEQ ID NO: 6684037 - DNA, 21 bp, Homo sapiens
caaagccccatgctggagcct

SEQ ID NO: 6684038 - DNA, 22 bp, Homo sapiens
caaagccccatgtgccttgtcc

SEQ ID NO: 6684039 - DNA, 19 bp, Homo sapiens
caaagcccccacttctctc

SEQ ID NO: 6684040 - DNA, 16 bp, Homo sapiens
caaagcccccagagcc

SEQ ID NO: 6684041 - DNA, 17 bp, Homo sapiens
caaagccccccagctcc

SEQ ID NO: 6684042 - DNA, 18 bp, Homo sapiens
caaagcccctcacactgc

SEQ ID NO: 6684043 - DNA, 22 bp, Homo sapiens
caaagcccctcacactgcaagg

SEQ ID NO: 6684044 - DNA, 23 bp, Homo sapiens
caaagccccttgctctcccctgc

SEQ ID NO: 6684045 - DNA, 16 bp, Homo sapiens
caaagccctccctgtc

SEQ ID NO: 6684046 - DNA, 11 bp, Homo sapiens
caaagccctgc

SEQ ID NO: 6684047 - DNA, 18 bp, Homo sapiens
caaagccctgcctctgtg

SEQ ID NO: 6684048 - DNA, 18 bp, Homo sapiens
caaagcccttccatgtcg

SEQ ID NO: 6684049 - DNA, 17 bp, Homo sapiens
caaagccgtgcctttct

SEQ ID NO: 6684050 - DNA, 21 bp, Homo sapiens
caaagccgtgcctttctctgg

SEQ ID NO: 6684051 - DNA, 21 bp, Homo sapiens
caaagcctagacaacctttct

SEQ ID NO: 6684052 - DNA, 23 bp, Homo sapiens
caaagcctagacaacctttctgt

SEQ ID NO: 6684053 - DNA, 15 bp, Homo sapiens
caaagcctccttttt

SEQ ID NO: 6684054 - DNA, 12 bp, Homo sapiens
caaagcctgagg

SEQ ID NO: 6684055 - DNA, 19 bp, Homo sapiens
caaagcctgtcccaggact

SEQ ID NO: 6684056 - DNA, 20 bp, Homo sapiens
caaagcctgttcatggcaga

SEQ ID NO: 6684057 - DNA, 21 bp, Homo sapiens
caaagccttaagcaaattttg

SEQ ID NO: 6684058 - DNA, 11 bp, Homo sapiens
caaagccttat

SEQ ID NO: 6684059 - DNA, 21 bp, Homo sapiens
caaagccttgtgtctacagag

SEQ ID NO: 6684060 - DNA, 21 bp, Homo sapiens
caaagcgctaagtaaaaatat

SEQ ID NO: 6684061 - DNA, 13 bp, Homo sapiens
caaagcgctcgcc

SEQ ID NO: 6684062 - DNA, 19 bp, Homo sapiens
caaagcggtccctgtccct

SEQ ID NO: 6684063 - DNA, 20 bp, Homo sapiens
caaagcgtttctttacttct

SEQ ID NO: 6684064 - DNA, 16 bp, Homo sapiens
caaagctaaatacatg

SEQ ID NO: 6684065 - DNA, 18 bp, Homo sapiens
caaagctaaatacatgga

SEQ ID NO: 6684066 - DNA, 13 bp, Homo sapiens
caaagctaccttt

SEQ ID NO: 6684067 - DNA, 14 bp, Homo sapiens
caaagctacctttt

SEQ ID NO: 6684068 - DNA, 18 bp, Homo sapiens
caaagctaggaaaggcag

SEQ ID NO: 6684069 - DNA, 13 bp, Homo sapiens
caaagctaggcct

SEQ ID NO: 6684070 - DNA, 14 bp, Homo sapiens
caaagctaggcctg

SEQ ID NO: 6684071 - DNA, 19 bp, Homo sapiens
caaagctaggcctggccag

SEQ ID NO: 6684072 - DNA, 21 bp, Homo sapiens
caaagctagggtggcccttgc

SEQ ID NO: 6684073 - DNA, 15 bp, Homo sapiens
caaagctatttaagt

SEQ ID NO: 6684074 - DNA, 23 bp, Homo sapiens
caaagctctattaagatttccaa

SEQ ID NO: 6684075 - DNA, 13 bp, Homo sapiens
caaagctctgaat

SEQ ID NO: 6684076 - DNA, 15 bp, Homo sapiens
caaagctgaaaatgt

SEQ ID NO: 6684077 - DNA, 14 bp, Homo sapiens
caaagctgaagatc

SEQ ID NO: 6684078 - DNA, 14 bp, Homo sapiens
caaagctgaatatt

SEQ ID NO: 6684079 - DNA, 14 bp, Homo sapiens
caaagctgagcctg

SEQ ID NO: 6684080 - DNA, 23 bp, Homo sapiens
caaagctgagcctgcagggaagc

SEQ ID NO: 6684081 - DNA, 15 bp, Homo sapiens
caaagctgatttccc

SEQ ID NO: 6684082 - DNA, 23 bp, Homo sapiens
caaagctgatttcccttttttct

SEQ ID NO: 6684083 - DNA, 21 bp, Homo sapiens
caaagctgcctgtccctaccc

SEQ ID NO: 6684084 - DNA, 17 bp, Homo sapiens
caaagctgcctgtgcca

SEQ ID NO: 6684085 - DNA, 17 bp, Homo sapiens
caaagctgctgggccag

SEQ ID NO: 6684086 - DNA, 18 bp, Homo sapiens
caaagctgctgggccagt

SEQ ID NO: 6684087 - DNA, 14 bp, Homo sapiens
caaagctgcttgaa

SEQ ID NO: 6684088 - DNA, 15 bp, Homo sapiens
caaagctgcttgaat

SEQ ID NO: 6684089 - DNA, 16 bp, Homo sapiens
caaagctgcttgaatc

SEQ ID NO: 6684090 - DNA, 16 bp, Homo sapiens
caaagctgctttcttc

SEQ ID NO: 6684091 - DNA, 23 bp, Homo sapiens
caaagctgctttcttctctgcct

SEQ ID NO: 6684092 - DNA, 15 bp, Homo sapiens
caaagctggagatga

SEQ ID NO: 6684093 - DNA, 13 bp, Homo sapiens
caaagctggccca

SEQ ID NO: 6684094 - DNA, 16 bp, Homo sapiens
caaagctggctcacct

SEQ ID NO: 6684095 - DNA, 17 bp, Homo sapiens
caaagctggctcacctt

SEQ ID NO: 6684096 - DNA, 17 bp, Homo sapiens
caaagctggctttttgt

SEQ ID NO: 6684097 - DNA, 16 bp, Homo sapiens
caaagctgttaaactg

SEQ ID NO: 6684098 - DNA, 22 bp, Homo sapiens
caaagctgttaaactgttagca

SEQ ID NO: 6684099 - DNA, 14 bp, Homo sapiens
caaagcttaaatgc

SEQ ID NO: 6684100 - DNA, 15 bp, Homo sapiens
caaagcttagcagga

SEQ ID NO: 6684101 - DNA, 18 bp, Homo sapiens
caaagcttattttgtaag

SEQ ID NO: 6684102 - DNA, 16 bp, Homo sapiens
caaagcttcaaaaact

SEQ ID NO: 6684103 - DNA, 17 bp, Homo sapiens
caaagcttcgtcttgtg

SEQ ID NO: 6684104 - DNA, 14 bp, Homo sapiens
caaagcttgaagat

SEQ ID NO: 6684105 - DNA, 20 bp, Homo sapiens
caaagcttggattaaataca

SEQ ID NO: 6684106 - DNA, 21 bp, Homo sapiens
caaagcttggtgtcttggcac

SEQ ID NO: 6684107 - DNA, 16 bp, Homo sapiens
caaagcttgttaagat

SEQ ID NO: 6684108 - DNA, 13 bp, Homo sapiens
caaagctttacta

SEQ ID NO: 6684109 - DNA, 16 bp, Homo sapiens
caaagctttactactg

SEQ ID NO: 6684110 - DNA, 23 bp, Homo sapiens
caaagctttatttcaaatctctt

SEQ ID NO: 6684111 - DNA, 17 bp, Homo sapiens
caaagctttcctggaga

SEQ ID NO: 6684112 - DNA, 19 bp, Homo sapiens
caaagctttggctgagacc

SEQ ID NO: 6684113 - DNA, 14 bp, Homo sapiens
caaagctttttgaa

SEQ ID NO: 6684114 - DNA, 21 bp, Homo sapiens
caaaggaaaaagcacaagaag

SEQ ID NO: 6684115 - DNA, 14 bp, Homo sapiens
caaaggaaaccaaa

SEQ ID NO: 6684116 - DNA, 16 bp, Homo sapiens
caaaggaaaccaaagg

SEQ ID NO: 6684117 - DNA, 15 bp, Homo sapiens
caaaggaaataaagc

SEQ ID NO: 6684118 - DNA, 18 bp, Homo sapiens
caaaggaaatccaaaaaa

SEQ ID NO: 6684119 - DNA, 16 bp, Homo sapiens
caaaggaactctagag

SEQ ID NO: 6684120 - DNA, 12 bp, Homo sapiens
caaaggaagcac

SEQ ID NO: 6684121 - DNA, 13 bp, Homo sapiens
caaaggaagcaca

SEQ ID NO: 6684122 - DNA, 14 bp, Homo sapiens
caaaggaagcacat

SEQ ID NO: 6684123 - DNA, 20 bp, Homo sapiens
caaaggaagctttctctgct

SEQ ID NO: 6684124 - DNA, 21 bp, Homo sapiens
caaaggaaggaccctgaggcc

SEQ ID NO: 6684125 - DNA, 17 bp, Homo sapiens
caaaggaaggtggatgg

SEQ ID NO: 6684126 - DNA, 10 bp, Homo sapiens
caaaggaagt

SEQ ID NO: 6684127 - DNA, 17 bp, Homo sapiens
caaaggaagtagcaggc

SEQ ID NO: 6684128 - DNA, 19 bp, Homo sapiens
caaaggaagtctaaatatt

SEQ ID NO: 6684129 - DNA, 16 bp, Homo sapiens
caaaggaagtgaggta

SEQ ID NO: 6684130 - DNA, 21 bp, Homo sapiens
caaaggaataacctttctgga

SEQ ID NO: 6684131 - DNA, 24 bp, Homo sapiens
caaaggaatggaggctctaattga

SEQ ID NO: 6684132 - DNA, 17 bp, Homo sapiens
caaaggacacaagggtg

SEQ ID NO: 6684133 - DNA, 17 bp, Homo sapiens
caaaggacattatgtgt

SEQ ID NO: 6684134 - DNA, 19 bp, Homo sapiens
caaaggacattatgtgtgc

SEQ ID NO: 6684135 - DNA, 20 bp, Homo sapiens
caaaggacattatgtgtgca

SEQ ID NO: 6684136 - DNA, 19 bp, Homo sapiens
caaaggaccgttttgtatt

SEQ ID NO: 6684137 - DNA, 13 bp, Homo sapiens
caaaggacgcact

SEQ ID NO: 6684138 - DNA, 15 bp, Homo sapiens
caaaggactccaccc

SEQ ID NO: 6684139 - DNA, 16 bp, Homo sapiens
caaaggactgtaagca

SEQ ID NO: 6684140 - DNA, 23 bp, Homo sapiens
caaaggactgttttttcctgagc

SEQ ID NO: 6684141 - DNA, 11 bp, Homo sapiens
caaaggagaaa

SEQ ID NO: 6684142 - DNA, 19 bp, Homo sapiens
caaaggagacaaagcagga

SEQ ID NO: 6684143 - DNA, 20 bp, Homo sapiens
caaaggagacgggggagcag

SEQ ID NO: 6684144 - DNA, 16 bp, Homo sapiens
caaaggagagtcctgg

SEQ ID NO: 6684145 - DNA, 19 bp, Homo sapiens
caaaggagagtcctgggag

SEQ ID NO: 6684146 - DNA, 14 bp, Homo sapiens
caaaggagattgga

SEQ ID NO: 6684147 - DNA, 17 bp, Homo sapiens
caaaggagcattaagcc

SEQ ID NO: 6684148 - DNA, 20 bp, Homo sapiens
caaaggagcattgcagtcac

SEQ ID NO: 6684149 - DNA, 11 bp, Homo sapiens
caaaggagcct

SEQ ID NO: 6684150 - DNA, 13 bp, Homo sapiens
caaaggagcctgt

SEQ ID NO: 6684151 - DNA, 15 bp, Homo sapiens
caaaggagcctgtga

SEQ ID NO: 6684152 - DNA, 14 bp, Homo sapiens
caaaggagccttga

SEQ ID NO: 6684153 - DNA, 18 bp, Homo sapiens
caaaggagcgagcatgtc

SEQ ID NO: 6684154 - DNA, 16 bp, Homo sapiens
caaaggaggaatttac

SEQ ID NO: 6684155 - DNA, 20 bp, Homo sapiens
caaaggaggacaagaccctc

SEQ ID NO: 6684156 - DNA, 18 bp, Homo sapiens
caaaggagggcctcagag

SEQ ID NO: 6684157 - DNA, 22 bp, Homo sapiens
caaaggaggggaaacaatgaaa

SEQ ID NO: 6684158 - DNA, 20 bp, Homo sapiens
caaaggagggtcaggaagga

SEQ ID NO: 6684159 - DNA, 16 bp, Homo sapiens
caaaggagtagaaaga

SEQ ID NO: 6684160 - DNA, 22 bp, Homo sapiens
caaaggagtgcatggccacagc

SEQ ID NO: 6684161 - DNA, 13 bp, Homo sapiens
caaaggatactgt

SEQ ID NO: 6684162 - DNA, 12 bp, Homo sapiens
caaaggatgaag

SEQ ID NO: 6684163 - DNA, 14 bp, Homo sapiens
caaaggatgaagaa

SEQ ID NO: 6684164 - DNA, 21 bp, Homo sapiens
caaaggatgaagaacacagca

SEQ ID NO: 6684165 - DNA, 18 bp, Homo sapiens
caaaggatgagaatgtga

SEQ ID NO: 6684166 - DNA, 21 bp, Homo sapiens
caaaggatgcccaaagatgca

SEQ ID NO: 6684167 - DNA, 14 bp, Homo sapiens
caaaggatgtgata

SEQ ID NO: 6684168 - DNA, 21 bp, Homo sapiens
caaaggatgtgatatataagt

SEQ ID NO: 6684169 - DNA, 14 bp, Homo sapiens
caaaggatttgaaa

SEQ ID NO: 6684170 - DNA, 23 bp, Homo sapiens
caaaggatttgatgcttttctct

SEQ ID NO: 6684171 - DNA, 14 bp, Homo sapiens
caaaggcaagttaa

SEQ ID NO: 6684172 - DNA, 11 bp, Homo sapiens
caaaggcagaa

SEQ ID NO: 6684173 - DNA, 16 bp, Homo sapiens
caaaggcagaaaggag

SEQ ID NO: 6684174 - DNA, 18 bp, Homo sapiens
caaaggcagaaaggagat

SEQ ID NO: 6684175 - DNA, 15 bp, Homo sapiens
caaaggcagaggaat

SEQ ID NO: 6684176 - DNA, 15 bp, Homo sapiens
caaaggcagcgtgcc

SEQ ID NO: 6684177 - DNA, 14 bp, Homo sapiens
caaaggcagctgtg

SEQ ID NO: 6684178 - DNA, 16 bp, Homo sapiens
caaaggcagctgtgtc

SEQ ID NO: 6684179 - DNA, 23 bp, Homo sapiens
caaaggcagctgtgtctgagccc

SEQ ID NO: 6684180 - DNA, 13 bp, Homo sapiens
caaaggcagggcc

SEQ ID NO: 6684181 - DNA, 13 bp, Homo sapiens
caaaggcatgctg

SEQ ID NO: 6684182 - DNA, 17 bp, Homo sapiens
caaaggcatgctggagt

SEQ ID NO: 6684183 - DNA, 19 bp, Homo sapiens
caaaggccagacctgcaga

SEQ ID NO: 6684184 - DNA, 20 bp, Homo sapiens
caaaggccagacctgcagac

SEQ ID NO: 6684185 - DNA, 12 bp, Homo sapiens
caaaggccagcg

SEQ ID NO: 6684186 - DNA, 21 bp, Homo sapiens
caaaggccatggagagctgga

SEQ ID NO: 6684187 - DNA, 13 bp, Homo sapiens
caaaggcccagaa

SEQ ID NO: 6684188 - DNA, 17 bp, Homo sapiens
caaaggcccagggaggc

SEQ ID NO: 6684189 - DNA, 20 bp, Homo sapiens
caaaggcccagggaggcagc

SEQ ID NO: 6684190 - DNA, 23 bp, Homo sapiens
caaaggcccatgcccccttcgct

SEQ ID NO: 6684191 - DNA, 17 bp, Homo sapiens
caaaggccccagcatct

SEQ ID NO: 6684192 - DNA, 16 bp, Homo sapiens
caaaggcccccagcca

SEQ ID NO: 6684193 - DNA, 11 bp, Homo sapiens
caaaggccctt

SEQ ID NO: 6684194 - DNA, 15 bp, Homo sapiens
caaaggcccttgtca

SEQ ID NO: 6684195 - DNA, 13 bp, Homo sapiens
caaaggcctgggc

SEQ ID NO: 6684196 - DNA, 23 bp, Homo sapiens
caaaggcgcagtgcttctctaca

SEQ ID NO: 6684197 - DNA, 14 bp, Homo sapiens
caaaggcggggtgg

SEQ ID NO: 6684198 - DNA, 23 bp, Homo sapiens
caaaggctgagaacactgtgaaa

SEQ ID NO: 6684199 - DNA, 13 bp, Homo sapiens
caaaggctgggac

SEQ ID NO: 6684200 - DNA, 12 bp, Homo sapiens
caaagggaaaaa

SEQ ID NO: 6684201 - DNA, 19 bp, Homo sapiens
caaagggaaaaaagagttt

SEQ ID NO: 6684202 - DNA, 17 bp, Homo sapiens
caaagggaaagcctctg

SEQ ID NO: 6684203 - DNA, 20 bp, Homo sapiens
caaagggaaagcctctggcc

SEQ ID NO: 6684204 - DNA, 21 bp, Homo sapiens
caaagggaaagcctctggccg

SEQ ID NO: 6684205 - DNA, 18 bp, Homo sapiens
caaagggaaatatcattt

SEQ ID NO: 6684206 - DNA, 23 bp, Homo sapiens
caaagggaagtgaggcccaagga

SEQ ID NO: 6684207 - DNA, 22 bp, Homo sapiens
caaagggacttttgtaaaatca

SEQ ID NO: 6684208 - DNA, 12 bp, Homo sapiens
caaagggaggga

SEQ ID NO: 6684209 - DNA, 14 bp, Homo sapiens
caaagggagggagc

SEQ ID NO: 6684210 - DNA, 19 bp, Homo sapiens
caaagggagggagcaagcc

SEQ ID NO: 6684211 - DNA, 15 bp, Homo sapiens
caaagggagggtggc

SEQ ID NO: 6684212 - DNA, 17 bp, Homo sapiens
caaagggagtctgccag

SEQ ID NO: 6684213 - DNA, 11 bp, Homo sapiens
caaagggcagt

SEQ ID NO: 6684214 - DNA, 18 bp, Homo sapiens
caaagggcagtaaagttt

SEQ ID NO: 6684215 - DNA, 17 bp, Homo sapiens
caaagggcagttttgag

SEQ ID NO: 6684216 - DNA, 21 bp, Homo sapiens
caaagggctgaaagccatttg

SEQ ID NO: 6684217 - DNA, 17 bp, Homo sapiens
caaaggggaaagaacat

SEQ ID NO: 6684218 - DNA, 21 bp, Homo sapiens
caaaggggaaagaacataaag

SEQ ID NO: 6684219 - DNA, 15 bp, Homo sapiens
caaaggggacaggcc

SEQ ID NO: 6684220 - DNA, 19 bp, Homo sapiens
caaaggggacaggcctcac

SEQ ID NO: 6684221 - DNA, 16 bp, Homo sapiens
caaaggggagaagggc

SEQ ID NO: 6684222 - DNA, 14 bp, Homo sapiens
caaaggggagccag

SEQ ID NO: 6684223 - DNA, 15 bp, Homo sapiens
caaaggggagccaga

SEQ ID NO: 6684224 - DNA, 21 bp, Homo sapiens
caaaggggagccagaaatggg

SEQ ID NO: 6684225 - DNA, 17 bp, Homo sapiens
caaaggggcctctcctt

SEQ ID NO: 6684226 - DNA, 15 bp, Homo sapiens
caaaggggctgctgg

SEQ ID NO: 6684227 - DNA, 19 bp, Homo sapiens
caaaggggctgctggggca

SEQ ID NO: 6684228 - DNA, 22 bp, Homo sapiens
caaagggggaggctaaagccca

SEQ ID NO: 6684229 - DNA, 12 bp, Homo sapiens
caaaggggggag

SEQ ID NO: 6684230 - DNA, 21 bp, Homo sapiens
caaagggtatcaggtgctgcc

SEQ ID NO: 6684231 - DNA, 17 bp, Homo sapiens
caaagggtccagaagga

SEQ ID NO: 6684232 - DNA, 21 bp, Homo sapiens
caaagggtccagaaggagaca

SEQ ID NO: 6684233 - DNA, 11 bp, Homo sapiens
caaagggtctt

SEQ ID NO: 6684234 - DNA, 23 bp, Homo sapiens
caaagggtgaagctatttatctg

SEQ ID NO: 6684235 - DNA, 16 bp, Homo sapiens
caaagggttttaatgt

SEQ ID NO: 6684236 - DNA, 18 bp, Homo sapiens
caaagggttttaatgtag

SEQ ID NO: 6684237 - DNA, 19 bp, Homo sapiens
caaagggttttaatgtaga

SEQ ID NO: 6684238 - DNA, 23 bp, Homo sapiens
caaaggtccgcaccctgtcctgc

SEQ ID NO: 6684239 - DNA, 18 bp, Homo sapiens
caaaggtctttttaaacc

SEQ ID NO: 6684240 - DNA, 18 bp, Homo sapiens
caaaggtgaaggaatata

SEQ ID NO: 6684241 - DNA, 18 bp, Homo sapiens
caaaggtgattttcctgt

SEQ ID NO: 6684242 - DNA, 14 bp, Homo sapiens
caaaggtgcactcc

SEQ ID NO: 6684243 - DNA, 16 bp, Homo sapiens
caaaggtgcactccag

SEQ ID NO: 6684244 - DNA, 18 bp, Homo sapiens
caaaggtgctaattaata

SEQ ID NO: 6684245 - DNA, 23 bp, Homo sapiens
caaaggtggcagcttgtgaagat

SEQ ID NO: 6684246 - DNA, 24 bp, Homo sapiens
caaaggtggcagcttgtgaagatt

SEQ ID NO: 6684247 - DNA, 16 bp, Homo sapiens
caaaggtggtaaattc

SEQ ID NO: 6684248 - DNA, 19 bp, Homo sapiens
caaaggtggtaaattcaga

SEQ ID NO: 6684249 - DNA, 22 bp, Homo sapiens
caaaggtggtaaattcagacaa

SEQ ID NO: 6684250 - DNA, 17 bp, Homo sapiens
caaaggtgtgcaaactt

SEQ ID NO: 6684251 - DNA, 22 bp, Homo sapiens
caaaggtgtgcttcctgctgta

SEQ ID NO: 6684252 - DNA, 22 bp, Homo sapiens
caaaggttctaggtttcaaaga

SEQ ID NO: 6684253 - DNA, 15 bp, Homo sapiens
caaaggttgagatgt

SEQ ID NO: 6684254 - DNA, 15 bp, Homo sapiens
caaaggttgtacata

SEQ ID NO: 6684255 - DNA, 16 bp, Homo sapiens
caaaggtttggaagga

SEQ ID NO: 6684256 - DNA, 17 bp, Homo sapiens
caaaggtttggaaggag

SEQ ID NO: 6684257 - DNA, 21 bp, Homo sapiens
caaaggtttggaaggagcaga

SEQ ID NO: 6684258 - DNA, 22 bp, Homo sapiens
caaagtaaaaattgaactgtaa

SEQ ID NO: 6684259 - DNA, 21 bp, Homo sapiens
caaagtaaaacttgctgcctg

SEQ ID NO: 6684260 - DNA, 20 bp, Homo sapiens
caaagtaaaatgaacatttt

SEQ ID NO: 6684261 - DNA, 15 bp, Homo sapiens
caaagtaaactgtgt

SEQ ID NO: 6684262 - DNA, 19 bp, Homo sapiens
caaagtaaaggcctcctcc

SEQ ID NO: 6684263 - DNA, 21 bp, Homo sapiens
caaagtaacctgggcttaagt

SEQ ID NO: 6684264 - DNA, 23 bp, Homo sapiens
caaagtaacctgggcttaagttt

SEQ ID NO: 6684265 - DNA, 18 bp, Homo sapiens
caaagtaatttggaaatt

SEQ ID NO: 6684266 - DNA, 20 bp, Homo sapiens
caaagtacactgtttcaaac

SEQ ID NO: 6684267 - DNA, 22 bp, Homo sapiens
caaagtacagaatagaatacat

SEQ ID NO: 6684268 - DNA, 19 bp, Homo sapiens
caaagtacaggtactttgt

SEQ ID NO: 6684269 - DNA, 18 bp, Homo sapiens
caaagtacattgtaaaat

SEQ ID NO: 6684270 - DNA, 16 bp, Homo sapiens
caaagtaccaactgag

SEQ ID NO: 6684271 - DNA, 19 bp, Homo sapiens
caaagtaccaactgagcca

SEQ ID NO: 6684272 - DNA, 20 bp, Homo sapiens
caaagtaccaactgagccaa

SEQ ID NO: 6684273 - DNA, 16 bp, Homo sapiens
caaagtaccacactga

SEQ ID NO: 6684274 - DNA, 12 bp, Homo sapiens
caaagtactgta

SEQ ID NO: 6684275 - DNA, 21 bp, Homo sapiens
caaagtagaaactactaattt

SEQ ID NO: 6684276 - DNA, 22 bp, Homo sapiens
caaagtagaagtcttagatgta

SEQ ID NO: 6684277 - DNA, 15 bp, Homo sapiens
caaagtagagaagta

SEQ ID NO: 6684278 - DNA, 22 bp, Homo sapiens
caaagtagagaagtatccaatt

SEQ ID NO: 6684279 - DNA, 23 bp, Homo sapiens
caaagtagattcttacaaggccc

SEQ ID NO: 6684280 - DNA, 18 bp, Homo sapiens
caaagtaggtatacaaaa

SEQ ID NO: 6684281 - DNA, 23 bp, Homo sapiens
caaagtaggtatacaaaagacta

SEQ ID NO: 6684282 - DNA, 16 bp, Homo sapiens
caaagtatatacagag

SEQ ID NO: 6684283 - DNA, 17 bp, Homo sapiens
caaagtatatacagagc

SEQ ID NO: 6684284 - DNA, 15 bp, Homo sapiens
caaagtatcaaagaa

SEQ ID NO: 6684285 - DNA, 19 bp, Homo sapiens
caaagtatccctactgtaa

SEQ ID NO: 6684286 - DNA, 14 bp, Homo sapiens
caaagtattaagca

SEQ ID NO: 6684287 - DNA, 16 bp, Homo sapiens
caaagtattgtaaatt

SEQ ID NO: 6684288 - DNA, 17 bp, Homo sapiens
caaagtattgtaaatta

SEQ ID NO: 6684289 - DNA, 16 bp, Homo sapiens
caaagtattgtgaaag

SEQ ID NO: 6684290 - DNA, 23 bp, Homo sapiens
caaagtatttttttatcttggga

SEQ ID NO: 6684291 - DNA, 19 bp, Homo sapiens
caaagtatttttttctttt

SEQ ID NO: 6684292 - DNA, 16 bp, Homo sapiens
caaagtcaagccacat

SEQ ID NO: 6684293 - DNA, 16 bp, Homo sapiens
caaagtcacaggaaga

SEQ ID NO: 6684294 - DNA, 21 bp, Homo sapiens
caaagtcacttccccaagatc

SEQ ID NO: 6684295 - DNA, 15 bp, Homo sapiens
caaagtcacttctcc

SEQ ID NO: 6684296 - DNA, 16 bp, Homo sapiens
caaagtcacttctcca

SEQ ID NO: 6684297 - DNA, 18 bp, Homo sapiens
caaagtcaggaatcatca

SEQ ID NO: 6684298 - DNA, 19 bp, Homo sapiens
caaagtcagtaggagagga

SEQ ID NO: 6684299 - DNA, 18 bp, Homo sapiens
caaagtcataattgcatt

SEQ ID NO: 6684300 - DNA, 17 bp, Homo sapiens
caaagtcatcccctctc

SEQ ID NO: 6684301 - DNA, 15 bp, Homo sapiens
caaagtcatgatgtt

SEQ ID NO: 6684302 - DNA, 12 bp, Homo sapiens
caaagtcattaa

SEQ ID NO: 6684303 - DNA, 16 bp, Homo sapiens
caaagtcattaaagac

SEQ ID NO: 6684304 - DNA, 14 bp, Homo sapiens
caaagtcattgaat

SEQ ID NO: 6684305 - DNA, 21 bp, Homo sapiens
caaagtccccctcctcagcca

SEQ ID NO: 6684306 - DNA, 23 bp, Homo sapiens
caaagtccccctcctcagccagc

SEQ ID NO: 6684307 - DNA, 15 bp, Homo sapiens
caaagtcctcctttc

SEQ ID NO: 6684308 - DNA, 19 bp, Homo sapiens
caaagtcctgggattacag

SEQ ID NO: 6684309 - DNA, 14 bp, Homo sapiens
caaagtcctttccc

SEQ ID NO: 6684310 - DNA, 21 bp, Homo sapiens
caaagtcgccagtcactgctg

SEQ ID NO: 6684311 - DNA, 13 bp, Homo sapiens
caaagtctaaact

SEQ ID NO: 6684312 - DNA, 15 bp, Homo sapiens
caaagtctaaagttt

SEQ ID NO: 6684313 - DNA, 17 bp, Homo sapiens
caaagtctaaagtttac

SEQ ID NO: 6684314 - DNA, 18 bp, Homo sapiens
caaagtctccagaagaaa

SEQ ID NO: 6684315 - DNA, 13 bp, Homo sapiens
caaagtctctaat

SEQ ID NO: 6684316 - DNA, 21 bp, Homo sapiens
caaagtctctggaatttgaaa

SEQ ID NO: 6684317 - DNA, 17 bp, Homo sapiens
caaagtctgccgcccac

SEQ ID NO: 6684318 - DNA, 20 bp, Homo sapiens
caaagtctgccgcccacctc

SEQ ID NO: 6684319 - DNA, 20 bp, Homo sapiens
caaagtctgctctcatataa

SEQ ID NO: 6684320 - DNA, 17 bp, Homo sapiens
caaagtctgggaaattc

SEQ ID NO: 6684321 - DNA, 19 bp, Homo sapiens
caaagtgaaagacatttca

SEQ ID NO: 6684322 - DNA, 20 bp, Homo sapiens
caaagtgaactctattttga

SEQ ID NO: 6684323 - DNA, 18 bp, Homo sapiens
caaagtgactgtttggct

SEQ ID NO: 6684324 - DNA, 15 bp, Homo sapiens
caaagtgagaaatga

SEQ ID NO: 6684325 - DNA, 21 bp, Homo sapiens
caaagtgatagaaaagtgtgg

SEQ ID NO: 6684326 - DNA, 14 bp, Homo sapiens
caaagtgcaaagct

SEQ ID NO: 6684327 - DNA, 16 bp, Homo sapiens
caaagtgcacacacac

SEQ ID NO: 6684328 - DNA, 21 bp, Homo sapiens
caaagtgcagcccttcctcct

SEQ ID NO: 6684329 - DNA, 14 bp, Homo sapiens
caaagtgcatgtca

SEQ ID NO: 6684330 - DNA, 21 bp, Homo sapiens
caaagtgcatgtcacatgcca

SEQ ID NO: 6684331 - DNA, 14 bp, Homo sapiens
caaagtgcctggga

SEQ ID NO: 6684332 - DNA, 15 bp, Homo sapiens
caaagtgcctgggct

SEQ ID NO: 6684333 - DNA, 18 bp, Homo sapiens
caaagtgcctgggctcag

SEQ ID NO: 6684334 - DNA, 22 bp, Homo sapiens
caaagtgcctgggctcagcctg

SEQ ID NO: 6684335 - DNA, 19 bp, Homo sapiens
caaagtgctagccactgga

SEQ ID NO: 6684336 - DNA, 19 bp, Homo sapiens
caaagtgctgagattacag

SEQ ID NO: 6684337 - DNA, 20 bp, Homo sapiens
caaagtgctgggattaaggc

SEQ ID NO: 6684338 - DNA, 19 bp, Homo sapiens
caaagtgctgggattacaa

SEQ ID NO: 6684339 - DNA, 23 bp, Homo sapiens
caaagtgctgggattacaagcgt

SEQ ID NO: 6684340 - DNA, 23 bp, Homo sapiens
caaagtgctgggattacaggtgt

SEQ ID NO: 6684341 - DNA, 21 bp, Homo sapiens
caaagtggaaaggatcacaga

SEQ ID NO: 6684342 - DNA, 14 bp, Homo sapiens
caaagtggcaggga

SEQ ID NO: 6684343 - DNA, 15 bp, Homo sapiens
caaagtggggaggga

SEQ ID NO: 6684344 - DNA, 20 bp, Homo sapiens
caaagtggggagggacaagg

SEQ ID NO: 6684345 - DNA, 23 bp, Homo sapiens
caaagtggggggtggacacagaa

SEQ ID NO: 6684346 - DNA, 23 bp, Homo sapiens
caaagtgggtactttctgaaaat

SEQ ID NO: 6684347 - DNA, 17 bp, Homo sapiens
caaagtggtaaatactg

SEQ ID NO: 6684348 - DNA, 18 bp, Homo sapiens
caaagtggtaaatactgt

SEQ ID NO: 6684349 - DNA, 19 bp, Homo sapiens
caaagtggtaaatactgtg

SEQ ID NO: 6684350 - DNA, 18 bp, Homo sapiens
caaagtggtatagaaatg

SEQ ID NO: 6684351 - DNA, 19 bp, Homo sapiens
caaagtgtaagcacttctg

SEQ ID NO: 6684352 - DNA, 20 bp, Homo sapiens
caaagtgtacaattttcatc

SEQ ID NO: 6684353 - DNA, 13 bp, Homo sapiens
caaagtgtatatt

SEQ ID NO: 6684354 - DNA, 19 bp, Homo sapiens
caaagtgtattttataaaa

SEQ ID NO: 6684355 - DNA, 20 bp, Homo sapiens
caaagtgtctacatgtgcca

SEQ ID NO: 6684356 - DNA, 20 bp, Homo sapiens
caaagtgtgtaattatgtaa

SEQ ID NO: 6684357 - DNA, 23 bp, Homo sapiens
caaagtgtgtaattatgtaaata

SEQ ID NO: 6684358 - DNA, 13 bp, Homo sapiens
caaagtgtgtatt

SEQ ID NO: 6684359 - DNA, 11 bp, Homo sapiens
caaagtgttaa

SEQ ID NO: 6684360 - DNA, 18 bp, Homo sapiens
caaagtgttgctgtggct

SEQ ID NO: 6684361 - DNA, 21 bp, Homo sapiens
caaagtgttgctgtggctcca

SEQ ID NO: 6684362 - DNA, 17 bp, Homo sapiens
caaagtgttgtcttatt

SEQ ID NO: 6684363 - DNA, 17 bp, Homo sapiens
caaagtgttttgtacca

SEQ ID NO: 6684364 - DNA, 15 bp, Homo sapiens
caaagttaaaagtaa

SEQ ID NO: 6684365 - DNA, 18 bp, Homo sapiens
caaagttaaaagtaaaat

SEQ ID NO: 6684366 - DNA, 17 bp, Homo sapiens
caaagttaaaattgtta

SEQ ID NO: 6684367 - DNA, 15 bp, Homo sapiens
caaagttaacagatt

SEQ ID NO: 6684368 - DNA, 20 bp, Homo sapiens
caaagttaacctacctgtaa

SEQ ID NO: 6684369 - DNA, 19 bp, Homo sapiens
caaagttaatgggatggtc

SEQ ID NO: 6684370 - DNA, 21 bp, Homo sapiens
caaagttactaggtaacttca

SEQ ID NO: 6684371 - DNA, 16 bp, Homo sapiens
caaagttactggctct

SEQ ID NO: 6684372 - DNA, 17 bp, Homo sapiens
caaagttagttcagtag

SEQ ID NO: 6684373 - DNA, 13 bp, Homo sapiens
caaagttatattt

SEQ ID NO: 6684374 - DNA, 17 bp, Homo sapiens
caaagttatcttaaata

SEQ ID NO: 6684375 - DNA, 20 bp, Homo sapiens
caaagttatcttaaatatga

SEQ ID NO: 6684376 - DNA, 21 bp, Homo sapiens
caaagttccacttccaggtct

SEQ ID NO: 6684377 - DNA, 23 bp, Homo sapiens
caaagttctaataatttctaatg

SEQ ID NO: 6684378 - DNA, 16 bp, Homo sapiens
caaagttctcagagct

SEQ ID NO: 6684379 - DNA, 11 bp, Homo sapiens
caaagttctta

SEQ ID NO: 6684380 - DNA, 23 bp, Homo sapiens
caaagttgattaagaaaggaagt

SEQ ID NO: 6684381 - DNA, 22 bp, Homo sapiens
caaagttgccacagatgatact

SEQ ID NO: 6684382 - DNA, 17 bp, Homo sapiens
caaagttggggcaggct

SEQ ID NO: 6684383 - DNA, 15 bp, Homo sapiens
caaagttgttgtaac

SEQ ID NO: 6684384 - DNA, 16 bp, Homo sapiens
caaagttgtttaacta

SEQ ID NO: 6684385 - DNA, 15 bp, Homo sapiens
caaagtttaacacaa

SEQ ID NO: 6684386 - DNA, 13 bp, Homo sapiens
caaagtttaataa

SEQ ID NO: 6684387 - DNA, 20 bp, Homo sapiens
caaagtttaataaatttatt

SEQ ID NO: 6684388 - DNA, 23 bp, Homo sapiens
caaagtttacagatgtttttaat

SEQ ID NO: 6684389 - DNA, 19 bp, Homo sapiens
caaagtttaccagaaagca

SEQ ID NO: 6684390 - DNA, 13 bp, Homo sapiens
caaagtttcagaa

SEQ ID NO: 6684391 - DNA, 18 bp, Homo sapiens
caaagtttcagagtatat

SEQ ID NO: 6684392 - DNA, 22 bp, Homo sapiens
caaagtttcctaatcagaaatt

SEQ ID NO: 6684393 - DNA, 15 bp, Homo sapiens
caaagtttctgttga

SEQ ID NO: 6684394 - DNA, 16 bp, Homo sapiens
caaagtttgacaggaa

SEQ ID NO: 6684395 - DNA, 17 bp, Homo sapiens
caaagtttgctgaaaga

SEQ ID NO: 6684396 - DNA, 17 bp, Homo sapiens
caaagtttgtggtaatt

SEQ ID NO: 6684397 - DNA, 14 bp, Homo sapiens
caaagttttcaaac

SEQ ID NO: 6684398 - DNA, 18 bp, Homo sapiens
caaagttttcaaactgct

SEQ ID NO: 6684399 - DNA, 13 bp, Homo sapiens
caaagttttcaga

SEQ ID NO: 6684400 - DNA, 14 bp, Homo sapiens
caaagttttcagat

SEQ ID NO: 6684401 - DNA, 20 bp, Homo sapiens
caaagttttcagattgtaaa

SEQ ID NO: 6684402 - DNA, 12 bp, Homo sapiens
caaagttttcct

SEQ ID NO: 6684403 - DNA, 14 bp, Homo sapiens
caaagttttccttt

SEQ ID NO: 6684404 - DNA, 17 bp, Homo sapiens
caaagttttcctttgta

SEQ ID NO: 6684405 - DNA, 14 bp, Homo sapiens
caaagttttgaaaa

SEQ ID NO: 6684406 - DNA, 16 bp, Homo sapiens
caaagtttttacagtg

SEQ ID NO: 6684407 - DNA, 19 bp, Homo sapiens
caaagtttttacagtgtat

SEQ ID NO: 6684408 - DNA, 16 bp, Homo sapiens
caaataaaaaacagaa

SEQ ID NO: 6684409 - DNA, 20 bp, Homo sapiens
caaataaaaaacagaaaccg

SEQ ID NO: 6684410 - DNA, 17 bp, Homo sapiens
caaataaaaactaaatt

SEQ ID NO: 6684411 - DNA, 17 bp, Homo sapiens
caaataaaaagtgcttt

SEQ ID NO: 6684412 - DNA, 18 bp, Homo sapiens
caaataaaaagtgctttt

SEQ ID NO: 6684413 - DNA, 15 bp, Homo sapiens
caaataaaaatattg

SEQ ID NO: 6684414 - DNA, 16 bp, Homo sapiens
caaataaaacctcagg

SEQ ID NO: 6684415 - DNA, 12 bp, Homo sapiens
caaataaaatga

SEQ ID NO: 6684416 - DNA, 15 bp, Homo sapiens
caaataaaatgttta

SEQ ID NO: 6684417 - DNA, 16 bp, Homo sapiens
caaataaaatgtttac

SEQ ID NO: 6684418 - DNA, 14 bp, Homo sapiens
caaataaaattggc

SEQ ID NO: 6684419 - DNA, 12 bp, Homo sapiens
caaataaacact

SEQ ID NO: 6684420 - DNA, 14 bp, Homo sapiens
caaataaacactgt

SEQ ID NO: 6684421 - DNA, 12 bp, Homo sapiens
caaataaacagc

SEQ ID NO: 6684422 - DNA, 17 bp, Homo sapiens
caaataaacagctattt

SEQ ID NO: 6684423 - DNA, 19 bp, Homo sapiens
caaataaacagttgttact

SEQ ID NO: 6684424 - DNA, 15 bp, Homo sapiens
caaataaacctgagg

SEQ ID NO: 6684425 - DNA, 17 bp, Homo sapiens
caaataaacctgaggca

SEQ ID NO: 6684426 - DNA, 19 bp, Homo sapiens
caaataaacctgaggcagg

SEQ ID NO: 6684427 - DNA, 18 bp, Homo sapiens
caaataaaccttgtttct

SEQ ID NO: 6684428 - DNA, 18 bp, Homo sapiens
caaataaactctaaacat

SEQ ID NO: 6684429 - DNA, 23 bp, Homo sapiens
caaataaagagagaacaggacta

SEQ ID NO: 6684430 - DNA, 14 bp, Homo sapiens
caaataaagcctgc

SEQ ID NO: 6684431 - DNA, 13 bp, Homo sapiens
caaataaagcctt

SEQ ID NO: 6684432 - DNA, 14 bp, Homo sapiens
caaataaagtctct

SEQ ID NO: 6684433 - DNA, 15 bp, Homo sapiens
caaataaagtctctt

SEQ ID NO: 6684434 - DNA, 18 bp, Homo sapiens
caaataaagttaaaagta

SEQ ID NO: 6684435 - DNA, 16 bp, Homo sapiens
caaataaataaataat

SEQ ID NO: 6684436 - DNA, 18 bp, Homo sapiens
caaataaatagttgctct

SEQ ID NO: 6684437 - DNA, 15 bp, Homo sapiens
caaataaatatgaaa

SEQ ID NO: 6684438 - DNA, 20 bp, Homo sapiens
caaataaatgattatattca

SEQ ID NO: 6684439 - DNA, 23 bp, Homo sapiens
caaataaatgattatattcacag

SEQ ID NO: 6684440 - DNA, 18 bp, Homo sapiens
caaataaatgtgtaaatg

SEQ ID NO: 6684441 - DNA, 22 bp, Homo sapiens
caaataaatgtttcccccactc

SEQ ID NO: 6684442 - DNA, 15 bp, Homo sapiens
caaataaattggaat

SEQ ID NO: 6684443 - DNA, 21 bp, Homo sapiens
caaataaattggaatttaaaa

SEQ ID NO: 6684444 - DNA, 14 bp, Homo sapiens
caaataacaacttt

SEQ ID NO: 6684445 - DNA, 14 bp, Homo sapiens
caaataacagcttt

SEQ ID NO: 6684446 - DNA, 19 bp, Homo sapiens
caaataacagctttcttat

SEQ ID NO: 6684447 - DNA, 11 bp, Homo sapiens
caaataacagt

SEQ ID NO: 6684448 - DNA, 21 bp, Homo sapiens
caaataactaaggaatatata

SEQ ID NO: 6684449 - DNA, 13 bp, Homo sapiens
caaataactgcag

SEQ ID NO: 6684450 - DNA, 18 bp, Homo sapiens
caaataactgcagaaaaa

SEQ ID NO: 6684451 - DNA, 22 bp, Homo sapiens
caaataacttacaagactgtaa

SEQ ID NO: 6684452 - DNA, 16 bp, Homo sapiens
caaataacttcagtcc

SEQ ID NO: 6684453 - DNA, 18 bp, Homo sapiens
caaataagcatctgtgta

SEQ ID NO: 6684454 - DNA, 18 bp, Homo sapiens
caaataaggacagcagct

SEQ ID NO: 6684455 - DNA, 18 bp, Homo sapiens
caaataagggaataaaat

SEQ ID NO: 6684456 - DNA, 22 bp, Homo sapiens
caaataagtaatatctttcagt

SEQ ID NO: 6684457 - DNA, 22 bp, Homo sapiens
caaataagtgcatttattgcct

SEQ ID NO: 6684458 - DNA, 16 bp, Homo sapiens
caaataagtttttgct

SEQ ID NO: 6684459 - DNA, 17 bp, Homo sapiens
caaataataaagcaatc

SEQ ID NO: 6684460 - DNA, 22 bp, Homo sapiens
caaataataaagtagcaaaaca

SEQ ID NO: 6684461 - DNA, 18 bp, Homo sapiens
caaataataccttagaag

SEQ ID NO: 6684462 - DNA, 15 bp, Homo sapiens
caaataatattcatg

SEQ ID NO: 6684463 - DNA, 13 bp, Homo sapiens
caaataatattgc

SEQ ID NO: 6684464 - DNA, 14 bp, Homo sapiens
caaataatattgcc

SEQ ID NO: 6684465 - DNA, 15 bp, Homo sapiens
caaataatattgcct

SEQ ID NO: 6684466 - DNA, 21 bp, Homo sapiens
caaataatccattccaaaata

SEQ ID NO: 6684467 - DNA, 23 bp, Homo sapiens
caaataatccattccaaaataca

SEQ ID NO: 6684468 - DNA, 22 bp, Homo sapiens
caaataatgatcgaaaaaataa

SEQ ID NO: 6684469 - DNA, 17 bp, Homo sapiens
caaataatgcttttcta

SEQ ID NO: 6684470 - DNA, 20 bp, Homo sapiens
caaataatgcttttctaatt

SEQ ID NO: 6684471 - DNA, 17 bp, Homo sapiens
caaataatggaaaaata

SEQ ID NO: 6684472 - DNA, 19 bp, Homo sapiens
caaataatggaaaaatagt

SEQ ID NO: 6684473 - DNA, 13 bp, Homo sapiens
caaataatgtctc

SEQ ID NO: 6684474 - DNA, 20 bp, Homo sapiens
caaataatgtctctgtgaga

SEQ ID NO: 6684475 - DNA, 14 bp, Homo sapiens
caaataattatcac

SEQ ID NO: 6684476 - DNA, 14 bp, Homo sapiens
caaataatttagaa

SEQ ID NO: 6684477 - DNA, 17 bp, Homo sapiens
caaataatttagaaata

SEQ ID NO: 6684478 - DNA, 14 bp, Homo sapiens
caaataatttcata

SEQ ID NO: 6684479 - DNA, 16 bp, Homo sapiens
caaataatttgaactt

SEQ ID NO: 6684480 - DNA, 17 bp, Homo sapiens
caaataatttgaacttt

SEQ ID NO: 6684481 - DNA, 18 bp, Homo sapiens
caaataatttgaactttg

SEQ ID NO: 6684482 - DNA, 23 bp, Homo sapiens
caaataatttgaactttggaaca

SEQ ID NO: 6684483 - DNA, 11 bp, Homo sapiens
caaataatttt

SEQ ID NO: 6684484 - DNA, 13 bp, Homo sapiens
caaatacaaaatg

SEQ ID NO: 6684485 - DNA, 17 bp, Homo sapiens
caaatacaaagtaaata

SEQ ID NO: 6684486 - DNA, 22 bp, Homo sapiens
caaatacaaagtaaatacaaga

SEQ ID NO: 6684487 - DNA, 19 bp, Homo sapiens
caaatacaaagtggaaact

SEQ ID NO: 6684488 - DNA, 14 bp, Homo sapiens
caaatacaatcagc

SEQ ID NO: 6684489 - DNA, 12 bp, Homo sapiens
caaatacacata

SEQ ID NO: 6684490 - DNA, 14 bp, Homo sapiens
caaatacacatttg

SEQ ID NO: 6684491 - DNA, 16 bp, Homo sapiens
caaatacacatttgct

SEQ ID NO: 6684492 - DNA, 22 bp, Homo sapiens
caaatacagtagtataatgtat

SEQ ID NO: 6684493 - DNA, 18 bp, Homo sapiens
caaatacatgcacagtca

SEQ ID NO: 6684494 - DNA, 14 bp, Homo sapiens
caaatacatgtgta

SEQ ID NO: 6684495 - DNA, 22 bp, Homo sapiens
caaatacatgtgtatattcctt

SEQ ID NO: 6684496 - DNA, 19 bp, Homo sapiens
caaatacattcataaggaa

SEQ ID NO: 6684497 - DNA, 13 bp, Homo sapiens
caaataccaaagc

SEQ ID NO: 6684498 - DNA, 13 bp, Homo sapiens
caaatacctcaat

SEQ ID NO: 6684499 - DNA, 19 bp, Homo sapiens
caaatacctccattaaatg

SEQ ID NO: 6684500 - DNA, 18 bp, Homo sapiens
caaataccttagctccct

SEQ ID NO: 6684501 - DNA, 20 bp, Homo sapiens
caaatacgtgggcattcaaa

SEQ ID NO: 6684502 - DNA, 17 bp, Homo sapiens
caaatactatccaaata

SEQ ID NO: 6684503 - DNA, 19 bp, Homo sapiens
caaatactatccaaataaa

SEQ ID NO: 6684504 - DNA, 22 bp, Homo sapiens
caaatactgcttagcattttgc

SEQ ID NO: 6684505 - DNA, 15 bp, Homo sapiens
caaatacttagcaaa

SEQ ID NO: 6684506 - DNA, 16 bp, Homo sapiens
caaatagaagcttctt

SEQ ID NO: 6684507 - DNA, 21 bp, Homo sapiens
caaatagaagcttcttgctcc

SEQ ID NO: 6684508 - DNA, 11 bp, Homo sapiens
caaatagattt

SEQ ID NO: 6684509 - DNA, 13 bp, Homo sapiens
caaatagattttt

SEQ ID NO: 6684510 - DNA, 22 bp, Homo sapiens
caaatagatttttgattcagct

SEQ ID NO: 6684511 - DNA, 13 bp, Homo sapiens
caaatagcaaaga

SEQ ID NO: 6684512 - DNA, 22 bp, Homo sapiens
caaatagcaaatgaaaaagtca

SEQ ID NO: 6684513 - DNA, 15 bp, Homo sapiens
caaatagcacttgac

SEQ ID NO: 6684514 - DNA, 18 bp, Homo sapiens
caaatagccacaattata

SEQ ID NO: 6684515 - DNA, 15 bp, Homo sapiens
caaatagccccagac

SEQ ID NO: 6684516 - DNA, 22 bp, Homo sapiens
caaatagccccagactgggccc

SEQ ID NO: 6684517 - DNA, 21 bp, Homo sapiens
caaatagcgatgtgcaggaag

SEQ ID NO: 6684518 - DNA, 17 bp, Homo sapiens
caaatagcttttcactt

SEQ ID NO: 6684519 - DNA, 21 bp, Homo sapiens
caaataggatgtactgttgaa

SEQ ID NO: 6684520 - DNA, 15 bp, Homo sapiens
caaataggcagaatg

SEQ ID NO: 6684521 - DNA, 20 bp, Homo sapiens
caaataggctattaaaaaag

SEQ ID NO: 6684522 - DNA, 12 bp, Homo sapiens
caaataggtaga

SEQ ID NO: 6684523 - DNA, 20 bp, Homo sapiens
caaataggtagagtcattca

SEQ ID NO: 6684524 - DNA, 14 bp, Homo sapiens
caaataggtcatca

SEQ ID NO: 6684525 - DNA, 16 bp, Homo sapiens
caaatagtagacattt

SEQ ID NO: 6684526 - DNA, 18 bp, Homo sapiens
caaatagtagacatttgt

SEQ ID NO: 6684527 - DNA, 16 bp, Homo sapiens
caaatagtatagaaaa

SEQ ID NO: 6684528 - DNA, 17 bp, Homo sapiens
caaatagtatagaaaat

SEQ ID NO: 6684529 - DNA, 20 bp, Homo sapiens
caaatagtttataaatgtga

SEQ ID NO: 6684530 - DNA, 17 bp, Homo sapiens
caaatataaaacttaca

SEQ ID NO: 6684531 - DNA, 17 bp, Homo sapiens
caaatataaacagcaac

SEQ ID NO: 6684532 - DNA, 13 bp, Homo sapiens
caaatataaacat

SEQ ID NO: 6684533 - DNA, 16 bp, Homo sapiens
caaatataacaagtat

SEQ ID NO: 6684534 - DNA, 12 bp, Homo sapiens
caaatataacat

SEQ ID NO: 6684535 - DNA, 14 bp, Homo sapiens
caaatataagaata

SEQ ID NO: 6684536 - DNA, 15 bp, Homo sapiens
caaatataagacatt

SEQ ID NO: 6684537 - DNA, 19 bp, Homo sapiens
caaatataagacatttgtt

SEQ ID NO: 6684538 - DNA, 15 bp, Homo sapiens
caaatataagatttt

SEQ ID NO: 6684539 - DNA, 18 bp, Homo sapiens
caaatataagattttctg

SEQ ID NO: 6684540 - DNA, 21 bp, Homo sapiens
caaatatacattttctaaata

SEQ ID NO: 6684541 - DNA, 19 bp, Homo sapiens
caaatatactcatttggat

SEQ ID NO: 6684542 - DNA, 17 bp, Homo sapiens
caaatatactttacttt

SEQ ID NO: 6684543 - DNA, 16 bp, Homo sapiens
caaatatagaaagttg

SEQ ID NO: 6684544 - DNA, 23 bp, Homo sapiens
caaatatagaaagttgatattca

SEQ ID NO: 6684545 - DNA, 15 bp, Homo sapiens
caaatatatgcctta

SEQ ID NO: 6684546 - DNA, 13 bp, Homo sapiens
caaatatattgtt

SEQ ID NO: 6684547 - DNA, 15 bp, Homo sapiens
caaatatatttaact

SEQ ID NO: 6684548 - DNA, 21 bp, Homo sapiens
caaatatatttaactatttag

SEQ ID NO: 6684549 - DNA, 19 bp, Homo sapiens
caaatatatttaattgtgt

SEQ ID NO: 6684550 - DNA, 14 bp, Homo sapiens
caaatatcaaaagg

SEQ ID NO: 6684551 - DNA, 17 bp, Homo sapiens
caaatatcaaaaggaag

SEQ ID NO: 6684552 - DNA, 15 bp, Homo sapiens
caaatatcatataaa

SEQ ID NO: 6684553 - DNA, 20 bp, Homo sapiens
caaatatctaaataatggcc

SEQ ID NO: 6684554 - DNA, 15 bp, Homo sapiens
caaatatctcagagg

SEQ ID NO: 6684555 - DNA, 16 bp, Homo sapiens
caaatatctctattta

SEQ ID NO: 6684556 - DNA, 21 bp, Homo sapiens
caaatatcttgtgttgtcctt

SEQ ID NO: 6684557 - DNA, 23 bp, Homo sapiens
caaatatgagtacaaatgcctta

SEQ ID NO: 6684558 - DNA, 21 bp, Homo sapiens
caaatatgcaaagcactgact

SEQ ID NO: 6684559 - DNA, 21 bp, Homo sapiens
caaatatgcactttccctaga

SEQ ID NO: 6684560 - DNA, 13 bp, Homo sapiens
caaatatgctttg

SEQ ID NO: 6684561 - DNA, 18 bp, Homo sapiens
caaatatgtaaactttaa

SEQ ID NO: 6684562 - DNA, 18 bp, Homo sapiens
caaatatgtattttccta

SEQ ID NO: 6684563 - DNA, 13 bp, Homo sapiens
caaatatgtcaag

SEQ ID NO: 6684564 - DNA, 13 bp, Homo sapiens
caaatatgttaaa

SEQ ID NO: 6684565 - DNA, 16 bp, Homo sapiens
caaatatgttaaagtt

SEQ ID NO: 6684566 - DNA, 14 bp, Homo sapiens
caaatatgttctct

SEQ ID NO: 6684567 - DNA, 15 bp, Homo sapiens
caaatatgttctctg

SEQ ID NO: 6684568 - DNA, 19 bp, Homo sapiens
caaatattaaaaagtcttt

SEQ ID NO: 6684569 - DNA, 18 bp, Homo sapiens
caaatattaaaattgtta

SEQ ID NO: 6684570 - DNA, 15 bp, Homo sapiens
caaatattaaagatt

SEQ ID NO: 6684571 - DNA, 13 bp, Homo sapiens
caaatattaagaa

SEQ ID NO: 6684572 - DNA, 15 bp, Homo sapiens
caaatattacaacaa

SEQ ID NO: 6684573 - DNA, 15 bp, Homo sapiens
caaatattagatgtg

SEQ ID NO: 6684574 - DNA, 17 bp, Homo sapiens
caaatattagcaaagaa

SEQ ID NO: 6684575 - DNA, 14 bp, Homo sapiens
caaatattattcaa

SEQ ID NO: 6684576 - DNA, 23 bp, Homo sapiens
caaatattgaagttgtttatcaa

SEQ ID NO: 6684577 - DNA, 18 bp, Homo sapiens
caaatattgaatgcctta

SEQ ID NO: 6684578 - DNA, 21 bp, Homo sapiens
caaatattgaatgccttattt

SEQ ID NO: 6684579 - DNA, 22 bp, Homo sapiens
caaatattgaatgccttatttt

SEQ ID NO: 6684580 - DNA, 19 bp, Homo sapiens
caaatattgatctgtatta

SEQ ID NO: 6684581 - DNA, 21 bp, Homo sapiens
caaatattgccaactcttcta

SEQ ID NO: 6684582 - DNA, 23 bp, Homo sapiens
caaatattgctattgtttatagg

SEQ ID NO: 6684583 - DNA, 18 bp, Homo sapiens
caaatattgtaaaacttt

SEQ ID NO: 6684584 - DNA, 15 bp, Homo sapiens
caaatattgtcatct

SEQ ID NO: 6684585 - DNA, 17 bp, Homo sapiens
caaatattgtgcacatt

SEQ ID NO: 6684586 - DNA, 23 bp, Homo sapiens
caaatattgtgcacatttaataa

SEQ ID NO: 6684587 - DNA, 19 bp, Homo sapiens
caaatattgttaccatgaa

SEQ ID NO: 6684588 - DNA, 18 bp, Homo sapiens
caaatattgttgacaact

SEQ ID NO: 6684589 - DNA, 22 bp, Homo sapiens
caaatatttagatgtaattttg

SEQ ID NO: 6684590 - DNA, 23 bp, Homo sapiens
caaatatttagatgtaattttgt

SEQ ID NO: 6684591 - DNA, 14 bp, Homo sapiens
caaatatttatttt

SEQ ID NO: 6684592 - DNA, 15 bp, Homo sapiens
caaatatttattttc

SEQ ID NO: 6684593 - DNA, 20 bp, Homo sapiens
caaatatttattttctttct

SEQ ID NO: 6684594 - DNA, 14 bp, Homo sapiens
caaatatttcactt

SEQ ID NO: 6684595 - DNA, 12 bp, Homo sapiens
caaatattttca

SEQ ID NO: 6684596 - DNA, 14 bp, Homo sapiens
caaatattttcaag

SEQ ID NO: 6684597 - DNA, 14 bp, Homo sapiens
caaatattttcatg

SEQ ID NO: 6684598 - DNA, 15 bp, Homo sapiens
caaatattttcatgt

SEQ ID NO: 6684599 - DNA, 17 bp, Homo sapiens
caaatattttctttatt

SEQ ID NO: 6684600 - DNA, 15 bp, Homo sapiens
caaatattttgtcac

SEQ ID NO: 6684601 - DNA, 19 bp, Homo sapiens
caaatattttgtcactgct

SEQ ID NO: 6684602 - DNA, 22 bp, Homo sapiens
caaatattttgtcactgctgta

SEQ ID NO: 6684603 - DNA, 17 bp, Homo sapiens
caaatcaaaaacaggca

SEQ ID NO: 6684604 - DNA, 18 bp, Homo sapiens
caaatcaaaataaaagaa

SEQ ID NO: 6684605 - DNA, 13 bp, Homo sapiens
caaatcaaacaca

SEQ ID NO: 6684606 - DNA, 16 bp, Homo sapiens
caaatcaaacacaaca

SEQ ID NO: 6684607 - DNA, 16 bp, Homo sapiens
caaatcaaattgctta

SEQ ID NO: 6684608 - DNA, 17 bp, Homo sapiens
caaatcaacagaagcat

SEQ ID NO: 6684609 - DNA, 15 bp, Homo sapiens
caaatcaaccccaga

SEQ ID NO: 6684610 - DNA, 16 bp, Homo sapiens
caaatcaaccccagac

SEQ ID NO: 6684611 - DNA, 17 bp, Homo sapiens
caaatcaacttttatgc

SEQ ID NO: 6684612 - DNA, 13 bp, Homo sapiens
caaatcaaggata

SEQ ID NO: 6684613 - DNA, 17 bp, Homo sapiens
caaatcaataagaaggt

SEQ ID NO: 6684614 - DNA, 17 bp, Homo sapiens
caaatcaatacactagt

SEQ ID NO: 6684615 - DNA, 16 bp, Homo sapiens
caaatcaattactggt

SEQ ID NO: 6684616 - DNA, 17 bp, Homo sapiens
caaatcacacctctggg

SEQ ID NO: 6684617 - DNA, 18 bp, Homo sapiens
caaatcacatctcacctc

SEQ ID NO: 6684618 - DNA, 22 bp, Homo sapiens
caaatcactgtggggaaacaat

SEQ ID NO: 6684619 - DNA, 14 bp, Homo sapiens
caaatcagaagtca

SEQ ID NO: 6684620 - DNA, 15 bp, Homo sapiens
caaatcagaagtcat

SEQ ID NO: 6684621 - DNA, 13 bp, Homo sapiens
caaatcagacaca

SEQ ID NO: 6684622 - DNA, 14 bp, Homo sapiens
caaatcagacacaa

SEQ ID NO: 6684623 - DNA, 22 bp, Homo sapiens
caaatcagacacaattagagaa

SEQ ID NO: 6684624 - DNA, 13 bp, Homo sapiens
caaatcagccatg

SEQ ID NO: 6684625 - DNA, 13 bp, Homo sapiens
caaatcagctgct

SEQ ID NO: 6684626 - DNA, 16 bp, Homo sapiens
caaatcagctgctact

SEQ ID NO: 6684627 - DNA, 17 bp, Homo sapiens
caaatcagctgctacta

SEQ ID NO: 6684628 - DNA, 16 bp, Homo sapiens
caaatcaggcttttgt

SEQ ID NO: 6684629 - DNA, 17 bp, Homo sapiens
caaatcagtctcacaat

SEQ ID NO: 6684630 - DNA, 23 bp, Homo sapiens
caaatcagtcttccttgtggaat

SEQ ID NO: 6684631 - DNA, 17 bp, Homo sapiens
caaatcagtgataattg

SEQ ID NO: 6684632 - DNA, 22 bp, Homo sapiens
caaatcagttactaagaagaaa

SEQ ID NO: 6684633 - DNA, 13 bp, Homo sapiens
caaatcatagctg

SEQ ID NO: 6684634 - DNA, 20 bp, Homo sapiens
caaatcatgttttttctgca

SEQ ID NO: 6684635 - DNA, 15 bp, Homo sapiens
caaatcattccttag

SEQ ID NO: 6684636 - DNA, 14 bp, Homo sapiens
caaatcatttgttt

SEQ ID NO: 6684637 - DNA, 19 bp, Homo sapiens
caaatccaaggaaacatgc

SEQ ID NO: 6684638 - DNA, 23 bp, Homo sapiens
caaatccataagcaggttatttt

SEQ ID NO: 6684639 - DNA, 17 bp, Homo sapiens
caaatccataccccctg

SEQ ID NO: 6684640 - DNA, 18 bp, Homo sapiens
caaatccataccccctgc

SEQ ID NO: 6684641 - DNA, 21 bp, Homo sapiens
caaatccatcctgctcttcca

SEQ ID NO: 6684642 - DNA, 14 bp, Homo sapiens
caaatccatgtgtc

SEQ ID NO: 6684643 - DNA, 15 bp, Homo sapiens
caaatcccaaaccat

SEQ ID NO: 6684644 - DNA, 20 bp, Homo sapiens
caaatcccaaaccattactg

SEQ ID NO: 6684645 - DNA, 18 bp, Homo sapiens
caaatcccagggaaggac

SEQ ID NO: 6684646 - DNA, 15 bp, Homo sapiens
caaatcccatttctt

SEQ ID NO: 6684647 - DNA, 18 bp, Homo sapiens
caaatccccaagaacaca

SEQ ID NO: 6684648 - DNA, 19 bp, Homo sapiens
caaatcccctccctgtgac

SEQ ID NO: 6684649 - DNA, 17 bp, Homo sapiens
caaatcccgcagcctcg

SEQ ID NO: 6684650 - DNA, 17 bp, Homo sapiens
caaatccctatgttgct

SEQ ID NO: 6684651 - DNA, 21 bp, Homo sapiens
caaatccgaacctcctctgtg

SEQ ID NO: 6684652 - DNA, 16 bp, Homo sapiens
caaatccgccagtgtt

SEQ ID NO: 6684653 - DNA, 17 bp, Homo sapiens
caaatccgccagtgttt

SEQ ID NO: 6684654 - DNA, 17 bp, Homo sapiens
caaatccgctctcttcc

SEQ ID NO: 6684655 - DNA, 22 bp, Homo sapiens
caaatccgctctcttcctgccc

SEQ ID NO: 6684656 - DNA, 19 bp, Homo sapiens
caaatcctagactgctcct

SEQ ID NO: 6684657 - DNA, 22 bp, Homo sapiens
caaatcctagactgctcctggg

SEQ ID NO: 6684658 - DNA, 18 bp, Homo sapiens
caaatcctaggctcctgg

SEQ ID NO: 6684659 - DNA, 23 bp, Homo sapiens
caaatcctatgtgattttaactc

SEQ ID NO: 6684660 - DNA, 18 bp, Homo sapiens
caaatcctatttaaagac

SEQ ID NO: 6684661 - DNA, 15 bp, Homo sapiens
caaatcctctgtttt

SEQ ID NO: 6684662 - DNA, 17 bp, Homo sapiens
caaatcctctgttttct

SEQ ID NO: 6684663 - DNA, 22 bp, Homo sapiens
caaatcctggaaggacacagtg

SEQ ID NO: 6684664 - DNA, 17 bp, Homo sapiens
caaatccttagatctgg

SEQ ID NO: 6684665 - DNA, 14 bp, Homo sapiens
caaatccttcaaaa

SEQ ID NO: 6684666 - DNA, 19 bp, Homo sapiens
caaatccttccaaaaatta

SEQ ID NO: 6684667 - DNA, 20 bp, Homo sapiens
caaatccttccaaaaattat

SEQ ID NO: 6684668 - DNA, 20 bp, Homo sapiens
caaatccttgtgggaaaaga

SEQ ID NO: 6684669 - DNA, 16 bp, Homo sapiens
caaatcctttctgccc

SEQ ID NO: 6684670 - DNA, 14 bp, Homo sapiens
caaatcgaatgaaa

SEQ ID NO: 6684671 - DNA, 15 bp, Homo sapiens
caaatcgatggcctg

SEQ ID NO: 6684672 - DNA, 21 bp, Homo sapiens
caaatcgtccagcgaccttcc

SEQ ID NO: 6684673 - DNA, 18 bp, Homo sapiens
caaatctaaaatttaaaa

SEQ ID NO: 6684674 - DNA, 19 bp, Homo sapiens
caaatctaaaatttaaaat

SEQ ID NO: 6684675 - DNA, 20 bp, Homo sapiens
caaatctaaaatttaaaatt

SEQ ID NO: 6684676 - DNA, 23 bp, Homo sapiens
caaatctaagggaaaaagccttg

SEQ ID NO: 6684677 - DNA, 15 bp, Homo sapiens
caaatctaatctctt

SEQ ID NO: 6684678 - DNA, 22 bp, Homo sapiens
caaatctaatctcttattctaa

SEQ ID NO: 6684679 - DNA, 14 bp, Homo sapiens
caaatctaccactg

SEQ ID NO: 6684680 - DNA, 14 bp, Homo sapiens
caaatctagaattt

SEQ ID NO: 6684681 - DNA, 20 bp, Homo sapiens
caaatctaggaaaatatttt

SEQ ID NO: 6684682 - DNA, 21 bp, Homo sapiens
caaatctatattaaagtgtta

SEQ ID NO: 6684683 - DNA, 14 bp, Homo sapiens
caaatctattactt

SEQ ID NO: 6684684 - DNA, 15 bp, Homo sapiens
caaatctattacttt

SEQ ID NO: 6684685 - DNA, 16 bp, Homo sapiens
caaatctattcagaca

SEQ ID NO: 6684686 - DNA, 20 bp, Homo sapiens
caaatctattcagacaagca

SEQ ID NO: 6684687 - DNA, 22 bp, Homo sapiens
caaatctcaaaagatctcctgt

SEQ ID NO: 6684688 - DNA, 17 bp, Homo sapiens
caaatctcactgtatta

SEQ ID NO: 6684689 - DNA, 14 bp, Homo sapiens
caaatctcagtggc

SEQ ID NO: 6684690 - DNA, 13 bp, Homo sapiens
caaatctcagttg

SEQ ID NO: 6684691 - DNA, 18 bp, Homo sapiens
caaatctcccacaagtat

SEQ ID NO: 6684692 - DNA, 21 bp, Homo sapiens
caaatctcctctttgtgaaat

SEQ ID NO: 6684693 - DNA, 17 bp, Homo sapiens
caaatctcttgcttgtc

SEQ ID NO: 6684694 - DNA, 19 bp, Homo sapiens
caaatctcttgcttgtcat

SEQ ID NO: 6684695 - DNA, 16 bp, Homo sapiens
caaatctgacatatta

SEQ ID NO: 6684696 - DNA, 12 bp, Homo sapiens
caaatctgactt

SEQ ID NO: 6684697 - DNA, 16 bp, Homo sapiens
caaatctgagccttag

SEQ ID NO: 6684698 - DNA, 14 bp, Homo sapiens
caaatctgatggct

SEQ ID NO: 6684699 - DNA, 20 bp, Homo sapiens
caaatctgcaaagcatgttt

SEQ ID NO: 6684700 - DNA, 20 bp, Homo sapiens
caaatctgccaccgtggggg

SEQ ID NO: 6684701 - DNA, 21 bp, Homo sapiens
caaatctggctcctttacaaa

SEQ ID NO: 6684702 - DNA, 13 bp, Homo sapiens
caaatctgtaatt

SEQ ID NO: 6684703 - DNA, 15 bp, Homo sapiens
caaatctgtataaat

SEQ ID NO: 6684704 - DNA, 20 bp, Homo sapiens
caaatctgtataaatgtgaa

SEQ ID NO: 6684705 - DNA, 15 bp, Homo sapiens
caaatctgtatatgt

SEQ ID NO: 6684706 - DNA, 19 bp, Homo sapiens
caaatctgtatatgttgta

SEQ ID NO: 6684707 - DNA, 23 bp, Homo sapiens
caaatctgtatatgttgtaataa

SEQ ID NO: 6684708 - DNA, 18 bp, Homo sapiens
caaatctgtcagcatctg

SEQ ID NO: 6684709 - DNA, 13 bp, Homo sapiens
caaatctgtcctc

SEQ ID NO: 6684710 - DNA, 17 bp, Homo sapiens
caaatctgtcctctgta

SEQ ID NO: 6684711 - DNA, 20 bp, Homo sapiens
caaatctgtcctctgtagta

SEQ ID NO: 6684712 - DNA, 16 bp, Homo sapiens
caaatctgtgtatatt

SEQ ID NO: 6684713 - DNA, 21 bp, Homo sapiens
caaatcttaacttgaaggagt

SEQ ID NO: 6684714 - DNA, 14 bp, Homo sapiens
caaatcttaagaaa

SEQ ID NO: 6684715 - DNA, 12 bp, Homo sapiens
caaatcttcaag

SEQ ID NO: 6684716 - DNA, 14 bp, Homo sapiens
caaatcttcctctg

SEQ ID NO: 6684717 - DNA, 20 bp, Homo sapiens
caaatcttccttactgtctc

SEQ ID NO: 6684718 - DNA, 12 bp, Homo sapiens
caaatcttgaaa

SEQ ID NO: 6684719 - DNA, 13 bp, Homo sapiens
caaatcttgaaat

SEQ ID NO: 6684720 - DNA, 22 bp, Homo sapiens
caaatcttggcaatattcctta

SEQ ID NO: 6684721 - DNA, 13 bp, Homo sapiens
caaatctttaaga

SEQ ID NO: 6684722 - DNA, 15 bp, Homo sapiens
caaatctttaagaat

SEQ ID NO: 6684723 - DNA, 20 bp, Homo sapiens
caaatctttccatatccata

SEQ ID NO: 6684724 - DNA, 18 bp, Homo sapiens
caaatctttctgtaaaca

SEQ ID NO: 6684725 - DNA, 23 bp, Homo sapiens
caaatctttctgtaaacagaata

SEQ ID NO: 6684726 - DNA, 12 bp, Homo sapiens
caaatgaaactc

SEQ ID NO: 6684727 - DNA, 21 bp, Homo sapiens
caaatgaaactctttcattct

SEQ ID NO: 6684728 - DNA, 13 bp, Homo sapiens
caaatgaaagaga

SEQ ID NO: 6684729 - DNA, 14 bp, Homo sapiens
caaatgaaagagaa

SEQ ID NO: 6684730 - DNA, 17 bp, Homo sapiens
caaatgaaatgccaaag

SEQ ID NO: 6684731 - DNA, 18 bp, Homo sapiens
caaatgaaatgtatgcat

SEQ ID NO: 6684732 - DNA, 13 bp, Homo sapiens
caaatgaactttt

SEQ ID NO: 6684733 - DNA, 21 bp, Homo sapiens
caaatgaacttttacagaatg

SEQ ID NO: 6684734 - DNA, 22 bp, Homo sapiens
caaatgaagaaagtcaaaaaat

SEQ ID NO: 6684735 - DNA, 15 bp, Homo sapiens
caaatgaaggaatgc

SEQ ID NO: 6684736 - DNA, 22 bp, Homo sapiens
caaatgaagtatttcatgtaat

SEQ ID NO: 6684737 - DNA, 18 bp, Homo sapiens
caaatgaataatgccttt

SEQ ID NO: 6684738 - DNA, 14 bp, Homo sapiens
caaatgaatcattg

SEQ ID NO: 6684739 - DNA, 19 bp, Homo sapiens
caaatgaatgaccttgttg

SEQ ID NO: 6684740 - DNA, 14 bp, Homo sapiens
caaatgaatgcctt

SEQ ID NO: 6684741 - DNA, 20 bp, Homo sapiens
caaatgaatttgctaaatac

SEQ ID NO: 6684742 - DNA, 17 bp, Homo sapiens
caaatgaccgagccctg

SEQ ID NO: 6684743 - DNA, 19 bp, Homo sapiens
caaatgaccgagccctgga

SEQ ID NO: 6684744 - DNA, 16 bp, Homo sapiens
caaatgactttattat

SEQ ID NO: 6684745 - DNA, 18 bp, Homo sapiens
caaatgactttattattt

SEQ ID NO: 6684746 - DNA, 21 bp, Homo sapiens
caaatgagatgtatgcccaaa

SEQ ID NO: 6684747 - DNA, 14 bp, Homo sapiens
caaatgagatttct

SEQ ID NO: 6684748 - DNA, 20 bp, Homo sapiens
caaatgagatttctttgaat

SEQ ID NO: 6684749 - DNA, 12 bp, Homo sapiens
caaatgagccat

SEQ ID NO: 6684750 - DNA, 15 bp, Homo sapiens
caaatgaggaaacca

SEQ ID NO: 6684751 - DNA, 23 bp, Homo sapiens
caaatgaggaaaccaagataaat

SEQ ID NO: 6684752 - DNA, 22 bp, Homo sapiens
caaatgagggtcttggttccag

SEQ ID NO: 6684753 - DNA, 19 bp, Homo sapiens
caaatgagtaacatttgct

SEQ ID NO: 6684754 - DNA, 21 bp, Homo sapiens
caaatgagtaacatttgctgt

SEQ ID NO: 6684755 - DNA, 15 bp, Homo sapiens
caaatgagttcagga

SEQ ID NO: 6684756 - DNA, 20 bp, Homo sapiens
caaatgatgtgcctgcttca

SEQ ID NO: 6684757 - DNA, 14 bp, Homo sapiens
caaatgattgcttt

SEQ ID NO: 6684758 - DNA, 22 bp, Homo sapiens
caaatgattgcttttaaaattt

SEQ ID NO: 6684759 - DNA, 21 bp, Homo sapiens
caaatgatttcatattgatct

SEQ ID NO: 6684760 - DNA, 22 bp, Homo sapiens
caaatgattttcatcaatttaa

SEQ ID NO: 6684761 - DNA, 19 bp, Homo sapiens
caaatgcaaaaactctttg

SEQ ID NO: 6684762 - DNA, 15 bp, Homo sapiens
caaatgcaaaaataa

SEQ ID NO: 6684763 - DNA, 16 bp, Homo sapiens
caaatgcacaagctca

SEQ ID NO: 6684764 - DNA, 21 bp, Homo sapiens
caaatgcacacacctcatgct

SEQ ID NO: 6684765 - DNA, 11 bp, Homo sapiens
caaatgcagaa

SEQ ID NO: 6684766 - DNA, 23 bp, Homo sapiens
caaatgcagcttcaggtgagcca

SEQ ID NO: 6684767 - DNA, 20 bp, Homo sapiens
caaatgcagggaggggaggc

SEQ ID NO: 6684768 - DNA, 22 bp, Homo sapiens
caaatgcagggaggggaggcag

SEQ ID NO: 6684769 - DNA, 19 bp, Homo sapiens
caaatgcagggattgctgc

SEQ ID NO: 6684770 - DNA, 22 bp, Homo sapiens
caaatgcagggattgctgccac

SEQ ID NO: 6684771 - DNA, 16 bp, Homo sapiens
caaatgcagtatattt

SEQ ID NO: 6684772 - DNA, 22 bp, Homo sapiens
caaatgcagtgtatttaatgtt

SEQ ID NO: 6684773 - DNA, 19 bp, Homo sapiens
caaatgcatgcttcttctc

SEQ ID NO: 6684774 - DNA, 17 bp, Homo sapiens
caaatgcattcatgttt

SEQ ID NO: 6684775 - DNA, 19 bp, Homo sapiens
caaatgcattcatgtttta

SEQ ID NO: 6684776 - DNA, 14 bp, Homo sapiens
caaatgcattctat

SEQ ID NO: 6684777 - DNA, 15 bp, Homo sapiens
caaatgccactctgg

SEQ ID NO: 6684778 - DNA, 17 bp, Homo sapiens
caaatgccactctgggc

SEQ ID NO: 6684779 - DNA, 14 bp, Homo sapiens
caaatgccagggcc

SEQ ID NO: 6684780 - DNA, 18 bp, Homo sapiens
caaatgcccaaggatgcc

SEQ ID NO: 6684781 - DNA, 14 bp, Homo sapiens
caaatgcctctgcc

SEQ ID NO: 6684782 - DNA, 16 bp, Homo sapiens
caaatgcctctgcctt

SEQ ID NO: 6684783 - DNA, 17 bp, Homo sapiens
caaatgcctctgccttg

SEQ ID NO: 6684784 - DNA, 16 bp, Homo sapiens
caaatgcctgccaaat

SEQ ID NO: 6684785 - DNA, 15 bp, Homo sapiens
caaatgccttgaact

SEQ ID NO: 6684786 - DNA, 23 bp, Homo sapiens
caaatgccttgaactgttgtctg

SEQ ID NO: 6684787 - DNA, 17 bp, Homo sapiens
caaatgcgcgtgtgcac

SEQ ID NO: 6684788 - DNA, 16 bp, Homo sapiens
caaatgctaaatgcaa

SEQ ID NO: 6684789 - DNA, 21 bp, Homo sapiens
caaatgctaatgtcaaacttg

SEQ ID NO: 6684790 - DNA, 16 bp, Homo sapiens
caaatgctcaaagaaa

SEQ ID NO: 6684791 - DNA, 22 bp, Homo sapiens
caaatgctcccacctgaatttg

SEQ ID NO: 6684792 - DNA, 14 bp, Homo sapiens
caaatgctctctct

SEQ ID NO: 6684793 - DNA, 20 bp, Homo sapiens
caaatgctggcaaatccagg

SEQ ID NO: 6684794 - DNA, 15 bp, Homo sapiens
caaatgctggggcag

SEQ ID NO: 6684795 - DNA, 13 bp, Homo sapiens
caaatgcttaaaa

SEQ ID NO: 6684796 - DNA, 12 bp, Homo sapiens
caaatgcttcta

SEQ ID NO: 6684797 - DNA, 18 bp, Homo sapiens
caaatgcttggcttctca

SEQ ID NO: 6684798 - DNA, 13 bp, Homo sapiens
caaatgcttttcc

SEQ ID NO: 6684799 - DNA, 22 bp, Homo sapiens
caaatgcttttccaacccatga

SEQ ID NO: 6684800 - DNA, 16 bp, Homo sapiens
caaatggaaaatgtat

SEQ ID NO: 6684801 - DNA, 20 bp, Homo sapiens
caaatggaaacagaggacca

SEQ ID NO: 6684802 - DNA, 22 bp, Homo sapiens
caaatggaaagtaactcatttg

SEQ ID NO: 6684803 - DNA, 14 bp, Homo sapiens
caaatggaagagaa

SEQ ID NO: 6684804 - DNA, 15 bp, Homo sapiens
caaatggaagagaag

SEQ ID NO: 6684805 - DNA, 20 bp, Homo sapiens
caaatggaagagaagagaaa

SEQ ID NO: 6684806 - DNA, 21 bp, Homo sapiens
caaatggaagagaagagaaag

SEQ ID NO: 6684807 - DNA, 17 bp, Homo sapiens
caaatggagaagctgca

SEQ ID NO: 6684808 - DNA, 14 bp, Homo sapiens
caaatggaggaata

SEQ ID NO: 6684809 - DNA, 21 bp, Homo sapiens
caaatggagttggagttcatt

SEQ ID NO: 6684810 - DNA, 15 bp, Homo sapiens
caaatggcactgcag

SEQ ID NO: 6684811 - DNA, 14 bp, Homo sapiens
caaatggcagtttt

SEQ ID NO: 6684812 - DNA, 21 bp, Homo sapiens
caaatggccagttttctggta

SEQ ID NO: 6684813 - DNA, 20 bp, Homo sapiens
caaatggccattttaaaatg

SEQ ID NO: 6684814 - DNA, 15 bp, Homo sapiens
caaatggctctgtga

SEQ ID NO: 6684815 - DNA, 22 bp, Homo sapiens
caaatggctctgtgaaatcaga

SEQ ID NO: 6684816 - DNA, 18 bp, Homo sapiens
caaatggctgtaaaacta

SEQ ID NO: 6684817 - DNA, 17 bp, Homo sapiens
caaatggcttacttaca

SEQ ID NO: 6684818 - DNA, 23 bp, Homo sapiens
caaatgggaaaaaaacaaacaaa

SEQ ID NO: 6684819 - DNA, 18 bp, Homo sapiens
caaatgggactgatgtca

SEQ ID NO: 6684820 - DNA, 20 bp, Homo sapiens
caaatgggagctgagcagcc

SEQ ID NO: 6684821 - DNA, 21 bp, Homo sapiens
caaatgggcattttacaagaa

SEQ ID NO: 6684822 - DNA, 19 bp, Homo sapiens
caaatggggccagatccag

SEQ ID NO: 6684823 - DNA, 20 bp, Homo sapiens
caaatggggccagatccagc

SEQ ID NO: 6684824 - DNA, 21 bp, Homo sapiens
caaatgggggcggctggaaag

SEQ ID NO: 6684825 - DNA, 22 bp, Homo sapiens
caaatgggggcggctggaaaga

SEQ ID NO: 6684826 - DNA, 24 bp, Homo sapiens
caaatggtacaaaaccacagtgta

SEQ ID NO: 6684827 - DNA, 18 bp, Homo sapiens
caaatggtagctgaaaaa

SEQ ID NO: 6684828 - DNA, 13 bp, Homo sapiens
caaatggtatttt

SEQ ID NO: 6684829 - DNA, 14 bp, Homo sapiens
caaatggtattttt

SEQ ID NO: 6684830 - DNA, 21 bp, Homo sapiens
caaatggtattttttgtgaat

SEQ ID NO: 6684831 - DNA, 21 bp, Homo sapiens
caaatggtggttgtttcttcc

SEQ ID NO: 6684832 - DNA, 14 bp, Homo sapiens
caaatggtgtcatg

SEQ ID NO: 6684833 - DNA, 22 bp, Homo sapiens
caaatggttcttacttttcctg

SEQ ID NO: 6684834 - DNA, 23 bp, Homo sapiens
caaatggtttaacttctgcctgt

SEQ ID NO: 6684835 - DNA, 21 bp, Homo sapiens
caaatggtttttgcaagattt

SEQ ID NO: 6684836 - DNA, 14 bp, Homo sapiens
caaatgtaaaatat

SEQ ID NO: 6684837 - DNA, 19 bp, Homo sapiens
caaatgtaaaatatttata

SEQ ID NO: 6684838 - DNA, 21 bp, Homo sapiens
caaatgtaaatagaggtctgt

SEQ ID NO: 6684839 - DNA, 20 bp, Homo sapiens
caaatgtaaatttactgagc

SEQ ID NO: 6684840 - DNA, 20 bp, Homo sapiens
caaatgtaatagtttatctt

SEQ ID NO: 6684841 - DNA, 21 bp, Homo sapiens
caaatgtaatagtttatctta

SEQ ID NO: 6684842 - DNA, 22 bp, Homo sapiens
caaatgtaatgtggcttctgga

SEQ ID NO: 6684843 - DNA, 13 bp, Homo sapiens
caaatgtacatct

SEQ ID NO: 6684844 - DNA, 17 bp, Homo sapiens
caaatgtagttttgtat

SEQ ID NO: 6684845 - DNA, 18 bp, Homo sapiens
caaatgtatatttaactt

SEQ ID NO: 6684846 - DNA, 15 bp, Homo sapiens
caaatgtatgtatca

SEQ ID NO: 6684847 - DNA, 14 bp, Homo sapiens
caaatgtattttga

SEQ ID NO: 6684848 - DNA, 17 bp, Homo sapiens
caaatgtattttgaaga

SEQ ID NO: 6684849 - DNA, 20 bp, Homo sapiens
caaatgtcacagtaatgcaa

SEQ ID NO: 6684850 - DNA, 14 bp, Homo sapiens
caaatgtcagagct

SEQ ID NO: 6684851 - DNA, 20 bp, Homo sapiens
caaatgtcagatacaatgta

SEQ ID NO: 6684852 - DNA, 20 bp, Homo sapiens
caaatgtcagcttaaaattg

SEQ ID NO: 6684853 - DNA, 17 bp, Homo sapiens
caaatgtcatgctgcct

SEQ ID NO: 6684854 - DNA, 18 bp, Homo sapiens
caaatgtcatgctgcctt

SEQ ID NO: 6684855 - DNA, 16 bp, Homo sapiens
caaatgtcattatgta

SEQ ID NO: 6684856 - DNA, 16 bp, Homo sapiens
caaatgtcattgtcta

SEQ ID NO: 6684857 - DNA, 14 bp, Homo sapiens
caaatgtccaagca

SEQ ID NO: 6684858 - DNA, 14 bp, Homo sapiens
caaatgtcctttct

SEQ ID NO: 6684859 - DNA, 15 bp, Homo sapiens
caaatgtcctttctc

SEQ ID NO: 6684860 - DNA, 17 bp, Homo sapiens
caaatgtcctttctcag

SEQ ID NO: 6684861 - DNA, 18 bp, Homo sapiens
caaatgtcctttctcaga

SEQ ID NO: 6684862 - DNA, 17 bp, Homo sapiens
caaatgtcggggttggg

SEQ ID NO: 6684863 - DNA, 15 bp, Homo sapiens
caaatgtctaattgt

SEQ ID NO: 6684864 - DNA, 20 bp, Homo sapiens
caaatgtctagtttctagtg

SEQ ID NO: 6684865 - DNA, 15 bp, Homo sapiens
caaatgtctataaac

SEQ ID NO: 6684866 - DNA, 18 bp, Homo sapiens
caaatgtcttcctggatt

SEQ ID NO: 6684867 - DNA, 16 bp, Homo sapiens
caaatgtgaaagatgc

SEQ ID NO: 6684868 - DNA, 20 bp, Homo sapiens
caaatgtgaaagatgcatgt

SEQ ID NO: 6684869 - DNA, 20 bp, Homo sapiens
caaatgtgaccatgtgaatc

SEQ ID NO: 6684870 - DNA, 14 bp, Homo sapiens
caaatgtgacctgt

SEQ ID NO: 6684871 - DNA, 17 bp, Homo sapiens
caaatgtgacctgtgtc

SEQ ID NO: 6684872 - DNA, 20 bp, Homo sapiens
caaatgtgatcaactgttca

SEQ ID NO: 6684873 - DNA, 14 bp, Homo sapiens
caaatgtgattttt

SEQ ID NO: 6684874 - DNA, 16 bp, Homo sapiens
caaatgtgcaatttgt

SEQ ID NO: 6684875 - DNA, 24 bp, Homo sapiens
caaatgtgcaatttgtaaatattg

SEQ ID NO: 6684876 - DNA, 18 bp, Homo sapiens
caaatgtgctttgagaag

SEQ ID NO: 6684877 - DNA, 13 bp, Homo sapiens
caaatgtgtaata

SEQ ID NO: 6684878 - DNA, 14 bp, Homo sapiens
caaatgtgtaatat

SEQ ID NO: 6684879 - DNA, 21 bp, Homo sapiens
caaatgtgtaatattccagtt

SEQ ID NO: 6684880 - DNA, 13 bp, Homo sapiens
caaatgtgtaatt

SEQ ID NO: 6684881 - DNA, 14 bp, Homo sapiens
caaatgtgtaattt

SEQ ID NO: 6684882 - DNA, 22 bp, Homo sapiens
caaatgtgtacgtgcatgctgt

SEQ ID NO: 6684883 - DNA, 14 bp, Homo sapiens
caaatgtgtcccag

SEQ ID NO: 6684884 - DNA, 19 bp, Homo sapiens
caaatgtgtcccagtgaac

SEQ ID NO: 6684885 - DNA, 19 bp, Homo sapiens
caaatgtgtcttgtattat

SEQ ID NO: 6684886 - DNA, 11 bp, Homo sapiens
caaatgtgtga

SEQ ID NO: 6684887 - DNA, 15 bp, Homo sapiens
caaatgtgtgcccag

SEQ ID NO: 6684888 - DNA, 16 bp, Homo sapiens
caaatgtgtgttcctg

SEQ ID NO: 6684889 - DNA, 17 bp, Homo sapiens
caaatgtgttttggtcc

SEQ ID NO: 6684890 - DNA, 16 bp, Homo sapiens
caaatgttaaaatgtg

SEQ ID NO: 6684891 - DNA, 17 bp, Homo sapiens
caaatgttaactgccaa

SEQ ID NO: 6684892 - DNA, 12 bp, Homo sapiens
caaatgttacaa

SEQ ID NO: 6684893 - DNA, 14 bp, Homo sapiens
caaatgttacaaaa

SEQ ID NO: 6684894 - DNA, 14 bp, Homo sapiens
caaatgttacagtt

SEQ ID NO: 6684895 - DNA, 18 bp, Homo sapiens
caaatgttagacttgtgt

SEQ ID NO: 6684896 - DNA, 21 bp, Homo sapiens
caaatgttatgcataaagtca

SEQ ID NO: 6684897 - DNA, 14 bp, Homo sapiens
caaatgttcatcaa

SEQ ID NO: 6684898 - DNA, 18 bp, Homo sapiens
caaatgttcatcaatgaa

SEQ ID NO: 6684899 - DNA, 21 bp, Homo sapiens
caaatgttcatcaatgaatga

SEQ ID NO: 6684900 - DNA, 14 bp, Homo sapiens
caaatgttcctttt

SEQ ID NO: 6684901 - DNA, 23 bp, Homo sapiens
caaatgttctaagtttctaagat

SEQ ID NO: 6684902 - DNA, 18 bp, Homo sapiens
caaatgttgtatttcaaa

SEQ ID NO: 6684903 - DNA, 16 bp, Homo sapiens
caaatgtttaaacatt

SEQ ID NO: 6684904 - DNA, 19 bp, Homo sapiens
caaatgtttaatcatataa

SEQ ID NO: 6684905 - DNA, 20 bp, Homo sapiens
caaatgtttacagggagcct

SEQ ID NO: 6684906 - DNA, 22 bp, Homo sapiens
caaatgtttacagggagcctcc

SEQ ID NO: 6684907 - DNA, 17 bp, Homo sapiens
caaatgtttacattttg

SEQ ID NO: 6684908 - DNA, 14 bp, Homo sapiens
caaatgtttactgt

SEQ ID NO: 6684909 - DNA, 18 bp, Homo sapiens
caaatgtttataactcta

SEQ ID NO: 6684910 - DNA, 21 bp, Homo sapiens
caaatgtttataactctaggg

SEQ ID NO: 6684911 - DNA, 17 bp, Homo sapiens
caaatgtttatgttttc

SEQ ID NO: 6684912 - DNA, 13 bp, Homo sapiens
caaatgtttattt

SEQ ID NO: 6684913 - DNA, 12 bp, Homo sapiens
caaatgtttcct

SEQ ID NO: 6684914 - DNA, 13 bp, Homo sapiens
caaatgttttaaa

SEQ ID NO: 6684915 - DNA, 18 bp, Homo sapiens
caaatgttttagtaaaaa

SEQ ID NO: 6684916 - DNA, 18 bp, Homo sapiens
caaatgttttctgcagaa

SEQ ID NO: 6684917 - DNA, 13 bp, Homo sapiens
caaatgtttttca

SEQ ID NO: 6684918 - DNA, 15 bp, Homo sapiens
caaattaaaaaagat

SEQ ID NO: 6684919 - DNA, 16 bp, Homo sapiens
caaattaaaaaagata

SEQ ID NO: 6684920 - DNA, 20 bp, Homo sapiens
caaattaaaaaagataaaca

SEQ ID NO: 6684921 - DNA, 15 bp, Homo sapiens
caaattaaaaagatt

SEQ ID NO: 6684922 - DNA, 21 bp, Homo sapiens
caaattaaaaagattcttttt

SEQ ID NO: 6684923 - DNA, 14 bp, Homo sapiens
caaattaaaacaaa

SEQ ID NO: 6684924 - DNA, 22 bp, Homo sapiens
caaattaaaacaaatatacatt

SEQ ID NO: 6684925 - DNA, 19 bp, Homo sapiens
caaattaaaacatatttca

SEQ ID NO: 6684926 - DNA, 23 bp, Homo sapiens
caaattaaaacatatttcatttt

SEQ ID NO: 6684927 - DNA, 17 bp, Homo sapiens
caaattaaataaattac

SEQ ID NO: 6684928 - DNA, 12 bp, Homo sapiens
caaattaactgt

SEQ ID NO: 6684929 - DNA, 13 bp, Homo sapiens
caaattaactgta

SEQ ID NO: 6684930 - DNA, 13 bp, Homo sapiens
caaattaacttga

SEQ ID NO: 6684931 - DNA, 12 bp, Homo sapiens
caaattaagaca

SEQ ID NO: 6684932 - DNA, 17 bp, Homo sapiens
caaattaataatcttat

SEQ ID NO: 6684933 - DNA, 19 bp, Homo sapiens
caaattaatacaatcagaa

SEQ ID NO: 6684934 - DNA, 15 bp, Homo sapiens
caaattaatatttgt

SEQ ID NO: 6684935 - DNA, 16 bp, Homo sapiens
caaattaatatttgtg

SEQ ID NO: 6684936 - DNA, 17 bp, Homo sapiens
caaattaatctttctat

SEQ ID NO: 6684937 - DNA, 16 bp, Homo sapiens
caaattaatgtgtaaa

SEQ ID NO: 6684938 - DNA, 17 bp, Homo sapiens
caaattaatgtgtaaaa

SEQ ID NO: 6684939 - DNA, 20 bp, Homo sapiens
caaattacaagtattcagtt

SEQ ID NO: 6684940 - DNA, 14 bp, Homo sapiens
caaattactccaag

SEQ ID NO: 6684941 - DNA, 19 bp, Homo sapiens
caaattagaaaatgttatt

SEQ ID NO: 6684942 - DNA, 23 bp, Homo sapiens
caaattagaaacaccattcatct

SEQ ID NO: 6684943 - DNA, 18 bp, Homo sapiens
caaattagaagacattta

SEQ ID NO: 6684944 - DNA, 14 bp, Homo sapiens
caaattagaggaga

SEQ ID NO: 6684945 - DNA, 15 bp, Homo sapiens
caaattagcatgcaa

SEQ ID NO: 6684946 - DNA, 14 bp, Homo sapiens
caaattagggcaat

SEQ ID NO: 6684947 - DNA, 21 bp, Homo sapiens
caaattagggcaattggaaca

SEQ ID NO: 6684948 - DNA, 21 bp, Homo sapiens
caaattaggttttgtacaatt

SEQ ID NO: 6684949 - DNA, 17 bp, Homo sapiens
caaattataagggccct

SEQ ID NO: 6684950 - DNA, 17 bp, Homo sapiens
caaattataatgtattc

SEQ ID NO: 6684951 - DNA, 16 bp, Homo sapiens
caaattatcaagctaa

SEQ ID NO: 6684952 - DNA, 17 bp, Homo sapiens
caaattatcaagctaat

SEQ ID NO: 6684953 - DNA, 15 bp, Homo sapiens
caaattatgtgaaat

SEQ ID NO: 6684954 - DNA, 19 bp, Homo sapiens
caaattatttattacttgt

SEQ ID NO: 6684955 - DNA, 23 bp, Homo sapiens
caaattatttattacttgtgcac

SEQ ID NO: 6684956 - DNA, 12 bp, Homo sapiens
caaattatttgt

SEQ ID NO: 6684957 - DNA, 14 bp, Homo sapiens
caaattatttgtgt

SEQ ID NO: 6684958 - DNA, 16 bp, Homo sapiens
caaattatttgtgtaa

SEQ ID NO: 6684959 - DNA, 20 bp, Homo sapiens
caaattatttgtgtaataga

SEQ ID NO: 6684960 - DNA, 14 bp, Homo sapiens
caaattatttttat

SEQ ID NO: 6684961 - DNA, 13 bp, Homo sapiens
caaattcaaataa

SEQ ID NO: 6684962 - DNA, 14 bp, Homo sapiens
caaattcaaataaa

SEQ ID NO: 6684963 - DNA, 23 bp, Homo sapiens
caaattcaaataatccattccaa

SEQ ID NO: 6684964 - DNA, 23 bp, Homo sapiens
caaattcaaggagatataaaatc

SEQ ID NO: 6684965 - DNA, 17 bp, Homo sapiens
caaattcaatgattctt

SEQ ID NO: 6684966 - DNA, 22 bp, Homo sapiens
caaattcagctctgatctgagg

SEQ ID NO: 6684967 - DNA, 16 bp, Homo sapiens
caaattcatattctgt

SEQ ID NO: 6684968 - DNA, 23 bp, Homo sapiens
caaattcatggcatgcttaaatt

SEQ ID NO: 6684969 - DNA, 20 bp, Homo sapiens
caaattcatttcatggtgac

SEQ ID NO: 6684970 - DNA, 20 bp, Homo sapiens
caaattccatagctcaataa

SEQ ID NO: 6684971 - DNA, 22 bp, Homo sapiens
caaattccatagctcaataaaa

SEQ ID NO: 6684972 - DNA, 15 bp, Homo sapiens
caaattccctctgga

SEQ ID NO: 6684973 - DNA, 16 bp, Homo sapiens
caaattcgcaaacttt

SEQ ID NO: 6684974 - DNA, 16 bp, Homo sapiens
caaattctatttgtct

SEQ ID NO: 6684975 - DNA, 22 bp, Homo sapiens
caaattctcaacctaccacccc

SEQ ID NO: 6684976 - DNA, 17 bp, Homo sapiens
caaattctgattattac

SEQ ID NO: 6684977 - DNA, 22 bp, Homo sapiens
caaattctgcttgcttgctttt

SEQ ID NO: 6684978 - DNA, 15 bp, Homo sapiens
caaattctgtctctg

SEQ ID NO: 6684979 - DNA, 17 bp, Homo sapiens
caaattctgtctgggga

SEQ ID NO: 6684980 - DNA, 18 bp, Homo sapiens
caaattctgtctggggac

SEQ ID NO: 6684981 - DNA, 15 bp, Homo sapiens
caaattctgtttctt

SEQ ID NO: 6684982 - DNA, 15 bp, Homo sapiens
caaattcttctgaac

SEQ ID NO: 6684983 - DNA, 22 bp, Homo sapiens
caaattcttgaataaactcccc

SEQ ID NO: 6684984 - DNA, 15 bp, Homo sapiens
caaattctttagtac

SEQ ID NO: 6684985 - DNA, 16 bp, Homo sapiens
caaattcttttgaatt

SEQ ID NO: 6684986 - DNA, 18 bp, Homo sapiens
caaattcttttgaattgt

SEQ ID NO: 6684987 - DNA, 23 bp, Homo sapiens
caaattgagacagtgcacatgaa

SEQ ID NO: 6684988 - DNA, 21 bp, Homo sapiens
caaattgattcaaatgttaca

SEQ ID NO: 6684989 - DNA, 20 bp, Homo sapiens
caaattgccctatgctgtgc

SEQ ID NO: 6684990 - DNA, 13 bp, Homo sapiens
caaattgccttca

SEQ ID NO: 6684991 - DNA, 15 bp, Homo sapiens
caaattgccttcagc

SEQ ID NO: 6684992 - DNA, 22 bp, Homo sapiens
caaattgctcctaagcttcaaa

SEQ ID NO: 6684993 - DNA, 12 bp, Homo sapiens
caaattgctgag

SEQ ID NO: 6684994 - DNA, 21 bp, Homo sapiens
caaattgctgcatatttgtgc

SEQ ID NO: 6684995 - DNA, 12 bp, Homo sapiens
caaattgctgct

SEQ ID NO: 6684996 - DNA, 13 bp, Homo sapiens
caaattgctgctt

SEQ ID NO: 6684997 - DNA, 14 bp, Homo sapiens
caaattgcttctag

SEQ ID NO: 6684998 - DNA, 23 bp, Homo sapiens
caaattgcttctaggagtcaact

SEQ ID NO: 6684999 - DNA, 20 bp, Homo sapiens
caaattgcttttttccaaaa

SEQ ID NO: 6685000 - DNA, 22 bp, Homo sapiens
caaattgcttttttccaaaaca

SEQ ID NO: 6685001 - DNA, 21 bp, Homo sapiens
caaattggactttcaaaatta

SEQ ID NO: 6685002 - DNA, 22 bp, Homo sapiens
caaattggctaaagtgcatttt

SEQ ID NO: 6685003 - DNA, 16 bp, Homo sapiens
caaattggctttcaag

SEQ ID NO: 6685004 - DNA, 22 bp, Homo sapiens
caaattgggacaacagtgcttt

SEQ ID NO: 6685005 - DNA, 14 bp, Homo sapiens
caaattgtatctta

SEQ ID NO: 6685006 - DNA, 19 bp, Homo sapiens
caaattgtatcttattata

SEQ ID NO: 6685007 - DNA, 14 bp, Homo sapiens
caaattgtcagcaa

SEQ ID NO: 6685008 - DNA, 14 bp, Homo sapiens
caaattgtccttca

SEQ ID NO: 6685009 - DNA, 16 bp, Homo sapiens
caaattgtcgttttta

SEQ ID NO: 6685010 - DNA, 18 bp, Homo sapiens
caaattgtcgtttttatt

SEQ ID NO: 6685011 - DNA, 13 bp, Homo sapiens
caaattgtctgtc

SEQ ID NO: 6685012 - DNA, 21 bp, Homo sapiens
caaattgtctgtctgctctta

SEQ ID NO: 6685013 - DNA, 22 bp, Homo sapiens
caaattgtctgtctgctcttat

SEQ ID NO: 6685014 - DNA, 22 bp, Homo sapiens
caaattgtcttttgtcatgtgg

SEQ ID NO: 6685015 - DNA, 14 bp, Homo sapiens
caaattgtgaaata

SEQ ID NO: 6685016 - DNA, 18 bp, Homo sapiens
caaattgtgcttctcccc

SEQ ID NO: 6685017 - DNA, 21 bp, Homo sapiens
caaattgtgcttctccccaga

SEQ ID NO: 6685018 - DNA, 14 bp, Homo sapiens
caaattgtggagcc

SEQ ID NO: 6685019 - DNA, 23 bp, Homo sapiens
caaattgtgtgtgctctgcttca

SEQ ID NO: 6685020 - DNA, 14 bp, Homo sapiens
caaatttaaaacaa

SEQ ID NO: 6685021 - DNA, 19 bp, Homo sapiens
caaatttaaaactgttgga

SEQ ID NO: 6685022 - DNA, 13 bp, Homo sapiens
caaatttaacagg

SEQ ID NO: 6685023 - DNA, 16 bp, Homo sapiens
caaatttaattttgca

SEQ ID NO: 6685024 - DNA, 16 bp, Homo sapiens
caaatttacagagaca

SEQ ID NO: 6685025 - DNA, 21 bp, Homo sapiens
caaatttactgtcttaaatca

SEQ ID NO: 6685026 - DNA, 18 bp, Homo sapiens
caaatttactttaaaaag

SEQ ID NO: 6685027 - DNA, 20 bp, Homo sapiens
caaatttagccaataaagaa

SEQ ID NO: 6685028 - DNA, 18 bp, Homo sapiens
caaatttagtttgttaaa

SEQ ID NO: 6685029 - DNA, 13 bp, Homo sapiens
caaatttataatt

SEQ ID NO: 6685030 - DNA, 12 bp, Homo sapiens
caaatttatatg

SEQ ID NO: 6685031 - DNA, 13 bp, Homo sapiens
caaatttatgcat

SEQ ID NO: 6685032 - DNA, 18 bp, Homo sapiens
caaatttatgcatttcat

SEQ ID NO: 6685033 - DNA, 11 bp, Homo sapiens
caaatttattt

SEQ ID NO: 6685034 - DNA, 15 bp, Homo sapiens
caaatttatttccaa

SEQ ID NO: 6685035 - DNA, 15 bp, Homo sapiens
caaatttcattgcac

SEQ ID NO: 6685036 - DNA, 19 bp, Homo sapiens
caaatttcattgcactttc

SEQ ID NO: 6685037 - DNA, 13 bp, Homo sapiens
caaatttcatttc

SEQ ID NO: 6685038 - DNA, 17 bp, Homo sapiens
caaatttctataaattt

SEQ ID NO: 6685039 - DNA, 20 bp, Homo sapiens
caaatttctctctttcttca

SEQ ID NO: 6685040 - DNA, 15 bp, Homo sapiens
caaatttgattctaa

SEQ ID NO: 6685041 - DNA, 14 bp, Homo sapiens
caaatttgattgat

SEQ ID NO: 6685042 - DNA, 17 bp, Homo sapiens
caaatttgattgatttg

SEQ ID NO: 6685043 - DNA, 20 bp, Homo sapiens
caaatttgcaaaactgtgct

SEQ ID NO: 6685044 - DNA, 21 bp, Homo sapiens
caaatttgccatgacatttca

SEQ ID NO: 6685045 - DNA, 22 bp, Homo sapiens
caaatttgctttgggattttct

SEQ ID NO: 6685046 - DNA, 24 bp, Homo sapiens
caaatttggccttaagaactgtgt

SEQ ID NO: 6685047 - DNA, 22 bp, Homo sapiens
caaatttggctcacttgcctta

SEQ ID NO: 6685048 - DNA, 19 bp, Homo sapiens
caaatttgggggtttctca

SEQ ID NO: 6685049 - DNA, 16 bp, Homo sapiens
caaatttgtaataaaa

SEQ ID NO: 6685050 - DNA, 11 bp, Homo sapiens
caaatttgtac

SEQ ID NO: 6685051 - DNA, 22 bp, Homo sapiens
caaatttgtctggttaaaaaat

SEQ ID NO: 6685052 - DNA, 22 bp, Homo sapiens
caaatttgtcttgccttattaa

SEQ ID NO: 6685053 - DNA, 13 bp, Homo sapiens
caaatttgtgtgt

SEQ ID NO: 6685054 - DNA, 13 bp, Homo sapiens
caaatttgtttaa

SEQ ID NO: 6685055 - DNA, 15 bp, Homo sapiens
caaattttaaaacat

SEQ ID NO: 6685056 - DNA, 16 bp, Homo sapiens
caaattttaaaacatt

SEQ ID NO: 6685057 - DNA, 17 bp, Homo sapiens
caaattttaaaacattt

SEQ ID NO: 6685058 - DNA, 18 bp, Homo sapiens
caaattttaaaacatttt

SEQ ID NO: 6685059 - DNA, 21 bp, Homo sapiens
caaattttattaaaagagtag

SEQ ID NO: 6685060 - DNA, 15 bp, Homo sapiens
caaattttatttgta

SEQ ID NO: 6685061 - DNA, 18 bp, Homo sapiens
caaattttcaagtttaca

SEQ ID NO: 6685062 - DNA, 16 bp, Homo sapiens
caaattttgaggtctt

SEQ ID NO: 6685063 - DNA, 17 bp, Homo sapiens
caaattttgcatttagt

SEQ ID NO: 6685064 - DNA, 20 bp, Homo sapiens
caaattttgcatttagtttt

SEQ ID NO: 6685065 - DNA, 21 bp, Homo sapiens
caaatttttcaaatcattcct

SEQ ID NO: 6685066 - DNA, 15 bp, Homo sapiens
caaatttttcatctc

SEQ ID NO: 6685067 - DNA, 16 bp, Homo sapiens
caaatttttcatctct

SEQ ID NO: 6685068 - DNA, 15 bp, Homo sapiens
caaatttttcctgca

SEQ ID NO: 6685069 - DNA, 15 bp, Homo sapiens
caaatttttctgctt

SEQ ID NO: 6685070 - DNA, 13 bp, Homo sapiens
caaattttttaat

SEQ ID NO: 6685071 - DNA, 9 bp, Homo sapiens
caacaaaaa

SEQ ID NO: 6685072 - DNA, 10 bp, Homo sapiens
caacaaaaaa

SEQ ID NO: 6685073 - DNA, 13 bp, Homo sapiens
caacaaaaaaagt

SEQ ID NO: 6685074 - DNA, 13 bp, Homo sapiens
caacaaaaaatac

SEQ ID NO: 6685075 - DNA, 17 bp, Homo sapiens
caacaaaaaatacatta

SEQ ID NO: 6685076 - DNA, 17 bp, Homo sapiens
caacaaaaagacatgga

SEQ ID NO: 6685077 - DNA, 18 bp, Homo sapiens
caacaaaaagacatggaa

SEQ ID NO: 6685078 - DNA, 10 bp, Homo sapiens
caacaaaaat

SEQ ID NO: 6685079 - DNA, 12 bp, Homo sapiens
caacaaaaattt

SEQ ID NO: 6685080 - DNA, 13 bp, Homo sapiens
caacaaaaatttg

SEQ ID NO: 6685081 - DNA, 17 bp, Homo sapiens
caacaaaagaatttttg

SEQ ID NO: 6685082 - DNA, 15 bp, Homo sapiens
caacaaaaggaagac

SEQ ID NO: 6685083 - DNA, 14 bp, Homo sapiens
caacaaaccaaaac

SEQ ID NO: 6685084 - DNA, 20 bp, Homo sapiens
caacaaagaaacaaagatgt

SEQ ID NO: 6685085 - DNA, 13 bp, Homo sapiens
caacaaagaaata

SEQ ID NO: 6685086 - DNA, 14 bp, Homo sapiens
caacaaagaacact

SEQ ID NO: 6685087 - DNA, 13 bp, Homo sapiens
caacaaagaagaa

SEQ ID NO: 6685088 - DNA, 21 bp, Homo sapiens
caacaaagacatgctttccat

SEQ ID NO: 6685089 - DNA, 22 bp, Homo sapiens
caacaaagacatgctttccatt

SEQ ID NO: 6685090 - DNA, 23 bp, Homo sapiens
caacaaagacatgctttccattt

SEQ ID NO: 6685091 - DNA, 19 bp, Homo sapiens
caacaaagacttgctttaa

SEQ ID NO: 6685092 - DNA, 17 bp, Homo sapiens
caacaaagattgagaag

SEQ ID NO: 6685093 - DNA, 14 bp, Homo sapiens
caacaaagcatgct

SEQ ID NO: 6685094 - DNA, 15 bp, Homo sapiens
caacaaagcatgctc

SEQ ID NO: 6685095 - DNA, 23 bp, Homo sapiens
caacaaagcgagatcccatctct

SEQ ID NO: 6685096 - DNA, 23 bp, Homo sapiens
caacaaaggattaattgctgcaa

SEQ ID NO: 6685097 - DNA, 19 bp, Homo sapiens
caacaaagggttttaatgt

SEQ ID NO: 6685098 - DNA, 17 bp, Homo sapiens
caacaaagtgcttcctt

SEQ ID NO: 6685099 - DNA, 15 bp, Homo sapiens
caacaaagtgctttt

SEQ ID NO: 6685100 - DNA, 23 bp, Homo sapiens
caacaaatgtggccaagcctatc

SEQ ID NO: 6685101 - DNA, 18 bp, Homo sapiens
caacaaattaaataaatt

SEQ ID NO: 6685102 - DNA, 21 bp, Homo sapiens
caacaaattaggttttgtaca

SEQ ID NO: 6685103 - DNA, 18 bp, Homo sapiens
caacaaatttcattgcac

SEQ ID NO: 6685104 - DNA, 22 bp, Homo sapiens
caacaaatttcattgcactttc

SEQ ID NO: 6685105 - DNA, 12 bp, Homo sapiens
caacaacaaaac

SEQ ID NO: 6685106 - DNA, 23 bp, Homo sapiens
caacaacaaaacatttgctctgg

SEQ ID NO: 6685107 - DNA, 12 bp, Homo sapiens
caacaacaaagc

SEQ ID NO: 6685108 - DNA, 13 bp, Homo sapiens
caacaacaaagca

SEQ ID NO: 6685109 - DNA, 13 bp, Homo sapiens
caacaacaacaaa

SEQ ID NO: 6685110 - DNA, 13 bp, Homo sapiens
caacaacaacaat

SEQ ID NO: 6685111 - DNA, 13 bp, Homo sapiens
caacaacaacaga

SEQ ID NO: 6685112 - DNA, 11 bp, Homo sapiens
caacaacaata

SEQ ID NO: 6685113 - DNA, 15 bp, Homo sapiens
caacaacaattttaa

SEQ ID NO: 6685114 - DNA, 13 bp, Homo sapiens
caacaacatcaga

SEQ ID NO: 6685115 - DNA, 20 bp, Homo sapiens
caacaacatcagaaagaatt

SEQ ID NO: 6685116 - DNA, 15 bp, Homo sapiens
caacaacatccactg

SEQ ID NO: 6685117 - DNA, 17 bp, Homo sapiens
caacaacgggcagaaat

SEQ ID NO: 6685118 - DNA, 22 bp, Homo sapiens
caacaacgtgagagaaagagag

SEQ ID NO: 6685119 - DNA, 20 bp, Homo sapiens
caacaactattttttaagaa

SEQ ID NO: 6685120 - DNA, 14 bp, Homo sapiens
caacaactccagga

SEQ ID NO: 6685121 - DNA, 20 bp, Homo sapiens
caacaactctgcctttatga

SEQ ID NO: 6685122 - DNA, 21 bp, Homo sapiens
caacaactctgcctttatgat

SEQ ID NO: 6685123 - DNA, 16 bp, Homo sapiens
caacaactgtcagttc

SEQ ID NO: 6685124 - DNA, 13 bp, Homo sapiens
caacaacttaatg

SEQ ID NO: 6685125 - DNA, 15 bp, Homo sapiens
caacaacttactaaa

SEQ ID NO: 6685126 - DNA, 13 bp, Homo sapiens
caacaactttgtt

SEQ ID NO: 6685127 - DNA, 12 bp, Homo sapiens
caacaacttttc

SEQ ID NO: 6685128 - DNA, 12 bp, Homo sapiens
caacaagaacaa

SEQ ID NO: 6685129 - DNA, 13 bp, Homo sapiens
caacaagaacaac

SEQ ID NO: 6685130 - DNA, 14 bp, Homo sapiens
caacaagaacaaca

SEQ ID NO: 6685131 - DNA, 17 bp, Homo sapiens
caacaagaacaacaaca

SEQ ID NO: 6685132 - DNA, 20 bp, Homo sapiens
caacaagaagaaatatgaaa

SEQ ID NO: 6685133 - DNA, 21 bp, Homo sapiens
caacaagaagggactgagaga

SEQ ID NO: 6685134 - DNA, 18 bp, Homo sapiens
caacaagaataaaggcag

SEQ ID NO: 6685135 - DNA, 19 bp, Homo sapiens
caacaagaataaaggcagc

SEQ ID NO: 6685136 - DNA, 14 bp, Homo sapiens
caacaagaatgcat

SEQ ID NO: 6685137 - DNA, 20 bp, Homo sapiens
caacaagaatgcattgatat

SEQ ID NO: 6685138 - DNA, 23 bp, Homo sapiens
caacaagaccgccccagggctat

SEQ ID NO: 6685139 - DNA, 16 bp, Homo sapiens
caacaagactgccagg

SEQ ID NO: 6685140 - DNA, 21 bp, Homo sapiens
caacaagagcgaaactccatc

SEQ ID NO: 6685141 - DNA, 15 bp, Homo sapiens
caacaagagtttatt

SEQ ID NO: 6685142 - DNA, 13 bp, Homo sapiens
caacaagatttcc

SEQ ID NO: 6685143 - DNA, 21 bp, Homo sapiens
caacaagatttccttgtgcaa

SEQ ID NO: 6685144 - DNA, 22 bp, Homo sapiens
caacaagcaaactgaaattagt

SEQ ID NO: 6685145 - DNA, 21 bp, Homo sapiens
caacaagccctgcttttgcat

SEQ ID NO: 6685146 - DNA, 21 bp, Homo sapiens
caacaagcctgaaagtaattt

SEQ ID NO: 6685147 - DNA, 22 bp, Homo sapiens
caacaaggaaaaatgccactcc

SEQ ID NO: 6685148 - DNA, 23 bp, Homo sapiens
caacaaggaaaaatgccactccc

SEQ ID NO: 6685149 - DNA, 12 bp, Homo sapiens
caacaaggaaat

SEQ ID NO: 6685150 - DNA, 15 bp, Homo sapiens
caacaaggaaataga

SEQ ID NO: 6685151 - DNA, 21 bp, Homo sapiens
caacaaggacaactttatgta

SEQ ID NO: 6685152 - DNA, 16 bp, Homo sapiens
caacaaggaccctgtt

SEQ ID NO: 6685153 - DNA, 20 bp, Homo sapiens
caacaaggaccctgttttcc

SEQ ID NO: 6685154 - DNA, 19 bp, Homo sapiens
caacaaggcttgctgcaga

SEQ ID NO: 6685155 - DNA, 14 bp, Homo sapiens
caacaagggagaga

SEQ ID NO: 6685156 - DNA, 16 bp, Homo sapiens
caacaaggggtcaatg

SEQ ID NO: 6685157 - DNA, 21 bp, Homo sapiens
caacaaggggtcaatgtcata

SEQ ID NO: 6685158 - DNA, 22 bp, Homo sapiens
caacaagtgctcctgaaagaaa

SEQ ID NO: 6685159 - DNA, 16 bp, Homo sapiens
caacaataaaattttt

SEQ ID NO: 6685160 - DNA, 12 bp, Homo sapiens
caacaataaacc

SEQ ID NO: 6685161 - DNA, 13 bp, Homo sapiens
caacaataacact

SEQ ID NO: 6685162 - DNA, 20 bp, Homo sapiens
caacaataatgattttcttg

SEQ ID NO: 6685163 - DNA, 20 bp, Homo sapiens
caacaatacaacaagaacaa

SEQ ID NO: 6685164 - DNA, 16 bp, Homo sapiens
caacaatactttgtgt

SEQ ID NO: 6685165 - DNA, 17 bp, Homo sapiens
caacaatcctagtgctt

SEQ ID NO: 6685166 - DNA, 18 bp, Homo sapiens
caacaatcctagtgcttt

SEQ ID NO: 6685167 - DNA, 12 bp, Homo sapiens
caacaatccttt

SEQ ID NO: 6685168 - DNA, 19 bp, Homo sapiens
caacaatgaatcagaacag

SEQ ID NO: 6685169 - DNA, 20 bp, Homo sapiens
caacaatgctttgataaaat

SEQ ID NO: 6685170 - DNA, 21 bp, Homo sapiens
caacaatgctttgataaaata

SEQ ID NO: 6685171 - DNA, 16 bp, Homo sapiens
caacaatggggtgggc

SEQ ID NO: 6685172 - DNA, 20 bp, Homo sapiens
caacaatgtgttgtaaaaat

SEQ ID NO: 6685173 - DNA, 19 bp, Homo sapiens
caacaattaggtctgcatt

SEQ ID NO: 6685174 - DNA, 23 bp, Homo sapiens
caacaattgtcccaacaaccaca

SEQ ID NO: 6685175 - DNA, 14 bp, Homo sapiens
caacaatttatgaa

SEQ ID NO: 6685176 - DNA, 16 bp, Homo sapiens
caacaatttatgaatt

SEQ ID NO: 6685177 - DNA, 18 bp, Homo sapiens
caacaatttatgaattga

SEQ ID NO: 6685178 - DNA, 20 bp, Homo sapiens
caacaatttctactttgaag

SEQ ID NO: 6685179 - DNA, 13 bp, Homo sapiens
caacaattttaaa

SEQ ID NO: 6685180 - DNA, 13 bp, Homo sapiens
caacaattttcag

SEQ ID NO: 6685181 - DNA, 15 bp, Homo sapiens
caacaattttcagat

SEQ ID NO: 6685182 - DNA, 23 bp, Homo sapiens
caacaattttcagatttgcacaa

SEQ ID NO: 6685183 - DNA, 13 bp, Homo sapiens
caacacaaagaca

SEQ ID NO: 6685184 - DNA, 15 bp, Homo sapiens
caacacaaagacaca

SEQ ID NO: 6685185 - DNA, 22 bp, Homo sapiens
caacacaaagacacaggaagaa

SEQ ID NO: 6685186 - DNA, 20 bp, Homo sapiens
caacacaaagacatggaaga

SEQ ID NO: 6685187 - DNA, 13 bp, Homo sapiens
caacacaaagaga

SEQ ID NO: 6685188 - DNA, 15 bp, Homo sapiens
caacacaaagagaaa

SEQ ID NO: 6685189 - DNA, 20 bp, Homo sapiens
caacacaaagagaaaaagaa

SEQ ID NO: 6685190 - DNA, 23 bp, Homo sapiens
caacacaaagagaaaaagaaatg

SEQ ID NO: 6685191 - DNA, 17 bp, Homo sapiens
caacacaacatttgtgt

SEQ ID NO: 6685192 - DNA, 15 bp, Homo sapiens
caacacaagaaaact

SEQ ID NO: 6685193 - DNA, 16 bp, Homo sapiens
caacacaaggtgggca

SEQ ID NO: 6685194 - DNA, 18 bp, Homo sapiens
caacacacacacacacaa

SEQ ID NO: 6685195 - DNA, 11 bp, Homo sapiens
caacacacaga

SEQ ID NO: 6685196 - DNA, 16 bp, Homo sapiens
caacacactgccttat

SEQ ID NO: 6685197 - DNA, 11 bp, Homo sapiens
caacacagagc

SEQ ID NO: 6685198 - DNA, 14 bp, Homo sapiens
caacacagaggaat

SEQ ID NO: 6685199 - DNA, 21 bp, Homo sapiens
caacacagataattttttctt

SEQ ID NO: 6685200 - DNA, 17 bp, Homo sapiens
caacacagtagtgttct

SEQ ID NO: 6685201 - DNA, 16 bp, Homo sapiens
caacacagttgggacc

SEQ ID NO: 6685202 - DNA, 18 bp, Homo sapiens
caacacattgaaactgta

SEQ ID NO: 6685203 - DNA, 19 bp, Homo sapiens
caacacattgaaactgtat

SEQ ID NO: 6685204 - DNA, 13 bp, Homo sapiens
caacacattttta

SEQ ID NO: 6685205 - DNA, 23 bp, Homo sapiens
caacaccaaaaaatatctagtaa

SEQ ID NO: 6685206 - DNA, 14 bp, Homo sapiens
caacaccacagaca

SEQ ID NO: 6685207 - DNA, 15 bp, Homo sapiens
caacaccacagacac

SEQ ID NO: 6685208 - DNA, 16 bp, Homo sapiens
caacaccacagacaca

SEQ ID NO: 6685209 - DNA, 22 bp, Homo sapiens
caacaccactaggaatcccaga

SEQ ID NO: 6685210 - DNA, 16 bp, Homo sapiens
caacaccagccccact

SEQ ID NO: 6685211 - DNA, 19 bp, Homo sapiens
caacaccatgattccttta

SEQ ID NO: 6685212 - DNA, 22 bp, Homo sapiens
caacaccatgattcctttaaca

SEQ ID NO: 6685213 - DNA, 19 bp, Homo sapiens
caacacccaaaggtggcct

SEQ ID NO: 6685214 - DNA, 15 bp, Homo sapiens
caacacccaagtcca

SEQ ID NO: 6685215 - DNA, 20 bp, Homo sapiens
caacacccccgacggcctcc

SEQ ID NO: 6685216 - DNA, 22 bp, Homo sapiens
caacaccccgcctgcctcctgg

SEQ ID NO: 6685217 - DNA, 14 bp, Homo sapiens
caacaccctgcttc

SEQ ID NO: 6685218 - DNA, 15 bp, Homo sapiens
caacaccctgcttct

SEQ ID NO: 6685219 - DNA, 22 bp, Homo sapiens
caacacctccttgctttgctgt

SEQ ID NO: 6685220 - DNA, 15 bp, Homo sapiens
caacacctgcctctg

SEQ ID NO: 6685221 - DNA, 16 bp, Homo sapiens
caacacctgcctctga

SEQ ID NO: 6685222 - DNA, 22 bp, Homo sapiens
caacacctgcctctgaccccag

SEQ ID NO: 6685223 - DNA, 13 bp, Homo sapiens
caacaccttcctc

SEQ ID NO: 6685224 - DNA, 14 bp, Homo sapiens
caacaccttcctcc

SEQ ID NO: 6685225 - DNA, 19 bp, Homo sapiens
caacaccttcctcctgcag

SEQ ID NO: 6685226 - DNA, 12 bp, Homo sapiens
caacaccttctt

SEQ ID NO: 6685227 - DNA, 20 bp, Homo sapiens
caacaccttcttggcttctg

SEQ ID NO: 6685228 - DNA, 15 bp, Homo sapiens
caacacgcacctgcc

SEQ ID NO: 6685229 - DNA, 17 bp, Homo sapiens
caacacgcacctgcctc

SEQ ID NO: 6685230 - DNA, 16 bp, Homo sapiens
caacacgcaggagcac

SEQ ID NO: 6685231 - DNA, 14 bp, Homo sapiens
caacacgcctggct

SEQ ID NO: 6685232 - DNA, 14 bp, Homo sapiens
caacacgtcattgt

SEQ ID NO: 6685233 - DNA, 18 bp, Homo sapiens
caacacgtggaggtgaag

SEQ ID NO: 6685234 - DNA, 13 bp, Homo sapiens
caacactaataca

SEQ ID NO: 6685235 - DNA, 19 bp, Homo sapiens
caacactaattgtccacag

SEQ ID NO: 6685236 - DNA, 19 bp, Homo sapiens
caacactattgtaatcatt

SEQ ID NO: 6685237 - DNA, 22 bp, Homo sapiens
caacactcacatttattctgct

SEQ ID NO: 6685238 - DNA, 13 bp, Homo sapiens
caacactcactgc

SEQ ID NO: 6685239 - DNA, 21 bp, Homo sapiens
caacactcactgcctgcagct

SEQ ID NO: 6685240 - DNA, 12 bp, Homo sapiens
caacactccagg

SEQ ID NO: 6685241 - DNA, 19 bp, Homo sapiens
caacactccaggccctgcc

SEQ ID NO: 6685242 - DNA, 20 bp, Homo sapiens
caacactccaggccctgccc

SEQ ID NO: 6685243 - DNA, 21 bp, Homo sapiens
caacactccattattcctctc

SEQ ID NO: 6685244 - DNA, 14 bp, Homo sapiens
caacactcttcttg

SEQ ID NO: 6685245 - DNA, 15 bp, Homo sapiens
caacactcttcttga

SEQ ID NO: 6685246 - DNA, 13 bp, Homo sapiens
caacactcttggg

SEQ ID NO: 6685247 - DNA, 18 bp, Homo sapiens
caacactgattcctggag

SEQ ID NO: 6685248 - DNA, 22 bp, Homo sapiens
caacactgccaaacatcagtca

SEQ ID NO: 6685249 - DNA, 14 bp, Homo sapiens
caacactgccagca

SEQ ID NO: 6685250 - DNA, 18 bp, Homo sapiens
caacactggtctgctgtt

SEQ ID NO: 6685251 - DNA, 13 bp, Homo sapiens
caacactggtgtg

SEQ ID NO: 6685252 - DNA, 18 bp, Homo sapiens
caacactggtgtgacctg

SEQ ID NO: 6685253 - DNA, 22 bp, Homo sapiens
caacactggtgtgacctgaggg

SEQ ID NO: 6685254 - DNA, 13 bp, Homo sapiens
caacactgtaaca

SEQ ID NO: 6685255 - DNA, 22 bp, Homo sapiens
caacactgtccttccctgccac

SEQ ID NO: 6685256 - DNA, 14 bp, Homo sapiens
caacactgtgccct

SEQ ID NO: 6685257 - DNA, 15 bp, Homo sapiens
caacactgtgccctg

SEQ ID NO: 6685258 - DNA, 16 bp, Homo sapiens
caacactgtgccctgg

SEQ ID NO: 6685259 - DNA, 15 bp, Homo sapiens
caacacttcagactg

SEQ ID NO: 6685260 - DNA, 15 bp, Homo sapiens
caacacttcattttc

SEQ ID NO: 6685261 - DNA, 24 bp, Homo sapiens
caacacttccagcatttagctggc

SEQ ID NO: 6685262 - DNA, 20 bp, Homo sapiens
caacacttgcaggggtccct

SEQ ID NO: 6685263 - DNA, 14 bp, Homo sapiens
caacagaaaaacaa

SEQ ID NO: 6685264 - DNA, 20 bp, Homo sapiens
caacagaaaaacaatcttat

SEQ ID NO: 6685265 - DNA, 17 bp, Homo sapiens
caacagaaacttctcag

SEQ ID NO: 6685266 - DNA, 14 bp, Homo sapiens
caacagaaagtcat

SEQ ID NO: 6685267 - DNA, 20 bp, Homo sapiens
caacagaacaacaacaaagc

SEQ ID NO: 6685268 - DNA, 15 bp, Homo sapiens
caacagaactaaatg

SEQ ID NO: 6685269 - DNA, 17 bp, Homo sapiens
caacagaagcagacttt

SEQ ID NO: 6685270 - DNA, 17 bp, Homo sapiens
caacagaagcatttgta

SEQ ID NO: 6685271 - DNA, 18 bp, Homo sapiens
caacagaagcatttgtat

SEQ ID NO: 6685272 - DNA, 19 bp, Homo sapiens
caacagaagcatttgtatt

SEQ ID NO: 6685273 - DNA, 17 bp, Homo sapiens
caacagaagcttcagaa

SEQ ID NO: 6685274 - DNA, 14 bp, Homo sapiens
caacagaagggaaa

SEQ ID NO: 6685275 - DNA, 16 bp, Homo sapiens
caacagaataaagcag

SEQ ID NO: 6685276 - DNA, 20 bp, Homo sapiens
caacagaataaagcagcctg

SEQ ID NO: 6685277 - DNA, 21 bp, Homo sapiens
caacagaataaagcagcctga

SEQ ID NO: 6685278 - DNA, 23 bp, Homo sapiens
caacagaataaagcagcctgatt

SEQ ID NO: 6685279 - DNA, 13 bp, Homo sapiens
caacagaatgaaa

SEQ ID NO: 6685280 - DNA, 16 bp, Homo sapiens
caacagaatgaaaaat

SEQ ID NO: 6685281 - DNA, 18 bp, Homo sapiens
caacagaatgaaaaatga

SEQ ID NO: 6685282 - DNA, 19 bp, Homo sapiens
caacagaatgaaaaatgaa

SEQ ID NO: 6685283 - DNA, 16 bp, Homo sapiens
caacagaattgttctt

SEQ ID NO: 6685284 - DNA, 23 bp, Homo sapiens
caacagaatttttccctccactc

SEQ ID NO: 6685285 - DNA, 21 bp, Homo sapiens
caacagacacaatttatactg

SEQ ID NO: 6685286 - DNA, 16 bp, Homo sapiens
caacagacaccctcca

SEQ ID NO: 6685287 - DNA, 21 bp, Homo sapiens
caacagacaccctccactctg

SEQ ID NO: 6685288 - DNA, 16 bp, Homo sapiens
caacagactctcacag

SEQ ID NO: 6685289 - DNA, 22 bp, Homo sapiens
caacagactgccttatattatt

SEQ ID NO: 6685290 - DNA, 15 bp, Homo sapiens
caacagagacagtga

SEQ ID NO: 6685291 - DNA, 17 bp, Homo sapiens
caacagagaggttcctg

SEQ ID NO: 6685292 - DNA, 23 bp, Homo sapiens
caacagagtgagaccctgtctct

SEQ ID NO: 6685293 - DNA, 14 bp, Homo sapiens
caacagataaagtt

SEQ ID NO: 6685294 - DNA, 17 bp, Homo sapiens
caacagataaagttttt

SEQ ID NO: 6685295 - DNA, 17 bp, Homo sapiens
caacagatacctctcag

SEQ ID NO: 6685296 - DNA, 14 bp, Homo sapiens
caacagatactgga

SEQ ID NO: 6685297 - DNA, 16 bp, Homo sapiens
caacagatattccaga

SEQ ID NO: 6685298 - DNA, 13 bp, Homo sapiens
caacagatctgga

SEQ ID NO: 6685299 - DNA, 14 bp, Homo sapiens
caacagatctggaa

SEQ ID NO: 6685300 - DNA, 21 bp, Homo sapiens
caacagatgcttttctgtctc

SEQ ID NO: 6685301 - DNA, 23 bp, Homo sapiens
caacagatgcttttctgtctctg

SEQ ID NO: 6685302 - DNA, 19 bp, Homo sapiens
caacagattcagaatgaga

SEQ ID NO: 6685303 - DNA, 15 bp, Homo sapiens
caacagattggattt

SEQ ID NO: 6685304 - DNA, 15 bp, Homo sapiens
caacagatttctaag

SEQ ID NO: 6685305 - DNA, 17 bp, Homo sapiens
caacagatttctaagtt

SEQ ID NO: 6685306 - DNA, 23 bp, Homo sapiens
caacagatttgtgaactcagcca

SEQ ID NO: 6685307 - DNA, 17 bp, Homo sapiens
caacagcaaacaggtgc

SEQ ID NO: 6685308 - DNA, 16 bp, Homo sapiens
caacagcaaaccctga

SEQ ID NO: 6685309 - DNA, 16 bp, Homo sapiens
caacagcaaaggaact

SEQ ID NO: 6685310 - DNA, 18 bp, Homo sapiens
caacagcaacaacaacag

SEQ ID NO: 6685311 - DNA, 18 bp, Homo sapiens
caacagcacacaggcagc

SEQ ID NO: 6685312 - DNA, 23 bp, Homo sapiens
caacagcacacaggcagccagcc

SEQ ID NO: 6685313 - DNA, 22 bp, Homo sapiens
caacagcacctccccgctggga

SEQ ID NO: 6685314 - DNA, 15 bp, Homo sapiens
caacagcactggctc

SEQ ID NO: 6685315 - DNA, 12 bp, Homo sapiens
caacagcacttt

SEQ ID NO: 6685316 - DNA, 10 bp, Homo sapiens
caacagcagc

SEQ ID NO: 6685317 - DNA, 11 bp, Homo sapiens
caacagcagga

SEQ ID NO: 6685318 - DNA, 19 bp, Homo sapiens
caacagcaggaggcacagc

SEQ ID NO: 6685319 - DNA, 23 bp, Homo sapiens
caacagcagtgatctcagggcag

SEQ ID NO: 6685320 - DNA, 19 bp, Homo sapiens
caacagcatgtctactgct

SEQ ID NO: 6685321 - DNA, 16 bp, Homo sapiens
caacagccaacagcta

SEQ ID NO: 6685322 - DNA, 14 bp, Homo sapiens
caacagccaagctg

SEQ ID NO: 6685323 - DNA, 22 bp, Homo sapiens
caacagccatttaggcaaataa

SEQ ID NO: 6685324 - DNA, 12 bp, Homo sapiens
caacagccctgc

SEQ ID NO: 6685325 - DNA, 17 bp, Homo sapiens
caacagccctgcctgag

SEQ ID NO: 6685326 - DNA, 19 bp, Homo sapiens
caacagcctaatcccgtgc

SEQ ID NO: 6685327 - DNA, 14 bp, Homo sapiens
caacagcctcactt

SEQ ID NO: 6685328 - DNA, 14 bp, Homo sapiens
caacagcctgagaa

SEQ ID NO: 6685329 - DNA, 15 bp, Homo sapiens
caacagcctgagaaa

SEQ ID NO: 6685330 - DNA, 22 bp, Homo sapiens
caacagcctgtttgggaggctg

SEQ ID NO: 6685331 - DNA, 16 bp, Homo sapiens
caacagcctttgaatg

SEQ ID NO: 6685332 - DNA, 23 bp, Homo sapiens
caacagcctttgaatgtaaccaa

SEQ ID NO: 6685333 - DNA, 21 bp, Homo sapiens
caacagcgacatagcccatcc

SEQ ID NO: 6685334 - DNA, 15 bp, Homo sapiens
caacagcgcccaaag

SEQ ID NO: 6685335 - DNA, 15 bp, Homo sapiens
caacagctacaacag

SEQ ID NO: 6685336 - DNA, 20 bp, Homo sapiens
caacagctacaacagcctca

SEQ ID NO: 6685337 - DNA, 15 bp, Homo sapiens
caacagctcaagtct

SEQ ID NO: 6685338 - DNA, 23 bp, Homo sapiens
caacagctctcgttctccttccc

SEQ ID NO: 6685339 - DNA, 18 bp, Homo sapiens
caacagctggacaccccc

SEQ ID NO: 6685340 - DNA, 19 bp, Homo sapiens
caacagctggacaccccct

SEQ ID NO: 6685341 - DNA, 19 bp, Homo sapiens
caacagctggaccctgacc

SEQ ID NO: 6685342 - DNA, 14 bp, Homo sapiens
caacagcttgacca

SEQ ID NO: 6685343 - DNA, 16 bp, Homo sapiens
caacagcttgaccaga

SEQ ID NO: 6685344 - DNA, 19 bp, Homo sapiens
caacagcttgaccagacct

SEQ ID NO: 6685345 - DNA, 22 bp, Homo sapiens
caacaggaatctcagagacagg

SEQ ID NO: 6685346 - DNA, 11 bp, Homo sapiens
caacaggacag

SEQ ID NO: 6685347 - DNA, 22 bp, Homo sapiens
caacaggacagagttcacagga

SEQ ID NO: 6685348 - DNA, 15 bp, Homo sapiens
caacaggaccaggag

SEQ ID NO: 6685349 - DNA, 23 bp, Homo sapiens
caacaggagaatggggttcctgc

SEQ ID NO: 6685350 - DNA, 22 bp, Homo sapiens
caacaggagctgggatcctaag

SEQ ID NO: 6685351 - DNA, 14 bp, Homo sapiens
caacaggaggacaa

SEQ ID NO: 6685352 - DNA, 17 bp, Homo sapiens
caacaggaggacaattc

SEQ ID NO: 6685353 - DNA, 19 bp, Homo sapiens
caacaggaggacaattcat

SEQ ID NO: 6685354 - DNA, 16 bp, Homo sapiens
caacaggagggcagcc

SEQ ID NO: 6685355 - DNA, 18 bp, Homo sapiens
caacaggcccagggaggg

SEQ ID NO: 6685356 - DNA, 23 bp, Homo sapiens
caacaggcccttggtagagctgg

SEQ ID NO: 6685357 - DNA, 15 bp, Homo sapiens
caacaggcctcaggg

SEQ ID NO: 6685358 - DNA, 12 bp, Homo sapiens
caacaggctggg

SEQ ID NO: 6685359 - DNA, 20 bp, Homo sapiens
caacaggctgggcttcagtg

SEQ ID NO: 6685360 - DNA, 21 bp, Homo sapiens
caacaggctgtgtgtggaaat

SEQ ID NO: 6685361 - DNA, 19 bp, Homo sapiens
caacaggctgttctgcact

SEQ ID NO: 6685362 - DNA, 20 bp, Homo sapiens
caacaggctgttctgcactg

SEQ ID NO: 6685363 - DNA, 21 bp, Homo sapiens
caacaggctgttctgcactga

SEQ ID NO: 6685364 - DNA, 22 bp, Homo sapiens
caacaggctgttctgcactgaa

SEQ ID NO: 6685365 - DNA, 24 bp, Homo sapiens
caacaggctgttctgcactgaaaa

SEQ ID NO: 6685366 - DNA, 20 bp, Homo sapiens
caacaggcttatgaatatat

SEQ ID NO: 6685367 - DNA, 22 bp, Homo sapiens
caacagggaagaaactttctgg

SEQ ID NO: 6685368 - DNA, 20 bp, Homo sapiens
caacagggagcacctgtctg

SEQ ID NO: 6685369 - DNA, 22 bp, Homo sapiens
caacagggagcacctgtctgga

SEQ ID NO: 6685370 - DNA, 20 bp, Homo sapiens
caacagggccatgtgctgcc

SEQ ID NO: 6685371 - DNA, 22 bp, Homo sapiens
caacagggccatgtgctgccct

SEQ ID NO: 6685372 - DNA, 21 bp, Homo sapiens
caacaggggaggaaaaaagaa

SEQ ID NO: 6685373 - DNA, 18 bp, Homo sapiens
caacaggggcacaagccc

SEQ ID NO: 6685374 - DNA, 14 bp, Homo sapiens
caacaggggctgga

SEQ ID NO: 6685375 - DNA, 23 bp, Homo sapiens
caacaggggctggagggctgggc

SEQ ID NO: 6685376 - DNA, 23 bp, Homo sapiens
caacaggtaaaacagggccacat

SEQ ID NO: 6685377 - DNA, 18 bp, Homo sapiens
caacaggtggcaggacca

SEQ ID NO: 6685378 - DNA, 21 bp, Homo sapiens
caacaggtggcaggaccagga

SEQ ID NO: 6685379 - DNA, 13 bp, Homo sapiens
caacaggttttat

SEQ ID NO: 6685380 - DNA, 22 bp, Homo sapiens
caacagtaaaccactgaaaaaa

SEQ ID NO: 6685381 - DNA, 22 bp, Homo sapiens
caacagtaattattatttaact

SEQ ID NO: 6685382 - DNA, 13 bp, Homo sapiens
caacagtcagcca

SEQ ID NO: 6685383 - DNA, 17 bp, Homo sapiens
caacagtcagccagctt

SEQ ID NO: 6685384 - DNA, 14 bp, Homo sapiens
caacagtcttgtga

SEQ ID NO: 6685385 - DNA, 16 bp, Homo sapiens
caacagtgaagacaga

SEQ ID NO: 6685386 - DNA, 13 bp, Homo sapiens
caacagtgctaaa

SEQ ID NO: 6685387 - DNA, 13 bp, Homo sapiens
caacagtgtgaag

SEQ ID NO: 6685388 - DNA, 18 bp, Homo sapiens
caacagtgtgaagttaga

SEQ ID NO: 6685389 - DNA, 23 bp, Homo sapiens
caacagtgtgaagttagaattcc

SEQ ID NO: 6685390 - DNA, 20 bp, Homo sapiens
caacagtgttaggcctggca

SEQ ID NO: 6685391 - DNA, 16 bp, Homo sapiens
caacagtgttctgagc

SEQ ID NO: 6685392 - DNA, 16 bp, Homo sapiens
caacagttacataatt

SEQ ID NO: 6685393 - DNA, 22 bp, Homo sapiens
caacagttctgagctgtaattt

SEQ ID NO: 6685394 - DNA, 20 bp, Homo sapiens
caacagttgtatgtttgctg

SEQ ID NO: 6685395 - DNA, 22 bp, Homo sapiens
caacagttttttatgctaatca

SEQ ID NO: 6685396 - DNA, 13 bp, Homo sapiens
caacataaaacaa

SEQ ID NO: 6685397 - DNA, 17 bp, Homo sapiens
caacataaaacaaaacc

SEQ ID NO: 6685398 - DNA, 19 bp, Homo sapiens
caacataaaacaaaaccaa

SEQ ID NO: 6685399 - DNA, 20 bp, Homo sapiens
caacataaaactcttttgac

SEQ ID NO: 6685400 - DNA, 19 bp, Homo sapiens
caacataaaattaaaattt

SEQ ID NO: 6685401 - DNA, 23 bp, Homo sapiens
caacatacccttctttaaatcaa

SEQ ID NO: 6685402 - DNA, 15 bp, Homo sapiens
caacatactcccatc

SEQ ID NO: 6685403 - DNA, 16 bp, Homo sapiens
caacatactcccatct

SEQ ID NO: 6685404 - DNA, 12 bp, Homo sapiens
caacatactgta

SEQ ID NO: 6685405 - DNA, 17 bp, Homo sapiens
caacatagtgagacact

SEQ ID NO: 6685406 - DNA, 22 bp, Homo sapiens
caacatagtgagatcccatttc

SEQ ID NO: 6685407 - DNA, 23 bp, Homo sapiens
caacatatcagacttcaccaaat

SEQ ID NO: 6685408 - DNA, 14 bp, Homo sapiens
caacatatctctgc

SEQ ID NO: 6685409 - DNA, 19 bp, Homo sapiens
caacatattgtttcagtgt

SEQ ID NO: 6685410 - DNA, 12 bp, Homo sapiens
caacatcaagaa

SEQ ID NO: 6685411 - DNA, 16 bp, Homo sapiens
caacatcaagaaaaca

SEQ ID NO: 6685412 - DNA, 15 bp, Homo sapiens
caacatcaatgttca

SEQ ID NO: 6685413 - DNA, 17 bp, Homo sapiens
caacatcaatgttcatt

SEQ ID NO: 6685414 - DNA, 15 bp, Homo sapiens
caacatcagaaagaa

SEQ ID NO: 6685415 - DNA, 12 bp, Homo sapiens
caacatcagctt

SEQ ID NO: 6685416 - DNA, 15 bp, Homo sapiens
caacatcagcttgac

SEQ ID NO: 6685417 - DNA, 20 bp, Homo sapiens
caacatcatcaggaagcctg

SEQ ID NO: 6685418 - DNA, 14 bp, Homo sapiens
caacatccactgtt

SEQ ID NO: 6685419 - DNA, 21 bp, Homo sapiens
caacatccatgtcctatgtgt

SEQ ID NO: 6685420 - DNA, 15 bp, Homo sapiens
caacatcccattgcc

SEQ ID NO: 6685421 - DNA, 17 bp, Homo sapiens
caacatcccattgccct

SEQ ID NO: 6685422 - DNA, 18 bp, Homo sapiens
caacatcccattgccctg

SEQ ID NO: 6685423 - DNA, 16 bp, Homo sapiens
caacatcctgccagcc

SEQ ID NO: 6685424 - DNA, 14 bp, Homo sapiens
caacatcgtggatg

SEQ ID NO: 6685425 - DNA, 23 bp, Homo sapiens
caacatctaagcctgttgagact

SEQ ID NO: 6685426 - DNA, 17 bp, Homo sapiens
caacatcttacttgtcc

SEQ ID NO: 6685427 - DNA, 13 bp, Homo sapiens
caacatcttttta

SEQ ID NO: 6685428 - DNA, 13 bp, Homo sapiens
caacatgaggaca

SEQ ID NO: 6685429 - DNA, 22 bp, Homo sapiens
caacatgaggacagaaggactg

SEQ ID NO: 6685430 - DNA, 15 bp, Homo sapiens
caacatgatgaggta

SEQ ID NO: 6685431 - DNA, 22 bp, Homo sapiens
caacatgatgaggtagtacctt

SEQ ID NO: 6685432 - DNA, 16 bp, Homo sapiens
caacatgcattgccat

SEQ ID NO: 6685433 - DNA, 23 bp, Homo sapiens
caacatgcattgccatgaatttc

SEQ ID NO: 6685434 - DNA, 20 bp, Homo sapiens
caacatgcctgctttagaat

SEQ ID NO: 6685435 - DNA, 21 bp, Homo sapiens
caacatggaaaaatcctgtca

SEQ ID NO: 6685436 - DNA, 18 bp, Homo sapiens
caacatggaatttttcca

SEQ ID NO: 6685437 - DNA, 18 bp, Homo sapiens
caacatggagaaaccctg

SEQ ID NO: 6685438 - DNA, 20 bp, Homo sapiens
caacatggattccaaagcat

SEQ ID NO: 6685439 - DNA, 21 bp, Homo sapiens
caacatggattccaaagcatt

SEQ ID NO: 6685440 - DNA, 22 bp, Homo sapiens
caacatggctgatcattaatta

SEQ ID NO: 6685441 - DNA, 18 bp, Homo sapiens
caacatggcttctccttt

SEQ ID NO: 6685442 - DNA, 12 bp, Homo sapiens
caacatggcttt

SEQ ID NO: 6685443 - DNA, 10 bp, Homo sapiens
caacatggga

SEQ ID NO: 6685444 - DNA, 17 bp, Homo sapiens
caacatgggagggatca

SEQ ID NO: 6685445 - DNA, 22 bp, Homo sapiens
caacatgggagggatcagcccc

SEQ ID NO: 6685446 - DNA, 15 bp, Homo sapiens
caacatggtaattca

SEQ ID NO: 6685447 - DNA, 22 bp, Homo sapiens
caacatggtgaaacccccatct

SEQ ID NO: 6685448 - DNA, 23 bp, Homo sapiens
caacatggtgaaaccctgtctct

SEQ ID NO: 6685449 - DNA, 14 bp, Homo sapiens
caacatggtgctac

SEQ ID NO: 6685450 - DNA, 16 bp, Homo sapiens
caacatggtgtctgga

SEQ ID NO: 6685451 - DNA, 20 bp, Homo sapiens
caacatgtagctgagtttaa

SEQ ID NO: 6685452 - DNA, 18 bp, Homo sapiens
caacatgtataatatttt

SEQ ID NO: 6685453 - DNA, 16 bp, Homo sapiens
caacatgtatctgtct

SEQ ID NO: 6685454 - DNA, 18 bp, Homo sapiens
caacatgtatctgtctac

SEQ ID NO: 6685455 - DNA, 19 bp, Homo sapiens
caacatgtatctgtctact

SEQ ID NO: 6685456 - DNA, 22 bp, Homo sapiens
caacatgtcaaagctgcatgtg

SEQ ID NO: 6685457 - DNA, 9 bp, Homo sapiens
caacatgtg

SEQ ID NO: 6685458 - DNA, 21 bp, Homo sapiens
caacatgtgtacttaatttct

SEQ ID NO: 6685459 - DNA, 14 bp, Homo sapiens
caacatgtgtgact

SEQ ID NO: 6685460 - DNA, 16 bp, Homo sapiens
caacatgtgtttctga

SEQ ID NO: 6685461 - DNA, 13 bp, Homo sapiens
caacatgttcaga

SEQ ID NO: 6685462 - DNA, 22 bp, Homo sapiens
caacatgttgggaaacttggct

SEQ ID NO: 6685463 - DNA, 23 bp, Homo sapiens
caacatgttgggaaacttggctc

SEQ ID NO: 6685464 - DNA, 20 bp, Homo sapiens
caacatgtttccagcattcc

SEQ ID NO: 6685465 - DNA, 13 bp, Homo sapiens
caacatgtttctg

SEQ ID NO: 6685466 - DNA, 14 bp, Homo sapiens
caacatgttttatg

SEQ ID NO: 6685467 - DNA, 14 bp, Homo sapiens
caacattaaaactc

SEQ ID NO: 6685468 - DNA, 15 bp, Homo sapiens
caacattaaaactca

SEQ ID NO: 6685469 - DNA, 20 bp, Homo sapiens
caacattaaggaatttgatg

SEQ ID NO: 6685470 - DNA, 20 bp, Homo sapiens
caacattaaggcagtatgat

SEQ ID NO: 6685471 - DNA, 11 bp, Homo sapiens
caacattacaa

SEQ ID NO: 6685472 - DNA, 18 bp, Homo sapiens
caacattaccttgtcttt

SEQ ID NO: 6685473 - DNA, 15 bp, Homo sapiens
caacattatcctgtg

SEQ ID NO: 6685474 - DNA, 16 bp, Homo sapiens
caacattccagggatg

SEQ ID NO: 6685475 - DNA, 11 bp, Homo sapiens
caacattctgc

SEQ ID NO: 6685476 - DNA, 19 bp, Homo sapiens
caacattctgcaatggcag

SEQ ID NO: 6685477 - DNA, 14 bp, Homo sapiens
caacattctttgca

SEQ ID NO: 6685478 - DNA, 22 bp, Homo sapiens
caacattgctggctggaaggga

SEQ ID NO: 6685479 - DNA, 17 bp, Homo sapiens
caacattgcttgtgcca

SEQ ID NO: 6685480 - DNA, 18 bp, Homo sapiens
caacattggacagaaaat

SEQ ID NO: 6685481 - DNA, 21 bp, Homo sapiens
caacattggacagaaaatgca

SEQ ID NO: 6685482 - DNA, 18 bp, Homo sapiens
caacattggagacatcac

SEQ ID NO: 6685483 - DNA, 20 bp, Homo sapiens
caacattgttcacctttgta

SEQ ID NO: 6685484 - DNA, 23 bp, Homo sapiens
caacattgttcacctttgtagca

SEQ ID NO: 6685485 - DNA, 12 bp, Homo sapiens
caacatttatat

SEQ ID NO: 6685486 - DNA, 19 bp, Homo sapiens
caacatttatatattgtct

SEQ ID NO: 6685487 - DNA, 22 bp, Homo sapiens
caacatttatatattgtctgta

SEQ ID NO: 6685488 - DNA, 22 bp, Homo sapiens
caacatttatttcaaactattg

SEQ ID NO: 6685489 - DNA, 14 bp, Homo sapiens
caacatttccaaaa

SEQ ID NO: 6685490 - DNA, 16 bp, Homo sapiens
caacatttctcaataa

SEQ ID NO: 6685491 - DNA, 15 bp, Homo sapiens
caacatttctcatgt

SEQ ID NO: 6685492 - DNA, 18 bp, Homo sapiens
caacatttctcatgttga

SEQ ID NO: 6685493 - DNA, 14 bp, Homo sapiens
caacatttctgtat

SEQ ID NO: 6685494 - DNA, 19 bp, Homo sapiens
caacatttctgtatactgt

SEQ ID NO: 6685495 - DNA, 20 bp, Homo sapiens
caacatttctgtatactgta

SEQ ID NO: 6685496 - DNA, 18 bp, Homo sapiens
caacatttcttaaattat

SEQ ID NO: 6685497 - DNA, 20 bp, Homo sapiens
caacatttcttaaattattt

SEQ ID NO: 6685498 - DNA, 23 bp, Homo sapiens
caacatttcttaaattattttat

SEQ ID NO: 6685499 - DNA, 14 bp, Homo sapiens
caacatttgctttt

SEQ ID NO: 6685500 - DNA, 12 bp, Homo sapiens
caacattttaat

SEQ ID NO: 6685501 - DNA, 22 bp, Homo sapiens
caacattttagctctattgata

SEQ ID NO: 6685502 - DNA, 21 bp, Homo sapiens
caacattttgagaacaaagat

SEQ ID NO: 6685503 - DNA, 15 bp, Homo sapiens
caacatttttcagtt

SEQ ID NO: 6685504 - DNA, 23 bp, Homo sapiens
caacatttttgtacattatgtta

SEQ ID NO: 6685505 - DNA, 19 bp, Homo sapiens
caacattttttcccagtga

SEQ ID NO: 6685506 - DNA, 17 bp, Homo sapiens
caacatttttttttctc

SEQ ID NO: 6685507 - DNA, 22 bp, Homo sapiens
caaccaaaagggaaaaaataaa

SEQ ID NO: 6685508 - DNA, 14 bp, Homo sapiens
caaccaaagaaaat

SEQ ID NO: 6685509 - DNA, 17 bp, Homo sapiens
caaccaaccagcagggt

SEQ ID NO: 6685510 - DNA, 24 bp, Homo sapiens
caaccaacctccccgcagagctcc

SEQ ID NO: 6685511 - DNA, 19 bp, Homo sapiens
caaccaactatccaagtgt

SEQ ID NO: 6685512 - DNA, 16 bp, Homo sapiens
caaccaactgccccag

SEQ ID NO: 6685513 - DNA, 18 bp, Homo sapiens
caaccaactgccccaggg

SEQ ID NO: 6685514 - DNA, 20 bp, Homo sapiens
caaccaagagcacattctta

SEQ ID NO: 6685515 - DNA, 18 bp, Homo sapiens
caaccaagatgcaaatgt

SEQ ID NO: 6685516 - DNA, 22 bp, Homo sapiens
caaccaaggaaggagcccctga

SEQ ID NO: 6685517 - DNA, 13 bp, Homo sapiens
caaccaagtcaca

SEQ ID NO: 6685518 - DNA, 18 bp, Homo sapiens
caaccaagtcatgtgcat

SEQ ID NO: 6685519 - DNA, 12 bp, Homo sapiens
caaccaataaaa

SEQ ID NO: 6685520 - DNA, 18 bp, Homo sapiens
caaccaataaaagccaga

SEQ ID NO: 6685521 - DNA, 14 bp, Homo sapiens
caaccaatggaatg

SEQ ID NO: 6685522 - DNA, 16 bp, Homo sapiens
caaccacatgtcccag

SEQ ID NO: 6685523 - DNA, 19 bp, Homo sapiens
caaccacatgtcccagatc

SEQ ID NO: 6685524 - DNA, 21 bp, Homo sapiens
caaccacatttagaaatgttt

SEQ ID NO: 6685525 - DNA, 21 bp, Homo sapiens
caaccaccgctccccagccca

SEQ ID NO: 6685526 - DNA, 22 bp, Homo sapiens
caaccaccgctccccagcccag

SEQ ID NO: 6685527 - DNA, 14 bp, Homo sapiens
caaccacctctggc

SEQ ID NO: 6685528 - DNA, 16 bp, Homo sapiens
caaccacctctggccc

SEQ ID NO: 6685529 - DNA, 21 bp, Homo sapiens
caaccactaagaattcaaact

SEQ ID NO: 6685530 - DNA, 22 bp, Homo sapiens
caaccactaatttgtcactgga

SEQ ID NO: 6685531 - DNA, 22 bp, Homo sapiens
caaccactcggggcccccatct

SEQ ID NO: 6685532 - DNA, 20 bp, Homo sapiens
caaccactctgtggccagcc

SEQ ID NO: 6685533 - DNA, 23 bp, Homo sapiens
caaccactctgtggccagcctgg

SEQ ID NO: 6685534 - DNA, 24 bp, Homo sapiens
caaccactctgtggccagcctggc

SEQ ID NO: 6685535 - DNA, 14 bp, Homo sapiens
caaccactggtctg

SEQ ID NO: 6685536 - DNA, 16 bp, Homo sapiens
caaccactgtgccact

SEQ ID NO: 6685537 - DNA, 23 bp, Homo sapiens
caaccactgtggcgttctgctgc

SEQ ID NO: 6685538 - DNA, 13 bp, Homo sapiens
caaccacttgcta

SEQ ID NO: 6685539 - DNA, 15 bp, Homo sapiens
caaccactttctcag

SEQ ID NO: 6685540 - DNA, 11 bp, Homo sapiens
caaccactttt

SEQ ID NO: 6685541 - DNA, 18 bp, Homo sapiens
caaccagaaacacccctc

SEQ ID NO: 6685542 - DNA, 15 bp, Homo sapiens
caaccagaaggccct

SEQ ID NO: 6685543 - DNA, 16 bp, Homo sapiens
caaccagaaggccctt

SEQ ID NO: 6685544 - DNA, 16 bp, Homo sapiens
caaccagaattgtcct

SEQ ID NO: 6685545 - DNA, 17 bp, Homo sapiens
caaccagaattgtcctc

SEQ ID NO: 6685546 - DNA, 15 bp, Homo sapiens
caaccagacagaggg

SEQ ID NO: 6685547 - DNA, 16 bp, Homo sapiens
caaccagacagcacag

SEQ ID NO: 6685548 - DNA, 21 bp, Homo sapiens
caaccagaccattgtctcaga

SEQ ID NO: 6685549 - DNA, 15 bp, Homo sapiens
caaccagagcactgt

SEQ ID NO: 6685550 - DNA, 18 bp, Homo sapiens
caaccagagcactgtata

SEQ ID NO: 6685551 - DNA, 13 bp, Homo sapiens
caaccagagcccc

SEQ ID NO: 6685552 - DNA, 19 bp, Homo sapiens
caaccagagccccccacaa

SEQ ID NO: 6685553 - DNA, 13 bp, Homo sapiens
caaccagcattca

SEQ ID NO: 6685554 - DNA, 12 bp, Homo sapiens
caaccagccaca

SEQ ID NO: 6685555 - DNA, 13 bp, Homo sapiens
caaccagccagcg

SEQ ID NO: 6685556 - DNA, 11 bp, Homo sapiens
caaccagcccg

SEQ ID NO: 6685557 - DNA, 20 bp, Homo sapiens
caaccagcccgacagtgcca

SEQ ID NO: 6685558 - DNA, 12 bp, Homo sapiens
caaccaggaccc

SEQ ID NO: 6685559 - DNA, 16 bp, Homo sapiens
caaccaggacccaggg

SEQ ID NO: 6685560 - DNA, 17 bp, Homo sapiens
caaccaggacccagggt

SEQ ID NO: 6685561 - DNA, 19 bp, Homo sapiens
caaccaggacccagggtcc

SEQ ID NO: 6685562 - DNA, 12 bp, Homo sapiens
caaccaggaggg

SEQ ID NO: 6685563 - DNA, 20 bp, Homo sapiens
caaccaggaggggtctgcct

SEQ ID NO: 6685564 - DNA, 14 bp, Homo sapiens
caaccaggcagagt

SEQ ID NO: 6685565 - DNA, 19 bp, Homo sapiens
caaccaggcagagttctgt

SEQ ID NO: 6685566 - DNA, 12 bp, Homo sapiens
caaccaggcagc

SEQ ID NO: 6685567 - DNA, 22 bp, Homo sapiens
caaccaggctacagttgatatt

SEQ ID NO: 6685568 - DNA, 23 bp, Homo sapiens
caaccagggccccggggcctgtt

SEQ ID NO: 6685569 - DNA, 16 bp, Homo sapiens
caaccaggggaagggt

SEQ ID NO: 6685570 - DNA, 15 bp, Homo sapiens
caaccagtgccaagg

SEQ ID NO: 6685571 - DNA, 14 bp, Homo sapiens
caaccataaaagaa

SEQ ID NO: 6685572 - DNA, 14 bp, Homo sapiens
caaccatactttat

SEQ ID NO: 6685573 - DNA, 22 bp, Homo sapiens
caaccatatggatattagtcat

SEQ ID NO: 6685574 - DNA, 18 bp, Homo sapiens
caaccatcaaagtggcaa

SEQ ID NO: 6685575 - DNA, 16 bp, Homo sapiens
caaccatccctgccac

SEQ ID NO: 6685576 - DNA, 17 bp, Homo sapiens
caaccatccctgccaca

SEQ ID NO: 6685577 - DNA, 23 bp, Homo sapiens
caaccatgagaccactgttatca

SEQ ID NO: 6685578 - DNA, 20 bp, Homo sapiens
caaccatgaggtaaaagagc

SEQ ID NO: 6685579 - DNA, 20 bp, Homo sapiens
caaccatgcaaattgtgaaa

SEQ ID NO: 6685580 - DNA, 13 bp, Homo sapiens
caaccatggactt

SEQ ID NO: 6685581 - DNA, 14 bp, Homo sapiens
caaccatggacttt

SEQ ID NO: 6685582 - DNA, 15 bp, Homo sapiens
caaccatggacttta

SEQ ID NO: 6685583 - DNA, 18 bp, Homo sapiens
caaccatggactttataa

SEQ ID NO: 6685584 - DNA, 22 bp, Homo sapiens
caaccatgtcatttcagaagtt

SEQ ID NO: 6685585 - DNA, 17 bp, Homo sapiens
caaccattaaagtcaga

SEQ ID NO: 6685586 - DNA, 23 bp, Homo sapiens
caaccattagataaacacaggca

SEQ ID NO: 6685587 - DNA, 22 bp, Homo sapiens
caaccattataaccttaattta

SEQ ID NO: 6685588 - DNA, 13 bp, Homo sapiens
caaccattccaga

SEQ ID NO: 6685589 - DNA, 14 bp, Homo sapiens
caaccattccccat

SEQ ID NO: 6685590 - DNA, 17 bp, Homo sapiens
caaccatttcctcagac

SEQ ID NO: 6685591 - DNA, 13 bp, Homo sapiens
caaccatttctag

SEQ ID NO: 6685592 - DNA, 21 bp, Homo sapiens
caacccaaaccatgagaattt

SEQ ID NO: 6685593 - DNA, 12 bp, Homo sapiens
caacccaaactg

SEQ ID NO: 6685594 - DNA, 22 bp, Homo sapiens
caacccaaggactgagggactc

SEQ ID NO: 6685595 - DNA, 13 bp, Homo sapiens
caacccaagtctc

SEQ ID NO: 6685596 - DNA, 17 bp, Homo sapiens
caacccaataaaactga

SEQ ID NO: 6685597 - DNA, 19 bp, Homo sapiens
caacccaataaaactgatg

SEQ ID NO: 6685598 - DNA, 17 bp, Homo sapiens
caacccaatccctctcc

SEQ ID NO: 6685599 - DNA, 14 bp, Homo sapiens
caacccaatgggct

SEQ ID NO: 6685600 - DNA, 15 bp, Homo sapiens
caacccacagccttt

SEQ ID NO: 6685601 - DNA, 20 bp, Homo sapiens
caacccacagctcagctgcc

SEQ ID NO: 6685602 - DNA, 14 bp, Homo sapiens
caacccaccatttc

SEQ ID NO: 6685603 - DNA, 18 bp, Homo sapiens
caacccaccatttctggg

SEQ ID NO: 6685604 - DNA, 13 bp, Homo sapiens
caacccacctctg

SEQ ID NO: 6685605 - DNA, 17 bp, Homo sapiens
caacccacctctggccc

SEQ ID NO: 6685606 - DNA, 12 bp, Homo sapiens
caacccagaatg

SEQ ID NO: 6685607 - DNA, 21 bp, Homo sapiens
caacccagccacgactgccat

SEQ ID NO: 6685608 - DNA, 22 bp, Homo sapiens
caacccagccgtcgtctccctc

SEQ ID NO: 6685609 - DNA, 13 bp, Homo sapiens
caacccagcctga

SEQ ID NO: 6685610 - DNA, 13 bp, Homo sapiens
caacccaggtctg

SEQ ID NO: 6685611 - DNA, 21 bp, Homo sapiens
caacccagtcacactgtggcc

SEQ ID NO: 6685612 - DNA, 16 bp, Homo sapiens
caacccatgcatggcc

SEQ ID NO: 6685613 - DNA, 16 bp, Homo sapiens
caacccatgcccctga

SEQ ID NO: 6685614 - DNA, 15 bp, Homo sapiens
caacccatgccctgc

SEQ ID NO: 6685615 - DNA, 18 bp, Homo sapiens
caacccattcactacagg

SEQ ID NO: 6685616 - DNA, 22 bp, Homo sapiens
caaccccaaatcccccgactcc

SEQ ID NO: 6685617 - DNA, 15 bp, Homo sapiens
caaccccaactccag

SEQ ID NO: 6685618 - DNA, 19 bp, Homo sapiens
caaccccacaagcaccact

SEQ ID NO: 6685619 - DNA, 15 bp, Homo sapiens
caaccccacccagct

SEQ ID NO: 6685620 - DNA, 14 bp, Homo sapiens
caaccccagacccc

SEQ ID NO: 6685621 - DNA, 14 bp, Homo sapiens
caaccccagactca

SEQ ID NO: 6685622 - DNA, 21 bp, Homo sapiens
caaccccagcagtcctgggcc

SEQ ID NO: 6685623 - DNA, 15 bp, Homo sapiens
caaccccagcctcct

SEQ ID NO: 6685624 - DNA, 23 bp, Homo sapiens
caaccccagctactctgatccct

SEQ ID NO: 6685625 - DNA, 16 bp, Homo sapiens
caaccccagctggcct

SEQ ID NO: 6685626 - DNA, 22 bp, Homo sapiens
caaccccagctggcctctagaa

SEQ ID NO: 6685627 - DNA, 13 bp, Homo sapiens
caaccccaggctg

SEQ ID NO: 6685628 - DNA, 20 bp, Homo sapiens
caaccccagggcccccacag

SEQ ID NO: 6685629 - DNA, 14 bp, Homo sapiens
caaccccagttctg

SEQ ID NO: 6685630 - DNA, 11 bp, Homo sapiens
caacccccacc

SEQ ID NO: 6685631 - DNA, 18 bp, Homo sapiens
caacccccaccccacact

SEQ ID NO: 6685632 - DNA, 23 bp, Homo sapiens
caacccccaccccacacttgttc

SEQ ID NO: 6685633 - DNA, 20 bp, Homo sapiens
caacccccaccgaagagccc

SEQ ID NO: 6685634 - DNA, 14 bp, Homo sapiens
caacccccacctcc

SEQ ID NO: 6685635 - DNA, 18 bp, Homo sapiens
caacccccacctcccggt

SEQ ID NO: 6685636 - DNA, 19 bp, Homo sapiens
caacccccacctcccggtg

SEQ ID NO: 6685637 - DNA, 20 bp, Homo sapiens
caacccccagaggtggccct

SEQ ID NO: 6685638 - DNA, 13 bp, Homo sapiens
caacccccagcac

SEQ ID NO: 6685639 - DNA, 15 bp, Homo sapiens
caacccccagcaccc

SEQ ID NO: 6685640 - DNA, 20 bp, Homo sapiens
caacccccagcacccgggct

SEQ ID NO: 6685641 - DNA, 12 bp, Homo sapiens
caacccccagct

SEQ ID NO: 6685642 - DNA, 15 bp, Homo sapiens
caacccccagctccc

SEQ ID NO: 6685643 - DNA, 13 bp, Homo sapiens
caacccccatctc

SEQ ID NO: 6685644 - DNA, 16 bp, Homo sapiens
caacccccatttctat

SEQ ID NO: 6685645 - DNA, 16 bp, Homo sapiens
caaccccccagcactg

SEQ ID NO: 6685646 - DNA, 18 bp, Homo sapiens
caaccccccagcactgag

SEQ ID NO: 6685647 - DNA, 19 bp, Homo sapiens
caaccccccagcactgagg

SEQ ID NO: 6685648 - DNA, 13 bp, Homo sapiens
caaccccccagct

SEQ ID NO: 6685649 - DNA, 22 bp, Homo sapiens
caaccccccatcacaaacttaa

SEQ ID NO: 6685650 - DNA, 16 bp, Homo sapiens
caacccccccaaaaca

SEQ ID NO: 6685651 - DNA, 14 bp, Homo sapiens
caacccccctccca

SEQ ID NO: 6685652 - DNA, 15 bp, Homo sapiens
caacccccctcccag

SEQ ID NO: 6685653 - DNA, 19 bp, Homo sapiens
caacccccctcctgctcct

SEQ ID NO: 6685654 - DNA, 21 bp, Homo sapiens
caacccccctcctgctcctcc

SEQ ID NO: 6685655 - DNA, 20 bp, Homo sapiens
caacccccgccacctcaggg

SEQ ID NO: 6685656 - DNA, 14 bp, Homo sapiens
caaccccctgtaag

SEQ ID NO: 6685657 - DNA, 19 bp, Homo sapiens
caaccccctgtaaggttcc

SEQ ID NO: 6685658 - DNA, 23 bp, Homo sapiens
caaccccgaggtccctgttgtca

SEQ ID NO: 6685659 - DNA, 13 bp, Homo sapiens
caaccccgcggcc

SEQ ID NO: 6685660 - DNA, 15 bp, Homo sapiens
caaccccgcggccca

SEQ ID NO: 6685661 - DNA, 16 bp, Homo sapiens
caaccccgcggcccag

SEQ ID NO: 6685662 - DNA, 19 bp, Homo sapiens
caaccccgcggtgctctgg

SEQ ID NO: 6685663 - DNA, 19 bp, Homo sapiens
caacccctcccccacgtct

SEQ ID NO: 6685664 - DNA, 16 bp, Homo sapiens
caacccctcctccctc

SEQ ID NO: 6685665 - DNA, 17 bp, Homo sapiens
caacccctcctccctca

SEQ ID NO: 6685666 - DNA, 16 bp, Homo sapiens
caacccctccttcccc

SEQ ID NO: 6685667 - DNA, 16 bp, Homo sapiens
caacccctctccaggc

SEQ ID NO: 6685668 - DNA, 21 bp, Homo sapiens
caacccctctccaggcctgtc

SEQ ID NO: 6685669 - DNA, 13 bp, Homo sapiens
caacccctgagga

SEQ ID NO: 6685670 - DNA, 17 bp, Homo sapiens
caacccctggaccccag

SEQ ID NO: 6685671 - DNA, 18 bp, Homo sapiens
caacccctggaccccagc

SEQ ID NO: 6685672 - DNA, 13 bp, Homo sapiens
caacccctgtacc

SEQ ID NO: 6685673 - DNA, 14 bp, Homo sapiens
caacccctgtaccc

SEQ ID NO: 6685674 - DNA, 19 bp, Homo sapiens
caaccccttaagccctggc

SEQ ID NO: 6685675 - DNA, 21 bp, Homo sapiens
caaccccttaagccctggccc

SEQ ID NO: 6685676 - DNA, 16 bp, Homo sapiens
caaccccttcgctcct

SEQ ID NO: 6685677 - DNA, 18 bp, Homo sapiens
caaccccttcgctcctgt

SEQ ID NO: 6685678 - DNA, 21 bp, Homo sapiens
caaccccttcgctcctgtgtc

SEQ ID NO: 6685679 - DNA, 16 bp, Homo sapiens
caacccgaggcccgca

SEQ ID NO: 6685680 - DNA, 17 bp, Homo sapiens
caacccgctggagccca

SEQ ID NO: 6685681 - DNA, 22 bp, Homo sapiens
caacccgctggagcccacagcg

SEQ ID NO: 6685682 - DNA, 14 bp, Homo sapiens
caacccggaaacag

SEQ ID NO: 6685683 - DNA, 20 bp, Homo sapiens
caacccgtctggcccaccag

SEQ ID NO: 6685684 - DNA, 21 bp, Homo sapiens
caacccgtctggcccaccagg

SEQ ID NO: 6685685 - DNA, 17 bp, Homo sapiens
caacccgtgccaagtcc

SEQ ID NO: 6685686 - DNA, 18 bp, Homo sapiens
caacccgtggaggctgct

SEQ ID NO: 6685687 - DNA, 21 bp, Homo sapiens
caacccgtggaggctgctcgg

SEQ ID NO: 6685688 - DNA, 21 bp, Homo sapiens
caacccgttgggtcccttgct

SEQ ID NO: 6685689 - DNA, 14 bp, Homo sapiens
caaccctaccctgg

SEQ ID NO: 6685690 - DNA, 19 bp, Homo sapiens
caaccctaccctggcaggg

SEQ ID NO: 6685691 - DNA, 18 bp, Homo sapiens
caaccctaggttccctgt

SEQ ID NO: 6685692 - DNA, 21 bp, Homo sapiens
caaccctaggttccctgttct

SEQ ID NO: 6685693 - DNA, 22 bp, Homo sapiens
caaccctaggttccctgttctt

SEQ ID NO: 6685694 - DNA, 20 bp, Homo sapiens
caaccctatctcctgacaga

SEQ ID NO: 6685695 - DNA, 21 bp, Homo sapiens
caaccctcagagccaccccta

SEQ ID NO: 6685696 - DNA, 12 bp, Homo sapiens
caaccctcagcc

SEQ ID NO: 6685697 - DNA, 21 bp, Homo sapiens
caaccctcagggcaaagccag

SEQ ID NO: 6685698 - DNA, 18 bp, Homo sapiens
caaccctccctcagcccc

SEQ ID NO: 6685699 - DNA, 19 bp, Homo sapiens
caaccctccctcagcccct

SEQ ID NO: 6685700 - DNA, 21 bp, Homo sapiens
caaccctccctcagcccctct

SEQ ID NO: 6685701 - DNA, 19 bp, Homo sapiens
caaccctcctaaaagttca

SEQ ID NO: 6685702 - DNA, 19 bp, Homo sapiens
caaccctcctatcacctcc

SEQ ID NO: 6685703 - DNA, 20 bp, Homo sapiens
caaccctcctccaatggaaa

SEQ ID NO: 6685704 - DNA, 16 bp, Homo sapiens
caaccctcggagcccc

SEQ ID NO: 6685705 - DNA, 18 bp, Homo sapiens
caaccctcggagcccccc

SEQ ID NO: 6685706 - DNA, 19 bp, Homo sapiens
caaccctcggagcccccca

SEQ ID NO: 6685707 - DNA, 21 bp, Homo sapiens
caaccctcggagccccccact

SEQ ID NO: 6685708 - DNA, 21 bp, Homo sapiens
caaccctctcctgtctgccct

SEQ ID NO: 6685709 - DNA, 14 bp, Homo sapiens
caaccctctggaag

SEQ ID NO: 6685710 - DNA, 15 bp, Homo sapiens
caaccctctggaagt

SEQ ID NO: 6685711 - DNA, 11 bp, Homo sapiens
caaccctgacc

SEQ ID NO: 6685712 - DNA, 12 bp, Homo sapiens
caaccctgaccg

SEQ ID NO: 6685713 - DNA, 11 bp, Homo sapiens
caaccctgcaa

SEQ ID NO: 6685714 - DNA, 13 bp, Homo sapiens
caaccctgcccct

SEQ ID NO: 6685715 - DNA, 14 bp, Homo sapiens
caaccctgcccctg

SEQ ID NO: 6685716 - DNA, 23 bp, Homo sapiens
caaccctgcccctgccccgtcac

SEQ ID NO: 6685717 - DNA, 13 bp, Homo sapiens
caaccctgccctg

SEQ ID NO: 6685718 - DNA, 14 bp, Homo sapiens
caaccctgccctgc

SEQ ID NO: 6685719 - DNA, 15 bp, Homo sapiens
caaccctgccctgca

SEQ ID NO: 6685720 - DNA, 15 bp, Homo sapiens
caaccctgccgtcac

SEQ ID NO: 6685721 - DNA, 19 bp, Homo sapiens
caaccctgcctgccgctgc

SEQ ID NO: 6685722 - DNA, 13 bp, Homo sapiens
caaccctgcctgt

SEQ ID NO: 6685723 - DNA, 23 bp, Homo sapiens
caaccctgcctgtcacctgggag

SEQ ID NO: 6685724 - DNA, 19 bp, Homo sapiens
caaccctggcattatgtcc

SEQ ID NO: 6685725 - DNA, 13 bp, Homo sapiens
caaccctgggacc

SEQ ID NO: 6685726 - DNA, 15 bp, Homo sapiens
caaccctgggaccta

SEQ ID NO: 6685727 - DNA, 22 bp, Homo sapiens
caaccctgggctattgctgctg

SEQ ID NO: 6685728 - DNA, 16 bp, Homo sapiens
caaccctggggaagga

SEQ ID NO: 6685729 - DNA, 14 bp, Homo sapiens
caaccctgtgggct

SEQ ID NO: 6685730 - DNA, 16 bp, Homo sapiens
caaccctgtgggctta

SEQ ID NO: 6685731 - DNA, 13 bp, Homo sapiens
caaccctgttgag

SEQ ID NO: 6685732 - DNA, 19 bp, Homo sapiens
caaccctgttttatactgt

SEQ ID NO: 6685733 - DNA, 23 bp, Homo sapiens
caacccttagcttttagcctggc

SEQ ID NO: 6685734 - DNA, 17 bp, Homo sapiens
caacccttcctgctgct

SEQ ID NO: 6685735 - DNA, 18 bp, Homo sapiens
caacccttcctgctgctg

SEQ ID NO: 6685736 - DNA, 19 bp, Homo sapiens
caacccttcctgctgctgc

SEQ ID NO: 6685737 - DNA, 23 bp, Homo sapiens
caacccttctcctcttgtaaata

SEQ ID NO: 6685738 - DNA, 15 bp, Homo sapiens
caacccttctctgtt

SEQ ID NO: 6685739 - DNA, 13 bp, Homo sapiens
caacccttgctga

SEQ ID NO: 6685740 - DNA, 13 bp, Homo sapiens
caaccctttccaa

SEQ ID NO: 6685741 - DNA, 19 bp, Homo sapiens
caacccttttgtctgcctc

SEQ ID NO: 6685742 - DNA, 18 bp, Homo sapiens
caaccgacagctcttact

SEQ ID NO: 6685743 - DNA, 14 bp, Homo sapiens
caaccgagaaggtt

SEQ ID NO: 6685744 - DNA, 23 bp, Homo sapiens
caaccgagagaatgctgacctga

SEQ ID NO: 6685745 - DNA, 22 bp, Homo sapiens
caaccgccacacacacaggagc

SEQ ID NO: 6685746 - DNA, 21 bp, Homo sapiens
caaccgcttccctatttattt

SEQ ID NO: 6685747 - DNA, 16 bp, Homo sapiens
caaccgggaaaggcat

SEQ ID NO: 6685748 - DNA, 19 bp, Homo sapiens
caaccggggagcccccgcc

SEQ ID NO: 6685749 - DNA, 15 bp, Homo sapiens
caaccggtcccttcc

SEQ ID NO: 6685750 - DNA, 12 bp, Homo sapiens
caaccgtcctgc

SEQ ID NO: 6685751 - DNA, 16 bp, Homo sapiens
caaccgtcctgctgtc

SEQ ID NO: 6685752 - DNA, 19 bp, Homo sapiens
caaccgtcctgctgtccct

SEQ ID NO: 6685753 - DNA, 23 bp, Homo sapiens
caaccgtcctgctgtccctgtca

SEQ ID NO: 6685754 - DNA, 15 bp, Homo sapiens
caaccgtggcccttc

SEQ ID NO: 6685755 - DNA, 18 bp, Homo sapiens
caaccgtggcccttcctg

SEQ ID NO: 6685756 - DNA, 20 bp, Homo sapiens
caaccgtggcccttcctgga

SEQ ID NO: 6685757 - DNA, 13 bp, Homo sapiens
caacctaaaactc

SEQ ID NO: 6685758 - DNA, 14 bp, Homo sapiens
caacctaaatactg

SEQ ID NO: 6685759 - DNA, 13 bp, Homo sapiens
caacctaaatttg

SEQ ID NO: 6685760 - DNA, 15 bp, Homo sapiens
caacctaagcaacag

SEQ ID NO: 6685761 - DNA, 17 bp, Homo sapiens
caacctacagtggaggg

SEQ ID NO: 6685762 - DNA, 18 bp, Homo sapiens
caacctacagtggaggga

SEQ ID NO: 6685763 - DNA, 20 bp, Homo sapiens
caacctaccaccccttcctg

SEQ ID NO: 6685764 - DNA, 12 bp, Homo sapiens
caacctactgtc

SEQ ID NO: 6685765 - DNA, 21 bp, Homo sapiens
caacctactgtctaagcagtt

SEQ ID NO: 6685766 - DNA, 14 bp, Homo sapiens
caacctatttgact

SEQ ID NO: 6685767 - DNA, 18 bp, Homo sapiens
caacctcaatgccctgcc

SEQ ID NO: 6685768 - DNA, 21 bp, Homo sapiens
caacctcaatgccctgccatt

SEQ ID NO: 6685769 - DNA, 13 bp, Homo sapiens
caacctcaccaaa

SEQ ID NO: 6685770 - DNA, 14 bp, Homo sapiens
caacctcaccctcc

SEQ ID NO: 6685771 - DNA, 18 bp, Homo sapiens
caacctcacctcccgggt

SEQ ID NO: 6685772 - DNA, 15 bp, Homo sapiens
caacctcaccttcct

SEQ ID NO: 6685773 - DNA, 19 bp, Homo sapiens
caacctcaccttcctgtgg

SEQ ID NO: 6685774 - DNA, 20 bp, Homo sapiens
caacctcaccttcctgtggg

SEQ ID NO: 6685775 - DNA, 14 bp, Homo sapiens
caacctcactgccc

SEQ ID NO: 6685776 - DNA, 14 bp, Homo sapiens
caacctcaggctcc

SEQ ID NO: 6685777 - DNA, 15 bp, Homo sapiens
caacctcagggctcc

SEQ ID NO: 6685778 - DNA, 18 bp, Homo sapiens
caacctcagggctcccag

SEQ ID NO: 6685779 - DNA, 19 bp, Homo sapiens
caacctcagggctcccagg

SEQ ID NO: 6685780 - DNA, 15 bp, Homo sapiens
caacctcagtaattt

SEQ ID NO: 6685781 - DNA, 20 bp, Homo sapiens
caacctccaactccctggtt

SEQ ID NO: 6685782 - DNA, 20 bp, Homo sapiens
caacctccacctcccaggtt

SEQ ID NO: 6685783 - DNA, 19 bp, Homo sapiens
caacctccacctccgggtt

SEQ ID NO: 6685784 - DNA, 13 bp, Homo sapiens
caacctccagact

SEQ ID NO: 6685785 - DNA, 19 bp, Homo sapiens
caacctccagactcagcag

SEQ ID NO: 6685786 - DNA, 20 bp, Homo sapiens
caacctccagtgtcagggtc

SEQ ID NO: 6685787 - DNA, 21 bp, Homo sapiens
caacctccccgcagagctccc

SEQ ID NO: 6685788 - DNA, 20 bp, Homo sapiens
caacctcccctggtcctgca

SEQ ID NO: 6685789 - DNA, 21 bp, Homo sapiens
caacctcccctggtcctgcac

SEQ ID NO: 6685790 - DNA, 16 bp, Homo sapiens
caacctccctcttgtt

SEQ ID NO: 6685791 - DNA, 20 bp, Homo sapiens
caacctccgcctcccaggtt

SEQ ID NO: 6685792 - DNA, 14 bp, Homo sapiens
caacctcctgctct

SEQ ID NO: 6685793 - DNA, 12 bp, Homo sapiens
caacctcctgtg

SEQ ID NO: 6685794 - DNA, 14 bp, Homo sapiens
caacctcgccctct

SEQ ID NO: 6685795 - DNA, 15 bp, Homo sapiens
caacctcgccctctc

SEQ ID NO: 6685796 - DNA, 13 bp, Homo sapiens
caacctcgctcca

SEQ ID NO: 6685797 - DNA, 21 bp, Homo sapiens
caacctcgctccaactccaac

SEQ ID NO: 6685798 - DNA, 18 bp, Homo sapiens
caacctcggctcctggac

SEQ ID NO: 6685799 - DNA, 20 bp, Homo sapiens
caacctcggctcctggactc

SEQ ID NO: 6685800 - DNA, 13 bp, Homo sapiens
caacctctcactc

SEQ ID NO: 6685801 - DNA, 14 bp, Homo sapiens
caacctctcactcc

SEQ ID NO: 6685802 - DNA, 17 bp, Homo sapiens
caacctctcactcccca

SEQ ID NO: 6685803 - DNA, 16 bp, Homo sapiens
caacctctcagatccc

SEQ ID NO: 6685804 - DNA, 13 bp, Homo sapiens
caacctctccttt

SEQ ID NO: 6685805 - DNA, 18 bp, Homo sapiens
caacctctcctttctgtg

SEQ ID NO: 6685806 - DNA, 12 bp, Homo sapiens
caacctctgccc

SEQ ID NO: 6685807 - DNA, 13 bp, Homo sapiens
caacctctgcctc

SEQ ID NO: 6685808 - DNA, 20 bp, Homo sapiens
caacctctgcctcccgggtt

SEQ ID NO: 6685809 - DNA, 20 bp, Homo sapiens
caacctctgcttcccaggtt

SEQ ID NO: 6685810 - DNA, 12 bp, Homo sapiens
caacctcttcct

SEQ ID NO: 6685811 - DNA, 15 bp, Homo sapiens
caacctcttcctcct

SEQ ID NO: 6685812 - DNA, 13 bp, Homo sapiens
caacctcttggcc

SEQ ID NO: 6685813 - DNA, 15 bp, Homo sapiens
caacctctttcctct

SEQ ID NO: 6685814 - DNA, 21 bp, Homo sapiens
caacctctttgcgtttccttt

SEQ ID NO: 6685815 - DNA, 15 bp, Homo sapiens
caacctctttgctca

SEQ ID NO: 6685816 - DNA, 16 bp, Homo sapiens
caacctctttttcctc

SEQ ID NO: 6685817 - DNA, 23 bp, Homo sapiens
caacctctttttcctcctggaca

SEQ ID NO: 6685818 - DNA, 22 bp, Homo sapiens
caacctgaaagttccttctgta

SEQ ID NO: 6685819 - DNA, 15 bp, Homo sapiens
caacctgaaatttat

SEQ ID NO: 6685820 - DNA, 14 bp, Homo sapiens
caacctgaatcttt

SEQ ID NO: 6685821 - DNA, 20 bp, Homo sapiens
caacctgaattaaagtctac

SEQ ID NO: 6685822 - DNA, 20 bp, Homo sapiens
caacctgaccaacatggaga

SEQ ID NO: 6685823 - DNA, 21 bp, Homo sapiens
caacctgaccaacatggagaa

SEQ ID NO: 6685824 - DNA, 23 bp, Homo sapiens
caacctgaccaacatggagaaac

SEQ ID NO: 6685825 - DNA, 21 bp, Homo sapiens
caacctgagccttttcttata

SEQ ID NO: 6685826 - DNA, 17 bp, Homo sapiens
caacctgattgtgtctc

SEQ ID NO: 6685827 - DNA, 16 bp, Homo sapiens
caacctgccacaatgt

SEQ ID NO: 6685828 - DNA, 19 bp, Homo sapiens
caacctgccacaatgtgat

SEQ ID NO: 6685829 - DNA, 14 bp, Homo sapiens
caacctgcctgtgc

SEQ ID NO: 6685830 - DNA, 12 bp, Homo sapiens
caacctgctctg

SEQ ID NO: 6685831 - DNA, 14 bp, Homo sapiens
caacctggacttcc

SEQ ID NO: 6685832 - DNA, 16 bp, Homo sapiens
caacctggacttcctg

SEQ ID NO: 6685833 - DNA, 20 bp, Homo sapiens
caacctggacttcctgtcat

SEQ ID NO: 6685834 - DNA, 19 bp, Homo sapiens
caacctggaggctggacca

SEQ ID NO: 6685835 - DNA, 15 bp, Homo sapiens
caacctggccagagg

SEQ ID NO: 6685836 - DNA, 20 bp, Homo sapiens
caacctggggggcagtggtg

SEQ ID NO: 6685837 - DNA, 18 bp, Homo sapiens
caacctgggtccaaataa

SEQ ID NO: 6685838 - DNA, 13 bp, Homo sapiens
caacctgtaaatt

SEQ ID NO: 6685839 - DNA, 16 bp, Homo sapiens
caacctgtaaattatt

SEQ ID NO: 6685840 - DNA, 15 bp, Homo sapiens
caacctgtaactgcc

SEQ ID NO: 6685841 - DNA, 16 bp, Homo sapiens
caacctgtaactgccc

SEQ ID NO: 6685842 - DNA, 15 bp, Homo sapiens
caacctgtaagactg

SEQ ID NO: 6685843 - DNA, 21 bp, Homo sapiens
caacctgtaataaatatgagt

SEQ ID NO: 6685844 - DNA, 22 bp, Homo sapiens
caacctgtaataaatatgagtg

SEQ ID NO: 6685845 - DNA, 18 bp, Homo sapiens
caacctgtagagtggcca

SEQ ID NO: 6685846 - DNA, 22 bp, Homo sapiens
caacctgtccttactcagagct

SEQ ID NO: 6685847 - DNA, 14 bp, Homo sapiens
caacctgtgatcaa

SEQ ID NO: 6685848 - DNA, 18 bp, Homo sapiens
caacctgtgatcaagcaa

SEQ ID NO: 6685849 - DNA, 14 bp, Homo sapiens
caacctgtgcaaaa

SEQ ID NO: 6685850 - DNA, 21 bp, Homo sapiens
caacctgtgcaaaataaaatg

SEQ ID NO: 6685851 - DNA, 19 bp, Homo sapiens
caacctgtggcgctgcagc

SEQ ID NO: 6685852 - DNA, 13 bp, Homo sapiens
caacctgtggctc

SEQ ID NO: 6685853 - DNA, 17 bp, Homo sapiens
caacctgtggctcaggg

SEQ ID NO: 6685854 - DNA, 20 bp, Homo sapiens
caacctgtggggtctgatgt

SEQ ID NO: 6685855 - DNA, 20 bp, Homo sapiens
caacctgttacctactttga

SEQ ID NO: 6685856 - DNA, 21 bp, Homo sapiens
caacctgttcacgtgactcct

SEQ ID NO: 6685857 - DNA, 23 bp, Homo sapiens
caacctgttcacgtgactcctca

SEQ ID NO: 6685858 - DNA, 20 bp, Homo sapiens
caacctgttcttagagtgta

SEQ ID NO: 6685859 - DNA, 24 bp, Homo sapiens
caacctgttcttagagtgtagctg

SEQ ID NO: 6685860 - DNA, 18 bp, Homo sapiens
caaccttagatgttctaa

SEQ ID NO: 6685861 - DNA, 18 bp, Homo sapiens
caaccttccaacttcctg

SEQ ID NO: 6685862 - DNA, 19 bp, Homo sapiens
caaccttccaacttcctgt

SEQ ID NO: 6685863 - DNA, 20 bp, Homo sapiens
caaccttcctttttttaaat

SEQ ID NO: 6685864 - DNA, 14 bp, Homo sapiens
caaccttcggctcc

SEQ ID NO: 6685865 - DNA, 16 bp, Homo sapiens
caaccttctgccctcc

SEQ ID NO: 6685866 - DNA, 15 bp, Homo sapiens
caaccttctggggga

SEQ ID NO: 6685867 - DNA, 20 bp, Homo sapiens
caaccttctgtggctcacag

SEQ ID NO: 6685868 - DNA, 14 bp, Homo sapiens
caaccttggccttc

SEQ ID NO: 6685869 - DNA, 23 bp, Homo sapiens
caaccttgtaaattccccttccc

SEQ ID NO: 6685870 - DNA, 13 bp, Homo sapiens
caaccttgtttaa

SEQ ID NO: 6685871 - DNA, 12 bp, Homo sapiens
caacctttaaaa

SEQ ID NO: 6685872 - DNA, 19 bp, Homo sapiens
caacctttaaaattgtcac

SEQ ID NO: 6685873 - DNA, 12 bp, Homo sapiens
caacctttatag

SEQ ID NO: 6685874 - DNA, 21 bp, Homo sapiens
caacctttcacctttgtgtat

SEQ ID NO: 6685875 - DNA, 14 bp, Homo sapiens
caacctttccagct

SEQ ID NO: 6685876 - DNA, 13 bp, Homo sapiens
caacctttctgta

SEQ ID NO: 6685877 - DNA, 22 bp, Homo sapiens
caacctttgtaagaaaaccaaa

SEQ ID NO: 6685878 - DNA, 17 bp, Homo sapiens
caaccttttacattgtg

SEQ ID NO: 6685879 - DNA, 13 bp, Homo sapiens
caacgaaaagcac

SEQ ID NO: 6685880 - DNA, 21 bp, Homo sapiens
caacgaaccctagaaatatat

SEQ ID NO: 6685881 - DNA, 13 bp, Homo sapiens
caacgacaaagcc

SEQ ID NO: 6685882 - DNA, 12 bp, Homo sapiens
caacgaccaggg

SEQ ID NO: 6685883 - DNA, 15 bp, Homo sapiens
caacgactactttgc

SEQ ID NO: 6685884 - DNA, 13 bp, Homo sapiens
caacgagacacat

SEQ ID NO: 6685885 - DNA, 20 bp, Homo sapiens
caacgagacacattgccttc

SEQ ID NO: 6685886 - DNA, 14 bp, Homo sapiens
caacgagcctcctc

SEQ ID NO: 6685887 - DNA, 18 bp, Homo sapiens
caacgagcctcctcaggg

SEQ ID NO: 6685888 - DNA, 16 bp, Homo sapiens
caacgatcacaaatga

SEQ ID NO: 6685889 - DNA, 20 bp, Homo sapiens
caacgatcacaaatgacttt

SEQ ID NO: 6685890 - DNA, 13 bp, Homo sapiens
caacgattcacag

SEQ ID NO: 6685891 - DNA, 14 bp, Homo sapiens
caacgattcacagc

SEQ ID NO: 6685892 - DNA, 15 bp, Homo sapiens
caacgattcacagcc

SEQ ID NO: 6685893 - DNA, 15 bp, Homo sapiens
caacgcacaaatgac

SEQ ID NO: 6685894 - DNA, 13 bp, Homo sapiens
caacgcagccctg

SEQ ID NO: 6685895 - DNA, 23 bp, Homo sapiens
caacgcaggaggagaaaagaaat

SEQ ID NO: 6685896 - DNA, 15 bp, Homo sapiens
caacgccagtggcaa

SEQ ID NO: 6685897 - DNA, 13 bp, Homo sapiens
caacgcccctcca

SEQ ID NO: 6685898 - DNA, 14 bp, Homo sapiens
caacgcccctccaa

SEQ ID NO: 6685899 - DNA, 18 bp, Homo sapiens
caacgcccctgtggccaa

SEQ ID NO: 6685900 - DNA, 19 bp, Homo sapiens
caacgcccctgtggccaac

SEQ ID NO: 6685901 - DNA, 16 bp, Homo sapiens
caacgctcactctacc

SEQ ID NO: 6685902 - DNA, 19 bp, Homo sapiens
caacgctctaccctgcagc

SEQ ID NO: 6685903 - DNA, 20 bp, Homo sapiens
caacgctctaccctgcagct

SEQ ID NO: 6685904 - DNA, 21 bp, Homo sapiens
caacgctgaagcggtcagact

SEQ ID NO: 6685905 - DNA, 20 bp, Homo sapiens
caacggaaagtgctgtctta

SEQ ID NO: 6685906 - DNA, 15 bp, Homo sapiens
caacggagggagtgg

SEQ ID NO: 6685907 - DNA, 14 bp, Homo sapiens
caacggcaagacag

SEQ ID NO: 6685908 - DNA, 14 bp, Homo sapiens
caacggccagggtt

SEQ ID NO: 6685909 - DNA, 14 bp, Homo sapiens
caacggccccagcg

SEQ ID NO: 6685910 - DNA, 20 bp, Homo sapiens
caacggccctgcagccagct

SEQ ID NO: 6685911 - DNA, 21 bp, Homo sapiens
caacgggaccccctggccctg

SEQ ID NO: 6685912 - DNA, 21 bp, Homo sapiens
caacgggattgaagggtcctg

SEQ ID NO: 6685913 - DNA, 17 bp, Homo sapiens
caacggggggctcctgc

SEQ ID NO: 6685914 - DNA, 18 bp, Homo sapiens
caacggggggctcctgcc

SEQ ID NO: 6685915 - DNA, 21 bp, Homo sapiens
caacggggggctcctgcccag

SEQ ID NO: 6685916 - DNA, 22 bp, Homo sapiens
caacggggggctcctgcccagg

SEQ ID NO: 6685917 - DNA, 17 bp, Homo sapiens
caacggggtggggaggg

SEQ ID NO: 6685918 - DNA, 18 bp, Homo sapiens
caacggggtggggagggt

SEQ ID NO: 6685919 - DNA, 18 bp, Homo sapiens
caacgtactatggaagcc

SEQ ID NO: 6685920 - DNA, 22 bp, Homo sapiens
caacgtactatggaagccacat

SEQ ID NO: 6685921 - DNA, 14 bp, Homo sapiens
caacgtctgtgcca

SEQ ID NO: 6685922 - DNA, 18 bp, Homo sapiens
caacgtctttttgtttgt

SEQ ID NO: 6685923 - DNA, 15 bp, Homo sapiens
caacgtgagagaaag

SEQ ID NO: 6685924 - DNA, 19 bp, Homo sapiens
caacgtgcaaagccaaggc

SEQ ID NO: 6685925 - DNA, 21 bp, Homo sapiens
caacgtgcgtgtctctgccat

SEQ ID NO: 6685926 - DNA, 13 bp, Homo sapiens
caacgtggcccag

SEQ ID NO: 6685927 - DNA, 14 bp, Homo sapiens
caacgtggcccaga

SEQ ID NO: 6685928 - DNA, 21 bp, Homo sapiens
caacgtggcccagagaagcca

SEQ ID NO: 6685929 - DNA, 15 bp, Homo sapiens
caacgtggggcagca

SEQ ID NO: 6685930 - DNA, 18 bp, Homo sapiens
caacgttaaaagacagtg

SEQ ID NO: 6685931 - DNA, 18 bp, Homo sapiens
caacgtttcttcactttt

SEQ ID NO: 6685932 - DNA, 22 bp, Homo sapiens
caacgtttggaagatcctgtga

SEQ ID NO: 6685933 - DNA, 17 bp, Homo sapiens
caactaaaaataaatta

SEQ ID NO: 6685934 - DNA, 22 bp, Homo sapiens
caactaaaaatatatctgttgg

SEQ ID NO: 6685935 - DNA, 22 bp, Homo sapiens
caactaaaatgtgtcttgctgt

SEQ ID NO: 6685936 - DNA, 23 bp, Homo sapiens
caactaaagaatagtgcctcagc

SEQ ID NO: 6685937 - DNA, 18 bp, Homo sapiens
caactaaagttgtacttt

SEQ ID NO: 6685938 - DNA, 21 bp, Homo sapiens
caactaaataaaaaattcaaa

SEQ ID NO: 6685939 - DNA, 15 bp, Homo sapiens
caactaacaatgcct

SEQ ID NO: 6685940 - DNA, 21 bp, Homo sapiens
caactaacccttaaaaatgca

SEQ ID NO: 6685941 - DNA, 17 bp, Homo sapiens
caactaagttaataata

SEQ ID NO: 6685942 - DNA, 21 bp, Homo sapiens
caactaagttaataataatga

SEQ ID NO: 6685943 - DNA, 15 bp, Homo sapiens
caactaatttttgta

SEQ ID NO: 6685944 - DNA, 17 bp, Homo sapiens
caactacagaaaaacca

SEQ ID NO: 6685945 - DNA, 15 bp, Homo sapiens
caactacagtctaaa

SEQ ID NO: 6685946 - DNA, 17 bp, Homo sapiens
caactacccaaaacaag

SEQ ID NO: 6685947 - DNA, 22 bp, Homo sapiens
caactactactggtgatgccta

SEQ ID NO: 6685948 - DNA, 13 bp, Homo sapiens
caactactattca

SEQ ID NO: 6685949 - DNA, 20 bp, Homo sapiens
caactactcagctctcctgc

SEQ ID NO: 6685950 - DNA, 17 bp, Homo sapiens
caactagacattctgtc

SEQ ID NO: 6685951 - DNA, 13 bp, Homo sapiens
caactagatttgt

SEQ ID NO: 6685952 - DNA, 18 bp, Homo sapiens
caactagatttgtccttt

SEQ ID NO: 6685953 - DNA, 21 bp, Homo sapiens
caactagtggggtttcctggc

SEQ ID NO: 6685954 - DNA, 16 bp, Homo sapiens
caactagttttgttta

SEQ ID NO: 6685955 - DNA, 22 bp, Homo sapiens
caactatattgcgagaaacaga

SEQ ID NO: 6685956 - DNA, 13 bp, Homo sapiens
caactatcaaaat

SEQ ID NO: 6685957 - DNA, 14 bp, Homo sapiens
caactatcaattct

SEQ ID NO: 6685958 - DNA, 19 bp, Homo sapiens
caactatctcatttccaag

SEQ ID NO: 6685959 - DNA, 21 bp, Homo sapiens
caactatctcatttccaagca

SEQ ID NO: 6685960 - DNA, 18 bp, Homo sapiens
caactatggaatagatta

SEQ ID NO: 6685961 - DNA, 16 bp, Homo sapiens
caactatggatcagaa

SEQ ID NO: 6685962 - DNA, 14 bp, Homo sapiens
caactatgtaattt

SEQ ID NO: 6685963 - DNA, 15 bp, Homo sapiens
caactattcttcatt

SEQ ID NO: 6685964 - DNA, 14 bp, Homo sapiens
caactatttataaa

SEQ ID NO: 6685965 - DNA, 17 bp, Homo sapiens
caactatttataaacta

SEQ ID NO: 6685966 - DNA, 15 bp, Homo sapiens
caactatttcaataa

SEQ ID NO: 6685967 - DNA, 12 bp, Homo sapiens
caactattttat

SEQ ID NO: 6685968 - DNA, 15 bp, Homo sapiens
caactcaaagatgat

SEQ ID NO: 6685969 - DNA, 16 bp, Homo sapiens
caactcaaagatgatg

SEQ ID NO: 6685970 - DNA, 17 bp, Homo sapiens
caactcaagtgtcacct

SEQ ID NO: 6685971 - DNA, 16 bp, Homo sapiens
caactcacacctcctt

SEQ ID NO: 6685972 - DNA, 20 bp, Homo sapiens
caactcacacctccttttct

SEQ ID NO: 6685973 - DNA, 18 bp, Homo sapiens
caactcacagcttctcca

SEQ ID NO: 6685974 - DNA, 20 bp, Homo sapiens
caactcacagcttctccaag

SEQ ID NO: 6685975 - DNA, 15 bp, Homo sapiens
caactcaccccagcc

SEQ ID NO: 6685976 - DNA, 17 bp, Homo sapiens
caactcaccccagcccc

SEQ ID NO: 6685977 - DNA, 16 bp, Homo sapiens
caactcacccttggcc

SEQ ID NO: 6685978 - DNA, 19 bp, Homo sapiens
caactcacccttggcccat

SEQ ID NO: 6685979 - DNA, 17 bp, Homo sapiens
caactcactccttttaa

SEQ ID NO: 6685980 - DNA, 22 bp, Homo sapiens
caactcactccttttaaagaaa

SEQ ID NO: 6685981 - DNA, 23 bp, Homo sapiens
caactcactccttttaaagaaaa

SEQ ID NO: 6685982 - DNA, 17 bp, Homo sapiens
caactcactcttatgaa

SEQ ID NO: 6685983 - DNA, 20 bp, Homo sapiens
caactcactcttatgaaatg

SEQ ID NO: 6685984 - DNA, 18 bp, Homo sapiens
caactcactgtgctccta

SEQ ID NO: 6685985 - DNA, 16 bp, Homo sapiens
caactcacttccagtg

SEQ ID NO: 6685986 - DNA, 23 bp, Homo sapiens
caactcacttttttacaactcca

SEQ ID NO: 6685987 - DNA, 21 bp, Homo sapiens
caactcagaatgggggctttc

SEQ ID NO: 6685988 - DNA, 12 bp, Homo sapiens
caactcagacta

SEQ ID NO: 6685989 - DNA, 15 bp, Homo sapiens
caactcagagcacag

SEQ ID NO: 6685990 - DNA, 18 bp, Homo sapiens
caactcagagcacagcca

SEQ ID NO: 6685991 - DNA, 16 bp, Homo sapiens
caactcagcaggctaa

SEQ ID NO: 6685992 - DNA, 12 bp, Homo sapiens
caactcagcctg

SEQ ID NO: 6685993 - DNA, 23 bp, Homo sapiens
caactcagtccctaaaaacacag

SEQ ID NO: 6685994 - DNA, 16 bp, Homo sapiens
caactcatcattttct

SEQ ID NO: 6685995 - DNA, 19 bp, Homo sapiens
caactcatcattttctact

SEQ ID NO: 6685996 - DNA, 12 bp, Homo sapiens
caactcattcca

SEQ ID NO: 6685997 - DNA, 16 bp, Homo sapiens
caactcattccagatc

SEQ ID NO: 6685998 - DNA, 13 bp, Homo sapiens
caactccaaaacc

SEQ ID NO: 6685999 - DNA, 19 bp, Homo sapiens
caactccaaacaattctga

SEQ ID NO: 6686000 - DNA, 22 bp, Homo sapiens
caactccaacctctcggcccca

SEQ ID NO: 6686001 - DNA, 16 bp, Homo sapiens
caactccacagggctg

SEQ ID NO: 6686002 - DNA, 23 bp, Homo sapiens
caactccaccagatagcagaggg

SEQ ID NO: 6686003 - DNA, 16 bp, Homo sapiens
caactccactcactga

SEQ ID NO: 6686004 - DNA, 13 bp, Homo sapiens
caactccagccac

SEQ ID NO: 6686005 - DNA, 16 bp, Homo sapiens
caactccagcgtcctc

SEQ ID NO: 6686006 - DNA, 20 bp, Homo sapiens
caactccagctgagtcctgg

SEQ ID NO: 6686007 - DNA, 15 bp, Homo sapiens
caactccaggaaaga

SEQ ID NO: 6686008 - DNA, 19 bp, Homo sapiens
caactccaggatttaggcc

SEQ ID NO: 6686009 - DNA, 17 bp, Homo sapiens
caactccaggggcacct

SEQ ID NO: 6686010 - DNA, 17 bp, Homo sapiens
caactccagtactggag

SEQ ID NO: 6686011 - DNA, 20 bp, Homo sapiens
caactccagtactggagctt

SEQ ID NO: 6686012 - DNA, 13 bp, Homo sapiens
caactccatactc

SEQ ID NO: 6686013 - DNA, 22 bp, Homo sapiens
caactccatgaccaggccacca

SEQ ID NO: 6686014 - DNA, 13 bp, Homo sapiens
caactccatgcct

SEQ ID NO: 6686015 - DNA, 13 bp, Homo sapiens
caactcccacgac

SEQ ID NO: 6686016 - DNA, 13 bp, Homo sapiens
caactcccagcca

SEQ ID NO: 6686017 - DNA, 14 bp, Homo sapiens
caactcccccaccg

SEQ ID NO: 6686018 - DNA, 15 bp, Homo sapiens
caactcccccaccgc

SEQ ID NO: 6686019 - DNA, 21 bp, Homo sapiens
caactcccccaccgcccactc

SEQ ID NO: 6686020 - DNA, 17 bp, Homo sapiens
caactccctctctgtgc

SEQ ID NO: 6686021 - DNA, 22 bp, Homo sapiens
caactccctgccattttttaag

SEQ ID NO: 6686022 - DNA, 19 bp, Homo sapiens
caactccctgccccccagc

SEQ ID NO: 6686023 - DNA, 20 bp, Homo sapiens
caactccctgccccccagcc

SEQ ID NO: 6686024 - DNA, 15 bp, Homo sapiens
caactcccttctgct

SEQ ID NO: 6686025 - DNA, 20 bp, Homo sapiens
caactcccttctgcttgtcc

SEQ ID NO: 6686026 - DNA, 14 bp, Homo sapiens
caactcctaatttt

SEQ ID NO: 6686027 - DNA, 15 bp, Homo sapiens
caactcctaatttta

SEQ ID NO: 6686028 - DNA, 12 bp, Homo sapiens
caactcctccca

SEQ ID NO: 6686029 - DNA, 19 bp, Homo sapiens
caactcctcgacatcactg

SEQ ID NO: 6686030 - DNA, 14 bp, Homo sapiens
caactcctggaagc

SEQ ID NO: 6686031 - DNA, 21 bp, Homo sapiens
caactcctggaagctgtgtcc

SEQ ID NO: 6686032 - DNA, 14 bp, Homo sapiens
caactcctggctcc

SEQ ID NO: 6686033 - DNA, 21 bp, Homo sapiens
caactcctggctccgcagggg

SEQ ID NO: 6686034 - DNA, 14 bp, Homo sapiens
caactcctgtctaa

SEQ ID NO: 6686035 - DNA, 17 bp, Homo sapiens
caactccttccagctag

SEQ ID NO: 6686036 - DNA, 13 bp, Homo sapiens
caactccttcctc

SEQ ID NO: 6686037 - DNA, 14 bp, Homo sapiens
caactccttcctct

SEQ ID NO: 6686038 - DNA, 15 bp, Homo sapiens
caactccttttactg

SEQ ID NO: 6686039 - DNA, 22 bp, Homo sapiens
caactcgaatcactcatttatt

SEQ ID NO: 6686040 - DNA, 16 bp, Homo sapiens
caactcgcctgtggac

SEQ ID NO: 6686041 - DNA, 16 bp, Homo sapiens
caactcggagagggct

SEQ ID NO: 6686042 - DNA, 23 bp, Homo sapiens
caactcgggagcattctgcctgc

SEQ ID NO: 6686043 - DNA, 15 bp, Homo sapiens
caactcgggctcccg

SEQ ID NO: 6686044 - DNA, 20 bp, Homo sapiens
caactcgggggcgcctggag

SEQ ID NO: 6686045 - DNA, 17 bp, Homo sapiens
caactctaacaggcact

SEQ ID NO: 6686046 - DNA, 16 bp, Homo sapiens
caactctacccctgct

SEQ ID NO: 6686047 - DNA, 19 bp, Homo sapiens
caactctatactcaatcaa

SEQ ID NO: 6686048 - DNA, 21 bp, Homo sapiens
caactctcccaaagggcacac

SEQ ID NO: 6686049 - DNA, 20 bp, Homo sapiens
caactctccccagtgcctgc

SEQ ID NO: 6686050 - DNA, 18 bp, Homo sapiens
caactctctctgccccca

SEQ ID NO: 6686051 - DNA, 22 bp, Homo sapiens
caactctcttattgcctcactt

SEQ ID NO: 6686052 - DNA, 23 bp, Homo sapiens
caactctgaagctaattgtacta

SEQ ID NO: 6686053 - DNA, 14 bp, Homo sapiens
caactctgactctt

SEQ ID NO: 6686054 - DNA, 18 bp, Homo sapiens
caactctgactgtaaaat

SEQ ID NO: 6686055 - DNA, 16 bp, Homo sapiens
caactctgagcccata

SEQ ID NO: 6686056 - DNA, 12 bp, Homo sapiens
caactctgcact

SEQ ID NO: 6686057 - DNA, 14 bp, Homo sapiens
caactctgcactcc

SEQ ID NO: 6686058 - DNA, 21 bp, Homo sapiens
caactctgctgagggtccaga

SEQ ID NO: 6686059 - DNA, 15 bp, Homo sapiens
caactctggccttgg

SEQ ID NO: 6686060 - DNA, 13 bp, Homo sapiens
caactctgtcccc

SEQ ID NO: 6686061 - DNA, 18 bp, Homo sapiens
caactctgtgtcccagca

SEQ ID NO: 6686062 - DNA, 17 bp, Homo sapiens
caactcttatttctttc

SEQ ID NO: 6686063 - DNA, 19 bp, Homo sapiens
caactcttccacctctggg

SEQ ID NO: 6686064 - DNA, 18 bp, Homo sapiens
caactcttcctcccctct

SEQ ID NO: 6686065 - DNA, 12 bp, Homo sapiens
caactcttgatt

SEQ ID NO: 6686066 - DNA, 16 bp, Homo sapiens
caactcttgattatcc

SEQ ID NO: 6686067 - DNA, 13 bp, Homo sapiens
caactctttgtta

SEQ ID NO: 6686068 - DNA, 19 bp, Homo sapiens
caactcttttaagtgcctt

SEQ ID NO: 6686069 - DNA, 13 bp, Homo sapiens
caactgaaaagac

SEQ ID NO: 6686070 - DNA, 14 bp, Homo sapiens
caactgaaaagact

SEQ ID NO: 6686071 - DNA, 19 bp, Homo sapiens
caactgaaagtgtttcctt

SEQ ID NO: 6686072 - DNA, 22 bp, Homo sapiens
caactgaaagtgtttccttcat

SEQ ID NO: 6686073 - DNA, 14 bp, Homo sapiens
caactgaacaaaaa

SEQ ID NO: 6686074 - DNA, 23 bp, Homo sapiens
caactgaacgaccttacaaatga

SEQ ID NO: 6686075 - DNA, 14 bp, Homo sapiens
caactgaagataac

SEQ ID NO: 6686076 - DNA, 23 bp, Homo sapiens
caactgaagccttcttctgccac

SEQ ID NO: 6686077 - DNA, 24 bp, Homo sapiens
caactgaagccttcttctgccact

SEQ ID NO: 6686078 - DNA, 23 bp, Homo sapiens
caactgaaggggtgcacccacct

SEQ ID NO: 6686079 - DNA, 16 bp, Homo sapiens
caactgaataaattca

SEQ ID NO: 6686080 - DNA, 20 bp, Homo sapiens
caactgaattgctatcattt

SEQ ID NO: 6686081 - DNA, 15 bp, Homo sapiens
caactgacacaggaa

SEQ ID NO: 6686082 - DNA, 22 bp, Homo sapiens
caactgacactcccacccagtc

SEQ ID NO: 6686083 - DNA, 17 bp, Homo sapiens
caactgaccagcctcca

SEQ ID NO: 6686084 - DNA, 19 bp, Homo sapiens
caactgaccagcctccatg

SEQ ID NO: 6686085 - DNA, 15 bp, Homo sapiens
caactgacctgccag

SEQ ID NO: 6686086 - DNA, 17 bp, Homo sapiens
caactgacctgccagcc

SEQ ID NO: 6686087 - DNA, 17 bp, Homo sapiens
caactgacttctgctag

SEQ ID NO: 6686088 - DNA, 16 bp, Homo sapiens
caactgagaagccaag

SEQ ID NO: 6686089 - DNA, 16 bp, Homo sapiens
caactgagatgttaaa

SEQ ID NO: 6686090 - DNA, 15 bp, Homo sapiens
caactgagccaaaaa

SEQ ID NO: 6686091 - DNA, 13 bp, Homo sapiens
caactgaggcaga

SEQ ID NO: 6686092 - DNA, 20 bp, Homo sapiens
caactgaggcagacagcagc

SEQ ID NO: 6686093 - DNA, 14 bp, Homo sapiens
caactgagggccag

SEQ ID NO: 6686094 - DNA, 18 bp, Homo sapiens
caactgagggccagggac

SEQ ID NO: 6686095 - DNA, 20 bp, Homo sapiens
caactgagggccagggaccc

SEQ ID NO: 6686096 - DNA, 18 bp, Homo sapiens
caactgaggttcttggga

SEQ ID NO: 6686097 - DNA, 16 bp, Homo sapiens
caactgatcatttgca

SEQ ID NO: 6686098 - DNA, 13 bp, Homo sapiens
caactgatcctgc

SEQ ID NO: 6686099 - DNA, 19 bp, Homo sapiens
caactgatcctgctccagc

SEQ ID NO: 6686100 - DNA, 21 bp, Homo sapiens
caactgatcctgctccagcag

SEQ ID NO: 6686101 - DNA, 24 bp, Homo sapiens
caactgatcctgctccagcagcac

SEQ ID NO: 6686102 - DNA, 14 bp, Homo sapiens
caactgatctgtta

SEQ ID NO: 6686103 - DNA, 12 bp, Homo sapiens
caactgattgca

SEQ ID NO: 6686104 - DNA, 16 bp, Homo sapiens
caactgattttgtatg

SEQ ID NO: 6686105 - DNA, 18 bp, Homo sapiens
caactgcaaaaaaagcct

SEQ ID NO: 6686106 - DNA, 20 bp, Homo sapiens
caactgcaaaaaaagcctcc

SEQ ID NO: 6686107 - DNA, 22 bp, Homo sapiens
caactgcaaaaaaagcctccaa

SEQ ID NO: 6686108 - DNA, 19 bp, Homo sapiens
caactgcaaagaaagtggg

SEQ ID NO: 6686109 - DNA, 12 bp, Homo sapiens
caactgcaactc

SEQ ID NO: 6686110 - DNA, 21 bp, Homo sapiens
caactgcaagaaaggggaccc

SEQ ID NO: 6686111 - DNA, 19 bp, Homo sapiens
caactgcaataacttctga

SEQ ID NO: 6686112 - DNA, 23 bp, Homo sapiens
caactgcaataacttctgacctt

SEQ ID NO: 6686113 - DNA, 16 bp, Homo sapiens
caactgcaggaatgct

SEQ ID NO: 6686114 - DNA, 16 bp, Homo sapiens
caactgcattggcttt

SEQ ID NO: 6686115 - DNA, 14 bp, Homo sapiens
caactgccaaataa

SEQ ID NO: 6686116 - DNA, 18 bp, Homo sapiens
caactgccaaataaaatg

SEQ ID NO: 6686117 - DNA, 20 bp, Homo sapiens
caactgccaaataaaatgtt

SEQ ID NO: 6686118 - DNA, 15 bp, Homo sapiens
caactgccaggctgc

SEQ ID NO: 6686119 - DNA, 21 bp, Homo sapiens
caactgccaggctgcctcctg

SEQ ID NO: 6686120 - DNA, 15 bp, Homo sapiens
caactgccccagggg

SEQ ID NO: 6686121 - DNA, 15 bp, Homo sapiens
caactgccccgggtg

SEQ ID NO: 6686122 - DNA, 19 bp, Homo sapiens
caactgcccttccaggtgg

SEQ ID NO: 6686123 - DNA, 22 bp, Homo sapiens
caactgcctactccaaaatgtt

SEQ ID NO: 6686124 - DNA, 17 bp, Homo sapiens
caactgcctccttgcca

SEQ ID NO: 6686125 - DNA, 21 bp, Homo sapiens
caactgcctccttgccagccc

SEQ ID NO: 6686126 - DNA, 21 bp, Homo sapiens
caactgcctcgaaacacagaa

SEQ ID NO: 6686127 - DNA, 23 bp, Homo sapiens
caactgcctcgaaacacagaaac

SEQ ID NO: 6686128 - DNA, 13 bp, Homo sapiens
caactgcctgcct

SEQ ID NO: 6686129 - DNA, 18 bp, Homo sapiens
caactgcgacaaaacatt

SEQ ID NO: 6686130 - DNA, 13 bp, Homo sapiens
caactgctcagct

SEQ ID NO: 6686131 - DNA, 13 bp, Homo sapiens
caactgctccagc

SEQ ID NO: 6686132 - DNA, 17 bp, Homo sapiens
caactgctccagcctct

SEQ ID NO: 6686133 - DNA, 19 bp, Homo sapiens
caactgctccagcctctgc

SEQ ID NO: 6686134 - DNA, 22 bp, Homo sapiens
caactgctccagcctctgccgc

SEQ ID NO: 6686135 - DNA, 11 bp, Homo sapiens
caactgctccc

SEQ ID NO: 6686136 - DNA, 14 bp, Homo sapiens
caactgctcccacc

SEQ ID NO: 6686137 - DNA, 15 bp, Homo sapiens
caactgctctcaaaa

SEQ ID NO: 6686138 - DNA, 20 bp, Homo sapiens
caactgctgatgctcatggt

SEQ ID NO: 6686139 - DNA, 12 bp, Homo sapiens
caactgctgctt

SEQ ID NO: 6686140 - DNA, 13 bp, Homo sapiens
caactgctgtaaa

SEQ ID NO: 6686141 - DNA, 23 bp, Homo sapiens
caactggaaaagtgttccttgct

SEQ ID NO: 6686142 - DNA, 13 bp, Homo sapiens
caactggaagctt

SEQ ID NO: 6686143 - DNA, 14 bp, Homo sapiens
caactggaagcttt

SEQ ID NO: 6686144 - DNA, 21 bp, Homo sapiens
caactggactatagcagggct

SEQ ID NO: 6686145 - DNA, 20 bp, Homo sapiens
caactggatgcatcaagaac

SEQ ID NO: 6686146 - DNA, 23 bp, Homo sapiens
caactggatgcatcaagaactat

SEQ ID NO: 6686147 - DNA, 12 bp, Homo sapiens
caactggcaggc

SEQ ID NO: 6686148 - DNA, 14 bp, Homo sapiens
caactggcaggcag

SEQ ID NO: 6686149 - DNA, 23 bp, Homo sapiens
caactggccctatttagatgata

SEQ ID NO: 6686150 - DNA, 23 bp, Homo sapiens
caactggccctcttcttacttga

SEQ ID NO: 6686151 - DNA, 14 bp, Homo sapiens
caactggctgggac

SEQ ID NO: 6686152 - DNA, 17 bp, Homo sapiens
caactggcttctgtgca

SEQ ID NO: 6686153 - DNA, 17 bp, Homo sapiens
caactgggcatttcaat

SEQ ID NO: 6686154 - DNA, 17 bp, Homo sapiens
caactggggaaaaggat

SEQ ID NO: 6686155 - DNA, 19 bp, Homo sapiens
caactggggggaccaaata

SEQ ID NO: 6686156 - DNA, 20 bp, Homo sapiens
caactggggggaccaaatag

SEQ ID NO: 6686157 - DNA, 16 bp, Homo sapiens
caactggtatatattt

SEQ ID NO: 6686158 - DNA, 12 bp, Homo sapiens
caactggttcag

SEQ ID NO: 6686159 - DNA, 19 bp, Homo sapiens
caactgtataccgtgtgct

SEQ ID NO: 6686160 - DNA, 13 bp, Homo sapiens
caactgtatttat

SEQ ID NO: 6686161 - DNA, 15 bp, Homo sapiens
caactgtcagttcat

SEQ ID NO: 6686162 - DNA, 18 bp, Homo sapiens
caactgtcttatttaatg

SEQ ID NO: 6686163 - DNA, 19 bp, Homo sapiens
caactgtgaatatgagaaa

SEQ ID NO: 6686164 - DNA, 23 bp, Homo sapiens
caactgtgaatatgagaaataca

SEQ ID NO: 6686165 - DNA, 14 bp, Homo sapiens
caactgtggataaa

SEQ ID NO: 6686166 - DNA, 13 bp, Homo sapiens
caactgtggctgg

SEQ ID NO: 6686167 - DNA, 12 bp, Homo sapiens
caactgtgttgt

SEQ ID NO: 6686168 - DNA, 14 bp, Homo sapiens
caactgtgttgtat

SEQ ID NO: 6686169 - DNA, 15 bp, Homo sapiens
caactgtgttgtatt

SEQ ID NO: 6686170 - DNA, 17 bp, Homo sapiens
caactgtgttgtattaa

SEQ ID NO: 6686171 - DNA, 17 bp, Homo sapiens
caactgttgccaggaga

SEQ ID NO: 6686172 - DNA, 18 bp, Homo sapiens
caactgttggattcagaa

SEQ ID NO: 6686173 - DNA, 18 bp, Homo sapiens
caactgttttaaaacttt

SEQ ID NO: 6686174 - DNA, 22 bp, Homo sapiens
caactgttttaaaactttaaga

SEQ ID NO: 6686175 - DNA, 18 bp, Homo sapiens
caacttaaacctgtgctt

SEQ ID NO: 6686176 - DNA, 23 bp, Homo sapiens
caacttaaacctgtgctttcatg

SEQ ID NO: 6686177 - DNA, 21 bp, Homo sapiens
caacttaaagtgaattgtctt

SEQ ID NO: 6686178 - DNA, 16 bp, Homo sapiens
caacttaatacaaaac

SEQ ID NO: 6686179 - DNA, 22 bp, Homo sapiens
caacttaatactcaaatgagta

SEQ ID NO: 6686180 - DNA, 21 bp, Homo sapiens
caacttaatgaagaaatacag

SEQ ID NO: 6686181 - DNA, 15 bp, Homo sapiens
caacttagaaaccaa

SEQ ID NO: 6686182 - DNA, 21 bp, Homo sapiens
caacttagatctctcctgcaa

SEQ ID NO: 6686183 - DNA, 14 bp, Homo sapiens
caacttagctcagg

SEQ ID NO: 6686184 - DNA, 20 bp, Homo sapiens
caacttagctcaggtgcctt

SEQ ID NO: 6686185 - DNA, 19 bp, Homo sapiens
caacttagtcaataagaaa

SEQ ID NO: 6686186 - DNA, 13 bp, Homo sapiens
caacttatgacta

SEQ ID NO: 6686187 - DNA, 14 bp, Homo sapiens
caacttatggactc

SEQ ID NO: 6686188 - DNA, 20 bp, Homo sapiens
caacttatttaaaaatattt

SEQ ID NO: 6686189 - DNA, 21 bp, Homo sapiens
caacttatttaaaaatatttc

SEQ ID NO: 6686190 - DNA, 17 bp, Homo sapiens
caacttatttcataatt

SEQ ID NO: 6686191 - DNA, 14 bp, Homo sapiens
caacttatttctga

SEQ ID NO: 6686192 - DNA, 15 bp, Homo sapiens
caacttattttgctt

SEQ ID NO: 6686193 - DNA, 16 bp, Homo sapiens
caacttcaccaccccc

SEQ ID NO: 6686194 - DNA, 14 bp, Homo sapiens
caacttcagcaggg

SEQ ID NO: 6686195 - DNA, 14 bp, Homo sapiens
caacttcagtccaa

SEQ ID NO: 6686196 - DNA, 16 bp, Homo sapiens
caacttcatctggaag

SEQ ID NO: 6686197 - DNA, 16 bp, Homo sapiens
caacttccaagacaag

SEQ ID NO: 6686198 - DNA, 15 bp, Homo sapiens
caacttccagaggac

SEQ ID NO: 6686199 - DNA, 24 bp, Homo sapiens
caacttccagaggacagctctggg

SEQ ID NO: 6686200 - DNA, 16 bp, Homo sapiens
caacttccagatttga

SEQ ID NO: 6686201 - DNA, 11 bp, Homo sapiens
caacttcccaa

SEQ ID NO: 6686202 - DNA, 20 bp, Homo sapiens
caacttcccattaaaaatga

SEQ ID NO: 6686203 - DNA, 14 bp, Homo sapiens
caacttcccctcta

SEQ ID NO: 6686204 - DNA, 22 bp, Homo sapiens
caacttccccttagagtgctgt

SEQ ID NO: 6686205 - DNA, 15 bp, Homo sapiens
caacttcctgtggcc

SEQ ID NO: 6686206 - DNA, 23 bp, Homo sapiens
caacttcgctagaaaaaaaaaac

SEQ ID NO: 6686207 - DNA, 14 bp, Homo sapiens
caacttcgtttcct

SEQ ID NO: 6686208 - DNA, 18 bp, Homo sapiens
caacttctatcctttctt

SEQ ID NO: 6686209 - DNA, 15 bp, Homo sapiens
caacttctcccaccc

SEQ ID NO: 6686210 - DNA, 21 bp, Homo sapiens
caacttctcccaccccttggc

SEQ ID NO: 6686211 - DNA, 15 bp, Homo sapiens
caacttctcttgctt

SEQ ID NO: 6686212 - DNA, 21 bp, Homo sapiens
caacttctgaatattggacat

SEQ ID NO: 6686213 - DNA, 14 bp, Homo sapiens
caacttctggctcc

SEQ ID NO: 6686214 - DNA, 23 bp, Homo sapiens
caacttcttacccgaaagcatca

SEQ ID NO: 6686215 - DNA, 20 bp, Homo sapiens
caacttctttttattttctt

SEQ ID NO: 6686216 - DNA, 23 bp, Homo sapiens
caacttgaaattatatctgtggt

SEQ ID NO: 6686217 - DNA, 12 bp, Homo sapiens
caacttgaagaa

SEQ ID NO: 6686218 - DNA, 19 bp, Homo sapiens
caacttgaagaaacgcttc

SEQ ID NO: 6686219 - DNA, 18 bp, Homo sapiens
caacttgaaggattgcat

SEQ ID NO: 6686220 - DNA, 21 bp, Homo sapiens
caacttgaaggattgcatcct

SEQ ID NO: 6686221 - DNA, 23 bp, Homo sapiens
caacttgaaggattgcatcctgc

SEQ ID NO: 6686222 - DNA, 14 bp, Homo sapiens
caacttgaattaca

SEQ ID NO: 6686223 - DNA, 15 bp, Homo sapiens
caacttgaattacaa

SEQ ID NO: 6686224 - DNA, 15 bp, Homo sapiens
caacttgacaccact

SEQ ID NO: 6686225 - DNA, 22 bp, Homo sapiens
caacttgagatgtatgaaggct

SEQ ID NO: 6686226 - DNA, 18 bp, Homo sapiens
caacttgagcatgttact

SEQ ID NO: 6686227 - DNA, 20 bp, Homo sapiens
caacttgagcatgttactga

SEQ ID NO: 6686228 - DNA, 19 bp, Homo sapiens
caacttgagggcccagagc

SEQ ID NO: 6686229 - DNA, 15 bp, Homo sapiens
caacttgatgtgaaa

SEQ ID NO: 6686230 - DNA, 22 bp, Homo sapiens
caacttgatgttccacctgcca

SEQ ID NO: 6686231 - DNA, 16 bp, Homo sapiens
caacttgattttttca

SEQ ID NO: 6686232 - DNA, 19 bp, Homo sapiens
caacttgcaaaatcagttt

SEQ ID NO: 6686233 - DNA, 14 bp, Homo sapiens
caacttgcaagggc

SEQ ID NO: 6686234 - DNA, 12 bp, Homo sapiens
caacttgccttt

SEQ ID NO: 6686235 - DNA, 20 bp, Homo sapiens
caacttgctacttatcattt

SEQ ID NO: 6686236 - DNA, 15 bp, Homo sapiens
caacttgctcctttc

SEQ ID NO: 6686237 - DNA, 21 bp, Homo sapiens
caacttgctcctttccatcag

SEQ ID NO: 6686238 - DNA, 13 bp, Homo sapiens
caacttgcttcta

SEQ ID NO: 6686239 - DNA, 15 bp, Homo sapiens
caacttgcttctaaa

SEQ ID NO: 6686240 - DNA, 12 bp, Homo sapiens
caacttggaaaa

SEQ ID NO: 6686241 - DNA, 19 bp, Homo sapiens
caacttggaaaaagaaaga

SEQ ID NO: 6686242 - DNA, 21 bp, Homo sapiens
caacttggaaaaagaaagaaa

SEQ ID NO: 6686243 - DNA, 22 bp, Homo sapiens
caacttggaagatctacctgca

SEQ ID NO: 6686244 - DNA, 17 bp, Homo sapiens
caacttggctttcccgg

SEQ ID NO: 6686245 - DNA, 17 bp, Homo sapiens
caacttggttctgcttc

SEQ ID NO: 6686246 - DNA, 18 bp, Homo sapiens
caacttggttctgcttca

SEQ ID NO: 6686247 - DNA, 16 bp, Homo sapiens
caacttgtaaatacac

SEQ ID NO: 6686248 - DNA, 16 bp, Homo sapiens
caacttgtacttgttt

SEQ ID NO: 6686249 - DNA, 18 bp, Homo sapiens
caacttgtagcagctata

SEQ ID NO: 6686250 - DNA, 17 bp, Homo sapiens
caacttgtcacccaaag

SEQ ID NO: 6686251 - DNA, 19 bp, Homo sapiens
caacttgtcctagcacaga

SEQ ID NO: 6686252 - DNA, 20 bp, Homo sapiens
caacttgtcctagcacagat

SEQ ID NO: 6686253 - DNA, 17 bp, Homo sapiens
caacttgtctttttctg

SEQ ID NO: 6686254 - DNA, 12 bp, Homo sapiens
caacttgtgtac

SEQ ID NO: 6686255 - DNA, 21 bp, Homo sapiens
caacttgttgtggctcttatt

SEQ ID NO: 6686256 - DNA, 21 bp, Homo sapiens
caactttaagcagctcttgct

SEQ ID NO: 6686257 - DNA, 21 bp, Homo sapiens
caactttaccataaagccttt

SEQ ID NO: 6686258 - DNA, 13 bp, Homo sapiens
caactttactgta

SEQ ID NO: 6686259 - DNA, 12 bp, Homo sapiens
caactttagaaa

SEQ ID NO: 6686260 - DNA, 16 bp, Homo sapiens
caactttagaaagaaa

SEQ ID NO: 6686261 - DNA, 24 bp, Homo sapiens
caactttagctagtatcttcaaac

SEQ ID NO: 6686262 - DNA, 19 bp, Homo sapiens
caactttagtatttttact

SEQ ID NO: 6686263 - DNA, 19 bp, Homo sapiens
caactttatcatggaattt

SEQ ID NO: 6686264 - DNA, 17 bp, Homo sapiens
caactttattttgaatg

SEQ ID NO: 6686265 - DNA, 20 bp, Homo sapiens
caactttattttgaatgtac

SEQ ID NO: 6686266 - DNA, 13 bp, Homo sapiens
caactttcacttc

SEQ ID NO: 6686267 - DNA, 17 bp, Homo sapiens
caactttcacttcttcc

SEQ ID NO: 6686268 - DNA, 18 bp, Homo sapiens
caactttcacttcttcct

SEQ ID NO: 6686269 - DNA, 18 bp, Homo sapiens
caactttcagaagtgcca

SEQ ID NO: 6686270 - DNA, 23 bp, Homo sapiens
caactttcatttgaaagtgggtt

SEQ ID NO: 6686271 - DNA, 21 bp, Homo sapiens
caactttccactgacaacgaa

SEQ ID NO: 6686272 - DNA, 14 bp, Homo sapiens
caactttccagact

SEQ ID NO: 6686273 - DNA, 15 bp, Homo sapiens
caactttccagactt

SEQ ID NO: 6686274 - DNA, 12 bp, Homo sapiens
caactttcctca

SEQ ID NO: 6686275 - DNA, 19 bp, Homo sapiens
caactttcctcaaatcaaa

SEQ ID NO: 6686276 - DNA, 20 bp, Homo sapiens
caactttctcactgctgtca

SEQ ID NO: 6686277 - DNA, 20 bp, Homo sapiens
caactttcttatctggaaat

SEQ ID NO: 6686278 - DNA, 14 bp, Homo sapiens
caactttgaataaa

SEQ ID NO: 6686279 - DNA, 12 bp, Homo sapiens
caactttggaaa

SEQ ID NO: 6686280 - DNA, 13 bp, Homo sapiens
caactttggaaaa

SEQ ID NO: 6686281 - DNA, 19 bp, Homo sapiens
caactttgtaaaaatcttt

SEQ ID NO: 6686282 - DNA, 12 bp, Homo sapiens
caactttgtata

SEQ ID NO: 6686283 - DNA, 21 bp, Homo sapiens
caacttttagtgggtgagaaa

SEQ ID NO: 6686284 - DNA, 15 bp, Homo sapiens
caacttttcatccag

SEQ ID NO: 6686285 - DNA, 20 bp, Homo sapiens
caacttttcctttgaatcct

SEQ ID NO: 6686286 - DNA, 17 bp, Homo sapiens
caacttttctgctacct

SEQ ID NO: 6686287 - DNA, 23 bp, Homo sapiens
caacttttcttggaactgtccca

SEQ ID NO: 6686288 - DNA, 20 bp, Homo sapiens
caactttttaattccatatc

SEQ ID NO: 6686289 - DNA, 14 bp, Homo sapiens
caactttttattgc

SEQ ID NO: 6686290 - DNA, 18 bp, Homo sapiens
caactttttattgccttc

SEQ ID NO: 6686291 - DNA, 20 bp, Homo sapiens
caactttttattgccttctc

SEQ ID NO: 6686292 - DNA, 23 bp, Homo sapiens
caactttttattgccttctcacc

SEQ ID NO: 6686293 - DNA, 17 bp, Homo sapiens
caacttttttttctttt

SEQ ID NO: 6686294 - DNA, 16 bp, Homo sapiens
caactttttttttccc

SEQ ID NO: 6686295 - DNA, 17 bp, Homo sapiens
caagaaaaaataaatgg

SEQ ID NO: 6686296 - DNA, 16 bp, Homo sapiens
caagaaaaataaagaa

SEQ ID NO: 6686297 - DNA, 18 bp, Homo sapiens
caagaaaaataaagaaaa

SEQ ID NO: 6686298 - DNA, 20 bp, Homo sapiens
caagaaaaataaagaaaaga

SEQ ID NO: 6686299 - DNA, 21 bp, Homo sapiens
caagaaaacaggcactgccct

SEQ ID NO: 6686300 - DNA, 12 bp, Homo sapiens
caagaaaactac

SEQ ID NO: 6686301 - DNA, 18 bp, Homo sapiens
caagaaaactcaaagaat

SEQ ID NO: 6686302 - DNA, 18 bp, Homo sapiens
caagaaaagaggaaaaaa

SEQ ID NO: 6686303 - DNA, 19 bp, Homo sapiens
caagaaaagaggaaaaaaa

SEQ ID NO: 6686304 - DNA, 19 bp, Homo sapiens
caagaaaagcgcagagaaa

SEQ ID NO: 6686305 - DNA, 18 bp, Homo sapiens
caagaaaataagagctca

SEQ ID NO: 6686306 - DNA, 20 bp, Homo sapiens
caagaaaataagagctcagg

SEQ ID NO: 6686307 - DNA, 12 bp, Homo sapiens
caagaaaatcag

SEQ ID NO: 6686308 - DNA, 13 bp, Homo sapiens
caagaaaatcttt

SEQ ID NO: 6686309 - DNA, 20 bp, Homo sapiens
caagaaaatctttgttgaag

SEQ ID NO: 6686310 - DNA, 22 bp, Homo sapiens
caagaaaattgcctttaaaact

SEQ ID NO: 6686311 - DNA, 13 bp, Homo sapiens
caagaaaattttg

SEQ ID NO: 6686312 - DNA, 14 bp, Homo sapiens
caagaaaattttgc

SEQ ID NO: 6686313 - DNA, 16 bp, Homo sapiens
caagaaaattttgcag

SEQ ID NO: 6686314 - DNA, 22 bp, Homo sapiens
caagaaacaatgtctggggaca

SEQ ID NO: 6686315 - DNA, 13 bp, Homo sapiens
caagaaacagcca

SEQ ID NO: 6686316 - DNA, 16 bp, Homo sapiens
caagaaacagtttctt

SEQ ID NO: 6686317 - DNA, 19 bp, Homo sapiens
caagaaaccaagtgggctg

SEQ ID NO: 6686318 - DNA, 16 bp, Homo sapiens
caagaaacctgactca

SEQ ID NO: 6686319 - DNA, 15 bp, Homo sapiens
caagaaactcacccc

SEQ ID NO: 6686320 - DNA, 15 bp, Homo sapiens
caagaaactgaatga

SEQ ID NO: 6686321 - DNA, 12 bp, Homo sapiens
caagaaactgtc

SEQ ID NO: 6686322 - DNA, 17 bp, Homo sapiens
caagaaactttggaagc

SEQ ID NO: 6686323 - DNA, 15 bp, Homo sapiens
caagaaactttgtaa

SEQ ID NO: 6686324 - DNA, 12 bp, Homo sapiens
caagaaagaaac

SEQ ID NO: 6686325 - DNA, 16 bp, Homo sapiens
caagaaagaaatggct

SEQ ID NO: 6686326 - DNA, 20 bp, Homo sapiens
caagaaagagggtcccaggg

SEQ ID NO: 6686327 - DNA, 21 bp, Homo sapiens
caagaaagccgtactgtctat

SEQ ID NO: 6686328 - DNA, 19 bp, Homo sapiens
caagaaagcttcttcagag

SEQ ID NO: 6686329 - DNA, 12 bp, Homo sapiens
caagaaaggaga

SEQ ID NO: 6686330 - DNA, 14 bp, Homo sapiens
caagaaaggagagt

SEQ ID NO: 6686331 - DNA, 13 bp, Homo sapiens
caagaaataaaag

SEQ ID NO: 6686332 - DNA, 20 bp, Homo sapiens
caagaaatatactctcccag

SEQ ID NO: 6686333 - DNA, 22 bp, Homo sapiens
caagaaatccagtttcccacca

SEQ ID NO: 6686334 - DNA, 23 bp, Homo sapiens
caagaaatcgccttatgagaaca

SEQ ID NO: 6686335 - DNA, 12 bp, Homo sapiens
caagaaatgaag

SEQ ID NO: 6686336 - DNA, 17 bp, Homo sapiens
caagaaatgaagagctg

SEQ ID NO: 6686337 - DNA, 12 bp, Homo sapiens
caagaaatggcg

SEQ ID NO: 6686338 - DNA, 21 bp, Homo sapiens
caagaaatggcgtctgctctg

SEQ ID NO: 6686339 - DNA, 22 bp, Homo sapiens
caagaaatggcgtctgctctgg

SEQ ID NO: 6686340 - DNA, 17 bp, Homo sapiens
caagaaatgtctctgct

SEQ ID NO: 6686341 - DNA, 17 bp, Homo sapiens
caagaaattcattaaag

SEQ ID NO: 6686342 - DNA, 23 bp, Homo sapiens
caagaaattcattaaagaaaaac

SEQ ID NO: 6686343 - DNA, 15 bp, Homo sapiens
caagaaattctgctg

SEQ ID NO: 6686344 - DNA, 23 bp, Homo sapiens
caagaacaacaacaacaataaca

SEQ ID NO: 6686345 - DNA, 15 bp, Homo sapiens
caagaacaagcaatg

SEQ ID NO: 6686346 - DNA, 17 bp, Homo sapiens
caagaacacacacatat

SEQ ID NO: 6686347 - DNA, 20 bp, Homo sapiens
caagaacacagccctgcttc

SEQ ID NO: 6686348 - DNA, 17 bp, Homo sapiens
caagaacagcaggccca

SEQ ID NO: 6686349 - DNA, 17 bp, Homo sapiens
caagaacattatcttag

SEQ ID NO: 6686350 - DNA, 17 bp, Homo sapiens
caagaaccactccttca

SEQ ID NO: 6686351 - DNA, 14 bp, Homo sapiens
caagaaccatttgc

SEQ ID NO: 6686352 - DNA, 15 bp, Homo sapiens
caagaacctggaaaa

SEQ ID NO: 6686353 - DNA, 20 bp, Homo sapiens
caagaactcatcactgtggc

SEQ ID NO: 6686354 - DNA, 13 bp, Homo sapiens
caagaactccacc

SEQ ID NO: 6686355 - DNA, 21 bp, Homo sapiens
caagaactccacccccagagg

SEQ ID NO: 6686356 - DNA, 15 bp, Homo sapiens
caagaactcctccca

SEQ ID NO: 6686357 - DNA, 22 bp, Homo sapiens
caagaactcctcccacccaact

SEQ ID NO: 6686358 - DNA, 17 bp, Homo sapiens
caagaactcctgaaatc

SEQ ID NO: 6686359 - DNA, 16 bp, Homo sapiens
caagaactgaaaacat

SEQ ID NO: 6686360 - DNA, 13 bp, Homo sapiens
caagaactgcaga

SEQ ID NO: 6686361 - DNA, 18 bp, Homo sapiens
caagaactgcatggacct

SEQ ID NO: 6686362 - DNA, 10 bp, Homo sapiens
caagaacttg

SEQ ID NO: 6686363 - DNA, 13 bp, Homo sapiens
caagaacttgttt

SEQ ID NO: 6686364 - DNA, 15 bp, Homo sapiens
caagaacttgtttac

SEQ ID NO: 6686365 - DNA, 18 bp, Homo sapiens
caagaagaaatatgaaat

SEQ ID NO: 6686366 - DNA, 20 bp, Homo sapiens
caagaagaaatatgaaattc

SEQ ID NO: 6686367 - DNA, 13 bp, Homo sapiens
caagaagaatata

SEQ ID NO: 6686368 - DNA, 12 bp, Homo sapiens
caagaagacatg

SEQ ID NO: 6686369 - DNA, 18 bp, Homo sapiens
caagaagacatggagact

SEQ ID NO: 6686370 - DNA, 13 bp, Homo sapiens
caagaagaccaga

SEQ ID NO: 6686371 - DNA, 14 bp, Homo sapiens
caagaagaccccgc

SEQ ID NO: 6686372 - DNA, 20 bp, Homo sapiens
caagaagataggctctcagt

SEQ ID NO: 6686373 - DNA, 20 bp, Homo sapiens
caagaagatcacgctccccg

SEQ ID NO: 6686374 - DNA, 21 bp, Homo sapiens
caagaagatcacgctccccgc

SEQ ID NO: 6686375 - DNA, 13 bp, Homo sapiens
caagaagatgaat

SEQ ID NO: 6686376 - DNA, 18 bp, Homo sapiens
caagaagatgaatggcgt

SEQ ID NO: 6686377 - DNA, 18 bp, Homo sapiens
caagaagcaattatttaa

SEQ ID NO: 6686378 - DNA, 16 bp, Homo sapiens
caagaagcagcctgtt

SEQ ID NO: 6686379 - DNA, 15 bp, Homo sapiens
caagaagcaggaagg

SEQ ID NO: 6686380 - DNA, 14 bp, Homo sapiens
caagaagcagtggc

SEQ ID NO: 6686381 - DNA, 14 bp, Homo sapiens
caagaagcccagga

SEQ ID NO: 6686382 - DNA, 18 bp, Homo sapiens
caagaagcccaggaaagg

SEQ ID NO: 6686383 - DNA, 13 bp, Homo sapiens
caagaagcccagt

SEQ ID NO: 6686384 - DNA, 15 bp, Homo sapiens
caagaagcctttcct

SEQ ID NO: 6686385 - DNA, 20 bp, Homo sapiens
caagaagcgccgactccctg

SEQ ID NO: 6686386 - DNA, 21 bp, Homo sapiens
caagaagcgccgactccctga

SEQ ID NO: 6686387 - DNA, 15 bp, Homo sapiens
caagaagctcccaga

SEQ ID NO: 6686388 - DNA, 16 bp, Homo sapiens
caagaagctcccagat

SEQ ID NO: 6686389 - DNA, 13 bp, Homo sapiens
caagaagctgcta

SEQ ID NO: 6686390 - DNA, 22 bp, Homo sapiens
caagaagctttaatatttaaat

SEQ ID NO: 6686391 - DNA, 17 bp, Homo sapiens
caagaaggaaggaggca

SEQ ID NO: 6686392 - DNA, 19 bp, Homo sapiens
caagaaggaaggaggcaga

SEQ ID NO: 6686393 - DNA, 17 bp, Homo sapiens
caagaaggatgattcaa

SEQ ID NO: 6686394 - DNA, 16 bp, Homo sapiens
caagaaggcaaaaata

SEQ ID NO: 6686395 - DNA, 20 bp, Homo sapiens
caagaaggcaacttgaagaa

SEQ ID NO: 6686396 - DNA, 21 bp, Homo sapiens
caagaaggcaacttgaagaaa

SEQ ID NO: 6686397 - DNA, 22 bp, Homo sapiens
caagaaggccagcccactgggc

SEQ ID NO: 6686398 - DNA, 13 bp, Homo sapiens
caagaaggctggg

SEQ ID NO: 6686399 - DNA, 16 bp, Homo sapiens
caagaagggactgaga

SEQ ID NO: 6686400 - DNA, 12 bp, Homo sapiens
caagaagggctg

SEQ ID NO: 6686401 - DNA, 14 bp, Homo sapiens
caagaagggctgca

SEQ ID NO: 6686402 - DNA, 15 bp, Homo sapiens
caagaagggctgcat

SEQ ID NO: 6686403 - DNA, 20 bp, Homo sapiens
caagaaggggacagcgccac

SEQ ID NO: 6686404 - DNA, 21 bp, Homo sapiens
caagaaggggctcgagtgccc

SEQ ID NO: 6686405 - DNA, 22 bp, Homo sapiens
caagaagggttttccaccctgg

SEQ ID NO: 6686406 - DNA, 15 bp, Homo sapiens
caagaaggtttctgt

SEQ ID NO: 6686407 - DNA, 22 bp, Homo sapiens
caagaagtctgtccatatgaaa

SEQ ID NO: 6686408 - DNA, 18 bp, Homo sapiens
caagaagtgggtgccctt

SEQ ID NO: 6686409 - DNA, 22 bp, Homo sapiens
caagaagtgggtgcccttggta

SEQ ID NO: 6686410 - DNA, 20 bp, Homo sapiens
caagaagttaaaaaacagct

SEQ ID NO: 6686411 - DNA, 21 bp, Homo sapiens
caagaagttctttgattctgt

SEQ ID NO: 6686412 - DNA, 14 bp, Homo sapiens
caagaagtttattc

SEQ ID NO: 6686413 - DNA, 12 bp, Homo sapiens
caagaataaaaa

SEQ ID NO: 6686414 - DNA, 15 bp, Homo sapiens
caagaataaaggcag

SEQ ID NO: 6686415 - DNA, 18 bp, Homo sapiens
caagaataaaggcagctg

SEQ ID NO: 6686416 - DNA, 19 bp, Homo sapiens
caagaataaaggcagctgt

SEQ ID NO: 6686417 - DNA, 21 bp, Homo sapiens
caagaataaaggcagctgttg

SEQ ID NO: 6686418 - DNA, 22 bp, Homo sapiens
caagaataaaggcagctgttgt

SEQ ID NO: 6686419 - DNA, 17 bp, Homo sapiens
caagaataatcacgctt

SEQ ID NO: 6686420 - DNA, 23 bp, Homo sapiens
caagaataatcacgctttcctga

SEQ ID NO: 6686421 - DNA, 17 bp, Homo sapiens
caagaataattttggaa

SEQ ID NO: 6686422 - DNA, 14 bp, Homo sapiens
caagaatacagaaa

SEQ ID NO: 6686423 - DNA, 22 bp, Homo sapiens
caagaatacagaaaatgctttt

SEQ ID NO: 6686424 - DNA, 15 bp, Homo sapiens
caagaatactactta

SEQ ID NO: 6686425 - DNA, 18 bp, Homo sapiens
caagaatagatgctgact

SEQ ID NO: 6686426 - DNA, 22 bp, Homo sapiens
caagaatagcatctgtacaaag

SEQ ID NO: 6686427 - DNA, 19 bp, Homo sapiens
caagaatagcattgtaaaa

SEQ ID NO: 6686428 - DNA, 17 bp, Homo sapiens
caagaatagttgtcaga

SEQ ID NO: 6686429 - DNA, 23 bp, Homo sapiens
caagaatagttgtcagaatatgt

SEQ ID NO: 6686430 - DNA, 18 bp, Homo sapiens
caagaatatggaggctgg

SEQ ID NO: 6686431 - DNA, 17 bp, Homo sapiens
caagaatattcaaatgt

SEQ ID NO: 6686432 - DNA, 20 bp, Homo sapiens
caagaatattgcaaaataca

SEQ ID NO: 6686433 - DNA, 17 bp, Homo sapiens
caagaatattgtatgtt

SEQ ID NO: 6686434 - DNA, 16 bp, Homo sapiens
caagaatattgtccct

SEQ ID NO: 6686435 - DNA, 14 bp, Homo sapiens
caagaatcagaaga

SEQ ID NO: 6686436 - DNA, 19 bp, Homo sapiens
caagaatcagaagaaaggc

SEQ ID NO: 6686437 - DNA, 15 bp, Homo sapiens
caagaatcagagaag

SEQ ID NO: 6686438 - DNA, 23 bp, Homo sapiens
caagaatcagtctatccacagag

SEQ ID NO: 6686439 - DNA, 18 bp, Homo sapiens
caagaatcagtgcaaaga

SEQ ID NO: 6686440 - DNA, 19 bp, Homo sapiens
caagaatcagtgcaaagat

SEQ ID NO: 6686441 - DNA, 14 bp, Homo sapiens
caagaatccacatt

SEQ ID NO: 6686442 - DNA, 15 bp, Homo sapiens
caagaatctagaaga

SEQ ID NO: 6686443 - DNA, 17 bp, Homo sapiens
caagaatctagaagatg

SEQ ID NO: 6686444 - DNA, 19 bp, Homo sapiens
caagaatctagaagatgtg

SEQ ID NO: 6686445 - DNA, 14 bp, Homo sapiens
caagaatgaaaaat

SEQ ID NO: 6686446 - DNA, 19 bp, Homo sapiens
caagaatgaaaaatataat

SEQ ID NO: 6686447 - DNA, 16 bp, Homo sapiens
caagaatgaaatgaat

SEQ ID NO: 6686448 - DNA, 23 bp, Homo sapiens
caagaatgaaatgaatgattcta

SEQ ID NO: 6686449 - DNA, 13 bp, Homo sapiens
caagaatgaaggt

SEQ ID NO: 6686450 - DNA, 21 bp, Homo sapiens
caagaatgaaggtttttgtaa

SEQ ID NO: 6686451 - DNA, 22 bp, Homo sapiens
caagaatgaaggtttttgtaaa

SEQ ID NO: 6686452 - DNA, 12 bp, Homo sapiens
caagaatgcagt

SEQ ID NO: 6686453 - DNA, 16 bp, Homo sapiens
caagaatgcattgata

SEQ ID NO: 6686454 - DNA, 16 bp, Homo sapiens
caagaatgctgaaacc

SEQ ID NO: 6686455 - DNA, 17 bp, Homo sapiens
caagaatggaagcctga

SEQ ID NO: 6686456 - DNA, 19 bp, Homo sapiens
caagaatggaagcctgaac

SEQ ID NO: 6686457 - DNA, 11 bp, Homo sapiens
caagaatgtac

SEQ ID NO: 6686458 - DNA, 14 bp, Homo sapiens
caagaatgtttcag

SEQ ID NO: 6686459 - DNA, 16 bp, Homo sapiens
caagaatgtttcagtt

SEQ ID NO: 6686460 - DNA, 18 bp, Homo sapiens
caagaattaaaactgagt

SEQ ID NO: 6686461 - DNA, 22 bp, Homo sapiens
caagaattataacagcaaggaa

SEQ ID NO: 6686462 - DNA, 19 bp, Homo sapiens
caagaattctagaaaattt

SEQ ID NO: 6686463 - DNA, 21 bp, Homo sapiens
caagaattctccaaaacaatt

SEQ ID NO: 6686464 - DNA, 22 bp, Homo sapiens
caagaattgaagcaggactaaa

SEQ ID NO: 6686465 - DNA, 21 bp, Homo sapiens
caagaatttcctgttggattt

SEQ ID NO: 6686466 - DNA, 17 bp, Homo sapiens
caagaatttctggaaga

SEQ ID NO: 6686467 - DNA, 19 bp, Homo sapiens
caagaatttctggaagaaa

SEQ ID NO: 6686468 - DNA, 20 bp, Homo sapiens
caagaatttctggaagaaag

SEQ ID NO: 6686469 - DNA, 23 bp, Homo sapiens
caagaatttcttggtaagaagcc

SEQ ID NO: 6686470 - DNA, 14 bp, Homo sapiens
caagacaaaccaag

SEQ ID NO: 6686471 - DNA, 15 bp, Homo sapiens
caagacaaactaaac

SEQ ID NO: 6686472 - DNA, 14 bp, Homo sapiens
caagacaaagcaaa

SEQ ID NO: 6686473 - DNA, 14 bp, Homo sapiens
caagacaaatcaac

SEQ ID NO: 6686474 - DNA, 19 bp, Homo sapiens
caagacaataattacattg

SEQ ID NO: 6686475 - DNA, 13 bp, Homo sapiens
caagacaatgaca

SEQ ID NO: 6686476 - DNA, 14 bp, Homo sapiens
caagacacagaata

SEQ ID NO: 6686477 - DNA, 13 bp, Homo sapiens
caagacacagtga

SEQ ID NO: 6686478 - DNA, 13 bp, Homo sapiens
caagacacccagt

SEQ ID NO: 6686479 - DNA, 21 bp, Homo sapiens
caagacacccagtggaaccaa

SEQ ID NO: 6686480 - DNA, 17 bp, Homo sapiens
caagacacgtggcctcg

SEQ ID NO: 6686481 - DNA, 20 bp, Homo sapiens
caagacactagttcagagga

SEQ ID NO: 6686482 - DNA, 20 bp, Homo sapiens
caagacagatgagcaggagc

SEQ ID NO: 6686483 - DNA, 21 bp, Homo sapiens
caagacagatgagcaggagct

SEQ ID NO: 6686484 - DNA, 13 bp, Homo sapiens
caagacagatgcc

SEQ ID NO: 6686485 - DNA, 22 bp, Homo sapiens
caagacagatgccccagagctg

SEQ ID NO: 6686486 - DNA, 16 bp, Homo sapiens
caagacagatggacac

SEQ ID NO: 6686487 - DNA, 17 bp, Homo sapiens
caagacagatggacact

SEQ ID NO: 6686488 - DNA, 17 bp, Homo sapiens
caagacagcagagccat

SEQ ID NO: 6686489 - DNA, 23 bp, Homo sapiens
caagacagcagcagcctgcacct

SEQ ID NO: 6686490 - DNA, 24 bp, Homo sapiens
caagacagcagcagcctgcacctg

SEQ ID NO: 6686491 - DNA, 21 bp, Homo sapiens
caagacagctcttcttgaaaa

SEQ ID NO: 6686492 - DNA, 13 bp, Homo sapiens
caagacagtcttt

SEQ ID NO: 6686493 - DNA, 12 bp, Homo sapiens
caagacagtggc

SEQ ID NO: 6686494 - DNA, 15 bp, Homo sapiens
caagacagtggttct

SEQ ID NO: 6686495 - DNA, 14 bp, Homo sapiens
caagacataatgca

SEQ ID NO: 6686496 - DNA, 14 bp, Homo sapiens
caagacatgtctgt

SEQ ID NO: 6686497 - DNA, 18 bp, Homo sapiens
caagacattgtcaataaa

SEQ ID NO: 6686498 - DNA, 12 bp, Homo sapiens
caagacatttct

SEQ ID NO: 6686499 - DNA, 23 bp, Homo sapiens
caagacatttctttctgttttgt

SEQ ID NO: 6686500 - DNA, 20 bp, Homo sapiens
caagacatttgctgaactca

SEQ ID NO: 6686501 - DNA, 11 bp, Homo sapiens
caagaccaaaa

SEQ ID NO: 6686502 - DNA, 13 bp, Homo sapiens
caagaccaaagag

SEQ ID NO: 6686503 - DNA, 21 bp, Homo sapiens
caagaccaaatcattgtatca

SEQ ID NO: 6686504 - DNA, 19 bp, Homo sapiens
caagaccaagcttagtcct

SEQ ID NO: 6686505 - DNA, 13 bp, Homo sapiens
caagaccaccagg

SEQ ID NO: 6686506 - DNA, 20 bp, Homo sapiens
caagaccaccagggtcccag

SEQ ID NO: 6686507 - DNA, 22 bp, Homo sapiens
caagaccaccagggtcccagga

SEQ ID NO: 6686508 - DNA, 18 bp, Homo sapiens
caagaccacggagggagc

SEQ ID NO: 6686509 - DNA, 22 bp, Homo sapiens
caagaccacggagggagcgaca

SEQ ID NO: 6686510 - DNA, 22 bp, Homo sapiens
caagaccagactcgccaacatg

SEQ ID NO: 6686511 - DNA, 15 bp, Homo sapiens
caagaccagcctgga

SEQ ID NO: 6686512 - DNA, 22 bp, Homo sapiens
caagaccaggctgcagcctcca

SEQ ID NO: 6686513 - DNA, 14 bp, Homo sapiens
caagaccatccctg

SEQ ID NO: 6686514 - DNA, 20 bp, Homo sapiens
caagaccatctctccctcct

SEQ ID NO: 6686515 - DNA, 22 bp, Homo sapiens
caagaccatttcacagaaaaca

SEQ ID NO: 6686516 - DNA, 14 bp, Homo sapiens
caagaccatttgta

SEQ ID NO: 6686517 - DNA, 23 bp, Homo sapiens
caagaccccaagaggaagttcag

SEQ ID NO: 6686518 - DNA, 20 bp, Homo sapiens
caagacccccatctctgcaa

SEQ ID NO: 6686519 - DNA, 15 bp, Homo sapiens
caagacccctgctcc

SEQ ID NO: 6686520 - DNA, 13 bp, Homo sapiens
caagaccctctca

SEQ ID NO: 6686521 - DNA, 22 bp, Homo sapiens
caagaccctctcaggctgtccc

SEQ ID NO: 6686522 - DNA, 14 bp, Homo sapiens
caagaccctgcctc

SEQ ID NO: 6686523 - DNA, 18 bp, Homo sapiens
caagaccgccccagggct

SEQ ID NO: 6686524 - DNA, 15 bp, Homo sapiens
caagacctaggctca

SEQ ID NO: 6686525 - DNA, 21 bp, Homo sapiens
caagacctagtcccctttcct

SEQ ID NO: 6686526 - DNA, 20 bp, Homo sapiens
caagacctcatctgcctgca

SEQ ID NO: 6686527 - DNA, 23 bp, Homo sapiens
caagacctcatctgcctgcagtg

SEQ ID NO: 6686528 - DNA, 14 bp, Homo sapiens
caagacctcttccc

SEQ ID NO: 6686529 - DNA, 18 bp, Homo sapiens
caagacctcttccctctg

SEQ ID NO: 6686530 - DNA, 20 bp, Homo sapiens
caagacctcttccctctggg

SEQ ID NO: 6686531 - DNA, 24 bp, Homo sapiens
caagacctcttccctctgggcctg

SEQ ID NO: 6686532 - DNA, 14 bp, Homo sapiens
caagacctgaaaat

SEQ ID NO: 6686533 - DNA, 13 bp, Homo sapiens
caagacctgactc

SEQ ID NO: 6686534 - DNA, 14 bp, Homo sapiens
caagacctgactca

SEQ ID NO: 6686535 - DNA, 22 bp, Homo sapiens
caagacctgttggttagctgga

SEQ ID NO: 6686536 - DNA, 17 bp, Homo sapiens
caagacctgttggttcc

SEQ ID NO: 6686537 - DNA, 23 bp, Homo sapiens
caagaccttacaaccacatttct

SEQ ID NO: 6686538 - DNA, 13 bp, Homo sapiens
caagaccttctcc

SEQ ID NO: 6686539 - DNA, 16 bp, Homo sapiens
caagaccttctccttc

SEQ ID NO: 6686540 - DNA, 21 bp, Homo sapiens
caagaccttctccttcacctt

SEQ ID NO: 6686541 - DNA, 16 bp, Homo sapiens
caagacgaggggcagg

SEQ ID NO: 6686542 - DNA, 13 bp, Homo sapiens
caagacgctgtgc

SEQ ID NO: 6686543 - DNA, 19 bp, Homo sapiens
caagacgctgtgctgccct

SEQ ID NO: 6686544 - DNA, 21 bp, Homo sapiens
caagacgctgtgctgccctgc

SEQ ID NO: 6686545 - DNA, 22 bp, Homo sapiens
caagacgctgtgctgccctgcc

SEQ ID NO: 6686546 - DNA, 23 bp, Homo sapiens
caagacggaggaggggaaggggc

SEQ ID NO: 6686547 - DNA, 16 bp, Homo sapiens
caagacggatccacag

SEQ ID NO: 6686548 - DNA, 23 bp, Homo sapiens
caagacgggatgattgcttgagc

SEQ ID NO: 6686549 - DNA, 13 bp, Homo sapiens
caagacgtaaaga

SEQ ID NO: 6686550 - DNA, 20 bp, Homo sapiens
caagacgtcctggaatgaag

SEQ ID NO: 6686551 - DNA, 20 bp, Homo sapiens
caagactaacctttgttcgt

SEQ ID NO: 6686552 - DNA, 17 bp, Homo sapiens
caagactagcctggcca

SEQ ID NO: 6686553 - DNA, 20 bp, Homo sapiens
caagactatctacaaaaatt

SEQ ID NO: 6686554 - DNA, 22 bp, Homo sapiens
caagactccctcgtcgagctgg

SEQ ID NO: 6686555 - DNA, 21 bp, Homo sapiens
caagactccgtctcaaaaaaa

SEQ ID NO: 6686556 - DNA, 18 bp, Homo sapiens
caagactctatgctctgg

SEQ ID NO: 6686557 - DNA, 20 bp, Homo sapiens
caagactctatgctctggaa

SEQ ID NO: 6686558 - DNA, 21 bp, Homo sapiens
caagactctatgctctggaaa

SEQ ID NO: 6686559 - DNA, 18 bp, Homo sapiens
caagactctgctctcctc

SEQ ID NO: 6686560 - DNA, 18 bp, Homo sapiens
caagactctttggacact

SEQ ID NO: 6686561 - DNA, 22 bp, Homo sapiens
caagactgaaatggcttctatg

SEQ ID NO: 6686562 - DNA, 17 bp, Homo sapiens
caagactgaagatggct

SEQ ID NO: 6686563 - DNA, 23 bp, Homo sapiens
caagactgaagatggcttttcct

SEQ ID NO: 6686564 - DNA, 14 bp, Homo sapiens
caagactgcaaact

SEQ ID NO: 6686565 - DNA, 23 bp, Homo sapiens
caagactgcaaacttttttatat

SEQ ID NO: 6686566 - DNA, 14 bp, Homo sapiens
caagactgcaagag

SEQ ID NO: 6686567 - DNA, 15 bp, Homo sapiens
caagactgcaagaga

SEQ ID NO: 6686568 - DNA, 12 bp, Homo sapiens
caagactgccag

SEQ ID NO: 6686569 - DNA, 13 bp, Homo sapiens
caagactgcctcc

SEQ ID NO: 6686570 - DNA, 15 bp, Homo sapiens
caagactgcctccct

SEQ ID NO: 6686571 - DNA, 12 bp, Homo sapiens
caagactgctgt

SEQ ID NO: 6686572 - DNA, 14 bp, Homo sapiens
caagactggcccag

SEQ ID NO: 6686573 - DNA, 16 bp, Homo sapiens
caagactggcccagtg

SEQ ID NO: 6686574 - DNA, 13 bp, Homo sapiens
caagactgggccc

SEQ ID NO: 6686575 - DNA, 12 bp, Homo sapiens
caagactgggct

SEQ ID NO: 6686576 - DNA, 14 bp, Homo sapiens
caagactgtaaatt

SEQ ID NO: 6686577 - DNA, 19 bp, Homo sapiens
caagactgtcattgcccct

SEQ ID NO: 6686578 - DNA, 21 bp, Homo sapiens
caagactgtcattgcccctcc

SEQ ID NO: 6686579 - DNA, 17 bp, Homo sapiens
caagacttattttcaca

SEQ ID NO: 6686580 - DNA, 18 bp, Homo sapiens
caagacttcactgcagcc

SEQ ID NO: 6686581 - DNA, 21 bp, Homo sapiens
caagacttcagtatgttgtca

SEQ ID NO: 6686582 - DNA, 21 bp, Homo sapiens
caagacttcgggaaggtgtct

SEQ ID NO: 6686583 - DNA, 20 bp, Homo sapiens
caagactttagcttttcctt

SEQ ID NO: 6686584 - DNA, 22 bp, Homo sapiens
caagactttagttaccgagaca

SEQ ID NO: 6686585 - DNA, 16 bp, Homo sapiens
caagactttgatcctt

SEQ ID NO: 6686586 - DNA, 20 bp, Homo sapiens
caagactttgatccttggaa

SEQ ID NO: 6686587 - DNA, 21 bp, Homo sapiens
caagactttgatccttggaaa

SEQ ID NO: 6686588 - DNA, 18 bp, Homo sapiens
caagacttttctttgaag

SEQ ID NO: 6686589 - DNA, 12 bp, Homo sapiens
caagagaaaatg

SEQ ID NO: 6686590 - DNA, 13 bp, Homo sapiens
caagagaaacttc

SEQ ID NO: 6686591 - DNA, 14 bp, Homo sapiens
caagagaaacttcc

SEQ ID NO: 6686592 - DNA, 16 bp, Homo sapiens
caagagaaacttccta

SEQ ID NO: 6686593 - DNA, 18 bp, Homo sapiens
caagagaaaggcctgcac

SEQ ID NO: 6686594 - DNA, 19 bp, Homo sapiens
caagagaaatgaggaagaa

SEQ ID NO: 6686595 - DNA, 12 bp, Homo sapiens
caagagaacatt

SEQ ID NO: 6686596 - DNA, 14 bp, Homo sapiens
caagagaacatttt

SEQ ID NO: 6686597 - DNA, 19 bp, Homo sapiens
caagagaacattttactgt

SEQ ID NO: 6686598 - DNA, 12 bp, Homo sapiens
caagagaactaa

SEQ ID NO: 6686599 - DNA, 15 bp, Homo sapiens
caagagaactaaagc

SEQ ID NO: 6686600 - DNA, 13 bp, Homo sapiens
caagagaagaaaa

SEQ ID NO: 6686601 - DNA, 21 bp, Homo sapiens
caagagaagaaaaaattaaga

SEQ ID NO: 6686602 - DNA, 12 bp, Homo sapiens
caagagaagggg

SEQ ID NO: 6686603 - DNA, 22 bp, Homo sapiens
caagagaaggtggacctggcag

SEQ ID NO: 6686604 - DNA, 22 bp, Homo sapiens
caagagaataggggagccaagg

SEQ ID NO: 6686605 - DNA, 23 bp, Homo sapiens
caagagaataggggagccaagga

SEQ ID NO: 6686606 - DNA, 17 bp, Homo sapiens
caagagaatctgatcaa

SEQ ID NO: 6686607 - DNA, 16 bp, Homo sapiens
caagagaatgctgtca

SEQ ID NO: 6686608 - DNA, 22 bp, Homo sapiens
caagagacacaattacgcaggt

SEQ ID NO: 6686609 - DNA, 14 bp, Homo sapiens
caagagacagagcc

SEQ ID NO: 6686610 - DNA, 15 bp, Homo sapiens
caagagacagagccc

SEQ ID NO: 6686611 - DNA, 19 bp, Homo sapiens
caagagacagagcccccaa

SEQ ID NO: 6686612 - DNA, 14 bp, Homo sapiens
caagagaccacttc

SEQ ID NO: 6686613 - DNA, 19 bp, Homo sapiens
caagagaccacttccttaa

SEQ ID NO: 6686614 - DNA, 21 bp, Homo sapiens
caagagacccctgtctggcag

SEQ ID NO: 6686615 - DNA, 18 bp, Homo sapiens
caagagactctcctgcct

SEQ ID NO: 6686616 - DNA, 18 bp, Homo sapiens
caagagactttgtcactt

SEQ ID NO: 6686617 - DNA, 20 bp, Homo sapiens
caagagactttgtcacttat

SEQ ID NO: 6686618 - DNA, 22 bp, Homo sapiens
caagagactttgtcacttattt

SEQ ID NO: 6686619 - DNA, 13 bp, Homo sapiens
caagagagaaaga

SEQ ID NO: 6686620 - DNA, 22 bp, Homo sapiens
caagagagaagcaaccaccaca

SEQ ID NO: 6686621 - DNA, 16 bp, Homo sapiens
caagagagacaaaatt

SEQ ID NO: 6686622 - DNA, 13 bp, Homo sapiens
caagagagacatg

SEQ ID NO: 6686623 - DNA, 22 bp, Homo sapiens
caagagagagctcgctcttggg

SEQ ID NO: 6686624 - DNA, 21 bp, Homo sapiens
caagagagatgtatgtgtcac

SEQ ID NO: 6686625 - DNA, 21 bp, Homo sapiens
caagagagcagcaaggtcttg

SEQ ID NO: 6686626 - DNA, 23 bp, Homo sapiens
caagagagcgagaccctgtctca

SEQ ID NO: 6686627 - DNA, 14 bp, Homo sapiens
caagagaggaagga

SEQ ID NO: 6686628 - DNA, 13 bp, Homo sapiens
caagagaggatga

SEQ ID NO: 6686629 - DNA, 13 bp, Homo sapiens
caagagataactg

SEQ ID NO: 6686630 - DNA, 15 bp, Homo sapiens
caagagatcagcagt

SEQ ID NO: 6686631 - DNA, 18 bp, Homo sapiens
caagagatcagcagtggc

SEQ ID NO: 6686632 - DNA, 20 bp, Homo sapiens
caagagatcagcagtggcag

SEQ ID NO: 6686633 - DNA, 12 bp, Homo sapiens
caagagatcata

SEQ ID NO: 6686634 - DNA, 20 bp, Homo sapiens
caagagatcatatcctcaga

SEQ ID NO: 6686635 - DNA, 15 bp, Homo sapiens
caagagatctacaca

SEQ ID NO: 6686636 - DNA, 18 bp, Homo sapiens
caagagatctgtgtggct

SEQ ID NO: 6686637 - DNA, 21 bp, Homo sapiens
caagagatctttctttccaaa

SEQ ID NO: 6686638 - DNA, 22 bp, Homo sapiens
caagagatgagaaacaacagaa

SEQ ID NO: 6686639 - DNA, 15 bp, Homo sapiens
caagagatggaaaaa

SEQ ID NO: 6686640 - DNA, 20 bp, Homo sapiens
caagagatgggatgctccga

SEQ ID NO: 6686641 - DNA, 16 bp, Homo sapiens
caagagattgctaatt

SEQ ID NO: 6686642 - DNA, 20 bp, Homo sapiens
caagagattgctaattgctg

SEQ ID NO: 6686643 - DNA, 16 bp, Homo sapiens
caagagcaaaactcag

SEQ ID NO: 6686644 - DNA, 13 bp, Homo sapiens
caagagcaaaatg

SEQ ID NO: 6686645 - DNA, 15 bp, Homo sapiens
caagagcaagggctt

SEQ ID NO: 6686646 - DNA, 19 bp, Homo sapiens
caagagcaatcaaagcagc

SEQ ID NO: 6686647 - DNA, 13 bp, Homo sapiens
caagagcacacag

SEQ ID NO: 6686648 - DNA, 15 bp, Homo sapiens
caagagcagaggcag

SEQ ID NO: 6686649 - DNA, 16 bp, Homo sapiens
caagagcagaggcagc

SEQ ID NO: 6686650 - DNA, 16 bp, Homo sapiens
caagagcagagtctgg

SEQ ID NO: 6686651 - DNA, 22 bp, Homo sapiens
caagagcagagtctgggcctct

SEQ ID NO: 6686652 - DNA, 21 bp, Homo sapiens
caagagcagcctgtggcatct

SEQ ID NO: 6686653 - DNA, 18 bp, Homo sapiens
caagagcagctgggaact

SEQ ID NO: 6686654 - DNA, 20 bp, Homo sapiens
caagagcaggaggtgcctga

SEQ ID NO: 6686655 - DNA, 19 bp, Homo sapiens
caagagcatcatgcctctg

SEQ ID NO: 6686656 - DNA, 21 bp, Homo sapiens
caagagcatcatgcctctgag

SEQ ID NO: 6686657 - DNA, 17 bp, Homo sapiens
caagagcatgcacatgc

SEQ ID NO: 6686658 - DNA, 21 bp, Homo sapiens
caagagcatgcacatgctgtc

SEQ ID NO: 6686659 - DNA, 13 bp, Homo sapiens
caagagccacagt

SEQ ID NO: 6686660 - DNA, 22 bp, Homo sapiens
caagagccataagggggtggga

SEQ ID NO: 6686661 - DNA, 17 bp, Homo sapiens
caagagccatgtaccag

SEQ ID NO: 6686662 - DNA, 22 bp, Homo sapiens
caagagcccaaaagagggcaca

SEQ ID NO: 6686663 - DNA, 14 bp, Homo sapiens
caagagccccaaag

SEQ ID NO: 6686664 - DNA, 22 bp, Homo sapiens
caagagccccaaagatcccacg

SEQ ID NO: 6686665 - DNA, 22 bp, Homo sapiens
caagagcccccttgacaccggg

SEQ ID NO: 6686666 - DNA, 17 bp, Homo sapiens
caagagcccctgcccct

SEQ ID NO: 6686667 - DNA, 19 bp, Homo sapiens
caagagcccgtgccacccc

SEQ ID NO: 6686668 - DNA, 16 bp, Homo sapiens
caagagccctgtggcc

SEQ ID NO: 6686669 - DNA, 21 bp, Homo sapiens
caagagccctgtggccgccac

SEQ ID NO: 6686670 - DNA, 22 bp, Homo sapiens
caagagccctgtggccgccacc

SEQ ID NO: 6686671 - DNA, 11 bp, Homo sapiens
caagagcctga

SEQ ID NO: 6686672 - DNA, 21 bp, Homo sapiens
caagagcctgatctcttcctg

SEQ ID NO: 6686673 - DNA, 20 bp, Homo sapiens
caagagcctgattttttgag

SEQ ID NO: 6686674 - DNA, 23 bp, Homo sapiens
caagagccttggtgtccacctgg

SEQ ID NO: 6686675 - DNA, 22 bp, Homo sapiens
caagagctacgtatttaatagc

SEQ ID NO: 6686676 - DNA, 19 bp, Homo sapiens
caagagctagaaaaataaa

SEQ ID NO: 6686677 - DNA, 21 bp, Homo sapiens
caagagctagaaaaataaaat

SEQ ID NO: 6686678 - DNA, 16 bp, Homo sapiens
caagagctcaggagaa

SEQ ID NO: 6686679 - DNA, 14 bp, Homo sapiens
caagagctcttgtg

SEQ ID NO: 6686680 - DNA, 21 bp, Homo sapiens
caagagctctttgtctcacca

SEQ ID NO: 6686681 - DNA, 13 bp, Homo sapiens
caagagctgccct

SEQ ID NO: 6686682 - DNA, 16 bp, Homo sapiens
caagagctgccctcct

SEQ ID NO: 6686683 - DNA, 20 bp, Homo sapiens
caagagctgttatgctgttt

SEQ ID NO: 6686684 - DNA, 21 bp, Homo sapiens
caagagctgttatgctgtttc

SEQ ID NO: 6686685 - DNA, 22 bp, Homo sapiens
caagagctgttatgctgtttcc

SEQ ID NO: 6686686 - DNA, 18 bp, Homo sapiens
caagagcttccagagctc

SEQ ID NO: 6686687 - DNA, 11 bp, Homo sapiens
caagaggaaaa

SEQ ID NO: 6686688 - DNA, 17 bp, Homo sapiens
caagaggaaaaacaggg

SEQ ID NO: 6686689 - DNA, 21 bp, Homo sapiens
caagaggaaaaatactaagag

SEQ ID NO: 6686690 - DNA, 21 bp, Homo sapiens
caagaggaaaatgccctgtcc

SEQ ID NO: 6686691 - DNA, 23 bp, Homo sapiens
caagaggaaaggcgcccccgccc

SEQ ID NO: 6686692 - DNA, 20 bp, Homo sapiens
caagaggaagttcagatctt

SEQ ID NO: 6686693 - DNA, 22 bp, Homo sapiens
caagaggaataagaatggagca

SEQ ID NO: 6686694 - DNA, 15 bp, Homo sapiens
caagaggaatctgtt

SEQ ID NO: 6686695 - DNA, 22 bp, Homo sapiens
caagaggaatctgtttctctgc

SEQ ID NO: 6686696 - DNA, 18 bp, Homo sapiens
caagaggagcaggaagca

SEQ ID NO: 6686697 - DNA, 22 bp, Homo sapiens
caagaggagcaggaagcaaggc

SEQ ID NO: 6686698 - DNA, 23 bp, Homo sapiens
caagaggagttctaacacatttc

SEQ ID NO: 6686699 - DNA, 19 bp, Homo sapiens
caagaggattgtaaaatgc

SEQ ID NO: 6686700 - DNA, 16 bp, Homo sapiens
caagaggatttcttca

SEQ ID NO: 6686701 - DNA, 15 bp, Homo sapiens
caagaggcaagctga

SEQ ID NO: 6686702 - DNA, 23 bp, Homo sapiens
caagaggcagagttctgtgaaga

SEQ ID NO: 6686703 - DNA, 16 bp, Homo sapiens
caagaggcatcccaag

SEQ ID NO: 6686704 - DNA, 22 bp, Homo sapiens
caagaggccacttagggaaaga

SEQ ID NO: 6686705 - DNA, 12 bp, Homo sapiens
caagaggcccag

SEQ ID NO: 6686706 - DNA, 14 bp, Homo sapiens
caagaggcccaggg

SEQ ID NO: 6686707 - DNA, 16 bp, Homo sapiens
caagaggcccagggag

SEQ ID NO: 6686708 - DNA, 12 bp, Homo sapiens
caagaggcctca

SEQ ID NO: 6686709 - DNA, 17 bp, Homo sapiens
caagaggcgtgtgcagg

SEQ ID NO: 6686710 - DNA, 14 bp, Homo sapiens
caagaggctagccc

SEQ ID NO: 6686711 - DNA, 19 bp, Homo sapiens
caagaggctccctcctgtc

SEQ ID NO: 6686712 - DNA, 16 bp, Homo sapiens
caagaggctcctgtcc

SEQ ID NO: 6686713 - DNA, 16 bp, Homo sapiens
caagaggctgcagcca

SEQ ID NO: 6686714 - DNA, 11 bp, Homo sapiens
caagaggctgg

SEQ ID NO: 6686715 - DNA, 12 bp, Homo sapiens
caagaggctggt

SEQ ID NO: 6686716 - DNA, 16 bp, Homo sapiens
caagaggctggttttg

SEQ ID NO: 6686717 - DNA, 21 bp, Homo sapiens
caagagggaatagtatagaca

SEQ ID NO: 6686718 - DNA, 12 bp, Homo sapiens
caagagggacag

SEQ ID NO: 6686719 - DNA, 13 bp, Homo sapiens
caagagggacaga

SEQ ID NO: 6686720 - DNA, 15 bp, Homo sapiens
caagagggacagagc

SEQ ID NO: 6686721 - DNA, 16 bp, Homo sapiens
caagagggacagagcc

SEQ ID NO: 6686722 - DNA, 17 bp, Homo sapiens
caagagggacgcctggg

SEQ ID NO: 6686723 - DNA, 21 bp, Homo sapiens
caagagggactccaagccctg

SEQ ID NO: 6686724 - DNA, 19 bp, Homo sapiens
caagagggactgtatttct

SEQ ID NO: 6686725 - DNA, 20 bp, Homo sapiens
caagagggaggggacagagg

SEQ ID NO: 6686726 - DNA, 21 bp, Homo sapiens
caagagggaggggacagaggc

SEQ ID NO: 6686727 - DNA, 14 bp, Homo sapiens
caagagggcaaagc

SEQ ID NO: 6686728 - DNA, 17 bp, Homo sapiens
caagagggcaaagctga

SEQ ID NO: 6686729 - DNA, 18 bp, Homo sapiens
caagagggcaagcctcta

SEQ ID NO: 6686730 - DNA, 14 bp, Homo sapiens
caagagggcactgg

SEQ ID NO: 6686731 - DNA, 15 bp, Homo sapiens
caagagggcactggt

SEQ ID NO: 6686732 - DNA, 17 bp, Homo sapiens
caagaggggcgggctca

SEQ ID NO: 6686733 - DNA, 20 bp, Homo sapiens
caagaggggcgggctcagag

SEQ ID NO: 6686734 - DNA, 22 bp, Homo sapiens
caagaggggcgggctcagagct

SEQ ID NO: 6686735 - DNA, 23 bp, Homo sapiens
caagaggggcgggctcagagctt

SEQ ID NO: 6686736 - DNA, 15 bp, Homo sapiens
caagagggggtggag

SEQ ID NO: 6686737 - DNA, 22 bp, Homo sapiens
caagagggtcctttagtacctg

SEQ ID NO: 6686738 - DNA, 14 bp, Homo sapiens
caagagggtctctt

SEQ ID NO: 6686739 - DNA, 21 bp, Homo sapiens
caagagggtctctttgttcaa

SEQ ID NO: 6686740 - DNA, 14 bp, Homo sapiens
caagagggtggatc

SEQ ID NO: 6686741 - DNA, 15 bp, Homo sapiens
caagaggtctgagcc

SEQ ID NO: 6686742 - DNA, 16 bp, Homo sapiens
caagaggtctgagccc

SEQ ID NO: 6686743 - DNA, 18 bp, Homo sapiens
caagaggtctgagccctg

SEQ ID NO: 6686744 - DNA, 14 bp, Homo sapiens
caagaggtgcctgg

SEQ ID NO: 6686745 - DNA, 18 bp, Homo sapiens
caagaggtgcctgggagg

SEQ ID NO: 6686746 - DNA, 19 bp, Homo sapiens
caagaggtgctagctctta

SEQ ID NO: 6686747 - DNA, 11 bp, Homo sapiens
caagaggtggg

SEQ ID NO: 6686748 - DNA, 17 bp, Homo sapiens
caagaggtggggaccaa

SEQ ID NO: 6686749 - DNA, 19 bp, Homo sapiens
caagaggtgtgcacaccaa

SEQ ID NO: 6686750 - DNA, 17 bp, Homo sapiens
caagaggtttcagcatt

SEQ ID NO: 6686751 - DNA, 20 bp, Homo sapiens
caagaggtttttctccccgc

SEQ ID NO: 6686752 - DNA, 17 bp, Homo sapiens
caagagtccccagactc

SEQ ID NO: 6686753 - DNA, 18 bp, Homo sapiens
caagagtccccagactct

SEQ ID NO: 6686754 - DNA, 14 bp, Homo sapiens
caagagtccctttg

SEQ ID NO: 6686755 - DNA, 20 bp, Homo sapiens
caagagtctaatagtctttg

SEQ ID NO: 6686756 - DNA, 15 bp, Homo sapiens
caagagtctctccag

SEQ ID NO: 6686757 - DNA, 17 bp, Homo sapiens
caagagtctctccagcc

SEQ ID NO: 6686758 - DNA, 22 bp, Homo sapiens
caagagtctctccagcctcaca

SEQ ID NO: 6686759 - DNA, 22 bp, Homo sapiens
caagagtgagatgtagaaagtt

SEQ ID NO: 6686760 - DNA, 18 bp, Homo sapiens
caagagtgattgcagctt

SEQ ID NO: 6686761 - DNA, 15 bp, Homo sapiens
caagagtgctgagaa

SEQ ID NO: 6686762 - DNA, 17 bp, Homo sapiens
caagagtggccccacct

SEQ ID NO: 6686763 - DNA, 23 bp, Homo sapiens
caagagtggccccacctggccct

SEQ ID NO: 6686764 - DNA, 21 bp, Homo sapiens
caagagtgggctttccagggt

SEQ ID NO: 6686765 - DNA, 17 bp, Homo sapiens
caagagtgggctttgtg

SEQ ID NO: 6686766 - DNA, 18 bp, Homo sapiens
caagagtgggctttgtgg

SEQ ID NO: 6686767 - DNA, 20 bp, Homo sapiens
caagagtggtggcagctcaa

SEQ ID NO: 6686768 - DNA, 17 bp, Homo sapiens
caagagtgtctatggag

SEQ ID NO: 6686769 - DNA, 12 bp, Homo sapiens
caagagttaaac

SEQ ID NO: 6686770 - DNA, 16 bp, Homo sapiens
caagagttaaacttag

SEQ ID NO: 6686771 - DNA, 23 bp, Homo sapiens
caagagttctttaggtgcctcct

SEQ ID NO: 6686772 - DNA, 22 bp, Homo sapiens
caagagtttcttctcatatcca

SEQ ID NO: 6686773 - DNA, 22 bp, Homo sapiens
caagagtttcttgtaagccatc

SEQ ID NO: 6686774 - DNA, 18 bp, Homo sapiens
caagagttttcttccttg

SEQ ID NO: 6686775 - DNA, 14 bp, Homo sapiens
caagataaaagaat

SEQ ID NO: 6686776 - DNA, 18 bp, Homo sapiens
caagataaaggacagtga

SEQ ID NO: 6686777 - DNA, 15 bp, Homo sapiens
caagataactgagaa

SEQ ID NO: 6686778 - DNA, 16 bp, Homo sapiens
caagataagcctgagc

SEQ ID NO: 6686779 - DNA, 18 bp, Homo sapiens
caagataagcctgagcct

SEQ ID NO: 6686780 - DNA, 13 bp, Homo sapiens
caagataaggaga

SEQ ID NO: 6686781 - DNA, 12 bp, Homo sapiens
caagataatttt

SEQ ID NO: 6686782 - DNA, 18 bp, Homo sapiens
caagatacatagtaaatg

SEQ ID NO: 6686783 - DNA, 19 bp, Homo sapiens
caagatacatgttgtattt

SEQ ID NO: 6686784 - DNA, 14 bp, Homo sapiens
caagatacctttgc

SEQ ID NO: 6686785 - DNA, 22 bp, Homo sapiens
caagatactctttgtggggaag

SEQ ID NO: 6686786 - DNA, 18 bp, Homo sapiens
caagatactggactaagt

SEQ ID NO: 6686787 - DNA, 17 bp, Homo sapiens
caagatagatttggaat

SEQ ID NO: 6686788 - DNA, 18 bp, Homo sapiens
caagatagatttggaata

SEQ ID NO: 6686789 - DNA, 15 bp, Homo sapiens
caagatagcatccca

SEQ ID NO: 6686790 - DNA, 15 bp, Homo sapiens
caagataggaccttg

SEQ ID NO: 6686791 - DNA, 19 bp, Homo sapiens
caagataggagttctctga

SEQ ID NO: 6686792 - DNA, 14 bp, Homo sapiens
caagatattatgta

SEQ ID NO: 6686793 - DNA, 17 bp, Homo sapiens
caagatattatgtataa

SEQ ID NO: 6686794 - DNA, 21 bp, Homo sapiens
caagatattatgtataaaatg

SEQ ID NO: 6686795 - DNA, 21 bp, Homo sapiens
caagatattattaatttttat

SEQ ID NO: 6686796 - DNA, 18 bp, Homo sapiens
caagatattgatgataac

SEQ ID NO: 6686797 - DNA, 16 bp, Homo sapiens
caagatatttatatat

SEQ ID NO: 6686798 - DNA, 21 bp, Homo sapiens
caagatattttaaaatctgtc

SEQ ID NO: 6686799 - DNA, 23 bp, Homo sapiens
caagatattttaaaatctgtcac

SEQ ID NO: 6686800 - DNA, 18 bp, Homo sapiens
caagatcaattccctctc

SEQ ID NO: 6686801 - DNA, 21 bp, Homo sapiens
caagatcaattccctctctca

SEQ ID NO: 6686802 - DNA, 15 bp, Homo sapiens
caagatcacaaatag

SEQ ID NO: 6686803 - DNA, 18 bp, Homo sapiens
caagatcacgccactgca

SEQ ID NO: 6686804 - DNA, 18 bp, Homo sapiens
caagatcatgtaccccaa

SEQ ID NO: 6686805 - DNA, 19 bp, Homo sapiens
caagatccaaatgctgtgc

SEQ ID NO: 6686806 - DNA, 20 bp, Homo sapiens
caagatccaaatgctgtgca

SEQ ID NO: 6686807 - DNA, 21 bp, Homo sapiens
caagatccaggcagaaggaga

SEQ ID NO: 6686808 - DNA, 17 bp, Homo sapiens
caagatccatttgcctt

SEQ ID NO: 6686809 - DNA, 18 bp, Homo sapiens
caagatccatttgccttt

SEQ ID NO: 6686810 - DNA, 16 bp, Homo sapiens
caagatcgcgccactg

SEQ ID NO: 6686811 - DNA, 20 bp, Homo sapiens
caagatctgccagacctgca

SEQ ID NO: 6686812 - DNA, 22 bp, Homo sapiens
caagatctgccagacctgcatg

SEQ ID NO: 6686813 - DNA, 23 bp, Homo sapiens
caagatctgccagacctgcatgg

SEQ ID NO: 6686814 - DNA, 13 bp, Homo sapiens
caagatctttcag

SEQ ID NO: 6686815 - DNA, 15 bp, Homo sapiens
caagatgaaataatt

SEQ ID NO: 6686816 - DNA, 17 bp, Homo sapiens
caagatgaaataatttt

SEQ ID NO: 6686817 - DNA, 19 bp, Homo sapiens
caagatgaaataatttttc

SEQ ID NO: 6686818 - DNA, 14 bp, Homo sapiens
caagatgaattatt

SEQ ID NO: 6686819 - DNA, 13 bp, Homo sapiens
caagatgacagct

SEQ ID NO: 6686820 - DNA, 16 bp, Homo sapiens
caagatgacagctctt

SEQ ID NO: 6686821 - DNA, 17 bp, Homo sapiens
caagatgacagctcttc

SEQ ID NO: 6686822 - DNA, 15 bp, Homo sapiens
caagatgagcctggg

SEQ ID NO: 6686823 - DNA, 18 bp, Homo sapiens
caagatgagcctgggctc

SEQ ID NO: 6686824 - DNA, 18 bp, Homo sapiens
caagatgccatctgtgtc

SEQ ID NO: 6686825 - DNA, 13 bp, Homo sapiens
caagatgcctctt

SEQ ID NO: 6686826 - DNA, 16 bp, Homo sapiens
caagatgcctgatcag

SEQ ID NO: 6686827 - DNA, 12 bp, Homo sapiens
caagatgctctg

SEQ ID NO: 6686828 - DNA, 22 bp, Homo sapiens
caagatgctggatgtctgccaa

SEQ ID NO: 6686829 - DNA, 13 bp, Homo sapiens
caagatgcttggt

SEQ ID NO: 6686830 - DNA, 19 bp, Homo sapiens
caagatgcttttcaaactg

SEQ ID NO: 6686831 - DNA, 22 bp, Homo sapiens
caagatggaagtcacctttctg

SEQ ID NO: 6686832 - DNA, 20 bp, Homo sapiens
caagatggacacgagccaca

SEQ ID NO: 6686833 - DNA, 17 bp, Homo sapiens
caagatggacttacctg

SEQ ID NO: 6686834 - DNA, 17 bp, Homo sapiens
caagatggagaggaaga

SEQ ID NO: 6686835 - DNA, 18 bp, Homo sapiens
caagatggagaggaagaa

SEQ ID NO: 6686836 - DNA, 16 bp, Homo sapiens
caagatggcacagggc

SEQ ID NO: 6686837 - DNA, 20 bp, Homo sapiens
caagatggcgaccaccaaag

SEQ ID NO: 6686838 - DNA, 18 bp, Homo sapiens
caagatggctgctgcctg

SEQ ID NO: 6686839 - DNA, 19 bp, Homo sapiens
caagatggctgctgcctgc

SEQ ID NO: 6686840 - DNA, 13 bp, Homo sapiens
caagatgggcaca

SEQ ID NO: 6686841 - DNA, 14 bp, Homo sapiens
caagatgggcacat

SEQ ID NO: 6686842 - DNA, 16 bp, Homo sapiens
caagatgggcacatga

SEQ ID NO: 6686843 - DNA, 20 bp, Homo sapiens
caagatgggcacatgaggag

SEQ ID NO: 6686844 - DNA, 16 bp, Homo sapiens
caagatgggcatcttt

SEQ ID NO: 6686845 - DNA, 21 bp, Homo sapiens
caagatgggcatcttttgtat

SEQ ID NO: 6686846 - DNA, 18 bp, Homo sapiens
caagatgggggcagggct

SEQ ID NO: 6686847 - DNA, 20 bp, Homo sapiens
caagatggtccatttgttcc

SEQ ID NO: 6686848 - DNA, 22 bp, Homo sapiens
caagatgtagcaccttttctcc

SEQ ID NO: 6686849 - DNA, 16 bp, Homo sapiens
caagatgtcagactgg

SEQ ID NO: 6686850 - DNA, 17 bp, Homo sapiens
caagatgtcagactggc

SEQ ID NO: 6686851 - DNA, 14 bp, Homo sapiens
caagatgtgaatta

SEQ ID NO: 6686852 - DNA, 19 bp, Homo sapiens
caagatgtgaattattgac

SEQ ID NO: 6686853 - DNA, 21 bp, Homo sapiens
caagatgttatattaaagaaa

SEQ ID NO: 6686854 - DNA, 20 bp, Homo sapiens
caagatgttgaggcgagcag

SEQ ID NO: 6686855 - DNA, 12 bp, Homo sapiens
caagatgtttct

SEQ ID NO: 6686856 - DNA, 13 bp, Homo sapiens
caagatgtttctt

SEQ ID NO: 6686857 - DNA, 21 bp, Homo sapiens
caagatgtttcttatattatt

SEQ ID NO: 6686858 - DNA, 19 bp, Homo sapiens
caagatgtttcttgccttt

SEQ ID NO: 6686859 - DNA, 19 bp, Homo sapiens
caagatgttttgtataaaa

SEQ ID NO: 6686860 - DNA, 22 bp, Homo sapiens
caagattaagttataccagcaa

SEQ ID NO: 6686861 - DNA, 23 bp, Homo sapiens
caagattaagttataccagcaaa

SEQ ID NO: 6686862 - DNA, 17 bp, Homo sapiens
caagattactaatattt

SEQ ID NO: 6686863 - DNA, 18 bp, Homo sapiens
caagattcaaagagacta

SEQ ID NO: 6686864 - DNA, 17 bp, Homo sapiens
caagattcacacctgac

SEQ ID NO: 6686865 - DNA, 17 bp, Homo sapiens
caagattccatttctta

SEQ ID NO: 6686866 - DNA, 13 bp, Homo sapiens
caagattcccaga

SEQ ID NO: 6686867 - DNA, 15 bp, Homo sapiens
caagattcccagaga

SEQ ID NO: 6686868 - DNA, 18 bp, Homo sapiens
caagattcccagagacag

SEQ ID NO: 6686869 - DNA, 19 bp, Homo sapiens
caagattcccagagacagg

SEQ ID NO: 6686870 - DNA, 23 bp, Homo sapiens
caagattcccagagacaggaaaa

SEQ ID NO: 6686871 - DNA, 21 bp, Homo sapiens
caagattcccaggagttctgc

SEQ ID NO: 6686872 - DNA, 20 bp, Homo sapiens
caagattcccggctggactt

SEQ ID NO: 6686873 - DNA, 19 bp, Homo sapiens
caagattccggatcctaag

SEQ ID NO: 6686874 - DNA, 22 bp, Homo sapiens
caagattccggatcctaagcat

SEQ ID NO: 6686875 - DNA, 12 bp, Homo sapiens
caagattcctgg

SEQ ID NO: 6686876 - DNA, 14 bp, Homo sapiens
caagattctaaagc

SEQ ID NO: 6686877 - DNA, 16 bp, Homo sapiens
caagattctaaagctc

SEQ ID NO: 6686878 - DNA, 15 bp, Homo sapiens
caagattctgtgggc

SEQ ID NO: 6686879 - DNA, 22 bp, Homo sapiens
caagattctgtgggcagctggc

SEQ ID NO: 6686880 - DNA, 20 bp, Homo sapiens
caagattgaagtctgatatt

SEQ ID NO: 6686881 - DNA, 23 bp, Homo sapiens
caagattgagctctctgcccttg

SEQ ID NO: 6686882 - DNA, 13 bp, Homo sapiens
caagattgcttaa

SEQ ID NO: 6686883 - DNA, 16 bp, Homo sapiens
caagattgcttaaaat

SEQ ID NO: 6686884 - DNA, 19 bp, Homo sapiens
caagattggaaagacagga

SEQ ID NO: 6686885 - DNA, 20 bp, Homo sapiens
caagattggtgtttttttct

SEQ ID NO: 6686886 - DNA, 22 bp, Homo sapiens
caagattggtgtttttttctat

SEQ ID NO: 6686887 - DNA, 16 bp, Homo sapiens
caagattgtcattagt

SEQ ID NO: 6686888 - DNA, 19 bp, Homo sapiens
caagattgtccttttctcc

SEQ ID NO: 6686889 - DNA, 15 bp, Homo sapiens
caagattgtgtccca

SEQ ID NO: 6686890 - DNA, 17 bp, Homo sapiens
caagatttaaaattaaa

SEQ ID NO: 6686891 - DNA, 22 bp, Homo sapiens
caagatttaaaattaaatttga

SEQ ID NO: 6686892 - DNA, 12 bp, Homo sapiens
caagatttcaga

SEQ ID NO: 6686893 - DNA, 15 bp, Homo sapiens
caagatttcagaagc

SEQ ID NO: 6686894 - DNA, 17 bp, Homo sapiens
caagatttcagaagcca

SEQ ID NO: 6686895 - DNA, 17 bp, Homo sapiens
caagatttcctactttc

SEQ ID NO: 6686896 - DNA, 13 bp, Homo sapiens
caagatttccttg

SEQ ID NO: 6686897 - DNA, 16 bp, Homo sapiens
caagatttccttgtgc

SEQ ID NO: 6686898 - DNA, 15 bp, Homo sapiens
caagattttaaaagt

SEQ ID NO: 6686899 - DNA, 12 bp, Homo sapiens
caagattttagg

SEQ ID NO: 6686900 - DNA, 14 bp, Homo sapiens
caagattttagggc

SEQ ID NO: 6686901 - DNA, 17 bp, Homo sapiens
caagattttcctttttt

SEQ ID NO: 6686902 - DNA, 17 bp, Homo sapiens
caagattttctactttt

SEQ ID NO: 6686903 - DNA, 16 bp, Homo sapiens
caagattttttaattg

SEQ ID NO: 6686904 - DNA, 19 bp, Homo sapiens
caagattttttaattgttt

SEQ ID NO: 6686905 - DNA, 23 bp, Homo sapiens
caagcaaaatcatggaatggtta

SEQ ID NO: 6686906 - DNA, 19 bp, Homo sapiens
caagcaaaatctaaaatgt

SEQ ID NO: 6686907 - DNA, 11 bp, Homo sapiens
caagcaaacat

SEQ ID NO: 6686908 - DNA, 18 bp, Homo sapiens
caagcaaacatcaaataa

SEQ ID NO: 6686909 - DNA, 17 bp, Homo sapiens
caagcaaacccagacgg

SEQ ID NO: 6686910 - DNA, 16 bp, Homo sapiens
caagcaaagacagttt

SEQ ID NO: 6686911 - DNA, 22 bp, Homo sapiens
caagcaaagacagtttcttgca

SEQ ID NO: 6686912 - DNA, 13 bp, Homo sapiens
caagcaaatataa

SEQ ID NO: 6686913 - DNA, 18 bp, Homo sapiens
caagcaacacagaggaat

SEQ ID NO: 6686914 - DNA, 14 bp, Homo sapiens
caagcaacccaaac

SEQ ID NO: 6686915 - DNA, 17 bp, Homo sapiens
caagcaacctgggtcca

SEQ ID NO: 6686916 - DNA, 22 bp, Homo sapiens
caagcaacctgggtccaaataa

SEQ ID NO: 6686917 - DNA, 16 bp, Homo sapiens
caagcaactaattttc

SEQ ID NO: 6686918 - DNA, 18 bp, Homo sapiens
caagcaactaattttctc

SEQ ID NO: 6686919 - DNA, 13 bp, Homo sapiens
caagcaagactga

SEQ ID NO: 6686920 - DNA, 23 bp, Homo sapiens
caagcaagctcccaagggatggt

SEQ ID NO: 6686921 - DNA, 14 bp, Homo sapiens
caagcaagtattag

SEQ ID NO: 6686922 - DNA, 15 bp, Homo sapiens
caagcaagttctgag

SEQ ID NO: 6686923 - DNA, 16 bp, Homo sapiens
caagcaataattgttt

SEQ ID NO: 6686924 - DNA, 19 bp, Homo sapiens
caagcaatccacctgcctt

SEQ ID NO: 6686925 - DNA, 18 bp, Homo sapiens
caagcaatccatgatcta

SEQ ID NO: 6686926 - DNA, 16 bp, Homo sapiens
caagcaatcctcctgc

SEQ ID NO: 6686927 - DNA, 18 bp, Homo sapiens
caagcaatcctcctgcct

SEQ ID NO: 6686928 - DNA, 22 bp, Homo sapiens
caagcaatcctcctgcctcagc

SEQ ID NO: 6686929 - DNA, 15 bp, Homo sapiens
caagcaatgatgacc

SEQ ID NO: 6686930 - DNA, 16 bp, Homo sapiens
caagcaatgcaagaaa

SEQ ID NO: 6686931 - DNA, 15 bp, Homo sapiens
caagcacaaactgtc

SEQ ID NO: 6686932 - DNA, 21 bp, Homo sapiens
caagcacaaactgtcgtcttt

SEQ ID NO: 6686933 - DNA, 18 bp, Homo sapiens
caagcacaaagctcaaga

SEQ ID NO: 6686934 - DNA, 22 bp, Homo sapiens
caagcacacacacacagtcctc

SEQ ID NO: 6686935 - DNA, 15 bp, Homo sapiens
caagcacagagcctg

SEQ ID NO: 6686936 - DNA, 22 bp, Homo sapiens
caagcacagagcctggccccag

SEQ ID NO: 6686937 - DNA, 12 bp, Homo sapiens
caagcacagcag

SEQ ID NO: 6686938 - DNA, 14 bp, Homo sapiens
caagcacagtcagg

SEQ ID NO: 6686939 - DNA, 15 bp, Homo sapiens
caagcacagtggtgg

SEQ ID NO: 6686940 - DNA, 16 bp, Homo sapiens
caagcacagtggtggc

SEQ ID NO: 6686941 - DNA, 19 bp, Homo sapiens
caagcacagtggtggcagg

SEQ ID NO: 6686942 - DNA, 17 bp, Homo sapiens
caagcacagttttaaga

SEQ ID NO: 6686943 - DNA, 20 bp, Homo sapiens
caagcacatctgcattttca

SEQ ID NO: 6686944 - DNA, 16 bp, Homo sapiens
caagcaccaacctcca

SEQ ID NO: 6686945 - DNA, 18 bp, Homo sapiens
caagcaccaacctccaga

SEQ ID NO: 6686946 - DNA, 22 bp, Homo sapiens
caagcaccaggaagtgtttatg

SEQ ID NO: 6686947 - DNA, 19 bp, Homo sapiens
caagcacctccaaccaaat

SEQ ID NO: 6686948 - DNA, 14 bp, Homo sapiens
caagcacctgggtg

SEQ ID NO: 6686949 - DNA, 15 bp, Homo sapiens
caagcactattttat

SEQ ID NO: 6686950 - DNA, 20 bp, Homo sapiens
caagcactattttatattta

SEQ ID NO: 6686951 - DNA, 23 bp, Homo sapiens
caagcactcggggtccctggagg

SEQ ID NO: 6686952 - DNA, 18 bp, Homo sapiens
caagcactgctaggcgag

SEQ ID NO: 6686953 - DNA, 14 bp, Homo sapiens
caagcactgctcac

SEQ ID NO: 6686954 - DNA, 21 bp, Homo sapiens
caagcactgctcacgtctctg

SEQ ID NO: 6686955 - DNA, 16 bp, Homo sapiens
caagcacttcccagga

SEQ ID NO: 6686956 - DNA, 14 bp, Homo sapiens
caagcacttctttt

SEQ ID NO: 6686957 - DNA, 12 bp, Homo sapiens
caagcagaaaaa

SEQ ID NO: 6686958 - DNA, 12 bp, Homo sapiens
caagcagactcc

SEQ ID NO: 6686959 - DNA, 20 bp, Homo sapiens
caagcagactccagcccctg

SEQ ID NO: 6686960 - DNA, 21 bp, Homo sapiens
caagcagactccagcccctgg

SEQ ID NO: 6686961 - DNA, 22 bp, Homo sapiens
caagcagactccagcccctgga

SEQ ID NO: 6686962 - DNA, 22 bp, Homo sapiens
caagcagactgttctaaaatat

SEQ ID NO: 6686963 - DNA, 23 bp, Homo sapiens
caagcagagcgggtaaagtgcaa

SEQ ID NO: 6686964 - DNA, 11 bp, Homo sapiens
caagcagagga

SEQ ID NO: 6686965 - DNA, 18 bp, Homo sapiens
caagcagaggaccagggc

SEQ ID NO: 6686966 - DNA, 18 bp, Homo sapiens
caagcagagtaacaggat

SEQ ID NO: 6686967 - DNA, 21 bp, Homo sapiens
caagcagagtgcacagctgtc

SEQ ID NO: 6686968 - DNA, 13 bp, Homo sapiens
caagcagcaaaat

SEQ ID NO: 6686969 - DNA, 15 bp, Homo sapiens
caagcagcaaaatcc

SEQ ID NO: 6686970 - DNA, 17 bp, Homo sapiens
caagcagcattcagcac

SEQ ID NO: 6686971 - DNA, 14 bp, Homo sapiens
caagcagccagcca

SEQ ID NO: 6686972 - DNA, 21 bp, Homo sapiens
caagcagcctgagcaactctt

SEQ ID NO: 6686973 - DNA, 13 bp, Homo sapiens
caagcagctgaag

SEQ ID NO: 6686974 - DNA, 19 bp, Homo sapiens
caagcagctgaagaaaaaa

SEQ ID NO: 6686975 - DNA, 14 bp, Homo sapiens
caagcagctgaagg

SEQ ID NO: 6686976 - DNA, 15 bp, Homo sapiens
caagcagctggtcag

SEQ ID NO: 6686977 - DNA, 20 bp, Homo sapiens
caagcagcttagagttggcc

SEQ ID NO: 6686978 - DNA, 23 bp, Homo sapiens
caagcaggaaatgaaaatgtctt

SEQ ID NO: 6686979 - DNA, 15 bp, Homo sapiens
caagcaggaagctca

SEQ ID NO: 6686980 - DNA, 18 bp, Homo sapiens
caagcaggacatggacaa

SEQ ID NO: 6686981 - DNA, 13 bp, Homo sapiens
caagcaggagacg

SEQ ID NO: 6686982 - DNA, 14 bp, Homo sapiens
caagcaggagacga

SEQ ID NO: 6686983 - DNA, 12 bp, Homo sapiens
caagcaggaggc

SEQ ID NO: 6686984 - DNA, 13 bp, Homo sapiens
caagcaggaggct

SEQ ID NO: 6686985 - DNA, 15 bp, Homo sapiens
caagcagggcactct

SEQ ID NO: 6686986 - DNA, 17 bp, Homo sapiens
caagcagtctaccctgt

SEQ ID NO: 6686987 - DNA, 18 bp, Homo sapiens
caagcagtgtctgtcagc

SEQ ID NO: 6686988 - DNA, 23 bp, Homo sapiens
caagcagttactccctacactga

SEQ ID NO: 6686989 - DNA, 15 bp, Homo sapiens
caagcagtttcaata

SEQ ID NO: 6686990 - DNA, 15 bp, Homo sapiens
caagcatcagcaaga

SEQ ID NO: 6686991 - DNA, 15 bp, Homo sapiens
caagcatcaggggga

SEQ ID NO: 6686992 - DNA, 22 bp, Homo sapiens
caagcatcagggggaagaagca

SEQ ID NO: 6686993 - DNA, 18 bp, Homo sapiens
caagcatctcctgaggat

SEQ ID NO: 6686994 - DNA, 14 bp, Homo sapiens
caagcatgaataaa

SEQ ID NO: 6686995 - DNA, 13 bp, Homo sapiens
caagcatgcaata

SEQ ID NO: 6686996 - DNA, 13 bp, Homo sapiens
caagcatgcccca

SEQ ID NO: 6686997 - DNA, 18 bp, Homo sapiens
caagcatgccccacccac

SEQ ID NO: 6686998 - DNA, 22 bp, Homo sapiens
caagcatgccccacccacccct

SEQ ID NO: 6686999 - DNA, 22 bp, Homo sapiens
caagcatggaaaatcagtgaca

SEQ ID NO: 6687000 - DNA, 20 bp, Homo sapiens
caagcatggaacaaagcatg

SEQ ID NO: 6687001 - DNA, 20 bp, Homo sapiens
caagcatgggggaccccttc

SEQ ID NO: 6687002 - DNA, 23 bp, Homo sapiens
caagcatggtcccacatccctgg

SEQ ID NO: 6687003 - DNA, 13 bp, Homo sapiens
caagcattacttt

SEQ ID NO: 6687004 - DNA, 22 bp, Homo sapiens
caagcattactttaacctccct

SEQ ID NO: 6687005 - DNA, 19 bp, Homo sapiens
caagcattagattcctttc

SEQ ID NO: 6687006 - DNA, 22 bp, Homo sapiens
caagcattagattcctttcctg

SEQ ID NO: 6687007 - DNA, 16 bp, Homo sapiens
caagcattcagaagaa

SEQ ID NO: 6687008 - DNA, 13 bp, Homo sapiens
caagcattctcct

SEQ ID NO: 6687009 - DNA, 14 bp, Homo sapiens
caagcattctgtct

SEQ ID NO: 6687010 - DNA, 17 bp, Homo sapiens
caagcattctgtttatc

SEQ ID NO: 6687011 - DNA, 19 bp, Homo sapiens
caagcattgctaaagtcag

SEQ ID NO: 6687012 - DNA, 18 bp, Homo sapiens
caagcattgggtcagacc

SEQ ID NO: 6687013 - DNA, 20 bp, Homo sapiens
caagcattgggtcagaccca

SEQ ID NO: 6687014 - DNA, 13 bp, Homo sapiens
caagcatttcatg

SEQ ID NO: 6687015 - DNA, 20 bp, Homo sapiens
caagcatttcatgaaaaagc

SEQ ID NO: 6687016 - DNA, 19 bp, Homo sapiens
caagccaaacattcttatt

SEQ ID NO: 6687017 - DNA, 18 bp, Homo sapiens
caagccaacgacaaagcc

SEQ ID NO: 6687018 - DNA, 19 bp, Homo sapiens
caagccaacgacaaagcca

SEQ ID NO: 6687019 - DNA, 17 bp, Homo sapiens
caagccaagaaagatgt

SEQ ID NO: 6687020 - DNA, 18 bp, Homo sapiens
caagccaagcagccaagc

SEQ ID NO: 6687021 - DNA, 14 bp, Homo sapiens
caagccaatcccct

SEQ ID NO: 6687022 - DNA, 17 bp, Homo sapiens
caagccaatcccctcct

SEQ ID NO: 6687023 - DNA, 20 bp, Homo sapiens
caagccacaagtcttccaga

SEQ ID NO: 6687024 - DNA, 14 bp, Homo sapiens
caagccacagaagc

SEQ ID NO: 6687025 - DNA, 22 bp, Homo sapiens
caagccacagaagccaggagca

SEQ ID NO: 6687026 - DNA, 14 bp, Homo sapiens
caagccacagcctg

SEQ ID NO: 6687027 - DNA, 15 bp, Homo sapiens
caagccacagcctgt

SEQ ID NO: 6687028 - DNA, 16 bp, Homo sapiens
caagccacagcctgtc

SEQ ID NO: 6687029 - DNA, 15 bp, Homo sapiens
caagccacaggaagg

SEQ ID NO: 6687030 - DNA, 16 bp, Homo sapiens
caagccacaggaagga

SEQ ID NO: 6687031 - DNA, 19 bp, Homo sapiens
caagccaccgcagctgctg

SEQ ID NO: 6687032 - DNA, 20 bp, Homo sapiens
caagccaccgcagctgctgc

SEQ ID NO: 6687033 - DNA, 22 bp, Homo sapiens
caagccagacctagcaggctgt

SEQ ID NO: 6687034 - DNA, 12 bp, Homo sapiens
caagccagagcc

SEQ ID NO: 6687035 - DNA, 13 bp, Homo sapiens
caagccagaggct

SEQ ID NO: 6687036 - DNA, 18 bp, Homo sapiens
caagccagattctcttga

SEQ ID NO: 6687037 - DNA, 19 bp, Homo sapiens
caagccagattctcttgaa

SEQ ID NO: 6687038 - DNA, 15 bp, Homo sapiens
caagccagatttttt

SEQ ID NO: 6687039 - DNA, 11 bp, Homo sapiens
caagccagctg

SEQ ID NO: 6687040 - DNA, 15 bp, Homo sapiens
caagccagctgccta

SEQ ID NO: 6687041 - DNA, 16 bp, Homo sapiens
caagccagctgcctag

SEQ ID NO: 6687042 - DNA, 16 bp, Homo sapiens
caagccagcttcctgt

SEQ ID NO: 6687043 - DNA, 12 bp, Homo sapiens
caagccaggaga

SEQ ID NO: 6687044 - DNA, 23 bp, Homo sapiens
caagccaggagaagacccctgcc

SEQ ID NO: 6687045 - DNA, 13 bp, Homo sapiens
caagccaggagac

SEQ ID NO: 6687046 - DNA, 14 bp, Homo sapiens
caagccaggagacc

SEQ ID NO: 6687047 - DNA, 12 bp, Homo sapiens
caagccaggccc

SEQ ID NO: 6687048 - DNA, 13 bp, Homo sapiens
caagccagggatg

SEQ ID NO: 6687049 - DNA, 18 bp, Homo sapiens
caagccagggcccagagc

SEQ ID NO: 6687050 - DNA, 19 bp, Homo sapiens
caagccagggcccagagcc

SEQ ID NO: 6687051 - DNA, 20 bp, Homo sapiens
caagccagggcccagagccc

SEQ ID NO: 6687052 - DNA, 14 bp, Homo sapiens
caagccagggtgtg

SEQ ID NO: 6687053 - DNA, 19 bp, Homo sapiens
caagccagggttccagaca

SEQ ID NO: 6687054 - DNA, 13 bp, Homo sapiens
caagccagttctc

SEQ ID NO: 6687055 - DNA, 22 bp, Homo sapiens
caagccagttctccttccctgc

SEQ ID NO: 6687056 - DNA, 23 bp, Homo sapiens
caagccataaaccaataaaacaa

SEQ ID NO: 6687057 - DNA, 20 bp, Homo sapiens
caagccataacgtgccccca

SEQ ID NO: 6687058 - DNA, 15 bp, Homo sapiens
caagccatcttcccg

SEQ ID NO: 6687059 - DNA, 13 bp, Homo sapiens
caagccatggtga

SEQ ID NO: 6687060 - DNA, 22 bp, Homo sapiens
caagccatggtgacacacagca

SEQ ID NO: 6687061 - DNA, 15 bp, Homo sapiens
caagccattctgcct

SEQ ID NO: 6687062 - DNA, 17 bp, Homo sapiens
caagccattctgcctca

SEQ ID NO: 6687063 - DNA, 22 bp, Homo sapiens
caagccattctgcctcagcctc

SEQ ID NO: 6687064 - DNA, 17 bp, Homo sapiens
caagccatttactttgc

SEQ ID NO: 6687065 - DNA, 18 bp, Homo sapiens
caagcccaaatttaattt

SEQ ID NO: 6687066 - DNA, 12 bp, Homo sapiens
caagcccaccag

SEQ ID NO: 6687067 - DNA, 15 bp, Homo sapiens
caagcccaccaggtg

SEQ ID NO: 6687068 - DNA, 18 bp, Homo sapiens
caagcccaccaggtgtca

SEQ ID NO: 6687069 - DNA, 22 bp, Homo sapiens
caagcccacgtcaggcctggcc

SEQ ID NO: 6687070 - DNA, 17 bp, Homo sapiens
caagcccaggacactgc

SEQ ID NO: 6687071 - DNA, 17 bp, Homo sapiens
caagcccaggcttcctg

SEQ ID NO: 6687072 - DNA, 14 bp, Homo sapiens
caagcccagtgacc

SEQ ID NO: 6687073 - DNA, 14 bp, Homo sapiens
caagccccaacttt

SEQ ID NO: 6687074 - DNA, 19 bp, Homo sapiens
caagccccagcagccctca

SEQ ID NO: 6687075 - DNA, 18 bp, Homo sapiens
caagccccaggcaggctg

SEQ ID NO: 6687076 - DNA, 14 bp, Homo sapiens
caagccccagggcc

SEQ ID NO: 6687077 - DNA, 17 bp, Homo sapiens
caagccccagggcctgg

SEQ ID NO: 6687078 - DNA, 21 bp, Homo sapiens
caagccccagggcctgggggc

SEQ ID NO: 6687079 - DNA, 13 bp, Homo sapiens
caagccccatcct

SEQ ID NO: 6687080 - DNA, 13 bp, Homo sapiens
caagccccatctc

SEQ ID NO: 6687081 - DNA, 18 bp, Homo sapiens
caagccccatctcatcct

SEQ ID NO: 6687082 - DNA, 20 bp, Homo sapiens
caagccccatctcatcctgg

SEQ ID NO: 6687083 - DNA, 21 bp, Homo sapiens
caagccccatctcatcctggc

SEQ ID NO: 6687084 - DNA, 14 bp, Homo sapiens
caagccccatttcc

SEQ ID NO: 6687085 - DNA, 16 bp, Homo sapiens
caagcccccccttcca

SEQ ID NO: 6687086 - DNA, 14 bp, Homo sapiens
caagccccccgagt

SEQ ID NO: 6687087 - DNA, 13 bp, Homo sapiens
caagccccctgcc

SEQ ID NO: 6687088 - DNA, 22 bp, Homo sapiens
caagccccctggcagctgcccc

SEQ ID NO: 6687089 - DNA, 19 bp, Homo sapiens
caagcccctcagcccttgc

SEQ ID NO: 6687090 - DNA, 17 bp, Homo sapiens
caagcccctctttctgt

SEQ ID NO: 6687091 - DNA, 18 bp, Homo sapiens
caagcccgttagccccag

SEQ ID NO: 6687092 - DNA, 17 bp, Homo sapiens
caagccctaagcctgtc

SEQ ID NO: 6687093 - DNA, 17 bp, Homo sapiens
caagccctacagagctg

SEQ ID NO: 6687094 - DNA, 13 bp, Homo sapiens
caagccctactcg

SEQ ID NO: 6687095 - DNA, 12 bp, Homo sapiens
caagccctcagc

SEQ ID NO: 6687096 - DNA, 14 bp, Homo sapiens
caagccctcagctg

SEQ ID NO: 6687097 - DNA, 21 bp, Homo sapiens
caagccctccccatcccatgt

SEQ ID NO: 6687098 - DNA, 14 bp, Homo sapiens
caagccctgcccac

SEQ ID NO: 6687099 - DNA, 10 bp, Homo sapiens
caagccctgg

SEQ ID NO: 6687100 - DNA, 14 bp, Homo sapiens
caagccctggggca

SEQ ID NO: 6687101 - DNA, 15 bp, Homo sapiens
caagccctggggcag

SEQ ID NO: 6687102 - DNA, 16 bp, Homo sapiens
caagccctggggcagg

SEQ ID NO: 6687103 - DNA, 19 bp, Homo sapiens
caagcccttcggtcacctg

SEQ ID NO: 6687104 - DNA, 21 bp, Homo sapiens
caagccggccccccctctttt

SEQ ID NO: 6687105 - DNA, 15 bp, Homo sapiens
caagccggtgcccac

SEQ ID NO: 6687106 - DNA, 20 bp, Homo sapiens
caagccggtgggctagaaag

SEQ ID NO: 6687107 - DNA, 16 bp, Homo sapiens
caagccgtaggaccca

SEQ ID NO: 6687108 - DNA, 14 bp, Homo sapiens
caagccgtggccgg

SEQ ID NO: 6687109 - DNA, 23 bp, Homo sapiens
caagccgtggccggggtccaggc

SEQ ID NO: 6687110 - DNA, 16 bp, Homo sapiens
caagccgtggcttccc

SEQ ID NO: 6687111 - DNA, 21 bp, Homo sapiens
caagcctaaaattaaataaat

SEQ ID NO: 6687112 - DNA, 11 bp, Homo sapiens
caagcctcagc

SEQ ID NO: 6687113 - DNA, 23 bp, Homo sapiens
caagcctcagcaaacccaaagat

SEQ ID NO: 6687114 - DNA, 16 bp, Homo sapiens
caagcctccacagcga

SEQ ID NO: 6687115 - DNA, 13 bp, Homo sapiens
caagcctcctgta

SEQ ID NO: 6687116 - DNA, 18 bp, Homo sapiens
caagcctctgcccaggca

SEQ ID NO: 6687117 - DNA, 22 bp, Homo sapiens
caagcctctgccccaaggggcc

SEQ ID NO: 6687118 - DNA, 16 bp, Homo sapiens
caagcctcttctgaag

SEQ ID NO: 6687119 - DNA, 14 bp, Homo sapiens
caagcctgactttg

SEQ ID NO: 6687120 - DNA, 11 bp, Homo sapiens
caagcctgagg

SEQ ID NO: 6687121 - DNA, 13 bp, Homo sapiens
caagcctgaggga

SEQ ID NO: 6687122 - DNA, 18 bp, Homo sapiens
caagcctgagggaaaggc

SEQ ID NO: 6687123 - DNA, 23 bp, Homo sapiens
caagcctgcacaataaaaatgtt

SEQ ID NO: 6687124 - DNA, 19 bp, Homo sapiens
caagcctgcagctttctgg

SEQ ID NO: 6687125 - DNA, 19 bp, Homo sapiens
caagcctgccccggccact

SEQ ID NO: 6687126 - DNA, 14 bp, Homo sapiens
caagcctgcctagg

SEQ ID NO: 6687127 - DNA, 13 bp, Homo sapiens
caagcctgcctca

SEQ ID NO: 6687128 - DNA, 14 bp, Homo sapiens
caagcctgcctccc

SEQ ID NO: 6687129 - DNA, 19 bp, Homo sapiens
caagcctgcctcgccttgt

SEQ ID NO: 6687130 - DNA, 15 bp, Homo sapiens
caagcctgctgtgtc

SEQ ID NO: 6687131 - DNA, 18 bp, Homo sapiens
caagcctgctgtgtcctt

SEQ ID NO: 6687132 - DNA, 15 bp, Homo sapiens
caagcctggaaaaaa

SEQ ID NO: 6687133 - DNA, 11 bp, Homo sapiens
caagcctggag

SEQ ID NO: 6687134 - DNA, 19 bp, Homo sapiens
caagcctggagtaggcctg

SEQ ID NO: 6687135 - DNA, 13 bp, Homo sapiens
caagcctggcacc

SEQ ID NO: 6687136 - DNA, 15 bp, Homo sapiens
caagcctggcaccca

SEQ ID NO: 6687137 - DNA, 17 bp, Homo sapiens
caagcctggcacccacc

SEQ ID NO: 6687138 - DNA, 18 bp, Homo sapiens
caagcctggcacccaccg

SEQ ID NO: 6687139 - DNA, 22 bp, Homo sapiens
caagcctggcacccaccgtctc

SEQ ID NO: 6687140 - DNA, 12 bp, Homo sapiens
caagcctggcag

SEQ ID NO: 6687141 - DNA, 14 bp, Homo sapiens
caagcctggcaggg

SEQ ID NO: 6687142 - DNA, 15 bp, Homo sapiens
caagcctggcagggg

SEQ ID NO: 6687143 - DNA, 11 bp, Homo sapiens
caagcctggcc

SEQ ID NO: 6687144 - DNA, 24 bp, Homo sapiens
caagcctggcccagtgagagtgag

SEQ ID NO: 6687145 - DNA, 14 bp, Homo sapiens
caagcctgggccac

SEQ ID NO: 6687146 - DNA, 16 bp, Homo sapiens
caagcctgggccactg

SEQ ID NO: 6687147 - DNA, 19 bp, Homo sapiens
caagcctgggccactggca

SEQ ID NO: 6687148 - DNA, 22 bp, Homo sapiens
caagcctgggcttgagctgcag

SEQ ID NO: 6687149 - DNA, 12 bp, Homo sapiens
caagcctggtca

SEQ ID NO: 6687150 - DNA, 16 bp, Homo sapiens
caagcctggtcagccc

SEQ ID NO: 6687151 - DNA, 16 bp, Homo sapiens
caagcctgtgaataaa

SEQ ID NO: 6687152 - DNA, 15 bp, Homo sapiens
caagcctgtgggcag

SEQ ID NO: 6687153 - DNA, 14 bp, Homo sapiens
caagccttactcac

SEQ ID NO: 6687154 - DNA, 17 bp, Homo sapiens
caagccttactcacctc

SEQ ID NO: 6687155 - DNA, 18 bp, Homo sapiens
caagcctttatggctgct

SEQ ID NO: 6687156 - DNA, 16 bp, Homo sapiens
caagcctttgacctgt

SEQ ID NO: 6687157 - DNA, 19 bp, Homo sapiens
caagcctttgacctgttca

SEQ ID NO: 6687158 - DNA, 17 bp, Homo sapiens
caagcgacacaggctgc

SEQ ID NO: 6687159 - DNA, 21 bp, Homo sapiens
caagcgacctaaacagctgct

SEQ ID NO: 6687160 - DNA, 23 bp, Homo sapiens
caagcgacctaaacagctgcttt

SEQ ID NO: 6687161 - DNA, 21 bp, Homo sapiens
caagcgatccctcccctcagc

SEQ ID NO: 6687162 - DNA, 18 bp, Homo sapiens
caagcgattctcatgtct

SEQ ID NO: 6687163 - DNA, 23 bp, Homo sapiens
caagcgattctcccgcctcagcc

SEQ ID NO: 6687164 - DNA, 19 bp, Homo sapiens
caagcgattctcctgtctc

SEQ ID NO: 6687165 - DNA, 22 bp, Homo sapiens
caagcgattcttctgcttcagc

SEQ ID NO: 6687166 - DNA, 20 bp, Homo sapiens
caagcgattcttgtgcctcg

SEQ ID NO: 6687167 - DNA, 13 bp, Homo sapiens
caagcgcagggag

SEQ ID NO: 6687168 - DNA, 19 bp, Homo sapiens
caagcgccagaaagagctg

SEQ ID NO: 6687169 - DNA, 14 bp, Homo sapiens
caagcgccctggcc

SEQ ID NO: 6687170 - DNA, 12 bp, Homo sapiens
caagcgctcatg

SEQ ID NO: 6687171 - DNA, 16 bp, Homo sapiens
caagcgctccagggcc

SEQ ID NO: 6687172 - DNA, 18 bp, Homo sapiens
caagcgctcccagcctgc

SEQ ID NO: 6687173 - DNA, 24 bp, Homo sapiens
caagcgctcccagcctgccctcca

SEQ ID NO: 6687174 - DNA, 19 bp, Homo sapiens
caagcgctgggcgctcccg

SEQ ID NO: 6687175 - DNA, 15 bp, Homo sapiens
caagcggccctgaca

SEQ ID NO: 6687176 - DNA, 16 bp, Homo sapiens
caagcggccctgacac

SEQ ID NO: 6687177 - DNA, 18 bp, Homo sapiens
caagcggctcaagaataa

SEQ ID NO: 6687178 - DNA, 17 bp, Homo sapiens
caagcgggggcgtggct

SEQ ID NO: 6687179 - DNA, 15 bp, Homo sapiens
caagcgggtggctct

SEQ ID NO: 6687180 - DNA, 16 bp, Homo sapiens
caagcggtgtctctcc

SEQ ID NO: 6687181 - DNA, 19 bp, Homo sapiens
caagcgtctgggcaagagg

SEQ ID NO: 6687182 - DNA, 23 bp, Homo sapiens
caagcgtctgggcaagaggaaaa

SEQ ID NO: 6687183 - DNA, 18 bp, Homo sapiens
caagcgtgttctcagcac

SEQ ID NO: 6687184 - DNA, 13 bp, Homo sapiens
caagctaacctta

SEQ ID NO: 6687185 - DNA, 13 bp, Homo sapiens
caagctaagctgc

SEQ ID NO: 6687186 - DNA, 16 bp, Homo sapiens
caagctaagctgcagg

SEQ ID NO: 6687187 - DNA, 16 bp, Homo sapiens
caagctaagtaaaaat

SEQ ID NO: 6687188 - DNA, 22 bp, Homo sapiens
caagctaataaaatatcattca

SEQ ID NO: 6687189 - DNA, 23 bp, Homo sapiens
caagctaataaaatatcattcag

SEQ ID NO: 6687190 - DNA, 21 bp, Homo sapiens
caagctaatctgcctggtttt

SEQ ID NO: 6687191 - DNA, 21 bp, Homo sapiens
caagctaattgggagtccagg

SEQ ID NO: 6687192 - DNA, 17 bp, Homo sapiens
caagctagaaggccaca

SEQ ID NO: 6687193 - DNA, 18 bp, Homo sapiens
caagctagaaggccacat

SEQ ID NO: 6687194 - DNA, 17 bp, Homo sapiens
caagctaggtgctaatt

SEQ ID NO: 6687195 - DNA, 21 bp, Homo sapiens
caagctaggtgctatttgtca

SEQ ID NO: 6687196 - DNA, 16 bp, Homo sapiens
caagctagtgtttcta

SEQ ID NO: 6687197 - DNA, 16 bp, Homo sapiens
caagctatgggaattt

SEQ ID NO: 6687198 - DNA, 15 bp, Homo sapiens
caagctattcaattc

SEQ ID NO: 6687199 - DNA, 20 bp, Homo sapiens
caagctattcctttcccttc

SEQ ID NO: 6687200 - DNA, 21 bp, Homo sapiens
caagctattcctttcccttcc

SEQ ID NO: 6687201 - DNA, 23 bp, Homo sapiens
caagctattcctttcccttcctc

SEQ ID NO: 6687202 - DNA, 20 bp, Homo sapiens
caagctattctcatgcctca

SEQ ID NO: 6687203 - DNA, 23 bp, Homo sapiens
caagctatttaatatctggcact

SEQ ID NO: 6687204 - DNA, 14 bp, Homo sapiens
caagctcaaccttg

SEQ ID NO: 6687205 - DNA, 17 bp, Homo sapiens
caagctcacacagcagg

SEQ ID NO: 6687206 - DNA, 20 bp, Homo sapiens
caagctcacagttcctcgcc

SEQ ID NO: 6687207 - DNA, 19 bp, Homo sapiens
caagctcagagcagcctct

SEQ ID NO: 6687208 - DNA, 22 bp, Homo sapiens
caagctcagcacaatctgtaaa

SEQ ID NO: 6687209 - DNA, 18 bp, Homo sapiens
caagctcaggaccaggca

SEQ ID NO: 6687210 - DNA, 19 bp, Homo sapiens
caagctcaggtcctgctgc

SEQ ID NO: 6687211 - DNA, 17 bp, Homo sapiens
caagctcatagcacatg

SEQ ID NO: 6687212 - DNA, 18 bp, Homo sapiens
caagctcatccctggact

SEQ ID NO: 6687213 - DNA, 19 bp, Homo sapiens
caagctcatctatttggaa

SEQ ID NO: 6687214 - DNA, 20 bp, Homo sapiens
caagctccaactcccgggtt

SEQ ID NO: 6687215 - DNA, 13 bp, Homo sapiens
caagctccaagcc

SEQ ID NO: 6687216 - DNA, 14 bp, Homo sapiens
caagctccaagccc

SEQ ID NO: 6687217 - DNA, 17 bp, Homo sapiens
caagctccaagctccca

SEQ ID NO: 6687218 - DNA, 19 bp, Homo sapiens
caagctccaagctcccagg

SEQ ID NO: 6687219 - DNA, 14 bp, Homo sapiens
caagctccagtagc

SEQ ID NO: 6687220 - DNA, 22 bp, Homo sapiens
caagctcccaagggatggtgcc

SEQ ID NO: 6687221 - DNA, 13 bp, Homo sapiens
caagctccctgga

SEQ ID NO: 6687222 - DNA, 16 bp, Homo sapiens
caagctccctggagcc

SEQ ID NO: 6687223 - DNA, 17 bp, Homo sapiens
caagctccctggagccc

SEQ ID NO: 6687224 - DNA, 18 bp, Homo sapiens
caagctccctggagccct

SEQ ID NO: 6687225 - DNA, 19 bp, Homo sapiens
caagctccctggagccctg

SEQ ID NO: 6687226 - DNA, 14 bp, Homo sapiens
caagctccctggtg

SEQ ID NO: 6687227 - DNA, 14 bp, Homo sapiens
caagctccgcagga

SEQ ID NO: 6687228 - DNA, 15 bp, Homo sapiens
caagctccgcaggac

SEQ ID NO: 6687229 - DNA, 16 bp, Homo sapiens
caagctccgcaggact

SEQ ID NO: 6687230 - DNA, 17 bp, Homo sapiens
caagctccgcaggactt

SEQ ID NO: 6687231 - DNA, 17 bp, Homo sapiens
caagctccgcctcccgg

SEQ ID NO: 6687232 - DNA, 15 bp, Homo sapiens
caagctcctcctccc

SEQ ID NO: 6687233 - DNA, 19 bp, Homo sapiens
caagctctatcaccaagga

SEQ ID NO: 6687234 - DNA, 19 bp, Homo sapiens
caagctctcagcaagtgcc

SEQ ID NO: 6687235 - DNA, 22 bp, Homo sapiens
caagctctcagcaagtgcccag

SEQ ID NO: 6687236 - DNA, 16 bp, Homo sapiens
caagctctcgggacta

SEQ ID NO: 6687237 - DNA, 23 bp, Homo sapiens
caagctctcgggactagctgcct

SEQ ID NO: 6687238 - DNA, 15 bp, Homo sapiens
caagctctctgttgc

SEQ ID NO: 6687239 - DNA, 23 bp, Homo sapiens
caagctctctgttgcgctcccgc

SEQ ID NO: 6687240 - DNA, 12 bp, Homo sapiens
caagctctcttg

SEQ ID NO: 6687241 - DNA, 17 bp, Homo sapiens
caagctctgccctggct

SEQ ID NO: 6687242 - DNA, 17 bp, Homo sapiens
caagctctgcctcccgg

SEQ ID NO: 6687243 - DNA, 16 bp, Homo sapiens
caagctctgctcctct

SEQ ID NO: 6687244 - DNA, 20 bp, Homo sapiens
caagctctggaattgttgaa

SEQ ID NO: 6687245 - DNA, 14 bp, Homo sapiens
caagctctggggat

SEQ ID NO: 6687246 - DNA, 15 bp, Homo sapiens
caagctcttcattgc

SEQ ID NO: 6687247 - DNA, 11 bp, Homo sapiens
caagctcttcc

SEQ ID NO: 6687248 - DNA, 17 bp, Homo sapiens
caagctcttcccttgct

SEQ ID NO: 6687249 - DNA, 13 bp, Homo sapiens
caagctcttcctt

SEQ ID NO: 6687250 - DNA, 14 bp, Homo sapiens
caagctcttctcct

SEQ ID NO: 6687251 - DNA, 17 bp, Homo sapiens
caagctcttctcctcag

SEQ ID NO: 6687252 - DNA, 20 bp, Homo sapiens
caagctcttctcctcagctt

SEQ ID NO: 6687253 - DNA, 23 bp, Homo sapiens
caagctcttctcctcagcttggg

SEQ ID NO: 6687254 - DNA, 14 bp, Homo sapiens
caagctgaaatttt

SEQ ID NO: 6687255 - DNA, 13 bp, Homo sapiens
caagctgacttgg

SEQ ID NO: 6687256 - DNA, 16 bp, Homo sapiens
caagctgagaaaagta

SEQ ID NO: 6687257 - DNA, 21 bp, Homo sapiens
caagctgagaaaagtattctc

SEQ ID NO: 6687258 - DNA, 21 bp, Homo sapiens
caagctgagcaggacagccag

SEQ ID NO: 6687259 - DNA, 18 bp, Homo sapiens
caagctgaggtgcccagg

SEQ ID NO: 6687260 - DNA, 20 bp, Homo sapiens
caagctgagtattaaaatgt

SEQ ID NO: 6687261 - DNA, 22 bp, Homo sapiens
caagctgagtttcctatgggaa

SEQ ID NO: 6687262 - DNA, 20 bp, Homo sapiens
caagctgcaaaaggcctgtg

SEQ ID NO: 6687263 - DNA, 21 bp, Homo sapiens
caagctgcaaaaggcctgtga

SEQ ID NO: 6687264 - DNA, 11 bp, Homo sapiens
caagctgcaca

SEQ ID NO: 6687265 - DNA, 13 bp, Homo sapiens
caagctgcaccct

SEQ ID NO: 6687266 - DNA, 14 bp, Homo sapiens
caagctgcaccctc

SEQ ID NO: 6687267 - DNA, 14 bp, Homo sapiens
caagctgcatctag

SEQ ID NO: 6687268 - DNA, 12 bp, Homo sapiens
caagctgcccag

SEQ ID NO: 6687269 - DNA, 13 bp, Homo sapiens
caagctgcccagc

SEQ ID NO: 6687270 - DNA, 16 bp, Homo sapiens
caagctgcccagccct

SEQ ID NO: 6687271 - DNA, 19 bp, Homo sapiens
caagctgcctccctgtcca

SEQ ID NO: 6687272 - DNA, 16 bp, Homo sapiens
caagctgcctctgaca

SEQ ID NO: 6687273 - DNA, 23 bp, Homo sapiens
caagctgcctctgacagcagcct

SEQ ID NO: 6687274 - DNA, 19 bp, Homo sapiens
caagctgctctccttcact

SEQ ID NO: 6687275 - DNA, 18 bp, Homo sapiens
caagctgctctgagccac

SEQ ID NO: 6687276 - DNA, 21 bp, Homo sapiens
caagctgctctgagccacagt

SEQ ID NO: 6687277 - DNA, 22 bp, Homo sapiens
caagctgctctgagccacagtg

SEQ ID NO: 6687278 - DNA, 18 bp, Homo sapiens
caagctggaaaggccagc

SEQ ID NO: 6687279 - DNA, 22 bp, Homo sapiens
caagctggaaaggccagcagcc

SEQ ID NO: 6687280 - DNA, 18 bp, Homo sapiens
caagctggatgcagtggc

SEQ ID NO: 6687281 - DNA, 23 bp, Homo sapiens
caagctggatgcagtggctcatg

SEQ ID NO: 6687282 - DNA, 13 bp, Homo sapiens
caagctggcacaa

SEQ ID NO: 6687283 - DNA, 15 bp, Homo sapiens
caagctggcacaaaa

SEQ ID NO: 6687284 - DNA, 14 bp, Homo sapiens
caagctggcaggag

SEQ ID NO: 6687285 - DNA, 12 bp, Homo sapiens
caagctggccaa

SEQ ID NO: 6687286 - DNA, 15 bp, Homo sapiens
caagctggccaaagt

SEQ ID NO: 6687287 - DNA, 16 bp, Homo sapiens
caagctggccaaagtc

SEQ ID NO: 6687288 - DNA, 21 bp, Homo sapiens
caagctggccaaagtcacttc

SEQ ID NO: 6687289 - DNA, 13 bp, Homo sapiens
caagctggcctct

SEQ ID NO: 6687290 - DNA, 19 bp, Homo sapiens
caagctggtcccactcagt

SEQ ID NO: 6687291 - DNA, 19 bp, Homo sapiens
caagctggtggcctctgca

SEQ ID NO: 6687292 - DNA, 19 bp, Homo sapiens
caagctgtacaaagggaag

SEQ ID NO: 6687293 - DNA, 22 bp, Homo sapiens
caagctgtacaaagggaagcag

SEQ ID NO: 6687294 - DNA, 21 bp, Homo sapiens
caagctgtatgtacttccagt

SEQ ID NO: 6687295 - DNA, 15 bp, Homo sapiens
caagctgtcacaggt

SEQ ID NO: 6687296 - DNA, 18 bp, Homo sapiens
caagctgtccagagaaaa

SEQ ID NO: 6687297 - DNA, 14 bp, Homo sapiens
caagctgtccctgc

SEQ ID NO: 6687298 - DNA, 20 bp, Homo sapiens
caagctgtccctgcagggcc

SEQ ID NO: 6687299 - DNA, 21 bp, Homo sapiens
caagctgtccctgcagggcca

SEQ ID NO: 6687300 - DNA, 11 bp, Homo sapiens
caagctgtctc

SEQ ID NO: 6687301 - DNA, 19 bp, Homo sapiens
caagctgtgcaggcatggt

SEQ ID NO: 6687302 - DNA, 18 bp, Homo sapiens
caagctgtgccaccctgg

SEQ ID NO: 6687303 - DNA, 19 bp, Homo sapiens
caagctgtgccaccctggg

SEQ ID NO: 6687304 - DNA, 21 bp, Homo sapiens
caagctgtgccaccctgggct

SEQ ID NO: 6687305 - DNA, 14 bp, Homo sapiens
caagctgtgctggg

SEQ ID NO: 6687306 - DNA, 19 bp, Homo sapiens
caagctgtgctgggaagcc

SEQ ID NO: 6687307 - DNA, 15 bp, Homo sapiens
caagctgtgttactt

SEQ ID NO: 6687308 - DNA, 17 bp, Homo sapiens
caagctgtgttcatcca

SEQ ID NO: 6687309 - DNA, 22 bp, Homo sapiens
caagctgtgttcatccagctac

SEQ ID NO: 6687310 - DNA, 19 bp, Homo sapiens
caagctgttaaagatattt

SEQ ID NO: 6687311 - DNA, 19 bp, Homo sapiens
caagctgttgaccaggcac

SEQ ID NO: 6687312 - DNA, 15 bp, Homo sapiens
caagcttaaggagag

SEQ ID NO: 6687313 - DNA, 20 bp, Homo sapiens
caagcttaaggagaggagag

SEQ ID NO: 6687314 - DNA, 23 bp, Homo sapiens
caagcttaaggagaggagagcat

SEQ ID NO: 6687315 - DNA, 18 bp, Homo sapiens
caagcttaatagccctcc

SEQ ID NO: 6687316 - DNA, 19 bp, Homo sapiens
caagcttaatagccctccc

SEQ ID NO: 6687317 - DNA, 20 bp, Homo sapiens
caagcttaatggctgataat

SEQ ID NO: 6687318 - DNA, 18 bp, Homo sapiens
caagcttagtcctgggag

SEQ ID NO: 6687319 - DNA, 22 bp, Homo sapiens
caagcttcaaccctcagccttg

SEQ ID NO: 6687320 - DNA, 23 bp, Homo sapiens
caagcttcaaccctcagccttga

SEQ ID NO: 6687321 - DNA, 14 bp, Homo sapiens
caagcttcaagtga

SEQ ID NO: 6687322 - DNA, 21 bp, Homo sapiens
caagcttcaagtgatatatgt

SEQ ID NO: 6687323 - DNA, 16 bp, Homo sapiens
caagcttcagagccta

SEQ ID NO: 6687324 - DNA, 18 bp, Homo sapiens
caagcttcagagcctagc

SEQ ID NO: 6687325 - DNA, 19 bp, Homo sapiens
caagcttcagagcctagcc

SEQ ID NO: 6687326 - DNA, 21 bp, Homo sapiens
caagcttcagagcctagccac

SEQ ID NO: 6687327 - DNA, 19 bp, Homo sapiens
caagcttcagtttcctggt

SEQ ID NO: 6687328 - DNA, 12 bp, Homo sapiens
caagcttccctc

SEQ ID NO: 6687329 - DNA, 12 bp, Homo sapiens
caagcttcctgt

SEQ ID NO: 6687330 - DNA, 23 bp, Homo sapiens
caagcttcctgtgccctcacccc

SEQ ID NO: 6687331 - DNA, 13 bp, Homo sapiens
caagcttctgtcc

SEQ ID NO: 6687332 - DNA, 13 bp, Homo sapiens
caagcttcttgct

SEQ ID NO: 6687333 - DNA, 15 bp, Homo sapiens
caagcttcttgctga

SEQ ID NO: 6687334 - DNA, 13 bp, Homo sapiens
caagcttggcagc

SEQ ID NO: 6687335 - DNA, 20 bp, Homo sapiens
caagcttggcagccgagctc

SEQ ID NO: 6687336 - DNA, 16 bp, Homo sapiens
caagcttggtcaaact

SEQ ID NO: 6687337 - DNA, 17 bp, Homo sapiens
caagcttggtcaaactt

SEQ ID NO: 6687338 - DNA, 16 bp, Homo sapiens
caagcttgtatataca

SEQ ID NO: 6687339 - DNA, 22 bp, Homo sapiens
caagcttgtatatacatattat

SEQ ID NO: 6687340 - DNA, 23 bp, Homo sapiens
caagcttgtccaggttgatcttg

SEQ ID NO: 6687341 - DNA, 13 bp, Homo sapiens
caagcttgtgtac

SEQ ID NO: 6687342 - DNA, 16 bp, Homo sapiens
caagcttgtgtgggcc

SEQ ID NO: 6687343 - DNA, 17 bp, Homo sapiens
caagcttgtttccctgc

SEQ ID NO: 6687344 - DNA, 20 bp, Homo sapiens
caagctttcaaacatgttga

SEQ ID NO: 6687345 - DNA, 19 bp, Homo sapiens
caagctttcttctacaacc

SEQ ID NO: 6687346 - DNA, 21 bp, Homo sapiens
caagctttcttctacaaccag

SEQ ID NO: 6687347 - DNA, 13 bp, Homo sapiens
caagctttgctcc

SEQ ID NO: 6687348 - DNA, 12 bp, Homo sapiens
caagctttggtt

SEQ ID NO: 6687349 - DNA, 14 bp, Homo sapiens
caagcttttaactt

SEQ ID NO: 6687350 - DNA, 15 bp, Homo sapiens
caagcttttgcttga

SEQ ID NO: 6687351 - DNA, 13 bp, Homo sapiens
caagcttttttat

SEQ ID NO: 6687352 - DNA, 14 bp, Homo sapiens
caagcttttttatt

SEQ ID NO: 6687353 - DNA, 15 bp, Homo sapiens
caagcttttttattt

SEQ ID NO: 6687354 - DNA, 23 bp, Homo sapiens
caagcttttttattttttataca

SEQ ID NO: 6687355 - DNA, 15 bp, Homo sapiens
caaggaaaaacaggt

SEQ ID NO: 6687356 - DNA, 13 bp, Homo sapiens
caaggaaaaagaa

SEQ ID NO: 6687357 - DNA, 15 bp, Homo sapiens
caaggaaaaggagga

SEQ ID NO: 6687358 - DNA, 16 bp, Homo sapiens
caaggaaaataagtga

SEQ ID NO: 6687359 - DNA, 20 bp, Homo sapiens
caaggaaaataagtgaaatt

SEQ ID NO: 6687360 - DNA, 16 bp, Homo sapiens
caaggaaaatctatat

SEQ ID NO: 6687361 - DNA, 16 bp, Homo sapiens
caaggaaaattgaaag

SEQ ID NO: 6687362 - DNA, 19 bp, Homo sapiens
caaggaaaattgaaagtat

SEQ ID NO: 6687363 - DNA, 21 bp, Homo sapiens
caaggaaaccacagctgctgg

SEQ ID NO: 6687364 - DNA, 22 bp, Homo sapiens
caaggaaaccgcctagtttact

SEQ ID NO: 6687365 - DNA, 22 bp, Homo sapiens
caaggaaagagagaccccagtc

SEQ ID NO: 6687366 - DNA, 20 bp, Homo sapiens
caaggaaagccccagcacta

SEQ ID NO: 6687367 - DNA, 15 bp, Homo sapiens
caaggaaaggcaaat

SEQ ID NO: 6687368 - DNA, 22 bp, Homo sapiens
caaggaaaggcatgtacaaaaa

SEQ ID NO: 6687369 - DNA, 14 bp, Homo sapiens
caaggaaaggcctg

SEQ ID NO: 6687370 - DNA, 19 bp, Homo sapiens
caaggaaaggctcatttaa

SEQ ID NO: 6687371 - DNA, 19 bp, Homo sapiens
caaggaaaggggagaaggg

SEQ ID NO: 6687372 - DNA, 20 bp, Homo sapiens
caaggaaagggggtcccagt

SEQ ID NO: 6687373 - DNA, 22 bp, Homo sapiens
caaggaaagggggtcccagtgg

SEQ ID NO: 6687374 - DNA, 14 bp, Homo sapiens
caaggaaataaagc

SEQ ID NO: 6687375 - DNA, 23 bp, Homo sapiens
caaggaaatacaacctagggtgc

SEQ ID NO: 6687376 - DNA, 14 bp, Homo sapiens
caaggaaatagagg

SEQ ID NO: 6687377 - DNA, 16 bp, Homo sapiens
caaggaaatgtcctgc

SEQ ID NO: 6687378 - DNA, 21 bp, Homo sapiens
caaggaaattaagaactgaat

SEQ ID NO: 6687379 - DNA, 16 bp, Homo sapiens
caaggaacaaaaaaac

SEQ ID NO: 6687380 - DNA, 21 bp, Homo sapiens
caaggaacaagacccccagga

SEQ ID NO: 6687381 - DNA, 11 bp, Homo sapiens
caaggaacaga

SEQ ID NO: 6687382 - DNA, 16 bp, Homo sapiens
caaggaacagccacaa

SEQ ID NO: 6687383 - DNA, 15 bp, Homo sapiens
caaggaaccctcagg

SEQ ID NO: 6687384 - DNA, 16 bp, Homo sapiens
caaggaaccctcaggc

SEQ ID NO: 6687385 - DNA, 20 bp, Homo sapiens
caaggaaccctcaggccacc

SEQ ID NO: 6687386 - DNA, 24 bp, Homo sapiens
caaggaaccctcaggccaccctcc

SEQ ID NO: 6687387 - DNA, 17 bp, Homo sapiens
caaggaacctaattgaa

SEQ ID NO: 6687388 - DNA, 21 bp, Homo sapiens
caaggaacctaattgaaattt

SEQ ID NO: 6687389 - DNA, 17 bp, Homo sapiens
caaggaacttcatgctt

SEQ ID NO: 6687390 - DNA, 18 bp, Homo sapiens
caaggaacttgaaaaata

SEQ ID NO: 6687391 - DNA, 14 bp, Homo sapiens
caaggaagaaaacg

SEQ ID NO: 6687392 - DNA, 16 bp, Homo sapiens
caaggaagaaaacgga

SEQ ID NO: 6687393 - DNA, 13 bp, Homo sapiens
caaggaagaaatt

SEQ ID NO: 6687394 - DNA, 16 bp, Homo sapiens
caaggaagagccagcc

SEQ ID NO: 6687395 - DNA, 17 bp, Homo sapiens
caaggaagagccagccg

SEQ ID NO: 6687396 - DNA, 21 bp, Homo sapiens
caaggaagcagaagacgggag

SEQ ID NO: 6687397 - DNA, 16 bp, Homo sapiens
caaggaagcagagcac

SEQ ID NO: 6687398 - DNA, 13 bp, Homo sapiens
caaggaagcagcc

SEQ ID NO: 6687399 - DNA, 19 bp, Homo sapiens
caaggaagcagcctcagag

SEQ ID NO: 6687400 - DNA, 11 bp, Homo sapiens
caaggaagctc

SEQ ID NO: 6687401 - DNA, 17 bp, Homo sapiens
caaggaagctccttcct

SEQ ID NO: 6687402 - DNA, 18 bp, Homo sapiens
caaggaagctccttcctg

SEQ ID NO: 6687403 - DNA, 19 bp, Homo sapiens
caaggaagctccttcctgt

SEQ ID NO: 6687404 - DNA, 12 bp, Homo sapiens
caaggaaggaaa

SEQ ID NO: 6687405 - DNA, 13 bp, Homo sapiens
caaggaaggaaag

SEQ ID NO: 6687406 - DNA, 18 bp, Homo sapiens
caaggaaggaaagaaaga

SEQ ID NO: 6687407 - DNA, 11 bp, Homo sapiens
caaggaaggag

SEQ ID NO: 6687408 - DNA, 16 bp, Homo sapiens
caaggaaggagcccct

SEQ ID NO: 6687409 - DNA, 17 bp, Homo sapiens
caaggaagggacaagac

SEQ ID NO: 6687410 - DNA, 13 bp, Homo sapiens
caaggaagtgggg

SEQ ID NO: 6687411 - DNA, 21 bp, Homo sapiens
caaggaagtgggggccgctgg

SEQ ID NO: 6687412 - DNA, 22 bp, Homo sapiens
caaggaagttttaactttaata

SEQ ID NO: 6687413 - DNA, 16 bp, Homo sapiens
caaggaataaatgaga

SEQ ID NO: 6687414 - DNA, 13 bp, Homo sapiens
caaggaatacaag

SEQ ID NO: 6687415 - DNA, 22 bp, Homo sapiens
caaggaatgaattttttcctac

SEQ ID NO: 6687416 - DNA, 17 bp, Homo sapiens
caaggaatgcctgtgcc

SEQ ID NO: 6687417 - DNA, 18 bp, Homo sapiens
caaggaatgcctgtgcca

SEQ ID NO: 6687418 - DNA, 13 bp, Homo sapiens
caaggacaagcaa

SEQ ID NO: 6687419 - DNA, 14 bp, Homo sapiens
caaggacaaggggc

SEQ ID NO: 6687420 - DNA, 19 bp, Homo sapiens
caaggacaatgccttggga

SEQ ID NO: 6687421 - DNA, 14 bp, Homo sapiens
caaggacaccctcc

SEQ ID NO: 6687422 - DNA, 23 bp, Homo sapiens
caaggacagaaccctccacccct

SEQ ID NO: 6687423 - DNA, 14 bp, Homo sapiens
caaggacagacagc

SEQ ID NO: 6687424 - DNA, 12 bp, Homo sapiens
caaggacaggag

SEQ ID NO: 6687425 - DNA, 14 bp, Homo sapiens
caaggacaggagcc

SEQ ID NO: 6687426 - DNA, 16 bp, Homo sapiens
caaggacattcactgc

SEQ ID NO: 6687427 - DNA, 18 bp, Homo sapiens
caaggacattcactgctg

SEQ ID NO: 6687428 - DNA, 21 bp, Homo sapiens
caaggacattgtatgcaggga

SEQ ID NO: 6687429 - DNA, 18 bp, Homo sapiens
caaggaccaacaagggca

SEQ ID NO: 6687430 - DNA, 18 bp, Homo sapiens
caaggaccaggactccct

SEQ ID NO: 6687431 - DNA, 21 bp, Homo sapiens
caaggaccaggactccctcct

SEQ ID NO: 6687432 - DNA, 18 bp, Homo sapiens
caaggacccagccctcgc

SEQ ID NO: 6687433 - DNA, 22 bp, Homo sapiens
caaggacccagcctgagatggt

SEQ ID NO: 6687434 - DNA, 12 bp, Homo sapiens
caaggacccagg

SEQ ID NO: 6687435 - DNA, 13 bp, Homo sapiens
caaggacccaggc

SEQ ID NO: 6687436 - DNA, 14 bp, Homo sapiens
caaggacccaggcg

SEQ ID NO: 6687437 - DNA, 16 bp, Homo sapiens
caaggacccaggcgct

SEQ ID NO: 6687438 - DNA, 17 bp, Homo sapiens
caaggacccaggcgctg

SEQ ID NO: 6687439 - DNA, 13 bp, Homo sapiens
caaggacccctca

SEQ ID NO: 6687440 - DNA, 21 bp, Homo sapiens
caaggaccctgttttccacac

SEQ ID NO: 6687441 - DNA, 22 bp, Homo sapiens
caaggaccttttggaatgactg

SEQ ID NO: 6687442 - DNA, 20 bp, Homo sapiens
caaggacgcttcacaggaca

SEQ ID NO: 6687443 - DNA, 21 bp, Homo sapiens
caaggactacgttaagggaag

SEQ ID NO: 6687444 - DNA, 14 bp, Homo sapiens
caaggactagggtc

SEQ ID NO: 6687445 - DNA, 15 bp, Homo sapiens
caaggactcccggag

SEQ ID NO: 6687446 - DNA, 12 bp, Homo sapiens
caaggactcctg

SEQ ID NO: 6687447 - DNA, 14 bp, Homo sapiens
caaggactgactga

SEQ ID NO: 6687448 - DNA, 15 bp, Homo sapiens
caaggactgactgag

SEQ ID NO: 6687449 - DNA, 18 bp, Homo sapiens
caaggactgactttgcca

SEQ ID NO: 6687450 - DNA, 12 bp, Homo sapiens
caaggactgagc

SEQ ID NO: 6687451 - DNA, 13 bp, Homo sapiens
caaggactgagca

SEQ ID NO: 6687452 - DNA, 12 bp, Homo sapiens
caaggactgagg

SEQ ID NO: 6687453 - DNA, 14 bp, Homo sapiens
caaggactgagggc

SEQ ID NO: 6687454 - DNA, 17 bp, Homo sapiens
caaggactgagggcagt

SEQ ID NO: 6687455 - DNA, 15 bp, Homo sapiens
caaggactgcaggga

SEQ ID NO: 6687456 - DNA, 19 bp, Homo sapiens
caaggactgtttcagtgtg

SEQ ID NO: 6687457 - DNA, 14 bp, Homo sapiens
caaggacttcctgt

SEQ ID NO: 6687458 - DNA, 22 bp, Homo sapiens
caaggacttcctgtccagctcc

SEQ ID NO: 6687459 - DNA, 19 bp, Homo sapiens
caaggactttccaaatcca

SEQ ID NO: 6687460 - DNA, 19 bp, Homo sapiens
caaggactttccagtgagg

SEQ ID NO: 6687461 - DNA, 15 bp, Homo sapiens
caaggactttgcagc

SEQ ID NO: 6687462 - DNA, 15 bp, Homo sapiens
caaggactttgtaca

SEQ ID NO: 6687463 - DNA, 14 bp, Homo sapiens
caaggagaaacaga

SEQ ID NO: 6687464 - DNA, 20 bp, Homo sapiens
caaggagaaacagagacagg

SEQ ID NO: 6687465 - DNA, 13 bp, Homo sapiens
caaggagaacaaa

SEQ ID NO: 6687466 - DNA, 21 bp, Homo sapiens
caaggagaatatgataaaaca

SEQ ID NO: 6687467 - DNA, 20 bp, Homo sapiens
caaggagacacaacaactcc

SEQ ID NO: 6687468 - DNA, 22 bp, Homo sapiens
caaggagaccaagtcctggcta

SEQ ID NO: 6687469 - DNA, 13 bp, Homo sapiens
caaggagaggagg

SEQ ID NO: 6687470 - DNA, 18 bp, Homo sapiens
caaggagaggcaaagaaa

SEQ ID NO: 6687471 - DNA, 16 bp, Homo sapiens
caaggagataagaaag

SEQ ID NO: 6687472 - DNA, 23 bp, Homo sapiens
caaggagatataaaatctagatc

SEQ ID NO: 6687473 - DNA, 19 bp, Homo sapiens
caaggagatatatcagtgt

SEQ ID NO: 6687474 - DNA, 13 bp, Homo sapiens
caaggagatgaag

SEQ ID NO: 6687475 - DNA, 14 bp, Homo sapiens
caaggagatttctt

SEQ ID NO: 6687476 - DNA, 16 bp, Homo sapiens
caaggagatttcttag

SEQ ID NO: 6687477 - DNA, 21 bp, Homo sapiens
caaggagcaaacactgaaata

SEQ ID NO: 6687478 - DNA, 16 bp, Homo sapiens
caaggagcacaagcca

SEQ ID NO: 6687479 - DNA, 22 bp, Homo sapiens
caaggagcacaggtcccacctc

SEQ ID NO: 6687480 - DNA, 13 bp, Homo sapiens
caaggagcagaga

SEQ ID NO: 6687481 - DNA, 15 bp, Homo sapiens
caaggagcagagagg

SEQ ID NO: 6687482 - DNA, 16 bp, Homo sapiens
caaggagcagagaggt

SEQ ID NO: 6687483 - DNA, 13 bp, Homo sapiens
caaggagcatcct

SEQ ID NO: 6687484 - DNA, 14 bp, Homo sapiens
caaggagcccagaa

SEQ ID NO: 6687485 - DNA, 20 bp, Homo sapiens
caaggagctactgacattcc

SEQ ID NO: 6687486 - DNA, 20 bp, Homo sapiens
caaggagctgatttccaggc

SEQ ID NO: 6687487 - DNA, 21 bp, Homo sapiens
caaggagctgatttccaggcc

SEQ ID NO: 6687488 - DNA, 22 bp, Homo sapiens
caaggagctgatttccaggccc

SEQ ID NO: 6687489 - DNA, 16 bp, Homo sapiens
caaggagctttcttgt

SEQ ID NO: 6687490 - DNA, 14 bp, Homo sapiens
caaggaggaaaaac

SEQ ID NO: 6687491 - DNA, 20 bp, Homo sapiens
caaggaggaaaaacagacaa

SEQ ID NO: 6687492 - DNA, 17 bp, Homo sapiens
caaggaggcagcctgga

SEQ ID NO: 6687493 - DNA, 13 bp, Homo sapiens
caaggaggcagga

SEQ ID NO: 6687494 - DNA, 22 bp, Homo sapiens
caaggaggcctggggaggccct

SEQ ID NO: 6687495 - DNA, 12 bp, Homo sapiens
caaggagggaga

SEQ ID NO: 6687496 - DNA, 15 bp, Homo sapiens
caaggagggagaaag

SEQ ID NO: 6687497 - DNA, 20 bp, Homo sapiens
caaggagggcacaggtgtct

SEQ ID NO: 6687498 - DNA, 18 bp, Homo sapiens
caaggaggggctgtaaaa

SEQ ID NO: 6687499 - DNA, 20 bp, Homo sapiens
caaggagggggcctcattgt

SEQ ID NO: 6687500 - DNA, 19 bp, Homo sapiens
caaggagggtgagtgcaag

SEQ ID NO: 6687501 - DNA, 23 bp, Homo sapiens
caaggagggtgtaatggagcatc

SEQ ID NO: 6687502 - DNA, 17 bp, Homo sapiens
caaggaggtagagaggg

SEQ ID NO: 6687503 - DNA, 24 bp, Homo sapiens
caaggaggtcccaggaagtccagc

SEQ ID NO: 6687504 - DNA, 17 bp, Homo sapiens
caaggaggtctgtgcca

SEQ ID NO: 6687505 - DNA, 16 bp, Homo sapiens
caaggagtgcccgcct

SEQ ID NO: 6687506 - DNA, 23 bp, Homo sapiens
caaggagttccatgaagaccaca

SEQ ID NO: 6687507 - DNA, 18 bp, Homo sapiens
caaggataattaaatata

SEQ ID NO: 6687508 - DNA, 20 bp, Homo sapiens
caaggatagatgctggccca

SEQ ID NO: 6687509 - DNA, 18 bp, Homo sapiens
caaggatatactgcagct

SEQ ID NO: 6687510 - DNA, 17 bp, Homo sapiens
caaggatatcagagctg

SEQ ID NO: 6687511 - DNA, 17 bp, Homo sapiens
caaggatcctctccact

SEQ ID NO: 6687512 - DNA, 14 bp, Homo sapiens
caaggatcctgagc

SEQ ID NO: 6687513 - DNA, 16 bp, Homo sapiens
caaggatcctgagcca

SEQ ID NO: 6687514 - DNA, 17 bp, Homo sapiens
caaggatcctgagccag

SEQ ID NO: 6687515 - DNA, 19 bp, Homo sapiens
caaggatcctgagccagat

SEQ ID NO: 6687516 - DNA, 20 bp, Homo sapiens
caaggatcctgagccagatt

SEQ ID NO: 6687517 - DNA, 18 bp, Homo sapiens
caaggatcggactctgcc

SEQ ID NO: 6687518 - DNA, 20 bp, Homo sapiens
caaggatcggactctgcccc

SEQ ID NO: 6687519 - DNA, 14 bp, Homo sapiens
caaggatctttcac

SEQ ID NO: 6687520 - DNA, 17 bp, Homo sapiens
caaggatgaccacaccc

SEQ ID NO: 6687521 - DNA, 14 bp, Homo sapiens
caaggatgatccag

SEQ ID NO: 6687522 - DNA, 21 bp, Homo sapiens
caaggatgatctaggaagact

SEQ ID NO: 6687523 - DNA, 18 bp, Homo sapiens
caaggatgtccaatcttt

SEQ ID NO: 6687524 - DNA, 15 bp, Homo sapiens
caaggattcaatgca

SEQ ID NO: 6687525 - DNA, 20 bp, Homo sapiens
caaggattgctactgtccta

SEQ ID NO: 6687526 - DNA, 14 bp, Homo sapiens
caaggattttttaa

SEQ ID NO: 6687527 - DNA, 17 bp, Homo sapiens
caaggattttttaaaaa

SEQ ID NO: 6687528 - DNA, 23 bp, Homo sapiens
caaggcaaacaatcccaatcttt

SEQ ID NO: 6687529 - DNA, 16 bp, Homo sapiens
caaggcaaatgtccaa

SEQ ID NO: 6687530 - DNA, 13 bp, Homo sapiens
caaggcaaatgtt

SEQ ID NO: 6687531 - DNA, 16 bp, Homo sapiens
caaggcaagaagtggg

SEQ ID NO: 6687532 - DNA, 12 bp, Homo sapiens
caaggcaagcat

SEQ ID NO: 6687533 - DNA, 17 bp, Homo sapiens
caaggcaagcatgaata

SEQ ID NO: 6687534 - DNA, 17 bp, Homo sapiens
caaggcaaggctgtcaa

SEQ ID NO: 6687535 - DNA, 18 bp, Homo sapiens
caaggcaaggggtgcctg

SEQ ID NO: 6687536 - DNA, 20 bp, Homo sapiens
caaggcaaggggtgcctggg

SEQ ID NO: 6687537 - DNA, 15 bp, Homo sapiens
caaggcaatggaaac

SEQ ID NO: 6687538 - DNA, 15 bp, Homo sapiens
caaggcaatgggcta

SEQ ID NO: 6687539 - DNA, 16 bp, Homo sapiens
caaggcaatgggctac

SEQ ID NO: 6687540 - DNA, 18 bp, Homo sapiens
caaggcacattgaaatac

SEQ ID NO: 6687541 - DNA, 22 bp, Homo sapiens
caaggcaccgcagcctgtcagc

SEQ ID NO: 6687542 - DNA, 22 bp, Homo sapiens
caaggcacgtttggcatttctc

SEQ ID NO: 6687543 - DNA, 15 bp, Homo sapiens
caaggcactaatgtt

SEQ ID NO: 6687544 - DNA, 21 bp, Homo sapiens
caaggcactgagcgcctgcag

SEQ ID NO: 6687545 - DNA, 18 bp, Homo sapiens
caaggcacttgaggggga

SEQ ID NO: 6687546 - DNA, 20 bp, Homo sapiens
caaggcacttgagggggaag

SEQ ID NO: 6687547 - DNA, 21 bp, Homo sapiens
caaggcacttttaaacgtgga

SEQ ID NO: 6687548 - DNA, 16 bp, Homo sapiens
caaggcagaaggccag

SEQ ID NO: 6687549 - DNA, 16 bp, Homo sapiens
caaggcagaggcctgg

SEQ ID NO: 6687550 - DNA, 20 bp, Homo sapiens
caaggcagaggcctgggctg

SEQ ID NO: 6687551 - DNA, 14 bp, Homo sapiens
caaggcagcaaggc

SEQ ID NO: 6687552 - DNA, 19 bp, Homo sapiens
caaggcagcaaggcccgag

SEQ ID NO: 6687553 - DNA, 12 bp, Homo sapiens
caaggcagccgt

SEQ ID NO: 6687554 - DNA, 12 bp, Homo sapiens
caaggcagcctc

SEQ ID NO: 6687555 - DNA, 15 bp, Homo sapiens
caaggcagcctccag

SEQ ID NO: 6687556 - DNA, 16 bp, Homo sapiens
caaggcagcctccaga

SEQ ID NO: 6687557 - DNA, 22 bp, Homo sapiens
caaggcagcctccagagccagc

SEQ ID NO: 6687558 - DNA, 20 bp, Homo sapiens
caaggcagcctgaacactca

SEQ ID NO: 6687559 - DNA, 15 bp, Homo sapiens
caaggcagcgggatc

SEQ ID NO: 6687560 - DNA, 14 bp, Homo sapiens
caaggcaggcctga

SEQ ID NO: 6687561 - DNA, 19 bp, Homo sapiens
caaggcaggcctttcctac

SEQ ID NO: 6687562 - DNA, 13 bp, Homo sapiens
caaggcagggacc

SEQ ID NO: 6687563 - DNA, 23 bp, Homo sapiens
caaggcaggtagatcgcttgagc

SEQ ID NO: 6687564 - DNA, 13 bp, Homo sapiens
caaggcaggtgcc

SEQ ID NO: 6687565 - DNA, 14 bp, Homo sapiens
caaggcaggtgcct

SEQ ID NO: 6687566 - DNA, 20 bp, Homo sapiens
caaggcaggtgcctccaggt

SEQ ID NO: 6687567 - DNA, 15 bp, Homo sapiens
caaggcagtgcatgc

SEQ ID NO: 6687568 - DNA, 17 bp, Homo sapiens
caaggcagttctgtgtc

SEQ ID NO: 6687569 - DNA, 19 bp, Homo sapiens
caaggcagttctgtgtcct

SEQ ID NO: 6687570 - DNA, 18 bp, Homo sapiens
caaggcataatgtaattt

SEQ ID NO: 6687571 - DNA, 17 bp, Homo sapiens
caaggcatacctgtcct

SEQ ID NO: 6687572 - DNA, 18 bp, Homo sapiens
caaggcatacctgtccta

SEQ ID NO: 6687573 - DNA, 15 bp, Homo sapiens
caaggcatccccagt

SEQ ID NO: 6687574 - DNA, 14 bp, Homo sapiens
caaggcattcctca

SEQ ID NO: 6687575 - DNA, 17 bp, Homo sapiens
caaggcattctcccagc

SEQ ID NO: 6687576 - DNA, 17 bp, Homo sapiens
caaggcatttgtctttg

SEQ ID NO: 6687577 - DNA, 16 bp, Homo sapiens
caaggccaaaggaagc

SEQ ID NO: 6687578 - DNA, 19 bp, Homo sapiens
caaggccaaaggaagcaca

SEQ ID NO: 6687579 - DNA, 20 bp, Homo sapiens
caaggccaaaggaagcacat

SEQ ID NO: 6687580 - DNA, 18 bp, Homo sapiens
caaggccacaaaaacaat

SEQ ID NO: 6687581 - DNA, 17 bp, Homo sapiens
caaggccacctctgcct

SEQ ID NO: 6687582 - DNA, 23 bp, Homo sapiens
caaggccaccttggaggaggatg

SEQ ID NO: 6687583 - DNA, 15 bp, Homo sapiens
caaggccagaaaaag

SEQ ID NO: 6687584 - DNA, 18 bp, Homo sapiens
caaggccagagtggcctg

SEQ ID NO: 6687585 - DNA, 19 bp, Homo sapiens
caaggccagagtggcctgg

SEQ ID NO: 6687586 - DNA, 21 bp, Homo sapiens
caaggccagagtggcctggcc

SEQ ID NO: 6687587 - DNA, 18 bp, Homo sapiens
caaggccagcacccaaag

SEQ ID NO: 6687588 - DNA, 19 bp, Homo sapiens
caaggccagcacccaaagg

SEQ ID NO: 6687589 - DNA, 21 bp, Homo sapiens
caaggccagcccacacagccc

SEQ ID NO: 6687590 - DNA, 22 bp, Homo sapiens
caaggccagcccacacagcccg

SEQ ID NO: 6687591 - DNA, 20 bp, Homo sapiens
caaggccagtccccatttct

SEQ ID NO: 6687592 - DNA, 21 bp, Homo sapiens
caaggccatattttaaaaaat

SEQ ID NO: 6687593 - DNA, 22 bp, Homo sapiens
caaggcccagacctggcctctg

SEQ ID NO: 6687594 - DNA, 13 bp, Homo sapiens
caaggcccaggag

SEQ ID NO: 6687595 - DNA, 16 bp, Homo sapiens
caaggcccaggagacc

SEQ ID NO: 6687596 - DNA, 12 bp, Homo sapiens
caaggccccaga

SEQ ID NO: 6687597 - DNA, 15 bp, Homo sapiens
caaggccccagagac

SEQ ID NO: 6687598 - DNA, 21 bp, Homo sapiens
caaggccccagggacagaggc

SEQ ID NO: 6687599 - DNA, 17 bp, Homo sapiens
caaggcccccacctctg

SEQ ID NO: 6687600 - DNA, 15 bp, Homo sapiens
caaggccccctgcct

SEQ ID NO: 6687601 - DNA, 20 bp, Homo sapiens
caaggccccctgcctgccct

SEQ ID NO: 6687602 - DNA, 22 bp, Homo sapiens
caaggccccgagctcagggcag

SEQ ID NO: 6687603 - DNA, 17 bp, Homo sapiens
caaggccccttccacgg

SEQ ID NO: 6687604 - DNA, 18 bp, Homo sapiens
caaggccccttccacggg

SEQ ID NO: 6687605 - DNA, 22 bp, Homo sapiens
caaggccccttccacgggggct

SEQ ID NO: 6687606 - DNA, 17 bp, Homo sapiens
caaggcccgagcagctg

SEQ ID NO: 6687607 - DNA, 20 bp, Homo sapiens
caaggcccgagcagctgagc

SEQ ID NO: 6687608 - DNA, 22 bp, Homo sapiens
caaggccctcagagatgatcag

SEQ ID NO: 6687609 - DNA, 16 bp, Homo sapiens
caaggccctcggagct

SEQ ID NO: 6687610 - DNA, 21 bp, Homo sapiens
caaggccctcggagctggctg

SEQ ID NO: 6687611 - DNA, 22 bp, Homo sapiens
caaggccctcggagctggctgt

SEQ ID NO: 6687612 - DNA, 13 bp, Homo sapiens
caaggccctgcat

SEQ ID NO: 6687613 - DNA, 15 bp, Homo sapiens
caaggccctgcatct

SEQ ID NO: 6687614 - DNA, 16 bp, Homo sapiens
caaggccctgctgccc

SEQ ID NO: 6687615 - DNA, 11 bp, Homo sapiens
caaggccctgt

SEQ ID NO: 6687616 - DNA, 13 bp, Homo sapiens
caaggccctgtcc

SEQ ID NO: 6687617 - DNA, 15 bp, Homo sapiens
caaggccctgtccca

SEQ ID NO: 6687618 - DNA, 18 bp, Homo sapiens
caaggccctgtctctggc

SEQ ID NO: 6687619 - DNA, 23 bp, Homo sapiens
caaggccgaagctctggctgaac

SEQ ID NO: 6687620 - DNA, 13 bp, Homo sapiens
caaggccgagggc

SEQ ID NO: 6687621 - DNA, 18 bp, Homo sapiens
caaggccgagggccaggc

SEQ ID NO: 6687622 - DNA, 20 bp, Homo sapiens
caaggccgagggccaggcag

SEQ ID NO: 6687623 - DNA, 21 bp, Homo sapiens
caaggccgagggccaggcaga

SEQ ID NO: 6687624 - DNA, 18 bp, Homo sapiens
caaggccgcccacctgca

SEQ ID NO: 6687625 - DNA, 19 bp, Homo sapiens
caaggccggagacccacag

SEQ ID NO: 6687626 - DNA, 14 bp, Homo sapiens
caaggcctatgcca

SEQ ID NO: 6687627 - DNA, 15 bp, Homo sapiens
caaggcctatgccac

SEQ ID NO: 6687628 - DNA, 16 bp, Homo sapiens
caaggcctatgccacc

SEQ ID NO: 6687629 - DNA, 23 bp, Homo sapiens
caaggcctatgccacctgcagcg

SEQ ID NO: 6687630 - DNA, 12 bp, Homo sapiens
caaggcctcagg

SEQ ID NO: 6687631 - DNA, 16 bp, Homo sapiens
caaggcctcaggagag

SEQ ID NO: 6687632 - DNA, 16 bp, Homo sapiens
caaggcctcggcagaa

SEQ ID NO: 6687633 - DNA, 20 bp, Homo sapiens
caaggcctctcaccccactt

SEQ ID NO: 6687634 - DNA, 16 bp, Homo sapiens
caaggcctctctctgc

SEQ ID NO: 6687635 - DNA, 19 bp, Homo sapiens
caaggcctctctctgcctg

SEQ ID NO: 6687636 - DNA, 13 bp, Homo sapiens
caaggcctgcttg

SEQ ID NO: 6687637 - DNA, 22 bp, Homo sapiens
caaggcctgcttgactttccag

SEQ ID NO: 6687638 - DNA, 17 bp, Homo sapiens
caaggcctggtctggga

SEQ ID NO: 6687639 - DNA, 22 bp, Homo sapiens
caaggcctggtgtttcttgata

SEQ ID NO: 6687640 - DNA, 21 bp, Homo sapiens
caaggcctgtcagctaaagaa

SEQ ID NO: 6687641 - DNA, 16 bp, Homo sapiens
caaggcctgtccctgg

SEQ ID NO: 6687642 - DNA, 18 bp, Homo sapiens
caaggcctgtccctggcc

SEQ ID NO: 6687643 - DNA, 13 bp, Homo sapiens
caaggcctgtgct

SEQ ID NO: 6687644 - DNA, 17 bp, Homo sapiens
caaggcctgtgctgcat

SEQ ID NO: 6687645 - DNA, 12 bp, Homo sapiens
caaggccttcag

SEQ ID NO: 6687646 - DNA, 13 bp, Homo sapiens
caaggccttcagt

SEQ ID NO: 6687647 - DNA, 20 bp, Homo sapiens
caaggccttgctcactcact

SEQ ID NO: 6687648 - DNA, 21 bp, Homo sapiens
caaggcgagtttccccactaa

SEQ ID NO: 6687649 - DNA, 16 bp, Homo sapiens
caaggcggcccctccc

SEQ ID NO: 6687650 - DNA, 16 bp, Homo sapiens
caaggcggtgcttgat

SEQ ID NO: 6687651 - DNA, 19 bp, Homo sapiens
caaggcgtccgcgcgccag

SEQ ID NO: 6687652 - DNA, 22 bp, Homo sapiens
caaggcgtccgcgcgccagcac

SEQ ID NO: 6687653 - DNA, 20 bp, Homo sapiens
caaggctactatgcttcagg

SEQ ID NO: 6687654 - DNA, 17 bp, Homo sapiens
caaggctcacatgctcc

SEQ ID NO: 6687655 - DNA, 18 bp, Homo sapiens
caaggctcactgcagcgc

SEQ ID NO: 6687656 - DNA, 15 bp, Homo sapiens
caaggctcccgttcc

SEQ ID NO: 6687657 - DNA, 16 bp, Homo sapiens
caaggctctcccctct

SEQ ID NO: 6687658 - DNA, 15 bp, Homo sapiens
caaggctctgagcaa

SEQ ID NO: 6687659 - DNA, 23 bp, Homo sapiens
caaggctctgctatacagtctat

SEQ ID NO: 6687660 - DNA, 22 bp, Homo sapiens
caaggctcttctccttggagga

SEQ ID NO: 6687661 - DNA, 17 bp, Homo sapiens
caaggctcttcttcctc

SEQ ID NO: 6687662 - DNA, 18 bp, Homo sapiens
caaggctgaccaagagag

SEQ ID NO: 6687663 - DNA, 21 bp, Homo sapiens
caaggctgaccaagagagaaa

SEQ ID NO: 6687664 - DNA, 23 bp, Homo sapiens
caaggctgaccaagagagaaaga

SEQ ID NO: 6687665 - DNA, 13 bp, Homo sapiens
caaggctgacttc

SEQ ID NO: 6687666 - DNA, 19 bp, Homo sapiens
caaggctgatgcaggattt

SEQ ID NO: 6687667 - DNA, 17 bp, Homo sapiens
caaggctgattaaacca

SEQ ID NO: 6687668 - DNA, 15 bp, Homo sapiens
caaggctgccctgtc

SEQ ID NO: 6687669 - DNA, 22 bp, Homo sapiens
caaggctgccctgtccactctg

SEQ ID NO: 6687670 - DNA, 18 bp, Homo sapiens
caaggctgcggtttgttg

SEQ ID NO: 6687671 - DNA, 10 bp, Homo sapiens
caaggctgct

SEQ ID NO: 6687672 - DNA, 20 bp, Homo sapiens
caaggctgctaagtggaaga

SEQ ID NO: 6687673 - DNA, 21 bp, Homo sapiens
caaggctggccagcaaggcag

SEQ ID NO: 6687674 - DNA, 23 bp, Homo sapiens
caaggctggccagcaaggcaggt

SEQ ID NO: 6687675 - DNA, 14 bp, Homo sapiens
caaggctgggagga

SEQ ID NO: 6687676 - DNA, 12 bp, Homo sapiens
caaggctggggc

SEQ ID NO: 6687677 - DNA, 21 bp, Homo sapiens
caaggctgggggaagaagctc

SEQ ID NO: 6687678 - DNA, 14 bp, Homo sapiens
caaggctggtccca

SEQ ID NO: 6687679 - DNA, 21 bp, Homo sapiens
caaggctggtcccacacttat

SEQ ID NO: 6687680 - DNA, 23 bp, Homo sapiens
caaggctgtcaattacaggaagt

SEQ ID NO: 6687681 - DNA, 20 bp, Homo sapiens
caaggctgtgccaggctggg

SEQ ID NO: 6687682 - DNA, 21 bp, Homo sapiens
caaggctgtgccaggctggga

SEQ ID NO: 6687683 - DNA, 17 bp, Homo sapiens
caaggctgtgctccctg

SEQ ID NO: 6687684 - DNA, 15 bp, Homo sapiens
caaggctgtgctctt

SEQ ID NO: 6687685 - DNA, 22 bp, Homo sapiens
caaggctgtgctcttcctctgg

SEQ ID NO: 6687686 - DNA, 22 bp, Homo sapiens
caaggctgtgtttagattgtat

SEQ ID NO: 6687687 - DNA, 18 bp, Homo sapiens
caaggctgttgcatgggc

SEQ ID NO: 6687688 - DNA, 17 bp, Homo sapiens
caaggcttaaaagagta

SEQ ID NO: 6687689 - DNA, 14 bp, Homo sapiens
caaggcttagaccc

SEQ ID NO: 6687690 - DNA, 22 bp, Homo sapiens
caaggcttagaccctcatgctg

SEQ ID NO: 6687691 - DNA, 17 bp, Homo sapiens
caaggcttatattcaac

SEQ ID NO: 6687692 - DNA, 18 bp, Homo sapiens
caaggctttaaagctgag

SEQ ID NO: 6687693 - DNA, 20 bp, Homo sapiens
caagggaaaaatttttatgt

SEQ ID NO: 6687694 - DNA, 21 bp, Homo sapiens
caagggaaaggcaagcttgag

SEQ ID NO: 6687695 - DNA, 23 bp, Homo sapiens
caagggaaaggcaagcttgaggc

SEQ ID NO: 6687696 - DNA, 12 bp, Homo sapiens
caagggaaaggg

SEQ ID NO: 6687697 - DNA, 20 bp, Homo sapiens
caagggaaaggggtgctttt

SEQ ID NO: 6687698 - DNA, 21 bp, Homo sapiens
caagggaaaggggtgctttta

SEQ ID NO: 6687699 - DNA, 17 bp, Homo sapiens
caagggaagaaacactc

SEQ ID NO: 6687700 - DNA, 23 bp, Homo sapiens
caagggaaggaagggacacacac

SEQ ID NO: 6687701 - DNA, 14 bp, Homo sapiens
caagggaaggggcc

SEQ ID NO: 6687702 - DNA, 19 bp, Homo sapiens
caagggaaggggcctccct

SEQ ID NO: 6687703 - DNA, 19 bp, Homo sapiens
caagggacaaccccatcat

SEQ ID NO: 6687704 - DNA, 15 bp, Homo sapiens
caagggacacaggag

SEQ ID NO: 6687705 - DNA, 15 bp, Homo sapiens
caagggacagaaaag

SEQ ID NO: 6687706 - DNA, 20 bp, Homo sapiens
caagggacagcaagtgagca

SEQ ID NO: 6687707 - DNA, 15 bp, Homo sapiens
caagggacaggaagg

SEQ ID NO: 6687708 - DNA, 21 bp, Homo sapiens
caagggacaggagaagagagg

SEQ ID NO: 6687709 - DNA, 13 bp, Homo sapiens
caagggaccttca

SEQ ID NO: 6687710 - DNA, 14 bp, Homo sapiens
caagggagaaaaga

SEQ ID NO: 6687711 - DNA, 15 bp, Homo sapiens
caagggagaaaagag

SEQ ID NO: 6687712 - DNA, 17 bp, Homo sapiens
caagggagaaaagagaa

SEQ ID NO: 6687713 - DNA, 18 bp, Homo sapiens
caagggagaagaaatcca

SEQ ID NO: 6687714 - DNA, 19 bp, Homo sapiens
caagggagaagaaatccat

SEQ ID NO: 6687715 - DNA, 20 bp, Homo sapiens
caagggagaagaaatccata

SEQ ID NO: 6687716 - DNA, 16 bp, Homo sapiens
caagggagacaccagt

SEQ ID NO: 6687717 - DNA, 20 bp, Homo sapiens
caagggagagacctcatcag

SEQ ID NO: 6687718 - DNA, 17 bp, Homo sapiens
caagggaggcagtggct

SEQ ID NO: 6687719 - DNA, 16 bp, Homo sapiens
caagggaggctgctgc

SEQ ID NO: 6687720 - DNA, 13 bp, Homo sapiens
caagggagggtgc

SEQ ID NO: 6687721 - DNA, 21 bp, Homo sapiens
caagggagggtgcagccctct

SEQ ID NO: 6687722 - DNA, 18 bp, Homo sapiens
caagggaggtaagggagg

SEQ ID NO: 6687723 - DNA, 22 bp, Homo sapiens
caagggatctgccattgggacc

SEQ ID NO: 6687724 - DNA, 20 bp, Homo sapiens
caagggatctggtcctaccc

SEQ ID NO: 6687725 - DNA, 22 bp, Homo sapiens
caagggatggcaccacttattt

SEQ ID NO: 6687726 - DNA, 13 bp, Homo sapiens
caagggattctgg

SEQ ID NO: 6687727 - DNA, 16 bp, Homo sapiens
caagggattctgggaa

SEQ ID NO: 6687728 - DNA, 19 bp, Homo sapiens
caagggcaaaaagtctaca

SEQ ID NO: 6687729 - DNA, 18 bp, Homo sapiens
caagggcaagaacccaag

SEQ ID NO: 6687730 - DNA, 14 bp, Homo sapiens
caagggcacaaact

SEQ ID NO: 6687731 - DNA, 23 bp, Homo sapiens
caagggcacattgcccatggctg

SEQ ID NO: 6687732 - DNA, 21 bp, Homo sapiens
caagggcagaatgaatctatg

SEQ ID NO: 6687733 - DNA, 22 bp, Homo sapiens
caagggcagagaactgtctttc

SEQ ID NO: 6687734 - DNA, 22 bp, Homo sapiens
caagggcagggggcccctttgc

SEQ ID NO: 6687735 - DNA, 16 bp, Homo sapiens
caagggcagtggaggt

SEQ ID NO: 6687736 - DNA, 20 bp, Homo sapiens
caagggcatcaggcactggt

SEQ ID NO: 6687737 - DNA, 22 bp, Homo sapiens
caagggcatcatcctcagcagc

SEQ ID NO: 6687738 - DNA, 17 bp, Homo sapiens
caagggccaaacccact

SEQ ID NO: 6687739 - DNA, 21 bp, Homo sapiens
caagggccagacagaccttca

SEQ ID NO: 6687740 - DNA, 14 bp, Homo sapiens
caagggcccagacc

SEQ ID NO: 6687741 - DNA, 16 bp, Homo sapiens
caagggcccagaccct

SEQ ID NO: 6687742 - DNA, 18 bp, Homo sapiens
caagggcccagaccctgg

SEQ ID NO: 6687743 - DNA, 14 bp, Homo sapiens
caagggcccagagt

SEQ ID NO: 6687744 - DNA, 22 bp, Homo sapiens
caagggccctcactcaggaacc

SEQ ID NO: 6687745 - DNA, 12 bp, Homo sapiens
caagggccctgg

SEQ ID NO: 6687746 - DNA, 14 bp, Homo sapiens
caagggcctgatgg

SEQ ID NO: 6687747 - DNA, 13 bp, Homo sapiens
caagggcctggac

SEQ ID NO: 6687748 - DNA, 18 bp, Homo sapiens
caagggctacctctgagt

SEQ ID NO: 6687749 - DNA, 18 bp, Homo sapiens
caagggctccagggccag

SEQ ID NO: 6687750 - DNA, 14 bp, Homo sapiens
caagggctccccac

SEQ ID NO: 6687751 - DNA, 17 bp, Homo sapiens
caagggctccccactgc

SEQ ID NO: 6687752 - DNA, 13 bp, Homo sapiens
caagggctgcaat

SEQ ID NO: 6687753 - DNA, 13 bp, Homo sapiens
caagggctggcac

SEQ ID NO: 6687754 - DNA, 22 bp, Homo sapiens
caagggctggggcggagctggg

SEQ ID NO: 6687755 - DNA, 14 bp, Homo sapiens
caagggctgtaggt

SEQ ID NO: 6687756 - DNA, 18 bp, Homo sapiens
caagggctttcctgtgcc

SEQ ID NO: 6687757 - DNA, 22 bp, Homo sapiens
caaggggaatctggaggtagcc

SEQ ID NO: 6687758 - DNA, 21 bp, Homo sapiens
caaggggaatgtttgcctctg

SEQ ID NO: 6687759 - DNA, 23 bp, Homo sapiens
caaggggaccccgagaaccctga

SEQ ID NO: 6687760 - DNA, 21 bp, Homo sapiens
caaggggatttttatgtctgg

SEQ ID NO: 6687761 - DNA, 16 bp, Homo sapiens
caaggggcagtctgga

SEQ ID NO: 6687762 - DNA, 18 bp, Homo sapiens
caaggggcagtctggagg

SEQ ID NO: 6687763 - DNA, 17 bp, Homo sapiens
caaggggccatttggca

SEQ ID NO: 6687764 - DNA, 22 bp, Homo sapiens
caaggggcccacaaaggggaga

SEQ ID NO: 6687765 - DNA, 15 bp, Homo sapiens
caaggggccctagga

SEQ ID NO: 6687766 - DNA, 18 bp, Homo sapiens
caaggggcgcgcgccccc

SEQ ID NO: 6687767 - DNA, 20 bp, Homo sapiens
caaggggcgtgcctggcgcc

SEQ ID NO: 6687768 - DNA, 15 bp, Homo sapiens
caaggggctcagaac

SEQ ID NO: 6687769 - DNA, 15 bp, Homo sapiens
caaggggctgcttct

SEQ ID NO: 6687770 - DNA, 16 bp, Homo sapiens
caagggggaaggctgc

SEQ ID NO: 6687771 - DNA, 14 bp, Homo sapiens
caagggggacacat

SEQ ID NO: 6687772 - DNA, 12 bp, Homo sapiens
caagggggcggg

SEQ ID NO: 6687773 - DNA, 16 bp, Homo sapiens
caagggggctgctctg

SEQ ID NO: 6687774 - DNA, 16 bp, Homo sapiens
caagggggctgctgct

SEQ ID NO: 6687775 - DNA, 16 bp, Homo sapiens
caaggggtctgctcct

SEQ ID NO: 6687776 - DNA, 21 bp, Homo sapiens
caaggggtgaggataggacag

SEQ ID NO: 6687777 - DNA, 23 bp, Homo sapiens
caaggggtgaggataggacagag

SEQ ID NO: 6687778 - DNA, 15 bp, Homo sapiens
caaggggtgcctggg

SEQ ID NO: 6687779 - DNA, 21 bp, Homo sapiens
caaggggtggaagggcaggag

SEQ ID NO: 6687780 - DNA, 13 bp, Homo sapiens
caaggggtggccg

SEQ ID NO: 6687781 - DNA, 19 bp, Homo sapiens
caaggggtggccgtcctga

SEQ ID NO: 6687782 - DNA, 21 bp, Homo sapiens
caaggggtgggactggtgggg

SEQ ID NO: 6687783 - DNA, 18 bp, Homo sapiens
caagggtaaacaagcctg

SEQ ID NO: 6687784 - DNA, 22 bp, Homo sapiens
caagggtaactcttggccagag

SEQ ID NO: 6687785 - DNA, 18 bp, Homo sapiens
caagggtagggtgggcct

SEQ ID NO: 6687786 - DNA, 16 bp, Homo sapiens
caagggtcaggccttt

SEQ ID NO: 6687787 - DNA, 18 bp, Homo sapiens
caagggtcaggcctttga

SEQ ID NO: 6687788 - DNA, 14 bp, Homo sapiens
caagggtcagggtg

SEQ ID NO: 6687789 - DNA, 14 bp, Homo sapiens
caagggtccagaag

SEQ ID NO: 6687790 - DNA, 22 bp, Homo sapiens
caagggtcctacggagggacca

SEQ ID NO: 6687791 - DNA, 17 bp, Homo sapiens
caagggtctagggagag

SEQ ID NO: 6687792 - DNA, 13 bp, Homo sapiens
caagggtgcctca

SEQ ID NO: 6687793 - DNA, 14 bp, Homo sapiens
caagggtgcctcag

SEQ ID NO: 6687794 - DNA, 13 bp, Homo sapiens
caagggtgctgtg

SEQ ID NO: 6687795 - DNA, 20 bp, Homo sapiens
caagggttcagagactcagg

SEQ ID NO: 6687796 - DNA, 19 bp, Homo sapiens
caagggttgagagccagtg

SEQ ID NO: 6687797 - DNA, 21 bp, Homo sapiens
caagggtttcgactggtccag

SEQ ID NO: 6687798 - DNA, 16 bp, Homo sapiens
caagggttttccaggt

SEQ ID NO: 6687799 - DNA, 23 bp, Homo sapiens
caagggttttccaggtgtagcta

SEQ ID NO: 6687800 - DNA, 13 bp, Homo sapiens
caaggtaaacttc

SEQ ID NO: 6687801 - DNA, 16 bp, Homo sapiens
caaggtaactgtactg

SEQ ID NO: 6687802 - DNA, 11 bp, Homo sapiens
caaggtacagc

SEQ ID NO: 6687803 - DNA, 14 bp, Homo sapiens
caaggtacagctgt

SEQ ID NO: 6687804 - DNA, 16 bp, Homo sapiens
caaggtactctggtga

SEQ ID NO: 6687805 - DNA, 13 bp, Homo sapiens
caaggtagaatga

SEQ ID NO: 6687806 - DNA, 20 bp, Homo sapiens
caaggtagaatgaccttgta

SEQ ID NO: 6687807 - DNA, 13 bp, Homo sapiens
caaggtagacatg

SEQ ID NO: 6687808 - DNA, 16 bp, Homo sapiens
caaggtagccctggcc

SEQ ID NO: 6687809 - DNA, 19 bp, Homo sapiens
caaggtaggctgcaaaatt

SEQ ID NO: 6687810 - DNA, 22 bp, Homo sapiens
caaggtatttctccagttggga

SEQ ID NO: 6687811 - DNA, 17 bp, Homo sapiens
caaggtcactcttggtc

SEQ ID NO: 6687812 - DNA, 20 bp, Homo sapiens
caaggtcactgtttcctggg

SEQ ID NO: 6687813 - DNA, 9 bp, Homo sapiens
caaggtcag

SEQ ID NO: 6687814 - DNA, 19 bp, Homo sapiens
caaggtcagaacaggtttt

SEQ ID NO: 6687815 - DNA, 14 bp, Homo sapiens
caaggtcaggaggc

SEQ ID NO: 6687816 - DNA, 14 bp, Homo sapiens
caaggtcaggatga

SEQ ID NO: 6687817 - DNA, 13 bp, Homo sapiens
caaggtcagggag

SEQ ID NO: 6687818 - DNA, 21 bp, Homo sapiens
caaggtcatagacaattcctc

SEQ ID NO: 6687819 - DNA, 24 bp, Homo sapiens
caaggtcatagacaattcctccag

SEQ ID NO: 6687820 - DNA, 14 bp, Homo sapiens
caaggtcatcaaac

SEQ ID NO: 6687821 - DNA, 22 bp, Homo sapiens
caaggtcatggccacactgtga

SEQ ID NO: 6687822 - DNA, 13 bp, Homo sapiens
caaggtcattttt

SEQ ID NO: 6687823 - DNA, 18 bp, Homo sapiens
caaggtccactccctgct

SEQ ID NO: 6687824 - DNA, 19 bp, Homo sapiens
caaggtccactccctgctc

SEQ ID NO: 6687825 - DNA, 20 bp, Homo sapiens
caaggtccaggcaaagctgg

SEQ ID NO: 6687826 - DNA, 14 bp, Homo sapiens
caaggtccagtgga

SEQ ID NO: 6687827 - DNA, 23 bp, Homo sapiens
caaggtccatggagtacggctgg

SEQ ID NO: 6687828 - DNA, 23 bp, Homo sapiens
caaggtccattattttgtattct

SEQ ID NO: 6687829 - DNA, 23 bp, Homo sapiens
caaggtcccattttccccctgtg

SEQ ID NO: 6687830 - DNA, 17 bp, Homo sapiens
caaggtcccctccacat

SEQ ID NO: 6687831 - DNA, 18 bp, Homo sapiens
caaggtcccctccacatc

SEQ ID NO: 6687832 - DNA, 15 bp, Homo sapiens
caaggtcctctcagt

SEQ ID NO: 6687833 - DNA, 10 bp, Homo sapiens
caaggtcctg

SEQ ID NO: 6687834 - DNA, 15 bp, Homo sapiens
caaggtctcacactc

SEQ ID NO: 6687835 - DNA, 13 bp, Homo sapiens
caaggtctggcct

SEQ ID NO: 6687836 - DNA, 16 bp, Homo sapiens
caaggtcttcagccat

SEQ ID NO: 6687837 - DNA, 13 bp, Homo sapiens
caaggtcttgctc

SEQ ID NO: 6687838 - DNA, 15 bp, Homo sapiens
caaggtcttgctctc

SEQ ID NO: 6687839 - DNA, 21 bp, Homo sapiens
caaggtgaaatgaagcaacag

SEQ ID NO: 6687840 - DNA, 12 bp, Homo sapiens
caaggtgaagca

SEQ ID NO: 6687841 - DNA, 14 bp, Homo sapiens
caaggtgagagagg

SEQ ID NO: 6687842 - DNA, 22 bp, Homo sapiens
caaggtgaggtgaactccaggc

SEQ ID NO: 6687843 - DNA, 23 bp, Homo sapiens
caaggtgaggtgaactccaggca

SEQ ID NO: 6687844 - DNA, 13 bp, Homo sapiens
caaggtgcacaga

SEQ ID NO: 6687845 - DNA, 22 bp, Homo sapiens
caaggtgcacagacctcagaga

SEQ ID NO: 6687846 - DNA, 15 bp, Homo sapiens
caaggtgcaggcagg

SEQ ID NO: 6687847 - DNA, 19 bp, Homo sapiens
caaggtgcatatagaaaac

SEQ ID NO: 6687848 - DNA, 20 bp, Homo sapiens
caaggtgccaccaccctgcc

SEQ ID NO: 6687849 - DNA, 19 bp, Homo sapiens
caaggtgcggggagaagaa

SEQ ID NO: 6687850 - DNA, 16 bp, Homo sapiens
caaggtgctaaaagga

SEQ ID NO: 6687851 - DNA, 12 bp, Homo sapiens
caaggtgctaac

SEQ ID NO: 6687852 - DNA, 12 bp, Homo sapiens
caaggtgctctg

SEQ ID NO: 6687853 - DNA, 17 bp, Homo sapiens
caaggtgctctgtgtcc

SEQ ID NO: 6687854 - DNA, 21 bp, Homo sapiens
caaggtgctgatgtcaaagtg

SEQ ID NO: 6687855 - DNA, 14 bp, Homo sapiens
caaggtggagggaa

SEQ ID NO: 6687856 - DNA, 21 bp, Homo sapiens
caaggtggagtggatgcctca

SEQ ID NO: 6687857 - DNA, 21 bp, Homo sapiens
caaggtggcagatgtcttccc

SEQ ID NO: 6687858 - DNA, 22 bp, Homo sapiens
caaggtggcagatgtcttccct

SEQ ID NO: 6687859 - DNA, 16 bp, Homo sapiens
caaggtggcagcaagc

SEQ ID NO: 6687860 - DNA, 17 bp, Homo sapiens
caaggtggccaaattat

SEQ ID NO: 6687861 - DNA, 14 bp, Homo sapiens
caaggtggcctctg

SEQ ID NO: 6687862 - DNA, 16 bp, Homo sapiens
caaggtggcctctgcc

SEQ ID NO: 6687863 - DNA, 19 bp, Homo sapiens
caaggtggcctctgcctgg

SEQ ID NO: 6687864 - DNA, 20 bp, Homo sapiens
caaggtggcctctgcctggg

SEQ ID NO: 6687865 - DNA, 12 bp, Homo sapiens
caaggtgggcgg

SEQ ID NO: 6687866 - DNA, 23 bp, Homo sapiens
caaggtgggctgagccctggcag

SEQ ID NO: 6687867 - DNA, 23 bp, Homo sapiens
caaggtggggattgcccctggct

SEQ ID NO: 6687868 - DNA, 19 bp, Homo sapiens
caaggtgggggagcctgga

SEQ ID NO: 6687869 - DNA, 21 bp, Homo sapiens
caaggtgggtgattcctccca

SEQ ID NO: 6687870 - DNA, 23 bp, Homo sapiens
caaggtgggtgattcctcccagg

SEQ ID NO: 6687871 - DNA, 21 bp, Homo sapiens
caaggtgggtggatcacctga

SEQ ID NO: 6687872 - DNA, 18 bp, Homo sapiens
caaggtgggttccaggga

SEQ ID NO: 6687873 - DNA, 22 bp, Homo sapiens
caaggtggtatggttgtataca

SEQ ID NO: 6687874 - DNA, 15 bp, Homo sapiens
caaggtggtcttgga

SEQ ID NO: 6687875 - DNA, 17 bp, Homo sapiens
caaggtgtccagggtcc

SEQ ID NO: 6687876 - DNA, 16 bp, Homo sapiens
caaggtgtccctgcct

SEQ ID NO: 6687877 - DNA, 16 bp, Homo sapiens
caaggtgtcctacaga

SEQ ID NO: 6687878 - DNA, 21 bp, Homo sapiens
caaggtgtcctacagaaaaac

SEQ ID NO: 6687879 - DNA, 12 bp, Homo sapiens
caaggtgtcttt

SEQ ID NO: 6687880 - DNA, 17 bp, Homo sapiens
caaggtgtgccccgtgg

SEQ ID NO: 6687881 - DNA, 17 bp, Homo sapiens
caaggtgtgctctgagc

SEQ ID NO: 6687882 - DNA, 20 bp, Homo sapiens
caaggtgtgctctgagccac

SEQ ID NO: 6687883 - DNA, 15 bp, Homo sapiens
caaggtgtggaggct

SEQ ID NO: 6687884 - DNA, 18 bp, Homo sapiens
caaggtgtggaggctcct

SEQ ID NO: 6687885 - DNA, 20 bp, Homo sapiens
caaggtgtggaggctcctgt

SEQ ID NO: 6687886 - DNA, 21 bp, Homo sapiens
caaggtgtttccatttctcaa

SEQ ID NO: 6687887 - DNA, 19 bp, Homo sapiens
caaggttactcagcagcag

SEQ ID NO: 6687888 - DNA, 21 bp, Homo sapiens
caaggttactcagcagcagag

SEQ ID NO: 6687889 - DNA, 22 bp, Homo sapiens
caaggttactcagcagcagaga

SEQ ID NO: 6687890 - DNA, 17 bp, Homo sapiens
caaggttactgggagtg

SEQ ID NO: 6687891 - DNA, 20 bp, Homo sapiens
caaggttactgggagtgtgg

SEQ ID NO: 6687892 - DNA, 20 bp, Homo sapiens
caaggttacttaattcaact

SEQ ID NO: 6687893 - DNA, 21 bp, Homo sapiens
caaggttacttaattcaactt

SEQ ID NO: 6687894 - DNA, 18 bp, Homo sapiens
caaggttcaacttattaa

SEQ ID NO: 6687895 - DNA, 14 bp, Homo sapiens
caaggttccacaga

SEQ ID NO: 6687896 - DNA, 15 bp, Homo sapiens
caaggttccctctga

SEQ ID NO: 6687897 - DNA, 16 bp, Homo sapiens
caaggttctcatttct

SEQ ID NO: 6687898 - DNA, 15 bp, Homo sapiens
caaggttctccaaca

SEQ ID NO: 6687899 - DNA, 13 bp, Homo sapiens
caaggttctgggt

SEQ ID NO: 6687900 - DNA, 16 bp, Homo sapiens
caaggttgctgttgtg

SEQ ID NO: 6687901 - DNA, 19 bp, Homo sapiens
caaggttggcaccccagct

SEQ ID NO: 6687902 - DNA, 15 bp, Homo sapiens
caaggttgtcagctt

SEQ ID NO: 6687903 - DNA, 17 bp, Homo sapiens
caaggtttaaagagtct

SEQ ID NO: 6687904 - DNA, 18 bp, Homo sapiens
caaggtttaaagagtcta

SEQ ID NO: 6687905 - DNA, 18 bp, Homo sapiens
caaggtttacactgcgga

SEQ ID NO: 6687906 - DNA, 21 bp, Homo sapiens
caaggtttacactgcggaagc

SEQ ID NO: 6687907 - DNA, 17 bp, Homo sapiens
caaggtttaggctggtg

SEQ ID NO: 6687908 - DNA, 21 bp, Homo sapiens
caaggtttaggctggtggccc

SEQ ID NO: 6687909 - DNA, 14 bp, Homo sapiens
caaggtttataaag

SEQ ID NO: 6687910 - DNA, 15 bp, Homo sapiens
caaggtttataaagc

SEQ ID NO: 6687911 - DNA, 19 bp, Homo sapiens
caaggtttatgccaccagg

SEQ ID NO: 6687912 - DNA, 20 bp, Homo sapiens
caaggtttcctttcagccct

SEQ ID NO: 6687913 - DNA, 16 bp, Homo sapiens
caaggtttcgtggcag

SEQ ID NO: 6687914 - DNA, 18 bp, Homo sapiens
caaggtttcgtggcagca

SEQ ID NO: 6687915 - DNA, 21 bp, Homo sapiens
caaggttttaggttctaaagt

SEQ ID NO: 6687916 - DNA, 16 bp, Homo sapiens
caaggttttggagtca

SEQ ID NO: 6687917 - DNA, 12 bp, Homo sapiens
caagtaaaacaa

SEQ ID NO: 6687918 - DNA, 14 bp, Homo sapiens
caagtaaaacaaat

SEQ ID NO: 6687919 - DNA, 19 bp, Homo sapiens
caagtaaaacaaatgaaat

SEQ ID NO: 6687920 - DNA, 22 bp, Homo sapiens
caagtaaatctatctctatata

SEQ ID NO: 6687921 - DNA, 23 bp, Homo sapiens
caagtaaatctatctctatataa

SEQ ID NO: 6687922 - DNA, 16 bp, Homo sapiens
caagtaaattctgttg

SEQ ID NO: 6687923 - DNA, 18 bp, Homo sapiens
caagtaaattctgttgaa

SEQ ID NO: 6687924 - DNA, 14 bp, Homo sapiens
caagtaacaaaaat

SEQ ID NO: 6687925 - DNA, 17 bp, Homo sapiens
caagtaacacatttggc

SEQ ID NO: 6687926 - DNA, 23 bp, Homo sapiens
caagtaacactttaaaaccagtt

SEQ ID NO: 6687927 - DNA, 23 bp, Homo sapiens
caagtaaccaggccccagcctcc

SEQ ID NO: 6687928 - DNA, 18 bp, Homo sapiens
caagtaagaaaaataagc

SEQ ID NO: 6687929 - DNA, 22 bp, Homo sapiens
caagtaagagactcagcctgca

SEQ ID NO: 6687930 - DNA, 15 bp, Homo sapiens
caagtaagaggctgg

SEQ ID NO: 6687931 - DNA, 20 bp, Homo sapiens
caagtaagaggctggagttg

SEQ ID NO: 6687932 - DNA, 15 bp, Homo sapiens
caagtaagagtggtg

SEQ ID NO: 6687933 - DNA, 18 bp, Homo sapiens
caagtaaggcttttaatt

SEQ ID NO: 6687934 - DNA, 15 bp, Homo sapiens
caagtaataaaacaa

SEQ ID NO: 6687935 - DNA, 20 bp, Homo sapiens
caagtaatacgttttgacat

SEQ ID NO: 6687936 - DNA, 23 bp, Homo sapiens
caagtaatataatggaagagaaa

SEQ ID NO: 6687937 - DNA, 21 bp, Homo sapiens
caagtaatggaggtcccagcc

SEQ ID NO: 6687938 - DNA, 16 bp, Homo sapiens
caagtaattctgctgt

SEQ ID NO: 6687939 - DNA, 23 bp, Homo sapiens
caagtaattctgctgtctcagcc

SEQ ID NO: 6687940 - DNA, 11 bp, Homo sapiens
caagtaattgt

SEQ ID NO: 6687941 - DNA, 13 bp, Homo sapiens
caagtacaaggac

SEQ ID NO: 6687942 - DNA, 20 bp, Homo sapiens
caagtacagcggctcccctc

SEQ ID NO: 6687943 - DNA, 16 bp, Homo sapiens
caagtacagtactttg

SEQ ID NO: 6687944 - DNA, 19 bp, Homo sapiens
caagtacctgtgaacagta

SEQ ID NO: 6687945 - DNA, 14 bp, Homo sapiens
caagtactgctgta

SEQ ID NO: 6687946 - DNA, 16 bp, Homo sapiens
caagtactgctgtaaa

SEQ ID NO: 6687947 - DNA, 19 bp, Homo sapiens
caagtactggttgactttc

SEQ ID NO: 6687948 - DNA, 19 bp, Homo sapiens
caagtacttaactatctgt

SEQ ID NO: 6687949 - DNA, 18 bp, Homo sapiens
caagtagataaatatttg

SEQ ID NO: 6687950 - DNA, 22 bp, Homo sapiens
caagtagataggaagaaagaag

SEQ ID NO: 6687951 - DNA, 22 bp, Homo sapiens
caagtagatcatggcagcatga

SEQ ID NO: 6687952 - DNA, 23 bp, Homo sapiens
caagtagatcatggcagcatgaa

SEQ ID NO: 6687953 - DNA, 20 bp, Homo sapiens
caagtagatcctgagaagta

SEQ ID NO: 6687954 - DNA, 19 bp, Homo sapiens
caagtagattggctgggca

SEQ ID NO: 6687955 - DNA, 16 bp, Homo sapiens
caagtagcatttactg

SEQ ID NO: 6687956 - DNA, 21 bp, Homo sapiens
caagtagcctctgggatctgc

SEQ ID NO: 6687957 - DNA, 19 bp, Homo sapiens
caagtagctgggactacag

SEQ ID NO: 6687958 - DNA, 21 bp, Homo sapiens
caagtagctgggattttaaac

SEQ ID NO: 6687959 - DNA, 15 bp, Homo sapiens
caagtaggagacaca

SEQ ID NO: 6687960 - DNA, 16 bp, Homo sapiens
caagtaggagttttat

SEQ ID NO: 6687961 - DNA, 13 bp, Homo sapiens
caagtaggcattc

SEQ ID NO: 6687962 - DNA, 14 bp, Homo sapiens
caagtagggcacaa

SEQ ID NO: 6687963 - DNA, 16 bp, Homo sapiens
caagtagtagtactta

SEQ ID NO: 6687964 - DNA, 13 bp, Homo sapiens
caagtagtctgct

SEQ ID NO: 6687965 - DNA, 15 bp, Homo sapiens
caagtagtctgctca

SEQ ID NO: 6687966 - DNA, 16 bp, Homo sapiens
caagtagtctgctcac

SEQ ID NO: 6687967 - DNA, 13 bp, Homo sapiens
caagtagttctgt

SEQ ID NO: 6687968 - DNA, 23 bp, Homo sapiens
caagtagttctgtatttgaaagt

SEQ ID NO: 6687969 - DNA, 20 bp, Homo sapiens
caagtataaaaaattctcat

SEQ ID NO: 6687970 - DNA, 20 bp, Homo sapiens
caagtataattttttgtaat

SEQ ID NO: 6687971 - DNA, 20 bp, Homo sapiens
caagtatactaagagtaaag

SEQ ID NO: 6687972 - DNA, 14 bp, Homo sapiens
caagtatagaaaat

SEQ ID NO: 6687973 - DNA, 12 bp, Homo sapiens
caagtatatact

SEQ ID NO: 6687974 - DNA, 20 bp, Homo sapiens
caagtatatacttttaaatt

SEQ ID NO: 6687975 - DNA, 20 bp, Homo sapiens
caagtatatatgaatgaata

SEQ ID NO: 6687976 - DNA, 19 bp, Homo sapiens
caagtatatgtgaaaaaaa

SEQ ID NO: 6687977 - DNA, 18 bp, Homo sapiens
caagtatatttatttcta

SEQ ID NO: 6687978 - DNA, 20 bp, Homo sapiens
caagtatatttatttctagc

SEQ ID NO: 6687979 - DNA, 22 bp, Homo sapiens
caagtatccaaccaacttggtt

SEQ ID NO: 6687980 - DNA, 22 bp, Homo sapiens
caagtatctaaatttggaactt

SEQ ID NO: 6687981 - DNA, 20 bp, Homo sapiens
caagtatgaagtataaatct

SEQ ID NO: 6687982 - DNA, 21 bp, Homo sapiens
caagtatgaagtataaatctg

SEQ ID NO: 6687983 - DNA, 14 bp, Homo sapiens
caagtatgaatatt

SEQ ID NO: 6687984 - DNA, 12 bp, Homo sapiens
caagtatgcctt

SEQ ID NO: 6687985 - DNA, 18 bp, Homo sapiens
caagtatgccttaagcag

SEQ ID NO: 6687986 - DNA, 19 bp, Homo sapiens
caagtatgccttaagcaga

SEQ ID NO: 6687987 - DNA, 15 bp, Homo sapiens
caagtatgtgagtgt

SEQ ID NO: 6687988 - DNA, 14 bp, Homo sapiens
caagtattaagcag

SEQ ID NO: 6687989 - DNA, 15 bp, Homo sapiens
caagtattaagcagt

SEQ ID NO: 6687990 - DNA, 17 bp, Homo sapiens
caagtattaagcagttc

SEQ ID NO: 6687991 - DNA, 19 bp, Homo sapiens
caagtattaagcagttcat

SEQ ID NO: 6687992 - DNA, 24 bp, Homo sapiens
caagtattactaaattgaccttta

SEQ ID NO: 6687993 - DNA, 22 bp, Homo sapiens
caagtattataaacaagaatga

SEQ ID NO: 6687994 - DNA, 14 bp, Homo sapiens
caagtattatattt

SEQ ID NO: 6687995 - DNA, 22 bp, Homo sapiens
caagtattcagttccaatactt

SEQ ID NO: 6687996 - DNA, 18 bp, Homo sapiens
caagtattctgcctttgc

SEQ ID NO: 6687997 - DNA, 20 bp, Homo sapiens
caagtattgcgaatgtgcag

SEQ ID NO: 6687998 - DNA, 20 bp, Homo sapiens
caagtatttattattgaaga

SEQ ID NO: 6687999 - DNA, 15 bp, Homo sapiens
caagtatttattccc

SEQ ID NO: 6688000 - DNA, 16 bp, Homo sapiens
caagtatttgttaatt

SEQ ID NO: 6688001 - DNA, 20 bp, Homo sapiens
caagtatttgttaatttaga

SEQ ID NO: 6688002 - DNA, 11 bp, Homo sapiens
caagtattttg

SEQ ID NO: 6688003 - DNA, 20 bp, Homo sapiens
caagtcaacactcttcttga

SEQ ID NO: 6688004 - DNA, 14 bp, Homo sapiens
caagtcaatcattt

SEQ ID NO: 6688005 - DNA, 15 bp, Homo sapiens
caagtcaatcatttc

SEQ ID NO: 6688006 - DNA, 15 bp, Homo sapiens
caagtcacacccact

SEQ ID NO: 6688007 - DNA, 18 bp, Homo sapiens
caagtcacacccactccc

SEQ ID NO: 6688008 - DNA, 12 bp, Homo sapiens
caagtcacagct

SEQ ID NO: 6688009 - DNA, 19 bp, Homo sapiens
caagtcacagctgcagctg

SEQ ID NO: 6688010 - DNA, 20 bp, Homo sapiens
caagtcaccaaaagacactg

SEQ ID NO: 6688011 - DNA, 19 bp, Homo sapiens
caagtcactaaatttctca

SEQ ID NO: 6688012 - DNA, 13 bp, Homo sapiens
caagtcagacaga

SEQ ID NO: 6688013 - DNA, 14 bp, Homo sapiens
caagtcagaggatg

SEQ ID NO: 6688014 - DNA, 19 bp, Homo sapiens
caagtcagctttgccttcc

SEQ ID NO: 6688015 - DNA, 20 bp, Homo sapiens
caagtcagctttgccttcca

SEQ ID NO: 6688016 - DNA, 13 bp, Homo sapiens
caagtcaggccag

SEQ ID NO: 6688017 - DNA, 19 bp, Homo sapiens
caagtcaggccaggtgggc

SEQ ID NO: 6688018 - DNA, 18 bp, Homo sapiens
caagtcatagccataaat

SEQ ID NO: 6688019 - DNA, 22 bp, Homo sapiens
caagtcatgatggagacttcag

SEQ ID NO: 6688020 - DNA, 13 bp, Homo sapiens
caagtcatgggag

SEQ ID NO: 6688021 - DNA, 14 bp, Homo sapiens
caagtcatgggaga

SEQ ID NO: 6688022 - DNA, 16 bp, Homo sapiens
caagtcatgggagaag

SEQ ID NO: 6688023 - DNA, 16 bp, Homo sapiens
caagtcatggtcacag

SEQ ID NO: 6688024 - DNA, 23 bp, Homo sapiens
caagtcatttccgtcccccccca

SEQ ID NO: 6688025 - DNA, 14 bp, Homo sapiens
caagtcatttttgt

SEQ ID NO: 6688026 - DNA, 16 bp, Homo sapiens
caagtcatttttgtat

SEQ ID NO: 6688027 - DNA, 20 bp, Homo sapiens
caagtcatttttgtattttt

SEQ ID NO: 6688028 - DNA, 13 bp, Homo sapiens
caagtccaacctg

SEQ ID NO: 6688029 - DNA, 14 bp, Homo sapiens
caagtccaagcccg

SEQ ID NO: 6688030 - DNA, 14 bp, Homo sapiens
caagtccactgtcc

SEQ ID NO: 6688031 - DNA, 15 bp, Homo sapiens
caagtccactgtcct

SEQ ID NO: 6688032 - DNA, 16 bp, Homo sapiens
caagtccactgtcctc

SEQ ID NO: 6688033 - DNA, 22 bp, Homo sapiens
caagtccactgtcctccttggc

SEQ ID NO: 6688034 - DNA, 14 bp, Homo sapiens
caagtccagagccg

SEQ ID NO: 6688035 - DNA, 15 bp, Homo sapiens
caagtccaggtcctg

SEQ ID NO: 6688036 - DNA, 24 bp, Homo sapiens
caagtccaggtcctggtggggcag

SEQ ID NO: 6688037 - DNA, 20 bp, Homo sapiens
caagtccaggtcgggctcag

SEQ ID NO: 6688038 - DNA, 22 bp, Homo sapiens
caagtccattatgtaatagtga

SEQ ID NO: 6688039 - DNA, 17 bp, Homo sapiens
caagtcccaaattcatt

SEQ ID NO: 6688040 - DNA, 21 bp, Homo sapiens
caagtcccagggagctctgca

SEQ ID NO: 6688041 - DNA, 13 bp, Homo sapiens
caagtccccagcc

SEQ ID NO: 6688042 - DNA, 15 bp, Homo sapiens
caagtccccagcccc

SEQ ID NO: 6688043 - DNA, 21 bp, Homo sapiens
caagtccccagcccctcaacc

SEQ ID NO: 6688044 - DNA, 14 bp, Homo sapiens
caagtcccgaggca

SEQ ID NO: 6688045 - DNA, 16 bp, Homo sapiens
caagtcccgaggcagc

SEQ ID NO: 6688046 - DNA, 21 bp, Homo sapiens
caagtcccgaggcagcaacag

SEQ ID NO: 6688047 - DNA, 21 bp, Homo sapiens
caagtccctgactctctgtga

SEQ ID NO: 6688048 - DNA, 18 bp, Homo sapiens
caagtccctggaaaagga

SEQ ID NO: 6688049 - DNA, 20 bp, Homo sapiens
caagtccctgttttctgagc

SEQ ID NO: 6688050 - DNA, 19 bp, Homo sapiens
caagtccgcagaagccctg

SEQ ID NO: 6688051 - DNA, 19 bp, Homo sapiens
caagtcctagctcctcctc

SEQ ID NO: 6688052 - DNA, 24 bp, Homo sapiens
caagtcctccctctctactggagt

SEQ ID NO: 6688053 - DNA, 17 bp, Homo sapiens
caagtcctcgccccccg

SEQ ID NO: 6688054 - DNA, 18 bp, Homo sapiens
caagtcctcgccccccgc

SEQ ID NO: 6688055 - DNA, 21 bp, Homo sapiens
caagtcctcttttctgagagg

SEQ ID NO: 6688056 - DNA, 16 bp, Homo sapiens
caagtcctgaagaggc

SEQ ID NO: 6688057 - DNA, 18 bp, Homo sapiens
caagtcctgactgggctg

SEQ ID NO: 6688058 - DNA, 19 bp, Homo sapiens
caagtcctgactgggctgg

SEQ ID NO: 6688059 - DNA, 20 bp, Homo sapiens
caagtcctgactgggctggg

SEQ ID NO: 6688060 - DNA, 13 bp, Homo sapiens
caagtcctggcta

SEQ ID NO: 6688061 - DNA, 15 bp, Homo sapiens
caagtcctggctaca

SEQ ID NO: 6688062 - DNA, 15 bp, Homo sapiens
caagtccttacctct

SEQ ID NO: 6688063 - DNA, 13 bp, Homo sapiens
caagtcctttaac

SEQ ID NO: 6688064 - DNA, 14 bp, Homo sapiens
caagtcctttgtga

SEQ ID NO: 6688065 - DNA, 17 bp, Homo sapiens
caagtcctttgtgaata

SEQ ID NO: 6688066 - DNA, 16 bp, Homo sapiens
caagtcggaacagcag

SEQ ID NO: 6688067 - DNA, 17 bp, Homo sapiens
caagtcggaacagcaga

SEQ ID NO: 6688068 - DNA, 13 bp, Homo sapiens
caagtcggggcct

SEQ ID NO: 6688069 - DNA, 24 bp, Homo sapiens
caagtctaaaaagacctggccttt

SEQ ID NO: 6688070 - DNA, 15 bp, Homo sapiens
caagtctaatgaaga

SEQ ID NO: 6688071 - DNA, 18 bp, Homo sapiens
caagtctaatgaagagaa

SEQ ID NO: 6688072 - DNA, 16 bp, Homo sapiens
caagtctacagagtga

SEQ ID NO: 6688073 - DNA, 20 bp, Homo sapiens
caagtctaccctgatcacct

SEQ ID NO: 6688074 - DNA, 23 bp, Homo sapiens
caagtctacctgccttgcctgtt

SEQ ID NO: 6688075 - DNA, 12 bp, Homo sapiens
caagtctagaaa

SEQ ID NO: 6688076 - DNA, 16 bp, Homo sapiens
caagtctagtcttctg

SEQ ID NO: 6688077 - DNA, 15 bp, Homo sapiens
caagtctagtggaac

SEQ ID NO: 6688078 - DNA, 15 bp, Homo sapiens
caagtctcagaagag

SEQ ID NO: 6688079 - DNA, 18 bp, Homo sapiens
caagtctcctagacactc

SEQ ID NO: 6688080 - DNA, 18 bp, Homo sapiens
caagtctctctgtgaata

SEQ ID NO: 6688081 - DNA, 22 bp, Homo sapiens
caagtctctgctggcccagcca

SEQ ID NO: 6688082 - DNA, 23 bp, Homo sapiens
caagtctctgctggcccagccaa

SEQ ID NO: 6688083 - DNA, 22 bp, Homo sapiens
caagtctgatccatatttaata

SEQ ID NO: 6688084 - DNA, 13 bp, Homo sapiens
caagtctgcagcc

SEQ ID NO: 6688085 - DNA, 17 bp, Homo sapiens
caagtctgcaggtgcac

SEQ ID NO: 6688086 - DNA, 22 bp, Homo sapiens
caagtctgtacctcaaatgaat

SEQ ID NO: 6688087 - DNA, 12 bp, Homo sapiens
caagtctgtgaa

SEQ ID NO: 6688088 - DNA, 16 bp, Homo sapiens
caagtctgtgcctgga

SEQ ID NO: 6688089 - DNA, 18 bp, Homo sapiens
caagtctgtgcctggagc

SEQ ID NO: 6688090 - DNA, 14 bp, Homo sapiens
caagtctgtggctt

SEQ ID NO: 6688091 - DNA, 18 bp, Homo sapiens
caagtcttctcccgtcca

SEQ ID NO: 6688092 - DNA, 20 bp, Homo sapiens
caagtcttgagcaatgtttt

SEQ ID NO: 6688093 - DNA, 14 bp, Homo sapiens
caagtctttccaga

SEQ ID NO: 6688094 - DNA, 18 bp, Homo sapiens
caagtctttctcctcttt

SEQ ID NO: 6688095 - DNA, 23 bp, Homo sapiens
caagtctttctcctctttgagac

SEQ ID NO: 6688096 - DNA, 17 bp, Homo sapiens
caagtctttctctttcc

SEQ ID NO: 6688097 - DNA, 23 bp, Homo sapiens
caagtctttcttcttttttaagt

SEQ ID NO: 6688098 - DNA, 12 bp, Homo sapiens
caagtgaaaact

SEQ ID NO: 6688099 - DNA, 21 bp, Homo sapiens
caagtgaaataacaaaatgga

SEQ ID NO: 6688100 - DNA, 22 bp, Homo sapiens
caagtgaaataacaaaatggac

SEQ ID NO: 6688101 - DNA, 20 bp, Homo sapiens
caagtgaaataatattgatt

SEQ ID NO: 6688102 - DNA, 14 bp, Homo sapiens
caagtgaacaaagt

SEQ ID NO: 6688103 - DNA, 17 bp, Homo sapiens
caagtgaacaaagtgag

SEQ ID NO: 6688104 - DNA, 13 bp, Homo sapiens
caagtgaacacat

SEQ ID NO: 6688105 - DNA, 19 bp, Homo sapiens
caagtgaacactagccaga

SEQ ID NO: 6688106 - DNA, 21 bp, Homo sapiens
caagtgaacactgttctacca

SEQ ID NO: 6688107 - DNA, 17 bp, Homo sapiens
caagtgaactcatccct

SEQ ID NO: 6688108 - DNA, 12 bp, Homo sapiens
caagtgaagaat

SEQ ID NO: 6688109 - DNA, 14 bp, Homo sapiens
caagtgaagaatct

SEQ ID NO: 6688110 - DNA, 11 bp, Homo sapiens
caagtgaaggt

SEQ ID NO: 6688111 - DNA, 23 bp, Homo sapiens
caagtgaaggttcccaaggacat

SEQ ID NO: 6688112 - DNA, 14 bp, Homo sapiens
caagtgaaggttta

SEQ ID NO: 6688113 - DNA, 21 bp, Homo sapiens
caagtgaaggtttacaattta

SEQ ID NO: 6688114 - DNA, 23 bp, Homo sapiens
caagtgaatacattttataattt

SEQ ID NO: 6688115 - DNA, 15 bp, Homo sapiens
caagtgaatctttct

SEQ ID NO: 6688116 - DNA, 16 bp, Homo sapiens
caagtgaatctttctc

SEQ ID NO: 6688117 - DNA, 20 bp, Homo sapiens
caagtgaatgagtttccagc

SEQ ID NO: 6688118 - DNA, 19 bp, Homo sapiens
caagtgaccccagggcctg

SEQ ID NO: 6688119 - DNA, 16 bp, Homo sapiens
caagtgaccgacaaaa

SEQ ID NO: 6688120 - DNA, 21 bp, Homo sapiens
caagtgaccgactcatttaca

SEQ ID NO: 6688121 - DNA, 17 bp, Homo sapiens
caagtgacgaaaacatt

SEQ ID NO: 6688122 - DNA, 18 bp, Homo sapiens
caagtgactctcctgcct

SEQ ID NO: 6688123 - DNA, 19 bp, Homo sapiens
caagtgactctcctgcctc

SEQ ID NO: 6688124 - DNA, 18 bp, Homo sapiens
caagtgactgtatctgtg

SEQ ID NO: 6688125 - DNA, 19 bp, Homo sapiens
caagtgagaccctgtctca

SEQ ID NO: 6688126 - DNA, 16 bp, Homo sapiens
caagtgagagagcaag

SEQ ID NO: 6688127 - DNA, 15 bp, Homo sapiens
caagtgagagctggg

SEQ ID NO: 6688128 - DNA, 17 bp, Homo sapiens
caagtgagagctgggtg

SEQ ID NO: 6688129 - DNA, 16 bp, Homo sapiens
caagtgagaggggagg

SEQ ID NO: 6688130 - DNA, 19 bp, Homo sapiens
caagtgagcaaacctgccc

SEQ ID NO: 6688131 - DNA, 12 bp, Homo sapiens
caagtgagcaga

SEQ ID NO: 6688132 - DNA, 13 bp, Homo sapiens
caagtgagccctc

SEQ ID NO: 6688133 - DNA, 21 bp, Homo sapiens
caagtgaggccggagaggagt

SEQ ID NO: 6688134 - DNA, 19 bp, Homo sapiens
caagtgagtctggtggagg

SEQ ID NO: 6688135 - DNA, 21 bp, Homo sapiens
caagtgagtctggtggaggag

SEQ ID NO: 6688136 - DNA, 10 bp, Homo sapiens
caagtgagtg

SEQ ID NO: 6688137 - DNA, 16 bp, Homo sapiens
caagtgataattttat

SEQ ID NO: 6688138 - DNA, 23 bp, Homo sapiens
caagtgataattttatttataaa

SEQ ID NO: 6688139 - DNA, 14 bp, Homo sapiens
caagtgatatatgt

SEQ ID NO: 6688140 - DNA, 21 bp, Homo sapiens
caagtgatccttccacctcag

SEQ ID NO: 6688141 - DNA, 21 bp, Homo sapiens
caagtgatctgccgcctcagc

SEQ ID NO: 6688142 - DNA, 19 bp, Homo sapiens
caagtgatctgtccacctc

SEQ ID NO: 6688143 - DNA, 22 bp, Homo sapiens
caagtgatctttcaatatcatt

SEQ ID NO: 6688144 - DNA, 18 bp, Homo sapiens
caagtgatgctaaaacct

SEQ ID NO: 6688145 - DNA, 17 bp, Homo sapiens
caagtgattctcatgcc

SEQ ID NO: 6688146 - DNA, 21 bp, Homo sapiens
caagtgattctcatgcctcag

SEQ ID NO: 6688147 - DNA, 23 bp, Homo sapiens
caagtgattcttccacctcagcc

SEQ ID NO: 6688148 - DNA, 19 bp, Homo sapiens
caagtgattgaaaatagta

SEQ ID NO: 6688149 - DNA, 23 bp, Homo sapiens
caagtgattgacaactgaagaga

SEQ ID NO: 6688150 - DNA, 17 bp, Homo sapiens
caagtgattttcattgt

SEQ ID NO: 6688151 - DNA, 15 bp, Homo sapiens
caagtgcaaggacca

SEQ ID NO: 6688152 - DNA, 17 bp, Homo sapiens
caagtgcaatatgggcg

SEQ ID NO: 6688153 - DNA, 16 bp, Homo sapiens
caagtgcaatccatgt

SEQ ID NO: 6688154 - DNA, 23 bp, Homo sapiens
caagtgcaatccatgtatctgta

SEQ ID NO: 6688155 - DNA, 14 bp, Homo sapiens
caagtgcacggggc

SEQ ID NO: 6688156 - DNA, 19 bp, Homo sapiens
caagtgcaggcgactggag

SEQ ID NO: 6688157 - DNA, 20 bp, Homo sapiens
caagtgcaggctggcaccgc

SEQ ID NO: 6688158 - DNA, 17 bp, Homo sapiens
caagtgcatgctctctg

SEQ ID NO: 6688159 - DNA, 19 bp, Homo sapiens
caagtgcatgctctctgca

SEQ ID NO: 6688160 - DNA, 23 bp, Homo sapiens
caagtgcatttttatctgtgagt

SEQ ID NO: 6688161 - DNA, 15 bp, Homo sapiens
caagtgccaaatgct

SEQ ID NO: 6688162 - DNA, 13 bp, Homo sapiens
caagtgccagagg

SEQ ID NO: 6688163 - DNA, 15 bp, Homo sapiens
caagtgccagaggtg

SEQ ID NO: 6688164 - DNA, 16 bp, Homo sapiens
caagtgccagaggtgg

SEQ ID NO: 6688165 - DNA, 20 bp, Homo sapiens
caagtgccagaggtgggcag

SEQ ID NO: 6688166 - DNA, 16 bp, Homo sapiens
caagtgccatcccaca

SEQ ID NO: 6688167 - DNA, 18 bp, Homo sapiens
caagtgccatcccacatt

SEQ ID NO: 6688168 - DNA, 12 bp, Homo sapiens
caagtgcccagt

SEQ ID NO: 6688169 - DNA, 14 bp, Homo sapiens
caagtgccccctca

SEQ ID NO: 6688170 - DNA, 20 bp, Homo sapiens
caagtgccccctcacctctc

SEQ ID NO: 6688171 - DNA, 22 bp, Homo sapiens
caagtgccccctcacctctcca

SEQ ID NO: 6688172 - DNA, 16 bp, Homo sapiens
caagtgcccgccctgc

SEQ ID NO: 6688173 - DNA, 17 bp, Homo sapiens
caagtgcctagactgtt

SEQ ID NO: 6688174 - DNA, 14 bp, Homo sapiens
caagtgcctcacct

SEQ ID NO: 6688175 - DNA, 22 bp, Homo sapiens
caagtgcctcacctcgaaagga

SEQ ID NO: 6688176 - DNA, 15 bp, Homo sapiens
caagtgcctcttgtt

SEQ ID NO: 6688177 - DNA, 16 bp, Homo sapiens
caagtgcctcttgttg

SEQ ID NO: 6688178 - DNA, 21 bp, Homo sapiens
caagtgcctgcaccaggggtg

SEQ ID NO: 6688179 - DNA, 12 bp, Homo sapiens
caagtgcctggg

SEQ ID NO: 6688180 - DNA, 13 bp, Homo sapiens
caagtgccttaat

SEQ ID NO: 6688181 - DNA, 18 bp, Homo sapiens
caagtgccttttgctgcg

SEQ ID NO: 6688182 - DNA, 15 bp, Homo sapiens
caagtgctcaagcag

SEQ ID NO: 6688183 - DNA, 13 bp, Homo sapiens
caagtgctcaggg

SEQ ID NO: 6688184 - DNA, 20 bp, Homo sapiens
caagtgctcagttccaatgt

SEQ ID NO: 6688185 - DNA, 12 bp, Homo sapiens
caagtgctggca

SEQ ID NO: 6688186 - DNA, 21 bp, Homo sapiens
caagtgctggcccacccagtc

SEQ ID NO: 6688187 - DNA, 22 bp, Homo sapiens
caagtgctgtttgggcaggagt

SEQ ID NO: 6688188 - DNA, 19 bp, Homo sapiens
caagtgcttaaaaatactt

SEQ ID NO: 6688189 - DNA, 23 bp, Homo sapiens
caagtgcttaaaaatacttctat

SEQ ID NO: 6688190 - DNA, 19 bp, Homo sapiens
caagtggaaacatgctgaa

SEQ ID NO: 6688191 - DNA, 15 bp, Homo sapiens
caagtggactcaggg

SEQ ID NO: 6688192 - DNA, 16 bp, Homo sapiens
caagtggagctgtctg

SEQ ID NO: 6688193 - DNA, 20 bp, Homo sapiens
caagtggagctgtctgtctc

SEQ ID NO: 6688194 - DNA, 20 bp, Homo sapiens
caagtggatattttcttaaa

SEQ ID NO: 6688195 - DNA, 23 bp, Homo sapiens
caagtggatggcccagcaggcag

SEQ ID NO: 6688196 - DNA, 19 bp, Homo sapiens
caagtggatgggaatttgt

SEQ ID NO: 6688197 - DNA, 17 bp, Homo sapiens
caagtggatgtttttaa

SEQ ID NO: 6688198 - DNA, 23 bp, Homo sapiens
caagtggcaaagctgttcttcct

SEQ ID NO: 6688199 - DNA, 17 bp, Homo sapiens
caagtggcataaagcat

SEQ ID NO: 6688200 - DNA, 12 bp, Homo sapiens
caagtggctccc

SEQ ID NO: 6688201 - DNA, 16 bp, Homo sapiens
caagtggctccccacc

SEQ ID NO: 6688202 - DNA, 19 bp, Homo sapiens
caagtggctccccacctgg

SEQ ID NO: 6688203 - DNA, 21 bp, Homo sapiens
caagtggctccccacctggac

SEQ ID NO: 6688204 - DNA, 12 bp, Homo sapiens
caagtggctctt

SEQ ID NO: 6688205 - DNA, 15 bp, Homo sapiens
caagtggctcttggg

SEQ ID NO: 6688206 - DNA, 20 bp, Homo sapiens
caagtggctgggtgccctct

SEQ ID NO: 6688207 - DNA, 22 bp, Homo sapiens
caagtgggagatgaaaacctgc

SEQ ID NO: 6688208 - DNA, 22 bp, Homo sapiens
caagtgggatctgtcacaccag

SEQ ID NO: 6688209 - DNA, 12 bp, Homo sapiens
caagtgggctgg

SEQ ID NO: 6688210 - DNA, 23 bp, Homo sapiens
caagtgggctggtattctctcta

SEQ ID NO: 6688211 - DNA, 18 bp, Homo sapiens
caagtggggctggttttt

SEQ ID NO: 6688212 - DNA, 16 bp, Homo sapiens
caagtgggggtcgaga

SEQ ID NO: 6688213 - DNA, 18 bp, Homo sapiens
caagtggggtgctgggag

SEQ ID NO: 6688214 - DNA, 20 bp, Homo sapiens
caagtggtagcaagaagtga

SEQ ID NO: 6688215 - DNA, 11 bp, Homo sapiens
caagtggtagg

SEQ ID NO: 6688216 - DNA, 16 bp, Homo sapiens
caagtggtatgaccag

SEQ ID NO: 6688217 - DNA, 15 bp, Homo sapiens
caagtggtccagcgt

SEQ ID NO: 6688218 - DNA, 23 bp, Homo sapiens
caagtggtccagcgtcactccag

SEQ ID NO: 6688219 - DNA, 19 bp, Homo sapiens
caagtggtgaccaaaattt

SEQ ID NO: 6688220 - DNA, 22 bp, Homo sapiens
caagtggtgggaatcagatctg

SEQ ID NO: 6688221 - DNA, 17 bp, Homo sapiens
caagtggttgttttaga

SEQ ID NO: 6688222 - DNA, 21 bp, Homo sapiens
caagtggtttccacatgctct

SEQ ID NO: 6688223 - DNA, 23 bp, Homo sapiens
caagtgtaaaatattttgaatca

SEQ ID NO: 6688224 - DNA, 15 bp, Homo sapiens
caagtgtaatgaata

SEQ ID NO: 6688225 - DNA, 18 bp, Homo sapiens
caagtgtaatgaatacct

SEQ ID NO: 6688226 - DNA, 16 bp, Homo sapiens
caagtgtaattagctt

SEQ ID NO: 6688227 - DNA, 22 bp, Homo sapiens
caagtgtaattagcttttggag

SEQ ID NO: 6688228 - DNA, 11 bp, Homo sapiens
caagtgtacag

SEQ ID NO: 6688229 - DNA, 13 bp, Homo sapiens
caagtgtacagaa

SEQ ID NO: 6688230 - DNA, 15 bp, Homo sapiens
caagtgtacagaaga

SEQ ID NO: 6688231 - DNA, 20 bp, Homo sapiens
caagtgtacagtatttacct

SEQ ID NO: 6688232 - DNA, 12 bp, Homo sapiens
caagtgtacatt

SEQ ID NO: 6688233 - DNA, 14 bp, Homo sapiens
caagtgtacatttg

SEQ ID NO: 6688234 - DNA, 18 bp, Homo sapiens
caagtgtataactaaact

SEQ ID NO: 6688235 - DNA, 16 bp, Homo sapiens
caagtgtatatcagaa

SEQ ID NO: 6688236 - DNA, 21 bp, Homo sapiens
caagtgtattttaaaatagag

SEQ ID NO: 6688237 - DNA, 14 bp, Homo sapiens
caagtgtcacctcc

SEQ ID NO: 6688238 - DNA, 20 bp, Homo sapiens
caagtgtcacctccttcccc

SEQ ID NO: 6688239 - DNA, 23 bp, Homo sapiens
caagtgtcacctccttccccagc

SEQ ID NO: 6688240 - DNA, 14 bp, Homo sapiens
caagtgtcttttaa

SEQ ID NO: 6688241 - DNA, 13 bp, Homo sapiens
caagtgtcttttt

SEQ ID NO: 6688242 - DNA, 16 bp, Homo sapiens
caagtgtgaatactgc

SEQ ID NO: 6688243 - DNA, 16 bp, Homo sapiens
caagtgtgcatatata

SEQ ID NO: 6688244 - DNA, 18 bp, Homo sapiens
caagtgtgcatattgtac

SEQ ID NO: 6688245 - DNA, 22 bp, Homo sapiens
caagtgtgcatattgtacactt

SEQ ID NO: 6688246 - DNA, 15 bp, Homo sapiens
caagtgtgcatggct

SEQ ID NO: 6688247 - DNA, 14 bp, Homo sapiens
caagtgtgcctgct

SEQ ID NO: 6688248 - DNA, 21 bp, Homo sapiens
caagtgtgcctgctatccagc

SEQ ID NO: 6688249 - DNA, 23 bp, Homo sapiens
caagtgtggtagggacttaaaaa

SEQ ID NO: 6688250 - DNA, 16 bp, Homo sapiens
caagtgtgtgcatgtg

SEQ ID NO: 6688251 - DNA, 17 bp, Homo sapiens
caagtgtgtgcatgtgt

SEQ ID NO: 6688252 - DNA, 12 bp, Homo sapiens
caagtgtgtggc

SEQ ID NO: 6688253 - DNA, 11 bp, Homo sapiens
caagtgtgtgt

SEQ ID NO: 6688254 - DNA, 17 bp, Homo sapiens
caagtgtgtgtgcaatg

SEQ ID NO: 6688255 - DNA, 17 bp, Homo sapiens
caagtgtgtgtgcgtgt

SEQ ID NO: 6688256 - DNA, 17 bp, Homo sapiens
caagtgttaaattattt

SEQ ID NO: 6688257 - DNA, 23 bp, Homo sapiens
caagtgttaaggcaacattcctt

SEQ ID NO: 6688258 - DNA, 19 bp, Homo sapiens
caagtgttacctaacaatg

SEQ ID NO: 6688259 - DNA, 13 bp, Homo sapiens
caagtgttcactg

SEQ ID NO: 6688260 - DNA, 15 bp, Homo sapiens
caagtgttcactgct

SEQ ID NO: 6688261 - DNA, 23 bp, Homo sapiens
caagtgttcactgctccttgctg

SEQ ID NO: 6688262 - DNA, 13 bp, Homo sapiens
caagtgttcttag

SEQ ID NO: 6688263 - DNA, 18 bp, Homo sapiens
caagtgttcttaggttta

SEQ ID NO: 6688264 - DNA, 15 bp, Homo sapiens
caagtgtttctgttc

SEQ ID NO: 6688265 - DNA, 23 bp, Homo sapiens
caagtgtttgaagtctgctcatt

SEQ ID NO: 6688266 - DNA, 23 bp, Homo sapiens
caagtgttttactatctcactgc

SEQ ID NO: 6688267 - DNA, 15 bp, Homo sapiens
caagtgttttcacac

SEQ ID NO: 6688268 - DNA, 15 bp, Homo sapiens
caagttaacaaggaa

SEQ ID NO: 6688269 - DNA, 16 bp, Homo sapiens
caagttaacaaggaat

SEQ ID NO: 6688270 - DNA, 17 bp, Homo sapiens
caagttaaccagttgca

SEQ ID NO: 6688271 - DNA, 14 bp, Homo sapiens
caagttaagagaaa

SEQ ID NO: 6688272 - DNA, 17 bp, Homo sapiens
caagttaagagaaactt

SEQ ID NO: 6688273 - DNA, 18 bp, Homo sapiens
caagttaagagaaacttt

SEQ ID NO: 6688274 - DNA, 22 bp, Homo sapiens
caagttaagagaaactttatac

SEQ ID NO: 6688275 - DNA, 15 bp, Homo sapiens
caagttaagattctt

SEQ ID NO: 6688276 - DNA, 22 bp, Homo sapiens
caagttaaggtatctggtatct

SEQ ID NO: 6688277 - DNA, 14 bp, Homo sapiens
caagttacacctcc

SEQ ID NO: 6688278 - DNA, 23 bp, Homo sapiens
caagttacacggggttacactgt

SEQ ID NO: 6688279 - DNA, 23 bp, Homo sapiens
caagttacccctgaaatctgagt

SEQ ID NO: 6688280 - DNA, 21 bp, Homo sapiens
caagttagaaaattcagctcc

SEQ ID NO: 6688281 - DNA, 22 bp, Homo sapiens
caagttatacacgggacagttg

SEQ ID NO: 6688282 - DNA, 13 bp, Homo sapiens
caagttattaatt

SEQ ID NO: 6688283 - DNA, 19 bp, Homo sapiens
caagttattgacaaactct

SEQ ID NO: 6688284 - DNA, 22 bp, Homo sapiens
caagttattttatttgcttatt

SEQ ID NO: 6688285 - DNA, 16 bp, Homo sapiens
caagttcaagactgaa

SEQ ID NO: 6688286 - DNA, 12 bp, Homo sapiens
caagttcaagga

SEQ ID NO: 6688287 - DNA, 14 bp, Homo sapiens
caagttcaaggacc

SEQ ID NO: 6688288 - DNA, 15 bp, Homo sapiens
caagttcaatatgga

SEQ ID NO: 6688289 - DNA, 22 bp, Homo sapiens
caagttcacacctgcagattct

SEQ ID NO: 6688290 - DNA, 19 bp, Homo sapiens
caagttcagggaagcaggc

SEQ ID NO: 6688291 - DNA, 21 bp, Homo sapiens
caagttccaacatgcaatact

SEQ ID NO: 6688292 - DNA, 18 bp, Homo sapiens
caagttccaagttgctaa

SEQ ID NO: 6688293 - DNA, 14 bp, Homo sapiens
caagttccagctgg

SEQ ID NO: 6688294 - DNA, 22 bp, Homo sapiens
caagttccattatgaaaatctt

SEQ ID NO: 6688295 - DNA, 19 bp, Homo sapiens
caagttcccagttggagct

SEQ ID NO: 6688296 - DNA, 22 bp, Homo sapiens
caagttccccatccctgtcatt

SEQ ID NO: 6688297 - DNA, 20 bp, Homo sapiens
caagttcctctaacttggct

SEQ ID NO: 6688298 - DNA, 15 bp, Homo sapiens
caagttcctgcactc

SEQ ID NO: 6688299 - DNA, 19 bp, Homo sapiens
caagttcctgcactccaga

SEQ ID NO: 6688300 - DNA, 20 bp, Homo sapiens
caagttctaagattctaatg

SEQ ID NO: 6688301 - DNA, 21 bp, Homo sapiens
caagttctaagattctaatga

SEQ ID NO: 6688302 - DNA, 21 bp, Homo sapiens
caagttctagagaagaggctg

SEQ ID NO: 6688303 - DNA, 23 bp, Homo sapiens
caagttctagagaagaggctggt

SEQ ID NO: 6688304 - DNA, 18 bp, Homo sapiens
caagttctatttcttgaa

SEQ ID NO: 6688305 - DNA, 18 bp, Homo sapiens
caagttcttcacctctat

SEQ ID NO: 6688306 - DNA, 22 bp, Homo sapiens
caagttcttggaccagtttgca

SEQ ID NO: 6688307 - DNA, 18 bp, Homo sapiens
caagttgaaatcagaagc

SEQ ID NO: 6688308 - DNA, 15 bp, Homo sapiens
caagttgaattgagg

SEQ ID NO: 6688309 - DNA, 15 bp, Homo sapiens
caagttgagattttt

SEQ ID NO: 6688310 - DNA, 22 bp, Homo sapiens
caagttgagatttttaagaact

SEQ ID NO: 6688311 - DNA, 19 bp, Homo sapiens
caagttgagctatgactta

SEQ ID NO: 6688312 - DNA, 22 bp, Homo sapiens
caagttgcagtgagcagggtgg

SEQ ID NO: 6688313 - DNA, 23 bp, Homo sapiens
caagttgcagtgagcagggtggg

SEQ ID NO: 6688314 - DNA, 23 bp, Homo sapiens
caagttgccacattgcttcatta

SEQ ID NO: 6688315 - DNA, 20 bp, Homo sapiens
caagttgcgacggagagaaa

SEQ ID NO: 6688316 - DNA, 23 bp, Homo sapiens
caagttgcgacggagagaaaaaa

SEQ ID NO: 6688317 - DNA, 15 bp, Homo sapiens
caagttgctaataca

SEQ ID NO: 6688318 - DNA, 14 bp, Homo sapiens
caagttgctctgta

SEQ ID NO: 6688319 - DNA, 14 bp, Homo sapiens
caagttggactggg

SEQ ID NO: 6688320 - DNA, 13 bp, Homo sapiens
caagttggagtca

SEQ ID NO: 6688321 - DNA, 15 bp, Homo sapiens
caagttggagtcact

SEQ ID NO: 6688322 - DNA, 16 bp, Homo sapiens
caagttggctagaaga

SEQ ID NO: 6688323 - DNA, 17 bp, Homo sapiens
caagttggctagaagaa

SEQ ID NO: 6688324 - DNA, 19 bp, Homo sapiens
caagttggctagaagaaag

SEQ ID NO: 6688325 - DNA, 23 bp, Homo sapiens
caagttgggttcacttgccatgc

SEQ ID NO: 6688326 - DNA, 24 bp, Homo sapiens
caagttgggttcacttgccatgca

SEQ ID NO: 6688327 - DNA, 16 bp, Homo sapiens
caagttgtaaaaatga

SEQ ID NO: 6688328 - DNA, 20 bp, Homo sapiens
caagttgtaaaaatgaaagt

SEQ ID NO: 6688329 - DNA, 15 bp, Homo sapiens
caagttgtaaataat

SEQ ID NO: 6688330 - DNA, 18 bp, Homo sapiens
caagttgtgcttgagcca

SEQ ID NO: 6688331 - DNA, 17 bp, Homo sapiens
caagttgtggtgctgac

SEQ ID NO: 6688332 - DNA, 20 bp, Homo sapiens
caagttgtggtgctgacaaa

SEQ ID NO: 6688333 - DNA, 14 bp, Homo sapiens
caagttgttaaaac

SEQ ID NO: 6688334 - DNA, 23 bp, Homo sapiens
caagttgttaaaacatttaatat

SEQ ID NO: 6688335 - DNA, 17 bp, Homo sapiens
caagttgttattgttga

SEQ ID NO: 6688336 - DNA, 14 bp, Homo sapiens
caagttgttgactg

SEQ ID NO: 6688337 - DNA, 18 bp, Homo sapiens
caagttgttgactgtgat

SEQ ID NO: 6688338 - DNA, 14 bp, Homo sapiens
caagttgtttaact

SEQ ID NO: 6688339 - DNA, 21 bp, Homo sapiens
caagttgtttaactgtgcatg

SEQ ID NO: 6688340 - DNA, 19 bp, Homo sapiens
caagttgtttattccaaag

SEQ ID NO: 6688341 - DNA, 19 bp, Homo sapiens
caagttgtttcaaacagca

SEQ ID NO: 6688342 - DNA, 23 bp, Homo sapiens
caagttgtttgagaaattaagta

SEQ ID NO: 6688343 - DNA, 20 bp, Homo sapiens
caagtttactccttctgttt

SEQ ID NO: 6688344 - DNA, 14 bp, Homo sapiens
caagtttacttgtc

SEQ ID NO: 6688345 - DNA, 19 bp, Homo sapiens
caagtttacttgtctttga

SEQ ID NO: 6688346 - DNA, 12 bp, Homo sapiens
caagtttattca

SEQ ID NO: 6688347 - DNA, 21 bp, Homo sapiens
caagtttattgccctcaaaat

SEQ ID NO: 6688348 - DNA, 16 bp, Homo sapiens
caagtttatttctctc

SEQ ID NO: 6688349 - DNA, 16 bp, Homo sapiens
caagtttcagacaggg

SEQ ID NO: 6688350 - DNA, 19 bp, Homo sapiens
caagtttcataccaaatat

SEQ ID NO: 6688351 - DNA, 20 bp, Homo sapiens
caagtttccatagcaacagg

SEQ ID NO: 6688352 - DNA, 15 bp, Homo sapiens
caagtttctagctct

SEQ ID NO: 6688353 - DNA, 12 bp, Homo sapiens
caagtttgaatt

SEQ ID NO: 6688354 - DNA, 19 bp, Homo sapiens
caagtttgaccagtgcagt

SEQ ID NO: 6688355 - DNA, 15 bp, Homo sapiens
caagtttgagagtgg

SEQ ID NO: 6688356 - DNA, 17 bp, Homo sapiens
caagtttgctaaaagaa

SEQ ID NO: 6688357 - DNA, 21 bp, Homo sapiens
caagttttaaacccaaaatat

SEQ ID NO: 6688358 - DNA, 14 bp, Homo sapiens
caagttttaaagtt

SEQ ID NO: 6688359 - DNA, 22 bp, Homo sapiens
caagttttaaatattatctaac

SEQ ID NO: 6688360 - DNA, 16 bp, Homo sapiens
caagttttagttaaaa

SEQ ID NO: 6688361 - DNA, 17 bp, Homo sapiens
caagttttccatatttt

SEQ ID NO: 6688362 - DNA, 18 bp, Homo sapiens
caagttttccctgaagtt

SEQ ID NO: 6688363 - DNA, 17 bp, Homo sapiens
caagttttcttccatga

SEQ ID NO: 6688364 - DNA, 21 bp, Homo sapiens
caagttttcttccatgatttt

SEQ ID NO: 6688365 - DNA, 18 bp, Homo sapiens
caagttttggcagccatg

SEQ ID NO: 6688366 - DNA, 19 bp, Homo sapiens
caagttttgtataaataat

SEQ ID NO: 6688367 - DNA, 18 bp, Homo sapiens
caagttttgtgaaatttt

SEQ ID NO: 6688368 - DNA, 23 bp, Homo sapiens
caagtttttatacctgtacacac

SEQ ID NO: 6688369 - DNA, 17 bp, Homo sapiens
caagtttttatagttat

SEQ ID NO: 6688370 - DNA, 12 bp, Homo sapiens
caagtttttcag

SEQ ID NO: 6688371 - DNA, 14 bp, Homo sapiens
caagtttttcatac

SEQ ID NO: 6688372 - DNA, 17 bp, Homo sapiens
caagtttttcatactgt

SEQ ID NO: 6688373 - DNA, 18 bp, Homo sapiens
caagtttttcatactgta

SEQ ID NO: 6688374 - DNA, 22 bp, Homo sapiens
caagtttttcatactgtacaca

SEQ ID NO: 6688375 - DNA, 12 bp, Homo sapiens
caagtttttggt

SEQ ID NO: 6688376 - DNA, 20 bp, Homo sapiens
caagtttttggtaatgatga

SEQ ID NO: 6688377 - DNA, 13 bp, Homo sapiens
caataaaaaaaag

SEQ ID NO: 6688378 - DNA, 20 bp, Homo sapiens
caataaaaaaaagaaatgaa

SEQ ID NO: 6688379 - DNA, 20 bp, Homo sapiens
caataaaaaatatattttta

SEQ ID NO: 6688380 - DNA, 20 bp, Homo sapiens
caataaaaacattgcctttg

SEQ ID NO: 6688381 - DNA, 14 bp, Homo sapiens
caataaaaaccaaa

SEQ ID NO: 6688382 - DNA, 13 bp, Homo sapiens
caataaaaagttc

SEQ ID NO: 6688383 - DNA, 17 bp, Homo sapiens
caataaaaataaatcta

SEQ ID NO: 6688384 - DNA, 14 bp, Homo sapiens
caataaaaatcata

SEQ ID NO: 6688385 - DNA, 14 bp, Homo sapiens
caataaaaatggca

SEQ ID NO: 6688386 - DNA, 20 bp, Homo sapiens
caataaaaatgtttaacggt

SEQ ID NO: 6688387 - DNA, 15 bp, Homo sapiens
caataaaacaaataa

SEQ ID NO: 6688388 - DNA, 12 bp, Homo sapiens
caataaaacatt

SEQ ID NO: 6688389 - DNA, 17 bp, Homo sapiens
caataaaactaaatgtg

SEQ ID NO: 6688390 - DNA, 22 bp, Homo sapiens
caataaaactaaatgtgtacac

SEQ ID NO: 6688391 - DNA, 13 bp, Homo sapiens
caataaaagagct

SEQ ID NO: 6688392 - DNA, 18 bp, Homo sapiens
caataaaagagctgtctg

SEQ ID NO: 6688393 - DNA, 20 bp, Homo sapiens
caataaaagcaattccaacc

SEQ ID NO: 6688394 - DNA, 22 bp, Homo sapiens
caataaaagcaattccaacctt

SEQ ID NO: 6688395 - DNA, 18 bp, Homo sapiens
caataaaagcccaggagc

SEQ ID NO: 6688396 - DNA, 19 bp, Homo sapiens
caataaaagcccaggagcc

SEQ ID NO: 6688397 - DNA, 13 bp, Homo sapiens
caataaaagtgac

SEQ ID NO: 6688398 - DNA, 14 bp, Homo sapiens
caataaaatagtat

SEQ ID NO: 6688399 - DNA, 17 bp, Homo sapiens
caataaaatattattga

SEQ ID NO: 6688400 - DNA, 14 bp, Homo sapiens
caataaaatcatgt

SEQ ID NO: 6688401 - DNA, 20 bp, Homo sapiens
caataaaatcatgtacattt

SEQ ID NO: 6688402 - DNA, 20 bp, Homo sapiens
caataaaatccatacatttg

SEQ ID NO: 6688403 - DNA, 23 bp, Homo sapiens
caataaaatccatacatttgtgt

SEQ ID NO: 6688404 - DNA, 13 bp, Homo sapiens
caataaaattata

SEQ ID NO: 6688405 - DNA, 14 bp, Homo sapiens
caataaaatttaaa

SEQ ID NO: 6688406 - DNA, 18 bp, Homo sapiens
caataaaatttctaagag

SEQ ID NO: 6688407 - DNA, 20 bp, Homo sapiens
caataaaatttttttaaagt

SEQ ID NO: 6688408 - DNA, 13 bp, Homo sapiens
caataaacagctg

SEQ ID NO: 6688409 - DNA, 17 bp, Homo sapiens
caataaacaggaatttt

SEQ ID NO: 6688410 - DNA, 15 bp, Homo sapiens
caataaacagtcact

SEQ ID NO: 6688411 - DNA, 20 bp, Homo sapiens
caataaaccaatgaacgaag

SEQ ID NO: 6688412 - DNA, 11 bp, Homo sapiens
caataaaccag

SEQ ID NO: 6688413 - DNA, 17 bp, Homo sapiens
caataaaccagtgtgaa

SEQ ID NO: 6688414 - DNA, 18 bp, Homo sapiens
caataaaccagtgtgaac

SEQ ID NO: 6688415 - DNA, 19 bp, Homo sapiens
caataaaccagtgtgaacc

SEQ ID NO: 6688416 - DNA, 20 bp, Homo sapiens
caataaaccctcagagcctc

SEQ ID NO: 6688417 - DNA, 14 bp, Homo sapiens
caataaaccctcct

SEQ ID NO: 6688418 - DNA, 17 bp, Homo sapiens
caataaaccctccttgg

SEQ ID NO: 6688419 - DNA, 23 bp, Homo sapiens
caataaacctccgccaatgcacg

SEQ ID NO: 6688420 - DNA, 17 bp, Homo sapiens
caataaacctcttttct

SEQ ID NO: 6688421 - DNA, 12 bp, Homo sapiens
caataaacgatt

SEQ ID NO: 6688422 - DNA, 11 bp, Homo sapiens
caataaactat

SEQ ID NO: 6688423 - DNA, 20 bp, Homo sapiens
caataaactcagtcaaatgt

SEQ ID NO: 6688424 - DNA, 12 bp, Homo sapiens
caataaactcct

SEQ ID NO: 6688425 - DNA, 14 bp, Homo sapiens
caataaactgaatt

SEQ ID NO: 6688426 - DNA, 14 bp, Homo sapiens
caataaactgagcg

SEQ ID NO: 6688427 - DNA, 22 bp, Homo sapiens
caataaactggtatgaataatt

SEQ ID NO: 6688428 - DNA, 16 bp, Homo sapiens
caataaacttcctttt

SEQ ID NO: 6688429 - DNA, 13 bp, Homo sapiens
caataaacttgta

SEQ ID NO: 6688430 - DNA, 19 bp, Homo sapiens
caataaacttgtgcctcca

SEQ ID NO: 6688431 - DNA, 13 bp, Homo sapiens
caataaagaaaaa

SEQ ID NO: 6688432 - DNA, 19 bp, Homo sapiens
caataaagaaaacttccat

SEQ ID NO: 6688433 - DNA, 13 bp, Homo sapiens
caataaagaaatt

SEQ ID NO: 6688434 - DNA, 12 bp, Homo sapiens
caataaagagat

SEQ ID NO: 6688435 - DNA, 22 bp, Homo sapiens
caataaagagttagaatgaaaa

SEQ ID NO: 6688436 - DNA, 11 bp, Homo sapiens
caataaagcaa

SEQ ID NO: 6688437 - DNA, 17 bp, Homo sapiens
caataaagcaataagaa

SEQ ID NO: 6688438 - DNA, 13 bp, Homo sapiens
caataaagcacta

SEQ ID NO: 6688439 - DNA, 21 bp, Homo sapiens
caataaagcagagccaaggcc

SEQ ID NO: 6688440 - DNA, 23 bp, Homo sapiens
caataaagcagagccaaggccac

SEQ ID NO: 6688441 - DNA, 14 bp, Homo sapiens
caataaagcagagt

SEQ ID NO: 6688442 - DNA, 14 bp, Homo sapiens
caataaagcattta

SEQ ID NO: 6688443 - DNA, 15 bp, Homo sapiens
caataaagcatttat

SEQ ID NO: 6688444 - DNA, 16 bp, Homo sapiens
caataaagcatttata

SEQ ID NO: 6688445 - DNA, 19 bp, Homo sapiens
caataaagcatttataaat

SEQ ID NO: 6688446 - DNA, 15 bp, Homo sapiens
caataaagcctgact

SEQ ID NO: 6688447 - DNA, 18 bp, Homo sapiens
caataaagcctgacttca

SEQ ID NO: 6688448 - DNA, 14 bp, Homo sapiens
caataaagcctttt

SEQ ID NO: 6688449 - DNA, 15 bp, Homo sapiens
caataaagctcacac

SEQ ID NO: 6688450 - DNA, 19 bp, Homo sapiens
caataaagctggacaagaa

SEQ ID NO: 6688451 - DNA, 23 bp, Homo sapiens
caataaagctggacaagaagctg

SEQ ID NO: 6688452 - DNA, 13 bp, Homo sapiens
caataaagcttgt

SEQ ID NO: 6688453 - DNA, 13 bp, Homo sapiens
caataaagctttt

SEQ ID NO: 6688454 - DNA, 16 bp, Homo sapiens
caataaagcttttgga

SEQ ID NO: 6688455 - DNA, 15 bp, Homo sapiens
caataaaggaaatat

SEQ ID NO: 6688456 - DNA, 11 bp, Homo sapiens
caataaaggca

SEQ ID NO: 6688457 - DNA, 14 bp, Homo sapiens
caataaaggcagct

SEQ ID NO: 6688458 - DNA, 16 bp, Homo sapiens
caataaaggcagctgc

SEQ ID NO: 6688459 - DNA, 17 bp, Homo sapiens
caataaaggcagctgcc

SEQ ID NO: 6688460 - DNA, 19 bp, Homo sapiens
caataaaggcagctgcctc

SEQ ID NO: 6688461 - DNA, 20 bp, Homo sapiens
caataaaggcagctgcctct

SEQ ID NO: 6688462 - DNA, 13 bp, Homo sapiens
caataaagggaga

SEQ ID NO: 6688463 - DNA, 21 bp, Homo sapiens
caataaaggtcccttagcccc

SEQ ID NO: 6688464 - DNA, 16 bp, Homo sapiens
caataaagtactgcaa

SEQ ID NO: 6688465 - DNA, 20 bp, Homo sapiens
caataaagtatttaattagt

SEQ ID NO: 6688466 - DNA, 14 bp, Homo sapiens
caataaagtgaccc

SEQ ID NO: 6688467 - DNA, 18 bp, Homo sapiens
caataaagttattcagaa

SEQ ID NO: 6688468 - DNA, 11 bp, Homo sapiens
caataaagttg

SEQ ID NO: 6688469 - DNA, 19 bp, Homo sapiens
caataaagttgagcaaaca

SEQ ID NO: 6688470 - DNA, 19 bp, Homo sapiens
caataaagttgttgcattc

SEQ ID NO: 6688471 - DNA, 20 bp, Homo sapiens
caataaagttgttgcattcc

SEQ ID NO: 6688472 - DNA, 17 bp, Homo sapiens
caataaagtttacaagc

SEQ ID NO: 6688473 - DNA, 20 bp, Homo sapiens
caataaagtttgatcttcct

SEQ ID NO: 6688474 - DNA, 13 bp, Homo sapiens
caataaataaatg

SEQ ID NO: 6688475 - DNA, 17 bp, Homo sapiens
caataaataatattata

SEQ ID NO: 6688476 - DNA, 17 bp, Homo sapiens
caataaatagacacgca

SEQ ID NO: 6688477 - DNA, 15 bp, Homo sapiens
caataaatattattt

SEQ ID NO: 6688478 - DNA, 19 bp, Homo sapiens
caataaatccgcttctcct

SEQ ID NO: 6688479 - DNA, 14 bp, Homo sapiens
caataaatctttca

SEQ ID NO: 6688480 - DNA, 11 bp, Homo sapiens
caataaatgaa

SEQ ID NO: 6688481 - DNA, 12 bp, Homo sapiens
caataaatgaat

SEQ ID NO: 6688482 - DNA, 16 bp, Homo sapiens
caataaatgaatgaat

SEQ ID NO: 6688483 - DNA, 13 bp, Homo sapiens
caataaatgacac

SEQ ID NO: 6688484 - DNA, 15 bp, Homo sapiens
caataaatgctgaat

SEQ ID NO: 6688485 - DNA, 17 bp, Homo sapiens
caataaatggccagtgc

SEQ ID NO: 6688486 - DNA, 23 bp, Homo sapiens
caataaatggtatagcaaatgtt

SEQ ID NO: 6688487 - DNA, 15 bp, Homo sapiens
caataaatgtattca

SEQ ID NO: 6688488 - DNA, 12 bp, Homo sapiens
caataaatgtca

SEQ ID NO: 6688489 - DNA, 14 bp, Homo sapiens
caataaatgtctgt

SEQ ID NO: 6688490 - DNA, 15 bp, Homo sapiens
caataaatgtctgtt

SEQ ID NO: 6688491 - DNA, 17 bp, Homo sapiens
caataaatgtgcttatg

SEQ ID NO: 6688492 - DNA, 12 bp, Homo sapiens
caataaatgttg

SEQ ID NO: 6688493 - DNA, 14 bp, Homo sapiens
caataaatgttgaa

SEQ ID NO: 6688494 - DNA, 19 bp, Homo sapiens
caataaatgttgaaaagtc

SEQ ID NO: 6688495 - DNA, 16 bp, Homo sapiens
caataaatgtttgtta

SEQ ID NO: 6688496 - DNA, 11 bp, Homo sapiens
caataaattct

SEQ ID NO: 6688497 - DNA, 16 bp, Homo sapiens
caataaattctaaatt

SEQ ID NO: 6688498 - DNA, 22 bp, Homo sapiens
caataaattgctaatgttgctg

SEQ ID NO: 6688499 - DNA, 15 bp, Homo sapiens
caataaatttctgct

SEQ ID NO: 6688500 - DNA, 17 bp, Homo sapiens
caataaatttgtaactt

SEQ ID NO: 6688501 - DNA, 18 bp, Homo sapiens
caataaattttatctcag

SEQ ID NO: 6688502 - DNA, 14 bp, Homo sapiens
caataaattttgaa

SEQ ID NO: 6688503 - DNA, 18 bp, Homo sapiens
caataaattttttttggt

SEQ ID NO: 6688504 - DNA, 22 bp, Homo sapiens
caataaattttttttggtcaaa

SEQ ID NO: 6688505 - DNA, 23 bp, Homo sapiens
caataaattttttttggtcaaat

SEQ ID NO: 6688506 - DNA, 16 bp, Homo sapiens
caataacaaagcacat

SEQ ID NO: 6688507 - DNA, 14 bp, Homo sapiens
caataacaacaatg

SEQ ID NO: 6688508 - DNA, 22 bp, Homo sapiens
caataacaacaatggtttacat

SEQ ID NO: 6688509 - DNA, 15 bp, Homo sapiens
caataacactgtatt

SEQ ID NO: 6688510 - DNA, 13 bp, Homo sapiens
caataacactgtc

SEQ ID NO: 6688511 - DNA, 14 bp, Homo sapiens
caataacagtttta

SEQ ID NO: 6688512 - DNA, 15 bp, Homo sapiens
caataacccagttac

SEQ ID NO: 6688513 - DNA, 17 bp, Homo sapiens
caataacccagttactt

SEQ ID NO: 6688514 - DNA, 22 bp, Homo sapiens
caataactactgtgttcctggc

SEQ ID NO: 6688515 - DNA, 20 bp, Homo sapiens
caataactccaagcagactc

SEQ ID NO: 6688516 - DNA, 18 bp, Homo sapiens
caataactcctcccaggg

SEQ ID NO: 6688517 - DNA, 17 bp, Homo sapiens
caataactctgggaggg

SEQ ID NO: 6688518 - DNA, 19 bp, Homo sapiens
caataacttcagagaagtc

SEQ ID NO: 6688519 - DNA, 17 bp, Homo sapiens
caataacttctatattt

SEQ ID NO: 6688520 - DNA, 22 bp, Homo sapiens
caataacttctatattttaata

SEQ ID NO: 6688521 - DNA, 15 bp, Homo sapiens
caataactttatatg

SEQ ID NO: 6688522 - DNA, 14 bp, Homo sapiens
caataagaaaatgt

SEQ ID NO: 6688523 - DNA, 12 bp, Homo sapiens
caataagaaatg

SEQ ID NO: 6688524 - DNA, 16 bp, Homo sapiens
caataagaaatgaaca

SEQ ID NO: 6688525 - DNA, 12 bp, Homo sapiens
caataagaacaa

SEQ ID NO: 6688526 - DNA, 21 bp, Homo sapiens
caataagaattactttgtgtt

SEQ ID NO: 6688527 - DNA, 13 bp, Homo sapiens
caataagacatgc

SEQ ID NO: 6688528 - DNA, 21 bp, Homo sapiens
caataagagcgtttgcccaaa

SEQ ID NO: 6688529 - DNA, 22 bp, Homo sapiens
caataagagtctccttctcttc

SEQ ID NO: 6688530 - DNA, 20 bp, Homo sapiens
caataagatattaccctcag

SEQ ID NO: 6688531 - DNA, 17 bp, Homo sapiens
caataagcagaggtgga

SEQ ID NO: 6688532 - DNA, 21 bp, Homo sapiens
caataagcagaggtggaaaat

SEQ ID NO: 6688533 - DNA, 12 bp, Homo sapiens
caataagccttg

SEQ ID NO: 6688534 - DNA, 13 bp, Homo sapiens
caataagccttgt

SEQ ID NO: 6688535 - DNA, 21 bp, Homo sapiens
caataagcgttaagggcagag

SEQ ID NO: 6688536 - DNA, 22 bp, Homo sapiens
caataagcgttaagggcagagt

SEQ ID NO: 6688537 - DNA, 22 bp, Homo sapiens
caataagctcctaaattataga

SEQ ID NO: 6688538 - DNA, 23 bp, Homo sapiens
caataagctcctaaattatagag

SEQ ID NO: 6688539 - DNA, 17 bp, Homo sapiens
caataaggatttattct

SEQ ID NO: 6688540 - DNA, 22 bp, Homo sapiens
caataaggatttattctcagaa

SEQ ID NO: 6688541 - DNA, 17 bp, Homo sapiens
caataaggtcaatgcca

SEQ ID NO: 6688542 - DNA, 20 bp, Homo sapiens
caataagttacttgaaataa

SEQ ID NO: 6688543 - DNA, 21 bp, Homo sapiens
caataagttacttgaaataag

SEQ ID NO: 6688544 - DNA, 21 bp, Homo sapiens
caataagttcattaaacagaa

SEQ ID NO: 6688545 - DNA, 14 bp, Homo sapiens
caataagttgaatg

SEQ ID NO: 6688546 - DNA, 17 bp, Homo sapiens
caataagttgaatgata

SEQ ID NO: 6688547 - DNA, 11 bp, Homo sapiens
caataataaaa

SEQ ID NO: 6688548 - DNA, 22 bp, Homo sapiens
caataataaagatgtgaaaact

SEQ ID NO: 6688549 - DNA, 15 bp, Homo sapiens
caataataaagtact

SEQ ID NO: 6688550 - DNA, 15 bp, Homo sapiens
caataataattaaag

SEQ ID NO: 6688551 - DNA, 13 bp, Homo sapiens
caataatatattt

SEQ ID NO: 6688552 - DNA, 17 bp, Homo sapiens
caataatatattttctg

SEQ ID NO: 6688553 - DNA, 18 bp, Homo sapiens
caataatatattttctgt

SEQ ID NO: 6688554 - DNA, 20 bp, Homo sapiens
caataatatattttctgttt

SEQ ID NO: 6688555 - DNA, 14 bp, Homo sapiens
caataatatttcaa

SEQ ID NO: 6688556 - DNA, 18 bp, Homo sapiens
caataatatttcaagtgc

SEQ ID NO: 6688557 - DNA, 19 bp, Homo sapiens
caataatatttcaagtgcc

SEQ ID NO: 6688558 - DNA, 21 bp, Homo sapiens
caataatatttcaagtgccta

SEQ ID NO: 6688559 - DNA, 12 bp, Homo sapiens
caataatcagaa

SEQ ID NO: 6688560 - DNA, 15 bp, Homo sapiens
caataatcagaaaag

SEQ ID NO: 6688561 - DNA, 14 bp, Homo sapiens
caataatccacccc

SEQ ID NO: 6688562 - DNA, 23 bp, Homo sapiens
caataatgcagtatggtacattt

SEQ ID NO: 6688563 - DNA, 18 bp, Homo sapiens
caataatggggcagacac

SEQ ID NO: 6688564 - DNA, 20 bp, Homo sapiens
caataatggggcagacacaa

SEQ ID NO: 6688565 - DNA, 20 bp, Homo sapiens
caataatggtcccatccagg

SEQ ID NO: 6688566 - DNA, 21 bp, Homo sapiens
caataatgtaatttagtctaa

SEQ ID NO: 6688567 - DNA, 15 bp, Homo sapiens
caataatgtactcac

SEQ ID NO: 6688568 - DNA, 21 bp, Homo sapiens
caataattacattggcacaat

SEQ ID NO: 6688569 - DNA, 16 bp, Homo sapiens
caataattcatattct

SEQ ID NO: 6688570 - DNA, 15 bp, Homo sapiens
caataattgaagtgt

SEQ ID NO: 6688571 - DNA, 16 bp, Homo sapiens
caataattgcagaact

SEQ ID NO: 6688572 - DNA, 18 bp, Homo sapiens
caataattgtggagagga

SEQ ID NO: 6688573 - DNA, 12 bp, Homo sapiens
caataattgttt

SEQ ID NO: 6688574 - DNA, 17 bp, Homo sapiens
caataatttgtacaatg

SEQ ID NO: 6688575 - DNA, 18 bp, Homo sapiens
caataattttcctgtgac

SEQ ID NO: 6688576 - DNA, 14 bp, Homo sapiens
caatacaaagatga

SEQ ID NO: 6688577 - DNA, 19 bp, Homo sapiens
caatacaaaggttccattc

SEQ ID NO: 6688578 - DNA, 13 bp, Homo sapiens
caatacaaatgga

SEQ ID NO: 6688579 - DNA, 16 bp, Homo sapiens
caatacaaatggattt

SEQ ID NO: 6688580 - DNA, 21 bp, Homo sapiens
caatacaaatggattttggga

SEQ ID NO: 6688581 - DNA, 13 bp, Homo sapiens
caatacaacttta

SEQ ID NO: 6688582 - DNA, 16 bp, Homo sapiens
caatacaactttacca

SEQ ID NO: 6688583 - DNA, 21 bp, Homo sapiens
caatacaactttaccataaag

SEQ ID NO: 6688584 - DNA, 15 bp, Homo sapiens
caatacaatgtacaa

SEQ ID NO: 6688585 - DNA, 22 bp, Homo sapiens
caatacacataagaccgtgtcc

SEQ ID NO: 6688586 - DNA, 19 bp, Homo sapiens
caatacactagttgtttct

SEQ ID NO: 6688587 - DNA, 23 bp, Homo sapiens
caatacagaattgactgcagttg

SEQ ID NO: 6688588 - DNA, 22 bp, Homo sapiens
caatacagcctgaataaaccaa

SEQ ID NO: 6688589 - DNA, 18 bp, Homo sapiens
caatacagggaggctccc

SEQ ID NO: 6688590 - DNA, 14 bp, Homo sapiens
caatacagtatttc

SEQ ID NO: 6688591 - DNA, 23 bp, Homo sapiens
caatacagtgaaggtctttgtta

SEQ ID NO: 6688592 - DNA, 13 bp, Homo sapiens
caatacagtgctc

SEQ ID NO: 6688593 - DNA, 23 bp, Homo sapiens
caatacagtttataaagccaaga

SEQ ID NO: 6688594 - DNA, 23 bp, Homo sapiens
caatacatcccttacctgggaaa

SEQ ID NO: 6688595 - DNA, 17 bp, Homo sapiens
caatacatgctgctaat

SEQ ID NO: 6688596 - DNA, 14 bp, Homo sapiens
caatacattaaaat

SEQ ID NO: 6688597 - DNA, 15 bp, Homo sapiens
caatacatttgtatt

SEQ ID NO: 6688598 - DNA, 21 bp, Homo sapiens
caatacatttgtattttgtga

SEQ ID NO: 6688599 - DNA, 15 bp, Homo sapiens
caataccaacctgaa

SEQ ID NO: 6688600 - DNA, 18 bp, Homo sapiens
caataccaacctgaaagt

SEQ ID NO: 6688601 - DNA, 13 bp, Homo sapiens
caataccactggt

SEQ ID NO: 6688602 - DNA, 19 bp, Homo sapiens
caatacccaaatcctctcc

SEQ ID NO: 6688603 - DNA, 20 bp, Homo sapiens
caatacccaaatcctctcca

SEQ ID NO: 6688604 - DNA, 23 bp, Homo sapiens
caataccccaagtccacctgcct

SEQ ID NO: 6688605 - DNA, 14 bp, Homo sapiens
caataccccgactc

SEQ ID NO: 6688606 - DNA, 23 bp, Homo sapiens
caataccccgactcaccttgtgt

SEQ ID NO: 6688607 - DNA, 21 bp, Homo sapiens
caataccctagaagaaaaccc

SEQ ID NO: 6688608 - DNA, 23 bp, Homo sapiens
caataccctagaagaaaacccga

SEQ ID NO: 6688609 - DNA, 21 bp, Homo sapiens
caataccctgtctttaaaaat

SEQ ID NO: 6688610 - DNA, 22 bp, Homo sapiens
caataccctgtctttaaaaata

SEQ ID NO: 6688611 - DNA, 17 bp, Homo sapiens
caatacccttggcactg

SEQ ID NO: 6688612 - DNA, 23 bp, Homo sapiens
caataccctttgaattggacaat

SEQ ID NO: 6688613 - DNA, 16 bp, Homo sapiens
caataccgctcagtat

SEQ ID NO: 6688614 - DNA, 18 bp, Homo sapiens
caataccgctcagtattt

SEQ ID NO: 6688615 - DNA, 21 bp, Homo sapiens
caatacctggcctcatttaaa

SEQ ID NO: 6688616 - DNA, 16 bp, Homo sapiens
caatacctgtactatg

SEQ ID NO: 6688617 - DNA, 16 bp, Homo sapiens
caatacgcctttaaag

SEQ ID NO: 6688618 - DNA, 19 bp, Homo sapiens
caatacgtgatctctgtta

SEQ ID NO: 6688619 - DNA, 17 bp, Homo sapiens
caatacgtttgtgcaga

SEQ ID NO: 6688620 - DNA, 19 bp, Homo sapiens
caatacgtttgtgcagaat

SEQ ID NO: 6688621 - DNA, 23 bp, Homo sapiens
caatacgtttgtgcagaatctct

SEQ ID NO: 6688622 - DNA, 13 bp, Homo sapiens
caatactaaataa

SEQ ID NO: 6688623 - DNA, 21 bp, Homo sapiens
caatactaagaataacaagaa

SEQ ID NO: 6688624 - DNA, 22 bp, Homo sapiens
caatactaagaataacaagaag

SEQ ID NO: 6688625 - DNA, 11 bp, Homo sapiens
caatactacct

SEQ ID NO: 6688626 - DNA, 15 bp, Homo sapiens
caatactacctcact

SEQ ID NO: 6688627 - DNA, 14 bp, Homo sapiens
caatactacctctg

SEQ ID NO: 6688628 - DNA, 13 bp, Homo sapiens
caatactactgta

SEQ ID NO: 6688629 - DNA, 16 bp, Homo sapiens
caatactactgtaaat

SEQ ID NO: 6688630 - DNA, 19 bp, Homo sapiens
caatactactgtaaatgta

SEQ ID NO: 6688631 - DNA, 22 bp, Homo sapiens
caatactcataatgtgaagtgt

SEQ ID NO: 6688632 - DNA, 13 bp, Homo sapiens
caatactgagcca

SEQ ID NO: 6688633 - DNA, 18 bp, Homo sapiens
caatactgagtgcctgca

SEQ ID NO: 6688634 - DNA, 17 bp, Homo sapiens
caatactgccgctgccc

SEQ ID NO: 6688635 - DNA, 18 bp, Homo sapiens
caatactgggcagccttt

SEQ ID NO: 6688636 - DNA, 15 bp, Homo sapiens
caatactttgtgtct

SEQ ID NO: 6688637 - DNA, 16 bp, Homo sapiens
caatactttgtgtctt

SEQ ID NO: 6688638 - DNA, 17 bp, Homo sapiens
caatactttgtgtcttt

SEQ ID NO: 6688639 - DNA, 19 bp, Homo sapiens
caatacttttgtgtattct

SEQ ID NO: 6688640 - DNA, 23 bp, Homo sapiens
caatagaaactcaccatgtaaaa

SEQ ID NO: 6688641 - DNA, 16 bp, Homo sapiens
caatagaaagaaacta

SEQ ID NO: 6688642 - DNA, 22 bp, Homo sapiens
caatagaaagcaaacatgtgca

SEQ ID NO: 6688643 - DNA, 11 bp, Homo sapiens
caatagaaata

SEQ ID NO: 6688644 - DNA, 15 bp, Homo sapiens
caatagaacagttta

SEQ ID NO: 6688645 - DNA, 23 bp, Homo sapiens
caatagaacatgcaagaatttct

SEQ ID NO: 6688646 - DNA, 12 bp, Homo sapiens
caatagaactgg

SEQ ID NO: 6688647 - DNA, 13 bp, Homo sapiens
caatagaatttat

SEQ ID NO: 6688648 - DNA, 16 bp, Homo sapiens
caatagacacatacat

SEQ ID NO: 6688649 - DNA, 12 bp, Homo sapiens
caatagagactg

SEQ ID NO: 6688650 - DNA, 19 bp, Homo sapiens
caatagattgctcaaatca

SEQ ID NO: 6688651 - DNA, 15 bp, Homo sapiens
caatagattgtaata

SEQ ID NO: 6688652 - DNA, 19 bp, Homo sapiens
caatagcagacagtgtttt

SEQ ID NO: 6688653 - DNA, 14 bp, Homo sapiens
caatagcagttata

SEQ ID NO: 6688654 - DNA, 16 bp, Homo sapiens
caatagcagttataac

SEQ ID NO: 6688655 - DNA, 18 bp, Homo sapiens
caatagcattagaaataa

SEQ ID NO: 6688656 - DNA, 15 bp, Homo sapiens
caatagcattgttct

SEQ ID NO: 6688657 - DNA, 17 bp, Homo sapiens
caatagccactaacctt

SEQ ID NO: 6688658 - DNA, 22 bp, Homo sapiens
caatagccactaaccttgcctg

SEQ ID NO: 6688659 - DNA, 21 bp, Homo sapiens
caatagcgctcccttttcacc

SEQ ID NO: 6688660 - DNA, 19 bp, Homo sapiens
caatagctaagcatctcct

SEQ ID NO: 6688661 - DNA, 18 bp, Homo sapiens
caatagctagctatatat

SEQ ID NO: 6688662 - DNA, 22 bp, Homo sapiens
caatagctagctatatatggta

SEQ ID NO: 6688663 - DNA, 15 bp, Homo sapiens
caatagctattgcat

SEQ ID NO: 6688664 - DNA, 20 bp, Homo sapiens
caatagctattgcatgtaaa

SEQ ID NO: 6688665 - DNA, 18 bp, Homo sapiens
caatagctccaagctgtt

SEQ ID NO: 6688666 - DNA, 21 bp, Homo sapiens
caatagctctactgccctccc

SEQ ID NO: 6688667 - DNA, 12 bp, Homo sapiens
caatagctgccc

SEQ ID NO: 6688668 - DNA, 18 bp, Homo sapiens
caatagctgcccatttcg

SEQ ID NO: 6688669 - DNA, 21 bp, Homo sapiens
caatagctttaccctcaggca

SEQ ID NO: 6688670 - DNA, 17 bp, Homo sapiens
caataggaaaaactgat

SEQ ID NO: 6688671 - DNA, 18 bp, Homo sapiens
caataggaaagcatatgc

SEQ ID NO: 6688672 - DNA, 16 bp, Homo sapiens
caataggaatgctaac

SEQ ID NO: 6688673 - DNA, 22 bp, Homo sapiens
caataggagtggtgatttgaaa

SEQ ID NO: 6688674 - DNA, 15 bp, Homo sapiens
caataggcaaattaa

SEQ ID NO: 6688675 - DNA, 15 bp, Homo sapiens
caataggctgtaatc

SEQ ID NO: 6688676 - DNA, 16 bp, Homo sapiens
caataggctgtaatca

SEQ ID NO: 6688677 - DNA, 15 bp, Homo sapiens
caataggctgttccc

SEQ ID NO: 6688678 - DNA, 23 bp, Homo sapiens
caatagggctaaatgtttaaaga

SEQ ID NO: 6688679 - DNA, 16 bp, Homo sapiens
caatagggtagaatga

SEQ ID NO: 6688680 - DNA, 21 bp, Homo sapiens
caatagggtagaatgattaat

SEQ ID NO: 6688681 - DNA, 15 bp, Homo sapiens
caatagggtgcagtt

SEQ ID NO: 6688682 - DNA, 17 bp, Homo sapiens
caataggtagctgggga

SEQ ID NO: 6688683 - DNA, 17 bp, Homo sapiens
caataggtctttctctc

SEQ ID NO: 6688684 - DNA, 22 bp, Homo sapiens
caataggtgctgagtgtacaga

SEQ ID NO: 6688685 - DNA, 19 bp, Homo sapiens
caataggtttgtaaaatgc

SEQ ID NO: 6688686 - DNA, 18 bp, Homo sapiens
caatagtatacattttat

SEQ ID NO: 6688687 - DNA, 19 bp, Homo sapiens
caatagtatttctcctttg

SEQ ID NO: 6688688 - DNA, 17 bp, Homo sapiens
caatagtcaaattgtgt

SEQ ID NO: 6688689 - DNA, 16 bp, Homo sapiens
caatagtcaagaaaaa

SEQ ID NO: 6688690 - DNA, 23 bp, Homo sapiens
caatagtcatatgtgaagacaga

SEQ ID NO: 6688691 - DNA, 16 bp, Homo sapiens
caatagtgggccctcc

SEQ ID NO: 6688692 - DNA, 14 bp, Homo sapiens
caatagtgtcatcc

SEQ ID NO: 6688693 - DNA, 21 bp, Homo sapiens
caatagtgtcctatgcaataa

SEQ ID NO: 6688694 - DNA, 22 bp, Homo sapiens
caatagtgtcctatgcaataaa

SEQ ID NO: 6688695 - DNA, 16 bp, Homo sapiens
caatagtgtgttctga

SEQ ID NO: 6688696 - DNA, 17 bp, Homo sapiens
caatagtgttgaggagg

SEQ ID NO: 6688697 - DNA, 22 bp, Homo sapiens
caatagttcaaggaacttgaaa

SEQ ID NO: 6688698 - DNA, 18 bp, Homo sapiens
caatagttcttaaaatta

SEQ ID NO: 6688699 - DNA, 20 bp, Homo sapiens
caatagttttagattatttt

SEQ ID NO: 6688700 - DNA, 16 bp, Homo sapiens
caatagtttttaaaag

SEQ ID NO: 6688701 - DNA, 16 bp, Homo sapiens
caatataaaaatgtga

SEQ ID NO: 6688702 - DNA, 18 bp, Homo sapiens
caatataaaaatgtgaat

SEQ ID NO: 6688703 - DNA, 18 bp, Homo sapiens
caatataaaactgtactt

SEQ ID NO: 6688704 - DNA, 13 bp, Homo sapiens
caatataaaccgt

SEQ ID NO: 6688705 - DNA, 23 bp, Homo sapiens
caatataaagttctacagttaat

SEQ ID NO: 6688706 - DNA, 18 bp, Homo sapiens
caatataaccaatgttta

SEQ ID NO: 6688707 - DNA, 19 bp, Homo sapiens
caatataaccaatgtttaa

SEQ ID NO: 6688708 - DNA, 14 bp, Homo sapiens
caatataccatgac

SEQ ID NO: 6688709 - DNA, 13 bp, Homo sapiens
caatatacgaaaa

SEQ ID NO: 6688710 - DNA, 15 bp, Homo sapiens
caatatacgaaaagc

SEQ ID NO: 6688711 - DNA, 20 bp, Homo sapiens
caatatactggaaagctttt

SEQ ID NO: 6688712 - DNA, 20 bp, Homo sapiens
caatatagaaaaataaaaat

SEQ ID NO: 6688713 - DNA, 12 bp, Homo sapiens
caatatagaaac

SEQ ID NO: 6688714 - DNA, 16 bp, Homo sapiens
caatatataaaaatat

SEQ ID NO: 6688715 - DNA, 17 bp, Homo sapiens
caatatataaaaatata

SEQ ID NO: 6688716 - DNA, 21 bp, Homo sapiens
caatatataaaaatatatata

SEQ ID NO: 6688717 - DNA, 18 bp, Homo sapiens
caatatatagaattgtag

SEQ ID NO: 6688718 - DNA, 12 bp, Homo sapiens
caatatatatta

SEQ ID NO: 6688719 - DNA, 18 bp, Homo sapiens
caatatatattatatata

SEQ ID NO: 6688720 - DNA, 22 bp, Homo sapiens
caatatatattatatatatcta

SEQ ID NO: 6688721 - DNA, 22 bp, Homo sapiens
caatatatcataacttaataaa

SEQ ID NO: 6688722 - DNA, 21 bp, Homo sapiens
caatatatctaaattgaataa

SEQ ID NO: 6688723 - DNA, 14 bp, Homo sapiens
caatatattttgta

SEQ ID NO: 6688724 - DNA, 15 bp, Homo sapiens
caatatattttgtat

SEQ ID NO: 6688725 - DNA, 16 bp, Homo sapiens
caatatcaatcacatt

SEQ ID NO: 6688726 - DNA, 15 bp, Homo sapiens
caatatcactcttga

SEQ ID NO: 6688727 - DNA, 14 bp, Homo sapiens
caatatcagacttt

SEQ ID NO: 6688728 - DNA, 17 bp, Homo sapiens
caatatcagctttgata

SEQ ID NO: 6688729 - DNA, 13 bp, Homo sapiens
caatatcagtgct

SEQ ID NO: 6688730 - DNA, 13 bp, Homo sapiens
caatatcatgtct

SEQ ID NO: 6688731 - DNA, 18 bp, Homo sapiens
caatatcatgtgtagata

SEQ ID NO: 6688732 - DNA, 22 bp, Homo sapiens
caatatcatgtgtagatattat

SEQ ID NO: 6688733 - DNA, 14 bp, Homo sapiens
caatatcattacta

SEQ ID NO: 6688734 - DNA, 20 bp, Homo sapiens
caatatcattttcctgggag

SEQ ID NO: 6688735 - DNA, 17 bp, Homo sapiens
caatatccaatgaagaa

SEQ ID NO: 6688736 - DNA, 14 bp, Homo sapiens
caatatcccaacat

SEQ ID NO: 6688737 - DNA, 17 bp, Homo sapiens
caatatcccaacattct

SEQ ID NO: 6688738 - DNA, 21 bp, Homo sapiens
caatatcccaacattctgcaa

SEQ ID NO: 6688739 - DNA, 15 bp, Homo sapiens
caatatcccttactt

SEQ ID NO: 6688740 - DNA, 13 bp, Homo sapiens
caatatcctaata

SEQ ID NO: 6688741 - DNA, 14 bp, Homo sapiens
caatatcctaataa

SEQ ID NO: 6688742 - DNA, 19 bp, Homo sapiens
caatatcctaataaaaagg

SEQ ID NO: 6688743 - DNA, 21 bp, Homo sapiens
caatatcctaataaaaaggtg

SEQ ID NO: 6688744 - DNA, 22 bp, Homo sapiens
caatatcctaataaaaaggtga

SEQ ID NO: 6688745 - DNA, 22 bp, Homo sapiens
caatatcgtacctgtccctcca

SEQ ID NO: 6688746 - DNA, 16 bp, Homo sapiens
caatatctaatatata

SEQ ID NO: 6688747 - DNA, 23 bp, Homo sapiens
caatatctgaagccctcccaggt

SEQ ID NO: 6688748 - DNA, 23 bp, Homo sapiens
caatatcttcgttagtaatctgt

SEQ ID NO: 6688749 - DNA, 23 bp, Homo sapiens
caatatgaaaaggatattatcta

SEQ ID NO: 6688750 - DNA, 20 bp, Homo sapiens
caatatgaaggaaatgaacc

SEQ ID NO: 6688751 - DNA, 22 bp, Homo sapiens
caatatgaagttactttcttaa

SEQ ID NO: 6688752 - DNA, 21 bp, Homo sapiens
caatatgaattcaagaaagga

SEQ ID NO: 6688753 - DNA, 16 bp, Homo sapiens
caatatgacacagctt

SEQ ID NO: 6688754 - DNA, 18 bp, Homo sapiens
caatatgacacttgtaaa

SEQ ID NO: 6688755 - DNA, 18 bp, Homo sapiens
caatatgattgcactaaa

SEQ ID NO: 6688756 - DNA, 19 bp, Homo sapiens
caatatgattgcactaaat

SEQ ID NO: 6688757 - DNA, 13 bp, Homo sapiens
caatatgcaagca

SEQ ID NO: 6688758 - DNA, 18 bp, Homo sapiens
caatatgcaagcagcttt

SEQ ID NO: 6688759 - DNA, 20 bp, Homo sapiens
caatatgcaagcagcttttt

SEQ ID NO: 6688760 - DNA, 15 bp, Homo sapiens
caatatgcagttctg

SEQ ID NO: 6688761 - DNA, 14 bp, Homo sapiens
caatatgccagctt

SEQ ID NO: 6688762 - DNA, 15 bp, Homo sapiens
caatatgctttacac

SEQ ID NO: 6688763 - DNA, 23 bp, Homo sapiens
caatatgctttacactcattttc

SEQ ID NO: 6688764 - DNA, 23 bp, Homo sapiens
caatatgtaacatgtctaaagtt

SEQ ID NO: 6688765 - DNA, 21 bp, Homo sapiens
caatatgtattgtaaacatgt

SEQ ID NO: 6688766 - DNA, 18 bp, Homo sapiens
caatatgtgtttacttta

SEQ ID NO: 6688767 - DNA, 17 bp, Homo sapiens
caatattaaaagagacc

SEQ ID NO: 6688768 - DNA, 21 bp, Homo sapiens
caatattaaagggtctggaaa

SEQ ID NO: 6688769 - DNA, 12 bp, Homo sapiens
caatattaaata

SEQ ID NO: 6688770 - DNA, 15 bp, Homo sapiens
caatattaaatctgc

SEQ ID NO: 6688771 - DNA, 21 bp, Homo sapiens
caatattaagtgttgtacaat

SEQ ID NO: 6688772 - DNA, 22 bp, Homo sapiens
caatattaagtgttgtacaatt

SEQ ID NO: 6688773 - DNA, 22 bp, Homo sapiens
caatattaccatcttaatcttt

SEQ ID NO: 6688774 - DNA, 19 bp, Homo sapiens
caatattactttgtctttt

SEQ ID NO: 6688775 - DNA, 22 bp, Homo sapiens
caatattataatttttttcaat

SEQ ID NO: 6688776 - DNA, 14 bp, Homo sapiens
caatattatgaaat

SEQ ID NO: 6688777 - DNA, 15 bp, Homo sapiens
caatattatgaaatt

SEQ ID NO: 6688778 - DNA, 15 bp, Homo sapiens
caatattcaataaag

SEQ ID NO: 6688779 - DNA, 17 bp, Homo sapiens
caatattcaataaagct

SEQ ID NO: 6688780 - DNA, 14 bp, Homo sapiens
caatattcagtggt

SEQ ID NO: 6688781 - DNA, 21 bp, Homo sapiens
caatattcagtggtgaaatct

SEQ ID NO: 6688782 - DNA, 14 bp, Homo sapiens
caatattccttagt

SEQ ID NO: 6688783 - DNA, 23 bp, Homo sapiens
caatattctattttgcagataga

SEQ ID NO: 6688784 - DNA, 15 bp, Homo sapiens
caatattctctgtac

SEQ ID NO: 6688785 - DNA, 15 bp, Homo sapiens
caatattctgtaact

SEQ ID NO: 6688786 - DNA, 16 bp, Homo sapiens
caatattctgtaacta

SEQ ID NO: 6688787 - DNA, 16 bp, Homo sapiens
caatattgactttgtc

SEQ ID NO: 6688788 - DNA, 23 bp, Homo sapiens
caatattgattgggaaaacattt

SEQ ID NO: 6688789 - DNA, 15 bp, Homo sapiens
caatattgattttaa

SEQ ID NO: 6688790 - DNA, 16 bp, Homo sapiens
caatattgtacagttt

SEQ ID NO: 6688791 - DNA, 22 bp, Homo sapiens
caatattgtctcccttccagca

SEQ ID NO: 6688792 - DNA, 24 bp, Homo sapiens
caatatttaacaatttattctgat

SEQ ID NO: 6688793 - DNA, 19 bp, Homo sapiens
caatatttaaggagatgta

SEQ ID NO: 6688794 - DNA, 22 bp, Homo sapiens
caatatttaaggagatgtaaga

SEQ ID NO: 6688795 - DNA, 20 bp, Homo sapiens
caatatttaagtttgttgct

SEQ ID NO: 6688796 - DNA, 16 bp, Homo sapiens
caatatttactcatca

SEQ ID NO: 6688797 - DNA, 13 bp, Homo sapiens
caatatttagaaa

SEQ ID NO: 6688798 - DNA, 13 bp, Homo sapiens
caatatttataat

SEQ ID NO: 6688799 - DNA, 14 bp, Homo sapiens
caatatttattgta

SEQ ID NO: 6688800 - DNA, 21 bp, Homo sapiens
caatatttcagataatcacaa

SEQ ID NO: 6688801 - DNA, 22 bp, Homo sapiens
caatatttccctggaatttaat

SEQ ID NO: 6688802 - DNA, 19 bp, Homo sapiens
caatatttcctcatgtgat

SEQ ID NO: 6688803 - DNA, 22 bp, Homo sapiens
caatatttctgctttctttgat

SEQ ID NO: 6688804 - DNA, 19 bp, Homo sapiens
caatatttcttttgttgta

SEQ ID NO: 6688805 - DNA, 15 bp, Homo sapiens
caatatttgtagaag

SEQ ID NO: 6688806 - DNA, 22 bp, Homo sapiens
caatatttgtgtgctaaacgtg

SEQ ID NO: 6688807 - DNA, 11 bp, Homo sapiens
caatattttaa

SEQ ID NO: 6688808 - DNA, 13 bp, Homo sapiens
caatattttaata

SEQ ID NO: 6688809 - DNA, 15 bp, Homo sapiens
caatattttaataaa

SEQ ID NO: 6688810 - DNA, 17 bp, Homo sapiens
caatattttattctagg

SEQ ID NO: 6688811 - DNA, 19 bp, Homo sapiens
caatattttcagaagaaag

SEQ ID NO: 6688812 - DNA, 15 bp, Homo sapiens
caatattttccatga

SEQ ID NO: 6688813 - DNA, 20 bp, Homo sapiens
caatattttccatgaaaatg

SEQ ID NO: 6688814 - DNA, 22 bp, Homo sapiens
caatattttccatgaaaatgca

SEQ ID NO: 6688815 - DNA, 16 bp, Homo sapiens
caatattttctttaat

SEQ ID NO: 6688816 - DNA, 20 bp, Homo sapiens
caatattttctttaatgctt

SEQ ID NO: 6688817 - DNA, 14 bp, Homo sapiens
caatattttgtata

SEQ ID NO: 6688818 - DNA, 16 bp, Homo sapiens
caatatttttatatca

SEQ ID NO: 6688819 - DNA, 23 bp, Homo sapiens
caatatttttatatcatgcaaaa

SEQ ID NO: 6688820 - DNA, 17 bp, Homo sapiens
caatatttttattttta

SEQ ID NO: 6688821 - DNA, 12 bp, Homo sapiens
caatatttttct

SEQ ID NO: 6688822 - DNA, 15 bp, Homo sapiens
caatcaaaacacact

SEQ ID NO: 6688823 - DNA, 15 bp, Homo sapiens
caatcaaactttcag

SEQ ID NO: 6688824 - DNA, 12 bp, Homo sapiens
caatcaaagcta

SEQ ID NO: 6688825 - DNA, 20 bp, Homo sapiens
caatcaaatctcctgctgat

SEQ ID NO: 6688826 - DNA, 12 bp, Homo sapiens
caatcaacacta

SEQ ID NO: 6688827 - DNA, 22 bp, Homo sapiens
caatcaacagcatgtctactgc

SEQ ID NO: 6688828 - DNA, 16 bp, Homo sapiens
caatcaactttactgt

SEQ ID NO: 6688829 - DNA, 17 bp, Homo sapiens
caatcaagataaaggac

SEQ ID NO: 6688830 - DNA, 14 bp, Homo sapiens
caatcaagcaaaat

SEQ ID NO: 6688831 - DNA, 18 bp, Homo sapiens
caatcaaggttataattt

SEQ ID NO: 6688832 - DNA, 18 bp, Homo sapiens
caatcaagtctgtttact

SEQ ID NO: 6688833 - DNA, 13 bp, Homo sapiens
caatcaagttttt

SEQ ID NO: 6688834 - DNA, 20 bp, Homo sapiens
caatcaataaaaatggcatt

SEQ ID NO: 6688835 - DNA, 19 bp, Homo sapiens
caatcaatcttgcatgtaa

SEQ ID NO: 6688836 - DNA, 19 bp, Homo sapiens
caatcacacgtggtgacct

SEQ ID NO: 6688837 - DNA, 13 bp, Homo sapiens
caatcacactaca

SEQ ID NO: 6688838 - DNA, 16 bp, Homo sapiens
caatcacagctcactg

SEQ ID NO: 6688839 - DNA, 21 bp, Homo sapiens
caatcacagggaatggccaca

SEQ ID NO: 6688840 - DNA, 19 bp, Homo sapiens
caatcacgagatcttcctt

SEQ ID NO: 6688841 - DNA, 20 bp, Homo sapiens
caatcacgagatcttccttc

SEQ ID NO: 6688842 - DNA, 24 bp, Homo sapiens
caatcacgagatcttccttccgct

SEQ ID NO: 6688843 - DNA, 21 bp, Homo sapiens
caatcacgggcggtcctgcac

SEQ ID NO: 6688844 - DNA, 23 bp, Homo sapiens
caatcacgggcggtcctgcacag

SEQ ID NO: 6688845 - DNA, 22 bp, Homo sapiens
caatcactaaatatctagtgct

SEQ ID NO: 6688846 - DNA, 19 bp, Homo sapiens
caatcactagtcaagaaaa

SEQ ID NO: 6688847 - DNA, 23 bp, Homo sapiens
caatcactgaaaactatgcaaga

SEQ ID NO: 6688848 - DNA, 16 bp, Homo sapiens
caatcactgcactgca

SEQ ID NO: 6688849 - DNA, 12 bp, Homo sapiens
caatcactgcca

SEQ ID NO: 6688850 - DNA, 15 bp, Homo sapiens
caatcactgggccca

SEQ ID NO: 6688851 - DNA, 18 bp, Homo sapiens
caatcactgggcccagag

SEQ ID NO: 6688852 - DNA, 11 bp, Homo sapiens
caatcactgtc

SEQ ID NO: 6688853 - DNA, 15 bp, Homo sapiens
caatcactttttgga

SEQ ID NO: 6688854 - DNA, 19 bp, Homo sapiens
caatcagaacttcaggtgt

SEQ ID NO: 6688855 - DNA, 13 bp, Homo sapiens
caatcagaagaaa

SEQ ID NO: 6688856 - DNA, 19 bp, Homo sapiens
caatcagagaccaggccct

SEQ ID NO: 6688857 - DNA, 20 bp, Homo sapiens
caatcagagaccaggccctg

SEQ ID NO: 6688858 - DNA, 12 bp, Homo sapiens
caatcagcaaac

SEQ ID NO: 6688859 - DNA, 13 bp, Homo sapiens
caatcagcactga

SEQ ID NO: 6688860 - DNA, 17 bp, Homo sapiens
caatcagcactgaaaat

SEQ ID NO: 6688861 - DNA, 17 bp, Homo sapiens
caatcagcctagttgat

SEQ ID NO: 6688862 - DNA, 17 bp, Homo sapiens
caatcagcctcatgact

SEQ ID NO: 6688863 - DNA, 13 bp, Homo sapiens
caatcagccttta

SEQ ID NO: 6688864 - DNA, 23 bp, Homo sapiens
caatcagcctttaggtctttagt

SEQ ID NO: 6688865 - DNA, 15 bp, Homo sapiens
caatcagctccttcc

SEQ ID NO: 6688866 - DNA, 18 bp, Homo sapiens
caatcagcttttgttcta

SEQ ID NO: 6688867 - DNA, 20 bp, Homo sapiens
caatcagcttttgttctaga

SEQ ID NO: 6688868 - DNA, 16 bp, Homo sapiens
caatcaggaatgagtc

SEQ ID NO: 6688869 - DNA, 17 bp, Homo sapiens
caatcagtagcttaaga

SEQ ID NO: 6688870 - DNA, 15 bp, Homo sapiens
caatcagtcatcatg

SEQ ID NO: 6688871 - DNA, 19 bp, Homo sapiens
caatcagtttatcctgaca

SEQ ID NO: 6688872 - DNA, 13 bp, Homo sapiens
caatcatatgtga

SEQ ID NO: 6688873 - DNA, 15 bp, Homo sapiens
caatcatatgtgatc

SEQ ID NO: 6688874 - DNA, 20 bp, Homo sapiens
caatcatattaatacaatga

SEQ ID NO: 6688875 - DNA, 17 bp, Homo sapiens
caatcatcaaaaagtaa

SEQ ID NO: 6688876 - DNA, 22 bp, Homo sapiens
caatcatggctcactgcagcct

SEQ ID NO: 6688877 - DNA, 14 bp, Homo sapiens
caatcatgggaatt

SEQ ID NO: 6688878 - DNA, 14 bp, Homo sapiens
caatcatgtgttta

SEQ ID NO: 6688879 - DNA, 14 bp, Homo sapiens
caatcatgttctgg

SEQ ID NO: 6688880 - DNA, 12 bp, Homo sapiens
caatcattgaag

SEQ ID NO: 6688881 - DNA, 14 bp, Homo sapiens
caatcattgcaaac

SEQ ID NO: 6688882 - DNA, 20 bp, Homo sapiens
caatcattgcaaacaactga

SEQ ID NO: 6688883 - DNA, 21 bp, Homo sapiens
caatcattgctgaaaatggta

SEQ ID NO: 6688884 - DNA, 14 bp, Homo sapiens
caatcattgtacag

SEQ ID NO: 6688885 - DNA, 16 bp, Homo sapiens
caatcattgtcagaga

SEQ ID NO: 6688886 - DNA, 17 bp, Homo sapiens
caatcattgttttgaat

SEQ ID NO: 6688887 - DNA, 20 bp, Homo sapiens
caatcattgttttgaatatt

SEQ ID NO: 6688888 - DNA, 18 bp, Homo sapiens
caatcatttctcactgtg

SEQ ID NO: 6688889 - DNA, 12 bp, Homo sapiens
caatcattttat

SEQ ID NO: 6688890 - DNA, 15 bp, Homo sapiens
caatcattttatata

SEQ ID NO: 6688891 - DNA, 18 bp, Homo sapiens
caatcattttctagccct

SEQ ID NO: 6688892 - DNA, 15 bp, Homo sapiens
caatccaaataaaga

SEQ ID NO: 6688893 - DNA, 15 bp, Homo sapiens
caatccaaatgcatt

SEQ ID NO: 6688894 - DNA, 16 bp, Homo sapiens
caatccaaatgcattc

SEQ ID NO: 6688895 - DNA, 17 bp, Homo sapiens
caatccaaatgcattca

SEQ ID NO: 6688896 - DNA, 17 bp, Homo sapiens
caatccaaattccctct

SEQ ID NO: 6688897 - DNA, 15 bp, Homo sapiens
caatccaagagtctg

SEQ ID NO: 6688898 - DNA, 21 bp, Homo sapiens
caatccaatctgtaatttcac

SEQ ID NO: 6688899 - DNA, 14 bp, Homo sapiens
caatccacagtatt

SEQ ID NO: 6688900 - DNA, 15 bp, Homo sapiens
caatccacagtattg

SEQ ID NO: 6688901 - DNA, 15 bp, Homo sapiens
caatccacctgcctt

SEQ ID NO: 6688902 - DNA, 16 bp, Homo sapiens
caatccacctgccttg

SEQ ID NO: 6688903 - DNA, 23 bp, Homo sapiens
caatccaccttcaggccccgccc

SEQ ID NO: 6688904 - DNA, 16 bp, Homo sapiens
caatccactctcagga

SEQ ID NO: 6688905 - DNA, 14 bp, Homo sapiens
caatccagaggaac

SEQ ID NO: 6688906 - DNA, 18 bp, Homo sapiens
caatccagatggtgggat

SEQ ID NO: 6688907 - DNA, 16 bp, Homo sapiens
caatccaggccaaagc

SEQ ID NO: 6688908 - DNA, 22 bp, Homo sapiens
caatccaggctgttctcagcgt

SEQ ID NO: 6688909 - DNA, 19 bp, Homo sapiens
caatccaggtgggagagac

SEQ ID NO: 6688910 - DNA, 14 bp, Homo sapiens
caatccatcagcaa

SEQ ID NO: 6688911 - DNA, 21 bp, Homo sapiens
caatccatcgtattaaaaaac

SEQ ID NO: 6688912 - DNA, 19 bp, Homo sapiens
caatccatgtgattaatgt

SEQ ID NO: 6688913 - DNA, 22 bp, Homo sapiens
caatccatgttagtttttactt

SEQ ID NO: 6688914 - DNA, 19 bp, Homo sapiens
caatccatttggcagaact

SEQ ID NO: 6688915 - DNA, 17 bp, Homo sapiens
caatcccaccaaccctc

SEQ ID NO: 6688916 - DNA, 22 bp, Homo sapiens
caatcccaccaaccctcagagc

SEQ ID NO: 6688917 - DNA, 19 bp, Homo sapiens
caatcccacctagcccagg

SEQ ID NO: 6688918 - DNA, 12 bp, Homo sapiens
caatcccagcta

SEQ ID NO: 6688919 - DNA, 17 bp, Homo sapiens
caatcccagctacctca

SEQ ID NO: 6688920 - DNA, 18 bp, Homo sapiens
caatcccagggctggctc

SEQ ID NO: 6688921 - DNA, 19 bp, Homo sapiens
caatcccagggctggctct

SEQ ID NO: 6688922 - DNA, 14 bp, Homo sapiens
caatcccagttctt

SEQ ID NO: 6688923 - DNA, 20 bp, Homo sapiens
caatcccagttcttcctgca

SEQ ID NO: 6688924 - DNA, 22 bp, Homo sapiens
caatcccagttcttcctgcaac

SEQ ID NO: 6688925 - DNA, 16 bp, Homo sapiens
caatccccactcctcc

SEQ ID NO: 6688926 - DNA, 12 bp, Homo sapiens
caatccccagcc

SEQ ID NO: 6688927 - DNA, 16 bp, Homo sapiens
caatccccagcccttt

SEQ ID NO: 6688928 - DNA, 13 bp, Homo sapiens
caatccccagcct

SEQ ID NO: 6688929 - DNA, 16 bp, Homo sapiens
caatccccagcctagg

SEQ ID NO: 6688930 - DNA, 15 bp, Homo sapiens
caatcccctcattca

SEQ ID NO: 6688931 - DNA, 16 bp, Homo sapiens
caatcccctccttggg

SEQ ID NO: 6688932 - DNA, 15 bp, Homo sapiens
caatccctcaaacct

SEQ ID NO: 6688933 - DNA, 20 bp, Homo sapiens
caatccctcaccttctgagt

SEQ ID NO: 6688934 - DNA, 20 bp, Homo sapiens
caatccctgccactgggctc

SEQ ID NO: 6688935 - DNA, 21 bp, Homo sapiens
caatccctgccactgggctct

SEQ ID NO: 6688936 - DNA, 22 bp, Homo sapiens
caatcccttaatatcctaaaca

SEQ ID NO: 6688937 - DNA, 20 bp, Homo sapiens
caatccctttattaccccct

SEQ ID NO: 6688938 - DNA, 23 bp, Homo sapiens
caatccgttcccttctgccacct

SEQ ID NO: 6688939 - DNA, 20 bp, Homo sapiens
caatcctaatttctcctccc

SEQ ID NO: 6688940 - DNA, 22 bp, Homo sapiens
caatcctagaaccaagcttcag

SEQ ID NO: 6688941 - DNA, 16 bp, Homo sapiens
caatcctatgcatggt

SEQ ID NO: 6688942 - DNA, 22 bp, Homo sapiens
caatcctattactcttcctcta

SEQ ID NO: 6688943 - DNA, 23 bp, Homo sapiens
caatcctcaaatcagtcttcctt

SEQ ID NO: 6688944 - DNA, 13 bp, Homo sapiens
caatcctcaccta

SEQ ID NO: 6688945 - DNA, 18 bp, Homo sapiens
caatcctcactgggtggg

SEQ ID NO: 6688946 - DNA, 15 bp, Homo sapiens
caatcctcccagaaa

SEQ ID NO: 6688947 - DNA, 12 bp, Homo sapiens
caatcctccccg

SEQ ID NO: 6688948 - DNA, 16 bp, Homo sapiens
caatcctccctggaga

SEQ ID NO: 6688949 - DNA, 17 bp, Homo sapiens
caatcctcctgcctcag

SEQ ID NO: 6688950 - DNA, 13 bp, Homo sapiens
caatcctctaagc

SEQ ID NO: 6688951 - DNA, 12 bp, Homo sapiens
caatcctctctc

SEQ ID NO: 6688952 - DNA, 13 bp, Homo sapiens
caatcctgccccc

SEQ ID NO: 6688953 - DNA, 19 bp, Homo sapiens
caatcctggaagaagcagg

SEQ ID NO: 6688954 - DNA, 11 bp, Homo sapiens
caatcctggac

SEQ ID NO: 6688955 - DNA, 19 bp, Homo sapiens
caatcctggctctgtggct

SEQ ID NO: 6688956 - DNA, 15 bp, Homo sapiens
caatcctgtccctca

SEQ ID NO: 6688957 - DNA, 18 bp, Homo sapiens
caatcctgtgggtgaaga

SEQ ID NO: 6688958 - DNA, 23 bp, Homo sapiens
caatcctgttaagagataattct

SEQ ID NO: 6688959 - DNA, 17 bp, Homo sapiens
caatcctgttactctgt

SEQ ID NO: 6688960 - DNA, 15 bp, Homo sapiens
caatccttacaaatg

SEQ ID NO: 6688961 - DNA, 21 bp, Homo sapiens
caatccttcttatgtttgctt

SEQ ID NO: 6688962 - DNA, 15 bp, Homo sapiens
caatccttttgataa

SEQ ID NO: 6688963 - DNA, 15 bp, Homo sapiens
caatcggactgccaa

SEQ ID NO: 6688964 - DNA, 17 bp, Homo sapiens
caatcggactgccaaat

SEQ ID NO: 6688965 - DNA, 15 bp, Homo sapiens
caatcggctacccct

SEQ ID NO: 6688966 - DNA, 18 bp, Homo sapiens
caatcgtcttaagttttt

SEQ ID NO: 6688967 - DNA, 14 bp, Homo sapiens
caatctaaattaaa

SEQ ID NO: 6688968 - DNA, 15 bp, Homo sapiens
caatctaaattaaaa

SEQ ID NO: 6688969 - DNA, 20 bp, Homo sapiens
caatctaaattaaaaaagaa

SEQ ID NO: 6688970 - DNA, 17 bp, Homo sapiens
caatctaacaataatat

SEQ ID NO: 6688971 - DNA, 15 bp, Homo sapiens
caatctaaccacatc

SEQ ID NO: 6688972 - DNA, 20 bp, Homo sapiens
caatctacgatgttaaaaca

SEQ ID NO: 6688973 - DNA, 16 bp, Homo sapiens
caatctactcaaagca

SEQ ID NO: 6688974 - DNA, 16 bp, Homo sapiens
caatctagttccagag

SEQ ID NO: 6688975 - DNA, 16 bp, Homo sapiens
caatctatcttttcca

SEQ ID NO: 6688976 - DNA, 21 bp, Homo sapiens
caatctatggcttatttctat

SEQ ID NO: 6688977 - DNA, 14 bp, Homo sapiens
caatctattatttc

SEQ ID NO: 6688978 - DNA, 13 bp, Homo sapiens
caatctatttaaa

SEQ ID NO: 6688979 - DNA, 14 bp, Homo sapiens
caatctcaaggaat

SEQ ID NO: 6688980 - DNA, 18 bp, Homo sapiens
caatctcaaggaatcttt

SEQ ID NO: 6688981 - DNA, 20 bp, Homo sapiens
caatctcaaggaatctttaa

SEQ ID NO: 6688982 - DNA, 18 bp, Homo sapiens
caatctcaatacagcctg

SEQ ID NO: 6688983 - DNA, 23 bp, Homo sapiens
caatctcctctctctttcctcca

SEQ ID NO: 6688984 - DNA, 19 bp, Homo sapiens
caatctcgccttcctgcag

SEQ ID NO: 6688985 - DNA, 22 bp, Homo sapiens
caatctcgtatagaagtcttca

SEQ ID NO: 6688986 - DNA, 19 bp, Homo sapiens
caatctctacccctttctt

SEQ ID NO: 6688987 - DNA, 15 bp, Homo sapiens
caatctctgcctccc

SEQ ID NO: 6688988 - DNA, 14 bp, Homo sapiens
caatctctgttctg

SEQ ID NO: 6688989 - DNA, 15 bp, Homo sapiens
caatctctgttctgc

SEQ ID NO: 6688990 - DNA, 23 bp, Homo sapiens
caatctctgttctgtttggcact

SEQ ID NO: 6688991 - DNA, 19 bp, Homo sapiens
caatctctgttgcacctga

SEQ ID NO: 6688992 - DNA, 20 bp, Homo sapiens
caatctgaagatacatgtct

SEQ ID NO: 6688993 - DNA, 14 bp, Homo sapiens
caatctgagcaaac

SEQ ID NO: 6688994 - DNA, 24 bp, Homo sapiens
caatctgattcagcatcactaaac

SEQ ID NO: 6688995 - DNA, 20 bp, Homo sapiens
caatctgcaagtcccaggga

SEQ ID NO: 6688996 - DNA, 20 bp, Homo sapiens
caatctgctcagcaggccct

SEQ ID NO: 6688997 - DNA, 17 bp, Homo sapiens
caatctggaagaaaaaa

SEQ ID NO: 6688998 - DNA, 22 bp, Homo sapiens
caatctggaagaaagccctgtg

SEQ ID NO: 6688999 - DNA, 16 bp, Homo sapiens
caatctggacacttct

SEQ ID NO: 6689000 - DNA, 20 bp, Homo sapiens
caatctggatgcctcattat

SEQ ID NO: 6689001 - DNA, 20 bp, Homo sapiens
caatctggattcatatttaa

SEQ ID NO: 6689002 - DNA, 18 bp, Homo sapiens
caatctggcccttacaca

SEQ ID NO: 6689003 - DNA, 21 bp, Homo sapiens
caatctggctcactgcagcct

SEQ ID NO: 6689004 - DNA, 18 bp, Homo sapiens
caatctggcttagtgcca

SEQ ID NO: 6689005 - DNA, 13 bp, Homo sapiens
caatctgggaaga

SEQ ID NO: 6689006 - DNA, 15 bp, Homo sapiens
caatctgggactttc

SEQ ID NO: 6689007 - DNA, 16 bp, Homo sapiens
caatctggtaatggtg

SEQ ID NO: 6689008 - DNA, 16 bp, Homo sapiens
caatctgtaaactgtg

SEQ ID NO: 6689009 - DNA, 17 bp, Homo sapiens
caatctgtacaaaatgg

SEQ ID NO: 6689010 - DNA, 14 bp, Homo sapiens
caatctgtccagac

SEQ ID NO: 6689011 - DNA, 23 bp, Homo sapiens
caatctgttctactcttaatgat

SEQ ID NO: 6689012 - DNA, 16 bp, Homo sapiens
caatcttaaacataat

SEQ ID NO: 6689013 - DNA, 20 bp, Homo sapiens
caatcttaacaaaagtgaac

SEQ ID NO: 6689014 - DNA, 17 bp, Homo sapiens
caatcttaccagatgct

SEQ ID NO: 6689015 - DNA, 14 bp, Homo sapiens
caatcttactttgt

SEQ ID NO: 6689016 - DNA, 19 bp, Homo sapiens
caatcttactttgtaaatt

SEQ ID NO: 6689017 - DNA, 14 bp, Homo sapiens
caatcttcaatcct

SEQ ID NO: 6689018 - DNA, 18 bp, Homo sapiens
caatcttcaatccttgaa

SEQ ID NO: 6689019 - DNA, 14 bp, Homo sapiens
caatcttccaaaga

SEQ ID NO: 6689020 - DNA, 16 bp, Homo sapiens
caatcttccttcctta

SEQ ID NO: 6689021 - DNA, 19 bp, Homo sapiens
caatcttctttttcaggct

SEQ ID NO: 6689022 - DNA, 11 bp, Homo sapiens
caatcttgctg

SEQ ID NO: 6689023 - DNA, 15 bp, Homo sapiens
caatcttgctgtgaa

SEQ ID NO: 6689024 - DNA, 17 bp, Homo sapiens
caatcttggagctgctt

SEQ ID NO: 6689025 - DNA, 17 bp, Homo sapiens
caatcttggggctgatg

SEQ ID NO: 6689026 - DNA, 15 bp, Homo sapiens
caatcttgtccacag

SEQ ID NO: 6689027 - DNA, 14 bp, Homo sapiens
caatcttgttactg

SEQ ID NO: 6689028 - DNA, 12 bp, Homo sapiens
caatcttgtttc

SEQ ID NO: 6689029 - DNA, 12 bp, Homo sapiens
caatcttgtttt

SEQ ID NO: 6689030 - DNA, 18 bp, Homo sapiens
caatctttcatgtcttgt

SEQ ID NO: 6689031 - DNA, 20 bp, Homo sapiens
caatctttcctactttctat

SEQ ID NO: 6689032 - DNA, 13 bp, Homo sapiens
caatctttctata

SEQ ID NO: 6689033 - DNA, 14 bp, Homo sapiens
caatctttctatat

SEQ ID NO: 6689034 - DNA, 19 bp, Homo sapiens
caatctttgaaagacttcc

SEQ ID NO: 6689035 - DNA, 23 bp, Homo sapiens
caatctttgaaagacttccaaag

SEQ ID NO: 6689036 - DNA, 14 bp, Homo sapiens
caatctttgccttt

SEQ ID NO: 6689037 - DNA, 13 bp, Homo sapiens
caatctttgctgt

SEQ ID NO: 6689038 - DNA, 17 bp, Homo sapiens
caatcttttaaattgca

SEQ ID NO: 6689039 - DNA, 17 bp, Homo sapiens
caatgaaaaatgtaatt

SEQ ID NO: 6689040 - DNA, 18 bp, Homo sapiens
caatgaaaaatgtaattt

SEQ ID NO: 6689041 - DNA, 14 bp, Homo sapiens
caatgaaaacaaaa

SEQ ID NO: 6689042 - DNA, 22 bp, Homo sapiens
caatgaaaacaaaattccatta

SEQ ID NO: 6689043 - DNA, 12 bp, Homo sapiens
caatgaaaacat

SEQ ID NO: 6689044 - DNA, 15 bp, Homo sapiens
caatgaaaagaaaat

SEQ ID NO: 6689045 - DNA, 18 bp, Homo sapiens
caatgaaaattttaagaa

SEQ ID NO: 6689046 - DNA, 12 bp, Homo sapiens
caatgaaaccaa

SEQ ID NO: 6689047 - DNA, 13 bp, Homo sapiens
caatgaaaccaaa

SEQ ID NO: 6689048 - DNA, 17 bp, Homo sapiens
caatgaaaccttcctct

SEQ ID NO: 6689049 - DNA, 18 bp, Homo sapiens
caatgaaaggtactatat

SEQ ID NO: 6689050 - DNA, 12 bp, Homo sapiens
caatgaaagtca

SEQ ID NO: 6689051 - DNA, 22 bp, Homo sapiens
caatgaaatacacaagtaaaca

SEQ ID NO: 6689052 - DNA, 21 bp, Homo sapiens
caatgaaatactccagcacct

SEQ ID NO: 6689053 - DNA, 19 bp, Homo sapiens
caatgaaatatgtgaagcc

SEQ ID NO: 6689054 - DNA, 22 bp, Homo sapiens
caatgaaatatttgcttattta

SEQ ID NO: 6689055 - DNA, 11 bp, Homo sapiens
caatgaaatga

SEQ ID NO: 6689056 - DNA, 13 bp, Homo sapiens
caatgaaattgac

SEQ ID NO: 6689057 - DNA, 19 bp, Homo sapiens
caatgaaccataaattcaa

SEQ ID NO: 6689058 - DNA, 20 bp, Homo sapiens
caatgaacccccatgatgta

SEQ ID NO: 6689059 - DNA, 17 bp, Homo sapiens
caatgaactctttcccc

SEQ ID NO: 6689060 - DNA, 18 bp, Homo sapiens
caatgaagataaatgctt

SEQ ID NO: 6689061 - DNA, 16 bp, Homo sapiens
caatgaagattaacac

SEQ ID NO: 6689062 - DNA, 14 bp, Homo sapiens
caatgaagccagct

SEQ ID NO: 6689063 - DNA, 18 bp, Homo sapiens
caatgaagtgaaaaagtt

SEQ ID NO: 6689064 - DNA, 16 bp, Homo sapiens
caatgaagtgttttac

SEQ ID NO: 6689065 - DNA, 18 bp, Homo sapiens
caatgaagtgttttacaa

SEQ ID NO: 6689066 - DNA, 13 bp, Homo sapiens
caatgaagttgaa

SEQ ID NO: 6689067 - DNA, 18 bp, Homo sapiens
caatgaatatactcatta

SEQ ID NO: 6689068 - DNA, 14 bp, Homo sapiens
caatgaatattgaa

SEQ ID NO: 6689069 - DNA, 18 bp, Homo sapiens
caatgaatccccgacccc

SEQ ID NO: 6689070 - DNA, 21 bp, Homo sapiens
caatgaatccccgacccccct

SEQ ID NO: 6689071 - DNA, 22 bp, Homo sapiens
caatgaatgaatgaatggctaa

SEQ ID NO: 6689072 - DNA, 22 bp, Homo sapiens
caatgaattaagaaagattaaa

SEQ ID NO: 6689073 - DNA, 15 bp, Homo sapiens
caatgaattaattca

SEQ ID NO: 6689074 - DNA, 17 bp, Homo sapiens
caatgaattaattcaga

SEQ ID NO: 6689075 - DNA, 19 bp, Homo sapiens
caatgaattgaatgctcta

SEQ ID NO: 6689076 - DNA, 17 bp, Homo sapiens
caatgacaaaaagaaga

SEQ ID NO: 6689077 - DNA, 18 bp, Homo sapiens
caatgacacccctggcct

SEQ ID NO: 6689078 - DNA, 23 bp, Homo sapiens
caatgacacccctggcctgactc

SEQ ID NO: 6689079 - DNA, 19 bp, Homo sapiens
caatgacatctcaggggcc

SEQ ID NO: 6689080 - DNA, 22 bp, Homo sapiens
caatgacatctcaggggccaga

SEQ ID NO: 6689081 - DNA, 15 bp, Homo sapiens
caatgacatcttcaa

SEQ ID NO: 6689082 - DNA, 19 bp, Homo sapiens
caatgacatcttcaaagct

SEQ ID NO: 6689083 - DNA, 12 bp, Homo sapiens
caatgacatgaa

SEQ ID NO: 6689084 - DNA, 20 bp, Homo sapiens
caatgacatgaattttagct

SEQ ID NO: 6689085 - DNA, 18 bp, Homo sapiens
caatgacattttgttgga

SEQ ID NO: 6689086 - DNA, 17 bp, Homo sapiens
caatgaccagcaggagg

SEQ ID NO: 6689087 - DNA, 18 bp, Homo sapiens
caatgaccagcaggaggg

SEQ ID NO: 6689088 - DNA, 15 bp, Homo sapiens
caatgacctttcaat

SEQ ID NO: 6689089 - DNA, 23 bp, Homo sapiens
caatgacctttcaataggaaaaa

SEQ ID NO: 6689090 - DNA, 16 bp, Homo sapiens
caatgactaagccaag

SEQ ID NO: 6689091 - DNA, 20 bp, Homo sapiens
caatgactaagccaagctgt

SEQ ID NO: 6689092 - DNA, 11 bp, Homo sapiens
caatgactact

SEQ ID NO: 6689093 - DNA, 15 bp, Homo sapiens
caatgactcaaagtc

SEQ ID NO: 6689094 - DNA, 14 bp, Homo sapiens
caatgactctctgg

SEQ ID NO: 6689095 - DNA, 22 bp, Homo sapiens
caatgactgtgagcgagcctgg

SEQ ID NO: 6689096 - DNA, 16 bp, Homo sapiens
caatgagaaaaataaa

SEQ ID NO: 6689097 - DNA, 21 bp, Homo sapiens
caatgagactctagggtccag

SEQ ID NO: 6689098 - DNA, 13 bp, Homo sapiens
caatgagagcata

SEQ ID NO: 6689099 - DNA, 19 bp, Homo sapiens
caatgagatagaagatgtt

SEQ ID NO: 6689100 - DNA, 22 bp, Homo sapiens
caatgagatagaagatgtttgc

SEQ ID NO: 6689101 - DNA, 19 bp, Homo sapiens
caatgagatcattgtgaag

SEQ ID NO: 6689102 - DNA, 13 bp, Homo sapiens
caatgagcatgtt

SEQ ID NO: 6689103 - DNA, 13 bp, Homo sapiens
caatgagccaaga

SEQ ID NO: 6689104 - DNA, 14 bp, Homo sapiens
caatgagctttctg

SEQ ID NO: 6689105 - DNA, 22 bp, Homo sapiens
caatgagctttctgaacagctg

SEQ ID NO: 6689106 - DNA, 23 bp, Homo sapiens
caatgagctttctgaacagctgg

SEQ ID NO: 6689107 - DNA, 19 bp, Homo sapiens
caatgaggcagatagcact

SEQ ID NO: 6689108 - DNA, 19 bp, Homo sapiens
caatgaggtctgaaatgga

SEQ ID NO: 6689109 - DNA, 19 bp, Homo sapiens
caatgaggtggctcatgcc

SEQ ID NO: 6689110 - DNA, 21 bp, Homo sapiens
caatgaggtggctcatgcctg

SEQ ID NO: 6689111 - DNA, 20 bp, Homo sapiens
caatgaggttatgagaaaaa

SEQ ID NO: 6689112 - DNA, 14 bp, Homo sapiens
caatgagtctgtaa

SEQ ID NO: 6689113 - DNA, 15 bp, Homo sapiens
caatgagtctgtaat

SEQ ID NO: 6689114 - DNA, 23 bp, Homo sapiens
caatgagttcttctcaaaaaata

SEQ ID NO: 6689115 - DNA, 16 bp, Homo sapiens
caatgataaataaagt

SEQ ID NO: 6689116 - DNA, 17 bp, Homo sapiens
caatgataaataaagtc

SEQ ID NO: 6689117 - DNA, 19 bp, Homo sapiens
caatgataaatttaaatga

SEQ ID NO: 6689118 - DNA, 20 bp, Homo sapiens
caatgatacccaacagttta

SEQ ID NO: 6689119 - DNA, 18 bp, Homo sapiens
caatgatagtaagaaaag

SEQ ID NO: 6689120 - DNA, 20 bp, Homo sapiens
caatgatagtaagaaaagtg

SEQ ID NO: 6689121 - DNA, 17 bp, Homo sapiens
caatgatataggaaaat

SEQ ID NO: 6689122 - DNA, 14 bp, Homo sapiens
caatgatatccaat

SEQ ID NO: 6689123 - DNA, 15 bp, Homo sapiens
caatgatcaaatttt

SEQ ID NO: 6689124 - DNA, 15 bp, Homo sapiens
caatgatcagacttg

SEQ ID NO: 6689125 - DNA, 14 bp, Homo sapiens
caatgatctaggtt

SEQ ID NO: 6689126 - DNA, 17 bp, Homo sapiens
caatgatctaggtttaa

SEQ ID NO: 6689127 - DNA, 20 bp, Homo sapiens
caatgatctaggtttaactc

SEQ ID NO: 6689128 - DNA, 21 bp, Homo sapiens
caatgatctaggtttaactca

SEQ ID NO: 6689129 - DNA, 14 bp, Homo sapiens
caatgatgaatgag

SEQ ID NO: 6689130 - DNA, 16 bp, Homo sapiens
caatgatgacccacta

SEQ ID NO: 6689131 - DNA, 18 bp, Homo sapiens
caatgatgattaaacacc

SEQ ID NO: 6689132 - DNA, 18 bp, Homo sapiens
caatgatggtaaagccat

SEQ ID NO: 6689133 - DNA, 16 bp, Homo sapiens
caatgattaatcagct

SEQ ID NO: 6689134 - DNA, 18 bp, Homo sapiens
caatgattaatcagctgt

SEQ ID NO: 6689135 - DNA, 22 bp, Homo sapiens
caatgattatttgtatttacag

SEQ ID NO: 6689136 - DNA, 20 bp, Homo sapiens
caatgattattttcattaca

SEQ ID NO: 6689137 - DNA, 19 bp, Homo sapiens
caatgattcataacaatgt

SEQ ID NO: 6689138 - DNA, 16 bp, Homo sapiens
caatgatttggccagg

SEQ ID NO: 6689139 - DNA, 19 bp, Homo sapiens
caatgatttggccaggcct

SEQ ID NO: 6689140 - DNA, 12 bp, Homo sapiens
caatgatttgta

SEQ ID NO: 6689141 - DNA, 13 bp, Homo sapiens
caatgatttgtca

SEQ ID NO: 6689142 - DNA, 14 bp, Homo sapiens
caatgcaaaccatc

SEQ ID NO: 6689143 - DNA, 17 bp, Homo sapiens
caatgcaaaccatcatt

SEQ ID NO: 6689144 - DNA, 19 bp, Homo sapiens
caatgcaaaccatcattga

SEQ ID NO: 6689145 - DNA, 13 bp, Homo sapiens
caatgcaaagtaa

SEQ ID NO: 6689146 - DNA, 19 bp, Homo sapiens
caatgcaaccaactatcca

SEQ ID NO: 6689147 - DNA, 17 bp, Homo sapiens
caatgcaacctctgccc

SEQ ID NO: 6689148 - DNA, 20 bp, Homo sapiens
caatgcaagaatctcagaca

SEQ ID NO: 6689149 - DNA, 22 bp, Homo sapiens
caatgcaagagtgattgcagct

SEQ ID NO: 6689150 - DNA, 20 bp, Homo sapiens
caatgcaatgaaaacaaaat

SEQ ID NO: 6689151 - DNA, 17 bp, Homo sapiens
caatgcaatgcatctga

SEQ ID NO: 6689152 - DNA, 17 bp, Homo sapiens
caatgcaattcaatgca

SEQ ID NO: 6689153 - DNA, 17 bp, Homo sapiens
caatgcacacacacaga

SEQ ID NO: 6689154 - DNA, 14 bp, Homo sapiens
caatgcacatccat

SEQ ID NO: 6689155 - DNA, 18 bp, Homo sapiens
caatgcacatccattccc

SEQ ID NO: 6689156 - DNA, 23 bp, Homo sapiens
caatgcacctaaagaaaaacaaa

SEQ ID NO: 6689157 - DNA, 18 bp, Homo sapiens
caatgcactgatgtgtga

SEQ ID NO: 6689158 - DNA, 19 bp, Homo sapiens
caatgcactgatgtgtgaa

SEQ ID NO: 6689159 - DNA, 13 bp, Homo sapiens
caatgcactttgt

SEQ ID NO: 6689160 - DNA, 22 bp, Homo sapiens
caatgcacttttatgaagtttt

SEQ ID NO: 6689161 - DNA, 14 bp, Homo sapiens
caatgcagatgcca

SEQ ID NO: 6689162 - DNA, 18 bp, Homo sapiens
caatgcagatgccagagc

SEQ ID NO: 6689163 - DNA, 19 bp, Homo sapiens
caatgcagatgccagagca

SEQ ID NO: 6689164 - DNA, 13 bp, Homo sapiens
caatgcagcaagg

SEQ ID NO: 6689165 - DNA, 20 bp, Homo sapiens
caatgcagcaaggccctgct

SEQ ID NO: 6689166 - DNA, 19 bp, Homo sapiens
caatgcagtcagtgtttct

SEQ ID NO: 6689167 - DNA, 16 bp, Homo sapiens
caatgcagttgtctct

SEQ ID NO: 6689168 - DNA, 18 bp, Homo sapiens
caatgcatacaataaaag

SEQ ID NO: 6689169 - DNA, 22 bp, Homo sapiens
caatgcatacaataaaagagct

SEQ ID NO: 6689170 - DNA, 16 bp, Homo sapiens
caatgcatagagccct

SEQ ID NO: 6689171 - DNA, 18 bp, Homo sapiens
caatgcatagagccctgg

SEQ ID NO: 6689172 - DNA, 18 bp, Homo sapiens
caatgcatatctgtttat

SEQ ID NO: 6689173 - DNA, 18 bp, Homo sapiens
caatgcatctgaaagttt

SEQ ID NO: 6689174 - DNA, 23 bp, Homo sapiens
caatgcatctgaaagttttgata

SEQ ID NO: 6689175 - DNA, 13 bp, Homo sapiens
caatgcatgatga

SEQ ID NO: 6689176 - DNA, 18 bp, Homo sapiens
caatgcatgctttggaaa

SEQ ID NO: 6689177 - DNA, 14 bp, Homo sapiens
caatgcattctgga

SEQ ID NO: 6689178 - DNA, 16 bp, Homo sapiens
caatgcattctggaga

SEQ ID NO: 6689179 - DNA, 19 bp, Homo sapiens
caatgcattctggagacag

SEQ ID NO: 6689180 - DNA, 14 bp, Homo sapiens
caatgcattggcct

SEQ ID NO: 6689181 - DNA, 20 bp, Homo sapiens
caatgcattgtcttgtggag

SEQ ID NO: 6689182 - DNA, 16 bp, Homo sapiens
caatgcatttaaaata

SEQ ID NO: 6689183 - DNA, 13 bp, Homo sapiens
caatgcattttgg

SEQ ID NO: 6689184 - DNA, 21 bp, Homo sapiens
caatgcattttggaaagctcc

SEQ ID NO: 6689185 - DNA, 13 bp, Homo sapiens
caatgccacagac

SEQ ID NO: 6689186 - DNA, 13 bp, Homo sapiens
caatgccacagcc

SEQ ID NO: 6689187 - DNA, 14 bp, Homo sapiens
caatgccacagcca

SEQ ID NO: 6689188 - DNA, 17 bp, Homo sapiens
caatgccacagccctgt

SEQ ID NO: 6689189 - DNA, 15 bp, Homo sapiens
caatgccacatactt

SEQ ID NO: 6689190 - DNA, 21 bp, Homo sapiens
caatgccacctagactctccc

SEQ ID NO: 6689191 - DNA, 21 bp, Homo sapiens
caatgccacgatttagattta

SEQ ID NO: 6689192 - DNA, 15 bp, Homo sapiens
caatgccagggccca

SEQ ID NO: 6689193 - DNA, 17 bp, Homo sapiens
caatgccatcagcccct

SEQ ID NO: 6689194 - DNA, 21 bp, Homo sapiens
caatgccatcagcccctggga

SEQ ID NO: 6689195 - DNA, 13 bp, Homo sapiens
caatgccatcatc

SEQ ID NO: 6689196 - DNA, 16 bp, Homo sapiens
caatgccatcctcaaa

SEQ ID NO: 6689197 - DNA, 20 bp, Homo sapiens
caatgccatcctcaaacact

SEQ ID NO: 6689198 - DNA, 14 bp, Homo sapiens
caatgccatgaaca

SEQ ID NO: 6689199 - DNA, 21 bp, Homo sapiens
caatgccatgaacaaattctt

SEQ ID NO: 6689200 - DNA, 19 bp, Homo sapiens
caatgccatgactgctcag

SEQ ID NO: 6689201 - DNA, 14 bp, Homo sapiens
caatgccattgtgc

SEQ ID NO: 6689202 - DNA, 13 bp, Homo sapiens
caatgcccagcag

SEQ ID NO: 6689203 - DNA, 15 bp, Homo sapiens
caatgcccagcaggg

SEQ ID NO: 6689204 - DNA, 14 bp, Homo sapiens
caatgccccaaact

SEQ ID NO: 6689205 - DNA, 22 bp, Homo sapiens
caatgccccctcccctccttta

SEQ ID NO: 6689206 - DNA, 23 bp, Homo sapiens
caatgccctacctgcctgttctc

SEQ ID NO: 6689207 - DNA, 16 bp, Homo sapiens
caatgccctgccatta

SEQ ID NO: 6689208 - DNA, 19 bp, Homo sapiens
caatgccctgcggctctgg

SEQ ID NO: 6689209 - DNA, 21 bp, Homo sapiens
caatgccgccgtgtttcctca

SEQ ID NO: 6689210 - DNA, 20 bp, Homo sapiens
caatgccgcctgtcaataaa

SEQ ID NO: 6689211 - DNA, 16 bp, Homo sapiens
caatgcctacagctgt

SEQ ID NO: 6689212 - DNA, 17 bp, Homo sapiens
caatgcctacagctgtc

SEQ ID NO: 6689213 - DNA, 23 bp, Homo sapiens
caatgcctattgtaatatagaaa

SEQ ID NO: 6689214 - DNA, 12 bp, Homo sapiens
caatgcctcagt

SEQ ID NO: 6689215 - DNA, 15 bp, Homo sapiens
caatgcctcagtagc

SEQ ID NO: 6689216 - DNA, 17 bp, Homo sapiens
caatgcctctcccacga

SEQ ID NO: 6689217 - DNA, 14 bp, Homo sapiens
caatgcctgcctga

SEQ ID NO: 6689218 - DNA, 15 bp, Homo sapiens
caatgcctgtgaagc

SEQ ID NO: 6689219 - DNA, 15 bp, Homo sapiens
caatgcctttttaga

SEQ ID NO: 6689220 - DNA, 19 bp, Homo sapiens
caatgcgaatggtagtcta

SEQ ID NO: 6689221 - DNA, 18 bp, Homo sapiens
caatgcgtcttgtgaaat

SEQ ID NO: 6689222 - DNA, 21 bp, Homo sapiens
caatgcgtcttgtgaaattgt

SEQ ID NO: 6689223 - DNA, 22 bp, Homo sapiens
caatgcgtggcacatctaaatt

SEQ ID NO: 6689224 - DNA, 22 bp, Homo sapiens
caatgctagcacaatattccta

SEQ ID NO: 6689225 - DNA, 18 bp, Homo sapiens
caatgctcaaacacccaa

SEQ ID NO: 6689226 - DNA, 20 bp, Homo sapiens
caatgctcttttcacagcta

SEQ ID NO: 6689227 - DNA, 23 bp, Homo sapiens
caatgctgatgaatcactgtttt

SEQ ID NO: 6689228 - DNA, 11 bp, Homo sapiens
caatgctgcca

SEQ ID NO: 6689229 - DNA, 22 bp, Homo sapiens
caatgctgcctgggagccaggg

SEQ ID NO: 6689230 - DNA, 18 bp, Homo sapiens
caatgctgcgtctcccat

SEQ ID NO: 6689231 - DNA, 20 bp, Homo sapiens
caatgctgctccaccctccc

SEQ ID NO: 6689232 - DNA, 23 bp, Homo sapiens
caatgctgctttggttaatctct

SEQ ID NO: 6689233 - DNA, 12 bp, Homo sapiens
caatgctggctg

SEQ ID NO: 6689234 - DNA, 21 bp, Homo sapiens
caatgctggctgttggctggg

SEQ ID NO: 6689235 - DNA, 23 bp, Homo sapiens
caatgctggctgttggctggggg

SEQ ID NO: 6689236 - DNA, 14 bp, Homo sapiens
caatgctgggccct

SEQ ID NO: 6689237 - DNA, 14 bp, Homo sapiens
caatgctgtacctg

SEQ ID NO: 6689238 - DNA, 22 bp, Homo sapiens
caatgctgtacgtactgcattt

SEQ ID NO: 6689239 - DNA, 15 bp, Homo sapiens
caatgctgtatttta

SEQ ID NO: 6689240 - DNA, 17 bp, Homo sapiens
caatgctgtattttaaa

SEQ ID NO: 6689241 - DNA, 14 bp, Homo sapiens
caatgctgtgaata

SEQ ID NO: 6689242 - DNA, 20 bp, Homo sapiens
caatgctgtgaataaaaaga

SEQ ID NO: 6689243 - DNA, 17 bp, Homo sapiens
caatgctgttgtaaaca

SEQ ID NO: 6689244 - DNA, 18 bp, Homo sapiens
caatgctgttgtaaacaa

SEQ ID NO: 6689245 - DNA, 15 bp, Homo sapiens
caatgcttcattatt

SEQ ID NO: 6689246 - DNA, 21 bp, Homo sapiens
caatgcttctatcagactcag

SEQ ID NO: 6689247 - DNA, 16 bp, Homo sapiens
caatgcttctgcctca

SEQ ID NO: 6689248 - DNA, 20 bp, Homo sapiens
caatgcttctgcctcagctt

SEQ ID NO: 6689249 - DNA, 23 bp, Homo sapiens
caatgcttctgtagcttctaatg

SEQ ID NO: 6689250 - DNA, 11 bp, Homo sapiens
caatgcttctt

SEQ ID NO: 6689251 - DNA, 18 bp, Homo sapiens
caatgcttgcatggagaa

SEQ ID NO: 6689252 - DNA, 20 bp, Homo sapiens
caatgctttatttgtaaatt

SEQ ID NO: 6689253 - DNA, 23 bp, Homo sapiens
caatgctttatttgtaaatttag

SEQ ID NO: 6689254 - DNA, 20 bp, Homo sapiens
caatgctttgataaaatatt

SEQ ID NO: 6689255 - DNA, 13 bp, Homo sapiens
caatgctttggga

SEQ ID NO: 6689256 - DNA, 18 bp, Homo sapiens
caatgctttgggaggcca

SEQ ID NO: 6689257 - DNA, 20 bp, Homo sapiens
caatgctttgggaggccaag

SEQ ID NO: 6689258 - DNA, 22 bp, Homo sapiens
caatgctttgggaggccaaggc

SEQ ID NO: 6689259 - DNA, 23 bp, Homo sapiens
caatgctttgggaggccaaggca

SEQ ID NO: 6689260 - DNA, 16 bp, Homo sapiens
caatgcttttaatgaa

SEQ ID NO: 6689261 - DNA, 22 bp, Homo sapiens
caatgcttttctagcaactgtt

SEQ ID NO: 6689262 - DNA, 13 bp, Homo sapiens
caatggaaacaat

SEQ ID NO: 6689263 - DNA, 15 bp, Homo sapiens
caatggaaacctcac

SEQ ID NO: 6689264 - DNA, 16 bp, Homo sapiens
caatggaaacctcacg

SEQ ID NO: 6689265 - DNA, 16 bp, Homo sapiens
caatggaaactgaatg

SEQ ID NO: 6689266 - DNA, 16 bp, Homo sapiens
caatggaaagcttttc

SEQ ID NO: 6689267 - DNA, 13 bp, Homo sapiens
caatggaagattt

SEQ ID NO: 6689268 - DNA, 13 bp, Homo sapiens
caatggaataaat

SEQ ID NO: 6689269 - DNA, 14 bp, Homo sapiens
caatggaccggaga

SEQ ID NO: 6689270 - DNA, 20 bp, Homo sapiens
caatggacctctcagcagaa

SEQ ID NO: 6689271 - DNA, 23 bp, Homo sapiens
caatggacctctcagcagaaaca

SEQ ID NO: 6689272 - DNA, 17 bp, Homo sapiens
caatggacttcaaattg

SEQ ID NO: 6689273 - DNA, 14 bp, Homo sapiens
caatggagaaaatg

SEQ ID NO: 6689274 - DNA, 17 bp, Homo sapiens
caatggagaaaatgaat

SEQ ID NO: 6689275 - DNA, 13 bp, Homo sapiens
caatggagaaatg

SEQ ID NO: 6689276 - DNA, 16 bp, Homo sapiens
caatggagaaatgaag

SEQ ID NO: 6689277 - DNA, 15 bp, Homo sapiens
caatggagtattctc

SEQ ID NO: 6689278 - DNA, 19 bp, Homo sapiens
caatggatcagccaaggcc

SEQ ID NO: 6689279 - DNA, 18 bp, Homo sapiens
caatggattatacaaaaa

SEQ ID NO: 6689280 - DNA, 18 bp, Homo sapiens
caatggcaataggacaaa

SEQ ID NO: 6689281 - DNA, 14 bp, Homo sapiens
caatggcacctctg

SEQ ID NO: 6689282 - DNA, 22 bp, Homo sapiens
caatggcacctctgcccttccc

SEQ ID NO: 6689283 - DNA, 19 bp, Homo sapiens
caatggcacgatctcagct

SEQ ID NO: 6689284 - DNA, 20 bp, Homo sapiens
caatggcagcattcccacca

SEQ ID NO: 6689285 - DNA, 17 bp, Homo sapiens
caatggcagctagactg

SEQ ID NO: 6689286 - DNA, 20 bp, Homo sapiens
caatggcagctagactggag

SEQ ID NO: 6689287 - DNA, 23 bp, Homo sapiens
caatggcagctagactggagtga

SEQ ID NO: 6689288 - DNA, 17 bp, Homo sapiens
caatggccagagcctct

SEQ ID NO: 6689289 - DNA, 14 bp, Homo sapiens
caatggccagccca

SEQ ID NO: 6689290 - DNA, 21 bp, Homo sapiens
caatggcctaaaactggcctg

SEQ ID NO: 6689291 - DNA, 19 bp, Homo sapiens
caatggcgcagtgcctctg

SEQ ID NO: 6689292 - DNA, 19 bp, Homo sapiens
caatggcgcgatctcagct

SEQ ID NO: 6689293 - DNA, 16 bp, Homo sapiens
caatggctaattccca

SEQ ID NO: 6689294 - DNA, 22 bp, Homo sapiens
caatggctatatggcaagaaag

SEQ ID NO: 6689295 - DNA, 21 bp, Homo sapiens
caatggctgagcctcgtgtcc

SEQ ID NO: 6689296 - DNA, 15 bp, Homo sapiens
caatggctgtaaact

SEQ ID NO: 6689297 - DNA, 15 bp, Homo sapiens
caatggctttttaaa

SEQ ID NO: 6689298 - DNA, 16 bp, Homo sapiens
caatgggaagactcag

SEQ ID NO: 6689299 - DNA, 10 bp, Homo sapiens
caatgggact

SEQ ID NO: 6689300 - DNA, 17 bp, Homo sapiens
caatgggactggagtca

SEQ ID NO: 6689301 - DNA, 23 bp, Homo sapiens
caatgggactggagtcagatgag

SEQ ID NO: 6689302 - DNA, 19 bp, Homo sapiens
caatgggagcacatagccc

SEQ ID NO: 6689303 - DNA, 21 bp, Homo sapiens
caatgggagcctcataaagat

SEQ ID NO: 6689304 - DNA, 21 bp, Homo sapiens
caatgggagggggctccatgg

SEQ ID NO: 6689305 - DNA, 23 bp, Homo sapiens
caatgggatgtatgaatacagca

SEQ ID NO: 6689306 - DNA, 16 bp, Homo sapiens
caatgggattttctag

SEQ ID NO: 6689307 - DNA, 15 bp, Homo sapiens
caatgggcaatgaca

SEQ ID NO: 6689308 - DNA, 19 bp, Homo sapiens
caatgggcactgggatgag

SEQ ID NO: 6689309 - DNA, 23 bp, Homo sapiens
caatgggctttcccccaactcag

SEQ ID NO: 6689310 - DNA, 20 bp, Homo sapiens
caatggggaattttttgatc

SEQ ID NO: 6689311 - DNA, 14 bp, Homo sapiens
caatggggagaggc

SEQ ID NO: 6689312 - DNA, 15 bp, Homo sapiens
caatggggagaggca

SEQ ID NO: 6689313 - DNA, 17 bp, Homo sapiens
caatggggagaggcaaa

SEQ ID NO: 6689314 - DNA, 13 bp, Homo sapiens
caatggggcgggg

SEQ ID NO: 6689315 - DNA, 16 bp, Homo sapiens
caatggggtgggccca

SEQ ID NO: 6689316 - DNA, 18 bp, Homo sapiens
caatgggtaaataaatgc

SEQ ID NO: 6689317 - DNA, 17 bp, Homo sapiens
caatgggtaagggaggg

SEQ ID NO: 6689318 - DNA, 22 bp, Homo sapiens
caatgggtaagggagggaaggg

SEQ ID NO: 6689319 - DNA, 14 bp, Homo sapiens
caatgggtggtgaa

SEQ ID NO: 6689320 - DNA, 22 bp, Homo sapiens
caatggtagattcgctgtcccc

SEQ ID NO: 6689321 - DNA, 20 bp, Homo sapiens
caatggtagtttctgtggtt

SEQ ID NO: 6689322 - DNA, 23 bp, Homo sapiens
caatggtgaactgtcattacaga

SEQ ID NO: 6689323 - DNA, 14 bp, Homo sapiens
caatggtgactgat

SEQ ID NO: 6689324 - DNA, 16 bp, Homo sapiens
caatggtgagggctga

SEQ ID NO: 6689325 - DNA, 21 bp, Homo sapiens
caatggtgatcctctattttg

SEQ ID NO: 6689326 - DNA, 13 bp, Homo sapiens
caatggtgcaaaa

SEQ ID NO: 6689327 - DNA, 21 bp, Homo sapiens
caatggtgcttcccccacccc

SEQ ID NO: 6689328 - DNA, 14 bp, Homo sapiens
caatggtgcttgga

SEQ ID NO: 6689329 - DNA, 17 bp, Homo sapiens
caatggtgcttggaggg

SEQ ID NO: 6689330 - DNA, 21 bp, Homo sapiens
caatggtgcttggagggggaa

SEQ ID NO: 6689331 - DNA, 22 bp, Homo sapiens
caatggtgcttggagggggaag

SEQ ID NO: 6689332 - DNA, 18 bp, Homo sapiens
caatggtgtagctgtcct

SEQ ID NO: 6689333 - DNA, 15 bp, Homo sapiens
caatggtgtttttct

SEQ ID NO: 6689334 - DNA, 15 bp, Homo sapiens
caatggttcaagtct

SEQ ID NO: 6689335 - DNA, 16 bp, Homo sapiens
caatggttcaagtctt

SEQ ID NO: 6689336 - DNA, 17 bp, Homo sapiens
caatggtttgcaaggaa

SEQ ID NO: 6689337 - DNA, 19 bp, Homo sapiens
caatggtttgcaaggaagc

SEQ ID NO: 6689338 - DNA, 23 bp, Homo sapiens
caatgtaacattaattctactaa

SEQ ID NO: 6689339 - DNA, 12 bp, Homo sapiens
caatgtaattat

SEQ ID NO: 6689340 - DNA, 23 bp, Homo sapiens
caatgtaattatttatgtatggt

SEQ ID NO: 6689341 - DNA, 14 bp, Homo sapiens
caatgtacaattat

SEQ ID NO: 6689342 - DNA, 17 bp, Homo sapiens
caatgtacaattatgtc

SEQ ID NO: 6689343 - DNA, 22 bp, Homo sapiens
caatgtactaggatactgctgc

SEQ ID NO: 6689344 - DNA, 15 bp, Homo sapiens
caatgtactgtattg

SEQ ID NO: 6689345 - DNA, 22 bp, Homo sapiens
caatgtagaggcataaacctgt

SEQ ID NO: 6689346 - DNA, 16 bp, Homo sapiens
caatgtagataagtgt

SEQ ID NO: 6689347 - DNA, 11 bp, Homo sapiens
caatgtataaa

SEQ ID NO: 6689348 - DNA, 19 bp, Homo sapiens
caatgtataaagattgtac

SEQ ID NO: 6689349 - DNA, 20 bp, Homo sapiens
caatgtataaagattgtact

SEQ ID NO: 6689350 - DNA, 21 bp, Homo sapiens
caatgtataaagattgtactt

SEQ ID NO: 6689351 - DNA, 13 bp, Homo sapiens
caatgtatacaat

SEQ ID NO: 6689352 - DNA, 20 bp, Homo sapiens
caatgtatacttcagtgctc

SEQ ID NO: 6689353 - DNA, 17 bp, Homo sapiens
caatgtatcccttctca

SEQ ID NO: 6689354 - DNA, 14 bp, Homo sapiens
caatgtatctttat

SEQ ID NO: 6689355 - DNA, 15 bp, Homo sapiens
caatgtatgtaattt

SEQ ID NO: 6689356 - DNA, 17 bp, Homo sapiens
caatgtatgtacaatac

SEQ ID NO: 6689357 - DNA, 23 bp, Homo sapiens
caatgtatgtgaaagtgtaaaat

SEQ ID NO: 6689358 - DNA, 20 bp, Homo sapiens
caatgtattgataagagggc

SEQ ID NO: 6689359 - DNA, 18 bp, Homo sapiens
caatgtatttagctacag

SEQ ID NO: 6689360 - DNA, 22 bp, Homo sapiens
caatgtatttatttaaaagatt

SEQ ID NO: 6689361 - DNA, 23 bp, Homo sapiens
caatgtatttatttaaaagattc

SEQ ID NO: 6689362 - DNA, 12 bp, Homo sapiens
caatgtatttta

SEQ ID NO: 6689363 - DNA, 15 bp, Homo sapiens
caatgtcaaggtgct

SEQ ID NO: 6689364 - DNA, 18 bp, Homo sapiens
caatgtcaatgaacaagc

SEQ ID NO: 6689365 - DNA, 22 bp, Homo sapiens
caatgtcacaacctctctgatc

SEQ ID NO: 6689366 - DNA, 14 bp, Homo sapiens
caatgtcacttaaa

SEQ ID NO: 6689367 - DNA, 14 bp, Homo sapiens
caatgtcagaaact

SEQ ID NO: 6689368 - DNA, 14 bp, Homo sapiens
caatgtcagtattt

SEQ ID NO: 6689369 - DNA, 17 bp, Homo sapiens
caatgtccccctcaccc

SEQ ID NO: 6689370 - DNA, 15 bp, Homo sapiens
caatgtcctctttga

SEQ ID NO: 6689371 - DNA, 23 bp, Homo sapiens
caatgtcctgaaacatgaaccca

SEQ ID NO: 6689372 - DNA, 15 bp, Homo sapiens
caatgtctaaaaaca

SEQ ID NO: 6689373 - DNA, 15 bp, Homo sapiens
caatgtctgagtgaa

SEQ ID NO: 6689374 - DNA, 16 bp, Homo sapiens
caatgtctgcagccct

SEQ ID NO: 6689375 - DNA, 14 bp, Homo sapiens
caatgtctggagac

SEQ ID NO: 6689376 - DNA, 14 bp, Homo sapiens
caatgtctggggac

SEQ ID NO: 6689377 - DNA, 21 bp, Homo sapiens
caatgtctgtccctaaacata

SEQ ID NO: 6689378 - DNA, 12 bp, Homo sapiens
caatgtctgtgc

SEQ ID NO: 6689379 - DNA, 19 bp, Homo sapiens
caatgtcttaaataaaact

SEQ ID NO: 6689380 - DNA, 20 bp, Homo sapiens
caatgtcttaaataaaacta

SEQ ID NO: 6689381 - DNA, 14 bp, Homo sapiens
caatgtgaaaaatc

SEQ ID NO: 6689382 - DNA, 19 bp, Homo sapiens
caatgtgaaaagaaaaatg

SEQ ID NO: 6689383 - DNA, 18 bp, Homo sapiens
caatgtgaaacacatgcc

SEQ ID NO: 6689384 - DNA, 20 bp, Homo sapiens
caatgtgaaacacatgccag

SEQ ID NO: 6689385 - DNA, 21 bp, Homo sapiens
caatgtgaaacacatgccagt

SEQ ID NO: 6689386 - DNA, 16 bp, Homo sapiens
caatgtgaaactgaga

SEQ ID NO: 6689387 - DNA, 21 bp, Homo sapiens
caatgtgaactttattaaata

SEQ ID NO: 6689388 - DNA, 21 bp, Homo sapiens
caatgtgaagacactacagag

SEQ ID NO: 6689389 - DNA, 22 bp, Homo sapiens
caatgtgaagttcatcttgcag

SEQ ID NO: 6689390 - DNA, 11 bp, Homo sapiens
caatgtgaata

SEQ ID NO: 6689391 - DNA, 21 bp, Homo sapiens
caatgtgaatagtcatctcct

SEQ ID NO: 6689392 - DNA, 23 bp, Homo sapiens
caatgtgacacctaactcttttc

SEQ ID NO: 6689393 - DNA, 21 bp, Homo sapiens
caatgtgactaccgtgccagc

SEQ ID NO: 6689394 - DNA, 22 bp, Homo sapiens
caatgtgactaccgtgccagca

SEQ ID NO: 6689395 - DNA, 22 bp, Homo sapiens
caatgtgacttaatgccactaa

SEQ ID NO: 6689396 - DNA, 20 bp, Homo sapiens
caatgtgaggggtccctagc

SEQ ID NO: 6689397 - DNA, 20 bp, Homo sapiens
caatgtgatggtatttgaga

SEQ ID NO: 6689398 - DNA, 22 bp, Homo sapiens
caatgtgattcttctaaagcac

SEQ ID NO: 6689399 - DNA, 13 bp, Homo sapiens
caatgtgattttg

SEQ ID NO: 6689400 - DNA, 13 bp, Homo sapiens
caatgtgcagtgt

SEQ ID NO: 6689401 - DNA, 13 bp, Homo sapiens
caatgtgcataat

SEQ ID NO: 6689402 - DNA, 22 bp, Homo sapiens
caatgtgcataatgataaaata

SEQ ID NO: 6689403 - DNA, 23 bp, Homo sapiens
caatgtgccttgattgattagat

SEQ ID NO: 6689404 - DNA, 16 bp, Homo sapiens
caatgtgctgttgatt

SEQ ID NO: 6689405 - DNA, 22 bp, Homo sapiens
caatgtgctgttgattctttca

SEQ ID NO: 6689406 - DNA, 20 bp, Homo sapiens
caatgtggaaaaaatatttt

SEQ ID NO: 6689407 - DNA, 14 bp, Homo sapiens
caatgtggaaattg

SEQ ID NO: 6689408 - DNA, 18 bp, Homo sapiens
caatgtggacgtgcactg

SEQ ID NO: 6689409 - DNA, 19 bp, Homo sapiens
caatgtggacgtgcactga

SEQ ID NO: 6689410 - DNA, 22 bp, Homo sapiens
caatgtggacgtgcactgacag

SEQ ID NO: 6689411 - DNA, 17 bp, Homo sapiens
caatgtggagcagcagc

SEQ ID NO: 6689412 - DNA, 18 bp, Homo sapiens
caatgtggagcagcagcc

SEQ ID NO: 6689413 - DNA, 21 bp, Homo sapiens
caatgtggttggtcaaatcaa

SEQ ID NO: 6689414 - DNA, 21 bp, Homo sapiens
caatgtgtctatttctgaaag

SEQ ID NO: 6689415 - DNA, 15 bp, Homo sapiens
caatgtgtctttcta

SEQ ID NO: 6689416 - DNA, 22 bp, Homo sapiens
caatgtgtgccgagcccttgcc

SEQ ID NO: 6689417 - DNA, 20 bp, Homo sapiens
caatgtgtggctgaagactt

SEQ ID NO: 6689418 - DNA, 14 bp, Homo sapiens
caatgtgtgttgct

SEQ ID NO: 6689419 - DNA, 11 bp, Homo sapiens
caatgtgttca

SEQ ID NO: 6689420 - DNA, 20 bp, Homo sapiens
caatgtgttgatacattccc

SEQ ID NO: 6689421 - DNA, 17 bp, Homo sapiens
caatgtgttttctgtag

SEQ ID NO: 6689422 - DNA, 23 bp, Homo sapiens
caatgtgttttttcggacatgct

SEQ ID NO: 6689423 - DNA, 20 bp, Homo sapiens
caatgttaaattaattataa

SEQ ID NO: 6689424 - DNA, 20 bp, Homo sapiens
caatgttaaggaaactctta

SEQ ID NO: 6689425 - DNA, 19 bp, Homo sapiens
caatgttactatctgcttt

SEQ ID NO: 6689426 - DNA, 13 bp, Homo sapiens
caatgttatcaac

SEQ ID NO: 6689427 - DNA, 16 bp, Homo sapiens
caatgttatgccagct

SEQ ID NO: 6689428 - DNA, 17 bp, Homo sapiens
caatgttatgccagctc

SEQ ID NO: 6689429 - DNA, 20 bp, Homo sapiens
caatgttcaggagagtaaaa

SEQ ID NO: 6689430 - DNA, 13 bp, Homo sapiens
caatgttcatcat

SEQ ID NO: 6689431 - DNA, 14 bp, Homo sapiens
caatgttcatccca

SEQ ID NO: 6689432 - DNA, 15 bp, Homo sapiens
caatgttcatcccat

SEQ ID NO: 6689433 - DNA, 12 bp, Homo sapiens
caatgttcattg

SEQ ID NO: 6689434 - DNA, 13 bp, Homo sapiens
caatgttcattgt

SEQ ID NO: 6689435 - DNA, 14 bp, Homo sapiens
caatgttcattgta

SEQ ID NO: 6689436 - DNA, 15 bp, Homo sapiens
caatgttcattgtaa

SEQ ID NO: 6689437 - DNA, 21 bp, Homo sapiens
caatgttccgttcatctgagg

SEQ ID NO: 6689438 - DNA, 22 bp, Homo sapiens
caatgttccgttcatctgagga

SEQ ID NO: 6689439 - DNA, 21 bp, Homo sapiens
caatgttcctgctaataattt

SEQ ID NO: 6689440 - DNA, 20 bp, Homo sapiens
caatgttctgttgtaaagag

SEQ ID NO: 6689441 - DNA, 22 bp, Homo sapiens
caatgttctgttgtaaagagtg

SEQ ID NO: 6689442 - DNA, 23 bp, Homo sapiens
caatgttctgttgtaaagagtgg

SEQ ID NO: 6689443 - DNA, 15 bp, Homo sapiens
caatgttctttatat

SEQ ID NO: 6689444 - DNA, 14 bp, Homo sapiens
caatgttgagaagt

SEQ ID NO: 6689445 - DNA, 23 bp, Homo sapiens
caatgttgctagttttttgcttc

SEQ ID NO: 6689446 - DNA, 14 bp, Homo sapiens
caatgttgtagtgt

SEQ ID NO: 6689447 - DNA, 19 bp, Homo sapiens
caatgttgtatttgttatt

SEQ ID NO: 6689448 - DNA, 22 bp, Homo sapiens
caatgttgtatttgttatttat

SEQ ID NO: 6689449 - DNA, 16 bp, Homo sapiens
caatgttgtccaacaa

SEQ ID NO: 6689450 - DNA, 20 bp, Homo sapiens
caatgttgtccaacaataaa

SEQ ID NO: 6689451 - DNA, 13 bp, Homo sapiens
caatgttgtgtgt

SEQ ID NO: 6689452 - DNA, 18 bp, Homo sapiens
caatgtttaaaaaagttt

SEQ ID NO: 6689453 - DNA, 21 bp, Homo sapiens
caatgtttatttcataaagaa

SEQ ID NO: 6689454 - DNA, 19 bp, Homo sapiens
caatgtttctggacattct

SEQ ID NO: 6689455 - DNA, 20 bp, Homo sapiens
caatgtttctggacattctc

SEQ ID NO: 6689456 - DNA, 22 bp, Homo sapiens
caatgtttctggacattctctt

SEQ ID NO: 6689457 - DNA, 23 bp, Homo sapiens
caatgtttctggacattctcttt

SEQ ID NO: 6689458 - DNA, 17 bp, Homo sapiens
caatgtttcttctaggt

SEQ ID NO: 6689459 - DNA, 18 bp, Homo sapiens
caatgtttcttttatcac

SEQ ID NO: 6689460 - DNA, 22 bp, Homo sapiens
caatgtttgatgtccccaaagt

SEQ ID NO: 6689461 - DNA, 23 bp, Homo sapiens
caatgtttgatgtccccaaagta

SEQ ID NO: 6689462 - DNA, 18 bp, Homo sapiens
caatgtttgggggaaaaa

SEQ ID NO: 6689463 - DNA, 22 bp, Homo sapiens
caatgttttcctttgtcatcat

SEQ ID NO: 6689464 - DNA, 14 bp, Homo sapiens
caatgttttcttca

SEQ ID NO: 6689465 - DNA, 17 bp, Homo sapiens
caatgtttttaaaaatc

SEQ ID NO: 6689466 - DNA, 16 bp, Homo sapiens
caatgtttttctcaaa

SEQ ID NO: 6689467 - DNA, 16 bp, Homo sapiens
caatgttttttatact

SEQ ID NO: 6689468 - DNA, 14 bp, Homo sapiens
caattaaaaacctt

SEQ ID NO: 6689469 - DNA, 16 bp, Homo sapiens
caattaaaaacgaaaa

SEQ ID NO: 6689470 - DNA, 13 bp, Homo sapiens
caattaaaaataa

SEQ ID NO: 6689471 - DNA, 22 bp, Homo sapiens
caattaaaaattgtcttcatgt

SEQ ID NO: 6689472 - DNA, 13 bp, Homo sapiens
caattaaaaccat

SEQ ID NO: 6689473 - DNA, 14 bp, Homo sapiens
caattaaaatatat

SEQ ID NO: 6689474 - DNA, 16 bp, Homo sapiens
caattaaaatatatat

SEQ ID NO: 6689475 - DNA, 11 bp, Homo sapiens
caattaaaatt

SEQ ID NO: 6689476 - DNA, 19 bp, Homo sapiens
caattaaaattacaaaaga

SEQ ID NO: 6689477 - DNA, 16 bp, Homo sapiens
caattaaacagccaaa

SEQ ID NO: 6689478 - DNA, 13 bp, Homo sapiens
caattaaacggat

SEQ ID NO: 6689479 - DNA, 13 bp, Homo sapiens
caattaaactgtg

SEQ ID NO: 6689480 - DNA, 17 bp, Homo sapiens
caattaaagaaataatt

SEQ ID NO: 6689481 - DNA, 18 bp, Homo sapiens
caattaaagaaataattt

SEQ ID NO: 6689482 - DNA, 13 bp, Homo sapiens
caattaaaggtcc

SEQ ID NO: 6689483 - DNA, 20 bp, Homo sapiens
caattaaaggtcctgccctc

SEQ ID NO: 6689484 - DNA, 19 bp, Homo sapiens
caattaactccgtttccaa

SEQ ID NO: 6689485 - DNA, 13 bp, Homo sapiens
caattaaggattt

SEQ ID NO: 6689486 - DNA, 20 bp, Homo sapiens
caattaaggattttatgctt

SEQ ID NO: 6689487 - DNA, 17 bp, Homo sapiens
caattaagtgttgaaaa

SEQ ID NO: 6689488 - DNA, 20 bp, Homo sapiens
caattaagtgttgaaaaata

SEQ ID NO: 6689489 - DNA, 18 bp, Homo sapiens
caattaataaaaaatgga

SEQ ID NO: 6689490 - DNA, 18 bp, Homo sapiens
caattaatagtttgtcta

SEQ ID NO: 6689491 - DNA, 11 bp, Homo sapiens
caattaatgct

SEQ ID NO: 6689492 - DNA, 13 bp, Homo sapiens
caattaatgcttt

SEQ ID NO: 6689493 - DNA, 13 bp, Homo sapiens
caattaatggaaa

SEQ ID NO: 6689494 - DNA, 17 bp, Homo sapiens
caattaatggaaaactg

SEQ ID NO: 6689495 - DNA, 18 bp, Homo sapiens
caattaatggaaaactgt

SEQ ID NO: 6689496 - DNA, 15 bp, Homo sapiens
caattaattccttca

SEQ ID NO: 6689497 - DNA, 18 bp, Homo sapiens
caattaattccttcagca

SEQ ID NO: 6689498 - DNA, 13 bp, Homo sapiens
caattaattctta

SEQ ID NO: 6689499 - DNA, 22 bp, Homo sapiens
caattaattgctattgtgttat

SEQ ID NO: 6689500 - DNA, 14 bp, Homo sapiens
caattaattttaga

SEQ ID NO: 6689501 - DNA, 20 bp, Homo sapiens
caattaatttttttattgtt

SEQ ID NO: 6689502 - DNA, 23 bp, Homo sapiens
caattaatttttttattgtttaa

SEQ ID NO: 6689503 - DNA, 18 bp, Homo sapiens
caattacaggaagtactg

SEQ ID NO: 6689504 - DNA, 18 bp, Homo sapiens
caattacagggtgactca

SEQ ID NO: 6689505 - DNA, 19 bp, Homo sapiens
caattacagggtgactcac

SEQ ID NO: 6689506 - DNA, 17 bp, Homo sapiens
caattacccataaacag

SEQ ID NO: 6689507 - DNA, 18 bp, Homo sapiens
caattacccataaacagc

SEQ ID NO: 6689508 - DNA, 15 bp, Homo sapiens
caattacctgccaaa

SEQ ID NO: 6689509 - DNA, 21 bp, Homo sapiens
caattactacaaatggatgac

SEQ ID NO: 6689510 - DNA, 21 bp, Homo sapiens
caattactgcactcttaaaca

SEQ ID NO: 6689511 - DNA, 17 bp, Homo sapiens
caattactgtgagaact

SEQ ID NO: 6689512 - DNA, 21 bp, Homo sapiens
caattactgtgagaactgtga

SEQ ID NO: 6689513 - DNA, 23 bp, Homo sapiens
caattactgtgagaactgtgaat

SEQ ID NO: 6689514 - DNA, 21 bp, Homo sapiens
caattacttattttaggaaat

SEQ ID NO: 6689515 - DNA, 15 bp, Homo sapiens
caattactttagaaa

SEQ ID NO: 6689516 - DNA, 17 bp, Homo sapiens
caattactttagaaaat

SEQ ID NO: 6689517 - DNA, 16 bp, Homo sapiens
caattagaaaaggaaa

SEQ ID NO: 6689518 - DNA, 17 bp, Homo sapiens
caattagaaaaggaaat

SEQ ID NO: 6689519 - DNA, 16 bp, Homo sapiens
caattaggaagtgtaa

SEQ ID NO: 6689520 - DNA, 20 bp, Homo sapiens
caattaggaagtgtaacagc

SEQ ID NO: 6689521 - DNA, 16 bp, Homo sapiens
caattaggtagcacag

SEQ ID NO: 6689522 - DNA, 15 bp, Homo sapiens
caattaggtctgcat

SEQ ID NO: 6689523 - DNA, 17 bp, Homo sapiens
caattaggtttttcctt

SEQ ID NO: 6689524 - DNA, 17 bp, Homo sapiens
caattagtaacattcat

SEQ ID NO: 6689525 - DNA, 23 bp, Homo sapiens
caattagtgtgacagtttccaaa

SEQ ID NO: 6689526 - DNA, 14 bp, Homo sapiens
caattagtttcctt

SEQ ID NO: 6689527 - DNA, 17 bp, Homo sapiens
caattagtttccttttt

SEQ ID NO: 6689528 - DNA, 18 bp, Homo sapiens
caattagtttccttttta

SEQ ID NO: 6689529 - DNA, 20 bp, Homo sapiens
caattataacttattagcag

SEQ ID NO: 6689530 - DNA, 18 bp, Homo sapiens
caattatagtttctgagg

SEQ ID NO: 6689531 - DNA, 16 bp, Homo sapiens
caattatagtttgaca

SEQ ID NO: 6689532 - DNA, 19 bp, Homo sapiens
caattatatctattatgta

SEQ ID NO: 6689533 - DNA, 18 bp, Homo sapiens
caattatcaaaaaacaga

SEQ ID NO: 6689534 - DNA, 23 bp, Homo sapiens
caattatcaaaaaacagaaaaac

SEQ ID NO: 6689535 - DNA, 14 bp, Homo sapiens
caattatgaaaata

SEQ ID NO: 6689536 - DNA, 17 bp, Homo sapiens
caattatgcactggcca

SEQ ID NO: 6689537 - DNA, 16 bp, Homo sapiens
caattatggaaaaaaa

SEQ ID NO: 6689538 - DNA, 18 bp, Homo sapiens
caattatggaaaaaaaat

SEQ ID NO: 6689539 - DNA, 14 bp, Homo sapiens
caattatgtgacaa

SEQ ID NO: 6689540 - DNA, 14 bp, Homo sapiens
caattatgtttctt

SEQ ID NO: 6689541 - DNA, 22 bp, Homo sapiens
caattattaaattgtgtacact

SEQ ID NO: 6689542 - DNA, 21 bp, Homo sapiens
caattattctaattttatata

SEQ ID NO: 6689543 - DNA, 17 bp, Homo sapiens
caattattgatatatat

SEQ ID NO: 6689544 - DNA, 20 bp, Homo sapiens
caattattgatatatattat

SEQ ID NO: 6689545 - DNA, 12 bp, Homo sapiens
caattatttatt

SEQ ID NO: 6689546 - DNA, 11 bp, Homo sapiens
caattatttca

SEQ ID NO: 6689547 - DNA, 12 bp, Homo sapiens
caattatttcaa

SEQ ID NO: 6689548 - DNA, 13 bp, Homo sapiens
caattatttcaat

SEQ ID NO: 6689549 - DNA, 20 bp, Homo sapiens
caattatttgcatattttga

SEQ ID NO: 6689550 - DNA, 22 bp, Homo sapiens
caattcaaaaataaattagaaa

SEQ ID NO: 6689551 - DNA, 15 bp, Homo sapiens
caattcaaaagttcc

SEQ ID NO: 6689552 - DNA, 19 bp, Homo sapiens
caattcaaacaattcaatc

SEQ ID NO: 6689553 - DNA, 15 bp, Homo sapiens
caattcaacaatgtg

SEQ ID NO: 6689554 - DNA, 19 bp, Homo sapiens
caattcaagctgagaaaag

SEQ ID NO: 6689555 - DNA, 22 bp, Homo sapiens
caattcaatacaaacaatctct

SEQ ID NO: 6689556 - DNA, 14 bp, Homo sapiens
caattcaatcaaag

SEQ ID NO: 6689557 - DNA, 17 bp, Homo sapiens
caattcaatcaaagcta

SEQ ID NO: 6689558 - DNA, 14 bp, Homo sapiens
caattcacagcaca

SEQ ID NO: 6689559 - DNA, 17 bp, Homo sapiens
caattcacccactccct

SEQ ID NO: 6689560 - DNA, 21 bp, Homo sapiens
caattcacttcattgaccaag

SEQ ID NO: 6689561 - DNA, 15 bp, Homo sapiens
caattcagacaggca

SEQ ID NO: 6689562 - DNA, 14 bp, Homo sapiens
caattcagagaata

SEQ ID NO: 6689563 - DNA, 14 bp, Homo sapiens
caattcaggactgg

SEQ ID NO: 6689564 - DNA, 16 bp, Homo sapiens
caattcaggactggct

SEQ ID NO: 6689565 - DNA, 21 bp, Homo sapiens
caattcagtggtcttattttt

SEQ ID NO: 6689566 - DNA, 13 bp, Homo sapiens
caattcagtgttc

SEQ ID NO: 6689567 - DNA, 16 bp, Homo sapiens
caattcataaaaacaa

SEQ ID NO: 6689568 - DNA, 16 bp, Homo sapiens
caattcatagaataac

SEQ ID NO: 6689569 - DNA, 18 bp, Homo sapiens
caattcatagaataacaa

SEQ ID NO: 6689570 - DNA, 23 bp, Homo sapiens
caattcatagaataacaactgct

SEQ ID NO: 6689571 - DNA, 20 bp, Homo sapiens
caattcatatttatgaatct

SEQ ID NO: 6689572 - DNA, 15 bp, Homo sapiens
caattcatgaacttc

SEQ ID NO: 6689573 - DNA, 21 bp, Homo sapiens
caattcatgaacttcgcatca

SEQ ID NO: 6689574 - DNA, 22 bp, Homo sapiens
caattcatggttcaagtattaa

SEQ ID NO: 6689575 - DNA, 14 bp, Homo sapiens
caattcatgtaaca

SEQ ID NO: 6689576 - DNA, 20 bp, Homo sapiens
caattcatgtaacagttgtg

SEQ ID NO: 6689577 - DNA, 17 bp, Homo sapiens
caattcattaataaaat

SEQ ID NO: 6689578 - DNA, 17 bp, Homo sapiens
caattcattatgtcaat

SEQ ID NO: 6689579 - DNA, 22 bp, Homo sapiens
caattcatttcactttaaagtc

SEQ ID NO: 6689580 - DNA, 15 bp, Homo sapiens
caattccaacagttt

SEQ ID NO: 6689581 - DNA, 18 bp, Homo sapiens
caattccaacagtttaat

SEQ ID NO: 6689582 - DNA, 21 bp, Homo sapiens
caattccaacagtttaatgaa

SEQ ID NO: 6689583 - DNA, 18 bp, Homo sapiens
caattccaagaaaatatc

SEQ ID NO: 6689584 - DNA, 21 bp, Homo sapiens
caattccaagaaaatatcact

SEQ ID NO: 6689585 - DNA, 10 bp, Homo sapiens
caattccaat

SEQ ID NO: 6689586 - DNA, 16 bp, Homo sapiens
caattccaatatttct

SEQ ID NO: 6689587 - DNA, 21 bp, Homo sapiens
caattccaatatttctgcttt

SEQ ID NO: 6689588 - DNA, 18 bp, Homo sapiens
caattccacagtctctgg

SEQ ID NO: 6689589 - DNA, 18 bp, Homo sapiens
caattccaccaagacagt

SEQ ID NO: 6689590 - DNA, 16 bp, Homo sapiens
caattccacccctcct

SEQ ID NO: 6689591 - DNA, 16 bp, Homo sapiens
caattccactctgata

SEQ ID NO: 6689592 - DNA, 20 bp, Homo sapiens
caattccagactttctatta

SEQ ID NO: 6689593 - DNA, 15 bp, Homo sapiens
caattccagagctgt

SEQ ID NO: 6689594 - DNA, 13 bp, Homo sapiens
caattccaggctg

SEQ ID NO: 6689595 - DNA, 15 bp, Homo sapiens
caattccaggctgag

SEQ ID NO: 6689596 - DNA, 18 bp, Homo sapiens
caattccaggctgagcca

SEQ ID NO: 6689597 - DNA, 19 bp, Homo sapiens
caattcccccatccttcag

SEQ ID NO: 6689598 - DNA, 19 bp, Homo sapiens
caattccctctctcagcac

SEQ ID NO: 6689599 - DNA, 21 bp, Homo sapiens
caattccctctctcagcacag

SEQ ID NO: 6689600 - DNA, 22 bp, Homo sapiens
caattccctctctcagcacagc

SEQ ID NO: 6689601 - DNA, 20 bp, Homo sapiens
caattcccttctttttcatc

SEQ ID NO: 6689602 - DNA, 20 bp, Homo sapiens
caattccgtagccagctgct

SEQ ID NO: 6689603 - DNA, 22 bp, Homo sapiens
caattccgtcttcttaatctga

SEQ ID NO: 6689604 - DNA, 23 bp, Homo sapiens
caattcctacctcttcacctgac

SEQ ID NO: 6689605 - DNA, 23 bp, Homo sapiens
caattcctcatcctcagatgctc

SEQ ID NO: 6689606 - DNA, 21 bp, Homo sapiens
caattcctcatttgttcatta

SEQ ID NO: 6689607 - DNA, 22 bp, Homo sapiens
caattcctcatttgttcattaa

SEQ ID NO: 6689608 - DNA, 19 bp, Homo sapiens
caattcctccagagacact

SEQ ID NO: 6689609 - DNA, 15 bp, Homo sapiens
caattcctctgggaa

SEQ ID NO: 6689610 - DNA, 14 bp, Homo sapiens
caattcctggccct

SEQ ID NO: 6689611 - DNA, 13 bp, Homo sapiens
caattcctgggcc

SEQ ID NO: 6689612 - DNA, 16 bp, Homo sapiens
caattcgatatccgga

SEQ ID NO: 6689613 - DNA, 23 bp, Homo sapiens
caattctatcttttgtttccttt

SEQ ID NO: 6689614 - DNA, 19 bp, Homo sapiens
caattctcccgggactctg

SEQ ID NO: 6689615 - DNA, 15 bp, Homo sapiens
caattctcctgcctc

SEQ ID NO: 6689616 - DNA, 16 bp, Homo sapiens
caattctcctgcctca

SEQ ID NO: 6689617 - DNA, 15 bp, Homo sapiens
caattctcctgcctt

SEQ ID NO: 6689618 - DNA, 16 bp, Homo sapiens
caattctcctgccttt

SEQ ID NO: 6689619 - DNA, 13 bp, Homo sapiens
caattctccttta

SEQ ID NO: 6689620 - DNA, 20 bp, Homo sapiens
caattctcgattctttgaag

SEQ ID NO: 6689621 - DNA, 18 bp, Homo sapiens
caattctgaaatactttt

SEQ ID NO: 6689622 - DNA, 15 bp, Homo sapiens
caattctgacttctc

SEQ ID NO: 6689623 - DNA, 11 bp, Homo sapiens
caattctgatg

SEQ ID NO: 6689624 - DNA, 20 bp, Homo sapiens
caattctgatgttactgaga

SEQ ID NO: 6689625 - DNA, 21 bp, Homo sapiens
caattctgatgttactgagat

SEQ ID NO: 6689626 - DNA, 14 bp, Homo sapiens
caattctgcagaaa

SEQ ID NO: 6689627 - DNA, 19 bp, Homo sapiens
caattctgccccacaccca

SEQ ID NO: 6689628 - DNA, 13 bp, Homo sapiens
caattctgcctgc

SEQ ID NO: 6689629 - DNA, 13 bp, Homo sapiens
caattctgtaatt

SEQ ID NO: 6689630 - DNA, 17 bp, Homo sapiens
caattctgtaattacat

SEQ ID NO: 6689631 - DNA, 15 bp, Homo sapiens
caattctgtcccaat

SEQ ID NO: 6689632 - DNA, 13 bp, Homo sapiens
caattctgtccct

SEQ ID NO: 6689633 - DNA, 16 bp, Homo sapiens
caattctgtccctgtc

SEQ ID NO: 6689634 - DNA, 22 bp, Homo sapiens
caattctgtctcattgattgat

SEQ ID NO: 6689635 - DNA, 14 bp, Homo sapiens
caattctgttttta

SEQ ID NO: 6689636 - DNA, 23 bp, Homo sapiens
caattctgtttttaatgctattt

SEQ ID NO: 6689637 - DNA, 16 bp, Homo sapiens
caattctttatacaac

SEQ ID NO: 6689638 - DNA, 13 bp, Homo sapiens
caattctttcaac

SEQ ID NO: 6689639 - DNA, 15 bp, Homo sapiens
caattcttttgaaag

SEQ ID NO: 6689640 - DNA, 16 bp, Homo sapiens
caattcttttgaaaga

SEQ ID NO: 6689641 - DNA, 12 bp, Homo sapiens
caattgaaaagt

SEQ ID NO: 6689642 - DNA, 17 bp, Homo sapiens
caattgaaaagtgttct

SEQ ID NO: 6689643 - DNA, 21 bp, Homo sapiens
caattgaaaagtgttctgtgc

SEQ ID NO: 6689644 - DNA, 22 bp, Homo sapiens
caattgaaagtgggcaaaagct

SEQ ID NO: 6689645 - DNA, 14 bp, Homo sapiens
caattgaaatgcat

SEQ ID NO: 6689646 - DNA, 15 bp, Homo sapiens
caattgaagcatgaa

SEQ ID NO: 6689647 - DNA, 19 bp, Homo sapiens
caattgaagcatgaacgtg

SEQ ID NO: 6689648 - DNA, 22 bp, Homo sapiens
caattgaagcatgaacgtggat

SEQ ID NO: 6689649 - DNA, 22 bp, Homo sapiens
caattgaaggatcatctgaagg

SEQ ID NO: 6689650 - DNA, 22 bp, Homo sapiens
caattgacataggcaataataa

SEQ ID NO: 6689651 - DNA, 14 bp, Homo sapiens
caattgacttcctc

SEQ ID NO: 6689652 - DNA, 23 bp, Homo sapiens
caattgatgtatatgtttatata

SEQ ID NO: 6689653 - DNA, 20 bp, Homo sapiens
caattgatgttttacgtgca

SEQ ID NO: 6689654 - DNA, 22 bp, Homo sapiens
caattgatgttttacgtgcaaa

SEQ ID NO: 6689655 - DNA, 15 bp, Homo sapiens
caattgattgtgaat

SEQ ID NO: 6689656 - DNA, 16 bp, Homo sapiens
caattgcacaaataca

SEQ ID NO: 6689657 - DNA, 21 bp, Homo sapiens
caattgcacgcggagtgagtt

SEQ ID NO: 6689658 - DNA, 19 bp, Homo sapiens
caattgcacgtttggtgaa

SEQ ID NO: 6689659 - DNA, 14 bp, Homo sapiens
caattgcatctccc

SEQ ID NO: 6689660 - DNA, 22 bp, Homo sapiens
caattgcattgctaccaagttt

SEQ ID NO: 6689661 - DNA, 13 bp, Homo sapiens
caattgccctgcc

SEQ ID NO: 6689662 - DNA, 14 bp, Homo sapiens
caattgccctgcca

SEQ ID NO: 6689663 - DNA, 12 bp, Homo sapiens
caattgccctgt

SEQ ID NO: 6689664 - DNA, 15 bp, Homo sapiens
caattgctcttctcc

SEQ ID NO: 6689665 - DNA, 13 bp, Homo sapiens
caattgctgccaa

SEQ ID NO: 6689666 - DNA, 17 bp, Homo sapiens
caattgctgctacttat

SEQ ID NO: 6689667 - DNA, 20 bp, Homo sapiens
caattgcttactcattaaaa

SEQ ID NO: 6689668 - DNA, 19 bp, Homo sapiens
caattggattggaatgcag

SEQ ID NO: 6689669 - DNA, 21 bp, Homo sapiens
caattggcagtgactttgtat

SEQ ID NO: 6689670 - DNA, 15 bp, Homo sapiens
caattggctcctcca

SEQ ID NO: 6689671 - DNA, 21 bp, Homo sapiens
caattgggagctgccaagagt

SEQ ID NO: 6689672 - DNA, 15 bp, Homo sapiens
caattggggaagaaa

SEQ ID NO: 6689673 - DNA, 19 bp, Homo sapiens
caattggggaagaaaaaat

SEQ ID NO: 6689674 - DNA, 17 bp, Homo sapiens
caattggtggaattcct

SEQ ID NO: 6689675 - DNA, 16 bp, Homo sapiens
caattggtgtcatttt

SEQ ID NO: 6689676 - DNA, 18 bp, Homo sapiens
caattggtgtcattttct

SEQ ID NO: 6689677 - DNA, 16 bp, Homo sapiens
caattggttgtatata

SEQ ID NO: 6689678 - DNA, 19 bp, Homo sapiens
caattggttgtatataaag

SEQ ID NO: 6689679 - DNA, 14 bp, Homo sapiens
caattgtaaaaaaa

SEQ ID NO: 6689680 - DNA, 12 bp, Homo sapiens
caattgtaaagt

SEQ ID NO: 6689681 - DNA, 13 bp, Homo sapiens
caattgtacaaaa

SEQ ID NO: 6689682 - DNA, 18 bp, Homo sapiens
caattgtacaaaaaagtt

SEQ ID NO: 6689683 - DNA, 17 bp, Homo sapiens
caattgtacattccctg

SEQ ID NO: 6689684 - DNA, 18 bp, Homo sapiens
caattgtacattccctgc

SEQ ID NO: 6689685 - DNA, 12 bp, Homo sapiens
caattgtatata

SEQ ID NO: 6689686 - DNA, 13 bp, Homo sapiens
caattgtatatat

SEQ ID NO: 6689687 - DNA, 24 bp, Homo sapiens
caattgtattttatatgagagaat

SEQ ID NO: 6689688 - DNA, 16 bp, Homo sapiens
caattgtcacttttta

SEQ ID NO: 6689689 - DNA, 19 bp, Homo sapiens
caattgtcttttttttcct

SEQ ID NO: 6689690 - DNA, 22 bp, Homo sapiens
caattgtgaaaaaatttacttt

SEQ ID NO: 6689691 - DNA, 13 bp, Homo sapiens
caattgtgacagc

SEQ ID NO: 6689692 - DNA, 18 bp, Homo sapiens
caattgtgagccaccacg

SEQ ID NO: 6689693 - DNA, 13 bp, Homo sapiens
caattgtgctgcc

SEQ ID NO: 6689694 - DNA, 16 bp, Homo sapiens
caattgtgctttgtat

SEQ ID NO: 6689695 - DNA, 21 bp, Homo sapiens
caattgtgggcataaactgtt

SEQ ID NO: 6689696 - DNA, 17 bp, Homo sapiens
caattgtgtagcctttt

SEQ ID NO: 6689697 - DNA, 20 bp, Homo sapiens
caattgtgtgaattaatttc

SEQ ID NO: 6689698 - DNA, 17 bp, Homo sapiens
caattgtgtggtcagtg

SEQ ID NO: 6689699 - DNA, 21 bp, Homo sapiens
caattgtgttttcgtcacagg

SEQ ID NO: 6689700 - DNA, 17 bp, Homo sapiens
caattgttaattgtaat

SEQ ID NO: 6689701 - DNA, 13 bp, Homo sapiens
caattgttacaag

SEQ ID NO: 6689702 - DNA, 19 bp, Homo sapiens
caattgttacaagtgttct

SEQ ID NO: 6689703 - DNA, 22 bp, Homo sapiens
caattgttacaagtgttcttag

SEQ ID NO: 6689704 - DNA, 16 bp, Homo sapiens
caattgttacagtact

SEQ ID NO: 6689705 - DNA, 16 bp, Homo sapiens
caattgttgactaaaa

SEQ ID NO: 6689706 - DNA, 18 bp, Homo sapiens
caattgttgactaaaatg

SEQ ID NO: 6689707 - DNA, 16 bp, Homo sapiens
caattgtttaagaatc

SEQ ID NO: 6689708 - DNA, 20 bp, Homo sapiens
caattgtttgttctgttttc

SEQ ID NO: 6689709 - DNA, 16 bp, Homo sapiens
caatttaaaatatttc

SEQ ID NO: 6689710 - DNA, 20 bp, Homo sapiens
caatttaaaatcattcaata

SEQ ID NO: 6689711 - DNA, 15 bp, Homo sapiens
caatttaaaattatt

SEQ ID NO: 6689712 - DNA, 18 bp, Homo sapiens
caatttaaacccatttta

SEQ ID NO: 6689713 - DNA, 13 bp, Homo sapiens
caatttaaagcaa

SEQ ID NO: 6689714 - DNA, 18 bp, Homo sapiens
caatttaagatacaaata

SEQ ID NO: 6689715 - DNA, 14 bp, Homo sapiens
caatttaattccat

SEQ ID NO: 6689716 - DNA, 14 bp, Homo sapiens
caatttacaaagtg

SEQ ID NO: 6689717 - DNA, 17 bp, Homo sapiens
caatttacaaagtgtgt

SEQ ID NO: 6689718 - DNA, 15 bp, Homo sapiens
caatttacaagagct

SEQ ID NO: 6689719 - DNA, 15 bp, Homo sapiens
caatttactggccac

SEQ ID NO: 6689720 - DNA, 17 bp, Homo sapiens
caatttacttttaataa

SEQ ID NO: 6689721 - DNA, 21 bp, Homo sapiens
caatttactttttaaacagtg

SEQ ID NO: 6689722 - DNA, 22 bp, Homo sapiens
caatttactttttaaacagtgt

SEQ ID NO: 6689723 - DNA, 14 bp, Homo sapiens
caatttagaaaaca

SEQ ID NO: 6689724 - DNA, 13 bp, Homo sapiens
caatttagacaaa

SEQ ID NO: 6689725 - DNA, 15 bp, Homo sapiens
caatttagcaaactg

SEQ ID NO: 6689726 - DNA, 17 bp, Homo sapiens
caatttagcaaactgat

SEQ ID NO: 6689727 - DNA, 18 bp, Homo sapiens
caatttagccagaatgtt

SEQ ID NO: 6689728 - DNA, 22 bp, Homo sapiens
caatttagtctagacacaattt

SEQ ID NO: 6689729 - DNA, 13 bp, Homo sapiens
caatttatacctc

SEQ ID NO: 6689730 - DNA, 13 bp, Homo sapiens
caatttatactgc

SEQ ID NO: 6689731 - DNA, 16 bp, Homo sapiens
caatttatattttccc

SEQ ID NO: 6689732 - DNA, 23 bp, Homo sapiens
caatttatccaaagcattgcaga

SEQ ID NO: 6689733 - DNA, 20 bp, Homo sapiens
caatttatccattcaatcat

SEQ ID NO: 6689734 - DNA, 23 bp, Homo sapiens
caatttatcttccatatgctctt

SEQ ID NO: 6689735 - DNA, 18 bp, Homo sapiens
caatttatgttaacagat

SEQ ID NO: 6689736 - DNA, 19 bp, Homo sapiens
caatttatgttaacagatg

SEQ ID NO: 6689737 - DNA, 16 bp, Homo sapiens
caatttattactgaaa

SEQ ID NO: 6689738 - DNA, 20 bp, Homo sapiens
caatttattatggcacatca

SEQ ID NO: 6689739 - DNA, 14 bp, Homo sapiens
caatttattcaaga

SEQ ID NO: 6689740 - DNA, 14 bp, Homo sapiens
caatttattctgat

SEQ ID NO: 6689741 - DNA, 16 bp, Homo sapiens
caatttattgcacaaa

SEQ ID NO: 6689742 - DNA, 22 bp, Homo sapiens
caatttattgcacaaaatataa

SEQ ID NO: 6689743 - DNA, 13 bp, Homo sapiens
caatttatttgaa

SEQ ID NO: 6689744 - DNA, 15 bp, Homo sapiens
caatttatttgaatg

SEQ ID NO: 6689745 - DNA, 19 bp, Homo sapiens
caatttatttggggggaaa

SEQ ID NO: 6689746 - DNA, 19 bp, Homo sapiens
caatttcaaaatgcatgtg

SEQ ID NO: 6689747 - DNA, 16 bp, Homo sapiens
caatttcaaaatgtct

SEQ ID NO: 6689748 - DNA, 13 bp, Homo sapiens
caatttcaaactt

SEQ ID NO: 6689749 - DNA, 19 bp, Homo sapiens
caatttcaaagaaaacaga

SEQ ID NO: 6689750 - DNA, 15 bp, Homo sapiens
caatttcaaggttct

SEQ ID NO: 6689751 - DNA, 19 bp, Homo sapiens
caatttcaaggttctaacc

SEQ ID NO: 6689752 - DNA, 11 bp, Homo sapiens
caatttcaagt

SEQ ID NO: 6689753 - DNA, 14 bp, Homo sapiens
caatttcaataaaa

SEQ ID NO: 6689754 - DNA, 15 bp, Homo sapiens
caatttcacagagta

SEQ ID NO: 6689755 - DNA, 21 bp, Homo sapiens
caatttcacagagtacaaaat

SEQ ID NO: 6689756 - DNA, 14 bp, Homo sapiens
caatttcacatgga

SEQ ID NO: 6689757 - DNA, 19 bp, Homo sapiens
caatttcaccccattttct

SEQ ID NO: 6689758 - DNA, 22 bp, Homo sapiens
caatttcacgacacactttgat

SEQ ID NO: 6689759 - DNA, 14 bp, Homo sapiens
caatttcagaacca

SEQ ID NO: 6689760 - DNA, 22 bp, Homo sapiens
caatttcagttttaaaaatgaa

SEQ ID NO: 6689761 - DNA, 16 bp, Homo sapiens
caatttcatttccagc

SEQ ID NO: 6689762 - DNA, 21 bp, Homo sapiens
caatttcatttccagcatttt

SEQ ID NO: 6689763 - DNA, 21 bp, Homo sapiens
caatttccaagaatgatgcct

SEQ ID NO: 6689764 - DNA, 22 bp, Homo sapiens
caatttccatatagtctattca

SEQ ID NO: 6689765 - DNA, 21 bp, Homo sapiens
caatttccattcttttaaatg

SEQ ID NO: 6689766 - DNA, 13 bp, Homo sapiens
caatttcccagaa

SEQ ID NO: 6689767 - DNA, 17 bp, Homo sapiens
caatttcccccctcgtg

SEQ ID NO: 6689768 - DNA, 12 bp, Homo sapiens
caatttccccct

SEQ ID NO: 6689769 - DNA, 16 bp, Homo sapiens
caatttcccggagcca

SEQ ID NO: 6689770 - DNA, 13 bp, Homo sapiens
caatttccctcag

SEQ ID NO: 6689771 - DNA, 12 bp, Homo sapiens
caatttcctggc

SEQ ID NO: 6689772 - DNA, 20 bp, Homo sapiens
caatttcctttatatttagt

SEQ ID NO: 6689773 - DNA, 22 bp, Homo sapiens
caatttcgggagccttgtcagt

SEQ ID NO: 6689774 - DNA, 12 bp, Homo sapiens
caatttctaaat

SEQ ID NO: 6689775 - DNA, 19 bp, Homo sapiens
caatttctaatttttaaga

SEQ ID NO: 6689776 - DNA, 21 bp, Homo sapiens
caatttctagtacctgtgact

SEQ ID NO: 6689777 - DNA, 15 bp, Homo sapiens
caatttctattattt

SEQ ID NO: 6689778 - DNA, 14 bp, Homo sapiens
caatttctccccag

SEQ ID NO: 6689779 - DNA, 15 bp, Homo sapiens
caatttctgtacatt

SEQ ID NO: 6689780 - DNA, 19 bp, Homo sapiens
caatttctgtacatttgca

SEQ ID NO: 6689781 - DNA, 20 bp, Homo sapiens
caatttctgtgttgccaagc

SEQ ID NO: 6689782 - DNA, 19 bp, Homo sapiens
caatttcttctgtagctat

SEQ ID NO: 6689783 - DNA, 19 bp, Homo sapiens
caatttctttaaaaaagaa

SEQ ID NO: 6689784 - DNA, 20 bp, Homo sapiens
caatttctttaaaaaagaaa

SEQ ID NO: 6689785 - DNA, 11 bp, Homo sapiens
caatttgaagg

SEQ ID NO: 6689786 - DNA, 21 bp, Homo sapiens
caatttgaatttatctttcat

SEQ ID NO: 6689787 - DNA, 17 bp, Homo sapiens
caatttgacaaaaccca

SEQ ID NO: 6689788 - DNA, 17 bp, Homo sapiens
caatttgagactgaaat

SEQ ID NO: 6689789 - DNA, 19 bp, Homo sapiens
caatttgagactgaaattt

SEQ ID NO: 6689790 - DNA, 15 bp, Homo sapiens
caatttgagcaattc

SEQ ID NO: 6689791 - DNA, 12 bp, Homo sapiens
caatttgagcca

SEQ ID NO: 6689792 - DNA, 14 bp, Homo sapiens
caatttgcacaata

SEQ ID NO: 6689793 - DNA, 23 bp, Homo sapiens
caatttgcacatcttggctatgt

SEQ ID NO: 6689794 - DNA, 15 bp, Homo sapiens
caatttgcacatgta

SEQ ID NO: 6689795 - DNA, 14 bp, Homo sapiens
caatttgcacatta

SEQ ID NO: 6689796 - DNA, 15 bp, Homo sapiens
caatttgcaccagtt

SEQ ID NO: 6689797 - DNA, 22 bp, Homo sapiens
caatttgcataatactaattta

SEQ ID NO: 6689798 - DNA, 23 bp, Homo sapiens
caatttgccatagcagtgctagg

SEQ ID NO: 6689799 - DNA, 13 bp, Homo sapiens
caatttgcctctg

SEQ ID NO: 6689800 - DNA, 17 bp, Homo sapiens
caatttgctatttacaa

SEQ ID NO: 6689801 - DNA, 23 bp, Homo sapiens
caatttgctgaaaacattacatg

SEQ ID NO: 6689802 - DNA, 20 bp, Homo sapiens
caatttggagcattaactaa

SEQ ID NO: 6689803 - DNA, 22 bp, Homo sapiens
caatttggagcattaactaaat

SEQ ID NO: 6689804 - DNA, 21 bp, Homo sapiens
caatttggatatttggaggag

SEQ ID NO: 6689805 - DNA, 19 bp, Homo sapiens
caatttggcaattttgtgg

SEQ ID NO: 6689806 - DNA, 18 bp, Homo sapiens
caatttgggagatatatt

SEQ ID NO: 6689807 - DNA, 21 bp, Homo sapiens
caatttgggcttcctgtttgt

SEQ ID NO: 6689808 - DNA, 23 bp, Homo sapiens
caatttgggtttgttggtcacat

SEQ ID NO: 6689809 - DNA, 13 bp, Homo sapiens
caatttggtctta

SEQ ID NO: 6689810 - DNA, 22 bp, Homo sapiens
caatttggtcttagctttacat

SEQ ID NO: 6689811 - DNA, 19 bp, Homo sapiens
caatttgtaaaaacagcat

SEQ ID NO: 6689812 - DNA, 12 bp, Homo sapiens
caatttgtaatg

SEQ ID NO: 6689813 - DNA, 22 bp, Homo sapiens
caatttgtacttttttcttaag

SEQ ID NO: 6689814 - DNA, 16 bp, Homo sapiens
caatttgtataaaatg

SEQ ID NO: 6689815 - DNA, 17 bp, Homo sapiens
caatttgtcattttgaa

SEQ ID NO: 6689816 - DNA, 18 bp, Homo sapiens
caatttgtcattttgaag

SEQ ID NO: 6689817 - DNA, 22 bp, Homo sapiens
caatttgtcattttgaagctaa

SEQ ID NO: 6689818 - DNA, 23 bp, Homo sapiens
caatttgtcattttgaagctaat

SEQ ID NO: 6689819 - DNA, 17 bp, Homo sapiens
caatttgtctcctactc

SEQ ID NO: 6689820 - DNA, 22 bp, Homo sapiens
caatttgttaattcctatgaag

SEQ ID NO: 6689821 - DNA, 16 bp, Homo sapiens
caatttgttcttgtat

SEQ ID NO: 6689822 - DNA, 23 bp, Homo sapiens
caatttgttcttgtattttaata

SEQ ID NO: 6689823 - DNA, 22 bp, Homo sapiens
caatttgttggagatgcagcct

SEQ ID NO: 6689824 - DNA, 16 bp, Homo sapiens
caatttgtttgtgctt

SEQ ID NO: 6689825 - DNA, 16 bp, Homo sapiens
caatttgtttgtgttc

SEQ ID NO: 6689826 - DNA, 22 bp, Homo sapiens
caatttgtttgtgttcaatatc

SEQ ID NO: 6689827 - DNA, 15 bp, Homo sapiens
caatttgtttttgca

SEQ ID NO: 6689828 - DNA, 17 bp, Homo sapiens
caattttaaaatgaaat

SEQ ID NO: 6689829 - DNA, 12 bp, Homo sapiens
caattttaaaca

SEQ ID NO: 6689830 - DNA, 15 bp, Homo sapiens
caattttaaataaga

SEQ ID NO: 6689831 - DNA, 22 bp, Homo sapiens
caattttaacttagagcttttt

SEQ ID NO: 6689832 - DNA, 22 bp, Homo sapiens
caattttaaggaaactttttaa

SEQ ID NO: 6689833 - DNA, 17 bp, Homo sapiens
caattttaatgctattt

SEQ ID NO: 6689834 - DNA, 19 bp, Homo sapiens
caattttaatttagtaaat

SEQ ID NO: 6689835 - DNA, 21 bp, Homo sapiens
caattttaatttagtaaatgt

SEQ ID NO: 6689836 - DNA, 16 bp, Homo sapiens
caattttactgtgaaa

SEQ ID NO: 6689837 - DNA, 20 bp, Homo sapiens
caattttagtcactaagact

SEQ ID NO: 6689838 - DNA, 16 bp, Homo sapiens
caattttagtgtatta

SEQ ID NO: 6689839 - DNA, 17 bp, Homo sapiens
caattttagtgtattaa

SEQ ID NO: 6689840 - DNA, 19 bp, Homo sapiens
caattttatataattctga

SEQ ID NO: 6689841 - DNA, 23 bp, Homo sapiens
caattttatgtttttatttatga

SEQ ID NO: 6689842 - DNA, 18 bp, Homo sapiens
caattttattaaatgcat

SEQ ID NO: 6689843 - DNA, 15 bp, Homo sapiens
caattttcactgtgt

SEQ ID NO: 6689844 - DNA, 14 bp, Homo sapiens
caattttcagattt

SEQ ID NO: 6689845 - DNA, 19 bp, Homo sapiens
caattttcagatttgcaca

SEQ ID NO: 6689846 - DNA, 15 bp, Homo sapiens
caattttcatcccac

SEQ ID NO: 6689847 - DNA, 18 bp, Homo sapiens
caattttcattaaacttg

SEQ ID NO: 6689848 - DNA, 20 bp, Homo sapiens
caattttcattaaacttgaa

SEQ ID NO: 6689849 - DNA, 10 bp, Homo sapiens
caattttcct

SEQ ID NO: 6689850 - DNA, 13 bp, Homo sapiens
caattttcctaag

SEQ ID NO: 6689851 - DNA, 16 bp, Homo sapiens
caattttcctaagttt

SEQ ID NO: 6689852 - DNA, 14 bp, Homo sapiens
caattttcctgtgg

SEQ ID NO: 6689853 - DNA, 17 bp, Homo sapiens
caattttccttgaagcc

SEQ ID NO: 6689854 - DNA, 19 bp, Homo sapiens
caattttccttgaagccga

SEQ ID NO: 6689855 - DNA, 22 bp, Homo sapiens
caattttctaagcaatttcttg

SEQ ID NO: 6689856 - DNA, 17 bp, Homo sapiens
caattttctcccaggaa

SEQ ID NO: 6689857 - DNA, 19 bp, Homo sapiens
caattttctttaaccagtc

SEQ ID NO: 6689858 - DNA, 17 bp, Homo sapiens
caattttctttgtttct

SEQ ID NO: 6689859 - DNA, 18 bp, Homo sapiens
caattttgcatgctcgat

SEQ ID NO: 6689860 - DNA, 14 bp, Homo sapiens
caattttgtcacag

SEQ ID NO: 6689861 - DNA, 12 bp, Homo sapiens
caatttttaaac

SEQ ID NO: 6689862 - DNA, 19 bp, Homo sapiens
caatttttaaactagtaat

SEQ ID NO: 6689863 - DNA, 21 bp, Homo sapiens
caatttttaacttatctccag

SEQ ID NO: 6689864 - DNA, 14 bp, Homo sapiens
caatttttaggaag

SEQ ID NO: 6689865 - DNA, 14 bp, Homo sapiens
caatttttatacat

SEQ ID NO: 6689866 - DNA, 18 bp, Homo sapiens
caatttttatttctttta

SEQ ID NO: 6689867 - DNA, 11 bp, Homo sapiens
caatttttcca

SEQ ID NO: 6689868 - DNA, 13 bp, Homo sapiens
caatttttgcctt

SEQ ID NO: 6689869 - DNA, 14 bp, Homo sapiens
caatttttgccttc

SEQ ID NO: 6689870 - DNA, 18 bp, Homo sapiens
caatttttgtctcagaag

SEQ ID NO: 6689871 - DNA, 21 bp, Homo sapiens
caattttttaagtgaaaatat

SEQ ID NO: 6689872 - DNA, 21 bp, Homo sapiens
caattttttatcatgcatgtc

SEQ ID NO: 6689873 - DNA, 17 bp, Homo sapiens
caattttttatttttat

SEQ ID NO: 6689874 - DNA, 13 bp, Homo sapiens
caattttttctca

SEQ ID NO: 6689875 - DNA, 14 bp, Homo sapiens
caatttttttatac

SEQ ID NO: 6689876 - DNA, 20 bp, Homo sapiens
caattttttttccgtaaatg

SEQ ID NO: 6689877 - DNA, 16 bp, Homo sapiens
caatttttttttcctt

SEQ ID NO: 6689878 - DNA, 16 bp, Homo sapiens
caattttttttttcct

SEQ ID NO: 6689879 - DNA, 22 bp, Homo sapiens
cacaaaaaaaatttaaaaaaat

SEQ ID NO: 6689880 - DNA, 14 bp, Homo sapiens
cacaaaaaaacaag

SEQ ID NO: 6689881 - DNA, 23 bp, Homo sapiens
cacaaaaaaatatcagacaagca

SEQ ID NO: 6689882 - DNA, 23 bp, Homo sapiens
cacaaaaaaatgttcattgtaga

SEQ ID NO: 6689883 - DNA, 16 bp, Homo sapiens
cacaaaaaatttaaga

SEQ ID NO: 6689884 - DNA, 19 bp, Homo sapiens
cacaaaaagaaagctgtga

SEQ ID NO: 6689885 - DNA, 22 bp, Homo sapiens
cacaaaaagataccttaaaatt

SEQ ID NO: 6689886 - DNA, 15 bp, Homo sapiens
cacaaaaaggagcgg

SEQ ID NO: 6689887 - DNA, 20 bp, Homo sapiens
cacaaaaatttgaacactgg

SEQ ID NO: 6689888 - DNA, 15 bp, Homo sapiens
cacaaaacaacccta

SEQ ID NO: 6689889 - DNA, 20 bp, Homo sapiens
cacaaaactacttttctaaa

SEQ ID NO: 6689890 - DNA, 22 bp, Homo sapiens
cacaaaactacttttctaaaat

SEQ ID NO: 6689891 - DNA, 14 bp, Homo sapiens
cacaaaacttgaaa

SEQ ID NO: 6689892 - DNA, 21 bp, Homo sapiens
cacaaaagaagaaataaataa

SEQ ID NO: 6689893 - DNA, 14 bp, Homo sapiens
cacaaaagacaagc

SEQ ID NO: 6689894 - DNA, 13 bp, Homo sapiens
cacaaaagacagc

SEQ ID NO: 6689895 - DNA, 14 bp, Homo sapiens
cacaaaagccaaaa

SEQ ID NO: 6689896 - DNA, 14 bp, Homo sapiens
cacaaaagcctctc

SEQ ID NO: 6689897 - DNA, 16 bp, Homo sapiens
cacaaaagtttctctt

SEQ ID NO: 6689898 - DNA, 20 bp, Homo sapiens
cacaaaataaagctgtgaca

SEQ ID NO: 6689899 - DNA, 22 bp, Homo sapiens
cacaaaataaccaatcctggac

SEQ ID NO: 6689900 - DNA, 22 bp, Homo sapiens
cacaaaatagcacatccaccaa

SEQ ID NO: 6689901 - DNA, 22 bp, Homo sapiens
cacaaaatatattttgtttaca

SEQ ID NO: 6689902 - DNA, 15 bp, Homo sapiens
cacaaaatatttcta

SEQ ID NO: 6689903 - DNA, 13 bp, Homo sapiens
cacaaaatgaata

SEQ ID NO: 6689904 - DNA, 12 bp, Homo sapiens
cacaaaatgcac

SEQ ID NO: 6689905 - DNA, 17 bp, Homo sapiens
cacaaaatggattttag

SEQ ID NO: 6689906 - DNA, 13 bp, Homo sapiens
cacaaaatgtgac

SEQ ID NO: 6689907 - DNA, 17 bp, Homo sapiens
cacaaaattagaaagga

SEQ ID NO: 6689908 - DNA, 22 bp, Homo sapiens
cacaaaattatgctgcatttgg

SEQ ID NO: 6689909 - DNA, 13 bp, Homo sapiens
cacaaaattcaaa

SEQ ID NO: 6689910 - DNA, 20 bp, Homo sapiens
cacaaaattctagaagcaga

SEQ ID NO: 6689911 - DNA, 13 bp, Homo sapiens
cacaaacacaagg

SEQ ID NO: 6689912 - DNA, 13 bp, Homo sapiens
cacaaacacacac

SEQ ID NO: 6689913 - DNA, 14 bp, Homo sapiens
cacaaacacctcct

SEQ ID NO: 6689914 - DNA, 21 bp, Homo sapiens
cacaaacagaattttccattt

SEQ ID NO: 6689915 - DNA, 21 bp, Homo sapiens
cacaaacaggaatgtctggag

SEQ ID NO: 6689916 - DNA, 15 bp, Homo sapiens
cacaaacatagacag

SEQ ID NO: 6689917 - DNA, 12 bp, Homo sapiens
cacaaacatgaa

SEQ ID NO: 6689918 - DNA, 14 bp, Homo sapiens
cacaaacattgctg

SEQ ID NO: 6689919 - DNA, 16 bp, Homo sapiens
cacaaacattgctgcc

SEQ ID NO: 6689920 - DNA, 12 bp, Homo sapiens
cacaaacatttt

SEQ ID NO: 6689921 - DNA, 15 bp, Homo sapiens
cacaaacatttttca

SEQ ID NO: 6689922 - DNA, 22 bp, Homo sapiens
cacaaaccatggattgtacata

SEQ ID NO: 6689923 - DNA, 18 bp, Homo sapiens
cacaaaccattttatttt

SEQ ID NO: 6689924 - DNA, 16 bp, Homo sapiens
cacaaaccctgcctct

SEQ ID NO: 6689925 - DNA, 16 bp, Homo sapiens
cacaaaccctgctgaa

SEQ ID NO: 6689926 - DNA, 17 bp, Homo sapiens
cacaaaccctggggact

SEQ ID NO: 6689927 - DNA, 17 bp, Homo sapiens
cacaaacctactgccca

SEQ ID NO: 6689928 - DNA, 14 bp, Homo sapiens
cacaaacctgcccg

SEQ ID NO: 6689929 - DNA, 14 bp, Homo sapiens
cacaaaccttcttt

SEQ ID NO: 6689930 - DNA, 15 bp, Homo sapiens
cacaaaccttctttt

SEQ ID NO: 6689931 - DNA, 18 bp, Homo sapiens
cacaaaccttcttttcaa

SEQ ID NO: 6689932 - DNA, 21 bp, Homo sapiens
cacaaaccttcttttcaatgc

SEQ ID NO: 6689933 - DNA, 17 bp, Homo sapiens
cacaaacgggctcagca

SEQ ID NO: 6689934 - DNA, 22 bp, Homo sapiens
cacaaacgtatgtaaatgtata

SEQ ID NO: 6689935 - DNA, 17 bp, Homo sapiens
cacaaactacctctgga

SEQ ID NO: 6689936 - DNA, 23 bp, Homo sapiens
cacaaactctatcggagaacatg

SEQ ID NO: 6689937 - DNA, 14 bp, Homo sapiens
cacaaactgcagct

SEQ ID NO: 6689938 - DNA, 16 bp, Homo sapiens
cacaaactgcagctgt

SEQ ID NO: 6689939 - DNA, 15 bp, Homo sapiens
cacaaactgtaaata

SEQ ID NO: 6689940 - DNA, 23 bp, Homo sapiens
cacaaactgtaaataaaaagaaa

SEQ ID NO: 6689941 - DNA, 14 bp, Homo sapiens
cacaaactgtcgtc

SEQ ID NO: 6689942 - DNA, 15 bp, Homo sapiens
cacaaactgtcgtct

SEQ ID NO: 6689943 - DNA, 21 bp, Homo sapiens
cacaaacttgtgagcatcaga

SEQ ID NO: 6689944 - DNA, 19 bp, Homo sapiens
cacaaactttcaagtatta

SEQ ID NO: 6689945 - DNA, 19 bp, Homo sapiens
cacaaagaaaattcctata

SEQ ID NO: 6689946 - DNA, 11 bp, Homo sapiens
cacaaagaaac

SEQ ID NO: 6689947 - DNA, 20 bp, Homo sapiens
cacaaagaacttgctgctgc

SEQ ID NO: 6689948 - DNA, 12 bp, Homo sapiens
cacaaagacaca

SEQ ID NO: 6689949 - DNA, 15 bp, Homo sapiens
cacaaagacacagga

SEQ ID NO: 6689950 - DNA, 17 bp, Homo sapiens
cacaaagacacaggaag

SEQ ID NO: 6689951 - DNA, 16 bp, Homo sapiens
cacaaagacatggaag

SEQ ID NO: 6689952 - DNA, 17 bp, Homo sapiens
cacaaagaccaaaatga

SEQ ID NO: 6689953 - DNA, 16 bp, Homo sapiens
cacaaagaccctggct

SEQ ID NO: 6689954 - DNA, 12 bp, Homo sapiens
cacaaagagagt

SEQ ID NO: 6689955 - DNA, 13 bp, Homo sapiens
cacaaagagctga

SEQ ID NO: 6689956 - DNA, 15 bp, Homo sapiens
cacaaagatattatt

SEQ ID NO: 6689957 - DNA, 15 bp, Homo sapiens
cacaaagatcaaatg

SEQ ID NO: 6689958 - DNA, 17 bp, Homo sapiens
cacaaagattttctaag

SEQ ID NO: 6689959 - DNA, 16 bp, Homo sapiens
cacaaagcaaaggcag

SEQ ID NO: 6689960 - DNA, 14 bp, Homo sapiens
cacaaagccaagcc

SEQ ID NO: 6689961 - DNA, 23 bp, Homo sapiens
cacaaagccaagcctaggccgcc

SEQ ID NO: 6689962 - DNA, 12 bp, Homo sapiens
cacaaagcccaa

SEQ ID NO: 6689963 - DNA, 22 bp, Homo sapiens
cacaaagcccatcataatataa

SEQ ID NO: 6689964 - DNA, 15 bp, Homo sapiens
cacaaagccgtgcct

SEQ ID NO: 6689965 - DNA, 17 bp, Homo sapiens
cacaaagcggctctaaa

SEQ ID NO: 6689966 - DNA, 20 bp, Homo sapiens
cacaaagctatttaagtgga

SEQ ID NO: 6689967 - DNA, 19 bp, Homo sapiens
cacaaagctcaagatgaca

SEQ ID NO: 6689968 - DNA, 21 bp, Homo sapiens
cacaaagctcaagatgacagc

SEQ ID NO: 6689969 - DNA, 21 bp, Homo sapiens
cacaaagctcaataggaggga

SEQ ID NO: 6689970 - DNA, 16 bp, Homo sapiens
cacaaagcttttgcat

SEQ ID NO: 6689971 - DNA, 21 bp, Homo sapiens
cacaaaggacctcagctgctt

SEQ ID NO: 6689972 - DNA, 16 bp, Homo sapiens
cacaaaggagtgagtg

SEQ ID NO: 6689973 - DNA, 13 bp, Homo sapiens
cacaaaggatttg

SEQ ID NO: 6689974 - DNA, 20 bp, Homo sapiens
cacaaaggcaaagggtccag

SEQ ID NO: 6689975 - DNA, 17 bp, Homo sapiens
cacaaaggcatgctgga

SEQ ID NO: 6689976 - DNA, 21 bp, Homo sapiens
cacaaaggccaaactgctgga

SEQ ID NO: 6689977 - DNA, 23 bp, Homo sapiens
cacaaaggctgacattcactgag

SEQ ID NO: 6689978 - DNA, 14 bp, Homo sapiens
cacaaagggacaca

SEQ ID NO: 6689979 - DNA, 16 bp, Homo sapiens
cacaaagggactttgg

SEQ ID NO: 6689980 - DNA, 13 bp, Homo sapiens
cacaaagggccca

SEQ ID NO: 6689981 - DNA, 15 bp, Homo sapiens
cacaaagggcccaga

SEQ ID NO: 6689982 - DNA, 15 bp, Homo sapiens
cacaaaggggagaag

SEQ ID NO: 6689983 - DNA, 21 bp, Homo sapiens
cacaaaggggagaagggccag

SEQ ID NO: 6689984 - DNA, 17 bp, Homo sapiens
cacaaaggtggaataaa

SEQ ID NO: 6689985 - DNA, 13 bp, Homo sapiens
cacaaagtgaaat

SEQ ID NO: 6689986 - DNA, 18 bp, Homo sapiens
cacaaagttctcagagct

SEQ ID NO: 6689987 - DNA, 18 bp, Homo sapiens
cacaaagtttgtggtaat

SEQ ID NO: 6689988 - DNA, 12 bp, Homo sapiens
cacaaataaaat

SEQ ID NO: 6689989 - DNA, 21 bp, Homo sapiens
cacaaataatgaacagcagaa

SEQ ID NO: 6689990 - DNA, 16 bp, Homo sapiens
cacaaatacattcctt

SEQ ID NO: 6689991 - DNA, 18 bp, Homo sapiens
cacaaatcaaagcaaggg

SEQ ID NO: 6689992 - DNA, 20 bp, Homo sapiens
cacaaatccctatgttgcta

SEQ ID NO: 6689993 - DNA, 16 bp, Homo sapiens
cacaaatccttcaaaa

SEQ ID NO: 6689994 - DNA, 11 bp, Homo sapiens
cacaaatgaaa

SEQ ID NO: 6689995 - DNA, 15 bp, Homo sapiens
cacaaatgaaaatga

SEQ ID NO: 6689996 - DNA, 14 bp, Homo sapiens
cacaaatgacttta

SEQ ID NO: 6689997 - DNA, 22 bp, Homo sapiens
cacaaatgactttattatttat

SEQ ID NO: 6689998 - DNA, 16 bp, Homo sapiens
cacaaatgtcctcaga

SEQ ID NO: 6689999 - DNA, 18 bp, Homo sapiens
cacaaatgtctagtttct

SEQ ID NO: 6690000 - DNA, 19 bp, Homo sapiens
cacaaatgtgatttttgta

SEQ ID NO: 6690001 - DNA, 14 bp, Homo sapiens
cacaaatgtgtccc

SEQ ID NO: 6690002 - DNA, 21 bp, Homo sapiens
cacaaatgtgtcccagtgaac

SEQ ID NO: 6690003 - DNA, 20 bp, Homo sapiens
cacaaattatgctaagaatt

SEQ ID NO: 6690004 - DNA, 20 bp, Homo sapiens
cacaaattattaatgaaaat

SEQ ID NO: 6690005 - DNA, 21 bp, Homo sapiens
cacaaattctgtctctggatt

SEQ ID NO: 6690006 - DNA, 14 bp, Homo sapiens
cacaaatttgcttt

SEQ ID NO: 6690007 - DNA, 18 bp, Homo sapiens
cacaaattttcaagttta

SEQ ID NO: 6690008 - DNA, 22 bp, Homo sapiens
cacaaattttcaagtttacact

SEQ ID NO: 6690009 - DNA, 11 bp, Homo sapiens
cacaacaaaaa

SEQ ID NO: 6690010 - DNA, 22 bp, Homo sapiens
cacaacaaaaatttgaaccaaa

SEQ ID NO: 6690011 - DNA, 14 bp, Homo sapiens
cacaacaagaaact

SEQ ID NO: 6690012 - DNA, 14 bp, Homo sapiens
cacaacagagtaac

SEQ ID NO: 6690013 - DNA, 17 bp, Homo sapiens
cacaacagatttctaag

SEQ ID NO: 6690014 - DNA, 18 bp, Homo sapiens
cacaacagatttctaagt

SEQ ID NO: 6690015 - DNA, 21 bp, Homo sapiens
cacaacagccaacagctacaa

SEQ ID NO: 6690016 - DNA, 19 bp, Homo sapiens
cacaacagccctgcctgag

SEQ ID NO: 6690017 - DNA, 15 bp, Homo sapiens
cacaacagcctgggg

SEQ ID NO: 6690018 - DNA, 19 bp, Homo sapiens
cacaacagcgtggcttaga

SEQ ID NO: 6690019 - DNA, 14 bp, Homo sapiens
cacaacaggcattc

SEQ ID NO: 6690020 - DNA, 23 bp, Homo sapiens
cacaacaggctgtgtgtggaaat

SEQ ID NO: 6690021 - DNA, 16 bp, Homo sapiens
cacaacatggtgctac

SEQ ID NO: 6690022 - DNA, 22 bp, Homo sapiens
cacaacatttgtgtcactgtac

SEQ ID NO: 6690023 - DNA, 14 bp, Homo sapiens
cacaacattttaat

SEQ ID NO: 6690024 - DNA, 22 bp, Homo sapiens
cacaaccactaatttgtcactg

SEQ ID NO: 6690025 - DNA, 19 bp, Homo sapiens
cacaaccagaggtggcagg

SEQ ID NO: 6690026 - DNA, 16 bp, Homo sapiens
cacaaccagccacaca

SEQ ID NO: 6690027 - DNA, 18 bp, Homo sapiens
cacaaccagccacacaga

SEQ ID NO: 6690028 - DNA, 23 bp, Homo sapiens
cacaaccatctgtccctgcctca

SEQ ID NO: 6690029 - DNA, 18 bp, Homo sapiens
cacaacccaataggagtc

SEQ ID NO: 6690030 - DNA, 15 bp, Homo sapiens
cacaaccctctggaa

SEQ ID NO: 6690031 - DNA, 17 bp, Homo sapiens
cacaaccctctggaagt

SEQ ID NO: 6690032 - DNA, 19 bp, Homo sapiens
cacaacccttctctgttgg

SEQ ID NO: 6690033 - DNA, 21 bp, Homo sapiens
cacaaccgtccccggcccctg

SEQ ID NO: 6690034 - DNA, 23 bp, Homo sapiens
cacaaccgtccccggcccctgcc

SEQ ID NO: 6690035 - DNA, 21 bp, Homo sapiens
cacaacctaaatggagaaagc

SEQ ID NO: 6690036 - DNA, 17 bp, Homo sapiens
cacaacctagggcaagt

SEQ ID NO: 6690037 - DNA, 15 bp, Homo sapiens
cacaacctcaccaaa

SEQ ID NO: 6690038 - DNA, 17 bp, Homo sapiens
cacaacctctctgatct

SEQ ID NO: 6690039 - DNA, 18 bp, Homo sapiens
cacaacctctctgatctt

SEQ ID NO: 6690040 - DNA, 23 bp, Homo sapiens
cacaacctctctgatcttgtgct

SEQ ID NO: 6690041 - DNA, 22 bp, Homo sapiens
cacaacctgtggggtctgatgt

SEQ ID NO: 6690042 - DNA, 19 bp, Homo sapiens
cacaacgctctaccctgca

SEQ ID NO: 6690043 - DNA, 21 bp, Homo sapiens
cacaacgctctaccctgcagc

SEQ ID NO: 6690044 - DNA, 19 bp, Homo sapiens
cacaacgtaaaaataaaag

SEQ ID NO: 6690045 - DNA, 19 bp, Homo sapiens
cacaacgtcccctcaagcc

SEQ ID NO: 6690046 - DNA, 17 bp, Homo sapiens
cacaacgtgcattgtgc

SEQ ID NO: 6690047 - DNA, 20 bp, Homo sapiens
cacaacgtttgacctcgact

SEQ ID NO: 6690048 - DNA, 17 bp, Homo sapiens
cacaactaacaatgcct

SEQ ID NO: 6690049 - DNA, 15 bp, Homo sapiens
cacaactactagtgt

SEQ ID NO: 6690050 - DNA, 11 bp, Homo sapiens
cacaactagga

SEQ ID NO: 6690051 - DNA, 14 bp, Homo sapiens
cacaactatttttc

SEQ ID NO: 6690052 - DNA, 19 bp, Homo sapiens
cacaactcactccttttaa

SEQ ID NO: 6690053 - DNA, 22 bp, Homo sapiens
cacaactcactccttttaaaga

SEQ ID NO: 6690054 - DNA, 13 bp, Homo sapiens
cacaactcagcat

SEQ ID NO: 6690055 - DNA, 16 bp, Homo sapiens
cacaactcccttgcac

SEQ ID NO: 6690056 - DNA, 12 bp, Homo sapiens
cacaactgacac

SEQ ID NO: 6690057 - DNA, 17 bp, Homo sapiens
cacaactgacacaggaa

SEQ ID NO: 6690058 - DNA, 20 bp, Homo sapiens
cacaactgcaataacttctg

SEQ ID NO: 6690059 - DNA, 12 bp, Homo sapiens
cacaactgctgt

SEQ ID NO: 6690060 - DNA, 19 bp, Homo sapiens
cacaactgctgtggccccc

SEQ ID NO: 6690061 - DNA, 16 bp, Homo sapiens
cacaactggaagcttt

SEQ ID NO: 6690062 - DNA, 22 bp, Homo sapiens
cacaactgtcccgttccccgct

SEQ ID NO: 6690063 - DNA, 18 bp, Homo sapiens
cacaactgtttttgaaga

SEQ ID NO: 6690064 - DNA, 19 bp, Homo sapiens
cacaacttcagcaggggat

SEQ ID NO: 6690065 - DNA, 14 bp, Homo sapiens
cacaactttgcaaa

SEQ ID NO: 6690066 - DNA, 20 bp, Homo sapiens
cacaactttgcaaattattt

SEQ ID NO: 6690067 - DNA, 14 bp, Homo sapiens
cacaagaaaactca

SEQ ID NO: 6690068 - DNA, 22 bp, Homo sapiens
cacaagaaatcaaaatccaaaa

SEQ ID NO: 6690069 - DNA, 20 bp, Homo sapiens
cacaagaaatttgatttcta

SEQ ID NO: 6690070 - DNA, 17 bp, Homo sapiens
cacaagaactcctccca

SEQ ID NO: 6690071 - DNA, 13 bp, Homo sapiens
cacaagaaggcca

SEQ ID NO: 6690072 - DNA, 19 bp, Homo sapiens
cacaagaaggccagcccac

SEQ ID NO: 6690073 - DNA, 23 bp, Homo sapiens
cacaagaaggccagcccactggg

SEQ ID NO: 6690074 - DNA, 23 bp, Homo sapiens
cacaagaagtgggagtgggagag

SEQ ID NO: 6690075 - DNA, 23 bp, Homo sapiens
cacaagaatggatcacaagatgg

SEQ ID NO: 6690076 - DNA, 19 bp, Homo sapiens
cacaagaatggtgtgtgcc

SEQ ID NO: 6690077 - DNA, 23 bp, Homo sapiens
cacaagacacagaatagtttaca

SEQ ID NO: 6690078 - DNA, 16 bp, Homo sapiens
cacaagacccttgtgg

SEQ ID NO: 6690079 - DNA, 11 bp, Homo sapiens
cacaagactga

SEQ ID NO: 6690080 - DNA, 18 bp, Homo sapiens
cacaagactgcacatcaa

SEQ ID NO: 6690081 - DNA, 16 bp, Homo sapiens
cacaagactggcccag

SEQ ID NO: 6690082 - DNA, 19 bp, Homo sapiens
cacaagactggcccagtgc

SEQ ID NO: 6690083 - DNA, 23 bp, Homo sapiens
cacaagactggcccagtgccagc

SEQ ID NO: 6690084 - DNA, 15 bp, Homo sapiens
cacaagagatcagca

SEQ ID NO: 6690085 - DNA, 21 bp, Homo sapiens
cacaagagatcagcagtggca

SEQ ID NO: 6690086 - DNA, 20 bp, Homo sapiens
cacaagagcccagcagggcc

SEQ ID NO: 6690087 - DNA, 21 bp, Homo sapiens
cacaagagcccagcagggcct

SEQ ID NO: 6690088 - DNA, 17 bp, Homo sapiens
cacaagagccccaaaga

SEQ ID NO: 6690089 - DNA, 16 bp, Homo sapiens
cacaagagctccttga

SEQ ID NO: 6690090 - DNA, 20 bp, Homo sapiens
cacaagatgccccagggatg

SEQ ID NO: 6690091 - DNA, 19 bp, Homo sapiens
cacaagattcccagagaca

SEQ ID NO: 6690092 - DNA, 15 bp, Homo sapiens
cacaagattggtgtt

SEQ ID NO: 6690093 - DNA, 17 bp, Homo sapiens
cacaagattggtgtttt

SEQ ID NO: 6690094 - DNA, 15 bp, Homo sapiens
cacaagcaatgcaag

SEQ ID NO: 6690095 - DNA, 16 bp, Homo sapiens
cacaagcaatgcaaga

SEQ ID NO: 6690096 - DNA, 13 bp, Homo sapiens
cacaagcacaaag

SEQ ID NO: 6690097 - DNA, 13 bp, Homo sapiens
cacaagcacaatt

SEQ ID NO: 6690098 - DNA, 15 bp, Homo sapiens
cacaagcaccactct

SEQ ID NO: 6690099 - DNA, 21 bp, Homo sapiens
cacaagcaccactctgggcac

SEQ ID NO: 6690100 - DNA, 18 bp, Homo sapiens
cacaagcaccccagacct

SEQ ID NO: 6690101 - DNA, 18 bp, Homo sapiens
cacaagcagacacacaca

SEQ ID NO: 6690102 - DNA, 23 bp, Homo sapiens
cacaagcagagtgcacagctgtc

SEQ ID NO: 6690103 - DNA, 20 bp, Homo sapiens
cacaagccaaggaagtctgt

SEQ ID NO: 6690104 - DNA, 21 bp, Homo sapiens
cacaagccaaggaagtctgtg

SEQ ID NO: 6690105 - DNA, 15 bp, Homo sapiens
cacaagccagggtgt

SEQ ID NO: 6690106 - DNA, 15 bp, Homo sapiens
cacaagcccacagca

SEQ ID NO: 6690107 - DNA, 14 bp, Homo sapiens
cacaagcccaggct

SEQ ID NO: 6690108 - DNA, 22 bp, Homo sapiens
cacaagcccgtgacagatgcca

SEQ ID NO: 6690109 - DNA, 14 bp, Homo sapiens
cacaagcctcctgt

SEQ ID NO: 6690110 - DNA, 15 bp, Homo sapiens
cacaagcctcctgta

SEQ ID NO: 6690111 - DNA, 16 bp, Homo sapiens
cacaagcctcctgtac

SEQ ID NO: 6690112 - DNA, 21 bp, Homo sapiens
cacaagcctcgaggtgccttc

SEQ ID NO: 6690113 - DNA, 22 bp, Homo sapiens
cacaagccttactcacctctct

SEQ ID NO: 6690114 - DNA, 18 bp, Homo sapiens
cacaagcgctcccagcct

SEQ ID NO: 6690115 - DNA, 15 bp, Homo sapiens
cacaagcggccctga

SEQ ID NO: 6690116 - DNA, 16 bp, Homo sapiens
cacaagctcaggtcct

SEQ ID NO: 6690117 - DNA, 15 bp, Homo sapiens
cacaagctccaagct

SEQ ID NO: 6690118 - DNA, 20 bp, Homo sapiens
cacaagctccaagctcccag

SEQ ID NO: 6690119 - DNA, 17 bp, Homo sapiens
cacaagctgcaccctca

SEQ ID NO: 6690120 - DNA, 20 bp, Homo sapiens
cacaagctgcactgtgaacc

SEQ ID NO: 6690121 - DNA, 16 bp, Homo sapiens
cacaagctgcctccct

SEQ ID NO: 6690122 - DNA, 22 bp, Homo sapiens
cacaagctgcctccctgtccac

SEQ ID NO: 6690123 - DNA, 19 bp, Homo sapiens
cacaagcttctgtcctgcc

SEQ ID NO: 6690124 - DNA, 16 bp, Homo sapiens
cacaagcttgtatata

SEQ ID NO: 6690125 - DNA, 20 bp, Homo sapiens
cacaagcttgtatatacata

SEQ ID NO: 6690126 - DNA, 12 bp, Homo sapiens
cacaaggaaaga

SEQ ID NO: 6690127 - DNA, 14 bp, Homo sapiens
cacaaggaaataaa

SEQ ID NO: 6690128 - DNA, 17 bp, Homo sapiens
cacaaggaaataaaatt

SEQ ID NO: 6690129 - DNA, 23 bp, Homo sapiens
cacaaggaatttccctgtgtgga

SEQ ID NO: 6690130 - DNA, 20 bp, Homo sapiens
cacaaggacagaaccctcca

SEQ ID NO: 6690131 - DNA, 16 bp, Homo sapiens
cacaaggacttcctgt

SEQ ID NO: 6690132 - DNA, 16 bp, Homo sapiens
cacaaggattgaaaat

SEQ ID NO: 6690133 - DNA, 15 bp, Homo sapiens
cacaaggcagcaagg

SEQ ID NO: 6690134 - DNA, 20 bp, Homo sapiens
cacaaggccagaaaaagaag

SEQ ID NO: 6690135 - DNA, 16 bp, Homo sapiens
cacaaggcctggtctg

SEQ ID NO: 6690136 - DNA, 22 bp, Homo sapiens
cacaaggctgaaaagtgctttg

SEQ ID NO: 6690137 - DNA, 17 bp, Homo sapiens
cacaagggatataaaat

SEQ ID NO: 6690138 - DNA, 15 bp, Homo sapiens
cacaaggtcaggagt

SEQ ID NO: 6690139 - DNA, 20 bp, Homo sapiens
cacaaggtcatggccacact

SEQ ID NO: 6690140 - DNA, 15 bp, Homo sapiens
cacaaggtccactcc

SEQ ID NO: 6690141 - DNA, 20 bp, Homo sapiens
cacaaggtccactccctgct

SEQ ID NO: 6690142 - DNA, 15 bp, Homo sapiens
cacaaggtgctcaga

SEQ ID NO: 6690143 - DNA, 16 bp, Homo sapiens
cacaaggtggcagcaa

SEQ ID NO: 6690144 - DNA, 15 bp, Homo sapiens
cacaaggtgggcagg

SEQ ID NO: 6690145 - DNA, 18 bp, Homo sapiens
cacaagtaacacatttgg

SEQ ID NO: 6690146 - DNA, 22 bp, Homo sapiens
cacaagtaacagttgaagaaaa

SEQ ID NO: 6690147 - DNA, 14 bp, Homo sapiens
cacaagtaagagac

SEQ ID NO: 6690148 - DNA, 23 bp, Homo sapiens
cacaagtaagagactcagcctgc

SEQ ID NO: 6690149 - DNA, 15 bp, Homo sapiens
cacaagtagcctctg

SEQ ID NO: 6690150 - DNA, 17 bp, Homo sapiens
cacaagtagcctctggg

SEQ ID NO: 6690151 - DNA, 16 bp, Homo sapiens
cacaagtaggagacac

SEQ ID NO: 6690152 - DNA, 20 bp, Homo sapiens
cacaagtatatacttttaaa

SEQ ID NO: 6690153 - DNA, 16 bp, Homo sapiens
cacaagtcctgtgaat

SEQ ID NO: 6690154 - DNA, 15 bp, Homo sapiens
cacaagtctttccag

SEQ ID NO: 6690155 - DNA, 12 bp, Homo sapiens
cacaagtgaaaa

SEQ ID NO: 6690156 - DNA, 22 bp, Homo sapiens
cacaagtgaatctttctcctgg

SEQ ID NO: 6690157 - DNA, 23 bp, Homo sapiens
cacaagtgaatctttctcctggt

SEQ ID NO: 6690158 - DNA, 22 bp, Homo sapiens
cacaagtgagccctcttgccca

SEQ ID NO: 6690159 - DNA, 19 bp, Homo sapiens
cacaagtgggtacccccag

SEQ ID NO: 6690160 - DNA, 13 bp, Homo sapiens
cacaagtggtggt

SEQ ID NO: 6690161 - DNA, 21 bp, Homo sapiens
cacaagtggtggtaaccctgg

SEQ ID NO: 6690162 - DNA, 21 bp, Homo sapiens
cacaagtgtaactatgctgtt

SEQ ID NO: 6690163 - DNA, 15 bp, Homo sapiens
cacaagtgtaatgaa

SEQ ID NO: 6690164 - DNA, 17 bp, Homo sapiens
cacaagtgtaatgaata

SEQ ID NO: 6690165 - DNA, 18 bp, Homo sapiens
cacaagtgtgtggccccg

SEQ ID NO: 6690166 - DNA, 17 bp, Homo sapiens
cacaagttaagattctt

SEQ ID NO: 6690167 - DNA, 16 bp, Homo sapiens
cacaagttatttaaat

SEQ ID NO: 6690168 - DNA, 20 bp, Homo sapiens
cacaagttcatctcatttgt

SEQ ID NO: 6690169 - DNA, 14 bp, Homo sapiens
cacaagttccctgg

SEQ ID NO: 6690170 - DNA, 20 bp, Homo sapiens
cacaagttccctggagaaaa

SEQ ID NO: 6690171 - DNA, 18 bp, Homo sapiens
cacaagtttttttgttca

SEQ ID NO: 6690172 - DNA, 13 bp, Homo sapiens
cacaataaaaaat

SEQ ID NO: 6690173 - DNA, 18 bp, Homo sapiens
cacaataaaaccaagcct

SEQ ID NO: 6690174 - DNA, 11 bp, Homo sapiens
cacaataaaca

SEQ ID NO: 6690175 - DNA, 14 bp, Homo sapiens
cacaataaagtgta

SEQ ID NO: 6690176 - DNA, 13 bp, Homo sapiens
cacaataaatggc

SEQ ID NO: 6690177 - DNA, 19 bp, Homo sapiens
cacaataaatgtattcaaa

SEQ ID NO: 6690178 - DNA, 18 bp, Homo sapiens
cacaataagagtctcctt

SEQ ID NO: 6690179 - DNA, 15 bp, Homo sapiens
cacaataattttcta

SEQ ID NO: 6690180 - DNA, 13 bp, Homo sapiens
cacaatacagtat

SEQ ID NO: 6690181 - DNA, 11 bp, Homo sapiens
cacaataccta

SEQ ID NO: 6690182 - DNA, 21 bp, Homo sapiens
cacaatacctacaataaactg

SEQ ID NO: 6690183 - DNA, 17 bp, Homo sapiens
cacaatagacagaaaca

SEQ ID NO: 6690184 - DNA, 18 bp, Homo sapiens
cacaataggtctttctct

SEQ ID NO: 6690185 - DNA, 19 bp, Homo sapiens
cacaatatacgaaaagcca

SEQ ID NO: 6690186 - DNA, 18 bp, Homo sapiens
cacaatatagttttttct

SEQ ID NO: 6690187 - DNA, 12 bp, Homo sapiens
cacaatatgaat

SEQ ID NO: 6690188 - DNA, 14 bp, Homo sapiens
cacaatatgtatgc

SEQ ID NO: 6690189 - DNA, 15 bp, Homo sapiens
cacaatattgaactt

SEQ ID NO: 6690190 - DNA, 13 bp, Homo sapiens
cacaatatttctt

SEQ ID NO: 6690191 - DNA, 14 bp, Homo sapiens
cacaatcaataaaa

SEQ ID NO: 6690192 - DNA, 20 bp, Homo sapiens
cacaatcactaaactttatt

SEQ ID NO: 6690193 - DNA, 15 bp, Homo sapiens
cacaatcactaaata

SEQ ID NO: 6690194 - DNA, 17 bp, Homo sapiens
cacaatcagaccaagga

SEQ ID NO: 6690195 - DNA, 19 bp, Homo sapiens
cacaatcccacctagccca

SEQ ID NO: 6690196 - DNA, 20 bp, Homo sapiens
cacaatcccacctagcccag

SEQ ID NO: 6690197 - DNA, 14 bp, Homo sapiens
cacaatccctgggg

SEQ ID NO: 6690198 - DNA, 16 bp, Homo sapiens
cacaatccctggggct

SEQ ID NO: 6690199 - DNA, 22 bp, Homo sapiens
cacaatcctaacacattatcgg

SEQ ID NO: 6690200 - DNA, 19 bp, Homo sapiens
cacaatctcagctcactgt

SEQ ID NO: 6690201 - DNA, 20 bp, Homo sapiens
cacaatctggcttagtgcca

SEQ ID NO: 6690202 - DNA, 21 bp, Homo sapiens
cacaatctggcttagtgccac

SEQ ID NO: 6690203 - DNA, 18 bp, Homo sapiens
cacaatctgggactttca

SEQ ID NO: 6690204 - DNA, 20 bp, Homo sapiens
cacaatctgggactttcact

SEQ ID NO: 6690205 - DNA, 15 bp, Homo sapiens
cacaatctgttctac

SEQ ID NO: 6690206 - DNA, 18 bp, Homo sapiens
cacaatcttaaggggcag

SEQ ID NO: 6690207 - DNA, 15 bp, Homo sapiens
cacaatgaatgtata

SEQ ID NO: 6690208 - DNA, 17 bp, Homo sapiens
cacaatgagatgcatga

SEQ ID NO: 6690209 - DNA, 23 bp, Homo sapiens
cacaatgatgattaaacacctga

SEQ ID NO: 6690210 - DNA, 13 bp, Homo sapiens
cacaatggcaagc

SEQ ID NO: 6690211 - DNA, 14 bp, Homo sapiens
cacaatggcacctc

SEQ ID NO: 6690212 - DNA, 20 bp, Homo sapiens
cacaatggcacctctgccct

SEQ ID NO: 6690213 - DNA, 17 bp, Homo sapiens
cacaatggctgggaggg

SEQ ID NO: 6690214 - DNA, 23 bp, Homo sapiens
cacaatggctgggagggggccct

SEQ ID NO: 6690215 - DNA, 15 bp, Homo sapiens
cacaatggtagctct

SEQ ID NO: 6690216 - DNA, 21 bp, Homo sapiens
cacaatggtttcaaagaaaga

SEQ ID NO: 6690217 - DNA, 22 bp, Homo sapiens
cacaatgtatacttcagtgctc

SEQ ID NO: 6690218 - DNA, 16 bp, Homo sapiens
cacaatgtcagtattt

SEQ ID NO: 6690219 - DNA, 11 bp, Homo sapiens
cacaatgtctt

SEQ ID NO: 6690220 - DNA, 23 bp, Homo sapiens
cacaatgtcttgtttcagtccat

SEQ ID NO: 6690221 - DNA, 17 bp, Homo sapiens
cacaatgtgaaactgaa

SEQ ID NO: 6690222 - DNA, 24 bp, Homo sapiens
cacaatgtggacgtgcactgacag

SEQ ID NO: 6690223 - DNA, 15 bp, Homo sapiens
cacaatgttctttat

SEQ ID NO: 6690224 - DNA, 22 bp, Homo sapiens
cacaatgttctttatatacaat

SEQ ID NO: 6690225 - DNA, 22 bp, Homo sapiens
cacaatgttgctagttttttgc

SEQ ID NO: 6690226 - DNA, 22 bp, Homo sapiens
cacaatgttggagcagcaggcc

SEQ ID NO: 6690227 - DNA, 23 bp, Homo sapiens
cacaatgtttcttcatttctctg

SEQ ID NO: 6690228 - DNA, 23 bp, Homo sapiens
cacaattattttaatattggata

SEQ ID NO: 6690229 - DNA, 19 bp, Homo sapiens
cacaattcattggctcctg

SEQ ID NO: 6690230 - DNA, 16 bp, Homo sapiens
cacaattcattgttaa

SEQ ID NO: 6690231 - DNA, 20 bp, Homo sapiens
cacaattccagactttctat

SEQ ID NO: 6690232 - DNA, 16 bp, Homo sapiens
cacaattcctgtgctc

SEQ ID NO: 6690233 - DNA, 16 bp, Homo sapiens
cacaattctgtccctg

SEQ ID NO: 6690234 - DNA, 16 bp, Homo sapiens
cacaattgttttacct

SEQ ID NO: 6690235 - DNA, 17 bp, Homo sapiens
cacaattgttttacctg

SEQ ID NO: 6690236 - DNA, 12 bp, Homo sapiens
cacaatttaaaa

SEQ ID NO: 6690237 - DNA, 16 bp, Homo sapiens
cacaatttaaaacaat

SEQ ID NO: 6690238 - DNA, 22 bp, Homo sapiens
cacaatttagaaaacattcatc

SEQ ID NO: 6690239 - DNA, 13 bp, Homo sapiens
cacaatttatatt

SEQ ID NO: 6690240 - DNA, 23 bp, Homo sapiens
cacaatttcatttccagcatttt

SEQ ID NO: 6690241 - DNA, 18 bp, Homo sapiens
cacaatttctttaaaaaa

SEQ ID NO: 6690242 - DNA, 20 bp, Homo sapiens
cacaatttctttaaaaaaga

SEQ ID NO: 6690243 - DNA, 22 bp, Homo sapiens
cacaatttctttaaaaaagaaa

SEQ ID NO: 6690244 - DNA, 18 bp, Homo sapiens
cacaatttgagcaattca

SEQ ID NO: 6690245 - DNA, 22 bp, Homo sapiens
cacaatttgttgaatctcaggt

SEQ ID NO: 6690246 - DNA, 21 bp, Homo sapiens
cacaattttattttttttctg

SEQ ID NO: 6690247 - DNA, 23 bp, Homo sapiens
cacaattttcaggtttcttaaaa

SEQ ID NO: 6690248 - DNA, 16 bp, Homo sapiens
cacaattttgtctcta

SEQ ID NO: 6690249 - DNA, 13 bp, Homo sapiens
cacaatttttaat

SEQ ID NO: 6690250 - DNA, 14 bp, Homo sapiens
cacaatttttaatg

SEQ ID NO: 6690251 - DNA, 13 bp, Homo sapiens
cacacaaaaaaag

SEQ ID NO: 6690252 - DNA, 15 bp, Homo sapiens
cacacaaaaaaagac

SEQ ID NO: 6690253 - DNA, 22 bp, Homo sapiens
cacacaaaaaccttggcataag

SEQ ID NO: 6690254 - DNA, 20 bp, Homo sapiens
cacacaaaaaggagcgggca

SEQ ID NO: 6690255 - DNA, 23 bp, Homo sapiens
cacacaaaaaggagcgggcaggg

SEQ ID NO: 6690256 - DNA, 17 bp, Homo sapiens
cacacaaaacaacagca

SEQ ID NO: 6690257 - DNA, 23 bp, Homo sapiens
cacacaaaacaacagcaacaaca

SEQ ID NO: 6690258 - DNA, 16 bp, Homo sapiens
cacacaaaatgtcaca

SEQ ID NO: 6690259 - DNA, 10 bp, Homo sapiens
cacacaaaca

SEQ ID NO: 6690260 - DNA, 15 bp, Homo sapiens
cacacaaacacctcc

SEQ ID NO: 6690261 - DNA, 16 bp, Homo sapiens
cacacaaacacctcct

SEQ ID NO: 6690262 - DNA, 20 bp, Homo sapiens
cacacaaacacctcctagca

SEQ ID NO: 6690263 - DNA, 18 bp, Homo sapiens
cacacaaaccattttatt

SEQ ID NO: 6690264 - DNA, 18 bp, Homo sapiens
cacacaaaggtataattt

SEQ ID NO: 6690265 - DNA, 16 bp, Homo sapiens
cacacaaagtgaaatt

SEQ ID NO: 6690266 - DNA, 16 bp, Homo sapiens
cacacaaatattgctt

SEQ ID NO: 6690267 - DNA, 11 bp, Homo sapiens
cacacaaatgc

SEQ ID NO: 6690268 - DNA, 23 bp, Homo sapiens
cacacaaatgcagacacacaaca

SEQ ID NO: 6690269 - DNA, 13 bp, Homo sapiens
cacacaacaaaaa

SEQ ID NO: 6690270 - DNA, 14 bp, Homo sapiens
cacacaacaccagg

SEQ ID NO: 6690271 - DNA, 17 bp, Homo sapiens
cacacaacaccaggact

SEQ ID NO: 6690272 - DNA, 15 bp, Homo sapiens
cacacaaggaactct

SEQ ID NO: 6690273 - DNA, 19 bp, Homo sapiens
cacacaaggatagatgctg

SEQ ID NO: 6690274 - DNA, 19 bp, Homo sapiens
cacacaagggaaggacaga

SEQ ID NO: 6690275 - DNA, 14 bp, Homo sapiens
cacacaaggtgctc

SEQ ID NO: 6690276 - DNA, 16 bp, Homo sapiens
cacacaaggtgctcag

SEQ ID NO: 6690277 - DNA, 16 bp, Homo sapiens
cacacaagtaagagac

SEQ ID NO: 6690278 - DNA, 21 bp, Homo sapiens
cacacaagtaagagactcagc

SEQ ID NO: 6690279 - DNA, 17 bp, Homo sapiens
cacacacaaaaaaagac

SEQ ID NO: 6690280 - DNA, 14 bp, Homo sapiens
cacacacaaaacaa

SEQ ID NO: 6690281 - DNA, 15 bp, Homo sapiens
cacacacaaaacaac

SEQ ID NO: 6690282 - DNA, 19 bp, Homo sapiens
cacacacaaaacaacagca

SEQ ID NO: 6690283 - DNA, 13 bp, Homo sapiens
cacacacaaaact

SEQ ID NO: 6690284 - DNA, 14 bp, Homo sapiens
cacacacaaacctt

SEQ ID NO: 6690285 - DNA, 13 bp, Homo sapiens
cacacacaaagag

SEQ ID NO: 6690286 - DNA, 15 bp, Homo sapiens
cacacacaacagcca

SEQ ID NO: 6690287 - DNA, 16 bp, Homo sapiens
cacacacaataaagaa

SEQ ID NO: 6690288 - DNA, 12 bp, Homo sapiens
cacacacacaaa

SEQ ID NO: 6690289 - DNA, 15 bp, Homo sapiens
cacacacacaaaaca

SEQ ID NO: 6690290 - DNA, 13 bp, Homo sapiens
cacacacacacaa

SEQ ID NO: 6690291 - DNA, 14 bp, Homo sapiens
cacacacacacaag

SEQ ID NO: 6690292 - DNA, 13 bp, Homo sapiens
cacacacacacac

SEQ ID NO: 6690293 - DNA, 15 bp, Homo sapiens
cacacacacacacaa

SEQ ID NO: 6690294 - DNA, 16 bp, Homo sapiens
cacacacacacacagg

SEQ ID NO: 6690295 - DNA, 15 bp, Homo sapiens
cacacacacacacga

SEQ ID NO: 6690296 - DNA, 13 bp, Homo sapiens
cacacacacacat

SEQ ID NO: 6690297 - DNA, 15 bp, Homo sapiens
cacacacacacatgc

SEQ ID NO: 6690298 - DNA, 16 bp, Homo sapiens
cacacacacacatgca

SEQ ID NO: 6690299 - DNA, 12 bp, Homo sapiens
cacacacacacc

SEQ ID NO: 6690300 - DNA, 15 bp, Homo sapiens
cacacacacacgatg

SEQ ID NO: 6690301 - DNA, 13 bp, Homo sapiens
cacacacacacgc

SEQ ID NO: 6690302 - DNA, 14 bp, Homo sapiens
cacacacacacgca

SEQ ID NO: 6690303 - DNA, 12 bp, Homo sapiens
cacacacacact

SEQ ID NO: 6690304 - DNA, 13 bp, Homo sapiens
cacacacacactc

SEQ ID NO: 6690305 - DNA, 12 bp, Homo sapiens
cacacacacaga

SEQ ID NO: 6690306 - DNA, 13 bp, Homo sapiens
cacacacacagcc

SEQ ID NO: 6690307 - DNA, 16 bp, Homo sapiens
cacacacacagccagg

SEQ ID NO: 6690308 - DNA, 14 bp, Homo sapiens
cacacacacagctg

SEQ ID NO: 6690309 - DNA, 13 bp, Homo sapiens
cacacacacagga

SEQ ID NO: 6690310 - DNA, 12 bp, Homo sapiens
cacacacacata

SEQ ID NO: 6690311 - DNA, 14 bp, Homo sapiens
cacacacacataca

SEQ ID NO: 6690312 - DNA, 15 bp, Homo sapiens
cacacacacatacac

SEQ ID NO: 6690313 - DNA, 14 bp, Homo sapiens
cacacacacatata

SEQ ID NO: 6690314 - DNA, 12 bp, Homo sapiens
cacacacacatc

SEQ ID NO: 6690315 - DNA, 13 bp, Homo sapiens
cacacacacatgc

SEQ ID NO: 6690316 - DNA, 14 bp, Homo sapiens
cacacacacatgca

SEQ ID NO: 6690317 - DNA, 14 bp, Homo sapiens
cacacacacccttc

SEQ ID NO: 6690318 - DNA, 11 bp, Homo sapiens
cacacacacga

SEQ ID NO: 6690319 - DNA, 15 bp, Homo sapiens
cacacacacgatgca

SEQ ID NO: 6690320 - DNA, 12 bp, Homo sapiens
cacacacactcc

SEQ ID NO: 6690321 - DNA, 13 bp, Homo sapiens
cacacacactccc

SEQ ID NO: 6690322 - DNA, 14 bp, Homo sapiens
cacacacactccct

SEQ ID NO: 6690323 - DNA, 13 bp, Homo sapiens
cacacacactcct

SEQ ID NO: 6690324 - DNA, 13 bp, Homo sapiens
cacacacactcta

SEQ ID NO: 6690325 - DNA, 13 bp, Homo sapiens
cacacacagaaaa

SEQ ID NO: 6690326 - DNA, 12 bp, Homo sapiens
cacacacagagg

SEQ ID NO: 6690327 - DNA, 19 bp, Homo sapiens
cacacacagatatgcacac

SEQ ID NO: 6690328 - DNA, 12 bp, Homo sapiens
cacacacagcca

SEQ ID NO: 6690329 - DNA, 13 bp, Homo sapiens
cacacacagcccc

SEQ ID NO: 6690330 - DNA, 15 bp, Homo sapiens
cacacacagcctggc

SEQ ID NO: 6690331 - DNA, 15 bp, Homo sapiens
cacacacagcctgtc

SEQ ID NO: 6690332 - DNA, 16 bp, Homo sapiens
cacacacagctgggca

SEQ ID NO: 6690333 - DNA, 22 bp, Homo sapiens
cacacacagctgggcaaagcca

SEQ ID NO: 6690334 - DNA, 10 bp, Homo sapiens
cacacacagg

SEQ ID NO: 6690335 - DNA, 12 bp, Homo sapiens
cacacacaggag

SEQ ID NO: 6690336 - DNA, 15 bp, Homo sapiens
cacacacaggagcat

SEQ ID NO: 6690337 - DNA, 15 bp, Homo sapiens
cacacacaggccttc

SEQ ID NO: 6690338 - DNA, 12 bp, Homo sapiens
cacacacaggtg

SEQ ID NO: 6690339 - DNA, 13 bp, Homo sapiens
cacacacatctgg

SEQ ID NO: 6690340 - DNA, 12 bp, Homo sapiens
cacacacatgca

SEQ ID NO: 6690341 - DNA, 16 bp, Homo sapiens
cacacacatgcataca

SEQ ID NO: 6690342 - DNA, 17 bp, Homo sapiens
cacacacatgcatacac

SEQ ID NO: 6690343 - DNA, 18 bp, Homo sapiens
cacacacatgctaggatg

SEQ ID NO: 6690344 - DNA, 23 bp, Homo sapiens
cacacacatttggaatgcacaca

SEQ ID NO: 6690345 - DNA, 15 bp, Homo sapiens
cacacaccacagaag

SEQ ID NO: 6690346 - DNA, 15 bp, Homo sapiens
cacacaccagcactt

SEQ ID NO: 6690347 - DNA, 18 bp, Homo sapiens
cacacaccctgaggtcag

SEQ ID NO: 6690348 - DNA, 21 bp, Homo sapiens
cacacacctatggctggctgg

SEQ ID NO: 6690349 - DNA, 15 bp, Homo sapiens
cacacacctctgccc

SEQ ID NO: 6690350 - DNA, 14 bp, Homo sapiens
cacacacctgcaca

SEQ ID NO: 6690351 - DNA, 12 bp, Homo sapiens
cacacacctgcc

SEQ ID NO: 6690352 - DNA, 15 bp, Homo sapiens
cacacacctgcctgc

SEQ ID NO: 6690353 - DNA, 23 bp, Homo sapiens
cacacacctgtctgtgcagatgc

SEQ ID NO: 6690354 - DNA, 22 bp, Homo sapiens
cacacacgatgcatttaataaa

SEQ ID NO: 6690355 - DNA, 18 bp, Homo sapiens
cacacacgcacgcacaca

SEQ ID NO: 6690356 - DNA, 14 bp, Homo sapiens
cacacacgcagaca

SEQ ID NO: 6690357 - DNA, 15 bp, Homo sapiens
cacacacgcagacac

SEQ ID NO: 6690358 - DNA, 17 bp, Homo sapiens
cacacacgcagacacac

SEQ ID NO: 6690359 - DNA, 13 bp, Homo sapiens
cacacacgccagc

SEQ ID NO: 6690360 - DNA, 16 bp, Homo sapiens
cacacacgccagctcc

SEQ ID NO: 6690361 - DNA, 17 bp, Homo sapiens
cacacacgccagctcct

SEQ ID NO: 6690362 - DNA, 18 bp, Homo sapiens
cacacacgccttcatgcc

SEQ ID NO: 6690363 - DNA, 18 bp, Homo sapiens
cacacacgcgtccacata

SEQ ID NO: 6690364 - DNA, 15 bp, Homo sapiens
cacacacgctccctg

SEQ ID NO: 6690365 - DNA, 17 bp, Homo sapiens
cacacacggaggccaga

SEQ ID NO: 6690366 - DNA, 21 bp, Homo sapiens
cacacactcaccagtggcctt

SEQ ID NO: 6690367 - DNA, 16 bp, Homo sapiens
cacacactccttcccc

SEQ ID NO: 6690368 - DNA, 17 bp, Homo sapiens
cacacactccttcccct

SEQ ID NO: 6690369 - DNA, 13 bp, Homo sapiens
cacacactgacca

SEQ ID NO: 6690370 - DNA, 19 bp, Homo sapiens
cacacactgagttgcacat

SEQ ID NO: 6690371 - DNA, 20 bp, Homo sapiens
cacacactgagttgcacata

SEQ ID NO: 6690372 - DNA, 14 bp, Homo sapiens
cacacactgatgct

SEQ ID NO: 6690373 - DNA, 10 bp, Homo sapiens
cacacactgg

SEQ ID NO: 6690374 - DNA, 11 bp, Homo sapiens
cacacactgga

SEQ ID NO: 6690375 - DNA, 14 bp, Homo sapiens
cacacactggaccc

SEQ ID NO: 6690376 - DNA, 20 bp, Homo sapiens
cacacactggaccccactgg

SEQ ID NO: 6690377 - DNA, 22 bp, Homo sapiens
cacacactgtgctttctattgt

SEQ ID NO: 6690378 - DNA, 23 bp, Homo sapiens
cacacactgtgctttctattgta

SEQ ID NO: 6690379 - DNA, 14 bp, Homo sapiens
cacacactttccat

SEQ ID NO: 6690380 - DNA, 18 bp, Homo sapiens
cacacactttccatctct

SEQ ID NO: 6690381 - DNA, 19 bp, Homo sapiens
cacacactttccatctctg

SEQ ID NO: 6690382 - DNA, 12 bp, Homo sapiens
cacacagaaaat

SEQ ID NO: 6690383 - DNA, 13 bp, Homo sapiens
cacacagaaaata

SEQ ID NO: 6690384 - DNA, 15 bp, Homo sapiens
cacacagaaaatata

SEQ ID NO: 6690385 - DNA, 16 bp, Homo sapiens
cacacagaaaatatac

SEQ ID NO: 6690386 - DNA, 17 bp, Homo sapiens
cacacagaaaatatact

SEQ ID NO: 6690387 - DNA, 18 bp, Homo sapiens
cacacagaaaatatactg

SEQ ID NO: 6690388 - DNA, 19 bp, Homo sapiens
cacacagaaaatatactgt

SEQ ID NO: 6690389 - DNA, 20 bp, Homo sapiens
cacacagaaaatatactgta

SEQ ID NO: 6690390 - DNA, 22 bp, Homo sapiens
cacacagaaaatatactgtaaa

SEQ ID NO: 6690391 - DNA, 18 bp, Homo sapiens
cacacagaaatatatata

SEQ ID NO: 6690392 - DNA, 22 bp, Homo sapiens
cacacagaaatatatatacata

SEQ ID NO: 6690393 - DNA, 12 bp, Homo sapiens
cacacagaaggg

SEQ ID NO: 6690394 - DNA, 14 bp, Homo sapiens
cacacagacacaca

SEQ ID NO: 6690395 - DNA, 17 bp, Homo sapiens
cacacagacacacaagc

SEQ ID NO: 6690396 - DNA, 20 bp, Homo sapiens
cacacagacctcgagtttct

SEQ ID NO: 6690397 - DNA, 20 bp, Homo sapiens
cacacagactcatattactg

SEQ ID NO: 6690398 - DNA, 22 bp, Homo sapiens
cacacagactgttgtccctgca

SEQ ID NO: 6690399 - DNA, 16 bp, Homo sapiens
cacacagagatatgca

SEQ ID NO: 6690400 - DNA, 21 bp, Homo sapiens
cacacagagatttgagaacca

SEQ ID NO: 6690401 - DNA, 15 bp, Homo sapiens
cacacagagcctgcc

SEQ ID NO: 6690402 - DNA, 19 bp, Homo sapiens
cacacagagcctgcctcag

SEQ ID NO: 6690403 - DNA, 20 bp, Homo sapiens
cacacagagcgcctcacctg

SEQ ID NO: 6690404 - DNA, 12 bp, Homo sapiens
cacacagaggaa

SEQ ID NO: 6690405 - DNA, 17 bp, Homo sapiens
cacacagaggacctctt

SEQ ID NO: 6690406 - DNA, 21 bp, Homo sapiens
cacacagaggctgcctctccc

SEQ ID NO: 6690407 - DNA, 20 bp, Homo sapiens
cacacagatatgcacacaca

SEQ ID NO: 6690408 - DNA, 13 bp, Homo sapiens
cacacagatgcac

SEQ ID NO: 6690409 - DNA, 18 bp, Homo sapiens
cacacagatgcacacaca

SEQ ID NO: 6690410 - DNA, 19 bp, Homo sapiens
cacacagatggtcacacag

SEQ ID NO: 6690411 - DNA, 20 bp, Homo sapiens
cacacagatttgagctcagc

SEQ ID NO: 6690412 - DNA, 14 bp, Homo sapiens
cacacagcactctc

SEQ ID NO: 6690413 - DNA, 18 bp, Homo sapiens
cacacagcactctctaaa

SEQ ID NO: 6690414 - DNA, 13 bp, Homo sapiens
cacacagcagccc

SEQ ID NO: 6690415 - DNA, 12 bp, Homo sapiens
cacacagcagcg

SEQ ID NO: 6690416 - DNA, 12 bp, Homo sapiens
cacacagcagct

SEQ ID NO: 6690417 - DNA, 11 bp, Homo sapiens
cacacagccac

SEQ ID NO: 6690418 - DNA, 17 bp, Homo sapiens
cacacagccacacacac

SEQ ID NO: 6690419 - DNA, 22 bp, Homo sapiens
cacacagccacacacacagaaa

SEQ ID NO: 6690420 - DNA, 11 bp, Homo sapiens
cacacagccat

SEQ ID NO: 6690421 - DNA, 15 bp, Homo sapiens
cacacagccattcat

SEQ ID NO: 6690422 - DNA, 19 bp, Homo sapiens
cacacagcccagaaggcca

SEQ ID NO: 6690423 - DNA, 13 bp, Homo sapiens
cacacagccccta

SEQ ID NO: 6690424 - DNA, 14 bp, Homo sapiens
cacacagcctggcc

SEQ ID NO: 6690425 - DNA, 15 bp, Homo sapiens
cacacagcctttctg

SEQ ID NO: 6690426 - DNA, 20 bp, Homo sapiens
cacacagcctttctgtatca

SEQ ID NO: 6690427 - DNA, 18 bp, Homo sapiens
cacacagctactctcccc

SEQ ID NO: 6690428 - DNA, 22 bp, Homo sapiens
cacacagctaggcatgcctggg

SEQ ID NO: 6690429 - DNA, 20 bp, Homo sapiens
cacacagctctgtcctggga

SEQ ID NO: 6690430 - DNA, 14 bp, Homo sapiens
cacacagctgagca

SEQ ID NO: 6690431 - DNA, 15 bp, Homo sapiens
cacacagctgagcac

SEQ ID NO: 6690432 - DNA, 13 bp, Homo sapiens
cacacagctgggc

SEQ ID NO: 6690433 - DNA, 21 bp, Homo sapiens
cacacagctggggctgtagca

SEQ ID NO: 6690434 - DNA, 14 bp, Homo sapiens
cacacaggacagcg

SEQ ID NO: 6690435 - DNA, 18 bp, Homo sapiens
cacacaggacccccttcc

SEQ ID NO: 6690436 - DNA, 19 bp, Homo sapiens
cacacaggacccccttccc

SEQ ID NO: 6690437 - DNA, 19 bp, Homo sapiens
cacacaggagtcctttctt

SEQ ID NO: 6690438 - DNA, 19 bp, Homo sapiens
cacacaggcaactgaggca

SEQ ID NO: 6690439 - DNA, 20 bp, Homo sapiens
cacacaggcaactgaggcag

SEQ ID NO: 6690440 - DNA, 16 bp, Homo sapiens
cacacaggcagccagc

SEQ ID NO: 6690441 - DNA, 20 bp, Homo sapiens
cacacaggcagccagccgtg

SEQ ID NO: 6690442 - DNA, 14 bp, Homo sapiens
cacacaggcagggc

SEQ ID NO: 6690443 - DNA, 16 bp, Homo sapiens
cacacaggcagggcct

SEQ ID NO: 6690444 - DNA, 22 bp, Homo sapiens
cacacaggcagggcctggctcc

SEQ ID NO: 6690445 - DNA, 16 bp, Homo sapiens
cacacaggcatttcct

SEQ ID NO: 6690446 - DNA, 19 bp, Homo sapiens
cacacaggcatttcctggg

SEQ ID NO: 6690447 - DNA, 21 bp, Homo sapiens
cacacaggcatttcctgggtg

SEQ ID NO: 6690448 - DNA, 16 bp, Homo sapiens
cacacaggcctggccc

SEQ ID NO: 6690449 - DNA, 12 bp, Homo sapiens
cacacaggcctt

SEQ ID NO: 6690450 - DNA, 13 bp, Homo sapiens
cacacaggccttc

SEQ ID NO: 6690451 - DNA, 15 bp, Homo sapiens
cacacaggccttctg

SEQ ID NO: 6690452 - DNA, 23 bp, Homo sapiens
cacacaggccttctgtggggctg

SEQ ID NO: 6690453 - DNA, 16 bp, Homo sapiens
cacacagggctcacag

SEQ ID NO: 6690454 - DNA, 17 bp, Homo sapiens
cacacagggctcacagg

SEQ ID NO: 6690455 - DNA, 18 bp, Homo sapiens
cacacagggctcacaggg

SEQ ID NO: 6690456 - DNA, 22 bp, Homo sapiens
cacacaggggtggagtttctga

SEQ ID NO: 6690457 - DNA, 20 bp, Homo sapiens
cacacagggtggtggcacat

SEQ ID NO: 6690458 - DNA, 23 bp, Homo sapiens
cacacaggtggggactgggcaca

SEQ ID NO: 6690459 - DNA, 22 bp, Homo sapiens
cacacaggtggtgtcactgtcc

SEQ ID NO: 6690460 - DNA, 14 bp, Homo sapiens
cacacaggtgttga

SEQ ID NO: 6690461 - DNA, 21 bp, Homo sapiens
cacacagtattaagtgacagt

SEQ ID NO: 6690462 - DNA, 13 bp, Homo sapiens
cacacagtatttt

SEQ ID NO: 6690463 - DNA, 17 bp, Homo sapiens
cacacagtcacattcga

SEQ ID NO: 6690464 - DNA, 18 bp, Homo sapiens
cacacagtccccagactc

SEQ ID NO: 6690465 - DNA, 21 bp, Homo sapiens
cacacagtgagtcgaggacag

SEQ ID NO: 6690466 - DNA, 23 bp, Homo sapiens
cacacagtgagtcgaggacaggg

SEQ ID NO: 6690467 - DNA, 19 bp, Homo sapiens
cacacagtggccggggctg

SEQ ID NO: 6690468 - DNA, 16 bp, Homo sapiens
cacacagttgttgaat

SEQ ID NO: 6690469 - DNA, 17 bp, Homo sapiens
cacacagtttaaaaaat

SEQ ID NO: 6690470 - DNA, 15 bp, Homo sapiens
cacacataacacaca

SEQ ID NO: 6690471 - DNA, 18 bp, Homo sapiens
cacacataacacacatca

SEQ ID NO: 6690472 - DNA, 18 bp, Homo sapiens
cacacatacgtgcacagg

SEQ ID NO: 6690473 - DNA, 21 bp, Homo sapiens
cacacatataaacatcacaca

SEQ ID NO: 6690474 - DNA, 17 bp, Homo sapiens
cacacatatacatatat

SEQ ID NO: 6690475 - DNA, 18 bp, Homo sapiens
cacacatatacatatata

SEQ ID NO: 6690476 - DNA, 14 bp, Homo sapiens
cacacatatacatt

SEQ ID NO: 6690477 - DNA, 12 bp, Homo sapiens
cacacatatata

SEQ ID NO: 6690478 - DNA, 23 bp, Homo sapiens
cacacatatatataacaaataat

SEQ ID NO: 6690479 - DNA, 14 bp, Homo sapiens
cacacatatatctg

SEQ ID NO: 6690480 - DNA, 17 bp, Homo sapiens
cacacatcaccaggtgc

SEQ ID NO: 6690481 - DNA, 13 bp, Homo sapiens
cacacatcaggag

SEQ ID NO: 6690482 - DNA, 15 bp, Homo sapiens
cacacatcatctgta

SEQ ID NO: 6690483 - DNA, 22 bp, Homo sapiens
cacacatcatctgtaagctgtt

SEQ ID NO: 6690484 - DNA, 23 bp, Homo sapiens
cacacatccaagagggactccaa

SEQ ID NO: 6690485 - DNA, 23 bp, Homo sapiens
cacacatccagctgcccctccct

SEQ ID NO: 6690486 - DNA, 16 bp, Homo sapiens
cacacatcccagccca

SEQ ID NO: 6690487 - DNA, 17 bp, Homo sapiens
cacacatcctgctgggc

SEQ ID NO: 6690488 - DNA, 14 bp, Homo sapiens
cacacatcctgtca

SEQ ID NO: 6690489 - DNA, 16 bp, Homo sapiens
cacacatcctgtcagt

SEQ ID NO: 6690490 - DNA, 17 bp, Homo sapiens
cacacatctggccctga

SEQ ID NO: 6690491 - DNA, 16 bp, Homo sapiens
cacacatctgtggaga

SEQ ID NO: 6690492 - DNA, 17 bp, Homo sapiens
cacacatgaagtccaag

SEQ ID NO: 6690493 - DNA, 20 bp, Homo sapiens
cacacatgagcatcaggcca

SEQ ID NO: 6690494 - DNA, 14 bp, Homo sapiens
cacacatgcataca

SEQ ID NO: 6690495 - DNA, 15 bp, Homo sapiens
cacacatgcatacac

SEQ ID NO: 6690496 - DNA, 18 bp, Homo sapiens
cacacatgcatacacaca

SEQ ID NO: 6690497 - DNA, 17 bp, Homo sapiens
cacacatgccctcctgg

SEQ ID NO: 6690498 - DNA, 17 bp, Homo sapiens
cacacatgggcagccca

SEQ ID NO: 6690499 - DNA, 20 bp, Homo sapiens
cacacatgtatattcttcct

SEQ ID NO: 6690500 - DNA, 19 bp, Homo sapiens
cacacatgtcctatccaaa

SEQ ID NO: 6690501 - DNA, 19 bp, Homo sapiens
cacacattccagggctggg

SEQ ID NO: 6690502 - DNA, 15 bp, Homo sapiens
cacacattctgcctt

SEQ ID NO: 6690503 - DNA, 16 bp, Homo sapiens
cacacattctgccttg

SEQ ID NO: 6690504 - DNA, 16 bp, Homo sapiens
cacacattggccgctt

SEQ ID NO: 6690505 - DNA, 12 bp, Homo sapiens
cacacatttaaa

SEQ ID NO: 6690506 - DNA, 13 bp, Homo sapiens
cacacatttccct

SEQ ID NO: 6690507 - DNA, 21 bp, Homo sapiens
cacacatttccctattttagg

SEQ ID NO: 6690508 - DNA, 15 bp, Homo sapiens
cacacatttctgcca

SEQ ID NO: 6690509 - DNA, 18 bp, Homo sapiens
cacacatttgtgtaaaca

SEQ ID NO: 6690510 - DNA, 14 bp, Homo sapiens
cacacattttatga

SEQ ID NO: 6690511 - DNA, 15 bp, Homo sapiens
cacacattttatgag

SEQ ID NO: 6690512 - DNA, 19 bp, Homo sapiens
cacacattttttaaatgca

SEQ ID NO: 6690513 - DNA, 16 bp, Homo sapiens
cacaccaaccaggcct

SEQ ID NO: 6690514 - DNA, 20 bp, Homo sapiens
cacaccaagctgtgccaccc

SEQ ID NO: 6690515 - DNA, 14 bp, Homo sapiens
cacaccaaggccct

SEQ ID NO: 6690516 - DNA, 21 bp, Homo sapiens
cacaccaaggccctgcatctg

SEQ ID NO: 6690517 - DNA, 13 bp, Homo sapiens
cacaccaagtggc

SEQ ID NO: 6690518 - DNA, 18 bp, Homo sapiens
cacaccaatcagagagcc

SEQ ID NO: 6690519 - DNA, 19 bp, Homo sapiens
cacaccaatcagagagcct

SEQ ID NO: 6690520 - DNA, 16 bp, Homo sapiens
cacaccaatcagcgct

SEQ ID NO: 6690521 - DNA, 19 bp, Homo sapiens
cacaccacaggatctgaac

SEQ ID NO: 6690522 - DNA, 16 bp, Homo sapiens
cacaccacatctaagc

SEQ ID NO: 6690523 - DNA, 16 bp, Homo sapiens
cacaccacgcccagct

SEQ ID NO: 6690524 - DNA, 20 bp, Homo sapiens
cacaccacgcgtcacccaac

SEQ ID NO: 6690525 - DNA, 23 bp, Homo sapiens
cacaccactaaccatccccaact

SEQ ID NO: 6690526 - DNA, 19 bp, Homo sapiens
cacaccactagcctcaggg

SEQ ID NO: 6690527 - DNA, 14 bp, Homo sapiens
cacaccactgccct

SEQ ID NO: 6690528 - DNA, 20 bp, Homo sapiens
cacaccactgccctgcctgc

SEQ ID NO: 6690529 - DNA, 19 bp, Homo sapiens
cacaccactgtactccagc

SEQ ID NO: 6690530 - DNA, 16 bp, Homo sapiens
cacaccagaagatgtg

SEQ ID NO: 6690531 - DNA, 12 bp, Homo sapiens
cacaccagagcc

SEQ ID NO: 6690532 - DNA, 22 bp, Homo sapiens
cacaccagagcccaccttggct

SEQ ID NO: 6690533 - DNA, 13 bp, Homo sapiens
cacaccagccctg

SEQ ID NO: 6690534 - DNA, 16 bp, Homo sapiens
cacaccagccgctgca

SEQ ID NO: 6690535 - DNA, 17 bp, Homo sapiens
cacaccagccgctgcag

SEQ ID NO: 6690536 - DNA, 18 bp, Homo sapiens
cacaccagccgctgcagg

SEQ ID NO: 6690537 - DNA, 19 bp, Homo sapiens
cacaccaggctgtgggcct

SEQ ID NO: 6690538 - DNA, 22 bp, Homo sapiens
cacaccaggctgtgggcctcaa

SEQ ID NO: 6690539 - DNA, 15 bp, Homo sapiens
cacaccagggccagc

SEQ ID NO: 6690540 - DNA, 16 bp, Homo sapiens
cacaccagtaataaaa

SEQ ID NO: 6690541 - DNA, 21 bp, Homo sapiens
cacaccagtaataaaaagcca

SEQ ID NO: 6690542 - DNA, 22 bp, Homo sapiens
cacaccagtaataaaaagccac

SEQ ID NO: 6690543 - DNA, 20 bp, Homo sapiens
cacaccagtccacgccgggt

SEQ ID NO: 6690544 - DNA, 23 bp, Homo sapiens
cacaccataagctactgccatcc

SEQ ID NO: 6690545 - DNA, 14 bp, Homo sapiens
cacaccatcaccct

SEQ ID NO: 6690546 - DNA, 12 bp, Homo sapiens
cacaccatctgg

SEQ ID NO: 6690547 - DNA, 16 bp, Homo sapiens
cacaccatctggccca

SEQ ID NO: 6690548 - DNA, 18 bp, Homo sapiens
cacaccatctggcccagg

SEQ ID NO: 6690549 - DNA, 20 bp, Homo sapiens
cacaccatctggcccaggct

SEQ ID NO: 6690550 - DNA, 19 bp, Homo sapiens
cacacccaaagctgagcct

SEQ ID NO: 6690551 - DNA, 20 bp, Homo sapiens
cacacccaccccctctggag

SEQ ID NO: 6690552 - DNA, 19 bp, Homo sapiens
cacacccaccccctgcctg

SEQ ID NO: 6690553 - DNA, 21 bp, Homo sapiens
cacacccaccgtccgccctgc

SEQ ID NO: 6690554 - DNA, 17 bp, Homo sapiens
cacacccacctgctgct

SEQ ID NO: 6690555 - DNA, 21 bp, Homo sapiens
cacacccagagggtagggcag

SEQ ID NO: 6690556 - DNA, 13 bp, Homo sapiens
cacacccagccag

SEQ ID NO: 6690557 - DNA, 14 bp, Homo sapiens
cacacccagcccac

SEQ ID NO: 6690558 - DNA, 20 bp, Homo sapiens
cacacccagcccacttctgc

SEQ ID NO: 6690559 - DNA, 16 bp, Homo sapiens
cacacccagcctcagt

SEQ ID NO: 6690560 - DNA, 18 bp, Homo sapiens
cacacccagcctcagtcc

SEQ ID NO: 6690561 - DNA, 15 bp, Homo sapiens
cacacccagcctctg

SEQ ID NO: 6690562 - DNA, 13 bp, Homo sapiens
cacacccagcctg

SEQ ID NO: 6690563 - DNA, 15 bp, Homo sapiens
cacacccagcctgtc

SEQ ID NO: 6690564 - DNA, 14 bp, Homo sapiens
cacacccaggaagg

SEQ ID NO: 6690565 - DNA, 15 bp, Homo sapiens
cacacccaggaaggg

SEQ ID NO: 6690566 - DNA, 14 bp, Homo sapiens
cacacccatttaaa

SEQ ID NO: 6690567 - DNA, 20 bp, Homo sapiens
cacaccccaaaactctacac

SEQ ID NO: 6690568 - DNA, 13 bp, Homo sapiens
cacaccccaaggg

SEQ ID NO: 6690569 - DNA, 14 bp, Homo sapiens
cacaccccaaggga

SEQ ID NO: 6690570 - DNA, 19 bp, Homo sapiens
cacaccccacaccccagcc

SEQ ID NO: 6690571 - DNA, 14 bp, Homo sapiens
cacaccccacctgc

SEQ ID NO: 6690572 - DNA, 15 bp, Homo sapiens
cacaccccacctgcg

SEQ ID NO: 6690573 - DNA, 16 bp, Homo sapiens
cacaccccacctgcgc

SEQ ID NO: 6690574 - DNA, 12 bp, Homo sapiens
cacaccccactc

SEQ ID NO: 6690575 - DNA, 16 bp, Homo sapiens
cacaccccagactcca

SEQ ID NO: 6690576 - DNA, 14 bp, Homo sapiens
cacaccccagccca

SEQ ID NO: 6690577 - DNA, 20 bp, Homo sapiens
cacaccccagcccaccctgc

SEQ ID NO: 6690578 - DNA, 23 bp, Homo sapiens
cacaccccagcgcctgtgctgag

SEQ ID NO: 6690579 - DNA, 23 bp, Homo sapiens
cacacccccaccccttgctctca

SEQ ID NO: 6690580 - DNA, 15 bp, Homo sapiens
cacacccccagagag

SEQ ID NO: 6690581 - DNA, 21 bp, Homo sapiens
cacacccctcagcgctccctg

SEQ ID NO: 6690582 - DNA, 16 bp, Homo sapiens
cacacccctctgctgc

SEQ ID NO: 6690583 - DNA, 14 bp, Homo sapiens
cacacccctgcaca

SEQ ID NO: 6690584 - DNA, 16 bp, Homo sapiens
cacacccctgcacaca

SEQ ID NO: 6690585 - DNA, 16 bp, Homo sapiens
cacacccctgccggcc

SEQ ID NO: 6690586 - DNA, 17 bp, Homo sapiens
cacacccctgtcccacc

SEQ ID NO: 6690587 - DNA, 23 bp, Homo sapiens
cacacccgaagtcctgtcactga

SEQ ID NO: 6690588 - DNA, 23 bp, Homo sapiens
cacacccgacaccagccctgctg

SEQ ID NO: 6690589 - DNA, 21 bp, Homo sapiens
cacaccctacagcagatccac

SEQ ID NO: 6690590 - DNA, 20 bp, Homo sapiens
cacaccctatatctccgtgt

SEQ ID NO: 6690591 - DNA, 19 bp, Homo sapiens
cacaccctccagcacagac

SEQ ID NO: 6690592 - DNA, 15 bp, Homo sapiens
cacaccctctctgtc

SEQ ID NO: 6690593 - DNA, 21 bp, Homo sapiens
cacaccctgaggtcagggagt

SEQ ID NO: 6690594 - DNA, 14 bp, Homo sapiens
cacaccctgcccct

SEQ ID NO: 6690595 - DNA, 20 bp, Homo sapiens
cacaccctgcccctgcaaag

SEQ ID NO: 6690596 - DNA, 16 bp, Homo sapiens
cacaccctgcccctgg

SEQ ID NO: 6690597 - DNA, 15 bp, Homo sapiens
cacaccctggagtgg

SEQ ID NO: 6690598 - DNA, 11 bp, Homo sapiens
cacacccttcc

SEQ ID NO: 6690599 - DNA, 16 bp, Homo sapiens
cacacccttccccact

SEQ ID NO: 6690600 - DNA, 14 bp, Homo sapiens
cacaccgccatcct

SEQ ID NO: 6690601 - DNA, 15 bp, Homo sapiens
cacaccgccatcctc

SEQ ID NO: 6690602 - DNA, 16 bp, Homo sapiens
cacaccgcgtcccagc

SEQ ID NO: 6690603 - DNA, 20 bp, Homo sapiens
cacaccgcgtcccagctccc

SEQ ID NO: 6690604 - DNA, 22 bp, Homo sapiens
cacaccgctggtccctgccctc

SEQ ID NO: 6690605 - DNA, 13 bp, Homo sapiens
cacaccggcactg

SEQ ID NO: 6690606 - DNA, 17 bp, Homo sapiens
cacaccgggcactcaga

SEQ ID NO: 6690607 - DNA, 19 bp, Homo sapiens
cacaccggtaccctcctcc

SEQ ID NO: 6690608 - DNA, 20 bp, Homo sapiens
cacaccggtaccctcctccc

SEQ ID NO: 6690609 - DNA, 17 bp, Homo sapiens
cacaccggtcaccgaga

SEQ ID NO: 6690610 - DNA, 15 bp, Homo sapiens
cacaccgtgagcaga

SEQ ID NO: 6690611 - DNA, 23 bp, Homo sapiens
cacaccgtggcagcttgctgggc

SEQ ID NO: 6690612 - DNA, 20 bp, Homo sapiens
cacaccgtgtaaaccaaagc

SEQ ID NO: 6690613 - DNA, 16 bp, Homo sapiens
cacacctaaattaaca

SEQ ID NO: 6690614 - DNA, 15 bp, Homo sapiens
cacacctagccagct

SEQ ID NO: 6690615 - DNA, 14 bp, Homo sapiens
cacacctcacgctc

SEQ ID NO: 6690616 - DNA, 22 bp, Homo sapiens
cacacctcactgtcatctgcca

SEQ ID NO: 6690617 - DNA, 15 bp, Homo sapiens
cacacctcagaggct

SEQ ID NO: 6690618 - DNA, 15 bp, Homo sapiens
cacacctccccctgc

SEQ ID NO: 6690619 - DNA, 16 bp, Homo sapiens
cacacctccctgaacc

SEQ ID NO: 6690620 - DNA, 15 bp, Homo sapiens
cacacctccgagaca

SEQ ID NO: 6690621 - DNA, 19 bp, Homo sapiens
cacacctcctcccactgcc

SEQ ID NO: 6690622 - DNA, 13 bp, Homo sapiens
cacacctcctggg

SEQ ID NO: 6690623 - DNA, 15 bp, Homo sapiens
cacacctccttttct

SEQ ID NO: 6690624 - DNA, 17 bp, Homo sapiens
cacacctccttttcttc

SEQ ID NO: 6690625 - DNA, 15 bp, Homo sapiens
cacacctctgccacc

SEQ ID NO: 6690626 - DNA, 11 bp, Homo sapiens
cacacctctgg

SEQ ID NO: 6690627 - DNA, 21 bp, Homo sapiens
cacacctctggatccctggag

SEQ ID NO: 6690628 - DNA, 14 bp, Homo sapiens
cacacctctgggct

SEQ ID NO: 6690629 - DNA, 16 bp, Homo sapiens
cacacctctgggcttc

SEQ ID NO: 6690630 - DNA, 14 bp, Homo sapiens
cacacctgacaaat

SEQ ID NO: 6690631 - DNA, 16 bp, Homo sapiens
cacacctgacaaatgg

SEQ ID NO: 6690632 - DNA, 20 bp, Homo sapiens
cacacctgagcgctgtggac

SEQ ID NO: 6690633 - DNA, 20 bp, Homo sapiens
cacacctgcaatcccagcac

SEQ ID NO: 6690634 - DNA, 19 bp, Homo sapiens
cacacctgcacaccgtccc

SEQ ID NO: 6690635 - DNA, 12 bp, Homo sapiens
cacacctgcctg

SEQ ID NO: 6690636 - DNA, 18 bp, Homo sapiens
cacacctggactgaccct

SEQ ID NO: 6690637 - DNA, 13 bp, Homo sapiens
cacacctggccct

SEQ ID NO: 6690638 - DNA, 15 bp, Homo sapiens
cacacctggccttaa

SEQ ID NO: 6690639 - DNA, 23 bp, Homo sapiens
cacacctgggcatcagggccttt

SEQ ID NO: 6690640 - DNA, 24 bp, Homo sapiens
cacacctgggcccgggcaggccag

SEQ ID NO: 6690641 - DNA, 12 bp, Homo sapiens
cacacctggtct

SEQ ID NO: 6690642 - DNA, 14 bp, Homo sapiens
cacacctgtaatcc

SEQ ID NO: 6690643 - DNA, 22 bp, Homo sapiens
cacacctgtaatcccagcactt

SEQ ID NO: 6690644 - DNA, 14 bp, Homo sapiens
cacacctgtccttc

SEQ ID NO: 6690645 - DNA, 23 bp, Homo sapiens
cacacctgtctgtgcagatgctt

SEQ ID NO: 6690646 - DNA, 12 bp, Homo sapiens
cacacctgtgtc

SEQ ID NO: 6690647 - DNA, 22 bp, Homo sapiens
cacaccttacaaagccagctct

SEQ ID NO: 6690648 - DNA, 12 bp, Homo sapiens
cacaccttaggt

SEQ ID NO: 6690649 - DNA, 17 bp, Homo sapiens
cacaccttccagggccc

SEQ ID NO: 6690650 - DNA, 21 bp, Homo sapiens
cacaccttccagggccctagg

SEQ ID NO: 6690651 - DNA, 13 bp, Homo sapiens
cacaccttgcaga

SEQ ID NO: 6690652 - DNA, 19 bp, Homo sapiens
cacaccttgcagaaggcaa

SEQ ID NO: 6690653 - DNA, 14 bp, Homo sapiens
cacaccttggagaa

SEQ ID NO: 6690654 - DNA, 14 bp, Homo sapiens
cacaccttggcctt

SEQ ID NO: 6690655 - DNA, 20 bp, Homo sapiens
cacaccttttccccaggagc

SEQ ID NO: 6690656 - DNA, 17 bp, Homo sapiens
cacacgagaacctgaag

SEQ ID NO: 6690657 - DNA, 16 bp, Homo sapiens
cacacgagttccagac

SEQ ID NO: 6690658 - DNA, 16 bp, Homo sapiens
cacacgcacacacaca

SEQ ID NO: 6690659 - DNA, 21 bp, Homo sapiens
cacacgcacatatacacacac

SEQ ID NO: 6690660 - DNA, 15 bp, Homo sapiens
cacacgcacgcacac

SEQ ID NO: 6690661 - DNA, 14 bp, Homo sapiens
cacacgcactggtg

SEQ ID NO: 6690662 - DNA, 15 bp, Homo sapiens
cacacgcactggtgc

SEQ ID NO: 6690663 - DNA, 14 bp, Homo sapiens
cacacgcagacaca

SEQ ID NO: 6690664 - DNA, 16 bp, Homo sapiens
cacacgcagacacaca

SEQ ID NO: 6690665 - DNA, 14 bp, Homo sapiens
cacacgcaggaact

SEQ ID NO: 6690666 - DNA, 17 bp, Homo sapiens
cacacgcaggcggccag

SEQ ID NO: 6690667 - DNA, 18 bp, Homo sapiens
cacacgcatgggcattgc

SEQ ID NO: 6690668 - DNA, 13 bp, Homo sapiens
cacacgccagctc

SEQ ID NO: 6690669 - DNA, 20 bp, Homo sapiens
cacacgccagctcctctctg

SEQ ID NO: 6690670 - DNA, 21 bp, Homo sapiens
cacacgccccaattttcaggt

SEQ ID NO: 6690671 - DNA, 13 bp, Homo sapiens
cacacgccccggt

SEQ ID NO: 6690672 - DNA, 21 bp, Homo sapiens
cacacgccccggtcccccaga

SEQ ID NO: 6690673 - DNA, 20 bp, Homo sapiens
cacacgccggggctggccct

SEQ ID NO: 6690674 - DNA, 23 bp, Homo sapiens
cacacgccggggctggccctgcc

SEQ ID NO: 6690675 - DNA, 16 bp, Homo sapiens
cacacgccttcatgcc

SEQ ID NO: 6690676 - DNA, 14 bp, Homo sapiens
cacacgcgcgcaca

SEQ ID NO: 6690677 - DNA, 22 bp, Homo sapiens
cacacgcgcgcgcgcgcacaca

SEQ ID NO: 6690678 - DNA, 17 bp, Homo sapiens
cacacgctccctggaag

SEQ ID NO: 6690679 - DNA, 18 bp, Homo sapiens
cacacgctccctggaagc

SEQ ID NO: 6690680 - DNA, 18 bp, Homo sapiens
cacacgctgcctcctcag

SEQ ID NO: 6690681 - DNA, 14 bp, Homo sapiens
cacacgctgtctct

SEQ ID NO: 6690682 - DNA, 14 bp, Homo sapiens
cacacggaagcaag

SEQ ID NO: 6690683 - DNA, 18 bp, Homo sapiens
cacacggaagcaagcaga

SEQ ID NO: 6690684 - DNA, 21 bp, Homo sapiens
cacacggactcccgggccacg

SEQ ID NO: 6690685 - DNA, 23 bp, Homo sapiens
cacacggactcccgggccacgcc

SEQ ID NO: 6690686 - DNA, 17 bp, Homo sapiens
cacacggagctcctggc

SEQ ID NO: 6690687 - DNA, 19 bp, Homo sapiens
cacacggagctcctggcag

SEQ ID NO: 6690688 - DNA, 15 bp, Homo sapiens
cacacggaggccaga

SEQ ID NO: 6690689 - DNA, 23 bp, Homo sapiens
cacacggaggccagacacaggcc

SEQ ID NO: 6690690 - DNA, 19 bp, Homo sapiens
cacacggcaatcagaagaa

SEQ ID NO: 6690691 - DNA, 15 bp, Homo sapiens
cacacggcacagagc

SEQ ID NO: 6690692 - DNA, 13 bp, Homo sapiens
cacacggcagccc

SEQ ID NO: 6690693 - DNA, 21 bp, Homo sapiens
cacacggcagcccccccctca

SEQ ID NO: 6690694 - DNA, 14 bp, Homo sapiens
cacacggccacccg

SEQ ID NO: 6690695 - DNA, 14 bp, Homo sapiens
cacacggccctgcc

SEQ ID NO: 6690696 - DNA, 23 bp, Homo sapiens
cacacggctcccccaggcctgag

SEQ ID NO: 6690697 - DNA, 21 bp, Homo sapiens
cacacgggaagatcatttctt

SEQ ID NO: 6690698 - DNA, 14 bp, Homo sapiens
cacacgggcctctg

SEQ ID NO: 6690699 - DNA, 21 bp, Homo sapiens
cacacgggcctctgcttgcca

SEQ ID NO: 6690700 - DNA, 23 bp, Homo sapiens
cacacgggcctctgcttgccagc

SEQ ID NO: 6690701 - DNA, 21 bp, Homo sapiens
cacacgggcgagctttctctc

SEQ ID NO: 6690702 - DNA, 20 bp, Homo sapiens
cacacggtttgaagcctgga

SEQ ID NO: 6690703 - DNA, 19 bp, Homo sapiens
cacacgtaatgaaacttgg

SEQ ID NO: 6690704 - DNA, 21 bp, Homo sapiens
cacacgtccactcccaagcca

SEQ ID NO: 6690705 - DNA, 13 bp, Homo sapiens
cacacgtgcatag

SEQ ID NO: 6690706 - DNA, 18 bp, Homo sapiens
cacacgtgctcgcagcct

SEQ ID NO: 6690707 - DNA, 20 bp, Homo sapiens
cacacgtgctcgcagcctgg

SEQ ID NO: 6690708 - DNA, 22 bp, Homo sapiens
cacacgtgctcgcagcctggcg

SEQ ID NO: 6690709 - DNA, 17 bp, Homo sapiens
cacacgtggtgacctca

SEQ ID NO: 6690710 - DNA, 16 bp, Homo sapiens
cacacgttgacgggcc

SEQ ID NO: 6690711 - DNA, 19 bp, Homo sapiens
cacacgttgacgggccgca

SEQ ID NO: 6690712 - DNA, 16 bp, Homo sapiens
cacactaaactctggg

SEQ ID NO: 6690713 - DNA, 17 bp, Homo sapiens
cacactaaactctgggg

SEQ ID NO: 6690714 - DNA, 19 bp, Homo sapiens
cacactaaactctggggct

SEQ ID NO: 6690715 - DNA, 21 bp, Homo sapiens
cacactaacctgggttccctt

SEQ ID NO: 6690716 - DNA, 18 bp, Homo sapiens
cacactacacagcacacc

SEQ ID NO: 6690717 - DNA, 22 bp, Homo sapiens
cacactacaccacacacaacag

SEQ ID NO: 6690718 - DNA, 21 bp, Homo sapiens
cacactacagagcagctcccc

SEQ ID NO: 6690719 - DNA, 16 bp, Homo sapiens
cacactaccgaatgtg

SEQ ID NO: 6690720 - DNA, 14 bp, Homo sapiens
cacactactacctc

SEQ ID NO: 6690721 - DNA, 17 bp, Homo sapiens
cacactactacctctta

SEQ ID NO: 6690722 - DNA, 14 bp, Homo sapiens
cacactactgtatt

SEQ ID NO: 6690723 - DNA, 18 bp, Homo sapiens
cacactagcctctccagg

SEQ ID NO: 6690724 - DNA, 13 bp, Homo sapiens
cacactagccttc

SEQ ID NO: 6690725 - DNA, 17 bp, Homo sapiens
cacactagggactatca

SEQ ID NO: 6690726 - DNA, 18 bp, Homo sapiens
cacactatcatagttaac

SEQ ID NO: 6690727 - DNA, 18 bp, Homo sapiens
cacactattaccatgaga

SEQ ID NO: 6690728 - DNA, 19 bp, Homo sapiens
cacactcaaatcaagaaac

SEQ ID NO: 6690729 - DNA, 14 bp, Homo sapiens
cacactcaaggaca

SEQ ID NO: 6690730 - DNA, 20 bp, Homo sapiens
cacactcaaggacaggagcc

SEQ ID NO: 6690731 - DNA, 21 bp, Homo sapiens
cacactcaaggacaggagcct

SEQ ID NO: 6690732 - DNA, 16 bp, Homo sapiens
cacactcaccagtggc

SEQ ID NO: 6690733 - DNA, 17 bp, Homo sapiens
cacactcaccagtggcc

SEQ ID NO: 6690734 - DNA, 13 bp, Homo sapiens
cacactcacctct

SEQ ID NO: 6690735 - DNA, 20 bp, Homo sapiens
cacactcagaaaattccctg

SEQ ID NO: 6690736 - DNA, 21 bp, Homo sapiens
cacactcagaaaattccctgg

SEQ ID NO: 6690737 - DNA, 20 bp, Homo sapiens
cacactcagcacccccttct

SEQ ID NO: 6690738 - DNA, 12 bp, Homo sapiens
cacactcagcca

SEQ ID NO: 6690739 - DNA, 18 bp, Homo sapiens
cacactcaggcctgtgcc

SEQ ID NO: 6690740 - DNA, 20 bp, Homo sapiens
cacactcaggcctgtgccca

SEQ ID NO: 6690741 - DNA, 20 bp, Homo sapiens
cacactcagtcccccaccac

SEQ ID NO: 6690742 - DNA, 17 bp, Homo sapiens
cacactcagttctgctc

SEQ ID NO: 6690743 - DNA, 19 bp, Homo sapiens
cacactcagttctgctcta

SEQ ID NO: 6690744 - DNA, 12 bp, Homo sapiens
cacactcatcca

SEQ ID NO: 6690745 - DNA, 19 bp, Homo sapiens
cacactcatgcattgtcct

SEQ ID NO: 6690746 - DNA, 22 bp, Homo sapiens
cacactccaagatatggacaca

SEQ ID NO: 6690747 - DNA, 14 bp, Homo sapiens
cacactccactctg

SEQ ID NO: 6690748 - DNA, 18 bp, Homo sapiens
cacactcccaaactccaa

SEQ ID NO: 6690749 - DNA, 14 bp, Homo sapiens
cacactcccaaggt

SEQ ID NO: 6690750 - DNA, 21 bp, Homo sapiens
cacactcccaaggttggagcc

SEQ ID NO: 6690751 - DNA, 23 bp, Homo sapiens
cacactcccaaggttggagccca

SEQ ID NO: 6690752 - DNA, 21 bp, Homo sapiens
cacactcccgagacggcactg

SEQ ID NO: 6690753 - DNA, 18 bp, Homo sapiens
cacactccctgcttgcag

SEQ ID NO: 6690754 - DNA, 20 bp, Homo sapiens
cacactccctgcttgcagga

SEQ ID NO: 6690755 - DNA, 13 bp, Homo sapiens
cacactccttccc

SEQ ID NO: 6690756 - DNA, 15 bp, Homo sapiens
cacactccttcccct

SEQ ID NO: 6690757 - DNA, 14 bp, Homo sapiens
cacactctaaaccc

SEQ ID NO: 6690758 - DNA, 22 bp, Homo sapiens
cacactctccatcaccctcttc

SEQ ID NO: 6690759 - DNA, 23 bp, Homo sapiens
cacactctcctgggccccaagga

SEQ ID NO: 6690760 - DNA, 15 bp, Homo sapiens
cacactctctgcagc

SEQ ID NO: 6690761 - DNA, 19 bp, Homo sapiens
cacactctctgcagcccag

SEQ ID NO: 6690762 - DNA, 20 bp, Homo sapiens
cacactctctgcagcccagc

SEQ ID NO: 6690763 - DNA, 13 bp, Homo sapiens
cacactctcttct

SEQ ID NO: 6690764 - DNA, 15 bp, Homo sapiens
cacactctcttctcc

SEQ ID NO: 6690765 - DNA, 13 bp, Homo sapiens
cacactctgcctt

SEQ ID NO: 6690766 - DNA, 18 bp, Homo sapiens
cacactgaaaccaaaaca

SEQ ID NO: 6690767 - DNA, 14 bp, Homo sapiens
cacactgaaccgct

SEQ ID NO: 6690768 - DNA, 21 bp, Homo sapiens
cacactgaataagagagcagg

SEQ ID NO: 6690769 - DNA, 15 bp, Homo sapiens
cacactgaccacact

SEQ ID NO: 6690770 - DNA, 13 bp, Homo sapiens
cacactgagctgg

SEQ ID NO: 6690771 - DNA, 17 bp, Homo sapiens
cacactgaggcagggaa

SEQ ID NO: 6690772 - DNA, 21 bp, Homo sapiens
cacactgaggcttaggcctct

SEQ ID NO: 6690773 - DNA, 16 bp, Homo sapiens
cacactgatacataaa

SEQ ID NO: 6690774 - DNA, 19 bp, Homo sapiens
cacactgatgggctggggc

SEQ ID NO: 6690775 - DNA, 22 bp, Homo sapiens
cacactgatgggctggggcagg

SEQ ID NO: 6690776 - DNA, 16 bp, Homo sapiens
cacactgcaagagcct

SEQ ID NO: 6690777 - DNA, 18 bp, Homo sapiens
cacactgcaagagccttg

SEQ ID NO: 6690778 - DNA, 18 bp, Homo sapiens
cacactgcactgttttca

SEQ ID NO: 6690779 - DNA, 16 bp, Homo sapiens
cacactgcagggagga

SEQ ID NO: 6690780 - DNA, 20 bp, Homo sapiens
cacactgcagggctgctgtg

SEQ ID NO: 6690781 - DNA, 12 bp, Homo sapiens
cacactgccaaa

SEQ ID NO: 6690782 - DNA, 15 bp, Homo sapiens
cacactgccaaataa

SEQ ID NO: 6690783 - DNA, 14 bp, Homo sapiens
cacactgccctctg

SEQ ID NO: 6690784 - DNA, 17 bp, Homo sapiens
cacactgccttattaca

SEQ ID NO: 6690785 - DNA, 15 bp, Homo sapiens
cacactgcgcaggtc

SEQ ID NO: 6690786 - DNA, 13 bp, Homo sapiens
cacactgctctta

SEQ ID NO: 6690787 - DNA, 19 bp, Homo sapiens
cacactgctcttaagaaac

SEQ ID NO: 6690788 - DNA, 15 bp, Homo sapiens
cacactgctgggaag

SEQ ID NO: 6690789 - DNA, 20 bp, Homo sapiens
cacactgctgtcctctcccc

SEQ ID NO: 6690790 - DNA, 21 bp, Homo sapiens
cacactgcttctcggaggcca

SEQ ID NO: 6690791 - DNA, 12 bp, Homo sapiens
cacactgcttgg

SEQ ID NO: 6690792 - DNA, 13 bp, Homo sapiens
cacactggaatat

SEQ ID NO: 6690793 - DNA, 12 bp, Homo sapiens
cacactggaccc

SEQ ID NO: 6690794 - DNA, 18 bp, Homo sapiens
cacactggaccccactgg

SEQ ID NO: 6690795 - DNA, 19 bp, Homo sapiens
cacactggaccccactggc

SEQ ID NO: 6690796 - DNA, 19 bp, Homo sapiens
cacactggactccggccct

SEQ ID NO: 6690797 - DNA, 22 bp, Homo sapiens
cacactggcacgtttgtgagaa

SEQ ID NO: 6690798 - DNA, 12 bp, Homo sapiens
cacactggccac

SEQ ID NO: 6690799 - DNA, 12 bp, Homo sapiens
cacactggccat

SEQ ID NO: 6690800 - DNA, 12 bp, Homo sapiens
cacactggctca

SEQ ID NO: 6690801 - DNA, 18 bp, Homo sapiens
cacactggctcctggacc

SEQ ID NO: 6690802 - DNA, 13 bp, Homo sapiens
cacactgggctca

SEQ ID NO: 6690803 - DNA, 19 bp, Homo sapiens
cacactggtacttagagtt

SEQ ID NO: 6690804 - DNA, 18 bp, Homo sapiens
cacactggtgctgagtga

SEQ ID NO: 6690805 - DNA, 19 bp, Homo sapiens
cacactggttctcaatgaa

SEQ ID NO: 6690806 - DNA, 20 bp, Homo sapiens
cacactggtttgccaggcca

SEQ ID NO: 6690807 - DNA, 16 bp, Homo sapiens
cacactgtaaacccct

SEQ ID NO: 6690808 - DNA, 20 bp, Homo sapiens
cacactgtaaacccctgggt

SEQ ID NO: 6690809 - DNA, 13 bp, Homo sapiens
cacactgtaaata

SEQ ID NO: 6690810 - DNA, 15 bp, Homo sapiens
cacactgtaacctca

SEQ ID NO: 6690811 - DNA, 23 bp, Homo sapiens
cacactgtagcattacagtgggt

SEQ ID NO: 6690812 - DNA, 15 bp, Homo sapiens
cacactgtcagagct

SEQ ID NO: 6690813 - DNA, 22 bp, Homo sapiens
cacactgtcagagctgttggcc

SEQ ID NO: 6690814 - DNA, 18 bp, Homo sapiens
cacactgtcatgcttcat

SEQ ID NO: 6690815 - DNA, 14 bp, Homo sapiens
cacactgtgacaca

SEQ ID NO: 6690816 - DNA, 19 bp, Homo sapiens
cacactgtgacacactaca

SEQ ID NO: 6690817 - DNA, 16 bp, Homo sapiens
cacactgtgccccaca

SEQ ID NO: 6690818 - DNA, 16 bp, Homo sapiens
cacactgtgctttcta

SEQ ID NO: 6690819 - DNA, 20 bp, Homo sapiens
cacactgtgtcctggtgctc

SEQ ID NO: 6690820 - DNA, 24 bp, Homo sapiens
cacactgtgtcctggtgctctctg

SEQ ID NO: 6690821 - DNA, 17 bp, Homo sapiens
cacactgtgtgaggctg

SEQ ID NO: 6690822 - DNA, 23 bp, Homo sapiens
cacactgttacacgtgcctgtag

SEQ ID NO: 6690823 - DNA, 18 bp, Homo sapiens
cacactgttactccacag

SEQ ID NO: 6690824 - DNA, 19 bp, Homo sapiens
cacacttagccattgaaat

SEQ ID NO: 6690825 - DNA, 19 bp, Homo sapiens
cacacttatattttatgaa

SEQ ID NO: 6690826 - DNA, 23 bp, Homo sapiens
cacacttatattttatgaacatt

SEQ ID NO: 6690827 - DNA, 15 bp, Homo sapiens
cacacttatttatga

SEQ ID NO: 6690828 - DNA, 22 bp, Homo sapiens
cacacttcaggctcttctcctt

SEQ ID NO: 6690829 - DNA, 21 bp, Homo sapiens
cacacttcattgtaaatcact

SEQ ID NO: 6690830 - DNA, 14 bp, Homo sapiens
cacacttccccatc

SEQ ID NO: 6690831 - DNA, 15 bp, Homo sapiens
cacacttcgctcttg

SEQ ID NO: 6690832 - DNA, 22 bp, Homo sapiens
cacacttgaagcctaaatttgt

SEQ ID NO: 6690833 - DNA, 12 bp, Homo sapiens
cacacttgacct

SEQ ID NO: 6690834 - DNA, 21 bp, Homo sapiens
cacacttgagaggatgaatgt

SEQ ID NO: 6690835 - DNA, 17 bp, Homo sapiens
cacacttgcaaatgaat

SEQ ID NO: 6690836 - DNA, 21 bp, Homo sapiens
cacacttggcccaagtggcag

SEQ ID NO: 6690837 - DNA, 13 bp, Homo sapiens
cacacttgggctg

SEQ ID NO: 6690838 - DNA, 10 bp, Homo sapiens
cacacttgtc

SEQ ID NO: 6690839 - DNA, 18 bp, Homo sapiens
cacacttgtcggctccag

SEQ ID NO: 6690840 - DNA, 18 bp, Homo sapiens
cacacttgtgccagcccg

SEQ ID NO: 6690841 - DNA, 21 bp, Homo sapiens
cacacttgtgtgtgggctgtg

SEQ ID NO: 6690842 - DNA, 19 bp, Homo sapiens
cacacttgttccagctctt

SEQ ID NO: 6690843 - DNA, 13 bp, Homo sapiens
cacactttctggg

SEQ ID NO: 6690844 - DNA, 17 bp, Homo sapiens
cacactttgagaacctg

SEQ ID NO: 6690845 - DNA, 15 bp, Homo sapiens
cacactttggcccag

SEQ ID NO: 6690846 - DNA, 18 bp, Homo sapiens
cacactttggcccagggt

SEQ ID NO: 6690847 - DNA, 14 bp, Homo sapiens
cacacttttgcaca

SEQ ID NO: 6690848 - DNA, 19 bp, Homo sapiens
cacacttttgcacatatat

SEQ ID NO: 6690849 - DNA, 21 bp, Homo sapiens
cacacttttgcacatatattt

SEQ ID NO: 6690850 - DNA, 15 bp, Homo sapiens
cacagaaaaagcatg

SEQ ID NO: 6690851 - DNA, 14 bp, Homo sapiens
cacagaaaagcata

SEQ ID NO: 6690852 - DNA, 12 bp, Homo sapiens
cacagaaaatat

SEQ ID NO: 6690853 - DNA, 18 bp, Homo sapiens
cacagaaaatatactgta

SEQ ID NO: 6690854 - DNA, 20 bp, Homo sapiens
cacagaaaatatactgtaaa

SEQ ID NO: 6690855 - DNA, 18 bp, Homo sapiens
cacagaaaatggaagaca

SEQ ID NO: 6690856 - DNA, 19 bp, Homo sapiens
cacagaaaatggaagacag

SEQ ID NO: 6690857 - DNA, 15 bp, Homo sapiens
cacagaaacactgcc

SEQ ID NO: 6690858 - DNA, 16 bp, Homo sapiens
cacagaaacactgcct

SEQ ID NO: 6690859 - DNA, 18 bp, Homo sapiens
cacagaaacttgaactcc

SEQ ID NO: 6690860 - DNA, 15 bp, Homo sapiens
cacagaaagactgag

SEQ ID NO: 6690861 - DNA, 22 bp, Homo sapiens
cacagaaagactgagctcaagg

SEQ ID NO: 6690862 - DNA, 14 bp, Homo sapiens
cacagaaagggcag

SEQ ID NO: 6690863 - DNA, 16 bp, Homo sapiens
cacagaaagggcagct

SEQ ID NO: 6690864 - DNA, 19 bp, Homo sapiens
cacagaaatatatatacat

SEQ ID NO: 6690865 - DNA, 19 bp, Homo sapiens
cacagaaatcagaggagag

SEQ ID NO: 6690866 - DNA, 17 bp, Homo sapiens
cacagaaatgagatcag

SEQ ID NO: 6690867 - DNA, 19 bp, Homo sapiens
cacagaaatgctgctggcc

SEQ ID NO: 6690868 - DNA, 23 bp, Homo sapiens
cacagaacactgggtagtagcta

SEQ ID NO: 6690869 - DNA, 22 bp, Homo sapiens
cacagaacctactgttcctttc

SEQ ID NO: 6690870 - DNA, 22 bp, Homo sapiens
cacagaacctttgtcaacttca

SEQ ID NO: 6690871 - DNA, 16 bp, Homo sapiens
cacagaactcagcctt

SEQ ID NO: 6690872 - DNA, 18 bp, Homo sapiens
cacagaactcagccttaa

SEQ ID NO: 6690873 - DNA, 15 bp, Homo sapiens
cacagaactggcagg

SEQ ID NO: 6690874 - DNA, 20 bp, Homo sapiens
cacagaagacttcccagctt

SEQ ID NO: 6690875 - DNA, 19 bp, Homo sapiens
cacagaagaggctggttct

SEQ ID NO: 6690876 - DNA, 16 bp, Homo sapiens
cacagaagccaggagc

SEQ ID NO: 6690877 - DNA, 16 bp, Homo sapiens
cacagaagggctcttt

SEQ ID NO: 6690878 - DNA, 22 bp, Homo sapiens
cacagaaggggactgccacctc

SEQ ID NO: 6690879 - DNA, 19 bp, Homo sapiens
cacagaaggtgaactttgt

SEQ ID NO: 6690880 - DNA, 14 bp, Homo sapiens
cacagaagtcctgt

SEQ ID NO: 6690881 - DNA, 22 bp, Homo sapiens
cacagaagtcctgtatgtctgt

SEQ ID NO: 6690882 - DNA, 19 bp, Homo sapiens
cacagaagtgctttcttct

SEQ ID NO: 6690883 - DNA, 18 bp, Homo sapiens
cacagaatagtttacaca

SEQ ID NO: 6690884 - DNA, 17 bp, Homo sapiens
cacagaatataggataa

SEQ ID NO: 6690885 - DNA, 12 bp, Homo sapiens
cacagaatgcaa

SEQ ID NO: 6690886 - DNA, 15 bp, Homo sapiens
cacagaatgctcagg

SEQ ID NO: 6690887 - DNA, 20 bp, Homo sapiens
cacagacaactcacattgtt

SEQ ID NO: 6690888 - DNA, 16 bp, Homo sapiens
cacagacaagcagccc

SEQ ID NO: 6690889 - DNA, 22 bp, Homo sapiens
cacagacaagcagcccttgctt

SEQ ID NO: 6690890 - DNA, 20 bp, Homo sapiens
cacagacacaatatgtatgc

SEQ ID NO: 6690891 - DNA, 19 bp, Homo sapiens
cacagacacacacacacct

SEQ ID NO: 6690892 - DNA, 20 bp, Homo sapiens
cacagacacacacacgcacg

SEQ ID NO: 6690893 - DNA, 22 bp, Homo sapiens
cacagacactaacgaaatatca

SEQ ID NO: 6690894 - DNA, 15 bp, Homo sapiens
cacagacagatccca

SEQ ID NO: 6690895 - DNA, 17 bp, Homo sapiens
cacagacagatcccatc

SEQ ID NO: 6690896 - DNA, 14 bp, Homo sapiens
cacagacaggaccc

SEQ ID NO: 6690897 - DNA, 19 bp, Homo sapiens
cacagacatactaaccagc

SEQ ID NO: 6690898 - DNA, 13 bp, Homo sapiens
cacagacatatat

SEQ ID NO: 6690899 - DNA, 20 bp, Homo sapiens
cacagaccaagtccaagccc

SEQ ID NO: 6690900 - DNA, 13 bp, Homo sapiens
cacagaccacagg

SEQ ID NO: 6690901 - DNA, 14 bp, Homo sapiens
cacagaccacagga

SEQ ID NO: 6690902 - DNA, 14 bp, Homo sapiens
cacagaccacctgc

SEQ ID NO: 6690903 - DNA, 14 bp, Homo sapiens
cacagaccaggcct

SEQ ID NO: 6690904 - DNA, 16 bp, Homo sapiens
cacagacccacacatg

SEQ ID NO: 6690905 - DNA, 16 bp, Homo sapiens
cacagacccaggaccc

SEQ ID NO: 6690906 - DNA, 22 bp, Homo sapiens
cacagaccccgggtctccttgg

SEQ ID NO: 6690907 - DNA, 15 bp, Homo sapiens
cacagacccctggga

SEQ ID NO: 6690908 - DNA, 18 bp, Homo sapiens
cacagacccctgggggag

SEQ ID NO: 6690909 - DNA, 19 bp, Homo sapiens
cacagacccctgggggagg

SEQ ID NO: 6690910 - DNA, 21 bp, Homo sapiens
cacagacccctgggggaggct

SEQ ID NO: 6690911 - DNA, 14 bp, Homo sapiens
cacagaccctgccc

SEQ ID NO: 6690912 - DNA, 15 bp, Homo sapiens
cacagaccctgccca

SEQ ID NO: 6690913 - DNA, 20 bp, Homo sapiens
cacagaccctgcccacccca

SEQ ID NO: 6690914 - DNA, 17 bp, Homo sapiens
cacagaccctgccctgt

SEQ ID NO: 6690915 - DNA, 19 bp, Homo sapiens
cacagaccctgccctgtgg

SEQ ID NO: 6690916 - DNA, 21 bp, Homo sapiens
cacagaccctgccctgtgggc

SEQ ID NO: 6690917 - DNA, 21 bp, Homo sapiens
cacagaccgcgcccctgggac

SEQ ID NO: 6690918 - DNA, 23 bp, Homo sapiens
cacagaccggccgcatgtctgca

SEQ ID NO: 6690919 - DNA, 14 bp, Homo sapiens
cacagacctcagag

SEQ ID NO: 6690920 - DNA, 22 bp, Homo sapiens
cacagacctgcagtgaggggcc

SEQ ID NO: 6690921 - DNA, 13 bp, Homo sapiens
cacagacctgctc

SEQ ID NO: 6690922 - DNA, 16 bp, Homo sapiens
cacagacctggagccc

SEQ ID NO: 6690923 - DNA, 19 bp, Homo sapiens
cacagacctggagcccctg

SEQ ID NO: 6690924 - DNA, 22 bp, Homo sapiens
cacagacctggagcccctgggt

SEQ ID NO: 6690925 - DNA, 24 bp, Homo sapiens
cacagacctggagcccctgggtgg

SEQ ID NO: 6690926 - DNA, 19 bp, Homo sapiens
cacagacggatactgggga

SEQ ID NO: 6690927 - DNA, 18 bp, Homo sapiens
cacagacgggcacacaga

SEQ ID NO: 6690928 - DNA, 15 bp, Homo sapiens
cacagactacagcca

SEQ ID NO: 6690929 - DNA, 13 bp, Homo sapiens
cacagactatttt

SEQ ID NO: 6690930 - DNA, 14 bp, Homo sapiens
cacagactattttt

SEQ ID NO: 6690931 - DNA, 12 bp, Homo sapiens
cacagactccct

SEQ ID NO: 6690932 - DNA, 19 bp, Homo sapiens
cacagactccctcccctgc

SEQ ID NO: 6690933 - DNA, 16 bp, Homo sapiens
cacagactccggcctg

SEQ ID NO: 6690934 - DNA, 18 bp, Homo sapiens
cacagactccggcctgta

SEQ ID NO: 6690935 - DNA, 17 bp, Homo sapiens
cacagactcttccacca

SEQ ID NO: 6690936 - DNA, 21 bp, Homo sapiens
cacagactcttccaccagagc

SEQ ID NO: 6690937 - DNA, 13 bp, Homo sapiens
cacagactgcccc

SEQ ID NO: 6690938 - DNA, 19 bp, Homo sapiens
cacagactgccccagccaa

SEQ ID NO: 6690939 - DNA, 15 bp, Homo sapiens
cacagactgctgtct

SEQ ID NO: 6690940 - DNA, 18 bp, Homo sapiens
cacagactgggaacccct

SEQ ID NO: 6690941 - DNA, 14 bp, Homo sapiens
cacagactgttccc

SEQ ID NO: 6690942 - DNA, 23 bp, Homo sapiens
cacagactgttccctccaaggtc

SEQ ID NO: 6690943 - DNA, 18 bp, Homo sapiens
cacagacttctggaaggc

SEQ ID NO: 6690944 - DNA, 18 bp, Homo sapiens
cacagacttctggcctag

SEQ ID NO: 6690945 - DNA, 13 bp, Homo sapiens
cacagacttgcac

SEQ ID NO: 6690946 - DNA, 16 bp, Homo sapiens
cacagactttctgtga

SEQ ID NO: 6690947 - DNA, 12 bp, Homo sapiens
cacagagaaagt

SEQ ID NO: 6690948 - DNA, 20 bp, Homo sapiens
cacagagaaagtacttctcc

SEQ ID NO: 6690949 - DNA, 23 bp, Homo sapiens
cacagagaactagtggtggctct

SEQ ID NO: 6690950 - DNA, 15 bp, Homo sapiens
cacagagaagacaaa

SEQ ID NO: 6690951 - DNA, 13 bp, Homo sapiens
cacagagaagctg

SEQ ID NO: 6690952 - DNA, 15 bp, Homo sapiens
cacagagaagctggg

SEQ ID NO: 6690953 - DNA, 20 bp, Homo sapiens
cacagagaagctggggagga

SEQ ID NO: 6690954 - DNA, 15 bp, Homo sapiens
cacagagaagggaag

SEQ ID NO: 6690955 - DNA, 16 bp, Homo sapiens
cacagagacattcctc

SEQ ID NO: 6690956 - DNA, 22 bp, Homo sapiens
cacagagacccccggaacaagc

SEQ ID NO: 6690957 - DNA, 20 bp, Homo sapiens
cacagagactgtttgaatgt

SEQ ID NO: 6690958 - DNA, 12 bp, Homo sapiens
cacagagagaaa

SEQ ID NO: 6690959 - DNA, 19 bp, Homo sapiens
cacagagagcggcttcccc

SEQ ID NO: 6690960 - DNA, 17 bp, Homo sapiens
cacagagagcttggcaa

SEQ ID NO: 6690961 - DNA, 10 bp, Homo sapiens
cacagagagg

SEQ ID NO: 6690962 - DNA, 10 bp, Homo sapiens
cacagagagt

SEQ ID NO: 6690963 - DNA, 12 bp, Homo sapiens
cacagagagtcc

SEQ ID NO: 6690964 - DNA, 18 bp, Homo sapiens
cacagagagtcccactgc

SEQ ID NO: 6690965 - DNA, 19 bp, Homo sapiens
cacagagagtcccactgcc

SEQ ID NO: 6690966 - DNA, 20 bp, Homo sapiens
cacagagcacacttatttat

SEQ ID NO: 6690967 - DNA, 13 bp, Homo sapiens
cacagagcacgcc

SEQ ID NO: 6690968 - DNA, 20 bp, Homo sapiens
cacagagcacgcctgccatc

SEQ ID NO: 6690969 - DNA, 13 bp, Homo sapiens
cacagagcagcaa

SEQ ID NO: 6690970 - DNA, 21 bp, Homo sapiens
cacagagcaggactgcacagc

SEQ ID NO: 6690971 - DNA, 21 bp, Homo sapiens
cacagagcatccgtctcccct

SEQ ID NO: 6690972 - DNA, 13 bp, Homo sapiens
cacagagcccaat

SEQ ID NO: 6690973 - DNA, 16 bp, Homo sapiens
cacagagccctgaggg

SEQ ID NO: 6690974 - DNA, 22 bp, Homo sapiens
cacagagccctgaggggctggg

SEQ ID NO: 6690975 - DNA, 13 bp, Homo sapiens
cacagagcctgcc

SEQ ID NO: 6690976 - DNA, 14 bp, Homo sapiens
cacagagcctgcct

SEQ ID NO: 6690977 - DNA, 12 bp, Homo sapiens
cacagagcctgg

SEQ ID NO: 6690978 - DNA, 13 bp, Homo sapiens
cacagagcctggc

SEQ ID NO: 6690979 - DNA, 15 bp, Homo sapiens
cacagagcctggccc

SEQ ID NO: 6690980 - DNA, 18 bp, Homo sapiens
cacagagcctggccccag

SEQ ID NO: 6690981 - DNA, 19 bp, Homo sapiens
cacagagcctggccccagg

SEQ ID NO: 6690982 - DNA, 20 bp, Homo sapiens
cacagagcgcctcacctgca

SEQ ID NO: 6690983 - DNA, 21 bp, Homo sapiens
cacagagctggcgactgcagc

SEQ ID NO: 6690984 - DNA, 22 bp, Homo sapiens
cacagagctggcgactgcagct

SEQ ID NO: 6690985 - DNA, 22 bp, Homo sapiens
cacagagctttggtctgtgtgt

SEQ ID NO: 6690986 - DNA, 13 bp, Homo sapiens
cacagaggaagag

SEQ ID NO: 6690987 - DNA, 17 bp, Homo sapiens
cacagaggaagagcagg

SEQ ID NO: 6690988 - DNA, 19 bp, Homo sapiens
cacagaggacggcttcccc

SEQ ID NO: 6690989 - DNA, 20 bp, Homo sapiens
cacagaggcagctgtgtggg

SEQ ID NO: 6690990 - DNA, 14 bp, Homo sapiens
cacagaggccaggc

SEQ ID NO: 6690991 - DNA, 16 bp, Homo sapiens
cacagaggccccacct

SEQ ID NO: 6690992 - DNA, 12 bp, Homo sapiens
cacagaggcggt

SEQ ID NO: 6690993 - DNA, 19 bp, Homo sapiens
cacagaggctgtggtcaga

SEQ ID NO: 6690994 - DNA, 13 bp, Homo sapiens
cacagagtacaaa

SEQ ID NO: 6690995 - DNA, 17 bp, Homo sapiens
cacagagtcaaggcctg

SEQ ID NO: 6690996 - DNA, 17 bp, Homo sapiens
cacagagtcgatgctca

SEQ ID NO: 6690997 - DNA, 18 bp, Homo sapiens
cacagagtgagggaggag

SEQ ID NO: 6690998 - DNA, 20 bp, Homo sapiens
cacagagtgccatccctgag

SEQ ID NO: 6690999 - DNA, 22 bp, Homo sapiens
cacagagtgccatccctgagag

SEQ ID NO: 6691000 - DNA, 18 bp, Homo sapiens
cacagagtgctggactgt

SEQ ID NO: 6691001 - DNA, 22 bp, Homo sapiens
cacagagtggtctttctggaga

SEQ ID NO: 6691002 - DNA, 19 bp, Homo sapiens
cacagagtgtgctggagga

SEQ ID NO: 6691003 - DNA, 23 bp, Homo sapiens
cacagagtgtgtttttgcactgt

SEQ ID NO: 6691004 - DNA, 16 bp, Homo sapiens
cacagagttccccgct

SEQ ID NO: 6691005 - DNA, 17 bp, Homo sapiens
cacagagttgttacatt

SEQ ID NO: 6691006 - DNA, 20 bp, Homo sapiens
cacagagttgttacattttt

SEQ ID NO: 6691007 - DNA, 22 bp, Homo sapiens
cacagagttgttacatttttaa

SEQ ID NO: 6691008 - DNA, 19 bp, Homo sapiens
cacagagtttgtagtaaat

SEQ ID NO: 6691009 - DNA, 23 bp, Homo sapiens
cacagagtttgtagtaaatatta

SEQ ID NO: 6691010 - DNA, 20 bp, Homo sapiens
cacagagttttttaaacaaa

SEQ ID NO: 6691011 - DNA, 21 bp, Homo sapiens
cacagagttttttaaacaaat

SEQ ID NO: 6691012 - DNA, 14 bp, Homo sapiens
cacagataaaaagt

SEQ ID NO: 6691013 - DNA, 19 bp, Homo sapiens
cacagataattttttctta

SEQ ID NO: 6691014 - DNA, 16 bp, Homo sapiens
cacagatacacacaca

SEQ ID NO: 6691015 - DNA, 15 bp, Homo sapiens
cacagatacacatac

SEQ ID NO: 6691016 - DNA, 19 bp, Homo sapiens
cacagataccttgaaagga

SEQ ID NO: 6691017 - DNA, 22 bp, Homo sapiens
cacagatatacacatggatgca

SEQ ID NO: 6691018 - DNA, 17 bp, Homo sapiens
cacagatatactttgtg

SEQ ID NO: 6691019 - DNA, 20 bp, Homo sapiens
cacagatatactttgtggac

SEQ ID NO: 6691020 - DNA, 15 bp, Homo sapiens
cacagatatcttttt

SEQ ID NO: 6691021 - DNA, 14 bp, Homo sapiens
cacagatatgcaca

SEQ ID NO: 6691022 - DNA, 21 bp, Homo sapiens
cacagatattgttataaataa

SEQ ID NO: 6691023 - DNA, 22 bp, Homo sapiens
cacagatcacagcttcagccag

SEQ ID NO: 6691024 - DNA, 23 bp, Homo sapiens
cacagatccatccttttgcttca

SEQ ID NO: 6691025 - DNA, 20 bp, Homo sapiens
cacagatcccactggaagat

SEQ ID NO: 6691026 - DNA, 17 bp, Homo sapiens
cacagatctgcatctga

SEQ ID NO: 6691027 - DNA, 15 bp, Homo sapiens
cacagatgaccaaag

SEQ ID NO: 6691028 - DNA, 14 bp, Homo sapiens
cacagatgaggagc

SEQ ID NO: 6691029 - DNA, 23 bp, Homo sapiens
cacagatgaggagcagctggggt

SEQ ID NO: 6691030 - DNA, 20 bp, Homo sapiens
cacagatgagttatctaaga

SEQ ID NO: 6691031 - DNA, 20 bp, Homo sapiens
cacagatgcacacacagatg

SEQ ID NO: 6691032 - DNA, 22 bp, Homo sapiens
cacagatgcacacacagatgca

SEQ ID NO: 6691033 - DNA, 18 bp, Homo sapiens
cacagatgcatatagaca

SEQ ID NO: 6691034 - DNA, 21 bp, Homo sapiens
cacagatgcatatagacacac

SEQ ID NO: 6691035 - DNA, 11 bp, Homo sapiens
cacagatgcct

SEQ ID NO: 6691036 - DNA, 15 bp, Homo sapiens
cacagatgctccagg

SEQ ID NO: 6691037 - DNA, 14 bp, Homo sapiens
cacagatgctggcc

SEQ ID NO: 6691038 - DNA, 15 bp, Homo sapiens
cacagatgctggcct

SEQ ID NO: 6691039 - DNA, 19 bp, Homo sapiens
cacagatgctggcctcttg

SEQ ID NO: 6691040 - DNA, 17 bp, Homo sapiens
cacagatggatttgcct

SEQ ID NO: 6691041 - DNA, 18 bp, Homo sapiens
cacagatggcacctgtgg

SEQ ID NO: 6691042 - DNA, 19 bp, Homo sapiens
cacagatggcacctgtggc

SEQ ID NO: 6691043 - DNA, 21 bp, Homo sapiens
cacagatggctttcagggcag

SEQ ID NO: 6691044 - DNA, 19 bp, Homo sapiens
cacagatgggtattaaact

SEQ ID NO: 6691045 - DNA, 23 bp, Homo sapiens
cacagatgggtgcttggaggaag

SEQ ID NO: 6691046 - DNA, 18 bp, Homo sapiens
cacagatggtcacacaga

SEQ ID NO: 6691047 - DNA, 19 bp, Homo sapiens
cacagatgtctctggggca

SEQ ID NO: 6691048 - DNA, 13 bp, Homo sapiens
cacagatgtgaag

SEQ ID NO: 6691049 - DNA, 14 bp, Homo sapiens
cacagatgtgccca

SEQ ID NO: 6691050 - DNA, 19 bp, Homo sapiens
cacagattacttcagggct

SEQ ID NO: 6691051 - DNA, 21 bp, Homo sapiens
cacagattatgttcctgctgt

SEQ ID NO: 6691052 - DNA, 14 bp, Homo sapiens
cacagattatttgt

SEQ ID NO: 6691053 - DNA, 17 bp, Homo sapiens
cacagattcccaggcca

SEQ ID NO: 6691054 - DNA, 20 bp, Homo sapiens
cacagattcccaggccaggg

SEQ ID NO: 6691055 - DNA, 23 bp, Homo sapiens
cacagattcccaggccagggctg

SEQ ID NO: 6691056 - DNA, 15 bp, Homo sapiens
cacagattgtttcta

SEQ ID NO: 6691057 - DNA, 21 bp, Homo sapiens
cacagattgtttctatacaaa

SEQ ID NO: 6691058 - DNA, 18 bp, Homo sapiens
cacagatttgagctcagc

SEQ ID NO: 6691059 - DNA, 13 bp, Homo sapiens
cacagatttgcat

SEQ ID NO: 6691060 - DNA, 14 bp, Homo sapiens
cacagattttaatt

SEQ ID NO: 6691061 - DNA, 16 bp, Homo sapiens
cacagattttgaatct

SEQ ID NO: 6691062 - DNA, 17 bp, Homo sapiens
cacagatttttacacta

SEQ ID NO: 6691063 - DNA, 22 bp, Homo sapiens
cacagattttttctttaaataa

SEQ ID NO: 6691064 - DNA, 20 bp, Homo sapiens
cacagcaacgatcacaaatg

SEQ ID NO: 6691065 - DNA, 22 bp, Homo sapiens
cacagcaacgatcacaaatgac

SEQ ID NO: 6691066 - DNA, 22 bp, Homo sapiens
cacagcaaggaaatgtcctgca

SEQ ID NO: 6691067 - DNA, 23 bp, Homo sapiens
cacagcaaggaggctggctgggg

SEQ ID NO: 6691068 - DNA, 17 bp, Homo sapiens
cacagcaaggcacctgc

SEQ ID NO: 6691069 - DNA, 15 bp, Homo sapiens
cacagcaagtacagc

SEQ ID NO: 6691070 - DNA, 16 bp, Homo sapiens
cacagcaatatttaac

SEQ ID NO: 6691071 - DNA, 16 bp, Homo sapiens
cacagcaattttgtat

SEQ ID NO: 6691072 - DNA, 17 bp, Homo sapiens
cacagcaattttgtatc

SEQ ID NO: 6691073 - DNA, 19 bp, Homo sapiens
cacagcacaaacacacctc

SEQ ID NO: 6691074 - DNA, 14 bp, Homo sapiens
cacagcacaaatta

SEQ ID NO: 6691075 - DNA, 15 bp, Homo sapiens
cacagcacaagggca

SEQ ID NO: 6691076 - DNA, 16 bp, Homo sapiens
cacagcacagtacaca

SEQ ID NO: 6691077 - DNA, 13 bp, Homo sapiens
cacagcacatgct

SEQ ID NO: 6691078 - DNA, 14 bp, Homo sapiens
cacagcacatgctg

SEQ ID NO: 6691079 - DNA, 20 bp, Homo sapiens
cacagcacatgctggccagc

SEQ ID NO: 6691080 - DNA, 16 bp, Homo sapiens
cacagcaccagaatgt

SEQ ID NO: 6691081 - DNA, 14 bp, Homo sapiens
cacagcacccaggc

SEQ ID NO: 6691082 - DNA, 15 bp, Homo sapiens
cacagcacccaggct

SEQ ID NO: 6691083 - DNA, 16 bp, Homo sapiens
cacagcacccaggctc

SEQ ID NO: 6691084 - DNA, 19 bp, Homo sapiens
cacagcaccgggggagagg

SEQ ID NO: 6691085 - DNA, 16 bp, Homo sapiens
cacagcaccgtgccaa

SEQ ID NO: 6691086 - DNA, 20 bp, Homo sapiens
cacagcacctcctctctgct

SEQ ID NO: 6691087 - DNA, 16 bp, Homo sapiens
cacagcactctctaaa

SEQ ID NO: 6691088 - DNA, 12 bp, Homo sapiens
cacagcactgcc

SEQ ID NO: 6691089 - DNA, 13 bp, Homo sapiens
cacagcactgcct

SEQ ID NO: 6691090 - DNA, 17 bp, Homo sapiens
cacagcactgcctgcca

SEQ ID NO: 6691091 - DNA, 13 bp, Homo sapiens
cacagcagaccta

SEQ ID NO: 6691092 - DNA, 13 bp, Homo sapiens
cacagcagagcat

SEQ ID NO: 6691093 - DNA, 16 bp, Homo sapiens
cacagcagcagaacaa

SEQ ID NO: 6691094 - DNA, 12 bp, Homo sapiens
cacagcagcatt

SEQ ID NO: 6691095 - DNA, 13 bp, Homo sapiens
cacagcagcattt

SEQ ID NO: 6691096 - DNA, 14 bp, Homo sapiens
cacagcagcatttt

SEQ ID NO: 6691097 - DNA, 20 bp, Homo sapiens
cacagcagccccaggagaag

SEQ ID NO: 6691098 - DNA, 18 bp, Homo sapiens
cacagcagcctctgaagt

SEQ ID NO: 6691099 - DNA, 14 bp, Homo sapiens
cacagcagcctgct

SEQ ID NO: 6691100 - DNA, 19 bp, Homo sapiens
cacagcagctgaacagcca

SEQ ID NO: 6691101 - DNA, 23 bp, Homo sapiens
cacagcagcttataatgggctct

SEQ ID NO: 6691102 - DNA, 13 bp, Homo sapiens
cacagcagcttca

SEQ ID NO: 6691103 - DNA, 15 bp, Homo sapiens
cacagcagcttcacc

SEQ ID NO: 6691104 - DNA, 19 bp, Homo sapiens
cacagcagcttcaccagag

SEQ ID NO: 6691105 - DNA, 20 bp, Homo sapiens
cacagcaggacctgtgcttt

SEQ ID NO: 6691106 - DNA, 13 bp, Homo sapiens
cacagcaggctgc

SEQ ID NO: 6691107 - DNA, 20 bp, Homo sapiens
cacagcaggctgccagtgcc

SEQ ID NO: 6691108 - DNA, 22 bp, Homo sapiens
cacagcaggctgccagtgcctg

SEQ ID NO: 6691109 - DNA, 12 bp, Homo sapiens
cacagcagggcc

SEQ ID NO: 6691110 - DNA, 13 bp, Homo sapiens
cacagcagggcct

SEQ ID NO: 6691111 - DNA, 21 bp, Homo sapiens
cacagcagggccttctgcctg

SEQ ID NO: 6691112 - DNA, 22 bp, Homo sapiens
cacagcagggccttctgcctgc

SEQ ID NO: 6691113 - DNA, 17 bp, Homo sapiens
cacagcaggggagccct

SEQ ID NO: 6691114 - DNA, 23 bp, Homo sapiens
cacagcaggtttatccagatgaa

SEQ ID NO: 6691115 - DNA, 19 bp, Homo sapiens
cacagcagtacttgctcaa

SEQ ID NO: 6691116 - DNA, 17 bp, Homo sapiens
cacagcagtatgaatga

SEQ ID NO: 6691117 - DNA, 17 bp, Homo sapiens
cacagcagtcacaggcc

SEQ ID NO: 6691118 - DNA, 19 bp, Homo sapiens
cacagcagtcacaggccca

SEQ ID NO: 6691119 - DNA, 21 bp, Homo sapiens
cacagcagtcacaggcccagg

SEQ ID NO: 6691120 - DNA, 12 bp, Homo sapiens
cacagcagtgag

SEQ ID NO: 6691121 - DNA, 17 bp, Homo sapiens
cacagcagtgagactgg

SEQ ID NO: 6691122 - DNA, 21 bp, Homo sapiens
cacagcagttctgcagaggac

SEQ ID NO: 6691123 - DNA, 19 bp, Homo sapiens
cacagcagttgaaaagact

SEQ ID NO: 6691124 - DNA, 23 bp, Homo sapiens
cacagcatcattttgcattcaaa

SEQ ID NO: 6691125 - DNA, 23 bp, Homo sapiens
cacagcatcgtgatcactgagcc

SEQ ID NO: 6691126 - DNA, 13 bp, Homo sapiens
cacagcatctcag

SEQ ID NO: 6691127 - DNA, 16 bp, Homo sapiens
cacagcatctcagctc

SEQ ID NO: 6691128 - DNA, 19 bp, Homo sapiens
cacagcatctcagctcatc

SEQ ID NO: 6691129 - DNA, 13 bp, Homo sapiens
cacagcatctgta

SEQ ID NO: 6691130 - DNA, 13 bp, Homo sapiens
cacagcatgcaga

SEQ ID NO: 6691131 - DNA, 17 bp, Homo sapiens
cacagcatggaggagga

SEQ ID NO: 6691132 - DNA, 20 bp, Homo sapiens
cacagcatggaggaggaggg

SEQ ID NO: 6691133 - DNA, 15 bp, Homo sapiens
cacagcatgtgccaa

SEQ ID NO: 6691134 - DNA, 16 bp, Homo sapiens
cacagcatgtgccaag

SEQ ID NO: 6691135 - DNA, 17 bp, Homo sapiens
cacagcatgtgccaaga

SEQ ID NO: 6691136 - DNA, 18 bp, Homo sapiens
cacagcatgtgccaagat

SEQ ID NO: 6691137 - DNA, 21 bp, Homo sapiens
cacagcatttgctttcctctg

SEQ ID NO: 6691138 - DNA, 16 bp, Homo sapiens
cacagccaacgagaca

SEQ ID NO: 6691139 - DNA, 20 bp, Homo sapiens
cacagccaacgagacacatt

SEQ ID NO: 6691140 - DNA, 19 bp, Homo sapiens
cacagccaagcccaccctg

SEQ ID NO: 6691141 - DNA, 14 bp, Homo sapiens
cacagccaaggact

SEQ ID NO: 6691142 - DNA, 17 bp, Homo sapiens
cacagccaatctccagg

SEQ ID NO: 6691143 - DNA, 23 bp, Homo sapiens
cacagccaatctccaggctccct

SEQ ID NO: 6691144 - DNA, 10 bp, Homo sapiens
cacagccaca

SEQ ID NO: 6691145 - DNA, 13 bp, Homo sapiens
cacagccacacac

SEQ ID NO: 6691146 - DNA, 18 bp, Homo sapiens
cacagccacacacacaga

SEQ ID NO: 6691147 - DNA, 23 bp, Homo sapiens
cacagccacacacacagaaaata

SEQ ID NO: 6691148 - DNA, 14 bp, Homo sapiens
cacagccacacctg

SEQ ID NO: 6691149 - DNA, 15 bp, Homo sapiens
cacagccaccacctg

SEQ ID NO: 6691150 - DNA, 19 bp, Homo sapiens
cacagccaccacctggatg

SEQ ID NO: 6691151 - DNA, 12 bp, Homo sapiens
cacagccacccg

SEQ ID NO: 6691152 - DNA, 13 bp, Homo sapiens
cacagccacctcc

SEQ ID NO: 6691153 - DNA, 14 bp, Homo sapiens
cacagccacctcca

SEQ ID NO: 6691154 - DNA, 22 bp, Homo sapiens
cacagccacctccgccagaccc

SEQ ID NO: 6691155 - DNA, 20 bp, Homo sapiens
cacagccactaaaacacaaa

SEQ ID NO: 6691156 - DNA, 20 bp, Homo sapiens
cacagccagaaactgaactg

SEQ ID NO: 6691157 - DNA, 23 bp, Homo sapiens
cacagccagaaactgaactggcc

SEQ ID NO: 6691158 - DNA, 19 bp, Homo sapiens
cacagccagaaccccgagc

SEQ ID NO: 6691159 - DNA, 17 bp, Homo sapiens
cacagccagacttgctt

SEQ ID NO: 6691160 - DNA, 21 bp, Homo sapiens
cacagccagacttgcttcctg

SEQ ID NO: 6691161 - DNA, 13 bp, Homo sapiens
cacagccagagga

SEQ ID NO: 6691162 - DNA, 14 bp, Homo sapiens
cacagccagaggag

SEQ ID NO: 6691163 - DNA, 16 bp, Homo sapiens
cacagccagcacctgg

SEQ ID NO: 6691164 - DNA, 14 bp, Homo sapiens
cacagccagcccaa

SEQ ID NO: 6691165 - DNA, 21 bp, Homo sapiens
cacagccagcccaaaccttgg

SEQ ID NO: 6691166 - DNA, 19 bp, Homo sapiens
cacagccaggggagcagag

SEQ ID NO: 6691167 - DNA, 15 bp, Homo sapiens
cacagccaggtgcct

SEQ ID NO: 6691168 - DNA, 19 bp, Homo sapiens
cacagccaggtgccttgga

SEQ ID NO: 6691169 - DNA, 20 bp, Homo sapiens
cacagccattcatctgggct

SEQ ID NO: 6691170 - DNA, 18 bp, Homo sapiens
cacagcccaaaatttgat

SEQ ID NO: 6691171 - DNA, 15 bp, Homo sapiens
cacagcccaaccagg

SEQ ID NO: 6691172 - DNA, 13 bp, Homo sapiens
cacagcccaccct

SEQ ID NO: 6691173 - DNA, 16 bp, Homo sapiens
cacagcccacgtcctg

SEQ ID NO: 6691174 - DNA, 17 bp, Homo sapiens
cacagcccacgtcctgt

SEQ ID NO: 6691175 - DNA, 18 bp, Homo sapiens
cacagcccacgtcctgtc

SEQ ID NO: 6691176 - DNA, 12 bp, Homo sapiens
cacagcccagaa

SEQ ID NO: 6691177 - DNA, 12 bp, Homo sapiens
cacagcccagac

SEQ ID NO: 6691178 - DNA, 13 bp, Homo sapiens
cacagcccagcca

SEQ ID NO: 6691179 - DNA, 23 bp, Homo sapiens
cacagcccagccacggacgctgg

SEQ ID NO: 6691180 - DNA, 11 bp, Homo sapiens
cacagcccagg

SEQ ID NO: 6691181 - DNA, 14 bp, Homo sapiens
cacagcccagggcc

SEQ ID NO: 6691182 - DNA, 17 bp, Homo sapiens
cacagcccagggcctgc

SEQ ID NO: 6691183 - DNA, 13 bp, Homo sapiens
cacagccccacag

SEQ ID NO: 6691184 - DNA, 15 bp, Homo sapiens
cacagccccacagca

SEQ ID NO: 6691185 - DNA, 21 bp, Homo sapiens
cacagccccacagcacccagg

SEQ ID NO: 6691186 - DNA, 23 bp, Homo sapiens
cacagccccacagcacccaggct

SEQ ID NO: 6691187 - DNA, 13 bp, Homo sapiens
cacagccccaccc

SEQ ID NO: 6691188 - DNA, 19 bp, Homo sapiens
cacagccccacccttgtcc

SEQ ID NO: 6691189 - DNA, 17 bp, Homo sapiens
cacagcccccaccccag

SEQ ID NO: 6691190 - DNA, 23 bp, Homo sapiens
cacagcccccgggacaccgtggg

SEQ ID NO: 6691191 - DNA, 18 bp, Homo sapiens
cacagcccccttgccctc

SEQ ID NO: 6691192 - DNA, 18 bp, Homo sapiens
cacagcccctcaaagact

SEQ ID NO: 6691193 - DNA, 12 bp, Homo sapiens
cacagcccctgg

SEQ ID NO: 6691194 - DNA, 19 bp, Homo sapiens
cacagcccctggcactgca

SEQ ID NO: 6691195 - DNA, 22 bp, Homo sapiens
cacagcccctggcactgcaggt

SEQ ID NO: 6691196 - DNA, 14 bp, Homo sapiens
cacagccccttgct

SEQ ID NO: 6691197 - DNA, 18 bp, Homo sapiens
cacagcccgcatgcagca

SEQ ID NO: 6691198 - DNA, 18 bp, Homo sapiens
cacagcccgctctctggc

SEQ ID NO: 6691199 - DNA, 13 bp, Homo sapiens
cacagcccgggtg

SEQ ID NO: 6691200 - DNA, 17 bp, Homo sapiens
cacagcccgggtgtgcc

SEQ ID NO: 6691201 - DNA, 11 bp, Homo sapiens
cacagccctcc

SEQ ID NO: 6691202 - DNA, 12 bp, Homo sapiens
cacagccctccc

SEQ ID NO: 6691203 - DNA, 22 bp, Homo sapiens
cacagccctccgaccctcatgg

SEQ ID NO: 6691204 - DNA, 23 bp, Homo sapiens
cacagccctccgaccctcatggc

SEQ ID NO: 6691205 - DNA, 11 bp, Homo sapiens
cacagccctga

SEQ ID NO: 6691206 - DNA, 13 bp, Homo sapiens
cacagccctgagt

SEQ ID NO: 6691207 - DNA, 21 bp, Homo sapiens
cacagccctgagtgtcccaag

SEQ ID NO: 6691208 - DNA, 15 bp, Homo sapiens
cacagccctgggagg

SEQ ID NO: 6691209 - DNA, 16 bp, Homo sapiens
cacagccctgggaggg

SEQ ID NO: 6691210 - DNA, 16 bp, Homo sapiens
cacagccctgtcagca

SEQ ID NO: 6691211 - DNA, 14 bp, Homo sapiens
cacagcccttttgt

SEQ ID NO: 6691212 - DNA, 14 bp, Homo sapiens
cacagccgcagcct

SEQ ID NO: 6691213 - DNA, 21 bp, Homo sapiens
cacagccgcctgaaagccaca

SEQ ID NO: 6691214 - DNA, 19 bp, Homo sapiens
cacagccggggcctgccta

SEQ ID NO: 6691215 - DNA, 23 bp, Homo sapiens
cacagccgtttgaatatatttta

SEQ ID NO: 6691216 - DNA, 21 bp, Homo sapiens
cacagcctataggccaatgca

SEQ ID NO: 6691217 - DNA, 12 bp, Homo sapiens
cacagcctcacc

SEQ ID NO: 6691218 - DNA, 21 bp, Homo sapiens
cacagcctcacccctgcaggc

SEQ ID NO: 6691219 - DNA, 18 bp, Homo sapiens
cacagcctcacccctgcc

SEQ ID NO: 6691220 - DNA, 23 bp, Homo sapiens
cacagcctcacgcccccaggaat

SEQ ID NO: 6691221 - DNA, 14 bp, Homo sapiens
cacagcctccaggg

SEQ ID NO: 6691222 - DNA, 15 bp, Homo sapiens
cacagcctccagggc

SEQ ID NO: 6691223 - DNA, 16 bp, Homo sapiens
cacagcctccagggcc

SEQ ID NO: 6691224 - DNA, 13 bp, Homo sapiens
cacagcctcccct

SEQ ID NO: 6691225 - DNA, 19 bp, Homo sapiens
cacagcctcccctgccagg

SEQ ID NO: 6691226 - DNA, 23 bp, Homo sapiens
cacagcctcccctgccagggcag

SEQ ID NO: 6691227 - DNA, 17 bp, Homo sapiens
cacagcctccccttccc

SEQ ID NO: 6691228 - DNA, 18 bp, Homo sapiens
cacagcctccccttccca

SEQ ID NO: 6691229 - DNA, 22 bp, Homo sapiens
cacagcctccccttcccagacc

SEQ ID NO: 6691230 - DNA, 13 bp, Homo sapiens
cacagcctccctg

SEQ ID NO: 6691231 - DNA, 16 bp, Homo sapiens
cacagcctccctgagc

SEQ ID NO: 6691232 - DNA, 17 bp, Homo sapiens
cacagcctccctgagcc

SEQ ID NO: 6691233 - DNA, 19 bp, Homo sapiens
cacagcctcctctgtctgc

SEQ ID NO: 6691234 - DNA, 10 bp, Homo sapiens
cacagcctct

SEQ ID NO: 6691235 - DNA, 11 bp, Homo sapiens
cacagcctctg

SEQ ID NO: 6691236 - DNA, 13 bp, Homo sapiens
cacagcctctgac

SEQ ID NO: 6691237 - DNA, 17 bp, Homo sapiens
cacagcctctgacccct

SEQ ID NO: 6691238 - DNA, 23 bp, Homo sapiens
cacagcctctgacccctcctcac

SEQ ID NO: 6691239 - DNA, 14 bp, Homo sapiens
cacagcctctgcct

SEQ ID NO: 6691240 - DNA, 21 bp, Homo sapiens
cacagcctctggctccacacc

SEQ ID NO: 6691241 - DNA, 20 bp, Homo sapiens
cacagcctcttcctccccat

SEQ ID NO: 6691242 - DNA, 13 bp, Homo sapiens
cacagcctgcact

SEQ ID NO: 6691243 - DNA, 14 bp, Homo sapiens
cacagcctgcactt

SEQ ID NO: 6691244 - DNA, 13 bp, Homo sapiens
cacagcctgctgg

SEQ ID NO: 6691245 - DNA, 14 bp, Homo sapiens
cacagcctggcctc

SEQ ID NO: 6691246 - DNA, 15 bp, Homo sapiens
cacagcctggcctcc

SEQ ID NO: 6691247 - DNA, 16 bp, Homo sapiens
cacagcctggcctccc

SEQ ID NO: 6691248 - DNA, 17 bp, Homo sapiens
cacagcctgggaccagg

SEQ ID NO: 6691249 - DNA, 19 bp, Homo sapiens
cacagcctgggccccagct

SEQ ID NO: 6691250 - DNA, 21 bp, Homo sapiens
cacagcctgggccccagctcg

SEQ ID NO: 6691251 - DNA, 15 bp, Homo sapiens
cacagcctgtccctg

SEQ ID NO: 6691252 - DNA, 21 bp, Homo sapiens
cacagcctgtcttcagatcct

SEQ ID NO: 6691253 - DNA, 22 bp, Homo sapiens
cacagcctgtcttgtcaggtgg

SEQ ID NO: 6691254 - DNA, 19 bp, Homo sapiens
cacagccttccctctgcat

SEQ ID NO: 6691255 - DNA, 18 bp, Homo sapiens
cacagccttccttctgct

SEQ ID NO: 6691256 - DNA, 21 bp, Homo sapiens
cacagccttcggacagacata

SEQ ID NO: 6691257 - DNA, 23 bp, Homo sapiens
cacagccttcggacagacatatg

SEQ ID NO: 6691258 - DNA, 18 bp, Homo sapiens
cacagccttctaaattcc

SEQ ID NO: 6691259 - DNA, 22 bp, Homo sapiens
cacagccttctaaattcccaaa

SEQ ID NO: 6691260 - DNA, 18 bp, Homo sapiens
cacagccttctccactgg

SEQ ID NO: 6691261 - DNA, 16 bp, Homo sapiens
cacagccttggctcct

SEQ ID NO: 6691262 - DNA, 13 bp, Homo sapiens
cacagcctttctg

SEQ ID NO: 6691263 - DNA, 23 bp, Homo sapiens
cacagcctttgcgctctgggttt

SEQ ID NO: 6691264 - DNA, 23 bp, Homo sapiens
cacagcgacgctcccctgagagg

SEQ ID NO: 6691265 - DNA, 13 bp, Homo sapiens
cacagcgagcctg

SEQ ID NO: 6691266 - DNA, 17 bp, Homo sapiens
cacagcgagcctgtgcc

SEQ ID NO: 6691267 - DNA, 18 bp, Homo sapiens
cacagcgagcctgtgcct

SEQ ID NO: 6691268 - DNA, 22 bp, Homo sapiens
cacagcgagcctgtgccttcct

SEQ ID NO: 6691269 - DNA, 14 bp, Homo sapiens
cacagcgccagcct

SEQ ID NO: 6691270 - DNA, 16 bp, Homo sapiens
cacagcgcgggcggag

SEQ ID NO: 6691271 - DNA, 18 bp, Homo sapiens
cacagcgcgggcggaggc

SEQ ID NO: 6691272 - DNA, 23 bp, Homo sapiens
cacagcgctcgatggacctcagc

SEQ ID NO: 6691273 - DNA, 22 bp, Homo sapiens
cacagcgctggccgggaccccg

SEQ ID NO: 6691274 - DNA, 19 bp, Homo sapiens
cacagcggaggagaccagc

SEQ ID NO: 6691275 - DNA, 22 bp, Homo sapiens
cacagcggaggagaccagctca

SEQ ID NO: 6691276 - DNA, 23 bp, Homo sapiens
cacagcggaggagaccagctcag

SEQ ID NO: 6691277 - DNA, 20 bp, Homo sapiens
cacagcggaggtgtggagcc

SEQ ID NO: 6691278 - DNA, 19 bp, Homo sapiens
cacagcgggagaacgcagt

SEQ ID NO: 6691279 - DNA, 22 bp, Homo sapiens
cacagcgtccctagcagtgaac

SEQ ID NO: 6691280 - DNA, 16 bp, Homo sapiens
cacagcgtccctggcg

SEQ ID NO: 6691281 - DNA, 13 bp, Homo sapiens
cacagcgtctgct

SEQ ID NO: 6691282 - DNA, 14 bp, Homo sapiens
cacagcgtctgctc

SEQ ID NO: 6691283 - DNA, 17 bp, Homo sapiens
cacagcgtgctggcgac

SEQ ID NO: 6691284 - DNA, 22 bp, Homo sapiens
cacagcgttatgtgtctgccac

SEQ ID NO: 6691285 - DNA, 21 bp, Homo sapiens
cacagctaacaattgtgaagt

SEQ ID NO: 6691286 - DNA, 16 bp, Homo sapiens
cacagctaacatggaa

SEQ ID NO: 6691287 - DNA, 22 bp, Homo sapiens
cacagctaacatggaagtacta

SEQ ID NO: 6691288 - DNA, 19 bp, Homo sapiens
cacagctaaccacttcgca

SEQ ID NO: 6691289 - DNA, 22 bp, Homo sapiens
cacagctaaccacttcgcacac

SEQ ID NO: 6691290 - DNA, 22 bp, Homo sapiens
cacagctaagatgccatgtgca

SEQ ID NO: 6691291 - DNA, 20 bp, Homo sapiens
cacagctaataaaagtcaga

SEQ ID NO: 6691292 - DNA, 22 bp, Homo sapiens
cacagctaataaaagtcagagc

SEQ ID NO: 6691293 - DNA, 23 bp, Homo sapiens
cacagctaataaaagtcagagct

SEQ ID NO: 6691294 - DNA, 22 bp, Homo sapiens
cacagctacaaccctaccctgg

SEQ ID NO: 6691295 - DNA, 13 bp, Homo sapiens
cacagctactcag

SEQ ID NO: 6691296 - DNA, 16 bp, Homo sapiens
cacagctactcagatc

SEQ ID NO: 6691297 - DNA, 21 bp, Homo sapiens
cacagctactcagatctgcac

SEQ ID NO: 6691298 - DNA, 21 bp, Homo sapiens
cacagctactcagtggggctg

SEQ ID NO: 6691299 - DNA, 16 bp, Homo sapiens
cacagctactctcccc

SEQ ID NO: 6691300 - DNA, 13 bp, Homo sapiens
cacagctcacggc

SEQ ID NO: 6691301 - DNA, 18 bp, Homo sapiens
cacagctcacggcagcct

SEQ ID NO: 6691302 - DNA, 18 bp, Homo sapiens
cacagctcagctgcccat

SEQ ID NO: 6691303 - DNA, 15 bp, Homo sapiens
cacagctcaggaggc

SEQ ID NO: 6691304 - DNA, 12 bp, Homo sapiens
cacagctccagg

SEQ ID NO: 6691305 - DNA, 14 bp, Homo sapiens
cacagctccaggac

SEQ ID NO: 6691306 - DNA, 15 bp, Homo sapiens
cacagctccaggaca

SEQ ID NO: 6691307 - DNA, 14 bp, Homo sapiens
cacagctcccaccc

SEQ ID NO: 6691308 - DNA, 11 bp, Homo sapiens
cacagctcctc

SEQ ID NO: 6691309 - DNA, 23 bp, Homo sapiens
cacagctcctccatgcctgacca

SEQ ID NO: 6691310 - DNA, 14 bp, Homo sapiens
cacagctcctcccc

SEQ ID NO: 6691311 - DNA, 20 bp, Homo sapiens
cacagctcctcccctgccgc

SEQ ID NO: 6691312 - DNA, 21 bp, Homo sapiens
cacagctcctcccctgccgcc

SEQ ID NO: 6691313 - DNA, 22 bp, Homo sapiens
cacagctcctcttaccgtagcc

SEQ ID NO: 6691314 - DNA, 14 bp, Homo sapiens
cacagctcctgcca

SEQ ID NO: 6691315 - DNA, 14 bp, Homo sapiens
cacagctccttgca

SEQ ID NO: 6691316 - DNA, 13 bp, Homo sapiens
cacagctcctttt

SEQ ID NO: 6691317 - DNA, 16 bp, Homo sapiens
cacagctctcactggc

SEQ ID NO: 6691318 - DNA, 20 bp, Homo sapiens
cacagctctccggtctctct

SEQ ID NO: 6691319 - DNA, 15 bp, Homo sapiens
cacagctctgggcct

SEQ ID NO: 6691320 - DNA, 11 bp, Homo sapiens
cacagctctgt

SEQ ID NO: 6691321 - DNA, 16 bp, Homo sapiens
cacagctcttcattcc

SEQ ID NO: 6691322 - DNA, 21 bp, Homo sapiens
cacagctcttccagggcagcg

SEQ ID NO: 6691323 - DNA, 18 bp, Homo sapiens
cacagctcttctccaggc

SEQ ID NO: 6691324 - DNA, 20 bp, Homo sapiens
cacagctcttctccaggctg

SEQ ID NO: 6691325 - DNA, 21 bp, Homo sapiens
cacagctcttctccaggctgt

SEQ ID NO: 6691326 - DNA, 13 bp, Homo sapiens
cacagctcttgtt

SEQ ID NO: 6691327 - DNA, 13 bp, Homo sapiens
cacagctctttaa

SEQ ID NO: 6691328 - DNA, 19 bp, Homo sapiens
cacagctgagagactttta

SEQ ID NO: 6691329 - DNA, 14 bp, Homo sapiens
cacagctgagaggc

SEQ ID NO: 6691330 - DNA, 16 bp, Homo sapiens
cacagctgagcactta

SEQ ID NO: 6691331 - DNA, 21 bp, Homo sapiens
cacagctgaggaccctcagcc

SEQ ID NO: 6691332 - DNA, 19 bp, Homo sapiens
cacagctgcagctgggccc

SEQ ID NO: 6691333 - DNA, 18 bp, Homo sapiens
cacagctgccctagctga

SEQ ID NO: 6691334 - DNA, 21 bp, Homo sapiens
cacagctgccctagctgaccc

SEQ ID NO: 6691335 - DNA, 18 bp, Homo sapiens
cacagctgccctgctgcc

SEQ ID NO: 6691336 - DNA, 15 bp, Homo sapiens
cacagctgcctccgg

SEQ ID NO: 6691337 - DNA, 22 bp, Homo sapiens
cacagctgcctcttccctcttc

SEQ ID NO: 6691338 - DNA, 22 bp, Homo sapiens
cacagctgctcaataaagtaca

SEQ ID NO: 6691339 - DNA, 13 bp, Homo sapiens
cacagctgctgga

SEQ ID NO: 6691340 - DNA, 15 bp, Homo sapiens
cacagctgctggcca

SEQ ID NO: 6691341 - DNA, 17 bp, Homo sapiens
cacagctgctggccagg

SEQ ID NO: 6691342 - DNA, 16 bp, Homo sapiens
cacagctgctgtgcca

SEQ ID NO: 6691343 - DNA, 18 bp, Homo sapiens
cacagctgctgttctcag

SEQ ID NO: 6691344 - DNA, 23 bp, Homo sapiens
cacagctggagacgatcttgctg

SEQ ID NO: 6691345 - DNA, 13 bp, Homo sapiens
cacagctgggcag

SEQ ID NO: 6691346 - DNA, 16 bp, Homo sapiens
cacagctgggcagggt

SEQ ID NO: 6691347 - DNA, 13 bp, Homo sapiens
cacagctgggcat

SEQ ID NO: 6691348 - DNA, 17 bp, Homo sapiens
cacagctgggcatgcca

SEQ ID NO: 6691349 - DNA, 13 bp, Homo sapiens
cacagctggggcc

SEQ ID NO: 6691350 - DNA, 22 bp, Homo sapiens
cacagctggggtggggacctca

SEQ ID NO: 6691351 - DNA, 17 bp, Homo sapiens
cacagctgtatagctgc

SEQ ID NO: 6691352 - DNA, 16 bp, Homo sapiens
cacagctgtctgccag

SEQ ID NO: 6691353 - DNA, 21 bp, Homo sapiens
cacagctgtctgccaggcact

SEQ ID NO: 6691354 - DNA, 14 bp, Homo sapiens
cacagctgtgagga

SEQ ID NO: 6691355 - DNA, 12 bp, Homo sapiens
cacagctgtggt

SEQ ID NO: 6691356 - DNA, 15 bp, Homo sapiens
cacagctgtttgaaa

SEQ ID NO: 6691357 - DNA, 17 bp, Homo sapiens
cacagcttaacaatgca

SEQ ID NO: 6691358 - DNA, 16 bp, Homo sapiens
cacagcttagatttca

SEQ ID NO: 6691359 - DNA, 18 bp, Homo sapiens
cacagcttcagccaggag

SEQ ID NO: 6691360 - DNA, 16 bp, Homo sapiens
cacagcttcccctctc

SEQ ID NO: 6691361 - DNA, 22 bp, Homo sapiens
cacagcttcctgtccccatctg

SEQ ID NO: 6691362 - DNA, 13 bp, Homo sapiens
cacagcttctcca

SEQ ID NO: 6691363 - DNA, 13 bp, Homo sapiens
cacagcttcttct

SEQ ID NO: 6691364 - DNA, 18 bp, Homo sapiens
cacagcttcttctgcccc

SEQ ID NO: 6691365 - DNA, 21 bp, Homo sapiens
cacagcttgacctgaggctgt

SEQ ID NO: 6691366 - DNA, 15 bp, Homo sapiens
cacagcttgggtcag

SEQ ID NO: 6691367 - DNA, 18 bp, Homo sapiens
cacagctttgaggaacat

SEQ ID NO: 6691368 - DNA, 16 bp, Homo sapiens
cacagctttgcacccc

SEQ ID NO: 6691369 - DNA, 23 bp, Homo sapiens
cacagcttttagtacccacctga

SEQ ID NO: 6691370 - DNA, 13 bp, Homo sapiens
cacaggaaaaata

SEQ ID NO: 6691371 - DNA, 16 bp, Homo sapiens
cacaggaaaagaattt

SEQ ID NO: 6691372 - DNA, 15 bp, Homo sapiens
cacaggaaagagtca

SEQ ID NO: 6691373 - DNA, 19 bp, Homo sapiens
cacaggaaccacaagactg

SEQ ID NO: 6691374 - DNA, 15 bp, Homo sapiens
cacaggaacggccct

SEQ ID NO: 6691375 - DNA, 20 bp, Homo sapiens
cacaggaacggccctgcagg

SEQ ID NO: 6691376 - DNA, 20 bp, Homo sapiens
cacaggaactctgtgtgaga

SEQ ID NO: 6691377 - DNA, 14 bp, Homo sapiens
cacaggaagagaag

SEQ ID NO: 6691378 - DNA, 15 bp, Homo sapiens
cacaggaagctcagc

SEQ ID NO: 6691379 - DNA, 17 bp, Homo sapiens
cacaggaagctcagcct

SEQ ID NO: 6691380 - DNA, 24 bp, Homo sapiens
cacaggaagctcagccttctcctc

SEQ ID NO: 6691381 - DNA, 18 bp, Homo sapiens
cacaggacaggggttcct

SEQ ID NO: 6691382 - DNA, 20 bp, Homo sapiens
cacaggacatgcggtagcca

SEQ ID NO: 6691383 - DNA, 23 bp, Homo sapiens
cacaggacatgcggtagccagca

SEQ ID NO: 6691384 - DNA, 17 bp, Homo sapiens
cacaggaccacacgcag

SEQ ID NO: 6691385 - DNA, 14 bp, Homo sapiens
cacaggaccacctc

SEQ ID NO: 6691386 - DNA, 15 bp, Homo sapiens
cacaggaccacctcc

SEQ ID NO: 6691387 - DNA, 16 bp, Homo sapiens
cacaggacccccttcc

SEQ ID NO: 6691388 - DNA, 19 bp, Homo sapiens
cacaggacccccttcccct

SEQ ID NO: 6691389 - DNA, 19 bp, Homo sapiens
cacaggacgatttcactga

SEQ ID NO: 6691390 - DNA, 15 bp, Homo sapiens
cacaggactctgcag

SEQ ID NO: 6691391 - DNA, 15 bp, Homo sapiens
cacaggactctgcct

SEQ ID NO: 6691392 - DNA, 21 bp, Homo sapiens
cacaggactgattctgggatg

SEQ ID NO: 6691393 - DNA, 22 bp, Homo sapiens
cacaggacttcccccaccccag

SEQ ID NO: 6691394 - DNA, 15 bp, Homo sapiens
cacaggagacactgt

SEQ ID NO: 6691395 - DNA, 21 bp, Homo sapiens
cacaggagactccaaggagct

SEQ ID NO: 6691396 - DNA, 19 bp, Homo sapiens
cacaggagaggatggccca

SEQ ID NO: 6691397 - DNA, 21 bp, Homo sapiens
cacaggagcaatcacaggaaa

SEQ ID NO: 6691398 - DNA, 13 bp, Homo sapiens
cacaggagcagac

SEQ ID NO: 6691399 - DNA, 18 bp, Homo sapiens
cacaggagcagacagaga

SEQ ID NO: 6691400 - DNA, 21 bp, Homo sapiens
cacaggagcagacagagaaat

SEQ ID NO: 6691401 - DNA, 23 bp, Homo sapiens
cacaggagcagacagagaaatgt

SEQ ID NO: 6691402 - DNA, 18 bp, Homo sapiens
cacaggagcctctgcagt

SEQ ID NO: 6691403 - DNA, 17 bp, Homo sapiens
cacaggagcgtgtccta

SEQ ID NO: 6691404 - DNA, 19 bp, Homo sapiens
cacaggaggcaagcaagct

SEQ ID NO: 6691405 - DNA, 14 bp, Homo sapiens
cacaggaggcaggc

SEQ ID NO: 6691406 - DNA, 22 bp, Homo sapiens
cacaggaggcaggcatggccct

SEQ ID NO: 6691407 - DNA, 13 bp, Homo sapiens
cacaggaggctcc

SEQ ID NO: 6691408 - DNA, 21 bp, Homo sapiens
cacaggagggagggggaaggc

SEQ ID NO: 6691409 - DNA, 12 bp, Homo sapiens
cacaggagggcc

SEQ ID NO: 6691410 - DNA, 15 bp, Homo sapiens
cacaggagggccagc

SEQ ID NO: 6691411 - DNA, 12 bp, Homo sapiens
cacaggagggta

SEQ ID NO: 6691412 - DNA, 19 bp, Homo sapiens
cacaggagtcctttctttt

SEQ ID NO: 6691413 - DNA, 23 bp, Homo sapiens
cacaggagtcttcagacccagag

SEQ ID NO: 6691414 - DNA, 20 bp, Homo sapiens
cacaggagtgtcctcttccc

SEQ ID NO: 6691415 - DNA, 18 bp, Homo sapiens
cacaggagttgtgagccc

SEQ ID NO: 6691416 - DNA, 19 bp, Homo sapiens
cacaggagttgtgagccct

SEQ ID NO: 6691417 - DNA, 22 bp, Homo sapiens
cacaggagttgtgagccctcta

SEQ ID NO: 6691418 - DNA, 15 bp, Homo sapiens
cacaggatcagtctg

SEQ ID NO: 6691419 - DNA, 17 bp, Homo sapiens
cacaggatcagtctgat

SEQ ID NO: 6691420 - DNA, 20 bp, Homo sapiens
cacaggatcatcatttaaaa

SEQ ID NO: 6691421 - DNA, 19 bp, Homo sapiens
cacaggatcctattctcac

SEQ ID NO: 6691422 - DNA, 21 bp, Homo sapiens
cacaggatcctggcctgagaa

SEQ ID NO: 6691423 - DNA, 15 bp, Homo sapiens
cacaggatctgaact

SEQ ID NO: 6691424 - DNA, 18 bp, Homo sapiens
cacaggatgaactagcca

SEQ ID NO: 6691425 - DNA, 23 bp, Homo sapiens
cacaggatgaggtggtggagtgg

SEQ ID NO: 6691426 - DNA, 15 bp, Homo sapiens
cacaggatgccagcc

SEQ ID NO: 6691427 - DNA, 16 bp, Homo sapiens
cacaggatgccagccc

SEQ ID NO: 6691428 - DNA, 21 bp, Homo sapiens
cacaggcaaagaggtgctgct

SEQ ID NO: 6691429 - DNA, 16 bp, Homo sapiens
cacaggcaacattaca

SEQ ID NO: 6691430 - DNA, 19 bp, Homo sapiens
cacaggcaagagtgttctt

SEQ ID NO: 6691431 - DNA, 13 bp, Homo sapiens
cacaggcacacag

SEQ ID NO: 6691432 - DNA, 17 bp, Homo sapiens
cacaggcacacagggcc

SEQ ID NO: 6691433 - DNA, 18 bp, Homo sapiens
cacaggcacacagggccc

SEQ ID NO: 6691434 - DNA, 12 bp, Homo sapiens
cacaggcagacg

SEQ ID NO: 6691435 - DNA, 14 bp, Homo sapiens
cacaggcagcattt

SEQ ID NO: 6691436 - DNA, 17 bp, Homo sapiens
cacaggcagccagtgcc

SEQ ID NO: 6691437 - DNA, 16 bp, Homo sapiens
cacaggcagctggatg

SEQ ID NO: 6691438 - DNA, 19 bp, Homo sapiens
cacaggcagctttctagaa

SEQ ID NO: 6691439 - DNA, 10 bp, Homo sapiens
cacaggcagg

SEQ ID NO: 6691440 - DNA, 18 bp, Homo sapiens
cacaggcaggaagagaga

SEQ ID NO: 6691441 - DNA, 14 bp, Homo sapiens
cacaggcagggcag

SEQ ID NO: 6691442 - DNA, 13 bp, Homo sapiens
cacaggcagggcc

SEQ ID NO: 6691443 - DNA, 14 bp, Homo sapiens
cacaggcagggcct

SEQ ID NO: 6691444 - DNA, 17 bp, Homo sapiens
cacaggcagggcctggc

SEQ ID NO: 6691445 - DNA, 15 bp, Homo sapiens
cacaggcaggggtag

SEQ ID NO: 6691446 - DNA, 19 bp, Homo sapiens
cacaggcaggggtgagagc

SEQ ID NO: 6691447 - DNA, 11 bp, Homo sapiens
cacaggcaggt

SEQ ID NO: 6691448 - DNA, 23 bp, Homo sapiens
cacaggcatattccctgcacaca

SEQ ID NO: 6691449 - DNA, 17 bp, Homo sapiens
cacaggcatctacacag

SEQ ID NO: 6691450 - DNA, 22 bp, Homo sapiens
cacaggcatctacacagcctgg

SEQ ID NO: 6691451 - DNA, 18 bp, Homo sapiens
cacaggccacacgctgcc

SEQ ID NO: 6691452 - DNA, 23 bp, Homo sapiens
cacaggccacacgctgcccaggc

SEQ ID NO: 6691453 - DNA, 19 bp, Homo sapiens
cacaggccacttgctcaga

SEQ ID NO: 6691454 - DNA, 13 bp, Homo sapiens
cacaggccagccc

SEQ ID NO: 6691455 - DNA, 13 bp, Homo sapiens
cacaggccagcct

SEQ ID NO: 6691456 - DNA, 20 bp, Homo sapiens
cacaggccatatttgtggcc

SEQ ID NO: 6691457 - DNA, 13 bp, Homo sapiens
cacaggcccagaa

SEQ ID NO: 6691458 - DNA, 13 bp, Homo sapiens
cacaggcccagga

SEQ ID NO: 6691459 - DNA, 23 bp, Homo sapiens
cacaggccccccgcagcaccctg

SEQ ID NO: 6691460 - DNA, 12 bp, Homo sapiens
cacaggccccct

SEQ ID NO: 6691461 - DNA, 13 bp, Homo sapiens
cacaggccccctt

SEQ ID NO: 6691462 - DNA, 14 bp, Homo sapiens
cacaggcccggctc

SEQ ID NO: 6691463 - DNA, 20 bp, Homo sapiens
cacaggcccggctccaggct

SEQ ID NO: 6691464 - DNA, 12 bp, Homo sapiens
cacaggccctgg

SEQ ID NO: 6691465 - DNA, 14 bp, Homo sapiens
cacaggccctggct

SEQ ID NO: 6691466 - DNA, 17 bp, Homo sapiens
cacaggcccttcctctc

SEQ ID NO: 6691467 - DNA, 22 bp, Homo sapiens
cacaggccgtcaccctgggagc

SEQ ID NO: 6691468 - DNA, 14 bp, Homo sapiens
cacaggcctgagat

SEQ ID NO: 6691469 - DNA, 20 bp, Homo sapiens
cacaggcctgagatttcatc

SEQ ID NO: 6691470 - DNA, 14 bp, Homo sapiens
cacaggcctggccc

SEQ ID NO: 6691471 - DNA, 17 bp, Homo sapiens
cacaggcctggcccagc

SEQ ID NO: 6691472 - DNA, 23 bp, Homo sapiens
cacaggcctggcccagccagcag

SEQ ID NO: 6691473 - DNA, 14 bp, Homo sapiens
cacaggcctgtgta

SEQ ID NO: 6691474 - DNA, 22 bp, Homo sapiens
cacaggcctgtgtagctgtgac

SEQ ID NO: 6691475 - DNA, 13 bp, Homo sapiens
cacaggccttctg

SEQ ID NO: 6691476 - DNA, 17 bp, Homo sapiens
cacaggccttctgtggg

SEQ ID NO: 6691477 - DNA, 18 bp, Homo sapiens
cacaggccttctgtgggg

SEQ ID NO: 6691478 - DNA, 21 bp, Homo sapiens
cacaggccttctgtggggctg

SEQ ID NO: 6691479 - DNA, 23 bp, Homo sapiens
cacaggccttctgtggggctggg

SEQ ID NO: 6691480 - DNA, 14 bp, Homo sapiens
cacaggccttgctt

SEQ ID NO: 6691481 - DNA, 15 bp, Homo sapiens
cacaggctcagcatg

SEQ ID NO: 6691482 - DNA, 13 bp, Homo sapiens
cacaggctcaggc

SEQ ID NO: 6691483 - DNA, 13 bp, Homo sapiens
cacaggctcctgt

SEQ ID NO: 6691484 - DNA, 14 bp, Homo sapiens
cacaggctcctgta

SEQ ID NO: 6691485 - DNA, 12 bp, Homo sapiens
cacaggctgccc

SEQ ID NO: 6691486 - DNA, 19 bp, Homo sapiens
cacaggctgccgctgctct

SEQ ID NO: 6691487 - DNA, 14 bp, Homo sapiens
cacaggctggcagt

SEQ ID NO: 6691488 - DNA, 17 bp, Homo sapiens
cacaggctgggctgggc

SEQ ID NO: 6691489 - DNA, 19 bp, Homo sapiens
cacaggctgggctgggcac

SEQ ID NO: 6691490 - DNA, 13 bp, Homo sapiens
cacaggctgggtc

SEQ ID NO: 6691491 - DNA, 20 bp, Homo sapiens
cacaggcttacgctgctctc

SEQ ID NO: 6691492 - DNA, 18 bp, Homo sapiens
cacaggcttagggacagg

SEQ ID NO: 6691493 - DNA, 17 bp, Homo sapiens
cacaggcttctgagcag

SEQ ID NO: 6691494 - DNA, 15 bp, Homo sapiens
cacagggaaatactg

SEQ ID NO: 6691495 - DNA, 18 bp, Homo sapiens
cacagggaaatgtgtatc

SEQ ID NO: 6691496 - DNA, 14 bp, Homo sapiens
cacagggactctcc

SEQ ID NO: 6691497 - DNA, 22 bp, Homo sapiens
cacagggactgaaaacctctcc

SEQ ID NO: 6691498 - DNA, 16 bp, Homo sapiens
cacagggacttgaagt

SEQ ID NO: 6691499 - DNA, 15 bp, Homo sapiens
cacagggagctggca

SEQ ID NO: 6691500 - DNA, 15 bp, Homo sapiens
cacagggatccgact

SEQ ID NO: 6691501 - DNA, 24 bp, Homo sapiens
cacagggcaaaatcgccataggcc

SEQ ID NO: 6691502 - DNA, 14 bp, Homo sapiens
cacagggcaccaga

SEQ ID NO: 6691503 - DNA, 18 bp, Homo sapiens
cacagggcaccagaggcc

SEQ ID NO: 6691504 - DNA, 20 bp, Homo sapiens
cacagggcaccagaggccga

SEQ ID NO: 6691505 - DNA, 17 bp, Homo sapiens
cacagggcactgactga

SEQ ID NO: 6691506 - DNA, 17 bp, Homo sapiens
cacagggcagctgggcc

SEQ ID NO: 6691507 - DNA, 22 bp, Homo sapiens
cacagggcaggccttgctgggg

SEQ ID NO: 6691508 - DNA, 11 bp, Homo sapiens
cacagggcagt

SEQ ID NO: 6691509 - DNA, 20 bp, Homo sapiens
cacagggcatccaactgaga

SEQ ID NO: 6691510 - DNA, 17 bp, Homo sapiens
cacagggcatgaaatga

SEQ ID NO: 6691511 - DNA, 23 bp, Homo sapiens
cacagggcatgccccggccacct

SEQ ID NO: 6691512 - DNA, 24 bp, Homo sapiens
cacagggcatgcctggcctgagga

SEQ ID NO: 6691513 - DNA, 16 bp, Homo sapiens
cacagggccagaggga

SEQ ID NO: 6691514 - DNA, 17 bp, Homo sapiens
cacagggccagagggag

SEQ ID NO: 6691515 - DNA, 15 bp, Homo sapiens
cacagggcccggcca

SEQ ID NO: 6691516 - DNA, 17 bp, Homo sapiens
cacagggcctcagtttc

SEQ ID NO: 6691517 - DNA, 13 bp, Homo sapiens
cacagggcctgac

SEQ ID NO: 6691518 - DNA, 13 bp, Homo sapiens
cacagggcctggc

SEQ ID NO: 6691519 - DNA, 15 bp, Homo sapiens
cacagggcctggccc

SEQ ID NO: 6691520 - DNA, 17 bp, Homo sapiens
cacagggcctggcccat

SEQ ID NO: 6691521 - DNA, 19 bp, Homo sapiens
cacagggcctggcccatgt

SEQ ID NO: 6691522 - DNA, 13 bp, Homo sapiens
cacagggctcctg

SEQ ID NO: 6691523 - DNA, 18 bp, Homo sapiens
cacagggctcctgaagga

SEQ ID NO: 6691524 - DNA, 16 bp, Homo sapiens
cacagggctctttgat

SEQ ID NO: 6691525 - DNA, 15 bp, Homo sapiens
cacagggctgcatcc

SEQ ID NO: 6691526 - DNA, 17 bp, Homo sapiens
cacaggggacacccaga

SEQ ID NO: 6691527 - DNA, 23 bp, Homo sapiens
cacaggggcaaagaactgcccca

SEQ ID NO: 6691528 - DNA, 21 bp, Homo sapiens
cacaggggccatgtcctctct

SEQ ID NO: 6691529 - DNA, 13 bp, Homo sapiens
cacaggggcccca

SEQ ID NO: 6691530 - DNA, 15 bp, Homo sapiens
cacaggggccccaga

SEQ ID NO: 6691531 - DNA, 18 bp, Homo sapiens
cacaggggcggggcagga

SEQ ID NO: 6691532 - DNA, 22 bp, Homo sapiens
cacaggggctatcccttctcag

SEQ ID NO: 6691533 - DNA, 22 bp, Homo sapiens
cacagggggattctgagcagtg

SEQ ID NO: 6691534 - DNA, 19 bp, Homo sapiens
cacaggggtggagtttctg

SEQ ID NO: 6691535 - DNA, 23 bp, Homo sapiens
cacagggtctgctctttctctgc

SEQ ID NO: 6691536 - DNA, 14 bp, Homo sapiens
cacagggtgggcct

SEQ ID NO: 6691537 - DNA, 16 bp, Homo sapiens
cacagggtgggcctcg

SEQ ID NO: 6691538 - DNA, 23 bp, Homo sapiens
cacaggtatgaccttctaggaag

SEQ ID NO: 6691539 - DNA, 13 bp, Homo sapiens
cacaggtcagggc

SEQ ID NO: 6691540 - DNA, 18 bp, Homo sapiens
cacaggtcagggctcaga

SEQ ID NO: 6691541 - DNA, 20 bp, Homo sapiens
cacaggtcaggggtgacaca

SEQ ID NO: 6691542 - DNA, 22 bp, Homo sapiens
cacaggtcatcagatgcctgct

SEQ ID NO: 6691543 - DNA, 14 bp, Homo sapiens
cacaggtcccaaat

SEQ ID NO: 6691544 - DNA, 21 bp, Homo sapiens
cacaggtcccaaatggccctg

SEQ ID NO: 6691545 - DNA, 12 bp, Homo sapiens
cacaggtcccac

SEQ ID NO: 6691546 - DNA, 13 bp, Homo sapiens
cacaggtcctcca

SEQ ID NO: 6691547 - DNA, 21 bp, Homo sapiens
cacaggtcctccatcacccct

SEQ ID NO: 6691548 - DNA, 22 bp, Homo sapiens
cacaggtcctccatcacccctg

SEQ ID NO: 6691549 - DNA, 23 bp, Homo sapiens
cacaggtcctccatcacccctgg

SEQ ID NO: 6691550 - DNA, 23 bp, Homo sapiens
cacaggtcctgaaagtctgtgtc

SEQ ID NO: 6691551 - DNA, 13 bp, Homo sapiens
cacaggtctagac

SEQ ID NO: 6691552 - DNA, 14 bp, Homo sapiens
cacaggtctagact

SEQ ID NO: 6691553 - DNA, 13 bp, Homo sapiens
cacaggtctctgt

SEQ ID NO: 6691554 - DNA, 18 bp, Homo sapiens
cacaggtcttcactgccc

SEQ ID NO: 6691555 - DNA, 14 bp, Homo sapiens
cacaggtctttcct

SEQ ID NO: 6691556 - DNA, 18 bp, Homo sapiens
cacaggtctttcctaagg

SEQ ID NO: 6691557 - DNA, 18 bp, Homo sapiens
cacaggtgccgccagctg

SEQ ID NO: 6691558 - DNA, 18 bp, Homo sapiens
cacaggtgggcttcccag

SEQ ID NO: 6691559 - DNA, 16 bp, Homo sapiens
cacaggtggtgtcact

SEQ ID NO: 6691560 - DNA, 16 bp, Homo sapiens
cacaggtgtaaatata

SEQ ID NO: 6691561 - DNA, 14 bp, Homo sapiens
cacaggtgtcagcc

SEQ ID NO: 6691562 - DNA, 17 bp, Homo sapiens
cacaggtgtcagccatt

SEQ ID NO: 6691563 - DNA, 19 bp, Homo sapiens
cacaggtgtggtgtaattt

SEQ ID NO: 6691564 - DNA, 19 bp, Homo sapiens
cacaggttagggtgtgtgc

SEQ ID NO: 6691565 - DNA, 23 bp, Homo sapiens
cacaggttctgcgttacaacagt

SEQ ID NO: 6691566 - DNA, 22 bp, Homo sapiens
cacaggtttccccaaggcctct

SEQ ID NO: 6691567 - DNA, 23 bp, Homo sapiens
cacaggttttaaggattctgcag

SEQ ID NO: 6691568 - DNA, 16 bp, Homo sapiens
cacaggttttcagaga

SEQ ID NO: 6691569 - DNA, 20 bp, Homo sapiens
cacaggttttcagagaatta

SEQ ID NO: 6691570 - DNA, 15 bp, Homo sapiens
cacagtaaaaataaa

SEQ ID NO: 6691571 - DNA, 18 bp, Homo sapiens
cacagtaaacgtgtttgt

SEQ ID NO: 6691572 - DNA, 16 bp, Homo sapiens
cacagtaaagagtaca

SEQ ID NO: 6691573 - DNA, 20 bp, Homo sapiens
cacagtaaagagtacactca

SEQ ID NO: 6691574 - DNA, 21 bp, Homo sapiens
cacagtaaagagtacactcag

SEQ ID NO: 6691575 - DNA, 23 bp, Homo sapiens
cacagtaatctttcggtctcctt

SEQ ID NO: 6691576 - DNA, 16 bp, Homo sapiens
cacagtacaataatgt

SEQ ID NO: 6691577 - DNA, 17 bp, Homo sapiens
cacagtacaataatgta

SEQ ID NO: 6691578 - DNA, 18 bp, Homo sapiens
cacagtacaatgtttcag

SEQ ID NO: 6691579 - DNA, 23 bp, Homo sapiens
cacagtacacacaaaaaccttgg

SEQ ID NO: 6691580 - DNA, 20 bp, Homo sapiens
cacagtacacaccagaagat

SEQ ID NO: 6691581 - DNA, 17 bp, Homo sapiens
cacagtacagcatgtgc

SEQ ID NO: 6691582 - DNA, 14 bp, Homo sapiens
cacagtacatatgt

SEQ ID NO: 6691583 - DNA, 17 bp, Homo sapiens
cacagtaccggattctc

SEQ ID NO: 6691584 - DNA, 21 bp, Homo sapiens
cacagtactcactttttccaa

SEQ ID NO: 6691585 - DNA, 21 bp, Homo sapiens
cacagtacttcctcccagcat

SEQ ID NO: 6691586 - DNA, 18 bp, Homo sapiens
cacagtactttattgtac

SEQ ID NO: 6691587 - DNA, 15 bp, Homo sapiens
cacagtagagcactt

SEQ ID NO: 6691588 - DNA, 14 bp, Homo sapiens
cacagtagagccag

SEQ ID NO: 6691589 - DNA, 20 bp, Homo sapiens
cacagtagctccaacacttt

SEQ ID NO: 6691590 - DNA, 23 bp, Homo sapiens
cacagtaggtcccggccagctct

SEQ ID NO: 6691591 - DNA, 13 bp, Homo sapiens
cacagtagtcttg

SEQ ID NO: 6691592 - DNA, 22 bp, Homo sapiens
cacagtagtgttgggtggagga

SEQ ID NO: 6691593 - DNA, 13 bp, Homo sapiens
cacagtatatttt

SEQ ID NO: 6691594 - DNA, 16 bp, Homo sapiens
cacagtatattttatt

SEQ ID NO: 6691595 - DNA, 19 bp, Homo sapiens
cacagtatctgctgttctt

SEQ ID NO: 6691596 - DNA, 23 bp, Homo sapiens
cacagtatctgctgttcttcagt

SEQ ID NO: 6691597 - DNA, 19 bp, Homo sapiens
cacagtatgttacatgcat

SEQ ID NO: 6691598 - DNA, 16 bp, Homo sapiens
cacagtattgtagaaa

SEQ ID NO: 6691599 - DNA, 23 bp, Homo sapiens
cacagtattgtagaaagctaata

SEQ ID NO: 6691600 - DNA, 13 bp, Homo sapiens
cacagtatttaac

SEQ ID NO: 6691601 - DNA, 15 bp, Homo sapiens
cacagtatttgtaat

SEQ ID NO: 6691602 - DNA, 13 bp, Homo sapiens
cacagtattttga

SEQ ID NO: 6691603 - DNA, 14 bp, Homo sapiens
cacagtattttgat

SEQ ID NO: 6691604 - DNA, 15 bp, Homo sapiens
cacagtcaaaaggaa

SEQ ID NO: 6691605 - DNA, 15 bp, Homo sapiens
cacagtcacattcga

SEQ ID NO: 6691606 - DNA, 15 bp, Homo sapiens
cacagtcactgctct

SEQ ID NO: 6691607 - DNA, 14 bp, Homo sapiens
cacagtcagaagga

SEQ ID NO: 6691608 - DNA, 23 bp, Homo sapiens
cacagtcagcatgcttcccagag

SEQ ID NO: 6691609 - DNA, 21 bp, Homo sapiens
cacagtcagggcggggctggc

SEQ ID NO: 6691610 - DNA, 16 bp, Homo sapiens
cacagtcaggggctgg

SEQ ID NO: 6691611 - DNA, 19 bp, Homo sapiens
cacagtcaggggctgggca

SEQ ID NO: 6691612 - DNA, 13 bp, Homo sapiens
cacagtcagtgac

SEQ ID NO: 6691613 - DNA, 14 bp, Homo sapiens
cacagtcagtggag

SEQ ID NO: 6691614 - DNA, 17 bp, Homo sapiens
cacagtcagtggagcct

SEQ ID NO: 6691615 - DNA, 19 bp, Homo sapiens
cacagtcatacaagtcatg

SEQ ID NO: 6691616 - DNA, 17 bp, Homo sapiens
cacagtcattctaggat

SEQ ID NO: 6691617 - DNA, 16 bp, Homo sapiens
cacagtccaaccagaa

SEQ ID NO: 6691618 - DNA, 18 bp, Homo sapiens
cacagtccaaccagaaac

SEQ ID NO: 6691619 - DNA, 21 bp, Homo sapiens
cacagtccaactcttccacct

SEQ ID NO: 6691620 - DNA, 15 bp, Homo sapiens
cacagtccagaccca

SEQ ID NO: 6691621 - DNA, 18 bp, Homo sapiens
cacagtccaggaacaagc

SEQ ID NO: 6691622 - DNA, 23 bp, Homo sapiens
cacagtcccaggtttagtgaaaa

SEQ ID NO: 6691623 - DNA, 15 bp, Homo sapiens
cacagtcccattcct

SEQ ID NO: 6691624 - DNA, 15 bp, Homo sapiens
cacagtccccagact

SEQ ID NO: 6691625 - DNA, 20 bp, Homo sapiens
cacagtcccccacccacctc

SEQ ID NO: 6691626 - DNA, 23 bp, Homo sapiens
cacagtcccccacccacctcctg

SEQ ID NO: 6691627 - DNA, 14 bp, Homo sapiens
cacagtccctcacc

SEQ ID NO: 6691628 - DNA, 15 bp, Homo sapiens
cacagtccctcacct

SEQ ID NO: 6691629 - DNA, 16 bp, Homo sapiens
cacagtccctcacctc

SEQ ID NO: 6691630 - DNA, 15 bp, Homo sapiens
cacagtccctcctgt

SEQ ID NO: 6691631 - DNA, 22 bp, Homo sapiens
cacagtcctcacacacggaggc

SEQ ID NO: 6691632 - DNA, 16 bp, Homo sapiens
cacagtcctgaagcag

SEQ ID NO: 6691633 - DNA, 15 bp, Homo sapiens
cacagtccttaccag

SEQ ID NO: 6691634 - DNA, 18 bp, Homo sapiens
cacagtctcagtccagat

SEQ ID NO: 6691635 - DNA, 20 bp, Homo sapiens
cacagtctccatgtgtgtgc

SEQ ID NO: 6691636 - DNA, 17 bp, Homo sapiens
cacagtctccccagata

SEQ ID NO: 6691637 - DNA, 14 bp, Homo sapiens
cacagtctccccca

SEQ ID NO: 6691638 - DNA, 20 bp, Homo sapiens
cacagtctccggcctctcca

SEQ ID NO: 6691639 - DNA, 12 bp, Homo sapiens
cacagtctctgg

SEQ ID NO: 6691640 - DNA, 14 bp, Homo sapiens
cacagtctctggaa

SEQ ID NO: 6691641 - DNA, 23 bp, Homo sapiens
cacagtctctggaaaagctgggg

SEQ ID NO: 6691642 - DNA, 13 bp, Homo sapiens
cacagtctctggg

SEQ ID NO: 6691643 - DNA, 23 bp, Homo sapiens
cacagtctggagtgatagctact

SEQ ID NO: 6691644 - DNA, 15 bp, Homo sapiens
cacagtcttgtgaac

SEQ ID NO: 6691645 - DNA, 12 bp, Homo sapiens
cacagtgaaacg

SEQ ID NO: 6691646 - DNA, 21 bp, Homo sapiens
cacagtgaaacgcaattttac

SEQ ID NO: 6691647 - DNA, 16 bp, Homo sapiens
cacagtgaaaggcctg

SEQ ID NO: 6691648 - DNA, 23 bp, Homo sapiens
cacagtgaacataactgtaacat

SEQ ID NO: 6691649 - DNA, 15 bp, Homo sapiens
cacagtgaagtgctg

SEQ ID NO: 6691650 - DNA, 21 bp, Homo sapiens
cacagtgaatgtgtgtatgta

SEQ ID NO: 6691651 - DNA, 20 bp, Homo sapiens
cacagtgacaccatttgtcc

SEQ ID NO: 6691652 - DNA, 16 bp, Homo sapiens
cacagtgacacgtttg

SEQ ID NO: 6691653 - DNA, 14 bp, Homo sapiens
cacagtgacactgg

SEQ ID NO: 6691654 - DNA, 17 bp, Homo sapiens
cacagtgacagtcactt

SEQ ID NO: 6691655 - DNA, 16 bp, Homo sapiens
cacagtgacccttccc

SEQ ID NO: 6691656 - DNA, 14 bp, Homo sapiens
cacagtgacttcct

SEQ ID NO: 6691657 - DNA, 15 bp, Homo sapiens
cacagtgacttctga

SEQ ID NO: 6691658 - DNA, 18 bp, Homo sapiens
cacagtgagactgtacat

SEQ ID NO: 6691659 - DNA, 22 bp, Homo sapiens
cacagtgagactgtacataatt

SEQ ID NO: 6691660 - DNA, 16 bp, Homo sapiens
cacagtgagaggggag

SEQ ID NO: 6691661 - DNA, 19 bp, Homo sapiens
cacagtgagtcgaggacag

SEQ ID NO: 6691662 - DNA, 20 bp, Homo sapiens
cacagtgagtcgaggacagg

SEQ ID NO: 6691663 - DNA, 11 bp, Homo sapiens
cacagtgatat

SEQ ID NO: 6691664 - DNA, 19 bp, Homo sapiens
cacagtgatcaagttattt

SEQ ID NO: 6691665 - DNA, 14 bp, Homo sapiens
cacagtgatgccgg

SEQ ID NO: 6691666 - DNA, 16 bp, Homo sapiens
cacagtgattagcctc

SEQ ID NO: 6691667 - DNA, 21 bp, Homo sapiens
cacagtgcagcaagcctggcc

SEQ ID NO: 6691668 - DNA, 19 bp, Homo sapiens
cacagtgccaccaagctca

SEQ ID NO: 6691669 - DNA, 13 bp, Homo sapiens
cacagtgccccag

SEQ ID NO: 6691670 - DNA, 18 bp, Homo sapiens
cacagtgccttcaataaa

SEQ ID NO: 6691671 - DNA, 13 bp, Homo sapiens
cacagtgctcagt

SEQ ID NO: 6691672 - DNA, 15 bp, Homo sapiens
cacagtgctgcccct

SEQ ID NO: 6691673 - DNA, 23 bp, Homo sapiens
cacagtgctgccccttgcaagcc

SEQ ID NO: 6691674 - DNA, 23 bp, Homo sapiens
cacagtgctgcgagatcgctggc

SEQ ID NO: 6691675 - DNA, 15 bp, Homo sapiens
cacagtgctgggatt

SEQ ID NO: 6691676 - DNA, 13 bp, Homo sapiens
cacagtgctgttg

SEQ ID NO: 6691677 - DNA, 16 bp, Homo sapiens
cacagtgcttagaagt

SEQ ID NO: 6691678 - DNA, 19 bp, Homo sapiens
cacagtggacggaggtccc

SEQ ID NO: 6691679 - DNA, 18 bp, Homo sapiens
cacagtggactcagcagt

SEQ ID NO: 6691680 - DNA, 20 bp, Homo sapiens
cacagtggactcagcagtga

SEQ ID NO: 6691681 - DNA, 18 bp, Homo sapiens
cacagtggcaagaaacat

SEQ ID NO: 6691682 - DNA, 22 bp, Homo sapiens
cacagtggccaagatcacagtg

SEQ ID NO: 6691683 - DNA, 13 bp, Homo sapiens
cacagtggccacg

SEQ ID NO: 6691684 - DNA, 16 bp, Homo sapiens
cacagtggccggggct

SEQ ID NO: 6691685 - DNA, 22 bp, Homo sapiens
cacagtggccggggctgaagcc

SEQ ID NO: 6691686 - DNA, 18 bp, Homo sapiens
cacagtgggagccagggc

SEQ ID NO: 6691687 - DNA, 13 bp, Homo sapiens
cacagtgggagct

SEQ ID NO: 6691688 - DNA, 19 bp, Homo sapiens
cacagtgggatgaaccagc

SEQ ID NO: 6691689 - DNA, 21 bp, Homo sapiens
cacagtgggccggccccaggc

SEQ ID NO: 6691690 - DNA, 22 bp, Homo sapiens
cacagtgggccggccccaggct

SEQ ID NO: 6691691 - DNA, 16 bp, Homo sapiens
cacagtgggcctgtgt

SEQ ID NO: 6691692 - DNA, 20 bp, Homo sapiens
cacagtgggcggcttccctg

SEQ ID NO: 6691693 - DNA, 22 bp, Homo sapiens
cacagtggggcccatggcccca

SEQ ID NO: 6691694 - DNA, 21 bp, Homo sapiens
cacagtggggctgcaggcagg

SEQ ID NO: 6691695 - DNA, 13 bp, Homo sapiens
cacagtgggtggc

SEQ ID NO: 6691696 - DNA, 20 bp, Homo sapiens
cacagtgggtggcacctcct

SEQ ID NO: 6691697 - DNA, 22 bp, Homo sapiens
cacagtgggtggcacctcctga

SEQ ID NO: 6691698 - DNA, 16 bp, Homo sapiens
cacagtggtccagggt

SEQ ID NO: 6691699 - DNA, 15 bp, Homo sapiens
cacagtggtggcagg

SEQ ID NO: 6691700 - DNA, 19 bp, Homo sapiens
cacagtggtggcagggcct

SEQ ID NO: 6691701 - DNA, 17 bp, Homo sapiens
cacagtggttcctggct

SEQ ID NO: 6691702 - DNA, 20 bp, Homo sapiens
cacagtgtaatccaggggtg

SEQ ID NO: 6691703 - DNA, 15 bp, Homo sapiens
cacagtgtaccatta

SEQ ID NO: 6691704 - DNA, 16 bp, Homo sapiens
cacagtgtatgaaggg

SEQ ID NO: 6691705 - DNA, 14 bp, Homo sapiens
cacagtgtctgggc

SEQ ID NO: 6691706 - DNA, 17 bp, Homo sapiens
cacagtgtctgggctga

SEQ ID NO: 6691707 - DNA, 19 bp, Homo sapiens
cacagtgtctgtaaatcaa

SEQ ID NO: 6691708 - DNA, 18 bp, Homo sapiens
cacagtgtctgtatcgga

SEQ ID NO: 6691709 - DNA, 15 bp, Homo sapiens
cacagtgtggggcag

SEQ ID NO: 6691710 - DNA, 11 bp, Homo sapiens
cacagtgtgtg

SEQ ID NO: 6691711 - DNA, 21 bp, Homo sapiens
cacagtgtgtgacttacagaa

SEQ ID NO: 6691712 - DNA, 21 bp, Homo sapiens
cacagtgtgtggtcaacattt

SEQ ID NO: 6691713 - DNA, 16 bp, Homo sapiens
cacagtgtgtttgtga

SEQ ID NO: 6691714 - DNA, 16 bp, Homo sapiens
cacagtgttagtgctg

SEQ ID NO: 6691715 - DNA, 17 bp, Homo sapiens
cacagtgttgtgcccct

SEQ ID NO: 6691716 - DNA, 13 bp, Homo sapiens
cacagtgtttata

SEQ ID NO: 6691717 - DNA, 13 bp, Homo sapiens
cacagtgtttcaa

SEQ ID NO: 6691718 - DNA, 14 bp, Homo sapiens
cacagtgtttcaat

SEQ ID NO: 6691719 - DNA, 17 bp, Homo sapiens
cacagtgtttcttattc

SEQ ID NO: 6691720 - DNA, 21 bp, Homo sapiens
cacagttagttgtgaaagaaa

SEQ ID NO: 6691721 - DNA, 23 bp, Homo sapiens
cacagttcaaaattctaaatgta

SEQ ID NO: 6691722 - DNA, 16 bp, Homo sapiens
cacagttcctcgccct

SEQ ID NO: 6691723 - DNA, 20 bp, Homo sapiens
cacagttcctcgccctgggt

SEQ ID NO: 6691724 - DNA, 22 bp, Homo sapiens
cacagttcctcgccctgggtct

SEQ ID NO: 6691725 - DNA, 14 bp, Homo sapiens
cacagttccttgca

SEQ ID NO: 6691726 - DNA, 14 bp, Homo sapiens
cacagttctatttg

SEQ ID NO: 6691727 - DNA, 15 bp, Homo sapiens
cacagttctctcctt

SEQ ID NO: 6691728 - DNA, 21 bp, Homo sapiens
cacagttcttaatacaggaga

SEQ ID NO: 6691729 - DNA, 14 bp, Homo sapiens
cacagttgccacca

SEQ ID NO: 6691730 - DNA, 19 bp, Homo sapiens
cacagttggcacttctgcc

SEQ ID NO: 6691731 - DNA, 20 bp, Homo sapiens
cacagttggcacttctgcca

SEQ ID NO: 6691732 - DNA, 12 bp, Homo sapiens
cacagttggcct

SEQ ID NO: 6691733 - DNA, 18 bp, Homo sapiens
cacagttgggacccaaaa

SEQ ID NO: 6691734 - DNA, 22 bp, Homo sapiens
cacagttgggacccaaaacaca

SEQ ID NO: 6691735 - DNA, 21 bp, Homo sapiens
cacagttgtctattctgagcc

SEQ ID NO: 6691736 - DNA, 22 bp, Homo sapiens
cacagttgtctattctgagcct

SEQ ID NO: 6691737 - DNA, 19 bp, Homo sapiens
cacagttgttgaatgactg

SEQ ID NO: 6691738 - DNA, 15 bp, Homo sapiens
cacagtttaaaaaat

SEQ ID NO: 6691739 - DNA, 18 bp, Homo sapiens
cacagtttaaacacatca

SEQ ID NO: 6691740 - DNA, 18 bp, Homo sapiens
cacagtttagaacagagg

SEQ ID NO: 6691741 - DNA, 20 bp, Homo sapiens
cacagtttcaggcttttatg

SEQ ID NO: 6691742 - DNA, 22 bp, Homo sapiens
cacagtttgcaatcttatgttg

SEQ ID NO: 6691743 - DNA, 21 bp, Homo sapiens
cacagtttgctatttgcttta

SEQ ID NO: 6691744 - DNA, 14 bp, Homo sapiens
cacagttttaataa

SEQ ID NO: 6691745 - DNA, 17 bp, Homo sapiens
cacagttttaataagaa

SEQ ID NO: 6691746 - DNA, 14 bp, Homo sapiens
cacagttttctgag

SEQ ID NO: 6691747 - DNA, 15 bp, Homo sapiens
cacagttttctgaga

SEQ ID NO: 6691748 - DNA, 16 bp, Homo sapiens
cacagttttctgagaa

SEQ ID NO: 6691749 - DNA, 21 bp, Homo sapiens
cacagttttctgagaaagact

SEQ ID NO: 6691750 - DNA, 22 bp, Homo sapiens
cacagttttctgagaaagacta

SEQ ID NO: 6691751 - DNA, 15 bp, Homo sapiens
cacagttttgaaaga

SEQ ID NO: 6691752 - DNA, 23 bp, Homo sapiens
cacagttttggttgctttaatat

SEQ ID NO: 6691753 - DNA, 13 bp, Homo sapiens
cacagttttgtct

SEQ ID NO: 6691754 - DNA, 17 bp, Homo sapiens
cacataaaagccccagc

SEQ ID NO: 6691755 - DNA, 14 bp, Homo sapiens
cacataaaagtaat

SEQ ID NO: 6691756 - DNA, 18 bp, Homo sapiens
cacataaaagtaattaat

SEQ ID NO: 6691757 - DNA, 20 bp, Homo sapiens
cacataaaagtaattaattg

SEQ ID NO: 6691758 - DNA, 15 bp, Homo sapiens
cacataaaagtctgt

SEQ ID NO: 6691759 - DNA, 16 bp, Homo sapiens
cacataaactccgttt

SEQ ID NO: 6691760 - DNA, 20 bp, Homo sapiens
cacataaaggtatttagaat

SEQ ID NO: 6691761 - DNA, 15 bp, Homo sapiens
cacataaatctgtct

SEQ ID NO: 6691762 - DNA, 20 bp, Homo sapiens
cacataaatctgtctgattc

SEQ ID NO: 6691763 - DNA, 18 bp, Homo sapiens
cacataaatgaaagaaac

SEQ ID NO: 6691764 - DNA, 16 bp, Homo sapiens
cacataaatgcagccc

SEQ ID NO: 6691765 - DNA, 17 bp, Homo sapiens
cacataaatgctccttg

SEQ ID NO: 6691766 - DNA, 22 bp, Homo sapiens
cacataaatggattaattacta

SEQ ID NO: 6691767 - DNA, 12 bp, Homo sapiens
cacataaattat

SEQ ID NO: 6691768 - DNA, 13 bp, Homo sapiens
cacataaatttta

SEQ ID NO: 6691769 - DNA, 19 bp, Homo sapiens
cacataaattttaattcaa

SEQ ID NO: 6691770 - DNA, 17 bp, Homo sapiens
cacataaccttaaaaag

SEQ ID NO: 6691771 - DNA, 18 bp, Homo sapiens
cacataagagagatgaga

SEQ ID NO: 6691772 - DNA, 19 bp, Homo sapiens
cacataagcccagttcatc

SEQ ID NO: 6691773 - DNA, 21 bp, Homo sapiens
cacataaggggtttgccattt

SEQ ID NO: 6691774 - DNA, 13 bp, Homo sapiens
cacataataaacg

SEQ ID NO: 6691775 - DNA, 18 bp, Homo sapiens
cacataatttctgtttca

SEQ ID NO: 6691776 - DNA, 13 bp, Homo sapiens
cacataatttgaa

SEQ ID NO: 6691777 - DNA, 12 bp, Homo sapiens
cacataatttgc

SEQ ID NO: 6691778 - DNA, 16 bp, Homo sapiens
cacataatttttgtac

SEQ ID NO: 6691779 - DNA, 15 bp, Homo sapiens
cacatacaatttgca

SEQ ID NO: 6691780 - DNA, 17 bp, Homo sapiens
cacatacaatttgcact

SEQ ID NO: 6691781 - DNA, 19 bp, Homo sapiens
cacatacaatttgcactgt

SEQ ID NO: 6691782 - DNA, 13 bp, Homo sapiens
cacatacacacac

SEQ ID NO: 6691783 - DNA, 20 bp, Homo sapiens
cacatacacccaaacactta

SEQ ID NO: 6691784 - DNA, 12 bp, Homo sapiens
cacatacagaaa

SEQ ID NO: 6691785 - DNA, 17 bp, Homo sapiens
cacatacagaaagaagc

SEQ ID NO: 6691786 - DNA, 21 bp, Homo sapiens
cacatacagagctctctgagg

SEQ ID NO: 6691787 - DNA, 16 bp, Homo sapiens
cacatacattaaaact

SEQ ID NO: 6691788 - DNA, 22 bp, Homo sapiens
cacataccaggcaacctcccat

SEQ ID NO: 6691789 - DNA, 20 bp, Homo sapiens
cacatacccacacattccag

SEQ ID NO: 6691790 - DNA, 22 bp, Homo sapiens
cacatacccacacattccaggg

SEQ ID NO: 6691791 - DNA, 23 bp, Homo sapiens
cacatacccacacattccagggc

SEQ ID NO: 6691792 - DNA, 19 bp, Homo sapiens
cacataccctcttcatgga

SEQ ID NO: 6691793 - DNA, 22 bp, Homo sapiens
cacatacgtgagggggagctga

SEQ ID NO: 6691794 - DNA, 17 bp, Homo sapiens
cacatactgtgttccaa

SEQ ID NO: 6691795 - DNA, 15 bp, Homo sapiens
cacatagactgtgcg

SEQ ID NO: 6691796 - DNA, 16 bp, Homo sapiens
cacatagagatatgca

SEQ ID NO: 6691797 - DNA, 18 bp, Homo sapiens
cacatagagatatgcaca

SEQ ID NO: 6691798 - DNA, 18 bp, Homo sapiens
cacatagagctttttaat

SEQ ID NO: 6691799 - DNA, 13 bp, Homo sapiens
cacatagattaat

SEQ ID NO: 6691800 - DNA, 18 bp, Homo sapiens
cacatagattaatggcac

SEQ ID NO: 6691801 - DNA, 20 bp, Homo sapiens
cacatagattaatggcactg

SEQ ID NO: 6691802 - DNA, 21 bp, Homo sapiens
cacatagcaggggcaccttcc

SEQ ID NO: 6691803 - DNA, 15 bp, Homo sapiens
cacatagcatgcttc

SEQ ID NO: 6691804 - DNA, 12 bp, Homo sapiens
cacatagcatgt

SEQ ID NO: 6691805 - DNA, 21 bp, Homo sapiens
cacatagcccacttacattta

SEQ ID NO: 6691806 - DNA, 16 bp, Homo sapiens
cacatagccctgttga

SEQ ID NO: 6691807 - DNA, 21 bp, Homo sapiens
cacatagccctgttgacctgc

SEQ ID NO: 6691808 - DNA, 18 bp, Homo sapiens
cacatagcgccgtgctgt

SEQ ID NO: 6691809 - DNA, 23 bp, Homo sapiens
cacatagcgccgtgctgtaaata

SEQ ID NO: 6691810 - DNA, 21 bp, Homo sapiens
cacatagctagttatgtgaga

SEQ ID NO: 6691811 - DNA, 17 bp, Homo sapiens
cacatagctgggatttg

SEQ ID NO: 6691812 - DNA, 22 bp, Homo sapiens
cacatagctgggatttgaactg

SEQ ID NO: 6691813 - DNA, 21 bp, Homo sapiens
cacataggaagggatctgaga

SEQ ID NO: 6691814 - DNA, 20 bp, Homo sapiens
cacataggctctcaggtgcc

SEQ ID NO: 6691815 - DNA, 19 bp, Homo sapiens
cacataggctggtggcctt

SEQ ID NO: 6691816 - DNA, 21 bp, Homo sapiens
cacataggctggtggccttgg

SEQ ID NO: 6691817 - DNA, 23 bp, Homo sapiens
cacataggctggtggccttgggc

SEQ ID NO: 6691818 - DNA, 22 bp, Homo sapiens
cacataggtaggtatctttata

SEQ ID NO: 6691819 - DNA, 19 bp, Homo sapiens
cacatagtgtcctgcccac

SEQ ID NO: 6691820 - DNA, 22 bp, Homo sapiens
cacatagtttttaaggttattt

SEQ ID NO: 6691821 - DNA, 16 bp, Homo sapiens
cacatagtttttcagt

SEQ ID NO: 6691822 - DNA, 20 bp, Homo sapiens
cacatagtttttcagtctat

SEQ ID NO: 6691823 - DNA, 13 bp, Homo sapiens
cacatataaaaac

SEQ ID NO: 6691824 - DNA, 20 bp, Homo sapiens
cacatataaaagttaaacta

SEQ ID NO: 6691825 - DNA, 12 bp, Homo sapiens
cacatataacat

SEQ ID NO: 6691826 - DNA, 13 bp, Homo sapiens
cacatatacacga

SEQ ID NO: 6691827 - DNA, 15 bp, Homo sapiens
cacatatacatatat

SEQ ID NO: 6691828 - DNA, 17 bp, Homo sapiens
cacatatacatatatat

SEQ ID NO: 6691829 - DNA, 18 bp, Homo sapiens
cacatatacatatatata

SEQ ID NO: 6691830 - DNA, 15 bp, Homo sapiens
cacatatacatatga

SEQ ID NO: 6691831 - DNA, 22 bp, Homo sapiens
cacatatacgtgacagaattgt

SEQ ID NO: 6691832 - DNA, 17 bp, Homo sapiens
cacatatatacatacgc

SEQ ID NO: 6691833 - DNA, 14 bp, Homo sapiens
cacatatatattac

SEQ ID NO: 6691834 - DNA, 14 bp, Homo sapiens
cacatatatctgat

SEQ ID NO: 6691835 - DNA, 18 bp, Homo sapiens
cacatatcaaactgaaac

SEQ ID NO: 6691836 - DNA, 21 bp, Homo sapiens
cacatatcaagtcccgaggca

SEQ ID NO: 6691837 - DNA, 14 bp, Homo sapiens
cacatatcagcagg

SEQ ID NO: 6691838 - DNA, 15 bp, Homo sapiens
cacatatccaggcac

SEQ ID NO: 6691839 - DNA, 14 bp, Homo sapiens
cacatatctgtcat

SEQ ID NO: 6691840 - DNA, 17 bp, Homo sapiens
cacatatggcacaactg

SEQ ID NO: 6691841 - DNA, 17 bp, Homo sapiens
cacatatgtctgtatct

SEQ ID NO: 6691842 - DNA, 21 bp, Homo sapiens
cacatattaagaatagtctct

SEQ ID NO: 6691843 - DNA, 21 bp, Homo sapiens
cacatattagtgcagccaagt

SEQ ID NO: 6691844 - DNA, 21 bp, Homo sapiens
cacatattcatcagcaggagt

SEQ ID NO: 6691845 - DNA, 17 bp, Homo sapiens
cacatatttcagtgagg

SEQ ID NO: 6691846 - DNA, 12 bp, Homo sapiens
cacatattttaa

SEQ ID NO: 6691847 - DNA, 15 bp, Homo sapiens
cacatattttaaaat

SEQ ID NO: 6691848 - DNA, 18 bp, Homo sapiens
cacatcaaataagaaata

SEQ ID NO: 6691849 - DNA, 17 bp, Homo sapiens
cacatcaaatatttctt

SEQ ID NO: 6691850 - DNA, 22 bp, Homo sapiens
cacatcaagactatctacaaaa

SEQ ID NO: 6691851 - DNA, 15 bp, Homo sapiens
cacatcaagcatcat

SEQ ID NO: 6691852 - DNA, 15 bp, Homo sapiens
cacatcaagcttttc

SEQ ID NO: 6691853 - DNA, 17 bp, Homo sapiens
cacatcaattaattgat

SEQ ID NO: 6691854 - DNA, 19 bp, Homo sapiens
cacatcacacccatttaaa

SEQ ID NO: 6691855 - DNA, 14 bp, Homo sapiens
cacatcacagatga

SEQ ID NO: 6691856 - DNA, 16 bp, Homo sapiens
cacatcaccaggtgca

SEQ ID NO: 6691857 - DNA, 19 bp, Homo sapiens
cacatcacccatgttgaga

SEQ ID NO: 6691858 - DNA, 20 bp, Homo sapiens
cacatcagcaatttcagaac

SEQ ID NO: 6691859 - DNA, 19 bp, Homo sapiens
cacatcagctagcaaaaga

SEQ ID NO: 6691860 - DNA, 18 bp, Homo sapiens
cacatcagctcaaaattt

SEQ ID NO: 6691861 - DNA, 24 bp, Homo sapiens
cacatcagctccactttcagtgaa

SEQ ID NO: 6691862 - DNA, 17 bp, Homo sapiens
cacatcagtcacaagtt

SEQ ID NO: 6691863 - DNA, 17 bp, Homo sapiens
cacatcagtgaggaggg

SEQ ID NO: 6691864 - DNA, 20 bp, Homo sapiens
cacatcatattctattgttt

SEQ ID NO: 6691865 - DNA, 23 bp, Homo sapiens
cacatcatattctattgtttact

SEQ ID NO: 6691866 - DNA, 21 bp, Homo sapiens
cacatcatgagccttcagtca

SEQ ID NO: 6691867 - DNA, 18 bp, Homo sapiens
cacatcatggaccaaatg

SEQ ID NO: 6691868 - DNA, 14 bp, Homo sapiens
cacatcatgttact

SEQ ID NO: 6691869 - DNA, 15 bp, Homo sapiens
cacatcattcattca

SEQ ID NO: 6691870 - DNA, 17 bp, Homo sapiens
cacatcattcattcact

SEQ ID NO: 6691871 - DNA, 15 bp, Homo sapiens
cacatcattctgtgt

SEQ ID NO: 6691872 - DNA, 16 bp, Homo sapiens
cacatcattctgtgtc

SEQ ID NO: 6691873 - DNA, 13 bp, Homo sapiens
cacatcattggaa

SEQ ID NO: 6691874 - DNA, 14 bp, Homo sapiens
cacatccaactact

SEQ ID NO: 6691875 - DNA, 19 bp, Homo sapiens
cacatccaactccagcaac

SEQ ID NO: 6691876 - DNA, 17 bp, Homo sapiens
cacatccaatgcatagt

SEQ ID NO: 6691877 - DNA, 21 bp, Homo sapiens
cacatccacacacgcaggaac

SEQ ID NO: 6691878 - DNA, 12 bp, Homo sapiens
cacatccacccc

SEQ ID NO: 6691879 - DNA, 13 bp, Homo sapiens
cacatccacccca

SEQ ID NO: 6691880 - DNA, 17 bp, Homo sapiens
cacatccaccccagccc

SEQ ID NO: 6691881 - DNA, 16 bp, Homo sapiens
cacatccagccttgga

SEQ ID NO: 6691882 - DNA, 21 bp, Homo sapiens
cacatccatttcatctatttc

SEQ ID NO: 6691883 - DNA, 21 bp, Homo sapiens
cacatcccaccccatcctcca

SEQ ID NO: 6691884 - DNA, 18 bp, Homo sapiens
cacatcccagcagcccaa

SEQ ID NO: 6691885 - DNA, 22 bp, Homo sapiens
cacatcccagcagcccaagctt

SEQ ID NO: 6691886 - DNA, 12 bp, Homo sapiens
cacatcccagcc

SEQ ID NO: 6691887 - DNA, 12 bp, Homo sapiens
cacatcccaggc

SEQ ID NO: 6691888 - DNA, 15 bp, Homo sapiens
cacatcccatgttga

SEQ ID NO: 6691889 - DNA, 14 bp, Homo sapiens
cacatccccacctg

SEQ ID NO: 6691890 - DNA, 21 bp, Homo sapiens
cacatccccaccttccaagga

SEQ ID NO: 6691891 - DNA, 18 bp, Homo sapiens
cacatccccagagcccag

SEQ ID NO: 6691892 - DNA, 19 bp, Homo sapiens
cacatccccagagcccagc

SEQ ID NO: 6691893 - DNA, 14 bp, Homo sapiens
cacatccccctctc

SEQ ID NO: 6691894 - DNA, 16 bp, Homo sapiens
cacatccccgctggct

SEQ ID NO: 6691895 - DNA, 18 bp, Homo sapiens
cacatccccttagaggac

SEQ ID NO: 6691896 - DNA, 21 bp, Homo sapiens
cacatccccttagaggacctg

SEQ ID NO: 6691897 - DNA, 16 bp, Homo sapiens
cacatcccggcctctt

SEQ ID NO: 6691898 - DNA, 12 bp, Homo sapiens
cacatccctggg

SEQ ID NO: 6691899 - DNA, 18 bp, Homo sapiens
cacatccgcgtgtgcctg

SEQ ID NO: 6691900 - DNA, 19 bp, Homo sapiens
cacatccgcgtgtgcctgt

SEQ ID NO: 6691901 - DNA, 23 bp, Homo sapiens
cacatccgcgtgtgcctgtgtgc

SEQ ID NO: 6691902 - DNA, 19 bp, Homo sapiens
cacatccggggccagctcc

SEQ ID NO: 6691903 - DNA, 20 bp, Homo sapiens
cacatccggggccagctccg

SEQ ID NO: 6691904 - DNA, 19 bp, Homo sapiens
cacatcctatgcaatatat

SEQ ID NO: 6691905 - DNA, 12 bp, Homo sapiens
cacatcctcaga

SEQ ID NO: 6691906 - DNA, 21 bp, Homo sapiens
cacatcctcagaaagtgcagc

SEQ ID NO: 6691907 - DNA, 19 bp, Homo sapiens
cacatcctcatggcccatc

SEQ ID NO: 6691908 - DNA, 16 bp, Homo sapiens
cacatcctcattcact

SEQ ID NO: 6691909 - DNA, 18 bp, Homo sapiens
cacatcctccgtccagcc

SEQ ID NO: 6691910 - DNA, 14 bp, Homo sapiens
cacatcctctccag

SEQ ID NO: 6691911 - DNA, 22 bp, Homo sapiens
cacatcctgggatccagtgtat

SEQ ID NO: 6691912 - DNA, 14 bp, Homo sapiens
cacatcctgtggga

SEQ ID NO: 6691913 - DNA, 23 bp, Homo sapiens
cacatcctgtgggacctgggcca

SEQ ID NO: 6691914 - DNA, 17 bp, Homo sapiens
cacatcctgtgtttcta

SEQ ID NO: 6691915 - DNA, 21 bp, Homo sapiens
cacatccttgactttttagat

SEQ ID NO: 6691916 - DNA, 18 bp, Homo sapiens
cacatcgcacactggggc

SEQ ID NO: 6691917 - DNA, 17 bp, Homo sapiens
cacatcgttgccgcagc

SEQ ID NO: 6691918 - DNA, 16 bp, Homo sapiens
cacatctaattaaatg

SEQ ID NO: 6691919 - DNA, 17 bp, Homo sapiens
cacatctacatgccatg

SEQ ID NO: 6691920 - DNA, 21 bp, Homo sapiens
cacatctacatgccatgccta

SEQ ID NO: 6691921 - DNA, 13 bp, Homo sapiens
cacatctcaacag

SEQ ID NO: 6691922 - DNA, 14 bp, Homo sapiens
cacatctcaacagg

SEQ ID NO: 6691923 - DNA, 14 bp, Homo sapiens
cacatctcagggaa

SEQ ID NO: 6691924 - DNA, 20 bp, Homo sapiens
cacatctccagaaaaatgaa

SEQ ID NO: 6691925 - DNA, 13 bp, Homo sapiens
cacatctctatct

SEQ ID NO: 6691926 - DNA, 16 bp, Homo sapiens
cacatctctctgccct

SEQ ID NO: 6691927 - DNA, 23 bp, Homo sapiens
cacatctctctgccctctccctg

SEQ ID NO: 6691928 - DNA, 13 bp, Homo sapiens
cacatctctgaaa

SEQ ID NO: 6691929 - DNA, 11 bp, Homo sapiens
cacatctctgc

SEQ ID NO: 6691930 - DNA, 14 bp, Homo sapiens
cacatctctgcagt

SEQ ID NO: 6691931 - DNA, 14 bp, Homo sapiens
cacatctcttcatg

SEQ ID NO: 6691932 - DNA, 17 bp, Homo sapiens
cacatctgcacactctc

SEQ ID NO: 6691933 - DNA, 19 bp, Homo sapiens
cacatctgcctcctctcct

SEQ ID NO: 6691934 - DNA, 12 bp, Homo sapiens
cacatctgcctt

SEQ ID NO: 6691935 - DNA, 13 bp, Homo sapiens
cacatctgctcta

SEQ ID NO: 6691936 - DNA, 13 bp, Homo sapiens
cacatctggccct

SEQ ID NO: 6691937 - DNA, 15 bp, Homo sapiens
cacatctggccctga

SEQ ID NO: 6691938 - DNA, 15 bp, Homo sapiens
cacatctgggtgccc

SEQ ID NO: 6691939 - DNA, 16 bp, Homo sapiens
cacatctgggtgccct

SEQ ID NO: 6691940 - DNA, 17 bp, Homo sapiens
cacatctgggtgccctg

SEQ ID NO: 6691941 - DNA, 14 bp, Homo sapiens
cacatctgtatatc

SEQ ID NO: 6691942 - DNA, 17 bp, Homo sapiens
cacatctgtcctcaccc

SEQ ID NO: 6691943 - DNA, 23 bp, Homo sapiens
cacatctgtcctcaccctgtggg

SEQ ID NO: 6691944 - DNA, 12 bp, Homo sapiens
cacatctgtgtc

SEQ ID NO: 6691945 - DNA, 18 bp, Homo sapiens
cacatctgtgtctctgga

SEQ ID NO: 6691946 - DNA, 23 bp, Homo sapiens
cacatctgtgtctctggaaccca

SEQ ID NO: 6691947 - DNA, 12 bp, Homo sapiens
cacatcttaaaa

SEQ ID NO: 6691948 - DNA, 21 bp, Homo sapiens
cacatcttaattaagctcctt

SEQ ID NO: 6691949 - DNA, 14 bp, Homo sapiens
cacatcttccacag

SEQ ID NO: 6691950 - DNA, 22 bp, Homo sapiens
cacatcttccctagagggttcc

SEQ ID NO: 6691951 - DNA, 20 bp, Homo sapiens
cacatcttgatctgctcagc

SEQ ID NO: 6691952 - DNA, 13 bp, Homo sapiens
cacatcttgctct

SEQ ID NO: 6691953 - DNA, 16 bp, Homo sapiens
cacatcttgctctgca

SEQ ID NO: 6691954 - DNA, 16 bp, Homo sapiens
cacatcttgctctgct

SEQ ID NO: 6691955 - DNA, 20 bp, Homo sapiens
cacatcttgctctgctgaca

SEQ ID NO: 6691956 - DNA, 18 bp, Homo sapiens
cacatctttcacacttcc

SEQ ID NO: 6691957 - DNA, 15 bp, Homo sapiens
cacatgaaaaatttt

SEQ ID NO: 6691958 - DNA, 18 bp, Homo sapiens
cacatgaaaccttatttt

SEQ ID NO: 6691959 - DNA, 21 bp, Homo sapiens
cacatgaaaggcatcagtccc

SEQ ID NO: 6691960 - DNA, 22 bp, Homo sapiens
cacatgaacagcttgccaggga

SEQ ID NO: 6691961 - DNA, 15 bp, Homo sapiens
cacatgaacttagat

SEQ ID NO: 6691962 - DNA, 21 bp, Homo sapiens
cacatgaataaagcctttgta

SEQ ID NO: 6691963 - DNA, 24 bp, Homo sapiens
cacatgaatcccacccacatgtga

SEQ ID NO: 6691964 - DNA, 15 bp, Homo sapiens
cacatgacagtggtt

SEQ ID NO: 6691965 - DNA, 20 bp, Homo sapiens
cacatgacagtggttatatt

SEQ ID NO: 6691966 - DNA, 14 bp, Homo sapiens
cacatgacatccac

SEQ ID NO: 6691967 - DNA, 16 bp, Homo sapiens
cacatgacatccacat

SEQ ID NO: 6691968 - DNA, 21 bp, Homo sapiens
cacatgacgcaccagttacag

SEQ ID NO: 6691969 - DNA, 22 bp, Homo sapiens
cacatgacgcaccagttacagg

SEQ ID NO: 6691970 - DNA, 23 bp, Homo sapiens
cacatgacgccagataaaatgtt

SEQ ID NO: 6691971 - DNA, 17 bp, Homo sapiens
cacatgacgtaaaattt

SEQ ID NO: 6691972 - DNA, 20 bp, Homo sapiens
cacatgactcgggggtgggg

SEQ ID NO: 6691973 - DNA, 18 bp, Homo sapiens
cacatgactctcatttta

SEQ ID NO: 6691974 - DNA, 17 bp, Homo sapiens
cacatgagaatgctagc

SEQ ID NO: 6691975 - DNA, 15 bp, Homo sapiens
cacatgagataatat

SEQ ID NO: 6691976 - DNA, 13 bp, Homo sapiens
cacatgagcatca

SEQ ID NO: 6691977 - DNA, 23 bp, Homo sapiens
cacatgaggccatctcaggagat

SEQ ID NO: 6691978 - DNA, 17 bp, Homo sapiens
cacatgagtcaaaacaa

SEQ ID NO: 6691979 - DNA, 18 bp, Homo sapiens
cacatgagtcaaaacaaa

SEQ ID NO: 6691980 - DNA, 17 bp, Homo sapiens
cacatgagttcttgaag

SEQ ID NO: 6691981 - DNA, 19 bp, Homo sapiens
cacatgataccagcagcaa

SEQ ID NO: 6691982 - DNA, 21 bp, Homo sapiens
cacatgataccagcagcaact

SEQ ID NO: 6691983 - DNA, 22 bp, Homo sapiens
cacatgataccagcagcaactg

SEQ ID NO: 6691984 - DNA, 16 bp, Homo sapiens
cacatgattgtataag

SEQ ID NO: 6691985 - DNA, 23 bp, Homo sapiens
cacatgattgtataagcatgctt

SEQ ID NO: 6691986 - DNA, 18 bp, Homo sapiens
cacatgatttcacaaata

SEQ ID NO: 6691987 - DNA, 12 bp, Homo sapiens
cacatgcacaca

SEQ ID NO: 6691988 - DNA, 15 bp, Homo sapiens
cacatgcacacacac

SEQ ID NO: 6691989 - DNA, 16 bp, Homo sapiens
cacatgcacacacaca

SEQ ID NO: 6691990 - DNA, 19 bp, Homo sapiens
cacatgcacttttgggcct

SEQ ID NO: 6691991 - DNA, 14 bp, Homo sapiens
cacatgcagctgca

SEQ ID NO: 6691992 - DNA, 13 bp, Homo sapiens
cacatgcatacac

SEQ ID NO: 6691993 - DNA, 16 bp, Homo sapiens
cacatgcatacacaca

SEQ ID NO: 6691994 - DNA, 18 bp, Homo sapiens
cacatgcatacacacaca

SEQ ID NO: 6691995 - DNA, 20 bp, Homo sapiens
cacatgcatacttacagact

SEQ ID NO: 6691996 - DNA, 19 bp, Homo sapiens
cacatgcatcatcagccta

SEQ ID NO: 6691997 - DNA, 13 bp, Homo sapiens
cacatgcatcctc

SEQ ID NO: 6691998 - DNA, 17 bp, Homo sapiens
cacatgcatcctcccct

SEQ ID NO: 6691999 - DNA, 17 bp, Homo sapiens
cacatgcatgtctgcct

SEQ ID NO: 6692000 - DNA, 14 bp, Homo sapiens
cacatgccacctgg

SEQ ID NO: 6692001 - DNA, 16 bp, Homo sapiens
cacatgccacctggca

SEQ ID NO: 6692002 - DNA, 12 bp, Homo sapiens
cacatgccactg

SEQ ID NO: 6692003 - DNA, 15 bp, Homo sapiens
cacatgccactgcct

SEQ ID NO: 6692004 - DNA, 17 bp, Homo sapiens
cacatgccactgcctgc

SEQ ID NO: 6692005 - DNA, 18 bp, Homo sapiens
cacatgccactgcctgca

SEQ ID NO: 6692006 - DNA, 14 bp, Homo sapiens
cacatgccaggggc

SEQ ID NO: 6692007 - DNA, 20 bp, Homo sapiens
cacatgccccccagattgct

SEQ ID NO: 6692008 - DNA, 22 bp, Homo sapiens
cacatgcccctcccccagctgc

SEQ ID NO: 6692009 - DNA, 14 bp, Homo sapiens
cacatgcccctctt

SEQ ID NO: 6692010 - DNA, 20 bp, Homo sapiens
cacatgccctaatgtctgta

SEQ ID NO: 6692011 - DNA, 13 bp, Homo sapiens
cacatgccctcct

SEQ ID NO: 6692012 - DNA, 14 bp, Homo sapiens
cacatgccctcctg

SEQ ID NO: 6692013 - DNA, 22 bp, Homo sapiens
cacatgcccttggtgacagctg

SEQ ID NO: 6692014 - DNA, 22 bp, Homo sapiens
cacatgccgcgggcggccaggc

SEQ ID NO: 6692015 - DNA, 19 bp, Homo sapiens
cacatgcctctctcaggcc

SEQ ID NO: 6692016 - DNA, 13 bp, Homo sapiens
cacatgccttgca

SEQ ID NO: 6692017 - DNA, 23 bp, Homo sapiens
cacatgccttgcaatggatcagc

SEQ ID NO: 6692018 - DNA, 14 bp, Homo sapiens
cacatgcgctcctg

SEQ ID NO: 6692019 - DNA, 15 bp, Homo sapiens
cacatgcgctcctgg

SEQ ID NO: 6692020 - DNA, 9 bp, Homo sapiens
cacatgcta

SEQ ID NO: 6692021 - DNA, 16 bp, Homo sapiens
cacatgctaaagccag

SEQ ID NO: 6692022 - DNA, 21 bp, Homo sapiens
cacatgctaggatgcggaaat

SEQ ID NO: 6692023 - DNA, 19 bp, Homo sapiens
cacatgctatgttctgtct

SEQ ID NO: 6692024 - DNA, 14 bp, Homo sapiens
cacatgctctgcag

SEQ ID NO: 6692025 - DNA, 16 bp, Homo sapiens
cacatgctgagtctcc

SEQ ID NO: 6692026 - DNA, 15 bp, Homo sapiens
cacatgctgcctggc

SEQ ID NO: 6692027 - DNA, 16 bp, Homo sapiens
cacatgctgcctggca

SEQ ID NO: 6692028 - DNA, 18 bp, Homo sapiens
cacatgctgcctggcaca

SEQ ID NO: 6692029 - DNA, 19 bp, Homo sapiens
cacatgctgcctggcacag

SEQ ID NO: 6692030 - DNA, 15 bp, Homo sapiens
cacatgctggacagg

SEQ ID NO: 6692031 - DNA, 13 bp, Homo sapiens
cacatgctggcca

SEQ ID NO: 6692032 - DNA, 17 bp, Homo sapiens
cacatgctggccagcct

SEQ ID NO: 6692033 - DNA, 19 bp, Homo sapiens
cacatgctggccagcctgg

SEQ ID NO: 6692034 - DNA, 16 bp, Homo sapiens
cacatgctggctcctg

SEQ ID NO: 6692035 - DNA, 13 bp, Homo sapiens
cacatggaaaaaa

SEQ ID NO: 6692036 - DNA, 14 bp, Homo sapiens
cacatggaaaccca

SEQ ID NO: 6692037 - DNA, 22 bp, Homo sapiens
cacatggaaggcggcacagagg

SEQ ID NO: 6692038 - DNA, 16 bp, Homo sapiens
cacatggacacagacc

SEQ ID NO: 6692039 - DNA, 22 bp, Homo sapiens
cacatggacagacttcacagcg

SEQ ID NO: 6692040 - DNA, 22 bp, Homo sapiens
cacatggaggagacgtccaccc

SEQ ID NO: 6692041 - DNA, 19 bp, Homo sapiens
cacatggattttggcaggg

SEQ ID NO: 6692042 - DNA, 21 bp, Homo sapiens
cacatggattttggcagggcg

SEQ ID NO: 6692043 - DNA, 18 bp, Homo sapiens
cacatggcagatgatttg

SEQ ID NO: 6692044 - DNA, 17 bp, Homo sapiens
cacatggcatgttttgt

SEQ ID NO: 6692045 - DNA, 15 bp, Homo sapiens
cacatggccatagag

SEQ ID NO: 6692046 - DNA, 19 bp, Homo sapiens
cacatggccatcttctttc

SEQ ID NO: 6692047 - DNA, 17 bp, Homo sapiens
cacatggccccatccca

SEQ ID NO: 6692048 - DNA, 23 bp, Homo sapiens
cacatggcccctccccctgccag

SEQ ID NO: 6692049 - DNA, 14 bp, Homo sapiens
cacatggcctgagc

SEQ ID NO: 6692050 - DNA, 22 bp, Homo sapiens
cacatggctatcctagagaggc

SEQ ID NO: 6692051 - DNA, 12 bp, Homo sapiens
cacatggctggg

SEQ ID NO: 6692052 - DNA, 13 bp, Homo sapiens
cacatggctgggg

SEQ ID NO: 6692053 - DNA, 13 bp, Homo sapiens
cacatggcttcct

SEQ ID NO: 6692054 - DNA, 22 bp, Homo sapiens
cacatgggaggaaggcccaggg

SEQ ID NO: 6692055 - DNA, 23 bp, Homo sapiens
cacatgggaggaaggcccagggg

SEQ ID NO: 6692056 - DNA, 17 bp, Homo sapiens
cacatgggcttgtgaca

SEQ ID NO: 6692057 - DNA, 17 bp, Homo sapiens
cacatggggaaaaaaat

SEQ ID NO: 6692058 - DNA, 18 bp, Homo sapiens
cacatggtgcccctagct

SEQ ID NO: 6692059 - DNA, 18 bp, Homo sapiens
cacatggtgttgtatact

SEQ ID NO: 6692060 - DNA, 18 bp, Homo sapiens
cacatggttcaccatgca

SEQ ID NO: 6692061 - DNA, 15 bp, Homo sapiens
cacatgtaaaatatg

SEQ ID NO: 6692062 - DNA, 22 bp, Homo sapiens
cacatgtacactacattttttc

SEQ ID NO: 6692063 - DNA, 14 bp, Homo sapiens
cacatgtatgtttt

SEQ ID NO: 6692064 - DNA, 16 bp, Homo sapiens
cacatgtattctgttg

SEQ ID NO: 6692065 - DNA, 22 bp, Homo sapiens
cacatgtattctgttggccagc

SEQ ID NO: 6692066 - DNA, 16 bp, Homo sapiens
cacatgtccaagaagc

SEQ ID NO: 6692067 - DNA, 23 bp, Homo sapiens
cacatgtccaagaagcccaggaa

SEQ ID NO: 6692068 - DNA, 18 bp, Homo sapiens
cacatgtcccagatcgtc

SEQ ID NO: 6692069 - DNA, 13 bp, Homo sapiens
cacatgtcttaat

SEQ ID NO: 6692070 - DNA, 16 bp, Homo sapiens
cacatgtcttaatgaa

SEQ ID NO: 6692071 - DNA, 22 bp, Homo sapiens
cacatgtcttaatgaagtttga

SEQ ID NO: 6692072 - DNA, 20 bp, Homo sapiens
cacatgtcttgtacatgtgt

SEQ ID NO: 6692073 - DNA, 15 bp, Homo sapiens
cacatgtgacacata

SEQ ID NO: 6692074 - DNA, 13 bp, Homo sapiens
cacatgtgccaca

SEQ ID NO: 6692075 - DNA, 19 bp, Homo sapiens
cacatgtgccacacagtga

SEQ ID NO: 6692076 - DNA, 21 bp, Homo sapiens
cacatgtgctgatgtttacaa

SEQ ID NO: 6692077 - DNA, 19 bp, Homo sapiens
cacatgtggcaaaatatgg

SEQ ID NO: 6692078 - DNA, 11 bp, Homo sapiens
cacatgtgtgc

SEQ ID NO: 6692079 - DNA, 22 bp, Homo sapiens
cacatgttggaggagagagcct

SEQ ID NO: 6692080 - DNA, 14 bp, Homo sapiens
cacatgtttaactt

SEQ ID NO: 6692081 - DNA, 16 bp, Homo sapiens
cacatgtttacagaac

SEQ ID NO: 6692082 - DNA, 18 bp, Homo sapiens
cacatgtttagagttgca

SEQ ID NO: 6692083 - DNA, 13 bp, Homo sapiens
cacatgttttcaa

SEQ ID NO: 6692084 - DNA, 15 bp, Homo sapiens
cacatgttttcaaat

SEQ ID NO: 6692085 - DNA, 16 bp, Homo sapiens
cacatgttttcaaatg

SEQ ID NO: 6692086 - DNA, 18 bp, Homo sapiens
cacatgtttttatttcct

SEQ ID NO: 6692087 - DNA, 16 bp, Homo sapiens
cacattaaaaaatgaa

SEQ ID NO: 6692088 - DNA, 20 bp, Homo sapiens
cacattaaaaaatgaaatat

SEQ ID NO: 6692089 - DNA, 22 bp, Homo sapiens
cacattaaaaaatgaaatattt

SEQ ID NO: 6692090 - DNA, 18 bp, Homo sapiens
cacattaaaagacaaata

SEQ ID NO: 6692091 - DNA, 14 bp, Homo sapiens
cacattaaacagga

SEQ ID NO: 6692092 - DNA, 17 bp, Homo sapiens
cacattaaaggtacttt

SEQ ID NO: 6692093 - DNA, 19 bp, Homo sapiens
cacattaaagtaaagtaca

SEQ ID NO: 6692094 - DNA, 13 bp, Homo sapiens
cacattaaagtta

SEQ ID NO: 6692095 - DNA, 22 bp, Homo sapiens
cacattaactccctccaccagc

SEQ ID NO: 6692096 - DNA, 23 bp, Homo sapiens
cacattaacttctggactgccgg

SEQ ID NO: 6692097 - DNA, 22 bp, Homo sapiens
cacattaagtaatcaataaaga

SEQ ID NO: 6692098 - DNA, 17 bp, Homo sapiens
cacattaatctcaaaga

SEQ ID NO: 6692099 - DNA, 13 bp, Homo sapiens
cacattaatgata

SEQ ID NO: 6692100 - DNA, 13 bp, Homo sapiens
cacattaattaat

SEQ ID NO: 6692101 - DNA, 20 bp, Homo sapiens
cacattacatcatcctcctt

SEQ ID NO: 6692102 - DNA, 18 bp, Homo sapiens
cacattacattaacattt

SEQ ID NO: 6692103 - DNA, 23 bp, Homo sapiens
cacattaccattcatagtaagaa

SEQ ID NO: 6692104 - DNA, 16 bp, Homo sapiens
cacattacttgcacaa

SEQ ID NO: 6692105 - DNA, 17 bp, Homo sapiens
cacattacttgcacaag

SEQ ID NO: 6692106 - DNA, 22 bp, Homo sapiens
cacattacttgcacaagcttgt

SEQ ID NO: 6692107 - DNA, 14 bp, Homo sapiens
cacattagaacttc

SEQ ID NO: 6692108 - DNA, 21 bp, Homo sapiens
cacattagaagacaattgaca

SEQ ID NO: 6692109 - DNA, 17 bp, Homo sapiens
cacattagactatccat

SEQ ID NO: 6692110 - DNA, 20 bp, Homo sapiens
cacattagagggacagccaa

SEQ ID NO: 6692111 - DNA, 21 bp, Homo sapiens
cacattagattttattttact

SEQ ID NO: 6692112 - DNA, 18 bp, Homo sapiens
cacattataaagttcaga

SEQ ID NO: 6692113 - DNA, 14 bp, Homo sapiens
cacattatagaaat

SEQ ID NO: 6692114 - DNA, 18 bp, Homo sapiens
cacattatagaaattact

SEQ ID NO: 6692115 - DNA, 16 bp, Homo sapiens
cacattatcgggagca

SEQ ID NO: 6692116 - DNA, 17 bp, Homo sapiens
cacattatcgggagcag

SEQ ID NO: 6692117 - DNA, 22 bp, Homo sapiens
cacattatcgggagcagtgtct

SEQ ID NO: 6692118 - DNA, 22 bp, Homo sapiens
cacattatgtatcttagttaca

SEQ ID NO: 6692119 - DNA, 21 bp, Homo sapiens
cacattatgttagagaggtag

SEQ ID NO: 6692120 - DNA, 21 bp, Homo sapiens
cacattattgtagagaaaaaa

SEQ ID NO: 6692121 - DNA, 23 bp, Homo sapiens
cacattatttattaaaaatgttc

SEQ ID NO: 6692122 - DNA, 13 bp, Homo sapiens
cacattatttcta

SEQ ID NO: 6692123 - DNA, 13 bp, Homo sapiens
cacattatttgca

SEQ ID NO: 6692124 - DNA, 15 bp, Homo sapiens
cacattatttgcatg

SEQ ID NO: 6692125 - DNA, 22 bp, Homo sapiens
cacattcaaaatagggtatatt

SEQ ID NO: 6692126 - DNA, 16 bp, Homo sapiens
cacattcatcctcaca

SEQ ID NO: 6692127 - DNA, 12 bp, Homo sapiens
cacattccaaaa

SEQ ID NO: 6692128 - DNA, 18 bp, Homo sapiens
cacattccagccaggccc

SEQ ID NO: 6692129 - DNA, 22 bp, Homo sapiens
cacattccagccaggcccaggc

SEQ ID NO: 6692130 - DNA, 24 bp, Homo sapiens
cacattccagccaggcccaggcca

SEQ ID NO: 6692131 - DNA, 14 bp, Homo sapiens
cacattccagggct

SEQ ID NO: 6692132 - DNA, 16 bp, Homo sapiens
cacattccagggctgg

SEQ ID NO: 6692133 - DNA, 16 bp, Homo sapiens
cacattccatgacgca

SEQ ID NO: 6692134 - DNA, 19 bp, Homo sapiens
cacattccatgacgcagga

SEQ ID NO: 6692135 - DNA, 21 bp, Homo sapiens
cacattcccatggtggcctca

SEQ ID NO: 6692136 - DNA, 23 bp, Homo sapiens
cacattcccccaccagctgcagc

SEQ ID NO: 6692137 - DNA, 19 bp, Homo sapiens
cacattcccccggtgcctc

SEQ ID NO: 6692138 - DNA, 11 bp, Homo sapiens
cacattcccct

SEQ ID NO: 6692139 - DNA, 15 bp, Homo sapiens
cacattcccctgggg

SEQ ID NO: 6692140 - DNA, 14 bp, Homo sapiens
cacattcctttggg

SEQ ID NO: 6692141 - DNA, 23 bp, Homo sapiens
cacattcggaccctgcccatacc

SEQ ID NO: 6692142 - DNA, 18 bp, Homo sapiens
cacattcgggaccaatat

SEQ ID NO: 6692143 - DNA, 20 bp, Homo sapiens
cacattcgggaccaatatat

SEQ ID NO: 6692144 - DNA, 13 bp, Homo sapiens
cacattctacttc

SEQ ID NO: 6692145 - DNA, 14 bp, Homo sapiens
cacattctcccttg

SEQ ID NO: 6692146 - DNA, 16 bp, Homo sapiens
cacattctcctgtgcc

SEQ ID NO: 6692147 - DNA, 22 bp, Homo sapiens
cacattctgctatgaattattt

SEQ ID NO: 6692148 - DNA, 20 bp, Homo sapiens
cacattctggctcagggagg

SEQ ID NO: 6692149 - DNA, 15 bp, Homo sapiens
cacattctggctcca

SEQ ID NO: 6692150 - DNA, 13 bp, Homo sapiens
cacattcttaagg

SEQ ID NO: 6692151 - DNA, 14 bp, Homo sapiens
cacattcttcagtt

SEQ ID NO: 6692152 - DNA, 22 bp, Homo sapiens
cacattcttggcttaatcattt

SEQ ID NO: 6692153 - DNA, 16 bp, Homo sapiens
cacattgaaactgtat

SEQ ID NO: 6692154 - DNA, 24 bp, Homo sapiens
cacattgaatcatgtaggatcttg

SEQ ID NO: 6692155 - DNA, 16 bp, Homo sapiens
cacattgacagtggtg

SEQ ID NO: 6692156 - DNA, 19 bp, Homo sapiens
cacattgagactttcttct

SEQ ID NO: 6692157 - DNA, 18 bp, Homo sapiens
cacattgatgtaaggact

SEQ ID NO: 6692158 - DNA, 19 bp, Homo sapiens
cacattgatttttctataa

SEQ ID NO: 6692159 - DNA, 16 bp, Homo sapiens
cacattgcattctatt

SEQ ID NO: 6692160 - DNA, 21 bp, Homo sapiens
cacattgcccacacctgcctc

SEQ ID NO: 6692161 - DNA, 22 bp, Homo sapiens
cacattgcccacacctgcctct

SEQ ID NO: 6692162 - DNA, 14 bp, Homo sapiens
cacattgccccatg

SEQ ID NO: 6692163 - DNA, 17 bp, Homo sapiens
cacattgccctgagggg

SEQ ID NO: 6692164 - DNA, 19 bp, Homo sapiens
cacattgccctgaggggcc

SEQ ID NO: 6692165 - DNA, 11 bp, Homo sapiens
cacattgcctt

SEQ ID NO: 6692166 - DNA, 12 bp, Homo sapiens
cacattgccttc

SEQ ID NO: 6692167 - DNA, 13 bp, Homo sapiens
cacattgctacct

SEQ ID NO: 6692168 - DNA, 15 bp, Homo sapiens
cacattgctacctca

SEQ ID NO: 6692169 - DNA, 15 bp, Homo sapiens
cacattgctggctgc

SEQ ID NO: 6692170 - DNA, 14 bp, Homo sapiens
cacattggacttcc

SEQ ID NO: 6692171 - DNA, 20 bp, Homo sapiens
cacattggcagtgtgtcaca

SEQ ID NO: 6692172 - DNA, 22 bp, Homo sapiens
cacattgggcagcgcccttcct

SEQ ID NO: 6692173 - DNA, 23 bp, Homo sapiens
cacattgggcagcgcccttcctc

SEQ ID NO: 6692174 - DNA, 22 bp, Homo sapiens
cacattggggaaatttttaagt

SEQ ID NO: 6692175 - DNA, 16 bp, Homo sapiens
cacattgttattttca

SEQ ID NO: 6692176 - DNA, 17 bp, Homo sapiens
cacattgttattttcag

SEQ ID NO: 6692177 - DNA, 22 bp, Homo sapiens
cacattgttgtttttttaatag

SEQ ID NO: 6692178 - DNA, 15 bp, Homo sapiens
cacattgttttaaaa

SEQ ID NO: 6692179 - DNA, 18 bp, Homo sapiens
cacattgttttaaaaaga

SEQ ID NO: 6692180 - DNA, 21 bp, Homo sapiens
cacattgttttccagaagcct

SEQ ID NO: 6692181 - DNA, 15 bp, Homo sapiens
cacatttaaaacatt

SEQ ID NO: 6692182 - DNA, 16 bp, Homo sapiens
cacatttaaaacattt

SEQ ID NO: 6692183 - DNA, 12 bp, Homo sapiens
cacatttaaatt

SEQ ID NO: 6692184 - DNA, 17 bp, Homo sapiens
cacatttagtctcttta

SEQ ID NO: 6692185 - DNA, 18 bp, Homo sapiens
cacatttagtctctttat

SEQ ID NO: 6692186 - DNA, 21 bp, Homo sapiens
cacatttatatatatatgtat

SEQ ID NO: 6692187 - DNA, 14 bp, Homo sapiens
cacatttatttggt

SEQ ID NO: 6692188 - DNA, 12 bp, Homo sapiens
cacatttcacat

SEQ ID NO: 6692189 - DNA, 21 bp, Homo sapiens
cacatttccagggcagcagcc

SEQ ID NO: 6692190 - DNA, 18 bp, Homo sapiens
cacatttcctatcctggt

SEQ ID NO: 6692191 - DNA, 12 bp, Homo sapiens
cacatttcctct

SEQ ID NO: 6692192 - DNA, 17 bp, Homo sapiens
cacatttcctctctatc

SEQ ID NO: 6692193 - DNA, 16 bp, Homo sapiens
cacatttctgatcaga

SEQ ID NO: 6692194 - DNA, 13 bp, Homo sapiens
cacatttctggat

SEQ ID NO: 6692195 - DNA, 19 bp, Homo sapiens
cacatttctggccatttaa

SEQ ID NO: 6692196 - DNA, 24 bp, Homo sapiens
cacatttcttaaaacacatgatac

SEQ ID NO: 6692197 - DNA, 23 bp, Homo sapiens
cacatttctttgcattccagctg

SEQ ID NO: 6692198 - DNA, 21 bp, Homo sapiens
cacatttgaaagaaagtgtta

SEQ ID NO: 6692199 - DNA, 14 bp, Homo sapiens
cacatttgaattca

SEQ ID NO: 6692200 - DNA, 21 bp, Homo sapiens
cacatttgaattcatttgctg

SEQ ID NO: 6692201 - DNA, 14 bp, Homo sapiens
cacatttgactcca

SEQ ID NO: 6692202 - DNA, 13 bp, Homo sapiens
cacatttgatgta

SEQ ID NO: 6692203 - DNA, 18 bp, Homo sapiens
cacatttgatgtacatgt

SEQ ID NO: 6692204 - DNA, 17 bp, Homo sapiens
cacatttgattctgtgt

SEQ ID NO: 6692205 - DNA, 15 bp, Homo sapiens
cacatttggaatgca

SEQ ID NO: 6692206 - DNA, 19 bp, Homo sapiens
cacatttggaatgcacaca

SEQ ID NO: 6692207 - DNA, 15 bp, Homo sapiens
cacatttggaattga

SEQ ID NO: 6692208 - DNA, 18 bp, Homo sapiens
cacatttggcttacagta

SEQ ID NO: 6692209 - DNA, 22 bp, Homo sapiens
cacatttgggatgttccttttt

SEQ ID NO: 6692210 - DNA, 20 bp, Homo sapiens
cacatttgggctcagggttg

SEQ ID NO: 6692211 - DNA, 20 bp, Homo sapiens
cacatttggtaatgttttta

SEQ ID NO: 6692212 - DNA, 22 bp, Homo sapiens
cacatttggttctaagaaaccc

SEQ ID NO: 6692213 - DNA, 19 bp, Homo sapiens
cacatttgtaaatgtcttt

SEQ ID NO: 6692214 - DNA, 17 bp, Homo sapiens
cacatttgtcagtattt

SEQ ID NO: 6692215 - DNA, 22 bp, Homo sapiens
cacatttgtcagtatttttgcc

SEQ ID NO: 6692216 - DNA, 22 bp, Homo sapiens
cacatttgtgcataaatttcca

SEQ ID NO: 6692217 - DNA, 15 bp, Homo sapiens
cacattttaaaagtg

SEQ ID NO: 6692218 - DNA, 12 bp, Homo sapiens
cacattttaaca

SEQ ID NO: 6692219 - DNA, 21 bp, Homo sapiens
cacattttacttagctggaga

SEQ ID NO: 6692220 - DNA, 15 bp, Homo sapiens
cacattttattttat

SEQ ID NO: 6692221 - DNA, 17 bp, Homo sapiens
cacattttattttatta

SEQ ID NO: 6692222 - DNA, 19 bp, Homo sapiens
cacattttattttattatg

SEQ ID NO: 6692223 - DNA, 16 bp, Homo sapiens
cacattttcagccaaa

SEQ ID NO: 6692224 - DNA, 21 bp, Homo sapiens
cacattttccacggaaacaga

SEQ ID NO: 6692225 - DNA, 19 bp, Homo sapiens
cacattttccatatttgga

SEQ ID NO: 6692226 - DNA, 18 bp, Homo sapiens
cacattttccttttcaaa

SEQ ID NO: 6692227 - DNA, 20 bp, Homo sapiens
cacattttgacacaatgttg

SEQ ID NO: 6692228 - DNA, 12 bp, Homo sapiens
cacattttgatt

SEQ ID NO: 6692229 - DNA, 23 bp, Homo sapiens
cacattttgctttataatttcta

SEQ ID NO: 6692230 - DNA, 13 bp, Homo sapiens
cacattttgtaaa

SEQ ID NO: 6692231 - DNA, 15 bp, Homo sapiens
cacattttgtaaatc

SEQ ID NO: 6692232 - DNA, 13 bp, Homo sapiens
cacattttgtaca

SEQ ID NO: 6692233 - DNA, 19 bp, Homo sapiens
cacattttgtacaaagata

SEQ ID NO: 6692234 - DNA, 14 bp, Homo sapiens
cacattttgtacat

SEQ ID NO: 6692235 - DNA, 13 bp, Homo sapiens
cacattttgtata

SEQ ID NO: 6692236 - DNA, 15 bp, Homo sapiens
cacattttgtataat

SEQ ID NO: 6692237 - DNA, 22 bp, Homo sapiens
cacattttgtataattgtatcg

SEQ ID NO: 6692238 - DNA, 21 bp, Homo sapiens
cacattttgtggctgttgaga

SEQ ID NO: 6692239 - DNA, 16 bp, Homo sapiens
cacatttttaaagctt

SEQ ID NO: 6692240 - DNA, 19 bp, Homo sapiens
cacatttttaaagctttcc

SEQ ID NO: 6692241 - DNA, 20 bp, Homo sapiens
cacatttttaagatgcatgt

SEQ ID NO: 6692242 - DNA, 17 bp, Homo sapiens
cacatttttatacctgt

SEQ ID NO: 6692243 - DNA, 23 bp, Homo sapiens
cacatttttatacctgtttaaat

SEQ ID NO: 6692244 - DNA, 21 bp, Homo sapiens
cacattttttaaatgcacctg

SEQ ID NO: 6692245 - DNA, 22 bp, Homo sapiens
cacatttttttttttaattttg

SEQ ID NO: 6692246 - DNA, 21 bp, Homo sapiens
caccaaaaaaatacttgagct

SEQ ID NO: 6692247 - DNA, 23 bp, Homo sapiens
caccaaaaaaatacttgagctgt

SEQ ID NO: 6692248 - DNA, 13 bp, Homo sapiens
caccaaaaaatat

SEQ ID NO: 6692249 - DNA, 13 bp, Homo sapiens
caccaaaaacaaa

SEQ ID NO: 6692250 - DNA, 13 bp, Homo sapiens
caccaaaacatgc

SEQ ID NO: 6692251 - DNA, 17 bp, Homo sapiens
caccaaaataagaaaag

SEQ ID NO: 6692252 - DNA, 15 bp, Homo sapiens
caccaaacatttctg

SEQ ID NO: 6692253 - DNA, 20 bp, Homo sapiens
caccaaacatttctgtgaaa

SEQ ID NO: 6692254 - DNA, 13 bp, Homo sapiens
caccaaactagta

SEQ ID NO: 6692255 - DNA, 15 bp, Homo sapiens
caccaaactgccaaa

SEQ ID NO: 6692256 - DNA, 18 bp, Homo sapiens
caccaaagatctgctcct

SEQ ID NO: 6692257 - DNA, 18 bp, Homo sapiens
caccaaagatgcagccgc

SEQ ID NO: 6692258 - DNA, 13 bp, Homo sapiens
caccaaaggccag

SEQ ID NO: 6692259 - DNA, 16 bp, Homo sapiens
caccaaaggtcaatgt

SEQ ID NO: 6692260 - DNA, 15 bp, Homo sapiens
caccaaagtattttt

SEQ ID NO: 6692261 - DNA, 16 bp, Homo sapiens
caccaaagttctaata

SEQ ID NO: 6692262 - DNA, 17 bp, Homo sapiens
caccaaagttctaataa

SEQ ID NO: 6692263 - DNA, 22 bp, Homo sapiens
caccaaagttctaataatttct

SEQ ID NO: 6692264 - DNA, 18 bp, Homo sapiens
caccaaatacaattcaaa

SEQ ID NO: 6692265 - DNA, 22 bp, Homo sapiens
caccaaatacaattcaaatgct

SEQ ID NO: 6692266 - DNA, 22 bp, Homo sapiens
caccaaatatatgccttactat

SEQ ID NO: 6692267 - DNA, 18 bp, Homo sapiens
caccaaatcaaaatctct

SEQ ID NO: 6692268 - DNA, 16 bp, Homo sapiens
caccaaatcatcctga

SEQ ID NO: 6692269 - DNA, 19 bp, Homo sapiens
caccaaatgcctctgcctt

SEQ ID NO: 6692270 - DNA, 13 bp, Homo sapiens
caccaaatgtgct

SEQ ID NO: 6692271 - DNA, 15 bp, Homo sapiens
caccaaattgctgag

SEQ ID NO: 6692272 - DNA, 18 bp, Homo sapiens
caccaaattgctgagatg

SEQ ID NO: 6692273 - DNA, 20 bp, Homo sapiens
caccaaattgctgagatgtt

SEQ ID NO: 6692274 - DNA, 16 bp, Homo sapiens
caccaacactgtaaca

SEQ ID NO: 6692275 - DNA, 15 bp, Homo sapiens
caccaacagtgtgaa

SEQ ID NO: 6692276 - DNA, 17 bp, Homo sapiens
caccaacatactcccat

SEQ ID NO: 6692277 - DNA, 20 bp, Homo sapiens
caccaacatactcccatctg

SEQ ID NO: 6692278 - DNA, 14 bp, Homo sapiens
caccaacccagccg

SEQ ID NO: 6692279 - DNA, 18 bp, Homo sapiens
caccaaccccgcggccca

SEQ ID NO: 6692280 - DNA, 20 bp, Homo sapiens
caccaaccccgcggcccaga

SEQ ID NO: 6692281 - DNA, 15 bp, Homo sapiens
caccaaccctcaggg

SEQ ID NO: 6692282 - DNA, 15 bp, Homo sapiens
caccaaccgacaggc

SEQ ID NO: 6692283 - DNA, 17 bp, Homo sapiens
caccaacctcactgccc

SEQ ID NO: 6692284 - DNA, 14 bp, Homo sapiens
caccaacctccaga

SEQ ID NO: 6692285 - DNA, 14 bp, Homo sapiens
caccaacctccagt

SEQ ID NO: 6692286 - DNA, 22 bp, Homo sapiens
caccaactcctagttctagaaa

SEQ ID NO: 6692287 - DNA, 18 bp, Homo sapiens
caccaactctctctgccc

SEQ ID NO: 6692288 - DNA, 20 bp, Homo sapiens
caccaactgaattaaactta

SEQ ID NO: 6692289 - DNA, 16 bp, Homo sapiens
caccaacttgccacat

SEQ ID NO: 6692290 - DNA, 18 bp, Homo sapiens
caccaactttttccaagt

SEQ ID NO: 6692291 - DNA, 22 bp, Homo sapiens
caccaagacttgttttatgctc

SEQ ID NO: 6692292 - DNA, 15 bp, Homo sapiens
caccaagagcagctg

SEQ ID NO: 6692293 - DNA, 13 bp, Homo sapiens
caccaagcacagc

SEQ ID NO: 6692294 - DNA, 14 bp, Homo sapiens
caccaagcacagca

SEQ ID NO: 6692295 - DNA, 13 bp, Homo sapiens
caccaagcagtgg

SEQ ID NO: 6692296 - DNA, 14 bp, Homo sapiens
caccaagccaaggg

SEQ ID NO: 6692297 - DNA, 15 bp, Homo sapiens
caccaagcccacagg

SEQ ID NO: 6692298 - DNA, 21 bp, Homo sapiens
caccaagcctggtcagcccaa

SEQ ID NO: 6692299 - DNA, 21 bp, Homo sapiens
caccaagcgtgattcctgctg

SEQ ID NO: 6692300 - DNA, 14 bp, Homo sapiens
caccaagctcacag

SEQ ID NO: 6692301 - DNA, 19 bp, Homo sapiens
caccaagctcacagttcct

SEQ ID NO: 6692302 - DNA, 18 bp, Homo sapiens
caccaagctgtgccaccc

SEQ ID NO: 6692303 - DNA, 21 bp, Homo sapiens
caccaagctgtgccaccctgg

SEQ ID NO: 6692304 - DNA, 22 bp, Homo sapiens
caccaagctgtgccaccctggg

SEQ ID NO: 6692305 - DNA, 23 bp, Homo sapiens
caccaagctgtgccaccctgggc

SEQ ID NO: 6692306 - DNA, 11 bp, Homo sapiens
caccaaggaaa

SEQ ID NO: 6692307 - DNA, 13 bp, Homo sapiens
caccaaggcagtg

SEQ ID NO: 6692308 - DNA, 19 bp, Homo sapiens
caccaaggcagtgcatgca

SEQ ID NO: 6692309 - DNA, 18 bp, Homo sapiens
caccaagggacaggagaa

SEQ ID NO: 6692310 - DNA, 20 bp, Homo sapiens
caccaagggacaggagaaga

SEQ ID NO: 6692311 - DNA, 19 bp, Homo sapiens
caccaagggcgcaagagta

SEQ ID NO: 6692312 - DNA, 20 bp, Homo sapiens
caccaaggtctcacactcct

SEQ ID NO: 6692313 - DNA, 21 bp, Homo sapiens
caccaaggtctcacactcctc

SEQ ID NO: 6692314 - DNA, 16 bp, Homo sapiens
caccaagtaaatctat

SEQ ID NO: 6692315 - DNA, 16 bp, Homo sapiens
caccaagtattaaact

SEQ ID NO: 6692316 - DNA, 21 bp, Homo sapiens
caccaagtctaaaaagacctg

SEQ ID NO: 6692317 - DNA, 15 bp, Homo sapiens
caccaagtgtggaat

SEQ ID NO: 6692318 - DNA, 15 bp, Homo sapiens
caccaagttctggaa

SEQ ID NO: 6692319 - DNA, 23 bp, Homo sapiens
caccaagttggaacatccttgga

SEQ ID NO: 6692320 - DNA, 12 bp, Homo sapiens
caccaataaaaa

SEQ ID NO: 6692321 - DNA, 16 bp, Homo sapiens
caccaataaaaatcct

SEQ ID NO: 6692322 - DNA, 21 bp, Homo sapiens
caccaataaaggaggaatcag

SEQ ID NO: 6692323 - DNA, 15 bp, Homo sapiens
caccaataaatgttt

SEQ ID NO: 6692324 - DNA, 24 bp, Homo sapiens
caccaataacttcagagaagtcag

SEQ ID NO: 6692325 - DNA, 14 bp, Homo sapiens
caccaatcagagag

SEQ ID NO: 6692326 - DNA, 17 bp, Homo sapiens
caccaatcagagagcct

SEQ ID NO: 6692327 - DNA, 14 bp, Homo sapiens
caccaatcagcact

SEQ ID NO: 6692328 - DNA, 18 bp, Homo sapiens
caccaatcagcgctctgt

SEQ ID NO: 6692329 - DNA, 17 bp, Homo sapiens
caccaatcccagggctg

SEQ ID NO: 6692330 - DNA, 22 bp, Homo sapiens
caccaatcccagggctggctct

SEQ ID NO: 6692331 - DNA, 17 bp, Homo sapiens
caccaatcttactttgt

SEQ ID NO: 6692332 - DNA, 12 bp, Homo sapiens
caccaatgaaaa

SEQ ID NO: 6692333 - DNA, 13 bp, Homo sapiens
caccaatgaaaac

SEQ ID NO: 6692334 - DNA, 15 bp, Homo sapiens
caccaatgaaaacat

SEQ ID NO: 6692335 - DNA, 14 bp, Homo sapiens
caccaatgagcctt

SEQ ID NO: 6692336 - DNA, 22 bp, Homo sapiens
caccaatgccgccgtgtttcct

SEQ ID NO: 6692337 - DNA, 23 bp, Homo sapiens
caccaatgccgccgtgtttcctc

SEQ ID NO: 6692338 - DNA, 23 bp, Homo sapiens
caccaatgtttcaagaggagccc

SEQ ID NO: 6692339 - DNA, 15 bp, Homo sapiens
caccaattaagtgtt

SEQ ID NO: 6692340 - DNA, 24 bp, Homo sapiens
caccaattggttaatctttcctga

SEQ ID NO: 6692341 - DNA, 24 bp, Homo sapiens
caccaattgtacattccctgcatc

SEQ ID NO: 6692342 - DNA, 15 bp, Homo sapiens
caccacaacctccac

SEQ ID NO: 6692343 - DNA, 14 bp, Homo sapiens
caccacaactaaca

SEQ ID NO: 6692344 - DNA, 14 bp, Homo sapiens
caccacaagagctc

SEQ ID NO: 6692345 - DNA, 22 bp, Homo sapiens
caccacaagagctccttgatga

SEQ ID NO: 6692346 - DNA, 17 bp, Homo sapiens
caccacacacaacagcc

SEQ ID NO: 6692347 - DNA, 15 bp, Homo sapiens
caccacacacacaca

SEQ ID NO: 6692348 - DNA, 12 bp, Homo sapiens
caccacacactg

SEQ ID NO: 6692349 - DNA, 21 bp, Homo sapiens
caccacacagtcacccctccc

SEQ ID NO: 6692350 - DNA, 14 bp, Homo sapiens
caccacacatccca

SEQ ID NO: 6692351 - DNA, 16 bp, Homo sapiens
caccacacccagcctc

SEQ ID NO: 6692352 - DNA, 20 bp, Homo sapiens
caccacacccaggtctcttc

SEQ ID NO: 6692353 - DNA, 17 bp, Homo sapiens
caccacactgaatctcc

SEQ ID NO: 6692354 - DNA, 17 bp, Homo sapiens
caccacagaagcttgta

SEQ ID NO: 6692355 - DNA, 20 bp, Homo sapiens
caccacagacacacacacgc

SEQ ID NO: 6692356 - DNA, 14 bp, Homo sapiens
caccacagagaaga

SEQ ID NO: 6692357 - DNA, 13 bp, Homo sapiens
caccacagcaggt

SEQ ID NO: 6692358 - DNA, 13 bp, Homo sapiens
caccacagccagc

SEQ ID NO: 6692359 - DNA, 13 bp, Homo sapiens
caccacagcctcc

SEQ ID NO: 6692360 - DNA, 22 bp, Homo sapiens
caccacagcttatggcatctca

SEQ ID NO: 6692361 - DNA, 17 bp, Homo sapiens
caccacagtaagttcct

SEQ ID NO: 6692362 - DNA, 23 bp, Homo sapiens
caccacataaggtcagctcagag

SEQ ID NO: 6692363 - DNA, 14 bp, Homo sapiens
caccacatctaagc

SEQ ID NO: 6692364 - DNA, 15 bp, Homo sapiens
caccacatctgccag

SEQ ID NO: 6692365 - DNA, 18 bp, Homo sapiens
caccacatgtgcacatgc

SEQ ID NO: 6692366 - DNA, 18 bp, Homo sapiens
caccacattctgtctctg

SEQ ID NO: 6692367 - DNA, 19 bp, Homo sapiens
caccacattctgtctctgc

SEQ ID NO: 6692368 - DNA, 21 bp, Homo sapiens
caccaccaaatgccaagaaaa

SEQ ID NO: 6692369 - DNA, 20 bp, Homo sapiens
caccaccaagccctgcaaat

SEQ ID NO: 6692370 - DNA, 14 bp, Homo sapiens
caccaccacccttg

SEQ ID NO: 6692371 - DNA, 14 bp, Homo sapiens
caccaccacgcctg

SEQ ID NO: 6692372 - DNA, 17 bp, Homo sapiens
caccaccactctcactc

SEQ ID NO: 6692373 - DNA, 16 bp, Homo sapiens
caccaccactggccac

SEQ ID NO: 6692374 - DNA, 23 bp, Homo sapiens
caccaccactggccaccaggctg

SEQ ID NO: 6692375 - DNA, 21 bp, Homo sapiens
caccaccagatgagaagttaa

SEQ ID NO: 6692376 - DNA, 22 bp, Homo sapiens
caccaccagatgagaagttaag

SEQ ID NO: 6692377 - DNA, 20 bp, Homo sapiens
caccaccaggagcagcagcc

SEQ ID NO: 6692378 - DNA, 22 bp, Homo sapiens
caccaccaggagcagcagccag

SEQ ID NO: 6692379 - DNA, 18 bp, Homo sapiens
caccaccagggctccagg

SEQ ID NO: 6692380 - DNA, 14 bp, Homo sapiens
caccaccaggtctc

SEQ ID NO: 6692381 - DNA, 14 bp, Homo sapiens
caccacccaacctg

SEQ ID NO: 6692382 - DNA, 17 bp, Homo sapiens
caccacccaacctgtcc

SEQ ID NO: 6692383 - DNA, 13 bp, Homo sapiens
caccacccagagc

SEQ ID NO: 6692384 - DNA, 14 bp, Homo sapiens
caccacccagagca

SEQ ID NO: 6692385 - DNA, 15 bp, Homo sapiens
caccacccagccctt

SEQ ID NO: 6692386 - DNA, 14 bp, Homo sapiens
caccaccccagctg

SEQ ID NO: 6692387 - DNA, 17 bp, Homo sapiens
caccacccccagtcccc

SEQ ID NO: 6692388 - DNA, 14 bp, Homo sapiens
caccaccccccact

SEQ ID NO: 6692389 - DNA, 16 bp, Homo sapiens
caccaccccccactct

SEQ ID NO: 6692390 - DNA, 20 bp, Homo sapiens
caccaccccctcaagcccca

SEQ ID NO: 6692391 - DNA, 23 bp, Homo sapiens
caccaccccctcaagccccagca

SEQ ID NO: 6692392 - DNA, 16 bp, Homo sapiens
caccaccccctgtccc

SEQ ID NO: 6692393 - DNA, 20 bp, Homo sapiens
caccaccccctgtcccattc

SEQ ID NO: 6692394 - DNA, 19 bp, Homo sapiens
caccacccctccctctgct

SEQ ID NO: 6692395 - DNA, 17 bp, Homo sapiens
caccacccgaaatgcca

SEQ ID NO: 6692396 - DNA, 17 bp, Homo sapiens
caccaccctcaggtgcc

SEQ ID NO: 6692397 - DNA, 18 bp, Homo sapiens
caccaccctcaggtgcct

SEQ ID NO: 6692398 - DNA, 22 bp, Homo sapiens
caccaccctcccctgtcttctc

SEQ ID NO: 6692399 - DNA, 12 bp, Homo sapiens
caccaccctgcc

SEQ ID NO: 6692400 - DNA, 20 bp, Homo sapiens
caccaccctgctcatccact

SEQ ID NO: 6692401 - DNA, 21 bp, Homo sapiens
caccaccctgtcttcctctgc

SEQ ID NO: 6692402 - DNA, 22 bp, Homo sapiens
caccaccctgtcttcctctgca

SEQ ID NO: 6692403 - DNA, 13 bp, Homo sapiens
caccacccttcca

SEQ ID NO: 6692404 - DNA, 17 bp, Homo sapiens
caccaccgaccaactcc

SEQ ID NO: 6692405 - DNA, 17 bp, Homo sapiens
caccaccgagctctgtg

SEQ ID NO: 6692406 - DNA, 21 bp, Homo sapiens
caccaccgccctcctcgctgt

SEQ ID NO: 6692407 - DNA, 23 bp, Homo sapiens
caccaccgccctcctcgctgtgc

SEQ ID NO: 6692408 - DNA, 14 bp, Homo sapiens
caccaccgcctctg

SEQ ID NO: 6692409 - DNA, 15 bp, Homo sapiens
caccaccgcctctgg

SEQ ID NO: 6692410 - DNA, 13 bp, Homo sapiens
caccacctcagag

SEQ ID NO: 6692411 - DNA, 13 bp, Homo sapiens
caccacctccctc

SEQ ID NO: 6692412 - DNA, 14 bp, Homo sapiens
caccacctctgtgg

SEQ ID NO: 6692413 - DNA, 14 bp, Homo sapiens
caccacctggagtg

SEQ ID NO: 6692414 - DNA, 19 bp, Homo sapiens
caccaccttcccagctctc

SEQ ID NO: 6692415 - DNA, 21 bp, Homo sapiens
caccaccttcccagctctccc

SEQ ID NO: 6692416 - DNA, 22 bp, Homo sapiens
caccaccttcccagctctccct

SEQ ID NO: 6692417 - DNA, 18 bp, Homo sapiens
caccaccttcttctccta

SEQ ID NO: 6692418 - DNA, 13 bp, Homo sapiens
caccacgaatttg

SEQ ID NO: 6692419 - DNA, 21 bp, Homo sapiens
caccacgatgacgcctctgga

SEQ ID NO: 6692420 - DNA, 15 bp, Homo sapiens
caccacgatgtggcc

SEQ ID NO: 6692421 - DNA, 19 bp, Homo sapiens
caccacgctggggtctggg

SEQ ID NO: 6692422 - DNA, 17 bp, Homo sapiens
caccacggccaccactg

SEQ ID NO: 6692423 - DNA, 22 bp, Homo sapiens
caccacggcgttgtacctgtag

SEQ ID NO: 6692424 - DNA, 20 bp, Homo sapiens
caccacggcgtttttttaca

SEQ ID NO: 6692425 - DNA, 23 bp, Homo sapiens
caccacggggtcgggggaggagc

SEQ ID NO: 6692426 - DNA, 13 bp, Homo sapiens
caccacgtcctgg

SEQ ID NO: 6692427 - DNA, 14 bp, Homo sapiens
caccacgtcctggt

SEQ ID NO: 6692428 - DNA, 20 bp, Homo sapiens
caccacgtctgccaggccca

SEQ ID NO: 6692429 - DNA, 22 bp, Homo sapiens
caccacgtctggctccctgccc

SEQ ID NO: 6692430 - DNA, 20 bp, Homo sapiens
caccacgttaactgcatttt

SEQ ID NO: 6692431 - DNA, 14 bp, Homo sapiens
caccactaaaaaac

SEQ ID NO: 6692432 - DNA, 18 bp, Homo sapiens
caccactaaccatcccca

SEQ ID NO: 6692433 - DNA, 14 bp, Homo sapiens
caccactacagtaa

SEQ ID NO: 6692434 - DNA, 15 bp, Homo sapiens
caccactacagtaag

SEQ ID NO: 6692435 - DNA, 19 bp, Homo sapiens
caccactaggaatcccaga

SEQ ID NO: 6692436 - DNA, 23 bp, Homo sapiens
caccactccccaacccctctcca

SEQ ID NO: 6692437 - DNA, 16 bp, Homo sapiens
caccactcccctccca

SEQ ID NO: 6692438 - DNA, 15 bp, Homo sapiens
caccactcctgccag

SEQ ID NO: 6692439 - DNA, 16 bp, Homo sapiens
caccactcctgccagc

SEQ ID NO: 6692440 - DNA, 18 bp, Homo sapiens
caccactcctgccagccc

SEQ ID NO: 6692441 - DNA, 20 bp, Homo sapiens
caccactcctgcctgccccc

SEQ ID NO: 6692442 - DNA, 12 bp, Homo sapiens
caccactctggc

SEQ ID NO: 6692443 - DNA, 13 bp, Homo sapiens
caccactctggca

SEQ ID NO: 6692444 - DNA, 14 bp, Homo sapiens
caccactctggcag

SEQ ID NO: 6692445 - DNA, 17 bp, Homo sapiens
caccactctggcagcca

SEQ ID NO: 6692446 - DNA, 15 bp, Homo sapiens
caccactctgggcac

SEQ ID NO: 6692447 - DNA, 16 bp, Homo sapiens
caccactgatatcatg

SEQ ID NO: 6692448 - DNA, 13 bp, Homo sapiens
caccactgcactc

SEQ ID NO: 6692449 - DNA, 22 bp, Homo sapiens
caccactgccattacccagtgc

SEQ ID NO: 6692450 - DNA, 16 bp, Homo sapiens
caccactgccctgcct

SEQ ID NO: 6692451 - DNA, 18 bp, Homo sapiens
caccactgccctgcctgc

SEQ ID NO: 6692452 - DNA, 15 bp, Homo sapiens
caccactgctgagga

SEQ ID NO: 6692453 - DNA, 17 bp, Homo sapiens
caccactgctgaggagt

SEQ ID NO: 6692454 - DNA, 20 bp, Homo sapiens
caccactgctgaggagtctg

SEQ ID NO: 6692455 - DNA, 23 bp, Homo sapiens
caccactgctgaggagtctgagg

SEQ ID NO: 6692456 - DNA, 13 bp, Homo sapiens
caccactgcttcc

SEQ ID NO: 6692457 - DNA, 20 bp, Homo sapiens
caccactgcttcccactggg

SEQ ID NO: 6692458 - DNA, 23 bp, Homo sapiens
caccactgcttcccactggggcc

SEQ ID NO: 6692459 - DNA, 16 bp, Homo sapiens
caccactggccaccag

SEQ ID NO: 6692460 - DNA, 19 bp, Homo sapiens
caccactggccaccaggct

SEQ ID NO: 6692461 - DNA, 13 bp, Homo sapiens
caccactgggaac

SEQ ID NO: 6692462 - DNA, 19 bp, Homo sapiens
caccactgtactccagccc

SEQ ID NO: 6692463 - DNA, 17 bp, Homo sapiens
caccactgtccctacca

SEQ ID NO: 6692464 - DNA, 14 bp, Homo sapiens
caccactgtgtccc

SEQ ID NO: 6692465 - DNA, 21 bp, Homo sapiens
caccactgtgtcccagtgtct

SEQ ID NO: 6692466 - DNA, 18 bp, Homo sapiens
caccactgttctgttcat

SEQ ID NO: 6692467 - DNA, 19 bp, Homo sapiens
caccacttagcctctttct

SEQ ID NO: 6692468 - DNA, 12 bp, Homo sapiens
caccacttattt

SEQ ID NO: 6692469 - DNA, 21 bp, Homo sapiens
caccacttatttattgttgcc

SEQ ID NO: 6692470 - DNA, 20 bp, Homo sapiens
caccacttcaggggatgggt

SEQ ID NO: 6692471 - DNA, 18 bp, Homo sapiens
caccacttccagagccag

SEQ ID NO: 6692472 - DNA, 21 bp, Homo sapiens
caccacttggagatctttgct

SEQ ID NO: 6692473 - DNA, 16 bp, Homo sapiens
caccactttcccacac

SEQ ID NO: 6692474 - DNA, 19 bp, Homo sapiens
caccactttgtaaaaggac

SEQ ID NO: 6692475 - DNA, 21 bp, Homo sapiens
caccagaaagcctcctctgga

SEQ ID NO: 6692476 - DNA, 17 bp, Homo sapiens
caccagaaatgtttatg

SEQ ID NO: 6692477 - DNA, 20 bp, Homo sapiens
caccagaagctgttgggaga

SEQ ID NO: 6692478 - DNA, 17 bp, Homo sapiens
caccagaagtgccatgc

SEQ ID NO: 6692479 - DNA, 13 bp, Homo sapiens
caccagaagttac

SEQ ID NO: 6692480 - DNA, 15 bp, Homo sapiens
caccagacacccagg

SEQ ID NO: 6692481 - DNA, 17 bp, Homo sapiens
caccagacacccaggac

SEQ ID NO: 6692482 - DNA, 19 bp, Homo sapiens
caccagacacccaggactt

SEQ ID NO: 6692483 - DNA, 19 bp, Homo sapiens
caccagactgaagtaaaca

SEQ ID NO: 6692484 - DNA, 14 bp, Homo sapiens
caccagagacaagc

SEQ ID NO: 6692485 - DNA, 17 bp, Homo sapiens
caccagagacaagcaga

SEQ ID NO: 6692486 - DNA, 21 bp, Homo sapiens
caccagagaccgtcctcaccc

SEQ ID NO: 6692487 - DNA, 14 bp, Homo sapiens
caccagagagggac

SEQ ID NO: 6692488 - DNA, 18 bp, Homo sapiens
caccagagcaacctctca

SEQ ID NO: 6692489 - DNA, 20 bp, Homo sapiens
caccagagcaacctctcact

SEQ ID NO: 6692490 - DNA, 16 bp, Homo sapiens
caccagagcaggggct

SEQ ID NO: 6692491 - DNA, 23 bp, Homo sapiens
caccagagcaggggctgctgggg

SEQ ID NO: 6692492 - DNA, 21 bp, Homo sapiens
caccagagcatttccaacacc

SEQ ID NO: 6692493 - DNA, 22 bp, Homo sapiens
caccagagcccaccttggctca

SEQ ID NO: 6692494 - DNA, 14 bp, Homo sapiens
caccagagcctccc

SEQ ID NO: 6692495 - DNA, 15 bp, Homo sapiens
caccagagcctccct

SEQ ID NO: 6692496 - DNA, 14 bp, Homo sapiens
caccagagcttctc

SEQ ID NO: 6692497 - DNA, 21 bp, Homo sapiens
caccagaggctgcagaaggcc

SEQ ID NO: 6692498 - DNA, 18 bp, Homo sapiens
caccagagtgtatgcata

SEQ ID NO: 6692499 - DNA, 19 bp, Homo sapiens
caccagagtgtatgcatac

SEQ ID NO: 6692500 - DNA, 13 bp, Homo sapiens
caccagatctgat

SEQ ID NO: 6692501 - DNA, 15 bp, Homo sapiens
caccagatgagaagt

SEQ ID NO: 6692502 - DNA, 16 bp, Homo sapiens
caccagatgagaagtt

SEQ ID NO: 6692503 - DNA, 12 bp, Homo sapiens
caccagatgctg

SEQ ID NO: 6692504 - DNA, 15 bp, Homo sapiens
caccagatgtgacag

SEQ ID NO: 6692505 - DNA, 11 bp, Homo sapiens
caccagcagaa

SEQ ID NO: 6692506 - DNA, 14 bp, Homo sapiens
caccagcagcacaa

SEQ ID NO: 6692507 - DNA, 17 bp, Homo sapiens
caccagcagcacaattc

SEQ ID NO: 6692508 - DNA, 15 bp, Homo sapiens
caccagcagcatggc

SEQ ID NO: 6692509 - DNA, 12 bp, Homo sapiens
caccagcagcct

SEQ ID NO: 6692510 - DNA, 15 bp, Homo sapiens
caccagcagcctgga

SEQ ID NO: 6692511 - DNA, 11 bp, Homo sapiens
caccagcaggc

SEQ ID NO: 6692512 - DNA, 21 bp, Homo sapiens
caccagcatccaccttggctc

SEQ ID NO: 6692513 - DNA, 22 bp, Homo sapiens
caccagcatccaccttggctct

SEQ ID NO: 6692514 - DNA, 13 bp, Homo sapiens
caccagcatgtca

SEQ ID NO: 6692515 - DNA, 14 bp, Homo sapiens
caccagcattcctt

SEQ ID NO: 6692516 - DNA, 20 bp, Homo sapiens
caccagccacagcctcccca

SEQ ID NO: 6692517 - DNA, 12 bp, Homo sapiens
caccagccacct

SEQ ID NO: 6692518 - DNA, 12 bp, Homo sapiens
caccagccagcg

SEQ ID NO: 6692519 - DNA, 16 bp, Homo sapiens
caccagccagcgcagg

SEQ ID NO: 6692520 - DNA, 13 bp, Homo sapiens
caccagccaggct

SEQ ID NO: 6692521 - DNA, 15 bp, Homo sapiens
caccagccaggctct

SEQ ID NO: 6692522 - DNA, 20 bp, Homo sapiens
caccagccaggctctgtgct

SEQ ID NO: 6692523 - DNA, 13 bp, Homo sapiens
caccagccatcct

SEQ ID NO: 6692524 - DNA, 16 bp, Homo sapiens
caccagccatcctccc

SEQ ID NO: 6692525 - DNA, 15 bp, Homo sapiens
caccagcccagaagt

SEQ ID NO: 6692526 - DNA, 19 bp, Homo sapiens
caccagcccatggccctgt

SEQ ID NO: 6692527 - DNA, 16 bp, Homo sapiens
caccagccccaatcca

SEQ ID NO: 6692528 - DNA, 23 bp, Homo sapiens
caccagccccactgccagcagca

SEQ ID NO: 6692529 - DNA, 17 bp, Homo sapiens
caccagccccacttctg

SEQ ID NO: 6692530 - DNA, 14 bp, Homo sapiens
caccagccccagca

SEQ ID NO: 6692531 - DNA, 13 bp, Homo sapiens
caccagccccagt

SEQ ID NO: 6692532 - DNA, 17 bp, Homo sapiens
caccagccccagtgccc

SEQ ID NO: 6692533 - DNA, 14 bp, Homo sapiens
caccagccccccgc

SEQ ID NO: 6692534 - DNA, 16 bp, Homo sapiens
caccagccccccgcgc

SEQ ID NO: 6692535 - DNA, 20 bp, Homo sapiens
caccagcccccgccccagag

SEQ ID NO: 6692536 - DNA, 21 bp, Homo sapiens
caccagcccccgccccagagt

SEQ ID NO: 6692537 - DNA, 24 bp, Homo sapiens
caccagccccctggatgggcattg

SEQ ID NO: 6692538 - DNA, 12 bp, Homo sapiens
caccagcccctc

SEQ ID NO: 6692539 - DNA, 16 bp, Homo sapiens
caccagcccctcccca

SEQ ID NO: 6692540 - DNA, 19 bp, Homo sapiens
caccagcccctgccccagc

SEQ ID NO: 6692541 - DNA, 12 bp, Homo sapiens
caccagcccgca

SEQ ID NO: 6692542 - DNA, 20 bp, Homo sapiens
caccagcccgcaactctcca

SEQ ID NO: 6692543 - DNA, 16 bp, Homo sapiens
caccagcccggcctgc

SEQ ID NO: 6692544 - DNA, 13 bp, Homo sapiens
caccagccctgag

SEQ ID NO: 6692545 - DNA, 20 bp, Homo sapiens
caccagccctgcagcccacc

SEQ ID NO: 6692546 - DNA, 12 bp, Homo sapiens
caccagccctgg

SEQ ID NO: 6692547 - DNA, 13 bp, Homo sapiens
caccagccctggt

SEQ ID NO: 6692548 - DNA, 15 bp, Homo sapiens
caccagcccttccct

SEQ ID NO: 6692549 - DNA, 16 bp, Homo sapiens
caccagccgctgcagg

SEQ ID NO: 6692550 - DNA, 22 bp, Homo sapiens
caccagcctagcctggctctgc

SEQ ID NO: 6692551 - DNA, 13 bp, Homo sapiens
caccagcctcagt

SEQ ID NO: 6692552 - DNA, 10 bp, Homo sapiens
caccagcctg

SEQ ID NO: 6692553 - DNA, 14 bp, Homo sapiens
caccagcctgagcc

SEQ ID NO: 6692554 - DNA, 15 bp, Homo sapiens
caccagcctgagcca

SEQ ID NO: 6692555 - DNA, 22 bp, Homo sapiens
caccagcctgagccacagtggg

SEQ ID NO: 6692556 - DNA, 13 bp, Homo sapiens
caccagcctgcac

SEQ ID NO: 6692557 - DNA, 13 bp, Homo sapiens
caccagcctgctg

SEQ ID NO: 6692558 - DNA, 16 bp, Homo sapiens
caccagcctgctgaca

SEQ ID NO: 6692559 - DNA, 21 bp, Homo sapiens
caccagcctgctgacagacac

SEQ ID NO: 6692560 - DNA, 12 bp, Homo sapiens
caccagccttgc

SEQ ID NO: 6692561 - DNA, 13 bp, Homo sapiens
caccagccttgct

SEQ ID NO: 6692562 - DNA, 20 bp, Homo sapiens
caccagccttggtgccacca

SEQ ID NO: 6692563 - DNA, 17 bp, Homo sapiens
caccagcgcccccactc

SEQ ID NO: 6692564 - DNA, 19 bp, Homo sapiens
caccagcgcccccactcct

SEQ ID NO: 6692565 - DNA, 22 bp, Homo sapiens
caccagcgcccccactcctcct

SEQ ID NO: 6692566 - DNA, 22 bp, Homo sapiens
caccagcggtccaacgccgcct

SEQ ID NO: 6692567 - DNA, 17 bp, Homo sapiens
caccagcgttcccttct

SEQ ID NO: 6692568 - DNA, 19 bp, Homo sapiens
caccagcgttcccttctcc

SEQ ID NO: 6692569 - DNA, 23 bp, Homo sapiens
caccagcgttcccttctccccct

SEQ ID NO: 6692570 - DNA, 24 bp, Homo sapiens
caccagcgttgggtttgctcatgt

SEQ ID NO: 6692571 - DNA, 22 bp, Homo sapiens
caccagctcagccccggccact

SEQ ID NO: 6692572 - DNA, 19 bp, Homo sapiens
caccagctccacacattcc

SEQ ID NO: 6692573 - DNA, 21 bp, Homo sapiens
caccagctccacacattccag

SEQ ID NO: 6692574 - DNA, 15 bp, Homo sapiens
caccagctccactgg

SEQ ID NO: 6692575 - DNA, 18 bp, Homo sapiens
caccagctccactggcct

SEQ ID NO: 6692576 - DNA, 13 bp, Homo sapiens
caccagctcccaa

SEQ ID NO: 6692577 - DNA, 23 bp, Homo sapiens
caccagctctgtggcctgtgtcc

SEQ ID NO: 6692578 - DNA, 13 bp, Homo sapiens
caccagctgcaaa

SEQ ID NO: 6692579 - DNA, 18 bp, Homo sapiens
caccagctgcaaagtgtt

SEQ ID NO: 6692580 - DNA, 13 bp, Homo sapiens
caccagctgcagc

SEQ ID NO: 6692581 - DNA, 20 bp, Homo sapiens
caccagctgccaaaatcgta

SEQ ID NO: 6692582 - DNA, 12 bp, Homo sapiens
caccagctgctc

SEQ ID NO: 6692583 - DNA, 19 bp, Homo sapiens
caccagctgctctgcccct

SEQ ID NO: 6692584 - DNA, 14 bp, Homo sapiens
caccagctgctgga

SEQ ID NO: 6692585 - DNA, 15 bp, Homo sapiens
caccagctgctgtgc

SEQ ID NO: 6692586 - DNA, 14 bp, Homo sapiens
caccagctggctct

SEQ ID NO: 6692587 - DNA, 18 bp, Homo sapiens
caccagctggctctgcag

SEQ ID NO: 6692588 - DNA, 16 bp, Homo sapiens
caccagcttaagcgtt

SEQ ID NO: 6692589 - DNA, 13 bp, Homo sapiens
caccagctttatt

SEQ ID NO: 6692590 - DNA, 17 bp, Homo sapiens
caccaggaagaaggccc

SEQ ID NO: 6692591 - DNA, 11 bp, Homo sapiens
caccaggaagg

SEQ ID NO: 6692592 - DNA, 17 bp, Homo sapiens
caccaggaagtgtttat

SEQ ID NO: 6692593 - DNA, 21 bp, Homo sapiens
caccaggaatgttaaagtcag

SEQ ID NO: 6692594 - DNA, 19 bp, Homo sapiens
caccaggacttggggtcag

SEQ ID NO: 6692595 - DNA, 20 bp, Homo sapiens
caccaggacttggggtcagg

SEQ ID NO: 6692596 - DNA, 23 bp, Homo sapiens
caccaggacttggggtcaggaac

SEQ ID NO: 6692597 - DNA, 14 bp, Homo sapiens
caccaggactttaa

SEQ ID NO: 6692598 - DNA, 22 bp, Homo sapiens
caccaggagcacctggaccccc

SEQ ID NO: 6692599 - DNA, 15 bp, Homo sapiens
caccaggagcagcag

SEQ ID NO: 6692600 - DNA, 18 bp, Homo sapiens
caccaggagcagcagcca

SEQ ID NO: 6692601 - DNA, 19 bp, Homo sapiens
caccaggagcagcagccag

SEQ ID NO: 6692602 - DNA, 21 bp, Homo sapiens
caccaggagcagcagccagca

SEQ ID NO: 6692603 - DNA, 22 bp, Homo sapiens
caccaggagcagcagccagcac

SEQ ID NO: 6692604 - DNA, 23 bp, Homo sapiens
caccaggagcagcagccagcacc

SEQ ID NO: 6692605 - DNA, 17 bp, Homo sapiens
caccaggagtccctggt

SEQ ID NO: 6692606 - DNA, 19 bp, Homo sapiens
caccaggatgaaggcgtgc

SEQ ID NO: 6692607 - DNA, 13 bp, Homo sapiens
caccaggatggcc

SEQ ID NO: 6692608 - DNA, 15 bp, Homo sapiens
caccaggatggccct

SEQ ID NO: 6692609 - DNA, 18 bp, Homo sapiens
caccaggatttatacata

SEQ ID NO: 6692610 - DNA, 13 bp, Homo sapiens
caccaggcaagaa

SEQ ID NO: 6692611 - DNA, 17 bp, Homo sapiens
caccaggcaagaaaagc

SEQ ID NO: 6692612 - DNA, 20 bp, Homo sapiens
caccaggcacctcacagaaa

SEQ ID NO: 6692613 - DNA, 20 bp, Homo sapiens
caccaggcacgaacccacct

SEQ ID NO: 6692614 - DNA, 13 bp, Homo sapiens
caccaggcagcct

SEQ ID NO: 6692615 - DNA, 14 bp, Homo sapiens
caccaggcagcctc

SEQ ID NO: 6692616 - DNA, 18 bp, Homo sapiens
caccaggcagcctctggg

SEQ ID NO: 6692617 - DNA, 19 bp, Homo sapiens
caccaggccacctccccag

SEQ ID NO: 6692618 - DNA, 14 bp, Homo sapiens
caccaggccagctc

SEQ ID NO: 6692619 - DNA, 15 bp, Homo sapiens
caccaggccagctca

SEQ ID NO: 6692620 - DNA, 17 bp, Homo sapiens
caccaggcccccctgtc

SEQ ID NO: 6692621 - DNA, 14 bp, Homo sapiens
caccaggccgggct

SEQ ID NO: 6692622 - DNA, 17 bp, Homo sapiens
caccaggcctcactggc

SEQ ID NO: 6692623 - DNA, 23 bp, Homo sapiens
caccaggctgagccgaagctgcg

SEQ ID NO: 6692624 - DNA, 21 bp, Homo sapiens
caccaggctgaggtcctgatc

SEQ ID NO: 6692625 - DNA, 16 bp, Homo sapiens
caccaggctggcgcag

SEQ ID NO: 6692626 - DNA, 18 bp, Homo sapiens
caccaggctggcgcagcc

SEQ ID NO: 6692627 - DNA, 15 bp, Homo sapiens
caccaggctgtgggc

SEQ ID NO: 6692628 - DNA, 15 bp, Homo sapiens
caccagggaagaaga

SEQ ID NO: 6692629 - DNA, 13 bp, Homo sapiens
caccagggactgc

SEQ ID NO: 6692630 - DNA, 16 bp, Homo sapiens
caccagggagaggcct

SEQ ID NO: 6692631 - DNA, 17 bp, Homo sapiens
caccagggagaggcctc

SEQ ID NO: 6692632 - DNA, 18 bp, Homo sapiens
caccagggagcttcctgg

SEQ ID NO: 6692633 - DNA, 15 bp, Homo sapiens
caccagggatcacag

SEQ ID NO: 6692634 - DNA, 16 bp, Homo sapiens
caccagggatggtact

SEQ ID NO: 6692635 - DNA, 18 bp, Homo sapiens
caccagggcactgtctgc

SEQ ID NO: 6692636 - DNA, 18 bp, Homo sapiens
caccagggcatctctggg

SEQ ID NO: 6692637 - DNA, 19 bp, Homo sapiens
caccagggcatctctgggc

SEQ ID NO: 6692638 - DNA, 21 bp, Homo sapiens
caccagggcatctctgggctg

SEQ ID NO: 6692639 - DNA, 16 bp, Homo sapiens
caccagggccaaaagc

SEQ ID NO: 6692640 - DNA, 22 bp, Homo sapiens
caccagggccaaaagcttccct

SEQ ID NO: 6692641 - DNA, 13 bp, Homo sapiens
caccagggccaga

SEQ ID NO: 6692642 - DNA, 14 bp, Homo sapiens
caccagggccagag

SEQ ID NO: 6692643 - DNA, 17 bp, Homo sapiens
caccagggccagagcag

SEQ ID NO: 6692644 - DNA, 20 bp, Homo sapiens
caccagggccagagcagctc

SEQ ID NO: 6692645 - DNA, 21 bp, Homo sapiens
caccagggccagagcagctcc

SEQ ID NO: 6692646 - DNA, 14 bp, Homo sapiens
caccagggccagcc

SEQ ID NO: 6692647 - DNA, 21 bp, Homo sapiens
caccagggccagctaattttt

SEQ ID NO: 6692648 - DNA, 22 bp, Homo sapiens
caccagggccagctaatttttg

SEQ ID NO: 6692649 - DNA, 17 bp, Homo sapiens
caccagggcctggctgg

SEQ ID NO: 6692650 - DNA, 18 bp, Homo sapiens
caccagggctcagctcct

SEQ ID NO: 6692651 - DNA, 16 bp, Homo sapiens
caccaggggaaggaag

SEQ ID NO: 6692652 - DNA, 19 bp, Homo sapiens
caccaggggaaggaaggag

SEQ ID NO: 6692653 - DNA, 14 bp, Homo sapiens
caccaggggaggag

SEQ ID NO: 6692654 - DNA, 13 bp, Homo sapiens
caccaggggcagg

SEQ ID NO: 6692655 - DNA, 17 bp, Homo sapiens
caccaggggcaggcaca

SEQ ID NO: 6692656 - DNA, 18 bp, Homo sapiens
caccaggggcaggcacag

SEQ ID NO: 6692657 - DNA, 21 bp, Homo sapiens
caccaggggccaacctcaggc

SEQ ID NO: 6692658 - DNA, 14 bp, Homo sapiens
caccagggtcccag

SEQ ID NO: 6692659 - DNA, 17 bp, Homo sapiens
caccagggtcccaggaa

SEQ ID NO: 6692660 - DNA, 22 bp, Homo sapiens
caccagggtccgcaccagctgc

SEQ ID NO: 6692661 - DNA, 23 bp, Homo sapiens
caccagggtccgcaccagctgct

SEQ ID NO: 6692662 - DNA, 24 bp, Homo sapiens
caccagggtccgcaccagctgctc

SEQ ID NO: 6692663 - DNA, 13 bp, Homo sapiens
caccagggtggac

SEQ ID NO: 6692664 - DNA, 17 bp, Homo sapiens
caccagggtggaccagg

SEQ ID NO: 6692665 - DNA, 23 bp, Homo sapiens
caccagggtggaccaggcctgga

SEQ ID NO: 6692666 - DNA, 19 bp, Homo sapiens
caccagggttgaccccaga

SEQ ID NO: 6692667 - DNA, 23 bp, Homo sapiens
caccagggttgaccccagaggat

SEQ ID NO: 6692668 - DNA, 20 bp, Homo sapiens
caccaggtagaacgccaggg

SEQ ID NO: 6692669 - DNA, 15 bp, Homo sapiens
caccaggtcactctg

SEQ ID NO: 6692670 - DNA, 15 bp, Homo sapiens
caccaggtgcatgca

SEQ ID NO: 6692671 - DNA, 16 bp, Homo sapiens
caccaggtgcatgcat

SEQ ID NO: 6692672 - DNA, 21 bp, Homo sapiens
caccaggtgcatgcatgccct

SEQ ID NO: 6692673 - DNA, 19 bp, Homo sapiens
caccaggtgcctttcaaat

SEQ ID NO: 6692674 - DNA, 23 bp, Homo sapiens
caccaggttaaaattttaatttc

SEQ ID NO: 6692675 - DNA, 18 bp, Homo sapiens
caccagtcacctcgtctc

SEQ ID NO: 6692676 - DNA, 19 bp, Homo sapiens
caccagtcacctcgtctcc

SEQ ID NO: 6692677 - DNA, 16 bp, Homo sapiens
caccagtcatttttca

SEQ ID NO: 6692678 - DNA, 16 bp, Homo sapiens
caccagtccacgccgg

SEQ ID NO: 6692679 - DNA, 19 bp, Homo sapiens
caccagtccacgccgggtc

SEQ ID NO: 6692680 - DNA, 13 bp, Homo sapiens
caccagtctgtct

SEQ ID NO: 6692681 - DNA, 21 bp, Homo sapiens
caccagtgactttttctaaga

SEQ ID NO: 6692682 - DNA, 22 bp, Homo sapiens
caccagtgcatcacatctgcac

SEQ ID NO: 6692683 - DNA, 14 bp, Homo sapiens
caccagtgcatcct

SEQ ID NO: 6692684 - DNA, 17 bp, Homo sapiens
caccagtgccacgtcat

SEQ ID NO: 6692685 - DNA, 23 bp, Homo sapiens
caccagtgccacgtcatgagcgt

SEQ ID NO: 6692686 - DNA, 13 bp, Homo sapiens
caccagtgccgcc

SEQ ID NO: 6692687 - DNA, 18 bp, Homo sapiens
caccagtgccgcctgtgc

SEQ ID NO: 6692688 - DNA, 20 bp, Homo sapiens
caccagtgccgcctgtgccc

SEQ ID NO: 6692689 - DNA, 13 bp, Homo sapiens
caccagtgcctca

SEQ ID NO: 6692690 - DNA, 14 bp, Homo sapiens
caccagtgcctcag

SEQ ID NO: 6692691 - DNA, 17 bp, Homo sapiens
caccagtgcctcagtgc

SEQ ID NO: 6692692 - DNA, 19 bp, Homo sapiens
caccagtgcctcagtgctg

SEQ ID NO: 6692693 - DNA, 20 bp, Homo sapiens
caccagtgcctcagtgctgc

SEQ ID NO: 6692694 - DNA, 22 bp, Homo sapiens
caccagtgcctcagtgctgcaa

SEQ ID NO: 6692695 - DNA, 15 bp, Homo sapiens
caccagtggacctag

SEQ ID NO: 6692696 - DNA, 19 bp, Homo sapiens
caccagtggacctagcctg

SEQ ID NO: 6692697 - DNA, 14 bp, Homo sapiens
caccagtggccttt

SEQ ID NO: 6692698 - DNA, 19 bp, Homo sapiens
caccagtgtagcatcttcc

SEQ ID NO: 6692699 - DNA, 24 bp, Homo sapiens
caccagtgtagcatcttcctctgc

SEQ ID NO: 6692700 - DNA, 15 bp, Homo sapiens
caccagtgtcctccc

SEQ ID NO: 6692701 - DNA, 23 bp, Homo sapiens
caccagtgtggggttctgctggg

SEQ ID NO: 6692702 - DNA, 18 bp, Homo sapiens
caccagtgtgtgggggag

SEQ ID NO: 6692703 - DNA, 14 bp, Homo sapiens
caccagtgttcctg

SEQ ID NO: 6692704 - DNA, 21 bp, Homo sapiens
caccagtgttcctgaagctgc

SEQ ID NO: 6692705 - DNA, 14 bp, Homo sapiens
caccagttactgtt

SEQ ID NO: 6692706 - DNA, 19 bp, Homo sapiens
caccagttatgtttgaatg

SEQ ID NO: 6692707 - DNA, 11 bp, Homo sapiens
caccagttctc

SEQ ID NO: 6692708 - DNA, 19 bp, Homo sapiens
caccagttgaactgcagga

SEQ ID NO: 6692709 - DNA, 15 bp, Homo sapiens
caccagttgctgctt

SEQ ID NO: 6692710 - DNA, 17 bp, Homo sapiens
caccagtttctgcggcc

SEQ ID NO: 6692711 - DNA, 22 bp, Homo sapiens
caccagttttgagtgtactgtg

SEQ ID NO: 6692712 - DNA, 20 bp, Homo sapiens
caccataagctactgccatc

SEQ ID NO: 6692713 - DNA, 14 bp, Homo sapiens
caccataccttaga

SEQ ID NO: 6692714 - DNA, 19 bp, Homo sapiens
caccataccttagagactt

SEQ ID NO: 6692715 - DNA, 16 bp, Homo sapiens
caccatacctttgcta

SEQ ID NO: 6692716 - DNA, 17 bp, Homo sapiens
caccatactccttgctt

SEQ ID NO: 6692717 - DNA, 22 bp, Homo sapiens
caccatactccttgcttcctga

SEQ ID NO: 6692718 - DNA, 21 bp, Homo sapiens
caccatagaagaacagcagat

SEQ ID NO: 6692719 - DNA, 13 bp, Homo sapiens
caccatatgaatt

SEQ ID NO: 6692720 - DNA, 21 bp, Homo sapiens
caccatattaccacagacata

SEQ ID NO: 6692721 - DNA, 14 bp, Homo sapiens
caccatatttgaat

SEQ ID NO: 6692722 - DNA, 16 bp, Homo sapiens
caccatatttgaattg

SEQ ID NO: 6692723 - DNA, 15 bp, Homo sapiens
caccatcaagccacc

SEQ ID NO: 6692724 - DNA, 15 bp, Homo sapiens
caccatcacagcttg

SEQ ID NO: 6692725 - DNA, 16 bp, Homo sapiens
caccatcacagcttgt

SEQ ID NO: 6692726 - DNA, 15 bp, Homo sapiens
caccatcaccaccgc

SEQ ID NO: 6692727 - DNA, 12 bp, Homo sapiens
caccatcagcct

SEQ ID NO: 6692728 - DNA, 15 bp, Homo sapiens
caccatcagcctgtt

SEQ ID NO: 6692729 - DNA, 22 bp, Homo sapiens
caccatcatgtttcagtgaaga

SEQ ID NO: 6692730 - DNA, 16 bp, Homo sapiens
caccatcatttctagt

SEQ ID NO: 6692731 - DNA, 17 bp, Homo sapiens
caccatccaacagacct

SEQ ID NO: 6692732 - DNA, 16 bp, Homo sapiens
caccatccaccctgca

SEQ ID NO: 6692733 - DNA, 19 bp, Homo sapiens
caccatccagagaccaaat

SEQ ID NO: 6692734 - DNA, 20 bp, Homo sapiens
caccatccagagaccaaata

SEQ ID NO: 6692735 - DNA, 15 bp, Homo sapiens
caccatcctgagcca

SEQ ID NO: 6692736 - DNA, 20 bp, Homo sapiens
caccatcctgcagcctcctc

SEQ ID NO: 6692737 - DNA, 13 bp, Homo sapiens
caccatcctgctg

SEQ ID NO: 6692738 - DNA, 14 bp, Homo sapiens
caccatcgctggcc

SEQ ID NO: 6692739 - DNA, 19 bp, Homo sapiens
caccatctcaggccacctg

SEQ ID NO: 6692740 - DNA, 11 bp, Homo sapiens
caccatctctt

SEQ ID NO: 6692741 - DNA, 14 bp, Homo sapiens
caccatctgccaat

SEQ ID NO: 6692742 - DNA, 15 bp, Homo sapiens
caccatctgctgtct

SEQ ID NO: 6692743 - DNA, 12 bp, Homo sapiens
caccatctgctt

SEQ ID NO: 6692744 - DNA, 10 bp, Homo sapiens
caccatctgg

SEQ ID NO: 6692745 - DNA, 12 bp, Homo sapiens
caccatctggcc

SEQ ID NO: 6692746 - DNA, 13 bp, Homo sapiens
caccatctggccc

SEQ ID NO: 6692747 - DNA, 20 bp, Homo sapiens
caccatctggcccaggctgg

SEQ ID NO: 6692748 - DNA, 18 bp, Homo sapiens
caccatctgtaccctgct

SEQ ID NO: 6692749 - DNA, 21 bp, Homo sapiens
caccatctgtaccctgcttcc

SEQ ID NO: 6692750 - DNA, 14 bp, Homo sapiens
caccatctttgagg

SEQ ID NO: 6692751 - DNA, 22 bp, Homo sapiens
caccatgagggaagaataaaga

SEQ ID NO: 6692752 - DNA, 18 bp, Homo sapiens
caccatgcactgtaaata

SEQ ID NO: 6692753 - DNA, 20 bp, Homo sapiens
caccatgcactgtaaatatc

SEQ ID NO: 6692754 - DNA, 22 bp, Homo sapiens
caccatgcagtgcccctagctt

SEQ ID NO: 6692755 - DNA, 19 bp, Homo sapiens
caccatgctgctggggaag

SEQ ID NO: 6692756 - DNA, 22 bp, Homo sapiens
caccatgctgctggggaagaca

SEQ ID NO: 6692757 - DNA, 15 bp, Homo sapiens
caccatgctgggccg

SEQ ID NO: 6692758 - DNA, 14 bp, Homo sapiens
caccatggaccagc

SEQ ID NO: 6692759 - DNA, 13 bp, Homo sapiens
caccatggcaaac

SEQ ID NO: 6692760 - DNA, 16 bp, Homo sapiens
caccatggccagccaa

SEQ ID NO: 6692761 - DNA, 22 bp, Homo sapiens
caccatggctaaggcaccagcc

SEQ ID NO: 6692762 - DNA, 18 bp, Homo sapiens
caccatggggtcctacca

SEQ ID NO: 6692763 - DNA, 20 bp, Homo sapiens
caccatggtatcatatatta

SEQ ID NO: 6692764 - DNA, 23 bp, Homo sapiens
caccatggtatcatatattaaaa

SEQ ID NO: 6692765 - DNA, 19 bp, Homo sapiens
caccatggtcatcaccacc

SEQ ID NO: 6692766 - DNA, 21 bp, Homo sapiens
caccatggtgtgtcatgctca

SEQ ID NO: 6692767 - DNA, 16 bp, Homo sapiens
caccatgtaaaacaaa

SEQ ID NO: 6692768 - DNA, 19 bp, Homo sapiens
caccatgtaaaacaaaaaa

SEQ ID NO: 6692769 - DNA, 21 bp, Homo sapiens
caccatgtaaaacaaaaaaca

SEQ ID NO: 6692770 - DNA, 18 bp, Homo sapiens
caccatgtaacaaccaga

SEQ ID NO: 6692771 - DNA, 14 bp, Homo sapiens
caccatgtctggct

SEQ ID NO: 6692772 - DNA, 15 bp, Homo sapiens
caccatgtgccatct

SEQ ID NO: 6692773 - DNA, 22 bp, Homo sapiens
caccatgtgccatctgtacata

SEQ ID NO: 6692774 - DNA, 16 bp, Homo sapiens
caccatgttagcctta

SEQ ID NO: 6692775 - DNA, 17 bp, Homo sapiens
caccatgttagccttag

SEQ ID NO: 6692776 - DNA, 19 bp, Homo sapiens
caccatgttcccagctcag

SEQ ID NO: 6692777 - DNA, 20 bp, Homo sapiens
caccatgttgcccaggctgg

SEQ ID NO: 6692778 - DNA, 20 bp, Homo sapiens
caccatgttggccaggctgc

SEQ ID NO: 6692779 - DNA, 19 bp, Homo sapiens
caccatgttggtcaggctg

SEQ ID NO: 6692780 - DNA, 23 bp, Homo sapiens
caccatgttggtcaggctggtct

SEQ ID NO: 6692781 - DNA, 14 bp, Homo sapiens
caccattaaaaggg

SEQ ID NO: 6692782 - DNA, 18 bp, Homo sapiens
caccattaacaggtcttt

SEQ ID NO: 6692783 - DNA, 16 bp, Homo sapiens
caccattcacatttga

SEQ ID NO: 6692784 - DNA, 23 bp, Homo sapiens
caccattcacatttgatgtacat

SEQ ID NO: 6692785 - DNA, 13 bp, Homo sapiens
caccattcaggtc

SEQ ID NO: 6692786 - DNA, 14 bp, Homo sapiens
caccattccacatc

SEQ ID NO: 6692787 - DNA, 15 bp, Homo sapiens
caccattcctgcctt

SEQ ID NO: 6692788 - DNA, 14 bp, Homo sapiens
caccattcctggaa

SEQ ID NO: 6692789 - DNA, 14 bp, Homo sapiens
caccattctgactc

SEQ ID NO: 6692790 - DNA, 19 bp, Homo sapiens
caccattcttcttttttgt

SEQ ID NO: 6692791 - DNA, 16 bp, Homo sapiens
caccattgaaggctta

SEQ ID NO: 6692792 - DNA, 19 bp, Homo sapiens
caccattgcaacaaaatac

SEQ ID NO: 6692793 - DNA, 13 bp, Homo sapiens
caccattgctgct

SEQ ID NO: 6692794 - DNA, 17 bp, Homo sapiens
caccattgctgctcctt

SEQ ID NO: 6692795 - DNA, 14 bp, Homo sapiens
caccattgctggaa

SEQ ID NO: 6692796 - DNA, 15 bp, Homo sapiens
caccattgctggaaa

SEQ ID NO: 6692797 - DNA, 17 bp, Homo sapiens
caccatttatgtgtaga

SEQ ID NO: 6692798 - DNA, 17 bp, Homo sapiens
caccatttccccagggc

SEQ ID NO: 6692799 - DNA, 21 bp, Homo sapiens
caccatttcccctgtggtttg

SEQ ID NO: 6692800 - DNA, 23 bp, Homo sapiens
caccatttctgggggccgcagag

SEQ ID NO: 6692801 - DNA, 18 bp, Homo sapiens
caccatttctgtcactca

SEQ ID NO: 6692802 - DNA, 18 bp, Homo sapiens
caccatttcttggcattg

SEQ ID NO: 6692803 - DNA, 17 bp, Homo sapiens
caccatttggatcctgt

SEQ ID NO: 6692804 - DNA, 17 bp, Homo sapiens
caccatttggcaatgcc

SEQ ID NO: 6692805 - DNA, 19 bp, Homo sapiens
caccatttggcatccctgg

SEQ ID NO: 6692806 - DNA, 14 bp, Homo sapiens
caccattttgtaaa

SEQ ID NO: 6692807 - DNA, 14 bp, Homo sapiens
cacccaaaagcaca

SEQ ID NO: 6692808 - DNA, 23 bp, Homo sapiens
cacccaaaagtcaaaaggtgcct

SEQ ID NO: 6692809 - DNA, 15 bp, Homo sapiens
cacccaaacacttct

SEQ ID NO: 6692810 - DNA, 18 bp, Homo sapiens
cacccaaacacttctgct

SEQ ID NO: 6692811 - DNA, 15 bp, Homo sapiens
cacccaaaccccttc

SEQ ID NO: 6692812 - DNA, 17 bp, Homo sapiens
cacccaaaccccttccc

SEQ ID NO: 6692813 - DNA, 21 bp, Homo sapiens
cacccaaaccggcaggtgcga

SEQ ID NO: 6692814 - DNA, 23 bp, Homo sapiens
cacccaaagcctgtcccaggact

SEQ ID NO: 6692815 - DNA, 19 bp, Homo sapiens
cacccaaagctgagcctgc

SEQ ID NO: 6692816 - DNA, 19 bp, Homo sapiens
cacccaaatcacatctcac

SEQ ID NO: 6692817 - DNA, 20 bp, Homo sapiens
cacccaaatcacatctcacc

SEQ ID NO: 6692818 - DNA, 20 bp, Homo sapiens
cacccaaatgtgtacacctg

SEQ ID NO: 6692819 - DNA, 12 bp, Homo sapiens
cacccaacactt

SEQ ID NO: 6692820 - DNA, 21 bp, Homo sapiens
cacccaaccaactttcccccc

SEQ ID NO: 6692821 - DNA, 23 bp, Homo sapiens
cacccaaccctatctcctgacag

SEQ ID NO: 6692822 - DNA, 24 bp, Homo sapiens
cacccaaccctatctcctgacaga

SEQ ID NO: 6692823 - DNA, 13 bp, Homo sapiens
cacccaactactg

SEQ ID NO: 6692824 - DNA, 13 bp, Homo sapiens
cacccaagcctga

SEQ ID NO: 6692825 - DNA, 15 bp, Homo sapiens
cacccaagcctgctg

SEQ ID NO: 6692826 - DNA, 13 bp, Homo sapiens
cacccaaggagaa

SEQ ID NO: 6692827 - DNA, 14 bp, Homo sapiens
cacccaagggcctg

SEQ ID NO: 6692828 - DNA, 16 bp, Homo sapiens
cacccaagggcctggc

SEQ ID NO: 6692829 - DNA, 17 bp, Homo sapiens
cacccaagggcctggcc

SEQ ID NO: 6692830 - DNA, 21 bp, Homo sapiens
cacccaagggcctggcctgag

SEQ ID NO: 6692831 - DNA, 21 bp, Homo sapiens
cacccaagtatacaataaagt

SEQ ID NO: 6692832 - DNA, 13 bp, Homo sapiens
cacccaagtccac

SEQ ID NO: 6692833 - DNA, 15 bp, Homo sapiens
cacccaagtccaccc

SEQ ID NO: 6692834 - DNA, 23 bp, Homo sapiens
cacccaataaacattaagattga

SEQ ID NO: 6692835 - DNA, 18 bp, Homo sapiens
cacccaatgctgctccac

SEQ ID NO: 6692836 - DNA, 18 bp, Homo sapiens
cacccacaaactccaggc

SEQ ID NO: 6692837 - DNA, 20 bp, Homo sapiens
cacccacaaactccaggctg

SEQ ID NO: 6692838 - DNA, 15 bp, Homo sapiens
cacccacaaagaaac

SEQ ID NO: 6692839 - DNA, 19 bp, Homo sapiens
cacccacaatcccacctag

SEQ ID NO: 6692840 - DNA, 21 bp, Homo sapiens
cacccacaatcccacctagcc

SEQ ID NO: 6692841 - DNA, 17 bp, Homo sapiens
cacccacacactcgccc

SEQ ID NO: 6692842 - DNA, 18 bp, Homo sapiens
cacccacacagaggacct

SEQ ID NO: 6692843 - DNA, 13 bp, Homo sapiens
cacccacaccccg

SEQ ID NO: 6692844 - DNA, 16 bp, Homo sapiens
cacccacaccctacag

SEQ ID NO: 6692845 - DNA, 15 bp, Homo sapiens
cacccacagaaagag

SEQ ID NO: 6692846 - DNA, 14 bp, Homo sapiens
cacccacagaccgc

SEQ ID NO: 6692847 - DNA, 13 bp, Homo sapiens
cacccacagggct

SEQ ID NO: 6692848 - DNA, 21 bp, Homo sapiens
cacccacatgtgacacatatg

SEQ ID NO: 6692849 - DNA, 20 bp, Homo sapiens
cacccaccaaccctcagggc

SEQ ID NO: 6692850 - DNA, 14 bp, Homo sapiens
cacccaccaccccc

SEQ ID NO: 6692851 - DNA, 16 bp, Homo sapiens
cacccaccacccccat

SEQ ID NO: 6692852 - DNA, 19 bp, Homo sapiens
cacccaccaccgctcccgc

SEQ ID NO: 6692853 - DNA, 14 bp, Homo sapiens
cacccaccagctcc

SEQ ID NO: 6692854 - DNA, 21 bp, Homo sapiens
cacccaccagctccacacatt

SEQ ID NO: 6692855 - DNA, 14 bp, Homo sapiens
cacccaccaggcca

SEQ ID NO: 6692856 - DNA, 23 bp, Homo sapiens
cacccaccagggctcagctcctt

SEQ ID NO: 6692857 - DNA, 22 bp, Homo sapiens
cacccaccagttgaatttcatc

SEQ ID NO: 6692858 - DNA, 20 bp, Homo sapiens
cacccaccatcatgtctggc

SEQ ID NO: 6692859 - DNA, 17 bp, Homo sapiens
cacccaccatggaccag

SEQ ID NO: 6692860 - DNA, 17 bp, Homo sapiens
cacccaccccaagctgc

SEQ ID NO: 6692861 - DNA, 11 bp, Homo sapiens
cacccaccccc

SEQ ID NO: 6692862 - DNA, 13 bp, Homo sapiens
cacccacccccag

SEQ ID NO: 6692863 - DNA, 20 bp, Homo sapiens
cacccacccccaggcctcct

SEQ ID NO: 6692864 - DNA, 14 bp, Homo sapiens
cacccaccccctgc

SEQ ID NO: 6692865 - DNA, 22 bp, Homo sapiens
cacccaccccctgcctggttct

SEQ ID NO: 6692866 - DNA, 13 bp, Homo sapiens
cacccaccccctt

SEQ ID NO: 6692867 - DNA, 11 bp, Homo sapiens
cacccacccct

SEQ ID NO: 6692868 - DNA, 12 bp, Homo sapiens
cacccacccctc

SEQ ID NO: 6692869 - DNA, 13 bp, Homo sapiens
cacccacccctgc

SEQ ID NO: 6692870 - DNA, 14 bp, Homo sapiens
cacccaccctgtgc

SEQ ID NO: 6692871 - DNA, 21 bp, Homo sapiens
cacccaccgtctcggccctga

SEQ ID NO: 6692872 - DNA, 13 bp, Homo sapiens
cacccaccgtgga

SEQ ID NO: 6692873 - DNA, 16 bp, Homo sapiens
cacccacctcagcctc

SEQ ID NO: 6692874 - DNA, 18 bp, Homo sapiens
cacccacctcagcctccc

SEQ ID NO: 6692875 - DNA, 14 bp, Homo sapiens
cacccacctccacc

SEQ ID NO: 6692876 - DNA, 15 bp, Homo sapiens
cacccacctccaccc

SEQ ID NO: 6692877 - DNA, 17 bp, Homo sapiens
cacccacctccacccag

SEQ ID NO: 6692878 - DNA, 13 bp, Homo sapiens
cacccacctccct

SEQ ID NO: 6692879 - DNA, 15 bp, Homo sapiens
cacccacctcctgcg

SEQ ID NO: 6692880 - DNA, 12 bp, Homo sapiens
cacccacctgct

SEQ ID NO: 6692881 - DNA, 18 bp, Homo sapiens
cacccacctgctgctgta

SEQ ID NO: 6692882 - DNA, 23 bp, Homo sapiens
cacccacctggtactgacccagg

SEQ ID NO: 6692883 - DNA, 19 bp, Homo sapiens
cacccaccttccttgcgac

SEQ ID NO: 6692884 - DNA, 23 bp, Homo sapiens
cacccactaccatacagacagca

SEQ ID NO: 6692885 - DNA, 18 bp, Homo sapiens
cacccactcaccagggtc

SEQ ID NO: 6692886 - DNA, 13 bp, Homo sapiens
cacccactcagcc

SEQ ID NO: 6692887 - DNA, 13 bp, Homo sapiens
cacccactcagct

SEQ ID NO: 6692888 - DNA, 16 bp, Homo sapiens
cacccactccacacca

SEQ ID NO: 6692889 - DNA, 21 bp, Homo sapiens
cacccactctcctctgcctca

SEQ ID NO: 6692890 - DNA, 14 bp, Homo sapiens
cacccactgccccg

SEQ ID NO: 6692891 - DNA, 12 bp, Homo sapiens
cacccactggcc

SEQ ID NO: 6692892 - DNA, 16 bp, Homo sapiens
cacccactggccagtc

SEQ ID NO: 6692893 - DNA, 14 bp, Homo sapiens
cacccactgtgcac

SEQ ID NO: 6692894 - DNA, 14 bp, Homo sapiens
cacccactgtgggg

SEQ ID NO: 6692895 - DNA, 20 bp, Homo sapiens
cacccactgtggggcaagcc

SEQ ID NO: 6692896 - DNA, 22 bp, Homo sapiens
cacccactgtggggcaagcctg

SEQ ID NO: 6692897 - DNA, 14 bp, Homo sapiens
cacccacttctgca

SEQ ID NO: 6692898 - DNA, 11 bp, Homo sapiens
cacccagaaac

SEQ ID NO: 6692899 - DNA, 21 bp, Homo sapiens
cacccagaagaagatggctgt

SEQ ID NO: 6692900 - DNA, 13 bp, Homo sapiens
cacccagaaggaa

SEQ ID NO: 6692901 - DNA, 21 bp, Homo sapiens
cacccagaaggaacccggtcc

SEQ ID NO: 6692902 - DNA, 14 bp, Homo sapiens
cacccagaaggacc

SEQ ID NO: 6692903 - DNA, 20 bp, Homo sapiens
cacccagaatgtagcatctg

SEQ ID NO: 6692904 - DNA, 20 bp, Homo sapiens
cacccagacagcctgtttct

SEQ ID NO: 6692905 - DNA, 14 bp, Homo sapiens
cacccagacagctc

SEQ ID NO: 6692906 - DNA, 21 bp, Homo sapiens
cacccagacataaaggaaaag

SEQ ID NO: 6692907 - DNA, 22 bp, Homo sapiens
cacccagaccctccttccccac

SEQ ID NO: 6692908 - DNA, 19 bp, Homo sapiens
cacccagacctgcctgtct

SEQ ID NO: 6692909 - DNA, 13 bp, Homo sapiens
cacccagagaaaa

SEQ ID NO: 6692910 - DNA, 14 bp, Homo sapiens
cacccagagcacag

SEQ ID NO: 6692911 - DNA, 17 bp, Homo sapiens
cacccagagcaccccct

SEQ ID NO: 6692912 - DNA, 21 bp, Homo sapiens
cacccagagcaccccctgctc

SEQ ID NO: 6692913 - DNA, 16 bp, Homo sapiens
cacccagagcaccctc

SEQ ID NO: 6692914 - DNA, 20 bp, Homo sapiens
cacccagagctgcctatgcc

SEQ ID NO: 6692915 - DNA, 14 bp, Homo sapiens
cacccagagggagt

SEQ ID NO: 6692916 - DNA, 12 bp, Homo sapiens
cacccagagggt

SEQ ID NO: 6692917 - DNA, 22 bp, Homo sapiens
cacccagagggtagggcagcag

SEQ ID NO: 6692918 - DNA, 14 bp, Homo sapiens
cacccagaggtctc

SEQ ID NO: 6692919 - DNA, 22 bp, Homo sapiens
cacccagaggtctcatctccca

SEQ ID NO: 6692920 - DNA, 15 bp, Homo sapiens
cacccagaggtggcc

SEQ ID NO: 6692921 - DNA, 18 bp, Homo sapiens
cacccagcaactccaact

SEQ ID NO: 6692922 - DNA, 19 bp, Homo sapiens
cacccagcaaggcacaggc

SEQ ID NO: 6692923 - DNA, 13 bp, Homo sapiens
cacccagcaatag

SEQ ID NO: 6692924 - DNA, 23 bp, Homo sapiens
cacccagcagcgcccgaggccag

SEQ ID NO: 6692925 - DNA, 19 bp, Homo sapiens
cacccagccagctcctttc

SEQ ID NO: 6692926 - DNA, 21 bp, Homo sapiens
cacccagccagctcctttccc

SEQ ID NO: 6692927 - DNA, 23 bp, Homo sapiens
cacccagcccactaactgaggag

SEQ ID NO: 6692928 - DNA, 12 bp, Homo sapiens
cacccagcccag

SEQ ID NO: 6692929 - DNA, 22 bp, Homo sapiens
cacccagcccattctctctcct

SEQ ID NO: 6692930 - DNA, 23 bp, Homo sapiens
cacccagcccattctctctcctg

SEQ ID NO: 6692931 - DNA, 20 bp, Homo sapiens
cacccagccccaaggggtgg

SEQ ID NO: 6692932 - DNA, 15 bp, Homo sapiens
cacccagccccagcg

SEQ ID NO: 6692933 - DNA, 13 bp, Homo sapiens
cacccagcccctc

SEQ ID NO: 6692934 - DNA, 19 bp, Homo sapiens
cacccagcccctctcccct

SEQ ID NO: 6692935 - DNA, 14 bp, Homo sapiens
cacccagcccctgg

SEQ ID NO: 6692936 - DNA, 15 bp, Homo sapiens
cacccagcccctggc

SEQ ID NO: 6692937 - DNA, 12 bp, Homo sapiens
cacccagccctg

SEQ ID NO: 6692938 - DNA, 16 bp, Homo sapiens
cacccagccctggtct

SEQ ID NO: 6692939 - DNA, 19 bp, Homo sapiens
cacccagccctggtctcag

SEQ ID NO: 6692940 - DNA, 14 bp, Homo sapiens
cacccagcccttcc

SEQ ID NO: 6692941 - DNA, 16 bp, Homo sapiens
cacccagcccttcctt

SEQ ID NO: 6692942 - DNA, 15 bp, Homo sapiens
cacccagcctcagtc

SEQ ID NO: 6692943 - DNA, 19 bp, Homo sapiens
cacccagcctcagtcctcc

SEQ ID NO: 6692944 - DNA, 11 bp, Homo sapiens
cacccagcctg

SEQ ID NO: 6692945 - DNA, 15 bp, Homo sapiens
cacccagcggccccc

SEQ ID NO: 6692946 - DNA, 12 bp, Homo sapiens
cacccagctcca

SEQ ID NO: 6692947 - DNA, 16 bp, Homo sapiens
cacccagctccaggcc

SEQ ID NO: 6692948 - DNA, 22 bp, Homo sapiens
cacccagctggtcctgtggatg

SEQ ID NO: 6692949 - DNA, 22 bp, Homo sapiens
cacccaggaagggagggagctg

SEQ ID NO: 6692950 - DNA, 15 bp, Homo sapiens
cacccaggacctctg

SEQ ID NO: 6692951 - DNA, 24 bp, Homo sapiens
cacccaggagccccgaggccttct

SEQ ID NO: 6692952 - DNA, 21 bp, Homo sapiens
cacccaggaggggaacactgc

SEQ ID NO: 6692953 - DNA, 22 bp, Homo sapiens
cacccaggaggggaacactgcc

SEQ ID NO: 6692954 - DNA, 20 bp, Homo sapiens
cacccaggcaggccctgcct

SEQ ID NO: 6692955 - DNA, 21 bp, Homo sapiens
cacccaggcctccctgcagac

SEQ ID NO: 6692956 - DNA, 22 bp, Homo sapiens
cacccaggcctccctgcagact

SEQ ID NO: 6692957 - DNA, 23 bp, Homo sapiens
cacccaggcctccctgcagactc

SEQ ID NO: 6692958 - DNA, 11 bp, Homo sapiens
cacccaggctc

SEQ ID NO: 6692959 - DNA, 12 bp, Homo sapiens
cacccaggctcc

SEQ ID NO: 6692960 - DNA, 16 bp, Homo sapiens
cacccaggctccatgg

SEQ ID NO: 6692961 - DNA, 15 bp, Homo sapiens
cacccaggctgcact

SEQ ID NO: 6692962 - DNA, 16 bp, Homo sapiens
cacccaggctgcactg

SEQ ID NO: 6692963 - DNA, 19 bp, Homo sapiens
cacccaggctggagtgcag

SEQ ID NO: 6692964 - DNA, 23 bp, Homo sapiens
cacccaggctggagtgcggtggc

SEQ ID NO: 6692965 - DNA, 20 bp, Homo sapiens
cacccaggctggagtggagt

SEQ ID NO: 6692966 - DNA, 20 bp, Homo sapiens
cacccagggagctgatgccc

SEQ ID NO: 6692967 - DNA, 12 bp, Homo sapiens
cacccagggccc

SEQ ID NO: 6692968 - DNA, 15 bp, Homo sapiens
cacccagggctccct

SEQ ID NO: 6692969 - DNA, 16 bp, Homo sapiens
cacccagggctccctc

SEQ ID NO: 6692970 - DNA, 22 bp, Homo sapiens
cacccaggggacgcgctggaaa

SEQ ID NO: 6692971 - DNA, 13 bp, Homo sapiens
cacccaggggcag

SEQ ID NO: 6692972 - DNA, 16 bp, Homo sapiens
cacccaggggcagccc

SEQ ID NO: 6692973 - DNA, 15 bp, Homo sapiens
cacccagggtctagc

SEQ ID NO: 6692974 - DNA, 15 bp, Homo sapiens
cacccagtcacctcc

SEQ ID NO: 6692975 - DNA, 16 bp, Homo sapiens
cacccagtcacctccc

SEQ ID NO: 6692976 - DNA, 17 bp, Homo sapiens
cacccagtccccacccg

SEQ ID NO: 6692977 - DNA, 19 bp, Homo sapiens
cacccagtcctgcccgcca

SEQ ID NO: 6692978 - DNA, 13 bp, Homo sapiens
cacccagtcctgg

SEQ ID NO: 6692979 - DNA, 18 bp, Homo sapiens
cacccagtctgttgctgc

SEQ ID NO: 6692980 - DNA, 20 bp, Homo sapiens
cacccagtgagcactcccaa

SEQ ID NO: 6692981 - DNA, 16 bp, Homo sapiens
cacccagtgccctctc

SEQ ID NO: 6692982 - DNA, 21 bp, Homo sapiens
cacccagtgctgccatgccac

SEQ ID NO: 6692983 - DNA, 22 bp, Homo sapiens
cacccagtgctgccatgccact

SEQ ID NO: 6692984 - DNA, 18 bp, Homo sapiens
cacccagtgtccttccat

SEQ ID NO: 6692985 - DNA, 16 bp, Homo sapiens
cacccagttcttcatt

SEQ ID NO: 6692986 - DNA, 14 bp, Homo sapiens
cacccataaacagt

SEQ ID NO: 6692987 - DNA, 18 bp, Homo sapiens
cacccataataaaggttg

SEQ ID NO: 6692988 - DNA, 14 bp, Homo sapiens
cacccatatcatgc

SEQ ID NO: 6692989 - DNA, 13 bp, Homo sapiens
cacccatatctgt

SEQ ID NO: 6692990 - DNA, 16 bp, Homo sapiens
cacccatatctgtgtg

SEQ ID NO: 6692991 - DNA, 14 bp, Homo sapiens
cacccatcagcact

SEQ ID NO: 6692992 - DNA, 22 bp, Homo sapiens
cacccatcctaccaatgcatgc

SEQ ID NO: 6692993 - DNA, 18 bp, Homo sapiens
cacccatcctaggaacca

SEQ ID NO: 6692994 - DNA, 23 bp, Homo sapiens
cacccatcctatcagcctgtctc

SEQ ID NO: 6692995 - DNA, 11 bp, Homo sapiens
cacccatctcc

SEQ ID NO: 6692996 - DNA, 14 bp, Homo sapiens
cacccatcttcctg

SEQ ID NO: 6692997 - DNA, 18 bp, Homo sapiens
cacccatcttcctgctgc

SEQ ID NO: 6692998 - DNA, 14 bp, Homo sapiens
cacccatgaagaca

SEQ ID NO: 6692999 - DNA, 22 bp, Homo sapiens
cacccatgaagacaggacagtg

SEQ ID NO: 6693000 - DNA, 15 bp, Homo sapiens
cacccatgactgccc

SEQ ID NO: 6693001 - DNA, 20 bp, Homo sapiens
cacccatgactgccccttgc

SEQ ID NO: 6693002 - DNA, 18 bp, Homo sapiens
cacccatgatactccact

SEQ ID NO: 6693003 - DNA, 22 bp, Homo sapiens
cacccatgcaagcagaggacca

SEQ ID NO: 6693004 - DNA, 16 bp, Homo sapiens
cacccatgcatcttcc

SEQ ID NO: 6693005 - DNA, 19 bp, Homo sapiens
cacccatgcatcttccact

SEQ ID NO: 6693006 - DNA, 16 bp, Homo sapiens
cacccatgccagagag

SEQ ID NO: 6693007 - DNA, 16 bp, Homo sapiens
cacccatgccagcgca

SEQ ID NO: 6693008 - DNA, 21 bp, Homo sapiens
cacccatgccccactctgctg

SEQ ID NO: 6693009 - DNA, 22 bp, Homo sapiens
cacccatgcgccttcgtgcctg

SEQ ID NO: 6693010 - DNA, 16 bp, Homo sapiens
cacccatggcctcaga

SEQ ID NO: 6693011 - DNA, 13 bp, Homo sapiens
cacccatgggctc

SEQ ID NO: 6693012 - DNA, 20 bp, Homo sapiens
cacccatgggctctgacaga

SEQ ID NO: 6693013 - DNA, 18 bp, Homo sapiens
cacccatggggaggagac

SEQ ID NO: 6693014 - DNA, 21 bp, Homo sapiens
cacccatgtgggcgcccaccc

SEQ ID NO: 6693015 - DNA, 23 bp, Homo sapiens
cacccatgtgggcgcccaccctg

SEQ ID NO: 6693016 - DNA, 24 bp, Homo sapiens
cacccatgtgggcgcccaccctgg

SEQ ID NO: 6693017 - DNA, 17 bp, Homo sapiens
cacccatgtttctctgg

SEQ ID NO: 6693018 - DNA, 18 bp, Homo sapiens
cacccatgtttctctggc

SEQ ID NO: 6693019 - DNA, 23 bp, Homo sapiens
caccccaaacaaatggaagagaa

SEQ ID NO: 6693020 - DNA, 16 bp, Homo sapiens
caccccaaaccccagc

SEQ ID NO: 6693021 - DNA, 19 bp, Homo sapiens
caccccaaagctttcctgc

SEQ ID NO: 6693022 - DNA, 19 bp, Homo sapiens
caccccaaaggggcctctc

SEQ ID NO: 6693023 - DNA, 18 bp, Homo sapiens
caccccaacatgcctgca

SEQ ID NO: 6693024 - DNA, 15 bp, Homo sapiens
caccccaacctgctc

SEQ ID NO: 6693025 - DNA, 15 bp, Homo sapiens
caccccaactctccc

SEQ ID NO: 6693026 - DNA, 16 bp, Homo sapiens
caccccaactctcccc

SEQ ID NO: 6693027 - DNA, 17 bp, Homo sapiens
caccccaactctcccca

SEQ ID NO: 6693028 - DNA, 20 bp, Homo sapiens
caccccaactctccccagtg

SEQ ID NO: 6693029 - DNA, 22 bp, Homo sapiens
caccccaactctccccagtgcc

SEQ ID NO: 6693030 - DNA, 12 bp, Homo sapiens
caccccaagaga

SEQ ID NO: 6693031 - DNA, 15 bp, Homo sapiens
caccccaagctgctg

SEQ ID NO: 6693032 - DNA, 20 bp, Homo sapiens
caccccaagggacaacccca

SEQ ID NO: 6693033 - DNA, 21 bp, Homo sapiens
caccccaagtagtctgctcac

SEQ ID NO: 6693034 - DNA, 18 bp, Homo sapiens
caccccaatccctgccac

SEQ ID NO: 6693035 - DNA, 20 bp, Homo sapiens
caccccaatccctgccactg

SEQ ID NO: 6693036 - DNA, 21 bp, Homo sapiens
caccccaatccctgccactgg

SEQ ID NO: 6693037 - DNA, 23 bp, Homo sapiens
caccccaatccctgccactgggc

SEQ ID NO: 6693038 - DNA, 19 bp, Homo sapiens
caccccaatcctcccagaa

SEQ ID NO: 6693039 - DNA, 18 bp, Homo sapiens
caccccaattaactgaag

SEQ ID NO: 6693040 - DNA, 11 bp, Homo sapiens
caccccacact

SEQ ID NO: 6693041 - DNA, 17 bp, Homo sapiens
caccccacagactccgg

SEQ ID NO: 6693042 - DNA, 23 bp, Homo sapiens
caccccacagactccggcctgta

SEQ ID NO: 6693043 - DNA, 21 bp, Homo sapiens
caccccacattggacttcctt

SEQ ID NO: 6693044 - DNA, 13 bp, Homo sapiens
caccccaccaggg

SEQ ID NO: 6693045 - DNA, 12 bp, Homo sapiens
caccccacccac

SEQ ID NO: 6693046 - DNA, 13 bp, Homo sapiens
caccccaccccct

SEQ ID NO: 6693047 - DNA, 22 bp, Homo sapiens
caccccacccccttcagtgccc

SEQ ID NO: 6693048 - DNA, 18 bp, Homo sapiens
caccccaccctccctacc

SEQ ID NO: 6693049 - DNA, 20 bp, Homo sapiens
caccccaccctccctggagt

SEQ ID NO: 6693050 - DNA, 15 bp, Homo sapiens
caccccaccctgccc

SEQ ID NO: 6693051 - DNA, 17 bp, Homo sapiens
caccccaccctgcccct

SEQ ID NO: 6693052 - DNA, 11 bp, Homo sapiens
caccccacctg

SEQ ID NO: 6693053 - DNA, 14 bp, Homo sapiens
caccccacctgcag

SEQ ID NO: 6693054 - DNA, 15 bp, Homo sapiens
caccccacgcccgca

SEQ ID NO: 6693055 - DNA, 14 bp, Homo sapiens
caccccacgccctg

SEQ ID NO: 6693056 - DNA, 18 bp, Homo sapiens
caccccactccagccctg

SEQ ID NO: 6693057 - DNA, 15 bp, Homo sapiens
caccccactcccaca

SEQ ID NO: 6693058 - DNA, 15 bp, Homo sapiens
caccccactcctcag

SEQ ID NO: 6693059 - DNA, 12 bp, Homo sapiens
caccccactcta

SEQ ID NO: 6693060 - DNA, 16 bp, Homo sapiens
caccccactctacctc

SEQ ID NO: 6693061 - DNA, 15 bp, Homo sapiens
caccccactgagagc

SEQ ID NO: 6693062 - DNA, 22 bp, Homo sapiens
caccccactgagagctgctcct

SEQ ID NO: 6693063 - DNA, 14 bp, Homo sapiens
caccccactggatc

SEQ ID NO: 6693064 - DNA, 19 bp, Homo sapiens
caccccacttatccctctc

SEQ ID NO: 6693065 - DNA, 21 bp, Homo sapiens
caccccagaaatcactgtgaa

SEQ ID NO: 6693066 - DNA, 17 bp, Homo sapiens
caccccagacctgcgaa

SEQ ID NO: 6693067 - DNA, 19 bp, Homo sapiens
caccccagacctgcgaagg

SEQ ID NO: 6693068 - DNA, 16 bp, Homo sapiens
caccccagactccagg

SEQ ID NO: 6693069 - DNA, 20 bp, Homo sapiens
caccccagactccaggcccc

SEQ ID NO: 6693070 - DNA, 14 bp, Homo sapiens
caccccagagccac

SEQ ID NO: 6693071 - DNA, 13 bp, Homo sapiens
caccccagaggac

SEQ ID NO: 6693072 - DNA, 15 bp, Homo sapiens
caccccagcacagcc

SEQ ID NO: 6693073 - DNA, 15 bp, Homo sapiens
caccccagcacagct

SEQ ID NO: 6693074 - DNA, 19 bp, Homo sapiens
caccccagcacagctcctc

SEQ ID NO: 6693075 - DNA, 19 bp, Homo sapiens
caccccagcatcagcacag

SEQ ID NO: 6693076 - DNA, 13 bp, Homo sapiens
caccccagcattc

SEQ ID NO: 6693077 - DNA, 20 bp, Homo sapiens
caccccagcattccagctct

SEQ ID NO: 6693078 - DNA, 21 bp, Homo sapiens
caccccagcattccagctctg

SEQ ID NO: 6693079 - DNA, 22 bp, Homo sapiens
caccccagcattccagctctgc

SEQ ID NO: 6693080 - DNA, 23 bp, Homo sapiens
caccccagcattccagctctgcc

SEQ ID NO: 6693081 - DNA, 11 bp, Homo sapiens
caccccagccc

SEQ ID NO: 6693082 - DNA, 14 bp, Homo sapiens
caccccagcccacc

SEQ ID NO: 6693083 - DNA, 17 bp, Homo sapiens
caccccagccccactgc

SEQ ID NO: 6693084 - DNA, 22 bp, Homo sapiens
caccccagcccccacagccctg

SEQ ID NO: 6693085 - DNA, 11 bp, Homo sapiens
caccccagcct

SEQ ID NO: 6693086 - DNA, 19 bp, Homo sapiens
caccccagcctaagatgaa

SEQ ID NO: 6693087 - DNA, 14 bp, Homo sapiens
caccccagcctcat

SEQ ID NO: 6693088 - DNA, 15 bp, Homo sapiens
caccccagcctcgcc

SEQ ID NO: 6693089 - DNA, 21 bp, Homo sapiens
caccccagcctcgcctgtcac

SEQ ID NO: 6693090 - DNA, 19 bp, Homo sapiens
caccccagctaccccttct

SEQ ID NO: 6693091 - DNA, 18 bp, Homo sapiens
caccccagctgctcccct

SEQ ID NO: 6693092 - DNA, 19 bp, Homo sapiens
caccccaggaaaagcacaa

SEQ ID NO: 6693093 - DNA, 17 bp, Homo sapiens
caccccaggacgccact

SEQ ID NO: 6693094 - DNA, 20 bp, Homo sapiens
caccccaggcagctcctgtt

SEQ ID NO: 6693095 - DNA, 14 bp, Homo sapiens
caccccaggccctt

SEQ ID NO: 6693096 - DNA, 13 bp, Homo sapiens
caccccagggcag

SEQ ID NO: 6693097 - DNA, 16 bp, Homo sapiens
caccccagggcctgag

SEQ ID NO: 6693098 - DNA, 22 bp, Homo sapiens
caccccagggcctgagcctggc

SEQ ID NO: 6693099 - DNA, 20 bp, Homo sapiens
caccccagtgcacccactct

SEQ ID NO: 6693100 - DNA, 20 bp, Homo sapiens
caccccataagccctgagac

SEQ ID NO: 6693101 - DNA, 12 bp, Homo sapiens
caccccatccac

SEQ ID NO: 6693102 - DNA, 12 bp, Homo sapiens
caccccatccca

SEQ ID NO: 6693103 - DNA, 21 bp, Homo sapiens
caccccatcccacaccctgga

SEQ ID NO: 6693104 - DNA, 12 bp, Homo sapiens
caccccatccct

SEQ ID NO: 6693105 - DNA, 18 bp, Homo sapiens
caccccatctctcttccc

SEQ ID NO: 6693106 - DNA, 20 bp, Homo sapiens
caccccatgaggctcactca

SEQ ID NO: 6693107 - DNA, 17 bp, Homo sapiens
caccccatgccaaagct

SEQ ID NO: 6693108 - DNA, 15 bp, Homo sapiens
caccccatgctggcc

SEQ ID NO: 6693109 - DNA, 16 bp, Homo sapiens
caccccatgctgttga

SEQ ID NO: 6693110 - DNA, 22 bp, Homo sapiens
caccccatgctgttgattgcta

SEQ ID NO: 6693111 - DNA, 21 bp, Homo sapiens
caccccatgtgggtgaccagg

SEQ ID NO: 6693112 - DNA, 15 bp, Homo sapiens
caccccattcccgca

SEQ ID NO: 6693113 - DNA, 12 bp, Homo sapiens
caccccatttca

SEQ ID NO: 6693114 - DNA, 16 bp, Homo sapiens
cacccccaacccccag

SEQ ID NO: 6693115 - DNA, 20 bp, Homo sapiens
cacccccaacttcaccaccc

SEQ ID NO: 6693116 - DNA, 12 bp, Homo sapiens
cacccccaagaa

SEQ ID NO: 6693117 - DNA, 12 bp, Homo sapiens
cacccccaaggt

SEQ ID NO: 6693118 - DNA, 19 bp, Homo sapiens
cacccccacaagctgtccc

SEQ ID NO: 6693119 - DNA, 15 bp, Homo sapiens
cacccccaccaaggg

SEQ ID NO: 6693120 - DNA, 22 bp, Homo sapiens
cacccccaccactcttgactca

SEQ ID NO: 6693121 - DNA, 17 bp, Homo sapiens
cacccccaccatgcagc

SEQ ID NO: 6693122 - DNA, 13 bp, Homo sapiens
cacccccacccac

SEQ ID NO: 6693123 - DNA, 17 bp, Homo sapiens
cacccccacccacctcc

SEQ ID NO: 6693124 - DNA, 14 bp, Homo sapiens
cacccccaccccca

SEQ ID NO: 6693125 - DNA, 16 bp, Homo sapiens
cacccccacccctgta

SEQ ID NO: 6693126 - DNA, 14 bp, Homo sapiens
cacccccacccctt

SEQ ID NO: 6693127 - DNA, 21 bp, Homo sapiens
cacccccactttcgcctcctc

SEQ ID NO: 6693128 - DNA, 24 bp, Homo sapiens
cacccccactttcgcctcctccag

SEQ ID NO: 6693129 - DNA, 9 bp, Homo sapiens
cacccccag

SEQ ID NO: 6693130 - DNA, 17 bp, Homo sapiens
cacccccagccaggcta

SEQ ID NO: 6693131 - DNA, 13 bp, Homo sapiens
cacccccagcccc

SEQ ID NO: 6693132 - DNA, 23 bp, Homo sapiens
cacccccagccccgactccagcc

SEQ ID NO: 6693133 - DNA, 16 bp, Homo sapiens
cacccccagccctggc

SEQ ID NO: 6693134 - DNA, 15 bp, Homo sapiens
cacccccagcctccc

SEQ ID NO: 6693135 - DNA, 13 bp, Homo sapiens
cacccccagcctg

SEQ ID NO: 6693136 - DNA, 19 bp, Homo sapiens
cacccccagcctgggccta

SEQ ID NO: 6693137 - DNA, 20 bp, Homo sapiens
cacccccagccttgcccagc

SEQ ID NO: 6693138 - DNA, 21 bp, Homo sapiens
cacccccagccttgcccagct

SEQ ID NO: 6693139 - DNA, 12 bp, Homo sapiens
cacccccagctc

SEQ ID NO: 6693140 - DNA, 13 bp, Homo sapiens
cacccccagctca

SEQ ID NO: 6693141 - DNA, 14 bp, Homo sapiens
cacccccagctcaa

SEQ ID NO: 6693142 - DNA, 13 bp, Homo sapiens
cacccccagctgc

SEQ ID NO: 6693143 - DNA, 12 bp, Homo sapiens
cacccccagctt

SEQ ID NO: 6693144 - DNA, 12 bp, Homo sapiens
cacccccaggac

SEQ ID NO: 6693145 - DNA, 13 bp, Homo sapiens
cacccccaggacc

SEQ ID NO: 6693146 - DNA, 15 bp, Homo sapiens
cacccccaggcatct

SEQ ID NO: 6693147 - DNA, 14 bp, Homo sapiens
cacccccaggtgca

SEQ ID NO: 6693148 - DNA, 14 bp, Homo sapiens
cacccccagttcct

SEQ ID NO: 6693149 - DNA, 13 bp, Homo sapiens
cacccccatcatc

SEQ ID NO: 6693150 - DNA, 19 bp, Homo sapiens
cacccccatcttccacctg

SEQ ID NO: 6693151 - DNA, 22 bp, Homo sapiens
cacccccatgctgccttcaggg

SEQ ID NO: 6693152 - DNA, 15 bp, Homo sapiens
cacccccattgtgaa

SEQ ID NO: 6693153 - DNA, 15 bp, Homo sapiens
caccccccaagctgt

SEQ ID NO: 6693154 - DNA, 18 bp, Homo sapiens
caccccccacacacacta

SEQ ID NO: 6693155 - DNA, 21 bp, Homo sapiens
caccccccacgtctgtcctcc

SEQ ID NO: 6693156 - DNA, 12 bp, Homo sapiens
caccccccactc

SEQ ID NO: 6693157 - DNA, 15 bp, Homo sapiens
caccccccactcagt

SEQ ID NO: 6693158 - DNA, 13 bp, Homo sapiens
caccccccagaac

SEQ ID NO: 6693159 - DNA, 19 bp, Homo sapiens
caccccccagaacctgtcc

SEQ ID NO: 6693160 - DNA, 12 bp, Homo sapiens
caccccccaggc

SEQ ID NO: 6693161 - DNA, 16 bp, Homo sapiens
cacccccccaaccccc

SEQ ID NO: 6693162 - DNA, 14 bp, Homo sapiens
cacccccccaggcc

SEQ ID NO: 6693163 - DNA, 14 bp, Homo sapiens
caccccccgacctg

SEQ ID NO: 6693164 - DNA, 17 bp, Homo sapiens
caccccccgacctggct

SEQ ID NO: 6693165 - DNA, 18 bp, Homo sapiens
cacccccctcctccccct

SEQ ID NO: 6693166 - DNA, 21 bp, Homo sapiens
cacccccctctctttctctgg

SEQ ID NO: 6693167 - DNA, 17 bp, Homo sapiens
cacccccctctgctgcc

SEQ ID NO: 6693168 - DNA, 18 bp, Homo sapiens
cacccccctctgctgccg

SEQ ID NO: 6693169 - DNA, 16 bp, Homo sapiens
cacccccgacggcctc

SEQ ID NO: 6693170 - DNA, 22 bp, Homo sapiens
cacccccgacggcctccaggag

SEQ ID NO: 6693171 - DNA, 17 bp, Homo sapiens
cacccccgccacggcca

SEQ ID NO: 6693172 - DNA, 16 bp, Homo sapiens
cacccccgctggagga

SEQ ID NO: 6693173 - DNA, 19 bp, Homo sapiens
cacccccgctgggggtggg

SEQ ID NO: 6693174 - DNA, 14 bp, Homo sapiens
cacccccgggatcc

SEQ ID NO: 6693175 - DNA, 20 bp, Homo sapiens
cacccccgttagcttcctgc

SEQ ID NO: 6693176 - DNA, 16 bp, Homo sapiens
caccccctaccccaga

SEQ ID NO: 6693177 - DNA, 18 bp, Homo sapiens
caccccctcaagccccag

SEQ ID NO: 6693178 - DNA, 18 bp, Homo sapiens
caccccctcacccctcca

SEQ ID NO: 6693179 - DNA, 11 bp, Homo sapiens
caccccctcat

SEQ ID NO: 6693180 - DNA, 14 bp, Homo sapiens
caccccctcattcc

SEQ ID NO: 6693181 - DNA, 11 bp, Homo sapiens
caccccctccc

SEQ ID NO: 6693182 - DNA, 15 bp, Homo sapiens
caccccctcccaccc

SEQ ID NO: 6693183 - DNA, 16 bp, Homo sapiens
caccccctcccacccc

SEQ ID NO: 6693184 - DNA, 14 bp, Homo sapiens
caccccctccccag

SEQ ID NO: 6693185 - DNA, 15 bp, Homo sapiens
caccccctccccagg

SEQ ID NO: 6693186 - DNA, 16 bp, Homo sapiens
caccccctccccgccc

SEQ ID NO: 6693187 - DNA, 21 bp, Homo sapiens
caccccctccccgggcagcag

SEQ ID NO: 6693188 - DNA, 22 bp, Homo sapiens
caccccctccccgggcagcaga

SEQ ID NO: 6693189 - DNA, 16 bp, Homo sapiens
caccccctccctggcc

SEQ ID NO: 6693190 - DNA, 11 bp, Homo sapiens
caccccctcct

SEQ ID NO: 6693191 - DNA, 15 bp, Homo sapiens
caccccctcctgctg

SEQ ID NO: 6693192 - DNA, 16 bp, Homo sapiens
caccccctcctggcaa

SEQ ID NO: 6693193 - DNA, 14 bp, Homo sapiens
caccccctctggag

SEQ ID NO: 6693194 - DNA, 13 bp, Homo sapiens
caccccctgcagc

SEQ ID NO: 6693195 - DNA, 17 bp, Homo sapiens
caccccctgcagcttgt

SEQ ID NO: 6693196 - DNA, 19 bp, Homo sapiens
caccccctgcctggttcta

SEQ ID NO: 6693197 - DNA, 23 bp, Homo sapiens
caccccctgctggtgcccaccct

SEQ ID NO: 6693198 - DNA, 19 bp, Homo sapiens
caccccctggtgcctgcag

SEQ ID NO: 6693199 - DNA, 13 bp, Homo sapiens
caccccctgtccc

SEQ ID NO: 6693200 - DNA, 14 bp, Homo sapiens
caccccctgtccca

SEQ ID NO: 6693201 - DNA, 22 bp, Homo sapiens
caccccctgtcccattctagat

SEQ ID NO: 6693202 - DNA, 17 bp, Homo sapiens
cacccccttcagtgccc

SEQ ID NO: 6693203 - DNA, 14 bp, Homo sapiens
cacccccttccccc

SEQ ID NO: 6693204 - DNA, 18 bp, Homo sapiens
cacccccttctccatcca

SEQ ID NO: 6693205 - DNA, 13 bp, Homo sapiens
cacccccttctct

SEQ ID NO: 6693206 - DNA, 23 bp, Homo sapiens
cacccccttctctgcccattccc

SEQ ID NO: 6693207 - DNA, 17 bp, Homo sapiens
cacccccttctctgctc

SEQ ID NO: 6693208 - DNA, 12 bp, Homo sapiens
cacccccttggt

SEQ ID NO: 6693209 - DNA, 14 bp, Homo sapiens
caccccctttcctg

SEQ ID NO: 6693210 - DNA, 13 bp, Homo sapiens
caccccctttggt

SEQ ID NO: 6693211 - DNA, 15 bp, Homo sapiens
caccccgaggccctg

SEQ ID NO: 6693212 - DNA, 16 bp, Homo sapiens
caccccgaggccctgc

SEQ ID NO: 6693213 - DNA, 18 bp, Homo sapiens
caccccgaggccctgcat

SEQ ID NO: 6693214 - DNA, 19 bp, Homo sapiens
caccccgaggccctgcatg

SEQ ID NO: 6693215 - DNA, 18 bp, Homo sapiens
caccccgcccctgcatgc

SEQ ID NO: 6693216 - DNA, 19 bp, Homo sapiens
caccccgccgttccctgcg

SEQ ID NO: 6693217 - DNA, 18 bp, Homo sapiens
caccccgcctctgggctc

SEQ ID NO: 6693218 - DNA, 16 bp, Homo sapiens
caccccgcctgccctc

SEQ ID NO: 6693219 - DNA, 13 bp, Homo sapiens
caccccgctctgc

SEQ ID NO: 6693220 - DNA, 15 bp, Homo sapiens
caccccgctctgcat

SEQ ID NO: 6693221 - DNA, 17 bp, Homo sapiens
caccccgctcttcccaa

SEQ ID NO: 6693222 - DNA, 15 bp, Homo sapiens
caccccgctgatgga

SEQ ID NO: 6693223 - DNA, 23 bp, Homo sapiens
caccccgctgatggagccccacc

SEQ ID NO: 6693224 - DNA, 23 bp, Homo sapiens
caccccgctgcctggcgggcagc

SEQ ID NO: 6693225 - DNA, 22 bp, Homo sapiens
caccccgctgtaagctcctttg

SEQ ID NO: 6693226 - DNA, 23 bp, Homo sapiens
caccccgcttttgcagcagagga

SEQ ID NO: 6693227 - DNA, 13 bp, Homo sapiens
caccccggcaggc

SEQ ID NO: 6693228 - DNA, 18 bp, Homo sapiens
caccccggcaggccctgc

SEQ ID NO: 6693229 - DNA, 19 bp, Homo sapiens
caccccggcaggccctgca

SEQ ID NO: 6693230 - DNA, 22 bp, Homo sapiens
caccccggcaggccctgcagtg

SEQ ID NO: 6693231 - DNA, 15 bp, Homo sapiens
caccccggccacctg

SEQ ID NO: 6693232 - DNA, 18 bp, Homo sapiens
caccccggccccctgccc

SEQ ID NO: 6693233 - DNA, 14 bp, Homo sapiens
caccccggcctcag

SEQ ID NO: 6693234 - DNA, 16 bp, Homo sapiens
caccccggcctccact

SEQ ID NO: 6693235 - DNA, 19 bp, Homo sapiens
caccccggcctccactccc

SEQ ID NO: 6693236 - DNA, 21 bp, Homo sapiens
caccccgggctctcctgccct

SEQ ID NO: 6693237 - DNA, 18 bp, Homo sapiens
caccccgggctctctgct

SEQ ID NO: 6693238 - DNA, 18 bp, Homo sapiens
caccccggggaccctgtg

SEQ ID NO: 6693239 - DNA, 20 bp, Homo sapiens
caccccggggaccctgtgac

SEQ ID NO: 6693240 - DNA, 15 bp, Homo sapiens
caccccgtagattcc

SEQ ID NO: 6693241 - DNA, 18 bp, Homo sapiens
caccccgtccctcctctc

SEQ ID NO: 6693242 - DNA, 14 bp, Homo sapiens
caccccgtctgccc

SEQ ID NO: 6693243 - DNA, 16 bp, Homo sapiens
caccccgtctgcccct

SEQ ID NO: 6693244 - DNA, 20 bp, Homo sapiens
caccccgttacagctcccca

SEQ ID NO: 6693245 - DNA, 21 bp, Homo sapiens
caccccgttgttgtccctgca

SEQ ID NO: 6693246 - DNA, 16 bp, Homo sapiens
cacccctaagtgccca

SEQ ID NO: 6693247 - DNA, 17 bp, Homo sapiens
cacccctaagtgcccaa

SEQ ID NO: 6693248 - DNA, 20 bp, Homo sapiens
cacccctaagtgcccaaagt

SEQ ID NO: 6693249 - DNA, 16 bp, Homo sapiens
cacccctaatgagggt

SEQ ID NO: 6693250 - DNA, 22 bp, Homo sapiens
cacccctaatgagggtgtgaga

SEQ ID NO: 6693251 - DNA, 19 bp, Homo sapiens
cacccctacacacacactc

SEQ ID NO: 6693252 - DNA, 17 bp, Homo sapiens
cacccctacagcctgca

SEQ ID NO: 6693253 - DNA, 21 bp, Homo sapiens
cacccctacagcctgcacaca

SEQ ID NO: 6693254 - DNA, 16 bp, Homo sapiens
cacccctagccaccag

SEQ ID NO: 6693255 - DNA, 21 bp, Homo sapiens
cacccctagccaccagtgtcc

SEQ ID NO: 6693256 - DNA, 20 bp, Homo sapiens
cacccctcaacacctctgca

SEQ ID NO: 6693257 - DNA, 13 bp, Homo sapiens
cacccctcactcc

SEQ ID NO: 6693258 - DNA, 17 bp, Homo sapiens
cacccctcactccccag

SEQ ID NO: 6693259 - DNA, 21 bp, Homo sapiens
cacccctcagcgctccctgtc

SEQ ID NO: 6693260 - DNA, 18 bp, Homo sapiens
cacccctcagttgtgcag

SEQ ID NO: 6693261 - DNA, 13 bp, Homo sapiens
cacccctccaaag

SEQ ID NO: 6693262 - DNA, 17 bp, Homo sapiens
cacccctccacgtgtcc

SEQ ID NO: 6693263 - DNA, 22 bp, Homo sapiens
cacccctccagaacacggctca

SEQ ID NO: 6693264 - DNA, 18 bp, Homo sapiens
cacccctcccacctcttt

SEQ ID NO: 6693265 - DNA, 13 bp, Homo sapiens
cacccctccccag

SEQ ID NO: 6693266 - DNA, 22 bp, Homo sapiens
cacccctcccctgccctagagc

SEQ ID NO: 6693267 - DNA, 17 bp, Homo sapiens
cacccctcccctgggac

SEQ ID NO: 6693268 - DNA, 18 bp, Homo sapiens
cacccctccctccctctt

SEQ ID NO: 6693269 - DNA, 16 bp, Homo sapiens
cacccctccctctgct

SEQ ID NO: 6693270 - DNA, 18 bp, Homo sapiens
cacccctccctctgctct

SEQ ID NO: 6693271 - DNA, 18 bp, Homo sapiens
cacccctccgtgtggagc

SEQ ID NO: 6693272 - DNA, 19 bp, Homo sapiens
cacccctcctctagctctg

SEQ ID NO: 6693273 - DNA, 22 bp, Homo sapiens
cacccctcctctagctctggtg

SEQ ID NO: 6693274 - DNA, 13 bp, Homo sapiens
cacccctcctggg

SEQ ID NO: 6693275 - DNA, 15 bp, Homo sapiens
cacccctcctgggcc

SEQ ID NO: 6693276 - DNA, 17 bp, Homo sapiens
cacccctctcgcctcat

SEQ ID NO: 6693277 - DNA, 12 bp, Homo sapiens
cacccctctctg

SEQ ID NO: 6693278 - DNA, 15 bp, Homo sapiens
cacccctctgcccct

SEQ ID NO: 6693279 - DNA, 16 bp, Homo sapiens
cacccctctgcccctg

SEQ ID NO: 6693280 - DNA, 17 bp, Homo sapiens
cacccctctgcccctgc

SEQ ID NO: 6693281 - DNA, 18 bp, Homo sapiens
cacccctctgcccctgca

SEQ ID NO: 6693282 - DNA, 17 bp, Homo sapiens
cacccctctggcacctg

SEQ ID NO: 6693283 - DNA, 23 bp, Homo sapiens
cacccctctgtctaggactgcag

SEQ ID NO: 6693284 - DNA, 18 bp, Homo sapiens
cacccctcttcccccttc

SEQ ID NO: 6693285 - DNA, 21 bp, Homo sapiens
cacccctcttcccccttcccc

SEQ ID NO: 6693286 - DNA, 20 bp, Homo sapiens
cacccctgaggacacccagg

SEQ ID NO: 6693287 - DNA, 22 bp, Homo sapiens
cacccctgagttgggcagccag

SEQ ID NO: 6693288 - DNA, 11 bp, Homo sapiens
cacccctgcac

SEQ ID NO: 6693289 - DNA, 14 bp, Homo sapiens
cacccctgcacaca

SEQ ID NO: 6693290 - DNA, 13 bp, Homo sapiens
cacccctgcacag

SEQ ID NO: 6693291 - DNA, 13 bp, Homo sapiens
cacccctgcactt

SEQ ID NO: 6693292 - DNA, 13 bp, Homo sapiens
cacccctgccact

SEQ ID NO: 6693293 - DNA, 14 bp, Homo sapiens
cacccctgcccagg

SEQ ID NO: 6693294 - DNA, 14 bp, Homo sapiens
cacccctgccccca

SEQ ID NO: 6693295 - DNA, 21 bp, Homo sapiens
cacccctgcccccacttcctg

SEQ ID NO: 6693296 - DNA, 19 bp, Homo sapiens
cacccctgcccccagcccc

SEQ ID NO: 6693297 - DNA, 13 bp, Homo sapiens
cacccctgccccg

SEQ ID NO: 6693298 - DNA, 15 bp, Homo sapiens
cacccctgccctggg

SEQ ID NO: 6693299 - DNA, 19 bp, Homo sapiens
cacccctgccggccttggc

SEQ ID NO: 6693300 - DNA, 13 bp, Homo sapiens
cacccctgcctcc

SEQ ID NO: 6693301 - DNA, 16 bp, Homo sapiens
cacccctgcctccacc

SEQ ID NO: 6693302 - DNA, 18 bp, Homo sapiens
cacccctgcctccaccct

SEQ ID NO: 6693303 - DNA, 22 bp, Homo sapiens
cacccctgcctccaccctctga

SEQ ID NO: 6693304 - DNA, 23 bp, Homo sapiens
cacccctgcctccaccctctgag

SEQ ID NO: 6693305 - DNA, 14 bp, Homo sapiens
cacccctgcctcct

SEQ ID NO: 6693306 - DNA, 15 bp, Homo sapiens
cacccctgcctcctg

SEQ ID NO: 6693307 - DNA, 14 bp, Homo sapiens
cacccctgcctttg

SEQ ID NO: 6693308 - DNA, 24 bp, Homo sapiens
cacccctgctctacccatgagcct

SEQ ID NO: 6693309 - DNA, 17 bp, Homo sapiens
cacccctgctgccgcca

SEQ ID NO: 6693310 - DNA, 15 bp, Homo sapiens
cacccctggaaccag

SEQ ID NO: 6693311 - DNA, 15 bp, Homo sapiens
cacccctggctacct

SEQ ID NO: 6693312 - DNA, 14 bp, Homo sapiens
cacccctgggcagg

SEQ ID NO: 6693313 - DNA, 18 bp, Homo sapiens
cacccctgggcaggcggt

SEQ ID NO: 6693314 - DNA, 14 bp, Homo sapiens
cacccctgggggct

SEQ ID NO: 6693315 - DNA, 18 bp, Homo sapiens
cacccctgggggctctca

SEQ ID NO: 6693316 - DNA, 12 bp, Homo sapiens
cacccctggtgt

SEQ ID NO: 6693317 - DNA, 21 bp, Homo sapiens
cacccctggtgtccctgcctg

SEQ ID NO: 6693318 - DNA, 21 bp, Homo sapiens
cacccctgtaatcaggcaagg

SEQ ID NO: 6693319 - DNA, 22 bp, Homo sapiens
cacccctgtaatcaggcaagga

SEQ ID NO: 6693320 - DNA, 18 bp, Homo sapiens
cacccctgtacccagcca

SEQ ID NO: 6693321 - DNA, 21 bp, Homo sapiens
cacccctgtacccagccacct

SEQ ID NO: 6693322 - DNA, 17 bp, Homo sapiens
cacccctgtcccaccca

SEQ ID NO: 6693323 - DNA, 23 bp, Homo sapiens
cacccctgtgctccgtgcctcca

SEQ ID NO: 6693324 - DNA, 12 bp, Homo sapiens
caccccttagat

SEQ ID NO: 6693325 - DNA, 17 bp, Homo sapiens
caccccttaggccccgt

SEQ ID NO: 6693326 - DNA, 19 bp, Homo sapiens
caccccttaggccccgtgg

SEQ ID NO: 6693327 - DNA, 21 bp, Homo sapiens
caccccttaggccccgtggtg

SEQ ID NO: 6693328 - DNA, 16 bp, Homo sapiens
caccccttatccagga

SEQ ID NO: 6693329 - DNA, 18 bp, Homo sapiens
caccccttatccaggact

SEQ ID NO: 6693330 - DNA, 20 bp, Homo sapiens
caccccttatccaggactct

SEQ ID NO: 6693331 - DNA, 15 bp, Homo sapiens
caccccttccatgtg

SEQ ID NO: 6693332 - DNA, 13 bp, Homo sapiens
caccccttcccca

SEQ ID NO: 6693333 - DNA, 21 bp, Homo sapiens
caccccttccccatttcctct

SEQ ID NO: 6693334 - DNA, 20 bp, Homo sapiens
caccccttcctcagcctggg

SEQ ID NO: 6693335 - DNA, 22 bp, Homo sapiens
caccccttcctcagcctggggt

SEQ ID NO: 6693336 - DNA, 15 bp, Homo sapiens
caccccttcctgggc

SEQ ID NO: 6693337 - DNA, 13 bp, Homo sapiens
caccccttcctgt

SEQ ID NO: 6693338 - DNA, 20 bp, Homo sapiens
caccccttcctgtctcactc

SEQ ID NO: 6693339 - DNA, 12 bp, Homo sapiens
caccccttctct

SEQ ID NO: 6693340 - DNA, 16 bp, Homo sapiens
caccccttgctctctg

SEQ ID NO: 6693341 - DNA, 20 bp, Homo sapiens
caccccttgctctctgttct

SEQ ID NO: 6693342 - DNA, 12 bp, Homo sapiens
caccccttggcc

SEQ ID NO: 6693343 - DNA, 15 bp, Homo sapiens
caccccttggcccct

SEQ ID NO: 6693344 - DNA, 16 bp, Homo sapiens
cacccctttccccagc

SEQ ID NO: 6693345 - DNA, 15 bp, Homo sapiens
cacccctttcctccc

SEQ ID NO: 6693346 - DNA, 21 bp, Homo sapiens
cacccctttcctccccataca

SEQ ID NO: 6693347 - DNA, 15 bp, Homo sapiens
cacccctttctagtt

SEQ ID NO: 6693348 - DNA, 16 bp, Homo sapiens
cacccgaagtcctgtc

SEQ ID NO: 6693349 - DNA, 20 bp, Homo sapiens
cacccgaagtcctgtcactg

SEQ ID NO: 6693350 - DNA, 23 bp, Homo sapiens
cacccgaagtcctgtcactgagc

SEQ ID NO: 6693351 - DNA, 14 bp, Homo sapiens
cacccgacaccagc

SEQ ID NO: 6693352 - DNA, 22 bp, Homo sapiens
cacccgacaccagccctgctgc

SEQ ID NO: 6693353 - DNA, 16 bp, Homo sapiens
cacccgacctctgact

SEQ ID NO: 6693354 - DNA, 12 bp, Homo sapiens
cacccgacctgg

SEQ ID NO: 6693355 - DNA, 13 bp, Homo sapiens
cacccgacctggc

SEQ ID NO: 6693356 - DNA, 14 bp, Homo sapiens
cacccgacttcttt

SEQ ID NO: 6693357 - DNA, 16 bp, Homo sapiens
cacccgactttggaat

SEQ ID NO: 6693358 - DNA, 15 bp, Homo sapiens
cacccgaggctgccc

SEQ ID NO: 6693359 - DNA, 17 bp, Homo sapiens
cacccgagtacctccag

SEQ ID NO: 6693360 - DNA, 16 bp, Homo sapiens
cacccgatgctgcttt

SEQ ID NO: 6693361 - DNA, 19 bp, Homo sapiens
cacccgatgctgctttccc

SEQ ID NO: 6693362 - DNA, 18 bp, Homo sapiens
cacccgcatgtacaaaaa

SEQ ID NO: 6693363 - DNA, 11 bp, Homo sapiens
cacccgcccca

SEQ ID NO: 6693364 - DNA, 12 bp, Homo sapiens
cacccgccccag

SEQ ID NO: 6693365 - DNA, 13 bp, Homo sapiens
cacccgccccaga

SEQ ID NO: 6693366 - DNA, 17 bp, Homo sapiens
cacccgccccagagact

SEQ ID NO: 6693367 - DNA, 22 bp, Homo sapiens
cacccgccccagagactgccca

SEQ ID NO: 6693368 - DNA, 17 bp, Homo sapiens
cacccgccccgccccct

SEQ ID NO: 6693369 - DNA, 18 bp, Homo sapiens
cacccgccccgccccctc

SEQ ID NO: 6693370 - DNA, 22 bp, Homo sapiens
cacccgccccgcgcaccccacg

SEQ ID NO: 6693371 - DNA, 14 bp, Homo sapiens
cacccgccctttcc

SEQ ID NO: 6693372 - DNA, 15 bp, Homo sapiens
cacccgccctttcct

SEQ ID NO: 6693373 - DNA, 23 bp, Homo sapiens
cacccgccgccactaggtgtccc

SEQ ID NO: 6693374 - DNA, 21 bp, Homo sapiens
cacccgccgcctcccacggca

SEQ ID NO: 6693375 - DNA, 19 bp, Homo sapiens
cacccgcctcccgcctccc

SEQ ID NO: 6693376 - DNA, 17 bp, Homo sapiens
cacccgcctccctctca

SEQ ID NO: 6693377 - DNA, 13 bp, Homo sapiens
cacccgcctctcc

SEQ ID NO: 6693378 - DNA, 14 bp, Homo sapiens
cacccgcctgcaga

SEQ ID NO: 6693379 - DNA, 15 bp, Homo sapiens
cacccgcctgcagag

SEQ ID NO: 6693380 - DNA, 18 bp, Homo sapiens
cacccgccttcagcctcc

SEQ ID NO: 6693381 - DNA, 16 bp, Homo sapiens
cacccgccttggcctc

SEQ ID NO: 6693382 - DNA, 16 bp, Homo sapiens
cacccgccttgtgaga

SEQ ID NO: 6693383 - DNA, 17 bp, Homo sapiens
cacccgccttgtgagat

SEQ ID NO: 6693384 - DNA, 15 bp, Homo sapiens
cacccgctgcccagc

SEQ ID NO: 6693385 - DNA, 18 bp, Homo sapiens
cacccgctgcccagccct

SEQ ID NO: 6693386 - DNA, 19 bp, Homo sapiens
cacccgctgcccagccctc

SEQ ID NO: 6693387 - DNA, 15 bp, Homo sapiens
cacccgcttcctgtt

SEQ ID NO: 6693388 - DNA, 17 bp, Homo sapiens
cacccgcttcctgtttc

SEQ ID NO: 6693389 - DNA, 13 bp, Homo sapiens
cacccggacaggt

SEQ ID NO: 6693390 - DNA, 21 bp, Homo sapiens
cacccggacaggtggggcctc

SEQ ID NO: 6693391 - DNA, 22 bp, Homo sapiens
cacccggacaggtggggcctca

SEQ ID NO: 6693392 - DNA, 18 bp, Homo sapiens
cacccggatctccaggcc

SEQ ID NO: 6693393 - DNA, 20 bp, Homo sapiens
cacccggatctccaggccca

SEQ ID NO: 6693394 - DNA, 17 bp, Homo sapiens
cacccggccacagctgc

SEQ ID NO: 6693395 - DNA, 18 bp, Homo sapiens
cacccggccacagctgct

SEQ ID NO: 6693396 - DNA, 20 bp, Homo sapiens
cacccggcccatatccctgg

SEQ ID NO: 6693397 - DNA, 16 bp, Homo sapiens
cacccggcccctgctg

SEQ ID NO: 6693398 - DNA, 15 bp, Homo sapiens
cacccggcccggctg

SEQ ID NO: 6693399 - DNA, 12 bp, Homo sapiens
cacccggcctgg

SEQ ID NO: 6693400 - DNA, 23 bp, Homo sapiens
cacccggcctggatgccagctgt

SEQ ID NO: 6693401 - DNA, 17 bp, Homo sapiens
cacccggctggccggga

SEQ ID NO: 6693402 - DNA, 13 bp, Homo sapiens
cacccgggctcag

SEQ ID NO: 6693403 - DNA, 17 bp, Homo sapiens
cacccgggctgcctgcc

SEQ ID NO: 6693404 - DNA, 19 bp, Homo sapiens
cacccggggccagagacat

SEQ ID NO: 6693405 - DNA, 17 bp, Homo sapiens
cacccgggggagcccag

SEQ ID NO: 6693406 - DNA, 18 bp, Homo sapiens
cacccgggggagcccagt

SEQ ID NO: 6693407 - DNA, 20 bp, Homo sapiens
cacccgggggagcccagtga

SEQ ID NO: 6693408 - DNA, 23 bp, Homo sapiens
cacccggtccccactttattgcc

SEQ ID NO: 6693409 - DNA, 15 bp, Homo sapiens
cacccggtcccctct

SEQ ID NO: 6693410 - DNA, 20 bp, Homo sapiens
cacccggtggctctggtatg

SEQ ID NO: 6693411 - DNA, 17 bp, Homo sapiens
cacccgtaggcagcctc

SEQ ID NO: 6693412 - DNA, 18 bp, Homo sapiens
cacccgtaggcagcctct

SEQ ID NO: 6693413 - DNA, 15 bp, Homo sapiens
cacccgtccccacac

SEQ ID NO: 6693414 - DNA, 23 bp, Homo sapiens
cacccgtccccacacgagggccc

SEQ ID NO: 6693415 - DNA, 21 bp, Homo sapiens
cacccgtcttcaatctctgtt

SEQ ID NO: 6693416 - DNA, 21 bp, Homo sapiens
cacccgtcttggggctcgccc

SEQ ID NO: 6693417 - DNA, 17 bp, Homo sapiens
cacccgtgagcgcctgt

SEQ ID NO: 6693418 - DNA, 19 bp, Homo sapiens
cacccgtggggtgctgccc

SEQ ID NO: 6693419 - DNA, 20 bp, Homo sapiens
cacccgtggggtgctgccct

SEQ ID NO: 6693420 - DNA, 21 bp, Homo sapiens
cacccgtgtggtaccttcagc

SEQ ID NO: 6693421 - DNA, 18 bp, Homo sapiens
cacccgtgttctcctcca

SEQ ID NO: 6693422 - DNA, 16 bp, Homo sapiens
cacccgtgtttgtaaa

SEQ ID NO: 6693423 - DNA, 21 bp, Homo sapiens
cacccgttcccactgccctgg

SEQ ID NO: 6693424 - DNA, 19 bp, Homo sapiens
cacccgttctgctggcctg

SEQ ID NO: 6693425 - DNA, 16 bp, Homo sapiens
cacccgtttccaagcc

SEQ ID NO: 6693426 - DNA, 23 bp, Homo sapiens
cacccgtttccaagcctgggcca

SEQ ID NO: 6693427 - DNA, 18 bp, Homo sapiens
caccctaactcttgctca

SEQ ID NO: 6693428 - DNA, 17 bp, Homo sapiens
caccctaagggcagccc

SEQ ID NO: 6693429 - DNA, 18 bp, Homo sapiens
caccctaagggcagccct

SEQ ID NO: 6693430 - DNA, 12 bp, Homo sapiens
caccctaatttg

SEQ ID NO: 6693431 - DNA, 19 bp, Homo sapiens
caccctaatttgcccttca

SEQ ID NO: 6693432 - DNA, 20 bp, Homo sapiens
caccctaatttgcccttcag

SEQ ID NO: 6693433 - DNA, 14 bp, Homo sapiens
caccctaccagctc

SEQ ID NO: 6693434 - DNA, 16 bp, Homo sapiens
caccctaccagctcct

SEQ ID NO: 6693435 - DNA, 14 bp, Homo sapiens
caccctaccccctt

SEQ ID NO: 6693436 - DNA, 14 bp, Homo sapiens
caccctacctgttc

SEQ ID NO: 6693437 - DNA, 18 bp, Homo sapiens
caccctaccttccccaga

SEQ ID NO: 6693438 - DNA, 19 bp, Homo sapiens
caccctaccttccccagac

SEQ ID NO: 6693439 - DNA, 23 bp, Homo sapiens
caccctaccttccccagacttgc

SEQ ID NO: 6693440 - DNA, 21 bp, Homo sapiens
caccctacgctcatctctgga

SEQ ID NO: 6693441 - DNA, 17 bp, Homo sapiens
caccctagcctccacca

SEQ ID NO: 6693442 - DNA, 16 bp, Homo sapiens
caccctaggttctaca

SEQ ID NO: 6693443 - DNA, 20 bp, Homo sapiens
caccctagtcccttcccctc

SEQ ID NO: 6693444 - DNA, 17 bp, Homo sapiens
caccctagtttccctga

SEQ ID NO: 6693445 - DNA, 14 bp, Homo sapiens
caccctatatataa

SEQ ID NO: 6693446 - DNA, 14 bp, Homo sapiens
caccctatggccac

SEQ ID NO: 6693447 - DNA, 14 bp, Homo sapiens
caccctattcccta

SEQ ID NO: 6693448 - DNA, 13 bp, Homo sapiens
caccctattttca

SEQ ID NO: 6693449 - DNA, 18 bp, Homo sapiens
caccctcaaatgtcagag

SEQ ID NO: 6693450 - DNA, 14 bp, Homo sapiens
caccctcacacaca

SEQ ID NO: 6693451 - DNA, 18 bp, Homo sapiens
caccctcacacacacagc

SEQ ID NO: 6693452 - DNA, 15 bp, Homo sapiens
caccctcaccaggat

SEQ ID NO: 6693453 - DNA, 19 bp, Homo sapiens
caccctcaccgcggctgga

SEQ ID NO: 6693454 - DNA, 20 bp, Homo sapiens
caccctcagatgcacatgag

SEQ ID NO: 6693455 - DNA, 21 bp, Homo sapiens
caccctcagcaccccttccat

SEQ ID NO: 6693456 - DNA, 15 bp, Homo sapiens
caccctcagcccgct

SEQ ID NO: 6693457 - DNA, 13 bp, Homo sapiens
caccctcagggag

SEQ ID NO: 6693458 - DNA, 14 bp, Homo sapiens
caccctcaggtgcc

SEQ ID NO: 6693459 - DNA, 17 bp, Homo sapiens
caccctcaggtgcctcc

SEQ ID NO: 6693460 - DNA, 18 bp, Homo sapiens
caccctcaggtgcctcca

SEQ ID NO: 6693461 - DNA, 15 bp, Homo sapiens
caccctcatccttta

SEQ ID NO: 6693462 - DNA, 14 bp, Homo sapiens
caccctcatgaaaa

SEQ ID NO: 6693463 - DNA, 13 bp, Homo sapiens
caccctcatgctg

SEQ ID NO: 6693464 - DNA, 18 bp, Homo sapiens
caccctccacaggagccg

SEQ ID NO: 6693465 - DNA, 12 bp, Homo sapiens
caccctccaccc

SEQ ID NO: 6693466 - DNA, 16 bp, Homo sapiens
caccctccaccctgtc

SEQ ID NO: 6693467 - DNA, 17 bp, Homo sapiens
caccctccacctcttca

SEQ ID NO: 6693468 - DNA, 14 bp, Homo sapiens
caccctccactctg

SEQ ID NO: 6693469 - DNA, 16 bp, Homo sapiens
caccctccactctgag

SEQ ID NO: 6693470 - DNA, 22 bp, Homo sapiens
caccctccactctgaggtctca

SEQ ID NO: 6693471 - DNA, 14 bp, Homo sapiens
caccctccacttcc

SEQ ID NO: 6693472 - DNA, 15 bp, Homo sapiens
caccctccacttccc

SEQ ID NO: 6693473 - DNA, 19 bp, Homo sapiens
caccctccattctgcactc

SEQ ID NO: 6693474 - DNA, 14 bp, Homo sapiens
caccctcccaccat

SEQ ID NO: 6693475 - DNA, 17 bp, Homo sapiens
caccctccccattagta

SEQ ID NO: 6693476 - DNA, 12 bp, Homo sapiens
caccctcccctc

SEQ ID NO: 6693477 - DNA, 13 bp, Homo sapiens
caccctcccctcc

SEQ ID NO: 6693478 - DNA, 13 bp, Homo sapiens
caccctcccctct

SEQ ID NO: 6693479 - DNA, 14 bp, Homo sapiens
caccctcccggaat

SEQ ID NO: 6693480 - DNA, 16 bp, Homo sapiens
caccctccctccaggg

SEQ ID NO: 6693481 - DNA, 19 bp, Homo sapiens
caccctccctgactggcct

SEQ ID NO: 6693482 - DNA, 13 bp, Homo sapiens
caccctccctgga

SEQ ID NO: 6693483 - DNA, 14 bp, Homo sapiens
caccctccctggag

SEQ ID NO: 6693484 - DNA, 16 bp, Homo sapiens
caccctcctagcctgc

SEQ ID NO: 6693485 - DNA, 15 bp, Homo sapiens
caccctcctcacaga

SEQ ID NO: 6693486 - DNA, 20 bp, Homo sapiens
caccctcctccctccaagcc

SEQ ID NO: 6693487 - DNA, 21 bp, Homo sapiens
caccctcctccctccaagcct

SEQ ID NO: 6693488 - DNA, 12 bp, Homo sapiens
caccctcctcta

SEQ ID NO: 6693489 - DNA, 14 bp, Homo sapiens
caccctcctgaacc

SEQ ID NO: 6693490 - DNA, 13 bp, Homo sapiens
caccctcctgagc

SEQ ID NO: 6693491 - DNA, 18 bp, Homo sapiens
caccctcctgagcctcac

SEQ ID NO: 6693492 - DNA, 18 bp, Homo sapiens
caccctcctgccccacac

SEQ ID NO: 6693493 - DNA, 22 bp, Homo sapiens
caccctcctgcccccccacccc

SEQ ID NO: 6693494 - DNA, 14 bp, Homo sapiens
caccctcctgcgca

SEQ ID NO: 6693495 - DNA, 11 bp, Homo sapiens
caccctcctgg

SEQ ID NO: 6693496 - DNA, 12 bp, Homo sapiens
caccctcctggc

SEQ ID NO: 6693497 - DNA, 18 bp, Homo sapiens
caccctcctggcctcaga

SEQ ID NO: 6693498 - DNA, 16 bp, Homo sapiens
caccctcctgtaccgt

SEQ ID NO: 6693499 - DNA, 16 bp, Homo sapiens
caccctcctgtcttcc

SEQ ID NO: 6693500 - DNA, 22 bp, Homo sapiens
caccctcctgtcttcccagggt

SEQ ID NO: 6693501 - DNA, 12 bp, Homo sapiens
caccctccttcc

SEQ ID NO: 6693502 - DNA, 20 bp, Homo sapiens
caccctccttcccactcttc

SEQ ID NO: 6693503 - DNA, 12 bp, Homo sapiens
caccctcctttc

SEQ ID NO: 6693504 - DNA, 21 bp, Homo sapiens
caccctcctttctcaccagcc

SEQ ID NO: 6693505 - DNA, 20 bp, Homo sapiens
caccctcgtggacacctgcc

SEQ ID NO: 6693506 - DNA, 23 bp, Homo sapiens
caccctcgtggacacctgccctg

SEQ ID NO: 6693507 - DNA, 16 bp, Homo sapiens
caccctctaaatggga

SEQ ID NO: 6693508 - DNA, 15 bp, Homo sapiens
caccctctccacacc

SEQ ID NO: 6693509 - DNA, 19 bp, Homo sapiens
caccctctccacacccagc

SEQ ID NO: 6693510 - DNA, 20 bp, Homo sapiens
caccctctccacacccagcc

SEQ ID NO: 6693511 - DNA, 22 bp, Homo sapiens
caccctctccatgcccaaccta

SEQ ID NO: 6693512 - DNA, 18 bp, Homo sapiens
caccctctctgtccaatc

SEQ ID NO: 6693513 - DNA, 22 bp, Homo sapiens
caccctctgagctttgcatgtt

SEQ ID NO: 6693514 - DNA, 17 bp, Homo sapiens
caccctctgcagggcag

SEQ ID NO: 6693515 - DNA, 19 bp, Homo sapiens
caccctctgcagggcagcc

SEQ ID NO: 6693516 - DNA, 20 bp, Homo sapiens
caccctctgcagggcagcct

SEQ ID NO: 6693517 - DNA, 16 bp, Homo sapiens
caccctctgcccaggg

SEQ ID NO: 6693518 - DNA, 21 bp, Homo sapiens
caccctctgctatgtctgtga

SEQ ID NO: 6693519 - DNA, 13 bp, Homo sapiens
caccctctgctgc

SEQ ID NO: 6693520 - DNA, 18 bp, Homo sapiens
caccctctgctgcacagt

SEQ ID NO: 6693521 - DNA, 12 bp, Homo sapiens
caccctctggcc

SEQ ID NO: 6693522 - DNA, 17 bp, Homo sapiens
caccctctgggcagctg

SEQ ID NO: 6693523 - DNA, 12 bp, Homo sapiens
caccctctgggg

SEQ ID NO: 6693524 - DNA, 11 bp, Homo sapiens
caccctcttcc

SEQ ID NO: 6693525 - DNA, 12 bp, Homo sapiens
caccctcttcct

SEQ ID NO: 6693526 - DNA, 15 bp, Homo sapiens
caccctcttcctact

SEQ ID NO: 6693527 - DNA, 17 bp, Homo sapiens
caccctcttcctactgg

SEQ ID NO: 6693528 - DNA, 17 bp, Homo sapiens
caccctgacccccttcc

SEQ ID NO: 6693529 - DNA, 14 bp, Homo sapiens
caccctgagccggc

SEQ ID NO: 6693530 - DNA, 19 bp, Homo sapiens
caccctgaggcctctggaa

SEQ ID NO: 6693531 - DNA, 12 bp, Homo sapiens
caccctgagggc

SEQ ID NO: 6693532 - DNA, 22 bp, Homo sapiens
caccctgatttaggagaagcca

SEQ ID NO: 6693533 - DNA, 13 bp, Homo sapiens
caccctgcaaggc

SEQ ID NO: 6693534 - DNA, 21 bp, Homo sapiens
caccctgcaaggcccacagga

SEQ ID NO: 6693535 - DNA, 15 bp, Homo sapiens
caccctgcacctgct

SEQ ID NO: 6693536 - DNA, 16 bp, Homo sapiens
caccctgcacctgctg

SEQ ID NO: 6693537 - DNA, 15 bp, Homo sapiens
caccctgcactttcc

SEQ ID NO: 6693538 - DNA, 15 bp, Homo sapiens
caccctgcagagcac

SEQ ID NO: 6693539 - DNA, 20 bp, Homo sapiens
caccctgcagagcacacagg

SEQ ID NO: 6693540 - DNA, 15 bp, Homo sapiens
caccctgcaggactt

SEQ ID NO: 6693541 - DNA, 14 bp, Homo sapiens
caccctgcaggcag

SEQ ID NO: 6693542 - DNA, 17 bp, Homo sapiens
caccctgcaggcaggca

SEQ ID NO: 6693543 - DNA, 22 bp, Homo sapiens
caccctgcaggcaggcagacca

SEQ ID NO: 6693544 - DNA, 16 bp, Homo sapiens
caccctgcattttcct

SEQ ID NO: 6693545 - DNA, 15 bp, Homo sapiens
caccctgccaaggca

SEQ ID NO: 6693546 - DNA, 15 bp, Homo sapiens
caccctgcccactcc

SEQ ID NO: 6693547 - DNA, 12 bp, Homo sapiens
caccctgccccc

SEQ ID NO: 6693548 - DNA, 13 bp, Homo sapiens
caccctgcccctt

SEQ ID NO: 6693549 - DNA, 15 bp, Homo sapiens
caccctgcccgctcc

SEQ ID NO: 6693550 - DNA, 17 bp, Homo sapiens
caccctgcccgctccca

SEQ ID NO: 6693551 - DNA, 15 bp, Homo sapiens
caccctgccctgctg

SEQ ID NO: 6693552 - DNA, 18 bp, Homo sapiens
caccctgcctctacccaa

SEQ ID NO: 6693553 - DNA, 21 bp, Homo sapiens
caccctgcctctacccaacca

SEQ ID NO: 6693554 - DNA, 16 bp, Homo sapiens
caccctgcctgcacct

SEQ ID NO: 6693555 - DNA, 14 bp, Homo sapiens
caccctgcctgctg

SEQ ID NO: 6693556 - DNA, 17 bp, Homo sapiens
caccctgcctgctgtgg

SEQ ID NO: 6693557 - DNA, 12 bp, Homo sapiens
caccctgcctgt

SEQ ID NO: 6693558 - DNA, 13 bp, Homo sapiens
caccctgcctgtg

SEQ ID NO: 6693559 - DNA, 14 bp, Homo sapiens
caccctgcgcctcc

SEQ ID NO: 6693560 - DNA, 18 bp, Homo sapiens
caccctgcgcctccagag

SEQ ID NO: 6693561 - DNA, 18 bp, Homo sapiens
caccctgctgcactagga

SEQ ID NO: 6693562 - DNA, 15 bp, Homo sapiens
caccctgcttctccc

SEQ ID NO: 6693563 - DNA, 18 bp, Homo sapiens
caccctgcttctcccggg

SEQ ID NO: 6693564 - DNA, 19 bp, Homo sapiens
caccctgcttctgctgcct

SEQ ID NO: 6693565 - DNA, 21 bp, Homo sapiens
caccctgcttggggcctggcg

SEQ ID NO: 6693566 - DNA, 22 bp, Homo sapiens
caccctggaatacgatcctgca

SEQ ID NO: 6693567 - DNA, 21 bp, Homo sapiens
caccctggattgatcggagcc

SEQ ID NO: 6693568 - DNA, 23 bp, Homo sapiens
caccctggcctagaccagcagac

SEQ ID NO: 6693569 - DNA, 14 bp, Homo sapiens
caccctggcctggt

SEQ ID NO: 6693570 - DNA, 12 bp, Homo sapiens
caccctggctgg

SEQ ID NO: 6693571 - DNA, 12 bp, Homo sapiens
caccctgggagc

SEQ ID NO: 6693572 - DNA, 15 bp, Homo sapiens
caccctgggagccag

SEQ ID NO: 6693573 - DNA, 13 bp, Homo sapiens
caccctgggcctc

SEQ ID NO: 6693574 - DNA, 16 bp, Homo sapiens
caccctgggcctcccg

SEQ ID NO: 6693575 - DNA, 18 bp, Homo sapiens
caccctgggcctcccgtc

SEQ ID NO: 6693576 - DNA, 16 bp, Homo sapiens
caccctgggctccaca

SEQ ID NO: 6693577 - DNA, 15 bp, Homo sapiens
caccctgggctctgt

SEQ ID NO: 6693578 - DNA, 15 bp, Homo sapiens
caccctggggagaaa

SEQ ID NO: 6693579 - DNA, 16 bp, Homo sapiens
caccctggggagaaag

SEQ ID NO: 6693580 - DNA, 17 bp, Homo sapiens
caccctggggagaaagt

SEQ ID NO: 6693581 - DNA, 15 bp, Homo sapiens
caccctggggcctgg

SEQ ID NO: 6693582 - DNA, 21 bp, Homo sapiens
caccctggggcctggacctgc

SEQ ID NO: 6693583 - DNA, 22 bp, Homo sapiens
caccctggggcctggacctgcc

SEQ ID NO: 6693584 - DNA, 13 bp, Homo sapiens
caccctggggctg

SEQ ID NO: 6693585 - DNA, 12 bp, Homo sapiens
caccctgggtgc

SEQ ID NO: 6693586 - DNA, 22 bp, Homo sapiens
caccctgggtttggcccctgga

SEQ ID NO: 6693587 - DNA, 22 bp, Homo sapiens
caccctggtcctgacttccctg

SEQ ID NO: 6693588 - DNA, 15 bp, Homo sapiens
caccctggtctgtgg

SEQ ID NO: 6693589 - DNA, 17 bp, Homo sapiens
caccctggtctgtggag

SEQ ID NO: 6693590 - DNA, 16 bp, Homo sapiens
caccctggtgggccaa

SEQ ID NO: 6693591 - DNA, 21 bp, Homo sapiens
caccctgtactgttctgtgtc

SEQ ID NO: 6693592 - DNA, 11 bp, Homo sapiens
caccctgtaga

SEQ ID NO: 6693593 - DNA, 14 bp, Homo sapiens
caccctgtagatgt

SEQ ID NO: 6693594 - DNA, 20 bp, Homo sapiens
caccctgtagatgttctagg

SEQ ID NO: 6693595 - DNA, 17 bp, Homo sapiens
caccctgtatggagcta

SEQ ID NO: 6693596 - DNA, 22 bp, Homo sapiens
caccctgtcaagttaacaagga

SEQ ID NO: 6693597 - DNA, 16 bp, Homo sapiens
caccctgtcccaggca

SEQ ID NO: 6693598 - DNA, 22 bp, Homo sapiens
caccctgtcccaggcagcgcca

SEQ ID NO: 6693599 - DNA, 18 bp, Homo sapiens
caccctgtcccccagctc

SEQ ID NO: 6693600 - DNA, 18 bp, Homo sapiens
caccctgtcctatgactt

SEQ ID NO: 6693601 - DNA, 21 bp, Homo sapiens
caccctgtcctgcacaccctg

SEQ ID NO: 6693602 - DNA, 20 bp, Homo sapiens
caccctgtctcagtacctcc

SEQ ID NO: 6693603 - DNA, 14 bp, Homo sapiens
caccctgtctgcag

SEQ ID NO: 6693604 - DNA, 15 bp, Homo sapiens
caccctgtcttcctc

SEQ ID NO: 6693605 - DNA, 22 bp, Homo sapiens
caccctgtgaccctctcacttt

SEQ ID NO: 6693606 - DNA, 11 bp, Homo sapiens
caccctgtgat

SEQ ID NO: 6693607 - DNA, 18 bp, Homo sapiens
caccctgtgatggggccc

SEQ ID NO: 6693608 - DNA, 22 bp, Homo sapiens
caccctgtgatggggccctgcc

SEQ ID NO: 6693609 - DNA, 13 bp, Homo sapiens
caccctgtgccat

SEQ ID NO: 6693610 - DNA, 15 bp, Homo sapiens
caccctgtgccatca

SEQ ID NO: 6693611 - DNA, 15 bp, Homo sapiens
caccctgtggccctg

SEQ ID NO: 6693612 - DNA, 15 bp, Homo sapiens
caccctgtgggaccg

SEQ ID NO: 6693613 - DNA, 21 bp, Homo sapiens
caccctgtgggaccgcctggc

SEQ ID NO: 6693614 - DNA, 14 bp, Homo sapiens
caccctgtgggtgt

SEQ ID NO: 6693615 - DNA, 21 bp, Homo sapiens
caccctgtgggtgtctccctc

SEQ ID NO: 6693616 - DNA, 22 bp, Homo sapiens
caccctgtgggtgtctccctcg

SEQ ID NO: 6693617 - DNA, 15 bp, Homo sapiens
caccctgttccctct

SEQ ID NO: 6693618 - DNA, 19 bp, Homo sapiens
caccctgttccctctttct

SEQ ID NO: 6693619 - DNA, 16 bp, Homo sapiens
caccctgttcctgctg

SEQ ID NO: 6693620 - DNA, 17 bp, Homo sapiens
caccctgttcctgctgc

SEQ ID NO: 6693621 - DNA, 20 bp, Homo sapiens
caccctgtttggatttttaa

SEQ ID NO: 6693622 - DNA, 21 bp, Homo sapiens
caccctgtttggatttttaat

SEQ ID NO: 6693623 - DNA, 14 bp, Homo sapiens
cacccttagaaaat

SEQ ID NO: 6693624 - DNA, 19 bp, Homo sapiens
cacccttagaaaatgtgtc

SEQ ID NO: 6693625 - DNA, 18 bp, Homo sapiens
cacccttcacgctggctt

SEQ ID NO: 6693626 - DNA, 15 bp, Homo sapiens
cacccttcagcaatg

SEQ ID NO: 6693627 - DNA, 15 bp, Homo sapiens
cacccttccacagct

SEQ ID NO: 6693628 - DNA, 21 bp, Homo sapiens
cacccttccagggcctgagca

SEQ ID NO: 6693629 - DNA, 15 bp, Homo sapiens
cacccttccatcagc

SEQ ID NO: 6693630 - DNA, 12 bp, Homo sapiens
cacccttcccca

SEQ ID NO: 6693631 - DNA, 15 bp, Homo sapiens
cacccttccccactc

SEQ ID NO: 6693632 - DNA, 13 bp, Homo sapiens
cacccttcccctc

SEQ ID NO: 6693633 - DNA, 11 bp, Homo sapiens
cacccttcccg

SEQ ID NO: 6693634 - DNA, 22 bp, Homo sapiens
cacccttccctcttccctctcc

SEQ ID NO: 6693635 - DNA, 12 bp, Homo sapiens
cacccttccctg

SEQ ID NO: 6693636 - DNA, 13 bp, Homo sapiens
cacccttccctgc

SEQ ID NO: 6693637 - DNA, 14 bp, Homo sapiens
cacccttccctgcc

SEQ ID NO: 6693638 - DNA, 15 bp, Homo sapiens
cacccttccctgcct

SEQ ID NO: 6693639 - DNA, 18 bp, Homo sapiens
cacccttccctgcctcca

SEQ ID NO: 6693640 - DNA, 20 bp, Homo sapiens
cacccttccctgctcccacc

SEQ ID NO: 6693641 - DNA, 22 bp, Homo sapiens
cacccttcctggcccaggcctt

SEQ ID NO: 6693642 - DNA, 12 bp, Homo sapiens
cacccttctggg

SEQ ID NO: 6693643 - DNA, 20 bp, Homo sapiens
cacccttctttcctcttccc

SEQ ID NO: 6693644 - DNA, 14 bp, Homo sapiens
cacccttcttttct

SEQ ID NO: 6693645 - DNA, 16 bp, Homo sapiens
cacccttcttttctca

SEQ ID NO: 6693646 - DNA, 19 bp, Homo sapiens
cacccttcttttctcatgt

SEQ ID NO: 6693647 - DNA, 21 bp, Homo sapiens
cacccttcttttctcatgtgt

SEQ ID NO: 6693648 - DNA, 21 bp, Homo sapiens
cacccttgcccacttctcctt

SEQ ID NO: 6693649 - DNA, 15 bp, Homo sapiens
cacccttggagctct

SEQ ID NO: 6693650 - DNA, 16 bp, Homo sapiens
cacccttggagctctg

SEQ ID NO: 6693651 - DNA, 17 bp, Homo sapiens
cacccttggcctgtcca

SEQ ID NO: 6693652 - DNA, 19 bp, Homo sapiens
caccctttcatagagaggc

SEQ ID NO: 6693653 - DNA, 14 bp, Homo sapiens
caccctttccagga

SEQ ID NO: 6693654 - DNA, 19 bp, Homo sapiens
caccctttccggcacactg

SEQ ID NO: 6693655 - DNA, 21 bp, Homo sapiens
caccctttccggcacactgcc

SEQ ID NO: 6693656 - DNA, 22 bp, Homo sapiens
caccctttctacttccaagact

SEQ ID NO: 6693657 - DNA, 17 bp, Homo sapiens
caccctttctggcacga

SEQ ID NO: 6693658 - DNA, 16 bp, Homo sapiens
caccctttgccttagc

SEQ ID NO: 6693659 - DNA, 15 bp, Homo sapiens
caccgaaaacgtggc

SEQ ID NO: 6693660 - DNA, 18 bp, Homo sapiens
caccgaaaacgtggctgc

SEQ ID NO: 6693661 - DNA, 22 bp, Homo sapiens
caccgaaaacgtggctgcttca

SEQ ID NO: 6693662 - DNA, 15 bp, Homo sapiens
caccgaagagccctg

SEQ ID NO: 6693663 - DNA, 18 bp, Homo sapiens
caccgaagagccctgagc

SEQ ID NO: 6693664 - DNA, 14 bp, Homo sapiens
caccgaagcccaga

SEQ ID NO: 6693665 - DNA, 21 bp, Homo sapiens
caccgaagtggactggcccct

SEQ ID NO: 6693666 - DNA, 19 bp, Homo sapiens
caccgaattgcttttatca

SEQ ID NO: 6693667 - DNA, 14 bp, Homo sapiens
caccgacagcggcc

SEQ ID NO: 6693668 - DNA, 14 bp, Homo sapiens
caccgaccaactcc

SEQ ID NO: 6693669 - DNA, 14 bp, Homo sapiens
caccgaccaactgc

SEQ ID NO: 6693670 - DNA, 15 bp, Homo sapiens
caccgaccaactgcc

SEQ ID NO: 6693671 - DNA, 18 bp, Homo sapiens
caccgaccccgggccgga

SEQ ID NO: 6693672 - DNA, 17 bp, Homo sapiens
caccgacgcgtctcctg

SEQ ID NO: 6693673 - DNA, 19 bp, Homo sapiens
caccgacgcgtctcctgtt

SEQ ID NO: 6693674 - DNA, 15 bp, Homo sapiens
caccgactgaaaata

SEQ ID NO: 6693675 - DNA, 14 bp, Homo sapiens
caccgactgcccag

SEQ ID NO: 6693676 - DNA, 13 bp, Homo sapiens
caccgagactcag

SEQ ID NO: 6693677 - DNA, 18 bp, Homo sapiens
caccgagactcagcctct

SEQ ID NO: 6693678 - DNA, 20 bp, Homo sapiens
caccgagactcagcctctgc

SEQ ID NO: 6693679 - DNA, 16 bp, Homo sapiens
caccgagccagcttgg

SEQ ID NO: 6693680 - DNA, 23 bp, Homo sapiens
caccgagctctgtgggaaaaaag

SEQ ID NO: 6693681 - DNA, 14 bp, Homo sapiens
caccgagctggagc

SEQ ID NO: 6693682 - DNA, 22 bp, Homo sapiens
caccgaggagccccagccccgt

SEQ ID NO: 6693683 - DNA, 13 bp, Homo sapiens
caccgaggggcct

SEQ ID NO: 6693684 - DNA, 16 bp, Homo sapiens
caccgaggggcctttg

SEQ ID NO: 6693685 - DNA, 15 bp, Homo sapiens
caccgaggttcccag

SEQ ID NO: 6693686 - DNA, 16 bp, Homo sapiens
caccgaggttcccagg

SEQ ID NO: 6693687 - DNA, 19 bp, Homo sapiens
caccgaggttcccagggct

SEQ ID NO: 6693688 - DNA, 12 bp, Homo sapiens
caccgagtgggg

SEQ ID NO: 6693689 - DNA, 16 bp, Homo sapiens
caccgatgcacacgca

SEQ ID NO: 6693690 - DNA, 13 bp, Homo sapiens
caccgattcttcc

SEQ ID NO: 6693691 - DNA, 15 bp, Homo sapiens
caccgattcttcctt

SEQ ID NO: 6693692 - DNA, 20 bp, Homo sapiens
caccgattcttccttgccac

SEQ ID NO: 6693693 - DNA, 14 bp, Homo sapiens
caccgcaccgggct

SEQ ID NO: 6693694 - DNA, 15 bp, Homo sapiens
caccgcagacaggac

SEQ ID NO: 6693695 - DNA, 17 bp, Homo sapiens
caccgcagacaggacca

SEQ ID NO: 6693696 - DNA, 13 bp, Homo sapiens
caccgcagcctct

SEQ ID NO: 6693697 - DNA, 15 bp, Homo sapiens
caccgcagcctgtca

SEQ ID NO: 6693698 - DNA, 20 bp, Homo sapiens
caccgcagcgtcccccgccg

SEQ ID NO: 6693699 - DNA, 18 bp, Homo sapiens
caccgcagctgctgccac

SEQ ID NO: 6693700 - DNA, 21 bp, Homo sapiens
caccgcaggggactgtctcag

SEQ ID NO: 6693701 - DNA, 22 bp, Homo sapiens
caccgcaggtgctcatgctgct

SEQ ID NO: 6693702 - DNA, 14 bp, Homo sapiens
caccgcatatgcat

SEQ ID NO: 6693703 - DNA, 17 bp, Homo sapiens
caccgcatcctcactgg

SEQ ID NO: 6693704 - DNA, 22 bp, Homo sapiens
caccgcatcctcactgggctca

SEQ ID NO: 6693705 - DNA, 23 bp, Homo sapiens
caccgcatcctcactgggctcac

SEQ ID NO: 6693706 - DNA, 18 bp, Homo sapiens
caccgcatgccccctcgt

SEQ ID NO: 6693707 - DNA, 19 bp, Homo sapiens
caccgcatgccccctcgtg

SEQ ID NO: 6693708 - DNA, 14 bp, Homo sapiens
caccgcattccagg

SEQ ID NO: 6693709 - DNA, 16 bp, Homo sapiens
caccgcattccagggg

SEQ ID NO: 6693710 - DNA, 21 bp, Homo sapiens
caccgccacaataaagatcgc

SEQ ID NO: 6693711 - DNA, 13 bp, Homo sapiens
caccgccacccca

SEQ ID NO: 6693712 - DNA, 16 bp, Homo sapiens
caccgccacgtcccag

SEQ ID NO: 6693713 - DNA, 13 bp, Homo sapiens
caccgccagccgc

SEQ ID NO: 6693714 - DNA, 19 bp, Homo sapiens
caccgccatcctctgcctc

SEQ ID NO: 6693715 - DNA, 16 bp, Homo sapiens
caccgccatgcatgat

SEQ ID NO: 6693716 - DNA, 16 bp, Homo sapiens
caccgccatggcttcc

SEQ ID NO: 6693717 - DNA, 23 bp, Homo sapiens
caccgccatggcttccaaggtgg

SEQ ID NO: 6693718 - DNA, 22 bp, Homo sapiens
caccgcccaacccccacctccc

SEQ ID NO: 6693719 - DNA, 14 bp, Homo sapiens
caccgcccacccac

SEQ ID NO: 6693720 - DNA, 16 bp, Homo sapiens
caccgcccactctcca

SEQ ID NO: 6693721 - DNA, 13 bp, Homo sapiens
caccgcccagctc

SEQ ID NO: 6693722 - DNA, 14 bp, Homo sapiens
caccgcccagctca

SEQ ID NO: 6693723 - DNA, 14 bp, Homo sapiens
caccgcccatcagg

SEQ ID NO: 6693724 - DNA, 16 bp, Homo sapiens
caccgcccctggacag

SEQ ID NO: 6693725 - DNA, 14 bp, Homo sapiens
caccgccctcctcc

SEQ ID NO: 6693726 - DNA, 15 bp, Homo sapiens
caccgccctcctcca

SEQ ID NO: 6693727 - DNA, 19 bp, Homo sapiens
caccgccctcctcgctgtg

SEQ ID NO: 6693728 - DNA, 22 bp, Homo sapiens
caccgccgactttgtacccccc

SEQ ID NO: 6693729 - DNA, 22 bp, Homo sapiens
caccgccgcagaagcagcccct

SEQ ID NO: 6693730 - DNA, 18 bp, Homo sapiens
caccgccgccaccagccc

SEQ ID NO: 6693731 - DNA, 18 bp, Homo sapiens
caccgccggccagctggg

SEQ ID NO: 6693732 - DNA, 19 bp, Homo sapiens
caccgccggggtcctggga

SEQ ID NO: 6693733 - DNA, 14 bp, Homo sapiens
caccgccgtggagt

SEQ ID NO: 6693734 - DNA, 22 bp, Homo sapiens
caccgcctccccacctccaggc

SEQ ID NO: 6693735 - DNA, 17 bp, Homo sapiens
caccgcctcctacagcc

SEQ ID NO: 6693736 - DNA, 17 bp, Homo sapiens
caccgcctctggccgcc

SEQ ID NO: 6693737 - DNA, 20 bp, Homo sapiens
caccgcctctggccgccacc

SEQ ID NO: 6693738 - DNA, 16 bp, Homo sapiens
caccgcctcttcccgc

SEQ ID NO: 6693739 - DNA, 17 bp, Homo sapiens
caccgcctcttcccgcc

SEQ ID NO: 6693740 - DNA, 19 bp, Homo sapiens
caccgcctgaaggcacagc

SEQ ID NO: 6693741 - DNA, 12 bp, Homo sapiens
caccgcctgccc

SEQ ID NO: 6693742 - DNA, 22 bp, Homo sapiens
caccgcctgctacacaggcagg

SEQ ID NO: 6693743 - DNA, 18 bp, Homo sapiens
caccgccttgcccagcct

SEQ ID NO: 6693744 - DNA, 23 bp, Homo sapiens
caccgccttgcccagcctggatg

SEQ ID NO: 6693745 - DNA, 18 bp, Homo sapiens
caccgcgcccctctgcgc

SEQ ID NO: 6693746 - DNA, 20 bp, Homo sapiens
caccgcgccctcctgcccac

SEQ ID NO: 6693747 - DNA, 17 bp, Homo sapiens
caccgcggccaggcacc

SEQ ID NO: 6693748 - DNA, 21 bp, Homo sapiens
caccgcggcgcttcccagcac

SEQ ID NO: 6693749 - DNA, 15 bp, Homo sapiens
caccgcgtcccagct

SEQ ID NO: 6693750 - DNA, 16 bp, Homo sapiens
caccgcgtcccagctc

SEQ ID NO: 6693751 - DNA, 12 bp, Homo sapiens
caccgctcagta

SEQ ID NO: 6693752 - DNA, 15 bp, Homo sapiens
caccgctcagtgtca

SEQ ID NO: 6693753 - DNA, 16 bp, Homo sapiens
caccgctccccagccc

SEQ ID NO: 6693754 - DNA, 21 bp, Homo sapiens
caccgctccccagcccagggt

SEQ ID NO: 6693755 - DNA, 15 bp, Homo sapiens
caccgctgagaggct

SEQ ID NO: 6693756 - DNA, 13 bp, Homo sapiens
caccgctgcctcg

SEQ ID NO: 6693757 - DNA, 14 bp, Homo sapiens
caccgctgcctcgt

SEQ ID NO: 6693758 - DNA, 12 bp, Homo sapiens
caccgctggccc

SEQ ID NO: 6693759 - DNA, 13 bp, Homo sapiens
caccgctgggtgg

SEQ ID NO: 6693760 - DNA, 21 bp, Homo sapiens
caccgctgggttctgactctg

SEQ ID NO: 6693761 - DNA, 19 bp, Homo sapiens
caccggaccagcctggccc

SEQ ID NO: 6693762 - DNA, 19 bp, Homo sapiens
caccggaggtcactccacc

SEQ ID NO: 6693763 - DNA, 22 bp, Homo sapiens
caccggagtatgtgcagtgtgg

SEQ ID NO: 6693764 - DNA, 21 bp, Homo sapiens
caccggatcctgggtggtctg

SEQ ID NO: 6693765 - DNA, 20 bp, Homo sapiens
caccggatgctgtgcctggc

SEQ ID NO: 6693766 - DNA, 15 bp, Homo sapiens
caccggcactcatga

SEQ ID NO: 6693767 - DNA, 14 bp, Homo sapiens
caccggcactgtgc

SEQ ID NO: 6693768 - DNA, 16 bp, Homo sapiens
caccggcactgtgcac

SEQ ID NO: 6693769 - DNA, 18 bp, Homo sapiens
caccggcatgctggcctg

SEQ ID NO: 6693770 - DNA, 19 bp, Homo sapiens
caccggcatgctggcctgt

SEQ ID NO: 6693771 - DNA, 22 bp, Homo sapiens
caccggccaggccgcgcccagc

SEQ ID NO: 6693772 - DNA, 23 bp, Homo sapiens
caccggccaggccgcgcccagca

SEQ ID NO: 6693773 - DNA, 14 bp, Homo sapiens
caccggcccctggc

SEQ ID NO: 6693774 - DNA, 22 bp, Homo sapiens
caccggcctggctgcagctggg

SEQ ID NO: 6693775 - DNA, 18 bp, Homo sapiens
caccggcctgtgggtctc

SEQ ID NO: 6693776 - DNA, 16 bp, Homo sapiens
caccggctctcacctg

SEQ ID NO: 6693777 - DNA, 15 bp, Homo sapiens
caccggctggcctgg

SEQ ID NO: 6693778 - DNA, 16 bp, Homo sapiens
caccggctggcctggc

SEQ ID NO: 6693779 - DNA, 19 bp, Homo sapiens
caccgggaccccctcacca

SEQ ID NO: 6693780 - DNA, 14 bp, Homo sapiens
caccgggcactcag

SEQ ID NO: 6693781 - DNA, 12 bp, Homo sapiens
caccgggccact

SEQ ID NO: 6693782 - DNA, 23 bp, Homo sapiens
caccgggcgcatgcctcccaggc

SEQ ID NO: 6693783 - DNA, 18 bp, Homo sapiens
caccgggctgcaggtgct

SEQ ID NO: 6693784 - DNA, 19 bp, Homo sapiens
caccggggcactggctgct

SEQ ID NO: 6693785 - DNA, 21 bp, Homo sapiens
caccggggcctgggcaggagg

SEQ ID NO: 6693786 - DNA, 14 bp, Homo sapiens
caccggtcagtgcc

SEQ ID NO: 6693787 - DNA, 21 bp, Homo sapiens
caccggtgccaaacccagccc

SEQ ID NO: 6693788 - DNA, 14 bp, Homo sapiens
caccggtgggcagt

SEQ ID NO: 6693789 - DNA, 16 bp, Homo sapiens
caccggtgggcagtgg

SEQ ID NO: 6693790 - DNA, 18 bp, Homo sapiens
caccggttgcttctggga

SEQ ID NO: 6693791 - DNA, 20 bp, Homo sapiens
caccgtaaagtgagcatgct

SEQ ID NO: 6693792 - DNA, 17 bp, Homo sapiens
caccgtacaaccccctc

SEQ ID NO: 6693793 - DNA, 23 bp, Homo sapiens
caccgtagtaacacataaagtaa

SEQ ID NO: 6693794 - DNA, 18 bp, Homo sapiens
caccgtcaggtactcctg

SEQ ID NO: 6693795 - DNA, 15 bp, Homo sapiens
caccgtcatggctta

SEQ ID NO: 6693796 - DNA, 16 bp, Homo sapiens
caccgtccaggcccca

SEQ ID NO: 6693797 - DNA, 15 bp, Homo sapiens
caccgtcccgcacag

SEQ ID NO: 6693798 - DNA, 14 bp, Homo sapiens
caccgtccctcagt

SEQ ID NO: 6693799 - DNA, 16 bp, Homo sapiens
caccgtccgccctgct

SEQ ID NO: 6693800 - DNA, 19 bp, Homo sapiens
caccgtccgccctgctcct

SEQ ID NO: 6693801 - DNA, 14 bp, Homo sapiens
caccgtcctcagca

SEQ ID NO: 6693802 - DNA, 14 bp, Homo sapiens
caccgtcgaccagg

SEQ ID NO: 6693803 - DNA, 15 bp, Homo sapiens
caccgtcgaccagga

SEQ ID NO: 6693804 - DNA, 18 bp, Homo sapiens
caccgtcgaccaggaaag

SEQ ID NO: 6693805 - DNA, 18 bp, Homo sapiens
caccgtctacagatggct

SEQ ID NO: 6693806 - DNA, 22 bp, Homo sapiens
caccgtctcggccctgaaccac

SEQ ID NO: 6693807 - DNA, 17 bp, Homo sapiens
caccgtgaaccagaggg

SEQ ID NO: 6693808 - DNA, 18 bp, Homo sapiens
caccgtgaggccaagatc

SEQ ID NO: 6693809 - DNA, 23 bp, Homo sapiens
caccgtgccaaccccacccagct

SEQ ID NO: 6693810 - DNA, 13 bp, Homo sapiens
caccgtgcctggc

SEQ ID NO: 6693811 - DNA, 20 bp, Homo sapiens
caccgtgcctggccacgccc

SEQ ID NO: 6693812 - DNA, 14 bp, Homo sapiens
caccgtgcctggct

SEQ ID NO: 6693813 - DNA, 16 bp, Homo sapiens
caccgtgcctggctga

SEQ ID NO: 6693814 - DNA, 19 bp, Homo sapiens
caccgtgctgtcttctggt

SEQ ID NO: 6693815 - DNA, 20 bp, Homo sapiens
caccgtgctgtcttctggtc

SEQ ID NO: 6693816 - DNA, 15 bp, Homo sapiens
caccgtggaccttcc

SEQ ID NO: 6693817 - DNA, 23 bp, Homo sapiens
caccgtggcagcttgctgggctt

SEQ ID NO: 6693818 - DNA, 15 bp, Homo sapiens
caccgtggctaagag

SEQ ID NO: 6693819 - DNA, 20 bp, Homo sapiens
caccgtggctaccattgtca

SEQ ID NO: 6693820 - DNA, 17 bp, Homo sapiens
caccgtgggccctcaag

SEQ ID NO: 6693821 - DNA, 17 bp, Homo sapiens
caccgtgggctccctga

SEQ ID NO: 6693822 - DNA, 20 bp, Homo sapiens
caccgtggggaaggggtgca

SEQ ID NO: 6693823 - DNA, 17 bp, Homo sapiens
caccgtggtgtgaggcc

SEQ ID NO: 6693824 - DNA, 21 bp, Homo sapiens
caccgtggtgtgaggcccccg

SEQ ID NO: 6693825 - DNA, 19 bp, Homo sapiens
caccgtgtcaagctgctct

SEQ ID NO: 6693826 - DNA, 23 bp, Homo sapiens
caccgtgtcaagctgctctgagc

SEQ ID NO: 6693827 - DNA, 15 bp, Homo sapiens
caccgtgtcctcctc

SEQ ID NO: 6693828 - DNA, 17 bp, Homo sapiens
caccgtgtcctcctctg

SEQ ID NO: 6693829 - DNA, 23 bp, Homo sapiens
caccgtgtcctcctctgaggaag

SEQ ID NO: 6693830 - DNA, 15 bp, Homo sapiens
caccgtgtcgggcag

SEQ ID NO: 6693831 - DNA, 20 bp, Homo sapiens
caccgttaggattcaggcag

SEQ ID NO: 6693832 - DNA, 16 bp, Homo sapiens
caccgttatcggtgtc

SEQ ID NO: 6693833 - DNA, 13 bp, Homo sapiens
caccgttctgtgc

SEQ ID NO: 6693834 - DNA, 15 bp, Homo sapiens
caccgttctgtgcac

SEQ ID NO: 6693835 - DNA, 21 bp, Homo sapiens
caccgttggggattggggaag

SEQ ID NO: 6693836 - DNA, 17 bp, Homo sapiens
caccgtttcttcctgcc

SEQ ID NO: 6693837 - DNA, 16 bp, Homo sapiens
cacctaaaccctctgt

SEQ ID NO: 6693838 - DNA, 17 bp, Homo sapiens
cacctaaaccctctgtg

SEQ ID NO: 6693839 - DNA, 16 bp, Homo sapiens
cacctaaacggggcag

SEQ ID NO: 6693840 - DNA, 12 bp, Homo sapiens
cacctaaagaaa

SEQ ID NO: 6693841 - DNA, 14 bp, Homo sapiens
cacctaaagcagcc

SEQ ID NO: 6693842 - DNA, 18 bp, Homo sapiens
cacctaaagggaagccct

SEQ ID NO: 6693843 - DNA, 20 bp, Homo sapiens
cacctaaaggtgtatttaaa

SEQ ID NO: 6693844 - DNA, 14 bp, Homo sapiens
cacctaaccccagg

SEQ ID NO: 6693845 - DNA, 18 bp, Homo sapiens
cacctaaccccagggcac

SEQ ID NO: 6693846 - DNA, 18 bp, Homo sapiens
cacctaaccctctgtcac

SEQ ID NO: 6693847 - DNA, 23 bp, Homo sapiens
cacctaagcaatcactgggccca

SEQ ID NO: 6693848 - DNA, 15 bp, Homo sapiens
cacctaattaatttc

SEQ ID NO: 6693849 - DNA, 21 bp, Homo sapiens
cacctaattcgatgaaggctg

SEQ ID NO: 6693850 - DNA, 22 bp, Homo sapiens
cacctaattcgatgaaggctgc

SEQ ID NO: 6693851 - DNA, 23 bp, Homo sapiens
cacctaattcgatgaaggctgcc

SEQ ID NO: 6693852 - DNA, 13 bp, Homo sapiens
cacctacacagga

SEQ ID NO: 6693853 - DNA, 16 bp, Homo sapiens
cacctacagtgtacag

SEQ ID NO: 6693854 - DNA, 17 bp, Homo sapiens
cacctacagtgtacagt

SEQ ID NO: 6693855 - DNA, 23 bp, Homo sapiens
cacctacagtgtacagtcttgta

SEQ ID NO: 6693856 - DNA, 19 bp, Homo sapiens
cacctacatccccaggtct

SEQ ID NO: 6693857 - DNA, 21 bp, Homo sapiens
cacctacatgaggtactgaga

SEQ ID NO: 6693858 - DNA, 18 bp, Homo sapiens
cacctaccatcagggaca

SEQ ID NO: 6693859 - DNA, 22 bp, Homo sapiens
cacctaccatcagggacaggat

SEQ ID NO: 6693860 - DNA, 14 bp, Homo sapiens
cacctaccatgctg

SEQ ID NO: 6693861 - DNA, 16 bp, Homo sapiens
cacctacccctgactt

SEQ ID NO: 6693862 - DNA, 19 bp, Homo sapiens
cacctaccccttggaaatg

SEQ ID NO: 6693863 - DNA, 17 bp, Homo sapiens
cacctaccctcaaagta

SEQ ID NO: 6693864 - DNA, 20 bp, Homo sapiens
cacctactacatcgccctcc

SEQ ID NO: 6693865 - DNA, 21 bp, Homo sapiens
cacctactacatcgccctcca

SEQ ID NO: 6693866 - DNA, 20 bp, Homo sapiens
cacctactatgtgctgggtg

SEQ ID NO: 6693867 - DNA, 17 bp, Homo sapiens
cacctactcacacaggc

SEQ ID NO: 6693868 - DNA, 21 bp, Homo sapiens
cacctactgcactttccccct

SEQ ID NO: 6693869 - DNA, 13 bp, Homo sapiens
cacctacttcctc

SEQ ID NO: 6693870 - DNA, 19 bp, Homo sapiens
cacctacttgtgactgaag

SEQ ID NO: 6693871 - DNA, 21 bp, Homo sapiens
cacctacttgtgactgaaggg

SEQ ID NO: 6693872 - DNA, 17 bp, Homo sapiens
cacctagaagtctccct

SEQ ID NO: 6693873 - DNA, 21 bp, Homo sapiens
cacctagacaaccagaggctg

SEQ ID NO: 6693874 - DNA, 16 bp, Homo sapiens
cacctagactctccct

SEQ ID NO: 6693875 - DNA, 14 bp, Homo sapiens
cacctagagccaga

SEQ ID NO: 6693876 - DNA, 16 bp, Homo sapiens
cacctagagccagacc

SEQ ID NO: 6693877 - DNA, 22 bp, Homo sapiens
cacctagagcttttttataaca

SEQ ID NO: 6693878 - DNA, 15 bp, Homo sapiens
cacctagagtagtgc

SEQ ID NO: 6693879 - DNA, 21 bp, Homo sapiens
cacctagcaacatatctctgc

SEQ ID NO: 6693880 - DNA, 14 bp, Homo sapiens
cacctagcagcacc

SEQ ID NO: 6693881 - DNA, 14 bp, Homo sapiens
cacctagctgaatg

SEQ ID NO: 6693882 - DNA, 21 bp, Homo sapiens
cacctagctgaatgtttttct

SEQ ID NO: 6693883 - DNA, 17 bp, Homo sapiens
cacctagcttagtcatg

SEQ ID NO: 6693884 - DNA, 19 bp, Homo sapiens
cacctaggaagcctcagat

SEQ ID NO: 6693885 - DNA, 19 bp, Homo sapiens
cacctaggccactcctcca

SEQ ID NO: 6693886 - DNA, 20 bp, Homo sapiens
cacctaggtcgccagtgaaa

SEQ ID NO: 6693887 - DNA, 13 bp, Homo sapiens
cacctagtgcccc

SEQ ID NO: 6693888 - DNA, 15 bp, Homo sapiens
cacctagtgccccag

SEQ ID NO: 6693889 - DNA, 18 bp, Homo sapiens
cacctagtgccccagact

SEQ ID NO: 6693890 - DNA, 15 bp, Homo sapiens
cacctagtggctgtc

SEQ ID NO: 6693891 - DNA, 16 bp, Homo sapiens
cacctagtggctgtcc

SEQ ID NO: 6693892 - DNA, 23 bp, Homo sapiens
cacctagtggctgtccagtgccc

SEQ ID NO: 6693893 - DNA, 14 bp, Homo sapiens
cacctataaaacag

SEQ ID NO: 6693894 - DNA, 21 bp, Homo sapiens
cacctataaatactaaatatg

SEQ ID NO: 6693895 - DNA, 22 bp, Homo sapiens
cacctataaatactaaatatga

SEQ ID NO: 6693896 - DNA, 14 bp, Homo sapiens
cacctataatacca

SEQ ID NO: 6693897 - DNA, 20 bp, Homo sapiens
cacctataataccagctact

SEQ ID NO: 6693898 - DNA, 16 bp, Homo sapiens
cacctatatccagaag

SEQ ID NO: 6693899 - DNA, 21 bp, Homo sapiens
cacctatccctaacaggctgt

SEQ ID NO: 6693900 - DNA, 15 bp, Homo sapiens
cacctatctcagcca

SEQ ID NO: 6693901 - DNA, 17 bp, Homo sapiens
cacctatctcagccata

SEQ ID NO: 6693902 - DNA, 18 bp, Homo sapiens
cacctatctcagccatag

SEQ ID NO: 6693903 - DNA, 18 bp, Homo sapiens
cacctatctcgtgggaga

SEQ ID NO: 6693904 - DNA, 21 bp, Homo sapiens
cacctatctcgtgggagagcc

SEQ ID NO: 6693905 - DNA, 23 bp, Homo sapiens
cacctatgagatggccatgctca

SEQ ID NO: 6693906 - DNA, 22 bp, Homo sapiens
cacctatgccagtgctcaaggt

SEQ ID NO: 6693907 - DNA, 19 bp, Homo sapiens
cacctatgtcatttcattt

SEQ ID NO: 6693908 - DNA, 20 bp, Homo sapiens
cacctatgtcatttcatttc

SEQ ID NO: 6693909 - DNA, 21 bp, Homo sapiens
cacctatgtgccaactgttgt

SEQ ID NO: 6693910 - DNA, 17 bp, Homo sapiens
cacctattatcccagct

SEQ ID NO: 6693911 - DNA, 18 bp, Homo sapiens
cacctattatcccagctg

SEQ ID NO: 6693912 - DNA, 19 bp, Homo sapiens
cacctattatcccagctgc

SEQ ID NO: 6693913 - DNA, 15 bp, Homo sapiens
cacctatttaatgtt

SEQ ID NO: 6693914 - DNA, 15 bp, Homo sapiens
cacctcaaatacata

SEQ ID NO: 6693915 - DNA, 18 bp, Homo sapiens
cacctcaacccagaggct

SEQ ID NO: 6693916 - DNA, 13 bp, Homo sapiens
cacctcacagcta

SEQ ID NO: 6693917 - DNA, 10 bp, Homo sapiens
cacctcaccc

SEQ ID NO: 6693918 - DNA, 11 bp, Homo sapiens
cacctcacccc

SEQ ID NO: 6693919 - DNA, 16 bp, Homo sapiens
cacctcaccccactta

SEQ ID NO: 6693920 - DNA, 16 bp, Homo sapiens
cacctcacccggcctc

SEQ ID NO: 6693921 - DNA, 17 bp, Homo sapiens
cacctcacccggcctct

SEQ ID NO: 6693922 - DNA, 14 bp, Homo sapiens
cacctcaccctctc

SEQ ID NO: 6693923 - DNA, 12 bp, Homo sapiens
cacctcacctct

SEQ ID NO: 6693924 - DNA, 19 bp, Homo sapiens
cacctcacgctctggacat

SEQ ID NO: 6693925 - DNA, 16 bp, Homo sapiens
cacctcactagctccc

SEQ ID NO: 6693926 - DNA, 18 bp, Homo sapiens
cacctcactagctcccca

SEQ ID NO: 6693927 - DNA, 15 bp, Homo sapiens
cacctcactcagcac

SEQ ID NO: 6693928 - DNA, 17 bp, Homo sapiens
cacctcactcagcacca

SEQ ID NO: 6693929 - DNA, 16 bp, Homo sapiens
cacctcactctgctac

SEQ ID NO: 6693930 - DNA, 21 bp, Homo sapiens
cacctcactgaaaacatctgg

SEQ ID NO: 6693931 - DNA, 14 bp, Homo sapiens
cacctcactgagga

SEQ ID NO: 6693932 - DNA, 13 bp, Homo sapiens
cacctcactgtca

SEQ ID NO: 6693933 - DNA, 15 bp, Homo sapiens
cacctcactgtcatc

SEQ ID NO: 6693934 - DNA, 17 bp, Homo sapiens
cacctcactgtcatctg

SEQ ID NO: 6693935 - DNA, 19 bp, Homo sapiens
cacctcactgtcatctgcc

SEQ ID NO: 6693936 - DNA, 11 bp, Homo sapiens
cacctcagaaa

SEQ ID NO: 6693937 - DNA, 21 bp, Homo sapiens
cacctcagacaatccactctc

SEQ ID NO: 6693938 - DNA, 13 bp, Homo sapiens
cacctcagagcag

SEQ ID NO: 6693939 - DNA, 16 bp, Homo sapiens
cacctcagagccccgc

SEQ ID NO: 6693940 - DNA, 19 bp, Homo sapiens
cacctcagaggctgttctt

SEQ ID NO: 6693941 - DNA, 17 bp, Homo sapiens
cacctcagagtggagtt

SEQ ID NO: 6693942 - DNA, 20 bp, Homo sapiens
cacctcagatggcagctttt

SEQ ID NO: 6693943 - DNA, 14 bp, Homo sapiens
cacctcagcctccc

SEQ ID NO: 6693944 - DNA, 14 bp, Homo sapiens
cacctcagcctcct

SEQ ID NO: 6693945 - DNA, 16 bp, Homo sapiens
cacctcagcctcctga

SEQ ID NO: 6693946 - DNA, 12 bp, Homo sapiens
cacctcagcctg

SEQ ID NO: 6693947 - DNA, 13 bp, Homo sapiens
cacctcagcctgg

SEQ ID NO: 6693948 - DNA, 14 bp, Homo sapiens
cacctcagcctgga

SEQ ID NO: 6693949 - DNA, 22 bp, Homo sapiens
cacctcagcctggagaggcctg

SEQ ID NO: 6693950 - DNA, 15 bp, Homo sapiens
cacctcagccttgga

SEQ ID NO: 6693951 - DNA, 12 bp, Homo sapiens
cacctcagctga

SEQ ID NO: 6693952 - DNA, 11 bp, Homo sapiens
cacctcaggac

SEQ ID NO: 6693953 - DNA, 11 bp, Homo sapiens
cacctcagggc

SEQ ID NO: 6693954 - DNA, 20 bp, Homo sapiens
cacctcagttcccttggcct

SEQ ID NO: 6693955 - DNA, 23 bp, Homo sapiens
cacctcagttcccttggcctcag

SEQ ID NO: 6693956 - DNA, 15 bp, Homo sapiens
cacctcatccccaac

SEQ ID NO: 6693957 - DNA, 15 bp, Homo sapiens
cacctcatgcccacc

SEQ ID NO: 6693958 - DNA, 17 bp, Homo sapiens
cacctcatgcccacccc

SEQ ID NO: 6693959 - DNA, 22 bp, Homo sapiens
cacctcatgcccaccccctgcc

SEQ ID NO: 6693960 - DNA, 12 bp, Homo sapiens
cacctcatggaa

SEQ ID NO: 6693961 - DNA, 23 bp, Homo sapiens
cacctcatggattgccacagctc

SEQ ID NO: 6693962 - DNA, 17 bp, Homo sapiens
cacctccaagcatttca

SEQ ID NO: 6693963 - DNA, 21 bp, Homo sapiens
cacctccaagttctagggccg

SEQ ID NO: 6693964 - DNA, 16 bp, Homo sapiens
cacctccacacccacc

SEQ ID NO: 6693965 - DNA, 20 bp, Homo sapiens
cacctccacacccaccccct

SEQ ID NO: 6693966 - DNA, 21 bp, Homo sapiens
cacctccacacccaccccctc

SEQ ID NO: 6693967 - DNA, 13 bp, Homo sapiens
cacctccacagtt

SEQ ID NO: 6693968 - DNA, 18 bp, Homo sapiens
cacctccacagttcagtg

SEQ ID NO: 6693969 - DNA, 16 bp, Homo sapiens
cacctccacatcctcc

SEQ ID NO: 6693970 - DNA, 18 bp, Homo sapiens
cacctccaccacatctgc

SEQ ID NO: 6693971 - DNA, 12 bp, Homo sapiens
cacctccaccca

SEQ ID NO: 6693972 - DNA, 16 bp, Homo sapiens
cacctccacccagccc

SEQ ID NO: 6693973 - DNA, 17 bp, Homo sapiens
cacctccacccagcccc

SEQ ID NO: 6693974 - DNA, 19 bp, Homo sapiens
cacctccacccagcccctg

SEQ ID NO: 6693975 - DNA, 14 bp, Homo sapiens
cacctccaccccca

SEQ ID NO: 6693976 - DNA, 17 bp, Homo sapiens
cacctccacccccaaga

SEQ ID NO: 6693977 - DNA, 18 bp, Homo sapiens
cacctccacccccaagaa

SEQ ID NO: 6693978 - DNA, 15 bp, Homo sapiens
cacctccacccgtcc

SEQ ID NO: 6693979 - DNA, 15 bp, Homo sapiens
cacctccactcagca

SEQ ID NO: 6693980 - DNA, 22 bp, Homo sapiens
cacctccactcccacctcaccc

SEQ ID NO: 6693981 - DNA, 17 bp, Homo sapiens
cacctccagcccacagt

SEQ ID NO: 6693982 - DNA, 18 bp, Homo sapiens
cacctccagcccacagtg

SEQ ID NO: 6693983 - DNA, 15 bp, Homo sapiens
cacctccagcctctg

SEQ ID NO: 6693984 - DNA, 16 bp, Homo sapiens
cacctccagcctctgg

SEQ ID NO: 6693985 - DNA, 21 bp, Homo sapiens
cacctccagctgccccgggat

SEQ ID NO: 6693986 - DNA, 12 bp, Homo sapiens
cacctccaggca

SEQ ID NO: 6693987 - DNA, 15 bp, Homo sapiens
cacctccaggcaggc

SEQ ID NO: 6693988 - DNA, 21 bp, Homo sapiens
cacctccaggcaggccaggct

SEQ ID NO: 6693989 - DNA, 22 bp, Homo sapiens
cacctccaggcaggccaggctg

SEQ ID NO: 6693990 - DNA, 23 bp, Homo sapiens
cacctccaggcaggccaggctgc

SEQ ID NO: 6693991 - DNA, 15 bp, Homo sapiens
cacctccaggcctgt

SEQ ID NO: 6693992 - DNA, 15 bp, Homo sapiens
cacctccatcccaga

SEQ ID NO: 6693993 - DNA, 14 bp, Homo sapiens
cacctccatgtcat

SEQ ID NO: 6693994 - DNA, 15 bp, Homo sapiens
cacctccatgtcatc

SEQ ID NO: 6693995 - DNA, 21 bp, Homo sapiens
cacctccattaaagtctgaat

SEQ ID NO: 6693996 - DNA, 13 bp, Homo sapiens
cacctcccacccc

SEQ ID NO: 6693997 - DNA, 14 bp, Homo sapiens
cacctcccacccca

SEQ ID NO: 6693998 - DNA, 17 bp, Homo sapiens
cacctcccaccccactc

SEQ ID NO: 6693999 - DNA, 23 bp, Homo sapiens
cacctcccaccccactccagccc

SEQ ID NO: 6694000 - DNA, 18 bp, Homo sapiens
cacctcccactcctgctg

SEQ ID NO: 6694001 - DNA, 10 bp, Homo sapiens
cacctcccag

SEQ ID NO: 6694002 - DNA, 16 bp, Homo sapiens
cacctcccagcccctg

SEQ ID NO: 6694003 - DNA, 11 bp, Homo sapiens
cacctcccagg

SEQ ID NO: 6694004 - DNA, 12 bp, Homo sapiens
cacctcccagga

SEQ ID NO: 6694005 - DNA, 14 bp, Homo sapiens
cacctcccagggct

SEQ ID NO: 6694006 - DNA, 19 bp, Homo sapiens
cacctcccagggctacaca

SEQ ID NO: 6694007 - DNA, 20 bp, Homo sapiens
cacctcccagggctacacag

SEQ ID NO: 6694008 - DNA, 13 bp, Homo sapiens
cacctcccagggg

SEQ ID NO: 6694009 - DNA, 21 bp, Homo sapiens
cacctcccaggggactgttcc

SEQ ID NO: 6694010 - DNA, 21 bp, Homo sapiens
cacctcccaggggctccacct

SEQ ID NO: 6694011 - DNA, 20 bp, Homo sapiens
cacctcccaggttcaagcga

SEQ ID NO: 6694012 - DNA, 13 bp, Homo sapiens
cacctcccatcct

SEQ ID NO: 6694013 - DNA, 16 bp, Homo sapiens
cacctcccatcctaat

SEQ ID NO: 6694014 - DNA, 12 bp, Homo sapiens
cacctccccaaa

SEQ ID NO: 6694015 - DNA, 14 bp, Homo sapiens
cacctccccaaagc

SEQ ID NO: 6694016 - DNA, 20 bp, Homo sapiens
cacctccccacatcgcacac

SEQ ID NO: 6694017 - DNA, 22 bp, Homo sapiens
cacctccccacatcgcacactg

SEQ ID NO: 6694018 - DNA, 23 bp, Homo sapiens
cacctccccacatcgcacactgg

SEQ ID NO: 6694019 - DNA, 18 bp, Homo sapiens
cacctccccactccagca

SEQ ID NO: 6694020 - DNA, 20 bp, Homo sapiens
cacctccccagacagggctc

SEQ ID NO: 6694021 - DNA, 20 bp, Homo sapiens
cacctccccagagccctgca

SEQ ID NO: 6694022 - DNA, 21 bp, Homo sapiens
cacctccccaggccgtggctg

SEQ ID NO: 6694023 - DNA, 16 bp, Homo sapiens
cacctcccccaaaccc

SEQ ID NO: 6694024 - DNA, 21 bp, Homo sapiens
cacctcccccactcccaacca

SEQ ID NO: 6694025 - DNA, 21 bp, Homo sapiens
cacctcccccatctcttctgg

SEQ ID NO: 6694026 - DNA, 23 bp, Homo sapiens
cacctccccccacaagtgccctc

SEQ ID NO: 6694027 - DNA, 14 bp, Homo sapiens
cacctccccccact

SEQ ID NO: 6694028 - DNA, 16 bp, Homo sapiens
cacctccccccactgc

SEQ ID NO: 6694029 - DNA, 21 bp, Homo sapiens
cacctccccccactgcaggcc

SEQ ID NO: 6694030 - DNA, 11 bp, Homo sapiens
cacctccccct

SEQ ID NO: 6694031 - DNA, 16 bp, Homo sapiens
cacctccccctccccg

SEQ ID NO: 6694032 - DNA, 14 bp, Homo sapiens
cacctccccctgcg

SEQ ID NO: 6694033 - DNA, 24 bp, Homo sapiens
cacctccccctgctgctgctgccc

SEQ ID NO: 6694034 - DNA, 15 bp, Homo sapiens
cacctccccctttca

SEQ ID NO: 6694035 - DNA, 21 bp, Homo sapiens
cacctccccgctctccctgtc

SEQ ID NO: 6694036 - DNA, 16 bp, Homo sapiens
cacctccccgctggga

SEQ ID NO: 6694037 - DNA, 13 bp, Homo sapiens
cacctcccctatc

SEQ ID NO: 6694038 - DNA, 20 bp, Homo sapiens
cacctcccctatccacccag

SEQ ID NO: 6694039 - DNA, 15 bp, Homo sapiens
cacctcccctccttg

SEQ ID NO: 6694040 - DNA, 17 bp, Homo sapiens
cacctccccttgccagc

SEQ ID NO: 6694041 - DNA, 23 bp, Homo sapiens
cacctccctaccaaaaattgcca

SEQ ID NO: 6694042 - DNA, 20 bp, Homo sapiens
cacctccctatactgcttgg

SEQ ID NO: 6694043 - DNA, 19 bp, Homo sapiens
cacctccctcaacctcatc

SEQ ID NO: 6694044 - DNA, 19 bp, Homo sapiens
cacctccctgaaccatccc

SEQ ID NO: 6694045 - DNA, 11 bp, Homo sapiens
cacctccctgc

SEQ ID NO: 6694046 - DNA, 13 bp, Homo sapiens
cacctccctgcaa

SEQ ID NO: 6694047 - DNA, 15 bp, Homo sapiens
cacctccctgcagct

SEQ ID NO: 6694048 - DNA, 12 bp, Homo sapiens
cacctccctgcc

SEQ ID NO: 6694049 - DNA, 14 bp, Homo sapiens
cacctccctgccca

SEQ ID NO: 6694050 - DNA, 15 bp, Homo sapiens
cacctccctgcccag

SEQ ID NO: 6694051 - DNA, 17 bp, Homo sapiens
cacctccctgcccaggc

SEQ ID NO: 6694052 - DNA, 16 bp, Homo sapiens
cacctccctgccctgt

SEQ ID NO: 6694053 - DNA, 14 bp, Homo sapiens
cacctccctgcctc

SEQ ID NO: 6694054 - DNA, 15 bp, Homo sapiens
cacctccctgcctcc

SEQ ID NO: 6694055 - DNA, 17 bp, Homo sapiens
cacctccctgcctccag

SEQ ID NO: 6694056 - DNA, 13 bp, Homo sapiens
cacctccctgcgc

SEQ ID NO: 6694057 - DNA, 13 bp, Homo sapiens
cacctcccttggg

SEQ ID NO: 6694058 - DNA, 23 bp, Homo sapiens
cacctccgccagaccccgtggct

SEQ ID NO: 6694059 - DNA, 18 bp, Homo sapiens
cacctccgccccagacac

SEQ ID NO: 6694060 - DNA, 20 bp, Homo sapiens
cacctccgccccagacacac

SEQ ID NO: 6694061 - DNA, 18 bp, Homo sapiens
cacctccgcttgccagag

SEQ ID NO: 6694062 - DNA, 19 bp, Homo sapiens
cacctcctaccccttcctg

SEQ ID NO: 6694063 - DNA, 22 bp, Homo sapiens
cacctcctagaggtgggcagct

SEQ ID NO: 6694064 - DNA, 23 bp, Homo sapiens
cacctcctagaggtgggcagctg

SEQ ID NO: 6694065 - DNA, 14 bp, Homo sapiens
cacctcctccatgc

SEQ ID NO: 6694066 - DNA, 16 bp, Homo sapiens
cacctcctcccactgc

SEQ ID NO: 6694067 - DNA, 13 bp, Homo sapiens
cacctcctccccc

SEQ ID NO: 6694068 - DNA, 20 bp, Homo sapiens
cacctcctccccctgttctg

SEQ ID NO: 6694069 - DNA, 13 bp, Homo sapiens
cacctcctcctgc

SEQ ID NO: 6694070 - DNA, 17 bp, Homo sapiens
cacctcctcctgctgct

SEQ ID NO: 6694071 - DNA, 22 bp, Homo sapiens
cacctcctcctgctgctcactc

SEQ ID NO: 6694072 - DNA, 17 bp, Homo sapiens
cacctcctctgccagca

SEQ ID NO: 6694073 - DNA, 18 bp, Homo sapiens
cacctcctctgccagcag

SEQ ID NO: 6694074 - DNA, 19 bp, Homo sapiens
cacctcctgagaaggcgag

SEQ ID NO: 6694075 - DNA, 20 bp, Homo sapiens
cacctcctgagttcaagcga

SEQ ID NO: 6694076 - DNA, 11 bp, Homo sapiens
cacctcctgcg

SEQ ID NO: 6694077 - DNA, 14 bp, Homo sapiens
cacctcctgcggct

SEQ ID NO: 6694078 - DNA, 14 bp, Homo sapiens
cacctcctgctcct

SEQ ID NO: 6694079 - DNA, 17 bp, Homo sapiens
cacctcctgctgggcag

SEQ ID NO: 6694080 - DNA, 20 bp, Homo sapiens
cacctcctgggttcaagcga

SEQ ID NO: 6694081 - DNA, 22 bp, Homo sapiens
cacctcctgtgttgtgctggga

SEQ ID NO: 6694082 - DNA, 14 bp, Homo sapiens
cacctccttcaatt

SEQ ID NO: 6694083 - DNA, 12 bp, Homo sapiens
cacctccttccc

SEQ ID NO: 6694084 - DNA, 23 bp, Homo sapiens
cacctcctttcaaggtaactgta

SEQ ID NO: 6694085 - DNA, 17 bp, Homo sapiens
cacctccttttcttcta

SEQ ID NO: 6694086 - DNA, 16 bp, Homo sapiens
cacctcgagaagtaat

SEQ ID NO: 6694087 - DNA, 19 bp, Homo sapiens
cacctcgcccttcagccca

SEQ ID NO: 6694088 - DNA, 15 bp, Homo sapiens
cacctcgcggcgcag

SEQ ID NO: 6694089 - DNA, 18 bp, Homo sapiens
cacctcgcggcgcagccc

SEQ ID NO: 6694090 - DNA, 17 bp, Homo sapiens
cacctcgctcccctctg

SEQ ID NO: 6694091 - DNA, 20 bp, Homo sapiens
cacctcgctcccctctggaa

SEQ ID NO: 6694092 - DNA, 15 bp, Homo sapiens
cacctcgctgggctc

SEQ ID NO: 6694093 - DNA, 21 bp, Homo sapiens
cacctcgctgttgtcacatct

SEQ ID NO: 6694094 - DNA, 20 bp, Homo sapiens
cacctcggagggatggagaa

SEQ ID NO: 6694095 - DNA, 20 bp, Homo sapiens
cacctcggatcccactgatt

SEQ ID NO: 6694096 - DNA, 17 bp, Homo sapiens
cacctcggcacacactg

SEQ ID NO: 6694097 - DNA, 14 bp, Homo sapiens
cacctcggccctcc

SEQ ID NO: 6694098 - DNA, 15 bp, Homo sapiens
cacctcggcctccca

SEQ ID NO: 6694099 - DNA, 15 bp, Homo sapiens
cacctcggggacacc

SEQ ID NO: 6694100 - DNA, 20 bp, Homo sapiens
cacctcggggacaccagagc

SEQ ID NO: 6694101 - DNA, 19 bp, Homo sapiens
cacctcgttactctcacct

SEQ ID NO: 6694102 - DNA, 22 bp, Homo sapiens
cacctctaacagcaccaaatca

SEQ ID NO: 6694103 - DNA, 15 bp, Homo sapiens
cacctctacccaaac

SEQ ID NO: 6694104 - DNA, 18 bp, Homo sapiens
cacctctaggcctcagtg

SEQ ID NO: 6694105 - DNA, 14 bp, Homo sapiens
cacctctagtcaga

SEQ ID NO: 6694106 - DNA, 15 bp, Homo sapiens
cacctctatccaaag

SEQ ID NO: 6694107 - DNA, 20 bp, Homo sapiens
cacctctcagagcaagcctt

SEQ ID NO: 6694108 - DNA, 21 bp, Homo sapiens
cacctctcagagcaagccttt

SEQ ID NO: 6694109 - DNA, 11 bp, Homo sapiens
cacctctccaa

SEQ ID NO: 6694110 - DNA, 13 bp, Homo sapiens
cacctctccaagg

SEQ ID NO: 6694111 - DNA, 15 bp, Homo sapiens
cacctctccaagtct

SEQ ID NO: 6694112 - DNA, 18 bp, Homo sapiens
cacctctccaagtctctc

SEQ ID NO: 6694113 - DNA, 16 bp, Homo sapiens
cacctctccaggtgct

SEQ ID NO: 6694114 - DNA, 19 bp, Homo sapiens
cacctctccaggtgctcat

SEQ ID NO: 6694115 - DNA, 14 bp, Homo sapiens
cacctctcccagcc

SEQ ID NO: 6694116 - DNA, 12 bp, Homo sapiens
cacctctccctc

SEQ ID NO: 6694117 - DNA, 13 bp, Homo sapiens
cacctctccctca

SEQ ID NO: 6694118 - DNA, 19 bp, Homo sapiens
cacctctccctcaacaagg

SEQ ID NO: 6694119 - DNA, 13 bp, Homo sapiens
cacctctccctgc

SEQ ID NO: 6694120 - DNA, 24 bp, Homo sapiens
cacctctccctgcatcctgaggcc

SEQ ID NO: 6694121 - DNA, 19 bp, Homo sapiens
cacctctcctactcactta

SEQ ID NO: 6694122 - DNA, 22 bp, Homo sapiens
cacctctcgcaagagggtctct

SEQ ID NO: 6694123 - DNA, 15 bp, Homo sapiens
cacctctctcactcc

SEQ ID NO: 6694124 - DNA, 18 bp, Homo sapiens
cacctctctcactccttg

SEQ ID NO: 6694125 - DNA, 19 bp, Homo sapiens
cacctctctcactccttga

SEQ ID NO: 6694126 - DNA, 14 bp, Homo sapiens
cacctctctcagag

SEQ ID NO: 6694127 - DNA, 15 bp, Homo sapiens
cacctctctcagagc

SEQ ID NO: 6694128 - DNA, 16 bp, Homo sapiens
cacctctctctgagga

SEQ ID NO: 6694129 - DNA, 11 bp, Homo sapiens
cacctctctgg

SEQ ID NO: 6694130 - DNA, 13 bp, Homo sapiens
cacctctctgtct

SEQ ID NO: 6694131 - DNA, 14 bp, Homo sapiens
cacctctctgtctt

SEQ ID NO: 6694132 - DNA, 20 bp, Homo sapiens
cacctctctgtctttttcct

SEQ ID NO: 6694133 - DNA, 12 bp, Homo sapiens
cacctctcttcc

SEQ ID NO: 6694134 - DNA, 12 bp, Homo sapiens
cacctctctttt

SEQ ID NO: 6694135 - DNA, 21 bp, Homo sapiens
cacctctgacgcaccactgcc

SEQ ID NO: 6694136 - DNA, 11 bp, Homo sapiens
cacctctgagg

SEQ ID NO: 6694137 - DNA, 16 bp, Homo sapiens
cacctctgaggacaga

SEQ ID NO: 6694138 - DNA, 14 bp, Homo sapiens
cacctctgccactc

SEQ ID NO: 6694139 - DNA, 11 bp, Homo sapiens
cacctctgccc

SEQ ID NO: 6694140 - DNA, 23 bp, Homo sapiens
cacctctgccccttgggcctccc

SEQ ID NO: 6694141 - DNA, 18 bp, Homo sapiens
cacctctgcccttcccct

SEQ ID NO: 6694142 - DNA, 13 bp, Homo sapiens
cacctctgcctct

SEQ ID NO: 6694143 - DNA, 12 bp, Homo sapiens
cacctctgcgga

SEQ ID NO: 6694144 - DNA, 19 bp, Homo sapiens
cacctctgcggaccccagc

SEQ ID NO: 6694145 - DNA, 20 bp, Homo sapiens
cacctctgcggaccccagct

SEQ ID NO: 6694146 - DNA, 22 bp, Homo sapiens
cacctctgcggaccccagctgt

SEQ ID NO: 6694147 - DNA, 13 bp, Homo sapiens
cacctctgctcca

SEQ ID NO: 6694148 - DNA, 12 bp, Homo sapiens
cacctctgctgc

SEQ ID NO: 6694149 - DNA, 14 bp, Homo sapiens
cacctctgctgccc

SEQ ID NO: 6694150 - DNA, 15 bp, Homo sapiens
cacctctgctgccca

SEQ ID NO: 6694151 - DNA, 21 bp, Homo sapiens
cacctctgctgcccacggcca

SEQ ID NO: 6694152 - DNA, 22 bp, Homo sapiens
cacctctgctgcccacggccac

SEQ ID NO: 6694153 - DNA, 16 bp, Homo sapiens
cacctctgctttctga

SEQ ID NO: 6694154 - DNA, 17 bp, Homo sapiens
cacctctggactggcta

SEQ ID NO: 6694155 - DNA, 24 bp, Homo sapiens
cacctctggccaaatatgcacttt

SEQ ID NO: 6694156 - DNA, 16 bp, Homo sapiens
cacctctggccctgtg

SEQ ID NO: 6694157 - DNA, 17 bp, Homo sapiens
cacctctggccctgtgt

SEQ ID NO: 6694158 - DNA, 20 bp, Homo sapiens
cacctctggctagagccgag

SEQ ID NO: 6694159 - DNA, 23 bp, Homo sapiens
cacctctggctttgtctctagcc

SEQ ID NO: 6694160 - DNA, 21 bp, Homo sapiens
cacctctgggaccccagctgc

SEQ ID NO: 6694161 - DNA, 23 bp, Homo sapiens
cacctctgggaccccagctgctc

SEQ ID NO: 6694162 - DNA, 12 bp, Homo sapiens
cacctctgggcc

SEQ ID NO: 6694163 - DNA, 14 bp, Homo sapiens
cacctctgggcttc

SEQ ID NO: 6694164 - DNA, 22 bp, Homo sapiens
cacctctggggaagatggagca

SEQ ID NO: 6694165 - DNA, 12 bp, Homo sapiens
cacctctggggg

SEQ ID NO: 6694166 - DNA, 13 bp, Homo sapiens
cacctctgtaatt

SEQ ID NO: 6694167 - DNA, 14 bp, Homo sapiens
cacctctgtgacct

SEQ ID NO: 6694168 - DNA, 18 bp, Homo sapiens
cacctctgtgacctcagg

SEQ ID NO: 6694169 - DNA, 17 bp, Homo sapiens
cacctctgtgcagggca

SEQ ID NO: 6694170 - DNA, 15 bp, Homo sapiens
cacctctgttaaggt

SEQ ID NO: 6694171 - DNA, 17 bp, Homo sapiens
cacctcttcctctggtt

SEQ ID NO: 6694172 - DNA, 17 bp, Homo sapiens
cacctcttcctggccgg

SEQ ID NO: 6694173 - DNA, 22 bp, Homo sapiens
cacctcttctcttcctgtaaca

SEQ ID NO: 6694174 - DNA, 16 bp, Homo sapiens
cacctcttggctttgt

SEQ ID NO: 6694175 - DNA, 20 bp, Homo sapiens
cacctcttggctttgttgat

SEQ ID NO: 6694176 - DNA, 18 bp, Homo sapiens
cacctcttgggcatgctc

SEQ ID NO: 6694177 - DNA, 23 bp, Homo sapiens
cacctcttgtgcaaggtggcctt

SEQ ID NO: 6694178 - DNA, 17 bp, Homo sapiens
cacctcttgtgctgagt

SEQ ID NO: 6694179 - DNA, 16 bp, Homo sapiens
cacctcttgtttctgg

SEQ ID NO: 6694180 - DNA, 18 bp, Homo sapiens
cacctctttaaaaactca

SEQ ID NO: 6694181 - DNA, 20 bp, Homo sapiens
cacctctttaaaaactcact

SEQ ID NO: 6694182 - DNA, 19 bp, Homo sapiens
cacctctttaaccactcct

SEQ ID NO: 6694183 - DNA, 21 bp, Homo sapiens
cacctctttaaccactcctca

SEQ ID NO: 6694184 - DNA, 16 bp, Homo sapiens
cacctctttcttcaat

SEQ ID NO: 6694185 - DNA, 16 bp, Homo sapiens
cacctctttgcccccg

SEQ ID NO: 6694186 - DNA, 16 bp, Homo sapiens
cacctctttgctccct

SEQ ID NO: 6694187 - DNA, 19 bp, Homo sapiens
cacctctttgtgttttatt

SEQ ID NO: 6694188 - DNA, 12 bp, Homo sapiens
cacctcttttcc

SEQ ID NO: 6694189 - DNA, 15 bp, Homo sapiens
cacctcttttcctag

SEQ ID NO: 6694190 - DNA, 16 bp, Homo sapiens
cacctgaaacactgga

SEQ ID NO: 6694191 - DNA, 19 bp, Homo sapiens
cacctgaaacactggacct

SEQ ID NO: 6694192 - DNA, 21 bp, Homo sapiens
cacctgaaacactggacctgg

SEQ ID NO: 6694193 - DNA, 19 bp, Homo sapiens
cacctgaaagcctgtctct

SEQ ID NO: 6694194 - DNA, 17 bp, Homo sapiens
cacctgaaatgcagtat

SEQ ID NO: 6694195 - DNA, 19 bp, Homo sapiens
cacctgaaattaatttgtg

SEQ ID NO: 6694196 - DNA, 20 bp, Homo sapiens
cacctgaaattaatttgtga

SEQ ID NO: 6694197 - DNA, 15 bp, Homo sapiens
cacctgaaccactgt

SEQ ID NO: 6694198 - DNA, 18 bp, Homo sapiens
cacctgaaccactgtggc

SEQ ID NO: 6694199 - DNA, 20 bp, Homo sapiens
cacctgaaccccagaggcag

SEQ ID NO: 6694200 - DNA, 15 bp, Homo sapiens
cacctgaaccccatg

SEQ ID NO: 6694201 - DNA, 17 bp, Homo sapiens
cacctgaactgaacacc

SEQ ID NO: 6694202 - DNA, 23 bp, Homo sapiens
cacctgaagactcattcttctgt

SEQ ID NO: 6694203 - DNA, 21 bp, Homo sapiens
cacctgaattcgagacaggca

SEQ ID NO: 6694204 - DNA, 16 bp, Homo sapiens
cacctgacaaatggaa

SEQ ID NO: 6694205 - DNA, 15 bp, Homo sapiens
cacctgacaacttct

SEQ ID NO: 6694206 - DNA, 17 bp, Homo sapiens
cacctgacaatggcagc

SEQ ID NO: 6694207 - DNA, 19 bp, Homo sapiens
cacctgacaatggcagcta

SEQ ID NO: 6694208 - DNA, 21 bp, Homo sapiens
cacctgacaatggcagctaga

SEQ ID NO: 6694209 - DNA, 11 bp, Homo sapiens
cacctgacaca

SEQ ID NO: 6694210 - DNA, 20 bp, Homo sapiens
cacctgacacaccaggcgct

SEQ ID NO: 6694211 - DNA, 13 bp, Homo sapiens
cacctgacacatc

SEQ ID NO: 6694212 - DNA, 16 bp, Homo sapiens
cacctgaccaggggcc

SEQ ID NO: 6694213 - DNA, 12 bp, Homo sapiens
cacctgacctct

SEQ ID NO: 6694214 - DNA, 16 bp, Homo sapiens
cacctgacctgctgaa

SEQ ID NO: 6694215 - DNA, 17 bp, Homo sapiens
cacctgacctgctgaat

SEQ ID NO: 6694216 - DNA, 18 bp, Homo sapiens
cacctgacggctggggac

SEQ ID NO: 6694217 - DNA, 17 bp, Homo sapiens
cacctgacttggctggg

SEQ ID NO: 6694218 - DNA, 16 bp, Homo sapiens
cacctgagaccctact

SEQ ID NO: 6694219 - DNA, 18 bp, Homo sapiens
cacctgagaccctactga

SEQ ID NO: 6694220 - DNA, 20 bp, Homo sapiens
cacctgagaccctgggagag

SEQ ID NO: 6694221 - DNA, 20 bp, Homo sapiens
cacctgagcaggacctctga

SEQ ID NO: 6694222 - DNA, 11 bp, Homo sapiens
cacctgagcct

SEQ ID NO: 6694223 - DNA, 13 bp, Homo sapiens
cacctgagcctgt

SEQ ID NO: 6694224 - DNA, 16 bp, Homo sapiens
cacctgagcgctgtgg

SEQ ID NO: 6694225 - DNA, 20 bp, Homo sapiens
cacctgagctttggacgcac

SEQ ID NO: 6694226 - DNA, 14 bp, Homo sapiens
cacctgaggaactg

SEQ ID NO: 6694227 - DNA, 17 bp, Homo sapiens
cacctgaggcaggaggg

SEQ ID NO: 6694228 - DNA, 14 bp, Homo sapiens
cacctgaggcccag

SEQ ID NO: 6694229 - DNA, 22 bp, Homo sapiens
cacctgaggcccagcagagccg

SEQ ID NO: 6694230 - DNA, 15 bp, Homo sapiens
cacctgaggctcagc

SEQ ID NO: 6694231 - DNA, 18 bp, Homo sapiens
cacctgaggctcagccct

SEQ ID NO: 6694232 - DNA, 13 bp, Homo sapiens
cacctgaggtcag

SEQ ID NO: 6694233 - DNA, 19 bp, Homo sapiens
cacctgaggtgggcccagg

SEQ ID NO: 6694234 - DNA, 21 bp, Homo sapiens
cacctgaggtgggcccaggac

SEQ ID NO: 6694235 - DNA, 19 bp, Homo sapiens
cacctgagtcaccctacct

SEQ ID NO: 6694236 - DNA, 13 bp, Homo sapiens
cacctgatctggc

SEQ ID NO: 6694237 - DNA, 16 bp, Homo sapiens
cacctgatctggccca

SEQ ID NO: 6694238 - DNA, 18 bp, Homo sapiens
cacctgattcaactaaaa

SEQ ID NO: 6694239 - DNA, 19 bp, Homo sapiens
cacctgattcaactaaaaa

SEQ ID NO: 6694240 - DNA, 21 bp, Homo sapiens
cacctgattcaactaaaaaaa

SEQ ID NO: 6694241 - DNA, 11 bp, Homo sapiens
cacctgcaaga

SEQ ID NO: 6694242 - DNA, 20 bp, Homo sapiens
cacctgcaagccccagggcc

SEQ ID NO: 6694243 - DNA, 15 bp, Homo sapiens
cacctgcaagtgccc

SEQ ID NO: 6694244 - DNA, 14 bp, Homo sapiens
cacctgcaatccca

SEQ ID NO: 6694245 - DNA, 15 bp, Homo sapiens
cacctgcaatcccag

SEQ ID NO: 6694246 - DNA, 15 bp, Homo sapiens
cacctgcacaaacat

SEQ ID NO: 6694247 - DNA, 23 bp, Homo sapiens
cacctgcacaaacatagacagat

SEQ ID NO: 6694248 - DNA, 12 bp, Homo sapiens
cacctgcacacc

SEQ ID NO: 6694249 - DNA, 17 bp, Homo sapiens
cacctgcacacccctgc

SEQ ID NO: 6694250 - DNA, 20 bp, Homo sapiens
cacctgcacacccctgcaca

SEQ ID NO: 6694251 - DNA, 22 bp, Homo sapiens
cacctgcacaccgtccctctcc

SEQ ID NO: 6694252 - DNA, 12 bp, Homo sapiens
cacctgcacact

SEQ ID NO: 6694253 - DNA, 20 bp, Homo sapiens
cacctgcacactccatctcc

SEQ ID NO: 6694254 - DNA, 20 bp, Homo sapiens
cacctgcacagggccctctg

SEQ ID NO: 6694255 - DNA, 22 bp, Homo sapiens
cacctgcacaggtatttttgaa

SEQ ID NO: 6694256 - DNA, 12 bp, Homo sapiens
cacctgcacatt

SEQ ID NO: 6694257 - DNA, 14 bp, Homo sapiens
cacctgcacctccc

SEQ ID NO: 6694258 - DNA, 20 bp, Homo sapiens
cacctgcactccatccagct

SEQ ID NO: 6694259 - DNA, 14 bp, Homo sapiens
cacctgcagccaag

SEQ ID NO: 6694260 - DNA, 18 bp, Homo sapiens
cacctgcagccccaggcc

SEQ ID NO: 6694261 - DNA, 16 bp, Homo sapiens
cacctgcagctccctc

SEQ ID NO: 6694262 - DNA, 13 bp, Homo sapiens
cacctgcaggacc

SEQ ID NO: 6694263 - DNA, 15 bp, Homo sapiens
cacctgcaggaccct

SEQ ID NO: 6694264 - DNA, 12 bp, Homo sapiens
cacctgcaggga

SEQ ID NO: 6694265 - DNA, 18 bp, Homo sapiens
cacctgcaggttgggcca

SEQ ID NO: 6694266 - DNA, 23 bp, Homo sapiens
cacctgcaggttgggccatactg

SEQ ID NO: 6694267 - DNA, 17 bp, Homo sapiens
cacctgcagtgccagct

SEQ ID NO: 6694268 - DNA, 11 bp, Homo sapiens
cacctgccaca

SEQ ID NO: 6694269 - DNA, 11 bp, Homo sapiens
cacctgccacc

SEQ ID NO: 6694270 - DNA, 16 bp, Homo sapiens
cacctgccaccacaca

SEQ ID NO: 6694271 - DNA, 21 bp, Homo sapiens
cacctgccactaggctgggtg

SEQ ID NO: 6694272 - DNA, 14 bp, Homo sapiens
cacctgccagccat

SEQ ID NO: 6694273 - DNA, 17 bp, Homo sapiens
cacctgccagccatcac

SEQ ID NO: 6694274 - DNA, 13 bp, Homo sapiens
cacctgccagcct

SEQ ID NO: 6694275 - DNA, 20 bp, Homo sapiens
cacctgccagcctggcttct

SEQ ID NO: 6694276 - DNA, 15 bp, Homo sapiens
cacctgccaggcctc

SEQ ID NO: 6694277 - DNA, 17 bp, Homo sapiens
cacctgccaggcctccc

SEQ ID NO: 6694278 - DNA, 14 bp, Homo sapiens
cacctgccaggctg

SEQ ID NO: 6694279 - DNA, 16 bp, Homo sapiens
cacctgccagggacag

SEQ ID NO: 6694280 - DNA, 13 bp, Homo sapiens
cacctgccagggc

SEQ ID NO: 6694281 - DNA, 22 bp, Homo sapiens
cacctgccatttgcaccctccg

SEQ ID NO: 6694282 - DNA, 11 bp, Homo sapiens
cacctgcccag

SEQ ID NO: 6694283 - DNA, 21 bp, Homo sapiens
cacctgcccagttagcccggc

SEQ ID NO: 6694284 - DNA, 15 bp, Homo sapiens
cacctgccccaactc

SEQ ID NO: 6694285 - DNA, 13 bp, Homo sapiens
cacctgccccagc

SEQ ID NO: 6694286 - DNA, 22 bp, Homo sapiens
cacctgccccagcgcggcttgg

SEQ ID NO: 6694287 - DNA, 21 bp, Homo sapiens
cacctgcccccttctcccaca

SEQ ID NO: 6694288 - DNA, 22 bp, Homo sapiens
cacctgcccccttctcccacac

SEQ ID NO: 6694289 - DNA, 23 bp, Homo sapiens
cacctgcccccttctcccacact

SEQ ID NO: 6694290 - DNA, 14 bp, Homo sapiens
cacctgccccgtgt

SEQ ID NO: 6694291 - DNA, 21 bp, Homo sapiens
cacctgccccgtgtgtgtggc

SEQ ID NO: 6694292 - DNA, 15 bp, Homo sapiens
cacctgcccctcaac

SEQ ID NO: 6694293 - DNA, 18 bp, Homo sapiens
cacctgcccctcaactct

SEQ ID NO: 6694294 - DNA, 20 bp, Homo sapiens
cacctgcccctctgttctct

SEQ ID NO: 6694295 - DNA, 20 bp, Homo sapiens
cacctgcccggcccaggagc

SEQ ID NO: 6694296 - DNA, 14 bp, Homo sapiens
cacctgccctgccc

SEQ ID NO: 6694297 - DNA, 16 bp, Homo sapiens
cacctgccctgccctg

SEQ ID NO: 6694298 - DNA, 17 bp, Homo sapiens
cacctgccctgccctgc

SEQ ID NO: 6694299 - DNA, 22 bp, Homo sapiens
cacctgccctgccctgccacct

SEQ ID NO: 6694300 - DNA, 21 bp, Homo sapiens
cacctgccgacctcgtcctcc

SEQ ID NO: 6694301 - DNA, 23 bp, Homo sapiens
cacctgccgacctcgtcctcccc

SEQ ID NO: 6694302 - DNA, 17 bp, Homo sapiens
cacctgccgctgcttga

SEQ ID NO: 6694303 - DNA, 15 bp, Homo sapiens
cacctgccggctctg

SEQ ID NO: 6694304 - DNA, 21 bp, Homo sapiens
cacctgccggctctgggctgg

SEQ ID NO: 6694305 - DNA, 15 bp, Homo sapiens
cacctgcctagctct

SEQ ID NO: 6694306 - DNA, 18 bp, Homo sapiens
cacctgcctagctcttgg

SEQ ID NO: 6694307 - DNA, 20 bp, Homo sapiens
cacctgcctagctcttgggc

SEQ ID NO: 6694308 - DNA, 23 bp, Homo sapiens
cacctgcctagctcttgggcctg

SEQ ID NO: 6694309 - DNA, 22 bp, Homo sapiens
cacctgcctaggtttttcctac

SEQ ID NO: 6694310 - DNA, 13 bp, Homo sapiens
cacctgcctcagc

SEQ ID NO: 6694311 - DNA, 14 bp, Homo sapiens
cacctgcctcagga

SEQ ID NO: 6694312 - DNA, 20 bp, Homo sapiens
cacctgcctcaggactgcga

SEQ ID NO: 6694313 - DNA, 12 bp, Homo sapiens
cacctgcctcca

SEQ ID NO: 6694314 - DNA, 15 bp, Homo sapiens
cacctgcctccacca

SEQ ID NO: 6694315 - DNA, 17 bp, Homo sapiens
cacctgcctctgaactg

SEQ ID NO: 6694316 - DNA, 21 bp, Homo sapiens
cacctgcctctgaactgctgc

SEQ ID NO: 6694317 - DNA, 18 bp, Homo sapiens
cacctgcctgcagagcag

SEQ ID NO: 6694318 - DNA, 15 bp, Homo sapiens
cacctgcctgcgtct

SEQ ID NO: 6694319 - DNA, 23 bp, Homo sapiens
cacctgcctgcgtcttccgcccc

SEQ ID NO: 6694320 - DNA, 11 bp, Homo sapiens
cacctgcctgg

SEQ ID NO: 6694321 - DNA, 12 bp, Homo sapiens
cacctgcctggc

SEQ ID NO: 6694322 - DNA, 21 bp, Homo sapiens
cacctgcctggccggccagcc

SEQ ID NO: 6694323 - DNA, 18 bp, Homo sapiens
cacctgcctgttaggaga

SEQ ID NO: 6694324 - DNA, 23 bp, Homo sapiens
cacctgcctgttaggagaagctg

SEQ ID NO: 6694325 - DNA, 24 bp, Homo sapiens
cacctgcctgttgggccaggagcc

SEQ ID NO: 6694326 - DNA, 15 bp, Homo sapiens
cacctgccttatgca

SEQ ID NO: 6694327 - DNA, 16 bp, Homo sapiens
cacctgccttatgcaa

SEQ ID NO: 6694328 - DNA, 16 bp, Homo sapiens
cacctgcgcacaggtg

SEQ ID NO: 6694329 - DNA, 16 bp, Homo sapiens
cacctgcgcctggctc

SEQ ID NO: 6694330 - DNA, 19 bp, Homo sapiens
cacctgcgcctggctctgt

SEQ ID NO: 6694331 - DNA, 23 bp, Homo sapiens
cacctgcgcttctgctggaggag

SEQ ID NO: 6694332 - DNA, 17 bp, Homo sapiens
cacctgcggtgctatct

SEQ ID NO: 6694333 - DNA, 23 bp, Homo sapiens
cacctgcggtgctatctccccca

SEQ ID NO: 6694334 - DNA, 22 bp, Homo sapiens
cacctgctagtcgcccctcaga

SEQ ID NO: 6694335 - DNA, 18 bp, Homo sapiens
cacctgctcacagggatg

SEQ ID NO: 6694336 - DNA, 14 bp, Homo sapiens
cacctgctcactgg

SEQ ID NO: 6694337 - DNA, 11 bp, Homo sapiens
cacctgctcca

SEQ ID NO: 6694338 - DNA, 11 bp, Homo sapiens
cacctgctccc

SEQ ID NO: 6694339 - DNA, 13 bp, Homo sapiens
cacctgctcccac

SEQ ID NO: 6694340 - DNA, 14 bp, Homo sapiens
cacctgctcccagg

SEQ ID NO: 6694341 - DNA, 22 bp, Homo sapiens
cacctgctcccaggccccaggc

SEQ ID NO: 6694342 - DNA, 14 bp, Homo sapiens
cacctgctcccagt

SEQ ID NO: 6694343 - DNA, 23 bp, Homo sapiens
cacctgctcccagtcctgcctga

SEQ ID NO: 6694344 - DNA, 12 bp, Homo sapiens
cacctgctctgc

SEQ ID NO: 6694345 - DNA, 13 bp, Homo sapiens
cacctgctctgct

SEQ ID NO: 6694346 - DNA, 14 bp, Homo sapiens
cacctgctcttcta

SEQ ID NO: 6694347 - DNA, 18 bp, Homo sapiens
cacctgctgagagaccca

SEQ ID NO: 6694348 - DNA, 13 bp, Homo sapiens
cacctgctgcgct

SEQ ID NO: 6694349 - DNA, 14 bp, Homo sapiens
cacctgctgcgctt

SEQ ID NO: 6694350 - DNA, 15 bp, Homo sapiens
cacctgctgcgcttg

SEQ ID NO: 6694351 - DNA, 14 bp, Homo sapiens
cacctgctgcgtcc

SEQ ID NO: 6694352 - DNA, 14 bp, Homo sapiens
cacctgctgctgta

SEQ ID NO: 6694353 - DNA, 10 bp, Homo sapiens
cacctgctgg

SEQ ID NO: 6694354 - DNA, 22 bp, Homo sapiens
cacctgctggaaaccacacttc

SEQ ID NO: 6694355 - DNA, 16 bp, Homo sapiens
cacctgctggcccctc

SEQ ID NO: 6694356 - DNA, 17 bp, Homo sapiens
cacctgctggcccctca

SEQ ID NO: 6694357 - DNA, 18 bp, Homo sapiens
cacctgctggcccctcac

SEQ ID NO: 6694358 - DNA, 20 bp, Homo sapiens
cacctgctggcccctcacct

SEQ ID NO: 6694359 - DNA, 20 bp, Homo sapiens
cacctgcttccacccgtctc

SEQ ID NO: 6694360 - DNA, 17 bp, Homo sapiens
cacctgcttcccccact

SEQ ID NO: 6694361 - DNA, 13 bp, Homo sapiens
cacctgcttctca

SEQ ID NO: 6694362 - DNA, 15 bp, Homo sapiens
cacctgcttctcagc

SEQ ID NO: 6694363 - DNA, 18 bp, Homo sapiens
cacctgcttctctgccca

SEQ ID NO: 6694364 - DNA, 18 bp, Homo sapiens
cacctgcttctgaactca

SEQ ID NO: 6694365 - DNA, 19 bp, Homo sapiens
cacctggaaactgctcaga

SEQ ID NO: 6694366 - DNA, 18 bp, Homo sapiens
cacctggacacacactca

SEQ ID NO: 6694367 - DNA, 22 bp, Homo sapiens
cacctggaccatttgattgttt

SEQ ID NO: 6694368 - DNA, 11 bp, Homo sapiens
cacctggaccc

SEQ ID NO: 6694369 - DNA, 16 bp, Homo sapiens
cacctggactgagcca

SEQ ID NO: 6694370 - DNA, 23 bp, Homo sapiens
cacctggagcccacagagtctgt

SEQ ID NO: 6694371 - DNA, 14 bp, Homo sapiens
cacctggagcccgc

SEQ ID NO: 6694372 - DNA, 23 bp, Homo sapiens
cacctggagcccgcttcaagctc

SEQ ID NO: 6694373 - DNA, 12 bp, Homo sapiens
cacctggagggc

SEQ ID NO: 6694374 - DNA, 20 bp, Homo sapiens
cacctggaggggcaccaggt

SEQ ID NO: 6694375 - DNA, 18 bp, Homo sapiens
cacctggatggatctgct

SEQ ID NO: 6694376 - DNA, 15 bp, Homo sapiens
cacctggcacattca

SEQ ID NO: 6694377 - DNA, 19 bp, Homo sapiens
cacctggccacctgaggtg

SEQ ID NO: 6694378 - DNA, 15 bp, Homo sapiens
cacctggccaggatt

SEQ ID NO: 6694379 - DNA, 11 bp, Homo sapiens
cacctggcccc

SEQ ID NO: 6694380 - DNA, 15 bp, Homo sapiens
cacctggccccatgt

SEQ ID NO: 6694381 - DNA, 16 bp, Homo sapiens
cacctggccccatgtc

SEQ ID NO: 6694382 - DNA, 20 bp, Homo sapiens
cacctggccccctcagctct

SEQ ID NO: 6694383 - DNA, 18 bp, Homo sapiens
cacctggccccttctcca

SEQ ID NO: 6694384 - DNA, 20 bp, Homo sapiens
cacctggccccttctccagc

SEQ ID NO: 6694385 - DNA, 11 bp, Homo sapiens
cacctggccct

SEQ ID NO: 6694386 - DNA, 13 bp, Homo sapiens
cacctggccctgc

SEQ ID NO: 6694387 - DNA, 15 bp, Homo sapiens
cacctggccctgctt

SEQ ID NO: 6694388 - DNA, 16 bp, Homo sapiens
cacctggccctgcttc

SEQ ID NO: 6694389 - DNA, 22 bp, Homo sapiens
cacctggccctgcttcctgctt

SEQ ID NO: 6694390 - DNA, 17 bp, Homo sapiens
cacctggccctggggcc

SEQ ID NO: 6694391 - DNA, 19 bp, Homo sapiens
cacctggccctggggcctg

SEQ ID NO: 6694392 - DNA, 19 bp, Homo sapiens
cacctggccgcctccagga

SEQ ID NO: 6694393 - DNA, 20 bp, Homo sapiens
cacctggccgcctccaggag

SEQ ID NO: 6694394 - DNA, 21 bp, Homo sapiens
cacctggccgcctccaggagc

SEQ ID NO: 6694395 - DNA, 23 bp, Homo sapiens
cacctggccgcctccaggagcct

SEQ ID NO: 6694396 - DNA, 19 bp, Homo sapiens
cacctggccgggtcaccct

SEQ ID NO: 6694397 - DNA, 23 bp, Homo sapiens
cacctggccgggtcaccctgtga

SEQ ID NO: 6694398 - DNA, 17 bp, Homo sapiens
cacctggcctctgcact

SEQ ID NO: 6694399 - DNA, 14 bp, Homo sapiens
cacctggcctgctg

SEQ ID NO: 6694400 - DNA, 17 bp, Homo sapiens
cacctggcctgctggga

SEQ ID NO: 6694401 - DNA, 22 bp, Homo sapiens
cacctggcctgggccacacctg

SEQ ID NO: 6694402 - DNA, 23 bp, Homo sapiens
cacctggccttaaagagggacag

SEQ ID NO: 6694403 - DNA, 14 bp, Homo sapiens
cacctggcggagct

SEQ ID NO: 6694404 - DNA, 21 bp, Homo sapiens
cacctggcggagctctcctcc

SEQ ID NO: 6694405 - DNA, 12 bp, Homo sapiens
cacctggctccc

SEQ ID NO: 6694406 - DNA, 18 bp, Homo sapiens
cacctggctctcacctct

SEQ ID NO: 6694407 - DNA, 13 bp, Homo sapiens
cacctggctctgt

SEQ ID NO: 6694408 - DNA, 23 bp, Homo sapiens
cacctggctgaggttcctctgcc

SEQ ID NO: 6694409 - DNA, 17 bp, Homo sapiens
cacctggcttcccagga

SEQ ID NO: 6694410 - DNA, 21 bp, Homo sapiens
cacctgggaaaacagaggaat

SEQ ID NO: 6694411 - DNA, 14 bp, Homo sapiens
cacctgggaacaca

SEQ ID NO: 6694412 - DNA, 17 bp, Homo sapiens
cacctgggagaaatctg

SEQ ID NO: 6694413 - DNA, 20 bp, Homo sapiens
cacctgggagaaggtctcca

SEQ ID NO: 6694414 - DNA, 21 bp, Homo sapiens
cacctgggagaaggtctccaa

SEQ ID NO: 6694415 - DNA, 16 bp, Homo sapiens
cacctgggagatgctg

SEQ ID NO: 6694416 - DNA, 17 bp, Homo sapiens
cacctgggagatgctgg

SEQ ID NO: 6694417 - DNA, 12 bp, Homo sapiens
cacctgggcacc

SEQ ID NO: 6694418 - DNA, 15 bp, Homo sapiens
cacctgggcagctcc

SEQ ID NO: 6694419 - DNA, 23 bp, Homo sapiens
cacctgggcagggatgatggcag

SEQ ID NO: 6694420 - DNA, 18 bp, Homo sapiens
cacctgggccaccatgca

SEQ ID NO: 6694421 - DNA, 17 bp, Homo sapiens
cacctgggccccactgg

SEQ ID NO: 6694422 - DNA, 22 bp, Homo sapiens
cacctgggcccgggcaggccag

SEQ ID NO: 6694423 - DNA, 14 bp, Homo sapiens
cacctgggccctgg

SEQ ID NO: 6694424 - DNA, 19 bp, Homo sapiens
cacctgggccctggggcct

SEQ ID NO: 6694425 - DNA, 20 bp, Homo sapiens
cacctgggccctggggcctg

SEQ ID NO: 6694426 - DNA, 22 bp, Homo sapiens
cacctgggccctggggcctgta

SEQ ID NO: 6694427 - DNA, 14 bp, Homo sapiens
cacctgggcctccc

SEQ ID NO: 6694428 - DNA, 12 bp, Homo sapiens
cacctgggcctt

SEQ ID NO: 6694429 - DNA, 11 bp, Homo sapiens
cacctgggctg

SEQ ID NO: 6694430 - DNA, 12 bp, Homo sapiens
cacctgggctgg

SEQ ID NO: 6694431 - DNA, 16 bp, Homo sapiens
cacctgggctgggaga

SEQ ID NO: 6694432 - DNA, 16 bp, Homo sapiens
cacctgggctgggcgc

SEQ ID NO: 6694433 - DNA, 19 bp, Homo sapiens
cacctgggcttaagaaatc

SEQ ID NO: 6694434 - DNA, 15 bp, Homo sapiens
cacctgggctttctg

SEQ ID NO: 6694435 - DNA, 15 bp, Homo sapiens
cacctggggagtggg

SEQ ID NO: 6694436 - DNA, 14 bp, Homo sapiens
cacctggggcagtc

SEQ ID NO: 6694437 - DNA, 17 bp, Homo sapiens
cacctggggtctctctc

SEQ ID NO: 6694438 - DNA, 21 bp, Homo sapiens
cacctggggtgctgcctctca

SEQ ID NO: 6694439 - DNA, 20 bp, Homo sapiens
cacctggggtgtgggaggcc

SEQ ID NO: 6694440 - DNA, 22 bp, Homo sapiens
cacctggggtgtgggaggcccg

SEQ ID NO: 6694441 - DNA, 19 bp, Homo sapiens
cacctgggtgctctggctg

SEQ ID NO: 6694442 - DNA, 15 bp, Homo sapiens
cacctgggttcagcc

SEQ ID NO: 6694443 - DNA, 17 bp, Homo sapiens
cacctgggtttgcaaga

SEQ ID NO: 6694444 - DNA, 15 bp, Homo sapiens
cacctggtacctgga

SEQ ID NO: 6694445 - DNA, 19 bp, Homo sapiens
cacctggtcgccaatccat

SEQ ID NO: 6694446 - DNA, 22 bp, Homo sapiens
cacctggtgcgggcctggccct

SEQ ID NO: 6694447 - DNA, 23 bp, Homo sapiens
cacctggtggatacctggttgag

SEQ ID NO: 6694448 - DNA, 16 bp, Homo sapiens
cacctggtggccatgc

SEQ ID NO: 6694449 - DNA, 17 bp, Homo sapiens
cacctggtggccctgcg

SEQ ID NO: 6694450 - DNA, 18 bp, Homo sapiens
cacctggtggccctgcgg

SEQ ID NO: 6694451 - DNA, 15 bp, Homo sapiens
cacctggtggcctct

SEQ ID NO: 6694452 - DNA, 17 bp, Homo sapiens
cacctggtggcctctgc

SEQ ID NO: 6694453 - DNA, 23 bp, Homo sapiens
cacctggtgggtggtgtcctgaa

SEQ ID NO: 6694454 - DNA, 17 bp, Homo sapiens
cacctggttatgagccg

SEQ ID NO: 6694455 - DNA, 16 bp, Homo sapiens
cacctggttccggaat

SEQ ID NO: 6694456 - DNA, 21 bp, Homo sapiens
cacctggttccggaatcctgt

SEQ ID NO: 6694457 - DNA, 23 bp, Homo sapiens
cacctggttccggaatcctgtcc

SEQ ID NO: 6694458 - DNA, 22 bp, Homo sapiens
cacctggttgacccaaaaatgt

SEQ ID NO: 6694459 - DNA, 18 bp, Homo sapiens
cacctggtttctgttctg

SEQ ID NO: 6694460 - DNA, 13 bp, Homo sapiens
cacctgtaaaact

SEQ ID NO: 6694461 - DNA, 14 bp, Homo sapiens
cacctgtaaacctg

SEQ ID NO: 6694462 - DNA, 15 bp, Homo sapiens
cacctgtaaacctga

SEQ ID NO: 6694463 - DNA, 14 bp, Homo sapiens
cacctgtaagaaac

SEQ ID NO: 6694464 - DNA, 13 bp, Homo sapiens
cacctgtaatccc

SEQ ID NO: 6694465 - DNA, 17 bp, Homo sapiens
cacctgtaatcccagca

SEQ ID NO: 6694466 - DNA, 18 bp, Homo sapiens
cacctgtaatcccagcac

SEQ ID NO: 6694467 - DNA, 18 bp, Homo sapiens
cacctgtacagtggaacc

SEQ ID NO: 6694468 - DNA, 12 bp, Homo sapiens
cacctgtacata

SEQ ID NO: 6694469 - DNA, 18 bp, Homo sapiens
cacctgtacatacattgt

SEQ ID NO: 6694470 - DNA, 15 bp, Homo sapiens
cacctgtacattctt

SEQ ID NO: 6694471 - DNA, 15 bp, Homo sapiens
cacctgtactcagga

SEQ ID NO: 6694472 - DNA, 16 bp, Homo sapiens
cacctgtactcaggag

SEQ ID NO: 6694473 - DNA, 15 bp, Homo sapiens
cacctgtactcttcc

SEQ ID NO: 6694474 - DNA, 17 bp, Homo sapiens
cacctgtactggagagc

SEQ ID NO: 6694475 - DNA, 15 bp, Homo sapiens
cacctgtagcagcca

SEQ ID NO: 6694476 - DNA, 17 bp, Homo sapiens
cacctgtagccatctgc

SEQ ID NO: 6694477 - DNA, 17 bp, Homo sapiens
cacctgtagctgaagca

SEQ ID NO: 6694478 - DNA, 21 bp, Homo sapiens
cacctgtagtcccagcacttt

SEQ ID NO: 6694479 - DNA, 18 bp, Homo sapiens
cacctgtagtcccagcta

SEQ ID NO: 6694480 - DNA, 20 bp, Homo sapiens
cacctgtagtcccagctact

SEQ ID NO: 6694481 - DNA, 22 bp, Homo sapiens
cacctgtagtcccagctacttg

SEQ ID NO: 6694482 - DNA, 22 bp, Homo sapiens
cacctgtatatttcttttaatg

SEQ ID NO: 6694483 - DNA, 21 bp, Homo sapiens
cacctgtcaaacaaagccaga

SEQ ID NO: 6694484 - DNA, 14 bp, Homo sapiens
cacctgtcccacct

SEQ ID NO: 6694485 - DNA, 16 bp, Homo sapiens
cacctgtcccacctca

SEQ ID NO: 6694486 - DNA, 20 bp, Homo sapiens
cacctgtccccaccctccac

SEQ ID NO: 6694487 - DNA, 13 bp, Homo sapiens
cacctgtccggcc

SEQ ID NO: 6694488 - DNA, 14 bp, Homo sapiens
cacctgtccggccc

SEQ ID NO: 6694489 - DNA, 19 bp, Homo sapiens
cacctgtccggcccagtgc

SEQ ID NO: 6694490 - DNA, 19 bp, Homo sapiens
cacctgtccttctcaggct

SEQ ID NO: 6694491 - DNA, 18 bp, Homo sapiens
cacctgtcggtggctgcc

SEQ ID NO: 6694492 - DNA, 17 bp, Homo sapiens
cacctgtctcagcctcc

SEQ ID NO: 6694493 - DNA, 20 bp, Homo sapiens
cacctgtctgctccagctct

SEQ ID NO: 6694494 - DNA, 12 bp, Homo sapiens
cacctgtctgtc

SEQ ID NO: 6694495 - DNA, 14 bp, Homo sapiens
cacctgtctgtctg

SEQ ID NO: 6694496 - DNA, 18 bp, Homo sapiens
cacctgtctgtgcagatg

SEQ ID NO: 6694497 - DNA, 15 bp, Homo sapiens
cacctgtcttggcct

SEQ ID NO: 6694498 - DNA, 12 bp, Homo sapiens
cacctgtgacaa

SEQ ID NO: 6694499 - DNA, 14 bp, Homo sapiens
cacctgtgagacca

SEQ ID NO: 6694500 - DNA, 11 bp, Homo sapiens
cacctgtgcac

SEQ ID NO: 6694501 - DNA, 16 bp, Homo sapiens
cacctgtgccctcacc

SEQ ID NO: 6694502 - DNA, 20 bp, Homo sapiens
cacctgtgctacctctaaca

SEQ ID NO: 6694503 - DNA, 22 bp, Homo sapiens
cacctgtggatgtttttgagta

SEQ ID NO: 6694504 - DNA, 17 bp, Homo sapiens
cacctgtggccagagca

SEQ ID NO: 6694505 - DNA, 15 bp, Homo sapiens
cacctgtgggccagc

SEQ ID NO: 6694506 - DNA, 20 bp, Homo sapiens
cacctgtggggcctggggag

SEQ ID NO: 6694507 - DNA, 20 bp, Homo sapiens
cacctgtgggtgtagccagg

SEQ ID NO: 6694508 - DNA, 22 bp, Homo sapiens
cacctgtgggtgtagccaggta

SEQ ID NO: 6694509 - DNA, 17 bp, Homo sapiens
cacctgtggtgcctgcc

SEQ ID NO: 6694510 - DNA, 14 bp, Homo sapiens
cacctgtgtgccca

SEQ ID NO: 6694511 - DNA, 20 bp, Homo sapiens
cacctgtgtgttcttttgat

SEQ ID NO: 6694512 - DNA, 21 bp, Homo sapiens
cacctgtgtgttcttttgata

SEQ ID NO: 6694513 - DNA, 17 bp, Homo sapiens
cacctgttataataaat

SEQ ID NO: 6694514 - DNA, 20 bp, Homo sapiens
cacctgttgcttacaatttt

SEQ ID NO: 6694515 - DNA, 22 bp, Homo sapiens
cacctgttggctacacagaccc

SEQ ID NO: 6694516 - DNA, 14 bp, Homo sapiens
cacctgttgtcctg

SEQ ID NO: 6694517 - DNA, 14 bp, Homo sapiens
cacctgttttctga

SEQ ID NO: 6694518 - DNA, 21 bp, Homo sapiens
cacctgttttctgaaacacac

SEQ ID NO: 6694519 - DNA, 20 bp, Homo sapiens
cacctgtttttaagctgttt

SEQ ID NO: 6694520 - DNA, 20 bp, Homo sapiens
caccttaaaattagcatctg

SEQ ID NO: 6694521 - DNA, 14 bp, Homo sapiens
caccttaaattaaa

SEQ ID NO: 6694522 - DNA, 18 bp, Homo sapiens
caccttaaattaaacaat

SEQ ID NO: 6694523 - DNA, 13 bp, Homo sapiens
caccttaactgga

SEQ ID NO: 6694524 - DNA, 22 bp, Homo sapiens
caccttaactggagaccagaaa

SEQ ID NO: 6694525 - DNA, 23 bp, Homo sapiens
caccttaatatgctgcaacaaaa

SEQ ID NO: 6694526 - DNA, 15 bp, Homo sapiens
caccttacaaagcca

SEQ ID NO: 6694527 - DNA, 18 bp, Homo sapiens
caccttaccaactttctg

SEQ ID NO: 6694528 - DNA, 19 bp, Homo sapiens
caccttaccctactggctg

SEQ ID NO: 6694529 - DNA, 21 bp, Homo sapiens
caccttaccctactggctgta

SEQ ID NO: 6694530 - DNA, 23 bp, Homo sapiens
caccttaccctactggctgtaaa

SEQ ID NO: 6694531 - DNA, 20 bp, Homo sapiens
caccttactttcccattgta

SEQ ID NO: 6694532 - DNA, 21 bp, Homo sapiens
caccttactttcccattgtaa

SEQ ID NO: 6694533 - DNA, 23 bp, Homo sapiens
caccttagacagtccctgccaat

SEQ ID NO: 6694534 - DNA, 14 bp, Homo sapiens
caccttagaccacc

SEQ ID NO: 6694535 - DNA, 20 bp, Homo sapiens
caccttagaccaccaagcct

SEQ ID NO: 6694536 - DNA, 23 bp, Homo sapiens
caccttagaccaccaagccttga

SEQ ID NO: 6694537 - DNA, 20 bp, Homo sapiens
caccttagacggaggtgcct

SEQ ID NO: 6694538 - DNA, 21 bp, Homo sapiens
caccttagacggaggtgcctg

SEQ ID NO: 6694539 - DNA, 22 bp, Homo sapiens
caccttagacggaggtgcctga

SEQ ID NO: 6694540 - DNA, 21 bp, Homo sapiens
caccttagagaagctacccct

SEQ ID NO: 6694541 - DNA, 17 bp, Homo sapiens
caccttaggaggccgag

SEQ ID NO: 6694542 - DNA, 20 bp, Homo sapiens
caccttaggaggccgaggca

SEQ ID NO: 6694543 - DNA, 18 bp, Homo sapiens
caccttaggcagggaagt

SEQ ID NO: 6694544 - DNA, 23 bp, Homo sapiens
caccttagggtggctttaattgt

SEQ ID NO: 6694545 - DNA, 16 bp, Homo sapiens
caccttatacatcact

SEQ ID NO: 6694546 - DNA, 21 bp, Homo sapiens
caccttatacatcacttcctg

SEQ ID NO: 6694547 - DNA, 22 bp, Homo sapiens
caccttatctatgatgtttctt

SEQ ID NO: 6694548 - DNA, 23 bp, Homo sapiens
caccttattagctaaaaatatat

SEQ ID NO: 6694549 - DNA, 14 bp, Homo sapiens
caccttcaaaatgt

SEQ ID NO: 6694550 - DNA, 15 bp, Homo sapiens
caccttcaaaatgtt

SEQ ID NO: 6694551 - DNA, 16 bp, Homo sapiens
caccttcaaaatgttc

SEQ ID NO: 6694552 - DNA, 17 bp, Homo sapiens
caccttcaagcgctcca

SEQ ID NO: 6694553 - DNA, 19 bp, Homo sapiens
caccttcaagcgctccagg

SEQ ID NO: 6694554 - DNA, 10 bp, Homo sapiens
caccttcacc

SEQ ID NO: 6694555 - DNA, 19 bp, Homo sapiens
caccttcaccttcatccat

SEQ ID NO: 6694556 - DNA, 14 bp, Homo sapiens
caccttcaggcccc

SEQ ID NO: 6694557 - DNA, 13 bp, Homo sapiens
caccttcagggct

SEQ ID NO: 6694558 - DNA, 18 bp, Homo sapiens
caccttcattctccgttg

SEQ ID NO: 6694559 - DNA, 19 bp, Homo sapiens
caccttccaaacaaaagca

SEQ ID NO: 6694560 - DNA, 22 bp, Homo sapiens
caccttccaaagagtgctaagc

SEQ ID NO: 6694561 - DNA, 18 bp, Homo sapiens
caccttccaacactccat

SEQ ID NO: 6694562 - DNA, 13 bp, Homo sapiens
caccttccagggc

SEQ ID NO: 6694563 - DNA, 14 bp, Homo sapiens
caccttccagggcc

SEQ ID NO: 6694564 - DNA, 18 bp, Homo sapiens
caccttccagggccctag

SEQ ID NO: 6694565 - DNA, 15 bp, Homo sapiens
caccttcccacccct

SEQ ID NO: 6694566 - DNA, 17 bp, Homo sapiens
caccttcccagctctcc

SEQ ID NO: 6694567 - DNA, 20 bp, Homo sapiens
caccttcccctaaaccccaa

SEQ ID NO: 6694568 - DNA, 11 bp, Homo sapiens
caccttccctc

SEQ ID NO: 6694569 - DNA, 15 bp, Homo sapiens
caccttccctcgact

SEQ ID NO: 6694570 - DNA, 16 bp, Homo sapiens
caccttcccttcctca

SEQ ID NO: 6694571 - DNA, 15 bp, Homo sapiens
caccttcccttgcca

SEQ ID NO: 6694572 - DNA, 21 bp, Homo sapiens
caccttcccttgccactttgc

SEQ ID NO: 6694573 - DNA, 19 bp, Homo sapiens
caccttcctcctccccgct

SEQ ID NO: 6694574 - DNA, 17 bp, Homo sapiens
caccttcctcctgcaga

SEQ ID NO: 6694575 - DNA, 18 bp, Homo sapiens
caccttcctcctgcagac

SEQ ID NO: 6694576 - DNA, 12 bp, Homo sapiens
caccttcctggg

SEQ ID NO: 6694577 - DNA, 19 bp, Homo sapiens
caccttcctgggcagccca

SEQ ID NO: 6694578 - DNA, 21 bp, Homo sapiens
caccttcctgggcagcccaga

SEQ ID NO: 6694579 - DNA, 22 bp, Homo sapiens
caccttcctgggcagcccagag

SEQ ID NO: 6694580 - DNA, 16 bp, Homo sapiens
caccttcctgtgggtg

SEQ ID NO: 6694581 - DNA, 14 bp, Homo sapiens
caccttccttgaaa

SEQ ID NO: 6694582 - DNA, 16 bp, Homo sapiens
caccttcgagtagaga

SEQ ID NO: 6694583 - DNA, 15 bp, Homo sapiens
caccttcgcctttgc

SEQ ID NO: 6694584 - DNA, 14 bp, Homo sapiens
caccttcgggcagt

SEQ ID NO: 6694585 - DNA, 21 bp, Homo sapiens
caccttcgggcagtcctgtgt

SEQ ID NO: 6694586 - DNA, 14 bp, Homo sapiens
caccttctcacatg

SEQ ID NO: 6694587 - DNA, 19 bp, Homo sapiens
caccttctgacgcagcctg

SEQ ID NO: 6694588 - DNA, 23 bp, Homo sapiens
caccttctgacgcagcctgagaa

SEQ ID NO: 6694589 - DNA, 17 bp, Homo sapiens
caccttctgccaaggcc

SEQ ID NO: 6694590 - DNA, 22 bp, Homo sapiens
caccttctgggcaagggctcct

SEQ ID NO: 6694591 - DNA, 21 bp, Homo sapiens
caccttctgtgcatctggcct

SEQ ID NO: 6694592 - DNA, 23 bp, Homo sapiens
caccttctgtgcatctggcctgg

SEQ ID NO: 6694593 - DNA, 13 bp, Homo sapiens
caccttcttggct

SEQ ID NO: 6694594 - DNA, 21 bp, Homo sapiens
caccttcttggcttctgggac

SEQ ID NO: 6694595 - DNA, 21 bp, Homo sapiens
caccttcttgggactgctgtg

SEQ ID NO: 6694596 - DNA, 22 bp, Homo sapiens
caccttcttgggactgctgtga

SEQ ID NO: 6694597 - DNA, 16 bp, Homo sapiens
caccttctttctggac

SEQ ID NO: 6694598 - DNA, 15 bp, Homo sapiens
caccttgacagggca

SEQ ID NO: 6694599 - DNA, 23 bp, Homo sapiens
caccttgagaggcatgacagctg

SEQ ID NO: 6694600 - DNA, 13 bp, Homo sapiens
caccttgagcact

SEQ ID NO: 6694601 - DNA, 23 bp, Homo sapiens
caccttgatcccaatccttatcc

SEQ ID NO: 6694602 - DNA, 21 bp, Homo sapiens
caccttgcaacacacagacac

SEQ ID NO: 6694603 - DNA, 20 bp, Homo sapiens
caccttgcactattggactt

SEQ ID NO: 6694604 - DNA, 14 bp, Homo sapiens
caccttgcactcct

SEQ ID NO: 6694605 - DNA, 23 bp, Homo sapiens
caccttgcagaaggcaaggccct

SEQ ID NO: 6694606 - DNA, 17 bp, Homo sapiens
caccttgccaaagcact

SEQ ID NO: 6694607 - DNA, 17 bp, Homo sapiens
caccttgccagggcagg

SEQ ID NO: 6694608 - DNA, 18 bp, Homo sapiens
caccttgccgagagaggc

SEQ ID NO: 6694609 - DNA, 22 bp, Homo sapiens
caccttgctcttctttctgaga

SEQ ID NO: 6694610 - DNA, 15 bp, Homo sapiens
caccttgctgcagtg

SEQ ID NO: 6694611 - DNA, 20 bp, Homo sapiens
caccttgctgcagtgtccag

SEQ ID NO: 6694612 - DNA, 15 bp, Homo sapiens
caccttgctgtgtga

SEQ ID NO: 6694613 - DNA, 16 bp, Homo sapiens
caccttgcttgaggga

SEQ ID NO: 6694614 - DNA, 21 bp, Homo sapiens
caccttggacatcctcctccc

SEQ ID NO: 6694615 - DNA, 19 bp, Homo sapiens
caccttggaccctggtgac

SEQ ID NO: 6694616 - DNA, 16 bp, Homo sapiens
caccttggactcctcc

SEQ ID NO: 6694617 - DNA, 18 bp, Homo sapiens
caccttggagcatttatg

SEQ ID NO: 6694618 - DNA, 20 bp, Homo sapiens
caccttggagcatttatgta

SEQ ID NO: 6694619 - DNA, 16 bp, Homo sapiens
caccttggaggaggat

SEQ ID NO: 6694620 - DNA, 14 bp, Homo sapiens
caccttggatggtt

SEQ ID NO: 6694621 - DNA, 12 bp, Homo sapiens
caccttggccca

SEQ ID NO: 6694622 - DNA, 12 bp, Homo sapiens
caccttggcctc

SEQ ID NO: 6694623 - DNA, 17 bp, Homo sapiens
caccttggctctgccag

SEQ ID NO: 6694624 - DNA, 21 bp, Homo sapiens
caccttggctctgccagtgga

SEQ ID NO: 6694625 - DNA, 13 bp, Homo sapiens
caccttggctgca

SEQ ID NO: 6694626 - DNA, 18 bp, Homo sapiens
caccttggctgcagggag

SEQ ID NO: 6694627 - DNA, 19 bp, Homo sapiens
caccttgggatgatgcctc

SEQ ID NO: 6694628 - DNA, 23 bp, Homo sapiens
caccttgggcacgggagagcgcc

SEQ ID NO: 6694629 - DNA, 21 bp, Homo sapiens
caccttggggtccctccaccc

SEQ ID NO: 6694630 - DNA, 16 bp, Homo sapiens
caccttggtccctctc

SEQ ID NO: 6694631 - DNA, 19 bp, Homo sapiens
caccttggtccctctcaga

SEQ ID NO: 6694632 - DNA, 22 bp, Homo sapiens
caccttggttcctggggcatcc

SEQ ID NO: 6694633 - DNA, 22 bp, Homo sapiens
caccttgtacagaaccagcact

SEQ ID NO: 6694634 - DNA, 16 bp, Homo sapiens
caccttgtcaacctct

SEQ ID NO: 6694635 - DNA, 15 bp, Homo sapiens
caccttgtcgctgaa

SEQ ID NO: 6694636 - DNA, 21 bp, Homo sapiens
caccttgtgtctgtacacgtg

SEQ ID NO: 6694637 - DNA, 12 bp, Homo sapiens
caccttgtgttt

SEQ ID NO: 6694638 - DNA, 13 bp, Homo sapiens
caccttgttacaa

SEQ ID NO: 6694639 - DNA, 19 bp, Homo sapiens
caccttgttggagcctgca

SEQ ID NO: 6694640 - DNA, 21 bp, Homo sapiens
caccttgttggagcctgcagg

SEQ ID NO: 6694641 - DNA, 14 bp, Homo sapiens
cacctttaaagtgt

SEQ ID NO: 6694642 - DNA, 20 bp, Homo sapiens
cacctttaagtagataagca

SEQ ID NO: 6694643 - DNA, 22 bp, Homo sapiens
cacctttactgtgcttattttt

SEQ ID NO: 6694644 - DNA, 14 bp, Homo sapiens
cacctttagaatat

SEQ ID NO: 6694645 - DNA, 22 bp, Homo sapiens
cacctttagaatattaaaaatt

SEQ ID NO: 6694646 - DNA, 23 bp, Homo sapiens
cacctttattctggcagaggagg

SEQ ID NO: 6694647 - DNA, 15 bp, Homo sapiens
cacctttattttatt

SEQ ID NO: 6694648 - DNA, 12 bp, Homo sapiens
cacctttcaacc

SEQ ID NO: 6694649 - DNA, 15 bp, Homo sapiens
cacctttccaaggcc

SEQ ID NO: 6694650 - DNA, 16 bp, Homo sapiens
cacctttcccacctct

SEQ ID NO: 6694651 - DNA, 20 bp, Homo sapiens
cacctttcctctaatccagc

SEQ ID NO: 6694652 - DNA, 18 bp, Homo sapiens
cacctttcctctccctca

SEQ ID NO: 6694653 - DNA, 23 bp, Homo sapiens
cacctttcctctccctcaggggc

SEQ ID NO: 6694654 - DNA, 20 bp, Homo sapiens
cacctttctcgctggaatca

SEQ ID NO: 6694655 - DNA, 13 bp, Homo sapiens
cacctttctggct

SEQ ID NO: 6694656 - DNA, 16 bp, Homo sapiens
cacctttctgggcttt

SEQ ID NO: 6694657 - DNA, 19 bp, Homo sapiens
cacctttctgggctttctc

SEQ ID NO: 6694658 - DNA, 16 bp, Homo sapiens
cacctttgagagaggg

SEQ ID NO: 6694659 - DNA, 15 bp, Homo sapiens
cacctttgcaaagtt

SEQ ID NO: 6694660 - DNA, 14 bp, Homo sapiens
cacctttgggatca

SEQ ID NO: 6694661 - DNA, 17 bp, Homo sapiens
cacctttgggatcagcc

SEQ ID NO: 6694662 - DNA, 23 bp, Homo sapiens
cacctttgggatcagcctccgcc

SEQ ID NO: 6694663 - DNA, 16 bp, Homo sapiens
cacctttgtaagacat

SEQ ID NO: 6694664 - DNA, 11 bp, Homo sapiens
cacctttgtct

SEQ ID NO: 6694665 - DNA, 16 bp, Homo sapiens
cacctttgtctggatg

SEQ ID NO: 6694666 - DNA, 23 bp, Homo sapiens
cacctttgtggggtttttggaga

SEQ ID NO: 6694667 - DNA, 21 bp, Homo sapiens
cacctttgtgtatttttcaat

SEQ ID NO: 6694668 - DNA, 23 bp, Homo sapiens
caccttttaaatcctgttgaaaa

SEQ ID NO: 6694669 - DNA, 21 bp, Homo sapiens
caccttttaggctgcatatgg

SEQ ID NO: 6694670 - DNA, 14 bp, Homo sapiens
caccttttatgaat

SEQ ID NO: 6694671 - DNA, 21 bp, Homo sapiens
caccttttatgaatcaaatat

SEQ ID NO: 6694672 - DNA, 23 bp, Homo sapiens
caccttttcatgtacagcattaa

SEQ ID NO: 6694673 - DNA, 21 bp, Homo sapiens
caccttttccaggagttctga

SEQ ID NO: 6694674 - DNA, 16 bp, Homo sapiens
caccttttccccagga

SEQ ID NO: 6694675 - DNA, 17 bp, Homo sapiens
caccttttctgtggctg

SEQ ID NO: 6694676 - DNA, 21 bp, Homo sapiens
caccttttctgtggctggctc

SEQ ID NO: 6694677 - DNA, 17 bp, Homo sapiens
cacctttttaaatccta

SEQ ID NO: 6694678 - DNA, 20 bp, Homo sapiens
cacctttttaataaaaatac

SEQ ID NO: 6694679 - DNA, 17 bp, Homo sapiens
caccttttttcaacagt

SEQ ID NO: 6694680 - DNA, 20 bp, Homo sapiens
caccttttttcaccccacac

SEQ ID NO: 6694681 - DNA, 16 bp, Homo sapiens
cacgaaactgccctgg

SEQ ID NO: 6694682 - DNA, 14 bp, Homo sapiens
cacgaaacttgtta

SEQ ID NO: 6694683 - DNA, 22 bp, Homo sapiens
cacgaaacttgttattgtgaat

SEQ ID NO: 6694684 - DNA, 16 bp, Homo sapiens
cacgaactgttcacac

SEQ ID NO: 6694685 - DNA, 18 bp, Homo sapiens
cacgaagccttaagccat

SEQ ID NO: 6694686 - DNA, 19 bp, Homo sapiens
cacgaagccttaagccata

SEQ ID NO: 6694687 - DNA, 18 bp, Homo sapiens
cacgaagtgttgcatgga

SEQ ID NO: 6694688 - DNA, 19 bp, Homo sapiens
cacgaatattgctgatggt

SEQ ID NO: 6694689 - DNA, 17 bp, Homo sapiens
cacgaatttctgtgccc

SEQ ID NO: 6694690 - DNA, 18 bp, Homo sapiens
cacgacaaaaacaagact

SEQ ID NO: 6694691 - DNA, 12 bp, Homo sapiens
cacgaccagccc

SEQ ID NO: 6694692 - DNA, 22 bp, Homo sapiens
cacgaccagccccttcctgggt

SEQ ID NO: 6694693 - DNA, 15 bp, Homo sapiens
cacgacccctgcctc

SEQ ID NO: 6694694 - DNA, 16 bp, Homo sapiens
cacgacccctgcctcg

SEQ ID NO: 6694695 - DNA, 17 bp, Homo sapiens
cacgactgcgggagcca

SEQ ID NO: 6694696 - DNA, 18 bp, Homo sapiens
cacgactgcgggagccag

SEQ ID NO: 6694697 - DNA, 23 bp, Homo sapiens
cacgactgcgggagccagactgt

SEQ ID NO: 6694698 - DNA, 15 bp, Homo sapiens
cacgactggtcacct

SEQ ID NO: 6694699 - DNA, 18 bp, Homo sapiens
cacgagagcgcagcatcc

SEQ ID NO: 6694700 - DNA, 18 bp, Homo sapiens
cacgagatcttccttccg

SEQ ID NO: 6694701 - DNA, 21 bp, Homo sapiens
cacgagatcttccttccgctc

SEQ ID NO: 6694702 - DNA, 20 bp, Homo sapiens
cacgagatttcttttttatg

SEQ ID NO: 6694703 - DNA, 14 bp, Homo sapiens
cacgagcacaatgg

SEQ ID NO: 6694704 - DNA, 17 bp, Homo sapiens
cacgagcaggctactgt

SEQ ID NO: 6694705 - DNA, 22 bp, Homo sapiens
cacgagcaggctactgtcagct

SEQ ID NO: 6694706 - DNA, 20 bp, Homo sapiens
cacgagccacaagctgcact

SEQ ID NO: 6694707 - DNA, 21 bp, Homo sapiens
cacgagccacaagctgcactg

SEQ ID NO: 6694708 - DNA, 15 bp, Homo sapiens
cacgagcctgggcga

SEQ ID NO: 6694709 - DNA, 21 bp, Homo sapiens
cacgaggagcttccagtgcat

SEQ ID NO: 6694710 - DNA, 20 bp, Homo sapiens
cacgaggaggaaccaggcta

SEQ ID NO: 6694711 - DNA, 23 bp, Homo sapiens
cacgaggctgattcctctcattt

SEQ ID NO: 6694712 - DNA, 12 bp, Homo sapiens
cacgaggctgcc

SEQ ID NO: 6694713 - DNA, 17 bp, Homo sapiens
cacgagggctggctggc

SEQ ID NO: 6694714 - DNA, 14 bp, Homo sapiens
cacgaggggaccca

SEQ ID NO: 6694715 - DNA, 17 bp, Homo sapiens
cacgaggggacccatgg

SEQ ID NO: 6694716 - DNA, 18 bp, Homo sapiens
cacgaggggacccatggg

SEQ ID NO: 6694717 - DNA, 14 bp, Homo sapiens
cacgagggtctccc

SEQ ID NO: 6694718 - DNA, 15 bp, Homo sapiens
cacgaggtcaggaga

SEQ ID NO: 6694719 - DNA, 14 bp, Homo sapiens
cacgaggtgcagta

SEQ ID NO: 6694720 - DNA, 20 bp, Homo sapiens
cacgaggtggtagctctgag

SEQ ID NO: 6694721 - DNA, 23 bp, Homo sapiens
cacgaggtggtagctctgagccc

SEQ ID NO: 6694722 - DNA, 19 bp, Homo sapiens
cacgagtcacctgcaagcc

SEQ ID NO: 6694723 - DNA, 20 bp, Homo sapiens
cacgagtcacctgcaagccc

SEQ ID NO: 6694724 - DNA, 17 bp, Homo sapiens
cacgagtgttcctgtgc

SEQ ID NO: 6694725 - DNA, 15 bp, Homo sapiens
cacgatcacaggcct

SEQ ID NO: 6694726 - DNA, 17 bp, Homo sapiens
cacgatcacaggccttg

SEQ ID NO: 6694727 - DNA, 17 bp, Homo sapiens
cacgatccgcaacccat

SEQ ID NO: 6694728 - DNA, 19 bp, Homo sapiens
cacgatccgcaacccatgc

SEQ ID NO: 6694729 - DNA, 19 bp, Homo sapiens
cacgatcctgccaccctgt

SEQ ID NO: 6694730 - DNA, 19 bp, Homo sapiens
cacgatcggccttggtaac

SEQ ID NO: 6694731 - DNA, 14 bp, Homo sapiens
cacgatctcagctc

SEQ ID NO: 6694732 - DNA, 16 bp, Homo sapiens
cacgatctcagctcac

SEQ ID NO: 6694733 - DNA, 18 bp, Homo sapiens
cacgatgacgcctctgga

SEQ ID NO: 6694734 - DNA, 21 bp, Homo sapiens
cacgatgacgcctctggacct

SEQ ID NO: 6694735 - DNA, 18 bp, Homo sapiens
cacgatgcatttaataaa

SEQ ID NO: 6694736 - DNA, 16 bp, Homo sapiens
cacgatgcctttgagt

SEQ ID NO: 6694737 - DNA, 16 bp, Homo sapiens
cacgatgtggccctgg

SEQ ID NO: 6694738 - DNA, 21 bp, Homo sapiens
cacgatgtggccctggcctgc

SEQ ID NO: 6694739 - DNA, 20 bp, Homo sapiens
cacgattacgtgaataaaat

SEQ ID NO: 6694740 - DNA, 18 bp, Homo sapiens
cacgattccagtgcagta

SEQ ID NO: 6694741 - DNA, 14 bp, Homo sapiens
cacgattggagaat

SEQ ID NO: 6694742 - DNA, 22 bp, Homo sapiens
cacgattggtatgatgctgccg

SEQ ID NO: 6694743 - DNA, 11 bp, Homo sapiens
cacgattttaa

SEQ ID NO: 6694744 - DNA, 16 bp, Homo sapiens
cacgattttaaaatga

SEQ ID NO: 6694745 - DNA, 18 bp, Homo sapiens
cacgcaaatacactccag

SEQ ID NO: 6694746 - DNA, 16 bp, Homo sapiens
cacgcaaggctgtgct

SEQ ID NO: 6694747 - DNA, 17 bp, Homo sapiens
cacgcaagggcatcagg

SEQ ID NO: 6694748 - DNA, 20 bp, Homo sapiens
cacgcaagggcatcaggcac

SEQ ID NO: 6694749 - DNA, 21 bp, Homo sapiens
cacgcacaaacacacacacta

SEQ ID NO: 6694750 - DNA, 13 bp, Homo sapiens
cacgcacacacac

SEQ ID NO: 6694751 - DNA, 14 bp, Homo sapiens
cacgcacacacaca

SEQ ID NO: 6694752 - DNA, 22 bp, Homo sapiens
cacgcacacacacacacaggag

SEQ ID NO: 6694753 - DNA, 21 bp, Homo sapiens
cacgcacacatcttacctctc

SEQ ID NO: 6694754 - DNA, 13 bp, Homo sapiens
cacgcacacatgg

SEQ ID NO: 6694755 - DNA, 21 bp, Homo sapiens
cacgcacatgcgaccccgagg

SEQ ID NO: 6694756 - DNA, 17 bp, Homo sapiens
cacgcaccactgcttcc

SEQ ID NO: 6694757 - DNA, 20 bp, Homo sapiens
cacgcaccactgcttcccac

SEQ ID NO: 6694758 - DNA, 16 bp, Homo sapiens
cacgcacccacaccct

SEQ ID NO: 6694759 - DNA, 13 bp, Homo sapiens
cacgcaccccgcc

SEQ ID NO: 6694760 - DNA, 17 bp, Homo sapiens
cacgcaccccgcccctg

SEQ ID NO: 6694761 - DNA, 16 bp, Homo sapiens
cacgcacctgcctcag

SEQ ID NO: 6694762 - DNA, 13 bp, Homo sapiens
cacgcacctgggt

SEQ ID NO: 6694763 - DNA, 19 bp, Homo sapiens
cacgcacgacgtcagcctc

SEQ ID NO: 6694764 - DNA, 12 bp, Homo sapiens
cacgcacgcaca

SEQ ID NO: 6694765 - DNA, 17 bp, Homo sapiens
cacgcacggcttcctat

SEQ ID NO: 6694766 - DNA, 21 bp, Homo sapiens
cacgcactctccccgctcagg

SEQ ID NO: 6694767 - DNA, 19 bp, Homo sapiens
cacgcactgcgtagagcct

SEQ ID NO: 6694768 - DNA, 20 bp, Homo sapiens
cacgcactgcgtagagcctg

SEQ ID NO: 6694769 - DNA, 16 bp, Homo sapiens
cacgcactgggccacg

SEQ ID NO: 6694770 - DNA, 18 bp, Homo sapiens
cacgcactgggccacgga

SEQ ID NO: 6694771 - DNA, 23 bp, Homo sapiens
cacgcactgggccacggaggagg

SEQ ID NO: 6694772 - DNA, 18 bp, Homo sapiens
cacgcacttctggggcca

SEQ ID NO: 6694773 - DNA, 21 bp, Homo sapiens
cacgcacttctggggccagcc

SEQ ID NO: 6694774 - DNA, 21 bp, Homo sapiens
cacgcacttgcctgttggctg

SEQ ID NO: 6694775 - DNA, 13 bp, Homo sapiens
cacgcagacctgc

SEQ ID NO: 6694776 - DNA, 12 bp, Homo sapiens
cacgcagagagg

SEQ ID NO: 6694777 - DNA, 22 bp, Homo sapiens
cacgcagagattttcatctatt

SEQ ID NO: 6694778 - DNA, 14 bp, Homo sapiens
cacgcagagccccg

SEQ ID NO: 6694779 - DNA, 15 bp, Homo sapiens
cacgcagagccccgg

SEQ ID NO: 6694780 - DNA, 20 bp, Homo sapiens
cacgcagattagcaggccaa

SEQ ID NO: 6694781 - DNA, 19 bp, Homo sapiens
cacgcagccaggacaccgg

SEQ ID NO: 6694782 - DNA, 18 bp, Homo sapiens
cacgcagcctgctctgga

SEQ ID NO: 6694783 - DNA, 16 bp, Homo sapiens
cacgcagctggcagag

SEQ ID NO: 6694784 - DNA, 16 bp, Homo sapiens
cacgcaggaactccca

SEQ ID NO: 6694785 - DNA, 17 bp, Homo sapiens
cacgcaggaactcccag

SEQ ID NO: 6694786 - DNA, 22 bp, Homo sapiens
cacgcaggcctccctgcctcag

SEQ ID NO: 6694787 - DNA, 15 bp, Homo sapiens
cacgcaggcggccag

SEQ ID NO: 6694788 - DNA, 18 bp, Homo sapiens
cacgcaggcggccagggc

SEQ ID NO: 6694789 - DNA, 23 bp, Homo sapiens
cacgcaggctgagtgcactggca

SEQ ID NO: 6694790 - DNA, 21 bp, Homo sapiens
cacgcagggccatccactgtg

SEQ ID NO: 6694791 - DNA, 20 bp, Homo sapiens
cacgcaggggccctgagcca

SEQ ID NO: 6694792 - DNA, 18 bp, Homo sapiens
cacgcatgatggagctga

SEQ ID NO: 6694793 - DNA, 23 bp, Homo sapiens
cacgcatgcctcagccagccctg

SEQ ID NO: 6694794 - DNA, 15 bp, Homo sapiens
cacgcatgggcattg

SEQ ID NO: 6694795 - DNA, 15 bp, Homo sapiens
cacgccaaccccagc

SEQ ID NO: 6694796 - DNA, 23 bp, Homo sapiens
cacgccaaccccagcagtcctgg

SEQ ID NO: 6694797 - DNA, 17 bp, Homo sapiens
cacgccaccacacctgg

SEQ ID NO: 6694798 - DNA, 20 bp, Homo sapiens
cacgccaccacacctggctt

SEQ ID NO: 6694799 - DNA, 15 bp, Homo sapiens
cacgccacccccgcc

SEQ ID NO: 6694800 - DNA, 17 bp, Homo sapiens
cacgccactgcctcccc

SEQ ID NO: 6694801 - DNA, 19 bp, Homo sapiens
cacgccagattctttcctg

SEQ ID NO: 6694802 - DNA, 13 bp, Homo sapiens
cacgccagctcct

SEQ ID NO: 6694803 - DNA, 12 bp, Homo sapiens
cacgccagctgg

SEQ ID NO: 6694804 - DNA, 21 bp, Homo sapiens
cacgccattgtactccagcct

SEQ ID NO: 6694805 - DNA, 22 bp, Homo sapiens
cacgccattgtactccagcctg

SEQ ID NO: 6694806 - DNA, 17 bp, Homo sapiens
cacgcccaccagccttg

SEQ ID NO: 6694807 - DNA, 15 bp, Homo sapiens
cacgcccacccccag

SEQ ID NO: 6694808 - DNA, 19 bp, Homo sapiens
cacgcccagcctcctccca

SEQ ID NO: 6694809 - DNA, 13 bp, Homo sapiens
cacgccccaggac

SEQ ID NO: 6694810 - DNA, 13 bp, Homo sapiens
cacgcccccactg

SEQ ID NO: 6694811 - DNA, 17 bp, Homo sapiens
cacgcccccactggtga

SEQ ID NO: 6694812 - DNA, 15 bp, Homo sapiens
cacgcccccaggaat

SEQ ID NO: 6694813 - DNA, 15 bp, Homo sapiens
cacgcccccatgcag

SEQ ID NO: 6694814 - DNA, 16 bp, Homo sapiens
cacgccccgctgtgtc

SEQ ID NO: 6694815 - DNA, 17 bp, Homo sapiens
cacgccccgctgtgtcc

SEQ ID NO: 6694816 - DNA, 22 bp, Homo sapiens
cacgccccggtcccccagagca

SEQ ID NO: 6694817 - DNA, 14 bp, Homo sapiens
cacgccccgtgtct

SEQ ID NO: 6694818 - DNA, 19 bp, Homo sapiens
cacgcccctccccagcccc

SEQ ID NO: 6694819 - DNA, 21 bp, Homo sapiens
cacgcccgcacccccgcaccc

SEQ ID NO: 6694820 - DNA, 21 bp, Homo sapiens
cacgcccgtcctgcctgtggc

SEQ ID NO: 6694821 - DNA, 21 bp, Homo sapiens
cacgccctcccctcccctgct

SEQ ID NO: 6694822 - DNA, 15 bp, Homo sapiens
cacgccctccctgct

SEQ ID NO: 6694823 - DNA, 16 bp, Homo sapiens
cacgccctccctgcta

SEQ ID NO: 6694824 - DNA, 14 bp, Homo sapiens
cacgccctcctccc

SEQ ID NO: 6694825 - DNA, 16 bp, Homo sapiens
cacgccctcctccctc

SEQ ID NO: 6694826 - DNA, 22 bp, Homo sapiens
cacgccgatataagccatagcc

SEQ ID NO: 6694827 - DNA, 15 bp, Homo sapiens
cacgccgccctccat

SEQ ID NO: 6694828 - DNA, 15 bp, Homo sapiens
cacgccggcctctgc

SEQ ID NO: 6694829 - DNA, 18 bp, Homo sapiens
cacgccggcctctgctgc

SEQ ID NO: 6694830 - DNA, 22 bp, Homo sapiens
cacgccggcctctgctgccccc

SEQ ID NO: 6694831 - DNA, 17 bp, Homo sapiens
cacgccggggctggccc

SEQ ID NO: 6694832 - DNA, 21 bp, Homo sapiens
cacgccggggctggccctgcc

SEQ ID NO: 6694833 - DNA, 20 bp, Homo sapiens
cacgccgtaattctttctgt

SEQ ID NO: 6694834 - DNA, 17 bp, Homo sapiens
cacgccgtctgtcctca

SEQ ID NO: 6694835 - DNA, 16 bp, Homo sapiens
cacgcctagcctcacg

SEQ ID NO: 6694836 - DNA, 17 bp, Homo sapiens
cacgcctagcctcacgc

SEQ ID NO: 6694837 - DNA, 19 bp, Homo sapiens
cacgcctataatcccagca

SEQ ID NO: 6694838 - DNA, 18 bp, Homo sapiens
cacgcctatgatcccagc

SEQ ID NO: 6694839 - DNA, 23 bp, Homo sapiens
cacgcctatgccctgcccttcct

SEQ ID NO: 6694840 - DNA, 13 bp, Homo sapiens
cacgcctccatcc

SEQ ID NO: 6694841 - DNA, 16 bp, Homo sapiens
cacgcctcccactggg

SEQ ID NO: 6694842 - DNA, 17 bp, Homo sapiens
cacgcctcccactgggg

SEQ ID NO: 6694843 - DNA, 14 bp, Homo sapiens
cacgcctcctggcc

SEQ ID NO: 6694844 - DNA, 17 bp, Homo sapiens
cacgcctcctggccaga

SEQ ID NO: 6694845 - DNA, 13 bp, Homo sapiens
cacgcctctcccc

SEQ ID NO: 6694846 - DNA, 13 bp, Homo sapiens
cacgcctctctca

SEQ ID NO: 6694847 - DNA, 17 bp, Homo sapiens
cacgcctctctcagccc

SEQ ID NO: 6694848 - DNA, 21 bp, Homo sapiens
cacgcctctctcagcccaggt

SEQ ID NO: 6694849 - DNA, 15 bp, Homo sapiens
cacgcctctgtgtac

SEQ ID NO: 6694850 - DNA, 12 bp, Homo sapiens
cacgcctgagcg

SEQ ID NO: 6694851 - DNA, 21 bp, Homo sapiens
cacgcctgcaaacgctgcctg

SEQ ID NO: 6694852 - DNA, 23 bp, Homo sapiens
cacgcctgcaaacgctgcctgcc

SEQ ID NO: 6694853 - DNA, 15 bp, Homo sapiens
cacgcctgcaggctg

SEQ ID NO: 6694854 - DNA, 16 bp, Homo sapiens
cacgcctgcaggctgg

SEQ ID NO: 6694855 - DNA, 22 bp, Homo sapiens
cacgcctgcaggctggagactg

SEQ ID NO: 6694856 - DNA, 15 bp, Homo sapiens
cacgcctgcccagcc

SEQ ID NO: 6694857 - DNA, 16 bp, Homo sapiens
cacgcctgcccagcct

SEQ ID NO: 6694858 - DNA, 20 bp, Homo sapiens
cacgcctgcccagcctcgca

SEQ ID NO: 6694859 - DNA, 23 bp, Homo sapiens
cacgcctgcgatggtgctgcacc

SEQ ID NO: 6694860 - DNA, 12 bp, Homo sapiens
cacgcctggaag

SEQ ID NO: 6694861 - DNA, 14 bp, Homo sapiens
cacgcctggaaggg

SEQ ID NO: 6694862 - DNA, 17 bp, Homo sapiens
cacgcctgggtgacccc

SEQ ID NO: 6694863 - DNA, 14 bp, Homo sapiens
cacgcctgtaatcc

SEQ ID NO: 6694864 - DNA, 16 bp, Homo sapiens
cacgcctgtaatccca

SEQ ID NO: 6694865 - DNA, 23 bp, Homo sapiens
cacgcctgtaatcccagcaattt

SEQ ID NO: 6694866 - DNA, 21 bp, Homo sapiens
cacgcctgtaatcccagcact

SEQ ID NO: 6694867 - DNA, 22 bp, Homo sapiens
cacgcctgtaatcccagcactt

SEQ ID NO: 6694868 - DNA, 20 bp, Homo sapiens
cacgcctgtaatcccagcag

SEQ ID NO: 6694869 - DNA, 19 bp, Homo sapiens
cacgcctgtaatcccagct

SEQ ID NO: 6694870 - DNA, 12 bp, Homo sapiens
cacgcctgtgca

SEQ ID NO: 6694871 - DNA, 17 bp, Homo sapiens
cacgcgcgagtgtgctg

SEQ ID NO: 6694872 - DNA, 16 bp, Homo sapiens
cacgcgctctccacca

SEQ ID NO: 6694873 - DNA, 12 bp, Homo sapiens
cacgcgctctgc

SEQ ID NO: 6694874 - DNA, 14 bp, Homo sapiens
cacgcgctctgcat

SEQ ID NO: 6694875 - DNA, 15 bp, Homo sapiens
cacgcgctctgcatg

SEQ ID NO: 6694876 - DNA, 19 bp, Homo sapiens
cacgcgctctgcatgctcc

SEQ ID NO: 6694877 - DNA, 15 bp, Homo sapiens
cacgcgcttccctgg

SEQ ID NO: 6694878 - DNA, 16 bp, Homo sapiens
cacgcggtggcatgca

SEQ ID NO: 6694879 - DNA, 14 bp, Homo sapiens
cacgcgtccacata

SEQ ID NO: 6694880 - DNA, 16 bp, Homo sapiens
cacgcgtgattgaccc

SEQ ID NO: 6694881 - DNA, 17 bp, Homo sapiens
cacgcgtgattgaccct

SEQ ID NO: 6694882 - DNA, 15 bp, Homo sapiens
cacgctcaaggaagg

SEQ ID NO: 6694883 - DNA, 17 bp, Homo sapiens
cacgctcaatgcccagt

SEQ ID NO: 6694884 - DNA, 18 bp, Homo sapiens
cacgctcatgtcctgtcc

SEQ ID NO: 6694885 - DNA, 13 bp, Homo sapiens
cacgctccagctg

SEQ ID NO: 6694886 - DNA, 14 bp, Homo sapiens
cacgctccagctgc

SEQ ID NO: 6694887 - DNA, 18 bp, Homo sapiens
cacgctccagctgccccg

SEQ ID NO: 6694888 - DNA, 19 bp, Homo sapiens
cacgctcccccgcagtccc

SEQ ID NO: 6694889 - DNA, 21 bp, Homo sapiens
cacgctccccgcctgttcccc

SEQ ID NO: 6694890 - DNA, 13 bp, Homo sapiens
cacgctcccctcc

SEQ ID NO: 6694891 - DNA, 14 bp, Homo sapiens
cacgctccctgact

SEQ ID NO: 6694892 - DNA, 23 bp, Homo sapiens
cacgctccctgacttctcccccg

SEQ ID NO: 6694893 - DNA, 15 bp, Homo sapiens
cacgctccctggaag

SEQ ID NO: 6694894 - DNA, 18 bp, Homo sapiens
cacgctcctccctctgag

SEQ ID NO: 6694895 - DNA, 23 bp, Homo sapiens
cacgctcctccctctgaggctgt

SEQ ID NO: 6694896 - DNA, 12 bp, Homo sapiens
cacgctcctctg

SEQ ID NO: 6694897 - DNA, 16 bp, Homo sapiens
cacgctcgcgggcagc

SEQ ID NO: 6694898 - DNA, 14 bp, Homo sapiens
cacgctcgctgcca

SEQ ID NO: 6694899 - DNA, 15 bp, Homo sapiens
cacgctcgctgccat

SEQ ID NO: 6694900 - DNA, 16 bp, Homo sapiens
cacgctcgctgccatc

SEQ ID NO: 6694901 - DNA, 23 bp, Homo sapiens
cacgctctctccaggcaggtctg

SEQ ID NO: 6694902 - DNA, 17 bp, Homo sapiens
cacgctgacagcctcct

SEQ ID NO: 6694903 - DNA, 16 bp, Homo sapiens
cacgctgcccaggctc

SEQ ID NO: 6694904 - DNA, 21 bp, Homo sapiens
cacgctgcccaggctctgctg

SEQ ID NO: 6694905 - DNA, 22 bp, Homo sapiens
cacgctgccttcggtacccacc

SEQ ID NO: 6694906 - DNA, 21 bp, Homo sapiens
cacgctgctctgccccagctt

SEQ ID NO: 6694907 - DNA, 17 bp, Homo sapiens
cacgctggaccttgaac

SEQ ID NO: 6694908 - DNA, 18 bp, Homo sapiens
cacgctgggacacagacc

SEQ ID NO: 6694909 - DNA, 19 bp, Homo sapiens
cacgctgggacacagaccg

SEQ ID NO: 6694910 - DNA, 16 bp, Homo sapiens
cacgctggggctctct

SEQ ID NO: 6694911 - DNA, 17 bp, Homo sapiens
cacgctggggctctctg

SEQ ID NO: 6694912 - DNA, 18 bp, Homo sapiens
cacgctgggtattaccat

SEQ ID NO: 6694913 - DNA, 20 bp, Homo sapiens
cacgctgggtattaccatgt

SEQ ID NO: 6694914 - DNA, 14 bp, Homo sapiens
cacgctgtcctctc

SEQ ID NO: 6694915 - DNA, 14 bp, Homo sapiens
cacgctgtctccag

SEQ ID NO: 6694916 - DNA, 23 bp, Homo sapiens
cacgctgtctccagacccccacc

SEQ ID NO: 6694917 - DNA, 20 bp, Homo sapiens
cacgctgtggccctggaggg

SEQ ID NO: 6694918 - DNA, 22 bp, Homo sapiens
cacgcttcaaggatatactgca

SEQ ID NO: 6694919 - DNA, 18 bp, Homo sapiens
cacgcttctgagcagggg

SEQ ID NO: 6694920 - DNA, 14 bp, Homo sapiens
cacgcttctggagg

SEQ ID NO: 6694921 - DNA, 22 bp, Homo sapiens
cacgcttctggaggtggggagg

SEQ ID NO: 6694922 - DNA, 17 bp, Homo sapiens
cacgcttgcctggtcac

SEQ ID NO: 6694923 - DNA, 19 bp, Homo sapiens
cacgcttgcgtatgtctgt

SEQ ID NO: 6694924 - DNA, 14 bp, Homo sapiens
cacgctttcctgaa

SEQ ID NO: 6694925 - DNA, 19 bp, Homo sapiens
cacgcttttaattctcatt

SEQ ID NO: 6694926 - DNA, 23 bp, Homo sapiens
cacgcttttcccgtatgctttct

SEQ ID NO: 6694927 - DNA, 15 bp, Homo sapiens
cacggaaacagaact

SEQ ID NO: 6694928 - DNA, 18 bp, Homo sapiens
cacggaaacatagaaaca

SEQ ID NO: 6694929 - DNA, 14 bp, Homo sapiens
cacggaagcacagt

SEQ ID NO: 6694930 - DNA, 22 bp, Homo sapiens
cacggaaggcgggctgaggaga

SEQ ID NO: 6694931 - DNA, 19 bp, Homo sapiens
cacggacaataaacctccg

SEQ ID NO: 6694932 - DNA, 14 bp, Homo sapiens
cacggacaggaagc

SEQ ID NO: 6694933 - DNA, 22 bp, Homo sapiens
cacggaccactcgaggcctgca

SEQ ID NO: 6694934 - DNA, 14 bp, Homo sapiens
cacggacccccaga

SEQ ID NO: 6694935 - DNA, 23 bp, Homo sapiens
cacggacgctggctccccaaagg

SEQ ID NO: 6694936 - DNA, 23 bp, Homo sapiens
cacggactctcccaggcctgcct

SEQ ID NO: 6694937 - DNA, 14 bp, Homo sapiens
cacggactctttgc

SEQ ID NO: 6694938 - DNA, 14 bp, Homo sapiens
cacggagagaaggc

SEQ ID NO: 6694939 - DNA, 15 bp, Homo sapiens
cacggagagaaggcc

SEQ ID NO: 6694940 - DNA, 16 bp, Homo sapiens
cacggagaggccactg

SEQ ID NO: 6694941 - DNA, 20 bp, Homo sapiens
cacggagcagttcagagtgg

SEQ ID NO: 6694942 - DNA, 15 bp, Homo sapiens
cacggagccactcct

SEQ ID NO: 6694943 - DNA, 21 bp, Homo sapiens
cacggagccactcctctgact

SEQ ID NO: 6694944 - DNA, 12 bp, Homo sapiens
cacggagccctc

SEQ ID NO: 6694945 - DNA, 22 bp, Homo sapiens
cacggagcggattgcaaagcaa

SEQ ID NO: 6694946 - DNA, 16 bp, Homo sapiens
cacggagctcctggca

SEQ ID NO: 6694947 - DNA, 22 bp, Homo sapiens
cacggagctcctggcagcgaga

SEQ ID NO: 6694948 - DNA, 21 bp, Homo sapiens
cacggaggcatctgcaccctc

SEQ ID NO: 6694949 - DNA, 13 bp, Homo sapiens
cacggaggccaga

SEQ ID NO: 6694950 - DNA, 17 bp, Homo sapiens
cacggaggccagacaca

SEQ ID NO: 6694951 - DNA, 20 bp, Homo sapiens
cacggaggccagacacaggc

SEQ ID NO: 6694952 - DNA, 21 bp, Homo sapiens
cacggaggccagacacaggcc

SEQ ID NO: 6694953 - DNA, 22 bp, Homo sapiens
cacggagggggacggggctcag

SEQ ID NO: 6694954 - DNA, 18 bp, Homo sapiens
cacggagtgttggggctg

SEQ ID NO: 6694955 - DNA, 21 bp, Homo sapiens
cacggagtgttggggctgggg

SEQ ID NO: 6694956 - DNA, 16 bp, Homo sapiens
cacggagtttccattt

SEQ ID NO: 6694957 - DNA, 13 bp, Homo sapiens
cacggataccgcc

SEQ ID NO: 6694958 - DNA, 19 bp, Homo sapiens
cacggatcacgatgtaaat

SEQ ID NO: 6694959 - DNA, 13 bp, Homo sapiens
cacggatctgaga

SEQ ID NO: 6694960 - DNA, 16 bp, Homo sapiens
cacggatgcacagaga

SEQ ID NO: 6694961 - DNA, 17 bp, Homo sapiens
cacggatggtgcatggg

SEQ ID NO: 6694962 - DNA, 20 bp, Homo sapiens
cacggatggtgcatgggctc

SEQ ID NO: 6694963 - DNA, 19 bp, Homo sapiens
cacggcacctgggccctgg

SEQ ID NO: 6694964 - DNA, 19 bp, Homo sapiens
cacggcactccagcctggg

SEQ ID NO: 6694965 - DNA, 20 bp, Homo sapiens
cacggcagccacagcttggg

SEQ ID NO: 6694966 - DNA, 14 bp, Homo sapiens
cacggcagccaccc

SEQ ID NO: 6694967 - DNA, 18 bp, Homo sapiens
cacggcagccaccctgcc

SEQ ID NO: 6694968 - DNA, 19 bp, Homo sapiens
cacggcagccaccctgcca

SEQ ID NO: 6694969 - DNA, 22 bp, Homo sapiens
cacggcagcccccccctcaagg

SEQ ID NO: 6694970 - DNA, 14 bp, Homo sapiens
cacggcagcctcaa

SEQ ID NO: 6694971 - DNA, 14 bp, Homo sapiens
cacggcagcttgag

SEQ ID NO: 6694972 - DNA, 15 bp, Homo sapiens
cacggcagcttgagc

SEQ ID NO: 6694973 - DNA, 19 bp, Homo sapiens
cacggcaggcgtgtggcag

SEQ ID NO: 6694974 - DNA, 21 bp, Homo sapiens
cacggcattatgatcccttcc

SEQ ID NO: 6694975 - DNA, 19 bp, Homo sapiens
cacggccacacagctgccg

SEQ ID NO: 6694976 - DNA, 13 bp, Homo sapiens
cacggccacagtc

SEQ ID NO: 6694977 - DNA, 19 bp, Homo sapiens
cacggccacatcaaagagg

SEQ ID NO: 6694978 - DNA, 12 bp, Homo sapiens
cacggccaccca

SEQ ID NO: 6694979 - DNA, 14 bp, Homo sapiens
cacggccaccctcc

SEQ ID NO: 6694980 - DNA, 17 bp, Homo sapiens
cacggccaccctccttc

SEQ ID NO: 6694981 - DNA, 23 bp, Homo sapiens
cacggccacgtcatgtctctaaa

SEQ ID NO: 6694982 - DNA, 15 bp, Homo sapiens
cacggccactgcagt

SEQ ID NO: 6694983 - DNA, 14 bp, Homo sapiens
cacggccactggcc

SEQ ID NO: 6694984 - DNA, 13 bp, Homo sapiens
cacggccaggcca

SEQ ID NO: 6694985 - DNA, 16 bp, Homo sapiens
cacggccaggccagag

SEQ ID NO: 6694986 - DNA, 14 bp, Homo sapiens
cacggcccagggag

SEQ ID NO: 6694987 - DNA, 18 bp, Homo sapiens
cacggccccgggtccagg

SEQ ID NO: 6694988 - DNA, 19 bp, Homo sapiens
cacggcccggcccctcacc

SEQ ID NO: 6694989 - DNA, 20 bp, Homo sapiens
cacggcccggcccctcaccc

SEQ ID NO: 6694990 - DNA, 21 bp, Homo sapiens
cacggcccggcccctcaccct

SEQ ID NO: 6694991 - DNA, 16 bp, Homo sapiens
cacggccctcctggga

SEQ ID NO: 6694992 - DNA, 17 bp, Homo sapiens
cacggccctcctgggaa

SEQ ID NO: 6694993 - DNA, 12 bp, Homo sapiens
cacggccctgcc

SEQ ID NO: 6694994 - DNA, 22 bp, Homo sapiens
cacggccctgccccatcctggg

SEQ ID NO: 6694995 - DNA, 13 bp, Homo sapiens
cacggccctgtca

SEQ ID NO: 6694996 - DNA, 14 bp, Homo sapiens
cacggccgctccag

SEQ ID NO: 6694997 - DNA, 21 bp, Homo sapiens
cacggccgtccctgacttccc

SEQ ID NO: 6694998 - DNA, 19 bp, Homo sapiens
cacggcctctggggagacc

SEQ ID NO: 6694999 - DNA, 17 bp, Homo sapiens
cacggcctggcatgcag

SEQ ID NO: 6695000 - DNA, 13 bp, Homo sapiens
cacggcctggctg

SEQ ID NO: 6695001 - DNA, 14 bp, Homo sapiens
cacggcctggctgg

SEQ ID NO: 6695002 - DNA, 12 bp, Homo sapiens
cacggcctggga

SEQ ID NO: 6695003 - DNA, 21 bp, Homo sapiens
cacggccttcgacctggacgt

SEQ ID NO: 6695004 - DNA, 13 bp, Homo sapiens
cacggcggcaggg

SEQ ID NO: 6695005 - DNA, 17 bp, Homo sapiens
cacggcgggatcctcca

SEQ ID NO: 6695006 - DNA, 19 bp, Homo sapiens
cacggcgggatcctccaca

SEQ ID NO: 6695007 - DNA, 22 bp, Homo sapiens
cacggcgtggtgtgtccctgga

SEQ ID NO: 6695008 - DNA, 15 bp, Homo sapiens
cacggctcactgcag

SEQ ID NO: 6695009 - DNA, 16 bp, Homo sapiens
cacggctcactgcagc

SEQ ID NO: 6695010 - DNA, 19 bp, Homo sapiens
cacggctcactgcagcctc

SEQ ID NO: 6695011 - DNA, 18 bp, Homo sapiens
cacggctcccccaggcct

SEQ ID NO: 6695012 - DNA, 22 bp, Homo sapiens
cacggctcccccaggcctgagc

SEQ ID NO: 6695013 - DNA, 20 bp, Homo sapiens
cacggctccgagggcggcca

SEQ ID NO: 6695014 - DNA, 21 bp, Homo sapiens
cacggctccgagggcggccag

SEQ ID NO: 6695015 - DNA, 19 bp, Homo sapiens
cacggctctgtccccagcc

SEQ ID NO: 6695016 - DNA, 14 bp, Homo sapiens
cacggctgcacctg

SEQ ID NO: 6695017 - DNA, 17 bp, Homo sapiens
cacggctgcgcactgtg

SEQ ID NO: 6695018 - DNA, 12 bp, Homo sapiens
cacggctggtca

SEQ ID NO: 6695019 - DNA, 19 bp, Homo sapiens
cacggctggtcactctgcc

SEQ ID NO: 6695020 - DNA, 23 bp, Homo sapiens
cacggcttcactgaccagcggct

SEQ ID NO: 6695021 - DNA, 21 bp, Homo sapiens
cacgggagagcgccacccgcc

SEQ ID NO: 6695022 - DNA, 22 bp, Homo sapiens
cacgggagagcgccacccgccc

SEQ ID NO: 6695023 - DNA, 18 bp, Homo sapiens
cacgggatgcgtgggagg

SEQ ID NO: 6695024 - DNA, 20 bp, Homo sapiens
cacgggatgcgtgggaggca

SEQ ID NO: 6695025 - DNA, 21 bp, Homo sapiens
cacgggatgcgtgggaggcag

SEQ ID NO: 6695026 - DNA, 22 bp, Homo sapiens
cacgggcaacactcactgcctg

SEQ ID NO: 6695027 - DNA, 12 bp, Homo sapiens
cacgggcagcct

SEQ ID NO: 6695028 - DNA, 18 bp, Homo sapiens
cacgggcagcctggctcc

SEQ ID NO: 6695029 - DNA, 14 bp, Homo sapiens
cacgggcatgcaca

SEQ ID NO: 6695030 - DNA, 18 bp, Homo sapiens
cacgggcatgcacacggc

SEQ ID NO: 6695031 - DNA, 12 bp, Homo sapiens
cacgggcccgct

SEQ ID NO: 6695032 - DNA, 14 bp, Homo sapiens
cacgggccctgccc

SEQ ID NO: 6695033 - DNA, 14 bp, Homo sapiens
cacgggccggccag

SEQ ID NO: 6695034 - DNA, 12 bp, Homo sapiens
cacgggcctcag

SEQ ID NO: 6695035 - DNA, 14 bp, Homo sapiens
cacgggcctcagtt

SEQ ID NO: 6695036 - DNA, 17 bp, Homo sapiens
cacgggcggtcctgcac

SEQ ID NO: 6695037 - DNA, 22 bp, Homo sapiens
cacgggcgttatgtaagtttct

SEQ ID NO: 6695038 - DNA, 21 bp, Homo sapiens
cacgggctctatgcctgcact

SEQ ID NO: 6695039 - DNA, 13 bp, Homo sapiens
cacgggctgtctg

SEQ ID NO: 6695040 - DNA, 16 bp, Homo sapiens
cacgggctgtctgggt

SEQ ID NO: 6695041 - DNA, 22 bp, Homo sapiens
cacggggaccactgggcccctc

SEQ ID NO: 6695042 - DNA, 13 bp, Homo sapiens
cacggggacctgg

SEQ ID NO: 6695043 - DNA, 23 bp, Homo sapiens
cacggggcaaagctgctgggcca

SEQ ID NO: 6695044 - DNA, 13 bp, Homo sapiens
cacggggcaccca

SEQ ID NO: 6695045 - DNA, 20 bp, Homo sapiens
cacggggctcactctggccc

SEQ ID NO: 6695046 - DNA, 21 bp, Homo sapiens
cacgggggaggccgaggcagg

SEQ ID NO: 6695047 - DNA, 22 bp, Homo sapiens
cacgggggaggccgaggcaggg

SEQ ID NO: 6695048 - DNA, 22 bp, Homo sapiens
cacgggggagtgagacaggctg

SEQ ID NO: 6695049 - DNA, 15 bp, Homo sapiens
cacgggggccaagga

SEQ ID NO: 6695050 - DNA, 18 bp, Homo sapiens
cacggggttccctcctag

SEQ ID NO: 6695051 - DNA, 21 bp, Homo sapiens
cacgggtaaatctagtaccat

SEQ ID NO: 6695052 - DNA, 13 bp, Homo sapiens
cacgggtggtccc

SEQ ID NO: 6695053 - DNA, 16 bp, Homo sapiens
cacggtaaccatgatg

SEQ ID NO: 6695054 - DNA, 14 bp, Homo sapiens
cacggtagtgcctg

SEQ ID NO: 6695055 - DNA, 20 bp, Homo sapiens
cacggtattcccaagagtgg

SEQ ID NO: 6695056 - DNA, 16 bp, Homo sapiens
cacggtcacacctcac

SEQ ID NO: 6695057 - DNA, 18 bp, Homo sapiens
cacggtccaatccagcct

SEQ ID NO: 6695058 - DNA, 19 bp, Homo sapiens
cacggtccaatccagcctt

SEQ ID NO: 6695059 - DNA, 18 bp, Homo sapiens
cacggtcccccaggaggc

SEQ ID NO: 6695060 - DNA, 13 bp, Homo sapiens
cacggtccgcggc

SEQ ID NO: 6695061 - DNA, 17 bp, Homo sapiens
cacggtccgcggcctgc

SEQ ID NO: 6695062 - DNA, 14 bp, Homo sapiens
cacggtctaaacac

SEQ ID NO: 6695063 - DNA, 12 bp, Homo sapiens
cacggtctgagc

SEQ ID NO: 6695064 - DNA, 17 bp, Homo sapiens
cacggtctggggaagag

SEQ ID NO: 6695065 - DNA, 14 bp, Homo sapiens
cacggtctgttctt

SEQ ID NO: 6695066 - DNA, 16 bp, Homo sapiens
cacggtgaaagtgctg

SEQ ID NO: 6695067 - DNA, 17 bp, Homo sapiens
cacggtgacacaggtca

SEQ ID NO: 6695068 - DNA, 22 bp, Homo sapiens
cacggtgacacaggtcagggct

SEQ ID NO: 6695069 - DNA, 23 bp, Homo sapiens
cacggtgacacaggtcagggctc

SEQ ID NO: 6695070 - DNA, 15 bp, Homo sapiens
cacggtgcgtggctg

SEQ ID NO: 6695071 - DNA, 17 bp, Homo sapiens
cacggtgcgtggctgtg

SEQ ID NO: 6695072 - DNA, 14 bp, Homo sapiens
cacggtgggccttg

SEQ ID NO: 6695073 - DNA, 15 bp, Homo sapiens
cacggtgtccaccat

SEQ ID NO: 6695074 - DNA, 13 bp, Homo sapiens
cacggtgtggggg

SEQ ID NO: 6695075 - DNA, 21 bp, Homo sapiens
cacggtttaactgtcccagcg

SEQ ID NO: 6695076 - DNA, 16 bp, Homo sapiens
cacggtttctgttctg

SEQ ID NO: 6695077 - DNA, 20 bp, Homo sapiens
cacggtttgaagcctggaac

SEQ ID NO: 6695078 - DNA, 11 bp, Homo sapiens
cacggtttgtg

SEQ ID NO: 6695079 - DNA, 18 bp, Homo sapiens
cacggttttggcagctga

SEQ ID NO: 6695080 - DNA, 22 bp, Homo sapiens
cacgtaagatacaagtttcaga

SEQ ID NO: 6695081 - DNA, 15 bp, Homo sapiens
cacgtaatcctcctg

SEQ ID NO: 6695082 - DNA, 18 bp, Homo sapiens
cacgtaatcctcctgagt

SEQ ID NO: 6695083 - DNA, 16 bp, Homo sapiens
cacgtaatgaaacttg

SEQ ID NO: 6695084 - DNA, 13 bp, Homo sapiens
cacgtaattcaat

SEQ ID NO: 6695085 - DNA, 17 bp, Homo sapiens
cacgtaattcaatttct

SEQ ID NO: 6695086 - DNA, 23 bp, Homo sapiens
cacgtacaaaactctgtataagt

SEQ ID NO: 6695087 - DNA, 19 bp, Homo sapiens
cacgtacacacacatacac

SEQ ID NO: 6695088 - DNA, 21 bp, Homo sapiens
cacgtagagatgattcggatt

SEQ ID NO: 6695089 - DNA, 16 bp, Homo sapiens
cacgtagggggcaggg

SEQ ID NO: 6695090 - DNA, 19 bp, Homo sapiens
cacgtagggggcaggggca

SEQ ID NO: 6695091 - DNA, 18 bp, Homo sapiens
cacgtagggggctctggg

SEQ ID NO: 6695092 - DNA, 20 bp, Homo sapiens
cacgtaggttccccagagag

SEQ ID NO: 6695093 - DNA, 18 bp, Homo sapiens
cacgtatttatatttgga

SEQ ID NO: 6695094 - DNA, 17 bp, Homo sapiens
cacgtatttcacagagc

SEQ ID NO: 6695095 - DNA, 13 bp, Homo sapiens
cacgtcaccctcc

SEQ ID NO: 6695096 - DNA, 22 bp, Homo sapiens
cacgtcaccctcctgagcctca

SEQ ID NO: 6695097 - DNA, 20 bp, Homo sapiens
cacgtcacgtgtagtgtcca

SEQ ID NO: 6695098 - DNA, 14 bp, Homo sapiens
cacgtcactgccag

SEQ ID NO: 6695099 - DNA, 15 bp, Homo sapiens
cacgtcactgccaga

SEQ ID NO: 6695100 - DNA, 16 bp, Homo sapiens
cacgtcactgccagag

SEQ ID NO: 6695101 - DNA, 17 bp, Homo sapiens
cacgtcaggcctggcct

SEQ ID NO: 6695102 - DNA, 18 bp, Homo sapiens
cacgtcattgtgtaagga

SEQ ID NO: 6695103 - DNA, 14 bp, Homo sapiens
cacgtcccagcatc

SEQ ID NO: 6695104 - DNA, 13 bp, Homo sapiens
cacgtccccctgg

SEQ ID NO: 6695105 - DNA, 16 bp, Homo sapiens
cacgtcccgggcactg

SEQ ID NO: 6695106 - DNA, 14 bp, Homo sapiens
cacgtcctccaccg

SEQ ID NO: 6695107 - DNA, 13 bp, Homo sapiens
cacgtcctgagaa

SEQ ID NO: 6695108 - DNA, 19 bp, Homo sapiens
cacgtcctgagaaagctca

SEQ ID NO: 6695109 - DNA, 16 bp, Homo sapiens
cacgtcctgtcagtgc

SEQ ID NO: 6695110 - DNA, 14 bp, Homo sapiens
cacgtccttgggcg

SEQ ID NO: 6695111 - DNA, 13 bp, Homo sapiens
cacgtcctttcct

SEQ ID NO: 6695112 - DNA, 23 bp, Homo sapiens
cacgtctatttcatcagaacagc

SEQ ID NO: 6695113 - DNA, 16 bp, Homo sapiens
cacgtctccctggccc

SEQ ID NO: 6695114 - DNA, 18 bp, Homo sapiens
cacgtctccctggcccca

SEQ ID NO: 6695115 - DNA, 14 bp, Homo sapiens
cacgtctcctcctc

SEQ ID NO: 6695116 - DNA, 17 bp, Homo sapiens
cacgtctgccaggccca

SEQ ID NO: 6695117 - DNA, 19 bp, Homo sapiens
cacgtctggctccctgccc

SEQ ID NO: 6695118 - DNA, 12 bp, Homo sapiens
cacgtctgtcct

SEQ ID NO: 6695119 - DNA, 21 bp, Homo sapiens
cacgtctgtgagtctgtcctt

SEQ ID NO: 6695120 - DNA, 13 bp, Homo sapiens
cacgtcttcctcc

SEQ ID NO: 6695121 - DNA, 22 bp, Homo sapiens
cacgtgaaatttgcctctgtcc

SEQ ID NO: 6695122 - DNA, 17 bp, Homo sapiens
cacgtgacacaaacaca

SEQ ID NO: 6695123 - DNA, 19 bp, Homo sapiens
cacgtgaccagccccgtgt

SEQ ID NO: 6695124 - DNA, 14 bp, Homo sapiens
cacgtgaccctgtg

SEQ ID NO: 6695125 - DNA, 19 bp, Homo sapiens
cacgtgactcctcaattcc

SEQ ID NO: 6695126 - DNA, 20 bp, Homo sapiens
cacgtgagagaatctgcctg

SEQ ID NO: 6695127 - DNA, 19 bp, Homo sapiens
cacgtgaggcccctgtgca

SEQ ID NO: 6695128 - DNA, 17 bp, Homo sapiens
cacgtgatggaccaaag

SEQ ID NO: 6695129 - DNA, 18 bp, Homo sapiens
cacgtgatggaccaaagc

SEQ ID NO: 6695130 - DNA, 18 bp, Homo sapiens
cacgtgcaaaaatgtatt

SEQ ID NO: 6695131 - DNA, 12 bp, Homo sapiens
cacgtgcaagga

SEQ ID NO: 6695132 - DNA, 14 bp, Homo sapiens
cacgtgcacacacc

SEQ ID NO: 6695133 - DNA, 17 bp, Homo sapiens
cacgtgcacacacctgc

SEQ ID NO: 6695134 - DNA, 12 bp, Homo sapiens
cacgtgcacagc

SEQ ID NO: 6695135 - DNA, 17 bp, Homo sapiens
cacgtgcagcacctgtc

SEQ ID NO: 6695136 - DNA, 18 bp, Homo sapiens
cacgtgcagcacctgtca

SEQ ID NO: 6695137 - DNA, 15 bp, Homo sapiens
cacgtgcaggacagc

SEQ ID NO: 6695138 - DNA, 13 bp, Homo sapiens
cacgtgccaggcc

SEQ ID NO: 6695139 - DNA, 17 bp, Homo sapiens
cacgtgcctgtgggcct

SEQ ID NO: 6695140 - DNA, 21 bp, Homo sapiens
cacgtgcgctgggcacttccc

SEQ ID NO: 6695141 - DNA, 20 bp, Homo sapiens
cacgtgctcgcagcctggcg

SEQ ID NO: 6695142 - DNA, 17 bp, Homo sapiens
cacgtgctcgcctctgc

SEQ ID NO: 6695143 - DNA, 18 bp, Homo sapiens
cacgtggaggagcagtgc

SEQ ID NO: 6695144 - DNA, 20 bp, Homo sapiens
cacgtggaggagcagtgcag

SEQ ID NO: 6695145 - DNA, 21 bp, Homo sapiens
cacgtggaggagcagtgcagg

SEQ ID NO: 6695146 - DNA, 20 bp, Homo sapiens
cacgtggaggtgaagtccct

SEQ ID NO: 6695147 - DNA, 18 bp, Homo sapiens
cacgtggcatgtggcctg

SEQ ID NO: 6695148 - DNA, 19 bp, Homo sapiens
cacgtggcatgtggcctgt

SEQ ID NO: 6695149 - DNA, 15 bp, Homo sapiens
cacgtggccaggagc

SEQ ID NO: 6695150 - DNA, 16 bp, Homo sapiens
cacgtggccaggagcc

SEQ ID NO: 6695151 - DNA, 17 bp, Homo sapiens
cacgtggcctcttgagc

SEQ ID NO: 6695152 - DNA, 14 bp, Homo sapiens
cacgtggcttggag

SEQ ID NO: 6695153 - DNA, 18 bp, Homo sapiens
cacgtgggctcccctctt

SEQ ID NO: 6695154 - DNA, 21 bp, Homo sapiens
cacgtgggctcccctcttcct

SEQ ID NO: 6695155 - DNA, 15 bp, Homo sapiens
cacgtggggcccact

SEQ ID NO: 6695156 - DNA, 18 bp, Homo sapiens
cacgtggtaaaacacttg

SEQ ID NO: 6695157 - DNA, 13 bp, Homo sapiens
cacgtggtgtccc

SEQ ID NO: 6695158 - DNA, 18 bp, Homo sapiens
cacgtgtactggctcctc

SEQ ID NO: 6695159 - DNA, 12 bp, Homo sapiens
cacgtgtatatg

SEQ ID NO: 6695160 - DNA, 14 bp, Homo sapiens
cacgtgtatgcaag

SEQ ID NO: 6695161 - DNA, 21 bp, Homo sapiens
cacgtgtccgtccacccttcc

SEQ ID NO: 6695162 - DNA, 15 bp, Homo sapiens
cacgtgtcctgtagt

SEQ ID NO: 6695163 - DNA, 21 bp, Homo sapiens
cacgtgtgctgtggccaggcc

SEQ ID NO: 6695164 - DNA, 16 bp, Homo sapiens
cacgtgtggcctccgt

SEQ ID NO: 6695165 - DNA, 16 bp, Homo sapiens
cacgtgtgtgactcag

SEQ ID NO: 6695166 - DNA, 19 bp, Homo sapiens
cacgtgtgtttttctatta

SEQ ID NO: 6695167 - DNA, 20 bp, Homo sapiens
cacgtgtgtttttctattaa

SEQ ID NO: 6695168 - DNA, 22 bp, Homo sapiens
cacgtgtgtttttctattaaaa

SEQ ID NO: 6695169 - DNA, 23 bp, Homo sapiens
cacgtgtgtttttctattaaaag

SEQ ID NO: 6695170 - DNA, 18 bp, Homo sapiens
cacgtgtttcgggccagg

SEQ ID NO: 6695171 - DNA, 20 bp, Homo sapiens
cacgtgtttcgggccagggc

SEQ ID NO: 6695172 - DNA, 23 bp, Homo sapiens
cacgtgttttattcctgtatgtt

SEQ ID NO: 6695173 - DNA, 16 bp, Homo sapiens
cacgtgtttttgtatc

SEQ ID NO: 6695174 - DNA, 16 bp, Homo sapiens
cacgttactcccctgg

SEQ ID NO: 6695175 - DNA, 19 bp, Homo sapiens
cacgttagaggaaaaatat

SEQ ID NO: 6695176 - DNA, 17 bp, Homo sapiens
cacgttcagggaggggc

SEQ ID NO: 6695177 - DNA, 14 bp, Homo sapiens
cacgttcataacca

SEQ ID NO: 6695178 - DNA, 20 bp, Homo sapiens
cacgttccttcccccgcaat

SEQ ID NO: 6695179 - DNA, 13 bp, Homo sapiens
cacgttctatata

SEQ ID NO: 6695180 - DNA, 22 bp, Homo sapiens
cacgttctcacacccaccgtcc

SEQ ID NO: 6695181 - DNA, 22 bp, Homo sapiens
cacgttcttactagtttccctt

SEQ ID NO: 6695182 - DNA, 13 bp, Homo sapiens
cacgttctttccc

SEQ ID NO: 6695183 - DNA, 14 bp, Homo sapiens
cacgttggccctca

SEQ ID NO: 6695184 - DNA, 18 bp, Homo sapiens
cacgttggccggcggcta

SEQ ID NO: 6695185 - DNA, 19 bp, Homo sapiens
cacgttggcgaggaaaaac

SEQ ID NO: 6695186 - DNA, 22 bp, Homo sapiens
cacgttgtgatgaagctgaggc

SEQ ID NO: 6695187 - DNA, 14 bp, Homo sapiens
cacgtttcttcccc

SEQ ID NO: 6695188 - DNA, 17 bp, Homo sapiens
cacgtttggcatttctc

SEQ ID NO: 6695189 - DNA, 20 bp, Homo sapiens
cacgtttgttcgcttcctga

SEQ ID NO: 6695190 - DNA, 15 bp, Homo sapiens
cacgttttaaggact

SEQ ID NO: 6695191 - DNA, 22 bp, Homo sapiens
cacgttttaaggactgactgag

SEQ ID NO: 6695192 - DNA, 15 bp, Homo sapiens
cacgttttctggctt

SEQ ID NO: 6695193 - DNA, 20 bp, Homo sapiens
cacgttttctggcttctgct

SEQ ID NO: 6695194 - DNA, 15 bp, Homo sapiens
cacgtttttctggac

SEQ ID NO: 6695195 - DNA, 15 bp, Homo sapiens
cactaaaaagtggct

SEQ ID NO: 6695196 - DNA, 20 bp, Homo sapiens
cactaaaacaaaacaaaaaa

SEQ ID NO: 6695197 - DNA, 13 bp, Homo sapiens
cactaaaagcatg

SEQ ID NO: 6695198 - DNA, 23 bp, Homo sapiens
cactaaaagcatgaattggaact

SEQ ID NO: 6695199 - DNA, 18 bp, Homo sapiens
cactaaaagtgatgtgat

SEQ ID NO: 6695200 - DNA, 13 bp, Homo sapiens
cactaaaatacat

SEQ ID NO: 6695201 - DNA, 18 bp, Homo sapiens
cactaaaatccacccagc

SEQ ID NO: 6695202 - DNA, 15 bp, Homo sapiens
cactaaaatgtttaa

SEQ ID NO: 6695203 - DNA, 15 bp, Homo sapiens
cactaaaattttagg

SEQ ID NO: 6695204 - DNA, 17 bp, Homo sapiens
cactaaacagactattt

SEQ ID NO: 6695205 - DNA, 23 bp, Homo sapiens
cactaaacagagaaaagcttgga

SEQ ID NO: 6695206 - DNA, 19 bp, Homo sapiens
cactaaaccgataatgcat

SEQ ID NO: 6695207 - DNA, 21 bp, Homo sapiens
cactaaacttggtgcttattg

SEQ ID NO: 6695208 - DNA, 13 bp, Homo sapiens
cactaaactttat

SEQ ID NO: 6695209 - DNA, 20 bp, Homo sapiens
cactaaactttatttgtaaa

SEQ ID NO: 6695210 - DNA, 12 bp, Homo sapiens
cactaaagcagt

SEQ ID NO: 6695211 - DNA, 16 bp, Homo sapiens
cactaaagcatgaaat

SEQ ID NO: 6695212 - DNA, 22 bp, Homo sapiens
cactaaagcatgaaatgtgaat

SEQ ID NO: 6695213 - DNA, 21 bp, Homo sapiens
cactaaagccagcctgacctt

SEQ ID NO: 6695214 - DNA, 13 bp, Homo sapiens
cactaaagcttca

SEQ ID NO: 6695215 - DNA, 23 bp, Homo sapiens
cactaaaggtggttttattttcc

SEQ ID NO: 6695216 - DNA, 17 bp, Homo sapiens
cactaaagtatcctgac

SEQ ID NO: 6695217 - DNA, 16 bp, Homo sapiens
cactaaagtatgtaaa

SEQ ID NO: 6695218 - DNA, 18 bp, Homo sapiens
cactaaagtgcattattt

SEQ ID NO: 6695219 - DNA, 18 bp, Homo sapiens
cactaaataaactacttt

SEQ ID NO: 6695220 - DNA, 16 bp, Homo sapiens
cactaaatatctagtg

SEQ ID NO: 6695221 - DNA, 17 bp, Homo sapiens
cactaaatgagctcctg

SEQ ID NO: 6695222 - DNA, 14 bp, Homo sapiens
cactaaatgatatt

SEQ ID NO: 6695223 - DNA, 18 bp, Homo sapiens
cactaaatgatattcata

SEQ ID NO: 6695224 - DNA, 13 bp, Homo sapiens
cactaaatgtaaa

SEQ ID NO: 6695225 - DNA, 13 bp, Homo sapiens
cactaaatgttaa

SEQ ID NO: 6695226 - DNA, 14 bp, Homo sapiens
cactaaatgttaaa

SEQ ID NO: 6695227 - DNA, 16 bp, Homo sapiens
cactaaatgttaaaga

SEQ ID NO: 6695228 - DNA, 20 bp, Homo sapiens
cactaaattagtttaaaatg

SEQ ID NO: 6695229 - DNA, 22 bp, Homo sapiens
cactaaattagtttaaaatgaa

SEQ ID NO: 6695230 - DNA, 22 bp, Homo sapiens
cactaaattattagcatttgtt

SEQ ID NO: 6695231 - DNA, 21 bp, Homo sapiens
cactaaattgcagtttacagt

SEQ ID NO: 6695232 - DNA, 13 bp, Homo sapiens
cactaacaaaatt

SEQ ID NO: 6695233 - DNA, 16 bp, Homo sapiens
cactaacatgatttgg

SEQ ID NO: 6695234 - DNA, 20 bp, Homo sapiens
cactaacattatattgcaat

SEQ ID NO: 6695235 - DNA, 12 bp, Homo sapiens
cactaacattgt

SEQ ID NO: 6695236 - DNA, 15 bp, Homo sapiens
cactaaccaaaaact

SEQ ID NO: 6695237 - DNA, 16 bp, Homo sapiens
cactaaccacgctgga

SEQ ID NO: 6695238 - DNA, 18 bp, Homo sapiens
cactaaccacgctggacc

SEQ ID NO: 6695239 - DNA, 17 bp, Homo sapiens
cactaaccccagctgcc

SEQ ID NO: 6695240 - DNA, 18 bp, Homo sapiens
cactaacccgttttattc

SEQ ID NO: 6695241 - DNA, 14 bp, Homo sapiens
cactaacctgtaga

SEQ ID NO: 6695242 - DNA, 18 bp, Homo sapiens
cactaacgtgtgtgtctt

SEQ ID NO: 6695243 - DNA, 20 bp, Homo sapiens
cactaacgttgagcccctgg

SEQ ID NO: 6695244 - DNA, 11 bp, Homo sapiens
cactaactaga

SEQ ID NO: 6695245 - DNA, 13 bp, Homo sapiens
cactaactgctgg

SEQ ID NO: 6695246 - DNA, 14 bp, Homo sapiens
cactaactgctggt

SEQ ID NO: 6695247 - DNA, 13 bp, Homo sapiens
cactaagaaagaa

SEQ ID NO: 6695248 - DNA, 19 bp, Homo sapiens
cactaagaaagaaaggaaa

SEQ ID NO: 6695249 - DNA, 14 bp, Homo sapiens
cactaagacaagaa

SEQ ID NO: 6695250 - DNA, 19 bp, Homo sapiens
cactaagagaaaattgcac

SEQ ID NO: 6695251 - DNA, 22 bp, Homo sapiens
cactaagaggaggcaggaggag

SEQ ID NO: 6695252 - DNA, 13 bp, Homo sapiens
cactaagcagagg

SEQ ID NO: 6695253 - DNA, 16 bp, Homo sapiens
cactaagccatgccat

SEQ ID NO: 6695254 - DNA, 22 bp, Homo sapiens
cactaagccatgccatgcccag

SEQ ID NO: 6695255 - DNA, 18 bp, Homo sapiens
cactaagctttctccttt

SEQ ID NO: 6695256 - DNA, 23 bp, Homo sapiens
cactaaggccgtgtctctgagga

SEQ ID NO: 6695257 - DNA, 12 bp, Homo sapiens
cactaaggctgc

SEQ ID NO: 6695258 - DNA, 12 bp, Homo sapiens
cactaaggggcc

SEQ ID NO: 6695259 - DNA, 16 bp, Homo sapiens
cactaagggtggagag

SEQ ID NO: 6695260 - DNA, 20 bp, Homo sapiens
cactaagggtggagagttgg

SEQ ID NO: 6695261 - DNA, 20 bp, Homo sapiens
cactaagtctcttttttaca

SEQ ID NO: 6695262 - DNA, 22 bp, Homo sapiens
cactaagttatagtatatctgg

SEQ ID NO: 6695263 - DNA, 20 bp, Homo sapiens
cactaagtttgcaacattta

SEQ ID NO: 6695264 - DNA, 16 bp, Homo sapiens
cactaataatagtact

SEQ ID NO: 6695265 - DNA, 17 bp, Homo sapiens
cactaatatatggacct

SEQ ID NO: 6695266 - DNA, 21 bp, Homo sapiens
cactaatatatttaaaaataa

SEQ ID NO: 6695267 - DNA, 14 bp, Homo sapiens
cactaatcaatact

SEQ ID NO: 6695268 - DNA, 21 bp, Homo sapiens
cactaatcacaaactgaatga

SEQ ID NO: 6695269 - DNA, 16 bp, Homo sapiens
cactaatctgaaagga

SEQ ID NO: 6695270 - DNA, 15 bp, Homo sapiens
cactaatgttagaat

SEQ ID NO: 6695271 - DNA, 14 bp, Homo sapiens
cactaattagtgtc

SEQ ID NO: 6695272 - DNA, 11 bp, Homo sapiens
cactaattcat

SEQ ID NO: 6695273 - DNA, 19 bp, Homo sapiens
cactaattccttaaatgaa

SEQ ID NO: 6695274 - DNA, 22 bp, Homo sapiens
cactaatttgaataaactctcc

SEQ ID NO: 6695275 - DNA, 18 bp, Homo sapiens
cactaatttgtcactgga

SEQ ID NO: 6695276 - DNA, 13 bp, Homo sapiens
cactacaaaaaga

SEQ ID NO: 6695277 - DNA, 14 bp, Homo sapiens
cactacaacctccg

SEQ ID NO: 6695278 - DNA, 12 bp, Homo sapiens
cactacaatcat

SEQ ID NO: 6695279 - DNA, 15 bp, Homo sapiens
cactacacagcacac

SEQ ID NO: 6695280 - DNA, 20 bp, Homo sapiens
cactacaccacacacaacag

SEQ ID NO: 6695281 - DNA, 16 bp, Homo sapiens
cactacacccagcaat

SEQ ID NO: 6695282 - DNA, 23 bp, Homo sapiens
cactacacctggctgaggttcct

SEQ ID NO: 6695283 - DNA, 16 bp, Homo sapiens
cactacaccttgcctt

SEQ ID NO: 6695284 - DNA, 20 bp, Homo sapiens
cactacactccagcctgagc

SEQ ID NO: 6695285 - DNA, 21 bp, Homo sapiens
cactacactccagcctgagca

SEQ ID NO: 6695286 - DNA, 15 bp, Homo sapiens
cactacagagcagct

SEQ ID NO: 6695287 - DNA, 18 bp, Homo sapiens
cactacagagcagctccc

SEQ ID NO: 6695288 - DNA, 20 bp, Homo sapiens
cactacagagcagctcccca

SEQ ID NO: 6695289 - DNA, 22 bp, Homo sapiens
cactacagagcagctccccagg

SEQ ID NO: 6695290 - DNA, 21 bp, Homo sapiens
cactacaggaggaatgcacca

SEQ ID NO: 6695291 - DNA, 19 bp, Homo sapiens
cactacataaactgacttt

SEQ ID NO: 6695292 - DNA, 14 bp, Homo sapiens
cactacatctggct

SEQ ID NO: 6695293 - DNA, 15 bp, Homo sapiens
cactacatgcagccc

SEQ ID NO: 6695294 - DNA, 20 bp, Homo sapiens
cactacatgggccagccctt

SEQ ID NO: 6695295 - DNA, 17 bp, Homo sapiens
cactaccaaaggacact

SEQ ID NO: 6695296 - DNA, 14 bp, Homo sapiens
cactaccagccagc

SEQ ID NO: 6695297 - DNA, 15 bp, Homo sapiens
cactaccagccagcc

SEQ ID NO: 6695298 - DNA, 17 bp, Homo sapiens
cactaccagccagcctc

SEQ ID NO: 6695299 - DNA, 18 bp, Homo sapiens
cactaccatacagacagc

SEQ ID NO: 6695300 - DNA, 21 bp, Homo sapiens
cactaccccacaccagccttg

SEQ ID NO: 6695301 - DNA, 16 bp, Homo sapiens
cactaccccttgattt

SEQ ID NO: 6695302 - DNA, 17 bp, Homo sapiens
cactaccctgagatctg

SEQ ID NO: 6695303 - DNA, 16 bp, Homo sapiens
cactacccttctcctt

SEQ ID NO: 6695304 - DNA, 20 bp, Homo sapiens
cactaccgggggctctgagc

SEQ ID NO: 6695305 - DNA, 15 bp, Homo sapiens
cactaccgtggacca

SEQ ID NO: 6695306 - DNA, 15 bp, Homo sapiens
cactacctcctcagg

SEQ ID NO: 6695307 - DNA, 17 bp, Homo sapiens
cactacctgaacattgt

SEQ ID NO: 6695308 - DNA, 17 bp, Homo sapiens
cactaccttctgacctc

SEQ ID NO: 6695309 - DNA, 20 bp, Homo sapiens
cactacctttatagctctca

SEQ ID NO: 6695310 - DNA, 22 bp, Homo sapiens
cactacctttatagctctcatc

SEQ ID NO: 6695311 - DNA, 14 bp, Homo sapiens
cactacctttgtcc

SEQ ID NO: 6695312 - DNA, 21 bp, Homo sapiens
cactacctttgtccaggcctg

SEQ ID NO: 6695313 - DNA, 14 bp, Homo sapiens
cactacgcagaaga

SEQ ID NO: 6695314 - DNA, 22 bp, Homo sapiens
cactacgcatgactaatttttt

SEQ ID NO: 6695315 - DNA, 23 bp, Homo sapiens
cactacgcctggctgatttttgt

SEQ ID NO: 6695316 - DNA, 16 bp, Homo sapiens
cactacgctcctgtct

SEQ ID NO: 6695317 - DNA, 13 bp, Homo sapiens
cactactaaaagt

SEQ ID NO: 6695318 - DNA, 15 bp, Homo sapiens
cactactcctctgca

SEQ ID NO: 6695319 - DNA, 18 bp, Homo sapiens
cactactcctctgcagtg

SEQ ID NO: 6695320 - DNA, 20 bp, Homo sapiens
cactactcctctgcagtgcc

SEQ ID NO: 6695321 - DNA, 21 bp, Homo sapiens
cactactcgagcccacccagc

SEQ ID NO: 6695322 - DNA, 13 bp, Homo sapiens
cactactctgtgc

SEQ ID NO: 6695323 - DNA, 13 bp, Homo sapiens
cactactgggtgt

SEQ ID NO: 6695324 - DNA, 15 bp, Homo sapiens
cactactgggtgtca

SEQ ID NO: 6695325 - DNA, 16 bp, Homo sapiens
cactactgggtgtcat

SEQ ID NO: 6695326 - DNA, 22 bp, Homo sapiens
cactactgggtgtcatttcatt

SEQ ID NO: 6695327 - DNA, 19 bp, Homo sapiens
cactactgtatttcattat

SEQ ID NO: 6695328 - DNA, 13 bp, Homo sapiens
cactacttgacca

SEQ ID NO: 6695329 - DNA, 13 bp, Homo sapiens
cactagaaaacat

SEQ ID NO: 6695330 - DNA, 12 bp, Homo sapiens
cactagaaaact

SEQ ID NO: 6695331 - DNA, 12 bp, Homo sapiens
cactagaaagaa

SEQ ID NO: 6695332 - DNA, 17 bp, Homo sapiens
cactagaaattgggcag

SEQ ID NO: 6695333 - DNA, 17 bp, Homo sapiens
cactagaactctccatc

SEQ ID NO: 6695334 - DNA, 18 bp, Homo sapiens
cactagaagaaaagccca

SEQ ID NO: 6695335 - DNA, 20 bp, Homo sapiens
cactagaagaaaagcccatt

SEQ ID NO: 6695336 - DNA, 12 bp, Homo sapiens
cactagaagatg

SEQ ID NO: 6695337 - DNA, 18 bp, Homo sapiens
cactagaagatgagggtg

SEQ ID NO: 6695338 - DNA, 16 bp, Homo sapiens
cactagacaagccaga

SEQ ID NO: 6695339 - DNA, 16 bp, Homo sapiens
cactagacccactgga

SEQ ID NO: 6695340 - DNA, 23 bp, Homo sapiens
cactagactcaaggaagaataat

SEQ ID NO: 6695341 - DNA, 18 bp, Homo sapiens
cactagagacaaatcttt

SEQ ID NO: 6695342 - DNA, 14 bp, Homo sapiens
cactagagctggga

SEQ ID NO: 6695343 - DNA, 13 bp, Homo sapiens
cactagagggccc

SEQ ID NO: 6695344 - DNA, 18 bp, Homo sapiens
cactagagggcccatcag

SEQ ID NO: 6695345 - DNA, 23 bp, Homo sapiens
cactagagggcccatcaggcagt

SEQ ID NO: 6695346 - DNA, 21 bp, Homo sapiens
cactagagtcacccccccagg

SEQ ID NO: 6695347 - DNA, 12 bp, Homo sapiens
cactagcagctg

SEQ ID NO: 6695348 - DNA, 14 bp, Homo sapiens
cactagcagctgca

SEQ ID NO: 6695349 - DNA, 22 bp, Homo sapiens
cactagcatagagaatgtgttg

SEQ ID NO: 6695350 - DNA, 17 bp, Homo sapiens
cactagcattttcttga

SEQ ID NO: 6695351 - DNA, 18 bp, Homo sapiens
cactagccaacccaactg

SEQ ID NO: 6695352 - DNA, 16 bp, Homo sapiens
cactagcccaatgaaa

SEQ ID NO: 6695353 - DNA, 16 bp, Homo sapiens
cactagccctctttct

SEQ ID NO: 6695354 - DNA, 22 bp, Homo sapiens
cactagctcttgttgagccgtg

SEQ ID NO: 6695355 - DNA, 22 bp, Homo sapiens
cactaggaatttttttcagtat

SEQ ID NO: 6695356 - DNA, 17 bp, Homo sapiens
cactaggactctgaggc

SEQ ID NO: 6695357 - DNA, 18 bp, Homo sapiens
cactaggactctgaggct

SEQ ID NO: 6695358 - DNA, 15 bp, Homo sapiens
cactaggagactggt

SEQ ID NO: 6695359 - DNA, 20 bp, Homo sapiens
cactaggcacccagctgcca

SEQ ID NO: 6695360 - DNA, 20 bp, Homo sapiens
cactaggcaggtaataataa

SEQ ID NO: 6695361 - DNA, 23 bp, Homo sapiens
cactaggcccccacttgcctctt

SEQ ID NO: 6695362 - DNA, 18 bp, Homo sapiens
cactaggctgggtgccca

SEQ ID NO: 6695363 - DNA, 21 bp, Homo sapiens
cactaggctgggtgcccacag

SEQ ID NO: 6695364 - DNA, 23 bp, Homo sapiens
cactaggctgggtgcccacagcc

SEQ ID NO: 6695365 - DNA, 21 bp, Homo sapiens
cactaggggatataggagagg

SEQ ID NO: 6695366 - DNA, 14 bp, Homo sapiens
cactaggtaactta

SEQ ID NO: 6695367 - DNA, 15 bp, Homo sapiens
cactaggtaacttat

SEQ ID NO: 6695368 - DNA, 16 bp, Homo sapiens
cactaggtgaacagca

SEQ ID NO: 6695369 - DNA, 20 bp, Homo sapiens
cactaggtgcccagtcttga

SEQ ID NO: 6695370 - DNA, 21 bp, Homo sapiens
cactaggtgcccagtcttgag

SEQ ID NO: 6695371 - DNA, 17 bp, Homo sapiens
cactaggtgtccccaac

SEQ ID NO: 6695372 - DNA, 20 bp, Homo sapiens
cactaggttctaggtcctgg

SEQ ID NO: 6695373 - DNA, 15 bp, Homo sapiens
cactaggttcttttc

SEQ ID NO: 6695374 - DNA, 16 bp, Homo sapiens
cactagtagctgtttt

SEQ ID NO: 6695375 - DNA, 19 bp, Homo sapiens
cactagtatttctatgaaa

SEQ ID NO: 6695376 - DNA, 22 bp, Homo sapiens
cactagtcaagaaaaatataaa

SEQ ID NO: 6695377 - DNA, 13 bp, Homo sapiens
cactagtctgtgt

SEQ ID NO: 6695378 - DNA, 20 bp, Homo sapiens
cactagtctgtgtgctgtgg

SEQ ID NO: 6695379 - DNA, 21 bp, Homo sapiens
cactagtctgtgtgctgtggt

SEQ ID NO: 6695380 - DNA, 13 bp, Homo sapiens
cactagtgccaat

SEQ ID NO: 6695381 - DNA, 20 bp, Homo sapiens
cactagtggaaagtcaggct

SEQ ID NO: 6695382 - DNA, 17 bp, Homo sapiens
cactagtggggtcctga

SEQ ID NO: 6695383 - DNA, 16 bp, Homo sapiens
cactagtgtcaggccc

SEQ ID NO: 6695384 - DNA, 21 bp, Homo sapiens
cactagtgtcaggcccccagt

SEQ ID NO: 6695385 - DNA, 12 bp, Homo sapiens
cactagttttgt

SEQ ID NO: 6695386 - DNA, 16 bp, Homo sapiens
cactataatgtgaaat

SEQ ID NO: 6695387 - DNA, 15 bp, Homo sapiens
cactatacaattcag

SEQ ID NO: 6695388 - DNA, 11 bp, Homo sapiens
cactatagctc

SEQ ID NO: 6695389 - DNA, 22 bp, Homo sapiens
cactatagtttaatactcagag

SEQ ID NO: 6695390 - DNA, 15 bp, Homo sapiens
cactatatcatgggc

SEQ ID NO: 6695391 - DNA, 14 bp, Homo sapiens
cactatatctgtat

SEQ ID NO: 6695392 - DNA, 12 bp, Homo sapiens
cactatatcttc

SEQ ID NO: 6695393 - DNA, 20 bp, Homo sapiens
cactatatgatcagtgttac

SEQ ID NO: 6695394 - DNA, 19 bp, Homo sapiens
cactatatttgtatatatt

SEQ ID NO: 6695395 - DNA, 19 bp, Homo sapiens
cactatcatagttaacata

SEQ ID NO: 6695396 - DNA, 19 bp, Homo sapiens
cactatcccaatcaaagaa

SEQ ID NO: 6695397 - DNA, 20 bp, Homo sapiens
cactatcccaatcaaagaat

SEQ ID NO: 6695398 - DNA, 21 bp, Homo sapiens
cactatcccaatcaaagaatt

SEQ ID NO: 6695399 - DNA, 22 bp, Homo sapiens
cactatcccaatcaaagaatta

SEQ ID NO: 6695400 - DNA, 19 bp, Homo sapiens
cactatcccggctgccctt

SEQ ID NO: 6695401 - DNA, 18 bp, Homo sapiens
cactatctcacactaatc

SEQ ID NO: 6695402 - DNA, 20 bp, Homo sapiens
cactatctgaaaatacattt

SEQ ID NO: 6695403 - DNA, 11 bp, Homo sapiens
cactatctggg

SEQ ID NO: 6695404 - DNA, 12 bp, Homo sapiens
cactatcttctt

SEQ ID NO: 6695405 - DNA, 15 bp, Homo sapiens
cactatcttcttcaa

SEQ ID NO: 6695406 - DNA, 14 bp, Homo sapiens
cactatctttcagc

SEQ ID NO: 6695407 - DNA, 18 bp, Homo sapiens
cactatctttcaggaaat

SEQ ID NO: 6695408 - DNA, 15 bp, Homo sapiens
cactatgaaaatcag

SEQ ID NO: 6695409 - DNA, 16 bp, Homo sapiens
cactatgaaaatcagt

SEQ ID NO: 6695410 - DNA, 17 bp, Homo sapiens
cactatgacactgagca

SEQ ID NO: 6695411 - DNA, 16 bp, Homo sapiens
cactatgatttctgaa

SEQ ID NO: 6695412 - DNA, 17 bp, Homo sapiens
cactatgatttctgaat

SEQ ID NO: 6695413 - DNA, 21 bp, Homo sapiens
cactatgcacagattaaactt

SEQ ID NO: 6695414 - DNA, 15 bp, Homo sapiens
cactatgcactgctg

SEQ ID NO: 6695415 - DNA, 18 bp, Homo sapiens
cactatgcactgctgtaa

SEQ ID NO: 6695416 - DNA, 15 bp, Homo sapiens
cactatgcattttaa

SEQ ID NO: 6695417 - DNA, 16 bp, Homo sapiens
cactatgctatttctg

SEQ ID NO: 6695418 - DNA, 23 bp, Homo sapiens
cactatgctatttctggcctcag

SEQ ID NO: 6695419 - DNA, 15 bp, Homo sapiens
cactatgctgctatg

SEQ ID NO: 6695420 - DNA, 23 bp, Homo sapiens
cactatggaccagggagcttatt

SEQ ID NO: 6695421 - DNA, 21 bp, Homo sapiens
cactatgggaagctctgtgtg

SEQ ID NO: 6695422 - DNA, 23 bp, Homo sapiens
cactatgtccatgaaaaacagca

SEQ ID NO: 6695423 - DNA, 14 bp, Homo sapiens
cactatgtgtgttg

SEQ ID NO: 6695424 - DNA, 19 bp, Homo sapiens
cactatgtgtgttgtttcc

SEQ ID NO: 6695425 - DNA, 16 bp, Homo sapiens
cactatgttgcccagg

SEQ ID NO: 6695426 - DNA, 14 bp, Homo sapiens
cactattatttcct

SEQ ID NO: 6695427 - DNA, 20 bp, Homo sapiens
cactattcaaggatgactcc

SEQ ID NO: 6695428 - DNA, 20 bp, Homo sapiens
cactattcttaagcactttg

SEQ ID NO: 6695429 - DNA, 23 bp, Homo sapiens
cactattctttgtattaccaaag

SEQ ID NO: 6695430 - DNA, 13 bp, Homo sapiens
cactattggactt

SEQ ID NO: 6695431 - DNA, 17 bp, Homo sapiens
cactattgtaatcattt

SEQ ID NO: 6695432 - DNA, 22 bp, Homo sapiens
cactatttatttacaaatgttt

SEQ ID NO: 6695433 - DNA, 17 bp, Homo sapiens
cactatttcctttataa

SEQ ID NO: 6695434 - DNA, 13 bp, Homo sapiens
cactatttgtgac

SEQ ID NO: 6695435 - DNA, 15 bp, Homo sapiens
cactatttgtgactt

SEQ ID NO: 6695436 - DNA, 18 bp, Homo sapiens
cactattttatatttaaa

SEQ ID NO: 6695437 - DNA, 21 bp, Homo sapiens
cactattttattaaaaataaa

SEQ ID NO: 6695438 - DNA, 20 bp, Homo sapiens
cactattttcactagggctg

SEQ ID NO: 6695439 - DNA, 17 bp, Homo sapiens
cactattttcagaatct

SEQ ID NO: 6695440 - DNA, 20 bp, Homo sapiens
cactattttcagaatctgaa

SEQ ID NO: 6695441 - DNA, 12 bp, Homo sapiens
cactatttttat

SEQ ID NO: 6695442 - DNA, 22 bp, Homo sapiens
cactatttttatttatattttt

SEQ ID NO: 6695443 - DNA, 19 bp, Homo sapiens
cactcaaaagctgggcagg

SEQ ID NO: 6695444 - DNA, 17 bp, Homo sapiens
cactcaaacaatcatga

SEQ ID NO: 6695445 - DNA, 19 bp, Homo sapiens
cactcaaacctggagctga

SEQ ID NO: 6695446 - DNA, 12 bp, Homo sapiens
cactcaaaggcc

SEQ ID NO: 6695447 - DNA, 20 bp, Homo sapiens
cactcaaattaatctttctt

SEQ ID NO: 6695448 - DNA, 22 bp, Homo sapiens
cactcaacaaaagtgctttgga

SEQ ID NO: 6695449 - DNA, 15 bp, Homo sapiens
cactcaacaataaag

SEQ ID NO: 6695450 - DNA, 17 bp, Homo sapiens
cactcaaccatgacctc

SEQ ID NO: 6695451 - DNA, 16 bp, Homo sapiens
cactcaactaattttt

SEQ ID NO: 6695452 - DNA, 17 bp, Homo sapiens
cactcaactaatttttg

SEQ ID NO: 6695453 - DNA, 18 bp, Homo sapiens
cactcaactaatttttgt

SEQ ID NO: 6695454 - DNA, 14 bp, Homo sapiens
cactcaactctgag

SEQ ID NO: 6695455 - DNA, 17 bp, Homo sapiens
cactcaactctgagccc

SEQ ID NO: 6695456 - DNA, 18 bp, Homo sapiens
cactcaactctgagccca

SEQ ID NO: 6695457 - DNA, 15 bp, Homo sapiens
cactcaagaagcagg

SEQ ID NO: 6695458 - DNA, 20 bp, Homo sapiens
cactcaagaagcaggctaca

SEQ ID NO: 6695459 - DNA, 12 bp, Homo sapiens
cactcaagccaa

SEQ ID NO: 6695460 - DNA, 13 bp, Homo sapiens
cactcaagcttgg

SEQ ID NO: 6695461 - DNA, 24 bp, Homo sapiens
cactcaaggacaggagcctggtcc

SEQ ID NO: 6695462 - DNA, 16 bp, Homo sapiens
cactcaagttcaagga

SEQ ID NO: 6695463 - DNA, 14 bp, Homo sapiens
cactcaagttgttt

SEQ ID NO: 6695464 - DNA, 13 bp, Homo sapiens
cactcaataaatt

SEQ ID NO: 6695465 - DNA, 18 bp, Homo sapiens
cactcaatgggagaatca

SEQ ID NO: 6695466 - DNA, 22 bp, Homo sapiens
cactcacaatcatcttctccca

SEQ ID NO: 6695467 - DNA, 22 bp, Homo sapiens
cactcacacagccaggtgcctt

SEQ ID NO: 6695468 - DNA, 12 bp, Homo sapiens
cactcacacagg

SEQ ID NO: 6695469 - DNA, 13 bp, Homo sapiens
cactcacacagga

SEQ ID NO: 6695470 - DNA, 16 bp, Homo sapiens
cactcacagacctgga

SEQ ID NO: 6695471 - DNA, 18 bp, Homo sapiens
cactcacagagtcaaggc

SEQ ID NO: 6695472 - DNA, 13 bp, Homo sapiens
cactcacatgaca

SEQ ID NO: 6695473 - DNA, 14 bp, Homo sapiens
cactcacatgacac

SEQ ID NO: 6695474 - DNA, 13 bp, Homo sapiens
cactcacatgccg

SEQ ID NO: 6695475 - DNA, 12 bp, Homo sapiens
cactcacatgct

SEQ ID NO: 6695476 - DNA, 23 bp, Homo sapiens
cactcacatgctggacaggtctg

SEQ ID NO: 6695477 - DNA, 13 bp, Homo sapiens
cactcacattgag

SEQ ID NO: 6695478 - DNA, 20 bp, Homo sapiens
cactcacatttattctgctc

SEQ ID NO: 6695479 - DNA, 16 bp, Homo sapiens
cactcacattttctca

SEQ ID NO: 6695480 - DNA, 18 bp, Homo sapiens
cactcaccactaccagcc

SEQ ID NO: 6695481 - DNA, 14 bp, Homo sapiens
cactcaccagggtc

SEQ ID NO: 6695482 - DNA, 15 bp, Homo sapiens
cactcaccagtggcc

SEQ ID NO: 6695483 - DNA, 14 bp, Homo sapiens
cactcaccatgaag

SEQ ID NO: 6695484 - DNA, 21 bp, Homo sapiens
cactcacccatgtgccaaggt

SEQ ID NO: 6695485 - DNA, 16 bp, Homo sapiens
cactcaccccagcctc

SEQ ID NO: 6695486 - DNA, 13 bp, Homo sapiens
cactcaccccctt

SEQ ID NO: 6695487 - DNA, 18 bp, Homo sapiens
cactcacccctagccctg

SEQ ID NO: 6695488 - DNA, 22 bp, Homo sapiens
cactcacccttcctggcccagg

SEQ ID NO: 6695489 - DNA, 17 bp, Homo sapiens
cactcaccgaagccact

SEQ ID NO: 6695490 - DNA, 12 bp, Homo sapiens
cactcacctcta

SEQ ID NO: 6695491 - DNA, 12 bp, Homo sapiens
cactcacctgca

SEQ ID NO: 6695492 - DNA, 18 bp, Homo sapiens
cactcacgctcagcacac

SEQ ID NO: 6695493 - DNA, 17 bp, Homo sapiens
cactcactaggccccca

SEQ ID NO: 6695494 - DNA, 15 bp, Homo sapiens
cactcactcactcat

SEQ ID NO: 6695495 - DNA, 17 bp, Homo sapiens
cactcactcactccaag

SEQ ID NO: 6695496 - DNA, 18 bp, Homo sapiens
cactcactcactccccac

SEQ ID NO: 6695497 - DNA, 14 bp, Homo sapiens
cactcactccaaga

SEQ ID NO: 6695498 - DNA, 18 bp, Homo sapiens
cactcactccaagaccac

SEQ ID NO: 6695499 - DNA, 14 bp, Homo sapiens
cactcactccagcc

SEQ ID NO: 6695500 - DNA, 14 bp, Homo sapiens
cactcactcctgag

SEQ ID NO: 6695501 - DNA, 14 bp, Homo sapiens
cactcactgaagcc

SEQ ID NO: 6695502 - DNA, 22 bp, Homo sapiens
cactcactgaagcccagacctc

SEQ ID NO: 6695503 - DNA, 17 bp, Homo sapiens
cactcactgcggagaac

SEQ ID NO: 6695504 - DNA, 12 bp, Homo sapiens
cactcactgctg

SEQ ID NO: 6695505 - DNA, 19 bp, Homo sapiens
cactcactgtttataaatg

SEQ ID NO: 6695506 - DNA, 12 bp, Homo sapiens
cactcagaaaat

SEQ ID NO: 6695507 - DNA, 18 bp, Homo sapiens
cactcagaaaattccctg

SEQ ID NO: 6695508 - DNA, 20 bp, Homo sapiens
cactcagaaaattccctggg

SEQ ID NO: 6695509 - DNA, 21 bp, Homo sapiens
cactcagaaaattccctgggg

SEQ ID NO: 6695510 - DNA, 13 bp, Homo sapiens
cactcagaagcct

SEQ ID NO: 6695511 - DNA, 15 bp, Homo sapiens
cactcagaagcctgg

SEQ ID NO: 6695512 - DNA, 22 bp, Homo sapiens
cactcagaagcctgggggcctg

SEQ ID NO: 6695513 - DNA, 23 bp, Homo sapiens
cactcagaagcctgggggcctgg

SEQ ID NO: 6695514 - DNA, 12 bp, Homo sapiens
cactcagacctg

SEQ ID NO: 6695515 - DNA, 15 bp, Homo sapiens
cactcagagacatgc

SEQ ID NO: 6695516 - DNA, 20 bp, Homo sapiens
cactcagagacatgcagaga

SEQ ID NO: 6695517 - DNA, 17 bp, Homo sapiens
cactcagagcagtctgt

SEQ ID NO: 6695518 - DNA, 14 bp, Homo sapiens
cactcagaggcccc

SEQ ID NO: 6695519 - DNA, 19 bp, Homo sapiens
cactcagaggcccccagtg

SEQ ID NO: 6695520 - DNA, 20 bp, Homo sapiens
cactcagaggcccccagtgg

SEQ ID NO: 6695521 - DNA, 21 bp, Homo sapiens
cactcagaggcccccagtggg

SEQ ID NO: 6695522 - DNA, 15 bp, Homo sapiens
cactcagcacaaggc

SEQ ID NO: 6695523 - DNA, 22 bp, Homo sapiens
cactcagcacaaggccatctgg

SEQ ID NO: 6695524 - DNA, 14 bp, Homo sapiens
cactcagcaccact

SEQ ID NO: 6695525 - DNA, 21 bp, Homo sapiens
cactcagcactctggactcca

SEQ ID NO: 6695526 - DNA, 17 bp, Homo sapiens
cactcagcacttggccc

SEQ ID NO: 6695527 - DNA, 15 bp, Homo sapiens
cactcagcagccccc

SEQ ID NO: 6695528 - DNA, 23 bp, Homo sapiens
cactcagcatttcggtgcttccc

SEQ ID NO: 6695529 - DNA, 18 bp, Homo sapiens
cactcagccacaaagccc

SEQ ID NO: 6695530 - DNA, 17 bp, Homo sapiens
cactcagccaccctgag

SEQ ID NO: 6695531 - DNA, 20 bp, Homo sapiens
cactcagccacgaccagccc

SEQ ID NO: 6695532 - DNA, 23 bp, Homo sapiens
cactcagccacgaccagcccctt

SEQ ID NO: 6695533 - DNA, 23 bp, Homo sapiens
cactcagccactgtcacaggcat

SEQ ID NO: 6695534 - DNA, 15 bp, Homo sapiens
cactcagccatttcc

SEQ ID NO: 6695535 - DNA, 21 bp, Homo sapiens
cactcagccatttccccctcc

SEQ ID NO: 6695536 - DNA, 12 bp, Homo sapiens
cactcagccccg

SEQ ID NO: 6695537 - DNA, 12 bp, Homo sapiens
cactcagcccct

SEQ ID NO: 6695538 - DNA, 13 bp, Homo sapiens
cactcagccccta

SEQ ID NO: 6695539 - DNA, 18 bp, Homo sapiens
cactcagcccctacccct

SEQ ID NO: 6695540 - DNA, 15 bp, Homo sapiens
cactcagcccctagg

SEQ ID NO: 6695541 - DNA, 16 bp, Homo sapiens
cactcagccccttccc

SEQ ID NO: 6695542 - DNA, 23 bp, Homo sapiens
cactcagccggcagccagatggc

SEQ ID NO: 6695543 - DNA, 22 bp, Homo sapiens
cactcagctggactgcattgaa

SEQ ID NO: 6695544 - DNA, 11 bp, Homo sapiens
cactcagctgt

SEQ ID NO: 6695545 - DNA, 13 bp, Homo sapiens
cactcagctgttc

SEQ ID NO: 6695546 - DNA, 18 bp, Homo sapiens
cactcaggaaccctggag

SEQ ID NO: 6695547 - DNA, 19 bp, Homo sapiens
cactcaggaaccctggaga

SEQ ID NO: 6695548 - DNA, 22 bp, Homo sapiens
cactcaggaaccctggagacag

SEQ ID NO: 6695549 - DNA, 13 bp, Homo sapiens
cactcaggagcac

SEQ ID NO: 6695550 - DNA, 16 bp, Homo sapiens
cactcaggagcacagc

SEQ ID NO: 6695551 - DNA, 20 bp, Homo sapiens
cactcaggagcacagccata

SEQ ID NO: 6695552 - DNA, 21 bp, Homo sapiens
cactcaggaggctgaggcagg

SEQ ID NO: 6695553 - DNA, 23 bp, Homo sapiens
cactcaggatgtcctttgtgtcc

SEQ ID NO: 6695554 - DNA, 20 bp, Homo sapiens
cactcaggccacagtggggc

SEQ ID NO: 6695555 - DNA, 16 bp, Homo sapiens
cactcaggcctctgca

SEQ ID NO: 6695556 - DNA, 17 bp, Homo sapiens
cactcaggcctgtgccc

SEQ ID NO: 6695557 - DNA, 19 bp, Homo sapiens
cactcaggcctgtgcccac

SEQ ID NO: 6695558 - DNA, 16 bp, Homo sapiens
cactcagggcagctgc

SEQ ID NO: 6695559 - DNA, 17 bp, Homo sapiens
cactcagggcagctgcc

SEQ ID NO: 6695560 - DNA, 14 bp, Homo sapiens
cactcagggctgcc

SEQ ID NO: 6695561 - DNA, 21 bp, Homo sapiens
cactcagggctggcccgggga

SEQ ID NO: 6695562 - DNA, 20 bp, Homo sapiens
cactcaggggtcactgaggc

SEQ ID NO: 6695563 - DNA, 23 bp, Homo sapiens
cactcaggtagggagctaaggaa

SEQ ID NO: 6695564 - DNA, 16 bp, Homo sapiens
cactcagtaaaacata

SEQ ID NO: 6695565 - DNA, 17 bp, Homo sapiens
cactcagtactgtacag

SEQ ID NO: 6695566 - DNA, 22 bp, Homo sapiens
cactcagtactgtacagggtgg

SEQ ID NO: 6695567 - DNA, 22 bp, Homo sapiens
cactcagtaggtctgaaggcct

SEQ ID NO: 6695568 - DNA, 18 bp, Homo sapiens
cactcagtctctcttctc

SEQ ID NO: 6695569 - DNA, 16 bp, Homo sapiens
cactcagtctcttcca

SEQ ID NO: 6695570 - DNA, 20 bp, Homo sapiens
cactcagtgagcctcctgtg

SEQ ID NO: 6695571 - DNA, 20 bp, Homo sapiens
cactcagtgggccaattgtt

SEQ ID NO: 6695572 - DNA, 15 bp, Homo sapiens
cactcagttctgctc

SEQ ID NO: 6695573 - DNA, 16 bp, Homo sapiens
cactcagtttatgctg

SEQ ID NO: 6695574 - DNA, 14 bp, Homo sapiens
cactcatacacatg

SEQ ID NO: 6695575 - DNA, 22 bp, Homo sapiens
cactcatcacacttcattgtaa

SEQ ID NO: 6695576 - DNA, 18 bp, Homo sapiens
cactcatcccccatcaga

SEQ ID NO: 6695577 - DNA, 20 bp, Homo sapiens
cactcatgacggcctgcctg

SEQ ID NO: 6695578 - DNA, 21 bp, Homo sapiens
cactcatgacggcctgcctgc

SEQ ID NO: 6695579 - DNA, 22 bp, Homo sapiens
cactcatgacggcctgcctgca

SEQ ID NO: 6695580 - DNA, 14 bp, Homo sapiens
cactcatgactgca

SEQ ID NO: 6695581 - DNA, 17 bp, Homo sapiens
cactcatgactgcatga

SEQ ID NO: 6695582 - DNA, 19 bp, Homo sapiens
cactcatgcaaactgcttt

SEQ ID NO: 6695583 - DNA, 20 bp, Homo sapiens
cactcatgcaaactgcttta

SEQ ID NO: 6695584 - DNA, 21 bp, Homo sapiens
cactcatgcaaactgctttat

SEQ ID NO: 6695585 - DNA, 19 bp, Homo sapiens
cactcatgcattgtcctct

SEQ ID NO: 6695586 - DNA, 19 bp, Homo sapiens
cactcatgcggcccagcca

SEQ ID NO: 6695587 - DNA, 21 bp, Homo sapiens
cactcatgcggcccagccatg

SEQ ID NO: 6695588 - DNA, 12 bp, Homo sapiens
cactcatgctga

SEQ ID NO: 6695589 - DNA, 15 bp, Homo sapiens
cactcatgctgaaag

SEQ ID NO: 6695590 - DNA, 15 bp, Homo sapiens
cactcatgtggactg

SEQ ID NO: 6695591 - DNA, 20 bp, Homo sapiens
cactcatgttgttcccacac

SEQ ID NO: 6695592 - DNA, 21 bp, Homo sapiens
cactcatgttgttcccacaca

SEQ ID NO: 6695593 - DNA, 15 bp, Homo sapiens
cactcattcctgtag

SEQ ID NO: 6695594 - DNA, 18 bp, Homo sapiens
cactcattctgaattaat

SEQ ID NO: 6695595 - DNA, 23 bp, Homo sapiens
cactcattcttcggtctgaattt

SEQ ID NO: 6695596 - DNA, 18 bp, Homo sapiens
cactcattcttttttcta

SEQ ID NO: 6695597 - DNA, 15 bp, Homo sapiens
cactcattgacctga

SEQ ID NO: 6695598 - DNA, 22 bp, Homo sapiens
cactcattgacctgaggccctt

SEQ ID NO: 6695599 - DNA, 22 bp, Homo sapiens
cactcatttttttttgaggaga

SEQ ID NO: 6695600 - DNA, 22 bp, Homo sapiens
cactccaaaccttactctgagc

SEQ ID NO: 6695601 - DNA, 21 bp, Homo sapiens
cactccaaagagaaacctatt

SEQ ID NO: 6695602 - DNA, 16 bp, Homo sapiens
cactccaacctaacct

SEQ ID NO: 6695603 - DNA, 22 bp, Homo sapiens
cactccaacctaacctgtgtct

SEQ ID NO: 6695604 - DNA, 11 bp, Homo sapiens
cactccaactc

SEQ ID NO: 6695605 - DNA, 20 bp, Homo sapiens
cactccaagaccaccagggt

SEQ ID NO: 6695606 - DNA, 15 bp, Homo sapiens
cactccaagccagca

SEQ ID NO: 6695607 - DNA, 15 bp, Homo sapiens
cactccaagcccagc

SEQ ID NO: 6695608 - DNA, 20 bp, Homo sapiens
cactccaagccccctggcag

SEQ ID NO: 6695609 - DNA, 16 bp, Homo sapiens
cactccaatctgggtg

SEQ ID NO: 6695610 - DNA, 13 bp, Homo sapiens
cactccaattaag

SEQ ID NO: 6695611 - DNA, 17 bp, Homo sapiens
cactccaattaaggatt

SEQ ID NO: 6695612 - DNA, 21 bp, Homo sapiens
cactccacatctgcatcactc

SEQ ID NO: 6695613 - DNA, 18 bp, Homo sapiens
cactccacattcttcagt

SEQ ID NO: 6695614 - DNA, 14 bp, Homo sapiens
cactccaccaccca

SEQ ID NO: 6695615 - DNA, 15 bp, Homo sapiens
cactccaccacccaa

SEQ ID NO: 6695616 - DNA, 11 bp, Homo sapiens
cactccaccat

SEQ ID NO: 6695617 - DNA, 16 bp, Homo sapiens
cactccaccatcactc

SEQ ID NO: 6695618 - DNA, 18 bp, Homo sapiens
cactccaccccctccagc

SEQ ID NO: 6695619 - DNA, 18 bp, Homo sapiens
cactccaccctccacctt

SEQ ID NO: 6695620 - DNA, 16 bp, Homo sapiens
cactccacctccaccc

SEQ ID NO: 6695621 - DNA, 16 bp, Homo sapiens
cactccactcccctca

SEQ ID NO: 6695622 - DNA, 12 bp, Homo sapiens
cactccactctg

SEQ ID NO: 6695623 - DNA, 16 bp, Homo sapiens
cactccactctgattc

SEQ ID NO: 6695624 - DNA, 23 bp, Homo sapiens
cactccactctgattcacctctt

SEQ ID NO: 6695625 - DNA, 23 bp, Homo sapiens
cactccactgacaaacgtcccca

SEQ ID NO: 6695626 - DNA, 12 bp, Homo sapiens
cactccactgcc

SEQ ID NO: 6695627 - DNA, 14 bp, Homo sapiens
cactccagccaaag

SEQ ID NO: 6695628 - DNA, 15 bp, Homo sapiens
cactccagccaaaga

SEQ ID NO: 6695629 - DNA, 13 bp, Homo sapiens
cactccagccctg

SEQ ID NO: 6695630 - DNA, 13 bp, Homo sapiens
cactccagcctga

SEQ ID NO: 6695631 - DNA, 14 bp, Homo sapiens
cactccagcctgag

SEQ ID NO: 6695632 - DNA, 13 bp, Homo sapiens
cactccagctcct

SEQ ID NO: 6695633 - DNA, 12 bp, Homo sapiens
cactccagctgg

SEQ ID NO: 6695634 - DNA, 22 bp, Homo sapiens
cactccaggcatatgtttcccc

SEQ ID NO: 6695635 - DNA, 12 bp, Homo sapiens
cactccaggccc

SEQ ID NO: 6695636 - DNA, 14 bp, Homo sapiens
cactccaggccctg

SEQ ID NO: 6695637 - DNA, 17 bp, Homo sapiens
cactccaggccctgccc

SEQ ID NO: 6695638 - DNA, 20 bp, Homo sapiens
cactccaggccctgccccct

SEQ ID NO: 6695639 - DNA, 14 bp, Homo sapiens
cactccaggcctct

SEQ ID NO: 6695640 - DNA, 13 bp, Homo sapiens
cactccagggaca

SEQ ID NO: 6695641 - DNA, 15 bp, Homo sapiens
cactccaggtgtgga

SEQ ID NO: 6695642 - DNA, 18 bp, Homo sapiens
cactccagtagctcctgg

SEQ ID NO: 6695643 - DNA, 13 bp, Homo sapiens
cactccagtcctg

SEQ ID NO: 6695644 - DNA, 17 bp, Homo sapiens
cactccagtgctcagct

SEQ ID NO: 6695645 - DNA, 18 bp, Homo sapiens
cactccagtgctcagctg

SEQ ID NO: 6695646 - DNA, 22 bp, Homo sapiens
cactccagtttttgtttttgca

SEQ ID NO: 6695647 - DNA, 19 bp, Homo sapiens
cactccataaaaagaaagc

SEQ ID NO: 6695648 - DNA, 13 bp, Homo sapiens
cactccatcactg

SEQ ID NO: 6695649 - DNA, 14 bp, Homo sapiens
cactccatccctcc

SEQ ID NO: 6695650 - DNA, 16 bp, Homo sapiens
cactccatctcctgct

SEQ ID NO: 6695651 - DNA, 16 bp, Homo sapiens
cactccatggccaccc

SEQ ID NO: 6695652 - DNA, 17 bp, Homo sapiens
cactccatggccacccc

SEQ ID NO: 6695653 - DNA, 17 bp, Homo sapiens
cactccattattcctct

SEQ ID NO: 6695654 - DNA, 13 bp, Homo sapiens
cactccattccca

SEQ ID NO: 6695655 - DNA, 20 bp, Homo sapiens
cactccatttggtcctttct

SEQ ID NO: 6695656 - DNA, 20 bp, Homo sapiens
cactcccaaggttggagccc

SEQ ID NO: 6695657 - DNA, 13 bp, Homo sapiens
cactcccaagtct

SEQ ID NO: 6695658 - DNA, 17 bp, Homo sapiens
cactcccacctgacaca

SEQ ID NO: 6695659 - DNA, 13 bp, Homo sapiens
cactcccactgcc

SEQ ID NO: 6695660 - DNA, 16 bp, Homo sapiens
cactcccactgccagg

SEQ ID NO: 6695661 - DNA, 19 bp, Homo sapiens
cactcccactgccaggatt

SEQ ID NO: 6695662 - DNA, 14 bp, Homo sapiens
cactcccacttccc

SEQ ID NO: 6695663 - DNA, 14 bp, Homo sapiens
cactcccagcactc

SEQ ID NO: 6695664 - DNA, 14 bp, Homo sapiens
cactcccaggcagc

SEQ ID NO: 6695665 - DNA, 18 bp, Homo sapiens
cactcccagggcccgagc

SEQ ID NO: 6695666 - DNA, 15 bp, Homo sapiens
cactcccatctcctt

SEQ ID NO: 6695667 - DNA, 17 bp, Homo sapiens
cactcccatctccttac

SEQ ID NO: 6695668 - DNA, 17 bp, Homo sapiens
cactcccatctgattta

SEQ ID NO: 6695669 - DNA, 16 bp, Homo sapiens
cactcccatggctctg

SEQ ID NO: 6695670 - DNA, 16 bp, Homo sapiens
cactcccatttttact

SEQ ID NO: 6695671 - DNA, 19 bp, Homo sapiens
cactcccatttttacttaa

SEQ ID NO: 6695672 - DNA, 19 bp, Homo sapiens
cactccccaacccctctcc

SEQ ID NO: 6695673 - DNA, 20 bp, Homo sapiens
cactccccaaggaagagcca

SEQ ID NO: 6695674 - DNA, 14 bp, Homo sapiens
cactccccaccttc

SEQ ID NO: 6695675 - DNA, 15 bp, Homo sapiens
cactccccaccttca

SEQ ID NO: 6695676 - DNA, 14 bp, Homo sapiens
cactccccacggga

SEQ ID NO: 6695677 - DNA, 21 bp, Homo sapiens
cactccccacttcactttctt

SEQ ID NO: 6695678 - DNA, 20 bp, Homo sapiens
cactccccagagctgtgcca

SEQ ID NO: 6695679 - DNA, 15 bp, Homo sapiens
cactccccagcccca

SEQ ID NO: 6695680 - DNA, 18 bp, Homo sapiens
cactccccagccccagcc

SEQ ID NO: 6695681 - DNA, 12 bp, Homo sapiens
cactccccaggg

SEQ ID NO: 6695682 - DNA, 20 bp, Homo sapiens
cactccccagtgctcctgtg

SEQ ID NO: 6695683 - DNA, 16 bp, Homo sapiens
cactccccatgccacg

SEQ ID NO: 6695684 - DNA, 15 bp, Homo sapiens
cactcccccacccat

SEQ ID NO: 6695685 - DNA, 19 bp, Homo sapiens
cactcccccacccatgggg

SEQ ID NO: 6695686 - DNA, 21 bp, Homo sapiens
cactcccccacccatggggag

SEQ ID NO: 6695687 - DNA, 16 bp, Homo sapiens
cactcccccacctgac

SEQ ID NO: 6695688 - DNA, 13 bp, Homo sapiens
cactcccccagga

SEQ ID NO: 6695689 - DNA, 20 bp, Homo sapiens
cactcccccaggattgtgca

SEQ ID NO: 6695690 - DNA, 19 bp, Homo sapiens
cactccccccatcctacct

SEQ ID NO: 6695691 - DNA, 22 bp, Homo sapiens
cactcccccttcccttggaggg

SEQ ID NO: 6695692 - DNA, 18 bp, Homo sapiens
cactccccgaagtctttt

SEQ ID NO: 6695693 - DNA, 20 bp, Homo sapiens
cactccccgccgtacagttc

SEQ ID NO: 6695694 - DNA, 17 bp, Homo sapiens
cactccccgcctcccca

SEQ ID NO: 6695695 - DNA, 21 bp, Homo sapiens
cactccccgcctgtcctgcct

SEQ ID NO: 6695696 - DNA, 22 bp, Homo sapiens
cactccccgcctgtcctgcctc

SEQ ID NO: 6695697 - DNA, 13 bp, Homo sapiens
cactccccgcctt

SEQ ID NO: 6695698 - DNA, 18 bp, Homo sapiens
cactccccgccttagagc

SEQ ID NO: 6695699 - DNA, 16 bp, Homo sapiens
cactcccctcatccac

SEQ ID NO: 6695700 - DNA, 22 bp, Homo sapiens
cactcccctctcctccccttcc

SEQ ID NO: 6695701 - DNA, 17 bp, Homo sapiens
cactcccctgcactgga

SEQ ID NO: 6695702 - DNA, 13 bp, Homo sapiens
cactccccttgcc

SEQ ID NO: 6695703 - DNA, 12 bp, Homo sapiens
cactcccgcctc

SEQ ID NO: 6695704 - DNA, 15 bp, Homo sapiens
cactcccgctgcaca

SEQ ID NO: 6695705 - DNA, 16 bp, Homo sapiens
cactcccgctgcacac

SEQ ID NO: 6695706 - DNA, 18 bp, Homo sapiens
cactcccgctgcacacag

SEQ ID NO: 6695707 - DNA, 21 bp, Homo sapiens
cactcccggcactccatgctt

SEQ ID NO: 6695708 - DNA, 19 bp, Homo sapiens
cactcccggcctaggcacc

SEQ ID NO: 6695709 - DNA, 22 bp, Homo sapiens
cactcccggcctaggcacctcc

SEQ ID NO: 6695710 - DNA, 16 bp, Homo sapiens
cactcccgttttcggt

SEQ ID NO: 6695711 - DNA, 9 bp, Homo sapiens
cactcccta

SEQ ID NO: 6695712 - DNA, 21 bp, Homo sapiens
cactccctaaagccctcttca

SEQ ID NO: 6695713 - DNA, 12 bp, Homo sapiens
cactccctaccc

SEQ ID NO: 6695714 - DNA, 14 bp, Homo sapiens
cactccctaggccc

SEQ ID NO: 6695715 - DNA, 14 bp, Homo sapiens
cactccctccagca

SEQ ID NO: 6695716 - DNA, 17 bp, Homo sapiens
cactccctccagcacaa

SEQ ID NO: 6695717 - DNA, 19 bp, Homo sapiens
cactccctccagcacaaac

SEQ ID NO: 6695718 - DNA, 22 bp, Homo sapiens
cactccctcctggagctctgtg

SEQ ID NO: 6695719 - DNA, 23 bp, Homo sapiens
cactccctcctggagctctgtgg

SEQ ID NO: 6695720 - DNA, 17 bp, Homo sapiens
cactccctctgccttca

SEQ ID NO: 6695721 - DNA, 13 bp, Homo sapiens
cactccctcttgg

SEQ ID NO: 6695722 - DNA, 13 bp, Homo sapiens
cactccctgagct

SEQ ID NO: 6695723 - DNA, 14 bp, Homo sapiens
cactccctgagctt

SEQ ID NO: 6695724 - DNA, 23 bp, Homo sapiens
cactccctgccaactccatgacc

SEQ ID NO: 6695725 - DNA, 13 bp, Homo sapiens
cactccctgctcc

SEQ ID NO: 6695726 - DNA, 16 bp, Homo sapiens
cactccctgctccacg

SEQ ID NO: 6695727 - DNA, 20 bp, Homo sapiens
cactccctgctccacgaagc

SEQ ID NO: 6695728 - DNA, 16 bp, Homo sapiens
cactccctgcttgcag

SEQ ID NO: 6695729 - DNA, 18 bp, Homo sapiens
cactccctgcttgcagga

SEQ ID NO: 6695730 - DNA, 13 bp, Homo sapiens
cactccctggcct

SEQ ID NO: 6695731 - DNA, 15 bp, Homo sapiens
cactccctggccttg

SEQ ID NO: 6695732 - DNA, 16 bp, Homo sapiens
cactccctggccttgc

SEQ ID NO: 6695733 - DNA, 11 bp, Homo sapiens
cactccctggg

SEQ ID NO: 6695734 - DNA, 14 bp, Homo sapiens
cactccctgggaca

SEQ ID NO: 6695735 - DNA, 22 bp, Homo sapiens
cactccctgggacacagaccca

SEQ ID NO: 6695736 - DNA, 23 bp, Homo sapiens
cactccctgggggcgctgttcca

SEQ ID NO: 6695737 - DNA, 18 bp, Homo sapiens
cactcccttctacctgcc

SEQ ID NO: 6695738 - DNA, 14 bp, Homo sapiens
cactcccttctcct

SEQ ID NO: 6695739 - DNA, 17 bp, Homo sapiens
cactcccttgctggccc

SEQ ID NO: 6695740 - DNA, 19 bp, Homo sapiens
cactcccttgctggcccca

SEQ ID NO: 6695741 - DNA, 20 bp, Homo sapiens
cactcccttgctggccccag

SEQ ID NO: 6695742 - DNA, 16 bp, Homo sapiens
cactcccttgggctcc

SEQ ID NO: 6695743 - DNA, 22 bp, Homo sapiens
cactccctttccaacctcactt

SEQ ID NO: 6695744 - DNA, 22 bp, Homo sapiens
cactccctttgcgtcaggagca

SEQ ID NO: 6695745 - DNA, 19 bp, Homo sapiens
cactccctttgtggacttt

SEQ ID NO: 6695746 - DNA, 21 bp, Homo sapiens
cactccgactccccctccccg

SEQ ID NO: 6695747 - DNA, 15 bp, Homo sapiens
cactccgccagccac

SEQ ID NO: 6695748 - DNA, 17 bp, Homo sapiens
cactccgccagccacag

SEQ ID NO: 6695749 - DNA, 20 bp, Homo sapiens
cactccgccagccacaggac

SEQ ID NO: 6695750 - DNA, 21 bp, Homo sapiens
cactccgccagccacaggacc

SEQ ID NO: 6695751 - DNA, 22 bp, Homo sapiens
cactccgcgccgatgccaccgg

SEQ ID NO: 6695752 - DNA, 16 bp, Homo sapiens
cactccggattccggc

SEQ ID NO: 6695753 - DNA, 23 bp, Homo sapiens
cactccggattccggccctggct

SEQ ID NO: 6695754 - DNA, 23 bp, Homo sapiens
cactccggcctgggtgacagagt

SEQ ID NO: 6695755 - DNA, 20 bp, Homo sapiens
cactccggtgtgcctgcagc

SEQ ID NO: 6695756 - DNA, 22 bp, Homo sapiens
cactccggtgtgcctgcagccc

SEQ ID NO: 6695757 - DNA, 13 bp, Homo sapiens
cactcctacctgg

SEQ ID NO: 6695758 - DNA, 12 bp, Homo sapiens
cactcctagaga

SEQ ID NO: 6695759 - DNA, 18 bp, Homo sapiens
cactcctaggagagccaa

SEQ ID NO: 6695760 - DNA, 21 bp, Homo sapiens
cactcctcagtaaaagtcttc

SEQ ID NO: 6695761 - DNA, 15 bp, Homo sapiens
cactcctccaaagga

SEQ ID NO: 6695762 - DNA, 14 bp, Homo sapiens
cactcctccagcca

SEQ ID NO: 6695763 - DNA, 18 bp, Homo sapiens
cactcctccctgatgtac

SEQ ID NO: 6695764 - DNA, 15 bp, Homo sapiens
cactcctccgtgagc

SEQ ID NO: 6695765 - DNA, 10 bp, Homo sapiens
cactcctcct

SEQ ID NO: 6695766 - DNA, 16 bp, Homo sapiens
cactcctcctcggaag

SEQ ID NO: 6695767 - DNA, 16 bp, Homo sapiens
cactcctcctgccagc

SEQ ID NO: 6695768 - DNA, 20 bp, Homo sapiens
cactcctcctgccagctctg

SEQ ID NO: 6695769 - DNA, 15 bp, Homo sapiens
cactcctctcccaca

SEQ ID NO: 6695770 - DNA, 16 bp, Homo sapiens
cactcctctcccacag

SEQ ID NO: 6695771 - DNA, 13 bp, Homo sapiens
cactcctctgact

SEQ ID NO: 6695772 - DNA, 21 bp, Homo sapiens
cactcctctgactcagggctc

SEQ ID NO: 6695773 - DNA, 13 bp, Homo sapiens
cactcctctgctg

SEQ ID NO: 6695774 - DNA, 16 bp, Homo sapiens
cactcctctgtctctg

SEQ ID NO: 6695775 - DNA, 23 bp, Homo sapiens
cactcctctgtctctgctcttgc

SEQ ID NO: 6695776 - DNA, 14 bp, Homo sapiens
cactcctgagaccc

SEQ ID NO: 6695777 - DNA, 17 bp, Homo sapiens
cactcctgatttttatc

SEQ ID NO: 6695778 - DNA, 15 bp, Homo sapiens
cactcctgccagccc

SEQ ID NO: 6695779 - DNA, 13 bp, Homo sapiens
cactcctgcctgc

SEQ ID NO: 6695780 - DNA, 12 bp, Homo sapiens
cactcctgctct

SEQ ID NO: 6695781 - DNA, 10 bp, Homo sapiens
cactcctggg

SEQ ID NO: 6695782 - DNA, 22 bp, Homo sapiens
cactcctgggccccagaaagcc

SEQ ID NO: 6695783 - DNA, 13 bp, Homo sapiens
cactcctgggctc

SEQ ID NO: 6695784 - DNA, 19 bp, Homo sapiens
cactcctgggctctgaaca

SEQ ID NO: 6695785 - DNA, 21 bp, Homo sapiens
cactcctggtgcaggtctcca

SEQ ID NO: 6695786 - DNA, 13 bp, Homo sapiens
cactcctgtacac

SEQ ID NO: 6695787 - DNA, 13 bp, Homo sapiens
cactcctgtcccg

SEQ ID NO: 6695788 - DNA, 21 bp, Homo sapiens
cactccttcacagatgggtgc

SEQ ID NO: 6695789 - DNA, 16 bp, Homo sapiens
cactccttcccaaatc

SEQ ID NO: 6695790 - DNA, 13 bp, Homo sapiens
cactccttcccct

SEQ ID NO: 6695791 - DNA, 15 bp, Homo sapiens
cactccttcctgcca

SEQ ID NO: 6695792 - DNA, 17 bp, Homo sapiens
cactccttcctgccacc

SEQ ID NO: 6695793 - DNA, 17 bp, Homo sapiens
cactccttccttcagga

SEQ ID NO: 6695794 - DNA, 14 bp, Homo sapiens
cactccttgtcaac

SEQ ID NO: 6695795 - DNA, 13 bp, Homo sapiens
cactccttgtccc

SEQ ID NO: 6695796 - DNA, 16 bp, Homo sapiens
cactcgaactcgggag

SEQ ID NO: 6695797 - DNA, 13 bp, Homo sapiens
cactcgacatgaa

SEQ ID NO: 6695798 - DNA, 14 bp, Homo sapiens
cactcgacccagaa

SEQ ID NO: 6695799 - DNA, 16 bp, Homo sapiens
cactcgagaccatcct

SEQ ID NO: 6695800 - DNA, 19 bp, Homo sapiens
cactcgagaccatcctggc

SEQ ID NO: 6695801 - DNA, 14 bp, Homo sapiens
cactcgaggcctgc

SEQ ID NO: 6695802 - DNA, 19 bp, Homo sapiens
cactcgaggtcgggcagca

SEQ ID NO: 6695803 - DNA, 13 bp, Homo sapiens
cactcgcactgca

SEQ ID NO: 6695804 - DNA, 16 bp, Homo sapiens
cactcgcactgcaaat

SEQ ID NO: 6695805 - DNA, 12 bp, Homo sapiens
cactcgcaggac

SEQ ID NO: 6695806 - DNA, 13 bp, Homo sapiens
cactcgcaggacc

SEQ ID NO: 6695807 - DNA, 15 bp, Homo sapiens
cactcgcagtcgcag

SEQ ID NO: 6695808 - DNA, 21 bp, Homo sapiens
cactcgccatttcctcacgtg

SEQ ID NO: 6695809 - DNA, 15 bp, Homo sapiens
cactcgcccgcccac

SEQ ID NO: 6695810 - DNA, 18 bp, Homo sapiens
cactcgcccgcccactgt

SEQ ID NO: 6695811 - DNA, 13 bp, Homo sapiens
cactcgccttctt

SEQ ID NO: 6695812 - DNA, 14 bp, Homo sapiens
cactcgccttctta

SEQ ID NO: 6695813 - DNA, 13 bp, Homo sapiens
cactcgcttcccc

SEQ ID NO: 6695814 - DNA, 18 bp, Homo sapiens
cactcggggcccccatct

SEQ ID NO: 6695815 - DNA, 17 bp, Homo sapiens
cactcgggttaagaaat

SEQ ID NO: 6695816 - DNA, 18 bp, Homo sapiens
cactcgggttaagaaata

SEQ ID NO: 6695817 - DNA, 12 bp, Homo sapiens
cactcggtccca

SEQ ID NO: 6695818 - DNA, 14 bp, Homo sapiens
cactcggtcccagt

SEQ ID NO: 6695819 - DNA, 17 bp, Homo sapiens
cactcgtccaagggaca

SEQ ID NO: 6695820 - DNA, 22 bp, Homo sapiens
cactcgtccaagggacagccca

SEQ ID NO: 6695821 - DNA, 24 bp, Homo sapiens
cactcgtccaagggacagcccacg

SEQ ID NO: 6695822 - DNA, 20 bp, Homo sapiens
cactcgtgtgcaacagacaa

SEQ ID NO: 6695823 - DNA, 13 bp, Homo sapiens
cactctaaaaaac

SEQ ID NO: 6695824 - DNA, 12 bp, Homo sapiens
cactctaaactg

SEQ ID NO: 6695825 - DNA, 19 bp, Homo sapiens
cactctaagatgttatatt

SEQ ID NO: 6695826 - DNA, 17 bp, Homo sapiens
cactctaagtcatgtat

SEQ ID NO: 6695827 - DNA, 22 bp, Homo sapiens
cactctaagtcatgtatgtttc

SEQ ID NO: 6695828 - DNA, 14 bp, Homo sapiens
cactctacagactc

SEQ ID NO: 6695829 - DNA, 15 bp, Homo sapiens
cactctaccctccca

SEQ ID NO: 6695830 - DNA, 19 bp, Homo sapiens
cactctactgccccagctc

SEQ ID NO: 6695831 - DNA, 14 bp, Homo sapiens
cactctacttagca

SEQ ID NO: 6695832 - DNA, 16 bp, Homo sapiens
cactctagcctggcaa

SEQ ID NO: 6695833 - DNA, 19 bp, Homo sapiens
cactctagggcagtggagt

SEQ ID NO: 6695834 - DNA, 18 bp, Homo sapiens
cactctaggttttacaga

SEQ ID NO: 6695835 - DNA, 18 bp, Homo sapiens
cactctagtgacttcctg

SEQ ID NO: 6695836 - DNA, 19 bp, Homo sapiens
cactctagtgacttcctgg

SEQ ID NO: 6695837 - DNA, 21 bp, Homo sapiens
cactctagtgacttcctggtg

SEQ ID NO: 6695838 - DNA, 22 bp, Homo sapiens
cactctagtgacttcctggtga

SEQ ID NO: 6695839 - DNA, 14 bp, Homo sapiens
cactctagttctag

SEQ ID NO: 6695840 - DNA, 17 bp, Homo sapiens
cactctagttctagatg

SEQ ID NO: 6695841 - DNA, 20 bp, Homo sapiens
cactctatccaaagtgtcac

SEQ ID NO: 6695842 - DNA, 21 bp, Homo sapiens
cactctatccaaagtgtcact

SEQ ID NO: 6695843 - DNA, 20 bp, Homo sapiens
cactctcagagactcccagg

SEQ ID NO: 6695844 - DNA, 16 bp, Homo sapiens
cactctcagaggcccc

SEQ ID NO: 6695845 - DNA, 22 bp, Homo sapiens
cactctcaggaccaccctgcca

SEQ ID NO: 6695846 - DNA, 20 bp, Homo sapiens
cactctcatcaccccagagg

SEQ ID NO: 6695847 - DNA, 17 bp, Homo sapiens
cactctcattccccagg

SEQ ID NO: 6695848 - DNA, 18 bp, Homo sapiens
cactctccaccctggctg

SEQ ID NO: 6695849 - DNA, 12 bp, Homo sapiens
cactctccacct

SEQ ID NO: 6695850 - DNA, 15 bp, Homo sapiens
cactctccatttaat

SEQ ID NO: 6695851 - DNA, 17 bp, Homo sapiens
cactctccatttaataa

SEQ ID NO: 6695852 - DNA, 24 bp, Homo sapiens
cactctcccagaggctcctggagc

SEQ ID NO: 6695853 - DNA, 20 bp, Homo sapiens
cactctcccattatatttat

SEQ ID NO: 6695854 - DNA, 12 bp, Homo sapiens
cactctccccac

SEQ ID NO: 6695855 - DNA, 20 bp, Homo sapiens
cactctcccccaccccctcc

SEQ ID NO: 6695856 - DNA, 20 bp, Homo sapiens
cactctccccgctcaggggc

SEQ ID NO: 6695857 - DNA, 12 bp, Homo sapiens
cactctcccctc

SEQ ID NO: 6695858 - DNA, 17 bp, Homo sapiens
cactctcccctccctct

SEQ ID NO: 6695859 - DNA, 22 bp, Homo sapiens
cactctcccctccctcttcctt

SEQ ID NO: 6695860 - DNA, 15 bp, Homo sapiens
cactctcccttgtac

SEQ ID NO: 6695861 - DNA, 12 bp, Homo sapiens
cactctcctggg

SEQ ID NO: 6695862 - DNA, 14 bp, Homo sapiens
cactctcctgggcc

SEQ ID NO: 6695863 - DNA, 15 bp, Homo sapiens
cactctcctgggccc

SEQ ID NO: 6695864 - DNA, 21 bp, Homo sapiens
cactctcctgggccccaagga

SEQ ID NO: 6695865 - DNA, 20 bp, Homo sapiens
cactctcctgggcccctccc

SEQ ID NO: 6695866 - DNA, 21 bp, Homo sapiens
cactctcctgggcccctccct

SEQ ID NO: 6695867 - DNA, 13 bp, Homo sapiens
cactctccttgca

SEQ ID NO: 6695868 - DNA, 15 bp, Homo sapiens
cactctccttgcagt

SEQ ID NO: 6695869 - DNA, 20 bp, Homo sapiens
cactctccttgctacccaga

SEQ ID NO: 6695870 - DNA, 21 bp, Homo sapiens
cactctccttgctacccagaa

SEQ ID NO: 6695871 - DNA, 12 bp, Homo sapiens
cactctccttgg

SEQ ID NO: 6695872 - DNA, 20 bp, Homo sapiens
cactctcgtggtatgtatgg

SEQ ID NO: 6695873 - DNA, 22 bp, Homo sapiens
cactctctattgtcatggggat

SEQ ID NO: 6695874 - DNA, 19 bp, Homo sapiens
cactctctcacccaccagc

SEQ ID NO: 6695875 - DNA, 23 bp, Homo sapiens
cactctctcacccaccagctcca

SEQ ID NO: 6695876 - DNA, 13 bp, Homo sapiens
cactctctgaaga

SEQ ID NO: 6695877 - DNA, 13 bp, Homo sapiens
cactctctgcagc

SEQ ID NO: 6695878 - DNA, 19 bp, Homo sapiens
cactctctgcagcccagcc

SEQ ID NO: 6695879 - DNA, 12 bp, Homo sapiens
cactctctgcca

SEQ ID NO: 6695880 - DNA, 13 bp, Homo sapiens
cactctctgccag

SEQ ID NO: 6695881 - DNA, 14 bp, Homo sapiens
cactctctgccagc

SEQ ID NO: 6695882 - DNA, 13 bp, Homo sapiens
cactctctgccat

SEQ ID NO: 6695883 - DNA, 12 bp, Homo sapiens
cactctctgccc

SEQ ID NO: 6695884 - DNA, 14 bp, Homo sapiens
cactctctgcccct

SEQ ID NO: 6695885 - DNA, 12 bp, Homo sapiens
cactctctgctg

SEQ ID NO: 6695886 - DNA, 13 bp, Homo sapiens
cactctctggaag

SEQ ID NO: 6695887 - DNA, 13 bp, Homo sapiens
cactctcttcctt

SEQ ID NO: 6695888 - DNA, 14 bp, Homo sapiens
cactctcttccttt

SEQ ID NO: 6695889 - DNA, 11 bp, Homo sapiens
cactctgaagt

SEQ ID NO: 6695890 - DNA, 19 bp, Homo sapiens
cactctgacaagctggcca

SEQ ID NO: 6695891 - DNA, 13 bp, Homo sapiens
cactctgaccggg

SEQ ID NO: 6695892 - DNA, 20 bp, Homo sapiens
cactctgacgcaaaaccact

SEQ ID NO: 6695893 - DNA, 12 bp, Homo sapiens
cactctgagact

SEQ ID NO: 6695894 - DNA, 20 bp, Homo sapiens
cactctgaggtctcaccttc

SEQ ID NO: 6695895 - DNA, 18 bp, Homo sapiens
cactctgagtctctgaat

SEQ ID NO: 6695896 - DNA, 19 bp, Homo sapiens
cactctgagtctctgaatg

SEQ ID NO: 6695897 - DNA, 19 bp, Homo sapiens
cactctgagtgaatacttt

SEQ ID NO: 6695898 - DNA, 16 bp, Homo sapiens
cactctgattcacctc

SEQ ID NO: 6695899 - DNA, 22 bp, Homo sapiens
cactctgattcacctcttcctc

SEQ ID NO: 6695900 - DNA, 15 bp, Homo sapiens
cactctgcaggaaat

SEQ ID NO: 6695901 - DNA, 16 bp, Homo sapiens
cactctgccagcaaag

SEQ ID NO: 6695902 - DNA, 17 bp, Homo sapiens
cactctgccagcaaaga

SEQ ID NO: 6695903 - DNA, 16 bp, Homo sapiens
cactctgccagggcag

SEQ ID NO: 6695904 - DNA, 15 bp, Homo sapiens
cactctgccctctgc

SEQ ID NO: 6695905 - DNA, 16 bp, Homo sapiens
cactctgccctctgct

SEQ ID NO: 6695906 - DNA, 20 bp, Homo sapiens
cactctgccctctgctgctg

SEQ ID NO: 6695907 - DNA, 20 bp, Homo sapiens
cactctgcctctgcctgcat

SEQ ID NO: 6695908 - DNA, 12 bp, Homo sapiens
cactctgcctgc

SEQ ID NO: 6695909 - DNA, 18 bp, Homo sapiens
cactctgccttcctgagt

SEQ ID NO: 6695910 - DNA, 18 bp, Homo sapiens
cactctgcggcccgggcc

SEQ ID NO: 6695911 - DNA, 21 bp, Homo sapiens
cactctgcggcccgggccgac

SEQ ID NO: 6695912 - DNA, 16 bp, Homo sapiens
cactctgctcccagcc

SEQ ID NO: 6695913 - DNA, 17 bp, Homo sapiens
cactctgctcccagccc

SEQ ID NO: 6695914 - DNA, 15 bp, Homo sapiens
cactctgctctgatg

SEQ ID NO: 6695915 - DNA, 17 bp, Homo sapiens
cactctgctctgatgca

SEQ ID NO: 6695916 - DNA, 13 bp, Homo sapiens
cactctgctgagg

SEQ ID NO: 6695917 - DNA, 15 bp, Homo sapiens
cactctgctgaggcc

SEQ ID NO: 6695918 - DNA, 23 bp, Homo sapiens
cactctgctgaggccagaggaag

SEQ ID NO: 6695919 - DNA, 15 bp, Homo sapiens
cactctgctgcctgt

SEQ ID NO: 6695920 - DNA, 20 bp, Homo sapiens
cactctgctgcctgtacaga

SEQ ID NO: 6695921 - DNA, 14 bp, Homo sapiens
cactctgctgctta

SEQ ID NO: 6695922 - DNA, 17 bp, Homo sapiens
cactctgcttctctgac

SEQ ID NO: 6695923 - DNA, 19 bp, Homo sapiens
cactctgcttctctgactt

SEQ ID NO: 6695924 - DNA, 21 bp, Homo sapiens
cactctgctttgactgagcag

SEQ ID NO: 6695925 - DNA, 22 bp, Homo sapiens
cactctggattcagccttcttt

SEQ ID NO: 6695926 - DNA, 13 bp, Homo sapiens
cactctggcagca

SEQ ID NO: 6695927 - DNA, 16 bp, Homo sapiens
cactctggcagcaccg

SEQ ID NO: 6695928 - DNA, 23 bp, Homo sapiens
cactctggcagctcagagagggt

SEQ ID NO: 6695929 - DNA, 12 bp, Homo sapiens
cactctggcctc

SEQ ID NO: 6695930 - DNA, 21 bp, Homo sapiens
cactctgggcaaagcccctca

SEQ ID NO: 6695931 - DNA, 21 bp, Homo sapiens
cactctgggcacactctgcca

SEQ ID NO: 6695932 - DNA, 16 bp, Homo sapiens
cactctgggcctgggg

SEQ ID NO: 6695933 - DNA, 17 bp, Homo sapiens
cactctgggctccagag

SEQ ID NO: 6695934 - DNA, 17 bp, Homo sapiens
cactctggggtgggagg

SEQ ID NO: 6695935 - DNA, 17 bp, Homo sapiens
cactctgggtctggcca

SEQ ID NO: 6695936 - DNA, 18 bp, Homo sapiens
cactctggtcttggaatt

SEQ ID NO: 6695937 - DNA, 12 bp, Homo sapiens
cactctggtggc

SEQ ID NO: 6695938 - DNA, 19 bp, Homo sapiens
cactctggtggccacttca

SEQ ID NO: 6695939 - DNA, 24 bp, Homo sapiens
cactctgtaatagttcagtagaat

SEQ ID NO: 6695940 - DNA, 13 bp, Homo sapiens
cactctgtaattg

SEQ ID NO: 6695941 - DNA, 18 bp, Homo sapiens
cactctgtcacccaggct

SEQ ID NO: 6695942 - DNA, 16 bp, Homo sapiens
cactctgtcagccagc

SEQ ID NO: 6695943 - DNA, 22 bp, Homo sapiens
cactctgtcagccagccgccct

SEQ ID NO: 6695944 - DNA, 15 bp, Homo sapiens
cactctgtcgcccag

SEQ ID NO: 6695945 - DNA, 20 bp, Homo sapiens
cactctgtcgctcaggctgg

SEQ ID NO: 6695946 - DNA, 14 bp, Homo sapiens
cactctgtggccag

SEQ ID NO: 6695947 - DNA, 17 bp, Homo sapiens
cactctgtggccagcct

SEQ ID NO: 6695948 - DNA, 23 bp, Homo sapiens
cactctgtggccagcctggcatc

SEQ ID NO: 6695949 - DNA, 19 bp, Homo sapiens
cactctgtggtccagagtc

SEQ ID NO: 6695950 - DNA, 20 bp, Homo sapiens
cactctgtggtccagagtca

SEQ ID NO: 6695951 - DNA, 17 bp, Homo sapiens
cactctgtgtctgagtg

SEQ ID NO: 6695952 - DNA, 22 bp, Homo sapiens
cactctgtgtgggaaaatggca

SEQ ID NO: 6695953 - DNA, 13 bp, Homo sapiens
cactctgttattt

SEQ ID NO: 6695954 - DNA, 17 bp, Homo sapiens
cactctgttcattcctc

SEQ ID NO: 6695955 - DNA, 20 bp, Homo sapiens
cactctgttcattcctccag

SEQ ID NO: 6695956 - DNA, 20 bp, Homo sapiens
cactctgttgaccaggctgg

SEQ ID NO: 6695957 - DNA, 17 bp, Homo sapiens
cactctgttgcccaggc

SEQ ID NO: 6695958 - DNA, 20 bp, Homo sapiens
cactctgttgcccaggctgg

SEQ ID NO: 6695959 - DNA, 21 bp, Homo sapiens
cactctgtttgctcacccagg

SEQ ID NO: 6695960 - DNA, 14 bp, Homo sapiens
cactcttaaatgat

SEQ ID NO: 6695961 - DNA, 22 bp, Homo sapiens
cactcttagcccatgctgtttt

SEQ ID NO: 6695962 - DNA, 11 bp, Homo sapiens
cactcttaggc

SEQ ID NO: 6695963 - DNA, 14 bp, Homo sapiens
cactcttatgctgt

SEQ ID NO: 6695964 - DNA, 17 bp, Homo sapiens
cactcttattgcccacg

SEQ ID NO: 6695965 - DNA, 19 bp, Homo sapiens
cactcttattgcccacgct

SEQ ID NO: 6695966 - DNA, 20 bp, Homo sapiens
cactcttattgcccacgctg

SEQ ID NO: 6695967 - DNA, 19 bp, Homo sapiens
cactcttattgtccttcta

SEQ ID NO: 6695968 - DNA, 23 bp, Homo sapiens
cactcttcacttgagttggctgt

SEQ ID NO: 6695969 - DNA, 22 bp, Homo sapiens
cactcttcagtgactcctgctg

SEQ ID NO: 6695970 - DNA, 23 bp, Homo sapiens
cactcttcagtgactcctgctgg

SEQ ID NO: 6695971 - DNA, 14 bp, Homo sapiens
cactcttcatggtg

SEQ ID NO: 6695972 - DNA, 17 bp, Homo sapiens
cactcttcctgcaagga

SEQ ID NO: 6695973 - DNA, 13 bp, Homo sapiens
cactcttctcagc

SEQ ID NO: 6695974 - DNA, 14 bp, Homo sapiens
cactcttctcagcc

SEQ ID NO: 6695975 - DNA, 17 bp, Homo sapiens
cactcttctcagccact

SEQ ID NO: 6695976 - DNA, 20 bp, Homo sapiens
cactcttctctccaaggaaa

SEQ ID NO: 6695977 - DNA, 14 bp, Homo sapiens
cactcttctctcct

SEQ ID NO: 6695978 - DNA, 22 bp, Homo sapiens
cactcttctgtcttgtccccac

SEQ ID NO: 6695979 - DNA, 13 bp, Homo sapiens
cactcttgaagag

SEQ ID NO: 6695980 - DNA, 18 bp, Homo sapiens
cactcttgaagtccagga

SEQ ID NO: 6695981 - DNA, 19 bp, Homo sapiens
cactcttgaagtccaggac

SEQ ID NO: 6695982 - DNA, 20 bp, Homo sapiens
cactcttgaagtccaggact

SEQ ID NO: 6695983 - DNA, 18 bp, Homo sapiens
cactcttgatctctcttg

SEQ ID NO: 6695984 - DNA, 21 bp, Homo sapiens
cactcttggagcctgcagagc

SEQ ID NO: 6695985 - DNA, 19 bp, Homo sapiens
cactcttgttgaagtgctg

SEQ ID NO: 6695986 - DNA, 16 bp, Homo sapiens
cactcttgtttgcttt

SEQ ID NO: 6695987 - DNA, 19 bp, Homo sapiens
cactctttaacacattctt

SEQ ID NO: 6695988 - DNA, 20 bp, Homo sapiens
cactctttaacacattcttt

SEQ ID NO: 6695989 - DNA, 15 bp, Homo sapiens
cactctttaccttta

SEQ ID NO: 6695990 - DNA, 20 bp, Homo sapiens
cactctttatagtgcacaaa

SEQ ID NO: 6695991 - DNA, 14 bp, Homo sapiens
cactctttccagat

SEQ ID NO: 6695992 - DNA, 16 bp, Homo sapiens
cactctttctcctgct

SEQ ID NO: 6695993 - DNA, 20 bp, Homo sapiens
cactctttcttctctctttg

SEQ ID NO: 6695994 - DNA, 14 bp, Homo sapiens
cactctttctttca

SEQ ID NO: 6695995 - DNA, 17 bp, Homo sapiens
cactctttgctacaata

SEQ ID NO: 6695996 - DNA, 21 bp, Homo sapiens
cactctttgctacaataaatg

SEQ ID NO: 6695997 - DNA, 23 bp, Homo sapiens
cactcttttgctttattccagaa

SEQ ID NO: 6695998 - DNA, 12 bp, Homo sapiens
cactgaaaaaat

SEQ ID NO: 6695999 - DNA, 14 bp, Homo sapiens
cactgaaaaaatat

SEQ ID NO: 6696000 - DNA, 17 bp, Homo sapiens
cactgaaaaaatatatg

SEQ ID NO: 6696001 - DNA, 11 bp, Homo sapiens
cactgaaaaat

SEQ ID NO: 6696002 - DNA, 15 bp, Homo sapiens
cactgaaaacatctg

SEQ ID NO: 6696003 - DNA, 22 bp, Homo sapiens
cactgaaaacatttcaaagctg

SEQ ID NO: 6696004 - DNA, 19 bp, Homo sapiens
cactgaaaacttagccaga

SEQ ID NO: 6696005 - DNA, 16 bp, Homo sapiens
cactgaaaagctttcc

SEQ ID NO: 6696006 - DNA, 12 bp, Homo sapiens
cactgaaaccaa

SEQ ID NO: 6696007 - DNA, 14 bp, Homo sapiens
cactgaaaccaaaa

SEQ ID NO: 6696008 - DNA, 17 bp, Homo sapiens
cactgaaacctctgcct

SEQ ID NO: 6696009 - DNA, 12 bp, Homo sapiens
cactgaaacctg

SEQ ID NO: 6696010 - DNA, 14 bp, Homo sapiens
cactgaaaccttta

SEQ ID NO: 6696011 - DNA, 20 bp, Homo sapiens
cactgaaacctttaagaaaa

SEQ ID NO: 6696012 - DNA, 18 bp, Homo sapiens
cactgaaaggaaaaatgt

SEQ ID NO: 6696013 - DNA, 17 bp, Homo sapiens
cactgaaagttttgtaa

SEQ ID NO: 6696014 - DNA, 18 bp, Homo sapiens
cactgaaagttttgtaaa

SEQ ID NO: 6696015 - DNA, 14 bp, Homo sapiens
cactgaaatagagt

SEQ ID NO: 6696016 - DNA, 17 bp, Homo sapiens
cactgaaatctgtcaag

SEQ ID NO: 6696017 - DNA, 23 bp, Homo sapiens
cactgaaatgaaatcttcccagt

SEQ ID NO: 6696018 - DNA, 21 bp, Homo sapiens
cactgaaattctaaatattga

SEQ ID NO: 6696019 - DNA, 18 bp, Homo sapiens
cactgaaattgcctgaaa

SEQ ID NO: 6696020 - DNA, 13 bp, Homo sapiens
cactgaacaaaac

SEQ ID NO: 6696021 - DNA, 16 bp, Homo sapiens
cactgaacaaaaccta

SEQ ID NO: 6696022 - DNA, 15 bp, Homo sapiens
cactgaacaaactaa

SEQ ID NO: 6696023 - DNA, 22 bp, Homo sapiens
cactgaacaaactaaaggtgca

SEQ ID NO: 6696024 - DNA, 16 bp, Homo sapiens
cactgaacaggctggg

SEQ ID NO: 6696025 - DNA, 14 bp, Homo sapiens
cactgaacatgcct

SEQ ID NO: 6696026 - DNA, 13 bp, Homo sapiens
cactgaaccactg

SEQ ID NO: 6696027 - DNA, 16 bp, Homo sapiens
cactgaaccactgctt

SEQ ID NO: 6696028 - DNA, 22 bp, Homo sapiens
cactgaaccgctacaagagggc

SEQ ID NO: 6696029 - DNA, 13 bp, Homo sapiens
cactgaacctctg

SEQ ID NO: 6696030 - DNA, 23 bp, Homo sapiens
cactgaaccttgttgatgccagc

SEQ ID NO: 6696031 - DNA, 14 bp, Homo sapiens
cactgaactcagga

SEQ ID NO: 6696032 - DNA, 17 bp, Homo sapiens
cactgaactccttcccc

SEQ ID NO: 6696033 - DNA, 21 bp, Homo sapiens
cactgaactctacgccactcc

SEQ ID NO: 6696034 - DNA, 14 bp, Homo sapiens
cactgaactgcttt

SEQ ID NO: 6696035 - DNA, 23 bp, Homo sapiens
cactgaacttttcaaaataaagc

SEQ ID NO: 6696036 - DNA, 21 bp, Homo sapiens
cactgaagagagcatttggca

SEQ ID NO: 6696037 - DNA, 12 bp, Homo sapiens
cactgaagagct

SEQ ID NO: 6696038 - DNA, 17 bp, Homo sapiens
cactgaagagctcttgg

SEQ ID NO: 6696039 - DNA, 21 bp, Homo sapiens
cactgaagccggacagctgcc

SEQ ID NO: 6696040 - DNA, 22 bp, Homo sapiens
cactgaagccggacagctgccc

SEQ ID NO: 6696041 - DNA, 17 bp, Homo sapiens
cactgaagctgggattc

SEQ ID NO: 6696042 - DNA, 17 bp, Homo sapiens
cactgaaggacctgagc

SEQ ID NO: 6696043 - DNA, 20 bp, Homo sapiens
cactgaaggctttcagggcc

SEQ ID NO: 6696044 - DNA, 19 bp, Homo sapiens
cactgaagtagtgtgcagt

SEQ ID NO: 6696045 - DNA, 16 bp, Homo sapiens
cactgaagtgaataca

SEQ ID NO: 6696046 - DNA, 21 bp, Homo sapiens
cactgaagtgaatacatggta

SEQ ID NO: 6696047 - DNA, 16 bp, Homo sapiens
cactgaagtgattgaa

SEQ ID NO: 6696048 - DNA, 18 bp, Homo sapiens
cactgaagtgattgaaag

SEQ ID NO: 6696049 - DNA, 13 bp, Homo sapiens
cactgaagtgctt

SEQ ID NO: 6696050 - DNA, 17 bp, Homo sapiens
cactgaagtggccctcc

SEQ ID NO: 6696051 - DNA, 22 bp, Homo sapiens
cactgaagtttgataaatagtg

SEQ ID NO: 6696052 - DNA, 19 bp, Homo sapiens
cactgaagtttttgaaata

SEQ ID NO: 6696053 - DNA, 21 bp, Homo sapiens
cactgaagtttttgaaatacc

SEQ ID NO: 6696054 - DNA, 13 bp, Homo sapiens
cactgaatatata

SEQ ID NO: 6696055 - DNA, 20 bp, Homo sapiens
cactgaatatataaacactc

SEQ ID NO: 6696056 - DNA, 19 bp, Homo sapiens
cactgaatcatgttaatag

SEQ ID NO: 6696057 - DNA, 15 bp, Homo sapiens
cactgaatcgtttca

SEQ ID NO: 6696058 - DNA, 18 bp, Homo sapiens
cactgaatcgtttcatgt

SEQ ID NO: 6696059 - DNA, 23 bp, Homo sapiens
cactgaattaatgacagagccag

SEQ ID NO: 6696060 - DNA, 12 bp, Homo sapiens
cactgaattcac

SEQ ID NO: 6696061 - DNA, 14 bp, Homo sapiens
cactgaattcactc

SEQ ID NO: 6696062 - DNA, 16 bp, Homo sapiens
cactgaattcactcca

SEQ ID NO: 6696063 - DNA, 13 bp, Homo sapiens
cactgaattgaat

SEQ ID NO: 6696064 - DNA, 19 bp, Homo sapiens
cactgaattggaacttttc

SEQ ID NO: 6696065 - DNA, 20 bp, Homo sapiens
cactgacaaacgtccccagc

SEQ ID NO: 6696066 - DNA, 14 bp, Homo sapiens
cactgacaacgaaa

SEQ ID NO: 6696067 - DNA, 15 bp, Homo sapiens
cactgacacaaagga

SEQ ID NO: 6696068 - DNA, 14 bp, Homo sapiens
cactgacacccagt

SEQ ID NO: 6696069 - DNA, 17 bp, Homo sapiens
cactgacacctttgcag

SEQ ID NO: 6696070 - DNA, 15 bp, Homo sapiens
cactgacagcctggg

SEQ ID NO: 6696071 - DNA, 17 bp, Homo sapiens
cactgacagccttgccc

SEQ ID NO: 6696072 - DNA, 17 bp, Homo sapiens
cactgacatttcacttc

SEQ ID NO: 6696073 - DNA, 13 bp, Homo sapiens
cactgaccacact

SEQ ID NO: 6696074 - DNA, 18 bp, Homo sapiens
cactgaccagcggctgct

SEQ ID NO: 6696075 - DNA, 19 bp, Homo sapiens
cactgaccagcggctgctc

SEQ ID NO: 6696076 - DNA, 13 bp, Homo sapiens
cactgacccaaat

SEQ ID NO: 6696077 - DNA, 21 bp, Homo sapiens
cactgacccaactgatcctgc

SEQ ID NO: 6696078 - DNA, 14 bp, Homo sapiens
cactgacccacagc

SEQ ID NO: 6696079 - DNA, 19 bp, Homo sapiens
cactgacccacagcctctg

SEQ ID NO: 6696080 - DNA, 24 bp, Homo sapiens
cactgacccacctgcgcttctgct

SEQ ID NO: 6696081 - DNA, 21 bp, Homo sapiens
cactgaccccccccattagaa

SEQ ID NO: 6696082 - DNA, 16 bp, Homo sapiens
cactgacctcaccggc

SEQ ID NO: 6696083 - DNA, 17 bp, Homo sapiens
cactgacctcaccggca

SEQ ID NO: 6696084 - DNA, 16 bp, Homo sapiens
cactgacctgcccatg

SEQ ID NO: 6696085 - DNA, 21 bp, Homo sapiens
cactgacctgctccgccagga

SEQ ID NO: 6696086 - DNA, 23 bp, Homo sapiens
cactgacctgctccgccaggaaa

SEQ ID NO: 6696087 - DNA, 13 bp, Homo sapiens
cactgactattac

SEQ ID NO: 6696088 - DNA, 14 bp, Homo sapiens
cactgactcctgtg

SEQ ID NO: 6696089 - DNA, 14 bp, Homo sapiens
cactgactctggaa

SEQ ID NO: 6696090 - DNA, 16 bp, Homo sapiens
cactgactgcagggac

SEQ ID NO: 6696091 - DNA, 14 bp, Homo sapiens
cactgactgggacc

SEQ ID NO: 6696092 - DNA, 15 bp, Homo sapiens
cactgactgtatggc

SEQ ID NO: 6696093 - DNA, 13 bp, Homo sapiens
cactgacttctcc

SEQ ID NO: 6696094 - DNA, 18 bp, Homo sapiens
cactgacttctcccgggt

SEQ ID NO: 6696095 - DNA, 18 bp, Homo sapiens
cactgacttgctgtgtga

SEQ ID NO: 6696096 - DNA, 12 bp, Homo sapiens
cactgagaaaga

SEQ ID NO: 6696097 - DNA, 13 bp, Homo sapiens
cactgagaaagag

SEQ ID NO: 6696098 - DNA, 19 bp, Homo sapiens
cactgagaaagaggcaggg

SEQ ID NO: 6696099 - DNA, 19 bp, Homo sapiens
cactgagaaatagtgcact

SEQ ID NO: 6696100 - DNA, 16 bp, Homo sapiens
cactgagaagatggca

SEQ ID NO: 6696101 - DNA, 22 bp, Homo sapiens
cactgagaagatggcactgtcc

SEQ ID NO: 6696102 - DNA, 21 bp, Homo sapiens
cactgagaaggccccagggca

SEQ ID NO: 6696103 - DNA, 20 bp, Homo sapiens
cactgagaatgtaagaacta

SEQ ID NO: 6696104 - DNA, 21 bp, Homo sapiens
cactgagaatgtaagaactac

SEQ ID NO: 6696105 - DNA, 18 bp, Homo sapiens
cactgagacggcagagac

SEQ ID NO: 6696106 - DNA, 17 bp, Homo sapiens
cactgagagcctttttg

SEQ ID NO: 6696107 - DNA, 19 bp, Homo sapiens
cactgagagctgcctcctg

SEQ ID NO: 6696108 - DNA, 21 bp, Homo sapiens
cactgagaggacagagagaaa

SEQ ID NO: 6696109 - DNA, 12 bp, Homo sapiens
cactgagcaagt

SEQ ID NO: 6696110 - DNA, 13 bp, Homo sapiens
cactgagcacagt

SEQ ID NO: 6696111 - DNA, 13 bp, Homo sapiens
cactgagcaggga

SEQ ID NO: 6696112 - DNA, 16 bp, Homo sapiens
cactgagcatcacaat

SEQ ID NO: 6696113 - DNA, 18 bp, Homo sapiens
cactgagcatcactagtg

SEQ ID NO: 6696114 - DNA, 11 bp, Homo sapiens
cactgagcccc

SEQ ID NO: 6696115 - DNA, 16 bp, Homo sapiens
cactgagcccccccaa

SEQ ID NO: 6696116 - DNA, 15 bp, Homo sapiens
cactgagcccttgca

SEQ ID NO: 6696117 - DNA, 13 bp, Homo sapiens
cactgagcctggc

SEQ ID NO: 6696118 - DNA, 12 bp, Homo sapiens
cactgagctcca

SEQ ID NO: 6696119 - DNA, 15 bp, Homo sapiens
cactgagctccccag

SEQ ID NO: 6696120 - DNA, 19 bp, Homo sapiens
cactgagctccccagatct

SEQ ID NO: 6696121 - DNA, 14 bp, Homo sapiens
cactgagctggctg

SEQ ID NO: 6696122 - DNA, 16 bp, Homo sapiens
cactgagctggctgac

SEQ ID NO: 6696123 - DNA, 12 bp, Homo sapiens
cactgagctggg

SEQ ID NO: 6696124 - DNA, 19 bp, Homo sapiens
cactgaggagacagaaagc

SEQ ID NO: 6696125 - DNA, 18 bp, Homo sapiens
cactgaggcagccttggg

SEQ ID NO: 6696126 - DNA, 14 bp, Homo sapiens
cactgaggcaggga

SEQ ID NO: 6696127 - DNA, 19 bp, Homo sapiens
cactgaggcagggaagtcc

SEQ ID NO: 6696128 - DNA, 19 bp, Homo sapiens
cactgaggccatcagggcc

SEQ ID NO: 6696129 - DNA, 20 bp, Homo sapiens
cactgaggccatcagggccc

SEQ ID NO: 6696130 - DNA, 23 bp, Homo sapiens
cactgaggccatcagggccctgc

SEQ ID NO: 6696131 - DNA, 23 bp, Homo sapiens
cactgaggcctgagacccaggac

SEQ ID NO: 6696132 - DNA, 19 bp, Homo sapiens
cactgaggcttaggcctct

SEQ ID NO: 6696133 - DNA, 10 bp, Homo sapiens
cactgagggc

SEQ ID NO: 6696134 - DNA, 14 bp, Homo sapiens
cactgagggcagtc

SEQ ID NO: 6696135 - DNA, 18 bp, Homo sapiens
cactgagggccacactat

SEQ ID NO: 6696136 - DNA, 20 bp, Homo sapiens
cactgaggggccagggagga

SEQ ID NO: 6696137 - DNA, 20 bp, Homo sapiens
cactgaggggggatccagtt

SEQ ID NO: 6696138 - DNA, 15 bp, Homo sapiens
cactgagggtcactc

SEQ ID NO: 6696139 - DNA, 19 bp, Homo sapiens
cactgaggtccacagacct

SEQ ID NO: 6696140 - DNA, 17 bp, Homo sapiens
cactgagtaccaggggc

SEQ ID NO: 6696141 - DNA, 22 bp, Homo sapiens
cactgagtaccaggggctgggc

SEQ ID NO: 6696142 - DNA, 21 bp, Homo sapiens
cactgagtctcattcctctgt

SEQ ID NO: 6696143 - DNA, 13 bp, Homo sapiens
cactgagtggctt

SEQ ID NO: 6696144 - DNA, 15 bp, Homo sapiens
cactgagttctatca

SEQ ID NO: 6696145 - DNA, 23 bp, Homo sapiens
cactgagttgggcaaaacccagg

SEQ ID NO: 6696146 - DNA, 14 bp, Homo sapiens
cactgagtttctat

SEQ ID NO: 6696147 - DNA, 20 bp, Homo sapiens
cactgatacataaaaattaa

SEQ ID NO: 6696148 - DNA, 18 bp, Homo sapiens
cactgatatcacgggccc

SEQ ID NO: 6696149 - DNA, 19 bp, Homo sapiens
cactgatatcacgggcccg

SEQ ID NO: 6696150 - DNA, 21 bp, Homo sapiens
cactgatatcacgggcccgct

SEQ ID NO: 6696151 - DNA, 17 bp, Homo sapiens
cactgatatcatgggga

SEQ ID NO: 6696152 - DNA, 14 bp, Homo sapiens
cactgatccagccc

SEQ ID NO: 6696153 - DNA, 15 bp, Homo sapiens
cactgatccagccct

SEQ ID NO: 6696154 - DNA, 21 bp, Homo sapiens
cactgatctgctagtgctgta

SEQ ID NO: 6696155 - DNA, 17 bp, Homo sapiens
cactgatctttgcaaag

SEQ ID NO: 6696156 - DNA, 18 bp, Homo sapiens
cactgatgagtttcactg

SEQ ID NO: 6696157 - DNA, 23 bp, Homo sapiens
cactgatgagtttcactgtactg

SEQ ID NO: 6696158 - DNA, 14 bp, Homo sapiens
cactgatgcaagga

SEQ ID NO: 6696159 - DNA, 17 bp, Homo sapiens
cactgatgctgcccctc

SEQ ID NO: 6696160 - DNA, 23 bp, Homo sapiens
cactgatgctgttctcttcttca

SEQ ID NO: 6696161 - DNA, 15 bp, Homo sapiens
cactgatgcttagat

SEQ ID NO: 6696162 - DNA, 16 bp, Homo sapiens
cactgatgcttagatg

SEQ ID NO: 6696163 - DNA, 19 bp, Homo sapiens
cactgatggaaacaaagtg

SEQ ID NO: 6696164 - DNA, 20 bp, Homo sapiens
cactgatggaaacaaagtgg

SEQ ID NO: 6696165 - DNA, 14 bp, Homo sapiens
cactgatggaaggt

SEQ ID NO: 6696166 - DNA, 16 bp, Homo sapiens
cactgatggctcaaga

SEQ ID NO: 6696167 - DNA, 18 bp, Homo sapiens
cactgatgggaataaaag

SEQ ID NO: 6696168 - DNA, 17 bp, Homo sapiens
cactgatgggtcctgct

SEQ ID NO: 6696169 - DNA, 16 bp, Homo sapiens
cactgatgtgtgaagt

SEQ ID NO: 6696170 - DNA, 19 bp, Homo sapiens
cactgattaaaataggatt

SEQ ID NO: 6696171 - DNA, 19 bp, Homo sapiens
cactgattccctctcccac

SEQ ID NO: 6696172 - DNA, 13 bp, Homo sapiens
cactgatttcaca

SEQ ID NO: 6696173 - DNA, 18 bp, Homo sapiens
cactgatttcacaacaga

SEQ ID NO: 6696174 - DNA, 23 bp, Homo sapiens
cactgatttccccttttgcattc

SEQ ID NO: 6696175 - DNA, 16 bp, Homo sapiens
cactgatttggagata

SEQ ID NO: 6696176 - DNA, 17 bp, Homo sapiens
cactgcaaacacacctt

SEQ ID NO: 6696177 - DNA, 22 bp, Homo sapiens
cactgcaaacacaccttggaga

SEQ ID NO: 6696178 - DNA, 17 bp, Homo sapiens
cactgcaaataaagcct

SEQ ID NO: 6696179 - DNA, 14 bp, Homo sapiens
cactgcaaatactt

SEQ ID NO: 6696180 - DNA, 15 bp, Homo sapiens
cactgcaacaggaac

SEQ ID NO: 6696181 - DNA, 19 bp, Homo sapiens
cactgcaacctccacctcc

SEQ ID NO: 6696182 - DNA, 22 bp, Homo sapiens
cactgcaacctccacctcccag

SEQ ID NO: 6696183 - DNA, 16 bp, Homo sapiens
cactgcaacctccgcc

SEQ ID NO: 6696184 - DNA, 18 bp, Homo sapiens
cactgcaacctccgcctc

SEQ ID NO: 6696185 - DNA, 23 bp, Homo sapiens
cactgcaacctccgcctcttggg

SEQ ID NO: 6696186 - DNA, 14 bp, Homo sapiens
cactgcaacctctg

SEQ ID NO: 6696187 - DNA, 23 bp, Homo sapiens
cactgcaacctctgcctcctggg

SEQ ID NO: 6696188 - DNA, 22 bp, Homo sapiens
cactgcaaccttcgccacctgg

SEQ ID NO: 6696189 - DNA, 16 bp, Homo sapiens
cactgcaacttctgcc

SEQ ID NO: 6696190 - DNA, 14 bp, Homo sapiens
cactgcaacttgtg

SEQ ID NO: 6696191 - DNA, 21 bp, Homo sapiens
cactgcaacttgtgaactcca

SEQ ID NO: 6696192 - DNA, 17 bp, Homo sapiens
cactgcaagctctgcct

SEQ ID NO: 6696193 - DNA, 19 bp, Homo sapiens
cactgcaagtccttttgta

SEQ ID NO: 6696194 - DNA, 13 bp, Homo sapiens
cactgcaagtctg

SEQ ID NO: 6696195 - DNA, 15 bp, Homo sapiens
cactgcaatatcttc

SEQ ID NO: 6696196 - DNA, 19 bp, Homo sapiens
cactgcaatcctgtctttc

SEQ ID NO: 6696197 - DNA, 20 bp, Homo sapiens
cactgcaattggcaccgaag

SEQ ID NO: 6696198 - DNA, 19 bp, Homo sapiens
cactgcacacacctcagag

SEQ ID NO: 6696199 - DNA, 17 bp, Homo sapiens
cactgcacacagtgact

SEQ ID NO: 6696200 - DNA, 18 bp, Homo sapiens
cactgcacagtgcatctc

SEQ ID NO: 6696201 - DNA, 14 bp, Homo sapiens
cactgcaccccctc

SEQ ID NO: 6696202 - DNA, 16 bp, Homo sapiens
cactgcaccccctcct

SEQ ID NO: 6696203 - DNA, 20 bp, Homo sapiens
cactgcaccccctcctgctg

SEQ ID NO: 6696204 - DNA, 17 bp, Homo sapiens
cactgcaccccgtctca

SEQ ID NO: 6696205 - DNA, 20 bp, Homo sapiens
cactgcacccctgcccccag

SEQ ID NO: 6696206 - DNA, 13 bp, Homo sapiens
cactgcaccctcc

SEQ ID NO: 6696207 - DNA, 15 bp, Homo sapiens
cactgcaccctccac

SEQ ID NO: 6696208 - DNA, 13 bp, Homo sapiens
cactgcaccgcct

SEQ ID NO: 6696209 - DNA, 17 bp, Homo sapiens
cactgcacctgcccagc

SEQ ID NO: 6696210 - DNA, 22 bp, Homo sapiens
cactgcacctgcctccagccgc

SEQ ID NO: 6696211 - DNA, 18 bp, Homo sapiens
cactgcacgttttcatct

SEQ ID NO: 6696212 - DNA, 14 bp, Homo sapiens
cactgcactccagc

SEQ ID NO: 6696213 - DNA, 19 bp, Homo sapiens
cactgcactccagcctggg

SEQ ID NO: 6696214 - DNA, 21 bp, Homo sapiens
cactgcactccagcctgggtg

SEQ ID NO: 6696215 - DNA, 16 bp, Homo sapiens
cactgcactccagctt

SEQ ID NO: 6696216 - DNA, 22 bp, Homo sapiens
cactgcactccagcttgggtga

SEQ ID NO: 6696217 - DNA, 13 bp, Homo sapiens
cactgcactccgg

SEQ ID NO: 6696218 - DNA, 17 bp, Homo sapiens
cactgcactctagcctg

SEQ ID NO: 6696219 - DNA, 19 bp, Homo sapiens
cactgcactctagcctggc

SEQ ID NO: 6696220 - DNA, 15 bp, Homo sapiens
cactgcactttgttt

SEQ ID NO: 6696221 - DNA, 19 bp, Homo sapiens
cactgcagacgggaatgcc

SEQ ID NO: 6696222 - DNA, 12 bp, Homo sapiens
cactgcagagat

SEQ ID NO: 6696223 - DNA, 21 bp, Homo sapiens
cactgcagatagccagacaca

SEQ ID NO: 6696224 - DNA, 15 bp, Homo sapiens
cactgcagcacctgc

SEQ ID NO: 6696225 - DNA, 13 bp, Homo sapiens
cactgcagcctca

SEQ ID NO: 6696226 - DNA, 20 bp, Homo sapiens
cactgcagcctcaacctcct

SEQ ID NO: 6696227 - DNA, 23 bp, Homo sapiens
cactgcagcctccgcttccctgg

SEQ ID NO: 6696228 - DNA, 20 bp, Homo sapiens
cactgcagcctcgacctccc

SEQ ID NO: 6696229 - DNA, 23 bp, Homo sapiens
cactgcagcctctgcctcccagg

SEQ ID NO: 6696230 - DNA, 13 bp, Homo sapiens
cactgcagccttg

SEQ ID NO: 6696231 - DNA, 22 bp, Homo sapiens
cactgcagccttgtcctcccag

SEQ ID NO: 6696232 - DNA, 13 bp, Homo sapiens
cactgcagccttt

SEQ ID NO: 6696233 - DNA, 12 bp, Homo sapiens
cactgcaggcac

SEQ ID NO: 6696234 - DNA, 12 bp, Homo sapiens
cactgcagggct

SEQ ID NO: 6696235 - DNA, 13 bp, Homo sapiens
cactgcagggctg

SEQ ID NO: 6696236 - DNA, 20 bp, Homo sapiens
cactgcagggctgctgtggc

SEQ ID NO: 6696237 - DNA, 19 bp, Homo sapiens
cactgcaggtggcctccct

SEQ ID NO: 6696238 - DNA, 20 bp, Homo sapiens
cactgcaggtggcctccctc

SEQ ID NO: 6696239 - DNA, 17 bp, Homo sapiens
cactgcagtcacctctt

SEQ ID NO: 6696240 - DNA, 13 bp, Homo sapiens
cactgcagtgatg

SEQ ID NO: 6696241 - DNA, 18 bp, Homo sapiens
cactgcagttatttacca

SEQ ID NO: 6696242 - DNA, 19 bp, Homo sapiens
cactgcagttatttaccag

SEQ ID NO: 6696243 - DNA, 17 bp, Homo sapiens
cactgcagtttcctgga

SEQ ID NO: 6696244 - DNA, 16 bp, Homo sapiens
cactgcataccaacct

SEQ ID NO: 6696245 - DNA, 18 bp, Homo sapiens
cactgcatcctccgcctc

SEQ ID NO: 6696246 - DNA, 19 bp, Homo sapiens
cactgcatctttctcttcc

SEQ ID NO: 6696247 - DNA, 22 bp, Homo sapiens
cactgcatgagcttttatacta

SEQ ID NO: 6696248 - DNA, 13 bp, Homo sapiens
cactgcatgcaaa

SEQ ID NO: 6696249 - DNA, 19 bp, Homo sapiens
cactgcatggctcccacag

SEQ ID NO: 6696250 - DNA, 17 bp, Homo sapiens
cactgcatgtcagagca

SEQ ID NO: 6696251 - DNA, 18 bp, Homo sapiens
cactgcatgtcagagcac

SEQ ID NO: 6696252 - DNA, 21 bp, Homo sapiens
cactgcatgtcagagcacttt

SEQ ID NO: 6696253 - DNA, 16 bp, Homo sapiens
cactgcatgtttgtga

SEQ ID NO: 6696254 - DNA, 20 bp, Homo sapiens
cactgcattatcttgctcat

SEQ ID NO: 6696255 - DNA, 22 bp, Homo sapiens
cactgcatttggggcctttccc

SEQ ID NO: 6696256 - DNA, 21 bp, Homo sapiens
cactgcatttggtcagggggg

SEQ ID NO: 6696257 - DNA, 22 bp, Homo sapiens
cactgccaaaaatagaaagtga

SEQ ID NO: 6696258 - DNA, 16 bp, Homo sapiens
cactgccaaataaaca

SEQ ID NO: 6696259 - DNA, 21 bp, Homo sapiens
cactgccaagagccgacaatg

SEQ ID NO: 6696260 - DNA, 17 bp, Homo sapiens
cactgccaagcttcctg

SEQ ID NO: 6696261 - DNA, 20 bp, Homo sapiens
cactgccaagcttcctgtgc

SEQ ID NO: 6696262 - DNA, 22 bp, Homo sapiens
cactgccaagcttcctgtgccc

SEQ ID NO: 6696263 - DNA, 11 bp, Homo sapiens
cactgccacac

SEQ ID NO: 6696264 - DNA, 14 bp, Homo sapiens
cactgccacaccct

SEQ ID NO: 6696265 - DNA, 19 bp, Homo sapiens
cactgccacaccctcccca

SEQ ID NO: 6696266 - DNA, 14 bp, Homo sapiens
cactgccaccagca

SEQ ID NO: 6696267 - DNA, 19 bp, Homo sapiens
cactgccactccagtcctg

SEQ ID NO: 6696268 - DNA, 22 bp, Homo sapiens
cactgccactccagtcctgcca

SEQ ID NO: 6696269 - DNA, 14 bp, Homo sapiens
cactgccagaagag

SEQ ID NO: 6696270 - DNA, 21 bp, Homo sapiens
cactgccagaagagaattcag

SEQ ID NO: 6696271 - DNA, 13 bp, Homo sapiens
cactgccagcagc

SEQ ID NO: 6696272 - DNA, 11 bp, Homo sapiens
cactgccagcc

SEQ ID NO: 6696273 - DNA, 18 bp, Homo sapiens
cactgccagcccaccccc

SEQ ID NO: 6696274 - DNA, 16 bp, Homo sapiens
cactgccagccgccac

SEQ ID NO: 6696275 - DNA, 13 bp, Homo sapiens
cactgccaggacc

SEQ ID NO: 6696276 - DNA, 12 bp, Homo sapiens
cactgccaggca

SEQ ID NO: 6696277 - DNA, 14 bp, Homo sapiens
cactgccaggcacc

SEQ ID NO: 6696278 - DNA, 17 bp, Homo sapiens
cactgccaggcacctgg

SEQ ID NO: 6696279 - DNA, 19 bp, Homo sapiens
cactgccaggcacctggcc

SEQ ID NO: 6696280 - DNA, 20 bp, Homo sapiens
cactgccaggcacctggcct

SEQ ID NO: 6696281 - DNA, 21 bp, Homo sapiens
cactgccaggcacctggcctg

SEQ ID NO: 6696282 - DNA, 23 bp, Homo sapiens
cactgccaggcacctggcctgct

SEQ ID NO: 6696283 - DNA, 16 bp, Homo sapiens
cactgccaggccagcc

SEQ ID NO: 6696284 - DNA, 17 bp, Homo sapiens
cactgccaggccagcct

SEQ ID NO: 6696285 - DNA, 19 bp, Homo sapiens
cactgccaggccagcctcc

SEQ ID NO: 6696286 - DNA, 20 bp, Homo sapiens
cactgccaggggttcttgag

SEQ ID NO: 6696287 - DNA, 18 bp, Homo sapiens
cactgccatatgatttac

SEQ ID NO: 6696288 - DNA, 17 bp, Homo sapiens
cactgccatctgatgcc

SEQ ID NO: 6696289 - DNA, 22 bp, Homo sapiens
cactgccatcttagtttggatt

SEQ ID NO: 6696290 - DNA, 17 bp, Homo sapiens
cactgccatgcagggcc

SEQ ID NO: 6696291 - DNA, 17 bp, Homo sapiens
cactgccatgccagctt

SEQ ID NO: 6696292 - DNA, 14 bp, Homo sapiens
cactgccatgcctc

SEQ ID NO: 6696293 - DNA, 19 bp, Homo sapiens
cactgccattacccagtgc

SEQ ID NO: 6696294 - DNA, 16 bp, Homo sapiens
cactgcccaaagccat

SEQ ID NO: 6696295 - DNA, 20 bp, Homo sapiens
cactgcccacatgggacctg

SEQ ID NO: 6696296 - DNA, 16 bp, Homo sapiens
cactgcccaccaaagg

SEQ ID NO: 6696297 - DNA, 18 bp, Homo sapiens
cactgcccaccaaaggtc

SEQ ID NO: 6696298 - DNA, 16 bp, Homo sapiens
cactgcccaccccctc

SEQ ID NO: 6696299 - DNA, 19 bp, Homo sapiens
cactgcccacctgccaggc

SEQ ID NO: 6696300 - DNA, 15 bp, Homo sapiens
cactgcccatcccac

SEQ ID NO: 6696301 - DNA, 18 bp, Homo sapiens
cactgcccatggacaggc

SEQ ID NO: 6696302 - DNA, 14 bp, Homo sapiens
cactgcccatggca

SEQ ID NO: 6696303 - DNA, 17 bp, Homo sapiens
cactgcccatggcatgt

SEQ ID NO: 6696304 - DNA, 22 bp, Homo sapiens
cactgcccatggcatgtctttg

SEQ ID NO: 6696305 - DNA, 16 bp, Homo sapiens
cactgccccacatgca

SEQ ID NO: 6696306 - DNA, 20 bp, Homo sapiens
cactgccccaccagccacct

SEQ ID NO: 6696307 - DNA, 22 bp, Homo sapiens
cactgccccaccagccacctct

SEQ ID NO: 6696308 - DNA, 13 bp, Homo sapiens
cactgccccacgt

SEQ ID NO: 6696309 - DNA, 18 bp, Homo sapiens
cactgccccacttctggc

SEQ ID NO: 6696310 - DNA, 24 bp, Homo sapiens
cactgccccacttctggcatggga

SEQ ID NO: 6696311 - DNA, 22 bp, Homo sapiens
cactgccccctccgtcccaccc

SEQ ID NO: 6696312 - DNA, 17 bp, Homo sapiens
cactgccccctgctgcc

SEQ ID NO: 6696313 - DNA, 16 bp, Homo sapiens
cactgccccctgcttg

SEQ ID NO: 6696314 - DNA, 15 bp, Homo sapiens
cactgcccgagctgg

SEQ ID NO: 6696315 - DNA, 16 bp, Homo sapiens
cactgcccgagctggt

SEQ ID NO: 6696316 - DNA, 21 bp, Homo sapiens
cactgcccgagctggtgcatt

SEQ ID NO: 6696317 - DNA, 15 bp, Homo sapiens
cactgcccgcacacc

SEQ ID NO: 6696318 - DNA, 18 bp, Homo sapiens
cactgcccgcacaccctc

SEQ ID NO: 6696319 - DNA, 19 bp, Homo sapiens
cactgccctccagggccag

SEQ ID NO: 6696320 - DNA, 20 bp, Homo sapiens
cactgccctccgcccttccc

SEQ ID NO: 6696321 - DNA, 18 bp, Homo sapiens
cactgccctcgcacggcc

SEQ ID NO: 6696322 - DNA, 17 bp, Homo sapiens
cactgccctctccacac

SEQ ID NO: 6696323 - DNA, 20 bp, Homo sapiens
cactgccctctccacaccca

SEQ ID NO: 6696324 - DNA, 12 bp, Homo sapiens
cactgccctctg

SEQ ID NO: 6696325 - DNA, 18 bp, Homo sapiens
cactgccctctgccactg

SEQ ID NO: 6696326 - DNA, 11 bp, Homo sapiens
cactgccctgc

SEQ ID NO: 6696327 - DNA, 14 bp, Homo sapiens
cactgccctgcctg

SEQ ID NO: 6696328 - DNA, 18 bp, Homo sapiens
cactgccctgcctgccca

SEQ ID NO: 6696329 - DNA, 21 bp, Homo sapiens
cactgccctgttcatgtgcct

SEQ ID NO: 6696330 - DNA, 18 bp, Homo sapiens
cactgccgcctccttctt

SEQ ID NO: 6696331 - DNA, 15 bp, Homo sapiens
cactgcctactgcat

SEQ ID NO: 6696332 - DNA, 23 bp, Homo sapiens
cactgcctaggaggctggccaag

SEQ ID NO: 6696333 - DNA, 12 bp, Homo sapiens
cactgcctcagg

SEQ ID NO: 6696334 - DNA, 15 bp, Homo sapiens
cactgcctcaggttc

SEQ ID NO: 6696335 - DNA, 22 bp, Homo sapiens
cactgcctccatgatgcaagcc

SEQ ID NO: 6696336 - DNA, 16 bp, Homo sapiens
cactgcctcccatcct

SEQ ID NO: 6696337 - DNA, 12 bp, Homo sapiens
cactgcctcctc

SEQ ID NO: 6696338 - DNA, 14 bp, Homo sapiens
cactgcctcctccc

SEQ ID NO: 6696339 - DNA, 17 bp, Homo sapiens
cactgcctcctccctgg

SEQ ID NO: 6696340 - DNA, 19 bp, Homo sapiens
cactgcctcctgttttctc

SEQ ID NO: 6696341 - DNA, 22 bp, Homo sapiens
cactgcctcctgttttctccct

SEQ ID NO: 6696342 - DNA, 21 bp, Homo sapiens
cactgcctcgggaacctcact

SEQ ID NO: 6696343 - DNA, 21 bp, Homo sapiens
cactgcctctatgccctgcag

SEQ ID NO: 6696344 - DNA, 22 bp, Homo sapiens
cactgcctctatgccctgcaga

SEQ ID NO: 6696345 - DNA, 14 bp, Homo sapiens
cactgcctctcaca

SEQ ID NO: 6696346 - DNA, 15 bp, Homo sapiens
cactgcctctcacag

SEQ ID NO: 6696347 - DNA, 13 bp, Homo sapiens
cactgcctctgcc

SEQ ID NO: 6696348 - DNA, 14 bp, Homo sapiens
cactgcctctgcct

SEQ ID NO: 6696349 - DNA, 16 bp, Homo sapiens
cactgcctctgcctta

SEQ ID NO: 6696350 - DNA, 13 bp, Homo sapiens
cactgcctgcacc

SEQ ID NO: 6696351 - DNA, 14 bp, Homo sapiens
cactgcctgcacct

SEQ ID NO: 6696352 - DNA, 14 bp, Homo sapiens
cactgcctgccaag

SEQ ID NO: 6696353 - DNA, 12 bp, Homo sapiens
cactgcctgcct

SEQ ID NO: 6696354 - DNA, 17 bp, Homo sapiens
cactgcctgcctcccct

SEQ ID NO: 6696355 - DNA, 15 bp, Homo sapiens
cactgcctgccttaa

SEQ ID NO: 6696356 - DNA, 21 bp, Homo sapiens
cactgcctgctcccatcctgt

SEQ ID NO: 6696357 - DNA, 11 bp, Homo sapiens
cactgcctggg

SEQ ID NO: 6696358 - DNA, 13 bp, Homo sapiens
cactgcctgtata

SEQ ID NO: 6696359 - DNA, 21 bp, Homo sapiens
cactgccttagcctcttggaa

SEQ ID NO: 6696360 - DNA, 18 bp, Homo sapiens
cactgccttcgtttatat

SEQ ID NO: 6696361 - DNA, 20 bp, Homo sapiens
cactgccttcgtttatattt

SEQ ID NO: 6696362 - DNA, 22 bp, Homo sapiens
cactgccttcgtttatattttt

SEQ ID NO: 6696363 - DNA, 17 bp, Homo sapiens
cactgccttctcctctc

SEQ ID NO: 6696364 - DNA, 23 bp, Homo sapiens
cactgccttctcctctctgggcc

SEQ ID NO: 6696365 - DNA, 12 bp, Homo sapiens
cactgcctttga

SEQ ID NO: 6696366 - DNA, 12 bp, Homo sapiens
cactgcctttgc

SEQ ID NO: 6696367 - DNA, 16 bp, Homo sapiens
cactgcctttgctgcc

SEQ ID NO: 6696368 - DNA, 17 bp, Homo sapiens
cactgcctttgctgcct

SEQ ID NO: 6696369 - DNA, 14 bp, Homo sapiens
cactgcgaactctc

SEQ ID NO: 6696370 - DNA, 18 bp, Homo sapiens
cactgcgccactgccatc

SEQ ID NO: 6696371 - DNA, 14 bp, Homo sapiens
cactgcgcccagcc

SEQ ID NO: 6696372 - DNA, 16 bp, Homo sapiens
cactgcgcccagcctg

SEQ ID NO: 6696373 - DNA, 17 bp, Homo sapiens
cactgcgcccagcctga

SEQ ID NO: 6696374 - DNA, 18 bp, Homo sapiens
cactgcggaacaggagtg

SEQ ID NO: 6696375 - DNA, 17 bp, Homo sapiens
cactgcggaagccaaag

SEQ ID NO: 6696376 - DNA, 22 bp, Homo sapiens
cactgcggagaaccttgtgcct

SEQ ID NO: 6696377 - DNA, 22 bp, Homo sapiens
cactgcggctgtctccttgaag

SEQ ID NO: 6696378 - DNA, 19 bp, Homo sapiens
cactgcggggcttggctga

SEQ ID NO: 6696379 - DNA, 13 bp, Homo sapiens
cactgctaaattt

SEQ ID NO: 6696380 - DNA, 16 bp, Homo sapiens
cactgctaaatttacg

SEQ ID NO: 6696381 - DNA, 22 bp, Homo sapiens
cactgctaaggctgctggcttc

SEQ ID NO: 6696382 - DNA, 17 bp, Homo sapiens
cactgctaataaatgac

SEQ ID NO: 6696383 - DNA, 18 bp, Homo sapiens
cactgctaataaatgacc

SEQ ID NO: 6696384 - DNA, 22 bp, Homo sapiens
cactgctaataaatgaccagtt

SEQ ID NO: 6696385 - DNA, 23 bp, Homo sapiens
cactgctaataaatgaccagttt

SEQ ID NO: 6696386 - DNA, 17 bp, Homo sapiens
cactgctaatgaaagaa

SEQ ID NO: 6696387 - DNA, 15 bp, Homo sapiens
cactgctacacttct

SEQ ID NO: 6696388 - DNA, 21 bp, Homo sapiens
cactgctaggcgagtgccagg

SEQ ID NO: 6696389 - DNA, 17 bp, Homo sapiens
cactgctaggtgggcca

SEQ ID NO: 6696390 - DNA, 22 bp, Homo sapiens
cactgctaggtgggccagcccc

SEQ ID NO: 6696391 - DNA, 22 bp, Homo sapiens
cactgctcaagaagacatggag

SEQ ID NO: 6696392 - DNA, 13 bp, Homo sapiens
cactgctcacact

SEQ ID NO: 6696393 - DNA, 15 bp, Homo sapiens
cactgctcacgtctc

SEQ ID NO: 6696394 - DNA, 16 bp, Homo sapiens
cactgctccaagggac

SEQ ID NO: 6696395 - DNA, 22 bp, Homo sapiens
cactgctccctaagccagcctg

SEQ ID NO: 6696396 - DNA, 18 bp, Homo sapiens
cactgctccctgaagcca

SEQ ID NO: 6696397 - DNA, 20 bp, Homo sapiens
cactgctccctgaagccagc

SEQ ID NO: 6696398 - DNA, 21 bp, Homo sapiens
cactgctccctgaagccagcc

SEQ ID NO: 6696399 - DNA, 23 bp, Homo sapiens
cactgctccctgaagccagcctt

SEQ ID NO: 6696400 - DNA, 13 bp, Homo sapiens
cactgctccttgc

SEQ ID NO: 6696401 - DNA, 14 bp, Homo sapiens
cactgctccttgct

SEQ ID NO: 6696402 - DNA, 22 bp, Homo sapiens
cactgctcgaaatggcccctgt

SEQ ID NO: 6696403 - DNA, 18 bp, Homo sapiens
cactgctctaacagccct

SEQ ID NO: 6696404 - DNA, 15 bp, Homo sapiens
cactgctctcacctt

SEQ ID NO: 6696405 - DNA, 16 bp, Homo sapiens
cactgctgaaaaagaa

SEQ ID NO: 6696406 - DNA, 12 bp, Homo sapiens
cactgctgagct

SEQ ID NO: 6696407 - DNA, 17 bp, Homo sapiens
cactgctgagctggccc

SEQ ID NO: 6696408 - DNA, 21 bp, Homo sapiens
cactgctgaggagtctgagga

SEQ ID NO: 6696409 - DNA, 16 bp, Homo sapiens
cactgctgcaaggcct

SEQ ID NO: 6696410 - DNA, 18 bp, Homo sapiens
cactgctgcaaggccttt

SEQ ID NO: 6696411 - DNA, 19 bp, Homo sapiens
cactgctgcaaggcctttc

SEQ ID NO: 6696412 - DNA, 22 bp, Homo sapiens
cactgctgcaaggcctttctgt

SEQ ID NO: 6696413 - DNA, 15 bp, Homo sapiens
cactgctgcaaggtg

SEQ ID NO: 6696414 - DNA, 12 bp, Homo sapiens
cactgctgcacc

SEQ ID NO: 6696415 - DNA, 13 bp, Homo sapiens
cactgctgcagta

SEQ ID NO: 6696416 - DNA, 13 bp, Homo sapiens
cactgctgcattc

SEQ ID NO: 6696417 - DNA, 17 bp, Homo sapiens
cactgctgcccagcctc

SEQ ID NO: 6696418 - DNA, 13 bp, Homo sapiens
cactgctgcctca

SEQ ID NO: 6696419 - DNA, 14 bp, Homo sapiens
cactgctgcctcag

SEQ ID NO: 6696420 - DNA, 15 bp, Homo sapiens
cactgctgcctcagc

SEQ ID NO: 6696421 - DNA, 16 bp, Homo sapiens
cactgctgcctcagct

SEQ ID NO: 6696422 - DNA, 15 bp, Homo sapiens
cactgctgctcctct

SEQ ID NO: 6696423 - DNA, 21 bp, Homo sapiens
cactgctgctcctctttcccc

SEQ ID NO: 6696424 - DNA, 22 bp, Homo sapiens
cactgctgctcctctttcccct

SEQ ID NO: 6696425 - DNA, 17 bp, Homo sapiens
cactgctgctgggactt

SEQ ID NO: 6696426 - DNA, 13 bp, Homo sapiens
cactgctggacat

SEQ ID NO: 6696427 - DNA, 13 bp, Homo sapiens
cactgctggaggc

SEQ ID NO: 6696428 - DNA, 14 bp, Homo sapiens
cactgctggctgcc

SEQ ID NO: 6696429 - DNA, 22 bp, Homo sapiens
cactgctgggtggcccatcccc

SEQ ID NO: 6696430 - DNA, 18 bp, Homo sapiens
cactgctggtgccagggt

SEQ ID NO: 6696431 - DNA, 22 bp, Homo sapiens
cactgctggtgccagggtgggt

SEQ ID NO: 6696432 - DNA, 13 bp, Homo sapiens
cactgctggtgtt

SEQ ID NO: 6696433 - DNA, 16 bp, Homo sapiens
cactgctggtgtttat

SEQ ID NO: 6696434 - DNA, 18 bp, Homo sapiens
cactgctggtgtttatgt

SEQ ID NO: 6696435 - DNA, 23 bp, Homo sapiens
cactgctggtgtttatgtgaaca

SEQ ID NO: 6696436 - DNA, 10 bp, Homo sapiens
cactgctgta

SEQ ID NO: 6696437 - DNA, 23 bp, Homo sapiens
cactgctgtaaagcaaaatattt

SEQ ID NO: 6696438 - DNA, 19 bp, Homo sapiens
cactgctgtacccagatgc

SEQ ID NO: 6696439 - DNA, 22 bp, Homo sapiens
cactgctgtatttttatttttg

SEQ ID NO: 6696440 - DNA, 10 bp, Homo sapiens
cactgctgtc

SEQ ID NO: 6696441 - DNA, 13 bp, Homo sapiens
cactgctgtcagc

SEQ ID NO: 6696442 - DNA, 14 bp, Homo sapiens
cactgctgtcagcc

SEQ ID NO: 6696443 - DNA, 13 bp, Homo sapiens
cactgctgtccac

SEQ ID NO: 6696444 - DNA, 16 bp, Homo sapiens
cactgctgtccacatg

SEQ ID NO: 6696445 - DNA, 18 bp, Homo sapiens
cactgctgtccctcctga

SEQ ID NO: 6696446 - DNA, 19 bp, Homo sapiens
cactgctgtccctcctgag

SEQ ID NO: 6696447 - DNA, 20 bp, Homo sapiens
cactgctgtcctctccccct

SEQ ID NO: 6696448 - DNA, 20 bp, Homo sapiens
cactgctgtgagtgcgcctc

SEQ ID NO: 6696449 - DNA, 17 bp, Homo sapiens
cactgctgtgctgtgcc

SEQ ID NO: 6696450 - DNA, 15 bp, Homo sapiens
cactgcttccagtga

SEQ ID NO: 6696451 - DNA, 18 bp, Homo sapiens
cactgcttccagtgaggc

SEQ ID NO: 6696452 - DNA, 21 bp, Homo sapiens
cactgcttccagtgaggctct

SEQ ID NO: 6696453 - DNA, 16 bp, Homo sapiens
cactgcttcccactgg

SEQ ID NO: 6696454 - DNA, 19 bp, Homo sapiens
cactgcttcccactggggc

SEQ ID NO: 6696455 - DNA, 18 bp, Homo sapiens
cactgcttctcggccagc

SEQ ID NO: 6696456 - DNA, 21 bp, Homo sapiens
cactgcttctcggccagcccg

SEQ ID NO: 6696457 - DNA, 19 bp, Homo sapiens
cactgcttctcttttgaaa

SEQ ID NO: 6696458 - DNA, 17 bp, Homo sapiens
cactgcttgaactaggc

SEQ ID NO: 6696459 - DNA, 20 bp, Homo sapiens
cactgcttgaactaggctga

SEQ ID NO: 6696460 - DNA, 14 bp, Homo sapiens
cactgcttgaggaa

SEQ ID NO: 6696461 - DNA, 15 bp, Homo sapiens
cactgcttgaggaaa

SEQ ID NO: 6696462 - DNA, 20 bp, Homo sapiens
cactgcttgaggaaaacaag

SEQ ID NO: 6696463 - DNA, 18 bp, Homo sapiens
cactgcttgatgaagcaa

SEQ ID NO: 6696464 - DNA, 19 bp, Homo sapiens
cactgcttgatgaagcaag

SEQ ID NO: 6696465 - DNA, 16 bp, Homo sapiens
cactgctttccagcct

SEQ ID NO: 6696466 - DNA, 15 bp, Homo sapiens
cactggaaaaggtga

SEQ ID NO: 6696467 - DNA, 16 bp, Homo sapiens
cactggaaaggaaaga

SEQ ID NO: 6696468 - DNA, 12 bp, Homo sapiens
cactggaaaggg

SEQ ID NO: 6696469 - DNA, 18 bp, Homo sapiens
cactggaaaggggagagc

SEQ ID NO: 6696470 - DNA, 19 bp, Homo sapiens
cactggaaaggggagagcc

SEQ ID NO: 6696471 - DNA, 24 bp, Homo sapiens
cactggaaaggggagagcctgctg

SEQ ID NO: 6696472 - DNA, 17 bp, Homo sapiens
cactggaacactaatga

SEQ ID NO: 6696473 - DNA, 22 bp, Homo sapiens
cactggaacagcccattttatc

SEQ ID NO: 6696474 - DNA, 17 bp, Homo sapiens
cactggaaccacctgga

SEQ ID NO: 6696475 - DNA, 17 bp, Homo sapiens
cactggaagatttatga

SEQ ID NO: 6696476 - DNA, 23 bp, Homo sapiens
cactggaaggaacatggagctgt

SEQ ID NO: 6696477 - DNA, 12 bp, Homo sapiens
cactggaaggag

SEQ ID NO: 6696478 - DNA, 23 bp, Homo sapiens
cactggaaggagcacatactacc

SEQ ID NO: 6696479 - DNA, 14 bp, Homo sapiens
cactggaagggtcc

SEQ ID NO: 6696480 - DNA, 11 bp, Homo sapiens
cactggaatat

SEQ ID NO: 6696481 - DNA, 21 bp, Homo sapiens
cactggaatcgatctgtactg

SEQ ID NO: 6696482 - DNA, 14 bp, Homo sapiens
cactggacaacact

SEQ ID NO: 6696483 - DNA, 15 bp, Homo sapiens
cactggacaacactg

SEQ ID NO: 6696484 - DNA, 13 bp, Homo sapiens
cactggacagacc

SEQ ID NO: 6696485 - DNA, 16 bp, Homo sapiens
cactggacagacccag

SEQ ID NO: 6696486 - DNA, 22 bp, Homo sapiens
cactggacagacccaggtcttc

SEQ ID NO: 6696487 - DNA, 13 bp, Homo sapiens
cactggacagcat

SEQ ID NO: 6696488 - DNA, 17 bp, Homo sapiens
cactggaccaggtcctg

SEQ ID NO: 6696489 - DNA, 18 bp, Homo sapiens
cactggacccttgattca

SEQ ID NO: 6696490 - DNA, 14 bp, Homo sapiens
cactggacctgggg

SEQ ID NO: 6696491 - DNA, 19 bp, Homo sapiens
cactggactccggccctcc

SEQ ID NO: 6696492 - DNA, 16 bp, Homo sapiens
cactggactgacctgg

SEQ ID NO: 6696493 - DNA, 15 bp, Homo sapiens
cactggactgcatgg

SEQ ID NO: 6696494 - DNA, 19 bp, Homo sapiens
cactggagacgcatatgag

SEQ ID NO: 6696495 - DNA, 22 bp, Homo sapiens
cactggagagcacagcatgcct

SEQ ID NO: 6696496 - DNA, 10 bp, Homo sapiens
cactggagca

SEQ ID NO: 6696497 - DNA, 13 bp, Homo sapiens
cactggagcacaa

SEQ ID NO: 6696498 - DNA, 16 bp, Homo sapiens
cactggagcaccaggc

SEQ ID NO: 6696499 - DNA, 17 bp, Homo sapiens
cactggagcaccaggca

SEQ ID NO: 6696500 - DNA, 23 bp, Homo sapiens
cactggagcagaaggggagatgg

SEQ ID NO: 6696501 - DNA, 18 bp, Homo sapiens
cactggagccacaggcag

SEQ ID NO: 6696502 - DNA, 11 bp, Homo sapiens
cactggagccc

SEQ ID NO: 6696503 - DNA, 12 bp, Homo sapiens
cactggagccca

SEQ ID NO: 6696504 - DNA, 13 bp, Homo sapiens
cactggagcccag

SEQ ID NO: 6696505 - DNA, 15 bp, Homo sapiens
cactggagcgtgtac

SEQ ID NO: 6696506 - DNA, 19 bp, Homo sapiens
cactggaggagagaagaat

SEQ ID NO: 6696507 - DNA, 14 bp, Homo sapiens
cactggaggcctct

SEQ ID NO: 6696508 - DNA, 16 bp, Homo sapiens
cactggagtgcaggga

SEQ ID NO: 6696509 - DNA, 20 bp, Homo sapiens
cactggagtgcagggaggag

SEQ ID NO: 6696510 - DNA, 14 bp, Homo sapiens
cactggataaaaat

SEQ ID NO: 6696511 - DNA, 18 bp, Homo sapiens
cactggatccagaagcta

SEQ ID NO: 6696512 - DNA, 20 bp, Homo sapiens
cactggatcccatcaaagaa

SEQ ID NO: 6696513 - DNA, 16 bp, Homo sapiens
cactggatcctgctgc

SEQ ID NO: 6696514 - DNA, 23 bp, Homo sapiens
cactggatgcaaagaaaatcaga

SEQ ID NO: 6696515 - DNA, 15 bp, Homo sapiens
cactggatgcagaaa

SEQ ID NO: 6696516 - DNA, 17 bp, Homo sapiens
cactggatggagctgga

SEQ ID NO: 6696517 - DNA, 21 bp, Homo sapiens
cactggattgactttgctgtc

SEQ ID NO: 6696518 - DNA, 19 bp, Homo sapiens
cactggattggtcatttag

SEQ ID NO: 6696519 - DNA, 19 bp, Homo sapiens
cactggattgtagaacttg

SEQ ID NO: 6696520 - DNA, 21 bp, Homo sapiens
cactggattgtagaacttgtt

SEQ ID NO: 6696521 - DNA, 18 bp, Homo sapiens
cactggcaaacagggcct

SEQ ID NO: 6696522 - DNA, 19 bp, Homo sapiens
cactggcaaacagggcctc

SEQ ID NO: 6696523 - DNA, 20 bp, Homo sapiens
cactggcaaacagggcctct

SEQ ID NO: 6696524 - DNA, 15 bp, Homo sapiens
cactggcaaatggag

SEQ ID NO: 6696525 - DNA, 23 bp, Homo sapiens
cactggcagagagatcttcccat

SEQ ID NO: 6696526 - DNA, 12 bp, Homo sapiens
cactggcagagc

SEQ ID NO: 6696527 - DNA, 17 bp, Homo sapiens
cactggcagagcacagc

SEQ ID NO: 6696528 - DNA, 13 bp, Homo sapiens
cactggcagcctg

SEQ ID NO: 6696529 - DNA, 14 bp, Homo sapiens
cactggcagcctgc

SEQ ID NO: 6696530 - DNA, 23 bp, Homo sapiens
cactggcaggatcacagctcacg

SEQ ID NO: 6696531 - DNA, 21 bp, Homo sapiens
cactggcataaatctgaagtg

SEQ ID NO: 6696532 - DNA, 17 bp, Homo sapiens
cactggcatagccctcc

SEQ ID NO: 6696533 - DNA, 16 bp, Homo sapiens
cactggcatctctgga

SEQ ID NO: 6696534 - DNA, 16 bp, Homo sapiens
cactggcatctttgct

SEQ ID NO: 6696535 - DNA, 14 bp, Homo sapiens
cactggcattgtcc

SEQ ID NO: 6696536 - DNA, 18 bp, Homo sapiens
cactggcattgtccctgt

SEQ ID NO: 6696537 - DNA, 11 bp, Homo sapiens
cactggccacc

SEQ ID NO: 6696538 - DNA, 14 bp, Homo sapiens
cactggccaccagg

SEQ ID NO: 6696539 - DNA, 13 bp, Homo sapiens
cactggccaccca

SEQ ID NO: 6696540 - DNA, 14 bp, Homo sapiens
cactggccagagag

SEQ ID NO: 6696541 - DNA, 19 bp, Homo sapiens
cactggccagagagggccc

SEQ ID NO: 6696542 - DNA, 21 bp, Homo sapiens
cactggccagctctggctcag

SEQ ID NO: 6696543 - DNA, 16 bp, Homo sapiens
cactggccagtagctg

SEQ ID NO: 6696544 - DNA, 12 bp, Homo sapiens
cactggccagtc

SEQ ID NO: 6696545 - DNA, 19 bp, Homo sapiens
cactggccagtcctagagc

SEQ ID NO: 6696546 - DNA, 12 bp, Homo sapiens
cactggccccac

SEQ ID NO: 6696547 - DNA, 13 bp, Homo sapiens
cactggcccctca

SEQ ID NO: 6696548 - DNA, 17 bp, Homo sapiens
cactggcccctgagatc

SEQ ID NO: 6696549 - DNA, 15 bp, Homo sapiens
cactggccctggggc

SEQ ID NO: 6696550 - DNA, 14 bp, Homo sapiens
cactggccggccca

SEQ ID NO: 6696551 - DNA, 15 bp, Homo sapiens
cactggcctacccct

SEQ ID NO: 6696552 - DNA, 18 bp, Homo sapiens
cactggcctctccccagg

SEQ ID NO: 6696553 - DNA, 13 bp, Homo sapiens
cactggcctgcca

SEQ ID NO: 6696554 - DNA, 15 bp, Homo sapiens
cactggcctgccatg

SEQ ID NO: 6696555 - DNA, 12 bp, Homo sapiens
cactggcctggg

SEQ ID NO: 6696556 - DNA, 17 bp, Homo sapiens
cactggccttcccttct

SEQ ID NO: 6696557 - DNA, 18 bp, Homo sapiens
cactggccttcccttctc

SEQ ID NO: 6696558 - DNA, 21 bp, Homo sapiens
cactggcgaagatggtctcca

SEQ ID NO: 6696559 - DNA, 23 bp, Homo sapiens
cactggcgcatcatatgcagtga

SEQ ID NO: 6696560 - DNA, 15 bp, Homo sapiens
cactggcgccttctc

SEQ ID NO: 6696561 - DNA, 23 bp, Homo sapiens
cactggcgtagaagtttttgtac

SEQ ID NO: 6696562 - DNA, 11 bp, Homo sapiens
cactggctcct

SEQ ID NO: 6696563 - DNA, 13 bp, Homo sapiens
cactggctcctcc

SEQ ID NO: 6696564 - DNA, 19 bp, Homo sapiens
cactggctcctcccagcac

SEQ ID NO: 6696565 - DNA, 14 bp, Homo sapiens
cactggctcctgga

SEQ ID NO: 6696566 - DNA, 17 bp, Homo sapiens
cactggctcctggacct

SEQ ID NO: 6696567 - DNA, 22 bp, Homo sapiens
cactggctcctggacctaaagg

SEQ ID NO: 6696568 - DNA, 12 bp, Homo sapiens
cactggctctcc

SEQ ID NO: 6696569 - DNA, 14 bp, Homo sapiens
cactggctctccaa

SEQ ID NO: 6696570 - DNA, 16 bp, Homo sapiens
cactggctctccaagt

SEQ ID NO: 6696571 - DNA, 18 bp, Homo sapiens
cactggctctccaagtgc

SEQ ID NO: 6696572 - DNA, 22 bp, Homo sapiens
cactggctctccaagtgccaga

SEQ ID NO: 6696573 - DNA, 15 bp, Homo sapiens
cactggctctcctgg

SEQ ID NO: 6696574 - DNA, 12 bp, Homo sapiens
cactggctctgg

SEQ ID NO: 6696575 - DNA, 16 bp, Homo sapiens
cactggctctgggact

SEQ ID NO: 6696576 - DNA, 13 bp, Homo sapiens
cactggctgcctc

SEQ ID NO: 6696577 - DNA, 18 bp, Homo sapiens
cactggctgcctccactc

SEQ ID NO: 6696578 - DNA, 14 bp, Homo sapiens
cactggctggactg

SEQ ID NO: 6696579 - DNA, 14 bp, Homo sapiens
cactggctggctcc

SEQ ID NO: 6696580 - DNA, 15 bp, Homo sapiens
cactggctggctcct

SEQ ID NO: 6696581 - DNA, 19 bp, Homo sapiens
cactggctggctcctaggg

SEQ ID NO: 6696582 - DNA, 23 bp, Homo sapiens
cactggctggggcagaggggcag

SEQ ID NO: 6696583 - DNA, 17 bp, Homo sapiens
cactggctgtgcctccc

SEQ ID NO: 6696584 - DNA, 22 bp, Homo sapiens
cactggcttggaacaccttggg

SEQ ID NO: 6696585 - DNA, 18 bp, Homo sapiens
cactggctttgcggaggc

SEQ ID NO: 6696586 - DNA, 21 bp, Homo sapiens
cactgggaaccaagggccctc

SEQ ID NO: 6696587 - DNA, 23 bp, Homo sapiens
cactgggaaccaagggccctcac

SEQ ID NO: 6696588 - DNA, 23 bp, Homo sapiens
cactgggaacctagctacactga

SEQ ID NO: 6696589 - DNA, 21 bp, Homo sapiens
cactgggaagaagcaagggca

SEQ ID NO: 6696590 - DNA, 18 bp, Homo sapiens
cactgggaagctcccacc

SEQ ID NO: 6696591 - DNA, 23 bp, Homo sapiens
cactgggaagctcccaccccact

SEQ ID NO: 6696592 - DNA, 16 bp, Homo sapiens
cactgggaagctggag

SEQ ID NO: 6696593 - DNA, 23 bp, Homo sapiens
cactgggaaggaaacaaatgtgt

SEQ ID NO: 6696594 - DNA, 14 bp, Homo sapiens
cactgggacagctg

SEQ ID NO: 6696595 - DNA, 20 bp, Homo sapiens
cactgggacagctggctggg

SEQ ID NO: 6696596 - DNA, 21 bp, Homo sapiens
cactgggactcccagcagagc

SEQ ID NO: 6696597 - DNA, 17 bp, Homo sapiens
cactgggacttgcaaaa

SEQ ID NO: 6696598 - DNA, 16 bp, Homo sapiens
cactgggactttgtaa

SEQ ID NO: 6696599 - DNA, 11 bp, Homo sapiens
cactgggagaa

SEQ ID NO: 6696600 - DNA, 18 bp, Homo sapiens
cactgggagaaatgaaaa

SEQ ID NO: 6696601 - DNA, 21 bp, Homo sapiens
cactgggagaagagaacctca

SEQ ID NO: 6696602 - DNA, 21 bp, Homo sapiens
cactgggaggccagtgagcca

SEQ ID NO: 6696603 - DNA, 20 bp, Homo sapiens
cactgggatgagccgctgtg

SEQ ID NO: 6696604 - DNA, 16 bp, Homo sapiens
cactgggcacctgcgc

SEQ ID NO: 6696605 - DNA, 23 bp, Homo sapiens
cactgggcacctgcgcacaggtg

SEQ ID NO: 6696606 - DNA, 12 bp, Homo sapiens
cactgggcagca

SEQ ID NO: 6696607 - DNA, 14 bp, Homo sapiens
cactgggcagcaag

SEQ ID NO: 6696608 - DNA, 22 bp, Homo sapiens
cactgggcagcaaggctgctgc

SEQ ID NO: 6696609 - DNA, 23 bp, Homo sapiens
cactgggcagcaaggctgctgcc

SEQ ID NO: 6696610 - DNA, 11 bp, Homo sapiens
cactgggcagg

SEQ ID NO: 6696611 - DNA, 12 bp, Homo sapiens
cactgggcaggt

SEQ ID NO: 6696612 - DNA, 19 bp, Homo sapiens
cactgggcaggttcctggg

SEQ ID NO: 6696613 - DNA, 15 bp, Homo sapiens
cactgggcataatgc

SEQ ID NO: 6696614 - DNA, 11 bp, Homo sapiens
cactgggccaa

SEQ ID NO: 6696615 - DNA, 15 bp, Homo sapiens
cactgggccagccct

SEQ ID NO: 6696616 - DNA, 19 bp, Homo sapiens
cactgggccagccctgcag

SEQ ID NO: 6696617 - DNA, 23 bp, Homo sapiens
cactgggccagccctgcagccca

SEQ ID NO: 6696618 - DNA, 16 bp, Homo sapiens
cactgggcccagagga

SEQ ID NO: 6696619 - DNA, 20 bp, Homo sapiens
cactgggcccagaggagagg

SEQ ID NO: 6696620 - DNA, 11 bp, Homo sapiens
cactgggcccc

SEQ ID NO: 6696621 - DNA, 13 bp, Homo sapiens
cactgggcccctg

SEQ ID NO: 6696622 - DNA, 20 bp, Homo sapiens
cactgggcccctgtccccag

SEQ ID NO: 6696623 - DNA, 18 bp, Homo sapiens
cactgggcccgagcctga

SEQ ID NO: 6696624 - DNA, 18 bp, Homo sapiens
cactgggccctggggctg

SEQ ID NO: 6696625 - DNA, 12 bp, Homo sapiens
cactgggcctgg

SEQ ID NO: 6696626 - DNA, 14 bp, Homo sapiens
cactgggcctggag

SEQ ID NO: 6696627 - DNA, 20 bp, Homo sapiens
cactgggcctggagccctgg

SEQ ID NO: 6696628 - DNA, 13 bp, Homo sapiens
cactgggcgtctg

SEQ ID NO: 6696629 - DNA, 18 bp, Homo sapiens
cactgggcgtctgactcc

SEQ ID NO: 6696630 - DNA, 18 bp, Homo sapiens
cactgggctcactgcagg

SEQ ID NO: 6696631 - DNA, 16 bp, Homo sapiens
cactgggctctgagga

SEQ ID NO: 6696632 - DNA, 13 bp, Homo sapiens
cactgggcttcta

SEQ ID NO: 6696633 - DNA, 21 bp, Homo sapiens
cactggggaaaaataaacaat

SEQ ID NO: 6696634 - DNA, 16 bp, Homo sapiens
cactggggaaaactcc

SEQ ID NO: 6696635 - DNA, 19 bp, Homo sapiens
cactggggaatgctcccag

SEQ ID NO: 6696636 - DNA, 18 bp, Homo sapiens
cactggggacttggcctc

SEQ ID NO: 6696637 - DNA, 22 bp, Homo sapiens
cactggggagcccgtctcagtg

SEQ ID NO: 6696638 - DNA, 17 bp, Homo sapiens
cactggggagtgctgga

SEQ ID NO: 6696639 - DNA, 20 bp, Homo sapiens
cactggggatcccgtgctgg

SEQ ID NO: 6696640 - DNA, 22 bp, Homo sapiens
cactggggatggtggcacaggc

SEQ ID NO: 6696641 - DNA, 15 bp, Homo sapiens
cactggggattgggc

SEQ ID NO: 6696642 - DNA, 16 bp, Homo sapiens
cactggggattgggcc

SEQ ID NO: 6696643 - DNA, 17 bp, Homo sapiens
cactggggattgggccc

SEQ ID NO: 6696644 - DNA, 13 bp, Homo sapiens
cactggggcaggg

SEQ ID NO: 6696645 - DNA, 19 bp, Homo sapiens
cactggggcaggggccggg

SEQ ID NO: 6696646 - DNA, 15 bp, Homo sapiens
cactggggccccggg

SEQ ID NO: 6696647 - DNA, 15 bp, Homo sapiens
cactggggctcagag

SEQ ID NO: 6696648 - DNA, 18 bp, Homo sapiens
cactggggctcagagccg

SEQ ID NO: 6696649 - DNA, 20 bp, Homo sapiens
cactggggctcagagccggg

SEQ ID NO: 6696650 - DNA, 16 bp, Homo sapiens
cactggggctgacacc

SEQ ID NO: 6696651 - DNA, 22 bp, Homo sapiens
cactggggctgacacccaggcc

SEQ ID NO: 6696652 - DNA, 23 bp, Homo sapiens
cactgggggaacagatgctaata

SEQ ID NO: 6696653 - DNA, 21 bp, Homo sapiens
cactggggtaccacatggtcc

SEQ ID NO: 6696654 - DNA, 18 bp, Homo sapiens
cactggggtgccttcact

SEQ ID NO: 6696655 - DNA, 19 bp, Homo sapiens
cactggggtgggagggggc

SEQ ID NO: 6696656 - DNA, 18 bp, Homo sapiens
cactgggtctcactcctg

SEQ ID NO: 6696657 - DNA, 15 bp, Homo sapiens
cactgggtggggtga

SEQ ID NO: 6696658 - DNA, 21 bp, Homo sapiens
cactgggtggggtgaggacca

SEQ ID NO: 6696659 - DNA, 23 bp, Homo sapiens
cactgggtggggtgaggaccact

SEQ ID NO: 6696660 - DNA, 15 bp, Homo sapiens
cactgggtggtggcc

SEQ ID NO: 6696661 - DNA, 18 bp, Homo sapiens
cactgggtggtggcctgg

SEQ ID NO: 6696662 - DNA, 22 bp, Homo sapiens
cactgggtggtggcctggtccc

SEQ ID NO: 6696663 - DNA, 23 bp, Homo sapiens
cactgggtgtggccccgcagtgc

SEQ ID NO: 6696664 - DNA, 16 bp, Homo sapiens
cactgggtgttgatct

SEQ ID NO: 6696665 - DNA, 16 bp, Homo sapiens
cactgggttctagaac

SEQ ID NO: 6696666 - DNA, 21 bp, Homo sapiens
cactggtaggttgggacacca

SEQ ID NO: 6696667 - DNA, 22 bp, Homo sapiens
cactggtaggttgggacaccag

SEQ ID NO: 6696668 - DNA, 16 bp, Homo sapiens
cactggtattcctgcc

SEQ ID NO: 6696669 - DNA, 12 bp, Homo sapiens
cactggtcacag

SEQ ID NO: 6696670 - DNA, 18 bp, Homo sapiens
cactggtcagggcagtgg

SEQ ID NO: 6696671 - DNA, 22 bp, Homo sapiens
cactggtccgaggagtgtgctc

SEQ ID NO: 6696672 - DNA, 17 bp, Homo sapiens
cactggtctaatgtttg

SEQ ID NO: 6696673 - DNA, 16 bp, Homo sapiens
cactggtctcagagga

SEQ ID NO: 6696674 - DNA, 20 bp, Homo sapiens
cactggtctcagaggaggga

SEQ ID NO: 6696675 - DNA, 16 bp, Homo sapiens
cactggtctgtctttg

SEQ ID NO: 6696676 - DNA, 12 bp, Homo sapiens
cactggtgagac

SEQ ID NO: 6696677 - DNA, 19 bp, Homo sapiens
cactggtgcatttaaaatg

SEQ ID NO: 6696678 - DNA, 21 bp, Homo sapiens
cactggtgccaaaaccaggcc

SEQ ID NO: 6696679 - DNA, 21 bp, Homo sapiens
cactggtggggataggccagc

SEQ ID NO: 6696680 - DNA, 19 bp, Homo sapiens
cactggtggtttttgctct

SEQ ID NO: 6696681 - DNA, 13 bp, Homo sapiens
cactggtgtaaaa

SEQ ID NO: 6696682 - DNA, 18 bp, Homo sapiens
cactggtgtatctcagaa

SEQ ID NO: 6696683 - DNA, 18 bp, Homo sapiens
cactggtgtatgaaatga

SEQ ID NO: 6696684 - DNA, 19 bp, Homo sapiens
cactggtgtgaactcaccc

SEQ ID NO: 6696685 - DNA, 20 bp, Homo sapiens
cactggtgtgaactcaccct

SEQ ID NO: 6696686 - DNA, 18 bp, Homo sapiens
cactggtgtttaggtgaa

SEQ ID NO: 6696687 - DNA, 20 bp, Homo sapiens
cactggttaaaataaagcct

SEQ ID NO: 6696688 - DNA, 21 bp, Homo sapiens
cactggttaaaataaagccta

SEQ ID NO: 6696689 - DNA, 19 bp, Homo sapiens
cactggtttctcagaatcc

SEQ ID NO: 6696690 - DNA, 14 bp, Homo sapiens
cactggtttgaaga

SEQ ID NO: 6696691 - DNA, 17 bp, Homo sapiens
cactggtttgccaggcc

SEQ ID NO: 6696692 - DNA, 19 bp, Homo sapiens
cactggtttgccaggccaa

SEQ ID NO: 6696693 - DNA, 12 bp, Homo sapiens
cactggttttaa

SEQ ID NO: 6696694 - DNA, 20 bp, Homo sapiens
cactggttttggccacccct

SEQ ID NO: 6696695 - DNA, 12 bp, Homo sapiens
cactgtaaaatg

SEQ ID NO: 6696696 - DNA, 17 bp, Homo sapiens
cactgtaaaatgaaatt

SEQ ID NO: 6696697 - DNA, 19 bp, Homo sapiens
cactgtaaacccctgggta

SEQ ID NO: 6696698 - DNA, 15 bp, Homo sapiens
cactgtaaagacaaa

SEQ ID NO: 6696699 - DNA, 19 bp, Homo sapiens
cactgtaaagacaaataaa

SEQ ID NO: 6696700 - DNA, 17 bp, Homo sapiens
cactgtaaatatccctc

SEQ ID NO: 6696701 - DNA, 17 bp, Homo sapiens
cactgtaacctcaaact

SEQ ID NO: 6696702 - DNA, 20 bp, Homo sapiens
cactgtaacctcaaactctg

SEQ ID NO: 6696703 - DNA, 20 bp, Homo sapiens
cactgtaaggtgcttgctcc

SEQ ID NO: 6696704 - DNA, 21 bp, Homo sapiens
cactgtaaggtgcttgctccc

SEQ ID NO: 6696705 - DNA, 22 bp, Homo sapiens
cactgtaagtttattttttcta

SEQ ID NO: 6696706 - DNA, 22 bp, Homo sapiens
cactgtaatatctttaaatgat

SEQ ID NO: 6696707 - DNA, 18 bp, Homo sapiens
cactgtaatgaggaaaaa

SEQ ID NO: 6696708 - DNA, 15 bp, Homo sapiens
cactgtaattaaaac

SEQ ID NO: 6696709 - DNA, 19 bp, Homo sapiens
cactgtaattaaaactatt

SEQ ID NO: 6696710 - DNA, 14 bp, Homo sapiens
cactgtacacataa

SEQ ID NO: 6696711 - DNA, 16 bp, Homo sapiens
cactgtacagttttgt

SEQ ID NO: 6696712 - DNA, 15 bp, Homo sapiens
cactgtacttgctct

SEQ ID NO: 6696713 - DNA, 18 bp, Homo sapiens
cactgtagacaggaaagc

SEQ ID NO: 6696714 - DNA, 22 bp, Homo sapiens
cactgtagctattagcggctcc

SEQ ID NO: 6696715 - DNA, 19 bp, Homo sapiens
cactgtagtaaataatgct

SEQ ID NO: 6696716 - DNA, 20 bp, Homo sapiens
cactgtagtaaataatgctt

SEQ ID NO: 6696717 - DNA, 17 bp, Homo sapiens
cactgtagtcagacctc

SEQ ID NO: 6696718 - DNA, 14 bp, Homo sapiens
cactgtagttctaa

SEQ ID NO: 6696719 - DNA, 16 bp, Homo sapiens
cactgtagttctaaga

SEQ ID NO: 6696720 - DNA, 13 bp, Homo sapiens
cactgtagttttg

SEQ ID NO: 6696721 - DNA, 22 bp, Homo sapiens
cactgtagttttgagtgtatac

SEQ ID NO: 6696722 - DNA, 21 bp, Homo sapiens
cactgtagtttttgaaaatta

SEQ ID NO: 6696723 - DNA, 15 bp, Homo sapiens
cactgtataaatagg

SEQ ID NO: 6696724 - DNA, 16 bp, Homo sapiens
cactgtataaatagga

SEQ ID NO: 6696725 - DNA, 23 bp, Homo sapiens
cactgtatagatccacagggagc

SEQ ID NO: 6696726 - DNA, 17 bp, Homo sapiens
cactgtatagtaatcat

SEQ ID NO: 6696727 - DNA, 13 bp, Homo sapiens
cactgtatataaa

SEQ ID NO: 6696728 - DNA, 22 bp, Homo sapiens
cactgtatattttttaatgtat

SEQ ID NO: 6696729 - DNA, 12 bp, Homo sapiens
cactgtatcatt

SEQ ID NO: 6696730 - DNA, 17 bp, Homo sapiens
cactgtatcatttcatg

SEQ ID NO: 6696731 - DNA, 18 bp, Homo sapiens
cactgtatcatttcatgc

SEQ ID NO: 6696732 - DNA, 16 bp, Homo sapiens
cactgtatgctggacg

SEQ ID NO: 6696733 - DNA, 19 bp, Homo sapiens
cactgtattaaagatgcag

SEQ ID NO: 6696734 - DNA, 15 bp, Homo sapiens
cactgtattgctcct

SEQ ID NO: 6696735 - DNA, 22 bp, Homo sapiens
cactgtattgctcctcccactt

SEQ ID NO: 6696736 - DNA, 17 bp, Homo sapiens
cactgtatttgtatctc

SEQ ID NO: 6696737 - DNA, 14 bp, Homo sapiens
cactgtatttgtta

SEQ ID NO: 6696738 - DNA, 17 bp, Homo sapiens
cactgtatttgttaatt

SEQ ID NO: 6696739 - DNA, 18 bp, Homo sapiens
cactgtcactgtttctct

SEQ ID NO: 6696740 - DNA, 19 bp, Homo sapiens
cactgtcactgtttctctg

SEQ ID NO: 6696741 - DNA, 20 bp, Homo sapiens
cactgtcactttgctctggg

SEQ ID NO: 6696742 - DNA, 15 bp, Homo sapiens
cactgtcagagctgt

SEQ ID NO: 6696743 - DNA, 18 bp, Homo sapiens
cactgtcagccctcactg

SEQ ID NO: 6696744 - DNA, 22 bp, Homo sapiens
cactgtcagccctcactgtcag

SEQ ID NO: 6696745 - DNA, 15 bp, Homo sapiens
cactgtcaggaatgg

SEQ ID NO: 6696746 - DNA, 18 bp, Homo sapiens
cactgtcataatctcttt

SEQ ID NO: 6696747 - DNA, 15 bp, Homo sapiens
cactgtcatcaatgt

SEQ ID NO: 6696748 - DNA, 22 bp, Homo sapiens
cactgtcatgcccagcttggag

SEQ ID NO: 6696749 - DNA, 23 bp, Homo sapiens
cactgtcatgtgcgaacacagtg

SEQ ID NO: 6696750 - DNA, 15 bp, Homo sapiens
cactgtcatgtgtct

SEQ ID NO: 6696751 - DNA, 18 bp, Homo sapiens
cactgtccaatatgaaaa

SEQ ID NO: 6696752 - DNA, 14 bp, Homo sapiens
cactgtccctacca

SEQ ID NO: 6696753 - DNA, 15 bp, Homo sapiens
cactgtccctaccac

SEQ ID NO: 6696754 - DNA, 16 bp, Homo sapiens
cactgtccctaccact

SEQ ID NO: 6696755 - DNA, 18 bp, Homo sapiens
cactgtccctaccactga

SEQ ID NO: 6696756 - DNA, 16 bp, Homo sapiens
cactgtccctcaaatg

SEQ ID NO: 6696757 - DNA, 12 bp, Homo sapiens
cactgtcccttg

SEQ ID NO: 6696758 - DNA, 17 bp, Homo sapiens
cactgtcccttgcctca

SEQ ID NO: 6696759 - DNA, 18 bp, Homo sapiens
cactgtcccttgcctcaa

SEQ ID NO: 6696760 - DNA, 12 bp, Homo sapiens
cactgtccgcct

SEQ ID NO: 6696761 - DNA, 16 bp, Homo sapiens
cactgtccgcctctgc

SEQ ID NO: 6696762 - DNA, 21 bp, Homo sapiens
cactgtccgctgtctccctcc

SEQ ID NO: 6696763 - DNA, 14 bp, Homo sapiens
cactgtcctccaag

SEQ ID NO: 6696764 - DNA, 16 bp, Homo sapiens
cactgtcctccttggc

SEQ ID NO: 6696765 - DNA, 15 bp, Homo sapiens
cactgtcctgctcca

SEQ ID NO: 6696766 - DNA, 13 bp, Homo sapiens
cactgtcctggct

SEQ ID NO: 6696767 - DNA, 18 bp, Homo sapiens
cactgtcctgggcctgca

SEQ ID NO: 6696768 - DNA, 15 bp, Homo sapiens
cactgtcctgggcgc

SEQ ID NO: 6696769 - DNA, 16 bp, Homo sapiens
cactgtcctgggcgcc

SEQ ID NO: 6696770 - DNA, 23 bp, Homo sapiens
cactgtcctgggcgccctggaag

SEQ ID NO: 6696771 - DNA, 12 bp, Homo sapiens
cactgtcctgtt

SEQ ID NO: 6696772 - DNA, 18 bp, Homo sapiens
cactgtccttccctgcca

SEQ ID NO: 6696773 - DNA, 15 bp, Homo sapiens
cactgtcctttctcc

SEQ ID NO: 6696774 - DNA, 17 bp, Homo sapiens
cactgtcctttctccag

SEQ ID NO: 6696775 - DNA, 17 bp, Homo sapiens
cactgtctagagcaact

SEQ ID NO: 6696776 - DNA, 22 bp, Homo sapiens
cactgtctgctaccagggctca

SEQ ID NO: 6696777 - DNA, 15 bp, Homo sapiens
cactgtctgttgctt

SEQ ID NO: 6696778 - DNA, 14 bp, Homo sapiens
cactgtcttcacaa

SEQ ID NO: 6696779 - DNA, 16 bp, Homo sapiens
cactgtcttgcctgcc

SEQ ID NO: 6696780 - DNA, 17 bp, Homo sapiens
cactgtcttgcctgcca

SEQ ID NO: 6696781 - DNA, 18 bp, Homo sapiens
cactgtctttaattctgt

SEQ ID NO: 6696782 - DNA, 14 bp, Homo sapiens
cactgtcttttaaa

SEQ ID NO: 6696783 - DNA, 12 bp, Homo sapiens
cactgtcttttt

SEQ ID NO: 6696784 - DNA, 14 bp, Homo sapiens
cactgtgaaataca

SEQ ID NO: 6696785 - DNA, 15 bp, Homo sapiens
cactgtgaaatttca

SEQ ID NO: 6696786 - DNA, 16 bp, Homo sapiens
cactgtgaaatttcat

SEQ ID NO: 6696787 - DNA, 20 bp, Homo sapiens
cactgtgaaccggctcccac

SEQ ID NO: 6696788 - DNA, 20 bp, Homo sapiens
cactgtgaacctgggcactc

SEQ ID NO: 6696789 - DNA, 22 bp, Homo sapiens
cactgtgaactattttgaagaa

SEQ ID NO: 6696790 - DNA, 23 bp, Homo sapiens
cactgtgaagacccagcaggaag

SEQ ID NO: 6696791 - DNA, 15 bp, Homo sapiens
cactgtgaaggaccc

SEQ ID NO: 6696792 - DNA, 17 bp, Homo sapiens
cactgtgaaggaccctt

SEQ ID NO: 6696793 - DNA, 19 bp, Homo sapiens
cactgtgaatcctggcaag

SEQ ID NO: 6696794 - DNA, 17 bp, Homo sapiens
cactgtgacacactaca

SEQ ID NO: 6696795 - DNA, 15 bp, Homo sapiens
cactgtgacccccag

SEQ ID NO: 6696796 - DNA, 19 bp, Homo sapiens
cactgtgacctgctcctgc

SEQ ID NO: 6696797 - DNA, 16 bp, Homo sapiens
cactgtgaccttgact

SEQ ID NO: 6696798 - DNA, 17 bp, Homo sapiens
cactgtgaccttgagaa

SEQ ID NO: 6696799 - DNA, 16 bp, Homo sapiens
cactgtgagctcccag

SEQ ID NO: 6696800 - DNA, 15 bp, Homo sapiens
cactgtgatgttggg

SEQ ID NO: 6696801 - DNA, 16 bp, Homo sapiens
cactgtgattttgccc

SEQ ID NO: 6696802 - DNA, 20 bp, Homo sapiens
cactgtgcacatctgtgtct

SEQ ID NO: 6696803 - DNA, 22 bp, Homo sapiens
cactgtgcacatctgtgtcttg

SEQ ID NO: 6696804 - DNA, 22 bp, Homo sapiens
cactgtgcagacccagtcccac

SEQ ID NO: 6696805 - DNA, 22 bp, Homo sapiens
cactgtgcagccggggagctga

SEQ ID NO: 6696806 - DNA, 12 bp, Homo sapiens
cactgtgcagga

SEQ ID NO: 6696807 - DNA, 15 bp, Homo sapiens
cactgtgcagtggag

SEQ ID NO: 6696808 - DNA, 16 bp, Homo sapiens
cactgtgccatgtgcc

SEQ ID NO: 6696809 - DNA, 17 bp, Homo sapiens
cactgtgcccagcccgg

SEQ ID NO: 6696810 - DNA, 19 bp, Homo sapiens
cactgtgccccgcgggctt

SEQ ID NO: 6696811 - DNA, 12 bp, Homo sapiens
cactgtgccctg

SEQ ID NO: 6696812 - DNA, 22 bp, Homo sapiens
cactgtgcctcagagaccaggg

SEQ ID NO: 6696813 - DNA, 22 bp, Homo sapiens
cactgtgcctttgcaaatcagt

SEQ ID NO: 6696814 - DNA, 21 bp, Homo sapiens
cactgtgctaataacagtgca

SEQ ID NO: 6696815 - DNA, 14 bp, Homo sapiens
cactgtgctataaa

SEQ ID NO: 6696816 - DNA, 16 bp, Homo sapiens
cactgtgctattacaa

SEQ ID NO: 6696817 - DNA, 15 bp, Homo sapiens
cactgtgctcagcca

SEQ ID NO: 6696818 - DNA, 15 bp, Homo sapiens
cactgtgctcagggc

SEQ ID NO: 6696819 - DNA, 12 bp, Homo sapiens
cactgtgctcca

SEQ ID NO: 6696820 - DNA, 17 bp, Homo sapiens
cactgtgctccaacctg

SEQ ID NO: 6696821 - DNA, 13 bp, Homo sapiens
cactgtgctgagt

SEQ ID NO: 6696822 - DNA, 20 bp, Homo sapiens
cactgtgctgagtctgaagg

SEQ ID NO: 6696823 - DNA, 21 bp, Homo sapiens
cactgtgctgagtctgaaggc

SEQ ID NO: 6696824 - DNA, 14 bp, Homo sapiens
cactgtgctgttgt

SEQ ID NO: 6696825 - DNA, 20 bp, Homo sapiens
cactgtgctgttgttatgat

SEQ ID NO: 6696826 - DNA, 23 bp, Homo sapiens
cactgtgctgttgttatgatgtg

SEQ ID NO: 6696827 - DNA, 16 bp, Homo sapiens
cactgtgcttacagtg

SEQ ID NO: 6696828 - DNA, 16 bp, Homo sapiens
cactgtgcttgctcct

SEQ ID NO: 6696829 - DNA, 17 bp, Homo sapiens
cactgtgcttgctccta

SEQ ID NO: 6696830 - DNA, 20 bp, Homo sapiens
cactgtggaacactaaagag

SEQ ID NO: 6696831 - DNA, 23 bp, Homo sapiens
cactgtggaactaataaatacat

SEQ ID NO: 6696832 - DNA, 17 bp, Homo sapiens
cactgtggaagtccctc

SEQ ID NO: 6696833 - DNA, 14 bp, Homo sapiens
cactgtggcagcag

SEQ ID NO: 6696834 - DNA, 17 bp, Homo sapiens
cactgtggcagcaggag

SEQ ID NO: 6696835 - DNA, 23 bp, Homo sapiens
cactgtggcagcaggagggactc

SEQ ID NO: 6696836 - DNA, 13 bp, Homo sapiens
cactgtggccaga

SEQ ID NO: 6696837 - DNA, 15 bp, Homo sapiens
cactgtggccagagc

SEQ ID NO: 6696838 - DNA, 17 bp, Homo sapiens
cactgtggccagagctg

SEQ ID NO: 6696839 - DNA, 18 bp, Homo sapiens
cactgtggccagagctgg

SEQ ID NO: 6696840 - DNA, 20 bp, Homo sapiens
cactgtggccagagctggaa

SEQ ID NO: 6696841 - DNA, 23 bp, Homo sapiens
cactgtggccagagctggaaggc

SEQ ID NO: 6696842 - DNA, 17 bp, Homo sapiens
cactgtggccaggcctt

SEQ ID NO: 6696843 - DNA, 23 bp, Homo sapiens
cactgtggccagtaaaatactat

SEQ ID NO: 6696844 - DNA, 14 bp, Homo sapiens
cactgtggccccaa

SEQ ID NO: 6696845 - DNA, 20 bp, Homo sapiens
cactgtggcctgatcagcag

SEQ ID NO: 6696846 - DNA, 20 bp, Homo sapiens
cactgtggcgttctgctgcc

SEQ ID NO: 6696847 - DNA, 15 bp, Homo sapiens
cactgtggctgtctg

SEQ ID NO: 6696848 - DNA, 19 bp, Homo sapiens
cactgtggggaaacaattt

SEQ ID NO: 6696849 - DNA, 16 bp, Homo sapiens
cactgtgggtgtgtga

SEQ ID NO: 6696850 - DNA, 19 bp, Homo sapiens
cactgtgggtgtgtgactc

SEQ ID NO: 6696851 - DNA, 14 bp, Homo sapiens
cactgtggtcaggc

SEQ ID NO: 6696852 - DNA, 20 bp, Homo sapiens
cactgtggtcaggcccagcc

SEQ ID NO: 6696853 - DNA, 13 bp, Homo sapiens
cactgtggtggca

SEQ ID NO: 6696854 - DNA, 11 bp, Homo sapiens
cactgtggttt

SEQ ID NO: 6696855 - DNA, 16 bp, Homo sapiens
cactgtggtttcagat

SEQ ID NO: 6696856 - DNA, 18 bp, Homo sapiens
cactgtgtaaccagcagt

SEQ ID NO: 6696857 - DNA, 19 bp, Homo sapiens
cactgtgtactggagcctg

SEQ ID NO: 6696858 - DNA, 21 bp, Homo sapiens
cactgtgtactggagcctgca

SEQ ID NO: 6696859 - DNA, 22 bp, Homo sapiens
cactgtgtataggaatttgtat

SEQ ID NO: 6696860 - DNA, 15 bp, Homo sapiens
cactgtgtatatttg

SEQ ID NO: 6696861 - DNA, 20 bp, Homo sapiens
cactgtgtatatttgattta

SEQ ID NO: 6696862 - DNA, 21 bp, Homo sapiens
cactgtgtatatttgatttat

SEQ ID NO: 6696863 - DNA, 21 bp, Homo sapiens
cactgtgtcacccagactgga

SEQ ID NO: 6696864 - DNA, 14 bp, Homo sapiens
cactgtgtcccagt

SEQ ID NO: 6696865 - DNA, 18 bp, Homo sapiens
cactgtgtcccagtgtct

SEQ ID NO: 6696866 - DNA, 19 bp, Homo sapiens
cactgtgtcccagtgtctg

SEQ ID NO: 6696867 - DNA, 12 bp, Homo sapiens
cactgtgtctct

SEQ ID NO: 6696868 - DNA, 15 bp, Homo sapiens
cactgtgtctctatg

SEQ ID NO: 6696869 - DNA, 16 bp, Homo sapiens
cactgtgtctctatgt

SEQ ID NO: 6696870 - DNA, 20 bp, Homo sapiens
cactgtgtctctatgtgaat

SEQ ID NO: 6696871 - DNA, 13 bp, Homo sapiens
cactgtgtctctg

SEQ ID NO: 6696872 - DNA, 19 bp, Homo sapiens
cactgtgtctctgtttcct

SEQ ID NO: 6696873 - DNA, 22 bp, Homo sapiens
cactgtgtggccctggacaagc

SEQ ID NO: 6696874 - DNA, 18 bp, Homo sapiens
cactgtgttactgctttg

SEQ ID NO: 6696875 - DNA, 16 bp, Homo sapiens
cactgtgttgcccagg

SEQ ID NO: 6696876 - DNA, 19 bp, Homo sapiens
cactgtgttggccaggctg

SEQ ID NO: 6696877 - DNA, 14 bp, Homo sapiens
cactgtgtttctgt

SEQ ID NO: 6696878 - DNA, 16 bp, Homo sapiens
cactgttactccacag

SEQ ID NO: 6696879 - DNA, 16 bp, Homo sapiens
cactgttagaacacta

SEQ ID NO: 6696880 - DNA, 14 bp, Homo sapiens
cactgttcaatact

SEQ ID NO: 6696881 - DNA, 17 bp, Homo sapiens
cactgttcagcggagct

SEQ ID NO: 6696882 - DNA, 22 bp, Homo sapiens
cactgttcccaatatgtagcct

SEQ ID NO: 6696883 - DNA, 23 bp, Homo sapiens
cactgttcccagcaaagttttca

SEQ ID NO: 6696884 - DNA, 17 bp, Homo sapiens
cactgttccctctgctc

SEQ ID NO: 6696885 - DNA, 18 bp, Homo sapiens
cactgttccctctggctt

SEQ ID NO: 6696886 - DNA, 14 bp, Homo sapiens
cactgttctctgcc

SEQ ID NO: 6696887 - DNA, 16 bp, Homo sapiens
cactgttctctgccct

SEQ ID NO: 6696888 - DNA, 19 bp, Homo sapiens
cactgttctctgccctcca

SEQ ID NO: 6696889 - DNA, 22 bp, Homo sapiens
cactgttctctgccctccaaga

SEQ ID NO: 6696890 - DNA, 16 bp, Homo sapiens
cactgttcttagctca

SEQ ID NO: 6696891 - DNA, 17 bp, Homo sapiens
cactgttgaaaattatt

SEQ ID NO: 6696892 - DNA, 19 bp, Homo sapiens
cactgttgagaccttgtgg

SEQ ID NO: 6696893 - DNA, 20 bp, Homo sapiens
cactgttgagccccagtgct

SEQ ID NO: 6696894 - DNA, 21 bp, Homo sapiens
cactgttgagccccagtgctg

SEQ ID NO: 6696895 - DNA, 20 bp, Homo sapiens
cactgttgagttggacacac

SEQ ID NO: 6696896 - DNA, 14 bp, Homo sapiens
cactgttgataaaa

SEQ ID NO: 6696897 - DNA, 16 bp, Homo sapiens
cactgttgataaaaac

SEQ ID NO: 6696898 - DNA, 12 bp, Homo sapiens
cactgttgcaaa

SEQ ID NO: 6696899 - DNA, 23 bp, Homo sapiens
cactgttgcagtggcctggccgt

SEQ ID NO: 6696900 - DNA, 16 bp, Homo sapiens
cactgttgcccaggct

SEQ ID NO: 6696901 - DNA, 19 bp, Homo sapiens
cactgttgcccaggctggc

SEQ ID NO: 6696902 - DNA, 13 bp, Homo sapiens
cactgttgccttt

SEQ ID NO: 6696903 - DNA, 20 bp, Homo sapiens
cactgttgcttaattgtgaa

SEQ ID NO: 6696904 - DNA, 21 bp, Homo sapiens
cactgttggaagaaaagagat

SEQ ID NO: 6696905 - DNA, 24 bp, Homo sapiens
cactgttggaatgtatgctaattg

SEQ ID NO: 6696906 - DNA, 18 bp, Homo sapiens
cactgttgtacacagtct

SEQ ID NO: 6696907 - DNA, 23 bp, Homo sapiens
cactgtttagatttgccatagag

SEQ ID NO: 6696908 - DNA, 21 bp, Homo sapiens
cactgtttatggaaataccag

SEQ ID NO: 6696909 - DNA, 19 bp, Homo sapiens
cactgtttcaaactttact

SEQ ID NO: 6696910 - DNA, 19 bp, Homo sapiens
cactgtttcatctcagctt

SEQ ID NO: 6696911 - DNA, 12 bp, Homo sapiens
cactgtttcctg

SEQ ID NO: 6696912 - DNA, 18 bp, Homo sapiens
cactgtttctctgctgtt

SEQ ID NO: 6696913 - DNA, 19 bp, Homo sapiens
cactgtttctcttgagctg

SEQ ID NO: 6696914 - DNA, 21 bp, Homo sapiens
cactgtttctcttgagctggc

SEQ ID NO: 6696915 - DNA, 22 bp, Homo sapiens
cactgtttctcttgagctggcc

SEQ ID NO: 6696916 - DNA, 18 bp, Homo sapiens
cactgtttcttgcttgta

SEQ ID NO: 6696917 - DNA, 21 bp, Homo sapiens
cactgtttcttgcttgtacct

SEQ ID NO: 6696918 - DNA, 22 bp, Homo sapiens
cactgtttgcatgcgcccgagg

SEQ ID NO: 6696919 - DNA, 15 bp, Homo sapiens
cactgtttggatatg

SEQ ID NO: 6696920 - DNA, 16 bp, Homo sapiens
cactgttttatagaaa

SEQ ID NO: 6696921 - DNA, 21 bp, Homo sapiens
cactgttttctagtgtatcaa

SEQ ID NO: 6696922 - DNA, 18 bp, Homo sapiens
cactgttttgttggccca

SEQ ID NO: 6696923 - DNA, 14 bp, Homo sapiens
cactgtttttaatc

SEQ ID NO: 6696924 - DNA, 20 bp, Homo sapiens
cactgtttttagacaccttc

SEQ ID NO: 6696925 - DNA, 19 bp, Homo sapiens
cactgtttttccatagttt

SEQ ID NO: 6696926 - DNA, 19 bp, Homo sapiens
cactgttttttggcttgct

SEQ ID NO: 6696927 - DNA, 14 bp, Homo sapiens
cacttaaaatacat

SEQ ID NO: 6696928 - DNA, 22 bp, Homo sapiens
cacttaaaatcaaatttttctg

SEQ ID NO: 6696929 - DNA, 17 bp, Homo sapiens
cacttaaaatgtgcagt

SEQ ID NO: 6696930 - DNA, 17 bp, Homo sapiens
cacttaaacagaagcag

SEQ ID NO: 6696931 - DNA, 15 bp, Homo sapiens
cacttaaacttgcat

SEQ ID NO: 6696932 - DNA, 17 bp, Homo sapiens
cacttaaactttgtcac

SEQ ID NO: 6696933 - DNA, 22 bp, Homo sapiens
cacttaaactttgtcacttctg

SEQ ID NO: 6696934 - DNA, 15 bp, Homo sapiens
cacttaaagaagtat

SEQ ID NO: 6696935 - DNA, 16 bp, Homo sapiens
cacttaaagaagtatt

SEQ ID NO: 6696936 - DNA, 23 bp, Homo sapiens
cacttaaatatcaatcattttcc

SEQ ID NO: 6696937 - DNA, 16 bp, Homo sapiens
cacttaaattatgata

SEQ ID NO: 6696938 - DNA, 12 bp, Homo sapiens
cacttaaatttc

SEQ ID NO: 6696939 - DNA, 11 bp, Homo sapiens
cacttaacagg

SEQ ID NO: 6696940 - DNA, 22 bp, Homo sapiens
cacttaactataaggtgcctca

SEQ ID NO: 6696941 - DNA, 13 bp, Homo sapiens
cacttaagactgt

SEQ ID NO: 6696942 - DNA, 20 bp, Homo sapiens
cacttaagagaatattttaa

SEQ ID NO: 6696943 - DNA, 18 bp, Homo sapiens
cacttaagcagagcagaa

SEQ ID NO: 6696944 - DNA, 17 bp, Homo sapiens
cacttaagttagcctcc

SEQ ID NO: 6696945 - DNA, 22 bp, Homo sapiens
cacttaagttagttccactgag

SEQ ID NO: 6696946 - DNA, 17 bp, Homo sapiens
cacttaagttctttgat

SEQ ID NO: 6696947 - DNA, 13 bp, Homo sapiens
cacttaataattt

SEQ ID NO: 6696948 - DNA, 20 bp, Homo sapiens
cacttaatattagcttgctt

SEQ ID NO: 6696949 - DNA, 12 bp, Homo sapiens
cacttaatcatt

SEQ ID NO: 6696950 - DNA, 12 bp, Homo sapiens
cacttaatcttc

SEQ ID NO: 6696951 - DNA, 17 bp, Homo sapiens
cacttaatcttctctct

SEQ ID NO: 6696952 - DNA, 14 bp, Homo sapiens
cacttaatgtttct

SEQ ID NO: 6696953 - DNA, 23 bp, Homo sapiens
cacttaattacagttaaagaagc

SEQ ID NO: 6696954 - DNA, 13 bp, Homo sapiens
cacttaattctgt

SEQ ID NO: 6696955 - DNA, 13 bp, Homo sapiens
cacttaatttgaa

SEQ ID NO: 6696956 - DNA, 21 bp, Homo sapiens
cacttaatttgtaaacttctg

SEQ ID NO: 6696957 - DNA, 15 bp, Homo sapiens
cacttacaagtggtg

SEQ ID NO: 6696958 - DNA, 20 bp, Homo sapiens
cacttacacttataaaataa

SEQ ID NO: 6696959 - DNA, 19 bp, Homo sapiens
cacttacagataggccttc

SEQ ID NO: 6696960 - DNA, 21 bp, Homo sapiens
cacttacagataggccttctt

SEQ ID NO: 6696961 - DNA, 20 bp, Homo sapiens
cacttacataaagctccctt

SEQ ID NO: 6696962 - DNA, 13 bp, Homo sapiens
cacttacatatat

SEQ ID NO: 6696963 - DNA, 14 bp, Homo sapiens
cacttaccccgaga

SEQ ID NO: 6696964 - DNA, 23 bp, Homo sapiens
cacttaccgccctgcgggccaca

SEQ ID NO: 6696965 - DNA, 12 bp, Homo sapiens
cacttacctcaa

SEQ ID NO: 6696966 - DNA, 16 bp, Homo sapiens
cacttacctgcttgag

SEQ ID NO: 6696967 - DNA, 14 bp, Homo sapiens
cacttaccttcaat

SEQ ID NO: 6696968 - DNA, 15 bp, Homo sapiens
cacttaccttcaata

SEQ ID NO: 6696969 - DNA, 18 bp, Homo sapiens
cacttactataatggttg

SEQ ID NO: 6696970 - DNA, 19 bp, Homo sapiens
cacttactggtccttacca

SEQ ID NO: 6696971 - DNA, 19 bp, Homo sapiens
cacttagaaattgcatttc

SEQ ID NO: 6696972 - DNA, 24 bp, Homo sapiens
cacttagaaattgcatttcctgac

SEQ ID NO: 6696973 - DNA, 18 bp, Homo sapiens
cacttagacctgccagcc

SEQ ID NO: 6696974 - DNA, 19 bp, Homo sapiens
cacttagacctgccagcca

SEQ ID NO: 6696975 - DNA, 22 bp, Homo sapiens
cacttagacctgccagccactg

SEQ ID NO: 6696976 - DNA, 23 bp, Homo sapiens
cacttagcaggcaccgccacgtc

SEQ ID NO: 6696977 - DNA, 14 bp, Homo sapiens
cacttagcagggac

SEQ ID NO: 6696978 - DNA, 16 bp, Homo sapiens
cacttagcagggacag

SEQ ID NO: 6696979 - DNA, 22 bp, Homo sapiens
cacttagccatgatggcaacag

SEQ ID NO: 6696980 - DNA, 16 bp, Homo sapiens
cacttagccattgaaa

SEQ ID NO: 6696981 - DNA, 16 bp, Homo sapiens
cacttagcccaagagg

SEQ ID NO: 6696982 - DNA, 19 bp, Homo sapiens
cacttagccgcaccctgca

SEQ ID NO: 6696983 - DNA, 22 bp, Homo sapiens
cacttagccgtccatggcacca

SEQ ID NO: 6696984 - DNA, 17 bp, Homo sapiens
cacttagcctctttctg

SEQ ID NO: 6696985 - DNA, 15 bp, Homo sapiens
cacttagctatcaga

SEQ ID NO: 6696986 - DNA, 21 bp, Homo sapiens
cacttagctggagatgtctct

SEQ ID NO: 6696987 - DNA, 23 bp, Homo sapiens
cacttaggaacgtaatcgtgtcc

SEQ ID NO: 6696988 - DNA, 12 bp, Homo sapiens
cacttaggaaga

SEQ ID NO: 6696989 - DNA, 13 bp, Homo sapiens
cacttaggaagaa

SEQ ID NO: 6696990 - DNA, 14 bp, Homo sapiens
cacttaggaagaaa

SEQ ID NO: 6696991 - DNA, 16 bp, Homo sapiens
cacttaggaagaaatc

SEQ ID NO: 6696992 - DNA, 18 bp, Homo sapiens
cacttaggagaagtcttc

SEQ ID NO: 6696993 - DNA, 17 bp, Homo sapiens
cacttagggatatatat

SEQ ID NO: 6696994 - DNA, 22 bp, Homo sapiens
cacttagtattttaaaaaataa

SEQ ID NO: 6696995 - DNA, 12 bp, Homo sapiens
cacttagtcctt

SEQ ID NO: 6696996 - DNA, 20 bp, Homo sapiens
cacttataaatatcctgctc

SEQ ID NO: 6696997 - DNA, 18 bp, Homo sapiens
cacttatatagcaccttt

SEQ ID NO: 6696998 - DNA, 11 bp, Homo sapiens
cacttatatat

SEQ ID NO: 6696999 - DNA, 18 bp, Homo sapiens
cacttatattttatgaac

SEQ ID NO: 6697000 - DNA, 20 bp, Homo sapiens
cacttatattttatgaacat

SEQ ID NO: 6697001 - DNA, 21 bp, Homo sapiens
cacttatattttatgaacatt

SEQ ID NO: 6697002 - DNA, 19 bp, Homo sapiens
cacttatcattagaatctt

SEQ ID NO: 6697003 - DNA, 16 bp, Homo sapiens
cacttatccctctcca

SEQ ID NO: 6697004 - DNA, 14 bp, Homo sapiens
cacttatcctgaca

SEQ ID NO: 6697005 - DNA, 14 bp, Homo sapiens
cacttatctcactg

SEQ ID NO: 6697006 - DNA, 21 bp, Homo sapiens
cacttatgaatgatttgcata

SEQ ID NO: 6697007 - DNA, 18 bp, Homo sapiens
cacttatggaatttttaa

SEQ ID NO: 6697008 - DNA, 13 bp, Homo sapiens
cacttatggtaat

SEQ ID NO: 6697009 - DNA, 13 bp, Homo sapiens
cacttatgtactt

SEQ ID NO: 6697010 - DNA, 20 bp, Homo sapiens
cacttattccctcatccttt

SEQ ID NO: 6697011 - DNA, 13 bp, Homo sapiens
cacttattctgta

SEQ ID NO: 6697012 - DNA, 13 bp, Homo sapiens
cacttattgcttt

SEQ ID NO: 6697013 - DNA, 22 bp, Homo sapiens
cacttattggaactctgcttga

SEQ ID NO: 6697014 - DNA, 20 bp, Homo sapiens
cacttattgtccaggtgagg

SEQ ID NO: 6697015 - DNA, 19 bp, Homo sapiens
cacttattgtttgaaagac

SEQ ID NO: 6697016 - DNA, 20 bp, Homo sapiens
cacttatttatgaacctgcc

SEQ ID NO: 6697017 - DNA, 13 bp, Homo sapiens
cacttatttccat

SEQ ID NO: 6697018 - DNA, 23 bp, Homo sapiens
cacttatttgggggaggcttcag

SEQ ID NO: 6697019 - DNA, 13 bp, Homo sapiens
cacttatttgtca

SEQ ID NO: 6697020 - DNA, 18 bp, Homo sapiens
cacttatttgtcaaaata

SEQ ID NO: 6697021 - DNA, 16 bp, Homo sapiens
cacttattttacacag

SEQ ID NO: 6697022 - DNA, 12 bp, Homo sapiens
cacttattttct

SEQ ID NO: 6697023 - DNA, 16 bp, Homo sapiens
cacttcaaactacttt

SEQ ID NO: 6697024 - DNA, 17 bp, Homo sapiens
cacttcaaatcagagca

SEQ ID NO: 6697025 - DNA, 20 bp, Homo sapiens
cacttcaaatcagagcagtg

SEQ ID NO: 6697026 - DNA, 23 bp, Homo sapiens
cacttcaagctcaccctgctcct

SEQ ID NO: 6697027 - DNA, 23 bp, Homo sapiens
cacttcaagctgttatttcttcc

SEQ ID NO: 6697028 - DNA, 17 bp, Homo sapiens
cacttcaaggtgacaga

SEQ ID NO: 6697029 - DNA, 18 bp, Homo sapiens
cacttcaataattgtcca

SEQ ID NO: 6697030 - DNA, 17 bp, Homo sapiens
cacttcaatcctcaaat

SEQ ID NO: 6697031 - DNA, 15 bp, Homo sapiens
cacttcacagagtgt

SEQ ID NO: 6697032 - DNA, 14 bp, Homo sapiens
cacttcacagctgg

SEQ ID NO: 6697033 - DNA, 13 bp, Homo sapiens
cacttcaccccca

SEQ ID NO: 6697034 - DNA, 15 bp, Homo sapiens
cacttcacctccttc

SEQ ID NO: 6697035 - DNA, 17 bp, Homo sapiens
cacttcacctccttctg

SEQ ID NO: 6697036 - DNA, 12 bp, Homo sapiens
cacttcaccttc

SEQ ID NO: 6697037 - DNA, 17 bp, Homo sapiens
cacttcacgcccttggc

SEQ ID NO: 6697038 - DNA, 20 bp, Homo sapiens
cacttcacgcccttggccat

SEQ ID NO: 6697039 - DNA, 21 bp, Homo sapiens
cacttcacgcccttggccatg

SEQ ID NO: 6697040 - DNA, 17 bp, Homo sapiens
cacttcacgctttcagc

SEQ ID NO: 6697041 - DNA, 13 bp, Homo sapiens
cacttcactgtga

SEQ ID NO: 6697042 - DNA, 14 bp, Homo sapiens
cacttcactgtgag

SEQ ID NO: 6697043 - DNA, 14 bp, Homo sapiens
cacttcagaatcag

SEQ ID NO: 6697044 - DNA, 23 bp, Homo sapiens
cacttcagacacaggaaaaataa

SEQ ID NO: 6697045 - DNA, 13 bp, Homo sapiens
cacttcagagagc

SEQ ID NO: 6697046 - DNA, 15 bp, Homo sapiens
cacttcagagagctg

SEQ ID NO: 6697047 - DNA, 13 bp, Homo sapiens
cacttcagatctc

SEQ ID NO: 6697048 - DNA, 16 bp, Homo sapiens
cacttcagatctctaa

SEQ ID NO: 6697049 - DNA, 13 bp, Homo sapiens
cacttcagcccag

SEQ ID NO: 6697050 - DNA, 16 bp, Homo sapiens
cacttcagcctgtgca

SEQ ID NO: 6697051 - DNA, 12 bp, Homo sapiens
cacttcagctga

SEQ ID NO: 6697052 - DNA, 14 bp, Homo sapiens
cacttcaggctctt

SEQ ID NO: 6697053 - DNA, 17 bp, Homo sapiens
cacttcagggcagattt

SEQ ID NO: 6697054 - DNA, 19 bp, Homo sapiens
cacttcagggcagatttta

SEQ ID NO: 6697055 - DNA, 22 bp, Homo sapiens
cacttcagggcagattttagtt

SEQ ID NO: 6697056 - DNA, 19 bp, Homo sapiens
cacttcagggctttactcc

SEQ ID NO: 6697057 - DNA, 17 bp, Homo sapiens
cacttcaggggatgggt

SEQ ID NO: 6697058 - DNA, 19 bp, Homo sapiens
cacttcaggtccgtgggcc

SEQ ID NO: 6697059 - DNA, 18 bp, Homo sapiens
cacttcagttgtggcctc

SEQ ID NO: 6697060 - DNA, 16 bp, Homo sapiens
cacttcatatctagat

SEQ ID NO: 6697061 - DNA, 18 bp, Homo sapiens
cacttcatcttctcagct

SEQ ID NO: 6697062 - DNA, 16 bp, Homo sapiens
cacttcatgcccactg

SEQ ID NO: 6697063 - DNA, 18 bp, Homo sapiens
cacttcatgcccactgcc

SEQ ID NO: 6697064 - DNA, 14 bp, Homo sapiens
cacttcattccagc

SEQ ID NO: 6697065 - DNA, 18 bp, Homo sapiens
cacttcattccagcagct

SEQ ID NO: 6697066 - DNA, 13 bp, Homo sapiens
cacttcattgaaa

SEQ ID NO: 6697067 - DNA, 13 bp, Homo sapiens
cacttcattgttt

SEQ ID NO: 6697068 - DNA, 16 bp, Homo sapiens
cacttcattttgtata

SEQ ID NO: 6697069 - DNA, 14 bp, Homo sapiens
cacttcatttttaa

SEQ ID NO: 6697070 - DNA, 17 bp, Homo sapiens
cacttccaccagcctgc

SEQ ID NO: 6697071 - DNA, 20 bp, Homo sapiens
cacttccaccagcctgcact

SEQ ID NO: 6697072 - DNA, 20 bp, Homo sapiens
cacttccacccccagctcct

SEQ ID NO: 6697073 - DNA, 23 bp, Homo sapiens
cacttccacccccgttagcttcc

SEQ ID NO: 6697074 - DNA, 15 bp, Homo sapiens
cacttccacctccag

SEQ ID NO: 6697075 - DNA, 18 bp, Homo sapiens
cacttccacctccagcct

SEQ ID NO: 6697076 - DNA, 15 bp, Homo sapiens
cacttccagagccag

SEQ ID NO: 6697077 - DNA, 19 bp, Homo sapiens
cacttccagatatccacat

SEQ ID NO: 6697078 - DNA, 22 bp, Homo sapiens
cacttccagatatccacataaa

SEQ ID NO: 6697079 - DNA, 12 bp, Homo sapiens
cacttccaggtc

SEQ ID NO: 6697080 - DNA, 16 bp, Homo sapiens
cacttccagtctggag

SEQ ID NO: 6697081 - DNA, 12 bp, Homo sapiens
cacttccagtgt

SEQ ID NO: 6697082 - DNA, 14 bp, Homo sapiens
cacttccagtgttg

SEQ ID NO: 6697083 - DNA, 16 bp, Homo sapiens
cacttccatgttgtct

SEQ ID NO: 6697084 - DNA, 23 bp, Homo sapiens
cacttccattggttcttcctttc

SEQ ID NO: 6697085 - DNA, 15 bp, Homo sapiens
cacttccattgttta

SEQ ID NO: 6697086 - DNA, 16 bp, Homo sapiens
cacttccattgtttaa

SEQ ID NO: 6697087 - DNA, 14 bp, Homo sapiens
cacttcccaccccc

SEQ ID NO: 6697088 - DNA, 15 bp, Homo sapiens
cacttcccaccccca

SEQ ID NO: 6697089 - DNA, 18 bp, Homo sapiens
cacttcccacccccaggc

SEQ ID NO: 6697090 - DNA, 14 bp, Homo sapiens
cacttcccaccctg

SEQ ID NO: 6697091 - DNA, 16 bp, Homo sapiens
cacttcccaccctgcc

SEQ ID NO: 6697092 - DNA, 12 bp, Homo sapiens
cacttcccagga

SEQ ID NO: 6697093 - DNA, 13 bp, Homo sapiens
cacttcccaggat

SEQ ID NO: 6697094 - DNA, 14 bp, Homo sapiens
cacttcccagtgga

SEQ ID NO: 6697095 - DNA, 14 bp, Homo sapiens
cacttcccatctcc

SEQ ID NO: 6697096 - DNA, 17 bp, Homo sapiens
cacttcccatctccagg

SEQ ID NO: 6697097 - DNA, 19 bp, Homo sapiens
cacttcccatctccaggga

SEQ ID NO: 6697098 - DNA, 20 bp, Homo sapiens
cacttcccatctccagggaa

SEQ ID NO: 6697099 - DNA, 21 bp, Homo sapiens
cacttcccatctccagggaag

SEQ ID NO: 6697100 - DNA, 20 bp, Homo sapiens
cacttccccaagatctgcca

SEQ ID NO: 6697101 - DNA, 22 bp, Homo sapiens
cacttccccatctgtgtgtgaa

SEQ ID NO: 6697102 - DNA, 20 bp, Homo sapiens
cacttcccctccaagaccct

SEQ ID NO: 6697103 - DNA, 13 bp, Homo sapiens
cacttcccctcct

SEQ ID NO: 6697104 - DNA, 15 bp, Homo sapiens
cacttcccctcctac

SEQ ID NO: 6697105 - DNA, 21 bp, Homo sapiens
cacttcccctcctacccctcc

SEQ ID NO: 6697106 - DNA, 14 bp, Homo sapiens
cacttccccttgtc

SEQ ID NO: 6697107 - DNA, 22 bp, Homo sapiens
cacttccccttgtctccctggt

SEQ ID NO: 6697108 - DNA, 19 bp, Homo sapiens
cacttcccgtagctgccag

SEQ ID NO: 6697109 - DNA, 17 bp, Homo sapiens
cacttcccgtctcagaa

SEQ ID NO: 6697110 - DNA, 18 bp, Homo sapiens
cacttcccgtctcagaat

SEQ ID NO: 6697111 - DNA, 15 bp, Homo sapiens
cacttccctgacact

SEQ ID NO: 6697112 - DNA, 20 bp, Homo sapiens
cacttccctgacactgcggg

SEQ ID NO: 6697113 - DNA, 23 bp, Homo sapiens
cacttccctgcaaggtgcacctg

SEQ ID NO: 6697114 - DNA, 12 bp, Homo sapiens
cacttccctgct

SEQ ID NO: 6697115 - DNA, 18 bp, Homo sapiens
cacttccctgctgcctgt

SEQ ID NO: 6697116 - DNA, 14 bp, Homo sapiens
cacttccctgcttt

SEQ ID NO: 6697117 - DNA, 17 bp, Homo sapiens
cacttccctgggcctca

SEQ ID NO: 6697118 - DNA, 17 bp, Homo sapiens
cacttccgtcacatccc

SEQ ID NO: 6697119 - DNA, 21 bp, Homo sapiens
cacttcctagagcatctgtcc

SEQ ID NO: 6697120 - DNA, 23 bp, Homo sapiens
cacttcctagagcatctgtccca

SEQ ID NO: 6697121 - DNA, 24 bp, Homo sapiens
cacttcctagagcatctgtcccac

SEQ ID NO: 6697122 - DNA, 21 bp, Homo sapiens
cacttcctcatcatgaaaact

SEQ ID NO: 6697123 - DNA, 13 bp, Homo sapiens
cacttcctccaca

SEQ ID NO: 6697124 - DNA, 14 bp, Homo sapiens
cacttcctccacag

SEQ ID NO: 6697125 - DNA, 16 bp, Homo sapiens
cacttcctccagaagc

SEQ ID NO: 6697126 - DNA, 18 bp, Homo sapiens
cacttcctccagaagcct

SEQ ID NO: 6697127 - DNA, 13 bp, Homo sapiens
cacttcctcccct

SEQ ID NO: 6697128 - DNA, 12 bp, Homo sapiens
cacttcctccta

SEQ ID NO: 6697129 - DNA, 18 bp, Homo sapiens
cacttcctcctacctggg

SEQ ID NO: 6697130 - DNA, 21 bp, Homo sapiens
cacttcctctccacaggagcc

SEQ ID NO: 6697131 - DNA, 17 bp, Homo sapiens
cacttcctgaggcctca

SEQ ID NO: 6697132 - DNA, 12 bp, Homo sapiens
cacttcctgccc

SEQ ID NO: 6697133 - DNA, 22 bp, Homo sapiens
cacttcctgccccaactgcagg

SEQ ID NO: 6697134 - DNA, 12 bp, Homo sapiens
cacttcctgcct

SEQ ID NO: 6697135 - DNA, 16 bp, Homo sapiens
cacttcctgctacagg

SEQ ID NO: 6697136 - DNA, 19 bp, Homo sapiens
cacttcctgctacaggagg

SEQ ID NO: 6697137 - DNA, 20 bp, Homo sapiens
cacttcctgctacaggaggg

SEQ ID NO: 6697138 - DNA, 21 bp, Homo sapiens
cacttcctgttttaagcagct

SEQ ID NO: 6697139 - DNA, 13 bp, Homo sapiens
cacttccttaaca

SEQ ID NO: 6697140 - DNA, 14 bp, Homo sapiens
cacttccttaacag

SEQ ID NO: 6697141 - DNA, 15 bp, Homo sapiens
cacttccttaacagc

SEQ ID NO: 6697142 - DNA, 18 bp, Homo sapiens
cacttccttaacagctgt

SEQ ID NO: 6697143 - DNA, 12 bp, Homo sapiens
cacttcctttag

SEQ ID NO: 6697144 - DNA, 19 bp, Homo sapiens
cacttcctttgtgtttata

SEQ ID NO: 6697145 - DNA, 20 bp, Homo sapiens
cacttcctttgtgtttatat

SEQ ID NO: 6697146 - DNA, 21 bp, Homo sapiens
cacttcctttgtgtttatatg

SEQ ID NO: 6697147 - DNA, 16 bp, Homo sapiens
cacttcgctcttgagg

SEQ ID NO: 6697148 - DNA, 21 bp, Homo sapiens
cacttcgctcttgaggagctc

SEQ ID NO: 6697149 - DNA, 23 bp, Homo sapiens
cacttcgggaggtcgaggcagga

SEQ ID NO: 6697150 - DNA, 23 bp, Homo sapiens
cacttcgggctgtgtaaacacag

SEQ ID NO: 6697151 - DNA, 23 bp, Homo sapiens
cacttcgtgggatctgcccctcc

SEQ ID NO: 6697152 - DNA, 11 bp, Homo sapiens
cacttctaaac

SEQ ID NO: 6697153 - DNA, 17 bp, Homo sapiens
cacttctaaatagcaat

SEQ ID NO: 6697154 - DNA, 20 bp, Homo sapiens
cacttctaagttgagtatat

SEQ ID NO: 6697155 - DNA, 18 bp, Homo sapiens
cacttctagatctcagcc

SEQ ID NO: 6697156 - DNA, 19 bp, Homo sapiens
cacttctagtggtctcacc

SEQ ID NO: 6697157 - DNA, 11 bp, Homo sapiens
cacttctattt

SEQ ID NO: 6697158 - DNA, 13 bp, Homo sapiens
cacttctatttaa

SEQ ID NO: 6697159 - DNA, 12 bp, Homo sapiens
cacttctcagga

SEQ ID NO: 6697160 - DNA, 17 bp, Homo sapiens
cacttctcatcatattg

SEQ ID NO: 6697161 - DNA, 19 bp, Homo sapiens
cacttctcatcatattgta

SEQ ID NO: 6697162 - DNA, 16 bp, Homo sapiens
cacttctcatcttaaa

SEQ ID NO: 6697163 - DNA, 16 bp, Homo sapiens
cacttctccccagaaa

SEQ ID NO: 6697164 - DNA, 14 bp, Homo sapiens
cacttctccccgca

SEQ ID NO: 6697165 - DNA, 17 bp, Homo sapiens
cacttctccccgcagcc

SEQ ID NO: 6697166 - DNA, 23 bp, Homo sapiens
cacttctccccgcagcccgcctg

SEQ ID NO: 6697167 - DNA, 17 bp, Homo sapiens
cacttctccttaacccc

SEQ ID NO: 6697168 - DNA, 21 bp, Homo sapiens
cacttctccttaacccccatt

SEQ ID NO: 6697169 - DNA, 13 bp, Homo sapiens
cacttctctgctg

SEQ ID NO: 6697170 - DNA, 14 bp, Homo sapiens
cacttctctgctgc

SEQ ID NO: 6697171 - DNA, 20 bp, Homo sapiens
cacttctctgctgcctctgt

SEQ ID NO: 6697172 - DNA, 21 bp, Homo sapiens
cacttctctgggtcccggggt

SEQ ID NO: 6697173 - DNA, 16 bp, Homo sapiens
cacttctgaccacact

SEQ ID NO: 6697174 - DNA, 19 bp, Homo sapiens
cacttctgaccacacttcc

SEQ ID NO: 6697175 - DNA, 14 bp, Homo sapiens
cacttctgcacttg

SEQ ID NO: 6697176 - DNA, 16 bp, Homo sapiens
cacttctgcattcctg

SEQ ID NO: 6697177 - DNA, 21 bp, Homo sapiens
cacttctgcgggctccctcct

SEQ ID NO: 6697178 - DNA, 13 bp, Homo sapiens
cacttctgctgca

SEQ ID NO: 6697179 - DNA, 17 bp, Homo sapiens
cacttctgctgcatcgc

SEQ ID NO: 6697180 - DNA, 12 bp, Homo sapiens
cacttctgctgt

SEQ ID NO: 6697181 - DNA, 13 bp, Homo sapiens
cacttctgctttc

SEQ ID NO: 6697182 - DNA, 22 bp, Homo sapiens
cacttctggatatagctaggtg

SEQ ID NO: 6697183 - DNA, 18 bp, Homo sapiens
cacttctggcatgggaca

SEQ ID NO: 6697184 - DNA, 16 bp, Homo sapiens
cacttctggcctccag

SEQ ID NO: 6697185 - DNA, 18 bp, Homo sapiens
cacttctggcctccagcc

SEQ ID NO: 6697186 - DNA, 18 bp, Homo sapiens
cacttctggctcacagga

SEQ ID NO: 6697187 - DNA, 11 bp, Homo sapiens
cacttctggga

SEQ ID NO: 6697188 - DNA, 22 bp, Homo sapiens
cacttctggggccagcccctcc

SEQ ID NO: 6697189 - DNA, 18 bp, Homo sapiens
cacttctggtcccctgtg

SEQ ID NO: 6697190 - DNA, 22 bp, Homo sapiens
cacttctggtcccctgtggtga

SEQ ID NO: 6697191 - DNA, 17 bp, Homo sapiens
cacttctgtctcctgtc

SEQ ID NO: 6697192 - DNA, 21 bp, Homo sapiens
cacttctgtctcctgtcttca

SEQ ID NO: 6697193 - DNA, 13 bp, Homo sapiens
cacttctgtgcca

SEQ ID NO: 6697194 - DNA, 17 bp, Homo sapiens
cacttcttaaaggcctg

SEQ ID NO: 6697195 - DNA, 19 bp, Homo sapiens
cacttcttaaaggcctgga

SEQ ID NO: 6697196 - DNA, 20 bp, Homo sapiens
cacttcttaaggacagtgtt

SEQ ID NO: 6697197 - DNA, 19 bp, Homo sapiens
cacttcttacaataattct

SEQ ID NO: 6697198 - DNA, 14 bp, Homo sapiens
cacttcttacccca

SEQ ID NO: 6697199 - DNA, 20 bp, Homo sapiens
cacttcttctgtccaagcag

SEQ ID NO: 6697200 - DNA, 20 bp, Homo sapiens
cacttcttgaaacagcctgg

SEQ ID NO: 6697201 - DNA, 18 bp, Homo sapiens
cacttcttggttcctggg

SEQ ID NO: 6697202 - DNA, 15 bp, Homo sapiens
cacttctttcccttc

SEQ ID NO: 6697203 - DNA, 21 bp, Homo sapiens
cacttctttcccttcctccat

SEQ ID NO: 6697204 - DNA, 16 bp, Homo sapiens
cacttctttcctcaaa

SEQ ID NO: 6697205 - DNA, 14 bp, Homo sapiens
cacttctttcctct

SEQ ID NO: 6697206 - DNA, 17 bp, Homo sapiens
cacttctttgcagagcc

SEQ ID NO: 6697207 - DNA, 14 bp, Homo sapiens
cacttgaaaccttt

SEQ ID NO: 6697208 - DNA, 21 bp, Homo sapiens
cacttgaaacctttttttatc

SEQ ID NO: 6697209 - DNA, 12 bp, Homo sapiens
cacttgaaagat

SEQ ID NO: 6697210 - DNA, 15 bp, Homo sapiens
cacttgaaagatttt

SEQ ID NO: 6697211 - DNA, 19 bp, Homo sapiens
cacttgaaagattttattg

SEQ ID NO: 6697212 - DNA, 17 bp, Homo sapiens
cacttgaaattctttca

SEQ ID NO: 6697213 - DNA, 21 bp, Homo sapiens
cacttgaaccatagttactgt

SEQ ID NO: 6697214 - DNA, 18 bp, Homo sapiens
cacttgaacccgggaggc

SEQ ID NO: 6697215 - DNA, 21 bp, Homo sapiens
cacttgaacccgggaggcaga

SEQ ID NO: 6697216 - DNA, 17 bp, Homo sapiens
cacttgaagcacttaag

SEQ ID NO: 6697217 - DNA, 15 bp, Homo sapiens
cacttgaatcctagg

SEQ ID NO: 6697218 - DNA, 13 bp, Homo sapiens
cacttgaatttat

SEQ ID NO: 6697219 - DNA, 15 bp, Homo sapiens
cacttgaatttattg

SEQ ID NO: 6697220 - DNA, 16 bp, Homo sapiens
cacttgaatttattga

SEQ ID NO: 6697221 - DNA, 18 bp, Homo sapiens
cacttgaatttattgata

SEQ ID NO: 6697222 - DNA, 19 bp, Homo sapiens
cacttgacatcaactgcat

SEQ ID NO: 6697223 - DNA, 13 bp, Homo sapiens
cacttgacattcc

SEQ ID NO: 6697224 - DNA, 16 bp, Homo sapiens
cacttgacctcatctc

SEQ ID NO: 6697225 - DNA, 24 bp, Homo sapiens
cacttgacctgagatgctgggagg

SEQ ID NO: 6697226 - DNA, 15 bp, Homo sapiens
cacttgaccttctgt

SEQ ID NO: 6697227 - DNA, 22 bp, Homo sapiens
cacttgagaaccagtctcctca

SEQ ID NO: 6697228 - DNA, 23 bp, Homo sapiens
cacttgagaaccagtctcctcac

SEQ ID NO: 6697229 - DNA, 15 bp, Homo sapiens
cacttgagatgattt

SEQ ID NO: 6697230 - DNA, 15 bp, Homo sapiens
cacttgagcccagga

SEQ ID NO: 6697231 - DNA, 19 bp, Homo sapiens
cacttgagctcaggaggtc

SEQ ID NO: 6697232 - DNA, 15 bp, Homo sapiens
cacttgagctgtctg

SEQ ID NO: 6697233 - DNA, 18 bp, Homo sapiens
cacttgaggccaggagtt

SEQ ID NO: 6697234 - DNA, 16 bp, Homo sapiens
cacttgaggctggcac

SEQ ID NO: 6697235 - DNA, 18 bp, Homo sapiens
cacttgaggtcaggagtt

SEQ ID NO: 6697236 - DNA, 18 bp, Homo sapiens
cacttgagttcaggagtt

SEQ ID NO: 6697237 - DNA, 15 bp, Homo sapiens
cacttgagttggctg

SEQ ID NO: 6697238 - DNA, 11 bp, Homo sapiens
cacttgagttt

SEQ ID NO: 6697239 - DNA, 23 bp, Homo sapiens
cacttgatgatacaatgaacact

SEQ ID NO: 6697240 - DNA, 18 bp, Homo sapiens
cacttgattcatctctgg

SEQ ID NO: 6697241 - DNA, 14 bp, Homo sapiens
cacttgcactgtgc

SEQ ID NO: 6697242 - DNA, 22 bp, Homo sapiens
cacttgcagactctacagaggc

SEQ ID NO: 6697243 - DNA, 21 bp, Homo sapiens
cacttgcagaggagcccagtg

SEQ ID NO: 6697244 - DNA, 23 bp, Homo sapiens
cacttgcagaggagcccagtggg

SEQ ID NO: 6697245 - DNA, 18 bp, Homo sapiens
cacttgcagtggaagata

SEQ ID NO: 6697246 - DNA, 13 bp, Homo sapiens
cacttgccacatg

SEQ ID NO: 6697247 - DNA, 13 bp, Homo sapiens
cacttgccagggc

SEQ ID NO: 6697248 - DNA, 18 bp, Homo sapiens
cacttgccagggctctgg

SEQ ID NO: 6697249 - DNA, 18 bp, Homo sapiens
cacttgccatgcaggaag

SEQ ID NO: 6697250 - DNA, 20 bp, Homo sapiens
cacttgccattccaaaatat

SEQ ID NO: 6697251 - DNA, 20 bp, Homo sapiens
cacttgccattgccaggaga

SEQ ID NO: 6697252 - DNA, 18 bp, Homo sapiens
cacttgcccctgttacct

SEQ ID NO: 6697253 - DNA, 17 bp, Homo sapiens
cacttgccctgctccct

SEQ ID NO: 6697254 - DNA, 12 bp, Homo sapiens
cacttgcctctt

SEQ ID NO: 6697255 - DNA, 13 bp, Homo sapiens
cacttgcctcttc

SEQ ID NO: 6697256 - DNA, 17 bp, Homo sapiens
cacttgcctcttccttg

SEQ ID NO: 6697257 - DNA, 21 bp, Homo sapiens
cacttgcctcttccttgaaga

SEQ ID NO: 6697258 - DNA, 14 bp, Homo sapiens
cacttgcctgctgc

SEQ ID NO: 6697259 - DNA, 12 bp, Homo sapiens
cacttgcctggg

SEQ ID NO: 6697260 - DNA, 22 bp, Homo sapiens
cacttgcctgtcaccccagtca

SEQ ID NO: 6697261 - DNA, 21 bp, Homo sapiens
cacttgcctgttggctgctgc

SEQ ID NO: 6697262 - DNA, 19 bp, Homo sapiens
cacttgcgtcctgcagagg

SEQ ID NO: 6697263 - DNA, 20 bp, Homo sapiens
cacttgctgagtgaaggaaa

SEQ ID NO: 6697264 - DNA, 14 bp, Homo sapiens
cacttgcttcttat

SEQ ID NO: 6697265 - DNA, 18 bp, Homo sapiens
cacttgcttgaagaccca

SEQ ID NO: 6697266 - DNA, 14 bp, Homo sapiens
cacttgcttgctga

SEQ ID NO: 6697267 - DNA, 18 bp, Homo sapiens
cacttggaaataaaccat

SEQ ID NO: 6697268 - DNA, 16 bp, Homo sapiens
cacttggagatctttg

SEQ ID NO: 6697269 - DNA, 18 bp, Homo sapiens
cacttggagatctttgct

SEQ ID NO: 6697270 - DNA, 20 bp, Homo sapiens
cacttggagatctttgcttc

SEQ ID NO: 6697271 - DNA, 12 bp, Homo sapiens
cacttggagcca

SEQ ID NO: 6697272 - DNA, 18 bp, Homo sapiens
cacttggagcccgtgcag

SEQ ID NO: 6697273 - DNA, 22 bp, Homo sapiens
cacttggagtttgcattcttat

SEQ ID NO: 6697274 - DNA, 16 bp, Homo sapiens
cacttggcagccttgt

SEQ ID NO: 6697275 - DNA, 18 bp, Homo sapiens
cacttggcagccttgtga

SEQ ID NO: 6697276 - DNA, 14 bp, Homo sapiens
cacttggcagcgcg

SEQ ID NO: 6697277 - DNA, 20 bp, Homo sapiens
cacttggcatacaaaatatt

SEQ ID NO: 6697278 - DNA, 17 bp, Homo sapiens
cacttggcatcagctgg

SEQ ID NO: 6697279 - DNA, 19 bp, Homo sapiens
cacttggcatcagctggcg

SEQ ID NO: 6697280 - DNA, 18 bp, Homo sapiens
cacttggccaccaggact

SEQ ID NO: 6697281 - DNA, 22 bp, Homo sapiens
cacttggccagttttctgttca

SEQ ID NO: 6697282 - DNA, 21 bp, Homo sapiens
cacttggcccagaaagctgcg

SEQ ID NO: 6697283 - DNA, 12 bp, Homo sapiens
cacttggcctca

SEQ ID NO: 6697284 - DNA, 21 bp, Homo sapiens
cacttggcctcagctggctgt

SEQ ID NO: 6697285 - DNA, 22 bp, Homo sapiens
cacttggcctcagctggctgta

SEQ ID NO: 6697286 - DNA, 11 bp, Homo sapiens
cacttgggagc

SEQ ID NO: 6697287 - DNA, 18 bp, Homo sapiens
cacttgggcccaggaggt

SEQ ID NO: 6697288 - DNA, 22 bp, Homo sapiens
cacttgggctggcacccactgg

SEQ ID NO: 6697289 - DNA, 22 bp, Homo sapiens
cacttggggcaccttgctcctc

SEQ ID NO: 6697290 - DNA, 17 bp, Homo sapiens
cacttgggggctcagca

SEQ ID NO: 6697291 - DNA, 22 bp, Homo sapiens
cacttggggtcaccaccctccc

SEQ ID NO: 6697292 - DNA, 23 bp, Homo sapiens
cacttggggtcaccaccctcccc

SEQ ID NO: 6697293 - DNA, 19 bp, Homo sapiens
cacttgggtccaggcctac

SEQ ID NO: 6697294 - DNA, 22 bp, Homo sapiens
cacttgggtccaggcctactcc

SEQ ID NO: 6697295 - DNA, 14 bp, Homo sapiens
cacttgggtctctg

SEQ ID NO: 6697296 - DNA, 20 bp, Homo sapiens
cacttggtcctacctattat

SEQ ID NO: 6697297 - DNA, 20 bp, Homo sapiens
cacttggtctgtgagatgct

SEQ ID NO: 6697298 - DNA, 16 bp, Homo sapiens
cacttggtgctgcttt

SEQ ID NO: 6697299 - DNA, 17 bp, Homo sapiens
cacttggtgctgctttg

SEQ ID NO: 6697300 - DNA, 17 bp, Homo sapiens
cacttggtgctgggaac

SEQ ID NO: 6697301 - DNA, 19 bp, Homo sapiens
cacttggttagacgccttc

SEQ ID NO: 6697302 - DNA, 19 bp, Homo sapiens
cacttggttgggtcctcac

SEQ ID NO: 6697303 - DNA, 20 bp, Homo sapiens
cacttggttgggtcctcaca

SEQ ID NO: 6697304 - DNA, 18 bp, Homo sapiens
cacttggtttttggctct

SEQ ID NO: 6697305 - DNA, 13 bp, Homo sapiens
cacttgtaaataa

SEQ ID NO: 6697306 - DNA, 15 bp, Homo sapiens
cacttgtaaataaat

SEQ ID NO: 6697307 - DNA, 12 bp, Homo sapiens
cacttgtacaaa

SEQ ID NO: 6697308 - DNA, 19 bp, Homo sapiens
cacttgtacaattaattat

SEQ ID NO: 6697309 - DNA, 14 bp, Homo sapiens
cacttgtagagcag

SEQ ID NO: 6697310 - DNA, 13 bp, Homo sapiens
cacttgtatatac

SEQ ID NO: 6697311 - DNA, 19 bp, Homo sapiens
cacttgtatatatggatca

SEQ ID NO: 6697312 - DNA, 15 bp, Homo sapiens
cacttgtatttaatt

SEQ ID NO: 6697313 - DNA, 23 bp, Homo sapiens
cacttgtcactacaaaaatacaa

SEQ ID NO: 6697314 - DNA, 22 bp, Homo sapiens
cacttgtcaggagtgtgtgtga

SEQ ID NO: 6697315 - DNA, 23 bp, Homo sapiens
cacttgtccagctgagcgccagg

SEQ ID NO: 6697316 - DNA, 20 bp, Homo sapiens
cacttgtcccactatctggg

SEQ ID NO: 6697317 - DNA, 22 bp, Homo sapiens
cacttgtcccactatctgggtg

SEQ ID NO: 6697318 - DNA, 12 bp, Homo sapiens
cacttgtcccca

SEQ ID NO: 6697319 - DNA, 20 bp, Homo sapiens
cacttgtccttagcctggac

SEQ ID NO: 6697320 - DNA, 21 bp, Homo sapiens
cacttgtccttagcctggacc

SEQ ID NO: 6697321 - DNA, 22 bp, Homo sapiens
cacttgtctcctttctgactgt

SEQ ID NO: 6697322 - DNA, 18 bp, Homo sapiens
cacttgtcttgctcttag

SEQ ID NO: 6697323 - DNA, 18 bp, Homo sapiens
cacttgtgacttttgctt

SEQ ID NO: 6697324 - DNA, 20 bp, Homo sapiens
cacttgtgacttttgcttta

SEQ ID NO: 6697325 - DNA, 19 bp, Homo sapiens
cacttgtgattataaaatt

SEQ ID NO: 6697326 - DNA, 17 bp, Homo sapiens
cacttgtgattatttat

SEQ ID NO: 6697327 - DNA, 18 bp, Homo sapiens
cacttgtgccaacactca

SEQ ID NO: 6697328 - DNA, 24 bp, Homo sapiens
cacttgtgccaacactcaagaagc

SEQ ID NO: 6697329 - DNA, 14 bp, Homo sapiens
cacttgtgccagcc

SEQ ID NO: 6697330 - DNA, 18 bp, Homo sapiens
cacttgtgccagcccgga

SEQ ID NO: 6697331 - DNA, 16 bp, Homo sapiens
cacttgtgctttgctc

SEQ ID NO: 6697332 - DNA, 12 bp, Homo sapiens
cacttgtgggct

SEQ ID NO: 6697333 - DNA, 20 bp, Homo sapiens
cacttgtgggcttcaggtgt

SEQ ID NO: 6697334 - DNA, 14 bp, Homo sapiens
cacttgtgggtcct

SEQ ID NO: 6697335 - DNA, 13 bp, Homo sapiens
cacttgtgtgtgg

SEQ ID NO: 6697336 - DNA, 14 bp, Homo sapiens
cacttgtgtgtggg

SEQ ID NO: 6697337 - DNA, 17 bp, Homo sapiens
cacttgtgttgctttct

SEQ ID NO: 6697338 - DNA, 12 bp, Homo sapiens
cacttgtgtttg

SEQ ID NO: 6697339 - DNA, 23 bp, Homo sapiens
cacttgtgtttgtatataaatgg

SEQ ID NO: 6697340 - DNA, 19 bp, Homo sapiens
cacttgtgttttgcaagcc

SEQ ID NO: 6697341 - DNA, 19 bp, Homo sapiens
cacttgttcattctgtgac

SEQ ID NO: 6697342 - DNA, 12 bp, Homo sapiens
cacttgtttgca

SEQ ID NO: 6697343 - DNA, 18 bp, Homo sapiens
cacttgtttgcactgtgt

SEQ ID NO: 6697344 - DNA, 17 bp, Homo sapiens
cacttgttttaaaatgc

SEQ ID NO: 6697345 - DNA, 21 bp, Homo sapiens
cacttgtttttctttttacag

SEQ ID NO: 6697346 - DNA, 19 bp, Homo sapiens
cactttaaaaacaggccag

SEQ ID NO: 6697347 - DNA, 13 bp, Homo sapiens
cactttaaaacac

SEQ ID NO: 6697348 - DNA, 19 bp, Homo sapiens
cactttaaaatatctacat

SEQ ID NO: 6697349 - DNA, 23 bp, Homo sapiens
cactttaaagaggctgtgtggcc

SEQ ID NO: 6697350 - DNA, 22 bp, Homo sapiens
cactttaaagcaattgcataat

SEQ ID NO: 6697351 - DNA, 16 bp, Homo sapiens
cactttaaagtctttc

SEQ ID NO: 6697352 - DNA, 21 bp, Homo sapiens
cactttaaatatgaaagccta

SEQ ID NO: 6697353 - DNA, 15 bp, Homo sapiens
cactttaaccctctc

SEQ ID NO: 6697354 - DNA, 19 bp, Homo sapiens
cactttaaccctctcttcc

SEQ ID NO: 6697355 - DNA, 15 bp, Homo sapiens
cactttaatgataaa

SEQ ID NO: 6697356 - DNA, 19 bp, Homo sapiens
cactttaatggcctggagg

SEQ ID NO: 6697357 - DNA, 20 bp, Homo sapiens
cactttaattaccaacctgt

SEQ ID NO: 6697358 - DNA, 20 bp, Homo sapiens
cactttaattctcatgtgat

SEQ ID NO: 6697359 - DNA, 22 bp, Homo sapiens
cactttaattgaagaactgcac

SEQ ID NO: 6697360 - DNA, 22 bp, Homo sapiens
cactttacacaatagaattata

SEQ ID NO: 6697361 - DNA, 16 bp, Homo sapiens
cactttaccagaggca

SEQ ID NO: 6697362 - DNA, 22 bp, Homo sapiens
cactttacccacctagaacact

SEQ ID NO: 6697363 - DNA, 10 bp, Homo sapiens
cactttagac

SEQ ID NO: 6697364 - DNA, 16 bp, Homo sapiens
cactttagatgctgat

SEQ ID NO: 6697365 - DNA, 18 bp, Homo sapiens
cactttagggctgtaaaa

SEQ ID NO: 6697366 - DNA, 18 bp, Homo sapiens
cactttataagtcattgt

SEQ ID NO: 6697367 - DNA, 20 bp, Homo sapiens
cactttataagtcattgtat

SEQ ID NO: 6697368 - DNA, 22 bp, Homo sapiens
cactttataagtcattgtatgt

SEQ ID NO: 6697369 - DNA, 15 bp, Homo sapiens
cactttattaccttc

SEQ ID NO: 6697370 - DNA, 23 bp, Homo sapiens
cactttattgccttttaattttt

SEQ ID NO: 6697371 - DNA, 18 bp, Homo sapiens
cactttattgtagaaaaa

SEQ ID NO: 6697372 - DNA, 13 bp, Homo sapiens
cactttcaagaat

SEQ ID NO: 6697373 - DNA, 12 bp, Homo sapiens
cactttcacgtg

SEQ ID NO: 6697374 - DNA, 21 bp, Homo sapiens
cactttcagagcccccagccc

SEQ ID NO: 6697375 - DNA, 23 bp, Homo sapiens
cactttcagagcccccagccctg

SEQ ID NO: 6697376 - DNA, 12 bp, Homo sapiens
cactttcagagt

SEQ ID NO: 6697377 - DNA, 14 bp, Homo sapiens
cactttcagctgtc

SEQ ID NO: 6697378 - DNA, 18 bp, Homo sapiens
cactttcagctgtctttt

SEQ ID NO: 6697379 - DNA, 18 bp, Homo sapiens
cactttcagtgaaagcat

SEQ ID NO: 6697380 - DNA, 21 bp, Homo sapiens
cactttcatgcagtgctcttt

SEQ ID NO: 6697381 - DNA, 22 bp, Homo sapiens
cactttcattgccagtgtcttt

SEQ ID NO: 6697382 - DNA, 23 bp, Homo sapiens
cactttcattgccagtgtctttc

SEQ ID NO: 6697383 - DNA, 21 bp, Homo sapiens
cactttccaccaactttttcc

SEQ ID NO: 6697384 - DNA, 22 bp, Homo sapiens
cactttccaccaagtgtctaga

SEQ ID NO: 6697385 - DNA, 14 bp, Homo sapiens
cactttccatctct

SEQ ID NO: 6697386 - DNA, 17 bp, Homo sapiens
cactttccatctctgcc

SEQ ID NO: 6697387 - DNA, 17 bp, Homo sapiens
cactttcccccttcccg

SEQ ID NO: 6697388 - DNA, 22 bp, Homo sapiens
cactttccccgtgggccatggc

SEQ ID NO: 6697389 - DNA, 12 bp, Homo sapiens
cactttccctag

SEQ ID NO: 6697390 - DNA, 20 bp, Homo sapiens
cactttccctagaaagccat

SEQ ID NO: 6697391 - DNA, 15 bp, Homo sapiens
cactttcccttcccc

SEQ ID NO: 6697392 - DNA, 18 bp, Homo sapiens
cactttcccttgtgtcaa

SEQ ID NO: 6697393 - DNA, 13 bp, Homo sapiens
cactttcctcagt

SEQ ID NO: 6697394 - DNA, 12 bp, Homo sapiens
cactttcctctc

SEQ ID NO: 6697395 - DNA, 15 bp, Homo sapiens
cactttcctctctct

SEQ ID NO: 6697396 - DNA, 22 bp, Homo sapiens
cactttcctcttcagatcctgg

SEQ ID NO: 6697397 - DNA, 16 bp, Homo sapiens
cactttcctgagctgt

SEQ ID NO: 6697398 - DNA, 18 bp, Homo sapiens
cactttcctttcaataaa

SEQ ID NO: 6697399 - DNA, 20 bp, Homo sapiens
cactttcctttcaataaagt

SEQ ID NO: 6697400 - DNA, 21 bp, Homo sapiens
cactttcctttcaataaagtt

SEQ ID NO: 6697401 - DNA, 22 bp, Homo sapiens
cactttcctttcaataaagttg

SEQ ID NO: 6697402 - DNA, 22 bp, Homo sapiens
cactttccttttcttgtctctg

SEQ ID NO: 6697403 - DNA, 23 bp, Homo sapiens
cactttcgcctcctccagctcct

SEQ ID NO: 6697404 - DNA, 17 bp, Homo sapiens
cactttctagccagagg

SEQ ID NO: 6697405 - DNA, 19 bp, Homo sapiens
cactttctagccagaggag

SEQ ID NO: 6697406 - DNA, 19 bp, Homo sapiens
cactttctcagttttcata

SEQ ID NO: 6697407 - DNA, 22 bp, Homo sapiens
cactttctcatgatttacagag

SEQ ID NO: 6697408 - DNA, 13 bp, Homo sapiens
cactttctcctgg

SEQ ID NO: 6697409 - DNA, 15 bp, Homo sapiens
cactttctcttcaat

SEQ ID NO: 6697410 - DNA, 17 bp, Homo sapiens
cactttctgtagtaata

SEQ ID NO: 6697411 - DNA, 22 bp, Homo sapiens
cactttcttctagctgagcttt

SEQ ID NO: 6697412 - DNA, 22 bp, Homo sapiens
cactttgaaaatatttctatgt

SEQ ID NO: 6697413 - DNA, 18 bp, Homo sapiens
cactttgaaatacctcat

SEQ ID NO: 6697414 - DNA, 15 bp, Homo sapiens
cactttgaaatgtgt

SEQ ID NO: 6697415 - DNA, 17 bp, Homo sapiens
cactttgaaatgtgttt

SEQ ID NO: 6697416 - DNA, 19 bp, Homo sapiens
cactttgaaatgtgtttct

SEQ ID NO: 6697417 - DNA, 19 bp, Homo sapiens
cactttgaaggtaataaat

SEQ ID NO: 6697418 - DNA, 15 bp, Homo sapiens
cactttgacacccag

SEQ ID NO: 6697419 - DNA, 16 bp, Homo sapiens
cactttgagaaacacc

SEQ ID NO: 6697420 - DNA, 13 bp, Homo sapiens
cactttgagaggg

SEQ ID NO: 6697421 - DNA, 22 bp, Homo sapiens
cactttgagagggctgaaggga

SEQ ID NO: 6697422 - DNA, 21 bp, Homo sapiens
cactttgagatgtgttcctcc

SEQ ID NO: 6697423 - DNA, 22 bp, Homo sapiens
cactttgagatgtgttcctcct

SEQ ID NO: 6697424 - DNA, 23 bp, Homo sapiens
cactttgagatgtgttcctcctg

SEQ ID NO: 6697425 - DNA, 13 bp, Homo sapiens
cactttgatgtca

SEQ ID NO: 6697426 - DNA, 14 bp, Homo sapiens
cactttgcacattt

SEQ ID NO: 6697427 - DNA, 15 bp, Homo sapiens
cactttgcacatttt

SEQ ID NO: 6697428 - DNA, 20 bp, Homo sapiens
cactttgcacgacgccctct

SEQ ID NO: 6697429 - DNA, 14 bp, Homo sapiens
cactttgcagacct

SEQ ID NO: 6697430 - DNA, 17 bp, Homo sapiens
cactttgcagacctggg

SEQ ID NO: 6697431 - DNA, 20 bp, Homo sapiens
cactttgcagacctgggact

SEQ ID NO: 6697432 - DNA, 23 bp, Homo sapiens
cactttgcatatgagccgtgaac

SEQ ID NO: 6697433 - DNA, 21 bp, Homo sapiens
cactttgccaaggctctcccc

SEQ ID NO: 6697434 - DNA, 20 bp, Homo sapiens
cactttgccatttgcttgta

SEQ ID NO: 6697435 - DNA, 14 bp, Homo sapiens
cactttgccttcca

SEQ ID NO: 6697436 - DNA, 19 bp, Homo sapiens
cactttgctctcaattaaa

SEQ ID NO: 6697437 - DNA, 13 bp, Homo sapiens
cactttgctctga

SEQ ID NO: 6697438 - DNA, 12 bp, Homo sapiens
cactttgcttta

SEQ ID NO: 6697439 - DNA, 17 bp, Homo sapiens
cactttgctttaatata

SEQ ID NO: 6697440 - DNA, 19 bp, Homo sapiens
cactttgctttaatataaa

SEQ ID NO: 6697441 - DNA, 20 bp, Homo sapiens
cactttgctttaatataaat

SEQ ID NO: 6697442 - DNA, 16 bp, Homo sapiens
cactttgctttctgaa

SEQ ID NO: 6697443 - DNA, 18 bp, Homo sapiens
cactttgctttctgaatt

SEQ ID NO: 6697444 - DNA, 20 bp, Homo sapiens
cactttggaagtttgtgttc

SEQ ID NO: 6697445 - DNA, 13 bp, Homo sapiens
cactttggagact

SEQ ID NO: 6697446 - DNA, 13 bp, Homo sapiens
cactttggcccag

SEQ ID NO: 6697447 - DNA, 18 bp, Homo sapiens
cactttggcttataattc

SEQ ID NO: 6697448 - DNA, 12 bp, Homo sapiens
cactttggggaa

SEQ ID NO: 6697449 - DNA, 12 bp, Homo sapiens
cactttggggtt

SEQ ID NO: 6697450 - DNA, 19 bp, Homo sapiens
cactttgggtttttaactc

SEQ ID NO: 6697451 - DNA, 18 bp, Homo sapiens
cactttggtaatgtgtca

SEQ ID NO: 6697452 - DNA, 22 bp, Homo sapiens
cactttggtaccagataacttt

SEQ ID NO: 6697453 - DNA, 15 bp, Homo sapiens
cactttgtaaataaa

SEQ ID NO: 6697454 - DNA, 18 bp, Homo sapiens
cactttgtaaataaaaac

SEQ ID NO: 6697455 - DNA, 14 bp, Homo sapiens
cactttgtataaat

SEQ ID NO: 6697456 - DNA, 18 bp, Homo sapiens
cactttgtataaattttt

SEQ ID NO: 6697457 - DNA, 13 bp, Homo sapiens
cactttgtattct

SEQ ID NO: 6697458 - DNA, 14 bp, Homo sapiens
cactttgtattctc

SEQ ID NO: 6697459 - DNA, 20 bp, Homo sapiens
cactttgtcgcccaggctgg

SEQ ID NO: 6697460 - DNA, 14 bp, Homo sapiens
cactttgtctgtac

SEQ ID NO: 6697461 - DNA, 15 bp, Homo sapiens
cactttgttaaaaat

SEQ ID NO: 6697462 - DNA, 13 bp, Homo sapiens
cactttgttctgg

SEQ ID NO: 6697463 - DNA, 21 bp, Homo sapiens
cactttgttgcaagatgtgaa

SEQ ID NO: 6697464 - DNA, 22 bp, Homo sapiens
cactttgttgcaagatgtgaat

SEQ ID NO: 6697465 - DNA, 23 bp, Homo sapiens
cactttgttgcaagatgtgaatt

SEQ ID NO: 6697466 - DNA, 13 bp, Homo sapiens
cactttgtttaga

SEQ ID NO: 6697467 - DNA, 17 bp, Homo sapiens
cactttgtttagaaaaa

SEQ ID NO: 6697468 - DNA, 18 bp, Homo sapiens
cactttgtttagaaaaaa

SEQ ID NO: 6697469 - DNA, 19 bp, Homo sapiens
cactttgtttagaaaaaaa

SEQ ID NO: 6697470 - DNA, 20 bp, Homo sapiens
cactttgtttcgtggggagg

SEQ ID NO: 6697471 - DNA, 19 bp, Homo sapiens
cacttttaaaaaaattttt

SEQ ID NO: 6697472 - DNA, 14 bp, Homo sapiens
cacttttaaaaaac

SEQ ID NO: 6697473 - DNA, 19 bp, Homo sapiens
cacttttaaaaaacaaaaa

SEQ ID NO: 6697474 - DNA, 23 bp, Homo sapiens
cacttttaaaaaacaaaaaaaga

SEQ ID NO: 6697475 - DNA, 17 bp, Homo sapiens
cacttttagaaatgcat

SEQ ID NO: 6697476 - DNA, 14 bp, Homo sapiens
cacttttagccaga

SEQ ID NO: 6697477 - DNA, 16 bp, Homo sapiens
cacttttatgagcttc

SEQ ID NO: 6697478 - DNA, 13 bp, Homo sapiens
cacttttatttat

SEQ ID NO: 6697479 - DNA, 14 bp, Homo sapiens
cacttttatttcct

SEQ ID NO: 6697480 - DNA, 14 bp, Homo sapiens
cacttttattttca

SEQ ID NO: 6697481 - DNA, 18 bp, Homo sapiens
cacttttcaaaagaagac

SEQ ID NO: 6697482 - DNA, 18 bp, Homo sapiens
cacttttcacctccttca

SEQ ID NO: 6697483 - DNA, 21 bp, Homo sapiens
cacttttcacttgtcttgctc

SEQ ID NO: 6697484 - DNA, 13 bp, Homo sapiens
cacttttcagtga

SEQ ID NO: 6697485 - DNA, 18 bp, Homo sapiens
cacttttcatatcatttc

SEQ ID NO: 6697486 - DNA, 14 bp, Homo sapiens
cacttttcatcctt

SEQ ID NO: 6697487 - DNA, 19 bp, Homo sapiens
cacttttcatccttcccca

SEQ ID NO: 6697488 - DNA, 19 bp, Homo sapiens
cacttttccacattccagt

SEQ ID NO: 6697489 - DNA, 14 bp, Homo sapiens
cacttttcccactc

SEQ ID NO: 6697490 - DNA, 22 bp, Homo sapiens
cacttttctttattgctgtgaa

SEQ ID NO: 6697491 - DNA, 12 bp, Homo sapiens
cacttttgaaaa

SEQ ID NO: 6697492 - DNA, 16 bp, Homo sapiens
cacttttgaactcacg

SEQ ID NO: 6697493 - DNA, 21 bp, Homo sapiens
cacttttgaactcacgagcct

SEQ ID NO: 6697494 - DNA, 19 bp, Homo sapiens
cacttttgatgaaataaaa

SEQ ID NO: 6697495 - DNA, 20 bp, Homo sapiens
cacttttgatgtttgaagtt

SEQ ID NO: 6697496 - DNA, 12 bp, Homo sapiens
cacttttgcaag

SEQ ID NO: 6697497 - DNA, 19 bp, Homo sapiens
cacttttgcacatatattt

SEQ ID NO: 6697498 - DNA, 13 bp, Homo sapiens
cacttttgggagg

SEQ ID NO: 6697499 - DNA, 14 bp, Homo sapiens
cacttttgggcctt

SEQ ID NO: 6697500 - DNA, 14 bp, Homo sapiens
cacttttgtgaaag

SEQ ID NO: 6697501 - DNA, 20 bp, Homo sapiens
cacttttgttattccatcaa

SEQ ID NO: 6697502 - DNA, 19 bp, Homo sapiens
cacttttgttctactcctt

SEQ ID NO: 6697503 - DNA, 15 bp, Homo sapiens
cacttttgttctgct

SEQ ID NO: 6697504 - DNA, 19 bp, Homo sapiens
cacttttgttctgctttat

SEQ ID NO: 6697505 - DNA, 14 bp, Homo sapiens
cacttttgttcttg

SEQ ID NO: 6697506 - DNA, 18 bp, Homo sapiens
cactttttaacattctca

SEQ ID NO: 6697507 - DNA, 16 bp, Homo sapiens
cactttttacagcagc

SEQ ID NO: 6697508 - DNA, 14 bp, Homo sapiens
cactttttatgcta

SEQ ID NO: 6697509 - DNA, 19 bp, Homo sapiens
cactttttcacataagcca

SEQ ID NO: 6697510 - DNA, 20 bp, Homo sapiens
cactttttcatttgcctatt

SEQ ID NO: 6697511 - DNA, 20 bp, Homo sapiens
cactttttccagaatttgaa

SEQ ID NO: 6697512 - DNA, 17 bp, Homo sapiens
cactttttcccctgcaa

SEQ ID NO: 6697513 - DNA, 16 bp, Homo sapiens
cactttttcgtgtgga

SEQ ID NO: 6697514 - DNA, 14 bp, Homo sapiens
cactttttgaggca

SEQ ID NO: 6697515 - DNA, 20 bp, Homo sapiens
cactttttgaggcaaaagaa

SEQ ID NO: 6697516 - DNA, 18 bp, Homo sapiens
cactttttgcagctttct

SEQ ID NO: 6697517 - DNA, 21 bp, Homo sapiens
cactttttgtattttttcctt

SEQ ID NO: 6697518 - DNA, 14 bp, Homo sapiens
cactttttgtgaat

SEQ ID NO: 6697519 - DNA, 16 bp, Homo sapiens
cactttttgttacata

SEQ ID NO: 6697520 - DNA, 16 bp, Homo sapiens
cacttttttcctgtca

SEQ ID NO: 6697521 - DNA, 22 bp, Homo sapiens
cacttttttcctgtcaatatat

SEQ ID NO: 6697522 - DNA, 17 bp, Homo sapiens
cacttttttctgccttg

SEQ ID NO: 6697523 - DNA, 23 bp, Homo sapiens
cacttttttttttaatctccacc

SEQ ID NO: 6697524 - DNA, 20 bp, Homo sapiens
cactttttttttttctgcct

SEQ ID NO: 6697525 - DNA, 22 bp, Homo sapiens
cactttttttttttctgcctga

SEQ ID NO: 6697526 - DNA, 22 bp, Homo sapiens
cacttttttttttttttttgtt

SEQ ID NO: 6697527 - DNA, 14 bp, Homo sapiens
cagaaaaaaaagaa

SEQ ID NO: 6697528 - DNA, 21 bp, Homo sapiens
cagaaaaaaagagtgaaaaag

SEQ ID NO: 6697529 - DNA, 14 bp, Homo sapiens
cagaaaaaaataaa

SEQ ID NO: 6697530 - DNA, 18 bp, Homo sapiens
cagaaaaaaataactatt

SEQ ID NO: 6697531 - DNA, 14 bp, Homo sapiens
cagaaaaaaggact

SEQ ID NO: 6697532 - DNA, 15 bp, Homo sapiens
cagaaaaaaggactg

SEQ ID NO: 6697533 - DNA, 16 bp, Homo sapiens
cagaaaaaataaatgt

SEQ ID NO: 6697534 - DNA, 13 bp, Homo sapiens
cagaaaaacaaaa

SEQ ID NO: 6697535 - DNA, 14 bp, Homo sapiens
cagaaaaacaataa

SEQ ID NO: 6697536 - DNA, 15 bp, Homo sapiens
cagaaaaacaatctt

SEQ ID NO: 6697537 - DNA, 14 bp, Homo sapiens
cagaaaaacaggca

SEQ ID NO: 6697538 - DNA, 20 bp, Homo sapiens
cagaaaaacaggcacaggct

SEQ ID NO: 6697539 - DNA, 22 bp, Homo sapiens
cagaaaaaccaacatctacaaa

SEQ ID NO: 6697540 - DNA, 15 bp, Homo sapiens
cagaaaaaccttggg

SEQ ID NO: 6697541 - DNA, 16 bp, Homo sapiens
cagaaaaactctggga

SEQ ID NO: 6697542 - DNA, 16 bp, Homo sapiens
cagaaaaactggctct

SEQ ID NO: 6697543 - DNA, 21 bp, Homo sapiens
cagaaaaataaatgtcactgc

SEQ ID NO: 6697544 - DNA, 13 bp, Homo sapiens
cagaaaaataagt

SEQ ID NO: 6697545 - DNA, 17 bp, Homo sapiens
cagaaaaataagtcaaa

SEQ ID NO: 6697546 - DNA, 16 bp, Homo sapiens
cagaaaaatatatatt

SEQ ID NO: 6697547 - DNA, 18 bp, Homo sapiens
cagaaaaatatgtaccaa

SEQ ID NO: 6697548 - DNA, 18 bp, Homo sapiens
cagaaaaatcaatcattt

SEQ ID NO: 6697549 - DNA, 21 bp, Homo sapiens
cagaaaaatcaatcattttct

SEQ ID NO: 6697550 - DNA, 13 bp, Homo sapiens
cagaaaaatggag

SEQ ID NO: 6697551 - DNA, 18 bp, Homo sapiens
cagaaaaatggagcaaag

SEQ ID NO: 6697552 - DNA, 13 bp, Homo sapiens
cagaaaaattaaa

SEQ ID NO: 6697553 - DNA, 13 bp, Homo sapiens
cagaaaaattaat

SEQ ID NO: 6697554 - DNA, 14 bp, Homo sapiens
cagaaaacaaaact

SEQ ID NO: 6697555 - DNA, 15 bp, Homo sapiens
cagaaaacaaaactg

SEQ ID NO: 6697556 - DNA, 14 bp, Homo sapiens
cagaaaacaaatct

SEQ ID NO: 6697557 - DNA, 17 bp, Homo sapiens
cagaaaacaaatcttca

SEQ ID NO: 6697558 - DNA, 23 bp, Homo sapiens
cagaaaacaaatcttcaaggtgt

SEQ ID NO: 6697559 - DNA, 11 bp, Homo sapiens
cagaaaacaac

SEQ ID NO: 6697560 - DNA, 19 bp, Homo sapiens
cagaaaacaacaaaaaata

SEQ ID NO: 6697561 - DNA, 20 bp, Homo sapiens
cagaaaacaacaaaaaataa

SEQ ID NO: 6697562 - DNA, 22 bp, Homo sapiens
cagaaaacaacttggcatttct

SEQ ID NO: 6697563 - DNA, 13 bp, Homo sapiens
cagaaaacagaaa

SEQ ID NO: 6697564 - DNA, 13 bp, Homo sapiens
cagaaaacagaga

SEQ ID NO: 6697565 - DNA, 18 bp, Homo sapiens
cagaaaacagagcctgcc

SEQ ID NO: 6697566 - DNA, 20 bp, Homo sapiens
cagaaaacagagcctgccta

SEQ ID NO: 6697567 - DNA, 20 bp, Homo sapiens
cagaaaacataatatagctt

SEQ ID NO: 6697568 - DNA, 16 bp, Homo sapiens
cagaaaacatgtttcc

SEQ ID NO: 6697569 - DNA, 11 bp, Homo sapiens
cagaaaacatt

SEQ ID NO: 6697570 - DNA, 19 bp, Homo sapiens
cagaaaacccttgggccag

SEQ ID NO: 6697571 - DNA, 20 bp, Homo sapiens
cagaaaacccttgggccaga

SEQ ID NO: 6697572 - DNA, 23 bp, Homo sapiens
cagaaaacccttgggccagaagt

SEQ ID NO: 6697573 - DNA, 15 bp, Homo sapiens
cagaaaacctcaagg

SEQ ID NO: 6697574 - DNA, 13 bp, Homo sapiens
cagaaaacctcca

SEQ ID NO: 6697575 - DNA, 18 bp, Homo sapiens
cagaaaactagaatttca

SEQ ID NO: 6697576 - DNA, 15 bp, Homo sapiens
cagaaaactttaaaa

SEQ ID NO: 6697577 - DNA, 20 bp, Homo sapiens
cagaaaactttaaaaaatat

SEQ ID NO: 6697578 - DNA, 14 bp, Homo sapiens
cagaaaagaaaacc

SEQ ID NO: 6697579 - DNA, 23 bp, Homo sapiens
cagaaaagaaagctacagaagaa

SEQ ID NO: 6697580 - DNA, 12 bp, Homo sapiens
cagaaaagacac

SEQ ID NO: 6697581 - DNA, 12 bp, Homo sapiens
cagaaaagcata

SEQ ID NO: 6697582 - DNA, 19 bp, Homo sapiens
cagaaaagcataacaccaa

SEQ ID NO: 6697583 - DNA, 20 bp, Homo sapiens
cagaaaagcataacaccaat

SEQ ID NO: 6697584 - DNA, 13 bp, Homo sapiens
cagaaaaggacag

SEQ ID NO: 6697585 - DNA, 14 bp, Homo sapiens
cagaaaaggcagcc

SEQ ID NO: 6697586 - DNA, 15 bp, Homo sapiens
cagaaaagtagaatt

SEQ ID NO: 6697587 - DNA, 20 bp, Homo sapiens
cagaaaagtagaattatatc

SEQ ID NO: 6697588 - DNA, 22 bp, Homo sapiens
cagaaaagtagaattatatcta

SEQ ID NO: 6697589 - DNA, 15 bp, Homo sapiens
cagaaaagtaggaat

SEQ ID NO: 6697590 - DNA, 18 bp, Homo sapiens
cagaaaagtgcttagaaa

SEQ ID NO: 6697591 - DNA, 23 bp, Homo sapiens
cagaaaagtgcttagaaagttat

SEQ ID NO: 6697592 - DNA, 17 bp, Homo sapiens
cagaaaagttgaatttt

SEQ ID NO: 6697593 - DNA, 12 bp, Homo sapiens
cagaaaataagg

SEQ ID NO: 6697594 - DNA, 21 bp, Homo sapiens
cagaaaataaggcacccatct

SEQ ID NO: 6697595 - DNA, 11 bp, Homo sapiens
cagaaaatata

SEQ ID NO: 6697596 - DNA, 14 bp, Homo sapiens
cagaaaatataaat

SEQ ID NO: 6697597 - DNA, 15 bp, Homo sapiens
cagaaaatataaatg

SEQ ID NO: 6697598 - DNA, 16 bp, Homo sapiens
cagaaaatataaatgc

SEQ ID NO: 6697599 - DNA, 15 bp, Homo sapiens
cagaaaatatactgt

SEQ ID NO: 6697600 - DNA, 20 bp, Homo sapiens
cagaaaatatactgtaaaga

SEQ ID NO: 6697601 - DNA, 20 bp, Homo sapiens
cagaaaatggaagacagctc

SEQ ID NO: 6697602 - DNA, 19 bp, Homo sapiens
cagaaaatgtgtcagcatg

SEQ ID NO: 6697603 - DNA, 23 bp, Homo sapiens
cagaaaatgttgagaatcccaaa

SEQ ID NO: 6697604 - DNA, 16 bp, Homo sapiens
cagaaaattagccggg

SEQ ID NO: 6697605 - DNA, 16 bp, Homo sapiens
cagaaaattgcacaat

SEQ ID NO: 6697606 - DNA, 19 bp, Homo sapiens
cagaaaattggcagtggca

SEQ ID NO: 6697607 - DNA, 22 bp, Homo sapiens
cagaaaattggcagtggcagag

SEQ ID NO: 6697608 - DNA, 23 bp, Homo sapiens
cagaaaattggcagtggcagaga

SEQ ID NO: 6697609 - DNA, 20 bp, Homo sapiens
cagaaaatttgcaacatata

SEQ ID NO: 6697610 - DNA, 17 bp, Homo sapiens
cagaaacaaaaagcccc

SEQ ID NO: 6697611 - DNA, 16 bp, Homo sapiens
cagaaacaacagggga

SEQ ID NO: 6697612 - DNA, 15 bp, Homo sapiens
cagaaacaactgcca

SEQ ID NO: 6697613 - DNA, 20 bp, Homo sapiens
cagaaacaactgccaaataa

SEQ ID NO: 6697614 - DNA, 17 bp, Homo sapiens
cagaaacaatgtgtcta

SEQ ID NO: 6697615 - DNA, 15 bp, Homo sapiens
cagaaacacccacag

SEQ ID NO: 6697616 - DNA, 17 bp, Homo sapiens
cagaaacacccacaggc

SEQ ID NO: 6697617 - DNA, 16 bp, Homo sapiens
cagaaacacccctctg

SEQ ID NO: 6697618 - DNA, 18 bp, Homo sapiens
cagaaacaccctcacact

SEQ ID NO: 6697619 - DNA, 14 bp, Homo sapiens
cagaaacactgcct

SEQ ID NO: 6697620 - DNA, 15 bp, Homo sapiens
cagaaacactgcctt

SEQ ID NO: 6697621 - DNA, 19 bp, Homo sapiens
cagaaacactgccttttta

SEQ ID NO: 6697622 - DNA, 21 bp, Homo sapiens
cagaaacactgcctttttatt

SEQ ID NO: 6697623 - DNA, 16 bp, Homo sapiens
cagaaacagagagaga

SEQ ID NO: 6697624 - DNA, 14 bp, Homo sapiens
cagaaacagccatt

SEQ ID NO: 6697625 - DNA, 18 bp, Homo sapiens
cagaaacagccattgcgg

SEQ ID NO: 6697626 - DNA, 16 bp, Homo sapiens
cagaaacagctgcttc

SEQ ID NO: 6697627 - DNA, 18 bp, Homo sapiens
cagaaacagctgcttctc

SEQ ID NO: 6697628 - DNA, 14 bp, Homo sapiens
cagaaacagggaca

SEQ ID NO: 6697629 - DNA, 19 bp, Homo sapiens
cagaaacagggacaaagaa

SEQ ID NO: 6697630 - DNA, 21 bp, Homo sapiens
cagaaacagggacaaagaaat

SEQ ID NO: 6697631 - DNA, 22 bp, Homo sapiens
cagaaacagggcagcagtgggg

SEQ ID NO: 6697632 - DNA, 23 bp, Homo sapiens
cagaaacagggggaaaatgtttg

SEQ ID NO: 6697633 - DNA, 21 bp, Homo sapiens
cagaaacagtacttaggtaat

SEQ ID NO: 6697634 - DNA, 15 bp, Homo sapiens
cagaaacagtgggag

SEQ ID NO: 6697635 - DNA, 12 bp, Homo sapiens
cagaaacatctc

SEQ ID NO: 6697636 - DNA, 15 bp, Homo sapiens
cagaaacatgtcttg

SEQ ID NO: 6697637 - DNA, 18 bp, Homo sapiens
cagaaaccaacaagaacc

SEQ ID NO: 6697638 - DNA, 16 bp, Homo sapiens
cagaaaccaagagaca

SEQ ID NO: 6697639 - DNA, 15 bp, Homo sapiens
cagaaaccaagccat

SEQ ID NO: 6697640 - DNA, 15 bp, Homo sapiens
cagaaaccagttatg

SEQ ID NO: 6697641 - DNA, 15 bp, Homo sapiens
cagaaacccccagga

SEQ ID NO: 6697642 - DNA, 22 bp, Homo sapiens
cagaaacccggcttcctgtgct

SEQ ID NO: 6697643 - DNA, 22 bp, Homo sapiens
cagaaaccctcattgtgtttct

SEQ ID NO: 6697644 - DNA, 21 bp, Homo sapiens
cagaaacctatcctcactgcc

SEQ ID NO: 6697645 - DNA, 19 bp, Homo sapiens
cagaaacctatctcaggga

SEQ ID NO: 6697646 - DNA, 16 bp, Homo sapiens
cagaaaccttccagag

SEQ ID NO: 6697647 - DNA, 14 bp, Homo sapiens
cagaaaccttgttt

SEQ ID NO: 6697648 - DNA, 19 bp, Homo sapiens
cagaaaccttgtttgtttt

SEQ ID NO: 6697649 - DNA, 20 bp, Homo sapiens
cagaaacgaagtagaaaggg

SEQ ID NO: 6697650 - DNA, 20 bp, Homo sapiens
cagaaacggtctttatgaat

SEQ ID NO: 6697651 - DNA, 20 bp, Homo sapiens
cagaaacgtgttaaaggttt

SEQ ID NO: 6697652 - DNA, 18 bp, Homo sapiens
cagaaactacattgtaac

SEQ ID NO: 6697653 - DNA, 17 bp, Homo sapiens
cagaaactccttttgct

SEQ ID NO: 6697654 - DNA, 23 bp, Homo sapiens
cagaaactccttttgctgtcttt

SEQ ID NO: 6697655 - DNA, 14 bp, Homo sapiens
cagaaacttctcag

SEQ ID NO: 6697656 - DNA, 20 bp, Homo sapiens
cagaaacttgtgaagtggaa

SEQ ID NO: 6697657 - DNA, 18 bp, Homo sapiens
cagaaagaagcagttctc

SEQ ID NO: 6697658 - DNA, 21 bp, Homo sapiens
cagaaagaagcagttctcaca

SEQ ID NO: 6697659 - DNA, 22 bp, Homo sapiens
cagaaagaattgatcagaatcc

SEQ ID NO: 6697660 - DNA, 14 bp, Homo sapiens
cagaaagaccctga

SEQ ID NO: 6697661 - DNA, 17 bp, Homo sapiens
cagaaagaccctgatgc

SEQ ID NO: 6697662 - DNA, 18 bp, Homo sapiens
cagaaagaccctgatgca

SEQ ID NO: 6697663 - DNA, 21 bp, Homo sapiens
cagaaagaccctgatgcaggt

SEQ ID NO: 6697664 - DNA, 13 bp, Homo sapiens
cagaaagagggac

SEQ ID NO: 6697665 - DNA, 21 bp, Homo sapiens
cagaaagatttgatgggccac

SEQ ID NO: 6697666 - DNA, 16 bp, Homo sapiens
cagaaagcaacagtta

SEQ ID NO: 6697667 - DNA, 16 bp, Homo sapiens
cagaaagcaaggactg

SEQ ID NO: 6697668 - DNA, 19 bp, Homo sapiens
cagaaagcactacaatcat

SEQ ID NO: 6697669 - DNA, 21 bp, Homo sapiens
cagaaagcactacaatcatgg

SEQ ID NO: 6697670 - DNA, 20 bp, Homo sapiens
cagaaagcagaggctggcct

SEQ ID NO: 6697671 - DNA, 23 bp, Homo sapiens
cagaaagcagttctgatgcttac

SEQ ID NO: 6697672 - DNA, 22 bp, Homo sapiens
cagaaagcagttgagacaagaa

SEQ ID NO: 6697673 - DNA, 23 bp, Homo sapiens
cagaaagccaggagcagccctgg

SEQ ID NO: 6697674 - DNA, 21 bp, Homo sapiens
cagaaagccccacccaggcca

SEQ ID NO: 6697675 - DNA, 22 bp, Homo sapiens
cagaaagcctatcaaagacctt

SEQ ID NO: 6697676 - DNA, 11 bp, Homo sapiens
cagaaagcctc

SEQ ID NO: 6697677 - DNA, 17 bp, Homo sapiens
cagaaagcctcctgccc

SEQ ID NO: 6697678 - DNA, 21 bp, Homo sapiens
cagaaagcctcctgccccctg

SEQ ID NO: 6697679 - DNA, 13 bp, Homo sapiens
cagaaagccttcc

SEQ ID NO: 6697680 - DNA, 15 bp, Homo sapiens
cagaaagctgcctgg

SEQ ID NO: 6697681 - DNA, 15 bp, Homo sapiens
cagaaagctgcggat

SEQ ID NO: 6697682 - DNA, 21 bp, Homo sapiens
cagaaagcttcatccacagcc

SEQ ID NO: 6697683 - DNA, 18 bp, Homo sapiens
cagaaaggaaaacctgaa

SEQ ID NO: 6697684 - DNA, 20 bp, Homo sapiens
cagaaaggaaaacctgaaga

SEQ ID NO: 6697685 - DNA, 12 bp, Homo sapiens
cagaaaggagac

SEQ ID NO: 6697686 - DNA, 13 bp, Homo sapiens
cagaaaggagaga

SEQ ID NO: 6697687 - DNA, 13 bp, Homo sapiens
cagaaaggagagt

SEQ ID NO: 6697688 - DNA, 23 bp, Homo sapiens
cagaaaggcaggtttcatttctt

SEQ ID NO: 6697689 - DNA, 15 bp, Homo sapiens
cagaaagggagggct

SEQ ID NO: 6697690 - DNA, 18 bp, Homo sapiens
cagaaagggagggctctg

SEQ ID NO: 6697691 - DNA, 19 bp, Homo sapiens
cagaaagggagggctctga

SEQ ID NO: 6697692 - DNA, 20 bp, Homo sapiens
cagaaagggagggctctgag

SEQ ID NO: 6697693 - DNA, 22 bp, Homo sapiens
cagaaagggagggctctgaggc

SEQ ID NO: 6697694 - DNA, 15 bp, Homo sapiens
cagaaagggccaccc

SEQ ID NO: 6697695 - DNA, 20 bp, Homo sapiens
cagaaaggggcattttgtac

SEQ ID NO: 6697696 - DNA, 19 bp, Homo sapiens
cagaaaggtgtgaggagag

SEQ ID NO: 6697697 - DNA, 23 bp, Homo sapiens
cagaaaggtgtgaggagagagga

SEQ ID NO: 6697698 - DNA, 17 bp, Homo sapiens
cagaaaggttctgcccg

SEQ ID NO: 6697699 - DNA, 20 bp, Homo sapiens
cagaaaggttgaggggctcc

SEQ ID NO: 6697700 - DNA, 18 bp, Homo sapiens
cagaaagtaatttcttct

SEQ ID NO: 6697701 - DNA, 15 bp, Homo sapiens
cagaaagtcaccagg

SEQ ID NO: 6697702 - DNA, 22 bp, Homo sapiens
cagaaagtgataagtgcaggga

SEQ ID NO: 6697703 - DNA, 12 bp, Homo sapiens
cagaaagtgcct

SEQ ID NO: 6697704 - DNA, 22 bp, Homo sapiens
cagaaagtggccatgccaccct

SEQ ID NO: 6697705 - DNA, 17 bp, Homo sapiens
cagaaagtgggggtgga

SEQ ID NO: 6697706 - DNA, 20 bp, Homo sapiens
cagaaagtgggggtggagga

SEQ ID NO: 6697707 - DNA, 18 bp, Homo sapiens
cagaaagtggtgctcagt

SEQ ID NO: 6697708 - DNA, 21 bp, Homo sapiens
cagaaagtggtgctcagttgt

SEQ ID NO: 6697709 - DNA, 22 bp, Homo sapiens
cagaaagtggtgctcagttgta

SEQ ID NO: 6697710 - DNA, 17 bp, Homo sapiens
cagaaagtgtgctttat

SEQ ID NO: 6697711 - DNA, 23 bp, Homo sapiens
cagaaagtgtgctttatgctgaa

SEQ ID NO: 6697712 - DNA, 16 bp, Homo sapiens
cagaaagttattgata

SEQ ID NO: 6697713 - DNA, 21 bp, Homo sapiens
cagaaagtttgtaaaaatata

SEQ ID NO: 6697714 - DNA, 15 bp, Homo sapiens
cagaaataaaagtat

SEQ ID NO: 6697715 - DNA, 22 bp, Homo sapiens
cagaaataaaatgaaatgtctt

SEQ ID NO: 6697716 - DNA, 17 bp, Homo sapiens
cagaaataacagctggg

SEQ ID NO: 6697717 - DNA, 20 bp, Homo sapiens
cagaaataatctgacactac

SEQ ID NO: 6697718 - DNA, 15 bp, Homo sapiens
cagaaatacaaaaaa

SEQ ID NO: 6697719 - DNA, 14 bp, Homo sapiens
cagaaatacaattt

SEQ ID NO: 6697720 - DNA, 11 bp, Homo sapiens
cagaaatacag

SEQ ID NO: 6697721 - DNA, 15 bp, Homo sapiens
cagaaatacagattt

SEQ ID NO: 6697722 - DNA, 23 bp, Homo sapiens
cagaaatacagattttgatagca

SEQ ID NO: 6697723 - DNA, 23 bp, Homo sapiens
cagaaataccaaaattatttcag

SEQ ID NO: 6697724 - DNA, 21 bp, Homo sapiens
cagaaatagacaaaaagtata

SEQ ID NO: 6697725 - DNA, 15 bp, Homo sapiens
cagaaatatataaaa

SEQ ID NO: 6697726 - DNA, 13 bp, Homo sapiens
cagaaatatatat

SEQ ID NO: 6697727 - DNA, 18 bp, Homo sapiens
cagaaatatatatacata

SEQ ID NO: 6697728 - DNA, 17 bp, Homo sapiens
cagaaatatattatgaa

SEQ ID NO: 6697729 - DNA, 18 bp, Homo sapiens
cagaaatatattatgaaa

SEQ ID NO: 6697730 - DNA, 19 bp, Homo sapiens
cagaaatattcttattact

SEQ ID NO: 6697731 - DNA, 23 bp, Homo sapiens
cagaaatcacaattttcctgtgg

SEQ ID NO: 6697732 - DNA, 22 bp, Homo sapiens
cagaaatcacagtcaatggatc

SEQ ID NO: 6697733 - DNA, 16 bp, Homo sapiens
cagaaatcacgttgct

SEQ ID NO: 6697734 - DNA, 11 bp, Homo sapiens
cagaaatcact

SEQ ID NO: 6697735 - DNA, 18 bp, Homo sapiens
cagaaatcactgtgaaat

SEQ ID NO: 6697736 - DNA, 20 bp, Homo sapiens
cagaaatcagtaatatttat

SEQ ID NO: 6697737 - DNA, 15 bp, Homo sapiens
cagaaatcccagttc

SEQ ID NO: 6697738 - DNA, 17 bp, Homo sapiens
cagaaatcccagttcat

SEQ ID NO: 6697739 - DNA, 17 bp, Homo sapiens
cagaaatccttgtattt

SEQ ID NO: 6697740 - DNA, 19 bp, Homo sapiens
cagaaatctagaagactgt

SEQ ID NO: 6697741 - DNA, 23 bp, Homo sapiens
cagaaatctctcacccagttcag

SEQ ID NO: 6697742 - DNA, 23 bp, Homo sapiens
cagaaatgagatcaggctctgcc

SEQ ID NO: 6697743 - DNA, 14 bp, Homo sapiens
cagaaatgccccca

SEQ ID NO: 6697744 - DNA, 22 bp, Homo sapiens
cagaaatgcccccattctccca

SEQ ID NO: 6697745 - DNA, 14 bp, Homo sapiens
cagaaatgctgcct

SEQ ID NO: 6697746 - DNA, 17 bp, Homo sapiens
cagaaatgctgctggcc

SEQ ID NO: 6697747 - DNA, 13 bp, Homo sapiens
cagaaatgggcag

SEQ ID NO: 6697748 - DNA, 17 bp, Homo sapiens
cagaaatgggcagttct

SEQ ID NO: 6697749 - DNA, 21 bp, Homo sapiens
cagaaatgggcagttctccca

SEQ ID NO: 6697750 - DNA, 21 bp, Homo sapiens
cagaaatggggaattctctaa

SEQ ID NO: 6697751 - DNA, 23 bp, Homo sapiens
cagaaatggtgagatgtatgttt

SEQ ID NO: 6697752 - DNA, 16 bp, Homo sapiens
cagaaatgtacagcaa

SEQ ID NO: 6697753 - DNA, 23 bp, Homo sapiens
cagaaatgtcatgagattgctgt

SEQ ID NO: 6697754 - DNA, 14 bp, Homo sapiens
cagaaatgtctaaa

SEQ ID NO: 6697755 - DNA, 19 bp, Homo sapiens
cagaaatgtggatgctctt

SEQ ID NO: 6697756 - DNA, 22 bp, Homo sapiens
cagaaatgttgagtctgtacta

SEQ ID NO: 6697757 - DNA, 17 bp, Homo sapiens
cagaaatgtttctgtgt

SEQ ID NO: 6697758 - DNA, 17 bp, Homo sapiens
cagaaatgtttttaaca

SEQ ID NO: 6697759 - DNA, 13 bp, Homo sapiens
cagaaattaaaat

SEQ ID NO: 6697760 - DNA, 17 bp, Homo sapiens
cagaaattaaaatatta

SEQ ID NO: 6697761 - DNA, 23 bp, Homo sapiens
cagaaattagaaaccttaatatg

SEQ ID NO: 6697762 - DNA, 17 bp, Homo sapiens
cagaaattattttctat

SEQ ID NO: 6697763 - DNA, 16 bp, Homo sapiens
cagaaattcaatttgg

SEQ ID NO: 6697764 - DNA, 14 bp, Homo sapiens
cagaaattccagta

SEQ ID NO: 6697765 - DNA, 18 bp, Homo sapiens
cagaaattccagtaaatc

SEQ ID NO: 6697766 - DNA, 16 bp, Homo sapiens
cagaaattccttccca

SEQ ID NO: 6697767 - DNA, 17 bp, Homo sapiens
cagaaattctcaaaata

SEQ ID NO: 6697768 - DNA, 14 bp, Homo sapiens
cagaaattcttcaa

SEQ ID NO: 6697769 - DNA, 15 bp, Homo sapiens
cagaaattcttcaat

SEQ ID NO: 6697770 - DNA, 21 bp, Homo sapiens
cagaaattcttcaatttgaaa

SEQ ID NO: 6697771 - DNA, 23 bp, Homo sapiens
cagaaattgcataattttctaat

SEQ ID NO: 6697772 - DNA, 11 bp, Homo sapiens
cagaaattggt

SEQ ID NO: 6697773 - DNA, 15 bp, Homo sapiens
cagaaattggtacct

SEQ ID NO: 6697774 - DNA, 17 bp, Homo sapiens
cagaaattggtaccttg

SEQ ID NO: 6697775 - DNA, 23 bp, Homo sapiens
cagaaattggtaccttgcacaca

SEQ ID NO: 6697776 - DNA, 18 bp, Homo sapiens
cagaaattgtatattgta

SEQ ID NO: 6697777 - DNA, 21 bp, Homo sapiens
cagaaattgtatattgtaatt

SEQ ID NO: 6697778 - DNA, 15 bp, Homo sapiens
cagaaatttaaaagc

SEQ ID NO: 6697779 - DNA, 22 bp, Homo sapiens
cagaaatttaattcatgtttct

SEQ ID NO: 6697780 - DNA, 23 bp, Homo sapiens
cagaaatttaattcatgtttctt

SEQ ID NO: 6697781 - DNA, 15 bp, Homo sapiens
cagaaattttctaca

SEQ ID NO: 6697782 - DNA, 22 bp, Homo sapiens
cagaaattttctacagtacatg

SEQ ID NO: 6697783 - DNA, 15 bp, Homo sapiens
cagaaatttttattt

SEQ ID NO: 6697784 - DNA, 18 bp, Homo sapiens
cagaaatttttatttttc

SEQ ID NO: 6697785 - DNA, 13 bp, Homo sapiens
cagaacaaaactt

SEQ ID NO: 6697786 - DNA, 16 bp, Homo sapiens
cagaacaaaacttcta

SEQ ID NO: 6697787 - DNA, 14 bp, Homo sapiens
cagaacaaatgaag

SEQ ID NO: 6697788 - DNA, 12 bp, Homo sapiens
cagaacaaattg

SEQ ID NO: 6697789 - DNA, 20 bp, Homo sapiens
cagaacaacttgctacttat

SEQ ID NO: 6697790 - DNA, 16 bp, Homo sapiens
cagaacaattctgcag

SEQ ID NO: 6697791 - DNA, 18 bp, Homo sapiens
cagaacaattctgcagag

SEQ ID NO: 6697792 - DNA, 17 bp, Homo sapiens
cagaacacaaatgtcta

SEQ ID NO: 6697793 - DNA, 20 bp, Homo sapiens
cagaacacaaatgtctagtt

SEQ ID NO: 6697794 - DNA, 13 bp, Homo sapiens
cagaacacacaga

SEQ ID NO: 6697795 - DNA, 19 bp, Homo sapiens
cagaacacacagactttct

SEQ ID NO: 6697796 - DNA, 19 bp, Homo sapiens
cagaacacagatctcttgt

SEQ ID NO: 6697797 - DNA, 14 bp, Homo sapiens
cagaacacattctt

SEQ ID NO: 6697798 - DNA, 19 bp, Homo sapiens
cagaacacatttcaaatga

SEQ ID NO: 6697799 - DNA, 16 bp, Homo sapiens
cagaacaccaagtaaa

SEQ ID NO: 6697800 - DNA, 17 bp, Homo sapiens
cagaacaccgtgggctg

SEQ ID NO: 6697801 - DNA, 19 bp, Homo sapiens
cagaacacggctcacgctt

SEQ ID NO: 6697802 - DNA, 21 bp, Homo sapiens
cagaacactaacctgaccgtg

SEQ ID NO: 6697803 - DNA, 12 bp, Homo sapiens
cagaacactctt

SEQ ID NO: 6697804 - DNA, 11 bp, Homo sapiens
cagaacactgt

SEQ ID NO: 6697805 - DNA, 16 bp, Homo sapiens
cagaacactgtaatag

SEQ ID NO: 6697806 - DNA, 12 bp, Homo sapiens
cagaacagaggg

SEQ ID NO: 6697807 - DNA, 21 bp, Homo sapiens
cagaacagagggccagagcta

SEQ ID NO: 6697808 - DNA, 14 bp, Homo sapiens
cagaacagcagagg

SEQ ID NO: 6697809 - DNA, 13 bp, Homo sapiens
cagaacagcatgg

SEQ ID NO: 6697810 - DNA, 13 bp, Homo sapiens
cagaacagccctc

SEQ ID NO: 6697811 - DNA, 14 bp, Homo sapiens
cagaacagccctcg

SEQ ID NO: 6697812 - DNA, 23 bp, Homo sapiens
cagaacagccctcggcctccgag

SEQ ID NO: 6697813 - DNA, 12 bp, Homo sapiens
cagaacagccgc

SEQ ID NO: 6697814 - DNA, 17 bp, Homo sapiens
cagaacaggcagaaata

SEQ ID NO: 6697815 - DNA, 18 bp, Homo sapiens
cagaacaggcagaaatat

SEQ ID NO: 6697816 - DNA, 16 bp, Homo sapiens
cagaacagtgaaaggt

SEQ ID NO: 6697817 - DNA, 17 bp, Homo sapiens
cagaacagtgattacca

SEQ ID NO: 6697818 - DNA, 23 bp, Homo sapiens
cagaacagtgattaccagggact

SEQ ID NO: 6697819 - DNA, 17 bp, Homo sapiens
cagaacagtggtggcaa

SEQ ID NO: 6697820 - DNA, 22 bp, Homo sapiens
cagaacagtgtttgatttttat

SEQ ID NO: 6697821 - DNA, 19 bp, Homo sapiens
cagaacagttaagcagccg

SEQ ID NO: 6697822 - DNA, 17 bp, Homo sapiens
cagaacatcattagaac

SEQ ID NO: 6697823 - DNA, 14 bp, Homo sapiens
cagaacatcctcca

SEQ ID NO: 6697824 - DNA, 20 bp, Homo sapiens
cagaacatcgatatgtatat

SEQ ID NO: 6697825 - DNA, 15 bp, Homo sapiens
cagaacatgagtgct

SEQ ID NO: 6697826 - DNA, 17 bp, Homo sapiens
cagaacatgagtgctga

SEQ ID NO: 6697827 - DNA, 16 bp, Homo sapiens
cagaacatgtgggagg

SEQ ID NO: 6697828 - DNA, 18 bp, Homo sapiens
cagaacattcagctctgg

SEQ ID NO: 6697829 - DNA, 22 bp, Homo sapiens
cagaacattcgaatctctgccc

SEQ ID NO: 6697830 - DNA, 19 bp, Homo sapiens
cagaacattgccttcctcg

SEQ ID NO: 6697831 - DNA, 20 bp, Homo sapiens
cagaacattgccttcctcgt

SEQ ID NO: 6697832 - DNA, 19 bp, Homo sapiens
cagaaccaaaagggaggct

SEQ ID NO: 6697833 - DNA, 15 bp, Homo sapiens
cagaaccaaatcttt

SEQ ID NO: 6697834 - DNA, 16 bp, Homo sapiens
cagaaccaacgggtct

SEQ ID NO: 6697835 - DNA, 21 bp, Homo sapiens
cagaaccacactgttgagttg

SEQ ID NO: 6697836 - DNA, 15 bp, Homo sapiens
cagaaccacagatgt

SEQ ID NO: 6697837 - DNA, 14 bp, Homo sapiens
cagaaccacagggc

SEQ ID NO: 6697838 - DNA, 20 bp, Homo sapiens
cagaaccacagggctatttt

SEQ ID NO: 6697839 - DNA, 15 bp, Homo sapiens
cagaaccagcactcc

SEQ ID NO: 6697840 - DNA, 17 bp, Homo sapiens
cagaaccagcactccca

SEQ ID NO: 6697841 - DNA, 19 bp, Homo sapiens
cagaaccagcactcccagg

SEQ ID NO: 6697842 - DNA, 13 bp, Homo sapiens
cagaaccagcctc

SEQ ID NO: 6697843 - DNA, 19 bp, Homo sapiens
cagaaccagtacctcagta

SEQ ID NO: 6697844 - DNA, 16 bp, Homo sapiens
cagaaccagtctttca

SEQ ID NO: 6697845 - DNA, 17 bp, Homo sapiens
cagaaccagtctttcaa

SEQ ID NO: 6697846 - DNA, 19 bp, Homo sapiens
cagaaccattcactggcaa

SEQ ID NO: 6697847 - DNA, 21 bp, Homo sapiens
cagaaccattcactggcaaat

SEQ ID NO: 6697848 - DNA, 19 bp, Homo sapiens
cagaacccacagtgagagg

SEQ ID NO: 6697849 - DNA, 23 bp, Homo sapiens
cagaacccacataaaagccccag

SEQ ID NO: 6697850 - DNA, 19 bp, Homo sapiens
cagaacccagggctctgcc

SEQ ID NO: 6697851 - DNA, 21 bp, Homo sapiens
cagaacccagggctctgcccc

SEQ ID NO: 6697852 - DNA, 16 bp, Homo sapiens
cagaacccccaggtgg

SEQ ID NO: 6697853 - DNA, 23 bp, Homo sapiens
cagaacccctacatgaaacagaa

SEQ ID NO: 6697854 - DNA, 22 bp, Homo sapiens
cagaacccttggagccaatgga

SEQ ID NO: 6697855 - DNA, 18 bp, Homo sapiens
cagaaccggagagccagc

SEQ ID NO: 6697856 - DNA, 20 bp, Homo sapiens
cagaaccggtcccagcctgg

SEQ ID NO: 6697857 - DNA, 21 bp, Homo sapiens
cagaacctaaaagtattattc

SEQ ID NO: 6697858 - DNA, 19 bp, Homo sapiens
cagaacctactgttccttt

SEQ ID NO: 6697859 - DNA, 20 bp, Homo sapiens
cagaacctactgttcctttc

SEQ ID NO: 6697860 - DNA, 22 bp, Homo sapiens
cagaacctcaagtctagaaacc

SEQ ID NO: 6697861 - DNA, 23 bp, Homo sapiens
cagaacctcagcatttccttcca

SEQ ID NO: 6697862 - DNA, 24 bp, Homo sapiens
cagaacctctaagtgctgctgtgg

SEQ ID NO: 6697863 - DNA, 12 bp, Homo sapiens
cagaacctcttc

SEQ ID NO: 6697864 - DNA, 18 bp, Homo sapiens
cagaacctcttccccaga

SEQ ID NO: 6697865 - DNA, 13 bp, Homo sapiens
cagaacctggagg

SEQ ID NO: 6697866 - DNA, 20 bp, Homo sapiens
cagaacctggagggctagaa

SEQ ID NO: 6697867 - DNA, 14 bp, Homo sapiens
cagaacctggtggc

SEQ ID NO: 6697868 - DNA, 23 bp, Homo sapiens
cagaacctgttattttatgtctg

SEQ ID NO: 6697869 - DNA, 17 bp, Homo sapiens
cagaaccttactggcac

SEQ ID NO: 6697870 - DNA, 18 bp, Homo sapiens
cagaaccttactggcact

SEQ ID NO: 6697871 - DNA, 15 bp, Homo sapiens
cagaaccttgtccca

SEQ ID NO: 6697872 - DNA, 16 bp, Homo sapiens
cagaaccttgtcccag

SEQ ID NO: 6697873 - DNA, 16 bp, Homo sapiens
cagaaccttgttattt

SEQ ID NO: 6697874 - DNA, 23 bp, Homo sapiens
cagaacctttggacaagaggaaa

SEQ ID NO: 6697875 - DNA, 23 bp, Homo sapiens
cagaacgatgcctgcaggcatgg

SEQ ID NO: 6697876 - DNA, 17 bp, Homo sapiens
cagaacgcaccccactg

SEQ ID NO: 6697877 - DNA, 17 bp, Homo sapiens
cagaacgccctgtgtcc

SEQ ID NO: 6697878 - DNA, 21 bp, Homo sapiens
cagaacggagccccaggcctc

SEQ ID NO: 6697879 - DNA, 15 bp, Homo sapiens
cagaacgggcctccc

SEQ ID NO: 6697880 - DNA, 23 bp, Homo sapiens
cagaacggttctttgaccagcac

SEQ ID NO: 6697881 - DNA, 22 bp, Homo sapiens
cagaacgtatttagccattacc

SEQ ID NO: 6697882 - DNA, 14 bp, Homo sapiens
cagaacgtctctca

SEQ ID NO: 6697883 - DNA, 18 bp, Homo sapiens
cagaacgtggctctgctg

SEQ ID NO: 6697884 - DNA, 19 bp, Homo sapiens
cagaacgtggctctgctgg

SEQ ID NO: 6697885 - DNA, 18 bp, Homo sapiens
cagaactaaactcattta

SEQ ID NO: 6697886 - DNA, 19 bp, Homo sapiens
cagaactaaactcatttat

SEQ ID NO: 6697887 - DNA, 16 bp, Homo sapiens
cagaactaaatttttc

SEQ ID NO: 6697888 - DNA, 19 bp, Homo sapiens
cagaactaaatttttcata

SEQ ID NO: 6697889 - DNA, 20 bp, Homo sapiens
cagaactaaatttttcatag

SEQ ID NO: 6697890 - DNA, 15 bp, Homo sapiens
cagaactagaaaccc

SEQ ID NO: 6697891 - DNA, 12 bp, Homo sapiens
cagaactcccac

SEQ ID NO: 6697892 - DNA, 17 bp, Homo sapiens
cagaactcctttctaag

SEQ ID NO: 6697893 - DNA, 13 bp, Homo sapiens
cagaactcgatgc

SEQ ID NO: 6697894 - DNA, 16 bp, Homo sapiens
cagaactcgatgcact

SEQ ID NO: 6697895 - DNA, 17 bp, Homo sapiens
cagaactcgatgcactg

SEQ ID NO: 6697896 - DNA, 21 bp, Homo sapiens
cagaactcgatgcactgacct

SEQ ID NO: 6697897 - DNA, 22 bp, Homo sapiens
cagaactcgatgcactgacctg

SEQ ID NO: 6697898 - DNA, 21 bp, Homo sapiens
cagaactcggtgtccccacca

SEQ ID NO: 6697899 - DNA, 22 bp, Homo sapiens
cagaactctgcctgccctttgt

SEQ ID NO: 6697900 - DNA, 17 bp, Homo sapiens
cagaactcttaaaaatg

SEQ ID NO: 6697901 - DNA, 14 bp, Homo sapiens
cagaactctttcaa

SEQ ID NO: 6697902 - DNA, 18 bp, Homo sapiens
cagaactgaaataaaaaa

SEQ ID NO: 6697903 - DNA, 22 bp, Homo sapiens
cagaactgaaccggctttacca

SEQ ID NO: 6697904 - DNA, 14 bp, Homo sapiens
cagaactgaagcca

SEQ ID NO: 6697905 - DNA, 21 bp, Homo sapiens
cagaactgaattaagttattg

SEQ ID NO: 6697906 - DNA, 13 bp, Homo sapiens
cagaactgagctc

SEQ ID NO: 6697907 - DNA, 15 bp, Homo sapiens
cagaactgagctcct

SEQ ID NO: 6697908 - DNA, 17 bp, Homo sapiens
cagaactgagctcctct

SEQ ID NO: 6697909 - DNA, 23 bp, Homo sapiens
cagaactgagctcctctgggcag

SEQ ID NO: 6697910 - DNA, 24 bp, Homo sapiens
cagaactgagctcctctgggcagg

SEQ ID NO: 6697911 - DNA, 16 bp, Homo sapiens
cagaactgcagggcct

SEQ ID NO: 6697912 - DNA, 19 bp, Homo sapiens
cagaactgccattattttc

SEQ ID NO: 6697913 - DNA, 20 bp, Homo sapiens
cagaactgccattattttct

SEQ ID NO: 6697914 - DNA, 15 bp, Homo sapiens
cagaactgcccccac

SEQ ID NO: 6697915 - DNA, 19 bp, Homo sapiens
cagaactgctggggctggt

SEQ ID NO: 6697916 - DNA, 19 bp, Homo sapiens
cagaactggacgcccagct

SEQ ID NO: 6697917 - DNA, 16 bp, Homo sapiens
cagaactggcaggagc

SEQ ID NO: 6697918 - DNA, 18 bp, Homo sapiens
cagaactggcaggagcct

SEQ ID NO: 6697919 - DNA, 15 bp, Homo sapiens
cagaactggctgggc

SEQ ID NO: 6697920 - DNA, 22 bp, Homo sapiens
cagaactgtccacatctgcctc

SEQ ID NO: 6697921 - DNA, 18 bp, Homo sapiens
cagaactgtcccatcccc

SEQ ID NO: 6697922 - DNA, 22 bp, Homo sapiens
cagaactgtcccatccccaggt

SEQ ID NO: 6697923 - DNA, 16 bp, Homo sapiens
cagaactgtcttagtc

SEQ ID NO: 6697924 - DNA, 23 bp, Homo sapiens
cagaacttcaagatgagcctggg

SEQ ID NO: 6697925 - DNA, 17 bp, Homo sapiens
cagaacttcagaaagac

SEQ ID NO: 6697926 - DNA, 20 bp, Homo sapiens
cagaacttcagaaagacttg

SEQ ID NO: 6697927 - DNA, 16 bp, Homo sapiens
cagaacttccaaagag

SEQ ID NO: 6697928 - DNA, 14 bp, Homo sapiens
cagaacttccctga

SEQ ID NO: 6697929 - DNA, 21 bp, Homo sapiens
cagaacttgaagcctgctcct

SEQ ID NO: 6697930 - DNA, 16 bp, Homo sapiens
cagaacttgaagggtt

SEQ ID NO: 6697931 - DNA, 18 bp, Homo sapiens
cagaacttgctgctgtct

SEQ ID NO: 6697932 - DNA, 15 bp, Homo sapiens
cagaactttagtatt

SEQ ID NO: 6697933 - DNA, 17 bp, Homo sapiens
cagaactttagtattaa

SEQ ID NO: 6697934 - DNA, 18 bp, Homo sapiens
cagaactttgggaggcca

SEQ ID NO: 6697935 - DNA, 18 bp, Homo sapiens
cagaagaaaaacactgag

SEQ ID NO: 6697936 - DNA, 12 bp, Homo sapiens
cagaagaaaaca

SEQ ID NO: 6697937 - DNA, 16 bp, Homo sapiens
cagaagaaaacttttg

SEQ ID NO: 6697938 - DNA, 13 bp, Homo sapiens
cagaagaaaagac

SEQ ID NO: 6697939 - DNA, 23 bp, Homo sapiens
cagaagaaaagacttacctgaat

SEQ ID NO: 6697940 - DNA, 13 bp, Homo sapiens
cagaagaaaataa

SEQ ID NO: 6697941 - DNA, 22 bp, Homo sapiens
cagaagaaaatagaattgacat

SEQ ID NO: 6697942 - DNA, 24 bp, Homo sapiens
cagaagaaaattggactggtgaaa

SEQ ID NO: 6697943 - DNA, 14 bp, Homo sapiens
cagaagaaacaagg

SEQ ID NO: 6697944 - DNA, 13 bp, Homo sapiens
cagaagaaaggca

SEQ ID NO: 6697945 - DNA, 22 bp, Homo sapiens
cagaagaaaggcattgcacaga

SEQ ID NO: 6697946 - DNA, 16 bp, Homo sapiens
cagaagaaagggtgga

SEQ ID NO: 6697947 - DNA, 23 bp, Homo sapiens
cagaagaaattatttaatatgca

SEQ ID NO: 6697948 - DNA, 15 bp, Homo sapiens
cagaagaaccctggc

SEQ ID NO: 6697949 - DNA, 21 bp, Homo sapiens
cagaagaagagaagctgctga

SEQ ID NO: 6697950 - DNA, 22 bp, Homo sapiens
cagaagaagctgggagggaggg

SEQ ID NO: 6697951 - DNA, 14 bp, Homo sapiens
cagaagaaggcagc

SEQ ID NO: 6697952 - DNA, 16 bp, Homo sapiens
cagaagaagtgggagc

SEQ ID NO: 6697953 - DNA, 18 bp, Homo sapiens
cagaagaagtgggagcag

SEQ ID NO: 6697954 - DNA, 18 bp, Homo sapiens
cagaagaatatgacagct

SEQ ID NO: 6697955 - DNA, 15 bp, Homo sapiens
cagaagaatattcag

SEQ ID NO: 6697956 - DNA, 18 bp, Homo sapiens
cagaagaatattcaggac

SEQ ID NO: 6697957 - DNA, 19 bp, Homo sapiens
cagaagaatattcaggact

SEQ ID NO: 6697958 - DNA, 16 bp, Homo sapiens
cagaagaatcttcctg

SEQ ID NO: 6697959 - DNA, 23 bp, Homo sapiens
cagaagaatcttcctggcacaat

SEQ ID NO: 6697960 - DNA, 16 bp, Homo sapiens
cagaagaatctttctt

SEQ ID NO: 6697961 - DNA, 19 bp, Homo sapiens
cagaagaattgaacccagg

SEQ ID NO: 6697962 - DNA, 11 bp, Homo sapiens
cagaagaattt

SEQ ID NO: 6697963 - DNA, 12 bp, Homo sapiens
cagaagaattta

SEQ ID NO: 6697964 - DNA, 20 bp, Homo sapiens
cagaagaattttttttttaa

SEQ ID NO: 6697965 - DNA, 18 bp, Homo sapiens
cagaagacaaaaagacaa

SEQ ID NO: 6697966 - DNA, 13 bp, Homo sapiens
cagaagacacaga

SEQ ID NO: 6697967 - DNA, 18 bp, Homo sapiens
cagaagacaccagagcag

SEQ ID NO: 6697968 - DNA, 19 bp, Homo sapiens
cagaagacaccagagcaga

SEQ ID NO: 6697969 - DNA, 20 bp, Homo sapiens
cagaagacaccagagcagat

SEQ ID NO: 6697970 - DNA, 16 bp, Homo sapiens
cagaagacacgtgttt

SEQ ID NO: 6697971 - DNA, 20 bp, Homo sapiens
cagaagacacgtgtttttgt

SEQ ID NO: 6697972 - DNA, 12 bp, Homo sapiens
cagaagacacta

SEQ ID NO: 6697973 - DNA, 20 bp, Homo sapiens
cagaagacactaattcctta

SEQ ID NO: 6697974 - DNA, 21 bp, Homo sapiens
cagaagacactgatgggcaac

SEQ ID NO: 6697975 - DNA, 19 bp, Homo sapiens
cagaagacactgcaaaggc

SEQ ID NO: 6697976 - DNA, 14 bp, Homo sapiens
cagaagaccagatc

SEQ ID NO: 6697977 - DNA, 20 bp, Homo sapiens
cagaagacctccctgtgaga

SEQ ID NO: 6697978 - DNA, 12 bp, Homo sapiens
cagaagacggga

SEQ ID NO: 6697979 - DNA, 17 bp, Homo sapiens
cagaagacgggagggga

SEQ ID NO: 6697980 - DNA, 19 bp, Homo sapiens
cagaagacgggaggggagg

SEQ ID NO: 6697981 - DNA, 17 bp, Homo sapiens
cagaagactctccactg

SEQ ID NO: 6697982 - DNA, 21 bp, Homo sapiens
cagaagactctccactgacct

SEQ ID NO: 6697983 - DNA, 12 bp, Homo sapiens
cagaagagaaag

SEQ ID NO: 6697984 - DNA, 13 bp, Homo sapiens
cagaagagaaagt

SEQ ID NO: 6697985 - DNA, 20 bp, Homo sapiens
cagaagagaaagtacaacca

SEQ ID NO: 6697986 - DNA, 22 bp, Homo sapiens
cagaagagaaatacagctggct

SEQ ID NO: 6697987 - DNA, 23 bp, Homo sapiens
cagaagagaaatacagctggcta

SEQ ID NO: 6697988 - DNA, 14 bp, Homo sapiens
cagaagagaaggaa

SEQ ID NO: 6697989 - DNA, 15 bp, Homo sapiens
cagaagagaaggaag

SEQ ID NO: 6697990 - DNA, 19 bp, Homo sapiens
cagaagagaaggaagccat

SEQ ID NO: 6697991 - DNA, 12 bp, Homo sapiens
cagaagagaatc

SEQ ID NO: 6697992 - DNA, 18 bp, Homo sapiens
cagaagagaattcagtat

SEQ ID NO: 6697993 - DNA, 22 bp, Homo sapiens
cagaagagaattcagtattttt

SEQ ID NO: 6697994 - DNA, 16 bp, Homo sapiens
cagaagagactgatcc

SEQ ID NO: 6697995 - DNA, 20 bp, Homo sapiens
cagaagagagtggggcctgc

SEQ ID NO: 6697996 - DNA, 13 bp, Homo sapiens
cagaagagcagct

SEQ ID NO: 6697997 - DNA, 13 bp, Homo sapiens
cagaagaggaaat

SEQ ID NO: 6697998 - DNA, 14 bp, Homo sapiens
cagaagagggaggc

SEQ ID NO: 6697999 - DNA, 23 bp, Homo sapiens
cagaagagggaggcttcctgact

SEQ ID NO: 6698000 - DNA, 18 bp, Homo sapiens
cagaagaggggcagcttt

SEQ ID NO: 6698001 - DNA, 23 bp, Homo sapiens
cagaagagggtgtgtttgaaatc

SEQ ID NO: 6698002 - DNA, 20 bp, Homo sapiens
cagaagagttgtgcacgcag

SEQ ID NO: 6698003 - DNA, 16 bp, Homo sapiens
cagaagagtttcttaa

SEQ ID NO: 6698004 - DNA, 22 bp, Homo sapiens
cagaagataacttgagcaccgt

SEQ ID NO: 6698005 - DNA, 14 bp, Homo sapiens
cagaagatagagat

SEQ ID NO: 6698006 - DNA, 15 bp, Homo sapiens
cagaagatcccctca

SEQ ID NO: 6698007 - DNA, 15 bp, Homo sapiens
cagaagatgaaaaaa

SEQ ID NO: 6698008 - DNA, 16 bp, Homo sapiens
cagaagatgccagctt

SEQ ID NO: 6698009 - DNA, 13 bp, Homo sapiens
cagaagatgccct

SEQ ID NO: 6698010 - DNA, 14 bp, Homo sapiens
cagaagatggtgaa

SEQ ID NO: 6698011 - DNA, 20 bp, Homo sapiens
cagaagatgtattcagagcc

SEQ ID NO: 6698012 - DNA, 20 bp, Homo sapiens
cagaagattaagacagagaa

SEQ ID NO: 6698013 - DNA, 23 bp, Homo sapiens
cagaagattaagacagagaaaca

SEQ ID NO: 6698014 - DNA, 19 bp, Homo sapiens
cagaagattacaaaagcaa

SEQ ID NO: 6698015 - DNA, 20 bp, Homo sapiens
cagaagcaacccaaatgttc

SEQ ID NO: 6698016 - DNA, 14 bp, Homo sapiens
cagaagcaagccag

SEQ ID NO: 6698017 - DNA, 15 bp, Homo sapiens
cagaagcaagccaga

SEQ ID NO: 6698018 - DNA, 14 bp, Homo sapiens
cagaagcaaggaag

SEQ ID NO: 6698019 - DNA, 15 bp, Homo sapiens
cagaagcaaggaagt

SEQ ID NO: 6698020 - DNA, 20 bp, Homo sapiens
cagaagcacagaatattttt

SEQ ID NO: 6698021 - DNA, 13 bp, Homo sapiens
cagaagcagagag

SEQ ID NO: 6698022 - DNA, 22 bp, Homo sapiens
cagaagcagcagctagaaagag

SEQ ID NO: 6698023 - DNA, 13 bp, Homo sapiens
cagaagcagcccc

SEQ ID NO: 6698024 - DNA, 22 bp, Homo sapiens
cagaagcagcccctcgaggcct

SEQ ID NO: 6698025 - DNA, 16 bp, Homo sapiens
cagaagcaggcagggc

SEQ ID NO: 6698026 - DNA, 16 bp, Homo sapiens
cagaagcaggctggag

SEQ ID NO: 6698027 - DNA, 23 bp, Homo sapiens
cagaagcagttgagtcgtcatca

SEQ ID NO: 6698028 - DNA, 16 bp, Homo sapiens
cagaagcagttgcaat

SEQ ID NO: 6698029 - DNA, 13 bp, Homo sapiens
cagaagcatattt

SEQ ID NO: 6698030 - DNA, 22 bp, Homo sapiens
cagaagcatattttgctggttt

SEQ ID NO: 6698031 - DNA, 14 bp, Homo sapiens
cagaagcattaact

SEQ ID NO: 6698032 - DNA, 14 bp, Homo sapiens
cagaagcattgcct

SEQ ID NO: 6698033 - DNA, 23 bp, Homo sapiens
cagaagcattgcctggactgacc

SEQ ID NO: 6698034 - DNA, 23 bp, Homo sapiens
cagaagccaagctccctggagcc

SEQ ID NO: 6698035 - DNA, 18 bp, Homo sapiens
cagaagccacccaaagca

SEQ ID NO: 6698036 - DNA, 19 bp, Homo sapiens
cagaagccacccaaagcag

SEQ ID NO: 6698037 - DNA, 15 bp, Homo sapiens
cagaagccagaaggt

SEQ ID NO: 6698038 - DNA, 14 bp, Homo sapiens
cagaagccagaggg

SEQ ID NO: 6698039 - DNA, 15 bp, Homo sapiens
cagaagccagtctgc

SEQ ID NO: 6698040 - DNA, 22 bp, Homo sapiens
cagaagcccatgaactgtgttt

SEQ ID NO: 6698041 - DNA, 17 bp, Homo sapiens
cagaagcccatgtcttc

SEQ ID NO: 6698042 - DNA, 20 bp, Homo sapiens
cagaagcccattaaaatagt

SEQ ID NO: 6698043 - DNA, 15 bp, Homo sapiens
cagaagccccacagc

SEQ ID NO: 6698044 - DNA, 20 bp, Homo sapiens
cagaagccccatttgcacag

SEQ ID NO: 6698045 - DNA, 22 bp, Homo sapiens
cagaagccggcggagctctggc

SEQ ID NO: 6698046 - DNA, 16 bp, Homo sapiens
cagaagcctattgtaa

SEQ ID NO: 6698047 - DNA, 18 bp, Homo sapiens
cagaagcctattgtaaat

SEQ ID NO: 6698048 - DNA, 15 bp, Homo sapiens
cagaagcctccaagc

SEQ ID NO: 6698049 - DNA, 21 bp, Homo sapiens
cagaagcctccaagcctgcct

SEQ ID NO: 6698050 - DNA, 20 bp, Homo sapiens
cagaagcctccttacattaa

SEQ ID NO: 6698051 - DNA, 14 bp, Homo sapiens
cagaagcctctggc

SEQ ID NO: 6698052 - DNA, 19 bp, Homo sapiens
cagaagcctgaggctggga

SEQ ID NO: 6698053 - DNA, 23 bp, Homo sapiens
cagaagcctgatctttgggcatc

SEQ ID NO: 6698054 - DNA, 17 bp, Homo sapiens
cagaagcctggactctg

SEQ ID NO: 6698055 - DNA, 22 bp, Homo sapiens
cagaagcctggactctgcccca

SEQ ID NO: 6698056 - DNA, 13 bp, Homo sapiens
cagaagcctgggg

SEQ ID NO: 6698057 - DNA, 20 bp, Homo sapiens
cagaagcctgggggcctggc

SEQ ID NO: 6698058 - DNA, 21 bp, Homo sapiens
cagaagcctgggggcctggct

SEQ ID NO: 6698059 - DNA, 15 bp, Homo sapiens
cagaagcctgtttca

SEQ ID NO: 6698060 - DNA, 17 bp, Homo sapiens
cagaagccttcttgctg

SEQ ID NO: 6698061 - DNA, 20 bp, Homo sapiens
cagaagccttggaaccagcc

SEQ ID NO: 6698062 - DNA, 18 bp, Homo sapiens
cagaagcgtctcccttgg

SEQ ID NO: 6698063 - DNA, 22 bp, Homo sapiens
cagaagcgtctcccttggccac

SEQ ID NO: 6698064 - DNA, 19 bp, Homo sapiens
cagaagctatgtttttaaa

SEQ ID NO: 6698065 - DNA, 20 bp, Homo sapiens
cagaagctcttactctttcc

SEQ ID NO: 6698066 - DNA, 21 bp, Homo sapiens
cagaagctcttactctttcct

SEQ ID NO: 6698067 - DNA, 15 bp, Homo sapiens
cagaagctgcagctg

SEQ ID NO: 6698068 - DNA, 12 bp, Homo sapiens
cagaagctggga

SEQ ID NO: 6698069 - DNA, 12 bp, Homo sapiens
cagaagcttcca

SEQ ID NO: 6698070 - DNA, 15 bp, Homo sapiens
cagaagcttggagga

SEQ ID NO: 6698071 - DNA, 16 bp, Homo sapiens
cagaagcttggaggag

SEQ ID NO: 6698072 - DNA, 18 bp, Homo sapiens
cagaagcttggaggaggg

SEQ ID NO: 6698073 - DNA, 13 bp, Homo sapiens
cagaagcttgtat

SEQ ID NO: 6698074 - DNA, 19 bp, Homo sapiens
cagaaggaaaaatgtgtaa

SEQ ID NO: 6698075 - DNA, 20 bp, Homo sapiens
cagaaggaaaagagtaatgg

SEQ ID NO: 6698076 - DNA, 14 bp, Homo sapiens
cagaaggaaatgat

SEQ ID NO: 6698077 - DNA, 23 bp, Homo sapiens
cagaaggaacccggtcccaggcc

SEQ ID NO: 6698078 - DNA, 17 bp, Homo sapiens
cagaaggaagacttcat

SEQ ID NO: 6698079 - DNA, 11 bp, Homo sapiens
cagaaggaagg

SEQ ID NO: 6698080 - DNA, 24 bp, Homo sapiens
cagaaggaaggatgccacttggga

SEQ ID NO: 6698081 - DNA, 19 bp, Homo sapiens
cagaaggaatctgtgcaga

SEQ ID NO: 6698082 - DNA, 21 bp, Homo sapiens
cagaaggacaggtctctgaga

SEQ ID NO: 6698083 - DNA, 13 bp, Homo sapiens
cagaaggactggt

SEQ ID NO: 6698084 - DNA, 14 bp, Homo sapiens
cagaaggactggtg

SEQ ID NO: 6698085 - DNA, 15 bp, Homo sapiens
cagaaggactggtgc

SEQ ID NO: 6698086 - DNA, 22 bp, Homo sapiens
cagaaggactggtgcgaccccc

SEQ ID NO: 6698087 - DNA, 16 bp, Homo sapiens
cagaaggagaaggaaa

SEQ ID NO: 6698088 - DNA, 18 bp, Homo sapiens
cagaaggagaaggaagga

SEQ ID NO: 6698089 - DNA, 20 bp, Homo sapiens
cagaaggagaaggaaggaga

SEQ ID NO: 6698090 - DNA, 20 bp, Homo sapiens
cagaaggagaaggctggaga

SEQ ID NO: 6698091 - DNA, 22 bp, Homo sapiens
cagaaggaggaagggactggtc

SEQ ID NO: 6698092 - DNA, 23 bp, Homo sapiens
cagaaggaggaagggactggtcc

SEQ ID NO: 6698093 - DNA, 21 bp, Homo sapiens
cagaaggaggattcgagcatc

SEQ ID NO: 6698094 - DNA, 18 bp, Homo sapiens
cagaaggagggcagagcc

SEQ ID NO: 6698095 - DNA, 19 bp, Homo sapiens
cagaaggagggcagagcca

SEQ ID NO: 6698096 - DNA, 19 bp, Homo sapiens
cagaaggagtctgatgctc

SEQ ID NO: 6698097 - DNA, 16 bp, Homo sapiens
cagaaggatccaagac

SEQ ID NO: 6698098 - DNA, 16 bp, Homo sapiens
cagaaggatttcttgt

SEQ ID NO: 6698099 - DNA, 18 bp, Homo sapiens
cagaaggatttcttgtat

SEQ ID NO: 6698100 - DNA, 18 bp, Homo sapiens
cagaaggattttttaaag

SEQ ID NO: 6698101 - DNA, 18 bp, Homo sapiens
cagaaggcaaacccatca

SEQ ID NO: 6698102 - DNA, 15 bp, Homo sapiens
cagaaggcaaagttt

SEQ ID NO: 6698103 - DNA, 23 bp, Homo sapiens
cagaaggcaaagtttacagatgt

SEQ ID NO: 6698104 - DNA, 19 bp, Homo sapiens
cagaaggcaaatgactttg

SEQ ID NO: 6698105 - DNA, 20 bp, Homo sapiens
cagaaggcaaatgactttgg

SEQ ID NO: 6698106 - DNA, 13 bp, Homo sapiens
cagaaggcaggga

SEQ ID NO: 6698107 - DNA, 14 bp, Homo sapiens
cagaaggccaagag

SEQ ID NO: 6698108 - DNA, 12 bp, Homo sapiens
cagaaggccagg

SEQ ID NO: 6698109 - DNA, 14 bp, Homo sapiens
cagaaggccccaga

SEQ ID NO: 6698110 - DNA, 12 bp, Homo sapiens
cagaaggcccga

SEQ ID NO: 6698111 - DNA, 14 bp, Homo sapiens
cagaaggcccgagg

SEQ ID NO: 6698112 - DNA, 18 bp, Homo sapiens
cagaaggcccgaggaggc

SEQ ID NO: 6698113 - DNA, 19 bp, Homo sapiens
cagaaggcccgaggaggcc

SEQ ID NO: 6698114 - DNA, 11 bp, Homo sapiens
cagaaggccct

SEQ ID NO: 6698115 - DNA, 23 bp, Homo sapiens
cagaaggcctcactcaagcctga

SEQ ID NO: 6698116 - DNA, 14 bp, Homo sapiens
cagaaggctcttct

SEQ ID NO: 6698117 - DNA, 19 bp, Homo sapiens
cagaaggctggggccagtg

SEQ ID NO: 6698118 - DNA, 15 bp, Homo sapiens
cagaagggaaacagt

SEQ ID NO: 6698119 - DNA, 16 bp, Homo sapiens
cagaagggaaacagtc

SEQ ID NO: 6698120 - DNA, 11 bp, Homo sapiens
cagaagggaat

SEQ ID NO: 6698121 - DNA, 15 bp, Homo sapiens
cagaagggagaagga

SEQ ID NO: 6698122 - DNA, 19 bp, Homo sapiens
cagaagggagctagccaga

SEQ ID NO: 6698123 - DNA, 19 bp, Homo sapiens
cagaagggagctggctcca

SEQ ID NO: 6698124 - DNA, 16 bp, Homo sapiens
cagaagggagggcaga

SEQ ID NO: 6698125 - DNA, 17 bp, Homo sapiens
cagaagggagggcagag

SEQ ID NO: 6698126 - DNA, 23 bp, Homo sapiens
cagaaggggaatgtgtcctcctg

SEQ ID NO: 6698127 - DNA, 23 bp, Homo sapiens
cagaaggggactgccacctcccc

SEQ ID NO: 6698128 - DNA, 17 bp, Homo sapiens
cagaaggggagatggac

SEQ ID NO: 6698129 - DNA, 16 bp, Homo sapiens
cagaaggggctgcttg

SEQ ID NO: 6698130 - DNA, 21 bp, Homo sapiens
cagaaggggctgcttgctttt

SEQ ID NO: 6698131 - DNA, 22 bp, Homo sapiens
cagaaggggctgcttgcttttg

SEQ ID NO: 6698132 - DNA, 16 bp, Homo sapiens
cagaagggggccatga

SEQ ID NO: 6698133 - DNA, 19 bp, Homo sapiens
cagaagggggtggtgtctc

SEQ ID NO: 6698134 - DNA, 20 bp, Homo sapiens
cagaagggggtggtgtctcc

SEQ ID NO: 6698135 - DNA, 19 bp, Homo sapiens
cagaaggtaggggccgtgt

SEQ ID NO: 6698136 - DNA, 14 bp, Homo sapiens
cagaaggtattttt

SEQ ID NO: 6698137 - DNA, 19 bp, Homo sapiens
cagaaggtctggtcggcaa

SEQ ID NO: 6698138 - DNA, 14 bp, Homo sapiens
cagaaggtgaactt

SEQ ID NO: 6698139 - DNA, 22 bp, Homo sapiens
cagaaggtgccactttacccac

SEQ ID NO: 6698140 - DNA, 23 bp, Homo sapiens
cagaaggtgggggttggctgggt

SEQ ID NO: 6698141 - DNA, 17 bp, Homo sapiens
cagaaggttcacccagc

SEQ ID NO: 6698142 - DNA, 23 bp, Homo sapiens
cagaaggttgctctagattgaga

SEQ ID NO: 6698143 - DNA, 20 bp, Homo sapiens
cagaagtactggcatcacac

SEQ ID NO: 6698144 - DNA, 23 bp, Homo sapiens
cagaagtaggggaagaataattt

SEQ ID NO: 6698145 - DNA, 21 bp, Homo sapiens
cagaagtagtggtttgctttg

SEQ ID NO: 6698146 - DNA, 21 bp, Homo sapiens
cagaagtagttttgttcatga

SEQ ID NO: 6698147 - DNA, 22 bp, Homo sapiens
cagaagtcatcttgctaccagt

SEQ ID NO: 6698148 - DNA, 19 bp, Homo sapiens
cagaagtccctaggaggga

SEQ ID NO: 6698149 - DNA, 23 bp, Homo sapiens
cagaagtccctaggagggaagga

SEQ ID NO: 6698150 - DNA, 21 bp, Homo sapiens
cagaagtccctcccatctcta

SEQ ID NO: 6698151 - DNA, 19 bp, Homo sapiens
cagaagtcctgtatgtctg

SEQ ID NO: 6698152 - DNA, 20 bp, Homo sapiens
cagaagtcctgtatgtctgt

SEQ ID NO: 6698153 - DNA, 22 bp, Homo sapiens
cagaagtcctgtatgtctgtca

SEQ ID NO: 6698154 - DNA, 22 bp, Homo sapiens
cagaagtccttaagcagaggaa

SEQ ID NO: 6698155 - DNA, 14 bp, Homo sapiens
cagaagtctggctt

SEQ ID NO: 6698156 - DNA, 13 bp, Homo sapiens
cagaagtctttca

SEQ ID NO: 6698157 - DNA, 20 bp, Homo sapiens
cagaagtgaatgggaaaggg

SEQ ID NO: 6698158 - DNA, 15 bp, Homo sapiens
cagaagtgaccaaat

SEQ ID NO: 6698159 - DNA, 22 bp, Homo sapiens
cagaagtgaccaaattgggaga

SEQ ID NO: 6698160 - DNA, 17 bp, Homo sapiens
cagaagtgagccccccc

SEQ ID NO: 6698161 - DNA, 18 bp, Homo sapiens
cagaagtgagctttgctg

SEQ ID NO: 6698162 - DNA, 21 bp, Homo sapiens
cagaagtgagctttgctgcta

SEQ ID NO: 6698163 - DNA, 22 bp, Homo sapiens
cagaagtgagctttgctgctac

SEQ ID NO: 6698164 - DNA, 14 bp, Homo sapiens
cagaagtgcaaagg

SEQ ID NO: 6698165 - DNA, 13 bp, Homo sapiens
cagaagtgcatcc

SEQ ID NO: 6698166 - DNA, 19 bp, Homo sapiens
cagaagtgcatgaacaggg

SEQ ID NO: 6698167 - DNA, 20 bp, Homo sapiens
cagaagtggaatccagtgtg

SEQ ID NO: 6698168 - DNA, 17 bp, Homo sapiens
cagaagtggagatttca

SEQ ID NO: 6698169 - DNA, 16 bp, Homo sapiens
cagaagtggggctctg

SEQ ID NO: 6698170 - DNA, 18 bp, Homo sapiens
cagaagtggggctctggg

SEQ ID NO: 6698171 - DNA, 13 bp, Homo sapiens
cagaagtgtattc

SEQ ID NO: 6698172 - DNA, 16 bp, Homo sapiens
cagaagttaaaccatg

SEQ ID NO: 6698173 - DNA, 18 bp, Homo sapiens
cagaagttatatttttaa

SEQ ID NO: 6698174 - DNA, 15 bp, Homo sapiens
cagaagttctgggtg

SEQ ID NO: 6698175 - DNA, 15 bp, Homo sapiens
cagaagttgtgaaac

SEQ ID NO: 6698176 - DNA, 18 bp, Homo sapiens
cagaagttgtgaaactaa

SEQ ID NO: 6698177 - DNA, 17 bp, Homo sapiens
cagaagttgtgctaaac

SEQ ID NO: 6698178 - DNA, 18 bp, Homo sapiens
cagaagttgttagtgatt

SEQ ID NO: 6698179 - DNA, 14 bp, Homo sapiens
cagaagtttctgcc

SEQ ID NO: 6698180 - DNA, 21 bp, Homo sapiens
cagaagtttctgccgcagccc

SEQ ID NO: 6698181 - DNA, 22 bp, Homo sapiens
cagaagtttgcactatctttca

SEQ ID NO: 6698182 - DNA, 16 bp, Homo sapiens
cagaagtttggcaata

SEQ ID NO: 6698183 - DNA, 19 bp, Homo sapiens
cagaagttttaacttccag

SEQ ID NO: 6698184 - DNA, 22 bp, Homo sapiens
cagaataaaagttcctctccct

SEQ ID NO: 6698185 - DNA, 12 bp, Homo sapiens
cagaataaagca

SEQ ID NO: 6698186 - DNA, 16 bp, Homo sapiens
cagaataaagcaattt

SEQ ID NO: 6698187 - DNA, 22 bp, Homo sapiens
cagaataaagcaattttccttg

SEQ ID NO: 6698188 - DNA, 19 bp, Homo sapiens
cagaataaagcagcctgat

SEQ ID NO: 6698189 - DNA, 13 bp, Homo sapiens
cagaataaagttg

SEQ ID NO: 6698190 - DNA, 15 bp, Homo sapiens
cagaataaagttgta

SEQ ID NO: 6698191 - DNA, 17 bp, Homo sapiens
cagaataaatgttttac

SEQ ID NO: 6698192 - DNA, 15 bp, Homo sapiens
cagaataagtgctgt

SEQ ID NO: 6698193 - DNA, 23 bp, Homo sapiens
cagaataagtgctgtttgagatg

SEQ ID NO: 6698194 - DNA, 24 bp, Homo sapiens
cagaataagtgctgtttgagatgt

SEQ ID NO: 6698195 - DNA, 18 bp, Homo sapiens
cagaataagttattgcag

SEQ ID NO: 6698196 - DNA, 19 bp, Homo sapiens
cagaataagttattgcagt

SEQ ID NO: 6698197 - DNA, 20 bp, Homo sapiens
cagaataagttattgcagtt

SEQ ID NO: 6698198 - DNA, 21 bp, Homo sapiens
cagaataagttattgcagttt

SEQ ID NO: 6698199 - DNA, 22 bp, Homo sapiens
cagaataatccagtattgctga

SEQ ID NO: 6698200 - DNA, 15 bp, Homo sapiens
cagaataatcctgtt

SEQ ID NO: 6698201 - DNA, 12 bp, Homo sapiens
cagaataatgga

SEQ ID NO: 6698202 - DNA, 15 bp, Homo sapiens
cagaataatgttcta

SEQ ID NO: 6698203 - DNA, 18 bp, Homo sapiens
cagaataatgttctattg

SEQ ID NO: 6698204 - DNA, 20 bp, Homo sapiens
cagaatacaattcagtttta

SEQ ID NO: 6698205 - DNA, 15 bp, Homo sapiens
cagaatacatacaaa

SEQ ID NO: 6698206 - DNA, 15 bp, Homo sapiens
cagaatactgatgga

SEQ ID NO: 6698207 - DNA, 19 bp, Homo sapiens
cagaatacttgcactcttt

SEQ ID NO: 6698208 - DNA, 16 bp, Homo sapiens
cagaatacttttctct

SEQ ID NO: 6698209 - DNA, 22 bp, Homo sapiens
cagaatagaatacattgataca

SEQ ID NO: 6698210 - DNA, 19 bp, Homo sapiens
cagaatagatagcactgaa

SEQ ID NO: 6698211 - DNA, 15 bp, Homo sapiens
cagaatagccacatt

SEQ ID NO: 6698212 - DNA, 20 bp, Homo sapiens
cagaatagctgttttgtgta

SEQ ID NO: 6698213 - DNA, 20 bp, Homo sapiens
cagaataggaagatatgcca

SEQ ID NO: 6698214 - DNA, 20 bp, Homo sapiens
cagaatagggtggcagaagt

SEQ ID NO: 6698215 - DNA, 13 bp, Homo sapiens
cagaatagtttac

SEQ ID NO: 6698216 - DNA, 14 bp, Homo sapiens
cagaatagtttaca

SEQ ID NO: 6698217 - DNA, 16 bp, Homo sapiens
cagaatagtttacaca

SEQ ID NO: 6698218 - DNA, 15 bp, Homo sapiens
cagaatatacacatt

SEQ ID NO: 6698219 - DNA, 16 bp, Homo sapiens
cagaatatacacattt

SEQ ID NO: 6698220 - DNA, 16 bp, Homo sapiens
cagaatatcatctttt

SEQ ID NO: 6698221 - DNA, 22 bp, Homo sapiens
cagaatatgattcactatttaa

SEQ ID NO: 6698222 - DNA, 22 bp, Homo sapiens
cagaatatggacaaagaaggca

SEQ ID NO: 6698223 - DNA, 13 bp, Homo sapiens
cagaatatgtcag

SEQ ID NO: 6698224 - DNA, 12 bp, Homo sapiens
cagaatatgttt

SEQ ID NO: 6698225 - DNA, 17 bp, Homo sapiens
cagaatatgtttcaaac

SEQ ID NO: 6698226 - DNA, 20 bp, Homo sapiens
cagaatatgtttcaaacttt

SEQ ID NO: 6698227 - DNA, 17 bp, Homo sapiens
cagaatattaaatatta

SEQ ID NO: 6698228 - DNA, 22 bp, Homo sapiens
cagaatattagtgacctcagct

SEQ ID NO: 6698229 - DNA, 14 bp, Homo sapiens
cagaatattctttt

SEQ ID NO: 6698230 - DNA, 22 bp, Homo sapiens
cagaatattgctaggttttgct

SEQ ID NO: 6698231 - DNA, 19 bp, Homo sapiens
cagaatatttttgaaagct

SEQ ID NO: 6698232 - DNA, 16 bp, Homo sapiens
cagaatcaaacctttt

SEQ ID NO: 6698233 - DNA, 15 bp, Homo sapiens
cagaatcaaagcaat

SEQ ID NO: 6698234 - DNA, 20 bp, Homo sapiens
cagaatcaaatctgagcctt

SEQ ID NO: 6698235 - DNA, 17 bp, Homo sapiens
cagaatcaacttgaagc

SEQ ID NO: 6698236 - DNA, 22 bp, Homo sapiens
cagaatcagatatacctagagt

SEQ ID NO: 6698237 - DNA, 16 bp, Homo sapiens
cagaatcagcacagat

SEQ ID NO: 6698238 - DNA, 14 bp, Homo sapiens
cagaatcagtgtta

SEQ ID NO: 6698239 - DNA, 14 bp, Homo sapiens
cagaatcattgctt

SEQ ID NO: 6698240 - DNA, 20 bp, Homo sapiens
cagaatcattgcttatgaca

SEQ ID NO: 6698241 - DNA, 13 bp, Homo sapiens
cagaatccaaaga

SEQ ID NO: 6698242 - DNA, 18 bp, Homo sapiens
cagaatccaaagatcaca

SEQ ID NO: 6698243 - DNA, 19 bp, Homo sapiens
cagaatccaagtgaacact

SEQ ID NO: 6698244 - DNA, 17 bp, Homo sapiens
cagaatccataaatgtg

SEQ ID NO: 6698245 - DNA, 13 bp, Homo sapiens
cagaatcccctgg

SEQ ID NO: 6698246 - DNA, 14 bp, Homo sapiens
cagaatcccctggg

SEQ ID NO: 6698247 - DNA, 16 bp, Homo sapiens
cagaatcccctgggga

SEQ ID NO: 6698248 - DNA, 20 bp, Homo sapiens
cagaatccctctacatggac

SEQ ID NO: 6698249 - DNA, 18 bp, Homo sapiens
cagaatcccttaacagtt

SEQ ID NO: 6698250 - DNA, 23 bp, Homo sapiens
cagaatccctttgcacctgagac

SEQ ID NO: 6698251 - DNA, 13 bp, Homo sapiens
cagaatcctgggc

SEQ ID NO: 6698252 - DNA, 14 bp, Homo sapiens
cagaatcctgggcc

SEQ ID NO: 6698253 - DNA, 23 bp, Homo sapiens
cagaatcctgggcccccagagac

SEQ ID NO: 6698254 - DNA, 17 bp, Homo sapiens
cagaatccttggctgaa

SEQ ID NO: 6698255 - DNA, 23 bp, Homo sapiens
cagaatctaaacgtggtcacctt

SEQ ID NO: 6698256 - DNA, 23 bp, Homo sapiens
cagaatctaactggtggacatgg

SEQ ID NO: 6698257 - DNA, 15 bp, Homo sapiens
cagaatctcgctctg

SEQ ID NO: 6698258 - DNA, 21 bp, Homo sapiens
cagaatctctatgtatattct

SEQ ID NO: 6698259 - DNA, 14 bp, Homo sapiens
cagaatctgaatgt

SEQ ID NO: 6698260 - DNA, 18 bp, Homo sapiens
cagaatctgaatgtaatt

SEQ ID NO: 6698261 - DNA, 12 bp, Homo sapiens
cagaatctgtat

SEQ ID NO: 6698262 - DNA, 15 bp, Homo sapiens
cagaatcttcgtcct

SEQ ID NO: 6698263 - DNA, 20 bp, Homo sapiens
cagaatcttcgtcctgcccc

SEQ ID NO: 6698264 - DNA, 19 bp, Homo sapiens
cagaatcttgactttctga

SEQ ID NO: 6698265 - DNA, 22 bp, Homo sapiens
cagaatcttgactttctgattg

SEQ ID NO: 6698266 - DNA, 13 bp, Homo sapiens
cagaatcttgttt

SEQ ID NO: 6698267 - DNA, 17 bp, Homo sapiens
cagaatcttgttttgaa

SEQ ID NO: 6698268 - DNA, 19 bp, Homo sapiens
cagaatcttgttttgaaaa

SEQ ID NO: 6698269 - DNA, 15 bp, Homo sapiens
cagaatctttaaaga

SEQ ID NO: 6698270 - DNA, 13 bp, Homo sapiens
cagaatctttgtt

SEQ ID NO: 6698271 - DNA, 15 bp, Homo sapiens
cagaatctttgttaa

SEQ ID NO: 6698272 - DNA, 18 bp, Homo sapiens
cagaatgaaaaatgaaag

SEQ ID NO: 6698273 - DNA, 14 bp, Homo sapiens
cagaatgaaaatca

SEQ ID NO: 6698274 - DNA, 20 bp, Homo sapiens
cagaatgaaccctcctcctt

SEQ ID NO: 6698275 - DNA, 21 bp, Homo sapiens
cagaatgaagacctaaatgac

SEQ ID NO: 6698276 - DNA, 24 bp, Homo sapiens
cagaatgaagacctaaatgacctc

SEQ ID NO: 6698277 - DNA, 13 bp, Homo sapiens
cagaatgaagcca

SEQ ID NO: 6698278 - DNA, 14 bp, Homo sapiens
cagaatgaagccat

SEQ ID NO: 6698279 - DNA, 16 bp, Homo sapiens
cagaatgaccttgagt

SEQ ID NO: 6698280 - DNA, 16 bp, Homo sapiens
cagaatgagagagaaa

SEQ ID NO: 6698281 - DNA, 18 bp, Homo sapiens
cagaatgagagagaaaag

SEQ ID NO: 6698282 - DNA, 22 bp, Homo sapiens
cagaatgagatgatttaattct

SEQ ID NO: 6698283 - DNA, 23 bp, Homo sapiens
cagaatgagatgatttaattctt

SEQ ID NO: 6698284 - DNA, 14 bp, Homo sapiens
cagaatgaggctgc

SEQ ID NO: 6698285 - DNA, 15 bp, Homo sapiens
cagaatgcattaaaa

SEQ ID NO: 6698286 - DNA, 17 bp, Homo sapiens
cagaatgcattaaaaaa

SEQ ID NO: 6698287 - DNA, 19 bp, Homo sapiens
cagaatgcggcctctgaga

SEQ ID NO: 6698288 - DNA, 15 bp, Homo sapiens
cagaatgctcctgag

SEQ ID NO: 6698289 - DNA, 16 bp, Homo sapiens
cagaatgctgaactcc

SEQ ID NO: 6698290 - DNA, 14 bp, Homo sapiens
cagaatggaaaaaa

SEQ ID NO: 6698291 - DNA, 15 bp, Homo sapiens
cagaatggaaaaaaa

SEQ ID NO: 6698292 - DNA, 17 bp, Homo sapiens
cagaatggaaaaatcct

SEQ ID NO: 6698293 - DNA, 19 bp, Homo sapiens
cagaatggaagagagaaag

SEQ ID NO: 6698294 - DNA, 18 bp, Homo sapiens
cagaatggaatccatctg

SEQ ID NO: 6698295 - DNA, 15 bp, Homo sapiens
cagaatggagaaagt

SEQ ID NO: 6698296 - DNA, 16 bp, Homo sapiens
cagaatggagaaagta

SEQ ID NO: 6698297 - DNA, 16 bp, Homo sapiens
cagaatggaggcaggg

SEQ ID NO: 6698298 - DNA, 23 bp, Homo sapiens
cagaatggaggcaggggacaagg

SEQ ID NO: 6698299 - DNA, 20 bp, Homo sapiens
cagaatggcagtcctggagg

SEQ ID NO: 6698300 - DNA, 16 bp, Homo sapiens
cagaatggctgcacgt

SEQ ID NO: 6698301 - DNA, 13 bp, Homo sapiens
cagaatgtaactg

SEQ ID NO: 6698302 - DNA, 20 bp, Homo sapiens
cagaatgtaagaaaacaaaa

SEQ ID NO: 6698303 - DNA, 20 bp, Homo sapiens
cagaatgtaagtgggcccac

SEQ ID NO: 6698304 - DNA, 21 bp, Homo sapiens
cagaatgtaagtgggcccacc

SEQ ID NO: 6698305 - DNA, 16 bp, Homo sapiens
cagaatgtaggctggt

SEQ ID NO: 6698306 - DNA, 12 bp, Homo sapiens
cagaatgtcaga

SEQ ID NO: 6698307 - DNA, 15 bp, Homo sapiens
cagaatgtgttcttt

SEQ ID NO: 6698308 - DNA, 14 bp, Homo sapiens
cagaatgtttcctg

SEQ ID NO: 6698309 - DNA, 18 bp, Homo sapiens
cagaatgtttcctgtgga

SEQ ID NO: 6698310 - DNA, 16 bp, Homo sapiens
cagaatgttttactgt

SEQ ID NO: 6698311 - DNA, 14 bp, Homo sapiens
cagaattaaacttt

SEQ ID NO: 6698312 - DNA, 16 bp, Homo sapiens
cagaattaaactttta

SEQ ID NO: 6698313 - DNA, 14 bp, Homo sapiens
cagaattaagcaga

SEQ ID NO: 6698314 - DNA, 17 bp, Homo sapiens
cagaattaatgcattca

SEQ ID NO: 6698315 - DNA, 16 bp, Homo sapiens
cagaattacccttcct

SEQ ID NO: 6698316 - DNA, 17 bp, Homo sapiens
cagaattacccttcctc

SEQ ID NO: 6698317 - DNA, 21 bp, Homo sapiens
cagaattagatggcttatttt

SEQ ID NO: 6698318 - DNA, 20 bp, Homo sapiens
cagaattatacagacctaat

SEQ ID NO: 6698319 - DNA, 22 bp, Homo sapiens
cagaattatacagacctaatat

SEQ ID NO: 6698320 - DNA, 22 bp, Homo sapiens
cagaattatccattacgtgcat

SEQ ID NO: 6698321 - DNA, 13 bp, Homo sapiens
cagaattattttt

SEQ ID NO: 6698322 - DNA, 14 bp, Homo sapiens
cagaattcattcat

SEQ ID NO: 6698323 - DNA, 22 bp, Homo sapiens
cagaattcattcatacttaaaa

SEQ ID NO: 6698324 - DNA, 13 bp, Homo sapiens
cagaattcccttg

SEQ ID NO: 6698325 - DNA, 23 bp, Homo sapiens
cagaattcccttgaattgtgtat

SEQ ID NO: 6698326 - DNA, 15 bp, Homo sapiens
cagaattccttttct

SEQ ID NO: 6698327 - DNA, 20 bp, Homo sapiens
cagaattcggtgtgctgcca

SEQ ID NO: 6698328 - DNA, 11 bp, Homo sapiens
cagaattctca

SEQ ID NO: 6698329 - DNA, 13 bp, Homo sapiens
cagaattctgcta

SEQ ID NO: 6698330 - DNA, 23 bp, Homo sapiens
cagaattctgctacctcactggg

SEQ ID NO: 6698331 - DNA, 21 bp, Homo sapiens
cagaattgaaccgtcaatgtg

SEQ ID NO: 6698332 - DNA, 22 bp, Homo sapiens
cagaattgacagttgaacagag

SEQ ID NO: 6698333 - DNA, 22 bp, Homo sapiens
cagaattgactgcagttgaaca

SEQ ID NO: 6698334 - DNA, 13 bp, Homo sapiens
cagaattgatcat

SEQ ID NO: 6698335 - DNA, 16 bp, Homo sapiens
cagaattgcacatcta

SEQ ID NO: 6698336 - DNA, 22 bp, Homo sapiens
cagaattgcttgaacccaggag

SEQ ID NO: 6698337 - DNA, 23 bp, Homo sapiens
cagaattggatacatacaccagc

SEQ ID NO: 6698338 - DNA, 16 bp, Homo sapiens
cagaattggtaaaaac

SEQ ID NO: 6698339 - DNA, 16 bp, Homo sapiens
cagaattgtgtctgca

SEQ ID NO: 6698340 - DNA, 17 bp, Homo sapiens
cagaattgtgtctgcag

SEQ ID NO: 6698341 - DNA, 18 bp, Homo sapiens
cagaatttagtgtatcca

SEQ ID NO: 6698342 - DNA, 17 bp, Homo sapiens
cagaatttatagaataa

SEQ ID NO: 6698343 - DNA, 14 bp, Homo sapiens
cagaatttatctcc

SEQ ID NO: 6698344 - DNA, 21 bp, Homo sapiens
cagaatttattagtttaaaat

SEQ ID NO: 6698345 - DNA, 13 bp, Homo sapiens
cagaatttcatac

SEQ ID NO: 6698346 - DNA, 17 bp, Homo sapiens
cagaatttccactgtaa

SEQ ID NO: 6698347 - DNA, 19 bp, Homo sapiens
cagaatttctttgtcattc

SEQ ID NO: 6698348 - DNA, 22 bp, Homo sapiens
cagaatttctttgtcattcaag

SEQ ID NO: 6698349 - DNA, 15 bp, Homo sapiens
cagaatttgaattat

SEQ ID NO: 6698350 - DNA, 12 bp, Homo sapiens
cagaatttgaga

SEQ ID NO: 6698351 - DNA, 13 bp, Homo sapiens
cagaatttgagaa

SEQ ID NO: 6698352 - DNA, 19 bp, Homo sapiens
cagaatttggaagctagaa

SEQ ID NO: 6698353 - DNA, 19 bp, Homo sapiens
cagaatttgggttctgcct

SEQ ID NO: 6698354 - DNA, 18 bp, Homo sapiens
cagaatttgtgaatatat

SEQ ID NO: 6698355 - DNA, 21 bp, Homo sapiens
cagaatttgtgaatatatttt

SEQ ID NO: 6698356 - DNA, 17 bp, Homo sapiens
cagaattttaatgtgaa

SEQ ID NO: 6698357 - DNA, 19 bp, Homo sapiens
cagaattttaatgtgaaga

SEQ ID NO: 6698358 - DNA, 23 bp, Homo sapiens
cagaattttaggaacttcagaga

SEQ ID NO: 6698359 - DNA, 22 bp, Homo sapiens
cagaattttatactttccctac

SEQ ID NO: 6698360 - DNA, 19 bp, Homo sapiens
cagaattttctggcctttc

SEQ ID NO: 6698361 - DNA, 14 bp, Homo sapiens
cagaattttggaaa

SEQ ID NO: 6698362 - DNA, 19 bp, Homo sapiens
cagaattttggaaaaatgt

SEQ ID NO: 6698363 - DNA, 20 bp, Homo sapiens
cagaattttggaaaaatgtc

SEQ ID NO: 6698364 - DNA, 21 bp, Homo sapiens
cagaattttggaaaaatgtca

SEQ ID NO: 6698365 - DNA, 15 bp, Homo sapiens
cagaatttttaatga

SEQ ID NO: 6698366 - DNA, 19 bp, Homo sapiens
cagaatttttaatgacttt

SEQ ID NO: 6698367 - DNA, 22 bp, Homo sapiens
cagaatttttaatgacttttta

SEQ ID NO: 6698368 - DNA, 14 bp, Homo sapiens
cagacaaaaagaac

SEQ ID NO: 6698369 - DNA, 20 bp, Homo sapiens
cagacaaaagcgcttttcct

SEQ ID NO: 6698370 - DNA, 15 bp, Homo sapiens
cagacaaaatgaaag

SEQ ID NO: 6698371 - DNA, 20 bp, Homo sapiens
cagacaaaatggatacataa

SEQ ID NO: 6698372 - DNA, 17 bp, Homo sapiens
cagacaaaatttgagaa

SEQ ID NO: 6698373 - DNA, 17 bp, Homo sapiens
cagacaaaccagaagca

SEQ ID NO: 6698374 - DNA, 22 bp, Homo sapiens
cagacaaagcgtggtggacatg

SEQ ID NO: 6698375 - DNA, 17 bp, Homo sapiens
cagacaaatgaaataat

SEQ ID NO: 6698376 - DNA, 22 bp, Homo sapiens
cagacaaatttaaaggaaacac

SEQ ID NO: 6698377 - DNA, 20 bp, Homo sapiens
cagacaacaccttcctcctg

SEQ ID NO: 6698378 - DNA, 14 bp, Homo sapiens
cagacaacagaagt

SEQ ID NO: 6698379 - DNA, 15 bp, Homo sapiens
cagacaacagaagtc

SEQ ID NO: 6698380 - DNA, 18 bp, Homo sapiens
cagacaacattatgatct

SEQ ID NO: 6698381 - DNA, 13 bp, Homo sapiens
cagacaaccaaaa

SEQ ID NO: 6698382 - DNA, 17 bp, Homo sapiens
cagacaaccaaaacata

SEQ ID NO: 6698383 - DNA, 18 bp, Homo sapiens
cagacaaccttgtcccaa

SEQ ID NO: 6698384 - DNA, 21 bp, Homo sapiens
cagacaaccttgtcccaagga

SEQ ID NO: 6698385 - DNA, 17 bp, Homo sapiens
cagacaactctagaaat

SEQ ID NO: 6698386 - DNA, 15 bp, Homo sapiens
cagacaagacagagg

SEQ ID NO: 6698387 - DNA, 19 bp, Homo sapiens
cagacaagagctgctgtcc

SEQ ID NO: 6698388 - DNA, 21 bp, Homo sapiens
cagacaagagctgctgtcctt

SEQ ID NO: 6698389 - DNA, 21 bp, Homo sapiens
cagacaagagggcaagcctct

SEQ ID NO: 6698390 - DNA, 19 bp, Homo sapiens
cagacaagatggctggaag

SEQ ID NO: 6698391 - DNA, 19 bp, Homo sapiens
cagacaagcaacaggtttt

SEQ ID NO: 6698392 - DNA, 16 bp, Homo sapiens
cagacaagcaacccaa

SEQ ID NO: 6698393 - DNA, 19 bp, Homo sapiens
cagacaagcaacccaaact

SEQ ID NO: 6698394 - DNA, 20 bp, Homo sapiens
cagacaagcaacccaaactg

SEQ ID NO: 6698395 - DNA, 15 bp, Homo sapiens
cagacaagcactatt

SEQ ID NO: 6698396 - DNA, 20 bp, Homo sapiens
cagacaagcactattttata

SEQ ID NO: 6698397 - DNA, 17 bp, Homo sapiens
cagacaagcagcccttg

SEQ ID NO: 6698398 - DNA, 21 bp, Homo sapiens
cagacaagccctgcttgctgg

SEQ ID NO: 6698399 - DNA, 19 bp, Homo sapiens
cagacaagctgttgaccag

SEQ ID NO: 6698400 - DNA, 22 bp, Homo sapiens
cagacaaggagagcggaggagg

SEQ ID NO: 6698401 - DNA, 15 bp, Homo sapiens
cagacaaggcaggcc

SEQ ID NO: 6698402 - DNA, 15 bp, Homo sapiens
cagacaaggttctgc

SEQ ID NO: 6698403 - DNA, 16 bp, Homo sapiens
cagacaagtcttgctg

SEQ ID NO: 6698404 - DNA, 19 bp, Homo sapiens
cagacaagtgggagagccc

SEQ ID NO: 6698405 - DNA, 20 bp, Homo sapiens
cagacaagttggaaaaacaa

SEQ ID NO: 6698406 - DNA, 17 bp, Homo sapiens
cagacaataaaatggaa

SEQ ID NO: 6698407 - DNA, 16 bp, Homo sapiens
cagacaatacgtttga

SEQ ID NO: 6698408 - DNA, 13 bp, Homo sapiens
cagacaatccact

SEQ ID NO: 6698409 - DNA, 15 bp, Homo sapiens
cagacaatccactct

SEQ ID NO: 6698410 - DNA, 21 bp, Homo sapiens
cagacaattcagaagcatcac

SEQ ID NO: 6698411 - DNA, 14 bp, Homo sapiens
cagacaattctaat

SEQ ID NO: 6698412 - DNA, 15 bp, Homo sapiens
cagacaattctccct

SEQ ID NO: 6698413 - DNA, 12 bp, Homo sapiens
cagacacacaac

SEQ ID NO: 6698414 - DNA, 16 bp, Homo sapiens
cagacacacaacatca

SEQ ID NO: 6698415 - DNA, 18 bp, Homo sapiens
cagacacacaacatcaag

SEQ ID NO: 6698416 - DNA, 12 bp, Homo sapiens
cagacacacaca

SEQ ID NO: 6698417 - DNA, 14 bp, Homo sapiens
cagacacacacaca

SEQ ID NO: 6698418 - DNA, 21 bp, Homo sapiens
cagacacacacacacacacaa

SEQ ID NO: 6698419 - DNA, 16 bp, Homo sapiens
cagacacacacacacc

SEQ ID NO: 6698420 - DNA, 17 bp, Homo sapiens
cagacacacacacacct

SEQ ID NO: 6698421 - DNA, 21 bp, Homo sapiens
cagacacacacacgcacgcac

SEQ ID NO: 6698422 - DNA, 14 bp, Homo sapiens
cagacacacacata

SEQ ID NO: 6698423 - DNA, 15 bp, Homo sapiens
cagacacacactggc

SEQ ID NO: 6698424 - DNA, 22 bp, Homo sapiens
cagacacacatgggcagcccaa

SEQ ID NO: 6698425 - DNA, 13 bp, Homo sapiens
cagacacagccca

SEQ ID NO: 6698426 - DNA, 13 bp, Homo sapiens
cagacacagctct

SEQ ID NO: 6698427 - DNA, 23 bp, Homo sapiens
cagacacagctcttccagggcag

SEQ ID NO: 6698428 - DNA, 17 bp, Homo sapiens
cagacacaggcccggct

SEQ ID NO: 6698429 - DNA, 21 bp, Homo sapiens
cagacacaggcccggctccag

SEQ ID NO: 6698430 - DNA, 14 bp, Homo sapiens
cagacacaggccct

SEQ ID NO: 6698431 - DNA, 13 bp, Homo sapiens
cagacacaggccg

SEQ ID NO: 6698432 - DNA, 21 bp, Homo sapiens
cagacacagggacttgaagtt

SEQ ID NO: 6698433 - DNA, 13 bp, Homo sapiens
cagacacatgcta

SEQ ID NO: 6698434 - DNA, 17 bp, Homo sapiens
cagacacatgctatgtt

SEQ ID NO: 6698435 - DNA, 16 bp, Homo sapiens
cagacacattctcctg

SEQ ID NO: 6698436 - DNA, 17 bp, Homo sapiens
cagacaccatgtgcaat

SEQ ID NO: 6698437 - DNA, 13 bp, Homo sapiens
cagacacccagga

SEQ ID NO: 6698438 - DNA, 19 bp, Homo sapiens
cagacaccctccactctga

SEQ ID NO: 6698439 - DNA, 21 bp, Homo sapiens
cagacaccctccactctgagg

SEQ ID NO: 6698440 - DNA, 18 bp, Homo sapiens
cagacaccctctccttaa

SEQ ID NO: 6698441 - DNA, 15 bp, Homo sapiens
cagacaccgccacat

SEQ ID NO: 6698442 - DNA, 16 bp, Homo sapiens
cagacacctaacccca

SEQ ID NO: 6698443 - DNA, 19 bp, Homo sapiens
cagacacctaaccccaggg

SEQ ID NO: 6698444 - DNA, 14 bp, Homo sapiens
cagacacctagact

SEQ ID NO: 6698445 - DNA, 22 bp, Homo sapiens
cagacacctccccctacccata

SEQ ID NO: 6698446 - DNA, 19 bp, Homo sapiens
cagacacctgttcacagaa

SEQ ID NO: 6698447 - DNA, 21 bp, Homo sapiens
cagacacgcacttctggggcc

SEQ ID NO: 6698448 - DNA, 18 bp, Homo sapiens
cagacacgccttcccctc

SEQ ID NO: 6698449 - DNA, 20 bp, Homo sapiens
cagacacgctcgcgggcagc

SEQ ID NO: 6698450 - DNA, 19 bp, Homo sapiens
cagacactaaatgcagaca

SEQ ID NO: 6698451 - DNA, 19 bp, Homo sapiens
cagacactaacgaaatatc

SEQ ID NO: 6698452 - DNA, 12 bp, Homo sapiens
cagacactaagt

SEQ ID NO: 6698453 - DNA, 17 bp, Homo sapiens
cagacactacatgatga

SEQ ID NO: 6698454 - DNA, 15 bp, Homo sapiens
cagacactcctgggg

SEQ ID NO: 6698455 - DNA, 19 bp, Homo sapiens
cagacactctgctctgccc

SEQ ID NO: 6698456 - DNA, 14 bp, Homo sapiens
cagacactgagctt

SEQ ID NO: 6698457 - DNA, 11 bp, Homo sapiens
cagacactgta

SEQ ID NO: 6698458 - DNA, 16 bp, Homo sapiens
cagacacttatttatt

SEQ ID NO: 6698459 - DNA, 14 bp, Homo sapiens
cagacactttggaa

SEQ ID NO: 6698460 - DNA, 15 bp, Homo sapiens
cagacactttggaag

SEQ ID NO: 6698461 - DNA, 14 bp, Homo sapiens
cagacagaaactgg

SEQ ID NO: 6698462 - DNA, 16 bp, Homo sapiens
cagacagaaagagaca

SEQ ID NO: 6698463 - DNA, 17 bp, Homo sapiens
cagacagaaagagacac

SEQ ID NO: 6698464 - DNA, 20 bp, Homo sapiens
cagacagaacttgaatgtgt

SEQ ID NO: 6698465 - DNA, 11 bp, Homo sapiens
cagacagaaga

SEQ ID NO: 6698466 - DNA, 21 bp, Homo sapiens
cagacagaagggtaatgcgtg

SEQ ID NO: 6698467 - DNA, 18 bp, Homo sapiens
cagacagaagtctcctca

SEQ ID NO: 6698468 - DNA, 23 bp, Homo sapiens
cagacagaagtgtagtatgctgt

SEQ ID NO: 6698469 - DNA, 15 bp, Homo sapiens
cagacagacacacac

SEQ ID NO: 6698470 - DNA, 16 bp, Homo sapiens
cagacagacacacaca

SEQ ID NO: 6698471 - DNA, 22 bp, Homo sapiens
cagacagacaccacagcctccc

SEQ ID NO: 6698472 - DNA, 23 bp, Homo sapiens
cagacagacaccacagcctcccc

SEQ ID NO: 6698473 - DNA, 16 bp, Homo sapiens
cagacagaccttcaca

SEQ ID NO: 6698474 - DNA, 22 bp, Homo sapiens
cagacagagaaatgtgaagggt

SEQ ID NO: 6698475 - DNA, 20 bp, Homo sapiens
cagacagagaatatgtctgc

SEQ ID NO: 6698476 - DNA, 22 bp, Homo sapiens
cagacagagaatatgtctgctc

SEQ ID NO: 6698477 - DNA, 13 bp, Homo sapiens
cagacagagccag

SEQ ID NO: 6698478 - DNA, 15 bp, Homo sapiens
cagacagagccagga

SEQ ID NO: 6698479 - DNA, 17 bp, Homo sapiens
cagacagagccaggaga

SEQ ID NO: 6698480 - DNA, 20 bp, Homo sapiens
cagacagagccaggagaagc

SEQ ID NO: 6698481 - DNA, 23 bp, Homo sapiens
cagacagagccaggagaagctca

SEQ ID NO: 6698482 - DNA, 18 bp, Homo sapiens
cagacagaggcagggcag

SEQ ID NO: 6698483 - DNA, 19 bp, Homo sapiens
cagacagaggcagggcagc

SEQ ID NO: 6698484 - DNA, 11 bp, Homo sapiens
cagacagatga

SEQ ID NO: 6698485 - DNA, 18 bp, Homo sapiens
cagacagatgaggctttc

SEQ ID NO: 6698486 - DNA, 21 bp, Homo sapiens
cagacagatggaaaagggaga

SEQ ID NO: 6698487 - DNA, 19 bp, Homo sapiens
cagacagatgtcagcttcc

SEQ ID NO: 6698488 - DNA, 15 bp, Homo sapiens
cagacagcaaggtgt

SEQ ID NO: 6698489 - DNA, 11 bp, Homo sapiens
cagacagcaca

SEQ ID NO: 6698490 - DNA, 23 bp, Homo sapiens
cagacagcacaaggtggcagcaa

SEQ ID NO: 6698491 - DNA, 17 bp, Homo sapiens
cagacagcacagggcag

SEQ ID NO: 6698492 - DNA, 12 bp, Homo sapiens
cagacagcagct

SEQ ID NO: 6698493 - DNA, 17 bp, Homo sapiens
cagacagcagctcaggc

SEQ ID NO: 6698494 - DNA, 17 bp, Homo sapiens
cagacagcagctggact

SEQ ID NO: 6698495 - DNA, 16 bp, Homo sapiens
cagacagcaggcagcg

SEQ ID NO: 6698496 - DNA, 16 bp, Homo sapiens
cagacagccatgcgtg

SEQ ID NO: 6698497 - DNA, 19 bp, Homo sapiens
cagacagccccaagcttct

SEQ ID NO: 6698498 - DNA, 21 bp, Homo sapiens
cagacagccccctgccccgca

SEQ ID NO: 6698499 - DNA, 16 bp, Homo sapiens
cagacagcctgtatct

SEQ ID NO: 6698500 - DNA, 11 bp, Homo sapiens
cagacagctcc

SEQ ID NO: 6698501 - DNA, 19 bp, Homo sapiens
cagacagctccctctgcct

SEQ ID NO: 6698502 - DNA, 13 bp, Homo sapiens
cagacagctgcct

SEQ ID NO: 6698503 - DNA, 16 bp, Homo sapiens
cagacagctgcctggg

SEQ ID NO: 6698504 - DNA, 17 bp, Homo sapiens
cagacagctgcctggga

SEQ ID NO: 6698505 - DNA, 13 bp, Homo sapiens
cagacagctggac

SEQ ID NO: 6698506 - DNA, 19 bp, Homo sapiens
cagacagcttacaggagcc

SEQ ID NO: 6698507 - DNA, 14 bp, Homo sapiens
cagacaggaaggaa

SEQ ID NO: 6698508 - DNA, 17 bp, Homo sapiens
cagacaggaccagggat

SEQ ID NO: 6698509 - DNA, 24 bp, Homo sapiens
cagacaggaccagggatttccatg

SEQ ID NO: 6698510 - DNA, 16 bp, Homo sapiens
cagacaggacccctgc

SEQ ID NO: 6698511 - DNA, 13 bp, Homo sapiens
cagacaggagaaa

SEQ ID NO: 6698512 - DNA, 12 bp, Homo sapiens
cagacaggagga

SEQ ID NO: 6698513 - DNA, 22 bp, Homo sapiens
cagacaggaggagtgggacaga

SEQ ID NO: 6698514 - DNA, 11 bp, Homo sapiens
cagacaggcaa

SEQ ID NO: 6698515 - DNA, 18 bp, Homo sapiens
cagacaggcaagcacctc

SEQ ID NO: 6698516 - DNA, 21 bp, Homo sapiens
cagacaggcaagcacctcctg

SEQ ID NO: 6698517 - DNA, 23 bp, Homo sapiens
cagacaggcaagcacctcctgcc

SEQ ID NO: 6698518 - DNA, 15 bp, Homo sapiens
cagacaggccccgtg

SEQ ID NO: 6698519 - DNA, 13 bp, Homo sapiens
cagacaggccctc

SEQ ID NO: 6698520 - DNA, 18 bp, Homo sapiens
cagacaggccctccctgt

SEQ ID NO: 6698521 - DNA, 14 bp, Homo sapiens
cagacaggctctta

SEQ ID NO: 6698522 - DNA, 16 bp, Homo sapiens
cagacagggcgtcctc

SEQ ID NO: 6698523 - DNA, 20 bp, Homo sapiens
cagacagggctccagcctgt

SEQ ID NO: 6698524 - DNA, 15 bp, Homo sapiens
cagacagggtggggc

SEQ ID NO: 6698525 - DNA, 17 bp, Homo sapiens
cagacagggtggggctt

SEQ ID NO: 6698526 - DNA, 21 bp, Homo sapiens
cagacaggtaaatgggcagtg

SEQ ID NO: 6698527 - DNA, 23 bp, Homo sapiens
cagacaggtggaaaaactgagac

SEQ ID NO: 6698528 - DNA, 21 bp, Homo sapiens
cagacaggtgggagatggagg

SEQ ID NO: 6698529 - DNA, 16 bp, Homo sapiens
cagacaggtttaaaag

SEQ ID NO: 6698530 - DNA, 23 bp, Homo sapiens
cagacaggttttcacataaatgc

SEQ ID NO: 6698531 - DNA, 18 bp, Homo sapiens
cagacagtcgctcagtct

SEQ ID NO: 6698532 - DNA, 15 bp, Homo sapiens
cagacagtctgttat

SEQ ID NO: 6698533 - DNA, 18 bp, Homo sapiens
cagacagtggatgagaca

SEQ ID NO: 6698534 - DNA, 19 bp, Homo sapiens
cagacagtgtcagagtcat

SEQ ID NO: 6698535 - DNA, 17 bp, Homo sapiens
cagacagttcttttcta

SEQ ID NO: 6698536 - DNA, 17 bp, Homo sapiens
cagacagtttatgagaa

SEQ ID NO: 6698537 - DNA, 14 bp, Homo sapiens
cagacataaaggaa

SEQ ID NO: 6698538 - DNA, 15 bp, Homo sapiens
cagacataaaggaaa

SEQ ID NO: 6698539 - DNA, 17 bp, Homo sapiens
cagacataaaggaaaag

SEQ ID NO: 6698540 - DNA, 20 bp, Homo sapiens
cagacataaaggaaaagaca

SEQ ID NO: 6698541 - DNA, 22 bp, Homo sapiens
cagacataaaggaaaagacaca

SEQ ID NO: 6698542 - DNA, 14 bp, Homo sapiens
cagacatacataga

SEQ ID NO: 6698543 - DNA, 19 bp, Homo sapiens
cagacatactaaccagcag

SEQ ID NO: 6698544 - DNA, 17 bp, Homo sapiens
cagacatagaattaaca

SEQ ID NO: 6698545 - DNA, 13 bp, Homo sapiens
cagacatagactg

SEQ ID NO: 6698546 - DNA, 16 bp, Homo sapiens
cagacatagactgcaa

SEQ ID NO: 6698547 - DNA, 14 bp, Homo sapiens
cagacatatttaac

SEQ ID NO: 6698548 - DNA, 17 bp, Homo sapiens
cagacatcaccctttgc

SEQ ID NO: 6698549 - DNA, 15 bp, Homo sapiens
cagacatcatgaatt

SEQ ID NO: 6698550 - DNA, 20 bp, Homo sapiens
cagacatctactacagcact

SEQ ID NO: 6698551 - DNA, 17 bp, Homo sapiens
cagacatctccagtgtg

SEQ ID NO: 6698552 - DNA, 18 bp, Homo sapiens
cagacatctctggagcca

SEQ ID NO: 6698553 - DNA, 20 bp, Homo sapiens
cagacatctctggagccaga

SEQ ID NO: 6698554 - DNA, 21 bp, Homo sapiens
cagacatctctggagccagag

SEQ ID NO: 6698555 - DNA, 23 bp, Homo sapiens
cagacatctctggagccagagag

SEQ ID NO: 6698556 - DNA, 14 bp, Homo sapiens
cagacatgaaaact

SEQ ID NO: 6698557 - DNA, 13 bp, Homo sapiens
cagacatgctgcc

SEQ ID NO: 6698558 - DNA, 14 bp, Homo sapiens
cagacatgctgccc

SEQ ID NO: 6698559 - DNA, 17 bp, Homo sapiens
cagacatggacctccag

SEQ ID NO: 6698560 - DNA, 21 bp, Homo sapiens
cagacatggaccttctctcca

SEQ ID NO: 6698561 - DNA, 17 bp, Homo sapiens
cagacatggtggggtct

SEQ ID NO: 6698562 - DNA, 23 bp, Homo sapiens
cagacatggtggggtctcctcag

SEQ ID NO: 6698563 - DNA, 22 bp, Homo sapiens
cagacatgtggtgggacaggga

SEQ ID NO: 6698564 - DNA, 17 bp, Homo sapiens
cagacattaaacctgga

SEQ ID NO: 6698565 - DNA, 17 bp, Homo sapiens
cagacattatgtaaaag

SEQ ID NO: 6698566 - DNA, 22 bp, Homo sapiens
cagacattcacctgtatatttc

SEQ ID NO: 6698567 - DNA, 14 bp, Homo sapiens
cagacattcagaga

SEQ ID NO: 6698568 - DNA, 20 bp, Homo sapiens
cagacattctcaaagcctct

SEQ ID NO: 6698569 - DNA, 18 bp, Homo sapiens
cagacattgctctcagtg

SEQ ID NO: 6698570 - DNA, 22 bp, Homo sapiens
cagacattgctctcagtgcttt

SEQ ID NO: 6698571 - DNA, 17 bp, Homo sapiens
cagacattgtcagcaaa

SEQ ID NO: 6698572 - DNA, 14 bp, Homo sapiens
cagacattgtgcta

SEQ ID NO: 6698573 - DNA, 15 bp, Homo sapiens
cagacattgttttgc

SEQ ID NO: 6698574 - DNA, 19 bp, Homo sapiens
cagacattgttttgccaac

SEQ ID NO: 6698575 - DNA, 20 bp, Homo sapiens
cagacattgttttgccaaca

SEQ ID NO: 6698576 - DNA, 22 bp, Homo sapiens
cagacattgttttgccaacatt

SEQ ID NO: 6698577 - DNA, 12 bp, Homo sapiens
cagacatttata

SEQ ID NO: 6698578 - DNA, 18 bp, Homo sapiens
cagacatttctttggaaa

SEQ ID NO: 6698579 - DNA, 14 bp, Homo sapiens
cagacattttcctc

SEQ ID NO: 6698580 - DNA, 18 bp, Homo sapiens
cagacattttcctcacac

SEQ ID NO: 6698581 - DNA, 22 bp, Homo sapiens
cagacattttcctcacacccac

SEQ ID NO: 6698582 - DNA, 17 bp, Homo sapiens
cagacattttgtgtgag

SEQ ID NO: 6698583 - DNA, 14 bp, Homo sapiens
cagaccaaaaatca

SEQ ID NO: 6698584 - DNA, 16 bp, Homo sapiens
cagaccaaaataatac

SEQ ID NO: 6698585 - DNA, 19 bp, Homo sapiens
cagaccaaaataatacaac

SEQ ID NO: 6698586 - DNA, 12 bp, Homo sapiens
cagaccaaccct

SEQ ID NO: 6698587 - DNA, 19 bp, Homo sapiens
cagaccaaccctgggacct

SEQ ID NO: 6698588 - DNA, 13 bp, Homo sapiens
cagaccacagcag

SEQ ID NO: 6698589 - DNA, 16 bp, Homo sapiens
cagaccacattgcttt

SEQ ID NO: 6698590 - DNA, 19 bp, Homo sapiens
cagaccaccagccgcccca

SEQ ID NO: 6698591 - DNA, 21 bp, Homo sapiens
cagaccaccagccgccccagc

SEQ ID NO: 6698592 - DNA, 15 bp, Homo sapiens
cagaccaccccgcct

SEQ ID NO: 6698593 - DNA, 14 bp, Homo sapiens
cagaccacctgcca

SEQ ID NO: 6698594 - DNA, 18 bp, Homo sapiens
cagaccacctgccagcca

SEQ ID NO: 6698595 - DNA, 23 bp, Homo sapiens
cagaccacgcccgtcctgcctgt

SEQ ID NO: 6698596 - DNA, 18 bp, Homo sapiens
cagaccacggtgtggggg

SEQ ID NO: 6698597 - DNA, 17 bp, Homo sapiens
cagaccacttttctata

SEQ ID NO: 6698598 - DNA, 22 bp, Homo sapiens
cagaccagagctgtctgaactc

SEQ ID NO: 6698599 - DNA, 12 bp, Homo sapiens
cagaccagcagc

SEQ ID NO: 6698600 - DNA, 10 bp, Homo sapiens
cagaccagcc

SEQ ID NO: 6698601 - DNA, 14 bp, Homo sapiens
cagaccaggaagct

SEQ ID NO: 6698602 - DNA, 15 bp, Homo sapiens
cagaccaggtgacct

SEQ ID NO: 6698603 - DNA, 17 bp, Homo sapiens
cagaccagtactgggaa

SEQ ID NO: 6698604 - DNA, 15 bp, Homo sapiens
cagaccagtagtgac

SEQ ID NO: 6698605 - DNA, 16 bp, Homo sapiens
cagaccataatgttac

SEQ ID NO: 6698606 - DNA, 20 bp, Homo sapiens
cagaccatattacctggatt

SEQ ID NO: 6698607 - DNA, 23 bp, Homo sapiens
cagaccatgaagtaaattatgta

SEQ ID NO: 6698608 - DNA, 20 bp, Homo sapiens
cagaccatggatatgttgta

SEQ ID NO: 6698609 - DNA, 23 bp, Homo sapiens
cagaccattggggctcccagcca

SEQ ID NO: 6698610 - DNA, 15 bp, Homo sapiens
cagaccattgtcttc

SEQ ID NO: 6698611 - DNA, 23 bp, Homo sapiens
cagaccattgtcttccaacccca

SEQ ID NO: 6698612 - DNA, 24 bp, Homo sapiens
cagaccattgtcttccaaccccag

SEQ ID NO: 6698613 - DNA, 15 bp, Homo sapiens
cagacccaacccatg

SEQ ID NO: 6698614 - DNA, 23 bp, Homo sapiens
cagacccacagaaggtgttcaaa

SEQ ID NO: 6698615 - DNA, 14 bp, Homo sapiens
cagacccacctgga

SEQ ID NO: 6698616 - DNA, 15 bp, Homo sapiens
cagacccacctggag

SEQ ID NO: 6698617 - DNA, 17 bp, Homo sapiens
cagacccacctggagcc

SEQ ID NO: 6698618 - DNA, 18 bp, Homo sapiens
cagacccacctggagccc

SEQ ID NO: 6698619 - DNA, 19 bp, Homo sapiens
cagacccacctggagcccg

SEQ ID NO: 6698620 - DNA, 19 bp, Homo sapiens
cagacccacgggctcatgc

SEQ ID NO: 6698621 - DNA, 20 bp, Homo sapiens
cagacccacgggctcatgca

SEQ ID NO: 6698622 - DNA, 12 bp, Homo sapiens
cagacccactct

SEQ ID NO: 6698623 - DNA, 12 bp, Homo sapiens
cagacccagaga

SEQ ID NO: 6698624 - DNA, 13 bp, Homo sapiens
cagacccagagaa

SEQ ID NO: 6698625 - DNA, 13 bp, Homo sapiens
cagacccagagcc

SEQ ID NO: 6698626 - DNA, 18 bp, Homo sapiens
cagacccagaggtccagg

SEQ ID NO: 6698627 - DNA, 23 bp, Homo sapiens
cagacccagaggtccaggtccca

SEQ ID NO: 6698628 - DNA, 20 bp, Homo sapiens
cagacccagcccgcggcctg

SEQ ID NO: 6698629 - DNA, 23 bp, Homo sapiens
cagacccagcccgcggcctggac

SEQ ID NO: 6698630 - DNA, 11 bp, Homo sapiens
cagacccagcg

SEQ ID NO: 6698631 - DNA, 19 bp, Homo sapiens
cagacccaggacccccgag

SEQ ID NO: 6698632 - DNA, 16 bp, Homo sapiens
cagacccaggagtcca

SEQ ID NO: 6698633 - DNA, 17 bp, Homo sapiens
cagacccaggagtccag

SEQ ID NO: 6698634 - DNA, 18 bp, Homo sapiens
cagacccaggagtccaga

SEQ ID NO: 6698635 - DNA, 19 bp, Homo sapiens
cagacccaggagtccagac

SEQ ID NO: 6698636 - DNA, 20 bp, Homo sapiens
cagacccaggagtccagacc

SEQ ID NO: 6698637 - DNA, 21 bp, Homo sapiens
cagacccaggagtccagaccc

SEQ ID NO: 6698638 - DNA, 22 bp, Homo sapiens
cagacccaggagtccagacccc

SEQ ID NO: 6698639 - DNA, 19 bp, Homo sapiens
cagacccaggagtccagcc

SEQ ID NO: 6698640 - DNA, 13 bp, Homo sapiens
cagacccagggca

SEQ ID NO: 6698641 - DNA, 19 bp, Homo sapiens
cagacccagggcagtgtgg

SEQ ID NO: 6698642 - DNA, 20 bp, Homo sapiens
cagacccaggggtccaggcc

SEQ ID NO: 6698643 - DNA, 20 bp, Homo sapiens
cagacccagggtggtcttca

SEQ ID NO: 6698644 - DNA, 13 bp, Homo sapiens
cagacccaggtct

SEQ ID NO: 6698645 - DNA, 18 bp, Homo sapiens
cagacccaggtcttccag

SEQ ID NO: 6698646 - DNA, 15 bp, Homo sapiens
cagacccagtcccac

SEQ ID NO: 6698647 - DNA, 18 bp, Homo sapiens
cagacccatgtgctggga

SEQ ID NO: 6698648 - DNA, 13 bp, Homo sapiens
cagacccattcct

SEQ ID NO: 6698649 - DNA, 14 bp, Homo sapiens
cagacccattcctt

SEQ ID NO: 6698650 - DNA, 18 bp, Homo sapiens
cagaccccacaacttcag

SEQ ID NO: 6698651 - DNA, 21 bp, Homo sapiens
cagaccccaccctgtctgcag

SEQ ID NO: 6698652 - DNA, 14 bp, Homo sapiens
cagaccccagcggc

SEQ ID NO: 6698653 - DNA, 14 bp, Homo sapiens
cagaccccagctgg

SEQ ID NO: 6698654 - DNA, 16 bp, Homo sapiens
cagaccccagctgggg

SEQ ID NO: 6698655 - DNA, 17 bp, Homo sapiens
cagaccccagctggggc

SEQ ID NO: 6698656 - DNA, 16 bp, Homo sapiens
cagaccccaggtcagc

SEQ ID NO: 6698657 - DNA, 13 bp, Homo sapiens
cagaccccatcca

SEQ ID NO: 6698658 - DNA, 13 bp, Homo sapiens
cagacccccaccc

SEQ ID NO: 6698659 - DNA, 15 bp, Homo sapiens
cagacccccacccct

SEQ ID NO: 6698660 - DNA, 18 bp, Homo sapiens
cagacccccagcaaccct

SEQ ID NO: 6698661 - DNA, 17 bp, Homo sapiens
cagaccccccagcccct

SEQ ID NO: 6698662 - DNA, 18 bp, Homo sapiens
cagaccccccagcccctc

SEQ ID NO: 6698663 - DNA, 20 bp, Homo sapiens
cagacccccttgcccaggcc

SEQ ID NO: 6698664 - DNA, 22 bp, Homo sapiens
cagaccccgcagcacgcctctc

SEQ ID NO: 6698665 - DNA, 23 bp, Homo sapiens
cagaccccgcagcacgcctctcc

SEQ ID NO: 6698666 - DNA, 12 bp, Homo sapiens
cagaccccgccc

SEQ ID NO: 6698667 - DNA, 15 bp, Homo sapiens
cagaccccgcccctg

SEQ ID NO: 6698668 - DNA, 20 bp, Homo sapiens
cagaccccgcccctggggaa

SEQ ID NO: 6698669 - DNA, 20 bp, Homo sapiens
cagaccccgtggctctggga

SEQ ID NO: 6698670 - DNA, 14 bp, Homo sapiens
cagacccctaccct

SEQ ID NO: 6698671 - DNA, 18 bp, Homo sapiens
cagacccctcccctcgtg

SEQ ID NO: 6698672 - DNA, 21 bp, Homo sapiens
cagacccctcccctcgtgtca

SEQ ID NO: 6698673 - DNA, 13 bp, Homo sapiens
cagacccctctca

SEQ ID NO: 6698674 - DNA, 16 bp, Homo sapiens
cagacccctctggcca

SEQ ID NO: 6698675 - DNA, 13 bp, Homo sapiens
cagacccctggct

SEQ ID NO: 6698676 - DNA, 15 bp, Homo sapiens
cagacccctggcttt

SEQ ID NO: 6698677 - DNA, 18 bp, Homo sapiens
cagacccctggcttttca

SEQ ID NO: 6698678 - DNA, 23 bp, Homo sapiens
cagacccctggcttttcactgct

SEQ ID NO: 6698679 - DNA, 13 bp, Homo sapiens
cagacccctggga

SEQ ID NO: 6698680 - DNA, 14 bp, Homo sapiens
cagacccctgtggc

SEQ ID NO: 6698681 - DNA, 17 bp, Homo sapiens
cagaccccttggctttt

SEQ ID NO: 6698682 - DNA, 23 bp, Homo sapiens
cagaccccttggcttttgcttgg

SEQ ID NO: 6698683 - DNA, 12 bp, Homo sapiens
cagacccggctg

SEQ ID NO: 6698684 - DNA, 14 bp, Homo sapiens
cagacccggctgcg

SEQ ID NO: 6698685 - DNA, 16 bp, Homo sapiens
cagacccggctgcgtg

SEQ ID NO: 6698686 - DNA, 14 bp, Homo sapiens
cagaccctccttcc

SEQ ID NO: 6698687 - DNA, 16 bp, Homo sapiens
cagaccctccttcccc

SEQ ID NO: 6698688 - DNA, 18 bp, Homo sapiens
cagaccctgaacccacac

SEQ ID NO: 6698689 - DNA, 20 bp, Homo sapiens
cagaccctgaacccacacct

SEQ ID NO: 6698690 - DNA, 13 bp, Homo sapiens
cagaccctgccag

SEQ ID NO: 6698691 - DNA, 14 bp, Homo sapiens
cagaccctgccagg

SEQ ID NO: 6698692 - DNA, 16 bp, Homo sapiens
cagaccctgccagggg

SEQ ID NO: 6698693 - DNA, 20 bp, Homo sapiens
cagaccctgcccaccccatc

SEQ ID NO: 6698694 - DNA, 16 bp, Homo sapiens
cagaccctgccctgtg

SEQ ID NO: 6698695 - DNA, 13 bp, Homo sapiens
cagaccctgcctg

SEQ ID NO: 6698696 - DNA, 16 bp, Homo sapiens
cagaccctgcctgagc

SEQ ID NO: 6698697 - DNA, 17 bp, Homo sapiens
cagaccctgcctgagcc

SEQ ID NO: 6698698 - DNA, 22 bp, Homo sapiens
cagaccctgggcaaacagagct

SEQ ID NO: 6698699 - DNA, 20 bp, Homo sapiens
cagacccttcttgcctgctg

SEQ ID NO: 6698700 - DNA, 22 bp, Homo sapiens
cagacccttcttgcctgctggg

SEQ ID NO: 6698701 - DNA, 17 bp, Homo sapiens
cagaccgatccttccca

SEQ ID NO: 6698702 - DNA, 13 bp, Homo sapiens
cagaccgccgtct

SEQ ID NO: 6698703 - DNA, 17 bp, Homo sapiens
cagaccgcgcccctggg

SEQ ID NO: 6698704 - DNA, 13 bp, Homo sapiens
cagaccggccgca

SEQ ID NO: 6698705 - DNA, 20 bp, Homo sapiens
cagaccggggttcaagccat

SEQ ID NO: 6698706 - DNA, 22 bp, Homo sapiens
cagaccggggttcaagccatgg

SEQ ID NO: 6698707 - DNA, 20 bp, Homo sapiens
cagaccgtcttcctccaacc

SEQ ID NO: 6698708 - DNA, 21 bp, Homo sapiens
cagacctaaagcaagcctgaa

SEQ ID NO: 6698709 - DNA, 17 bp, Homo sapiens
cagacctaatgctcctt

SEQ ID NO: 6698710 - DNA, 14 bp, Homo sapiens
cagacctagacctg

SEQ ID NO: 6698711 - DNA, 18 bp, Homo sapiens
cagacctagacctgggcc

SEQ ID NO: 6698712 - DNA, 20 bp, Homo sapiens
cagacctagacctgggccaa

SEQ ID NO: 6698713 - DNA, 20 bp, Homo sapiens
cagacctagcaggctgttcc

SEQ ID NO: 6698714 - DNA, 21 bp, Homo sapiens
cagacctagcaggctgttcca

SEQ ID NO: 6698715 - DNA, 22 bp, Homo sapiens
cagacctaggatttcatgattt

SEQ ID NO: 6698716 - DNA, 16 bp, Homo sapiens
cagacctcaagccatc

SEQ ID NO: 6698717 - DNA, 20 bp, Homo sapiens
cagacctcaagggacaggga

SEQ ID NO: 6698718 - DNA, 15 bp, Homo sapiens
cagacctcatgccca

SEQ ID NO: 6698719 - DNA, 17 bp, Homo sapiens
cagacctcatgcccagc

SEQ ID NO: 6698720 - DNA, 15 bp, Homo sapiens
cagacctccccagcc

SEQ ID NO: 6698721 - DNA, 18 bp, Homo sapiens
cagacctccccagcccct

SEQ ID NO: 6698722 - DNA, 21 bp, Homo sapiens
cagacctccccagcccctagc

SEQ ID NO: 6698723 - DNA, 15 bp, Homo sapiens
cagacctcccctctt

SEQ ID NO: 6698724 - DNA, 15 bp, Homo sapiens
cagacctctcccacc

SEQ ID NO: 6698725 - DNA, 20 bp, Homo sapiens
cagacctctgaatgtcccag

SEQ ID NO: 6698726 - DNA, 16 bp, Homo sapiens
cagacctctgcttgga

SEQ ID NO: 6698727 - DNA, 18 bp, Homo sapiens
cagacctcttagagtcct

SEQ ID NO: 6698728 - DNA, 20 bp, Homo sapiens
cagacctgaatgcttctgag

SEQ ID NO: 6698729 - DNA, 22 bp, Homo sapiens
cagacctgaatgcttctgagag

SEQ ID NO: 6698730 - DNA, 12 bp, Homo sapiens
cagacctgacac

SEQ ID NO: 6698731 - DNA, 16 bp, Homo sapiens
cagacctgagctttcc

SEQ ID NO: 6698732 - DNA, 20 bp, Homo sapiens
cagacctgcagacgcccaga

SEQ ID NO: 6698733 - DNA, 16 bp, Homo sapiens
cagacctgcagtgagg

SEQ ID NO: 6698734 - DNA, 22 bp, Homo sapiens
cagacctgcagtgaggggccct

SEQ ID NO: 6698735 - DNA, 21 bp, Homo sapiens
cagacctgcatggtcaagcct

SEQ ID NO: 6698736 - DNA, 16 bp, Homo sapiens
cagacctgcctcttcc

SEQ ID NO: 6698737 - DNA, 20 bp, Homo sapiens
cagacctgcctgtctcccac

SEQ ID NO: 6698738 - DNA, 18 bp, Homo sapiens
cagacctgcgaaggatga

SEQ ID NO: 6698739 - DNA, 19 bp, Homo sapiens
cagacctgcttcctgaaat

SEQ ID NO: 6698740 - DNA, 20 bp, Homo sapiens
cagacctgctttttgaaatg

SEQ ID NO: 6698741 - DNA, 23 bp, Homo sapiens
cagacctgctttttgaaatgaaa

SEQ ID NO: 6698742 - DNA, 16 bp, Homo sapiens
cagacctggaagaaca

SEQ ID NO: 6698743 - DNA, 19 bp, Homo sapiens
cagacctggacactagggt

SEQ ID NO: 6698744 - DNA, 14 bp, Homo sapiens
cagacctggagccc

SEQ ID NO: 6698745 - DNA, 15 bp, Homo sapiens
cagacctggagcccc

SEQ ID NO: 6698746 - DNA, 23 bp, Homo sapiens
cagacctggagcccctgggtggg

SEQ ID NO: 6698747 - DNA, 22 bp, Homo sapiens
cagacctggagcttcagccagg

SEQ ID NO: 6698748 - DNA, 14 bp, Homo sapiens
cagacctggcctct

SEQ ID NO: 6698749 - DNA, 18 bp, Homo sapiens
cagacctggcctctgcca

SEQ ID NO: 6698750 - DNA, 12 bp, Homo sapiens
cagacctggctg

SEQ ID NO: 6698751 - DNA, 20 bp, Homo sapiens
cagacctggctgggcctggg

SEQ ID NO: 6698752 - DNA, 13 bp, Homo sapiens
cagacctgggccc

SEQ ID NO: 6698753 - DNA, 20 bp, Homo sapiens
cagacctgtcaccctgcagg

SEQ ID NO: 6698754 - DNA, 13 bp, Homo sapiens
cagacctgtcctc

SEQ ID NO: 6698755 - DNA, 16 bp, Homo sapiens
cagacctgtcgtctct

SEQ ID NO: 6698756 - DNA, 14 bp, Homo sapiens
cagacctgtcttcc

SEQ ID NO: 6698757 - DNA, 19 bp, Homo sapiens
cagaccttactcaggggat

SEQ ID NO: 6698758 - DNA, 20 bp, Homo sapiens
cagaccttactcaggggatg

SEQ ID NO: 6698759 - DNA, 14 bp, Homo sapiens
cagaccttcacaga

SEQ ID NO: 6698760 - DNA, 22 bp, Homo sapiens
cagaccttcggggcctgtctga

SEQ ID NO: 6698761 - DNA, 21 bp, Homo sapiens
cagaccttctaggacgccacc

SEQ ID NO: 6698762 - DNA, 19 bp, Homo sapiens
cagaccttgttcacactct

SEQ ID NO: 6698763 - DNA, 18 bp, Homo sapiens
cagacctttgtctgaagg

SEQ ID NO: 6698764 - DNA, 19 bp, Homo sapiens
cagacctttgtctgaagga

SEQ ID NO: 6698765 - DNA, 13 bp, Homo sapiens
cagaccttttatc

SEQ ID NO: 6698766 - DNA, 18 bp, Homo sapiens
cagacctttttctctctt

SEQ ID NO: 6698767 - DNA, 14 bp, Homo sapiens
cagacgaaggcaac

SEQ ID NO: 6698768 - DNA, 17 bp, Homo sapiens
cagacgactagcccagg

SEQ ID NO: 6698769 - DNA, 18 bp, Homo sapiens
cagacgactagcccagga

SEQ ID NO: 6698770 - DNA, 19 bp, Homo sapiens
cagacgagacaacagcaca

SEQ ID NO: 6698771 - DNA, 16 bp, Homo sapiens
cagacgagacacccta

SEQ ID NO: 6698772 - DNA, 23 bp, Homo sapiens
cagacgagatcctgtttcagcta

SEQ ID NO: 6698773 - DNA, 14 bp, Homo sapiens
cagacgaggacact

SEQ ID NO: 6698774 - DNA, 17 bp, Homo sapiens
cagacgcacgtgggtct

SEQ ID NO: 6698775 - DNA, 15 bp, Homo sapiens
cagacgcagcagctg

SEQ ID NO: 6698776 - DNA, 17 bp, Homo sapiens
cagacgccacagtctcc

SEQ ID NO: 6698777 - DNA, 23 bp, Homo sapiens
cagacgccggggacagaggcctg

SEQ ID NO: 6698778 - DNA, 19 bp, Homo sapiens
cagacgctcattcagcatc

SEQ ID NO: 6698779 - DNA, 20 bp, Homo sapiens
cagacgctcattcagcatct

SEQ ID NO: 6698780 - DNA, 20 bp, Homo sapiens
cagacggaagggtaaacaat

SEQ ID NO: 6698781 - DNA, 20 bp, Homo sapiens
cagacggacgggacagcggc

SEQ ID NO: 6698782 - DNA, 14 bp, Homo sapiens
cagacggaggactg

SEQ ID NO: 6698783 - DNA, 17 bp, Homo sapiens
cagacggcacccaccca

SEQ ID NO: 6698784 - DNA, 12 bp, Homo sapiens
cagacggcctag

SEQ ID NO: 6698785 - DNA, 13 bp, Homo sapiens
cagacggcggcca

SEQ ID NO: 6698786 - DNA, 17 bp, Homo sapiens
cagacggcggccaggca

SEQ ID NO: 6698787 - DNA, 17 bp, Homo sapiens
cagacgggaatgcctag

SEQ ID NO: 6698788 - DNA, 19 bp, Homo sapiens
cagacgggaatgcctaggt

SEQ ID NO: 6698789 - DNA, 18 bp, Homo sapiens
cagacgggcaagaagctg

SEQ ID NO: 6698790 - DNA, 20 bp, Homo sapiens
cagacgggcaagaagctgct

SEQ ID NO: 6698791 - DNA, 13 bp, Homo sapiens
cagacggggctgg

SEQ ID NO: 6698792 - DNA, 19 bp, Homo sapiens
cagacggggctggagtgtg

SEQ ID NO: 6698793 - DNA, 17 bp, Homo sapiens
cagacgggtctgagact

SEQ ID NO: 6698794 - DNA, 16 bp, Homo sapiens
cagacggtctgtgtgc

SEQ ID NO: 6698795 - DNA, 17 bp, Homo sapiens
cagacggtctgtgtgct

SEQ ID NO: 6698796 - DNA, 20 bp, Homo sapiens
cagacggtctgtgtgctgtt

SEQ ID NO: 6698797 - DNA, 21 bp, Homo sapiens
cagacggtctgtgtgctgttt

SEQ ID NO: 6698798 - DNA, 21 bp, Homo sapiens
cagacgtatattgtatcattt

SEQ ID NO: 6698799 - DNA, 15 bp, Homo sapiens
cagacgtccctccac

SEQ ID NO: 6698800 - DNA, 22 bp, Homo sapiens
cagacgtcgtacccagccatgt

SEQ ID NO: 6698801 - DNA, 14 bp, Homo sapiens
cagacgtctgcctt

SEQ ID NO: 6698802 - DNA, 14 bp, Homo sapiens
cagacgtctggccc

SEQ ID NO: 6698803 - DNA, 21 bp, Homo sapiens
cagacgtctggccctggcggg

SEQ ID NO: 6698804 - DNA, 17 bp, Homo sapiens
cagacgtgaaagccaga

SEQ ID NO: 6698805 - DNA, 17 bp, Homo sapiens
cagacgtgtgacctcca

SEQ ID NO: 6698806 - DNA, 15 bp, Homo sapiens
cagacgttggtccca

SEQ ID NO: 6698807 - DNA, 16 bp, Homo sapiens
cagactaaaaatacac

SEQ ID NO: 6698808 - DNA, 20 bp, Homo sapiens
cagactaaaggatccagaga

SEQ ID NO: 6698809 - DNA, 17 bp, Homo sapiens
cagactaagaaggaaaa

SEQ ID NO: 6698810 - DNA, 20 bp, Homo sapiens
cagactaagaaggaaaagaa

SEQ ID NO: 6698811 - DNA, 15 bp, Homo sapiens
cagactacagccaga

SEQ ID NO: 6698812 - DNA, 19 bp, Homo sapiens
cagactacagccagaagcc

SEQ ID NO: 6698813 - DNA, 23 bp, Homo sapiens
cagactacctgccctcagcttgg

SEQ ID NO: 6698814 - DNA, 16 bp, Homo sapiens
cagactactattttct

SEQ ID NO: 6698815 - DNA, 16 bp, Homo sapiens
cagactagaagtattt

SEQ ID NO: 6698816 - DNA, 22 bp, Homo sapiens
cagactagaattctagtgctgc

SEQ ID NO: 6698817 - DNA, 14 bp, Homo sapiens
cagactagatgtag

SEQ ID NO: 6698818 - DNA, 21 bp, Homo sapiens
cagactagatgtagtattttt

SEQ ID NO: 6698819 - DNA, 22 bp, Homo sapiens
cagactagtttagttaaatgag

SEQ ID NO: 6698820 - DNA, 13 bp, Homo sapiens
cagactatgcagc

SEQ ID NO: 6698821 - DNA, 14 bp, Homo sapiens
cagactatttgcta

SEQ ID NO: 6698822 - DNA, 20 bp, Homo sapiens
cagactatttttagattttc

SEQ ID NO: 6698823 - DNA, 21 bp, Homo sapiens
cagactcaaacggaggaagcc

SEQ ID NO: 6698824 - DNA, 23 bp, Homo sapiens
cagactcaaacggaggaagccca

SEQ ID NO: 6698825 - DNA, 14 bp, Homo sapiens
cagactcaaactca

SEQ ID NO: 6698826 - DNA, 23 bp, Homo sapiens
cagactcaaatgctcagaccagc

SEQ ID NO: 6698827 - DNA, 20 bp, Homo sapiens
cagactcaaggagttggtaa

SEQ ID NO: 6698828 - DNA, 18 bp, Homo sapiens
cagactcaaggggctgga

SEQ ID NO: 6698829 - DNA, 16 bp, Homo sapiens
cagactcacttgccat

SEQ ID NO: 6698830 - DNA, 20 bp, Homo sapiens
cagactcacttgccattgcc

SEQ ID NO: 6698831 - DNA, 23 bp, Homo sapiens
cagactcagagaccgtgagcgcc

SEQ ID NO: 6698832 - DNA, 23 bp, Homo sapiens
cagactcagagctctctctacag

SEQ ID NO: 6698833 - DNA, 14 bp, Homo sapiens
cagactcagaggtc

SEQ ID NO: 6698834 - DNA, 16 bp, Homo sapiens
cagactcagaggtcca

SEQ ID NO: 6698835 - DNA, 20 bp, Homo sapiens
cagactcagaggtccaggcc

SEQ ID NO: 6698836 - DNA, 21 bp, Homo sapiens
cagactcagaggtccaggccc

SEQ ID NO: 6698837 - DNA, 22 bp, Homo sapiens
cagactcagaggtccaggcccc

SEQ ID NO: 6698838 - DNA, 13 bp, Homo sapiens
cagactcagcaga

SEQ ID NO: 6698839 - DNA, 15 bp, Homo sapiens
cagactcagcagagt

SEQ ID NO: 6698840 - DNA, 14 bp, Homo sapiens
cagactcagctcca

SEQ ID NO: 6698841 - DNA, 14 bp, Homo sapiens
cagactcagctctg

SEQ ID NO: 6698842 - DNA, 17 bp, Homo sapiens
cagactcagctgctata

SEQ ID NO: 6698843 - DNA, 16 bp, Homo sapiens
cagactcagtttgtca

SEQ ID NO: 6698844 - DNA, 13 bp, Homo sapiens
cagactcagtttt

SEQ ID NO: 6698845 - DNA, 17 bp, Homo sapiens
cagactcagttttttgt

SEQ ID NO: 6698846 - DNA, 16 bp, Homo sapiens
cagactcatattactg

SEQ ID NO: 6698847 - DNA, 19 bp, Homo sapiens
cagactcatcctgaacagc

SEQ ID NO: 6698848 - DNA, 22 bp, Homo sapiens
cagactcatcctgaacagcatg

SEQ ID NO: 6698849 - DNA, 21 bp, Homo sapiens
cagactccaatggggccagca

SEQ ID NO: 6698850 - DNA, 13 bp, Homo sapiens
cagactccagccc

SEQ ID NO: 6698851 - DNA, 17 bp, Homo sapiens
cagactccagcccctgg

SEQ ID NO: 6698852 - DNA, 18 bp, Homo sapiens
cagactccagcccctgga

SEQ ID NO: 6698853 - DNA, 19 bp, Homo sapiens
cagactccagcccctggac

SEQ ID NO: 6698854 - DNA, 14 bp, Homo sapiens
cagactccaggccc

SEQ ID NO: 6698855 - DNA, 19 bp, Homo sapiens
cagactccatctcttctgc

SEQ ID NO: 6698856 - DNA, 19 bp, Homo sapiens
cagactcccattcctgaag

SEQ ID NO: 6698857 - DNA, 16 bp, Homo sapiens
cagactccgccctcct

SEQ ID NO: 6698858 - DNA, 18 bp, Homo sapiens
cagactccgccctcctcg

SEQ ID NO: 6698859 - DNA, 21 bp, Homo sapiens
cagactccgccctcctcgggc

SEQ ID NO: 6698860 - DNA, 18 bp, Homo sapiens
cagactcctcagatctga

SEQ ID NO: 6698861 - DNA, 14 bp, Homo sapiens
cagactcctccacg

SEQ ID NO: 6698862 - DNA, 13 bp, Homo sapiens
cagactcctgagg

SEQ ID NO: 6698863 - DNA, 12 bp, Homo sapiens
cagactcctggc

SEQ ID NO: 6698864 - DNA, 18 bp, Homo sapiens
cagactccttcaacaatt

SEQ ID NO: 6698865 - DNA, 23 bp, Homo sapiens
cagactccttcaacaattctaaa

SEQ ID NO: 6698866 - DNA, 19 bp, Homo sapiens
cagactcgagagggctgag

SEQ ID NO: 6698867 - DNA, 22 bp, Homo sapiens
cagactcgattcatattgaata

SEQ ID NO: 6698868 - DNA, 19 bp, Homo sapiens
cagactcggaatctatttt

SEQ ID NO: 6698869 - DNA, 22 bp, Homo sapiens
cagactcgttctcgtgacccag

SEQ ID NO: 6698870 - DNA, 21 bp, Homo sapiens
cagactctacagaggccatgg

SEQ ID NO: 6698871 - DNA, 19 bp, Homo sapiens
cagactctaggttatacaa

SEQ ID NO: 6698872 - DNA, 18 bp, Homo sapiens
cagactctcagcccagaa

SEQ ID NO: 6698873 - DNA, 12 bp, Homo sapiens
cagactctcagg

SEQ ID NO: 6698874 - DNA, 22 bp, Homo sapiens
cagactctctcctctctctccc

SEQ ID NO: 6698875 - DNA, 12 bp, Homo sapiens
cagactctctgt

SEQ ID NO: 6698876 - DNA, 18 bp, Homo sapiens
cagactctgctagtgaaa

SEQ ID NO: 6698877 - DNA, 22 bp, Homo sapiens
cagactctgctagtgaaaagaa

SEQ ID NO: 6698878 - DNA, 14 bp, Homo sapiens
cagactctggtctt

SEQ ID NO: 6698879 - DNA, 19 bp, Homo sapiens
cagactcttccaccagagc

SEQ ID NO: 6698880 - DNA, 23 bp, Homo sapiens
cagactctttttgtacctggtga

SEQ ID NO: 6698881 - DNA, 23 bp, Homo sapiens
cagactctttttttgagtgacag

SEQ ID NO: 6698882 - DNA, 17 bp, Homo sapiens
cagactgaactcgcagg

SEQ ID NO: 6698883 - DNA, 20 bp, Homo sapiens
cagactgaacttaccgtgag

SEQ ID NO: 6698884 - DNA, 20 bp, Homo sapiens
cagactgacaaatgtgtatc

SEQ ID NO: 6698885 - DNA, 15 bp, Homo sapiens
cagactgacactact

SEQ ID NO: 6698886 - DNA, 22 bp, Homo sapiens
cagactgaccttgatgagctgt

SEQ ID NO: 6698887 - DNA, 14 bp, Homo sapiens
cagactgagctctc

SEQ ID NO: 6698888 - DNA, 15 bp, Homo sapiens
cagactgagctctcc

SEQ ID NO: 6698889 - DNA, 14 bp, Homo sapiens
cagactgaggcctt

SEQ ID NO: 6698890 - DNA, 17 bp, Homo sapiens
cagactgatagacacca

SEQ ID NO: 6698891 - DNA, 18 bp, Homo sapiens
cagactgatgagcacatc

SEQ ID NO: 6698892 - DNA, 12 bp, Homo sapiens
cagactgcagac

SEQ ID NO: 6698893 - DNA, 22 bp, Homo sapiens
cagactgcagacattctcaaag

SEQ ID NO: 6698894 - DNA, 23 bp, Homo sapiens
cagactgcagaggggaaagactt

SEQ ID NO: 6698895 - DNA, 12 bp, Homo sapiens
cagactgcaggt

SEQ ID NO: 6698896 - DNA, 15 bp, Homo sapiens
cagactgcaggttgg

SEQ ID NO: 6698897 - DNA, 15 bp, Homo sapiens
cagactgccaaagaa

SEQ ID NO: 6698898 - DNA, 14 bp, Homo sapiens
cagactgccccagc

SEQ ID NO: 6698899 - DNA, 17 bp, Homo sapiens
cagactgccccagccaa

SEQ ID NO: 6698900 - DNA, 18 bp, Homo sapiens
cagactgccccagccaac

SEQ ID NO: 6698901 - DNA, 15 bp, Homo sapiens
cagactgcctgtctg

SEQ ID NO: 6698902 - DNA, 17 bp, Homo sapiens
cagactgcctgtctgct

SEQ ID NO: 6698903 - DNA, 17 bp, Homo sapiens
cagactgcggagcagcc

SEQ ID NO: 6698904 - DNA, 20 bp, Homo sapiens
cagactgcggagcagcctcc

SEQ ID NO: 6698905 - DNA, 22 bp, Homo sapiens
cagactgcggagcagcctccag

SEQ ID NO: 6698906 - DNA, 16 bp, Homo sapiens
cagactgctgggactg

SEQ ID NO: 6698907 - DNA, 20 bp, Homo sapiens
cagactgctgtcttactaat

SEQ ID NO: 6698908 - DNA, 14 bp, Homo sapiens
cagactgcttccaa

SEQ ID NO: 6698909 - DNA, 21 bp, Homo sapiens
cagactggaagacacttcaga

SEQ ID NO: 6698910 - DNA, 13 bp, Homo sapiens
cagactggaagca

SEQ ID NO: 6698911 - DNA, 18 bp, Homo sapiens
cagactggaagcacagct

SEQ ID NO: 6698912 - DNA, 21 bp, Homo sapiens
cagactggaagcacagcttca

SEQ ID NO: 6698913 - DNA, 19 bp, Homo sapiens
cagactggcaataaactcc

SEQ ID NO: 6698914 - DNA, 17 bp, Homo sapiens
cagactggcacagtttt

SEQ ID NO: 6698915 - DNA, 22 bp, Homo sapiens
cagactggcacagttttctgag

SEQ ID NO: 6698916 - DNA, 20 bp, Homo sapiens
cagactggcggagaaggaga

SEQ ID NO: 6698917 - DNA, 14 bp, Homo sapiens
cagactggctgcac

SEQ ID NO: 6698918 - DNA, 17 bp, Homo sapiens
cagactggctgcacagc

SEQ ID NO: 6698919 - DNA, 18 bp, Homo sapiens
cagactggctgcacagcc

SEQ ID NO: 6698920 - DNA, 16 bp, Homo sapiens
cagactggctggctgc

SEQ ID NO: 6698921 - DNA, 18 bp, Homo sapiens
cagactgggaacagggcc

SEQ ID NO: 6698922 - DNA, 18 bp, Homo sapiens
cagactgggcactggggc

SEQ ID NO: 6698923 - DNA, 19 bp, Homo sapiens
cagactgggcactggggcc

SEQ ID NO: 6698924 - DNA, 15 bp, Homo sapiens
cagactgggcccagg

SEQ ID NO: 6698925 - DNA, 17 bp, Homo sapiens
cagactgggcccaggca

SEQ ID NO: 6698926 - DNA, 23 bp, Homo sapiens
cagactgggcccaggcaggtctg

SEQ ID NO: 6698927 - DNA, 18 bp, Homo sapiens
cagactggggcatcctgt

SEQ ID NO: 6698928 - DNA, 18 bp, Homo sapiens
cagactgggtttctagcc

SEQ ID NO: 6698929 - DNA, 20 bp, Homo sapiens
cagactggtgttaatgagta

SEQ ID NO: 6698930 - DNA, 22 bp, Homo sapiens
cagactggtgttaatgagtata

SEQ ID NO: 6698931 - DNA, 23 bp, Homo sapiens
cagactggttgagttcaggtagc

SEQ ID NO: 6698932 - DNA, 19 bp, Homo sapiens
cagactggtttgggcaagc

SEQ ID NO: 6698933 - DNA, 23 bp, Homo sapiens
cagactgtaagatgttgttttag

SEQ ID NO: 6698934 - DNA, 13 bp, Homo sapiens
cagactgtccagg

SEQ ID NO: 6698935 - DNA, 15 bp, Homo sapiens
cagactgtccaggga

SEQ ID NO: 6698936 - DNA, 14 bp, Homo sapiens
cagactgtggctgc

SEQ ID NO: 6698937 - DNA, 21 bp, Homo sapiens
cagactgtgggtccctgcgtc

SEQ ID NO: 6698938 - DNA, 23 bp, Homo sapiens
cagactgtgtttaactgctgcag

SEQ ID NO: 6698939 - DNA, 16 bp, Homo sapiens
cagactgttaattata

SEQ ID NO: 6698940 - DNA, 22 bp, Homo sapiens
cagactgttccctccaaggtcc

SEQ ID NO: 6698941 - DNA, 15 bp, Homo sapiens
cagactgttgagtta

SEQ ID NO: 6698942 - DNA, 14 bp, Homo sapiens
cagacttaccagga

SEQ ID NO: 6698943 - DNA, 18 bp, Homo sapiens
cagacttaccaggaagca

SEQ ID NO: 6698944 - DNA, 14 bp, Homo sapiens
cagacttagaacct

SEQ ID NO: 6698945 - DNA, 21 bp, Homo sapiens
cagacttagtttttataaaat

SEQ ID NO: 6698946 - DNA, 15 bp, Homo sapiens
cagacttcacacagc

SEQ ID NO: 6698947 - DNA, 14 bp, Homo sapiens
cagacttcacactg

SEQ ID NO: 6698948 - DNA, 19 bp, Homo sapiens
cagacttcacagcgtctgc

SEQ ID NO: 6698949 - DNA, 21 bp, Homo sapiens
cagacttccaaatcctggaag

SEQ ID NO: 6698950 - DNA, 15 bp, Homo sapiens
cagacttctaaaata

SEQ ID NO: 6698951 - DNA, 23 bp, Homo sapiens
cagacttctattttttaaagact

SEQ ID NO: 6698952 - DNA, 20 bp, Homo sapiens
cagacttctccagacccacc

SEQ ID NO: 6698953 - DNA, 17 bp, Homo sapiens
cagacttctctttctta

SEQ ID NO: 6698954 - DNA, 23 bp, Homo sapiens
cagacttctggaaggctggctga

SEQ ID NO: 6698955 - DNA, 21 bp, Homo sapiens
cagacttcttaaaaggagctc

SEQ ID NO: 6698956 - DNA, 13 bp, Homo sapiens
cagacttgagaac

SEQ ID NO: 6698957 - DNA, 13 bp, Homo sapiens
cagacttgattta

SEQ ID NO: 6698958 - DNA, 14 bp, Homo sapiens
cagacttgatttac

SEQ ID NO: 6698959 - DNA, 14 bp, Homo sapiens
cagacttgcactgg

SEQ ID NO: 6698960 - DNA, 18 bp, Homo sapiens
cagacttgccatgtgact

SEQ ID NO: 6698961 - DNA, 14 bp, Homo sapiens
cagacttgcggcca

SEQ ID NO: 6698962 - DNA, 17 bp, Homo sapiens
cagacttgcggccacag

SEQ ID NO: 6698963 - DNA, 19 bp, Homo sapiens
cagacttgcggccacagca

SEQ ID NO: 6698964 - DNA, 15 bp, Homo sapiens
cagacttggcctcca

SEQ ID NO: 6698965 - DNA, 19 bp, Homo sapiens
cagacttggcctccagctg

SEQ ID NO: 6698966 - DNA, 23 bp, Homo sapiens
cagacttgtatattctattttac

SEQ ID NO: 6698967 - DNA, 13 bp, Homo sapiens
cagacttgtcaag

SEQ ID NO: 6698968 - DNA, 19 bp, Homo sapiens
cagacttgttctcagagca

SEQ ID NO: 6698969 - DNA, 15 bp, Homo sapiens
cagactttaaagaat

SEQ ID NO: 6698970 - DNA, 20 bp, Homo sapiens
cagactttacatgacacagc

SEQ ID NO: 6698971 - DNA, 18 bp, Homo sapiens
cagactttagtgccctgc

SEQ ID NO: 6698972 - DNA, 20 bp, Homo sapiens
cagactttagtgccctgccc

SEQ ID NO: 6698973 - DNA, 22 bp, Homo sapiens
cagactttagtgccctgccccc

SEQ ID NO: 6698974 - DNA, 15 bp, Homo sapiens
cagactttcacacca

SEQ ID NO: 6698975 - DNA, 18 bp, Homo sapiens
cagactttcagccgactc

SEQ ID NO: 6698976 - DNA, 19 bp, Homo sapiens
cagactttcccaaatgtat

SEQ ID NO: 6698977 - DNA, 20 bp, Homo sapiens
cagactttctacatgcaaat

SEQ ID NO: 6698978 - DNA, 21 bp, Homo sapiens
cagactttctattaatattta

SEQ ID NO: 6698979 - DNA, 12 bp, Homo sapiens
cagactttctgt

SEQ ID NO: 6698980 - DNA, 19 bp, Homo sapiens
cagactttctttttctaca

SEQ ID NO: 6698981 - DNA, 20 bp, Homo sapiens
cagactttctttttctacat

SEQ ID NO: 6698982 - DNA, 15 bp, Homo sapiens
cagactttgagcctg

SEQ ID NO: 6698983 - DNA, 19 bp, Homo sapiens
cagactttgagcctgcatc

SEQ ID NO: 6698984 - DNA, 22 bp, Homo sapiens
cagactttggaaaatgcattgt

SEQ ID NO: 6698985 - DNA, 13 bp, Homo sapiens
cagacttttgctt

SEQ ID NO: 6698986 - DNA, 23 bp, Homo sapiens
cagacttttgcttaccttttcct

SEQ ID NO: 6698987 - DNA, 15 bp, Homo sapiens
cagacttttgtacat

SEQ ID NO: 6698988 - DNA, 16 bp, Homo sapiens
cagacttttgtacatc

SEQ ID NO: 6698989 - DNA, 12 bp, Homo sapiens
cagagaaaaagg

SEQ ID NO: 6698990 - DNA, 14 bp, Homo sapiens
cagagaaaacactt

SEQ ID NO: 6698991 - DNA, 21 bp, Homo sapiens
cagagaaaacactttcctgga

SEQ ID NO: 6698992 - DNA, 23 bp, Homo sapiens
cagagaaaacactttcctggata

SEQ ID NO: 6698993 - DNA, 13 bp, Homo sapiens
cagagaaaactgt

SEQ ID NO: 6698994 - DNA, 15 bp, Homo sapiens
cagagaaaactgttg

SEQ ID NO: 6698995 - DNA, 15 bp, Homo sapiens
cagagaaaacttgcc

SEQ ID NO: 6698996 - DNA, 18 bp, Homo sapiens
cagagaaaatgaatttgg

SEQ ID NO: 6698997 - DNA, 15 bp, Homo sapiens
cagagaaaatgctgc

SEQ ID NO: 6698998 - DNA, 15 bp, Homo sapiens
cagagaaaccagctt

SEQ ID NO: 6698999 - DNA, 17 bp, Homo sapiens
cagagaaaccagcttcc

SEQ ID NO: 6699000 - DNA, 18 bp, Homo sapiens
cagagaaaccagcttcct

SEQ ID NO: 6699001 - DNA, 21 bp, Homo sapiens
cagagaaaccagcttccttca

SEQ ID NO: 6699002 - DNA, 9 bp, Homo sapiens
cagagaaag

SEQ ID NO: 6699003 - DNA, 13 bp, Homo sapiens
cagagaaagaaaa

SEQ ID NO: 6699004 - DNA, 20 bp, Homo sapiens
cagagaaagaagagacagga

SEQ ID NO: 6699005 - DNA, 17 bp, Homo sapiens
cagagaaagaggaagct

SEQ ID NO: 6699006 - DNA, 16 bp, Homo sapiens
cagagaaagcaaaggt

SEQ ID NO: 6699007 - DNA, 19 bp, Homo sapiens
cagagaaagtacttctcca

SEQ ID NO: 6699008 - DNA, 20 bp, Homo sapiens
cagagaaagttggtgctgct

SEQ ID NO: 6699009 - DNA, 16 bp, Homo sapiens
cagagaaatacaaaat

SEQ ID NO: 6699010 - DNA, 19 bp, Homo sapiens
cagagaaatatgcagaagg

SEQ ID NO: 6699011 - DNA, 16 bp, Homo sapiens
cagagaaatgccccag

SEQ ID NO: 6699012 - DNA, 16 bp, Homo sapiens
cagagaaatgtctgtc

SEQ ID NO: 6699013 - DNA, 21 bp, Homo sapiens
cagagaaatttagagctaaaa

SEQ ID NO: 6699014 - DNA, 20 bp, Homo sapiens
cagagaacaatcactattct

SEQ ID NO: 6699015 - DNA, 17 bp, Homo sapiens
cagagaacacagggctg

SEQ ID NO: 6699016 - DNA, 11 bp, Homo sapiens
cagagaaccat

SEQ ID NO: 6699017 - DNA, 21 bp, Homo sapiens
cagagaaccatcaaggcggga

SEQ ID NO: 6699018 - DNA, 22 bp, Homo sapiens
cagagaacctgagttcccggga

SEQ ID NO: 6699019 - DNA, 19 bp, Homo sapiens
cagagaacctgtgggctga

SEQ ID NO: 6699020 - DNA, 16 bp, Homo sapiens
cagagaacctttagaa

SEQ ID NO: 6699021 - DNA, 18 bp, Homo sapiens
cagagaactaacactatt

SEQ ID NO: 6699022 - DNA, 17 bp, Homo sapiens
cagagaactagtggtgg

SEQ ID NO: 6699023 - DNA, 20 bp, Homo sapiens
cagagaactgacatgcaggt

SEQ ID NO: 6699024 - DNA, 19 bp, Homo sapiens
cagagaactgcagacctca

SEQ ID NO: 6699025 - DNA, 18 bp, Homo sapiens
cagagaagaaaaacgtga

SEQ ID NO: 6699026 - DNA, 18 bp, Homo sapiens
cagagaagaaagaacgga

SEQ ID NO: 6699027 - DNA, 23 bp, Homo sapiens
cagagaagagaccaagcttgttt

SEQ ID NO: 6699028 - DNA, 21 bp, Homo sapiens
cagagaagattcttgtattta

SEQ ID NO: 6699029 - DNA, 13 bp, Homo sapiens
cagagaagcagca

SEQ ID NO: 6699030 - DNA, 17 bp, Homo sapiens
cagagaagcagcatcaa

SEQ ID NO: 6699031 - DNA, 12 bp, Homo sapiens
cagagaagccag

SEQ ID NO: 6699032 - DNA, 15 bp, Homo sapiens
cagagaagccagctt

SEQ ID NO: 6699033 - DNA, 17 bp, Homo sapiens
cagagaagccagcttgt

SEQ ID NO: 6699034 - DNA, 14 bp, Homo sapiens
cagagaagccatca

SEQ ID NO: 6699035 - DNA, 21 bp, Homo sapiens
cagagaagccatcacctcaga

SEQ ID NO: 6699036 - DNA, 20 bp, Homo sapiens
cagagaagccccgcacgggc

SEQ ID NO: 6699037 - DNA, 21 bp, Homo sapiens
cagagaagccccgcacgggct

SEQ ID NO: 6699038 - DNA, 17 bp, Homo sapiens
cagagaagccccttccc

SEQ ID NO: 6699039 - DNA, 23 bp, Homo sapiens
cagagaagcctcagtccctccct

SEQ ID NO: 6699040 - DNA, 13 bp, Homo sapiens
cagagaagccttc

SEQ ID NO: 6699041 - DNA, 20 bp, Homo sapiens
cagagaagccttcaagctct

SEQ ID NO: 6699042 - DNA, 23 bp, Homo sapiens
cagagaagccttcaagctctgag

SEQ ID NO: 6699043 - DNA, 21 bp, Homo sapiens
cagagaagctataaattcctc

SEQ ID NO: 6699044 - DNA, 13 bp, Homo sapiens
cagagaagctcct

SEQ ID NO: 6699045 - DNA, 16 bp, Homo sapiens
cagagaagctcctgct

SEQ ID NO: 6699046 - DNA, 19 bp, Homo sapiens
cagagaagctctcgggcta

SEQ ID NO: 6699047 - DNA, 13 bp, Homo sapiens
cagagaagctgga

SEQ ID NO: 6699048 - DNA, 14 bp, Homo sapiens
cagagaagctggac

SEQ ID NO: 6699049 - DNA, 22 bp, Homo sapiens
cagagaagctggacttctgtgg

SEQ ID NO: 6699050 - DNA, 23 bp, Homo sapiens
cagagaaggacggtgccaagggc

SEQ ID NO: 6699051 - DNA, 15 bp, Homo sapiens
cagagaaggcagcag

SEQ ID NO: 6699052 - DNA, 14 bp, Homo sapiens
cagagaaggcctct

SEQ ID NO: 6699053 - DNA, 21 bp, Homo sapiens
cagagaaggcctcttgtgctc

SEQ ID NO: 6699054 - DNA, 16 bp, Homo sapiens
cagagaaggcttcctc

SEQ ID NO: 6699055 - DNA, 17 bp, Homo sapiens
cagagaagtacaggtca

SEQ ID NO: 6699056 - DNA, 16 bp, Homo sapiens
cagagaagtcagttgg

SEQ ID NO: 6699057 - DNA, 23 bp, Homo sapiens
cagagaagtctggtcagagccac

SEQ ID NO: 6699058 - DNA, 14 bp, Homo sapiens
cagagaagtgacag

SEQ ID NO: 6699059 - DNA, 18 bp, Homo sapiens
cagagaagtgacagggaa

SEQ ID NO: 6699060 - DNA, 24 bp, Homo sapiens
cagagaagtgacagggaagctaca

SEQ ID NO: 6699061 - DNA, 11 bp, Homo sapiens
cagagaagttc

SEQ ID NO: 6699062 - DNA, 22 bp, Homo sapiens
cagagaagttctcaaagttaat

SEQ ID NO: 6699063 - DNA, 13 bp, Homo sapiens
cagagaatcaggg

SEQ ID NO: 6699064 - DNA, 16 bp, Homo sapiens
cagagaatctcttggg

SEQ ID NO: 6699065 - DNA, 18 bp, Homo sapiens
cagagaatctgaagctat

SEQ ID NO: 6699066 - DNA, 14 bp, Homo sapiens
cagagaatggctgg

SEQ ID NO: 6699067 - DNA, 19 bp, Homo sapiens
cagagaatgggtaattcaa

SEQ ID NO: 6699068 - DNA, 15 bp, Homo sapiens
cagagaattatctca

SEQ ID NO: 6699069 - DNA, 15 bp, Homo sapiens
cagagaattctctta

SEQ ID NO: 6699070 - DNA, 14 bp, Homo sapiens
cagagaattcttag

SEQ ID NO: 6699071 - DNA, 15 bp, Homo sapiens
cagagaatttctacc

SEQ ID NO: 6699072 - DNA, 22 bp, Homo sapiens
cagagaatttctaccatttcag

SEQ ID NO: 6699073 - DNA, 23 bp, Homo sapiens
cagagaatttctaccatttcaga

SEQ ID NO: 6699074 - DNA, 20 bp, Homo sapiens
cagagacaaggagggcacag

SEQ ID NO: 6699075 - DNA, 22 bp, Homo sapiens
cagagacaaggtcacctgggct

SEQ ID NO: 6699076 - DNA, 15 bp, Homo sapiens
cagagacaagtaatt

SEQ ID NO: 6699077 - DNA, 14 bp, Homo sapiens
cagagacacaagcc

SEQ ID NO: 6699078 - DNA, 17 bp, Homo sapiens
cagagacacaagccttc

SEQ ID NO: 6699079 - DNA, 15 bp, Homo sapiens
cagagacacctgcac

SEQ ID NO: 6699080 - DNA, 16 bp, Homo sapiens
cagagacacctgcacc

SEQ ID NO: 6699081 - DNA, 22 bp, Homo sapiens
cagagacacctgcacctccccc

SEQ ID NO: 6699082 - DNA, 20 bp, Homo sapiens
cagagacactgagccagtct

SEQ ID NO: 6699083 - DNA, 23 bp, Homo sapiens
cagagacactttgtctagtgtat

SEQ ID NO: 6699084 - DNA, 22 bp, Homo sapiens
cagagacagaccccttggcttt

SEQ ID NO: 6699085 - DNA, 14 bp, Homo sapiens
cagagacagagagg

SEQ ID NO: 6699086 - DNA, 15 bp, Homo sapiens
cagagacagaggatg

SEQ ID NO: 6699087 - DNA, 24 bp, Homo sapiens
cagagacagctgtttgaattggac

SEQ ID NO: 6699088 - DNA, 22 bp, Homo sapiens
cagagacaggaaaatcctctgg

SEQ ID NO: 6699089 - DNA, 17 bp, Homo sapiens
cagagacaggaaagaat

SEQ ID NO: 6699090 - DNA, 22 bp, Homo sapiens
cagagacaggaagtcttcaggg

SEQ ID NO: 6699091 - DNA, 14 bp, Homo sapiens
cagagacaggccca

SEQ ID NO: 6699092 - DNA, 19 bp, Homo sapiens
cagagacaggcccaagaga

SEQ ID NO: 6699093 - DNA, 23 bp, Homo sapiens
cagagacaggcccaagagatgaa

SEQ ID NO: 6699094 - DNA, 21 bp, Homo sapiens
cagagacaggtggcctagcag

SEQ ID NO: 6699095 - DNA, 10 bp, Homo sapiens
cagagacagt

SEQ ID NO: 6699096 - DNA, 15 bp, Homo sapiens
cagagacagtgggca

SEQ ID NO: 6699097 - DNA, 16 bp, Homo sapiens
cagagacagtgggcac

SEQ ID NO: 6699098 - DNA, 10 bp, Homo sapiens
cagagacata

SEQ ID NO: 6699099 - DNA, 17 bp, Homo sapiens
cagagacatacttgaag

SEQ ID NO: 6699100 - DNA, 17 bp, Homo sapiens
cagagacatcagccctt

SEQ ID NO: 6699101 - DNA, 14 bp, Homo sapiens
cagagacatgggag

SEQ ID NO: 6699102 - DNA, 16 bp, Homo sapiens
cagagacatgggcctc

SEQ ID NO: 6699103 - DNA, 18 bp, Homo sapiens
cagagacatgtggcagca

SEQ ID NO: 6699104 - DNA, 23 bp, Homo sapiens
cagagaccaaataattaaaagaa

SEQ ID NO: 6699105 - DNA, 16 bp, Homo sapiens
cagagaccaccgcgcc

SEQ ID NO: 6699106 - DNA, 17 bp, Homo sapiens
cagagaccaccgcgccc

SEQ ID NO: 6699107 - DNA, 18 bp, Homo sapiens
cagagaccagcactcagc

SEQ ID NO: 6699108 - DNA, 16 bp, Homo sapiens
cagagaccaggccctg

SEQ ID NO: 6699109 - DNA, 22 bp, Homo sapiens
cagagaccaggccctggctaag

SEQ ID NO: 6699110 - DNA, 17 bp, Homo sapiens
cagagaccatccctgaa

SEQ ID NO: 6699111 - DNA, 21 bp, Homo sapiens
cagagaccatccctgaaggcc

SEQ ID NO: 6699112 - DNA, 20 bp, Homo sapiens
cagagacccaacagcagtga

SEQ ID NO: 6699113 - DNA, 14 bp, Homo sapiens
cagagacccagatc

SEQ ID NO: 6699114 - DNA, 12 bp, Homo sapiens
cagagacccagc

SEQ ID NO: 6699115 - DNA, 13 bp, Homo sapiens
cagagacccagcg

SEQ ID NO: 6699116 - DNA, 15 bp, Homo sapiens
cagagacccccgtgc

SEQ ID NO: 6699117 - DNA, 21 bp, Homo sapiens
cagagaccccttcctttcctc

SEQ ID NO: 6699118 - DNA, 20 bp, Homo sapiens
cagagaccgtcctcacccct

SEQ ID NO: 6699119 - DNA, 11 bp, Homo sapiens
cagagacctca

SEQ ID NO: 6699120 - DNA, 18 bp, Homo sapiens
cagagacctcatcagcct

SEQ ID NO: 6699121 - DNA, 13 bp, Homo sapiens
cagagacctccaa

SEQ ID NO: 6699122 - DNA, 15 bp, Homo sapiens
cagagacctccaata

SEQ ID NO: 6699123 - DNA, 16 bp, Homo sapiens
cagagacctcctgcct

SEQ ID NO: 6699124 - DNA, 14 bp, Homo sapiens
cagagacctgctcc

SEQ ID NO: 6699125 - DNA, 20 bp, Homo sapiens
cagagacctgctccagatcc

SEQ ID NO: 6699126 - DNA, 18 bp, Homo sapiens
cagagaccttaatttata

SEQ ID NO: 6699127 - DNA, 14 bp, Homo sapiens
cagagaccttgcga

SEQ ID NO: 6699128 - DNA, 13 bp, Homo sapiens
cagagacctttgc

SEQ ID NO: 6699129 - DNA, 18 bp, Homo sapiens
cagagacctttgcccaca

SEQ ID NO: 6699130 - DNA, 19 bp, Homo sapiens
cagagacctttgcccacac

SEQ ID NO: 6699131 - DNA, 14 bp, Homo sapiens
cagagacctttgtt

SEQ ID NO: 6699132 - DNA, 19 bp, Homo sapiens
cagagaccttttctctccc

SEQ ID NO: 6699133 - DNA, 21 bp, Homo sapiens
cagagaccttttctctcccat

SEQ ID NO: 6699134 - DNA, 22 bp, Homo sapiens
cagagaccttttctctcccata

SEQ ID NO: 6699135 - DNA, 12 bp, Homo sapiens
cagagacgccca

SEQ ID NO: 6699136 - DNA, 15 bp, Homo sapiens
cagagacgcccagcc

SEQ ID NO: 6699137 - DNA, 16 bp, Homo sapiens
cagagacgcccagccc

SEQ ID NO: 6699138 - DNA, 17 bp, Homo sapiens
cagagacgcccagcccc

SEQ ID NO: 6699139 - DNA, 18 bp, Homo sapiens
cagagacgcccagcccca

SEQ ID NO: 6699140 - DNA, 20 bp, Homo sapiens
cagagacgcccagccccatc

SEQ ID NO: 6699141 - DNA, 23 bp, Homo sapiens
cagagacgcccagccccatccct

SEQ ID NO: 6699142 - DNA, 14 bp, Homo sapiens
cagagacggcagaa

SEQ ID NO: 6699143 - DNA, 15 bp, Homo sapiens
cagagacggcagccc

SEQ ID NO: 6699144 - DNA, 18 bp, Homo sapiens
cagagacggcagccccat

SEQ ID NO: 6699145 - DNA, 16 bp, Homo sapiens
cagagactaatgttgg

SEQ ID NO: 6699146 - DNA, 22 bp, Homo sapiens
cagagactcagatgaggacaga

SEQ ID NO: 6699147 - DNA, 18 bp, Homo sapiens
cagagactcagcgctcct

SEQ ID NO: 6699148 - DNA, 23 bp, Homo sapiens
cagagactcagggccccagcact

SEQ ID NO: 6699149 - DNA, 23 bp, Homo sapiens
cagagactcatttcacagccttt

SEQ ID NO: 6699150 - DNA, 14 bp, Homo sapiens
cagagactcctgca

SEQ ID NO: 6699151 - DNA, 15 bp, Homo sapiens
cagagactcctgcag

SEQ ID NO: 6699152 - DNA, 16 bp, Homo sapiens
cagagactcctgcagg

SEQ ID NO: 6699153 - DNA, 17 bp, Homo sapiens
cagagactcctgcaggc

SEQ ID NO: 6699154 - DNA, 19 bp, Homo sapiens
cagagactcctgcaggcag

SEQ ID NO: 6699155 - DNA, 22 bp, Homo sapiens
cagagactcctgcaggcagcca

SEQ ID NO: 6699156 - DNA, 14 bp, Homo sapiens
cagagactctattt

SEQ ID NO: 6699157 - DNA, 10 bp, Homo sapiens
cagagactgc

SEQ ID NO: 6699158 - DNA, 16 bp, Homo sapiens
cagagactgcaagctg

SEQ ID NO: 6699159 - DNA, 18 bp, Homo sapiens
cagagactgcaagctgct

SEQ ID NO: 6699160 - DNA, 19 bp, Homo sapiens
cagagactgcccaccctgg

SEQ ID NO: 6699161 - DNA, 17 bp, Homo sapiens
cagagactgcccttctc

SEQ ID NO: 6699162 - DNA, 19 bp, Homo sapiens
cagagactgcccttctcac

SEQ ID NO: 6699163 - DNA, 13 bp, Homo sapiens
cagagactggcag

SEQ ID NO: 6699164 - DNA, 18 bp, Homo sapiens
cagagactggcagccagg

SEQ ID NO: 6699165 - DNA, 22 bp, Homo sapiens
cagagactggcagccagggagc

SEQ ID NO: 6699166 - DNA, 18 bp, Homo sapiens
cagagactggggcctgga

SEQ ID NO: 6699167 - DNA, 12 bp, Homo sapiens
cagagacttcta

SEQ ID NO: 6699168 - DNA, 22 bp, Homo sapiens
cagagacttctaggaggatgct

SEQ ID NO: 6699169 - DNA, 15 bp, Homo sapiens
cagagacttgggaca

SEQ ID NO: 6699170 - DNA, 20 bp, Homo sapiens
cagagacttggggaccagag

SEQ ID NO: 6699171 - DNA, 13 bp, Homo sapiens
cagagagaaaaag

SEQ ID NO: 6699172 - DNA, 18 bp, Homo sapiens
cagagagaaaaagagaga

SEQ ID NO: 6699173 - DNA, 16 bp, Homo sapiens
cagagagaaaaagatt

SEQ ID NO: 6699174 - DNA, 11 bp, Homo sapiens
cagagagaaac

SEQ ID NO: 6699175 - DNA, 19 bp, Homo sapiens
cagagagaaatcaggcctg

SEQ ID NO: 6699176 - DNA, 16 bp, Homo sapiens
cagagagaaccaggag

SEQ ID NO: 6699177 - DNA, 11 bp, Homo sapiens
cagagagacag

SEQ ID NO: 6699178 - DNA, 16 bp, Homo sapiens
cagagagacagaccgg

SEQ ID NO: 6699179 - DNA, 15 bp, Homo sapiens
cagagagacagactt

SEQ ID NO: 6699180 - DNA, 17 bp, Homo sapiens
cagagagacagacttga

SEQ ID NO: 6699181 - DNA, 18 bp, Homo sapiens
cagagagacagacttgag

SEQ ID NO: 6699182 - DNA, 22 bp, Homo sapiens
cagagagacagacttgagaact

SEQ ID NO: 6699183 - DNA, 14 bp, Homo sapiens
cagagagaccgagg

SEQ ID NO: 6699184 - DNA, 21 bp, Homo sapiens
cagagagagaagtgcccctgc

SEQ ID NO: 6699185 - DNA, 13 bp, Homo sapiens
cagagagagacag

SEQ ID NO: 6699186 - DNA, 13 bp, Homo sapiens
cagagagagactg

SEQ ID NO: 6699187 - DNA, 21 bp, Homo sapiens
cagagagagactgagggagag

SEQ ID NO: 6699188 - DNA, 17 bp, Homo sapiens
cagagagagagaatgga

SEQ ID NO: 6699189 - DNA, 17 bp, Homo sapiens
cagagagagaggacaga

SEQ ID NO: 6699190 - DNA, 21 bp, Homo sapiens
cagagagagaggacagagggg

SEQ ID NO: 6699191 - DNA, 22 bp, Homo sapiens
cagagagaggcgtcctggtgag

SEQ ID NO: 6699192 - DNA, 18 bp, Homo sapiens
cagagagaggggcctgca

SEQ ID NO: 6699193 - DNA, 12 bp, Homo sapiens
cagagagagtgt

SEQ ID NO: 6699194 - DNA, 23 bp, Homo sapiens
cagagagagttgacccctcctga

SEQ ID NO: 6699195 - DNA, 22 bp, Homo sapiens
cagagagatcttcccataataa

SEQ ID NO: 6699196 - DNA, 20 bp, Homo sapiens
cagagagcaactctgagatc

SEQ ID NO: 6699197 - DNA, 16 bp, Homo sapiens
cagagagcaggcaggg

SEQ ID NO: 6699198 - DNA, 14 bp, Homo sapiens
cagagagcagggga

SEQ ID NO: 6699199 - DNA, 11 bp, Homo sapiens
cagagagcagt

SEQ ID NO: 6699200 - DNA, 17 bp, Homo sapiens
cagagagcagtgctttt

SEQ ID NO: 6699201 - DNA, 15 bp, Homo sapiens
cagagagcatctttc

SEQ ID NO: 6699202 - DNA, 13 bp, Homo sapiens
cagagagccaaat

SEQ ID NO: 6699203 - DNA, 16 bp, Homo sapiens
cagagagccaaatctg

SEQ ID NO: 6699204 - DNA, 15 bp, Homo sapiens
cagagagccattttg

SEQ ID NO: 6699205 - DNA, 13 bp, Homo sapiens
cagagagccctgg

SEQ ID NO: 6699206 - DNA, 17 bp, Homo sapiens
cagagagcctagaacat

SEQ ID NO: 6699207 - DNA, 18 bp, Homo sapiens
cagagagcgaccagcagg

SEQ ID NO: 6699208 - DNA, 22 bp, Homo sapiens
cagagagcgaccagcaggctcc

SEQ ID NO: 6699209 - DNA, 23 bp, Homo sapiens
cagagagcgaccagcaggctcct

SEQ ID NO: 6699210 - DNA, 20 bp, Homo sapiens
cagagagcttagcctggagc

SEQ ID NO: 6699211 - DNA, 17 bp, Homo sapiens
cagagaggacgtgggcg

SEQ ID NO: 6699212 - DNA, 18 bp, Homo sapiens
cagagaggacgtgggcgg

SEQ ID NO: 6699213 - DNA, 21 bp, Homo sapiens
cagagaggagaaacacatctt

SEQ ID NO: 6699214 - DNA, 12 bp, Homo sapiens
cagagaggagca

SEQ ID NO: 6699215 - DNA, 14 bp, Homo sapiens
cagagaggagcacc

SEQ ID NO: 6699216 - DNA, 17 bp, Homo sapiens
cagagaggagcacctga

SEQ ID NO: 6699217 - DNA, 20 bp, Homo sapiens
cagagaggagcacctgaacc

SEQ ID NO: 6699218 - DNA, 18 bp, Homo sapiens
cagagaggagttgccagg

SEQ ID NO: 6699219 - DNA, 20 bp, Homo sapiens
cagagaggatacatttaata

SEQ ID NO: 6699220 - DNA, 15 bp, Homo sapiens
cagagaggcaaggtt

SEQ ID NO: 6699221 - DNA, 18 bp, Homo sapiens
cagagaggcactcagtga

SEQ ID NO: 6699222 - DNA, 20 bp, Homo sapiens
cagagaggccttttggaatg

SEQ ID NO: 6699223 - DNA, 20 bp, Homo sapiens
cagagagggaaaaggcaggt

SEQ ID NO: 6699224 - DNA, 23 bp, Homo sapiens
cagagagggaaaaggcaggtgct

SEQ ID NO: 6699225 - DNA, 21 bp, Homo sapiens
cagagagggaactagggcacc

SEQ ID NO: 6699226 - DNA, 12 bp, Homo sapiens
cagagagggaag

SEQ ID NO: 6699227 - DNA, 15 bp, Homo sapiens
cagagagggaagctg

SEQ ID NO: 6699228 - DNA, 19 bp, Homo sapiens
cagagagggacacatgccc

SEQ ID NO: 6699229 - DNA, 21 bp, Homo sapiens
cagagagggcaggcatgaagt

SEQ ID NO: 6699230 - DNA, 13 bp, Homo sapiens
cagagagggccca

SEQ ID NO: 6699231 - DNA, 21 bp, Homo sapiens
cagagaggggacatttccctc

SEQ ID NO: 6699232 - DNA, 17 bp, Homo sapiens
cagagaggggcagggaa

SEQ ID NO: 6699233 - DNA, 17 bp, Homo sapiens
cagagagggtcactggg

SEQ ID NO: 6699234 - DNA, 12 bp, Homo sapiens
cagagagggtgg

SEQ ID NO: 6699235 - DNA, 16 bp, Homo sapiens
cagagagggtgggagt

SEQ ID NO: 6699236 - DNA, 23 bp, Homo sapiens
cagagagggtgggagtgggccca

SEQ ID NO: 6699237 - DNA, 21 bp, Homo sapiens
cagagaggtcaagcccaggag

SEQ ID NO: 6699238 - DNA, 17 bp, Homo sapiens
cagagaggtctcaggtt

SEQ ID NO: 6699239 - DNA, 21 bp, Homo sapiens
cagagaggtctcaggttcttt

SEQ ID NO: 6699240 - DNA, 23 bp, Homo sapiens
cagagaggtggagaactgggatt

SEQ ID NO: 6699241 - DNA, 20 bp, Homo sapiens
cagagaggtggatcctgtag

SEQ ID NO: 6699242 - DNA, 21 bp, Homo sapiens
cagagaggtttcgatatttat

SEQ ID NO: 6699243 - DNA, 18 bp, Homo sapiens
cagagagtacactgtgtc

SEQ ID NO: 6699244 - DNA, 16 bp, Homo sapiens
cagagagtacagactg

SEQ ID NO: 6699245 - DNA, 14 bp, Homo sapiens
cagagagtcccact

SEQ ID NO: 6699246 - DNA, 23 bp, Homo sapiens
cagagagtcccactgcctcaggt

SEQ ID NO: 6699247 - DNA, 17 bp, Homo sapiens
cagagagtcctctggat

SEQ ID NO: 6699248 - DNA, 18 bp, Homo sapiens
cagagagtcctctggatg

SEQ ID NO: 6699249 - DNA, 17 bp, Homo sapiens
cagagagtggagagagc

SEQ ID NO: 6699250 - DNA, 23 bp, Homo sapiens
cagagagtggagagagcagggct

SEQ ID NO: 6699251 - DNA, 15 bp, Homo sapiens
cagagagtggctcct

SEQ ID NO: 6699252 - DNA, 14 bp, Homo sapiens
cagagagtgtacat

SEQ ID NO: 6699253 - DNA, 16 bp, Homo sapiens
cagagataaaaatcat

SEQ ID NO: 6699254 - DNA, 13 bp, Homo sapiens
cagagataaataa

SEQ ID NO: 6699255 - DNA, 15 bp, Homo sapiens
cagagataggcctgt

SEQ ID NO: 6699256 - DNA, 22 bp, Homo sapiens
cagagatagtggggagacttct

SEQ ID NO: 6699257 - DNA, 15 bp, Homo sapiens
cagagatataaatga

SEQ ID NO: 6699258 - DNA, 20 bp, Homo sapiens
cagagatatgcacacaccga

SEQ ID NO: 6699259 - DNA, 20 bp, Homo sapiens
cagagatccaaaagaagccc

SEQ ID NO: 6699260 - DNA, 17 bp, Homo sapiens
cagagatcctacttctc

SEQ ID NO: 6699261 - DNA, 21 bp, Homo sapiens
cagagatcgacagacagccag

SEQ ID NO: 6699262 - DNA, 16 bp, Homo sapiens
cagagatctcccttct

SEQ ID NO: 6699263 - DNA, 19 bp, Homo sapiens
cagagatgagtgtctggag

SEQ ID NO: 6699264 - DNA, 21 bp, Homo sapiens
cagagatgcaccaccaagcca

SEQ ID NO: 6699265 - DNA, 21 bp, Homo sapiens
cagagatgcatgcgcaggctc

SEQ ID NO: 6699266 - DNA, 16 bp, Homo sapiens
cagagatgccagccct

SEQ ID NO: 6699267 - DNA, 19 bp, Homo sapiens
cagagatgccagcccttca

SEQ ID NO: 6699268 - DNA, 21 bp, Homo sapiens
cagagatgcgaaccacccaaa

SEQ ID NO: 6699269 - DNA, 13 bp, Homo sapiens
cagagatggacag

SEQ ID NO: 6699270 - DNA, 18 bp, Homo sapiens
cagagatggaggccgagc

SEQ ID NO: 6699271 - DNA, 16 bp, Homo sapiens
cagagatggcagagcc

SEQ ID NO: 6699272 - DNA, 17 bp, Homo sapiens
cagagatggcagagcca

SEQ ID NO: 6699273 - DNA, 18 bp, Homo sapiens
cagagatgggactgggag

SEQ ID NO: 6699274 - DNA, 22 bp, Homo sapiens
cagagatgggactgggagggcc

SEQ ID NO: 6699275 - DNA, 11 bp, Homo sapiens
cagagatgtac

SEQ ID NO: 6699276 - DNA, 16 bp, Homo sapiens
cagagatgtactgcaa

SEQ ID NO: 6699277 - DNA, 18 bp, Homo sapiens
cagagatgtcatcagagc

SEQ ID NO: 6699278 - DNA, 23 bp, Homo sapiens
cagagatgtcatcagagctcctc

SEQ ID NO: 6699279 - DNA, 14 bp, Homo sapiens
cagagatgttttca

SEQ ID NO: 6699280 - DNA, 21 bp, Homo sapiens
cagagatgttttcaagttgca

SEQ ID NO: 6699281 - DNA, 15 bp, Homo sapiens
cagagattagtctta

SEQ ID NO: 6699282 - DNA, 21 bp, Homo sapiens
cagagattattcaacagagag

SEQ ID NO: 6699283 - DNA, 21 bp, Homo sapiens
cagagattcattttctagata

SEQ ID NO: 6699284 - DNA, 22 bp, Homo sapiens
cagagattctggatctcctgct

SEQ ID NO: 6699285 - DNA, 24 bp, Homo sapiens
cagagattctggatctcctgctgc

SEQ ID NO: 6699286 - DNA, 21 bp, Homo sapiens
cagagattcttgaagaatgaa

SEQ ID NO: 6699287 - DNA, 22 bp, Homo sapiens
cagagattggaatgggcagctc

SEQ ID NO: 6699288 - DNA, 23 bp, Homo sapiens
cagagattgtagtatttagtata

SEQ ID NO: 6699289 - DNA, 21 bp, Homo sapiens
cagagatttctcattgacttt

SEQ ID NO: 6699290 - DNA, 14 bp, Homo sapiens
cagagcaaaataat

SEQ ID NO: 6699291 - DNA, 16 bp, Homo sapiens
cagagcaaaatgctct

SEQ ID NO: 6699292 - DNA, 15 bp, Homo sapiens
cagagcaaagcgccc

SEQ ID NO: 6699293 - DNA, 16 bp, Homo sapiens
cagagcaacgaccagg

SEQ ID NO: 6699294 - DNA, 19 bp, Homo sapiens
cagagcaagaccctgcctc

SEQ ID NO: 6699295 - DNA, 20 bp, Homo sapiens
cagagcaagagtctgtctca

SEQ ID NO: 6699296 - DNA, 13 bp, Homo sapiens
cagagcaagcctt

SEQ ID NO: 6699297 - DNA, 20 bp, Homo sapiens
cagagcaagcgaaagagcaa

SEQ ID NO: 6699298 - DNA, 16 bp, Homo sapiens
cagagcaagctttttt

SEQ ID NO: 6699299 - DNA, 20 bp, Homo sapiens
cagagcaagcttttttattt

SEQ ID NO: 6699300 - DNA, 16 bp, Homo sapiens
cagagcaagtctgcag

SEQ ID NO: 6699301 - DNA, 20 bp, Homo sapiens
cagagcaataacactatatt

SEQ ID NO: 6699302 - DNA, 21 bp, Homo sapiens
cagagcacaagaaggccagcc

SEQ ID NO: 6699303 - DNA, 21 bp, Homo sapiens
cagagcacacttatttatgaa

SEQ ID NO: 6699304 - DNA, 21 bp, Homo sapiens
cagagcacagccaatctccag

SEQ ID NO: 6699305 - DNA, 18 bp, Homo sapiens
cagagcacagcccacggg

SEQ ID NO: 6699306 - DNA, 14 bp, Homo sapiens
cagagcacaggagc

SEQ ID NO: 6699307 - DNA, 18 bp, Homo sapiens
cagagcacccagatcaga

SEQ ID NO: 6699308 - DNA, 21 bp, Homo sapiens
cagagcacccccaagcctggg

SEQ ID NO: 6699309 - DNA, 13 bp, Homo sapiens
cagagcaccctct

SEQ ID NO: 6699310 - DNA, 14 bp, Homo sapiens
cagagcacctcacc

SEQ ID NO: 6699311 - DNA, 13 bp, Homo sapiens
cagagcacctcag

SEQ ID NO: 6699312 - DNA, 18 bp, Homo sapiens
cagagcacctgctgtctg

SEQ ID NO: 6699313 - DNA, 20 bp, Homo sapiens
cagagcacctttgcacagga

SEQ ID NO: 6699314 - DNA, 15 bp, Homo sapiens
cagagcacgcctgcc

SEQ ID NO: 6699315 - DNA, 16 bp, Homo sapiens
cagagcacgcctgcca

SEQ ID NO: 6699316 - DNA, 21 bp, Homo sapiens
cagagcactaggttcaattcc

SEQ ID NO: 6699317 - DNA, 16 bp, Homo sapiens
cagagcactgtatacc

SEQ ID NO: 6699318 - DNA, 21 bp, Homo sapiens
cagagcactgtgtaaccagca

SEQ ID NO: 6699319 - DNA, 23 bp, Homo sapiens
cagagcactttaaaaacaggcca

SEQ ID NO: 6699320 - DNA, 14 bp, Homo sapiens
cagagcactttagc

SEQ ID NO: 6699321 - DNA, 22 bp, Homo sapiens
cagagcactttgcaactccctg

SEQ ID NO: 6699322 - DNA, 22 bp, Homo sapiens
cagagcagaactttttttgtgg

SEQ ID NO: 6699323 - DNA, 12 bp, Homo sapiens
cagagcagagac

SEQ ID NO: 6699324 - DNA, 15 bp, Homo sapiens
cagagcagagagcag

SEQ ID NO: 6699325 - DNA, 12 bp, Homo sapiens
cagagcagagcc

SEQ ID NO: 6699326 - DNA, 22 bp, Homo sapiens
cagagcagaggaaggctacttg

SEQ ID NO: 6699327 - DNA, 21 bp, Homo sapiens
cagagcagatgcagagagcca

SEQ ID NO: 6699328 - DNA, 20 bp, Homo sapiens
cagagcagatggcagatgca

SEQ ID NO: 6699329 - DNA, 15 bp, Homo sapiens
cagagcagcagcacc

SEQ ID NO: 6699330 - DNA, 12 bp, Homo sapiens
cagagcagctcc

SEQ ID NO: 6699331 - DNA, 21 bp, Homo sapiens
cagagcagctccaccactgtg

SEQ ID NO: 6699332 - DNA, 21 bp, Homo sapiens
cagagcaggaaggacaggaag

SEQ ID NO: 6699333 - DNA, 13 bp, Homo sapiens
cagagcaggacct

SEQ ID NO: 6699334 - DNA, 15 bp, Homo sapiens
cagagcaggacctcc

SEQ ID NO: 6699335 - DNA, 16 bp, Homo sapiens
cagagcaggacctccc

SEQ ID NO: 6699336 - DNA, 19 bp, Homo sapiens
cagagcaggacctcccttc

SEQ ID NO: 6699337 - DNA, 22 bp, Homo sapiens
cagagcaggacctcccttccga

SEQ ID NO: 6699338 - DNA, 19 bp, Homo sapiens
cagagcaggacctgggaca

SEQ ID NO: 6699339 - DNA, 13 bp, Homo sapiens
cagagcaggagca

SEQ ID NO: 6699340 - DNA, 15 bp, Homo sapiens
cagagcaggagcatc

SEQ ID NO: 6699341 - DNA, 13 bp, Homo sapiens
cagagcaggaggc

SEQ ID NO: 6699342 - DNA, 15 bp, Homo sapiens
cagagcaggaggccc

SEQ ID NO: 6699343 - DNA, 19 bp, Homo sapiens
cagagcaggaggcccctgg

SEQ ID NO: 6699344 - DNA, 11 bp, Homo sapiens
cagagcaggct

SEQ ID NO: 6699345 - DNA, 21 bp, Homo sapiens
cagagcaggctcagactctgg

SEQ ID NO: 6699346 - DNA, 14 bp, Homo sapiens
cagagcaggctttg

SEQ ID NO: 6699347 - DNA, 23 bp, Homo sapiens
cagagcagggccaaagcacagct

SEQ ID NO: 6699348 - DNA, 14 bp, Homo sapiens
cagagcaggggcag

SEQ ID NO: 6699349 - DNA, 13 bp, Homo sapiens
cagagcaggggcc

SEQ ID NO: 6699350 - DNA, 13 bp, Homo sapiens
cagagcaggggct

SEQ ID NO: 6699351 - DNA, 18 bp, Homo sapiens
cagagcaggggctccagc

SEQ ID NO: 6699352 - DNA, 19 bp, Homo sapiens
cagagcaggggctccagca

SEQ ID NO: 6699353 - DNA, 21 bp, Homo sapiens
cagagcagggggacctaggct

SEQ ID NO: 6699354 - DNA, 19 bp, Homo sapiens
cagagcaggtctgcaggcc

SEQ ID NO: 6699355 - DNA, 24 bp, Homo sapiens
cagagcaggtctgcaggccaccag

SEQ ID NO: 6699356 - DNA, 20 bp, Homo sapiens
cagagcagtgattctctctt

SEQ ID NO: 6699357 - DNA, 14 bp, Homo sapiens
cagagcatctgccc

SEQ ID NO: 6699358 - DNA, 16 bp, Homo sapiens
cagagcatctggctgt

SEQ ID NO: 6699359 - DNA, 19 bp, Homo sapiens
cagagcatctggctgttta

SEQ ID NO: 6699360 - DNA, 15 bp, Homo sapiens
cagagcatgatggga

SEQ ID NO: 6699361 - DNA, 20 bp, Homo sapiens
cagagcattacgtgagccag

SEQ ID NO: 6699362 - DNA, 22 bp, Homo sapiens
cagagcattacgtgagccaggt

SEQ ID NO: 6699363 - DNA, 23 bp, Homo sapiens
cagagcattacgtgagccaggta

SEQ ID NO: 6699364 - DNA, 17 bp, Homo sapiens
cagagcattccagtcag

SEQ ID NO: 6699365 - DNA, 18 bp, Homo sapiens
cagagcattccagtcagg

SEQ ID NO: 6699366 - DNA, 19 bp, Homo sapiens
cagagcatttaaggaaact

SEQ ID NO: 6699367 - DNA, 22 bp, Homo sapiens
cagagcatttaaggaaactaga

SEQ ID NO: 6699368 - DNA, 21 bp, Homo sapiens
cagagcatttccaacaccaca

SEQ ID NO: 6699369 - DNA, 14 bp, Homo sapiens
cagagccaacctgg

SEQ ID NO: 6699370 - DNA, 13 bp, Homo sapiens
cagagccaagcac

SEQ ID NO: 6699371 - DNA, 14 bp, Homo sapiens
cagagccaagcact

SEQ ID NO: 6699372 - DNA, 15 bp, Homo sapiens
cagagccaagcactg

SEQ ID NO: 6699373 - DNA, 19 bp, Homo sapiens
cagagccaagcactgctca

SEQ ID NO: 6699374 - DNA, 17 bp, Homo sapiens
cagagccaagggggcag

SEQ ID NO: 6699375 - DNA, 11 bp, Homo sapiens
cagagccaagt

SEQ ID NO: 6699376 - DNA, 13 bp, Homo sapiens
cagagccacacat

SEQ ID NO: 6699377 - DNA, 14 bp, Homo sapiens
cagagccacacatg

SEQ ID NO: 6699378 - DNA, 17 bp, Homo sapiens
cagagccacacatgggc

SEQ ID NO: 6699379 - DNA, 16 bp, Homo sapiens
cagagccacagggtct

SEQ ID NO: 6699380 - DNA, 20 bp, Homo sapiens
cagagccacagggtctgcct

SEQ ID NO: 6699381 - DNA, 13 bp, Homo sapiens
cagagccacagtt

SEQ ID NO: 6699382 - DNA, 11 bp, Homo sapiens
cagagccaccc

SEQ ID NO: 6699383 - DNA, 22 bp, Homo sapiens
cagagccacccctaaagagata

SEQ ID NO: 6699384 - DNA, 13 bp, Homo sapiens
cagagccacctgg

SEQ ID NO: 6699385 - DNA, 16 bp, Homo sapiens
cagagccactctatga

SEQ ID NO: 6699386 - DNA, 22 bp, Homo sapiens
cagagccagatgcaggacagga

SEQ ID NO: 6699387 - DNA, 23 bp, Homo sapiens
cagagccagatgcaggacaggag

SEQ ID NO: 6699388 - DNA, 23 bp, Homo sapiens
cagagccagcctggctctgcccc

SEQ ID NO: 6699389 - DNA, 18 bp, Homo sapiens
cagagccagcctgggact

SEQ ID NO: 6699390 - DNA, 15 bp, Homo sapiens
cagagccaggaagat

SEQ ID NO: 6699391 - DNA, 12 bp, Homo sapiens
cagagccaggct

SEQ ID NO: 6699392 - DNA, 17 bp, Homo sapiens
cagagccaggctctgcc

SEQ ID NO: 6699393 - DNA, 18 bp, Homo sapiens
cagagccaggctctgcct

SEQ ID NO: 6699394 - DNA, 20 bp, Homo sapiens
cagagccaggctctgcctgg

SEQ ID NO: 6699395 - DNA, 18 bp, Homo sapiens
cagagccaggctgttgga

SEQ ID NO: 6699396 - DNA, 14 bp, Homo sapiens
cagagccagggcag

SEQ ID NO: 6699397 - DNA, 16 bp, Homo sapiens
cagagccagggcaggg

SEQ ID NO: 6699398 - DNA, 17 bp, Homo sapiens
cagagccagggcagggc

SEQ ID NO: 6699399 - DNA, 15 bp, Homo sapiens
cagagccagggctgt

SEQ ID NO: 6699400 - DNA, 18 bp, Homo sapiens
cagagccagggctgtcct

SEQ ID NO: 6699401 - DNA, 13 bp, Homo sapiens
cagagccagtgaa

SEQ ID NO: 6699402 - DNA, 17 bp, Homo sapiens
cagagccagtgaaggag

SEQ ID NO: 6699403 - DNA, 19 bp, Homo sapiens
cagagccatactgcgtcca

SEQ ID NO: 6699404 - DNA, 14 bp, Homo sapiens
cagagccatccacc

SEQ ID NO: 6699405 - DNA, 14 bp, Homo sapiens
cagagccatctgcg

SEQ ID NO: 6699406 - DNA, 16 bp, Homo sapiens
cagagccatctgcgac

SEQ ID NO: 6699407 - DNA, 14 bp, Homo sapiens
cagagccatggact

SEQ ID NO: 6699408 - DNA, 19 bp, Homo sapiens
cagagccatgggcctgggc

SEQ ID NO: 6699409 - DNA, 19 bp, Homo sapiens
cagagcccaagtgccatcc

SEQ ID NO: 6699410 - DNA, 22 bp, Homo sapiens
cagagcccaagtgccatcccac

SEQ ID NO: 6699411 - DNA, 19 bp, Homo sapiens
cagagcccaccagccagcc

SEQ ID NO: 6699412 - DNA, 21 bp, Homo sapiens
cagagcccaccagccagccct

SEQ ID NO: 6699413 - DNA, 21 bp, Homo sapiens
cagagcccacgcccccactgg

SEQ ID NO: 6699414 - DNA, 13 bp, Homo sapiens
cagagcccactcc

SEQ ID NO: 6699415 - DNA, 20 bp, Homo sapiens
cagagcccagaccctggagg

SEQ ID NO: 6699416 - DNA, 11 bp, Homo sapiens
cagagcccagc

SEQ ID NO: 6699417 - DNA, 17 bp, Homo sapiens
cagagcccagcccagga

SEQ ID NO: 6699418 - DNA, 18 bp, Homo sapiens
cagagcccagcccaggag

SEQ ID NO: 6699419 - DNA, 12 bp, Homo sapiens
cagagcccagct

SEQ ID NO: 6699420 - DNA, 17 bp, Homo sapiens
cagagcccagctcttgc

SEQ ID NO: 6699421 - DNA, 23 bp, Homo sapiens
cagagcccaggctcggcctgccc

SEQ ID NO: 6699422 - DNA, 12 bp, Homo sapiens
cagagcccaggg

SEQ ID NO: 6699423 - DNA, 16 bp, Homo sapiens
cagagcccagggaaga

SEQ ID NO: 6699424 - DNA, 15 bp, Homo sapiens
cagagcccagggaga

SEQ ID NO: 6699425 - DNA, 15 bp, Homo sapiens
cagagcccaggggag

SEQ ID NO: 6699426 - DNA, 19 bp, Homo sapiens
cagagcccatgctcaacca

SEQ ID NO: 6699427 - DNA, 20 bp, Homo sapiens
cagagccccacacggaggca

SEQ ID NO: 6699428 - DNA, 22 bp, Homo sapiens
cagagccccacagccccatctg

SEQ ID NO: 6699429 - DNA, 15 bp, Homo sapiens
cagagccccactccc

SEQ ID NO: 6699430 - DNA, 18 bp, Homo sapiens
cagagccccactcccggc

SEQ ID NO: 6699431 - DNA, 14 bp, Homo sapiens
cagagcccccaagc

SEQ ID NO: 6699432 - DNA, 15 bp, Homo sapiens
cagagcccccagccc

SEQ ID NO: 6699433 - DNA, 18 bp, Homo sapiens
cagagcccccagccctgg

SEQ ID NO: 6699434 - DNA, 16 bp, Homo sapiens
cagagcccccatggcc

SEQ ID NO: 6699435 - DNA, 15 bp, Homo sapiens
cagagcccccctagc

SEQ ID NO: 6699436 - DNA, 18 bp, Homo sapiens
cagagccccgccccaccc

SEQ ID NO: 6699437 - DNA, 14 bp, Homo sapiens
cagagcccctccct

SEQ ID NO: 6699438 - DNA, 17 bp, Homo sapiens
cagagcccctccctgct

SEQ ID NO: 6699439 - DNA, 12 bp, Homo sapiens
cagagcccgccc

SEQ ID NO: 6699440 - DNA, 16 bp, Homo sapiens
cagagcccgcccacct

SEQ ID NO: 6699441 - DNA, 19 bp, Homo sapiens
cagagcccgcccacctggg

SEQ ID NO: 6699442 - DNA, 21 bp, Homo sapiens
cagagcccgcccacctgggcc

SEQ ID NO: 6699443 - DNA, 23 bp, Homo sapiens
cagagcccggagctccggcctgc

SEQ ID NO: 6699444 - DNA, 12 bp, Homo sapiens
cagagccctcca

SEQ ID NO: 6699445 - DNA, 13 bp, Homo sapiens
cagagccctccag

SEQ ID NO: 6699446 - DNA, 15 bp, Homo sapiens
cagagccctccaggc

SEQ ID NO: 6699447 - DNA, 17 bp, Homo sapiens
cagagccctccaggcct

SEQ ID NO: 6699448 - DNA, 15 bp, Homo sapiens
cagagccctcggagc

SEQ ID NO: 6699449 - DNA, 13 bp, Homo sapiens
cagagccctctga

SEQ ID NO: 6699450 - DNA, 14 bp, Homo sapiens
cagagccctctgag

SEQ ID NO: 6699451 - DNA, 22 bp, Homo sapiens
cagagccctgccctgcaccctt

SEQ ID NO: 6699452 - DNA, 15 bp, Homo sapiens
cagagccctggacct

SEQ ID NO: 6699453 - DNA, 20 bp, Homo sapiens
cagagccctggaccttgggc

SEQ ID NO: 6699454 - DNA, 23 bp, Homo sapiens
cagagccctgtgaggctgggtcc

SEQ ID NO: 6699455 - DNA, 16 bp, Homo sapiens
cagagcccttcactgc

SEQ ID NO: 6699456 - DNA, 20 bp, Homo sapiens
cagagcccttcactgccatg

SEQ ID NO: 6699457 - DNA, 21 bp, Homo sapiens
cagagcccttcactgccatga

SEQ ID NO: 6699458 - DNA, 15 bp, Homo sapiens
cagagcccttgactg

SEQ ID NO: 6699459 - DNA, 23 bp, Homo sapiens
cagagccgcaaatcaaccccaga

SEQ ID NO: 6699460 - DNA, 18 bp, Homo sapiens
cagagccgcaccctggct

SEQ ID NO: 6699461 - DNA, 20 bp, Homo sapiens
cagagccggcatccttgcct

SEQ ID NO: 6699462 - DNA, 20 bp, Homo sapiens
cagagccggccgccttctcc

SEQ ID NO: 6699463 - DNA, 19 bp, Homo sapiens
cagagccggggcactttca

SEQ ID NO: 6699464 - DNA, 21 bp, Homo sapiens
cagagccggggcactttcaga

SEQ ID NO: 6699465 - DNA, 22 bp, Homo sapiens
cagagccggggtggggtggctg

SEQ ID NO: 6699466 - DNA, 23 bp, Homo sapiens
cagagccggggtggggtggctgc

SEQ ID NO: 6699467 - DNA, 16 bp, Homo sapiens
cagagccgttcctggg

SEQ ID NO: 6699468 - DNA, 15 bp, Homo sapiens
cagagcctaagaaaa

SEQ ID NO: 6699469 - DNA, 17 bp, Homo sapiens
cagagcctaccttcacc

SEQ ID NO: 6699470 - DNA, 14 bp, Homo sapiens
cagagcctagccac

SEQ ID NO: 6699471 - DNA, 16 bp, Homo sapiens
cagagcctagccacct

SEQ ID NO: 6699472 - DNA, 18 bp, Homo sapiens
cagagcctatggaaaggg

SEQ ID NO: 6699473 - DNA, 12 bp, Homo sapiens
cagagcctcagc

SEQ ID NO: 6699474 - DNA, 18 bp, Homo sapiens
cagagcctcagcttctgg

SEQ ID NO: 6699475 - DNA, 14 bp, Homo sapiens
cagagcctccctca

SEQ ID NO: 6699476 - DNA, 15 bp, Homo sapiens
cagagcctcctggga

SEQ ID NO: 6699477 - DNA, 20 bp, Homo sapiens
cagagcctcctttctggctt

SEQ ID NO: 6699478 - DNA, 15 bp, Homo sapiens
cagagcctctcccac

SEQ ID NO: 6699479 - DNA, 16 bp, Homo sapiens
cagagcctctggcccc

SEQ ID NO: 6699480 - DNA, 19 bp, Homo sapiens
cagagcctgacgctcagcc

SEQ ID NO: 6699481 - DNA, 22 bp, Homo sapiens
cagagcctgacgctcagcccca

SEQ ID NO: 6699482 - DNA, 13 bp, Homo sapiens
cagagcctgcagt

SEQ ID NO: 6699483 - DNA, 14 bp, Homo sapiens
cagagcctgcccca

SEQ ID NO: 6699484 - DNA, 15 bp, Homo sapiens
cagagcctgccccag

SEQ ID NO: 6699485 - DNA, 14 bp, Homo sapiens
cagagcctgcctaa

SEQ ID NO: 6699486 - DNA, 20 bp, Homo sapiens
cagagcctgcctaaccaggc

SEQ ID NO: 6699487 - DNA, 22 bp, Homo sapiens
cagagcctgcctaaccaggccc

SEQ ID NO: 6699488 - DNA, 24 bp, Homo sapiens
cagagcctgcctaaccaggcccag

SEQ ID NO: 6699489 - DNA, 19 bp, Homo sapiens
cagagcctgcctcagctgc

SEQ ID NO: 6699490 - DNA, 24 bp, Homo sapiens
cagagcctgcctcagctgctcgca

SEQ ID NO: 6699491 - DNA, 15 bp, Homo sapiens
cagagcctggcccca

SEQ ID NO: 6699492 - DNA, 16 bp, Homo sapiens
cagagcctggccccag

SEQ ID NO: 6699493 - DNA, 11 bp, Homo sapiens
cagagcctggg

SEQ ID NO: 6699494 - DNA, 13 bp, Homo sapiens
cagagcctgggcg

SEQ ID NO: 6699495 - DNA, 14 bp, Homo sapiens
cagagcctggggca

SEQ ID NO: 6699496 - DNA, 14 bp, Homo sapiens
cagagcctggggct

SEQ ID NO: 6699497 - DNA, 12 bp, Homo sapiens
cagagcctgtcc

SEQ ID NO: 6699498 - DNA, 17 bp, Homo sapiens
cagagcctgtctttcag

SEQ ID NO: 6699499 - DNA, 21 bp, Homo sapiens
cagagcctgtggccccgaggc

SEQ ID NO: 6699500 - DNA, 14 bp, Homo sapiens
cagagcctgtttta

SEQ ID NO: 6699501 - DNA, 16 bp, Homo sapiens
cagagcctgttttaaa

SEQ ID NO: 6699502 - DNA, 11 bp, Homo sapiens
cagagccttca

SEQ ID NO: 6699503 - DNA, 15 bp, Homo sapiens
cagagccttcaagtg

SEQ ID NO: 6699504 - DNA, 16 bp, Homo sapiens
cagagccttcaagtgc

SEQ ID NO: 6699505 - DNA, 22 bp, Homo sapiens
cagagccttccatgacctcccc

SEQ ID NO: 6699506 - DNA, 13 bp, Homo sapiens
cagagccttctca

SEQ ID NO: 6699507 - DNA, 18 bp, Homo sapiens
cagagcctttggatgacc

SEQ ID NO: 6699508 - DNA, 18 bp, Homo sapiens
cagagcctttttacctgg

SEQ ID NO: 6699509 - DNA, 16 bp, Homo sapiens
cagagcgacagagcag

SEQ ID NO: 6699510 - DNA, 15 bp, Homo sapiens
cagagcgagactcca

SEQ ID NO: 6699511 - DNA, 18 bp, Homo sapiens
cagagcgagactccatct

SEQ ID NO: 6699512 - DNA, 17 bp, Homo sapiens
cagagcgagactctgtc

SEQ ID NO: 6699513 - DNA, 21 bp, Homo sapiens
cagagcgatgtgttctttgta

SEQ ID NO: 6699514 - DNA, 22 bp, Homo sapiens
cagagcgatgtgttctttgtac

SEQ ID NO: 6699515 - DNA, 23 bp, Homo sapiens
cagagcgatgtgttctttgtacc

SEQ ID NO: 6699516 - DNA, 18 bp, Homo sapiens
cagagcgccaggaagcca

SEQ ID NO: 6699517 - DNA, 19 bp, Homo sapiens
cagagcgccaggaagccag

SEQ ID NO: 6699518 - DNA, 19 bp, Homo sapiens
cagagcgccgtgagttctc

SEQ ID NO: 6699519 - DNA, 17 bp, Homo sapiens
cagagcgcgcccctagc

SEQ ID NO: 6699520 - DNA, 14 bp, Homo sapiens
cagagcgggagtga

SEQ ID NO: 6699521 - DNA, 12 bp, Homo sapiens
cagagcgggcct

SEQ ID NO: 6699522 - DNA, 17 bp, Homo sapiens
cagagcgggcctcttcc

SEQ ID NO: 6699523 - DNA, 19 bp, Homo sapiens
cagagcgggcctcttccct

SEQ ID NO: 6699524 - DNA, 20 bp, Homo sapiens
cagagcgggctcgaagaaaa

SEQ ID NO: 6699525 - DNA, 14 bp, Homo sapiens
cagagcgtccttcc

SEQ ID NO: 6699526 - DNA, 22 bp, Homo sapiens
cagagcgtccttccccctgtag

SEQ ID NO: 6699527 - DNA, 23 bp, Homo sapiens
cagagcgtccttccccctgtaga

SEQ ID NO: 6699528 - DNA, 18 bp, Homo sapiens
cagagctaaggccaatgg

SEQ ID NO: 6699529 - DNA, 22 bp, Homo sapiens
cagagctaagggtgggtgctca

SEQ ID NO: 6699530 - DNA, 22 bp, Homo sapiens
cagagctacacaggggaaaaga

SEQ ID NO: 6699531 - DNA, 21 bp, Homo sapiens
cagagctactgagacttggaa

SEQ ID NO: 6699532 - DNA, 17 bp, Homo sapiens
cagagctacttgggcca

SEQ ID NO: 6699533 - DNA, 15 bp, Homo sapiens
cagagctaggctgtg

SEQ ID NO: 6699534 - DNA, 17 bp, Homo sapiens
cagagctagggctgctg

SEQ ID NO: 6699535 - DNA, 11 bp, Homo sapiens
cagagctcaga

SEQ ID NO: 6699536 - DNA, 12 bp, Homo sapiens
cagagctcagag

SEQ ID NO: 6699537 - DNA, 14 bp, Homo sapiens
cagagctcagagga

SEQ ID NO: 6699538 - DNA, 15 bp, Homo sapiens
cagagctcagaggag

SEQ ID NO: 6699539 - DNA, 18 bp, Homo sapiens
cagagctcagcacagcct

SEQ ID NO: 6699540 - DNA, 22 bp, Homo sapiens
cagagctcatcccccctgctgc

SEQ ID NO: 6699541 - DNA, 22 bp, Homo sapiens
cagagctcccaggacgcaggga

SEQ ID NO: 6699542 - DNA, 23 bp, Homo sapiens
cagagctcccccgtggtgcctgc

SEQ ID NO: 6699543 - DNA, 15 bp, Homo sapiens
cagagctcctgagtg

SEQ ID NO: 6699544 - DNA, 15 bp, Homo sapiens
cagagctctacaggc

SEQ ID NO: 6699545 - DNA, 15 bp, Homo sapiens
cagagctctccagct

SEQ ID NO: 6699546 - DNA, 24 bp, Homo sapiens
cagagctctcccctcctgctgggc

SEQ ID NO: 6699547 - DNA, 22 bp, Homo sapiens
cagagctctcgaggaaagtggt

SEQ ID NO: 6699548 - DNA, 14 bp, Homo sapiens
cagagctctgaccc

SEQ ID NO: 6699549 - DNA, 21 bp, Homo sapiens
cagagctctggagccacctgt

SEQ ID NO: 6699550 - DNA, 13 bp, Homo sapiens
cagagctctgggt

SEQ ID NO: 6699551 - DNA, 21 bp, Homo sapiens
cagagctctgggttgtgcaca

SEQ ID NO: 6699552 - DNA, 15 bp, Homo sapiens
cagagctcttatgtg

SEQ ID NO: 6699553 - DNA, 17 bp, Homo sapiens
cagagctcttcaagctg

SEQ ID NO: 6699554 - DNA, 20 bp, Homo sapiens
cagagctcttcaagctgtcc

SEQ ID NO: 6699555 - DNA, 22 bp, Homo sapiens
cagagctcttcaagctgtcccc

SEQ ID NO: 6699556 - DNA, 14 bp, Homo sapiens
cagagctctttgat

SEQ ID NO: 6699557 - DNA, 21 bp, Homo sapiens
cagagctgaagagttgccccg

SEQ ID NO: 6699558 - DNA, 12 bp, Homo sapiens
cagagctgaccc

SEQ ID NO: 6699559 - DNA, 19 bp, Homo sapiens
cagagctgacgggaggccc

SEQ ID NO: 6699560 - DNA, 20 bp, Homo sapiens
cagagctgacgggaggcccc

SEQ ID NO: 6699561 - DNA, 21 bp, Homo sapiens
cagagctgacgggaggcccca

SEQ ID NO: 6699562 - DNA, 12 bp, Homo sapiens
cagagctgagga

SEQ ID NO: 6699563 - DNA, 23 bp, Homo sapiens
cagagctgaggatttcctggagt

SEQ ID NO: 6699564 - DNA, 13 bp, Homo sapiens
cagagctgagggc

SEQ ID NO: 6699565 - DNA, 16 bp, Homo sapiens
cagagctgagggccct

SEQ ID NO: 6699566 - DNA, 18 bp, Homo sapiens
cagagctgagggccctgt

SEQ ID NO: 6699567 - DNA, 20 bp, Homo sapiens
cagagctgagggccctgtgg

SEQ ID NO: 6699568 - DNA, 20 bp, Homo sapiens
cagagctgagtcggctgggc

SEQ ID NO: 6699569 - DNA, 19 bp, Homo sapiens
cagagctgatggagaagga

SEQ ID NO: 6699570 - DNA, 21 bp, Homo sapiens
cagagctgatggagaaggaag

SEQ ID NO: 6699571 - DNA, 22 bp, Homo sapiens
cagagctgatggagaaggaagg

SEQ ID NO: 6699572 - DNA, 19 bp, Homo sapiens
cagagctgcacttggcctc

SEQ ID NO: 6699573 - DNA, 22 bp, Homo sapiens
cagagctgcagagtacagtgta

SEQ ID NO: 6699574 - DNA, 13 bp, Homo sapiens
cagagctgcagcc

SEQ ID NO: 6699575 - DNA, 13 bp, Homo sapiens
cagagctgccacc

SEQ ID NO: 6699576 - DNA, 13 bp, Homo sapiens
cagagctgccagt

SEQ ID NO: 6699577 - DNA, 21 bp, Homo sapiens
cagagctgccctctcctgggc

SEQ ID NO: 6699578 - DNA, 22 bp, Homo sapiens
cagagctgcctccccaatccat

SEQ ID NO: 6699579 - DNA, 21 bp, Homo sapiens
cagagctgcctgctctgtgag

SEQ ID NO: 6699580 - DNA, 10 bp, Homo sapiens
cagagctgcg

SEQ ID NO: 6699581 - DNA, 20 bp, Homo sapiens
cagagctgcgggctgagggc

SEQ ID NO: 6699582 - DNA, 18 bp, Homo sapiens
cagagctgctgagcagga

SEQ ID NO: 6699583 - DNA, 16 bp, Homo sapiens
cagagctgcttccccg

SEQ ID NO: 6699584 - DNA, 14 bp, Homo sapiens
cagagctggaacac

SEQ ID NO: 6699585 - DNA, 16 bp, Homo sapiens
cagagctggaacacaa

SEQ ID NO: 6699586 - DNA, 14 bp, Homo sapiens
cagagctggaaggc

SEQ ID NO: 6699587 - DNA, 23 bp, Homo sapiens
cagagctggaccagtggtgcctt

SEQ ID NO: 6699588 - DNA, 17 bp, Homo sapiens
cagagctggagatgagg

SEQ ID NO: 6699589 - DNA, 22 bp, Homo sapiens
cagagctggagatgaggccaga

SEQ ID NO: 6699590 - DNA, 23 bp, Homo sapiens
cagagctggagatgaggccagac

SEQ ID NO: 6699591 - DNA, 13 bp, Homo sapiens
cagagctggatgc

SEQ ID NO: 6699592 - DNA, 14 bp, Homo sapiens
cagagctggcctcc

SEQ ID NO: 6699593 - DNA, 13 bp, Homo sapiens
cagagctggctct

SEQ ID NO: 6699594 - DNA, 18 bp, Homo sapiens
cagagctggctctgagcg

SEQ ID NO: 6699595 - DNA, 10 bp, Homo sapiens
cagagctggg

SEQ ID NO: 6699596 - DNA, 13 bp, Homo sapiens
cagagctgggagg

SEQ ID NO: 6699597 - DNA, 14 bp, Homo sapiens
cagagctgggaggg

SEQ ID NO: 6699598 - DNA, 20 bp, Homo sapiens
cagagctggggctgagggat

SEQ ID NO: 6699599 - DNA, 21 bp, Homo sapiens
cagagctggggctgccagcct

SEQ ID NO: 6699600 - DNA, 12 bp, Homo sapiens
cagagctgggtg

SEQ ID NO: 6699601 - DNA, 19 bp, Homo sapiens
cagagctggtgcggctggc

SEQ ID NO: 6699602 - DNA, 21 bp, Homo sapiens
cagagctggtgcggctggcca

SEQ ID NO: 6699603 - DNA, 22 bp, Homo sapiens
cagagctggtgcggctggccat

SEQ ID NO: 6699604 - DNA, 17 bp, Homo sapiens
cagagctgtcctcctgg

SEQ ID NO: 6699605 - DNA, 18 bp, Homo sapiens
cagagctgtcctcctggc

SEQ ID NO: 6699606 - DNA, 19 bp, Homo sapiens
cagagctgtcctcctggca

SEQ ID NO: 6699607 - DNA, 13 bp, Homo sapiens
cagagctgtgcca

SEQ ID NO: 6699608 - DNA, 17 bp, Homo sapiens
cagagctgtgccagcag

SEQ ID NO: 6699609 - DNA, 20 bp, Homo sapiens
cagagctgtgcctgctcagc

SEQ ID NO: 6699610 - DNA, 21 bp, Homo sapiens
cagagctgttggcctcgcctg

SEQ ID NO: 6699611 - DNA, 20 bp, Homo sapiens
cagagctgtttatggcctca

SEQ ID NO: 6699612 - DNA, 22 bp, Homo sapiens
cagagctgtttatggcctcagc

SEQ ID NO: 6699613 - DNA, 18 bp, Homo sapiens
cagagctgtttggataca

SEQ ID NO: 6699614 - DNA, 18 bp, Homo sapiens
cagagcttattggccact

SEQ ID NO: 6699615 - DNA, 20 bp, Homo sapiens
cagagcttattggccactgg

SEQ ID NO: 6699616 - DNA, 17 bp, Homo sapiens
cagagcttcagggctgg

SEQ ID NO: 6699617 - DNA, 23 bp, Homo sapiens
cagagcttccctgactcattctg

SEQ ID NO: 6699618 - DNA, 13 bp, Homo sapiens
cagagcttcctgg

SEQ ID NO: 6699619 - DNA, 21 bp, Homo sapiens
cagagcttcctggggaccaag

SEQ ID NO: 6699620 - DNA, 12 bp, Homo sapiens
cagagcttctcc

SEQ ID NO: 6699621 - DNA, 14 bp, Homo sapiens
cagagcttctcctg

SEQ ID NO: 6699622 - DNA, 17 bp, Homo sapiens
cagagcttctcctgacc

SEQ ID NO: 6699623 - DNA, 19 bp, Homo sapiens
cagagcttgattagaagcc

SEQ ID NO: 6699624 - DNA, 15 bp, Homo sapiens
cagagcttggactgg

SEQ ID NO: 6699625 - DNA, 19 bp, Homo sapiens
cagagcttgtagccctgga

SEQ ID NO: 6699626 - DNA, 20 bp, Homo sapiens
cagagcttgtagccctggat

SEQ ID NO: 6699627 - DNA, 13 bp, Homo sapiens
cagagctttaaaa

SEQ ID NO: 6699628 - DNA, 15 bp, Homo sapiens
cagagctttgtcact

SEQ ID NO: 6699629 - DNA, 20 bp, Homo sapiens
cagagctttgtcacttgcca

SEQ ID NO: 6699630 - DNA, 17 bp, Homo sapiens
cagaggaaaaagaaaaa

SEQ ID NO: 6699631 - DNA, 13 bp, Homo sapiens
cagaggaaagaca

SEQ ID NO: 6699632 - DNA, 14 bp, Homo sapiens
cagaggaaagacag

SEQ ID NO: 6699633 - DNA, 20 bp, Homo sapiens
cagaggaaagcaaaggagat

SEQ ID NO: 6699634 - DNA, 18 bp, Homo sapiens
cagaggaaagggctggct

SEQ ID NO: 6699635 - DNA, 20 bp, Homo sapiens
cagaggaaagggctggctcc

SEQ ID NO: 6699636 - DNA, 23 bp, Homo sapiens
cagaggaaatctgaatgtattat

SEQ ID NO: 6699637 - DNA, 23 bp, Homo sapiens
cagaggaaccagcactccatcac

SEQ ID NO: 6699638 - DNA, 19 bp, Homo sapiens
cagaggaactgtccagaga

SEQ ID NO: 6699639 - DNA, 22 bp, Homo sapiens
cagaggaactgtccagagagca

SEQ ID NO: 6699640 - DNA, 14 bp, Homo sapiens
cagaggaagagcag

SEQ ID NO: 6699641 - DNA, 15 bp, Homo sapiens
cagaggaagagcagg

SEQ ID NO: 6699642 - DNA, 12 bp, Homo sapiens
cagaggaagcac

SEQ ID NO: 6699643 - DNA, 15 bp, Homo sapiens
cagaggaagcccagc

SEQ ID NO: 6699644 - DNA, 14 bp, Homo sapiens
cagaggaagcccct

SEQ ID NO: 6699645 - DNA, 14 bp, Homo sapiens
cagaggaaggaaac

SEQ ID NO: 6699646 - DNA, 19 bp, Homo sapiens
cagaggaaggaaacataga

SEQ ID NO: 6699647 - DNA, 22 bp, Homo sapiens
cagaggaaggaaacatagaaag

SEQ ID NO: 6699648 - DNA, 13 bp, Homo sapiens
cagaggaaggaga

SEQ ID NO: 6699649 - DNA, 15 bp, Homo sapiens
cagaggaagggaggc

SEQ ID NO: 6699650 - DNA, 16 bp, Homo sapiens
cagaggaagggaggcc

SEQ ID NO: 6699651 - DNA, 21 bp, Homo sapiens
cagaggaagggaggcctgagg

SEQ ID NO: 6699652 - DNA, 18 bp, Homo sapiens
cagaggaaggggccagag

SEQ ID NO: 6699653 - DNA, 21 bp, Homo sapiens
cagaggaaggggccagaggct

SEQ ID NO: 6699654 - DNA, 22 bp, Homo sapiens
cagaggaatatgaacattttat

SEQ ID NO: 6699655 - DNA, 17 bp, Homo sapiens
cagaggaatcctggcag

SEQ ID NO: 6699656 - DNA, 18 bp, Homo sapiens
cagaggaatcctggcagc

SEQ ID NO: 6699657 - DNA, 21 bp, Homo sapiens
cagaggaatcctggcagccca

SEQ ID NO: 6699658 - DNA, 17 bp, Homo sapiens
cagaggaatctacctgt

SEQ ID NO: 6699659 - DNA, 19 bp, Homo sapiens
cagaggaatctacctgtgg

SEQ ID NO: 6699660 - DNA, 20 bp, Homo sapiens
cagaggaatctacctgtggt

SEQ ID NO: 6699661 - DNA, 17 bp, Homo sapiens
cagaggaatgtgggcta

SEQ ID NO: 6699662 - DNA, 19 bp, Homo sapiens
cagaggaatgtgggctatg

SEQ ID NO: 6699663 - DNA, 16 bp, Homo sapiens
cagaggaattatgaac

SEQ ID NO: 6699664 - DNA, 18 bp, Homo sapiens
cagaggaatttatacctc

SEQ ID NO: 6699665 - DNA, 15 bp, Homo sapiens
cagaggacacagaga

SEQ ID NO: 6699666 - DNA, 17 bp, Homo sapiens
cagaggacacagagaag

SEQ ID NO: 6699667 - DNA, 16 bp, Homo sapiens
cagaggacacaggcag

SEQ ID NO: 6699668 - DNA, 22 bp, Homo sapiens
cagaggacagagctggctgtct

SEQ ID NO: 6699669 - DNA, 17 bp, Homo sapiens
cagaggacagctctggg

SEQ ID NO: 6699670 - DNA, 18 bp, Homo sapiens
cagaggacagctctgggg

SEQ ID NO: 6699671 - DNA, 18 bp, Homo sapiens
cagaggacagtctggaga

SEQ ID NO: 6699672 - DNA, 21 bp, Homo sapiens
cagaggacagtctggagaagg

SEQ ID NO: 6699673 - DNA, 16 bp, Homo sapiens
cagaggacagtgctga

SEQ ID NO: 6699674 - DNA, 18 bp, Homo sapiens
cagaggaccaatgcttgc

SEQ ID NO: 6699675 - DNA, 12 bp, Homo sapiens
cagaggaccaca

SEQ ID NO: 6699676 - DNA, 13 bp, Homo sapiens
cagaggaccacag

SEQ ID NO: 6699677 - DNA, 15 bp, Homo sapiens
cagaggaccacagtg

SEQ ID NO: 6699678 - DNA, 15 bp, Homo sapiens
cagaggaccagggcc

SEQ ID NO: 6699679 - DNA, 17 bp, Homo sapiens
cagaggaccccagggtg

SEQ ID NO: 6699680 - DNA, 19 bp, Homo sapiens
cagaggaccccagggtggt

SEQ ID NO: 6699681 - DNA, 16 bp, Homo sapiens
cagaggactctgctta

SEQ ID NO: 6699682 - DNA, 17 bp, Homo sapiens
cagaggactctgcttaa

SEQ ID NO: 6699683 - DNA, 21 bp, Homo sapiens
cagaggactgtgatgccctgc

SEQ ID NO: 6699684 - DNA, 21 bp, Homo sapiens
cagaggagaacttgctgcctc

SEQ ID NO: 6699685 - DNA, 16 bp, Homo sapiens
cagaggagagacggtg

SEQ ID NO: 6699686 - DNA, 15 bp, Homo sapiens
cagaggagagaggac

SEQ ID NO: 6699687 - DNA, 20 bp, Homo sapiens
cagaggagagaggaccccct

SEQ ID NO: 6699688 - DNA, 22 bp, Homo sapiens
cagaggagagatagcctgtggc

SEQ ID NO: 6699689 - DNA, 18 bp, Homo sapiens
cagaggagaggagacaga

SEQ ID NO: 6699690 - DNA, 22 bp, Homo sapiens
cagaggagaggagcaaacagga

SEQ ID NO: 6699691 - DNA, 17 bp, Homo sapiens
cagaggagagtaccccc

SEQ ID NO: 6699692 - DNA, 23 bp, Homo sapiens
cagaggagagtacccccctgaga

SEQ ID NO: 6699693 - DNA, 20 bp, Homo sapiens
cagaggagagtcccagagca

SEQ ID NO: 6699694 - DNA, 16 bp, Homo sapiens
cagaggagagtggcct

SEQ ID NO: 6699695 - DNA, 17 bp, Homo sapiens
cagaggagagtggcctg

SEQ ID NO: 6699696 - DNA, 19 bp, Homo sapiens
cagaggagagtggcctggg

SEQ ID NO: 6699697 - DNA, 22 bp, Homo sapiens
cagaggagatgccacttctcac

SEQ ID NO: 6699698 - DNA, 17 bp, Homo sapiens
cagaggagcaaggttta

SEQ ID NO: 6699699 - DNA, 20 bp, Homo sapiens
cagaggagccaccagttctc

SEQ ID NO: 6699700 - DNA, 17 bp, Homo sapiens
cagaggagccacctggg

SEQ ID NO: 6699701 - DNA, 21 bp, Homo sapiens
cagaggagcccagcggcccaa

SEQ ID NO: 6699702 - DNA, 14 bp, Homo sapiens
cagaggagcccagt

SEQ ID NO: 6699703 - DNA, 24 bp, Homo sapiens
cagaggagctctaccctgctccct

SEQ ID NO: 6699704 - DNA, 20 bp, Homo sapiens
cagaggagctgggagccggg

SEQ ID NO: 6699705 - DNA, 20 bp, Homo sapiens
cagaggagcttttctggaat

SEQ ID NO: 6699706 - DNA, 14 bp, Homo sapiens
cagaggaggagaaa

SEQ ID NO: 6699707 - DNA, 20 bp, Homo sapiens
cagaggaggatgtaaggcct

SEQ ID NO: 6699708 - DNA, 22 bp, Homo sapiens
cagaggaggatgtaaggcctta

SEQ ID NO: 6699709 - DNA, 15 bp, Homo sapiens
cagaggaggccagcc

SEQ ID NO: 6699710 - DNA, 18 bp, Homo sapiens
cagaggaggccagcctca

SEQ ID NO: 6699711 - DNA, 13 bp, Homo sapiens
cagaggaggcctc

SEQ ID NO: 6699712 - DNA, 19 bp, Homo sapiens
cagaggaggcctcaaagca

SEQ ID NO: 6699713 - DNA, 18 bp, Homo sapiens
cagaggaggcgaggaggc

SEQ ID NO: 6699714 - DNA, 22 bp, Homo sapiens
cagaggagggatagagacgcag

SEQ ID NO: 6699715 - DNA, 14 bp, Homo sapiens
cagaggagggcagc

SEQ ID NO: 6699716 - DNA, 18 bp, Homo sapiens
cagaggagggcagcagaa

SEQ ID NO: 6699717 - DNA, 14 bp, Homo sapiens
cagaggaggtgccc

SEQ ID NO: 6699718 - DNA, 16 bp, Homo sapiens
cagaggaggtgcccgg

SEQ ID NO: 6699719 - DNA, 21 bp, Homo sapiens
cagaggagtacaggtgaagca

SEQ ID NO: 6699720 - DNA, 17 bp, Homo sapiens
cagaggagtccagggcg

SEQ ID NO: 6699721 - DNA, 22 bp, Homo sapiens
cagaggagtgattgaaccagct

SEQ ID NO: 6699722 - DNA, 23 bp, Homo sapiens
cagaggagtgattgaaccagctc

SEQ ID NO: 6699723 - DNA, 22 bp, Homo sapiens
cagaggagtgcagccttctcca

SEQ ID NO: 6699724 - DNA, 19 bp, Homo sapiens
cagaggatcaccagtgcat

SEQ ID NO: 6699725 - DNA, 18 bp, Homo sapiens
cagaggatgctctttccc

SEQ ID NO: 6699726 - DNA, 15 bp, Homo sapiens
cagaggatggccagt

SEQ ID NO: 6699727 - DNA, 22 bp, Homo sapiens
cagaggatggccagtgtctgtc

SEQ ID NO: 6699728 - DNA, 22 bp, Homo sapiens
cagaggatgttctggacctccc

SEQ ID NO: 6699729 - DNA, 15 bp, Homo sapiens
cagaggattctgtct

SEQ ID NO: 6699730 - DNA, 21 bp, Homo sapiens
cagaggattctgtcttccagg

SEQ ID NO: 6699731 - DNA, 16 bp, Homo sapiens
cagaggcaactgactt

SEQ ID NO: 6699732 - DNA, 16 bp, Homo sapiens
cagaggcacagccggg

SEQ ID NO: 6699733 - DNA, 11 bp, Homo sapiens
cagaggcagag

SEQ ID NO: 6699734 - DNA, 19 bp, Homo sapiens
cagaggcagaggttgcagt

SEQ ID NO: 6699735 - DNA, 11 bp, Homo sapiens
cagaggcagcc

SEQ ID NO: 6699736 - DNA, 22 bp, Homo sapiens
cagaggcagccccattctgcct

SEQ ID NO: 6699737 - DNA, 21 bp, Homo sapiens
cagaggcagcccgcacacctg

SEQ ID NO: 6699738 - DNA, 19 bp, Homo sapiens
cagaggcagcttcaagtgc

SEQ ID NO: 6699739 - DNA, 16 bp, Homo sapiens
cagaggcaggagtggc

SEQ ID NO: 6699740 - DNA, 18 bp, Homo sapiens
cagaggcaggagtggcag

SEQ ID NO: 6699741 - DNA, 13 bp, Homo sapiens
cagaggcaggctg

SEQ ID NO: 6699742 - DNA, 15 bp, Homo sapiens
cagaggcaggctggg

SEQ ID NO: 6699743 - DNA, 15 bp, Homo sapiens
cagaggcagggcagc

SEQ ID NO: 6699744 - DNA, 14 bp, Homo sapiens
cagaggcagggccc

SEQ ID NO: 6699745 - DNA, 17 bp, Homo sapiens
cagaggcagggccctgg

SEQ ID NO: 6699746 - DNA, 21 bp, Homo sapiens
cagaggcagggccctggggtc

SEQ ID NO: 6699747 - DNA, 14 bp, Homo sapiens
cagaggcagtggca

SEQ ID NO: 6699748 - DNA, 16 bp, Homo sapiens
cagaggcagtggcagc

SEQ ID NO: 6699749 - DNA, 17 bp, Homo sapiens
cagaggcagtggcagca

SEQ ID NO: 6699750 - DNA, 16 bp, Homo sapiens
cagaggcagtggccac

SEQ ID NO: 6699751 - DNA, 20 bp, Homo sapiens
cagaggcatttgagcagctg

SEQ ID NO: 6699752 - DNA, 20 bp, Homo sapiens
cagaggccaaggactgactt

SEQ ID NO: 6699753 - DNA, 15 bp, Homo sapiens
cagaggccacttgct

SEQ ID NO: 6699754 - DNA, 20 bp, Homo sapiens
cagaggccacttgcttgctg

SEQ ID NO: 6699755 - DNA, 21 bp, Homo sapiens
cagaggccatgggcctcctgt

SEQ ID NO: 6699756 - DNA, 19 bp, Homo sapiens
cagaggcccaggctgccgt

SEQ ID NO: 6699757 - DNA, 23 bp, Homo sapiens
cagaggccccaataccccatgga

SEQ ID NO: 6699758 - DNA, 12 bp, Homo sapiens
cagaggccccac

SEQ ID NO: 6699759 - DNA, 13 bp, Homo sapiens
cagaggccccacc

SEQ ID NO: 6699760 - DNA, 13 bp, Homo sapiens
cagaggcccccag

SEQ ID NO: 6699761 - DNA, 17 bp, Homo sapiens
cagaggcccccagccca

SEQ ID NO: 6699762 - DNA, 16 bp, Homo sapiens
cagaggcccccagtgg

SEQ ID NO: 6699763 - DNA, 22 bp, Homo sapiens
cagaggcccccagtggggacag

SEQ ID NO: 6699764 - DNA, 21 bp, Homo sapiens
cagaggccccttgctgctggc

SEQ ID NO: 6699765 - DNA, 18 bp, Homo sapiens
cagaggcccgaggcaccg

SEQ ID NO: 6699766 - DNA, 11 bp, Homo sapiens
cagaggccctg

SEQ ID NO: 6699767 - DNA, 13 bp, Homo sapiens
cagaggccctgaa

SEQ ID NO: 6699768 - DNA, 18 bp, Homo sapiens
cagaggccctgaagcctc

SEQ ID NO: 6699769 - DNA, 22 bp, Homo sapiens
cagaggccctgaagcctccgtg

SEQ ID NO: 6699770 - DNA, 16 bp, Homo sapiens
cagaggccctgccacg

SEQ ID NO: 6699771 - DNA, 14 bp, Homo sapiens
cagaggccctgccc

SEQ ID NO: 6699772 - DNA, 20 bp, Homo sapiens
cagaggccctgcccccaccc

SEQ ID NO: 6699773 - DNA, 16 bp, Homo sapiens
cagaggccctggaggg

SEQ ID NO: 6699774 - DNA, 21 bp, Homo sapiens
cagaggccgaaggtgcctcag

SEQ ID NO: 6699775 - DNA, 18 bp, Homo sapiens
cagaggccgctgcccctg

SEQ ID NO: 6699776 - DNA, 19 bp, Homo sapiens
cagaggccgctgcccctga

SEQ ID NO: 6699777 - DNA, 20 bp, Homo sapiens
cagaggccgctgcccctgag

SEQ ID NO: 6699778 - DNA, 23 bp, Homo sapiens
cagaggcctagtcagccacatgg

SEQ ID NO: 6699779 - DNA, 12 bp, Homo sapiens
cagaggcctccc

SEQ ID NO: 6699780 - DNA, 22 bp, Homo sapiens
cagaggcctcccccagccagga

SEQ ID NO: 6699781 - DNA, 12 bp, Homo sapiens
cagaggcctcct

SEQ ID NO: 6699782 - DNA, 21 bp, Homo sapiens
cagaggcctcttttcctgaag

SEQ ID NO: 6699783 - DNA, 19 bp, Homo sapiens
cagaggcctgaagctgagc

SEQ ID NO: 6699784 - DNA, 20 bp, Homo sapiens
cagaggcctgcagggcctct

SEQ ID NO: 6699785 - DNA, 23 bp, Homo sapiens
cagaggcctgctgccagtgcagc

SEQ ID NO: 6699786 - DNA, 23 bp, Homo sapiens
cagaggcctggcatcttctggag

SEQ ID NO: 6699787 - DNA, 16 bp, Homo sapiens
cagaggcctgggctgg

SEQ ID NO: 6699788 - DNA, 15 bp, Homo sapiens
cagaggcctggggga

SEQ ID NO: 6699789 - DNA, 15 bp, Homo sapiens
cagaggcctggtgcc

SEQ ID NO: 6699790 - DNA, 18 bp, Homo sapiens
cagaggccttgggagctc

SEQ ID NO: 6699791 - DNA, 22 bp, Homo sapiens
cagaggccttgtcatcctccct

SEQ ID NO: 6699792 - DNA, 23 bp, Homo sapiens
cagaggcgcatgaatttgtgaag

SEQ ID NO: 6699793 - DNA, 23 bp, Homo sapiens
cagaggcgtactacccagctctg

SEQ ID NO: 6699794 - DNA, 19 bp, Homo sapiens
cagaggcgtcccgcacctg

SEQ ID NO: 6699795 - DNA, 18 bp, Homo sapiens
cagaggctcagagactgc

SEQ ID NO: 6699796 - DNA, 13 bp, Homo sapiens
cagaggctcctgg

SEQ ID NO: 6699797 - DNA, 21 bp, Homo sapiens
cagaggctcctggagccagcc

SEQ ID NO: 6699798 - DNA, 16 bp, Homo sapiens
cagaggctgagccctg

SEQ ID NO: 6699799 - DNA, 18 bp, Homo sapiens
cagaggctgagccctgta

SEQ ID NO: 6699800 - DNA, 22 bp, Homo sapiens
cagaggctgcacccctgggcca

SEQ ID NO: 6699801 - DNA, 13 bp, Homo sapiens
cagaggctgcagg

SEQ ID NO: 6699802 - DNA, 13 bp, Homo sapiens
cagaggctggcac

SEQ ID NO: 6699803 - DNA, 15 bp, Homo sapiens
cagaggctggcctca

SEQ ID NO: 6699804 - DNA, 16 bp, Homo sapiens
cagaggctggcctcag

SEQ ID NO: 6699805 - DNA, 18 bp, Homo sapiens
cagaggctgggagcatag

SEQ ID NO: 6699806 - DNA, 14 bp, Homo sapiens
cagaggctgggagt

SEQ ID NO: 6699807 - DNA, 14 bp, Homo sapiens
cagaggctgggttc

SEQ ID NO: 6699808 - DNA, 15 bp, Homo sapiens
cagaggcttcttcag

SEQ ID NO: 6699809 - DNA, 20 bp, Homo sapiens
cagaggcttttccagtgtgt

SEQ ID NO: 6699810 - DNA, 22 bp, Homo sapiens
cagaggcttttccagtgtgtat

SEQ ID NO: 6699811 - DNA, 20 bp, Homo sapiens
cagagggaaactcagatgtc

SEQ ID NO: 6699812 - DNA, 23 bp, Homo sapiens
cagagggaaagtaaatatttcag

SEQ ID NO: 6699813 - DNA, 19 bp, Homo sapiens
cagagggaagaaaagagct

SEQ ID NO: 6699814 - DNA, 21 bp, Homo sapiens
cagagggaagccagtcagggc

SEQ ID NO: 6699815 - DNA, 20 bp, Homo sapiens
cagagggaagccatgtgggg

SEQ ID NO: 6699816 - DNA, 19 bp, Homo sapiens
cagagggaatgttccctgc

SEQ ID NO: 6699817 - DNA, 20 bp, Homo sapiens
cagagggaatgttccctgca

SEQ ID NO: 6699818 - DNA, 13 bp, Homo sapiens
cagagggacaggg

SEQ ID NO: 6699819 - DNA, 17 bp, Homo sapiens
cagagggacagggtgga

SEQ ID NO: 6699820 - DNA, 22 bp, Homo sapiens
cagagggaccaaattgcttcta

SEQ ID NO: 6699821 - DNA, 16 bp, Homo sapiens
cagagggaccagctgg

SEQ ID NO: 6699822 - DNA, 17 bp, Homo sapiens
cagagggaccagctggg

SEQ ID NO: 6699823 - DNA, 12 bp, Homo sapiens
cagagggactgg

SEQ ID NO: 6699824 - DNA, 16 bp, Homo sapiens
cagagggagaagggag

SEQ ID NO: 6699825 - DNA, 21 bp, Homo sapiens
cagagggagaagggagaacag

SEQ ID NO: 6699826 - DNA, 18 bp, Homo sapiens
cagagggagacagggctg

SEQ ID NO: 6699827 - DNA, 23 bp, Homo sapiens
cagagggagacagggctgctccc

SEQ ID NO: 6699828 - DNA, 22 bp, Homo sapiens
cagagggagacggccctgctgg

SEQ ID NO: 6699829 - DNA, 12 bp, Homo sapiens
cagagggagcag

SEQ ID NO: 6699830 - DNA, 22 bp, Homo sapiens
cagagggagctggaacccgagg

SEQ ID NO: 6699831 - DNA, 14 bp, Homo sapiens
cagagggagtgaca

SEQ ID NO: 6699832 - DNA, 18 bp, Homo sapiens
cagagggcacatgaacag

SEQ ID NO: 6699833 - DNA, 15 bp, Homo sapiens
cagagggcaggggtg

SEQ ID NO: 6699834 - DNA, 16 bp, Homo sapiens
cagagggcatgctgaa

SEQ ID NO: 6699835 - DNA, 13 bp, Homo sapiens
cagagggccacac

SEQ ID NO: 6699836 - DNA, 15 bp, Homo sapiens
cagagggccagagct

SEQ ID NO: 6699837 - DNA, 14 bp, Homo sapiens
cagagggccagcag

SEQ ID NO: 6699838 - DNA, 15 bp, Homo sapiens
cagagggccagcagg

SEQ ID NO: 6699839 - DNA, 21 bp, Homo sapiens
cagagggccagcaggctcctg

SEQ ID NO: 6699840 - DNA, 23 bp, Homo sapiens
cagagggcccctcactggctgga

SEQ ID NO: 6699841 - DNA, 22 bp, Homo sapiens
cagagggcctgcaagggagtga

SEQ ID NO: 6699842 - DNA, 14 bp, Homo sapiens
cagagggcctggac

SEQ ID NO: 6699843 - DNA, 14 bp, Homo sapiens
cagagggcgccacc

SEQ ID NO: 6699844 - DNA, 15 bp, Homo sapiens
cagagggcgccacca

SEQ ID NO: 6699845 - DNA, 16 bp, Homo sapiens
cagagggcgccaccac

SEQ ID NO: 6699846 - DNA, 14 bp, Homo sapiens
cagagggcgctcct

SEQ ID NO: 6699847 - DNA, 17 bp, Homo sapiens
cagagggcgctcctgtt

SEQ ID NO: 6699848 - DNA, 18 bp, Homo sapiens
cagagggctggaggccca

SEQ ID NO: 6699849 - DNA, 21 bp, Homo sapiens
cagagggctggaggcccaggc

SEQ ID NO: 6699850 - DNA, 14 bp, Homo sapiens
cagagggctgtgtc

SEQ ID NO: 6699851 - DNA, 16 bp, Homo sapiens
cagagggctgtgtctt

SEQ ID NO: 6699852 - DNA, 19 bp, Homo sapiens
cagagggcttgtgaacaga

SEQ ID NO: 6699853 - DNA, 23 bp, Homo sapiens
cagaggggaaaccagtgtagcct

SEQ ID NO: 6699854 - DNA, 12 bp, Homo sapiens
cagaggggaagg

SEQ ID NO: 6699855 - DNA, 13 bp, Homo sapiens
cagaggggagagg

SEQ ID NO: 6699856 - DNA, 13 bp, Homo sapiens
cagaggggagcag

SEQ ID NO: 6699857 - DNA, 16 bp, Homo sapiens
cagaggggagcagtgg

SEQ ID NO: 6699858 - DNA, 17 bp, Homo sapiens
cagaggggcagatggaa

SEQ ID NO: 6699859 - DNA, 13 bp, Homo sapiens
cagaggggcagcc

SEQ ID NO: 6699860 - DNA, 14 bp, Homo sapiens
cagaggggcagccg

SEQ ID NO: 6699861 - DNA, 13 bp, Homo sapiens
cagaggggccagc

SEQ ID NO: 6699862 - DNA, 14 bp, Homo sapiens
cagaggggccaggc

SEQ ID NO: 6699863 - DNA, 15 bp, Homo sapiens
cagaggggccaggcc

SEQ ID NO: 6699864 - DNA, 22 bp, Homo sapiens
cagaggggccaggcccaggcag

SEQ ID NO: 6699865 - DNA, 23 bp, Homo sapiens
cagaggggcctgccacctggacc

SEQ ID NO: 6699866 - DNA, 20 bp, Homo sapiens
cagaggggcggggccaggat

SEQ ID NO: 6699867 - DNA, 20 bp, Homo sapiens
cagaggggctccccgggtct

SEQ ID NO: 6699868 - DNA, 19 bp, Homo sapiens
cagagggggagtagccaag

SEQ ID NO: 6699869 - DNA, 22 bp, Homo sapiens
cagagggggagtagccaagctg

SEQ ID NO: 6699870 - DNA, 21 bp, Homo sapiens
cagagggggcgtgcctgccaa

SEQ ID NO: 6699871 - DNA, 20 bp, Homo sapiens
cagagggggtggcctcccaa

SEQ ID NO: 6699872 - DNA, 21 bp, Homo sapiens
cagaggggtaggcagagcctt

SEQ ID NO: 6699873 - DNA, 16 bp, Homo sapiens
cagagggtcacagtgt

SEQ ID NO: 6699874 - DNA, 20 bp, Homo sapiens
cagagggtcacagtgtttac

SEQ ID NO: 6699875 - DNA, 15 bp, Homo sapiens
cagagggtggctgga

SEQ ID NO: 6699876 - DNA, 17 bp, Homo sapiens
cagagggtggctggagt

SEQ ID NO: 6699877 - DNA, 18 bp, Homo sapiens
cagagggtggctggagtg

SEQ ID NO: 6699878 - DNA, 17 bp, Homo sapiens
cagagggtgtcctgcac

SEQ ID NO: 6699879 - DNA, 22 bp, Homo sapiens
cagagggttgctggtcctgcac

SEQ ID NO: 6699880 - DNA, 19 bp, Homo sapiens
cagagggtttgtgcccagt

SEQ ID NO: 6699881 - DNA, 13 bp, Homo sapiens
cagaggtaacaga

SEQ ID NO: 6699882 - DNA, 15 bp, Homo sapiens
cagaggtaacagaac

SEQ ID NO: 6699883 - DNA, 17 bp, Homo sapiens
cagaggtaacagaacag

SEQ ID NO: 6699884 - DNA, 19 bp, Homo sapiens
cagaggtaacagaacagct

SEQ ID NO: 6699885 - DNA, 22 bp, Homo sapiens
cagaggtaactatcaatattta

SEQ ID NO: 6699886 - DNA, 13 bp, Homo sapiens
cagaggtaccctg

SEQ ID NO: 6699887 - DNA, 19 bp, Homo sapiens
cagaggtcacacagcctgt

SEQ ID NO: 6699888 - DNA, 23 bp, Homo sapiens
cagaggtcacacagcctgtgtgc

SEQ ID NO: 6699889 - DNA, 20 bp, Homo sapiens
cagaggtccacaacacacag

SEQ ID NO: 6699890 - DNA, 16 bp, Homo sapiens
cagaggtccagcccat

SEQ ID NO: 6699891 - DNA, 14 bp, Homo sapiens
cagaggtccaggcc

SEQ ID NO: 6699892 - DNA, 18 bp, Homo sapiens
cagaggtccaggtcccag

SEQ ID NO: 6699893 - DNA, 17 bp, Homo sapiens
cagaggtcccctgaggt

SEQ ID NO: 6699894 - DNA, 21 bp, Homo sapiens
cagaggtcccctgaggtcatg

SEQ ID NO: 6699895 - DNA, 22 bp, Homo sapiens
cagaggtcgcagctaccctcag

SEQ ID NO: 6699896 - DNA, 17 bp, Homo sapiens
cagaggtctagattaat

SEQ ID NO: 6699897 - DNA, 13 bp, Homo sapiens
cagaggtctccca

SEQ ID NO: 6699898 - DNA, 15 bp, Homo sapiens
cagaggtctctgccg

SEQ ID NO: 6699899 - DNA, 16 bp, Homo sapiens
cagaggtcttcagggc

SEQ ID NO: 6699900 - DNA, 22 bp, Homo sapiens
cagaggtgagcagaggagtcca

SEQ ID NO: 6699901 - DNA, 21 bp, Homo sapiens
cagaggtgcttcaccctgagt

SEQ ID NO: 6699902 - DNA, 14 bp, Homo sapiens
cagaggtggagcca

SEQ ID NO: 6699903 - DNA, 12 bp, Homo sapiens
cagaggtggccc

SEQ ID NO: 6699904 - DNA, 20 bp, Homo sapiens
cagaggtggccctcccaggc

SEQ ID NO: 6699905 - DNA, 23 bp, Homo sapiens
cagaggtggccctcccaggctgg

SEQ ID NO: 6699906 - DNA, 16 bp, Homo sapiens
cagaggtggcgcccag

SEQ ID NO: 6699907 - DNA, 23 bp, Homo sapiens
cagaggtgggaggcccctggtgg

SEQ ID NO: 6699908 - DNA, 22 bp, Homo sapiens
cagaggtgggcaggtggtggca

SEQ ID NO: 6699909 - DNA, 23 bp, Homo sapiens
cagaggtggggaagagagcctgc

SEQ ID NO: 6699910 - DNA, 16 bp, Homo sapiens
cagaggtggggtgctg

SEQ ID NO: 6699911 - DNA, 19 bp, Homo sapiens
cagaggtgtacactaacat

SEQ ID NO: 6699912 - DNA, 20 bp, Homo sapiens
cagaggttatctgcctggcc

SEQ ID NO: 6699913 - DNA, 19 bp, Homo sapiens
cagaggttatctgtcccag

SEQ ID NO: 6699914 - DNA, 21 bp, Homo sapiens
cagaggttatctgtcccaggt

SEQ ID NO: 6699915 - DNA, 21 bp, Homo sapiens
cagaggttcggactaacattt

SEQ ID NO: 6699916 - DNA, 15 bp, Homo sapiens
cagaggttgcagtga

SEQ ID NO: 6699917 - DNA, 16 bp, Homo sapiens
cagaggttgcagtgag

SEQ ID NO: 6699918 - DNA, 22 bp, Homo sapiens
cagaggttgcagtgagctgaga

SEQ ID NO: 6699919 - DNA, 16 bp, Homo sapiens
cagaggtttcattttc

SEQ ID NO: 6699920 - DNA, 18 bp, Homo sapiens
cagaggtttgaaggagaa

SEQ ID NO: 6699921 - DNA, 22 bp, Homo sapiens
cagaggtttgaaggagaatggc

SEQ ID NO: 6699922 - DNA, 15 bp, Homo sapiens
cagaggtttggagcc

SEQ ID NO: 6699923 - DNA, 21 bp, Homo sapiens
cagaggttttaatgtctgttt

SEQ ID NO: 6699924 - DNA, 22 bp, Homo sapiens
cagaggttttaggaaacctggc

SEQ ID NO: 6699925 - DNA, 20 bp, Homo sapiens
cagagtaaaattacagaaga

SEQ ID NO: 6699926 - DNA, 21 bp, Homo sapiens
cagagtaacaaaaaataaaga

SEQ ID NO: 6699927 - DNA, 18 bp, Homo sapiens
cagagtaacatgccagct

SEQ ID NO: 6699928 - DNA, 19 bp, Homo sapiens
cagagtaacgagaagacaa

SEQ ID NO: 6699929 - DNA, 17 bp, Homo sapiens
cagagtacgtcctgcct

SEQ ID NO: 6699930 - DNA, 19 bp, Homo sapiens
cagagtacgtcctgcctgg

SEQ ID NO: 6699931 - DNA, 22 bp, Homo sapiens
cagagtacgtcctgcctggcac

SEQ ID NO: 6699932 - DNA, 13 bp, Homo sapiens
cagagtagaaata

SEQ ID NO: 6699933 - DNA, 18 bp, Homo sapiens
cagagtagccatgaggag

SEQ ID NO: 6699934 - DNA, 16 bp, Homo sapiens
cagagtagctgggact

SEQ ID NO: 6699935 - DNA, 20 bp, Homo sapiens
cagagtaggggtctgtcttt

SEQ ID NO: 6699936 - DNA, 23 bp, Homo sapiens
cagagtaggggtctgtcttttaa

SEQ ID NO: 6699937 - DNA, 16 bp, Homo sapiens
cagagtaggtgggtct

SEQ ID NO: 6699938 - DNA, 23 bp, Homo sapiens
cagagtataattttggttgtaat

SEQ ID NO: 6699939 - DNA, 18 bp, Homo sapiens
cagagtatacaagtgttt

SEQ ID NO: 6699940 - DNA, 16 bp, Homo sapiens
cagagtataggatgga

SEQ ID NO: 6699941 - DNA, 22 bp, Homo sapiens
cagagtataggatggattgcag

SEQ ID NO: 6699942 - DNA, 17 bp, Homo sapiens
cagagtatatatgtaca

SEQ ID NO: 6699943 - DNA, 21 bp, Homo sapiens
cagagtatatttttgtctgca

SEQ ID NO: 6699944 - DNA, 16 bp, Homo sapiens
cagagtatctaatcct

SEQ ID NO: 6699945 - DNA, 17 bp, Homo sapiens
cagagtatgagtgcaag

SEQ ID NO: 6699946 - DNA, 20 bp, Homo sapiens
cagagtatgtccgatggtat

SEQ ID NO: 6699947 - DNA, 17 bp, Homo sapiens
cagagtatgttcttgaa

SEQ ID NO: 6699948 - DNA, 22 bp, Homo sapiens
cagagtatgtttttaagtgtat

SEQ ID NO: 6699949 - DNA, 18 bp, Homo sapiens
cagagtcaacaaattaaa

SEQ ID NO: 6699950 - DNA, 19 bp, Homo sapiens
cagagtcacaagcctcgag

SEQ ID NO: 6699951 - DNA, 23 bp, Homo sapiens
cagagtcacaagtagcctctggg

SEQ ID NO: 6699952 - DNA, 21 bp, Homo sapiens
cagagtcacacgggggcagct

SEQ ID NO: 6699953 - DNA, 22 bp, Homo sapiens
cagagtcagaattaggcacttg

SEQ ID NO: 6699954 - DNA, 18 bp, Homo sapiens
cagagtcagaggagaaga

SEQ ID NO: 6699955 - DNA, 15 bp, Homo sapiens
cagagtcagcagaac

SEQ ID NO: 6699956 - DNA, 15 bp, Homo sapiens
cagagtcagccagga

SEQ ID NO: 6699957 - DNA, 16 bp, Homo sapiens
cagagtcagccaggac

SEQ ID NO: 6699958 - DNA, 13 bp, Homo sapiens
cagagtcaggaag

SEQ ID NO: 6699959 - DNA, 16 bp, Homo sapiens
cagagtcaggaagaga

SEQ ID NO: 6699960 - DNA, 16 bp, Homo sapiens
cagagtccaatttaag

SEQ ID NO: 6699961 - DNA, 18 bp, Homo sapiens
cagagtccaatttaagga

SEQ ID NO: 6699962 - DNA, 12 bp, Homo sapiens
cagagtccagtg

SEQ ID NO: 6699963 - DNA, 13 bp, Homo sapiens
cagagtccagtgc

SEQ ID NO: 6699964 - DNA, 18 bp, Homo sapiens
cagagtccagtgctctgc

SEQ ID NO: 6699965 - DNA, 20 bp, Homo sapiens
cagagtccagtgctctgcct

SEQ ID NO: 6699966 - DNA, 22 bp, Homo sapiens
cagagtccccccactcccagca

SEQ ID NO: 6699967 - DNA, 18 bp, Homo sapiens
cagagtccctgcctggac

SEQ ID NO: 6699968 - DNA, 20 bp, Homo sapiens
cagagtccgggagaatgctg

SEQ ID NO: 6699969 - DNA, 17 bp, Homo sapiens
cagagtcctcattataa

SEQ ID NO: 6699970 - DNA, 22 bp, Homo sapiens
cagagtcctgccgacggagcca

SEQ ID NO: 6699971 - DNA, 13 bp, Homo sapiens
cagagtcctgcct

SEQ ID NO: 6699972 - DNA, 23 bp, Homo sapiens
cagagtcctggtttcctcagcct

SEQ ID NO: 6699973 - DNA, 16 bp, Homo sapiens
cagagtccttaaaatg

SEQ ID NO: 6699974 - DNA, 15 bp, Homo sapiens
cagagtcctttccaa

SEQ ID NO: 6699975 - DNA, 18 bp, Homo sapiens
cagagtcggaacggagaa

SEQ ID NO: 6699976 - DNA, 18 bp, Homo sapiens
cagagtcgttggagactg

SEQ ID NO: 6699977 - DNA, 20 bp, Homo sapiens
cagagtcgttggagactgaa

SEQ ID NO: 6699978 - DNA, 18 bp, Homo sapiens
cagagtctcactctgttg

SEQ ID NO: 6699979 - DNA, 13 bp, Homo sapiens
cagagtctcactg

SEQ ID NO: 6699980 - DNA, 17 bp, Homo sapiens
cagagtctcactgttgc

SEQ ID NO: 6699981 - DNA, 21 bp, Homo sapiens
cagagtctcactgttgcccag

SEQ ID NO: 6699982 - DNA, 23 bp, Homo sapiens
cagagtctcactgttgcccaggc

SEQ ID NO: 6699983 - DNA, 15 bp, Homo sapiens
cagagtctcccagtg

SEQ ID NO: 6699984 - DNA, 17 bp, Homo sapiens
cagagtctcccagtggg

SEQ ID NO: 6699985 - DNA, 20 bp, Homo sapiens
cagagtctcccagtgggtga

SEQ ID NO: 6699986 - DNA, 17 bp, Homo sapiens
cagagtctcccgctgca

SEQ ID NO: 6699987 - DNA, 17 bp, Homo sapiens
cagagtctcgctctgtc

SEQ ID NO: 6699988 - DNA, 23 bp, Homo sapiens
cagagtctcgctctgttgcccag

SEQ ID NO: 6699989 - DNA, 17 bp, Homo sapiens
cagagtctgacaggaag

SEQ ID NO: 6699990 - DNA, 22 bp, Homo sapiens
cagagtctgacaggaagactgg

SEQ ID NO: 6699991 - DNA, 15 bp, Homo sapiens
cagagtctgagcccc

SEQ ID NO: 6699992 - DNA, 23 bp, Homo sapiens
cagagtctggagctgagctacct

SEQ ID NO: 6699993 - DNA, 17 bp, Homo sapiens
cagagtctggcctgcca

SEQ ID NO: 6699994 - DNA, 14 bp, Homo sapiens
cagagtctggctct

SEQ ID NO: 6699995 - DNA, 18 bp, Homo sapiens
cagagtctgggcctctga

SEQ ID NO: 6699996 - DNA, 20 bp, Homo sapiens
cagagtctgtatttttctaa

SEQ ID NO: 6699997 - DNA, 22 bp, Homo sapiens
cagagtctgtgtgtagccagga

SEQ ID NO: 6699998 - DNA, 21 bp, Homo sapiens
cagagtgaaaaatcttaagta

SEQ ID NO: 6699999 - DNA, 16 bp, Homo sapiens
cagagtgaaattcaat

SEQ ID NO: 6700000 - DNA, 18 bp, Homo sapiens
cagagtgaagagtgaaga

SEQ ID NO: 6700001 - DNA, 19 bp, Homo sapiens
cagagtgaagagtgaagag

SEQ ID NO: 6700002 - DNA, 22 bp, Homo sapiens
cagagtgacacccaagagggct

SEQ ID NO: 6700003 - DNA, 23 bp, Homo sapiens
cagagtgacacccaagagggctg

SEQ ID NO: 6700004 - DNA, 15 bp, Homo sapiens
cagagtgacagtcat

SEQ ID NO: 6700005 - DNA, 21 bp, Homo sapiens
cagagtgaccagcacactgga

SEQ ID NO: 6700006 - DNA, 14 bp, Homo sapiens
cagagtgagaccca

SEQ ID NO: 6700007 - DNA, 17 bp, Homo sapiens
cagagtgagacccagcc

SEQ ID NO: 6700008 - DNA, 18 bp, Homo sapiens
cagagtgagaccctgtct

SEQ ID NO: 6700009 - DNA, 18 bp, Homo sapiens
cagagtgagactctgtct

SEQ ID NO: 6700010 - DNA, 22 bp, Homo sapiens
cagagtgagcaagggggcccaa

SEQ ID NO: 6700011 - DNA, 11 bp, Homo sapiens
cagagtgagcc

SEQ ID NO: 6700012 - DNA, 15 bp, Homo sapiens
cagagtgattctagt

SEQ ID NO: 6700013 - DNA, 19 bp, Homo sapiens
cagagtgattgtagtttaa

SEQ ID NO: 6700014 - DNA, 23 bp, Homo sapiens
cagagtgcaagcccctgctccag

SEQ ID NO: 6700015 - DNA, 15 bp, Homo sapiens
cagagtgcacagctg

SEQ ID NO: 6700016 - DNA, 15 bp, Homo sapiens
cagagtgcagaggcg

SEQ ID NO: 6700017 - DNA, 20 bp, Homo sapiens
cagagtgcagaggcggctct

SEQ ID NO: 6700018 - DNA, 14 bp, Homo sapiens
cagagtgcagcagc

SEQ ID NO: 6700019 - DNA, 15 bp, Homo sapiens
cagagtgcagtggcg

SEQ ID NO: 6700020 - DNA, 17 bp, Homo sapiens
cagagtgccatccctga

SEQ ID NO: 6700021 - DNA, 15 bp, Homo sapiens
cagagtgcccagaac

SEQ ID NO: 6700022 - DNA, 12 bp, Homo sapiens
cagagtgcccca

SEQ ID NO: 6700023 - DNA, 14 bp, Homo sapiens
cagagtgccccacc

SEQ ID NO: 6700024 - DNA, 17 bp, Homo sapiens
cagagtgccccacctgc

SEQ ID NO: 6700025 - DNA, 19 bp, Homo sapiens
cagagtgccccacctgcca

SEQ ID NO: 6700026 - DNA, 20 bp, Homo sapiens
cagagtgccccacctgccac

SEQ ID NO: 6700027 - DNA, 21 bp, Homo sapiens
cagagtgccccacctgccact

SEQ ID NO: 6700028 - DNA, 17 bp, Homo sapiens
cagagtgctgaggccag

SEQ ID NO: 6700029 - DNA, 16 bp, Homo sapiens
cagagtgctggactgt

SEQ ID NO: 6700030 - DNA, 17 bp, Homo sapiens
cagagtgctggcactta

SEQ ID NO: 6700031 - DNA, 13 bp, Homo sapiens
cagagtgctggga

SEQ ID NO: 6700032 - DNA, 20 bp, Homo sapiens
cagagtgctgtcgggaccac

SEQ ID NO: 6700033 - DNA, 23 bp, Homo sapiens
cagagtgctgtcgggaccacatc

SEQ ID NO: 6700034 - DNA, 23 bp, Homo sapiens
cagagtgctttaaaaaattctct

SEQ ID NO: 6700035 - DNA, 19 bp, Homo sapiens
cagagtggaaactcagccg

SEQ ID NO: 6700036 - DNA, 17 bp, Homo sapiens
cagagtggaataagaca

SEQ ID NO: 6700037 - DNA, 18 bp, Homo sapiens
cagagtggactcttccct

SEQ ID NO: 6700038 - DNA, 20 bp, Homo sapiens
cagagtggactcttccctct

SEQ ID NO: 6700039 - DNA, 17 bp, Homo sapiens
cagagtggactgcattt

SEQ ID NO: 6700040 - DNA, 13 bp, Homo sapiens
cagagtggagccc

SEQ ID NO: 6700041 - DNA, 16 bp, Homo sapiens
cagagtggagcccagg

SEQ ID NO: 6700042 - DNA, 17 bp, Homo sapiens
cagagtggagcccaggg

SEQ ID NO: 6700043 - DNA, 21 bp, Homo sapiens
cagagtggagcccagggtgct

SEQ ID NO: 6700044 - DNA, 18 bp, Homo sapiens
cagagtggagccctcagt

SEQ ID NO: 6700045 - DNA, 15 bp, Homo sapiens
cagagtggagtctga

SEQ ID NO: 6700046 - DNA, 17 bp, Homo sapiens
cagagtggagtctgagt

SEQ ID NO: 6700047 - DNA, 15 bp, Homo sapiens
cagagtggatctgga

SEQ ID NO: 6700048 - DNA, 20 bp, Homo sapiens
cagagtggccaatccctgtg

SEQ ID NO: 6700049 - DNA, 14 bp, Homo sapiens
cagagtggccacgg

SEQ ID NO: 6700050 - DNA, 18 bp, Homo sapiens
cagagtggccacggccca

SEQ ID NO: 6700051 - DNA, 21 bp, Homo sapiens
cagagtggccacggcccaggg

SEQ ID NO: 6700052 - DNA, 23 bp, Homo sapiens
cagagtggccacggcccagggag

SEQ ID NO: 6700053 - DNA, 17 bp, Homo sapiens
cagagtggcctagagca

SEQ ID NO: 6700054 - DNA, 15 bp, Homo sapiens
cagagtggcctggcc

SEQ ID NO: 6700055 - DNA, 18 bp, Homo sapiens
cagagtggcctggccagg

SEQ ID NO: 6700056 - DNA, 21 bp, Homo sapiens
cagagtggcctggccaggagc

SEQ ID NO: 6700057 - DNA, 17 bp, Homo sapiens
cagagtggcctgtgagc

SEQ ID NO: 6700058 - DNA, 20 bp, Homo sapiens
cagagtggcgtgagctgccc

SEQ ID NO: 6700059 - DNA, 12 bp, Homo sapiens
cagagtggctca

SEQ ID NO: 6700060 - DNA, 14 bp, Homo sapiens
cagagtggctcact

SEQ ID NO: 6700061 - DNA, 17 bp, Homo sapiens
cagagtggctcactggc

SEQ ID NO: 6700062 - DNA, 21 bp, Homo sapiens
cagagtggctcactggctggg

SEQ ID NO: 6700063 - DNA, 12 bp, Homo sapiens
cagagtggctgc

SEQ ID NO: 6700064 - DNA, 17 bp, Homo sapiens
cagagtgggacttggag

SEQ ID NO: 6700065 - DNA, 21 bp, Homo sapiens
cagagtgggagaggctgggag

SEQ ID NO: 6700066 - DNA, 15 bp, Homo sapiens
cagagtgggccccgg

SEQ ID NO: 6700067 - DNA, 16 bp, Homo sapiens
cagagtgggctgcctg

SEQ ID NO: 6700068 - DNA, 18 bp, Homo sapiens
cagagtgggctgcctggg

SEQ ID NO: 6700069 - DNA, 21 bp, Homo sapiens
cagagtgggtcttggaccagg

SEQ ID NO: 6700070 - DNA, 12 bp, Homo sapiens
cagagtggtggg

SEQ ID NO: 6700071 - DNA, 19 bp, Homo sapiens
cagagtggtttcattgcct

SEQ ID NO: 6700072 - DNA, 18 bp, Homo sapiens
cagagtgtacaaattgtc

SEQ ID NO: 6700073 - DNA, 18 bp, Homo sapiens
cagagtgtatttttgtaa

SEQ ID NO: 6700074 - DNA, 14 bp, Homo sapiens
cagagtgtcctgct

SEQ ID NO: 6700075 - DNA, 16 bp, Homo sapiens
cagagtgtcctgctac

SEQ ID NO: 6700076 - DNA, 20 bp, Homo sapiens
cagagtgtccttcctctgtc

SEQ ID NO: 6700077 - DNA, 17 bp, Homo sapiens
cagagtgtgcagactga

SEQ ID NO: 6700078 - DNA, 16 bp, Homo sapiens
cagagtgtgctggagg

SEQ ID NO: 6700079 - DNA, 18 bp, Homo sapiens
cagagtgtgctggaggac

SEQ ID NO: 6700080 - DNA, 15 bp, Homo sapiens
cagagtgtggtccct

SEQ ID NO: 6700081 - DNA, 21 bp, Homo sapiens
cagagtgtggtccctccacta

SEQ ID NO: 6700082 - DNA, 17 bp, Homo sapiens
cagagtgtgtttttgca

SEQ ID NO: 6700083 - DNA, 14 bp, Homo sapiens
cagagttaaaatat

SEQ ID NO: 6700084 - DNA, 23 bp, Homo sapiens
cagagttaaaatgtttactgtaa

SEQ ID NO: 6700085 - DNA, 15 bp, Homo sapiens
cagagttaaagcata

SEQ ID NO: 6700086 - DNA, 17 bp, Homo sapiens
cagagttaaatctcaaa

SEQ ID NO: 6700087 - DNA, 12 bp, Homo sapiens
cagagttacagt

SEQ ID NO: 6700088 - DNA, 13 bp, Homo sapiens
cagagttacagtt

SEQ ID NO: 6700089 - DNA, 15 bp, Homo sapiens
cagagttacagttct

SEQ ID NO: 6700090 - DNA, 16 bp, Homo sapiens
cagagttacagttctg

SEQ ID NO: 6700091 - DNA, 18 bp, Homo sapiens
cagagttacagttctgtg

SEQ ID NO: 6700092 - DNA, 21 bp, Homo sapiens
cagagttattgaatcttaatt

SEQ ID NO: 6700093 - DNA, 15 bp, Homo sapiens
cagagttcacaggag

SEQ ID NO: 6700094 - DNA, 17 bp, Homo sapiens
cagagttcacaggaggc

SEQ ID NO: 6700095 - DNA, 23 bp, Homo sapiens
cagagttcagacttcgctaaggg

SEQ ID NO: 6700096 - DNA, 15 bp, Homo sapiens
cagagttcagggagg

SEQ ID NO: 6700097 - DNA, 22 bp, Homo sapiens
cagagttcagggaggggctgag

SEQ ID NO: 6700098 - DNA, 22 bp, Homo sapiens
cagagttccacaaatctatatt

SEQ ID NO: 6700099 - DNA, 14 bp, Homo sapiens
cagagttccacagt

SEQ ID NO: 6700100 - DNA, 17 bp, Homo sapiens
cagagttcctgcggagt

SEQ ID NO: 6700101 - DNA, 23 bp, Homo sapiens
cagagttcctgcggagtgaagag

SEQ ID NO: 6700102 - DNA, 19 bp, Homo sapiens
cagagttctgtgaagagga

SEQ ID NO: 6700103 - DNA, 22 bp, Homo sapiens
cagagttctgtgaagaggaaca

SEQ ID NO: 6700104 - DNA, 13 bp, Homo sapiens
cagagttctttgc

SEQ ID NO: 6700105 - DNA, 15 bp, Homo sapiens
cagagttgaagacag

SEQ ID NO: 6700106 - DNA, 18 bp, Homo sapiens
cagagttgaagacagagc

SEQ ID NO: 6700107 - DNA, 22 bp, Homo sapiens
cagagttgactttcctcccatt

SEQ ID NO: 6700108 - DNA, 19 bp, Homo sapiens
cagagttgctgggagctga

SEQ ID NO: 6700109 - DNA, 17 bp, Homo sapiens
cagagttgtaaatatat

SEQ ID NO: 6700110 - DNA, 18 bp, Homo sapiens
cagagttgttacattttt

SEQ ID NO: 6700111 - DNA, 18 bp, Homo sapiens
cagagttgttctcagggg

SEQ ID NO: 6700112 - DNA, 15 bp, Homo sapiens
cagagtttcagcttt

SEQ ID NO: 6700113 - DNA, 15 bp, Homo sapiens
cagagtttctgcagt

SEQ ID NO: 6700114 - DNA, 17 bp, Homo sapiens
cagagtttgccttcctt

SEQ ID NO: 6700115 - DNA, 19 bp, Homo sapiens
cagagtttgccttcctttc

SEQ ID NO: 6700116 - DNA, 22 bp, Homo sapiens
cagagtttgtagtaaatattat

SEQ ID NO: 6700117 - DNA, 13 bp, Homo sapiens
cagagtttgtgtg

SEQ ID NO: 6700118 - DNA, 16 bp, Homo sapiens
cagagtttgtgtgtat

SEQ ID NO: 6700119 - DNA, 17 bp, Homo sapiens
cagagtttgtgtgttgt

SEQ ID NO: 6700120 - DNA, 14 bp, Homo sapiens
cagagttttctaac

SEQ ID NO: 6700121 - DNA, 22 bp, Homo sapiens
cagagtttttaaagccttctgg

SEQ ID NO: 6700122 - DNA, 22 bp, Homo sapiens
cagagttttttaaacaaatgag

SEQ ID NO: 6700123 - DNA, 15 bp, Homo sapiens
cagataaaatatttt

SEQ ID NO: 6700124 - DNA, 22 bp, Homo sapiens
cagataaaatattttgttaact

SEQ ID NO: 6700125 - DNA, 21 bp, Homo sapiens
cagataaaatctactccaaat

SEQ ID NO: 6700126 - DNA, 16 bp, Homo sapiens
cagataaaatgttcag

SEQ ID NO: 6700127 - DNA, 17 bp, Homo sapiens
cagataaaatgttcagt

SEQ ID NO: 6700128 - DNA, 23 bp, Homo sapiens
cagataaagaaactgaggcccac

SEQ ID NO: 6700129 - DNA, 16 bp, Homo sapiens
cagataaagattgtgt

SEQ ID NO: 6700130 - DNA, 17 bp, Homo sapiens
cagataaagattgtgtg

SEQ ID NO: 6700131 - DNA, 17 bp, Homo sapiens
cagataaatacatttat

SEQ ID NO: 6700132 - DNA, 23 bp, Homo sapiens
cagataaatagtttatgattcca

SEQ ID NO: 6700133 - DNA, 16 bp, Homo sapiens
cagataaatcatgggc

SEQ ID NO: 6700134 - DNA, 20 bp, Homo sapiens
cagataacaatgcagcaagg

SEQ ID NO: 6700135 - DNA, 17 bp, Homo sapiens
cagataaccagctgtaa

SEQ ID NO: 6700136 - DNA, 15 bp, Homo sapiens
cagataactctcttt

SEQ ID NO: 6700137 - DNA, 18 bp, Homo sapiens
cagataactctctttcct

SEQ ID NO: 6700138 - DNA, 19 bp, Homo sapiens
cagataactctctttcctt

SEQ ID NO: 6700139 - DNA, 19 bp, Homo sapiens
cagataactgttatttata

SEQ ID NO: 6700140 - DNA, 20 bp, Homo sapiens
cagataactgttatttataa

SEQ ID NO: 6700141 - DNA, 19 bp, Homo sapiens
cagataagaatgctggttt

SEQ ID NO: 6700142 - DNA, 21 bp, Homo sapiens
cagataagaatgctggttttc

SEQ ID NO: 6700143 - DNA, 20 bp, Homo sapiens
cagataagacatatctctaa

SEQ ID NO: 6700144 - DNA, 22 bp, Homo sapiens
cagataagcaagagagatgttt

SEQ ID NO: 6700145 - DNA, 16 bp, Homo sapiens
cagataaggccgagcc

SEQ ID NO: 6700146 - DNA, 14 bp, Homo sapiens
cagataaggcttta

SEQ ID NO: 6700147 - DNA, 16 bp, Homo sapiens
cagataagtatgggat

SEQ ID NO: 6700148 - DNA, 14 bp, Homo sapiens
cagataagttattt

SEQ ID NO: 6700149 - DNA, 14 bp, Homo sapiens
cagataatcacaat

SEQ ID NO: 6700150 - DNA, 18 bp, Homo sapiens
cagataatcagcctctta

SEQ ID NO: 6700151 - DNA, 16 bp, Homo sapiens
cagataatgtgaaaat

SEQ ID NO: 6700152 - DNA, 17 bp, Homo sapiens
cagataattctggacca

SEQ ID NO: 6700153 - DNA, 21 bp, Homo sapiens
cagataattctggaccagaga

SEQ ID NO: 6700154 - DNA, 21 bp, Homo sapiens
cagataatttattttgtattt

SEQ ID NO: 6700155 - DNA, 14 bp, Homo sapiens
cagatacaatgtat

SEQ ID NO: 6700156 - DNA, 17 bp, Homo sapiens
cagatacaatgtattta

SEQ ID NO: 6700157 - DNA, 14 bp, Homo sapiens
cagatacacacaca

SEQ ID NO: 6700158 - DNA, 13 bp, Homo sapiens
cagatacactgct

SEQ ID NO: 6700159 - DNA, 16 bp, Homo sapiens
cagatacagcacatcc

SEQ ID NO: 6700160 - DNA, 23 bp, Homo sapiens
cagatacagccccaaaccagggt

SEQ ID NO: 6700161 - DNA, 20 bp, Homo sapiens
cagatacaggaaaagctgct

SEQ ID NO: 6700162 - DNA, 20 bp, Homo sapiens
cagatacatagatggaccag

SEQ ID NO: 6700163 - DNA, 15 bp, Homo sapiens
cagatacatcactgc

SEQ ID NO: 6700164 - DNA, 16 bp, Homo sapiens
cagatacatcactgct

SEQ ID NO: 6700165 - DNA, 14 bp, Homo sapiens
cagatacatgggga

SEQ ID NO: 6700166 - DNA, 16 bp, Homo sapiens
cagatacatggggaac

SEQ ID NO: 6700167 - DNA, 14 bp, Homo sapiens
cagataccagcccc

SEQ ID NO: 6700168 - DNA, 21 bp, Homo sapiens
cagataccatactcatttcta

SEQ ID NO: 6700169 - DNA, 22 bp, Homo sapiens
cagataccatgatgctgagccc

SEQ ID NO: 6700170 - DNA, 23 bp, Homo sapiens
cagatacctcatcatccacccgc

SEQ ID NO: 6700171 - DNA, 18 bp, Homo sapiens
cagatacctccaaccctg

SEQ ID NO: 6700172 - DNA, 16 bp, Homo sapiens
cagatacctgtgagga

SEQ ID NO: 6700173 - DNA, 17 bp, Homo sapiens
cagataccttgaaagga

SEQ ID NO: 6700174 - DNA, 19 bp, Homo sapiens
cagataccttgaaaggaag

SEQ ID NO: 6700175 - DNA, 20 bp, Homo sapiens
cagatacgggggctgtgact

SEQ ID NO: 6700176 - DNA, 20 bp, Homo sapiens
cagatacgtagttgtgcttt

SEQ ID NO: 6700177 - DNA, 18 bp, Homo sapiens
cagatactactgaccaga

SEQ ID NO: 6700178 - DNA, 14 bp, Homo sapiens
cagatactgtcttt

SEQ ID NO: 6700179 - DNA, 15 bp, Homo sapiens
cagatactgtgagct

SEQ ID NO: 6700180 - DNA, 19 bp, Homo sapiens
cagatacttggggggctga

SEQ ID NO: 6700181 - DNA, 16 bp, Homo sapiens
cagatacttgtgaaca

SEQ ID NO: 6700182 - DNA, 18 bp, Homo sapiens
cagatacttgtgaacatg

SEQ ID NO: 6700183 - DNA, 13 bp, Homo sapiens
cagatagagaaat

SEQ ID NO: 6700184 - DNA, 17 bp, Homo sapiens
cagatagagctgggtgg

SEQ ID NO: 6700185 - DNA, 13 bp, Homo sapiens
cagatagatctgt

SEQ ID NO: 6700186 - DNA, 13 bp, Homo sapiens
cagatagatgtcg

SEQ ID NO: 6700187 - DNA, 18 bp, Homo sapiens
cagatagatgttgctctt

SEQ ID NO: 6700188 - DNA, 16 bp, Homo sapiens
cagatagcaggaggaa

SEQ ID NO: 6700189 - DNA, 17 bp, Homo sapiens
cagatagccagacacat

SEQ ID NO: 6700190 - DNA, 14 bp, Homo sapiens
cagatagcccagga

SEQ ID NO: 6700191 - DNA, 22 bp, Homo sapiens
cagatagcctagggtgagggtg

SEQ ID NO: 6700192 - DNA, 19 bp, Homo sapiens
cagataggccttcttgtga

SEQ ID NO: 6700193 - DNA, 13 bp, Homo sapiens
cagatagtcccag

SEQ ID NO: 6700194 - DNA, 17 bp, Homo sapiens
cagatagtgcctctgca

SEQ ID NO: 6700195 - DNA, 20 bp, Homo sapiens
cagatagtgtagctgaggag

SEQ ID NO: 6700196 - DNA, 14 bp, Homo sapiens
cagatataaatact

SEQ ID NO: 6700197 - DNA, 13 bp, Homo sapiens
cagatataactgt

SEQ ID NO: 6700198 - DNA, 15 bp, Homo sapiens
cagatataagatttg

SEQ ID NO: 6700199 - DNA, 19 bp, Homo sapiens
cagatataagatttgtaca

SEQ ID NO: 6700200 - DNA, 15 bp, Homo sapiens
cagatatacacatgg

SEQ ID NO: 6700201 - DNA, 18 bp, Homo sapiens
cagatatacacatggatg

SEQ ID NO: 6700202 - DNA, 18 bp, Homo sapiens
cagatatactttgtggac

SEQ ID NO: 6700203 - DNA, 19 bp, Homo sapiens
cagatatagatcctgagct

SEQ ID NO: 6700204 - DNA, 19 bp, Homo sapiens
cagatatattaagtgactg

SEQ ID NO: 6700205 - DNA, 17 bp, Homo sapiens
cagatatatttaagcct

SEQ ID NO: 6700206 - DNA, 19 bp, Homo sapiens
cagatatatttttcacagt

SEQ ID NO: 6700207 - DNA, 18 bp, Homo sapiens
cagatatccacataaatg

SEQ ID NO: 6700208 - DNA, 20 bp, Homo sapiens
cagatatccacataaatgct

SEQ ID NO: 6700209 - DNA, 20 bp, Homo sapiens
cagatatctatggcagcaca

SEQ ID NO: 6700210 - DNA, 16 bp, Homo sapiens
cagatatctgcatgtg

SEQ ID NO: 6700211 - DNA, 20 bp, Homo sapiens
cagatatcttggacaaatca

SEQ ID NO: 6700212 - DNA, 13 bp, Homo sapiens
cagatatcttttt

SEQ ID NO: 6700213 - DNA, 14 bp, Homo sapiens
cagatatgattcaa

SEQ ID NO: 6700214 - DNA, 18 bp, Homo sapiens
cagatatgcacacacatg

SEQ ID NO: 6700215 - DNA, 15 bp, Homo sapiens
cagatatgcttacta

SEQ ID NO: 6700216 - DNA, 13 bp, Homo sapiens
cagatatggaaac

SEQ ID NO: 6700217 - DNA, 18 bp, Homo sapiens
cagatatggaaacagaag

SEQ ID NO: 6700218 - DNA, 19 bp, Homo sapiens
cagatatggaaacagaaga

SEQ ID NO: 6700219 - DNA, 22 bp, Homo sapiens
cagatatggaaacagaagacaa

SEQ ID NO: 6700220 - DNA, 13 bp, Homo sapiens
cagatatgtatta

SEQ ID NO: 6700221 - DNA, 17 bp, Homo sapiens
cagatatgtattacttt

SEQ ID NO: 6700222 - DNA, 15 bp, Homo sapiens
cagatatttaaattt

SEQ ID NO: 6700223 - DNA, 17 bp, Homo sapiens
cagatatttagctctgt

SEQ ID NO: 6700224 - DNA, 18 bp, Homo sapiens
cagatatttagctctgtg

SEQ ID NO: 6700225 - DNA, 14 bp, Homo sapiens
cagatatttatatt

SEQ ID NO: 6700226 - DNA, 14 bp, Homo sapiens
cagatatttcaaac

SEQ ID NO: 6700227 - DNA, 18 bp, Homo sapiens
cagatatttccatttctt

SEQ ID NO: 6700228 - DNA, 13 bp, Homo sapiens
cagatatttgaga

SEQ ID NO: 6700229 - DNA, 12 bp, Homo sapiens
cagatattttat

SEQ ID NO: 6700230 - DNA, 22 bp, Homo sapiens
cagatattttcatatttaaagc

SEQ ID NO: 6700231 - DNA, 15 bp, Homo sapiens
cagatatttttctcc

SEQ ID NO: 6700232 - DNA, 17 bp, Homo sapiens
cagatcaaaatgccttt

SEQ ID NO: 6700233 - DNA, 17 bp, Homo sapiens
cagatcaaagtatgtat

SEQ ID NO: 6700234 - DNA, 19 bp, Homo sapiens
cagatcaaattaatacaat

SEQ ID NO: 6700235 - DNA, 15 bp, Homo sapiens
cagatcaactgagtt

SEQ ID NO: 6700236 - DNA, 18 bp, Homo sapiens
cagatcaagagttttgga

SEQ ID NO: 6700237 - DNA, 18 bp, Homo sapiens
cagatcacagcttcagcc

SEQ ID NO: 6700238 - DNA, 22 bp, Homo sapiens
cagatcacagcttcagccagga

SEQ ID NO: 6700239 - DNA, 15 bp, Homo sapiens
cagatcacagggtga

SEQ ID NO: 6700240 - DNA, 14 bp, Homo sapiens
cagatcacagtgtc

SEQ ID NO: 6700241 - DNA, 23 bp, Homo sapiens
cagatcacatgcccctcttagaa

SEQ ID NO: 6700242 - DNA, 22 bp, Homo sapiens
cagatcaccagcccggcctgct

SEQ ID NO: 6700243 - DNA, 13 bp, Homo sapiens
cagatcactactg

SEQ ID NO: 6700244 - DNA, 18 bp, Homo sapiens
cagatcactcctggaggc

SEQ ID NO: 6700245 - DNA, 14 bp, Homo sapiens
cagatcactgccac

SEQ ID NO: 6700246 - DNA, 22 bp, Homo sapiens
cagatcagactctccttcaggg

SEQ ID NO: 6700247 - DNA, 16 bp, Homo sapiens
cagatcaggaaccagg

SEQ ID NO: 6700248 - DNA, 19 bp, Homo sapiens
cagatcaggaaccagggcc

SEQ ID NO: 6700249 - DNA, 20 bp, Homo sapiens
cagatcaggaaccagggcct

SEQ ID NO: 6700250 - DNA, 21 bp, Homo sapiens
cagatcaggaaccagggcctc

SEQ ID NO: 6700251 - DNA, 13 bp, Homo sapiens
cagatcaggaagc

SEQ ID NO: 6700252 - DNA, 12 bp, Homo sapiens
cagatcaggaga

SEQ ID NO: 6700253 - DNA, 19 bp, Homo sapiens
cagatcaggcagtgtttaa

SEQ ID NO: 6700254 - DNA, 17 bp, Homo sapiens
cagatcagtcagagccc

SEQ ID NO: 6700255 - DNA, 20 bp, Homo sapiens
cagatcatatggtaggaccc

SEQ ID NO: 6700256 - DNA, 17 bp, Homo sapiens
cagatcatccgtctgtg

SEQ ID NO: 6700257 - DNA, 13 bp, Homo sapiens
cagatcatctggg

SEQ ID NO: 6700258 - DNA, 14 bp, Homo sapiens
cagatcatgccgcc

SEQ ID NO: 6700259 - DNA, 18 bp, Homo sapiens
cagatcatgtaaggaagg

SEQ ID NO: 6700260 - DNA, 18 bp, Homo sapiens
cagatcatttgaggccag

SEQ ID NO: 6700261 - DNA, 14 bp, Homo sapiens
cagatccacctgca

SEQ ID NO: 6700262 - DNA, 9 bp, Homo sapiens
cagatccag

SEQ ID NO: 6700263 - DNA, 18 bp, Homo sapiens
cagatccagcctggggtc

SEQ ID NO: 6700264 - DNA, 16 bp, Homo sapiens
cagatccaggaacaca

SEQ ID NO: 6700265 - DNA, 22 bp, Homo sapiens
cagatccaggaacacatgcaca

SEQ ID NO: 6700266 - DNA, 12 bp, Homo sapiens
cagatccaggac

SEQ ID NO: 6700267 - DNA, 15 bp, Homo sapiens
cagatccagggacag

SEQ ID NO: 6700268 - DNA, 17 bp, Homo sapiens
cagatcccaagagatta

SEQ ID NO: 6700269 - DNA, 12 bp, Homo sapiens
cagatcccagct

SEQ ID NO: 6700270 - DNA, 22 bp, Homo sapiens
cagatcccagcttcggcatttg

SEQ ID NO: 6700271 - DNA, 17 bp, Homo sapiens
cagatcccagggtacac

SEQ ID NO: 6700272 - DNA, 17 bp, Homo sapiens
cagatcccatccatcag

SEQ ID NO: 6700273 - DNA, 23 bp, Homo sapiens
cagatcccatccatcagctccct

SEQ ID NO: 6700274 - DNA, 19 bp, Homo sapiens
cagatccccaagcctggca

SEQ ID NO: 6700275 - DNA, 18 bp, Homo sapiens
cagatccccactgtccta

SEQ ID NO: 6700276 - DNA, 12 bp, Homo sapiens
cagatccccagg

SEQ ID NO: 6700277 - DNA, 14 bp, Homo sapiens
cagatccccagggc

SEQ ID NO: 6700278 - DNA, 17 bp, Homo sapiens
cagatccccagggcagc

SEQ ID NO: 6700279 - DNA, 20 bp, Homo sapiens
cagatccccagggcagcctc

SEQ ID NO: 6700280 - DNA, 13 bp, Homo sapiens
cagatcccctgga

SEQ ID NO: 6700281 - DNA, 14 bp, Homo sapiens
cagatccctcggtc

SEQ ID NO: 6700282 - DNA, 20 bp, Homo sapiens
cagatccctcggtcagcacc

SEQ ID NO: 6700283 - DNA, 17 bp, Homo sapiens
cagatccgcatgtgtct

SEQ ID NO: 6700284 - DNA, 18 bp, Homo sapiens
cagatccgcatgtgtctg

SEQ ID NO: 6700285 - DNA, 12 bp, Homo sapiens
cagatcctaccc

SEQ ID NO: 6700286 - DNA, 16 bp, Homo sapiens
cagatcctcacaacca

SEQ ID NO: 6700287 - DNA, 21 bp, Homo sapiens
cagatcctccgcggaggcccc

SEQ ID NO: 6700288 - DNA, 23 bp, Homo sapiens
cagatcctccgcggaggcccctg

SEQ ID NO: 6700289 - DNA, 14 bp, Homo sapiens
cagatcctcttctc

SEQ ID NO: 6700290 - DNA, 13 bp, Homo sapiens
cagatcctctttc

SEQ ID NO: 6700291 - DNA, 19 bp, Homo sapiens
cagatcctctttccccact

SEQ ID NO: 6700292 - DNA, 21 bp, Homo sapiens
cagatcctctttccccactga

SEQ ID NO: 6700293 - DNA, 22 bp, Homo sapiens
cagatcctgatcttaagaggct

SEQ ID NO: 6700294 - DNA, 12 bp, Homo sapiens
cagatcctgctg

SEQ ID NO: 6700295 - DNA, 13 bp, Homo sapiens
cagatcctgggca

SEQ ID NO: 6700296 - DNA, 13 bp, Homo sapiens
cagatcctgtccc

SEQ ID NO: 6700297 - DNA, 20 bp, Homo sapiens
cagatcctgtcccatgggct

SEQ ID NO: 6700298 - DNA, 23 bp, Homo sapiens
cagatcctgttacttgcttcagt

SEQ ID NO: 6700299 - DNA, 13 bp, Homo sapiens
cagatccttgttt

SEQ ID NO: 6700300 - DNA, 23 bp, Homo sapiens
cagatcctttttccatcatttta

SEQ ID NO: 6700301 - DNA, 23 bp, Homo sapiens
cagatcgaaattggactgtcttt

SEQ ID NO: 6700302 - DNA, 20 bp, Homo sapiens
cagatcgctcactgttgtga

SEQ ID NO: 6700303 - DNA, 17 bp, Homo sapiens
cagatcgctcccttggc

SEQ ID NO: 6700304 - DNA, 13 bp, Homo sapiens
cagatcgtgccgt

SEQ ID NO: 6700305 - DNA, 19 bp, Homo sapiens
cagatcgtgccgtggagct

SEQ ID NO: 6700306 - DNA, 22 bp, Homo sapiens
cagatcgtgccgtggagcttgg

SEQ ID NO: 6700307 - DNA, 13 bp, Homo sapiens
cagatcgttcatt

SEQ ID NO: 6700308 - DNA, 12 bp, Homo sapiens
cagatctagcca

SEQ ID NO: 6700309 - DNA, 14 bp, Homo sapiens
cagatctagccagg

SEQ ID NO: 6700310 - DNA, 15 bp, Homo sapiens
cagatctagccaggc

SEQ ID NO: 6700311 - DNA, 16 bp, Homo sapiens
cagatctagccaggcc

SEQ ID NO: 6700312 - DNA, 17 bp, Homo sapiens
cagatctagccaggcct

SEQ ID NO: 6700313 - DNA, 19 bp, Homo sapiens
cagatctagttctcttctc

SEQ ID NO: 6700314 - DNA, 21 bp, Homo sapiens
cagatctagttctcttctcct

SEQ ID NO: 6700315 - DNA, 23 bp, Homo sapiens
cagatctagttctcttctcctgt

SEQ ID NO: 6700316 - DNA, 19 bp, Homo sapiens
cagatctatatggcaaata

SEQ ID NO: 6700317 - DNA, 16 bp, Homo sapiens
cagatctccaaagctt

SEQ ID NO: 6700318 - DNA, 13 bp, Homo sapiens
cagatctcccaca

SEQ ID NO: 6700319 - DNA, 23 bp, Homo sapiens
cagatctcccacatgccaggggc

SEQ ID NO: 6700320 - DNA, 13 bp, Homo sapiens
cagatctcccact

SEQ ID NO: 6700321 - DNA, 20 bp, Homo sapiens
cagatctctaacttcaccat

SEQ ID NO: 6700322 - DNA, 14 bp, Homo sapiens
cagatctgaacaca

SEQ ID NO: 6700323 - DNA, 23 bp, Homo sapiens
cagatctgacatgattccttcct

SEQ ID NO: 6700324 - DNA, 23 bp, Homo sapiens
cagatctgatttgtaacccactg

SEQ ID NO: 6700325 - DNA, 17 bp, Homo sapiens
cagatctgcaccaccat

SEQ ID NO: 6700326 - DNA, 19 bp, Homo sapiens
cagatctgcactcctgtct

SEQ ID NO: 6700327 - DNA, 13 bp, Homo sapiens
cagatctgcatct

SEQ ID NO: 6700328 - DNA, 19 bp, Homo sapiens
cagatctgcctaaggactt

SEQ ID NO: 6700329 - DNA, 23 bp, Homo sapiens
cagatctgcctaaggacttcttt

SEQ ID NO: 6700330 - DNA, 15 bp, Homo sapiens
cagatctgcctgggc

SEQ ID NO: 6700331 - DNA, 19 bp, Homo sapiens
cagatctgcctgggcctgt

SEQ ID NO: 6700332 - DNA, 18 bp, Homo sapiens
cagatctggaacctcagc

SEQ ID NO: 6700333 - DNA, 20 bp, Homo sapiens
cagatctggaacctcagcct

SEQ ID NO: 6700334 - DNA, 13 bp, Homo sapiens
cagatctgggatt

SEQ ID NO: 6700335 - DNA, 20 bp, Homo sapiens
cagatctggtctagttaacc

SEQ ID NO: 6700336 - DNA, 16 bp, Homo sapiens
cagatctgtcctgggg

SEQ ID NO: 6700337 - DNA, 12 bp, Homo sapiens
cagatctgtgcc

SEQ ID NO: 6700338 - DNA, 14 bp, Homo sapiens
cagatctgtgcccc

SEQ ID NO: 6700339 - DNA, 21 bp, Homo sapiens
cagatctgtgccccatgcctg

SEQ ID NO: 6700340 - DNA, 16 bp, Homo sapiens
cagatctgtgcctggg

SEQ ID NO: 6700341 - DNA, 18 bp, Homo sapiens
cagatctgtgcctgggat

SEQ ID NO: 6700342 - DNA, 12 bp, Homo sapiens
cagatctgtttt

SEQ ID NO: 6700343 - DNA, 17 bp, Homo sapiens
cagatcttacaagttta

SEQ ID NO: 6700344 - DNA, 18 bp, Homo sapiens
cagatcttacaagtttat

SEQ ID NO: 6700345 - DNA, 23 bp, Homo sapiens
cagatcttccgtggtcagagtgc

SEQ ID NO: 6700346 - DNA, 14 bp, Homo sapiens
cagatcttgacagt

SEQ ID NO: 6700347 - DNA, 16 bp, Homo sapiens
cagatcttgagcaagg

SEQ ID NO: 6700348 - DNA, 12 bp, Homo sapiens
cagatctttaaa

SEQ ID NO: 6700349 - DNA, 18 bp, Homo sapiens
cagatctttaaatacagt

SEQ ID NO: 6700350 - DNA, 18 bp, Homo sapiens
cagatctttctccttgaa

SEQ ID NO: 6700351 - DNA, 23 bp, Homo sapiens
cagatctttgcaccagatactca

SEQ ID NO: 6700352 - DNA, 15 bp, Homo sapiens
cagatcttttcttta

SEQ ID NO: 6700353 - DNA, 16 bp, Homo sapiens
cagatctttttgtgaa

SEQ ID NO: 6700354 - DNA, 18 bp, Homo sapiens
cagatgaaaaaagttaac

SEQ ID NO: 6700355 - DNA, 14 bp, Homo sapiens
cagatgaaaatttg

SEQ ID NO: 6700356 - DNA, 21 bp, Homo sapiens
cagatgaaatgttctgttcac

SEQ ID NO: 6700357 - DNA, 16 bp, Homo sapiens
cagatgaactgactga

SEQ ID NO: 6700358 - DNA, 16 bp, Homo sapiens
cagatgaactgagaag

SEQ ID NO: 6700359 - DNA, 17 bp, Homo sapiens
cagatgaaggaaaggaa

SEQ ID NO: 6700360 - DNA, 12 bp, Homo sapiens
cagatgaataaa

SEQ ID NO: 6700361 - DNA, 14 bp, Homo sapiens
cagatgaatgataa

SEQ ID NO: 6700362 - DNA, 17 bp, Homo sapiens
cagatgaatgccgtgga

SEQ ID NO: 6700363 - DNA, 22 bp, Homo sapiens
cagatgaattgataaaagagtt

SEQ ID NO: 6700364 - DNA, 23 bp, Homo sapiens
cagatgaattgataaaagagttc

SEQ ID NO: 6700365 - DNA, 14 bp, Homo sapiens
cagatgacagggag

SEQ ID NO: 6700366 - DNA, 20 bp, Homo sapiens
cagatgaccccagaaactga

SEQ ID NO: 6700367 - DNA, 18 bp, Homo sapiens
cagatgacccctccccta

SEQ ID NO: 6700368 - DNA, 19 bp, Homo sapiens
cagatgaccgtgtacaata

SEQ ID NO: 6700369 - DNA, 20 bp, Homo sapiens
cagatgaccgtgtacaatac

SEQ ID NO: 6700370 - DNA, 17 bp, Homo sapiens
cagatgagaaactcttg

SEQ ID NO: 6700371 - DNA, 17 bp, Homo sapiens
cagatgagaacaaagct

SEQ ID NO: 6700372 - DNA, 15 bp, Homo sapiens
cagatgagaagacta

SEQ ID NO: 6700373 - DNA, 12 bp, Homo sapiens
cagatgagaagt

SEQ ID NO: 6700374 - DNA, 13 bp, Homo sapiens
cagatgagaagtt

SEQ ID NO: 6700375 - DNA, 22 bp, Homo sapiens
cagatgagaagttaagcagcct

SEQ ID NO: 6700376 - DNA, 17 bp, Homo sapiens
cagatgagattccctct

SEQ ID NO: 6700377 - DNA, 21 bp, Homo sapiens
cagatgagcaaggacattgcc

SEQ ID NO: 6700378 - DNA, 15 bp, Homo sapiens
cagatgagcaggagc

SEQ ID NO: 6700379 - DNA, 18 bp, Homo sapiens
cagatgagcagtcacact

SEQ ID NO: 6700380 - DNA, 19 bp, Homo sapiens
cagatgagcagtcacactg

SEQ ID NO: 6700381 - DNA, 20 bp, Homo sapiens
cagatgagcagtcacactgt

SEQ ID NO: 6700382 - DNA, 17 bp, Homo sapiens
cagatgagcgaaaatgt

SEQ ID NO: 6700383 - DNA, 22 bp, Homo sapiens
cagatgaggaaacaggcctcaa

SEQ ID NO: 6700384 - DNA, 16 bp, Homo sapiens
cagatgaggagcagct

SEQ ID NO: 6700385 - DNA, 12 bp, Homo sapiens
cagatgaggccc

SEQ ID NO: 6700386 - DNA, 16 bp, Homo sapiens
cagatgaggcccccgc

SEQ ID NO: 6700387 - DNA, 15 bp, Homo sapiens
cagatgagggctggc

SEQ ID NO: 6700388 - DNA, 16 bp, Homo sapiens
cagatgaggggccact

SEQ ID NO: 6700389 - DNA, 19 bp, Homo sapiens
cagatgaggggccactgac

SEQ ID NO: 6700390 - DNA, 14 bp, Homo sapiens
cagatgaggtcaac

SEQ ID NO: 6700391 - DNA, 16 bp, Homo sapiens
cagatgagtaaaggag

SEQ ID NO: 6700392 - DNA, 14 bp, Homo sapiens
cagatgagtcacac

SEQ ID NO: 6700393 - DNA, 15 bp, Homo sapiens
cagatgataaatatt

SEQ ID NO: 6700394 - DNA, 16 bp, Homo sapiens
cagatgataaatattt

SEQ ID NO: 6700395 - DNA, 18 bp, Homo sapiens
cagatgatcaactcttcg

SEQ ID NO: 6700396 - DNA, 15 bp, Homo sapiens
cagatgatccatttg

SEQ ID NO: 6700397 - DNA, 18 bp, Homo sapiens
cagatgatccatttgaac

SEQ ID NO: 6700398 - DNA, 21 bp, Homo sapiens
cagatgatccttgcacagaca

SEQ ID NO: 6700399 - DNA, 22 bp, Homo sapiens
cagatgatggccatttctaaat

SEQ ID NO: 6700400 - DNA, 21 bp, Homo sapiens
cagatgatggggtcagcaggc

SEQ ID NO: 6700401 - DNA, 20 bp, Homo sapiens
cagatgatgtaaaaatatgt

SEQ ID NO: 6700402 - DNA, 18 bp, Homo sapiens
cagatgcaaagaggcaag

SEQ ID NO: 6700403 - DNA, 22 bp, Homo sapiens
cagatgcaagttattttatttg

SEQ ID NO: 6700404 - DNA, 15 bp, Homo sapiens
cagatgcaatgtgct

SEQ ID NO: 6700405 - DNA, 22 bp, Homo sapiens
cagatgcaccacccatggagag

SEQ ID NO: 6700406 - DNA, 20 bp, Homo sapiens
cagatgcagagagccatttt

SEQ ID NO: 6700407 - DNA, 12 bp, Homo sapiens
cagatgcagctc

SEQ ID NO: 6700408 - DNA, 16 bp, Homo sapiens
cagatgcagctcaaga

SEQ ID NO: 6700409 - DNA, 15 bp, Homo sapiens
cagatgcagctcttc

SEQ ID NO: 6700410 - DNA, 17 bp, Homo sapiens
cagatgcaggacaggag

SEQ ID NO: 6700411 - DNA, 18 bp, Homo sapiens
cagatgcaggacaggagg

SEQ ID NO: 6700412 - DNA, 19 bp, Homo sapiens
cagatgcaggacaggaggc

SEQ ID NO: 6700413 - DNA, 21 bp, Homo sapiens
cagatgcaggacaggaggcgg

SEQ ID NO: 6700414 - DNA, 17 bp, Homo sapiens
cagatgcagggcagtca

SEQ ID NO: 6700415 - DNA, 18 bp, Homo sapiens
cagatgcagttttcaaat

SEQ ID NO: 6700416 - DNA, 16 bp, Homo sapiens
cagatgcatatagaca

SEQ ID NO: 6700417 - DNA, 21 bp, Homo sapiens
cagatgcatatagacacacat

SEQ ID NO: 6700418 - DNA, 13 bp, Homo sapiens
cagatgccaactt

SEQ ID NO: 6700419 - DNA, 18 bp, Homo sapiens
cagatgccaacttcccac

SEQ ID NO: 6700420 - DNA, 16 bp, Homo sapiens
cagatgccaccctagc

SEQ ID NO: 6700421 - DNA, 20 bp, Homo sapiens
cagatgccaccctagccaat

SEQ ID NO: 6700422 - DNA, 18 bp, Homo sapiens
cagatgccacttctaaga

SEQ ID NO: 6700423 - DNA, 19 bp, Homo sapiens
cagatgccatggcctgtgc

SEQ ID NO: 6700424 - DNA, 12 bp, Homo sapiens
cagatgcccacg

SEQ ID NO: 6700425 - DNA, 20 bp, Homo sapiens
cagatgcccagagggcccag

SEQ ID NO: 6700426 - DNA, 13 bp, Homo sapiens
cagatgccccaga

SEQ ID NO: 6700427 - DNA, 18 bp, Homo sapiens
cagatgccccagagctgt

SEQ ID NO: 6700428 - DNA, 15 bp, Homo sapiens
cagatgcccccgtga

SEQ ID NO: 6700429 - DNA, 15 bp, Homo sapiens
cagatgcccctttct

SEQ ID NO: 6700430 - DNA, 17 bp, Homo sapiens
cagatgcccctttctgg

SEQ ID NO: 6700431 - DNA, 18 bp, Homo sapiens
cagatgcccgagggaggg

SEQ ID NO: 6700432 - DNA, 17 bp, Homo sapiens
cagatgcccttgctggg

SEQ ID NO: 6700433 - DNA, 23 bp, Homo sapiens
cagatgcccttgctgggcctggg

SEQ ID NO: 6700434 - DNA, 22 bp, Homo sapiens
cagatgccctttggaaagccat

SEQ ID NO: 6700435 - DNA, 14 bp, Homo sapiens
cagatgcctccacc

SEQ ID NO: 6700436 - DNA, 15 bp, Homo sapiens
cagatgcctccccaa

SEQ ID NO: 6700437 - DNA, 23 bp, Homo sapiens
cagatgcctccccaagactgtca

SEQ ID NO: 6700438 - DNA, 20 bp, Homo sapiens
cagatgcctcctctgtcctc

SEQ ID NO: 6700439 - DNA, 21 bp, Homo sapiens
cagatgcctcctctgtcctca

SEQ ID NO: 6700440 - DNA, 15 bp, Homo sapiens
cagatgcctggtgag

SEQ ID NO: 6700441 - DNA, 17 bp, Homo sapiens
cagatgcctggtgagca

SEQ ID NO: 6700442 - DNA, 22 bp, Homo sapiens
cagatgccttctagattcactg

SEQ ID NO: 6700443 - DNA, 12 bp, Homo sapiens
cagatgcgggga

SEQ ID NO: 6700444 - DNA, 17 bp, Homo sapiens
cagatgcggggacaggc

SEQ ID NO: 6700445 - DNA, 15 bp, Homo sapiens
cagatgctaataaac

SEQ ID NO: 6700446 - DNA, 16 bp, Homo sapiens
cagatgctactggact

SEQ ID NO: 6700447 - DNA, 17 bp, Homo sapiens
cagatgctagagcctct

SEQ ID NO: 6700448 - DNA, 21 bp, Homo sapiens
cagatgctagagcctctgcct

SEQ ID NO: 6700449 - DNA, 11 bp, Homo sapiens
cagatgctcaa

SEQ ID NO: 6700450 - DNA, 14 bp, Homo sapiens
cagatgctctgaga

SEQ ID NO: 6700451 - DNA, 22 bp, Homo sapiens
cagatgctgaattgagaataag

SEQ ID NO: 6700452 - DNA, 18 bp, Homo sapiens
cagatgctgatgttcagt

SEQ ID NO: 6700453 - DNA, 22 bp, Homo sapiens
cagatgctgatgttcagtgtaa

SEQ ID NO: 6700454 - DNA, 14 bp, Homo sapiens
cagatgctgctgaa

SEQ ID NO: 6700455 - DNA, 15 bp, Homo sapiens
cagatgctgctgaag

SEQ ID NO: 6700456 - DNA, 19 bp, Homo sapiens
cagatgctgctgaagagag

SEQ ID NO: 6700457 - DNA, 14 bp, Homo sapiens
cagatgctggcctc

SEQ ID NO: 6700458 - DNA, 18 bp, Homo sapiens
cagatgctggcctcttgg

SEQ ID NO: 6700459 - DNA, 19 bp, Homo sapiens
cagatgctgggcaggaaac

SEQ ID NO: 6700460 - DNA, 22 bp, Homo sapiens
cagatgctggggagaatgaaga

SEQ ID NO: 6700461 - DNA, 21 bp, Homo sapiens
cagatgctggtcatcctgggc

SEQ ID NO: 6700462 - DNA, 24 bp, Homo sapiens
cagatgctggtcatcctgggcatg

SEQ ID NO: 6700463 - DNA, 17 bp, Homo sapiens
cagatgctggtggagga

SEQ ID NO: 6700464 - DNA, 18 bp, Homo sapiens
cagatgctggtggaggaa

SEQ ID NO: 6700465 - DNA, 20 bp, Homo sapiens
cagatgctggtggaggaagg

SEQ ID NO: 6700466 - DNA, 23 bp, Homo sapiens
cagatgctggtggaggaagggct

SEQ ID NO: 6700467 - DNA, 15 bp, Homo sapiens
cagatgctgtgcaaa

SEQ ID NO: 6700468 - DNA, 12 bp, Homo sapiens
cagatgcttctg

SEQ ID NO: 6700469 - DNA, 13 bp, Homo sapiens
cagatgcttctgg

SEQ ID NO: 6700470 - DNA, 22 bp, Homo sapiens
cagatgcttgcggcaaaaggaa

SEQ ID NO: 6700471 - DNA, 23 bp, Homo sapiens
cagatgcttgcggcaaaaggaaa

SEQ ID NO: 6700472 - DNA, 21 bp, Homo sapiens
cagatgctttcctgcacatta

SEQ ID NO: 6700473 - DNA, 14 bp, Homo sapiens
cagatgcttttgct

SEQ ID NO: 6700474 - DNA, 13 bp, Homo sapiens
cagatggaaaaat

SEQ ID NO: 6700475 - DNA, 17 bp, Homo sapiens
cagatggaaaaataaca

SEQ ID NO: 6700476 - DNA, 14 bp, Homo sapiens
cagatggaaagaaa

SEQ ID NO: 6700477 - DNA, 16 bp, Homo sapiens
cagatggaaaggagcc

SEQ ID NO: 6700478 - DNA, 21 bp, Homo sapiens
cagatggaaccgcaggaagct

SEQ ID NO: 6700479 - DNA, 18 bp, Homo sapiens
cagatggacactgccaag

SEQ ID NO: 6700480 - DNA, 12 bp, Homo sapiens
cagatggaccaa

SEQ ID NO: 6700481 - DNA, 15 bp, Homo sapiens
cagatggactgggag

SEQ ID NO: 6700482 - DNA, 23 bp, Homo sapiens
cagatggagaaacaggctctgag

SEQ ID NO: 6700483 - DNA, 14 bp, Homo sapiens
cagatggagcccat

SEQ ID NO: 6700484 - DNA, 15 bp, Homo sapiens
cagatggaggtgcca

SEQ ID NO: 6700485 - DNA, 23 bp, Homo sapiens
cagatggattgataattgcattc

SEQ ID NO: 6700486 - DNA, 18 bp, Homo sapiens
cagatggcagatgcacat

SEQ ID NO: 6700487 - DNA, 16 bp, Homo sapiens
cagatggcagctttta

SEQ ID NO: 6700488 - DNA, 13 bp, Homo sapiens
cagatggcaggct

SEQ ID NO: 6700489 - DNA, 16 bp, Homo sapiens
cagatggcaggctaca

SEQ ID NO: 6700490 - DNA, 19 bp, Homo sapiens
cagatggcatacctgtgcc

SEQ ID NO: 6700491 - DNA, 17 bp, Homo sapiens
cagatggccactgctct

SEQ ID NO: 6700492 - DNA, 16 bp, Homo sapiens
cagatggccagcccct

SEQ ID NO: 6700493 - DNA, 14 bp, Homo sapiens
cagatggcccaagg

SEQ ID NO: 6700494 - DNA, 21 bp, Homo sapiens
cagatggcccggatgctgctt

SEQ ID NO: 6700495 - DNA, 22 bp, Homo sapiens
cagatggcccggatgctgcttc

SEQ ID NO: 6700496 - DNA, 23 bp, Homo sapiens
cagatggcggtgatcagcagaga

SEQ ID NO: 6700497 - DNA, 19 bp, Homo sapiens
cagatggctccctgggctg

SEQ ID NO: 6700498 - DNA, 20 bp, Homo sapiens
cagatggctccctgggctgg

SEQ ID NO: 6700499 - DNA, 16 bp, Homo sapiens
cagatggctgtgaaaa

SEQ ID NO: 6700500 - DNA, 19 bp, Homo sapiens
cagatggctttcagggcag

SEQ ID NO: 6700501 - DNA, 20 bp, Homo sapiens
cagatgggatgggctttctc

SEQ ID NO: 6700502 - DNA, 21 bp, Homo sapiens
cagatgggcaaggcctttggc

SEQ ID NO: 6700503 - DNA, 15 bp, Homo sapiens
cagatgggccacggc

SEQ ID NO: 6700504 - DNA, 15 bp, Homo sapiens
cagatgggcctgtgt

SEQ ID NO: 6700505 - DNA, 14 bp, Homo sapiens
cagatggggcctgg

SEQ ID NO: 6700506 - DNA, 16 bp, Homo sapiens
cagatggggcctgggc

SEQ ID NO: 6700507 - DNA, 21 bp, Homo sapiens
cagatggggctcccgcccgtg

SEQ ID NO: 6700508 - DNA, 16 bp, Homo sapiens
cagatgggggcctctc

SEQ ID NO: 6700509 - DNA, 17 bp, Homo sapiens
cagatgggggcctctct

SEQ ID NO: 6700510 - DNA, 16 bp, Homo sapiens
cagatggggtctgtga

SEQ ID NO: 6700511 - DNA, 19 bp, Homo sapiens
cagatggggtctgtgactg

SEQ ID NO: 6700512 - DNA, 16 bp, Homo sapiens
cagatgggtattaaac

SEQ ID NO: 6700513 - DNA, 17 bp, Homo sapiens
cagatgggtattaaact

SEQ ID NO: 6700514 - DNA, 20 bp, Homo sapiens
cagatgggtctgatattaat

SEQ ID NO: 6700515 - DNA, 23 bp, Homo sapiens
cagatgggtctgatattaatcaa

SEQ ID NO: 6700516 - DNA, 19 bp, Homo sapiens
cagatgggtgtcccctggt

SEQ ID NO: 6700517 - DNA, 24 bp, Homo sapiens
cagatgggtgtcccctggtgcccc

SEQ ID NO: 6700518 - DNA, 23 bp, Homo sapiens
cagatgggttttgttaggggtgg

SEQ ID NO: 6700519 - DNA, 18 bp, Homo sapiens
cagatggtcacacagaga

SEQ ID NO: 6700520 - DNA, 16 bp, Homo sapiens
cagatggtcatccaga

SEQ ID NO: 6700521 - DNA, 21 bp, Homo sapiens
cagatggtgtcctgcatgtat

SEQ ID NO: 6700522 - DNA, 20 bp, Homo sapiens
cagatggtgtgtccagcact

SEQ ID NO: 6700523 - DNA, 17 bp, Homo sapiens
cagatggttgtgtatgg

SEQ ID NO: 6700524 - DNA, 19 bp, Homo sapiens
cagatggtttccacattta

SEQ ID NO: 6700525 - DNA, 12 bp, Homo sapiens
cagatgtaaaga

SEQ ID NO: 6700526 - DNA, 23 bp, Homo sapiens
cagatgtaaatcgggaaggatgg

SEQ ID NO: 6700527 - DNA, 13 bp, Homo sapiens
cagatgtaatgtt

SEQ ID NO: 6700528 - DNA, 15 bp, Homo sapiens
cagatgtacatagag

SEQ ID NO: 6700529 - DNA, 15 bp, Homo sapiens
cagatgtacatgtgt

SEQ ID NO: 6700530 - DNA, 24 bp, Homo sapiens
cagatgtaggagggactgtcgctg

SEQ ID NO: 6700531 - DNA, 12 bp, Homo sapiens
cagatgtattga

SEQ ID NO: 6700532 - DNA, 18 bp, Homo sapiens
cagatgtcagcttcccag

SEQ ID NO: 6700533 - DNA, 13 bp, Homo sapiens
cagatgtccctga

SEQ ID NO: 6700534 - DNA, 23 bp, Homo sapiens
cagatgtcccttgatgcacagag

SEQ ID NO: 6700535 - DNA, 15 bp, Homo sapiens
cagatgtctatattg

SEQ ID NO: 6700536 - DNA, 16 bp, Homo sapiens
cagatgtctctggggc

SEQ ID NO: 6700537 - DNA, 19 bp, Homo sapiens
cagatgtcttccctgggct

SEQ ID NO: 6700538 - DNA, 20 bp, Homo sapiens
cagatgtcttccctgggctg

SEQ ID NO: 6700539 - DNA, 17 bp, Homo sapiens
cagatgtgaaccattaa

SEQ ID NO: 6700540 - DNA, 19 bp, Homo sapiens
cagatgtgagggcaccacc

SEQ ID NO: 6700541 - DNA, 14 bp, Homo sapiens
cagatgtgcagcag

SEQ ID NO: 6700542 - DNA, 16 bp, Homo sapiens
cagatgtgcagcagat

SEQ ID NO: 6700543 - DNA, 20 bp, Homo sapiens
cagatgtgcagcagattgga

SEQ ID NO: 6700544 - DNA, 14 bp, Homo sapiens
cagatgtgcaggct

SEQ ID NO: 6700545 - DNA, 20 bp, Homo sapiens
cagatgtgcaggctcctcct

SEQ ID NO: 6700546 - DNA, 17 bp, Homo sapiens
cagatgtgcccagagta

SEQ ID NO: 6700547 - DNA, 19 bp, Homo sapiens
cagatgtgcccagagtagc

SEQ ID NO: 6700548 - DNA, 14 bp, Homo sapiens
cagatgtggagcca

SEQ ID NO: 6700549 - DNA, 17 bp, Homo sapiens
cagatgtggagccaggc

SEQ ID NO: 6700550 - DNA, 20 bp, Homo sapiens
cagatgtggctactgacata

SEQ ID NO: 6700551 - DNA, 23 bp, Homo sapiens
cagatgtggggctgagctgggga

SEQ ID NO: 6700552 - DNA, 21 bp, Homo sapiens
cagatgtgtcccccccaggcc

SEQ ID NO: 6700553 - DNA, 22 bp, Homo sapiens
cagatgtgtcccccccaggcct

SEQ ID NO: 6700554 - DNA, 13 bp, Homo sapiens
cagatgtgtctgg

SEQ ID NO: 6700555 - DNA, 18 bp, Homo sapiens
cagatgtgtctgggagag

SEQ ID NO: 6700556 - DNA, 23 bp, Homo sapiens
cagatgtgtctgggagagcctgg

SEQ ID NO: 6700557 - DNA, 23 bp, Homo sapiens
cagatgtgtgttgcttctctatt

SEQ ID NO: 6700558 - DNA, 15 bp, Homo sapiens
cagatgttaaaataa

SEQ ID NO: 6700559 - DNA, 17 bp, Homo sapiens
cagatgttagatatttt

SEQ ID NO: 6700560 - DNA, 13 bp, Homo sapiens
cagatgttcaaat

SEQ ID NO: 6700561 - DNA, 15 bp, Homo sapiens
cagatgttcaaatat

SEQ ID NO: 6700562 - DNA, 22 bp, Homo sapiens
cagatgttcggtttttttcctg

SEQ ID NO: 6700563 - DNA, 19 bp, Homo sapiens
cagatgttctctcccaggg

SEQ ID NO: 6700564 - DNA, 18 bp, Homo sapiens
cagatgttgaagacaggg

SEQ ID NO: 6700565 - DNA, 19 bp, Homo sapiens
cagatgttgaattcttttg

SEQ ID NO: 6700566 - DNA, 20 bp, Homo sapiens
cagatgttgcttttgaaaag

SEQ ID NO: 6700567 - DNA, 23 bp, Homo sapiens
cagatgttgcttttgaaaagttg

SEQ ID NO: 6700568 - DNA, 23 bp, Homo sapiens
cagatgttggtcttggtcatttg

SEQ ID NO: 6700569 - DNA, 19 bp, Homo sapiens
cagatgttgtctgaactaa

SEQ ID NO: 6700570 - DNA, 18 bp, Homo sapiens
cagatgttgttcctggct

SEQ ID NO: 6700571 - DNA, 17 bp, Homo sapiens
cagatgtttaatgaagt

SEQ ID NO: 6700572 - DNA, 18 bp, Homo sapiens
cagatgtttccaagatgt

SEQ ID NO: 6700573 - DNA, 16 bp, Homo sapiens
cagatgtttccagact

SEQ ID NO: 6700574 - DNA, 23 bp, Homo sapiens
cagatgtttcgagtaaacttgaa

SEQ ID NO: 6700575 - DNA, 22 bp, Homo sapiens
cagatgtttctcattttaaaca

SEQ ID NO: 6700576 - DNA, 17 bp, Homo sapiens
cagatgttttacgtctg

SEQ ID NO: 6700577 - DNA, 22 bp, Homo sapiens
cagatgttttagagataaatat

SEQ ID NO: 6700578 - DNA, 19 bp, Homo sapiens
cagatgttttatttatgaa

SEQ ID NO: 6700579 - DNA, 20 bp, Homo sapiens
cagatgttttatttatgaag

SEQ ID NO: 6700580 - DNA, 23 bp, Homo sapiens
cagatgttttatttatgaagttt

SEQ ID NO: 6700581 - DNA, 18 bp, Homo sapiens
cagatgttttccactgag

SEQ ID NO: 6700582 - DNA, 12 bp, Homo sapiens
cagattaaatta

SEQ ID NO: 6700583 - DNA, 20 bp, Homo sapiens
cagattaaattacagctttt

SEQ ID NO: 6700584 - DNA, 12 bp, Homo sapiens
cagattaataac

SEQ ID NO: 6700585 - DNA, 17 bp, Homo sapiens
cagattaataacagaaa

SEQ ID NO: 6700586 - DNA, 19 bp, Homo sapiens
cagattaataacagaaata

SEQ ID NO: 6700587 - DNA, 20 bp, Homo sapiens
cagattaataacagaaatac

SEQ ID NO: 6700588 - DNA, 12 bp, Homo sapiens
cagattaatatt

SEQ ID NO: 6700589 - DNA, 15 bp, Homo sapiens
cagattacaataaat

SEQ ID NO: 6700590 - DNA, 21 bp, Homo sapiens
cagattacaataaatccttta

SEQ ID NO: 6700591 - DNA, 11 bp, Homo sapiens
cagattacagg

SEQ ID NO: 6700592 - DNA, 21 bp, Homo sapiens
cagattacaggaatgaagaac

SEQ ID NO: 6700593 - DNA, 18 bp, Homo sapiens
cagattacttcagggctg

SEQ ID NO: 6700594 - DNA, 16 bp, Homo sapiens
cagattagatgtgcca

SEQ ID NO: 6700595 - DNA, 17 bp, Homo sapiens
cagattagatgtgccaa

SEQ ID NO: 6700596 - DNA, 17 bp, Homo sapiens
cagattaggacacagtg

SEQ ID NO: 6700597 - DNA, 15 bp, Homo sapiens
cagattaggcctgga

SEQ ID NO: 6700598 - DNA, 14 bp, Homo sapiens
cagattataataaa

SEQ ID NO: 6700599 - DNA, 17 bp, Homo sapiens
cagattataataaattg

SEQ ID NO: 6700600 - DNA, 21 bp, Homo sapiens
cagattatgagacacaggatg

SEQ ID NO: 6700601 - DNA, 21 bp, Homo sapiens
cagattatgtattaacttgta

SEQ ID NO: 6700602 - DNA, 23 bp, Homo sapiens
cagattatgttcctgctgtattt

SEQ ID NO: 6700603 - DNA, 12 bp, Homo sapiens
cagattattcac

SEQ ID NO: 6700604 - DNA, 23 bp, Homo sapiens
cagattattcactgatttgacat

SEQ ID NO: 6700605 - DNA, 19 bp, Homo sapiens
cagattattggctgctttg

SEQ ID NO: 6700606 - DNA, 22 bp, Homo sapiens
cagattattttagtctgtcatc

SEQ ID NO: 6700607 - DNA, 15 bp, Homo sapiens
cagattattttctat

SEQ ID NO: 6700608 - DNA, 16 bp, Homo sapiens
cagattattttctata

SEQ ID NO: 6700609 - DNA, 19 bp, Homo sapiens
cagattcacactgtctggt

SEQ ID NO: 6700610 - DNA, 17 bp, Homo sapiens
cagattcacttctgaat

SEQ ID NO: 6700611 - DNA, 15 bp, Homo sapiens
cagattcagaaatga

SEQ ID NO: 6700612 - DNA, 17 bp, Homo sapiens
cagattcagaatgagaa

SEQ ID NO: 6700613 - DNA, 13 bp, Homo sapiens
cagattcaggagc

SEQ ID NO: 6700614 - DNA, 17 bp, Homo sapiens
cagattcaggagctcag

SEQ ID NO: 6700615 - DNA, 13 bp, Homo sapiens
cagattcaggcat

SEQ ID NO: 6700616 - DNA, 18 bp, Homo sapiens
cagattcagtcttgcctt

SEQ ID NO: 6700617 - DNA, 20 bp, Homo sapiens
cagattcagtcttgccttac

SEQ ID NO: 6700618 - DNA, 22 bp, Homo sapiens
cagattcataaagtaatgatga

SEQ ID NO: 6700619 - DNA, 15 bp, Homo sapiens
cagattcatttttct

SEQ ID NO: 6700620 - DNA, 19 bp, Homo sapiens
cagattccacacaaaatgt

SEQ ID NO: 6700621 - DNA, 14 bp, Homo sapiens
cagattccacagga

SEQ ID NO: 6700622 - DNA, 17 bp, Homo sapiens
cagattccacaggacac

SEQ ID NO: 6700623 - DNA, 23 bp, Homo sapiens
cagattccaggcgatgtgcaagt

SEQ ID NO: 6700624 - DNA, 14 bp, Homo sapiens
cagattcccagagc

SEQ ID NO: 6700625 - DNA, 19 bp, Homo sapiens
cagattcccagagcaaaat

SEQ ID NO: 6700626 - DNA, 16 bp, Homo sapiens
cagattcccaggccag

SEQ ID NO: 6700627 - DNA, 17 bp, Homo sapiens
cagattcccaggccagg

SEQ ID NO: 6700628 - DNA, 21 bp, Homo sapiens
cagattccccactcagccttt

SEQ ID NO: 6700629 - DNA, 13 bp, Homo sapiens
cagattcccttcc

SEQ ID NO: 6700630 - DNA, 12 bp, Homo sapiens
cagattcctatg

SEQ ID NO: 6700631 - DNA, 21 bp, Homo sapiens
cagattcctgccccatcactt

SEQ ID NO: 6700632 - DNA, 14 bp, Homo sapiens
cagattcctgggcc

SEQ ID NO: 6700633 - DNA, 17 bp, Homo sapiens
cagattcctgggcctgt

SEQ ID NO: 6700634 - DNA, 16 bp, Homo sapiens
cagattcctttccctt

SEQ ID NO: 6700635 - DNA, 20 bp, Homo sapiens
cagattcctttccctttagc

SEQ ID NO: 6700636 - DNA, 20 bp, Homo sapiens
cagattcggaccactaggcc

SEQ ID NO: 6700637 - DNA, 22 bp, Homo sapiens
cagattcggaccactaggcctg

SEQ ID NO: 6700638 - DNA, 21 bp, Homo sapiens
cagattcgtggtcttttcctc

SEQ ID NO: 6700639 - DNA, 17 bp, Homo sapiens
cagattctccacggtgg

SEQ ID NO: 6700640 - DNA, 20 bp, Homo sapiens
cagattctgaaacaggccct

SEQ ID NO: 6700641 - DNA, 16 bp, Homo sapiens
cagattctgacattta

SEQ ID NO: 6700642 - DNA, 19 bp, Homo sapiens
cagattctgacatttatat

SEQ ID NO: 6700643 - DNA, 14 bp, Homo sapiens
cagattctgatgca

SEQ ID NO: 6700644 - DNA, 12 bp, Homo sapiens
cagattctgatt

SEQ ID NO: 6700645 - DNA, 13 bp, Homo sapiens
cagattctgattt

SEQ ID NO: 6700646 - DNA, 18 bp, Homo sapiens
cagattctttcctgaggc

SEQ ID NO: 6700647 - DNA, 19 bp, Homo sapiens
cagattctttcctgaggct

SEQ ID NO: 6700648 - DNA, 22 bp, Homo sapiens
cagattctttcctgaggctggg

SEQ ID NO: 6700649 - DNA, 18 bp, Homo sapiens
cagattctttttttctgt

SEQ ID NO: 6700650 - DNA, 14 bp, Homo sapiens
cagattgaaaagga

SEQ ID NO: 6700651 - DNA, 19 bp, Homo sapiens
cagattgaaaagtgtcctc

SEQ ID NO: 6700652 - DNA, 20 bp, Homo sapiens
cagattgaagaatctgcccc

SEQ ID NO: 6700653 - DNA, 18 bp, Homo sapiens
cagattgactaaataaaa

SEQ ID NO: 6700654 - DNA, 23 bp, Homo sapiens
cagattgagacctacaggctgac

SEQ ID NO: 6700655 - DNA, 18 bp, Homo sapiens
cagattgcaacaggctgg

SEQ ID NO: 6700656 - DNA, 17 bp, Homo sapiens
cagattgcagttctgat

SEQ ID NO: 6700657 - DNA, 18 bp, Homo sapiens
cagattgcagttctgatt

SEQ ID NO: 6700658 - DNA, 12 bp, Homo sapiens
cagattgcatgt

SEQ ID NO: 6700659 - DNA, 13 bp, Homo sapiens
cagattgcatgtg

SEQ ID NO: 6700660 - DNA, 18 bp, Homo sapiens
cagattgctacacacaca

SEQ ID NO: 6700661 - DNA, 17 bp, Homo sapiens
cagattgctctgcccca

SEQ ID NO: 6700662 - DNA, 15 bp, Homo sapiens
cagattgctgaaact

SEQ ID NO: 6700663 - DNA, 19 bp, Homo sapiens
cagattgctgaatggagtt

SEQ ID NO: 6700664 - DNA, 14 bp, Homo sapiens
cagattgcttaaaa

SEQ ID NO: 6700665 - DNA, 12 bp, Homo sapiens
cagattgctttt

SEQ ID NO: 6700666 - DNA, 23 bp, Homo sapiens
cagattggattttatgttgacat

SEQ ID NO: 6700667 - DNA, 20 bp, Homo sapiens
cagattggcacccctttcta

SEQ ID NO: 6700668 - DNA, 17 bp, Homo sapiens
cagattggccaattaaa

SEQ ID NO: 6700669 - DNA, 16 bp, Homo sapiens
cagattgggataaggc

SEQ ID NO: 6700670 - DNA, 17 bp, Homo sapiens
cagattgggcggggctt

SEQ ID NO: 6700671 - DNA, 18 bp, Homo sapiens
cagattgggctggctctg

SEQ ID NO: 6700672 - DNA, 18 bp, Homo sapiens
cagattgtaaaggtaggt

SEQ ID NO: 6700673 - DNA, 21 bp, Homo sapiens
cagattgtatcatgtgctaga

SEQ ID NO: 6700674 - DNA, 14 bp, Homo sapiens
cagattgtcagctc

SEQ ID NO: 6700675 - DNA, 20 bp, Homo sapiens
cagattgtcttaatttctat

SEQ ID NO: 6700676 - DNA, 18 bp, Homo sapiens
cagattgtcttgcaactt

SEQ ID NO: 6700677 - DNA, 16 bp, Homo sapiens
cagattgtggggtgca

SEQ ID NO: 6700678 - DNA, 12 bp, Homo sapiens
cagattgtgtac

SEQ ID NO: 6700679 - DNA, 14 bp, Homo sapiens
cagattgtgtacat

SEQ ID NO: 6700680 - DNA, 22 bp, Homo sapiens
cagattgtgtacatagagcaat

SEQ ID NO: 6700681 - DNA, 20 bp, Homo sapiens
cagattgtttctatacaaat

SEQ ID NO: 6700682 - DNA, 13 bp, Homo sapiens
cagattgtttgca

SEQ ID NO: 6700683 - DNA, 13 bp, Homo sapiens
cagatttaaaaca

SEQ ID NO: 6700684 - DNA, 20 bp, Homo sapiens
cagatttaacctgttatttc

SEQ ID NO: 6700685 - DNA, 18 bp, Homo sapiens
cagatttaagcaagacca

SEQ ID NO: 6700686 - DNA, 22 bp, Homo sapiens
cagatttaagcaagaccatggg

SEQ ID NO: 6700687 - DNA, 15 bp, Homo sapiens
cagatttaagcctta

SEQ ID NO: 6700688 - DNA, 19 bp, Homo sapiens
cagatttaagccttacaaa

SEQ ID NO: 6700689 - DNA, 20 bp, Homo sapiens
cagatttaagccttacaaag

SEQ ID NO: 6700690 - DNA, 18 bp, Homo sapiens
cagatttaagccttgaca

SEQ ID NO: 6700691 - DNA, 14 bp, Homo sapiens
cagatttacactgg

SEQ ID NO: 6700692 - DNA, 22 bp, Homo sapiens
cagatttagtgaaagctagaga

SEQ ID NO: 6700693 - DNA, 16 bp, Homo sapiens
cagatttattcctttg

SEQ ID NO: 6700694 - DNA, 13 bp, Homo sapiens
cagatttcactct

SEQ ID NO: 6700695 - DNA, 15 bp, Homo sapiens
cagatttcactctcc

SEQ ID NO: 6700696 - DNA, 19 bp, Homo sapiens
cagatttcagtaatgtctt

SEQ ID NO: 6700697 - DNA, 16 bp, Homo sapiens
cagatttcatacctca

SEQ ID NO: 6700698 - DNA, 19 bp, Homo sapiens
cagatttccattgtgtggc

SEQ ID NO: 6700699 - DNA, 16 bp, Homo sapiens
cagatttcctgtgtgg

SEQ ID NO: 6700700 - DNA, 22 bp, Homo sapiens
cagatttctaagttaaatcatt

SEQ ID NO: 6700701 - DNA, 16 bp, Homo sapiens
cagatttctctttgaa

SEQ ID NO: 6700702 - DNA, 14 bp, Homo sapiens
cagatttctgagga

SEQ ID NO: 6700703 - DNA, 17 bp, Homo sapiens
cagatttctgaggaaat

SEQ ID NO: 6700704 - DNA, 15 bp, Homo sapiens
cagatttcttaatgt

SEQ ID NO: 6700705 - DNA, 17 bp, Homo sapiens
cagatttcttaatgtct

SEQ ID NO: 6700706 - DNA, 18 bp, Homo sapiens
cagatttcttaatgtctg

SEQ ID NO: 6700707 - DNA, 21 bp, Homo sapiens
cagatttgaagacaaaaatac

SEQ ID NO: 6700708 - DNA, 14 bp, Homo sapiens
cagatttgagctca

SEQ ID NO: 6700709 - DNA, 14 bp, Homo sapiens
cagatttgcacaaa

SEQ ID NO: 6700710 - DNA, 14 bp, Homo sapiens
cagatttgctaata

SEQ ID NO: 6700711 - DNA, 20 bp, Homo sapiens
cagatttgctaatttatcct

SEQ ID NO: 6700712 - DNA, 13 bp, Homo sapiens
cagatttggaaag

SEQ ID NO: 6700713 - DNA, 18 bp, Homo sapiens
cagatttggcttgacaaa

SEQ ID NO: 6700714 - DNA, 15 bp, Homo sapiens
cagatttgggctgga

SEQ ID NO: 6700715 - DNA, 14 bp, Homo sapiens
cagatttgtctttt

SEQ ID NO: 6700716 - DNA, 24 bp, Homo sapiens
cagatttgtctttttgttgtaaaa

SEQ ID NO: 6700717 - DNA, 16 bp, Homo sapiens
cagatttgtgaactca

SEQ ID NO: 6700718 - DNA, 13 bp, Homo sapiens
cagatttgttcat

SEQ ID NO: 6700719 - DNA, 22 bp, Homo sapiens
cagattttaaaaagtcttcact

SEQ ID NO: 6700720 - DNA, 15 bp, Homo sapiens
cagattttaaatttt

SEQ ID NO: 6700721 - DNA, 21 bp, Homo sapiens
cagattttaaattttatgtca

SEQ ID NO: 6700722 - DNA, 15 bp, Homo sapiens
cagattttaattgtc

SEQ ID NO: 6700723 - DNA, 19 bp, Homo sapiens
cagattttaattgtcatgg

SEQ ID NO: 6700724 - DNA, 15 bp, Homo sapiens
cagattttaattttg

SEQ ID NO: 6700725 - DNA, 18 bp, Homo sapiens
cagattttacaaaagatg

SEQ ID NO: 6700726 - DNA, 19 bp, Homo sapiens
cagattttacagagcgcac

SEQ ID NO: 6700727 - DNA, 13 bp, Homo sapiens
cagattttatatt

SEQ ID NO: 6700728 - DNA, 16 bp, Homo sapiens
cagattttattatgta

SEQ ID NO: 6700729 - DNA, 20 bp, Homo sapiens
cagattttattatgtaaatc

SEQ ID NO: 6700730 - DNA, 13 bp, Homo sapiens
cagattttatttg

SEQ ID NO: 6700731 - DNA, 13 bp, Homo sapiens
cagattttcagca

SEQ ID NO: 6700732 - DNA, 22 bp, Homo sapiens
cagattttcagcaaactctttt

SEQ ID NO: 6700733 - DNA, 18 bp, Homo sapiens
cagattttcctaaggcca

SEQ ID NO: 6700734 - DNA, 14 bp, Homo sapiens
cagattttcctgtg

SEQ ID NO: 6700735 - DNA, 20 bp, Homo sapiens
cagattttcttaaggaattt

SEQ ID NO: 6700736 - DNA, 19 bp, Homo sapiens
cagattttgctgtatattt

SEQ ID NO: 6700737 - DNA, 23 bp, Homo sapiens
cagattttgttggcatagctctg

SEQ ID NO: 6700738 - DNA, 15 bp, Homo sapiens
cagatttttaaagtt

SEQ ID NO: 6700739 - DNA, 16 bp, Homo sapiens
cagatttttaaagttt

SEQ ID NO: 6700740 - DNA, 18 bp, Homo sapiens
cagatttttaaagttttg

SEQ ID NO: 6700741 - DNA, 11 bp, Homo sapiens
cagatttttat

SEQ ID NO: 6700742 - DNA, 22 bp, Homo sapiens
cagatttttatattagttgctt

SEQ ID NO: 6700743 - DNA, 19 bp, Homo sapiens
cagatttttatgttttctt

SEQ ID NO: 6700744 - DNA, 23 bp, Homo sapiens
cagatttttggtagtttctgggt

SEQ ID NO: 6700745 - DNA, 14 bp, Homo sapiens
cagattttttaaaa

SEQ ID NO: 6700746 - DNA, 15 bp, Homo sapiens
cagattttttcttta

SEQ ID NO: 6700747 - DNA, 16 bp, Homo sapiens
cagattttttctttaa

SEQ ID NO: 6700748 - DNA, 18 bp, Homo sapiens
cagcaaaaaagtccaatt

SEQ ID NO: 6700749 - DNA, 21 bp, Homo sapiens
cagcaaaaactgtgggaagat

SEQ ID NO: 6700750 - DNA, 15 bp, Homo sapiens
cagcaaaaagcaaaa

SEQ ID NO: 6700751 - DNA, 20 bp, Homo sapiens
cagcaaaaagcaaaatcatt

SEQ ID NO: 6700752 - DNA, 17 bp, Homo sapiens
cagcaaaaatattttat

SEQ ID NO: 6700753 - DNA, 13 bp, Homo sapiens
cagcaaaaccatt

SEQ ID NO: 6700754 - DNA, 18 bp, Homo sapiens
cagcaaaaccattgcttc

SEQ ID NO: 6700755 - DNA, 11 bp, Homo sapiens
cagcaaaagat

SEQ ID NO: 6700756 - DNA, 18 bp, Homo sapiens
cagcaaaagatgcttctc

SEQ ID NO: 6700757 - DNA, 22 bp, Homo sapiens
cagcaaaagatgtgcaaaatca

SEQ ID NO: 6700758 - DNA, 13 bp, Homo sapiens
cagcaaaatatat

SEQ ID NO: 6700759 - DNA, 17 bp, Homo sapiens
cagcaaaatatatgttt

SEQ ID NO: 6700760 - DNA, 20 bp, Homo sapiens
cagcaaaatccaaactgctg

SEQ ID NO: 6700761 - DNA, 22 bp, Homo sapiens
cagcaaaatccaaactgctgtc

SEQ ID NO: 6700762 - DNA, 23 bp, Homo sapiens
cagcaaaatccaaactgctgtct

SEQ ID NO: 6700763 - DNA, 22 bp, Homo sapiens
cagcaaaatgtgaatgggaaaa

SEQ ID NO: 6700764 - DNA, 13 bp, Homo sapiens
cagcaaaatgttg

SEQ ID NO: 6700765 - DNA, 13 bp, Homo sapiens
cagcaaacacaat

SEQ ID NO: 6700766 - DNA, 12 bp, Homo sapiens
cagcaaacacag

SEQ ID NO: 6700767 - DNA, 13 bp, Homo sapiens
cagcaaacacagt

SEQ ID NO: 6700768 - DNA, 14 bp, Homo sapiens
cagcaaacacagtc

SEQ ID NO: 6700769 - DNA, 16 bp, Homo sapiens
cagcaaaccaagagat

SEQ ID NO: 6700770 - DNA, 11 bp, Homo sapiens
cagcaaaccat

SEQ ID NO: 6700771 - DNA, 21 bp, Homo sapiens
cagcaaaccatttttaaagta

SEQ ID NO: 6700772 - DNA, 24 bp, Homo sapiens
cagcaaaccatttttaaagtagaa

SEQ ID NO: 6700773 - DNA, 15 bp, Homo sapiens
cagcaaacccaaaga

SEQ ID NO: 6700774 - DNA, 16 bp, Homo sapiens
cagcaaacccaaagat

SEQ ID NO: 6700775 - DNA, 17 bp, Homo sapiens
cagcaaacccaaagatg

SEQ ID NO: 6700776 - DNA, 21 bp, Homo sapiens
cagcaaacccaaagatgttaa

SEQ ID NO: 6700777 - DNA, 15 bp, Homo sapiens
cagcaaagaaaaaaa

SEQ ID NO: 6700778 - DNA, 15 bp, Homo sapiens
cagcaaagaggggcg

SEQ ID NO: 6700779 - DNA, 22 bp, Homo sapiens
cagcaaagcagcagtgtccaga

SEQ ID NO: 6700780 - DNA, 13 bp, Homo sapiens
cagcaaagccata

SEQ ID NO: 6700781 - DNA, 21 bp, Homo sapiens
cagcaaagccccatgctggag

SEQ ID NO: 6700782 - DNA, 19 bp, Homo sapiens
cagcaaagctacaggactg

SEQ ID NO: 6700783 - DNA, 14 bp, Homo sapiens
cagcaaaggaaact

SEQ ID NO: 6700784 - DNA, 20 bp, Homo sapiens
cagcaaagtagaatctcttt

SEQ ID NO: 6700785 - DNA, 14 bp, Homo sapiens
cagcaaagtggttc

SEQ ID NO: 6700786 - DNA, 18 bp, Homo sapiens
cagcaaagtgtcagtgtt

SEQ ID NO: 6700787 - DNA, 16 bp, Homo sapiens
cagcaaagttttcaga

SEQ ID NO: 6700788 - DNA, 15 bp, Homo sapiens
cagcaaatagcaaat

SEQ ID NO: 6700789 - DNA, 16 bp, Homo sapiens
cagcaaatatttattg

SEQ ID NO: 6700790 - DNA, 18 bp, Homo sapiens
cagcaaatcctcttctaa

SEQ ID NO: 6700791 - DNA, 16 bp, Homo sapiens
cagcaaatcctttgtg

SEQ ID NO: 6700792 - DNA, 14 bp, Homo sapiens
cagcaaatgggcat

SEQ ID NO: 6700793 - DNA, 18 bp, Homo sapiens
cagcaaatgggcatttta

SEQ ID NO: 6700794 - DNA, 16 bp, Homo sapiens
cagcaaattaatgtgt

SEQ ID NO: 6700795 - DNA, 19 bp, Homo sapiens
cagcaaattaattggcagc

SEQ ID NO: 6700796 - DNA, 14 bp, Homo sapiens
cagcaaattccaga

SEQ ID NO: 6700797 - DNA, 21 bp, Homo sapiens
cagcaaattcttgaataaact

SEQ ID NO: 6700798 - DNA, 16 bp, Homo sapiens
cagcaaatttataatt

SEQ ID NO: 6700799 - DNA, 19 bp, Homo sapiens
cagcaaatttataatttta

SEQ ID NO: 6700800 - DNA, 14 bp, Homo sapiens
cagcaaattttcag

SEQ ID NO: 6700801 - DNA, 22 bp, Homo sapiens
cagcaacaaaatcatggcttag

SEQ ID NO: 6700802 - DNA, 13 bp, Homo sapiens
cagcaacaacaac

SEQ ID NO: 6700803 - DNA, 14 bp, Homo sapiens
cagcaacaacaaca

SEQ ID NO: 6700804 - DNA, 19 bp, Homo sapiens
cagcaacaactgtcagttc

SEQ ID NO: 6700805 - DNA, 13 bp, Homo sapiens
cagcaacaagact

SEQ ID NO: 6700806 - DNA, 17 bp, Homo sapiens
cagcaacaagactgcca

SEQ ID NO: 6700807 - DNA, 18 bp, Homo sapiens
cagcaacaagactgccag

SEQ ID NO: 6700808 - DNA, 19 bp, Homo sapiens
cagcaacaagactgccagg

SEQ ID NO: 6700809 - DNA, 19 bp, Homo sapiens
cagcaacaataaatagaca

SEQ ID NO: 6700810 - DNA, 20 bp, Homo sapiens
cagcaacaataaatagacac

SEQ ID NO: 6700811 - DNA, 15 bp, Homo sapiens
cagcaacacaaagct

SEQ ID NO: 6700812 - DNA, 21 bp, Homo sapiens
cagcaacacaagctggaagca

SEQ ID NO: 6700813 - DNA, 14 bp, Homo sapiens
cagcaacacagagc

SEQ ID NO: 6700814 - DNA, 19 bp, Homo sapiens
cagcaacacagcctgggcc

SEQ ID NO: 6700815 - DNA, 17 bp, Homo sapiens
cagcaacacgtcattgt

SEQ ID NO: 6700816 - DNA, 18 bp, Homo sapiens
cagcaacacgtcattgtg

SEQ ID NO: 6700817 - DNA, 14 bp, Homo sapiens
cagcaacagaaaaa

SEQ ID NO: 6700818 - DNA, 21 bp, Homo sapiens
cagcaacaggaatctcagaga

SEQ ID NO: 6700819 - DNA, 23 bp, Homo sapiens
cagcaacaggaatctcagagaca

SEQ ID NO: 6700820 - DNA, 16 bp, Homo sapiens
cagcaacatcccatct

SEQ ID NO: 6700821 - DNA, 22 bp, Homo sapiens
cagcaacattataatggccctg

SEQ ID NO: 6700822 - DNA, 23 bp, Homo sapiens
cagcaacattttcttgaattttt

SEQ ID NO: 6700823 - DNA, 20 bp, Homo sapiens
cagcaaccagagcactgtat

SEQ ID NO: 6700824 - DNA, 12 bp, Homo sapiens
cagcaaccccag

SEQ ID NO: 6700825 - DNA, 10 bp, Homo sapiens
cagcaaccct

SEQ ID NO: 6700826 - DNA, 18 bp, Homo sapiens
cagcaacccttcctgctg

SEQ ID NO: 6700827 - DNA, 19 bp, Homo sapiens
cagcaacccttcctgctgc

SEQ ID NO: 6700828 - DNA, 21 bp, Homo sapiens
cagcaacccttcctgctgctg

SEQ ID NO: 6700829 - DNA, 18 bp, Homo sapiens
cagcaacctgtaagactg

SEQ ID NO: 6700830 - DNA, 19 bp, Homo sapiens
cagcaacgcccctccaaac

SEQ ID NO: 6700831 - DNA, 23 bp, Homo sapiens
cagcaacgcccctccaaacctcc

SEQ ID NO: 6700832 - DNA, 20 bp, Homo sapiens
cagcaactatcagactaagc

SEQ ID NO: 6700833 - DNA, 23 bp, Homo sapiens
cagcaactatcagactaagccag

SEQ ID NO: 6700834 - DNA, 12 bp, Homo sapiens
cagcaactccca

SEQ ID NO: 6700835 - DNA, 17 bp, Homo sapiens
cagcaactgaaaatgaa

SEQ ID NO: 6700836 - DNA, 12 bp, Homo sapiens
cagcaactgacc

SEQ ID NO: 6700837 - DNA, 14 bp, Homo sapiens
cagcaactgacctg

SEQ ID NO: 6700838 - DNA, 13 bp, Homo sapiens
cagcaactgccct

SEQ ID NO: 6700839 - DNA, 16 bp, Homo sapiens
cagcaactgcccttcc

SEQ ID NO: 6700840 - DNA, 22 bp, Homo sapiens
cagcaacttgtcctagcacaga

SEQ ID NO: 6700841 - DNA, 15 bp, Homo sapiens
cagcaacttgtcttt

SEQ ID NO: 6700842 - DNA, 22 bp, Homo sapiens
cagcaactttcccttgccctgg

SEQ ID NO: 6700843 - DNA, 15 bp, Homo sapiens
cagcaacttttctca

SEQ ID NO: 6700844 - DNA, 14 bp, Homo sapiens
cagcaagaaaaaaa

SEQ ID NO: 6700845 - DNA, 16 bp, Homo sapiens
cagcaagaagcagcct

SEQ ID NO: 6700846 - DNA, 15 bp, Homo sapiens
cagcaagagagaacc

SEQ ID NO: 6700847 - DNA, 14 bp, Homo sapiens
cagcaagaggagga

SEQ ID NO: 6700848 - DNA, 15 bp, Homo sapiens
cagcaagataaacac

SEQ ID NO: 6700849 - DNA, 20 bp, Homo sapiens
cagcaagataaacacaattt

SEQ ID NO: 6700850 - DNA, 16 bp, Homo sapiens
cagcaagatgtttctt

SEQ ID NO: 6700851 - DNA, 21 bp, Homo sapiens
cagcaagcaaacagggtggcc

SEQ ID NO: 6700852 - DNA, 21 bp, Homo sapiens
cagcaagcagtctaccctgtc

SEQ ID NO: 6700853 - DNA, 12 bp, Homo sapiens
cagcaagccggc

SEQ ID NO: 6700854 - DNA, 15 bp, Homo sapiens
cagcaagctgcccag

SEQ ID NO: 6700855 - DNA, 17 bp, Homo sapiens
cagcaagctgcccagcc

SEQ ID NO: 6700856 - DNA, 13 bp, Homo sapiens
cagcaaggaaaca

SEQ ID NO: 6700857 - DNA, 19 bp, Homo sapiens
cagcaaggaaatgtcctgc

SEQ ID NO: 6700858 - DNA, 20 bp, Homo sapiens
cagcaaggaaatgtcctgca

SEQ ID NO: 6700859 - DNA, 21 bp, Homo sapiens
cagcaaggaaatgtcctgcat

SEQ ID NO: 6700860 - DNA, 15 bp, Homo sapiens
cagcaaggcacaggc

SEQ ID NO: 6700861 - DNA, 17 bp, Homo sapiens
cagcaaggcacctgcag

SEQ ID NO: 6700862 - DNA, 14 bp, Homo sapiens
cagcaaggcaggtt

SEQ ID NO: 6700863 - DNA, 20 bp, Homo sapiens
cagcaaggcaggttggatgg

SEQ ID NO: 6700864 - DNA, 14 bp, Homo sapiens
cagcaaggccacct

SEQ ID NO: 6700865 - DNA, 21 bp, Homo sapiens
cagcaaggccacctcttcctg

SEQ ID NO: 6700866 - DNA, 20 bp, Homo sapiens
cagcaaggcccgagcagctg

SEQ ID NO: 6700867 - DNA, 22 bp, Homo sapiens
cagcaaggcccgagcagctgag

SEQ ID NO: 6700868 - DNA, 23 bp, Homo sapiens
cagcaaggccttggtggagcagc

SEQ ID NO: 6700869 - DNA, 16 bp, Homo sapiens
cagcaaggctgctgcc

SEQ ID NO: 6700870 - DNA, 18 bp, Homo sapiens
cagcaagggacctgctca

SEQ ID NO: 6700871 - DNA, 13 bp, Homo sapiens
cagcaagggagag

SEQ ID NO: 6700872 - DNA, 22 bp, Homo sapiens
cagcaagggagatttttgaatc

SEQ ID NO: 6700873 - DNA, 20 bp, Homo sapiens
cagcaaggggctctgccctc

SEQ ID NO: 6700874 - DNA, 21 bp, Homo sapiens
cagcaaggggctgcttctggg

SEQ ID NO: 6700875 - DNA, 19 bp, Homo sapiens
cagcaagggtgatgggaaa

SEQ ID NO: 6700876 - DNA, 23 bp, Homo sapiens
cagcaagggtgatgggaaagcat

SEQ ID NO: 6700877 - DNA, 19 bp, Homo sapiens
cagcaaggtcatggtctga

SEQ ID NO: 6700878 - DNA, 15 bp, Homo sapiens
cagcaaggtcttgct

SEQ ID NO: 6700879 - DNA, 18 bp, Homo sapiens
cagcaaggtcttgctctc

SEQ ID NO: 6700880 - DNA, 22 bp, Homo sapiens
cagcaaggtgggggtcaggcta

SEQ ID NO: 6700881 - DNA, 21 bp, Homo sapiens
cagcaaggtgtgaatgacctt

SEQ ID NO: 6700882 - DNA, 19 bp, Homo sapiens
cagcaaggtgtggaggctc

SEQ ID NO: 6700883 - DNA, 14 bp, Homo sapiens
cagcaagtcccaga

SEQ ID NO: 6700884 - DNA, 12 bp, Homo sapiens
cagcaagtgtac

SEQ ID NO: 6700885 - DNA, 15 bp, Homo sapiens
cagcaagtgtacagt

SEQ ID NO: 6700886 - DNA, 15 bp, Homo sapiens
cagcaagtgtgaata

SEQ ID NO: 6700887 - DNA, 13 bp, Homo sapiens
cagcaagtgtttg

SEQ ID NO: 6700888 - DNA, 22 bp, Homo sapiens
cagcaagtttataaaacatcca

SEQ ID NO: 6700889 - DNA, 18 bp, Homo sapiens
cagcaagtttcaccttgg

SEQ ID NO: 6700890 - DNA, 12 bp, Homo sapiens
cagcaataaaaa

SEQ ID NO: 6700891 - DNA, 21 bp, Homo sapiens
cagcaataaagcagcgtttct

SEQ ID NO: 6700892 - DNA, 15 bp, Homo sapiens
cagcaataagaaatg

SEQ ID NO: 6700893 - DNA, 18 bp, Homo sapiens
cagcaataagaaatgaac

SEQ ID NO: 6700894 - DNA, 22 bp, Homo sapiens
cagcaatactcatcagagcagc

SEQ ID NO: 6700895 - DNA, 22 bp, Homo sapiens
cagcaatatattaccagcaaga

SEQ ID NO: 6700896 - DNA, 22 bp, Homo sapiens
cagcaatattgcctgtgcttct

SEQ ID NO: 6700897 - DNA, 19 bp, Homo sapiens
cagcaatatttaaggagat

SEQ ID NO: 6700898 - DNA, 17 bp, Homo sapiens
cagcaatcacaaaggct

SEQ ID NO: 6700899 - DNA, 14 bp, Homo sapiens
cagcaatgccctgc

SEQ ID NO: 6700900 - DNA, 16 bp, Homo sapiens
cagcaatgccctgcct

SEQ ID NO: 6700901 - DNA, 18 bp, Homo sapiens
cagcaatgccctgccttg

SEQ ID NO: 6700902 - DNA, 19 bp, Homo sapiens
cagcaatgccctgccttgc

SEQ ID NO: 6700903 - DNA, 13 bp, Homo sapiens
cagcaattaatta

SEQ ID NO: 6700904 - DNA, 15 bp, Homo sapiens
cagcaattattatat

SEQ ID NO: 6700905 - DNA, 20 bp, Homo sapiens
cagcaattcacgctgtctct

SEQ ID NO: 6700906 - DNA, 17 bp, Homo sapiens
cagcaattcatggttca

SEQ ID NO: 6700907 - DNA, 16 bp, Homo sapiens
cagcaattctcctgcc

SEQ ID NO: 6700908 - DNA, 18 bp, Homo sapiens
cagcaattctcctgcctc

SEQ ID NO: 6700909 - DNA, 19 bp, Homo sapiens
cagcaattctcctgcctca

SEQ ID NO: 6700910 - DNA, 15 bp, Homo sapiens
cagcaatttcagaac

SEQ ID NO: 6700911 - DNA, 23 bp, Homo sapiens
cagcaatttctaatttttaagaa

SEQ ID NO: 6700912 - DNA, 12 bp, Homo sapiens
cagcacaaaatg

SEQ ID NO: 6700913 - DNA, 14 bp, Homo sapiens
cagcacaaacacaa

SEQ ID NO: 6700914 - DNA, 17 bp, Homo sapiens
cagcacaaacacacctc

SEQ ID NO: 6700915 - DNA, 17 bp, Homo sapiens
cagcacaaacattgctg

SEQ ID NO: 6700916 - DNA, 13 bp, Homo sapiens
cagcacaaagcac

SEQ ID NO: 6700917 - DNA, 15 bp, Homo sapiens
cagcacaaagcactg

SEQ ID NO: 6700918 - DNA, 13 bp, Homo sapiens
cagcacaaccccc

SEQ ID NO: 6700919 - DNA, 23 bp, Homo sapiens
cagcacaaccggtcccttccatg

SEQ ID NO: 6700920 - DNA, 21 bp, Homo sapiens
cagcacaaccttcaagctgct

SEQ ID NO: 6700921 - DNA, 13 bp, Homo sapiens
cagcacaaggaat

SEQ ID NO: 6700922 - DNA, 23 bp, Homo sapiens
cagcacaattatgtgtgaagctg

SEQ ID NO: 6700923 - DNA, 15 bp, Homo sapiens
cagcacaattctgtc

SEQ ID NO: 6700924 - DNA, 17 bp, Homo sapiens
cagcacaattctgtccc

SEQ ID NO: 6700925 - DNA, 22 bp, Homo sapiens
cagcacaattctgtccctgtcc

SEQ ID NO: 6700926 - DNA, 18 bp, Homo sapiens
cagcacacaggcagccag

SEQ ID NO: 6700927 - DNA, 13 bp, Homo sapiens
cagcacacagggc

SEQ ID NO: 6700928 - DNA, 15 bp, Homo sapiens
cagcacacagggcag

SEQ ID NO: 6700929 - DNA, 23 bp, Homo sapiens
cagcacacatgcatcctcccctc

SEQ ID NO: 6700930 - DNA, 21 bp, Homo sapiens
cagcacaccaagtggctgggt

SEQ ID NO: 6700931 - DNA, 18 bp, Homo sapiens
cagcacaccagccgctgc

SEQ ID NO: 6700932 - DNA, 20 bp, Homo sapiens
cagcacaccagccgctgcag

SEQ ID NO: 6700933 - DNA, 15 bp, Homo sapiens
cagcacaccccaagg

SEQ ID NO: 6700934 - DNA, 16 bp, Homo sapiens
cagcacaccccaaggg

SEQ ID NO: 6700935 - DNA, 20 bp, Homo sapiens
cagcacacctcagccccact

SEQ ID NO: 6700936 - DNA, 16 bp, Homo sapiens
cagcacacctctgggg

SEQ ID NO: 6700937 - DNA, 17 bp, Homo sapiens
cagcacacctctggggg

SEQ ID NO: 6700938 - DNA, 12 bp, Homo sapiens
cagcacacctgt

SEQ ID NO: 6700939 - DNA, 16 bp, Homo sapiens
cagcacagagaagaca

SEQ ID NO: 6700940 - DNA, 17 bp, Homo sapiens
cagcacagagaagacaa

SEQ ID NO: 6700941 - DNA, 16 bp, Homo sapiens
cagcacagagaccccc

SEQ ID NO: 6700942 - DNA, 17 bp, Homo sapiens
cagcacagagagggggc

SEQ ID NO: 6700943 - DNA, 19 bp, Homo sapiens
cagcacagataaaaagtgg

SEQ ID NO: 6700944 - DNA, 21 bp, Homo sapiens
cagcacagataaaaagtggaa

SEQ ID NO: 6700945 - DNA, 13 bp, Homo sapiens
cagcacagcaagg

SEQ ID NO: 6700946 - DNA, 21 bp, Homo sapiens
cagcacagcaaggaggctggc

SEQ ID NO: 6700947 - DNA, 12 bp, Homo sapiens
cagcacagccac

SEQ ID NO: 6700948 - DNA, 18 bp, Homo sapiens
cagcacagcccagggcct

SEQ ID NO: 6700949 - DNA, 20 bp, Homo sapiens
cagcacagccctaccccgcc

SEQ ID NO: 6700950 - DNA, 16 bp, Homo sapiens
cagcacagcctcaccc

SEQ ID NO: 6700951 - DNA, 11 bp, Homo sapiens
cagcacagctc

SEQ ID NO: 6700952 - DNA, 23 bp, Homo sapiens
cagcacagctcctcccctgccgc

SEQ ID NO: 6700953 - DNA, 18 bp, Homo sapiens
cagcacagctctcctcct

SEQ ID NO: 6700954 - DNA, 22 bp, Homo sapiens
cagcacagcttgacctgaggct

SEQ ID NO: 6700955 - DNA, 12 bp, Homo sapiens
cagcacaggaat

SEQ ID NO: 6700956 - DNA, 22 bp, Homo sapiens
cagcacaggagagcacccacag

SEQ ID NO: 6700957 - DNA, 14 bp, Homo sapiens
cagcacaggcacct

SEQ ID NO: 6700958 - DNA, 15 bp, Homo sapiens
cagcacaggcaccta

SEQ ID NO: 6700959 - DNA, 18 bp, Homo sapiens
cagcacagggatccgact

SEQ ID NO: 6700960 - DNA, 20 bp, Homo sapiens
cagcacagggcaggggtggt

SEQ ID NO: 6700961 - DNA, 17 bp, Homo sapiens
cagcacaggggccccag

SEQ ID NO: 6700962 - DNA, 21 bp, Homo sapiens
cagcacaggggccccagatct

SEQ ID NO: 6700963 - DNA, 23 bp, Homo sapiens
cagcacagggggattctgagcag

SEQ ID NO: 6700964 - DNA, 14 bp, Homo sapiens
cagcacatcacctc

SEQ ID NO: 6700965 - DNA, 15 bp, Homo sapiens
cagcacatcacctct

SEQ ID NO: 6700966 - DNA, 21 bp, Homo sapiens
cagcacatccatcagcacccc

SEQ ID NO: 6700967 - DNA, 16 bp, Homo sapiens
cagcacatctcaacag

SEQ ID NO: 6700968 - DNA, 22 bp, Homo sapiens
cagcacatgctggccagcctgg

SEQ ID NO: 6700969 - DNA, 17 bp, Homo sapiens
cagcacatggccataga

SEQ ID NO: 6700970 - DNA, 15 bp, Homo sapiens
cagcacatttcctct

SEQ ID NO: 6700971 - DNA, 16 bp, Homo sapiens
cagcacatttgttaat

SEQ ID NO: 6700972 - DNA, 22 bp, Homo sapiens
cagcaccaattgtacattccct

SEQ ID NO: 6700973 - DNA, 16 bp, Homo sapiens
cagcaccacattgcct

SEQ ID NO: 6700974 - DNA, 17 bp, Homo sapiens
cagcaccacattgcctc

SEQ ID NO: 6700975 - DNA, 13 bp, Homo sapiens
cagcaccaccagg

SEQ ID NO: 6700976 - DNA, 21 bp, Homo sapiens
cagcaccaccctagtcccttc

SEQ ID NO: 6700977 - DNA, 20 bp, Homo sapiens
cagcaccacctacacaggag

SEQ ID NO: 6700978 - DNA, 14 bp, Homo sapiens
cagcaccactcaag

SEQ ID NO: 6700979 - DNA, 14 bp, Homo sapiens
cagcaccactgctg

SEQ ID NO: 6700980 - DNA, 17 bp, Homo sapiens
cagcaccactgctgagg

SEQ ID NO: 6700981 - DNA, 18 bp, Homo sapiens
cagcaccactgctgagga

SEQ ID NO: 6700982 - DNA, 14 bp, Homo sapiens
cagcaccagaatgt

SEQ ID NO: 6700983 - DNA, 17 bp, Homo sapiens
cagcaccagcctgagcc

SEQ ID NO: 6700984 - DNA, 20 bp, Homo sapiens
cagcaccatccgccagggcc

SEQ ID NO: 6700985 - DNA, 17 bp, Homo sapiens
cagcaccatctctcctc

SEQ ID NO: 6700986 - DNA, 17 bp, Homo sapiens
cagcacccaaagggtta

SEQ ID NO: 6700987 - DNA, 15 bp, Homo sapiens
cagcacccactcagc

SEQ ID NO: 6700988 - DNA, 22 bp, Homo sapiens
cagcacccagtcctctgcctcc

SEQ ID NO: 6700989 - DNA, 15 bp, Homo sapiens
cagcaccccactcct

SEQ ID NO: 6700990 - DNA, 12 bp, Homo sapiens
cagcacccccac

SEQ ID NO: 6700991 - DNA, 14 bp, Homo sapiens
cagcacccccacgc

SEQ ID NO: 6700992 - DNA, 15 bp, Homo sapiens
cagcacccccaggcc

SEQ ID NO: 6700993 - DNA, 19 bp, Homo sapiens
cagcaccccctctcctgga

SEQ ID NO: 6700994 - DNA, 21 bp, Homo sapiens
cagcaccccctctcctggagg

SEQ ID NO: 6700995 - DNA, 17 bp, Homo sapiens
cagcacccctagcatga

SEQ ID NO: 6700996 - DNA, 14 bp, Homo sapiens
cagcacccctccag

SEQ ID NO: 6700997 - DNA, 13 bp, Homo sapiens
cagcaccctaaga

SEQ ID NO: 6700998 - DNA, 12 bp, Homo sapiens
cagcaccctccc

SEQ ID NO: 6700999 - DNA, 18 bp, Homo sapiens
cagcaccctctcctgggg

SEQ ID NO: 6701000 - DNA, 13 bp, Homo sapiens
cagcaccctgggt

SEQ ID NO: 6701001 - DNA, 17 bp, Homo sapiens
cagcaccctgggtgcca

SEQ ID NO: 6701002 - DNA, 18 bp, Homo sapiens
cagcacccttctcggaga

SEQ ID NO: 6701003 - DNA, 18 bp, Homo sapiens
cagcaccctttcaccccc

SEQ ID NO: 6701004 - DNA, 14 bp, Homo sapiens
cagcaccgccggct

SEQ ID NO: 6701005 - DNA, 15 bp, Homo sapiens
cagcaccggaccagc

SEQ ID NO: 6701006 - DNA, 20 bp, Homo sapiens
cagcaccggaccagcctggc

SEQ ID NO: 6701007 - DNA, 21 bp, Homo sapiens
cagcaccggaccagcctggcc

SEQ ID NO: 6701008 - DNA, 22 bp, Homo sapiens
cagcaccggaccagcctggccc

SEQ ID NO: 6701009 - DNA, 23 bp, Homo sapiens
cagcaccgtggtgtgaggccccc

SEQ ID NO: 6701010 - DNA, 22 bp, Homo sapiens
cagcacctagagtagtgcttgg

SEQ ID NO: 6701011 - DNA, 15 bp, Homo sapiens
cagcacctcctcagc

SEQ ID NO: 6701012 - DNA, 18 bp, Homo sapiens
cagcacctcctcagcctg

SEQ ID NO: 6701013 - DNA, 16 bp, Homo sapiens
cagcacctcctccatg

SEQ ID NO: 6701014 - DNA, 17 bp, Homo sapiens
cagcacctcctccgtgg

SEQ ID NO: 6701015 - DNA, 17 bp, Homo sapiens
cagcacctcctctctgc

SEQ ID NO: 6701016 - DNA, 20 bp, Homo sapiens
cagcacctcctctctgctgg

SEQ ID NO: 6701017 - DNA, 18 bp, Homo sapiens
cagcacctgagaagagga

SEQ ID NO: 6701018 - DNA, 11 bp, Homo sapiens
cagcacctgcc

SEQ ID NO: 6701019 - DNA, 15 bp, Homo sapiens
cagcacctgccaggg

SEQ ID NO: 6701020 - DNA, 12 bp, Homo sapiens
cagcacctgccc

SEQ ID NO: 6701021 - DNA, 13 bp, Homo sapiens
cagcacctgctcc

SEQ ID NO: 6701022 - DNA, 16 bp, Homo sapiens
cagcacctgctcccag

SEQ ID NO: 6701023 - DNA, 12 bp, Homo sapiens
cagcacctggag

SEQ ID NO: 6701024 - DNA, 18 bp, Homo sapiens
cagcacctggagcccaca

SEQ ID NO: 6701025 - DNA, 19 bp, Homo sapiens
cagcacctggcacaccaga

SEQ ID NO: 6701026 - DNA, 23 bp, Homo sapiens
cagcacctgtaagaaacagagca

SEQ ID NO: 6701027 - DNA, 17 bp, Homo sapiens
cagcaccttggcccagg

SEQ ID NO: 6701028 - DNA, 18 bp, Homo sapiens
cagcaccttggcccagga

SEQ ID NO: 6701029 - DNA, 17 bp, Homo sapiens
cagcaccttgtgcctgg

SEQ ID NO: 6701030 - DNA, 20 bp, Homo sapiens
cagcaccttgtgcctggggt

SEQ ID NO: 6701031 - DNA, 15 bp, Homo sapiens
cagcacctttctctg

SEQ ID NO: 6701032 - DNA, 18 bp, Homo sapiens
cagcacctttctctgaga

SEQ ID NO: 6701033 - DNA, 15 bp, Homo sapiens
cagcacgatttctgt

SEQ ID NO: 6701034 - DNA, 16 bp, Homo sapiens
cagcacgatttctgtt

SEQ ID NO: 6701035 - DNA, 19 bp, Homo sapiens
cagcacgcaggcggggcag

SEQ ID NO: 6701036 - DNA, 16 bp, Homo sapiens
cagcacgcatgtccct

SEQ ID NO: 6701037 - DNA, 22 bp, Homo sapiens
cagcacgcatgtccctccaagg

SEQ ID NO: 6701038 - DNA, 18 bp, Homo sapiens
cagcacgccaaccccagc

SEQ ID NO: 6701039 - DNA, 20 bp, Homo sapiens
cagcacgccaaccccagcag

SEQ ID NO: 6701040 - DNA, 12 bp, Homo sapiens
cagcacgcctct

SEQ ID NO: 6701041 - DNA, 21 bp, Homo sapiens
cagcacgcctctccccacctt

SEQ ID NO: 6701042 - DNA, 13 bp, Homo sapiens
cagcacgcctggc

SEQ ID NO: 6701043 - DNA, 14 bp, Homo sapiens
cagcacgcgacttc

SEQ ID NO: 6701044 - DNA, 20 bp, Homo sapiens
cagcacgcgacttctcagga

SEQ ID NO: 6701045 - DNA, 14 bp, Homo sapiens
cagcacggacaata

SEQ ID NO: 6701046 - DNA, 18 bp, Homo sapiens
cagcacggacaataaacc

SEQ ID NO: 6701047 - DNA, 19 bp, Homo sapiens
cagcacgggcacagctgct

SEQ ID NO: 6701048 - DNA, 15 bp, Homo sapiens
cagcacggtgcctcc

SEQ ID NO: 6701049 - DNA, 15 bp, Homo sapiens
cagcacgtctcagag

SEQ ID NO: 6701050 - DNA, 16 bp, Homo sapiens
cagcacgtggttttat

SEQ ID NO: 6701051 - DNA, 17 bp, Homo sapiens
cagcacgttctccagac

SEQ ID NO: 6701052 - DNA, 14 bp, Homo sapiens
cagcactaaacttg

SEQ ID NO: 6701053 - DNA, 19 bp, Homo sapiens
cagcactaaagcagtggac

SEQ ID NO: 6701054 - DNA, 16 bp, Homo sapiens
cagcactaaggccgtg

SEQ ID NO: 6701055 - DNA, 19 bp, Homo sapiens
cagcactaaggccgtgtct

SEQ ID NO: 6701056 - DNA, 21 bp, Homo sapiens
cagcactaaggccgtgtctct

SEQ ID NO: 6701057 - DNA, 15 bp, Homo sapiens
cagcactaaggtgga

SEQ ID NO: 6701058 - DNA, 19 bp, Homo sapiens
cagcactaaggtggacagc

SEQ ID NO: 6701059 - DNA, 22 bp, Homo sapiens
cagcactaaggtggacagcaga

SEQ ID NO: 6701060 - DNA, 11 bp, Homo sapiens
cagcactactc

SEQ ID NO: 6701061 - DNA, 14 bp, Homo sapiens
cagcactactctgt

SEQ ID NO: 6701062 - DNA, 20 bp, Homo sapiens
cagcactagaaattgggcag

SEQ ID NO: 6701063 - DNA, 23 bp, Homo sapiens
cagcactagagtcacccccccag

SEQ ID NO: 6701064 - DNA, 20 bp, Homo sapiens
cagcactagtaaaggaggaa

SEQ ID NO: 6701065 - DNA, 18 bp, Homo sapiens
cagcactcaaacctggag

SEQ ID NO: 6701066 - DNA, 17 bp, Homo sapiens
cagcactcacacaggac

SEQ ID NO: 6701067 - DNA, 15 bp, Homo sapiens
cagcactcagcctca

SEQ ID NO: 6701068 - DNA, 19 bp, Homo sapiens
cagcactccatcactgaga

SEQ ID NO: 6701069 - DNA, 22 bp, Homo sapiens
cagcactccatcactgagagcc

SEQ ID NO: 6701070 - DNA, 12 bp, Homo sapiens
cagcactcccca

SEQ ID NO: 6701071 - DNA, 21 bp, Homo sapiens
cagcactccccagagctgtgc

SEQ ID NO: 6701072 - DNA, 19 bp, Homo sapiens
cagcactccccttgccttc

SEQ ID NO: 6701073 - DNA, 20 bp, Homo sapiens
cagcactccccttgccttcc

SEQ ID NO: 6701074 - DNA, 23 bp, Homo sapiens
cagcactccccttgccttcccct

SEQ ID NO: 6701075 - DNA, 18 bp, Homo sapiens
cagcactcccgctgcaca

SEQ ID NO: 6701076 - DNA, 21 bp, Homo sapiens
cagcactccgcatcacctcac

SEQ ID NO: 6701077 - DNA, 17 bp, Homo sapiens
cagcactcctcggcagg

SEQ ID NO: 6701078 - DNA, 14 bp, Homo sapiens
cagcactcctctgt

SEQ ID NO: 6701079 - DNA, 16 bp, Homo sapiens
cagcactcctctgtct

SEQ ID NO: 6701080 - DNA, 11 bp, Homo sapiens
cagcactgagg

SEQ ID NO: 6701081 - DNA, 12 bp, Homo sapiens
cagcactgagga

SEQ ID NO: 6701082 - DNA, 18 bp, Homo sapiens
cagcactgatggaaaata

SEQ ID NO: 6701083 - DNA, 14 bp, Homo sapiens
cagcactgatttca

SEQ ID NO: 6701084 - DNA, 18 bp, Homo sapiens
cagcactgcccatcccac

SEQ ID NO: 6701085 - DNA, 13 bp, Homo sapiens
cagcactgcctcc

SEQ ID NO: 6701086 - DNA, 15 bp, Homo sapiens
cagcactgcctgcca

SEQ ID NO: 6701087 - DNA, 23 bp, Homo sapiens
cagcactgcctgctcccatcctg

SEQ ID NO: 6701088 - DNA, 17 bp, Homo sapiens
cagcactgctgcctcag

SEQ ID NO: 6701089 - DNA, 19 bp, Homo sapiens
cagcactgcttgaggaaaa

SEQ ID NO: 6701090 - DNA, 12 bp, Homo sapiens
cagcactggagg

SEQ ID NO: 6701091 - DNA, 20 bp, Homo sapiens
cagcactggaggggcccacc

SEQ ID NO: 6701092 - DNA, 20 bp, Homo sapiens
cagcactggattgtagaact

SEQ ID NO: 6701093 - DNA, 14 bp, Homo sapiens
cagcactggctctc

SEQ ID NO: 6701094 - DNA, 18 bp, Homo sapiens
cagcactggctctctcca

SEQ ID NO: 6701095 - DNA, 20 bp, Homo sapiens
cagcactggctctctccagg

SEQ ID NO: 6701096 - DNA, 14 bp, Homo sapiens
cagcactgggaagc

SEQ ID NO: 6701097 - DNA, 18 bp, Homo sapiens
cagcactgggaagctgga

SEQ ID NO: 6701098 - DNA, 16 bp, Homo sapiens
cagcactgtcccttgc

SEQ ID NO: 6701099 - DNA, 23 bp, Homo sapiens
cagcactgtctcagtttcacttt

SEQ ID NO: 6701100 - DNA, 11 bp, Homo sapiens
cagcactgtga

SEQ ID NO: 6701101 - DNA, 17 bp, Homo sapiens
cagcacttagacctgcc

SEQ ID NO: 6701102 - DNA, 13 bp, Homo sapiens
cagcacttattta

SEQ ID NO: 6701103 - DNA, 14 bp, Homo sapiens
cagcacttggccct

SEQ ID NO: 6701104 - DNA, 16 bp, Homo sapiens
cagcacttggcccttc

SEQ ID NO: 6701105 - DNA, 19 bp, Homo sapiens
cagcacttggcccttctac

SEQ ID NO: 6701106 - DNA, 15 bp, Homo sapiens
cagcacttggctcct

SEQ ID NO: 6701107 - DNA, 13 bp, Homo sapiens
cagcacttgtata

SEQ ID NO: 6701108 - DNA, 18 bp, Homo sapiens
cagcacttgtccagctga

SEQ ID NO: 6701109 - DNA, 11 bp, Homo sapiens
cagcacttgtt

SEQ ID NO: 6701110 - DNA, 15 bp, Homo sapiens
cagcactttaccaga

SEQ ID NO: 6701111 - DNA, 20 bp, Homo sapiens
cagcactttagatcacttga

SEQ ID NO: 6701112 - DNA, 19 bp, Homo sapiens
cagcactttcttcttccca

SEQ ID NO: 6701113 - DNA, 18 bp, Homo sapiens
cagcactttgagaggctg

SEQ ID NO: 6701114 - DNA, 20 bp, Homo sapiens
cagcactttgagaggctgag

SEQ ID NO: 6701115 - DNA, 23 bp, Homo sapiens
cagcactttgagaggctgaggtg

SEQ ID NO: 6701116 - DNA, 14 bp, Homo sapiens
cagcactttgggag

SEQ ID NO: 6701117 - DNA, 20 bp, Homo sapiens
cagcactttgggaggccaag

SEQ ID NO: 6701118 - DNA, 22 bp, Homo sapiens
cagcactttgggaggccaagga

SEQ ID NO: 6701119 - DNA, 23 bp, Homo sapiens
cagcactttgggaggccaaggag

SEQ ID NO: 6701120 - DNA, 18 bp, Homo sapiens
cagcactttgggaggccg

SEQ ID NO: 6701121 - DNA, 18 bp, Homo sapiens
cagcactttgggaggctg

SEQ ID NO: 6701122 - DNA, 19 bp, Homo sapiens
cagcactttgggaggctga

SEQ ID NO: 6701123 - DNA, 20 bp, Homo sapiens
cagcactttgggaggctgag

SEQ ID NO: 6701124 - DNA, 22 bp, Homo sapiens
cagcagaaaacttgtgtgaaat

SEQ ID NO: 6701125 - DNA, 12 bp, Homo sapiens
cagcagaaaagt

SEQ ID NO: 6701126 - DNA, 20 bp, Homo sapiens
cagcagaaacccccaggagg

SEQ ID NO: 6701127 - DNA, 17 bp, Homo sapiens
cagcagaaatgccccca

SEQ ID NO: 6701128 - DNA, 18 bp, Homo sapiens
cagcagaaatgcccccat

SEQ ID NO: 6701129 - DNA, 19 bp, Homo sapiens
cagcagaaatgccttaccc

SEQ ID NO: 6701130 - DNA, 22 bp, Homo sapiens
cagcagaaatgccttaccctca

SEQ ID NO: 6701131 - DNA, 22 bp, Homo sapiens
cagcagaacaaactcagatctc

SEQ ID NO: 6701132 - DNA, 14 bp, Homo sapiens
cagcagaaccagcc

SEQ ID NO: 6701133 - DNA, 17 bp, Homo sapiens
cagcagaacctgcacac

SEQ ID NO: 6701134 - DNA, 23 bp, Homo sapiens
cagcagaagagggaggcttcctg

SEQ ID NO: 6701135 - DNA, 11 bp, Homo sapiens
cagcagaagcc

SEQ ID NO: 6701136 - DNA, 20 bp, Homo sapiens
cagcagaagcctccaagcac

SEQ ID NO: 6701137 - DNA, 23 bp, Homo sapiens
cagcagaagcctccaagcacaga

SEQ ID NO: 6701138 - DNA, 13 bp, Homo sapiens
cagcagaaggatt

SEQ ID NO: 6701139 - DNA, 14 bp, Homo sapiens
cagcagaatgaaga

SEQ ID NO: 6701140 - DNA, 21 bp, Homo sapiens
cagcagaatgactctggaacc

SEQ ID NO: 6701141 - DNA, 19 bp, Homo sapiens
cagcagaatggaggcaggg

SEQ ID NO: 6701142 - DNA, 20 bp, Homo sapiens
cagcagacaagagggcaagc

SEQ ID NO: 6701143 - DNA, 22 bp, Homo sapiens
cagcagacaagagggcaagcct

SEQ ID NO: 6701144 - DNA, 14 bp, Homo sapiens
cagcagacacacat

SEQ ID NO: 6701145 - DNA, 15 bp, Homo sapiens
cagcagacacacatg

SEQ ID NO: 6701146 - DNA, 16 bp, Homo sapiens
cagcagacacacatgg

SEQ ID NO: 6701147 - DNA, 16 bp, Homo sapiens
cagcagacagagccag

SEQ ID NO: 6701148 - DNA, 17 bp, Homo sapiens
cagcagacagagccagg

SEQ ID NO: 6701149 - DNA, 16 bp, Homo sapiens
cagcagacatttatct

SEQ ID NO: 6701150 - DNA, 19 bp, Homo sapiens
cagcagacatttatctttg

SEQ ID NO: 6701151 - DNA, 21 bp, Homo sapiens
cagcagactcagctctgacat

SEQ ID NO: 6701152 - DNA, 20 bp, Homo sapiens
cagcagactgtgtttcgtga

SEQ ID NO: 6701153 - DNA, 19 bp, Homo sapiens
cagcagactttctctgtgt

SEQ ID NO: 6701154 - DNA, 17 bp, Homo sapiens
cagcagagaaccatcaa

SEQ ID NO: 6701155 - DNA, 13 bp, Homo sapiens
cagcagagacggg

SEQ ID NO: 6701156 - DNA, 21 bp, Homo sapiens
cagcagagacttgggacattg

SEQ ID NO: 6701157 - DNA, 20 bp, Homo sapiens
cagcagagagagaggacaga

SEQ ID NO: 6701158 - DNA, 15 bp, Homo sapiens
cagcagagccagggc

SEQ ID NO: 6701159 - DNA, 20 bp, Homo sapiens
cagcagagccagggcagggc

SEQ ID NO: 6701160 - DNA, 12 bp, Homo sapiens
cagcagagccca

SEQ ID NO: 6701161 - DNA, 21 bp, Homo sapiens
cagcagagcccaccagccagc

SEQ ID NO: 6701162 - DNA, 11 bp, Homo sapiens
cagcagagccg

SEQ ID NO: 6701163 - DNA, 18 bp, Homo sapiens
cagcagagccgttcctgg

SEQ ID NO: 6701164 - DNA, 14 bp, Homo sapiens
cagcagaggcagga

SEQ ID NO: 6701165 - DNA, 15 bp, Homo sapiens
cagcagaggcaggct

SEQ ID NO: 6701166 - DNA, 17 bp, Homo sapiens
cagcagaggcaggctgg

SEQ ID NO: 6701167 - DNA, 18 bp, Homo sapiens
cagcagaggcctgaggag

SEQ ID NO: 6701168 - DNA, 13 bp, Homo sapiens
cagcagaggcggt

SEQ ID NO: 6701169 - DNA, 13 bp, Homo sapiens
cagcagagggata

SEQ ID NO: 6701170 - DNA, 12 bp, Homo sapiens
cagcagaggtga

SEQ ID NO: 6701171 - DNA, 15 bp, Homo sapiens
cagcagaggtgagaa

SEQ ID NO: 6701172 - DNA, 10 bp, Homo sapiens
cagcagagtg

SEQ ID NO: 6701173 - DNA, 16 bp, Homo sapiens
cagcagagtgagcaag

SEQ ID NO: 6701174 - DNA, 20 bp, Homo sapiens
cagcagataacaatgcagca

SEQ ID NO: 6701175 - DNA, 16 bp, Homo sapiens
cagcagataaggccga

SEQ ID NO: 6701176 - DNA, 19 bp, Homo sapiens
cagcagatccacctgcaca

SEQ ID NO: 6701177 - DNA, 20 bp, Homo sapiens
cagcagatccacctgcacaa

SEQ ID NO: 6701178 - DNA, 23 bp, Homo sapiens
cagcagatccacctgcacaaaca

SEQ ID NO: 6701179 - DNA, 17 bp, Homo sapiens
cagcagatcccagctca

SEQ ID NO: 6701180 - DNA, 21 bp, Homo sapiens
cagcagatcccagctcacgtc

SEQ ID NO: 6701181 - DNA, 12 bp, Homo sapiens
cagcagatctgt

SEQ ID NO: 6701182 - DNA, 16 bp, Homo sapiens
cagcagatgccagtga

SEQ ID NO: 6701183 - DNA, 18 bp, Homo sapiens
cagcagattggaaggaga

SEQ ID NO: 6701184 - DNA, 22 bp, Homo sapiens
cagcagcaagaaaaaaaaatgc

SEQ ID NO: 6701185 - DNA, 10 bp, Homo sapiens
cagcagcaca

SEQ ID NO: 6701186 - DNA, 12 bp, Homo sapiens
cagcagcacaat

SEQ ID NO: 6701187 - DNA, 20 bp, Homo sapiens
cagcagcacaattctgtccc

SEQ ID NO: 6701188 - DNA, 12 bp, Homo sapiens
cagcagcacacc

SEQ ID NO: 6701189 - DNA, 13 bp, Homo sapiens
cagcagcacacct

SEQ ID NO: 6701190 - DNA, 14 bp, Homo sapiens
cagcagcaccaacc

SEQ ID NO: 6701191 - DNA, 14 bp, Homo sapiens
cagcagcacccacc

SEQ ID NO: 6701192 - DNA, 15 bp, Homo sapiens
cagcagcacccaccc

SEQ ID NO: 6701193 - DNA, 18 bp, Homo sapiens
cagcagcacccacccatg

SEQ ID NO: 6701194 - DNA, 14 bp, Homo sapiens
cagcagcacctttc

SEQ ID NO: 6701195 - DNA, 21 bp, Homo sapiens
cagcagcacctttctctgaga

SEQ ID NO: 6701196 - DNA, 12 bp, Homo sapiens
cagcagcacgca

SEQ ID NO: 6701197 - DNA, 18 bp, Homo sapiens
cagcagcacgcatgtccc

SEQ ID NO: 6701198 - DNA, 22 bp, Homo sapiens
cagcagcacgcatgtccctcca

SEQ ID NO: 6701199 - DNA, 11 bp, Homo sapiens
cagcagcactc

SEQ ID NO: 6701200 - DNA, 21 bp, Homo sapiens
cagcagcactcccgctgcaca

SEQ ID NO: 6701201 - DNA, 22 bp, Homo sapiens
cagcagcacttagacctgccag

SEQ ID NO: 6701202 - DNA, 16 bp, Homo sapiens
cagcagcagaatggaa

SEQ ID NO: 6701203 - DNA, 15 bp, Homo sapiens
cagcagcagagaacc

SEQ ID NO: 6701204 - DNA, 14 bp, Homo sapiens
cagcagcagagagc

SEQ ID NO: 6701205 - DNA, 18 bp, Homo sapiens
cagcagcagagagccctg

SEQ ID NO: 6701206 - DNA, 13 bp, Homo sapiens
cagcagcagcact

SEQ ID NO: 6701207 - DNA, 12 bp, Homo sapiens
cagcagcagcag

SEQ ID NO: 6701208 - DNA, 15 bp, Homo sapiens
cagcagcagcaggtg

SEQ ID NO: 6701209 - DNA, 13 bp, Homo sapiens
cagcagcagccct

SEQ ID NO: 6701210 - DNA, 13 bp, Homo sapiens
cagcagcagcctg

SEQ ID NO: 6701211 - DNA, 17 bp, Homo sapiens
cagcagcagcctgcacc

SEQ ID NO: 6701212 - DNA, 16 bp, Homo sapiens
cagcagcagctcacac

SEQ ID NO: 6701213 - DNA, 13 bp, Homo sapiens
cagcagcaggtga

SEQ ID NO: 6701214 - DNA, 19 bp, Homo sapiens
cagcagcagtttgtgatct

SEQ ID NO: 6701215 - DNA, 17 bp, Homo sapiens
cagcagcatcccagcct

SEQ ID NO: 6701216 - DNA, 15 bp, Homo sapiens
cagcagcatctactc

SEQ ID NO: 6701217 - DNA, 21 bp, Homo sapiens
cagcagccacttgactaatac

SEQ ID NO: 6701218 - DNA, 10 bp, Homo sapiens
cagcagccag

SEQ ID NO: 6701219 - DNA, 23 bp, Homo sapiens
cagcagccagccaaacacacaga

SEQ ID NO: 6701220 - DNA, 13 bp, Homo sapiens
cagcagccagccc

SEQ ID NO: 6701221 - DNA, 14 bp, Homo sapiens
cagcagccagccct

SEQ ID NO: 6701222 - DNA, 20 bp, Homo sapiens
cagcagccagccctgcctgg

SEQ ID NO: 6701223 - DNA, 13 bp, Homo sapiens
cagcagccagctc

SEQ ID NO: 6701224 - DNA, 19 bp, Homo sapiens
cagcagccagctctcagcc

SEQ ID NO: 6701225 - DNA, 15 bp, Homo sapiens
cagcagccagggacc

SEQ ID NO: 6701226 - DNA, 14 bp, Homo sapiens
cagcagccagtctc

SEQ ID NO: 6701227 - DNA, 19 bp, Homo sapiens
cagcagccagtctcagaga

SEQ ID NO: 6701228 - DNA, 24 bp, Homo sapiens
cagcagccagtctcagagaccagc

SEQ ID NO: 6701229 - DNA, 18 bp, Homo sapiens
cagcagcccaagcttccc

SEQ ID NO: 6701230 - DNA, 13 bp, Homo sapiens
cagcagcccagct

SEQ ID NO: 6701231 - DNA, 16 bp, Homo sapiens
cagcagcccagcttcc

SEQ ID NO: 6701232 - DNA, 18 bp, Homo sapiens
cagcagcccagcttcctg

SEQ ID NO: 6701233 - DNA, 21 bp, Homo sapiens
cagcagccccaccccaccctg

SEQ ID NO: 6701234 - DNA, 16 bp, Homo sapiens
cagcagccccaggaga

SEQ ID NO: 6701235 - DNA, 12 bp, Homo sapiens
cagcagccccca

SEQ ID NO: 6701236 - DNA, 13 bp, Homo sapiens
cagcagcccccca

SEQ ID NO: 6701237 - DNA, 15 bp, Homo sapiens
cagcagccccccagc

SEQ ID NO: 6701238 - DNA, 16 bp, Homo sapiens
cagcagccccccagca

SEQ ID NO: 6701239 - DNA, 17 bp, Homo sapiens
cagcagccccccagcac

SEQ ID NO: 6701240 - DNA, 17 bp, Homo sapiens
cagcagccccctgcccg

SEQ ID NO: 6701241 - DNA, 23 bp, Homo sapiens
cagcagccccggcaactctggct

SEQ ID NO: 6701242 - DNA, 20 bp, Homo sapiens
cagcagccccgtctgcccac

SEQ ID NO: 6701243 - DNA, 21 bp, Homo sapiens
cagcagcccctgagagcctgt

SEQ ID NO: 6701244 - DNA, 13 bp, Homo sapiens
cagcagcccctgc

SEQ ID NO: 6701245 - DNA, 23 bp, Homo sapiens
cagcagcccctgcacaaagccct

SEQ ID NO: 6701246 - DNA, 16 bp, Homo sapiens
cagcagccctcaacag

SEQ ID NO: 6701247 - DNA, 14 bp, Homo sapiens
cagcagccctcctc

SEQ ID NO: 6701248 - DNA, 15 bp, Homo sapiens
cagcagccctcctca

SEQ ID NO: 6701249 - DNA, 18 bp, Homo sapiens
cagcagccctcctcaccc

SEQ ID NO: 6701250 - DNA, 19 bp, Homo sapiens
cagcagccctcctcacccc

SEQ ID NO: 6701251 - DNA, 19 bp, Homo sapiens
cagcagccctgccccacac

SEQ ID NO: 6701252 - DNA, 20 bp, Homo sapiens
cagcagccctgccccacacc

SEQ ID NO: 6701253 - DNA, 14 bp, Homo sapiens
cagcagcctccctg

SEQ ID NO: 6701254 - DNA, 17 bp, Homo sapiens
cagcagcctccctgtca

SEQ ID NO: 6701255 - DNA, 21 bp, Homo sapiens
cagcagcctcgcacaggccct

SEQ ID NO: 6701256 - DNA, 18 bp, Homo sapiens
cagcagcctctgatctgt

SEQ ID NO: 6701257 - DNA, 11 bp, Homo sapiens
cagcagcctgc

SEQ ID NO: 6701258 - DNA, 14 bp, Homo sapiens
cagcagcctgcacc

SEQ ID NO: 6701259 - DNA, 16 bp, Homo sapiens
cagcagcctgcacctg

SEQ ID NO: 6701260 - DNA, 12 bp, Homo sapiens
cagcagcctgcc

SEQ ID NO: 6701261 - DNA, 16 bp, Homo sapiens
cagcagcctgccagca

SEQ ID NO: 6701262 - DNA, 21 bp, Homo sapiens
cagcagcctgcgctcggcagg

SEQ ID NO: 6701263 - DNA, 22 bp, Homo sapiens
cagcagcctgcgctcggcagga

SEQ ID NO: 6701264 - DNA, 12 bp, Homo sapiens
cagcagcctgct

SEQ ID NO: 6701265 - DNA, 21 bp, Homo sapiens
cagcagcctgcttcccacctc

SEQ ID NO: 6701266 - DNA, 12 bp, Homo sapiens
cagcagcctgga

SEQ ID NO: 6701267 - DNA, 15 bp, Homo sapiens
cagcagcctggaccc

SEQ ID NO: 6701268 - DNA, 19 bp, Homo sapiens
cagcagcctggaccctgtg

SEQ ID NO: 6701269 - DNA, 22 bp, Homo sapiens
cagcagcctggaccctgtggat

SEQ ID NO: 6701270 - DNA, 20 bp, Homo sapiens
cagcagcctggggctggcct

SEQ ID NO: 6701271 - DNA, 21 bp, Homo sapiens
cagcagcctggggctggcctc

SEQ ID NO: 6701272 - DNA, 13 bp, Homo sapiens
cagcagcctgtat

SEQ ID NO: 6701273 - DNA, 15 bp, Homo sapiens
cagcagcctgtatgt

SEQ ID NO: 6701274 - DNA, 12 bp, Homo sapiens
cagcagcctgtg

SEQ ID NO: 6701275 - DNA, 21 bp, Homo sapiens
cagcagcctgtgagggagtgc

SEQ ID NO: 6701276 - DNA, 12 bp, Homo sapiens
cagcagccttcc

SEQ ID NO: 6701277 - DNA, 15 bp, Homo sapiens
cagcagccttccagt

SEQ ID NO: 6701278 - DNA, 22 bp, Homo sapiens
cagcagccttccagtggcttct

SEQ ID NO: 6701279 - DNA, 23 bp, Homo sapiens
cagcagccttccagtggcttctc

SEQ ID NO: 6701280 - DNA, 15 bp, Homo sapiens
cagcagcgctcggcc

SEQ ID NO: 6701281 - DNA, 14 bp, Homo sapiens
cagcagcggcccag

SEQ ID NO: 6701282 - DNA, 22 bp, Homo sapiens
cagcagcgggggcggcccagcc

SEQ ID NO: 6701283 - DNA, 17 bp, Homo sapiens
cagcagcggtaccccag

SEQ ID NO: 6701284 - DNA, 15 bp, Homo sapiens
cagcagctaggactg

SEQ ID NO: 6701285 - DNA, 22 bp, Homo sapiens
cagcagctcaacctaccctggt

SEQ ID NO: 6701286 - DNA, 21 bp, Homo sapiens
cagcagctcagcctccccccg

SEQ ID NO: 6701287 - DNA, 14 bp, Homo sapiens
cagcagctcaggca

SEQ ID NO: 6701288 - DNA, 15 bp, Homo sapiens
cagcagctcatagaa

SEQ ID NO: 6701289 - DNA, 13 bp, Homo sapiens
cagcagctccaac

SEQ ID NO: 6701290 - DNA, 16 bp, Homo sapiens
cagcagctccaacctg

SEQ ID NO: 6701291 - DNA, 14 bp, Homo sapiens
cagcagctccgcct

SEQ ID NO: 6701292 - DNA, 17 bp, Homo sapiens
cagcagctccgcctggc

SEQ ID NO: 6701293 - DNA, 13 bp, Homo sapiens
cagcagctctgag

SEQ ID NO: 6701294 - DNA, 17 bp, Homo sapiens
cagcagctctgagccag

SEQ ID NO: 6701295 - DNA, 23 bp, Homo sapiens
cagcagctctgagccagattaca

SEQ ID NO: 6701296 - DNA, 20 bp, Homo sapiens
cagcagctctggctctgcct

SEQ ID NO: 6701297 - DNA, 24 bp, Homo sapiens
cagcagctctggctctgcctcagg

SEQ ID NO: 6701298 - DNA, 20 bp, Homo sapiens
cagcagctgaagccagctcc

SEQ ID NO: 6701299 - DNA, 13 bp, Homo sapiens
cagcagctgaagt

SEQ ID NO: 6701300 - DNA, 16 bp, Homo sapiens
cagcagctgatgctgt

SEQ ID NO: 6701301 - DNA, 13 bp, Homo sapiens
cagcagctgcacc

SEQ ID NO: 6701302 - DNA, 15 bp, Homo sapiens
cagcagctgcacccc

SEQ ID NO: 6701303 - DNA, 17 bp, Homo sapiens
cagcagctgcaccccag

SEQ ID NO: 6701304 - DNA, 17 bp, Homo sapiens
cagcagctgcgggtctg

SEQ ID NO: 6701305 - DNA, 12 bp, Homo sapiens
cagcagctggac

SEQ ID NO: 6701306 - DNA, 18 bp, Homo sapiens
cagcagctggactgggtg

SEQ ID NO: 6701307 - DNA, 22 bp, Homo sapiens
cagcagctggactgggtgggcc

SEQ ID NO: 6701308 - DNA, 15 bp, Homo sapiens
cagcagctgggaccc

SEQ ID NO: 6701309 - DNA, 22 bp, Homo sapiens
cagcagctgggccggccagcct

SEQ ID NO: 6701310 - DNA, 17 bp, Homo sapiens
cagcagctggtgcccca

SEQ ID NO: 6701311 - DNA, 17 bp, Homo sapiens
cagcagcttaagtccag

SEQ ID NO: 6701312 - DNA, 21 bp, Homo sapiens
cagcagcttataatgggctct

SEQ ID NO: 6701313 - DNA, 16 bp, Homo sapiens
cagcagcttcaccaga

SEQ ID NO: 6701314 - DNA, 19 bp, Homo sapiens
cagcagcttggctgagccc

SEQ ID NO: 6701315 - DNA, 21 bp, Homo sapiens
cagcagcttttccaccccagg

SEQ ID NO: 6701316 - DNA, 18 bp, Homo sapiens
cagcaggaagccaggctg

SEQ ID NO: 6701317 - DNA, 23 bp, Homo sapiens
cagcaggaagccatagatgctgg

SEQ ID NO: 6701318 - DNA, 22 bp, Homo sapiens
cagcaggaaggaacaaagacag

SEQ ID NO: 6701319 - DNA, 13 bp, Homo sapiens
cagcaggaataaa

SEQ ID NO: 6701320 - DNA, 16 bp, Homo sapiens
cagcaggaataaagac

SEQ ID NO: 6701321 - DNA, 22 bp, Homo sapiens
cagcaggacctgtgctttgaga

SEQ ID NO: 6701322 - DNA, 22 bp, Homo sapiens
cagcaggactgtgggaaagagc

SEQ ID NO: 6701323 - DNA, 23 bp, Homo sapiens
cagcaggacttgctaaagcactt

SEQ ID NO: 6701324 - DNA, 23 bp, Homo sapiens
cagcaggagagactgagcagccg

SEQ ID NO: 6701325 - DNA, 16 bp, Homo sapiens
cagcaggagcatggcc

SEQ ID NO: 6701326 - DNA, 23 bp, Homo sapiens
cagcaggaggacagagtgccctg

SEQ ID NO: 6701327 - DNA, 19 bp, Homo sapiens
cagcaggaggcacagcagt

SEQ ID NO: 6701328 - DNA, 22 bp, Homo sapiens
cagcaggaggctttctgggctc

SEQ ID NO: 6701329 - DNA, 14 bp, Homo sapiens
cagcaggagggaag

SEQ ID NO: 6701330 - DNA, 23 bp, Homo sapiens
cagcaggagggacagtctcacca

SEQ ID NO: 6701331 - DNA, 20 bp, Homo sapiens
cagcaggaggttctgggcct

SEQ ID NO: 6701332 - DNA, 22 bp, Homo sapiens
cagcaggaggttctgggcctct

SEQ ID NO: 6701333 - DNA, 18 bp, Homo sapiens
cagcaggatcgaagggtt

SEQ ID NO: 6701334 - DNA, 16 bp, Homo sapiens
cagcaggatgccctgt

SEQ ID NO: 6701335 - DNA, 19 bp, Homo sapiens
cagcaggcacggcccgcag

SEQ ID NO: 6701336 - DNA, 16 bp, Homo sapiens
cagcaggcactgaagc

SEQ ID NO: 6701337 - DNA, 18 bp, Homo sapiens
cagcaggcagaggagagt

SEQ ID NO: 6701338 - DNA, 13 bp, Homo sapiens
cagcaggcagagt

SEQ ID NO: 6701339 - DNA, 16 bp, Homo sapiens
cagcaggcaggcactg

SEQ ID NO: 6701340 - DNA, 21 bp, Homo sapiens
cagcaggcaggcactgtggcc

SEQ ID NO: 6701341 - DNA, 16 bp, Homo sapiens
cagcaggcaggctggg

SEQ ID NO: 6701342 - DNA, 22 bp, Homo sapiens
cagcaggcaggtggactgactg

SEQ ID NO: 6701343 - DNA, 22 bp, Homo sapiens
cagcaggcatttgctaaggcag

SEQ ID NO: 6701344 - DNA, 11 bp, Homo sapiens
cagcaggccaa

SEQ ID NO: 6701345 - DNA, 16 bp, Homo sapiens
cagcaggccactagtg

SEQ ID NO: 6701346 - DNA, 17 bp, Homo sapiens
cagcaggccactagtga

SEQ ID NO: 6701347 - DNA, 21 bp, Homo sapiens
cagcaggccaggtccagagag

SEQ ID NO: 6701348 - DNA, 13 bp, Homo sapiens
cagcaggcccacc

SEQ ID NO: 6701349 - DNA, 12 bp, Homo sapiens
cagcaggcccag

SEQ ID NO: 6701350 - DNA, 13 bp, Homo sapiens
cagcaggcccagc

SEQ ID NO: 6701351 - DNA, 14 bp, Homo sapiens
cagcaggcccagca

SEQ ID NO: 6701352 - DNA, 17 bp, Homo sapiens
cagcaggcccagcatgc

SEQ ID NO: 6701353 - DNA, 18 bp, Homo sapiens
cagcaggcccagcatgca

SEQ ID NO: 6701354 - DNA, 20 bp, Homo sapiens
cagcaggcccagcatgcagg

SEQ ID NO: 6701355 - DNA, 14 bp, Homo sapiens
cagcaggcccagga

SEQ ID NO: 6701356 - DNA, 15 bp, Homo sapiens
cagcaggcccaggag

SEQ ID NO: 6701357 - DNA, 22 bp, Homo sapiens
cagcaggcctctggttgcctcc

SEQ ID NO: 6701358 - DNA, 13 bp, Homo sapiens
cagcaggcgggct

SEQ ID NO: 6701359 - DNA, 24 bp, Homo sapiens
cagcaggcgggggtttgagccctg

SEQ ID NO: 6701360 - DNA, 14 bp, Homo sapiens
cagcaggcgtgcct

SEQ ID NO: 6701361 - DNA, 16 bp, Homo sapiens
cagcaggcgtgcctcg

SEQ ID NO: 6701362 - DNA, 17 bp, Homo sapiens
cagcaggctcaggcaca

SEQ ID NO: 6701363 - DNA, 17 bp, Homo sapiens
cagcaggctcctcagcc

SEQ ID NO: 6701364 - DNA, 21 bp, Homo sapiens
cagcaggctcctcagccctct

SEQ ID NO: 6701365 - DNA, 13 bp, Homo sapiens
cagcaggctcctg

SEQ ID NO: 6701366 - DNA, 17 bp, Homo sapiens
cagcaggctctcaggcc

SEQ ID NO: 6701367 - DNA, 20 bp, Homo sapiens
cagcaggctctcaggccagc

SEQ ID NO: 6701368 - DNA, 13 bp, Homo sapiens
cagcaggctgcca

SEQ ID NO: 6701369 - DNA, 18 bp, Homo sapiens
cagcaggctgccagtgcc

SEQ ID NO: 6701370 - DNA, 23 bp, Homo sapiens
cagcagggaaaatgcagcaggga

SEQ ID NO: 6701371 - DNA, 24 bp, Homo sapiens
cagcagggaaaatgcagcagggat

SEQ ID NO: 6701372 - DNA, 15 bp, Homo sapiens
cagcagggaacaaaa

SEQ ID NO: 6701373 - DNA, 16 bp, Homo sapiens
cagcagggaagctctt

SEQ ID NO: 6701374 - DNA, 18 bp, Homo sapiens
cagcagggagggcttctg

SEQ ID NO: 6701375 - DNA, 20 bp, Homo sapiens
cagcagggagggcttctgcc

SEQ ID NO: 6701376 - DNA, 21 bp, Homo sapiens
cagcagggatgccctggaggt

SEQ ID NO: 6701377 - DNA, 22 bp, Homo sapiens
cagcagggatgccctggaggtg

SEQ ID NO: 6701378 - DNA, 17 bp, Homo sapiens
cagcagggccactcccg

SEQ ID NO: 6701379 - DNA, 14 bp, Homo sapiens
cagcagggcctcaa

SEQ ID NO: 6701380 - DNA, 15 bp, Homo sapiens
cagcagggcctcaaa

SEQ ID NO: 6701381 - DNA, 12 bp, Homo sapiens
cagcagggcctt

SEQ ID NO: 6701382 - DNA, 21 bp, Homo sapiens
cagcagggccttctgcctgct

SEQ ID NO: 6701383 - DNA, 22 bp, Homo sapiens
cagcagggccttctgcctgctg

SEQ ID NO: 6701384 - DNA, 19 bp, Homo sapiens
cagcagggcgggccaggag

SEQ ID NO: 6701385 - DNA, 18 bp, Homo sapiens
cagcagggctggtcacct

SEQ ID NO: 6701386 - DNA, 23 bp, Homo sapiens
cagcagggctggtcacctcccat

SEQ ID NO: 6701387 - DNA, 14 bp, Homo sapiens
cagcaggggcagaa

SEQ ID NO: 6701388 - DNA, 21 bp, Homo sapiens
cagcaggggccctcactcttg

SEQ ID NO: 6701389 - DNA, 14 bp, Homo sapiens
cagcaggggctgcc

SEQ ID NO: 6701390 - DNA, 14 bp, Homo sapiens
cagcaggggctgct

SEQ ID NO: 6701391 - DNA, 23 bp, Homo sapiens
cagcagggggagaaacccttcac

SEQ ID NO: 6701392 - DNA, 18 bp, Homo sapiens
cagcaggggggctgtgcc

SEQ ID NO: 6701393 - DNA, 19 bp, Homo sapiens
cagcaggggggttgggttc

SEQ ID NO: 6701394 - DNA, 13 bp, Homo sapiens
cagcaggggtggg

SEQ ID NO: 6701395 - DNA, 21 bp, Homo sapiens
cagcaggggtgggaggctccc

SEQ ID NO: 6701396 - DNA, 20 bp, Homo sapiens
cagcaggggttggggaaaca

SEQ ID NO: 6701397 - DNA, 22 bp, Homo sapiens
cagcagggtcttttcatctggg

SEQ ID NO: 6701398 - DNA, 21 bp, Homo sapiens
cagcagggttttgggttgacc

SEQ ID NO: 6701399 - DNA, 16 bp, Homo sapiens
cagcaggtagcctgct

SEQ ID NO: 6701400 - DNA, 19 bp, Homo sapiens
cagcaggtaggggcacagt

SEQ ID NO: 6701401 - DNA, 21 bp, Homo sapiens
cagcaggtccccagctttggc

SEQ ID NO: 6701402 - DNA, 14 bp, Homo sapiens
cagcaggtgcaaga

SEQ ID NO: 6701403 - DNA, 18 bp, Homo sapiens
cagcaggtgcaagagaca

SEQ ID NO: 6701404 - DNA, 23 bp, Homo sapiens
cagcaggtgcctggtgggccacg

SEQ ID NO: 6701405 - DNA, 14 bp, Homo sapiens
cagcaggtgctgct

SEQ ID NO: 6701406 - DNA, 15 bp, Homo sapiens
cagcaggtgctgcta

SEQ ID NO: 6701407 - DNA, 19 bp, Homo sapiens
cagcaggtgctgctaccct

SEQ ID NO: 6701408 - DNA, 21 bp, Homo sapiens
cagcaggtgctgggctggact

SEQ ID NO: 6701409 - DNA, 13 bp, Homo sapiens
cagcaggtgctgt

SEQ ID NO: 6701410 - DNA, 17 bp, Homo sapiens
cagcaggtgtggtggct

SEQ ID NO: 6701411 - DNA, 19 bp, Homo sapiens
cagcaggtgtggtggctca

SEQ ID NO: 6701412 - DNA, 20 bp, Homo sapiens
cagcaggtgtggtggctcat

SEQ ID NO: 6701413 - DNA, 22 bp, Homo sapiens
cagcaggtgtggtggctcatgg

SEQ ID NO: 6701414 - DNA, 19 bp, Homo sapiens
cagcaggttctctcctgtg

SEQ ID NO: 6701415 - DNA, 15 bp, Homo sapiens
cagcagtagacattt

SEQ ID NO: 6701416 - DNA, 23 bp, Homo sapiens
cagcagtcaattaactctccagt

SEQ ID NO: 6701417 - DNA, 14 bp, Homo sapiens
cagcagtcacaggc

SEQ ID NO: 6701418 - DNA, 19 bp, Homo sapiens
cagcagtcacaggcccagg

SEQ ID NO: 6701419 - DNA, 20 bp, Homo sapiens
cagcagtcacaggcccagga

SEQ ID NO: 6701420 - DNA, 14 bp, Homo sapiens
cagcagtcctgggc

SEQ ID NO: 6701421 - DNA, 19 bp, Homo sapiens
cagcagtcctttgtaaaca

SEQ ID NO: 6701422 - DNA, 18 bp, Homo sapiens
cagcagtcgcccaagcag

SEQ ID NO: 6701423 - DNA, 21 bp, Homo sapiens
cagcagtcgcccaagcagaca

SEQ ID NO: 6701424 - DNA, 19 bp, Homo sapiens
cagcagtcggttggagcga

SEQ ID NO: 6701425 - DNA, 17 bp, Homo sapiens
cagcagtctaaattttc

SEQ ID NO: 6701426 - DNA, 19 bp, Homo sapiens
cagcagtctccttcagcac

SEQ ID NO: 6701427 - DNA, 15 bp, Homo sapiens
cagcagtctctgcct

SEQ ID NO: 6701428 - DNA, 12 bp, Homo sapiens
cagcagtcttct

SEQ ID NO: 6701429 - DNA, 14 bp, Homo sapiens
cagcagtgaaaaca

SEQ ID NO: 6701430 - DNA, 15 bp, Homo sapiens
cagcagtgagactgg

SEQ ID NO: 6701431 - DNA, 16 bp, Homo sapiens
cagcagtgagagcaga

SEQ ID NO: 6701432 - DNA, 21 bp, Homo sapiens
cagcagtgatctcagggcaga

SEQ ID NO: 6701433 - DNA, 16 bp, Homo sapiens
cagcagtgcagccggg

SEQ ID NO: 6701434 - DNA, 11 bp, Homo sapiens
cagcagtgctg

SEQ ID NO: 6701435 - DNA, 16 bp, Homo sapiens
cagcagtgctgggccc

SEQ ID NO: 6701436 - DNA, 13 bp, Homo sapiens
cagcagtggcagg

SEQ ID NO: 6701437 - DNA, 12 bp, Homo sapiens
cagcagtggggt

SEQ ID NO: 6701438 - DNA, 16 bp, Homo sapiens
cagcagtgtcacagac

SEQ ID NO: 6701439 - DNA, 16 bp, Homo sapiens
cagcagtgtcatcaga

SEQ ID NO: 6701440 - DNA, 11 bp, Homo sapiens
cagcagtgtcc

SEQ ID NO: 6701441 - DNA, 18 bp, Homo sapiens
cagcagtgtccagagacc

SEQ ID NO: 6701442 - DNA, 12 bp, Homo sapiens
cagcagtgtccc

SEQ ID NO: 6701443 - DNA, 13 bp, Homo sapiens
cagcagtgtcccc

SEQ ID NO: 6701444 - DNA, 16 bp, Homo sapiens
cagcagtgtcccctgc

SEQ ID NO: 6701445 - DNA, 19 bp, Homo sapiens
cagcagtgtcccctgcccc

SEQ ID NO: 6701446 - DNA, 21 bp, Homo sapiens
cagcagtgtcccctgccccag

SEQ ID NO: 6701447 - DNA, 23 bp, Homo sapiens
cagcagtgtcccctgccccagag

SEQ ID NO: 6701448 - DNA, 21 bp, Homo sapiens
cagcagtgtgaatagcctggc

SEQ ID NO: 6701449 - DNA, 22 bp, Homo sapiens
cagcagtgtgagggtgcaggga

SEQ ID NO: 6701450 - DNA, 19 bp, Homo sapiens
cagcagtgttccccatctg

SEQ ID NO: 6701451 - DNA, 23 bp, Homo sapiens
cagcagtgttccccatctgggtc

SEQ ID NO: 6701452 - DNA, 18 bp, Homo sapiens
cagcagtgttctcacagt

SEQ ID NO: 6701453 - DNA, 14 bp, Homo sapiens
cagcagtgttgctc

SEQ ID NO: 6701454 - DNA, 16 bp, Homo sapiens
cagcagtgttgctcag

SEQ ID NO: 6701455 - DNA, 15 bp, Homo sapiens
cagcagtgtttaaaa

SEQ ID NO: 6701456 - DNA, 18 bp, Homo sapiens
cagcagttaggcacctta

SEQ ID NO: 6701457 - DNA, 13 bp, Homo sapiens
cagcagttcagag

SEQ ID NO: 6701458 - DNA, 19 bp, Homo sapiens
cagcagttcagagctgccc

SEQ ID NO: 6701459 - DNA, 18 bp, Homo sapiens
cagcagttgactcagagt

SEQ ID NO: 6701460 - DNA, 19 bp, Homo sapiens
cagcagttgattcttgtat

SEQ ID NO: 6701461 - DNA, 13 bp, Homo sapiens
cagcagttgctag

SEQ ID NO: 6701462 - DNA, 20 bp, Homo sapiens
cagcagttgctggtaaaatg

SEQ ID NO: 6701463 - DNA, 14 bp, Homo sapiens
cagcagtttcatga

SEQ ID NO: 6701464 - DNA, 15 bp, Homo sapiens
cagcagtttcccaga

SEQ ID NO: 6701465 - DNA, 13 bp, Homo sapiens
cagcagtttgtga

SEQ ID NO: 6701466 - DNA, 20 bp, Homo sapiens
cagcagtttgtgatctgtcc

SEQ ID NO: 6701467 - DNA, 11 bp, Homo sapiens
cagcagtttta

SEQ ID NO: 6701468 - DNA, 20 bp, Homo sapiens
cagcagttttcaagtcaaat

SEQ ID NO: 6701469 - DNA, 21 bp, Homo sapiens
cagcagttttcttttaatttt

SEQ ID NO: 6701470 - DNA, 14 bp, Homo sapiens
cagcataaaggcct

SEQ ID NO: 6701471 - DNA, 13 bp, Homo sapiens
cagcatacaaaaa

SEQ ID NO: 6701472 - DNA, 23 bp, Homo sapiens
cagcataccagttcttgcaataa

SEQ ID NO: 6701473 - DNA, 18 bp, Homo sapiens
cagcatactccgtgaggc

SEQ ID NO: 6701474 - DNA, 18 bp, Homo sapiens
cagcatagaacaggacct

SEQ ID NO: 6701475 - DNA, 17 bp, Homo sapiens
cagcatagaagtaactt

SEQ ID NO: 6701476 - DNA, 21 bp, Homo sapiens
cagcatagcctgcctgatccc

SEQ ID NO: 6701477 - DNA, 19 bp, Homo sapiens
cagcataggggggagggtc

SEQ ID NO: 6701478 - DNA, 16 bp, Homo sapiens
cagcatagttctgcaa

SEQ ID NO: 6701479 - DNA, 20 bp, Homo sapiens
cagcatatatagtatttaat

SEQ ID NO: 6701480 - DNA, 16 bp, Homo sapiens
cagcatatcgtttaat

SEQ ID NO: 6701481 - DNA, 20 bp, Homo sapiens
cagcatatgggggcctggat

SEQ ID NO: 6701482 - DNA, 17 bp, Homo sapiens
cagcatattcaggaagc

SEQ ID NO: 6701483 - DNA, 19 bp, Homo sapiens
cagcatattcaggaagctc

SEQ ID NO: 6701484 - DNA, 22 bp, Homo sapiens
cagcatattcaggaagctcagg

SEQ ID NO: 6701485 - DNA, 14 bp, Homo sapiens
cagcatatttatag

SEQ ID NO: 6701486 - DNA, 18 bp, Homo sapiens
cagcatatttatagcaat

SEQ ID NO: 6701487 - DNA, 19 bp, Homo sapiens
cagcatcaaacatgaaaac

SEQ ID NO: 6701488 - DNA, 22 bp, Homo sapiens
cagcatcaaacatgaaaacatt

SEQ ID NO: 6701489 - DNA, 15 bp, Homo sapiens
cagcatcacctgcct

SEQ ID NO: 6701490 - DNA, 13 bp, Homo sapiens
cagcatcactccc

SEQ ID NO: 6701491 - DNA, 23 bp, Homo sapiens
cagcatcagggttaagaagactt

SEQ ID NO: 6701492 - DNA, 15 bp, Homo sapiens
cagcatcatgtagtg

SEQ ID NO: 6701493 - DNA, 16 bp, Homo sapiens
cagcatcattaaagga

SEQ ID NO: 6701494 - DNA, 20 bp, Homo sapiens
cagcatcattttgcattcaa

SEQ ID NO: 6701495 - DNA, 21 bp, Homo sapiens
cagcatccaaaagcaggaacc

SEQ ID NO: 6701496 - DNA, 17 bp, Homo sapiens
cagcatccaccttggct

SEQ ID NO: 6701497 - DNA, 13 bp, Homo sapiens
cagcatccagcct

SEQ ID NO: 6701498 - DNA, 15 bp, Homo sapiens
cagcatccagcctgt

SEQ ID NO: 6701499 - DNA, 16 bp, Homo sapiens
cagcatccagcctgtg

SEQ ID NO: 6701500 - DNA, 17 bp, Homo sapiens
cagcatccagtgtgaga

SEQ ID NO: 6701501 - DNA, 18 bp, Homo sapiens
cagcatccagtgtgagat

SEQ ID NO: 6701502 - DNA, 13 bp, Homo sapiens
cagcatcccagcc

SEQ ID NO: 6701503 - DNA, 19 bp, Homo sapiens
cagcatcccagccagggtt

SEQ ID NO: 6701504 - DNA, 14 bp, Homo sapiens
cagcatcccagcct

SEQ ID NO: 6701505 - DNA, 16 bp, Homo sapiens
cagcatcccagcctca

SEQ ID NO: 6701506 - DNA, 19 bp, Homo sapiens
cagcatcccagcctcagaa

SEQ ID NO: 6701507 - DNA, 17 bp, Homo sapiens
cagcatcccagccttga

SEQ ID NO: 6701508 - DNA, 15 bp, Homo sapiens
cagcatccctggagc

SEQ ID NO: 6701509 - DNA, 16 bp, Homo sapiens
cagcatccctggagca

SEQ ID NO: 6701510 - DNA, 19 bp, Homo sapiens
cagcatccctggagcagga

SEQ ID NO: 6701511 - DNA, 23 bp, Homo sapiens
cagcatcccttgaccaggcctgg

SEQ ID NO: 6701512 - DNA, 12 bp, Homo sapiens
cagcatccgcag

SEQ ID NO: 6701513 - DNA, 13 bp, Homo sapiens
cagcatcctctct

SEQ ID NO: 6701514 - DNA, 14 bp, Homo sapiens
cagcatcctgcttc

SEQ ID NO: 6701515 - DNA, 14 bp, Homo sapiens
cagcatcctggcac

SEQ ID NO: 6701516 - DNA, 15 bp, Homo sapiens
cagcatcctggcacc

SEQ ID NO: 6701517 - DNA, 20 bp, Homo sapiens
cagcatcctggcacccggcc

SEQ ID NO: 6701518 - DNA, 21 bp, Homo sapiens
cagcatcctggcacccggccc

SEQ ID NO: 6701519 - DNA, 18 bp, Homo sapiens
cagcatcgcactctggca

SEQ ID NO: 6701520 - DNA, 21 bp, Homo sapiens
cagcatcggacaagaccccca

SEQ ID NO: 6701521 - DNA, 15 bp, Homo sapiens
cagcatcgggagcac

SEQ ID NO: 6701522 - DNA, 19 bp, Homo sapiens
cagcatcgggagcacccag

SEQ ID NO: 6701523 - DNA, 20 bp, Homo sapiens
cagcatcgggagcacccaga

SEQ ID NO: 6701524 - DNA, 22 bp, Homo sapiens
cagcatcgggagcacccagagc

SEQ ID NO: 6701525 - DNA, 23 bp, Homo sapiens
cagcatcgggagcacccagagca

SEQ ID NO: 6701526 - DNA, 24 bp, Homo sapiens
cagcatcgggagcacccagagcac

SEQ ID NO: 6701527 - DNA, 14 bp, Homo sapiens
cagcatcgggggcc

SEQ ID NO: 6701528 - DNA, 21 bp, Homo sapiens
cagcatcgtgatcactgagcc

SEQ ID NO: 6701529 - DNA, 22 bp, Homo sapiens
cagcatcgtgatcactgagcca

SEQ ID NO: 6701530 - DNA, 15 bp, Homo sapiens
cagcatctcagagtc

SEQ ID NO: 6701531 - DNA, 16 bp, Homo sapiens
cagcatctcagcgcca

SEQ ID NO: 6701532 - DNA, 17 bp, Homo sapiens
cagcatctcagcgccag

SEQ ID NO: 6701533 - DNA, 21 bp, Homo sapiens
cagcatctccaagcagcttag

SEQ ID NO: 6701534 - DNA, 22 bp, Homo sapiens
cagcatctccaagcagcttaga

SEQ ID NO: 6701535 - DNA, 15 bp, Homo sapiens
cagcatctcccagca

SEQ ID NO: 6701536 - DNA, 23 bp, Homo sapiens
cagcatctccctcactgaaacca

SEQ ID NO: 6701537 - DNA, 17 bp, Homo sapiens
cagcatctctaccttct

SEQ ID NO: 6701538 - DNA, 21 bp, Homo sapiens
cagcatctctaccttctcccc

SEQ ID NO: 6701539 - DNA, 20 bp, Homo sapiens
cagcatctgaccatctgtga

SEQ ID NO: 6701540 - DNA, 13 bp, Homo sapiens
cagcatctgggcc

SEQ ID NO: 6701541 - DNA, 15 bp, Homo sapiens
cagcatctggtcttg

SEQ ID NO: 6701542 - DNA, 15 bp, Homo sapiens
cagcatctttgccct

SEQ ID NO: 6701543 - DNA, 17 bp, Homo sapiens
cagcatctttgcccttc

SEQ ID NO: 6701544 - DNA, 23 bp, Homo sapiens
cagcatcttttccatcctgaggt

SEQ ID NO: 6701545 - DNA, 16 bp, Homo sapiens
cagcatgaaaatgtgt

SEQ ID NO: 6701546 - DNA, 13 bp, Homo sapiens
cagcatgaataaa

SEQ ID NO: 6701547 - DNA, 18 bp, Homo sapiens
cagcatgaattccaactc

SEQ ID NO: 6701548 - DNA, 18 bp, Homo sapiens
cagcatgaatttgtaatg

SEQ ID NO: 6701549 - DNA, 20 bp, Homo sapiens
cagcatgacaaaaattattt

SEQ ID NO: 6701550 - DNA, 21 bp, Homo sapiens
cagcatgacataacagtgcag

SEQ ID NO: 6701551 - DNA, 23 bp, Homo sapiens
cagcatgacctgtgaccagcact

SEQ ID NO: 6701552 - DNA, 15 bp, Homo sapiens
cagcatgactatgta

SEQ ID NO: 6701553 - DNA, 16 bp, Homo sapiens
cagcatgactttcctt

SEQ ID NO: 6701554 - DNA, 16 bp, Homo sapiens
cagcatgagactttct

SEQ ID NO: 6701555 - DNA, 15 bp, Homo sapiens
cagcatgagattgta

SEQ ID NO: 6701556 - DNA, 17 bp, Homo sapiens
cagcatgaggaactagc

SEQ ID NO: 6701557 - DNA, 14 bp, Homo sapiens
cagcatgcatttag

SEQ ID NO: 6701558 - DNA, 20 bp, Homo sapiens
cagcatgcccagattcccag

SEQ ID NO: 6701559 - DNA, 21 bp, Homo sapiens
cagcatgcccagattcccaga

SEQ ID NO: 6701560 - DNA, 15 bp, Homo sapiens
cagcatgccccttgg

SEQ ID NO: 6701561 - DNA, 17 bp, Homo sapiens
cagcatgccccttggct

SEQ ID NO: 6701562 - DNA, 23 bp, Homo sapiens
cagcatgccccttggctggatca

SEQ ID NO: 6701563 - DNA, 18 bp, Homo sapiens
cagcatgcgatgtcatat

SEQ ID NO: 6701564 - DNA, 16 bp, Homo sapiens
cagcatgcttcccaga

SEQ ID NO: 6701565 - DNA, 18 bp, Homo sapiens
cagcatgcttcccagagg

SEQ ID NO: 6701566 - DNA, 15 bp, Homo sapiens
cagcatgcttgggct

SEQ ID NO: 6701567 - DNA, 15 bp, Homo sapiens
cagcatggaaaaatg

SEQ ID NO: 6701568 - DNA, 16 bp, Homo sapiens
cagcatggaaaaatgg

SEQ ID NO: 6701569 - DNA, 13 bp, Homo sapiens
cagcatggaggag

SEQ ID NO: 6701570 - DNA, 22 bp, Homo sapiens
cagcatggcactccctccagca

SEQ ID NO: 6701571 - DNA, 20 bp, Homo sapiens
cagcatgggcccaggaatgc

SEQ ID NO: 6701572 - DNA, 16 bp, Homo sapiens
cagcatggggttttta

SEQ ID NO: 6701573 - DNA, 17 bp, Homo sapiens
cagcatggtccctgcct

SEQ ID NO: 6701574 - DNA, 18 bp, Homo sapiens
cagcatggtccctgcctt

SEQ ID NO: 6701575 - DNA, 11 bp, Homo sapiens
cagcatggttt

SEQ ID NO: 6701576 - DNA, 17 bp, Homo sapiens
cagcatggtttgcatga

SEQ ID NO: 6701577 - DNA, 21 bp, Homo sapiens
cagcatgtagggcttctgtgg

SEQ ID NO: 6701578 - DNA, 13 bp, Homo sapiens
cagcatgtgccaa

SEQ ID NO: 6701579 - DNA, 14 bp, Homo sapiens
cagcatgtgccctc

SEQ ID NO: 6701580 - DNA, 16 bp, Homo sapiens
cagcatgtggggaagc

SEQ ID NO: 6701581 - DNA, 18 bp, Homo sapiens
cagcatgtggggaagcaa

SEQ ID NO: 6701582 - DNA, 22 bp, Homo sapiens
cagcatgtgggtgtcagtgtca

SEQ ID NO: 6701583 - DNA, 22 bp, Homo sapiens
cagcatgtgtatttccagtgca

SEQ ID NO: 6701584 - DNA, 16 bp, Homo sapiens
cagcatgtgtgtgtct

SEQ ID NO: 6701585 - DNA, 17 bp, Homo sapiens
cagcatgttttctgctt

SEQ ID NO: 6701586 - DNA, 20 bp, Homo sapiens
cagcattaaaattttacctc

SEQ ID NO: 6701587 - DNA, 18 bp, Homo sapiens
cagcattacctctttgga

SEQ ID NO: 6701588 - DNA, 21 bp, Homo sapiens
cagcattagagaaatgaatta

SEQ ID NO: 6701589 - DNA, 15 bp, Homo sapiens
cagcattaggctttt

SEQ ID NO: 6701590 - DNA, 16 bp, Homo sapiens
cagcattagtgggaaa

SEQ ID NO: 6701591 - DNA, 12 bp, Homo sapiens
cagcattcaaaa

SEQ ID NO: 6701592 - DNA, 20 bp, Homo sapiens
cagcattcagcacaccccaa

SEQ ID NO: 6701593 - DNA, 13 bp, Homo sapiens
cagcattcatgcc

SEQ ID NO: 6701594 - DNA, 24 bp, Homo sapiens
cagcattcatttgttttttcaatg

SEQ ID NO: 6701595 - DNA, 17 bp, Homo sapiens
cagcattccagacttca

SEQ ID NO: 6701596 - DNA, 18 bp, Homo sapiens
cagcattccagacttcaa

SEQ ID NO: 6701597 - DNA, 19 bp, Homo sapiens
cagcattccagacttcaaa

SEQ ID NO: 6701598 - DNA, 20 bp, Homo sapiens
cagcattccagcccctctgg

SEQ ID NO: 6701599 - DNA, 16 bp, Homo sapiens
cagcattccagctctg

SEQ ID NO: 6701600 - DNA, 17 bp, Homo sapiens
cagcattccagctctgc

SEQ ID NO: 6701601 - DNA, 22 bp, Homo sapiens
cagcattcccaattatcaaaaa

SEQ ID NO: 6701602 - DNA, 18 bp, Homo sapiens
cagcattcccaggtaggc

SEQ ID NO: 6701603 - DNA, 14 bp, Homo sapiens
cagcattccctccc

SEQ ID NO: 6701604 - DNA, 14 bp, Homo sapiens
cagcattcctccat

SEQ ID NO: 6701605 - DNA, 20 bp, Homo sapiens
cagcattctcaggcaccagt

SEQ ID NO: 6701606 - DNA, 14 bp, Homo sapiens
cagcattctggagg

SEQ ID NO: 6701607 - DNA, 20 bp, Homo sapiens
cagcattgatatttgtgcat

SEQ ID NO: 6701608 - DNA, 18 bp, Homo sapiens
cagcattgatctcctgga

SEQ ID NO: 6701609 - DNA, 19 bp, Homo sapiens
cagcattgctactgctcag

SEQ ID NO: 6701610 - DNA, 21 bp, Homo sapiens
cagcattgctactgctcagct

SEQ ID NO: 6701611 - DNA, 19 bp, Homo sapiens
cagcattgctggactctga

SEQ ID NO: 6701612 - DNA, 14 bp, Homo sapiens
cagcattgctggtt

SEQ ID NO: 6701613 - DNA, 12 bp, Homo sapiens
cagcattgcttt

SEQ ID NO: 6701614 - DNA, 13 bp, Homo sapiens
cagcattgtcttt

SEQ ID NO: 6701615 - DNA, 14 bp, Homo sapiens
cagcattgtctttg

SEQ ID NO: 6701616 - DNA, 18 bp, Homo sapiens
cagcattgtgacttggag

SEQ ID NO: 6701617 - DNA, 17 bp, Homo sapiens
cagcattgtttcaaaat

SEQ ID NO: 6701618 - DNA, 16 bp, Homo sapiens
cagcatttacttgaag

SEQ ID NO: 6701619 - DNA, 15 bp, Homo sapiens
cagcatttcccttcc

SEQ ID NO: 6701620 - DNA, 14 bp, Homo sapiens
cagcatttcctcag

SEQ ID NO: 6701621 - DNA, 16 bp, Homo sapiens
cagcatttccttccag

SEQ ID NO: 6701622 - DNA, 18 bp, Homo sapiens
cagcatttccttgtcccg

SEQ ID NO: 6701623 - DNA, 21 bp, Homo sapiens
cagcatttcggtgcttccctt

SEQ ID NO: 6701624 - DNA, 15 bp, Homo sapiens
cagcatttctgaagt

SEQ ID NO: 6701625 - DNA, 12 bp, Homo sapiens
cagcatttgaat

SEQ ID NO: 6701626 - DNA, 11 bp, Homo sapiens
cagcatttgat

SEQ ID NO: 6701627 - DNA, 22 bp, Homo sapiens
cagcatttgataatgataaaac

SEQ ID NO: 6701628 - DNA, 14 bp, Homo sapiens
cagcatttgatttc

SEQ ID NO: 6701629 - DNA, 23 bp, Homo sapiens
cagcatttggttttacacaggaa

SEQ ID NO: 6701630 - DNA, 13 bp, Homo sapiens
cagcatttgtcct

SEQ ID NO: 6701631 - DNA, 21 bp, Homo sapiens
cagcatttgtccttttgtgaa

SEQ ID NO: 6701632 - DNA, 16 bp, Homo sapiens
cagcatttgtgtgtta

SEQ ID NO: 6701633 - DNA, 21 bp, Homo sapiens
cagcattttaaggttctcaga

SEQ ID NO: 6701634 - DNA, 22 bp, Homo sapiens
cagcattttcatatccaagatc

SEQ ID NO: 6701635 - DNA, 19 bp, Homo sapiens
cagcattttgagaggctga

SEQ ID NO: 6701636 - DNA, 16 bp, Homo sapiens
cagccaaacagtatga

SEQ ID NO: 6701637 - DNA, 16 bp, Homo sapiens
cagccaaacccatgag

SEQ ID NO: 6701638 - DNA, 21 bp, Homo sapiens
cagccaaactgtagatgaaga

SEQ ID NO: 6701639 - DNA, 15 bp, Homo sapiens
cagccaaagaaactc

SEQ ID NO: 6701640 - DNA, 16 bp, Homo sapiens
cagccaaagaaactca

SEQ ID NO: 6701641 - DNA, 20 bp, Homo sapiens
cagccaaagaaactcagaag

SEQ ID NO: 6701642 - DNA, 18 bp, Homo sapiens
cagccaaagaaatgggcc

SEQ ID NO: 6701643 - DNA, 21 bp, Homo sapiens
cagccaaagaaatgggcctgc

SEQ ID NO: 6701644 - DNA, 22 bp, Homo sapiens
cagccaaagaaatgggcctgcc

SEQ ID NO: 6701645 - DNA, 23 bp, Homo sapiens
cagccaaagaaatgggcctgcct

SEQ ID NO: 6701646 - DNA, 24 bp, Homo sapiens
cagccaaagaaatgggcctgcctg

SEQ ID NO: 6701647 - DNA, 17 bp, Homo sapiens
cagccaaagataatctc

SEQ ID NO: 6701648 - DNA, 21 bp, Homo sapiens
cagccaaagcctcctccagcc

SEQ ID NO: 6701649 - DNA, 15 bp, Homo sapiens
cagccaaaggctggc

SEQ ID NO: 6701650 - DNA, 17 bp, Homo sapiens
cagccaaatgcagggag

SEQ ID NO: 6701651 - DNA, 18 bp, Homo sapiens
cagccaaatgcagggagg

SEQ ID NO: 6701652 - DNA, 15 bp, Homo sapiens
cagccaaattgcaga

SEQ ID NO: 6701653 - DNA, 18 bp, Homo sapiens
cagccaacaaacatagaa

SEQ ID NO: 6701654 - DNA, 19 bp, Homo sapiens
cagccaacagctacaacag

SEQ ID NO: 6701655 - DNA, 19 bp, Homo sapiens
cagccaacaggtggcagga

SEQ ID NO: 6701656 - DNA, 17 bp, Homo sapiens
cagccaacgagacacat

SEQ ID NO: 6701657 - DNA, 18 bp, Homo sapiens
cagccaactagcccctgg

SEQ ID NO: 6701658 - DNA, 16 bp, Homo sapiens
cagccaactgccccgg

SEQ ID NO: 6701659 - DNA, 17 bp, Homo sapiens
cagccaagacaaggagg

SEQ ID NO: 6701660 - DNA, 16 bp, Homo sapiens
cagccaagaccatctc

SEQ ID NO: 6701661 - DNA, 14 bp, Homo sapiens
cagccaagagctct

SEQ ID NO: 6701662 - DNA, 17 bp, Homo sapiens
cagccaagagctcttca

SEQ ID NO: 6701663 - DNA, 22 bp, Homo sapiens
cagccaagagctcttcatctgc

SEQ ID NO: 6701664 - DNA, 21 bp, Homo sapiens
cagccaagcaaatgcctgcca

SEQ ID NO: 6701665 - DNA, 16 bp, Homo sapiens
cagccaagcacctcca

SEQ ID NO: 6701666 - DNA, 17 bp, Homo sapiens
cagccaagcccaccctg

SEQ ID NO: 6701667 - DNA, 15 bp, Homo sapiens
cagccaagcctgact

SEQ ID NO: 6701668 - DNA, 11 bp, Homo sapiens
cagccaagctt

SEQ ID NO: 6701669 - DNA, 19 bp, Homo sapiens
cagccaaggaatgtgtcca

SEQ ID NO: 6701670 - DNA, 17 bp, Homo sapiens
cagccaaggccgagacc

SEQ ID NO: 6701671 - DNA, 16 bp, Homo sapiens
cagccaaggctcccgt

SEQ ID NO: 6701672 - DNA, 14 bp, Homo sapiens
cagccaaggggctg

SEQ ID NO: 6701673 - DNA, 15 bp, Homo sapiens
cagccaaggggctgc

SEQ ID NO: 6701674 - DNA, 23 bp, Homo sapiens
cagccaaggtgctaaaaggaata

SEQ ID NO: 6701675 - DNA, 13 bp, Homo sapiens
cagccaagtgcag

SEQ ID NO: 6701676 - DNA, 13 bp, Homo sapiens
cagccaagtgcct

SEQ ID NO: 6701677 - DNA, 16 bp, Homo sapiens
cagccaagtgccttcc

SEQ ID NO: 6701678 - DNA, 15 bp, Homo sapiens
cagccaatctccagg

SEQ ID NO: 6701679 - DNA, 13 bp, Homo sapiens
cagccaatctgga

SEQ ID NO: 6701680 - DNA, 15 bp, Homo sapiens
cagccaatttcaaag

SEQ ID NO: 6701681 - DNA, 16 bp, Homo sapiens
cagccaatttcaaaga

SEQ ID NO: 6701682 - DNA, 16 bp, Homo sapiens
cagccaatttcccgga

SEQ ID NO: 6701683 - DNA, 14 bp, Homo sapiens
cagccacaaagccc

SEQ ID NO: 6701684 - DNA, 17 bp, Homo sapiens
cagccacaaagcccccc

SEQ ID NO: 6701685 - DNA, 13 bp, Homo sapiens
cagccacacacac

SEQ ID NO: 6701686 - DNA, 17 bp, Homo sapiens
cagccacacacacagaa

SEQ ID NO: 6701687 - DNA, 12 bp, Homo sapiens
cagccacacaga

SEQ ID NO: 6701688 - DNA, 13 bp, Homo sapiens
cagccacacagag

SEQ ID NO: 6701689 - DNA, 14 bp, Homo sapiens
cagccacacagagc

SEQ ID NO: 6701690 - DNA, 12 bp, Homo sapiens
cagccacacagt

SEQ ID NO: 6701691 - DNA, 13 bp, Homo sapiens
cagccacaccact

SEQ ID NO: 6701692 - DNA, 19 bp, Homo sapiens
cagccacacccaggcactt

SEQ ID NO: 6701693 - DNA, 20 bp, Homo sapiens
cagccacaccgctggctccg

SEQ ID NO: 6701694 - DNA, 18 bp, Homo sapiens
cagccacacctggactga

SEQ ID NO: 6701695 - DNA, 23 bp, Homo sapiens
cagccacacctggactgaccctg

SEQ ID NO: 6701696 - DNA, 13 bp, Homo sapiens
cagccacacctgt

SEQ ID NO: 6701697 - DNA, 17 bp, Homo sapiens
cagccacactgggcctg

SEQ ID NO: 6701698 - DNA, 19 bp, Homo sapiens
cagccacactgggcctgga

SEQ ID NO: 6701699 - DNA, 12 bp, Homo sapiens
cagccacactgt

SEQ ID NO: 6701700 - DNA, 14 bp, Homo sapiens
cagccacacttctc

SEQ ID NO: 6701701 - DNA, 18 bp, Homo sapiens
cagccacacttctcagga

SEQ ID NO: 6701702 - DNA, 14 bp, Homo sapiens
cagccacacttgaa

SEQ ID NO: 6701703 - DNA, 13 bp, Homo sapiens
cagccacagaccc

SEQ ID NO: 6701704 - DNA, 22 bp, Homo sapiens
cagccacagacccctgggagct

SEQ ID NO: 6701705 - DNA, 18 bp, Homo sapiens
cagccacaggaccacctc

SEQ ID NO: 6701706 - DNA, 19 bp, Homo sapiens
cagccacaggaccacctcc

SEQ ID NO: 6701707 - DNA, 13 bp, Homo sapiens
cagccacaggact

SEQ ID NO: 6701708 - DNA, 18 bp, Homo sapiens
cagccacaggactgagcc

SEQ ID NO: 6701709 - DNA, 19 bp, Homo sapiens
cagccacaggactgagccc

SEQ ID NO: 6701710 - DNA, 20 bp, Homo sapiens
cagccacaggactgagccct

SEQ ID NO: 6701711 - DNA, 13 bp, Homo sapiens
cagccacaggcca

SEQ ID NO: 6701712 - DNA, 12 bp, Homo sapiens
cagccacatccc

SEQ ID NO: 6701713 - DNA, 18 bp, Homo sapiens
cagccacatccccaagcc

SEQ ID NO: 6701714 - DNA, 15 bp, Homo sapiens
cagccacatgcccca

SEQ ID NO: 6701715 - DNA, 16 bp, Homo sapiens
cagccacatgccccag

SEQ ID NO: 6701716 - DNA, 18 bp, Homo sapiens
cagccacatgccccaggc

SEQ ID NO: 6701717 - DNA, 14 bp, Homo sapiens
cagccacatggccc

SEQ ID NO: 6701718 - DNA, 23 bp, Homo sapiens
cagccacattgagactttcttct

SEQ ID NO: 6701719 - DNA, 19 bp, Homo sapiens
cagccaccaaggctgcctg

SEQ ID NO: 6701720 - DNA, 20 bp, Homo sapiens
cagccaccaaggctgcctgc

SEQ ID NO: 6701721 - DNA, 15 bp, Homo sapiens
cagccaccacatccc

SEQ ID NO: 6701722 - DNA, 16 bp, Homo sapiens
cagccaccaccctcag

SEQ ID NO: 6701723 - DNA, 13 bp, Homo sapiens
cagccaccacctg

SEQ ID NO: 6701724 - DNA, 21 bp, Homo sapiens
cagccaccagtggacctagcc

SEQ ID NO: 6701725 - DNA, 19 bp, Homo sapiens
cagccacccaagcctgctg

SEQ ID NO: 6701726 - DNA, 20 bp, Homo sapiens
cagccacccaagcctgctgg

SEQ ID NO: 6701727 - DNA, 22 bp, Homo sapiens
cagccacccaagcctgctggct

SEQ ID NO: 6701728 - DNA, 19 bp, Homo sapiens
cagccacccagccaggagg

SEQ ID NO: 6701729 - DNA, 15 bp, Homo sapiens
cagccaccccctccc

SEQ ID NO: 6701730 - DNA, 11 bp, Homo sapiens
cagccaccccg

SEQ ID NO: 6701731 - DNA, 21 bp, Homo sapiens
cagccaccccgggctctctgc

SEQ ID NO: 6701732 - DNA, 22 bp, Homo sapiens
cagccaccccgggctctctgct

SEQ ID NO: 6701733 - DNA, 16 bp, Homo sapiens
cagccacccctcctct

SEQ ID NO: 6701734 - DNA, 22 bp, Homo sapiens
cagccacccctcctctagctct

SEQ ID NO: 6701735 - DNA, 14 bp, Homo sapiens
cagccacccctgcc

SEQ ID NO: 6701736 - DNA, 18 bp, Homo sapiens
cagccacccggatctcca

SEQ ID NO: 6701737 - DNA, 20 bp, Homo sapiens
cagccacccggatctccagg

SEQ ID NO: 6701738 - DNA, 21 bp, Homo sapiens
cagccacccggatctccaggc

SEQ ID NO: 6701739 - DNA, 20 bp, Homo sapiens
cagccaccctgaggagtctg

SEQ ID NO: 6701740 - DNA, 17 bp, Homo sapiens
cagccaccctgccatgg

SEQ ID NO: 6701741 - DNA, 18 bp, Homo sapiens
cagccacccttggtctca

SEQ ID NO: 6701742 - DNA, 15 bp, Homo sapiens
cagccaccctttctg

SEQ ID NO: 6701743 - DNA, 18 bp, Homo sapiens
cagccaccctttctggca

SEQ ID NO: 6701744 - DNA, 19 bp, Homo sapiens
cagccaccctttctggcac

SEQ ID NO: 6701745 - DNA, 15 bp, Homo sapiens
cagccacctcatccc

SEQ ID NO: 6701746 - DNA, 15 bp, Homo sapiens
cagccacctcccaag

SEQ ID NO: 6701747 - DNA, 17 bp, Homo sapiens
cagccacctcccaagga

SEQ ID NO: 6701748 - DNA, 14 bp, Homo sapiens
cagccacctccgcc

SEQ ID NO: 6701749 - DNA, 15 bp, Homo sapiens
cagccacctctcttt

SEQ ID NO: 6701750 - DNA, 22 bp, Homo sapiens
cagccacctcttgggcatgctc

SEQ ID NO: 6701751 - DNA, 12 bp, Homo sapiens
cagccaccttcc

SEQ ID NO: 6701752 - DNA, 22 bp, Homo sapiens
cagccacgaacacgcatgcctc

SEQ ID NO: 6701753 - DNA, 14 bp, Homo sapiens
cagccacgaccagc

SEQ ID NO: 6701754 - DNA, 16 bp, Homo sapiens
cagccacgaccagccc

SEQ ID NO: 6701755 - DNA, 21 bp, Homo sapiens
cagccacgaccagccccttcc

SEQ ID NO: 6701756 - DNA, 21 bp, Homo sapiens
cagccacgaggtggtagctct

SEQ ID NO: 6701757 - DNA, 22 bp, Homo sapiens
cagccacgcagggccatccact

SEQ ID NO: 6701758 - DNA, 13 bp, Homo sapiens
cagccacgcctct

SEQ ID NO: 6701759 - DNA, 20 bp, Homo sapiens
cagccacggagggaggcacc

SEQ ID NO: 6701760 - DNA, 14 bp, Homo sapiens
cagccacggccagg

SEQ ID NO: 6701761 - DNA, 19 bp, Homo sapiens
cagccacggccaggccaga

SEQ ID NO: 6701762 - DNA, 22 bp, Homo sapiens
cagccacggccaggccagaggg

SEQ ID NO: 6701763 - DNA, 19 bp, Homo sapiens
cagccactaagaacccctc

SEQ ID NO: 6701764 - DNA, 13 bp, Homo sapiens
cagccactcaaag

SEQ ID NO: 6701765 - DNA, 18 bp, Homo sapiens
cagccactccaagccccc

SEQ ID NO: 6701766 - DNA, 20 bp, Homo sapiens
cagccactccaagccccctg

SEQ ID NO: 6701767 - DNA, 16 bp, Homo sapiens
cagccactccccagcc

SEQ ID NO: 6701768 - DNA, 21 bp, Homo sapiens
cagccactcccctccactctc

SEQ ID NO: 6701769 - DNA, 14 bp, Homo sapiens
cagccactcgggag

SEQ ID NO: 6701770 - DNA, 10 bp, Homo sapiens
cagccactct

SEQ ID NO: 6701771 - DNA, 21 bp, Homo sapiens
cagccactgattctctcttgt

SEQ ID NO: 6701772 - DNA, 10 bp, Homo sapiens
cagccactgc

SEQ ID NO: 6701773 - DNA, 14 bp, Homo sapiens
cagccactgcacag

SEQ ID NO: 6701774 - DNA, 13 bp, Homo sapiens
cagccactgcagc

SEQ ID NO: 6701775 - DNA, 14 bp, Homo sapiens
cagccactgcagca

SEQ ID NO: 6701776 - DNA, 16 bp, Homo sapiens
cagccactgcagcaca

SEQ ID NO: 6701777 - DNA, 12 bp, Homo sapiens
cagccactgcca

SEQ ID NO: 6701778 - DNA, 15 bp, Homo sapiens
cagccactgccaagc

SEQ ID NO: 6701779 - DNA, 20 bp, Homo sapiens
cagccactgccaagcttcct

SEQ ID NO: 6701780 - DNA, 15 bp, Homo sapiens
cagccactgcttagc

SEQ ID NO: 6701781 - DNA, 14 bp, Homo sapiens
cagccactgtcaca

SEQ ID NO: 6701782 - DNA, 16 bp, Homo sapiens
cagccactgtcacagg

SEQ ID NO: 6701783 - DNA, 15 bp, Homo sapiens
cagccactgtcaccg

SEQ ID NO: 6701784 - DNA, 18 bp, Homo sapiens
cagccacttccccctctt

SEQ ID NO: 6701785 - DNA, 21 bp, Homo sapiens
cagccacttcggccaggtcac

SEQ ID NO: 6701786 - DNA, 22 bp, Homo sapiens
cagccacttcggccaggtcaca

SEQ ID NO: 6701787 - DNA, 22 bp, Homo sapiens
cagccacttttagctactgcta

SEQ ID NO: 6701788 - DNA, 15 bp, Homo sapiens
cagccagaaactgaa

SEQ ID NO: 6701789 - DNA, 20 bp, Homo sapiens
cagccagaaactgaactggc

SEQ ID NO: 6701790 - DNA, 23 bp, Homo sapiens
cagccagaaactgaactggccgc

SEQ ID NO: 6701791 - DNA, 23 bp, Homo sapiens
cagccagaaagcactacaatcat

SEQ ID NO: 6701792 - DNA, 22 bp, Homo sapiens
cagccagaaccccgagccctac

SEQ ID NO: 6701793 - DNA, 17 bp, Homo sapiens
cagccagaacgtggctc

SEQ ID NO: 6701794 - DNA, 20 bp, Homo sapiens
cagccagaacgtggctctgc

SEQ ID NO: 6701795 - DNA, 21 bp, Homo sapiens
cagccagaacgtggctctgct

SEQ ID NO: 6701796 - DNA, 18 bp, Homo sapiens
cagccagaactctgtgtc

SEQ ID NO: 6701797 - DNA, 17 bp, Homo sapiens
cagccagaagcccatgg

SEQ ID NO: 6701798 - DNA, 12 bp, Homo sapiens
cagccagaagtt

SEQ ID NO: 6701799 - DNA, 20 bp, Homo sapiens
cagccagacctattcctcct

SEQ ID NO: 6701800 - DNA, 13 bp, Homo sapiens
cagccagagctgg

SEQ ID NO: 6701801 - DNA, 17 bp, Homo sapiens
cagccagagctgggtgg

SEQ ID NO: 6701802 - DNA, 14 bp, Homo sapiens
cagccagagctgtg

SEQ ID NO: 6701803 - DNA, 15 bp, Homo sapiens
cagccagagctgtgc

SEQ ID NO: 6701804 - DNA, 17 bp, Homo sapiens
cagccagagctgtgcct

SEQ ID NO: 6701805 - DNA, 12 bp, Homo sapiens
cagccagaggaa

SEQ ID NO: 6701806 - DNA, 13 bp, Homo sapiens
cagccagaggaac

SEQ ID NO: 6701807 - DNA, 23 bp, Homo sapiens
cagccagaggaaccagcactcca

SEQ ID NO: 6701808 - DNA, 20 bp, Homo sapiens
cagccagaggaggccggtga

SEQ ID NO: 6701809 - DNA, 13 bp, Homo sapiens
cagccagaggcac

SEQ ID NO: 6701810 - DNA, 19 bp, Homo sapiens
cagccagaggcatctgagg

SEQ ID NO: 6701811 - DNA, 11 bp, Homo sapiens
cagccagatcc

SEQ ID NO: 6701812 - DNA, 15 bp, Homo sapiens
cagccagatccccag

SEQ ID NO: 6701813 - DNA, 16 bp, Homo sapiens
cagccagatccccagg

SEQ ID NO: 6701814 - DNA, 20 bp, Homo sapiens
cagccagatccccagggcag

SEQ ID NO: 6701815 - DNA, 23 bp, Homo sapiens
cagccagatccccagggcagcct

SEQ ID NO: 6701816 - DNA, 22 bp, Homo sapiens
cagccagatggactccagcctg

SEQ ID NO: 6701817 - DNA, 14 bp, Homo sapiens
cagccagcaccacc

SEQ ID NO: 6701818 - DNA, 13 bp, Homo sapiens
cagccagcacctg

SEQ ID NO: 6701819 - DNA, 17 bp, Homo sapiens
cagccagcagcaggatg

SEQ ID NO: 6701820 - DNA, 15 bp, Homo sapiens
cagccagcagccagc

SEQ ID NO: 6701821 - DNA, 18 bp, Homo sapiens
cagccagcagccagctct

SEQ ID NO: 6701822 - DNA, 24 bp, Homo sapiens
cagccagcaggttctctcctgtga

SEQ ID NO: 6701823 - DNA, 13 bp, Homo sapiens
cagccagcatctg

SEQ ID NO: 6701824 - DNA, 17 bp, Homo sapiens
cagccagcatctgggcc

SEQ ID NO: 6701825 - DNA, 19 bp, Homo sapiens
cagccagccacccctgcca

SEQ ID NO: 6701826 - DNA, 21 bp, Homo sapiens
cagccagccacccctgccact

SEQ ID NO: 6701827 - DNA, 18 bp, Homo sapiens
cagccagccatcggaaga

SEQ ID NO: 6701828 - DNA, 10 bp, Homo sapiens
cagccagccc

SEQ ID NO: 6701829 - DNA, 11 bp, Homo sapiens
cagccagccca

SEQ ID NO: 6701830 - DNA, 16 bp, Homo sapiens
cagccagcccagccca

SEQ ID NO: 6701831 - DNA, 19 bp, Homo sapiens
cagccagcccagcccagct

SEQ ID NO: 6701832 - DNA, 15 bp, Homo sapiens
cagccagcccagctc

SEQ ID NO: 6701833 - DNA, 17 bp, Homo sapiens
cagccagcccagctcca

SEQ ID NO: 6701834 - DNA, 20 bp, Homo sapiens
cagccagcccatggccccca

SEQ ID NO: 6701835 - DNA, 17 bp, Homo sapiens
cagccagccctgcctgg

SEQ ID NO: 6701836 - DNA, 20 bp, Homo sapiens
cagccagccctgcctggagg

SEQ ID NO: 6701837 - DNA, 22 bp, Homo sapiens
cagccagccctgcctggaggac

SEQ ID NO: 6701838 - DNA, 17 bp, Homo sapiens
cagccagccctggaggc

SEQ ID NO: 6701839 - DNA, 20 bp, Homo sapiens
cagccagccctggaggctgg

SEQ ID NO: 6701840 - DNA, 14 bp, Homo sapiens
cagccagccctggc

SEQ ID NO: 6701841 - DNA, 17 bp, Homo sapiens
cagccagccctggccca

SEQ ID NO: 6701842 - DNA, 20 bp, Homo sapiens
cagccagccctggcccaccc

SEQ ID NO: 6701843 - DNA, 13 bp, Homo sapiens
cagccagcccttc

SEQ ID NO: 6701844 - DNA, 18 bp, Homo sapiens
cagccagcccttcccagg

SEQ ID NO: 6701845 - DNA, 22 bp, Homo sapiens
cagccagcccttcccaggccag

SEQ ID NO: 6701846 - DNA, 18 bp, Homo sapiens
cagccagccgccctgggc

SEQ ID NO: 6701847 - DNA, 18 bp, Homo sapiens
cagccagccggtgcctgg

SEQ ID NO: 6701848 - DNA, 19 bp, Homo sapiens
cagccagccggtgcctggc

SEQ ID NO: 6701849 - DNA, 20 bp, Homo sapiens
cagccagccggtgcctggcg

SEQ ID NO: 6701850 - DNA, 11 bp, Homo sapiens
cagccagcctc

SEQ ID NO: 6701851 - DNA, 12 bp, Homo sapiens
cagccagcctca

SEQ ID NO: 6701852 - DNA, 13 bp, Homo sapiens
cagccagcctcag

SEQ ID NO: 6701853 - DNA, 19 bp, Homo sapiens
cagccagcctcagaaggcc

SEQ ID NO: 6701854 - DNA, 14 bp, Homo sapiens
cagccagcctcgcc

SEQ ID NO: 6701855 - DNA, 13 bp, Homo sapiens
cagccagccttcc

SEQ ID NO: 6701856 - DNA, 21 bp, Homo sapiens
cagccagcgcctccctccacc

SEQ ID NO: 6701857 - DNA, 23 bp, Homo sapiens
cagccagcgtcggtctgtgcccc

SEQ ID NO: 6701858 - DNA, 15 bp, Homo sapiens
cagccagctcctgca

SEQ ID NO: 6701859 - DNA, 16 bp, Homo sapiens
cagccagctcctggta

SEQ ID NO: 6701860 - DNA, 15 bp, Homo sapiens
cagccagctcctttc

SEQ ID NO: 6701861 - DNA, 19 bp, Homo sapiens
cagccagctcctttccctt

SEQ ID NO: 6701862 - DNA, 15 bp, Homo sapiens
cagccagctctcagc

SEQ ID NO: 6701863 - DNA, 16 bp, Homo sapiens
cagccagctctcagcc

SEQ ID NO: 6701864 - DNA, 17 bp, Homo sapiens
cagccagctctcagcca

SEQ ID NO: 6701865 - DNA, 23 bp, Homo sapiens
cagccagctgcccacaagccata

SEQ ID NO: 6701866 - DNA, 13 bp, Homo sapiens
cagccagcttaaa

SEQ ID NO: 6701867 - DNA, 23 bp, Homo sapiens
cagccagcttggtggttatgtcc

SEQ ID NO: 6701868 - DNA, 11 bp, Homo sapiens
cagccaggaca

SEQ ID NO: 6701869 - DNA, 12 bp, Homo sapiens
cagccaggacac

SEQ ID NO: 6701870 - DNA, 22 bp, Homo sapiens
cagccaggaccataccgggtct

SEQ ID NO: 6701871 - DNA, 12 bp, Homo sapiens
cagccaggaccc

SEQ ID NO: 6701872 - DNA, 22 bp, Homo sapiens
cagccaggactccttagactga

SEQ ID NO: 6701873 - DNA, 15 bp, Homo sapiens
cagccaggagctggg

SEQ ID NO: 6701874 - DNA, 16 bp, Homo sapiens
cagccaggagctgggc

SEQ ID NO: 6701875 - DNA, 13 bp, Homo sapiens
cagccaggagggg

SEQ ID NO: 6701876 - DNA, 14 bp, Homo sapiens
cagccaggcaagaa

SEQ ID NO: 6701877 - DNA, 19 bp, Homo sapiens
cagccaggcaagaaagctt

SEQ ID NO: 6701878 - DNA, 11 bp, Homo sapiens
cagccaggcag

SEQ ID NO: 6701879 - DNA, 12 bp, Homo sapiens
cagccaggcaga

SEQ ID NO: 6701880 - DNA, 16 bp, Homo sapiens
cagccaggccaacagc

SEQ ID NO: 6701881 - DNA, 22 bp, Homo sapiens
cagccaggccacaagacccttg

SEQ ID NO: 6701882 - DNA, 18 bp, Homo sapiens
cagccaggccactggccc

SEQ ID NO: 6701883 - DNA, 11 bp, Homo sapiens
cagccaggccc

SEQ ID NO: 6701884 - DNA, 13 bp, Homo sapiens
cagccaggcccag

SEQ ID NO: 6701885 - DNA, 15 bp, Homo sapiens
cagccaggcccagcc

SEQ ID NO: 6701886 - DNA, 21 bp, Homo sapiens
cagccaggcccaggccagccc

SEQ ID NO: 6701887 - DNA, 17 bp, Homo sapiens
cagccaggccctgccag

SEQ ID NO: 6701888 - DNA, 11 bp, Homo sapiens
cagccaggcct

SEQ ID NO: 6701889 - DNA, 12 bp, Homo sapiens
cagccaggcctc

SEQ ID NO: 6701890 - DNA, 14 bp, Homo sapiens
cagccaggcctcgc

SEQ ID NO: 6701891 - DNA, 16 bp, Homo sapiens
cagccaggcctcgcct

SEQ ID NO: 6701892 - DNA, 23 bp, Homo sapiens
cagccaggcctcgcctgccctcc

SEQ ID NO: 6701893 - DNA, 20 bp, Homo sapiens
cagccaggcgggctcaagga

SEQ ID NO: 6701894 - DNA, 21 bp, Homo sapiens
cagccaggctatggttgccac

SEQ ID NO: 6701895 - DNA, 19 bp, Homo sapiens
cagccaggctcaggccatg

SEQ ID NO: 6701896 - DNA, 17 bp, Homo sapiens
cagccaggctctgtgct

SEQ ID NO: 6701897 - DNA, 12 bp, Homo sapiens
cagccaggctgc

SEQ ID NO: 6701898 - DNA, 22 bp, Homo sapiens
cagccaggctgccaaggccaga

SEQ ID NO: 6701899 - DNA, 16 bp, Homo sapiens
cagccaggctgggccg

SEQ ID NO: 6701900 - DNA, 13 bp, Homo sapiens
cagccagggaccc

SEQ ID NO: 6701901 - DNA, 15 bp, Homo sapiens
cagccagggaccccc

SEQ ID NO: 6701902 - DNA, 17 bp, Homo sapiens
cagccagggacccccag

SEQ ID NO: 6701903 - DNA, 19 bp, Homo sapiens
cagccagggacccccagaa

SEQ ID NO: 6701904 - DNA, 20 bp, Homo sapiens
cagccagggacccccagaac

SEQ ID NO: 6701905 - DNA, 18 bp, Homo sapiens
cagccagggagagcccag

SEQ ID NO: 6701906 - DNA, 23 bp, Homo sapiens
cagccagggagcccggggcagag

SEQ ID NO: 6701907 - DNA, 20 bp, Homo sapiens
cagccagggaggacaagcag

SEQ ID NO: 6701908 - DNA, 23 bp, Homo sapiens
cagccagggcctgcgagggcagc

SEQ ID NO: 6701909 - DNA, 16 bp, Homo sapiens
cagccagggctgctag

SEQ ID NO: 6701910 - DNA, 18 bp, Homo sapiens
cagccaggggctgctcat

SEQ ID NO: 6701911 - DNA, 23 bp, Homo sapiens
cagccaggtagttggaactttct

SEQ ID NO: 6701912 - DNA, 17 bp, Homo sapiens
cagccaggtctgactcc

SEQ ID NO: 6701913 - DNA, 18 bp, Homo sapiens
cagccaggtctgactcca

SEQ ID NO: 6701914 - DNA, 21 bp, Homo sapiens
cagccaggtctgactccaaag

SEQ ID NO: 6701915 - DNA, 18 bp, Homo sapiens
cagccaggtgctgtgaca

SEQ ID NO: 6701916 - DNA, 18 bp, Homo sapiens
cagccaggtttagcggca

SEQ ID NO: 6701917 - DNA, 16 bp, Homo sapiens
cagccagtctcagaga

SEQ ID NO: 6701918 - DNA, 18 bp, Homo sapiens
cagccagtctcagagacc

SEQ ID NO: 6701919 - DNA, 19 bp, Homo sapiens
cagccagtctcagagacca

SEQ ID NO: 6701920 - DNA, 20 bp, Homo sapiens
cagccagtctcagagaccag

SEQ ID NO: 6701921 - DNA, 16 bp, Homo sapiens
cagccagtcttgccta

SEQ ID NO: 6701922 - DNA, 20 bp, Homo sapiens
cagccagtcttgcctaggcc

SEQ ID NO: 6701923 - DNA, 21 bp, Homo sapiens
cagccagtcttgcctaggcca

SEQ ID NO: 6701924 - DNA, 23 bp, Homo sapiens
cagccagtcttgcctaggccaaa

SEQ ID NO: 6701925 - DNA, 19 bp, Homo sapiens
cagccagtgaatctgtttc

SEQ ID NO: 6701926 - DNA, 16 bp, Homo sapiens
cagccagtgacctgag

SEQ ID NO: 6701927 - DNA, 19 bp, Homo sapiens
cagccagtgacctgaggaa

SEQ ID NO: 6701928 - DNA, 22 bp, Homo sapiens
cagccagtgacctgaggaagcg

SEQ ID NO: 6701929 - DNA, 22 bp, Homo sapiens
cagccagtgacctttgacctcg

SEQ ID NO: 6701930 - DNA, 18 bp, Homo sapiens
cagccagtgagatgaggg

SEQ ID NO: 6701931 - DNA, 17 bp, Homo sapiens
cagccagtgccctgagc

SEQ ID NO: 6701932 - DNA, 21 bp, Homo sapiens
cagccagttggtggggccagg

SEQ ID NO: 6701933 - DNA, 18 bp, Homo sapiens
cagccagtttagagaaat

SEQ ID NO: 6701934 - DNA, 22 bp, Homo sapiens
cagccagttttcacaatgccta

SEQ ID NO: 6701935 - DNA, 17 bp, Homo sapiens
cagccataaaagcattg

SEQ ID NO: 6701936 - DNA, 13 bp, Homo sapiens
cagccataataat

SEQ ID NO: 6701937 - DNA, 23 bp, Homo sapiens
cagccatacttatctctctgtgc

SEQ ID NO: 6701938 - DNA, 21 bp, Homo sapiens
cagccatagacctacagacct

SEQ ID NO: 6701939 - DNA, 22 bp, Homo sapiens
cagccatagcttgattgctcag

SEQ ID NO: 6701940 - DNA, 16 bp, Homo sapiens
cagccataggtgcagt

SEQ ID NO: 6701941 - DNA, 14 bp, Homo sapiens
cagccatcaactaa

SEQ ID NO: 6701942 - DNA, 21 bp, Homo sapiens
cagccatcaagagactgagtc

SEQ ID NO: 6701943 - DNA, 15 bp, Homo sapiens
cagccatcagccatg

SEQ ID NO: 6701944 - DNA, 20 bp, Homo sapiens
cagccatcatgtgcctggaa

SEQ ID NO: 6701945 - DNA, 17 bp, Homo sapiens
cagccatcccaaggctc

SEQ ID NO: 6701946 - DNA, 19 bp, Homo sapiens
cagccatcccgcttagcct

SEQ ID NO: 6701947 - DNA, 20 bp, Homo sapiens
cagccatcccgcttagcctg

SEQ ID NO: 6701948 - DNA, 21 bp, Homo sapiens
cagccatcccgcttagcctgc

SEQ ID NO: 6701949 - DNA, 23 bp, Homo sapiens
cagccatcccgcttagcctgcct

SEQ ID NO: 6701950 - DNA, 15 bp, Homo sapiens
cagccatccgcagac

SEQ ID NO: 6701951 - DNA, 23 bp, Homo sapiens
cagccatcctccctccacctcaa

SEQ ID NO: 6701952 - DNA, 22 bp, Homo sapiens
cagccatcggaagagagggctg

SEQ ID NO: 6701953 - DNA, 23 bp, Homo sapiens
cagccatcggaagagagggctga

SEQ ID NO: 6701954 - DNA, 20 bp, Homo sapiens
cagccatcgtcctgggactc

SEQ ID NO: 6701955 - DNA, 23 bp, Homo sapiens
cagccatctcatgaggggagagg

SEQ ID NO: 6701956 - DNA, 21 bp, Homo sapiens
cagccatgcccgcattagctc

SEQ ID NO: 6701957 - DNA, 12 bp, Homo sapiens
cagccatggctg

SEQ ID NO: 6701958 - DNA, 13 bp, Homo sapiens
cagccatggctgg

SEQ ID NO: 6701959 - DNA, 14 bp, Homo sapiens
cagccatggctgga

SEQ ID NO: 6701960 - DNA, 22 bp, Homo sapiens
cagccatggctggatgtgcatc

SEQ ID NO: 6701961 - DNA, 23 bp, Homo sapiens
cagccatggctggatgtgcatct

SEQ ID NO: 6701962 - DNA, 21 bp, Homo sapiens
cagccatgggaacctcatatg

SEQ ID NO: 6701963 - DNA, 15 bp, Homo sapiens
cagccatgggccctc

SEQ ID NO: 6701964 - DNA, 21 bp, Homo sapiens
cagccatggggtccatcccct

SEQ ID NO: 6701965 - DNA, 16 bp, Homo sapiens
cagccatgtccaagtt

SEQ ID NO: 6701966 - DNA, 13 bp, Homo sapiens
cagccatgtgctg

SEQ ID NO: 6701967 - DNA, 21 bp, Homo sapiens
cagccatgtgctgcgtgcctg

SEQ ID NO: 6701968 - DNA, 14 bp, Homo sapiens
cagccatgtttggt

SEQ ID NO: 6701969 - DNA, 13 bp, Homo sapiens
cagccattaaaat

SEQ ID NO: 6701970 - DNA, 17 bp, Homo sapiens
cagccattaaaataaaa

SEQ ID NO: 6701971 - DNA, 18 bp, Homo sapiens
cagccattaaaataaaac

SEQ ID NO: 6701972 - DNA, 16 bp, Homo sapiens
cagccattaccatgga

SEQ ID NO: 6701973 - DNA, 17 bp, Homo sapiens
cagccattcatctgggc

SEQ ID NO: 6701974 - DNA, 18 bp, Homo sapiens
cagccattcatctgggct

SEQ ID NO: 6701975 - DNA, 21 bp, Homo sapiens
cagccattcatctgggctggc

SEQ ID NO: 6701976 - DNA, 22 bp, Homo sapiens
cagccattcatctgggctggca

SEQ ID NO: 6701977 - DNA, 23 bp, Homo sapiens
cagccattcatctgggctggcag

SEQ ID NO: 6701978 - DNA, 22 bp, Homo sapiens
cagccattcttcaggtcgtagc

SEQ ID NO: 6701979 - DNA, 15 bp, Homo sapiens
cagccattgcaccca

SEQ ID NO: 6701980 - DNA, 21 bp, Homo sapiens
cagccattgcggccccaggag

SEQ ID NO: 6701981 - DNA, 19 bp, Homo sapiens
cagccattggcctctgtct

SEQ ID NO: 6701982 - DNA, 19 bp, Homo sapiens
cagccattggctatttaaa

SEQ ID NO: 6701983 - DNA, 22 bp, Homo sapiens
cagccattggctatttaaaact

SEQ ID NO: 6701984 - DNA, 15 bp, Homo sapiens
cagccatttccccct

SEQ ID NO: 6701985 - DNA, 16 bp, Homo sapiens
cagccatttccccctc

SEQ ID NO: 6701986 - DNA, 17 bp, Homo sapiens
cagccatttccccctcc

SEQ ID NO: 6701987 - DNA, 17 bp, Homo sapiens
cagccatttctccatgg

SEQ ID NO: 6701988 - DNA, 16 bp, Homo sapiens
cagccatttgtaatga

SEQ ID NO: 6701989 - DNA, 21 bp, Homo sapiens
cagccattttacatagcacat

SEQ ID NO: 6701990 - DNA, 12 bp, Homo sapiens
cagccattttcc

SEQ ID NO: 6701991 - DNA, 14 bp, Homo sapiens
cagccatttttaat

SEQ ID NO: 6701992 - DNA, 15 bp, Homo sapiens
cagccatttttcaat

SEQ ID NO: 6701993 - DNA, 19 bp, Homo sapiens
cagcccaaaccaccagaag

SEQ ID NO: 6701994 - DNA, 20 bp, Homo sapiens
cagcccaaaccaccagaagc

SEQ ID NO: 6701995 - DNA, 23 bp, Homo sapiens
cagcccaaaccaccagaagccca

SEQ ID NO: 6701996 - DNA, 18 bp, Homo sapiens
cagcccaaacctgggaag

SEQ ID NO: 6701997 - DNA, 16 bp, Homo sapiens
cagcccaaagctgcag

SEQ ID NO: 6701998 - DNA, 19 bp, Homo sapiens
cagcccaaagctggagcca

SEQ ID NO: 6701999 - DNA, 23 bp, Homo sapiens
cagcccaaaggggacaggcctca

SEQ ID NO: 6702000 - DNA, 13 bp, Homo sapiens
cagcccaaccggg

SEQ ID NO: 6702001 - DNA, 16 bp, Homo sapiens
cagcccaacttccaga

SEQ ID NO: 6702002 - DNA, 16 bp, Homo sapiens
cagcccaacttcttac

SEQ ID NO: 6702003 - DNA, 19 bp, Homo sapiens
cagcccaacttcttacccg

SEQ ID NO: 6702004 - DNA, 15 bp, Homo sapiens
cagcccaagattctt

SEQ ID NO: 6702005 - DNA, 22 bp, Homo sapiens
cagcccaaggacagttcagaga

SEQ ID NO: 6702006 - DNA, 10 bp, Homo sapiens
cagcccaagt

SEQ ID NO: 6702007 - DNA, 16 bp, Homo sapiens
cagcccaataaaggtc

SEQ ID NO: 6702008 - DNA, 22 bp, Homo sapiens
cagcccaatccaggtacgcaca

SEQ ID NO: 6702009 - DNA, 23 bp, Homo sapiens
cagcccaatccaggtacgcacag

SEQ ID NO: 6702010 - DNA, 16 bp, Homo sapiens
cagcccacacccctcc

SEQ ID NO: 6702011 - DNA, 20 bp, Homo sapiens
cagcccacacccctccaaag

SEQ ID NO: 6702012 - DNA, 15 bp, Homo sapiens
cagcccacagagcct

SEQ ID NO: 6702013 - DNA, 15 bp, Homo sapiens
cagcccacagaggac

SEQ ID NO: 6702014 - DNA, 18 bp, Homo sapiens
cagcccacagtgctcagt

SEQ ID NO: 6702015 - DNA, 24 bp, Homo sapiens
cagcccacagtgctcagttgtact

SEQ ID NO: 6702016 - DNA, 19 bp, Homo sapiens
cagcccacatagtgatggt

SEQ ID NO: 6702017 - DNA, 13 bp, Homo sapiens
cagcccaccaccc

SEQ ID NO: 6702018 - DNA, 14 bp, Homo sapiens
cagcccaccaccct

SEQ ID NO: 6702019 - DNA, 12 bp, Homo sapiens
cagcccaccagg

SEQ ID NO: 6702020 - DNA, 14 bp, Homo sapiens
cagcccaccaggag

SEQ ID NO: 6702021 - DNA, 10 bp, Homo sapiens
cagcccaccc

SEQ ID NO: 6702022 - DNA, 16 bp, Homo sapiens
cagcccacccagcaga

SEQ ID NO: 6702023 - DNA, 12 bp, Homo sapiens
cagcccaccccc

SEQ ID NO: 6702024 - DNA, 19 bp, Homo sapiens
cagcccacccccctcattt

SEQ ID NO: 6702025 - DNA, 15 bp, Homo sapiens
cagcccacccctcaa

SEQ ID NO: 6702026 - DNA, 16 bp, Homo sapiens
cagcccaccctcctgt

SEQ ID NO: 6702027 - DNA, 24 bp, Homo sapiens
cagcccaccctcctgtcttcccag

SEQ ID NO: 6702028 - DNA, 12 bp, Homo sapiens
cagcccaccctg

SEQ ID NO: 6702029 - DNA, 19 bp, Homo sapiens
cagcccaccctgctcctcc

SEQ ID NO: 6702030 - DNA, 21 bp, Homo sapiens
cagcccacctcaacccagagg

SEQ ID NO: 6702031 - DNA, 17 bp, Homo sapiens
cagcccacctgcaccca

SEQ ID NO: 6702032 - DNA, 16 bp, Homo sapiens
cagcccacctgctgcc

SEQ ID NO: 6702033 - DNA, 16 bp, Homo sapiens
cagcccacctggcttt

SEQ ID NO: 6702034 - DNA, 13 bp, Homo sapiens
cagcccacgctga

SEQ ID NO: 6702035 - DNA, 15 bp, Homo sapiens
cagcccacgctgact

SEQ ID NO: 6702036 - DNA, 16 bp, Homo sapiens
cagcccacgtcctgtc

SEQ ID NO: 6702037 - DNA, 16 bp, Homo sapiens
cagcccactgagaagt

SEQ ID NO: 6702038 - DNA, 19 bp, Homo sapiens
cagcccactgcaccgcctc

SEQ ID NO: 6702039 - DNA, 18 bp, Homo sapiens
cagcccactgggccctgg

SEQ ID NO: 6702040 - DNA, 19 bp, Homo sapiens
cagcccactgggccctggg

SEQ ID NO: 6702041 - DNA, 17 bp, Homo sapiens
cagcccagaaccacaga

SEQ ID NO: 6702042 - DNA, 17 bp, Homo sapiens
cagcccagaacgggcct

SEQ ID NO: 6702043 - DNA, 19 bp, Homo sapiens
cagcccagaagaaaattct

SEQ ID NO: 6702044 - DNA, 17 bp, Homo sapiens
cagcccagacagcaagg

SEQ ID NO: 6702045 - DNA, 19 bp, Homo sapiens
cagcccagacccccagtgt

SEQ ID NO: 6702046 - DNA, 12 bp, Homo sapiens
cagcccagagac

SEQ ID NO: 6702047 - DNA, 13 bp, Homo sapiens
cagcccagagaca

SEQ ID NO: 6702048 - DNA, 13 bp, Homo sapiens
cagcccagagact

SEQ ID NO: 6702049 - DNA, 17 bp, Homo sapiens
cagcccagagactttgt

SEQ ID NO: 6702050 - DNA, 23 bp, Homo sapiens
cagcccagagagaccctgccaac

SEQ ID NO: 6702051 - DNA, 11 bp, Homo sapiens
cagcccagagc

SEQ ID NO: 6702052 - DNA, 12 bp, Homo sapiens
cagcccagagcc

SEQ ID NO: 6702053 - DNA, 18 bp, Homo sapiens
cagcccagagcctggctg

SEQ ID NO: 6702054 - DNA, 22 bp, Homo sapiens
cagcccagaggccgagagctat

SEQ ID NO: 6702055 - DNA, 13 bp, Homo sapiens
cagcccagatggc

SEQ ID NO: 6702056 - DNA, 17 bp, Homo sapiens
cagcccagatggctccc

SEQ ID NO: 6702057 - DNA, 16 bp, Homo sapiens
cagcccagcacaggta

SEQ ID NO: 6702058 - DNA, 12 bp, Homo sapiens
cagcccagcacc

SEQ ID NO: 6702059 - DNA, 18 bp, Homo sapiens
cagcccagcaccccttcc

SEQ ID NO: 6702060 - DNA, 17 bp, Homo sapiens
cagcccagcagtgtgga

SEQ ID NO: 6702061 - DNA, 12 bp, Homo sapiens
cagcccagccag

SEQ ID NO: 6702062 - DNA, 13 bp, Homo sapiens
cagcccagccagc

SEQ ID NO: 6702063 - DNA, 15 bp, Homo sapiens
cagcccagccaggcc

SEQ ID NO: 6702064 - DNA, 13 bp, Homo sapiens
cagcccagcccag

SEQ ID NO: 6702065 - DNA, 14 bp, Homo sapiens
cagcccagcccagc

SEQ ID NO: 6702066 - DNA, 16 bp, Homo sapiens
cagcccagccccactc

SEQ ID NO: 6702067 - DNA, 12 bp, Homo sapiens
cagcccagctcc

SEQ ID NO: 6702068 - DNA, 14 bp, Homo sapiens
cagcccagctccac

SEQ ID NO: 6702069 - DNA, 23 bp, Homo sapiens
cagcccagctccactcagggctg

SEQ ID NO: 6702070 - DNA, 24 bp, Homo sapiens
cagcccagctccactcagggctgg

SEQ ID NO: 6702071 - DNA, 19 bp, Homo sapiens
cagcccagctcctgaataa

SEQ ID NO: 6702072 - DNA, 13 bp, Homo sapiens
cagcccagctgct

SEQ ID NO: 6702073 - DNA, 16 bp, Homo sapiens
cagcccagctgctctg

SEQ ID NO: 6702074 - DNA, 17 bp, Homo sapiens
cagcccagctgctctgc

SEQ ID NO: 6702075 - DNA, 18 bp, Homo sapiens
cagcccagctgctctgcc

SEQ ID NO: 6702076 - DNA, 20 bp, Homo sapiens
cagcccagctgctctgccca

SEQ ID NO: 6702077 - DNA, 23 bp, Homo sapiens
cagcccagctgctctgcccagag

SEQ ID NO: 6702078 - DNA, 13 bp, Homo sapiens
cagcccagctggc

SEQ ID NO: 6702079 - DNA, 20 bp, Homo sapiens
cagcccaggaagtctcatct

SEQ ID NO: 6702080 - DNA, 20 bp, Homo sapiens
cagcccaggcatctccttgg

SEQ ID NO: 6702081 - DNA, 23 bp, Homo sapiens
cagcccaggccggggtggagcat

SEQ ID NO: 6702082 - DNA, 17 bp, Homo sapiens
cagcccaggcctccagc

SEQ ID NO: 6702083 - DNA, 14 bp, Homo sapiens
cagcccaggcctgg

SEQ ID NO: 6702084 - DNA, 14 bp, Homo sapiens
cagcccagggcctg

SEQ ID NO: 6702085 - DNA, 15 bp, Homo sapiens
cagcccagggcctgc

SEQ ID NO: 6702086 - DNA, 16 bp, Homo sapiens
cagcccagggcctgca

SEQ ID NO: 6702087 - DNA, 16 bp, Homo sapiens
cagcccagggctcctg

SEQ ID NO: 6702088 - DNA, 18 bp, Homo sapiens
cagcccagggctcctgca

SEQ ID NO: 6702089 - DNA, 21 bp, Homo sapiens
cagcccagggctcctgcactt

SEQ ID NO: 6702090 - DNA, 17 bp, Homo sapiens
cagcccagggttccccc

SEQ ID NO: 6702091 - DNA, 17 bp, Homo sapiens
cagcccaggtcccagtg

SEQ ID NO: 6702092 - DNA, 12 bp, Homo sapiens
cagcccatccat

SEQ ID NO: 6702093 - DNA, 22 bp, Homo sapiens
cagcccatccattaggccagca

SEQ ID NO: 6702094 - DNA, 19 bp, Homo sapiens
cagcccatcccctgcctct

SEQ ID NO: 6702095 - DNA, 17 bp, Homo sapiens
cagcccatcttgcctcc

SEQ ID NO: 6702096 - DNA, 21 bp, Homo sapiens
cagcccatggaggcagatgcc

SEQ ID NO: 6702097 - DNA, 15 bp, Homo sapiens
cagcccatggccccc

SEQ ID NO: 6702098 - DNA, 16 bp, Homo sapiens
cagcccatggccccca

SEQ ID NO: 6702099 - DNA, 17 bp, Homo sapiens
cagcccatggcccccaa

SEQ ID NO: 6702100 - DNA, 21 bp, Homo sapiens
cagcccatggcccccaataaa

SEQ ID NO: 6702101 - DNA, 16 bp, Homo sapiens
cagcccatggccctgt

SEQ ID NO: 6702102 - DNA, 20 bp, Homo sapiens
cagcccattctctctcctgt

SEQ ID NO: 6702103 - DNA, 22 bp, Homo sapiens
cagcccattctctctcctgtcc

SEQ ID NO: 6702104 - DNA, 15 bp, Homo sapiens
cagcccattgctgcc

SEQ ID NO: 6702105 - DNA, 16 bp, Homo sapiens
cagcccattgctgcca

SEQ ID NO: 6702106 - DNA, 15 bp, Homo sapiens
cagcccattggccga

SEQ ID NO: 6702107 - DNA, 24 bp, Homo sapiens
cagcccattggccgagctcctggg

SEQ ID NO: 6702108 - DNA, 20 bp, Homo sapiens
cagcccattggctcccatct

SEQ ID NO: 6702109 - DNA, 17 bp, Homo sapiens
cagcccatttctccaga

SEQ ID NO: 6702110 - DNA, 18 bp, Homo sapiens
cagcccatttctccagaa

SEQ ID NO: 6702111 - DNA, 22 bp, Homo sapiens
cagcccatttgggcagagaggc

SEQ ID NO: 6702112 - DNA, 18 bp, Homo sapiens
cagcccatttgggctctg

SEQ ID NO: 6702113 - DNA, 20 bp, Homo sapiens
cagccccaaaactctcctct

SEQ ID NO: 6702114 - DNA, 21 bp, Homo sapiens
cagccccaaaactctcctctg

SEQ ID NO: 6702115 - DNA, 22 bp, Homo sapiens
cagccccaaattgtcacctgct

SEQ ID NO: 6702116 - DNA, 23 bp, Homo sapiens
cagccccaactccaggggcacct

SEQ ID NO: 6702117 - DNA, 13 bp, Homo sapiens
cagccccaagctg

SEQ ID NO: 6702118 - DNA, 15 bp, Homo sapiens
cagccccaagctggg

SEQ ID NO: 6702119 - DNA, 17 bp, Homo sapiens
cagccccaagctgggcc

SEQ ID NO: 6702120 - DNA, 20 bp, Homo sapiens
cagccccaagcttctgagtc

SEQ ID NO: 6702121 - DNA, 22 bp, Homo sapiens
cagccccaagggctggggcgga

SEQ ID NO: 6702122 - DNA, 14 bp, Homo sapiens
cagccccaaggggt

SEQ ID NO: 6702123 - DNA, 18 bp, Homo sapiens
cagccccaatccagagaa

SEQ ID NO: 6702124 - DNA, 15 bp, Homo sapiens
cagccccacaacttt

SEQ ID NO: 6702125 - DNA, 16 bp, Homo sapiens
cagccccacacagcta

SEQ ID NO: 6702126 - DNA, 14 bp, Homo sapiens
cagccccacaccag

SEQ ID NO: 6702127 - DNA, 23 bp, Homo sapiens
cagccccacaccagggccagcct

SEQ ID NO: 6702128 - DNA, 14 bp, Homo sapiens
cagccccacaccct

SEQ ID NO: 6702129 - DNA, 16 bp, Homo sapiens
cagccccacagcaccc

SEQ ID NO: 6702130 - DNA, 17 bp, Homo sapiens
cagccccacagcaccca

SEQ ID NO: 6702131 - DNA, 15 bp, Homo sapiens
cagccccacagccca

SEQ ID NO: 6702132 - DNA, 18 bp, Homo sapiens
cagccccacagcccacgt

SEQ ID NO: 6702133 - DNA, 15 bp, Homo sapiens
cagccccacaggact

SEQ ID NO: 6702134 - DNA, 22 bp, Homo sapiens
cagccccaccccagggcagcca

SEQ ID NO: 6702135 - DNA, 23 bp, Homo sapiens
cagccccaccccagggcagccag

SEQ ID NO: 6702136 - DNA, 15 bp, Homo sapiens
cagccccacccccag

SEQ ID NO: 6702137 - DNA, 17 bp, Homo sapiens
cagccccacccccagcc

SEQ ID NO: 6702138 - DNA, 19 bp, Homo sapiens
cagccccacccccagccag

SEQ ID NO: 6702139 - DNA, 21 bp, Homo sapiens
cagccccacccccagccaggc

SEQ ID NO: 6702140 - DNA, 22 bp, Homo sapiens
cagccccacccctaagtgccca

SEQ ID NO: 6702141 - DNA, 17 bp, Homo sapiens
cagccccaccctggcct

SEQ ID NO: 6702142 - DNA, 17 bp, Homo sapiens
cagccccacccttgtcc

SEQ ID NO: 6702143 - DNA, 15 bp, Homo sapiens
cagccccactcctct

SEQ ID NO: 6702144 - DNA, 16 bp, Homo sapiens
cagccccactcctctg

SEQ ID NO: 6702145 - DNA, 18 bp, Homo sapiens
cagccccactgacaccca

SEQ ID NO: 6702146 - DNA, 15 bp, Homo sapiens
cagccccactgccag

SEQ ID NO: 6702147 - DNA, 16 bp, Homo sapiens
cagccccactgccagc

SEQ ID NO: 6702148 - DNA, 18 bp, Homo sapiens
cagccccactgccagcag

SEQ ID NO: 6702149 - DNA, 19 bp, Homo sapiens
cagccccactgccagcagc

SEQ ID NO: 6702150 - DNA, 15 bp, Homo sapiens
cagccccactgccct

SEQ ID NO: 6702151 - DNA, 22 bp, Homo sapiens
cagccccactgccctccagggc

SEQ ID NO: 6702152 - DNA, 13 bp, Homo sapiens
cagccccacttca

SEQ ID NO: 6702153 - DNA, 13 bp, Homo sapiens
cagccccacttct

SEQ ID NO: 6702154 - DNA, 18 bp, Homo sapiens
cagccccacttctgggtc

SEQ ID NO: 6702155 - DNA, 15 bp, Homo sapiens
cagccccagaagaaa

SEQ ID NO: 6702156 - DNA, 20 bp, Homo sapiens
cagccccagacaacagccca

SEQ ID NO: 6702157 - DNA, 17 bp, Homo sapiens
cagccccagacctgccg

SEQ ID NO: 6702158 - DNA, 15 bp, Homo sapiens
cagccccagagcagg

SEQ ID NO: 6702159 - DNA, 14 bp, Homo sapiens
cagccccagcacca

SEQ ID NO: 6702160 - DNA, 13 bp, Homo sapiens
cagccccagccca

SEQ ID NO: 6702161 - DNA, 16 bp, Homo sapiens
cagccccagcccagcc

SEQ ID NO: 6702162 - DNA, 12 bp, Homo sapiens
cagccccagcct

SEQ ID NO: 6702163 - DNA, 19 bp, Homo sapiens
cagccccagcctgctagct

SEQ ID NO: 6702164 - DNA, 12 bp, Homo sapiens
cagccccaggac

SEQ ID NO: 6702165 - DNA, 15 bp, Homo sapiens
cagccccaggagaag

SEQ ID NO: 6702166 - DNA, 15 bp, Homo sapiens
cagccccaggccagc

SEQ ID NO: 6702167 - DNA, 17 bp, Homo sapiens
cagccccaggccagctg

SEQ ID NO: 6702168 - DNA, 18 bp, Homo sapiens
cagccccaggccagctgc

SEQ ID NO: 6702169 - DNA, 19 bp, Homo sapiens
cagccccaggccagctgcg

SEQ ID NO: 6702170 - DNA, 18 bp, Homo sapiens
cagccccaggcctggcct

SEQ ID NO: 6702171 - DNA, 17 bp, Homo sapiens
cagccccagggccctgc

SEQ ID NO: 6702172 - DNA, 19 bp, Homo sapiens
cagccccagggccctgctc

SEQ ID NO: 6702173 - DNA, 20 bp, Homo sapiens
cagccccagggccctgctca

SEQ ID NO: 6702174 - DNA, 15 bp, Homo sapiens
cagccccaggggtgc

SEQ ID NO: 6702175 - DNA, 23 bp, Homo sapiens
cagccccagtcttccttgtctct

SEQ ID NO: 6702176 - DNA, 15 bp, Homo sapiens
cagccccagtgccca

SEQ ID NO: 6702177 - DNA, 21 bp, Homo sapiens
cagccccatcagaacctgagc

SEQ ID NO: 6702178 - DNA, 23 bp, Homo sapiens
cagccccatcagaacctgagcta

SEQ ID NO: 6702179 - DNA, 13 bp, Homo sapiens
cagccccatccct

SEQ ID NO: 6702180 - DNA, 20 bp, Homo sapiens
cagccccatccctgtcctca

SEQ ID NO: 6702181 - DNA, 13 bp, Homo sapiens
cagccccatcctc

SEQ ID NO: 6702182 - DNA, 17 bp, Homo sapiens
cagccccatccttcccg

SEQ ID NO: 6702183 - DNA, 13 bp, Homo sapiens
cagccccatctgt

SEQ ID NO: 6702184 - DNA, 17 bp, Homo sapiens
cagccccatctgtgcat

SEQ ID NO: 6702185 - DNA, 17 bp, Homo sapiens
cagccccatcttggtcc

SEQ ID NO: 6702186 - DNA, 16 bp, Homo sapiens
cagccccattctgcct

SEQ ID NO: 6702187 - DNA, 24 bp, Homo sapiens
cagccccattctgcctgcccaggc

SEQ ID NO: 6702188 - DNA, 17 bp, Homo sapiens
cagcccccaaagagctg

SEQ ID NO: 6702189 - DNA, 17 bp, Homo sapiens
cagcccccaaccccaag

SEQ ID NO: 6702190 - DNA, 16 bp, Homo sapiens
cagcccccacagccct

SEQ ID NO: 6702191 - DNA, 13 bp, Homo sapiens
cagcccccacagt

SEQ ID NO: 6702192 - DNA, 14 bp, Homo sapiens
cagcccccaccagg

SEQ ID NO: 6702193 - DNA, 17 bp, Homo sapiens
cagcccccaccagggga

SEQ ID NO: 6702194 - DNA, 16 bp, Homo sapiens
cagcccccacccatgc

SEQ ID NO: 6702195 - DNA, 17 bp, Homo sapiens
cagcccccacccatgcc

SEQ ID NO: 6702196 - DNA, 18 bp, Homo sapiens
cagcccccacccatgcca

SEQ ID NO: 6702197 - DNA, 20 bp, Homo sapiens
cagcccccacccatgccagc

SEQ ID NO: 6702198 - DNA, 22 bp, Homo sapiens
cagcccccacccatgccagcgc

SEQ ID NO: 6702199 - DNA, 18 bp, Homo sapiens
cagcccccaccccagcac

SEQ ID NO: 6702200 - DNA, 18 bp, Homo sapiens
cagcccccacccccaagg

SEQ ID NO: 6702201 - DNA, 16 bp, Homo sapiens
cagcccccacccccgt

SEQ ID NO: 6702202 - DNA, 18 bp, Homo sapiens
cagcccccacccccgtca

SEQ ID NO: 6702203 - DNA, 18 bp, Homo sapiens
cagcccccacctccgccc

SEQ ID NO: 6702204 - DNA, 18 bp, Homo sapiens
cagcccccactgacctgc

SEQ ID NO: 6702205 - DNA, 20 bp, Homo sapiens
cagcccccactgacctgccc

SEQ ID NO: 6702206 - DNA, 23 bp, Homo sapiens
cagcccccactgacctgcccatg

SEQ ID NO: 6702207 - DNA, 20 bp, Homo sapiens
cagcccccactgcacccctg

SEQ ID NO: 6702208 - DNA, 21 bp, Homo sapiens
cagcccccactgcctttgacc

SEQ ID NO: 6702209 - DNA, 15 bp, Homo sapiens
cagcccccactttcc

SEQ ID NO: 6702210 - DNA, 12 bp, Homo sapiens
cagcccccagcc

SEQ ID NO: 6702211 - DNA, 14 bp, Homo sapiens
cagcccccagcccc

SEQ ID NO: 6702212 - DNA, 17 bp, Homo sapiens
cagcccccagcccctcc

SEQ ID NO: 6702213 - DNA, 13 bp, Homo sapiens
cagcccccagcct

SEQ ID NO: 6702214 - DNA, 12 bp, Homo sapiens
cagcccccagga

SEQ ID NO: 6702215 - DNA, 18 bp, Homo sapiens
cagccccccaccccacag

SEQ ID NO: 6702216 - DNA, 22 bp, Homo sapiens
cagccccccacgcttctggagg

SEQ ID NO: 6702217 - DNA, 14 bp, Homo sapiens
cagccccccagcac

SEQ ID NO: 6702218 - DNA, 16 bp, Homo sapiens
cagccccccagcacta

SEQ ID NO: 6702219 - DNA, 23 bp, Homo sapiens
cagccccccaggctgcccagagc

SEQ ID NO: 6702220 - DNA, 14 bp, Homo sapiens
cagcccccccaccc

SEQ ID NO: 6702221 - DNA, 16 bp, Homo sapiens
cagcccccccacccac

SEQ ID NO: 6702222 - DNA, 21 bp, Homo sapiens
cagcccccccacccaccccca

SEQ ID NO: 6702223 - DNA, 17 bp, Homo sapiens
cagcccccccctcaagg

SEQ ID NO: 6702224 - DNA, 17 bp, Homo sapiens
cagcccccgccccagag

SEQ ID NO: 6702225 - DNA, 18 bp, Homo sapiens
cagcccccgcgccctccc

SEQ ID NO: 6702226 - DNA, 19 bp, Homo sapiens
cagcccccgcgccctccct

SEQ ID NO: 6702227 - DNA, 22 bp, Homo sapiens
cagcccccgcgccctccctccg

SEQ ID NO: 6702228 - DNA, 22 bp, Homo sapiens
cagcccccgggccgctggctgg

SEQ ID NO: 6702229 - DNA, 17 bp, Homo sapiens
cagccccctcccaccgc

SEQ ID NO: 6702230 - DNA, 18 bp, Homo sapiens
cagccccctcccaccgct

SEQ ID NO: 6702231 - DNA, 16 bp, Homo sapiens
cagccccctgaccact

SEQ ID NO: 6702232 - DNA, 20 bp, Homo sapiens
cagccccctgcttcagtccc

SEQ ID NO: 6702233 - DNA, 15 bp, Homo sapiens
cagccccctggatgg

SEQ ID NO: 6702234 - DNA, 13 bp, Homo sapiens
cagccccctgtgg

SEQ ID NO: 6702235 - DNA, 17 bp, Homo sapiens
cagcccccttgccctcc

SEQ ID NO: 6702236 - DNA, 20 bp, Homo sapiens
cagccccctttgggcccagg

SEQ ID NO: 6702237 - DNA, 17 bp, Homo sapiens
cagccccgagctgtccc

SEQ ID NO: 6702238 - DNA, 18 bp, Homo sapiens
cagccccgagttgtttcc

SEQ ID NO: 6702239 - DNA, 19 bp, Homo sapiens
cagccccgagttgtttcct

SEQ ID NO: 6702240 - DNA, 20 bp, Homo sapiens
cagccccgagttgtttcctc

SEQ ID NO: 6702241 - DNA, 18 bp, Homo sapiens
cagccccgccctctgcgt

SEQ ID NO: 6702242 - DNA, 21 bp, Homo sapiens
cagccccgccctctgcgtccc

SEQ ID NO: 6702243 - DNA, 16 bp, Homo sapiens
cagccccgcgaccacc

SEQ ID NO: 6702244 - DNA, 22 bp, Homo sapiens
cagccccgcgaccacccctgtg

SEQ ID NO: 6702245 - DNA, 18 bp, Homo sapiens
cagccccgcgcctccttc

SEQ ID NO: 6702246 - DNA, 24 bp, Homo sapiens
cagccccgcgtggaactcgtgtct

SEQ ID NO: 6702247 - DNA, 19 bp, Homo sapiens
cagccccgctcaggcctag

SEQ ID NO: 6702248 - DNA, 17 bp, Homo sapiens
cagccccgctcccacct

SEQ ID NO: 6702249 - DNA, 17 bp, Homo sapiens
cagccccggcaagccac

SEQ ID NO: 6702250 - DNA, 18 bp, Homo sapiens
cagccccggccacccagg

SEQ ID NO: 6702251 - DNA, 23 bp, Homo sapiens
cagccccggccactccctgccaa

SEQ ID NO: 6702252 - DNA, 22 bp, Homo sapiens
cagccccggcccccagcaggga

SEQ ID NO: 6702253 - DNA, 15 bp, Homo sapiens
cagccccggccctgg

SEQ ID NO: 6702254 - DNA, 19 bp, Homo sapiens
cagccccggccctgggctc

SEQ ID NO: 6702255 - DNA, 17 bp, Homo sapiens
cagccccgggagtggcg

SEQ ID NO: 6702256 - DNA, 16 bp, Homo sapiens
cagccccgggcctgcc

SEQ ID NO: 6702257 - DNA, 20 bp, Homo sapiens
cagccccgggcctgcctctg

SEQ ID NO: 6702258 - DNA, 15 bp, Homo sapiens
cagccccgtctgccc

SEQ ID NO: 6702259 - DNA, 19 bp, Homo sapiens
cagccccgtggggttcctc

SEQ ID NO: 6702260 - DNA, 19 bp, Homo sapiens
cagccccgtgtagccccgg

SEQ ID NO: 6702261 - DNA, 23 bp, Homo sapiens
cagccccgtgtagccccgggctg

SEQ ID NO: 6702262 - DNA, 12 bp, Homo sapiens
cagcccctaccc

SEQ ID NO: 6702263 - DNA, 17 bp, Homo sapiens
cagcccctacccctgcc

SEQ ID NO: 6702264 - DNA, 21 bp, Homo sapiens
cagcccctacccctgccctgc

SEQ ID NO: 6702265 - DNA, 22 bp, Homo sapiens
cagcccctacccctgccctgct

SEQ ID NO: 6702266 - DNA, 15 bp, Homo sapiens
cagcccctactgctg

SEQ ID NO: 6702267 - DNA, 17 bp, Homo sapiens
cagcccctactgctgtg

SEQ ID NO: 6702268 - DNA, 23 bp, Homo sapiens
cagcccctagcccaggagagaga

SEQ ID NO: 6702269 - DNA, 24 bp, Homo sapiens
cagcccctagcccaggagagagaa

SEQ ID NO: 6702270 - DNA, 13 bp, Homo sapiens
cagcccctaggag

SEQ ID NO: 6702271 - DNA, 22 bp, Homo sapiens
cagcccctatagcactgagctc

SEQ ID NO: 6702272 - DNA, 21 bp, Homo sapiens
cagcccctcaaagggagagaa

SEQ ID NO: 6702273 - DNA, 13 bp, Homo sapiens
cagcccctcccac

SEQ ID NO: 6702274 - DNA, 15 bp, Homo sapiens
cagcccctcccacca

SEQ ID NO: 6702275 - DNA, 16 bp, Homo sapiens
cagcccctcccagata

SEQ ID NO: 6702276 - DNA, 16 bp, Homo sapiens
cagcccctcccagcct

SEQ ID NO: 6702277 - DNA, 14 bp, Homo sapiens
cagcccctccccat

SEQ ID NO: 6702278 - DNA, 21 bp, Homo sapiens
cagcccctcccccatctccca

SEQ ID NO: 6702279 - DNA, 21 bp, Homo sapiens
cagcccctccccgcctcctcc

SEQ ID NO: 6702280 - DNA, 21 bp, Homo sapiens
cagcccctccctcctctgaga

SEQ ID NO: 6702281 - DNA, 14 bp, Homo sapiens
cagcccctcctccc

SEQ ID NO: 6702282 - DNA, 15 bp, Homo sapiens
cagcccctcctcccc

SEQ ID NO: 6702283 - DNA, 16 bp, Homo sapiens
cagcccctcctcccct

SEQ ID NO: 6702284 - DNA, 17 bp, Homo sapiens
cagcccctcctcccctt

SEQ ID NO: 6702285 - DNA, 20 bp, Homo sapiens
cagcccctcctccccttcct

SEQ ID NO: 6702286 - DNA, 15 bp, Homo sapiens
cagcccctcctccct

SEQ ID NO: 6702287 - DNA, 16 bp, Homo sapiens
cagcccctcctccctc

SEQ ID NO: 6702288 - DNA, 17 bp, Homo sapiens
cagcccctcctccctca

SEQ ID NO: 6702289 - DNA, 23 bp, Homo sapiens
cagcccctcctccctcaaaccaa

SEQ ID NO: 6702290 - DNA, 18 bp, Homo sapiens
cagcccctcctccctcag

SEQ ID NO: 6702291 - DNA, 20 bp, Homo sapiens
cagcccctcctccctcagac

SEQ ID NO: 6702292 - DNA, 22 bp, Homo sapiens
cagcccctcctccctcagaccc

SEQ ID NO: 6702293 - DNA, 17 bp, Homo sapiens
cagcccctcctctgcca

SEQ ID NO: 6702294 - DNA, 21 bp, Homo sapiens
cagcccctcctctgccacctc

SEQ ID NO: 6702295 - DNA, 23 bp, Homo sapiens
cagcccctcctctgccacctccc

SEQ ID NO: 6702296 - DNA, 16 bp, Homo sapiens
cagcccctcgaggcct

SEQ ID NO: 6702297 - DNA, 17 bp, Homo sapiens
cagcccctcgaggccta

SEQ ID NO: 6702298 - DNA, 18 bp, Homo sapiens
cagcccctcggctctgcc

SEQ ID NO: 6702299 - DNA, 17 bp, Homo sapiens
cagcccctcttcccttc

SEQ ID NO: 6702300 - DNA, 18 bp, Homo sapiens
cagcccctcttcccttcc

SEQ ID NO: 6702301 - DNA, 23 bp, Homo sapiens
cagcccctcttcccttcctccat

SEQ ID NO: 6702302 - DNA, 17 bp, Homo sapiens
cagcccctcttgccccc

SEQ ID NO: 6702303 - DNA, 18 bp, Homo sapiens
cagcccctcttggagaag

SEQ ID NO: 6702304 - DNA, 20 bp, Homo sapiens
cagcccctcttggagaagtc

SEQ ID NO: 6702305 - DNA, 12 bp, Homo sapiens
cagcccctgaga

SEQ ID NO: 6702306 - DNA, 17 bp, Homo sapiens
cagcccctgagagcctg

SEQ ID NO: 6702307 - DNA, 19 bp, Homo sapiens
cagcccctgagagcctgtg

SEQ ID NO: 6702308 - DNA, 19 bp, Homo sapiens
cagcccctgatcctgtgaa

SEQ ID NO: 6702309 - DNA, 15 bp, Homo sapiens
cagcccctgccccag

SEQ ID NO: 6702310 - DNA, 23 bp, Homo sapiens
cagcccctgcccctcatgccaac

SEQ ID NO: 6702311 - DNA, 13 bp, Homo sapiens
cagcccctgcctg

SEQ ID NO: 6702312 - DNA, 17 bp, Homo sapiens
cagcccctgcctgggtt

SEQ ID NO: 6702313 - DNA, 19 bp, Homo sapiens
cagcccctgcggccgtcac

SEQ ID NO: 6702314 - DNA, 13 bp, Homo sapiens
cagcccctgctgc

SEQ ID NO: 6702315 - DNA, 17 bp, Homo sapiens
cagcccctgctggctgg

SEQ ID NO: 6702316 - DNA, 19 bp, Homo sapiens
cagcccctgctgtgtgggt

SEQ ID NO: 6702317 - DNA, 17 bp, Homo sapiens
cagcccctggagctcct

SEQ ID NO: 6702318 - DNA, 19 bp, Homo sapiens
cagcccctggatgcagcct

SEQ ID NO: 6702319 - DNA, 23 bp, Homo sapiens
cagcccctgggaacaggccccac

SEQ ID NO: 6702320 - DNA, 14 bp, Homo sapiens
cagcccctgggccc

SEQ ID NO: 6702321 - DNA, 15 bp, Homo sapiens
cagcccctgggccct

SEQ ID NO: 6702322 - DNA, 18 bp, Homo sapiens
cagcccctgggcccttgt

SEQ ID NO: 6702323 - DNA, 13 bp, Homo sapiens
cagcccctggggc

SEQ ID NO: 6702324 - DNA, 13 bp, Homo sapiens
cagcccctggggt

SEQ ID NO: 6702325 - DNA, 20 bp, Homo sapiens
cagcccctgtttactggttc

SEQ ID NO: 6702326 - DNA, 21 bp, Homo sapiens
cagcccctgtttactggttct

SEQ ID NO: 6702327 - DNA, 18 bp, Homo sapiens
cagccccttagacagagg

SEQ ID NO: 6702328 - DNA, 16 bp, Homo sapiens
cagccccttcccctgg

SEQ ID NO: 6702329 - DNA, 14 bp, Homo sapiens
cagccccttcctgg

SEQ ID NO: 6702330 - DNA, 15 bp, Homo sapiens
cagccccttcctggg

SEQ ID NO: 6702331 - DNA, 17 bp, Homo sapiens
cagccccttctcccagc

SEQ ID NO: 6702332 - DNA, 17 bp, Homo sapiens
cagccccttctgaccca

SEQ ID NO: 6702333 - DNA, 19 bp, Homo sapiens
cagccccttctgacccatg

SEQ ID NO: 6702334 - DNA, 22 bp, Homo sapiens
cagccccttctgacccatgctg

SEQ ID NO: 6702335 - DNA, 24 bp, Homo sapiens
cagccccttctgacccatgctgcc

SEQ ID NO: 6702336 - DNA, 12 bp, Homo sapiens
cagccccttgct

SEQ ID NO: 6702337 - DNA, 16 bp, Homo sapiens
cagccccttgcttcta

SEQ ID NO: 6702338 - DNA, 20 bp, Homo sapiens
cagccccttgcttctaaggg

SEQ ID NO: 6702339 - DNA, 12 bp, Homo sapiens
cagcccctttcc

SEQ ID NO: 6702340 - DNA, 23 bp, Homo sapiens
cagcccctttccaaaatttttca

SEQ ID NO: 6702341 - DNA, 18 bp, Homo sapiens
cagcccctttgcctctgt

SEQ ID NO: 6702342 - DNA, 21 bp, Homo sapiens
cagcccctttgcctctgtcct

SEQ ID NO: 6702343 - DNA, 14 bp, Homo sapiens
cagccccttttctc

SEQ ID NO: 6702344 - DNA, 20 bp, Homo sapiens
cagccccttttctctgctct

SEQ ID NO: 6702345 - DNA, 21 bp, Homo sapiens
cagccccttttctctgctctt

SEQ ID NO: 6702346 - DNA, 13 bp, Homo sapiens
cagcccgaagccc

SEQ ID NO: 6702347 - DNA, 16 bp, Homo sapiens
cagcccgaatgcctgt

SEQ ID NO: 6702348 - DNA, 15 bp, Homo sapiens
cagcccgacagtgcc

SEQ ID NO: 6702349 - DNA, 18 bp, Homo sapiens
cagcccgacagtgccatc

SEQ ID NO: 6702350 - DNA, 20 bp, Homo sapiens
cagcccgatcctcccctgga

SEQ ID NO: 6702351 - DNA, 23 bp, Homo sapiens
cagcccgatcctcccctggactc

SEQ ID NO: 6702352 - DNA, 24 bp, Homo sapiens
cagcccgatcctcccctggactcc

SEQ ID NO: 6702353 - DNA, 17 bp, Homo sapiens
cagcccgcaactctcca

SEQ ID NO: 6702354 - DNA, 14 bp, Homo sapiens
cagcccgcagaggt

SEQ ID NO: 6702355 - DNA, 16 bp, Homo sapiens
cagcccgcagaggtgg

SEQ ID NO: 6702356 - DNA, 17 bp, Homo sapiens
cagcccgcagaggtggg

SEQ ID NO: 6702357 - DNA, 15 bp, Homo sapiens
cagcccgcagcacat

SEQ ID NO: 6702358 - DNA, 14 bp, Homo sapiens
cagcccgcatcagc

SEQ ID NO: 6702359 - DNA, 21 bp, Homo sapiens
cagcccgcatcagctgctcag

SEQ ID NO: 6702360 - DNA, 23 bp, Homo sapiens
cagcccgcatgcagcagcttgct

SEQ ID NO: 6702361 - DNA, 15 bp, Homo sapiens
cagcccgccagaggc

SEQ ID NO: 6702362 - DNA, 14 bp, Homo sapiens
cagcccgccgcccg

SEQ ID NO: 6702363 - DNA, 16 bp, Homo sapiens
cagcccgccgcccgcc

SEQ ID NO: 6702364 - DNA, 20 bp, Homo sapiens
cagcccgccgcccgcccctc

SEQ ID NO: 6702365 - DNA, 15 bp, Homo sapiens
cagcccgccgtcagg

SEQ ID NO: 6702366 - DNA, 13 bp, Homo sapiens
cagcccgcggcct

SEQ ID NO: 6702367 - DNA, 15 bp, Homo sapiens
cagcccgcggcctgg

SEQ ID NO: 6702368 - DNA, 16 bp, Homo sapiens
cagcccgctctctggc

SEQ ID NO: 6702369 - DNA, 14 bp, Homo sapiens
cagcccgctgagtg

SEQ ID NO: 6702370 - DNA, 13 bp, Homo sapiens
cagcccgcttggc

SEQ ID NO: 6702371 - DNA, 14 bp, Homo sapiens
cagcccgcttggcc

SEQ ID NO: 6702372 - DNA, 17 bp, Homo sapiens
cagcccggacctctgga

SEQ ID NO: 6702373 - DNA, 17 bp, Homo sapiens
cagcccggccgctccac

SEQ ID NO: 6702374 - DNA, 14 bp, Homo sapiens
cagcccggctgctg

SEQ ID NO: 6702375 - DNA, 22 bp, Homo sapiens
cagcccgggagatccgccctgg

SEQ ID NO: 6702376 - DNA, 23 bp, Homo sapiens
cagcccgggagatccgccctggg

SEQ ID NO: 6702377 - DNA, 14 bp, Homo sapiens
cagcccgggagcct

SEQ ID NO: 6702378 - DNA, 21 bp, Homo sapiens
cagcccgggagcctaggacca

SEQ ID NO: 6702379 - DNA, 14 bp, Homo sapiens
cagcccgggctctg

SEQ ID NO: 6702380 - DNA, 19 bp, Homo sapiens
cagcccgggctctgcctcc

SEQ ID NO: 6702381 - DNA, 22 bp, Homo sapiens
cagcccgggctctgcctcccat

SEQ ID NO: 6702382 - DNA, 19 bp, Homo sapiens
cagcccgtgaagcagtgcc

SEQ ID NO: 6702383 - DNA, 23 bp, Homo sapiens
cagcccgtgaagcagtgcctcga

SEQ ID NO: 6702384 - DNA, 15 bp, Homo sapiens
cagcccgtgtccagg

SEQ ID NO: 6702385 - DNA, 17 bp, Homo sapiens
cagcccgtttcagaagg

SEQ ID NO: 6702386 - DNA, 21 bp, Homo sapiens
cagccctaaatctagactcaa

SEQ ID NO: 6702387 - DNA, 17 bp, Homo sapiens
cagccctaaggatctct

SEQ ID NO: 6702388 - DNA, 20 bp, Homo sapiens
cagccctaaggatctctcag

SEQ ID NO: 6702389 - DNA, 19 bp, Homo sapiens
cagccctacatcttcagct

SEQ ID NO: 6702390 - DNA, 20 bp, Homo sapiens
cagccctacatcttcagctc

SEQ ID NO: 6702391 - DNA, 21 bp, Homo sapiens
cagccctagagcctgcctgga

SEQ ID NO: 6702392 - DNA, 22 bp, Homo sapiens
cagccctagagcctgcctggag

SEQ ID NO: 6702393 - DNA, 22 bp, Homo sapiens
cagccctagaggcgagccaggc

SEQ ID NO: 6702394 - DNA, 23 bp, Homo sapiens
cagccctagaggcgagccaggca

SEQ ID NO: 6702395 - DNA, 16 bp, Homo sapiens
cagccctagcggctgc

SEQ ID NO: 6702396 - DNA, 17 bp, Homo sapiens
cagccctagcggctgct

SEQ ID NO: 6702397 - DNA, 20 bp, Homo sapiens
cagccctagcggctgctcct

SEQ ID NO: 6702398 - DNA, 14 bp, Homo sapiens
cagccctagctgtc

SEQ ID NO: 6702399 - DNA, 11 bp, Homo sapiens
cagccctagga

SEQ ID NO: 6702400 - DNA, 15 bp, Homo sapiens
cagccctagtgggag

SEQ ID NO: 6702401 - DNA, 20 bp, Homo sapiens
cagccctagtgggagcccag

SEQ ID NO: 6702402 - DNA, 23 bp, Homo sapiens
cagccctagtgggagcccagcac

SEQ ID NO: 6702403 - DNA, 16 bp, Homo sapiens
cagccctcacacaccc

SEQ ID NO: 6702404 - DNA, 17 bp, Homo sapiens
cagccctcacacaccct

SEQ ID NO: 6702405 - DNA, 13 bp, Homo sapiens
cagccctcacccc

SEQ ID NO: 6702406 - DNA, 15 bp, Homo sapiens
cagccctcacccctg

SEQ ID NO: 6702407 - DNA, 18 bp, Homo sapiens
cagccctcacccctggtt

SEQ ID NO: 6702408 - DNA, 12 bp, Homo sapiens
cagccctcacta

SEQ ID NO: 6702409 - DNA, 21 bp, Homo sapiens
cagccctcactgtcagtccca

SEQ ID NO: 6702410 - DNA, 12 bp, Homo sapiens
cagccctcagca

SEQ ID NO: 6702411 - DNA, 22 bp, Homo sapiens
cagccctcagcattgtcagcct

SEQ ID NO: 6702412 - DNA, 13 bp, Homo sapiens
cagccctcagttc

SEQ ID NO: 6702413 - DNA, 18 bp, Homo sapiens
cagccctcagttccttca

SEQ ID NO: 6702414 - DNA, 13 bp, Homo sapiens
cagccctcagttt

SEQ ID NO: 6702415 - DNA, 14 bp, Homo sapiens
cagccctcatcccg

SEQ ID NO: 6702416 - DNA, 17 bp, Homo sapiens
cagccctccacttctgg

SEQ ID NO: 6702417 - DNA, 14 bp, Homo sapiens
cagccctccagagc

SEQ ID NO: 6702418 - DNA, 17 bp, Homo sapiens
cagccctccagagcagg

SEQ ID NO: 6702419 - DNA, 18 bp, Homo sapiens
cagccctccatggcctgg

SEQ ID NO: 6702420 - DNA, 15 bp, Homo sapiens
cagccctccatggtc

SEQ ID NO: 6702421 - DNA, 21 bp, Homo sapiens
cagccctccatggtcctgtct

SEQ ID NO: 6702422 - DNA, 20 bp, Homo sapiens
cagccctccccacctgctca

SEQ ID NO: 6702423 - DNA, 23 bp, Homo sapiens
cagccctccctggctgtgagcag

SEQ ID NO: 6702424 - DNA, 15 bp, Homo sapiens
cagccctccctgtcc

SEQ ID NO: 6702425 - DNA, 19 bp, Homo sapiens
cagccctccctgtcctcct

SEQ ID NO: 6702426 - DNA, 22 bp, Homo sapiens
cagccctccctgtcctcctcgg

SEQ ID NO: 6702427 - DNA, 17 bp, Homo sapiens
cagccctccgaccctca

SEQ ID NO: 6702428 - DNA, 13 bp, Homo sapiens
cagccctccgcca

SEQ ID NO: 6702429 - DNA, 14 bp, Homo sapiens
cagccctccgccag

SEQ ID NO: 6702430 - DNA, 18 bp, Homo sapiens
cagccctccgccagccct

SEQ ID NO: 6702431 - DNA, 12 bp, Homo sapiens
cagccctcctca

SEQ ID NO: 6702432 - DNA, 17 bp, Homo sapiens
cagccctcctctgcact

SEQ ID NO: 6702433 - DNA, 21 bp, Homo sapiens
cagccctccttaccactgtgg

SEQ ID NO: 6702434 - DNA, 14 bp, Homo sapiens
cagccctccttcag

SEQ ID NO: 6702435 - DNA, 19 bp, Homo sapiens
cagccctcgcctctgcgag

SEQ ID NO: 6702436 - DNA, 15 bp, Homo sapiens
cagccctcggcctcc

SEQ ID NO: 6702437 - DNA, 21 bp, Homo sapiens
cagccctcggcgctccgggac

SEQ ID NO: 6702438 - DNA, 15 bp, Homo sapiens
cagccctctcactgt

SEQ ID NO: 6702439 - DNA, 19 bp, Homo sapiens
cagccctctccacccagag

SEQ ID NO: 6702440 - DNA, 23 bp, Homo sapiens
cagccctctccacccagaggtct

SEQ ID NO: 6702441 - DNA, 17 bp, Homo sapiens
cagccctctctctcact

SEQ ID NO: 6702442 - DNA, 18 bp, Homo sapiens
cagccctctctctcactc

SEQ ID NO: 6702443 - DNA, 20 bp, Homo sapiens
cagccctctgtggccaggag

SEQ ID NO: 6702444 - DNA, 18 bp, Homo sapiens
cagccctcttctgacact

SEQ ID NO: 6702445 - DNA, 19 bp, Homo sapiens
cagccctcttgcccgcacc

SEQ ID NO: 6702446 - DNA, 11 bp, Homo sapiens
cagccctgaaa

SEQ ID NO: 6702447 - DNA, 20 bp, Homo sapiens
cagccctgaaacgagaagtg

SEQ ID NO: 6702448 - DNA, 16 bp, Homo sapiens
cagccctgaccctgtg

SEQ ID NO: 6702449 - DNA, 13 bp, Homo sapiens
cagccctgagcca

SEQ ID NO: 6702450 - DNA, 13 bp, Homo sapiens
cagccctgagcta

SEQ ID NO: 6702451 - DNA, 22 bp, Homo sapiens
cagccctgagctggcctcacct

SEQ ID NO: 6702452 - DNA, 12 bp, Homo sapiens
cagccctgaggg

SEQ ID NO: 6702453 - DNA, 13 bp, Homo sapiens
cagccctgagggg

SEQ ID NO: 6702454 - DNA, 21 bp, Homo sapiens
cagccctgaggggtggactag

SEQ ID NO: 6702455 - DNA, 22 bp, Homo sapiens
cagccctgaggggtggactagg

SEQ ID NO: 6702456 - DNA, 22 bp, Homo sapiens
cagccctgaggtgaaagggagc

SEQ ID NO: 6702457 - DNA, 20 bp, Homo sapiens
cagccctgagtggtcactgg

SEQ ID NO: 6702458 - DNA, 18 bp, Homo sapiens
cagccctgagttcctagc

SEQ ID NO: 6702459 - DNA, 19 bp, Homo sapiens
cagccctgagttcctagcc

SEQ ID NO: 6702460 - DNA, 12 bp, Homo sapiens
cagccctgcacg

SEQ ID NO: 6702461 - DNA, 13 bp, Homo sapiens
cagccctgcacga

SEQ ID NO: 6702462 - DNA, 13 bp, Homo sapiens
cagccctgcagag

SEQ ID NO: 6702463 - DNA, 15 bp, Homo sapiens
cagccctgcagaggg

SEQ ID NO: 6702464 - DNA, 13 bp, Homo sapiens
cagccctgcagcc

SEQ ID NO: 6702465 - DNA, 15 bp, Homo sapiens
cagccctgcagccca

SEQ ID NO: 6702466 - DNA, 13 bp, Homo sapiens
cagccctgcagta

SEQ ID NO: 6702467 - DNA, 23 bp, Homo sapiens
cagccctgcagtaatctccaggg

SEQ ID NO: 6702468 - DNA, 13 bp, Homo sapiens
cagccctgccagg

SEQ ID NO: 6702469 - DNA, 13 bp, Homo sapiens
cagccctgcccag

SEQ ID NO: 6702470 - DNA, 15 bp, Homo sapiens
cagccctgcccagag

SEQ ID NO: 6702471 - DNA, 20 bp, Homo sapiens
cagccctgccccacacctcc

SEQ ID NO: 6702472 - DNA, 21 bp, Homo sapiens
cagccctgccccacacctcct

SEQ ID NO: 6702473 - DNA, 12 bp, Homo sapiens
cagccctgccta

SEQ ID NO: 6702474 - DNA, 21 bp, Homo sapiens
cagccctgcctatcctctgta

SEQ ID NO: 6702475 - DNA, 15 bp, Homo sapiens
cagccctgcctgaga

SEQ ID NO: 6702476 - DNA, 14 bp, Homo sapiens
cagccctgcctgga

SEQ ID NO: 6702477 - DNA, 15 bp, Homo sapiens
cagccctgcctggag

SEQ ID NO: 6702478 - DNA, 16 bp, Homo sapiens
cagccctgcctggagg

SEQ ID NO: 6702479 - DNA, 13 bp, Homo sapiens
cagccctgctaga

SEQ ID NO: 6702480 - DNA, 18 bp, Homo sapiens
cagccctgctccctgcct

SEQ ID NO: 6702481 - DNA, 21 bp, Homo sapiens
cagccctgctccctgcctcct

SEQ ID NO: 6702482 - DNA, 11 bp, Homo sapiens
cagccctgctg

SEQ ID NO: 6702483 - DNA, 13 bp, Homo sapiens
cagccctgctgct

SEQ ID NO: 6702484 - DNA, 13 bp, Homo sapiens
cagccctgctggc

SEQ ID NO: 6702485 - DNA, 14 bp, Homo sapiens
cagccctgctggcc

SEQ ID NO: 6702486 - DNA, 18 bp, Homo sapiens
cagccctgctggccgcct

SEQ ID NO: 6702487 - DNA, 13 bp, Homo sapiens
cagccctgctttg

SEQ ID NO: 6702488 - DNA, 15 bp, Homo sapiens
cagccctggaggctg

SEQ ID NO: 6702489 - DNA, 16 bp, Homo sapiens
cagccctggaggctgg

SEQ ID NO: 6702490 - DNA, 17 bp, Homo sapiens
cagccctggaggtgcca

SEQ ID NO: 6702491 - DNA, 16 bp, Homo sapiens
cagccctggatggtgg

SEQ ID NO: 6702492 - DNA, 16 bp, Homo sapiens
cagccctggccaagct

SEQ ID NO: 6702493 - DNA, 23 bp, Homo sapiens
cagccctggcccccatcagccct

SEQ ID NO: 6702494 - DNA, 16 bp, Homo sapiens
cagccctggccctgcc

SEQ ID NO: 6702495 - DNA, 16 bp, Homo sapiens
cagccctggcctggct

SEQ ID NO: 6702496 - DNA, 18 bp, Homo sapiens
cagccctggcctggctgg

SEQ ID NO: 6702497 - DNA, 14 bp, Homo sapiens
cagccctggccttt

SEQ ID NO: 6702498 - DNA, 17 bp, Homo sapiens
cagccctggctgaagga

SEQ ID NO: 6702499 - DNA, 13 bp, Homo sapiens
cagccctgggcac

SEQ ID NO: 6702500 - DNA, 20 bp, Homo sapiens
cagccctgggccccaccacc

SEQ ID NO: 6702501 - DNA, 22 bp, Homo sapiens
cagccctgggccccaccaccta

SEQ ID NO: 6702502 - DNA, 23 bp, Homo sapiens
cagccctgggccccaccacctag

SEQ ID NO: 6702503 - DNA, 13 bp, Homo sapiens
cagccctgggcct

SEQ ID NO: 6702504 - DNA, 13 bp, Homo sapiens
cagccctgggctt

SEQ ID NO: 6702505 - DNA, 11 bp, Homo sapiens
cagccctgggg

SEQ ID NO: 6702506 - DNA, 17 bp, Homo sapiens
cagccctgggggccagc

SEQ ID NO: 6702507 - DNA, 12 bp, Homo sapiens
cagccctggtct

SEQ ID NO: 6702508 - DNA, 13 bp, Homo sapiens
cagccctggtctc

SEQ ID NO: 6702509 - DNA, 15 bp, Homo sapiens
cagccctggtctcag

SEQ ID NO: 6702510 - DNA, 19 bp, Homo sapiens
cagccctggtggccaagcc

SEQ ID NO: 6702511 - DNA, 18 bp, Homo sapiens
cagccctggttctggctg

SEQ ID NO: 6702512 - DNA, 17 bp, Homo sapiens
cagccctgtcagcatga

SEQ ID NO: 6702513 - DNA, 16 bp, Homo sapiens
cagccctgtcagtgca

SEQ ID NO: 6702514 - DNA, 16 bp, Homo sapiens
cagccctgtcctggtt

SEQ ID NO: 6702515 - DNA, 21 bp, Homo sapiens
cagccctgtctgaaggacact

SEQ ID NO: 6702516 - DNA, 16 bp, Homo sapiens
cagccctgtgtctgtc

SEQ ID NO: 6702517 - DNA, 23 bp, Homo sapiens
cagccctgtgtctgtcacaggct

SEQ ID NO: 6702518 - DNA, 24 bp, Homo sapiens
cagccctgtgtctgtcacaggctg

SEQ ID NO: 6702519 - DNA, 18 bp, Homo sapiens
cagccctgttccgcctca

SEQ ID NO: 6702520 - DNA, 21 bp, Homo sapiens
cagcccttagcacagagaggg

SEQ ID NO: 6702521 - DNA, 22 bp, Homo sapiens
cagcccttagcacagagaggga

SEQ ID NO: 6702522 - DNA, 23 bp, Homo sapiens
cagcccttatgcggttaattttg

SEQ ID NO: 6702523 - DNA, 21 bp, Homo sapiens
cagcccttcccaggccagcga

SEQ ID NO: 6702524 - DNA, 22 bp, Homo sapiens
cagcccttccctgctttgagga

SEQ ID NO: 6702525 - DNA, 18 bp, Homo sapiens
cagcccttcctcctgaag

SEQ ID NO: 6702526 - DNA, 22 bp, Homo sapiens
cagcccttcctcctgaagcctc

SEQ ID NO: 6702527 - DNA, 23 bp, Homo sapiens
cagcccttcctcctgaagcctct

SEQ ID NO: 6702528 - DNA, 17 bp, Homo sapiens
cagcccttcctctgctc

SEQ ID NO: 6702529 - DNA, 16 bp, Homo sapiens
cagcccttccttgggc

SEQ ID NO: 6702530 - DNA, 12 bp, Homo sapiens
cagcccttgccc

SEQ ID NO: 6702531 - DNA, 11 bp, Homo sapiens
cagcccttgct

SEQ ID NO: 6702532 - DNA, 14 bp, Homo sapiens
cagcccttgctcta

SEQ ID NO: 6702533 - DNA, 15 bp, Homo sapiens
cagcccttgcttgtt

SEQ ID NO: 6702534 - DNA, 15 bp, Homo sapiens
cagccctttggcttc

SEQ ID NO: 6702535 - DNA, 19 bp, Homo sapiens
cagccctttgggaggctga

SEQ ID NO: 6702536 - DNA, 23 bp, Homo sapiens
cagccctttgggaggctgaggcg

SEQ ID NO: 6702537 - DNA, 22 bp, Homo sapiens
cagccgaccctcctggccttcc

SEQ ID NO: 6702538 - DNA, 22 bp, Homo sapiens
cagccgactcagcaactttccc

SEQ ID NO: 6702539 - DNA, 20 bp, Homo sapiens
cagccgagatagccaaggcc

SEQ ID NO: 6702540 - DNA, 16 bp, Homo sapiens
cagccgagcaggaggc

SEQ ID NO: 6702541 - DNA, 14 bp, Homo sapiens
cagccgagcccagg

SEQ ID NO: 6702542 - DNA, 16 bp, Homo sapiens
cagccgagcccagggg

SEQ ID NO: 6702543 - DNA, 13 bp, Homo sapiens
cagccgagcccca

SEQ ID NO: 6702544 - DNA, 19 bp, Homo sapiens
cagccgagccccaggagcc

SEQ ID NO: 6702545 - DNA, 23 bp, Homo sapiens
cagccgagctcgtgtatcctggg

SEQ ID NO: 6702546 - DNA, 13 bp, Homo sapiens
cagccgaggcctg

SEQ ID NO: 6702547 - DNA, 22 bp, Homo sapiens
cagccgaggtccctgctgccag

SEQ ID NO: 6702548 - DNA, 21 bp, Homo sapiens
cagccgattcctccagccctg

SEQ ID NO: 6702549 - DNA, 18 bp, Homo sapiens
cagccgcagacaagtaat

SEQ ID NO: 6702550 - DNA, 12 bp, Homo sapiens
cagccgcagaga

SEQ ID NO: 6702551 - DNA, 13 bp, Homo sapiens
cagccgcagagaa

SEQ ID NO: 6702552 - DNA, 18 bp, Homo sapiens
cagccgcagagaaatgcc

SEQ ID NO: 6702553 - DNA, 19 bp, Homo sapiens
cagccgcagcctccctctg
